United States Patent 11,369,692 (MATERIALS AND METHODS FOR TREATMENT OF DUCHENNE MUSCULAR DYSTROPHY) - sequence listing, part 22

SEQ ID NO: 720020 - DNA, 22 bp, Artificial Sequence
  chemically synthesized
aggccccctcccttccccacac

SEQ ID NO: 720021 - DNA, 22 bp, Artificial Sequence
  chemically synthesized
ccttccccacacatcaagttcg

SEQ ID NO: 720022 - DNA, 22 bp, Artificial Sequence
  chemically synthesized
ccccacacatcaagttcgagga

SEQ ID NO: 720023 - DNA, 22 bp, Artificial Sequence
  chemically synthesized
ggcgggggcaaatcctcgaact

SEQ ID NO: 720024 - DNA, 22 bp, Artificial Sequence
  chemically synthesized
cccacacatcaagttcgaggat

SEQ ID NO: 720025 - DNA, 22 bp, Artificial Sequence
  chemically synthesized
ccagtcctgggcgggggcaaat

SEQ ID NO: 720026 - DNA, 22 bp, Artificial Sequence
  chemically synthesized
gccagtcctgggcgggggcaaa

SEQ ID NO: 720027 - DNA, 22 bp, Artificial Sequence
  chemically synthesized
gaggatttgcccccgcccagga

SEQ ID NO: 720028 - DNA, 22 bp, Artificial Sequence
  chemically synthesized
gtaaagccaatttgccagtcct

SEQ ID NO: 720029 - DNA, 22 bp, Artificial Sequence
  chemically synthesized
agtaaagccaatttgccagtcc

SEQ ID NO: 720030 - DNA, 22 bp, Artificial Sequence
  chemically synthesized
gcccccgcccaggactggcaaa

SEQ ID NO: 720031 - DNA, 22 bp, Artificial Sequence
  chemically synthesized
cccccgcccaggactggcaaat

SEQ ID NO: 720032 - DNA, 22 bp, Artificial Sequence
  chemically synthesized
ggggcatgtttagtaaagccaa

SEQ ID NO: 720033 - DNA, 22 bp, Artificial Sequence
  chemically synthesized
actcggggcatgtttagtaaag

SEQ ID NO: 720034 - DNA, 22 bp, Artificial Sequence
  chemically synthesized
gactcggggcatgtttagtaaa

SEQ ID NO: 720035 - DNA, 22 bp, Artificial Sequence
  chemically synthesized
gcaaattggctttactaaacat

SEQ ID NO: 720036 - DNA, 22 bp, Artificial Sequence
  chemically synthesized
ttgactcggggcatgtttagta

SEQ ID NO: 720037 - DNA, 22 bp, Artificial Sequence
  chemically synthesized
cttgactcggggcatgtttagt

SEQ ID NO: 720038 - DNA, 22 bp, Artificial Sequence
  chemically synthesized
gtttcttgactcggggcatgtt

SEQ ID NO: 720039 - DNA, 22 bp, Artificial Sequence
  chemically synthesized
agtttcttgactcggggcatgt

SEQ ID NO: 720040 - DNA, 22 bp, Artificial Sequence
  chemically synthesized
tagtttcttgactcggggcatg

SEQ ID NO: 720041 - DNA, 22 bp, Artificial Sequence
  chemically synthesized
gctttactaaacatgccccgag

SEQ ID NO: 720042 - DNA, 22 bp, Artificial Sequence
  chemically synthesized
tactaaacatgccccgagtcaa

SEQ ID NO: 720043 - DNA, 22 bp, Artificial Sequence
  chemically synthesized
actaaacatgccccgagtcaag

SEQ ID NO: 720044 - DNA, 22 bp, Artificial Sequence
  chemically synthesized
ctaaacatgccccgagtcaaga

SEQ ID NO: 720045 - DNA, 22 bp, Artificial Sequence
  chemically synthesized
aacatgccccgagtcaagaaac

SEQ ID NO: 720046 - DNA, 22 bp, Artificial Sequence
  chemically synthesized
gaccaagaggtattttagtttc

SEQ ID NO: 720047 - DNA, 22 bp, Artificial Sequence
  chemically synthesized
cctagaccaagaggtattttag

SEQ ID NO: 720048 - DNA, 22 bp, Artificial Sequence
  chemically synthesized
aaatacctcttggtctaggtag

SEQ ID NO: 720049 - DNA, 22 bp, Artificial Sequence
  chemically synthesized
tccagtgaaagtgtctacctag

SEQ ID NO: 720050 - DNA, 22 bp, Artificial Sequence
  chemically synthesized
cctatccagtgaaagtgtctac

SEQ ID NO: 720051 - DNA, 22 bp, Artificial Sequence
  chemically synthesized
tacctatccagtgaaagtgtct

SEQ ID NO: 720052 - DNA, 22 bp, Artificial Sequence
  chemically synthesized
ttggtctaggtagacactttca

SEQ ID NO: 720053 - DNA, 22 bp, Artificial Sequence
  chemically synthesized
ggtctaggtagacactttcact

SEQ ID NO: 720054 - DNA, 22 bp, Artificial Sequence
  chemically synthesized
gtctaggtagacactttcactg

SEQ ID NO: 720055 - DNA, 22 bp, Artificial Sequence
  chemically synthesized
ggtagacactttcactggatag

SEQ ID NO: 720056 - DNA, 22 bp, Artificial Sequence
  chemically synthesized
tgggaaaggcctctacctatcc

SEQ ID NO: 720057 - DNA, 22 bp, Artificial Sequence
  chemically synthesized
cctgtgggaaaggcctctacct

SEQ ID NO: 720058 - DNA, 22 bp, Artificial Sequence
  chemically synthesized
ccctgtgggaaaggcctctacc

SEQ ID NO: 720059 - DNA, 22 bp, Artificial Sequence
  chemically synthesized
tcactggataggtagaggcctt

SEQ ID NO: 720060 - DNA, 22 bp, Artificial Sequence
  chemically synthesized
cactggataggtagaggccttt

SEQ ID NO: 720061 - DNA, 22 bp, Artificial Sequence
  chemically synthesized
actggataggtagaggcctttc

SEQ ID NO: 720062 - DNA, 22 bp, Artificial Sequence
  chemically synthesized
tgtttccctgtgggaaaggcct

SEQ ID NO: 720063 - DNA, 22 bp, Artificial Sequence
  chemically synthesized
gataggtagaggcctttcccac

SEQ ID NO: 720064 - DNA, 22 bp, Artificial Sequence
  chemically synthesized
tcccacagggaaacataattcc

SEQ ID NO: 720065 - DNA, 22 bp, Artificial Sequence
  chemically synthesized
cccacagggaaacataattcct

SEQ ID NO: 720066 - DNA, 22 bp, Artificial Sequence
  chemically synthesized
ccacagggaaacataattcctc

SEQ ID NO: 720067 - DNA, 22 bp, Artificial Sequence
  chemically synthesized
ctcggtttggccttcccacctc

SEQ ID NO: 720068 - DNA, 22 bp, Artificial Sequence
  chemically synthesized
taggaccgtatagaggtgggaa

SEQ ID NO: 720069 - DNA, 22 bp, Artificial Sequence
  chemically synthesized
ggtttggccttcccacctctat

SEQ ID NO: 720070 - DNA, 22 bp, Artificial Sequence
  chemically synthesized
ttataggaccgtatagaggtgg

SEQ ID NO: 720071 - DNA, 22 bp, Artificial Sequence
  chemically synthesized
ggccttcccacctctatacggt

SEQ ID NO: 720072 - DNA, 22 bp, Artificial Sequence
  chemically synthesized
gccttcccacctctatacggtc

SEQ ID NO: 720073 - DNA, 22 bp, Artificial Sequence
  chemically synthesized
cccacctctatacggtcctata

SEQ ID NO: 720074 - DNA, 22 bp, Artificial Sequence
  chemically synthesized
ccacctctatacggtcctataa

SEQ ID NO: 720075 - DNA, 22 bp, Artificial Sequence
  chemically synthesized
ataaagtccagtctgttatagg

SEQ ID NO: 720076 - DNA, 22 bp, Artificial Sequence
  chemically synthesized
tatacggtcctataacagactg

SEQ ID NO: 720077 - DNA, 22 bp, Artificial Sequence
  chemically synthesized
actaataaagtccagtctgtta

SEQ ID NO: 720078 - DNA, 22 bp, Artificial Sequence
  chemically synthesized
gactaataaagtccagtctgtt

SEQ ID NO: 720079 - DNA, 22 bp, Artificial Sequence
  chemically synthesized
tacggtcctataacagactgga

SEQ ID NO: 720080 - DNA, 22 bp, Artificial Sequence
  chemically synthesized
ggtgatttgactaataaagtcc

SEQ ID NO: 720081 - DNA, 22 bp, Artificial Sequence
  chemically synthesized
gggtgatttgactaataaagtc

SEQ ID NO: 720082 - DNA, 22 bp, Artificial Sequence
  chemically synthesized
taacagactggactttattagt

SEQ ID NO: 720083 - DNA, 22 bp, Artificial Sequence
  chemically synthesized
cttgggtgatttgactaataaa

SEQ ID NO: 720084 - DNA, 22 bp, Artificial Sequence
  chemically synthesized
agaaactgcttgggtgatttga

SEQ ID NO: 720085 - DNA, 22 bp, Artificial Sequence
  chemically synthesized
gactttattagtcaaatcaccc

SEQ ID NO: 720086 - DNA, 22 bp, Artificial Sequence
  chemically synthesized
tattagtcaaatcacccaagca

SEQ ID NO: 720087 - DNA, 22 bp, Artificial Sequence
  chemically synthesized
attagtcaaatcacccaagcag

SEQ ID NO: 720088 - DNA, 22 bp, Artificial Sequence
  chemically synthesized
ttagtcaaatcacccaagcagt

SEQ ID NO: 720089 - DNA, 22 bp, Artificial Sequence
  chemically synthesized
agagcctgagaaactgcttggg

SEQ ID NO: 720090 - DNA, 22 bp, Artificial Sequence
  chemically synthesized
gtcaaatcacccaagcagtttc

SEQ ID NO: 720091 - DNA, 22 bp, Artificial Sequence
  chemically synthesized
aatactaagagcctgagaaact

SEQ ID NO: 720092 - DNA, 22 bp, Artificial Sequence
  chemically synthesized
actgaatactaagagcctgaga

SEQ ID NO: 720093 - DNA, 22 bp, Artificial Sequence
  chemically synthesized
gttcactgaatactaagagcct

SEQ ID NO: 720094 - DNA, 22 bp, Artificial Sequence
  chemically synthesized
ctcaggctcttagtattcagtg

SEQ ID NO: 720095 - DNA, 22 bp, Artificial Sequence
  chemically synthesized
tcaggctcttagtattcagtga

SEQ ID NO: 720096 - DNA, 22 bp, Artificial Sequence
  chemically synthesized
aaagaccattagttcactgaat

SEQ ID NO: 720097 - DNA, 22 bp, Artificial Sequence
  chemically synthesized
aggctcttagtattcagtgaac

SEQ ID NO: 720098 - DNA, 22 bp, Artificial Sequence
  chemically synthesized
aaaagaccattagttcactgaa

SEQ ID NO: 720099 - DNA, 22 bp, Artificial Sequence
  chemically synthesized
taaaagaccattagttcactga

SEQ ID NO: 720100 - DNA, 22 bp, Artificial Sequence
  chemically synthesized
ttaaaagaccattagttcactg

SEQ ID NO: 720101 - DNA, 22 bp, Artificial Sequence
  chemically synthesized
ttagtattcagtgaactaatgg

SEQ ID NO: 720102 - DNA, 22 bp, Artificial Sequence
  chemically synthesized
agtattcagtgaactaatggtc

SEQ ID NO: 720103 - DNA, 22 bp, Artificial Sequence
  chemically synthesized
gtattcagtgaactaatggtct

SEQ ID NO: 720104 - DNA, 22 bp, Artificial Sequence
  chemically synthesized
agtgaactaatggtcttttaaa

SEQ ID NO: 720105 - DNA, 22 bp, Artificial Sequence
  chemically synthesized
gtgaggtgtgtttttaaaagac

SEQ ID NO: 720106 - DNA, 22 bp, Artificial Sequence
  chemically synthesized
ggtgaggtgtgtttttaaaaga

SEQ ID NO: 720107 - DNA, 22 bp, Artificial Sequence
  chemically synthesized
agcttggtgaggtgtgttttta

SEQ ID NO: 720108 - DNA, 22 bp, Artificial Sequence
  chemically synthesized
atggtcttttaaaaacacacct

SEQ ID NO: 720109 - DNA, 22 bp, Artificial Sequence
  chemically synthesized
gtggctgagcttggtgaggtgt

SEQ ID NO: 720110 - DNA, 22 bp, Artificial Sequence
  chemically synthesized
ttaaaaacacacctcaccaagc

SEQ ID NO: 720111 - DNA, 22 bp, Artificial Sequence
  chemically synthesized
taaaaacacacctcaccaagct

SEQ ID NO: 720112 - DNA, 22 bp, Artificial Sequence
  chemically synthesized
agttggtggctgagcttggtga

SEQ ID NO: 720113 - DNA, 22 bp, Artificial Sequence
  chemically synthesized
aaaaacacacctcaccaagctc

SEQ ID NO: 720114 - DNA, 22 bp, Artificial Sequence
  chemically synthesized
aagttggtggctgagcttggtg

SEQ ID NO: 720115 - DNA, 22 bp, Artificial Sequence
  chemically synthesized
aaaacacacctcaccaagctca

SEQ ID NO: 720116 - DNA, 22 bp, Artificial Sequence
  chemically synthesized
taagttggtggctgagcttggt

SEQ ID NO: 720117 - DNA, 22 bp, Artificial Sequence
  chemically synthesized
ttaagttggtggctgagcttgg

SEQ ID NO: 720118 - DNA, 22 bp, Artificial Sequence
  chemically synthesized
tttaagttggtggctgagcttg

SEQ ID NO: 720119 - DNA, 22 bp, Artificial Sequence
  chemically synthesized
accaagctcagccaccaactta

SEQ ID NO: 720120 - DNA, 22 bp, Artificial Sequence
  chemically synthesized
tccagtcctttttaagttggtg

SEQ ID NO: 720121 - DNA, 22 bp, Artificial Sequence
  chemically synthesized
agccaccaacttaaaaaggact

SEQ ID NO: 720122 - DNA, 22 bp, Artificial Sequence
  chemically synthesized
aaaaaggactggacaatacttt

SEQ ID NO: 720123 - DNA, 22 bp, Artificial Sequence
  chemically synthesized
aaaaggactggacaatactttt

SEQ ID NO: 720124 - DNA, 22 bp, Artificial Sequence
  chemically synthesized
agaagggcaagtggtaaaagta

SEQ ID NO: 720125 - DNA, 22 bp, Artificial Sequence
  chemically synthesized
tgagaagggcaagtggtaaaag

SEQ ID NO: 720126 - DNA, 22 bp, Artificial Sequence
  chemically synthesized
gacaatacttttaccacttgcc

SEQ ID NO: 720127 - DNA, 22 bp, Artificial Sequence
  chemically synthesized
aattctgagaagggcaagtggt

SEQ ID NO: 720128 - DNA, 22 bp, Artificial Sequence
  chemically synthesized
ttaccacttgcccttctcagaa

SEQ ID NO: 720129 - DNA, 22 bp, Artificial Sequence
  chemically synthesized
taccacttgcccttctcagaat

SEQ ID NO: 720130 - DNA, 22 bp, Artificial Sequence
  chemically synthesized
accacttgcccttctcagaatt

SEQ ID NO: 720131 - DNA, 22 bp, Artificial Sequence
  chemically synthesized
aggacaggcctgaattctgaga

SEQ ID NO: 720132 - DNA, 22 bp, Artificial Sequence
  chemically synthesized
ccacttgcccttctcagaattc

SEQ ID NO: 720133 - DNA, 22 bp, Artificial Sequence
  chemically synthesized
tgaggacaggcctgaattctga

SEQ ID NO: 720134 - DNA, 22 bp, Artificial Sequence
  chemically synthesized
gcccttctcagaattcaggcct

SEQ ID NO: 720135 - DNA, 22 bp, Artificial Sequence
  chemically synthesized
cccttctcagaattcaggcctg

SEQ ID NO: 720136 - DNA, 22 bp, Artificial Sequence
  chemically synthesized
tagcattctgaggacaggcctg

SEQ ID NO: 720137 - DNA, 22 bp, Artificial Sequence
  chemically synthesized
gtagcattctgaggacaggcct

SEQ ID NO: 720138 - DNA, 22 bp, Artificial Sequence
  chemically synthesized
ctcagaattcaggcctgtcctc

SEQ ID NO: 720139 - DNA, 22 bp, Artificial Sequence
  chemically synthesized
tcagaattcaggcctgtcctca

SEQ ID NO: 720140 - DNA, 22 bp, Artificial Sequence
  chemically synthesized
agaattcaggcctgtcctcaga

SEQ ID NO: 720141 - DNA, 22 bp, Artificial Sequence
  chemically synthesized
taccttgtagcattctgaggac

SEQ ID NO: 720142 - DNA, 22 bp, Artificial Sequence
  chemically synthesized
aggcctgtcctcagaatgctac

SEQ ID NO: 720143 - DNA, 22 bp, Artificial Sequence
  chemically synthesized
aatgggctgtaccttgtagcat

SEQ ID NO: 720144 - DNA, 22 bp, Artificial Sequence
  chemically synthesized
aaatgggctgtaccttgtagca

SEQ ID NO: 720145 - DNA, 22 bp, Artificial Sequence
  chemically synthesized
tcctcagaatgctacaaggtac

SEQ ID NO: 720146 - DNA, 22 bp, Artificial Sequence
  chemically synthesized
agaatgctacaaggtacagccc

SEQ ID NO: 720147 - DNA, 22 bp, Artificial Sequence
  chemically synthesized
caaggtacagcccatttaagct

SEQ ID NO: 720148 - DNA, 22 bp, Artificial Sequence
  chemically synthesized
ataaaaaggagcgtccatacag

SEQ ID NO: 720149 - DNA, 22 bp, Artificial Sequence
  chemically synthesized
aagctcctgtatggacgctcct

SEQ ID NO: 720150 - DNA, 22 bp, Artificial Sequence
  chemically synthesized
agctcctgtatggacgctcctt

SEQ ID NO: 720151 - DNA, 22 bp, Artificial Sequence
  chemically synthesized
gggcctaataaaaaggagcgtc

SEQ ID NO: 720152 - DNA, 22 bp, Artificial Sequence
  chemically synthesized
ctgtatggacgctcctttttat

SEQ ID NO: 720153 - DNA, 22 bp, Artificial Sequence
  chemically synthesized
tatggacgctcctttttattag

SEQ ID NO: 720154 - DNA, 22 bp, Artificial Sequence
  chemically synthesized
gaatgagactggggcctaataa

SEQ ID NO: 720155 - DNA, 22 bp, Artificial Sequence
  chemically synthesized
gtgtctggaatgagactggggc

SEQ ID NO: 720156 - DNA, 22 bp, Artificial Sequence
  chemically synthesized
ctttttattaggccccagtctc

SEQ ID NO: 720157 - DNA, 22 bp, Artificial Sequence
  chemically synthesized
tttattaggccccagtctcatt

SEQ ID NO: 720158 - DNA, 22 bp, Artificial Sequence
  chemically synthesized
ttattaggccccagtctcattc

SEQ ID NO: 720159 - DNA, 22 bp, Artificial Sequence
  chemically synthesized
gtctggtgtctggaatgagact

SEQ ID NO: 720160 - DNA, 22 bp, Artificial Sequence
  chemically synthesized
tattaggccccagtctcattcc

SEQ ID NO: 720161 - DNA, 22 bp, Artificial Sequence
  chemically synthesized
attaggccccagtctcattcca

SEQ ID NO: 720162 - DNA, 22 bp, Artificial Sequence
  chemically synthesized
ttaggccccagtctcattccag

SEQ ID NO: 720163 - DNA, 22 bp, Artificial Sequence
  chemically synthesized
agttggtctggtgtctggaatg

SEQ ID NO: 720164 - DNA, 22 bp, Artificial Sequence
  chemically synthesized
ggccccagtctcattccagaca

SEQ ID NO: 720165 - DNA, 22 bp, Artificial Sequence
  chemically synthesized
gggtgcagtctaagttggtctg

SEQ ID NO: 720166 - DNA, 22 bp, Artificial Sequence
  chemically synthesized
attccagacaccagaccaactt

SEQ ID NO: 720167 - DNA, 22 bp, Artificial Sequence
  chemically synthesized
ggggtgcagtctaagttggtct

SEQ ID NO: 720168 - DNA, 22 bp, Artificial Sequence
  chemically synthesized
tggggtgcagtctaagttggtc

SEQ ID NO: 720169 - DNA, 22 bp, Artificial Sequence
  chemically synthesized
ttggggtgcagtctaagttggt

SEQ ID NO: 720170 - DNA, 22 bp, Artificial Sequence
  chemically synthesized
tttggggtgcagtctaagttgg

SEQ ID NO: 720171 - DNA, 22 bp, Artificial Sequence
  chemically synthesized
cagacaccagaccaacttagac

SEQ ID NO: 720172 - DNA, 22 bp, Artificial Sequence
  chemically synthesized
agactgcaccccaaaaaacttg

SEQ ID NO: 720173 - DNA, 22 bp, Artificial Sequence
  chemically synthesized
gactgcaccccaaaaaacttgt

SEQ ID NO: 720174 - DNA, 22 bp, Artificial Sequence
  chemically synthesized
caccccaaaaaacttgtcatcc

SEQ ID NO: 720175 - DNA, 22 bp, Artificial Sequence
  chemically synthesized
gacagaagataggagggatgac

SEQ ID NO: 720176 - DNA, 22 bp, Artificial Sequence
  chemically synthesized
gtcatccctcctatcttctgtc

SEQ ID NO: 720177 - DNA, 22 bp, Artificial Sequence
  chemically synthesized
tcatccctcctatcttctgtct

SEQ ID NO: 720178 - DNA, 22 bp, Artificial Sequence
  chemically synthesized
gtgaataggagtatgactagac

SEQ ID NO: 720179 - DNA, 22 bp, Artificial Sequence
  chemically synthesized
ctatcttctgtctagtcatact

SEQ ID NO: 720180 - DNA, 22 bp, Artificial Sequence
  chemically synthesized
tcttctgtctagtcatactcct

SEQ ID NO: 720181 - DNA, 22 bp, Artificial Sequence
  chemically synthesized
agactggtgaataggagtatga

SEQ ID NO: 720182 - DNA, 22 bp, Artificial Sequence
  chemically synthesized
ctgtctagtcatactcctattc

SEQ ID NO: 720183 - DNA, 22 bp, Artificial Sequence
  chemically synthesized
gttgagactggtgaataggagt

SEQ ID NO: 720184 - DNA, 22 bp, Artificial Sequence
  chemically synthesized
tgtctagtcatactcctattca

SEQ ID NO: 720185 - DNA, 22 bp, Artificial Sequence
  chemically synthesized
tctagtcatactcctattcacc

SEQ ID NO: 720186 - DNA, 22 bp, Artificial Sequence
  chemically synthesized
tgactagttgagactggtgaat

SEQ ID NO: 720187 - DNA, 22 bp, Artificial Sequence
  chemically synthesized
gtcatactcctattcaccagtc

SEQ ID NO: 720188 - DNA, 22 bp, Artificial Sequence
  chemically synthesized
atgactagttgagactggtgaa

SEQ ID NO: 720189 - DNA, 22 bp, Artificial Sequence
  chemically synthesized
ctattcaccagtctcaactagt

SEQ ID NO: 720190 - DNA, 22 bp, Artificial Sequence
  chemically synthesized
ttcaccagtctcaactagtcat

SEQ ID NO: 720191 - DNA, 22 bp, Artificial Sequence
  chemically synthesized
accagtctcaactagtcataaa

SEQ ID NO: 720192 - DNA, 22 bp, Artificial Sequence
  chemically synthesized
aactagtcataaatgccctgct

SEQ ID NO: 720193 - DNA, 22 bp, Artificial Sequence
  chemically synthesized
gtcataaatgccctgctcttgt

SEQ ID NO: 720194 - DNA, 22 bp, Artificial Sequence
  chemically synthesized
ctcttgtttacactgctggttt

SEQ ID NO: 720195 - DNA, 22 bp, Artificial Sequence
  chemically synthesized
gagaaacagtgtaaaccagcag

SEQ ID NO: 720196 - DNA, 22 bp, Artificial Sequence
  chemically synthesized
ggagaaacagtgtaaaccagca

SEQ ID NO: 720197 - DNA, 22 bp, Artificial Sequence
  chemically synthesized
ttgtttacactgctggtttaca

SEQ ID NO: 720198 - DNA, 22 bp, Artificial Sequence
  chemically synthesized
gtttacactgctggtttacact

SEQ ID NO: 720199 - DNA, 22 bp, Artificial Sequence
  chemically synthesized
tttacactgctggtttacactg

SEQ ID NO: 720200 - DNA, 22 bp, Artificial Sequence
  chemically synthesized
acactgctggtttacactgttt

SEQ ID NO: 720201 - DNA, 22 bp, Artificial Sequence
  chemically synthesized
cactgctggtttacactgtttc

SEQ ID NO: 720202 - DNA, 22 bp, Artificial Sequence
  chemically synthesized
tgatggcttggagaaacagtgt

SEQ ID NO: 720203 - DNA, 22 bp, Artificial Sequence
  chemically synthesized
ctggtttacactgtttctccaa

SEQ ID NO: 720204 - DNA, 22 bp, Artificial Sequence
  chemically synthesized
gtttacactgtttctccaagcc

SEQ ID NO: 720205 - DNA, 22 bp, Artificial Sequence
  chemically synthesized
acactgtttctccaagccatca

SEQ ID NO: 720206 - DNA, 22 bp, Artificial Sequence
  chemically synthesized
cactgtttctccaagccatcac

SEQ ID NO: 720207 - DNA, 22 bp, Artificial Sequence
  chemically synthesized
tttctccaagccatcacagctg

SEQ ID NO: 720208 - DNA, 22 bp, Artificial Sequence
  chemically synthesized
ctccaagccatcacagctgata

SEQ ID NO: 720209 - DNA, 22 bp, Artificial Sequence
  chemically synthesized
tccaagccatcacagctgatat

SEQ ID NO: 720210 - DNA, 22 bp, Artificial Sequence
  chemically synthesized
caagccatcacagctgatatct

SEQ ID NO: 720211 - DNA, 22 bp, Artificial Sequence
  chemically synthesized
gggatagcaccaagagatatca

SEQ ID NO: 720212 - DNA, 22 bp, Artificial Sequence
  chemically synthesized
ggggatagcaccaagagatatc

SEQ ID NO: 720213 - DNA, 22 bp, Artificial Sequence
  chemically synthesized
atatctcttggtgctatcccca

SEQ ID NO: 720214 - DNA, 22 bp, Artificial Sequence
  chemically synthesized
agagtggtggtttggggatagc

SEQ ID NO: 720215 - DNA, 22 bp, Artificial Sequence
  chemically synthesized
ttggtgctatccccaaaccacc

SEQ ID NO: 720216 - DNA, 22 bp, Artificial Sequence
  chemically synthesized
agagttaagagtggtggtttgg

SEQ ID NO: 720217 - DNA, 22 bp, Artificial Sequence
  chemically synthesized
aagagttaagagtggtggtttg

SEQ ID NO: 720218 - DNA, 22 bp, Artificial Sequence
  chemically synthesized
ggtgctatccccaaaccaccac

SEQ ID NO: 720219 - DNA, 22 bp, Artificial Sequence
  chemically synthesized
taagagttaagagtggtggttt

SEQ ID NO: 720220 - DNA, 22 bp, Artificial Sequence
  chemically synthesized
gtgctatccccaaaccaccact

SEQ ID NO: 720221 - DNA, 22 bp, Artificial Sequence
  chemically synthesized
ctttaagagttaagagtggtgg

SEQ ID NO: 720222 - DNA, 22 bp, Artificial Sequence
  chemically synthesized
actttaagagttaagagtggtg

SEQ ID NO: 720223 - DNA, 22 bp, Artificial Sequence
  chemically synthesized
tccccaaaccaccactcttaac

SEQ ID NO: 720224 - DNA, 22 bp, Artificial Sequence
  chemically synthesized
tttactttaagagttaagagtg

SEQ ID NO: 720225 - DNA, 22 bp, Artificial Sequence
  chemically synthesized
ccagcaaagattatttacttta

SEQ ID NO: 720226 - DNA, 22 bp, Artificial Sequence
  chemically synthesized
gccagcaaagattatttacttt

SEQ ID NO: 720227 - DNA, 22 bp, Artificial Sequence
  chemically synthesized
ttaactcttaaagtaaataatc

SEQ ID NO: 720228 - DNA, 22 bp, Artificial Sequence
  chemically synthesized
aactcttaaagtaaataatctt

SEQ ID NO: 720229 - DNA, 22 bp, Artificial Sequence
  chemically synthesized
actcttaaagtaaataatcttt

SEQ ID NO: 720230 - DNA, 22 bp, Artificial Sequence
  chemically synthesized
ttaaagtaaataatctttgctg

SEQ ID NO: 720231 - DNA, 22 bp, Artificial Sequence
  chemically synthesized
agcatagccttgccagcaaaga

SEQ ID NO: 720232 - DNA, 22 bp, Artificial Sequence
  chemically synthesized
aaagtaaataatctttgctggc

SEQ ID NO: 720233 - DNA, 22 bp, Artificial Sequence
  chemically synthesized
aagtaaataatctttgctggca

SEQ ID NO: 720234 - DNA, 22 bp, Artificial Sequence
  chemically synthesized
aggaggttcagcatagccttgc

SEQ ID NO: 720235 - DNA, 22 bp, Artificial Sequence
  chemically synthesized
tgctggcaaggctatgctgaac

SEQ ID NO: 720236 - DNA, 22 bp, Artificial Sequence
  chemically synthesized
gctggcaaggctatgctgaacc

SEQ ID NO: 720237 - DNA, 22 bp, Artificial Sequence
  chemically synthesized
ctggcaaggctatgctgaacct

SEQ ID NO: 720238 - DNA, 22 bp, Artificial Sequence
  chemically synthesized
gagagtgcctaaggaggttcag

SEQ ID NO: 720239 - DNA, 22 bp, Artificial Sequence
  chemically synthesized
gcaaggctatgctgaacctcct

SEQ ID NO: 720240 - DNA, 22 bp, Artificial Sequence
  chemically synthesized
attagagagtgcctaaggaggt

SEQ ID NO: 720241 - DNA, 22 bp, Artificial Sequence
  chemically synthesized
tgctgaacctccttaggcactc

SEQ ID NO: 720242 - DNA, 22 bp, Artificial Sequence
  chemically synthesized
ggacgtctaattagagagtgcc

SEQ ID NO: 720243 - DNA, 22 bp, Artificial Sequence
  chemically synthesized
aacctccttaggcactctctaa

SEQ ID NO: 720244 - DNA, 22 bp, Artificial Sequence
  chemically synthesized
cttaggcactctctaattagac

SEQ ID NO: 720245 - DNA, 22 bp, Artificial Sequence
  chemically synthesized
ggaggacctaggacgtctaatt

SEQ ID NO: 720246 - DNA, 22 bp, Artificial Sequence
  chemically synthesized
aggcactctctaattagacgtc

SEQ ID NO: 720247 - DNA, 22 bp, Artificial Sequence
  chemically synthesized
ggcactctctaattagacgtcc

SEQ ID NO: 720248 - DNA, 22 bp, Artificial Sequence
  chemically synthesized
tctaattagacgtcctaggtcc

SEQ ID NO: 720249 - DNA, 22 bp, Artificial Sequence
  chemically synthesized
taattagacgtcctaggtcctc

SEQ ID NO: 720250 - DNA, 22 bp, Artificial Sequence
  chemically synthesized
attagacgtcctaggtcctccc

SEQ ID NO: 720251 - DNA, 22 bp, Artificial Sequence
  chemically synthesized
aaggacgaagaattgggaggac

SEQ ID NO: 720252 - DNA, 22 bp, Artificial Sequence
  chemically synthesized
gacgtcctaggtcctcccaatt

SEQ ID NO: 720253 - DNA, 22 bp, Artificial Sequence
  chemically synthesized
ggtcctcccaattcttcgtcct

SEQ ID NO: 720254 - DNA, 22 bp, Artificial Sequence
  chemically synthesized
ccaattcttcgtcctttaatac

SEQ ID NO: 720255 - DNA, 22 bp, Artificial Sequence
  chemically synthesized
ttcgtcctttaatacctgtttt

SEQ ID NO: 720256 - DNA, 22 bp, Artificial Sequence
  chemically synthesized
cgtcctttaatacctgtttttc

SEQ ID NO: 720257 - DNA, 22 bp, Artificial Sequence
  chemically synthesized
gtcctttaatacctgtttttct

SEQ ID NO: 720258 - DNA, 22 bp, Artificial Sequence
  chemically synthesized
aacggaataagagaaggagaaa

SEQ ID NO: 720259 - DNA, 22 bp, Artificial Sequence
  chemically synthesized
taatacctgtttttctccttct

SEQ ID NO: 720260 - DNA, 22 bp, Artificial Sequence
  chemically synthesized
aatacctgtttttctccttctc

SEQ ID NO: 720261 - DNA, 22 bp, Artificial Sequence
  chemically synthesized
atacctgtttttctccttctct

SEQ ID NO: 720262 - DNA, 22 bp, Artificial Sequence
  chemically synthesized
aaaaactaaacggaataagaga

SEQ ID NO: 720263 - DNA, 22 bp, Artificial Sequence
  chemically synthesized
tttttctccttctcttattccg

SEQ ID NO: 720264 - DNA, 22 bp, Artificial Sequence
  chemically synthesized
ttctccttctcttattccgttt

SEQ ID NO: 720265 - DNA, 22 bp, Artificial Sequence
  chemically synthesized
tctccttctcttattccgttta

SEQ ID NO: 720266 - DNA, 22 bp, Artificial Sequence
  chemically synthesized
ctccttctcttattccgtttag

SEQ ID NO: 720267 - DNA, 22 bp, Artificial Sequence
  chemically synthesized
tccttctcttattccgtttagt

SEQ ID NO: 720268 - DNA, 22 bp, Artificial Sequence
  chemically synthesized
tatgaattgaaaaactaaacgg

SEQ ID NO: 720269 - DNA, 22 bp, Artificial Sequence
  chemically synthesized
cttctcttattccgtttagttt

SEQ ID NO: 720270 - DNA, 22 bp, Artificial Sequence
  chemically synthesized
gtatgaattgaaaaactaaacg

SEQ ID NO: 720271 - DNA, 22 bp, Artificial Sequence
  chemically synthesized
tgtatgaattgaaaaactaaac

SEQ ID NO: 720272 - DNA, 22 bp, Artificial Sequence
  chemically synthesized
ctcttattccgtttagtttttc

SEQ ID NO: 720273 - DNA, 22 bp, Artificial Sequence
  chemically synthesized
tcttattccgtttagtttttca

SEQ ID NO: 720274 - DNA, 22 bp, Artificial Sequence
  chemically synthesized
ttattccgtttagtttttcaat

SEQ ID NO: 720275 - DNA, 22 bp, Artificial Sequence
  chemically synthesized
attccgtttagtttttcaattc

SEQ ID NO: 720276 - DNA, 22 bp, Artificial Sequence
  chemically synthesized
ttccgtttagtttttcaattca

SEQ ID NO: 720277 - DNA, 22 bp, Artificial Sequence
  chemically synthesized
gatacggttttgtatgaattga

SEQ ID NO: 720278 - DNA, 22 bp, Artificial Sequence
  chemically synthesized
cgtttagtttttcaattcatac

SEQ ID NO: 720279 - DNA, 22 bp, Artificial Sequence
  chemically synthesized
agtttttcaattcatacaaaac

SEQ ID NO: 720280 - DNA, 22 bp, Artificial Sequence
  chemically synthesized
gtttttcaattcatacaaaacc

SEQ ID NO: 720281 - DNA, 22 bp, Artificial Sequence
  chemically synthesized
ttcaattcatacaaaaccgtat

SEQ ID NO: 720282 - DNA, 22 bp, Artificial Sequence
  chemically synthesized
gtgatggcctggatacggtttt

SEQ ID NO: 720283 - DNA, 22 bp, Artificial Sequence
  chemically synthesized
tcaattcatacaaaaccgtatc

SEQ ID NO: 720284 - DNA, 22 bp, Artificial Sequence
  chemically synthesized
caattcatacaaaaccgtatcc

SEQ ID NO: 720285 - DNA, 22 bp, Artificial Sequence
  chemically synthesized
aattcatacaaaaccgtatcca

SEQ ID NO: 720286 - DNA, 22 bp, Artificial Sequence
  chemically synthesized
ttggtgatggcctggatacggt

SEQ ID NO: 720287 - DNA, 22 bp, Artificial Sequence
  chemically synthesized
atacaaaaccgtatccaggcca

SEQ ID NO: 720288 - DNA, 22 bp, Artificial Sequence
  chemically synthesized
tcatgtagaattattggtgatg

SEQ ID NO: 720289 - DNA, 22 bp, Artificial Sequence
  chemically synthesized
gtcatgtagaattattggtgat

SEQ ID NO: 720290 - DNA, 22 bp, Artificial Sequence
  chemically synthesized
gaagaaacatttgtcatgtaga

SEQ ID NO: 720291 - DNA, 22 bp, Artificial Sequence
  chemically synthesized
ttagaagaaacatttgtcatgt

SEQ ID NO: 720292 - DNA, 22 bp, Artificial Sequence
  chemically synthesized
tggggttgttagaagaaacatt

SEQ ID NO: 720293 - DNA, 22 bp, Artificial Sequence
  chemically synthesized
tacatgacaaatgtttcttcta

SEQ ID NO: 720294 - DNA, 22 bp, Artificial Sequence
  chemically synthesized
catgacaaatgtttcttctaac

SEQ ID NO: 720295 - DNA, 22 bp, Artificial Sequence
  chemically synthesized
tggtaaggggtgatattgtggg

SEQ ID NO: 720296 - DNA, 22 bp, Artificial Sequence
  chemically synthesized
cttctaacaaccccacaatatc

SEQ ID NO: 720297 - DNA, 22 bp, Artificial Sequence
  chemically synthesized
gtggtaaggggtgatattgtgg

SEQ ID NO: 720298 - DNA, 22 bp, Artificial Sequence
  chemically synthesized
ttctaacaaccccacaatatca

SEQ ID NO: 720299 - DNA, 22 bp, Artificial Sequence
  chemically synthesized
tgtggtaaggggtgatattgtg

SEQ ID NO: 720300 - DNA, 22 bp, Artificial Sequence
  chemically synthesized
ctaacaaccccacaatatcacc

SEQ ID NO: 720301 - DNA, 22 bp, Artificial Sequence
  chemically synthesized
taacaaccccacaatatcaccc

SEQ ID NO: 720302 - DNA, 22 bp, Artificial Sequence
  chemically synthesized
acaaccccacaatatcacccct

SEQ ID NO: 720303 - DNA, 22 bp, Artificial Sequence
  chemically synthesized
aaggaagattttgtggtaaggg

SEQ ID NO: 720304 - DNA, 22 bp, Artificial Sequence
  chemically synthesized
agctgaaggaagattttgtggt

SEQ ID NO: 720305 - DNA, 22 bp, Artificial Sequence
  chemically synthesized
accacaaaatcttccttcagct

SEQ ID NO: 720306 - DNA, 22 bp, Artificial Sequence
  chemically synthesized
ccacaaaatcttccttcagctt

SEQ ID NO: 720307 - DNA, 22 bp, Artificial Sequence
  chemically synthesized
gagtgggagggattaagctgaa

SEQ ID NO: 720308 - DNA, 22 bp, Artificial Sequence
  chemically synthesized
ccttcagcttaatccctcccac

SEQ ID NO: 720309 - DNA, 22 bp, Artificial Sequence
  chemically synthesized
cttcagcttaatccctcccact

SEQ ID NO: 720310 - DNA, 22 bp, Artificial Sequence
  chemically synthesized
cagcttaatccctcccactcta

SEQ ID NO: 720311 - DNA, 22 bp, Artificial Sequence
  chemically synthesized
agcttaatccctcccactctag

SEQ ID NO: 720312 - DNA, 22 bp, Artificial Sequence
  chemically synthesized
aatccctcccactctaggttcc

SEQ ID NO: 720313 - DNA, 22 bp, Artificial Sequence
  chemically synthesized
atccctcccactctaggttccc

SEQ ID NO: 720314 - DNA, 22 bp, Artificial Sequence
  chemically synthesized
ccactctaggttcccacgccac

SEQ ID NO: 720315 - DNA, 22 bp, Artificial Sequence
  chemically synthesized
gaggtggatcaggggtggcgtg

SEQ ID NO: 720316 - DNA, 22 bp, Artificial Sequence
  chemically synthesized
cgaggtggatcaggggtggcgt

SEQ ID NO: 720317 - DNA, 22 bp, Artificial Sequence
  chemically synthesized
taggttcccacgccacccctga

SEQ ID NO: 720318 - DNA, 22 bp, Artificial Sequence
  chemically synthesized
cttcgaggtggatcaggggtgg

SEQ ID NO: 720319 - DNA, 22 bp, Artificial Sequence
  chemically synthesized
ggttcccacgccacccctgatc

SEQ ID NO: 720320 - DNA, 22 bp, Artificial Sequence
  chemically synthesized
ccacgccacccctgatccacct

SEQ ID NO: 720321 - DNA, 22 bp, Artificial Sequence
  chemically synthesized
agggctgcttcgaggtggatca

SEQ ID NO: 720322 - DNA, 22 bp, Artificial Sequence
  chemically synthesized
tcagggctgcttcgaggtggat

SEQ ID NO: 720323 - DNA, 22 bp, Artificial Sequence
  chemically synthesized
ctcagggctgcttcgaggtgga

SEQ ID NO: 720324 - DNA, 22 bp, Artificial Sequence
  chemically synthesized
atccacctcgaagcagccctga

SEQ ID NO: 720325 - DNA, 22 bp, Artificial Sequence
  chemically synthesized
gaagcagccctgagaaacatca

SEQ ID NO: 720326 - DNA, 22 bp, Artificial Sequence
  chemically synthesized
agaaacatcacccattatctct

SEQ ID NO: 720327 - DNA, 22 bp, Artificial Sequence
  chemically synthesized
ggggtggtgtggagagataatg

SEQ ID NO: 720328 - DNA, 22 bp, Artificial Sequence
  chemically synthesized
cggggtggtgtggagagataat

SEQ ID NO: 720329 - DNA, 22 bp, Artificial Sequence
  chemically synthesized
tcggggtggtgtggagagataa

SEQ ID NO: 720330 - DNA, 22 bp, Artificial Sequence
  chemically synthesized
tctctccacaccaccccgaaaa

SEQ ID NO: 720331 - DNA, 22 bp, Artificial Sequence
  chemically synthesized
gggcggcgaaaattttcggggt

SEQ ID NO: 720332 - DNA, 22 bp, Artificial Sequence
  chemically synthesized
tccacaccaccccgaaaatttt

SEQ ID NO: 720333 - DNA, 22 bp, Artificial Sequence
  chemically synthesized
cacaccaccccgaaaattttcg

SEQ ID NO: 720334 - DNA, 22 bp, Artificial Sequence
  chemically synthesized
aagtgttggggcggcgaaaatt

SEQ ID NO: 720335 - DNA, 22 bp, Artificial Sequence
  chemically synthesized
tcgccgccccaacacttcaaca

SEQ ID NO: 720336 - DNA, 22 bp, Artificial Sequence
  chemically synthesized
cgccgccccaacacttcaacac

SEQ ID NO: 720337 - DNA, 22 bp, Artificial Sequence
  chemically synthesized
gccgccccaacacttcaacact

SEQ ID NO: 720338 - DNA, 22 bp, Artificial Sequence
  chemically synthesized
ataagaaaaataaaacaaaata

SEQ ID NO: 720339 - DNA, 22 bp, Artificial Sequence
  chemically synthesized
tattaataagaaaaataaaaca

SEQ ID NO: 720340 - DNA, 22 bp, Artificial Sequence
  chemically synthesized
caacactattttgttttatttt

SEQ ID NO: 720341 - DNA, 22 bp, Artificial Sequence
  chemically synthesized
atattaataagaaaaataaaac

SEQ ID NO: 720342 - DNA, 22 bp, Artificial Sequence
  chemically synthesized
aacactattttgttttattttt

SEQ ID NO: 720343 - DNA, 22 bp, Artificial Sequence
  chemically synthesized
ttatattaataagaaaaataaa

SEQ ID NO: 720344 - DNA, 22 bp, Artificial Sequence
  chemically synthesized
cttatattaataagaaaaataa

SEQ ID NO: 720345 - DNA, 22 bp, Artificial Sequence
  chemically synthesized
tcttcttatattaataagaaaa

SEQ ID NO: 720346 - DNA, 22 bp, Artificial Sequence
  chemically synthesized
ttttgttttatttttcttatta

SEQ ID NO: 720347 - DNA, 22 bp, Artificial Sequence
  chemically synthesized
ctgtcttcttatattaataaga

SEQ ID NO: 720348 - DNA, 22 bp, Artificial Sequence
  chemically synthesized
tgttttatttttcttattaata

SEQ ID NO: 720349 - DNA, 22 bp, Artificial Sequence
  chemically synthesized
gttttatttttcttattaatat

SEQ ID NO: 720350 - DNA, 22 bp, Artificial Sequence
  chemically synthesized
ttttatttttcttattaatata

SEQ ID NO: 720351 - DNA, 22 bp, Artificial Sequence
  chemically synthesized
tatttttcttattaatataaga

SEQ ID NO: 720352 - DNA, 22 bp, Artificial Sequence
  chemically synthesized
acattcctgtcttcttatatta

SEQ ID NO: 720353 - DNA, 22 bp, Artificial Sequence
  chemically synthesized
atttttcttattaatataagaa

SEQ ID NO: 720354 - DNA, 22 bp, Artificial Sequence
  chemically synthesized
tttttcttattaatataagaag

SEQ ID NO: 720355 - DNA, 22 bp, Artificial Sequence
  chemically synthesized
ttcttattaatataagaagaca

SEQ ID NO: 720356 - DNA, 22 bp, Artificial Sequence
  chemically synthesized
tcttattaatataagaagacag

SEQ ID NO: 720357 - DNA, 22 bp, Artificial Sequence
  chemically synthesized
cttattaatataagaagacagg

SEQ ID NO: 720358 - DNA, 22 bp, Artificial Sequence
  chemically synthesized
ttattaatataagaagacagga

SEQ ID NO: 720359 - DNA, 22 bp, Artificial Sequence
  chemically synthesized
agaggcctgacattcctgtctt

SEQ ID NO: 720360 - DNA, 22 bp, Artificial Sequence
  chemically synthesized
attaatataagaagacaggaat

SEQ ID NO: 720361 - DNA, 22 bp, Artificial Sequence
  chemically synthesized
ttaatataagaagacaggaatg

SEQ ID NO: 720362 - DNA, 22 bp, Artificial Sequence
  chemically synthesized
atataagaagacaggaatgtca

SEQ ID NO: 720363 - DNA, 22 bp, Artificial Sequence
  chemically synthesized
ggctcagaggcctgacattcct

SEQ ID NO: 720364 - DNA, 22 bp, Artificial Sequence
  chemically synthesized
gggctcagaggcctgacattcc

SEQ ID NO: 720365 - DNA, 22 bp, Artificial Sequence
  chemically synthesized
gcttgggctcagaggcctgaca

SEQ ID NO: 720366 - DNA, 22 bp, Artificial Sequence
  chemically synthesized
agcttgggctcagaggcctgac

SEQ ID NO: 720367 - DNA, 22 bp, Artificial Sequence
  chemically synthesized
tgagcccaagctaagccatcat

SEQ ID NO: 720368 - DNA, 22 bp, Artificial Sequence
  chemically synthesized
agcccaagctaagccatcatat

SEQ ID NO: 720369 - DNA, 22 bp, Artificial Sequence
  chemically synthesized
agccatcatatcccctgtgacc

SEQ ID NO: 720370 - DNA, 22 bp, Artificial Sequence
  chemically synthesized
gatgtatatgtgtaggtcacag

SEQ ID NO: 720371 - DNA, 22 bp, Artificial Sequence
  chemically synthesized
aggccatctggatgtatatgtg

SEQ ID NO: 720372 - DNA, 22 bp, Artificial Sequence
  chemically synthesized
caggccatctggatgtatatgt

SEQ ID NO: 720373 - DNA, 22 bp, Artificial Sequence
  chemically synthesized
cttcaggccatctggatgtata

SEQ ID NO: 720374 - DNA, 22 bp, Artificial Sequence
  chemically synthesized
tgacctacacatatacatccag

SEQ ID NO: 720375 - DNA, 22 bp, Artificial Sequence
  chemically synthesized
agttacttcaggccatctggat

SEQ ID NO: 720376 - DNA, 22 bp, Artificial Sequence
  chemically synthesized
cagttacttcaggccatctgga

SEQ ID NO: 720377 - DNA, 22 bp, Artificial Sequence
  chemically synthesized
tcagttacttcaggccatctgg

SEQ ID NO: 720378 - DNA, 22 bp, Artificial Sequence
  chemically synthesized
cacatatacatccagatggcct

SEQ ID NO: 720379 - DNA, 22 bp, Artificial Sequence
  chemically synthesized
ttcagttacttcaggccatctg

SEQ ID NO: 720380 - DNA, 22 bp, Artificial Sequence
  chemically synthesized
tgatttttcagttacttcaggc

SEQ ID NO: 720381 - DNA, 22 bp, Artificial Sequence
  chemically synthesized
gtgatttttcagttacttcagg

SEQ ID NO: 720382 - DNA, 22 bp, Artificial Sequence
  chemically synthesized
tgtgatttttcagttacttcag

SEQ ID NO: 720383 - DNA, 22 bp, Artificial Sequence
  chemically synthesized
ttgtgatttttcagttacttca

SEQ ID NO: 720384 - DNA, 22 bp, Artificial Sequence
  chemically synthesized
ttttgtgatttttcagttactt

SEQ ID NO: 720385 - DNA, 22 bp, Artificial Sequence
  chemically synthesized
cttttgtgatttttcagttact

SEQ ID NO: 720386 - DNA, 22 bp, Artificial Sequence
  chemically synthesized
acttcttttgtgatttttcagt

SEQ ID NO: 720387 - DNA, 22 bp, Artificial Sequence
  chemically synthesized
cacttcttttgtgatttttcag

SEQ ID NO: 720388 - DNA, 22 bp, Artificial Sequence
  chemically synthesized
aatttcacttcttttgtgattt

SEQ ID NO: 720389 - DNA, 22 bp, Artificial Sequence
  chemically synthesized
aagtaactgaaaaatcacaaaa

SEQ ID NO: 720390 - DNA, 22 bp, Artificial Sequence
  chemically synthesized
aaatttcacttcttttgtgatt

SEQ ID NO: 720391 - DNA, 22 bp, Artificial Sequence
  chemically synthesized
aaaaatcacaaaagaagtgaaa

SEQ ID NO: 720392 - DNA, 22 bp, Artificial Sequence
  chemically synthesized
aggcaggaacaggccatttaaa

SEQ ID NO: 720393 - DNA, 22 bp, Artificial Sequence
  chemically synthesized
aaatggcctgttcctgccttaa

SEQ ID NO: 720394 - DNA, 22 bp, Artificial Sequence
  chemically synthesized
aatggcctgttcctgccttaac

SEQ ID NO: 720395 - DNA, 22 bp, Artificial Sequence
  chemically synthesized
tggtggaatgtcatcagttaag

SEQ ID NO: 720396 - DNA, 22 bp, Artificial Sequence
  chemically synthesized
gtggtggaatgtcatcagttaa

SEQ ID NO: 720397 - DNA, 22 bp, Artificial Sequence
  chemically synthesized
tgtggtggaatgtcatcagtta

SEQ ID NO: 720398 - DNA, 22 bp, Artificial Sequence
  chemically synthesized
ttgtggtggaatgtcatcagtt

SEQ ID NO: 720399 - DNA, 22 bp, Artificial Sequence
  chemically synthesized
ttcctgccttaactgatgacat

SEQ ID NO: 720400 - DNA, 22 bp, Artificial Sequence
  chemically synthesized
ttttgtggtggaatgtcatcag

SEQ ID NO: 720401 - DNA, 22 bp, Artificial Sequence
  chemically synthesized
cttttgtggtggaatgtcatca

SEQ ID NO: 720402 - DNA, 22 bp, Artificial Sequence
  chemically synthesized
ctgccttaactgatgacattcc

SEQ ID NO: 720403 - DNA, 22 bp, Artificial Sequence
  chemically synthesized
acttcttttgtggtggaatgtc

SEQ ID NO: 720404 - DNA, 22 bp, Artificial Sequence
  chemically synthesized
ccttaactgatgacattccacc

SEQ ID NO: 720405 - DNA, 22 bp, Artificial Sequence
  chemically synthesized
cacttcttttgtggtggaatgt

SEQ ID NO: 720406 - DNA, 22 bp, Artificial Sequence
  chemically synthesized
tcacttcttttgtggtggaatg

SEQ ID NO: 720407 - DNA, 22 bp, Artificial Sequence
  chemically synthesized
aactgatgacattccaccacaa

SEQ ID NO: 720408 - DNA, 22 bp, Artificial Sequence
  chemically synthesized
actgatgacattccaccacaaa

SEQ ID NO: 720409 - DNA, 22 bp, Artificial Sequence
  chemically synthesized
atgacattccaccacaaaagaa

SEQ ID NO: 720410 - DNA, 22 bp, Artificial Sequence
  chemically synthesized
caccacaaaagaagtgaaaatg

SEQ ID NO: 720411 - DNA, 22 bp, Artificial Sequence
  chemically synthesized
aggcaaggaccggccattttca

SEQ ID NO: 720412 - DNA, 22 bp, Artificial Sequence
  chemically synthesized
acaaggtaatgtcatcagttaa

SEQ ID NO: 720413 - DNA, 22 bp, Artificial Sequence
  chemically synthesized
cacaaggtaatgtcatcagtta

SEQ ID NO: 720414 - DNA, 22 bp, Artificial Sequence
  chemically synthesized
gccttaactgatgacattacct

SEQ ID NO: 720415 - DNA, 22 bp, Artificial Sequence
  chemically synthesized
ccttaactgatgacattacctt

SEQ ID NO: 720416 - DNA, 22 bp, Artificial Sequence
  chemically synthesized
aactgatgacattaccttgtga

SEQ ID NO: 720417 - DNA, 22 bp, Artificial Sequence
  chemically synthesized
actgatgacattaccttgtgaa

SEQ ID NO: 720418 - DNA, 22 bp, Artificial Sequence
  chemically synthesized
atgacattaccttgtgaaattc

SEQ ID NO: 720419 - DNA, 22 bp, Artificial Sequence
  chemically synthesized
ccttgtgaaattccttctcctg

SEQ ID NO: 720420 - DNA, 22 bp, Artificial Sequence
  chemically synthesized
agccaggaagagccaggagaag

SEQ ID NO: 720421 - DNA, 22 bp, Artificial Sequence
  chemically synthesized
gagccaggaagagccaggagaa

SEQ ID NO: 720422 - DNA, 22 bp, Artificial Sequence
  chemically synthesized
tgagccaggaagagccaggaga

SEQ ID NO: 720423 - DNA, 22 bp, Artificial Sequence
  chemically synthesized
gtgaaattccttctcctggctc

SEQ ID NO: 720424 - DNA, 22 bp, Artificial Sequence
  chemically synthesized
ttgagccaggaagagccaggag

SEQ ID NO: 720425 - DNA, 22 bp, Artificial Sequence
  chemically synthesized
tgaaattccttctcctggctct

SEQ ID NO: 720426 - DNA, 22 bp, Artificial Sequence
  chemically synthesized
cttctcctggctcttcctggct

SEQ ID NO: 720427 - DNA, 22 bp, Artificial Sequence
  chemically synthesized
ctcctggctcttcctggctcaa

SEQ ID NO: 720428 - DNA, 22 bp, Artificial Sequence
  chemically synthesized
tcctggctcttcctggctcaaa

SEQ ID NO: 720429 - DNA, 22 bp, Artificial Sequence
  chemically synthesized
agtgggggagcttttgagccag

SEQ ID NO: 720430 - DNA, 22 bp, Artificial Sequence
  chemically synthesized
ctggctcttcctggctcaaaag

SEQ ID NO: 720431 - DNA, 22 bp, Artificial Sequence
  chemically synthesized
gctcttcctggctcaaaagctc

SEQ ID NO: 720432 - DNA, 22 bp, Artificial Sequence
  chemically synthesized
ttcctggctcaaaagctccccc

SEQ ID NO: 720433 - DNA, 22 bp, Artificial Sequence
  chemically synthesized
cctggctcaaaagctcccccac

SEQ ID NO: 720434 - DNA, 22 bp, Artificial Sequence
  chemically synthesized
ctggctcaaaagctcccccact

SEQ ID NO: 720435 - DNA, 22 bp, Artificial Sequence
  chemically synthesized
gctcaaaagctcccccactgag

SEQ ID NO: 720436 - DNA, 22 bp, Artificial Sequence
  chemically synthesized
aaaagctcccccactgagcacc

SEQ ID NO: 720437 - DNA, 22 bp, Artificial Sequence
  chemically synthesized
ccccactgagcaccttgtgatc

SEQ ID NO: 720438 - DNA, 22 bp, Artificial Sequence
  chemically synthesized
gtgggcaggagtggggatcaca

SEQ ID NO: 720439 - DNA, 22 bp, Artificial Sequence
  chemically synthesized
tggtgggcaggagtggggatca

SEQ ID NO: 720440 - DNA, 22 bp, Artificial Sequence
  chemically synthesized
agcaccttgtgatccccactcc

SEQ ID NO: 720441 - DNA, 22 bp, Artificial Sequence
  chemically synthesized
tcctctggtgggcaggagtggg

SEQ ID NO: 720442 - DNA, 22 bp, Artificial Sequence
  chemically synthesized
gtgatccccactcctgcccacc

SEQ ID NO: 720443 - DNA, 22 bp, Artificial Sequence
  chemically synthesized
tgatccccactcctgcccacca

SEQ ID NO: 720444 - DNA, 22 bp, Artificial Sequence
  chemically synthesized
cagtcaaaggggggttgtcctc

SEQ ID NO: 720445 - DNA, 22 bp, Artificial Sequence
  chemically synthesized
ctgcccaccagaggacaacccc

SEQ ID NO: 720446 - DNA, 22 bp, Artificial Sequence
  chemically synthesized
cccaccagaggacaacccccct

SEQ ID NO: 720447 - DNA, 22 bp, Artificial Sequence
  chemically synthesized
aggaaaattacagtcaaagggg

SEQ ID NO: 720448 - DNA, 22 bp, Artificial Sequence
  chemically synthesized
ggtaggttaaggaaaattacag

SEQ ID NO: 720449 - DNA, 22 bp, Artificial Sequence
  chemically synthesized
gggtaggttaaggaaaattaca

SEQ ID NO: 720450 - DNA, 22 bp, Artificial Sequence
  chemically synthesized
tgactgtaattttccttaacct

SEQ ID NO: 720451 - DNA, 22 bp, Artificial Sequence
  chemically synthesized
taagatttgggtaggttaagga

SEQ ID NO: 720452 - DNA, 22 bp, Artificial Sequence
  chemically synthesized
gactgtaattttccttaaccta

SEQ ID NO: 720453 - DNA, 22 bp, Artificial Sequence
  chemically synthesized
actgtaattttccttaacctac

SEQ ID NO: 720454 - DNA, 22 bp, Artificial Sequence
  chemically synthesized
tataagatttgggtaggttaag

SEQ ID NO: 720455 - DNA, 22 bp, Artificial Sequence
  chemically synthesized
taattttccttaacctacccaa

SEQ ID NO: 720456 - DNA, 22 bp, Artificial Sequence
  chemically synthesized
tccttaacctacccaaatctta

SEQ ID NO: 720457 - DNA, 22 bp, Artificial Sequence
  chemically synthesized
ccttaacctacccaaatcttat

SEQ ID NO: 720458 - DNA, 22 bp, Artificial Sequence
  chemically synthesized
cttaacctacccaaatcttata

SEQ ID NO: 720459 - DNA, 22 bp, Artificial Sequence
  chemically synthesized
aacctacccaaatcttatagaa

SEQ ID NO: 720460 - DNA, 22 bp, Artificial Sequence
  chemically synthesized
acctacccaaatcttatagaac

SEQ ID NO: 720461 - DNA, 22 bp, Artificial Sequence
  chemically synthesized
cccaaatcttatagaacggccc

SEQ ID NO: 720462 - DNA, 22 bp, Artificial Sequence
  chemically synthesized
atagaacggccctacccctatc

SEQ ID NO: 720463 - DNA, 22 bp, Artificial Sequence
  chemically synthesized
tagaacggccctacccctatct

SEQ ID NO: 720464 - DNA, 22 bp, Artificial Sequence
  chemically synthesized
agtccgaaaagagtcagcgaag

SEQ ID NO: 720465 - DNA, 22 bp, Artificial Sequence
  chemically synthesized
cccctatctcccttcgctgact

SEQ ID NO: 720466 - DNA, 22 bp, Artificial Sequence
  chemically synthesized
tctcccttcgctgactcttttc

SEQ ID NO: 720467 - DNA, 22 bp, Artificial Sequence
  chemically synthesized
ccttcgctgactcttttcggac

SEQ ID NO: 720468 - DNA, 22 bp, Artificial Sequence
  chemically synthesized
cgctgactcttttcggactcag

SEQ ID NO: 720469 - DNA, 22 bp, Artificial Sequence
  chemically synthesized
ggcgcaggcgagctgagtccga

SEQ ID NO: 720470 - DNA, 22 bp, Artificial Sequence
  chemically synthesized
gctgactcttttcggactcagc

SEQ ID NO: 720471 - DNA, 22 bp, Artificial Sequence
  chemically synthesized
actcttttcggactcagctcgc

SEQ ID NO: 720472 - DNA, 22 bp, Artificial Sequence
  chemically synthesized
ttttcggactcagctcgcctgc

SEQ ID NO: 720473 - DNA, 22 bp, Artificial Sequence
  chemically synthesized
taatcacctgggcgcaggcgag

SEQ ID NO: 720474 - DNA, 22 bp, Artificial Sequence
  chemically synthesized
ttcggactcagctcgcctgcgc

SEQ ID NO: 720475 - DNA, 22 bp, Artificial Sequence
  chemically synthesized
gtaatcacctgggcgcaggcga

SEQ ID NO: 720476 - DNA, 22 bp, Artificial Sequence
  chemically synthesized
tcggactcagctcgcctgcgcc

SEQ ID NO: 720477 - DNA, 22 bp, Artificial Sequence
  chemically synthesized
tgtaatcacctgggcgcaggcg

SEQ ID NO: 720478 - DNA, 22 bp, Artificial Sequence
  chemically synthesized
cggactcagctcgcctgcgccc

SEQ ID NO: 720479 - DNA, 22 bp, Artificial Sequence
  chemically synthesized
ggactcagctcgcctgcgccca

SEQ ID NO: 720480 - DNA, 22 bp, Artificial Sequence
  chemically synthesized
agctcgcctgcgcccaggtgat

SEQ ID NO: 720481 - DNA, 22 bp, Artificial Sequence
  chemically synthesized
gcctgcgcccaggtgattacaa

SEQ ID NO: 720482 - DNA, 22 bp, Artificial Sequence
  chemically synthesized
tgtgagcaataaagctttgtaa

SEQ ID NO: 720483 - DNA, 22 bp, Artificial Sequence
  chemically synthesized
cgcccaggtgattacaaagctt

SEQ ID NO: 720484 - DNA, 22 bp, Artificial Sequence
  chemically synthesized
gtgtgagcaataaagctttgta

SEQ ID NO: 720485 - DNA, 22 bp, Artificial Sequence
  chemically synthesized
tgtgtgagcaataaagctttgt

SEQ ID NO: 720486 - DNA, 22 bp, Artificial Sequence
  chemically synthesized
caaagctttattgctcacacaa

SEQ ID NO: 720487 - DNA, 22 bp, Artificial Sequence
  chemically synthesized
tattgctcacacaaagactgtt

SEQ ID NO: 720488 - DNA, 22 bp, Artificial Sequence
  chemically synthesized
attgctcacacaaagactgttt

SEQ ID NO: 720489 - DNA, 22 bp, Artificial Sequence
  chemically synthesized
ttgctcacacaaagactgtttg

SEQ ID NO: 720490 - DNA, 22 bp, Artificial Sequence
  chemically synthesized
ctcacacaaagactgtttggtg

SEQ ID NO: 720491 - DNA, 22 bp, Artificial Sequence
  chemically synthesized
acacaaagactgtttggtggtc

SEQ ID NO: 720492 - DNA, 22 bp, Artificial Sequence
  chemically synthesized
gcgtccgtgtgaagagaccacc

SEQ ID NO: 720493 - DNA, 22 bp, Artificial Sequence
  chemically synthesized
actcgcgtccgtgtgaagagac

SEQ ID NO: 720494 - DNA, 22 bp, Artificial Sequence
  chemically synthesized
cactcgcgtccgtgtgaagaga

SEQ ID NO: 720495 - DNA, 22 bp, Artificial Sequence
  chemically synthesized
tcactcgcgtccgtgtgaagag

SEQ ID NO: 720496 - DNA, 22 bp, Artificial Sequence
  chemically synthesized
tttggtggtctcttcacacgga

SEQ ID NO: 720497 - DNA, 22 bp, Artificial Sequence
  chemically synthesized
ggtggtctcttcacacggacgc

SEQ ID NO: 720498 - DNA, 22 bp, Artificial Sequence
  chemically synthesized
caactttcactcgcgtccgtgt

SEQ ID NO: 720499 - DNA, 22 bp, Artificial Sequence
  chemically synthesized
gtggtctcttcacacggacgcg

SEQ ID NO: 720500 - DNA, 22 bp, Artificial Sequence
  chemically synthesized
ttacaactttcactcgcgtccg

SEQ ID NO: 720501 - DNA, 22 bp, Artificial Sequence
  chemically synthesized
attgttacaactttcactcgcg

SEQ ID NO: 720502 - DNA, 22 bp, Artificial Sequence
  chemically synthesized
ttcacacggacgcgagtgaaag

SEQ ID NO: 720503 - DNA, 22 bp, Artificial Sequence
  chemically synthesized
cacacggacgcgagtgaaagtt

SEQ ID NO: 720504 - DNA, 22 bp, Artificial Sequence
  chemically synthesized
acacggacgcgagtgaaagttg

SEQ ID NO: 720505 - DNA, 22 bp, Artificial Sequence
  chemically synthesized
accaacctaattgttacaactt

SEQ ID NO: 720506 - DNA, 22 bp, Artificial Sequence
  chemically synthesized
ttcaccaacctaattgttacaa

SEQ ID NO: 720507 - DNA, 22 bp, Artificial Sequence
  chemically synthesized
atatctattcaccaacctaatt

SEQ ID NO: 720508 - DNA, 22 bp, Artificial Sequence
  chemically synthesized
catatctattcaccaacctaat

SEQ ID NO: 720509 - DNA, 22 bp, Artificial Sequence
  chemically synthesized
taacaattaggttggtgaatag

SEQ ID NO: 720510 - DNA, 22 bp, Artificial Sequence
  chemically synthesized
cgtacttcatatctattcacca

SEQ ID NO: 720511 - DNA, 22 bp, Artificial Sequence
  chemically synthesized
tctacgtacttcatatctattc

SEQ ID NO: 720512 - DNA, 22 bp, Artificial Sequence
  chemically synthesized
ggttggtgaatagatatgaagt

SEQ ID NO: 720513 - DNA, 22 bp, Artificial Sequence
  chemically synthesized
gtgaatagatatgaagtacgta

SEQ ID NO: 720514 - DNA, 22 bp, Artificial Sequence
  chemically synthesized
cataccaagcattatctacgta

SEQ ID NO: 720515 - DNA, 22 bp, Artificial Sequence
  chemically synthesized
ctacataccaagcattatctac

SEQ ID NO: 720516 - DNA, 22 bp, Artificial Sequence
  chemically synthesized
actactacataccaagcattat

SEQ ID NO: 720517 - DNA, 22 bp, Artificial Sequence
  chemically synthesized
ggtatgtagtagttagtattac

SEQ ID NO: 720518 - DNA, 22 bp, Artificial Sequence
  chemically synthesized
gtatgtagtagttagtattact

SEQ ID NO: 720519 - DNA, 22 bp, Artificial Sequence
  chemically synthesized
gtattacttctgttgctgctgc

SEQ ID NO: 720520 - DNA, 22 bp, Artificial Sequence
  chemically synthesized
cttctgttgctgctgctactac

SEQ ID NO: 720521 - DNA, 22 bp, Artificial Sequence
  chemically synthesized
ctgttgctgctgctactactac

SEQ ID NO: 720522 - DNA, 22 bp, Artificial Sequence
  chemically synthesized
tgttgctgctgctactactact

SEQ ID NO: 720523 - DNA, 22 bp, Artificial Sequence
  chemically synthesized
ttgctgctgctactactactac

SEQ ID NO: 720524 - DNA, 22 bp, Artificial Sequence
  chemically synthesized
tcagtagtaatagtagtagtag

SEQ ID NO: 720525 - DNA, 22 bp, Artificial Sequence
  chemically synthesized
ctgctgctactactactactat

SEQ ID NO: 720526 - DNA, 22 bp, Artificial Sequence
  chemically synthesized
ctgctactactactactattac

SEQ ID NO: 720527 - DNA, 22 bp, Artificial Sequence
  chemically synthesized
tccctatcagtagtaatagtag

SEQ ID NO: 720528 - DNA, 22 bp, Artificial Sequence
  chemically synthesized
ctactactactactattactac

SEQ ID NO: 720529 - DNA, 22 bp, Artificial Sequence
  chemically synthesized
ctgtccctatcagtagtaatag

SEQ ID NO: 720530 - DNA, 22 bp, Artificial Sequence
  chemically synthesized
ctactactactattactactga

SEQ ID NO: 720531 - DNA, 22 bp, Artificial Sequence
  chemically synthesized
cctcctgtccctatcagtagta

SEQ ID NO: 720532 - DNA, 22 bp, Artificial Sequence
  chemically synthesized
ctactactattactactgatag

SEQ ID NO: 720533 - DNA, 22 bp, Artificial Sequence
  chemically synthesized
cctgcctcctgtccctatcagt

SEQ ID NO: 720534 - DNA, 22 bp, Artificial Sequence
  chemically synthesized
ctactattactactgataggga

SEQ ID NO: 720535 - DNA, 22 bp, Artificial Sequence
  chemically synthesized
ccctgcctcctgtccctatcag

SEQ ID NO: 720536 - DNA, 22 bp, Artificial Sequence
  chemically synthesized
ctattactactgatagggacag

SEQ ID NO: 720537 - DNA, 22 bp, Artificial Sequence
  chemically synthesized
ttactactgatagggacaggag

SEQ ID NO: 720538 - DNA, 22 bp, Artificial Sequence
  chemically synthesized
ctactgatagggacaggaggca

SEQ ID NO: 720539 - DNA, 22 bp, Artificial Sequence
  chemically synthesized
tccagaatttccctgcctcctg

SEQ ID NO: 720540 - DNA, 22 bp, Artificial Sequence
  chemically synthesized
ctgatagggacaggaggcaggg

SEQ ID NO: 720541 - DNA, 22 bp, Artificial Sequence
  chemically synthesized
tgtccagaatttccctgcctcc

SEQ ID NO: 720542 - DNA, 22 bp, Artificial Sequence
  chemically synthesized
ctgtccagaatttccctgcctc

SEQ ID NO: 720543 - DNA, 22 bp, Artificial Sequence
  chemically synthesized
atagggacaggaggcagggaaa

SEQ ID NO: 720544 - DNA, 22 bp, Artificial Sequence
  chemically synthesized
ttctgtccagaatttccctgcc

SEQ ID NO: 720545 - DNA, 22 bp, Artificial Sequence
  chemically synthesized
ccagagacccgccctcttctgt

SEQ ID NO: 720546 - DNA, 22 bp, Artificial Sequence
  chemically synthesized
gccagagacccgccctcttctg

SEQ ID NO: 720547 - DNA, 22 bp, Artificial Sequence
  chemically synthesized
tggacagaagagggcgggtctc

SEQ ID NO: 720548 - DNA, 22 bp, Artificial Sequence
  chemically synthesized
gacagaagagggcgggtctctg

SEQ ID NO: 720549 - DNA, 22 bp, Artificial Sequence
  chemically synthesized
agggtggggcccttgccagaga

SEQ ID NO: 720550 - DNA, 22 bp, Artificial Sequence
  chemically synthesized
aagggtggggcccttgccagag

SEQ ID NO: 720551 - DNA, 22 bp, Artificial Sequence
  chemically synthesized
ggcttaagggtggggcccttgc

SEQ ID NO: 720552 - DNA, 22 bp, Artificial Sequence
  chemically synthesized
aggcttaagggtggggcccttg

SEQ ID NO: 720553 - DNA, 22 bp, Artificial Sequence
  chemically synthesized
taggcttaagggtggggccctt

SEQ ID NO: 720554 - DNA, 22 bp, Artificial Sequence
  chemically synthesized
ttaggcttaagggtggggccct

SEQ ID NO: 720555 - DNA, 22 bp, Artificial Sequence
  chemically synthesized
tggcaagggccccacccttaag

SEQ ID NO: 720556 - DNA, 22 bp, Artificial Sequence
  chemically synthesized
caggcttttaggcttaagggtg

SEQ ID NO: 720557 - DNA, 22 bp, Artificial Sequence
  chemically synthesized
gcaagggccccacccttaagcc

SEQ ID NO: 720558 - DNA, 22 bp, Artificial Sequence
  chemically synthesized
ggccacagttccaggcttttag

SEQ ID NO: 720559 - DNA, 22 bp, Artificial Sequence
  chemically synthesized
gggccacagttccaggctttta

SEQ ID NO: 720560 - DNA, 22 bp, Artificial Sequence
  chemically synthesized
tgggccacagttccaggctttt

SEQ ID NO: 720561 - DNA, 22 bp, Artificial Sequence
  chemically synthesized
actttgggccacagttccaggc

SEQ ID NO: 720562 - DNA, 22 bp, Artificial Sequence
  chemically synthesized
aagcctaaaagcctggaactgt

SEQ ID NO: 720563 - DNA, 22 bp, Artificial Sequence
  chemically synthesized
tcactttgggccacagttccag

SEQ ID NO: 720564 - DNA, 22 bp, Artificial Sequence
  chemically synthesized
agcctaaaagcctggaactgtg

SEQ ID NO: 720565 - DNA, 22 bp, Artificial Sequence
  chemically synthesized
aaagcctggaactgtggcccaa

SEQ ID NO: 720566 - DNA, 22 bp, Artificial Sequence
  chemically synthesized
gaactgtggcccaaagtgagaa

SEQ ID NO: 720567 - DNA, 22 bp, Artificial Sequence
  chemically synthesized
tggcccaaagtgagaacttaca

SEQ ID NO: 720568 - DNA, 22 bp, Artificial Sequence
  chemically synthesized
agcaggaaaacagggatgtaag

SEQ ID NO: 720569 - DNA, 22 bp, Artificial Sequence
  chemically synthesized
gagcaggaaaacagggatgtaa

SEQ ID NO: 720570 - DNA, 22 bp, Artificial Sequence
  chemically synthesized
acatccctgttttcctgctcaa

SEQ ID NO: 720571 - DNA, 22 bp, Artificial Sequence
  chemically synthesized
catccctgttttcctgctcaaa

SEQ ID NO: 720572 - DNA, 22 bp, Artificial Sequence
  chemically synthesized
gaaaaggcaacatttgagcagg

SEQ ID NO: 720573 - DNA, 22 bp, Artificial Sequence
  chemically synthesized
ggaaaaggcaacatttgagcag

SEQ ID NO: 720574 - DNA, 22 bp, Artificial Sequence
  chemically synthesized
tggaaaaggcaacatttgagca

SEQ ID NO: 720575 - DNA, 22 bp, Artificial Sequence
  chemically synthesized
ttttcctgctcaaatgttgcct

SEQ ID NO: 720576 - DNA, 22 bp, Artificial Sequence
  chemically synthesized
tcctgctcaaatgttgcctttt

SEQ ID NO: 720577 - DNA, 22 bp, Artificial Sequence
  chemically synthesized
cctgctcaaatgttgccttttc

SEQ ID NO: 720578 - DNA, 22 bp, Artificial Sequence
  chemically synthesized
tgggtggttttggaaaaggcaa

SEQ ID NO: 720579 - DNA, 22 bp, Artificial Sequence
  chemically synthesized
ctgctcaaatgttgccttttcc

SEQ ID NO: 720580 - DNA, 22 bp, Artificial Sequence
  chemically synthesized
ctcaaatgttgccttttccaaa

SEQ ID NO: 720581 - DNA, 22 bp, Artificial Sequence
  chemically synthesized
aaatgttgccttttccaaaacc

SEQ ID NO: 720582 - DNA, 22 bp, Artificial Sequence
  chemically synthesized
ccttttccaaaaccacccatag

SEQ ID NO: 720583 - DNA, 22 bp, Artificial Sequence
  chemically synthesized
ttccaaaaccacccatagccca

SEQ ID NO: 720584 - DNA, 22 bp, Artificial Sequence
  chemically synthesized
tccaaaaccacccatagcccac

SEQ ID NO: 720585 - DNA, 22 bp, Artificial Sequence
  chemically synthesized
ccaaaaccacccatagcccacc

SEQ ID NO: 720586 - DNA, 22 bp, Artificial Sequence
  chemically synthesized
caaaaccacccatagcccaccc

SEQ ID NO: 720587 - DNA, 22 bp, Artificial Sequence
  chemically synthesized
caggcacaggatggagggcagg

SEQ ID NO: 720588 - DNA, 22 bp, Artificial Sequence
  chemically synthesized
acaggcacaggatggagggcag

SEQ ID NO: 720589 - DNA, 22 bp, Artificial Sequence
  chemically synthesized
tacaggcacaggatggagggca

SEQ ID NO: 720590 - DNA, 22 bp, Artificial Sequence
  chemically synthesized
ttacaggcacaggatggagggc

SEQ ID NO: 720591 - DNA, 22 bp, Artificial Sequence
  chemically synthesized
ggatttttacaggcacaggatg

SEQ ID NO: 720592 - DNA, 22 bp, Artificial Sequence
  chemically synthesized
agcctgggatttttacaggcac

SEQ ID NO: 720593 - DNA, 22 bp, Artificial Sequence
  chemically synthesized
ccctccatcctgtgcctgtaaa

SEQ ID NO: 720594 - DNA, 22 bp, Artificial Sequence
  chemically synthesized
catcctgtgcctgtaaaaatcc

SEQ ID NO: 720595 - DNA, 22 bp, Artificial Sequence
  chemically synthesized
tgccggctgagcctgggatttt

SEQ ID NO: 720596 - DNA, 22 bp, Artificial Sequence
  chemically synthesized
tgtgccggctgagcctgggatt

SEQ ID NO: 720597 - DNA, 22 bp, Artificial Sequence
  chemically synthesized
tgcctgtaaaaatcccaggctc

SEQ ID NO: 720598 - DNA, 22 bp, Artificial Sequence
  chemically synthesized
ctctgtgccggctgagcctggg

SEQ ID NO: 720599 - DNA, 22 bp, Artificial Sequence
  chemically synthesized
tcctctgtgccggctgagcctg

SEQ ID NO: 720600 - DNA, 22 bp, Artificial Sequence
  chemically synthesized
ctcctctgtgccggctgagcct

SEQ ID NO: 720601 - DNA, 22 bp, Artificial Sequence
  chemically synthesized
taaaaatcccaggctcagccgg

SEQ ID NO: 720602 - DNA, 22 bp, Artificial Sequence
  chemically synthesized
cttctcctctgtgccggctgag

SEQ ID NO: 720603 - DNA, 22 bp, Artificial Sequence
  chemically synthesized
caacatccagctgcttctcctc

SEQ ID NO: 720604 - DNA, 22 bp, Artificial Sequence
  chemically synthesized
ccaacatccagctgcttctcct

SEQ ID NO: 720605 - DNA, 22 bp, Artificial Sequence
  chemically synthesized
agccggcacagaggagaagcag

SEQ ID NO: 720606 - DNA, 22 bp, Artificial Sequence
  chemically synthesized
caatgcacaaccatagtttcca

SEQ ID NO: 720607 - DNA, 22 bp, Artificial Sequence
  chemically synthesized
tccaatgcacaaccatagtttc

SEQ ID NO: 720608 - DNA, 22 bp, Artificial Sequence
  chemically synthesized
tctccaatgcacaaccatagtt

SEQ ID NO: 720609 - DNA, 22 bp, Artificial Sequence
  chemically synthesized
ctctccaatgcacaaccatagt

SEQ ID NO: 720610 - DNA, 22 bp, Artificial Sequence
  chemically synthesized
gatgttggaaactatggttgtg

SEQ ID NO: 720611 - DNA, 22 bp, Artificial Sequence
  chemically synthesized
gaaactatggttgtgcattgga

SEQ ID NO: 720612 - DNA, 22 bp, Artificial Sequence
  chemically synthesized
tggttgtgcattggagagaagt

SEQ ID NO: 720613 - DNA, 22 bp, Artificial Sequence
  chemically synthesized
ggaagtcaagccacttctctcc

SEQ ID NO: 720614 - DNA, 22 bp, Artificial Sequence
  chemically synthesized
tgcattggagagaagtggcttg

SEQ ID NO: 720615 - DNA, 22 bp, Artificial Sequence
  chemically synthesized
tccctcggaagtcaagccactt

SEQ ID NO: 720616 - DNA, 22 bp, Artificial Sequence
  chemically synthesized
gagagaagtggcttgacttccg

SEQ ID NO: 720617 - DNA, 22 bp, Artificial Sequence
  chemically synthesized
ccaggctgtccctcggaagtca

SEQ ID NO: 720618 - DNA, 22 bp, Artificial Sequence
  chemically synthesized
tgctgccaggctgtccctcgga

SEQ ID NO: 720619 - DNA, 22 bp, Artificial Sequence
  chemically synthesized
aagctatgctgccaggctgtcc

SEQ ID NO: 720620 - DNA, 22 bp, Artificial Sequence
  chemically synthesized
gacttccgagggacagcctggc

SEQ ID NO: 720621 - DNA, 22 bp, Artificial Sequence
  chemically synthesized
tgaagctatgctgccaggctgt

SEQ ID NO: 720622 - DNA, 22 bp, Artificial Sequence
  chemically synthesized
acttccgagggacagcctggca

SEQ ID NO: 720623 - DNA, 22 bp, Artificial Sequence
  chemically synthesized
tctgaagctatgctgccaggct

SEQ ID NO: 720624 - DNA, 22 bp, Artificial Sequence
  chemically synthesized
ccgagggacagcctggcagcat

SEQ ID NO: 720625 - DNA, 22 bp, Artificial Sequence
  chemically synthesized
ctctctgaagctatgctgccag

SEQ ID NO: 720626 - DNA, 22 bp, Artificial Sequence
  chemically synthesized
cgagggacagcctggcagcata

SEQ ID NO: 720627 - DNA, 22 bp, Artificial Sequence
  chemically synthesized
gcagcatagcttcagagaggag

SEQ ID NO: 720628 - DNA, 22 bp, Artificial Sequence
  chemically synthesized
tccgcaatcagactcctctctg

SEQ ID NO: 720629 - DNA, 22 bp, Artificial Sequence
  chemically synthesized
gagtccagctgtccgcaatcag

SEQ ID NO: 720630 - DNA, 22 bp, Artificial Sequence
  chemically synthesized
cagagaggagtctgattgcgga

SEQ ID NO: 720631 - DNA, 22 bp, Artificial Sequence
  chemically synthesized
agagaggagtctgattgcggac

SEQ ID NO: 720632 - DNA, 22 bp, Artificial Sequence
  chemically synthesized
acctcgagtccagctgtccgca

SEQ ID NO: 720633 - DNA, 22 bp, Artificial Sequence
  chemically synthesized
cacctcgagtccagctgtccgc

SEQ ID NO: 720634 - DNA, 22 bp, Artificial Sequence
  chemically synthesized
attgcggacagctggactcgag

SEQ ID NO: 720635 - DNA, 22 bp, Artificial Sequence
  chemically synthesized
cggacagctggactcgaggtga

SEQ ID NO: 720636 - DNA, 22 bp, Artificial Sequence
  chemically synthesized
gactcgaggtgaagattacctt

SEQ ID NO: 720637 - DNA, 22 bp, Artificial Sequence
  chemically synthesized
gaggtgaagattaccttcctgc

SEQ ID NO: 720638 - DNA, 22 bp, Artificial Sequence
  chemically synthesized
aaaaggggacagagcaggaagg

SEQ ID NO: 720639 - DNA, 22 bp, Artificial Sequence
  chemically synthesized
ccttcctgctctgtcccctttt

SEQ ID NO: 720640 - DNA, 22 bp, Artificial Sequence
  chemically synthesized
cctgctctgtccccttttcagc

SEQ ID NO: 720641 - DNA, 22 bp, Artificial Sequence
  chemically synthesized
ctgctctgtccccttttcagct

SEQ ID NO: 720642 - DNA, 22 bp, Artificial Sequence
  chemically synthesized
agcaggaaaaggagctgaaaag

SEQ ID NO: 720643 - DNA, 22 bp, Artificial Sequence
  chemically synthesized
tcagcaggaaaaggagctgaaa

SEQ ID NO: 720644 - DNA, 22 bp, Artificial Sequence
  chemically synthesized
ctctgtccccttttcagctcct

SEQ ID NO: 720645 - DNA, 22 bp, Artificial Sequence
  chemically synthesized
tgtccccttttcagctcctttt

SEQ ID NO: 720646 - DNA, 22 bp, Artificial Sequence
  chemically synthesized
tccccttttcagctccttttcc

SEQ ID NO: 720647 - DNA, 22 bp, Artificial Sequence
  chemically synthesized
ttcagctccttttcctgctgag

SEQ ID NO: 720648 - DNA, 22 bp, Artificial Sequence
  chemically synthesized
atgaaagtggctctcagcagga

SEQ ID NO: 720649 - DNA, 22 bp, Artificial Sequence
  chemically synthesized
tcagctccttttcctgctgaga

SEQ ID NO: 720650 - DNA, 22 bp, Artificial Sequence
  chemically synthesized
cagctccttttcctgctgagag

SEQ ID NO: 720651 - DNA, 22 bp, Artificial Sequence
  chemically synthesized
agctccttttcctgctgagagc

SEQ ID NO: 720652 - DNA, 22 bp, Artificial Sequence
  chemically synthesized
ctgatgaaagtggctctcagca

SEQ ID NO: 720653 - DNA, 22 bp, Artificial Sequence
  chemically synthesized
ttgctgatgaaagtggctctca

SEQ ID NO: 720654 - DNA, 22 bp, Artificial Sequence
  chemically synthesized
attgctgatgaaagtggctctc

SEQ ID NO: 720655 - DNA, 22 bp, Artificial Sequence
  chemically synthesized
cttttcctgctgagagccactt

SEQ ID NO: 720656 - DNA, 22 bp, Artificial Sequence
  chemically synthesized
tattgctgatgaaagtggctct

SEQ ID NO: 720657 - DNA, 22 bp, Artificial Sequence
  chemically synthesized
ttcctgctgagagccactttca

SEQ ID NO: 720658 - DNA, 22 bp, Artificial Sequence
  chemically synthesized
tcctgctgagagccactttcat

SEQ ID NO: 720659 - DNA, 22 bp, Artificial Sequence
  chemically synthesized
cctgctgagagccactttcatc

SEQ ID NO: 720660 - DNA, 22 bp, Artificial Sequence
  chemically synthesized
ctgctgagagccactttcatca

SEQ ID NO: 720661 - DNA, 22 bp, Artificial Sequence
  chemically synthesized
ctgagagccactttcatcagca

SEQ ID NO: 720662 - DNA, 22 bp, Artificial Sequence
  chemically synthesized
agagccactttcatcagcaata

SEQ ID NO: 720663 - DNA, 22 bp, Artificial Sequence
  chemically synthesized
tcatcagcaataaaatcccccg

SEQ ID NO: 720664 - DNA, 22 bp, Artificial Sequence
  chemically synthesized
catcagcaataaaatcccccgc

SEQ ID NO: 720665 - DNA, 22 bp, Artificial Sequence
  chemically synthesized
gagatggtaaatgcgggggatt

SEQ ID NO: 720666 - DNA, 22 bp, Artificial Sequence
  chemically synthesized
atcagcaataaaatcccccgca

SEQ ID NO: 720667 - DNA, 22 bp, Artificial Sequence
  chemically synthesized
attggagatggtaaatgcgggg

SEQ ID NO: 720668 - DNA, 22 bp, Artificial Sequence
  chemically synthesized
accatctccaattagtttgtgt

SEQ ID NO: 720669 - DNA, 22 bp, Artificial Sequence
  chemically synthesized
ccatctccaattagtttgtgtg

SEQ ID NO: 720670 - DNA, 22 bp, Artificial Sequence
  chemically synthesized
caggaggaatgaggtcacacaa

SEQ ID NO: 720671 - DNA, 22 bp, Artificial Sequence
  chemically synthesized
ccaggaggaatgaggtcacaca

SEQ ID NO: 720672 - DNA, 22 bp, Artificial Sequence
  chemically synthesized
tccaggaggaatgaggtcacac

SEQ ID NO: 720673 - DNA, 22 bp, Artificial Sequence
  chemically synthesized
caattagtttgtgtgacctcat

SEQ ID NO: 720674 - DNA, 22 bp, Artificial Sequence
  chemically synthesized
cccattttccaggaggaatgag

SEQ ID NO: 720675 - DNA, 22 bp, Artificial Sequence
  chemically synthesized
gtttgtgtgacctcattcctcc

SEQ ID NO: 720676 - DNA, 22 bp, Artificial Sequence
  chemically synthesized
gcccattttccaggaggaatga

SEQ ID NO: 720677 - DNA, 22 bp, Artificial Sequence
  chemically synthesized
gtgtgacctcattcctcctgga

SEQ ID NO: 720678 - DNA, 22 bp, Artificial Sequence
  chemically synthesized
tgtgacctcattcctcctggaa

SEQ ID NO: 720679 - DNA, 22 bp, Artificial Sequence
  chemically synthesized
agatcttgcccattttccagga

SEQ ID NO: 720680 - DNA, 22 bp, Artificial Sequence
  chemically synthesized
attcctcctggaaaatgggcaa

SEQ ID NO: 720681 - DNA, 22 bp, Artificial Sequence
  chemically synthesized
tggcacctcagatcttgcccat

SEQ ID NO: 720682 - DNA, 22 bp, Artificial Sequence
  chemically synthesized
gtggcacctcagatcttgccca

SEQ ID NO: 720683 - DNA, 22 bp, Artificial Sequence
  chemically synthesized
ctcctggaaaatgggcaagatc

SEQ ID NO: 720684 - DNA, 22 bp, Artificial Sequence
  chemically synthesized
ctggaaaatgggcaagatctga

SEQ ID NO: 720685 - DNA, 22 bp, Artificial Sequence
  chemically synthesized
gcacttgtggcacctcagatct

SEQ ID NO: 720686 - DNA, 22 bp, Artificial Sequence
  chemically synthesized
gaaaatgggcaagatctgaggt

SEQ ID NO: 720687 - DNA, 22 bp, Artificial Sequence
  chemically synthesized
tactcgcacttgtggcacctca

SEQ ID NO: 720688 - DNA, 22 bp, Artificial Sequence
  chemically synthesized
tgtactcgcacttgtggcacct

SEQ ID NO: 720689 - DNA, 22 bp, Artificial Sequence
  chemically synthesized
ctgtactcgcacttgtggcacc

SEQ ID NO: 720690 - DNA, 22 bp, Artificial Sequence
  chemically synthesized
aggtgccacaagtgcgagtaca

SEQ ID NO: 720691 - DNA, 22 bp, Artificial Sequence
  chemically synthesized
agtggagggtcagtgtgacagc

SEQ ID NO: 720692 - DNA, 22 bp, Artificial Sequence
  chemically synthesized
acagctcagtggagggtcagtg

SEQ ID NO: 720693 - DNA, 22 bp, Artificial Sequence
  chemically synthesized
agtgttaacagctcagtggagg

SEQ ID NO: 720694 - DNA, 22 bp, Artificial Sequence
  chemically synthesized
aagtgttaacagctcagtggag

SEQ ID NO: 720695 - DNA, 22 bp, Artificial Sequence
  chemically synthesized
tcacactgaccctccactgagc

SEQ ID NO: 720696 - DNA, 22 bp, Artificial Sequence
  chemically synthesized
accctccactgagctgttaaca

SEQ ID NO: 720697 - DNA, 22 bp, Artificial Sequence
  chemically synthesized
cagatggcttaagtgttaacag

SEQ ID NO: 720698 - DNA, 22 bp, Artificial Sequence
  chemically synthesized
cactgagctgttaacacttaag

SEQ ID NO: 720699 - DNA, 22 bp, Artificial Sequence
  chemically synthesized
ccatctgcagatggcttaagtg

SEQ ID NO: 720700 - DNA, 22 bp, Artificial Sequence
  chemically synthesized
gccatctgcagatggcttaagt

SEQ ID NO: 720701 - DNA, 22 bp, Artificial Sequence
  chemically synthesized
tgccatctgcagatggcttaag

SEQ ID NO: 720702 - DNA, 22 bp, Artificial Sequence
  chemically synthesized
agctgttaacacttaagccatc

SEQ ID NO: 720703 - DNA, 22 bp, Artificial Sequence
  chemically synthesized
tctttgccatctgcagatggct

SEQ ID NO: 720704 - DNA, 22 bp, Artificial Sequence
  chemically synthesized
atctttgccatctgcagatggc

SEQ ID NO: 720705 - DNA, 22 bp, Artificial Sequence
  chemically synthesized
ttaacacttaagccatctgcag

SEQ ID NO: 720706 - DNA, 22 bp, Artificial Sequence
  chemically synthesized
tatctttgccatctgcagatgg

SEQ ID NO: 720707 - DNA, 22 bp, Artificial Sequence
  chemically synthesized
ttatctttgccatctgcagatg

SEQ ID NO: 720708 - DNA, 22 bp, Artificial Sequence
  chemically synthesized
acacttaagccatctgcagatg

SEQ ID NO: 720709 - DNA, 22 bp, Artificial Sequence
  chemically synthesized
aagccatctgcagatggcaaag

SEQ ID NO: 720710 - DNA, 22 bp, Artificial Sequence
  chemically synthesized
agccatctgcagatggcaaaga

SEQ ID NO: 720711 - DNA, 22 bp, Artificial Sequence
  chemically synthesized
cagggcccttttatctttgcca

SEQ ID NO: 720712 - DNA, 22 bp, Artificial Sequence
  chemically synthesized
cagatggcaaagataaaagggc

SEQ ID NO: 720713 - DNA, 22 bp, Artificial Sequence
  chemically synthesized
aatccccagaaggagtgttaca

SEQ ID NO: 720714 - DNA, 22 bp, Artificial Sequence
  chemically synthesized
gaatccccagaaggagtgttac

SEQ ID NO: 720715 - DNA, 22 bp, Artificial Sequence
  chemically synthesized
taacactccttctggggattca

SEQ ID NO: 720716 - DNA, 22 bp, Artificial Sequence
  chemically synthesized
ggagggtgcccgcgacccttga

SEQ ID NO: 720717 - DNA, 22 bp, Artificial Sequence
  chemically synthesized
cttctggggattcaagggtcgc

SEQ ID NO: 720718 - DNA, 22 bp, Artificial Sequence
  chemically synthesized
ctggggattcaagggtcgcggg

SEQ ID NO: 720719 - DNA, 22 bp, Artificial Sequence
  chemically synthesized
tggggattcaagggtcgcgggc

SEQ ID NO: 720720 - DNA, 22 bp, Artificial Sequence
  chemically synthesized
gggattcaagggtcgcgggcac

SEQ ID NO: 720721 - DNA, 22 bp, Artificial Sequence
  chemically synthesized
aagggtcgcgggcaccctccta

SEQ ID NO: 720722 - DNA, 22 bp, Artificial Sequence
  chemically synthesized
tgtgggccccatggcagtgtct

SEQ ID NO: 720723 - DNA, 22 bp, Artificial Sequence
  chemically synthesized
tgtgtgggccccatggcagtgt

SEQ ID NO: 720724 - DNA, 22 bp, Artificial Sequence
  chemically synthesized
ctagacactgccatggggccca

SEQ ID NO: 720725 - DNA, 22 bp, Artificial Sequence
  chemically synthesized
gacactgccatggggcccacac

SEQ ID NO: 720726 - DNA, 22 bp, Artificial Sequence
  chemically synthesized
ccatggggcccacacagagttt

SEQ ID NO: 720727 - DNA, 22 bp, Artificial Sequence
  chemically synthesized
ggcgccagcaggaacaaaactc

SEQ ID NO: 720728 - DNA, 22 bp, Artificial Sequence
  chemically synthesized
gggcgccagcaggaacaaaact

SEQ ID NO: 720729 - DNA, 22 bp, Artificial Sequence
  chemically synthesized
tgggcgccagcaggaacaaaac

SEQ ID NO: 720730 - DNA, 22 bp, Artificial Sequence
  chemically synthesized
ttgggcgccagcaggaacaaaa

SEQ ID NO: 720731 - DNA, 22 bp, Artificial Sequence
  chemically synthesized
tgttcctgctggcgcccaaaag

SEQ ID NO: 720732 - DNA, 22 bp, Artificial Sequence
  chemically synthesized
gttcctgctggcgcccaaaagc

SEQ ID NO: 720733 - DNA, 22 bp, Artificial Sequence
  chemically synthesized
ttcctgctggcgcccaaaagca

SEQ ID NO: 720734 - DNA, 22 bp, Artificial Sequence
  chemically synthesized
ctgctggcgcccaaaagcactc

SEQ ID NO: 720735 - DNA, 22 bp, Artificial Sequence
  chemically synthesized
ctggcgcccaaaagcactcacc

SEQ ID NO: 720736 - DNA, 22 bp, Artificial Sequence
  chemically synthesized
gcgcccaaaagcactcaccctg

SEQ ID NO: 720737 - DNA, 22 bp, Artificial Sequence
  chemically synthesized
accctggctcctgtacccactc

SEQ ID NO: 720738 - DNA, 22 bp, Artificial Sequence
  chemically synthesized
gctcctgtacccactcacctgt

SEQ ID NO: 720739 - DNA, 22 bp, Artificial Sequence
  chemically synthesized
atgggagaggaagcacaggtga

SEQ ID NO: 720740 - DNA, 22 bp, Artificial Sequence
  chemically synthesized
ctgtacccactcacctgtgctt

SEQ ID NO: 720741 - DNA, 22 bp, Artificial Sequence
  chemically synthesized
tacccactcacctgtgcttcct

SEQ ID NO: 720742 - DNA, 22 bp, Artificial Sequence
  chemically synthesized
cacccctcatgggagaggaagc

SEQ ID NO: 720743 - DNA, 22 bp, Artificial Sequence
  chemically synthesized
agttccacccctcatgggagag

SEQ ID NO: 720744 - DNA, 22 bp, Artificial Sequence
  chemically synthesized
acctgtgcttcctctcccatga

SEQ ID NO: 720745 - DNA, 22 bp, Artificial Sequence
  chemically synthesized
actgagttccacccctcatggg

SEQ ID NO: 720746 - DNA, 22 bp, Artificial Sequence
  chemically synthesized
tgcttcctctcccatgaggggt

SEQ ID NO: 720747 - DNA, 22 bp, Artificial Sequence
  chemically synthesized
agtctcactgagttccacccct

SEQ ID NO: 720748 - DNA, 22 bp, Artificial Sequence
  chemically synthesized
cctctcccatgaggggtggaac

SEQ ID NO: 720749 - DNA, 22 bp, Artificial Sequence
  chemically synthesized
ctctcccatgaggggtggaact

SEQ ID NO: 720750 - DNA, 22 bp, Artificial Sequence
  chemically synthesized
gctcagtctcactgagttccac

SEQ ID NO: 720751 - DNA, 22 bp, Artificial Sequence
  chemically synthesized
tcccatgaggggtggaactcag

SEQ ID NO: 720752 - DNA, 22 bp, Artificial Sequence
  chemically synthesized
ccatgaggggtggaactcagtg

SEQ ID NO: 720753 - DNA, 22 bp, Artificial Sequence
  chemically synthesized
cactggctcagtctcactgagt

SEQ ID NO: 720754 - DNA, 22 bp, Artificial Sequence
  chemically synthesized
gcaggggcagactccactggct

SEQ ID NO: 720755 - DNA, 22 bp, Artificial Sequence
  chemically synthesized
agtgagactgagccagtggagt

SEQ ID NO: 720756 - DNA, 22 bp, Artificial Sequence
  chemically synthesized
ggtgctggcaggggcagactcc

SEQ ID NO: 720757 - DNA, 22 bp, Artificial Sequence
  chemically synthesized
cggtgctggcaggggcagactc

SEQ ID NO: 720758 - DNA, 22 bp, Artificial Sequence
  chemically synthesized
agccagtggagtctgcccctgc

SEQ ID NO: 720759 - DNA, 22 bp, Artificial Sequence
  chemically synthesized
catagccgcttcggtgctggca

SEQ ID NO: 720760 - DNA, 22 bp, Artificial Sequence
  chemically synthesized
gactgcatagccgcttcggtgc

SEQ ID NO: 720761 - DNA, 22 bp, Artificial Sequence
  chemically synthesized
cccctgccagcaccgaagcggc

SEQ ID NO: 720762 - DNA, 22 bp, Artificial Sequence
  chemically synthesized
ccagcaccgaagcggctatgca

SEQ ID NO: 720763 - DNA, 22 bp, Artificial Sequence
  chemically synthesized
gcgggcgggaactggactgcat

SEQ ID NO: 720764 - DNA, 22 bp, Artificial Sequence
  chemically synthesized
atcccctcgcgggcgggaactg

SEQ ID NO: 720765 - DNA, 22 bp, Artificial Sequence
  chemically synthesized
tgcagtccagttcccgcccgcg

SEQ ID NO: 720766 - DNA, 22 bp, Artificial Sequence
  chemically synthesized
ccctgatcccctcgcgggcggg

SEQ ID NO: 720767 - DNA, 22 bp, Artificial Sequence
  chemically synthesized
ccgcccgcgaggggatcagggt

SEQ ID NO: 720768 - DNA, 22 bp, Artificial Sequence
  chemically synthesized
cttcactactactactactact

SEQ ID NO: 720769 - DNA, 22 bp, Artificial Sequence
  chemically synthesized
cactactactactactactact

SEQ ID NO: 720770 - DNA, 22 bp, Artificial Sequence
  chemically synthesized
actactactactactactacta

SEQ ID NO: 720771 - DNA, 22 bp, Artificial Sequence
  chemically synthesized
ctactactactactactactac

SEQ ID NO: 720772 - DNA, 22 bp, Artificial Sequence
  chemically synthesized
ctactactactactactactac

SEQ ID NO: 720773 - DNA, 22 bp, Artificial Sequence
  chemically synthesized
ctactactactactactactac

SEQ ID NO: 720774 - DNA, 22 bp, Artificial Sequence
  chemically synthesized
ctactactactactactactac

SEQ ID NO: 720775 - DNA, 22 bp, Artificial Sequence
  chemically synthesized
ctactactactactactactac

SEQ ID NO: 720776 - DNA, 22 bp, Artificial Sequence
  chemically synthesized
ctactactactactactactac

SEQ ID NO: 720777 - DNA, 22 bp, Artificial Sequence
  chemically synthesized
aagtagtagtagtagtagtagt

SEQ ID NO: 720778 - DNA, 22 bp, Artificial Sequence
  chemically synthesized
ctactactactactactactac

SEQ ID NO: 720779 - DNA, 22 bp, Artificial Sequence
  chemically synthesized
ctactactactactactactac

SEQ ID NO: 720780 - DNA, 22 bp, Artificial Sequence
  chemically synthesized
ctactactactactactactac

SEQ ID NO: 720781 - DNA, 22 bp, Artificial Sequence
  chemically synthesized
tgaagctaaagtagtagtagta

SEQ ID NO: 720782 - DNA, 22 bp, Artificial Sequence
  chemically synthesized
ctactactactactactactac

SEQ ID NO: 720783 - DNA, 22 bp, Artificial Sequence
  chemically synthesized
ctactactactactactacttt

SEQ ID NO: 720784 - DNA, 22 bp, Artificial Sequence
  chemically synthesized
atatctatgaagctaaagtagt

SEQ ID NO: 720785 - DNA, 22 bp, Artificial Sequence
  chemically synthesized
ctactactactactactttagc

SEQ ID NO: 720786 - DNA, 22 bp, Artificial Sequence
  chemically synthesized
ctactactactactttagcttc

SEQ ID NO: 720787 - DNA, 22 bp, Artificial Sequence
  chemically synthesized
ctactactactttagcttcata

SEQ ID NO: 720788 - DNA, 22 bp, Artificial Sequence
  chemically synthesized
ctactactttagcttcatagat

SEQ ID NO: 720789 - DNA, 22 bp, Artificial Sequence
  chemically synthesized
ctactttagcttcatagatatc

SEQ ID NO: 720790 - DNA, 22 bp, Artificial Sequence
  chemically synthesized
ctttagcttcatagatatcaat

SEQ ID NO: 720791 - DNA, 22 bp, Artificial Sequence
  chemically synthesized
tagcttcatagatatcaattct

SEQ ID NO: 720792 - DNA, 22 bp, Artificial Sequence
  chemically synthesized
agcttcatagatatcaattctt

SEQ ID NO: 720793 - DNA, 22 bp, Artificial Sequence
  chemically synthesized
gcttcatagatatcaattcttg

SEQ ID NO: 720794 - DNA, 22 bp, Artificial Sequence
  chemically synthesized
catagatatcaattcttgcttt

SEQ ID NO: 720795 - DNA, 22 bp, Artificial Sequence
  chemically synthesized
atagatatcaattcttgctttt

SEQ ID NO: 720796 - DNA, 22 bp, Artificial Sequence
  chemically synthesized
ttgctttttggttgtgattttg

SEQ ID NO: 720797 - DNA, 22 bp, Artificial Sequence
  chemically synthesized
gtcatcagagtacaaaatcaca

SEQ ID NO: 720798 - DNA, 22 bp, Artificial Sequence
  chemically synthesized
gctttttggttgtgattttgta

SEQ ID NO: 720799 - DNA, 22 bp, Artificial Sequence
  chemically synthesized
tggtcatcagagtacaaaatca

SEQ ID NO: 720800 - DNA, 22 bp, Artificial Sequence
  chemically synthesized
ctttttggttgtgattttgtac

SEQ ID NO: 720801 - DNA, 22 bp, Artificial Sequence
  chemically synthesized
tctggtcatcagagtacaaaat

SEQ ID NO: 720802 - DNA, 22 bp, Artificial Sequence
  chemically synthesized
ctctggtcatcagagtacaaaa

SEQ ID NO: 720803 - DNA, 22 bp, Artificial Sequence
  chemically synthesized
tttggttgtgattttgtactct

SEQ ID NO: 720804 - DNA, 22 bp, Artificial Sequence
  chemically synthesized
ttggttgtgattttgtactctg

SEQ ID NO: 720805 - DNA, 22 bp, Artificial Sequence
  chemically synthesized
ttctctggtcatcagagtacaa

SEQ ID NO: 720806 - DNA, 22 bp, Artificial Sequence
  chemically synthesized
tggttgtgattttgtactctga

SEQ ID NO: 720807 - DNA, 22 bp, Artificial Sequence
  chemically synthesized
ggttgtgattttgtactctgat

SEQ ID NO: 720808 - DNA, 22 bp, Artificial Sequence
  chemically synthesized
tcttctctggtcatcagagtac

SEQ ID NO: 720809 - DNA, 22 bp, Artificial Sequence
  chemically synthesized
gttgtgattttgtactctgatg

SEQ ID NO: 720810 - DNA, 22 bp, Artificial Sequence
  chemically synthesized
ttctcttctctggtcatcagag

SEQ ID NO: 720811 - DNA, 22 bp, Artificial Sequence
  chemically synthesized
tgattttgtactctgatgacca

SEQ ID NO: 720812 - DNA, 22 bp, Artificial Sequence
  chemically synthesized
tgtactctgatgaccagagaag

SEQ ID NO: 720813 - DNA, 22 bp, Artificial Sequence
  chemically synthesized
gtactctgatgaccagagaaga

SEQ ID NO: 720814 - DNA, 22 bp, Artificial Sequence
  chemically synthesized
tactctgatgaccagagaagag

SEQ ID NO: 720815 - DNA, 22 bp, Artificial Sequence
  chemically synthesized
cacaggtccctgttctcttctc

SEQ ID NO: 720816 - DNA, 22 bp, Artificial Sequence
  chemically synthesized
tgatgaccagagaagagaacag

SEQ ID NO: 720817 - DNA, 22 bp, Artificial Sequence
  chemically synthesized
atgaccagagaagagaacaggg

SEQ ID NO: 720818 - DNA, 22 bp, Artificial Sequence
  chemically synthesized
tattccacaggtccctgttctc

SEQ ID NO: 720819 - DNA, 22 bp, Artificial Sequence
  chemically synthesized
atattccacaggtccctgttct

SEQ ID NO: 720820 - DNA, 22 bp, Artificial Sequence
  chemically synthesized
accatgaatttatattccacag

SEQ ID NO: 720821 - DNA, 22 bp, Artificial Sequence
  chemically synthesized
caccatgaatttatattccaca

SEQ ID NO: 720822 - DNA, 22 bp, Artificial Sequence
  chemically synthesized
tggaatataaattcatggtgaa

SEQ ID NO: 720823 - DNA, 22 bp, Artificial Sequence
  chemically synthesized
ataacataacatgtacttcacc

SEQ ID NO: 720824 - DNA, 22 bp, Artificial Sequence
  chemically synthesized
aagaattgataacataacatgt

SEQ ID NO: 720825 - DNA, 22 bp, Artificial Sequence
  chemically synthesized
caagaattgataacataacatg

SEQ ID NO: 720826 - DNA, 22 bp, Artificial Sequence
  chemically synthesized
atggtgaagtacatgttatgtt

SEQ ID NO: 720827 - DNA, 22 bp, Artificial Sequence
  chemically synthesized
tcaagaattgataacataacat

SEQ ID NO: 720828 - DNA, 22 bp, Artificial Sequence
  chemically synthesized
ttcaagaattgataacataaca

SEQ ID NO: 720829 - DNA, 22 bp, Artificial Sequence
  chemically synthesized
agggtttttcaagaattgataa

SEQ ID NO: 720830 - DNA, 22 bp, Artificial Sequence
  chemically synthesized
cagggtttttcaagaattgata

SEQ ID NO: 720831 - DNA, 22 bp, Artificial Sequence
  chemically synthesized
catttcagggtttttcaagaat

SEQ ID NO: 720832 - DNA, 22 bp, Artificial Sequence
  chemically synthesized
tgttatcaattcttgaaaaacc

SEQ ID NO: 720833 - DNA, 22 bp, Artificial Sequence
  chemically synthesized
tcaattcttgaaaaaccctgaa

SEQ ID NO: 720834 - DNA, 22 bp, Artificial Sequence
  chemically synthesized
ttgaaaaaccctgaaatgtaga

SEQ ID NO: 720835 - DNA, 22 bp, Artificial Sequence
  chemically synthesized
gaaaaaccctgaaatgtagact

SEQ ID NO: 720836 - DNA, 22 bp, Artificial Sequence
  chemically synthesized
aaaaaccctgaaatgtagactc

SEQ ID NO: 720837 - DNA, 22 bp, Artificial Sequence
  chemically synthesized
catgggggaaatgagtctacat

SEQ ID NO: 720838 - DNA, 22 bp, Artificial Sequence
  chemically synthesized
aaatgtagactcatttccccca

SEQ ID NO: 720839 - DNA, 22 bp, Artificial Sequence
  chemically synthesized
aaaaacaacaaacctgcatggg

SEQ ID NO: 720840 - DNA, 22 bp, Artificial Sequence
  chemically synthesized
ctcaaaaacaacaaacctgcat

SEQ ID NO: 720841 - DNA, 22 bp, Artificial Sequence
  chemically synthesized
cctcaaaaacaacaaacctgca

SEQ ID NO: 720842 - DNA, 22 bp, Artificial Sequence
  chemically synthesized
tcctcaaaaacaacaaacctgc

SEQ ID NO: 720843 - DNA, 22 bp, Artificial Sequence
  chemically synthesized
atttcccccatgcaggtttgtt

SEQ ID NO: 720844 - DNA, 22 bp, Artificial Sequence
  chemically synthesized
tttcctcaaaaacaacaaacct

SEQ ID NO: 720845 - DNA, 22 bp, Artificial Sequence
  chemically synthesized
ctttcctcaaaaacaacaaacc

SEQ ID NO: 720846 - DNA, 22 bp, Artificial Sequence
  chemically synthesized
cccccatgcaggtttgttgttt

SEQ ID NO: 720847 - DNA, 22 bp, Artificial Sequence
  chemically synthesized
ccccatgcaggtttgttgtttt

SEQ ID NO: 720848 - DNA, 22 bp, Artificial Sequence
  chemically synthesized
tcatttctttcctcaaaaacaa

SEQ ID NO: 720849 - DNA, 22 bp, Artificial Sequence
  chemically synthesized
acagctgtcatttctttcctca

SEQ ID NO: 720850 - DNA, 22 bp, Artificial Sequence
  chemically synthesized
cacagctgtcatttctttcctc

SEQ ID NO: 720851 - DNA, 22 bp, Artificial Sequence
  chemically synthesized
gttgtttttgaggaaagaaatg

SEQ ID NO: 720852 - DNA, 22 bp, Artificial Sequence
  chemically synthesized
tttcacagctgtcatttctttc

SEQ ID NO: 720853 - DNA, 22 bp, Artificial Sequence
  chemically synthesized
ttgtttttgaggaaagaaatga

SEQ ID NO: 720854 - DNA, 22 bp, Artificial Sequence
  chemically synthesized
gtttcacagctgtcatttcttt

SEQ ID NO: 720855 - DNA, 22 bp, Artificial Sequence
  chemically synthesized
tttttgaggaaagaaatgacag

SEQ ID NO: 720856 - DNA, 22 bp, Artificial Sequence
  chemically synthesized
gacttgtttcacagctgtcatt

SEQ ID NO: 720857 - DNA, 22 bp, Artificial Sequence
  chemically synthesized
ttgaggaaagaaatgacagctg

SEQ ID NO: 720858 - DNA, 22 bp, Artificial Sequence
  chemically synthesized
agacttgtttcacagctgtcat

SEQ ID NO: 720859 - DNA, 22 bp, Artificial Sequence
  chemically synthesized
tgaggaaagaaatgacagctgt

SEQ ID NO: 720860 - DNA, 22 bp, Artificial Sequence
  chemically synthesized
gaggaaagaaatgacagctgtg

SEQ ID NO: 720861 - DNA, 22 bp, Artificial Sequence
  chemically synthesized
aggaaagaaatgacagctgtga

SEQ ID NO: 720862 - DNA, 22 bp, Artificial Sequence
  chemically synthesized
gggcacaatttagacttgtttc

SEQ ID NO: 720863 - DNA, 22 bp, Artificial Sequence
  chemically synthesized
agacattagggcacaatttaga

SEQ ID NO: 720864 - DNA, 22 bp, Artificial Sequence
  chemically synthesized
tgaaacaagtctaaattgtgcc

SEQ ID NO: 720865 - DNA, 22 bp, Artificial Sequence
  chemically synthesized
gacactcagacattagggcaca

SEQ ID NO: 720866 - DNA, 22 bp, Artificial Sequence
  chemically synthesized
ttggacactcagacattagggc

SEQ ID NO: 720867 - DNA, 22 bp, Artificial Sequence
  chemically synthesized
aattgtgccctaatgtctgagt

SEQ ID NO: 720868 - DNA, 22 bp, Artificial Sequence
  chemically synthesized
tgccctaatgtctgagtgtcca

SEQ ID NO: 720869 - DNA, 22 bp, Artificial Sequence
  chemically synthesized
aacagcagcatactgttggaca

SEQ ID NO: 720870 - DNA, 22 bp, Artificial Sequence
  chemically synthesized
caacagcagcatactgttggac

SEQ ID NO: 720871 - DNA, 22 bp, Artificial Sequence
  chemically synthesized
atgtctgagtgtccaacagtat

SEQ ID NO: 720872 - DNA, 22 bp, Artificial Sequence
  chemically synthesized
cttcaacagcagcatactgttg

SEQ ID NO: 720873 - DNA, 22 bp, Artificial Sequence
  chemically synthesized
ttgcttcaacagcagcatactg

SEQ ID NO: 720874 - DNA, 22 bp, Artificial Sequence
  chemically synthesized
agtgtccaacagtatgctgctg

SEQ ID NO: 720875 - DNA, 22 bp, Artificial Sequence
  chemically synthesized
ctattgcttcaacagcagcata

SEQ ID NO: 720876 - DNA, 22 bp, Artificial Sequence
  chemically synthesized
gctattgcttcaacagcagcat

SEQ ID NO: 720877 - DNA, 22 bp, Artificial Sequence
  chemically synthesized
tgctattgcttcaacagcagca

SEQ ID NO: 720878 - DNA, 22 bp, Artificial Sequence
  chemically synthesized
ctttgctattgcttcaacagca

SEQ ID NO: 720879 - DNA, 22 bp, Artificial Sequence
  chemically synthesized
tgctttgctattgcttcaacag

SEQ ID NO: 720880 - DNA, 22 bp, Artificial Sequence
  chemically synthesized
tctctgctttgctattgcttca

SEQ ID NO: 720881 - DNA, 22 bp, Artificial Sequence
  chemically synthesized
gtctctgctttgctattgcttc

SEQ ID NO: 720882 - DNA, 22 bp, Artificial Sequence
  chemically synthesized
tgtctctgctttgctattgctt

SEQ ID NO: 720883 - DNA, 22 bp, Artificial Sequence
  chemically synthesized
ctgttgaagcaatagcaaagca

SEQ ID NO: 720884 - DNA, 22 bp, Artificial Sequence
  chemically synthesized
ttgaagcaatagcaaagcagag

SEQ ID NO: 720885 - DNA, 22 bp, Artificial Sequence
  chemically synthesized
aagcaatagcaaagcagagaca

SEQ ID NO: 720886 - DNA, 22 bp, Artificial Sequence
  chemically synthesized
tacagggagaggaaacaatagg

SEQ ID NO: 720887 - DNA, 22 bp, Artificial Sequence
  chemically synthesized
agttatacagggagaggaaaca

SEQ ID NO: 720888 - DNA, 22 bp, Artificial Sequence
  chemically synthesized
cagttatacagggagaggaaac

SEQ ID NO: 720889 - DNA, 22 bp, Artificial Sequence
  chemically synthesized
ttgtttcctctccctgtataac

SEQ ID NO: 720890 - DNA, 22 bp, Artificial Sequence
  chemically synthesized
tttcctctccctgtataactga

SEQ ID NO: 720891 - DNA, 22 bp, Artificial Sequence
  chemically synthesized
cctctccctgtataactgaaac

SEQ ID NO: 720892 - DNA, 22 bp, Artificial Sequence
  chemically synthesized
ctctccctgtataactgaaacc

SEQ ID NO: 720893 - DNA, 22 bp, Artificial Sequence
  chemically synthesized
tccctgtataactgaaaccatg

SEQ ID NO: 720894 - DNA, 22 bp, Artificial Sequence
  chemically synthesized
cctgtataactgaaaccatggc

SEQ ID NO: 720895 - DNA, 22 bp, Artificial Sequence
  chemically synthesized
tataactgaaaccatggccggt

SEQ ID NO: 720896 - DNA, 22 bp, Artificial Sequence
  chemically synthesized
aaaccatggccggttgcccttt

SEQ ID NO: 720897 - DNA, 22 bp, Artificial Sequence
  chemically synthesized
cacatcatggacagaaaagggc

SEQ ID NO: 720898 - DNA, 22 bp, Artificial Sequence
  chemically synthesized
ccacatcatggacagaaaaggg

SEQ ID NO: 720899 - DNA, 22 bp, Artificial Sequence
  chemically synthesized
tccacatcatggacagaaaagg

SEQ ID NO: 720900 - DNA, 22 bp, Artificial Sequence
  chemically synthesized
cccttttctgtccatgatgtgg

SEQ ID NO: 720901 - DNA, 22 bp, Artificial Sequence
  chemically synthesized
ttctgtccatgatgtggaaagc

SEQ ID NO: 720902 - DNA, 22 bp, Artificial Sequence
  chemically synthesized
tctgtccatgatgtggaaagct

SEQ ID NO: 720903 - DNA, 22 bp, Artificial Sequence
  chemically synthesized
ctgtccatgatgtggaaagctc

SEQ ID NO: 720904 - DNA, 22 bp, Artificial Sequence
  chemically synthesized
tgtccatgatgtggaaagctct

SEQ ID NO: 720905 - DNA, 22 bp, Artificial Sequence
  chemically synthesized
aggtcatgagagcagagctttc

SEQ ID NO: 720906 - DNA, 22 bp, Artificial Sequence
  chemically synthesized
tccatgatgtggaaagctctgc

SEQ ID NO: 720907 - DNA, 22 bp, Artificial Sequence
  chemically synthesized
gaggtcatgagagcagagcttt

SEQ ID NO: 720908 - DNA, 22 bp, Artificial Sequence
  chemically synthesized
tgaggtcatgagagcagagctt

SEQ ID NO: 720909 - DNA, 22 bp, Artificial Sequence
  chemically synthesized
ttgaggtcatgagagcagagct

SEQ ID NO: 720910 - DNA, 22 bp, Artificial Sequence
  chemically synthesized
tgctctcatgacctcaaaaatg

SEQ ID NO: 720911 - DNA, 22 bp, Artificial Sequence
  chemically synthesized
ctctcatgacctcaaaaatggg

SEQ ID NO: 720912 - DNA, 22 bp, Artificial Sequence
  chemically synthesized
tcatgacctcaaaaatgggcat

SEQ ID NO: 720913 - DNA, 22 bp, Artificial Sequence
  chemically synthesized
atgacctcaaaaatgggcatgt

SEQ ID NO: 720914 - DNA, 22 bp, Artificial Sequence
  chemically synthesized
agtgaatggtgaaacatgccca

SEQ ID NO: 720915 - DNA, 22 bp, Artificial Sequence
  chemically synthesized
tgagtgaatggtgaaacatgcc

SEQ ID NO: 720916 - DNA, 22 bp, Artificial Sequence
  chemically synthesized
tctgagtgaatggtgaaacatg

SEQ ID NO: 720917 - DNA, 22 bp, Artificial Sequence
  chemically synthesized
ctctgagtgaatggtgaaacat

SEQ ID NO: 720918 - DNA, 22 bp, Artificial Sequence
  chemically synthesized
aaaaatgggcatgtttcaccat

SEQ ID NO: 720919 - DNA, 22 bp, Artificial Sequence
  chemically synthesized
taataggatcttctctgagtga

SEQ ID NO: 720920 - DNA, 22 bp, Artificial Sequence
  chemically synthesized
tgtaataggatcttctctgagt

SEQ ID NO: 720921 - DNA, 22 bp, Artificial Sequence
  chemically synthesized
ctgtaataggatcttctctgag

SEQ ID NO: 720922 - DNA, 22 bp, Artificial Sequence
  chemically synthesized
tctgtaataggatcttctctga

SEQ ID NO: 720923 - DNA, 22 bp, Artificial Sequence
  chemically synthesized
ttctgtaataggatcttctctg

SEQ ID NO: 720924 - DNA, 22 bp, Artificial Sequence
  chemically synthesized
caccattcactcagagaagatc

SEQ ID NO: 720925 - DNA, 22 bp, Artificial Sequence
  chemically synthesized
accattcactcagagaagatcc

SEQ ID NO: 720926 - DNA, 22 bp, Artificial Sequence
  chemically synthesized
tttttctgtaataggatcttct

SEQ ID NO: 720927 - DNA, 22 bp, Artificial Sequence
  chemically synthesized
actcagagaagatcctattaca

SEQ ID NO: 720928 - DNA, 22 bp, Artificial Sequence
  chemically synthesized
ggtattgtttttctgtaatagg

SEQ ID NO: 720929 - DNA, 22 bp, Artificial Sequence
  chemically synthesized
agagaagatcctattacagaaa

SEQ ID NO: 720930 - DNA, 22 bp, Artificial Sequence
  chemically synthesized
cagctgggtattgtttttctgt

SEQ ID NO: 720931 - DNA, 22 bp, Artificial Sequence
  chemically synthesized
aattgcagctgggtattgtttt

SEQ ID NO: 720932 - DNA, 22 bp, Artificial Sequence
  chemically synthesized
ttacagaaaaacaatacccagc

SEQ ID NO: 720933 - DNA, 22 bp, Artificial Sequence
  chemically synthesized
agttaaattgcagctgggtatt

SEQ ID NO: 720934 - DNA, 22 bp, Artificial Sequence
  chemically synthesized
tgagttaaattgcagctgggta

SEQ ID NO: 720935 - DNA, 22 bp, Artificial Sequence
  chemically synthesized
cagaaaaacaatacccagctgc

SEQ ID NO: 720936 - DNA, 22 bp, Artificial Sequence
  chemically synthesized
agctctgagttaaattgcagct

SEQ ID NO: 720937 - DNA, 22 bp, Artificial Sequence
  chemically synthesized
tcagctctgagttaaattgcag

SEQ ID NO: 720938 - DNA, 22 bp, Artificial Sequence
  chemically synthesized
ctcagctctgagttaaattgca

SEQ ID NO: 720939 - DNA, 22 bp, Artificial Sequence
  chemically synthesized
ggtagagggtttctcagctctg

SEQ ID NO: 720940 - DNA, 22 bp, Artificial Sequence
  chemically synthesized
caatttaactcagagctgagaa

SEQ ID NO: 720941 - DNA, 22 bp, Artificial Sequence
  chemically synthesized
aactcagagctgagaaaccctc

SEQ ID NO: 720942 - DNA, 22 bp, Artificial Sequence
  chemically synthesized
actcagagctgagaaaccctct

SEQ ID NO: 720943 - DNA, 22 bp, Artificial Sequence
  chemically synthesized
agagctgagaaaccctctaccc

SEQ ID NO: 720944 - DNA, 22 bp, Artificial Sequence
  chemically synthesized
agaaaccctctacccaatgatt

SEQ ID NO: 720945 - DNA, 22 bp, Artificial Sequence
  chemically synthesized
tacccaatgattatgggcccac

SEQ ID NO: 720946 - DNA, 22 bp, Artificial Sequence
  chemically synthesized
cccaatgattatgggcccactt

SEQ ID NO: 720947 - DNA, 22 bp, Artificial Sequence
  chemically synthesized
acaggtagatcacaaaagtggg

SEQ ID NO: 720948 - DNA, 22 bp, Artificial Sequence
  chemically synthesized
cctcacaggtagatcacaaaag

SEQ ID NO: 720949 - DNA, 22 bp, Artificial Sequence
  chemically synthesized
gcctcacaggtagatcacaaaa

SEQ ID NO: 720950 - DNA, 22 bp, Artificial Sequence
  chemically synthesized
tgcctcacaggtagatcacaaa

SEQ ID NO: 720951 - DNA, 22 bp, Artificial Sequence
  chemically synthesized
ttgcctcacaggtagatcacaa

SEQ ID NO: 720952 - DNA, 22 bp, Artificial Sequence
  chemically synthesized
tgggcccacttttgtgatctac

SEQ ID NO: 720953 - DNA, 22 bp, Artificial Sequence
  chemically synthesized
tttgcctcacaggtagatcaca

SEQ ID NO: 720954 - DNA, 22 bp, Artificial Sequence
  chemically synthesized
tttttgcctcacaggtagatca

SEQ ID NO: 720955 - DNA, 22 bp, Artificial Sequence
  chemically synthesized
ttgtgatctacctgtgaggcaa

SEQ ID NO: 720956 - DNA, 22 bp, Artificial Sequence
  chemically synthesized
tgtgatctacctgtgaggcaaa

SEQ ID NO: 720957 - DNA, 22 bp, Artificial Sequence
  chemically synthesized
gtgatctacctgtgaggcaaaa

SEQ ID NO: 720958 - DNA, 22 bp, Artificial Sequence
  chemically synthesized
aaagaatgttctttttgcctca

SEQ ID NO: 720959 - DNA, 22 bp, Artificial Sequence
  chemically synthesized
tgatctacctgtgaggcaaaaa

SEQ ID NO: 720960 - DNA, 22 bp, Artificial Sequence
  chemically synthesized
cctgtgaggcaaaaagaacatt

SEQ ID NO: 720961 - DNA, 22 bp, Artificial Sequence
  chemically synthesized
tgaggcaaaaagaacattcttt

SEQ ID NO: 720962 - DNA, 22 bp, Artificial Sequence
  chemically synthesized
cgcacatcgttgaaagaatgtt

SEQ ID NO: 720963 - DNA, 22 bp, Artificial Sequence
  chemically synthesized
atacagacatcctacgcacatc

SEQ ID NO: 720964 - DNA, 22 bp, Artificial Sequence
  chemically synthesized
ctaatacagacatcctacgcac

SEQ ID NO: 720965 - DNA, 22 bp, Artificial Sequence
  chemically synthesized
cctaatacagacatcctacgca

SEQ ID NO: 720966 - DNA, 22 bp, Artificial Sequence
  chemically synthesized
tttcaacgatgtgcgtaggatg

SEQ ID NO: 720967 - DNA, 22 bp, Artificial Sequence
  chemically synthesized
tcctaatacagacatcctacgc

SEQ ID NO: 720968 - DNA, 22 bp, Artificial Sequence
  chemically synthesized
tcaacgatgtgcgtaggatgtc

SEQ ID NO: 720969 - DNA, 22 bp, Artificial Sequence
  chemically synthesized
caacgatgtgcgtaggatgtct

SEQ ID NO: 720970 - DNA, 22 bp, Artificial Sequence
  chemically synthesized
aacgatgtgcgtaggatgtctg

SEQ ID NO: 720971 - DNA, 22 bp, Artificial Sequence
  chemically synthesized
tcagttttcctaatacagacat

SEQ ID NO: 720972 - DNA, 22 bp, Artificial Sequence
  chemically synthesized
atcagttttcctaatacagaca

SEQ ID NO: 720973 - DNA, 22 bp, Artificial Sequence
  chemically synthesized
catttatcagttttcctaatac

SEQ ID NO: 720974 - DNA, 22 bp, Artificial Sequence
  chemically synthesized
ccatttatcagttttcctaata

SEQ ID NO: 720975 - DNA, 22 bp, Artificial Sequence
  chemically synthesized
cacgtttccatttatcagtttt

SEQ ID NO: 720976 - DNA, 22 bp, Artificial Sequence
  chemically synthesized
tattaggaaaactgataaatgg

SEQ ID NO: 720977 - DNA, 22 bp, Artificial Sequence
  chemically synthesized
aagtcctccacgtttccattta

SEQ ID NO: 720978 - DNA, 22 bp, Artificial Sequence
  chemically synthesized
gaagtcctccacgtttccattt

SEQ ID NO: 720979 - DNA, 22 bp, Artificial Sequence
  chemically synthesized
ggaaaactgataaatggaaacg

SEQ ID NO: 720980 - DNA, 22 bp, Artificial Sequence
  chemically synthesized
tttgaagtcctccacgtttcca

SEQ ID NO: 720981 - DNA, 22 bp, Artificial Sequence
  chemically synthesized
ataaatggaaacgtggaggact

SEQ ID NO: 720982 - DNA, 22 bp, Artificial Sequence
  chemically synthesized
atgagaattatttgaagtcctc

SEQ ID NO: 720983 - DNA, 22 bp, Artificial Sequence
  chemically synthesized
gatgagaattatttgaagtcct

SEQ ID NO: 720984 - DNA, 22 bp, Artificial Sequence
  chemically synthesized
agaacagacttgatgagaatta

SEQ ID NO: 720985 - DNA, 22 bp, Artificial Sequence
  chemically synthesized
aagaacagacttgatgagaatt

SEQ ID NO: 720986 - DNA, 22 bp, Artificial Sequence
  chemically synthesized
taagaacagacttgatgagaat

SEQ ID NO: 720987 - DNA, 22 bp, Artificial Sequence
  chemically synthesized
caaataattctcatcaagtctg

SEQ ID NO: 720988 - DNA, 22 bp, Artificial Sequence
  chemically synthesized
ccattttaagaacagacttgat

SEQ ID NO: 720989 - DNA, 22 bp, Artificial Sequence
  chemically synthesized
aaataattctcatcaagtctgt

SEQ ID NO: 720990 - DNA, 22 bp, Artificial Sequence
  chemically synthesized
gccattttaagaacagacttga

SEQ ID NO: 720991 - DNA, 22 bp, Artificial Sequence
  chemically synthesized
gaagtttgccattttaagaaca

SEQ ID NO: 720992 - DNA, 22 bp, Artificial Sequence
  chemically synthesized
ggaagtttgccattttaagaac

SEQ ID NO: 720993 - DNA, 22 bp, Artificial Sequence
  chemically synthesized
tcatcaagtctgttcttaaaat

SEQ ID NO: 720994 - DNA, 22 bp, Artificial Sequence
  chemically synthesized
tggaagtttgccattttaagaa

SEQ ID NO: 720995 - DNA, 22 bp, Artificial Sequence
  chemically synthesized
atcaagtctgttcttaaaatgg

SEQ ID NO: 720996 - DNA, 22 bp, Artificial Sequence
  chemically synthesized
aagggactttggaagtttgcca

SEQ ID NO: 720997 - DNA, 22 bp, Artificial Sequence
  chemically synthesized
tcaagggactttggaagtttgc

SEQ ID NO: 720998 - DNA, 22 bp, Artificial Sequence
  chemically synthesized
ttcttaaaatggcaaacttcca

SEQ ID NO: 720999 - DNA, 22 bp, Artificial Sequence
  chemically synthesized
ttaaaatggcaaacttccaaag

SEQ ID NO: 721000 - DNA, 22 bp, Artificial Sequence
  chemically synthesized
aaaatggcaaacttccaaagtc

SEQ ID NO: 721001 - DNA, 22 bp, Artificial Sequence
  chemically synthesized
aaatggcaaacttccaaagtcc

SEQ ID NO: 721002 - DNA, 22 bp, Artificial Sequence
  chemically synthesized
tgtattctcaagggactttgga

SEQ ID NO: 721003 - DNA, 22 bp, Artificial Sequence
  chemically synthesized
agacctgtgtattctcaaggga

SEQ ID NO: 721004 - DNA, 22 bp, Artificial Sequence
  chemically synthesized
attgagacctgtgtattctcaa

SEQ ID NO: 721005 - DNA, 22 bp, Artificial Sequence
  chemically synthesized
ccaaagtcccttgagaatacac

SEQ ID NO: 721006 - DNA, 22 bp, Artificial Sequence
  chemically synthesized
tcattgagacctgtgtattctc

SEQ ID NO: 721007 - DNA, 22 bp, Artificial Sequence
  chemically synthesized
caaagtcccttgagaatacaca

SEQ ID NO: 721008 - DNA, 22 bp, Artificial Sequence
  chemically synthesized
ctcattgagacctgtgtattct

SEQ ID NO: 721009 - DNA, 22 bp, Artificial Sequence
  chemically synthesized
ttctcattgagacctgtgtatt

SEQ ID NO: 721010 - DNA, 22 bp, Artificial Sequence
  chemically synthesized
cttctcattgagacctgtgtat

SEQ ID NO: 721011 - DNA, 22 bp, Artificial Sequence
  chemically synthesized
tcttctcattgagacctgtgta

SEQ ID NO: 721012 - DNA, 22 bp, Artificial Sequence
  chemically synthesized
ttcttctcattgagacctgtgt

SEQ ID NO: 721013 - DNA, 22 bp, Artificial Sequence
  chemically synthesized
tttcttctcattgagacctgtg

SEQ ID NO: 721014 - DNA, 22 bp, Artificial Sequence
  chemically synthesized
gagaatacacaggtctcaatga

SEQ ID NO: 721015 - DNA, 22 bp, Artificial Sequence
  chemically synthesized
agaatacacaggtctcaatgag

SEQ ID NO: 721016 - DNA, 22 bp, Artificial Sequence
  chemically synthesized
tcagccgctttttcttctcatt

SEQ ID NO: 721017 - DNA, 22 bp, Artificial Sequence
  chemically synthesized
atcagccgctttttcttctcat

SEQ ID NO: 721018 - DNA, 22 bp, Artificial Sequence
  chemically synthesized
tatcagccgctttttcttctca

SEQ ID NO: 721019 - DNA, 22 bp, Artificial Sequence
  chemically synthesized
atgttttatcagccgctttttc

SEQ ID NO: 721020 - DNA, 22 bp, Artificial Sequence
  chemically synthesized
aatgagaagaaaaagcggctga

SEQ ID NO: 721021 - DNA, 22 bp, Artificial Sequence
  chemically synthesized
gaaagcctaatgttttatcagc

SEQ ID NO: 721022 - DNA, 22 bp, Artificial Sequence
  chemically synthesized
ggaaagcctaatgttttatcag

SEQ ID NO: 721023 - DNA, 22 bp, Artificial Sequence
  chemically synthesized
tggaaagcctaatgttttatca

SEQ ID NO: 721024 - DNA, 22 bp, Artificial Sequence
  chemically synthesized
ttggaaagcctaatgttttatc

SEQ ID NO: 721025 - DNA, 22 bp, Artificial Sequence
  chemically synthesized
ataaaacattaggctttccaaa

SEQ ID NO: 721026 - DNA, 22 bp, Artificial Sequence
  chemically synthesized
aggagaaatgggcaatttttgg

SEQ ID NO: 721027 - DNA, 22 bp, Artificial Sequence
  chemically synthesized
gaggagaaatgggcaatttttg

SEQ ID NO: 721028 - DNA, 22 bp, Artificial Sequence
  chemically synthesized
tgaggagaaatgggcaattttt

SEQ ID NO: 721029 - DNA, 22 bp, Artificial Sequence
  chemically synthesized
ggctttccaaaaattgcccatt

SEQ ID NO: 721030 - DNA, 22 bp, Artificial Sequence
  chemically synthesized
tccaaaaattgcccatttctcc

SEQ ID NO: 721031 - DNA, 22 bp, Artificial Sequence
  chemically synthesized
ccaaaaattgcccatttctcct

SEQ ID NO: 721032 - DNA, 22 bp, Artificial Sequence
  chemically synthesized
caaaaattgcccatttctcctc

SEQ ID NO: 721033 - DNA, 22 bp, Artificial Sequence
  chemically synthesized
atgtaggaattttgaggagaaa

SEQ ID NO: 721034 - DNA, 22 bp, Artificial Sequence
  chemically synthesized
catgtaggaattttgaggagaa

SEQ ID NO: 721035 - DNA, 22 bp, Artificial Sequence
  chemically synthesized
cccatttctcctcaaaattcct

SEQ ID NO: 721036 - DNA, 22 bp, Artificial Sequence
  chemically synthesized
tgaaccttcatgtaggaatttt

SEQ ID NO: 721037 - DNA, 22 bp, Artificial Sequence
  chemically synthesized
gtgaaccttcatgtaggaattt

SEQ ID NO: 721038 - DNA, 22 bp, Artificial Sequence
  chemically synthesized
ctcctcaaaattcctacatgaa

SEQ ID NO: 721039 - DNA, 22 bp, Artificial Sequence
  chemically synthesized
tcctcaaaattcctacatgaag

SEQ ID NO: 721040 - DNA, 22 bp, Artificial Sequence
  chemically synthesized
aaccttgtgaaccttcatgtag

SEQ ID NO: 721041 - DNA, 22 bp, Artificial Sequence
  chemically synthesized
ctcaaaattcctacatgaaggt

SEQ ID NO: 721042 - DNA, 22 bp, Artificial Sequence
  chemically synthesized
aaaattcctacatgaaggttca

SEQ ID NO: 721043 - DNA, 22 bp, Artificial Sequence
  chemically synthesized
tacgttaaaccttgtgaacctt

SEQ ID NO: 721044 - DNA, 22 bp, Artificial Sequence
  chemically synthesized
ctacatgaaggttcacaaggtt

SEQ ID NO: 721045 - DNA, 22 bp, Artificial Sequence
  chemically synthesized
catgaaggttcacaaggtttaa

SEQ ID NO: 721046 - DNA, 22 bp, Artificial Sequence
  chemically synthesized
caacaacctgtacgttaaacct

SEQ ID NO: 721047 - DNA, 22 bp, Artificial Sequence
  chemically synthesized
ccaacaacctgtacgttaaacc

SEQ ID NO: 721048 - DNA, 22 bp, Artificial Sequence
  chemically synthesized
tgcttccaacaacctgtacgtt

SEQ ID NO: 721049 - DNA, 22 bp, Artificial Sequence
  chemically synthesized
gtgcttccaacaacctgtacgt

SEQ ID NO: 721050 - DNA, 22 bp, Artificial Sequence
  chemically synthesized
acaaggtttaacgtacaggttg

SEQ ID NO: 721051 - DNA, 22 bp, Artificial Sequence
  chemically synthesized
tttgtgcttccaacaacctgta

SEQ ID NO: 721052 - DNA, 22 bp, Artificial Sequence
  chemically synthesized
gtttgtgcttccaacaacctgt

SEQ ID NO: 721053 - DNA, 22 bp, Artificial Sequence
  chemically synthesized
aacgtacaggttgttggaagca

SEQ ID NO: 721054 - DNA, 22 bp, Artificial Sequence
  chemically synthesized
acgtacaggttgttggaagcac

SEQ ID NO: 721055 - DNA, 22 bp, Artificial Sequence
  chemically synthesized
aggtagatttgtttgtgcttcc

SEQ ID NO: 721056 - DNA, 22 bp, Artificial Sequence
  chemically synthesized
ctgaggtagatttgtttgtgct

SEQ ID NO: 721057 - DNA, 22 bp, Artificial Sequence
  chemically synthesized
tcctgaggtagatttgtttgtg

SEQ ID NO: 721058 - DNA, 22 bp, Artificial Sequence
  chemically synthesized
actctcctgaggtagatttgtt

SEQ ID NO: 721059 - DNA, 22 bp, Artificial Sequence
  chemically synthesized
ttggaagcacaaacaaatctac

SEQ ID NO: 721060 - DNA, 22 bp, Artificial Sequence
  chemically synthesized
gaagcacaaacaaatctacctc

SEQ ID NO: 721061 - DNA, 22 bp, Artificial Sequence
  chemically synthesized
aggtgaattaactctcctgagg

SEQ ID NO: 721062 - DNA, 22 bp, Artificial Sequence
  chemically synthesized
gtcctgaggtgaattaactctc

SEQ ID NO: 721063 - DNA, 22 bp, Artificial Sequence
  chemically synthesized
cctcaggagagttaattcacct

SEQ ID NO: 721064 - DNA, 22 bp, Artificial Sequence
  chemically synthesized
aggagagttaattcacctcagg

SEQ ID NO: 721065 - DNA, 22 bp, Artificial Sequence
  chemically synthesized
attcacctcaggaccaatttct

SEQ ID NO: 721066 - DNA, 22 bp, Artificial Sequence
  chemically synthesized
acctcaggaccaatttctcctc

SEQ ID NO: 721067 - DNA, 22 bp, Artificial Sequence
  chemically synthesized
aggaccaatttctcctctgctg

SEQ ID NO: 721068 - DNA, 22 bp, Artificial Sequence
  chemically synthesized
aatgaatagtagatgtaccagc

SEQ ID NO: 721069 - DNA, 22 bp, Artificial Sequence
  chemically synthesized
ctaaatgaatagtagatgtacc

SEQ ID NO: 721070 - DNA, 22 bp, Artificial Sequence
  chemically synthesized
ctcctctgctggtacatctact

SEQ ID NO: 721071 - DNA, 22 bp, Artificial Sequence
  chemically synthesized
tcctctgctggtacatctacta

SEQ ID NO: 721072 - DNA, 22 bp, Artificial Sequence
  chemically synthesized
ctctgctggtacatctactatt

SEQ ID NO: 721073 - DNA, 22 bp, Artificial Sequence
  chemically synthesized
tgctggtacatctactattcat

SEQ ID NO: 721074 - DNA, 22 bp, Artificial Sequence
  chemically synthesized
ctggtacatctactattcattt

SEQ ID NO: 721075 - DNA, 22 bp, Artificial Sequence
  chemically synthesized
gtacatctactattcatttagc

SEQ ID NO: 721076 - DNA, 22 bp, Artificial Sequence
  chemically synthesized
tccaagcagggctgctaaatga

SEQ ID NO: 721077 - DNA, 22 bp, Artificial Sequence
  chemically synthesized
atccaagcagggctgctaaatg

SEQ ID NO: 721078 - DNA, 22 bp, Artificial Sequence
  chemically synthesized
tatccaagcagggctgctaaat

SEQ ID NO: 721079 - DNA, 22 bp, Artificial Sequence
  chemically synthesized
ggctttatccaagcagggctgc

SEQ ID NO: 721080 - DNA, 22 bp, Artificial Sequence
  chemically synthesized
ctattcatttagcagccctgct

SEQ ID NO: 721081 - DNA, 22 bp, Artificial Sequence
  chemically synthesized
tgggctttatccaagcagggct

SEQ ID NO: 721082 - DNA, 22 bp, Artificial Sequence
  chemically synthesized
ttcatttagcagccctgcttgg

SEQ ID NO: 721083 - DNA, 22 bp, Artificial Sequence
  chemically synthesized
atttagcagccctgcttggata

SEQ ID NO: 721084 - DNA, 22 bp, Artificial Sequence
  chemically synthesized
agcagccctgcttggataaagc

SEQ ID NO: 721085 - DNA, 22 bp, Artificial Sequence
  chemically synthesized
aaatggctctgggctttatcca

SEQ ID NO: 721086 - DNA, 22 bp, Artificial Sequence
  chemically synthesized
gcagccctgcttggataaagcc

SEQ ID NO: 721087 - DNA, 22 bp, Artificial Sequence
  chemically synthesized
ccgttgaaatggctctgggctt

SEQ ID NO: 721088 - DNA, 22 bp, Artificial Sequence
  chemically synthesized
ctgccgttgaaatggctctggg

SEQ ID NO: 721089 - DNA, 22 bp, Artificial Sequence
  chemically synthesized
cttggataaagcccagagccat

SEQ ID NO: 721090 - DNA, 22 bp, Artificial Sequence
  chemically synthesized
ctactgccgttgaaatggctct

SEQ ID NO: 721091 - DNA, 22 bp, Artificial Sequence
  chemically synthesized
ggataaagcccagagccatttc

SEQ ID NO: 721092 - DNA, 22 bp, Artificial Sequence
  chemically synthesized
cctactgccgttgaaatggctc

SEQ ID NO: 721093 - DNA, 22 bp, Artificial Sequence
  chemically synthesized
gataaagcccagagccatttca

SEQ ID NO: 721094 - DNA, 22 bp, Artificial Sequence
  chemically synthesized
aacgtcccttcctactgccgtt

SEQ ID NO: 721095 - DNA, 22 bp, Artificial Sequence
  chemically synthesized
taaacgtcccttcctactgccg

SEQ ID NO: 721096 - DNA, 22 bp, Artificial Sequence
  chemically synthesized
tctaaacgtcccttcctactgc

SEQ ID NO: 721097 - DNA, 22 bp, Artificial Sequence
  chemically synthesized
caacggcagtaggaagggacgt

SEQ ID NO: 721098 - DNA, 22 bp, Artificial Sequence
  chemically synthesized
aacggcagtaggaagggacgtt

SEQ ID NO: 721099 - DNA, 22 bp, Artificial Sequence
  chemically synthesized
atgataactctctaaacgtccc

SEQ ID NO: 721100 - DNA, 22 bp, Artificial Sequence
  chemically synthesized
agagagttatcatcagtcattt

SEQ ID NO: 721101 - DNA, 22 bp, Artificial Sequence
  chemically synthesized
gagagttatcatcagtcattta

SEQ ID NO: 721102 - DNA, 22 bp, Artificial Sequence
  chemically synthesized
acagcgcaggcataaatgactg

SEQ ID NO: 721103 - DNA, 22 bp, Artificial Sequence
  chemically synthesized
ttaacagcgcaggcataaatga

SEQ ID NO: 721104 - DNA, 22 bp, Artificial Sequence
  chemically synthesized
tcatcagtcatttatgcctgcg

SEQ ID NO: 721105 - DNA, 22 bp, Artificial Sequence
  chemically synthesized
agttgttaacagcgcaggcata

SEQ ID NO: 721106 - DNA, 22 bp, Artificial Sequence
  chemically synthesized
attcagttgttaacagcgcagg

SEQ ID NO: 721107 - DNA, 22 bp, Artificial Sequence
  chemically synthesized
ttgattcagttgttaacagcgc

SEQ ID NO: 721108 - DNA, 22 bp, Artificial Sequence
  chemically synthesized
atgcctgcgctgttaacaactg

SEQ ID NO: 721109 - DNA, 22 bp, Artificial Sequence
  chemically synthesized
atgttattgattcagttgttaa

SEQ ID NO: 721110 - DNA, 22 bp, Artificial Sequence
  chemically synthesized
tgcctgcgctgttaacaactga

SEQ ID NO: 721111 - DNA, 22 bp, Artificial Sequence
  chemically synthesized
cgctgttaacaactgaatcaat

SEQ ID NO: 721112 - DNA, 22 bp, Artificial Sequence
  chemically synthesized
catagcactgatgttattgatt

SEQ ID NO: 721113 - DNA, 22 bp, Artificial Sequence
  chemically synthesized
ttaacaactgaatcaataacat

SEQ ID NO: 721114 - DNA, 22 bp, Artificial Sequence
  chemically synthesized
tccatagcactgatgttattga

SEQ ID NO: 721115 - DNA, 22 bp, Artificial Sequence
  chemically synthesized
acaactgaatcaataacatcag

SEQ ID NO: 721116 - DNA, 22 bp, Artificial Sequence
  chemically synthesized
aaggtgctctccatagcactga

SEQ ID NO: 721117 - DNA, 22 bp, Artificial Sequence
  chemically synthesized
aatcaataacatcagtgctatg

SEQ ID NO: 721118 - DNA, 22 bp, Artificial Sequence
  chemically synthesized
tgaaggtgctctccatagcact

SEQ ID NO: 721119 - DNA, 22 bp, Artificial Sequence
  chemically synthesized
ggctctgaaggtgctctccata

SEQ ID NO: 721120 - DNA, 22 bp, Artificial Sequence
  chemically synthesized
actaggctctgaaggtgctctc

SEQ ID NO: 721121 - DNA, 22 bp, Artificial Sequence
  chemically synthesized
tggagagcaccttcagagccta

SEQ ID NO: 721122 - DNA, 22 bp, Artificial Sequence
  chemically synthesized
cagacatcctaactaggctctg

SEQ ID NO: 721123 - DNA, 22 bp, Artificial Sequence
  chemically synthesized
acaactgcagacatcctaacta

SEQ ID NO: 721124 - DNA, 22 bp, Artificial Sequence
  chemically synthesized
cagagcctagttaggatgtctg

SEQ ID NO: 721125 - DNA, 22 bp, Artificial Sequence
  chemically synthesized
atctgacaactgcagacatcct

SEQ ID NO: 721126 - DNA, 22 bp, Artificial Sequence
  chemically synthesized
agagcctagttaggatgtctgc

SEQ ID NO: 721127 - DNA, 22 bp, Artificial Sequence
  chemically synthesized
tctaatctgacaactgcagaca

SEQ ID NO: 721128 - DNA, 22 bp, Artificial Sequence
  chemically synthesized
cctgtctaatctgacaactgca

SEQ ID NO: 721129 - DNA, 22 bp, Artificial Sequence
  chemically synthesized
gttaggatgtctgcagttgtca

SEQ ID NO: 721130 - DNA, 22 bp, Artificial Sequence
  chemically synthesized
gcctgtctaatctgacaactgc

SEQ ID NO: 721131 - DNA, 22 bp, Artificial Sequence
  chemically synthesized
ggatgtctgcagttgtcagatt

SEQ ID NO: 721132 - DNA, 22 bp, Artificial Sequence
  chemically synthesized
caaaacatcttgcctgtctaat

SEQ ID NO: 721133 - DNA, 22 bp, Artificial Sequence
  chemically synthesized
ccaaaacatcttgcctgtctaa

SEQ ID NO: 721134 - DNA, 22 bp, Artificial Sequence
  chemically synthesized
cagttgtcagattagacaggca

SEQ ID NO: 721135 - DNA, 22 bp, Artificial Sequence
  chemically synthesized
tcagattagacaggcaagatgt

SEQ ID NO: 721136 - DNA, 22 bp, Artificial Sequence
  chemically synthesized
aaacaaatatgtttccaaaaca

SEQ ID NO: 721137 - DNA, 22 bp, Artificial Sequence
  chemically synthesized
gacaggcaagatgttttggaaa

SEQ ID NO: 721138 - DNA, 22 bp, Artificial Sequence
  chemically synthesized
ctgaaacaaatatgtttccaaa

SEQ ID NO: 721139 - DNA, 22 bp, Artificial Sequence
  chemically synthesized
cctgaaacaaatatgtttccaa

SEQ ID NO: 721140 - DNA, 22 bp, Artificial Sequence
  chemically synthesized
aacatttcctgaaacaaatatg

SEQ ID NO: 721141 - DNA, 22 bp, Artificial Sequence
  chemically synthesized
aaacatttcctgaaacaaatat

SEQ ID NO: 721142 - DNA, 22 bp, Artificial Sequence
  chemically synthesized
tggaaacatatttgtttcagga

SEQ ID NO: 721143 - DNA, 22 bp, Artificial Sequence
  chemically synthesized
ggaaacatatttgtttcaggaa

SEQ ID NO: 721144 - DNA, 22 bp, Artificial Sequence
  chemically synthesized
ccacttaaacatttcctgaaac

SEQ ID NO: 721145 - DNA, 22 bp, Artificial Sequence
  chemically synthesized
gaaacatatttgtttcaggaaa

SEQ ID NO: 721146 - DNA, 22 bp, Artificial Sequence
  chemically synthesized
accacttaaacatttcctgaaa

SEQ ID NO: 721147 - DNA, 22 bp, Artificial Sequence
  chemically synthesized
tggatgcttaccacttaaacat

SEQ ID NO: 721148 - DNA, 22 bp, Artificial Sequence
  chemically synthesized
gtttcaggaaatgtttaagtgg

SEQ ID NO: 721149 - DNA, 22 bp, Artificial Sequence
  chemically synthesized
tttcaggaaatgtttaagtggt

SEQ ID NO: 721150 - DNA, 22 bp, Artificial Sequence
  chemically synthesized
caggaaatgtttaagtggtaag

SEQ ID NO: 721151 - DNA, 22 bp, Artificial Sequence
  chemically synthesized
aggaaatgtttaagtggtaagc

SEQ ID NO: 721152 - DNA, 22 bp, Artificial Sequence
  chemically synthesized
aagtggtaagcatccacagggt

SEQ ID NO: 721153 - DNA, 22 bp, Artificial Sequence
  chemically synthesized
agtggtaagcatccacagggtt

SEQ ID NO: 721154 - DNA, 22 bp, Artificial Sequence
  chemically synthesized
tgaacaggatggccacagaacc

SEQ ID NO: 721155 - DNA, 22 bp, Artificial Sequence
  chemically synthesized
gtgaacaggatggccacagaac

SEQ ID NO: 721156 - DNA, 22 bp, Artificial Sequence
  chemically synthesized
atatatccatgtttgtgaacag

SEQ ID NO: 721157 - DNA, 22 bp, Artificial Sequence
  chemically synthesized
tgtggccatcctgttcacaaac

SEQ ID NO: 721158 - DNA, 22 bp, Artificial Sequence
  chemically synthesized
ttaatatatccatgtttgtgaa

SEQ ID NO: 721159 - DNA, 22 bp, Artificial Sequence
  chemically synthesized
tggccatcctgttcacaaacat

SEQ ID NO: 721160 - DNA, 22 bp, Artificial Sequence
  chemically synthesized
aatctattaatatatccatgtt

SEQ ID NO: 721161 - DNA, 22 bp, Artificial Sequence
  chemically synthesized
ttcacaaacatggatatattaa

SEQ ID NO: 721162 - DNA, 22 bp, Artificial Sequence
  chemically synthesized
acaaacatggatatattaatag

SEQ ID NO: 721163 - DNA, 22 bp, Artificial Sequence
  chemically synthesized
gtcaaccaaattaaatctatta

SEQ ID NO: 721164 - DNA, 22 bp, Artificial Sequence
  chemically synthesized
attagtcaaccaaattaaatct

SEQ ID NO: 721165 - DNA, 22 bp, Artificial Sequence
  chemically synthesized
cattagtcaaccaaattaaatc

SEQ ID NO: 721166 - DNA, 22 bp, Artificial Sequence
  chemically synthesized
atagatttaatttggttgacta

SEQ ID NO: 721167 - DNA, 22 bp, Artificial Sequence
  chemically synthesized
aatttggttgactaatgaagat

SEQ ID NO: 721168 - DNA, 22 bp, Artificial Sequence
  chemically synthesized
atttggttgactaatgaagata

SEQ ID NO: 721169 - DNA, 22 bp, Artificial Sequence
  chemically synthesized
aagcaacaataaatatcttcat

SEQ ID NO: 721170 - DNA, 22 bp, Artificial Sequence
  chemically synthesized
aaagcaacaataaatatcttca

SEQ ID NO: 721171 - DNA, 22 bp, Artificial Sequence
  chemically synthesized
taaagcaacaataaatatcttc

SEQ ID NO: 721172 - DNA, 22 bp, Artificial Sequence
  chemically synthesized
ggttgactaatgaagatattta

SEQ ID NO: 721173 - DNA, 22 bp, Artificial Sequence
  chemically synthesized
ttaaagcaacaataaatatctt

SEQ ID NO: 721174 - DNA, 22 bp, Artificial Sequence
  chemically synthesized
gttgactaatgaagatatttat

SEQ ID NO: 721175 - DNA, 22 bp, Artificial Sequence
  chemically synthesized
tttaaagcaacaataaatatct

SEQ ID NO: 721176 - DNA, 22 bp, Artificial Sequence
  chemically synthesized
ttttaaagcaacaataaatatc

SEQ ID NO: 721177 - DNA, 22 bp, Artificial Sequence
  chemically synthesized
tttttaaagcaacaataaatat

SEQ ID NO: 721178 - DNA, 22 bp, Artificial Sequence
  chemically synthesized
actaatgaagatatttattgtt

SEQ ID NO: 721179 - DNA, 22 bp, Artificial Sequence
  chemically synthesized
atgaagatatttattgttgctt

SEQ ID NO: 721180 - DNA, 22 bp, Artificial Sequence
  chemically synthesized
taagaattttttttaaagcaac

SEQ ID NO: 721181 - DNA, 22 bp, Artificial Sequence
  chemically synthesized
attgttgctttaaaaaaaattc

SEQ ID NO: 721182 - DNA, 22 bp, Artificial Sequence
  chemically synthesized
caaaaattataagaattttttt

SEQ ID NO: 721183 - DNA, 22 bp, Artificial Sequence
  chemically synthesized
ttgttgctttaaaaaaaattct

SEQ ID NO: 721184 - DNA, 22 bp, Artificial Sequence
  chemically synthesized
ttgctttaaaaaaaattcttat

SEQ ID NO: 721185 - DNA, 22 bp, Artificial Sequence
  chemically synthesized
ctttaaaaaaaattcttataat

SEQ ID NO: 721186 - DNA, 22 bp, Artificial Sequence
  chemically synthesized
taaaaaaaattcttataatttt

SEQ ID NO: 721187 - DNA, 22 bp, Artificial Sequence
  chemically synthesized
aaaaaaaattcttataattttt

SEQ ID NO: 721188 - DNA, 22 bp, Artificial Sequence
  chemically synthesized
atgtgtacctacaaaaattata

SEQ ID NO: 721189 - DNA, 22 bp, Artificial Sequence
  chemically synthesized
aaaaaaattcttataatttttg

SEQ ID NO: 721190 - DNA, 22 bp, Artificial Sequence
  chemically synthesized
aatgtgtacctacaaaaattat

SEQ ID NO: 721191 - DNA, 22 bp, Artificial Sequence
  chemically synthesized
ttataatttttgtaggtacaca

SEQ ID NO: 721192 - DNA, 22 bp, Artificial Sequence
  chemically synthesized
ataatttttgtaggtacacatt

SEQ ID NO: 721193 - DNA, 22 bp, Artificial Sequence
  chemically synthesized
taatttttgtaggtacacatta

SEQ ID NO: 721194 - DNA, 22 bp, Artificial Sequence
  chemically synthesized
taaatatatacgcttaatgtgt

SEQ ID NO: 721195 - DNA, 22 bp, Artificial Sequence
  chemically synthesized
tataaatatatacgcttaatgt

SEQ ID NO: 721196 - DNA, 22 bp, Artificial Sequence
  chemically synthesized
ttgtaggtacacattaagcgta

SEQ ID NO: 721197 - DNA, 22 bp, Artificial Sequence
  chemically synthesized
tgtaggtacacattaagcgtat

SEQ ID NO: 721198 - DNA, 22 bp, Artificial Sequence
  chemically synthesized
gtaggtacacattaagcgtata

SEQ ID NO: 721199 - DNA, 22 bp, Artificial Sequence
  chemically synthesized
taggtacacattaagcgtatat

SEQ ID NO: 721200 - DNA, 22 bp, Artificial Sequence
  chemically synthesized
atatgctctataaatatatacg

SEQ ID NO: 721201 - DNA, 22 bp, Artificial Sequence
  chemically synthesized
agcgtatatatttatagagcat

SEQ ID NO: 721202 - DNA, 22 bp, Artificial Sequence
  chemically synthesized
tatcaaaacatctcatatgctc

SEQ ID NO: 721203 - DNA, 22 bp, Artificial Sequence
  chemically synthesized
catgcctgtatcaaaacatctc

SEQ ID NO: 721204 - DNA, 22 bp, Artificial Sequence
  chemically synthesized
atagagcatatgagatgttttg

SEQ ID NO: 721205 - DNA, 22 bp, Artificial Sequence
  chemically synthesized
tagagcatatgagatgttttga

SEQ ID NO: 721206 - DNA, 22 bp, Artificial Sequence
  chemically synthesized
acattgcatgcctgtatcaaaa

SEQ ID NO: 721207 - DNA, 22 bp, Artificial Sequence
  chemically synthesized
cacattgcatgcctgtatcaaa

SEQ ID NO: 721208 - DNA, 22 bp, Artificial Sequence
  chemically synthesized
atttcacattgcatgcctgtat

SEQ ID NO: 721209 - DNA, 22 bp, Artificial Sequence
  chemically synthesized
tgatacaggcatgcaatgtgaa

SEQ ID NO: 721210 - DNA, 22 bp, Artificial Sequence
  chemically synthesized
gatacaggcatgcaatgtgaaa

SEQ ID NO: 721211 - DNA, 22 bp, Artificial Sequence
  chemically synthesized
atacaggcatgcaatgtgaaat

SEQ ID NO: 721212 - DNA, 22 bp, Artificial Sequence
  chemically synthesized
atataaaaagcataatgtgctg

SEQ ID NO: 721213 - DNA, 22 bp, Artificial Sequence
  chemically synthesized
aatataaaaagcataatgtgct

SEQ ID NO: 721214 - DNA, 22 bp, Artificial Sequence
  chemically synthesized
ttaatataaaaagcataatgtg

SEQ ID NO: 721215 - DNA, 22 bp, Artificial Sequence
  chemically synthesized
aacatcatctcttaatataaaa

SEQ ID NO: 721216 - DNA, 22 bp, Artificial Sequence
  chemically synthesized
tgaacatcatctcttaatataa

SEQ ID NO: 721217 - DNA, 22 bp, Artificial Sequence
  chemically synthesized
tctgaacatcatctcttaatat

SEQ ID NO: 721218 - DNA, 22 bp, Artificial Sequence
  chemically synthesized
ctctgaacatcatctcttaata

SEQ ID NO: 721219 - DNA, 22 bp, Artificial Sequence
  chemically synthesized
tgctttttatattaagagatga

SEQ ID NO: 721220 - DNA, 22 bp, Artificial Sequence
  chemically synthesized
catttctctgaacatcatctct

SEQ ID NO: 721221 - DNA, 22 bp, Artificial Sequence
  chemically synthesized
gcatttctctgaacatcatctc

SEQ ID NO: 721222 - DNA, 22 bp, Artificial Sequence
  chemically synthesized
tttatattaagagatgatgttc

SEQ ID NO: 721223 - DNA, 22 bp, Artificial Sequence
  chemically synthesized
ttatattaagagatgatgttca

SEQ ID NO: 721224 - DNA, 22 bp, Artificial Sequence
  chemically synthesized
tatattaagagatgatgttcag

SEQ ID NO: 721225 - DNA, 22 bp, Artificial Sequence
  chemically synthesized
atttgcatttctctgaacatca

SEQ ID NO: 721226 - DNA, 22 bp, Artificial Sequence
  chemically synthesized
atattaagagatgatgttcaga

SEQ ID NO: 721227 - DNA, 22 bp, Artificial Sequence
  chemically synthesized
gatttgcatttctctgaacatc

SEQ ID NO: 721228 - DNA, 22 bp, Artificial Sequence
  chemically synthesized
tattaagagatgatgttcagag

SEQ ID NO: 721229 - DNA, 22 bp, Artificial Sequence
  chemically synthesized
tgatttgcatttctctgaacat

SEQ ID NO: 721230 - DNA, 22 bp, Artificial Sequence
  chemically synthesized
agagatgatgttcagagaaatg

SEQ ID NO: 721231 - DNA, 22 bp, Artificial Sequence
  chemically synthesized
tggttttgatttgcatttctct

SEQ ID NO: 721232 - DNA, 22 bp, Artificial Sequence
  chemically synthesized
attgtggttttgatttgcattt

SEQ ID NO: 721233 - DNA, 22 bp, Artificial Sequence
  chemically synthesized
agagaaatgcaaatcaaaacca

SEQ ID NO: 721234 - DNA, 22 bp, Artificial Sequence
  chemically synthesized
gtgtgagatggtacctcattgt

SEQ ID NO: 721235 - DNA, 22 bp, Artificial Sequence
  chemically synthesized
actggtgtgagatggtacctca

SEQ ID NO: 721236 - DNA, 22 bp, Artificial Sequence
  chemically synthesized
taactggtgtgagatggtacct

SEQ ID NO: 721237 - DNA, 22 bp, Artificial Sequence
  chemically synthesized
aatgatagccattctaactggt

SEQ ID NO: 721238 - DNA, 22 bp, Artificial Sequence
  chemically synthesized
gaatgatagccattctaactgg

SEQ ID NO: 721239 - DNA, 22 bp, Artificial Sequence
  chemically synthesized
tgaatgatagccattctaactg

SEQ ID NO: 721240 - DNA, 22 bp, Artificial Sequence
  chemically synthesized
ttgaatgatagccattctaact

SEQ ID NO: 721241 - DNA, 22 bp, Artificial Sequence
  chemically synthesized
acttttgaatgatagccattct

SEQ ID NO: 721242 - DNA, 22 bp, Artificial Sequence
  chemically synthesized
acaccagttagaatggctatca

SEQ ID NO: 721243 - DNA, 22 bp, Artificial Sequence
  chemically synthesized
ctgacttttgaatgatagccat

SEQ ID NO: 721244 - DNA, 22 bp, Artificial Sequence
  chemically synthesized
cctgacttttgaatgatagcca

SEQ ID NO: 721245 - DNA, 22 bp, Artificial Sequence
  chemically synthesized
tttcctgacttttgaatgatag

SEQ ID NO: 721246 - DNA, 22 bp, Artificial Sequence
  chemically synthesized
ttgtttcctgacttttgaatga

SEQ ID NO: 721247 - DNA, 22 bp, Artificial Sequence
  chemically synthesized
gaatggctatcattcaaaagtc

SEQ ID NO: 721248 - DNA, 22 bp, Artificial Sequence
  chemically synthesized
gcatctgttgtttcctgacttt

SEQ ID NO: 721249 - DNA, 22 bp, Artificial Sequence
  chemically synthesized
tggcatctgttgtttcctgact

SEQ ID NO: 721250 - DNA, 22 bp, Artificial Sequence
  chemically synthesized
tctggcatctgttgtttcctga

SEQ ID NO: 721251 - DNA, 22 bp, Artificial Sequence
  chemically synthesized
tcattcaaaagtcaggaaacaa

SEQ ID NO: 721252 - DNA, 22 bp, Artificial Sequence
  chemically synthesized
aaaagtcaggaaacaacagatg

SEQ ID NO: 721253 - DNA, 22 bp, Artificial Sequence
  chemically synthesized
cacatcctctctggcatctgtt

SEQ ID NO: 721254 - DNA, 22 bp, Artificial Sequence
  chemically synthesized
tccacatcctctctggcatctg

SEQ ID NO: 721255 - DNA, 22 bp, Artificial Sequence
  chemically synthesized
ctccacatcctctctggcatct

SEQ ID NO: 721256 - DNA, 22 bp, Artificial Sequence
  chemically synthesized
tttctccacatcctctctggca

SEQ ID NO: 721257 - DNA, 22 bp, Artificial Sequence
  chemically synthesized
cagtcccaccaacagtgtaaaa

SEQ ID NO: 721258 - DNA, 22 bp, Artificial Sequence
  chemically synthesized
acagtcccaccaacagtgtaaa

SEQ ID NO: 721259 - DNA, 22 bp, Artificial Sequence
  chemically synthesized
gtttacagtcccaccaacagtg

SEQ ID NO: 721260 - DNA, 22 bp, Artificial Sequence
  chemically synthesized
aactagtttacagtcccaccaa

SEQ ID NO: 721261 - DNA, 22 bp, Artificial Sequence
  chemically synthesized
ttacactgttggtgggactgta

SEQ ID NO: 721262 - DNA, 22 bp, Artificial Sequence
  chemically synthesized
tacactgttggtgggactgtaa

SEQ ID NO: 721263 - DNA, 22 bp, Artificial Sequence
  chemically synthesized
acactgttggtgggactgtaaa

SEQ ID NO: 721264 - DNA, 22 bp, Artificial Sequence
  chemically synthesized
cactgttggtgggactgtaaac

SEQ ID NO: 721265 - DNA, 22 bp, Artificial Sequence
  chemically synthesized
cacaatggttgaactagtttac

SEQ ID NO: 721266 - DNA, 22 bp, Artificial Sequence
  chemically synthesized
ttggtgggactgtaaactagtt

SEQ ID NO: 721267 - DNA, 22 bp, Artificial Sequence
  chemically synthesized
ccacaatggttgaactagttta

SEQ ID NO: 721268 - DNA, 22 bp, Artificial Sequence
  chemically synthesized
gtgggactgtaaactagttcaa

SEQ ID NO: 721269 - DNA, 22 bp, Artificial Sequence
  chemically synthesized
tcttccacaatggttgaactag

SEQ ID NO: 721270 - DNA, 22 bp, Artificial Sequence
  chemically synthesized
taaactagttcaaccattgtgg

SEQ ID NO: 721271 - DNA, 22 bp, Artificial Sequence
  chemically synthesized
ccacactgtcttccacaatggt

SEQ ID NO: 721272 - DNA, 22 bp, Artificial Sequence
  chemically synthesized
gttcaaccattgtggaagacag

SEQ ID NO: 721273 - DNA, 22 bp, Artificial Sequence
  chemically synthesized
aggaattgccacactgtcttcc

SEQ ID NO: 721274 - DNA, 22 bp, Artificial Sequence
  chemically synthesized
gaggaattgccacactgtcttc

SEQ ID NO: 721275 - DNA, 22 bp, Artificial Sequence
  chemically synthesized
aaccattgtggaagacagtgtg

SEQ ID NO: 721276 - DNA, 22 bp, Artificial Sequence
  chemically synthesized
gatccttgaggaattgccacac

SEQ ID NO: 721277 - DNA, 22 bp, Artificial Sequence
  chemically synthesized
tagatccttgaggaattgccac

SEQ ID NO: 721278 - DNA, 22 bp, Artificial Sequence
  chemically synthesized
tggaagacagtgtggcaattcc

SEQ ID NO: 721279 - DNA, 22 bp, Artificial Sequence
  chemically synthesized
gttctagatccttgaggaattg

SEQ ID NO: 721280 - DNA, 22 bp, Artificial Sequence
  chemically synthesized
tagttctagatccttgaggaat

SEQ ID NO: 721281 - DNA, 22 bp, Artificial Sequence
  chemically synthesized
ctagttctagatccttgaggaa

SEQ ID NO: 721282 - DNA, 22 bp, Artificial Sequence
  chemically synthesized
ctcaaggatctagaactagaaa

SEQ ID NO: 721283 - DNA, 22 bp, Artificial Sequence
  chemically synthesized
ggtcaaatggtatttctagttc

SEQ ID NO: 721284 - DNA, 22 bp, Artificial Sequence
  chemically synthesized
aaggatctagaactagaaatac

SEQ ID NO: 721285 - DNA, 22 bp, Artificial Sequence
  chemically synthesized
gaactagaaataccatttgacc

SEQ ID NO: 721286 - DNA, 22 bp, Artificial Sequence
  chemically synthesized
gaaataccatttgacccagcca

SEQ ID NO: 721287 - DNA, 22 bp, Artificial Sequence
  chemically synthesized
ggtatatacccagtaatgggat

SEQ ID NO: 721288 - DNA, 22 bp, Artificial Sequence
  chemically synthesized
gggtatatacccagtaatggga

SEQ ID NO: 721289 - DNA, 22 bp, Artificial Sequence
  chemically synthesized
tgggtatatacccagtaatggg

SEQ ID NO: 721290 - DNA, 22 bp, Artificial Sequence
  chemically synthesized
gacccagccatcccattactgg

SEQ ID NO: 721291 - DNA, 22 bp, Artificial Sequence
  chemically synthesized
acccagccatcccattactggg

SEQ ID NO: 721292 - DNA, 22 bp, Artificial Sequence
  chemically synthesized
taatcctttgggtatataccca

SEQ ID NO: 721293 - DNA, 22 bp, Artificial Sequence
  chemically synthesized
ataatcctttgggtatataccc

SEQ ID NO: 721294 - DNA, 22 bp, Artificial Sequence
  chemically synthesized
ctgggtatatacccaaaggatt

SEQ ID NO: 721295 - DNA, 22 bp, Artificial Sequence
  chemically synthesized
ggtatatacccaaaggattata

SEQ ID NO: 721296 - DNA, 22 bp, Artificial Sequence
  chemically synthesized
atagcagcatgatttataatcc

SEQ ID NO: 721297 - DNA, 22 bp, Artificial Sequence
  chemically synthesized
catagcagcatgatttataatc

SEQ ID NO: 721298 - DNA, 22 bp, Artificial Sequence
  chemically synthesized
taaatcatgctgctatgaagac

SEQ ID NO: 721299 - DNA, 22 bp, Artificial Sequence
  chemically synthesized
ctatgaagacacatgcacacgt

SEQ ID NO: 721300 - DNA, 22 bp, Artificial Sequence
  chemically synthesized
tgaagacacatgcacacgtatg

SEQ ID NO: 721301 - DNA, 22 bp, Artificial Sequence
  chemically synthesized
tgaacagtgccgcaataaacat

SEQ ID NO: 721302 - DNA, 22 bp, Artificial Sequence
  chemically synthesized
ttgtgaacagtgccgcaataaa

SEQ ID NO: 721303 - DNA, 22 bp, Artificial Sequence
  chemically synthesized
ctattgtgaacagtgccgcaat

SEQ ID NO: 721304 - DNA, 22 bp, Artificial Sequence
  chemically synthesized
gctattgtgaacagtgccgcaa

SEQ ID NO: 721305 - DNA, 22 bp, Artificial Sequence
  chemically synthesized
tgctattgtgaacagtgccgca

SEQ ID NO: 721306 - DNA, 22 bp, Artificial Sequence
  chemically synthesized
caaatctttgctattgtgaaca

SEQ ID NO: 721307 - DNA, 22 bp, Artificial Sequence
  chemically synthesized
attgcggcactgttcacaatag

SEQ ID NO: 721308 - DNA, 22 bp, Artificial Sequence
  chemically synthesized
ttgcggcactgttcacaatagc

SEQ ID NO: 721309 - DNA, 22 bp, Artificial Sequence
  chemically synthesized
gttccaaatctttgctattgtg

SEQ ID NO: 721310 - DNA, 22 bp, Artificial Sequence
  chemically synthesized
cggcactgttcacaatagcaaa

SEQ ID NO: 721311 - DNA, 22 bp, Artificial Sequence
  chemically synthesized
ggttggttccaaatctttgcta

SEQ ID NO: 721312 - DNA, 22 bp, Artificial Sequence
  chemically synthesized
gggttggttccaaatctttgct

SEQ ID NO: 721313 - DNA, 22 bp, Artificial Sequence
  chemically synthesized
ttcacaatagcaaagatttgga

SEQ ID NO: 721314 - DNA, 22 bp, Artificial Sequence
  chemically synthesized
acaatagcaaagatttggaacc

SEQ ID NO: 721315 - DNA, 22 bp, Artificial Sequence
  chemically synthesized
atggacatttgggttggttcca

SEQ ID NO: 721316 - DNA, 22 bp, Artificial Sequence
  chemically synthesized
tcattgatggacatttgggttg

SEQ ID NO: 721317 - DNA, 22 bp, Artificial Sequence
  chemically synthesized
ggaaccaacccaaatgtccatc

SEQ ID NO: 721318 - DNA, 22 bp, Artificial Sequence
  chemically synthesized
gaaccaacccaaatgtccatca

SEQ ID NO: 721319 - DNA, 22 bp, Artificial Sequence
  chemically synthesized
atccagtctatcattgatggac

SEQ ID NO: 721320 - DNA, 22 bp, Artificial Sequence
  chemically synthesized
aatccagtctatcattgatgga

SEQ ID NO: 721321 - DNA, 22 bp, Artificial Sequence
  chemically synthesized
ttaatccagtctatcattgatg

SEQ ID NO: 721322 - DNA, 22 bp, Artificial Sequence
  chemically synthesized
cttaatccagtctatcattgat

SEQ ID NO: 721323 - DNA, 22 bp, Artificial Sequence
  chemically synthesized
tcttaatccagtctatcattga

SEQ ID NO: 721324 - DNA, 22 bp, Artificial Sequence
  chemically synthesized
catggtgtatatgtgccacatt

SEQ ID NO: 721325 - DNA, 22 bp, Artificial Sequence
  chemically synthesized
gattaagaaaatgtggcacata

SEQ ID NO: 721326 - DNA, 22 bp, Artificial Sequence
  chemically synthesized
agaaaatgtggcacatatacac

SEQ ID NO: 721327 - DNA, 22 bp, Artificial Sequence
  chemically synthesized
catagtattccatggtgtatat

SEQ ID NO: 721328 - DNA, 22 bp, Artificial Sequence
  chemically synthesized
tggctgcatagtattccatggt

SEQ ID NO: 721329 - DNA, 22 bp, Artificial Sequence
  chemically synthesized
atggctgcatagtattccatgg

SEQ ID NO: 721330 - DNA, 22 bp, Artificial Sequence
  chemically synthesized
tatggctgcatagtattccatg

SEQ ID NO: 721331 - DNA, 22 bp, Artificial Sequence
  chemically synthesized
ttatggctgcatagtattccat

SEQ ID NO: 721332 - DNA, 22 bp, Artificial Sequence
  chemically synthesized
tttatggctgcatagtattcca

SEQ ID NO: 721333 - DNA, 22 bp, Artificial Sequence
  chemically synthesized
ttttatggctgcatagtattcc

SEQ ID NO: 721334 - DNA, 22 bp, Artificial Sequence
  chemically synthesized
atccttttttatggctgcatag

SEQ ID NO: 721335 - DNA, 22 bp, Artificial Sequence
  chemically synthesized
tgcagccataaaaaaggatgaa

SEQ ID NO: 721336 - DNA, 22 bp, Artificial Sequence
  chemically synthesized
caaaggatatgaattcatcctt

SEQ ID NO: 721337 - DNA, 22 bp, Artificial Sequence
  chemically synthesized
atccatgtccctacaaaggata

SEQ ID NO: 721338 - DNA, 22 bp, Artificial Sequence
  chemically synthesized
catccatgtccctacaaaggat

SEQ ID NO: 721339 - DNA, 22 bp, Artificial Sequence
  chemically synthesized
cagcttcatccatgtccctaca

SEQ ID NO: 721340 - DNA, 22 bp, Artificial Sequence
  chemically synthesized
ccagcttcatccatgtccctac

SEQ ID NO: 721341 - DNA, 22 bp, Artificial Sequence
  chemically synthesized
atatcctttgtagggacatgga

SEQ ID NO: 721342 - DNA, 22 bp, Artificial Sequence
  chemically synthesized
tgtagggacatggatgaagctg

SEQ ID NO: 721343 - DNA, 22 bp, Artificial Sequence
  chemically synthesized
gtagggacatggatgaagctgg

SEQ ID NO: 721344 - DNA, 22 bp, Artificial Sequence
  chemically synthesized
tagggacatggatgaagctgga

SEQ ID NO: 721345 - DNA, 22 bp, Artificial Sequence
  chemically synthesized
agaatgatggtttccagcttca

SEQ ID NO: 721346 - DNA, 22 bp, Artificial Sequence
  chemically synthesized
ctgagaatgatggtttccagct

SEQ ID NO: 721347 - DNA, 22 bp, Artificial Sequence
  chemically synthesized
gctgagaatgatggtttccagc

SEQ ID NO: 721348 - DNA, 22 bp, Artificial Sequence
  chemically synthesized
tgatagtttgctgagaatgatg

SEQ ID NO: 721349 - DNA, 22 bp, Artificial Sequence
  chemically synthesized
gtgatagtttgctgagaatgat

SEQ ID NO: 721350 - DNA, 22 bp, Artificial Sequence
  chemically synthesized
tccttgtgatagtttgctgaga

SEQ ID NO: 721351 - DNA, 22 bp, Artificial Sequence
  chemically synthesized
gaaaccatcattctcagcaaac

SEQ ID NO: 721352 - DNA, 22 bp, Artificial Sequence
  chemically synthesized
tgtccttgtgatagtttgctga

SEQ ID NO: 721353 - DNA, 22 bp, Artificial Sequence
  chemically synthesized
ctgtccttgtgatagtttgctg

SEQ ID NO: 721354 - DNA, 22 bp, Artificial Sequence
  chemically synthesized
tctgtccttgtgatagtttgct

SEQ ID NO: 721355 - DNA, 22 bp, Artificial Sequence
  chemically synthesized
gttttctgtccttgtgatagtt

SEQ ID NO: 721356 - DNA, 22 bp, Artificial Sequence
  chemically synthesized
ggttttctgtccttgtgatagt

SEQ ID NO: 721357 - DNA, 22 bp, Artificial Sequence
  chemically synthesized
tcagcaaactatcacaaggaca

SEQ ID NO: 721358 - DNA, 22 bp, Artificial Sequence
  chemically synthesized
agcaaactatcacaaggacaga

SEQ ID NO: 721359 - DNA, 22 bp, Artificial Sequence
  chemically synthesized
tcacaaggacagaaaaccaaac

SEQ ID NO: 721360 - DNA, 22 bp, Artificial Sequence
  chemically synthesized
tgagtgagaacatgcaatgttt

SEQ ID NO: 721361 - DNA, 22 bp, Artificial Sequence
  chemically synthesized
atgagtgagaacatgcaatgtt

SEQ ID NO: 721362 - DNA, 22 bp, Artificial Sequence
  chemically synthesized
ccacttatgagtgagaacatgc

SEQ ID NO: 721363 - DNA, 22 bp, Artificial Sequence
  chemically synthesized
aattcccacttatgagtgagaa

SEQ ID NO: 721364 - DNA, 22 bp, Artificial Sequence
  chemically synthesized
ttcaattcccacttatgagtga

SEQ ID NO: 721365 - DNA, 22 bp, Artificial Sequence
  chemically synthesized
attgttcaattcccacttatga

SEQ ID NO: 721366 - DNA, 22 bp, Artificial Sequence
  chemically synthesized
catgttctcactcataagtggg

SEQ ID NO: 721367 - DNA, 22 bp, Artificial Sequence
  chemically synthesized
tcattgttcaattcccacttat

SEQ ID NO: 721368 - DNA, 22 bp, Artificial Sequence
  chemically synthesized
tcactcataagtgggaattgaa

SEQ ID NO: 721369 - DNA, 22 bp, Artificial Sequence
  chemically synthesized
actcataagtgggaattgaaca

SEQ ID NO: 721370 - DNA, 22 bp, Artificial Sequence
  chemically synthesized
ataagtgggaattgaacaatga

SEQ ID NO: 721371 - DNA, 22 bp, Artificial Sequence
  chemically synthesized
tgtccatgtgttctcattgttc

SEQ ID NO: 721372 - DNA, 22 bp, Artificial Sequence
  chemically synthesized
ctgtgtccatgtgttctcattg

SEQ ID NO: 721373 - DNA, 22 bp, Artificial Sequence
  chemically synthesized
cctgtgtccatgtgttctcatt

SEQ ID NO: 721374 - DNA, 22 bp, Artificial Sequence
  chemically synthesized
cttcctgtgtccatgtgttctc

SEQ ID NO: 721375 - DNA, 22 bp, Artificial Sequence
  chemically synthesized
tccttcctgtgtccatgtgttc

SEQ ID NO: 721376 - DNA, 22 bp, Artificial Sequence
  chemically synthesized
aacaatgagaacacatggacac

SEQ ID NO: 721377 - DNA, 22 bp, Artificial Sequence
  chemically synthesized
gtgtgtgatgttctccttcctg

SEQ ID NO: 721378 - DNA, 22 bp, Artificial Sequence
  chemically synthesized
accccaaaacagtccctggtgt

SEQ ID NO: 721379 - DNA, 22 bp, Artificial Sequence
  chemically synthesized
ccctcaccccaaaacagtccct

SEQ ID NO: 721380 - DNA, 22 bp, Artificial Sequence
  chemically synthesized
cctcccctcaccccaaaacagt

SEQ ID NO: 721381 - DNA, 22 bp, Artificial Sequence
  chemically synthesized
ctccctcccctcaccccaaaac

SEQ ID NO: 721382 - DNA, 22 bp, Artificial Sequence
  chemically synthesized
tccctcctccctcccctcaccc

SEQ ID NO: 721383 - DNA, 22 bp, Artificial Sequence
  chemically synthesized
atgctatccctcctccctcccc

SEQ ID NO: 721384 - DNA, 22 bp, Artificial Sequence
  chemically synthesized
ttttggggtgaggggagggagg

SEQ ID NO: 721385 - DNA, 22 bp, Artificial Sequence
  chemically synthesized
ctaatgctatccctcctccctc

SEQ ID NO: 721386 - DNA, 22 bp, Artificial Sequence
  chemically synthesized
tggggtgaggggagggaggagg

SEQ ID NO: 721387 - DNA, 22 bp, Artificial Sequence
  chemically synthesized
ggggtgaggggagggaggaggg

SEQ ID NO: 721388 - DNA, 22 bp, Artificial Sequence
  chemically synthesized
gggtgaggggagggaggaggga

SEQ ID NO: 721389 - DNA, 22 bp, Artificial Sequence
  chemically synthesized
ggtatatctcctaatgctatcc

SEQ ID NO: 721390 - DNA, 22 bp, Artificial Sequence
  chemically synthesized
cattaggtatatctcctaatgc

SEQ ID NO: 721391 - DNA, 22 bp, Artificial Sequence
  chemically synthesized
acattaggtatatctcctaatg

SEQ ID NO: 721392 - DNA, 22 bp, Artificial Sequence
  chemically synthesized
gtcatttacattaggtatatct

SEQ ID NO: 721393 - DNA, 22 bp, Artificial Sequence
  chemically synthesized
actcgtcatttacattaggtat

SEQ ID NO: 721394 - DNA, 22 bp, Artificial Sequence
  chemically synthesized
ggagatatacctaatgtaaatg

SEQ ID NO: 721395 - DNA, 22 bp, Artificial Sequence
  chemically synthesized
cacccattaactcgtcatttac

SEQ ID NO: 721396 - DNA, 22 bp, Artificial Sequence
  chemically synthesized
gtgtgctgcacccattaactcg

SEQ ID NO: 721397 - DNA, 22 bp, Artificial Sequence
  chemically synthesized
atgtaaatgacgagttaatggg

SEQ ID NO: 721398 - DNA, 22 bp, Artificial Sequence
  chemically synthesized
atgggtgcagcacaccaacatg

SEQ ID NO: 721399 - DNA, 22 bp, Artificial Sequence
  chemically synthesized
catatgtatacatgtgccatgt

SEQ ID NO: 721400 - DNA, 22 bp, Artificial Sequence
  chemically synthesized
ttacatatgtatacatgtgcca

SEQ ID NO: 721401 - DNA, 22 bp, Artificial Sequence
  chemically synthesized
gttacatatgtatacatgtgcc

SEQ ID NO: 721402 - DNA, 22 bp, Artificial Sequence
  chemically synthesized
gggtacatgtgcacaacgtgca

SEQ ID NO: 721403 - DNA, 22 bp, Artificial Sequence
  chemically synthesized
tagggtacatgtgcacaacgtg

SEQ ID NO: 721404 - DNA, 22 bp, Artificial Sequence
  chemically synthesized
agttctagggtacatgtgcaca

SEQ ID NO: 721405 - DNA, 22 bp, Artificial Sequence
  chemically synthesized
aagttctagggtacatgtgcac

SEQ ID NO: 721406 - DNA, 22 bp, Artificial Sequence
  chemically synthesized
cacgttgtgcacatgtacccta

SEQ ID NO: 721407 - DNA, 22 bp, Artificial Sequence
  chemically synthesized
tagtttaagttctagggtacat

SEQ ID NO: 721408 - DNA, 22 bp, Artificial Sequence
  chemically synthesized
ctatagtttaagttctagggta

SEQ ID NO: 721409 - DNA, 22 bp, Artificial Sequence
  chemically synthesized
ttactatagtttaagttctagg

SEQ ID NO: 721410 - DNA, 22 bp, Artificial Sequence
  chemically synthesized
tgcacatgtaccctagaactta

SEQ ID NO: 721411 - DNA, 22 bp, Artificial Sequence
  chemically synthesized
ttattactatagtttaagttct

SEQ ID NO: 721412 - DNA, 22 bp, Artificial Sequence
  chemically synthesized
attattactatagtttaagttc

SEQ ID NO: 721413 - DNA, 22 bp, Artificial Sequence
  chemically synthesized
tattattactatagtttaagtt

SEQ ID NO: 721414 - DNA, 22 bp, Artificial Sequence
  chemically synthesized
ttattattactatagtttaagt

SEQ ID NO: 721415 - DNA, 22 bp, Artificial Sequence
  chemically synthesized
tttattattactatagtttaag

SEQ ID NO: 721416 - DNA, 22 bp, Artificial Sequence
  chemically synthesized
ttttattattactatagtttaa

SEQ ID NO: 721417 - DNA, 22 bp, Artificial Sequence
  chemically synthesized
tttttattattactatagttta

SEQ ID NO: 721418 - DNA, 22 bp, Artificial Sequence
  chemically synthesized
ttttttattattactatagttt

SEQ ID NO: 721419 - DNA, 22 bp, Artificial Sequence
  chemically synthesized
tttttttattattactatagtt

SEQ ID NO: 721420 - DNA, 22 bp, Artificial Sequence
  chemically synthesized
ttttttttattattactatagt

SEQ ID NO: 721421 - DNA, 22 bp, Artificial Sequence
  chemically synthesized
ttttttttttattattactata

SEQ ID NO: 721422 - DNA, 22 bp, Artificial Sequence
  chemically synthesized
cttttttttttattattactat

SEQ ID NO: 721423 - DNA, 22 bp, Artificial Sequence
  chemically synthesized
gaacttaaactatagtaataat

SEQ ID NO: 721424 - DNA, 22 bp, Artificial Sequence
  chemically synthesized
ttcttttttttttattattact

SEQ ID NO: 721425 - DNA, 22 bp, Artificial Sequence
  chemically synthesized
aaactatagtaataataaaaaa

SEQ ID NO: 721426 - DNA, 22 bp, Artificial Sequence
  chemically synthesized
aactatagtaataataaaaaaa

SEQ ID NO: 721427 - DNA, 22 bp, Artificial Sequence
  chemically synthesized
tagtaataataaaaaaaaaaga

SEQ ID NO: 721428 - DNA, 22 bp, Artificial Sequence
  chemically synthesized
acacagacataggaaaaccaac

SEQ ID NO: 721429 - DNA, 22 bp, Artificial Sequence
  chemically synthesized
atgggggttggttttcctatgt

SEQ ID NO: 721430 - DNA, 22 bp, Artificial Sequence
  chemically synthesized
agcctcacacagacataggaaa

SEQ ID NO: 721431 - DNA, 22 bp, Artificial Sequence
  chemically synthesized
cagcctcacacagacataggaa

SEQ ID NO: 721432 - DNA, 22 bp, Artificial Sequence
  chemically synthesized
tcagcctcacacagacatagga

SEQ ID NO: 721433 - DNA, 22 bp, Artificial Sequence
  chemically synthesized
ttcagcctcacacagacatagg

SEQ ID NO: 721434 - DNA, 22 bp, Artificial Sequence
  chemically synthesized
gttttcctatgtctgtgtgagg

SEQ ID NO: 721435 - DNA, 22 bp, Artificial Sequence
  chemically synthesized
tcctatgtctgtgtgaggctga

SEQ ID NO: 721436 - DNA, 22 bp, Artificial Sequence
  chemically synthesized
cctatgtctgtgtgaggctgaa

SEQ ID NO: 721437 - DNA, 22 bp, Artificial Sequence
  chemically synthesized
ctatgtctgtgtgaggctgaaa

SEQ ID NO: 721438 - DNA, 22 bp, Artificial Sequence
  chemically synthesized
aaaataccagcttttcagcctc

SEQ ID NO: 721439 - DNA, 22 bp, Artificial Sequence
  chemically synthesized
tgtctgtgtgaggctgaaaagc

SEQ ID NO: 721440 - DNA, 22 bp, Artificial Sequence
  chemically synthesized
tgtgaggctgaaaagctggtat

SEQ ID NO: 721441 - DNA, 22 bp, Artificial Sequence
  chemically synthesized
aaaaacagaaaactgaaaatac

SEQ ID NO: 721442 - DNA, 22 bp, Artificial Sequence
  chemically synthesized
tgaaaaacagaaaactgaaaat

SEQ ID NO: 721443 - DNA, 22 bp, Artificial Sequence
  chemically synthesized
ctgaaaaacagaaaactgaaaa

SEQ ID NO: 721444 - DNA, 22 bp, Artificial Sequence
  chemically synthesized
aaaagctggtattttcagtttt

SEQ ID NO: 721445 - DNA, 22 bp, Artificial Sequence
  chemically synthesized
tctgaaaaacagaaaactgaaa

SEQ ID NO: 721446 - DNA, 22 bp, Artificial Sequence
  chemically synthesized
gtattttcagttttctgttttt

SEQ ID NO: 721447 - DNA, 22 bp, Artificial Sequence
  chemically synthesized
tcagttttctgtttttcagaaa

SEQ ID NO: 721448 - DNA, 22 bp, Artificial Sequence
  chemically synthesized
cagttttctgtttttcagaaaa

SEQ ID NO: 721449 - DNA, 22 bp, Artificial Sequence
  chemically synthesized
agttttctgtttttcagaaaat

SEQ ID NO: 721450 - DNA, 22 bp, Artificial Sequence
  chemically synthesized
tctgtttttcagaaaatgcctt

SEQ ID NO: 721451 - DNA, 22 bp, Artificial Sequence
  chemically synthesized
ctgtttttcagaaaatgccttc

SEQ ID NO: 721452 - DNA, 22 bp, Artificial Sequence
  chemically synthesized
tgtttttcagaaaatgccttcc

SEQ ID NO: 721453 - DNA, 22 bp, Artificial Sequence
  chemically synthesized
tttttcagaaaatgccttcccc

SEQ ID NO: 721454 - DNA, 22 bp, Artificial Sequence
  chemically synthesized
ttcagaaaatgccttccccttt

SEQ ID NO: 721455 - DNA, 22 bp, Artificial Sequence
  chemically synthesized
tcagaaaatgccttcccctttg

SEQ ID NO: 721456 - DNA, 22 bp, Artificial Sequence
  chemically synthesized
cagaaaatgccttcccctttgg

SEQ ID NO: 721457 - DNA, 22 bp, Artificial Sequence
  chemically synthesized
agaaaatgccttcccctttggg

SEQ ID NO: 721458 - DNA, 22 bp, Artificial Sequence
  chemically synthesized
cataatacagaacccaaagggg

SEQ ID NO: 721459 - DNA, 22 bp, Artificial Sequence
  chemically synthesized
tgattacataatacagaaccca

SEQ ID NO: 721460 - DNA, 22 bp, Artificial Sequence
  chemically synthesized
cccctttgggttctgtattatg

SEQ ID NO: 721461 - DNA, 22 bp, Artificial Sequence
  chemically synthesized
ccctttgggttctgtattatgt

SEQ ID NO: 721462 - DNA, 22 bp, Artificial Sequence
  chemically synthesized
aaagtgctatgattacataata

SEQ ID NO: 721463 - DNA, 22 bp, Artificial Sequence
  chemically synthesized
tgggttctgtattatgtaatca

SEQ ID NO: 721464 - DNA, 22 bp, Artificial Sequence
  chemically synthesized
gggttctgtattatgtaatcat

SEQ ID NO: 721465 - DNA, 22 bp, Artificial Sequence
  chemically synthesized
ggttctgtattatgtaatcata

SEQ ID NO: 721466 - DNA, 22 bp, Artificial Sequence
  chemically synthesized
tgtattatgtaatcatagcact

SEQ ID NO: 721467 - DNA, 22 bp, Artificial Sequence
  chemically synthesized
tattatgtaatcatagcacttt

SEQ ID NO: 721468 - DNA, 22 bp, Artificial Sequence
  chemically synthesized
tgtaatcatagcacttttaatg

SEQ ID NO: 721469 - DNA, 22 bp, Artificial Sequence
  chemically synthesized
aatgaggtaaggcattaaaagt

SEQ ID NO: 721470 - DNA, 22 bp, Artificial Sequence
  chemically synthesized
ttaatgccttacctcatttaat

SEQ ID NO: 721471 - DNA, 22 bp, Artificial Sequence
  chemically synthesized
ccatatgaagaaattaaatgag

SEQ ID NO: 721472 - DNA, 22 bp, Artificial Sequence
  chemically synthesized
taatgccttacctcatttaatt

SEQ ID NO: 721473 - DNA, 22 bp, Artificial Sequence
  chemically synthesized
aatgccttacctcatttaattt

SEQ ID NO: 721474 - DNA, 22 bp, Artificial Sequence
  chemically synthesized
atgccttacctcatttaatttc

SEQ ID NO: 721475 - DNA, 22 bp, Artificial Sequence
  chemically synthesized
cctcccatatgaagaaattaaa

SEQ ID NO: 721476 - DNA, 22 bp, Artificial Sequence
  chemically synthesized
acctcatttaatttcttcatat

SEQ ID NO: 721477 - DNA, 22 bp, Artificial Sequence
  chemically synthesized
gacctccctcccatatgaagaa

SEQ ID NO: 721478 - DNA, 22 bp, Artificial Sequence
  chemically synthesized
cctcatttaatttcttcatatg

SEQ ID NO: 721479 - DNA, 22 bp, Artificial Sequence
  chemically synthesized
atttaatttcttcatatgggag

SEQ ID NO: 721480 - DNA, 22 bp, Artificial Sequence
  chemically synthesized
aatttcttcatatgggagggag

SEQ ID NO: 721481 - DNA, 22 bp, Artificial Sequence
  chemically synthesized
gcagagttagacctccctccca

SEQ ID NO: 721482 - DNA, 22 bp, Artificial Sequence
  chemically synthesized
atttcttcatatgggagggagg

SEQ ID NO: 721483 - DNA, 22 bp, Artificial Sequence
  chemically synthesized
cttcatatgggagggaggtcta

SEQ ID NO: 721484 - DNA, 22 bp, Artificial Sequence
  chemically synthesized
ttcatatgggagggaggtctaa

SEQ ID NO: 721485 - DNA, 22 bp, Artificial Sequence
  chemically synthesized
catatgggagggaggtctaact

SEQ ID NO: 721486 - DNA, 22 bp, Artificial Sequence
  chemically synthesized
atatgggagggaggtctaactc

SEQ ID NO: 721487 - DNA, 22 bp, Artificial Sequence
  chemically synthesized
tccccagggagcataaagacta

SEQ ID NO: 721488 - DNA, 22 bp, Artificial Sequence
  chemically synthesized
actctgctagtctttatgctcc

SEQ ID NO: 721489 - DNA, 22 bp, Artificial Sequence
  chemically synthesized
gacccctgtccccagggagcat

SEQ ID NO: 721490 - DNA, 22 bp, Artificial Sequence
  chemically synthesized
tgctagtctttatgctccctgg

SEQ ID NO: 721491 - DNA, 22 bp, Artificial Sequence
  chemically synthesized
ctagtctttatgctccctgggg

SEQ ID NO: 721492 - DNA, 22 bp, Artificial Sequence
  chemically synthesized
gtctttatgctccctggggaca

SEQ ID NO: 721493 - DNA, 22 bp, Artificial Sequence
  chemically synthesized
tatgctccctggggacaggggt

SEQ ID NO: 721494 - DNA, 22 bp, Artificial Sequence
  chemically synthesized
atgctccctggggacaggggtc

SEQ ID NO: 721495 - DNA, 22 bp, Artificial Sequence
  chemically synthesized
tgctccctggggacaggggtct

SEQ ID NO: 721496 - DNA, 22 bp, Artificial Sequence
  chemically synthesized
cctggggacaggggtctaatcc

SEQ ID NO: 721497 - DNA, 22 bp, Artificial Sequence
  chemically synthesized
gaaacacagagatggattagac

SEQ ID NO: 721498 - DNA, 22 bp, Artificial Sequence
  chemically synthesized
tggaaacacagagatggattag

SEQ ID NO: 721499 - DNA, 22 bp, Artificial Sequence
  chemically synthesized
gggacaggggtctaatccatct

SEQ ID NO: 721500 - DNA, 22 bp, Artificial Sequence
  chemically synthesized
aattctggaaacacagagatgg

SEQ ID NO: 721501 - DNA, 22 bp, Artificial Sequence
  chemically synthesized
tgttaaattctggaaacacaga

SEQ ID NO: 721502 - DNA, 22 bp, Artificial Sequence
  chemically synthesized
atccatctctgtgtttccagaa

SEQ ID NO: 721503 - DNA, 22 bp, Artificial Sequence
  chemically synthesized
tgtgtttccagaatttaacaca

SEQ ID NO: 721504 - DNA, 22 bp, Artificial Sequence
  chemically synthesized
tgtgccaagcactgtgttaaat

SEQ ID NO: 721505 - DNA, 22 bp, Artificial Sequence
  chemically synthesized
tgtttccagaatttaacacagt

SEQ ID NO: 721506 - DNA, 22 bp, Artificial Sequence
  chemically synthesized
ccagaatttaacacagtgcttg

SEQ ID NO: 721507 - DNA, 22 bp, Artificial Sequence
  chemically synthesized
cagaatttaacacagtgcttgg

SEQ ID NO: 721508 - DNA, 22 bp, Artificial Sequence
  chemically synthesized
agcatccattatgtgccaagca

SEQ ID NO: 721509 - DNA, 22 bp, Artificial Sequence
  chemically synthesized
aacacagtgcttggcacataat

SEQ ID NO: 721510 - DNA, 22 bp, Artificial Sequence
  chemically synthesized
acacagtgcttggcacataatg

SEQ ID NO: 721511 - DNA, 22 bp, Artificial Sequence
  chemically synthesized
agtaaacaatattgagcatcca

SEQ ID NO: 721512 - DNA, 22 bp, Artificial Sequence
  chemically synthesized
ggcacataatggatgctcaata

SEQ ID NO: 721513 - DNA, 22 bp, Artificial Sequence
  chemically synthesized
gcacataatggatgctcaatat

SEQ ID NO: 721514 - DNA, 22 bp, Artificial Sequence
  chemically synthesized
atcatacagtcagtgattcagt

SEQ ID NO: 721515 - DNA, 22 bp, Artificial Sequence
  chemically synthesized
aatattgtttactgaatcactg

SEQ ID NO: 721516 - DNA, 22 bp, Artificial Sequence
  chemically synthesized
attcatcatacagtcagtgatt

SEQ ID NO: 721517 - DNA, 22 bp, Artificial Sequence
  chemically synthesized
attcattcatcatacagtcagt

SEQ ID NO: 721518 - DNA, 22 bp, Artificial Sequence
  chemically synthesized
tttactgaatcactgactgtat

SEQ ID NO: 721519 - DNA, 22 bp, Artificial Sequence
  chemically synthesized
actgaatcactgactgtatgat

SEQ ID NO: 721520 - DNA, 22 bp, Artificial Sequence
  chemically synthesized
ctgaatcactgactgtatgatg

SEQ ID NO: 721521 - DNA, 22 bp, Artificial Sequence
  chemically synthesized
aatcactgactgtatgatgaat

SEQ ID NO: 721522 - DNA, 22 bp, Artificial Sequence
  chemically synthesized
atgtgttcattcattcatcata

SEQ ID NO: 721523 - DNA, 22 bp, Artificial Sequence
  chemically synthesized
catgtgttcattcattcatcat

SEQ ID NO: 721524 - DNA, 22 bp, Artificial Sequence
  chemically synthesized
cttcatgtgttcattcattcat

SEQ ID NO: 721525 - DNA, 22 bp, Artificial Sequence
  chemically synthesized
acttcatgtgttcattcattca

SEQ ID NO: 721526 - DNA, 22 bp, Artificial Sequence
  chemically synthesized
tacttcatgtgttcattcattc

SEQ ID NO: 721527 - DNA, 22 bp, Artificial Sequence
  chemically synthesized
ttacttcatgtgttcattcatt

SEQ ID NO: 721528 - DNA, 22 bp, Artificial Sequence
  chemically synthesized
actgtatgatgaatgaatgaac

SEQ ID NO: 721529 - DNA, 22 bp, Artificial Sequence
  chemically synthesized
tatgatgaatgaatgaacacat

SEQ ID NO: 721530 - DNA, 22 bp, Artificial Sequence
  chemically synthesized
aatcatgtttttacttcatgtg

SEQ ID NO: 721531 - DNA, 22 bp, Artificial Sequence
  chemically synthesized
taaatcatgtttttacttcatg

SEQ ID NO: 721532 - DNA, 22 bp, Artificial Sequence
  chemically synthesized
gatagatcaggactctaaatca

SEQ ID NO: 721533 - DNA, 22 bp, Artificial Sequence
  chemically synthesized
tgattagatagatcaggactct

SEQ ID NO: 721534 - DNA, 22 bp, Artificial Sequence
  chemically synthesized
gtgattagatagatcaggactc

SEQ ID NO: 721535 - DNA, 22 bp, Artificial Sequence
  chemically synthesized
tgtgattagatagatcaggact

SEQ ID NO: 721536 - DNA, 22 bp, Artificial Sequence
  chemically synthesized
ctttgtgattagatagatcagg

SEQ ID NO: 721537 - DNA, 22 bp, Artificial Sequence
  chemically synthesized
agagtcctgatctatctaatca

SEQ ID NO: 721538 - DNA, 22 bp, Artificial Sequence
  chemically synthesized
gagtcctgatctatctaatcac

SEQ ID NO: 721539 - DNA, 22 bp, Artificial Sequence
  chemically synthesized
aaaccaaagagttcctttgtga

SEQ ID NO: 721540 - DNA, 22 bp, Artificial Sequence
  chemically synthesized
atctatctaatcacaaaggaac

SEQ ID NO: 721541 - DNA, 22 bp, Artificial Sequence
  chemically synthesized
tctaatcacaaaggaactcttt

SEQ ID NO: 721542 - DNA, 22 bp, Artificial Sequence
  chemically synthesized
atagattgaaaccaaagagttc

SEQ ID NO: 721543 - DNA, 22 bp, Artificial Sequence
  chemically synthesized
gatagattgaaaccaaagagtt

SEQ ID NO: 721544 - DNA, 22 bp, Artificial Sequence
  chemically synthesized
atcacaaaggaactctttggtt

SEQ ID NO: 721545 - DNA, 22 bp, Artificial Sequence
  chemically synthesized
cttgatagattgaaaccaaaga

SEQ ID NO: 721546 - DNA, 22 bp, Artificial Sequence
  chemically synthesized
tttggtttcaatctatcaagta

SEQ ID NO: 721547 - DNA, 22 bp, Artificial Sequence
  chemically synthesized
tgacagtcacaactacttgata

SEQ ID NO: 721548 - DNA, 22 bp, Artificial Sequence
  chemically synthesized
tggtttcaatctatcaagtagt

SEQ ID NO: 721549 - DNA, 22 bp, Artificial Sequence
  chemically synthesized
ggtttcaatctatcaagtagtt

SEQ ID NO: 721550 - DNA, 22 bp, Artificial Sequence
  chemically synthesized
gtttcaatctatcaagtagttg

SEQ ID NO: 721551 - DNA, 22 bp, Artificial Sequence
  chemically synthesized
caatctatcaagtagttgtgac

SEQ ID NO: 721552 - DNA, 22 bp, Artificial Sequence
  chemically synthesized
aatctatcaagtagttgtgact

SEQ ID NO: 721553 - DNA, 22 bp, Artificial Sequence
  chemically synthesized
aaagccattatgacagtcacaa

SEQ ID NO: 721554 - DNA, 22 bp, Artificial Sequence
  chemically synthesized
tcaagtagttgtgactgtcata

SEQ ID NO: 721555 - DNA, 22 bp, Artificial Sequence
  chemically synthesized
aagacagctgaaagccattatg

SEQ ID NO: 721556 - DNA, 22 bp, Artificial Sequence
  chemically synthesized
tgactgtcataatggctttcag

SEQ ID NO: 721557 - DNA, 22 bp, Artificial Sequence
  chemically synthesized
cagagctaaagacagctgaaag

SEQ ID NO: 721558 - DNA, 22 bp, Artificial Sequence
  chemically synthesized
tcataatggctttcagctgtct

SEQ ID NO: 721559 - DNA, 22 bp, Artificial Sequence
  chemically synthesized
ctgcagagctaaagacagctga

SEQ ID NO: 721560 - DNA, 22 bp, Artificial Sequence
  chemically synthesized
aaaaaactactgcagagctaaa

SEQ ID NO: 721561 - DNA, 22 bp, Artificial Sequence
  chemically synthesized
tcagctgtctttagctctgcag

SEQ ID NO: 721562 - DNA, 22 bp, Artificial Sequence
  chemically synthesized
ttaaaaaaactactgcagagct

SEQ ID NO: 721563 - DNA, 22 bp, Artificial Sequence
  chemically synthesized
cagctgtctttagctctgcagt

SEQ ID NO: 721564 - DNA, 22 bp, Artificial Sequence
  chemically synthesized
agctgtctttagctctgcagta

SEQ ID NO: 721565 - DNA, 22 bp, Artificial Sequence
  chemically synthesized
tctttagctctgcagtagtttt

SEQ ID NO: 721566 - DNA, 22 bp, Artificial Sequence
  chemically synthesized
tagctctgcagtagttttttta

SEQ ID NO: 721567 - DNA, 22 bp, Artificial Sequence
  chemically synthesized
agctctgcagtagtttttttaa

SEQ ID NO: 721568 - DNA, 22 bp, Artificial Sequence
  chemically synthesized
gaatgaagcctattaaaaaaac

SEQ ID NO: 721569 - DNA, 22 bp, Artificial Sequence
  chemically synthesized
gctctgcagtagtttttttaat

SEQ ID NO: 721570 - DNA, 22 bp, Artificial Sequence
  chemically synthesized
tgcagtagtttttttaataggc

SEQ ID NO: 721571 - DNA, 22 bp, Artificial Sequence
  chemically synthesized
cagtagtttttttaataggctt

SEQ ID NO: 721572 - DNA, 22 bp, Artificial Sequence
  chemically synthesized
agtatatgtgtctagaatgaag

SEQ ID NO: 721573 - DNA, 22 bp, Artificial Sequence
  chemically synthesized
ttttaataggcttcattctaga

SEQ ID NO: 721574 - DNA, 22 bp, Artificial Sequence
  chemically synthesized
tttaataggcttcattctagac

SEQ ID NO: 721575 - DNA, 22 bp, Artificial Sequence
  chemically synthesized
ttaataggcttcattctagaca

SEQ ID NO: 721576 - DNA, 22 bp, Artificial Sequence
  chemically synthesized
taataggcttcattctagacac

SEQ ID NO: 721577 - DNA, 22 bp, Artificial Sequence
  chemically synthesized
aataggcttcattctagacaca

SEQ ID NO: 721578 - DNA, 22 bp, Artificial Sequence
  chemically synthesized
ataggcttcattctagacacat

SEQ ID NO: 721579 - DNA, 22 bp, Artificial Sequence
  chemically synthesized
aggaacacctgagtatatgtgt

SEQ ID NO: 721580 - DNA, 22 bp, Artificial Sequence
  chemically synthesized
cattctagacacatatactcag

SEQ ID NO: 721581 - DNA, 22 bp, Artificial Sequence
  chemically synthesized
attctagacacatatactcagg

SEQ ID NO: 721582 - DNA, 22 bp, Artificial Sequence
  chemically synthesized
tagacacatatactcaggtgtt

SEQ ID NO: 721583 - DNA, 22 bp, Artificial Sequence
  chemically synthesized
gacacatatactcaggtgttcc

SEQ ID NO: 721584 - DNA, 22 bp, Artificial Sequence
  chemically synthesized
aggaagcagctcaggaacacct

SEQ ID NO: 721585 - DNA, 22 bp, Artificial Sequence
  chemically synthesized
aaggaagcagctcaggaacacc

SEQ ID NO: 721586 - DNA, 22 bp, Artificial Sequence
  chemically synthesized
aggtgttcctgagctgcttcct

SEQ ID NO: 721587 - DNA, 22 bp, Artificial Sequence
  chemically synthesized
accgaggaaatgccttaaggaa

SEQ ID NO: 721588 - DNA, 22 bp, Artificial Sequence
  chemically synthesized
ctgagctgcttccttaaggcat

SEQ ID NO: 721589 - DNA, 22 bp, Artificial Sequence
  chemically synthesized
agctgcttccttaaggcatttc

SEQ ID NO: 721590 - DNA, 22 bp, Artificial Sequence
  chemically synthesized
cttccttaaggcatttcctcgg

SEQ ID NO: 721591 - DNA, 22 bp, Artificial Sequence
  chemically synthesized
ccttaaggcatttcctcggtca

SEQ ID NO: 721592 - DNA, 22 bp, Artificial Sequence
  chemically synthesized
cttaaggcatttcctcggtcag

SEQ ID NO: 721593 - DNA, 22 bp, Artificial Sequence
  chemically synthesized
aaggcatttcctcggtcagatc

SEQ ID NO: 721594 - DNA, 22 bp, Artificial Sequence
  chemically synthesized
aggcatttcctcggtcagatct

SEQ ID NO: 721595 - DNA, 22 bp, Artificial Sequence
  chemically synthesized
cctcggtcagatctacttatgg

SEQ ID NO: 721596 - DNA, 22 bp, Artificial Sequence
  chemically synthesized
ctcggtcagatctacttatggt

SEQ ID NO: 721597 - DNA, 22 bp, Artificial Sequence
  chemically synthesized
tggtgagatgtcaaccataagt

SEQ ID NO: 721598 - DNA, 22 bp, Artificial Sequence
  chemically synthesized
ggtcagatctacttatggttga

SEQ ID NO: 721599 - DNA, 22 bp, Artificial Sequence
  chemically synthesized
gttgtggtgagatgtcaaccat

SEQ ID NO: 721600 - DNA, 22 bp, Artificial Sequence
  chemically synthesized
cttatggttgacatctcaccac

SEQ ID NO: 721601 - DNA, 22 bp, Artificial Sequence
  chemically synthesized
atggttgacatctcaccacaac

SEQ ID NO: 721602 - DNA, 22 bp, Artificial Sequence
  chemically synthesized
tggttgacatctcaccacaact

SEQ ID NO: 721603 - DNA, 22 bp, Artificial Sequence
  chemically synthesized
ccaaggtggtcatgttagttgt

SEQ ID NO: 721604 - DNA, 22 bp, Artificial Sequence
  chemically synthesized
acatctcaccacaactaacatg

SEQ ID NO: 721605 - DNA, 22 bp, Artificial Sequence
  chemically synthesized
accacaactaacatgaccacct

SEQ ID NO: 721606 - DNA, 22 bp, Artificial Sequence
  chemically synthesized
acatgaccaccttgggaatatt

SEQ ID NO: 721607 - DNA, 22 bp, Artificial Sequence
  chemically synthesized
cgcaaaaaagagcaatattccc

SEQ ID NO: 721608 - DNA, 22 bp, Artificial Sequence
  chemically synthesized
gggaatattgctcttttttgcg

SEQ ID NO: 721609 - DNA, 22 bp, Artificial Sequence
  chemically synthesized
gcccaaacattacgcaaaaaag

SEQ ID NO: 721610 - DNA, 22 bp, Artificial Sequence
  chemically synthesized
ggaatattgctcttttttgcgt

SEQ ID NO: 721611 - DNA, 22 bp, Artificial Sequence
  chemically synthesized
ttggcccaaacattacgcaaaa

SEQ ID NO: 721612 - DNA, 22 bp, Artificial Sequence
  chemically synthesized
ctcttttttgcgtaatgtttgg

SEQ ID NO: 721613 - DNA, 22 bp, Artificial Sequence
  chemically synthesized
ataacctgttggcccaaacatt

SEQ ID NO: 721614 - DNA, 22 bp, Artificial Sequence
  chemically synthesized
cataacctgttggcccaaacat

SEQ ID NO: 721615 - DNA, 22 bp, Artificial Sequence
  chemically synthesized
ttttttgcgtaatgtttgggcc

SEQ ID NO: 721616 - DNA, 22 bp, Artificial Sequence
  chemically synthesized
ttttgcgtaatgtttgggccaa

SEQ ID NO: 721617 - DNA, 22 bp, Artificial Sequence
  chemically synthesized
tttgcgtaatgtttgggccaac

SEQ ID NO: 721618 - DNA, 22 bp, Artificial Sequence
  chemically synthesized
gcttcataacctgttggcccaa

SEQ ID NO: 721619 - DNA, 22 bp, Artificial Sequence
  chemically synthesized
ttgcgtaatgtttgggccaaca

SEQ ID NO: 721620 - DNA, 22 bp, Artificial Sequence
  chemically synthesized
ggcttcataacctgttggccca

SEQ ID NO: 721621 - DNA, 22 bp, Artificial Sequence
  chemically synthesized
tgcgtaatgtttgggccaacag

SEQ ID NO: 721622 - DNA, 22 bp, Artificial Sequence
  chemically synthesized
gcgtaatgtttgggccaacagg

SEQ ID NO: 721623 - DNA, 22 bp, Artificial Sequence
  chemically synthesized
cgtaatgtttgggccaacaggt

SEQ ID NO: 721624 - DNA, 22 bp, Artificial Sequence
  chemically synthesized
tgtttggcttcataacctgttg

SEQ ID NO: 721625 - DNA, 22 bp, Artificial Sequence
  chemically synthesized
atcactgtgtttggcttcataa

SEQ ID NO: 721626 - DNA, 22 bp, Artificial Sequence
  chemically synthesized
gggccaacaggttatgaagcca

SEQ ID NO: 721627 - DNA, 22 bp, Artificial Sequence
  chemically synthesized
ggccaacaggttatgaagccaa

SEQ ID NO: 721628 - DNA, 22 bp, Artificial Sequence
  chemically synthesized
gtcctaatcactgtgtttggct

SEQ ID NO: 721629 - DNA, 22 bp, Artificial Sequence
  chemically synthesized
tgaagccaaacacagtgattag

SEQ ID NO: 721630 - DNA, 22 bp, Artificial Sequence
  chemically synthesized
ccccaggaagcccccaagtcca

SEQ ID NO: 721631 - DNA, 22 bp, Artificial Sequence
  chemically synthesized
ggactagtggacttgggggctt

SEQ ID NO: 721632 - DNA, 22 bp, Artificial Sequence
  chemically synthesized
taatgctcccccaggaagcccc

SEQ ID NO: 721633 - DNA, 22 bp, Artificial Sequence
  chemically synthesized
gtggacttgggggcttcctggg

SEQ ID NO: 721634 - DNA, 22 bp, Artificial Sequence
  chemically synthesized
tgtcacctgtaatgctccccca

SEQ ID NO: 721635 - DNA, 22 bp, Artificial Sequence
  chemically synthesized
gtgtcacctgtaatgctccccc

SEQ ID NO: 721636 - DNA, 22 bp, Artificial Sequence
  chemically synthesized
gggggcttcctgggggagcatt

SEQ ID NO: 721637 - DNA, 22 bp, Artificial Sequence
  chemically synthesized
tgtgtcacctgtaatgctcccc

SEQ ID NO: 721638 - DNA, 22 bp, Artificial Sequence
  chemically synthesized
ggggcttcctgggggagcatta

SEQ ID NO: 721639 - DNA, 22 bp, Artificial Sequence
  chemically synthesized
cctgggggagcattacaggtga

SEQ ID NO: 721640 - DNA, 22 bp, Artificial Sequence
  chemically synthesized
ctgggggagcattacaggtgac

SEQ ID NO: 721641 - DNA, 22 bp, Artificial Sequence
  chemically synthesized
ggggagcattacaggtgacaca

SEQ ID NO: 721642 - DNA, 22 bp, Artificial Sequence
  chemically synthesized
atgtcaaccaaggattttgtgt

SEQ ID NO: 721643 - DNA, 22 bp, Artificial Sequence
  chemically synthesized
aatgtcaaccaaggattttgtg

SEQ ID NO: 721644 - DNA, 22 bp, Artificial Sequence
  chemically synthesized
caggtgacacaaaatccttggt

SEQ ID NO: 721645 - DNA, 22 bp, Artificial Sequence
  chemically synthesized
ggttgacattaagtacatttgt

SEQ ID NO: 721646 - DNA, 22 bp, Artificial Sequence
  chemically synthesized
gttgacattaagtacatttgtg

SEQ ID NO: 721647 - DNA, 22 bp, Artificial Sequence
  chemically synthesized
taagcatcaaatccacaaatgt

SEQ ID NO: 721648 - DNA, 22 bp, Artificial Sequence
  chemically synthesized
gtaagcatcaaatccacaaatg

SEQ ID NO: 721649 - DNA, 22 bp, Artificial Sequence
  chemically synthesized
acattaagtacatttgtggatt

SEQ ID NO: 721650 - DNA, 22 bp, Artificial Sequence
  chemically synthesized
gatttgtaagcatcaaatccac

SEQ ID NO: 721651 - DNA, 22 bp, Artificial Sequence
  chemically synthesized
agtacatttgtggatttgatgc

SEQ ID NO: 721652 - DNA, 22 bp, Artificial Sequence
  chemically synthesized
gtggatttgatgcttacaaatc

SEQ ID NO: 721653 - DNA, 22 bp, Artificial Sequence
  chemically synthesized
tggatttgatgcttacaaatcc

SEQ ID NO: 721654 - DNA, 22 bp, Artificial Sequence
  chemically synthesized
ccaagggagtcacagctggatt

SEQ ID NO: 721655 - DNA, 22 bp, Artificial Sequence
  chemically synthesized
gccaagggagtcacagctggat

SEQ ID NO: 721656 - DNA, 22 bp, Artificial Sequence
  chemically synthesized
gatgcttacaaatccagctgtg

SEQ ID NO: 721657 - DNA, 22 bp, Artificial Sequence
  chemically synthesized
atgcttacaaatccagctgtga

SEQ ID NO: 721658 - DNA, 22 bp, Artificial Sequence
  chemically synthesized
aacttgccaagggagtcacagc

SEQ ID NO: 721659 - DNA, 22 bp, Artificial Sequence
  chemically synthesized
gaacttgccaagggagtcacag

SEQ ID NO: 721660 - DNA, 22 bp, Artificial Sequence
  chemically synthesized
acaaatccagctgtgactccct

SEQ ID NO: 721661 - DNA, 22 bp, Artificial Sequence
  chemically synthesized
caaatccagctgtgactccctt

SEQ ID NO: 721662 - DNA, 22 bp, Artificial Sequence
  chemically synthesized
agacttgaacttgccaagggag

SEQ ID NO: 721663 - DNA, 22 bp, Artificial Sequence
  chemically synthesized
tgactcccttggcaagttcaag

SEQ ID NO: 721664 - DNA, 22 bp, Artificial Sequence
  chemically synthesized
tagagtctaagacttgaacttg

SEQ ID NO: 721665 - DNA, 22 bp, Artificial Sequence
  chemically synthesized
ctatagagtctaagacttgaac

SEQ ID NO: 721666 - DNA, 22 bp, Artificial Sequence
  chemically synthesized
cctatagagtctaagacttgaa

SEQ ID NO: 721667 - DNA, 22 bp, Artificial Sequence
  chemically synthesized
ccttggcaagttcaagtcttag

SEQ ID NO: 721668 - DNA, 22 bp, Artificial Sequence
  chemically synthesized
gcttcctatagagtctaagact

SEQ ID NO: 721669 - DNA, 22 bp, Artificial Sequence
  chemically synthesized
agcttcctatagagtctaagac

SEQ ID NO: 721670 - DNA, 22 bp, Artificial Sequence
  chemically synthesized
ggcaagttcaagtcttagactc

SEQ ID NO: 721671 - DNA, 22 bp, Artificial Sequence
  chemically synthesized
tagcttcctatagagtctaaga

SEQ ID NO: 721672 - DNA, 22 bp, Artificial Sequence
  chemically synthesized
gcaagttcaagtcttagactct

SEQ ID NO: 721673 - DNA, 22 bp, Artificial Sequence
  chemically synthesized
ttagcttcctatagagtctaag

SEQ ID NO: 721674 - DNA, 22 bp, Artificial Sequence
  chemically synthesized
aagtcttagactctataggaag

SEQ ID NO: 721675 - DNA, 22 bp, Artificial Sequence
  chemically synthesized
agactctataggaagctaaaaa

SEQ ID NO: 721676 - DNA, 22 bp, Artificial Sequence
  chemically synthesized
gactctataggaagctaaaaat

SEQ ID NO: 721677 - DNA, 22 bp, Artificial Sequence
  chemically synthesized
atggaacaatgaccatttttag

SEQ ID NO: 721678 - DNA, 22 bp, Artificial Sequence
  chemically synthesized
gatggaacaatgaccattttta

SEQ ID NO: 721679 - DNA, 22 bp, Artificial Sequence
  chemically synthesized
tataggaagctaaaaatggtca

SEQ ID NO: 721680 - DNA, 22 bp, Artificial Sequence
  chemically synthesized
taggaagctaaaaatggtcatt

SEQ ID NO: 721681 - DNA, 22 bp, Artificial Sequence
  chemically synthesized
aaaatggtcattgttccatcaa

SEQ ID NO: 721682 - DNA, 22 bp, Artificial Sequence
  chemically synthesized
agatcataccaaatttgatgga

SEQ ID NO: 721683 - DNA, 22 bp, Artificial Sequence
  chemically synthesized
cagatcataccaaatttgatgg

SEQ ID NO: 721684 - DNA, 22 bp, Artificial Sequence
  chemically synthesized
tagatttcagatcataccaaat

SEQ ID NO: 721685 - DNA, 22 bp, Artificial Sequence
  chemically synthesized
ttccatcaaatttggtatgatc

SEQ ID NO: 721686 - DNA, 22 bp, Artificial Sequence
  chemically synthesized
catcaaatttggtatgatctga

SEQ ID NO: 721687 - DNA, 22 bp, Artificial Sequence
  chemically synthesized
ggtatgatctgaaatctacagc

SEQ ID NO: 721688 - DNA, 22 bp, Artificial Sequence
  chemically synthesized
gtatgatctgaaatctacagcc

SEQ ID NO: 721689 - DNA, 22 bp, Artificial Sequence
  chemically synthesized
aaaaatgacagaaagcatggct

SEQ ID NO: 721690 - DNA, 22 bp, Artificial Sequence
  chemically synthesized
aaaaaatgacagaaagcatggc

SEQ ID NO: 721691 - DNA, 22 bp, Artificial Sequence
  chemically synthesized
taaaaaatgacagaaagcatgg

SEQ ID NO: 721692 - DNA, 22 bp, Artificial Sequence
  chemically synthesized
ttaaaaaatgacagaaagcatg

SEQ ID NO: 721693 - DNA, 22 bp, Artificial Sequence
  chemically synthesized
aaatctacagccatgctttctg

SEQ ID NO: 721694 - DNA, 22 bp, Artificial Sequence
  chemically synthesized
cagccatgctttctgtcatttt

SEQ ID NO: 721695 - DNA, 22 bp, Artificial Sequence
  chemically synthesized
aggtcaatgtgccttttaaaaa

SEQ ID NO: 721696 - DNA, 22 bp, Artificial Sequence
  chemically synthesized
gaggtcaatgtgccttttaaaa

SEQ ID NO: 721697 - DNA, 22 bp, Artificial Sequence
  chemically synthesized
tgaggtcaatgtgccttttaaa

SEQ ID NO: 721698 - DNA, 22 bp, Artificial Sequence
  chemically synthesized
tctgtcattttttaaaaggcac

SEQ ID NO: 721699 - DNA, 22 bp, Artificial Sequence
  chemically synthesized
tttgaggtcaatgtgcctttta

SEQ ID NO: 721700 - DNA, 22 bp, Artificial Sequence
  chemically synthesized
ctgtcattttttaaaaggcaca

SEQ ID NO: 721701 - DNA, 22 bp, Artificial Sequence
  chemically synthesized
tgtcattttttaaaaggcacat

SEQ ID NO: 721702 - DNA, 22 bp, Artificial Sequence
  chemically synthesized
tcattttttaaaaggcacattg

SEQ ID NO: 721703 - DNA, 22 bp, Artificial Sequence
  chemically synthesized
tgctctttgaggtcaatgtgcc

SEQ ID NO: 721704 - DNA, 22 bp, Artificial Sequence
  chemically synthesized
tttaaaaggcacattgacctca

SEQ ID NO: 721705 - DNA, 22 bp, Artificial Sequence
  chemically synthesized
ttaaaaggcacattgacctcaa

SEQ ID NO: 721706 - DNA, 22 bp, Artificial Sequence
  chemically synthesized
aaattgtgctctttgaggtcaa

SEQ ID NO: 721707 - DNA, 22 bp, Artificial Sequence
  chemically synthesized
taaaaggcacattgacctcaaa

SEQ ID NO: 721708 - DNA, 22 bp, Artificial Sequence
  chemically synthesized
aaaaggcacattgacctcaaag

SEQ ID NO: 721709 - DNA, 22 bp, Artificial Sequence
  chemically synthesized
tcaaattgtgctctttgaggtc

SEQ ID NO: 721710 - DNA, 22 bp, Artificial Sequence
  chemically synthesized
aaaggcacattgacctcaaaga

SEQ ID NO: 721711 - DNA, 22 bp, Artificial Sequence
  chemically synthesized
ctctcaaattgtgctctttgag

SEQ ID NO: 721712 - DNA, 22 bp, Artificial Sequence
  chemically synthesized
aattcctctcaaattgtgctct

SEQ ID NO: 721713 - DNA, 22 bp, Artificial Sequence
  chemically synthesized
acctcaaagagcacaatttgag

SEQ ID NO: 721714 - DNA, 22 bp, Artificial Sequence
  chemically synthesized
atctgaattcctctcaaattgt

SEQ ID NO: 721715 - DNA, 22 bp, Artificial Sequence
  chemically synthesized
aaagagcacaatttgagaggaa

SEQ ID NO: 721716 - DNA, 22 bp, Artificial Sequence
  chemically synthesized
acctcatctgaattcctctcaa

SEQ ID NO: 721717 - DNA, 22 bp, Artificial Sequence
  chemically synthesized
gaattcacctcatctgaattcc

SEQ ID NO: 721718 - DNA, 22 bp, Artificial Sequence
  chemically synthesized
ggttagaattcacctcatctga

SEQ ID NO: 721719 - DNA, 22 bp, Artificial Sequence
  chemically synthesized
gagaggaattcagatgaggtga

SEQ ID NO: 721720 - DNA, 22 bp, Artificial Sequence
  chemically synthesized
agaggaattcagatgaggtgaa

SEQ ID NO: 721721 - DNA, 22 bp, Artificial Sequence
  chemically synthesized
atgtgatatctgggttagaatt

SEQ ID NO: 721722 - DNA, 22 bp, Artificial Sequence
  chemically synthesized
aatgtgatatctgggttagaat

SEQ ID NO: 721723 - DNA, 22 bp, Artificial Sequence
  chemically synthesized
agatgaggtgaattctaaccca

SEQ ID NO: 721724 - DNA, 22 bp, Artificial Sequence
  chemically synthesized
tttaatgtgatatctgggttag

SEQ ID NO: 721725 - DNA, 22 bp, Artificial Sequence
  chemically synthesized
taacccagatatcacattaaat

SEQ ID NO: 721726 - DNA, 22 bp, Artificial Sequence
  chemically synthesized
acccagatatcacattaaatag

SEQ ID NO: 721727 - DNA, 22 bp, Artificial Sequence
  chemically synthesized
gccaagatgacacagctattta

SEQ ID NO: 721728 - DNA, 22 bp, Artificial Sequence
  chemically synthesized
ggccaagatgacacagctattt

SEQ ID NO: 721729 - DNA, 22 bp, Artificial Sequence
  chemically synthesized
agacttggccaagatgacacag

SEQ ID NO: 721730 - DNA, 22 bp, Artificial Sequence
  chemically synthesized
aatagctgtgtcatcttggcca

SEQ ID NO: 721731 - DNA, 22 bp, Artificial Sequence
  chemically synthesized
aaaaaggttaagacttggccaa

SEQ ID NO: 721732 - DNA, 22 bp, Artificial Sequence
  chemically synthesized
tgtcatcttggccaagtcttaa

SEQ ID NO: 721733 - DNA, 22 bp, Artificial Sequence
  chemically synthesized
gacaagttcaaaaaggttaaga

SEQ ID NO: 721734 - DNA, 22 bp, Artificial Sequence
  chemically synthesized
ctagacaagttcaaaaaggtta

SEQ ID NO: 721735 - DNA, 22 bp, Artificial Sequence
  chemically synthesized
actagacaagttcaaaaaggtt

SEQ ID NO: 721736 - DNA, 22 bp, Artificial Sequence
  chemically synthesized
ggccaagtcttaacctttttga

SEQ ID NO: 721737 - DNA, 22 bp, Artificial Sequence
  chemically synthesized
gccaagtcttaacctttttgaa

SEQ ID NO: 721738 - DNA, 22 bp, Artificial Sequence
  chemically synthesized
acacccttactagacaagttca

SEQ ID NO: 721739 - DNA, 22 bp, Artificial Sequence
  chemically synthesized
aacctttttgaacttgtctagt

SEQ ID NO: 721740 - DNA, 22 bp, Artificial Sequence
  chemically synthesized
acctttttgaacttgtctagta

SEQ ID NO: 721741 - DNA, 22 bp, Artificial Sequence
  chemically synthesized
gtctaacacccttactagacaa

SEQ ID NO: 721742 - DNA, 22 bp, Artificial Sequence
  chemically synthesized
tttgaacttgtctagtaagggt

SEQ ID NO: 721743 - DNA, 22 bp, Artificial Sequence
  chemically synthesized
ttgaacttgtctagtaagggtg

SEQ ID NO: 721744 - DNA, 22 bp, Artificial Sequence
  chemically synthesized
tgaacttgtctagtaagggtgt

SEQ ID NO: 721745 - DNA, 22 bp, Artificial Sequence
  chemically synthesized
gaacttgtctagtaagggtgtt

SEQ ID NO: 721746 - DNA, 22 bp, Artificial Sequence
  chemically synthesized
aacttgtctagtaagggtgtta

SEQ ID NO: 721747 - DNA, 22 bp, Artificial Sequence
  chemically synthesized
gtctagtaagggtgttagacta

SEQ ID NO: 721748 - DNA, 22 bp, Artificial Sequence
  chemically synthesized
tctagtaagggtgttagactag

SEQ ID NO: 721749 - DNA, 22 bp, Artificial Sequence
  chemically synthesized
gtaagggtgttagactagatga

SEQ ID NO: 721750 - DNA, 22 bp, Artificial Sequence
  chemically synthesized
catatcatgagatcatctagtc

SEQ ID NO: 721751 - DNA, 22 bp, Artificial Sequence
  chemically synthesized
acatatcatgagatcatctagt

SEQ ID NO: 721752 - DNA, 22 bp, Artificial Sequence
  chemically synthesized
atttacatatcatgagatcatc

SEQ ID NO: 721753 - DNA, 22 bp, Artificial Sequence
  chemically synthesized
gactagatgatctcatgatatg

SEQ ID NO: 721754 - DNA, 22 bp, Artificial Sequence
  chemically synthesized
gatgatctcatgatatgtaaat

SEQ ID NO: 721755 - DNA, 22 bp, Artificial Sequence
  chemically synthesized
atgatatgtaaattaattcttt

SEQ ID NO: 721756 - DNA, 22 bp, Artificial Sequence
  chemically synthesized
aaacaaaaaaaaaaagaattaa

SEQ ID NO: 721757 - DNA, 22 bp, Artificial Sequence
  chemically synthesized
tctcaaacaaaaaaaaaaagaa

SEQ ID NO: 721758 - DNA, 22 bp, Artificial Sequence
  chemically synthesized
tgtctcaaacaaaaaaaaaaag

SEQ ID NO: 721759 - DNA, 22 bp, Artificial Sequence
  chemically synthesized
attctttttttttttgtttgag

SEQ ID NO: 721760 - DNA, 22 bp, Artificial Sequence
  chemically synthesized
tttttttttttgtttgagacag

SEQ ID NO: 721761 - DNA, 22 bp, Artificial Sequence
  chemically synthesized
tttttttttgtttgagacagag

SEQ ID NO: 721762 - DNA, 22 bp, Artificial Sequence
  chemically synthesized
ttttttttgtttgagacagagt

SEQ ID NO: 721763 - DNA, 22 bp, Artificial Sequence
  chemically synthesized
tttttttgtttgagacagagtc

SEQ ID NO: 721764 - DNA, 22 bp, Artificial Sequence
  chemically synthesized
ttttttgtttgagacagagtct

SEQ ID NO: 721765 - DNA, 22 bp, Artificial Sequence
  chemically synthesized
ggtgacagagcgagactctgtc

SEQ ID NO: 721766 - DNA, 22 bp, Artificial Sequence
  chemically synthesized
tttttgtttgagacagagtctc

SEQ ID NO: 721767 - DNA, 22 bp, Artificial Sequence
  chemically synthesized
ttttgtttgagacagagtctcg

SEQ ID NO: 721768 - DNA, 22 bp, Artificial Sequence
  chemically synthesized
tttgtttgagacagagtctcgc

SEQ ID NO: 721769 - DNA, 22 bp, Artificial Sequence
  chemically synthesized
ttgtttgagacagagtctcgct

SEQ ID NO: 721770 - DNA, 22 bp, Artificial Sequence
  chemically synthesized
tgtttgagacagagtctcgctc

SEQ ID NO: 721771 - DNA, 22 bp, Artificial Sequence
  chemically synthesized
gtttgagacagagtctcgctct

SEQ ID NO: 721772 - DNA, 22 bp, Artificial Sequence
  chemically synthesized
tttgagacagagtctcgctctg

SEQ ID NO: 721773 - DNA, 22 bp, Artificial Sequence
  chemically synthesized
cagcctgggtgacagagcgaga

SEQ ID NO: 721774 - DNA, 22 bp, Artificial Sequence
  chemically synthesized
gagacagagtctcgctctgtca

SEQ ID NO: 721775 - DNA, 22 bp, Artificial Sequence
  chemically synthesized
agacagagtctcgctctgtcac

SEQ ID NO: 721776 - DNA, 22 bp, Artificial Sequence
  chemically synthesized
tactccagcctgggtgacagag

SEQ ID NO: 721777 - DNA, 22 bp, Artificial Sequence
  chemically synthesized
caccactgtactccagcctggg

SEQ ID NO: 721778 - DNA, 22 bp, Artificial Sequence
  chemically synthesized
gctctgtcacccaggctggagt

SEQ ID NO: 721779 - DNA, 22 bp, Artificial Sequence
  chemically synthesized
tgtcacccaggctggagtacag

SEQ ID NO: 721780 - DNA, 22 bp, Artificial Sequence
  chemically synthesized
tcacccaggctggagtacagtg

SEQ ID NO: 721781 - DNA, 22 bp, Artificial Sequence
  chemically synthesized
gagtacagtggtgcaatcttgg

SEQ ID NO: 721782 - DNA, 22 bp, Artificial Sequence
  chemically synthesized
ggctcactgcatcctctgcctc

SEQ ID NO: 721783 - DNA, 22 bp, Artificial Sequence
  chemically synthesized
gctcactgcatcctctgcctcc

SEQ ID NO: 721784 - DNA, 22 bp, Artificial Sequence
  chemically synthesized
actgcatcctctgcctcctggg

SEQ ID NO: 721785 - DNA, 22 bp, Artificial Sequence
  chemically synthesized
catcctctgcctcctgggttca

SEQ ID NO: 721786 - DNA, 22 bp, Artificial Sequence
  chemically synthesized
aggcaggagagtcacatgaacc

SEQ ID NO: 721787 - DNA, 22 bp, Artificial Sequence
  chemically synthesized
tgcctcctgggttcatgtgact

SEQ ID NO: 721788 - DNA, 22 bp, Artificial Sequence
  chemically synthesized
cctcctgggttcatgtgactct

SEQ ID NO: 721789 - DNA, 22 bp, Artificial Sequence
  chemically synthesized
ggaggctgaggcaggagagtca

SEQ ID NO: 721790 - DNA, 22 bp, Artificial Sequence
  chemically synthesized
ctgggttcatgtgactctcctg

SEQ ID NO: 721791 - DNA, 22 bp, Artificial Sequence
  chemically synthesized
gggaggctgaggcaggagagtc

SEQ ID NO: 721792 - DNA, 22 bp, Artificial Sequence
  chemically synthesized
ggttcatgtgactctcctgcct

SEQ ID NO: 721793 - DNA, 22 bp, Artificial Sequence
  chemically synthesized
cttgggaggctgaggcaggaga

SEQ ID NO: 721794 - DNA, 22 bp, Artificial Sequence
  chemically synthesized
atgtgactctcctgcctcagcc

SEQ ID NO: 721795 - DNA, 22 bp, Artificial Sequence
  chemically synthesized
tcctgcctcagcctcccaagta

SEQ ID NO: 721796 - DNA, 22 bp, Artificial Sequence
  chemically synthesized
ctgcctcagcctcccaagtagc

SEQ ID NO: 721797 - DNA, 22 bp, Artificial Sequence
  chemically synthesized
cctcagcctcccaagtagccgg

SEQ ID NO: 721798 - DNA, 22 bp, Artificial Sequence
  chemically synthesized
agcctcccaagtagccgggact

SEQ ID NO: 721799 - DNA, 22 bp, Artificial Sequence
  chemically synthesized
ccaagtagccgggactatgggc

SEQ ID NO: 721800 - DNA, 22 bp, Artificial Sequence
  chemically synthesized
gccaggcatagtggtgcatgcc

SEQ ID NO: 721801 - DNA, 22 bp, Artificial Sequence
  chemically synthesized
agccaggcatagtggtgcatgc

SEQ ID NO: 721802 - DNA, 22 bp, Artificial Sequence
  chemically synthesized
tgggcatgcaccactatgcctg

SEQ ID NO: 721803 - DNA, 22 bp, Artificial Sequence
  chemically synthesized
aaaatacaaaacttagccaggc

SEQ ID NO: 721804 - DNA, 22 bp, Artificial Sequence
  chemically synthesized
ctaaaaatacaaaacttagcca

SEQ ID NO: 721805 - DNA, 22 bp, Artificial Sequence
  chemically synthesized
tactaaaaatacaaaacttagc

SEQ ID NO: 721806 - DNA, 22 bp, Artificial Sequence
  chemically synthesized
tgcctggctaagttttgtattt

SEQ ID NO: 721807 - DNA, 22 bp, Artificial Sequence
  chemically synthesized
gctaagttttgtatttttagta

SEQ ID NO: 721808 - DNA, 22 bp, Artificial Sequence
  chemically synthesized
agttttgtatttttagtagaga

SEQ ID NO: 721809 - DNA, 22 bp, Artificial Sequence
  chemically synthesized
tgtatttttagtagagacgcgg

SEQ ID NO: 721810 - DNA, 22 bp, Artificial Sequence
  chemically synthesized
gtatttttagtagagacgcggt

SEQ ID NO: 721811 - DNA, 22 bp, Artificial Sequence
  chemically synthesized
tatttttagtagagacgcggtt

SEQ ID NO: 721812 - DNA, 22 bp, Artificial Sequence
  chemically synthesized
gccaacatggcaaaaccgcgtc

SEQ ID NO: 721813 - DNA, 22 bp, Artificial Sequence
  chemically synthesized
ttagtagagacgcggttttgcc

SEQ ID NO: 721814 - DNA, 22 bp, Artificial Sequence
  chemically synthesized
tagtagagacgcggttttgcca

SEQ ID NO: 721815 - DNA, 22 bp, Artificial Sequence
  chemically synthesized
agtagagacgcggttttgccat

SEQ ID NO: 721816 - DNA, 22 bp, Artificial Sequence
  chemically synthesized
gtagagacgcggttttgccatg

SEQ ID NO: 721817 - DNA, 22 bp, Artificial Sequence
  chemically synthesized
aagaccagcctggccaacatgg

SEQ ID NO: 721818 - DNA, 22 bp, Artificial Sequence
  chemically synthesized
tgccatgttggccaggctggtc

SEQ ID NO: 721819 - DNA, 22 bp, Artificial Sequence
  chemically synthesized
gccatgttggccaggctggtct

SEQ ID NO: 721820 - DNA, 22 bp, Artificial Sequence
  chemically synthesized
ccatgttggccaggctggtctt

SEQ ID NO: 721821 - DNA, 22 bp, Artificial Sequence
  chemically synthesized
aggtcaggagttcaagaccagc

SEQ ID NO: 721822 - DNA, 22 bp, Artificial Sequence
  chemically synthesized
gccaggctggtcttgaactcct

SEQ ID NO: 721823 - DNA, 22 bp, Artificial Sequence
  chemically synthesized
gtcttgaactcctgacctcagg

SEQ ID NO: 721824 - DNA, 22 bp, Artificial Sequence
  chemically synthesized
gaactcctgacctcaggtgatc

SEQ ID NO: 721825 - DNA, 22 bp, Artificial Sequence
  chemically synthesized
aactcctgacctcaggtgatcc

SEQ ID NO: 721826 - DNA, 22 bp, Artificial Sequence
  chemically synthesized
gaggccaaggcgggtggatcac

SEQ ID NO: 721827 - DNA, 22 bp, Artificial Sequence
  chemically synthesized
ggaggccaaggcgggtggatca

SEQ ID NO: 721828 - DNA, 22 bp, Artificial Sequence
  chemically synthesized
ctgacctcaggtgatccacccg

SEQ ID NO: 721829 - DNA, 22 bp, Artificial Sequence
  chemically synthesized
tggaggccaaggcgggtggatc

SEQ ID NO: 721830 - DNA, 22 bp, Artificial Sequence
  chemically synthesized
ttggaggccaaggcgggtggat

SEQ ID NO: 721831 - DNA, 22 bp, Artificial Sequence
  chemically synthesized
acctcaggtgatccacccgcct

SEQ ID NO: 721832 - DNA, 22 bp, Artificial Sequence
  chemically synthesized
aggtgatccacccgccttggcc

SEQ ID NO: 721833 - DNA, 22 bp, Artificial Sequence
  chemically synthesized
taatcccagcacttttggaggc

SEQ ID NO: 721834 - DNA, 22 bp, Artificial Sequence
  chemically synthesized
acacctgtaatcccagcacttt

SEQ ID NO: 721835 - DNA, 22 bp, Artificial Sequence
  chemically synthesized
ggcctccaaaagtgctgggatt

SEQ ID NO: 721836 - DNA, 22 bp, Artificial Sequence
  chemically synthesized
gcctccaaaagtgctgggatta

SEQ ID NO: 721837 - DNA, 22 bp, Artificial Sequence
  chemically synthesized
caaaagtgctgggattacaggt

SEQ ID NO: 721838 - DNA, 22 bp, Artificial Sequence
  chemically synthesized
ggccaggtgtggtggctcacac

SEQ ID NO: 721839 - DNA, 22 bp, Artificial Sequence
  chemically synthesized
ggattacaggtgtgagccacca

SEQ ID NO: 721840 - DNA, 22 bp, Artificial Sequence
  chemically synthesized
caggtgtgagccaccacacctg

SEQ ID NO: 721841 - DNA, 22 bp, Artificial Sequence
  chemically synthesized
aaagaattaggccaggtgtggt

SEQ ID NO: 721842 - DNA, 22 bp, Artificial Sequence
  chemically synthesized
aaaagaattaggccaggtgtgg

SEQ ID NO: 721843 - DNA, 22 bp, Artificial Sequence
  chemically synthesized
tataacatttaaaagaattagg

SEQ ID NO: 721844 - DNA, 22 bp, Artificial Sequence
  chemically synthesized
attatataacatttaaaagaat

SEQ ID NO: 721845 - DNA, 22 bp, Artificial Sequence
  chemically synthesized
agctgattatataacatttaaa

SEQ ID NO: 721846 - DNA, 22 bp, Artificial Sequence
  chemically synthesized
gcctaattcttttaaatgttat

SEQ ID NO: 721847 - DNA, 22 bp, Artificial Sequence
  chemically synthesized
attcttttaaatgttatataat

SEQ ID NO: 721848 - DNA, 22 bp, Artificial Sequence
  chemically synthesized
ttttaaatgttatataatcagc

SEQ ID NO: 721849 - DNA, 22 bp, Artificial Sequence
  chemically synthesized
aggcaagactaagctgattata

SEQ ID NO: 721850 - DNA, 22 bp, Artificial Sequence
  chemically synthesized
gaggcaagactaagctgattat

SEQ ID NO: 721851 - DNA, 22 bp, Artificial Sequence
  chemically synthesized
ttaaatgttatataatcagctt

SEQ ID NO: 721852 - DNA, 22 bp, Artificial Sequence
  chemically synthesized
taaatgttatataatcagctta

SEQ ID NO: 721853 - DNA, 22 bp, Artificial Sequence
  chemically synthesized
aaatgttatataatcagcttag

SEQ ID NO: 721854 - DNA, 22 bp, Artificial Sequence
  chemically synthesized
aatgttatataatcagcttagt

SEQ ID NO: 721855 - DNA, 22 bp, Artificial Sequence
  chemically synthesized
tataatcagcttagtcttgcct

SEQ ID NO: 721856 - DNA, 22 bp, Artificial Sequence
  chemically synthesized
agtcttgcctcaaggacttttt

SEQ ID NO: 721857 - DNA, 22 bp, Artificial Sequence
  chemically synthesized
gtcttgcctcaaggacttttta

SEQ ID NO: 721858 - DNA, 22 bp, Artificial Sequence
  chemically synthesized
gcctcaaggactttttatgtgt

SEQ ID NO: 721859 - DNA, 22 bp, Artificial Sequence
  chemically synthesized
cctcaaggactttttatgtgtt

SEQ ID NO: 721860 - DNA, 22 bp, Artificial Sequence
  chemically synthesized
tgtcccaaacagggcaacacat

SEQ ID NO: 721861 - DNA, 22 bp, Artificial Sequence
  chemically synthesized
aaggactttttatgtgttgccc

SEQ ID NO: 721862 - DNA, 22 bp, Artificial Sequence
  chemically synthesized
tttatgtgttgccctgtttggg

SEQ ID NO: 721863 - DNA, 22 bp, Artificial Sequence
  chemically synthesized
ttatgtgttgccctgtttggga

SEQ ID NO: 721864 - DNA, 22 bp, Artificial Sequence
  chemically synthesized
tatgtgttgccctgtttgggac

SEQ ID NO: 721865 - DNA, 22 bp, Artificial Sequence
  chemically synthesized
atgaggaattgtgtcccaaaca

SEQ ID NO: 721866 - DNA, 22 bp, Artificial Sequence
  chemically synthesized
atgtgttgccctgtttgggaca

SEQ ID NO: 721867 - DNA, 22 bp, Artificial Sequence
  chemically synthesized
tgtgttgccctgtttgggacac

SEQ ID NO: 721868 - DNA, 22 bp, Artificial Sequence
  chemically synthesized
ccctgtttgggacacaattcct

SEQ ID NO: 721869 - DNA, 22 bp, Artificial Sequence
  chemically synthesized
tttgggacacaattcctcatga

SEQ ID NO: 721870 - DNA, 22 bp, Artificial Sequence
  chemically synthesized
gggacacaattcctcatgaact

SEQ ID NO: 721871 - DNA, 22 bp, Artificial Sequence
  chemically synthesized
ggacacaattcctcatgaactt

SEQ ID NO: 721872 - DNA, 22 bp, Artificial Sequence
  chemically synthesized
ctcatgaactttcgggtctccc

SEQ ID NO: 721873 - DNA, 22 bp, Artificial Sequence
  chemically synthesized
aaagaagtggggagggagaccc

SEQ ID NO: 721874 - DNA, 22 bp, Artificial Sequence
  chemically synthesized
atgaactttcgggtctccctcc

SEQ ID NO: 721875 - DNA, 22 bp, Artificial Sequence
  chemically synthesized
tcgggtctccctccccacttct

SEQ ID NO: 721876 - DNA, 22 bp, Artificial Sequence
  chemically synthesized
cgggtctccctccccacttctt

SEQ ID NO: 721877 - DNA, 22 bp, Artificial Sequence
  chemically synthesized
gggtctccctccccacttcttt

SEQ ID NO: 721878 - DNA, 22 bp, Artificial Sequence
  chemically synthesized
aggaaagacctgaaagaagtgg

SEQ ID NO: 721879 - DNA, 22 bp, Artificial Sequence
  chemically synthesized
gaggaaagacctgaaagaagtg

SEQ ID NO: 721880 - DNA, 22 bp, Artificial Sequence
  chemically synthesized
cctccccacttctttcaggtct

SEQ ID NO: 721881 - DNA, 22 bp, Artificial Sequence
  chemically synthesized
cccacttctttcaggtctttcc

SEQ ID NO: 721882 - DNA, 22 bp, Artificial Sequence
  chemically synthesized
aggaggtgacatttgaggaaag

SEQ ID NO: 721883 - DNA, 22 bp, Artificial Sequence
  chemically synthesized
ctttcaggtctttcctcaaatg

SEQ ID NO: 721884 - DNA, 22 bp, Artificial Sequence
  chemically synthesized
tttcaggtctttcctcaaatgt

SEQ ID NO: 721885 - DNA, 22 bp, Artificial Sequence
  chemically synthesized
cactgaggaggtgacatttgag

SEQ ID NO: 721886 - DNA, 22 bp, Artificial Sequence
  chemically synthesized
tcaggtctttcctcaaatgtca

SEQ ID NO: 721887 - DNA, 22 bp, Artificial Sequence
  chemically synthesized
caggtctttcctcaaatgtcac

SEQ ID NO: 721888 - DNA, 22 bp, Artificial Sequence
  chemically synthesized
aggtctttcctcaaatgtcacc

SEQ ID NO: 721889 - DNA, 22 bp, Artificial Sequence
  chemically synthesized
tcctcaaatgtcacctcctcag

SEQ ID NO: 721890 - DNA, 22 bp, Artificial Sequence
  chemically synthesized
cctcaaatgtcacctcctcagt

SEQ ID NO: 721891 - DNA, 22 bp, Artificial Sequence
  chemically synthesized
ctcaaatgtcacctcctcagtg

SEQ ID NO: 721892 - DNA, 22 bp, Artificial Sequence
  chemically synthesized
aaatgtcacctcctcagtggaa

SEQ ID NO: 721893 - DNA, 22 bp, Artificial Sequence
  chemically synthesized
tataaggtgatcagggaaggtt

SEQ ID NO: 721894 - DNA, 22 bp, Artificial Sequence
  chemically synthesized
atataaggtgatcagggaaggt

SEQ ID NO: 721895 - DNA, 22 bp, Artificial Sequence
  chemically synthesized
tatataaggtgatcagggaagg

SEQ ID NO: 721896 - DNA, 22 bp, Artificial Sequence
  chemically synthesized
ctcagtggaaccttccctgatc

SEQ ID NO: 721897 - DNA, 22 bp, Artificial Sequence
  chemically synthesized
agtggaaccttccctgatcacc

SEQ ID NO: 721898 - DNA, 22 bp, Artificial Sequence
  chemically synthesized
tcattttatataaggtgatcag

SEQ ID NO: 721899 - DNA, 22 bp, Artificial Sequence
  chemically synthesized
ccctgatcaccttatataaaat

SEQ ID NO: 721900 - DNA, 22 bp, Artificial Sequence
  chemically synthesized
cctgatcaccttatataaaatg

SEQ ID NO: 721901 - DNA, 22 bp, Artificial Sequence
  chemically synthesized
atggaaggaattgtcattttat

SEQ ID NO: 721902 - DNA, 22 bp, Artificial Sequence
  chemically synthesized
atcaccttatataaaatgacaa

SEQ ID NO: 721903 - DNA, 22 bp, Artificial Sequence
  chemically synthesized
ttcatggaaggaattgtcattt

SEQ ID NO: 721904 - DNA, 22 bp, Artificial Sequence
  chemically synthesized
atataaaatgacaattccttcc

SEQ ID NO: 721905 - DNA, 22 bp, Artificial Sequence
  chemically synthesized
tataaaatgacaattccttcca

SEQ ID NO: 721906 - DNA, 22 bp, Artificial Sequence
  chemically synthesized
gagagttgttcatggaaggaat

SEQ ID NO: 721907 - DNA, 22 bp, Artificial Sequence
  chemically synthesized
cttccatgaacaactctctagc

SEQ ID NO: 721908 - DNA, 22 bp, Artificial Sequence
  chemically synthesized
ccatgaacaactctctagcgtc

SEQ ID NO: 721909 - DNA, 22 bp, Artificial Sequence
  chemically synthesized
catgaacaactctctagcgtct

SEQ ID NO: 721910 - DNA, 22 bp, Artificial Sequence
  chemically synthesized
aaataaataaagcaaggaagac

SEQ ID NO: 721911 - DNA, 22 bp, Artificial Sequence
  chemically synthesized
tctagcgtcttccttgctttat

SEQ ID NO: 721912 - DNA, 22 bp, Artificial Sequence
  chemically synthesized
tagcgtcttccttgctttattt

SEQ ID NO: 721913 - DNA, 22 bp, Artificial Sequence
  chemically synthesized
gcgtcttccttgctttatttat

SEQ ID NO: 721914 - DNA, 22 bp, Artificial Sequence
  chemically synthesized
ccttgctttatttatttcaaca

SEQ ID NO: 721915 - DNA, 22 bp, Artificial Sequence
  chemically synthesized
cttgctttatttatttcaacat

SEQ ID NO: 721916 - DNA, 22 bp, Artificial Sequence
  chemically synthesized
aatagtgacagcatgttgaaat

SEQ ID NO: 721917 - DNA, 22 bp, Artificial Sequence
  chemically synthesized
aaatagtgacagcatgttgaaa

SEQ ID NO: 721918 - DNA, 22 bp, Artificial Sequence
  chemically synthesized
taaatagtgacagcatgttgaa

SEQ ID NO: 721919 - DNA, 22 bp, Artificial Sequence
  chemically synthesized
gctttatttatttcaacatgct

SEQ ID NO: 721920 - DNA, 22 bp, Artificial Sequence
  chemically synthesized
ctttatttatttcaacatgctg

SEQ ID NO: 721921 - DNA, 22 bp, Artificial Sequence
  chemically synthesized
tatttatttcaacatgctgtca

SEQ ID NO: 721922 - DNA, 22 bp, Artificial Sequence
  chemically synthesized
atttatttcaacatgctgtcac

SEQ ID NO: 721923 - DNA, 22 bp, Artificial Sequence
  chemically synthesized
tttatttcaacatgctgtcact

SEQ ID NO: 721924 - DNA, 22 bp, Artificial Sequence
  chemically synthesized
atttcaacatgctgtcactatt

SEQ ID NO: 721925 - DNA, 22 bp, Artificial Sequence
  chemically synthesized
tttcaacatgctgtcactattt

SEQ ID NO: 721926 - DNA, 22 bp, Artificial Sequence
  chemically synthesized
caacatgctgtcactatttaaa

SEQ ID NO: 721927 - DNA, 22 bp, Artificial Sequence
  chemically synthesized
tcatataacaattttaaatagt

SEQ ID NO: 721928 - DNA, 22 bp, Artificial Sequence
  chemically synthesized
aacatgctgtcactatttaaaa

SEQ ID NO: 721929 - DNA, 22 bp, Artificial Sequence
  chemically synthesized
tcactatttaaaattgttatat

SEQ ID NO: 721930 - DNA, 22 bp, Artificial Sequence
  chemically synthesized
tttaaaattgttatatgataat

SEQ ID NO: 721931 - DNA, 22 bp, Artificial Sequence
  chemically synthesized
aaaattgttatatgataattgt

SEQ ID NO: 721932 - DNA, 22 bp, Artificial Sequence
  chemically synthesized
aaattgttatatgataattgtg

SEQ ID NO: 721933 - DNA, 22 bp, Artificial Sequence
  chemically synthesized
ttatatgataattgtgtacttg

SEQ ID NO: 721934 - DNA, 22 bp, Artificial Sequence
  chemically synthesized
tatgataattgtgtacttgttt

SEQ ID NO: 721935 - DNA, 22 bp, Artificial Sequence
  chemically synthesized
tgtacttgtttatcatctttct

SEQ ID NO: 721936 - DNA, 22 bp, Artificial Sequence
  chemically synthesized
gtttatcatctttcttctttgt

SEQ ID NO: 721937 - DNA, 22 bp, Artificial Sequence
  chemically synthesized
tttatcatctttcttctttgtt

SEQ ID NO: 721938 - DNA, 22 bp, Artificial Sequence
  chemically synthesized
atcatctttcttctttgttttt

SEQ ID NO: 721939 - DNA, 22 bp, Artificial Sequence
  chemically synthesized
tcatctttcttctttgtttttc

SEQ ID NO: 721940 - DNA, 22 bp, Artificial Sequence
  chemically synthesized
aaaaaaaaaaaaaaccgaaaaa

SEQ ID NO: 721941 - DNA, 22 bp, Artificial Sequence
  chemically synthesized
tcttctttgtttttcggttttt

SEQ ID NO: 721942 - DNA, 22 bp, Artificial Sequence
  chemically synthesized
cttctttgtttttcggtttttt

SEQ ID NO: 721943 - DNA, 22 bp, Artificial Sequence
  chemically synthesized
ttctttgtttttcggttttttt

SEQ ID NO: 721944 - DNA, 22 bp, Artificial Sequence
  chemically synthesized
catctcaaaaaaaaaaaaaacc

SEQ ID NO: 721945 - DNA, 22 bp, Artificial Sequence
  chemically synthesized
ctttgtttttcggttttttttt

SEQ ID NO: 721946 - DNA, 22 bp, Artificial Sequence
  chemically synthesized
tttgtttttcggtttttttttt

SEQ ID NO: 721947 - DNA, 22 bp, Artificial Sequence
  chemically synthesized
tgtttttcggtttttttttttt

SEQ ID NO: 721948 - DNA, 22 bp, Artificial Sequence
  chemically synthesized
gtttttcggttttttttttttt

SEQ ID NO: 721949 - DNA, 22 bp, Artificial Sequence
  chemically synthesized
tttttcggtttttttttttttt

SEQ ID NO: 721950 - DNA, 22 bp, Artificial Sequence
  chemically synthesized
ttcggttttttttttttttgag

SEQ ID NO: 721951 - DNA, 22 bp, Artificial Sequence
  chemically synthesized
tcggttttttttttttttgaga

SEQ ID NO: 721952 - DNA, 22 bp, Artificial Sequence
  chemically synthesized
agcaagattccatctcaaaaaa

SEQ ID NO: 721953 - DNA, 22 bp, Artificial Sequence
  chemically synthesized
cggttttttttttttttgagat

SEQ ID NO: 721954 - DNA, 22 bp, Artificial Sequence
  chemically synthesized
ggttttttttttttttgagatg

SEQ ID NO: 721955 - DNA, 22 bp, Artificial Sequence
  chemically synthesized
tttttttttttgagatggaatc

SEQ ID NO: 721956 - DNA, 22 bp, Artificial Sequence
  chemically synthesized
ttttttttttgagatggaatct

SEQ ID NO: 721957 - DNA, 22 bp, Artificial Sequence
  chemically synthesized
ggtgactgagcaagattccatc

SEQ ID NO: 721958 - DNA, 22 bp, Artificial Sequence
  chemically synthesized
tttttttttgagatggaatctt

SEQ ID NO: 721959 - DNA, 22 bp, Artificial Sequence
  chemically synthesized
ttttttttgagatggaatcttg

SEQ ID NO: 721960 - DNA, 22 bp, Artificial Sequence
  chemically synthesized
tttttttgagatggaatcttgc

SEQ ID NO: 721961 - DNA, 22 bp, Artificial Sequence
  chemically synthesized
ttttttgagatggaatcttgct

SEQ ID NO: 721962 - DNA, 22 bp, Artificial Sequence
  chemically synthesized
tttttgagatggaatcttgctc

SEQ ID NO: 721963 - DNA, 22 bp, Artificial Sequence
  chemically synthesized
ttttgagatggaatcttgctca

SEQ ID NO: 721964 - DNA, 22 bp, Artificial Sequence
  chemically synthesized
tttgagatggaatcttgctcag

SEQ ID NO: 721965 - DNA, 22 bp, Artificial Sequence
  chemically synthesized
cagcctgggtgactgagcaaga

SEQ ID NO: 721966 - DNA, 22 bp, Artificial Sequence
  chemically synthesized
ttgagatggaatcttgctcagt

SEQ ID NO: 721967 - DNA, 22 bp, Artificial Sequence
  chemically synthesized
tgagatggaatcttgctcagtc

SEQ ID NO: 721968 - DNA, 22 bp, Artificial Sequence
  chemically synthesized
gagatggaatcttgctcagtca

SEQ ID NO: 721969 - DNA, 22 bp, Artificial Sequence
  chemically synthesized
agatggaatcttgctcagtcac

SEQ ID NO: 721970 - DNA, 22 bp, Artificial Sequence
  chemically synthesized
cactccagcctgggtgactgag

SEQ ID NO: 721971 - DNA, 22 bp, Artificial Sequence
  chemically synthesized
gctcagtcacccaggctggagt

SEQ ID NO: 721972 - DNA, 22 bp, Artificial Sequence
  chemically synthesized
ctcagtcacccaggctggagtg

SEQ ID NO: 721973 - DNA, 22 bp, Artificial Sequence
  chemically synthesized
agtcacccaggctggagtgcag

SEQ ID NO: 721974 - DNA, 22 bp, Artificial Sequence
  chemically synthesized
cagtgagccgagatcgtgccac

SEQ ID NO: 721975 - DNA, 22 bp, Artificial Sequence
  chemically synthesized
gagtgcagtggcacgatctcgg

SEQ ID NO: 721976 - DNA, 22 bp, Artificial Sequence
  chemically synthesized
gagattgcagtgagccgagatc

SEQ ID NO: 721977 - DNA, 22 bp, Artificial Sequence
  chemically synthesized
ggagctggagattgcagtgagc

SEQ ID NO: 721978 - DNA, 22 bp, Artificial Sequence
  chemically synthesized
ggctcactgcaatctccagctc

SEQ ID NO: 721979 - DNA, 22 bp, Artificial Sequence
  chemically synthesized
actgcaatctccagctcccagg

SEQ ID NO: 721980 - DNA, 22 bp, Artificial Sequence
  chemically synthesized
caatctccagctcccaggttca

SEQ ID NO: 721981 - DNA, 22 bp, Artificial Sequence
  chemically synthesized
aggcaggagaatggcatgaacc

SEQ ID NO: 721982 - DNA, 22 bp, Artificial Sequence
  chemically synthesized
cagctcccaggttcatgccatt

SEQ ID NO: 721983 - DNA, 22 bp, Artificial Sequence
  chemically synthesized
ccaggttcatgccattctcctg

SEQ ID NO: 721984 - DNA, 22 bp, Artificial Sequence
  chemically synthesized
gggaggctgaggcaggagaatg

SEQ ID NO: 721985 - DNA, 22 bp, Artificial Sequence
  chemically synthesized
ctcgggaggctgaggcaggaga

SEQ ID NO: 721986 - DNA, 22 bp, Artificial Sequence
  chemically synthesized
atgccattctcctgcctcagcc

SEQ ID NO: 721987 - DNA, 22 bp, Artificial Sequence
  chemically synthesized
tagtcccagctactcgggaggc

SEQ ID NO: 721988 - DNA, 22 bp, Artificial Sequence
  chemically synthesized
tcctgcctcagcctcccgagta

SEQ ID NO: 721989 - DNA, 22 bp, Artificial Sequence
  chemically synthesized
ctgcctcagcctcccgagtagc

SEQ ID NO: 721990 - DNA, 22 bp, Artificial Sequence
  chemically synthesized
cctcagcctcccgagtagctgg

SEQ ID NO: 721991 - DNA, 22 bp, Artificial Sequence
  chemically synthesized
agcctcccgagtagctgggact

SEQ ID NO: 721992 - DNA, 22 bp, Artificial Sequence
  chemically synthesized
gtggtgggcacctgtagtccca

SEQ ID NO: 721993 - DNA, 22 bp, Artificial Sequence
  chemically synthesized
ggtggtgggcacctgtagtccc

SEQ ID NO: 721994 - DNA, 22 bp, Artificial Sequence
  chemically synthesized
ccgagtagctgggactacaggt

SEQ ID NO: 721995 - DNA, 22 bp, Artificial Sequence
  chemically synthesized
gccgggcttggtggtgggcacc

SEQ ID NO: 721996 - DNA, 22 bp, Artificial Sequence
  chemically synthesized
ggactacaggtgcccaccacca

SEQ ID NO: 721997 - DNA, 22 bp, Artificial Sequence
  chemically synthesized
caggtgcccaccaccaagcccg

SEQ ID NO: 721998 - DNA, 22 bp, Artificial Sequence
  chemically synthesized
aaaatacaaaaaaaaaattagc

SEQ ID NO: 721999 - DNA, 22 bp, Artificial Sequence
  chemically synthesized
ctaaaaatacaaaaaaaaaatt

SEQ ID NO: 722000 - DNA, 22 bp, Artificial Sequence
  chemically synthesized
tactaaaaatacaaaaaaaaaa

SEQ ID NO: 722001 - DNA, 22 bp, Artificial Sequence
  chemically synthesized
cgtctctactaaaaatacaaaa

SEQ ID NO: 722002 - DNA, 22 bp, Artificial Sequence
  chemically synthesized
attttttttttgtatttttagt

SEQ ID NO: 722003 - DNA, 22 bp, Artificial Sequence
  chemically synthesized
tttttttgtatttttagtagag

SEQ ID NO: 722004 - DNA, 22 bp, Artificial Sequence
  chemically synthesized
ttttttgtatttttagtagaga

SEQ ID NO: 722005 - DNA, 22 bp, Artificial Sequence
  chemically synthesized
tttttgtatttttagtagagac

SEQ ID NO: 722006 - DNA, 22 bp, Artificial Sequence
  chemically synthesized
ttttgtatttttagtagagacg

SEQ ID NO: 722007 - DNA, 22 bp, Artificial Sequence
  chemically synthesized
tttgtatttttagtagagacgg

SEQ ID NO: 722008 - DNA, 22 bp, Artificial Sequence
  chemically synthesized
ttgtatttttagtagagacgga

SEQ ID NO: 722009 - DNA, 22 bp, Artificial Sequence
  chemically synthesized
acatggtgaaactccgtctcta

SEQ ID NO: 722010 - DNA, 22 bp, Artificial Sequence
  chemically synthesized
tgtatttttagtagagacggag

SEQ ID NO: 722011 - DNA, 22 bp, Artificial Sequence
  chemically synthesized
gtatttttagtagagacggagt

SEQ ID NO: 722012 - DNA, 22 bp, Artificial Sequence
  chemically synthesized
tatttttagtagagacggagtt

SEQ ID NO: 722013 - DNA, 22 bp, Artificial Sequence
  chemically synthesized
gctaacatggtgaaactccgtc

SEQ ID NO: 722014 - DNA, 22 bp, Artificial Sequence
  chemically synthesized
ttagtagagacggagtttcacc

SEQ ID NO: 722015 - DNA, 22 bp, Artificial Sequence
  chemically synthesized
tagtagagacggagtttcacca

SEQ ID NO: 722016 - DNA, 22 bp, Artificial Sequence
  chemically synthesized
agtagagacggagtttcaccat

SEQ ID NO: 722017 - DNA, 22 bp, Artificial Sequence
  chemically synthesized
gtagagacggagtttcaccatg

SEQ ID NO: 722018 - DNA, 22 bp, Artificial Sequence
  chemically synthesized
caccatgttagccaggacggtc

SEQ ID NO: 722019 - DNA, 22 bp, Artificial Sequence
  chemically synthesized
accatgttagccaggacggtct

SEQ ID NO: 722020 - DNA, 22 bp, Artificial Sequence
  chemically synthesized
gccaggacggtctcgatctcct

SEQ ID NO: 722021 - DNA, 22 bp, Artificial Sequence
  chemically synthesized
gatctcctgacctcgtgatcca

SEQ ID NO: 722022 - DNA, 22 bp, Artificial Sequence
  chemically synthesized
ggaggccaaggcgggtggatca

SEQ ID NO: 722023 - DNA, 22 bp, Artificial Sequence
  chemically synthesized
gggaggccaaggcgggtggatc

SEQ ID NO: 722024 - DNA, 22 bp, Artificial Sequence
  chemically synthesized
tgggaggccaaggcgggtggat

SEQ ID NO: 722025 - DNA, 22 bp, Artificial Sequence
  chemically synthesized
ctgacctcgtgatccacccgcc

SEQ ID NO: 722026 - DNA, 22 bp, Artificial Sequence
  chemically synthesized
acctcgtgatccacccgccttg

SEQ ID NO: 722027 - DNA, 22 bp, Artificial Sequence
  chemically synthesized
agcactttgggaggccaaggcg

SEQ ID NO: 722028 - DNA, 22 bp, Artificial Sequence
  chemically synthesized
gtgatccacccgccttggcctc

SEQ ID NO: 722029 - DNA, 22 bp, Artificial Sequence
  chemically synthesized
taatctcagcactttgggaggc

SEQ ID NO: 722030 - DNA, 22 bp, Artificial Sequence
  chemically synthesized
ctgtaatctcagcactttggga

SEQ ID NO: 722031 - DNA, 22 bp, Artificial Sequence
  chemically synthesized
actcctgtaatctcagcacttt

SEQ ID NO: 722032 - DNA, 22 bp, Artificial Sequence
  chemically synthesized
ggcctcccaaagtgctgagatt

SEQ ID NO: 722033 - DNA, 22 bp, Artificial Sequence
  chemically synthesized
gcctcccaaagtgctgagatta

SEQ ID NO: 722034 - DNA, 22 bp, Artificial Sequence
  chemically synthesized
ccaaagtgctgagattacagga

SEQ ID NO: 722035 - DNA, 22 bp, Artificial Sequence
  chemically synthesized
agattacaggagtgagccacca

SEQ ID NO: 722036 - DNA, 22 bp, Artificial Sequence
  chemically synthesized
caggagtgagccaccacgcccg

SEQ ID NO: 722037 - DNA, 22 bp, Artificial Sequence
  chemically synthesized
taaagaagacagatgataggcc

SEQ ID NO: 722038 - DNA, 22 bp, Artificial Sequence
  chemically synthesized
gtaaagaagacagatgataggc

SEQ ID NO: 722039 - DNA, 22 bp, Artificial Sequence
  chemically synthesized
ttgtaaagaagacagatgatag

SEQ ID NO: 722040 - DNA, 22 bp, Artificial Sequence
  chemically synthesized
cattcttgtaaagaagacagat

SEQ ID NO: 722041 - DNA, 22 bp, Artificial Sequence
  chemically synthesized
acattcttgtaaagaagacaga

SEQ ID NO: 722042 - DNA, 22 bp, Artificial Sequence
  chemically synthesized
tcatctgtcttctttacaagaa

SEQ ID NO: 722043 - DNA, 22 bp, Artificial Sequence
  chemically synthesized
aggagagcttacattcttgtaa

SEQ ID NO: 722044 - DNA, 22 bp, Artificial Sequence
  chemically synthesized
ccctcaggagagcttacattct

SEQ ID NO: 722045 - DNA, 22 bp, Artificial Sequence
  chemically synthesized
tcttctttacaagaatgtaagc

SEQ ID NO: 722046 - DNA, 22 bp, Artificial Sequence
  chemically synthesized
ctttacaagaatgtaagctctc

SEQ ID NO: 722047 - DNA, 22 bp, Artificial Sequence
  chemically synthesized
tttacaagaatgtaagctctcc

SEQ ID NO: 722048 - DNA, 22 bp, Artificial Sequence
  chemically synthesized
tacaagaatgtaagctctcctg

SEQ ID NO: 722049 - DNA, 22 bp, Artificial Sequence
  chemically synthesized
acaagaatgtaagctctcctga

SEQ ID NO: 722050 - DNA, 22 bp, Artificial Sequence
  chemically synthesized
caagaatgtaagctctcctgag

SEQ ID NO: 722051 - DNA, 22 bp, Artificial Sequence
  chemically synthesized
tcctgagggcaggggttttgtc

SEQ ID NO: 722052 - DNA, 22 bp, Artificial Sequence
  chemically synthesized
ctgagggcaggggttttgtctt

SEQ ID NO: 722053 - DNA, 22 bp, Artificial Sequence
  chemically synthesized
agggcaggggttttgtcttgtt

SEQ ID NO: 722054 - DNA, 22 bp, Artificial Sequence
  chemically synthesized
ataataaagcagcaaacaagac

SEQ ID NO: 722055 - DNA, 22 bp, Artificial Sequence
  chemically synthesized
ggtattgataataaagcagcaa

SEQ ID NO: 722056 - DNA, 22 bp, Artificial Sequence
  chemically synthesized
aggtattgataataaagcagca

SEQ ID NO: 722057 - DNA, 22 bp, Artificial Sequence
  chemically synthesized
taggtattgataataaagcagc

SEQ ID NO: 722058 - DNA, 22 bp, Artificial Sequence
  chemically synthesized
tgtcttgtttgctgctttatta

SEQ ID NO: 722059 - DNA, 22 bp, Artificial Sequence
  chemically synthesized
gtcttgtttgctgctttattat

SEQ ID NO: 722060 - DNA, 22 bp, Artificial Sequence
  chemically synthesized
tcttgtttgctgctttattatc

SEQ ID NO: 722061 - DNA, 22 bp, Artificial Sequence
  chemically synthesized
gtttgctgctttattatcaata

SEQ ID NO: 722062 - DNA, 22 bp, Artificial Sequence
  chemically synthesized
tttgctgctttattatcaatac

SEQ ID NO: 722063 - DNA, 22 bp, Artificial Sequence
  chemically synthesized
gctgctttattatcaataccta

SEQ ID NO: 722064 - DNA, 22 bp, Artificial Sequence
  chemically synthesized
ctgctttattatcaatacctaa

SEQ ID NO: 722065 - DNA, 22 bp, Artificial Sequence
  chemically synthesized
ctttattatcaatacctaaaat

SEQ ID NO: 722066 - DNA, 22 bp, Artificial Sequence
  chemically synthesized
tatgccaggcgccattttaggt

SEQ ID NO: 722067 - DNA, 22 bp, Artificial Sequence
  chemically synthesized
tattatcaatacctaaaatggc

SEQ ID NO: 722068 - DNA, 22 bp, Artificial Sequence
  chemically synthesized
attatcaatacctaaaatggcg

SEQ ID NO: 722069 - DNA, 22 bp, Artificial Sequence
  chemically synthesized
ttatatgccaggcgccatttta

SEQ ID NO: 722070 - DNA, 22 bp, Artificial Sequence
  chemically synthesized
ttatcaatacctaaaatggcgc

SEQ ID NO: 722071 - DNA, 22 bp, Artificial Sequence
  chemically synthesized
tcaatacctaaaatggcgcctg

SEQ ID NO: 722072 - DNA, 22 bp, Artificial Sequence
  chemically synthesized
tgggtctgttatatgccaggcg

SEQ ID NO: 722073 - DNA, 22 bp, Artificial Sequence
  chemically synthesized
ttgtgggtctgttatatgccag

SEQ ID NO: 722074 - DNA, 22 bp, Artificial Sequence
  chemically synthesized
aaatggcgcctggcatataaca

SEQ ID NO: 722075 - DNA, 22 bp, Artificial Sequence
  chemically synthesized
atatctattgtgggtctgttat

SEQ ID NO: 722076 - DNA, 22 bp, Artificial Sequence
  chemically synthesized
aattaatatctattgtgggtct

SEQ ID NO: 722077 - DNA, 22 bp, Artificial Sequence
  chemically synthesized
gcatataacagacccacaatag

SEQ ID NO: 722078 - DNA, 22 bp, Artificial Sequence
  chemically synthesized
gtcattcaattaatatctattg

SEQ ID NO: 722079 - DNA, 22 bp, Artificial Sequence
  chemically synthesized
agtcattcaattaatatctatt

SEQ ID NO: 722080 - DNA, 22 bp, Artificial Sequence
  chemically synthesized
acttagtcattcaattaatatc

SEQ ID NO: 722081 - DNA, 22 bp, Artificial Sequence
  chemically synthesized
aatattcacttagtcattcaat

SEQ ID NO: 722082 - DNA, 22 bp, Artificial Sequence
  chemically synthesized
aaatattcacttagtcattcaa

SEQ ID NO: 722083 - DNA, 22 bp, Artificial Sequence
  chemically synthesized
ggagtttaaatattcacttagt

SEQ ID NO: 722084 - DNA, 22 bp, Artificial Sequence
  chemically synthesized
attgaatgactaagtgaatatt

SEQ ID NO: 722085 - DNA, 22 bp, Artificial Sequence
  chemically synthesized
gctaggagtttaaatattcact

SEQ ID NO: 722086 - DNA, 22 bp, Artificial Sequence
  chemically synthesized
agctaggagtttaaatattcac

SEQ ID NO: 722087 - DNA, 22 bp, Artificial Sequence
  chemically synthesized
tagctaggagtttaaatattca

SEQ ID NO: 722088 - DNA, 22 bp, Artificial Sequence
  chemically synthesized
ttagctaggagtttaaatattc

SEQ ID NO: 722089 - DNA, 22 bp, Artificial Sequence
  chemically synthesized
aatgactaagtgaatatttaaa

SEQ ID NO: 722090 - DNA, 22 bp, Artificial Sequence
  chemically synthesized
tttagctaggagtttaaatatt

SEQ ID NO: 722091 - DNA, 22 bp, Artificial Sequence
  chemically synthesized
aagactttttagctaggagttt

SEQ ID NO: 722092 - DNA, 22 bp, Artificial Sequence
  chemically synthesized
agtgaatatttaaactcctagc

SEQ ID NO: 722093 - DNA, 22 bp, Artificial Sequence
  chemically synthesized
agaaaccctgaagactttttag

SEQ ID NO: 722094 - DNA, 22 bp, Artificial Sequence
  chemically synthesized
aaactcctagctaaaaagtctt

SEQ ID NO: 722095 - DNA, 22 bp, Artificial Sequence
  chemically synthesized
aactcctagctaaaaagtcttc

SEQ ID NO: 722096 - DNA, 22 bp, Artificial Sequence
  chemically synthesized
cacctaagaaaccctgaagact

SEQ ID NO: 722097 - DNA, 22 bp, Artificial Sequence
  chemically synthesized
ctagctaaaaagtcttcagggt

SEQ ID NO: 722098 - DNA, 22 bp, Artificial Sequence
  chemically synthesized
gctaaaaagtcttcagggtttc

SEQ ID NO: 722099 - DNA, 22 bp, Artificial Sequence
  chemically synthesized
aaaagtcttcagggtttcttag

SEQ ID NO: 722100 - DNA, 22 bp, Artificial Sequence
  chemically synthesized
aaccagattacacctaagaaac

SEQ ID NO: 722101 - DNA, 22 bp, Artificial Sequence
  chemically synthesized
cagggtttcttaggtgtaatct

SEQ ID NO: 722102 - DNA, 22 bp, Artificial Sequence
  chemically synthesized
gtgtgttaaaccagattacacc

SEQ ID NO: 722103 - DNA, 22 bp, Artificial Sequence
  chemically synthesized
agggtttcttaggtgtaatctg

SEQ ID NO: 722104 - DNA, 22 bp, Artificial Sequence
  chemically synthesized
ggtgtgttaaaccagattacac

SEQ ID NO: 722105 - DNA, 22 bp, Artificial Sequence
  chemically synthesized
aacttggtgtgttaaaccagat

SEQ ID NO: 722106 - DNA, 22 bp, Artificial Sequence
  chemically synthesized
cttaggtgtaatctggtttaac

SEQ ID NO: 722107 - DNA, 22 bp, Artificial Sequence
  chemically synthesized
tcaacttggtgtgttaaaccag

SEQ ID NO: 722108 - DNA, 22 bp, Artificial Sequence
  chemically synthesized
ttaggtgtaatctggtttaaca

SEQ ID NO: 722109 - DNA, 22 bp, Artificial Sequence
  chemically synthesized
aggtgtaatctggtttaacaca

SEQ ID NO: 722110 - DNA, 22 bp, Artificial Sequence
  chemically synthesized
ggtgtaatctggtttaacacac

SEQ ID NO: 722111 - DNA, 22 bp, Artificial Sequence
  chemically synthesized
tgattctcaacttggtgtgtta

SEQ ID NO: 722112 - DNA, 22 bp, Artificial Sequence
  chemically synthesized
tgtgattctcaacttggtgtgt

SEQ ID NO: 722113 - DNA, 22 bp, Artificial Sequence
  chemically synthesized
gtttaacacaccaagttgagaa

SEQ ID NO: 722114 - DNA, 22 bp, Artificial Sequence
  chemically synthesized
ataattctgtgattctcaactt

SEQ ID NO: 722115 - DNA, 22 bp, Artificial Sequence
  chemically synthesized
aacacaccaagttgagaatcac

SEQ ID NO: 722116 - DNA, 22 bp, Artificial Sequence
  chemically synthesized
tctaataattctgtgattctca

SEQ ID NO: 722117 - DNA, 22 bp, Artificial Sequence
  chemically synthesized
acacaccaagttgagaatcaca

SEQ ID NO: 722118 - DNA, 22 bp, Artificial Sequence
  chemically synthesized
attatctaataattctgtgatt

SEQ ID NO: 722119 - DNA, 22 bp, Artificial Sequence
  chemically synthesized
aattatctaataattctgtgat

SEQ ID NO: 722120 - DNA, 22 bp, Artificial Sequence
  chemically synthesized
taattatctaataattctgtga

SEQ ID NO: 722121 - DNA, 22 bp, Artificial Sequence
  chemically synthesized
gctttaattatctaataattct

SEQ ID NO: 722122 - DNA, 22 bp, Artificial Sequence
  chemically synthesized
cgctttaattatctaataattc

SEQ ID NO: 722123 - DNA, 22 bp, Artificial Sequence
  chemically synthesized
tcgctttaattatctaataatt

SEQ ID NO: 722124 - DNA, 22 bp, Artificial Sequence
  chemically synthesized
ttcgctttaattatctaataat

SEQ ID NO: 722125 - DNA, 22 bp, Artificial Sequence
  chemically synthesized
agaatcacagaattattagata

SEQ ID NO: 722126 - DNA, 22 bp, Artificial Sequence
  chemically synthesized
tttcgctttaattatctaataa

SEQ ID NO: 722127 - DNA, 22 bp, Artificial Sequence
  chemically synthesized
ttttcgctttaattatctaata

SEQ ID NO: 722128 - DNA, 22 bp, Artificial Sequence
  chemically synthesized
atgtcttttttcgctttaatta

SEQ ID NO: 722129 - DNA, 22 bp, Artificial Sequence
  chemically synthesized
aatgtcttttttcgctttaatt

SEQ ID NO: 722130 - DNA, 22 bp, Artificial Sequence
  chemically synthesized
ttagataattaaagcgaaaaaa

SEQ ID NO: 722131 - DNA, 22 bp, Artificial Sequence
  chemically synthesized
gataattaaagcgaaaaaagac

SEQ ID NO: 722132 - DNA, 22 bp, Artificial Sequence
  chemically synthesized
ggtaaacttaatgtcttttttc

SEQ ID NO: 722133 - DNA, 22 bp, Artificial Sequence
  chemically synthesized
agctaggtaaacttaatgtctt

SEQ ID NO: 722134 - DNA, 22 bp, Artificial Sequence
  chemically synthesized
aagcgaaaaaagacattaagtt

SEQ ID NO: 722135 - DNA, 22 bp, Artificial Sequence
  chemically synthesized
aaaatgaggtattgagctaggt

SEQ ID NO: 722136 - DNA, 22 bp, Artificial Sequence
  chemically synthesized
caaaatgaggtattgagctagg

SEQ ID NO: 722137 - DNA, 22 bp, Artificial Sequence
  chemically synthesized
tcttcaaaatgaggtattgagc

SEQ ID NO: 722138 - DNA, 22 bp, Artificial Sequence
  chemically synthesized
agtttacctagctcaatacctc

SEQ ID NO: 722139 - DNA, 22 bp, Artificial Sequence
  chemically synthesized
tgtcttcaaaatgaggtattga

SEQ ID NO: 722140 - DNA, 22 bp, Artificial Sequence
  chemically synthesized
ctgtcttcaaaatgaggtattg

SEQ ID NO: 722141 - DNA, 22 bp, Artificial Sequence
  chemically synthesized
tctgtcttcaaaatgaggtatt

SEQ ID NO: 722142 - DNA, 22 bp, Artificial Sequence
  chemically synthesized
ttctgtcttcaaaatgaggtat

SEQ ID NO: 722143 - DNA, 22 bp, Artificial Sequence
  chemically synthesized
tttctgtcttcaaaatgaggta

SEQ ID NO: 722144 - DNA, 22 bp, Artificial Sequence
  chemically synthesized
acctagctcaatacctcatttt

SEQ ID NO: 722145 - DNA, 22 bp, Artificial Sequence
  chemically synthesized
cctagctcaatacctcattttg

SEQ ID NO: 722146 - DNA, 22 bp, Artificial Sequence
  chemically synthesized
actttttctgtcttcaaaatga

SEQ ID NO: 722147 - DNA, 22 bp, Artificial Sequence
  chemically synthesized
cactttttctgtcttcaaaatg

SEQ ID NO: 722148 - DNA, 22 bp, Artificial Sequence
  chemically synthesized
gctcaatacctcattttgaaga

SEQ ID NO: 722149 - DNA, 22 bp, Artificial Sequence
  chemically synthesized
tcactttttctgtcttcaaaat

SEQ ID NO: 722150 - DNA, 22 bp, Artificial Sequence
  chemically synthesized
aatacctcattttgaagacaga

SEQ ID NO: 722151 - DNA, 22 bp, Artificial Sequence
  chemically synthesized
actttcactttttctgtcttca

SEQ ID NO: 722152 - DNA, 22 bp, Artificial Sequence
  chemically synthesized
gactttcactttttctgtcttc

SEQ ID NO: 722153 - DNA, 22 bp, Artificial Sequence
  chemically synthesized
tgactttcactttttctgtctt

SEQ ID NO: 722154 - DNA, 22 bp, Artificial Sequence
  chemically synthesized
attttgaagacagaaaaagtga

SEQ ID NO: 722155 - DNA, 22 bp, Artificial Sequence
  chemically synthesized
accattttgactttcacttttt

SEQ ID NO: 722156 - DNA, 22 bp, Artificial Sequence
  chemically synthesized
aaccattttgactttcactttt

SEQ ID NO: 722157 - DNA, 22 bp, Artificial Sequence
  chemically synthesized
tgaagacagaaaaagtgaaagt

SEQ ID NO: 722158 - DNA, 22 bp, Artificial Sequence
  chemically synthesized
gaagacagaaaaagtgaaagtc

SEQ ID NO: 722159 - DNA, 22 bp, Artificial Sequence
  chemically synthesized
aagacagaaaaagtgaaagtca

SEQ ID NO: 722160 - DNA, 22 bp, Artificial Sequence
  chemically synthesized
atttaaccattttgactttcac

SEQ ID NO: 722161 - DNA, 22 bp, Artificial Sequence
  chemically synthesized
gcctcatttaaccattttgact

SEQ ID NO: 722162 - DNA, 22 bp, Artificial Sequence
  chemically synthesized
ctggcctcatttaaccattttg

SEQ ID NO: 722163 - DNA, 22 bp, Artificial Sequence
  chemically synthesized
caggcatgagccaccgctcctg

SEQ ID NO: 722164 - DNA, 22 bp, Artificial Sequence
  chemically synthesized
aatgaggccaggagcggtggct

SEQ ID NO: 722165 - DNA, 22 bp, Artificial Sequence
  chemically synthesized
ggattacaggcatgagccaccg

SEQ ID NO: 722166 - DNA, 22 bp, Artificial Sequence
  chemically synthesized
aagtgctgggattacaggcatg

SEQ ID NO: 722167 - DNA, 22 bp, Artificial Sequence
  chemically synthesized
ctaaagtgctgggattacaggc

SEQ ID NO: 722168 - DNA, 22 bp, Artificial Sequence
  chemically synthesized
gcctcctaaagtgctgggatta

SEQ ID NO: 722169 - DNA, 22 bp, Artificial Sequence
  chemically synthesized
ggcctcctaaagtgctgggatt

SEQ ID NO: 722170 - DNA, 22 bp, Artificial Sequence
  chemically synthesized
atgcctgtaatcccagcacttt

SEQ ID NO: 722171 - DNA, 22 bp, Artificial Sequence
  chemically synthesized
taatcccagcactttaggaggc

SEQ ID NO: 722172 - DNA, 22 bp, Artificial Sequence
  chemically synthesized
aggtgatccgcccaccttggcc

SEQ ID NO: 722173 - DNA, 22 bp, Artificial Sequence
  chemically synthesized
acctcaggtgatccgcccacct

SEQ ID NO: 722174 - DNA, 22 bp, Artificial Sequence
  chemically synthesized
taggaggccaaggtgggcggat

SEQ ID NO: 722175 - DNA, 22 bp, Artificial Sequence
  chemically synthesized
aggaggccaaggtgggcggatc

SEQ ID NO: 722176 - DNA, 22 bp, Artificial Sequence
  chemically synthesized
ctgacctcaggtgatccgccca

SEQ ID NO: 722177 - DNA, 22 bp, Artificial Sequence
  chemically synthesized
ggaggccaaggtgggcggatca

SEQ ID NO: 722178 - DNA, 22 bp, Artificial Sequence
  chemically synthesized
aaactcctgacctcaggtgatc

SEQ ID NO: 722179 - DNA, 22 bp, Artificial Sequence
  chemically synthesized
gtctcaaactcctgacctcagg

SEQ ID NO: 722180 - DNA, 22 bp, Artificial Sequence
  chemically synthesized
gtcaggctggtctcaaactcct

SEQ ID NO: 722181 - DNA, 22 bp, Artificial Sequence
  chemically synthesized
aggtcaggagtttgagaccagc

SEQ ID NO: 722182 - DNA, 22 bp, Artificial Sequence
  chemically synthesized
ccatgttggtcaggctggtctc

SEQ ID NO: 722183 - DNA, 22 bp, Artificial Sequence
  chemically synthesized
gccatgttggtcaggctggtct

SEQ ID NO: 722184 - DNA, 22 bp, Artificial Sequence
  chemically synthesized
tgccatgttggtcaggctggtc

SEQ ID NO: 722185 - DNA, 22 bp, Artificial Sequence
  chemically synthesized
gagaccagcctgaccaacatgg

SEQ ID NO: 722186 - DNA, 22 bp, Artificial Sequence
  chemically synthesized
agaccagcctgaccaacatggc

SEQ ID NO: 722187 - DNA, 22 bp, Artificial Sequence
  chemically synthesized
gtagagacgggattttgccatg

SEQ ID NO: 722188 - DNA, 22 bp, Artificial Sequence
  chemically synthesized
agtagagacgggattttgccat

SEQ ID NO: 722189 - DNA, 22 bp, Artificial Sequence
  chemically synthesized
tagtagagacgggattttgcca

SEQ ID NO: 722190 - DNA, 22 bp, Artificial Sequence
  chemically synthesized
ttagtagagacgggattttgcc

SEQ ID NO: 722191 - DNA, 22 bp, Artificial Sequence
  chemically synthesized
accaacatggcaaaatcccgtc

SEQ ID NO: 722192 - DNA, 22 bp, Artificial Sequence
  chemically synthesized
tatttttagtagagacgggatt

SEQ ID NO: 722193 - DNA, 22 bp, Artificial Sequence
  chemically synthesized
gtatttttagtagagacgggat

SEQ ID NO: 722194 - DNA, 22 bp, Artificial Sequence
  chemically synthesized
tgtatttttagtagagacggga

SEQ ID NO: 722195 - DNA, 22 bp, Artificial Sequence
  chemically synthesized
ttgtatttttagtagagacggg

SEQ ID NO: 722196 - DNA, 22 bp, Artificial Sequence
  chemically synthesized
atttttgtatttttagtagaga

SEQ ID NO: 722197 - DNA, 22 bp, Artificial Sequence
  chemically synthesized
gctaatttttgtatttttagta

SEQ ID NO: 722198 - DNA, 22 bp, Artificial Sequence
  chemically synthesized
tactaaaaatacaaaaattagc

SEQ ID NO: 722199 - DNA, 22 bp, Artificial Sequence
  chemically synthesized
ccaccatgcctggctaattttt

SEQ ID NO: 722200 - DNA, 22 bp, Artificial Sequence
  chemically synthesized
ctaaaaatacaaaaattagcca

SEQ ID NO: 722201 - DNA, 22 bp, Artificial Sequence
  chemically synthesized
aaaatacaaaaattagccaggc

SEQ ID NO: 722202 - DNA, 22 bp, Artificial Sequence
  chemically synthesized
caagtgcctgccaccatgcctg

SEQ ID NO: 722203 - DNA, 22 bp, Artificial Sequence
  chemically synthesized
ggattacaagtgcctgccacca

SEQ ID NO: 722204 - DNA, 22 bp, Artificial Sequence
  chemically synthesized
gccaggcatggtggcaggcact

SEQ ID NO: 722205 - DNA, 22 bp, Artificial Sequence
  chemically synthesized
ccaagcagctgggattacaagt

SEQ ID NO: 722206 - DNA, 22 bp, Artificial Sequence
  chemically synthesized
agcctcccaagcagctgggatt

SEQ ID NO: 722207 - DNA, 22 bp, Artificial Sequence
  chemically synthesized
cctcagcctcccaagcagctgg

SEQ ID NO: 722208 - DNA, 22 bp, Artificial Sequence
  chemically synthesized
ctgcctcagcctcccaagcagc

SEQ ID NO: 722209 - DNA, 22 bp, Artificial Sequence
  chemically synthesized
tcctgcctcagcctcccaagca

SEQ ID NO: 722210 - DNA, 22 bp, Artificial Sequence
  chemically synthesized
gtaatcccagctgcttgggagg

SEQ ID NO: 722211 - DNA, 22 bp, Artificial Sequence
  chemically synthesized
taatcccagctgcttgggaggc

SEQ ID NO: 722212 - DNA, 22 bp, Artificial Sequence
  chemically synthesized
aagcaattctcctgcctcagcc

SEQ ID NO: 722213 - DNA, 22 bp, Artificial Sequence
  chemically synthesized
cttgggaggctgaggcaggaga

SEQ ID NO: 722214 - DNA, 22 bp, Artificial Sequence
  chemically synthesized
gggaggctgaggcaggagaatt

SEQ ID NO: 722215 - DNA, 22 bp, Artificial Sequence
  chemically synthesized
acgggttcaagcaattctcctg

SEQ ID NO: 722216 - DNA, 22 bp, Artificial Sequence
  chemically synthesized
ggaggctgaggcaggagaattg

SEQ ID NO: 722217 - DNA, 22 bp, Artificial Sequence
  chemically synthesized
cacctcacgggttcaagcaatt

SEQ ID NO: 722218 - DNA, 22 bp, Artificial Sequence
  chemically synthesized
aggcaggagaattgcttgaacc

SEQ ID NO: 722219 - DNA, 22 bp, Artificial Sequence
  chemically synthesized
caacctccacctcacgggttca

SEQ ID NO: 722220 - DNA, 22 bp, Artificial Sequence
  chemically synthesized
actgcaacctccacctcacggg

SEQ ID NO: 722221 - DNA, 22 bp, Artificial Sequence
  chemically synthesized
gctcactgcaacctccacctca

SEQ ID NO: 722222 - DNA, 22 bp, Artificial Sequence
  chemically synthesized
ggctcactgcaacctccacctc

SEQ ID NO: 722223 - DNA, 22 bp, Artificial Sequence
  chemically synthesized
cttgaacccgtgaggtggaggt

SEQ ID NO: 722224 - DNA, 22 bp, Artificial Sequence
  chemically synthesized
gaacccgtgaggtggaggttgc

SEQ ID NO: 722225 - DNA, 22 bp, Artificial Sequence
  chemically synthesized
aacccgtgaggtggaggttgca

SEQ ID NO: 722226 - DNA, 22 bp, Artificial Sequence
  chemically synthesized
gagtgcagtggcgtgatcttgg

SEQ ID NO: 722227 - DNA, 22 bp, Artificial Sequence
  chemically synthesized
cagtgagccaagatcacgccac

SEQ ID NO: 722228 - DNA, 22 bp, Artificial Sequence
  chemically synthesized
tcacccaggctggagtgcagtg

SEQ ID NO: 722229 - DNA, 22 bp, Artificial Sequence
  chemically synthesized
tgtcacccaggctggagtgcag

SEQ ID NO: 722230 - DNA, 22 bp, Artificial Sequence
  chemically synthesized
actctgtcacccaggctggagt

SEQ ID NO: 722231 - DNA, 22 bp, Artificial Sequence
  chemically synthesized
cactccagcctgggtgacagag

SEQ ID NO: 722232 - DNA, 22 bp, Artificial Sequence
  chemically synthesized
agacggagtctcactctgtcac

SEQ ID NO: 722233 - DNA, 22 bp, Artificial Sequence
  chemically synthesized
gagacggagtctcactctgtca

SEQ ID NO: 722234 - DNA, 22 bp, Artificial Sequence
  chemically synthesized
tgagacggagtctcactctgtc

SEQ ID NO: 722235 - DNA, 22 bp, Artificial Sequence
  chemically synthesized
ttgagacggagtctcactctgt

SEQ ID NO: 722236 - DNA, 22 bp, Artificial Sequence
  chemically synthesized
cagcctgggtgacagagtgaga

SEQ ID NO: 722237 - DNA, 22 bp, Artificial Sequence
  chemically synthesized
tttgagacggagtctcactctg

SEQ ID NO: 722238 - DNA, 22 bp, Artificial Sequence
  chemically synthesized
ttttttgagacggagtctcact

SEQ ID NO: 722239 - DNA, 22 bp, Artificial Sequence
  chemically synthesized
gttttttgagacggagtctcac

SEQ ID NO: 722240 - DNA, 22 bp, Artificial Sequence
  chemically synthesized
tgttttttgagacggagtctca

SEQ ID NO: 722241 - DNA, 22 bp, Artificial Sequence
  chemically synthesized
ggtgacagagtgagactccgtc

SEQ ID NO: 722242 - DNA, 22 bp, Artificial Sequence
  chemically synthesized
ttttgttttttgagacggagtc

SEQ ID NO: 722243 - DNA, 22 bp, Artificial Sequence
  chemically synthesized
gttttgttttttgagacggagt

SEQ ID NO: 722244 - DNA, 22 bp, Artificial Sequence
  chemically synthesized
tgttttgttttttgagacggag

SEQ ID NO: 722245 - DNA, 22 bp, Artificial Sequence
  chemically synthesized
ttttgttttgttttttgagacg

SEQ ID NO: 722246 - DNA, 22 bp, Artificial Sequence
  chemically synthesized
gttttgttttgttttttgagac

SEQ ID NO: 722247 - DNA, 22 bp, Artificial Sequence
  chemically synthesized
tgttttgttttgttttttgaga

SEQ ID NO: 722248 - DNA, 22 bp, Artificial Sequence
  chemically synthesized
gttttgttttgttttgtttttt

SEQ ID NO: 722249 - DNA, 22 bp, Artificial Sequence
  chemically synthesized
ggttttgttttgttttgttttt

SEQ ID NO: 722250 - DNA, 22 bp, Artificial Sequence
  chemically synthesized
tggttttgttttgttttgtttt

SEQ ID NO: 722251 - DNA, 22 bp, Artificial Sequence
  chemically synthesized
ttggttttgttttgttttgttt

SEQ ID NO: 722252 - DNA, 22 bp, Artificial Sequence
  chemically synthesized
tttggttttgttttgttttgtt

SEQ ID NO: 722253 - DNA, 22 bp, Artificial Sequence
  chemically synthesized
cgtctcaaaaaacaaaacaaaa

SEQ ID NO: 722254 - DNA, 22 bp, Artificial Sequence
  chemically synthesized
aaaaaacaaaacaaaacaaaac

SEQ ID NO: 722255 - DNA, 22 bp, Artificial Sequence
  chemically synthesized
aaatgttttttggttttgtttt

SEQ ID NO: 722256 - DNA, 22 bp, Artificial Sequence
  chemically synthesized
caatggtctcaaatgttttttg

SEQ ID NO: 722257 - DNA, 22 bp, Artificial Sequence
  chemically synthesized
ccaatggtctcaaatgtttttt

SEQ ID NO: 722258 - DNA, 22 bp, Artificial Sequence
  chemically synthesized
ttccaatggtctcaaatgtttt

SEQ ID NO: 722259 - DNA, 22 bp, Artificial Sequence
  chemically synthesized
agctcttccaatggtctcaaat

SEQ ID NO: 722260 - DNA, 22 bp, Artificial Sequence
  chemically synthesized
agattcagctcttccaatggtc

SEQ ID NO: 722261 - DNA, 22 bp, Artificial Sequence
  chemically synthesized
gagaccattggaagagctgaat

SEQ ID NO: 722262 - DNA, 22 bp, Artificial Sequence
  chemically synthesized
agaccattggaagagctgaatc

SEQ ID NO: 722263 - DNA, 22 bp, Artificial Sequence
  chemically synthesized
ataggatgctgagattcagctc

SEQ ID NO: 722264 - DNA, 22 bp, Artificial Sequence
  chemically synthesized
ctaataggatgctgagattcag

SEQ ID NO: 722265 - DNA, 22 bp, Artificial Sequence
  chemically synthesized
cctaataggatgctgagattca

SEQ ID NO: 722266 - DNA, 22 bp, Artificial Sequence
  chemically synthesized
tcctaataggatgctgagattc

SEQ ID NO: 722267 - DNA, 22 bp, Artificial Sequence
  chemically synthesized
ttcctaataggatgctgagatt

SEQ ID NO: 722268 - DNA, 22 bp, Artificial Sequence
  chemically synthesized
gaagagctgaatctcagcatcc

SEQ ID NO: 722269 - DNA, 22 bp, Artificial Sequence
  chemically synthesized
acttttcctaataggatgctga

SEQ ID NO: 722270 - DNA, 22 bp, Artificial Sequence
  chemically synthesized
aacttttcctaataggatgctg

SEQ ID NO: 722271 - DNA, 22 bp, Artificial Sequence
  chemically synthesized
aatctcagcatcctattaggaa

SEQ ID NO: 722272 - DNA, 22 bp, Artificial Sequence
  chemically synthesized
taagtttaacttttcctaatag

SEQ ID NO: 722273 - DNA, 22 bp, Artificial Sequence
  chemically synthesized
tgtaagtttaacttttcctaat

SEQ ID NO: 722274 - DNA, 22 bp, Artificial Sequence
  chemically synthesized
ctgtaagtttaacttttcctaa

SEQ ID NO: 722275 - DNA, 22 bp, Artificial Sequence
  chemically synthesized
tctgtaagtttaacttttccta

SEQ ID NO: 722276 - DNA, 22 bp, Artificial Sequence
  chemically synthesized
agcatcctattaggaaaagtta

SEQ ID NO: 722277 - DNA, 22 bp, Artificial Sequence
  chemically synthesized
caaattttctgtaagtttaact

SEQ ID NO: 722278 - DNA, 22 bp, Artificial Sequence
  chemically synthesized
gcaaattttctgtaagtttaac

SEQ ID NO: 722279 - DNA, 22 bp, Artificial Sequence
  chemically synthesized
tgcaaattttctgtaagtttaa

SEQ ID NO: 722280 - DNA, 22 bp, Artificial Sequence
  chemically synthesized
ttgcaaattttctgtaagttta

SEQ ID NO: 722281 - DNA, 22 bp, Artificial Sequence
  chemically synthesized
ttaggaaaagttaaacttacag

SEQ ID NO: 722282 - DNA, 22 bp, Artificial Sequence
  chemically synthesized
cttttgcaaattttctgtaagt

SEQ ID NO: 722283 - DNA, 22 bp, Artificial Sequence
  chemically synthesized
ggaaaagttaaacttacagaaa

SEQ ID NO: 722284 - DNA, 22 bp, Artificial Sequence
  chemically synthesized
tactacttttgcaaattttctg

SEQ ID NO: 722285 - DNA, 22 bp, Artificial Sequence
  chemically synthesized
tatactacttttgcaaattttc

SEQ ID NO: 722286 - DNA, 22 bp, Artificial Sequence
  chemically synthesized
ctatactacttttgcaaatttt

SEQ ID NO: 722287 - DNA, 22 bp, Artificial Sequence
  chemically synthesized
tctatactacttttgcaaattt

SEQ ID NO: 722288 - DNA, 22 bp, Artificial Sequence
  chemically synthesized
aacttacagaaaatttgcaaaa

SEQ ID NO: 722289 - DNA, 22 bp, Artificial Sequence
  chemically synthesized
acagaaaatttgcaaaagtagt

SEQ ID NO: 722290 - DNA, 22 bp, Artificial Sequence
  chemically synthesized
cagaaaatttgcaaaagtagta

SEQ ID NO: 722291 - DNA, 22 bp, Artificial Sequence
  chemically synthesized
tatatgggaactttctatacta

SEQ ID NO: 722292 - DNA, 22 bp, Artificial Sequence
  chemically synthesized
gcaaaagtagtatagaaagttc

SEQ ID NO: 722293 - DNA, 22 bp, Artificial Sequence
  chemically synthesized
caaaagtagtatagaaagttcc

SEQ ID NO: 722294 - DNA, 22 bp, Artificial Sequence
  chemically synthesized
gacaaattgtatatgggaactt

SEQ ID NO: 722295 - DNA, 22 bp, Artificial Sequence
  chemically synthesized
gaagttggacaaattgtatatg

SEQ ID NO: 722296 - DNA, 22 bp, Artificial Sequence
  chemically synthesized
ccatatacaatttgtccaactt

SEQ ID NO: 722297 - DNA, 22 bp, Artificial Sequence
  chemically synthesized
gtaaaagaagttggaagttgga

SEQ ID NO: 722298 - DNA, 22 bp, Artificial Sequence
  chemically synthesized
ctagtaaaagaagttggaagtt

SEQ ID NO: 722299 - DNA, 22 bp, Artificial Sequence
  chemically synthesized
cctagtaaaagaagttggaagt

SEQ ID NO: 722300 - DNA, 22 bp, Artificial Sequence
  chemically synthesized
atttcctagtaaaagaagttgg

SEQ ID NO: 722301 - DNA, 22 bp, Artificial Sequence
  chemically synthesized
gtccaacttccaacttctttta

SEQ ID NO: 722302 - DNA, 22 bp, Artificial Sequence
  chemically synthesized
tccaacttccaacttcttttac

SEQ ID NO: 722303 - DNA, 22 bp, Artificial Sequence
  chemically synthesized
ccaacttcttttactaggaaat

SEQ ID NO: 722304 - DNA, 22 bp, Artificial Sequence
  chemically synthesized
caacttcttttactaggaaatt

SEQ ID NO: 722305 - DNA, 22 bp, Artificial Sequence
  chemically synthesized
ggcaggcaaactaatttcctag

SEQ ID NO: 722306 - DNA, 22 bp, Artificial Sequence
  chemically synthesized
gggcaggcaaactaatttccta

SEQ ID NO: 722307 - DNA, 22 bp, Artificial Sequence
  chemically synthesized
ttgggcaggcaaactaatttcc

SEQ ID NO: 722308 - DNA, 22 bp, Artificial Sequence
  chemically synthesized
cttgggcaggcaaactaatttc

SEQ ID NO: 722309 - DNA, 22 bp, Artificial Sequence
  chemically synthesized
cttttactaggaaattagtttg

SEQ ID NO: 722310 - DNA, 22 bp, Artificial Sequence
  chemically synthesized
ttttactaggaaattagtttgc

SEQ ID NO: 722311 - DNA, 22 bp, Artificial Sequence
  chemically synthesized
ttactaggaaattagtttgcct

SEQ ID NO: 722312 - DNA, 22 bp, Artificial Sequence
  chemically synthesized
tactaggaaattagtttgcctg

SEQ ID NO: 722313 - DNA, 22 bp, Artificial Sequence
  chemically synthesized
actaggaaattagtttgcctgc

SEQ ID NO: 722314 - DNA, 22 bp, Artificial Sequence
  chemically synthesized
ctaggaaattagtttgcctgcc

SEQ ID NO: 722315 - DNA, 22 bp, Artificial Sequence
  chemically synthesized
cagacatttcttgggcaggcaa

SEQ ID NO: 722316 - DNA, 22 bp, Artificial Sequence
  chemically synthesized
gcagacatttcttgggcaggca

SEQ ID NO: 722317 - DNA, 22 bp, Artificial Sequence
  chemically synthesized
ggaaattagtttgcctgcccaa

SEQ ID NO: 722318 - DNA, 22 bp, Artificial Sequence
  chemically synthesized
gtttgcctgcccaagaaatgtc

SEQ ID NO: 722319 - DNA, 22 bp, Artificial Sequence
  chemically synthesized
gcctgcccaagaaatgtctgca

SEQ ID NO: 722320 - DNA, 22 bp, Artificial Sequence
  chemically synthesized
cctgcccaagaaatgtctgcaa

SEQ ID NO: 722321 - DNA, 22 bp, Artificial Sequence
  chemically synthesized
cccaagaaatgtctgcaagggg

SEQ ID NO: 722322 - DNA, 22 bp, Artificial Sequence
  chemically synthesized
caaggggttttatgactatttc

SEQ ID NO: 722323 - DNA, 22 bp, Artificial Sequence
  chemically synthesized
aatatgtagaggatcaaaatga

SEQ ID NO: 722324 - DNA, 22 bp, Artificial Sequence
  chemically synthesized
caatatgtagaggatcaaaatg

SEQ ID NO: 722325 - DNA, 22 bp, Artificial Sequence
  chemically synthesized
tatgactatttcattttgatcc

SEQ ID NO: 722326 - DNA, 22 bp, Artificial Sequence
  chemically synthesized
atgactatttcattttgatcct

SEQ ID NO: 722327 - DNA, 22 bp, Artificial Sequence
  chemically synthesized
tgactatttcattttgatcctc

SEQ ID NO: 722328 - DNA, 22 bp, Artificial Sequence
  chemically synthesized
aagtttcaatatgtagaggatc

SEQ ID NO: 722329 - DNA, 22 bp, Artificial Sequence
  chemically synthesized
tttcattttgatcctctacata

SEQ ID NO: 722330 - DNA, 22 bp, Artificial Sequence
  chemically synthesized
cattttgatcctctacatattg

SEQ ID NO: 722331 - DNA, 22 bp, Artificial Sequence
  chemically synthesized
attttgatcctctacatattga

SEQ ID NO: 722332 - DNA, 22 bp, Artificial Sequence
  chemically synthesized
gagcatctcaagtttcaatatg

SEQ ID NO: 722333 - DNA, 22 bp, Artificial Sequence
  chemically synthesized
tgatcctctacatattgaaact

SEQ ID NO: 722334 - DNA, 22 bp, Artificial Sequence
  chemically synthesized
gatcctctacatattgaaactt

SEQ ID NO: 722335 - DNA, 22 bp, Artificial Sequence
  chemically synthesized
atcctctacatattgaaacttg

SEQ ID NO: 722336 - DNA, 22 bp, Artificial Sequence
  chemically synthesized
tacatattgaaacttgagatgc

SEQ ID NO: 722337 - DNA, 22 bp, Artificial Sequence
  chemically synthesized
catattgaaacttgagatgctc

SEQ ID NO: 722338 - DNA, 22 bp, Artificial Sequence
  chemically synthesized
aaacttgagatgctccagctga

SEQ ID NO: 722339 - DNA, 22 bp, Artificial Sequence
  chemically synthesized
gagatgctccagctgacttatt

SEQ ID NO: 722340 - DNA, 22 bp, Artificial Sequence
  chemically synthesized
agatgctccagctgacttattc

SEQ ID NO: 722341 - DNA, 22 bp, Artificial Sequence
  chemically synthesized
ccccaagataatgaataagtca

SEQ ID NO: 722342 - DNA, 22 bp, Artificial Sequence
  chemically synthesized
cactcccccaagataatgaata

SEQ ID NO: 722343 - DNA, 22 bp, Artificial Sequence
  chemically synthesized
cagctgacttattcattatctt

SEQ ID NO: 722344 - DNA, 22 bp, Artificial Sequence
  chemically synthesized
acttattcattatcttggggga

SEQ ID NO: 722345 - DNA, 22 bp, Artificial Sequence
  chemically synthesized
attcattatcttgggggagtgt

SEQ ID NO: 722346 - DNA, 22 bp, Artificial Sequence
  chemically synthesized
cacaaataatctacactccccc

SEQ ID NO: 722347 - DNA, 22 bp, Artificial Sequence
  chemically synthesized
ttcattatcttgggggagtgta

SEQ ID NO: 722348 - DNA, 22 bp, Artificial Sequence
  chemically synthesized
ttgcacaaataatctacactcc

SEQ ID NO: 722349 - DNA, 22 bp, Artificial Sequence
  chemically synthesized
attatcttgggggagtgtagat

SEQ ID NO: 722350 - DNA, 22 bp, Artificial Sequence
  chemically synthesized
tcttgggggagtgtagattatt

SEQ ID NO: 722351 - DNA, 22 bp, Artificial Sequence
  chemically synthesized
gggggagtgtagattatttgtg

SEQ ID NO: 722352 - DNA, 22 bp, Artificial Sequence
  chemically synthesized
ggggagtgtagattatttgtgc

SEQ ID NO: 722353 - DNA, 22 bp, Artificial Sequence
  chemically synthesized
aaataagaatatgcctgttgca

SEQ ID NO: 722354 - DNA, 22 bp, Artificial Sequence
  chemically synthesized
aaaataagaatatgcctgttgc

SEQ ID NO: 722355 - DNA, 22 bp, Artificial Sequence
  chemically synthesized
tttgtgcaacaggcatattctt

SEQ ID NO: 722356 - DNA, 22 bp, Artificial Sequence
  chemically synthesized
gtgcaacaggcatattcttatt

SEQ ID NO: 722357 - DNA, 22 bp, Artificial Sequence
  chemically synthesized
tgcaacaggcatattcttattt

SEQ ID NO: 722358 - DNA, 22 bp, Artificial Sequence
  chemically synthesized
gataaaatggcttaaaataaga

SEQ ID NO: 722359 - DNA, 22 bp, Artificial Sequence
  chemically synthesized
atgacgttggataaaatggctt

SEQ ID NO: 722360 - DNA, 22 bp, Artificial Sequence
  chemically synthesized
gatgacgttggataaaatggct

SEQ ID NO: 722361 - DNA, 22 bp, Artificial Sequence
  chemically synthesized
ttattttaagccattttatcca

SEQ ID NO: 722362 - DNA, 22 bp, Artificial Sequence
  chemically synthesized
attttaagccattttatccaac

SEQ ID NO: 722363 - DNA, 22 bp, Artificial Sequence
  chemically synthesized
ttttaagccattttatccaacg

SEQ ID NO: 722364 - DNA, 22 bp, Artificial Sequence
  chemically synthesized
aatcatttgatgacgttggata

SEQ ID NO: 722365 - DNA, 22 bp, Artificial Sequence
  chemically synthesized
taagccattttatccaacgtca

SEQ ID NO: 722366 - DNA, 22 bp, Artificial Sequence
  chemically synthesized
aagccattttatccaacgtcat

SEQ ID NO: 722367 - DNA, 22 bp, Artificial Sequence
  chemically synthesized
ttaaatcatttgatgacgttgg

SEQ ID NO: 722368 - DNA, 22 bp, Artificial Sequence
  chemically synthesized
agccattttatccaacgtcatc

SEQ ID NO: 722369 - DNA, 22 bp, Artificial Sequence
  chemically synthesized
gttaaatcatttgatgacgttg

SEQ ID NO: 722370 - DNA, 22 bp, Artificial Sequence
  chemically synthesized
ttgttaaatcatttgatgacgt

SEQ ID NO: 722371 - DNA, 22 bp, Artificial Sequence
  chemically synthesized
tatccaacgtcatcaaatgatt

SEQ ID NO: 722372 - DNA, 22 bp, Artificial Sequence
  chemically synthesized
atccaacgtcatcaaatgattt

SEQ ID NO: 722373 - DNA, 22 bp, Artificial Sequence
  chemically synthesized
tccaacgtcatcaaatgattta

SEQ ID NO: 722374 - DNA, 22 bp, Artificial Sequence
  chemically synthesized
aaagtctcttgttaaatcattt

SEQ ID NO: 722375 - DNA, 22 bp, Artificial Sequence
  chemically synthesized
aaaagtctcttgttaaatcatt

SEQ ID NO: 722376 - DNA, 22 bp, Artificial Sequence
  chemically synthesized
agaagtttaaaagtctcttgtt

SEQ ID NO: 722377 - DNA, 22 bp, Artificial Sequence
  chemically synthesized
tgagaagtttaaaagtctcttg

SEQ ID NO: 722378 - DNA, 22 bp, Artificial Sequence
  chemically synthesized
aacaagagacttttaaacttct

SEQ ID NO: 722379 - DNA, 22 bp, Artificial Sequence
  chemically synthesized
acaagagacttttaaacttctc

SEQ ID NO: 722380 - DNA, 22 bp, Artificial Sequence
  chemically synthesized
taaggaagaatattctgagaag

SEQ ID NO: 722381 - DNA, 22 bp, Artificial Sequence
  chemically synthesized
ataaggaagaatattctgagaa

SEQ ID NO: 722382 - DNA, 22 bp, Artificial Sequence
  chemically synthesized
tttataaggaagaatattctga

SEQ ID NO: 722383 - DNA, 22 bp, Artificial Sequence
  chemically synthesized
ttaaacttctcagaatattctt

SEQ ID NO: 722384 - DNA, 22 bp, Artificial Sequence
  chemically synthesized
ttatttataaggaagaatattc

SEQ ID NO: 722385 - DNA, 22 bp, Artificial Sequence
  chemically synthesized
taaacttctcagaatattcttc

SEQ ID NO: 722386 - DNA, 22 bp, Artificial Sequence
  chemically synthesized
aaacttctcagaatattcttcc

SEQ ID NO: 722387 - DNA, 22 bp, Artificial Sequence
  chemically synthesized
aacttctcagaatattcttcct

SEQ ID NO: 722388 - DNA, 22 bp, Artificial Sequence
  chemically synthesized
ctgttatttataaggaagaata

SEQ ID NO: 722389 - DNA, 22 bp, Artificial Sequence
  chemically synthesized
ctcagaatattcttccttataa

SEQ ID NO: 722390 - DNA, 22 bp, Artificial Sequence
  chemically synthesized
tcagaatattcttccttataaa

SEQ ID NO: 722391 - DNA, 22 bp, Artificial Sequence
  chemically synthesized
agaatattcttccttataaata

SEQ ID NO: 722392 - DNA, 22 bp, Artificial Sequence
  chemically synthesized
aggcacctcctgttatttataa

SEQ ID NO: 722393 - DNA, 22 bp, Artificial Sequence
  chemically synthesized
aactaaggcacctcctgttatt

SEQ ID NO: 722394 - DNA, 22 bp, Artificial Sequence
  chemically synthesized
ttccttataaataacaggaggt

SEQ ID NO: 722395 - DNA, 22 bp, Artificial Sequence
  chemically synthesized
ctaaactaaggcacctcctgtt

SEQ ID NO: 722396 - DNA, 22 bp, Artificial Sequence
  chemically synthesized
ccttataaataacaggaggtgc

SEQ ID NO: 722397 - DNA, 22 bp, Artificial Sequence
  chemically synthesized
cttataaataacaggaggtgcc

SEQ ID NO: 722398 - DNA, 22 bp, Artificial Sequence
  chemically synthesized
ataaataacaggaggtgcctta

SEQ ID NO: 722399 - DNA, 22 bp, Artificial Sequence
  chemically synthesized
ccattcctaaactaaggcacct

SEQ ID NO: 722400 - DNA, 22 bp, Artificial Sequence
  chemically synthesized
taaataacaggaggtgccttag

SEQ ID NO: 722401 - DNA, 22 bp, Artificial Sequence
  chemically synthesized
tctgccattcctaaactaaggc

SEQ ID NO: 722402 - DNA, 22 bp, Artificial Sequence
  chemically synthesized
gtctgccattcctaaactaagg

SEQ ID NO: 722403 - DNA, 22 bp, Artificial Sequence
  chemically synthesized
catttgtctgccattcctaaac

SEQ ID NO: 722404 - DNA, 22 bp, Artificial Sequence
  chemically synthesized
acatttgtctgccattcctaaa

SEQ ID NO: 722405 - DNA, 22 bp, Artificial Sequence
  chemically synthesized
tacatttgtctgccattcctaa

SEQ ID NO: 722406 - DNA, 22 bp, Artificial Sequence
  chemically synthesized
agtttaggaatggcagacaaat

SEQ ID NO: 722407 - DNA, 22 bp, Artificial Sequence
  chemically synthesized
gtttaggaatggcagacaaatg

SEQ ID NO: 722408 - DNA, 22 bp, Artificial Sequence
  chemically synthesized
aggaatggcagacaaatgtaaa

SEQ ID NO: 722409 - DNA, 22 bp, Artificial Sequence
  chemically synthesized
ggaatggcagacaaatgtaaag

SEQ ID NO: 722410 - DNA, 22 bp, Artificial Sequence
  chemically synthesized
aatgagaaaataatggtacaag

SEQ ID NO: 722411 - DNA, 22 bp, Artificial Sequence
  chemically synthesized
gtattaaatgagaaaataatgg

SEQ ID NO: 722412 - DNA, 22 bp, Artificial Sequence
  chemically synthesized
ccattggtattaaatgagaaaa

SEQ ID NO: 722413 - DNA, 22 bp, Artificial Sequence
  chemically synthesized
taccattggtattaaatgagaa

SEQ ID NO: 722414 - DNA, 22 bp, Artificial Sequence
  chemically synthesized
gtaccattattttctcatttaa

SEQ ID NO: 722415 - DNA, 22 bp, Artificial Sequence
  chemically synthesized
ctaccattggtattaaatgaga

SEQ ID NO: 722416 - DNA, 22 bp, Artificial Sequence
  chemically synthesized
taccattattttctcatttaat

SEQ ID NO: 722417 - DNA, 22 bp, Artificial Sequence
  chemically synthesized
gtaatttctaccattggtatta

SEQ ID NO: 722418 - DNA, 22 bp, Artificial Sequence
  chemically synthesized
ttttctcatttaataccaatgg

SEQ ID NO: 722419 - DNA, 22 bp, Artificial Sequence
  chemically synthesized
attagtaatttctaccattggt

SEQ ID NO: 722420 - DNA, 22 bp, Artificial Sequence
  chemically synthesized
tctcatttaataccaatggtag

SEQ ID NO: 722421 - DNA, 22 bp, Artificial Sequence
  chemically synthesized
ctcatttaataccaatggtaga

SEQ ID NO: 722422 - DNA, 22 bp, Artificial Sequence
  chemically synthesized
tcatttaataccaatggtagaa

SEQ ID NO: 722423 - DNA, 22 bp, Artificial Sequence
  chemically synthesized
atttaataccaatggtagaaat

SEQ ID NO: 722424 - DNA, 22 bp, Artificial Sequence
  chemically synthesized
aataccaatggtagaaattact

SEQ ID NO: 722425 - DNA, 22 bp, Artificial Sequence
  chemically synthesized
ataccaatggtagaaattacta

SEQ ID NO: 722426 - DNA, 22 bp, Artificial Sequence
  chemically synthesized
caatacagtgccataggctgat

SEQ ID NO: 722427 - DNA, 22 bp, Artificial Sequence
  chemically synthesized
ctaatcagcctatggcactgta

SEQ ID NO: 722428 - DNA, 22 bp, Artificial Sequence
  chemically synthesized
gggaagactacaatacagtgcc

SEQ ID NO: 722429 - DNA, 22 bp, Artificial Sequence
  chemically synthesized
atcagcctatggcactgtattg

SEQ ID NO: 722430 - DNA, 22 bp, Artificial Sequence
  chemically synthesized
tggcactgtattgtagtcttcc

SEQ ID NO: 722431 - DNA, 22 bp, Artificial Sequence
  chemically synthesized
tattgtagtcttccccaatttg

SEQ ID NO: 722432 - DNA, 22 bp, Artificial Sequence
  chemically synthesized
taaaagagcataaagcaaattg

SEQ ID NO: 722433 - DNA, 22 bp, Artificial Sequence
  chemically synthesized
tagtcttccccaatttgcttta

SEQ ID NO: 722434 - DNA, 22 bp, Artificial Sequence
  chemically synthesized
ttgtaaaagagcataaagcaaa

SEQ ID NO: 722435 - DNA, 22 bp, Artificial Sequence
  chemically synthesized
attgtaaaagagcataaagcaa

SEQ ID NO: 722436 - DNA, 22 bp, Artificial Sequence
  chemically synthesized
ccccaatttgctttatgctctt

SEQ ID NO: 722437 - DNA, 22 bp, Artificial Sequence
  chemically synthesized
cccaatttgctttatgctcttt

SEQ ID NO: 722438 - DNA, 22 bp, Artificial Sequence
  chemically synthesized
gagtggtttattgtaaaagagc

SEQ ID NO: 722439 - DNA, 22 bp, Artificial Sequence
  chemically synthesized
cctagagtggtttattgtaaaa

SEQ ID NO: 722440 - DNA, 22 bp, Artificial Sequence
  chemically synthesized
gctttatgctcttttacaataa

SEQ ID NO: 722441 - DNA, 22 bp, Artificial Sequence
  chemically synthesized
ctttatgctcttttacaataaa

SEQ ID NO: 722442 - DNA, 22 bp, Artificial Sequence
  chemically synthesized
tatgctcttttacaataaacca

SEQ ID NO: 722443 - DNA, 22 bp, Artificial Sequence
  chemically synthesized
atgctcttttacaataaaccac

SEQ ID NO: 722444 - DNA, 22 bp, Artificial Sequence
  chemically synthesized
tgctcttttacaataaaccact

SEQ ID NO: 722445 - DNA, 22 bp, Artificial Sequence
  chemically synthesized
atatcagctgcctagagtggtt

SEQ ID NO: 722446 - DNA, 22 bp, Artificial Sequence
  chemically synthesized
ttttacaataaaccactctagg

SEQ ID NO: 722447 - DNA, 22 bp, Artificial Sequence
  chemically synthesized
ttacaataaaccactctaggca

SEQ ID NO: 722448 - DNA, 22 bp, Artificial Sequence
  chemically synthesized
actgatatcagctgcctagagt

SEQ ID NO: 722449 - DNA, 22 bp, Artificial Sequence
  chemically synthesized
tacaataaaccactctaggcag

SEQ ID NO: 722450 - DNA, 22 bp, Artificial Sequence
  chemically synthesized
acaataaaccactctaggcagc

SEQ ID NO: 722451 - DNA, 22 bp, Artificial Sequence
  chemically synthesized
caataaaccactctaggcagct

SEQ ID NO: 722452 - DNA, 22 bp, Artificial Sequence
  chemically synthesized
ttgactgatatcagctgcctag

SEQ ID NO: 722453 - DNA, 22 bp, Artificial Sequence
  chemically synthesized
attgactgatatcagctgccta

SEQ ID NO: 722454 - DNA, 22 bp, Artificial Sequence
  chemically synthesized
ttattgactgatatcagctgcc

SEQ ID NO: 722455 - DNA, 22 bp, Artificial Sequence
  chemically synthesized
taggcagctgatatcagtcaat

SEQ ID NO: 722456 - DNA, 22 bp, Artificial Sequence
  chemically synthesized
ggcagctgatatcagtcaataa

SEQ ID NO: 722457 - DNA, 22 bp, Artificial Sequence
  chemically synthesized
acaagcaagctcttattgactg

SEQ ID NO: 722458 - DNA, 22 bp, Artificial Sequence
  chemically synthesized
atctcacaagcaagctcttatt

SEQ ID NO: 722459 - DNA, 22 bp, Artificial Sequence
  chemically synthesized
atatcagtcaataagagcttgc

SEQ ID NO: 722460 - DNA, 22 bp, Artificial Sequence
  chemically synthesized
ttcatctcacaagcaagctctt

SEQ ID NO: 722461 - DNA, 22 bp, Artificial Sequence
  chemically synthesized
gaatggtaaatattgttcatct

SEQ ID NO: 722462 - DNA, 22 bp, Artificial Sequence
  chemically synthesized
gcttgtgagatgaacaatattt

SEQ ID NO: 722463 - DNA, 22 bp, Artificial Sequence
  chemically synthesized
cttgtgagatgaacaatattta

SEQ ID NO: 722464 - DNA, 22 bp, Artificial Sequence
  chemically synthesized
tatctggaatggtaaatattgt

SEQ ID NO: 722465 - DNA, 22 bp, Artificial Sequence
  chemically synthesized
gtgagatgaacaatatttacca

SEQ ID NO: 722466 - DNA, 22 bp, Artificial Sequence
  chemically synthesized
tgagatgaacaatatttaccat

SEQ ID NO: 722467 - DNA, 22 bp, Artificial Sequence
  chemically synthesized
cactatatctggaatggtaaat

SEQ ID NO: 722468 - DNA, 22 bp, Artificial Sequence
  chemically synthesized
ctgcactatatctggaatggta

SEQ ID NO: 722469 - DNA, 22 bp, Artificial Sequence
  chemically synthesized
actgcactatatctggaatggt

SEQ ID NO: 722470 - DNA, 22 bp, Artificial Sequence
  chemically synthesized
cttactgcactatatctggaat

SEQ ID NO: 722471 - DNA, 22 bp, Artificial Sequence
  chemically synthesized
ttccttactgcactatatctgg

SEQ ID NO: 722472 - DNA, 22 bp, Artificial Sequence
  chemically synthesized
attccttactgcactatatctg

SEQ ID NO: 722473 - DNA, 22 bp, Artificial Sequence
  chemically synthesized
tcttattccttactgcactata

SEQ ID NO: 722474 - DNA, 22 bp, Artificial Sequence
  chemically synthesized
accattccagatatagtgcagt

SEQ ID NO: 722475 - DNA, 22 bp, Artificial Sequence
  chemically synthesized
atcttattccttactgcactat

SEQ ID NO: 722476 - DNA, 22 bp, Artificial Sequence
  chemically synthesized
ccattccagatatagtgcagta

SEQ ID NO: 722477 - DNA, 22 bp, Artificial Sequence
  chemically synthesized
tatcttattccttactgcacta

SEQ ID NO: 722478 - DNA, 22 bp, Artificial Sequence
  chemically synthesized
cagatatagtgcagtaaggaat

SEQ ID NO: 722479 - DNA, 22 bp, Artificial Sequence
  chemically synthesized
ggcatctttatcttattcctta

SEQ ID NO: 722480 - DNA, 22 bp, Artificial Sequence
  chemically synthesized
cggcatctttatcttattcctt

SEQ ID NO: 722481 - DNA, 22 bp, Artificial Sequence
  chemically synthesized
agtttcggcatctttatcttat

SEQ ID NO: 722482 - DNA, 22 bp, Artificial Sequence
  chemically synthesized
taatagaatctgagtttcggca

SEQ ID NO: 722483 - DNA, 22 bp, Artificial Sequence
  chemically synthesized
tgattataatagaatctgagtt

SEQ ID NO: 722484 - DNA, 22 bp, Artificial Sequence
  chemically synthesized
atcaatggataatctgtgatta

SEQ ID NO: 722485 - DNA, 22 bp, Artificial Sequence
  chemically synthesized
agattctattataatcacagat

SEQ ID NO: 722486 - DNA, 22 bp, Artificial Sequence
  chemically synthesized
agctaatcaatggataatctgt

SEQ ID NO: 722487 - DNA, 22 bp, Artificial Sequence
  chemically synthesized
tattataatcacagattatcca

SEQ ID NO: 722488 - DNA, 22 bp, Artificial Sequence
  chemically synthesized
ttataatcacagattatccatt

SEQ ID NO: 722489 - DNA, 22 bp, Artificial Sequence
  chemically synthesized
actaagctaatcaatggataat

SEQ ID NO: 722490 - DNA, 22 bp, Artificial Sequence
  chemically synthesized
taatcacagattatccattgat

SEQ ID NO: 722491 - DNA, 22 bp, Artificial Sequence
  chemically synthesized
aaactcactaagctaatcaatg

SEQ ID NO: 722492 - DNA, 22 bp, Artificial Sequence
  chemically synthesized
aaaactcactaagctaatcaat

SEQ ID NO: 722493 - DNA, 22 bp, Artificial Sequence
  chemically synthesized
taaaactcactaagctaatcaa

SEQ ID NO: 722494 - DNA, 22 bp, Artificial Sequence
  chemically synthesized
ttaaaactcactaagctaatca

SEQ ID NO: 722495 - DNA, 22 bp, Artificial Sequence
  chemically synthesized
tttaaaactcactaagctaatc

SEQ ID NO: 722496 - DNA, 22 bp, Artificial Sequence
  chemically synthesized
tccattgattagcttagtgagt

SEQ ID NO: 722497 - DNA, 22 bp, Artificial Sequence
  chemically synthesized
attagcttagtgagttttaaaa

SEQ ID NO: 722498 - DNA, 22 bp, Artificial Sequence
  chemically synthesized
gcttagtgagttttaaaaaatc

SEQ ID NO: 722499 - DNA, 22 bp, Artificial Sequence
  chemically synthesized
agtgagttttaaaaaatcattt

SEQ ID NO: 722500 - DNA, 22 bp, Artificial Sequence
  chemically synthesized
gtgagttttaaaaaatcatttc

SEQ ID NO: 722501 - DNA, 22 bp, Artificial Sequence
  chemically synthesized
taaaaaatcatttctacacttc

SEQ ID NO: 722502 - DNA, 22 bp, Artificial Sequence
  chemically synthesized
aaaaaatcatttctacacttct

SEQ ID NO: 722503 - DNA, 22 bp, Artificial Sequence
  chemically synthesized
aaaaatcatttctacacttctg

SEQ ID NO: 722504 - DNA, 22 bp, Artificial Sequence
  chemically synthesized
tgtgaagtagggcacagaagtg

SEQ ID NO: 722505 - DNA, 22 bp, Artificial Sequence
  chemically synthesized
actgtgtgaagtagggcacaga

SEQ ID NO: 722506 - DNA, 22 bp, Artificial Sequence
  chemically synthesized
ctacacttctgtgccctacttc

SEQ ID NO: 722507 - DNA, 22 bp, Artificial Sequence
  chemically synthesized
tacacttctgtgccctacttca

SEQ ID NO: 722508 - DNA, 22 bp, Artificial Sequence
  chemically synthesized
atcctaactgtgtgaagtaggg

SEQ ID NO: 722509 - DNA, 22 bp, Artificial Sequence
  chemically synthesized
cacttctgtgccctacttcaca

SEQ ID NO: 722510 - DNA, 22 bp, Artificial Sequence
  chemically synthesized
accctcatcctaactgtgtgaa

SEQ ID NO: 722511 - DNA, 22 bp, Artificial Sequence
  chemically synthesized
ctgtgccctacttcacacagtt

SEQ ID NO: 722512 - DNA, 22 bp, Artificial Sequence
  chemically synthesized
aaccctcatcctaactgtgtga

SEQ ID NO: 722513 - DNA, 22 bp, Artificial Sequence
  chemically synthesized
tgtgccctacttcacacagtta

SEQ ID NO: 722514 - DNA, 22 bp, Artificial Sequence
  chemically synthesized
tgccctacttcacacagttagg

SEQ ID NO: 722515 - DNA, 22 bp, Artificial Sequence
  chemically synthesized
catttaaccctcatcctaactg

SEQ ID NO: 722516 - DNA, 22 bp, Artificial Sequence
  chemically synthesized
ttccatttaaccctcatcctaa

SEQ ID NO: 722517 - DNA, 22 bp, Artificial Sequence
  chemically synthesized
cttcacacagttaggatgaggg

SEQ ID NO: 722518 - DNA, 22 bp, Artificial Sequence
  chemically synthesized
cacacagttaggatgagggtta

SEQ ID NO: 722519 - DNA, 22 bp, Artificial Sequence
  chemically synthesized
acacagttaggatgagggttaa

SEQ ID NO: 722520 - DNA, 22 bp, Artificial Sequence
  chemically synthesized
gatgtgtctattccatttaacc

SEQ ID NO: 722521 - DNA, 22 bp, Artificial Sequence
  chemically synthesized
agatgtgtctattccatttaac

SEQ ID NO: 722522 - DNA, 22 bp, Artificial Sequence
  chemically synthesized
tagatgtgtctattccatttaa

SEQ ID NO: 722523 - DNA, 22 bp, Artificial Sequence
  chemically synthesized
ggatgagggttaaatggaatag

SEQ ID NO: 722524 - DNA, 22 bp, Artificial Sequence
  chemically synthesized
acaaagcacctttagatgtgtc

SEQ ID NO: 722525 - DNA, 22 bp, Artificial Sequence
  chemically synthesized
cacaaagcacctttagatgtgt

SEQ ID NO: 722526 - DNA, 22 bp, Artificial Sequence
  chemically synthesized
aatggaatagacacatctaaag

SEQ ID NO: 722527 - DNA, 22 bp, Artificial Sequence
  chemically synthesized
catttcacaaagcacctttaga

SEQ ID NO: 722528 - DNA, 22 bp, Artificial Sequence
  chemically synthesized
acatttcacaaagcacctttag

SEQ ID NO: 722529 - DNA, 22 bp, Artificial Sequence
  chemically synthesized
tacatttcacaaagcaccttta

SEQ ID NO: 722530 - DNA, 22 bp, Artificial Sequence
  chemically synthesized
tttacatttcacaaagcacctt

SEQ ID NO: 722531 - DNA, 22 bp, Artificial Sequence
  chemically synthesized
aaggtgctttgtgaaatgtaaa

SEQ ID NO: 722532 - DNA, 22 bp, Artificial Sequence
  chemically synthesized
atgtatataattctttacattt

SEQ ID NO: 722533 - DNA, 22 bp, Artificial Sequence
  chemically synthesized
catgtatataattctttacatt

SEQ ID NO: 722534 - DNA, 22 bp, Artificial Sequence
  chemically synthesized
tgtgaaatgtaaagaattatat

SEQ ID NO: 722535 - DNA, 22 bp, Artificial Sequence
  chemically synthesized
gtgaaatgtaaagaattatata

SEQ ID NO: 722536 - DNA, 22 bp, Artificial Sequence
  chemically synthesized
tgaaatgtaaagaattatatac

SEQ ID NO: 722537 - DNA, 22 bp, Artificial Sequence
  chemically synthesized
agatcaggtttcatgtatataa

SEQ ID NO: 722538 - DNA, 22 bp, Artificial Sequence
  chemically synthesized
aatatcctaagatcaggtttca

SEQ ID NO: 722539 - DNA, 22 bp, Artificial Sequence
  chemically synthesized
gaatatcctaagatcaggtttc

SEQ ID NO: 722540 - DNA, 22 bp, Artificial Sequence
  chemically synthesized
ttgaatatcctaagatcaggtt

SEQ ID NO: 722541 - DNA, 22 bp, Artificial Sequence
  chemically synthesized
cttgaatatcctaagatcaggt

SEQ ID NO: 722542 - DNA, 22 bp, Artificial Sequence
  chemically synthesized
tcttgaatatcctaagatcagg

SEQ ID NO: 722543 - DNA, 22 bp, Artificial Sequence
  chemically synthesized
tatacatgaaacctgatcttag

SEQ ID NO: 722544 - DNA, 22 bp, Artificial Sequence
  chemically synthesized
tggtcaattttcttgaatatcc

SEQ ID NO: 722545 - DNA, 22 bp, Artificial Sequence
  chemically synthesized
tatggtcaattttcttgaatat

SEQ ID NO: 722546 - DNA, 22 bp, Artificial Sequence
  chemically synthesized
ctatggtcaattttcttgaata

SEQ ID NO: 722547 - DNA, 22 bp, Artificial Sequence
  chemically synthesized
atcttaggatattcaagaaaat

SEQ ID NO: 722548 - DNA, 22 bp, Artificial Sequence
  chemically synthesized
aggatattcaagaaaattgacc

SEQ ID NO: 722549 - DNA, 22 bp, Artificial Sequence
  chemically synthesized
ggatattcaagaaaattgacca

SEQ ID NO: 722550 - DNA, 22 bp, Artificial Sequence
  chemically synthesized
gagaaatgcatttctatggtca

SEQ ID NO: 722551 - DNA, 22 bp, Artificial Sequence
  chemically synthesized
aagaaaattgaccatagaaatg

SEQ ID NO: 722552 - DNA, 22 bp, Artificial Sequence
  chemically synthesized
aagtatattggagaaatgcatt

SEQ ID NO: 722553 - DNA, 22 bp, Artificial Sequence
  chemically synthesized
aaagtatattggagaaatgcat

SEQ ID NO: 722554 - DNA, 22 bp, Artificial Sequence
  chemically synthesized
ttaaagtatattggagaaatgc

SEQ ID NO: 722555 - DNA, 22 bp, Artificial Sequence
  chemically synthesized
accatagaaatgcatttctcca

SEQ ID NO: 722556 - DNA, 22 bp, Artificial Sequence
  chemically synthesized
ctccaatatactttaagaatcc

SEQ ID NO: 722557 - DNA, 22 bp, Artificial Sequence
  chemically synthesized
tccaatatactttaagaatcct

SEQ ID NO: 722558 - DNA, 22 bp, Artificial Sequence
  chemically synthesized
caatatactttaagaatccttt

SEQ ID NO: 722559 - DNA, 22 bp, Artificial Sequence
  chemically synthesized
aacagatggtagaaaaacaaag

SEQ ID NO: 722560 - DNA, 22 bp, Artificial Sequence
  chemically synthesized
taagaatcctttgtttttctac

SEQ ID NO: 722561 - DNA, 22 bp, Artificial Sequence
  chemically synthesized
aagaatcctttgtttttctacc

SEQ ID NO: 722562 - DNA, 22 bp, Artificial Sequence
  chemically synthesized
aactaaacagatggtagaaaaa

SEQ ID NO: 722563 - DNA, 22 bp, Artificial Sequence
  chemically synthesized
agaatcctttgtttttctacca

SEQ ID NO: 722564 - DNA, 22 bp, Artificial Sequence
  chemically synthesized
tgtttttctaccatctgtttag

SEQ ID NO: 722565 - DNA, 22 bp, Artificial Sequence
  chemically synthesized
gtttttctaccatctgtttagt

SEQ ID NO: 722566 - DNA, 22 bp, Artificial Sequence
  chemically synthesized
tttttctaccatctgtttagtt

SEQ ID NO: 722567 - DNA, 22 bp, Artificial Sequence
  chemically synthesized
ttctaccatctgtttagtttag

SEQ ID NO: 722568 - DNA, 22 bp, Artificial Sequence
  chemically synthesized
gatgtatacagactaaactaaa

SEQ ID NO: 722569 - DNA, 22 bp, Artificial Sequence
  chemically synthesized
tctaccatctgtttagtttagt

SEQ ID NO: 722570 - DNA, 22 bp, Artificial Sequence
  chemically synthesized
ctaccatctgtttagtttagtc

SEQ ID NO: 722571 - DNA, 22 bp, Artificial Sequence
  chemically synthesized
taccatctgtttagtttagtct

SEQ ID NO: 722572 - DNA, 22 bp, Artificial Sequence
  chemically synthesized
ccatctgtttagtttagtctgt

SEQ ID NO: 722573 - DNA, 22 bp, Artificial Sequence
  chemically synthesized
tttagtttagtctgtatacatc

SEQ ID NO: 722574 - DNA, 22 bp, Artificial Sequence
  chemically synthesized
agtttagtctgtatacatctaa

SEQ ID NO: 722575 - DNA, 22 bp, Artificial Sequence
  chemically synthesized
gtttagtctgtatacatctaac

SEQ ID NO: 722576 - DNA, 22 bp, Artificial Sequence
  chemically synthesized
gacatgggaataaaagttagat

SEQ ID NO: 722577 - DNA, 22 bp, Artificial Sequence
  chemically synthesized
agtctgtatacatctaactttt

SEQ ID NO: 722578 - DNA, 22 bp, Artificial Sequence
  chemically synthesized
gtctgtatacatctaactttta

SEQ ID NO: 722579 - DNA, 22 bp, Artificial Sequence
  chemically synthesized
ttggacatgggaataaaagtta

SEQ ID NO: 722580 - DNA, 22 bp, Artificial Sequence
  chemically synthesized
tgttggacatgggaataaaagt

SEQ ID NO: 722581 - DNA, 22 bp, Artificial Sequence
  chemically synthesized
tatacatctaacttttattccc

SEQ ID NO: 722582 - DNA, 22 bp, Artificial Sequence
  chemically synthesized
agttctgttggacatgggaata

SEQ ID NO: 722583 - DNA, 22 bp, Artificial Sequence
  chemically synthesized
cagttctgttggacatgggaat

SEQ ID NO: 722584 - DNA, 22 bp, Artificial Sequence
  chemically synthesized
acttcagttctgttggacatgg

SEQ ID NO: 722585 - DNA, 22 bp, Artificial Sequence
  chemically synthesized
acttttattcccatgtccaaca

SEQ ID NO: 722586 - DNA, 22 bp, Artificial Sequence
  chemically synthesized
taacttcagttctgttggacat

SEQ ID NO: 722587 - DNA, 22 bp, Artificial Sequence
  chemically synthesized
ttattcccatgtccaacagaac

SEQ ID NO: 722588 - DNA, 22 bp, Artificial Sequence
  chemically synthesized
tattcccatgtccaacagaact

SEQ ID NO: 722589 - DNA, 22 bp, Artificial Sequence
  chemically synthesized
attcccatgtccaacagaactg

SEQ ID NO: 722590 - DNA, 22 bp, Artificial Sequence
  chemically synthesized
acactctaacttcagttctgtt

SEQ ID NO: 722591 - DNA, 22 bp, Artificial Sequence
  chemically synthesized
ttcccatgtccaacagaactga

SEQ ID NO: 722592 - DNA, 22 bp, Artificial Sequence
  chemically synthesized
tcacactctaacttcagttctg

SEQ ID NO: 722593 - DNA, 22 bp, Artificial Sequence
  chemically synthesized
ccatgtccaacagaactgaagt

SEQ ID NO: 722594 - DNA, 22 bp, Artificial Sequence
  chemically synthesized
aagaaggaatctctcacactct

SEQ ID NO: 722595 - DNA, 22 bp, Artificial Sequence
  chemically synthesized
gctgaagaaggaatctctcaca

SEQ ID NO: 722596 - DNA, 22 bp, Artificial Sequence
  chemically synthesized
aagttagagtgtgagagattcc

SEQ ID NO: 722597 - DNA, 22 bp, Artificial Sequence
  chemically synthesized
cattagctgaagaaggaatctc

SEQ ID NO: 722598 - DNA, 22 bp, Artificial Sequence
  chemically synthesized
ttccattagctgaagaaggaat

SEQ ID NO: 722599 - DNA, 22 bp, Artificial Sequence
  chemically synthesized
gagtgtgagagattccttcttc

SEQ ID NO: 722600 - DNA, 22 bp, Artificial Sequence
  chemically synthesized
attccattagctgaagaaggaa

SEQ ID NO: 722601 - DNA, 22 bp, Artificial Sequence
  chemically synthesized
tatcatttattccattagctga

SEQ ID NO: 722602 - DNA, 22 bp, Artificial Sequence
  chemically synthesized
tatatcatttattccattagct

SEQ ID NO: 722603 - DNA, 22 bp, Artificial Sequence
  chemically synthesized
cttcttcagctaatggaataaa

SEQ ID NO: 722604 - DNA, 22 bp, Artificial Sequence
  chemically synthesized
agctctatatcatttattccat

SEQ ID NO: 722605 - DNA, 22 bp, Artificial Sequence
  chemically synthesized
cttcagctaatggaataaatga

SEQ ID NO: 722606 - DNA, 22 bp, Artificial Sequence
  chemically synthesized
ttcagctaatggaataaatgat

SEQ ID NO: 722607 - DNA, 22 bp, Artificial Sequence
  chemically synthesized
cagctaatggaataaatgatat

SEQ ID NO: 722608 - DNA, 22 bp, Artificial Sequence
  chemically synthesized
agctaatggaataaatgatata

SEQ ID NO: 722609 - DNA, 22 bp, Artificial Sequence
  chemically synthesized
tccactgagctctatatcattt

SEQ ID NO: 722610 - DNA, 22 bp, Artificial Sequence
  chemically synthesized
atccactgagctctatatcatt

SEQ ID NO: 722611 - DNA, 22 bp, Artificial Sequence
  chemically synthesized
atggaataaatgatatagagct

SEQ ID NO: 722612 - DNA, 22 bp, Artificial Sequence
  chemically synthesized
aagcacatgtttatccactgag

SEQ ID NO: 722613 - DNA, 22 bp, Artificial Sequence
  chemically synthesized
gaatggcactcaagcacatgtt

SEQ ID NO: 722614 - DNA, 22 bp, Artificial Sequence
  chemically synthesized
tagaatggcactcaagcacatg

SEQ ID NO: 722615 - DNA, 22 bp, Artificial Sequence
  chemically synthesized
agtggataaacatgtgcttgag

SEQ ID NO: 722616 - DNA, 22 bp, Artificial Sequence
  chemically synthesized
ctctagaatggcactcaagcac

SEQ ID NO: 722617 - DNA, 22 bp, Artificial Sequence
  chemically synthesized
gctctagaatggcactcaagca

SEQ ID NO: 722618 - DNA, 22 bp, Artificial Sequence
  chemically synthesized
tcatgagggcttgctctagaat

SEQ ID NO: 722619 - DNA, 22 bp, Artificial Sequence
  chemically synthesized
gagtgccattctagagcaagcc

SEQ ID NO: 722620 - DNA, 22 bp, Artificial Sequence
  chemically synthesized
agctgtcatgagggcttgctct

SEQ ID NO: 722621 - DNA, 22 bp, Artificial Sequence
  chemically synthesized
agtgccattctagagcaagccc

SEQ ID NO: 722622 - DNA, 22 bp, Artificial Sequence
  chemically synthesized
gctcagctgtcatgagggcttg

SEQ ID NO: 722623 - DNA, 22 bp, Artificial Sequence
  chemically synthesized
tggctcagctgtcatgagggct

SEQ ID NO: 722624 - DNA, 22 bp, Artificial Sequence
  chemically synthesized
tctggctcagctgtcatgaggg

SEQ ID NO: 722625 - DNA, 22 bp, Artificial Sequence
  chemically synthesized
ctctggctcagctgtcatgagg

SEQ ID NO: 722626 - DNA, 22 bp, Artificial Sequence
  chemically synthesized
tagagcaagccctcatgacagc

SEQ ID NO: 722627 - DNA, 22 bp, Artificial Sequence
  chemically synthesized
gagcaagccctcatgacagctg

SEQ ID NO: 722628 - DNA, 22 bp, Artificial Sequence
  chemically synthesized
aaatatgtttctctggctcagc

SEQ ID NO: 722629 - DNA, 22 bp, Artificial Sequence
  chemically synthesized
atgacagctgagccagagaaac

SEQ ID NO: 722630 - DNA, 22 bp, Artificial Sequence
  chemically synthesized
agccagagaaacatatttcagc

SEQ ID NO: 722631 - DNA, 22 bp, Artificial Sequence
  chemically synthesized
agatatgaagcaatgagatagg

SEQ ID NO: 722632 - DNA, 22 bp, Artificial Sequence
  chemically synthesized
cagccacttccctatctcattg

SEQ ID NO: 722633 - DNA, 22 bp, Artificial Sequence
  chemically synthesized
agccacttccctatctcattgc

SEQ ID NO: 722634 - DNA, 22 bp, Artificial Sequence
  chemically synthesized
tctgagatatgaagcaatgaga

SEQ ID NO: 722635 - DNA, 22 bp, Artificial Sequence
  chemically synthesized
aattatctgagatatgaagcaa

SEQ ID NO: 722636 - DNA, 22 bp, Artificial Sequence
  chemically synthesized
ccctatctcattgcttcatatc

SEQ ID NO: 722637 - DNA, 22 bp, Artificial Sequence
  chemically synthesized
taaattatctgagatatgaagc

SEQ ID NO: 722638 - DNA, 22 bp, Artificial Sequence
  chemically synthesized
cctatctcattgcttcatatct

SEQ ID NO: 722639 - DNA, 22 bp, Artificial Sequence
  chemically synthesized
ctaaattatctgagatatgaag

SEQ ID NO: 722640 - DNA, 22 bp, Artificial Sequence
  chemically synthesized
tctcattgcttcatatctcaga

SEQ ID NO: 722641 - DNA, 22 bp, Artificial Sequence
  chemically synthesized
attgcttcatatctcagataat

SEQ ID NO: 722642 - DNA, 22 bp, Artificial Sequence
  chemically synthesized
cttcatatctcagataatttag

SEQ ID NO: 722643 - DNA, 22 bp, Artificial Sequence
  chemically synthesized
aaatcatatacttctaaattat

SEQ ID NO: 722644 - DNA, 22 bp, Artificial Sequence
  chemically synthesized
aaaatcatatacttctaaatta

SEQ ID NO: 722645 - DNA, 22 bp, Artificial Sequence
  chemically synthesized
catatctcagataatttagaag

SEQ ID NO: 722646 - DNA, 22 bp, Artificial Sequence
  chemically synthesized
taaaatcatatacttctaaatt

SEQ ID NO: 722647 - DNA, 22 bp, Artificial Sequence
  chemically synthesized
atatctcagataatttagaagt

SEQ ID NO: 722648 - DNA, 22 bp, Artificial Sequence
  chemically synthesized
ttaaaatcatatacttctaaat

SEQ ID NO: 722649 - DNA, 22 bp, Artificial Sequence
  chemically synthesized
agataatttagaagtatatgat

SEQ ID NO: 722650 - DNA, 22 bp, Artificial Sequence
  chemically synthesized
agaagtatatgattttaaaaat

SEQ ID NO: 722651 - DNA, 22 bp, Artificial Sequence
  chemically synthesized
gaagtatatgattttaaaaatc

SEQ ID NO: 722652 - DNA, 22 bp, Artificial Sequence
  chemically synthesized
atcagaaagcagtgatttttaa

SEQ ID NO: 722653 - DNA, 22 bp, Artificial Sequence
  chemically synthesized
gatcagaaagcagtgattttta

SEQ ID NO: 722654 - DNA, 22 bp, Artificial Sequence
  chemically synthesized
atacttgatcagaaagcagtga

SEQ ID NO: 722655 - DNA, 22 bp, Artificial Sequence
  chemically synthesized
attgatacttgatcagaaagca

SEQ ID NO: 722656 - DNA, 22 bp, Artificial Sequence
  chemically synthesized
taaaaatcactgctttctgatc

SEQ ID NO: 722657 - DNA, 22 bp, Artificial Sequence
  chemically synthesized
aaaaatcactgctttctgatca

SEQ ID NO: 722658 - DNA, 22 bp, Artificial Sequence
  chemically synthesized
aaaatcactgctttctgatcaa

SEQ ID NO: 722659 - DNA, 22 bp, Artificial Sequence
  chemically synthesized
aggatgttaattgatacttgat

SEQ ID NO: 722660 - DNA, 22 bp, Artificial Sequence
  chemically synthesized
tctgaggatgttaattgatact

SEQ ID NO: 722661 - DNA, 22 bp, Artificial Sequence
  chemically synthesized
ctttctgatcaagtatcaatta

SEQ ID NO: 722662 - DNA, 22 bp, Artificial Sequence
  chemically synthesized
tctgatcaagtatcaattaaca

SEQ ID NO: 722663 - DNA, 22 bp, Artificial Sequence
  chemically synthesized
ctgatcaagtatcaattaacat

SEQ ID NO: 722664 - DNA, 22 bp, Artificial Sequence
  chemically synthesized
tgatcaagtatcaattaacatc

SEQ ID NO: 722665 - DNA, 22 bp, Artificial Sequence
  chemically synthesized
atcaagtatcaattaacatcct

SEQ ID NO: 722666 - DNA, 22 bp, Artificial Sequence
  chemically synthesized
ccaaattatctgaggatgttaa

SEQ ID NO: 722667 - DNA, 22 bp, Artificial Sequence
  chemically synthesized
acatcctcagataatttgggag

SEQ ID NO: 722668 - DNA, 22 bp, Artificial Sequence
  chemically synthesized
cgaatcccacaccctcccaaat

SEQ ID NO: 722669 - DNA, 22 bp, Artificial Sequence
  chemically synthesized
agataatttgggagggtgtggg

SEQ ID NO: 722670 - DNA, 22 bp, Artificial Sequence
  chemically synthesized
caatccggctacgaatcccaca

SEQ ID NO: 722671 - DNA, 22 bp, Artificial Sequence
  chemically synthesized
ctacaatccggctacgaatccc

SEQ ID NO: 722672 - DNA, 22 bp, Artificial Sequence
  chemically synthesized
gctacaatccggctacgaatcc

SEQ ID NO: 722673 - DNA, 22 bp, Artificial Sequence
  chemically synthesized
gggagggtgtgggattcgtagc

SEQ ID NO: 722674 - DNA, 22 bp, Artificial Sequence
  chemically synthesized
tgctacaatccggctacgaatc

SEQ ID NO: 722675 - DNA, 22 bp, Artificial Sequence
  chemically synthesized
ggagggtgtgggattcgtagcc

SEQ ID NO: 722676 - DNA, 22 bp, Artificial Sequence
  chemically synthesized
caactttgctacaatccggcta

SEQ ID NO: 722677 - DNA, 22 bp, Artificial Sequence
  chemically synthesized
agttccaactttgctacaatcc

SEQ ID NO: 722678 - DNA, 22 bp, Artificial Sequence
  chemically synthesized
aagttccaactttgctacaatc

SEQ ID NO: 722679 - DNA, 22 bp, Artificial Sequence
  chemically synthesized
taagttccaactttgctacaat

SEQ ID NO: 722680 - DNA, 22 bp, Artificial Sequence
  chemically synthesized
gtagccggattgtagcaaagtt

SEQ ID NO: 722681 - DNA, 22 bp, Artificial Sequence
  chemically synthesized
cattttaagttccaactttgct

SEQ ID NO: 722682 - DNA, 22 bp, Artificial Sequence
  chemically synthesized
ccattttaagttccaactttgc

SEQ ID NO: 722683 - DNA, 22 bp, Artificial Sequence
  chemically synthesized
tccattttaagttccaactttg

SEQ ID NO: 722684 - DNA, 22 bp, Artificial Sequence
  chemically synthesized
ttccattttaagttccaacttt

SEQ ID NO: 722685 - DNA, 22 bp, Artificial Sequence
  chemically synthesized
tttccattttaagttccaactt

SEQ ID NO: 722686 - DNA, 22 bp, Artificial Sequence
  chemically synthesized
ttttccattttaagttccaact

SEQ ID NO: 722687 - DNA, 22 bp, Artificial Sequence
  chemically synthesized
tttttccattttaagttccaac

SEQ ID NO: 722688 - DNA, 22 bp, Artificial Sequence
  chemically synthesized
ttttttccattttaagttccaa

SEQ ID NO: 722689 - DNA, 22 bp, Artificial Sequence
  chemically synthesized
tttttttccattttaagttcca

SEQ ID NO: 722690 - DNA, 22 bp, Artificial Sequence
  chemically synthesized
tagcaaagttggaacttaaaat

SEQ ID NO: 722691 - DNA, 22 bp, Artificial Sequence
  chemically synthesized
ttttttttttccattttaagtt

SEQ ID NO: 722692 - DNA, 22 bp, Artificial Sequence
  chemically synthesized
gttttttttttccattttaagt

SEQ ID NO: 722693 - DNA, 22 bp, Artificial Sequence
  chemically synthesized
tgttttttttttccattttaag

SEQ ID NO: 722694 - DNA, 22 bp, Artificial Sequence
  chemically synthesized
ttgttttttttttccattttaa

SEQ ID NO: 722695 - DNA, 22 bp, Artificial Sequence
  chemically synthesized
tttgttttttttttccatttta

SEQ ID NO: 722696 - DNA, 22 bp, Artificial Sequence
  chemically synthesized
ggctttttgttttttttttcca

SEQ ID NO: 722697 - DNA, 22 bp, Artificial Sequence
  chemically synthesized
gaacttaaaatggaaaaaaaaa

SEQ ID NO: 722698 - DNA, 22 bp, Artificial Sequence
  chemically synthesized
ggtctgggctttttgttttttt

SEQ ID NO: 722699 - DNA, 22 bp, Artificial Sequence
  chemically synthesized
cggtctgggctttttgtttttt

SEQ ID NO: 722700 - DNA, 22 bp, Artificial Sequence
  chemically synthesized
aaaatggaaaaaaaaaacaaaa

SEQ ID NO: 722701 - DNA, 22 bp, Artificial Sequence
  chemically synthesized
tcggtctgggctttttgttttt

SEQ ID NO: 722702 - DNA, 22 bp, Artificial Sequence
  chemically synthesized
aaatggaaaaaaaaaacaaaaa

SEQ ID NO: 722703 - DNA, 22 bp, Artificial Sequence
  chemically synthesized
aaggatgtgaataaatgtgtaa

SEQ ID NO: 722704 - DNA, 22 bp, Artificial Sequence
  chemically synthesized
agaattcaaggatgtgaataaa

SEQ ID NO: 722705 - DNA, 22 bp, Artificial Sequence
  chemically synthesized
acacatttattcacatccttga

SEQ ID NO: 722706 - DNA, 22 bp, Artificial Sequence
  chemically synthesized
cacatttattcacatccttgaa

SEQ ID NO: 722707 - DNA, 22 bp, Artificial Sequence
  chemically synthesized
attcacatccttgaattctgag

SEQ ID NO: 722708 - DNA, 22 bp, Artificial Sequence
  chemically synthesized
ttcacatccttgaattctgaga

SEQ ID NO: 722709 - DNA, 22 bp, Artificial Sequence
  chemically synthesized
acatccttgaattctgagatgt

SEQ ID NO: 722710 - DNA, 22 bp, Artificial Sequence
  chemically synthesized
gaattctgagatgtcatattct

SEQ ID NO: 722711 - DNA, 22 bp, Artificial Sequence
  chemically synthesized
aattctgagatgtcatattctt

SEQ ID NO: 722712 - DNA, 22 bp, Artificial Sequence
  chemically synthesized
tgagatgtcatattcttttgat

SEQ ID NO: 722713 - DNA, 22 bp, Artificial Sequence
  chemically synthesized
agatgtcatattcttttgattt

SEQ ID NO: 722714 - DNA, 22 bp, Artificial Sequence
  chemically synthesized
ttttgatttttgactgacttct

SEQ ID NO: 722715 - DNA, 22 bp, Artificial Sequence
  chemically synthesized
ttgatttttgactgacttctct

SEQ ID NO: 722716 - DNA, 22 bp, Artificial Sequence
  chemically synthesized
tgatttttgactgacttctctt

SEQ ID NO: 722717 - DNA, 22 bp, Artificial Sequence
  chemically synthesized
gatttttgactgacttctcttc

SEQ ID NO: 722718 - DNA, 22 bp, Artificial Sequence
  chemically synthesized
atttttgactgacttctcttct

SEQ ID NO: 722719 - DNA, 22 bp, Artificial Sequence
  chemically synthesized
ttgactgacttctcttctccta

SEQ ID NO: 722720 - DNA, 22 bp, Artificial Sequence
  chemically synthesized
tgactgacttctcttctcctac

SEQ ID NO: 722721 - DNA, 22 bp, Artificial Sequence
  chemically synthesized
gactgacttctcttctcctacc

SEQ ID NO: 722722 - DNA, 22 bp, Artificial Sequence
  chemically synthesized
actgacttctcttctcctacct

SEQ ID NO: 722723 - DNA, 22 bp, Artificial Sequence
  chemically synthesized
acttctcttctcctacctctgc

SEQ ID NO: 722724 - DNA, 22 bp, Artificial Sequence
  chemically synthesized
ctcttctcctacctctgcttga

SEQ ID NO: 722725 - DNA, 22 bp, Artificial Sequence
  chemically synthesized
aagaaaaagaagtcaagcagag

SEQ ID NO: 722726 - DNA, 22 bp, Artificial Sequence
  chemically synthesized
tcttctcctacctctgcttgac

SEQ ID NO: 722727 - DNA, 22 bp, Artificial Sequence
  chemically synthesized
caagaaaaagaagtcaagcaga

SEQ ID NO: 722728 - DNA, 22 bp, Artificial Sequence
  chemically synthesized
ttctcctacctctgcttgactt

SEQ ID NO: 722729 - DNA, 22 bp, Artificial Sequence
  chemically synthesized
ctcctacctctgcttgacttct

SEQ ID NO: 722730 - DNA, 22 bp, Artificial Sequence
  chemically synthesized
tcctacctctgcttgacttctt

SEQ ID NO: 722731 - DNA, 22 bp, Artificial Sequence
  chemically synthesized
ctacctctgcttgacttctttt

SEQ ID NO: 722732 - DNA, 22 bp, Artificial Sequence
  chemically synthesized
ataaacttcaagaaaaagaagt

SEQ ID NO: 722733 - DNA, 22 bp, Artificial Sequence
  chemically synthesized
gataaacttcaagaaaaagaag

SEQ ID NO: 722734 - DNA, 22 bp, Artificial Sequence
  chemically synthesized
cctctgcttgacttctttttct

SEQ ID NO: 722735 - DNA, 22 bp, Artificial Sequence
  chemically synthesized
tgcttgacttctttttcttgaa

SEQ ID NO: 722736 - DNA, 22 bp, Artificial Sequence
  chemically synthesized
cttgacttctttttcttgaagt

SEQ ID NO: 722737 - DNA, 22 bp, Artificial Sequence
  chemically synthesized
gacttctttttcttgaagttta

SEQ ID NO: 722738 - DNA, 22 bp, Artificial Sequence
  chemically synthesized
acttctttttcttgaagtttat

SEQ ID NO: 722739 - DNA, 22 bp, Artificial Sequence
  chemically synthesized
ggaccaaaccttgataaacttc

SEQ ID NO: 722740 - DNA, 22 bp, Artificial Sequence
  chemically synthesized
ctttttcttgaagtttatcaag

SEQ ID NO: 722741 - DNA, 22 bp, Artificial Sequence
  chemically synthesized
tttttcttgaagtttatcaagg

SEQ ID NO: 722742 - DNA, 22 bp, Artificial Sequence
  chemically synthesized
tttcttgaagtttatcaaggtt

SEQ ID NO: 722743 - DNA, 22 bp, Artificial Sequence
  chemically synthesized
ttcttgaagtttatcaaggttt

SEQ ID NO: 722744 - DNA, 22 bp, Artificial Sequence
  chemically synthesized
tcttgaagtttatcaaggtttg

SEQ ID NO: 722745 - DNA, 22 bp, Artificial Sequence
  chemically synthesized
cttgaagtttatcaaggtttgg

SEQ ID NO: 722746 - DNA, 22 bp, Artificial Sequence
  chemically synthesized
ttgaagtttatcaaggtttggt

SEQ ID NO: 722747 - DNA, 22 bp, Artificial Sequence
  chemically synthesized
gaagtttatcaaggtttggtcc

SEQ ID NO: 722748 - DNA, 22 bp, Artificial Sequence
  chemically synthesized
aagtttatcaaggtttggtcct

SEQ ID NO: 722749 - DNA, 22 bp, Artificial Sequence
  chemically synthesized
atcaaggtttggtcctaggcca

SEQ ID NO: 722750 - DNA, 22 bp, Artificial Sequence
  chemically synthesized
tcaaggtttggtcctaggccat

SEQ ID NO: 722751 - DNA, 22 bp, Artificial Sequence
  chemically synthesized
ggtcctaggccatcttcccttc

SEQ ID NO: 722752 - DNA, 22 bp, Artificial Sequence
  chemically synthesized
gtcctaggccatcttcccttcc

SEQ ID NO: 722753 - DNA, 22 bp, Artificial Sequence
  chemically synthesized
gcatgtaaagagggaagggaag

SEQ ID NO: 722754 - DNA, 22 bp, Artificial Sequence
  chemically synthesized
agcatgtaaagagggaagggaa

SEQ ID NO: 722755 - DNA, 22 bp, Artificial Sequence
  chemically synthesized
ggccatcttcccttccctcttt

SEQ ID NO: 722756 - DNA, 22 bp, Artificial Sequence
  chemically synthesized
cccttccctctttacatgctaa

SEQ ID NO: 722757 - DNA, 22 bp, Artificial Sequence
  chemically synthesized
ccttccctctttacatgctaag

SEQ ID NO: 722758 - DNA, 22 bp, Artificial Sequence
  chemically synthesized
ccctctttacatgctaagtgat

SEQ ID NO: 722759 - DNA, 22 bp, Artificial Sequence
  chemically synthesized
cctctttacatgctaagtgatt

SEQ ID NO: 722760 - DNA, 22 bp, Artificial Sequence
  chemically synthesized
tttacatgctaagtgatttcca

SEQ ID NO: 722761 - DNA, 22 bp, Artificial Sequence
  chemically synthesized
gagcatccagaatggaaatcac

SEQ ID NO: 722762 - DNA, 22 bp, Artificial Sequence
  chemically synthesized
agagcatccagaatggaaatca

SEQ ID NO: 722763 - DNA, 22 bp, Artificial Sequence
  chemically synthesized
tacatgctaagtgatttccatt

SEQ ID NO: 722764 - DNA, 22 bp, Artificial Sequence
  chemically synthesized
acatgctaagtgatttccattc

SEQ ID NO: 722765 - DNA, 22 bp, Artificial Sequence
  chemically synthesized
catgctaagtgatttccattct

SEQ ID NO: 722766 - DNA, 22 bp, Artificial Sequence
  chemically synthesized
agtgatttccattctggatgct

SEQ ID NO: 722767 - DNA, 22 bp, Artificial Sequence
  chemically synthesized
atacaaaatggaatttagagca

SEQ ID NO: 722768 - DNA, 22 bp, Artificial Sequence
  chemically synthesized
ccattctggatgctctaaattc

SEQ ID NO: 722769 - DNA, 22 bp, Artificial Sequence
  chemically synthesized
cattctggatgctctaaattcc

SEQ ID NO: 722770 - DNA, 22 bp, Artificial Sequence
  chemically synthesized
tggatgctctaaattccatttt

SEQ ID NO: 722771 - DNA, 22 bp, Artificial Sequence
  chemically synthesized
gatgctctaaattccattttgt

SEQ ID NO: 722772 - DNA, 22 bp, Artificial Sequence
  chemically synthesized
taaattccattttgtatcaata

SEQ ID NO: 722773 - DNA, 22 bp, Artificial Sequence
  chemically synthesized
aattccattttgtatcaatatt

SEQ ID NO: 722774 - DNA, 22 bp, Artificial Sequence
  chemically synthesized
cattttgtatcaatatttttct

SEQ ID NO: 722775 - DNA, 22 bp, Artificial Sequence
  chemically synthesized
gaagcgtaaatgagaaaaatat

SEQ ID NO: 722776 - DNA, 22 bp, Artificial Sequence
  chemically synthesized
tgtatcaatatttttctcattt

SEQ ID NO: 722777 - DNA, 22 bp, Artificial Sequence
  chemically synthesized
gtatcaatatttttctcattta

SEQ ID NO: 722778 - DNA, 22 bp, Artificial Sequence
  chemically synthesized
tatcaatatttttctcatttac

SEQ ID NO: 722779 - DNA, 22 bp, Artificial Sequence
  chemically synthesized
ttctcatttacgcttctagctc

SEQ ID NO: 722780 - DNA, 22 bp, Artificial Sequence
  chemically synthesized
tctcatttacgcttctagctcg

SEQ ID NO: 722781 - DNA, 22 bp, Artificial Sequence
  chemically synthesized
aaaggagagacccgagctagaa

SEQ ID NO: 722782 - DNA, 22 bp, Artificial Sequence
  chemically synthesized
ctcatttacgcttctagctcgg

SEQ ID NO: 722783 - DNA, 22 bp, Artificial Sequence
  chemically synthesized
tcatttacgcttctagctcggg

SEQ ID NO: 722784 - DNA, 22 bp, Artificial Sequence
  chemically synthesized
atttacgcttctagctcgggtc

SEQ ID NO: 722785 - DNA, 22 bp, Artificial Sequence
  chemically synthesized
tagctcaaaggagagacccgag

SEQ ID NO: 722786 - DNA, 22 bp, Artificial Sequence
  chemically synthesized
acgcttctagctcgggtctctc

SEQ ID NO: 722787 - DNA, 22 bp, Artificial Sequence
  chemically synthesized
cgcttctagctcgggtctctcc

SEQ ID NO: 722788 - DNA, 22 bp, Artificial Sequence
  chemically synthesized
aattatagctcaaaggagagac

SEQ ID NO: 722789 - DNA, 22 bp, Artificial Sequence
  chemically synthesized
ctagctcgggtctctcctttga

SEQ ID NO: 722790 - DNA, 22 bp, Artificial Sequence
  chemically synthesized
tagctcgggtctctcctttgag

SEQ ID NO: 722791 - DNA, 22 bp, Artificial Sequence
  chemically synthesized
gctcgggtctctcctttgagct

SEQ ID NO: 722792 - DNA, 22 bp, Artificial Sequence
  chemically synthesized
gggtctctcctttgagctataa

SEQ ID NO: 722793 - DNA, 22 bp, Artificial Sequence
  chemically synthesized
tcctttgagctataattgaatt

SEQ ID NO: 722794 - DNA, 22 bp, Artificial Sequence
  chemically synthesized
ctttgagctataattgaatttg

SEQ ID NO: 722795 - DNA, 22 bp, Artificial Sequence
  chemically synthesized
tgagctataattgaatttgact

SEQ ID NO: 722796 - DNA, 22 bp, Artificial Sequence
  chemically synthesized
gagctataattgaatttgactt

SEQ ID NO: 722797 - DNA, 22 bp, Artificial Sequence
  chemically synthesized
agctataattgaatttgacttc

SEQ ID NO: 722798 - DNA, 22 bp, Artificial Sequence
  chemically synthesized
taattgaatttgacttctgcac

SEQ ID NO: 722799 - DNA, 22 bp, Artificial Sequence
  chemically synthesized
aatttgacttctgcacttggac

SEQ ID NO: 722800 - DNA, 22 bp, Artificial Sequence
  chemically synthesized
aaatgtgtgtgatatgtccaag

SEQ ID NO: 722801 - DNA, 22 bp, Artificial Sequence
  chemically synthesized
gaaatgtgtgtgatatgtccaa

SEQ ID NO: 722802 - DNA, 22 bp, Artificial Sequence
  chemically synthesized
gacttctgcacttggacatatc

SEQ ID NO: 722803 - DNA, 22 bp, Artificial Sequence
  chemically synthesized
acttctgcacttggacatatca

SEQ ID NO: 722804 - DNA, 22 bp, Artificial Sequence
  chemically synthesized
agtttgaaatgtgtgtgatatg

SEQ ID NO: 722805 - DNA, 22 bp, Artificial Sequence
  chemically synthesized
ctgcacttggacatatcacaca

SEQ ID NO: 722806 - DNA, 22 bp, Artificial Sequence
  chemically synthesized
tgcacttggacatatcacacac

SEQ ID NO: 722807 - DNA, 22 bp, Artificial Sequence
  chemically synthesized
cacttggacatatcacacacat

SEQ ID NO: 722808 - DNA, 22 bp, Artificial Sequence
  chemically synthesized
ggacatatcacacacatttcaa

SEQ ID NO: 722809 - DNA, 22 bp, Artificial Sequence
  chemically synthesized
gacatgttcagtttgaaatgtg

SEQ ID NO: 722810 - DNA, 22 bp, Artificial Sequence
  chemically synthesized
gacatatcacacacatttcaaa

SEQ ID NO: 722811 - DNA, 22 bp, Artificial Sequence
  chemically synthesized
agacatgttcagtttgaaatgt

SEQ ID NO: 722812 - DNA, 22 bp, Artificial Sequence
  chemically synthesized
tagacatgttcagtttgaaatg

SEQ ID NO: 722813 - DNA, 22 bp, Artificial Sequence
  chemically synthesized
agttttagacatgttcagtttg

SEQ ID NO: 722814 - DNA, 22 bp, Artificial Sequence
  chemically synthesized
caaactgaacatgtctaaaact

SEQ ID NO: 722815 - DNA, 22 bp, Artificial Sequence
  chemically synthesized
aaactgaacatgtctaaaactg

SEQ ID NO: 722816 - DNA, 22 bp, Artificial Sequence
  chemically synthesized
gaaaagatcaacagttcagttt

SEQ ID NO: 722817 - DNA, 22 bp, Artificial Sequence
  chemically synthesized
ggaaaagatcaacagttcagtt

SEQ ID NO: 722818 - DNA, 22 bp, Artificial Sequence
  chemically synthesized
aacatgtctaaaactgaactgt

SEQ ID NO: 722819 - DNA, 22 bp, Artificial Sequence
  chemically synthesized
aaactgaactgttgatcttttc

SEQ ID NO: 722820 - DNA, 22 bp, Artificial Sequence
  chemically synthesized
aactgttgatcttttccaaatc

SEQ ID NO: 722821 - DNA, 22 bp, Artificial Sequence
  chemically synthesized
ttgatcttttccaaatctgctt

SEQ ID NO: 722822 - DNA, 22 bp, Artificial Sequence
  chemically synthesized
atcttttccaaatctgcttcct

SEQ ID NO: 722823 - DNA, 22 bp, Artificial Sequence
  chemically synthesized
ttccaaatctgcttcctcctcc

SEQ ID NO: 722824 - DNA, 22 bp, Artificial Sequence
  chemically synthesized
tccaaatctgcttcctcctcca

SEQ ID NO: 722825 - DNA, 22 bp, Artificial Sequence
  chemically synthesized
aggtgataaagatggaggagga

SEQ ID NO: 722826 - DNA, 22 bp, Artificial Sequence
  chemically synthesized
ccaaatctgcttcctcctccat

SEQ ID NO: 722827 - DNA, 22 bp, Artificial Sequence
  chemically synthesized
caaatctgcttcctcctccatc

SEQ ID NO: 722828 - DNA, 22 bp, Artificial Sequence
  chemically synthesized
ctgaggtgataaagatggagga

SEQ ID NO: 722829 - DNA, 22 bp, Artificial Sequence
  chemically synthesized
gctgaggtgataaagatggagg

SEQ ID NO: 722830 - DNA, 22 bp, Artificial Sequence
  chemically synthesized
tttgctgaggtgataaagatgg

SEQ ID NO: 722831 - DNA, 22 bp, Artificial Sequence
  chemically synthesized
cttcctcctccatctttatcac

SEQ ID NO: 722832 - DNA, 22 bp, Artificial Sequence
  chemically synthesized
tactgtttgctgaggtgataaa

SEQ ID NO: 722833 - DNA, 22 bp, Artificial Sequence
  chemically synthesized
cctcctccatctttatcacctc

SEQ ID NO: 722834 - DNA, 22 bp, Artificial Sequence
  chemically synthesized
ctcctccatctttatcacctca

SEQ ID NO: 722835 - DNA, 22 bp, Artificial Sequence
  chemically synthesized
ttgtactgtttgctgaggtgat

SEQ ID NO: 722836 - DNA, 22 bp, Artificial Sequence
  chemically synthesized
gttgtactgtttgctgaggtga

SEQ ID NO: 722837 - DNA, 22 bp, Artificial Sequence
  chemically synthesized
ctccatctttatcacctcagca

SEQ ID NO: 722838 - DNA, 22 bp, Artificial Sequence
  chemically synthesized
catctttatcacctcagcaaac

SEQ ID NO: 722839 - DNA, 22 bp, Artificial Sequence
  chemically synthesized
atcaacttgttgtactgtttgc

SEQ ID NO: 722840 - DNA, 22 bp, Artificial Sequence
  chemically synthesized
gatcaacttgttgtactgtttg

SEQ ID NO: 722841 - DNA, 22 bp, Artificial Sequence
  chemically synthesized
tatcacctcagcaaacagtaca

SEQ ID NO: 722842 - DNA, 22 bp, Artificial Sequence
  chemically synthesized
atcacctcagcaaacagtacaa

SEQ ID NO: 722843 - DNA, 22 bp, Artificial Sequence
  chemically synthesized
tcacctcagcaaacagtacaac

SEQ ID NO: 722844 - DNA, 22 bp, Artificial Sequence
  chemically synthesized
tttgatcaacttgttgtactgt

SEQ ID NO: 722845 - DNA, 22 bp, Artificial Sequence
  chemically synthesized
gtttgatcaacttgttgtactg

SEQ ID NO: 722846 - DNA, 22 bp, Artificial Sequence
  chemically synthesized
tgtttgatcaacttgttgtact

SEQ ID NO: 722847 - DNA, 22 bp, Artificial Sequence
  chemically synthesized
ttgtttgatcaacttgttgtac

SEQ ID NO: 722848 - DNA, 22 bp, Artificial Sequence
  chemically synthesized
tttgtttgatcaacttgttgta

SEQ ID NO: 722849 - DNA, 22 bp, Artificial Sequence
  chemically synthesized
ttttgtttgatcaacttgttgt

SEQ ID NO: 722850 - DNA, 22 bp, Artificial Sequence
  chemically synthesized
tttttgtttgatcaacttgttg

SEQ ID NO: 722851 - DNA, 22 bp, Artificial Sequence
  chemically synthesized
agcaaacagtacaacaagttga

SEQ ID NO: 722852 - DNA, 22 bp, Artificial Sequence
  chemically synthesized
ccaagttttttttgtttgatca

SEQ ID NO: 722853 - DNA, 22 bp, Artificial Sequence
  chemically synthesized
aggatgactcccaagttttttt

SEQ ID NO: 722854 - DNA, 22 bp, Artificial Sequence
  chemically synthesized
atcaaacaaaaaaaacttggga

SEQ ID NO: 722855 - DNA, 22 bp, Artificial Sequence
  chemically synthesized
gatgtcaggcatgagggattga

SEQ ID NO: 722856 - DNA, 22 bp, Artificial Sequence
  chemically synthesized
gggagtcatcctcaatccctca

SEQ ID NO: 722857 - DNA, 22 bp, Artificial Sequence
  chemically synthesized
ggagtcatcctcaatccctcat

SEQ ID NO: 722858 - DNA, 22 bp, Artificial Sequence
  chemically synthesized
gtgatggattagatgtcaggca

SEQ ID NO: 722859 - DNA, 22 bp, Artificial Sequence
  chemically synthesized
ggtgatggattagatgtcaggc

SEQ ID NO: 722860 - DNA, 22 bp, Artificial Sequence
  chemically synthesized
aatccctcatgcctgacatcta

SEQ ID NO: 722861 - DNA, 22 bp, Artificial Sequence
  chemically synthesized
tatgacttggtgatggattaga

SEQ ID NO: 722862 - DNA, 22 bp, Artificial Sequence
  chemically synthesized
atgcctgacatctaatccatca

SEQ ID NO: 722863 - DNA, 22 bp, Artificial Sequence
  chemically synthesized
acatctaatccatcaccaagtc

SEQ ID NO: 722864 - DNA, 22 bp, Artificial Sequence
  chemically synthesized
gagacaaaatctgtatgacttg

SEQ ID NO: 722865 - DNA, 22 bp, Artificial Sequence
  chemically synthesized
cgagacaaaatctgtatgactt

SEQ ID NO: 722866 - DNA, 22 bp, Artificial Sequence
  chemically synthesized
tcgagacaaaatctgtatgact

SEQ ID NO: 722867 - DNA, 22 bp, Artificial Sequence
  chemically synthesized
atccatcaccaagtcatacaga

SEQ ID NO: 722868 - DNA, 22 bp, Artificial Sequence
  chemically synthesized
agatgtattttcgagacaaaat

SEQ ID NO: 722869 - DNA, 22 bp, Artificial Sequence
  chemically synthesized
gagatgtattttcgagacaaaa

SEQ ID NO: 722870 - DNA, 22 bp, Artificial Sequence
  chemically synthesized
tgtctcgaaaatacatctcaaa

SEQ ID NO: 722871 - DNA, 22 bp, Artificial Sequence
  chemically synthesized
gtctcgaaaatacatctcaaat

SEQ ID NO: 722872 - DNA, 22 bp, Artificial Sequence
  chemically synthesized
tctcgaaaatacatctcaaatc

SEQ ID NO: 722873 - DNA, 22 bp, Artificial Sequence
  chemically synthesized
gaaaatacatctcaaatctgtt

SEQ ID NO: 722874 - DNA, 22 bp, Artificial Sequence
  chemically synthesized
aaatctgttcatttctctctat

SEQ ID NO: 722875 - DNA, 22 bp, Artificial Sequence
  chemically synthesized
ttcatttctctctatttccatt

SEQ ID NO: 722876 - DNA, 22 bp, Artificial Sequence
  chemically synthesized
atttctctctatttccattgcc

SEQ ID NO: 722877 - DNA, 22 bp, Artificial Sequence
  chemically synthesized
ggagtaagatggcggcaatgga

SEQ ID NO: 722878 - DNA, 22 bp, Artificial Sequence
  chemically synthesized
ctctctatttccattgccgcca

SEQ ID NO: 722879 - DNA, 22 bp, Artificial Sequence
  chemically synthesized
ctgggagtaagatggcggcaat

SEQ ID NO: 722880 - DNA, 22 bp, Artificial Sequence
  chemically synthesized
tctctatttccattgccgccat

SEQ ID NO: 722881 - DNA, 22 bp, Artificial Sequence
  chemically synthesized
tctatttccattgccgccatct

SEQ ID NO: 722882 - DNA, 22 bp, Artificial Sequence
  chemically synthesized
tatttccattgccgccatctta

SEQ ID NO: 722883 - DNA, 22 bp, Artificial Sequence
  chemically synthesized
tttccattgccgccatcttact

SEQ ID NO: 722884 - DNA, 22 bp, Artificial Sequence
  chemically synthesized
ccattgccgccatcttactccc

SEQ ID NO: 722885 - DNA, 22 bp, Artificial Sequence
  chemically synthesized
cattgccgccatcttactccca

SEQ ID NO: 722886 - DNA, 22 bp, Artificial Sequence
  chemically synthesized
ccgccatcttactcccagtagt

SEQ ID NO: 722887 - DNA, 22 bp, Artificial Sequence
  chemically synthesized
atgaaagaaaatgactactggg

SEQ ID NO: 722888 - DNA, 22 bp, Artificial Sequence
  chemically synthesized
gatgaaagaaaatgactactgg

SEQ ID NO: 722889 - DNA, 22 bp, Artificial Sequence
  chemically synthesized
tcttgatgaaagaaaatgacta

SEQ ID NO: 722890 - DNA, 22 bp, Artificial Sequence
  chemically synthesized
actcccagtagtcattttcttt

SEQ ID NO: 722891 - DNA, 22 bp, Artificial Sequence
  chemically synthesized
ctcccagtagtcattttctttc

SEQ ID NO: 722892 - DNA, 22 bp, Artificial Sequence
  chemically synthesized
cagttgtcttgatgaaagaaaa

SEQ ID NO: 722893 - DNA, 22 bp, Artificial Sequence
  chemically synthesized
gcagttgtcttgatgaaagaaa

SEQ ID NO: 722894 - DNA, 22 bp, Artificial Sequence
  chemically synthesized
ccagtagtcattttctttcatc

SEQ ID NO: 722895 - DNA, 22 bp, Artificial Sequence
  chemically synthesized
tctttcatcaagacaactgcaa

SEQ ID NO: 722896 - DNA, 22 bp, Artificial Sequence
  chemically synthesized
ctttcatcaagacaactgcaaa

SEQ ID NO: 722897 - DNA, 22 bp, Artificial Sequence
  chemically synthesized
tttcatcaagacaactgcaaat

SEQ ID NO: 722898 - DNA, 22 bp, Artificial Sequence
  chemically synthesized
tcatcaagacaactgcaaatgc

SEQ ID NO: 722899 - DNA, 22 bp, Artificial Sequence
  chemically synthesized
catcaagacaactgcaaatgcc

SEQ ID NO: 722900 - DNA, 22 bp, Artificial Sequence
  chemically synthesized
atcaagacaactgcaaatgcct

SEQ ID NO: 722901 - DNA, 22 bp, Artificial Sequence
  chemically synthesized
caaatgcctcttacctggcctc

SEQ ID NO: 722902 - DNA, 22 bp, Artificial Sequence
  chemically synthesized
ttacctggcctctttgcttcta

SEQ ID NO: 722903 - DNA, 22 bp, Artificial Sequence
  chemically synthesized
aatgtggcaagagtagaagcaa

SEQ ID NO: 722904 - DNA, 22 bp, Artificial Sequence
  chemically synthesized
acctggcctctttgcttctact

SEQ ID NO: 722905 - DNA, 22 bp, Artificial Sequence
  chemically synthesized
cctggcctctttgcttctactc

SEQ ID NO: 722906 - DNA, 22 bp, Artificial Sequence
  chemically synthesized
gcctctttgcttctactcttgc

SEQ ID NO: 722907 - DNA, 22 bp, Artificial Sequence
  chemically synthesized
tttgcttctactcttgccacat

SEQ ID NO: 722908 - DNA, 22 bp, Artificial Sequence
  chemically synthesized
tgcttctactcttgccacattc

SEQ ID NO: 722909 - DNA, 22 bp, Artificial Sequence
  chemically synthesized
gcttctactcttgccacattca

SEQ ID NO: 722910 - DNA, 22 bp, Artificial Sequence
  chemically synthesized
cttctactcttgccacattcaa

SEQ ID NO: 722911 - DNA, 22 bp, Artificial Sequence
  chemically synthesized
tataaatgagagattgaatgtg

SEQ ID NO: 722912 - DNA, 22 bp, Artificial Sequence
  chemically synthesized
ctactcttgccacattcaatct

SEQ ID NO: 722913 - DNA, 22 bp, Artificial Sequence
  chemically synthesized
tactcttgccacattcaatctc

SEQ ID NO: 722914 - DNA, 22 bp, Artificial Sequence
  chemically synthesized
ctgtataaatgagagattgaat

SEQ ID NO: 722915 - DNA, 22 bp, Artificial Sequence
  chemically synthesized
ctcttgccacattcaatctctc

SEQ ID NO: 722916 - DNA, 22 bp, Artificial Sequence
  chemically synthesized
ttgccacattcaatctctcatt

SEQ ID NO: 722917 - DNA, 22 bp, Artificial Sequence
  chemically synthesized
gccacattcaatctctcattta

SEQ ID NO: 722918 - DNA, 22 bp, Artificial Sequence
  chemically synthesized
ccacattcaatctctcatttat

SEQ ID NO: 722919 - DNA, 22 bp, Artificial Sequence
  chemically synthesized
atggacctgctgtataaatgag

SEQ ID NO: 722920 - DNA, 22 bp, Artificial Sequence
  chemically synthesized
aatctctcatttatacagcagg

SEQ ID NO: 722921 - DNA, 22 bp, Artificial Sequence
  chemically synthesized
tcatttatacagcaggtccatc

SEQ ID NO: 722922 - DNA, 22 bp, Artificial Sequence
  chemically synthesized
atttatacagcaggtccatcag

SEQ ID NO: 722923 - DNA, 22 bp, Artificial Sequence
  chemically synthesized
atacagcaggtccatcagattg

SEQ ID NO: 722924 - DNA, 22 bp, Artificial Sequence
  chemically synthesized
caaaacatcatacaatctgatg

SEQ ID NO: 722925 - DNA, 22 bp, Artificial Sequence
  chemically synthesized
tacagcaggtccatcagattgt

SEQ ID NO: 722926 - DNA, 22 bp, Artificial Sequence
  chemically synthesized
atgtacctgcaaaacatcatac

SEQ ID NO: 722927 - DNA, 22 bp, Artificial Sequence
  chemically synthesized
agctgatgtacctgcaaaacat

SEQ ID NO: 722928 - DNA, 22 bp, Artificial Sequence
  chemically synthesized
tatgatgttttgcaggtacatc

SEQ ID NO: 722929 - DNA, 22 bp, Artificial Sequence
  chemically synthesized
tgaaagtacacctgagctgatg

SEQ ID NO: 722930 - DNA, 22 bp, Artificial Sequence
  chemically synthesized
tgcaggtacatcagctcaggtg

SEQ ID NO: 722931 - DNA, 22 bp, Artificial Sequence
  chemically synthesized
gcaggtacatcagctcaggtgt

SEQ ID NO: 722932 - DNA, 22 bp, Artificial Sequence
  chemically synthesized
caggtacatcagctcaggtgta

SEQ ID NO: 722933 - DNA, 22 bp, Artificial Sequence
  chemically synthesized
acgtacctgtgaaagtacacct

SEQ ID NO: 722934 - DNA, 22 bp, Artificial Sequence
  chemically synthesized
aggtgtactttcacaggtacgt

SEQ ID NO: 722935 - DNA, 22 bp, Artificial Sequence
  chemically synthesized
tcacaggtacgtcagattatat

SEQ ID NO: 722936 - DNA, 22 bp, Artificial Sequence
  chemically synthesized
cacaggtacgtcagattatatt

SEQ ID NO: 722937 - DNA, 22 bp, Artificial Sequence
  chemically synthesized
acaggtacgtcagattatatta

SEQ ID NO: 722938 - DNA, 22 bp, Artificial Sequence
  chemically synthesized
tgggtaagcagagaaataatat

SEQ ID NO: 722939 - DNA, 22 bp, Artificial Sequence
  chemically synthesized
atgggtaagcagagaaataata

SEQ ID NO: 722940 - DNA, 22 bp, Artificial Sequence
  chemically synthesized
tatgggtaagcagagaaataat

SEQ ID NO: 722941 - DNA, 22 bp, Artificial Sequence
  chemically synthesized
ttttatgggtaagcagagaaat

SEQ ID NO: 722942 - DNA, 22 bp, Artificial Sequence
  chemically synthesized
attttatgggtaagcagagaaa

SEQ ID NO: 722943 - DNA, 22 bp, Artificial Sequence
  chemically synthesized
tattatttctctgcttacccat

SEQ ID NO: 722944 - DNA, 22 bp, Artificial Sequence
  chemically synthesized
gagagtttattttatgggtaag

SEQ ID NO: 722945 - DNA, 22 bp, Artificial Sequence
  chemically synthesized
tttctctgcttacccataaaat

SEQ ID NO: 722946 - DNA, 22 bp, Artificial Sequence
  chemically synthesized
ctctgcttacccataaaataaa

SEQ ID NO: 722947 - DNA, 22 bp, Artificial Sequence
  chemically synthesized
tctgcttacccataaaataaac

SEQ ID NO: 722948 - DNA, 22 bp, Artificial Sequence
  chemically synthesized
tgcttacccataaaataaactc

SEQ ID NO: 722949 - DNA, 22 bp, Artificial Sequence
  chemically synthesized
cttacccataaaataaactctc

SEQ ID NO: 722950 - DNA, 22 bp, Artificial Sequence
  chemically synthesized
acccataaaataaactctccag

SEQ ID NO: 722951 - DNA, 22 bp, Artificial Sequence
  chemically synthesized
cccataaaataaactctccagc

SEQ ID NO: 722952 - DNA, 22 bp, Artificial Sequence
  chemically synthesized
agggggtgagtggtacaggaca

SEQ ID NO: 722953 - DNA, 22 bp, Artificial Sequence
  chemically synthesized
tccagccttgtcctgtaccact

SEQ ID NO: 722954 - DNA, 22 bp, Artificial Sequence
  chemically synthesized
cagccttgtcctgtaccactca

SEQ ID NO: 722955 - DNA, 22 bp, Artificial Sequence
  chemically synthesized
atgactgagggggtgagtggta

SEQ ID NO: 722956 - DNA, 22 bp, Artificial Sequence
  chemically synthesized
gtcctgtaccactcaccccctc

SEQ ID NO: 722957 - DNA, 22 bp, Artificial Sequence
  chemically synthesized
tcctgtaccactcaccccctca

SEQ ID NO: 722958 - DNA, 22 bp, Artificial Sequence
  chemically synthesized
ggagctaatgactgagggggtg

SEQ ID NO: 722959 - DNA, 22 bp, Artificial Sequence
  chemically synthesized
taccactcaccccctcagtcat

SEQ ID NO: 722960 - DNA, 22 bp, Artificial Sequence
  chemically synthesized
accccctcagtcattagctcct

SEQ ID NO: 722961 - DNA, 22 bp, Artificial Sequence
  chemically synthesized
aaaggaggcaagtatggctagg

SEQ ID NO: 722962 - DNA, 22 bp, Artificial Sequence
  chemically synthesized
agtcattagctcctagccatac

SEQ ID NO: 722963 - DNA, 22 bp, Artificial Sequence
  chemically synthesized
gctcctagccatacttgcctcc

SEQ ID NO: 722964 - DNA, 22 bp, Artificial Sequence
  chemically synthesized
ctagccatacttgcctcctttt

SEQ ID NO: 722965 - DNA, 22 bp, Artificial Sequence
  chemically synthesized
aagacaatgacctaaaaggagg

SEQ ID NO: 722966 - DNA, 22 bp, Artificial Sequence
  chemically synthesized
caagacaatgacctaaaaggag

SEQ ID NO: 722967 - DNA, 22 bp, Artificial Sequence
  chemically synthesized
gccatacttgcctccttttagg

SEQ ID NO: 722968 - DNA, 22 bp, Artificial Sequence
  chemically synthesized
tcaagacaatgacctaaaagga

SEQ ID NO: 722969 - DNA, 22 bp, Artificial Sequence
  chemically synthesized
gcctccttttaggtcattgtct

SEQ ID NO: 722970 - DNA, 22 bp, Artificial Sequence
  chemically synthesized
cctccttttaggtcattgtctt

SEQ ID NO: 722971 - DNA, 22 bp, Artificial Sequence
  chemically synthesized
cttttaggtcattgtcttgaaa

SEQ ID NO: 722972 - DNA, 22 bp, Artificial Sequence
  chemically synthesized
ttaggtcattgtcttgaaaata

SEQ ID NO: 722973 - DNA, 22 bp, Artificial Sequence
  chemically synthesized
taggtcattgtcttgaaaatat

SEQ ID NO: 722974 - DNA, 22 bp, Artificial Sequence
  chemically synthesized
aggtcattgtcttgaaaatatt

SEQ ID NO: 722975 - DNA, 22 bp, Artificial Sequence
  chemically synthesized
ggtcattgtcttgaaaatatta

SEQ ID NO: 722976 - DNA, 22 bp, Artificial Sequence
  chemically synthesized
tcttgaaaatattattccattc

SEQ ID NO: 722977 - DNA, 22 bp, Artificial Sequence
  chemically synthesized
gaaaatattattccattcccct

SEQ ID NO: 722978 - DNA, 22 bp, Artificial Sequence
  chemically synthesized
aaaatattattccattcccctc

SEQ ID NO: 722979 - DNA, 22 bp, Artificial Sequence
  chemically synthesized
ggtcagtcatatgaacagggag

SEQ ID NO: 722980 - DNA, 22 bp, Artificial Sequence
  chemically synthesized
ttccattcccctccctgttcat

SEQ ID NO: 722981 - DNA, 22 bp, Artificial Sequence
  chemically synthesized
cattcccctccctgttcatatg

SEQ ID NO: 722982 - DNA, 22 bp, Artificial Sequence
  chemically synthesized
aaggttaggtcagtcatatgaa

SEQ ID NO: 722983 - DNA, 22 bp, Artificial Sequence
  chemically synthesized
ccctccctgttcatatgactga

SEQ ID NO: 722984 - DNA, 22 bp, Artificial Sequence
  chemically synthesized
aaatctgaaggttaggtcagtc

SEQ ID NO: 722985 - DNA, 22 bp, Artificial Sequence
  chemically synthesized
cctgttcatatgactgacctaa

SEQ ID NO: 722986 - DNA, 22 bp, Artificial Sequence
  chemically synthesized
ttcatatgactgacctaacctt

SEQ ID NO: 722987 - DNA, 22 bp, Artificial Sequence
  chemically synthesized
agctaaaatctgaaggttaggt

SEQ ID NO: 722988 - DNA, 22 bp, Artificial Sequence
  chemically synthesized
aagctaaaatctgaaggttagg

SEQ ID NO: 722989 - DNA, 22 bp, Artificial Sequence
  chemically synthesized
atatgactgacctaaccttcag

SEQ ID NO: 722990 - DNA, 22 bp, Artificial Sequence
  chemically synthesized
acctaaccttcagattttagct

SEQ ID NO: 722991 - DNA, 22 bp, Artificial Sequence
  chemically synthesized
aaaaggatatatttaagctaaa

SEQ ID NO: 722992 - DNA, 22 bp, Artificial Sequence
  chemically synthesized
accttcagattttagcttaaat

SEQ ID NO: 722993 - DNA, 22 bp, Artificial Sequence
  chemically synthesized
tgaaaaggatatatttaagcta

SEQ ID NO: 722994 - DNA, 22 bp, Artificial Sequence
  chemically synthesized
tctgaaaaggatatatttaagc

SEQ ID NO: 722995 - DNA, 22 bp, Artificial Sequence
  chemically synthesized
cagattttagcttaaatatatc

SEQ ID NO: 722996 - DNA, 22 bp, Artificial Sequence
  chemically synthesized
agattttagcttaaatatatcc

SEQ ID NO: 722997 - DNA, 22 bp, Artificial Sequence
  chemically synthesized
tagcttaaatatatccttttca

SEQ ID NO: 722998 - DNA, 22 bp, Artificial Sequence
  chemically synthesized
ggaaggcctctctgaaaaggat

SEQ ID NO: 722999 - DNA, 22 bp, Artificial Sequence
  chemically synthesized
agcttaaatatatccttttcag

SEQ ID NO: 723000 - DNA, 22 bp, Artificial Sequence
  chemically synthesized
gcttaaatatatccttttcaga

SEQ ID NO: 723001 - DNA, 22 bp, Artificial Sequence
  chemically synthesized
aaatatatccttttcagagagg

SEQ ID NO: 723002 - DNA, 22 bp, Artificial Sequence
  chemically synthesized
aatatatccttttcagagaggc

SEQ ID NO: 723003 - DNA, 22 bp, Artificial Sequence
  chemically synthesized
atagtctaggaaggcctctctg

SEQ ID NO: 723004 - DNA, 22 bp, Artificial Sequence
  chemically synthesized
catagtctaggaaggcctctct

SEQ ID NO: 723005 - DNA, 22 bp, Artificial Sequence
  chemically synthesized
ttcatagtctaggaaggcctct

SEQ ID NO: 723006 - DNA, 22 bp, Artificial Sequence
  chemically synthesized
cttcatagtctaggaaggcctc

SEQ ID NO: 723007 - DNA, 22 bp, Artificial Sequence
  chemically synthesized
ttcagagaggccttcctagact

SEQ ID NO: 723008 - DNA, 22 bp, Artificial Sequence
  chemically synthesized
tcagagaggccttcctagacta

SEQ ID NO: 723009 - DNA, 22 bp, Artificial Sequence
  chemically synthesized
cagagaggccttcctagactat

SEQ ID NO: 723010 - DNA, 22 bp, Artificial Sequence
  chemically synthesized
agagaggccttcctagactatg

SEQ ID NO: 723011 - DNA, 22 bp, Artificial Sequence
  chemically synthesized
cctagactatgaagaagttccc

SEQ ID NO: 723012 - DNA, 22 bp, Artificial Sequence
  chemically synthesized
ctagactatgaagaagttccca

SEQ ID NO: 723013 - DNA, 22 bp, Artificial Sequence
  chemically synthesized
gaagaataatagtgggaacttc

SEQ ID NO: 723014 - DNA, 22 bp, Artificial Sequence
  chemically synthesized
ggaagaataatagtgggaactt

SEQ ID NO: 723015 - DNA, 22 bp, Artificial Sequence
  chemically synthesized
tggaagaataatagtgggaact

SEQ ID NO: 723016 - DNA, 22 bp, Artificial Sequence
  chemically synthesized
gactatgaagaagttcccacta

SEQ ID NO: 723017 - DNA, 22 bp, Artificial Sequence
  chemically synthesized
ctttggaagaataatagtggga

SEQ ID NO: 723018 - DNA, 22 bp, Artificial Sequence
  chemically synthesized
tgaagaagttcccactattatt

SEQ ID NO: 723019 - DNA, 22 bp, Artificial Sequence
  chemically synthesized
ccactattattcttccaaagta

SEQ ID NO: 723020 - DNA, 22 bp, Artificial Sequence
  chemically synthesized
ttattcttccaaagtagcctat

SEQ ID NO: 723021 - DNA, 22 bp, Artificial Sequence
  chemically synthesized
tgaagacaaagaataggctact

SEQ ID NO: 723022 - DNA, 22 bp, Artificial Sequence
  chemically synthesized
ttcttccaaagtagcctattct

SEQ ID NO: 723023 - DNA, 22 bp, Artificial Sequence
  chemically synthesized
ttccaaagtagcctattctttg

SEQ ID NO: 723024 - DNA, 22 bp, Artificial Sequence
  chemically synthesized
ccaaagtagcctattctttgtc

SEQ ID NO: 723025 - DNA, 22 bp, Artificial Sequence
  chemically synthesized
caaagtagcctattctttgtct

SEQ ID NO: 723026 - DNA, 22 bp, Artificial Sequence
  chemically synthesized
ttctttgtcttcataacatttc

SEQ ID NO: 723027 - DNA, 22 bp, Artificial Sequence
  chemically synthesized
tttgtcttcataacatttctca

SEQ ID NO: 723028 - DNA, 22 bp, Artificial Sequence
  chemically synthesized
tgtcttcataacatttctcact

SEQ ID NO: 723029 - DNA, 22 bp, Artificial Sequence
  chemically synthesized
gtcttcataacatttctcacta

SEQ ID NO: 723030 - DNA, 22 bp, Artificial Sequence
  chemically synthesized
tcttcataacatttctcactat

SEQ ID NO: 723031 - DNA, 22 bp, Artificial Sequence
  chemically synthesized
cataacatttctcactattttt

SEQ ID NO: 723032 - DNA, 22 bp, Artificial Sequence
  chemically synthesized
ataacatttctcactatttttc

SEQ ID NO: 723033 - DNA, 22 bp, Artificial Sequence
  chemically synthesized
ctcactatttttctttttattt

SEQ ID NO: 723034 - DNA, 22 bp, Artificial Sequence
  chemically synthesized
tcactatttttctttttatttt

SEQ ID NO: 723035 - DNA, 22 bp, Artificial Sequence
  chemically synthesized
actatttttctttttattttat

SEQ ID NO: 723036 - DNA, 22 bp, Artificial Sequence
  chemically synthesized
aaaaaaataaaaataaaataaa

SEQ ID NO: 723037 - DNA, 22 bp, Artificial Sequence
  chemically synthesized
tttttctttttattttattttt

SEQ ID NO: 723038 - DNA, 22 bp, Artificial Sequence
  chemically synthesized
tctcaaaaaaataaaaataaaa

SEQ ID NO: 723039 - DNA, 22 bp, Artificial Sequence
  chemically synthesized
tgtctcaaaaaaataaaaataa

SEQ ID NO: 723040 - DNA, 22 bp, Artificial Sequence
  chemically synthesized
ttctttttattttatttttatt

SEQ ID NO: 723041 - DNA, 22 bp, Artificial Sequence
  chemically synthesized
tctttttattttatttttattt

SEQ ID NO: 723042 - DNA, 22 bp, Artificial Sequence
  chemically synthesized
ctttttattttatttttatttt

SEQ ID NO: 723043 - DNA, 22 bp, Artificial Sequence
  chemically synthesized
tttttattttatttttattttt

SEQ ID NO: 723044 - DNA, 22 bp, Artificial Sequence
  chemically synthesized
tttattttatttttattttttt

SEQ ID NO: 723045 - DNA, 22 bp, Artificial Sequence
  chemically synthesized
ttattttatttttatttttttg

SEQ ID NO: 723046 - DNA, 22 bp, Artificial Sequence
  chemically synthesized
tattttatttttatttttttga

SEQ ID NO: 723047 - DNA, 22 bp, Artificial Sequence
  chemically synthesized
attttatttttatttttttgag

SEQ ID NO: 723048 - DNA, 22 bp, Artificial Sequence
  chemically synthesized
ttttatttttatttttttgaga

SEQ ID NO: 723049 - DNA, 22 bp, Artificial Sequence
  chemically synthesized
tatttttatttttttgagacag

SEQ ID NO: 723050 - DNA, 22 bp, Artificial Sequence
  chemically synthesized
atttttatttttttgagacaga

SEQ ID NO: 723051 - DNA, 22 bp, Artificial Sequence
  chemically synthesized
tttttatttttttgagacagag

SEQ ID NO: 723052 - DNA, 22 bp, Artificial Sequence
  chemically synthesized
ttatttttttgagacagagtct

SEQ ID NO: 723053 - DNA, 22 bp, Artificial Sequence
  chemically synthesized
ggtgatagggcaagactctgtc

SEQ ID NO: 723054 - DNA, 22 bp, Artificial Sequence
  chemically synthesized
tatttttttgagacagagtctt

SEQ ID NO: 723055 - DNA, 22 bp, Artificial Sequence
  chemically synthesized
atttttttgagacagagtcttg

SEQ ID NO: 723056 - DNA, 22 bp, Artificial Sequence
  chemically synthesized
tttttttgagacagagtcttgc

SEQ ID NO: 723057 - DNA, 22 bp, Artificial Sequence
  chemically synthesized
ttttgagacagagtcttgccct

SEQ ID NO: 723058 - DNA, 22 bp, Artificial Sequence
  chemically synthesized
tttgagacagagtcttgcccta

SEQ ID NO: 723059 - DNA, 22 bp, Artificial Sequence
  chemically synthesized
cagcctgggtgatagggcaaga

SEQ ID NO: 723060 - DNA, 22 bp, Artificial Sequence
  chemically synthesized
ttgagacagagtcttgccctat

SEQ ID NO: 723061 - DNA, 22 bp, Artificial Sequence
  chemically synthesized
tgagacagagtcttgccctatc

SEQ ID NO: 723062 - DNA, 22 bp, Artificial Sequence
  chemically synthesized
gagacagagtcttgccctatca

SEQ ID NO: 723063 - DNA, 22 bp, Artificial Sequence
  chemically synthesized
agacagagtcttgccctatcac

SEQ ID NO: 723064 - DNA, 22 bp, Artificial Sequence
  chemically synthesized
tgctccagcctgggtgataggg

SEQ ID NO: 723065 - DNA, 22 bp, Artificial Sequence
  chemically synthesized
gccctatcacccaggctggagc

SEQ ID NO: 723066 - DNA, 22 bp, Artificial Sequence
  chemically synthesized
ccctatcacccaggctggagca

SEQ ID NO: 723067 - DNA, 22 bp, Artificial Sequence
  chemically synthesized
tcacccaggctggagcacagtg

SEQ ID NO: 723068 - DNA, 22 bp, Artificial Sequence
  chemically synthesized
cagtgagccgagatcacgtcac

SEQ ID NO: 723069 - DNA, 22 bp, Artificial Sequence
  chemically synthesized
gagcacagtgacgtgatctcgg

SEQ ID NO: 723070 - DNA, 22 bp, Artificial Sequence
  chemically synthesized
gaacccaagaggcggaggttgc

SEQ ID NO: 723071 - DNA, 22 bp, Artificial Sequence
  chemically synthesized
ctggaacccaagaggcggaggt

SEQ ID NO: 723072 - DNA, 22 bp, Artificial Sequence
  chemically synthesized
ggctcactgcaacctccgcctc

SEQ ID NO: 723073 - DNA, 22 bp, Artificial Sequence
  chemically synthesized
actgcaacctccgcctcttggg

SEQ ID NO: 723074 - DNA, 22 bp, Artificial Sequence
  chemically synthesized
caacctccgcctcttgggttcc

SEQ ID NO: 723075 - DNA, 22 bp, Artificial Sequence
  chemically synthesized
aggccggagaattgctggaacc

SEQ ID NO: 723076 - DNA, 22 bp, Artificial Sequence
  chemically synthesized
cgcctcttgggttccagcaatt

SEQ ID NO: 723077 - DNA, 22 bp, Artificial Sequence
  chemically synthesized
agaggctgaggccggagaattg

SEQ ID NO: 723078 - DNA, 22 bp, Artificial Sequence
  chemically synthesized
ttgggttccagcaattctccgg

SEQ ID NO: 723079 - DNA, 22 bp, Artificial Sequence
  chemically synthesized
aagaggctgaggccggagaatt

SEQ ID NO: 723080 - DNA, 22 bp, Artificial Sequence
  chemically synthesized
gggttccagcaattctccggcc

SEQ ID NO: 723081 - DNA, 22 bp, Artificial Sequence
  chemically synthesized
ggttccagcaattctccggcct

SEQ ID NO: 723082 - DNA, 22 bp, Artificial Sequence
  chemically synthesized
cttaagaggctgaggccggaga

SEQ ID NO: 723083 - DNA, 22 bp, Artificial Sequence
  chemically synthesized
cagcaattctccggcctcagcc

SEQ ID NO: 723084 - DNA, 22 bp, Artificial Sequence
  chemically synthesized
cagctacttaagaggctgaggc

SEQ ID NO: 723085 - DNA, 22 bp, Artificial Sequence
  chemically synthesized
ccagctacttaagaggctgagg

SEQ ID NO: 723086 - DNA, 22 bp, Artificial Sequence
  chemically synthesized
tacttccagctacttaagaggc

SEQ ID NO: 723087 - DNA, 22 bp, Artificial Sequence
  chemically synthesized
tccggcctcagcctcttaagta

SEQ ID NO: 723088 - DNA, 22 bp, Artificial Sequence
  chemically synthesized
cggcctcagcctcttaagtagc

SEQ ID NO: 723089 - DNA, 22 bp, Artificial Sequence
  chemically synthesized
tctgtacttccagctacttaag

SEQ ID NO: 723090 - DNA, 22 bp, Artificial Sequence
  chemically synthesized
agcctcttaagtagctggaagt

SEQ ID NO: 723091 - DNA, 22 bp, Artificial Sequence
  chemically synthesized
ttaagtagctggaagtacagac

SEQ ID NO: 723092 - DNA, 22 bp, Artificial Sequence
  chemically synthesized
aagtagctggaagtacagacag

SEQ ID NO: 723093 - DNA, 22 bp, Artificial Sequence
  chemically synthesized
agtagctggaagtacagacagg

SEQ ID NO: 723094 - DNA, 22 bp, Artificial Sequence
  chemically synthesized
accaacatggtgaaaccctgtc

SEQ ID NO: 723095 - DNA, 22 bp, Artificial Sequence
  chemically synthesized
gaagtacagacagggtttcacc

SEQ ID NO: 723096 - DNA, 22 bp, Artificial Sequence
  chemically synthesized
aagaccagcctgaccaacatgg

SEQ ID NO: 723097 - DNA, 22 bp, Artificial Sequence
  chemically synthesized
caccatgttggtcaggctggtc

SEQ ID NO: 723098 - DNA, 22 bp, Artificial Sequence
  chemically synthesized
accatgttggtcaggctggtct

SEQ ID NO: 723099 - DNA, 22 bp, Artificial Sequence
  chemically synthesized
aggtcaggagttcaagaccagc

SEQ ID NO: 723100 - DNA, 22 bp, Artificial Sequence
  chemically synthesized
gaggtcaggagttcaagaccag

SEQ ID NO: 723101 - DNA, 22 bp, Artificial Sequence
  chemically synthesized
gtcaggctggtcttgaactcct

SEQ ID NO: 723102 - DNA, 22 bp, Artificial Sequence
  chemically synthesized
gtcttgaactcctgacctcaag

SEQ ID NO: 723103 - DNA, 22 bp, Artificial Sequence
  chemically synthesized
gaactcctgacctcaagtgatc

SEQ ID NO: 723104 - DNA, 22 bp, Artificial Sequence
  chemically synthesized
aactcctgacctcaagtgatcc

SEQ ID NO: 723105 - DNA, 22 bp, Artificial Sequence
  chemically synthesized
ggaccccgaggcgggcggatca

SEQ ID NO: 723106 - DNA, 22 bp, Artificial Sequence
  chemically synthesized
ctgacctcaagtgatccgcccg

SEQ ID NO: 723107 - DNA, 22 bp, Artificial Sequence
  chemically synthesized
gggaccccgaggcgggcggatc

SEQ ID NO: 723108 - DNA, 22 bp, Artificial Sequence
  chemically synthesized
tgggaccccgaggcgggcggat

SEQ ID NO: 723109 - DNA, 22 bp, Artificial Sequence
  chemically synthesized
acctcaagtgatccgcccgcct

SEQ ID NO: 723110 - DNA, 22 bp, Artificial Sequence
  chemically synthesized
aagtgatccgcccgcctcgggg

SEQ ID NO: 723111 - DNA, 22 bp, Artificial Sequence
  chemically synthesized
taatcccagcactttgggaccc

SEQ ID NO: 723112 - DNA, 22 bp, Artificial Sequence
  chemically synthesized
atgcctgtaatcccagcacttt

SEQ ID NO: 723113 - DNA, 22 bp, Artificial Sequence
  chemically synthesized
ggggtcccaaagtgctgggatt

SEQ ID NO: 723114 - DNA, 22 bp, Artificial Sequence
  chemically synthesized
caggcgcagtggctcatgcctg

SEQ ID NO: 723115 - DNA, 22 bp, Artificial Sequence
  chemically synthesized
ggattacaggcatgagccactg

SEQ ID NO: 723116 - DNA, 22 bp, Artificial Sequence
  chemically synthesized
caggcatgagccactgcgcctg

SEQ ID NO: 723117 - DNA, 22 bp, Artificial Sequence
  chemically synthesized
aaaatagtgagaaatgctccag

SEQ ID NO: 723118 - DNA, 22 bp, Artificial Sequence
  chemically synthesized
ttaaaaatagtgagaaatgctc

SEQ ID NO: 723119 - DNA, 22 bp, Artificial Sequence
  chemically synthesized
cgcctggagcatttctcactat

SEQ ID NO: 723120 - DNA, 22 bp, Artificial Sequence
  chemically synthesized
atatattattaaaaatagtgag

SEQ ID NO: 723121 - DNA, 22 bp, Artificial Sequence
  chemically synthesized
gagcatttctcactatttttaa

SEQ ID NO: 723122 - DNA, 22 bp, Artificial Sequence
  chemically synthesized
gcattaatatattattaaaaat

SEQ ID NO: 723123 - DNA, 22 bp, Artificial Sequence
  chemically synthesized
ctcactatttttaataatatat

SEQ ID NO: 723124 - DNA, 22 bp, Artificial Sequence
  chemically synthesized
tcactatttttaataatatatt

SEQ ID NO: 723125 - DNA, 22 bp, Artificial Sequence
  chemically synthesized
actatttttaataatatattaa

SEQ ID NO: 723126 - DNA, 22 bp, Artificial Sequence
  chemically synthesized
tttttaataatatattaatgct

SEQ ID NO: 723127 - DNA, 22 bp, Artificial Sequence
  chemically synthesized
ttaataatatattaatgctaac

SEQ ID NO: 723128 - DNA, 22 bp, Artificial Sequence
  chemically synthesized
taataatatattaatgctaaca

SEQ ID NO: 723129 - DNA, 22 bp, Artificial Sequence
  chemically synthesized
aataatatattaatgctaacat

SEQ ID NO: 723130 - DNA, 22 bp, Artificial Sequence
  chemically synthesized
ataatatattaatgctaacatt

SEQ ID NO: 723131 - DNA, 22 bp, Artificial Sequence
  chemically synthesized
atgctaacatttttactggcta

SEQ ID NO: 723132 - DNA, 22 bp, Artificial Sequence
  chemically synthesized
caagacagtgagacaaatagcc

SEQ ID NO: 723133 - DNA, 22 bp, Artificial Sequence
  chemically synthesized
acatttttactggctatttgtc

SEQ ID NO: 723134 - DNA, 22 bp, Artificial Sequence
  chemically synthesized
gcaagacagtgagacaaatagc

SEQ ID NO: 723135 - DNA, 22 bp, Artificial Sequence
  chemically synthesized
ttactggctatttgtctcactg

SEQ ID NO: 723136 - DNA, 22 bp, Artificial Sequence
  chemically synthesized
tactggctatttgtctcactgt

SEQ ID NO: 723137 - DNA, 22 bp, Artificial Sequence
  chemically synthesized
actggctatttgtctcactgtc

SEQ ID NO: 723138 - DNA, 22 bp, Artificial Sequence
  chemically synthesized
ctggctatttgtctcactgtct

SEQ ID NO: 723139 - DNA, 22 bp, Artificial Sequence
  chemically synthesized
gctatttgtctcactgtcttgc

SEQ ID NO: 723140 - DNA, 22 bp, Artificial Sequence
  chemically synthesized
tttgtctcactgtcttgcaaat

SEQ ID NO: 723141 - DNA, 22 bp, Artificial Sequence
  chemically synthesized
gacgtgccaaggaatttgcaag

SEQ ID NO: 723142 - DNA, 22 bp, Artificial Sequence
  chemically synthesized
ggacgtgccaaggaatttgcaa

SEQ ID NO: 723143 - DNA, 22 bp, Artificial Sequence
  chemically synthesized
gtctcactgtcttgcaaattcc

SEQ ID NO: 723144 - DNA, 22 bp, Artificial Sequence
  chemically synthesized
tggacgtgccaaggaatttgca

SEQ ID NO: 723145 - DNA, 22 bp, Artificial Sequence
  chemically synthesized
tctcactgtcttgcaaattcct

SEQ ID NO: 723146 - DNA, 22 bp, Artificial Sequence
  chemically synthesized
ttggacgtgccaaggaatttgc

SEQ ID NO: 723147 - DNA, 22 bp, Artificial Sequence
  chemically synthesized
actgtcttgcaaattccttggc

SEQ ID NO: 723148 - DNA, 22 bp, Artificial Sequence
  chemically synthesized
tcttgcaaattccttggcacgt

SEQ ID NO: 723149 - DNA, 22 bp, Artificial Sequence
  chemically synthesized
gcaaattccttggcacgtccaa

SEQ ID NO: 723150 - DNA, 22 bp, Artificial Sequence
  chemically synthesized
caaattccttggcacgtccaaa

SEQ ID NO: 723151 - DNA, 22 bp, Artificial Sequence
  chemically synthesized
cttggcacgtccaaaaatattt

SEQ ID NO: 723152 - DNA, 22 bp, Artificial Sequence
  chemically synthesized
ggcacgtccaaaaatatttctt

SEQ ID NO: 723153 - DNA, 22 bp, Artificial Sequence
  chemically synthesized
gcacaaaataggaagaaatatt

SEQ ID NO: 723154 - DNA, 22 bp, Artificial Sequence
  chemically synthesized
gcacgtccaaaaatatttcttc

SEQ ID NO: 723155 - DNA, 22 bp, Artificial Sequence
  chemically synthesized
tctggcacaaaataggaagaaa

SEQ ID NO: 723156 - DNA, 22 bp, Artificial Sequence
  chemically synthesized
cttcctattttgtgccagacaa

SEQ ID NO: 723157 - DNA, 22 bp, Artificial Sequence
  chemically synthesized
ttcctattttgtgccagacaat

SEQ ID NO: 723158 - DNA, 22 bp, Artificial Sequence
  chemically synthesized
cctattttgtgccagacaatat

SEQ ID NO: 723159 - DNA, 22 bp, Artificial Sequence
  chemically synthesized
ctattttgtgccagacaatatg

SEQ ID NO: 723160 - DNA, 22 bp, Artificial Sequence
  chemically synthesized
ttttgtgccagacaatatgccg

SEQ ID NO: 723161 - DNA, 22 bp, Artificial Sequence
  chemically synthesized
atagtccaaacacccggcatat

SEQ ID NO: 723162 - DNA, 22 bp, Artificial Sequence
  chemically synthesized
tgtgccagacaatatgccgggt

SEQ ID NO: 723163 - DNA, 22 bp, Artificial Sequence
  chemically synthesized
catagtccaaacacccggcata

SEQ ID NO: 723164 - DNA, 22 bp, Artificial Sequence
  chemically synthesized
gtgccagacaatatgccgggtg

SEQ ID NO: 723165 - DNA, 22 bp, Artificial Sequence
  chemically synthesized
tgccagacaatatgccgggtgt

SEQ ID NO: 723166 - DNA, 22 bp, Artificial Sequence
  chemically synthesized
taaatcttcatagtccaaacac

SEQ ID NO: 723167 - DNA, 22 bp, Artificial Sequence
  chemically synthesized
attataaatcttcatagtccaa

SEQ ID NO: 723168 - DNA, 22 bp, Artificial Sequence
  chemically synthesized
cattataaatcttcatagtcca

SEQ ID NO: 723169 - DNA, 22 bp, Artificial Sequence
  chemically synthesized
tcattataaatcttcatagtcc

SEQ ID NO: 723170 - DNA, 22 bp, Artificial Sequence
  chemically synthesized
aaggacctttcattataaatct

SEQ ID NO: 723171 - DNA, 22 bp, Artificial Sequence
  chemically synthesized
ggactatgaagatttataatga

SEQ ID NO: 723172 - DNA, 22 bp, Artificial Sequence
  chemically synthesized
gactatgaagatttataatgaa

SEQ ID NO: 723173 - DNA, 22 bp, Artificial Sequence
  chemically synthesized
gttcaaggacctttcattataa

SEQ ID NO: 723174 - DNA, 22 bp, Artificial Sequence
  chemically synthesized
agttcaaggacctttcattata

SEQ ID NO: 723175 - DNA, 22 bp, Artificial Sequence
  chemically synthesized
tagttcaaggacctttcattat

SEQ ID NO: 723176 - DNA, 22 bp, Artificial Sequence
  chemically synthesized
ttagttcaaggacctttcatta

SEQ ID NO: 723177 - DNA, 22 bp, Artificial Sequence
  chemically synthesized
tgaagatttataatgaaaggtc

SEQ ID NO: 723178 - DNA, 22 bp, Artificial Sequence
  chemically synthesized
ataatgaaaggtccttgaacta

SEQ ID NO: 723179 - DNA, 22 bp, Artificial Sequence
  chemically synthesized
taatgaaaggtccttgaactaa

SEQ ID NO: 723180 - DNA, 22 bp, Artificial Sequence
  chemically synthesized
gaactaaaaggctacacattgg

SEQ ID NO: 723181 - DNA, 22 bp, Artificial Sequence
  chemically synthesized
aactaaaaggctacacattggc

SEQ ID NO: 723182 - DNA, 22 bp, Artificial Sequence
  chemically synthesized
aaaggctacacattggctgggt

SEQ ID NO: 723183 - DNA, 22 bp, Artificial Sequence
  chemically synthesized
caggtgtgagtcaccgcaccca

SEQ ID NO: 723184 - DNA, 22 bp, Artificial Sequence
  chemically synthesized
cacattggctgggtgcggtgac

SEQ ID NO: 723185 - DNA, 22 bp, Artificial Sequence
  chemically synthesized
ggattacaggtgtgagtcaccg

SEQ ID NO: 723186 - DNA, 22 bp, Artificial Sequence
  chemically synthesized
gctgggtgcggtgactcacacc

SEQ ID NO: 723187 - DNA, 22 bp, Artificial Sequence
  chemically synthesized
ggtgcggtgactcacacctgta

SEQ ID NO: 723188 - DNA, 22 bp, Artificial Sequence
  chemically synthesized
ccaaagtgctgggattacaggt

SEQ ID NO: 723189 - DNA, 22 bp, Artificial Sequence
  chemically synthesized
agcctcccaaagtgctgggatt

SEQ ID NO: 723190 - DNA, 22 bp, Artificial Sequence
  chemically synthesized
acacctgtaatcccagcacttt

SEQ ID NO: 723191 - DNA, 22 bp, Artificial Sequence
  chemically synthesized
taatcccagcactttgggaggc

SEQ ID NO: 723192 - DNA, 22 bp, Artificial Sequence
  chemically synthesized
gtgatccgcccatctcagcctc

SEQ ID NO: 723193 - DNA, 22 bp, Artificial Sequence
  chemically synthesized
cagacctcgtgatccgcccatc

SEQ ID NO: 723194 - DNA, 22 bp, Artificial Sequence
  chemically synthesized
tgggaggctgagatgggcggat

SEQ ID NO: 723195 - DNA, 22 bp, Artificial Sequence
  chemically synthesized
gggaggctgagatgggcggatc

SEQ ID NO: 723196 - DNA, 22 bp, Artificial Sequence
  chemically synthesized
ggaggctgagatgggcggatca

SEQ ID NO: 723197 - DNA, 22 bp, Artificial Sequence
  chemically synthesized
gaactccagacctcgtgatccg

SEQ ID NO: 723198 - DNA, 22 bp, Artificial Sequence
  chemically synthesized
agatgggcggatcacgaggtct

SEQ ID NO: 723199 - DNA, 22 bp, Artificial Sequence
  chemically synthesized
gtctcgaactccagacctcgtg

SEQ ID NO: 723200 - DNA, 22 bp, Artificial Sequence
  chemically synthesized
atcatgctggtctcgaactcca

SEQ ID NO: 723201 - DNA, 22 bp, Artificial Sequence
  chemically synthesized
accatgttgatcatgctggtct

SEQ ID NO: 723202 - DNA, 22 bp, Artificial Sequence
  chemically synthesized
caccatgttgatcatgctggtc

SEQ ID NO: 723203 - DNA, 22 bp, Artificial Sequence
  chemically synthesized
gagttcgagaccagcatgatca

SEQ ID NO: 723204 - DNA, 22 bp, Artificial Sequence
  chemically synthesized
gagaccagcatgatcaacatgg

SEQ ID NO: 723205 - DNA, 22 bp, Artificial Sequence
  chemically synthesized
ggagacatggggtttcaccatg

SEQ ID NO: 723206 - DNA, 22 bp, Artificial Sequence
  chemically synthesized
aggagacatggggtttcaccat

SEQ ID NO: 723207 - DNA, 22 bp, Artificial Sequence
  chemically synthesized
taggagacatggggtttcacca

SEQ ID NO: 723208 - DNA, 22 bp, Artificial Sequence
  chemically synthesized
ttaggagacatggggtttcacc

SEQ ID NO: 723209 - DNA, 22 bp, Artificial Sequence
  chemically synthesized
tatttttaggagacatggggtt

SEQ ID NO: 723210 - DNA, 22 bp, Artificial Sequence
  chemically synthesized
gtatttttaggagacatggggt

SEQ ID NO: 723211 - DNA, 22 bp, Artificial Sequence
  chemically synthesized
tgtatttttaggagacatgggg

SEQ ID NO: 723212 - DNA, 22 bp, Artificial Sequence
  chemically synthesized
ttgtatttttaggagacatggg

SEQ ID NO: 723213 - DNA, 22 bp, Artificial Sequence
  chemically synthesized
atttttgtatttttaggagaca

SEQ ID NO: 723214 - DNA, 22 bp, Artificial Sequence
  chemically synthesized
ctaaaaatacaaaaattagctg

SEQ ID NO: 723215 - DNA, 22 bp, Artificial Sequence
  chemically synthesized
aaaatacaaaaattagctgggc

SEQ ID NO: 723216 - DNA, 22 bp, Artificial Sequence
  chemically synthesized
caggtgtgtgccaccacgccca

SEQ ID NO: 723217 - DNA, 22 bp, Artificial Sequence
  chemically synthesized
ggattacaggtgtgtgccacca

SEQ ID NO: 723218 - DNA, 22 bp, Artificial Sequence
  chemically synthesized
gctgggcgtggtggcacacacc

SEQ ID NO: 723219 - DNA, 22 bp, Artificial Sequence
  chemically synthesized
ggcgtggtggcacacacctgta

SEQ ID NO: 723220 - DNA, 22 bp, Artificial Sequence
  chemically synthesized
agtagctgggattacaggtgtg

SEQ ID NO: 723221 - DNA, 22 bp, Artificial Sequence
  chemically synthesized
ctgagtagctgggattacaggt

SEQ ID NO: 723222 - DNA, 22 bp, Artificial Sequence
  chemically synthesized
agcctcctgagtagctgggatt

SEQ ID NO: 723223 - DNA, 22 bp, Artificial Sequence
  chemically synthesized
cctcagcctcctgagtagctgg

SEQ ID NO: 723224 - DNA, 22 bp, Artificial Sequence
  chemically synthesized
ctgcctcagcctcctgagtagc

SEQ ID NO: 723225 - DNA, 22 bp, Artificial Sequence
  chemically synthesized
tcctgcctcagcctcctgagta

SEQ ID NO: 723226 - DNA, 22 bp, Artificial Sequence
  chemically synthesized
taatcccagctactcaggaggc

SEQ ID NO: 723227 - DNA, 22 bp, Artificial Sequence
  chemically synthesized
aagcaattctcctgcctcagcc

SEQ ID NO: 723228 - DNA, 22 bp, Artificial Sequence
  chemically synthesized
ctcaggaggctgaggcaggaga

SEQ ID NO: 723229 - DNA, 22 bp, Artificial Sequence
  chemically synthesized
aggaggctgaggcaggagaatt

SEQ ID NO: 723230 - DNA, 22 bp, Artificial Sequence
  chemically synthesized
ccaggttcaagcaattctcctg

SEQ ID NO: 723231 - DNA, 22 bp, Artificial Sequence
  chemically synthesized
cgcctcccaggttcaagcaatt

SEQ ID NO: 723232 - DNA, 22 bp, Artificial Sequence
  chemically synthesized
aggcaggagaattgcttgaacc

SEQ ID NO: 723233 - DNA, 22 bp, Artificial Sequence
  chemically synthesized
caacctccgcctcccaggttca

SEQ ID NO: 723234 - DNA, 22 bp, Artificial Sequence
  chemically synthesized
actgcaacctccgcctcccagg

SEQ ID NO: 723235 - DNA, 22 bp, Artificial Sequence
  chemically synthesized
ggctcactgcaacctccgcctc

SEQ ID NO: 723236 - DNA, 22 bp, Artificial Sequence
  chemically synthesized
cttgaacctgggaggcggaggt

SEQ ID NO: 723237 - DNA, 22 bp, Artificial Sequence
  chemically synthesized
gaacctgggaggcggaggttgc

SEQ ID NO: 723238 - DNA, 22 bp, Artificial Sequence
  chemically synthesized
aacctgggaggcggaggttgca

SEQ ID NO: 723239 - DNA, 22 bp, Artificial Sequence
  chemically synthesized
ggaggcggaggttgcagtgagc

SEQ ID NO: 723240 - DNA, 22 bp, Artificial Sequence
  chemically synthesized
gagtgcagtggcgtgatctcgg

SEQ ID NO: 723241 - DNA, 22 bp, Artificial Sequence
  chemically synthesized
cagtgagccgagatcacgccac

SEQ ID NO: 723242 - DNA, 22 bp, Artificial Sequence
  chemically synthesized
ccccaggctggagtgcagtggc

SEQ ID NO: 723243 - DNA, 22 bp, Artificial Sequence
  chemically synthesized
tcccccaggctggagtgcagtg

SEQ ID NO: 723244 - DNA, 22 bp, Artificial Sequence
  chemically synthesized
tctcccccaggctggagtgcag

SEQ ID NO: 723245 - DNA, 22 bp, Artificial Sequence
  chemically synthesized
actctctcccccaggctggagt

SEQ ID NO: 723246 - DNA, 22 bp, Artificial Sequence
  chemically synthesized
cactccagcctgggggagagag

SEQ ID NO: 723247 - DNA, 22 bp, Artificial Sequence
  chemically synthesized
agatggagcctcactctctccc

SEQ ID NO: 723248 - DNA, 22 bp, Artificial Sequence
  chemically synthesized
gagatggagcctcactctctcc

SEQ ID NO: 723249 - DNA, 22 bp, Artificial Sequence
  chemically synthesized
tgagatggagcctcactctctc

SEQ ID NO: 723250 - DNA, 22 bp, Artificial Sequence
  chemically synthesized
ttgagatggagcctcactctct

SEQ ID NO: 723251 - DNA, 22 bp, Artificial Sequence
  chemically synthesized
cagcctgggggagagagtgagg

SEQ ID NO: 723252 - DNA, 22 bp, Artificial Sequence
  chemically synthesized
tttttgagatggagcctcactc

SEQ ID NO: 723253 - DNA, 22 bp, Artificial Sequence
  chemically synthesized
gtttttgagatggagcctcact

SEQ ID NO: 723254 - DNA, 22 bp, Artificial Sequence
  chemically synthesized
tgtttttgagatggagcctcac

SEQ ID NO: 723255 - DNA, 22 bp, Artificial Sequence
  chemically synthesized
ttgtttttgagatggagcctca

SEQ ID NO: 723256 - DNA, 22 bp, Artificial Sequence
  chemically synthesized
tttgtttttgagatggagcctc

SEQ ID NO: 723257 - DNA, 22 bp, Artificial Sequence
  chemically synthesized
ggggagagagtgaggctccatc

SEQ ID NO: 723258 - DNA, 22 bp, Artificial Sequence
  chemically synthesized
ttttttgtttttgagatggagc

SEQ ID NO: 723259 - DNA, 22 bp, Artificial Sequence
  chemically synthesized
gttttttgtttttgagatggag

SEQ ID NO: 723260 - DNA, 22 bp, Artificial Sequence
  chemically synthesized
tgttttttgtttttgagatgga

SEQ ID NO: 723261 - DNA, 22 bp, Artificial Sequence
  chemically synthesized
ttgttttttgtttttgagatgg

SEQ ID NO: 723262 - DNA, 22 bp, Artificial Sequence
  chemically synthesized
tttgttttttgtttttgagatg

SEQ ID NO: 723263 - DNA, 22 bp, Artificial Sequence
  chemically synthesized
ctttttgttttttgtttttgag

SEQ ID NO: 723264 - DNA, 22 bp, Artificial Sequence
  chemically synthesized
gctttttgttttttgtttttga

SEQ ID NO: 723265 - DNA, 22 bp, Artificial Sequence
  chemically synthesized
cttgctttttgttttttgtttt

SEQ ID NO: 723266 - DNA, 22 bp, Artificial Sequence
  chemically synthesized
gcttgctttttgttttttgttt

SEQ ID NO: 723267 - DNA, 22 bp, Artificial Sequence
  chemically synthesized
tgcttgctttttgttttttgtt

SEQ ID NO: 723268 - DNA, 22 bp, Artificial Sequence
  chemically synthesized
ttgcttgctttttgttttttgt

SEQ ID NO: 723269 - DNA, 22 bp, Artificial Sequence
  chemically synthesized
tttgcttgctttttgttttttg

SEQ ID NO: 723270 - DNA, 22 bp, Artificial Sequence
  chemically synthesized
catctcaaaaacaaaaaacaaa

SEQ ID NO: 723271 - DNA, 22 bp, Artificial Sequence
  chemically synthesized
ttttgcttgctttttgtttttt

SEQ ID NO: 723272 - DNA, 22 bp, Artificial Sequence
  chemically synthesized
tttttgcttgctttttgttttt

SEQ ID NO: 723273 - DNA, 22 bp, Artificial Sequence
  chemically synthesized
aaaaacaaaaaacaaaaagcaa

SEQ ID NO: 723274 - DNA, 22 bp, Artificial Sequence
  chemically synthesized
aatgtgtggccgttttttttgc

SEQ ID NO: 723275 - DNA, 22 bp, Artificial Sequence
  chemically synthesized
ctaaatgtgtggccgttttttt

SEQ ID NO: 723276 - DNA, 22 bp, Artificial Sequence
  chemically synthesized
ctactaaatgtgtggccgtttt

SEQ ID NO: 723277 - DNA, 22 bp, Artificial Sequence
  chemically synthesized
cctactaaatgtgtggccgttt

SEQ ID NO: 723278 - DNA, 22 bp, Artificial Sequence
  chemically synthesized
tcctactaaatgtgtggccgtt

SEQ ID NO: 723279 - DNA, 22 bp, Artificial Sequence
  chemically synthesized
ttcctactaaatgtgtggccgt

SEQ ID NO: 723280 - DNA, 22 bp, Artificial Sequence
  chemically synthesized
atttttcctactaaatgtgtgg

SEQ ID NO: 723281 - DNA, 22 bp, Artificial Sequence
  chemically synthesized
gatttttcctactaaatgtgtg

SEQ ID NO: 723282 - DNA, 22 bp, Artificial Sequence
  chemically synthesized
ttgatttttcctactaaatgtg

SEQ ID NO: 723283 - DNA, 22 bp, Artificial Sequence
  chemically synthesized
cttgatttttcctactaaatgt

SEQ ID NO: 723284 - DNA, 22 bp, Artificial Sequence
  chemically synthesized
tcttgatttttcctactaaatg

SEQ ID NO: 723285 - DNA, 22 bp, Artificial Sequence
  chemically synthesized
ttcttgatttttcctactaaat

SEQ ID NO: 723286 - DNA, 22 bp, Artificial Sequence
  chemically synthesized
taaaccttttcttgatttttcc

SEQ ID NO: 723287 - DNA, 22 bp, Artificial Sequence
  chemically synthesized
ataaaccttttcttgatttttc

SEQ ID NO: 723288 - DNA, 22 bp, Artificial Sequence
  chemically synthesized
tttataaaccttttcttgattt

SEQ ID NO: 723289 - DNA, 22 bp, Artificial Sequence
  chemically synthesized
tatttataaaccttttcttgat

SEQ ID NO: 723290 - DNA, 22 bp, Artificial Sequence
  chemically synthesized
agtaggaaaaatcaagaaaagg

SEQ ID NO: 723291 - DNA, 22 bp, Artificial Sequence
  chemically synthesized
gtaggaaaaatcaagaaaaggt

SEQ ID NO: 723292 - DNA, 22 bp, Artificial Sequence
  chemically synthesized
ccactctatttataaacctttt

SEQ ID NO: 723293 - DNA, 22 bp, Artificial Sequence
  chemically synthesized
ataaatagagtggtagacactg

SEQ ID NO: 723294 - DNA, 22 bp, Artificial Sequence
  chemically synthesized
taaatagagtggtagacactgt

SEQ ID NO: 723295 - DNA, 22 bp, Artificial Sequence
  chemically synthesized
atgaggcaaccaacagtgtcta

SEQ ID NO: 723296 - DNA, 22 bp, Artificial Sequence
  chemically synthesized
ttgatgaggcaaccaacagtgt

SEQ ID NO: 723297 - DNA, 22 bp, Artificial Sequence
  chemically synthesized
ttggttgcctcatcaacaacca

SEQ ID NO: 723298 - DNA, 22 bp, Artificial Sequence
  chemically synthesized
gttgcctcatcaacaaccattc

SEQ ID NO: 723299 - DNA, 22 bp, Artificial Sequence
  chemically synthesized
cctcatcaacaaccattccact

SEQ ID NO: 723300 - DNA, 22 bp, Artificial Sequence
  chemically synthesized
gagaaaaaagggagagtggaat

SEQ ID NO: 723301 - DNA, 22 bp, Artificial Sequence
  chemically synthesized
atcaacaaccattccactctcc

SEQ ID NO: 723302 - DNA, 22 bp, Artificial Sequence
  chemically synthesized
cactctcccttttttctctagt

SEQ ID NO: 723303 - DNA, 22 bp, Artificial Sequence
  chemically synthesized
tcccttttttctctagtgatta

SEQ ID NO: 723304 - DNA, 22 bp, Artificial Sequence
  chemically synthesized
ccttttttctctagtgattatc

SEQ ID NO: 723305 - DNA, 22 bp, Artificial Sequence
  chemically synthesized
tgtgtgtggaaatagataatca

SEQ ID NO: 723306 - DNA, 22 bp, Artificial Sequence
  chemically synthesized
gtgtgtgtggaaatagataatc

SEQ ID NO: 723307 - DNA, 22 bp, Artificial Sequence
  chemically synthesized
ttttctctagtgattatctatt

SEQ ID NO: 723308 - DNA, 22 bp, Artificial Sequence
  chemically synthesized
tgtgtgtgtggaaatagataat

SEQ ID NO: 723309 - DNA, 22 bp, Artificial Sequence
  chemically synthesized
tttctctagtgattatctattt

SEQ ID NO: 723310 - DNA, 22 bp, Artificial Sequence
  chemically synthesized
ttgtgtgtgtggaaatagataa

SEQ ID NO: 723311 - DNA, 22 bp, Artificial Sequence
  chemically synthesized
ttctctagtgattatctatttc

SEQ ID NO: 723312 - DNA, 22 bp, Artificial Sequence
  chemically synthesized
tttgtgtgtgtggaaatagata

SEQ ID NO: 723313 - DNA, 22 bp, Artificial Sequence
  chemically synthesized
tctctagtgattatctatttcc

SEQ ID NO: 723314 - DNA, 22 bp, Artificial Sequence
  chemically synthesized
ttttgtgtgtgtggaaatagat

SEQ ID NO: 723315 - DNA, 22 bp, Artificial Sequence
  chemically synthesized
ctctagtgattatctatttcca

SEQ ID NO: 723316 - DNA, 22 bp, Artificial Sequence
  chemically synthesized
tttttgtgtgtgtggaaataga

SEQ ID NO: 723317 - DNA, 22 bp, Artificial Sequence
  chemically synthesized
tctagtgattatctatttccac

SEQ ID NO: 723318 - DNA, 22 bp, Artificial Sequence
  chemically synthesized
ttttttgtgtgtgtggaaatag

SEQ ID NO: 723319 - DNA, 22 bp, Artificial Sequence
  chemically synthesized
tagtgattatctatttccacac

SEQ ID NO: 723320 - DNA, 22 bp, Artificial Sequence
  chemically synthesized
gtgattatctatttccacacac

SEQ ID NO: 723321 - DNA, 22 bp, Artificial Sequence
  chemically synthesized
aacttttttttgtgtgtgtgga

SEQ ID NO: 723322 - DNA, 22 bp, Artificial Sequence
  chemically synthesized
aaacttttttttgtgtgtgtgg

SEQ ID NO: 723323 - DNA, 22 bp, Artificial Sequence
  chemically synthesized
taaacttttttttgtgtgtgtg

SEQ ID NO: 723324 - DNA, 22 bp, Artificial Sequence
  chemically synthesized
ttaaacttttttttgtgtgtgt

SEQ ID NO: 723325 - DNA, 22 bp, Artificial Sequence
  chemically synthesized
tttaaacttttttttgtgtgtg

SEQ ID NO: 723326 - DNA, 22 bp, Artificial Sequence
  chemically synthesized
tctatttccacacacacaaaaa

SEQ ID NO: 723327 - DNA, 22 bp, Artificial Sequence
  chemically synthesized
tttccacacacacaaaaaaaag

SEQ ID NO: 723328 - DNA, 22 bp, Artificial Sequence
  chemically synthesized
ccacacacacaaaaaaaagttt

SEQ ID NO: 723329 - DNA, 22 bp, Artificial Sequence
  chemically synthesized
tcagtgctttttaaactttttt

SEQ ID NO: 723330 - DNA, 22 bp, Artificial Sequence
  chemically synthesized
cacacacacaaaaaaaagttta

SEQ ID NO: 723331 - DNA, 22 bp, Artificial Sequence
  chemically synthesized
actatcagtgctttttaaactt

SEQ ID NO: 723332 - DNA, 22 bp, Artificial Sequence
  chemically synthesized
agaaattgactatcagtgcttt

SEQ ID NO: 723333 - DNA, 22 bp, Artificial Sequence
  chemically synthesized
aaaaagcactgatagtcaattt

SEQ ID NO: 723334 - DNA, 22 bp, Artificial Sequence
  chemically synthesized
aaaagcactgatagtcaatttc

SEQ ID NO: 723335 - DNA, 22 bp, Artificial Sequence
  chemically synthesized
caagggaaactaagaaattgac

SEQ ID NO: 723336 - DNA, 22 bp, Artificial Sequence
  chemically synthesized
cctgcaagggaaactaagaaat

SEQ ID NO: 723337 - DNA, 22 bp, Artificial Sequence
  chemically synthesized
atagtcaatttcttagtttccc

SEQ ID NO: 723338 - DNA, 22 bp, Artificial Sequence
  chemically synthesized
catctacctgcaagggaaacta

SEQ ID NO: 723339 - DNA, 22 bp, Artificial Sequence
  chemically synthesized
cttagtttcccttgcaggtaga

SEQ ID NO: 723340 - DNA, 22 bp, Artificial Sequence
  chemically synthesized
ttagtttcccttgcaggtagat

SEQ ID NO: 723341 - DNA, 22 bp, Artificial Sequence
  chemically synthesized
agtttcccttgcaggtagatgc

SEQ ID NO: 723342 - DNA, 22 bp, Artificial Sequence
  chemically synthesized
ggtcaagtagctgcatctacct

SEQ ID NO: 723343 - DNA, 22 bp, Artificial Sequence
  chemically synthesized
gtttcccttgcaggtagatgca

SEQ ID NO: 723344 - DNA, 22 bp, Artificial Sequence
  chemically synthesized
cccttgcaggtagatgcagcta

SEQ ID NO: 723345 - DNA, 22 bp, Artificial Sequence
  chemically synthesized
ccttgcaggtagatgcagctac

SEQ ID NO: 723346 - DNA, 22 bp, Artificial Sequence
  chemically synthesized
gcaggtagatgcagctacttga

SEQ ID NO: 723347 - DNA, 22 bp, Artificial Sequence
  chemically synthesized
gccagaactaggtcaagtagct

SEQ ID NO: 723348 - DNA, 22 bp, Artificial Sequence
  chemically synthesized
caggtagatgcagctacttgac

SEQ ID NO: 723349 - DNA, 22 bp, Artificial Sequence
  chemically synthesized
ggccagaactaggtcaagtagc

SEQ ID NO: 723350 - DNA, 22 bp, Artificial Sequence
  chemically synthesized
tggccagaactaggtcaagtag

SEQ ID NO: 723351 - DNA, 22 bp, Artificial Sequence
  chemically synthesized
tttggccagaactaggtcaagt

SEQ ID NO: 723352 - DNA, 22 bp, Artificial Sequence
  chemically synthesized
acatctctttggccagaactag

SEQ ID NO: 723353 - DNA, 22 bp, Artificial Sequence
  chemically synthesized
cctaacatctctttggccagaa

SEQ ID NO: 723354 - DNA, 22 bp, Artificial Sequence
  chemically synthesized
cttgacctagttctggccaaag

SEQ ID NO: 723355 - DNA, 22 bp, Artificial Sequence
  chemically synthesized
gacctagttctggccaaagaga

SEQ ID NO: 723356 - DNA, 22 bp, Artificial Sequence
  chemically synthesized
acctagttctggccaaagagat

SEQ ID NO: 723357 - DNA, 22 bp, Artificial Sequence
  chemically synthesized
gttctggccaaagagatgttag

SEQ ID NO: 723358 - DNA, 22 bp, Artificial Sequence
  chemically synthesized
tggccaaagagatgttagggag

SEQ ID NO: 723359 - DNA, 22 bp, Artificial Sequence
  chemically synthesized
gccaaagagatgttagggagac

SEQ ID NO: 723360 - DNA, 22 bp, Artificial Sequence
  chemically synthesized
agaagcaacagcatgtctccct

SEQ ID NO: 723361 - DNA, 22 bp, Artificial Sequence
  chemically synthesized
cagaagcaacagcatgtctccc

SEQ ID NO: 723362 - DNA, 22 bp, Artificial Sequence
  chemically synthesized
tcatgtttcagaagcaacagca

SEQ ID NO: 723363 - DNA, 22 bp, Artificial Sequence
  chemically synthesized
gtcatgtttcagaagcaacagc

SEQ ID NO: 723364 - DNA, 22 bp, Artificial Sequence
  chemically synthesized
ttgtcatgtttcagaagcaaca

SEQ ID NO: 723365 - DNA, 22 bp, Artificial Sequence
  chemically synthesized
gggagacatgctgttgcttctg

SEQ ID NO: 723366 - DNA, 22 bp, Artificial Sequence
  chemically synthesized
ttgcttctgaaacatgacaaga

SEQ ID NO: 723367 - DNA, 22 bp, Artificial Sequence
  chemically synthesized
cttctgaaacatgacaagaact

SEQ ID NO: 723368 - DNA, 22 bp, Artificial Sequence
  chemically synthesized
ctgaaacatgacaagaactgcc

SEQ ID NO: 723369 - DNA, 22 bp, Artificial Sequence
  chemically synthesized
tgaaacatgacaagaactgcca

SEQ ID NO: 723370 - DNA, 22 bp, Artificial Sequence
  chemically synthesized
aaacatgacaagaactgccact

SEQ ID NO: 723371 - DNA, 22 bp, Artificial Sequence
  chemically synthesized
ccactcttcctttattttccat

SEQ ID NO: 723372 - DNA, 22 bp, Artificial Sequence
  chemically synthesized
catcatgacagtgtgaatggaa

SEQ ID NO: 723373 - DNA, 22 bp, Artificial Sequence
  chemically synthesized
ttcctttattttccattcacac

SEQ ID NO: 723374 - DNA, 22 bp, Artificial Sequence
  chemically synthesized
cctttattttccattcacactg

SEQ ID NO: 723375 - DNA, 22 bp, Artificial Sequence
  chemically synthesized
ctttattttccattcacactgt

SEQ ID NO: 723376 - DNA, 22 bp, Artificial Sequence
  chemically synthesized
tattttccattcacactgtcat

SEQ ID NO: 723377 - DNA, 22 bp, Artificial Sequence
  chemically synthesized
attttccattcacactgtcatg

SEQ ID NO: 723378 - DNA, 22 bp, Artificial Sequence
  chemically synthesized
caggaattgcatcatgacagtg

SEQ ID NO: 723379 - DNA, 22 bp, Artificial Sequence
  chemically synthesized
ttttccattcacactgtcatga

SEQ ID NO: 723380 - DNA, 22 bp, Artificial Sequence
  chemically synthesized
tccattcacactgtcatgatgc

SEQ ID NO: 723381 - DNA, 22 bp, Artificial Sequence
  chemically synthesized
ccattcacactgtcatgatgca

SEQ ID NO: 723382 - DNA, 22 bp, Artificial Sequence
  chemically synthesized
cattcacactgtcatgatgcaa

SEQ ID NO: 723383 - DNA, 22 bp, Artificial Sequence
  chemically synthesized
ccacactccaggaattgcatca

SEQ ID NO: 723384 - DNA, 22 bp, Artificial Sequence
  chemically synthesized
acactgtcatgatgcaattcct

SEQ ID NO: 723385 - DNA, 22 bp, Artificial Sequence
  chemically synthesized
tcatgatgcaattcctggagtg

SEQ ID NO: 723386 - DNA, 22 bp, Artificial Sequence
  chemically synthesized
taaaatggctgccacactccag

SEQ ID NO: 723387 - DNA, 22 bp, Artificial Sequence
  chemically synthesized
ctggagtgtggcagccatttta

SEQ ID NO: 723388 - DNA, 22 bp, Artificial Sequence
  chemically synthesized
tcacgcgatggttataaaatgg

SEQ ID NO: 723389 - DNA, 22 bp, Artificial Sequence
  chemically synthesized
gagtgtggcagccattttataa

SEQ ID NO: 723390 - DNA, 22 bp, Artificial Sequence
  chemically synthesized
gaattgtcacgcgatggttata

SEQ ID NO: 723391 - DNA, 22 bp, Artificial Sequence
  chemically synthesized
ggaattgtcacgcgatggttat

SEQ ID NO: 723392 - DNA, 22 bp, Artificial Sequence
  chemically synthesized
tggaattgtcacgcgatggtta

SEQ ID NO: 723393 - DNA, 22 bp, Artificial Sequence
  chemically synthesized
gtctttggaattgtcacgcgat

SEQ ID NO: 723394 - DNA, 22 bp, Artificial Sequence
  chemically synthesized
ggtctttggaattgtcacgcga

SEQ ID NO: 723395 - DNA, 22 bp, Artificial Sequence
  chemically synthesized
tggtctttggaattgtcacgcg

SEQ ID NO: 723396 - DNA, 22 bp, Artificial Sequence
  chemically synthesized
tataaccatcgcgtgacaattc

SEQ ID NO: 723397 - DNA, 22 bp, Artificial Sequence
  chemically synthesized
ataaccatcgcgtgacaattcc

SEQ ID NO: 723398 - DNA, 22 bp, Artificial Sequence
  chemically synthesized
gctttggtctttggaattgtca

SEQ ID NO: 723399 - DNA, 22 bp, Artificial Sequence
  chemically synthesized
taaccatcgcgtgacaattcca

SEQ ID NO: 723400 - DNA, 22 bp, Artificial Sequence
  chemically synthesized
ggctttggtctttggaattgtc

SEQ ID NO: 723401 - DNA, 22 bp, Artificial Sequence
  chemically synthesized
tggctttggtctttggaattgt

SEQ ID NO: 723402 - DNA, 22 bp, Artificial Sequence
  chemically synthesized
gcctttggctttggtctttgga

SEQ ID NO: 723403 - DNA, 22 bp, Artificial Sequence
  chemically synthesized
agcctttggctttggtctttgg

SEQ ID NO: 723404 - DNA, 22 bp, Artificial Sequence
  chemically synthesized
tccttagcctttggctttggtc

SEQ ID NO: 723405 - DNA, 22 bp, Artificial Sequence
  chemically synthesized
ctatccttagcctttggctttg

SEQ ID NO: 723406 - DNA, 22 bp, Artificial Sequence
  chemically synthesized
gctatccttagcctttggcttt

SEQ ID NO: 723407 - DNA, 22 bp, Artificial Sequence
  chemically synthesized
caaagaccaaagccaaaggcta

SEQ ID NO: 723408 - DNA, 22 bp, Artificial Sequence
  chemically synthesized
catttgctatccttagcctttg

SEQ ID NO: 723409 - DNA, 22 bp, Artificial Sequence
  chemically synthesized
gcatttgctatccttagccttt

SEQ ID NO: 723410 - DNA, 22 bp, Artificial Sequence
  chemically synthesized
tgcatttgctatccttagcctt

SEQ ID NO: 723411 - DNA, 22 bp, Artificial Sequence
  chemically synthesized
catctttgcatttgctatcctt

SEQ ID NO: 723412 - DNA, 22 bp, Artificial Sequence
  chemically synthesized
ccatctttgcatttgctatcct

SEQ ID NO: 723413 - DNA, 22 bp, Artificial Sequence
  chemically synthesized
tccatctttgcatttgctatcc

SEQ ID NO: 723414 - DNA, 22 bp, Artificial Sequence
  chemically synthesized
aggatagcaaatgcaaagatgg

SEQ ID NO: 723415 - DNA, 22 bp, Artificial Sequence
  chemically synthesized
agaatccaatgtctttccatct

SEQ ID NO: 723416 - DNA, 22 bp, Artificial Sequence
  chemically synthesized
attcagaatccaatgtctttcc

SEQ ID NO: 723417 - DNA, 22 bp, Artificial Sequence
  chemically synthesized
cattcagaatccaatgtctttc

SEQ ID NO: 723418 - DNA, 22 bp, Artificial Sequence
  chemically synthesized
aacagtttcattcagaatccaa

SEQ ID NO: 723419 - DNA, 22 bp, Artificial Sequence
  chemically synthesized
gctcaacagtttcattcagaat

SEQ ID NO: 723420 - DNA, 22 bp, Artificial Sequence
  chemically synthesized
ttagctcaacagtttcattcag

SEQ ID NO: 723421 - DNA, 22 bp, Artificial Sequence
  chemically synthesized
attagctcaacagtttcattca

SEQ ID NO: 723422 - DNA, 22 bp, Artificial Sequence
  chemically synthesized
gtttattagctcaacagtttca

SEQ ID NO: 723423 - DNA, 22 bp, Artificial Sequence
  chemically synthesized
gattctgaatgaaactgttgag

SEQ ID NO: 723424 - DNA, 22 bp, Artificial Sequence
  chemically synthesized
tgaatgaaactgttgagctaat

SEQ ID NO: 723425 - DNA, 22 bp, Artificial Sequence
  chemically synthesized
aatgaaactgttgagctaataa

SEQ ID NO: 723426 - DNA, 22 bp, Artificial Sequence
  chemically synthesized
ttgagctaataaaccaattttg

SEQ ID NO: 723427 - DNA, 22 bp, Artificial Sequence
  chemically synthesized
agctaataaaccaattttgggt

SEQ ID NO: 723428 - DNA, 22 bp, Artificial Sequence
  chemically synthesized
agagaaagatatacccaaaatt

SEQ ID NO: 723429 - DNA, 22 bp, Artificial Sequence
  chemically synthesized
aagagaaagatatacccaaaat

SEQ ID NO: 723430 - DNA, 22 bp, Artificial Sequence
  chemically synthesized
ataaaccaattttgggtatatc

SEQ ID NO: 723431 - DNA, 22 bp, Artificial Sequence
  chemically synthesized
acataataggaatttaagagaa

SEQ ID NO: 723432 - DNA, 22 bp, Artificial Sequence
  chemically synthesized
tgggtatatctttctcttaaat

SEQ ID NO: 723433 - DNA, 22 bp, Artificial Sequence
  chemically synthesized
gggtatatctttctcttaaatt

SEQ ID NO: 723434 - DNA, 22 bp, Artificial Sequence
  chemically synthesized
tcacataataggaatttaagag

SEQ ID NO: 723435 - DNA, 22 bp, Artificial Sequence
  chemically synthesized
ggtatatctttctcttaaattc

SEQ ID NO: 723436 - DNA, 22 bp, Artificial Sequence
  chemically synthesized
ctcacataataggaatttaaga

SEQ ID NO: 723437 - DNA, 22 bp, Artificial Sequence
  chemically synthesized
tctcacataataggaatttaag

SEQ ID NO: 723438 - DNA, 22 bp, Artificial Sequence
  chemically synthesized
ttctcacataataggaatttaa

SEQ ID NO: 723439 - DNA, 22 bp, Artificial Sequence
  chemically synthesized
tttttctcacataataggaatt

SEQ ID NO: 723440 - DNA, 22 bp, Artificial Sequence
  chemically synthesized
atttttctcacataataggaat

SEQ ID NO: 723441 - DNA, 22 bp, Artificial Sequence
  chemically synthesized
tctcttaaattcctattatgtg

SEQ ID NO: 723442 - DNA, 22 bp, Artificial Sequence
  chemically synthesized
ctcttaaattcctattatgtga

SEQ ID NO: 723443 - DNA, 22 bp, Artificial Sequence
  chemically synthesized
tcttaaattcctattatgtgag

SEQ ID NO: 723444 - DNA, 22 bp, Artificial Sequence
  chemically synthesized
ttaaattcctattatgtgagaa

SEQ ID NO: 723445 - DNA, 22 bp, Artificial Sequence
  chemically synthesized
aaattcctattatgtgagaaaa

SEQ ID NO: 723446 - DNA, 22 bp, Artificial Sequence
  chemically synthesized
aattcctattatgtgagaaaaa

SEQ ID NO: 723447 - DNA, 22 bp, Artificial Sequence
  chemically synthesized
ctattatgtgagaaaaataaac

SEQ ID NO: 723448 - DNA, 22 bp, Artificial Sequence
  chemically synthesized
ttatgtgagaaaaataaacgat

SEQ ID NO: 723449 - DNA, 22 bp, Artificial Sequence
  chemically synthesized
tgtgagaaaaataaacgatggt

SEQ ID NO: 723450 - DNA, 22 bp, Artificial Sequence
  chemically synthesized
gtaaagggatatataatgaaaa

SEQ ID NO: 723451 - DNA, 22 bp, Artificial Sequence
  chemically synthesized
tagtaaagggatatataatgaa

SEQ ID NO: 723452 - DNA, 22 bp, Artificial Sequence
  chemically synthesized
ctagtaaagggatatataatga

SEQ ID NO: 723453 - DNA, 22 bp, Artificial Sequence
  chemically synthesized
cttacattttcattatatatcc

SEQ ID NO: 723454 - DNA, 22 bp, Artificial Sequence
  chemically synthesized
acttctagtaaagggatatata

SEQ ID NO: 723455 - DNA, 22 bp, Artificial Sequence
  chemically synthesized
aacttctagtaaagggatatat

SEQ ID NO: 723456 - DNA, 22 bp, Artificial Sequence
  chemically synthesized
acattttcattatatatccctt

SEQ ID NO: 723457 - DNA, 22 bp, Artificial Sequence
  chemically synthesized
taacttctagtaaagggatata

SEQ ID NO: 723458 - DNA, 22 bp, Artificial Sequence
  chemically synthesized
cattttcattatatatcccttt

SEQ ID NO: 723459 - DNA, 22 bp, Artificial Sequence
  chemically synthesized
tcattatatatccctttactag

SEQ ID NO: 723460 - DNA, 22 bp, Artificial Sequence
  chemically synthesized
cattatatatccctttactaga

SEQ ID NO: 723461 - DNA, 22 bp, Artificial Sequence
  chemically synthesized
attatatatccctttactagaa

SEQ ID NO: 723462 - DNA, 22 bp, Artificial Sequence
  chemically synthesized
tatatccctttactagaagtta

SEQ ID NO: 723463 - DNA, 22 bp, Artificial Sequence
  chemically synthesized
tgtcggtatagaggctttaact

SEQ ID NO: 723464 - DNA, 22 bp, Artificial Sequence
  chemically synthesized
gtgtcggtatagaggctttaac

SEQ ID NO: 723465 - DNA, 22 bp, Artificial Sequence
  chemically synthesized
tactagaagttaaagcctctat

SEQ ID NO: 723466 - DNA, 22 bp, Artificial Sequence
  chemically synthesized
actagaagttaaagcctctata

SEQ ID NO: 723467 - DNA, 22 bp, Artificial Sequence
  chemically synthesized
ctagaagttaaagcctctatac

SEQ ID NO: 723468 - DNA, 22 bp, Artificial Sequence
  chemically synthesized
gaagttaaagcctctataccga

SEQ ID NO: 723469 - DNA, 22 bp, Artificial Sequence
  chemically synthesized
aagcctctataccgacacaaac

SEQ ID NO: 723470 - DNA, 22 bp, Artificial Sequence
  chemically synthesized
tcacagcaggaacagtttgtgt

SEQ ID NO: 723471 - DNA, 22 bp, Artificial Sequence
  chemically synthesized
ttgtcacagcaggaacagtttg

SEQ ID NO: 723472 - DNA, 22 bp, Artificial Sequence
  chemically synthesized
tataccgacacaaactgttcct

SEQ ID NO: 723473 - DNA, 22 bp, Artificial Sequence
  chemically synthesized
taccgacacaaactgttcctgc

SEQ ID NO: 723474 - DNA, 22 bp, Artificial Sequence
  chemically synthesized
tattgttgtcacagcaggaaca

SEQ ID NO: 723475 - DNA, 22 bp, Artificial Sequence
  chemically synthesized
gctatattgttgtcacagcagg

SEQ ID NO: 723476 - DNA, 22 bp, Artificial Sequence
  chemically synthesized
tgctggctatattgttgtcaca

SEQ ID NO: 723477 - DNA, 22 bp, Artificial Sequence
  chemically synthesized
gtgctggctatattgttgtcac

SEQ ID NO: 723478 - DNA, 22 bp, Artificial Sequence
  chemically synthesized
ttcctgctgtgacaacaatata

SEQ ID NO: 723479 - DNA, 22 bp, Artificial Sequence
  chemically synthesized
ctgctgtgacaacaatatagcc

SEQ ID NO: 723480 - DNA, 22 bp, Artificial Sequence
  chemically synthesized
gggggacttgtgctggctatat

SEQ ID NO: 723481 - DNA, 22 bp, Artificial Sequence
  chemically synthesized
ctgtgacaacaatatagccagc

SEQ ID NO: 723482 - DNA, 22 bp, Artificial Sequence
  chemically synthesized
ggggggacttgtgctggctata

SEQ ID NO: 723483 - DNA, 22 bp, Artificial Sequence
  chemically synthesized
tgacaacaatatagccagcaca

SEQ ID NO: 723484 - DNA, 22 bp, Artificial Sequence
  chemically synthesized
tggtttggggggacttgtgctg

SEQ ID NO: 723485 - DNA, 22 bp, Artificial Sequence
  chemically synthesized
acaccagggtcaggggatctgt

SEQ ID NO: 723486 - DNA, 22 bp, Artificial Sequence
  chemically synthesized
gacaccagggtcaggggatctg

SEQ ID NO: 723487 - DNA, 22 bp, Artificial Sequence
  chemically synthesized
gaagacccaatcttgacaccag

SEQ ID NO: 723488 - DNA, 22 bp, Artificial Sequence
  chemically synthesized
accctggtgtcaagattgggtc

SEQ ID NO: 723489 - DNA, 22 bp, Artificial Sequence
  chemically synthesized
gtgtcaagattgggtcttctaa

SEQ ID NO: 723490 - DNA, 22 bp, Artificial Sequence
  chemically synthesized
gagtacccagatgcagaattag

SEQ ID NO: 723491 - DNA, 22 bp, Artificial Sequence
  chemically synthesized
ctagagtacccagatgcagaat

SEQ ID NO: 723492 - DNA, 22 bp, Artificial Sequence
  chemically synthesized
cctagagtacccagatgcagaa

SEQ ID NO: 723493 - DNA, 22 bp, Artificial Sequence
  chemically synthesized
ggtcttctaattctgcatctgg

SEQ ID NO: 723494 - DNA, 22 bp, Artificial Sequence
  chemically synthesized
ctaattctgcatctgggtactc

SEQ ID NO: 723495 - DNA, 22 bp, Artificial Sequence
  chemically synthesized
taattctgcatctgggtactct

SEQ ID NO: 723496 - DNA, 22 bp, Artificial Sequence
  chemically synthesized
attctgcatctgggtactctag

SEQ ID NO: 723497 - DNA, 22 bp, Artificial Sequence
  chemically synthesized
tgcatctgggtactctaggaag

SEQ ID NO: 723498 - DNA, 22 bp, Artificial Sequence
  chemically synthesized
catctgggtactctaggaagct

SEQ ID NO: 723499 - DNA, 22 bp, Artificial Sequence
  chemically synthesized
ggtactctaggaagctttgtgg

SEQ ID NO: 723500 - DNA, 22 bp, Artificial Sequence
  chemically synthesized
agtcatataaatgggaagccac

SEQ ID NO: 723501 - DNA, 22 bp, Artificial Sequence
  chemically synthesized
taggaagctttgtggcttccca

SEQ ID NO: 723502 - DNA, 22 bp, Artificial Sequence
  chemically synthesized
cagtcatataaatgggaagcca

SEQ ID NO: 723503 - DNA, 22 bp, Artificial Sequence
  chemically synthesized
ggaagctttgtggcttcccatt

SEQ ID NO: 723504 - DNA, 22 bp, Artificial Sequence
  chemically synthesized
gcgcttcagtcatataaatggg

SEQ ID NO: 723505 - DNA, 22 bp, Artificial Sequence
  chemically synthesized
tgtggcttcccatttatatgac

SEQ ID NO: 723506 - DNA, 22 bp, Artificial Sequence
  chemically synthesized
gtggcttcccatttatatgact

SEQ ID NO: 723507 - DNA, 22 bp, Artificial Sequence
  chemically synthesized
tggcttcccatttatatgactg

SEQ ID NO: 723508 - DNA, 22 bp, Artificial Sequence
  chemically synthesized
cccatttatatgactgaagcgc

SEQ ID NO: 723509 - DNA, 22 bp, Artificial Sequence
  chemically synthesized
ccatttatatgactgaagcgcg

SEQ ID NO: 723510 - DNA, 22 bp, Artificial Sequence
  chemically synthesized
atatgactgaagcgcgaactgt

SEQ ID NO: 723511 - DNA, 22 bp, Artificial Sequence
  chemically synthesized
tatgactgaagcgcgaactgtg

SEQ ID NO: 723512 - DNA, 22 bp, Artificial Sequence
  chemically synthesized
aagcgcgaactgtgtctatatg

SEQ ID NO: 723513 - DNA, 22 bp, Artificial Sequence
  chemically synthesized
cagtgtgcatgtgtgcatacac

SEQ ID NO: 723514 - DNA, 22 bp, Artificial Sequence
  chemically synthesized
tccagtgtgcatgtgtgcatac

SEQ ID NO: 723515 - DNA, 22 bp, Artificial Sequence
  chemically synthesized
tgtctatatgtgtatgcacaca

SEQ ID NO: 723516 - DNA, 22 bp, Artificial Sequence
  chemically synthesized
tctccagtgtgcatgtgtgcat

SEQ ID NO: 723517 - DNA, 22 bp, Artificial Sequence
  chemically synthesized
ctctccagtgtgcatgtgtgca

SEQ ID NO: 723518 - DNA, 22 bp, Artificial Sequence
  chemically synthesized
tctctccagtgtgcatgtgtgc

SEQ ID NO: 723519 - DNA, 22 bp, Artificial Sequence
  chemically synthesized
tatgtgtatgcacacatgcaca

SEQ ID NO: 723520 - DNA, 22 bp, Artificial Sequence
  chemically synthesized
tcctttctctccagtgtgcatg

SEQ ID NO: 723521 - DNA, 22 bp, Artificial Sequence
  chemically synthesized
gtcctttctctccagtgtgcat

SEQ ID NO: 723522 - DNA, 22 bp, Artificial Sequence
  chemically synthesized
tgtcctttctctccagtgtgca

SEQ ID NO: 723523 - DNA, 22 bp, Artificial Sequence
  chemically synthesized
ttgtcctttctctccagtgtgc

SEQ ID NO: 723524 - DNA, 22 bp, Artificial Sequence
  chemically synthesized
tggaatgatcttttgtcctttc

SEQ ID NO: 723525 - DNA, 22 bp, Artificial Sequence
  chemically synthesized
aattgtggaatgatcttttgtc

SEQ ID NO: 723526 - DNA, 22 bp, Artificial Sequence
  chemically synthesized
gagagaaaggacaaaagatcat

SEQ ID NO: 723527 - DNA, 22 bp, Artificial Sequence
  chemically synthesized
aagtctcaattgtggaatgatc

SEQ ID NO: 723528 - DNA, 22 bp, Artificial Sequence
  chemically synthesized
caagtctcaattgtggaatgat

SEQ ID NO: 723529 - DNA, 22 bp, Artificial Sequence
  chemically synthesized
gccttcaagtctcaattgtgga

SEQ ID NO: 723530 - DNA, 22 bp, Artificial Sequence
  chemically synthesized
agccttcaagtctcaattgtgg

SEQ ID NO: 723531 - DNA, 22 bp, Artificial Sequence
  chemically synthesized
cagtttagccttcaagtctcaa

SEQ ID NO: 723532 - DNA, 22 bp, Artificial Sequence
  chemically synthesized
acagtttagccttcaagtctca

SEQ ID NO: 723533 - DNA, 22 bp, Artificial Sequence
  chemically synthesized
cacaattgagacttgaaggcta

SEQ ID NO: 723534 - DNA, 22 bp, Artificial Sequence
  chemically synthesized
agacttgaaggctaaactgtaa

SEQ ID NO: 723535 - DNA, 22 bp, Artificial Sequence
  chemically synthesized
cgtacagccatcttacagttta

SEQ ID NO: 723536 - DNA, 22 bp, Artificial Sequence
  chemically synthesized
ttacgtacagccatcttacagt

SEQ ID NO: 723537 - DNA, 22 bp, Artificial Sequence
  chemically synthesized
attacgtacagccatcttacag

SEQ ID NO: 723538 - DNA, 22 bp, Artificial Sequence
  chemically synthesized
tattacgtacagccatcttaca

SEQ ID NO: 723539 - DNA, 22 bp, Artificial Sequence
  chemically synthesized
gaaggctaaactgtaagatggc

SEQ ID NO: 723540 - DNA, 22 bp, Artificial Sequence
  chemically synthesized
aaggctaaactgtaagatggct

SEQ ID NO: 723541 - DNA, 22 bp, Artificial Sequence
  chemically synthesized
gagctttattacgtacagccat

SEQ ID NO: 723542 - DNA, 22 bp, Artificial Sequence
  chemically synthesized
aactgtaagatggctgtacgta

SEQ ID NO: 723543 - DNA, 22 bp, Artificial Sequence
  chemically synthesized
taagatggctgtacgtaataaa

SEQ ID NO: 723544 - DNA, 22 bp, Artificial Sequence
  chemically synthesized
atagaggattagagctttatta

SEQ ID NO: 723545 - DNA, 22 bp, Artificial Sequence
  chemically synthesized
tacgtaataaagctctaatcct

SEQ ID NO: 723546 - DNA, 22 bp, Artificial Sequence
  chemically synthesized
aggagcctaatagaggattaga

SEQ ID NO: 723547 - DNA, 22 bp, Artificial Sequence
  chemically synthesized
caggagcctaatagaggattag

SEQ ID NO: 723548 - DNA, 22 bp, Artificial Sequence
  chemically synthesized
gatttcaggagcctaatagagg

SEQ ID NO: 723549 - DNA, 22 bp, Artificial Sequence
  chemically synthesized
taatcctctattaggctcctga

SEQ ID NO: 723550 - DNA, 22 bp, Artificial Sequence
  chemically synthesized
atcctctattaggctcctgaaa

SEQ ID NO: 723551 - DNA, 22 bp, Artificial Sequence
  chemically synthesized
aaccataaaacctagatttcag

SEQ ID NO: 723552 - DNA, 22 bp, Artificial Sequence
  chemically synthesized
tattaggctcctgaaatctagg

SEQ ID NO: 723553 - DNA, 22 bp, Artificial Sequence
  chemically synthesized
ctaaaccataaaacctagattt

SEQ ID NO: 723554 - DNA, 22 bp, Artificial Sequence
  chemically synthesized
ttaggctcctgaaatctaggtt

SEQ ID NO: 723555 - DNA, 22 bp, Artificial Sequence
  chemically synthesized
ggctcctgaaatctaggtttta

SEQ ID NO: 723556 - DNA, 22 bp, Artificial Sequence
  chemically synthesized
ctgaaatctaggttttatggtt

SEQ ID NO: 723557 - DNA, 22 bp, Artificial Sequence
  chemically synthesized
aaatctaggttttatggtttag

SEQ ID NO: 723558 - DNA, 22 bp, Artificial Sequence
  chemically synthesized
aaataatgaaaacattactaaa

SEQ ID NO: 723559 - DNA, 22 bp, Artificial Sequence
  chemically synthesized
gaaataatgaaaacattactaa

SEQ ID NO: 723560 - DNA, 22 bp, Artificial Sequence
  chemically synthesized
ggttttatggtttagtaatgtt

SEQ ID NO: 723561 - DNA, 22 bp, Artificial Sequence
  chemically synthesized
tgaaataatgaaaacattacta

SEQ ID NO: 723562 - DNA, 22 bp, Artificial Sequence
  chemically synthesized
tatggtttagtaatgttttcat

SEQ ID NO: 723563 - DNA, 22 bp, Artificial Sequence
  chemically synthesized
atggtttagtaatgttttcatt

SEQ ID NO: 723564 - DNA, 22 bp, Artificial Sequence
  chemically synthesized
agtctttgaaataatgaaaaca

SEQ ID NO: 723565 - DNA, 22 bp, Artificial Sequence
  chemically synthesized
tggtttagtaatgttttcatta

SEQ ID NO: 723566 - DNA, 22 bp, Artificial Sequence
  chemically synthesized
tgagtctttgaaataatgaaaa

SEQ ID NO: 723567 - DNA, 22 bp, Artificial Sequence
  chemically synthesized
agtaatgttttcattatttcaa

SEQ ID NO: 723568 - DNA, 22 bp, Artificial Sequence
  chemically synthesized
gtaatgttttcattatttcaaa

SEQ ID NO: 723569 - DNA, 22 bp, Artificial Sequence
  chemically synthesized
tcattatttcaaagactcagaa

SEQ ID NO: 723570 - DNA, 22 bp, Artificial Sequence
  chemically synthesized
agagagaaagaattctgagtct

SEQ ID NO: 723571 - DNA, 22 bp, Artificial Sequence
  chemically synthesized
cattatttcaaagactcagaat

SEQ ID NO: 723572 - DNA, 22 bp, Artificial Sequence
  chemically synthesized
attatttcaaagactcagaatt

SEQ ID NO: 723573 - DNA, 22 bp, Artificial Sequence
  chemically synthesized
tttcaaagactcagaattcttt

SEQ ID NO: 723574 - DNA, 22 bp, Artificial Sequence
  chemically synthesized
caaagactcagaattctttctc

SEQ ID NO: 723575 - DNA, 22 bp, Artificial Sequence
  chemically synthesized
tgatgcctcagagagaaagaat

SEQ ID NO: 723576 - DNA, 22 bp, Artificial Sequence
  chemically synthesized
aaagactcagaattctttctct

SEQ ID NO: 723577 - DNA, 22 bp, Artificial Sequence
  chemically synthesized
gtgatgcctcagagagaaagaa

SEQ ID NO: 723578 - DNA, 22 bp, Artificial Sequence
  chemically synthesized
tgtgatgcctcagagagaaaga

SEQ ID NO: 723579 - DNA, 22 bp, Artificial Sequence
  chemically synthesized
ttgtgatgcctcagagagaaag

SEQ ID NO: 723580 - DNA, 22 bp, Artificial Sequence
  chemically synthesized
agaattctttctctctgaggca

SEQ ID NO: 723581 - DNA, 22 bp, Artificial Sequence
  chemically synthesized
tggaagcttttgtgatgcctca

SEQ ID NO: 723582 - DNA, 22 bp, Artificial Sequence
  chemically synthesized
tatggaagcttttgtgatgcct

SEQ ID NO: 723583 - DNA, 22 bp, Artificial Sequence
  chemically synthesized
ctatggaagcttttgtgatgcc

SEQ ID NO: 723584 - DNA, 22 bp, Artificial Sequence
  chemically synthesized
tttctctctgaggcatcacaaa

SEQ ID NO: 723585 - DNA, 22 bp, Artificial Sequence
  chemically synthesized
tctctctgaggcatcacaaaag

SEQ ID NO: 723586 - DNA, 22 bp, Artificial Sequence
  chemically synthesized
tttctatggaagcttttgtgat

SEQ ID NO: 723587 - DNA, 22 bp, Artificial Sequence
  chemically synthesized
ctctctgaggcatcacaaaagc

SEQ ID NO: 723588 - DNA, 22 bp, Artificial Sequence
  chemically synthesized
tctctgaggcatcacaaaagct

SEQ ID NO: 723589 - DNA, 22 bp, Artificial Sequence
  chemically synthesized
tctgaggcatcacaaaagcttc

SEQ ID NO: 723590 - DNA, 22 bp, Artificial Sequence
  chemically synthesized
tctgtttctatggaagcttttg

SEQ ID NO: 723591 - DNA, 22 bp, Artificial Sequence
  chemically synthesized
tgaggcatcacaaaagcttcca

SEQ ID NO: 723592 - DNA, 22 bp, Artificial Sequence
  chemically synthesized
tatctgtttctatggaagcttt

SEQ ID NO: 723593 - DNA, 22 bp, Artificial Sequence
  chemically synthesized
aggcatcacaaaagcttccata

SEQ ID NO: 723594 - DNA, 22 bp, Artificial Sequence
  chemically synthesized
tctatctgtttctatggaagct

SEQ ID NO: 723595 - DNA, 22 bp, Artificial Sequence
  chemically synthesized
attctctatctgtttctatgga

SEQ ID NO: 723596 - DNA, 22 bp, Artificial Sequence
  chemically synthesized
gtgtgacattcattctctatct

SEQ ID NO: 723597 - DNA, 22 bp, Artificial Sequence
  chemically synthesized
ggtgtgacattcattctctatc

SEQ ID NO: 723598 - DNA, 22 bp, Artificial Sequence
  chemically synthesized
ccatagaaacagatagagaatg

SEQ ID NO: 723599 - DNA, 22 bp, Artificial Sequence
  chemically synthesized
catagaaacagatagagaatga

SEQ ID NO: 723600 - DNA, 22 bp, Artificial Sequence
  chemically synthesized
ttggtgtgacattcattctcta

SEQ ID NO: 723601 - DNA, 22 bp, Artificial Sequence
  chemically synthesized
ttcttggtgtgacattcattct

SEQ ID NO: 723602 - DNA, 22 bp, Artificial Sequence
  chemically synthesized
ctattcttggtgtgacattcat

SEQ ID NO: 723603 - DNA, 22 bp, Artificial Sequence
  chemically synthesized
cctattcttggtgtgacattca

SEQ ID NO: 723604 - DNA, 22 bp, Artificial Sequence
  chemically synthesized
tttcctattcttggtgtgacat

SEQ ID NO: 723605 - DNA, 22 bp, Artificial Sequence
  chemically synthesized
atttcctattcttggtgtgaca

SEQ ID NO: 723606 - DNA, 22 bp, Artificial Sequence
  chemically synthesized
tatttcctattcttggtgtgac

SEQ ID NO: 723607 - DNA, 22 bp, Artificial Sequence
  chemically synthesized
ctttatttcctattcttggtgt

SEQ ID NO: 723608 - DNA, 22 bp, Artificial Sequence
  chemically synthesized
gctttatttcctattcttggtg

SEQ ID NO: 723609 - DNA, 22 bp, Artificial Sequence
  chemically synthesized
tgctttatttcctattcttggt

SEQ ID NO: 723610 - DNA, 22 bp, Artificial Sequence
  chemically synthesized
tttgctttatttcctattcttg

SEQ ID NO: 723611 - DNA, 22 bp, Artificial Sequence
  chemically synthesized
ctttgctttatttcctattctt

SEQ ID NO: 723612 - DNA, 22 bp, Artificial Sequence
  chemically synthesized
tctttgctttatttcctattct

SEQ ID NO: 723613 - DNA, 22 bp, Artificial Sequence
  chemically synthesized
ttctttgctttatttcctattc

SEQ ID NO: 723614 - DNA, 22 bp, Artificial Sequence
  chemically synthesized
caaatttttctttgctttattt

SEQ ID NO: 723615 - DNA, 22 bp, Artificial Sequence
  chemically synthesized
actgcaaatttttctttgcttt

SEQ ID NO: 723616 - DNA, 22 bp, Artificial Sequence
  chemically synthesized
gttcactgcaaatttttctttg

SEQ ID NO: 723617 - DNA, 22 bp, Artificial Sequence
  chemically synthesized
atgactagttcactgcaaattt

SEQ ID NO: 723618 - DNA, 22 bp, Artificial Sequence
  chemically synthesized
attaatgactagttcactgcaa

SEQ ID NO: 723619 - DNA, 22 bp, Artificial Sequence
  chemically synthesized
cattaatgactagttcactgca

SEQ ID NO: 723620 - DNA, 22 bp, Artificial Sequence
  chemically synthesized
tcattaatgactagttcactgc

SEQ ID NO: 723621 - DNA, 22 bp, Artificial Sequence
  chemically synthesized
tacctttcattaatgactagtt

SEQ ID NO: 723622 - DNA, 22 bp, Artificial Sequence
  chemically synthesized
atacctttcattaatgactagt

SEQ ID NO: 723623 - DNA, 22 bp, Artificial Sequence
  chemically synthesized
tatacctttcattaatgactag

SEQ ID NO: 723624 - DNA, 22 bp, Artificial Sequence
  chemically synthesized
tttatacctttcattaatgact

SEQ ID NO: 723625 - DNA, 22 bp, Artificial Sequence
  chemically synthesized
gcagtgaactagtcattaatga

SEQ ID NO: 723626 - DNA, 22 bp, Artificial Sequence
  chemically synthesized
cagtgaactagtcattaatgaa

SEQ ID NO: 723627 - DNA, 22 bp, Artificial Sequence
  chemically synthesized
catgcactctttatacctttca

SEQ ID NO: 723628 - DNA, 22 bp, Artificial Sequence
  chemically synthesized
gcatgcactctttatacctttc

SEQ ID NO: 723629 - DNA, 22 bp, Artificial Sequence
  chemically synthesized
tgcatgcactctttataccttt

SEQ ID NO: 723630 - DNA, 22 bp, Artificial Sequence
  chemically synthesized
gtcattaatgaaaggtataaag

SEQ ID NO: 723631 - DNA, 22 bp, Artificial Sequence
  chemically synthesized
acattttgcatgcactctttat

SEQ ID NO: 723632 - DNA, 22 bp, Artificial Sequence
  chemically synthesized
atgaaaggtataaagagtgcat

SEQ ID NO: 723633 - DNA, 22 bp, Artificial Sequence
  chemically synthesized
ttaacattttgcatgcactctt

SEQ ID NO: 723634 - DNA, 22 bp, Artificial Sequence
  chemically synthesized
attaacattttgcatgcactct

SEQ ID NO: 723635 - DNA, 22 bp, Artificial Sequence
  chemically synthesized
atgatttattaacattttgcat

SEQ ID NO: 723636 - DNA, 22 bp, Artificial Sequence
  chemically synthesized
aatgatttattaacattttgca

SEQ ID NO: 723637 - DNA, 22 bp, Artificial Sequence
  chemically synthesized
taatgatttattaacattttgc

SEQ ID NO: 723638 - DNA, 22 bp, Artificial Sequence
  chemically synthesized
ttaatgatttattaacattttg

SEQ ID NO: 723639 - DNA, 22 bp, Artificial Sequence
  chemically synthesized
accttttaatgatttattaaca

SEQ ID NO: 723640 - DNA, 22 bp, Artificial Sequence
  chemically synthesized
ctaaccttttaatgatttatta

SEQ ID NO: 723641 - DNA, 22 bp, Artificial Sequence
  chemically synthesized
cctaaccttttaatgatttatt

SEQ ID NO: 723642 - DNA, 22 bp, Artificial Sequence
  chemically synthesized
tcctaaccttttaatgatttat

SEQ ID NO: 723643 - DNA, 22 bp, Artificial Sequence
  chemically synthesized
gaaactttcctaaccttttaat

SEQ ID NO: 723644 - DNA, 22 bp, Artificial Sequence
  chemically synthesized
ctggaaactttcctaacctttt

SEQ ID NO: 723645 - DNA, 22 bp, Artificial Sequence
  chemically synthesized
gctggaaactttcctaaccttt

SEQ ID NO: 723646 - DNA, 22 bp, Artificial Sequence
  chemically synthesized
ataaatcattaaaaggttagga

SEQ ID NO: 723647 - DNA, 22 bp, Artificial Sequence
  chemically synthesized
cttgctggaaactttcctaacc

SEQ ID NO: 723648 - DNA, 22 bp, Artificial Sequence
  chemically synthesized
ccttgctggaaactttcctaac

SEQ ID NO: 723649 - DNA, 22 bp, Artificial Sequence
  chemically synthesized
ttccttgctggaaactttccta

SEQ ID NO: 723650 - DNA, 22 bp, Artificial Sequence
  chemically synthesized
aaaggttaggaaagtttccagc

SEQ ID NO: 723651 - DNA, 22 bp, Artificial Sequence
  chemically synthesized
agagacctcttccttgctggaa

SEQ ID NO: 723652 - DNA, 22 bp, Artificial Sequence
  chemically synthesized
gctcagagacctcttccttgct

SEQ ID NO: 723653 - DNA, 22 bp, Artificial Sequence
  chemically synthesized
ggaaagtttccagcaaggaaga

SEQ ID NO: 723654 - DNA, 22 bp, Artificial Sequence
  chemically synthesized
ggctcagagacctcttccttgc

SEQ ID NO: 723655 - DNA, 22 bp, Artificial Sequence
  chemically synthesized
tggctcagagacctcttccttg

SEQ ID NO: 723656 - DNA, 22 bp, Artificial Sequence
  chemically synthesized
ttggctcagagacctcttcctt

SEQ ID NO: 723657 - DNA, 22 bp, Artificial Sequence
  chemically synthesized
aaccttttggctcagagacctc

SEQ ID NO: 723658 - DNA, 22 bp, Artificial Sequence
  chemically synthesized
ccagcaaggaagaggtctctga

SEQ ID NO: 723659 - DNA, 22 bp, Artificial Sequence
  chemically synthesized
cagcaaggaagaggtctctgag

SEQ ID NO: 723660 - DNA, 22 bp, Artificial Sequence
  chemically synthesized
tcctcaaccttttggctcagag

SEQ ID NO: 723661 - DNA, 22 bp, Artificial Sequence
  chemically synthesized
ttatcctcaaccttttggctca

SEQ ID NO: 723662 - DNA, 22 bp, Artificial Sequence
  chemically synthesized
gttatcctcaaccttttggctc

SEQ ID NO: 723663 - DNA, 22 bp, Artificial Sequence
  chemically synthesized
tgagccaaaaggttgaggataa

SEQ ID NO: 723664 - DNA, 22 bp, Artificial Sequence
  chemically synthesized
agccaaaaggttgaggataaca

SEQ ID NO: 723665 - DNA, 22 bp, Artificial Sequence
  chemically synthesized
aatgaggtaccttgttatcctc

SEQ ID NO: 723666 - DNA, 22 bp, Artificial Sequence
  chemically synthesized
aggataacaaggtacctcattc

SEQ ID NO: 723667 - DNA, 22 bp, Artificial Sequence
  chemically synthesized
attcagccatattctgtcatca

SEQ ID NO: 723668 - DNA, 22 bp, Artificial Sequence
  chemically synthesized
agccatattctgtcatcatctc

SEQ ID NO: 723669 - DNA, 22 bp, Artificial Sequence
  chemically synthesized
aaaacaatgatatgtggagatg

SEQ ID NO: 723670 - DNA, 22 bp, Artificial Sequence
  chemically synthesized
caaaacaatgatatgtggagat

SEQ ID NO: 723671 - DNA, 22 bp, Artificial Sequence
  chemically synthesized
tgtcatcatctccacatatcat

SEQ ID NO: 723672 - DNA, 22 bp, Artificial Sequence
  chemically synthesized
aaatttcaaaacaatgatatgt

SEQ ID NO: 723673 - DNA, 22 bp, Artificial Sequence
  chemically synthesized
tcatcatctccacatatcattg

SEQ ID NO: 723674 - DNA, 22 bp, Artificial Sequence
  chemically synthesized
catattaaaatttcaaaacaat

SEQ ID NO: 723675 - DNA, 22 bp, Artificial Sequence
  chemically synthesized
ccatattaaaatttcaaaacaa

SEQ ID NO: 723676 - DNA, 22 bp, Artificial Sequence
  chemically synthesized
tccatattaaaatttcaaaaca

SEQ ID NO: 723677 - DNA, 22 bp, Artificial Sequence
  chemically synthesized
cacatatcattgttttgaaatt

SEQ ID NO: 723678 - DNA, 22 bp, Artificial Sequence
  chemically synthesized
ctttccatattaaaatttcaaa

SEQ ID NO: 723679 - DNA, 22 bp, Artificial Sequence
  chemically synthesized
ttttgaaattttaatatggaaa

SEQ ID NO: 723680 - DNA, 22 bp, Artificial Sequence
  chemically synthesized
aaagaatgacctgctttccata

SEQ ID NO: 723681 - DNA, 22 bp, Artificial Sequence
  chemically synthesized
tgaaattttaatatggaaagca

SEQ ID NO: 723682 - DNA, 22 bp, Artificial Sequence
  chemically synthesized
aaaagaatgacctgctttccat

SEQ ID NO: 723683 - DNA, 22 bp, Artificial Sequence
  chemically synthesized
gaaattttaatatggaaagcag

SEQ ID NO: 723684 - DNA, 22 bp, Artificial Sequence
  chemically synthesized
taaaagaatgacctgctttcca

SEQ ID NO: 723685 - DNA, 22 bp, Artificial Sequence
  chemically synthesized
aaattttaatatggaaagcagg

SEQ ID NO: 723686 - DNA, 22 bp, Artificial Sequence
  chemically synthesized
ttaaaagaatgacctgctttcc

SEQ ID NO: 723687 - DNA, 22 bp, Artificial Sequence
  chemically synthesized
tttaaaagaatgacctgctttc

SEQ ID NO: 723688 - DNA, 22 bp, Artificial Sequence
  chemically synthesized
taatatggaaagcaggtcattc

SEQ ID NO: 723689 - DNA, 22 bp, Artificial Sequence
  chemically synthesized
agttttttaaaagaatgacctg

SEQ ID NO: 723690 - DNA, 22 bp, Artificial Sequence
  chemically synthesized
aatatggaaagcaggtcattct

SEQ ID NO: 723691 - DNA, 22 bp, Artificial Sequence
  chemically synthesized
atatggaaagcaggtcattctt

SEQ ID NO: 723692 - DNA, 22 bp, Artificial Sequence
  chemically synthesized
gatgcagttcagttttttaaaa

SEQ ID NO: 723693 - DNA, 22 bp, Artificial Sequence
  chemically synthesized
agatgcagttcagttttttaaa

SEQ ID NO: 723694 - DNA, 22 bp, Artificial Sequence
  chemically synthesized
tagatgcagttcagttttttaa

SEQ ID NO: 723695 - DNA, 22 bp, Artificial Sequence
  chemically synthesized
attttagatgcagttcagtttt

SEQ ID NO: 723696 - DNA, 22 bp, Artificial Sequence
  chemically synthesized
attgattttagatgcagttcag

SEQ ID NO: 723697 - DNA, 22 bp, Artificial Sequence
  chemically synthesized
ttttaaaaaactgaactgcatc

SEQ ID NO: 723698 - DNA, 22 bp, Artificial Sequence
  chemically synthesized
ttaaaaaactgaactgcatcta

SEQ ID NO: 723699 - DNA, 22 bp, Artificial Sequence
  chemically synthesized
taaaaaactgaactgcatctaa

SEQ ID NO: 723700 - DNA, 22 bp, Artificial Sequence
  chemically synthesized
aaaaaactgaactgcatctaaa

SEQ ID NO: 723701 - DNA, 22 bp, Artificial Sequence
  chemically synthesized
aaaaactgaactgcatctaaaa

SEQ ID NO: 723702 - DNA, 22 bp, Artificial Sequence
  chemically synthesized
aactgcatctaaaatcaattag

SEQ ID NO: 723703 - DNA, 22 bp, Artificial Sequence
  chemically synthesized
catctaaaatcaattagatctc

SEQ ID NO: 723704 - DNA, 22 bp, Artificial Sequence
  chemically synthesized
aaatcaattagatctcatgatc

SEQ ID NO: 723705 - DNA, 22 bp, Artificial Sequence
  chemically synthesized
agatgaggtgaacatgtagatc

SEQ ID NO: 723706 - DNA, 22 bp, Artificial Sequence
  chemically synthesized
gatctcatgatctacatgttca

SEQ ID NO: 723707 - DNA, 22 bp, Artificial Sequence
  chemically synthesized
tgccctaagatgaggtgaacat

SEQ ID NO: 723708 - DNA, 22 bp, Artificial Sequence
  chemically synthesized
atgatctacatgttcacctcat

SEQ ID NO: 723709 - DNA, 22 bp, Artificial Sequence
  chemically synthesized
tactgtgccctaagatgaggtg

SEQ ID NO: 723710 - DNA, 22 bp, Artificial Sequence
  chemically synthesized
ctatactgtgccctaagatgag

SEQ ID NO: 723711 - DNA, 22 bp, Artificial Sequence
  chemically synthesized
actatactgtgccctaagatga

SEQ ID NO: 723712 - DNA, 22 bp, Artificial Sequence
  chemically synthesized
catgttcacctcatcttagggc

SEQ ID NO: 723713 - DNA, 22 bp, Artificial Sequence
  chemically synthesized
acctcatcttagggcacagtat

SEQ ID NO: 723714 - DNA, 22 bp, Artificial Sequence
  chemically synthesized
agatcatttactatactgtgcc

SEQ ID NO: 723715 - DNA, 22 bp, Artificial Sequence
  chemically synthesized
atcttagggcacagtatagtaa

SEQ ID NO: 723716 - DNA, 22 bp, Artificial Sequence
  chemically synthesized
aacaagttaagatcatttacta

SEQ ID NO: 723717 - DNA, 22 bp, Artificial Sequence
  chemically synthesized
agggcacagtatagtaaatgat

SEQ ID NO: 723718 - DNA, 22 bp, Artificial Sequence
  chemically synthesized
aaacaagttaagatcatttact

SEQ ID NO: 723719 - DNA, 22 bp, Artificial Sequence
  chemically synthesized
gggcacagtatagtaaatgatc

SEQ ID NO: 723720 - DNA, 22 bp, Artificial Sequence
  chemically synthesized
taaacaagttaagatcatttac

SEQ ID NO: 723721 - DNA, 22 bp, Artificial Sequence
  chemically synthesized
aacttgtttaaaatattttttc

SEQ ID NO: 723722 - DNA, 22 bp, Artificial Sequence
  chemically synthesized
acttgtttaaaatattttttct

SEQ ID NO: 723723 - DNA, 22 bp, Artificial Sequence
  chemically synthesized
gtttaaaatattttttcttggc

SEQ ID NO: 723724 - DNA, 22 bp, Artificial Sequence
  chemically synthesized
tttaaaatattttttcttggct

SEQ ID NO: 723725 - DNA, 22 bp, Artificial Sequence
  chemically synthesized
aaaatattttttcttggctggg

SEQ ID NO: 723726 - DNA, 22 bp, Artificial Sequence
  chemically synthesized
aaatattttttcttggctgggc

SEQ ID NO: 723727 - DNA, 22 bp, Artificial Sequence
  chemically synthesized
tttcttggctgggcatggtggc

SEQ ID NO: 723728 - DNA, 22 bp, Artificial Sequence
  chemically synthesized
ttcttggctgggcatggtggct

SEQ ID NO: 723729 - DNA, 22 bp, Artificial Sequence
  chemically synthesized
tcttggctgggcatggtggctc

SEQ ID NO: 723730 - DNA, 22 bp, Artificial Sequence
  chemically synthesized
cttggctgggcatggtggctca

SEQ ID NO: 723731 - DNA, 22 bp, Artificial Sequence
  chemically synthesized
ggatgacaggcatgagccacca

SEQ ID NO: 723732 - DNA, 22 bp, Artificial Sequence
  chemically synthesized
ttggctgggcatggtggctcat

SEQ ID NO: 723733 - DNA, 22 bp, Artificial Sequence
  chemically synthesized
ggctgggcatggtggctcatgc

SEQ ID NO: 723734 - DNA, 22 bp, Artificial Sequence
  chemically synthesized
gctgggcatggtggctcatgcc

SEQ ID NO: 723735 - DNA, 22 bp, Artificial Sequence
  chemically synthesized
ggcatggtggctcatgcctgtc

SEQ ID NO: 723736 - DNA, 22 bp, Artificial Sequence
  chemically synthesized
ccaaagtgctgggatgacaggc

SEQ ID NO: 723737 - DNA, 22 bp, Artificial Sequence
  chemically synthesized
ggcctcccaaagtgctgggatg

SEQ ID NO: 723738 - DNA, 22 bp, Artificial Sequence
  chemically synthesized
atgcctgtcatcccagcacttt

SEQ ID NO: 723739 - DNA, 22 bp, Artificial Sequence
  chemically synthesized
cctcggcctcccaaagtgctgg

SEQ ID NO: 723740 - DNA, 22 bp, Artificial Sequence
  chemically synthesized
tcatcccagcactttgggaggc

SEQ ID NO: 723741 - DNA, 22 bp, Artificial Sequence
  chemically synthesized
tgatccacctgcctcggcctcc

SEQ ID NO: 723742 - DNA, 22 bp, Artificial Sequence
  chemically synthesized
gtgatccacctgcctcggcctc

SEQ ID NO: 723743 - DNA, 22 bp, Artificial Sequence
  chemically synthesized
atcttgtgatccacctgcctcg

SEQ ID NO: 723744 - DNA, 22 bp, Artificial Sequence
  chemically synthesized
ctgatcttgtgatccacctgcc

SEQ ID NO: 723745 - DNA, 22 bp, Artificial Sequence
  chemically synthesized
tgggaggccgaggcaggtggat

SEQ ID NO: 723746 - DNA, 22 bp, Artificial Sequence
  chemically synthesized
gggaggccgaggcaggtggatc

SEQ ID NO: 723747 - DNA, 22 bp, Artificial Sequence
  chemically synthesized
ggaggccgaggcaggtggatca

SEQ ID NO: 723748 - DNA, 22 bp, Artificial Sequence
  chemically synthesized
gaactcctgatcttgtgatcca

SEQ ID NO: 723749 - DNA, 22 bp, Artificial Sequence
  chemically synthesized
gtctcgaactcctgatcttgtg

SEQ ID NO: 723750 - DNA, 22 bp, Artificial Sequence
  chemically synthesized
gccaggctggtctcgaactcct

SEQ ID NO: 723751 - DNA, 22 bp, Artificial Sequence
  chemically synthesized
ggccaggctggtctcgaactcc

SEQ ID NO: 723752 - DNA, 22 bp, Artificial Sequence
  chemically synthesized
accatatttggccaggctggtc

SEQ ID NO: 723753 - DNA, 22 bp, Artificial Sequence
  chemically synthesized
caccatatttggccaggctggt

SEQ ID NO: 723754 - DNA, 22 bp, Artificial Sequence
  chemically synthesized
gagaccagcctggccaaatatg

SEQ ID NO: 723755 - DNA, 22 bp, Artificial Sequence
  chemically synthesized
gtggagaccgggtttcaccata

SEQ ID NO: 723756 - DNA, 22 bp, Artificial Sequence
  chemically synthesized
agtggagaccgggtttcaccat

SEQ ID NO: 723757 - DNA, 22 bp, Artificial Sequence
  chemically synthesized
tagtggagaccgggtttcacca

SEQ ID NO: 723758 - DNA, 22 bp, Artificial Sequence
  chemically synthesized
ttagtggagaccgggtttcacc

SEQ ID NO: 723759 - DNA, 22 bp, Artificial Sequence
  chemically synthesized
gccaaatatggtgaaacccggt

SEQ ID NO: 723760 - DNA, 22 bp, Artificial Sequence
  chemically synthesized
tatttttagtggagaccgggtt

SEQ ID NO: 723761 - DNA, 22 bp, Artificial Sequence
  chemically synthesized
gtatttttagtggagaccgggt

SEQ ID NO: 723762 - DNA, 22 bp, Artificial Sequence
  chemically synthesized
tgtatttttagtggagaccggg

SEQ ID NO: 723763 - DNA, 22 bp, Artificial Sequence
  chemically synthesized
ttgtatttttagtggagaccgg

SEQ ID NO: 723764 - DNA, 22 bp, Artificial Sequence
  chemically synthesized
atttttgtatttttagtggaga

SEQ ID NO: 723765 - DNA, 22 bp, Artificial Sequence
  chemically synthesized
cactaaaaatacaaaaattagc

SEQ ID NO: 723766 - DNA, 22 bp, Artificial Sequence
  chemically synthesized
aaaatacaaaaattagccgggc

SEQ ID NO: 723767 - DNA, 22 bp, Artificial Sequence
  chemically synthesized
caggcgtccgccaccatgcccg

SEQ ID NO: 723768 - DNA, 22 bp, Artificial Sequence
  chemically synthesized
ggactacaggcgtccgccacca

SEQ ID NO: 723769 - DNA, 22 bp, Artificial Sequence
  chemically synthesized
gccgggcatggtggcggacgcc

SEQ ID NO: 723770 - DNA, 22 bp, Artificial Sequence
  chemically synthesized
cagagtagctgggactacaggc

SEQ ID NO: 723771 - DNA, 22 bp, Artificial Sequence
  chemically synthesized
agcctccagagtagctgggact

SEQ ID NO: 723772 - DNA, 22 bp, Artificial Sequence
  chemically synthesized
cctcagcctccagagtagctgg

SEQ ID NO: 723773 - DNA, 22 bp, Artificial Sequence
  chemically synthesized
ccctgcctcagcctccagagta

SEQ ID NO: 723774 - DNA, 22 bp, Artificial Sequence
  chemically synthesized
tagtcccagctactctggaggc

SEQ ID NO: 723775 - DNA, 22 bp, Artificial Sequence
  chemically synthesized
agcaattcccctgcctcagcct

SEQ ID NO: 723776 - DNA, 22 bp, Artificial Sequence
  chemically synthesized
aagcaattcccctgcctcagcc

SEQ ID NO: 723777 - DNA, 22 bp, Artificial Sequence
  chemically synthesized
ctctggaggctgaggcagggga

SEQ ID NO: 723778 - DNA, 22 bp, Artificial Sequence
  chemically synthesized
ggtttaagcaattcccctgcct

SEQ ID NO: 723779 - DNA, 22 bp, Artificial Sequence
  chemically synthesized
tggaggctgaggcaggggaatt

SEQ ID NO: 723780 - DNA, 22 bp, Artificial Sequence
  chemically synthesized
ctgggtttaagcaattcccctg

SEQ ID NO: 723781 - DNA, 22 bp, Artificial Sequence
  chemically synthesized
gaggctgaggcaggggaattgc

SEQ ID NO: 723782 - DNA, 22 bp, Artificial Sequence
  chemically synthesized
tctcctgggtttaagcaattcc

SEQ ID NO: 723783 - DNA, 22 bp, Artificial Sequence
  chemically synthesized
tgtctcctgggtttaagcaatt

SEQ ID NO: 723784 - DNA, 22 bp, Artificial Sequence
  chemically synthesized
aggcaggggaattgcttaaacc

SEQ ID NO: 723785 - DNA, 22 bp, Artificial Sequence
  chemically synthesized
caacctctgtctcctgggttta

SEQ ID NO: 723786 - DNA, 22 bp, Artificial Sequence
  chemically synthesized
actgcaacctctgtctcctggg

SEQ ID NO: 723787 - DNA, 22 bp, Artificial Sequence
  chemically synthesized
ggctcactgcaacctctgtctc

SEQ ID NO: 723788 - DNA, 22 bp, Artificial Sequence
  chemically synthesized
cttaaacccaggagacagaggt

SEQ ID NO: 723789 - DNA, 22 bp, Artificial Sequence
  chemically synthesized
aaacccaggagacagaggttgc

SEQ ID NO: 723790 - DNA, 22 bp, Artificial Sequence
  chemically synthesized
aacccaggagacagaggttgca

SEQ ID NO: 723791 - DNA, 22 bp, Artificial Sequence
  chemically synthesized
cagtgagccgagattgcgccac

SEQ ID NO: 723792 - DNA, 22 bp, Artificial Sequence
  chemically synthesized
tcgcccaggccagagtgcagtg

SEQ ID NO: 723793 - DNA, 22 bp, Artificial Sequence
  chemically synthesized
tgtcgcccaggccagagtgcag

SEQ ID NO: 723794 - DNA, 22 bp, Artificial Sequence
  chemically synthesized
actctgtcgcccaggccagagt

SEQ ID NO: 723795 - DNA, 22 bp, Artificial Sequence
  chemically synthesized
cgccactgcactctggcctggg

SEQ ID NO: 723796 - DNA, 22 bp, Artificial Sequence
  chemically synthesized
cactctggcctgggcgacagag

SEQ ID NO: 723797 - DNA, 22 bp, Artificial Sequence
  chemically synthesized
agatggagtctcactctgtcgc

SEQ ID NO: 723798 - DNA, 22 bp, Artificial Sequence
  chemically synthesized
gagatggagtctcactctgtcg

SEQ ID NO: 723799 - DNA, 22 bp, Artificial Sequence
  chemically synthesized
tgagatggagtctcactctgtc

SEQ ID NO: 723800 - DNA, 22 bp, Artificial Sequence
  chemically synthesized
ttgagatggagtctcactctgt

SEQ ID NO: 723801 - DNA, 22 bp, Artificial Sequence
  chemically synthesized
tggcctgggcgacagagtgaga

SEQ ID NO: 723802 - DNA, 22 bp, Artificial Sequence
  chemically synthesized
tttgagatggagtctcactctg

SEQ ID NO: 723803 - DNA, 22 bp, Artificial Sequence
  chemically synthesized
ttttgagatggagtctcactct

SEQ ID NO: 723804 - DNA, 22 bp, Artificial Sequence
  chemically synthesized
gcctgggcgacagagtgagact

SEQ ID NO: 723805 - DNA, 22 bp, Artificial Sequence
  chemically synthesized
tttttgagatggagtctcactc

SEQ ID NO: 723806 - DNA, 22 bp, Artificial Sequence
  chemically synthesized
ttttttgagatggagtctcact

SEQ ID NO: 723807 - DNA, 22 bp, Artificial Sequence
  chemically synthesized
tttttttgagatggagtctcac

SEQ ID NO: 723808 - DNA, 22 bp, Artificial Sequence
  chemically synthesized
ttttttttgagatggagtctca

SEQ ID NO: 723809 - DNA, 22 bp, Artificial Sequence
  chemically synthesized
tttttttttgagatggagtctc

SEQ ID NO: 723810 - DNA, 22 bp, Artificial Sequence
  chemically synthesized
ggcgacagagtgagactccatc

SEQ ID NO: 723811 - DNA, 22 bp, Artificial Sequence
  chemically synthesized
ttttttttttgagatggagtct

SEQ ID NO: 723812 - DNA, 22 bp, Artificial Sequence
  chemically synthesized
tttttttttttgagatggagtc

SEQ ID NO: 723813 - DNA, 22 bp, Artificial Sequence
  chemically synthesized
ttttttttttttgagatggagt

SEQ ID NO: 723814 - DNA, 22 bp, Artificial Sequence
  chemically synthesized
tttttttttttttttgagatgg

SEQ ID NO: 723815 - DNA, 22 bp, Artificial Sequence
  chemically synthesized
gtttttttttttttttgagatg

SEQ ID NO: 723816 - DNA, 22 bp, Artificial Sequence
  chemically synthesized
tgtttttttttttttttgagat

SEQ ID NO: 723817 - DNA, 22 bp, Artificial Sequence
  chemically synthesized
ttgtttttttttttttttgaga

SEQ ID NO: 723818 - DNA, 22 bp, Artificial Sequence
  chemically synthesized
tttgtttttttttttttttgag

SEQ ID NO: 723819 - DNA, 22 bp, Artificial Sequence
  chemically synthesized
ttttgtttttttttttttttga

SEQ ID NO: 723820 - DNA, 22 bp, Artificial Sequence
  chemically synthesized
tttttgtttttttttttttttg

SEQ ID NO: 723821 - DNA, 22 bp, Artificial Sequence
  chemically synthesized
ttttttgttttttttttttttt

SEQ ID NO: 723822 - DNA, 22 bp, Artificial Sequence
  chemically synthesized
tttttttgtttttttttttttt

SEQ ID NO: 723823 - DNA, 22 bp, Artificial Sequence
  chemically synthesized
ttttttttgttttttttttttt

SEQ ID NO: 723824 - DNA, 22 bp, Artificial Sequence
  chemically synthesized
tttttttttgtttttttttttt

SEQ ID NO: 723825 - DNA, 22 bp, Artificial Sequence
  chemically synthesized
catctcaaaaaaaaaaaaaaac

SEQ ID NO: 723826 - DNA, 22 bp, Artificial Sequence
  chemically synthesized
ttttttttttttgttttttttt

SEQ ID NO: 723827 - DNA, 22 bp, Artificial Sequence
  chemically synthesized
gttttttttttttgtttttttt

SEQ ID NO: 723828 - DNA, 22 bp, Artificial Sequence
  chemically synthesized
aaaaaaaaaaaaaaacaaaaaa

SEQ ID NO: 723829 - DNA, 22 bp, Artificial Sequence
  chemically synthesized
ggtttgttttttttttttgttt

SEQ ID NO: 723830 - DNA, 22 bp, Artificial Sequence
  chemically synthesized
agaaaaagttgggtttgttttt

SEQ ID NO: 723831 - DNA, 22 bp, Artificial Sequence
  chemically synthesized
aagaaaaagttgggtttgtttt

SEQ ID NO: 723832 - DNA, 22 bp, Artificial Sequence
  chemically synthesized
taagaaaaagttgggtttgttt

SEQ ID NO: 723833 - DNA, 22 bp, Artificial Sequence
  chemically synthesized
attttaagaaaaagttgggttt

SEQ ID NO: 723834 - DNA, 22 bp, Artificial Sequence
  chemically synthesized
gattttaagaaaaagttgggtt

SEQ ID NO: 723835 - DNA, 22 bp, Artificial Sequence
  chemically synthesized
tggaatatttgattttaagaaa

SEQ ID NO: 723836 - DNA, 22 bp, Artificial Sequence
  chemically synthesized
tttcttaaaatcaaatattcca

SEQ ID NO: 723837 - DNA, 22 bp, Artificial Sequence
  chemically synthesized
ttcttaaaatcaaatattccat

SEQ ID NO: 723838 - DNA, 22 bp, Artificial Sequence
  chemically synthesized
tcttaaaatcaaatattccata

SEQ ID NO: 723839 - DNA, 22 bp, Artificial Sequence
  chemically synthesized
atcacaccatcctatggaatat

SEQ ID NO: 723840 - DNA, 22 bp, Artificial Sequence
  chemically synthesized
cttaaaatcaaatattccatag

SEQ ID NO: 723841 - DNA, 22 bp, Artificial Sequence
  chemically synthesized
ttaaaatcaaatattccatagg

SEQ ID NO: 723842 - DNA, 22 bp, Artificial Sequence
  chemically synthesized
aaaatcaaatattccataggat

SEQ ID NO: 723843 - DNA, 22 bp, Artificial Sequence
  chemically synthesized
aaatcaaatattccataggatg

SEQ ID NO: 723844 - DNA, 22 bp, Artificial Sequence
  chemically synthesized
atatgtgaatgctcatcacacc

SEQ ID NO: 723845 - DNA, 22 bp, Artificial Sequence
  chemically synthesized
gatatgtgaatgctcatcacac

SEQ ID NO: 723846 - DNA, 22 bp, Artificial Sequence
  chemically synthesized
ttgatatgtgaatgctcatcac

SEQ ID NO: 723847 - DNA, 22 bp, Artificial Sequence
  chemically synthesized
cataggatggtgtgatgagcat

SEQ ID NO: 723848 - DNA, 22 bp, Artificial Sequence
  chemically synthesized
tcttgatatgtgaatgctcatc

SEQ ID NO: 723849 - DNA, 22 bp, Artificial Sequence
  chemically synthesized
acatatcaagagaatacatcat

SEQ ID NO: 723850 - DNA, 22 bp, Artificial Sequence
  chemically synthesized
atatgatgatgacgatgatgat

SEQ ID NO: 723851 - DNA, 22 bp, Artificial Sequence
  chemically synthesized
ttgatatgatgatgacgatgat

SEQ ID NO: 723852 - DNA, 22 bp, Artificial Sequence
  chemically synthesized
gttgttgatatgatgatgacga

SEQ ID NO: 723853 - DNA, 22 bp, Artificial Sequence
  chemically synthesized
tagttgttgatatgatgatgac

SEQ ID NO: 723854 - DNA, 22 bp, Artificial Sequence
  chemically synthesized
ctagttgttgatatgatgatga

SEQ ID NO: 723855 - DNA, 22 bp, Artificial Sequence
  chemically synthesized
aataatttctagttgttgatat

SEQ ID NO: 723856 - DNA, 22 bp, Artificial Sequence
  chemically synthesized
gtattcaataatttctagttgt

SEQ ID NO: 723857 - DNA, 22 bp, Artificial Sequence
  chemically synthesized
gtgtatagttggtattcaataa

SEQ ID NO: 723858 - DNA, 22 bp, Artificial Sequence
  chemically synthesized
gaaattattgaataccaactat

SEQ ID NO: 723859 - DNA, 22 bp, Artificial Sequence
  chemically synthesized
ttgaataccaactatacaccag

SEQ ID NO: 723860 - DNA, 22 bp, Artificial Sequence
  chemically synthesized
aataccaactatacaccaggtg

SEQ ID NO: 723861 - DNA, 22 bp, Artificial Sequence
  chemically synthesized
caaaatgcaaagtggagcacct

SEQ ID NO: 723862 - DNA, 22 bp, Artificial Sequence
  chemically synthesized
gcaaaatgcaaagtggagcacc

SEQ ID NO: 723863 - DNA, 22 bp, Artificial Sequence
  chemically synthesized
tacaccaggtgctccactttgc

SEQ ID NO: 723864 - DNA, 22 bp, Artificial Sequence
  chemically synthesized
gatgagacaatgcttgcaaaat

SEQ ID NO: 723865 - DNA, 22 bp, Artificial Sequence
  chemically synthesized
cactttgcattttgcaagcatt

SEQ ID NO: 723866 - DNA, 22 bp, Artificial Sequence
  chemically synthesized
aggattagatgagacaatgctt

SEQ ID NO: 723867 - DNA, 22 bp, Artificial Sequence
  chemically synthesized
tgcattttgcaagcattgtctc

SEQ ID NO: 723868 - DNA, 22 bp, Artificial Sequence
  chemically synthesized
gcattttgcaagcattgtctca

SEQ ID NO: 723869 - DNA, 22 bp, Artificial Sequence
  chemically synthesized
cattttgcaagcattgtctcat

SEQ ID NO: 723870 - DNA, 22 bp, Artificial Sequence
  chemically synthesized
tctgaggattagatgagacaat

SEQ ID NO: 723871 - DNA, 22 bp, Artificial Sequence
  chemically synthesized
tgcaagcattgtctcatctaat

SEQ ID NO: 723872 - DNA, 22 bp, Artificial Sequence
  chemically synthesized
gcaagcattgtctcatctaatc

SEQ ID NO: 723873 - DNA, 22 bp, Artificial Sequence
  chemically synthesized
caagcattgtctcatctaatcc

SEQ ID NO: 723874 - DNA, 22 bp, Artificial Sequence
  chemically synthesized
aaagagttgtctgaggattaga

SEQ ID NO: 723875 - DNA, 22 bp, Artificial Sequence
  chemically synthesized
gctcaaagagttgtctgaggat

SEQ ID NO: 723876 - DNA, 22 bp, Artificial Sequence
  chemically synthesized
tctcatctaatcctcagacaac

SEQ ID NO: 723877 - DNA, 22 bp, Artificial Sequence
  chemically synthesized
atctaatcctcagacaactctt

SEQ ID NO: 723878 - DNA, 22 bp, Artificial Sequence
  chemically synthesized
atcctcagacaactctttgagc

SEQ ID NO: 723879 - DNA, 22 bp, Artificial Sequence
  chemically synthesized
agacaactctttgagcgagtgc

SEQ ID NO: 723880 - DNA, 22 bp, Artificial Sequence
  chemically synthesized
aataggagtaataatagcactc

SEQ ID NO: 723881 - DNA, 22 bp, Artificial Sequence
  chemically synthesized
ttcaataggagtaataatagca

SEQ ID NO: 723882 - DNA, 22 bp, Artificial Sequence
  chemically synthesized
tttgagcgagtgctattattac

SEQ ID NO: 723883 - DNA, 22 bp, Artificial Sequence
  chemically synthesized
tgagcgagtgctattattactc

SEQ ID NO: 723884 - DNA, 22 bp, Artificial Sequence
  chemically synthesized
tctgttcaataggagtaataat

SEQ ID NO: 723885 - DNA, 22 bp, Artificial Sequence
  chemically synthesized
gagcgagtgctattattactcc

SEQ ID NO: 723886 - DNA, 22 bp, Artificial Sequence
  chemically synthesized
atctgttcaataggagtaataa

SEQ ID NO: 723887 - DNA, 22 bp, Artificial Sequence
  chemically synthesized
agcgagtgctattattactcct

SEQ ID NO: 723888 - DNA, 22 bp, Artificial Sequence
  chemically synthesized
tttatctgttcaataggagtaa

SEQ ID NO: 723889 - DNA, 22 bp, Artificial Sequence
  chemically synthesized
atttatctgttcaataggagta

SEQ ID NO: 723890 - DNA, 22 bp, Artificial Sequence
  chemically synthesized
catttatttatctgttcaatag

SEQ ID NO: 723891 - DNA, 22 bp, Artificial Sequence
  chemically synthesized
ccatttatttatctgttcaata

SEQ ID NO: 723892 - DNA, 22 bp, Artificial Sequence
  chemically synthesized
ttattactcctattgaacagat

SEQ ID NO: 723893 - DNA, 22 bp, Artificial Sequence
  chemically synthesized
ttactcctattgaacagataaa

SEQ ID NO: 723894 - DNA, 22 bp, Artificial Sequence
  chemically synthesized
ctcctattgaacagataaataa

SEQ ID NO: 723895 - DNA, 22 bp, Artificial Sequence
  chemically synthesized
tagtgcttccatttatttatct

SEQ ID NO: 723896 - DNA, 22 bp, Artificial Sequence
  chemically synthesized
gtagtgcttccatttatttatc

SEQ ID NO: 723897 - DNA, 22 bp, Artificial Sequence
  chemically synthesized
tgtagtgcttccatttatttat

SEQ ID NO: 723898 - DNA, 22 bp, Artificial Sequence
  chemically synthesized
ctattgaacagataaataaatg

SEQ ID NO: 723899 - DNA, 22 bp, Artificial Sequence
  chemically synthesized
ttgtagtgcttccatttattta

SEQ ID NO: 723900 - DNA, 22 bp, Artificial Sequence
  chemically synthesized
ttgaacagataaataaatggaa

SEQ ID NO: 723901 - DNA, 22 bp, Artificial Sequence
  chemically synthesized
ccttttgtagtgcttccattta

SEQ ID NO: 723902 - DNA, 22 bp, Artificial Sequence
  chemically synthesized
aacagataaataaatggaagca

SEQ ID NO: 723903 - DNA, 22 bp, Artificial Sequence
  chemically synthesized
acaactcccttttgtagtgctt

SEQ ID NO: 723904 - DNA, 22 bp, Artificial Sequence
  chemically synthesized
ctaacaactcccttttgtagtg

SEQ ID NO: 723905 - DNA, 22 bp, Artificial Sequence
  chemically synthesized
actaacaactcccttttgtagt

SEQ ID NO: 723906 - DNA, 22 bp, Artificial Sequence
  chemically synthesized
accacttactaacaactccctt

SEQ ID NO: 723907 - DNA, 22 bp, Artificial Sequence
  chemically synthesized
caccacttactaacaactccct

SEQ ID NO: 723908 - DNA, 22 bp, Artificial Sequence
  chemically synthesized
gaacttcaccacttactaacaa

SEQ ID NO: 723909 - DNA, 22 bp, Artificial Sequence
  chemically synthesized
caaaagggagttgttagtaagt

SEQ ID NO: 723910 - DNA, 22 bp, Artificial Sequence
  chemically synthesized
ttagtaagtggtgaagttccaa

SEQ ID NO: 723911 - DNA, 22 bp, Artificial Sequence
  chemically synthesized
gtaagtggtgaagttccaattc

SEQ ID NO: 723912 - DNA, 22 bp, Artificial Sequence
  chemically synthesized
ggagtcaacgtgtggggtgtga

SEQ ID NO: 723913 - DNA, 22 bp, Artificial Sequence
  chemically synthesized
caattcacaccccacacgttga

SEQ ID NO: 723914 - DNA, 22 bp, Artificial Sequence
  chemically synthesized
agagtctgggagtcaacgtgtg

SEQ ID NO: 723915 - DNA, 22 bp, Artificial Sequence
  chemically synthesized
cagagtctgggagtcaacgtgt

SEQ ID NO: 723916 - DNA, 22 bp, Artificial Sequence
  chemically synthesized
tcagagtctgggagtcaacgtg

SEQ ID NO: 723917 - DNA, 22 bp, Artificial Sequence
  chemically synthesized
acaccccacacgttgactccca

SEQ ID NO: 723918 - DNA, 22 bp, Artificial Sequence
  chemically synthesized
aaaattttcagagtctgggagt

SEQ ID NO: 723919 - DNA, 22 bp, Artificial Sequence
  chemically synthesized
gagtctgaaaattttcagagtc

SEQ ID NO: 723920 - DNA, 22 bp, Artificial Sequence
  chemically synthesized
agagtctgaaaattttcagagt

SEQ ID NO: 723921 - DNA, 22 bp, Artificial Sequence
  chemically synthesized
actcccagactctgaaaatttt

SEQ ID NO: 723922 - DNA, 22 bp, Artificial Sequence
  chemically synthesized
agcttagagtctgaaaattttc

SEQ ID NO: 723923 - DNA, 22 bp, Artificial Sequence
  chemically synthesized
aagcttagagtctgaaaatttt

SEQ ID NO: 723924 - DNA, 22 bp, Artificial Sequence
  chemically synthesized
taagcttagagtctgaaaattt

SEQ ID NO: 723925 - DNA, 22 bp, Artificial Sequence
  chemically synthesized
ccagactctgaaaattttcaga

SEQ ID NO: 723926 - DNA, 22 bp, Artificial Sequence
  chemically synthesized
ttaagcttagagtctgaaaatt

SEQ ID NO: 723927 - DNA, 22 bp, Artificial Sequence
  chemically synthesized
tatttttaagcttagagtctga

SEQ ID NO: 723928 - DNA, 22 bp, Artificial Sequence
  chemically synthesized
tatatttttaagcttagagtct

SEQ ID NO: 723929 - DNA, 22 bp, Artificial Sequence
  chemically synthesized
tgaaaattttcagactctaagc

SEQ ID NO: 723930 - DNA, 22 bp, Artificial Sequence
  chemically synthesized
ctatatttttaagcttagagtc

SEQ ID NO: 723931 - DNA, 22 bp, Artificial Sequence
  chemically synthesized
aaaattttcagactctaagctt

SEQ ID NO: 723932 - DNA, 22 bp, Artificial Sequence
  chemically synthesized
tttctatatttttaagcttaga

SEQ ID NO: 723933 - DNA, 22 bp, Artificial Sequence
  chemically synthesized
atttctatatttttaagcttag

SEQ ID NO: 723934 - DNA, 22 bp, Artificial Sequence
  chemically synthesized
cttatttctatatttttaagct

SEQ ID NO: 723935 - DNA, 22 bp, Artificial Sequence
  chemically synthesized
gcttatttctatatttttaagc

SEQ ID NO: 723936 - DNA, 22 bp, Artificial Sequence
  chemically synthesized
tcagactctaagcttaaaaata

SEQ ID NO: 723937 - DNA, 22 bp, Artificial Sequence
  chemically synthesized
cagactctaagcttaaaaatat

SEQ ID NO: 723938 - DNA, 22 bp, Artificial Sequence
  chemically synthesized
agactctaagcttaaaaatata

SEQ ID NO: 723939 - DNA, 22 bp, Artificial Sequence
  chemically synthesized
atttgcttatttctatattttt

SEQ ID NO: 723940 - DNA, 22 bp, Artificial Sequence
  chemically synthesized
ttcatttgcttatttctatatt

SEQ ID NO: 723941 - DNA, 22 bp, Artificial Sequence
  chemically synthesized
attcatttgcttatttctatat

SEQ ID NO: 723942 - DNA, 22 bp, Artificial Sequence
  chemically synthesized
taagcttaaaaatatagaaata

SEQ ID NO: 723943 - DNA, 22 bp, Artificial Sequence
  chemically synthesized
agcttaaaaatatagaaataag

SEQ ID NO: 723944 - DNA, 22 bp, Artificial Sequence
  chemically synthesized
gtttattcatttgcttatttct

SEQ ID NO: 723945 - DNA, 22 bp, Artificial Sequence
  chemically synthesized
aaaaatatagaaataagcaaat

SEQ ID NO: 723946 - DNA, 22 bp, Artificial Sequence
  chemically synthesized
aaaatatagaaataagcaaatg

SEQ ID NO: 723947 - DNA, 22 bp, Artificial Sequence
  chemically synthesized
ataagaacgctagtttattcat

SEQ ID NO: 723948 - DNA, 22 bp, Artificial Sequence
  chemically synthesized
ggctgataagaacgctagttta

SEQ ID NO: 723949 - DNA, 22 bp, Artificial Sequence
  chemically synthesized
tgggctgataagaacgctagtt

SEQ ID NO: 723950 - DNA, 22 bp, Artificial Sequence
  chemically synthesized
ctgggctgataagaacgctagt

SEQ ID NO: 723951 - DNA, 22 bp, Artificial Sequence
  chemically synthesized
tctgggctgataagaacgctag

SEQ ID NO: 723952 - DNA, 22 bp, Artificial Sequence
  chemically synthesized
ctttctgggctgataagaacgc

SEQ ID NO: 723953 - DNA, 22 bp, Artificial Sequence
  chemically synthesized
gcgttcttatcagcccagaaag

SEQ ID NO: 723954 - DNA, 22 bp, Artificial Sequence
  chemically synthesized
ttatcagcccagaaaggagtct

SEQ ID NO: 723955 - DNA, 22 bp, Artificial Sequence
  chemically synthesized
atcagcccagaaaggagtcttc

SEQ ID NO: 723956 - DNA, 22 bp, Artificial Sequence
  chemically synthesized
tcagcccagaaaggagtcttca

SEQ ID NO: 723957 - DNA, 22 bp, Artificial Sequence
  chemically synthesized
acatgcataaagtgaagactcc

SEQ ID NO: 723958 - DNA, 22 bp, Artificial Sequence
  chemically synthesized
aacatgcataaagtgaagactc

SEQ ID NO: 723959 - DNA, 22 bp, Artificial Sequence
  chemically synthesized
acagtaacagtgtttaacatgc

SEQ ID NO: 723960 - DNA, 22 bp, Artificial Sequence
  chemically synthesized
cactttatgcatgttaaacact

SEQ ID NO: 723961 - DNA, 22 bp, Artificial Sequence
  chemically synthesized
gctaacagtaacagtgtttaac

SEQ ID NO: 723962 - DNA, 22 bp, Artificial Sequence
  chemically synthesized
actttatgcatgttaaacactg

SEQ ID NO: 723963 - DNA, 22 bp, Artificial Sequence
  chemically synthesized
agctaacagtaacagtgtttaa

SEQ ID NO: 723964 - DNA, 22 bp, Artificial Sequence
  chemically synthesized
tatgcatgttaaacactgttac

SEQ ID NO: 723965 - DNA, 22 bp, Artificial Sequence
  chemically synthesized
atgcatgttaaacactgttact

SEQ ID NO: 723966 - DNA, 22 bp, Artificial Sequence
  chemically synthesized
tgcatgttaaacactgttactg

SEQ ID NO: 723967 - DNA, 22 bp, Artificial Sequence
  chemically synthesized
taaagagcaatttagctaacag

SEQ ID NO: 723968 - DNA, 22 bp, Artificial Sequence
  chemically synthesized
aacactgttactgttagctaaa

SEQ ID NO: 723969 - DNA, 22 bp, Artificial Sequence
  chemically synthesized
ttgtaaagagcaatttagctaa

SEQ ID NO: 723970 - DNA, 22 bp, Artificial Sequence
  chemically synthesized
gttgtaaagagcaatttagcta

SEQ ID NO: 723971 - DNA, 22 bp, Artificial Sequence
  chemically synthesized
ttactgttagctaaattgctct

SEQ ID NO: 723972 - DNA, 22 bp, Artificial Sequence
  chemically synthesized
ctgttagctaaattgctcttta

SEQ ID NO: 723973 - DNA, 22 bp, Artificial Sequence
  chemically synthesized
taagccttgttgtaaagagcaa

SEQ ID NO: 723974 - DNA, 22 bp, Artificial Sequence
  chemically synthesized
gtaagccttgttgtaaagagca

SEQ ID NO: 723975 - DNA, 22 bp, Artificial Sequence
  chemically synthesized
ttagctaaattgctctttacaa

SEQ ID NO: 723976 - DNA, 22 bp, Artificial Sequence
  chemically synthesized
gctaaattgctctttacaacaa

SEQ ID NO: 723977 - DNA, 22 bp, Artificial Sequence
  chemically synthesized
aattgctctttacaacaaggct

SEQ ID NO: 723978 - DNA, 22 bp, Artificial Sequence
  chemically synthesized
ctctttacaacaaggcttacaa

SEQ ID NO: 723979 - DNA, 22 bp, Artificial Sequence
  chemically synthesized
atagtatcatcatcttgtaagc

SEQ ID NO: 723980 - DNA, 22 bp, Artificial Sequence
  chemically synthesized
tttacaacaaggcttacaagat

SEQ ID NO: 723981 - DNA, 22 bp, Artificial Sequence
  chemically synthesized
tacaacaaggcttacaagatga

SEQ ID NO: 723982 - DNA, 22 bp, Artificial Sequence
  chemically synthesized
acaacaaggcttacaagatgat

SEQ ID NO: 723983 - DNA, 22 bp, Artificial Sequence
  chemically synthesized
caacaaggcttacaagatgatg

SEQ ID NO: 723984 - DNA, 22 bp, Artificial Sequence
  chemically synthesized
atatacaaaatgttgatagtat

SEQ ID NO: 723985 - DNA, 22 bp, Artificial Sequence
  chemically synthesized
acaagatgatgatactatcaac

SEQ ID NO: 723986 - DNA, 22 bp, Artificial Sequence
  chemically synthesized
caagatgatgatactatcaaca

SEQ ID NO: 723987 - DNA, 22 bp, Artificial Sequence
  chemically synthesized
ctcatatacaaaatgttgatag

SEQ ID NO: 723988 - DNA, 22 bp, Artificial Sequence
  chemically synthesized
cctcatatacaaaatgttgata

SEQ ID NO: 723989 - DNA, 22 bp, Artificial Sequence
  chemically synthesized
agtttcctcatatacaaaatgt

SEQ ID NO: 723990 - DNA, 22 bp, Artificial Sequence
  chemically synthesized
cagtttcctcatatacaaaatg

SEQ ID NO: 723991 - DNA, 22 bp, Artificial Sequence
  chemically synthesized
agacttcagtttcctcatatac

SEQ ID NO: 723992 - DNA, 22 bp, Artificial Sequence
  chemically synthesized
aagacttcagtttcctcatata

SEQ ID NO: 723993 - DNA, 22 bp, Artificial Sequence
  chemically synthesized
tcaacattttgtatatgaggaa

SEQ ID NO: 723994 - DNA, 22 bp, Artificial Sequence
  chemically synthesized
tcttaagacttcagtttcctca

SEQ ID NO: 723995 - DNA, 22 bp, Artificial Sequence
  chemically synthesized
atcttaagacttcagtttcctc

SEQ ID NO: 723996 - DNA, 22 bp, Artificial Sequence
  chemically synthesized
tgtatatgaggaaactgaagtc

SEQ ID NO: 723997 - DNA, 22 bp, Artificial Sequence
  chemically synthesized
gatttatcttaagacttcagtt

SEQ ID NO: 723998 - DNA, 22 bp, Artificial Sequence
  chemically synthesized
gtatatgaggaaactgaagtct

SEQ ID NO: 723999 - DNA, 22 bp, Artificial Sequence
  chemically synthesized
tatatgaggaaactgaagtctt

SEQ ID NO: 724000 - DNA, 22 bp, Artificial Sequence
  chemically synthesized
gctagatttatcttaagacttc

SEQ ID NO: 724001 - DNA, 22 bp, Artificial Sequence
  chemically synthesized
ccatagctagctagatttatct

SEQ ID NO: 724002 - DNA, 22 bp, Artificial Sequence
  chemically synthesized
tgccatagctagctagatttat

SEQ ID NO: 724003 - DNA, 22 bp, Artificial Sequence
  chemically synthesized
aagtcttaagataaatctagct

SEQ ID NO: 724004 - DNA, 22 bp, Artificial Sequence
  chemically synthesized
gctctgccatagctagctagat

SEQ ID NO: 724005 - DNA, 22 bp, Artificial Sequence
  chemically synthesized
tggctctgccatagctagctag

SEQ ID NO: 724006 - DNA, 22 bp, Artificial Sequence
  chemically synthesized
aagataaatctagctagctatg

SEQ ID NO: 724007 - DNA, 22 bp, Artificial Sequence
  chemically synthesized
agataaatctagctagctatgg

SEQ ID NO: 724008 - DNA, 22 bp, Artificial Sequence
  chemically synthesized
aggttctggctctgccatagct

SEQ ID NO: 724009 - DNA, 22 bp, Artificial Sequence
  chemically synthesized
gctagctatggcagagccagaa

SEQ ID NO: 724010 - DNA, 22 bp, Artificial Sequence
  chemically synthesized
gctatggcagagccagaacctg

SEQ ID NO: 724011 - DNA, 22 bp, Artificial Sequence
  chemically synthesized
tggcagagccagaacctgagct

SEQ ID NO: 724012 - DNA, 22 bp, Artificial Sequence
  chemically synthesized
gaataaaaataaacagagctca

SEQ ID NO: 724013 - DNA, 22 bp, Artificial Sequence
  chemically synthesized
agaataaaaataaacagagctc

SEQ ID NO: 724014 - DNA, 22 bp, Artificial Sequence
  chemically synthesized
tagaataaaaataaacagagct

SEQ ID NO: 724015 - DNA, 22 bp, Artificial Sequence
  chemically synthesized
acatagctttagaataaaaata

SEQ ID NO: 724016 - DNA, 22 bp, Artificial Sequence
  chemically synthesized
agctctgtttatttttattcta

SEQ ID NO: 724017 - DNA, 22 bp, Artificial Sequence
  chemically synthesized
tgtttatttttattctaaagct

SEQ ID NO: 724018 - DNA, 22 bp, Artificial Sequence
  chemically synthesized
tttatttttattctaaagctat

SEQ ID NO: 724019 - DNA, 22 bp, Artificial Sequence
  chemically synthesized
gcaaatattgacatagctttag

SEQ ID NO: 724020 - DNA, 22 bp, Artificial Sequence
  chemically synthesized
atttttattctaaagctatgtc

SEQ ID NO: 724021 - DNA, 22 bp, Artificial Sequence
  chemically synthesized
tttttattctaaagctatgtca

SEQ ID NO: 724022 - DNA, 22 bp, Artificial Sequence
  chemically synthesized
ttattctaaagctatgtcaata

SEQ ID NO: 724023 - DNA, 22 bp, Artificial Sequence
  chemically synthesized
tattctaaagctatgtcaatat

SEQ ID NO: 724024 - DNA, 22 bp, Artificial Sequence
  chemically synthesized
attctaaagctatgtcaatatt

SEQ ID NO: 724025 - DNA, 22 bp, Artificial Sequence
  chemically synthesized
ttctaaagctatgtcaatattt

SEQ ID NO: 724026 - DNA, 22 bp, Artificial Sequence
  chemically synthesized
taaagctatgtcaatatttgct

SEQ ID NO: 724027 - DNA, 22 bp, Artificial Sequence
  chemically synthesized
aagctatgtcaatatttgctaa

SEQ ID NO: 724028 - DNA, 22 bp, Artificial Sequence
  chemically synthesized
ccaataccaagtattagcaaat

SEQ ID NO: 724029 - DNA, 22 bp, Artificial Sequence
  chemically synthesized
tgtcaatatttgctaatacttg

SEQ ID NO: 724030 - DNA, 22 bp, Artificial Sequence
  chemically synthesized
taatattaccaataccaagtat

SEQ ID NO: 724031 - DNA, 22 bp, Artificial Sequence
  chemically synthesized
gctaatacttggtattggtaat

SEQ ID NO: 724032 - DNA, 22 bp, Artificial Sequence
  chemically synthesized
ctaatacttggtattggtaata

SEQ ID NO: 724033 - DNA, 22 bp, Artificial Sequence
  chemically synthesized
atacttggtattggtaatatta

SEQ ID NO: 724034 - DNA, 22 bp, Artificial Sequence
  chemically synthesized
ggtattggtaatattacaatgg

SEQ ID NO: 724035 - DNA, 22 bp, Artificial Sequence
  chemically synthesized
gtattggtaatattacaatggc

SEQ ID NO: 724036 - DNA, 22 bp, Artificial Sequence
  chemically synthesized
gtaatattacaatggctttctt

SEQ ID NO: 724037 - DNA, 22 bp, Artificial Sequence
  chemically synthesized
caatggctttctttttatgaca

SEQ ID NO: 724038 - DNA, 22 bp, Artificial Sequence
  chemically synthesized
agatggatatcatgtgtcataa

SEQ ID NO: 724039 - DNA, 22 bp, Artificial Sequence
  chemically synthesized
gagatggatatcatgtgtcata

SEQ ID NO: 724040 - DNA, 22 bp, Artificial Sequence
  chemically synthesized
tgagatggatatcatgtgtcat

SEQ ID NO: 724041 - DNA, 22 bp, Artificial Sequence
  chemically synthesized
ttgagatggatatcatgtgtca

SEQ ID NO: 724042 - DNA, 22 bp, Artificial Sequence
  chemically synthesized
tctttttatgacacatgatatc

SEQ ID NO: 724043 - DNA, 22 bp, Artificial Sequence
  chemically synthesized
ctttttatgacacatgatatcc

SEQ ID NO: 724044 - DNA, 22 bp, Artificial Sequence
  chemically synthesized
tttttatgacacatgatatcca

SEQ ID NO: 724045 - DNA, 22 bp, Artificial Sequence
  chemically synthesized
atatttttgagatggatatcat

SEQ ID NO: 724046 - DNA, 22 bp, Artificial Sequence
  chemically synthesized
tttatgacacatgatatccatc

SEQ ID NO: 724047 - DNA, 22 bp, Artificial Sequence
  chemically synthesized
ttatgacacatgatatccatct

SEQ ID NO: 724048 - DNA, 22 bp, Artificial Sequence
  chemically synthesized
tatgacacatgatatccatctc

SEQ ID NO: 724049 - DNA, 22 bp, Artificial Sequence
  chemically synthesized
atgacacatgatatccatctca

SEQ ID NO: 724050 - DNA, 22 bp, Artificial Sequence
  chemically synthesized
tgacacatgatatccatctcaa

SEQ ID NO: 724051 - DNA, 22 bp, Artificial Sequence
  chemically synthesized
taatctaatatttttgagatgg

SEQ ID NO: 724052 - DNA, 22 bp, Artificial Sequence
  chemically synthesized
catacaaatgttataatctaat

SEQ ID NO: 724053 - DNA, 22 bp, Artificial Sequence
  chemically synthesized
agttgcatacaaatgttataat

SEQ ID NO: 724054 - DNA, 22 bp, Artificial Sequence
  chemically synthesized
aaaaatattagattataacatt

SEQ ID NO: 724055 - DNA, 22 bp, Artificial Sequence
  chemically synthesized
aagttgcatacaaatgttataa

SEQ ID NO: 724056 - DNA, 22 bp, Artificial Sequence
  chemically synthesized
ttaagttgcatacaaatgttat

SEQ ID NO: 724057 - DNA, 22 bp, Artificial Sequence
  chemically synthesized
cttaagttgcatacaaatgtta

SEQ ID NO: 724058 - DNA, 22 bp, Artificial Sequence
  chemically synthesized
tcttaagttgcatacaaatgtt

SEQ ID NO: 724059 - DNA, 22 bp, Artificial Sequence
  chemically synthesized
atctttcttaagttgcatacaa

SEQ ID NO: 724060 - DNA, 22 bp, Artificial Sequence
  chemically synthesized
gattataacatttgtatgcaac

SEQ ID NO: 724061 - DNA, 22 bp, Artificial Sequence
  chemically synthesized
catctttcttaagttgcataca

SEQ ID NO: 724062 - DNA, 22 bp, Artificial Sequence
  chemically synthesized
taacatttgtatgcaacttaag

SEQ ID NO: 724063 - DNA, 22 bp, Artificial Sequence
  chemically synthesized
caaataacttcatctttcttaa

SEQ ID NO: 724064 - DNA, 22 bp, Artificial Sequence
  chemically synthesized
ccaaataacttcatctttctta

SEQ ID NO: 724065 - DNA, 22 bp, Artificial Sequence
  chemically synthesized
tccaaataacttcatctttctt

SEQ ID NO: 724066 - DNA, 22 bp, Artificial Sequence
  chemically synthesized
gtatgcaacttaagaaagatga

SEQ ID NO: 724067 - DNA, 22 bp, Artificial Sequence
  chemically synthesized
ttccaaataacttcatctttct

SEQ ID NO: 724068 - DNA, 22 bp, Artificial Sequence
  chemically synthesized
tatgcaacttaagaaagatgaa

SEQ ID NO: 724069 - DNA, 22 bp, Artificial Sequence
  chemically synthesized
aatcccttttccaaataacttc

SEQ ID NO: 724070 - DNA, 22 bp, Artificial Sequence
  chemically synthesized
aagaaagatgaagttatttgga

SEQ ID NO: 724071 - DNA, 22 bp, Artificial Sequence
  chemically synthesized
agaaagatgaagttatttggaa

SEQ ID NO: 724072 - DNA, 22 bp, Artificial Sequence
  chemically synthesized
atatctcaatcccttttccaaa

SEQ ID NO: 724073 - DNA, 22 bp, Artificial Sequence
  chemically synthesized
catatctcaatcccttttccaa

SEQ ID NO: 724074 - DNA, 22 bp, Artificial Sequence
  chemically synthesized
tttggaaaagggattgagatat

SEQ ID NO: 724075 - DNA, 22 bp, Artificial Sequence
  chemically synthesized
tatcacaatcttcatatctcaa

SEQ ID NO: 724076 - DNA, 22 bp, Artificial Sequence
  chemically synthesized
atatcacaatcttcatatctca

SEQ ID NO: 724077 - DNA, 22 bp, Artificial Sequence
  chemically synthesized
ggaaaagggattgagatatgaa

SEQ ID NO: 724078 - DNA, 22 bp, Artificial Sequence
  chemically synthesized
gaaaagggattgagatatgaag

SEQ ID NO: 724079 - DNA, 22 bp, Artificial Sequence
  chemically synthesized
ttatatcacaatcttcatatct

SEQ ID NO: 724080 - DNA, 22 bp, Artificial Sequence
  chemically synthesized
acaattcttatatcacaatctt

SEQ ID NO: 724081 - DNA, 22 bp, Artificial Sequence
  chemically synthesized
agatatgaagattgtgatataa

SEQ ID NO: 724082 - DNA, 22 bp, Artificial Sequence
  chemically synthesized
tagtcacctaacaattcttata

SEQ ID NO: 724083 - DNA, 22 bp, Artificial Sequence
  chemically synthesized
tgatataagaattgttaggtga

SEQ ID NO: 724084 - DNA, 22 bp, Artificial Sequence
  chemically synthesized
catcagagctgtagtcacctaa

SEQ ID NO: 724085 - DNA, 22 bp, Artificial Sequence
  chemically synthesized
ccatcagagctgtagtcaccta

SEQ ID NO: 724086 - DNA, 22 bp, Artificial Sequence
  chemically synthesized
tccatcagagctgtagtcacct

SEQ ID NO: 724087 - DNA, 22 bp, Artificial Sequence
  chemically synthesized
ttaggtgactacagctctgatg

SEQ ID NO: 724088 - DNA, 22 bp, Artificial Sequence
  chemically synthesized
ggtgactacagctctgatggaa

SEQ ID NO: 724089 - DNA, 22 bp, Artificial Sequence
  chemically synthesized
gtgcgcataaacctttccatca

SEQ ID NO: 724090 - DNA, 22 bp, Artificial Sequence
  chemically synthesized
tggtgcgcataaacctttccat

SEQ ID NO: 724091 - DNA, 22 bp, Artificial Sequence
  chemically synthesized
cagctctgatggaaaggtttat

SEQ ID NO: 724092 - DNA, 22 bp, Artificial Sequence
  chemically synthesized
agattctggtgcgcataaacct

SEQ ID NO: 724093 - DNA, 22 bp, Artificial Sequence
  chemically synthesized
tgatggaaaggtttatgcgcac

SEQ ID NO: 724094 - DNA, 22 bp, Artificial Sequence
  chemically synthesized
atggaaaggtttatgcgcacca

SEQ ID NO: 724095 - DNA, 22 bp, Artificial Sequence
  chemically synthesized
cagctgagattctggtgcgcat

SEQ ID NO: 724096 - DNA, 22 bp, Artificial Sequence
  chemically synthesized
atgcgcaccagaatctcagctg

SEQ ID NO: 724097 - DNA, 22 bp, Artificial Sequence
  chemically synthesized
tgcgcaccagaatctcagctgt

SEQ ID NO: 724098 - DNA, 22 bp, Artificial Sequence
  chemically synthesized
caaagagaacagagctacagct

SEQ ID NO: 724099 - DNA, 22 bp, Artificial Sequence
  chemically synthesized
tccaaagagaacagagctacag

SEQ ID NO: 724100 - DNA, 22 bp, Artificial Sequence
  chemically synthesized
ctccaaagagaacagagctaca

SEQ ID NO: 724101 - DNA, 22 bp, Artificial Sequence
  chemically synthesized
tttctccaaagagaacagagct

SEQ ID NO: 724102 - DNA, 22 bp, Artificial Sequence
  chemically synthesized
agctgtagctctgttctctttg

SEQ ID NO: 724103 - DNA, 22 bp, Artificial Sequence
  chemically synthesized
caagttgtttctccaaagagaa

SEQ ID NO: 724104 - DNA, 22 bp, Artificial Sequence
  chemically synthesized
acaagttgtttctccaaagaga

SEQ ID NO: 724105 - DNA, 22 bp, Artificial Sequence
  chemically synthesized
tacaagttgtttctccaaagag

SEQ ID NO: 724106 - DNA, 22 bp, Artificial Sequence
  chemically synthesized
ttacaagttgtttctccaaaga

SEQ ID NO: 724107 - DNA, 22 bp, Artificial Sequence
  chemically synthesized
tagctctgttctctttggagaa

SEQ ID NO: 724108 - DNA, 22 bp, Artificial Sequence
  chemically synthesized
tgttctctttggagaaacaact

SEQ ID NO: 724109 - DNA, 22 bp, Artificial Sequence
  chemically synthesized
ttctctttggagaaacaacttg

SEQ ID NO: 724110 - DNA, 22 bp, Artificial Sequence
  chemically synthesized
tctttggagaaacaacttgtaa

SEQ ID NO: 724111 - DNA, 22 bp, Artificial Sequence
  chemically synthesized
tttggagaaacaacttgtaaaa

SEQ ID NO: 724112 - DNA, 22 bp, Artificial Sequence
  chemically synthesized
acaaggatcatatttttacaag

SEQ ID NO: 724113 - DNA, 22 bp, Artificial Sequence
  chemically synthesized
tggagaaacaacttgtaaaaat

SEQ ID NO: 724114 - DNA, 22 bp, Artificial Sequence
  chemically synthesized
ggagaaacaacttgtaaaaata

SEQ ID NO: 724115 - DNA, 22 bp, Artificial Sequence
  chemically synthesized
gagaaacaacttgtaaaaatat

SEQ ID NO: 724116 - DNA, 22 bp, Artificial Sequence
  chemically synthesized
ctaacaaggatcatatttttac

SEQ ID NO: 724117 - DNA, 22 bp, Artificial Sequence
  chemically synthesized
gatatcctgctaacaaggatca

SEQ ID NO: 724118 - DNA, 22 bp, Artificial Sequence
  chemically synthesized
gtaaaaatatgatccttgttag

SEQ ID NO: 724119 - DNA, 22 bp, Artificial Sequence
  chemically synthesized
taaaaatatgatccttgttagc

SEQ ID NO: 724120 - DNA, 22 bp, Artificial Sequence
  chemically synthesized
gttagcaggatatctaatatcc

SEQ ID NO: 724121 - DNA, 22 bp, Artificial Sequence
  chemically synthesized
ttagcaggatatctaatatcca

SEQ ID NO: 724122 - DNA, 22 bp, Artificial Sequence
  chemically synthesized
gcaggatatctaatatccattc

SEQ ID NO: 724123 - DNA, 22 bp, Artificial Sequence
  chemically synthesized
tcaatggaacaagaatggatat

SEQ ID NO: 724124 - DNA, 22 bp, Artificial Sequence
  chemically synthesized
aaatgctatcaatggaacaaga

SEQ ID NO: 724125 - DNA, 22 bp, Artificial Sequence
  chemically synthesized
caaatgctatcaatggaacaag

SEQ ID NO: 724126 - DNA, 22 bp, Artificial Sequence
  chemically synthesized
atatccattcttgttccattga

SEQ ID NO: 724127 - DNA, 22 bp, Artificial Sequence
  chemically synthesized
ataaataaatttcaaatgctat

SEQ ID NO: 724128 - DNA, 22 bp, Artificial Sequence
  chemically synthesized
ttgttccattgatagcatttga

SEQ ID NO: 724129 - DNA, 22 bp, Artificial Sequence
  chemically synthesized
gataaataaatttcaaatgcta

SEQ ID NO: 724130 - DNA, 22 bp, Artificial Sequence
  chemically synthesized
gttccattgatagcatttgaaa

SEQ ID NO: 724131 - DNA, 22 bp, Artificial Sequence
  chemically synthesized
ttccattgatagcatttgaaat

SEQ ID NO: 724132 - DNA, 22 bp, Artificial Sequence
  chemically synthesized
tttgataaataaatttcaaatg

SEQ ID NO: 724133 - DNA, 22 bp, Artificial Sequence
  chemically synthesized
cattgatagcatttgaaattta

SEQ ID NO: 724134 - DNA, 22 bp, Artificial Sequence
  chemically synthesized
atagcatttgaaatttatttat

SEQ ID NO: 724135 - DNA, 22 bp, Artificial Sequence
  chemically synthesized
aagtgattatttgataaataaa

SEQ ID NO: 724136 - DNA, 22 bp, Artificial Sequence
  chemically synthesized
gaaatttatttatcaaataatc

SEQ ID NO: 724137 - DNA, 22 bp, Artificial Sequence
  chemically synthesized
aaatttatttatcaaataatca

SEQ ID NO: 724138 - DNA, 22 bp, Artificial Sequence
  chemically synthesized
gaaaaactgaagtgattatttg

SEQ ID NO: 724139 - DNA, 22 bp, Artificial Sequence
  chemically synthesized
agaaaaactgaagtgattattt

SEQ ID NO: 724140 - DNA, 22 bp, Artificial Sequence
  chemically synthesized
atttatcaaataatcacttcag

SEQ ID NO: 724141 - DNA, 22 bp, Artificial Sequence
  chemically synthesized
tttatcaaataatcacttcagt

SEQ ID NO: 724142 - DNA, 22 bp, Artificial Sequence
  chemically synthesized
atcaaataatcacttcagtttt

SEQ ID NO: 724143 - DNA, 22 bp, Artificial Sequence
  chemically synthesized
aggtagtttagaaaaactgaag

SEQ ID NO: 724144 - DNA, 22 bp, Artificial Sequence
  chemically synthesized
tcaaataatcacttcagttttt

SEQ ID NO: 724145 - DNA, 22 bp, Artificial Sequence
  chemically synthesized
aaggtagtttagaaaaactgaa

SEQ ID NO: 724146 - DNA, 22 bp, Artificial Sequence
  chemically synthesized
taaggtagtttagaaaaactga

SEQ ID NO: 724147 - DNA, 22 bp, Artificial Sequence
  chemically synthesized
ttaaggtagtttagaaaaactg

SEQ ID NO: 724148 - DNA, 22 bp, Artificial Sequence
  chemically synthesized
aaaatatttttaaggtagttta

SEQ ID NO: 724149 - DNA, 22 bp, Artificial Sequence
  chemically synthesized
aaaaatatttttaaggtagttt

SEQ ID NO: 724150 - DNA, 22 bp, Artificial Sequence
  chemically synthesized
taaaaatatttttaaggtagtt

SEQ ID NO: 724151 - DNA, 22 bp, Artificial Sequence
  chemically synthesized
cagtttttctaaactaccttaa

SEQ ID NO: 724152 - DNA, 22 bp, Artificial Sequence
  chemically synthesized
agtttttctaaactaccttaaa

SEQ ID NO: 724153 - DNA, 22 bp, Artificial Sequence
  chemically synthesized
aggttttaaaaatatttttaag

SEQ ID NO: 724154 - DNA, 22 bp, Artificial Sequence
  chemically synthesized
ttctaaactaccttaaaaatat

SEQ ID NO: 724155 - DNA, 22 bp, Artificial Sequence
  chemically synthesized
tctaaactaccttaaaaatatt

SEQ ID NO: 724156 - DNA, 22 bp, Artificial Sequence
  chemically synthesized
ctaaactaccttaaaaatattt

SEQ ID NO: 724157 - DNA, 22 bp, Artificial Sequence
  chemically synthesized
taaactaccttaaaaatatttt

SEQ ID NO: 724158 - DNA, 22 bp, Artificial Sequence
  chemically synthesized
tcctcaggttttaaaaatattt

SEQ ID NO: 724159 - DNA, 22 bp, Artificial Sequence
  chemically synthesized
aactaccttaaaaatattttta

SEQ ID NO: 724160 - DNA, 22 bp, Artificial Sequence
  chemically synthesized
atcctcaggttttaaaaatatt

SEQ ID NO: 724161 - DNA, 22 bp, Artificial Sequence
  chemically synthesized
tatcctcaggttttaaaaatat

SEQ ID NO: 724162 - DNA, 22 bp, Artificial Sequence
  chemically synthesized
tttatcctcaggttttaaaaat

SEQ ID NO: 724163 - DNA, 22 bp, Artificial Sequence
  chemically synthesized
ccttaaaaatatttttaaaacc

SEQ ID NO: 724164 - DNA, 22 bp, Artificial Sequence
  chemically synthesized
aaaaatatttttaaaacctgag

SEQ ID NO: 724165 - DNA, 22 bp, Artificial Sequence
  chemically synthesized
aaaatatttttaaaacctgagg

SEQ ID NO: 724166 - DNA, 22 bp, Artificial Sequence
  chemically synthesized
aaaatgtgtcctctttatcctc

SEQ ID NO: 724167 - DNA, 22 bp, Artificial Sequence
  chemically synthesized
aaaaatgtgtcctctttatcct

SEQ ID NO: 724168 - DNA, 22 bp, Artificial Sequence
  chemically synthesized
ttaaaacctgaggataaagagg

SEQ ID NO: 724169 - DNA, 22 bp, Artificial Sequence
  chemically synthesized
taaaacctgaggataaagagga

SEQ ID NO: 724170 - DNA, 22 bp, Artificial Sequence
  chemically synthesized
aaaacctgaggataaagaggac

SEQ ID NO: 724171 - DNA, 22 bp, Artificial Sequence
  chemically synthesized
gtttaaaaatgtgtcctcttta

SEQ ID NO: 724172 - DNA, 22 bp, Artificial Sequence
  chemically synthesized
aaacctgaggataaagaggaca

SEQ ID NO: 724173 - DNA, 22 bp, Artificial Sequence
  chemically synthesized
aggataaagaggacacattttt

SEQ ID NO: 724174 - DNA, 22 bp, Artificial Sequence
  chemically synthesized
taagagaaaaatgcactagttt

SEQ ID NO: 724175 - DNA, 22 bp, Artificial Sequence
  chemically synthesized
attgtaagagaaaaatgcacta

SEQ ID NO: 724176 - DNA, 22 bp, Artificial Sequence
  chemically synthesized
aattgtaagagaaaaatgcact

SEQ ID NO: 724177 - DNA, 22 bp, Artificial Sequence
  chemically synthesized
ttaaactagtgcatttttctct

SEQ ID NO: 724178 - DNA, 22 bp, Artificial Sequence
  chemically synthesized
taaactagtgcatttttctctt

SEQ ID NO: 724179 - DNA, 22 bp, Artificial Sequence
  chemically synthesized
aaactagtgcatttttctctta

SEQ ID NO: 724180 - DNA, 22 bp, Artificial Sequence
  chemically synthesized
aactagtgcatttttctcttac

SEQ ID NO: 724181 - DNA, 22 bp, Artificial Sequence
  chemically synthesized
gaatatcgatttaattgtaaga

SEQ ID NO: 724182 - DNA, 22 bp, Artificial Sequence
  chemically synthesized
gtgcatttttctcttacaatta

SEQ ID NO: 724183 - DNA, 22 bp, Artificial Sequence
  chemically synthesized
ttctcttacaattaaatcgata

SEQ ID NO: 724184 - DNA, 22 bp, Artificial Sequence
  chemically synthesized
tctcttacaattaaatcgatat

SEQ ID NO: 724185 - DNA, 22 bp, Artificial Sequence
  chemically synthesized
cacccagctggaatatcgattt

SEQ ID NO: 724186 - DNA, 22 bp, Artificial Sequence
  chemically synthesized
ctcttacaattaaatcgatatt

SEQ ID NO: 724187 - DNA, 22 bp, Artificial Sequence
  chemically synthesized
tcttacaattaaatcgatattc

SEQ ID NO: 724188 - DNA, 22 bp, Artificial Sequence
  chemically synthesized
ttacaattaaatcgatattcca

SEQ ID NO: 724189 - DNA, 22 bp, Artificial Sequence
  chemically synthesized
acaattaaatcgatattccagc

SEQ ID NO: 724190 - DNA, 22 bp, Artificial Sequence
  chemically synthesized
caattaaatcgatattccagct

SEQ ID NO: 724191 - DNA, 22 bp, Artificial Sequence
  chemically synthesized
aatcgatattccagctgggtgc

SEQ ID NO: 724192 - DNA, 22 bp, Artificial Sequence
  chemically synthesized
caggcacgagccactgcaccca

SEQ ID NO: 724193 - DNA, 22 bp, Artificial Sequence
  chemically synthesized
ggattacaggcacgagccactg

SEQ ID NO: 724194 - DNA, 22 bp, Artificial Sequence
  chemically synthesized
cagctgggtgcagtggctcgtg

SEQ ID NO: 724195 - DNA, 22 bp, Artificial Sequence
  chemically synthesized
ggtgcagtggctcgtgcctgta

SEQ ID NO: 724196 - DNA, 22 bp, Artificial Sequence
  chemically synthesized
ccaaagtgctgggattacaggc

SEQ ID NO: 724197 - DNA, 22 bp, Artificial Sequence
  chemically synthesized
gacctcccaaagtgctgggatt

SEQ ID NO: 724198 - DNA, 22 bp, Artificial Sequence
  chemically synthesized
gtgcctgtaatcccagcacttt

SEQ ID NO: 724199 - DNA, 22 bp, Artificial Sequence
  chemically synthesized
taatcccagcactttgggaggt

SEQ ID NO: 724200 - DNA, 22 bp, Artificial Sequence
  chemically synthesized
aggtgatccacccacctcgacc

SEQ ID NO: 724201 - DNA, 22 bp, Artificial Sequence
  chemically synthesized
acctcaggtgatccacccacct

SEQ ID NO: 724202 - DNA, 22 bp, Artificial Sequence
  chemically synthesized
tgggaggtcgaggtgggtggat

SEQ ID NO: 724203 - DNA, 22 bp, Artificial Sequence
  chemically synthesized
gggaggtcgaggtgggtggatc

SEQ ID NO: 724204 - DNA, 22 bp, Artificial Sequence
  chemically synthesized
ctgacctcaggtgatccaccca

SEQ ID NO: 724205 - DNA, 22 bp, Artificial Sequence
  chemically synthesized
ggaggtcgaggtgggtggatca

SEQ ID NO: 724206 - DNA, 22 bp, Artificial Sequence
  chemically synthesized
cgaaactcctgacctcaggtga

SEQ ID NO: 724207 - DNA, 22 bp, Artificial Sequence
  chemically synthesized
ttccgaaactcctgacctcagg

SEQ ID NO: 724208 - DNA, 22 bp, Artificial Sequence
  chemically synthesized
gccaggctgttccgaaactcct

SEQ ID NO: 724209 - DNA, 22 bp, Artificial Sequence
  chemically synthesized
aggtcaggagtttcggaacagc

SEQ ID NO: 724210 - DNA, 22 bp, Artificial Sequence
  chemically synthesized
accatgttggccaggctgttcc

SEQ ID NO: 724211 - DNA, 22 bp, Artificial Sequence
  chemically synthesized
caccatgttggccaggctgttc

SEQ ID NO: 724212 - DNA, 22 bp, Artificial Sequence
  chemically synthesized
cggaacagcctggccaacatgg

SEQ ID NO: 724213 - DNA, 22 bp, Artificial Sequence
  chemically synthesized
ggaacagcctggccaacatggt

SEQ ID NO: 724214 - DNA, 22 bp, Artificial Sequence
  chemically synthesized
agtagagacagagtttcaccat

SEQ ID NO: 724215 - DNA, 22 bp, Artificial Sequence
  chemically synthesized
cagtagagacagagtttcacca

SEQ ID NO: 724216 - DNA, 22 bp, Artificial Sequence
  chemically synthesized
tcagtagagacagagtttcacc

SEQ ID NO: 724217 - DNA, 22 bp, Artificial Sequence
  chemically synthesized
gccaacatggtgaaactctgtc

SEQ ID NO: 724218 - DNA, 22 bp, Artificial Sequence
  chemically synthesized
tattttcagtagagacagagtt

SEQ ID NO: 724219 - DNA, 22 bp, Artificial Sequence
  chemically synthesized
gtattttcagtagagacagagt

SEQ ID NO: 724220 - DNA, 22 bp, Artificial Sequence
  chemically synthesized
tgtattttcagtagagacagag

SEQ ID NO: 724221 - DNA, 22 bp, Artificial Sequence
  chemically synthesized
ttgtattttcagtagagacaga

SEQ ID NO: 724222 - DNA, 22 bp, Artificial Sequence
  chemically synthesized
atttttgtattttcagtagaga

SEQ ID NO: 724223 - DNA, 22 bp, Artificial Sequence
  chemically synthesized
tgtctctactgaaaatacaaaa

SEQ ID NO: 724224 - DNA, 22 bp, Artificial Sequence
  chemically synthesized
tctctactgaaaatacaaaaat

SEQ ID NO: 724225 - DNA, 22 bp, Artificial Sequence
  chemically synthesized
tactgaaaatacaaaaattagc

SEQ ID NO: 724226 - DNA, 22 bp, Artificial Sequence
  chemically synthesized
ctgaaaatacaaaaattagctg

SEQ ID NO: 724227 - DNA, 22 bp, Artificial Sequence
  chemically synthesized
aaaatacaaaaattagctgggt

SEQ ID NO: 724228 - DNA, 22 bp, Artificial Sequence
  chemically synthesized
caggcacgtgccaccacaccca

SEQ ID NO: 724229 - DNA, 22 bp, Artificial Sequence
  chemically synthesized
ggactacaggcacgtgccacca

SEQ ID NO: 724230 - DNA, 22 bp, Artificial Sequence
  chemically synthesized
gctgggtgtggtggcacgtgcc

SEQ ID NO: 724231 - DNA, 22 bp, Artificial Sequence
  chemically synthesized
ggtgtggtggcacgtgcctgta

SEQ ID NO: 724232 - DNA, 22 bp, Artificial Sequence
  chemically synthesized
agtagctgggactacaggcacg

SEQ ID NO: 724233 - DNA, 22 bp, Artificial Sequence
  chemically synthesized
ctgagtagctgggactacaggc

SEQ ID NO: 724234 - DNA, 22 bp, Artificial Sequence
  chemically synthesized
agcctcctgagtagctgggact

SEQ ID NO: 724235 - DNA, 22 bp, Artificial Sequence
  chemically synthesized
cctcagcctcctgagtagctgg

SEQ ID NO: 724236 - DNA, 22 bp, Artificial Sequence
  chemically synthesized
ctgcctcagcctcctgagtagc

SEQ ID NO: 724237 - DNA, 22 bp, Artificial Sequence
  chemically synthesized
tcctgcctcagcctcctgagta

SEQ ID NO: 724238 - DNA, 22 bp, Artificial Sequence
  chemically synthesized
tagtcccagctactcaggaggc

SEQ ID NO: 724239 - DNA, 22 bp, Artificial Sequence
  chemically synthesized
aagcaattctcctgcctcagcc

SEQ ID NO: 724240 - DNA, 22 bp, Artificial Sequence
  chemically synthesized
ctcaggaggctgaggcaggaga

SEQ ID NO: 724241 - DNA, 22 bp, Artificial Sequence
  chemically synthesized
aggaggctgaggcaggagaatt

SEQ ID NO: 724242 - DNA, 22 bp, Artificial Sequence
  chemically synthesized
ccgggttcaagcaattctcctg

SEQ ID NO: 724243 - DNA, 22 bp, Artificial Sequence
  chemically synthesized
gctcccgggttcaagcaattct

SEQ ID NO: 724244 - DNA, 22 bp, Artificial Sequence
  chemically synthesized
tggctcccgggttcaagcaatt

SEQ ID NO: 724245 - DNA, 22 bp, Artificial Sequence
  chemically synthesized
aggcaggagaattgcttgaacc

SEQ ID NO: 724246 - DNA, 22 bp, Artificial Sequence
  chemically synthesized
caacctctggctcccgggttca

SEQ ID NO: 724247 - DNA, 22 bp, Artificial Sequence
  chemically synthesized
actgcaacctctggctcccggg

SEQ ID NO: 724248 - DNA, 22 bp, Artificial Sequence
  chemically synthesized
agctcactgcaacctctggctc

SEQ ID NO: 724249 - DNA, 22 bp, Artificial Sequence
  chemically synthesized
cttgaacccgggagccagaggt

SEQ ID NO: 724250 - DNA, 22 bp, Artificial Sequence
  chemically synthesized
gaacccgggagccagaggttgc

SEQ ID NO: 724251 - DNA, 22 bp, Artificial Sequence
  chemically synthesized
aacccgggagccagaggttgca

SEQ ID NO: 724252 - DNA, 22 bp, Artificial Sequence
  chemically synthesized
gagtccaatggcatgatctcag

SEQ ID NO: 724253 - DNA, 22 bp, Artificial Sequence
  chemically synthesized
cagtgagctgagatcatgccat

SEQ ID NO: 724254 - DNA, 22 bp, Artificial Sequence
  chemically synthesized
cgtggcccagactggagtccaa

SEQ ID NO: 724255 - DNA, 22 bp, Artificial Sequence
  chemically synthesized
agatcatgccattggactccag

SEQ ID NO: 724256 - DNA, 22 bp, Artificial Sequence
  chemically synthesized
gctccgtggcccagactggagt

SEQ ID NO: 724257 - DNA, 22 bp, Artificial Sequence
  chemically synthesized
gactccagtctgggccacggag

SEQ ID NO: 724258 - DNA, 22 bp, Artificial Sequence
  chemically synthesized
agacagagtctcgctccgtggc

SEQ ID NO: 724259 - DNA, 22 bp, Artificial Sequence
  chemically synthesized
gagacagagtctcgctccgtgg

SEQ ID NO: 724260 - DNA, 22 bp, Artificial Sequence
  chemically synthesized
tgagacagagtctcgctccgtg

SEQ ID NO: 724261 - DNA, 22 bp, Artificial Sequence
  chemically synthesized
ttgagacagagtctcgctccgt

SEQ ID NO: 724262 - DNA, 22 bp, Artificial Sequence
  chemically synthesized
cagtctgggccacggagcgaga

SEQ ID NO: 724263 - DNA, 22 bp, Artificial Sequence
  chemically synthesized
tttgagacagagtctcgctccg

SEQ ID NO: 724264 - DNA, 22 bp, Artificial Sequence
  chemically synthesized
ttttgagacagagtctcgctcc

SEQ ID NO: 724265 - DNA, 22 bp, Artificial Sequence
  chemically synthesized
tttttgagacagagtctcgctc

SEQ ID NO: 724266 - DNA, 22 bp, Artificial Sequence
  chemically synthesized
ggccacggagcgagactctgtc

SEQ ID NO: 724267 - DNA, 22 bp, Artificial Sequence
  chemically synthesized
aaaaattttttttgagacagag

SEQ ID NO: 724268 - DNA, 22 bp, Artificial Sequence
  chemically synthesized
aaaaaattttttttgagacaga

SEQ ID NO: 724269 - DNA, 22 bp, Artificial Sequence
  chemically synthesized
taaaaaattttttttgagacag

SEQ ID NO: 724270 - DNA, 22 bp, Artificial Sequence
  chemically synthesized
tgtctcaaaaaaaattttttaa

SEQ ID NO: 724271 - DNA, 22 bp, Artificial Sequence
  chemically synthesized
tctcaaaaaaaattttttaaag

SEQ ID NO: 724272 - DNA, 22 bp, Artificial Sequence
  chemically synthesized
aaaaaaaattttttaaagttga

SEQ ID NO: 724273 - DNA, 22 bp, Artificial Sequence
  chemically synthesized
tttaaagttgatattccattta

SEQ ID NO: 724274 - DNA, 22 bp, Artificial Sequence
  chemically synthesized
agtggagaaaaataaatggaat

SEQ ID NO: 724275 - DNA, 22 bp, Artificial Sequence
  chemically synthesized
ttaaagttgatattccatttat

SEQ ID NO: 724276 - DNA, 22 bp, Artificial Sequence
  chemically synthesized
aagtggagaaaaataaatggaa

SEQ ID NO: 724277 - DNA, 22 bp, Artificial Sequence
  chemically synthesized
taaagttgatattccatttatt

SEQ ID NO: 724278 - DNA, 22 bp, Artificial Sequence
  chemically synthesized
aaagttgatattccatttattt

SEQ ID NO: 724279 - DNA, 22 bp, Artificial Sequence
  chemically synthesized
aagttgatattccatttatttt

SEQ ID NO: 724280 - DNA, 22 bp, Artificial Sequence
  chemically synthesized
tatttaagtggagaaaaataaa

SEQ ID NO: 724281 - DNA, 22 bp, Artificial Sequence
  chemically synthesized
atattccatttatttttctcca

SEQ ID NO: 724282 - DNA, 22 bp, Artificial Sequence
  chemically synthesized
catttatttttctccacttaaa

SEQ ID NO: 724283 - DNA, 22 bp, Artificial Sequence
  chemically synthesized
atttttctccacttaaatacag

SEQ ID NO: 724284 - DNA, 22 bp, Artificial Sequence
  chemically synthesized
tttttctccacttaaatacaga

SEQ ID NO: 724285 - DNA, 22 bp, Artificial Sequence
  chemically synthesized
ttctccacttaaatacagattt

SEQ ID NO: 724286 - DNA, 22 bp, Artificial Sequence
  chemically synthesized
tctccacttaaatacagatttt

SEQ ID NO: 724287 - DNA, 22 bp, Artificial Sequence
  chemically synthesized
ctccacttaaatacagattttt

SEQ ID NO: 724288 - DNA, 22 bp, Artificial Sequence
  chemically synthesized
tgagatcataaaaaaaatctgt

SEQ ID NO: 724289 - DNA, 22 bp, Artificial Sequence
  chemically synthesized
tccacttaaatacagatttttt

SEQ ID NO: 724290 - DNA, 22 bp, Artificial Sequence
  chemically synthesized
atgagatcataaaaaaaatctg

SEQ ID NO: 724291 - DNA, 22 bp, Artificial Sequence
  chemically synthesized
cacttaaatacagatttttttt

SEQ ID NO: 724292 - DNA, 22 bp, Artificial Sequence
  chemically synthesized
aaatacagattttttttatgat

SEQ ID NO: 724293 - DNA, 22 bp, Artificial Sequence
  chemically synthesized
aatacagattttttttatgatc

SEQ ID NO: 724294 - DNA, 22 bp, Artificial Sequence
  chemically synthesized
tgatccttatgagatcataaaa

SEQ ID NO: 724295 - DNA, 22 bp, Artificial Sequence
  chemically synthesized
attgtgatccttatgagatcat

SEQ ID NO: 724296 - DNA, 22 bp, Artificial Sequence
  chemically synthesized
ttcattgtgatccttatgagat

SEQ ID NO: 724297 - DNA, 22 bp, Artificial Sequence
  chemically synthesized
tttttatgatctcataaggatc

SEQ ID NO: 724298 - DNA, 22 bp, Artificial Sequence
  chemically synthesized
gctattcattgtgatccttatg

SEQ ID NO: 724299 - DNA, 22 bp, Artificial Sequence
  chemically synthesized
ttttatgatctcataaggatca

SEQ ID NO: 724300 - DNA, 22 bp, Artificial Sequence
  chemically synthesized
tttatgatctcataaggatcac

SEQ ID NO: 724301 - DNA, 22 bp, Artificial Sequence
  chemically synthesized
ttatgatctcataaggatcaca

SEQ ID NO: 724302 - DNA, 22 bp, Artificial Sequence
  chemically synthesized
tatgatctcataaggatcacaa

SEQ ID NO: 724303 - DNA, 22 bp, Artificial Sequence
  chemically synthesized
atgatctcataaggatcacaat

SEQ ID NO: 724304 - DNA, 22 bp, Artificial Sequence
  chemically synthesized
tgatctcataaggatcacaatg

SEQ ID NO: 724305 - DNA, 22 bp, Artificial Sequence
  chemically synthesized
aggcctagctattcattgtgat

SEQ ID NO: 724306 - DNA, 22 bp, Artificial Sequence
  chemically synthesized
ataaggatcacaatgaatagct

SEQ ID NO: 724307 - DNA, 22 bp, Artificial Sequence
  chemically synthesized
caaaactaaggcctagctattc

SEQ ID NO: 724308 - DNA, 22 bp, Artificial Sequence
  chemically synthesized
aagctgcaaaactaaggcctag

SEQ ID NO: 724309 - DNA, 22 bp, Artificial Sequence
  chemically synthesized
ggccttagttttgcagctttag

SEQ ID NO: 724310 - DNA, 22 bp, Artificial Sequence
  chemically synthesized
atagtaatgaaactaaagctgc

SEQ ID NO: 724311 - DNA, 22 bp, Artificial Sequence
  chemically synthesized
tcatagtaatgaaactaaagct

SEQ ID NO: 724312 - DNA, 22 bp, Artificial Sequence
  chemically synthesized
tctcatagtaatgaaactaaag

SEQ ID NO: 724313 - DNA, 22 bp, Artificial Sequence
  chemically synthesized
agttttgcagctttagtttcat

SEQ ID NO: 724314 - DNA, 22 bp, Artificial Sequence
  chemically synthesized
tctctcatagtaatgaaactaa

SEQ ID NO: 724315 - DNA, 22 bp, Artificial Sequence
  chemically synthesized
gttttgcagctttagtttcatt

SEQ ID NO: 724316 - DNA, 22 bp, Artificial Sequence
  chemically synthesized
tctctctcatagtaatgaaact

SEQ ID NO: 724317 - DNA, 22 bp, Artificial Sequence
  chemically synthesized
tctctctctcatagtaatgaaa

SEQ ID NO: 724318 - DNA, 22 bp, Artificial Sequence
  chemically synthesized
tgcagctttagtttcattacta

SEQ ID NO: 724319 - DNA, 22 bp, Artificial Sequence
  chemically synthesized
ctctctctctcatagtaatgaa

SEQ ID NO: 724320 - DNA, 22 bp, Artificial Sequence
  chemically synthesized
gcagctttagtttcattactat

SEQ ID NO: 724321 - DNA, 22 bp, Artificial Sequence
  chemically synthesized
cagctttagtttcattactatg

SEQ ID NO: 724322 - DNA, 22 bp, Artificial Sequence
  chemically synthesized
acccttctctctctctcatagt

SEQ ID NO: 724323 - DNA, 22 bp, Artificial Sequence
  chemically synthesized
tagtttcattactatgagagag

SEQ ID NO: 724324 - DNA, 22 bp, Artificial Sequence
  chemically synthesized
tcacccttctctctctctcata

SEQ ID NO: 724325 - DNA, 22 bp, Artificial Sequence
  chemically synthesized
agtttcattactatgagagaga

SEQ ID NO: 724326 - DNA, 22 bp, Artificial Sequence
  chemically synthesized
gtttcattactatgagagagag

SEQ ID NO: 724327 - DNA, 22 bp, Artificial Sequence
  chemically synthesized
tctcacccttctctctctctca

SEQ ID NO: 724328 - DNA, 22 bp, Artificial Sequence
  chemically synthesized
tctctcacccttctctctctct

SEQ ID NO: 724329 - DNA, 22 bp, Artificial Sequence
  chemically synthesized
cattactatgagagagagagaa

SEQ ID NO: 724330 - DNA, 22 bp, Artificial Sequence
  chemically synthesized
tctctctcacccttctctctct

SEQ ID NO: 724331 - DNA, 22 bp, Artificial Sequence
  chemically synthesized
attactatgagagagagagaag

SEQ ID NO: 724332 - DNA, 22 bp, Artificial Sequence
  chemically synthesized
tctctctctcacccttctctct

SEQ ID NO: 724333 - DNA, 22 bp, Artificial Sequence
  chemically synthesized
tctctctctctcacccttctct

SEQ ID NO: 724334 - DNA, 22 bp, Artificial Sequence
  chemically synthesized
ctatgagagagagagaagggtg

SEQ ID NO: 724335 - DNA, 22 bp, Artificial Sequence
  chemically synthesized
tctctctctctctcacccttct

SEQ ID NO: 724336 - DNA, 22 bp, Artificial Sequence
  chemically synthesized
tgagagagagagaagggtgaga

SEQ ID NO: 724337 - DNA, 22 bp, Artificial Sequence
  chemically synthesized
tctctctctctctctcaccctt

SEQ ID NO: 724338 - DNA, 22 bp, Artificial Sequence
  chemically synthesized
tctctctctctctctctcaccc

SEQ ID NO: 724339 - DNA, 22 bp, Artificial Sequence
  chemically synthesized
tctctctctctctctctctcac

SEQ ID NO: 724340 - DNA, 22 bp, Artificial Sequence
  chemically synthesized
gtctctctctctctctctctct

SEQ ID NO: 724341 - DNA, 22 bp, Artificial Sequence
  chemically synthesized
ggtctctctctctctctctctc

SEQ ID NO: 724342 - DNA, 22 bp, Artificial Sequence
  chemically synthesized
accacacttggtctctctctct

SEQ ID NO: 724343 - DNA, 22 bp, Artificial Sequence
  chemically synthesized
tcaccacacttggtctctctct

SEQ ID NO: 724344 - DNA, 22 bp, Artificial Sequence
  chemically synthesized
ctcaccacacttggtctctctc

SEQ ID NO: 724345 - DNA, 22 bp, Artificial Sequence
  chemically synthesized
gacccacaaagacaacatatgt

SEQ ID NO: 724346 - DNA, 22 bp, Artificial Sequence
  chemically synthesized
gtagaaggatgaaatactggac

SEQ ID NO: 724347 - DNA, 22 bp, Artificial Sequence
  chemically synthesized
tctttgtgggtccagtatttca

SEQ ID NO: 724348 - DNA, 22 bp, Artificial Sequence
  chemically synthesized
tgtgggtccagtatttcatcct

SEQ ID NO: 724349 - DNA, 22 bp, Artificial Sequence
  chemically synthesized
gtgggtccagtatttcatcctt

SEQ ID NO: 724350 - DNA, 22 bp, Artificial Sequence
  chemically synthesized
tgggtccagtatttcatccttc

SEQ ID NO: 724351 - DNA, 22 bp, Artificial Sequence
  chemically synthesized
catccttctactaactgcctgg

SEQ ID NO: 724352 - DNA, 22 bp, Artificial Sequence
  chemically synthesized
atccttctactaactgcctggt

SEQ ID NO: 724353 - DNA, 22 bp, Artificial Sequence
  chemically synthesized
ctactaactgcctggttgttgt

SEQ ID NO: 724354 - DNA, 22 bp, Artificial Sequence
  chemically synthesized
tactaactgcctggttgttgtt

SEQ ID NO: 724355 - DNA, 22 bp, Artificial Sequence
  chemically synthesized
ctaactgcctggttgttgtttc

SEQ ID NO: 724356 - DNA, 22 bp, Artificial Sequence
  chemically synthesized
actgcctggttgttgtttctgt

SEQ ID NO: 724357 - DNA, 22 bp, Artificial Sequence
  chemically synthesized
aaaggaaaaacaaaaacagaaa

SEQ ID NO: 724358 - DNA, 22 bp, Artificial Sequence
  chemically synthesized
cctggttgttgtttctgttttt

SEQ ID NO: 724359 - DNA, 22 bp, Artificial Sequence
  chemically synthesized
ctcaaaggaaaaacaaaaacag

SEQ ID NO: 724360 - DNA, 22 bp, Artificial Sequence
  chemically synthesized
gttgttgtttctgtttttgttt

SEQ ID NO: 724361 - DNA, 22 bp, Artificial Sequence
  chemically synthesized
ttgtttctgtttttgtttttcc

SEQ ID NO: 724362 - DNA, 22 bp, Artificial Sequence
  chemically synthesized
tttctgtttttgtttttccttt

SEQ ID NO: 724363 - DNA, 22 bp, Artificial Sequence
  chemically synthesized
ctgtttttgtttttcctttgag

SEQ ID NO: 724364 - DNA, 22 bp, Artificial Sequence
  chemically synthesized
tgtttttgtttttcctttgagg

SEQ ID NO: 724365 - DNA, 22 bp, Artificial Sequence
  chemically synthesized
tttttgtttttcctttgaggaa

SEQ ID NO: 724366 - DNA, 22 bp, Artificial Sequence
  chemically synthesized
ttgtttttcctttgaggaatcg

SEQ ID NO: 724367 - DNA, 22 bp, Artificial Sequence
  chemically synthesized
tgtttttcctttgaggaatcgc

SEQ ID NO: 724368 - DNA, 22 bp, Artificial Sequence
  chemically synthesized
gtttttcctttgaggaatcgct

SEQ ID NO: 724369 - DNA, 22 bp, Artificial Sequence
  chemically synthesized
tttttcctttgaggaatcgctt

SEQ ID NO: 724370 - DNA, 22 bp, Artificial Sequence
  chemically synthesized
ttcctttgaggaatcgctttcc

SEQ ID NO: 724371 - DNA, 22 bp, Artificial Sequence
  chemically synthesized
tcctttgaggaatcgctttccc

SEQ ID NO: 724372 - DNA, 22 bp, Artificial Sequence
  chemically synthesized
cctttgaggaatcgctttcccc

SEQ ID NO: 724373 - DNA, 22 bp, Artificial Sequence
  chemically synthesized
ctttgaggaatcgctttcccca

SEQ ID NO: 724374 - DNA, 22 bp, Artificial Sequence
  chemically synthesized
tgaggaatcgctttccccatat

SEQ ID NO: 724375 - DNA, 22 bp, Artificial Sequence
  chemically synthesized
gagtcacaagaaatatggggaa

SEQ ID NO: 724376 - DNA, 22 bp, Artificial Sequence
  chemically synthesized
gaggaatcgctttccccatatt

SEQ ID NO: 724377 - DNA, 22 bp, Artificial Sequence
  chemically synthesized
aggaatcgctttccccatattt

SEQ ID NO: 724378 - DNA, 22 bp, Artificial Sequence
  chemically synthesized
ctagagtcacaagaaatatggg

SEQ ID NO: 724379 - DNA, 22 bp, Artificial Sequence
  chemically synthesized
tactagagtcacaagaaatatg

SEQ ID NO: 724380 - DNA, 22 bp, Artificial Sequence
  chemically synthesized
gcagctctactagagtcacaag

SEQ ID NO: 724381 - DNA, 22 bp, Artificial Sequence
  chemically synthesized
tccccatatttcttgtgactct

SEQ ID NO: 724382 - DNA, 22 bp, Artificial Sequence
  chemically synthesized
ccccatatttcttgtgactcta

SEQ ID NO: 724383 - DNA, 22 bp, Artificial Sequence
  chemically synthesized
cccatatttcttgtgactctag

SEQ ID NO: 724384 - DNA, 22 bp, Artificial Sequence
  chemically synthesized
cttgtgactctagtagagctgc

SEQ ID NO: 724385 - DNA, 22 bp, Artificial Sequence
  chemically synthesized
ttgtgactctagtagagctgcc

SEQ ID NO: 724386 - DNA, 22 bp, Artificial Sequence
  chemically synthesized
gtgactctagtagagctgccaa

SEQ ID NO: 724387 - DNA, 22 bp, Artificial Sequence
  chemically synthesized
tgactctagtagagctgccaat

SEQ ID NO: 724388 - DNA, 22 bp, Artificial Sequence
  chemically synthesized
tagtagagctgccaatcatggt

SEQ ID NO: 724389 - DNA, 22 bp, Artificial Sequence
  chemically synthesized
gtagagctgccaatcatggtac

SEQ ID NO: 724390 - DNA, 22 bp, Artificial Sequence
  chemically synthesized
aggaaggcaaaaaggtaccatg

SEQ ID NO: 724391 - DNA, 22 bp, Artificial Sequence
  chemically synthesized
ccaatcatggtacctttttgcc

SEQ ID NO: 724392 - DNA, 22 bp, Artificial Sequence
  chemically synthesized
ggggaattgaggaaggcaaaaa

SEQ ID NO: 724393 - DNA, 22 bp, Artificial Sequence
  chemically synthesized
aggggaattgaggaaggcaaaa

SEQ ID NO: 724394 - DNA, 22 bp, Artificial Sequence
  chemically synthesized
taggggaattgaggaaggcaaa

SEQ ID NO: 724395 - DNA, 22 bp, Artificial Sequence
  chemically synthesized
tttaggggaattgaggaaggca

SEQ ID NO: 724396 - DNA, 22 bp, Artificial Sequence
  chemically synthesized
aactctttaggggaattgagga

SEQ ID NO: 724397 - DNA, 22 bp, Artificial Sequence
  chemically synthesized
gaactctttaggggaattgagg

SEQ ID NO: 724398 - DNA, 22 bp, Artificial Sequence
  chemically synthesized
tgaactctttaggggaattgag

SEQ ID NO: 724399 - DNA, 22 bp, Artificial Sequence
  chemically synthesized
tttgccttcctcaattccccta

SEQ ID NO: 724400 - DNA, 22 bp, Artificial Sequence
  chemically synthesized
ttgccttcctcaattcccctaa

SEQ ID NO: 724401 - DNA, 22 bp, Artificial Sequence
  chemically synthesized
tgccttcctcaattcccctaaa

SEQ ID NO: 724402 - DNA, 22 bp, Artificial Sequence
  chemically synthesized
gccttcctcaattcccctaaag

SEQ ID NO: 724403 - DNA, 22 bp, Artificial Sequence
  chemically synthesized
ccttcctcaattcccctaaaga

SEQ ID NO: 724404 - DNA, 22 bp, Artificial Sequence
  chemically synthesized
tggggtctttgaactctttagg

SEQ ID NO: 724405 - DNA, 22 bp, Artificial Sequence
  chemically synthesized
cctcaattcccctaaagagttc

SEQ ID NO: 724406 - DNA, 22 bp, Artificial Sequence
  chemically synthesized
ctcaattcccctaaagagttca

SEQ ID NO: 724407 - DNA, 22 bp, Artificial Sequence
  chemically synthesized
aattcccctaaagagttcaaag

SEQ ID NO: 724408 - DNA, 22 bp, Artificial Sequence
  chemically synthesized
agtaacctatggggtctttgaa

SEQ ID NO: 724409 - DNA, 22 bp, Artificial Sequence
  chemically synthesized
ccctaaagagttcaaagacccc

SEQ ID NO: 724410 - DNA, 22 bp, Artificial Sequence
  chemically synthesized
aagagttcaaagaccccatagg

SEQ ID NO: 724411 - DNA, 22 bp, Artificial Sequence
  chemically synthesized
agtggcagagtctgagtaacct

SEQ ID NO: 724412 - DNA, 22 bp, Artificial Sequence
  chemically synthesized
aaagaccccataggttactcag

SEQ ID NO: 724413 - DNA, 22 bp, Artificial Sequence
  chemically synthesized
ctgagtggcagagtctgagtaa

SEQ ID NO: 724414 - DNA, 22 bp, Artificial Sequence
  chemically synthesized
cctgagtggcagagtctgagta

SEQ ID NO: 724415 - DNA, 22 bp, Artificial Sequence
  chemically synthesized
tcagcttcctgagtggcagagt

SEQ ID NO: 724416 - DNA, 22 bp, Artificial Sequence
  chemically synthesized
gtcagcttcctgagtggcagag

SEQ ID NO: 724417 - DNA, 22 bp, Artificial Sequence
  chemically synthesized
tgtcagcttcctgagtggcaga

SEQ ID NO: 724418 - DNA, 22 bp, Artificial Sequence
  chemically synthesized
ctttgtcagcttcctgagtggc

SEQ ID NO: 724419 - DNA, 22 bp, Artificial Sequence
  chemically synthesized
cctttgtcagcttcctgagtgg

SEQ ID NO: 724420 - DNA, 22 bp, Artificial Sequence
  chemically synthesized
ctcagactctgccactcaggaa

SEQ ID NO: 724421 - DNA, 22 bp, Artificial Sequence
  chemically synthesized
ttcctttgtcagcttcctgagt

SEQ ID NO: 724422 - DNA, 22 bp, Artificial Sequence
  chemically synthesized
cttcctttgtcagcttcctgag

SEQ ID NO: 724423 - DNA, 22 bp, Artificial Sequence
  chemically synthesized
agactctgccactcaggaagct

SEQ ID NO: 724424 - DNA, 22 bp, Artificial Sequence
  chemically synthesized
tcttcctttgtcagcttcctga

SEQ ID NO: 724425 - DNA, 22 bp, Artificial Sequence
  chemically synthesized
ttttcttcctttgtcagcttcc

SEQ ID NO: 724426 - DNA, 22 bp, Artificial Sequence
  chemically synthesized
tgccactcaggaagctgacaaa

SEQ ID NO: 724427 - DNA, 22 bp, Artificial Sequence
  chemically synthesized
ccactcaggaagctgacaaagg

SEQ ID NO: 724428 - DNA, 22 bp, Artificial Sequence
  chemically synthesized
tattattttcttcctttgtcag

SEQ ID NO: 724429 - DNA, 22 bp, Artificial Sequence
  chemically synthesized
gtattattttcttcctttgtca

SEQ ID NO: 724430 - DNA, 22 bp, Artificial Sequence
  chemically synthesized
aggaagctgacaaaggaagaaa

SEQ ID NO: 724431 - DNA, 22 bp, Artificial Sequence
  chemically synthesized
caaccttgtattattttcttcc

SEQ ID NO: 724432 - DNA, 22 bp, Artificial Sequence
  chemically synthesized
ccaaccttgtattattttcttc

SEQ ID NO: 724433 - DNA, 22 bp, Artificial Sequence
  chemically synthesized
tccaaccttgtattattttctt

SEQ ID NO: 724434 - DNA, 22 bp, Artificial Sequence
  chemically synthesized
acaaaggaagaaaataatacaa

SEQ ID NO: 724435 - DNA, 22 bp, Artificial Sequence
  chemically synthesized
caaagtctttccaaccttgtat

SEQ ID NO: 724436 - DNA, 22 bp, Artificial Sequence
  chemically synthesized
agctccaaagtctttccaacct

SEQ ID NO: 724437 - DNA, 22 bp, Artificial Sequence
  chemically synthesized
aaatactaagctccaaagtctt

SEQ ID NO: 724438 - DNA, 22 bp, Artificial Sequence
  chemically synthesized
gaaatactaagctccaaagtct

SEQ ID NO: 724439 - DNA, 22 bp, Artificial Sequence
  chemically synthesized
tgaaatactaagctccaaagtc

SEQ ID NO: 724440 - DNA, 22 bp, Artificial Sequence
  chemically synthesized
tctttgaaatactaagctccaa

SEQ ID NO: 724441 - DNA, 22 bp, Artificial Sequence
  chemically synthesized
gaaagactttggagcttagtat

SEQ ID NO: 724442 - DNA, 22 bp, Artificial Sequence
  chemically synthesized
agtgttgtctttgaaatactaa

SEQ ID NO: 724443 - DNA, 22 bp, Artificial Sequence
  chemically synthesized
aagtgttgtctttgaaatacta

SEQ ID NO: 724444 - DNA, 22 bp, Artificial Sequence
  chemically synthesized
taagtgttgtctttgaaatact

SEQ ID NO: 724445 - DNA, 22 bp, Artificial Sequence
  chemically synthesized
ttaagtgttgtctttgaaatac

SEQ ID NO: 724446 - DNA, 22 bp, Artificial Sequence
  chemically synthesized
tttaagtgttgtctttgaaata

SEQ ID NO: 724447 - DNA, 22 bp, Artificial Sequence
  chemically synthesized
tggagcttagtatttcaaagac

SEQ ID NO: 724448 - DNA, 22 bp, Artificial Sequence
  chemically synthesized
tttttaagtgttgtctttgaaa

SEQ ID NO: 724449 - DNA, 22 bp, Artificial Sequence
  chemically synthesized
ggagcttagtatttcaaagaca

SEQ ID NO: 724450 - DNA, 22 bp, Artificial Sequence
  chemically synthesized
ctttttaagtgttgtctttgaa

SEQ ID NO: 724451 - DNA, 22 bp, Artificial Sequence
  chemically synthesized
gagcttagtatttcaaagacaa

SEQ ID NO: 724452 - DNA, 22 bp, Artificial Sequence
  chemically synthesized
agtatttcaaagacaacactta

SEQ ID NO: 724453 - DNA, 22 bp, Artificial Sequence
  chemically synthesized
gtatttcaaagacaacacttaa

SEQ ID NO: 724454 - DNA, 22 bp, Artificial Sequence
  chemically synthesized
caaagacaacacttaaaaagaa

SEQ ID NO: 724455 - DNA, 22 bp, Artificial Sequence
  chemically synthesized
aaagacaacacttaaaaagaag

SEQ ID NO: 724456 - DNA, 22 bp, Artificial Sequence
  chemically synthesized
aaaagcaggaacacatgcatct

SEQ ID NO: 724457 - DNA, 22 bp, Artificial Sequence
  chemically synthesized
aaaaagaagatgcatgtgttcc

SEQ ID NO: 724458 - DNA, 22 bp, Artificial Sequence
  chemically synthesized
aaaagaagatgcatgtgttcct

SEQ ID NO: 724459 - DNA, 22 bp, Artificial Sequence
  chemically synthesized
aaatctcaaaagcaggaacaca

SEQ ID NO: 724460 - DNA, 22 bp, Artificial Sequence
  chemically synthesized
taaaatctcaaaagcaggaaca

SEQ ID NO: 724461 - DNA, 22 bp, Artificial Sequence
  chemically synthesized
ctgcttttgagattttagaact

SEQ ID NO: 724462 - DNA, 22 bp, Artificial Sequence
  chemically synthesized
cttttgagattttagaactctt

SEQ ID NO: 724463 - DNA, 22 bp, Artificial Sequence
  chemically synthesized
ttgagattttagaactcttata

SEQ ID NO: 724464 - DNA, 22 bp, Artificial Sequence
  chemically synthesized
tgagattttagaactcttatac

SEQ ID NO: 724465 - DNA, 22 bp, Artificial Sequence
  chemically synthesized
gagattttagaactcttatact

SEQ ID NO: 724466 - DNA, 22 bp, Artificial Sequence
  chemically synthesized
agattttagaactcttatactt

SEQ ID NO: 724467 - DNA, 22 bp, Artificial Sequence
  chemically synthesized
agaataggacatgaagtataag

SEQ ID NO: 724468 - DNA, 22 bp, Artificial Sequence
  chemically synthesized
tagaactcttatacttcatgtc

SEQ ID NO: 724469 - DNA, 22 bp, Artificial Sequence
  chemically synthesized
agaactcttatacttcatgtcc

SEQ ID NO: 724470 - DNA, 22 bp, Artificial Sequence
  chemically synthesized
ggtctcagaataggacatgaag

SEQ ID NO: 724471 - DNA, 22 bp, Artificial Sequence
  chemically synthesized
gaactcttatacttcatgtcct

SEQ ID NO: 724472 - DNA, 22 bp, Artificial Sequence
  chemically synthesized
ttatacttcatgtcctattctg

SEQ ID NO: 724473 - DNA, 22 bp, Artificial Sequence
  chemically synthesized
aaaactaggtctcagaatagga

SEQ ID NO: 724474 - DNA, 22 bp, Artificial Sequence
  chemically synthesized
gaaaactaggtctcagaatagg

SEQ ID NO: 724475 - DNA, 22 bp, Artificial Sequence
  chemically synthesized
atacttcatgtcctattctgag

SEQ ID NO: 724476 - DNA, 22 bp, Artificial Sequence
  chemically synthesized
tacttcatgtcctattctgaga

SEQ ID NO: 724477 - DNA, 22 bp, Artificial Sequence
  chemically synthesized
catgtcctattctgagacctag

SEQ ID NO: 724478 - DNA, 22 bp, Artificial Sequence
  chemically synthesized
atgtcctattctgagacctagt

SEQ ID NO: 724479 - DNA, 22 bp, Artificial Sequence
  chemically synthesized
ttctgagacctagttttcaaat

SEQ ID NO: 724480 - DNA, 22 bp, Artificial Sequence
  chemically synthesized
tgagacctagttttcaaattac

SEQ ID NO: 724481 - DNA, 22 bp, Artificial Sequence
  chemically synthesized
agacctagttttcaaattactt

SEQ ID NO: 724482 - DNA, 22 bp, Artificial Sequence
  chemically synthesized
atagaaatgaacgaagtaattt

SEQ ID NO: 724483 - DNA, 22 bp, Artificial Sequence
  chemically synthesized
gttttcaaattacttcgttcat

SEQ ID NO: 724484 - DNA, 22 bp, Artificial Sequence
  chemically synthesized
tcaaattacttcgttcatttct

SEQ ID NO: 724485 - DNA, 22 bp, Artificial Sequence
  chemically synthesized
aaagatactcatagaaatgaac

SEQ ID NO: 724486 - DNA, 22 bp, Artificial Sequence
  chemically synthesized
caaattacttcgttcatttcta

SEQ ID NO: 724487 - DNA, 22 bp, Artificial Sequence
  chemically synthesized
aaaagatactcatagaaatgaa

SEQ ID NO: 724488 - DNA, 22 bp, Artificial Sequence
  chemically synthesized
aaattacttcgttcatttctat

SEQ ID NO: 724489 - DNA, 22 bp, Artificial Sequence
  chemically synthesized
tttaaaagatactcatagaaat

SEQ ID NO: 724490 - DNA, 22 bp, Artificial Sequence
  chemically synthesized
atttaaaagatactcatagaaa

SEQ ID NO: 724491 - DNA, 22 bp, Artificial Sequence
  chemically synthesized
tatttaaaagatactcatagaa

SEQ ID NO: 724492 - DNA, 22 bp, Artificial Sequence
  chemically synthesized
cttcgttcatttctatgagtat

SEQ ID NO: 724493 - DNA, 22 bp, Artificial Sequence
  chemically synthesized
tttatttaaaagatactcatag

SEQ ID NO: 724494 - DNA, 22 bp, Artificial Sequence
  chemically synthesized
cgttcatttctatgagtatctt

SEQ ID NO: 724495 - DNA, 22 bp, Artificial Sequence
  chemically synthesized
gttcatttctatgagtatcttt

SEQ ID NO: 724496 - DNA, 22 bp, Artificial Sequence
  chemically synthesized
atttctatgagtatcttttaaa

SEQ ID NO: 724497 - DNA, 22 bp, Artificial Sequence
  chemically synthesized
ctatgagtatcttttaaataaa

SEQ ID NO: 724498 - DNA, 22 bp, Artificial Sequence
  chemically synthesized
tatgagtatcttttaaataaag

SEQ ID NO: 724499 - DNA, 22 bp, Artificial Sequence
  chemically synthesized
tgagtatcttttaaataaagag

SEQ ID NO: 724500 - DNA, 22 bp, Artificial Sequence
  chemically synthesized
ttaaataaagagcccctacccc

SEQ ID NO: 724501 - DNA, 22 bp, Artificial Sequence
  chemically synthesized
taaataaagagcccctacccca

SEQ ID NO: 724502 - DNA, 22 bp, Artificial Sequence
  chemically synthesized
aaataaagagcccctaccccat

SEQ ID NO: 724503 - DNA, 22 bp, Artificial Sequence
  chemically synthesized
aataaagagcccctaccccatc

SEQ ID NO: 724504 - DNA, 22 bp, Artificial Sequence
  chemically synthesized
aagtcagggaaaacaaagggga

SEQ ID NO: 724505 - DNA, 22 bp, Artificial Sequence
  chemically synthesized
attcaagtcagggaaaacaaag

SEQ ID NO: 724506 - DNA, 22 bp, Artificial Sequence
  chemically synthesized
ccccatcccctttgttttccct

SEQ ID NO: 724507 - DNA, 22 bp, Artificial Sequence
  chemically synthesized
gctaattcaagtcagggaaaac

SEQ ID NO: 724508 - DNA, 22 bp, Artificial Sequence
  chemically synthesized
tggctaattcaagtcagggaaa

SEQ ID NO: 724509 - DNA, 22 bp, Artificial Sequence
  chemically synthesized
actctggctaattcaagtcagg

SEQ ID NO: 724510 - DNA, 22 bp, Artificial Sequence
  chemically synthesized
tgttttccctgacttgaattag

SEQ ID NO: 724511 - DNA, 22 bp, Artificial Sequence
  chemically synthesized
gttttccctgacttgaattagc

SEQ ID NO: 724512 - DNA, 22 bp, Artificial Sequence
  chemically synthesized
ttttccctgacttgaattagcc

SEQ ID NO: 724513 - DNA, 22 bp, Artificial Sequence
  chemically synthesized
tccctgacttgaattagccaga

SEQ ID NO: 724514 - DNA, 22 bp, Artificial Sequence
  chemically synthesized
ccctgacttgaattagccagag

SEQ ID NO: 724515 - DNA, 22 bp, Artificial Sequence
  chemically synthesized
cctgacttgaattagccagagt

SEQ ID NO: 724516 - DNA, 22 bp, Artificial Sequence
  chemically synthesized
acttgaattagccagagttagc

SEQ ID NO: 724517 - DNA, 22 bp, Artificial Sequence
  chemically synthesized
taaacaccagcagctaactctg

SEQ ID NO: 724518 - DNA, 22 bp, Artificial Sequence
  chemically synthesized
gaattagccagagttagctgct

SEQ ID NO: 724519 - DNA, 22 bp, Artificial Sequence
  chemically synthesized
aattagccagagttagctgctg

SEQ ID NO: 724520 - DNA, 22 bp, Artificial Sequence
  chemically synthesized
agttataaacaccagcagctaa

SEQ ID NO: 724521 - DNA, 22 bp, Artificial Sequence
  chemically synthesized
cagttataaacaccagcagcta

SEQ ID NO: 724522 - DNA, 22 bp, Artificial Sequence
  chemically synthesized
gccagagttagctgctggtgtt

SEQ ID NO: 724523 - DNA, 22 bp, Artificial Sequence
  chemically synthesized
ccggtcttcagttataaacacc

SEQ ID NO: 724524 - DNA, 22 bp, Artificial Sequence
  chemically synthesized
gctgctggtgtttataactgaa

SEQ ID NO: 724525 - DNA, 22 bp, Artificial Sequence
  chemically synthesized
ctggtgtttataactgaagacc

SEQ ID NO: 724526 - DNA, 22 bp, Artificial Sequence
  chemically synthesized
gtgtttataactgaagaccggc

SEQ ID NO: 724527 - DNA, 22 bp, Artificial Sequence
  chemically synthesized
accggcagtgtctgccggtctt

SEQ ID NO: 724528 - DNA, 22 bp, Artificial Sequence
  chemically synthesized
ataactgaagaccggcagacac

SEQ ID NO: 724529 - DNA, 22 bp, Artificial Sequence
  chemically synthesized
taactgaagaccggcagacact

SEQ ID NO: 724530 - DNA, 22 bp, Artificial Sequence
  chemically synthesized
aagtagctaaccggcagtgtct

SEQ ID NO: 724531 - DNA, 22 bp, Artificial Sequence
  chemically synthesized
aagaccggcagacactgccggt

SEQ ID NO: 724532 - DNA, 22 bp, Artificial Sequence
  chemically synthesized
aacaggtattgaagtagctaac

SEQ ID NO: 724533 - DNA, 22 bp, Artificial Sequence
  chemically synthesized
caacaggtattgaagtagctaa

SEQ ID NO: 724534 - DNA, 22 bp, Artificial Sequence
  chemically synthesized
tcaacaggtattgaagtagcta

SEQ ID NO: 724535 - DNA, 22 bp, Artificial Sequence
  chemically synthesized
ccggttagctacttcaatacct

SEQ ID NO: 724536 - DNA, 22 bp, Artificial Sequence
  chemically synthesized
gctacttcaatacctgttgaaa

SEQ ID NO: 724537 - DNA, 22 bp, Artificial Sequence
  chemically synthesized
gggagaagtggttttcaacagg

SEQ ID NO: 724538 - DNA, 22 bp, Artificial Sequence
  chemically synthesized
cttcaatacctgttgaaaacca

SEQ ID NO: 724539 - DNA, 22 bp, Artificial Sequence
  chemically synthesized
caatacctgttgaaaaccactt

SEQ ID NO: 724540 - DNA, 22 bp, Artificial Sequence
  chemically synthesized
aatacctgttgaaaaccacttc

SEQ ID NO: 724541 - DNA, 22 bp, Artificial Sequence
  chemically synthesized
ttgaaaaccacttctccctagc

SEQ ID NO: 724542 - DNA, 22 bp, Artificial Sequence
  chemically synthesized
aaaaccacttctccctagccat

SEQ ID NO: 724543 - DNA, 22 bp, Artificial Sequence
  chemically synthesized
ctccctagccatctttttgttg

SEQ ID NO: 724544 - DNA, 22 bp, Artificial Sequence
  chemically synthesized
tccctagccatctttttgttgg

SEQ ID NO: 724545 - DNA, 22 bp, Artificial Sequence
  chemically synthesized
cctagccatctttttgttggtg

SEQ ID NO: 724546 - DNA, 22 bp, Artificial Sequence
  chemically synthesized
tgtcacatgacagccaccaaca

SEQ ID NO: 724547 - DNA, 22 bp, Artificial Sequence
  chemically synthesized
gccatctttttgttggtggctg

SEQ ID NO: 724548 - DNA, 22 bp, Artificial Sequence
  chemically synthesized
tttgttggtggctgtcatgtga

SEQ ID NO: 724549 - DNA, 22 bp, Artificial Sequence
  chemically synthesized
tgtagaactgtgtcacatgaca

SEQ ID NO: 724550 - DNA, 22 bp, Artificial Sequence
  chemically synthesized
ttgttggtggctgtcatgtgac

SEQ ID NO: 724551 - DNA, 22 bp, Artificial Sequence
  chemically synthesized
tgttggtggctgtcatgtgaca

SEQ ID NO: 724552 - DNA, 22 bp, Artificial Sequence
  chemically synthesized
gttggtggctgtcatgtgacac

SEQ ID NO: 724553 - DNA, 22 bp, Artificial Sequence
  chemically synthesized
ttggtggctgtcatgtgacaca

SEQ ID NO: 724554 - DNA, 22 bp, Artificial Sequence
  chemically synthesized
gtggctgtcatgtgacacagtt

SEQ ID NO: 724555 - DNA, 22 bp, Artificial Sequence
  chemically synthesized
tatatcattgtgtagaactgtg

SEQ ID NO: 724556 - DNA, 22 bp, Artificial Sequence
  chemically synthesized
gtatatcattgtgtagaactgt

SEQ ID NO: 724557 - DNA, 22 bp, Artificial Sequence
  chemically synthesized
tcatgtgacacagttctacaca

SEQ ID NO: 724558 - DNA, 22 bp, Artificial Sequence
  chemically synthesized
cttgtatatcattgtgtagaac

SEQ ID NO: 724559 - DNA, 22 bp, Artificial Sequence
  chemically synthesized
tacttgtatatcattgtgtaga

SEQ ID NO: 724560 - DNA, 22 bp, Artificial Sequence
  chemically synthesized
ctacttgtatatcattgtgtag

SEQ ID NO: 724561 - DNA, 22 bp, Artificial Sequence
  chemically synthesized
aaagacttctacttgtatatca

SEQ ID NO: 724562 - DNA, 22 bp, Artificial Sequence
  chemically synthesized
gaaagacttctacttgtatatc

SEQ ID NO: 724563 - DNA, 22 bp, Artificial Sequence
  chemically synthesized
tgaaagacttctacttgtatat

SEQ ID NO: 724564 - DNA, 22 bp, Artificial Sequence
  chemically synthesized
ttgaaagacttctacttgtata

SEQ ID NO: 724565 - DNA, 22 bp, Artificial Sequence
  chemically synthesized
tttgaaagacttctacttgtat

SEQ ID NO: 724566 - DNA, 22 bp, Artificial Sequence
  chemically synthesized
tacacaatgatatacaagtaga

SEQ ID NO: 724567 - DNA, 22 bp, Artificial Sequence
  chemically synthesized
ttttgaaagacttctacttgta

SEQ ID NO: 724568 - DNA, 22 bp, Artificial Sequence
  chemically synthesized
cacaatgatatacaagtagaag

SEQ ID NO: 724569 - DNA, 22 bp, Artificial Sequence
  chemically synthesized
ccagaaaccttttttgaaagac

SEQ ID NO: 724570 - DNA, 22 bp, Artificial Sequence
  chemically synthesized
cccagaaaccttttttgaaaga

SEQ ID NO: 724571 - DNA, 22 bp, Artificial Sequence
  chemically synthesized
taaagccaaaaatttcccagaa

SEQ ID NO: 724572 - DNA, 22 bp, Artificial Sequence
  chemically synthesized
tcaaaaaaggtttctgggaaat

SEQ ID NO: 724573 - DNA, 22 bp, Artificial Sequence
  chemically synthesized
ataaagccaaaaatttcccaga

SEQ ID NO: 724574 - DNA, 22 bp, Artificial Sequence
  chemically synthesized
caaaaaaggtttctgggaaatt

SEQ ID NO: 724575 - DNA, 22 bp, Artificial Sequence
  chemically synthesized
tataaagccaaaaatttcccag

SEQ ID NO: 724576 - DNA, 22 bp, Artificial Sequence
  chemically synthesized
aaaaaaggtttctgggaaattt

SEQ ID NO: 724577 - DNA, 22 bp, Artificial Sequence
  chemically synthesized
ttataaagccaaaaatttccca

SEQ ID NO: 724578 - DNA, 22 bp, Artificial Sequence
  chemically synthesized
tcatttttataaagccaaaaat

SEQ ID NO: 724579 - DNA, 22 bp, Artificial Sequence
  chemically synthesized
atcatttttataaagccaaaaa

SEQ ID NO: 724580 - DNA, 22 bp, Artificial Sequence
  chemically synthesized
ctgggaaatttttggctttata

SEQ ID NO: 724581 - DNA, 22 bp, Artificial Sequence
  chemically synthesized
tgggaaatttttggctttataa

SEQ ID NO: 724582 - DNA, 22 bp, Artificial Sequence
  chemically synthesized
agtcttatcatttttataaagc

SEQ ID NO: 724583 - DNA, 22 bp, Artificial Sequence
  chemically synthesized
ggaaatttttggctttataaaa

SEQ ID NO: 724584 - DNA, 22 bp, Artificial Sequence
  chemically synthesized
tctgagtcttatcatttttata

SEQ ID NO: 724585 - DNA, 22 bp, Artificial Sequence
  chemically synthesized
ttggctttataaaaatgataag

SEQ ID NO: 724586 - DNA, 22 bp, Artificial Sequence
  chemically synthesized
tggctttataaaaatgataaga

SEQ ID NO: 724587 - DNA, 22 bp, Artificial Sequence
  chemically synthesized
ggctttataaaaatgataagac

SEQ ID NO: 724588 - DNA, 22 bp, Artificial Sequence
  chemically synthesized
gctttataaaaatgataagact

SEQ ID NO: 724589 - DNA, 22 bp, Artificial Sequence
  chemically synthesized
tataaaaatgataagactcaga

SEQ ID NO: 724590 - DNA, 22 bp, Artificial Sequence
  chemically synthesized
ataaaaatgataagactcagat

SEQ ID NO: 724591 - DNA, 22 bp, Artificial Sequence
  chemically synthesized
taaaaatgataagactcagata

SEQ ID NO: 724592 - DNA, 22 bp, Artificial Sequence
  chemically synthesized
agatagtacaccctttttgcct

SEQ ID NO: 724593 - DNA, 22 bp, Artificial Sequence
  chemically synthesized
acagggtgaaaaagagaaggca

SEQ ID NO: 724594 - DNA, 22 bp, Artificial Sequence
  chemically synthesized
cacagggtgaaaaagagaaggc

SEQ ID NO: 724595 - DNA, 22 bp, Artificial Sequence
  chemically synthesized
tttcacagggtgaaaaagagaa

SEQ ID NO: 724596 - DNA, 22 bp, Artificial Sequence
  chemically synthesized
tttgccttctctttttcaccct

SEQ ID NO: 724597 - DNA, 22 bp, Artificial Sequence
  chemically synthesized
ttgccttctctttttcaccctg

SEQ ID NO: 724598 - DNA, 22 bp, Artificial Sequence
  chemically synthesized
tgccttctctttttcaccctgt

SEQ ID NO: 724599 - DNA, 22 bp, Artificial Sequence
  chemically synthesized
gccttctctttttcaccctgtg

SEQ ID NO: 724600 - DNA, 22 bp, Artificial Sequence
  chemically synthesized
ccttctctttttcaccctgtga

SEQ ID NO: 724601 - DNA, 22 bp, Artificial Sequence
  chemically synthesized
ctctttttcaccctgtgaaata

SEQ ID NO: 724602 - DNA, 22 bp, Artificial Sequence
  chemically synthesized
tctttttcaccctgtgaaataa

SEQ ID NO: 724603 - DNA, 22 bp, Artificial Sequence
  chemically synthesized
tttttcaccctgtgaaataatg

SEQ ID NO: 724604 - DNA, 22 bp, Artificial Sequence
  chemically synthesized
tttcaccctgtgaaataatggt

SEQ ID NO: 724605 - DNA, 22 bp, Artificial Sequence
  chemically synthesized
ttcaccctgtgaaataatggtg

SEQ ID NO: 724606 - DNA, 22 bp, Artificial Sequence
  chemically synthesized
tcaccctgtgaaataatggtgg

SEQ ID NO: 724607 - DNA, 22 bp, Artificial Sequence
  chemically synthesized
caccctgtgaaataatggtggc

SEQ ID NO: 724608 - DNA, 22 bp, Artificial Sequence
  chemically synthesized
accctgtgaaataatggtggct

SEQ ID NO: 724609 - DNA, 22 bp, Artificial Sequence
  chemically synthesized
atgcaatatagcagccaccatt

SEQ ID NO: 724610 - DNA, 22 bp, Artificial Sequence
  chemically synthesized
ctcatgcaatatagcagccacc

SEQ ID NO: 724611 - DNA, 22 bp, Artificial Sequence
  chemically synthesized
cctcatgcaatatagcagccac

SEQ ID NO: 724612 - DNA, 22 bp, Artificial Sequence
  chemically synthesized
tcctcatgcaatatagcagcca

SEQ ID NO: 724613 - DNA, 22 bp, Artificial Sequence
  chemically synthesized
tgaaataatggtggctgctata

SEQ ID NO: 724614 - DNA, 22 bp, Artificial Sequence
  chemically synthesized
ttcctcatgcaatatagcagcc

SEQ ID NO: 724615 - DNA, 22 bp, Artificial Sequence
  chemically synthesized
acttttcctcatgcaatatagc

SEQ ID NO: 724616 - DNA, 22 bp, Artificial Sequence
  chemically synthesized
ttgacttttcctcatgcaatat

SEQ ID NO: 724617 - DNA, 22 bp, Artificial Sequence
  chemically synthesized
attgacttttcctcatgcaata

SEQ ID NO: 724618 - DNA, 22 bp, Artificial Sequence
  chemically synthesized
tattgacttttcctcatgcaat

SEQ ID NO: 724619 - DNA, 22 bp, Artificial Sequence
  chemically synthesized
ttattgacttttcctcatgcaa

SEQ ID NO: 724620 - DNA, 22 bp, Artificial Sequence
  chemically synthesized
tttattgacttttcctcatgca

SEQ ID NO: 724621 - DNA, 22 bp, Artificial Sequence
  chemically synthesized
ctatattgcatgaggaaaagtc

SEQ ID NO: 724622 - DNA, 22 bp, Artificial Sequence
  chemically synthesized
tatattttttattgacttttcc

SEQ ID NO: 724623 - DNA, 22 bp, Artificial Sequence
  chemically synthesized
tattgcatgaggaaaagtcaat

SEQ ID NO: 724624 - DNA, 22 bp, Artificial Sequence
  chemically synthesized
catgaggaaaagtcaataaaaa

SEQ ID NO: 724625 - DNA, 22 bp, Artificial Sequence
  chemically synthesized
gcatctgtatattttttattga

SEQ ID NO: 724626 - DNA, 22 bp, Artificial Sequence
  chemically synthesized
ggcccaacagtatcaggactgg

SEQ ID NO: 724627 - DNA, 22 bp, Artificial Sequence
  chemically synthesized
gggcccaacagtatcaggactg

SEQ ID NO: 724628 - DNA, 22 bp, Artificial Sequence
  chemically synthesized
tgggcccaacagtatcaggact

SEQ ID NO: 724629 - DNA, 22 bp, Artificial Sequence
  chemically synthesized
gaaataaggtgctttgggccca

SEQ ID NO: 724630 - DNA, 22 bp, Artificial Sequence
  chemically synthesized
atactgttgggcccaaagcacc

SEQ ID NO: 724631 - DNA, 22 bp, Artificial Sequence
  chemically synthesized
agatgtctggaaataaggtgct

SEQ ID NO: 724632 - DNA, 22 bp, Artificial Sequence
  chemically synthesized
ttgggcccaaagcaccttattt

SEQ ID NO: 724633 - DNA, 22 bp, Artificial Sequence
  chemically synthesized
ggcccaaagcaccttatttcca

SEQ ID NO: 724634 - DNA, 22 bp, Artificial Sequence
  chemically synthesized
caatattaagatgtctggaaat

SEQ ID NO: 724635 - DNA, 22 bp, Artificial Sequence
  chemically synthesized
tctccaatattaagatgtctgg

SEQ ID NO: 724636 - DNA, 22 bp, Artificial Sequence
  chemically synthesized
atctccaatattaagatgtctg

SEQ ID NO: 724637 - DNA, 22 bp, Artificial Sequence
  chemically synthesized
tttatctccaatattaagatgt

SEQ ID NO: 724638 - DNA, 22 bp, Artificial Sequence
  chemically synthesized
atttatctccaatattaagatg

SEQ ID NO: 724639 - DNA, 22 bp, Artificial Sequence
  chemically synthesized
tatttatctccaatattaagat

SEQ ID NO: 724640 - DNA, 22 bp, Artificial Sequence
  chemically synthesized
atttccagacatcttaatattg

SEQ ID NO: 724641 - DNA, 22 bp, Artificial Sequence
  chemically synthesized
tttccagacatcttaatattgg

SEQ ID NO: 724642 - DNA, 22 bp, Artificial Sequence
  chemically synthesized
ccagacatcttaatattggaga

SEQ ID NO: 724643 - DNA, 22 bp, Artificial Sequence
  chemically synthesized
cagacatcttaatattggagat

SEQ ID NO: 724644 - DNA, 22 bp, Artificial Sequence
  chemically synthesized
aataaatagagttttatttatc

SEQ ID NO: 724645 - DNA, 22 bp, Artificial Sequence
  chemically synthesized
aaataaatagagttttatttat

SEQ ID NO: 724646 - DNA, 22 bp, Artificial Sequence
  chemically synthesized
aatattggagataaataaaact

SEQ ID NO: 724647 - DNA, 22 bp, Artificial Sequence
  chemically synthesized
atattggagataaataaaactc

SEQ ID NO: 724648 - DNA, 22 bp, Artificial Sequence
  chemically synthesized
gagataaataaaactctattta

SEQ ID NO: 724649 - DNA, 22 bp, Artificial Sequence
  chemically synthesized
cagtggcttaaataaatagagt

SEQ ID NO: 724650 - DNA, 22 bp, Artificial Sequence
  chemically synthesized
tctacagtggcttaaataaata

SEQ ID NO: 724651 - DNA, 22 bp, Artificial Sequence
  chemically synthesized
tatttatttaagccactgtaga

SEQ ID NO: 724652 - DNA, 22 bp, Artificial Sequence
  chemically synthesized
tttatttaagccactgtagata

SEQ ID NO: 724653 - DNA, 22 bp, Artificial Sequence
  chemically synthesized
atttaagccactgtagatagct

SEQ ID NO: 724654 - DNA, 22 bp, Artificial Sequence
  chemically synthesized
tttaagccactgtagatagctt

SEQ ID NO: 724655 - DNA, 22 bp, Artificial Sequence
  chemically synthesized
aagccactgtagatagcttctg

SEQ ID NO: 724656 - DNA, 22 bp, Artificial Sequence
  chemically synthesized
agccactgtagatagcttctgt

SEQ ID NO: 724657 - DNA, 22 bp, Artificial Sequence
  chemically synthesized
caatggcagcaaaaaacacaga

SEQ ID NO: 724658 - DNA, 22 bp, Artificial Sequence
  chemically synthesized
tagatagcttctgtgttttttg

SEQ ID NO: 724659 - DNA, 22 bp, Artificial Sequence
  chemically synthesized
gaattgcaatggcagcaaaaaa

SEQ ID NO: 724660 - DNA, 22 bp, Artificial Sequence
  chemically synthesized
gggttagaattgcaatggcagc

SEQ ID NO: 724661 - DNA, 22 bp, Artificial Sequence
  chemically synthesized
ctgtgttttttgctgccattgc

SEQ ID NO: 724662 - DNA, 22 bp, Artificial Sequence
  chemically synthesized
tgtgttttttgctgccattgca

SEQ ID NO: 724663 - DNA, 22 bp, Artificial Sequence
  chemically synthesized
tgttttttgctgccattgcaat

SEQ ID NO: 724664 - DNA, 22 bp, Artificial Sequence
  chemically synthesized
gctggggttagaattgcaatgg

SEQ ID NO: 724665 - DNA, 22 bp, Artificial Sequence
  chemically synthesized
ttggctggggttagaattgcaa

SEQ ID NO: 724666 - DNA, 22 bp, Artificial Sequence
  chemically synthesized
attggctggggttagaattgca

SEQ ID NO: 724667 - DNA, 22 bp, Artificial Sequence
  chemically synthesized
tttgctgccattgcaattctaa

SEQ ID NO: 724668 - DNA, 22 bp, Artificial Sequence
  chemically synthesized
tattggctggggttagaattgc

SEQ ID NO: 724669 - DNA, 22 bp, Artificial Sequence
  chemically synthesized
ttgctgccattgcaattctaac

SEQ ID NO: 724670 - DNA, 22 bp, Artificial Sequence
  chemically synthesized
tgctgccattgcaattctaacc

SEQ ID NO: 724671 - DNA, 22 bp, Artificial Sequence
  chemically synthesized
gctgccattgcaattctaaccc

SEQ ID NO: 724672 - DNA, 22 bp, Artificial Sequence
  chemically synthesized
ctgccattgcaattctaacccc

SEQ ID NO: 724673 - DNA, 22 bp, Artificial Sequence
  chemically synthesized
ccattttattggctggggttag

SEQ ID NO: 724674 - DNA, 22 bp, Artificial Sequence
  chemically synthesized
ccattgcaattctaaccccagc

SEQ ID NO: 724675 - DNA, 22 bp, Artificial Sequence
  chemically synthesized
atattcccattttattggctgg

SEQ ID NO: 724676 - DNA, 22 bp, Artificial Sequence
  chemically synthesized
caattctaaccccagccaataa

SEQ ID NO: 724677 - DNA, 22 bp, Artificial Sequence
  chemically synthesized
catattcccattttattggctg

SEQ ID NO: 724678 - DNA, 22 bp, Artificial Sequence
  chemically synthesized
tcatattcccattttattggct

SEQ ID NO: 724679 - DNA, 22 bp, Artificial Sequence
  chemically synthesized
ttcatattcccattttattggc

SEQ ID NO: 724680 - DNA, 22 bp, Artificial Sequence
  chemically synthesized
tttttcatattcccattttatt

SEQ ID NO: 724681 - DNA, 22 bp, Artificial Sequence
  chemically synthesized
taaccccagccaataaaatggg

SEQ ID NO: 724682 - DNA, 22 bp, Artificial Sequence
  chemically synthesized
gtttttcatattcccattttat

SEQ ID NO: 724683 - DNA, 22 bp, Artificial Sequence
  chemically synthesized
accccagccaataaaatgggaa

SEQ ID NO: 724684 - DNA, 22 bp, Artificial Sequence
  chemically synthesized
tttgtttttcatattcccattt

SEQ ID NO: 724685 - DNA, 22 bp, Artificial Sequence
  chemically synthesized
gtttgtttttcatattcccatt

SEQ ID NO: 724686 - DNA, 22 bp, Artificial Sequence
  chemically synthesized
tgtttgtttttcatattcccat

SEQ ID NO: 724687 - DNA, 22 bp, Artificial Sequence
  chemically synthesized
ttgtttgtttttcatattccca

SEQ ID NO: 724688 - DNA, 22 bp, Artificial Sequence
  chemically synthesized
tttgtttgtttttcatattccc

SEQ ID NO: 724689 - DNA, 22 bp, Artificial Sequence
  chemically synthesized
atattttttgtttgtttttcat

SEQ ID NO: 724690 - DNA, 22 bp, Artificial Sequence
  chemically synthesized
gaaggattcatattttttgttt

SEQ ID NO: 724691 - DNA, 22 bp, Artificial Sequence
  chemically synthesized
agaaggattcatattttttgtt

SEQ ID NO: 724692 - DNA, 22 bp, Artificial Sequence
  chemically synthesized
tttagaaggattcatatttttt

SEQ ID NO: 724693 - DNA, 22 bp, Artificial Sequence
  chemically synthesized
attgtttagaaggattcatatt

SEQ ID NO: 724694 - DNA, 22 bp, Artificial Sequence
  chemically synthesized
cattgtttagaaggattcatat

SEQ ID NO: 724695 - DNA, 22 bp, Artificial Sequence
  chemically synthesized
ttcattgtttagaaggattcat

SEQ ID NO: 724696 - DNA, 22 bp, Artificial Sequence
  chemically synthesized
accccataaattcttcattgtt

SEQ ID NO: 724697 - DNA, 22 bp, Artificial Sequence
  chemically synthesized
ctaaacaatgaagaatttatgg

SEQ ID NO: 724698 - DNA, 22 bp, Artificial Sequence
  chemically synthesized
taaacaatgaagaatttatggg

SEQ ID NO: 724699 - DNA, 22 bp, Artificial Sequence
  chemically synthesized
ccaaaccctaaccccataaatt

SEQ ID NO: 724700 - DNA, 22 bp, Artificial Sequence
  chemically synthesized
aacaatgaagaatttatggggt

SEQ ID NO: 724701 - DNA, 22 bp, Artificial Sequence
  chemically synthesized
ctcccaaaccctaaccccataa

SEQ ID NO: 724702 - DNA, 22 bp, Artificial Sequence
  chemically synthesized
ttcctcccaaaccctaacccca

SEQ ID NO: 724703 - DNA, 22 bp, Artificial Sequence
  chemically synthesized
tgttcctcccaaaccctaaccc

SEQ ID NO: 724704 - DNA, 22 bp, Artificial Sequence
  chemically synthesized
ctgttcctcccaaaccctaacc

SEQ ID NO: 724705 - DNA, 22 bp, Artificial Sequence
  chemically synthesized
tatcttctgttcctcccaaacc

SEQ ID NO: 724706 - DNA, 22 bp, Artificial Sequence
  chemically synthesized
atggggttagggtttgggagga

SEQ ID NO: 724707 - DNA, 22 bp, Artificial Sequence
  chemically synthesized
tggggttagggtttgggaggaa

SEQ ID NO: 724708 - DNA, 22 bp, Artificial Sequence
  chemically synthesized
gctatatcttctgttcctccca

SEQ ID NO: 724709 - DNA, 22 bp, Artificial Sequence
  chemically synthesized
atctggctatatcttctgttcc

SEQ ID NO: 724710 - DNA, 22 bp, Artificial Sequence
  chemically synthesized
gggtttgggaggaacagaagat

SEQ ID NO: 724711 - DNA, 22 bp, Artificial Sequence
  chemically synthesized
aattcatctggctatatcttct

SEQ ID NO: 724712 - DNA, 22 bp, Artificial Sequence
  chemically synthesized
gggaggaacagaagatatagcc

SEQ ID NO: 724713 - DNA, 22 bp, Artificial Sequence
  chemically synthesized
ggaggaacagaagatatagcca

SEQ ID NO: 724714 - DNA, 22 bp, Artificial Sequence
  chemically synthesized
agagatatgcctaaattcatct

SEQ ID NO: 724715 - DNA, 22 bp, Artificial Sequence
  chemically synthesized
ctgagagatatgcctaaattca

SEQ ID NO: 724716 - DNA, 22 bp, Artificial Sequence
  chemically synthesized
aaggacaaaggtcagttcctga

SEQ ID NO: 724717 - DNA, 22 bp, Artificial Sequence
  chemically synthesized
aggcatatctctcaggaactga

SEQ ID NO: 724718 - DNA, 22 bp, Artificial Sequence
  chemically synthesized
ggcatatctctcaggaactgac

SEQ ID NO: 724719 - DNA, 22 bp, Artificial Sequence
  chemically synthesized
tcaggaactgacctttgtcctt

SEQ ID NO: 724720 - DNA, 22 bp, Artificial Sequence
  chemically synthesized
aggaactgacctttgtccttta

SEQ ID NO: 724721 - DNA, 22 bp, Artificial Sequence
  chemically synthesized
atcaacagtaatagctaaagga

SEQ ID NO: 724722 - DNA, 22 bp, Artificial Sequence
  chemically synthesized
acctttgtcctttagctattac

SEQ ID NO: 724723 - DNA, 22 bp, Artificial Sequence
  chemically synthesized
agactaatcaacagtaatagct

SEQ ID NO: 724724 - DNA, 22 bp, Artificial Sequence
  chemically synthesized
tgtcctttagctattactgttg

SEQ ID NO: 724725 - DNA, 22 bp, Artificial Sequence
  chemically synthesized
gtcctttagctattactgttga

SEQ ID NO: 724726 - DNA, 22 bp, Artificial Sequence
  chemically synthesized
tcctttagctattactgttgat

SEQ ID NO: 724727 - DNA, 22 bp, Artificial Sequence
  chemically synthesized
ccatctaagactaatcaacagt

SEQ ID NO: 724728 - DNA, 22 bp, Artificial Sequence
  chemically synthesized
tagctattactgttgattagtc

SEQ ID NO: 724729 - DNA, 22 bp, Artificial Sequence
  chemically synthesized
actgccatctaagactaatcaa

SEQ ID NO: 724730 - DNA, 22 bp, Artificial Sequence
  chemically synthesized
agctattactgttgattagtct

SEQ ID NO: 724731 - DNA, 22 bp, Artificial Sequence
  chemically synthesized
gctattactgttgattagtctt

SEQ ID NO: 724732 - DNA, 22 bp, Artificial Sequence
  chemically synthesized
ttactgttgattagtcttagat

SEQ ID NO: 724733 - DNA, 22 bp, Artificial Sequence
  chemically synthesized
caaggttcactgccatctaaga

SEQ ID NO: 724734 - DNA, 22 bp, Artificial Sequence
  chemically synthesized
ctgttgattagtcttagatggc

SEQ ID NO: 724735 - DNA, 22 bp, Artificial Sequence
  chemically synthesized
ttgattagtcttagatggcagt

SEQ ID NO: 724736 - DNA, 22 bp, Artificial Sequence
  chemically synthesized
attagtcttagatggcagtgaa

SEQ ID NO: 724737 - DNA, 22 bp, Artificial Sequence
  chemically synthesized
acatcagctacaaggttcactg

SEQ ID NO: 724738 - DNA, 22 bp, Artificial Sequence
  chemically synthesized
gtcttagatggcagtgaacctt

SEQ ID NO: 724739 - DNA, 22 bp, Artificial Sequence
  chemically synthesized
cattaacatcagctacaaggtt

SEQ ID NO: 724740 - DNA, 22 bp, Artificial Sequence
  chemically synthesized
agatggcagtgaaccttgtagc

SEQ ID NO: 724741 - DNA, 22 bp, Artificial Sequence
  chemically synthesized
gcattaacatcagctacaaggt

SEQ ID NO: 724742 - DNA, 22 bp, Artificial Sequence
  chemically synthesized
gatggcagtgaaccttgtagct

SEQ ID NO: 724743 - DNA, 22 bp, Artificial Sequence
  chemically synthesized
tgcattaacatcagctacaagg

SEQ ID NO: 724744 - DNA, 22 bp, Artificial Sequence
  chemically synthesized
cagttttgcattaacatcagct

SEQ ID NO: 724745 - DNA, 22 bp, Artificial Sequence
  chemically synthesized
tccagttttgcattaacatcag

SEQ ID NO: 724746 - DNA, 22 bp, Artificial Sequence
  chemically synthesized
gtagctgatgttaatgcaaaac

SEQ ID NO: 724747 - DNA, 22 bp, Artificial Sequence
  chemically synthesized
tagctgatgttaatgcaaaact

SEQ ID NO: 724748 - DNA, 22 bp, Artificial Sequence
  chemically synthesized
atgttaatgcaaaactggagaa

SEQ ID NO: 724749 - DNA, 22 bp, Artificial Sequence
  chemically synthesized
tatccaggatgcaatgttctcc

SEQ ID NO: 724750 - DNA, 22 bp, Artificial Sequence
  chemically synthesized
atgcaaaactggagaacattgc

SEQ ID NO: 724751 - DNA, 22 bp, Artificial Sequence
  chemically synthesized
gagaacattgcatcctggatat

SEQ ID NO: 724752 - DNA, 22 bp, Artificial Sequence
  chemically synthesized
catcctggatataggtatattc

SEQ ID NO: 724753 - DNA, 22 bp, Artificial Sequence
  chemically synthesized
tatcagagtatcagaatatacc

SEQ ID NO: 724754 - DNA, 22 bp, Artificial Sequence
  chemically synthesized
gatataggtatattctgatact

SEQ ID NO: 724755 - DNA, 22 bp, Artificial Sequence
  chemically synthesized
agggccctgtatcagagtatca

SEQ ID NO: 724756 - DNA, 22 bp, Artificial Sequence
  chemically synthesized
gaagctaagggccctgtatcag

SEQ ID NO: 724757 - DNA, 22 bp, Artificial Sequence
  chemically synthesized
ggaagctaagggccctgtatca

SEQ ID NO: 724758 - DNA, 22 bp, Artificial Sequence
  chemically synthesized
tggaagctaagggccctgtatc

SEQ ID NO: 724759 - DNA, 22 bp, Artificial Sequence
  chemically synthesized
tgatactctgatacagggccct

SEQ ID NO: 724760 - DNA, 22 bp, Artificial Sequence
  chemically synthesized
atactctgatacagggccctta

SEQ ID NO: 724761 - DNA, 22 bp, Artificial Sequence
  chemically synthesized
tcatctttggaagctaagggcc

SEQ ID NO: 724762 - DNA, 22 bp, Artificial Sequence
  chemically synthesized
tgatacagggcccttagcttcc

SEQ ID NO: 724763 - DNA, 22 bp, Artificial Sequence
  chemically synthesized
atacagggcccttagcttccaa

SEQ ID NO: 724764 - DNA, 22 bp, Artificial Sequence
  chemically synthesized
agcttccaaagatgacaatttt

SEQ ID NO: 724765 - DNA, 22 bp, Artificial Sequence
  chemically synthesized
gcttccaaagatgacaattttt

SEQ ID NO: 724766 - DNA, 22 bp, Artificial Sequence
  chemically synthesized
aaaaaaaaaaaaaaaaaattgt

SEQ ID NO: 724767 - DNA, 22 bp, Artificial Sequence
  chemically synthesized
ccaaagatgacaattttttttt

SEQ ID NO: 724768 - DNA, 22 bp, Artificial Sequence
  chemically synthesized
caaagatgacaatttttttttt

SEQ ID NO: 724769 - DNA, 22 bp, Artificial Sequence
  chemically synthesized
cgtctcaaaaaaaaaaaaaaaa

SEQ ID NO: 724770 - DNA, 22 bp, Artificial Sequence
  chemically synthesized
tttttttttttttttgagacgg

SEQ ID NO: 724771 - DNA, 22 bp, Artificial Sequence
  chemically synthesized
ttttttttttttttgagacgga

SEQ ID NO: 724772 - DNA, 22 bp, Artificial Sequence
  chemically synthesized
tttttttttttttgagacggag

SEQ ID NO: 724773 - DNA, 22 bp, Artificial Sequence
  chemically synthesized
ttttttttttttgagacggagt

SEQ ID NO: 724774 - DNA, 22 bp, Artificial Sequence
  chemically synthesized
tttttttttttgagacggagtc

SEQ ID NO: 724775 - DNA, 22 bp, Artificial Sequence
  chemically synthesized
ttttttttttgagacggagtct

SEQ ID NO: 724776 - DNA, 22 bp, Artificial Sequence
  chemically synthesized
ggccacagagcgagactccgtc

SEQ ID NO: 724777 - DNA, 22 bp, Artificial Sequence
  chemically synthesized
tttttttttgagacggagtctc

SEQ ID NO: 724778 - DNA, 22 bp, Artificial Sequence
  chemically synthesized
ttttttttgagacggagtctcg

SEQ ID NO: 724779 - DNA, 22 bp, Artificial Sequence
  chemically synthesized
tttttttgagacggagtctcgc

SEQ ID NO: 724780 - DNA, 22 bp, Artificial Sequence
  chemically synthesized
ttttttgagacggagtctcgct

SEQ ID NO: 724781 - DNA, 22 bp, Artificial Sequence
  chemically synthesized
tttttgagacggagtctcgctc

SEQ ID NO: 724782 - DNA, 22 bp, Artificial Sequence
  chemically synthesized
ttttgagacggagtctcgctct

SEQ ID NO: 724783 - DNA, 22 bp, Artificial Sequence
  chemically synthesized
tttgagacggagtctcgctctg

SEQ ID NO: 724784 - DNA, 22 bp, Artificial Sequence
  chemically synthesized
cagcctgggccacagagcgaga

SEQ ID NO: 724785 - DNA, 22 bp, Artificial Sequence
  chemically synthesized
ttgagacggagtctcgctctgt

SEQ ID NO: 724786 - DNA, 22 bp, Artificial Sequence
  chemically synthesized
tgagacggagtctcgctctgtg

SEQ ID NO: 724787 - DNA, 22 bp, Artificial Sequence
  chemically synthesized
gagacggagtctcgctctgtgg

SEQ ID NO: 724788 - DNA, 22 bp, Artificial Sequence
  chemically synthesized
agacggagtctcgctctgtggc

SEQ ID NO: 724789 - DNA, 22 bp, Artificial Sequence
  chemically synthesized
cactccagcctgggccacagag

SEQ ID NO: 724790 - DNA, 22 bp, Artificial Sequence
  chemically synthesized
gctctgtggcccaggctggagt

SEQ ID NO: 724791 - DNA, 22 bp, Artificial Sequence
  chemically synthesized
tgtggcccaggctggagtgcag

SEQ ID NO: 724792 - DNA, 22 bp, Artificial Sequence
  chemically synthesized
tggcccaggctggagtgcagtg

SEQ ID NO: 724793 - DNA, 22 bp, Artificial Sequence
  chemically synthesized
cagtgagccgagatcgcgccac

SEQ ID NO: 724794 - DNA, 22 bp, Artificial Sequence
  chemically synthesized
gcagtgagccgagatcgcgcca

SEQ ID NO: 724795 - DNA, 22 bp, Artificial Sequence
  chemically synthesized
gagtgcagtggcgcgatctcgg

SEQ ID NO: 724796 - DNA, 22 bp, Artificial Sequence
  chemically synthesized
ggctcactgcaagctccgcctc

SEQ ID NO: 724797 - DNA, 22 bp, Artificial Sequence
  chemically synthesized
actgcaagctccgcctcccggg

SEQ ID NO: 724798 - DNA, 22 bp, Artificial Sequence
  chemically synthesized
caagctccgcctcccgggttca

SEQ ID NO: 724799 - DNA, 22 bp, Artificial Sequence
  chemically synthesized
aggcaggagaatggcgtgaacc

SEQ ID NO: 724800 - DNA, 22 bp, Artificial Sequence
  chemically synthesized
cgcctcccgggttcacgccatt

SEQ ID NO: 724801 - DNA, 22 bp, Artificial Sequence
  chemically synthesized
ccgggttcacgccattctcctg

SEQ ID NO: 724802 - DNA, 22 bp, Artificial Sequence
  chemically synthesized
aggaggctgaggcaggagaatg

SEQ ID NO: 724803 - DNA, 22 bp, Artificial Sequence
  chemically synthesized
ctcaggaggctgaggcaggaga

SEQ ID NO: 724804 - DNA, 22 bp, Artificial Sequence
  chemically synthesized
acgccattctcctgcctcagcc

SEQ ID NO: 724805 - DNA, 22 bp, Artificial Sequence
  chemically synthesized
tagtcccagctactcaggaggc

SEQ ID NO: 724806 - DNA, 22 bp, Artificial Sequence
  chemically synthesized
tcctgcctcagcctcctgagta

SEQ ID NO: 724807 - DNA, 22 bp, Artificial Sequence
  chemically synthesized
ctgcctcagcctcctgagtagc

SEQ ID NO: 724808 - DNA, 22 bp, Artificial Sequence
  chemically synthesized
cctcagcctcctgagtagctgg

SEQ ID NO: 724809 - DNA, 22 bp, Artificial Sequence
  chemically synthesized
cgggcgcctgtagtcccagcta

SEQ ID NO: 724810 - DNA, 22 bp, Artificial Sequence
  chemically synthesized
agcctcctgagtagctgggact

SEQ ID NO: 724811 - DNA, 22 bp, Artificial Sequence
  chemically synthesized
ctgagtagctgggactacaggc

SEQ ID NO: 724812 - DNA, 22 bp, Artificial Sequence
  chemically synthesized
agtagctgggactacaggcgcc

SEQ ID NO: 724813 - DNA, 22 bp, Artificial Sequence
  chemically synthesized
gccgggcgtggttgcgggcgcc

SEQ ID NO: 724814 - DNA, 22 bp, Artificial Sequence
  chemically synthesized
ggactacaggcgcccgcaacca

SEQ ID NO: 724815 - DNA, 22 bp, Artificial Sequence
  chemically synthesized
caggcgcccgcaaccacgcccg

SEQ ID NO: 724816 - DNA, 22 bp, Artificial Sequence
  chemically synthesized
aaaatacaaaaaattagccggg

SEQ ID NO: 724817 - DNA, 22 bp, Artificial Sequence
  chemically synthesized
ctaaaaatacaaaaaattagcc

SEQ ID NO: 724818 - DNA, 22 bp, Artificial Sequence
  chemically synthesized
tactaaaaatacaaaaaattag

SEQ ID NO: 724819 - DNA, 22 bp, Artificial Sequence
  chemically synthesized
attttttgtatttttagtagag

SEQ ID NO: 724820 - DNA, 22 bp, Artificial Sequence
  chemically synthesized
tttgtatttttagtagagacgg

SEQ ID NO: 724821 - DNA, 22 bp, Artificial Sequence
  chemically synthesized
ttgtatttttagtagagacggg

SEQ ID NO: 724822 - DNA, 22 bp, Artificial Sequence
  chemically synthesized
acacggtgaaaccccgtctcta

SEQ ID NO: 724823 - DNA, 22 bp, Artificial Sequence
  chemically synthesized
tgtatttttagtagagacgggg

SEQ ID NO: 724824 - DNA, 22 bp, Artificial Sequence
  chemically synthesized
gtatttttagtagagacggggt

SEQ ID NO: 724825 - DNA, 22 bp, Artificial Sequence
  chemically synthesized
tatttttagtagagacggggtt

SEQ ID NO: 724826 - DNA, 22 bp, Artificial Sequence
  chemically synthesized
gctaacacggtgaaaccccgtc

SEQ ID NO: 724827 - DNA, 22 bp, Artificial Sequence
  chemically synthesized
ttagtagagacggggtttcacc

SEQ ID NO: 724828 - DNA, 22 bp, Artificial Sequence
  chemically synthesized
tagtagagacggggtttcaccg

SEQ ID NO: 724829 - DNA, 22 bp, Artificial Sequence
  chemically synthesized
agtagagacggggtttcaccgt

SEQ ID NO: 724830 - DNA, 22 bp, Artificial Sequence
  chemically synthesized
gtagagacggggtttcaccgtg

SEQ ID NO: 724831 - DNA, 22 bp, Artificial Sequence
  chemically synthesized
caccgtgttagccaggatggtc

SEQ ID NO: 724832 - DNA, 22 bp, Artificial Sequence
  chemically synthesized
accgtgttagccaggatggtct

SEQ ID NO: 724833 - DNA, 22 bp, Artificial Sequence
  chemically synthesized
gccaggatggtctccatctcct

SEQ ID NO: 724834 - DNA, 22 bp, Artificial Sequence
  chemically synthesized
catctcctgacctcgtgatccg

SEQ ID NO: 724835 - DNA, 22 bp, Artificial Sequence
  chemically synthesized
ggaggccgaggcgggcggatca

SEQ ID NO: 724836 - DNA, 22 bp, Artificial Sequence
  chemically synthesized
gggaggccgaggcgggcggatc

SEQ ID NO: 724837 - DNA, 22 bp, Artificial Sequence
  chemically synthesized
tgggaggccgaggcgggcggat

SEQ ID NO: 724838 - DNA, 22 bp, Artificial Sequence
  chemically synthesized
ctgacctcgtgatccgcccgcc

SEQ ID NO: 724839 - DNA, 22 bp, Artificial Sequence
  chemically synthesized
acctcgtgatccgcccgcctcg

SEQ ID NO: 724840 - DNA, 22 bp, Artificial Sequence
  chemically synthesized
gtgatccgcccgcctcggcctc

SEQ ID NO: 724841 - DNA, 22 bp, Artificial Sequence
  chemically synthesized
taatcccagcactttgggaggc

SEQ ID NO: 724842 - DNA, 22 bp, Artificial Sequence
  chemically synthesized
acgcctgtaatcccagcacttt

SEQ ID NO: 724843 - DNA, 22 bp, Artificial Sequence
  chemically synthesized
ggcctcccaaagtgctgggatt

SEQ ID NO: 724844 - DNA, 22 bp, Artificial Sequence
  chemically synthesized
ccaaagtgctgggattacaggc

SEQ ID NO: 724845 - DNA, 22 bp, Artificial Sequence
  chemically synthesized
ggccgggcgcggtggctcacgc

SEQ ID NO: 724846 - DNA, 22 bp, Artificial Sequence
  chemically synthesized
gggccgggcgcggtggctcacg

SEQ ID NO: 724847 - DNA, 22 bp, Artificial Sequence
  chemically synthesized
tgggccgggcgcggtggctcac

SEQ ID NO: 724848 - DNA, 22 bp, Artificial Sequence
  chemically synthesized
ggattacaggcgtgagccaccg

SEQ ID NO: 724849 - DNA, 22 bp, Artificial Sequence
  chemically synthesized
caggcgtgagccaccgcgcccg

SEQ ID NO: 724850 - DNA, 22 bp, Artificial Sequence
  chemically synthesized
tcatctttgggccgggcgcggt

SEQ ID NO: 724851 - DNA, 22 bp, Artificial Sequence
  chemically synthesized
tgtacacacatataattgtcat

SEQ ID NO: 724852 - DNA, 22 bp, Artificial Sequence
  chemically synthesized
atgtacacacatataattgtca

SEQ ID NO: 724853 - DNA, 22 bp, Artificial Sequence
  chemically synthesized
tatgtgtgtacataaatatgtg

SEQ ID NO: 724854 - DNA, 22 bp, Artificial Sequence
  chemically synthesized
agtacaagtgcacacatattta

SEQ ID NO: 724855 - DNA, 22 bp, Artificial Sequence
  chemically synthesized
ctcagtacaagtgcacacatat

SEQ ID NO: 724856 - DNA, 22 bp, Artificial Sequence
  chemically synthesized
actcagtacaagtgcacacata

SEQ ID NO: 724857 - DNA, 22 bp, Artificial Sequence
  chemically synthesized
tactcagtacaagtgcacacat

SEQ ID NO: 724858 - DNA, 22 bp, Artificial Sequence
  chemically synthesized
ttttactcagtacaagtgcaca

SEQ ID NO: 724859 - DNA, 22 bp, Artificial Sequence
  chemically synthesized
tattttactcagtacaagtgca

SEQ ID NO: 724860 - DNA, 22 bp, Artificial Sequence
  chemically synthesized
gtactgagtaaaatagagactg

SEQ ID NO: 724861 - DNA, 22 bp, Artificial Sequence
  chemically synthesized
tactgagtaaaatagagactga

SEQ ID NO: 724862 - DNA, 22 bp, Artificial Sequence
  chemically synthesized
acgtatgggtgagatcagtctc

SEQ ID NO: 724863 - DNA, 22 bp, Artificial Sequence
  chemically synthesized
agtaaaatagagactgatctca

SEQ ID NO: 724864 - DNA, 22 bp, Artificial Sequence
  chemically synthesized
agtagaattgacgtatgggtga

SEQ ID NO: 724865 - DNA, 22 bp, Artificial Sequence
  chemically synthesized
tctaagtagaattgacgtatgg

SEQ ID NO: 724866 - DNA, 22 bp, Artificial Sequence
  chemically synthesized
gtctaagtagaattgacgtatg

SEQ ID NO: 724867 - DNA, 22 bp, Artificial Sequence
  chemically synthesized
tgtctaagtagaattgacgtat

SEQ ID NO: 724868 - DNA, 22 bp, Artificial Sequence
  chemically synthesized
atctcacccatacgtcaattct

SEQ ID NO: 724869 - DNA, 22 bp, Artificial Sequence
  chemically synthesized
ctttgtctaagtagaattgacg

SEQ ID NO: 724870 - DNA, 22 bp, Artificial Sequence
  chemically synthesized
cctttgtctaagtagaattgac

SEQ ID NO: 724871 - DNA, 22 bp, Artificial Sequence
  chemically synthesized
acccatacgtcaattctactta

SEQ ID NO: 724872 - DNA, 22 bp, Artificial Sequence
  chemically synthesized
ggatttcctttgtctaagtaga

SEQ ID NO: 724873 - DNA, 22 bp, Artificial Sequence
  chemically synthesized
tacttagacaaaggaaatccca

SEQ ID NO: 724874 - DNA, 22 bp, Artificial Sequence
  chemically synthesized
cttagacaaaggaaatcccagg

SEQ ID NO: 724875 - DNA, 22 bp, Artificial Sequence
  chemically synthesized
agacaaaggaaatcccagggtt

SEQ ID NO: 724876 - DNA, 22 bp, Artificial Sequence
  chemically synthesized
gacaaaggaaatcccagggttt

SEQ ID NO: 724877 - DNA, 22 bp, Artificial Sequence
  chemically synthesized
tggagagacaaaaaaaaaaaaa

SEQ ID NO: 724878 - DNA, 22 bp, Artificial Sequence
  chemically synthesized
tttttttttttttttttttttt

SEQ ID NO: 724879 - DNA, 22 bp, Artificial Sequence
  chemically synthesized
tttttttttttttttttttttg

SEQ ID NO: 724880 - DNA, 22 bp, Artificial Sequence
  chemically synthesized
ttttttttttttttttttttgt

SEQ ID NO: 724881 - DNA, 22 bp, Artificial Sequence
  chemically synthesized
tttttttttttttttttttgtc

SEQ ID NO: 724882 - DNA, 22 bp, Artificial Sequence
  chemically synthesized
ttttttttttttttttttgtct

SEQ ID NO: 724883 - DNA, 22 bp, Artificial Sequence
  chemically synthesized
tttttttttttttttttgtctc

SEQ ID NO: 724884 - DNA, 22 bp, Artificial Sequence
  chemically synthesized
ttttttttttttttttgtctct

SEQ ID NO: 724885 - DNA, 22 bp, Artificial Sequence
  chemically synthesized
tttttttttttttttgtctctc

SEQ ID NO: 724886 - DNA, 22 bp, Artificial Sequence
  chemically synthesized
ttttttttttttttgtctctcc

SEQ ID NO: 724887 - DNA, 22 bp, Artificial Sequence
  chemically synthesized
atagcacattatggagagacaa

SEQ ID NO: 724888 - DNA, 22 bp, Artificial Sequence
  chemically synthesized
tttttttttttttgtctctcca

SEQ ID NO: 724889 - DNA, 22 bp, Artificial Sequence
  chemically synthesized
aatagcacattatggagagaca

SEQ ID NO: 724890 - DNA, 22 bp, Artificial Sequence
  chemically synthesized
ttttttttttttgtctctccat

SEQ ID NO: 724891 - DNA, 22 bp, Artificial Sequence
  chemically synthesized
taatagcacattatggagagac

SEQ ID NO: 724892 - DNA, 22 bp, Artificial Sequence
  chemically synthesized
tttttttttttgtctctccata

SEQ ID NO: 724893 - DNA, 22 bp, Artificial Sequence
  chemically synthesized
ttttttttttgtctctccataa

SEQ ID NO: 724894 - DNA, 22 bp, Artificial Sequence
  chemically synthesized
tttttttttgtctctccataat

SEQ ID NO: 724895 - DNA, 22 bp, Artificial Sequence
  chemically synthesized
ttttaatagcacattatggaga

SEQ ID NO: 724896 - DNA, 22 bp, Artificial Sequence
  chemically synthesized
ttttttttgtctctccataatg

SEQ ID NO: 724897 - DNA, 22 bp, Artificial Sequence
  chemically synthesized
attttaatagcacattatggag

SEQ ID NO: 724898 - DNA, 22 bp, Artificial Sequence
  chemically synthesized
tttttttgtctctccataatgt

SEQ ID NO: 724899 - DNA, 22 bp, Artificial Sequence
  chemically synthesized
tattttaatagcacattatgga

SEQ ID NO: 724900 - DNA, 22 bp, Artificial Sequence
  chemically synthesized
ttttttgtctctccataatgtg

SEQ ID NO: 724901 - DNA, 22 bp, Artificial Sequence
  chemically synthesized
tttttgtctctccataatgtgc

SEQ ID NO: 724902 - DNA, 22 bp, Artificial Sequence
  chemically synthesized
ttttgtctctccataatgtgct

SEQ ID NO: 724903 - DNA, 22 bp, Artificial Sequence
  chemically synthesized
tttgtctctccataatgtgcta

SEQ ID NO: 724904 - DNA, 22 bp, Artificial Sequence
  chemically synthesized
ttgtctctccataatgtgctat

SEQ ID NO: 724905 - DNA, 22 bp, Artificial Sequence
  chemically synthesized
tgtctctccataatgtgctatt

SEQ ID NO: 724906 - DNA, 22 bp, Artificial Sequence
  chemically synthesized
gtctctccataatgtgctatta

SEQ ID NO: 724907 - DNA, 22 bp, Artificial Sequence
  chemically synthesized
tctctccataatgtgctattaa

SEQ ID NO: 724908 - DNA, 22 bp, Artificial Sequence
  chemically synthesized
tccataatgtgctattaaaata

SEQ ID NO: 724909 - DNA, 22 bp, Artificial Sequence
  chemically synthesized
cataatgtgctattaaaataaa

SEQ ID NO: 724910 - DNA, 22 bp, Artificial Sequence
  chemically synthesized
acaaaatagcattttattttaa

SEQ ID NO: 724911 - DNA, 22 bp, Artificial Sequence
  chemically synthesized
ttaaaataaaatgctattttgt

SEQ ID NO: 724912 - DNA, 22 bp, Artificial Sequence
  chemically synthesized
aaataaaatgctattttgtcag

SEQ ID NO: 724913 - DNA, 22 bp, Artificial Sequence
  chemically synthesized
aaagcaaaagaaaaaggcactg

SEQ ID NO: 724914 - DNA, 22 bp, Artificial Sequence
  chemically synthesized
ttttgtcagtgcctttttcttt

SEQ ID NO: 724915 - DNA, 22 bp, Artificial Sequence
  chemically synthesized
tgtcagtgcctttttcttttgc

SEQ ID NO: 724916 - DNA, 22 bp, Artificial Sequence
  chemically synthesized
gtcagtgcctttttcttttgct

SEQ ID NO: 724917 - DNA, 22 bp, Artificial Sequence
  chemically synthesized
tcagtgcctttttcttttgctt

SEQ ID NO: 724918 - DNA, 22 bp, Artificial Sequence
  chemically synthesized
cagtccaggattgaaagcaaaa

SEQ ID NO: 724919 - DNA, 22 bp, Artificial Sequence
  chemically synthesized
cctacagtccaggattgaaagc

SEQ ID NO: 724920 - DNA, 22 bp, Artificial Sequence
  chemically synthesized
gcctacagtccaggattgaaag

SEQ ID NO: 724921 - DNA, 22 bp, Artificial Sequence
  chemically synthesized
tttcttttgctttcaatcctgg

SEQ ID NO: 724922 - DNA, 22 bp, Artificial Sequence
  chemically synthesized
ttcttttgctttcaatcctgga

SEQ ID NO: 724923 - DNA, 22 bp, Artificial Sequence
  chemically synthesized
tcttttgctttcaatcctggac

SEQ ID NO: 724924 - DNA, 22 bp, Artificial Sequence
  chemically synthesized
cttttgctttcaatcctggact

SEQ ID NO: 724925 - DNA, 22 bp, Artificial Sequence
  chemically synthesized
ttttgctttcaatcctggactg

SEQ ID NO: 724926 - DNA, 22 bp, Artificial Sequence
  chemically synthesized
tatgtcttgcctacagtccagg

SEQ ID NO: 724927 - DNA, 22 bp, Artificial Sequence
  chemically synthesized
ttgctttcaatcctggactgta

SEQ ID NO: 724928 - DNA, 22 bp, Artificial Sequence
  chemically synthesized
tgctttcaatcctggactgtag

SEQ ID NO: 724929 - DNA, 22 bp, Artificial Sequence
  chemically synthesized
gctttcaatcctggactgtagg

SEQ ID NO: 724930 - DNA, 22 bp, Artificial Sequence
  chemically synthesized
ctttcaatcctggactgtaggc

SEQ ID NO: 724931 - DNA, 22 bp, Artificial Sequence
  chemically synthesized
tcaatcctggactgtaggcaag

SEQ ID NO: 724932 - DNA, 22 bp, Artificial Sequence
  chemically synthesized
caatcctggactgtaggcaaga

SEQ ID NO: 724933 - DNA, 22 bp, Artificial Sequence
  chemically synthesized
aatcctggactgtaggcaagac

SEQ ID NO: 724934 - DNA, 22 bp, Artificial Sequence
  chemically synthesized
aggagactgtatgtcttgccta

SEQ ID NO: 724935 - DNA, 22 bp, Artificial Sequence
  chemically synthesized
tgaggagactgtatgtcttgcc

SEQ ID NO: 724936 - DNA, 22 bp, Artificial Sequence
  chemically synthesized
gactgtaggcaagacatacagt

SEQ ID NO: 724937 - DNA, 22 bp, Artificial Sequence
  chemically synthesized
aatctctgaggagactgtatgt

SEQ ID NO: 724938 - DNA, 22 bp, Artificial Sequence
  chemically synthesized
tcaatctctgaggagactgtat

SEQ ID NO: 724939 - DNA, 22 bp, Artificial Sequence
  chemically synthesized
ctcaatctctgaggagactgta

SEQ ID NO: 724940 - DNA, 22 bp, Artificial Sequence
  chemically synthesized
taggcaagacatacagtctcct

SEQ ID NO: 724941 - DNA, 22 bp, Artificial Sequence
  chemically synthesized
tctcaatctctgaggagactgt

SEQ ID NO: 724942 - DNA, 22 bp, Artificial Sequence
  chemically synthesized
acctttctcaatctctgaggag

SEQ ID NO: 724943 - DNA, 22 bp, Artificial Sequence
  chemically synthesized
ttgacctttctcaatctctgag

SEQ ID NO: 724944 - DNA, 22 bp, Artificial Sequence
  chemically synthesized
ttattgacctttctcaatctct

SEQ ID NO: 724945 - DNA, 22 bp, Artificial Sequence
  chemically synthesized
tattattgacctttctcaatct

SEQ ID NO: 724946 - DNA, 22 bp, Artificial Sequence
  chemically synthesized
ctattattgacctttctcaatc

SEQ ID NO: 724947 - DNA, 22 bp, Artificial Sequence
  chemically synthesized
ctcagagattgagaaaggtcaa

SEQ ID NO: 724948 - DNA, 22 bp, Artificial Sequence
  chemically synthesized
agagattgagaaaggtcaataa

SEQ ID NO: 724949 - DNA, 22 bp, Artificial Sequence
  chemically synthesized
agaaaggtcaataatagaaatg

SEQ ID NO: 724950 - DNA, 22 bp, Artificial Sequence
  chemically synthesized
gtgaaaggaggaaaacagcatt

SEQ ID NO: 724951 - DNA, 22 bp, Artificial Sequence
  chemically synthesized
atcagttagtgaaaggaggaaa

SEQ ID NO: 724952 - DNA, 22 bp, Artificial Sequence
  chemically synthesized
aatcagttagtgaaaggaggaa

SEQ ID NO: 724953 - DNA, 22 bp, Artificial Sequence
  chemically synthesized
tttaatcagttagtgaaaggag

SEQ ID NO: 724954 - DNA, 22 bp, Artificial Sequence
  chemically synthesized
ttttcctcctttcactaactga

SEQ ID NO: 724955 - DNA, 22 bp, Artificial Sequence
  chemically synthesized
tcctcctttcactaactgatta

SEQ ID NO: 724956 - DNA, 22 bp, Artificial Sequence
  chemically synthesized
cctcctttcactaactgattaa

SEQ ID NO: 724957 - DNA, 22 bp, Artificial Sequence
  chemically synthesized
ctcctttcactaactgattaaa

SEQ ID NO: 724958 - DNA, 22 bp, Artificial Sequence
  chemically synthesized
ctttcactaactgattaaataa

SEQ ID NO: 724959 - DNA, 22 bp, Artificial Sequence
  chemically synthesized
tcactaactgattaaataacgc

SEQ ID NO: 724960 - DNA, 22 bp, Artificial Sequence
  chemically synthesized
cactaactgattaaataacgca

SEQ ID NO: 724961 - DNA, 22 bp, Artificial Sequence
  chemically synthesized
tacatatgcccatgcgttattt

SEQ ID NO: 724962 - DNA, 22 bp, Artificial Sequence
  chemically synthesized
actaactgattaaataacgcat

SEQ ID NO: 724963 - DNA, 22 bp, Artificial Sequence
  chemically synthesized
actgattaaataacgcatgggc

SEQ ID NO: 724964 - DNA, 22 bp, Artificial Sequence
  chemically synthesized
attaaataacgcatgggcatat

SEQ ID NO: 724965 - DNA, 22 bp, Artificial Sequence
  chemically synthesized
aataacgcatgggcatatgtat

SEQ ID NO: 724966 - DNA, 22 bp, Artificial Sequence
  chemically synthesized
gaaatacacgtgtagctataca

SEQ ID NO: 724967 - DNA, 22 bp, Artificial Sequence
  chemically synthesized
agaaatacacgtgtagctatac

SEQ ID NO: 724968 - DNA, 22 bp, Artificial Sequence
  chemically synthesized
cttagaaatacacgtgtagcta

SEQ ID NO: 724969 - DNA, 22 bp, Artificial Sequence
  chemically synthesized
ccttagaaatacacgtgtagct

SEQ ID NO: 724970 - DNA, 22 bp, Artificial Sequence
  chemically synthesized
tccttagaaatacacgtgtagc

SEQ ID NO: 724971 - DNA, 22 bp, Artificial Sequence
  chemically synthesized
aatgattttccttagaaataca

SEQ ID NO: 724972 - DNA, 22 bp, Artificial Sequence
  chemically synthesized
gaatgattttccttagaaatac

SEQ ID NO: 724973 - DNA, 22 bp, Artificial Sequence
  chemically synthesized
tgaatgattttccttagaaata

SEQ ID NO: 724974 - DNA, 22 bp, Artificial Sequence
  chemically synthesized
ttgaatgattttccttagaaat

SEQ ID NO: 724975 - DNA, 22 bp, Artificial Sequence
  chemically synthesized
cacgtgtatttctaaggaaaat

SEQ ID NO: 724976 - DNA, 22 bp, Artificial Sequence
  chemically synthesized
ctaaggaaaatcattcaaaaac

SEQ ID NO: 724977 - DNA, 22 bp, Artificial Sequence
  chemically synthesized
taaggaaaatcattcaaaaact

SEQ ID NO: 724978 - DNA, 22 bp, Artificial Sequence
  chemically synthesized
aggaaatcatgcagtttttgaa

SEQ ID NO: 724979 - DNA, 22 bp, Artificial Sequence
  chemically synthesized
aggaaaatcattcaaaaactgc

SEQ ID NO: 724980 - DNA, 22 bp, Artificial Sequence
  chemically synthesized
gaggtcacctcaggaaatcatg

SEQ ID NO: 724981 - DNA, 22 bp, Artificial Sequence
  chemically synthesized
aaaaactgcatgatttcctgag

SEQ ID NO: 724982 - DNA, 22 bp, Artificial Sequence
  chemically synthesized
agcaccctggaggtcacctcag

SEQ ID NO: 724983 - DNA, 22 bp, Artificial Sequence
  chemically synthesized
cagcaccctggaggtcacctca

SEQ ID NO: 724984 - DNA, 22 bp, Artificial Sequence
  chemically synthesized
tcagcaccctggaggtcacctc

SEQ ID NO: 724985 - DNA, 22 bp, Artificial Sequence
  chemically synthesized
catgatttcctgaggtgacctc

SEQ ID NO: 724986 - DNA, 22 bp, Artificial Sequence
  chemically synthesized
aattttcagcaccctggaggtc

SEQ ID NO: 724987 - DNA, 22 bp, Artificial Sequence
  chemically synthesized
taaattttcagcaccctggagg

SEQ ID NO: 724988 - DNA, 22 bp, Artificial Sequence
  chemically synthesized
ctaaattttcagcaccctggag

SEQ ID NO: 724989 - DNA, 22 bp, Artificial Sequence
  chemically synthesized
cctgaggtgacctccagggtgc

SEQ ID NO: 724990 - DNA, 22 bp, Artificial Sequence
  chemically synthesized
tctaaattttcagcaccctgga

SEQ ID NO: 724991 - DNA, 22 bp, Artificial Sequence
  chemically synthesized
ctgaggtgacctccagggtgct

SEQ ID NO: 724992 - DNA, 22 bp, Artificial Sequence
  chemically synthesized
aggtgacctccagggtgctgaa

SEQ ID NO: 724993 - DNA, 22 bp, Artificial Sequence
  chemically synthesized
cgttttctaaattttcagcacc

SEQ ID NO: 724994 - DNA, 22 bp, Artificial Sequence
  chemically synthesized
gatgttacgttttctaaatttt

SEQ ID NO: 724995 - DNA, 22 bp, Artificial Sequence
  chemically synthesized
cagggtgctgaaaatttagaaa

SEQ ID NO: 724996 - DNA, 22 bp, Artificial Sequence
  chemically synthesized
cattagatgttacgttttctaa

SEQ ID NO: 724997 - DNA, 22 bp, Artificial Sequence
  chemically synthesized
attgcattagatgttacgtttt

SEQ ID NO: 724998 - DNA, 22 bp, Artificial Sequence
  chemically synthesized
aaaatttagaaaacgtaacatc

SEQ ID NO: 724999 - DNA, 22 bp, Artificial Sequence
  chemically synthesized
ttgattgcattagatgttacgt

SEQ ID NO: 725000 - DNA, 22 bp, Artificial Sequence
  chemically synthesized
attgattgcattagatgttacg

SEQ ID NO: 725001 - DNA, 22 bp, Artificial Sequence
  chemically synthesized
tattgattgcattagatgttac

SEQ ID NO: 725002 - DNA, 22 bp, Artificial Sequence
  chemically synthesized
attttattgattgcattagatg

SEQ ID NO: 725003 - DNA, 22 bp, Artificial Sequence
  chemically synthesized
agaaaacgtaacatctaatgca

SEQ ID NO: 725004 - DNA, 22 bp, Artificial Sequence
  chemically synthesized
gattttattgattgcattagat

SEQ ID NO: 725005 - DNA, 22 bp, Artificial Sequence
  chemically synthesized
gaaaacgtaacatctaatgcaa

SEQ ID NO: 725006 - DNA, 22 bp, Artificial Sequence
  chemically synthesized
ttgattttattgattgcattag

SEQ ID NO: 725007 - DNA, 22 bp, Artificial Sequence
  chemically synthesized
acacagattcttgattttattg

SEQ ID NO: 725008 - DNA, 22 bp, Artificial Sequence
  chemically synthesized
atgcaatcaataaaatcaagaa

SEQ ID NO: 725009 - DNA, 22 bp, Artificial Sequence
  chemically synthesized
aaaatgcctaacacagattctt

SEQ ID NO: 725010 - DNA, 22 bp, Artificial Sequence
  chemically synthesized
tcaaaatgcctaacacagattc

SEQ ID NO: 725011 - DNA, 22 bp, Artificial Sequence
  chemically synthesized
caaaactctcaaaatgcctaac

SEQ ID NO: 725012 - DNA, 22 bp, Artificial Sequence
  chemically synthesized
actccaaaactctcaaaatgcc

SEQ ID NO: 725013 - DNA, 22 bp, Artificial Sequence
  chemically synthesized
tcactcactccaaaactctcaa

SEQ ID NO: 725014 - DNA, 22 bp, Artificial Sequence
  chemically synthesized
tgttaggcattttgagagtttt

SEQ ID NO: 725015 - DNA, 22 bp, Artificial Sequence
  chemically synthesized
tactgtcactcactccaaaact

SEQ ID NO: 725016 - DNA, 22 bp, Artificial Sequence
  chemically synthesized
ggcattttgagagttttggagt

SEQ ID NO: 725017 - DNA, 22 bp, Artificial Sequence
  chemically synthesized
gctgtactgtcactcactccaa

SEQ ID NO: 725018 - DNA, 22 bp, Artificial Sequence
  chemically synthesized
tgagagttttggagtgagtgac

SEQ ID NO: 725019 - DNA, 22 bp, Artificial Sequence
  chemically synthesized
gagagttttggagtgagtgaca

SEQ ID NO: 725020 - DNA, 22 bp, Artificial Sequence
  chemically synthesized
agagttttggagtgagtgacag

SEQ ID NO: 725021 - DNA, 22 bp, Artificial Sequence
  chemically synthesized
tatcaattggctgtactgtcac

SEQ ID NO: 725022 - DNA, 22 bp, Artificial Sequence
  chemically synthesized
tggagtgagtgacagtacagcc

SEQ ID NO: 725023 - DNA, 22 bp, Artificial Sequence
  chemically synthesized
ggagtgagtgacagtacagcca

SEQ ID NO: 725024 - DNA, 22 bp, Artificial Sequence
  chemically synthesized
gagtgagtgacagtacagccaa

SEQ ID NO: 725025 - DNA, 22 bp, Artificial Sequence
  chemically synthesized
acggggactatatcaattggct

SEQ ID NO: 725026 - DNA, 22 bp, Artificial Sequence
  chemically synthesized
cacggggactatatcaattggc

SEQ ID NO: 725027 - DNA, 22 bp, Artificial Sequence
  chemically synthesized
tcacggggactatatcaattgg

SEQ ID NO: 725028 - DNA, 22 bp, Artificial Sequence
  chemically synthesized
cctttcacggggactatatcaa

SEQ ID NO: 725029 - DNA, 22 bp, Artificial Sequence
  chemically synthesized
cctgcctttcacggggactata

SEQ ID NO: 725030 - DNA, 22 bp, Artificial Sequence
  chemically synthesized
acctgcctttcacggggactat

SEQ ID NO: 725031 - DNA, 22 bp, Artificial Sequence
  chemically synthesized
atatagtccccgtgaaaggcag

SEQ ID NO: 725032 - DNA, 22 bp, Artificial Sequence
  chemically synthesized
atcaatagagagccacataaag

SEQ ID NO: 725033 - DNA, 22 bp, Artificial Sequence
  chemically synthesized
tcatcaatagagagccacataa

SEQ ID NO: 725034 - DNA, 22 bp, Artificial Sequence
  chemically synthesized
ctcatcaatagagagccacata

SEQ ID NO: 725035 - DNA, 22 bp, Artificial Sequence
  chemically synthesized
tctcatcaatagagagccacat

SEQ ID NO: 725036 - DNA, 22 bp, Artificial Sequence
  chemically synthesized
ttctcatcaatagagagccaca

SEQ ID NO: 725037 - DNA, 22 bp, Artificial Sequence
  chemically synthesized
ggaagacttttctcatcaatag

SEQ ID NO: 725038 - DNA, 22 bp, Artificial Sequence
  chemically synthesized
tatgtggctctctattgatgag

SEQ ID NO: 725039 - DNA, 22 bp, Artificial Sequence
  chemically synthesized
aggaagacttttctcatcaata

SEQ ID NO: 725040 - DNA, 22 bp, Artificial Sequence
  chemically synthesized
atgtggctctctattgatgaga

SEQ ID NO: 725041 - DNA, 22 bp, Artificial Sequence
  chemically synthesized
tgtggctctctattgatgagaa

SEQ ID NO: 725042 - DNA, 22 bp, Artificial Sequence
  chemically synthesized
ttaggaagacttttctcatcaa

SEQ ID NO: 725043 - DNA, 22 bp, Artificial Sequence
  chemically synthesized
tcttaggaagacttttctcatc

SEQ ID NO: 725044 - DNA, 22 bp, Artificial Sequence
  chemically synthesized
ttctcttaggaagacttttctc

SEQ ID NO: 725045 - DNA, 22 bp, Artificial Sequence
  chemically synthesized
attctcttaggaagacttttct

SEQ ID NO: 725046 - DNA, 22 bp, Artificial Sequence
  chemically synthesized
tctattgatgagaaaagtcttc

SEQ ID NO: 725047 - DNA, 22 bp, Artificial Sequence
  chemically synthesized
tattgatgagaaaagtcttcct

SEQ ID NO: 725048 - DNA, 22 bp, Artificial Sequence
  chemically synthesized
gtttattctcttaggaagactt

SEQ ID NO: 725049 - DNA, 22 bp, Artificial Sequence
  chemically synthesized
ttgatgagaaaagtcttcctaa

SEQ ID NO: 725050 - DNA, 22 bp, Artificial Sequence
  chemically synthesized
atgagaaaagtcttcctaagag

SEQ ID NO: 725051 - DNA, 22 bp, Artificial Sequence
  chemically synthesized
aatctagtttattctcttagga

SEQ ID NO: 725052 - DNA, 22 bp, Artificial Sequence
  chemically synthesized
taaatctagtttattctcttag

SEQ ID NO: 725053 - DNA, 22 bp, Artificial Sequence
  chemically synthesized
cctaagagaataaactagattt

SEQ ID NO: 725054 - DNA, 22 bp, Artificial Sequence
  chemically synthesized
ctaagagaataaactagattta

SEQ ID NO: 725055 - DNA, 22 bp, Artificial Sequence
  chemically synthesized
ataagacacactctaaatctag

SEQ ID NO: 725056 - DNA, 22 bp, Artificial Sequence
  chemically synthesized
cataagacacactctaaatcta

SEQ ID NO: 725057 - DNA, 22 bp, Artificial Sequence
  chemically synthesized
agagaataaactagatttagag

SEQ ID NO: 725058 - DNA, 22 bp, Artificial Sequence
  chemically synthesized
tcataagacacactctaaatct

SEQ ID NO: 725059 - DNA, 22 bp, Artificial Sequence
  chemically synthesized
gatttagagtgtgtcttatgaa

SEQ ID NO: 725060 - DNA, 22 bp, Artificial Sequence
  chemically synthesized
agagtgtgtcttatgaaaactg

SEQ ID NO: 725061 - DNA, 22 bp, Artificial Sequence
  chemically synthesized
gagtgtgtcttatgaaaactgt

SEQ ID NO: 725062 - DNA, 22 bp, Artificial Sequence
  chemically synthesized
ggaaggcatgggggaaacaaca

SEQ ID NO: 725063 - DNA, 22 bp, Artificial Sequence
  chemically synthesized
atgaaaactgttgtttccccca

SEQ ID NO: 725064 - DNA, 22 bp, Artificial Sequence
  chemically synthesized
actgggaaggcatgggggaaac

SEQ ID NO: 725065 - DNA, 22 bp, Artificial Sequence
  chemically synthesized
tgaaaactgttgtttcccccat

SEQ ID NO: 725066 - DNA, 22 bp, Artificial Sequence
  chemically synthesized
ttgtttcccccatgccttccca

SEQ ID NO: 725067 - DNA, 22 bp, Artificial Sequence
  chemically synthesized
tttcccccatgccttcccagtt

SEQ ID NO: 725068 - DNA, 22 bp, Artificial Sequence
  chemically synthesized
tacaaatgagttaactgggaag

SEQ ID NO: 725069 - DNA, 22 bp, Artificial Sequence
  chemically synthesized
cccccatgccttcccagttaac

SEQ ID NO: 725070 - DNA, 22 bp, Artificial Sequence
  chemically synthesized
ccccatgccttcccagttaact

SEQ ID NO: 725071 - DNA, 22 bp, Artificial Sequence
  chemically synthesized
aagccccaaaattatacaaatg

SEQ ID NO: 725072 - DNA, 22 bp, Artificial Sequence
  chemically synthesized
cccagttaactcatttgtataa

SEQ ID NO: 725073 - DNA, 22 bp, Artificial Sequence
  chemically synthesized
ccagttaactcatttgtataat

SEQ ID NO: 725074 - DNA, 22 bp, Artificial Sequence
  chemically synthesized
actcatttgtataattttgggg

SEQ ID NO: 725075 - DNA, 22 bp, Artificial Sequence
  chemically synthesized
atttgtataattttggggcttc

SEQ ID NO: 725076 - DNA, 22 bp, Artificial Sequence
  chemically synthesized
gtataattttggggcttcagct

SEQ ID NO: 725077 - DNA, 22 bp, Artificial Sequence
  chemically synthesized
tataattttggggcttcagctt

SEQ ID NO: 725078 - DNA, 22 bp, Artificial Sequence
  chemically synthesized
tggggcttcagctttgatgggg

SEQ ID NO: 725079 - DNA, 22 bp, Artificial Sequence
  chemically synthesized
caaataaaggagccccatcaaa

SEQ ID NO: 725080 - DNA, 22 bp, Artificial Sequence
  chemically synthesized
ggggcttcagctttgatggggc

SEQ ID NO: 725081 - DNA, 22 bp, Artificial Sequence
  chemically synthesized
gggcttcagctttgatggggct

SEQ ID NO: 725082 - DNA, 22 bp, Artificial Sequence
  chemically synthesized
aatgttgcaaataaaggagccc

SEQ ID NO: 725083 - DNA, 22 bp, Artificial Sequence
  chemically synthesized
cagctttgatggggctccttta

SEQ ID NO: 725084 - DNA, 22 bp, Artificial Sequence
  chemically synthesized
agctttgatggggctcctttat

SEQ ID NO: 725085 - DNA, 22 bp, Artificial Sequence
  chemically synthesized
atctaaatgttgcaaataaagg

SEQ ID NO: 725086 - DNA, 22 bp, Artificial Sequence
  chemically synthesized
aatctaaatgttgcaaataaag

SEQ ID NO: 725087 - DNA, 22 bp, Artificial Sequence
  chemically synthesized
tgatggggctcctttatttgca

SEQ ID NO: 725088 - DNA, 22 bp, Artificial Sequence
  chemically synthesized
gatggggctcctttatttgcaa

SEQ ID NO: 725089 - DNA, 22 bp, Artificial Sequence
  chemically synthesized
atggggctcctttatttgcaac

SEQ ID NO: 725090 - DNA, 22 bp, Artificial Sequence
  chemically synthesized
acttaatctaaatgttgcaaat

SEQ ID NO: 725091 - DNA, 22 bp, Artificial Sequence
  chemically synthesized
ctttatttgcaacatttagatt

SEQ ID NO: 725092 - DNA, 22 bp, Artificial Sequence
  chemically synthesized
tatttgcaacatttagattaag

SEQ ID NO: 725093 - DNA, 22 bp, Artificial Sequence
  chemically synthesized
atttgcaacatttagattaagt

SEQ ID NO: 725094 - DNA, 22 bp, Artificial Sequence
  chemically synthesized
tttgcaacatttagattaagtt

SEQ ID NO: 725095 - DNA, 22 bp, Artificial Sequence
  chemically synthesized
gcaacatttagattaagttaat

SEQ ID NO: 725096 - DNA, 22 bp, Artificial Sequence
  chemically synthesized
caacatttagattaagttaatg

SEQ ID NO: 725097 - DNA, 22 bp, Artificial Sequence
  chemically synthesized
tgataaaacagtcattaactta

SEQ ID NO: 725098 - DNA, 22 bp, Artificial Sequence
  chemically synthesized
gctatgataaaacagtcattaa

SEQ ID NO: 725099 - DNA, 22 bp, Artificial Sequence
  chemically synthesized
agctatgataaaacagtcatta

SEQ ID NO: 725100 - DNA, 22 bp, Artificial Sequence
  chemically synthesized
ttagctatgataaaacagtcat

SEQ ID NO: 725101 - DNA, 22 bp, Artificial Sequence
  chemically synthesized
agattaagttaatgactgtttt

SEQ ID NO: 725102 - DNA, 22 bp, Artificial Sequence
  chemically synthesized
gattaagttaatgactgtttta

SEQ ID NO: 725103 - DNA, 22 bp, Artificial Sequence
  chemically synthesized
gtgctcttagctatgataaaac

SEQ ID NO: 725104 - DNA, 22 bp, Artificial Sequence
  chemically synthesized
agttaatgactgttttatcata

SEQ ID NO: 725105 - DNA, 22 bp, Artificial Sequence
  chemically synthesized
tagtgctcttagctatgataaa

SEQ ID NO: 725106 - DNA, 22 bp, Artificial Sequence
  chemically synthesized
atgactgttttatcatagctaa

SEQ ID NO: 725107 - DNA, 22 bp, Artificial Sequence
  chemically synthesized
attctagtgctcttagctatga

SEQ ID NO: 725108 - DNA, 22 bp, Artificial Sequence
  chemically synthesized
ctaattctagtgctcttagcta

SEQ ID NO: 725109 - DNA, 22 bp, Artificial Sequence
  chemically synthesized
ttttatcatagctaagagcact

SEQ ID NO: 725110 - DNA, 22 bp, Artificial Sequence
  chemically synthesized
acctcctaattctagtgctctt

SEQ ID NO: 725111 - DNA, 22 bp, Artificial Sequence
  chemically synthesized
tatcatagctaagagcactaga

SEQ ID NO: 725112 - DNA, 22 bp, Artificial Sequence
  chemically synthesized
atcatagctaagagcactagaa

SEQ ID NO: 725113 - DNA, 22 bp, Artificial Sequence
  chemically synthesized
tcatagctaagagcactagaat

SEQ ID NO: 725114 - DNA, 22 bp, Artificial Sequence
  chemically synthesized
atagccattgacctcctaattc

SEQ ID NO: 725115 - DNA, 22 bp, Artificial Sequence
  chemically synthesized
agagcactagaattaggaggtc

SEQ ID NO: 725116 - DNA, 22 bp, Artificial Sequence
  chemically synthesized
gaattaggaggtcaatggctat

SEQ ID NO: 725117 - DNA, 22 bp, Artificial Sequence
  chemically synthesized
ggaggtcaatggctattagcat

SEQ ID NO: 725118 - DNA, 22 bp, Artificial Sequence
  chemically synthesized
gtatcatcaagaaaatcaaatg

SEQ ID NO: 725119 - DNA, 22 bp, Artificial Sequence
  chemically synthesized
ggtatcatcaagaaaatcaaat

SEQ ID NO: 725120 - DNA, 22 bp, Artificial Sequence
  chemically synthesized
tggtatcatcaagaaaatcaaa

SEQ ID NO: 725121 - DNA, 22 bp, Artificial Sequence
  chemically synthesized
tttggtatcatcaagaaaatca

SEQ ID NO: 725122 - DNA, 22 bp, Artificial Sequence
  chemically synthesized
ttagcatttgattttcttgatg

SEQ ID NO: 725123 - DNA, 22 bp, Artificial Sequence
  chemically synthesized
atctctttggtatcatcaagaa

SEQ ID NO: 725124 - DNA, 22 bp, Artificial Sequence
  chemically synthesized
gcatttgattttcttgatgata

SEQ ID NO: 725125 - DNA, 22 bp, Artificial Sequence
  chemically synthesized
aaactcatctctttggtatcat

SEQ ID NO: 725126 - DNA, 22 bp, Artificial Sequence
  chemically synthesized
gattttcttgatgataccaaag

SEQ ID NO: 725127 - DNA, 22 bp, Artificial Sequence
  chemically synthesized
attttcttgatgataccaaaga

SEQ ID NO: 725128 - DNA, 22 bp, Artificial Sequence
  chemically synthesized
cccctcaaactcatctctttgg

SEQ ID NO: 725129 - DNA, 22 bp, Artificial Sequence
  chemically synthesized
tcttgatgataccaaagagatg

SEQ ID NO: 725130 - DNA, 22 bp, Artificial Sequence
  chemically synthesized
ccccctcaaactcatctctttg

SEQ ID NO: 725131 - DNA, 22 bp, Artificial Sequence
  chemically synthesized
cttgatgataccaaagagatga

SEQ ID NO: 725132 - DNA, 22 bp, Artificial Sequence
  chemically synthesized
ttgatgataccaaagagatgag

SEQ ID NO: 725133 - DNA, 22 bp, Artificial Sequence
  chemically synthesized
ttccccctcaaactcatctctt

SEQ ID NO: 725134 - DNA, 22 bp, Artificial Sequence
  chemically synthesized
cttccccctcaaactcatctct

SEQ ID NO: 725135 - DNA, 22 bp, Artificial Sequence
  chemically synthesized
gatgataccaaagagatgagtt

SEQ ID NO: 725136 - DNA, 22 bp, Artificial Sequence
  chemically synthesized
atgataccaaagagatgagttt

SEQ ID NO: 725137 - DNA, 22 bp, Artificial Sequence
  chemically synthesized
gagggggaagaagtgtgggctt

SEQ ID NO: 725138 - DNA, 22 bp, Artificial Sequence
  chemically synthesized
agggggaagaagtgtgggcttg

SEQ ID NO: 725139 - DNA, 22 bp, Artificial Sequence
  chemically synthesized
aaacatgagtaatcaagcccac

SEQ ID NO: 725140 - DNA, 22 bp, Artificial Sequence
  chemically synthesized
agatgaaattaaaacatgagta

SEQ ID NO: 725141 - DNA, 22 bp, Artificial Sequence
  chemically synthesized
ctgagatgaaattaaaacatga

SEQ ID NO: 725142 - DNA, 22 bp, Artificial Sequence
  chemically synthesized
tctactgagatgaaattaaaac

SEQ ID NO: 725143 - DNA, 22 bp, Artificial Sequence
  chemically synthesized
gtctactgagatgaaattaaaa

SEQ ID NO: 725144 - DNA, 22 bp, Artificial Sequence
  chemically synthesized
gattactcatgttttaatttca

SEQ ID NO: 725145 - DNA, 22 bp, Artificial Sequence
  chemically synthesized
attactcatgttttaatttcat

SEQ ID NO: 725146 - DNA, 22 bp, Artificial Sequence
  chemically synthesized
gatttgtctactgagatgaaat

SEQ ID NO: 725147 - DNA, 22 bp, Artificial Sequence
  chemically synthesized
ctcatgttttaatttcatctca

SEQ ID NO: 725148 - DNA, 22 bp, Artificial Sequence
  chemically synthesized
ggatttgtctactgagatgaaa

SEQ ID NO: 725149 - DNA, 22 bp, Artificial Sequence
  chemically synthesized
tggatttgtctactgagatgaa

SEQ ID NO: 725150 - DNA, 22 bp, Artificial Sequence
  chemically synthesized
atgttttaatttcatctcagta

SEQ ID NO: 725151 - DNA, 22 bp, Artificial Sequence
  chemically synthesized
taatttcatctcagtagacaaa

SEQ ID NO: 725152 - DNA, 22 bp, Artificial Sequence
  chemically synthesized
aatttcatctcagtagacaaat

SEQ ID NO: 725153 - DNA, 22 bp, Artificial Sequence
  chemically synthesized
atttcatctcagtagacaaatc

SEQ ID NO: 725154 - DNA, 22 bp, Artificial Sequence
  chemically synthesized
agacatcattttggatttgtct

SEQ ID NO: 725155 - DNA, 22 bp, Artificial Sequence
  chemically synthesized
catctcagtagacaaatccaaa

SEQ ID NO: 725156 - DNA, 22 bp, Artificial Sequence
  chemically synthesized
atctcagtagacaaatccaaaa

SEQ ID NO: 725157 - DNA, 22 bp, Artificial Sequence
  chemically synthesized
agtagacaaatccaaaatgatg

SEQ ID NO: 725158 - DNA, 22 bp, Artificial Sequence
  chemically synthesized
agtcatccctgagacatcattt

SEQ ID NO: 725159 - DNA, 22 bp, Artificial Sequence
  chemically synthesized
tgagtcatccctgagacatcat

SEQ ID NO: 725160 - DNA, 22 bp, Artificial Sequence
  chemically synthesized
gaattctgagtcatccctgaga

SEQ ID NO: 725161 - DNA, 22 bp, Artificial Sequence
  chemically synthesized
agggatgactcagaattccaga

SEQ ID NO: 725162 - DNA, 22 bp, Artificial Sequence
  chemically synthesized
agaattccagatgggatatgtg

SEQ ID NO: 725163 - DNA, 22 bp, Artificial Sequence
  chemically synthesized
gacaaagggcaaaagtacacat

SEQ ID NO: 725164 - DNA, 22 bp, Artificial Sequence
  chemically synthesized
cagatgggatatgtgtactttt

SEQ ID NO: 725165 - DNA, 22 bp, Artificial Sequence
  chemically synthesized
ttgccctttgtccagtcctttg

SEQ ID NO: 725166 - DNA, 22 bp, Artificial Sequence
  chemically synthesized
tgccctttgtccagtcctttgc

SEQ ID NO: 725167 - DNA, 22 bp, Artificial Sequence
  chemically synthesized
gccctttgtccagtcctttgca

SEQ ID NO: 725168 - DNA, 22 bp, Artificial Sequence
  chemically synthesized
ccctttgtccagtcctttgcac

SEQ ID NO: 725169 - DNA, 22 bp, Artificial Sequence
  chemically synthesized
tgtccagtcctttgcacactgg

SEQ ID NO: 725170 - DNA, 22 bp, Artificial Sequence
  chemically synthesized
gtccagtcctttgcacactggg

SEQ ID NO: 725171 - DNA, 22 bp, Artificial Sequence
  chemically synthesized
tcagtggatatgcccagtgtgc

SEQ ID NO: 725172 - DNA, 22 bp, Artificial Sequence
  chemically synthesized
tccagtcctttgcacactgggc

SEQ ID NO: 725173 - DNA, 22 bp, Artificial Sequence
  chemically synthesized
tgttgtcagtggatatgcccag

SEQ ID NO: 725174 - DNA, 22 bp, Artificial Sequence
  chemically synthesized
tgcacactgggcatatccactg

SEQ ID NO: 725175 - DNA, 22 bp, Artificial Sequence
  chemically synthesized
gcacactgggcatatccactga

SEQ ID NO: 725176 - DNA, 22 bp, Artificial Sequence
  chemically synthesized
acagttgtgttgtcagtggata

SEQ ID NO: 725177 - DNA, 22 bp, Artificial Sequence
  chemically synthesized
cacactgggcatatccactgac

SEQ ID NO: 725178 - DNA, 22 bp, Artificial Sequence
  chemically synthesized
tgacagttgtgttgtcagtgga

SEQ ID NO: 725179 - DNA, 22 bp, Artificial Sequence
  chemically synthesized
ctctgacagttgtgttgtcagt

SEQ ID NO: 725180 - DNA, 22 bp, Artificial Sequence
  chemically synthesized
ggcatatccactgacaacacaa

SEQ ID NO: 725181 - DNA, 22 bp, Artificial Sequence
  chemically synthesized
ttcctctgacagttgtgttgtc

SEQ ID NO: 725182 - DNA, 22 bp, Artificial Sequence
  chemically synthesized
gttcctctgacagttgtgttgt

SEQ ID NO: 725183 - DNA, 22 bp, Artificial Sequence
  chemically synthesized
aaagcttgttcctctgacagtt

SEQ ID NO: 725184 - DNA, 22 bp, Artificial Sequence
  chemically synthesized
acaacacaactgtcagaggaac

SEQ ID NO: 725185 - DNA, 22 bp, Artificial Sequence
  chemically synthesized
gaaattgaaagcttgttcctct

SEQ ID NO: 725186 - DNA, 22 bp, Artificial Sequence
  chemically synthesized
aaactggaaattgaaagcttgt

SEQ ID NO: 725187 - DNA, 22 bp, Artificial Sequence
  chemically synthesized
gaaactggaaattgaaagcttg

SEQ ID NO: 725188 - DNA, 22 bp, Artificial Sequence
  chemically synthesized
ttgaaactggaaattgaaagct

SEQ ID NO: 725189 - DNA, 22 bp, Artificial Sequence
  chemically synthesized
tcagaggaacaagctttcaatt

SEQ ID NO: 725190 - DNA, 22 bp, Artificial Sequence
  chemically synthesized
cctcttgaaactggaaattgaa

SEQ ID NO: 725191 - DNA, 22 bp, Artificial Sequence
  chemically synthesized
attccctcttgaaactggaaat

SEQ ID NO: 725192 - DNA, 22 bp, Artificial Sequence
  chemically synthesized
atctcattccctcttgaaactg

SEQ ID NO: 725193 - DNA, 22 bp, Artificial Sequence
  chemically synthesized
tcaatttccagtttcaagaggg

SEQ ID NO: 725194 - DNA, 22 bp, Artificial Sequence
  chemically synthesized
caatttccagtttcaagaggga

SEQ ID NO: 725195 - DNA, 22 bp, Artificial Sequence
  chemically synthesized
aatttccagtttcaagagggaa

SEQ ID NO: 725196 - DNA, 22 bp, Artificial Sequence
  chemically synthesized
aagcctgatctcattccctctt

SEQ ID NO: 725197 - DNA, 22 bp, Artificial Sequence
  chemically synthesized
ccagtttcaagagggaatgaga

SEQ ID NO: 725198 - DNA, 22 bp, Artificial Sequence
  chemically synthesized
cagtttcaagagggaatgagat

SEQ ID NO: 725199 - DNA, 22 bp, Artificial Sequence
  chemically synthesized
caagagggaatgagatcaggct

SEQ ID NO: 725200 - DNA, 22 bp, Artificial Sequence
  chemically synthesized
aagagggaatgagatcaggctt

SEQ ID NO: 725201 - DNA, 22 bp, Artificial Sequence
  chemically synthesized
agtcaccataaatgatcattca

SEQ ID NO: 725202 - DNA, 22 bp, Artificial Sequence
  chemically synthesized
gaatgatcatttatggtgactg

SEQ ID NO: 725203 - DNA, 22 bp, Artificial Sequence
  chemically synthesized
aatgatcatttatggtgactga

SEQ ID NO: 725204 - DNA, 22 bp, Artificial Sequence
  chemically synthesized
tcggagaaagcaattcagtcac

SEQ ID NO: 725205 - DNA, 22 bp, Artificial Sequence
  chemically synthesized
gtcggagaaagcaattcagtca

SEQ ID NO: 725206 - DNA, 22 bp, Artificial Sequence
  chemically synthesized
cttgtcggagaaagcaattcag

SEQ ID NO: 725207 - DNA, 22 bp, Artificial Sequence
  chemically synthesized
ccttgtcggagaaagcaattca

SEQ ID NO: 725208 - DNA, 22 bp, Artificial Sequence
  chemically synthesized
atggtgactgaattgctttctc

SEQ ID NO: 725209 - DNA, 22 bp, Artificial Sequence
  chemically synthesized
tggtgactgaattgctttctcc

SEQ ID NO: 725210 - DNA, 22 bp, Artificial Sequence
  chemically synthesized
aattgctttctccgacaaggaa

SEQ ID NO: 725211 - DNA, 22 bp, Artificial Sequence
  chemically synthesized
ctttctccgacaaggaagcctc

SEQ ID NO: 725212 - DNA, 22 bp, Artificial Sequence
  chemically synthesized
tctccgacaaggaagcctcact

SEQ ID NO: 725213 - DNA, 22 bp, Artificial Sequence
  chemically synthesized
ctccgacaaggaagcctcactt

SEQ ID NO: 725214 - DNA, 22 bp, Artificial Sequence
  chemically synthesized
tccgacaaggaagcctcacttg

SEQ ID NO: 725215 - DNA, 22 bp, Artificial Sequence
  chemically synthesized
cgacaaggaagcctcacttgtt

SEQ ID NO: 725216 - DNA, 22 bp, Artificial Sequence
  chemically synthesized
agagcaccatccgtaaagtcca

SEQ ID NO: 725217 - DNA, 22 bp, Artificial Sequence
  chemically synthesized
gagagcaccatccgtaaagtcc

SEQ ID NO: 725218 - DNA, 22 bp, Artificial Sequence
  chemically synthesized
tgagagcaccatccgtaaagtc

SEQ ID NO: 725219 - DNA, 22 bp, Artificial Sequence
  chemically synthesized
acttgttcgtggactttacgga

SEQ ID NO: 725220 - DNA, 22 bp, Artificial Sequence
  chemically synthesized
ttgagagcaccatccgtaaagt

SEQ ID NO: 725221 - DNA, 22 bp, Artificial Sequence
  chemically synthesized
gttcgtggactttacggatggt

SEQ ID NO: 725222 - DNA, 22 bp, Artificial Sequence
  chemically synthesized
ttcgtggactttacggatggtg

SEQ ID NO: 725223 - DNA, 22 bp, Artificial Sequence
  chemically synthesized
gtggactttacggatggtgctc

SEQ ID NO: 725224 - DNA, 22 bp, Artificial Sequence
  chemically synthesized
gccaatttttgagagcaccatc

SEQ ID NO: 725225 - DNA, 22 bp, Artificial Sequence
  chemically synthesized
actggccaatttttgagagcac

SEQ ID NO: 725226 - DNA, 22 bp, Artificial Sequence
  chemically synthesized
tacggatggtgctctcaaaaat

SEQ ID NO: 725227 - DNA, 22 bp, Artificial Sequence
  chemically synthesized
acggatggtgctctcaaaaatt

SEQ ID NO: 725228 - DNA, 22 bp, Artificial Sequence
  chemically synthesized
cggatggtgctctcaaaaattg

SEQ ID NO: 725229 - DNA, 22 bp, Artificial Sequence
  chemically synthesized
tcaaaaattggccagttaatct

SEQ ID NO: 725230 - DNA, 22 bp, Artificial Sequence
  chemically synthesized
aaaaattggccagttaatctct

SEQ ID NO: 725231 - DNA, 22 bp, Artificial Sequence
  chemically synthesized
ggaaagatgcaacagataaaga

SEQ ID NO: 725232 - DNA, 22 bp, Artificial Sequence
  chemically synthesized
gccagttaatctctttatctgt

SEQ ID NO: 725233 - DNA, 22 bp, Artificial Sequence
  chemically synthesized
atctctttatctgttgcatctt

SEQ ID NO: 725234 - DNA, 22 bp, Artificial Sequence
  chemically synthesized
tttatctgttgcatctttccta

SEQ ID NO: 725235 - DNA, 22 bp, Artificial Sequence
  chemically synthesized
tatctgttgcatctttcctaga

SEQ ID NO: 725236 - DNA, 22 bp, Artificial Sequence
  chemically synthesized
atctgttgcatctttcctagat

SEQ ID NO: 725237 - DNA, 22 bp, Artificial Sequence
  chemically synthesized
tctgttgcatctttcctagatt

SEQ ID NO: 725238 - DNA, 22 bp, Artificial Sequence
  chemically synthesized
gaaagacacaatggaatctagg

SEQ ID NO: 725239 - DNA, 22 bp, Artificial Sequence
  chemically synthesized
cgaaagacacaatggaatctag

SEQ ID NO: 725240 - DNA, 22 bp, Artificial Sequence
  chemically synthesized
ttgcatctttcctagattccat

SEQ ID NO: 725241 - DNA, 22 bp, Artificial Sequence
  chemically synthesized
tcgaaagacacaatggaatcta

SEQ ID NO: 725242 - DNA, 22 bp, Artificial Sequence
  chemically synthesized
catctttcctagattccattgt

SEQ ID NO: 725243 - DNA, 22 bp, Artificial Sequence
  chemically synthesized
cagtattttcgaaagacacaat

SEQ ID NO: 725244 - DNA, 22 bp, Artificial Sequence
  chemically synthesized
tcctagattccattgtgtcttt

SEQ ID NO: 725245 - DNA, 22 bp, Artificial Sequence
  chemically synthesized
acagtattttcgaaagacacaa

SEQ ID NO: 725246 - DNA, 22 bp, Artificial Sequence
  chemically synthesized
cctagattccattgtgtctttc

SEQ ID NO: 725247 - DNA, 22 bp, Artificial Sequence
  chemically synthesized
tacagtattttcgaaagacaca

SEQ ID NO: 725248 - DNA, 22 bp, Artificial Sequence
  chemically synthesized
ctagattccattgtgtctttcg

SEQ ID NO: 725249 - DNA, 22 bp, Artificial Sequence
  chemically synthesized
gattccattgtgtctttcgaaa

SEQ ID NO: 725250 - DNA, 22 bp, Artificial Sequence
  chemically synthesized
taaattttacagtattttcgaa

SEQ ID NO: 725251 - DNA, 22 bp, Artificial Sequence
  chemically synthesized
gtaaattttacagtattttcga

SEQ ID NO: 725252 - DNA, 22 bp, Artificial Sequence
  chemically synthesized
cattgtgtctttcgaaaatact

SEQ ID NO: 725253 - DNA, 22 bp, Artificial Sequence
  chemically synthesized
catttgtaaattttacagtatt

SEQ ID NO: 725254 - DNA, 22 bp, Artificial Sequence
  chemically synthesized
tgtctttcgaaaatactgtaaa

SEQ ID NO: 725255 - DNA, 22 bp, Artificial Sequence
  chemically synthesized
agctacatttgtaaattttaca

SEQ ID NO: 725256 - DNA, 22 bp, Artificial Sequence
  chemically synthesized
tcgaaaatactgtaaaatttac

SEQ ID NO: 725257 - DNA, 22 bp, Artificial Sequence
  chemically synthesized
cgaaaatactgtaaaatttaca

SEQ ID NO: 725258 - DNA, 22 bp, Artificial Sequence
  chemically synthesized
gaaaatactgtaaaatttacaa

SEQ ID NO: 725259 - DNA, 22 bp, Artificial Sequence
  chemically synthesized
cctaagctacatttgtaaattt

SEQ ID NO: 725260 - DNA, 22 bp, Artificial Sequence
  chemically synthesized
gcctaagctacatttgtaaatt

SEQ ID NO: 725261 - DNA, 22 bp, Artificial Sequence
  chemically synthesized
tgcctaagctacatttgtaaat

SEQ ID NO: 725262 - DNA, 22 bp, Artificial Sequence
  chemically synthesized
cattttgcctaagctacatttg

SEQ ID NO: 725263 - DNA, 22 bp, Artificial Sequence
  chemically synthesized
gcattttgcctaagctacattt

SEQ ID NO: 725264 - DNA, 22 bp, Artificial Sequence
  chemically synthesized
taaaatttacaaatgtagctta

SEQ ID NO: 725265 - DNA, 22 bp, Artificial Sequence
  chemically synthesized
acaaatgtagcttaggcaaaat

SEQ ID NO: 725266 - DNA, 22 bp, Artificial Sequence
  chemically synthesized
caaatgtagcttaggcaaaatg

SEQ ID NO: 725267 - DNA, 22 bp, Artificial Sequence
  chemically synthesized
agacagaaacacatttgcattt

SEQ ID NO: 725268 - DNA, 22 bp, Artificial Sequence
  chemically synthesized
aagacagaaacacatttgcatt

SEQ ID NO: 725269 - DNA, 22 bp, Artificial Sequence
  chemically synthesized
taagacagaaacacatttgcat

SEQ ID NO: 725270 - DNA, 22 bp, Artificial Sequence
  chemically synthesized
ttaagacagaaacacatttgca

SEQ ID NO: 725271 - DNA, 22 bp, Artificial Sequence
  chemically synthesized
tttaagacagaaacacatttgc

SEQ ID NO: 725272 - DNA, 22 bp, Artificial Sequence
  chemically synthesized
tttttaagacagaaacacattt

SEQ ID NO: 725273 - DNA, 22 bp, Artificial Sequence
  chemically synthesized
aggcaaaatgcaaatgtgtttc

SEQ ID NO: 725274 - DNA, 22 bp, Artificial Sequence
  chemically synthesized
ggcaaaatgcaaatgtgtttct

SEQ ID NO: 725275 - DNA, 22 bp, Artificial Sequence
  chemically synthesized
ctctttttaagacagaaacaca

SEQ ID NO: 725276 - DNA, 22 bp, Artificial Sequence
  chemically synthesized
cctctttttaagacagaaacac

SEQ ID NO: 725277 - DNA, 22 bp, Artificial Sequence
  chemically synthesized
tttcctctttttaagacagaaa

SEQ ID NO: 725278 - DNA, 22 bp, Artificial Sequence
  chemically synthesized
cagatagctatttcctcttttt

SEQ ID NO: 725279 - DNA, 22 bp, Artificial Sequence
  chemically synthesized
ctgtcttaaaaagaggaaatag

SEQ ID NO: 725280 - DNA, 22 bp, Artificial Sequence
  chemically synthesized
tgtcttaaaaagaggaaatagc

SEQ ID NO: 725281 - DNA, 22 bp, Artificial Sequence
  chemically synthesized
tcttaaaaagaggaaatagcta

SEQ ID NO: 725282 - DNA, 22 bp, Artificial Sequence
  chemically synthesized
aaaaagaggaaatagctatctg

SEQ ID NO: 725283 - DNA, 22 bp, Artificial Sequence
  chemically synthesized
aaaagaggaaatagctatctgc

SEQ ID NO: 725284 - DNA, 22 bp, Artificial Sequence
  chemically synthesized
catcccatatcgttgcagatag

SEQ ID NO: 725285 - DNA, 22 bp, Artificial Sequence
  chemically synthesized
tccatcccatatcgttgcagat

SEQ ID NO: 725286 - DNA, 22 bp, Artificial Sequence
  chemically synthesized
tctccatcccatatcgttgcag

SEQ ID NO: 725287 - DNA, 22 bp, Artificial Sequence
  chemically synthesized
ctctccatcccatatcgttgca

SEQ ID NO: 725288 - DNA, 22 bp, Artificial Sequence
  chemically synthesized
tctctccatcccatatcgttgc

SEQ ID NO: 725289 - DNA, 22 bp, Artificial Sequence
  chemically synthesized
gctttctctccatcccatatcg

SEQ ID NO: 725290 - DNA, 22 bp, Artificial Sequence
  chemically synthesized
ttcgctttctctccatcccata

SEQ ID NO: 725291 - DNA, 22 bp, Artificial Sequence
  chemically synthesized
tctgcaacgatatgggatggag

SEQ ID NO: 725292 - DNA, 22 bp, Artificial Sequence
  chemically synthesized
ctgttcgctttctctccatccc

SEQ ID NO: 725293 - DNA, 22 bp, Artificial Sequence
  chemically synthesized
caacgatatgggatggagagaa

SEQ ID NO: 725294 - DNA, 22 bp, Artificial Sequence
  chemically synthesized
aacggtcctcctgttcgctttc

SEQ ID NO: 725295 - DNA, 22 bp, Artificial Sequence
  chemically synthesized
taaacggtcctcctgttcgctt

SEQ ID NO: 725296 - DNA, 22 bp, Artificial Sequence
  chemically synthesized
catcatgattctaaacggtcct

SEQ ID NO: 725297 - DNA, 22 bp, Artificial Sequence
  chemically synthesized
ctacatcatgattctaaacggt

SEQ ID NO: 725298 - DNA, 22 bp, Artificial Sequence
  chemically synthesized
cctacatcatgattctaaacgg

SEQ ID NO: 725299 - DNA, 22 bp, Artificial Sequence
  chemically synthesized
tgtttcctacatcatgattcta

SEQ ID NO: 725300 - DNA, 22 bp, Artificial Sequence
  chemically synthesized
cattatgtttcctacatcatga

SEQ ID NO: 725301 - DNA, 22 bp, Artificial Sequence
  chemically synthesized
gcattatgtttcctacatcatg

SEQ ID NO: 725302 - DNA, 22 bp, Artificial Sequence
  chemically synthesized
tgcattatgtttcctacatcat

SEQ ID NO: 725303 - DNA, 22 bp, Artificial Sequence
  chemically synthesized
agaatcatgatgtaggaaacat

SEQ ID NO: 725304 - DNA, 22 bp, Artificial Sequence
  chemically synthesized
caattttgcattatgtttccta

SEQ ID NO: 725305 - DNA, 22 bp, Artificial Sequence
  chemically synthesized
gaatcatgatgtaggaaacata

SEQ ID NO: 725306 - DNA, 22 bp, Artificial Sequence
  chemically synthesized
acaattttgcattatgtttcct

SEQ ID NO: 725307 - DNA, 22 bp, Artificial Sequence
  chemically synthesized
ccatacccccacaccagcctta

SEQ ID NO: 725308 - DNA, 22 bp, Artificial Sequence
  chemically synthesized
gccatacccccacaccagcctt

SEQ ID NO: 725309 - DNA, 22 bp, Artificial Sequence
  chemically synthesized
tccttgccatacccccacacca

SEQ ID NO: 725310 - DNA, 22 bp, Artificial Sequence
  chemically synthesized
gttatccttgccatacccccac

SEQ ID NO: 725311 - DNA, 22 bp, Artificial Sequence
  chemically synthesized
taaggctggtgtgggggtatgg

SEQ ID NO: 725312 - DNA, 22 bp, Artificial Sequence
  chemically synthesized
actagttatccttgccataccc

SEQ ID NO: 725313 - DNA, 22 bp, Artificial Sequence
  chemically synthesized
tcactagttatccttgccatac

SEQ ID NO: 725314 - DNA, 22 bp, Artificial Sequence
  chemically synthesized
gtgtgggggtatggcaaggata

SEQ ID NO: 725315 - DNA, 22 bp, Artificial Sequence
  chemically synthesized
gggatctctcactagttatcct

SEQ ID NO: 725316 - DNA, 22 bp, Artificial Sequence
  chemically synthesized
cgttggggatctctcactagtt

SEQ ID NO: 725317 - DNA, 22 bp, Artificial Sequence
  chemically synthesized
acatctccgttggggatctctc

SEQ ID NO: 725318 - DNA, 22 bp, Artificial Sequence
  chemically synthesized
cacatctccgttggggatctct

SEQ ID NO: 725319 - DNA, 22 bp, Artificial Sequence
  chemically synthesized
caaatttcacatctccgttggg

SEQ ID NO: 725320 - DNA, 22 bp, Artificial Sequence
  chemically synthesized
gtgagagatccccaacggagat

SEQ ID NO: 725321 - DNA, 22 bp, Artificial Sequence
  chemically synthesized
tccaaatttcacatctccgttg

SEQ ID NO: 725322 - DNA, 22 bp, Artificial Sequence
  chemically synthesized
ctccaaatttcacatctccgtt

SEQ ID NO: 725323 - DNA, 22 bp, Artificial Sequence
  chemically synthesized
tctccaaatttcacatctccgt

SEQ ID NO: 725324 - DNA, 22 bp, Artificial Sequence
  chemically synthesized
ttctccaaatttcacatctccg

SEQ ID NO: 725325 - DNA, 22 bp, Artificial Sequence
  chemically synthesized
tgcttttctccaaatttcacat

SEQ ID NO: 725326 - DNA, 22 bp, Artificial Sequence
  chemically synthesized
ctatgcttttctccaaatttca

SEQ ID NO: 725327 - DNA, 22 bp, Artificial Sequence
  chemically synthesized
tgtgcagttcctatgcttttct

SEQ ID NO: 725328 - DNA, 22 bp, Artificial Sequence
  chemically synthesized
cattatgtgcagttcctatgct

SEQ ID NO: 725329 - DNA, 22 bp, Artificial Sequence
  chemically synthesized
gcattatgtgcagttcctatgc

SEQ ID NO: 725330 - DNA, 22 bp, Artificial Sequence
  chemically synthesized
tgcattatgtgcagttcctatg

SEQ ID NO: 725331 - DNA, 22 bp, Artificial Sequence
  chemically synthesized
ggagaaaagcataggaactgca

SEQ ID NO: 725332 - DNA, 22 bp, Artificial Sequence
  chemically synthesized
gagaaaagcataggaactgcac

SEQ ID NO: 725333 - DNA, 22 bp, Artificial Sequence
  chemically synthesized
aaagtgagagaaggaaactttg

SEQ ID NO: 725334 - DNA, 22 bp, Artificial Sequence
  chemically synthesized
cacataatgcaaagtttccttc

SEQ ID NO: 725335 - DNA, 22 bp, Artificial Sequence
  chemically synthesized
agctcaaagtgagagaaggaaa

SEQ ID NO: 725336 - DNA, 22 bp, Artificial Sequence
  chemically synthesized
actgagctcaaagtgagagaag

SEQ ID NO: 725337 - DNA, 22 bp, Artificial Sequence
  chemically synthesized
ccttctctcactttgagctcag

SEQ ID NO: 725338 - DNA, 22 bp, Artificial Sequence
  chemically synthesized
cttctctcactttgagctcagt

SEQ ID NO: 725339 - DNA, 22 bp, Artificial Sequence
  chemically synthesized
ctctcactttgagctcagtgaa

SEQ ID NO: 725340 - DNA, 22 bp, Artificial Sequence
  chemically synthesized
tctcactttgagctcagtgaat

SEQ ID NO: 725341 - DNA, 22 bp, Artificial Sequence
  chemically synthesized
tcactttgagctcagtgaatct

SEQ ID NO: 725342 - DNA, 22 bp, Artificial Sequence
  chemically synthesized
actttgagctcagtgaatctgg

SEQ ID NO: 725343 - DNA, 22 bp, Artificial Sequence
  chemically synthesized
ataaaacaaatcccagattcac

SEQ ID NO: 725344 - DNA, 22 bp, Artificial Sequence
  chemically synthesized
ttcataaaacaaatcccagatt

SEQ ID NO: 725345 - DNA, 22 bp, Artificial Sequence
  chemically synthesized
tgagctcagtgaatctgggatt

SEQ ID NO: 725346 - DNA, 22 bp, Artificial Sequence
  chemically synthesized
gttcataaaacaaatcccagat

SEQ ID NO: 725347 - DNA, 22 bp, Artificial Sequence
  chemically synthesized
gagctcagtgaatctgggattt

SEQ ID NO: 725348 - DNA, 22 bp, Artificial Sequence
  chemically synthesized
tgttcataaaacaaatcccaga

SEQ ID NO: 725349 - DNA, 22 bp, Artificial Sequence
  chemically synthesized
agctcagtgaatctgggatttg

SEQ ID NO: 725350 - DNA, 22 bp, Artificial Sequence
  chemically synthesized
tctttgttcataaaacaaatcc

SEQ ID NO: 725351 - DNA, 22 bp, Artificial Sequence
  chemically synthesized
agtgaatctgggatttgtttta

SEQ ID NO: 725352 - DNA, 22 bp, Artificial Sequence
  chemically synthesized
ctatctttgttcataaaacaaa

SEQ ID NO: 725353 - DNA, 22 bp, Artificial Sequence
  chemically synthesized
gctatctttgttcataaaacaa

SEQ ID NO: 725354 - DNA, 22 bp, Artificial Sequence
  chemically synthesized
ggatttgttttatgaacaaaga

SEQ ID NO: 725355 - DNA, 22 bp, Artificial Sequence
  chemically synthesized
gttttatgaacaaagatagcaa

SEQ ID NO: 725356 - DNA, 22 bp, Artificial Sequence
  chemically synthesized
ttttatgaacaaagatagcaag

SEQ ID NO: 725357 - DNA, 22 bp, Artificial Sequence
  chemically synthesized
ccatcataaagcaacttgctat

SEQ ID NO: 725358 - DNA, 22 bp, Artificial Sequence
  chemically synthesized
tatgaacaaagatagcaagttg

SEQ ID NO: 725359 - DNA, 22 bp, Artificial Sequence
  chemically synthesized
atgaacaaagatagcaagttgc

SEQ ID NO: 725360 - DNA, 22 bp, Artificial Sequence
  chemically synthesized
tgaacaaagatagcaagttgct

SEQ ID NO: 725361 - DNA, 22 bp, Artificial Sequence
  chemically synthesized
taaccactgccatcataaagca

SEQ ID NO: 725362 - DNA, 22 bp, Artificial Sequence
  chemically synthesized
ttataaccactgccatcataaa

SEQ ID NO: 725363 - DNA, 22 bp, Artificial Sequence
  chemically synthesized
gttataaccactgccatcataa

SEQ ID NO: 725364 - DNA, 22 bp, Artificial Sequence
  chemically synthesized
atgcatttgttataaccactgc

SEQ ID NO: 725365 - DNA, 22 bp, Artificial Sequence
  chemically synthesized
ctttatgatggcagtggttata

SEQ ID NO: 725366 - DNA, 22 bp, Artificial Sequence
  chemically synthesized
ttcatgcatttgttataaccac

SEQ ID NO: 725367 - DNA, 22 bp, Artificial Sequence
  chemically synthesized
gttcatgcatttgttataacca

SEQ ID NO: 725368 - DNA, 22 bp, Artificial Sequence
  chemically synthesized
tatgatggcagtggttataaca

SEQ ID NO: 725369 - DNA, 22 bp, Artificial Sequence
  chemically synthesized
tgttcatgcatttgttataacc

SEQ ID NO: 725370 - DNA, 22 bp, Artificial Sequence
  chemically synthesized
atgatggcagtggttataacaa

SEQ ID NO: 725371 - DNA, 22 bp, Artificial Sequence
  chemically synthesized
tgatggcagtggttataacaaa

SEQ ID NO: 725372 - DNA, 22 bp, Artificial Sequence
  chemically synthesized
ctttgttcatgcatttgttata

SEQ ID NO: 725373 - DNA, 22 bp, Artificial Sequence
  chemically synthesized
cccgttactttgttcatgcatt

SEQ ID NO: 725374 - DNA, 22 bp, Artificial Sequence
  chemically synthesized
acccgttactttgttcatgcat

SEQ ID NO: 725375 - DNA, 22 bp, Artificial Sequence
  chemically synthesized
taacaaatgcatgaacaaagta

SEQ ID NO: 725376 - DNA, 22 bp, Artificial Sequence
  chemically synthesized
tgtgtttacccgttactttgtt

SEQ ID NO: 725377 - DNA, 22 bp, Artificial Sequence
  chemically synthesized
atgtgtttacccgttactttgt

SEQ ID NO: 725378 - DNA, 22 bp, Artificial Sequence
  chemically synthesized
tatgtgtttacccgttactttg

SEQ ID NO: 725379 - DNA, 22 bp, Artificial Sequence
  chemically synthesized
ttatgtgtttacccgttacttt

SEQ ID NO: 725380 - DNA, 22 bp, Artificial Sequence
  chemically synthesized
tttatgtgtttacccgttactt

SEQ ID NO: 725381 - DNA, 22 bp, Artificial Sequence
  chemically synthesized
ttttatgtgtttacccgttact

SEQ ID NO: 725382 - DNA, 22 bp, Artificial Sequence
  chemically synthesized
ttttttatgtgtttacccgtta

SEQ ID NO: 725383 - DNA, 22 bp, Artificial Sequence
  chemically synthesized
ttcttttttatgtgtttacccg

SEQ ID NO: 725384 - DNA, 22 bp, Artificial Sequence
  chemically synthesized
cgcaaggtcaattgttcttttt

SEQ ID NO: 725385 - DNA, 22 bp, Artificial Sequence
  chemically synthesized
acgcaaggtcaattgttctttt

SEQ ID NO: 725386 - DNA, 22 bp, Artificial Sequence
  chemically synthesized
ccttacgcaaggtcaattgttc

SEQ ID NO: 725387 - DNA, 22 bp, Artificial Sequence
  chemically synthesized
tcccttacgcaaggtcaattgt

SEQ ID NO: 725388 - DNA, 22 bp, Artificial Sequence
  chemically synthesized
ctctcccttacgcaaggtcaat

SEQ ID NO: 725389 - DNA, 22 bp, Artificial Sequence
  chemically synthesized
gctctcccttacgcaaggtcaa

SEQ ID NO: 725390 - DNA, 22 bp, Artificial Sequence
  chemically synthesized
catttgctctcccttacgcaag

SEQ ID NO: 725391 - DNA, 22 bp, Artificial Sequence
  chemically synthesized
accttgcgtaagggagagcaaa

SEQ ID NO: 725392 - DNA, 22 bp, Artificial Sequence
  chemically synthesized
gcgtaagggagagcaaatgtaa

SEQ ID NO: 725393 - DNA, 22 bp, Artificial Sequence
  chemically synthesized
cgtaagggagagcaaatgtaac

SEQ ID NO: 725394 - DNA, 22 bp, Artificial Sequence
  chemically synthesized
gcacataagtcaagttacattt

SEQ ID NO: 725395 - DNA, 22 bp, Artificial Sequence
  chemically synthesized
agcacataagtcaagttacatt

SEQ ID NO: 725396 - DNA, 22 bp, Artificial Sequence
  chemically synthesized
ttagcacataagtcaagttaca

SEQ ID NO: 725397 - DNA, 22 bp, Artificial Sequence
  chemically synthesized
ttcttagcacataagtcaagtt

SEQ ID NO: 725398 - DNA, 22 bp, Artificial Sequence
  chemically synthesized
cattattcttagcacataagtc

SEQ ID NO: 725399 - DNA, 22 bp, Artificial Sequence
  chemically synthesized
gcattattcttagcacataagt

SEQ ID NO: 725400 - DNA, 22 bp, Artificial Sequence
  chemically synthesized
tgcattattcttagcacataag

SEQ ID NO: 725401 - DNA, 22 bp, Artificial Sequence
  chemically synthesized
tttgcattattcttagcacata

SEQ ID NO: 725402 - DNA, 22 bp, Artificial Sequence
  chemically synthesized
ctttgcattattcttagcacat

SEQ ID NO: 725403 - DNA, 22 bp, Artificial Sequence
  chemically synthesized
tctttgcattattcttagcaca

SEQ ID NO: 725404 - DNA, 22 bp, Artificial Sequence
  chemically synthesized
ttctttgcattattcttagcac

SEQ ID NO: 725405 - DNA, 22 bp, Artificial Sequence
  chemically synthesized
tttctttgcattattcttagca

SEQ ID NO: 725406 - DNA, 22 bp, Artificial Sequence
  chemically synthesized
tttttctttgcattattcttag

SEQ ID NO: 725407 - DNA, 22 bp, Artificial Sequence
  chemically synthesized
gacttatgtgctaagaataatg

SEQ ID NO: 725408 - DNA, 22 bp, Artificial Sequence
  chemically synthesized
acttatgtgctaagaataatgc

SEQ ID NO: 725409 - DNA, 22 bp, Artificial Sequence
  chemically synthesized
agttctttttctttgcattatt

SEQ ID NO: 725410 - DNA, 22 bp, Artificial Sequence
  chemically synthesized
atgtgctaagaataatgcaaag

SEQ ID NO: 725411 - DNA, 22 bp, Artificial Sequence
  chemically synthesized
tgtgctaagaataatgcaaaga

SEQ ID NO: 725412 - DNA, 22 bp, Artificial Sequence
  chemically synthesized
agaataatgcaaagaaaaagaa

SEQ ID NO: 725413 - DNA, 22 bp, Artificial Sequence
  chemically synthesized
cacatagtaagtgctcagttct

SEQ ID NO: 725414 - DNA, 22 bp, Artificial Sequence
  chemically synthesized
tatgtgttgcacatagtaagtg

SEQ ID NO: 725415 - DNA, 22 bp, Artificial Sequence
  chemically synthesized
agcacttactatgtgcaacaca

SEQ ID NO: 725416 - DNA, 22 bp, Artificial Sequence
  chemically synthesized
actatgtgcaacacatatagta

SEQ ID NO: 725417 - DNA, 22 bp, Artificial Sequence
  chemically synthesized
ctatgtgcaacacatatagtat

SEQ ID NO: 725418 - DNA, 22 bp, Artificial Sequence
  chemically synthesized
tgtgcaacacatatagtatgta

SEQ ID NO: 725419 - DNA, 22 bp, Artificial Sequence
  chemically synthesized
atgtacataacacagtacatac

SEQ ID NO: 725420 - DNA, 22 bp, Artificial Sequence
  chemically synthesized
tgttatgtacatgaggattata

SEQ ID NO: 725421 - DNA, 22 bp, Artificial Sequence
  chemically synthesized
aatgagatgaagcgtataatcc

SEQ ID NO: 725422 - DNA, 22 bp, Artificial Sequence
  chemically synthesized
tgtacatgaggattatacgctt

SEQ ID NO: 725423 - DNA, 22 bp, Artificial Sequence
  chemically synthesized
tagtgaggattaaatgagatga

SEQ ID NO: 725424 - DNA, 22 bp, Artificial Sequence
  chemically synthesized
tacgcttcatctcatttaatcc

SEQ ID NO: 725425 - DNA, 22 bp, Artificial Sequence
  chemically synthesized
atagggttgtagtgaggattaa

SEQ ID NO: 725426 - DNA, 22 bp, Artificial Sequence
  chemically synthesized
catagggttgtagtgaggatta

SEQ ID NO: 725427 - DNA, 22 bp, Artificial Sequence
  chemically synthesized
tcatagggttgtagtgaggatt

SEQ ID NO: 725428 - DNA, 22 bp, Artificial Sequence
  chemically synthesized
ttcatagggttgtagtgaggat

SEQ ID NO: 725429 - DNA, 22 bp, Artificial Sequence
  chemically synthesized
catctcatttaatcctcactac

SEQ ID NO: 725430 - DNA, 22 bp, Artificial Sequence
  chemically synthesized
tttcatagggttgtagtgagga

SEQ ID NO: 725431 - DNA, 22 bp, Artificial Sequence
  chemically synthesized
atctcatttaatcctcactaca

SEQ ID NO: 725432 - DNA, 22 bp, Artificial Sequence
  chemically synthesized
ttttcatagggttgtagtgagg

SEQ ID NO: 725433 - DNA, 22 bp, Artificial Sequence
  chemically synthesized
atttaatcctcactacaaccct

SEQ ID NO: 725434 - DNA, 22 bp, Artificial Sequence
  chemically synthesized
aatcctcactacaaccctatga

SEQ ID NO: 725435 - DNA, 22 bp, Artificial Sequence
  chemically synthesized
atcctcactacaaccctatgaa

SEQ ID NO: 725436 - DNA, 22 bp, Artificial Sequence
  chemically synthesized
actacaaccctatgaaaaaagc

SEQ ID NO: 725437 - DNA, 22 bp, Artificial Sequence
  chemically synthesized
caaccctatgaaaaaagcacta

SEQ ID NO: 725438 - DNA, 22 bp, Artificial Sequence
  chemically synthesized
tgaaaaaagcactactgtatta

SEQ ID NO: 725439 - DNA, 22 bp, Artificial Sequence
  chemically synthesized
atcagtagaatgaaaataatac

SEQ ID NO: 725440 - DNA, 22 bp, Artificial Sequence
  chemically synthesized
ctcatcagtagaatgaaaataa

SEQ ID NO: 725441 - DNA, 22 bp, Artificial Sequence
  chemically synthesized
cctcatcagtagaatgaaaata

SEQ ID NO: 725442 - DNA, 22 bp, Artificial Sequence
  chemically synthesized
agtttcctcatcagtagaatga

SEQ ID NO: 725443 - DNA, 22 bp, Artificial Sequence
  chemically synthesized
ctgtattattttcattctactg

SEQ ID NO: 725444 - DNA, 22 bp, Artificial Sequence
  chemically synthesized
tattattttcattctactgatg

SEQ ID NO: 725445 - DNA, 22 bp, Artificial Sequence
  chemically synthesized
tgcctcagtttcctcatcagta

SEQ ID NO: 725446 - DNA, 22 bp, Artificial Sequence
  chemically synthesized
ttttcattctactgatgaggaa

SEQ ID NO: 725447 - DNA, 22 bp, Artificial Sequence
  chemically synthesized
tcattctactgatgaggaaact

SEQ ID NO: 725448 - DNA, 22 bp, Artificial Sequence
  chemically synthesized
cattctactgatgaggaaactg

SEQ ID NO: 725449 - DNA, 22 bp, Artificial Sequence
  chemically synthesized
tgtactatgcctcagtttcctc

SEQ ID NO: 725450 - DNA, 22 bp, Artificial Sequence
  chemically synthesized
attctactgatgaggaaactga

SEQ ID NO: 725451 - DNA, 22 bp, Artificial Sequence
  chemically synthesized
tactgatgaggaaactgaggca

SEQ ID NO: 725452 - DNA, 22 bp, Artificial Sequence
  chemically synthesized
ctgatgaggaaactgaggcata

SEQ ID NO: 725453 - DNA, 22 bp, Artificial Sequence
  chemically synthesized
atgaggaaactgaggcatagta

SEQ ID NO: 725454 - DNA, 22 bp, Artificial Sequence
  chemically synthesized
aatcaagttatgtactatgcct

SEQ ID NO: 725455 - DNA, 22 bp, Artificial Sequence
  chemically synthesized
ccaacctcaatcaagttatgta

SEQ ID NO: 725456 - DNA, 22 bp, Artificial Sequence
  chemically synthesized
gccaacctcaatcaagttatgt

SEQ ID NO: 725457 - DNA, 22 bp, Artificial Sequence
  chemically synthesized
tgccaacctcaatcaagttatg

SEQ ID NO: 725458 - DNA, 22 bp, Artificial Sequence
  chemically synthesized
aggcatagtacataacttgatt

SEQ ID NO: 725459 - DNA, 22 bp, Artificial Sequence
  chemically synthesized
ctttgccaacctcaatcaagtt

SEQ ID NO: 725460 - DNA, 22 bp, Artificial Sequence
  chemically synthesized
tctgctttgccaacctcaatca

SEQ ID NO: 725461 - DNA, 22 bp, Artificial Sequence
  chemically synthesized
tgtctgctttgccaacctcaat

SEQ ID NO: 725462 - DNA, 22 bp, Artificial Sequence
  chemically synthesized
tcagattctgtctgctttgcca

SEQ ID NO: 725463 - DNA, 22 bp, Artificial Sequence
  chemically synthesized
tgtcagattctgtctgctttgc

SEQ ID NO: 725464 - DNA, 22 bp, Artificial Sequence
  chemically synthesized
gattgaggttggcaaagcagac

SEQ ID NO: 725465 - DNA, 22 bp, Artificial Sequence
  chemically synthesized
attgaggttggcaaagcagaca

SEQ ID NO: 725466 - DNA, 22 bp, Artificial Sequence
  chemically synthesized
aggttggcaaagcagacagaat

SEQ ID NO: 725467 - DNA, 22 bp, Artificial Sequence
  chemically synthesized
caattctgtcagattctgtctg

SEQ ID NO: 725468 - DNA, 22 bp, Artificial Sequence
  chemically synthesized
aattgcaattctgtcagattct

SEQ ID NO: 725469 - DNA, 22 bp, Artificial Sequence
  chemically synthesized
gcaaagcagacagaatctgaca

SEQ ID NO: 725470 - DNA, 22 bp, Artificial Sequence
  chemically synthesized
aaattgcaattctgtcagattc

SEQ ID NO: 725471 - DNA, 22 bp, Artificial Sequence
  chemically synthesized
gatttaaattgcaattctgtca

SEQ ID NO: 725472 - DNA, 22 bp, Artificial Sequence
  chemically synthesized
tagatttaaattgcaattctgt

SEQ ID NO: 725473 - DNA, 22 bp, Artificial Sequence
  chemically synthesized
agaggctctagatttaaattgc

SEQ ID NO: 725474 - DNA, 22 bp, Artificial Sequence
  chemically synthesized
acagaattgcaatttaaatcta

SEQ ID NO: 725475 - DNA, 22 bp, Artificial Sequence
  chemically synthesized
gttcagaggctctagatttaaa

SEQ ID NO: 725476 - DNA, 22 bp, Artificial Sequence
  chemically synthesized
agttcagaggctctagatttaa

SEQ ID NO: 725477 - DNA, 22 bp, Artificial Sequence
  chemically synthesized
gtggcttagttcagaggctcta

SEQ ID NO: 725478 - DNA, 22 bp, Artificial Sequence
  chemically synthesized
caatttaaatctagagcctctg

SEQ ID NO: 725479 - DNA, 22 bp, Artificial Sequence
  chemically synthesized
agtggcttagttcagaggctct

SEQ ID NO: 725480 - DNA, 22 bp, Artificial Sequence
  chemically synthesized
tagtggcttagttcagaggctc

SEQ ID NO: 725481 - DNA, 22 bp, Artificial Sequence
  chemically synthesized
aaatctagagcctctgaactaa

SEQ ID NO: 725482 - DNA, 22 bp, Artificial Sequence
  chemically synthesized
aatctagagcctctgaactaag

SEQ ID NO: 725483 - DNA, 22 bp, Artificial Sequence
  chemically synthesized
gagcctctgaactaagccacta

SEQ ID NO: 725484 - DNA, 22 bp, Artificial Sequence
  chemically synthesized
agccagtccattttagtggctt

SEQ ID NO: 725485 - DNA, 22 bp, Artificial Sequence
  chemically synthesized
tgagccagtccattttagtggc

SEQ ID NO: 725486 - DNA, 22 bp, Artificial Sequence
  chemically synthesized
tgaactaagccactaaaatgga

SEQ ID NO: 725487 - DNA, 22 bp, Artificial Sequence
  chemically synthesized
aactctgagccagtccatttta

SEQ ID NO: 725488 - DNA, 22 bp, Artificial Sequence
  chemically synthesized
aactaagccactaaaatggact

SEQ ID NO: 725489 - DNA, 22 bp, Artificial Sequence
  chemically synthesized
ttcaactctgagccagtccatt

SEQ ID NO: 725490 - DNA, 22 bp, Artificial Sequence
  chemically synthesized
attcaactctgagccagtccat

SEQ ID NO: 725491 - DNA, 22 bp, Artificial Sequence
  chemically synthesized
agccactaaaatggactggctc

SEQ ID NO: 725492 - DNA, 22 bp, Artificial Sequence
  chemically synthesized
ttattcaactctgagccagtcc

SEQ ID NO: 725493 - DNA, 22 bp, Artificial Sequence
  chemically synthesized
ttcttattcaactctgagccag

SEQ ID NO: 725494 - DNA, 22 bp, Artificial Sequence
  chemically synthesized
ctattcttattcaactctgagc

SEQ ID NO: 725495 - DNA, 22 bp, Artificial Sequence
  chemically synthesized
aaatggactggctcagagttga

SEQ ID NO: 725496 - DNA, 22 bp, Artificial Sequence
  chemically synthesized
gaaattcctattcttattcaac

SEQ ID NO: 725497 - DNA, 22 bp, Artificial Sequence
  chemically synthesized
gctcagagttgaataagaatag

SEQ ID NO: 725498 - DNA, 22 bp, Artificial Sequence
  chemically synthesized
taaacctggaaattcctattct

SEQ ID NO: 725499 - DNA, 22 bp, Artificial Sequence
  chemically synthesized
agagttgaataagaataggaat

SEQ ID NO: 725500 - DNA, 22 bp, Artificial Sequence
  chemically synthesized
ataaacctggaaattcctattc

SEQ ID NO: 725501 - DNA, 22 bp, Artificial Sequence
  chemically synthesized
aataagaataggaatttccagg

SEQ ID NO: 725502 - DNA, 22 bp, Artificial Sequence
  chemically synthesized
gaaagcccttataaacctggaa

SEQ ID NO: 725503 - DNA, 22 bp, Artificial Sequence
  chemically synthesized
tgcctggaaagcccttataaac

SEQ ID NO: 725504 - DNA, 22 bp, Artificial Sequence
  chemically synthesized
tatgcctggaaagcccttataa

SEQ ID NO: 725505 - DNA, 22 bp, Artificial Sequence
  chemically synthesized
ctatgcctggaaagcccttata

SEQ ID NO: 725506 - DNA, 22 bp, Artificial Sequence
  chemically synthesized
tctatgcctggaaagcccttat

SEQ ID NO: 725507 - DNA, 22 bp, Artificial Sequence
  chemically synthesized
tttctatgcctggaaagccctt

SEQ ID NO: 725508 - DNA, 22 bp, Artificial Sequence
  chemically synthesized
ccaggtttataagggctttcca

SEQ ID NO: 725509 - DNA, 22 bp, Artificial Sequence
  chemically synthesized
caggtttataagggctttccag

SEQ ID NO: 725510 - DNA, 22 bp, Artificial Sequence
  chemically synthesized
aaaatactctttctatgcctgg

SEQ ID NO: 725511 - DNA, 22 bp, Artificial Sequence
  chemically synthesized
ataagggctttccaggcataga

SEQ ID NO: 725512 - DNA, 22 bp, Artificial Sequence
  chemically synthesized
gaaaatactctttctatgcctg

SEQ ID NO: 725513 - DNA, 22 bp, Artificial Sequence
  chemically synthesized
taagggctttccaggcatagaa

SEQ ID NO: 725514 - DNA, 22 bp, Artificial Sequence
  chemically synthesized
tgaaaatactctttctatgcct

SEQ ID NO: 725515 - DNA, 22 bp, Artificial Sequence
  chemically synthesized
atgcctttgaaaatactctttc

SEQ ID NO: 725516 - DNA, 22 bp, Artificial Sequence
  chemically synthesized
catgcctttgaaaatactcttt

SEQ ID NO: 725517 - DNA, 22 bp, Artificial Sequence
  chemically synthesized
tccaggcatagaaagagtattt

SEQ ID NO: 725518 - DNA, 22 bp, Artificial Sequence
  chemically synthesized
ccaggcatagaaagagtatttt

SEQ ID NO: 725519 - DNA, 22 bp, Artificial Sequence
  chemically synthesized
caggcatagaaagagtattttc

SEQ ID NO: 725520 - DNA, 22 bp, Artificial Sequence
  chemically synthesized
agcttcatgcctttgaaaatac

SEQ ID NO: 725521 - DNA, 22 bp, Artificial Sequence
  chemically synthesized
tcagcttcatgcctttgaaaat

SEQ ID NO: 725522 - DNA, 22 bp, Artificial Sequence
  chemically synthesized
ctcagcttcatgcctttgaaaa

SEQ ID NO: 725523 - DNA, 22 bp, Artificial Sequence
  chemically synthesized
tctcagcttcatgcctttgaaa

SEQ ID NO: 725524 - DNA, 22 bp, Artificial Sequence
  chemically synthesized
tgtctttctcagcttcatgcct

SEQ ID NO: 725525 - DNA, 22 bp, Artificial Sequence
  chemically synthesized
gctatgtctttctcagcttcat

SEQ ID NO: 725526 - DNA, 22 bp, Artificial Sequence
  chemically synthesized
tcgctatgtctttctcagcttc

SEQ ID NO: 725527 - DNA, 22 bp, Artificial Sequence
  chemically synthesized
tcaaaggcatgaagctgagaaa

SEQ ID NO: 725528 - DNA, 22 bp, Artificial Sequence
  chemically synthesized
caaaggcatgaagctgagaaag

SEQ ID NO: 725529 - DNA, 22 bp, Artificial Sequence
  chemically synthesized
aaaggcatgaagctgagaaaga

SEQ ID NO: 725530 - DNA, 22 bp, Artificial Sequence
  chemically synthesized
gccctctcgctatgtctttctc

SEQ ID NO: 725531 - DNA, 22 bp, Artificial Sequence
  chemically synthesized
tggccctctcgctatgtctttc

SEQ ID NO: 725532 - DNA, 22 bp, Artificial Sequence
  chemically synthesized
ggcctctggccctctcgctatg

SEQ ID NO: 725533 - DNA, 22 bp, Artificial Sequence
  chemically synthesized
cggcctctggccctctcgctat

SEQ ID NO: 725534 - DNA, 22 bp, Artificial Sequence
  chemically synthesized
ttcggcctctggccctctcgct

SEQ ID NO: 725535 - DNA, 22 bp, Artificial Sequence
  chemically synthesized
agaaagacatagcgagagggcc

SEQ ID NO: 725536 - DNA, 22 bp, Artificial Sequence
  chemically synthesized
ctcttcggcctctggccctctc

SEQ ID NO: 725537 - DNA, 22 bp, Artificial Sequence
  chemically synthesized
actcttcggcctctggccctct

SEQ ID NO: 725538 - DNA, 22 bp, Artificial Sequence
  chemically synthesized
tttactcttcggcctctggccc

SEQ ID NO: 725539 - DNA, 22 bp, Artificial Sequence
  chemically synthesized
atttactcttcggcctctggcc

SEQ ID NO: 725540 - DNA, 22 bp, Artificial Sequence
  chemically synthesized
caaccttatttactcttcggcc

SEQ ID NO: 725541 - DNA, 22 bp, Artificial Sequence
  chemically synthesized
gcaaccttatttactcttcggc

SEQ ID NO: 725542 - DNA, 22 bp, Artificial Sequence
  chemically synthesized
cccccttgcaaccttatttact

SEQ ID NO: 725543 - DNA, 22 bp, Artificial Sequence
  chemically synthesized
cccaccctacccccttgcaacc

SEQ ID NO: 725544 - DNA, 22 bp, Artificial Sequence
  chemically synthesized
ctccccaccctacccccttgca

SEQ ID NO: 725545 - DNA, 22 bp, Artificial Sequence
  chemically synthesized
cctgctccccaccctaccccct

SEQ ID NO: 725546 - DNA, 22 bp, Artificial Sequence
  chemically synthesized
ctccctgctccccaccctaccc

SEQ ID NO: 725547 - DNA, 22 bp, Artificial Sequence
  chemically synthesized
cctccctgctccccaccctacc

SEQ ID NO: 725548 - DNA, 22 bp, Artificial Sequence
  chemically synthesized
tcctccctgctccccaccctac

SEQ ID NO: 725549 - DNA, 22 bp, Artificial Sequence
  chemically synthesized
ttcctccctgctccccacccta

SEQ ID NO: 725550 - DNA, 22 bp, Artificial Sequence
  chemically synthesized
tttcctccctgctccccaccct

SEQ ID NO: 725551 - DNA, 22 bp, Artificial Sequence
  chemically synthesized
caagggggtagggtggggagca

SEQ ID NO: 725552 - DNA, 22 bp, Artificial Sequence
  chemically synthesized
aaaaagaattttttcctccctg

SEQ ID NO: 725553 - DNA, 22 bp, Artificial Sequence
  chemically synthesized
caaaaagaattttttcctccct

SEQ ID NO: 725554 - DNA, 22 bp, Artificial Sequence
  chemically synthesized
tcaaaaagaattttttcctccc

SEQ ID NO: 725555 - DNA, 22 bp, Artificial Sequence
  chemically synthesized
ttcaaaaagaattttttcctcc

SEQ ID NO: 725556 - DNA, 22 bp, Artificial Sequence
  chemically synthesized
tttcaaaaagaattttttcctc

SEQ ID NO: 725557 - DNA, 22 bp, Artificial Sequence
  chemically synthesized
caacacattttttcaaaaagaa

SEQ ID NO: 725558 - DNA, 22 bp, Artificial Sequence
  chemically synthesized
atatctacaacacattttttca

SEQ ID NO: 725559 - DNA, 22 bp, Artificial Sequence
  chemically synthesized
catatctacaacacattttttc

SEQ ID NO: 725560 - DNA, 22 bp, Artificial Sequence
  chemically synthesized
tttttgaaaaaatgtgttgtag

SEQ ID NO: 725561 - DNA, 22 bp, Artificial Sequence
  chemically synthesized
tttgaaaaaatgtgttgtagat

SEQ ID NO: 725562 - DNA, 22 bp, Artificial Sequence
  chemically synthesized
ttgaaaaaatgtgttgtagata

SEQ ID NO: 725563 - DNA, 22 bp, Artificial Sequence
  chemically synthesized
tgaaaaaatgtgttgtagatat

SEQ ID NO: 725564 - DNA, 22 bp, Artificial Sequence
  chemically synthesized
gaaaaaatgtgttgtagatatg

SEQ ID NO: 725565 - DNA, 22 bp, Artificial Sequence
  chemically synthesized
aaaaaatgtgttgtagatatga

SEQ ID NO: 725566 - DNA, 22 bp, Artificial Sequence
  chemically synthesized
ggaaacatagtgagacttcata

SEQ ID NO: 725567 - DNA, 22 bp, Artificial Sequence
  chemically synthesized
tagatatgaagtctcactatgt

SEQ ID NO: 725568 - DNA, 22 bp, Artificial Sequence
  chemically synthesized
aagaccagcctgggaaacatag

SEQ ID NO: 725569 - DNA, 22 bp, Artificial Sequence
  chemically synthesized
actatgtttcccaggctggtct

SEQ ID NO: 725570 - DNA, 22 bp, Artificial Sequence
  chemically synthesized
agcccaggagttcaagaccagc

SEQ ID NO: 725571 - DNA, 22 bp, Artificial Sequence
  chemically synthesized
gagcccaggagttcaagaccag

SEQ ID NO: 725572 - DNA, 22 bp, Artificial Sequence
  chemically synthesized
tgtttcccaggctggtcttgaa

SEQ ID NO: 725573 - DNA, 22 bp, Artificial Sequence
  chemically synthesized
cttgagcccaggagttcaagac

SEQ ID NO: 725574 - DNA, 22 bp, Artificial Sequence
  chemically synthesized
cccaggctggtcttgaactcct

SEQ ID NO: 725575 - DNA, 22 bp, Artificial Sequence
  chemically synthesized
ccaggctggtcttgaactcctg

SEQ ID NO: 725576 - DNA, 22 bp, Artificial Sequence
  chemically synthesized
gtcttgaactcctgggctcaag

SEQ ID NO: 725577 - DNA, 22 bp, Artificial Sequence
  chemically synthesized
gaactcctgggctcaagcaatt

SEQ ID NO: 725578 - DNA, 22 bp, Artificial Sequence
  chemically synthesized
aactcctgggctcaagcaattc

SEQ ID NO: 725579 - DNA, 22 bp, Artificial Sequence
  chemically synthesized
agaggccaagacaggagaattg

SEQ ID NO: 725580 - DNA, 22 bp, Artificial Sequence
  chemically synthesized
ctgggctcaagcaattctcctg

SEQ ID NO: 725581 - DNA, 22 bp, Artificial Sequence
  chemically synthesized
gagaggccaagacaggagaatt

SEQ ID NO: 725582 - DNA, 22 bp, Artificial Sequence
  chemically synthesized
tgagaggccaagacaggagaat

SEQ ID NO: 725583 - DNA, 22 bp, Artificial Sequence
  chemically synthesized
ggctcaagcaattctcctgtct

SEQ ID NO: 725584 - DNA, 22 bp, Artificial Sequence
  chemically synthesized
gcactttgagaggccaagacag

SEQ ID NO: 725585 - DNA, 22 bp, Artificial Sequence
  chemically synthesized
aagcaattctcctgtcttggcc

SEQ ID NO: 725586 - DNA, 22 bp, Artificial Sequence
  chemically synthesized
taatcctagcactttgagaggc

SEQ ID NO: 725587 - DNA, 22 bp, Artificial Sequence
  chemically synthesized
tcctgtcttggcctctcaaagt

SEQ ID NO: 725588 - DNA, 22 bp, Artificial Sequence
  chemically synthesized
ctgtcttggcctctcaaagtgc

SEQ ID NO: 725589 - DNA, 22 bp, Artificial Sequence
  chemically synthesized
tgcctgtaatcctagcactttg

SEQ ID NO: 725590 - DNA, 22 bp, Artificial Sequence
  chemically synthesized
tcttggcctctcaaagtgctag

SEQ ID NO: 725591 - DNA, 22 bp, Artificial Sequence
  chemically synthesized
atgcctgtaatcctagcacttt

SEQ ID NO: 725592 - DNA, 22 bp, Artificial Sequence
  chemically synthesized
ggcctctcaaagtgctaggatt

SEQ ID NO: 725593 - DNA, 22 bp, Artificial Sequence
  chemically synthesized
gcctctcaaagtgctaggatta

SEQ ID NO: 725594 - DNA, 22 bp, Artificial Sequence
  chemically synthesized
tcaaagtgctaggattacaggc

SEQ ID NO: 725595 - DNA, 22 bp, Artificial Sequence
  chemically synthesized
aaagtgctaggattacaggcat

SEQ ID NO: 725596 - DNA, 22 bp, Artificial Sequence
  chemically synthesized
ggcacagtggcttatgcctgta

SEQ ID NO: 725597 - DNA, 22 bp, Artificial Sequence
  chemically synthesized
gctgggcacagtggcttatgcc

SEQ ID NO: 725598 - DNA, 22 bp, Artificial Sequence
  chemically synthesized
ctggctgggcacagtggcttat

SEQ ID NO: 725599 - DNA, 22 bp, Artificial Sequence
  chemically synthesized
ggattacaggcataagccactg

SEQ ID NO: 725600 - DNA, 22 bp, Artificial Sequence
  chemically synthesized
ctcctggctgggcacagtggct

SEQ ID NO: 725601 - DNA, 22 bp, Artificial Sequence
  chemically synthesized
cctcctggctgggcacagtggc

SEQ ID NO: 725602 - DNA, 22 bp, Artificial Sequence
  chemically synthesized
caggcataagccactgtgccca

SEQ ID NO: 725603 - DNA, 22 bp, Artificial Sequence
  chemically synthesized
cttcctcctggctgggcacagt

SEQ ID NO: 725604 - DNA, 22 bp, Artificial Sequence
  chemically synthesized
aattccttcctcctggctgggc

SEQ ID NO: 725605 - DNA, 22 bp, Artificial Sequence
  chemically synthesized
actgaattccttcctcctggct

SEQ ID NO: 725606 - DNA, 22 bp, Artificial Sequence
  chemically synthesized
aactgaattccttcctcctggc

SEQ ID NO: 725607 - DNA, 22 bp, Artificial Sequence
  chemically synthesized
ttaactgaattccttcctcctg

SEQ ID NO: 725608 - DNA, 22 bp, Artificial Sequence
  chemically synthesized
tgcccagccaggaggaaggaat

SEQ ID NO: 725609 - DNA, 22 bp, Artificial Sequence
  chemically synthesized
gcctcttaactgaattccttcc

SEQ ID NO: 725610 - DNA, 22 bp, Artificial Sequence
  chemically synthesized
atctagcctcttaactgaattc

SEQ ID NO: 725611 - DNA, 22 bp, Artificial Sequence
  chemically synthesized
actgatctagcctcttaactga

SEQ ID NO: 725612 - DNA, 22 bp, Artificial Sequence
  chemically synthesized
caattcactgatctagcctctt

SEQ ID NO: 725613 - DNA, 22 bp, Artificial Sequence
  chemically synthesized
agttaagaggctagatcagtga

SEQ ID NO: 725614 - DNA, 22 bp, Artificial Sequence
  chemically synthesized
agaggctagatcagtgaattgg

SEQ ID NO: 725615 - DNA, 22 bp, Artificial Sequence
  chemically synthesized
gatcagtgaattggagccacat

SEQ ID NO: 725616 - DNA, 22 bp, Artificial Sequence
  chemically synthesized
aaaaagaaaaaatatatatgat

SEQ ID NO: 725617 - DNA, 22 bp, Artificial Sequence
  chemically synthesized
taaaaaagaaaaaatatatatg

SEQ ID NO: 725618 - DNA, 22 bp, Artificial Sequence
  chemically synthesized
gagccacatcatatatattttt

SEQ ID NO: 725619 - DNA, 22 bp, Artificial Sequence
  chemically synthesized
atctctaaaaaagaaaaaatat

SEQ ID NO: 725620 - DNA, 22 bp, Artificial Sequence
  chemically synthesized
tttcttttttagagatgagatc

SEQ ID NO: 725621 - DNA, 22 bp, Artificial Sequence
  chemically synthesized
gcaacatagcaagatctcatct

SEQ ID NO: 725622 - DNA, 22 bp, Artificial Sequence
  chemically synthesized
ttcttttttagagatgagatct

SEQ ID NO: 725623 - DNA, 22 bp, Artificial Sequence
  chemically synthesized
ggcaacatagcaagatctcatc

SEQ ID NO: 725624 - DNA, 22 bp, Artificial Sequence
  chemically synthesized
tcttttttagagatgagatctt

SEQ ID NO: 725625 - DNA, 22 bp, Artificial Sequence
  chemically synthesized
cttttttagagatgagatcttg

SEQ ID NO: 725626 - DNA, 22 bp, Artificial Sequence
  chemically synthesized
ttttttagagatgagatcttgc

SEQ ID NO: 725627 - DNA, 22 bp, Artificial Sequence
  chemically synthesized
ttttagagatgagatcttgcta

SEQ ID NO: 725628 - DNA, 22 bp, Artificial Sequence
  chemically synthesized
tttagagatgagatcttgctat

SEQ ID NO: 725629 - DNA, 22 bp, Artificial Sequence
  chemically synthesized
ttagagatgagatcttgctatg

SEQ ID NO: 725630 - DNA, 22 bp, Artificial Sequence
  chemically synthesized
cagccttggcaacatagcaaga

SEQ ID NO: 725631 - DNA, 22 bp, Artificial Sequence
  chemically synthesized
tagagatgagatcttgctatgt

SEQ ID NO: 725632 - DNA, 22 bp, Artificial Sequence
  chemically synthesized
agagatgagatcttgctatgtt

SEQ ID NO: 725633 - DNA, 22 bp, Artificial Sequence
  chemically synthesized
gagatgagatcttgctatgttg

SEQ ID NO: 725634 - DNA, 22 bp, Artificial Sequence
  chemically synthesized
ccctccagccttggcaacatag

SEQ ID NO: 725635 - DNA, 22 bp, Artificial Sequence
  chemically synthesized
gctatgttgccaaggctggagg

SEQ ID NO: 725636 - DNA, 22 bp, Artificial Sequence
  chemically synthesized
ctatgttgccaaggctggaggg

SEQ ID NO: 725637 - DNA, 22 bp, Artificial Sequence
  chemically synthesized
tgaatagccactgccctccagc

SEQ ID NO: 725638 - DNA, 22 bp, Artificial Sequence
  chemically synthesized
tgttgccaaggctggagggcag

SEQ ID NO: 725639 - DNA, 22 bp, Artificial Sequence
  chemically synthesized
tacctgtgaatagccactgccc

SEQ ID NO: 725640 - DNA, 22 bp, Artificial Sequence
  chemically synthesized
ccaaggctggagggcagtggct

SEQ ID NO: 725641 - DNA, 22 bp, Artificial Sequence
  chemically synthesized
tggttgtacctgtgaatagcca

SEQ ID NO: 725642 - DNA, 22 bp, Artificial Sequence
  chemically synthesized
gagggcagtggctattcacagg

SEQ ID NO: 725643 - DNA, 22 bp, Artificial Sequence
  chemically synthesized
taggcactgtggttgtacctgt

SEQ ID NO: 725644 - DNA, 22 bp, Artificial Sequence
  chemically synthesized
aggctgtaggcactgtggttgt

SEQ ID NO: 725645 - DNA, 22 bp, Artificial Sequence
  chemically synthesized
gaggctgtaggcactgtggttg

SEQ ID NO: 725646 - DNA, 22 bp, Artificial Sequence
  chemically synthesized
ttcacaggtacaaccacagtgc

SEQ ID NO: 725647 - DNA, 22 bp, Artificial Sequence
  chemically synthesized
acaggtacaaccacagtgccta

SEQ ID NO: 725648 - DNA, 22 bp, Artificial Sequence
  chemically synthesized
aacccagaagtttgaggctgta

SEQ ID NO: 725649 - DNA, 22 bp, Artificial Sequence
  chemically synthesized
gaacccagaagtttgaggctgt

SEQ ID NO: 725650 - DNA, 22 bp, Artificial Sequence
  chemically synthesized
ttgaacccagaagtttgaggct

SEQ ID NO: 725651 - DNA, 22 bp, Artificial Sequence
  chemically synthesized
cagcctcaaacttctgggttca

SEQ ID NO: 725652 - DNA, 22 bp, Artificial Sequence
  chemically synthesized
aggtgggaggatctcttgaacc

SEQ ID NO: 725653 - DNA, 22 bp, Artificial Sequence
  chemically synthesized
aaacttctgggttcaagagatc

SEQ ID NO: 725654 - DNA, 22 bp, Artificial Sequence
  chemically synthesized
ctgggttcaagagatcctccca

SEQ ID NO: 725655 - DNA, 22 bp, Artificial Sequence
  chemically synthesized
aagaggctgaggtgggaggatc

SEQ ID NO: 725656 - DNA, 22 bp, Artificial Sequence
  chemically synthesized
tgggttcaagagatcctcccac

SEQ ID NO: 725657 - DNA, 22 bp, Artificial Sequence
  chemically synthesized
ggttcaagagatcctcccacct

SEQ ID NO: 725658 - DNA, 22 bp, Artificial Sequence
  chemically synthesized
ctgaagaggctgaggtgggagg

SEQ ID NO: 725659 - DNA, 22 bp, Artificial Sequence
  chemically synthesized
aagagatcctcccacctcagcc

SEQ ID NO: 725660 - DNA, 22 bp, Artificial Sequence
  chemically synthesized
tagtcccaactactgaagaggc

SEQ ID NO: 725661 - DNA, 22 bp, Artificial Sequence
  chemically synthesized
ccacctcagcctcttcagtagt

SEQ ID NO: 725662 - DNA, 22 bp, Artificial Sequence
  chemically synthesized
agcctcttcagtagttgggact

SEQ ID NO: 725663 - DNA, 22 bp, Artificial Sequence
  chemically synthesized
ttcagtagttgggactataggt

SEQ ID NO: 725664 - DNA, 22 bp, Artificial Sequence
  chemically synthesized
cagtagttgggactataggtgt

SEQ ID NO: 725665 - DNA, 22 bp, Artificial Sequence
  chemically synthesized
agtagttgggactataggtgta

SEQ ID NO: 725666 - DNA, 22 bp, Artificial Sequence
  chemically synthesized
cagtgaggcacagtggtataca

SEQ ID NO: 725667 - DNA, 22 bp, Artificial Sequence
  chemically synthesized
ggactataggtgtataccactg

SEQ ID NO: 725668 - DNA, 22 bp, Artificial Sequence
  chemically synthesized
agctccagtgaggcacagtggt

SEQ ID NO: 725669 - DNA, 22 bp, Artificial Sequence
  chemically synthesized
cagctccagtgaggcacagtgg

SEQ ID NO: 725670 - DNA, 22 bp, Artificial Sequence
  chemically synthesized
taggtgtataccactgtgcctc

SEQ ID NO: 725671 - DNA, 22 bp, Artificial Sequence
  chemically synthesized
cttcagctccagtgaggcacag

SEQ ID NO: 725672 - DNA, 22 bp, Artificial Sequence
  chemically synthesized
tgcctcactggagctgaaggag

SEQ ID NO: 725673 - DNA, 22 bp, Artificial Sequence
  chemically synthesized
actggagctgaaggaggatatt

SEQ ID NO: 725674 - DNA, 22 bp, Artificial Sequence
  chemically synthesized
gagctgaaggaggatatttccc

SEQ ID NO: 725675 - DNA, 22 bp, Artificial Sequence
  chemically synthesized
aaggaggatatttccctgatcc

SEQ ID NO: 725676 - DNA, 22 bp, Artificial Sequence
  chemically synthesized
ccacccacgaagggatcaggga

SEQ ID NO: 725677 - DNA, 22 bp, Artificial Sequence
  chemically synthesized
cagttcccacccacgaagggat

SEQ ID NO: 725678 - DNA, 22 bp, Artificial Sequence
  chemically synthesized
ccctccagttcccacccacgaa

SEQ ID NO: 725679 - DNA, 22 bp, Artificial Sequence
  chemically synthesized
ccctgatcccttcgtgggtggg

SEQ ID NO: 725680 - DNA, 22 bp, Artificial Sequence
  chemically synthesized
cctgatcccttcgtgggtggga

SEQ ID NO: 725681 - DNA, 22 bp, Artificial Sequence
  chemically synthesized
ctcccctccagttcccacccac

SEQ ID NO: 725682 - DNA, 22 bp, Artificial Sequence
  chemically synthesized
gctcccctccagttcccaccca

SEQ ID NO: 725683 - DNA, 22 bp, Artificial Sequence
  chemically synthesized
atcccttcgtgggtgggaactg

SEQ ID NO: 725684 - DNA, 22 bp, Artificial Sequence
  chemically synthesized
cgtgggtgggaactggagggga

SEQ ID NO: 725685 - DNA, 22 bp, Artificial Sequence
  chemically synthesized
gtgggtgggaactggaggggag

SEQ ID NO: 725686 - DNA, 22 bp, Artificial Sequence
  chemically synthesized
gaggggagcaaactccactcac

SEQ ID NO: 725687 - DNA, 22 bp, Artificial Sequence
  chemically synthesized
catgaggggtggaccagcgagt

SEQ ID NO: 725688 - DNA, 22 bp, Artificial Sequence
  chemically synthesized
ccatgaggggtggaccagcgag

SEQ ID NO: 725689 - DNA, 22 bp, Artificial Sequence
  chemically synthesized
cactcactcgctggtccacccc

SEQ ID NO: 725690 - DNA, 22 bp, Artificial Sequence
  chemically synthesized
ccccttccatgaggggtggacc

SEQ ID NO: 725691 - DNA, 22 bp, Artificial Sequence
  chemically synthesized
actcgctggtccacccctcatg

SEQ ID NO: 725692 - DNA, 22 bp, Artificial Sequence
  chemically synthesized
tgctcccccttccatgaggggt

SEQ ID NO: 725693 - DNA, 22 bp, Artificial Sequence
  chemically synthesized
gctggtccacccctcatggaag

SEQ ID NO: 725694 - DNA, 22 bp, Artificial Sequence
  chemically synthesized
acctgtgctcccccttccatga

SEQ ID NO: 725695 - DNA, 22 bp, Artificial Sequence
  chemically synthesized
gtccacccctcatggaaggggg

SEQ ID NO: 725696 - DNA, 22 bp, Artificial Sequence
  chemically synthesized
ctcacctgtgctcccccttcca

SEQ ID NO: 725697 - DNA, 22 bp, Artificial Sequence
  chemically synthesized
cacctgctcacctgtgctcccc

SEQ ID NO: 725698 - DNA, 22 bp, Artificial Sequence
  chemically synthesized
ctgcacctgctcacctgtgctc

SEQ ID NO: 725699 - DNA, 22 bp, Artificial Sequence
  chemically synthesized
atggaagggggagcacaggtga

SEQ ID NO: 725700 - DNA, 22 bp, Artificial Sequence
  chemically synthesized
gccccagctgctgcacctgctc

SEQ ID NO: 725701 - DNA, 22 bp, Artificial Sequence
  chemically synthesized
aaaaatgctggccccagctgct

SEQ ID NO: 725702 - DNA, 22 bp, Artificial Sequence
  chemically synthesized
ccagcactcaaaaatgctggcc

SEQ ID NO: 725703 - DNA, 22 bp, Artificial Sequence
  chemically synthesized
gccagcactcaaaaatgctggc

SEQ ID NO: 725704 - DNA, 22 bp, Artificial Sequence
  chemically synthesized
ttgccagcactcaaaaatgctg

SEQ ID NO: 725705 - DNA, 22 bp, Artificial Sequence
  chemically synthesized
actcttgccagcactcaaaaat

SEQ ID NO: 725706 - DNA, 22 bp, Artificial Sequence
  chemically synthesized
gggccagcatttttgagtgctg

SEQ ID NO: 725707 - DNA, 22 bp, Artificial Sequence
  chemically synthesized
ttgagtgctggcaagagtgaac

SEQ ID NO: 725708 - DNA, 22 bp, Artificial Sequence
  chemically synthesized
tgagtgctggcaagagtgaaca

SEQ ID NO: 725709 - DNA, 22 bp, Artificial Sequence
  chemically synthesized
gagtgctggcaagagtgaacac

SEQ ID NO: 725710 - DNA, 22 bp, Artificial Sequence
  chemically synthesized
agtgctggcaagagtgaacacc

SEQ ID NO: 725711 - DNA, 22 bp, Artificial Sequence
  chemically synthesized
cagggcccgtacggtgttcact

SEQ ID NO: 725712 - DNA, 22 bp, Artificial Sequence
  chemically synthesized
ctgcagggcccgtacggtgttc

SEQ ID NO: 725713 - DNA, 22 bp, Artificial Sequence
  chemically synthesized
gcaagagtgaacaccgtacggg

SEQ ID NO: 725714 - DNA, 22 bp, Artificial Sequence
  chemically synthesized
gaggctgctgcagggcccgtac

SEQ ID NO: 725715 - DNA, 22 bp, Artificial Sequence
  chemically synthesized
ccctagaggctgctgcagggcc

SEQ ID NO: 725716 - DNA, 22 bp, Artificial Sequence
  chemically synthesized
atgggcaccctcccctagaggc

SEQ ID NO: 725717 - DNA, 22 bp, Artificial Sequence
  chemically synthesized
ctcatgggcaccctcccctaga

SEQ ID NO: 725718 - DNA, 22 bp, Artificial Sequence
  chemically synthesized
cctcatgggcaccctcccctag

SEQ ID NO: 725719 - DNA, 22 bp, Artificial Sequence
  chemically synthesized
cagcagcctctaggggagggtg

SEQ ID NO: 725720 - DNA, 22 bp, Artificial Sequence
  chemically synthesized
taacacttcctcatgggcaccc

SEQ ID NO: 725721 - DNA, 22 bp, Artificial Sequence
  chemically synthesized
taggggagggtgcccatgagga

SEQ ID NO: 725722 - DNA, 22 bp, Artificial Sequence
  chemically synthesized
ggggagggtgcccatgaggaag

SEQ ID NO: 725723 - DNA, 22 bp, Artificial Sequence
  chemically synthesized
aaagggcgctgtaacacttcct

SEQ ID NO: 725724 - DNA, 22 bp, Artificial Sequence
  chemically synthesized
tgaatggcaaagctaaaagggc

SEQ ID NO: 725725 - DNA, 22 bp, Artificial Sequence
  chemically synthesized
cagcgcccttttagctttgcca

SEQ ID NO: 725726 - DNA, 22 bp, Artificial Sequence
  chemically synthesized
agccatctgtgaatggcaaagc

SEQ ID NO: 725727 - DNA, 22 bp, Artificial Sequence
  chemically synthesized
aagccatctgtgaatggcaaag

SEQ ID NO: 725728 - DNA, 22 bp, Artificial Sequence
  chemically synthesized
acacttaagccatctgtgaatg

SEQ ID NO: 725729 - DNA, 22 bp, Artificial Sequence
  chemically synthesized
ttagctttgccattcacagatg

SEQ ID NO: 725730 - DNA, 22 bp, Artificial Sequence
  chemically synthesized
tagctttgccattcacagatgg

SEQ ID NO: 725731 - DNA, 22 bp, Artificial Sequence
  chemically synthesized
ttaacacttaagccatctgtga

SEQ ID NO: 725732 - DNA, 22 bp, Artificial Sequence
  chemically synthesized
agctttgccattcacagatggc

SEQ ID NO: 725733 - DNA, 22 bp, Artificial Sequence
  chemically synthesized
gctttgccattcacagatggct

SEQ ID NO: 725734 - DNA, 22 bp, Artificial Sequence
  chemically synthesized
agctgttaacacttaagccatc

SEQ ID NO: 725735 - DNA, 22 bp, Artificial Sequence
  chemically synthesized
tgccattcacagatggcttaag

SEQ ID NO: 725736 - DNA, 22 bp, Artificial Sequence
  chemically synthesized
gccattcacagatggcttaagt

SEQ ID NO: 725737 - DNA, 22 bp, Artificial Sequence
  chemically synthesized
ccattcacagatggcttaagtg

SEQ ID NO: 725738 - DNA, 22 bp, Artificial Sequence
  chemically synthesized
cactgagctgttaacacttaag

SEQ ID NO: 725739 - DNA, 22 bp, Artificial Sequence
  chemically synthesized
acagatggcttaagtgttaaca

SEQ ID NO: 725740 - DNA, 22 bp, Artificial Sequence
  chemically synthesized
accctccactgagctgttaaca

SEQ ID NO: 725741 - DNA, 22 bp, Artificial Sequence
  chemically synthesized
tcacactgaccctccactgagc

SEQ ID NO: 725742 - DNA, 22 bp, Artificial Sequence
  chemically synthesized
aagtgttaacagctcagtggag

SEQ ID NO: 725743 - DNA, 22 bp, Artificial Sequence
  chemically synthesized
agtgttaacagctcagtggagg

SEQ ID NO: 725744 - DNA, 22 bp, Artificial Sequence
  chemically synthesized
acagctcagtggagggtcagtg

SEQ ID NO: 725745 - DNA, 22 bp, Artificial Sequence
  chemically synthesized
agtggagggtcagtgtgacagc

SEQ ID NO: 725746 - DNA, 22 bp, Artificial Sequence
  chemically synthesized
ggtgccatgcgtgtgggtgaaa

SEQ ID NO: 725747 - DNA, 22 bp, Artificial Sequence
  chemically synthesized
gggtgccatgcgtgtgggtgaa

SEQ ID NO: 725748 - DNA, 22 bp, Artificial Sequence
  chemically synthesized
tttcacccacacgcatggcacc

SEQ ID NO: 725749 - DNA, 22 bp, Artificial Sequence
  chemically synthesized
gacaagaacttgggtgccatgc

SEQ ID NO: 725750 - DNA, 22 bp, Artificial Sequence
  chemically synthesized
ttcacccacacgcatggcaccc

SEQ ID NO: 725751 - DNA, 22 bp, Artificial Sequence
  chemically synthesized
tcacccacacgcatggcaccca

SEQ ID NO: 725752 - DNA, 22 bp, Artificial Sequence
  chemically synthesized
cacccacacgcatggcacccaa

SEQ ID NO: 725753 - DNA, 22 bp, Artificial Sequence
  chemically synthesized
acccacacgcatggcacccaag

SEQ ID NO: 725754 - DNA, 22 bp, Artificial Sequence
  chemically synthesized
gatgctggacaagaacttgggt

SEQ ID NO: 725755 - DNA, 22 bp, Artificial Sequence
  chemically synthesized
ctggatgctggacaagaacttg

SEQ ID NO: 725756 - DNA, 22 bp, Artificial Sequence
  chemically synthesized
ctcctggatgctggacaagaac

SEQ ID NO: 725757 - DNA, 22 bp, Artificial Sequence
  chemically synthesized
attcctcctggatgctggacaa

SEQ ID NO: 725758 - DNA, 22 bp, Artificial Sequence
  chemically synthesized
atgtgacctcattcctcctgga

SEQ ID NO: 725759 - DNA, 22 bp, Artificial Sequence
  chemically synthesized
ttgtccagcatccaggaggaat

SEQ ID NO: 725760 - DNA, 22 bp, Artificial Sequence
  chemically synthesized
ttcatgtgacctcattcctcct

SEQ ID NO: 725761 - DNA, 22 bp, Artificial Sequence
  chemically synthesized
gtccagcatccaggaggaatga

SEQ ID NO: 725762 - DNA, 22 bp, Artificial Sequence
  chemically synthesized
gttcatgtgacctcattcctcc

SEQ ID NO: 725763 - DNA, 22 bp, Artificial Sequence
  chemically synthesized
tccagcatccaggaggaatgag

SEQ ID NO: 725764 - DNA, 22 bp, Artificial Sequence
  chemically synthesized
aatttgttcatgtgacctcatt

SEQ ID NO: 725765 - DNA, 22 bp, Artificial Sequence
  chemically synthesized
caatttgttcatgtgacctcat

SEQ ID NO: 725766 - DNA, 22 bp, Artificial Sequence
  chemically synthesized
ccatcttcaatttgttcatgtg

SEQ ID NO: 725767 - DNA, 22 bp, Artificial Sequence
  chemically synthesized
accatcttcaatttgttcatgt

SEQ ID NO: 725768 - DNA, 22 bp, Artificial Sequence
  chemically synthesized
gcaataaaatcccccatattta

SEQ ID NO: 725769 - DNA, 22 bp, Artificial Sequence
  chemically synthesized
attggcaataaaatcccccata

SEQ ID NO: 725770 - DNA, 22 bp, Artificial Sequence
  chemically synthesized
aagatggtaaatatgggggatt

SEQ ID NO: 725771 - DNA, 22 bp, Artificial Sequence
  chemically synthesized
cattggcaataaaatcccccat

SEQ ID NO: 725772 - DNA, 22 bp, Artificial Sequence
  chemically synthesized
tcattggcaataaaatccccca

SEQ ID NO: 725773 - DNA, 22 bp, Artificial Sequence
  chemically synthesized
agagccactttcattggcaata

SEQ ID NO: 725774 - DNA, 22 bp, Artificial Sequence
  chemically synthesized
ccactgagagccactttcattg

SEQ ID NO: 725775 - DNA, 22 bp, Artificial Sequence
  chemically synthesized
cccactgagagccactttcatt

SEQ ID NO: 725776 - DNA, 22 bp, Artificial Sequence
  chemically synthesized
tattgccaatgaaagtggctct

SEQ ID NO: 725777 - DNA, 22 bp, Artificial Sequence
  chemically synthesized
cccttcccactgagagccactt

SEQ ID NO: 725778 - DNA, 22 bp, Artificial Sequence
  chemically synthesized
attgccaatgaaagtggctctc

SEQ ID NO: 725779 - DNA, 22 bp, Artificial Sequence
  chemically synthesized
ttgccaatgaaagtggctctca

SEQ ID NO: 725780 - DNA, 22 bp, Artificial Sequence
  chemically synthesized
ccaatgaaagtggctctcagtg

SEQ ID NO: 725781 - DNA, 22 bp, Artificial Sequence
  chemically synthesized
agctccccttcccactgagagc

SEQ ID NO: 725782 - DNA, 22 bp, Artificial Sequence
  chemically synthesized
cagctccccttcccactgagag

SEQ ID NO: 725783 - DNA, 22 bp, Artificial Sequence
  chemically synthesized
tcagctccccttcccactgaga

SEQ ID NO: 725784 - DNA, 22 bp, Artificial Sequence
  chemically synthesized
ttcagctccccttcccactgag

SEQ ID NO: 725785 - DNA, 22 bp, Artificial Sequence
  chemically synthesized
catccccttttcagctcccctt

SEQ ID NO: 725786 - DNA, 22 bp, Artificial Sequence
  chemically synthesized
tcagtgggaaggggagctgaaa

SEQ ID NO: 725787 - DNA, 22 bp, Artificial Sequence
  chemically synthesized
agtgggaaggggagctgaaaag

SEQ ID NO: 725788 - DNA, 22 bp, Artificial Sequence
  chemically synthesized
ccactccatccccttttcagct

SEQ ID NO: 725789 - DNA, 22 bp, Artificial Sequence
  chemically synthesized
cccactccatccccttttcagc

SEQ ID NO: 725790 - DNA, 22 bp, Artificial Sequence
  chemically synthesized
ccttcccactccatcccctttt

SEQ ID NO: 725791 - DNA, 22 bp, Artificial Sequence
  chemically synthesized
aaaaggggatggagtgggaagg

SEQ ID NO: 725792 - DNA, 22 bp, Artificial Sequence
  chemically synthesized
caggggaagattaccttcccac

SEQ ID NO: 725793 - DNA, 22 bp, Artificial Sequence
  chemically synthesized
tggatggtcagactccagggga

SEQ ID NO: 725794 - DNA, 22 bp, Artificial Sequence
  chemically synthesized
cccctggagtctgaccatccac

SEQ ID NO: 725795 - DNA, 22 bp, Artificial Sequence
  chemically synthesized
ccctggagtctgaccatccaca

SEQ ID NO: 725796 - DNA, 22 bp, Artificial Sequence
  chemically synthesized
gagaggagtccagctgtggatg

SEQ ID NO: 725797 - DNA, 22 bp, Artificial Sequence
  chemically synthesized
ggagaggagtccagctgtggat

SEQ ID NO: 725798 - DNA, 22 bp, Artificial Sequence
  chemically synthesized
tggagaggagtccagctgtgga

SEQ ID NO: 725799 - DNA, 22 bp, Artificial Sequence
  chemically synthesized
gagtctgaccatccacagctgg

SEQ ID NO: 725800 - DNA, 22 bp, Artificial Sequence
  chemically synthesized
accatccacagctggactcctc

SEQ ID NO: 725801 - DNA, 22 bp, Artificial Sequence
  chemically synthesized
acagcatagctttggagaggag

SEQ ID NO: 725802 - DNA, 22 bp, Artificial Sequence
  chemically synthesized
gacagcatagctttggagagga

SEQ ID NO: 725803 - DNA, 22 bp, Artificial Sequence
  chemically synthesized
gactcctctccaaagctatgct

SEQ ID NO: 725804 - DNA, 22 bp, Artificial Sequence
  chemically synthesized
gagggacagtttgacagcatag

SEQ ID NO: 725805 - DNA, 22 bp, Artificial Sequence
  chemically synthesized
agagggacagtttgacagcata

SEQ ID NO: 725806 - DNA, 22 bp, Artificial Sequence
  chemically synthesized
ctctccaaagctatgctgtcaa

SEQ ID NO: 725807 - DNA, 22 bp, Artificial Sequence
  chemically synthesized
tagagggacagtttgacagcat

SEQ ID NO: 725808 - DNA, 22 bp, Artificial Sequence
  chemically synthesized
tccaaagctatgctgtcaaact

SEQ ID NO: 725809 - DNA, 22 bp, Artificial Sequence
  chemically synthesized
actttagagggacagtttgaca

SEQ ID NO: 725810 - DNA, 22 bp, Artificial Sequence
  chemically synthesized
caaagctatgctgtcaaactgt

SEQ ID NO: 725811 - DNA, 22 bp, Artificial Sequence
  chemically synthesized
gactttagagggacagtttgac

SEQ ID NO: 725812 - DNA, 22 bp, Artificial Sequence
  chemically synthesized
tgctgtcaaactgtccctctaa

SEQ ID NO: 725813 - DNA, 22 bp, Artificial Sequence
  chemically synthesized
tcaaactgtccctctaaagtca

SEQ ID NO: 725814 - DNA, 22 bp, Artificial Sequence
  chemically synthesized
tccctctaaagtcaagccgctt

SEQ ID NO: 725815 - DNA, 22 bp, Artificial Sequence
  chemically synthesized
gacatcaaagagaagcggcttg

SEQ ID NO: 725816 - DNA, 22 bp, Artificial Sequence
  chemically synthesized
taaagtcaagccgcttctcttt

SEQ ID NO: 725817 - DNA, 22 bp, Artificial Sequence
  chemically synthesized
cagttggacatcaaagagaagc

SEQ ID NO: 725818 - DNA, 22 bp, Artificial Sequence
  chemically synthesized
aagtcaagccgcttctctttga

SEQ ID NO: 725819 - DNA, 22 bp, Artificial Sequence
  chemically synthesized
ctctttgatgtccaactgtagt

SEQ ID NO: 725820 - DNA, 22 bp, Artificial Sequence
  chemically synthesized
tctttgatgtccaactgtagtt

SEQ ID NO: 725821 - DNA, 22 bp, Artificial Sequence
  chemically synthesized
tttgatgtccaactgtagtttc

SEQ ID NO: 725822 - DNA, 22 bp, Artificial Sequence
  chemically synthesized
tgatgtccaactgtagtttctg

SEQ ID NO: 725823 - DNA, 22 bp, Artificial Sequence
  chemically synthesized
gatgtccaactgtagtttctga

SEQ ID NO: 725824 - DNA, 22 bp, Artificial Sequence
  chemically synthesized
atgtccaactgtagtttctgac

SEQ ID NO: 725825 - DNA, 22 bp, Artificial Sequence
  chemically synthesized
tagtttctgacatccatctgct

SEQ ID NO: 725826 - DNA, 22 bp, Artificial Sequence
  chemically synthesized
gcagaaggaggagaagcagatg

SEQ ID NO: 725827 - DNA, 22 bp, Artificial Sequence
  chemically synthesized
ctgacatccatctgcttctcct

SEQ ID NO: 725828 - DNA, 22 bp, Artificial Sequence
  chemically synthesized
tgacatccatctgcttctcctc

SEQ ID NO: 725829 - DNA, 22 bp, Artificial Sequence
  chemically synthesized
agctggcagaaggaggagaagc

SEQ ID NO: 725830 - DNA, 22 bp, Artificial Sequence
  chemically synthesized
acatccatctgcttctcctcct

SEQ ID NO: 725831 - DNA, 22 bp, Artificial Sequence
  chemically synthesized
cttctcctccttctgccagctg

SEQ ID NO: 725832 - DNA, 22 bp, Artificial Sequence
  chemically synthesized
ctcctccttctgccagctgagc

SEQ ID NO: 725833 - DNA, 22 bp, Artificial Sequence
  chemically synthesized
tcctccttctgccagctgagct

SEQ ID NO: 725834 - DNA, 22 bp, Artificial Sequence
  chemically synthesized
taaaaaccccagagctcagctg

SEQ ID NO: 725835 - DNA, 22 bp, Artificial Sequence
  chemically synthesized
ctccttctgccagctgagctct

SEQ ID NO: 725836 - DNA, 22 bp, Artificial Sequence
  chemically synthesized
cttctgccagctgagctctggg

SEQ ID NO: 725837 - DNA, 22 bp, Artificial Sequence
  chemically synthesized
tgcctataaaaaccccagagct

SEQ ID NO: 725838 - DNA, 22 bp, Artificial Sequence
  chemically synthesized
ctgccagctgagctctggggtt

SEQ ID NO: 725839 - DNA, 22 bp, Artificial Sequence
  chemically synthesized
tgccagctgagctctggggttt

SEQ ID NO: 725840 - DNA, 22 bp, Artificial Sequence
  chemically synthesized
ccagctgagctctggggttttt

SEQ ID NO: 725841 - DNA, 22 bp, Artificial Sequence
  chemically synthesized
agctctggggtttttataggca

SEQ ID NO: 725842 - DNA, 22 bp, Artificial Sequence
  chemically synthesized
tggggtttttataggcacaggt

SEQ ID NO: 725843 - DNA, 22 bp, Artificial Sequence
  chemically synthesized
gggtttttataggcacaggttg

SEQ ID NO: 725844 - DNA, 22 bp, Artificial Sequence
  chemically synthesized
ccccccacccaccccccaacct

SEQ ID NO: 725845 - DNA, 22 bp, Artificial Sequence
  chemically synthesized
ttataggcacaggttggggggt

SEQ ID NO: 725846 - DNA, 22 bp, Artificial Sequence
  chemically synthesized
tataggcacaggttggggggtg

SEQ ID NO: 725847 - DNA, 22 bp, Artificial Sequence
  chemically synthesized
ataggcacaggttggggggtgg

SEQ ID NO: 725848 - DNA, 22 bp, Artificial Sequence
  chemically synthesized
taggcacaggttggggggtggg

SEQ ID NO: 725849 - DNA, 22 bp, Artificial Sequence
  chemically synthesized
caaaaccatccattacccccca

SEQ ID NO: 725850 - DNA, 22 bp, Artificial Sequence
  chemically synthesized
ccaaaaccatccattacccccc

SEQ ID NO: 725851 - DNA, 22 bp, Artificial Sequence
  chemically synthesized
tccaaaaccatccattaccccc

SEQ ID NO: 725852 - DNA, 22 bp, Artificial Sequence
  chemically synthesized
gggggtgggtggggggtaatgg

SEQ ID NO: 725853 - DNA, 22 bp, Artificial Sequence
  chemically synthesized
ttccaaaaccatccattacccc

SEQ ID NO: 725854 - DNA, 22 bp, Artificial Sequence
  chemically synthesized
aagggtgccttttccaaaacca

SEQ ID NO: 725855 - DNA, 22 bp, Artificial Sequence
  chemically synthesized
gaagggtgccttttccaaaacc

SEQ ID NO: 725856 - DNA, 22 bp, Artificial Sequence
  chemically synthesized
ttgaagggtgccttttccaaaa

SEQ ID NO: 725857 - DNA, 22 bp, Artificial Sequence
  chemically synthesized
cctcttgaagggtgccttttcc

SEQ ID NO: 725858 - DNA, 22 bp, Artificial Sequence
  chemically synthesized
ccctcttgaagggtgccttttc

SEQ ID NO: 725859 - DNA, 22 bp, Artificial Sequence
  chemically synthesized
tccctcttgaagggtgcctttt

SEQ ID NO: 725860 - DNA, 22 bp, Artificial Sequence
  chemically synthesized
ttttccctcttgaagggtgcct

SEQ ID NO: 725861 - DNA, 22 bp, Artificial Sequence
  chemically synthesized
tggaaaaggcacccttcaagag

SEQ ID NO: 725862 - DNA, 22 bp, Artificial Sequence
  chemically synthesized
ggaaaaggcacccttcaagagg

SEQ ID NO: 725863 - DNA, 22 bp, Artificial Sequence
  chemically synthesized
gaaaaggcacccttcaagaggg

SEQ ID NO: 725864 - DNA, 22 bp, Artificial Sequence
  chemically synthesized
catccctgttttccctcttgaa

SEQ ID NO: 725865 - DNA, 22 bp, Artificial Sequence
  chemically synthesized
acatccctgttttccctcttga

SEQ ID NO: 725866 - DNA, 22 bp, Artificial Sequence
  chemically synthesized
caagagggaaaacagggatgta

SEQ ID NO: 725867 - DNA, 22 bp, Artificial Sequence
  chemically synthesized
aagagggaaaacagggatgtaa

SEQ ID NO: 725868 - DNA, 22 bp, Artificial Sequence
  chemically synthesized
gaaccatggcccaaagtgagaa

SEQ ID NO: 725869 - DNA, 22 bp, Artificial Sequence
  chemically synthesized
tcactttgggccatggttccag

SEQ ID NO: 725870 - DNA, 22 bp, Artificial Sequence
  chemically synthesized
aagccaaaaagcctggaaccat

SEQ ID NO: 725871 - DNA, 22 bp, Artificial Sequence
  chemically synthesized
actttgggccatggttccaggc

SEQ ID NO: 725872 - DNA, 22 bp, Artificial Sequence
  chemically synthesized
tgggccatggttccaggctttt

SEQ ID NO: 725873 - DNA, 22 bp, Artificial Sequence
  chemically synthesized
gggccatggttccaggcttttt

SEQ ID NO: 725874 - DNA, 22 bp, Artificial Sequence
  chemically synthesized
ggccatggttccaggctttttg

SEQ ID NO: 725875 - DNA, 22 bp, Artificial Sequence
  chemically synthesized
aggacccaccctcaagccaaaa

SEQ ID NO: 725876 - DNA, 22 bp, Artificial Sequence
  chemically synthesized
caggctttttggcttgagggtg

SEQ ID NO: 725877 - DNA, 22 bp, Artificial Sequence
  chemically synthesized
tttggcttgagggtgggtcctc

SEQ ID NO: 725878 - DNA, 22 bp, Artificial Sequence
  chemically synthesized
ttggcttgagggtgggtcctca

SEQ ID NO: 725879 - DNA, 22 bp, Artificial Sequence
  chemically synthesized
tggcttgagggtgggtcctcaa

SEQ ID NO: 725880 - DNA, 22 bp, Artificial Sequence
  chemically synthesized
ggcttgagggtgggtcctcaat

SEQ ID NO: 725881 - DNA, 22 bp, Artificial Sequence
  chemically synthesized
gcttgagggtgggtcctcaatg

SEQ ID NO: 725882 - DNA, 22 bp, Artificial Sequence
  chemically synthesized
gagggtgggtcctcaatgggga

SEQ ID NO: 725883 - DNA, 22 bp, Artificial Sequence
  chemically synthesized
agggtgggtcctcaatggggac

SEQ ID NO: 725884 - DNA, 22 bp, Artificial Sequence
  chemically synthesized
ggcagaagagggcaggtcccca

SEQ ID NO: 725885 - DNA, 22 bp, Artificial Sequence
  chemically synthesized
tgggcagaagagggcaggtccc

SEQ ID NO: 725886 - DNA, 22 bp, Artificial Sequence
  chemically synthesized
aatggggacctgccctcttctg

SEQ ID NO: 725887 - DNA, 22 bp, Artificial Sequence
  chemically synthesized
ccctcttctgcccagaatttcc

SEQ ID NO: 725888 - DNA, 22 bp, Artificial Sequence
  chemically synthesized
ttctgcccagaatttccctgcc

SEQ ID NO: 725889 - DNA, 22 bp, Artificial Sequence
  chemically synthesized
ataaaggacagaaggcagggaa

SEQ ID NO: 725890 - DNA, 22 bp, Artificial Sequence
  chemically synthesized
ctgcccagaatttccctgcctt

SEQ ID NO: 725891 - DNA, 22 bp, Artificial Sequence
  chemically synthesized
gataaaggacagaaggcaggga

SEQ ID NO: 725892 - DNA, 22 bp, Artificial Sequence
  chemically synthesized
tgcccagaatttccctgccttc

SEQ ID NO: 725893 - DNA, 22 bp, Artificial Sequence
  chemically synthesized
tgataaaggacagaaggcaggg

SEQ ID NO: 725894 - DNA, 22 bp, Artificial Sequence
  chemically synthesized
cccagaatttccctgccttctg

SEQ ID NO: 725895 - DNA, 22 bp, Artificial Sequence
  chemically synthesized
ccctgccttctgtcctttatca

SEQ ID NO: 725896 - DNA, 22 bp, Artificial Sequence
  chemically synthesized
cctgccttctgtcctttatcaa

SEQ ID NO: 725897 - DNA, 22 bp, Artificial Sequence
  chemically synthesized
tcaagatgtggctttgataaag

SEQ ID NO: 725898 - DNA, 22 bp, Artificial Sequence
  chemically synthesized
ccttctgtcctttatcaaagcc

SEQ ID NO: 725899 - DNA, 22 bp, Artificial Sequence
  chemically synthesized
ctgtcctttatcaaagccacat

SEQ ID NO: 725900 - DNA, 22 bp, Artificial Sequence
  chemically synthesized
tgtcctttatcaaagccacatc

SEQ ID NO: 725901 - DNA, 22 bp, Artificial Sequence
  chemically synthesized
tcctttatcaaagccacatctt

SEQ ID NO: 725902 - DNA, 22 bp, Artificial Sequence
  chemically synthesized
tatcaaagccacatcttgacag

SEQ ID NO: 725903 - DNA, 22 bp, Artificial Sequence
  chemically synthesized
atcaaagccacatcttgacagg

SEQ ID NO: 725904 - DNA, 22 bp, Artificial Sequence
  chemically synthesized
tcaaagccacatcttgacaggc

SEQ ID NO: 725905 - DNA, 22 bp, Artificial Sequence
  chemically synthesized
caggtcagtatccatagcctgt

SEQ ID NO: 725906 - DNA, 22 bp, Artificial Sequence
  chemically synthesized
cctccaggtcagtatccatagc

SEQ ID NO: 725907 - DNA, 22 bp, Artificial Sequence
  chemically synthesized
tccctccaggtcagtatccata

SEQ ID NO: 725908 - DNA, 22 bp, Artificial Sequence
  chemically synthesized
tctccctccaggtcagtatcca

SEQ ID NO: 725909 - DNA, 22 bp, Artificial Sequence
  chemically synthesized
ctctccctccaggtcagtatcc

SEQ ID NO: 725910 - DNA, 22 bp, Artificial Sequence
  chemically synthesized
tctctccctccaggtcagtatc

SEQ ID NO: 725911 - DNA, 22 bp, Artificial Sequence
  chemically synthesized
gacaggctatggatactgacct

SEQ ID NO: 725912 - DNA, 22 bp, Artificial Sequence
  chemically synthesized
acaggctatggatactgacctg

SEQ ID NO: 725913 - DNA, 22 bp, Artificial Sequence
  chemically synthesized
cagctttctctccctccaggtc

SEQ ID NO: 725914 - DNA, 22 bp, Artificial Sequence
  chemically synthesized
tggatactgacctggagggaga

SEQ ID NO: 725915 - DNA, 22 bp, Artificial Sequence
  chemically synthesized
tagctacagctttctctccctc

SEQ ID NO: 725916 - DNA, 22 bp, Artificial Sequence
  chemically synthesized
tatagctacagctttctctccc

SEQ ID NO: 725917 - DNA, 22 bp, Artificial Sequence
  chemically synthesized
ctatagctacagctttctctcc

SEQ ID NO: 725918 - DNA, 22 bp, Artificial Sequence
  chemically synthesized
acctggagggagagaaagctgt

SEQ ID NO: 725919 - DNA, 22 bp, Artificial Sequence
  chemically synthesized
gagggagagaaagctgtagcta

SEQ ID NO: 725920 - DNA, 22 bp, Artificial Sequence
  chemically synthesized
aaaaaatcttctatagctacag

SEQ ID NO: 725921 - DNA, 22 bp, Artificial Sequence
  chemically synthesized
tattaaaaaaatcttctatagc

SEQ ID NO: 725922 - DNA, 22 bp, Artificial Sequence
  chemically synthesized
tagctatagaagatttttttaa

SEQ ID NO: 725923 - DNA, 22 bp, Artificial Sequence
  chemically synthesized
gtaccccattatattaaaaaaa

SEQ ID NO: 725924 - DNA, 22 bp, Artificial Sequence
  chemically synthesized
tagaagatttttttaatataat

SEQ ID NO: 725925 - DNA, 22 bp, Artificial Sequence
  chemically synthesized
atcctagtaccccattatatta

SEQ ID NO: 725926 - DNA, 22 bp, Artificial Sequence
  chemically synthesized
ttttaatataatggggtactag

SEQ ID NO: 725927 - DNA, 22 bp, Artificial Sequence
  chemically synthesized
tttaatataatggggtactagg

SEQ ID NO: 725928 - DNA, 22 bp, Artificial Sequence
  chemically synthesized
ttaatataatggggtactagga

SEQ ID NO: 725929 - DNA, 22 bp, Artificial Sequence
  chemically synthesized
taatataatggggtactaggat

SEQ ID NO: 725930 - DNA, 22 bp, Artificial Sequence
  chemically synthesized
aatataatggggtactaggatt

SEQ ID NO: 725931 - DNA, 22 bp, Artificial Sequence
  chemically synthesized
aacaacagatctaatcctagta

SEQ ID NO: 725932 - DNA, 22 bp, Artificial Sequence
  chemically synthesized
atataatggggtactaggatta

SEQ ID NO: 725933 - DNA, 22 bp, Artificial Sequence
  chemically synthesized
ctaaacaacagatctaatccta

SEQ ID NO: 725934 - DNA, 22 bp, Artificial Sequence
  chemically synthesized
gctaaacaacagatctaatcct

SEQ ID NO: 725935 - DNA, 22 bp, Artificial Sequence
  chemically synthesized
tcttgctaaacaacagatctaa

SEQ ID NO: 725936 - DNA, 22 bp, Artificial Sequence
  chemically synthesized
gttatcttgctaaacaacagat

SEQ ID NO: 725937 - DNA, 22 bp, Artificial Sequence
  chemically synthesized
ggattagatctgttgtttagca

SEQ ID NO: 725938 - DNA, 22 bp, Artificial Sequence
  chemically synthesized
tggctagttatcttgctaaaca

SEQ ID NO: 725939 - DNA, 22 bp, Artificial Sequence
  chemically synthesized
gatctgttgtttagcaagataa

SEQ ID NO: 725940 - DNA, 22 bp, Artificial Sequence
  chemically synthesized
tcactatggctagttatcttgc

SEQ ID NO: 725941 - DNA, 22 bp, Artificial Sequence
  chemically synthesized
atcactatggctagttatcttg

SEQ ID NO: 725942 - DNA, 22 bp, Artificial Sequence
  chemically synthesized
tatcactatggctagttatctt

SEQ ID NO: 725943 - DNA, 22 bp, Artificial Sequence
  chemically synthesized
ttgtttagcaagataactagcc

SEQ ID NO: 725944 - DNA, 22 bp, Artificial Sequence
  chemically synthesized
tttagcaagataactagccata

SEQ ID NO: 725945 - DNA, 22 bp, Artificial Sequence
  chemically synthesized
tccatctttatcactatggcta

SEQ ID NO: 725946 - DNA, 22 bp, Artificial Sequence
  chemically synthesized
agcaagataactagccatagtg

SEQ ID NO: 725947 - DNA, 22 bp, Artificial Sequence
  chemically synthesized
atccatctttatcactatggct

SEQ ID NO: 725948 - DNA, 22 bp, Artificial Sequence
  chemically synthesized
gcaagataactagccatagtga

SEQ ID NO: 725949 - DNA, 22 bp, Artificial Sequence
  chemically synthesized
tatccatctttatcactatggc

SEQ ID NO: 725950 - DNA, 22 bp, Artificial Sequence
  chemically synthesized
ttatccatctttatcactatgg

SEQ ID NO: 725951 - DNA, 22 bp, Artificial Sequence
  chemically synthesized
gccatagtgataaagatggata

SEQ ID NO: 725952 - DNA, 22 bp, Artificial Sequence
  chemically synthesized
tccccagacttttatccatctt

SEQ ID NO: 725953 - DNA, 22 bp, Artificial Sequence
  chemically synthesized
cctgtccccagacttttatcca

SEQ ID NO: 725954 - DNA, 22 bp, Artificial Sequence
  chemically synthesized
gcctccctgtccccagactttt

SEQ ID NO: 725955 - DNA, 22 bp, Artificial Sequence
  chemically synthesized
atgattagcctccctgtcccca

SEQ ID NO: 725956 - DNA, 22 bp, Artificial Sequence
  chemically synthesized
taatgattagcctccctgtccc

SEQ ID NO: 725957 - DNA, 22 bp, Artificial Sequence
  chemically synthesized
ctaatgattagcctccctgtcc

SEQ ID NO: 725958 - DNA, 22 bp, Artificial Sequence
  chemically synthesized
gccttctaatgattagcctccc

SEQ ID NO: 725959 - DNA, 22 bp, Artificial Sequence
  chemically synthesized
ggccttctaatgattagcctcc

SEQ ID NO: 725960 - DNA, 22 bp, Artificial Sequence
  chemically synthesized
gggacagggaggctaatcatta

SEQ ID NO: 725961 - DNA, 22 bp, Artificial Sequence
  chemically synthesized
atgatttggccttctaatgatt

SEQ ID NO: 725962 - DNA, 22 bp, Artificial Sequence
  chemically synthesized
ttaatgatttggccttctaatg

SEQ ID NO: 725963 - DNA, 22 bp, Artificial Sequence
  chemically synthesized
agtgactattaatgatttggcc

SEQ ID NO: 725964 - DNA, 22 bp, Artificial Sequence
  chemically synthesized
atcattagaaggccaaatcatt

SEQ ID NO: 725965 - DNA, 22 bp, Artificial Sequence
  chemically synthesized
tcagtgactattaatgatttgg

SEQ ID NO: 725966 - DNA, 22 bp, Artificial Sequence
  chemically synthesized
ctcagtgactattaatgatttg

SEQ ID NO: 725967 - DNA, 22 bp, Artificial Sequence
  chemically synthesized
tctcagtgactattaatgattt

SEQ ID NO: 725968 - DNA, 22 bp, Artificial Sequence
  chemically synthesized
gaaggccaaatcattaatagtc

SEQ ID NO: 725969 - DNA, 22 bp, Artificial Sequence
  chemically synthesized
agtcctttctcagtgactatta

SEQ ID NO: 725970 - DNA, 22 bp, Artificial Sequence
  chemically synthesized
cctcagtcctttctcagtgact

SEQ ID NO: 725971 - DNA, 22 bp, Artificial Sequence
  chemically synthesized
ccctcagtcctttctcagtgac

SEQ ID NO: 725972 - DNA, 22 bp, Artificial Sequence
  chemically synthesized
cccttccctcagtcctttctca

SEQ ID NO: 725973 - DNA, 22 bp, Artificial Sequence
  chemically synthesized
tgcccttccctcagtcctttct

SEQ ID NO: 725974 - DNA, 22 bp, Artificial Sequence
  chemically synthesized
atagtcactgagaaaggactga

SEQ ID NO: 725975 - DNA, 22 bp, Artificial Sequence
  chemically synthesized
ctctgcccttccctcagtcctt

SEQ ID NO: 725976 - DNA, 22 bp, Artificial Sequence
  chemically synthesized
actactctgcccttccctcagt

SEQ ID NO: 725977 - DNA, 22 bp, Artificial Sequence
  chemically synthesized
taactactctgcccttccctca

SEQ ID NO: 725978 - DNA, 22 bp, Artificial Sequence
  chemically synthesized
tctaactactctgcccttccct

SEQ ID NO: 725979 - DNA, 22 bp, Artificial Sequence
  chemically synthesized
agaaaggactgagggaagggca

SEQ ID NO: 725980 - DNA, 22 bp, Artificial Sequence
  chemically synthesized
ctctctaactactctgcccttc

SEQ ID NO: 725981 - DNA, 22 bp, Artificial Sequence
  chemically synthesized
ttcctctctaactactctgccc

SEQ ID NO: 725982 - DNA, 22 bp, Artificial Sequence
  chemically synthesized
agggaagggcagagtagttaga

SEQ ID NO: 725983 - DNA, 22 bp, Artificial Sequence
  chemically synthesized
aaatccagctattcctctctaa

SEQ ID NO: 725984 - DNA, 22 bp, Artificial Sequence
  chemically synthesized
gagaggaatagctggatttgag

SEQ ID NO: 725985 - DNA, 22 bp, Artificial Sequence
  chemically synthesized
aaaataaaaacactcaaatcca

SEQ ID NO: 725986 - DNA, 22 bp, Artificial Sequence
  chemically synthesized
tatctaaaaataaaaacactca

SEQ ID NO: 725987 - DNA, 22 bp, Artificial Sequence
  chemically synthesized
atatctaaaaataaaaacactc

SEQ ID NO: 725988 - DNA, 22 bp, Artificial Sequence
  chemically synthesized
ttatatctaaaaataaaaacac

SEQ ID NO: 725989 - DNA, 22 bp, Artificial Sequence
  chemically synthesized
actcttatatctaaaaataaaa

SEQ ID NO: 725990 - DNA, 22 bp, Artificial Sequence
  chemically synthesized
gatttgagtgtttttattttta

SEQ ID NO: 725991 - DNA, 22 bp, Artificial Sequence
  chemically synthesized
ctgactcttatatctaaaaata

SEQ ID NO: 725992 - DNA, 22 bp, Artificial Sequence
  chemically synthesized
gctgactcttatatctaaaaat

SEQ ID NO: 725993 - DNA, 22 bp, Artificial Sequence
  chemically synthesized
gagtgtttttatttttagatat

SEQ ID NO: 725994 - DNA, 22 bp, Artificial Sequence
  chemically synthesized
agtgtttttatttttagatata

SEQ ID NO: 725995 - DNA, 22 bp, Artificial Sequence
  chemically synthesized
tttgctgactcttatatctaaa

SEQ ID NO: 725996 - DNA, 22 bp, Artificial Sequence
  chemically synthesized
tgtttgctgactcttatatcta

SEQ ID NO: 725997 - DNA, 22 bp, Artificial Sequence
  chemically synthesized
ttatttttagatataagagtca

SEQ ID NO: 725998 - DNA, 22 bp, Artificial Sequence
  chemically synthesized
aattctgtttgctgactcttat

SEQ ID NO: 725999 - DNA, 22 bp, Artificial Sequence
  chemically synthesized
tatttttagatataagagtcag

SEQ ID NO: 726000 - DNA, 22 bp, Artificial Sequence
  chemically synthesized
atttttagatataagagtcagc

SEQ ID NO: 726001 - DNA, 22 bp, Artificial Sequence
  chemically synthesized
tttttagatataagagtcagca

SEQ ID NO: 726002 - DNA, 22 bp, Artificial Sequence
  chemically synthesized
ttagatataagagtcagcaaac

SEQ ID NO: 726003 - DNA, 22 bp, Artificial Sequence
  chemically synthesized
tagatataagagtcagcaaaca

SEQ ID NO: 726004 - DNA, 22 bp, Artificial Sequence
  chemically synthesized
gtcactaaattctgtttgctga

SEQ ID NO: 726005 - DNA, 22 bp, Artificial Sequence
  chemically synthesized
agatataagagtcagcaaacag

SEQ ID NO: 726006 - DNA, 22 bp, Artificial Sequence
  chemically synthesized
ggtcactaaattctgtttgctg

SEQ ID NO: 726007 - DNA, 22 bp, Artificial Sequence
  chemically synthesized
gatataagagtcagcaaacaga

SEQ ID NO: 726008 - DNA, 22 bp, Artificial Sequence
  chemically synthesized
tttggtcactaaattctgtttg

SEQ ID NO: 726009 - DNA, 22 bp, Artificial Sequence
  chemically synthesized
atttggtcactaaattctgttt

SEQ ID NO: 726010 - DNA, 22 bp, Artificial Sequence
  chemically synthesized
tatttggtcactaaattctgtt

SEQ ID NO: 726011 - DNA, 22 bp, Artificial Sequence
  chemically synthesized
ttatttggtcactaaattctgt

SEQ ID NO: 726012 - DNA, 22 bp, Artificial Sequence
  chemically synthesized
agtttttatttggtcactaaat

SEQ ID NO: 726013 - DNA, 22 bp, Artificial Sequence
  chemically synthesized
cagtttttatttggtcactaaa

SEQ ID NO: 726014 - DNA, 22 bp, Artificial Sequence
  chemically synthesized
tcttcagtttttatttggtcac

SEQ ID NO: 726015 - DNA, 22 bp, Artificial Sequence
  chemically synthesized
ttatcttcagtttttatttggt

SEQ ID NO: 726016 - DNA, 22 bp, Artificial Sequence
  chemically synthesized
tattatcttcagtttttatttg

SEQ ID NO: 726017 - DNA, 22 bp, Artificial Sequence
  chemically synthesized
tctattatcttcagtttttatt

SEQ ID NO: 726018 - DNA, 22 bp, Artificial Sequence
  chemically synthesized
ctctctattatcttcagttttt

SEQ ID NO: 726019 - DNA, 22 bp, Artificial Sequence
  chemically synthesized
agtgaccaaataaaaactgaag

SEQ ID NO: 726020 - DNA, 22 bp, Artificial Sequence
  chemically synthesized
cctctctattatcttcagtttt

SEQ ID NO: 726021 - DNA, 22 bp, Artificial Sequence
  chemically synthesized
gtgaccaaataaaaactgaaga

SEQ ID NO: 726022 - DNA, 22 bp, Artificial Sequence
  chemically synthesized
ttcctctctattatcttcagtt

SEQ ID NO: 726023 - DNA, 22 bp, Artificial Sequence
  chemically synthesized
cttcctctctattatcttcagt

SEQ ID NO: 726024 - DNA, 22 bp, Artificial Sequence
  chemically synthesized
cttcttcctctctattatcttc

SEQ ID NO: 726025 - DNA, 22 bp, Artificial Sequence
  chemically synthesized
acttcttcctctctattatctt

SEQ ID NO: 726026 - DNA, 22 bp, Artificial Sequence
  chemically synthesized
gggccacatttacttcttcctc

SEQ ID NO: 726027 - DNA, 22 bp, Artificial Sequence
  chemically synthesized
aagataatagagaggaagaagt

SEQ ID NO: 726028 - DNA, 22 bp, Artificial Sequence
  chemically synthesized
ggggccacatttacttcttcct

SEQ ID NO: 726029 - DNA, 22 bp, Artificial Sequence
  chemically synthesized
gaaaatttggggccacatttac

SEQ ID NO: 726030 - DNA, 22 bp, Artificial Sequence
  chemically synthesized
agaaaatttggggccacattta

SEQ ID NO: 726031 - DNA, 22 bp, Artificial Sequence
  chemically synthesized
caatttagaaaatttggggcca

SEQ ID NO: 726032 - DNA, 22 bp, Artificial Sequence
  chemically synthesized
atgatgtcattgcaatttagaa

SEQ ID NO: 726033 - DNA, 22 bp, Artificial Sequence
  chemically synthesized
ttaatgatgtcattgcaattta

SEQ ID NO: 726034 - DNA, 22 bp, Artificial Sequence
  chemically synthesized
attaatgatgtcattgcaattt

SEQ ID NO: 726035 - DNA, 22 bp, Artificial Sequence
  chemically synthesized
tattaatgatgtcattgcaatt

SEQ ID NO: 726036 - DNA, 22 bp, Artificial Sequence
  chemically synthesized
tttattaatgatgtcattgcaa

SEQ ID NO: 726037 - DNA, 22 bp, Artificial Sequence
  chemically synthesized
ctttattaatgatgtcattgca

SEQ ID NO: 726038 - DNA, 22 bp, Artificial Sequence
  chemically synthesized
tctttattaatgatgtcattgc

SEQ ID NO: 726039 - DNA, 22 bp, Artificial Sequence
  chemically synthesized
ctttctttattaatgatgtcat

SEQ ID NO: 726040 - DNA, 22 bp, Artificial Sequence
  chemically synthesized
tctaaattgcaatgacatcatt

SEQ ID NO: 726041 - DNA, 22 bp, Artificial Sequence
  chemically synthesized
actttctttattaatgatgtca

SEQ ID NO: 726042 - DNA, 22 bp, Artificial Sequence
  chemically synthesized
ctaaattgcaatgacatcatta

SEQ ID NO: 726043 - DNA, 22 bp, Artificial Sequence
  chemically synthesized
taaattgcaatgacatcattaa

SEQ ID NO: 726044 - DNA, 22 bp, Artificial Sequence
  chemically synthesized
aattgcaatgacatcattaata

SEQ ID NO: 726045 - DNA, 22 bp, Artificial Sequence
  chemically synthesized
catttactttctttattaatga

SEQ ID NO: 726046 - DNA, 22 bp, Artificial Sequence
  chemically synthesized
gcatttactttctttattaatg

SEQ ID NO: 726047 - DNA, 22 bp, Artificial Sequence
  chemically synthesized
caatgacatcattaataaagaa

SEQ ID NO: 726048 - DNA, 22 bp, Artificial Sequence
  chemically synthesized
caccttgcatttactttcttta

SEQ ID NO: 726049 - DNA, 22 bp, Artificial Sequence
  chemically synthesized
gcaccttgcatttactttcttt

SEQ ID NO: 726050 - DNA, 22 bp, Artificial Sequence
  chemically synthesized
tgcaccttgcatttactttctt

SEQ ID NO: 726051 - DNA, 22 bp, Artificial Sequence
  chemically synthesized
ttttgcaccttgcatttacttt

SEQ ID NO: 726052 - DNA, 22 bp, Artificial Sequence
  chemically synthesized
ataaagaaagtaaatgcaaggt

SEQ ID NO: 726053 - DNA, 22 bp, Artificial Sequence
  chemically synthesized
cataccatatcacaatcaaacc

SEQ ID NO: 726054 - DNA, 22 bp, Artificial Sequence
  chemically synthesized
ctacataccatatcacaatcaa

SEQ ID NO: 726055 - DNA, 22 bp, Artificial Sequence
  chemically synthesized
cctacataccatatcacaatca

SEQ ID NO: 726056 - DNA, 22 bp, Artificial Sequence
  chemically synthesized
tgtttcctacataccatatcac

SEQ ID NO: 726057 - DNA, 22 bp, Artificial Sequence
  chemically synthesized
gattgtgatatggtatgtagga

SEQ ID NO: 726058 - DNA, 22 bp, Artificial Sequence
  chemically synthesized
attgtgatatggtatgtaggaa

SEQ ID NO: 726059 - DNA, 22 bp, Artificial Sequence
  chemically synthesized
tgatatggtatgtaggaaacac

SEQ ID NO: 726060 - DNA, 22 bp, Artificial Sequence
  chemically synthesized
cagatatggcccaaccaatgga

SEQ ID NO: 726061 - DNA, 22 bp, Artificial Sequence
  chemically synthesized
atgataatattccagatatggc

SEQ ID NO: 726062 - DNA, 22 bp, Artificial Sequence
  chemically synthesized
ccattggttgggccatatctgg

SEQ ID NO: 726063 - DNA, 22 bp, Artificial Sequence
  chemically synthesized
cattggttgggccatatctgga

SEQ ID NO: 726064 - DNA, 22 bp, Artificial Sequence
  chemically synthesized
gttgggccatatctggaatatt

SEQ ID NO: 726065 - DNA, 22 bp, Artificial Sequence
  chemically synthesized
tccagaactgatgataatattc

SEQ ID NO: 726066 - DNA, 22 bp, Artificial Sequence
  chemically synthesized
ggccatatctggaatattatca

SEQ ID NO: 726067 - DNA, 22 bp, Artificial Sequence
  chemically synthesized
aatataagctatccagaactga

SEQ ID NO: 726068 - DNA, 22 bp, Artificial Sequence
  chemically synthesized
gaatattatcatcagttctgga

SEQ ID NO: 726069 - DNA, 22 bp, Artificial Sequence
  chemically synthesized
caatataagctatccagaactg

SEQ ID NO: 726070 - DNA, 22 bp, Artificial Sequence
  chemically synthesized
tcaatataagctatccagaact

SEQ ID NO: 726071 - DNA, 22 bp, Artificial Sequence
  chemically synthesized
acactttcaatataagctatcc

SEQ ID NO: 726072 - DNA, 22 bp, Artificial Sequence
  chemically synthesized
tcatcagttctggatagcttat

SEQ ID NO: 726073 - DNA, 22 bp, Artificial Sequence
  chemically synthesized
cacactttcaatataagctatc

SEQ ID NO: 726074 - DNA, 22 bp, Artificial Sequence
  chemically synthesized
tcacactttcaatataagctat

SEQ ID NO: 726075 - DNA, 22 bp, Artificial Sequence
  chemically synthesized
ctttcacactttcaatataagc

SEQ ID NO: 726076 - DNA, 22 bp, Artificial Sequence
  chemically synthesized
cctttcacactttcaatataag

SEQ ID NO: 726077 - DNA, 22 bp, Artificial Sequence
  chemically synthesized
tcctttcacactttcaatataa

SEQ ID NO: 726078 - DNA, 22 bp, Artificial Sequence
  chemically synthesized
ttttcctttcacactttcaata

SEQ ID NO: 726079 - DNA, 22 bp, Artificial Sequence
  chemically synthesized
tggatagcttatattgaaagtg

SEQ ID NO: 726080 - DNA, 22 bp, Artificial Sequence
  chemically synthesized
attttcctttcacactttcaat

SEQ ID NO: 726081 - DNA, 22 bp, Artificial Sequence
  chemically synthesized
gatagcttatattgaaagtgtg

SEQ ID NO: 726082 - DNA, 22 bp, Artificial Sequence
  chemically synthesized
atattgaaagtgtgaaaggaaa

SEQ ID NO: 726083 - DNA, 22 bp, Artificial Sequence
  chemically synthesized
tattgaaagtgtgaaaggaaaa

SEQ ID NO: 726084 - DNA, 22 bp, Artificial Sequence
  chemically synthesized
aggccccaagatttattttcct

SEQ ID NO: 726085 - DNA, 22 bp, Artificial Sequence
  chemically synthesized
gaggccccaagatttattttcc

SEQ ID NO: 726086 - DNA, 22 bp, Artificial Sequence
  chemically synthesized
aaagtgtgaaaggaaaataaat

SEQ ID NO: 726087 - DNA, 22 bp, Artificial Sequence
  chemically synthesized
tgaggccccaagatttattttc

SEQ ID NO: 726088 - DNA, 22 bp, Artificial Sequence
  chemically synthesized
gtgattttgaggccccaagatt

SEQ ID NO: 726089 - DNA, 22 bp, Artificial Sequence
  chemically synthesized
ggtgattttgaggccccaagat

SEQ ID NO: 726090 - DNA, 22 bp, Artificial Sequence
  chemically synthesized
gtttggtgattttgaggcccca

SEQ ID NO: 726091 - DNA, 22 bp, Artificial Sequence
  chemically synthesized
agtttggtgattttgaggcccc

SEQ ID NO: 726092 - DNA, 22 bp, Artificial Sequence
  chemically synthesized
tagtttggtgattttgaggccc

SEQ ID NO: 726093 - DNA, 22 bp, Artificial Sequence
  chemically synthesized
cctttagtttggtgattttgag

SEQ ID NO: 726094 - DNA, 22 bp, Artificial Sequence
  chemically synthesized
ccctttagtttggtgattttga

SEQ ID NO: 726095 - DNA, 22 bp, Artificial Sequence
  chemically synthesized
tccctttagtttggtgattttg

SEQ ID NO: 726096 - DNA, 22 bp, Artificial Sequence
  chemically synthesized
ttccctttagtttggtgatttt

SEQ ID NO: 726097 - DNA, 22 bp, Artificial Sequence
  chemically synthesized
ggggcctcaaaatcaccaaact

SEQ ID NO: 726098 - DNA, 22 bp, Artificial Sequence
  chemically synthesized
acttttccctttagtttggtga

SEQ ID NO: 726099 - DNA, 22 bp, Artificial Sequence
  chemically synthesized
gggcctcaaaatcaccaaacta

SEQ ID NO: 726100 - DNA, 22 bp, Artificial Sequence
  chemically synthesized
gacttttccctttagtttggtg

SEQ ID NO: 726101 - DNA, 22 bp, Artificial Sequence
  chemically synthesized
aaaatcaccaaactaaagggaa

SEQ ID NO: 726102 - DNA, 22 bp, Artificial Sequence
  chemically synthesized
ccagcttgacttttccctttag

SEQ ID NO: 726103 - DNA, 22 bp, Artificial Sequence
  chemically synthesized
agcagttcccagcttgactttt

SEQ ID NO: 726104 - DNA, 22 bp, Artificial Sequence
  chemically synthesized
ccctaagcagttcccagcttga

SEQ ID NO: 726105 - DNA, 22 bp, Artificial Sequence
  chemically synthesized
gccctaagcagttcccagcttg

SEQ ID NO: 726106 - DNA, 22 bp, Artificial Sequence
  chemically synthesized
aagggaaaagtcaagctgggaa

SEQ ID NO: 726107 - DNA, 22 bp, Artificial Sequence
  chemically synthesized
ggaactgcttagggcaaacctg

SEQ ID NO: 726108 - DNA, 22 bp, Artificial Sequence
  chemically synthesized
aatagaatgggagacaggtttg

SEQ ID NO: 726109 - DNA, 22 bp, Artificial Sequence
  chemically synthesized
gaatagaatgggagacaggttt

SEQ ID NO: 726110 - DNA, 22 bp, Artificial Sequence
  chemically synthesized
tgaatagaatgggagacaggtt

SEQ ID NO: 726111 - DNA, 22 bp, Artificial Sequence
  chemically synthesized
cttagggcaaacctgtctccca

SEQ ID NO: 726112 - DNA, 22 bp, Artificial Sequence
  chemically synthesized
agggcaaacctgtctcccattc

SEQ ID NO: 726113 - DNA, 22 bp, Artificial Sequence
  chemically synthesized
gggcaaacctgtctcccattct

SEQ ID NO: 726114 - DNA, 22 bp, Artificial Sequence
  chemically synthesized
tctcccattctattcaaagtca

SEQ ID NO: 726115 - DNA, 22 bp, Artificial Sequence
  chemically synthesized
agtgagcagagggatgactttg

SEQ ID NO: 726116 - DNA, 22 bp, Artificial Sequence
  chemically synthesized
ccattctattcaaagtcatccc

SEQ ID NO: 726117 - DNA, 22 bp, Artificial Sequence
  chemically synthesized
tctcagtgagcagagggatgac

SEQ ID NO: 726118 - DNA, 22 bp, Artificial Sequence
  chemically synthesized
tattcaaagtcatccctctgct

SEQ ID NO: 726119 - DNA, 22 bp, Artificial Sequence
  chemically synthesized
ttcaaagtcatccctctgctca

SEQ ID NO: 726120 - DNA, 22 bp, Artificial Sequence
  chemically synthesized
aaagtcatccctctgctcactg

SEQ ID NO: 726121 - DNA, 22 bp, Artificial Sequence
  chemically synthesized
tgctcactgagatagatgctta

SEQ ID NO: 726122 - DNA, 22 bp, Artificial Sequence
  chemically synthesized
ctcactgagatagatgcttatc

SEQ ID NO: 726123 - DNA, 22 bp, Artificial Sequence
  chemically synthesized
actgagatagatgcttatctga

SEQ ID NO: 726124 - DNA, 22 bp, Artificial Sequence
  chemically synthesized
caaaggaggcaatcagataagc

SEQ ID NO: 726125 - DNA, 22 bp, Artificial Sequence
  chemically synthesized
ccaaaggaggcaatcagataag

SEQ ID NO: 726126 - DNA, 22 bp, Artificial Sequence
  chemically synthesized
tccaaaggaggcaatcagataa

SEQ ID NO: 726127 - DNA, 22 bp, Artificial Sequence
  chemically synthesized
agatagatgcttatctgattgc

SEQ ID NO: 726128 - DNA, 22 bp, Artificial Sequence
  chemically synthesized
gcctttccaaaggaggcaatca

SEQ ID NO: 726129 - DNA, 22 bp, Artificial Sequence
  chemically synthesized
attcgcctttccaaaggaggca

SEQ ID NO: 726130 - DNA, 22 bp, Artificial Sequence
  chemically synthesized
atctgattgcctcctttggaaa

SEQ ID NO: 726131 - DNA, 22 bp, Artificial Sequence
  chemically synthesized
tctgattgcctcctttggaaag

SEQ ID NO: 726132 - DNA, 22 bp, Artificial Sequence
  chemically synthesized
agtatctgattcgcctttccaa

SEQ ID NO: 726133 - DNA, 22 bp, Artificial Sequence
  chemically synthesized
gagtatctgattcgcctttcca

SEQ ID NO: 726134 - DNA, 22 bp, Artificial Sequence
  chemically synthesized
attgcctcctttggaaaggcga

SEQ ID NO: 726135 - DNA, 22 bp, Artificial Sequence
  chemically synthesized
tgagtatctgattcgcctttcc

SEQ ID NO: 726136 - DNA, 22 bp, Artificial Sequence
  chemically synthesized
ttgagtatctgattcgcctttc

SEQ ID NO: 726137 - DNA, 22 bp, Artificial Sequence
  chemically synthesized
ttttgagtatctgattcgcctt

SEQ ID NO: 726138 - DNA, 22 bp, Artificial Sequence
  chemically synthesized
cctcctttggaaaggcgaatca

SEQ ID NO: 726139 - DNA, 22 bp, Artificial Sequence
  chemically synthesized
ctttggaaaggcgaatcagata

SEQ ID NO: 726140 - DNA, 22 bp, Artificial Sequence
  chemically synthesized
cattcttttgagtatctgattc

SEQ ID NO: 726141 - DNA, 22 bp, Artificial Sequence
  chemically synthesized
tggaaaggcgaatcagatactc

SEQ ID NO: 726142 - DNA, 22 bp, Artificial Sequence
  chemically synthesized
ggaaaggcgaatcagatactca

SEQ ID NO: 726143 - DNA, 22 bp, Artificial Sequence
  chemically synthesized
gaaaggcgaatcagatactcaa

SEQ ID NO: 726144 - DNA, 22 bp, Artificial Sequence
  chemically synthesized
aaaagaatgcaaccatttatct

SEQ ID NO: 726145 - DNA, 22 bp, Artificial Sequence
  chemically synthesized
caggtcacaggtaggtgagaga

SEQ ID NO: 726146 - DNA, 22 bp, Artificial Sequence
  chemically synthesized
ccaggtcacaggtaggtgagag

SEQ ID NO: 726147 - DNA, 22 bp, Artificial Sequence
  chemically synthesized
atctctcacctacctgtgacct

SEQ ID NO: 726148 - DNA, 22 bp, Artificial Sequence
  chemically synthesized
tctctcacctacctgtgacctg

SEQ ID NO: 726149 - DNA, 22 bp, Artificial Sequence
  chemically synthesized
tcacctacctgtgacctggaag

SEQ ID NO: 726150 - DNA, 22 bp, Artificial Sequence
  chemically synthesized
aagcaaggaggggcttccaggt

SEQ ID NO: 726151 - DNA, 22 bp, Artificial Sequence
  chemically synthesized
acctacctgtgacctggaagcc

SEQ ID NO: 726152 - DNA, 22 bp, Artificial Sequence
  chemically synthesized
gaagcaaggaggggcttccagg

SEQ ID NO: 726153 - DNA, 22 bp, Artificial Sequence
  chemically synthesized
cctgtgacctggaagcccctcc

SEQ ID NO: 726154 - DNA, 22 bp, Artificial Sequence
  chemically synthesized
tgacctggaagcccctccttgc

SEQ ID NO: 726155 - DNA, 22 bp, Artificial Sequence
  chemically synthesized
gaagcccctccttgcttcaagt

SEQ ID NO: 726156 - DNA, 22 bp, Artificial Sequence
  chemically synthesized
catccagaagggtgggacaact

SEQ ID NO: 726157 - DNA, 22 bp, Artificial Sequence
  chemically synthesized
cttgcttcaagttgtcccaccc

SEQ ID NO: 726158 - DNA, 22 bp, Artificial Sequence
  chemically synthesized
ttccatccagaagggtgggaca

SEQ ID NO: 726159 - DNA, 22 bp, Artificial Sequence
  chemically synthesized
gttccatccagaagggtgggac

SEQ ID NO: 726160 - DNA, 22 bp, Artificial Sequence
  chemically synthesized
gcttcaagttgtcccacccttc

SEQ ID NO: 726161 - DNA, 22 bp, Artificial Sequence
  chemically synthesized
cttcaagttgtcccacccttct

SEQ ID NO: 726162 - DNA, 22 bp, Artificial Sequence
  chemically synthesized
caagttgtcccacccttctgga

SEQ ID NO: 726163 - DNA, 22 bp, Artificial Sequence
  chemically synthesized
aagttgtcccacccttctggat

SEQ ID NO: 726164 - DNA, 22 bp, Artificial Sequence
  chemically synthesized
tcccacccttctggatggaaca

SEQ ID NO: 726165 - DNA, 22 bp, Artificial Sequence
  chemically synthesized
ctggatggaacaaatgtacatc

SEQ ID NO: 726166 - DNA, 22 bp, Artificial Sequence
  chemically synthesized
tggatggaacaaatgtacatct

SEQ ID NO: 726167 - DNA, 22 bp, Artificial Sequence
  chemically synthesized
gatggaacaaatgtacatctta

SEQ ID NO: 726168 - DNA, 22 bp, Artificial Sequence
  chemically synthesized
gggagacatgagacatcaacca

SEQ ID NO: 726169 - DNA, 22 bp, Artificial Sequence
  chemically synthesized
agggagacatgagacatcaacc

SEQ ID NO: 726170 - DNA, 22 bp, Artificial Sequence
  chemically synthesized
acatatattggttgatgtctca

SEQ ID NO: 726171 - DNA, 22 bp, Artificial Sequence
  chemically synthesized
catatattggttgatgtctcat

SEQ ID NO: 726172 - DNA, 22 bp, Artificial Sequence
  chemically synthesized
tatatatttagggagacatgag

SEQ ID NO: 726173 - DNA, 22 bp, Artificial Sequence
  chemically synthesized
atatatatttagggagacatga

SEQ ID NO: 726174 - DNA, 22 bp, Artificial Sequence
  chemically synthesized
tatatatatttagggagacatg

SEQ ID NO: 726175 - DNA, 22 bp, Artificial Sequence
  chemically synthesized
gttgatgtctcatgtctcccta

SEQ ID NO: 726176 - DNA, 22 bp, Artificial Sequence
  chemically synthesized
gttttatatatatttagggaga

SEQ ID NO: 726177 - DNA, 22 bp, Artificial Sequence
  chemically synthesized
ggttttatatatatttagggag

SEQ ID NO: 726178 - DNA, 22 bp, Artificial Sequence
  chemically synthesized
atgtctcatgtctccctaaata

SEQ ID NO: 726179 - DNA, 22 bp, Artificial Sequence
  chemically synthesized
atgtctccctaaatatatataa

SEQ ID NO: 726180 - DNA, 22 bp, Artificial Sequence
  chemically synthesized
gggcacagcttggttttatata

SEQ ID NO: 726181 - DNA, 22 bp, Artificial Sequence
  chemically synthesized
ggggcacagcttggttttatat

SEQ ID NO: 726182 - DNA, 22 bp, Artificial Sequence
  chemically synthesized
cctaaatatatataaaaccaag

SEQ ID NO: 726183 - DNA, 22 bp, Artificial Sequence
  chemically synthesized
aatatatataaaaccaagctgt

SEQ ID NO: 726184 - DNA, 22 bp, Artificial Sequence
  chemically synthesized
acgacatgtgcccaaggtgttt

SEQ ID NO: 726185 - DNA, 22 bp, Artificial Sequence
  chemically synthesized
taacgacatgtgcccaaggtgt

SEQ ID NO: 726186 - DNA, 22 bp, Artificial Sequence
  chemically synthesized
tgccccaaacaccttgggcaca

SEQ ID NO: 726187 - DNA, 22 bp, Artificial Sequence
  chemically synthesized
aggaggttctaacgacatgtgc

SEQ ID NO: 726188 - DNA, 22 bp, Artificial Sequence
  chemically synthesized
gggcacatgtcgttagaacctc

SEQ ID NO: 726189 - DNA, 22 bp, Artificial Sequence
  chemically synthesized
ggcacatgtcgttagaacctcc

SEQ ID NO: 726190 - DNA, 22 bp, Artificial Sequence
  chemically synthesized
gaacctcctgaggctgtttcat

SEQ ID NO: 726191 - DNA, 22 bp, Artificial Sequence
  chemically synthesized
agaatatgcacccatgaaacag

SEQ ID NO: 726192 - DNA, 22 bp, Artificial Sequence
  chemically synthesized
ctgaggctgtttcatgggtgca

SEQ ID NO: 726193 - DNA, 22 bp, Artificial Sequence
  chemically synthesized
aggctgtttcatgggtgcatat

SEQ ID NO: 726194 - DNA, 22 bp, Artificial Sequence
  chemically synthesized
ccaaggttgagaatatgcaccc

SEQ ID NO: 726195 - DNA, 22 bp, Artificial Sequence
  chemically synthesized
gccaaggttgagaatatgcacc

SEQ ID NO: 726196 - DNA, 22 bp, Artificial Sequence
  chemically synthesized
tgccaaggttgagaatatgcac

SEQ ID NO: 726197 - DNA, 22 bp, Artificial Sequence
  chemically synthesized
ttttgccaaggttgagaatatg

SEQ ID NO: 726198 - DNA, 22 bp, Artificial Sequence
  chemically synthesized
tttcatgggtgcatattctcaa

SEQ ID NO: 726199 - DNA, 22 bp, Artificial Sequence
  chemically synthesized
attttgccaaggttgagaatat

SEQ ID NO: 726200 - DNA, 22 bp, Artificial Sequence
  chemically synthesized
catgggtgcatattctcaacct

SEQ ID NO: 726201 - DNA, 22 bp, Artificial Sequence
  chemically synthesized
atgggtgcatattctcaacctt

SEQ ID NO: 726202 - DNA, 22 bp, Artificial Sequence
  chemically synthesized
ggaagtttattttgccaaggtt

SEQ ID NO: 726203 - DNA, 22 bp, Artificial Sequence
  chemically synthesized
aggaagtttattttgccaaggt

SEQ ID NO: 726204 - DNA, 22 bp, Artificial Sequence
  chemically synthesized
atttaggaagtttattttgcca

SEQ ID NO: 726205 - DNA, 22 bp, Artificial Sequence
  chemically synthesized
tcaaccttggcaaaataaactt

SEQ ID NO: 726206 - DNA, 22 bp, Artificial Sequence
  chemically synthesized
agttaatttaggaagtttattt

SEQ ID NO: 726207 - DNA, 22 bp, Artificial Sequence
  chemically synthesized
aaccttggcaaaataaacttcc

SEQ ID NO: 726208 - DNA, 22 bp, Artificial Sequence
  chemically synthesized
gtctcagttaatttaggaagtt

SEQ ID NO: 726209 - DNA, 22 bp, Artificial Sequence
  chemically synthesized
ggcaaaataaacttcctaaatt

SEQ ID NO: 726210 - DNA, 22 bp, Artificial Sequence
  chemically synthesized
gcaaaataaacttcctaaatta

SEQ ID NO: 726211 - DNA, 22 bp, Artificial Sequence
  chemically synthesized
agactggtctcagttaatttag

SEQ ID NO: 726212 - DNA, 22 bp, Artificial Sequence
  chemically synthesized
aaatatctgagactggtctcag

SEQ ID NO: 726213 - DNA, 22 bp, Artificial Sequence
  chemically synthesized
caaatatctgagactggtctca

SEQ ID NO: 726214 - DNA, 22 bp, Artificial Sequence
  chemically synthesized
cctaaattaactgagaccagtc

SEQ ID NO: 726215 - DNA, 22 bp, Artificial Sequence
  chemically synthesized
ctaaattaactgagaccagtct

SEQ ID NO: 726216 - DNA, 22 bp, Artificial Sequence
  chemically synthesized
aattaactgagaccagtctcag

SEQ ID NO: 726217 - DNA, 22 bp, Artificial Sequence
  chemically synthesized
tgaacttcaaatatctgagact

SEQ ID NO: 726218 - DNA, 22 bp, Artificial Sequence
  chemically synthesized
gtgaacttcaaatatctgagac

SEQ ID NO: 726219 - DNA, 22 bp, Artificial Sequence
  chemically synthesized
tgtgaacttcaaatatctgaga

SEQ ID NO: 726220 - DNA, 22 bp, Artificial Sequence
  chemically synthesized
actgagaccagtctcagatatt

SEQ ID NO: 726221 - DNA, 22 bp, Artificial Sequence
  chemically synthesized
ttgtgaacttcaaatatctgag

SEQ ID NO: 726222 - DNA, 22 bp, Artificial Sequence
  chemically synthesized
agaccagtctcagatatttgaa

SEQ ID NO: 726223 - DNA, 22 bp, Artificial Sequence
  chemically synthesized
acagtggtcccttttgtgaact

SEQ ID NO: 726224 - DNA, 22 bp, Artificial Sequence
  chemically synthesized
agatatttgaagttcacaaaag

SEQ ID NO: 726225 - DNA, 22 bp, Artificial Sequence
  chemically synthesized
caagaattaacagtggtccctt

SEQ ID NO: 726226 - DNA, 22 bp, Artificial Sequence
  chemically synthesized
gaagttcacaaaagggaccact

SEQ ID NO: 726227 - DNA, 22 bp, Artificial Sequence
  chemically synthesized
aagttcacaaaagggaccactg

SEQ ID NO: 726228 - DNA, 22 bp, Artificial Sequence
  chemically synthesized
tgcaagaattaacagtggtccc

SEQ ID NO: 726229 - DNA, 22 bp, Artificial Sequence
  chemically synthesized
ctctgcaagaattaacagtggt

SEQ ID NO: 726230 - DNA, 22 bp, Artificial Sequence
  chemically synthesized
cctctgcaagaattaacagtgg

SEQ ID NO: 726231 - DNA, 22 bp, Artificial Sequence
  chemically synthesized
acaaaagggaccactgttaatt

SEQ ID NO: 726232 - DNA, 22 bp, Artificial Sequence
  chemically synthesized
tcttcctctgcaagaattaaca

SEQ ID NO: 726233 - DNA, 22 bp, Artificial Sequence
  chemically synthesized
atcttcctctgcaagaattaac

SEQ ID NO: 726234 - DNA, 22 bp, Artificial Sequence
  chemically synthesized
tatcttcctctgcaagaattaa

SEQ ID NO: 726235 - DNA, 22 bp, Artificial Sequence
  chemically synthesized
gtctttatcttcctctgcaaga

SEQ ID NO: 726236 - DNA, 22 bp, Artificial Sequence
  chemically synthesized
cgtctttatcttcctctgcaag

SEQ ID NO: 726237 - DNA, 22 bp, Artificial Sequence
  chemically synthesized
atcttcgtctttatcttcctct

SEQ ID NO: 726238 - DNA, 22 bp, Artificial Sequence
  chemically synthesized
ttaattcttgcagaggaagata

SEQ ID NO: 726239 - DNA, 22 bp, Artificial Sequence
  chemically synthesized
catcttcgtctttatcttcctc

SEQ ID NO: 726240 - DNA, 22 bp, Artificial Sequence
  chemically synthesized
tcatcttcgtctttatcttcct

SEQ ID NO: 726241 - DNA, 22 bp, Artificial Sequence
  chemically synthesized
attcttgcagaggaagataaag

SEQ ID NO: 726242 - DNA, 22 bp, Artificial Sequence
  chemically synthesized
ttgcagaggaagataaagacga

SEQ ID NO: 726243 - DNA, 22 bp, Artificial Sequence
  chemically synthesized
gcagaggaagataaagacgaag

SEQ ID NO: 726244 - DNA, 22 bp, Artificial Sequence
  chemically synthesized
cagaggaagataaagacgaaga

SEQ ID NO: 726245 - DNA, 22 bp, Artificial Sequence
  chemically synthesized
agtcaagactttcatcttcgtc

SEQ ID NO: 726246 - DNA, 22 bp, Artificial Sequence
  chemically synthesized
ccctcagtcaagactttcatct

SEQ ID NO: 726247 - DNA, 22 bp, Artificial Sequence
  chemically synthesized
ataattaccctcagtcaagact

SEQ ID NO: 726248 - DNA, 22 bp, Artificial Sequence
  chemically synthesized
ctcataattaccctcagtcaag

SEQ ID NO: 726249 - DNA, 22 bp, Artificial Sequence
  chemically synthesized
ttcctcataattaccctcagtc

SEQ ID NO: 726250 - DNA, 22 bp, Artificial Sequence
  chemically synthesized
ttgttcctcataattaccctca

SEQ ID NO: 726251 - DNA, 22 bp, Artificial Sequence
  chemically synthesized
tgttgttcctcataattaccct

SEQ ID NO: 726252 - DNA, 22 bp, Artificial Sequence
  chemically synthesized
cctctgttgttcctcataatta

SEQ ID NO: 726253 - DNA, 22 bp, Artificial Sequence
  chemically synthesized
gactgagggtaattatgaggaa

SEQ ID NO: 726254 - DNA, 22 bp, Artificial Sequence
  chemically synthesized
actgagggtaattatgaggaac

SEQ ID NO: 726255 - DNA, 22 bp, Artificial Sequence
  chemically synthesized
gttccctctgttgttcctcata

SEQ ID NO: 726256 - DNA, 22 bp, Artificial Sequence
  chemically synthesized
cgttccctctgttgttcctcat

SEQ ID NO: 726257 - DNA, 22 bp, Artificial Sequence
  chemically synthesized
tcgttccctctgttgttcctca

SEQ ID NO: 726258 - DNA, 22 bp, Artificial Sequence
  chemically synthesized
ttcgttccctctgttgttcctc

SEQ ID NO: 726259 - DNA, 22 bp, Artificial Sequence
  chemically synthesized
agggtaattatgaggaacaaca

SEQ ID NO: 726260 - DNA, 22 bp, Artificial Sequence
  chemically synthesized
tttcgttccctctgttgttcct

SEQ ID NO: 726261 - DNA, 22 bp, Artificial Sequence
  chemically synthesized
ttttcgttccctctgttgttcc

SEQ ID NO: 726262 - DNA, 22 bp, Artificial Sequence
  chemically synthesized
atttttttcgttccctctgttg

SEQ ID NO: 726263 - DNA, 22 bp, Artificial Sequence
  chemically synthesized
tgaggaacaacagagggaacga

SEQ ID NO: 726264 - DNA, 22 bp, Artificial Sequence
  chemically synthesized
tattgatttttttcgttccctc

SEQ ID NO: 726265 - DNA, 22 bp, Artificial Sequence
  chemically synthesized
aattatattgatttttttcgtt

SEQ ID NO: 726266 - DNA, 22 bp, Artificial Sequence
  chemically synthesized
taaaagtattcaattatattga

SEQ ID NO: 726267 - DNA, 22 bp, Artificial Sequence
  chemically synthesized
gtaaaagtattcaattatattg

SEQ ID NO: 726268 - DNA, 22 bp, Artificial Sequence
  chemically synthesized
tgtaaaagtattcaattatatt

SEQ ID NO: 726269 - DNA, 22 bp, Artificial Sequence
  chemically synthesized
ttgtaaaagtattcaattatat

SEQ ID NO: 726270 - DNA, 22 bp, Artificial Sequence
  chemically synthesized
cttttgtaaaagtattcaatta

SEQ ID NO: 726271 - DNA, 22 bp, Artificial Sequence
  chemically synthesized
aataactgcttttgtaaaagta

SEQ ID NO: 726272 - DNA, 22 bp, Artificial Sequence
  chemically synthesized
taaataactgcttttgtaaaag

SEQ ID NO: 726273 - DNA, 22 bp, Artificial Sequence
  chemically synthesized
aatacttttacaaaagcagtta

SEQ ID NO: 726274 - DNA, 22 bp, Artificial Sequence
  chemically synthesized
agggtatacactctaaataact

SEQ ID NO: 726275 - DNA, 22 bp, Artificial Sequence
  chemically synthesized
ttacaaaagcagttatttagag

SEQ ID NO: 726276 - DNA, 22 bp, Artificial Sequence
  chemically synthesized
tacaaaagcagttatttagagt

SEQ ID NO: 726277 - DNA, 22 bp, Artificial Sequence
  chemically synthesized
acaaaagcagttatttagagtg

SEQ ID NO: 726278 - DNA, 22 bp, Artificial Sequence
  chemically synthesized
caaaagcagttatttagagtgt

SEQ ID NO: 726279 - DNA, 22 bp, Artificial Sequence
  chemically synthesized
agttcagggtatacactctaaa

SEQ ID NO: 726280 - DNA, 22 bp, Artificial Sequence
  chemically synthesized
gagttcagggtatacactctaa

SEQ ID NO: 726281 - DNA, 22 bp, Artificial Sequence
  chemically synthesized
tttagagtgtataccctgaact

SEQ ID NO: 726282 - DNA, 22 bp, Artificial Sequence
  chemically synthesized
tgtaacagaacttgagttcagg

SEQ ID NO: 726283 - DNA, 22 bp, Artificial Sequence
  chemically synthesized
agagtgtataccctgaactcaa

SEQ ID NO: 726284 - DNA, 22 bp, Artificial Sequence
  chemically synthesized
gagtgtataccctgaactcaag

SEQ ID NO: 726285 - DNA, 22 bp, Artificial Sequence
  chemically synthesized
tatatcccactgtgtaacagaa

SEQ ID NO: 726286 - DNA, 22 bp, Artificial Sequence
  chemically synthesized
ttatatatcccactgtgtaaca

SEQ ID NO: 726287 - DNA, 22 bp, Artificial Sequence
  chemically synthesized
aactcaagttctgttacacagt

SEQ ID NO: 726288 - DNA, 22 bp, Artificial Sequence
  chemically synthesized
aagttctgttacacagtgggat

SEQ ID NO: 726289 - DNA, 22 bp, Artificial Sequence
  chemically synthesized
atcactgttatatatcccactg

SEQ ID NO: 726290 - DNA, 22 bp, Artificial Sequence
  chemically synthesized
catcactgttatatatcccact

SEQ ID NO: 726291 - DNA, 22 bp, Artificial Sequence
  chemically synthesized
tcatcactgttatatatcccac

SEQ ID NO: 726292 - DNA, 22 bp, Artificial Sequence
  chemically synthesized
tttcatcactgttatatatccc

SEQ ID NO: 726293 - DNA, 22 bp, Artificial Sequence
  chemically synthesized
tgttacacagtgggatatataa

SEQ ID NO: 726294 - DNA, 22 bp, Artificial Sequence
  chemically synthesized
ttacacagtgggatatataaca

SEQ ID NO: 726295 - DNA, 22 bp, Artificial Sequence
  chemically synthesized
gctctttcatcactgttatata

SEQ ID NO: 726296 - DNA, 22 bp, Artificial Sequence
  chemically synthesized
ggctctttcatcactgttatat

SEQ ID NO: 726297 - DNA, 22 bp, Artificial Sequence
  chemically synthesized
cacagtgggatatataacagtg

SEQ ID NO: 726298 - DNA, 22 bp, Artificial Sequence
  chemically synthesized
agaaaagcttggctctttcatc

SEQ ID NO: 726299 - DNA, 22 bp, Artificial Sequence
  chemically synthesized
agtcgaaaagctaagaaaagct

SEQ ID NO: 726300 - DNA, 22 bp, Artificial Sequence
  chemically synthesized
ctaagtcgaaaagctaagaaaa

SEQ ID NO: 726301 - DNA, 22 bp, Artificial Sequence
  chemically synthesized
tcctgctaagtcgaaaagctaa

SEQ ID NO: 726302 - DNA, 22 bp, Artificial Sequence
  chemically synthesized
attgtcctgctaagtcgaaaag

SEQ ID NO: 726303 - DNA, 22 bp, Artificial Sequence
  chemically synthesized
cattgtcctgctaagtcgaaaa

SEQ ID NO: 726304 - DNA, 22 bp, Artificial Sequence
  chemically synthesized
tcattgtcctgctaagtcgaaa

SEQ ID NO: 726305 - DNA, 22 bp, Artificial Sequence
  chemically synthesized
ttcttagcttttcgacttagca

SEQ ID NO: 726306 - DNA, 22 bp, Artificial Sequence
  chemically synthesized
ttttcattgtcctgctaagtcg

SEQ ID NO: 726307 - DNA, 22 bp, Artificial Sequence
  chemically synthesized
tcttagcttttcgacttagcag

SEQ ID NO: 726308 - DNA, 22 bp, Artificial Sequence
  chemically synthesized
cttagcttttcgacttagcagg

SEQ ID NO: 726309 - DNA, 22 bp, Artificial Sequence
  chemically synthesized
ttagcttttcgacttagcagga

SEQ ID NO: 726310 - DNA, 22 bp, Artificial Sequence
  chemically synthesized
attgttttcattgtcctgctaa

SEQ ID NO: 726311 - DNA, 22 bp, Artificial Sequence
  chemically synthesized
agcttttcgacttagcaggaca

SEQ ID NO: 726312 - DNA, 22 bp, Artificial Sequence
  chemically synthesized
gattgttttcattgtcctgcta

SEQ ID NO: 726313 - DNA, 22 bp, Artificial Sequence
  chemically synthesized
gcttttcgacttagcaggacaa

SEQ ID NO: 726314 - DNA, 22 bp, Artificial Sequence
  chemically synthesized
tgattgttttcattgtcctgct

SEQ ID NO: 726315 - DNA, 22 bp, Artificial Sequence
  chemically synthesized
ttgattgttttcattgtcctgc

SEQ ID NO: 726316 - DNA, 22 bp, Artificial Sequence
  chemically synthesized
ttcgacttagcaggacaatgaa

SEQ ID NO: 726317 - DNA, 22 bp, Artificial Sequence
  chemically synthesized
tcgacttagcaggacaatgaaa

SEQ ID NO: 726318 - DNA, 22 bp, Artificial Sequence
  chemically synthesized
cgacttagcaggacaatgaaaa

SEQ ID NO: 726319 - DNA, 22 bp, Artificial Sequence
  chemically synthesized
ggtttttgattgttttcattgt

SEQ ID NO: 726320 - DNA, 22 bp, Artificial Sequence
  chemically synthesized
gacttagcaggacaatgaaaac

SEQ ID NO: 726321 - DNA, 22 bp, Artificial Sequence
  chemically synthesized
gttgggtttttgattgttttca

SEQ ID NO: 726322 - DNA, 22 bp, Artificial Sequence
  chemically synthesized
agcaggacaatgaaaacaatca

SEQ ID NO: 726323 - DNA, 22 bp, Artificial Sequence
  chemically synthesized
gcaggacaatgaaaacaatcaa

SEQ ID NO: 726324 - DNA, 22 bp, Artificial Sequence
  chemically synthesized
atgtgaactagttgggtttttg

SEQ ID NO: 726325 - DNA, 22 bp, Artificial Sequence
  chemically synthesized
aagctgatgtgaactagttggg

SEQ ID NO: 726326 - DNA, 22 bp, Artificial Sequence
  chemically synthesized
caagctgatgtgaactagttgg

SEQ ID NO: 726327 - DNA, 22 bp, Artificial Sequence
  chemically synthesized
gtttcaagctgatgtgaactag

SEQ ID NO: 726328 - DNA, 22 bp, Artificial Sequence
  chemically synthesized
agcatcctcgtttcaagctgat

SEQ ID NO: 726329 - DNA, 22 bp, Artificial Sequence
  chemically synthesized
taagcatcctcgtttcaagctg

SEQ ID NO: 726330 - DNA, 22 bp, Artificial Sequence
  chemically synthesized
tctaagcatcctcgtttcaagc

SEQ ID NO: 726331 - DNA, 22 bp, Artificial Sequence
  chemically synthesized
ctctaagcatcctcgtttcaag

SEQ ID NO: 726332 - DNA, 22 bp, Artificial Sequence
  chemically synthesized
gttcacatcagcttgaaacgag

SEQ ID NO: 726333 - DNA, 22 bp, Artificial Sequence
  chemically synthesized
acatcagcttgaaacgaggatg

SEQ ID NO: 726334 - DNA, 22 bp, Artificial Sequence
  chemically synthesized
gtatcttctctaagcatcctcg

SEQ ID NO: 726335 - DNA, 22 bp, Artificial Sequence
  chemically synthesized
cgtatcttctctaagcatcctc

SEQ ID NO: 726336 - DNA, 22 bp, Artificial Sequence
  chemically synthesized
tcgtatcttctctaagcatcct

SEQ ID NO: 726337 - DNA, 22 bp, Artificial Sequence
  chemically synthesized
gaaacgaggatgcttagagaag

SEQ ID NO: 726338 - DNA, 22 bp, Artificial Sequence
  chemically synthesized
aaacgaggatgcttagagaaga

SEQ ID NO: 726339 - DNA, 22 bp, Artificial Sequence
  chemically synthesized
tcaattttcgtatcttctctaa

SEQ ID NO: 726340 - DNA, 22 bp, Artificial Sequence
  chemically synthesized
gttgtcaattttcgtatcttct

SEQ ID NO: 726341 - DNA, 22 bp, Artificial Sequence
  chemically synthesized
agagaagatacgaaaattgaca

SEQ ID NO: 726342 - DNA, 22 bp, Artificial Sequence
  chemically synthesized
taaaatactcgttgtcaatttt

SEQ ID NO: 726343 - DNA, 22 bp, Artificial Sequence
  chemically synthesized
gagaagatacgaaaattgacaa

SEQ ID NO: 726344 - DNA, 22 bp, Artificial Sequence
  chemically synthesized
catctgtaaaatactcgttgtc

SEQ ID NO: 726345 - DNA, 22 bp, Artificial Sequence
  chemically synthesized
tacatctgtaaaatactcgttg

SEQ ID NO: 726346 - DNA, 22 bp, Artificial Sequence
  chemically synthesized
tctacatctgtaaaatactcgt

SEQ ID NO: 726347 - DNA, 22 bp, Artificial Sequence
  chemically synthesized
ctctacatctgtaaaatactcg

SEQ ID NO: 726348 - DNA, 22 bp, Artificial Sequence
  chemically synthesized
acaacgagtattttacagatgt

SEQ ID NO: 726349 - DNA, 22 bp, Artificial Sequence
  chemically synthesized
tacagatgtagagaagtgacgt

SEQ ID NO: 726350 - DNA, 22 bp, Artificial Sequence
  chemically synthesized
acagatgtagagaagtgacgtt

SEQ ID NO: 726351 - DNA, 22 bp, Artificial Sequence
  chemically synthesized
gagccaaagagaaacgtcactt

SEQ ID NO: 726352 - DNA, 22 bp, Artificial Sequence
  chemically synthesized
cagatgtagagaagtgacgttt

SEQ ID NO: 726353 - DNA, 22 bp, Artificial Sequence
  chemically synthesized
cccactggagccaaagagaaac

SEQ ID NO: 726354 - DNA, 22 bp, Artificial Sequence
  chemically synthesized
ctgcccactggagccaaagaga

SEQ ID NO: 726355 - DNA, 22 bp, Artificial Sequence
  chemically synthesized
ttcctgcccactggagccaaag

SEQ ID NO: 726356 - DNA, 22 bp, Artificial Sequence
  chemically synthesized
atctattcctgcccactggagc

SEQ ID NO: 726357 - DNA, 22 bp, Artificial Sequence
  chemically synthesized
ctctttggctccagtgggcagg

SEQ ID NO: 726358 - DNA, 22 bp, Artificial Sequence
  chemically synthesized
tctttggctccagtgggcagga

SEQ ID NO: 726359 - DNA, 22 bp, Artificial Sequence
  chemically synthesized
tatattgatctattcctgccca

SEQ ID NO: 726360 - DNA, 22 bp, Artificial Sequence
  chemically synthesized
tttggctccagtgggcaggaat

SEQ ID NO: 726361 - DNA, 22 bp, Artificial Sequence
  chemically synthesized
tatatattgatctattcctgcc

SEQ ID NO: 726362 - DNA, 22 bp, Artificial Sequence
  chemically synthesized
tggctccagtgggcaggaatag

SEQ ID NO: 726363 - DNA, 22 bp, Artificial Sequence
  chemically synthesized
ggctccagtgggcaggaataga

SEQ ID NO: 726364 - DNA, 22 bp, Artificial Sequence
  chemically synthesized
gctccagtgggcaggaatagat

SEQ ID NO: 726365 - DNA, 22 bp, Artificial Sequence
  chemically synthesized
cagtgggcaggaatagatcaat

SEQ ID NO: 726366 - DNA, 22 bp, Artificial Sequence
  chemically synthesized
aaatctctatatattgatctat

SEQ ID NO: 726367 - DNA, 22 bp, Artificial Sequence
  chemically synthesized
ctgaaatctctatatattgatc

SEQ ID NO: 726368 - DNA, 22 bp, Artificial Sequence
  chemically synthesized
cctgaaatctctatatattgat

SEQ ID NO: 726369 - DNA, 22 bp, Artificial Sequence
  chemically synthesized
tcctgaaatctctatatattga

SEQ ID NO: 726370 - DNA, 22 bp, Artificial Sequence
  chemically synthesized
gctttcctgaaatctctatata

SEQ ID NO: 726371 - DNA, 22 bp, Artificial Sequence
  chemically synthesized
taataaatgaaaattggctttc

SEQ ID NO: 726372 - DNA, 22 bp, Artificial Sequence
  chemically synthesized
ataataaatgaaaattggcttt

SEQ ID NO: 726373 - DNA, 22 bp, Artificial Sequence
  chemically synthesized
tataataaatgaaaattggctt

SEQ ID NO: 726374 - DNA, 22 bp, Artificial Sequence
  chemically synthesized
caggaaagccaattttcattta

SEQ ID NO: 726375 - DNA, 22 bp, Artificial Sequence
  chemically synthesized
aggaaagccaattttcatttat

SEQ ID NO: 726376 - DNA, 22 bp, Artificial Sequence
  chemically synthesized
aaagtctttataataaatgaaa

SEQ ID NO: 726377 - DNA, 22 bp, Artificial Sequence
  chemically synthesized
caaagtctttataataaatgaa

SEQ ID NO: 726378 - DNA, 22 bp, Artificial Sequence
  chemically synthesized
tttcaaagtctttataataaat

SEQ ID NO: 726379 - DNA, 22 bp, Artificial Sequence
  chemically synthesized
gttgtttcaaagtctttataat

SEQ ID NO: 726380 - DNA, 22 bp, Artificial Sequence
  chemically synthesized
tggttgtttcaaagtctttata

SEQ ID NO: 726381 - DNA, 22 bp, Artificial Sequence
  chemically synthesized
tcatttattataaagactttga

SEQ ID NO: 726382 - DNA, 22 bp, Artificial Sequence
  chemically synthesized
catttattataaagactttgaa

SEQ ID NO: 726383 - DNA, 22 bp, Artificial Sequence
  chemically synthesized
atttattataaagactttgaaa

SEQ ID NO: 726384 - DNA, 22 bp, Artificial Sequence
  chemically synthesized
attataaagactttgaaacaac

SEQ ID NO: 726385 - DNA, 22 bp, Artificial Sequence
  chemically synthesized
ttataaagactttgaaacaacc

SEQ ID NO: 726386 - DNA, 22 bp, Artificial Sequence
  chemically synthesized
taaagactttgaaacaaccaga

SEQ ID NO: 726387 - DNA, 22 bp, Artificial Sequence
  chemically synthesized
ccagggagcagttctggttgtt

SEQ ID NO: 726388 - DNA, 22 bp, Artificial Sequence
  chemically synthesized
cccagggagcagttctggttgt

SEQ ID NO: 726389 - DNA, 22 bp, Artificial Sequence
  chemically synthesized
tcccagggagcagttctggttg

SEQ ID NO: 726390 - DNA, 22 bp, Artificial Sequence
  chemically synthesized
ttcccagggagcagttctggtt

SEQ ID NO: 726391 - DNA, 22 bp, Artificial Sequence
  chemically synthesized
tgaaacaaccagaactgctccc

SEQ ID NO: 726392 - DNA, 22 bp, Artificial Sequence
  chemically synthesized
gaaacaaccagaactgctccct

SEQ ID NO: 726393 - DNA, 22 bp, Artificial Sequence
  chemically synthesized
aaacaaccagaactgctccctg

SEQ ID NO: 726394 - DNA, 22 bp, Artificial Sequence
  chemically synthesized
atgataaatcacccttttccca

SEQ ID NO: 726395 - DNA, 22 bp, Artificial Sequence
  chemically synthesized
ctccctgggaaaagggtgattt

SEQ ID NO: 726396 - DNA, 22 bp, Artificial Sequence
  chemically synthesized
cctgggaaaagggtgatttatc

SEQ ID NO: 726397 - DNA, 22 bp, Artificial Sequence
  chemically synthesized
agtacagtcattgatgataaat

SEQ ID NO: 726398 - DNA, 22 bp, Artificial Sequence
  chemically synthesized
ggaaaagggtgatttatcatca

SEQ ID NO: 726399 - DNA, 22 bp, Artificial Sequence
  chemically synthesized
gagtacagtcattgatgataaa

SEQ ID NO: 726400 - DNA, 22 bp, Artificial Sequence
  chemically synthesized
aaacccagtttgagtacagtca

SEQ ID NO: 726401 - DNA, 22 bp, Artificial Sequence
  chemically synthesized
atcatcaatgactgtactcaaa

SEQ ID NO: 726402 - DNA, 22 bp, Artificial Sequence
  chemically synthesized
tcatcaatgactgtactcaaac

SEQ ID NO: 726403 - DNA, 22 bp, Artificial Sequence
  chemically synthesized
gtcattcaaacccagtttgagt

SEQ ID NO: 726404 - DNA, 22 bp, Artificial Sequence
  chemically synthesized
ggtcattcaaacccagtttgag

SEQ ID NO: 726405 - DNA, 22 bp, Artificial Sequence
  chemically synthesized
tcagtttggtcattcaaaccca

SEQ ID NO: 726406 - DNA, 22 bp, Artificial Sequence
  chemically synthesized
tactcaaactgggtttgaatga

SEQ ID NO: 726407 - DNA, 22 bp, Artificial Sequence
  chemically synthesized
aaactgggtttgaatgaccaaa

SEQ ID NO: 726408 - DNA, 22 bp, Artificial Sequence
  chemically synthesized
taaaatccctgtcagtttggtc

SEQ ID NO: 726409 - DNA, 22 bp, Artificial Sequence
  chemically synthesized
ggtttgaatgaccaaactgaca

SEQ ID NO: 726410 - DNA, 22 bp, Artificial Sequence
  chemically synthesized
gaccctataaaatccctgtcag

SEQ ID NO: 726411 - DNA, 22 bp, Artificial Sequence
  chemically synthesized
gaatgaccaaactgacagggat

SEQ ID NO: 726412 - DNA, 22 bp, Artificial Sequence
  chemically synthesized
aatgaccaaactgacagggatt

SEQ ID NO: 726413 - DNA, 22 bp, Artificial Sequence
  chemically synthesized
aggcaggattcgaccctataaa

SEQ ID NO: 726414 - DNA, 22 bp, Artificial Sequence
  chemically synthesized
ctaaggcaggattcgaccctat

SEQ ID NO: 726415 - DNA, 22 bp, Artificial Sequence
  chemically synthesized
acagggattttatagggtcgaa

SEQ ID NO: 726416 - DNA, 22 bp, Artificial Sequence
  chemically synthesized
cctaaggcaggattcgacccta

SEQ ID NO: 726417 - DNA, 22 bp, Artificial Sequence
  chemically synthesized
ttcctaaggcaggattcgaccc

SEQ ID NO: 726418 - DNA, 22 bp, Artificial Sequence
  chemically synthesized
cttcctaaggcaggattcgacc

SEQ ID NO: 726419 - DNA, 22 bp, Artificial Sequence
  chemically synthesized
tcttcctaaggcaggattcgac

SEQ ID NO: 726420 - DNA, 22 bp, Artificial Sequence
  chemically synthesized
attttcttcctaaggcaggatt

SEQ ID NO: 726421 - DNA, 22 bp, Artificial Sequence
  chemically synthesized
tatagggtcgaatcctgcctta

SEQ ID NO: 726422 - DNA, 22 bp, Artificial Sequence
  chemically synthesized
atagggtcgaatcctgccttag

SEQ ID NO: 726423 - DNA, 22 bp, Artificial Sequence
  chemically synthesized
tagggtcgaatcctgccttagg

SEQ ID NO: 726424 - DNA, 22 bp, Artificial Sequence
  chemically synthesized
agaatcattcattttcttccta

SEQ ID NO: 726425 - DNA, 22 bp, Artificial Sequence
  chemically synthesized
aagaatcattcattttcttcct

SEQ ID NO: 726426 - DNA, 22 bp, Artificial Sequence
  chemically synthesized
ccttaggaagaaaatgaatgat

SEQ ID NO: 726427 - DNA, 22 bp, Artificial Sequence
  chemically synthesized
aagggatttaagaatcattcat

SEQ ID NO: 726428 - DNA, 22 bp, Artificial Sequence
  chemically synthesized
aaagggatttaagaatcattca

SEQ ID NO: 726429 - DNA, 22 bp, Artificial Sequence
  chemically synthesized
aggaagaaaatgaatgattctt

SEQ ID NO: 726430 - DNA, 22 bp, Artificial Sequence
  chemically synthesized
ggaagaaaatgaatgattctta

SEQ ID NO: 726431 - DNA, 22 bp, Artificial Sequence
  chemically synthesized
agaatttaaagggatttaagaa

SEQ ID NO: 726432 - DNA, 22 bp, Artificial Sequence
  chemically synthesized
ccatgcaatctcagaatttaaa

SEQ ID NO: 726433 - DNA, 22 bp, Artificial Sequence
  chemically synthesized
tgccatgcaatctcagaattta

SEQ ID NO: 726434 - DNA, 22 bp, Artificial Sequence
  chemically synthesized
ttaaatccctttaaattctgag

SEQ ID NO: 726435 - DNA, 22 bp, Artificial Sequence
  chemically synthesized
ctgccatgcaatctcagaattt

SEQ ID NO: 726436 - DNA, 22 bp, Artificial Sequence
  chemically synthesized
aaatccctttaaattctgagat

SEQ ID NO: 726437 - DNA, 22 bp, Artificial Sequence
  chemically synthesized
aatccctttaaattctgagatt

SEQ ID NO: 726438 - DNA, 22 bp, Artificial Sequence
  chemically synthesized
atcgtgcttctgccatgcaatc

SEQ ID NO: 726439 - DNA, 22 bp, Artificial Sequence
  chemically synthesized
catcgtgcttctgccatgcaat

SEQ ID NO: 726440 - DNA, 22 bp, Artificial Sequence
  chemically synthesized
taaattctgagattgcatggca

SEQ ID NO: 726441 - DNA, 22 bp, Artificial Sequence
  chemically synthesized
aaattctgagattgcatggcag

SEQ ID NO: 726442 - DNA, 22 bp, Artificial Sequence
  chemically synthesized
aattctgagattgcatggcaga

SEQ ID NO: 726443 - DNA, 22 bp, Artificial Sequence
  chemically synthesized
tgagattgcatggcagaagcac

SEQ ID NO: 726444 - DNA, 22 bp, Artificial Sequence
  chemically synthesized
agattgcatggcagaagcacga

SEQ ID NO: 726445 - DNA, 22 bp, Artificial Sequence
  chemically synthesized
ggtagtgtgatcttcatcgtgc

SEQ ID NO: 726446 - DNA, 22 bp, Artificial Sequence
  chemically synthesized
aggtagtgtgatcttcatcgtg

SEQ ID NO: 726447 - DNA, 22 bp, Artificial Sequence
  chemically synthesized
catggcagaagcacgatgaaga

SEQ ID NO: 726448 - DNA, 22 bp, Artificial Sequence
  chemically synthesized
taggtagtgtgatcttcatcgt

SEQ ID NO: 726449 - DNA, 22 bp, Artificial Sequence
  chemically synthesized
ttaggtagtgtgatcttcatcg

SEQ ID NO: 726450 - DNA, 22 bp, Artificial Sequence
  chemically synthesized
tttaggtagtgtgatcttcatc

SEQ ID NO: 726451 - DNA, 22 bp, Artificial Sequence
  chemically synthesized
tttttaggtagtgtgatcttca

SEQ ID NO: 726452 - DNA, 22 bp, Artificial Sequence
  chemically synthesized
tctttttaggtagtgtgatctt

SEQ ID NO: 726453 - DNA, 22 bp, Artificial Sequence
  chemically synthesized
aaatcagatcctctctttttag

SEQ ID NO: 726454 - DNA, 22 bp, Artificial Sequence
  chemically synthesized
ggacctgaaatcagatcctctc

SEQ ID NO: 726455 - DNA, 22 bp, Artificial Sequence
  chemically synthesized
taggacctgaaatcagatcctc

SEQ ID NO: 726456 - DNA, 22 bp, Artificial Sequence
  chemically synthesized
ctaggacctgaaatcagatcct

SEQ ID NO: 726457 - DNA, 22 bp, Artificial Sequence
  chemically synthesized
cctaaaaagagaggatctgatt

SEQ ID NO: 726458 - DNA, 22 bp, Artificial Sequence
  chemically synthesized
aaaagagaggatctgatttcag

SEQ ID NO: 726459 - DNA, 22 bp, Artificial Sequence
  chemically synthesized
atttcaggtcctagaagccttg

SEQ ID NO: 726460 - DNA, 22 bp, Artificial Sequence
  chemically synthesized
agggccaataaaaccaaggctt

SEQ ID NO: 726461 - DNA, 22 bp, Artificial Sequence
  chemically synthesized
caggtcctagaagccttggttt

SEQ ID NO: 726462 - DNA, 22 bp, Artificial Sequence
  chemically synthesized
aggtcctagaagccttggtttt

SEQ ID NO: 726463 - DNA, 22 bp, Artificial Sequence
  chemically synthesized
gaagccttggttttattggccc

SEQ ID NO: 726464 - DNA, 22 bp, Artificial Sequence
  chemically synthesized
ggttttattggcccttagtttc

SEQ ID NO: 726465 - DNA, 22 bp, Artificial Sequence
  chemically synthesized
gttttattggcccttagtttcc

SEQ ID NO: 726466 - DNA, 22 bp, Artificial Sequence
  chemically synthesized
atatcatagatatggaaactaa

SEQ ID NO: 726467 - DNA, 22 bp, Artificial Sequence
  chemically synthesized
tattggcccttagtttccatat

SEQ ID NO: 726468 - DNA, 22 bp, Artificial Sequence
  chemically synthesized
attggcccttagtttccatatc

SEQ ID NO: 726469 - DNA, 22 bp, Artificial Sequence
  chemically synthesized
ttggcccttagtttccatatct

SEQ ID NO: 726470 - DNA, 22 bp, Artificial Sequence
  chemically synthesized
aactcatatcatagatatggaa

SEQ ID NO: 726471 - DNA, 22 bp, Artificial Sequence
  chemically synthesized
gcccttagtttccatatctatg

SEQ ID NO: 726472 - DNA, 22 bp, Artificial Sequence
  chemically synthesized
atctaaactcatatcatagata

SEQ ID NO: 726473 - DNA, 22 bp, Artificial Sequence
  chemically synthesized
agtttccatatctatgatatga

SEQ ID NO: 726474 - DNA, 22 bp, Artificial Sequence
  chemically synthesized
gtttccatatctatgatatgag

SEQ ID NO: 726475 - DNA, 22 bp, Artificial Sequence
  chemically synthesized
ccatatctatgatatgagttta

SEQ ID NO: 726476 - DNA, 22 bp, Artificial Sequence
  chemically synthesized
catatctatgatatgagtttag

SEQ ID NO: 726477 - DNA, 22 bp, Artificial Sequence
  chemically synthesized
gaaataactcatctaaactcat

SEQ ID NO: 726478 - DNA, 22 bp, Artificial Sequence
  chemically synthesized
agaaataactcatctaaactca

SEQ ID NO: 726479 - DNA, 22 bp, Artificial Sequence
  chemically synthesized
tgatatgagtttagatgagtta

SEQ ID NO: 726480 - DNA, 22 bp, Artificial Sequence
  chemically synthesized
aagcaacaggaaaccttagaaa

SEQ ID NO: 726481 - DNA, 22 bp, Artificial Sequence
  chemically synthesized
aaagcaacaggaaaccttagaa

SEQ ID NO: 726482 - DNA, 22 bp, Artificial Sequence
  chemically synthesized
agatgagttatttctaaggttt

SEQ ID NO: 726483 - DNA, 22 bp, Artificial Sequence
  chemically synthesized
taaagcaacaggaaaccttaga

SEQ ID NO: 726484 - DNA, 22 bp, Artificial Sequence
  chemically synthesized
gatgagttatttctaaggtttc

SEQ ID NO: 726485 - DNA, 22 bp, Artificial Sequence
  chemically synthesized
aatgttttaaagcaacaggaaa

SEQ ID NO: 726486 - DNA, 22 bp, Artificial Sequence
  chemically synthesized
tttctaaggtttcctgttgctt

SEQ ID NO: 726487 - DNA, 22 bp, Artificial Sequence
  chemically synthesized
ctaaggtttcctgttgctttaa

SEQ ID NO: 726488 - DNA, 22 bp, Artificial Sequence
  chemically synthesized
taaggtttcctgttgctttaaa

SEQ ID NO: 726489 - DNA, 22 bp, Artificial Sequence
  chemically synthesized
aggtttcctgttgctttaaaac

SEQ ID NO: 726490 - DNA, 22 bp, Artificial Sequence
  chemically synthesized
aaatcattgaatgttttaaagc

SEQ ID NO: 726491 - DNA, 22 bp, Artificial Sequence
  chemically synthesized
taaaatcattgaatgttttaaa

SEQ ID NO: 726492 - DNA, 22 bp, Artificial Sequence
  chemically synthesized
cctgttgctttaaaacattcaa

SEQ ID NO: 726493 - DNA, 22 bp, Artificial Sequence
  chemically synthesized
ctgttgctttaaaacattcaat

SEQ ID NO: 726494 - DNA, 22 bp, Artificial Sequence
  chemically synthesized
ttgctttaaaacattcaatgat

SEQ ID NO: 726495 - DNA, 22 bp, Artificial Sequence
  chemically synthesized
ctttaaaacattcaatgatttt

SEQ ID NO: 726496 - DNA, 22 bp, Artificial Sequence
  chemically synthesized
taaaacattcaatgattttaga

SEQ ID NO: 726497 - DNA, 22 bp, Artificial Sequence
  chemically synthesized
aaaacattcaatgattttagag

SEQ ID NO: 726498 - DNA, 22 bp, Artificial Sequence
  chemically synthesized
aaacattcaatgattttagagt

SEQ ID NO: 726499 - DNA, 22 bp, Artificial Sequence
  chemically synthesized
acgacatcaagcaactctaaaa

SEQ ID NO: 726500 - DNA, 22 bp, Artificial Sequence
  chemically synthesized
taacgacatcaagcaactctaa

SEQ ID NO: 726501 - DNA, 22 bp, Artificial Sequence
  chemically synthesized
ctaacgacatcaagcaactcta

SEQ ID NO: 726502 - DNA, 22 bp, Artificial Sequence
  chemically synthesized
aatgattttagagttgcttgat

SEQ ID NO: 726503 - DNA, 22 bp, Artificial Sequence
  chemically synthesized
aatatttctaacgacatcaagc

SEQ ID NO: 726504 - DNA, 22 bp, Artificial Sequence
  chemically synthesized
tagagttgcttgatgtcgttag

SEQ ID NO: 726505 - DNA, 22 bp, Artificial Sequence
  chemically synthesized
agagttgcttgatgtcgttaga

SEQ ID NO: 726506 - DNA, 22 bp, Artificial Sequence
  chemically synthesized
gcattcaatatttctaacgaca

SEQ ID NO: 726507 - DNA, 22 bp, Artificial Sequence
  chemically synthesized
gagttgcttgatgtcgttagaa

SEQ ID NO: 726508 - DNA, 22 bp, Artificial Sequence
  chemically synthesized
tggcattcaatatttctaacga

SEQ ID NO: 726509 - DNA, 22 bp, Artificial Sequence
  chemically synthesized
cttgatgtcgttagaaatattg

SEQ ID NO: 726510 - DNA, 22 bp, Artificial Sequence
  chemically synthesized
cacattctggcattcaatattt

SEQ ID NO: 726511 - DNA, 22 bp, Artificial Sequence
  chemically synthesized
gatgtcgttagaaatattgaat

SEQ ID NO: 726512 - DNA, 22 bp, Artificial Sequence
  chemically synthesized
atgtcgttagaaatattgaatg

SEQ ID NO: 726513 - DNA, 22 bp, Artificial Sequence
  chemically synthesized
gaaatattgaatgccagaatgt

SEQ ID NO: 726514 - DNA, 22 bp, Artificial Sequence
  chemically synthesized
aataaatattccacattctggc

SEQ ID NO: 726515 - DNA, 22 bp, Artificial Sequence
  chemically synthesized
tccaattaaataaatattccac

SEQ ID NO: 726516 - DNA, 22 bp, Artificial Sequence
  chemically synthesized
aatgccagaatgtggaatattt

SEQ ID NO: 726517 - DNA, 22 bp, Artificial Sequence
  chemically synthesized
atccaattaaataaatattcca

SEQ ID NO: 726518 - DNA, 22 bp, Artificial Sequence
  chemically synthesized
ttatccaattaaataaatattc

SEQ ID NO: 726519 - DNA, 22 bp, Artificial Sequence
  chemically synthesized
cttatccaattaaataaatatt

SEQ ID NO: 726520 - DNA, 22 bp, Artificial Sequence
  chemically synthesized
tttcttatccaattaaataaat

SEQ ID NO: 726521 - DNA, 22 bp, Artificial Sequence
  chemically synthesized
tatttcttatccaattaaataa

SEQ ID NO: 726522 - DNA, 22 bp, Artificial Sequence
  chemically synthesized
ctatttcttatccaattaaata

SEQ ID NO: 726523 - DNA, 22 bp, Artificial Sequence
  chemically synthesized
tctatttcttatccaattaaat

SEQ ID NO: 726524 - DNA, 22 bp, Artificial Sequence
  chemically synthesized
ttctatttcttatccaattaaa

SEQ ID NO: 726525 - DNA, 22 bp, Artificial Sequence
  chemically synthesized
aacaaagtttttctatttctta

SEQ ID NO: 726526 - DNA, 22 bp, Artificial Sequence
  chemically synthesized
atttaattggataagaaataga

SEQ ID NO: 726527 - DNA, 22 bp, Artificial Sequence
  chemically synthesized
gaacaaagtttttctatttctt

SEQ ID NO: 726528 - DNA, 22 bp, Artificial Sequence
  chemically synthesized
tttaattggataagaaatagaa

SEQ ID NO: 726529 - DNA, 22 bp, Artificial Sequence
  chemically synthesized
tgaacaaagtttttctatttct

SEQ ID NO: 726530 - DNA, 22 bp, Artificial Sequence
  chemically synthesized
ttgaacaaagtttttctatttc

SEQ ID NO: 726531 - DNA, 22 bp, Artificial Sequence
  chemically synthesized
aattggataagaaatagaaaaa

SEQ ID NO: 726532 - DNA, 22 bp, Artificial Sequence
  chemically synthesized
attggataagaaatagaaaaac

SEQ ID NO: 726533 - DNA, 22 bp, Artificial Sequence
  chemically synthesized
aaatttttgaacaaagtttttc

SEQ ID NO: 726534 - DNA, 22 bp, Artificial Sequence
  chemically synthesized
gataagaaatagaaaaactttg

SEQ ID NO: 726535 - DNA, 22 bp, Artificial Sequence
  chemically synthesized
aaaatttttgaacaaagttttt

SEQ ID NO: 726536 - DNA, 22 bp, Artificial Sequence
  chemically synthesized
ttaaaatttttgaacaaagttt

SEQ ID NO: 726537 - DNA, 22 bp, Artificial Sequence
  chemically synthesized
cttaaaatttttgaacaaagtt

SEQ ID NO: 726538 - DNA, 22 bp, Artificial Sequence
  chemically synthesized
tttcttaaaatttttgaacaaa

SEQ ID NO: 726539 - DNA, 22 bp, Artificial Sequence
  chemically synthesized
atagtgattgtttcttaaaatt

SEQ ID NO: 726540 - DNA, 22 bp, Artificial Sequence
  chemically synthesized
aatagtgattgtttcttaaaat

SEQ ID NO: 726541 - DNA, 22 bp, Artificial Sequence
  chemically synthesized
taatagtgattgtttcttaaaa

SEQ ID NO: 726542 - DNA, 22 bp, Artificial Sequence
  chemically synthesized
tgttcaaaaattttaagaaaca

SEQ ID NO: 726543 - DNA, 22 bp, Artificial Sequence
  chemically synthesized
gttcaaaaattttaagaaacaa

SEQ ID NO: 726544 - DNA, 22 bp, Artificial Sequence
  chemically synthesized
ttcaaaaattttaagaaacaat

SEQ ID NO: 726545 - DNA, 22 bp, Artificial Sequence
  chemically synthesized
aaaaattttaagaaacaatcac

SEQ ID NO: 726546 - DNA, 22 bp, Artificial Sequence
  chemically synthesized
agtgcagctttaatagtgattg

SEQ ID NO: 726547 - DNA, 22 bp, Artificial Sequence
  chemically synthesized
taagtgcagctttaatagtgat

SEQ ID NO: 726548 - DNA, 22 bp, Artificial Sequence
  chemically synthesized
taagaaacaatcactattaaag

SEQ ID NO: 726549 - DNA, 22 bp, Artificial Sequence
  chemically synthesized
aagaaacaatcactattaaagc

SEQ ID NO: 726550 - DNA, 22 bp, Artificial Sequence
  chemically synthesized
agaaacaatcactattaaagct

SEQ ID NO: 726551 - DNA, 22 bp, Artificial Sequence
  chemically synthesized
cagataaatagcctctaagtgc

SEQ ID NO: 726552 - DNA, 22 bp, Artificial Sequence
  chemically synthesized
ttgcagataaatagcctctaag

SEQ ID NO: 726553 - DNA, 22 bp, Artificial Sequence
  chemically synthesized
ttaaagctgcacttagaggcta

SEQ ID NO: 726554 - DNA, 22 bp, Artificial Sequence
  chemically synthesized
aagctgcacttagaggctattt

SEQ ID NO: 726555 - DNA, 22 bp, Artificial Sequence
  chemically synthesized
attgttgcagataaatagcctc

SEQ ID NO: 726556 - DNA, 22 bp, Artificial Sequence
  chemically synthesized
ctcattgttgcagataaatagc

SEQ ID NO: 726557 - DNA, 22 bp, Artificial Sequence
  chemically synthesized
cacttagaggctatttatctgc

SEQ ID NO: 726558 - DNA, 22 bp, Artificial Sequence
  chemically synthesized
cgtctactcattgttgcagata

SEQ ID NO: 726559 - DNA, 22 bp, Artificial Sequence
  chemically synthesized
agaggctatttatctgcaacaa

SEQ ID NO: 726560 - DNA, 22 bp, Artificial Sequence
  chemically synthesized
gaggctatttatctgcaacaat

SEQ ID NO: 726561 - DNA, 22 bp, Artificial Sequence
  chemically synthesized
acatggttacgtctactcattg

SEQ ID NO: 726562 - DNA, 22 bp, Artificial Sequence
  chemically synthesized
tttatctgcaacaatgagtaga

SEQ ID NO: 726563 - DNA, 22 bp, Artificial Sequence
  chemically synthesized
atctgcaacaatgagtagacgt

SEQ ID NO: 726564 - DNA, 22 bp, Artificial Sequence
  chemically synthesized
gctgacatggttacgtctactc

SEQ ID NO: 726565 - DNA, 22 bp, Artificial Sequence
  chemically synthesized
tctgcaacaatgagtagacgta

SEQ ID NO: 726566 - DNA, 22 bp, Artificial Sequence
  chemically synthesized
caacaatgagtagacgtaacca

SEQ ID NO: 726567 - DNA, 22 bp, Artificial Sequence
  chemically synthesized
ataaatgttagctgacatggtt

SEQ ID NO: 726568 - DNA, 22 bp, Artificial Sequence
  chemically synthesized
aataaatgttagctgacatggt

SEQ ID NO: 726569 - DNA, 22 bp, Artificial Sequence
  chemically synthesized
aaataggatttaataaatgtta

SEQ ID NO: 726570 - DNA, 22 bp, Artificial Sequence
  chemically synthesized
gctgaaataggatttaataaat

SEQ ID NO: 726571 - DNA, 22 bp, Artificial Sequence
  chemically synthesized
actagctgaaataggatttaat

SEQ ID NO: 726572 - DNA, 22 bp, Artificial Sequence
  chemically synthesized
gctcactagctgaaataggatt

SEQ ID NO: 726573 - DNA, 22 bp, Artificial Sequence
  chemically synthesized
agctcactagctgaaataggat

SEQ ID NO: 726574 - DNA, 22 bp, Artificial Sequence
  chemically synthesized
acatttattaaatcctatttca

SEQ ID NO: 726575 - DNA, 22 bp, Artificial Sequence
  chemically synthesized
attaaatcctatttcagctagt

SEQ ID NO: 726576 - DNA, 22 bp, Artificial Sequence
  chemically synthesized
ttaaatcctatttcagctagtg

SEQ ID NO: 726577 - DNA, 22 bp, Artificial Sequence
  chemically synthesized
aatcctatttcagctagtgagc

SEQ ID NO: 726578 - DNA, 22 bp, Artificial Sequence
  chemically synthesized
tatcaggtgcttagctcactag

SEQ ID NO: 726579 - DNA, 22 bp, Artificial Sequence
  chemically synthesized
atatcaggtgcttagctcacta

SEQ ID NO: 726580 - DNA, 22 bp, Artificial Sequence
  chemically synthesized
tttcagctagtgagctaagcac

SEQ ID NO: 726581 - DNA, 22 bp, Artificial Sequence
  chemically synthesized
cagctagtgagctaagcacctg

SEQ ID NO: 726582 - DNA, 22 bp, Artificial Sequence
  chemically synthesized
agctagtgagctaagcacctga

SEQ ID NO: 726583 - DNA, 22 bp, Artificial Sequence
  chemically synthesized
aatgagatcatttatatcaggt

SEQ ID NO: 726584 - DNA, 22 bp, Artificial Sequence
  chemically synthesized
gtgagctaagcacctgatataa

SEQ ID NO: 726585 - DNA, 22 bp, Artificial Sequence
  chemically synthesized
agcacctgatataaatgatctc

SEQ ID NO: 726586 - DNA, 22 bp, Artificial Sequence
  chemically synthesized
tgagaattaaatgagatcattt

SEQ ID NO: 726587 - DNA, 22 bp, Artificial Sequence
  chemically synthesized
ttatgagaattaaatgagatca

SEQ ID NO: 726588 - DNA, 22 bp, Artificial Sequence
  chemically synthesized
atataaatgatctcatttaatt

SEQ ID NO: 726589 - DNA, 22 bp, Artificial Sequence
  chemically synthesized
cagggttgttatgagaattaaa

SEQ ID NO: 726590 - DNA, 22 bp, Artificial Sequence
  chemically synthesized
tgttacagggttgttatgagaa

SEQ ID NO: 726591 - DNA, 22 bp, Artificial Sequence
  chemically synthesized
atttaattctcataacaaccct

SEQ ID NO: 726592 - DNA, 22 bp, Artificial Sequence
  chemically synthesized
aattctcataacaaccctgtaa

SEQ ID NO: 726593 - DNA, 22 bp, Artificial Sequence
  chemically synthesized
attctcataacaaccctgtaac

SEQ ID NO: 726594 - DNA, 22 bp, Artificial Sequence
  chemically synthesized
tgaatagtacctatgttacagg

SEQ ID NO: 726595 - DNA, 22 bp, Artificial Sequence
  chemically synthesized
tcataacaaccctgtaacatag

SEQ ID NO: 726596 - DNA, 22 bp, Artificial Sequence
  chemically synthesized
ataacaaccctgtaacataggt

SEQ ID NO: 726597 - DNA, 22 bp, Artificial Sequence
  chemically synthesized
actgtgaatagtacctatgtta

SEQ ID NO: 726598 - DNA, 22 bp, Artificial Sequence
  chemically synthesized
cctgactgtgaatagtacctat

SEQ ID NO: 726599 - DNA, 22 bp, Artificial Sequence
  chemically synthesized
ccctgactgtgaatagtaccta

SEQ ID NO: 726600 - DNA, 22 bp, Artificial Sequence
  chemically synthesized
gtttccctgactgtgaatagta

SEQ ID NO: 726601 - DNA, 22 bp, Artificial Sequence
  chemically synthesized
ggtttccctgactgtgaatagt

SEQ ID NO: 726602 - DNA, 22 bp, Artificial Sequence
  chemically synthesized
taacataggtactattcacagt

SEQ ID NO: 726603 - DNA, 22 bp, Artificial Sequence
  chemically synthesized
caaggtttggtttccctgactg

SEQ ID NO: 726604 - DNA, 22 bp, Artificial Sequence
  chemically synthesized
tccaaggtttggtttccctgac

SEQ ID NO: 726605 - DNA, 22 bp, Artificial Sequence
  chemically synthesized
acctctccaaggtttggtttcc

SEQ ID NO: 726606 - DNA, 22 bp, Artificial Sequence
  chemically synthesized
ttcacagtcagggaaaccaaac

SEQ ID NO: 726607 - DNA, 22 bp, Artificial Sequence
  chemically synthesized
aacctctccaaggtttggtttc

SEQ ID NO: 726608 - DNA, 22 bp, Artificial Sequence
  chemically synthesized
taacctctccaaggtttggttt

SEQ ID NO: 726609 - DNA, 22 bp, Artificial Sequence
  chemically synthesized
acagtcagggaaaccaaacctt

SEQ ID NO: 726610 - DNA, 22 bp, Artificial Sequence
  chemically synthesized
ggcaaatgttttaacctctcca

SEQ ID NO: 726611 - DNA, 22 bp, Artificial Sequence
  chemically synthesized
gggcaaatgttttaacctctcc

SEQ ID NO: 726612 - DNA, 22 bp, Artificial Sequence
  chemically synthesized
tgtaaccttgggcaaatgtttt

SEQ ID NO: 726613 - DNA, 22 bp, Artificial Sequence
  chemically synthesized
ggagaggttaaaacatttgccc

SEQ ID NO: 726614 - DNA, 22 bp, Artificial Sequence
  chemically synthesized
gagaggttaaaacatttgccca

SEQ ID NO: 726615 - DNA, 22 bp, Artificial Sequence
  chemically synthesized
gaaactgtgtaaccttgggcaa

SEQ ID NO: 726616 - DNA, 22 bp, Artificial Sequence
  chemically synthesized
agaaactgtgtaaccttgggca

SEQ ID NO: 726617 - DNA, 22 bp, Artificial Sequence
  chemically synthesized
aaacatttgcccaaggttacac

SEQ ID NO: 726618 - DNA, 22 bp, Artificial Sequence
  chemically synthesized
ccacttagaaactgtgtaacct

SEQ ID NO: 726619 - DNA, 22 bp, Artificial Sequence
  chemically synthesized
taccacttagaaactgtgtaac

SEQ ID NO: 726620 - DNA, 22 bp, Artificial Sequence
  chemically synthesized
tctaccacttagaaactgtgta

SEQ ID NO: 726621 - DNA, 22 bp, Artificial Sequence
  chemically synthesized
gcccaaggttacacagtttcta

SEQ ID NO: 726622 - DNA, 22 bp, Artificial Sequence
  chemically synthesized
cccaaggttacacagtttctaa

SEQ ID NO: 726623 - DNA, 22 bp, Artificial Sequence
  chemically synthesized
cacagtttctaagtggtagaga

SEQ ID NO: 726624 - DNA, 22 bp, Artificial Sequence
  chemically synthesized
tcagggtatgaatcctctctac

SEQ ID NO: 726625 - DNA, 22 bp, Artificial Sequence
  chemically synthesized
ctaagtggtagagaggattcat

SEQ ID NO: 726626 - DNA, 22 bp, Artificial Sequence
  chemically synthesized
taagtggtagagaggattcata

SEQ ID NO: 726627 - DNA, 22 bp, Artificial Sequence
  chemically synthesized
acagctgtcagggtatgaatcc

SEQ ID NO: 726628 - DNA, 22 bp, Artificial Sequence
  chemically synthesized
agtggtagagaggattcatacc

SEQ ID NO: 726629 - DNA, 22 bp, Artificial Sequence
  chemically synthesized
ttgacagctgtcagggtatgaa

SEQ ID NO: 726630 - DNA, 22 bp, Artificial Sequence
  chemically synthesized
ctgttgacagctgtcagggtat

SEQ ID NO: 726631 - DNA, 22 bp, Artificial Sequence
  chemically synthesized
attcctgttgacagctgtcagg

SEQ ID NO: 726632 - DNA, 22 bp, Artificial Sequence
  chemically synthesized
attaattcctgttgacagctgt

SEQ ID NO: 726633 - DNA, 22 bp, Artificial Sequence
  chemically synthesized
cattaattcctgttgacagctg

SEQ ID NO: 726634 - DNA, 22 bp, Artificial Sequence
  chemically synthesized
tcattaattcctgttgacagct

SEQ ID NO: 726635 - DNA, 22 bp, Artificial Sequence
  chemically synthesized
ataccctgacagctgtcaacag

SEQ ID NO: 726636 - DNA, 22 bp, Artificial Sequence
  chemically synthesized
acagctgtcaacaggaattaat

SEQ ID NO: 726637 - DNA, 22 bp, Artificial Sequence
  chemically synthesized
cagagaactttcattaattcct

SEQ ID NO: 726638 - DNA, 22 bp, Artificial Sequence
  chemically synthesized
acagagaactttcattaattcc

SEQ ID NO: 726639 - DNA, 22 bp, Artificial Sequence
  chemically synthesized
tacagagaactttcattaattc

SEQ ID NO: 726640 - DNA, 22 bp, Artificial Sequence
  chemically synthesized
tcaacaggaattaatgaaagtt

SEQ ID NO: 726641 - DNA, 22 bp, Artificial Sequence
  chemically synthesized
gccctttacagagaactttcat

SEQ ID NO: 726642 - DNA, 22 bp, Artificial Sequence
  chemically synthesized
tggccctttacagagaactttc

SEQ ID NO: 726643 - DNA, 22 bp, Artificial Sequence
  chemically synthesized
ctggccctttacagagaacttt

SEQ ID NO: 726644 - DNA, 22 bp, Artificial Sequence
  chemically synthesized
tctggccctttacagagaactt

SEQ ID NO: 726645 - DNA, 22 bp, Artificial Sequence
  chemically synthesized
ctttctggccctttacagagaa

SEQ ID NO: 726646 - DNA, 22 bp, Artificial Sequence
  chemically synthesized
actttctggccctttacagaga

SEQ ID NO: 726647 - DNA, 22 bp, Artificial Sequence
  chemically synthesized
atgaaagttctctgtaaagggc

SEQ ID NO: 726648 - DNA, 22 bp, Artificial Sequence
  chemically synthesized
tctgtaaagggccagaaagtaa

SEQ ID NO: 726649 - DNA, 22 bp, Artificial Sequence
  chemically synthesized
tgtaaagggccagaaagtaaat

SEQ ID NO: 726650 - DNA, 22 bp, Artificial Sequence
  chemically synthesized
aaagccagaaatatttactttc

SEQ ID NO: 726651 - DNA, 22 bp, Artificial Sequence
  chemically synthesized
taaagggccagaaagtaaatat

SEQ ID NO: 726652 - DNA, 22 bp, Artificial Sequence
  chemically synthesized
ctcaaagccagaaatatttact

SEQ ID NO: 726653 - DNA, 22 bp, Artificial Sequence
  chemically synthesized
tgtgttcctcaaagccagaaat

SEQ ID NO: 726654 - DNA, 22 bp, Artificial Sequence
  chemically synthesized
atgtgttcctcaaagccagaaa

SEQ ID NO: 726655 - DNA, 22 bp, Artificial Sequence
  chemically synthesized
ctggctttgaggaacacataaa

SEQ ID NO: 726656 - DNA, 22 bp, Artificial Sequence
  chemically synthesized
tggctttgaggaacacataaat

SEQ ID NO: 726657 - DNA, 22 bp, Artificial Sequence
  chemically synthesized
gctttgaggaacacataaatct

SEQ ID NO: 726658 - DNA, 22 bp, Artificial Sequence
  chemically synthesized
tgaggaacacataaatctccgt

SEQ ID NO: 726659 - DNA, 22 bp, Artificial Sequence
  chemically synthesized
gaggaacacataaatctccgtt

SEQ ID NO: 726660 - DNA, 22 bp, Artificial Sequence
  chemically synthesized
aggaacacataaatctccgtta

SEQ ID NO: 726661 - DNA, 22 bp, Artificial Sequence
  chemically synthesized
tacgaaacccaaagaagaatat

SEQ ID NO: 726662 - DNA, 22 bp, Artificial Sequence
  chemically synthesized
cgttacatattcttctttgggt

SEQ ID NO: 726663 - DNA, 22 bp, Artificial Sequence
  chemically synthesized
ataagttgtacgaaacccaaag

SEQ ID NO: 726664 - DNA, 22 bp, Artificial Sequence
  chemically synthesized
aataagttgtacgaaacccaaa

SEQ ID NO: 726665 - DNA, 22 bp, Artificial Sequence
  chemically synthesized
taataagttgtacgaaacccaa

SEQ ID NO: 726666 - DNA, 22 bp, Artificial Sequence
  chemically synthesized
catattcttctttgggtttcgt

SEQ ID NO: 726667 - DNA, 22 bp, Artificial Sequence
  chemically synthesized
ttttaataagttgtacgaaacc

SEQ ID NO: 726668 - DNA, 22 bp, Artificial Sequence
  chemically synthesized
gttttaataagttgtacgaaac

SEQ ID NO: 726669 - DNA, 22 bp, Artificial Sequence
  chemically synthesized
cttgttttaataagttgtacga

SEQ ID NO: 726670 - DNA, 22 bp, Artificial Sequence
  chemically synthesized
ttctttgggtttcgtacaactt

SEQ ID NO: 726671 - DNA, 22 bp, Artificial Sequence
  chemically synthesized
acttgttttaataagttgtacg

SEQ ID NO: 726672 - DNA, 22 bp, Artificial Sequence
  chemically synthesized
ctttgggtttcgtacaacttat

SEQ ID NO: 726673 - DNA, 22 bp, Artificial Sequence
  chemically synthesized
tttgggtttcgtacaacttatt

SEQ ID NO: 726674 - DNA, 22 bp, Artificial Sequence
  chemically synthesized
tgggtttcgtacaacttattaa

SEQ ID NO: 726675 - DNA, 22 bp, Artificial Sequence
  chemically synthesized
gggtttcgtacaacttattaaa

SEQ ID NO: 726676 - DNA, 22 bp, Artificial Sequence
  chemically synthesized
ggtttcgtacaacttattaaaa

SEQ ID NO: 726677 - DNA, 22 bp, Artificial Sequence
  chemically synthesized
aaaacagtttacttgttttaat

SEQ ID NO: 726678 - DNA, 22 bp, Artificial Sequence
  chemically synthesized
cgtacaacttattaaaacaagt

SEQ ID NO: 726679 - DNA, 22 bp, Artificial Sequence
  chemically synthesized
gtacaacttattaaaacaagta

SEQ ID NO: 726680 - DNA, 22 bp, Artificial Sequence
  chemically synthesized
attaaaacaagtaaactgtttt

SEQ ID NO: 726681 - DNA, 22 bp, Artificial Sequence
  chemically synthesized
ttaaaacaagtaaactgttttt

SEQ ID NO: 726682 - DNA, 22 bp, Artificial Sequence
  chemically synthesized
atagcaggggagctaaaaacag

SEQ ID NO: 726683 - DNA, 22 bp, Artificial Sequence
  chemically synthesized
aaacaagtaaactgtttttagc

SEQ ID NO: 726684 - DNA, 22 bp, Artificial Sequence
  chemically synthesized
aatagcaggggagctaaaaaca

SEQ ID NO: 726685 - DNA, 22 bp, Artificial Sequence
  chemically synthesized
taatagcaggggagctaaaaac

SEQ ID NO: 726686 - DNA, 22 bp, Artificial Sequence
  chemically synthesized
ttaatagcaggggagctaaaaa

SEQ ID NO: 726687 - DNA, 22 bp, Artificial Sequence
  chemically synthesized
tttaatagcaggggagctaaaa

SEQ ID NO: 726688 - DNA, 22 bp, Artificial Sequence
  chemically synthesized
ttttaatagcaggggagctaaa

SEQ ID NO: 726689 - DNA, 22 bp, Artificial Sequence
  chemically synthesized
tttttaatagcaggggagctaa

SEQ ID NO: 726690 - DNA, 22 bp, Artificial Sequence
  chemically synthesized
ggttttttttaatagcagggga

SEQ ID NO: 726691 - DNA, 22 bp, Artificial Sequence
  chemically synthesized
tttttagctcccctgctattaa

SEQ ID NO: 726692 - DNA, 22 bp, Artificial Sequence
  chemically synthesized
ttagctcccctgctattaaaaa

SEQ ID NO: 726693 - DNA, 22 bp, Artificial Sequence
  chemically synthesized
tagctcccctgctattaaaaaa

SEQ ID NO: 726694 - DNA, 22 bp, Artificial Sequence
  chemically synthesized
agctcccctgctattaaaaaaa

SEQ ID NO: 726695 - DNA, 22 bp, Artificial Sequence
  chemically synthesized
gctcccctgctattaaaaaaaa

SEQ ID NO: 726696 - DNA, 22 bp, Artificial Sequence
  chemically synthesized
aacatggggcctgggttttttt

SEQ ID NO: 726697 - DNA, 22 bp, Artificial Sequence
  chemically synthesized
ccctgctattaaaaaaaaccca

SEQ ID NO: 726698 - DNA, 22 bp, Artificial Sequence
  chemically synthesized
ctattaaaaaaaacccaggccc

SEQ ID NO: 726699 - DNA, 22 bp, Artificial Sequence
  chemically synthesized
ttaaaaaaaacccaggccccat

SEQ ID NO: 726700 - DNA, 22 bp, Artificial Sequence
  chemically synthesized
agtacaaattcaacatggggcc

SEQ ID NO: 726701 - DNA, 22 bp, Artificial Sequence
  chemically synthesized
aaaaaaacccaggccccatgtt

SEQ ID NO: 726702 - DNA, 22 bp, Artificial Sequence
  chemically synthesized
caggtctcagtacaaattcaac

SEQ ID NO: 726703 - DNA, 22 bp, Artificial Sequence
  chemically synthesized
aatttgtactgagacctgtagt

SEQ ID NO: 726704 - DNA, 22 bp, Artificial Sequence
  chemically synthesized
gtactgagacctgtagtttgct

SEQ ID NO: 726705 - DNA, 22 bp, Artificial Sequence
  chemically synthesized
tactgagacctgtagtttgctg

SEQ ID NO: 726706 - DNA, 22 bp, Artificial Sequence
  chemically synthesized
agacctgtagtttgctgtcccc

SEQ ID NO: 726707 - DNA, 22 bp, Artificial Sequence
  chemically synthesized
tagtaagagagcagagcagggg

SEQ ID NO: 726708 - DNA, 22 bp, Artificial Sequence
  chemically synthesized
tagtttgctgtcccctgctctg

SEQ ID NO: 726709 - DNA, 22 bp, Artificial Sequence
  chemically synthesized
gctgtcccctgctctgctctct

SEQ ID NO: 726710 - DNA, 22 bp, Artificial Sequence
  chemically synthesized
ctgtcccctgctctgctctctt

SEQ ID NO: 726711 - DNA, 22 bp, Artificial Sequence
  chemically synthesized
tcccctgctctgctctcttact

SEQ ID NO: 726712 - DNA, 22 bp, Artificial Sequence
  chemically synthesized
ctctgctctcttactacaacac

SEQ ID NO: 726713 - DNA, 22 bp, Artificial Sequence
  chemically synthesized
gggaagcagtagggtgttgtag

SEQ ID NO: 726714 - DNA, 22 bp, Artificial Sequence
  chemically synthesized
ggggaagcagtagggtgttgta

SEQ ID NO: 726715 - DNA, 22 bp, Artificial Sequence
  chemically synthesized
tgctctcttactacaacaccct

SEQ ID NO: 726716 - DNA, 22 bp, Artificial Sequence
  chemically synthesized
ctctcttactacaacaccctac

SEQ ID NO: 726717 - DNA, 22 bp, Artificial Sequence
  chemically synthesized
tcttactacaacaccctactgc

SEQ ID NO: 726718 - DNA, 22 bp, Artificial Sequence
  chemically synthesized
ttactacaacaccctactgctt

SEQ ID NO: 726719 - DNA, 22 bp, Artificial Sequence
  chemically synthesized
actacaacaccctactgcttcc

SEQ ID NO: 726720 - DNA, 22 bp, Artificial Sequence
  chemically synthesized
ctacaacaccctactgcttccc

SEQ ID NO: 726721 - DNA, 22 bp, Artificial Sequence
  chemically synthesized
caacaccctactgcttccccaa

SEQ ID NO: 726722 - DNA, 22 bp, Artificial Sequence
  chemically synthesized
agtaaatagtagtcttggggaa

SEQ ID NO: 726723 - DNA, 22 bp, Artificial Sequence
  chemically synthesized
ctgcttccccaagactactatt

SEQ ID NO: 726724 - DNA, 22 bp, Artificial Sequence
  chemically synthesized
cttccccaagactactatttac

SEQ ID NO: 726725 - DNA, 22 bp, Artificial Sequence
  chemically synthesized
ccccaagactactatttactga

SEQ ID NO: 726726 - DNA, 22 bp, Artificial Sequence
  chemically synthesized
cccaagactactatttactgag

SEQ ID NO: 726727 - DNA, 22 bp, Artificial Sequence
  chemically synthesized
gcccataagaagtcctcagtaa

SEQ ID NO: 726728 - DNA, 22 bp, Artificial Sequence
  chemically synthesized
ctatttactgaggacttcttat

SEQ ID NO: 726729 - DNA, 22 bp, Artificial Sequence
  chemically synthesized
tttactgaggacttcttatggg

SEQ ID NO: 726730 - DNA, 22 bp, Artificial Sequence
  chemically synthesized
gcgcagtgtctggcccataaga

SEQ ID NO: 726731 - DNA, 22 bp, Artificial Sequence
  chemically synthesized
agcgcagtgtctggcccataag

SEQ ID NO: 726732 - DNA, 22 bp, Artificial Sequence
  chemically synthesized
actgaggacttcttatgggcca

SEQ ID NO: 726733 - DNA, 22 bp, Artificial Sequence
  chemically synthesized
ctgaggacttcttatgggccag

SEQ ID NO: 726734 - DNA, 22 bp, Artificial Sequence
  chemically synthesized
aggacttcttatgggccagaca

SEQ ID NO: 726735 - DNA, 22 bp, Artificial Sequence
  chemically synthesized
cttatgggccagacactgcgct

SEQ ID NO: 726736 - DNA, 22 bp, Artificial Sequence
  chemically synthesized
ttatgggccagacactgcgcta

SEQ ID NO: 726737 - DNA, 22 bp, Artificial Sequence
  chemically synthesized
catgaaaagcatttagcgcagt

SEQ ID NO: 726738 - DNA, 22 bp, Artificial Sequence
  chemically synthesized
atgggccagacactgcgctaaa

SEQ ID NO: 726739 - DNA, 22 bp, Artificial Sequence
  chemically synthesized
tgggccagacactgcgctaaat

SEQ ID NO: 726740 - DNA, 22 bp, Artificial Sequence
  chemically synthesized
cagagatattgcatgaaaagca

SEQ ID NO: 726741 - DNA, 22 bp, Artificial Sequence
  chemically synthesized
cgctaaatgcttttcatgcaat

SEQ ID NO: 726742 - DNA, 22 bp, Artificial Sequence
  chemically synthesized
tattacagagatattgcatgaa

SEQ ID NO: 726743 - DNA, 22 bp, Artificial Sequence
  chemically synthesized
gttgtattacagagatattgca

SEQ ID NO: 726744 - DNA, 22 bp, Artificial Sequence
  chemically synthesized
aatgcttttcatgcaatatctc

SEQ ID NO: 726745 - DNA, 22 bp, Artificial Sequence
  chemically synthesized
ttcatgcaatatctctgtaata

SEQ ID NO: 726746 - DNA, 22 bp, Artificial Sequence
  chemically synthesized
tcatgcaatatctctgtaatac

SEQ ID NO: 726747 - DNA, 22 bp, Artificial Sequence
  chemically synthesized
catgcaatatctctgtaataca

SEQ ID NO: 726748 - DNA, 22 bp, Artificial Sequence
  chemically synthesized
atgcaatatctctgtaatacaa

SEQ ID NO: 726749 - DNA, 22 bp, Artificial Sequence
  chemically synthesized
tgtaatacaacgagcctctggg

SEQ ID NO: 726750 - DNA, 22 bp, Artificial Sequence
  chemically synthesized
taatacaacgagcctctgggtt

SEQ ID NO: 726751 - DNA, 22 bp, Artificial Sequence
  chemically synthesized
taaaatggaaaccaacccagag

SEQ ID NO: 726752 - DNA, 22 bp, Artificial Sequence
  chemically synthesized
catctataaaatggaaaccaac

SEQ ID NO: 726753 - DNA, 22 bp, Artificial Sequence
  chemically synthesized
ccatctataaaatggaaaccaa

SEQ ID NO: 726754 - DNA, 22 bp, Artificial Sequence
  chemically synthesized
tccatctataaaatggaaacca

SEQ ID NO: 726755 - DNA, 22 bp, Artificial Sequence
  chemically synthesized
ttttccatctataaaatggaaa

SEQ ID NO: 726756 - DNA, 22 bp, Artificial Sequence
  chemically synthesized
tgggttggtttccattttatag

SEQ ID NO: 726757 - DNA, 22 bp, Artificial Sequence
  chemically synthesized
ggttggtttccattttatagat

SEQ ID NO: 726758 - DNA, 22 bp, Artificial Sequence
  chemically synthesized
agcctattttccatctataaaa

SEQ ID NO: 726759 - DNA, 22 bp, Artificial Sequence
  chemically synthesized
taagcctattttccatctataa

SEQ ID NO: 726760 - DNA, 22 bp, Artificial Sequence
  chemically synthesized
tctaagcctattttccatctat

SEQ ID NO: 726761 - DNA, 22 bp, Artificial Sequence
  chemically synthesized
gtttccattttatagatggaaa

SEQ ID NO: 726762 - DNA, 22 bp, Artificial Sequence
  chemically synthesized
ccattttatagatggaaaatag

SEQ ID NO: 726763 - DNA, 22 bp, Artificial Sequence
  chemically synthesized
cattttatagatggaaaatagg

SEQ ID NO: 726764 - DNA, 22 bp, Artificial Sequence
  chemically synthesized
aaactctctaagcctattttcc

SEQ ID NO: 726765 - DNA, 22 bp, Artificial Sequence
  chemically synthesized
ctgaaactctctaagcctattt

SEQ ID NO: 726766 - DNA, 22 bp, Artificial Sequence
  chemically synthesized
tatagatggaaaataggcttag

SEQ ID NO: 726767 - DNA, 22 bp, Artificial Sequence
  chemically synthesized
atagatggaaaataggcttaga

SEQ ID NO: 726768 - DNA, 22 bp, Artificial Sequence
  chemically synthesized
ctgctgaaactctctaagccta

SEQ ID NO: 726769 - DNA, 22 bp, Artificial Sequence
  chemically synthesized
tagatggaaaataggcttagag

SEQ ID NO: 726770 - DNA, 22 bp, Artificial Sequence
  chemically synthesized
agttgctgctgaaactctctaa

SEQ ID NO: 726771 - DNA, 22 bp, Artificial Sequence
  chemically synthesized
cagttgctgctgaaactctcta

SEQ ID NO: 726772 - DNA, 22 bp, Artificial Sequence
  chemically synthesized
tgtttcagttgctgctgaaact

SEQ ID NO: 726773 - DNA, 22 bp, Artificial Sequence
  chemically synthesized
gtgtttcagttgctgctgaaac

SEQ ID NO: 726774 - DNA, 22 bp, Artificial Sequence
  chemically synthesized
tatttgtgtttcagttgctgct

SEQ ID NO: 726775 - DNA, 22 bp, Artificial Sequence
  chemically synthesized
gtatttgtgtttcagttgctgc

SEQ ID NO: 726776 - DNA, 22 bp, Artificial Sequence
  chemically synthesized
agagagtttcagcagcaactga

SEQ ID NO: 726777 - DNA, 22 bp, Artificial Sequence
  chemically synthesized
gagagtttcagcagcaactgaa

SEQ ID NO: 726778 - DNA, 22 bp, Artificial Sequence
  chemically synthesized
gccttgtatttgtgtttcagtt

SEQ ID NO: 726779 - DNA, 22 bp, Artificial Sequence
  chemically synthesized
tagccttgtatttgtgtttcag

SEQ ID NO: 726780 - DNA, 22 bp, Artificial Sequence
  chemically synthesized
ctagccttgtatttgtgtttca

SEQ ID NO: 726781 - DNA, 22 bp, Artificial Sequence
  chemically synthesized
tctagccttgtatttgtgtttc

SEQ ID NO: 726782 - DNA, 22 bp, Artificial Sequence
  chemically synthesized
cagcagcaactgaaacacaaat

SEQ ID NO: 726783 - DNA, 22 bp, Artificial Sequence
  chemically synthesized
agcagcaactgaaacacaaata

SEQ ID NO: 726784 - DNA, 22 bp, Artificial Sequence
  chemically synthesized
ccactttctagccttgtatttg

SEQ ID NO: 726785 - DNA, 22 bp, Artificial Sequence
  chemically synthesized
tgccactttctagccttgtatt

SEQ ID NO: 726786 - DNA, 22 bp, Artificial Sequence
  chemically synthesized
aaacacaaatacaaggctagaa

SEQ ID NO: 726787 - DNA, 22 bp, Artificial Sequence
  chemically synthesized
acagctctgccactttctagcc

SEQ ID NO: 726788 - DNA, 22 bp, Artificial Sequence
  chemically synthesized
acaaagctcacagctctgccac

SEQ ID NO: 726789 - DNA, 22 bp, Artificial Sequence
  chemically synthesized
cagattcacaaagctcacagct

SEQ ID NO: 726790 - DNA, 22 bp, Artificial Sequence
  chemically synthesized
gaaagtggcagagctgtgagct

SEQ ID NO: 726791 - DNA, 22 bp, Artificial Sequence
  chemically synthesized
ccagattcacaaagctcacagc

SEQ ID NO: 726792 - DNA, 22 bp, Artificial Sequence
  chemically synthesized
tgagctttgtgaatctggaaac

SEQ ID NO: 726793 - DNA, 22 bp, Artificial Sequence
  chemically synthesized
caatggataaaatcacagtttc

SEQ ID NO: 726794 - DNA, 22 bp, Artificial Sequence
  chemically synthesized
tgtgaatctggaaactgtgatt

SEQ ID NO: 726795 - DNA, 22 bp, Artificial Sequence
  chemically synthesized
gtgaatctggaaactgtgattt

SEQ ID NO: 726796 - DNA, 22 bp, Artificial Sequence
  chemically synthesized
ctgcaatggataaaatcacagt

SEQ ID NO: 726797 - DNA, 22 bp, Artificial Sequence
  chemically synthesized
tgaatctggaaactgtgatttt

SEQ ID NO: 726798 - DNA, 22 bp, Artificial Sequence
  chemically synthesized
tactgcaatggataaaatcaca

SEQ ID NO: 726799 - DNA, 22 bp, Artificial Sequence
  chemically synthesized
tctactgcaatggataaaatca

SEQ ID NO: 726800 - DNA, 22 bp, Artificial Sequence
  chemically synthesized
gaaactgtgattttatccattg

SEQ ID NO: 726801 - DNA, 22 bp, Artificial Sequence
  chemically synthesized
agcctctctactgcaatggata

SEQ ID NO: 726802 - DNA, 22 bp, Artificial Sequence
  chemically synthesized
ctcagcctctctactgcaatgg

SEQ ID NO: 726803 - DNA, 22 bp, Artificial Sequence
  chemically synthesized
tactcagcctctctactgcaat

SEQ ID NO: 726804 - DNA, 22 bp, Artificial Sequence
  chemically synthesized
tgattttatccattgcagtaga

SEQ ID NO: 726805 - DNA, 22 bp, Artificial Sequence
  chemically synthesized
actctactcagcctctctactg

SEQ ID NO: 726806 - DNA, 22 bp, Artificial Sequence
  chemically synthesized
tatccattgcagtagagaggct

SEQ ID NO: 726807 - DNA, 22 bp, Artificial Sequence
  chemically synthesized
atccattgcagtagagaggctg

SEQ ID NO: 726808 - DNA, 22 bp, Artificial Sequence
  chemically synthesized
tccattgcagtagagaggctga

SEQ ID NO: 726809 - DNA, 22 bp, Artificial Sequence
  chemically synthesized
cagtagagaggctgagtagagt

SEQ ID NO: 726810 - DNA, 22 bp, Artificial Sequence
  chemically synthesized
ccccagtcccagttcactctac

SEQ ID NO: 726811 - DNA, 22 bp, Artificial Sequence
  chemically synthesized
cctgccccagtcccagttcact

SEQ ID NO: 726812 - DNA, 22 bp, Artificial Sequence
  chemically synthesized
agtagagtgaactgggactggg

SEQ ID NO: 726813 - DNA, 22 bp, Artificial Sequence
  chemically synthesized
cagtccctccctgccccagtcc

SEQ ID NO: 726814 - DNA, 22 bp, Artificial Sequence
  chemically synthesized
ttccagtccctccctgccccag

SEQ ID NO: 726815 - DNA, 22 bp, Artificial Sequence
  chemically synthesized
attccagtccctccctgcccca

SEQ ID NO: 726816 - DNA, 22 bp, Artificial Sequence
  chemically synthesized
ttattccagtccctccctgccc

SEQ ID NO: 726817 - DNA, 22 bp, Artificial Sequence
  chemically synthesized
cttattccagtccctccctgcc

SEQ ID NO: 726818 - DNA, 22 bp, Artificial Sequence
  chemically synthesized
tcttattccagtccctccctgc

SEQ ID NO: 726819 - DNA, 22 bp, Artificial Sequence
  chemically synthesized
ggactggggcagggagggactg

SEQ ID NO: 726820 - DNA, 22 bp, Artificial Sequence
  chemically synthesized
gggcagggagggactggaataa

SEQ ID NO: 726821 - DNA, 22 bp, Artificial Sequence
  chemically synthesized
cacaccagttttcttattccag

SEQ ID NO: 726822 - DNA, 22 bp, Artificial Sequence
  chemically synthesized
tacacaccagttttcttattcc

SEQ ID NO: 726823 - DNA, 22 bp, Artificial Sequence
  chemically synthesized
ccatgctctacacaccagtttt

SEQ ID NO: 726824 - DNA, 22 bp, Artificial Sequence
  chemically synthesized
ttgccatgctctacacaccagt

SEQ ID NO: 726825 - DNA, 22 bp, Artificial Sequence
  chemically synthesized
gaataagaaaactggtgtgtag

SEQ ID NO: 726826 - DNA, 22 bp, Artificial Sequence
  chemically synthesized
ggctgttgccatgctctacaca

SEQ ID NO: 726827 - DNA, 22 bp, Artificial Sequence
  chemically synthesized
tctaggctgttgccatgctcta

SEQ ID NO: 726828 - DNA, 22 bp, Artificial Sequence
  chemically synthesized
gtgtgtagagcatggcaacagc

SEQ ID NO: 726829 - DNA, 22 bp, Artificial Sequence
  chemically synthesized
aaaccataccataattgtctag

SEQ ID NO: 726830 - DNA, 22 bp, Artificial Sequence
  chemically synthesized
caaaccataccataattgtcta

SEQ ID NO: 726831 - DNA, 22 bp, Artificial Sequence
  chemically synthesized
tcaaaccataccataattgtct

SEQ ID NO: 726832 - DNA, 22 bp, Artificial Sequence
  chemically synthesized
ttcaaaccataccataattgtc

SEQ ID NO: 726833 - DNA, 22 bp, Artificial Sequence
  chemically synthesized
cagtgtttttcaaaccatacca

SEQ ID NO: 726834 - DNA, 22 bp, Artificial Sequence
  chemically synthesized
gacaattatggtatggtttgaa

SEQ ID NO: 726835 - DNA, 22 bp, Artificial Sequence
  chemically synthesized
tgaagctacagtgtttttcaaa

SEQ ID NO: 726836 - DNA, 22 bp, Artificial Sequence
  chemically synthesized
tggtatggtttgaaaaacactg

SEQ ID NO: 726837 - DNA, 22 bp, Artificial Sequence
  chemically synthesized
attatgaagctacagtgttttt

SEQ ID NO: 726838 - DNA, 22 bp, Artificial Sequence
  chemically synthesized
gaaaaacactgtagcttcataa

SEQ ID NO: 726839 - DNA, 22 bp, Artificial Sequence
  chemically synthesized
aaaaacactgtagcttcataat

SEQ ID NO: 726840 - DNA, 22 bp, Artificial Sequence
  chemically synthesized
acaaatccagttgattatgaag

SEQ ID NO: 726841 - DNA, 22 bp, Artificial Sequence
  chemically synthesized
tagcttcataatcaactggatt

SEQ ID NO: 726842 - DNA, 22 bp, Artificial Sequence
  chemically synthesized
cataatcaactggatttgtcag

SEQ ID NO: 726843 - DNA, 22 bp, Artificial Sequence
  chemically synthesized
acatccaataaactgacaaatc

SEQ ID NO: 726844 - DNA, 22 bp, Artificial Sequence
  chemically synthesized
ataatcaactggatttgtcagt

SEQ ID NO: 726845 - DNA, 22 bp, Artificial Sequence
  chemically synthesized
cctgacatccaataaactgaca

SEQ ID NO: 726846 - DNA, 22 bp, Artificial Sequence
  chemically synthesized
gatttgtcagtttattggatgt

SEQ ID NO: 726847 - DNA, 22 bp, Artificial Sequence
  chemically synthesized
atccaccctgcctgacatccaa

SEQ ID NO: 726848 - DNA, 22 bp, Artificial Sequence
  chemically synthesized
gtcagtttattggatgtcaggc

SEQ ID NO: 726849 - DNA, 22 bp, Artificial Sequence
  chemically synthesized
tcagtttattggatgtcaggca

SEQ ID NO: 726850 - DNA, 22 bp, Artificial Sequence
  chemically synthesized
ccctaatccaccctgcctgaca

SEQ ID NO: 726851 - DNA, 22 bp, Artificial Sequence
  chemically synthesized
cccctaatccaccctgcctgac

SEQ ID NO: 726852 - DNA, 22 bp, Artificial Sequence
  chemically synthesized
attggatgtcaggcagggtgga

SEQ ID NO: 726853 - DNA, 22 bp, Artificial Sequence
  chemically synthesized
ttggatgtcaggcagggtggat

SEQ ID NO: 726854 - DNA, 22 bp, Artificial Sequence
  chemically synthesized
gatgtcaggcagggtggattag

SEQ ID NO: 726855 - DNA, 22 bp, Artificial Sequence
  chemically synthesized
gagtgaccttcccctaatccac

SEQ ID NO: 726856 - DNA, 22 bp, Artificial Sequence
  chemically synthesized
agagtgaccttcccctaatcca

SEQ ID NO: 726857 - DNA, 22 bp, Artificial Sequence
  chemically synthesized
agaccttagagtgaccttcccc

SEQ ID NO: 726858 - DNA, 22 bp, Artificial Sequence
  chemically synthesized
ggggaaggtcactctaaggtct

SEQ ID NO: 726859 - DNA, 22 bp, Artificial Sequence
  chemically synthesized
agtaagccaagctcagacctta

SEQ ID NO: 726860 - DNA, 22 bp, Artificial Sequence
  chemically synthesized
taagtaagccaagctcagacct

SEQ ID NO: 726861 - DNA, 22 bp, Artificial Sequence
  chemically synthesized
tctaagtaagccaagctcagac

SEQ ID NO: 726862 - DNA, 22 bp, Artificial Sequence
  chemically synthesized
ttctctaagtaagccaagctca

SEQ ID NO: 726863 - DNA, 22 bp, Artificial Sequence
  chemically synthesized
tgttctctaagtaagccaagct

SEQ ID NO: 726864 - DNA, 22 bp, Artificial Sequence
  chemically synthesized
ctgttctctaagtaagccaagc

SEQ ID NO: 726865 - DNA, 22 bp, Artificial Sequence
  chemically synthesized
taaggtctgagcttggcttact

SEQ ID NO: 726866 - DNA, 22 bp, Artificial Sequence
  chemically synthesized
tttctgttctctaagtaagcca

SEQ ID NO: 726867 - DNA, 22 bp, Artificial Sequence
  chemically synthesized
aggtctgagcttggcttactta

SEQ ID NO: 726868 - DNA, 22 bp, Artificial Sequence
  chemically synthesized
atttctgttctctaagtaagcc

SEQ ID NO: 726869 - DNA, 22 bp, Artificial Sequence
  chemically synthesized
cttatttctgttctctaagtaa

SEQ ID NO: 726870 - DNA, 22 bp, Artificial Sequence
  chemically synthesized
ccttatttctgttctctaagta

SEQ ID NO: 726871 - DNA, 22 bp, Artificial Sequence
  chemically synthesized
agcttggcttacttagagaaca

SEQ ID NO: 726872 - DNA, 22 bp, Artificial Sequence
  chemically synthesized
atttccttatttctgttctcta

SEQ ID NO: 726873 - DNA, 22 bp, Artificial Sequence
  chemically synthesized
ggcttacttagagaacagaaat

SEQ ID NO: 726874 - DNA, 22 bp, Artificial Sequence
  chemically synthesized
gcttacttagagaacagaaata

SEQ ID NO: 726875 - DNA, 22 bp, Artificial Sequence
  chemically synthesized
tacctgatttccttatttctgt

SEQ ID NO: 726876 - DNA, 22 bp, Artificial Sequence
  chemically synthesized
acttagagaacagaaataagga

SEQ ID NO: 726877 - DNA, 22 bp, Artificial Sequence
  chemically synthesized
cttagagaacagaaataaggaa

SEQ ID NO: 726878 - DNA, 22 bp, Artificial Sequence
  chemically synthesized
agagaacagaaataaggaaatc

SEQ ID NO: 726879 - DNA, 22 bp, Artificial Sequence
  chemically synthesized
gagaacagaaataaggaaatca

SEQ ID NO: 726880 - DNA, 22 bp, Artificial Sequence
  chemically synthesized
aaagcagccctatacctgattt

SEQ ID NO: 726881 - DNA, 22 bp, Artificial Sequence
  chemically synthesized
ctcaaagcagccctatacctga

SEQ ID NO: 726882 - DNA, 22 bp, Artificial Sequence
  chemically synthesized
tctcctcaaagcagccctatac

SEQ ID NO: 726883 - DNA, 22 bp, Artificial Sequence
  chemically synthesized
atctcctcaaagcagccctata

SEQ ID NO: 726884 - DNA, 22 bp, Artificial Sequence
  chemically synthesized
tcggcccatccgtttatctcct

SEQ ID NO: 726885 - DNA, 22 bp, Artificial Sequence
  chemically synthesized
atcggcccatccgtttatctcc

SEQ ID NO: 726886 - DNA, 22 bp, Artificial Sequence
  chemically synthesized
tatcggcccatccgtttatctc

SEQ ID NO: 726887 - DNA, 22 bp, Artificial Sequence
  chemically synthesized
ctttgaggagataaacggatgg

SEQ ID NO: 726888 - DNA, 22 bp, Artificial Sequence
  chemically synthesized
tgaggagataaacggatgggcc

SEQ ID NO: 726889 - DNA, 22 bp, Artificial Sequence
  chemically synthesized
gaggagataaacggatgggccg

SEQ ID NO: 726890 - DNA, 22 bp, Artificial Sequence
  chemically synthesized
aggagataaacggatgggccga

SEQ ID NO: 726891 - DNA, 22 bp, Artificial Sequence
  chemically synthesized
ccaccataagctttatcggccc

SEQ ID NO: 726892 - DNA, 22 bp, Artificial Sequence
  chemically synthesized
gccaccataagctttatcggcc

SEQ ID NO: 726893 - DNA, 22 bp, Artificial Sequence
  chemically synthesized
taagggatcttgccaccataag

SEQ ID NO: 726894 - DNA, 22 bp, Artificial Sequence
  chemically synthesized
atggtggcaagatcccttatag

SEQ ID NO: 726895 - DNA, 22 bp, Artificial Sequence
  chemically synthesized
tggtggcaagatcccttatagt

SEQ ID NO: 726896 - DNA, 22 bp, Artificial Sequence
  chemically synthesized
gtgaagcagccaaaactataag

SEQ ID NO: 726897 - DNA, 22 bp, Artificial Sequence
  chemically synthesized
gttagtgaagcagccaaaacta

SEQ ID NO: 726898 - DNA, 22 bp, Artificial Sequence
  chemically synthesized
atagttttggctgcttcactaa

SEQ ID NO: 726899 - DNA, 22 bp, Artificial Sequence
  chemically synthesized
tagttttggctgcttcactaac

SEQ ID NO: 726900 - DNA, 22 bp, Artificial Sequence
  chemically synthesized
ccataacacaactagttagtga

SEQ ID NO: 726901 - DNA, 22 bp, Artificial Sequence
  chemically synthesized
tggctgcttcactaactagttg

SEQ ID NO: 726902 - DNA, 22 bp, Artificial Sequence
  chemically synthesized
cctgccataacacaactagtta

SEQ ID NO: 726903 - DNA, 22 bp, Artificial Sequence
  chemically synthesized
ggctgcttcactaactagttgt

SEQ ID NO: 726904 - DNA, 22 bp, Artificial Sequence
  chemically synthesized
gcctgccataacacaactagtt

SEQ ID NO: 726905 - DNA, 22 bp, Artificial Sequence
  chemically synthesized
gctgcttcactaactagttgtg

SEQ ID NO: 726906 - DNA, 22 bp, Artificial Sequence
  chemically synthesized
tgcctgccataacacaactagt

SEQ ID NO: 726907 - DNA, 22 bp, Artificial Sequence
  chemically synthesized
ttgcctgccataacacaactag

SEQ ID NO: 726908 - DNA, 22 bp, Artificial Sequence
  chemically synthesized
tttgcctgccataacacaacta

SEQ ID NO: 726909 - DNA, 22 bp, Artificial Sequence
  chemically synthesized
ttttgcctgccataacacaact

SEQ ID NO: 726910 - DNA, 22 bp, Artificial Sequence
  chemically synthesized
cttcactaactagttgtgttat

SEQ ID NO: 726911 - DNA, 22 bp, Artificial Sequence
  chemically synthesized
cactaactagttgtgttatggc

SEQ ID NO: 726912 - DNA, 22 bp, Artificial Sequence
  chemically synthesized
atttttttgcctgccataacac

SEQ ID NO: 726913 - DNA, 22 bp, Artificial Sequence
  chemically synthesized
actaactagttgtgttatggca

SEQ ID NO: 726914 - DNA, 22 bp, Artificial Sequence
  chemically synthesized
actagttgtgttatggcaggca

SEQ ID NO: 726915 - DNA, 22 bp, Artificial Sequence
  chemically synthesized
gttgtgttatggcaggcaaaaa

SEQ ID NO: 726916 - DNA, 22 bp, Artificial Sequence
  chemically synthesized
tgttatggcaggcaaaaaaatt

SEQ ID NO: 726917 - DNA, 22 bp, Artificial Sequence
  chemically synthesized
aagccaagagaagctaattttt

SEQ ID NO: 726918 - DNA, 22 bp, Artificial Sequence
  chemically synthesized
tggcaggcaaaaaaattagctt

SEQ ID NO: 726919 - DNA, 22 bp, Artificial Sequence
  chemically synthesized
ggatactgaagccaagagaagc

SEQ ID NO: 726920 - DNA, 22 bp, Artificial Sequence
  chemically synthesized
aggatactgaagccaagagaag

SEQ ID NO: 726921 - DNA, 22 bp, Artificial Sequence
  chemically synthesized
taggatactgaagccaagagaa

SEQ ID NO: 726922 - DNA, 22 bp, Artificial Sequence
  chemically synthesized
tactttaggatactgaagccaa

SEQ ID NO: 726923 - DNA, 22 bp, Artificial Sequence
  chemically synthesized
gtactttaggatactgaagcca

SEQ ID NO: 726924 - DNA, 22 bp, Artificial Sequence
  chemically synthesized
tgtactttaggatactgaagcc

SEQ ID NO: 726925 - DNA, 22 bp, Artificial Sequence
  chemically synthesized
gcttctcttggcttcagtatcc

SEQ ID NO: 726926 - DNA, 22 bp, Artificial Sequence
  chemically synthesized
gttttgtactttaggatactga

SEQ ID NO: 726927 - DNA, 22 bp, Artificial Sequence
  chemically synthesized
ctcttggcttcagtatcctaaa

SEQ ID NO: 726928 - DNA, 22 bp, Artificial Sequence
  chemically synthesized
tcttggcttcagtatcctaaag

SEQ ID NO: 726929 - DNA, 22 bp, Artificial Sequence
  chemically synthesized
ttggcttcagtatcctaaagta

SEQ ID NO: 726930 - DNA, 22 bp, Artificial Sequence
  chemically synthesized
ggcttcagtatcctaaagtaca

SEQ ID NO: 726931 - DNA, 22 bp, Artificial Sequence
  chemically synthesized
gcttcagtatcctaaagtacaa

SEQ ID NO: 726932 - DNA, 22 bp, Artificial Sequence
  chemically synthesized
aacaccctcgttttgtacttta

SEQ ID NO: 726933 - DNA, 22 bp, Artificial Sequence
  chemically synthesized
cagtatcctaaagtacaaaacg

SEQ ID NO: 726934 - DNA, 22 bp, Artificial Sequence
  chemically synthesized
attcaacaccctcgttttgtac

SEQ ID NO: 726935 - DNA, 22 bp, Artificial Sequence
  chemically synthesized
agtatcctaaagtacaaaacga

SEQ ID NO: 726936 - DNA, 22 bp, Artificial Sequence
  chemically synthesized
aagtacaaaacgagggtgttga

SEQ ID NO: 726937 - DNA, 22 bp, Artificial Sequence
  chemically synthesized
agggaccatctaattcaacacc

SEQ ID NO: 726938 - DNA, 22 bp, Artificial Sequence
  chemically synthesized
gaagtaaactaagggaccatct

SEQ ID NO: 726939 - DNA, 22 bp, Artificial Sequence
  chemically synthesized
tcactagaagtaaactaaggga

SEQ ID NO: 726940 - DNA, 22 bp, Artificial Sequence
  chemically synthesized
aattagatggtcccttagttta

SEQ ID NO: 726941 - DNA, 22 bp, Artificial Sequence
  chemically synthesized
gatggtcccttagtttacttct

SEQ ID NO: 726942 - DNA, 22 bp, Artificial Sequence
  chemically synthesized
gaacattatcactagaagtaaa

SEQ ID NO: 726943 - DNA, 22 bp, Artificial Sequence
  chemically synthesized
accaactggaacattatcacta

SEQ ID NO: 726944 - DNA, 22 bp, Artificial Sequence
  chemically synthesized
caccaactggaacattatcact

SEQ ID NO: 726945 - DNA, 22 bp, Artificial Sequence
  chemically synthesized
agtttacttctagtgataatgt

SEQ ID NO: 726946 - DNA, 22 bp, Artificial Sequence
  chemically synthesized
tcaccaactggaacattatcac

SEQ ID NO: 726947 - DNA, 22 bp, Artificial Sequence
  chemically synthesized
gtttacttctagtgataatgtt

SEQ ID NO: 726948 - DNA, 22 bp, Artificial Sequence
  chemically synthesized
ttcaccaactggaacattatca

SEQ ID NO: 726949 - DNA, 22 bp, Artificial Sequence
  chemically synthesized
cttttcaccaactggaacatta

SEQ ID NO: 726950 - DNA, 22 bp, Artificial Sequence
  chemically synthesized
acttctagtgataatgttccag

SEQ ID NO: 726951 - DNA, 22 bp, Artificial Sequence
  chemically synthesized
gcttttcaccaactggaacatt

SEQ ID NO: 726952 - DNA, 22 bp, Artificial Sequence
  chemically synthesized
cttctagtgataatgttccagt

SEQ ID NO: 726953 - DNA, 22 bp, Artificial Sequence
  chemically synthesized
tgcttttcaccaactggaacat

SEQ ID NO: 726954 - DNA, 22 bp, Artificial Sequence
  chemically synthesized
ctagtgataatgttccagttgg

SEQ ID NO: 726955 - DNA, 22 bp, Artificial Sequence
  chemically synthesized
ctttgcttttcaccaactggaa

SEQ ID NO: 726956 - DNA, 22 bp, Artificial Sequence
  chemically synthesized
tagtgataatgttccagttggt

SEQ ID NO: 726957 - DNA, 22 bp, Artificial Sequence
  chemically synthesized
cctttgcttttcaccaactgga

SEQ ID NO: 726958 - DNA, 22 bp, Artificial Sequence
  chemically synthesized
tcctttgcttttcaccaactgg

SEQ ID NO: 726959 - DNA, 22 bp, Artificial Sequence
  chemically synthesized
gtgataatgttccagttggtga

SEQ ID NO: 726960 - DNA, 22 bp, Artificial Sequence
  chemically synthesized
gaattttcctttgcttttcacc

SEQ ID NO: 726961 - DNA, 22 bp, Artificial Sequence
  chemically synthesized
ctagaattttcctttgcttttc

SEQ ID NO: 726962 - DNA, 22 bp, Artificial Sequence
  chemically synthesized
cctagaattttcctttgctttt

SEQ ID NO: 726963 - DNA, 22 bp, Artificial Sequence
  chemically synthesized
cagttggtgaaaagcaaaggaa

SEQ ID NO: 726964 - DNA, 22 bp, Artificial Sequence
  chemically synthesized
gcagtttcctagaattttcctt

SEQ ID NO: 726965 - DNA, 22 bp, Artificial Sequence
  chemically synthesized
ggcagtttcctagaattttcct

SEQ ID NO: 726966 - DNA, 22 bp, Artificial Sequence
  chemically synthesized
gtgaaaagcaaaggaaaattct

SEQ ID NO: 726967 - DNA, 22 bp, Artificial Sequence
  chemically synthesized
tggcagtttcctagaattttcc

SEQ ID NO: 726968 - DNA, 22 bp, Artificial Sequence
  chemically synthesized
ttggcagtttcctagaattttc

SEQ ID NO: 726969 - DNA, 22 bp, Artificial Sequence
  chemically synthesized
ttttggcagtttcctagaattt

SEQ ID NO: 726970 - DNA, 22 bp, Artificial Sequence
  chemically synthesized
cttttggcagtttcctagaatt

SEQ ID NO: 726971 - DNA, 22 bp, Artificial Sequence
  chemically synthesized
tcttttggcagtttcctagaat

SEQ ID NO: 726972 - DNA, 22 bp, Artificial Sequence
  chemically synthesized
tttcttttggcagtttcctaga

SEQ ID NO: 726973 - DNA, 22 bp, Artificial Sequence
  chemically synthesized
ggctctttcttttggcagtttc

SEQ ID NO: 726974 - DNA, 22 bp, Artificial Sequence
  chemically synthesized
taggctctttcttttggcagtt

SEQ ID NO: 726975 - DNA, 22 bp, Artificial Sequence
  chemically synthesized
ttctaggctctttcttttggca

SEQ ID NO: 726976 - DNA, 22 bp, Artificial Sequence
  chemically synthesized
taggaaactgccaaaagaaaga

SEQ ID NO: 726977 - DNA, 22 bp, Artificial Sequence
  chemically synthesized
ggaaactgccaaaagaaagagc

SEQ ID NO: 726978 - DNA, 22 bp, Artificial Sequence
  chemically synthesized
aaaaagcctattctaggctctt

SEQ ID NO: 726979 - DNA, 22 bp, Artificial Sequence
  chemically synthesized
ccaaaagaaagagcctagaata

SEQ ID NO: 726980 - DNA, 22 bp, Artificial Sequence
  chemically synthesized
cctcaaaaagcctattctaggc

SEQ ID NO: 726981 - DNA, 22 bp, Artificial Sequence
  chemically synthesized
agaaatcgttccctcaaaaagc

SEQ ID NO: 726982 - DNA, 22 bp, Artificial Sequence
  chemically synthesized
cagaaatcgttccctcaaaaag

SEQ ID NO: 726983 - DNA, 22 bp, Artificial Sequence
  chemically synthesized
tcagaaatcgttccctcaaaaa

SEQ ID NO: 726984 - DNA, 22 bp, Artificial Sequence
  chemically synthesized
ttcagaaatcgttccctcaaaa

SEQ ID NO: 726985 - DNA, 22 bp, Artificial Sequence
  chemically synthesized
tttcagaaatcgttccctcaaa

SEQ ID NO: 726986 - DNA, 22 bp, Artificial Sequence
  chemically synthesized
gaataggctttttgagggaacg

SEQ ID NO: 726987 - DNA, 22 bp, Artificial Sequence
  chemically synthesized
tttttcagaaatcgttccctca

SEQ ID NO: 726988 - DNA, 22 bp, Artificial Sequence
  chemically synthesized
aattctttttcagaaatcgttc

SEQ ID NO: 726989 - DNA, 22 bp, Artificial Sequence
  chemically synthesized
ttcaattctttttcagaaatcg

SEQ ID NO: 726990 - DNA, 22 bp, Artificial Sequence
  chemically synthesized
tttgagggaacgatttctgaaa

SEQ ID NO: 726991 - DNA, 22 bp, Artificial Sequence
  chemically synthesized
tgttcaattctttttcagaaat

SEQ ID NO: 726992 - DNA, 22 bp, Artificial Sequence
  chemically synthesized
ttgagggaacgatttctgaaaa

SEQ ID NO: 726993 - DNA, 22 bp, Artificial Sequence
  chemically synthesized
ctgttcaattctttttcagaaa

SEQ ID NO: 726994 - DNA, 22 bp, Artificial Sequence
  chemically synthesized
tgagggaacgatttctgaaaaa

SEQ ID NO: 726995 - DNA, 22 bp, Artificial Sequence
  chemically synthesized
gagggaacgatttctgaaaaag

SEQ ID NO: 726996 - DNA, 22 bp, Artificial Sequence
  chemically synthesized
agggaacgatttctgaaaaaga

SEQ ID NO: 726997 - DNA, 22 bp, Artificial Sequence
  chemically synthesized
gcacccttctgttcaattcttt

SEQ ID NO: 726998 - DNA, 22 bp, Artificial Sequence
  chemically synthesized
agcacccttctgttcaattctt

SEQ ID NO: 726999 - DNA, 22 bp, Artificial Sequence
  chemically synthesized
tagcacccttctgttcaattct

SEQ ID NO: 727000 - DNA, 22 bp, Artificial Sequence
  chemically synthesized
ttagcacccttctgttcaattc

SEQ ID NO: 727001 - DNA, 22 bp, Artificial Sequence
  chemically synthesized
tttagcacccttctgttcaatt

SEQ ID NO: 727002 - DNA, 22 bp, Artificial Sequence
  chemically synthesized
ctgaaaaagaattgaacagaag

SEQ ID NO: 727003 - DNA, 22 bp, Artificial Sequence
  chemically synthesized
tgaaaaagaattgaacagaagg

SEQ ID NO: 727004 - DNA, 22 bp, Artificial Sequence
  chemically synthesized
aaaaagaattgaacagaagggt

SEQ ID NO: 727005 - DNA, 22 bp, Artificial Sequence
  chemically synthesized
caataaactttttagcaccctt

SEQ ID NO: 727006 - DNA, 22 bp, Artificial Sequence
  chemically synthesized
aacagaagggtgctaaaaagtt

SEQ ID NO: 727007 - DNA, 22 bp, Artificial Sequence
  chemically synthesized
aaaagtttattgtaattcttct

SEQ ID NO: 727008 - DNA, 22 bp, Artificial Sequence
  chemically synthesized
agagcagtaagacagaagaatt

SEQ ID NO: 727009 - DNA, 22 bp, Artificial Sequence
  chemically synthesized
ctgagagcagtaagacagaaga

SEQ ID NO: 727010 - DNA, 22 bp, Artificial Sequence
  chemically synthesized
gctgagagcagtaagacagaag

SEQ ID NO: 727011 - DNA, 22 bp, Artificial Sequence
  chemically synthesized
attgtaattcttctgtcttact

SEQ ID NO: 727012 - DNA, 22 bp, Artificial Sequence
  chemically synthesized
tttgctgagagcagtaagacag

SEQ ID NO: 727013 - DNA, 22 bp, Artificial Sequence
  chemically synthesized
ttgtaattcttctgtcttactg

SEQ ID NO: 727014 - DNA, 22 bp, Artificial Sequence
  chemically synthesized
atttgctgagagcagtaagaca

SEQ ID NO: 727015 - DNA, 22 bp, Artificial Sequence
  chemically synthesized
tatttgctgagagcagtaagac

SEQ ID NO: 727016 - DNA, 22 bp, Artificial Sequence
  chemically synthesized
taattcttctgtcttactgctc

SEQ ID NO: 727017 - DNA, 22 bp, Artificial Sequence
  chemically synthesized
atctttatttgctgagagcagt

SEQ ID NO: 727018 - DNA, 22 bp, Artificial Sequence
  chemically synthesized
gatctttatttgctgagagcag

SEQ ID NO: 727019 - DNA, 22 bp, Artificial Sequence
  chemically synthesized
ttctgtcttactgctctcagca

SEQ ID NO: 727020 - DNA, 22 bp, Artificial Sequence
  chemically synthesized
tttgatctttatttgctgagag

SEQ ID NO: 727021 - DNA, 22 bp, Artificial Sequence
  chemically synthesized
ctgtcttactgctctcagcaaa

SEQ ID NO: 727022 - DNA, 22 bp, Artificial Sequence
  chemically synthesized
tgtcttactgctctcagcaaat

SEQ ID NO: 727023 - DNA, 22 bp, Artificial Sequence
  chemically synthesized
tcttactgctctcagcaaataa

SEQ ID NO: 727024 - DNA, 22 bp, Artificial Sequence
  chemically synthesized
actgctctcagcaaataaagat

SEQ ID NO: 727025 - DNA, 22 bp, Artificial Sequence
  chemically synthesized
ctgctctcagcaaataaagatc

SEQ ID NO: 727026 - DNA, 22 bp, Artificial Sequence
  chemically synthesized
ctctcagcaaataaagatcaaa

SEQ ID NO: 727027 - DNA, 22 bp, Artificial Sequence
  chemically synthesized
tcagcaaataaagatcaaacag

SEQ ID NO: 727028 - DNA, 22 bp, Artificial Sequence
  chemically synthesized
agcaaataaagatcaaacaggg

SEQ ID NO: 727029 - DNA, 22 bp, Artificial Sequence
  chemically synthesized
caaacacaaataccctgtttga

SEQ ID NO: 727030 - DNA, 22 bp, Artificial Sequence
  chemically synthesized
gcaaacacaaataccctgtttg

SEQ ID NO: 727031 - DNA, 22 bp, Artificial Sequence
  chemically synthesized
accttgcaaacacaaataccct

SEQ ID NO: 727032 - DNA, 22 bp, Artificial Sequence
  chemically synthesized
gaccttgcaaacacaaataccc

SEQ ID NO: 727033 - DNA, 22 bp, Artificial Sequence
  chemically synthesized
tgaccttgcaaacacaaatacc

SEQ ID NO: 727034 - DNA, 22 bp, Artificial Sequence
  chemically synthesized
ctttgaccttgcaaacacaaat

SEQ ID NO: 727035 - DNA, 22 bp, Artificial Sequence
  chemically synthesized
actttgaccttgcaaacacaaa

SEQ ID NO: 727036 - DNA, 22 bp, Artificial Sequence
  chemically synthesized
gtttactttgaccttgcaaaca

SEQ ID NO: 727037 - DNA, 22 bp, Artificial Sequence
  chemically synthesized
gtgtttgcaaggtcaaagtaaa

SEQ ID NO: 727038 - DNA, 22 bp, Artificial Sequence
  chemically synthesized
tgtttgcaaggtcaaagtaaac

SEQ ID NO: 727039 - DNA, 22 bp, Artificial Sequence
  chemically synthesized
ataatggacactagtttacttt

SEQ ID NO: 727040 - DNA, 22 bp, Artificial Sequence
  chemically synthesized
gataatggacactagtttactt

SEQ ID NO: 727041 - DNA, 22 bp, Artificial Sequence
  chemically synthesized
gcaaggtcaaagtaaactagtg

SEQ ID NO: 727042 - DNA, 22 bp, Artificial Sequence
  chemically synthesized
caaggtcaaagtaaactagtgt

SEQ ID NO: 727043 - DNA, 22 bp, Artificial Sequence
  chemically synthesized
agccatttgataatggacacta

SEQ ID NO: 727044 - DNA, 22 bp, Artificial Sequence
  chemically synthesized
agagtcattcagccatttgata

SEQ ID NO: 727045 - DNA, 22 bp, Artificial Sequence
  chemically synthesized
gtgtccattatcaaatggctga

SEQ ID NO: 727046 - DNA, 22 bp, Artificial Sequence
  chemically synthesized
agccagttaagagtcattcagc

SEQ ID NO: 727047 - DNA, 22 bp, Artificial Sequence
  chemically synthesized
tgagccagttaagagtcattca

SEQ ID NO: 727048 - DNA, 22 bp, Artificial Sequence
  chemically synthesized
tctgagccagttaagagtcatt

SEQ ID NO: 727049 - DNA, 22 bp, Artificial Sequence
  chemically synthesized
tcaaatggctgaatgactctta

SEQ ID NO: 727050 - DNA, 22 bp, Artificial Sequence
  chemically synthesized
ctctgagccagttaagagtcat

SEQ ID NO: 727051 - DNA, 22 bp, Artificial Sequence
  chemically synthesized
tctctgagccagttaagagtca

SEQ ID NO: 727052 - DNA, 22 bp, Artificial Sequence
  chemically synthesized
atctttctctgagccagttaag

SEQ ID NO: 727053 - DNA, 22 bp, Artificial Sequence
  chemically synthesized
tgatctttctctgagccagtta

SEQ ID NO: 727054 - DNA, 22 bp, Artificial Sequence
  chemically synthesized
ctgatctttctctgagccagtt

SEQ ID NO: 727055 - DNA, 22 bp, Artificial Sequence
  chemically synthesized
tctgatctttctctgagccagt

SEQ ID NO: 727056 - DNA, 22 bp, Artificial Sequence
  chemically synthesized
aatgactcttaactggctcaga

SEQ ID NO: 727057 - DNA, 22 bp, Artificial Sequence
  chemically synthesized
tacattttctgatctttctctg

SEQ ID NO: 727058 - DNA, 22 bp, Artificial Sequence
  chemically synthesized
ttaactggctcagagaaagatc

SEQ ID NO: 727059 - DNA, 22 bp, Artificial Sequence
  chemically synthesized
ctatacattttctgatctttct

SEQ ID NO: 727060 - DNA, 22 bp, Artificial Sequence
  chemically synthesized
aactggctcagagaaagatcag

SEQ ID NO: 727061 - DNA, 22 bp, Artificial Sequence
  chemically synthesized
actggctcagagaaagatcaga

SEQ ID NO: 727062 - DNA, 22 bp, Artificial Sequence
  chemically synthesized
tcctatacattttctgatcttt

SEQ ID NO: 727063 - DNA, 22 bp, Artificial Sequence
  chemically synthesized
ctcctatacattttctgatctt

SEQ ID NO: 727064 - DNA, 22 bp, Artificial Sequence
  chemically synthesized
tctcctatacattttctgatct

SEQ ID NO: 727065 - DNA, 22 bp, Artificial Sequence
  chemically synthesized
gctcagagaaagatcagaaaat

SEQ ID NO: 727066 - DNA, 22 bp, Artificial Sequence
  chemically synthesized
gttttctcctatacattttctg

SEQ ID NO: 727067 - DNA, 22 bp, Artificial Sequence
  chemically synthesized
agagaaagatcagaaaatgtat

SEQ ID NO: 727068 - DNA, 22 bp, Artificial Sequence
  chemically synthesized
cattagttttctcctatacatt

SEQ ID NO: 727069 - DNA, 22 bp, Artificial Sequence
  chemically synthesized
ccattagttttctcctatacat

SEQ ID NO: 727070 - DNA, 22 bp, Artificial Sequence
  chemically synthesized
tccattagttttctcctataca

SEQ ID NO: 727071 - DNA, 22 bp, Artificial Sequence
  chemically synthesized
tttccattagttttctcctata

SEQ ID NO: 727072 - DNA, 22 bp, Artificial Sequence
  chemically synthesized
atcactctttccattagttttc

SEQ ID NO: 727073 - DNA, 22 bp, Artificial Sequence
  chemically synthesized
atggaaagagtgattaacgtga

SEQ ID NO: 727074 - DNA, 22 bp, Artificial Sequence
  chemically synthesized
gagccagaaacgatcacgttaa

SEQ ID NO: 727075 - DNA, 22 bp, Artificial Sequence
  chemically synthesized
ggagccagaaacgatcacgtta

SEQ ID NO: 727076 - DNA, 22 bp, Artificial Sequence
  chemically synthesized
tggagccagaaacgatcacgtt

SEQ ID NO: 727077 - DNA, 22 bp, Artificial Sequence
  chemically synthesized
tttggagccagaaacgatcacg

SEQ ID NO: 727078 - DNA, 22 bp, Artificial Sequence
  chemically synthesized
ttctttggagccagaaacgatc

SEQ ID NO: 727079 - DNA, 22 bp, Artificial Sequence
  chemically synthesized
attctttggagccagaaacgat

SEQ ID NO: 727080 - DNA, 22 bp, Artificial Sequence
  chemically synthesized
cttattctttggagccagaaac

SEQ ID NO: 727081 - DNA, 22 bp, Artificial Sequence
  chemically synthesized
ccttattctttggagccagaaa

SEQ ID NO: 727082 - DNA, 22 bp, Artificial Sequence
  chemically synthesized
acgtgatcgtttctggctccaa

SEQ ID NO: 727083 - DNA, 22 bp, Artificial Sequence
  chemically synthesized
ccatgtttccttattctttgga

SEQ ID NO: 727084 - DNA, 22 bp, Artificial Sequence
  chemically synthesized
cccatgtttccttattctttgg

SEQ ID NO: 727085 - DNA, 22 bp, Artificial Sequence
  chemically synthesized
atttcccatgtttccttattct

SEQ ID NO: 727086 - DNA, 22 bp, Artificial Sequence
  chemically synthesized
catttcccatgtttccttattc

SEQ ID NO: 727087 - DNA, 22 bp, Artificial Sequence
  chemically synthesized
ctggctccaaagaataaggaaa

SEQ ID NO: 727088 - DNA, 22 bp, Artificial Sequence
  chemically synthesized
tggctccaaagaataaggaaac

SEQ ID NO: 727089 - DNA, 22 bp, Artificial Sequence
  chemically synthesized
ttcatttcccatgtttccttat

SEQ ID NO: 727090 - DNA, 22 bp, Artificial Sequence
  chemically synthesized
cttcatttcccatgtttcctta

SEQ ID NO: 727091 - DNA, 22 bp, Artificial Sequence
  chemically synthesized
gctccaaagaataaggaaacat

SEQ ID NO: 727092 - DNA, 22 bp, Artificial Sequence
  chemically synthesized
caaagaataaggaaacatggga

SEQ ID NO: 727093 - DNA, 22 bp, Artificial Sequence
  chemically synthesized
atatttcttcatttcccatgtt

SEQ ID NO: 727094 - DNA, 22 bp, Artificial Sequence
  chemically synthesized
catatttcttcatttcccatgt

SEQ ID NO: 727095 - DNA, 22 bp, Artificial Sequence
  chemically synthesized
ttcatatttcttcatttcccat

SEQ ID NO: 727096 - DNA, 22 bp, Artificial Sequence
  chemically synthesized
cttcatatttcttcatttccca

SEQ ID NO: 727097 - DNA, 22 bp, Artificial Sequence
  chemically synthesized
atacttcttcatatttcttcat

SEQ ID NO: 727098 - DNA, 22 bp, Artificial Sequence
  chemically synthesized
cctcatacttcttcatatttct

SEQ ID NO: 727099 - DNA, 22 bp, Artificial Sequence
  chemically synthesized
gcctcatacttcttcatatttc

SEQ ID NO: 727100 - DNA, 22 bp, Artificial Sequence
  chemically synthesized
ttgcctcatacttcttcatatt

SEQ ID NO: 727101 - DNA, 22 bp, Artificial Sequence
  chemically synthesized
cttgcctcatacttcttcatat

SEQ ID NO: 727102 - DNA, 22 bp, Artificial Sequence
  chemically synthesized
tttcttgcctcatacttcttca

SEQ ID NO: 727103 - DNA, 22 bp, Artificial Sequence
  chemically synthesized
atttcttgcctcatacttcttc

SEQ ID NO: 727104 - DNA, 22 bp, Artificial Sequence
  chemically synthesized
tatttcttgcctcatacttctt

SEQ ID NO: 727105 - DNA, 22 bp, Artificial Sequence
  chemically synthesized
tctttatttcttgcctcatact

SEQ ID NO: 727106 - DNA, 22 bp, Artificial Sequence
  chemically synthesized
tattatctttatttcttgcctc

SEQ ID NO: 727107 - DNA, 22 bp, Artificial Sequence
  chemically synthesized
atattatctttatttcttgcct

SEQ ID NO: 727108 - DNA, 22 bp, Artificial Sequence
  chemically synthesized
atttatattatctttatttctt

SEQ ID NO: 727109 - DNA, 22 bp, Artificial Sequence
  chemically synthesized
ttcatttatattatctttattt

SEQ ID NO: 727110 - DNA, 22 bp, Artificial Sequence
  chemically synthesized
aataggcaacccaaataatcat

SEQ ID NO: 727111 - DNA, 22 bp, Artificial Sequence
  chemically synthesized
tctaaataggcaacccaaataa

SEQ ID NO: 727112 - DNA, 22 bp, Artificial Sequence
  chemically synthesized
gtctaaataggcaacccaaata

SEQ ID NO: 727113 - DNA, 22 bp, Artificial Sequence
  chemically synthesized
ttgtctaaataggcaacccaaa

SEQ ID NO: 727114 - DNA, 22 bp, Artificial Sequence
  chemically synthesized
cttgtctaaataggcaacccaa

SEQ ID NO: 727115 - DNA, 22 bp, Artificial Sequence
  chemically synthesized
tcttgtctaaataggcaaccca

SEQ ID NO: 727116 - DNA, 22 bp, Artificial Sequence
  chemically synthesized
ttttcttgtctaaataggcaac

SEQ ID NO: 727117 - DNA, 22 bp, Artificial Sequence
  chemically synthesized
tgattatttgggttgcctattt

SEQ ID NO: 727118 - DNA, 22 bp, Artificial Sequence
  chemically synthesized
tttgggttgcctatttagacaa

SEQ ID NO: 727119 - DNA, 22 bp, Artificial Sequence
  chemically synthesized
gggttgcctatttagacaagaa

SEQ ID NO: 727120 - DNA, 22 bp, Artificial Sequence
  chemically synthesized
ggttgcctatttagacaagaaa

SEQ ID NO: 727121 - DNA, 22 bp, Artificial Sequence
  chemically synthesized
tcgatgccctattttcttgtct

SEQ ID NO: 727122 - DNA, 22 bp, Artificial Sequence
  chemically synthesized
cctatttagacaagaaaatagg

SEQ ID NO: 727123 - DNA, 22 bp, Artificial Sequence
  chemically synthesized
tttagacaagaaaatagggcat

SEQ ID NO: 727124 - DNA, 22 bp, Artificial Sequence
  chemically synthesized
agacaagaaaatagggcatcga

SEQ ID NO: 727125 - DNA, 22 bp, Artificial Sequence
  chemically synthesized
gacaagaaaatagggcatcgat

SEQ ID NO: 727126 - DNA, 22 bp, Artificial Sequence
  chemically synthesized
ggaggcatgagagattatcgat

SEQ ID NO: 727127 - DNA, 22 bp, Artificial Sequence
  chemically synthesized
tactaggaggcatgagagatta

SEQ ID NO: 727128 - DNA, 22 bp, Artificial Sequence
  chemically synthesized
caattgtactaggaggcatgag

SEQ ID NO: 727129 - DNA, 22 bp, Artificial Sequence
  chemically synthesized
ccaattgtactaggaggcatga

SEQ ID NO: 727130 - DNA, 22 bp, Artificial Sequence
  chemically synthesized
tccaattgtactaggaggcatg

SEQ ID NO: 727131 - DNA, 22 bp, Artificial Sequence
  chemically synthesized
ttccaattgtactaggaggcat

SEQ ID NO: 727132 - DNA, 22 bp, Artificial Sequence
  chemically synthesized
ttttccaattgtactaggaggc

SEQ ID NO: 727133 - DNA, 22 bp, Artificial Sequence
  chemically synthesized
cttttccaattgtactaggagg

SEQ ID NO: 727134 - DNA, 22 bp, Artificial Sequence
  chemically synthesized
tcttttccaattgtactaggag

SEQ ID NO: 727135 - DNA, 22 bp, Artificial Sequence
  chemically synthesized
gttttcttttccaattgtacta

SEQ ID NO: 727136 - DNA, 22 bp, Artificial Sequence
  chemically synthesized
tcatgcctcctagtacaattgg

SEQ ID NO: 727137 - DNA, 22 bp, Artificial Sequence
  chemically synthesized
atgcctcctagtacaattggaa

SEQ ID NO: 727138 - DNA, 22 bp, Artificial Sequence
  chemically synthesized
gcattagttttcttttccaatt

SEQ ID NO: 727139 - DNA, 22 bp, Artificial Sequence
  chemically synthesized
ctagtacaattggaaaagaaaa

SEQ ID NO: 727140 - DNA, 22 bp, Artificial Sequence
  chemically synthesized
gtacaattggaaaagaaaacta

SEQ ID NO: 727141 - DNA, 22 bp, Artificial Sequence
  chemically synthesized
gtgatactagcattagttttct

SEQ ID NO: 727142 - DNA, 22 bp, Artificial Sequence
  chemically synthesized
ctagtgatactagcattagttt

SEQ ID NO: 727143 - DNA, 22 bp, Artificial Sequence
  chemically synthesized
cctagtgatactagcattagtt

SEQ ID NO: 727144 - DNA, 22 bp, Artificial Sequence
  chemically synthesized
tcctagtgatactagcattagt

SEQ ID NO: 727145 - DNA, 22 bp, Artificial Sequence
  chemically synthesized
ttcctagtgatactagcattag

SEQ ID NO: 727146 - DNA, 22 bp, Artificial Sequence
  chemically synthesized
gaaaagaaaactaatgctagta

SEQ ID NO: 727147 - DNA, 22 bp, Artificial Sequence
  chemically synthesized
tgtcttttcctagtgatactag

SEQ ID NO: 727148 - DNA, 22 bp, Artificial Sequence
  chemically synthesized
tatgtcttttcctagtgatact

SEQ ID NO: 727149 - DNA, 22 bp, Artificial Sequence
  chemically synthesized
ctatgtcttttcctagtgatac

SEQ ID NO: 727150 - DNA, 22 bp, Artificial Sequence
  chemically synthesized
ttctatgtcttttcctagtgat

SEQ ID NO: 727151 - DNA, 22 bp, Artificial Sequence
  chemically synthesized
atgctagtatcactaggaaaag

SEQ ID NO: 727152 - DNA, 22 bp, Artificial Sequence
  chemically synthesized
gtatcactaggaaaagacatag

SEQ ID NO: 727153 - DNA, 22 bp, Artificial Sequence
  chemically synthesized
aaagtaattcttctatgtcttt

SEQ ID NO: 727154 - DNA, 22 bp, Artificial Sequence
  chemically synthesized
taaaagtaattcttctatgtct

SEQ ID NO: 727155 - DNA, 22 bp, Artificial Sequence
  chemically synthesized
ggaaaagacatagaagaattac

SEQ ID NO: 727156 - DNA, 22 bp, Artificial Sequence
  chemically synthesized
atgattctaaaagtaattcttc

SEQ ID NO: 727157 - DNA, 22 bp, Artificial Sequence
  chemically synthesized
gatgattctaaaagtaattctt

SEQ ID NO: 727158 - DNA, 22 bp, Artificial Sequence
  chemically synthesized
tgatgattctaaaagtaattct

SEQ ID NO: 727159 - DNA, 22 bp, Artificial Sequence
  chemically synthesized
ttgatgattctaaaagtaattc

SEQ ID NO: 727160 - DNA, 22 bp, Artificial Sequence
  chemically synthesized
tttgatgattctaaaagtaatt

SEQ ID NO: 727161 - DNA, 22 bp, Artificial Sequence
  chemically synthesized
ttttttgatgattctaaaagta

SEQ ID NO: 727162 - DNA, 22 bp, Artificial Sequence
  chemically synthesized
attttttgatgattctaaaagt

SEQ ID NO: 727163 - DNA, 22 bp, Artificial Sequence
  chemically synthesized
aaacttattttttgatgattct

SEQ ID NO: 727164 - DNA, 22 bp, Artificial Sequence
  chemically synthesized
caaacttattttttgatgattc

SEQ ID NO: 727165 - DNA, 22 bp, Artificial Sequence
  chemically synthesized
tcaaacttattttttgatgatt

SEQ ID NO: 727166 - DNA, 22 bp, Artificial Sequence
  chemically synthesized
cttttagaatcatcaaaaaata

SEQ ID NO: 727167 - DNA, 22 bp, Artificial Sequence
  chemically synthesized
ttagaatcatcaaaaaataagt

SEQ ID NO: 727168 - DNA, 22 bp, Artificial Sequence
  chemically synthesized
tagaatcatcaaaaaataagtt

SEQ ID NO: 727169 - DNA, 22 bp, Artificial Sequence
  chemically synthesized
caaaagctttcaaacttatttt

SEQ ID NO: 727170 - DNA, 22 bp, Artificial Sequence
  chemically synthesized
agaatcatcaaaaaataagttt

SEQ ID NO: 727171 - DNA, 22 bp, Artificial Sequence
  chemically synthesized
gcaaaagctttcaaacttattt

SEQ ID NO: 727172 - DNA, 22 bp, Artificial Sequence
  chemically synthesized
gaatcatcaaaaaataagtttg

SEQ ID NO: 727173 - DNA, 22 bp, Artificial Sequence
  chemically synthesized
tgcaaaagctttcaaacttatt

SEQ ID NO: 727174 - DNA, 22 bp, Artificial Sequence
  chemically synthesized
ttgcaaaagctttcaaacttat

SEQ ID NO: 727175 - DNA, 22 bp, Artificial Sequence
  chemically synthesized
tttgcaaaagctttcaaactta

SEQ ID NO: 727176 - DNA, 22 bp, Artificial Sequence
  chemically synthesized
tgctttttgcaaaagctttcaa

SEQ ID NO: 727177 - DNA, 22 bp, Artificial Sequence
  chemically synthesized
tgtgctttttgcaaaagctttc

SEQ ID NO: 727178 - DNA, 22 bp, Artificial Sequence
  chemically synthesized
ctgtgctttttgcaaaagcttt

SEQ ID NO: 727179 - DNA, 22 bp, Artificial Sequence
  chemically synthesized
acttctgtgctttttgcaaaag

SEQ ID NO: 727180 - DNA, 22 bp, Artificial Sequence
  chemically synthesized
gaaagcttttgcaaaaagcaca

SEQ ID NO: 727181 - DNA, 22 bp, Artificial Sequence
  chemically synthesized
aaagcttttgcaaaaagcacag

SEQ ID NO: 727182 - DNA, 22 bp, Artificial Sequence
  chemically synthesized
aaaacattcacttctgtgcttt

SEQ ID NO: 727183 - DNA, 22 bp, Artificial Sequence
  chemically synthesized
caaaacattcacttctgtgctt

SEQ ID NO: 727184 - DNA, 22 bp, Artificial Sequence
  chemically synthesized
cttcaaaacattcacttctgtg

SEQ ID NO: 727185 - DNA, 22 bp, Artificial Sequence
  chemically synthesized
gcttcaaaacattcacttctgt

SEQ ID NO: 727186 - DNA, 22 bp, Artificial Sequence
  chemically synthesized
ttgcaaaaagcacagaagtgaa

SEQ ID NO: 727187 - DNA, 22 bp, Artificial Sequence
  chemically synthesized
tgcaaaaagcacagaagtgaat

SEQ ID NO: 727188 - DNA, 22 bp, Artificial Sequence
  chemically synthesized
gcaaaaagcacagaagtgaatg

SEQ ID NO: 727189 - DNA, 22 bp, Artificial Sequence
  chemically synthesized
caaaaagcacagaagtgaatgt

SEQ ID NO: 727190 - DNA, 22 bp, Artificial Sequence
  chemically synthesized
atttgcttcaaaacattcactt

SEQ ID NO: 727191 - DNA, 22 bp, Artificial Sequence
  chemically synthesized
catttgcttcaaaacattcact

SEQ ID NO: 727192 - DNA, 22 bp, Artificial Sequence
  chemically synthesized
gtttcatttgcttcaaaacatt

SEQ ID NO: 727193 - DNA, 22 bp, Artificial Sequence
  chemically synthesized
ccattagtttcatttgcttcaa

SEQ ID NO: 727194 - DNA, 22 bp, Artificial Sequence
  chemically synthesized
taattcccattagtttcatttg

SEQ ID NO: 727195 - DNA, 22 bp, Artificial Sequence
  chemically synthesized
attataattcccattagtttca

SEQ ID NO: 727196 - DNA, 22 bp, Artificial Sequence
  chemically synthesized
tgaagcaaatgaaactaatggg

SEQ ID NO: 727197 - DNA, 22 bp, Artificial Sequence
  chemically synthesized
gaagcaaatgaaactaatggga

SEQ ID NO: 727198 - DNA, 22 bp, Artificial Sequence
  chemically synthesized
aagcaaatgaaactaatgggaa

SEQ ID NO: 727199 - DNA, 22 bp, Artificial Sequence
  chemically synthesized
tgtgtctcattataattcccat

SEQ ID NO: 727200 - DNA, 22 bp, Artificial Sequence
  chemically synthesized
ctatgtgtctcattataattcc

SEQ ID NO: 727201 - DNA, 22 bp, Artificial Sequence
  chemically synthesized
taaaactgctatgtgtctcatt

SEQ ID NO: 727202 - DNA, 22 bp, Artificial Sequence
  chemically synthesized
atgggaattataatgagacaca

SEQ ID NO: 727203 - DNA, 22 bp, Artificial Sequence
  chemically synthesized
taatgagacacatagcagtttt

SEQ ID NO: 727204 - DNA, 22 bp, Artificial Sequence
  chemically synthesized
caagagaggcaagattataaaa

SEQ ID NO: 727205 - DNA, 22 bp, Artificial Sequence
  chemically synthesized
acacattacaagagaggcaaga

SEQ ID NO: 727206 - DNA, 22 bp, Artificial Sequence
  chemically synthesized
tgacacattacaagagaggcaa

SEQ ID NO: 727207 - DNA, 22 bp, Artificial Sequence
  chemically synthesized
tctgacacattacaagagaggc

SEQ ID NO: 727208 - DNA, 22 bp, Artificial Sequence
  chemically synthesized
tataatcttgcctctcttgtaa

SEQ ID NO: 727209 - DNA, 22 bp, Artificial Sequence
  chemically synthesized
ttctctgacacattacaagaga

SEQ ID NO: 727210 - DNA, 22 bp, Artificial Sequence
  chemically synthesized
ataatcttgcctctcttgtaat

SEQ ID NO: 727211 - DNA, 22 bp, Artificial Sequence
  chemically synthesized
gttctctgacacattacaagag

SEQ ID NO: 727212 - DNA, 22 bp, Artificial Sequence
  chemically synthesized
taatcttgcctctcttgtaatg

SEQ ID NO: 727213 - DNA, 22 bp, Artificial Sequence
  chemically synthesized
ttgttctctgacacattacaag

SEQ ID NO: 727214 - DNA, 22 bp, Artificial Sequence
  chemically synthesized
gcctctcttgtaatgtgtcaga

SEQ ID NO: 727215 - DNA, 22 bp, Artificial Sequence
  chemically synthesized
cctctcttgtaatgtgtcagag

SEQ ID NO: 727216 - DNA, 22 bp, Artificial Sequence
  chemically synthesized
tcttgtaatgtgtcagagaaca

SEQ ID NO: 727217 - DNA, 22 bp, Artificial Sequence
  chemically synthesized
ttgtaatgtgtcagagaacaag

SEQ ID NO: 727218 - DNA, 22 bp, Artificial Sequence
  chemically synthesized
aaatagcagggttcttgttctc

SEQ ID NO: 727219 - DNA, 22 bp, Artificial Sequence
  chemically synthesized
gtaatgtgtcagagaacaagaa

SEQ ID NO: 727220 - DNA, 22 bp, Artificial Sequence
  chemically synthesized
taatgtgtcagagaacaagaac

SEQ ID NO: 727221 - DNA, 22 bp, Artificial Sequence
  chemically synthesized
gcaccgtatagacaaagcgtgt

SEQ ID NO: 727222 - DNA, 22 bp, Artificial Sequence
  chemically synthesized
ctattttaacacgctttgtcta

SEQ ID NO: 727223 - DNA, 22 bp, Artificial Sequence
  chemically synthesized
ttttaacacgctttgtctatac

SEQ ID NO: 727224 - DNA, 22 bp, Artificial Sequence
  chemically synthesized
agtgttggcaccgtatagacaa

SEQ ID NO: 727225 - DNA, 22 bp, Artificial Sequence
  chemically synthesized
taacacgctttgtctatacggt

SEQ ID NO: 727226 - DNA, 22 bp, Artificial Sequence
  chemically synthesized
aacacgctttgtctatacggtg

SEQ ID NO: 727227 - DNA, 22 bp, Artificial Sequence
  chemically synthesized
acacgctttgtctatacggtgc

SEQ ID NO: 727228 - DNA, 22 bp, Artificial Sequence
  chemically synthesized
gtgtcaagttcagtgttggcac

SEQ ID NO: 727229 - DNA, 22 bp, Artificial Sequence
  chemically synthesized
cgtgtcaagttcagtgttggca

SEQ ID NO: 727230 - DNA, 22 bp, Artificial Sequence
  chemically synthesized
tgtctatacggtgccaacactg

SEQ ID NO: 727231 - DNA, 22 bp, Artificial Sequence
  chemically synthesized
gtctatacggtgccaacactga

SEQ ID NO: 727232 - DNA, 22 bp, Artificial Sequence
  chemically synthesized
ttcgtgtcaagttcagtgttgg

SEQ ID NO: 727233 - DNA, 22 bp, Artificial Sequence
  chemically synthesized
tctatacggtgccaacactgaa

SEQ ID NO: 727234 - DNA, 22 bp, Artificial Sequence
  chemically synthesized
tcttcgtgtcaagttcagtgtt

SEQ ID NO: 727235 - DNA, 22 bp, Artificial Sequence
  chemically synthesized
ctcttcgtgtcaagttcagtgt

SEQ ID NO: 727236 - DNA, 22 bp, Artificial Sequence
  chemically synthesized
tacggtgccaacactgaacttg

SEQ ID NO: 727237 - DNA, 22 bp, Artificial Sequence
  chemically synthesized
ttctcttcgtgtcaagttcagt

SEQ ID NO: 727238 - DNA, 22 bp, Artificial Sequence
  chemically synthesized
cttctcttcgtgtcaagttcag

SEQ ID NO: 727239 - DNA, 22 bp, Artificial Sequence
  chemically synthesized
tcttctcttcgtgtcaagttca

SEQ ID NO: 727240 - DNA, 22 bp, Artificial Sequence
  chemically synthesized
aacttgacacgaagagaagaaa

SEQ ID NO: 727241 - DNA, 22 bp, Artificial Sequence
  chemically synthesized
atcagaaaggactttcttctct

SEQ ID NO: 727242 - DNA, 22 bp, Artificial Sequence
  chemically synthesized
tcatcagaaaggactttcttct

SEQ ID NO: 727243 - DNA, 22 bp, Artificial Sequence
  chemically synthesized
gacacgaagagaagaaagtcct

SEQ ID NO: 727244 - DNA, 22 bp, Artificial Sequence
  chemically synthesized
acacgaagagaagaaagtcctt

SEQ ID NO: 727245 - DNA, 22 bp, Artificial Sequence
  chemically synthesized
catgctctcatcagaaaggact

SEQ ID NO: 727246 - DNA, 22 bp, Artificial Sequence
  chemically synthesized
tctgatgagagcatgtagtatc

SEQ ID NO: 727247 - DNA, 22 bp, Artificial Sequence
  chemically synthesized
gaaacagatccagatactacat

SEQ ID NO: 727248 - DNA, 22 bp, Artificial Sequence
  chemically synthesized
ctgatgagagcatgtagtatct

SEQ ID NO: 727249 - DNA, 22 bp, Artificial Sequence
  chemically synthesized
tgatgagagcatgtagtatctg

SEQ ID NO: 727250 - DNA, 22 bp, Artificial Sequence
  chemically synthesized
atgagagcatgtagtatctgga

SEQ ID NO: 727251 - DNA, 22 bp, Artificial Sequence
  chemically synthesized
aaatgaatcacatagtctagaa

SEQ ID NO: 727252 - DNA, 22 bp, Artificial Sequence
  chemically synthesized
aaaatgaatcacatagtctaga

SEQ ID NO: 727253 - DNA, 22 bp, Artificial Sequence
  chemically synthesized
taaaatgaatcacatagtctag

SEQ ID NO: 727254 - DNA, 22 bp, Artificial Sequence
  chemically synthesized
gatctgtttctagactatgtga

SEQ ID NO: 727255 - DNA, 22 bp, Artificial Sequence
  chemically synthesized
gaaatctttaaaatgaatcaca

SEQ ID NO: 727256 - DNA, 22 bp, Artificial Sequence
  chemically synthesized
tttctagactatgtgattcatt

SEQ ID NO: 727257 - DNA, 22 bp, Artificial Sequence
  chemically synthesized
agaaatctttaaaatgaatcac

SEQ ID NO: 727258 - DNA, 22 bp, Artificial Sequence
  chemically synthesized
ctagactatgtgattcatttta

SEQ ID NO: 727259 - DNA, 22 bp, Artificial Sequence
  chemically synthesized
cttagaaatctttaaaatgaat

SEQ ID NO: 727260 - DNA, 22 bp, Artificial Sequence
  chemically synthesized
tagactatgtgattcattttaa

SEQ ID NO: 727261 - DNA, 22 bp, Artificial Sequence
  chemically synthesized
ccttagaaatctttaaaatgaa

SEQ ID NO: 727262 - DNA, 22 bp, Artificial Sequence
  chemically synthesized
tccttagaaatctttaaaatga

SEQ ID NO: 727263 - DNA, 22 bp, Artificial Sequence
  chemically synthesized
gactatgtgattcattttaaag

SEQ ID NO: 727264 - DNA, 22 bp, Artificial Sequence
  chemically synthesized
tgtgattcattttaaagatttc

SEQ ID NO: 727265 - DNA, 22 bp, Artificial Sequence
  chemically synthesized
gatgtgtcctttccttagaaat

SEQ ID NO: 727266 - DNA, 22 bp, Artificial Sequence
  chemically synthesized
attttaaagatttctaaggaaa

SEQ ID NO: 727267 - DNA, 22 bp, Artificial Sequence
  chemically synthesized
taaagatttctaaggaaaggac

SEQ ID NO: 727268 - DNA, 22 bp, Artificial Sequence
  chemically synthesized
aaagatttctaaggaaaggaca

SEQ ID NO: 727269 - DNA, 22 bp, Artificial Sequence
  chemically synthesized
aagatttctaaggaaaggacac

SEQ ID NO: 727270 - DNA, 22 bp, Artificial Sequence
  chemically synthesized
ctaaggaaaggacacatctaga

SEQ ID NO: 727271 - DNA, 22 bp, Artificial Sequence
  chemically synthesized
taaggaaaggacacatctagat

SEQ ID NO: 727272 - DNA, 22 bp, Artificial Sequence
  chemically synthesized
acgtcatagatgatctagatgt

SEQ ID NO: 727273 - DNA, 22 bp, Artificial Sequence
  chemically synthesized
aacgtcatagatgatctagatg

SEQ ID NO: 727274 - DNA, 22 bp, Artificial Sequence
  chemically synthesized
aggaaaggacacatctagatca

SEQ ID NO: 727275 - DNA, 22 bp, Artificial Sequence
  chemically synthesized
agaacagcggatttaacgtcat

SEQ ID NO: 727276 - DNA, 22 bp, Artificial Sequence
  chemically synthesized
cagaacagcggatttaacgtca

SEQ ID NO: 727277 - DNA, 22 bp, Artificial Sequence
  chemically synthesized
gatcatctatgacgttaaatcc

SEQ ID NO: 727278 - DNA, 22 bp, Artificial Sequence
  chemically synthesized
tttcagaacagcggatttaacg

SEQ ID NO: 727279 - DNA, 22 bp, Artificial Sequence
  chemically synthesized
atattatttcagaacagcggat

SEQ ID NO: 727280 - DNA, 22 bp, Artificial Sequence
  chemically synthesized
tgacgttaaatccgctgttctg

SEQ ID NO: 727281 - DNA, 22 bp, Artificial Sequence
  chemically synthesized
ttgatattatttcagaacagcg

SEQ ID NO: 727282 - DNA, 22 bp, Artificial Sequence
  chemically synthesized
tattattgatattatttcagaa

SEQ ID NO: 727283 - DNA, 22 bp, Artificial Sequence
  chemically synthesized
gtattattgatattatttcaga

SEQ ID NO: 727284 - DNA, 22 bp, Artificial Sequence
  chemically synthesized
aatccgctgttctgaaataata

SEQ ID NO: 727285 - DNA, 22 bp, Artificial Sequence
  chemically synthesized
tttgtattattgatattatttc

SEQ ID NO: 727286 - DNA, 22 bp, Artificial Sequence
  chemically synthesized
gtttgtattattgatattattt

SEQ ID NO: 727287 - DNA, 22 bp, Artificial Sequence
  chemically synthesized
gaatttgtttgtattattgata

SEQ ID NO: 727288 - DNA, 22 bp, Artificial Sequence
  chemically synthesized
ttctgaaataatatcaataata

SEQ ID NO: 727289 - DNA, 22 bp, Artificial Sequence
  chemically synthesized
tgaaataatatcaataatacaa

SEQ ID NO: 727290 - DNA, 22 bp, Artificial Sequence
  chemically synthesized
aaataatatcaataatacaaac

SEQ ID NO: 727291 - DNA, 22 bp, Artificial Sequence
  chemically synthesized
acatacataaaattagaatttg

SEQ ID NO: 727292 - DNA, 22 bp, Artificial Sequence
  chemically synthesized
cacatacataaaattagaattt

SEQ ID NO: 727293 - DNA, 22 bp, Artificial Sequence
  chemically synthesized
tcacatacataaaattagaatt

SEQ ID NO: 727294 - DNA, 22 bp, Artificial Sequence
  chemically synthesized
ttcacatacataaaattagaat

SEQ ID NO: 727295 - DNA, 22 bp, Artificial Sequence
  chemically synthesized
tttcacatacataaaattagaa

SEQ ID NO: 727296 - DNA, 22 bp, Artificial Sequence
  chemically synthesized
ttttcacatacataaaattaga

SEQ ID NO: 727297 - DNA, 22 bp, Artificial Sequence
  chemically synthesized
tataagtagtttttttcacata

SEQ ID NO: 727298 - DNA, 22 bp, Artificial Sequence
  chemically synthesized
atataagtagtttttttcacat

SEQ ID NO: 727299 - DNA, 22 bp, Artificial Sequence
  chemically synthesized
taattttatgtatgtgaaaaaa

SEQ ID NO: 727300 - DNA, 22 bp, Artificial Sequence
  chemically synthesized
attttatgtatgtgaaaaaaac

SEQ ID NO: 727301 - DNA, 22 bp, Artificial Sequence
  chemically synthesized
tatgtatgtgaaaaaaactact

SEQ ID NO: 727302 - DNA, 22 bp, Artificial Sequence
  chemically synthesized
atgtatgtgaaaaaaactactt

SEQ ID NO: 727303 - DNA, 22 bp, Artificial Sequence
  chemically synthesized
tgtatgtgaaaaaaactactta

SEQ ID NO: 727304 - DNA, 22 bp, Artificial Sequence
  chemically synthesized
gaatgaatatgagtttatataa

SEQ ID NO: 727305 - DNA, 22 bp, Artificial Sequence
  chemically synthesized
tcgaatgaatatgagtttatat

SEQ ID NO: 727306 - DNA, 22 bp, Artificial Sequence
  chemically synthesized
ctcgaatgaatatgagtttata

SEQ ID NO: 727307 - DNA, 22 bp, Artificial Sequence
  chemically synthesized
tttctcgaatgaatatgagttt

SEQ ID NO: 727308 - DNA, 22 bp, Artificial Sequence
  chemically synthesized
gtttctcgaatgaatatgagtt

SEQ ID NO: 727309 - DNA, 22 bp, Artificial Sequence
  chemically synthesized
cttatataaactcatattcatt

SEQ ID NO: 727310 - DNA, 22 bp, Artificial Sequence
  chemically synthesized
atataaactcatattcattcga

SEQ ID NO: 727311 - DNA, 22 bp, Artificial Sequence
  chemically synthesized
tataaactcatattcattcgag

SEQ ID NO: 727312 - DNA, 22 bp, Artificial Sequence
  chemically synthesized
gagtatttgtttctcgaatgaa

SEQ ID NO: 727313 - DNA, 22 bp, Artificial Sequence
  chemically synthesized
ggagtatttgtttctcgaatga

SEQ ID NO: 727314 - DNA, 22 bp, Artificial Sequence
  chemically synthesized
atattcattcgagaaacaaata

SEQ ID NO: 727315 - DNA, 22 bp, Artificial Sequence
  chemically synthesized
atatccaacttggagtatttgt

SEQ ID NO: 727316 - DNA, 22 bp, Artificial Sequence
  chemically synthesized
gatatccaacttggagtatttg

SEQ ID NO: 727317 - DNA, 22 bp, Artificial Sequence
  chemically synthesized
attcgagaaacaaatactccaa

SEQ ID NO: 727318 - DNA, 22 bp, Artificial Sequence
  chemically synthesized
cttgatatccaacttggagtat

SEQ ID NO: 727319 - DNA, 22 bp, Artificial Sequence
  chemically synthesized
gagaaacaaatactccaagttg

SEQ ID NO: 727320 - DNA, 22 bp, Artificial Sequence
  chemically synthesized
aaaggaaactccttgatatcca

SEQ ID NO: 727321 - DNA, 22 bp, Artificial Sequence
  chemically synthesized
caagttggatatcaaggagttt

SEQ ID NO: 727322 - DNA, 22 bp, Artificial Sequence
  chemically synthesized
gatatcaaggagtttcctttca

SEQ ID NO: 727323 - DNA, 22 bp, Artificial Sequence
  chemically synthesized
aacaaaggataactgaaaggaa

SEQ ID NO: 727324 - DNA, 22 bp, Artificial Sequence
  chemically synthesized
tatccactgaacaaaggataac

SEQ ID NO: 727325 - DNA, 22 bp, Artificial Sequence
  chemically synthesized
atatccactgaacaaaggataa

SEQ ID NO: 727326 - DNA, 22 bp, Artificial Sequence
  chemically synthesized
cctttcagttatcctttgttca

SEQ ID NO: 727327 - DNA, 22 bp, Artificial Sequence
  chemically synthesized
ctttcagttatcctttgttcag

SEQ ID NO: 727328 - DNA, 22 bp, Artificial Sequence
  chemically synthesized
tcagttatcctttgttcagtgg

SEQ ID NO: 727329 - DNA, 22 bp, Artificial Sequence
  chemically synthesized
cagttatcctttgttcagtgga

SEQ ID NO: 727330 - DNA, 22 bp, Artificial Sequence
  chemically synthesized
agttatcctttgttcagtggat

SEQ ID NO: 727331 - DNA, 22 bp, Artificial Sequence
  chemically synthesized
tcctttgttcagtggatataaa

SEQ ID NO: 727332 - DNA, 22 bp, Artificial Sequence
  chemically synthesized
aggagcacagcatttatatcca

SEQ ID NO: 727333 - DNA, 22 bp, Artificial Sequence
  chemically synthesized
tgttcagtggatataaatgctg

SEQ ID NO: 727334 - DNA, 22 bp, Artificial Sequence
  chemically synthesized
gttcagtggatataaatgctgt

SEQ ID NO: 727335 - DNA, 22 bp, Artificial Sequence
  chemically synthesized
ttcagtggatataaatgctgtg

SEQ ID NO: 727336 - DNA, 22 bp, Artificial Sequence
  chemically synthesized
agtggatataaatgctgtgctc

SEQ ID NO: 727337 - DNA, 22 bp, Artificial Sequence
  chemically synthesized
tacccagtattaaggagcacag

SEQ ID NO: 727338 - DNA, 22 bp, Artificial Sequence
  chemically synthesized
gtacccagtattaaggagcaca

SEQ ID NO: 727339 - DNA, 22 bp, Artificial Sequence
  chemically synthesized
tgtacccagtattaaggagcac

SEQ ID NO: 727340 - DNA, 22 bp, Artificial Sequence
  chemically synthesized
ttgtacccagtattaaggagca

SEQ ID NO: 727341 - DNA, 22 bp, Artificial Sequence
  chemically synthesized
tttgtacccagtattaaggagc

SEQ ID NO: 727342 - DNA, 22 bp, Artificial Sequence
  chemically synthesized
tttttgtacccagtattaagga

SEQ ID NO: 727343 - DNA, 22 bp, Artificial Sequence
  chemically synthesized
ctttttgtacccagtattaagg

SEQ ID NO: 727344 - DNA, 22 bp, Artificial Sequence
  chemically synthesized
tctttttgtacccagtattaag

SEQ ID NO: 727345 - DNA, 22 bp, Artificial Sequence
  chemically synthesized
ttctttttgtacccagtattaa

SEQ ID NO: 727346 - DNA, 22 bp, Artificial Sequence
  chemically synthesized
tttttctttttgtacccagtat

SEQ ID NO: 727347 - DNA, 22 bp, Artificial Sequence
  chemically synthesized
atttttctttttgtacccagta

SEQ ID NO: 727348 - DNA, 22 bp, Artificial Sequence
  chemically synthesized
tgctccttaatactgggtacaa

SEQ ID NO: 727349 - DNA, 22 bp, Artificial Sequence
  chemically synthesized
cttaatactgggtacaaaaaga

SEQ ID NO: 727350 - DNA, 22 bp, Artificial Sequence
  chemically synthesized
ataaacttatttttctttttgt

SEQ ID NO: 727351 - DNA, 22 bp, Artificial Sequence
  chemically synthesized
aatactgggtacaaaaagaaaa

SEQ ID NO: 727352 - DNA, 22 bp, Artificial Sequence
  chemically synthesized
taataaacttatttttcttttt

SEQ ID NO: 727353 - DNA, 22 bp, Artificial Sequence
  chemically synthesized
atactgggtacaaaaagaaaaa

SEQ ID NO: 727354 - DNA, 22 bp, Artificial Sequence
  chemically synthesized
ctaataaacttatttttctttt

SEQ ID NO: 727355 - DNA, 22 bp, Artificial Sequence
  chemically synthesized
ggtacaaaaagaaaaataagtt

SEQ ID NO: 727356 - DNA, 22 bp, Artificial Sequence
  chemically synthesized
atgtgtatatttctaataaact

SEQ ID NO: 727357 - DNA, 22 bp, Artificial Sequence
  chemically synthesized
gatgtgtatatttctaataaac

SEQ ID NO: 727358 - DNA, 22 bp, Artificial Sequence
  chemically synthesized
agaagtgtatttgatgtgtata

SEQ ID NO: 727359 - DNA, 22 bp, Artificial Sequence
  chemically synthesized
cagaagtgtatttgatgtgtat

SEQ ID NO: 727360 - DNA, 22 bp, Artificial Sequence
  chemically synthesized
tcagaagtgtatttgatgtgta

SEQ ID NO: 727361 - DNA, 22 bp, Artificial Sequence
  chemically synthesized
ttcagaagtgtatttgatgtgt

SEQ ID NO: 727362 - DNA, 22 bp, Artificial Sequence
  chemically synthesized
attagaaatatacacatcaaat

SEQ ID NO: 727363 - DNA, 22 bp, Artificial Sequence
  chemically synthesized
tttcagaagtgtatttgatgtg

SEQ ID NO: 727364 - DNA, 22 bp, Artificial Sequence
  chemically synthesized
ttagaaatatacacatcaaata

SEQ ID NO: 727365 - DNA, 22 bp, Artificial Sequence
  chemically synthesized
ttttcagaagtgtatttgatgt

SEQ ID NO: 727366 - DNA, 22 bp, Artificial Sequence
  chemically synthesized
gaaatatacacatcaaatacac

SEQ ID NO: 727367 - DNA, 22 bp, Artificial Sequence
  chemically synthesized
atttttttcagaagtgtatttg

SEQ ID NO: 727368 - DNA, 22 bp, Artificial Sequence
  chemically synthesized
tcatttttttcagaagtgtatt

SEQ ID NO: 727369 - DNA, 22 bp, Artificial Sequence
  chemically synthesized
ctcatttttttcagaagtgtat

SEQ ID NO: 727370 - DNA, 22 bp, Artificial Sequence
  chemically synthesized
aatagcttctcatttttttcag

SEQ ID NO: 727371 - DNA, 22 bp, Artificial Sequence
  chemically synthesized
caatagcttctcatttttttca

SEQ ID NO: 727372 - DNA, 22 bp, Artificial Sequence
  chemically synthesized
atttcaatagcttctcattttt

SEQ ID NO: 727373 - DNA, 22 bp, Artificial Sequence
  chemically synthesized
acctcatttcaatagcttctca

SEQ ID NO: 727374 - DNA, 22 bp, Artificial Sequence
  chemically synthesized
ctgaaaaaaatgagaagctatt

SEQ ID NO: 727375 - DNA, 22 bp, Artificial Sequence
  chemically synthesized
tgaaaaaaatgagaagctattg

SEQ ID NO: 727376 - DNA, 22 bp, Artificial Sequence
  chemically synthesized
gttgacctcatttcaatagctt

SEQ ID NO: 727377 - DNA, 22 bp, Artificial Sequence
  chemically synthesized
aaaaaaatgagaagctattgaa

SEQ ID NO: 727378 - DNA, 22 bp, Artificial Sequence
  chemically synthesized
agttgacctcatttcaatagct

SEQ ID NO: 727379 - DNA, 22 bp, Artificial Sequence
  chemically synthesized
tttagttgacctcatttcaata

SEQ ID NO: 727380 - DNA, 22 bp, Artificial Sequence
  chemically synthesized
tgtttagttgacctcatttcaa

SEQ ID NO: 727381 - DNA, 22 bp, Artificial Sequence
  chemically synthesized
ctgtttagttgacctcatttca

SEQ ID NO: 727382 - DNA, 22 bp, Artificial Sequence
  chemically synthesized
ttgaaatgaggtcaactaaaca

SEQ ID NO: 727383 - DNA, 22 bp, Artificial Sequence
  chemically synthesized
caaatagatttctgtttagttg

SEQ ID NO: 727384 - DNA, 22 bp, Artificial Sequence
  chemically synthesized
aaatgaggtcaactaaacagaa

SEQ ID NO: 727385 - DNA, 22 bp, Artificial Sequence
  chemically synthesized
aaccctacaaatagatttctgt

SEQ ID NO: 727386 - DNA, 22 bp, Artificial Sequence
  chemically synthesized
aaaccctacaaatagatttctg

SEQ ID NO: 727387 - DNA, 22 bp, Artificial Sequence
  chemically synthesized
taaaccctacaaatagatttct

SEQ ID NO: 727388 - DNA, 22 bp, Artificial Sequence
  chemically synthesized
aacagaaatctatttgtagggt

SEQ ID NO: 727389 - DNA, 22 bp, Artificial Sequence
  chemically synthesized
atggtgttttaaaccctacaaa

SEQ ID NO: 727390 - DNA, 22 bp, Artificial Sequence
  chemically synthesized
attcatggtgttttaaacccta

SEQ ID NO: 727391 - DNA, 22 bp, Artificial Sequence
  chemically synthesized
tttgtagggtttaaaacaccat

SEQ ID NO: 727392 - DNA, 22 bp, Artificial Sequence
  chemically synthesized
gtagggtttaaaacaccatgaa

SEQ ID NO: 727393 - DNA, 22 bp, Artificial Sequence
  chemically synthesized
tagggtttaaaacaccatgaat

SEQ ID NO: 727394 - DNA, 22 bp, Artificial Sequence
  chemically synthesized
aaaacaccatgaatgagatcat

SEQ ID NO: 727395 - DNA, 22 bp, Artificial Sequence
  chemically synthesized
aaacaccatgaatgagatcatc

SEQ ID NO: 727396 - DNA, 22 bp, Artificial Sequence
  chemically synthesized
agaaatgcaaggatagatggaa

SEQ ID NO: 727397 - DNA, 22 bp, Artificial Sequence
  chemically synthesized
gagaaatgcaaggatagatgga

SEQ ID NO: 727398 - DNA, 22 bp, Artificial Sequence
  chemically synthesized
ttgtgattccatctatccttgc

SEQ ID NO: 727399 - DNA, 22 bp, Artificial Sequence
  chemically synthesized
tgtgattccatctatccttgca

SEQ ID NO: 727400 - DNA, 22 bp, Artificial Sequence
  chemically synthesized
gtgattccatctatccttgcat

SEQ ID NO: 727401 - DNA, 22 bp, Artificial Sequence
  chemically synthesized
tgattccatctatccttgcatt

SEQ ID NO: 727402 - DNA, 22 bp, Artificial Sequence
  chemically synthesized
aaaatagaatttgagaaatgca

SEQ ID NO: 727403 - DNA, 22 bp, Artificial Sequence
  chemically synthesized
caaaatagaatttgagaaatgc

SEQ ID NO: 727404 - DNA, 22 bp, Artificial Sequence
  chemically synthesized
catctatccttgcatttctcaa

SEQ ID NO: 727405 - DNA, 22 bp, Artificial Sequence
  chemically synthesized
tccttgcatttctcaaattcta

SEQ ID NO: 727406 - DNA, 22 bp, Artificial Sequence
  chemically synthesized
gcatttctcaaattctattttg

SEQ ID NO: 727407 - DNA, 22 bp, Artificial Sequence
  chemically synthesized
catttctcaaattctattttga

SEQ ID NO: 727408 - DNA, 22 bp, Artificial Sequence
  chemically synthesized
ctcaaattctattttgaaatca

SEQ ID NO: 727409 - DNA, 22 bp, Artificial Sequence
  chemically synthesized
tcaaattctattttgaaatcac

SEQ ID NO: 727410 - DNA, 22 bp, Artificial Sequence
  chemically synthesized
aaattctattttgaaatcactg

SEQ ID NO: 727411 - DNA, 22 bp, Artificial Sequence
  chemically synthesized
ggcaatgaacataggcagtgat

SEQ ID NO: 727412 - DNA, 22 bp, Artificial Sequence
  chemically synthesized
aggcaatgaacataggcagtga

SEQ ID NO: 727413 - DNA, 22 bp, Artificial Sequence
  chemically synthesized
taggcaatgaacataggcagtg

SEQ ID NO: 727414 - DNA, 22 bp, Artificial Sequence
  chemically synthesized
tattttgaaatcactgcctatg

SEQ ID NO: 727415 - DNA, 22 bp, Artificial Sequence
  chemically synthesized
ttttgaaatcactgcctatgtt

SEQ ID NO: 727416 - DNA, 22 bp, Artificial Sequence
  chemically synthesized
ttttaggcaatgaacataggca

SEQ ID NO: 727417 - DNA, 22 bp, Artificial Sequence
  chemically synthesized
tgaaatcactgcctatgttcat

SEQ ID NO: 727418 - DNA, 22 bp, Artificial Sequence
  chemically synthesized
gaaatcactgcctatgttcatt

SEQ ID NO: 727419 - DNA, 22 bp, Artificial Sequence
  chemically synthesized
aaatcactgcctatgttcattg

SEQ ID NO: 727420 - DNA, 22 bp, Artificial Sequence
  chemically synthesized
cctatgttcattgcctaaaata

SEQ ID NO: 727421 - DNA, 22 bp, Artificial Sequence
  chemically synthesized
tgttcattgcctaaaatagctt

SEQ ID NO: 727422 - DNA, 22 bp, Artificial Sequence
  chemically synthesized
agaatcaaaggaaaagctattt

SEQ ID NO: 727423 - DNA, 22 bp, Artificial Sequence
  chemically synthesized
attgcctaaaatagcttttcct

SEQ ID NO: 727424 - DNA, 22 bp, Artificial Sequence
  chemically synthesized
cctaaaatagcttttcctttga

SEQ ID NO: 727425 - DNA, 22 bp, Artificial Sequence
  chemically synthesized
aaatagcttttcctttgattct

SEQ ID NO: 727426 - DNA, 22 bp, Artificial Sequence
  chemically synthesized
ataagatcatctaagaatcaaa

SEQ ID NO: 727427 - DNA, 22 bp, Artificial Sequence
  chemically synthesized
cataagatcatctaagaatcaa

SEQ ID NO: 727428 - DNA, 22 bp, Artificial Sequence
  chemically synthesized
tcataagatcatctaagaatca

SEQ ID NO: 727429 - DNA, 22 bp, Artificial Sequence
  chemically synthesized
attttcataagatcatctaaga

SEQ ID NO: 727430 - DNA, 22 bp, Artificial Sequence
  chemically synthesized
cattttcataagatcatctaag

SEQ ID NO: 727431 - DNA, 22 bp, Artificial Sequence
  chemically synthesized
ttcctttgattcttagatgatc

SEQ ID NO: 727432 - DNA, 22 bp, Artificial Sequence
  chemically synthesized
tcattttcataagatcatctaa

SEQ ID NO: 727433 - DNA, 22 bp, Artificial Sequence
  chemically synthesized
tcctttgattcttagatgatct

SEQ ID NO: 727434 - DNA, 22 bp, Artificial Sequence
  chemically synthesized
cctttgattcttagatgatctt

SEQ ID NO: 727435 - DNA, 22 bp, Artificial Sequence
  chemically synthesized
ctttgattcttagatgatctta

SEQ ID NO: 727436 - DNA, 22 bp, Artificial Sequence
  chemically synthesized
tgattcttagatgatcttatga

SEQ ID NO: 727437 - DNA, 22 bp, Artificial Sequence
  chemically synthesized
gattcttagatgatcttatgaa

SEQ ID NO: 727438 - DNA, 22 bp, Artificial Sequence
  chemically synthesized
attcttagatgatcttatgaaa

SEQ ID NO: 727439 - DNA, 22 bp, Artificial Sequence
  chemically synthesized
tatatattttcattttcataag

SEQ ID NO: 727440 - DNA, 22 bp, Artificial Sequence
  chemically synthesized
atatatattttcattttcataa

SEQ ID NO: 727441 - DNA, 22 bp, Artificial Sequence
  chemically synthesized
ttagatgatcttatgaaaatga

SEQ ID NO: 727442 - DNA, 22 bp, Artificial Sequence
  chemically synthesized
agatgatcttatgaaaatgaaa

SEQ ID NO: 727443 - DNA, 22 bp, Artificial Sequence
  chemically synthesized
gatgatcttatgaaaatgaaaa

SEQ ID NO: 727444 - DNA, 22 bp, Artificial Sequence
  chemically synthesized
atgaaaatgaaaatatatataa

SEQ ID NO: 727445 - DNA, 22 bp, Artificial Sequence
  chemically synthesized
tgcaaaatagccttatatatat

SEQ ID NO: 727446 - DNA, 22 bp, Artificial Sequence
  chemically synthesized
tgaaaatgaaaatatatataag

SEQ ID NO: 727447 - DNA, 22 bp, Artificial Sequence
  chemically synthesized
tatgcaaaatagccttatatat

SEQ ID NO: 727448 - DNA, 22 bp, Artificial Sequence
  chemically synthesized
ctatgcaaaatagccttatata

SEQ ID NO: 727449 - DNA, 22 bp, Artificial Sequence
  chemically synthesized
atcatttctatgcaaaatagcc

SEQ ID NO: 727450 - DNA, 22 bp, Artificial Sequence
  chemically synthesized
tgtctaatcatttctatgcaaa

SEQ ID NO: 727451 - DNA, 22 bp, Artificial Sequence
  chemically synthesized
tctatgtctaatcatttctatg

SEQ ID NO: 727452 - DNA, 22 bp, Artificial Sequence
  chemically synthesized
atctatgtctaatcatttctat

SEQ ID NO: 727453 - DNA, 22 bp, Artificial Sequence
  chemically synthesized
ttttgcatagaaatgattagac

SEQ ID NO: 727454 - DNA, 22 bp, Artificial Sequence
  chemically synthesized
tgcatagaaatgattagacata

SEQ ID NO: 727455 - DNA, 22 bp, Artificial Sequence
  chemically synthesized
gcatagaaatgattagacatag

SEQ ID NO: 727456 - DNA, 22 bp, Artificial Sequence
  chemically synthesized
catagaaatgattagacataga

SEQ ID NO: 727457 - DNA, 22 bp, Artificial Sequence
  chemically synthesized
gtgtaaatatttatctatgtct

SEQ ID NO: 727458 - DNA, 22 bp, Artificial Sequence
  chemically synthesized
ggtgtaaatatttatctatgtc

SEQ ID NO: 727459 - DNA, 22 bp, Artificial Sequence
  chemically synthesized
tttggtgtaaatatttatctat

SEQ ID NO: 727460 - DNA, 22 bp, Artificial Sequence
  chemically synthesized
aactgtttggtgtaaatattta

SEQ ID NO: 727461 - DNA, 22 bp, Artificial Sequence
  chemically synthesized
gacatagataaatatttacacc

SEQ ID NO: 727462 - DNA, 22 bp, Artificial Sequence
  chemically synthesized
cctaaactgtttggtgtaaata

SEQ ID NO: 727463 - DNA, 22 bp, Artificial Sequence
  chemically synthesized
gtccccactccctaaactgttt

SEQ ID NO: 727464 - DNA, 22 bp, Artificial Sequence
  chemically synthesized
acaccaaacagtttagggagtg

SEQ ID NO: 727465 - DNA, 22 bp, Artificial Sequence
  chemically synthesized
caccaaacagtttagggagtgg

SEQ ID NO: 727466 - DNA, 22 bp, Artificial Sequence
  chemically synthesized
aaataactagtccccactccct

SEQ ID NO: 727467 - DNA, 22 bp, Artificial Sequence
  chemically synthesized
tgaaataactagtccccactcc

SEQ ID NO: 727468 - DNA, 22 bp, Artificial Sequence
  chemically synthesized
tataatctctgaaataactagt

SEQ ID NO: 727469 - DNA, 22 bp, Artificial Sequence
  chemically synthesized
agggagtggggactagttattt

SEQ ID NO: 727470 - DNA, 22 bp, Artificial Sequence
  chemically synthesized
gggagtggggactagttatttc

SEQ ID NO: 727471 - DNA, 22 bp, Artificial Sequence
  chemically synthesized
attgtataatctctgaaataac

SEQ ID NO: 727472 - DNA, 22 bp, Artificial Sequence
  chemically synthesized
cattgtataatctctgaaataa

SEQ ID NO: 727473 - DNA, 22 bp, Artificial Sequence
  chemically synthesized
tcattgtataatctctgaaata

SEQ ID NO: 727474 - DNA, 22 bp, Artificial Sequence
  chemically synthesized
aaattttcattgtataatctct

SEQ ID NO: 727475 - DNA, 22 bp, Artificial Sequence
  chemically synthesized
gttatttcagagattatacaat

SEQ ID NO: 727476 - DNA, 22 bp, Artificial Sequence
  chemically synthesized
tttcagagattatacaatgaaa

SEQ ID NO: 727477 - DNA, 22 bp, Artificial Sequence
  chemically synthesized
aatcagtctaaaattttcattg

SEQ ID NO: 727478 - DNA, 22 bp, Artificial Sequence
  chemically synthesized
cagagattatacaatgaaaatt

SEQ ID NO: 727479 - DNA, 22 bp, Artificial Sequence
  chemically synthesized
aaatcagtctaaaattttcatt

SEQ ID NO: 727480 - DNA, 22 bp, Artificial Sequence
  chemically synthesized
agagattatacaatgaaaattt

SEQ ID NO: 727481 - DNA, 22 bp, Artificial Sequence
  chemically synthesized
tacaatgaaaattttagactga

SEQ ID NO: 727482 - DNA, 22 bp, Artificial Sequence
  chemically synthesized
gcatataaaataatatgtttaa

SEQ ID NO: 727483 - DNA, 22 bp, Artificial Sequence
  chemically synthesized
tagactgatttaaacatattat

SEQ ID NO: 727484 - DNA, 22 bp, Artificial Sequence
  chemically synthesized
agactgatttaaacatattatt

SEQ ID NO: 727485 - DNA, 22 bp, Artificial Sequence
  chemically synthesized
gactgatttaaacatattattt

SEQ ID NO: 727486 - DNA, 22 bp, Artificial Sequence
  chemically synthesized
aactggcatataaaataatatg

SEQ ID NO: 727487 - DNA, 22 bp, Artificial Sequence
  chemically synthesized
atttaaacatattattttatat

SEQ ID NO: 727488 - DNA, 22 bp, Artificial Sequence
  chemically synthesized
aaacatattattttatatgcca

SEQ ID NO: 727489 - DNA, 22 bp, Artificial Sequence
  chemically synthesized
atcatcctaaactggcatataa

SEQ ID NO: 727490 - DNA, 22 bp, Artificial Sequence
  chemically synthesized
aacatattattttatatgccag

SEQ ID NO: 727491 - DNA, 22 bp, Artificial Sequence
  chemically synthesized
ttcatcatcctaaactggcata

SEQ ID NO: 727492 - DNA, 22 bp, Artificial Sequence
  chemically synthesized
attcatcatcctaaactggcat

SEQ ID NO: 727493 - DNA, 22 bp, Artificial Sequence
  chemically synthesized
cttattcatcatcctaaactgg

SEQ ID NO: 727494 - DNA, 22 bp, Artificial Sequence
  chemically synthesized
ttttatatgccagtttaggatg

SEQ ID NO: 727495 - DNA, 22 bp, Artificial Sequence
  chemically synthesized
attacttattcatcatcctaaa

SEQ ID NO: 727496 - DNA, 22 bp, Artificial Sequence
  chemically synthesized
tatatgccagtttaggatgatg

SEQ ID NO: 727497 - DNA, 22 bp, Artificial Sequence
  chemically synthesized
atatgccagtttaggatgatga

SEQ ID NO: 727498 - DNA, 22 bp, Artificial Sequence
  chemically synthesized
tatgccagtttaggatgatgaa

SEQ ID NO: 727499 - DNA, 22 bp, Artificial Sequence
  chemically synthesized
agtgattcattacttattcatc

SEQ ID NO: 727500 - DNA, 22 bp, Artificial Sequence
  chemically synthesized
aggatgatgaataagtaatgaa

SEQ ID NO: 727501 - DNA, 22 bp, Artificial Sequence
  chemically synthesized
ggatgatgaataagtaatgaat

SEQ ID NO: 727502 - DNA, 22 bp, Artificial Sequence
  chemically synthesized
ggggtaggaagggagggagaaa

SEQ ID NO: 727503 - DNA, 22 bp, Artificial Sequence
  chemically synthesized
aatttctccctcccttcctacc

SEQ ID NO: 727504 - DNA, 22 bp, Artificial Sequence
  chemically synthesized
ctccctcccttcctacccccag

SEQ ID NO: 727505 - DNA, 22 bp, Artificial Sequence
  chemically synthesized
tccctcccttcctacccccagc

SEQ ID NO: 727506 - DNA, 22 bp, Artificial Sequence
  chemically synthesized
cctcccttcctacccccagcct

SEQ ID NO: 727507 - DNA, 22 bp, Artificial Sequence
  chemically synthesized
ccttcctacccccagccttctt

SEQ ID NO: 727508 - DNA, 22 bp, Artificial Sequence
  chemically synthesized
cctacccccagccttcttcact

SEQ ID NO: 727509 - DNA, 22 bp, Artificial Sequence
  chemically synthesized
ctacccccagccttcttcactt

SEQ ID NO: 727510 - DNA, 22 bp, Artificial Sequence
  chemically synthesized
cccccagccttcttcacttctt

SEQ ID NO: 727511 - DNA, 22 bp, Artificial Sequence
  chemically synthesized
cttcacttctttcctcctttat

SEQ ID NO: 727512 - DNA, 22 bp, Artificial Sequence
  chemically synthesized
ttcacttctttcctcctttatt

SEQ ID NO: 727513 - DNA, 22 bp, Artificial Sequence
  chemically synthesized
cacttctttcctcctttattcc

SEQ ID NO: 727514 - DNA, 22 bp, Artificial Sequence
  chemically synthesized
acttctttcctcctttattcct

SEQ ID NO: 727515 - DNA, 22 bp, Artificial Sequence
  chemically synthesized
ctttcctcctttattccttcat

SEQ ID NO: 727516 - DNA, 22 bp, Artificial Sequence
  chemically synthesized
tttcctcctttattccttcatt

SEQ ID NO: 727517 - DNA, 22 bp, Artificial Sequence
  chemically synthesized
tcctcctttattccttcatttc

SEQ ID NO: 727518 - DNA, 22 bp, Artificial Sequence
  chemically synthesized
cctcctttattccttcatttct

SEQ ID NO: 727519 - DNA, 22 bp, Artificial Sequence
  chemically synthesized
ctcctttattccttcatttctt

SEQ ID NO: 727520 - DNA, 22 bp, Artificial Sequence
  chemically synthesized
ctttattccttcatttctttat

SEQ ID NO: 727521 - DNA, 22 bp, Artificial Sequence
  chemically synthesized
cgtatgtatgtcaataaagaaa

SEQ ID NO: 727522 - DNA, 22 bp, Artificial Sequence
  chemically synthesized
tattccttcatttctttattga

SEQ ID NO: 727523 - DNA, 22 bp, Artificial Sequence
  chemically synthesized
attccttcatttctttattgac

SEQ ID NO: 727524 - DNA, 22 bp, Artificial Sequence
  chemically synthesized
ttccttcatttctttattgaca

SEQ ID NO: 727525 - DNA, 22 bp, Artificial Sequence
  chemically synthesized
cttcatttctttattgacatac

SEQ ID NO: 727526 - DNA, 22 bp, Artificial Sequence
  chemically synthesized
catttctttattgacatacata

SEQ ID NO: 727527 - DNA, 22 bp, Artificial Sequence
  chemically synthesized
atttctttattgacatacatac

SEQ ID NO: 727528 - DNA, 22 bp, Artificial Sequence
  chemically synthesized
ctttattgacatacatacgtag

SEQ ID NO: 727529 - DNA, 22 bp, Artificial Sequence
  chemically synthesized
tttattgacatacatacgtagt

SEQ ID NO: 727530 - DNA, 22 bp, Artificial Sequence
  chemically synthesized
tattgacatacatacgtagtgt

SEQ ID NO: 727531 - DNA, 22 bp, Artificial Sequence
  chemically synthesized
attgacatacatacgtagtgtg

SEQ ID NO: 727532 - DNA, 22 bp, Artificial Sequence
  chemically synthesized
ttgacatacatacgtagtgtgt

SEQ ID NO: 727533 - DNA, 22 bp, Artificial Sequence
  chemically synthesized
acatacatacgtagtgtgtaca

SEQ ID NO: 727534 - DNA, 22 bp, Artificial Sequence
  chemically synthesized
gaagatggggggtgtacacact

SEQ ID NO: 727535 - DNA, 22 bp, Artificial Sequence
  chemically synthesized
agaagatggggggtgtacacac

SEQ ID NO: 727536 - DNA, 22 bp, Artificial Sequence
  chemically synthesized
tagaagatggggggtgtacaca

SEQ ID NO: 727537 - DNA, 22 bp, Artificial Sequence
  chemically synthesized
ctttagaagatggggggtgtac

SEQ ID NO: 727538 - DNA, 22 bp, Artificial Sequence
  chemically synthesized
ccatggggttactttagaagat

SEQ ID NO: 727539 - DNA, 22 bp, Artificial Sequence
  chemically synthesized
cccatggggttactttagaaga

SEQ ID NO: 727540 - DNA, 22 bp, Artificial Sequence
  chemically synthesized
ttcccatggggttactttagaa

SEQ ID NO: 727541 - DNA, 22 bp, Artificial Sequence
  chemically synthesized
cttcccatggggttactttaga

SEQ ID NO: 727542 - DNA, 22 bp, Artificial Sequence
  chemically synthesized
agcgtttcttcccatggggtta

SEQ ID NO: 727543 - DNA, 22 bp, Artificial Sequence
  chemically synthesized
ctaaagtaaccccatgggaaga

SEQ ID NO: 727544 - DNA, 22 bp, Artificial Sequence
  chemically synthesized
taaagtaaccccatgggaagaa

SEQ ID NO: 727545 - DNA, 22 bp, Artificial Sequence
  chemically synthesized
aagtaaccccatgggaagaaac

SEQ ID NO: 727546 - DNA, 22 bp, Artificial Sequence
  chemically synthesized
atataaccacctgagcgtttct

SEQ ID NO: 727547 - DNA, 22 bp, Artificial Sequence
  chemically synthesized
aatataaccacctgagcgtttc

SEQ ID NO: 727548 - DNA, 22 bp, Artificial Sequence
  chemically synthesized
taatataaccacctgagcgttt

SEQ ID NO: 727549 - DNA, 22 bp, Artificial Sequence
  chemically synthesized
ttaatataaccacctgagcgtt

SEQ ID NO: 727550 - DNA, 22 bp, Artificial Sequence
  chemically synthesized
tttaatataaccacctgagcgt

SEQ ID NO: 727551 - DNA, 22 bp, Artificial Sequence
  chemically synthesized
ttttaatataaccacctgagcg

SEQ ID NO: 727552 - DNA, 22 bp, Artificial Sequence
  chemically synthesized
gatttttttaatataaccacct

SEQ ID NO: 727553 - DNA, 22 bp, Artificial Sequence
  chemically synthesized
ataccctcgatttttttaatat

SEQ ID NO: 727554 - DNA, 22 bp, Artificial Sequence
  chemically synthesized
cataccctcgatttttttaata

SEQ ID NO: 727555 - DNA, 22 bp, Artificial Sequence
  chemically synthesized
tcataccctcgatttttttaat

SEQ ID NO: 727556 - DNA, 22 bp, Artificial Sequence
  chemically synthesized
aggtggttatattaaaaaaatc

SEQ ID NO: 727557 - DNA, 22 bp, Artificial Sequence
  chemically synthesized
agattttcataccctcgatttt

SEQ ID NO: 727558 - DNA, 22 bp, Artificial Sequence
  chemically synthesized
tattaaaaaaatcgagggtatg

SEQ ID NO: 727559 - DNA, 22 bp, Artificial Sequence
  chemically synthesized
aaaaaatcgagggtatgaaaat

SEQ ID NO: 727560 - DNA, 22 bp, Artificial Sequence
  chemically synthesized
ggcatacgaccctgagattttc

SEQ ID NO: 727561 - DNA, 22 bp, Artificial Sequence
  chemically synthesized
gggcatacgaccctgagatttt

SEQ ID NO: 727562 - DNA, 22 bp, Artificial Sequence
  chemically synthesized
gtgtttgggcatacgaccctga

SEQ ID NO: 727563 - DNA, 22 bp, Artificial Sequence
  chemically synthesized
tatcgcattggtgtttgggcat

SEQ ID NO: 727564 - DNA, 22 bp, Artificial Sequence
  chemically synthesized
atatcgcattggtgtttgggca

SEQ ID NO: 727565 - DNA, 22 bp, Artificial Sequence
  chemically synthesized
tatatcgcattggtgtttgggc

SEQ ID NO: 727566 - DNA, 22 bp, Artificial Sequence
  chemically synthesized
ttatatcgcattggtgtttggg

SEQ ID NO: 727567 - DNA, 22 bp, Artificial Sequence
  chemically synthesized
agggtcgtatgcccaaacacca

SEQ ID NO: 727568 - DNA, 22 bp, Artificial Sequence
  chemically synthesized
atttttatatcgcattggtgtt

SEQ ID NO: 727569 - DNA, 22 bp, Artificial Sequence
  chemically synthesized
aatttttatatcgcattggtgt

SEQ ID NO: 727570 - DNA, 22 bp, Artificial Sequence
  chemically synthesized
aaaaatcatatatgtgcacctt

SEQ ID NO: 727571 - DNA, 22 bp, Artificial Sequence
  chemically synthesized
aggtgcacatatatgatttttc

SEQ ID NO: 727572 - DNA, 22 bp, Artificial Sequence
  chemically synthesized
acacataaaaatgaaaaaattg

SEQ ID NO: 727573 - DNA, 22 bp, Artificial Sequence
  chemically synthesized
attcacacataaaaatgaaaaa

SEQ ID NO: 727574 - DNA, 22 bp, Artificial Sequence
  chemically synthesized
ttcaattttttcatttttatgt

SEQ ID NO: 727575 - DNA, 22 bp, Artificial Sequence
  chemically synthesized
tcaattttttcatttttatgtg

SEQ ID NO: 727576 - DNA, 22 bp, Artificial Sequence
  chemically synthesized
caaattcattcacacataaaaa

SEQ ID NO: 727577 - DNA, 22 bp, Artificial Sequence
  chemically synthesized
caattttttcatttttatgtgt

SEQ ID NO: 727578 - DNA, 22 bp, Artificial Sequence
  chemically synthesized
ccaaattcattcacacataaaa

SEQ ID NO: 727579 - DNA, 22 bp, Artificial Sequence
  chemically synthesized
aattttttcatttttatgtgtg

SEQ ID NO: 727580 - DNA, 22 bp, Artificial Sequence
  chemically synthesized
ttccaaattcattcacacataa

SEQ ID NO: 727581 - DNA, 22 bp, Artificial Sequence
  chemically synthesized
cttccaaattcattcacacata

SEQ ID NO: 727582 - DNA, 22 bp, Artificial Sequence
  chemically synthesized
tcttccaaattcattcacacat

SEQ ID NO: 727583 - DNA, 22 bp, Artificial Sequence
  chemically synthesized
ttcttccaaattcattcacaca

SEQ ID NO: 727584 - DNA, 22 bp, Artificial Sequence
  chemically synthesized
tttcatttttatgtgtgaatga

SEQ ID NO: 727585 - DNA, 22 bp, Artificial Sequence
  chemically synthesized
ttcatttttatgtgtgaatgaa

SEQ ID NO: 727586 - DNA, 22 bp, Artificial Sequence
  chemically synthesized
tcatttttatgtgtgaatgaat

SEQ ID NO: 727587 - DNA, 22 bp, Artificial Sequence
  chemically synthesized
catttttatgtgtgaatgaatt

SEQ ID NO: 727588 - DNA, 22 bp, Artificial Sequence
  chemically synthesized
atttttatgtgtgaatgaattt

SEQ ID NO: 727589 - DNA, 22 bp, Artificial Sequence
  chemically synthesized
ttatgtgtgaatgaatttggaa

SEQ ID NO: 727590 - DNA, 22 bp, Artificial Sequence
  chemically synthesized
tatgtgtgaatgaatttggaag

SEQ ID NO: 727591 - DNA, 22 bp, Artificial Sequence
  chemically synthesized
atgtgtgaatgaatttggaaga

SEQ ID NO: 727592 - DNA, 22 bp, Artificial Sequence
  chemically synthesized
tgtgtgaatgaatttggaagaa

SEQ ID NO: 727593 - DNA, 22 bp, Artificial Sequence
  chemically synthesized
gagtgtatgaaaggtttttctt

SEQ ID NO: 727594 - DNA, 22 bp, Artificial Sequence
  chemically synthesized
ggaagaaaaacctttcatacac

SEQ ID NO: 727595 - DNA, 22 bp, Artificial Sequence
  chemically synthesized
gaagaaaaacctttcatacact

SEQ ID NO: 727596 - DNA, 22 bp, Artificial Sequence
  chemically synthesized
caaaacacagaaagtctggagt

SEQ ID NO: 727597 - DNA, 22 bp, Artificial Sequence
  chemically synthesized
tcatacactccagactttctgt

SEQ ID NO: 727598 - DNA, 22 bp, Artificial Sequence
  chemically synthesized
tggctacaaaacacagaaagtc

SEQ ID NO: 727599 - DNA, 22 bp, Artificial Sequence
  chemically synthesized
catacactccagactttctgtg

SEQ ID NO: 727600 - DNA, 22 bp, Artificial Sequence
  chemically synthesized
atacactccagactttctgtgt

SEQ ID NO: 727601 - DNA, 22 bp, Artificial Sequence
  chemically synthesized
cagactttctgtgttttgtagc

SEQ ID NO: 727602 - DNA, 22 bp, Artificial Sequence
  chemically synthesized
caaatgaaggctgtggctacaa

SEQ ID NO: 727603 - DNA, 22 bp, Artificial Sequence
  chemically synthesized
tctgtgttttgtagccacagcc

SEQ ID NO: 727604 - DNA, 22 bp, Artificial Sequence
  chemically synthesized
ctgtgttttgtagccacagcct

SEQ ID NO: 727605 - DNA, 22 bp, Artificial Sequence
  chemically synthesized
tgtgttttgtagccacagcctt

SEQ ID NO: 727606 - DNA, 22 bp, Artificial Sequence
  chemically synthesized
tgttttgtagccacagccttca

SEQ ID NO: 727607 - DNA, 22 bp, Artificial Sequence
  chemically synthesized
tgtagccacagccttcatttgc

SEQ ID NO: 727608 - DNA, 22 bp, Artificial Sequence
  chemically synthesized
gtagccacagccttcatttgca

SEQ ID NO: 727609 - DNA, 22 bp, Artificial Sequence
  chemically synthesized
ccatgtcagagttgcaaatgaa

SEQ ID NO: 727610 - DNA, 22 bp, Artificial Sequence
  chemically synthesized
tagccacagccttcatttgcaa

SEQ ID NO: 727611 - DNA, 22 bp, Artificial Sequence
  chemically synthesized
gccatgtcagagttgcaaatga

SEQ ID NO: 727612 - DNA, 22 bp, Artificial Sequence
  chemically synthesized
catttgcaactctgacatggca

SEQ ID NO: 727613 - DNA, 22 bp, Artificial Sequence
  chemically synthesized
atttgcaactctgacatggcaa

SEQ ID NO: 727614 - DNA, 22 bp, Artificial Sequence
  chemically synthesized
gaaaacagcagcttgccatgtc

SEQ ID NO: 727615 - DNA, 22 bp, Artificial Sequence
  chemically synthesized
gcaactctgacatggcaagctg

SEQ ID NO: 727616 - DNA, 22 bp, Artificial Sequence
  chemically synthesized
caactctgacatggcaagctgc

SEQ ID NO: 727617 - DNA, 22 bp, Artificial Sequence
  chemically synthesized
tgacatggcaagctgctgtttt

SEQ ID NO: 727618 - DNA, 22 bp, Artificial Sequence
  chemically synthesized
acatggcaagctgctgttttct

SEQ ID NO: 727619 - DNA, 22 bp, Artificial Sequence
  chemically synthesized
ctgttttctagatttcatttgt

SEQ ID NO: 727620 - DNA, 22 bp, Artificial Sequence
  chemically synthesized
ttttctagatttcatttgtgtg

SEQ ID NO: 727621 - DNA, 22 bp, Artificial Sequence
  chemically synthesized
tctagatttcatttgtgtgggc

SEQ ID NO: 727622 - DNA, 22 bp, Artificial Sequence
  chemically synthesized
ctagatttcatttgtgtgggcg

SEQ ID NO: 727623 - DNA, 22 bp, Artificial Sequence
  chemically synthesized
gtgtgcagcaggcgcccacaca

SEQ ID NO: 727624 - DNA, 22 bp, Artificial Sequence
  chemically synthesized
tagatttcatttgtgtgggcgc

SEQ ID NO: 727625 - DNA, 22 bp, Artificial Sequence
  chemically synthesized
gatttcatttgtgtgggcgcct

SEQ ID NO: 727626 - DNA, 22 bp, Artificial Sequence
  chemically synthesized
catttgtgtgggcgcctgctgc

SEQ ID NO: 727627 - DNA, 22 bp, Artificial Sequence
  chemically synthesized
atttgtgtgggcgcctgctgca

SEQ ID NO: 727628 - DNA, 22 bp, Artificial Sequence
  chemically synthesized
gtgtgggcgcctgctgcacacc

SEQ ID NO: 727629 - DNA, 22 bp, Artificial Sequence
  chemically synthesized
tgtgggcgcctgctgcacacca

SEQ ID NO: 727630 - DNA, 22 bp, Artificial Sequence
  chemically synthesized
taaagagaaaatatatattggt

SEQ ID NO: 727631 - DNA, 22 bp, Artificial Sequence
  chemically synthesized
ctgcacaccaatatatattttc

SEQ ID NO: 727632 - DNA, 22 bp, Artificial Sequence
  chemically synthesized
cacaccaatatatattttctct

SEQ ID NO: 727633 - DNA, 22 bp, Artificial Sequence
  chemically synthesized
tctctttacaaccatccaccat

SEQ ID NO: 727634 - DNA, 22 bp, Artificial Sequence
  chemically synthesized
ctctttacaaccatccaccatg

SEQ ID NO: 727635 - DNA, 22 bp, Artificial Sequence
  chemically synthesized
tctttacaaccatccaccatgt

SEQ ID NO: 727636 - DNA, 22 bp, Artificial Sequence
  chemically synthesized
tttacaaccatccaccatgtgg

SEQ ID NO: 727637 - DNA, 22 bp, Artificial Sequence
  chemically synthesized
tacaaccatccaccatgtggat

SEQ ID NO: 727638 - DNA, 22 bp, Artificial Sequence
  chemically synthesized
ataaagaaatgcatccacatgg

SEQ ID NO: 727639 - DNA, 22 bp, Artificial Sequence
  chemically synthesized
acaaccatccaccatgtggatg

SEQ ID NO: 727640 - DNA, 22 bp, Artificial Sequence
  chemically synthesized
caaccatccaccatgtggatgc

SEQ ID NO: 727641 - DNA, 22 bp, Artificial Sequence
  chemically synthesized
actaataaagaaatgcatccac

SEQ ID NO: 727642 - DNA, 22 bp, Artificial Sequence
  chemically synthesized
cagaatatatattgactaataa

SEQ ID NO: 727643 - DNA, 22 bp, Artificial Sequence
  chemically synthesized
ctttattagtcaatatatattc

SEQ ID NO: 727644 - DNA, 22 bp, Artificial Sequence
  chemically synthesized
tttattagtcaatatatattct

SEQ ID NO: 727645 - DNA, 22 bp, Artificial Sequence
  chemically synthesized
tattagtcaatatatattctgt

SEQ ID NO: 727646 - DNA, 22 bp, Artificial Sequence
  chemically synthesized
attagtcaatatatattctgta

SEQ ID NO: 727647 - DNA, 22 bp, Artificial Sequence
  chemically synthesized
cagaatgtaacctacagaatat

SEQ ID NO: 727648 - DNA, 22 bp, Artificial Sequence
  chemically synthesized
ttagtcaatatatattctgtag

SEQ ID NO: 727649 - DNA, 22 bp, Artificial Sequence
  chemically synthesized
gcagaatgtaacctacagaata

SEQ ID NO: 727650 - DNA, 22 bp, Artificial Sequence
  chemically synthesized
gtcaatatatattctgtaggtt

SEQ ID NO: 727651 - DNA, 22 bp, Artificial Sequence
  chemically synthesized
aaatttgcagaatgtaacctac

SEQ ID NO: 727652 - DNA, 22 bp, Artificial Sequence
  chemically synthesized
tccatgttcaaatttgcagaat

SEQ ID NO: 727653 - DNA, 22 bp, Artificial Sequence
  chemically synthesized
gtccatgttcaaatttgcagaa

SEQ ID NO: 727654 - DNA, 22 bp, Artificial Sequence
  chemically synthesized
tgtaggttacattctgcaaatt

SEQ ID NO: 727655 - DNA, 22 bp, Artificial Sequence
  chemically synthesized
tgtccatgttcaaatttgcaga

SEQ ID NO: 727656 - DNA, 22 bp, Artificial Sequence
  chemically synthesized
taggttacattctgcaaatttg

SEQ ID NO: 727657 - DNA, 22 bp, Artificial Sequence
  chemically synthesized
cattttgtccatgttcaaattt

SEQ ID NO: 727658 - DNA, 22 bp, Artificial Sequence
  chemically synthesized
cattctgcaaatttgaacatgg

SEQ ID NO: 727659 - DNA, 22 bp, Artificial Sequence
  chemically synthesized
attgcattttgtccatgttcaa

SEQ ID NO: 727660 - DNA, 22 bp, Artificial Sequence
  chemically synthesized
tgcaaatttgaacatggacaaa

SEQ ID NO: 727661 - DNA, 22 bp, Artificial Sequence
  chemically synthesized
tattgattgcattttgtccatg

SEQ ID NO: 727662 - DNA, 22 bp, Artificial Sequence
  chemically synthesized
caaatttgaacatggacaaaat

SEQ ID NO: 727663 - DNA, 22 bp, Artificial Sequence
  chemically synthesized
tggattatattgattgcatttt

SEQ ID NO: 727664 - DNA, 22 bp, Artificial Sequence
  chemically synthesized
gaacatggacaaaatgcaatca

SEQ ID NO: 727665 - DNA, 22 bp, Artificial Sequence
  chemically synthesized
aacatggacaaaatgcaatcaa

SEQ ID NO: 727666 - DNA, 22 bp, Artificial Sequence
  chemically synthesized
tgcagtgttatggattatattg

SEQ ID NO: 727667 - DNA, 22 bp, Artificial Sequence
  chemically synthesized
caagacatctgtgcagtgttat

SEQ ID NO: 727668 - DNA, 22 bp, Artificial Sequence
  chemically synthesized
tccaagacatctgtgcagtgtt

SEQ ID NO: 727669 - DNA, 22 bp, Artificial Sequence
  chemically synthesized
caatctctccaagacatctgtg

SEQ ID NO: 727670 - DNA, 22 bp, Artificial Sequence
  chemically synthesized
tgcaatctctccaagacatctg

SEQ ID NO: 727671 - DNA, 22 bp, Artificial Sequence
  chemically synthesized
ctgcaatctctccaagacatct

SEQ ID NO: 727672 - DNA, 22 bp, Artificial Sequence
  chemically synthesized
cacagatgtcttggagagattg

SEQ ID NO: 727673 - DNA, 22 bp, Artificial Sequence
  chemically synthesized
gtgaatgatttctgcaatctct

SEQ ID NO: 727674 - DNA, 22 bp, Artificial Sequence
  chemically synthesized
ctggtgaatgatttctgcaatc

SEQ ID NO: 727675 - DNA, 22 bp, Artificial Sequence
  chemically synthesized
agcctcctggtgaatgatttct

SEQ ID NO: 727676 - DNA, 22 bp, Artificial Sequence
  chemically synthesized
ggagagattgcagaaatcattc

SEQ ID NO: 727677 - DNA, 22 bp, Artificial Sequence
  chemically synthesized
gagagattgcagaaatcattca

SEQ ID NO: 727678 - DNA, 22 bp, Artificial Sequence
  chemically synthesized
gacattcagcctcctggtgaat

SEQ ID NO: 727679 - DNA, 22 bp, Artificial Sequence
  chemically synthesized
cgacattcagcctcctggtgaa

SEQ ID NO: 727680 - DNA, 22 bp, Artificial Sequence
  chemically synthesized
ttcgacattcagcctcctggtg

SEQ ID NO: 727681 - DNA, 22 bp, Artificial Sequence
  chemically synthesized
cagaaatcattcaccaggaggc

SEQ ID NO: 727682 - DNA, 22 bp, Artificial Sequence
  chemically synthesized
taattcttcgacattcagcctc

SEQ ID NO: 727683 - DNA, 22 bp, Artificial Sequence
  chemically synthesized
ataattcttcgacattcagcct

SEQ ID NO: 727684 - DNA, 22 bp, Artificial Sequence
  chemically synthesized
tataattcttcgacattcagcc

SEQ ID NO: 727685 - DNA, 22 bp, Artificial Sequence
  chemically synthesized
accaggaggctgaatgtcgaag

SEQ ID NO: 727686 - DNA, 22 bp, Artificial Sequence
  chemically synthesized
aatgcaattttataattcttcg

SEQ ID NO: 727687 - DNA, 22 bp, Artificial Sequence
  chemically synthesized
aatgtcgaagaattataaaatt

SEQ ID NO: 727688 - DNA, 22 bp, Artificial Sequence
  chemically synthesized
tccatctaaatgcaattttata

SEQ ID NO: 727689 - DNA, 22 bp, Artificial Sequence
  chemically synthesized
gtccatctaaatgcaattttat

SEQ ID NO: 727690 - DNA, 22 bp, Artificial Sequence
  chemically synthesized
acttgtccatctaaatgcaatt

SEQ ID NO: 727691 - DNA, 22 bp, Artificial Sequence
  chemically synthesized
tgacttgtccatctaaatgcaa

SEQ ID NO: 727692 - DNA, 22 bp, Artificial Sequence
  chemically synthesized
ctgacttgtccatctaaatgca

SEQ ID NO: 727693 - DNA, 22 bp, Artificial Sequence
  chemically synthesized
tctgacttgtccatctaaatgc

SEQ ID NO: 727694 - DNA, 22 bp, Artificial Sequence
  chemically synthesized
ttttctgacttgtccatctaaa

SEQ ID NO: 727695 - DNA, 22 bp, Artificial Sequence
  chemically synthesized
taaaattgcatttagatggaca

SEQ ID NO: 727696 - DNA, 22 bp, Artificial Sequence
  chemically synthesized
aacctgttttctgacttgtcca

SEQ ID NO: 727697 - DNA, 22 bp, Artificial Sequence
  chemically synthesized
aaacctgttttctgacttgtcc

SEQ ID NO: 727698 - DNA, 22 bp, Artificial Sequence
  chemically synthesized
taaacctgttttctgacttgtc

SEQ ID NO: 727699 - DNA, 22 bp, Artificial Sequence
  chemically synthesized
ttaaacctgttttctgacttgt

SEQ ID NO: 727700 - DNA, 22 bp, Artificial Sequence
  chemically synthesized
catttagatggacaagtcagaa

SEQ ID NO: 727701 - DNA, 22 bp, Artificial Sequence
  chemically synthesized
tttaaacctgttttctgacttg

SEQ ID NO: 727702 - DNA, 22 bp, Artificial Sequence
  chemically synthesized
ctttttaaacctgttttctgac

SEQ ID NO: 727703 - DNA, 22 bp, Artificial Sequence
  chemically synthesized
agatggacaagtcagaaaacag

SEQ ID NO: 727704 - DNA, 22 bp, Artificial Sequence
  chemically synthesized
gatggacaagtcagaaaacagg

SEQ ID NO: 727705 - DNA, 22 bp, Artificial Sequence
  chemically synthesized
aaaatgtactactttttaaacc

SEQ ID NO: 727706 - DNA, 22 bp, Artificial Sequence
  chemically synthesized
aaaaatgtactactttttaaac

SEQ ID NO: 727707 - DNA, 22 bp, Artificial Sequence
  chemically synthesized
aaaaagtagtacatttttaaat

SEQ ID NO: 727708 - DNA, 22 bp, Artificial Sequence
  chemically synthesized
aaaagtagtacatttttaaatt

SEQ ID NO: 727709 - DNA, 22 bp, Artificial Sequence
  chemically synthesized
catggtcataatgaaatcacaa

SEQ ID NO: 727710 - DNA, 22 bp, Artificial Sequence
  chemically synthesized
attccatggtcataatgaaatc

SEQ ID NO: 727711 - DNA, 22 bp, Artificial Sequence
  chemically synthesized
ttaaatttgtgatttcattatg

SEQ ID NO: 727712 - DNA, 22 bp, Artificial Sequence
  chemically synthesized
taaatttgtgatttcattatga

SEQ ID NO: 727713 - DNA, 22 bp, Artificial Sequence
  chemically synthesized
aaatttgtgatttcattatgac

SEQ ID NO: 727714 - DNA, 22 bp, Artificial Sequence
  chemically synthesized
cctcattccatggtcataatga

SEQ ID NO: 727715 - DNA, 22 bp, Artificial Sequence
  chemically synthesized
aatttgtgatttcattatgacc

SEQ ID NO: 727716 - DNA, 22 bp, Artificial Sequence
  chemically synthesized
acctcattccatggtcataatg

SEQ ID NO: 727717 - DNA, 22 bp, Artificial Sequence
  chemically synthesized
tacctcattccatggtcataat

SEQ ID NO: 727718 - DNA, 22 bp, Artificial Sequence
  chemically synthesized
ttacctcattccatggtcataa

SEQ ID NO: 727719 - DNA, 22 bp, Artificial Sequence
  chemically synthesized
gtgatttcattatgaccatgga

SEQ ID NO: 727720 - DNA, 22 bp, Artificial Sequence
  chemically synthesized
tgatttcattatgaccatggaa

SEQ ID NO: 727721 - DNA, 22 bp, Artificial Sequence
  chemically synthesized
tgcttttacctcattccatggt

SEQ ID NO: 727722 - DNA, 22 bp, Artificial Sequence
  chemically synthesized
cattatgaccatggaatgaggt

SEQ ID NO: 727723 - DNA, 22 bp, Artificial Sequence
  chemically synthesized
attatgaccatggaatgaggta

SEQ ID NO: 727724 - DNA, 22 bp, Artificial Sequence
  chemically synthesized
cagttatgcttttacctcattc

SEQ ID NO: 727725 - DNA, 22 bp, Artificial Sequence
  chemically synthesized
tgaccatggaatgaggtaaaag

SEQ ID NO: 727726 - DNA, 22 bp, Artificial Sequence
  chemically synthesized
actacagttatgcttttacctc

SEQ ID NO: 727727 - DNA, 22 bp, Artificial Sequence
  chemically synthesized
ctgactacagttatgcttttac

SEQ ID NO: 727728 - DNA, 22 bp, Artificial Sequence
  chemically synthesized
agtgtaaattgctgactacagt

SEQ ID NO: 727729 - DNA, 22 bp, Artificial Sequence
  chemically synthesized
aagtgtaaattgctgactacag

SEQ ID NO: 727730 - DNA, 22 bp, Artificial Sequence
  chemically synthesized
tatttaagtgtaaattgctgac

SEQ ID NO: 727731 - DNA, 22 bp, Artificial Sequence
  chemically synthesized
tgtatttaagtgtaaattgctg

SEQ ID NO: 727732 - DNA, 22 bp, Artificial Sequence
  chemically synthesized
ctgtatttaagtgtaaattgct

SEQ ID NO: 727733 - DNA, 22 bp, Artificial Sequence
  chemically synthesized
tctgtatttaagtgtaaattgc

SEQ ID NO: 727734 - DNA, 22 bp, Artificial Sequence
  chemically synthesized
cattttctgtatttaagtgtaa

SEQ ID NO: 727735 - DNA, 22 bp, Artificial Sequence
  chemically synthesized
tagtcagcaatttacacttaaa

SEQ ID NO: 727736 - DNA, 22 bp, Artificial Sequence
  chemically synthesized
gcattttctgtatttaagtgta

SEQ ID NO: 727737 - DNA, 22 bp, Artificial Sequence
  chemically synthesized
tgcattttctgtatttaagtgt

SEQ ID NO: 727738 - DNA, 22 bp, Artificial Sequence
  chemically synthesized
ttgcattttctgtatttaagtg

SEQ ID NO: 727739 - DNA, 22 bp, Artificial Sequence
  chemically synthesized
acacttaaatacagaaaatgca

SEQ ID NO: 727740 - DNA, 22 bp, Artificial Sequence
  chemically synthesized
cacttaaatacagaaaatgcaa

SEQ ID NO: 727741 - DNA, 22 bp, Artificial Sequence
  chemically synthesized
tgtacatagtgtcttttgcatt

SEQ ID NO: 727742 - DNA, 22 bp, Artificial Sequence
  chemically synthesized
aaatacagaaaatgcaaaagac

SEQ ID NO: 727743 - DNA, 22 bp, Artificial Sequence
  chemically synthesized
aatacagaaaatgcaaaagaca

SEQ ID NO: 727744 - DNA, 22 bp, Artificial Sequence
  chemically synthesized
ctatgtacatagtgtcttttgc

SEQ ID NO: 727745 - DNA, 22 bp, Artificial Sequence
  chemically synthesized
ctcctatgtacatagtgtcttt

SEQ ID NO: 727746 - DNA, 22 bp, Artificial Sequence
  chemically synthesized
cctcctatgtacatagtgtctt

SEQ ID NO: 727747 - DNA, 22 bp, Artificial Sequence
  chemically synthesized
tcctcctatgtacatagtgtct

SEQ ID NO: 727748 - DNA, 22 bp, Artificial Sequence
  chemically synthesized
ctttcctcctatgtacatagtg

SEQ ID NO: 727749 - DNA, 22 bp, Artificial Sequence
  chemically synthesized
acatccatacctcctttcctcc

SEQ ID NO: 727750 - DNA, 22 bp, Artificial Sequence
  chemically synthesized
tcacatccatacctcctttcct

SEQ ID NO: 727751 - DNA, 22 bp, Artificial Sequence
  chemically synthesized
ctcacatccatacctcctttcc

SEQ ID NO: 727752 - DNA, 22 bp, Artificial Sequence
  chemically synthesized
tgtacataggaggaaaggaggt

SEQ ID NO: 727753 - DNA, 22 bp, Artificial Sequence
  chemically synthesized
ttctcacatccatacctccttt

SEQ ID NO: 727754 - DNA, 22 bp, Artificial Sequence
  chemically synthesized
cttctcacatccatacctcctt

SEQ ID NO: 727755 - DNA, 22 bp, Artificial Sequence
  chemically synthesized
tttcttctcacatccatacctc

SEQ ID NO: 727756 - DNA, 22 bp, Artificial Sequence
  chemically synthesized
ctgtttcttctcacatccatac

SEQ ID NO: 727757 - DNA, 22 bp, Artificial Sequence
  chemically synthesized
cctcctgtttcttctcacatcc

SEQ ID NO: 727758 - DNA, 22 bp, Artificial Sequence
  chemically synthesized
tccctcctgtttcttctcacat

SEQ ID NO: 727759 - DNA, 22 bp, Artificial Sequence
  chemically synthesized
ctccctcctgtttcttctcaca

SEQ ID NO: 727760 - DNA, 22 bp, Artificial Sequence
  chemically synthesized
ggcttctccctcctgtttcttc

SEQ ID NO: 727761 - DNA, 22 bp, Artificial Sequence
  chemically synthesized
attaggcttctccctcctgttt

SEQ ID NO: 727762 - DNA, 22 bp, Artificial Sequence
  chemically synthesized
aagatcattcattaggcttctc

SEQ ID NO: 727763 - DNA, 22 bp, Artificial Sequence
  chemically synthesized
atctgaagatcattcattaggc

SEQ ID NO: 727764 - DNA, 22 bp, Artificial Sequence
  chemically synthesized
catctgaagatcattcattagg

SEQ ID NO: 727765 - DNA, 22 bp, Artificial Sequence
  chemically synthesized
tcatctgaagatcattcattag

SEQ ID NO: 727766 - DNA, 22 bp, Artificial Sequence
  chemically synthesized
ttcatctgaagatcattcatta

SEQ ID NO: 727767 - DNA, 22 bp, Artificial Sequence
  chemically synthesized
ttttcatctgaagatcattcat

SEQ ID NO: 727768 - DNA, 22 bp, Artificial Sequence
  chemically synthesized
attcttttcatctgaagatcat

SEQ ID NO: 727769 - DNA, 22 bp, Artificial Sequence
  chemically synthesized
attgattcttttcatctgaaga

SEQ ID NO: 727770 - DNA, 22 bp, Artificial Sequence
  chemically synthesized
cattgattcttttcatctgaag

SEQ ID NO: 727771 - DNA, 22 bp, Artificial Sequence
  chemically synthesized
tcattgattcttttcatctgaa

SEQ ID NO: 727772 - DNA, 22 bp, Artificial Sequence
  chemically synthesized
ttcattgattcttttcatctga

SEQ ID NO: 727773 - DNA, 22 bp, Artificial Sequence
  chemically synthesized
atgaatgatcttcagatgaaaa

SEQ ID NO: 727774 - DNA, 22 bp, Artificial Sequence
  chemically synthesized
gatatttttcattgattctttt

SEQ ID NO: 727775 - DNA, 22 bp, Artificial Sequence
  chemically synthesized
cagatgaaaagaatcaatgaaa

SEQ ID NO: 727776 - DNA, 22 bp, Artificial Sequence
  chemically synthesized
agatgaaaagaatcaatgaaaa

SEQ ID NO: 727777 - DNA, 22 bp, Artificial Sequence
  chemically synthesized
accacagctggatatttttcat

SEQ ID NO: 727778 - DNA, 22 bp, Artificial Sequence
  chemically synthesized
aaccacagctggatatttttca

SEQ ID NO: 727779 - DNA, 22 bp, Artificial Sequence
  chemically synthesized
aaagcatttaaccacagctgga

SEQ ID NO: 727780 - DNA, 22 bp, Artificial Sequence
  chemically synthesized
gaaagcatttaaccacagctgg

SEQ ID NO: 727781 - DNA, 22 bp, Artificial Sequence
  chemically synthesized
cataaatggcaatttgaaagca

SEQ ID NO: 727782 - DNA, 22 bp, Artificial Sequence
  chemically synthesized
tggttaaatgctttcaaattgc

SEQ ID NO: 727783 - DNA, 22 bp, Artificial Sequence
  chemically synthesized
aatgctttcaaattgccattta

SEQ ID NO: 727784 - DNA, 22 bp, Artificial Sequence
  chemically synthesized
catgcatcaattgcataaatgg

SEQ ID NO: 727785 - DNA, 22 bp, Artificial Sequence
  chemically synthesized
ttccatgcatcaattgcataaa

SEQ ID NO: 727786 - DNA, 22 bp, Artificial Sequence
  chemically synthesized
tcaaattgccatttatgcaatt

SEQ ID NO: 727787 - DNA, 22 bp, Artificial Sequence
  chemically synthesized
caaattgccatttatgcaattg

SEQ ID NO: 727788 - DNA, 22 bp, Artificial Sequence
  chemically synthesized
aaattgccatttatgcaattga

SEQ ID NO: 727789 - DNA, 22 bp, Artificial Sequence
  chemically synthesized
ccatttatgcaattgatgcatg

SEQ ID NO: 727790 - DNA, 22 bp, Artificial Sequence
  chemically synthesized
acaaatacctattccatgcatc

SEQ ID NO: 727791 - DNA, 22 bp, Artificial Sequence
  chemically synthesized
atgcaattgatgcatggaatag

SEQ ID NO: 727792 - DNA, 22 bp, Artificial Sequence
  chemically synthesized
tgcaattgatgcatggaatagg

SEQ ID NO: 727793 - DNA, 22 bp, Artificial Sequence
  chemically synthesized
cactgacaaatacctattccat

SEQ ID NO: 727794 - DNA, 22 bp, Artificial Sequence
  chemically synthesized
tgcactgacaaatacctattcc

SEQ ID NO: 727795 - DNA, 22 bp, Artificial Sequence
  chemically synthesized
tctgcactgacaaatacctatt

SEQ ID NO: 727796 - DNA, 22 bp, Artificial Sequence
  chemically synthesized
atgcatggaataggtatttgtc

SEQ ID NO: 727797 - DNA, 22 bp, Artificial Sequence
  chemically synthesized
gcactctctgcactgacaaata

SEQ ID NO: 727798 - DNA, 22 bp, Artificial Sequence
  chemically synthesized
ttcgcactctctgcactgacaa

SEQ ID NO: 727799 - DNA, 22 bp, Artificial Sequence
  chemically synthesized
tgttcgcactctctgcactgac

SEQ ID NO: 727800 - DNA, 22 bp, Artificial Sequence
  chemically synthesized
gtcagtgcagagagtgcgaaca

SEQ ID NO: 727801 - DNA, 22 bp, Artificial Sequence
  chemically synthesized
ataataatgttctgttcgcact

SEQ ID NO: 727802 - DNA, 22 bp, Artificial Sequence
  chemically synthesized
tcagtgcagagagtgcgaacag

SEQ ID NO: 727803 - DNA, 22 bp, Artificial Sequence
  chemically synthesized
cataataatgttctgttcgcac

SEQ ID NO: 727804 - DNA, 22 bp, Artificial Sequence
  chemically synthesized
tttcataataatgttctgttcg

SEQ ID NO: 727805 - DNA, 22 bp, Artificial Sequence
  chemically synthesized
tgtttcataataatgttctgtt

SEQ ID NO: 727806 - DNA, 22 bp, Artificial Sequence
  chemically synthesized
ctctgtttcataataatgttct

SEQ ID NO: 727807 - DNA, 22 bp, Artificial Sequence
  chemically synthesized
ccaaggatcctgctctgtttca

SEQ ID NO: 727808 - DNA, 22 bp, Artificial Sequence
  chemically synthesized
gccaaggatcctgctctgtttc

SEQ ID NO: 727809 - DNA, 22 bp, Artificial Sequence
  chemically synthesized
tgccaaggatcctgctctgttt

SEQ ID NO: 727810 - DNA, 22 bp, Artificial Sequence
  chemically synthesized
gtattttgccaaggatcctgct

SEQ ID NO: 727811 - DNA, 22 bp, Artificial Sequence
  chemically synthesized
ttatgaaacagagcaggatcct

SEQ ID NO: 727812 - DNA, 22 bp, Artificial Sequence
  chemically synthesized
tgaaacagagcaggatccttgg

SEQ ID NO: 727813 - DNA, 22 bp, Artificial Sequence
  chemically synthesized
attggtattttgccaaggatcc

SEQ ID NO: 727814 - DNA, 22 bp, Artificial Sequence
  chemically synthesized
cattggtattttgccaaggatc

SEQ ID NO: 727815 - DNA, 22 bp, Artificial Sequence
  chemically synthesized
tatttcattggtattttgccaa

SEQ ID NO: 727816 - DNA, 22 bp, Artificial Sequence
  chemically synthesized
aaaactgtatttcattggtatt

SEQ ID NO: 727817 - DNA, 22 bp, Artificial Sequence
  chemically synthesized
ttgaaaactgtatttcattggt

SEQ ID NO: 727818 - DNA, 22 bp, Artificial Sequence
  chemically synthesized
ctattgaaaactgtatttcatt

SEQ ID NO: 727819 - DNA, 22 bp, Artificial Sequence
  chemically synthesized
ggcaaaataccaatgaaataca

SEQ ID NO: 727820 - DNA, 22 bp, Artificial Sequence
  chemically synthesized
actattgaaaactgtatttcat

SEQ ID NO: 727821 - DNA, 22 bp, Artificial Sequence
  chemically synthesized
gcaaaataccaatgaaatacag

SEQ ID NO: 727822 - DNA, 22 bp, Artificial Sequence
  chemically synthesized
cttactattgaaaactgtattt

SEQ ID NO: 727823 - DNA, 22 bp, Artificial Sequence
  chemically synthesized
ccttactattgaaaactgtatt

SEQ ID NO: 727824 - DNA, 22 bp, Artificial Sequence
  chemically synthesized
tccttactattgaaaactgtat

SEQ ID NO: 727825 - DNA, 22 bp, Artificial Sequence
  chemically synthesized
cattttccttactattgaaaac

SEQ ID NO: 727826 - DNA, 22 bp, Artificial Sequence
  chemically synthesized
tccattttccttactattgaaa

SEQ ID NO: 727827 - DNA, 22 bp, Artificial Sequence
  chemically synthesized
acactctccattttccttacta

SEQ ID NO: 727828 - DNA, 22 bp, Artificial Sequence
  chemically synthesized
cacactctccattttccttact

SEQ ID NO: 727829 - DNA, 22 bp, Artificial Sequence
  chemically synthesized
tttcacactctccattttcctt

SEQ ID NO: 727830 - DNA, 22 bp, Artificial Sequence
  chemically synthesized
tcaatagtaaggaaaatggaga

SEQ ID NO: 727831 - DNA, 22 bp, Artificial Sequence
  chemically synthesized
caatagtaaggaaaatggagag

SEQ ID NO: 727832 - DNA, 22 bp, Artificial Sequence
  chemically synthesized
aatagtaaggaaaatggagagt

SEQ ID NO: 727833 - DNA, 22 bp, Artificial Sequence
  chemically synthesized
acattatttcacactctccatt

SEQ ID NO: 727834 - DNA, 22 bp, Artificial Sequence
  chemically synthesized
attgacattatttcacactctc

SEQ ID NO: 727835 - DNA, 22 bp, Artificial Sequence
  chemically synthesized
taattgacattatttcacactc

SEQ ID NO: 727836 - DNA, 22 bp, Artificial Sequence
  chemically synthesized
tctaattgacattatttcacac

SEQ ID NO: 727837 - DNA, 22 bp, Artificial Sequence
  chemically synthesized
tctctaattgacattatttcac

SEQ ID NO: 727838 - DNA, 22 bp, Artificial Sequence
  chemically synthesized
ctctctaattgacattatttca

SEQ ID NO: 727839 - DNA, 22 bp, Artificial Sequence
  chemically synthesized
agcagcatgcatttctctctaa

SEQ ID NO: 727840 - DNA, 22 bp, Artificial Sequence
  chemically synthesized
cagcagcatgcatttctctcta

SEQ ID NO: 727841 - DNA, 22 bp, Artificial Sequence
  chemically synthesized
gagagaaatgcatgctgctgaa

SEQ ID NO: 727842 - DNA, 22 bp, Artificial Sequence
  chemically synthesized
caggaatagtgccgagagtctt

SEQ ID NO: 727843 - DNA, 22 bp, Artificial Sequence
  chemically synthesized
ccaggaatagtgccgagagtct

SEQ ID NO: 727844 - DNA, 22 bp, Artificial Sequence
  chemically synthesized
ttccaggaatagtgccgagagt

SEQ ID NO: 727845 - DNA, 22 bp, Artificial Sequence
  chemically synthesized
ttcttccaggaatagtgccgag

SEQ ID NO: 727846 - DNA, 22 bp, Artificial Sequence
  chemically synthesized
ctgaagactctcggcactattc

SEQ ID NO: 727847 - DNA, 22 bp, Artificial Sequence
  chemically synthesized
aagactctcggcactattcctg

SEQ ID NO: 727848 - DNA, 22 bp, Artificial Sequence
  chemically synthesized
tcggcactattcctggaagaat

SEQ ID NO: 727849 - DNA, 22 bp, Artificial Sequence
  chemically synthesized
agcatggtggttattcttccag

SEQ ID NO: 727850 - DNA, 22 bp, Artificial Sequence
  chemically synthesized
ggcactattcctggaagaataa

SEQ ID NO: 727851 - DNA, 22 bp, Artificial Sequence
  chemically synthesized
taagcatggtggttattcttcc

SEQ ID NO: 727852 - DNA, 22 bp, Artificial Sequence
  chemically synthesized
ctaagcatggtggttattcttc

SEQ ID NO: 727853 - DNA, 22 bp, Artificial Sequence
  chemically synthesized
ttcctggaagaataaccaccat

SEQ ID NO: 727854 - DNA, 22 bp, Artificial Sequence
  chemically synthesized
cggatttctaagcatggtggtt

SEQ ID NO: 727855 - DNA, 22 bp, Artificial Sequence
  chemically synthesized
ctggaagaataaccaccatgct

SEQ ID NO: 727856 - DNA, 22 bp, Artificial Sequence
  chemically synthesized
tccggatttctaagcatggtgg

SEQ ID NO: 727857 - DNA, 22 bp, Artificial Sequence
  chemically synthesized
gaagaataaccaccatgcttag

SEQ ID NO: 727858 - DNA, 22 bp, Artificial Sequence
  chemically synthesized
ccagaactctccggatttctaa

SEQ ID NO: 727859 - DNA, 22 bp, Artificial Sequence
  chemically synthesized
cccagaactctccggatttcta

SEQ ID NO: 727860 - DNA, 22 bp, Artificial Sequence
  chemically synthesized
tttcccagaactctccggattt

SEQ ID NO: 727861 - DNA, 22 bp, Artificial Sequence
  chemically synthesized
tggccattgtttcccagaactc

SEQ ID NO: 727862 - DNA, 22 bp, Artificial Sequence
  chemically synthesized
agaaatccggagagttctggga

SEQ ID NO: 727863 - DNA, 22 bp, Artificial Sequence
  chemically synthesized
gaaatccggagagttctgggaa

SEQ ID NO: 727864 - DNA, 22 bp, Artificial Sequence
  chemically synthesized
tgtggccattgtttcccagaac

SEQ ID NO: 727865 - DNA, 22 bp, Artificial Sequence
  chemically synthesized
ctgtggccattgtttcccagaa

SEQ ID NO: 727866 - DNA, 22 bp, Artificial Sequence
  chemically synthesized
tttctgtggccattgtttccca

SEQ ID NO: 727867 - DNA, 22 bp, Artificial Sequence
  chemically synthesized
gtttctgtggccattgtttccc

SEQ ID NO: 727868 - DNA, 22 bp, Artificial Sequence
  chemically synthesized
tgggaaacaatggccacagaaa

SEQ ID NO: 727869 - DNA, 22 bp, Artificial Sequence
  chemically synthesized
ggaaacaatggccacagaaaca

SEQ ID NO: 727870 - DNA, 22 bp, Artificial Sequence
  chemically synthesized
aatcaataagtcttgtttctgt

SEQ ID NO: 727871 - DNA, 22 bp, Artificial Sequence
  chemically synthesized
aaatcaataagtcttgtttctg

SEQ ID NO: 727872 - DNA, 22 bp, Artificial Sequence
  chemically synthesized
atttaaatcaataagtcttgtt

SEQ ID NO: 727873 - DNA, 22 bp, Artificial Sequence
  chemically synthesized
aatttaaatcaataagtcttgt

SEQ ID NO: 727874 - DNA, 22 bp, Artificial Sequence
  chemically synthesized
aaatcttaatttaaatcaataa

SEQ ID NO: 727875 - DNA, 22 bp, Artificial Sequence
  chemically synthesized
agcacaactgaaatcttaattt

SEQ ID NO: 727876 - DNA, 22 bp, Artificial Sequence
  chemically synthesized
aagcacaactgaaatcttaatt

SEQ ID NO: 727877 - DNA, 22 bp, Artificial Sequence
  chemically synthesized
ttaagcacaactgaaatcttaa

SEQ ID NO: 727878 - DNA, 22 bp, Artificial Sequence
  chemically synthesized
attgatttaaattaagatttca

SEQ ID NO: 727879 - DNA, 22 bp, Artificial Sequence
  chemically synthesized
cttaagcacaactgaaatctta

SEQ ID NO: 727880 - DNA, 22 bp, Artificial Sequence
  chemically synthesized
ttgatttaaattaagatttcag

SEQ ID NO: 727881 - DNA, 22 bp, Artificial Sequence
  chemically synthesized
atttaaattaagatttcagttg

SEQ ID NO: 727882 - DNA, 22 bp, Artificial Sequence
  chemically synthesized
catgtttcttaagcacaactga

SEQ ID NO: 727883 - DNA, 22 bp, Artificial Sequence
  chemically synthesized
aaattaagatttcagttgtgct

SEQ ID NO: 727884 - DNA, 22 bp, Artificial Sequence
  chemically synthesized
aattaagatttcagttgtgctt

SEQ ID NO: 727885 - DNA, 22 bp, Artificial Sequence
  chemically synthesized
agatttcagttgtgcttaagaa

SEQ ID NO: 727886 - DNA, 22 bp, Artificial Sequence
  chemically synthesized
tagtcattacatgtttcttaag

SEQ ID NO: 727887 - DNA, 22 bp, Artificial Sequence
  chemically synthesized
cagttgtgcttaagaaacatgt

SEQ ID NO: 727888 - DNA, 22 bp, Artificial Sequence
  chemically synthesized
agttgtgcttaagaaacatgta

SEQ ID NO: 727889 - DNA, 22 bp, Artificial Sequence
  chemically synthesized
tgcttaagaaacatgtaatgac

SEQ ID NO: 727890 - DNA, 22 bp, Artificial Sequence
  chemically synthesized
aagaaacatgtaatgactacaa

SEQ ID NO: 727891 - DNA, 22 bp, Artificial Sequence
  chemically synthesized
agaaacatgtaatgactacaat

SEQ ID NO: 727892 - DNA, 22 bp, Artificial Sequence
  chemically synthesized
tcagatgatataattgtagtca

SEQ ID NO: 727893 - DNA, 22 bp, Artificial Sequence
  chemically synthesized
gtcagatgatataattgtagtc

SEQ ID NO: 727894 - DNA, 22 bp, Artificial Sequence
  chemically synthesized
ttgtcagatgatataattgtag

SEQ ID NO: 727895 - DNA, 22 bp, Artificial Sequence
  chemically synthesized
cttgtcagatgatataattgta

SEQ ID NO: 727896 - DNA, 22 bp, Artificial Sequence
  chemically synthesized
tcttgtcagatgatataattgt

SEQ ID NO: 727897 - DNA, 22 bp, Artificial Sequence
  chemically synthesized
ttcttgtcagatgatataattg

SEQ ID NO: 727898 - DNA, 22 bp, Artificial Sequence
  chemically synthesized
tttttcttgtcagatgatataa

SEQ ID NO: 727899 - DNA, 22 bp, Artificial Sequence
  chemically synthesized
caattatatcatctgacaagaa

SEQ ID NO: 727900 - DNA, 22 bp, Artificial Sequence
  chemically synthesized
tacatattatttttcttgtcag

SEQ ID NO: 727901 - DNA, 22 bp, Artificial Sequence
  chemically synthesized
cctatacatattatttttcttg

SEQ ID NO: 727902 - DNA, 22 bp, Artificial Sequence
  chemically synthesized
gcctatacatattatttttctt

SEQ ID NO: 727903 - DNA, 22 bp, Artificial Sequence
  chemically synthesized
tatcatctgacaagaaaaataa

SEQ ID NO: 727904 - DNA, 22 bp, Artificial Sequence
  chemically synthesized
ttgcctatacatattatttttc

SEQ ID NO: 727905 - DNA, 22 bp, Artificial Sequence
  chemically synthesized
acaagaaaaataatatgtatag

SEQ ID NO: 727906 - DNA, 22 bp, Artificial Sequence
  chemically synthesized
aatatcactcttgcctatacat

SEQ ID NO: 727907 - DNA, 22 bp, Artificial Sequence
  chemically synthesized
aaatatcactcttgcctataca

SEQ ID NO: 727908 - DNA, 22 bp, Artificial Sequence
  chemically synthesized
taaatatcactcttgcctatac

SEQ ID NO: 727909 - DNA, 22 bp, Artificial Sequence
  chemically synthesized
agtacaacattttaaatatcac

SEQ ID NO: 727910 - DNA, 22 bp, Artificial Sequence
  chemically synthesized
atacgaatggttaagtacaaca

SEQ ID NO: 727911 - DNA, 22 bp, Artificial Sequence
  chemically synthesized
aaaatgttgtacttaaccattc

SEQ ID NO: 727912 - DNA, 22 bp, Artificial Sequence
  chemically synthesized
aaatgttgtacttaaccattcg

SEQ ID NO: 727913 - DNA, 22 bp, Artificial Sequence
  chemically synthesized
tatccatctgatacgaatggtt

SEQ ID NO: 727914 - DNA, 22 bp, Artificial Sequence
  chemically synthesized
tgtatccatctgatacgaatgg

SEQ ID NO: 727915 - DNA, 22 bp, Artificial Sequence
  chemically synthesized
ttctgtatccatctgatacgaa

SEQ ID NO: 727916 - DNA, 22 bp, Artificial Sequence
  chemically synthesized
tacttaaccattcgtatcagat

SEQ ID NO: 727917 - DNA, 22 bp, Artificial Sequence
  chemically synthesized
attgttctgtatccatctgata

SEQ ID NO: 727918 - DNA, 22 bp, Artificial Sequence
  chemically synthesized
aaccattcgtatcagatggata

SEQ ID NO: 727919 - DNA, 22 bp, Artificial Sequence
  chemically synthesized
accattcgtatcagatggatac

SEQ ID NO: 727920 - DNA, 22 bp, Artificial Sequence
  chemically synthesized
tgcctgattgttctgtatccat

SEQ ID NO: 727921 - DNA, 22 bp, Artificial Sequence
  chemically synthesized
cctgtgcctgattgttctgtat

SEQ ID NO: 727922 - DNA, 22 bp, Artificial Sequence
  chemically synthesized
gtatcagatggatacagaacaa

SEQ ID NO: 727923 - DNA, 22 bp, Artificial Sequence
  chemically synthesized
attgcctgtgcctgattgttct

SEQ ID NO: 727924 - DNA, 22 bp, Artificial Sequence
  chemically synthesized
cattgcctgtgcctgattgttc

SEQ ID NO: 727925 - DNA, 22 bp, Artificial Sequence
  chemically synthesized
tcattgcctgtgcctgattgtt

SEQ ID NO: 727926 - DNA, 22 bp, Artificial Sequence
  chemically synthesized
ttcattgcctgtgcctgattgt

SEQ ID NO: 727927 - DNA, 22 bp, Artificial Sequence
  chemically synthesized
atttttcattgcctgtgcctga

SEQ ID NO: 727928 - DNA, 22 bp, Artificial Sequence
  chemically synthesized
taatttttcattgcctgtgcct

SEQ ID NO: 727929 - DNA, 22 bp, Artificial Sequence
  chemically synthesized
ttctaatttttcattgcctgtg

SEQ ID NO: 727930 - DNA, 22 bp, Artificial Sequence
  chemically synthesized
tgttctaatttttcattgcctg

SEQ ID NO: 727931 - DNA, 22 bp, Artificial Sequence
  chemically synthesized
attctgttctaatttttcattg

SEQ ID NO: 727932 - DNA, 22 bp, Artificial Sequence
  chemically synthesized
aattctgttctaatttttcatt

SEQ ID NO: 727933 - DNA, 22 bp, Artificial Sequence
  chemically synthesized
taattctgttctaatttttcat

SEQ ID NO: 727934 - DNA, 22 bp, Artificial Sequence
  chemically synthesized
ttaattctgttctaatttttca

SEQ ID NO: 727935 - DNA, 22 bp, Artificial Sequence
  chemically synthesized
aaccttttaattctgttctaat

SEQ ID NO: 727936 - DNA, 22 bp, Artificial Sequence
  chemically synthesized
aaaccttttaattctgttctaa

SEQ ID NO: 727937 - DNA, 22 bp, Artificial Sequence
  chemically synthesized
taaaccttttaattctgttcta

SEQ ID NO: 727938 - DNA, 22 bp, Artificial Sequence
  chemically synthesized
cattttaaaccttttaattctg

SEQ ID NO: 727939 - DNA, 22 bp, Artificial Sequence
  chemically synthesized
ccattttaaaccttttaattct

SEQ ID NO: 727940 - DNA, 22 bp, Artificial Sequence
  chemically synthesized
tccattttaaaccttttaattc

SEQ ID NO: 727941 - DNA, 22 bp, Artificial Sequence
  chemically synthesized
gaacagaattaaaaggtttaaa

SEQ ID NO: 727942 - DNA, 22 bp, Artificial Sequence
  chemically synthesized
caatacatccatgtctttccat

SEQ ID NO: 727943 - DNA, 22 bp, Artificial Sequence
  chemically synthesized
aaaggtttaaaatggaaagaca

SEQ ID NO: 727944 - DNA, 22 bp, Artificial Sequence
  chemically synthesized
aaaatggaaagacatggatgta

SEQ ID NO: 727945 - DNA, 22 bp, Artificial Sequence
  chemically synthesized
aaatggaaagacatggatgtat

SEQ ID NO: 727946 - DNA, 22 bp, Artificial Sequence
  chemically synthesized
agccagtatgttccaatacatc

SEQ ID NO: 727947 - DNA, 22 bp, Artificial Sequence
  chemically synthesized
atattcagccagtatgttccaa

SEQ ID NO: 727948 - DNA, 22 bp, Artificial Sequence
  chemically synthesized
aggcactgatattcagccagta

SEQ ID NO: 727949 - DNA, 22 bp, Artificial Sequence
  chemically synthesized
ccctcaggcactgatattcagc

SEQ ID NO: 727950 - DNA, 22 bp, Artificial Sequence
  chemically synthesized
gaacatactggctgaatatcag

SEQ ID NO: 727951 - DNA, 22 bp, Artificial Sequence
  chemically synthesized
tcaaccattgccctcaggcact

SEQ ID NO: 727952 - DNA, 22 bp, Artificial Sequence
  chemically synthesized
atcaaccattgccctcaggcac

SEQ ID NO: 727953 - DNA, 22 bp, Artificial Sequence
  chemically synthesized
gctgaatatcagtgcctgaggg

SEQ ID NO: 727954 - DNA, 22 bp, Artificial Sequence
  chemically synthesized
aatatcagtgcctgagggcaat

SEQ ID NO: 727955 - DNA, 22 bp, Artificial Sequence
  chemically synthesized
cagatttatcaaccattgccct

SEQ ID NO: 727956 - DNA, 22 bp, Artificial Sequence
  chemically synthesized
acagatttatcaaccattgccc

SEQ ID NO: 727957 - DNA, 22 bp, Artificial Sequence
  chemically synthesized
ttacagatttatcaaccattgc

SEQ ID NO: 727958 - DNA, 22 bp, Artificial Sequence
  chemically synthesized
cttacagatttatcaaccattg

SEQ ID NO: 727959 - DNA, 22 bp, Artificial Sequence
  chemically synthesized
agggcaatggttgataaatctg

SEQ ID NO: 727960 - DNA, 22 bp, Artificial Sequence
  chemically synthesized
aaaaatttcttacagatttatc

SEQ ID NO: 727961 - DNA, 22 bp, Artificial Sequence
  chemically synthesized
ataaatctgtaagaaatttttc

SEQ ID NO: 727962 - DNA, 22 bp, Artificial Sequence
  chemically synthesized
agaaatatgcattgaaaaattt

SEQ ID NO: 727963 - DNA, 22 bp, Artificial Sequence
  chemically synthesized
taagaaatttttcaatgcatat

SEQ ID NO: 727964 - DNA, 22 bp, Artificial Sequence
  chemically synthesized
ttcaatgcatatttctgagcac

SEQ ID NO: 727965 - DNA, 22 bp, Artificial Sequence
  chemically synthesized
tcaatgcatatttctgagcacc

SEQ ID NO: 727966 - DNA, 22 bp, Artificial Sequence
  chemically synthesized
aagggacaaaagggtgctcaga

SEQ ID NO: 727967 - DNA, 22 bp, Artificial Sequence
  chemically synthesized
caatgcatatttctgagcaccc

SEQ ID NO: 727968 - DNA, 22 bp, Artificial Sequence
  chemically synthesized
aatgcatatttctgagcaccct

SEQ ID NO: 727969 - DNA, 22 bp, Artificial Sequence
  chemically synthesized
ttaaagggacaaaagggtgctc

SEQ ID NO: 727970 - DNA, 22 bp, Artificial Sequence
  chemically synthesized
tattaaagggacaaaagggtgc

SEQ ID NO: 727971 - DNA, 22 bp, Artificial Sequence
  chemically synthesized
tcattctattaaagggacaaaa

SEQ ID NO: 727972 - DNA, 22 bp, Artificial Sequence
  chemically synthesized
ctgagcacccttttgtcccttt

SEQ ID NO: 727973 - DNA, 22 bp, Artificial Sequence
  chemically synthesized
tgagcacccttttgtcccttta

SEQ ID NO: 727974 - DNA, 22 bp, Artificial Sequence
  chemically synthesized
agcacccttttgtccctttaat

SEQ ID NO: 727975 - DNA, 22 bp, Artificial Sequence
  chemically synthesized
gaaattatcattctattaaagg

SEQ ID NO: 727976 - DNA, 22 bp, Artificial Sequence
  chemically synthesized
ctggaaattatcattctattaa

SEQ ID NO: 727977 - DNA, 22 bp, Artificial Sequence
  chemically synthesized
gctggaaattatcattctatta

SEQ ID NO: 727978 - DNA, 22 bp, Artificial Sequence
  chemically synthesized
tgctggaaattatcattctatt

SEQ ID NO: 727979 - DNA, 22 bp, Artificial Sequence
  chemically synthesized
ttgtccctttaatagaatgata

SEQ ID NO: 727980 - DNA, 22 bp, Artificial Sequence
  chemically synthesized
tgtccctttaatagaatgataa

SEQ ID NO: 727981 - DNA, 22 bp, Artificial Sequence
  chemically synthesized
gtccctttaatagaatgataat

SEQ ID NO: 727982 - DNA, 22 bp, Artificial Sequence
  chemically synthesized
attttgctggaaattatcattc

SEQ ID NO: 727983 - DNA, 22 bp, Artificial Sequence
  chemically synthesized
tccctttaatagaatgataatt

SEQ ID NO: 727984 - DNA, 22 bp, Artificial Sequence
  chemically synthesized
gattttgctggaaattatcatt

SEQ ID NO: 727985 - DNA, 22 bp, Artificial Sequence
  chemically synthesized
tgattttgctggaaattatcat

SEQ ID NO: 727986 - DNA, 22 bp, Artificial Sequence
  chemically synthesized
ttgattttgctggaaattatca

SEQ ID NO: 727987 - DNA, 22 bp, Artificial Sequence
  chemically synthesized
cttttgattttgctggaaatta

SEQ ID NO: 727988 - DNA, 22 bp, Artificial Sequence
  chemically synthesized
taatagaatgataatttccagc

SEQ ID NO: 727989 - DNA, 22 bp, Artificial Sequence
  chemically synthesized
aatagaatgataatttccagca

SEQ ID NO: 727990 - DNA, 22 bp, Artificial Sequence
  chemically synthesized
atagaatgataatttccagcaa

SEQ ID NO: 727991 - DNA, 22 bp, Artificial Sequence
  chemically synthesized
ctacttttgattttgctggaaa

SEQ ID NO: 727992 - DNA, 22 bp, Artificial Sequence
  chemically synthesized
tactacttttgattttgctgga

SEQ ID NO: 727993 - DNA, 22 bp, Artificial Sequence
  chemically synthesized
ctactacttttgattttgctgg

SEQ ID NO: 727994 - DNA, 22 bp, Artificial Sequence
  chemically synthesized
tttctactacttttgattttgc

SEQ ID NO: 727995 - DNA, 22 bp, Artificial Sequence
  chemically synthesized
atttctactacttttgattttg

SEQ ID NO: 727996 - DNA, 22 bp, Artificial Sequence
  chemically synthesized
tttatttctactacttttgatt

SEQ ID NO: 727997 - DNA, 22 bp, Artificial Sequence
  chemically synthesized
ccagcaaaatcaaaagtagtag

SEQ ID NO: 727998 - DNA, 22 bp, Artificial Sequence
  chemically synthesized
aactgtttatttctactacttt

SEQ ID NO: 727999 - DNA, 22 bp, Artificial Sequence
  chemically synthesized
cagcaaaatcaaaagtagtaga

SEQ ID NO: 728000 - DNA, 22 bp, Artificial Sequence
  chemically synthesized
gaactgtttatttctactactt

SEQ ID NO: 728001 - DNA, 22 bp, Artificial Sequence
  chemically synthesized
tgaactgtttatttctactact

SEQ ID NO: 728002 - DNA, 22 bp, Artificial Sequence
  chemically synthesized
ttgaactgtttatttctactac

SEQ ID NO: 728003 - DNA, 22 bp, Artificial Sequence
  chemically synthesized
ggatttttgaactgtttatttc

SEQ ID NO: 728004 - DNA, 22 bp, Artificial Sequence
  chemically synthesized
aaagttgggatttttgaactgt

SEQ ID NO: 728005 - DNA, 22 bp, Artificial Sequence
  chemically synthesized
aaaagttgggatttttgaactg

SEQ ID NO: 728006 - DNA, 22 bp, Artificial Sequence
  chemically synthesized
taaaagttgggatttttgaact

SEQ ID NO: 728007 - DNA, 22 bp, Artificial Sequence
  chemically synthesized
tttaaaagttgggatttttgaa

SEQ ID NO: 728008 - DNA, 22 bp, Artificial Sequence
  chemically synthesized
aaaaatcccaacttttaaagaa

SEQ ID NO: 728009 - DNA, 22 bp, Artificial Sequence
  chemically synthesized
gcaaatgtcatatgaaggtaat

SEQ ID NO: 728010 - DNA, 22 bp, Artificial Sequence
  chemically synthesized
ggcaaatgtcatatgaaggtaa

SEQ ID NO: 728011 - DNA, 22 bp, Artificial Sequence
  chemically synthesized
ttaaagaattaccttcatatga

SEQ ID NO: 728012 - DNA, 22 bp, Artificial Sequence
  chemically synthesized
taaagaattaccttcatatgac

SEQ ID NO: 728013 - DNA, 22 bp, Artificial Sequence
  chemically synthesized
aaagaattaccttcatatgaca

SEQ ID NO: 728014 - DNA, 22 bp, Artificial Sequence
  chemically synthesized
aagaattaccttcatatgacat

SEQ ID NO: 728015 - DNA, 22 bp, Artificial Sequence
  chemically synthesized
tcaggggtttggcaaatgtcat

SEQ ID NO: 728016 - DNA, 22 bp, Artificial Sequence
  chemically synthesized
ccttcatatgacatttgccaaa

SEQ ID NO: 728017 - DNA, 22 bp, Artificial Sequence
  chemically synthesized
catatgacatttgccaaacccc

SEQ ID NO: 728018 - DNA, 22 bp, Artificial Sequence
  chemically synthesized
atatgacatttgccaaacccct

SEQ ID NO: 728019 - DNA, 22 bp, Artificial Sequence
  chemically synthesized
tagatggttgtcaggggtttgg

SEQ ID NO: 728020 - DNA, 22 bp, Artificial Sequence
  chemically synthesized
tcaattatagatggttgtcagg

SEQ ID NO: 728021 - DNA, 22 bp, Artificial Sequence
  chemically synthesized
gtcaattatagatggttgtcag

SEQ ID NO: 728022 - DNA, 22 bp, Artificial Sequence
  chemically synthesized
tgtcaattatagatggttgtca

SEQ ID NO: 728023 - DNA, 22 bp, Artificial Sequence
  chemically synthesized
ttgtcaattatagatggttgtc

SEQ ID NO: 728024 - DNA, 22 bp, Artificial Sequence
  chemically synthesized
gccaaacccctgacaaccatct

SEQ ID NO: 728025 - DNA, 22 bp, Artificial Sequence
  chemically synthesized
tttgtcaattatagatggttgt

SEQ ID NO: 728026 - DNA, 22 bp, Artificial Sequence
  chemically synthesized
ccaaacccctgacaaccatcta

SEQ ID NO: 728027 - DNA, 22 bp, Artificial Sequence
  chemically synthesized
ttttgtcaattatagatggttg

SEQ ID NO: 728028 - DNA, 22 bp, Artificial Sequence
  chemically synthesized
tttttgtcaattatagatggtt

SEQ ID NO: 728029 - DNA, 22 bp, Artificial Sequence
  chemically synthesized
ttttttgtcaattatagatggt

SEQ ID NO: 728030 - DNA, 22 bp, Artificial Sequence
  chemically synthesized
gcttttttttgtcaattataga

SEQ ID NO: 728031 - DNA, 22 bp, Artificial Sequence
  chemically synthesized
acaaccatctataattgacaaa

SEQ ID NO: 728032 - DNA, 22 bp, Artificial Sequence
  chemically synthesized
tgctcgcttttttttgtcaatt

SEQ ID NO: 728033 - DNA, 22 bp, Artificial Sequence
  chemically synthesized
atgctcgcttttttttgtcaat

SEQ ID NO: 728034 - DNA, 22 bp, Artificial Sequence
  chemically synthesized
agtcaacttatgctcgcttttt

SEQ ID NO: 728035 - DNA, 22 bp, Artificial Sequence
  chemically synthesized
taattgacaaaaaaaagcgagc

SEQ ID NO: 728036 - DNA, 22 bp, Artificial Sequence
  chemically synthesized
gagtcaacttatgctcgctttt

SEQ ID NO: 728037 - DNA, 22 bp, Artificial Sequence
  chemically synthesized
atttgagtcaacttatgctcgc

SEQ ID NO: 728038 - DNA, 22 bp, Artificial Sequence
  chemically synthesized
acaaaaaaaagcgagcataagt

SEQ ID NO: 728039 - DNA, 22 bp, Artificial Sequence
  chemically synthesized
ttaatttgagtcaacttatgct

SEQ ID NO: 728040 - DNA, 22 bp, Artificial Sequence
  chemically synthesized
attaatttgagtcaacttatgc

SEQ ID NO: 728041 - DNA, 22 bp, Artificial Sequence
  chemically synthesized
ttattaatttgagtcaacttat

SEQ ID NO: 728042 - DNA, 22 bp, Artificial Sequence
  chemically synthesized
cttattaatttgagtcaactta

SEQ ID NO: 728043 - DNA, 22 bp, Artificial Sequence
  chemically synthesized
tcttattaatttgagtcaactt

SEQ ID NO: 728044 - DNA, 22 bp, Artificial Sequence
  chemically synthesized
tttcttattaatttgagtcaac

SEQ ID NO: 728045 - DNA, 22 bp, Artificial Sequence
  chemically synthesized
tagctctttcttattaatttga

SEQ ID NO: 728046 - DNA, 22 bp, Artificial Sequence
  chemically synthesized
gtagctctttcttattaatttg

SEQ ID NO: 728047 - DNA, 22 bp, Artificial Sequence
  chemically synthesized
tgtagctctttcttattaattt

SEQ ID NO: 728048 - DNA, 22 bp, Artificial Sequence
  chemically synthesized
aatattttgtagctctttctta

SEQ ID NO: 728049 - DNA, 22 bp, Artificial Sequence
  chemically synthesized
actcaaattaataagaaagagc

SEQ ID NO: 728050 - DNA, 22 bp, Artificial Sequence
  chemically synthesized
taaatattttgtagctctttct

SEQ ID NO: 728051 - DNA, 22 bp, Artificial Sequence
  chemically synthesized
ctaaatattttgtagctctttc

SEQ ID NO: 728052 - DNA, 22 bp, Artificial Sequence
  chemically synthesized
tctaaatattttgtagctcttt

SEQ ID NO: 728053 - DNA, 22 bp, Artificial Sequence
  chemically synthesized
aaattaataagaaagagctaca

SEQ ID NO: 728054 - DNA, 22 bp, Artificial Sequence
  chemically synthesized
ctttctaaatattttgtagctc

SEQ ID NO: 728055 - DNA, 22 bp, Artificial Sequence
  chemically synthesized
ctactttctaaatattttgtag

SEQ ID NO: 728056 - DNA, 22 bp, Artificial Sequence
  chemically synthesized
ataagaaagagctacaaaatat

SEQ ID NO: 728057 - DNA, 22 bp, Artificial Sequence
  chemically synthesized
cctactttctaaatattttgta

SEQ ID NO: 728058 - DNA, 22 bp, Artificial Sequence
  chemically synthesized
tcctactttctaaatattttgt

SEQ ID NO: 728059 - DNA, 22 bp, Artificial Sequence
  chemically synthesized
ttcctactttctaaatattttg

SEQ ID NO: 728060 - DNA, 22 bp, Artificial Sequence
  chemically synthesized
tttcctactttctaaatatttt

SEQ ID NO: 728061 - DNA, 22 bp, Artificial Sequence
  chemically synthesized
gattttttcctactttctaaat

SEQ ID NO: 728062 - DNA, 22 bp, Artificial Sequence
  chemically synthesized
caaaatatttagaaagtaggaa

SEQ ID NO: 728063 - DNA, 22 bp, Artificial Sequence
  chemically synthesized
aatattagattttttcctactt

SEQ ID NO: 728064 - DNA, 22 bp, Artificial Sequence
  chemically synthesized
aaatattagattttttcctact

SEQ ID NO: 728065 - DNA, 22 bp, Artificial Sequence
  chemically synthesized
taaatattagattttttcctac

SEQ ID NO: 728066 - DNA, 22 bp, Artificial Sequence
  chemically synthesized
ttaaatattagattttttccta

SEQ ID NO: 728067 - DNA, 22 bp, Artificial Sequence
  chemically synthesized
tttaaatattagattttttcct

SEQ ID NO: 728068 - DNA, 22 bp, Artificial Sequence
  chemically synthesized
ttttaaatattagattttttcc

SEQ ID NO: 728069 - DNA, 22 bp, Artificial Sequence
  chemically synthesized
agaaagtaggaaaaaatctaat

SEQ ID NO: 728070 - DNA, 22 bp, Artificial Sequence
  chemically synthesized
gaaagtaggaaaaaatctaata

SEQ ID NO: 728071 - DNA, 22 bp, Artificial Sequence
  chemically synthesized
ggcagaatttttttaaatatta

SEQ ID NO: 728072 - DNA, 22 bp, Artificial Sequence
  chemically synthesized
aggcagaatttttttaaatatt

SEQ ID NO: 728073 - DNA, 22 bp, Artificial Sequence
  chemically synthesized
aacaggtgatttaggcagaatt

SEQ ID NO: 728074 - DNA, 22 bp, Artificial Sequence
  chemically synthesized
atatttaaaaaaattctgccta

SEQ ID NO: 728075 - DNA, 22 bp, Artificial Sequence
  chemically synthesized
ggctaaacaggtgatttaggca

SEQ ID NO: 728076 - DNA, 22 bp, Artificial Sequence
  chemically synthesized
cggctaaacaggtgatttaggc

SEQ ID NO: 728077 - DNA, 22 bp, Artificial Sequence
  chemically synthesized
aaaaaaattctgcctaaatcac

SEQ ID NO: 728078 - DNA, 22 bp, Artificial Sequence
  chemically synthesized
aaaaaattctgcctaaatcacc

SEQ ID NO: 728079 - DNA, 22 bp, Artificial Sequence
  chemically synthesized
aacttcggctaaacaggtgatt

SEQ ID NO: 728080 - DNA, 22 bp, Artificial Sequence
  chemically synthesized
tgaacttcggctaaacaggtga

SEQ ID NO: 728081 - DNA, 22 bp, Artificial Sequence
  chemically synthesized
ttctgaacttcggctaaacagg

SEQ ID NO: 728082 - DNA, 22 bp, Artificial Sequence
  chemically synthesized
tgcctaaatcacctgtttagcc

SEQ ID NO: 728083 - DNA, 22 bp, Artificial Sequence
  chemically synthesized
cctaaatcacctgtttagccga

SEQ ID NO: 728084 - DNA, 22 bp, Artificial Sequence
  chemically synthesized
actattctgaacttcggctaaa

SEQ ID NO: 728085 - DNA, 22 bp, Artificial Sequence
  chemically synthesized
aatcacctgtttagccgaagtt

SEQ ID NO: 728086 - DNA, 22 bp, Artificial Sequence
  chemically synthesized
ttcactattctgaacttcggct

SEQ ID NO: 728087 - DNA, 22 bp, Artificial Sequence
  chemically synthesized
attgttcactattctgaacttc

SEQ ID NO: 728088 - DNA, 22 bp, Artificial Sequence
  chemically synthesized
ctgattgttcactattctgaac

SEQ ID NO: 728089 - DNA, 22 bp, Artificial Sequence
  chemically synthesized
tttagccgaagttcagaatagt

SEQ ID NO: 728090 - DNA, 22 bp, Artificial Sequence
  chemically synthesized
ttgctgattgttcactattctg

SEQ ID NO: 728091 - DNA, 22 bp, Artificial Sequence
  chemically synthesized
agccgaagttcagaatagtgaa

SEQ ID NO: 728092 - DNA, 22 bp, Artificial Sequence
  chemically synthesized
gccgaagttcagaatagtgaac

SEQ ID NO: 728093 - DNA, 22 bp, Artificial Sequence
  chemically synthesized
ttattgctgattgttcactatt

SEQ ID NO: 728094 - DNA, 22 bp, Artificial Sequence
  chemically synthesized
catctattattgctgattgttc

SEQ ID NO: 728095 - DNA, 22 bp, Artificial Sequence
  chemically synthesized
acatctattattgctgattgtt

SEQ ID NO: 728096 - DNA, 22 bp, Artificial Sequence
  chemically synthesized
agaatagtgaacaatcagcaat

SEQ ID NO: 728097 - DNA, 22 bp, Artificial Sequence
  chemically synthesized
atttacatctattattgctgat

SEQ ID NO: 728098 - DNA, 22 bp, Artificial Sequence
  chemically synthesized
catccataagtggaaattgatt

SEQ ID NO: 728099 - DNA, 22 bp, Artificial Sequence
  chemically synthesized
acatccataagtggaaattgat

SEQ ID NO: 728100 - DNA, 22 bp, Artificial Sequence
  chemically synthesized
caaagggcacttacatccataa

SEQ ID NO: 728101 - DNA, 22 bp, Artificial Sequence
  chemically synthesized
ccaaagggcacttacatccata

SEQ ID NO: 728102 - DNA, 22 bp, Artificial Sequence
  chemically synthesized
ccacttatggatgtaagtgccc

SEQ ID NO: 728103 - DNA, 22 bp, Artificial Sequence
  chemically synthesized
cacttatggatgtaagtgccct

SEQ ID NO: 728104 - DNA, 22 bp, Artificial Sequence
  chemically synthesized
aaaaagtatttccaaagggcac

SEQ ID NO: 728105 - DNA, 22 bp, Artificial Sequence
  chemically synthesized
caaaaagtatttccaaagggca

SEQ ID NO: 728106 - DNA, 22 bp, Artificial Sequence
  chemically synthesized
atggatgtaagtgccctttgga

SEQ ID NO: 728107 - DNA, 22 bp, Artificial Sequence
  chemically synthesized
tcaaaaagtatttccaaagggc

SEQ ID NO: 728108 - DNA, 22 bp, Artificial Sequence
  chemically synthesized
tggatgtaagtgccctttggaa

SEQ ID NO: 728109 - DNA, 22 bp, Artificial Sequence
  chemically synthesized
ttcaaaaagtatttccaaaggg

SEQ ID NO: 728110 - DNA, 22 bp, Artificial Sequence
  chemically synthesized
acttttcaaaaagtatttccaa

SEQ ID NO: 728111 - DNA, 22 bp, Artificial Sequence
  chemically synthesized
aacttttcaaaaagtatttcca

SEQ ID NO: 728112 - DNA, 22 bp, Artificial Sequence
  chemically synthesized
ttaacttttcaaaaagtatttc

SEQ ID NO: 728113 - DNA, 22 bp, Artificial Sequence
  chemically synthesized
tggtctcttaacttttcaaaaa

SEQ ID NO: 728114 - DNA, 22 bp, Artificial Sequence
  chemically synthesized
tggaaatactttttgaaaagtt

SEQ ID NO: 728115 - DNA, 22 bp, Artificial Sequence
  chemically synthesized
ggaaatactttttgaaaagtta

SEQ ID NO: 728116 - DNA, 22 bp, Artificial Sequence
  chemically synthesized
gaaatactttttgaaaagttaa

SEQ ID NO: 728117 - DNA, 22 bp, Artificial Sequence
  chemically synthesized
ccactgtggtctcttaactttt

SEQ ID NO: 728118 - DNA, 22 bp, Artificial Sequence
  chemically synthesized
accactgtggtctcttaacttt

SEQ ID NO: 728119 - DNA, 22 bp, Artificial Sequence
  chemically synthesized
tttgaaaagttaagagaccaca

SEQ ID NO: 728120 - DNA, 22 bp, Artificial Sequence
  chemically synthesized
ttgaaaagttaagagaccacag

SEQ ID NO: 728121 - DNA, 22 bp, Artificial Sequence
  chemically synthesized
tgaaaagttaagagaccacagt

SEQ ID NO: 728122 - DNA, 22 bp, Artificial Sequence
  chemically synthesized
gaaaagttaagagaccacagtg

SEQ ID NO: 728123 - DNA, 22 bp, Artificial Sequence
  chemically synthesized
aaaagttaagagaccacagtgg

SEQ ID NO: 728124 - DNA, 22 bp, Artificial Sequence
  chemically synthesized
gtatatggtttaccactgtggt

SEQ ID NO: 728125 - DNA, 22 bp, Artificial Sequence
  chemically synthesized
agtatatggtttaccactgtgg

SEQ ID NO: 728126 - DNA, 22 bp, Artificial Sequence
  chemically synthesized
tagtatatggtttaccactgtg

SEQ ID NO: 728127 - DNA, 22 bp, Artificial Sequence
  chemically synthesized
ttagtatatggtttaccactgt

SEQ ID NO: 728128 - DNA, 22 bp, Artificial Sequence
  chemically synthesized
cttttagtatatggtttaccac

SEQ ID NO: 728129 - DNA, 22 bp, Artificial Sequence
  chemically synthesized
agagaccacagtggtaaaccat

SEQ ID NO: 728130 - DNA, 22 bp, Artificial Sequence
  chemically synthesized
tcatagattgcttttagtatat

SEQ ID NO: 728131 - DNA, 22 bp, Artificial Sequence
  chemically synthesized
gaaaattgtcatagattgcttt

SEQ ID NO: 728132 - DNA, 22 bp, Artificial Sequence
  chemically synthesized
agaaaattgtcatagattgctt

SEQ ID NO: 728133 - DNA, 22 bp, Artificial Sequence
  chemically synthesized
agaggccttagaaaattgtcat

SEQ ID NO: 728134 - DNA, 22 bp, Artificial Sequence
  chemically synthesized
cagaggccttagaaaattgtca

SEQ ID NO: 728135 - DNA, 22 bp, Artificial Sequence
  chemically synthesized
aaagcaatctatgacaattttc

SEQ ID NO: 728136 - DNA, 22 bp, Artificial Sequence
  chemically synthesized
tatagaatttcagaggccttag

SEQ ID NO: 728137 - DNA, 22 bp, Artificial Sequence
  chemically synthesized
tgacaattttctaaggcctctg

SEQ ID NO: 728138 - DNA, 22 bp, Artificial Sequence
  chemically synthesized
agaacctgtatagaatttcaga

SEQ ID NO: 728139 - DNA, 22 bp, Artificial Sequence
  chemically synthesized
gagaacctgtatagaatttcag

SEQ ID NO: 728140 - DNA, 22 bp, Artificial Sequence
  chemically synthesized
tgagaacctgtatagaatttca

SEQ ID NO: 728141 - DNA, 22 bp, Artificial Sequence
  chemically synthesized
tctaaggcctctgaaattctat

SEQ ID NO: 728142 - DNA, 22 bp, Artificial Sequence
  chemically synthesized
ttgagaacctgtatagaatttc

SEQ ID NO: 728143 - DNA, 22 bp, Artificial Sequence
  chemically synthesized
ctaaggcctctgaaattctata

SEQ ID NO: 728144 - DNA, 22 bp, Artificial Sequence
  chemically synthesized
taaggcctctgaaattctatac

SEQ ID NO: 728145 - DNA, 22 bp, Artificial Sequence
  chemically synthesized
aggcctctgaaattctatacag

SEQ ID NO: 728146 - DNA, 22 bp, Artificial Sequence
  chemically synthesized
aatagtacttttgagaacctgt

SEQ ID NO: 728147 - DNA, 22 bp, Artificial Sequence
  chemically synthesized
tgaaattctatacaggttctca

SEQ ID NO: 728148 - DNA, 22 bp, Artificial Sequence
  chemically synthesized
tgaatagtacttttgagaacct

SEQ ID NO: 728149 - DNA, 22 bp, Artificial Sequence
  chemically synthesized
aaattctatacaggttctcaaa

SEQ ID NO: 728150 - DNA, 22 bp, Artificial Sequence
  chemically synthesized
ctgaatagtacttttgagaacc

SEQ ID NO: 728151 - DNA, 22 bp, Artificial Sequence
  chemically synthesized
acttctgaatagtacttttgag

SEQ ID NO: 728152 - DNA, 22 bp, Artificial Sequence
  chemically synthesized
cacttctgaatagtacttttga

SEQ ID NO: 728153 - DNA, 22 bp, Artificial Sequence
  chemically synthesized
tatacaggttctcaaaagtact

SEQ ID NO: 728154 - DNA, 22 bp, Artificial Sequence
  chemically synthesized
tcacttctgaatagtacttttg

SEQ ID NO: 728155 - DNA, 22 bp, Artificial Sequence
  chemically synthesized
tacaggttctcaaaagtactat

SEQ ID NO: 728156 - DNA, 22 bp, Artificial Sequence
  chemically synthesized
gaactttcacttctgaatagta

SEQ ID NO: 728157 - DNA, 22 bp, Artificial Sequence
  chemically synthesized
ttggaactttcacttctgaata

SEQ ID NO: 728158 - DNA, 22 bp, Artificial Sequence
  chemically synthesized
tcaaaagtactattcagaagtg

SEQ ID NO: 728159 - DNA, 22 bp, Artificial Sequence
  chemically synthesized
ttattggaactttcacttctga

SEQ ID NO: 728160 - DNA, 22 bp, Artificial Sequence
  chemically synthesized
aaaagtactattcagaagtgaa

SEQ ID NO: 728161 - DNA, 22 bp, Artificial Sequence
  chemically synthesized
aaagcatctattattggaactt

SEQ ID NO: 728162 - DNA, 22 bp, Artificial Sequence
  chemically synthesized
ttcagaagtgaaagttccaata

SEQ ID NO: 728163 - DNA, 22 bp, Artificial Sequence
  chemically synthesized
agaagtgaaagttccaataata

SEQ ID NO: 728164 - DNA, 22 bp, Artificial Sequence
  chemically synthesized
atatcgttgaaagcatctatta

SEQ ID NO: 728165 - DNA, 22 bp, Artificial Sequence
  chemically synthesized
aatatcgttgaaagcatctatt

SEQ ID NO: 728166 - DNA, 22 bp, Artificial Sequence
  chemically synthesized
taatatcgttgaaagcatctat

SEQ ID NO: 728167 - DNA, 22 bp, Artificial Sequence
  chemically synthesized
ctttaatatcgttgaaagcatc

SEQ ID NO: 728168 - DNA, 22 bp, Artificial Sequence
  chemically synthesized
gctttaatatcgttgaaagcat

SEQ ID NO: 728169 - DNA, 22 bp, Artificial Sequence
  chemically synthesized
tgctttaatatcgttgaaagca

SEQ ID NO: 728170 - DNA, 22 bp, Artificial Sequence
  chemically synthesized
ttgctttaatatcgttgaaagc

SEQ ID NO: 728171 - DNA, 22 bp, Artificial Sequence
  chemically synthesized
caataatagatgctttcaacga

SEQ ID NO: 728172 - DNA, 22 bp, Artificial Sequence
  chemically synthesized
tgtttttgctttaatatcgttg

SEQ ID NO: 728173 - DNA, 22 bp, Artificial Sequence
  chemically synthesized
gtgtttttgctttaatatcgtt

SEQ ID NO: 728174 - DNA, 22 bp, Artificial Sequence
  chemically synthesized
ttgtgtttttgctttaatatcg

SEQ ID NO: 728175 - DNA, 22 bp, Artificial Sequence
  chemically synthesized
ccctcttgtgtttttgctttaa

SEQ ID NO: 728176 - DNA, 22 bp, Artificial Sequence
  chemically synthesized
tcaacgatattaaagcaaaaac

SEQ ID NO: 728177 - DNA, 22 bp, Artificial Sequence
  chemically synthesized
ttcccctcttgtgtttttgctt

SEQ ID NO: 728178 - DNA, 22 bp, Artificial Sequence
  chemically synthesized
caacgatattaaagcaaaaaca

SEQ ID NO: 728179 - DNA, 22 bp, Artificial Sequence
  chemically synthesized
aacgatattaaagcaaaaacac

SEQ ID NO: 728180 - DNA, 22 bp, Artificial Sequence
  chemically synthesized
tcattgttcccctcttgtgttt

SEQ ID NO: 728181 - DNA, 22 bp, Artificial Sequence
  chemically synthesized
aagcaaaaacacaagaggggaa

SEQ ID NO: 728182 - DNA, 22 bp, Artificial Sequence
  chemically synthesized
tatctgtcattgttcccctctt

SEQ ID NO: 728183 - DNA, 22 bp, Artificial Sequence
  chemically synthesized
atatctgtcattgttcccctct

SEQ ID NO: 728184 - DNA, 22 bp, Artificial Sequence
  chemically synthesized
tatatctgtcattgttcccctc

SEQ ID NO: 728185 - DNA, 22 bp, Artificial Sequence
  chemically synthesized
ggtataaaacctttatatctgt

SEQ ID NO: 728186 - DNA, 22 bp, Artificial Sequence
  chemically synthesized
taggtataaaacctttatatct

SEQ ID NO: 728187 - DNA, 22 bp, Artificial Sequence
  chemically synthesized
ctaggtataaaacctttatatc

SEQ ID NO: 728188 - DNA, 22 bp, Artificial Sequence
  chemically synthesized
tctaggtataaaacctttatat

SEQ ID NO: 728189 - DNA, 22 bp, Artificial Sequence
  chemically synthesized
ttctaggtataaaacctttata

SEQ ID NO: 728190 - DNA, 22 bp, Artificial Sequence
  chemically synthesized
agtcttttctaggtataaaacc

SEQ ID NO: 728191 - DNA, 22 bp, Artificial Sequence
  chemically synthesized
ttaagtcttttctaggtataaa

SEQ ID NO: 728192 - DNA, 22 bp, Artificial Sequence
  chemically synthesized
gctattaagtcttttctaggta

SEQ ID NO: 728193 - DNA, 22 bp, Artificial Sequence
  chemically synthesized
tatacctagaaaagacttaata

SEQ ID NO: 728194 - DNA, 22 bp, Artificial Sequence
  chemically synthesized
atacctagaaaagacttaatag

SEQ ID NO: 728195 - DNA, 22 bp, Artificial Sequence
  chemically synthesized
tacctagaaaagacttaatagc

SEQ ID NO: 728196 - DNA, 22 bp, Artificial Sequence
  chemically synthesized
tgacaacgtctagctattaagt

SEQ ID NO: 728197 - DNA, 22 bp, Artificial Sequence
  chemically synthesized
gtgacaacgtctagctattaag

SEQ ID NO: 728198 - DNA, 22 bp, Artificial Sequence
  chemically synthesized
gaaaagacttaatagctagacg

SEQ ID NO: 728199 - DNA, 22 bp, Artificial Sequence
  chemically synthesized
gtgtagtaatttgtgacaacgt

SEQ ID NO: 728200 - DNA, 22 bp, Artificial Sequence
  chemically synthesized
aatagctagacgttgtcacaaa

SEQ ID NO: 728201 - DNA, 22 bp, Artificial Sequence
  chemically synthesized
ttagtgtagtaatttgtgacaa

SEQ ID NO: 728202 - DNA, 22 bp, Artificial Sequence
  chemically synthesized
atagctagacgttgtcacaaat

SEQ ID NO: 728203 - DNA, 22 bp, Artificial Sequence
  chemically synthesized
gttagtgtagtaatttgtgaca

SEQ ID NO: 728204 - DNA, 22 bp, Artificial Sequence
  chemically synthesized
tttgttagtgtagtaatttgtg

SEQ ID NO: 728205 - DNA, 22 bp, Artificial Sequence
  chemically synthesized
gacgttgtcacaaattactaca

SEQ ID NO: 728206 - DNA, 22 bp, Artificial Sequence
  chemically synthesized
atgcactgtttgttagtgtagt

SEQ ID NO: 728207 - DNA, 22 bp, Artificial Sequence
  chemically synthesized
tcacaaattactacactaacaa

SEQ ID NO: 728208 - DNA, 22 bp, Artificial Sequence
  chemically synthesized
aaattcatgcactgtttgttag

SEQ ID NO: 728209 - DNA, 22 bp, Artificial Sequence
  chemically synthesized
ctacactaacaaacagtgcatg

SEQ ID NO: 728210 - DNA, 22 bp, Artificial Sequence
  chemically synthesized
aaaagctgaaattcatgcactg

SEQ ID NO: 728211 - DNA, 22 bp, Artificial Sequence
  chemically synthesized
cactaacaaacagtgcatgaat

SEQ ID NO: 728212 - DNA, 22 bp, Artificial Sequence
  chemically synthesized
agttgaaaagctgaaattcatg

SEQ ID NO: 728213 - DNA, 22 bp, Artificial Sequence
  chemically synthesized
acaaacagtgcatgaatttcag

SEQ ID NO: 728214 - DNA, 22 bp, Artificial Sequence
  chemically synthesized
ttaagttgaaaagctgaaattc

SEQ ID NO: 728215 - DNA, 22 bp, Artificial Sequence
  chemically synthesized
gttaagttgaaaagctgaaatt

SEQ ID NO: 728216 - DNA, 22 bp, Artificial Sequence
  chemically synthesized
tgttaagttgaaaagctgaaat

SEQ ID NO: 728217 - DNA, 22 bp, Artificial Sequence
  chemically synthesized
ttgttaagttgaaaagctgaaa

SEQ ID NO: 728218 - DNA, 22 bp, Artificial Sequence
  chemically synthesized
cccatcttttgttaagttgaaa

SEQ ID NO: 728219 - DNA, 22 bp, Artificial Sequence
  chemically synthesized
tattgcccatcttttgttaagt

SEQ ID NO: 728220 - DNA, 22 bp, Artificial Sequence
  chemically synthesized
cagcttttcaacttaacaaaag

SEQ ID NO: 728221 - DNA, 22 bp, Artificial Sequence
  chemically synthesized
agcttttcaacttaacaaaaga

SEQ ID NO: 728222 - DNA, 22 bp, Artificial Sequence
  chemically synthesized
actatattgcccatcttttgtt

SEQ ID NO: 728223 - DNA, 22 bp, Artificial Sequence
  chemically synthesized
gactatattgcccatcttttgt

SEQ ID NO: 728224 - DNA, 22 bp, Artificial Sequence
  chemically synthesized
ttcaacttaacaaaagatgggc

SEQ ID NO: 728225 - DNA, 22 bp, Artificial Sequence
  chemically synthesized
tcaacttaacaaaagatgggca

SEQ ID NO: 728226 - DNA, 22 bp, Artificial Sequence
  chemically synthesized
caacttaacaaaagatgggcaa

SEQ ID NO: 728227 - DNA, 22 bp, Artificial Sequence
  chemically synthesized
aacttaacaaaagatgggcaat

SEQ ID NO: 728228 - DNA, 22 bp, Artificial Sequence
  chemically synthesized
aacaaaagatgggcaatatagt

SEQ ID NO: 728229 - DNA, 22 bp, Artificial Sequence
  chemically synthesized
acaaaagatgggcaatatagtc

SEQ ID NO: 728230 - DNA, 22 bp, Artificial Sequence
  chemically synthesized
atgtaaatgatggtttgactat

SEQ ID NO: 728231 - DNA, 22 bp, Artificial Sequence
  chemically synthesized
aagagctcatgtaaatgatggt

SEQ ID NO: 728232 - DNA, 22 bp, Artificial Sequence
  chemically synthesized
aagcctcaagagctcatgtaaa

SEQ ID NO: 728233 - DNA, 22 bp, Artificial Sequence
  chemically synthesized
atatgttcaagcctcaagagct

SEQ ID NO: 728234 - DNA, 22 bp, Artificial Sequence
  chemically synthesized
gtattaatatgttcaagcctca

SEQ ID NO: 728235 - DNA, 22 bp, Artificial Sequence
  chemically synthesized
acatgagctcttgaggcttgaa

SEQ ID NO: 728236 - DNA, 22 bp, Artificial Sequence
  chemically synthesized
ggtattaatatgttcaagcctc

SEQ ID NO: 728237 - DNA, 22 bp, Artificial Sequence
  chemically synthesized
catgagctcttgaggcttgaac

SEQ ID NO: 728238 - DNA, 22 bp, Artificial Sequence
  chemically synthesized
atttggtattaatatgttcaag

SEQ ID NO: 728239 - DNA, 22 bp, Artificial Sequence
  chemically synthesized
taatttggtattaatatgttca

SEQ ID NO: 728240 - DNA, 22 bp, Artificial Sequence
  chemically synthesized
ctaatttggtattaatatgttc

SEQ ID NO: 728241 - DNA, 22 bp, Artificial Sequence
  chemically synthesized
ttgaggcttgaacatattaata

SEQ ID NO: 728242 - DNA, 22 bp, Artificial Sequence
  chemically synthesized
gtttctaatttggtattaatat

SEQ ID NO: 728243 - DNA, 22 bp, Artificial Sequence
  chemically synthesized
gaggcttgaacatattaatacc

SEQ ID NO: 728244 - DNA, 22 bp, Artificial Sequence
  chemically synthesized
agtttctaatttggtattaata

SEQ ID NO: 728245 - DNA, 22 bp, Artificial Sequence
  chemically synthesized
aggcttgaacatattaatacca

SEQ ID NO: 728246 - DNA, 22 bp, Artificial Sequence
  chemically synthesized
ttagtttctaatttggtattaa

SEQ ID NO: 728247 - DNA, 22 bp, Artificial Sequence
  chemically synthesized
ctcttagtttctaatttggtat

SEQ ID NO: 728248 - DNA, 22 bp, Artificial Sequence
  chemically synthesized
gaacatattaataccaaattag

SEQ ID NO: 728249 - DNA, 22 bp, Artificial Sequence
  chemically synthesized
aacatattaataccaaattaga

SEQ ID NO: 728250 - DNA, 22 bp, Artificial Sequence
  chemically synthesized
ataccaaattagaaactaagag

SEQ ID NO: 728251 - DNA, 22 bp, Artificial Sequence
  chemically synthesized
aatgtatgggtacaatctgctc

SEQ ID NO: 728252 - DNA, 22 bp, Artificial Sequence
  chemically synthesized
gaaactaagagcagattgtacc

SEQ ID NO: 728253 - DNA, 22 bp, Artificial Sequence
  chemically synthesized
tattgaatgtatgggtacaatc

SEQ ID NO: 728254 - DNA, 22 bp, Artificial Sequence
  chemically synthesized
tgtattgaatgtatgggtacaa

SEQ ID NO: 728255 - DNA, 22 bp, Artificial Sequence
  chemically synthesized
agagcagattgtacccatacat

SEQ ID NO: 728256 - DNA, 22 bp, Artificial Sequence
  chemically synthesized
agcaactctgtattgaatgtat

SEQ ID NO: 728257 - DNA, 22 bp, Artificial Sequence
  chemically synthesized
tacccatacattcaatacagag

SEQ ID NO: 728258 - DNA, 22 bp, Artificial Sequence
  chemically synthesized
gatattcagcaactctgtattg

SEQ ID NO: 728259 - DNA, 22 bp, Artificial Sequence
  chemically synthesized
agatattcagcaactctgtatt

SEQ ID NO: 728260 - DNA, 22 bp, Artificial Sequence
  chemically synthesized
cacttagatattcagcaactct

SEQ ID NO: 728261 - DNA, 22 bp, Artificial Sequence
  chemically synthesized
aatacagagttgctgaatatct

SEQ ID NO: 728262 - DNA, 22 bp, Artificial Sequence
  chemically synthesized
acacagtacattgcacttagat

SEQ ID NO: 728263 - DNA, 22 bp, Artificial Sequence
  chemically synthesized
taacacagtacattgcacttag

SEQ ID NO: 728264 - DNA, 22 bp, Artificial Sequence
  chemically synthesized
ctaacacagtacattgcactta

SEQ ID NO: 728265 - DNA, 22 bp, Artificial Sequence
  chemically synthesized
ctgaatatctaagtgcaatgta

SEQ ID NO: 728266 - DNA, 22 bp, Artificial Sequence
  chemically synthesized
aatatctaagtgcaatgtactg

SEQ ID NO: 728267 - DNA, 22 bp, Artificial Sequence
  chemically synthesized
tggcttctaacacagtacattg

SEQ ID NO: 728268 - DNA, 22 bp, Artificial Sequence
  chemically synthesized
ctatggcttctaacacagtaca

SEQ ID NO: 728269 - DNA, 22 bp, Artificial Sequence
  chemically synthesized
cctatggcttctaacacagtac

SEQ ID NO: 728270 - DNA, 22 bp, Artificial Sequence
  chemically synthesized
agtgcaatgtactgtgttagaa

SEQ ID NO: 728271 - DNA, 22 bp, Artificial Sequence
  chemically synthesized
atatttcctatggcttctaaca

SEQ ID NO: 728272 - DNA, 22 bp, Artificial Sequence
  chemically synthesized
aaaaaacattgatatttcctat

SEQ ID NO: 728273 - DNA, 22 bp, Artificial Sequence
  chemically synthesized
tgttagaagccataggaaatat

SEQ ID NO: 728274 - DNA, 22 bp, Artificial Sequence
  chemically synthesized
gaagccataggaaatatcaatg

SEQ ID NO: 728275 - DNA, 22 bp, Artificial Sequence
  chemically synthesized
ggatccatgttgaaaaaacatt

SEQ ID NO: 728276 - DNA, 22 bp, Artificial Sequence
  chemically synthesized
aaattaggatccatgttgaaaa

SEQ ID NO: 728277 - DNA, 22 bp, Artificial Sequence
  chemically synthesized
aaaattaggatccatgttgaaa

SEQ ID NO: 728278 - DNA, 22 bp, Artificial Sequence
  chemically synthesized
tacatatcttaaaattaggatc

SEQ ID NO: 728279 - DNA, 22 bp, Artificial Sequence
  chemically synthesized
tttcaacatggatcctaatttt

SEQ ID NO: 728280 - DNA, 22 bp, Artificial Sequence
  chemically synthesized
ttcaacatggatcctaatttta

SEQ ID NO: 728281 - DNA, 22 bp, Artificial Sequence
  chemically synthesized
tcaacatggatcctaattttaa

SEQ ID NO: 728282 - DNA, 22 bp, Artificial Sequence
  chemically synthesized
caacatggatcctaattttaag

SEQ ID NO: 728283 - DNA, 22 bp, Artificial Sequence
  chemically synthesized
aacatggatcctaattttaaga

SEQ ID NO: 728284 - DNA, 22 bp, Artificial Sequence
  chemically synthesized
tccccaagtatactatacatat

SEQ ID NO: 728285 - DNA, 22 bp, Artificial Sequence
  chemically synthesized
attttaagatatgtatagtata

SEQ ID NO: 728286 - DNA, 22 bp, Artificial Sequence
  chemically synthesized
attatccccaagtatactatac

SEQ ID NO: 728287 - DNA, 22 bp, Artificial Sequence
  chemically synthesized
cattatccccaagtatactata

SEQ ID NO: 728288 - DNA, 22 bp, Artificial Sequence
  chemically synthesized
tcattatccccaagtatactat

SEQ ID NO: 728289 - DNA, 22 bp, Artificial Sequence
  chemically synthesized
taagatatgtatagtatacttg

SEQ ID NO: 728290 - DNA, 22 bp, Artificial Sequence
  chemically synthesized
aagatatgtatagtatacttgg

SEQ ID NO: 728291 - DNA, 22 bp, Artificial Sequence
  chemically synthesized
agatatgtatagtatacttggg

SEQ ID NO: 728292 - DNA, 22 bp, Artificial Sequence
  chemically synthesized
gtattttcattatccccaagta

SEQ ID NO: 728293 - DNA, 22 bp, Artificial Sequence
  chemically synthesized
ctcgtattttcattatccccaa

SEQ ID NO: 728294 - DNA, 22 bp, Artificial Sequence
  chemically synthesized
cctactcgtattttcattatcc

SEQ ID NO: 728295 - DNA, 22 bp, Artificial Sequence
  chemically synthesized
tgcctactcgtattttcattat

SEQ ID NO: 728296 - DNA, 22 bp, Artificial Sequence
  chemically synthesized
ctgcctactcgtattttcatta

SEQ ID NO: 728297 - DNA, 22 bp, Artificial Sequence
  chemically synthesized
tctgcctactcgtattttcatt

SEQ ID NO: 728298 - DNA, 22 bp, Artificial Sequence
  chemically synthesized
ttctgcctactcgtattttcat

SEQ ID NO: 728299 - DNA, 22 bp, Artificial Sequence
  chemically synthesized
tcttttctgcctactcgtattt

SEQ ID NO: 728300 - DNA, 22 bp, Artificial Sequence
  chemically synthesized
ggggataatgaaaatacgagta

SEQ ID NO: 728301 - DNA, 22 bp, Artificial Sequence
  chemically synthesized
gggataatgaaaatacgagtag

SEQ ID NO: 728302 - DNA, 22 bp, Artificial Sequence
  chemically synthesized
aatagttatcttttctgcctac

SEQ ID NO: 728303 - DNA, 22 bp, Artificial Sequence
  chemically synthesized
agcccagtactcaatagttatc

SEQ ID NO: 728304 - DNA, 22 bp, Artificial Sequence
  chemically synthesized
tcacccagatattaagcccagt

SEQ ID NO: 728305 - DNA, 22 bp, Artificial Sequence
  chemically synthesized
atcacccagatattaagcccag

SEQ ID NO: 728306 - DNA, 22 bp, Artificial Sequence
  chemically synthesized
tatcacccagatattaagccca

SEQ ID NO: 728307 - DNA, 22 bp, Artificial Sequence
  chemically synthesized
ttttatcacccagatattaagc

SEQ ID NO: 728308 - DNA, 22 bp, Artificial Sequence
  chemically synthesized
ttgagtactgggcttaatatct

SEQ ID NO: 728309 - DNA, 22 bp, Artificial Sequence
  chemically synthesized
agtactgggcttaatatctggg

SEQ ID NO: 728310 - DNA, 22 bp, Artificial Sequence
  chemically synthesized
tacacattattttatcacccag

SEQ ID NO: 728311 - DNA, 22 bp, Artificial Sequence
  chemically synthesized
ggcttaatatctgggtgataaa

SEQ ID NO: 728312 - DNA, 22 bp, Artificial Sequence
  chemically synthesized
ttgtacacattattttatcacc

SEQ ID NO: 728313 - DNA, 22 bp, Artificial Sequence
  chemically synthesized
gttgtacacattattttatcac

SEQ ID NO: 728314 - DNA, 22 bp, Artificial Sequence
  chemically synthesized
aatatctgggtgataaaataat

SEQ ID NO: 728315 - DNA, 22 bp, Artificial Sequence
  chemically synthesized
atatctgggtgataaaataatg

SEQ ID NO: 728316 - DNA, 22 bp, Artificial Sequence
  chemically synthesized
ggtgataaaataatgtgtacaa

SEQ ID NO: 728317 - DNA, 22 bp, Artificial Sequence
  chemically synthesized
cataggtaaacacatgtcatgg

SEQ ID NO: 728318 - DNA, 22 bp, Artificial Sequence
  chemically synthesized
ttacataggtaaacacatgtca

SEQ ID NO: 728319 - DNA, 22 bp, Artificial Sequence
  chemically synthesized
gttacataggtaaacacatgtc

SEQ ID NO: 728320 - DNA, 22 bp, Artificial Sequence
  chemically synthesized
catgacatgtgtttacctatgt

SEQ ID NO: 728321 - DNA, 22 bp, Artificial Sequence
  chemically synthesized
acggtacatgtgaaggtttgtt

SEQ ID NO: 728322 - DNA, 22 bp, Artificial Sequence
  chemically synthesized
gacggtacatgtgaaggtttgt

SEQ ID NO: 728323 - DNA, 22 bp, Artificial Sequence
  chemically synthesized
acctatgtaacaaaccttcaca

SEQ ID NO: 728324 - DNA, 22 bp, Artificial Sequence
  chemically synthesized
cctatgtaacaaaccttcacat

SEQ ID NO: 728325 - DNA, 22 bp, Artificial Sequence
  chemically synthesized
ggtttgacggtacatgtgaagg

SEQ ID NO: 728326 - DNA, 22 bp, Artificial Sequence
  chemically synthesized
aggtttgacggtacatgtgaag

SEQ ID NO: 728327 - DNA, 22 bp, Artificial Sequence
  chemically synthesized
taggtttgacggtacatgtgaa

SEQ ID NO: 728328 - DNA, 22 bp, Artificial Sequence
  chemically synthesized
tgtaacaaaccttcacatgtac

SEQ ID NO: 728329 - DNA, 22 bp, Artificial Sequence
  chemically synthesized
ttttaggtttgacggtacatgt

SEQ ID NO: 728330 - DNA, 22 bp, Artificial Sequence
  chemically synthesized
attttaggtttgacggtacatg

SEQ ID NO: 728331 - DNA, 22 bp, Artificial Sequence
  chemically synthesized
tattttaggtttgacggtacat

SEQ ID NO: 728332 - DNA, 22 bp, Artificial Sequence
  chemically synthesized
ttattttaggtttgacggtaca

SEQ ID NO: 728333 - DNA, 22 bp, Artificial Sequence
  chemically synthesized
gcttttattttaggtttgacgg

SEQ ID NO: 728334 - DNA, 22 bp, Artificial Sequence
  chemically synthesized
agcttttattttaggtttgacg

SEQ ID NO: 728335 - DNA, 22 bp, Artificial Sequence
  chemically synthesized
tagcttttattttaggtttgac

SEQ ID NO: 728336 - DNA, 22 bp, Artificial Sequence
  chemically synthesized
ttagcttttattttaggtttga

SEQ ID NO: 728337 - DNA, 22 bp, Artificial Sequence
  chemically synthesized
cacatgtaccgtcaaacctaaa

SEQ ID NO: 728338 - DNA, 22 bp, Artificial Sequence
  chemically synthesized
tttagcttttattttaggtttg

SEQ ID NO: 728339 - DNA, 22 bp, Artificial Sequence
  chemically synthesized
acatgtaccgtcaaacctaaaa

SEQ ID NO: 728340 - DNA, 22 bp, Artificial Sequence
  chemically synthesized
ttttagcttttattttaggttt

SEQ ID NO: 728341 - DNA, 22 bp, Artificial Sequence
  chemically synthesized
tttttagcttttattttaggtt

SEQ ID NO: 728342 - DNA, 22 bp, Artificial Sequence
  chemically synthesized
tttttttagcttttattttagg

SEQ ID NO: 728343 - DNA, 22 bp, Artificial Sequence
  chemically synthesized
ctttttttagcttttattttag

SEQ ID NO: 728344 - DNA, 22 bp, Artificial Sequence
  chemically synthesized
tctttttttagcttttatttta

SEQ ID NO: 728345 - DNA, 22 bp, Artificial Sequence
  chemically synthesized
tattttctttttttagctttta

SEQ ID NO: 728346 - DNA, 22 bp, Artificial Sequence
  chemically synthesized
gttgtattttctttttttagct

SEQ ID NO: 728347 - DNA, 22 bp, Artificial Sequence
  chemically synthesized
tagttgtattttctttttttag

SEQ ID NO: 728348 - DNA, 22 bp, Artificial Sequence
  chemically synthesized
ctagttgtattttcttttttta

SEQ ID NO: 728349 - DNA, 22 bp, Artificial Sequence
  chemically synthesized
tctagttgtattttcttttttt

SEQ ID NO: 728350 - DNA, 22 bp, Artificial Sequence
  chemically synthesized
aaataaaagctaaaaaaagaaa

SEQ ID NO: 728351 - DNA, 22 bp, Artificial Sequence
  chemically synthesized
ttctagttgtattttctttttt

SEQ ID NO: 728352 - DNA, 22 bp, Artificial Sequence
  chemically synthesized
cttttctagttgtattttcttt

SEQ ID NO: 728353 - DNA, 22 bp, Artificial Sequence
  chemically synthesized
aaaaaagaaaatacaactagaa

SEQ ID NO: 728354 - DNA, 22 bp, Artificial Sequence
  chemically synthesized
ataatattacttttctagttgt

SEQ ID NO: 728355 - DNA, 22 bp, Artificial Sequence
  chemically synthesized
atattaataatattacttttct

SEQ ID NO: 728356 - DNA, 22 bp, Artificial Sequence
  chemically synthesized
tcatattaataatattactttt

SEQ ID NO: 728357 - DNA, 22 bp, Artificial Sequence
  chemically synthesized
attctcatattaataatattac

SEQ ID NO: 728358 - DNA, 22 bp, Artificial Sequence
  chemically synthesized
gaaaagtaatattattaatatg

SEQ ID NO: 728359 - DNA, 22 bp, Artificial Sequence
  chemically synthesized
catatgaaaataattaattctc

SEQ ID NO: 728360 - DNA, 22 bp, Artificial Sequence
  chemically synthesized
ctccatatgaaaataattaatt

SEQ ID NO: 728361 - DNA, 22 bp, Artificial Sequence
  chemically synthesized
ttaatatgagaattaattattt

SEQ ID NO: 728362 - DNA, 22 bp, Artificial Sequence
  chemically synthesized
attcctccatatgaaaataatt

SEQ ID NO: 728363 - DNA, 22 bp, Artificial Sequence
  chemically synthesized
atatgagaattaattattttca

SEQ ID NO: 728364 - DNA, 22 bp, Artificial Sequence
  chemically synthesized
cctgattcctccatatgaaaat

SEQ ID NO: 728365 - DNA, 22 bp, Artificial Sequence
  chemically synthesized
ccctgattcctccatatgaaaa

SEQ ID NO: 728366 - DNA, 22 bp, Artificial Sequence
  chemically synthesized
attattttcatatggaggaatc

SEQ ID NO: 728367 - DNA, 22 bp, Artificial Sequence
  chemically synthesized
ttttcatatggaggaatcaggg

SEQ ID NO: 728368 - DNA, 22 bp, Artificial Sequence
  chemically synthesized
tatcatggagccttccctgatt

SEQ ID NO: 728369 - DNA, 22 bp, Artificial Sequence
  chemically synthesized
tcatatggaggaatcagggaag

SEQ ID NO: 728370 - DNA, 22 bp, Artificial Sequence
  chemically synthesized
catatggaggaatcagggaagg

SEQ ID NO: 728371 - DNA, 22 bp, Artificial Sequence
  chemically synthesized
atatggaggaatcagggaaggc

SEQ ID NO: 728372 - DNA, 22 bp, Artificial Sequence
  chemically synthesized
atgtcaagaccatgctgtatca

SEQ ID NO: 728373 - DNA, 22 bp, Artificial Sequence
  chemically synthesized
aatgtcaagaccatgctgtatc

SEQ ID NO: 728374 - DNA, 22 bp, Artificial Sequence
  chemically synthesized
ttaatgtcaagaccatgctgta

SEQ ID NO: 728375 - DNA, 22 bp, Artificial Sequence
  chemically synthesized
catgatacagcatggtcttgac

SEQ ID NO: 728376 - DNA, 22 bp, Artificial Sequence
  chemically synthesized
cacaaactcttaatgtcaagac

SEQ ID NO: 728377 - DNA, 22 bp, Artificial Sequence
  chemically synthesized
gaacaccaattccacaaactct

SEQ ID NO: 728378 - DNA, 22 bp, Artificial Sequence
  chemically synthesized
cctggaacaccaattccacaaa

SEQ ID NO: 728379 - DNA, 22 bp, Artificial Sequence
  chemically synthesized
gacattaagagtttgtggaatt

SEQ ID NO: 728380 - DNA, 22 bp, Artificial Sequence
  chemically synthesized
acattaagagtttgtggaattg

SEQ ID NO: 728381 - DNA, 22 bp, Artificial Sequence
  chemically synthesized
tacctggaacaccaattccaca

SEQ ID NO: 728382 - DNA, 22 bp, Artificial Sequence
  chemically synthesized
tctacctggaacaccaattcca

SEQ ID NO: 728383 - DNA, 22 bp, Artificial Sequence
  chemically synthesized
ctctacctggaacaccaattcc

SEQ ID NO: 728384 - DNA, 22 bp, Artificial Sequence
  chemically synthesized
tctctacctggaacaccaattc

SEQ ID NO: 728385 - DNA, 22 bp, Artificial Sequence
  chemically synthesized
agagtttgtggaattggtgttc

SEQ ID NO: 728386 - DNA, 22 bp, Artificial Sequence
  chemically synthesized
ttttctctacctggaacaccaa

SEQ ID NO: 728387 - DNA, 22 bp, Artificial Sequence
  chemically synthesized
ttattttctctacctggaacac

SEQ ID NO: 728388 - DNA, 22 bp, Artificial Sequence
  chemically synthesized
gtggaattggtgttccaggtag

SEQ ID NO: 728389 - DNA, 22 bp, Artificial Sequence
  chemically synthesized
ttattattttctctacctggaa

SEQ ID NO: 728390 - DNA, 22 bp, Artificial Sequence
  chemically synthesized
tggaattggtgttccaggtaga

SEQ ID NO: 728391 - DNA, 22 bp, Artificial Sequence
  chemically synthesized
tcattattattattttctctac

SEQ ID NO: 728392 - DNA, 22 bp, Artificial Sequence
  chemically synthesized
gtgttccaggtagagaaaataa

SEQ ID NO: 728393 - DNA, 22 bp, Artificial Sequence
  chemically synthesized
ttgtcattattattattttctc

SEQ ID NO: 728394 - DNA, 22 bp, Artificial Sequence
  chemically synthesized
ttattgtcattattattatttt

SEQ ID NO: 728395 - DNA, 22 bp, Artificial Sequence
  chemically synthesized
caggtagagaaaataataataa

SEQ ID NO: 728396 - DNA, 22 bp, Artificial Sequence
  chemically synthesized
ttattattgtcattattattat

SEQ ID NO: 728397 - DNA, 22 bp, Artificial Sequence
  chemically synthesized
ttattattattgtcattattat

SEQ ID NO: 728398 - DNA, 22 bp, Artificial Sequence
  chemically synthesized
ttattattattattgtcattat

SEQ ID NO: 728399 - DNA, 22 bp, Artificial Sequence
  chemically synthesized
ctgttattattattattgtcat

SEQ ID NO: 728400 - DNA, 22 bp, Artificial Sequence
  chemically synthesized
actgttattattattattgtca

SEQ ID NO: 728401 - DNA, 22 bp, Artificial Sequence
  chemically synthesized
tactgttattattattattgtc

SEQ ID NO: 728402 - DNA, 22 bp, Artificial Sequence
  chemically synthesized
tctttactgttattattattat

SEQ ID NO: 728403 - DNA, 22 bp, Artificial Sequence
  chemically synthesized
tcactgtctttactgttattat

SEQ ID NO: 728404 - DNA, 22 bp, Artificial Sequence
  chemically synthesized
tctatcactgtctttactgtta

SEQ ID NO: 728405 - DNA, 22 bp, Artificial Sequence
  chemically synthesized
ggtatcagaaacaataatgtta

SEQ ID NO: 728406 - DNA, 22 bp, Artificial Sequence
  chemically synthesized
ttgggtatcagaaacaataatg

SEQ ID NO: 728407 - DNA, 22 bp, Artificial Sequence
  chemically synthesized
aaagattattgggtatcagaaa

SEQ ID NO: 728408 - DNA, 22 bp, Artificial Sequence
  chemically synthesized
ttgtttctgatacccaataatc

SEQ ID NO: 728409 - DNA, 22 bp, Artificial Sequence
  chemically synthesized
tttctgatacccaataatcttt

SEQ ID NO: 728410 - DNA, 22 bp, Artificial Sequence
  chemically synthesized
ctgatacccaataatctttgag

SEQ ID NO: 728411 - DNA, 22 bp, Artificial Sequence
  chemically synthesized
tgatacccaataatctttgagt

SEQ ID NO: 728412 - DNA, 22 bp, Artificial Sequence
  chemically synthesized
atacccaataatctttgagtta

SEQ ID NO: 728413 - DNA, 22 bp, Artificial Sequence
  chemically synthesized
gagaatgaaaatgacataactc

SEQ ID NO: 728414 - DNA, 22 bp, Artificial Sequence
  chemically synthesized
ggagaatgaaaatgacataact

SEQ ID NO: 728415 - DNA, 22 bp, Artificial Sequence
  chemically synthesized
tggagaatgaaaatgacataac

SEQ ID NO: 728416 - DNA, 22 bp, Artificial Sequence
  chemically synthesized
ttggagaatgaaaatgacataa

SEQ ID NO: 728417 - DNA, 22 bp, Artificial Sequence
  chemically synthesized
tgagttatgtcattttcattct

SEQ ID NO: 728418 - DNA, 22 bp, Artificial Sequence
  chemically synthesized
gagttatgtcattttcattctc

SEQ ID NO: 728419 - DNA, 22 bp, Artificial Sequence
  chemically synthesized
gtgaggcttttggagaatgaaa

SEQ ID NO: 728420 - DNA, 22 bp, Artificial Sequence
  chemically synthesized
agttatgtcattttcattctcc

SEQ ID NO: 728421 - DNA, 22 bp, Artificial Sequence
  chemically synthesized
cgtgaggcttttggagaatgaa

SEQ ID NO: 728422 - DNA, 22 bp, Artificial Sequence
  chemically synthesized
tgtcattttcattctccaaaag

SEQ ID NO: 728423 - DNA, 22 bp, Artificial Sequence
  chemically synthesized
aaaaccaacttcgtgaggcttt

SEQ ID NO: 728424 - DNA, 22 bp, Artificial Sequence
  chemically synthesized
tcattctccaaaagcctcacga

SEQ ID NO: 728425 - DNA, 22 bp, Artificial Sequence
  chemically synthesized
cattctccaaaagcctcacgaa

SEQ ID NO: 728426 - DNA, 22 bp, Artificial Sequence
  chemically synthesized
attctccaaaagcctcacgaag

SEQ ID NO: 728427 - DNA, 22 bp, Artificial Sequence
  chemically synthesized
tccaaaagcctcacgaagttgg

SEQ ID NO: 728428 - DNA, 22 bp, Artificial Sequence
  chemically synthesized
caaaagcctcacgaagttggtt

SEQ ID NO: 728429 - DNA, 22 bp, Artificial Sequence
  chemically synthesized
taaaatggaattaaaaaccaac

SEQ ID NO: 728430 - DNA, 22 bp, Artificial Sequence
  chemically synthesized
atctgtaaaatggaattaaaaa

SEQ ID NO: 728431 - DNA, 22 bp, Artificial Sequence
  chemically synthesized
acgaagttggtttttaattcca

SEQ ID NO: 728432 - DNA, 22 bp, Artificial Sequence
  chemically synthesized
ctcatctgtaaaatggaattaa

SEQ ID NO: 728433 - DNA, 22 bp, Artificial Sequence
  chemically synthesized
cctcatctgtaaaatggaatta

SEQ ID NO: 728434 - DNA, 22 bp, Artificial Sequence
  chemically synthesized
agtttcctcatctgtaaaatgg

SEQ ID NO: 728435 - DNA, 22 bp, Artificial Sequence
  chemically synthesized
gtttttaattccattttacaga

SEQ ID NO: 728436 - DNA, 22 bp, Artificial Sequence
  chemically synthesized
ttaattccattttacagatgag

SEQ ID NO: 728437 - DNA, 22 bp, Artificial Sequence
  chemically synthesized
tgcctcagtttcctcatctgta

SEQ ID NO: 728438 - DNA, 22 bp, Artificial Sequence
  chemically synthesized
taattccattttacagatgagg

SEQ ID NO: 728439 - DNA, 22 bp, Artificial Sequence
  chemically synthesized
aattccattttacagatgagga

SEQ ID NO: 728440 - DNA, 22 bp, Artificial Sequence
  chemically synthesized
attccattttacagatgaggaa

SEQ ID NO: 728441 - DNA, 22 bp, Artificial Sequence
  chemically synthesized
ctgtgcctcagtttcctcatct

SEQ ID NO: 728442 - DNA, 22 bp, Artificial Sequence
  chemically synthesized
cctgtgcctcagtttcctcatc

SEQ ID NO: 728443 - DNA, 22 bp, Artificial Sequence
  chemically synthesized
cattttacagatgaggaaactg

SEQ ID NO: 728444 - DNA, 22 bp, Artificial Sequence
  chemically synthesized
agtccttcctgtgcctcagttt

SEQ ID NO: 728445 - DNA, 22 bp, Artificial Sequence
  chemically synthesized
tacagatgaggaaactgaggca

SEQ ID NO: 728446 - DNA, 22 bp, Artificial Sequence
  chemically synthesized
gagtccttcctgtgcctcagtt

SEQ ID NO: 728447 - DNA, 22 bp, Artificial Sequence
  chemically synthesized
acagatgaggaaactgaggcac

SEQ ID NO: 728448 - DNA, 22 bp, Artificial Sequence
  chemically synthesized
cagatgaggaaactgaggcaca

SEQ ID NO: 728449 - DNA, 22 bp, Artificial Sequence
  chemically synthesized
atagatatataaccttgagtcc

SEQ ID NO: 728450 - DNA, 22 bp, Artificial Sequence
  chemically synthesized
aggcacaggaaggactcaaggt

SEQ ID NO: 728451 - DNA, 22 bp, Artificial Sequence
  chemically synthesized
cattgatagatatataaccttg

SEQ ID NO: 728452 - DNA, 22 bp, Artificial Sequence
  chemically synthesized
atcaatccactccattgataga

SEQ ID NO: 728453 - DNA, 22 bp, Artificial Sequence
  chemically synthesized
aaggttatatatctatcaatgg

SEQ ID NO: 728454 - DNA, 22 bp, Artificial Sequence
  chemically synthesized
taatcaatccactccattgata

SEQ ID NO: 728455 - DNA, 22 bp, Artificial Sequence
  chemically synthesized
tatatctatcaatggagtggat

SEQ ID NO: 728456 - DNA, 22 bp, Artificial Sequence
  chemically synthesized
tcaatggagtggattgattaga

SEQ ID NO: 728457 - DNA, 22 bp, Artificial Sequence
  chemically synthesized
gacagatccaattctaatcaat

SEQ ID NO: 728458 - DNA, 22 bp, Artificial Sequence
  chemically synthesized
caattggacagatccaattcta

SEQ ID NO: 728459 - DNA, 22 bp, Artificial Sequence
  chemically synthesized
tgcaattggacagatccaattc

SEQ ID NO: 728460 - DNA, 22 bp, Artificial Sequence
  chemically synthesized
attagaattggatctgtccaat

SEQ ID NO: 728461 - DNA, 22 bp, Artificial Sequence
  chemically synthesized
gaattggatctgtccaattgca

SEQ ID NO: 728462 - DNA, 22 bp, Artificial Sequence
  chemically synthesized
gatctgtccaattgcagagccc

SEQ ID NO: 728463 - DNA, 22 bp, Artificial Sequence
  chemically synthesized
tccaattgcagagcccctgttc

SEQ ID NO: 728464 - DNA, 22 bp, Artificial Sequence
  chemically synthesized
tgaaaaggcggtataggaacag

SEQ ID NO: 728465 - DNA, 22 bp, Artificial Sequence
  chemically synthesized
atgaaaaggcggtataggaaca

SEQ ID NO: 728466 - DNA, 22 bp, Artificial Sequence
  chemically synthesized
cagagcccctgttcctataccg

SEQ ID NO: 728467 - DNA, 22 bp, Artificial Sequence
  chemically synthesized
tttatgaaaaggcggtatagga

SEQ ID NO: 728468 - DNA, 22 bp, Artificial Sequence
  chemically synthesized
atctgtttatgaaaaggcggta

SEQ ID NO: 728469 - DNA, 22 bp, Artificial Sequence
  chemically synthesized
gatctgtttatgaaaaggcggt

SEQ ID NO: 728470 - DNA, 22 bp, Artificial Sequence
  chemically synthesized
ttcctataccgccttttcataa

SEQ ID NO: 728471 - DNA, 22 bp, Artificial Sequence
  chemically synthesized
accttgatctgtttatgaaaag

SEQ ID NO: 728472 - DNA, 22 bp, Artificial Sequence
  chemically synthesized
ctataccgccttttcataaaca

SEQ ID NO: 728473 - DNA, 22 bp, Artificial Sequence
  chemically synthesized
aactgaccttgatctgtttatg

SEQ ID NO: 728474 - DNA, 22 bp, Artificial Sequence
  chemically synthesized
taccgccttttcataaacagat

SEQ ID NO: 728475 - DNA, 22 bp, Artificial Sequence
  chemically synthesized
ttcataaacagatcaaggtcag

SEQ ID NO: 728476 - DNA, 22 bp, Artificial Sequence
  chemically synthesized
tcataaacagatcaaggtcagt

SEQ ID NO: 728477 - DNA, 22 bp, Artificial Sequence
  chemically synthesized
catgccaactaaactgaccttg

SEQ ID NO: 728478 - DNA, 22 bp, Artificial Sequence
  chemically synthesized
cataaacagatcaaggtcagtt

SEQ ID NO: 728479 - DNA, 22 bp, Artificial Sequence
  chemically synthesized
ataaacagatcaaggtcagttt

SEQ ID NO: 728480 - DNA, 22 bp, Artificial Sequence
  chemically synthesized
caaactacatgccaactaaact

SEQ ID NO: 728481 - DNA, 22 bp, Artificial Sequence
  chemically synthesized
acaaactacatgccaactaaac

SEQ ID NO: 728482 - DNA, 22 bp, Artificial Sequence
  chemically synthesized
tacaaactacatgccaactaaa

SEQ ID NO: 728483 - DNA, 22 bp, Artificial Sequence
  chemically synthesized
ttacaaactacatgccaactaa

SEQ ID NO: 728484 - DNA, 22 bp, Artificial Sequence
  chemically synthesized
ttttacaaactacatgccaact

SEQ ID NO: 728485 - DNA, 22 bp, Artificial Sequence
  chemically synthesized
cttttacaaactacatgccaac

SEQ ID NO: 728486 - DNA, 22 bp, Artificial Sequence
  chemically synthesized
tcttttacaaactacatgccaa

SEQ ID NO: 728487 - DNA, 22 bp, Artificial Sequence
  chemically synthesized
ctttcttttacaaactacatgc

SEQ ID NO: 728488 - DNA, 22 bp, Artificial Sequence
  chemically synthesized
ctcctttcttttacaaactaca

SEQ ID NO: 728489 - DNA, 22 bp, Artificial Sequence
  chemically synthesized
ctactcctttcttttacaaact

SEQ ID NO: 728490 - DNA, 22 bp, Artificial Sequence
  chemically synthesized
agttggcatgtagtttgtaaaa

SEQ ID NO: 728491 - DNA, 22 bp, Artificial Sequence
  chemically synthesized
gttggcatgtagtttgtaaaag

SEQ ID NO: 728492 - DNA, 22 bp, Artificial Sequence
  chemically synthesized
actgctactcctttcttttaca

SEQ ID NO: 728493 - DNA, 22 bp, Artificial Sequence
  chemically synthesized
gcatgtagtttgtaaaagaaag

SEQ ID NO: 728494 - DNA, 22 bp, Artificial Sequence
  chemically synthesized
gtctaactgctactcctttctt

SEQ ID NO: 728495 - DNA, 22 bp, Artificial Sequence
  chemically synthesized
tagtctaactgctactcctttc

SEQ ID NO: 728496 - DNA, 22 bp, Artificial Sequence
  chemically synthesized
ctagtctaactgctactccttt

SEQ ID NO: 728497 - DNA, 22 bp, Artificial Sequence
  chemically synthesized
gtaaaagaaaggagtagcagtt

SEQ ID NO: 728498 - DNA, 22 bp, Artificial Sequence
  chemically synthesized
taaaagaaaggagtagcagtta

SEQ ID NO: 728499 - DNA, 22 bp, Artificial Sequence
  chemically synthesized
caagtcacccttctagtctaac

SEQ ID NO: 728500 - DNA, 22 bp, Artificial Sequence
  chemically synthesized
ggagactccaagtcacccttct

SEQ ID NO: 728501 - DNA, 22 bp, Artificial Sequence
  chemically synthesized
gactagaagggtgacttggagt

SEQ ID NO: 728502 - DNA, 22 bp, Artificial Sequence
  chemically synthesized
taaatgcagctaggagactcca

SEQ ID NO: 728503 - DNA, 22 bp, Artificial Sequence
  chemically synthesized
gaagggtgacttggagtctcct

SEQ ID NO: 728504 - DNA, 22 bp, Artificial Sequence
  chemically synthesized
gtaaatgcagctaggagactcc

SEQ ID NO: 728505 - DNA, 22 bp, Artificial Sequence
  chemically synthesized
tgtaaatgcagctaggagactc

SEQ ID NO: 728506 - DNA, 22 bp, Artificial Sequence
  chemically synthesized
aatgtgcctttgtaaatgcagc

SEQ ID NO: 728507 - DNA, 22 bp, Artificial Sequence
  chemically synthesized
ggagtctcctagctgcatttac

SEQ ID NO: 728508 - DNA, 22 bp, Artificial Sequence
  chemically synthesized
aaatgtgcctttgtaaatgcag

SEQ ID NO: 728509 - DNA, 22 bp, Artificial Sequence
  chemically synthesized
gagtctcctagctgcatttaca

SEQ ID NO: 728510 - DNA, 22 bp, Artificial Sequence
  chemically synthesized
ctagctgcatttacaaaggcac

SEQ ID NO: 728511 - DNA, 22 bp, Artificial Sequence
  chemically synthesized
gggtgccttaaatgtgcctttg

SEQ ID NO: 728512 - DNA, 22 bp, Artificial Sequence
  chemically synthesized
gctgcatttacaaaggcacatt

SEQ ID NO: 728513 - DNA, 22 bp, Artificial Sequence
  chemically synthesized
gattagggtgccttaaatgtgc

SEQ ID NO: 728514 - DNA, 22 bp, Artificial Sequence
  chemically synthesized
catttacaaaggcacatttaag

SEQ ID NO: 728515 - DNA, 22 bp, Artificial Sequence
  chemically synthesized
ggattagggtgccttaaatgtg

SEQ ID NO: 728516 - DNA, 22 bp, Artificial Sequence
  chemically synthesized
acaaaggcacatttaaggcacc

SEQ ID NO: 728517 - DNA, 22 bp, Artificial Sequence
  chemically synthesized
caaaggcacatttaaggcaccc

SEQ ID NO: 728518 - DNA, 22 bp, Artificial Sequence
  chemically synthesized
tggaaatgaacatgccttggat

SEQ ID NO: 728519 - DNA, 22 bp, Artificial Sequence
  chemically synthesized
aaggcaccctaatccaaggcat

SEQ ID NO: 728520 - DNA, 22 bp, Artificial Sequence
  chemically synthesized
gtggaaatgaacatgccttgga

SEQ ID NO: 728521 - DNA, 22 bp, Artificial Sequence
  chemically synthesized
aggcaccctaatccaaggcatg

SEQ ID NO: 728522 - DNA, 22 bp, Artificial Sequence
  chemically synthesized
atccaaggcatgttcatttcca

SEQ ID NO: 728523 - DNA, 22 bp, Artificial Sequence
  chemically synthesized
tggtaaagcttgtggaaatgaa

SEQ ID NO: 728524 - DNA, 22 bp, Artificial Sequence
  chemically synthesized
ataaaaaattgtggtaaagctt

SEQ ID NO: 728525 - DNA, 22 bp, Artificial Sequence
  chemically synthesized
atttccacaagctttaccacaa

SEQ ID NO: 728526 - DNA, 22 bp, Artificial Sequence
  chemically synthesized
ccacaagctttaccacaatttt

SEQ ID NO: 728527 - DNA, 22 bp, Artificial Sequence
  chemically synthesized
tggtattaataaaaaattgtgg

SEQ ID NO: 728528 - DNA, 22 bp, Artificial Sequence
  chemically synthesized
cacaagctttaccacaattttt

SEQ ID NO: 728529 - DNA, 22 bp, Artificial Sequence
  chemically synthesized
atggtattaataaaaaattgtg

SEQ ID NO: 728530 - DNA, 22 bp, Artificial Sequence
  chemically synthesized
gtgtttatggtattaataaaaa

SEQ ID NO: 728531 - DNA, 22 bp, Artificial Sequence
  chemically synthesized
ggtgtttatggtattaataaaa

SEQ ID NO: 728532 - DNA, 22 bp, Artificial Sequence
  chemically synthesized
tggtgtttatggtattaataaa

SEQ ID NO: 728533 - DNA, 22 bp, Artificial Sequence
  chemically synthesized
taccacaattttttattaatac

SEQ ID NO: 728534 - DNA, 22 bp, Artificial Sequence
  chemically synthesized
ttggtgtttatggtattaataa

SEQ ID NO: 728535 - DNA, 22 bp, Artificial Sequence
  chemically synthesized
accacaattttttattaatacc

SEQ ID NO: 728536 - DNA, 22 bp, Artificial Sequence
  chemically synthesized
ccacaattttttattaatacca

SEQ ID NO: 728537 - DNA, 22 bp, Artificial Sequence
  chemically synthesized
ttttggtgtttatggtattaat

SEQ ID NO: 728538 - DNA, 22 bp, Artificial Sequence
  chemically synthesized
tattcttttggtgtttatggta

SEQ ID NO: 728539 - DNA, 22 bp, Artificial Sequence
  chemically synthesized
tttattaataccataaacacca

SEQ ID NO: 728540 - DNA, 22 bp, Artificial Sequence
  chemically synthesized
ttattaataccataaacaccaa

SEQ ID NO: 728541 - DNA, 22 bp, Artificial Sequence
  chemically synthesized
tattaataccataaacaccaaa

SEQ ID NO: 728542 - DNA, 22 bp, Artificial Sequence
  chemically synthesized
attaataccataaacaccaaaa

SEQ ID NO: 728543 - DNA, 22 bp, Artificial Sequence
  chemically synthesized
ttaataccataaacaccaaaag

SEQ ID NO: 728544 - DNA, 22 bp, Artificial Sequence
  chemically synthesized
ataccataaacaccaaaagaat

SEQ ID NO: 728545 - DNA, 22 bp, Artificial Sequence
  chemically synthesized
tgatgatggcactatattcttt

SEQ ID NO: 728546 - DNA, 22 bp, Artificial Sequence
  chemically synthesized
tatgatgatggcactatattct

SEQ ID NO: 728547 - DNA, 22 bp, Artificial Sequence
  chemically synthesized
ctatgatgatggcactatattc

SEQ ID NO: 728548 - DNA, 22 bp, Artificial Sequence
  chemically synthesized
atgtaatggatttctatgatga

SEQ ID NO: 728549 - DNA, 22 bp, Artificial Sequence
  chemically synthesized
aatgtaatggatttctatgatg

SEQ ID NO: 728550 - DNA, 22 bp, Artificial Sequence
  chemically synthesized
atgacttaatgtaatggatttc

SEQ ID NO: 728551 - DNA, 22 bp, Artificial Sequence
  chemically synthesized
attgatgacttaatgtaatgga

SEQ ID NO: 728552 - DNA, 22 bp, Artificial Sequence
  chemically synthesized
cattgatgacttaatgtaatgg

SEQ ID NO: 728553 - DNA, 22 bp, Artificial Sequence
  chemically synthesized
tcattgatgacttaatgtaatg

SEQ ID NO: 728554 - DNA, 22 bp, Artificial Sequence
  chemically synthesized
ttcattgatgacttaatgtaat

SEQ ID NO: 728555 - DNA, 22 bp, Artificial Sequence
  chemically synthesized
agtatacttttcattgatgact

SEQ ID NO: 728556 - DNA, 22 bp, Artificial Sequence
  chemically synthesized
tgagtatacttttcattgatga

SEQ ID NO: 728557 - DNA, 22 bp, Artificial Sequence
  chemically synthesized
ctgagtatacttttcattgatg

SEQ ID NO: 728558 - DNA, 22 bp, Artificial Sequence
  chemically synthesized
cattaagtcatcaatgaaaagt

SEQ ID NO: 728559 - DNA, 22 bp, Artificial Sequence
  chemically synthesized
aagaacttctgagtatactttt

SEQ ID NO: 728560 - DNA, 22 bp, Artificial Sequence
  chemically synthesized
agtcatcaatgaaaagtatact

SEQ ID NO: 728561 - DNA, 22 bp, Artificial Sequence
  chemically synthesized
atgagcagagttcaagaacttc

SEQ ID NO: 728562 - DNA, 22 bp, Artificial Sequence
  chemically synthesized
catgagcagagttcaagaactt

SEQ ID NO: 728563 - DNA, 22 bp, Artificial Sequence
  chemically synthesized
aatttcatgagcagagttcaag

SEQ ID NO: 728564 - DNA, 22 bp, Artificial Sequence
  chemically synthesized
agaagttcttgaactctgctca

SEQ ID NO: 728565 - DNA, 22 bp, Artificial Sequence
  chemically synthesized
aaaagataactgaatttcatga

SEQ ID NO: 728566 - DNA, 22 bp, Artificial Sequence
  chemically synthesized
ttgaactctgctcatgaaattc

SEQ ID NO: 728567 - DNA, 22 bp, Artificial Sequence
  chemically synthesized
gaactctgctcatgaaattcag

SEQ ID NO: 728568 - DNA, 22 bp, Artificial Sequence
  chemically synthesized
aactctgctcatgaaattcagt

SEQ ID NO: 728569 - DNA, 22 bp, Artificial Sequence
  chemically synthesized
tgatattcaaaagataactgaa

SEQ ID NO: 728570 - DNA, 22 bp, Artificial Sequence
  chemically synthesized
tgctcatgaaattcagttatct

SEQ ID NO: 728571 - DNA, 22 bp, Artificial Sequence
  chemically synthesized
ctcatgaaattcagttatcttt

SEQ ID NO: 728572 - DNA, 22 bp, Artificial Sequence
  chemically synthesized
atgaaattcagttatcttttga

SEQ ID NO: 728573 - DNA, 22 bp, Artificial Sequence
  chemically synthesized
tgatgcctatgatattcaaaag

SEQ ID NO: 728574 - DNA, 22 bp, Artificial Sequence
  chemically synthesized
tatgatgcctatgatattcaaa

SEQ ID NO: 728575 - DNA, 22 bp, Artificial Sequence
  chemically synthesized
ctatgatgcctatgatattcaa

SEQ ID NO: 728576 - DNA, 22 bp, Artificial Sequence
  chemically synthesized
tctatgatgcctatgatattca

SEQ ID NO: 728577 - DNA, 22 bp, Artificial Sequence
  chemically synthesized
ttctatgatgcctatgatattc

SEQ ID NO: 728578 - DNA, 22 bp, Artificial Sequence
  chemically synthesized
agttatcttttgaatatcatag

SEQ ID NO: 728579 - DNA, 22 bp, Artificial Sequence
  chemically synthesized
tcttttgaatatcataggcatc

SEQ ID NO: 728580 - DNA, 22 bp, Artificial Sequence
  chemically synthesized
atgcatttttctatgatgccta

SEQ ID NO: 728581 - DNA, 22 bp, Artificial Sequence
  chemically synthesized
catgcatttttctatgatgcct

SEQ ID NO: 728582 - DNA, 22 bp, Artificial Sequence
  chemically synthesized
ttgaatatcataggcatcatag

SEQ ID NO: 728583 - DNA, 22 bp, Artificial Sequence
  chemically synthesized
tgaatatcataggcatcataga

SEQ ID NO: 728584 - DNA, 22 bp, Artificial Sequence
  chemically synthesized
gaatatcataggcatcatagaa

SEQ ID NO: 728585 - DNA, 22 bp, Artificial Sequence
  chemically synthesized
aatatcataggcatcatagaaa

SEQ ID NO: 728586 - DNA, 22 bp, Artificial Sequence
  chemically synthesized
aaacttcatgcatttttctatg

SEQ ID NO: 728587 - DNA, 22 bp, Artificial Sequence
  chemically synthesized
caactacatcttacttgtgata

SEQ ID NO: 728588 - DNA, 22 bp, Artificial Sequence
  chemically synthesized
aactacatcttacttgtgatac

SEQ ID NO: 728589 - DNA, 22 bp, Artificial Sequence
  chemically synthesized
catcttacttgtgatactttat

SEQ ID NO: 728590 - DNA, 22 bp, Artificial Sequence
  chemically synthesized
acttgtgatactttatcttatt

SEQ ID NO: 728591 - DNA, 22 bp, Artificial Sequence
  chemically synthesized
cttgtgatactttatcttattt

SEQ ID NO: 728592 - DNA, 22 bp, Artificial Sequence
  chemically synthesized
gtgatactttatcttatttttt

SEQ ID NO: 728593 - DNA, 22 bp, Artificial Sequence
  chemically synthesized
tgatactttatcttatttttta

SEQ ID NO: 728594 - DNA, 22 bp, Artificial Sequence
  chemically synthesized
tatcttattttttattattatt

SEQ ID NO: 728595 - DNA, 22 bp, Artificial Sequence
  chemically synthesized
atcttattttttattattattt

SEQ ID NO: 728596 - DNA, 22 bp, Artificial Sequence
  chemically synthesized
tcttattttttattattatttt

SEQ ID NO: 728597 - DNA, 22 bp, Artificial Sequence
  chemically synthesized
aaataaaatgaaataaaataat

SEQ ID NO: 728598 - DNA, 22 bp, Artificial Sequence
  chemically synthesized
attttttattattattttattt

SEQ ID NO: 728599 - DNA, 22 bp, Artificial Sequence
  chemically synthesized
ttttttattattattttatttc

SEQ ID NO: 728600 - DNA, 22 bp, Artificial Sequence
  chemically synthesized
tctcaaataaaatgaaataaaa

SEQ ID NO: 728601 - DNA, 22 bp, Artificial Sequence
  chemically synthesized
tttattattattttatttcatt

SEQ ID NO: 728602 - DNA, 22 bp, Artificial Sequence
  chemically synthesized
tgtctcaaataaaatgaaataa

SEQ ID NO: 728603 - DNA, 22 bp, Artificial Sequence
  chemically synthesized
ttattattattttatttcattt

SEQ ID NO: 728604 - DNA, 22 bp, Artificial Sequence
  chemically synthesized
tattattattttatttcatttt

SEQ ID NO: 728605 - DNA, 22 bp, Artificial Sequence
  chemically synthesized
attattattttatttcatttta

SEQ ID NO: 728606 - DNA, 22 bp, Artificial Sequence
  chemically synthesized
ttattattttatttcattttat

SEQ ID NO: 728607 - DNA, 22 bp, Artificial Sequence
  chemically synthesized
ttattttatttcattttatttg

SEQ ID NO: 728608 - DNA, 22 bp, Artificial Sequence
  chemically synthesized
ttttatttcattttatttgaga

SEQ ID NO: 728609 - DNA, 22 bp, Artificial Sequence
  chemically synthesized
tatttcattttatttgagacag

SEQ ID NO: 728610 - DNA, 22 bp, Artificial Sequence
  chemically synthesized
atttcattttatttgagacaga

SEQ ID NO: 728611 - DNA, 22 bp, Artificial Sequence
  chemically synthesized
tttcattttatttgagacagag

SEQ ID NO: 728612 - DNA, 22 bp, Artificial Sequence
  chemically synthesized
cattttatttgagacagagttt

SEQ ID NO: 728613 - DNA, 22 bp, Artificial Sequence
  chemically synthesized
attttatttgagacagagtttc

SEQ ID NO: 728614 - DNA, 22 bp, Artificial Sequence
  chemically synthesized
ggcaacaagaacgaaactctgt

SEQ ID NO: 728615 - DNA, 22 bp, Artificial Sequence
  chemically synthesized
tatttgagacagagtttcgttc

SEQ ID NO: 728616 - DNA, 22 bp, Artificial Sequence
  chemically synthesized
atttgagacagagtttcgttct

SEQ ID NO: 728617 - DNA, 22 bp, Artificial Sequence
  chemically synthesized
tttgagacagagtttcgttctt

SEQ ID NO: 728618 - DNA, 22 bp, Artificial Sequence
  chemically synthesized
cagcctgggcaacaagaacgaa

SEQ ID NO: 728619 - DNA, 22 bp, Artificial Sequence
  chemically synthesized
gagacagagtttcgttcttgtt

SEQ ID NO: 728620 - DNA, 22 bp, Artificial Sequence
  chemically synthesized
agacagagtttcgttcttgttg

SEQ ID NO: 728621 - DNA, 22 bp, Artificial Sequence
  chemically synthesized
cactccagcctgggcaacaaga

SEQ ID NO: 728622 - DNA, 22 bp, Artificial Sequence
  chemically synthesized
tgccattgcactccagcctggg

SEQ ID NO: 728623 - DNA, 22 bp, Artificial Sequence
  chemically synthesized
cgttcttgttgcccaggctgga

SEQ ID NO: 728624 - DNA, 22 bp, Artificial Sequence
  chemically synthesized
gttcttgttgcccaggctggag

SEQ ID NO: 728625 - DNA, 22 bp, Artificial Sequence
  chemically synthesized
ttgttgcccaggctggagtgca

SEQ ID NO: 728626 - DNA, 22 bp, Artificial Sequence
  chemically synthesized
gttgcccaggctggagtgcaat

SEQ ID NO: 728627 - DNA, 22 bp, Artificial Sequence
  chemically synthesized
ttgcccaggctggagtgcaatg

SEQ ID NO: 728628 - DNA, 22 bp, Artificial Sequence
  chemically synthesized
cccaggctggagtgcaatggca

SEQ ID NO: 728629 - DNA, 22 bp, Artificial Sequence
  chemically synthesized
cagtgagccgagattgtgccat

SEQ ID NO: 728630 - DNA, 22 bp, Artificial Sequence
  chemically synthesized
gagtgcaatggcacaatctcgg

SEQ ID NO: 728631 - DNA, 22 bp, Artificial Sequence
  chemically synthesized
aacccaggaggcagaggttgca

SEQ ID NO: 728632 - DNA, 22 bp, Artificial Sequence
  chemically synthesized
gaacccaggaggcagaggttgc

SEQ ID NO: 728633 - DNA, 22 bp, Artificial Sequence
  chemically synthesized
cttgaacccaggaggcagaggt

SEQ ID NO: 728634 - DNA, 22 bp, Artificial Sequence
  chemically synthesized
ggctcactgcaacctctgcctc

SEQ ID NO: 728635 - DNA, 22 bp, Artificial Sequence
  chemically synthesized
actgcaacctctgcctcctggg

SEQ ID NO: 728636 - DNA, 22 bp, Artificial Sequence
  chemically synthesized
caacctctgcctcctgggttca

SEQ ID NO: 728637 - DNA, 22 bp, Artificial Sequence
  chemically synthesized
aggcaggagaattgcttgaacc

SEQ ID NO: 728638 - DNA, 22 bp, Artificial Sequence
  chemically synthesized
tgcctcctgggttcaagcaatt

SEQ ID NO: 728639 - DNA, 22 bp, Artificial Sequence
  chemically synthesized
cctcctgggttcaagcaattct

SEQ ID NO: 728640 - DNA, 22 bp, Artificial Sequence
  chemically synthesized
ctgggttcaagcaattctcctg

SEQ ID NO: 728641 - DNA, 22 bp, Artificial Sequence
  chemically synthesized
cggaggctgaggcaggagaatt

SEQ ID NO: 728642 - DNA, 22 bp, Artificial Sequence
  chemically synthesized
ggttcaagcaattctcctgcct

SEQ ID NO: 728643 - DNA, 22 bp, Artificial Sequence
  chemically synthesized
ctacggaggctgaggcaggaga

SEQ ID NO: 728644 - DNA, 22 bp, Artificial Sequence
  chemically synthesized
aagcaattctcctgcctcagcc

SEQ ID NO: 728645 - DNA, 22 bp, Artificial Sequence
  chemically synthesized
taatcacagctactacggaggc

SEQ ID NO: 728646 - DNA, 22 bp, Artificial Sequence
  chemically synthesized
tcctgcctcagcctccgtagta

SEQ ID NO: 728647 - DNA, 22 bp, Artificial Sequence
  chemically synthesized
ctgcctcagcctccgtagtagc

SEQ ID NO: 728648 - DNA, 22 bp, Artificial Sequence
  chemically synthesized
cctcagcctccgtagtagctgt

SEQ ID NO: 728649 - DNA, 22 bp, Artificial Sequence
  chemically synthesized
agcctccgtagtagctgtgatt

SEQ ID NO: 728650 - DNA, 22 bp, Artificial Sequence
  chemically synthesized
cgtagtagctgtgattacaggt

SEQ ID NO: 728651 - DNA, 22 bp, Artificial Sequence
  chemically synthesized
gacgtggtgacaggcacctgta

SEQ ID NO: 728652 - DNA, 22 bp, Artificial Sequence
  chemically synthesized
gctggacgtggtgacaggcacc

SEQ ID NO: 728653 - DNA, 22 bp, Artificial Sequence
  chemically synthesized
tgattacaggtgcctgtcacca

SEQ ID NO: 728654 - DNA, 22 bp, Artificial Sequence
  chemically synthesized
caggtgcctgtcaccacgtcca

SEQ ID NO: 728655 - DNA, 22 bp, Artificial Sequence
  chemically synthesized
aaaatacaaaaaattagctgga

SEQ ID NO: 728656 - DNA, 22 bp, Artificial Sequence
  chemically synthesized
ctaaaaatacaaaaaattagct

SEQ ID NO: 728657 - DNA, 22 bp, Artificial Sequence
  chemically synthesized
tcaccacgtccagctaattttt

SEQ ID NO: 728658 - DNA, 22 bp, Artificial Sequence
  chemically synthesized
tactaaaaatacaaaaaattag

SEQ ID NO: 728659 - DNA, 22 bp, Artificial Sequence
  chemically synthesized
tctctactaaaaatacaaaaaa

SEQ ID NO: 728660 - DNA, 22 bp, Artificial Sequence
  chemically synthesized
attttttgtatttttagtagag

SEQ ID NO: 728661 - DNA, 22 bp, Artificial Sequence
  chemically synthesized
tttgtatttttagtagagacag

SEQ ID NO: 728662 - DNA, 22 bp, Artificial Sequence
  chemically synthesized
ttgtatttttagtagagacagg

SEQ ID NO: 728663 - DNA, 22 bp, Artificial Sequence
  chemically synthesized
tgtatttttagtagagacaggg

SEQ ID NO: 728664 - DNA, 22 bp, Artificial Sequence
  chemically synthesized
gtatttttagtagagacagggt

SEQ ID NO: 728665 - DNA, 22 bp, Artificial Sequence
  chemically synthesized
tatttttagtagagacagggtt

SEQ ID NO: 728666 - DNA, 22 bp, Artificial Sequence
  chemically synthesized
gccaacatagtgaaaccctgtc

SEQ ID NO: 728667 - DNA, 22 bp, Artificial Sequence
  chemically synthesized
ttagtagagacagggtttcact

SEQ ID NO: 728668 - DNA, 22 bp, Artificial Sequence
  chemically synthesized
tagtagagacagggtttcacta

SEQ ID NO: 728669 - DNA, 22 bp, Artificial Sequence
  chemically synthesized
agtagagacagggtttcactat

SEQ ID NO: 728670 - DNA, 22 bp, Artificial Sequence
  chemically synthesized
gtagagacagggtttcactatg

SEQ ID NO: 728671 - DNA, 22 bp, Artificial Sequence
  chemically synthesized
gagaccagcctggccaacatag

SEQ ID NO: 728672 - DNA, 22 bp, Artificial Sequence
  chemically synthesized
cactatgttggccaggctggtc

SEQ ID NO: 728673 - DNA, 22 bp, Artificial Sequence
  chemically synthesized
actatgttggccaggctggtct

SEQ ID NO: 728674 - DNA, 22 bp, Artificial Sequence
  chemically synthesized
aggtcaggaattcgagaccagc

SEQ ID NO: 728675 - DNA, 22 bp, Artificial Sequence
  chemically synthesized
tgttggccaggctggtctcgaa

SEQ ID NO: 728676 - DNA, 22 bp, Artificial Sequence
  chemically synthesized
gccaggctggtctcgaattcct

SEQ ID NO: 728677 - DNA, 22 bp, Artificial Sequence
  chemically synthesized
gtctcgaattcctgacctcagg

SEQ ID NO: 728678 - DNA, 22 bp, Artificial Sequence
  chemically synthesized
gaattcctgacctcaggtgatc

SEQ ID NO: 728679 - DNA, 22 bp, Artificial Sequence
  chemically synthesized
agaggccgaggtgggtggatca

SEQ ID NO: 728680 - DNA, 22 bp, Artificial Sequence
  chemically synthesized
ctgacctcaggtgatccaccca

SEQ ID NO: 728681 - DNA, 22 bp, Artificial Sequence
  chemically synthesized
gagaggccgaggtgggtggatc

SEQ ID NO: 728682 - DNA, 22 bp, Artificial Sequence
  chemically synthesized
tgagaggccgaggtgggtggat

SEQ ID NO: 728683 - DNA, 22 bp, Artificial Sequence
  chemically synthesized
acctcaggtgatccacccacct

SEQ ID NO: 728684 - DNA, 22 bp, Artificial Sequence
  chemically synthesized
aggtgatccacccacctcggcc

SEQ ID NO: 728685 - DNA, 22 bp, Artificial Sequence
  chemically synthesized
taatcccagcactttgagaggc

SEQ ID NO: 728686 - DNA, 22 bp, Artificial Sequence
  chemically synthesized
acacctgtaatcccagcacttt

SEQ ID NO: 728687 - DNA, 22 bp, Artificial Sequence
  chemically synthesized
ggcctctcaaagtgctgggatt

SEQ ID NO: 728688 - DNA, 22 bp, Artificial Sequence
  chemically synthesized
gctcacacctgtaatcccagca

SEQ ID NO: 728689 - DNA, 22 bp, Artificial Sequence
  chemically synthesized
tcaaagtgctgggattacaggt

SEQ ID NO: 728690 - DNA, 22 bp, Artificial Sequence
  chemically synthesized
aaagtgctgggattacaggtgt

SEQ ID NO: 728691 - DNA, 22 bp, Artificial Sequence
  chemically synthesized
ggattacaggtgtgagccagca

SEQ ID NO: 728692 - DNA, 22 bp, Artificial Sequence
  chemically synthesized
caggtgtgagccagcatgcttg

SEQ ID NO: 728693 - DNA, 22 bp, Artificial Sequence
  chemically synthesized
aaaaaaaaaaagaaaaaaaaaa

SEQ ID NO: 728694 - DNA, 22 bp, Artificial Sequence
  chemically synthesized
tctcaaaaaaaaaaagaaaaaa

SEQ ID NO: 728695 - DNA, 22 bp, Artificial Sequence
  chemically synthesized
ggccctttttttttttcttttt

SEQ ID NO: 728696 - DNA, 22 bp, Artificial Sequence
  chemically synthesized
tgtctcaaaaaaaaaaagaaaa

SEQ ID NO: 728697 - DNA, 22 bp, Artificial Sequence
  chemically synthesized
gccctttttttttttctttttt

SEQ ID NO: 728698 - DNA, 22 bp, Artificial Sequence
  chemically synthesized
tttttttttctttttttttttg

SEQ ID NO: 728699 - DNA, 22 bp, Artificial Sequence
  chemically synthesized
ttttttttctttttttttttga

SEQ ID NO: 728700 - DNA, 22 bp, Artificial Sequence
  chemically synthesized
tttttttctttttttttttgag

SEQ ID NO: 728701 - DNA, 22 bp, Artificial Sequence
  chemically synthesized
ttttttctttttttttttgaga

SEQ ID NO: 728702 - DNA, 22 bp, Artificial Sequence
  chemically synthesized
tttttctttttttttttgagac

SEQ ID NO: 728703 - DNA, 22 bp, Artificial Sequence
  chemically synthesized
ttttctttttttttttgagaca

SEQ ID NO: 728704 - DNA, 22 bp, Artificial Sequence
  chemically synthesized
tttctttttttttttgagacag

SEQ ID NO: 728705 - DNA, 22 bp, Artificial Sequence
  chemically synthesized
ttctttttttttttgagacaga

SEQ ID NO: 728706 - DNA, 22 bp, Artificial Sequence
  chemically synthesized
tctttttttttttgagacagag

SEQ ID NO: 728707 - DNA, 22 bp, Artificial Sequence
  chemically synthesized
ctttttttttttgagacagagt

SEQ ID NO: 728708 - DNA, 22 bp, Artificial Sequence
  chemically synthesized
tttttttttttgagacagagtc

SEQ ID NO: 728709 - DNA, 22 bp, Artificial Sequence
  chemically synthesized
ggcaacagagccagactctgtc

SEQ ID NO: 728710 - DNA, 22 bp, Artificial Sequence
  chemically synthesized
tttttttttgagacagagtctg

SEQ ID NO: 728711 - DNA, 22 bp, Artificial Sequence
  chemically synthesized
ttttttttgagacagagtctgg

SEQ ID NO: 728712 - DNA, 22 bp, Artificial Sequence
  chemically synthesized
tttttttgagacagagtctggc

SEQ ID NO: 728713 - DNA, 22 bp, Artificial Sequence
  chemically synthesized
ttttttgagacagagtctggct

SEQ ID NO: 728714 - DNA, 22 bp, Artificial Sequence
  chemically synthesized
tttttgagacagagtctggctc

SEQ ID NO: 728715 - DNA, 22 bp, Artificial Sequence
  chemically synthesized
ttttgagacagagtctggctct

SEQ ID NO: 728716 - DNA, 22 bp, Artificial Sequence
  chemically synthesized
tttgagacagagtctggctctg

SEQ ID NO: 728717 - DNA, 22 bp, Artificial Sequence
  chemically synthesized
cagcctgggcaacagagccaga

SEQ ID NO: 728718 - DNA, 22 bp, Artificial Sequence
  chemically synthesized
ttgagacagagtctggctctgt

SEQ ID NO: 728719 - DNA, 22 bp, Artificial Sequence
  chemically synthesized
tgagacagagtctggctctgtt

SEQ ID NO: 728720 - DNA, 22 bp, Artificial Sequence
  chemically synthesized
gagacagagtctggctctgttg

SEQ ID NO: 728721 - DNA, 22 bp, Artificial Sequence
  chemically synthesized
agacagagtctggctctgttgc

SEQ ID NO: 728722 - DNA, 22 bp, Artificial Sequence
  chemically synthesized
cactccagcctgggcaacagag

SEQ ID NO: 728723 - DNA, 22 bp, Artificial Sequence
  chemically synthesized
caccactgcactccagcctggg

SEQ ID NO: 728724 - DNA, 22 bp, Artificial Sequence
  chemically synthesized
gctctgttgcccaggctggagt

SEQ ID NO: 728725 - DNA, 22 bp, Artificial Sequence
  chemically synthesized
tgttgcccaggctggagtgcag

SEQ ID NO: 728726 - DNA, 22 bp, Artificial Sequence
  chemically synthesized
ttgcccaggctggagtgcagtg

SEQ ID NO: 728727 - DNA, 22 bp, Artificial Sequence
  chemically synthesized
cccaggctggagtgcagtggtg

SEQ ID NO: 728728 - DNA, 22 bp, Artificial Sequence
  chemically synthesized
gcagtgagccaagattgcacca

SEQ ID NO: 728729 - DNA, 22 bp, Artificial Sequence
  chemically synthesized
gagtgcagtggtgcaatcttgg

SEQ ID NO: 728730 - DNA, 22 bp, Artificial Sequence
  chemically synthesized
ggctcactgcgagcttcacctc

SEQ ID NO: 728731 - DNA, 22 bp, Artificial Sequence
  chemically synthesized
gctcactgcgagcttcacctcc

SEQ ID NO: 728732 - DNA, 22 bp, Artificial Sequence
  chemically synthesized
actgcgagcttcacctcccggg

SEQ ID NO: 728733 - DNA, 22 bp, Artificial Sequence
  chemically synthesized
cgagcttcacctcccgggttca

SEQ ID NO: 728734 - DNA, 22 bp, Artificial Sequence
  chemically synthesized
aggcaggagaatggcgtgaacc

SEQ ID NO: 728735 - DNA, 22 bp, Artificial Sequence
  chemically synthesized
cacctcccgggttcacgccatt

SEQ ID NO: 728736 - DNA, 22 bp, Artificial Sequence
  chemically synthesized
acctcccgggttcacgccattc

SEQ ID NO: 728737 - DNA, 22 bp, Artificial Sequence
  chemically synthesized
ccgggttcacgccattctcctg

SEQ ID NO: 728738 - DNA, 22 bp, Artificial Sequence
  chemically synthesized
gggaggctgaggcaggagaatg

SEQ ID NO: 728739 - DNA, 22 bp, Artificial Sequence
  chemically synthesized
ctcgggaggctgaggcaggaga

SEQ ID NO: 728740 - DNA, 22 bp, Artificial Sequence
  chemically synthesized
acgccattctcctgcctcagcc

SEQ ID NO: 728741 - DNA, 22 bp, Artificial Sequence
  chemically synthesized
tagtcccagctactcgggaggc

SEQ ID NO: 728742 - DNA, 22 bp, Artificial Sequence
  chemically synthesized
tcctgcctcagcctcccgagta

SEQ ID NO: 728743 - DNA, 22 bp, Artificial Sequence
  chemically synthesized
ctgcctcagcctcccgagtagc

SEQ ID NO: 728744 - DNA, 22 bp, Artificial Sequence
  chemically synthesized
cctcagcctcccgagtagctgg

SEQ ID NO: 728745 - DNA, 22 bp, Artificial Sequence
  chemically synthesized
agcctcccgagtagctgggact

SEQ ID NO: 728746 - DNA, 22 bp, Artificial Sequence
  chemically synthesized
ccgagtagctgggactacaggc

SEQ ID NO: 728747 - DNA, 22 bp, Artificial Sequence
  chemically synthesized
gccaggcgtggtggtgggtgcc

SEQ ID NO: 728748 - DNA, 22 bp, Artificial Sequence
  chemically synthesized
ggactacaggcacccaccacca

SEQ ID NO: 728749 - DNA, 22 bp, Artificial Sequence
  chemically synthesized
caggcacccaccaccacgcctg

SEQ ID NO: 728750 - DNA, 22 bp, Artificial Sequence
  chemically synthesized
aaaaaaaaaaaatacaaaaaat

SEQ ID NO: 728751 - DNA, 22 bp, Artificial Sequence
  chemically synthesized
aaaaaaaaaaaaatacaaaaaa

SEQ ID NO: 728752 - DNA, 22 bp, Artificial Sequence
  chemically synthesized
cttaaaaaaaaaaaaatacaaa

SEQ ID NO: 728753 - DNA, 22 bp, Artificial Sequence
  chemically synthesized
tacttaaaaaaaaaaaaataca

SEQ ID NO: 728754 - DNA, 22 bp, Artificial Sequence
  chemically synthesized
gctaattttttgtatttttttt

SEQ ID NO: 728755 - DNA, 22 bp, Artificial Sequence
  chemically synthesized
attttttgtatttttttttttt

SEQ ID NO: 728756 - DNA, 22 bp, Artificial Sequence
  chemically synthesized
tttgtatttttttttttttaag

SEQ ID NO: 728757 - DNA, 22 bp, Artificial Sequence
  chemically synthesized
ttgtatttttttttttttaagt

SEQ ID NO: 728758 - DNA, 22 bp, Artificial Sequence
  chemically synthesized
tgtatttttttttttttaagta

SEQ ID NO: 728759 - DNA, 22 bp, Artificial Sequence
  chemically synthesized
gtatttttttttttttaagtag

SEQ ID NO: 728760 - DNA, 22 bp, Artificial Sequence
  chemically synthesized
tatttttttttttttaagtaga

SEQ ID NO: 728761 - DNA, 22 bp, Artificial Sequence
  chemically synthesized
ttttttttttaagtagagatgg

SEQ ID NO: 728762 - DNA, 22 bp, Artificial Sequence
  chemically synthesized
tttttttttaagtagagatggg

SEQ ID NO: 728763 - DNA, 22 bp, Artificial Sequence
  chemically synthesized
acatggtgaaaccccatctcta

SEQ ID NO: 728764 - DNA, 22 bp, Artificial Sequence
  chemically synthesized
ttttttttaagtagagatgggg

SEQ ID NO: 728765 - DNA, 22 bp, Artificial Sequence
  chemically synthesized
tttttttaagtagagatggggt

SEQ ID NO: 728766 - DNA, 22 bp, Artificial Sequence
  chemically synthesized
ttttttaagtagagatggggtt

SEQ ID NO: 728767 - DNA, 22 bp, Artificial Sequence
  chemically synthesized
tttttaagtagagatggggttt

SEQ ID NO: 728768 - DNA, 22 bp, Artificial Sequence
  chemically synthesized
gctaacatggtgaaaccccatc

SEQ ID NO: 728769 - DNA, 22 bp, Artificial Sequence
  chemically synthesized
ttttaagtagagatggggtttc

SEQ ID NO: 728770 - DNA, 22 bp, Artificial Sequence
  chemically synthesized
tttaagtagagatggggtttca

SEQ ID NO: 728771 - DNA, 22 bp, Artificial Sequence
  chemically synthesized
ttaagtagagatggggtttcac

SEQ ID NO: 728772 - DNA, 22 bp, Artificial Sequence
  chemically synthesized
taagtagagatggggtttcacc

SEQ ID NO: 728773 - DNA, 22 bp, Artificial Sequence
  chemically synthesized
aagtagagatggggtttcacca

SEQ ID NO: 728774 - DNA, 22 bp, Artificial Sequence
  chemically synthesized
agtagagatggggtttcaccat

SEQ ID NO: 728775 - DNA, 22 bp, Artificial Sequence
  chemically synthesized
gagaccatcctggctaacatgg

SEQ ID NO: 728776 - DNA, 22 bp, Artificial Sequence
  chemically synthesized
caccatgttagccaggatggtc

SEQ ID NO: 728777 - DNA, 22 bp, Artificial Sequence
  chemically synthesized
accatgttagccaggatggtct

SEQ ID NO: 728778 - DNA, 22 bp, Artificial Sequence
  chemically synthesized
gccaggatggtctcgaactcct

SEQ ID NO: 728779 - DNA, 22 bp, Artificial Sequence
  chemically synthesized
gaactcctgacctcgtgatcca

SEQ ID NO: 728780 - DNA, 22 bp, Artificial Sequence
  chemically synthesized
agaggccgaggcggatggatca

SEQ ID NO: 728781 - DNA, 22 bp, Artificial Sequence
  chemically synthesized
gagaggccgaggcggatggatc

SEQ ID NO: 728782 - DNA, 22 bp, Artificial Sequence
  chemically synthesized
tgagaggccgaggcggatggat

SEQ ID NO: 728783 - DNA, 22 bp, Artificial Sequence
  chemically synthesized
ctgacctcgtgatccatccgcc

SEQ ID NO: 728784 - DNA, 22 bp, Artificial Sequence
  chemically synthesized
acctcgtgatccatccgcctcg

SEQ ID NO: 728785 - DNA, 22 bp, Artificial Sequence
  chemically synthesized
gtgatccatccgcctcggcctc

SEQ ID NO: 728786 - DNA, 22 bp, Artificial Sequence
  chemically synthesized
aaatcccagcactttgagaggc

SEQ ID NO: 728787 - DNA, 22 bp, Artificial Sequence
  chemically synthesized
atgcctaaaatcccagcacttt

SEQ ID NO: 728788 - DNA, 22 bp, Artificial Sequence
  chemically synthesized
ggcctctcaaagtgctgggatt

SEQ ID NO: 728789 - DNA, 22 bp, Artificial Sequence
  chemically synthesized
tcaaagtgctgggattttaggc

SEQ ID NO: 728790 - DNA, 22 bp, Artificial Sequence
  chemically synthesized
aaagtgctgggattttaggcat

SEQ ID NO: 728791 - DNA, 22 bp, Artificial Sequence
  chemically synthesized
ggattttaggcatgagccaccg

SEQ ID NO: 728792 - DNA, 22 bp, Artificial Sequence
  chemically synthesized
taggcatgagccaccgcacccg

SEQ ID NO: 728793 - DNA, 22 bp, Artificial Sequence
  chemically synthesized
aggcatgagccaccgcacccga

SEQ ID NO: 728794 - DNA, 22 bp, Artificial Sequence
  chemically synthesized
ggcatgagccaccgcacccgat

SEQ ID NO: 728795 - DNA, 22 bp, Artificial Sequence
  chemically synthesized
aaaataagatagatcgggtgcg

SEQ ID NO: 728796 - DNA, 22 bp, Artificial Sequence
  chemically synthesized
aaaaataagatagatcgggtgc

SEQ ID NO: 728797 - DNA, 22 bp, Artificial Sequence
  chemically synthesized
taaaaataagatagatcgggtg

SEQ ID NO: 728798 - DNA, 22 bp, Artificial Sequence
  chemically synthesized
ttaaaaataagatagatcgggt

SEQ ID NO: 728799 - DNA, 22 bp, Artificial Sequence
  chemically synthesized
agtgataatttttaaaaataag

SEQ ID NO: 728800 - DNA, 22 bp, Artificial Sequence
  chemically synthesized
tacgttgagtgataatttttaa

SEQ ID NO: 728801 - DNA, 22 bp, Artificial Sequence
  chemically synthesized
tcttatttttaaaaattatcac

SEQ ID NO: 728802 - DNA, 22 bp, Artificial Sequence
  chemically synthesized
agctgtacgttgagtgataatt

SEQ ID NO: 728803 - DNA, 22 bp, Artificial Sequence
  chemically synthesized
gagctgtacgttgagtgataat

SEQ ID NO: 728804 - DNA, 22 bp, Artificial Sequence
  chemically synthesized
atttttaaaaattatcactcaa

SEQ ID NO: 728805 - DNA, 22 bp, Artificial Sequence
  chemically synthesized
tttttaaaaattatcactcaac

SEQ ID NO: 728806 - DNA, 22 bp, Artificial Sequence
  chemically synthesized
ttaaaaattatcactcaacgta

SEQ ID NO: 728807 - DNA, 22 bp, Artificial Sequence
  chemically synthesized
taaaaattatcactcaacgtac

SEQ ID NO: 728808 - DNA, 22 bp, Artificial Sequence
  chemically synthesized
aaaaattatcactcaacgtaca

SEQ ID NO: 728809 - DNA, 22 bp, Artificial Sequence
  chemically synthesized
aaaattatcactcaacgtacag

SEQ ID NO: 728810 - DNA, 22 bp, Artificial Sequence
  chemically synthesized
tggatgatttgagctgtacgtt

SEQ ID NO: 728811 - DNA, 22 bp, Artificial Sequence
  chemically synthesized
tactatggatgatttgagctgt

SEQ ID NO: 728812 - DNA, 22 bp, Artificial Sequence
  chemically synthesized
tcactcaacgtacagctcaaat

SEQ ID NO: 728813 - DNA, 22 bp, Artificial Sequence
  chemically synthesized
aacgtacagctcaaatcatcca

SEQ ID NO: 728814 - DNA, 22 bp, Artificial Sequence
  chemically synthesized
aataaaattatactatggatga

SEQ ID NO: 728815 - DNA, 22 bp, Artificial Sequence
  chemically synthesized
agctaaataaaattatactatg

SEQ ID NO: 728816 - DNA, 22 bp, Artificial Sequence
  chemically synthesized
cagctaaataaaattatactat

SEQ ID NO: 728817 - DNA, 22 bp, Artificial Sequence
  chemically synthesized
aaatcatccatagtataatttt

SEQ ID NO: 728818 - DNA, 22 bp, Artificial Sequence
  chemically synthesized
atgacaaatccatccttcagct

SEQ ID NO: 728819 - DNA, 22 bp, Artificial Sequence
  chemically synthesized
tatttagctgaaggatggattt

SEQ ID NO: 728820 - DNA, 22 bp, Artificial Sequence
  chemically synthesized
atttagctgaaggatggatttg

SEQ ID NO: 728821 - DNA, 22 bp, Artificial Sequence
  chemically synthesized
tggaactaatgacaaatccatc

SEQ ID NO: 728822 - DNA, 22 bp, Artificial Sequence
  chemically synthesized
tttagctgaaggatggatttgt

SEQ ID NO: 728823 - DNA, 22 bp, Artificial Sequence
  chemically synthesized
agctgaaggatggatttgtcat

SEQ ID NO: 728824 - DNA, 22 bp, Artificial Sequence
  chemically synthesized
gctgaaggatggatttgtcatt

SEQ ID NO: 728825 - DNA, 22 bp, Artificial Sequence
  chemically synthesized
aaggatggatttgtcattagtt

SEQ ID NO: 728826 - DNA, 22 bp, Artificial Sequence
  chemically synthesized
gtcattagttccataactcctg

SEQ ID NO: 728827 - DNA, 22 bp, Artificial Sequence
  chemically synthesized
tcattagttccataactcctgt

SEQ ID NO: 728828 - DNA, 22 bp, Artificial Sequence
  chemically synthesized
gttccataactcctgttctctc

SEQ ID NO: 728829 - DNA, 22 bp, Artificial Sequence
  chemically synthesized
cataactcctgttctctctctt

SEQ ID NO: 728830 - DNA, 22 bp, Artificial Sequence
  chemically synthesized
ctgttctctctcttgactttat

SEQ ID NO: 728831 - DNA, 22 bp, Artificial Sequence
  chemically synthesized
tgtgtataaaaaataaagtcaa

SEQ ID NO: 728832 - DNA, 22 bp, Artificial Sequence
  chemically synthesized
ttctctctcttgactttatttt

SEQ ID NO: 728833 - DNA, 22 bp, Artificial Sequence
  chemically synthesized
tctctcttgactttatttttta

SEQ ID NO: 728834 - DNA, 22 bp, Artificial Sequence
  chemically synthesized
aatgttgtgtgtataaaaaata

SEQ ID NO: 728835 - DNA, 22 bp, Artificial Sequence
  chemically synthesized
tctcttgactttattttttata

SEQ ID NO: 728836 - DNA, 22 bp, Artificial Sequence
  chemically synthesized
tcttgactttattttttataca

SEQ ID NO: 728837 - DNA, 22 bp, Artificial Sequence
  chemically synthesized
gttaaatgttgtgtgtataaaa

SEQ ID NO: 728838 - DNA, 22 bp, Artificial Sequence
  chemically synthesized
ttgactttattttttatacaca

SEQ ID NO: 728839 - DNA, 22 bp, Artificial Sequence
  chemically synthesized
tggttaaatgttgtgtgtataa

SEQ ID NO: 728840 - DNA, 22 bp, Artificial Sequence
  chemically synthesized
gactttattttttatacacaca

SEQ ID NO: 728841 - DNA, 22 bp, Artificial Sequence
  chemically synthesized
ctggttaaatgttgtgtgtata

SEQ ID NO: 728842 - DNA, 22 bp, Artificial Sequence
  chemically synthesized
actttattttttatacacacaa

SEQ ID NO: 728843 - DNA, 22 bp, Artificial Sequence
  chemically synthesized
tcttctggttaaatgttgtgtg

SEQ ID NO: 728844 - DNA, 22 bp, Artificial Sequence
  chemically synthesized
tattttttatacacacaacatt

SEQ ID NO: 728845 - DNA, 22 bp, Artificial Sequence
  chemically synthesized
attttttatacacacaacattt

SEQ ID NO: 728846 - DNA, 22 bp, Artificial Sequence
  chemically synthesized
ttttttatacacacaacattta

SEQ ID NO: 728847 - DNA, 22 bp, Artificial Sequence
  chemically synthesized
tttatacacacaacatttaacc

SEQ ID NO: 728848 - DNA, 22 bp, Artificial Sequence
  chemically synthesized
ggtctgtcttctggttaaatgt

SEQ ID NO: 728849 - DNA, 22 bp, Artificial Sequence
  chemically synthesized
ttatacacacaacatttaacca

SEQ ID NO: 728850 - DNA, 22 bp, Artificial Sequence
  chemically synthesized
tatacacacaacatttaaccag

SEQ ID NO: 728851 - DNA, 22 bp, Artificial Sequence
  chemically synthesized
atacacacaacatttaaccaga

SEQ ID NO: 728852 - DNA, 22 bp, Artificial Sequence
  chemically synthesized
ttgggtctgtcttctggttaaa

SEQ ID NO: 728853 - DNA, 22 bp, Artificial Sequence
  chemically synthesized
tacacacaacatttaaccagaa

SEQ ID NO: 728854 - DNA, 22 bp, Artificial Sequence
  chemically synthesized
attgggtctgtcttctggttaa

SEQ ID NO: 728855 - DNA, 22 bp, Artificial Sequence
  chemically synthesized
tattgggtctgtcttctggtta

SEQ ID NO: 728856 - DNA, 22 bp, Artificial Sequence
  chemically synthesized
ttattgggtctgtcttctggtt

SEQ ID NO: 728857 - DNA, 22 bp, Artificial Sequence
  chemically synthesized
ataaatttttattgggtctgtc

SEQ ID NO: 728858 - DNA, 22 bp, Artificial Sequence
  chemically synthesized
aataaatttttattgggtctgt

SEQ ID NO: 728859 - DNA, 22 bp, Artificial Sequence
  chemically synthesized
aaccagaagacagacccaataa

SEQ ID NO: 728860 - DNA, 22 bp, Artificial Sequence
  chemically synthesized
accagaagacagacccaataaa

SEQ ID NO: 728861 - DNA, 22 bp, Artificial Sequence
  chemically synthesized
ataatttaataaatttttattg

SEQ ID NO: 728862 - DNA, 22 bp, Artificial Sequence
  chemically synthesized
cataatttaataaatttttatt

SEQ ID NO: 728863 - DNA, 22 bp, Artificial Sequence
  chemically synthesized
tttcataatttaataaattttt

SEQ ID NO: 728864 - DNA, 22 bp, Artificial Sequence
  chemically synthesized
tcctgtttcataatttaataaa

SEQ ID NO: 728865 - DNA, 22 bp, Artificial Sequence
  chemically synthesized
atcctgtttcataatttaataa

SEQ ID NO: 728866 - DNA, 22 bp, Artificial Sequence
  chemically synthesized
tatcctgtttcataatttaata

SEQ ID NO: 728867 - DNA, 22 bp, Artificial Sequence
  chemically synthesized
tgtccagttttatcctgtttca

SEQ ID NO: 728868 - DNA, 22 bp, Artificial Sequence
  chemically synthesized
attaaattatgaaacaggataa

SEQ ID NO: 728869 - DNA, 22 bp, Artificial Sequence
  chemically synthesized
ttaaattatgaaacaggataaa

SEQ ID NO: 728870 - DNA, 22 bp, Artificial Sequence
  chemically synthesized
attatgtccagttttatcctgt

SEQ ID NO: 728871 - DNA, 22 bp, Artificial Sequence
  chemically synthesized
aattatgaaacaggataaaact

SEQ ID NO: 728872 - DNA, 22 bp, Artificial Sequence
  chemically synthesized
tctcattatgtccagttttatc

SEQ ID NO: 728873 - DNA, 22 bp, Artificial Sequence
  chemically synthesized
gtctcattatgtccagttttat

SEQ ID NO: 728874 - DNA, 22 bp, Artificial Sequence
  chemically synthesized
tgaaacaggataaaactggaca

SEQ ID NO: 728875 - DNA, 22 bp, Artificial Sequence
  chemically synthesized
tttgtctcattatgtccagttt

SEQ ID NO: 728876 - DNA, 22 bp, Artificial Sequence
  chemically synthesized
gtttgtctcattatgtccagtt

SEQ ID NO: 728877 - DNA, 22 bp, Artificial Sequence
  chemically synthesized
tttgtttgtctcattatgtcca

SEQ ID NO: 728878 - DNA, 22 bp, Artificial Sequence
  chemically synthesized
gtttgtttgtctcattatgtcc

SEQ ID NO: 728879 - DNA, 22 bp, Artificial Sequence
  chemically synthesized
tttgtttgtttgtctcattatg

SEQ ID NO: 728880 - DNA, 22 bp, Artificial Sequence
  chemically synthesized
gtttgtttgtttgtctcattat

SEQ ID NO: 728881 - DNA, 22 bp, Artificial Sequence
  chemically synthesized
cgtttgtttgtttgtttgtctc

SEQ ID NO: 728882 - DNA, 22 bp, Artificial Sequence
  chemically synthesized
gcgtttgtttgtttgtttgtct

SEQ ID NO: 728883 - DNA, 22 bp, Artificial Sequence
  chemically synthesized
tgcgtttgtttgtttgtttgtc

SEQ ID NO: 728884 - DNA, 22 bp, Artificial Sequence
  chemically synthesized
gacataatgagacaaacaaaca

SEQ ID NO: 728885 - DNA, 22 bp, Artificial Sequence
  chemically synthesized
gaccactttgcgtttgtttgtt

SEQ ID NO: 728886 - DNA, 22 bp, Artificial Sequence
  chemically synthesized
agaccactttgcgtttgtttgt

SEQ ID NO: 728887 - DNA, 22 bp, Artificial Sequence
  chemically synthesized
tagaccactttgcgtttgtttg

SEQ ID NO: 728888 - DNA, 22 bp, Artificial Sequence
  chemically synthesized
aatcgaaacattttagaccact

SEQ ID NO: 728889 - DNA, 22 bp, Artificial Sequence
  chemically synthesized
tcatcattaaatcgaaacattt

SEQ ID NO: 728890 - DNA, 22 bp, Artificial Sequence
  chemically synthesized
cgctatcatcattaaatcgaaa

SEQ ID NO: 728891 - DNA, 22 bp, Artificial Sequence
  chemically synthesized
aaatgtttcgatttaatgatga

SEQ ID NO: 728892 - DNA, 22 bp, Artificial Sequence
  chemically synthesized
caggttacgctatcatcattaa

SEQ ID NO: 728893 - DNA, 22 bp, Artificial Sequence
  chemically synthesized
cgatttaatgatgatagcgtaa

SEQ ID NO: 728894 - DNA, 22 bp, Artificial Sequence
  chemically synthesized
gatttaatgatgatagcgtaac

SEQ ID NO: 728895 - DNA, 22 bp, Artificial Sequence
  chemically synthesized
aatgatgatagcgtaacctgca

SEQ ID NO: 728896 - DNA, 22 bp, Artificial Sequence
  chemically synthesized
atgatgatagcgtaacctgcaa

SEQ ID NO: 728897 - DNA, 22 bp, Artificial Sequence
  chemically synthesized
atatatgaatgattgcaggtta

SEQ ID NO: 728898 - DNA, 22 bp, Artificial Sequence
  chemically synthesized
tcatatatgaatgattgcaggt

SEQ ID NO: 728899 - DNA, 22 bp, Artificial Sequence
  chemically synthesized
tctcatatatgaatgattgcag

SEQ ID NO: 728900 - DNA, 22 bp, Artificial Sequence
  chemically synthesized
ctctcatatatgaatgattgca

SEQ ID NO: 728901 - DNA, 22 bp, Artificial Sequence
  chemically synthesized
atgatgccttctctcatatatg

SEQ ID NO: 728902 - DNA, 22 bp, Artificial Sequence
  chemically synthesized
caatcattcatatatgagagaa

SEQ ID NO: 728903 - DNA, 22 bp, Artificial Sequence
  chemically synthesized
agatcctcatgatgccttctct

SEQ ID NO: 728904 - DNA, 22 bp, Artificial Sequence
  chemically synthesized
atatatgagagaaggcatcatg

SEQ ID NO: 728905 - DNA, 22 bp, Artificial Sequence
  chemically synthesized
tcccaaagctgagatcctcatg

SEQ ID NO: 728906 - DNA, 22 bp, Artificial Sequence
  chemically synthesized
gaaaacctatcccaaagctgag

SEQ ID NO: 728907 - DNA, 22 bp, Artificial Sequence
  chemically synthesized
ctggaaaacctatcccaaagct

SEQ ID NO: 728908 - DNA, 22 bp, Artificial Sequence
  chemically synthesized
cctggaaaacctatcccaaagc

SEQ ID NO: 728909 - DNA, 22 bp, Artificial Sequence
  chemically synthesized
ccttcctggaaaacctatccca

SEQ ID NO: 728910 - DNA, 22 bp, Artificial Sequence
  chemically synthesized
gttcccttcctggaaaacctat

SEQ ID NO: 728911 - DNA, 22 bp, Artificial Sequence
  chemically synthesized
tagttcccttcctggaaaacct

SEQ ID NO: 728912 - DNA, 22 bp, Artificial Sequence
  chemically synthesized
agctttgggataggttttccag

SEQ ID NO: 728913 - DNA, 22 bp, Artificial Sequence
  chemically synthesized
tgggataggttttccaggaagg

SEQ ID NO: 728914 - DNA, 22 bp, Artificial Sequence
  chemically synthesized
atgctctagttcccttcctgga

SEQ ID NO: 728915 - DNA, 22 bp, Artificial Sequence
  chemically synthesized
gggataggttttccaggaaggg

SEQ ID NO: 728916 - DNA, 22 bp, Artificial Sequence
  chemically synthesized
ggataggttttccaggaaggga

SEQ ID NO: 728917 - DNA, 22 bp, Artificial Sequence
  chemically synthesized
gactaatgctctagttcccttc

SEQ ID NO: 728918 - DNA, 22 bp, Artificial Sequence
  chemically synthesized
tccaggaagggaactagagcat

SEQ ID NO: 728919 - DNA, 22 bp, Artificial Sequence
  chemically synthesized
ccaggaagggaactagagcatt

SEQ ID NO: 728920 - DNA, 22 bp, Artificial Sequence
  chemically synthesized
caggaagggaactagagcatta

SEQ ID NO: 728921 - DNA, 22 bp, Artificial Sequence
  chemically synthesized
aaacaacagggctggactaatg

SEQ ID NO: 728922 - DNA, 22 bp, Artificial Sequence
  chemically synthesized
ctgaaacaacagggctggacta

SEQ ID NO: 728923 - DNA, 22 bp, Artificial Sequence
  chemically synthesized
gctgaaacaacagggctggact

SEQ ID NO: 728924 - DNA, 22 bp, Artificial Sequence
  chemically synthesized
gagcattagtccagccctgttg

SEQ ID NO: 728925 - DNA, 22 bp, Artificial Sequence
  chemically synthesized
acaggggtccttgctgaaacaa

SEQ ID NO: 728926 - DNA, 22 bp, Artificial Sequence
  chemically synthesized
gtccagccctgttgtttcagca

SEQ ID NO: 728927 - DNA, 22 bp, Artificial Sequence
  chemically synthesized
ctaacaggggtccttgctgaaa

SEQ ID NO: 728928 - DNA, 22 bp, Artificial Sequence
  chemically synthesized
tcattgctaacaggggtccttg

SEQ ID NO: 728929 - DNA, 22 bp, Artificial Sequence
  chemically synthesized
ttgtttcagcaaggacccctgt

SEQ ID NO: 728930 - DNA, 22 bp, Artificial Sequence
  chemically synthesized
tttcagcaaggacccctgttag

SEQ ID NO: 728931 - DNA, 22 bp, Artificial Sequence
  chemically synthesized
cagcaaggacccctgttagcaa

SEQ ID NO: 728932 - DNA, 22 bp, Artificial Sequence
  chemically synthesized
agcaaggacccctgttagcaat

SEQ ID NO: 728933 - DNA, 22 bp, Artificial Sequence
  chemically synthesized
taaatgcctgtcattgctaaca

SEQ ID NO: 728934 - DNA, 22 bp, Artificial Sequence
  chemically synthesized
ataaatgcctgtcattgctaac

SEQ ID NO: 728935 - DNA, 22 bp, Artificial Sequence
  chemically synthesized
ttataaatgcctgtcattgcta

SEQ ID NO: 728936 - DNA, 22 bp, Artificial Sequence
  chemically synthesized
cttataaatgcctgtcattgct

SEQ ID NO: 728937 - DNA, 22 bp, Artificial Sequence
  chemically synthesized
acttcttataaatgcctgtcat

SEQ ID NO: 728938 - DNA, 22 bp, Artificial Sequence
  chemically synthesized
ttagcaatgacaggcatttata

SEQ ID NO: 728939 - DNA, 22 bp, Artificial Sequence
  chemically synthesized
gcaatgacaggcatttataaga

SEQ ID NO: 728940 - DNA, 22 bp, Artificial Sequence
  chemically synthesized
atgagtgtggcctcacttctta

SEQ ID NO: 728941 - DNA, 22 bp, Artificial Sequence
  chemically synthesized
cacctgatgagtgtggcctcac

SEQ ID NO: 728942 - DNA, 22 bp, Artificial Sequence
  chemically synthesized
tgcacctgatgagtgtggcctc

SEQ ID NO: 728943 - DNA, 22 bp, Artificial Sequence
  chemically synthesized
ataagaagtgaggccacactca

SEQ ID NO: 728944 - DNA, 22 bp, Artificial Sequence
  chemically synthesized
taagaagtgaggccacactcat

SEQ ID NO: 728945 - DNA, 22 bp, Artificial Sequence
  chemically synthesized
tgctctgcacctgatgagtgtg

SEQ ID NO: 728946 - DNA, 22 bp, Artificial Sequence
  chemically synthesized
ctgtgctctgcacctgatgagt

SEQ ID NO: 728947 - DNA, 22 bp, Artificial Sequence
  chemically synthesized
gctgtgctctgcacctgatgag

SEQ ID NO: 728948 - DNA, 22 bp, Artificial Sequence
  chemically synthesized
tgctgtgctctgcacctgatga

SEQ ID NO: 728949 - DNA, 22 bp, Artificial Sequence
  chemically synthesized
atcaggtgcagagcacagcaaa

SEQ ID NO: 728950 - DNA, 22 bp, Artificial Sequence
  chemically synthesized
gtgagccatgcagctttgctgt

SEQ ID NO: 728951 - DNA, 22 bp, Artificial Sequence
  chemically synthesized
tagtgagccatgcagctttgct

SEQ ID NO: 728952 - DNA, 22 bp, Artificial Sequence
  chemically synthesized
agtactctagtgagccatgcag

SEQ ID NO: 728953 - DNA, 22 bp, Artificial Sequence
  chemically synthesized
catggctcactagagtactgaa

SEQ ID NO: 728954 - DNA, 22 bp, Artificial Sequence
  chemically synthesized
actagagtactgaatctggcat

SEQ ID NO: 728955 - DNA, 22 bp, Artificial Sequence
  chemically synthesized
gagtactgaatctggcatcacg

SEQ ID NO: 728956 - DNA, 22 bp, Artificial Sequence
  chemically synthesized
agtggataacatgagcgtgatg

SEQ ID NO: 728957 - DNA, 22 bp, Artificial Sequence
  chemically synthesized
ctaagtggataacatgagcgtg

SEQ ID NO: 728958 - DNA, 22 bp, Artificial Sequence
  chemically synthesized
aatctggcatcacgctcatgtt

SEQ ID NO: 728959 - DNA, 22 bp, Artificial Sequence
  chemically synthesized
gttactaagtggataacatgag

SEQ ID NO: 728960 - DNA, 22 bp, Artificial Sequence
  chemically synthesized
gcatcacgctcatgttatccac

SEQ ID NO: 728961 - DNA, 22 bp, Artificial Sequence
  chemically synthesized
ccccattggttactaagtggat

SEQ ID NO: 728962 - DNA, 22 bp, Artificial Sequence
  chemically synthesized
aaactgccccattggttactaa

SEQ ID NO: 728963 - DNA, 22 bp, Artificial Sequence
  chemically synthesized
atgttatccacttagtaaccaa

SEQ ID NO: 728964 - DNA, 22 bp, Artificial Sequence
  chemically synthesized
aaaactgccccattggttacta

SEQ ID NO: 728965 - DNA, 22 bp, Artificial Sequence
  chemically synthesized
taaaactgccccattggttact

SEQ ID NO: 728966 - DNA, 22 bp, Artificial Sequence
  chemically synthesized
ttaaaactgccccattggttac

SEQ ID NO: 728967 - DNA, 22 bp, Artificial Sequence
  chemically synthesized
tccacttagtaaccaatggggc

SEQ ID NO: 728968 - DNA, 22 bp, Artificial Sequence
  chemically synthesized
tggtttttaaaactgccccatt

SEQ ID NO: 728969 - DNA, 22 bp, Artificial Sequence
  chemically synthesized
gtggtttttaaaactgccccat

SEQ ID NO: 728970 - DNA, 22 bp, Artificial Sequence
  chemically synthesized
agtaaccaatggggcagtttta

SEQ ID NO: 728971 - DNA, 22 bp, Artificial Sequence
  chemically synthesized
gtaaccaatggggcagttttaa

SEQ ID NO: 728972 - DNA, 22 bp, Artificial Sequence
  chemically synthesized
caaacatttgtggtttttaaaa

SEQ ID NO: 728973 - DNA, 22 bp, Artificial Sequence
  chemically synthesized
taaaaaccacaaatgtttgtag

SEQ ID NO: 728974 - DNA, 22 bp, Artificial Sequence
  chemically synthesized
aaaaaccacaaatgtttgtagg

SEQ ID NO: 728975 - DNA, 22 bp, Artificial Sequence
  chemically synthesized
aaaaccacaaatgtttgtaggg

SEQ ID NO: 728976 - DNA, 22 bp, Artificial Sequence
  chemically synthesized
atagagaaaacagatccctaca

SEQ ID NO: 728977 - DNA, 22 bp, Artificial Sequence
  chemically synthesized
aatagagaaaacagatccctac

SEQ ID NO: 728978 - DNA, 22 bp, Artificial Sequence
  chemically synthesized
gtagggatctgttttctctatt

SEQ ID NO: 728979 - DNA, 22 bp, Artificial Sequence
  chemically synthesized
tagggatctgttttctctatta

SEQ ID NO: 728980 - DNA, 22 bp, Artificial Sequence
  chemically synthesized
gcaggagaaagaggcttaatag

SEQ ID NO: 728981 - DNA, 22 bp, Artificial Sequence
  chemically synthesized
cgcaggagaaagaggcttaata

SEQ ID NO: 728982 - DNA, 22 bp, Artificial Sequence
  chemically synthesized
ttttctctattaagcctctttc

SEQ ID NO: 728983 - DNA, 22 bp, Artificial Sequence
  chemically synthesized
tctctattaagcctctttctcc

SEQ ID NO: 728984 - DNA, 22 bp, Artificial Sequence
  chemically synthesized
ctctattaagcctctttctcct

SEQ ID NO: 728985 - DNA, 22 bp, Artificial Sequence
  chemically synthesized
tctattaagcctctttctcctg

SEQ ID NO: 728986 - DNA, 22 bp, Artificial Sequence
  chemically synthesized
tattaagcctctttctcctgcg

SEQ ID NO: 728987 - DNA, 22 bp, Artificial Sequence
  chemically synthesized
aggagatatgtttcgcaggaga

SEQ ID NO: 728988 - DNA, 22 bp, Artificial Sequence
  chemically synthesized
ttaagcctctttctcctgcgaa

SEQ ID NO: 728989 - DNA, 22 bp, Artificial Sequence
  chemically synthesized
caggagatatgtttcgcaggag

SEQ ID NO: 728990 - DNA, 22 bp, Artificial Sequence
  chemically synthesized
agcctctttctcctgcgaaaca

SEQ ID NO: 728991 - DNA, 22 bp, Artificial Sequence
  chemically synthesized
catgcttcaggagatatgtttc

SEQ ID NO: 728992 - DNA, 22 bp, Artificial Sequence
  chemically synthesized
tttctcctgcgaaacatatctc

SEQ ID NO: 728993 - DNA, 22 bp, Artificial Sequence
  chemically synthesized
tccatgcttcaggagatatgtt

SEQ ID NO: 728994 - DNA, 22 bp, Artificial Sequence
  chemically synthesized
ctccatgcttcaggagatatgt

SEQ ID NO: 728995 - DNA, 22 bp, Artificial Sequence
  chemically synthesized
tctcctgcgaaacatatctcct

SEQ ID NO: 728996 - DNA, 22 bp, Artificial Sequence
  chemically synthesized
ctcctgcgaaacatatctcctg

SEQ ID NO: 728997 - DNA, 22 bp, Artificial Sequence
  chemically synthesized
tcctgcgaaacatatctcctga

SEQ ID NO: 728998 - DNA, 22 bp, Artificial Sequence
  chemically synthesized
tttctccatgcttcaggagata

SEQ ID NO: 728999 - DNA, 22 bp, Artificial Sequence
  chemically synthesized
ctgcgaaacatatctcctgaag

SEQ ID NO: 729000 - DNA, 22 bp, Artificial Sequence
  chemically synthesized
cgaaacatatctcctgaagcat

SEQ ID NO: 729001 - DNA, 22 bp, Artificial Sequence
  chemically synthesized
aagaaaaataagttatttctcc

SEQ ID NO: 729002 - DNA, 22 bp, Artificial Sequence
  chemically synthesized
aaagaaaaataagttatttctc

SEQ ID NO: 729003 - DNA, 22 bp, Artificial Sequence
  chemically synthesized
ctgaagcatggagaaataactt

SEQ ID NO: 729004 - DNA, 22 bp, Artificial Sequence
  chemically synthesized
aagcatggagaaataacttatt

SEQ ID NO: 729005 - DNA, 22 bp, Artificial Sequence
  chemically synthesized
aaaaaaaaaaaagtttaaagaa

SEQ ID NO: 729006 - DNA, 22 bp, Artificial Sequence
  chemically synthesized
aaattaaaaaaaaaaaaagttt

SEQ ID NO: 729007 - DNA, 22 bp, Artificial Sequence
  chemically synthesized
atttttctttaaactttttttt

SEQ ID NO: 729008 - DNA, 22 bp, Artificial Sequence
  chemically synthesized
tttttctttaaacttttttttt

SEQ ID NO: 729009 - DNA, 22 bp, Artificial Sequence
  chemically synthesized
tctcaaattaaaaaaaaaaaaa

SEQ ID NO: 729010 - DNA, 22 bp, Artificial Sequence
  chemically synthesized
ttctttaaactttttttttttt

SEQ ID NO: 729011 - DNA, 22 bp, Artificial Sequence
  chemically synthesized
tgtctcaaattaaaaaaaaaaa

SEQ ID NO: 729012 - DNA, 22 bp, Artificial Sequence
  chemically synthesized
tctttaaacttttttttttttt

SEQ ID NO: 729013 - DNA, 22 bp, Artificial Sequence
  chemically synthesized
ctttaaacttttttttttttta

SEQ ID NO: 729014 - DNA, 22 bp, Artificial Sequence
  chemically synthesized
tttaaactttttttttttttaa

SEQ ID NO: 729015 - DNA, 22 bp, Artificial Sequence
  chemically synthesized
taaactttttttttttttaatt

SEQ ID NO: 729016 - DNA, 22 bp, Artificial Sequence
  chemically synthesized
aaactttttttttttttaattt

SEQ ID NO: 729017 - DNA, 22 bp, Artificial Sequence
  chemically synthesized
aactttttttttttttaatttg

SEQ ID NO: 729018 - DNA, 22 bp, Artificial Sequence
  chemically synthesized
tttttttttttaatttgagaca

SEQ ID NO: 729019 - DNA, 22 bp, Artificial Sequence
  chemically synthesized
ttttttttttaatttgagacag

SEQ ID NO: 729020 - DNA, 22 bp, Artificial Sequence
  chemically synthesized
tttttttttaatttgagacaga

SEQ ID NO: 729021 - DNA, 22 bp, Artificial Sequence
  chemically synthesized
ttttttttaatttgagacagag

SEQ ID NO: 729022 - DNA, 22 bp, Artificial Sequence
  chemically synthesized
tttttttaatttgagacagagt

SEQ ID NO: 729023 - DNA, 22 bp, Artificial Sequence
  chemically synthesized
ttttttaatttgagacagagtc

SEQ ID NO: 729024 - DNA, 22 bp, Artificial Sequence
  chemically synthesized
tttttaatttgagacagagtct

SEQ ID NO: 729025 - DNA, 22 bp, Artificial Sequence
  chemically synthesized
ttttaatttgagacagagtctt

SEQ ID NO: 729026 - DNA, 22 bp, Artificial Sequence
  chemically synthesized
tttaatttgagacagagtcttg

SEQ ID NO: 729027 - DNA, 22 bp, Artificial Sequence
  chemically synthesized
ttaatttgagacagagtcttgc

SEQ ID NO: 729028 - DNA, 22 bp, Artificial Sequence
  chemically synthesized
taatttgagacagagtcttgct

SEQ ID NO: 729029 - DNA, 22 bp, Artificial Sequence
  chemically synthesized
aatttgagacagagtcttgctt

SEQ ID NO: 729030 - DNA, 22 bp, Artificial Sequence
  chemically synthesized
atgtgggcaacaaagcaagact

SEQ ID NO: 729031 - DNA, 22 bp, Artificial Sequence
  chemically synthesized
atttgagacagagtcttgcttt

SEQ ID NO: 729032 - DNA, 22 bp, Artificial Sequence
  chemically synthesized
taatgtgggcaacaaagcaaga

SEQ ID NO: 729033 - DNA, 22 bp, Artificial Sequence
  chemically synthesized
gagacagagtcttgctttgttg

SEQ ID NO: 729034 - DNA, 22 bp, Artificial Sequence
  chemically synthesized
agacagagtcttgctttgttgc

SEQ ID NO: 729035 - DNA, 22 bp, Artificial Sequence
  chemically synthesized
cactctaatgtgggcaacaaag

SEQ ID NO: 729036 - DNA, 22 bp, Artificial Sequence
  chemically synthesized
caccactgcactctaatgtggg

SEQ ID NO: 729037 - DNA, 22 bp, Artificial Sequence
  chemically synthesized
gctttgttgcccacattagagt

SEQ ID NO: 729038 - DNA, 22 bp, Artificial Sequence
  chemically synthesized
ctttgttgcccacattagagtg

SEQ ID NO: 729039 - DNA, 22 bp, Artificial Sequence
  chemically synthesized
agattgcaccactgcactctaa

SEQ ID NO: 729040 - DNA, 22 bp, Artificial Sequence
  chemically synthesized
tgttgcccacattagagtgcag

SEQ ID NO: 729041 - DNA, 22 bp, Artificial Sequence
  chemically synthesized
gttgcccacattagagtgcagt

SEQ ID NO: 729042 - DNA, 22 bp, Artificial Sequence
  chemically synthesized
ttgcccacattagagtgcagtg

SEQ ID NO: 729043 - DNA, 22 bp, Artificial Sequence
  chemically synthesized
cccacattagagtgcagtggtg

SEQ ID NO: 729044 - DNA, 22 bp, Artificial Sequence
  chemically synthesized
cagtgagctgagattgcaccac

SEQ ID NO: 729045 - DNA, 22 bp, Artificial Sequence
  chemically synthesized
gagtgcagtggtgcaatctcag

SEQ ID NO: 729046 - DNA, 22 bp, Artificial Sequence
  chemically synthesized
ggaggcagaggttgcagtgagc

SEQ ID NO: 729047 - DNA, 22 bp, Artificial Sequence
  chemically synthesized
aacctgggaggcagaggttgca

SEQ ID NO: 729048 - DNA, 22 bp, Artificial Sequence
  chemically synthesized
aaacctgggaggcagaggttgc

SEQ ID NO: 729049 - DNA, 22 bp, Artificial Sequence
  chemically synthesized
agctcactgcaacctctgcctc

SEQ ID NO: 729050 - DNA, 22 bp, Artificial Sequence
  chemically synthesized
actgcaacctctgcctcccagg

SEQ ID NO: 729051 - DNA, 22 bp, Artificial Sequence
  chemically synthesized
caacctctgcctcccaggttta

SEQ ID NO: 729052 - DNA, 22 bp, Artificial Sequence
  chemically synthesized
aggcatgagaatcacttaaacc

SEQ ID NO: 729053 - DNA, 22 bp, Artificial Sequence
  chemically synthesized
tgcctcccaggtttaagtgatt

SEQ ID NO: 729054 - DNA, 22 bp, Artificial Sequence
  chemically synthesized
cctcccaggtttaagtgattct

SEQ ID NO: 729055 - DNA, 22 bp, Artificial Sequence
  chemically synthesized
cactgaggcatgagaatcactt

SEQ ID NO: 729056 - DNA, 22 bp, Artificial Sequence
  chemically synthesized
ccaggtttaagtgattctcatg

SEQ ID NO: 729057 - DNA, 22 bp, Artificial Sequence
  chemically synthesized
aagtgattctcatgcctcagtg

SEQ ID NO: 729058 - DNA, 22 bp, Artificial Sequence
  chemically synthesized
taatcccagctacactgaggca

SEQ ID NO: 729059 - DNA, 22 bp, Artificial Sequence
  chemically synthesized
agtgattctcatgcctcagtgt

SEQ ID NO: 729060 - DNA, 22 bp, Artificial Sequence
  chemically synthesized
tcatgcctcagtgtagctggga

SEQ ID NO: 729061 - DNA, 22 bp, Artificial Sequence
  chemically synthesized
atgcctcagtgtagctgggatt

SEQ ID NO: 729062 - DNA, 22 bp, Artificial Sequence
  chemically synthesized
agtgtagctgggattacaggta

SEQ ID NO: 729063 - DNA, 22 bp, Artificial Sequence
  chemically synthesized
gatatgatggtgcgtacctgta

SEQ ID NO: 729064 - DNA, 22 bp, Artificial Sequence
  chemically synthesized
gctggatatgatggtgcgtacc

SEQ ID NO: 729065 - DNA, 22 bp, Artificial Sequence
  chemically synthesized
ggattacaggtacgcaccatca

SEQ ID NO: 729066 - DNA, 22 bp, Artificial Sequence
  chemically synthesized
caggtacgcaccatcatatcca

SEQ ID NO: 729067 - DNA, 22 bp, Artificial Sequence
  chemically synthesized
aaaatacaaaaattagctggat

SEQ ID NO: 729068 - DNA, 22 bp, Artificial Sequence
  chemically synthesized
cactaaaaatacaaaaattagc

SEQ ID NO: 729069 - DNA, 22 bp, Artificial Sequence
  chemically synthesized
ccactaaaaatacaaaaattag

SEQ ID NO: 729070 - DNA, 22 bp, Artificial Sequence
  chemically synthesized
gtttccactaaaaatacaaaaa

SEQ ID NO: 729071 - DNA, 22 bp, Artificial Sequence
  chemically synthesized
atttttgtatttttagtggaaa

SEQ ID NO: 729072 - DNA, 22 bp, Artificial Sequence
  chemically synthesized
ttgtatttttagtggaaacgag

SEQ ID NO: 729073 - DNA, 22 bp, Artificial Sequence
  chemically synthesized
tgtatttttagtggaaacgagg

SEQ ID NO: 729074 - DNA, 22 bp, Artificial Sequence
  chemically synthesized
gtatttttagtggaaacgaggt

SEQ ID NO: 729075 - DNA, 22 bp, Artificial Sequence
  chemically synthesized
tatttttagtggaaacgaggtt

SEQ ID NO: 729076 - DNA, 22 bp, Artificial Sequence
  chemically synthesized
gccaacacggtgaaacctcgtt

SEQ ID NO: 729077 - DNA, 22 bp, Artificial Sequence
  chemically synthesized
ttagtggaaacgaggtttcacc

SEQ ID NO: 729078 - DNA, 22 bp, Artificial Sequence
  chemically synthesized
tagtggaaacgaggtttcaccg

SEQ ID NO: 729079 - DNA, 22 bp, Artificial Sequence
  chemically synthesized
agtggaaacgaggtttcaccgt

SEQ ID NO: 729080 - DNA, 22 bp, Artificial Sequence
  chemically synthesized
gtggaaacgaggtttcaccgtg

SEQ ID NO: 729081 - DNA, 22 bp, Artificial Sequence
  chemically synthesized
gagaccagcctggccaacacgg

SEQ ID NO: 729082 - DNA, 22 bp, Artificial Sequence
  chemically synthesized
cgagaccagcctggccaacacg

SEQ ID NO: 729083 - DNA, 22 bp, Artificial Sequence
  chemically synthesized
caccgtgttggccaggctggtc

SEQ ID NO: 729084 - DNA, 22 bp, Artificial Sequence
  chemically synthesized
accgtgttggccaggctggtct

SEQ ID NO: 729085 - DNA, 22 bp, Artificial Sequence
  chemically synthesized
aagtcaggacttcgagaccagc

SEQ ID NO: 729086 - DNA, 22 bp, Artificial Sequence
  chemically synthesized
gaagtcaggacttcgagaccag

SEQ ID NO: 729087 - DNA, 22 bp, Artificial Sequence
  chemically synthesized
gccaggctggtctcgaagtcct

SEQ ID NO: 729088 - DNA, 22 bp, Artificial Sequence
  chemically synthesized
gtctcgaagtcctgacttcaag

SEQ ID NO: 729089 - DNA, 22 bp, Artificial Sequence
  chemically synthesized
gaagtcctgacttcaagtgatc

SEQ ID NO: 729090 - DNA, 22 bp, Artificial Sequence
  chemically synthesized
ggaggccgaggcaggcggatca

SEQ ID NO: 729091 - DNA, 22 bp, Artificial Sequence
  chemically synthesized
gggaggccgaggcaggcggatc

SEQ ID NO: 729092 - DNA, 22 bp, Artificial Sequence
  chemically synthesized
tgggaggccgaggcaggcggat

SEQ ID NO: 729093 - DNA, 22 bp, Artificial Sequence
  chemically synthesized
acttcaagtgatccgcctgcct

SEQ ID NO: 729094 - DNA, 22 bp, Artificial Sequence
  chemically synthesized
caagtgatccgcctgcctcggc

SEQ ID NO: 729095 - DNA, 22 bp, Artificial Sequence
  chemically synthesized
aagtgatccgcctgcctcggcc

SEQ ID NO: 729096 - DNA, 22 bp, Artificial Sequence
  chemically synthesized
taatcccagcactttgggaggc

SEQ ID NO: 729097 - DNA, 22 bp, Artificial Sequence
  chemically synthesized
cctcggcctcccaaagtgctgg

SEQ ID NO: 729098 - DNA, 22 bp, Artificial Sequence
  chemically synthesized
acgcctgtaatcccagcacttt

SEQ ID NO: 729099 - DNA, 22 bp, Artificial Sequence
  chemically synthesized
ggcctcccaaagtgctgggatt

SEQ ID NO: 729100 - DNA, 22 bp, Artificial Sequence
  chemically synthesized
ccaaagtgctgggattacaggc

SEQ ID NO: 729101 - DNA, 22 bp, Artificial Sequence
  chemically synthesized
ggattacaggcgtgagccactg

SEQ ID NO: 729102 - DNA, 22 bp, Artificial Sequence
  chemically synthesized
aaagaggccgggtgcagtggct

SEQ ID NO: 729103 - DNA, 22 bp, Artificial Sequence
  chemically synthesized
caggcgtgagccactgcacccg

SEQ ID NO: 729104 - DNA, 22 bp, Artificial Sequence
  chemically synthesized
cacccggcctctttgaactttt

SEQ ID NO: 729105 - DNA, 22 bp, Artificial Sequence
  chemically synthesized
tttgaacttttttttgttttgt

SEQ ID NO: 729106 - DNA, 22 bp, Artificial Sequence
  chemically synthesized
tgaacttttttttgttttgttt

SEQ ID NO: 729107 - DNA, 22 bp, Artificial Sequence
  chemically synthesized
gaacttttttttgttttgtttt

SEQ ID NO: 729108 - DNA, 22 bp, Artificial Sequence
  chemically synthesized
aacttttttttgttttgttttg

SEQ ID NO: 729109 - DNA, 22 bp, Artificial Sequence
  chemically synthesized
ttttttgttttgttttgttttg

SEQ ID NO: 729110 - DNA, 22 bp, Artificial Sequence
  chemically synthesized
tttttgttttgttttgttttgt

SEQ ID NO: 729111 - DNA, 22 bp, Artificial Sequence
  chemically synthesized
ttttgttttgttttgttttgtt

SEQ ID NO: 729112 - DNA, 22 bp, Artificial Sequence
  chemically synthesized
tttgttttgttttgttttgttt

SEQ ID NO: 729113 - DNA, 22 bp, Artificial Sequence
  chemically synthesized
ttgttttgttttgttttgtttt

SEQ ID NO: 729114 - DNA, 22 bp, Artificial Sequence
  chemically synthesized
tgttttgttttgttttgttttg

SEQ ID NO: 729115 - DNA, 22 bp, Artificial Sequence
  chemically synthesized
gttttgttttgttttgttttgt

SEQ ID NO: 729116 - DNA, 22 bp, Artificial Sequence
  chemically synthesized
ttttgttttgttttgttttgtt

SEQ ID NO: 729117 - DNA, 22 bp, Artificial Sequence
  chemically synthesized
tgttttgttttgttttgttttt

SEQ ID NO: 729118 - DNA, 22 bp, Artificial Sequence
  chemically synthesized
gttttgttttgttttgttttta

SEQ ID NO: 729119 - DNA, 22 bp, Artificial Sequence
  chemically synthesized
ttttgttttgttttgtttttac

SEQ ID NO: 729120 - DNA, 22 bp, Artificial Sequence
  chemically synthesized
tgttttgttttgtttttactgg

SEQ ID NO: 729121 - DNA, 22 bp, Artificial Sequence
  chemically synthesized
gttttgttttgtttttactggt

SEQ ID NO: 729122 - DNA, 22 bp, Artificial Sequence
  chemically synthesized
ttttgttttgtttttactggtt

SEQ ID NO: 729123 - DNA, 22 bp, Artificial Sequence
  chemically synthesized
tgttttgtttttactggtttat

SEQ ID NO: 729124 - DNA, 22 bp, Artificial Sequence
  chemically synthesized
gttttgtttttactggtttatc

SEQ ID NO: 729125 - DNA, 22 bp, Artificial Sequence
  chemically synthesized
ttttgtttttactggtttatct

SEQ ID NO: 729126 - DNA, 22 bp, Artificial Sequence
  chemically synthesized
tgtttttactggtttatcttac

SEQ ID NO: 729127 - DNA, 22 bp, Artificial Sequence
  chemically synthesized
gtttttactggtttatcttact

SEQ ID NO: 729128 - DNA, 22 bp, Artificial Sequence
  chemically synthesized
tataataaaagtagtaagataa

SEQ ID NO: 729129 - DNA, 22 bp, Artificial Sequence
  chemically synthesized
tttttactggtttatcttacta

SEQ ID NO: 729130 - DNA, 22 bp, Artificial Sequence
  chemically synthesized
ttactggtttatcttactactt

SEQ ID NO: 729131 - DNA, 22 bp, Artificial Sequence
  chemically synthesized
tactggtttatcttactacttt

SEQ ID NO: 729132 - DNA, 22 bp, Artificial Sequence
  chemically synthesized
actggtttatcttactactttt

SEQ ID NO: 729133 - DNA, 22 bp, Artificial Sequence
  chemically synthesized
ctggtttatcttactactttta

SEQ ID NO: 729134 - DNA, 22 bp, Artificial Sequence
  chemically synthesized
gtttatcttactacttttatta

SEQ ID NO: 729135 - DNA, 22 bp, Artificial Sequence
  chemically synthesized
taaaagcattgtataataaaag

SEQ ID NO: 729136 - DNA, 22 bp, Artificial Sequence
  chemically synthesized
gtaaaagcattgtataataaaa

SEQ ID NO: 729137 - DNA, 22 bp, Artificial Sequence
  chemically synthesized
tgtaaaagcattgtataataaa

SEQ ID NO: 729138 - DNA, 22 bp, Artificial Sequence
  chemically synthesized
atcttactacttttattataca

SEQ ID NO: 729139 - DNA, 22 bp, Artificial Sequence
  chemically synthesized
ttgtaaaagcattgtataataa

SEQ ID NO: 729140 - DNA, 22 bp, Artificial Sequence
  chemically synthesized
tcttactacttttattatacaa

SEQ ID NO: 729141 - DNA, 22 bp, Artificial Sequence
  chemically synthesized
tttgtaaaagcattgtataata

SEQ ID NO: 729142 - DNA, 22 bp, Artificial Sequence
  chemically synthesized
actacttttattatacaatgct

SEQ ID NO: 729143 - DNA, 22 bp, Artificial Sequence
  chemically synthesized
ctacttttattatacaatgctt

SEQ ID NO: 729144 - DNA, 22 bp, Artificial Sequence
  chemically synthesized
cttttattatacaatgctttta

SEQ ID NO: 729145 - DNA, 22 bp, Artificial Sequence
  chemically synthesized
ttattatacaatgcttttacaa

SEQ ID NO: 729146 - DNA, 22 bp, Artificial Sequence
  chemically synthesized
tattatacaatgcttttacaaa

SEQ ID NO: 729147 - DNA, 22 bp, Artificial Sequence
  chemically synthesized
attatacaatgcttttacaaaa

SEQ ID NO: 729148 - DNA, 22 bp, Artificial Sequence
  chemically synthesized
ttatacaatgcttttacaaaaa

SEQ ID NO: 729149 - DNA, 22 bp, Artificial Sequence
  chemically synthesized
tacaatgcttttacaaaaaatt

SEQ ID NO: 729150 - DNA, 22 bp, Artificial Sequence
  chemically synthesized
agtataataataataaaatttt

SEQ ID NO: 729151 - DNA, 22 bp, Artificial Sequence
  chemically synthesized
aagtataataataataaaattt

SEQ ID NO: 729152 - DNA, 22 bp, Artificial Sequence
  chemically synthesized
taagtataataataataaaatt

SEQ ID NO: 729153 - DNA, 22 bp, Artificial Sequence
  chemically synthesized
ttacaaaaaattttattattat

SEQ ID NO: 729154 - DNA, 22 bp, Artificial Sequence
  chemically synthesized
tacaaaaaattttattattatt

SEQ ID NO: 729155 - DNA, 22 bp, Artificial Sequence
  chemically synthesized
acaaaaaattttattattatta

SEQ ID NO: 729156 - DNA, 22 bp, Artificial Sequence
  chemically synthesized
aaactttaagtataataataat

SEQ ID NO: 729157 - DNA, 22 bp, Artificial Sequence
  chemically synthesized
caaaaaattttattattattat

SEQ ID NO: 729158 - DNA, 22 bp, Artificial Sequence
  chemically synthesized
tattattattatacttaaagtt

SEQ ID NO: 729159 - DNA, 22 bp, Artificial Sequence
  chemically synthesized
attattattatacttaaagttt

SEQ ID NO: 729160 - DNA, 22 bp, Artificial Sequence
  chemically synthesized
ttattattatacttaaagtttt

SEQ ID NO: 729161 - DNA, 22 bp, Artificial Sequence
  chemically synthesized
tgcacatgtaccctaaaacttt

SEQ ID NO: 729162 - DNA, 22 bp, Artificial Sequence
  chemically synthesized
ttattatacttaaagttttagg

SEQ ID NO: 729163 - DNA, 22 bp, Artificial Sequence
  chemically synthesized
ttatacttaaagttttagggta

SEQ ID NO: 729164 - DNA, 22 bp, Artificial Sequence
  chemically synthesized
tacttaaagttttagggtacat

SEQ ID NO: 729165 - DNA, 22 bp, Artificial Sequence
  chemically synthesized
cacgttgtgcacatgtacccta

SEQ ID NO: 729166 - DNA, 22 bp, Artificial Sequence
  chemically synthesized
aaagttttagggtacatgtgca

SEQ ID NO: 729167 - DNA, 22 bp, Artificial Sequence
  chemically synthesized
aagttttagggtacatgtgcac

SEQ ID NO: 729168 - DNA, 22 bp, Artificial Sequence
  chemically synthesized
tagggtacatgtgcacaacgtg

SEQ ID NO: 729169 - DNA, 22 bp, Artificial Sequence
  chemically synthesized
agggtacatgtgcacaacgtgc

SEQ ID NO: 729170 - DNA, 22 bp, Artificial Sequence
  chemically synthesized
gggtacatgtgcacaacgtgca

SEQ ID NO: 729171 - DNA, 22 bp, Artificial Sequence
  chemically synthesized
gttacatatgtatacatgtgcc

SEQ ID NO: 729172 - DNA, 22 bp, Artificial Sequence
  chemically synthesized
ttacatatgtatacatgtgcca

SEQ ID NO: 729173 - DNA, 22 bp, Artificial Sequence
  chemically synthesized
catatgtatacatgtgccatgc

SEQ ID NO: 729174 - DNA, 22 bp, Artificial Sequence
  chemically synthesized
atgggtgcagcacaccagcatg

SEQ ID NO: 729175 - DNA, 22 bp, Artificial Sequence
  chemically synthesized
aatgatgagttaatgggtgcag

SEQ ID NO: 729176 - DNA, 22 bp, Artificial Sequence
  chemically synthesized
gtgtgctgcacccattaactca

SEQ ID NO: 729177 - DNA, 22 bp, Artificial Sequence
  chemically synthesized
cacccattaactcatcatttag

SEQ ID NO: 729178 - DNA, 22 bp, Artificial Sequence
  chemically synthesized
ggagatatacgtaacgctaaat

SEQ ID NO: 729179 - DNA, 22 bp, Artificial Sequence
  chemically synthesized
actcatcatttagcgttacgta

SEQ ID NO: 729180 - DNA, 22 bp, Artificial Sequence
  chemically synthesized
atcatttagcgttacgtatatc

SEQ ID NO: 729181 - DNA, 22 bp, Artificial Sequence
  chemically synthesized
agcgttacgtatatctcctaat

SEQ ID NO: 729182 - DNA, 22 bp, Artificial Sequence
  chemically synthesized
gcgttacgtatatctcctaatg

SEQ ID NO: 729183 - DNA, 22 bp, Artificial Sequence
  chemically synthesized
cgtatatctcctaatgctatcc

SEQ ID NO: 729184 - DNA, 22 bp, Artificial Sequence
  chemically synthesized
ggggagtggggagggatagcat

SEQ ID NO: 729185 - DNA, 22 bp, Artificial Sequence
  chemically synthesized
gggttgggggagtggggaggga

SEQ ID NO: 729186 - DNA, 22 bp, Artificial Sequence
  chemically synthesized
ggggttgggggagtggggaggg

SEQ ID NO: 729187 - DNA, 22 bp, Artificial Sequence
  chemically synthesized
tggggttgggggagtggggagg

SEQ ID NO: 729188 - DNA, 22 bp, Artificial Sequence
  chemically synthesized
ctaatgctatccctccccactc

SEQ ID NO: 729189 - DNA, 22 bp, Artificial Sequence
  chemically synthesized
atgctatccctccccactcccc

SEQ ID NO: 729190 - DNA, 22 bp, Artificial Sequence
  chemically synthesized
tccctccccactcccccaaccc

SEQ ID NO: 729191 - DNA, 22 bp, Artificial Sequence
  chemically synthesized
cccactcccccaaccccaaaac

SEQ ID NO: 729192 - DNA, 22 bp, Artificial Sequence
  chemically synthesized
ccccaaccccaaaacattcccc

SEQ ID NO: 729193 - DNA, 22 bp, Artificial Sequence
  chemically synthesized
cccggtgtgtgatgttcccctt

SEQ ID NO: 729194 - DNA, 22 bp, Artificial Sequence
  chemically synthesized
aacaatgagaacacatggacaa

SEQ ID NO: 729195 - DNA, 22 bp, Artificial Sequence
  chemically synthesized
cccttcctttgtccatgtgttc

SEQ ID NO: 729196 - DNA, 22 bp, Artificial Sequence
  chemically synthesized
cctttgtccatgtgttctcatt

SEQ ID NO: 729197 - DNA, 22 bp, Artificial Sequence
  chemically synthesized
ctttgtccatgtgttctcattg

SEQ ID NO: 729198 - DNA, 22 bp, Artificial Sequence
  chemically synthesized
tgtccatgtgttctcattgttc

SEQ ID NO: 729199 - DNA, 22 bp, Artificial Sequence
  chemically synthesized
gtccatgtgttctcattgttca

SEQ ID NO: 729200 - DNA, 22 bp, Artificial Sequence
  chemically synthesized
ataggtgggaattgaacaatga

SEQ ID NO: 729201 - DNA, 22 bp, Artificial Sequence
  chemically synthesized
tccatgtgttctcattgttcaa

SEQ ID NO: 729202 - DNA, 22 bp, Artificial Sequence
  chemically synthesized
actcataggtgggaattgaaca

SEQ ID NO: 729203 - DNA, 22 bp, Artificial Sequence
  chemically synthesized
tcactcataggtgggaattgaa

SEQ ID NO: 729204 - DNA, 22 bp, Artificial Sequence
  chemically synthesized
tcattgttcaattcccacctat

SEQ ID NO: 729205 - DNA, 22 bp, Artificial Sequence
  chemically synthesized
attgttcaattcccacctatga

SEQ ID NO: 729206 - DNA, 22 bp, Artificial Sequence
  chemically synthesized
ttcaattcccacctatgagtga

SEQ ID NO: 729207 - DNA, 22 bp, Artificial Sequence
  chemically synthesized
aattcccacctatgagtgagaa

SEQ ID NO: 729208 - DNA, 22 bp, Artificial Sequence
  chemically synthesized
ccacctatgagtgagaacatgg

SEQ ID NO: 729209 - DNA, 22 bp, Artificial Sequence
  chemically synthesized
tgagtgagaacatggggtgttt

SEQ ID NO: 729210 - DNA, 22 bp, Artificial Sequence
  chemically synthesized
tcacaaggaccaaaaaccaaac

SEQ ID NO: 729211 - DNA, 22 bp, Artificial Sequence
  chemically synthesized
agcaaactatcacaaggaccaa

SEQ ID NO: 729212 - DNA, 22 bp, Artificial Sequence
  chemically synthesized
tcagcaaactatcacaaggacc

SEQ ID NO: 729213 - DNA, 22 bp, Artificial Sequence
  chemically synthesized
ggtttttggtccttgtgatagt

SEQ ID NO: 729214 - DNA, 22 bp, Artificial Sequence
  chemically synthesized
gtttttggtccttgtgatagtt

SEQ ID NO: 729215 - DNA, 22 bp, Artificial Sequence
  chemically synthesized
ttggtccttgtgatagtttgct

SEQ ID NO: 729216 - DNA, 22 bp, Artificial Sequence
  chemically synthesized
tggtccttgtgatagtttgctg

SEQ ID NO: 729217 - DNA, 22 bp, Artificial Sequence
  chemically synthesized
ggtccttgtgatagtttgctga

SEQ ID NO: 729218 - DNA, 22 bp, Artificial Sequence
  chemically synthesized
gtccttgtgatagtttgctgag

SEQ ID NO: 729219 - DNA, 22 bp, Artificial Sequence
  chemically synthesized
gaaaccatcattctcagcaaac

SEQ ID NO: 729220 - DNA, 22 bp, Artificial Sequence
  chemically synthesized
gtgatagtttgctgagaatgat

SEQ ID NO: 729221 - DNA, 22 bp, Artificial Sequence
  chemically synthesized
tgatagtttgctgagaatgatg

SEQ ID NO: 729222 - DNA, 22 bp, Artificial Sequence
  chemically synthesized
gctgagaatgatggtttccagc

SEQ ID NO: 729223 - DNA, 22 bp, Artificial Sequence
  chemically synthesized
ctgagaatgatggtttccagct

SEQ ID NO: 729224 - DNA, 22 bp, Artificial Sequence
  chemically synthesized
agaatgatggtttccagcttca

SEQ ID NO: 729225 - DNA, 22 bp, Artificial Sequence
  chemically synthesized
tagggacatggatgaagctgga

SEQ ID NO: 729226 - DNA, 22 bp, Artificial Sequence
  chemically synthesized
gtagggacatggatgaagctgg

SEQ ID NO: 729227 - DNA, 22 bp, Artificial Sequence
  chemically synthesized
tgtagggacatggatgaagctg

SEQ ID NO: 729228 - DNA, 22 bp, Artificial Sequence
  chemically synthesized
atgtcctttgtagggacatgga

SEQ ID NO: 729229 - DNA, 22 bp, Artificial Sequence
  chemically synthesized
ccagcttcatccatgtccctac

SEQ ID NO: 729230 - DNA, 22 bp, Artificial Sequence
  chemically synthesized
cagcttcatccatgtccctaca

SEQ ID NO: 729231 - DNA, 22 bp, Artificial Sequence
  chemically synthesized
catccatgtccctacaaaggac

SEQ ID NO: 729232 - DNA, 22 bp, Artificial Sequence
  chemically synthesized
atccatgtccctacaaaggaca

SEQ ID NO: 729233 - DNA, 22 bp, Artificial Sequence
  chemically synthesized
caaaggacatgaattcatcatt

SEQ ID NO: 729234 - DNA, 22 bp, Artificial Sequence
  chemically synthesized
tgcagccataaaaaatgatgaa

SEQ ID NO: 729235 - DNA, 22 bp, Artificial Sequence
  chemically synthesized
atcattttttatggctgcatag

SEQ ID NO: 729236 - DNA, 22 bp, Artificial Sequence
  chemically synthesized
tttatggctgcatagtattctc

SEQ ID NO: 729237 - DNA, 22 bp, Artificial Sequence
  chemically synthesized
ttatggctgcatagtattctct

SEQ ID NO: 729238 - DNA, 22 bp, Artificial Sequence
  chemically synthesized
tatggctgcatagtattctctg

SEQ ID NO: 729239 - DNA, 22 bp, Artificial Sequence
  chemically synthesized
atggctgcatagtattctctgg

SEQ ID NO: 729240 - DNA, 22 bp, Artificial Sequence
  chemically synthesized
tggctgcatagtattctctggt

SEQ ID NO: 729241 - DNA, 22 bp, Artificial Sequence
  chemically synthesized
aaagagcacatatacaccagag

SEQ ID NO: 729242 - DNA, 22 bp, Artificial Sequence
  chemically synthesized
catagtattctctggtgtatat

SEQ ID NO: 729243 - DNA, 22 bp, Artificial Sequence
  chemically synthesized
tctggtgtatatgtgctctttg

SEQ ID NO: 729244 - DNA, 22 bp, Artificial Sequence
  chemically synthesized
tggtgtatatgtgctctttgaa

SEQ ID NO: 729245 - DNA, 22 bp, Artificial Sequence
  chemically synthesized
gtgtatatgtgctctttgaaca

SEQ ID NO: 729246 - DNA, 22 bp, Artificial Sequence
  chemically synthesized
agataccaagatcaaatgttca

SEQ ID NO: 729247 - DNA, 22 bp, Artificial Sequence
  chemically synthesized
tttgaacatttgatcttggtat

SEQ ID NO: 729248 - DNA, 22 bp, Artificial Sequence
  chemically synthesized
tgaacatttgatcttggtatct

SEQ ID NO: 729249 - DNA, 22 bp, Artificial Sequence
  chemically synthesized
gaacatttgatcttggtatctt

SEQ ID NO: 729250 - DNA, 22 bp, Artificial Sequence
  chemically synthesized
aacatttgatcttggtatctta

SEQ ID NO: 729251 - DNA, 22 bp, Artificial Sequence
  chemically synthesized
gatgggaaaggataacattaag

SEQ ID NO: 729252 - DNA, 22 bp, Artificial Sequence
  chemically synthesized
gatcttggtatcttaatgttat

SEQ ID NO: 729253 - DNA, 22 bp, Artificial Sequence
  chemically synthesized
ggatgggaaaggataacattaa

SEQ ID NO: 729254 - DNA, 22 bp, Artificial Sequence
  chemically synthesized
atcttggtatcttaatgttatc

SEQ ID NO: 729255 - DNA, 22 bp, Artificial Sequence
  chemically synthesized
cttggatgggaaaggataacat

SEQ ID NO: 729256 - DNA, 22 bp, Artificial Sequence
  chemically synthesized
ccttggatgggaaaggataaca

SEQ ID NO: 729257 - DNA, 22 bp, Artificial Sequence
  chemically synthesized
tccttggatgggaaaggataac

SEQ ID NO: 729258 - DNA, 22 bp, Artificial Sequence
  chemically synthesized
ggtatcttaatgttatcctttc

SEQ ID NO: 729259 - DNA, 22 bp, Artificial Sequence
  chemically synthesized
gtatcttaatgttatcctttcc

SEQ ID NO: 729260 - DNA, 22 bp, Artificial Sequence
  chemically synthesized
gatacctttccttggatgggaa

SEQ ID NO: 729261 - DNA, 22 bp, Artificial Sequence
  chemically synthesized
aatgttatcctttcccatccaa

SEQ ID NO: 729262 - DNA, 22 bp, Artificial Sequence
  chemically synthesized
atgttatcctttcccatccaag

SEQ ID NO: 729263 - DNA, 22 bp, Artificial Sequence
  chemically synthesized
tcctttcccatccaaggaaagg

SEQ ID NO: 729264 - DNA, 22 bp, Artificial Sequence
  chemically synthesized
tcccatccaaggaaaggtatct

SEQ ID NO: 729265 - DNA, 22 bp, Artificial Sequence
  chemically synthesized
cccatccaaggaaaggtatcta

SEQ ID NO: 729266 - DNA, 22 bp, Artificial Sequence
  chemically synthesized
ccatccaaggaaaggtatctag

SEQ ID NO: 729267 - DNA, 22 bp, Artificial Sequence
  chemically synthesized
gagggagtaaacgcaaagaaaa

SEQ ID NO: 729268 - DNA, 22 bp, Artificial Sequence
  chemically synthesized
gcccattttctttgcgtttact

SEQ ID NO: 729269 - DNA, 22 bp, Artificial Sequence
  chemically synthesized
gaacatctggagggagtaaacg

SEQ ID NO: 729270 - DNA, 22 bp, Artificial Sequence
  chemically synthesized
tctttgcgtttactccctccag

SEQ ID NO: 729271 - DNA, 22 bp, Artificial Sequence
  chemically synthesized
ctttgcgtttactccctccaga

SEQ ID NO: 729272 - DNA, 22 bp, Artificial Sequence
  chemically synthesized
tttgcgtttactccctccagat

SEQ ID NO: 729273 - DNA, 22 bp, Artificial Sequence
  chemically synthesized
tgcgtttactccctccagatgt

SEQ ID NO: 729274 - DNA, 22 bp, Artificial Sequence
  chemically synthesized
gcgtttactccctccagatgtt

SEQ ID NO: 729275 - DNA, 22 bp, Artificial Sequence
  chemically synthesized
cgtttactccctccagatgttc

SEQ ID NO: 729276 - DNA, 22 bp, Artificial Sequence
  chemically synthesized
gagcagacattagaacatctgg

SEQ ID NO: 729277 - DNA, 22 bp, Artificial Sequence
  chemically synthesized
ggagcagacattagaacatctg

SEQ ID NO: 729278 - DNA, 22 bp, Artificial Sequence
  chemically synthesized
tggagcagacattagaacatct

SEQ ID NO: 729279 - DNA, 22 bp, Artificial Sequence
  chemically synthesized
actccctccagatgttctaatg

SEQ ID NO: 729280 - DNA, 22 bp, Artificial Sequence
  chemically synthesized
ctccctccagatgttctaatgt

SEQ ID NO: 729281 - DNA, 22 bp, Artificial Sequence
  chemically synthesized
cctccagatgttctaatgtctg

SEQ ID NO: 729282 - DNA, 22 bp, Artificial Sequence
  chemically synthesized
cagatgttctaatgtctgctcc

SEQ ID NO: 729283 - DNA, 22 bp, Artificial Sequence
  chemically synthesized
taatgtctgctccaaaatgctg

SEQ ID NO: 729284 - DNA, 22 bp, Artificial Sequence
  chemically synthesized
ggatggggtcacccagcatttt

SEQ ID NO: 729285 - DNA, 22 bp, Artificial Sequence
  chemically synthesized
atgtctgctccaaaatgctggg

SEQ ID NO: 729286 - DNA, 22 bp, Artificial Sequence
  chemically synthesized
taggatggggtcacccagcatt

SEQ ID NO: 729287 - DNA, 22 bp, Artificial Sequence
  chemically synthesized
ctccaaaatgctgggtgacccc

SEQ ID NO: 729288 - DNA, 22 bp, Artificial Sequence
  chemically synthesized
caaaatgctgggtgaccccatc

SEQ ID NO: 729289 - DNA, 22 bp, Artificial Sequence
  chemically synthesized
ggtgaccccatcctagagctgc

SEQ ID NO: 729290 - DNA, 22 bp, Artificial Sequence
  chemically synthesized
tataccatgtgagcagctctag

SEQ ID NO: 729291 - DNA, 22 bp, Artificial Sequence
  chemically synthesized
tgatcctgtataccatgtgagc

SEQ ID NO: 729292 - DNA, 22 bp, Artificial Sequence
  chemically synthesized
gagctgctcacatggtatacag

SEQ ID NO: 729293 - DNA, 22 bp, Artificial Sequence
  chemically synthesized
ctcacatggtatacaggatcat

SEQ ID NO: 729294 - DNA, 22 bp, Artificial Sequence
  chemically synthesized
agcaaaagtgctatgatcctgt

SEQ ID NO: 729295 - DNA, 22 bp, Artificial Sequence
  chemically synthesized
aagcaaaagtgctatgatcctg

SEQ ID NO: 729296 - DNA, 22 bp, Artificial Sequence
  chemically synthesized
acatggtatacaggatcatagc

SEQ ID NO: 729297 - DNA, 22 bp, Artificial Sequence
  chemically synthesized
acttaagcaaaagtgctatgat

SEQ ID NO: 729298 - DNA, 22 bp, Artificial Sequence
  chemically synthesized
caagaaataagtcaattcactt

SEQ ID NO: 729299 - DNA, 22 bp, Artificial Sequence
  chemically synthesized
acaagaaataagtcaattcact

SEQ ID NO: 729300 - DNA, 22 bp, Artificial Sequence
  chemically synthesized
ttgcttaagtgaattgacttat

SEQ ID NO: 729301 - DNA, 22 bp, Artificial Sequence
  chemically synthesized
tgcttaagtgaattgacttatt

SEQ ID NO: 729302 - DNA, 22 bp, Artificial Sequence
  chemically synthesized
gcttaagtgaattgacttattt

SEQ ID NO: 729303 - DNA, 22 bp, Artificial Sequence
  chemically synthesized
cttaagtgaattgacttatttc

SEQ ID NO: 729304 - DNA, 22 bp, Artificial Sequence
  chemically synthesized
ggcatgacttacaagaaataag

SEQ ID NO: 729305 - DNA, 22 bp, Artificial Sequence
  chemically synthesized
aagtgaattgacttatttcttg

SEQ ID NO: 729306 - DNA, 22 bp, Artificial Sequence
  chemically synthesized
agtgaattgacttatttcttgt

SEQ ID NO: 729307 - DNA, 22 bp, Artificial Sequence
  chemically synthesized
ctgggcatgacttacaagaaat

SEQ ID NO: 729308 - DNA, 22 bp, Artificial Sequence
  chemically synthesized
atgctgctgggcatgacttaca

SEQ ID NO: 729309 - DNA, 22 bp, Artificial Sequence
  chemically synthesized
acttatttcttgtaagtcatgc

SEQ ID NO: 729310 - DNA, 22 bp, Artificial Sequence
  chemically synthesized
atttcttgtaagtcatgcccag

SEQ ID NO: 729311 - DNA, 22 bp, Artificial Sequence
  chemically synthesized
tttcttgtaagtcatgcccagc

SEQ ID NO: 729312 - DNA, 22 bp, Artificial Sequence
  chemically synthesized
cttgtaagtcatgcccagcagc

SEQ ID NO: 729313 - DNA, 22 bp, Artificial Sequence
  chemically synthesized
ttgtaagtcatgcccagcagca

SEQ ID NO: 729314 - DNA, 22 bp, Artificial Sequence
  chemically synthesized
gtaagtcatgcccagcagcatt

SEQ ID NO: 729315 - DNA, 22 bp, Artificial Sequence
  chemically synthesized
taagtcatgcccagcagcatta

SEQ ID NO: 729316 - DNA, 22 bp, Artificial Sequence
  chemically synthesized
aggaggaagtattaatgctgct

SEQ ID NO: 729317 - DNA, 22 bp, Artificial Sequence
  chemically synthesized
tgttgaggaggaagtattaatg

SEQ ID NO: 729318 - DNA, 22 bp, Artificial Sequence
  chemically synthesized
tggttgtgttgaggaggaagta

SEQ ID NO: 729319 - DNA, 22 bp, Artificial Sequence
  chemically synthesized
gtggttgtgttgaggaggaagt

SEQ ID NO: 729320 - DNA, 22 bp, Artificial Sequence
  chemically synthesized
ttgtggttgtgttgaggaggaa

SEQ ID NO: 729321 - DNA, 22 bp, Artificial Sequence
  chemically synthesized
atacttcctcctcaacacaacc

SEQ ID NO: 729322 - DNA, 22 bp, Artificial Sequence
  chemically synthesized
cagagctcttgtggttgtgttg

SEQ ID NO: 729323 - DNA, 22 bp, Artificial Sequence
  chemically synthesized
cctccagagctcttgtggttgt

SEQ ID NO: 729324 - DNA, 22 bp, Artificial Sequence
  chemically synthesized
cctcctcaacacaaccacaaga

SEQ ID NO: 729325 - DNA, 22 bp, Artificial Sequence
  chemically synthesized
ctcctcaacacaaccacaagag

SEQ ID NO: 729326 - DNA, 22 bp, Artificial Sequence
  chemically synthesized
ctcaacacaaccacaagagctc

SEQ ID NO: 729327 - DNA, 22 bp, Artificial Sequence
  chemically synthesized
aacacaaccacaagagctctgg

SEQ ID NO: 729328 - DNA, 22 bp, Artificial Sequence
  chemically synthesized
tagtaaaggaggggttccctcc

SEQ ID NO: 729329 - DNA, 22 bp, Artificial Sequence
  chemically synthesized
tggagggaacccctcctttact

SEQ ID NO: 729330 - DNA, 22 bp, Artificial Sequence
  chemically synthesized
gagggaacccctcctttactac

SEQ ID NO: 729331 - DNA, 22 bp, Artificial Sequence
  chemically synthesized
gaaagcagagaaaacccccatt

SEQ ID NO: 729332 - DNA, 22 bp, Artificial Sequence
  chemically synthesized
ctttactacaatgggggttttc

SEQ ID NO: 729333 - DNA, 22 bp, Artificial Sequence
  chemically synthesized
tactacaatgggggttttctct

SEQ ID NO: 729334 - DNA, 22 bp, Artificial Sequence
  chemically synthesized
actacaatgggggttttctctg

SEQ ID NO: 729335 - DNA, 22 bp, Artificial Sequence
  chemically synthesized
cccactggaaagcagagaaaac

SEQ ID NO: 729336 - DNA, 22 bp, Artificial Sequence
  chemically synthesized
ctacaatgggggttttctctgc

SEQ ID NO: 729337 - DNA, 22 bp, Artificial Sequence
  chemically synthesized
ccccactggaaagcagagaaaa

SEQ ID NO: 729338 - DNA, 22 bp, Artificial Sequence
  chemically synthesized
caatgggggttttctctgcttt

SEQ ID NO: 729339 - DNA, 22 bp, Artificial Sequence
  chemically synthesized
tctctgctttccagtggggaaa

SEQ ID NO: 729340 - DNA, 22 bp, Artificial Sequence
  chemically synthesized
ctctgctttccagtggggaaat

SEQ ID NO: 729341 - DNA, 22 bp, Artificial Sequence
  chemically synthesized
tctgctttccagtggggaaatg

SEQ ID NO: 729342 - DNA, 22 bp, Artificial Sequence
  chemically synthesized
tgctttccagtggggaaatggg

SEQ ID NO: 729343 - DNA, 22 bp, Artificial Sequence
  chemically synthesized
ctttccagtggggaaatggggg

SEQ ID NO: 729344 - DNA, 22 bp, Artificial Sequence
  chemically synthesized
tccagtggggaaatgggggctt

SEQ ID NO: 729345 - DNA, 22 bp, Artificial Sequence
  chemically synthesized
ccagtggggaaatgggggcttc

SEQ ID NO: 729346 - DNA, 22 bp, Artificial Sequence
  chemically synthesized
cagtggggaaatgggggcttct

SEQ ID NO: 729347 - DNA, 22 bp, Artificial Sequence
  chemically synthesized
gtaaatcatgggagaagccccc

SEQ ID NO: 729348 - DNA, 22 bp, Artificial Sequence
  chemically synthesized
agaggctagtaaatcatgggag

SEQ ID NO: 729349 - DNA, 22 bp, Artificial Sequence
  chemically synthesized
gagaggctagtaaatcatggga

SEQ ID NO: 729350 - DNA, 22 bp, Artificial Sequence
  chemically synthesized
ctcccatgatttactagcctct

SEQ ID NO: 729351 - DNA, 22 bp, Artificial Sequence
  chemically synthesized
tcccatgatttactagcctctc

SEQ ID NO: 729352 - DNA, 22 bp, Artificial Sequence
  chemically synthesized
ccacaatagtcttgagaggcta

SEQ ID NO: 729353 - DNA, 22 bp, Artificial Sequence
  chemically synthesized
ccatgatttactagcctctcaa

SEQ ID NO: 729354 - DNA, 22 bp, Artificial Sequence
  chemically synthesized
ccaaattgccacaatagtcttg

SEQ ID NO: 729355 - DNA, 22 bp, Artificial Sequence
  chemically synthesized
accaaattgccacaatagtctt

SEQ ID NO: 729356 - DNA, 22 bp, Artificial Sequence
  chemically synthesized
actagcctctcaagactattgt

SEQ ID NO: 729357 - DNA, 22 bp, Artificial Sequence
  chemically synthesized
ctagcctctcaagactattgtg

SEQ ID NO: 729358 - DNA, 22 bp, Artificial Sequence
  chemically synthesized
tcttaccaaattgccacaatag

SEQ ID NO: 729359 - DNA, 22 bp, Artificial Sequence
  chemically synthesized
gcctctcaagactattgtggca

SEQ ID NO: 729360 - DNA, 22 bp, Artificial Sequence
  chemically synthesized
tcaagactattgtggcaatttg

SEQ ID NO: 729361 - DNA, 22 bp, Artificial Sequence
  chemically synthesized
aagactattgtggcaatttggt

SEQ ID NO: 729362 - DNA, 22 bp, Artificial Sequence
  chemically synthesized
aaagtattatcttaccaaattg

SEQ ID NO: 729363 - DNA, 22 bp, Artificial Sequence
  chemically synthesized
caaagtattatcttaccaaatt

SEQ ID NO: 729364 - DNA, 22 bp, Artificial Sequence
  chemically synthesized
tcaaagtattatcttaccaaat

SEQ ID NO: 729365 - DNA, 22 bp, Artificial Sequence
  chemically synthesized
ttgtggcaatttggtaagataa

SEQ ID NO: 729366 - DNA, 22 bp, Artificial Sequence
  chemically synthesized
tggcaatttggtaagataatac

SEQ ID NO: 729367 - DNA, 22 bp, Artificial Sequence
  chemically synthesized
agcattttcaaagtattatctt

SEQ ID NO: 729368 - DNA, 22 bp, Artificial Sequence
  chemically synthesized
actgagcattttcaaagtatta

SEQ ID NO: 729369 - DNA, 22 bp, Artificial Sequence
  chemically synthesized
ggtaagataatactttgaaaat

SEQ ID NO: 729370 - DNA, 22 bp, Artificial Sequence
  chemically synthesized
gtaagataatactttgaaaatg

SEQ ID NO: 729371 - DNA, 22 bp, Artificial Sequence
  chemically synthesized
gagttgactgagcattttcaaa

SEQ ID NO: 729372 - DNA, 22 bp, Artificial Sequence
  chemically synthesized
agagttgactgagcattttcaa

SEQ ID NO: 729373 - DNA, 22 bp, Artificial Sequence
  chemically synthesized
tagagttgactgagcattttca

SEQ ID NO: 729374 - DNA, 22 bp, Artificial Sequence
  chemically synthesized
cactttagagttgactgagcat

SEQ ID NO: 729375 - DNA, 22 bp, Artificial Sequence
  chemically synthesized
cattgcactttagagttgactg

SEQ ID NO: 729376 - DNA, 22 bp, Artificial Sequence
  chemically synthesized
tgaaaatgctcagtcaactcta

SEQ ID NO: 729377 - DNA, 22 bp, Artificial Sequence
  chemically synthesized
gaaaatgctcagtcaactctaa

SEQ ID NO: 729378 - DNA, 22 bp, Artificial Sequence
  chemically synthesized
aaaatgctcagtcaactctaaa

SEQ ID NO: 729379 - DNA, 22 bp, Artificial Sequence
  chemically synthesized
tatctgcattgcactttagagt

SEQ ID NO: 729380 - DNA, 22 bp, Artificial Sequence
  chemically synthesized
atatctgcattgcactttagag

SEQ ID NO: 729381 - DNA, 22 bp, Artificial Sequence
  chemically synthesized
tatatctgcattgcactttaga

SEQ ID NO: 729382 - DNA, 22 bp, Artificial Sequence
  chemically synthesized
agtcaactctaaagtgcaatgc

SEQ ID NO: 729383 - DNA, 22 bp, Artificial Sequence
  chemically synthesized
tactttatatctgcattgcact

SEQ ID NO: 729384 - DNA, 22 bp, Artificial Sequence
  chemically synthesized
atactttatatctgcattgcac

SEQ ID NO: 729385 - DNA, 22 bp, Artificial Sequence
  chemically synthesized
cttatactttatatctgcattg

SEQ ID NO: 729386 - DNA, 22 bp, Artificial Sequence
  chemically synthesized
ttacttatactttatatctgca

SEQ ID NO: 729387 - DNA, 22 bp, Artificial Sequence
  chemically synthesized
taaagtgcaatgcagatataaa

SEQ ID NO: 729388 - DNA, 22 bp, Artificial Sequence
  chemically synthesized
aagtgcaatgcagatataaagt

SEQ ID NO: 729389 - DNA, 22 bp, Artificial Sequence
  chemically synthesized
agtagctattacttatacttta

SEQ ID NO: 729390 - DNA, 22 bp, Artificial Sequence
  chemically synthesized
cagtagctattacttatacttt

SEQ ID NO: 729391 - DNA, 22 bp, Artificial Sequence
  chemically synthesized
aaatatttcagtagctattact

SEQ ID NO: 729392 - DNA, 22 bp, Artificial Sequence
  chemically synthesized
aaaatatttcagtagctattac

SEQ ID NO: 729393 - DNA, 22 bp, Artificial Sequence
  chemically synthesized
gggcccaaggatatttaaaata

SEQ ID NO: 729394 - DNA, 22 bp, Artificial Sequence
  chemically synthesized
tattagggcccaaggatattta

SEQ ID NO: 729395 - DNA, 22 bp, Artificial Sequence
  chemically synthesized
ctgaaatattttaaatatcctt

SEQ ID NO: 729396 - DNA, 22 bp, Artificial Sequence
  chemically synthesized
aaatattttaaatatccttggg

SEQ ID NO: 729397 - DNA, 22 bp, Artificial Sequence
  chemically synthesized
tcatgattgtattagggcccaa

SEQ ID NO: 729398 - DNA, 22 bp, Artificial Sequence
  chemically synthesized
atcatgattgtattagggccca

SEQ ID NO: 729399 - DNA, 22 bp, Artificial Sequence
  chemically synthesized
tatcatgattgtattagggccc

SEQ ID NO: 729400 - DNA, 22 bp, Artificial Sequence
  chemically synthesized
taaatatccttgggccctaata

SEQ ID NO: 729401 - DNA, 22 bp, Artificial Sequence
  chemically synthesized
aaatatccttgggccctaatac

SEQ ID NO: 729402 - DNA, 22 bp, Artificial Sequence
  chemically synthesized
aatatccttgggccctaataca

SEQ ID NO: 729403 - DNA, 22 bp, Artificial Sequence
  chemically synthesized
attttatcatgattgtattagg

SEQ ID NO: 729404 - DNA, 22 bp, Artificial Sequence
  chemically synthesized
ctgattttatcatgattgtatt

SEQ ID NO: 729405 - DNA, 22 bp, Artificial Sequence
  chemically synthesized
gggccctaatacaatcatgata

SEQ ID NO: 729406 - DNA, 22 bp, Artificial Sequence
  chemically synthesized
ggccctaatacaatcatgataa

SEQ ID NO: 729407 - DNA, 22 bp, Artificial Sequence
  chemically synthesized
tgtagaagactgctgattttat

SEQ ID NO: 729408 - DNA, 22 bp, Artificial Sequence
  chemically synthesized
atacaatcatgataaaatcagc

SEQ ID NO: 729409 - DNA, 22 bp, Artificial Sequence
  chemically synthesized
ctatgtagaagactgctgattt

SEQ ID NO: 729410 - DNA, 22 bp, Artificial Sequence
  chemically synthesized
ttcctatgtagaagactgctga

SEQ ID NO: 729411 - DNA, 22 bp, Artificial Sequence
  chemically synthesized
gttcctatgtagaagactgctg

SEQ ID NO: 729412 - DNA, 22 bp, Artificial Sequence
  chemically synthesized
tttgttcctatgtagaagactg

SEQ ID NO: 729413 - DNA, 22 bp, Artificial Sequence
  chemically synthesized
atttgttcctatgtagaagact

SEQ ID NO: 729414 - DNA, 22 bp, Artificial Sequence
  chemically synthesized
tatttgttcctatgtagaagac

SEQ ID NO: 729415 - DNA, 22 bp, Artificial Sequence
  chemically synthesized
ttttatttgttcctatgtagaa

SEQ ID NO: 729416 - DNA, 22 bp, Artificial Sequence
  chemically synthesized
ctacataggaacaaataaaaca

SEQ ID NO: 729417 - DNA, 22 bp, Artificial Sequence
  chemically synthesized
atggggagaatctgttttattt

SEQ ID NO: 729418 - DNA, 22 bp, Artificial Sequence
  chemically synthesized
tacataggaacaaataaaacag

SEQ ID NO: 729419 - DNA, 22 bp, Artificial Sequence
  chemically synthesized
aatggggagaatctgttttatt

SEQ ID NO: 729420 - DNA, 22 bp, Artificial Sequence
  chemically synthesized
cataggaacaaataaaacagat

SEQ ID NO: 729421 - DNA, 22 bp, Artificial Sequence
  chemically synthesized
cttaatggggagaatctgtttt

SEQ ID NO: 729422 - DNA, 22 bp, Artificial Sequence
  chemically synthesized
acttaatggggagaatctgttt

SEQ ID NO: 729423 - DNA, 22 bp, Artificial Sequence
  chemically synthesized
tttacttaatggggagaatctg

SEQ ID NO: 729424 - DNA, 22 bp, Artificial Sequence
  chemically synthesized
gtttacttaatggggagaatct

SEQ ID NO: 729425 - DNA, 22 bp, Artificial Sequence
  chemically synthesized
tgtttacttaatggggagaatc

SEQ ID NO: 729426 - DNA, 22 bp, Artificial Sequence
  chemically synthesized
agttttgtttacttaatgggga

SEQ ID NO: 729427 - DNA, 22 bp, Artificial Sequence
  chemically synthesized
ccctaagttttgtttacttaat

SEQ ID NO: 729428 - DNA, 22 bp, Artificial Sequence
  chemically synthesized
tccccattaagtaaacaaaact

SEQ ID NO: 729429 - DNA, 22 bp, Artificial Sequence
  chemically synthesized
aagcctaccctaagttttgttt

SEQ ID NO: 729430 - DNA, 22 bp, Artificial Sequence
  chemically synthesized
caagcctaccctaagttttgtt

SEQ ID NO: 729431 - DNA, 22 bp, Artificial Sequence
  chemically synthesized
cccattaagtaaacaaaactta

SEQ ID NO: 729432 - DNA, 22 bp, Artificial Sequence
  chemically synthesized
tcaagcctaccctaagttttgt

SEQ ID NO: 729433 - DNA, 22 bp, Artificial Sequence
  chemically synthesized
ttcaagcctaccctaagttttg

SEQ ID NO: 729434 - DNA, 22 bp, Artificial Sequence
  chemically synthesized
tttcaagcctaccctaagtttt

SEQ ID NO: 729435 - DNA, 22 bp, Artificial Sequence
  chemically synthesized
agtaaacaaaacttagggtagg

SEQ ID NO: 729436 - DNA, 22 bp, Artificial Sequence
  chemically synthesized
tcctttttcaagcctaccctaa

SEQ ID NO: 729437 - DNA, 22 bp, Artificial Sequence
  chemically synthesized
gtcctttttcaagcctacccta

SEQ ID NO: 729438 - DNA, 22 bp, Artificial Sequence
  chemically synthesized
acaacttgtcctttttcaagcc

SEQ ID NO: 729439 - DNA, 22 bp, Artificial Sequence
  chemically synthesized
cacaacttgtcctttttcaagc

SEQ ID NO: 729440 - DNA, 22 bp, Artificial Sequence
  chemically synthesized
atttcacaacttgtcctttttc

SEQ ID NO: 729441 - DNA, 22 bp, Artificial Sequence
  chemically synthesized
agggtaggcttgaaaaaggaca

SEQ ID NO: 729442 - DNA, 22 bp, Artificial Sequence
  chemically synthesized
aatttcacaacttgtccttttt

SEQ ID NO: 729443 - DNA, 22 bp, Artificial Sequence
  chemically synthesized
gggtaggcttgaaaaaggacaa

SEQ ID NO: 729444 - DNA, 22 bp, Artificial Sequence
  chemically synthesized
gaaatttaatttcacaacttgt

SEQ ID NO: 729445 - DNA, 22 bp, Artificial Sequence
  chemically synthesized
gaaaaaggacaagttgtgaaat

SEQ ID NO: 729446 - DNA, 22 bp, Artificial Sequence
  chemically synthesized
aaaaaggacaagttgtgaaatt

SEQ ID NO: 729447 - DNA, 22 bp, Artificial Sequence
  chemically synthesized
aaaatctggaaatttaatttca

SEQ ID NO: 729448 - DNA, 22 bp, Artificial Sequence
  chemically synthesized
aattaaaaatctggaaatttaa

SEQ ID NO: 729449 - DNA, 22 bp, Artificial Sequence
  chemically synthesized
aattgaattaaaaatctggaaa

SEQ ID NO: 729450 - DNA, 22 bp, Artificial Sequence
  chemically synthesized
tgaaattaaatttccagatttt

SEQ ID NO: 729451 - DNA, 22 bp, Artificial Sequence
  chemically synthesized
aatttccagatttttaattcaa

SEQ ID NO: 729452 - DNA, 22 bp, Artificial Sequence
  chemically synthesized
ccagatttttaattcaatttag

SEQ ID NO: 729453 - DNA, 22 bp, Artificial Sequence
  chemically synthesized
cagatttttaattcaatttagg

SEQ ID NO: 729454 - DNA, 22 bp, Artificial Sequence
  chemically synthesized
gcaccagaaaacacctaaattg

SEQ ID NO: 729455 - DNA, 22 bp, Artificial Sequence
  chemically synthesized
ttaattcaatttaggtgttttc

SEQ ID NO: 729456 - DNA, 22 bp, Artificial Sequence
  chemically synthesized
taattcaatttaggtgttttct

SEQ ID NO: 729457 - DNA, 22 bp, Artificial Sequence
  chemically synthesized
aattcaatttaggtgttttctg

SEQ ID NO: 729458 - DNA, 22 bp, Artificial Sequence
  chemically synthesized
attcaatttaggtgttttctgg

SEQ ID NO: 729459 - DNA, 22 bp, Artificial Sequence
  chemically synthesized
aaaccatctggcaccagaaaac

SEQ ID NO: 729460 - DNA, 22 bp, Artificial Sequence
  chemically synthesized
caaaccatctggcaccagaaaa

SEQ ID NO: 729461 - DNA, 22 bp, Artificial Sequence
  chemically synthesized
aatttaggtgttttctggtgcc

SEQ ID NO: 729462 - DNA, 22 bp, Artificial Sequence
  chemically synthesized
aggtgttttctggtgccagatg

SEQ ID NO: 729463 - DNA, 22 bp, Artificial Sequence
  chemically synthesized
agaacttcaaaccatctggcac

SEQ ID NO: 729464 - DNA, 22 bp, Artificial Sequence
  chemically synthesized
ggtgttttctggtgccagatgg

SEQ ID NO: 729465 - DNA, 22 bp, Artificial Sequence
  chemically synthesized
aagaacttcaaaccatctggca

SEQ ID NO: 729466 - DNA, 22 bp, Artificial Sequence
  chemically synthesized
tctggtgccagatggtttgaag

SEQ ID NO: 729467 - DNA, 22 bp, Artificial Sequence
  chemically synthesized
ctggtgccagatggtttgaagt

SEQ ID NO: 729468 - DNA, 22 bp, Artificial Sequence
  chemically synthesized
tggtgccagatggtttgaagtt

SEQ ID NO: 729469 - DNA, 22 bp, Artificial Sequence
  chemically synthesized
gtgccagatggtttgaagttct

SEQ ID NO: 729470 - DNA, 22 bp, Artificial Sequence
  chemically synthesized
gaagttcttaaaccatttttat

SEQ ID NO: 729471 - DNA, 22 bp, Artificial Sequence
  chemically synthesized
aagttcttaaaccatttttatt

SEQ ID NO: 729472 - DNA, 22 bp, Artificial Sequence
  chemically synthesized
ttaaaccatttttattttattt

SEQ ID NO: 729473 - DNA, 22 bp, Artificial Sequence
  chemically synthesized
aaaccatttttattttatttta

SEQ ID NO: 729474 - DNA, 22 bp, Artificial Sequence
  chemically synthesized
aaccatttttattttattttat

SEQ ID NO: 729475 - DNA, 22 bp, Artificial Sequence
  chemically synthesized
aaaaaaataaatgaataaaata

SEQ ID NO: 729476 - DNA, 22 bp, Artificial Sequence
  chemically synthesized
tctcaaaaaaataaatgaataa

SEQ ID NO: 729477 - DNA, 22 bp, Artificial Sequence
  chemically synthesized
ttattttattttattcatttat

SEQ ID NO: 729478 - DNA, 22 bp, Artificial Sequence
  chemically synthesized
tattttattttattcatttatt

SEQ ID NO: 729479 - DNA, 22 bp, Artificial Sequence
  chemically synthesized
attttattttattcatttattt

SEQ ID NO: 729480 - DNA, 22 bp, Artificial Sequence
  chemically synthesized
tctatctcaaaaaaataaatga

SEQ ID NO: 729481 - DNA, 22 bp, Artificial Sequence
  chemically synthesized
ttttattttattcatttatttt

SEQ ID NO: 729482 - DNA, 22 bp, Artificial Sequence
  chemically synthesized
tatctatctcaaaaaaataaat

SEQ ID NO: 729483 - DNA, 22 bp, Artificial Sequence
  chemically synthesized
tattttattcatttattttttt

SEQ ID NO: 729484 - DNA, 22 bp, Artificial Sequence
  chemically synthesized
attttattcatttatttttttg

SEQ ID NO: 729485 - DNA, 22 bp, Artificial Sequence
  chemically synthesized
ttttattcatttatttttttga

SEQ ID NO: 729486 - DNA, 22 bp, Artificial Sequence
  chemically synthesized
tattcatttatttttttgagat

SEQ ID NO: 729487 - DNA, 22 bp, Artificial Sequence
  chemically synthesized
attcatttatttttttgagata

SEQ ID NO: 729488 - DNA, 22 bp, Artificial Sequence
  chemically synthesized
ttcatttatttttttgagatag

SEQ ID NO: 729489 - DNA, 22 bp, Artificial Sequence
  chemically synthesized
atttatttttttgagatagata

SEQ ID NO: 729490 - DNA, 22 bp, Artificial Sequence
  chemically synthesized
atttttttgagatagatagagt

SEQ ID NO: 729491 - DNA, 22 bp, Artificial Sequence
  chemically synthesized
tttttttgagatagatagagtc

SEQ ID NO: 729492 - DNA, 22 bp, Artificial Sequence
  chemically synthesized
ggcgatagagcaagactctatc

SEQ ID NO: 729493 - DNA, 22 bp, Artificial Sequence
  chemically synthesized
ttttgagatagatagagtcttg

SEQ ID NO: 729494 - DNA, 22 bp, Artificial Sequence
  chemically synthesized
tttgagatagatagagtcttgc

SEQ ID NO: 729495 - DNA, 22 bp, Artificial Sequence
  chemically synthesized
ttgagatagatagagtcttgct

SEQ ID NO: 729496 - DNA, 22 bp, Artificial Sequence
  chemically synthesized
tgagatagatagagtcttgctc

SEQ ID NO: 729497 - DNA, 22 bp, Artificial Sequence
  chemically synthesized
gagatagatagagtcttgctct

SEQ ID NO: 729498 - DNA, 22 bp, Artificial Sequence
  chemically synthesized
agatagatagagtcttgctcta

SEQ ID NO: 729499 - DNA, 22 bp, Artificial Sequence
  chemically synthesized
cagcctgggcgatagagcaaga

SEQ ID NO: 729500 - DNA, 22 bp, Artificial Sequence
  chemically synthesized
ccctccagcctgggcgatagag

SEQ ID NO: 729501 - DNA, 22 bp, Artificial Sequence
  chemically synthesized
gctctatcgcccaggctggagg

SEQ ID NO: 729502 - DNA, 22 bp, Artificial Sequence
  chemically synthesized
ctctatcgcccaggctggaggg

SEQ ID NO: 729503 - DNA, 22 bp, Artificial Sequence
  chemically synthesized
tatcgcccaggctggagggcag

SEQ ID NO: 729504 - DNA, 22 bp, Artificial Sequence
  chemically synthesized
tcgcccaggctggagggcagtg

SEQ ID NO: 729505 - DNA, 22 bp, Artificial Sequence
  chemically synthesized
cagtgagcagagatcgtgtcac

SEQ ID NO: 729506 - DNA, 22 bp, Artificial Sequence
  chemically synthesized
gagggcagtgacacgatctctg

SEQ ID NO: 729507 - DNA, 22 bp, Artificial Sequence
  chemically synthesized
gaacccggaaggcagaggttgc

SEQ ID NO: 729508 - DNA, 22 bp, Artificial Sequence
  chemically synthesized
tggaacccggaaggcagaggtt

SEQ ID NO: 729509 - DNA, 22 bp, Artificial Sequence
  chemically synthesized
tgctcactgcaacctctgcctt

SEQ ID NO: 729510 - DNA, 22 bp, Artificial Sequence
  chemically synthesized
ctcactgcaacctctgccttcc

SEQ ID NO: 729511 - DNA, 22 bp, Artificial Sequence
  chemically synthesized
actgcaacctctgccttccggg

SEQ ID NO: 729512 - DNA, 22 bp, Artificial Sequence
  chemically synthesized
caacctctgccttccgggttcc

SEQ ID NO: 729513 - DNA, 22 bp, Artificial Sequence
  chemically synthesized
aggcaggacaatctctggaacc

SEQ ID NO: 729514 - DNA, 22 bp, Artificial Sequence
  chemically synthesized
tgccttccgggttccagagatt

SEQ ID NO: 729515 - DNA, 22 bp, Artificial Sequence
  chemically synthesized
ccttccgggttccagagattgt

SEQ ID NO: 729516 - DNA, 22 bp, Artificial Sequence
  chemically synthesized
ccgggttccagagattgtcctg

SEQ ID NO: 729517 - DNA, 22 bp, Artificial Sequence
  chemically synthesized
gggaggctgaggcaggacaatc

SEQ ID NO: 729518 - DNA, 22 bp, Artificial Sequence
  chemically synthesized
cgggttccagagattgtcctgc

SEQ ID NO: 729519 - DNA, 22 bp, Artificial Sequence
  chemically synthesized
ctcgggaggctgaggcaggaca

SEQ ID NO: 729520 - DNA, 22 bp, Artificial Sequence
  chemically synthesized
cagagattgtcctgcctcagcc

SEQ ID NO: 729521 - DNA, 22 bp, Artificial Sequence
  chemically synthesized
taatcccagctactcgggaggc

SEQ ID NO: 729522 - DNA, 22 bp, Artificial Sequence
  chemically synthesized
tcctgcctcagcctcccgagta

SEQ ID NO: 729523 - DNA, 22 bp, Artificial Sequence
  chemically synthesized
cctcagcctcccgagtagctgg

SEQ ID NO: 729524 - DNA, 22 bp, Artificial Sequence
  chemically synthesized
agcctcccgagtagctgggatt

SEQ ID NO: 729525 - DNA, 22 bp, Artificial Sequence
  chemically synthesized
ccgagtagctgggattacaggc

SEQ ID NO: 729526 - DNA, 22 bp, Artificial Sequence
  chemically synthesized
gtcaggcatggtggcgggcgcc

SEQ ID NO: 729527 - DNA, 22 bp, Artificial Sequence
  chemically synthesized
ggattacaggcgcccgccacca

SEQ ID NO: 729528 - DNA, 22 bp, Artificial Sequence
  chemically synthesized
caggcgcccgccaccatgcctg

SEQ ID NO: 729529 - DNA, 22 bp, Artificial Sequence
  chemically synthesized
aaaaatacaaaaattagtcagg

SEQ ID NO: 729530 - DNA, 22 bp, Artificial Sequence
  chemically synthesized
ctaaaaaatacaaaaattagtc

SEQ ID NO: 729531 - DNA, 22 bp, Artificial Sequence
  chemically synthesized
tactaaaaaatacaaaaattag

SEQ ID NO: 729532 - DNA, 22 bp, Artificial Sequence
  chemically synthesized
tctctactaaaaaatacaaaaa

SEQ ID NO: 729533 - DNA, 22 bp, Artificial Sequence
  chemically synthesized
actaatttttgtattttttagt

SEQ ID NO: 729534 - DNA, 22 bp, Artificial Sequence
  chemically synthesized
atttttgtattttttagtagag

SEQ ID NO: 729535 - DNA, 22 bp, Artificial Sequence
  chemically synthesized
ttgtattttttagtagagacag

SEQ ID NO: 729536 - DNA, 22 bp, Artificial Sequence
  chemically synthesized
tgtattttttagtagagacagg

SEQ ID NO: 729537 - DNA, 22 bp, Artificial Sequence
  chemically synthesized
gtattttttagtagagacaggg

SEQ ID NO: 729538 - DNA, 22 bp, Artificial Sequence
  chemically synthesized
tattttttagtagagacagggt

SEQ ID NO: 729539 - DNA, 22 bp, Artificial Sequence
  chemically synthesized
gccaacatggcaaaaccctgtc

SEQ ID NO: 729540 - DNA, 22 bp, Artificial Sequence
  chemically synthesized
tttagtagagacagggttttgc

SEQ ID NO: 729541 - DNA, 22 bp, Artificial Sequence
  chemically synthesized
ttagtagagacagggttttgcc

SEQ ID NO: 729542 - DNA, 22 bp, Artificial Sequence
  chemically synthesized
tagtagagacagggttttgcca

SEQ ID NO: 729543 - DNA, 22 bp, Artificial Sequence
  chemically synthesized
agtagagacagggttttgccat

SEQ ID NO: 729544 - DNA, 22 bp, Artificial Sequence
  chemically synthesized
gtagagacagggttttgccatg

SEQ ID NO: 729545 - DNA, 22 bp, Artificial Sequence
  chemically synthesized
aagaccagcctggccaacatgg

SEQ ID NO: 729546 - DNA, 22 bp, Artificial Sequence
  chemically synthesized
tgccatgttggccaggctggtc

SEQ ID NO: 729547 - DNA, 22 bp, Artificial Sequence
  chemically synthesized
gccatgttggccaggctggtct

SEQ ID NO: 729548 - DNA, 22 bp, Artificial Sequence
  chemically synthesized
ccatgttggccaggctggtctt

SEQ ID NO: 729549 - DNA, 22 bp, Artificial Sequence
  chemically synthesized
gccaggctggtcttgaacgtct

SEQ ID NO: 729550 - DNA, 22 bp, Artificial Sequence
  chemically synthesized
gtcttgaacgtctgacctcggg

SEQ ID NO: 729551 - DNA, 22 bp, Artificial Sequence
  chemically synthesized
aggtgggcagatcacccgaggt

SEQ ID NO: 729552 - DNA, 22 bp, Artificial Sequence
  chemically synthesized
gaacgtctgacctcgggtgatc

SEQ ID NO: 729553 - DNA, 22 bp, Artificial Sequence
  chemically synthesized
aacgtctgacctcgggtgatct

SEQ ID NO: 729554 - DNA, 22 bp, Artificial Sequence
  chemically synthesized
ggaggctgaggtgggcagatca

SEQ ID NO: 729555 - DNA, 22 bp, Artificial Sequence
  chemically synthesized
gggaggctgaggtgggcagatc

SEQ ID NO: 729556 - DNA, 22 bp, Artificial Sequence
  chemically synthesized
tgggaggctgaggtgggcagat

SEQ ID NO: 729557 - DNA, 22 bp, Artificial Sequence
  chemically synthesized
acctcgggtgatctgcccacct

SEQ ID NO: 729558 - DNA, 22 bp, Artificial Sequence
  chemically synthesized
gcactttgggaggctgaggtgg

SEQ ID NO: 729559 - DNA, 22 bp, Artificial Sequence
  chemically synthesized
gggtgatctgcccacctcagcc

SEQ ID NO: 729560 - DNA, 22 bp, Artificial Sequence
  chemically synthesized
taatcctggcactttgggaggc

SEQ ID NO: 729561 - DNA, 22 bp, Artificial Sequence
  chemically synthesized
cccacctcagcctcccaaagtg

SEQ ID NO: 729562 - DNA, 22 bp, Artificial Sequence
  chemically synthesized
acgtctataatcctggcacttt

SEQ ID NO: 729563 - DNA, 22 bp, Artificial Sequence
  chemically synthesized
agcctcccaaagtgccaggatt

SEQ ID NO: 729564 - DNA, 22 bp, Artificial Sequence
  chemically synthesized
ccaaagtgccaggattatagac

SEQ ID NO: 729565 - DNA, 22 bp, Artificial Sequence
  chemically synthesized
agggccggacacggtgactcac

SEQ ID NO: 729566 - DNA, 22 bp, Artificial Sequence
  chemically synthesized
aagggccggacacggtgactca

SEQ ID NO: 729567 - DNA, 22 bp, Artificial Sequence
  chemically synthesized
tagacgtgagtcaccgtgtccg

SEQ ID NO: 729568 - DNA, 22 bp, Artificial Sequence
  chemically synthesized
aaaatggtttaagggccggaca

SEQ ID NO: 729569 - DNA, 22 bp, Artificial Sequence
  chemically synthesized
aaaaatggtttaagggccggac

SEQ ID NO: 729570 - DNA, 22 bp, Artificial Sequence
  chemically synthesized
taaaaatggtttaagggccgga

SEQ ID NO: 729571 - DNA, 22 bp, Artificial Sequence
  chemically synthesized
aagatgcatgccgctttaaaaa

SEQ ID NO: 729572 - DNA, 22 bp, Artificial Sequence
  chemically synthesized
aaaccatttttaaagcggcatg

SEQ ID NO: 729573 - DNA, 22 bp, Artificial Sequence
  chemically synthesized
aaccatttttaaagcggcatgc

SEQ ID NO: 729574 - DNA, 22 bp, Artificial Sequence
  chemically synthesized
aaggttaaagatgcatgccgct

SEQ ID NO: 729575 - DNA, 22 bp, Artificial Sequence
  chemically synthesized
cattaaaggttaaagatgcatg

SEQ ID NO: 729576 - DNA, 22 bp, Artificial Sequence
  chemically synthesized
acattaaaggttaaagatgcat

SEQ ID NO: 729577 - DNA, 22 bp, Artificial Sequence
  chemically synthesized
tacattaaaggttaaagatgca

SEQ ID NO: 729578 - DNA, 22 bp, Artificial Sequence
  chemically synthesized
ttaaagcggcatgcatctttaa

SEQ ID NO: 729579 - DNA, 22 bp, Artificial Sequence
  chemically synthesized
taaagcggcatgcatctttaac

SEQ ID NO: 729580 - DNA, 22 bp, Artificial Sequence
  chemically synthesized
tttacattaaaggttaaagatg

SEQ ID NO: 729581 - DNA, 22 bp, Artificial Sequence
  chemically synthesized
aaagcggcatgcatctttaacc

SEQ ID NO: 729582 - DNA, 22 bp, Artificial Sequence
  chemically synthesized
aagcggcatgcatctttaacct

SEQ ID NO: 729583 - DNA, 22 bp, Artificial Sequence
  chemically synthesized
tgatcatgttctttacattaaa

SEQ ID NO: 729584 - DNA, 22 bp, Artificial Sequence
  chemically synthesized
tatgatcatgttctttacatta

SEQ ID NO: 729585 - DNA, 22 bp, Artificial Sequence
  chemically synthesized
ctatgatcatgttctttacatt

SEQ ID NO: 729586 - DNA, 22 bp, Artificial Sequence
  chemically synthesized
tctatgatcatgttctttacat

SEQ ID NO: 729587 - DNA, 22 bp, Artificial Sequence
  chemically synthesized
ttctatgatcatgttctttaca

SEQ ID NO: 729588 - DNA, 22 bp, Artificial Sequence
  chemically synthesized
taacctttaatgtaaagaacat

SEQ ID NO: 729589 - DNA, 22 bp, Artificial Sequence
  chemically synthesized
aacctttaatgtaaagaacatg

SEQ ID NO: 729590 - DNA, 22 bp, Artificial Sequence
  chemically synthesized
acctttaatgtaaagaacatga

SEQ ID NO: 729591 - DNA, 22 bp, Artificial Sequence
  chemically synthesized
aatacttttctatgatcatgtt

SEQ ID NO: 729592 - DNA, 22 bp, Artificial Sequence
  chemically synthesized
aaatacttttctatgatcatgt

SEQ ID NO: 729593 - DNA, 22 bp, Artificial Sequence
  chemically synthesized
taatgtaaagaacatgatcata

SEQ ID NO: 729594 - DNA, 22 bp, Artificial Sequence
  chemically synthesized
aatgtaaagaacatgatcatag

SEQ ID NO: 729595 - DNA, 22 bp, Artificial Sequence
  chemically synthesized
atgtaaagaacatgatcataga

SEQ ID NO: 729596 - DNA, 22 bp, Artificial Sequence
  chemically synthesized
catgaataaggtcaaaatttaa

SEQ ID NO: 729597 - DNA, 22 bp, Artificial Sequence
  chemically synthesized
cattgcatgaataaggtcaaaa

SEQ ID NO: 729598 - DNA, 22 bp, Artificial Sequence
  chemically synthesized
aagcattgcattgcatgaataa

SEQ ID NO: 729599 - DNA, 22 bp, Artificial Sequence
  chemically synthesized
aaattttgaccttattcatgca

SEQ ID NO: 729600 - DNA, 22 bp, Artificial Sequence
  chemically synthesized
aaagcattgcattgcatgaata

SEQ ID NO: 729601 - DNA, 22 bp, Artificial Sequence
  chemically synthesized
aattttgaccttattcatgcaa

SEQ ID NO: 729602 - DNA, 22 bp, Artificial Sequence
  chemically synthesized
tgaccttattcatgcaatgcaa

SEQ ID NO: 729603 - DNA, 22 bp, Artificial Sequence
  chemically synthesized
cagtttaaagcattgcattgca

SEQ ID NO: 729604 - DNA, 22 bp, Artificial Sequence
  chemically synthesized
gaccttattcatgcaatgcaat

SEQ ID NO: 729605 - DNA, 22 bp, Artificial Sequence
  chemically synthesized
accttattcatgcaatgcaatg

SEQ ID NO: 729606 - DNA, 22 bp, Artificial Sequence
  chemically synthesized
attcatgcaatgcaatgcttta

SEQ ID NO: 729607 - DNA, 22 bp, Artificial Sequence
  chemically synthesized
acatctacagtttaaagcattg

SEQ ID NO: 729608 - DNA, 22 bp, Artificial Sequence
  chemically synthesized
ttcatgcaatgcaatgctttaa

SEQ ID NO: 729609 - DNA, 22 bp, Artificial Sequence
  chemically synthesized
atgcaatgcaatgctttaaact

SEQ ID NO: 729610 - DNA, 22 bp, Artificial Sequence
  chemically synthesized
taaactgtagatgtcaactttg

SEQ ID NO: 729611 - DNA, 22 bp, Artificial Sequence
  chemically synthesized
aaactgtagatgtcaactttgc

SEQ ID NO: 729612 - DNA, 22 bp, Artificial Sequence
  chemically synthesized
tggtcatagagtgcaaagttga

SEQ ID NO: 729613 - DNA, 22 bp, Artificial Sequence
  chemically synthesized
aactgtagatgtcaactttgca

SEQ ID NO: 729614 - DNA, 22 bp, Artificial Sequence
  chemically synthesized
gtggtcatagagtgcaaagttg

SEQ ID NO: 729615 - DNA, 22 bp, Artificial Sequence
  chemically synthesized
tgtggtcatagagtgcaaagtt

SEQ ID NO: 729616 - DNA, 22 bp, Artificial Sequence
  chemically synthesized
tagatgtcaactttgcactcta

SEQ ID NO: 729617 - DNA, 22 bp, Artificial Sequence
  chemically synthesized
tgcactctatgaccacaaaata

SEQ ID NO: 729618 - DNA, 22 bp, Artificial Sequence
  chemically synthesized
gcactctatgaccacaaaatat

SEQ ID NO: 729619 - DNA, 22 bp, Artificial Sequence
  chemically synthesized
cactctatgaccacaaaatatg

SEQ ID NO: 729620 - DNA, 22 bp, Artificial Sequence
  chemically synthesized
tatgaccacaaaatatgcacat

SEQ ID NO: 729621 - DNA, 22 bp, Artificial Sequence
  chemically synthesized
tgaccacaaaatatgcacatat

SEQ ID NO: 729622 - DNA, 22 bp, Artificial Sequence
  chemically synthesized
taataaaagggtgatatgtgca

SEQ ID NO: 729623 - DNA, 22 bp, Artificial Sequence
  chemically synthesized
tataataaaagggtgatatgtg

SEQ ID NO: 729624 - DNA, 22 bp, Artificial Sequence
  chemically synthesized
gtggtaccgagttctataataa

SEQ ID NO: 729625 - DNA, 22 bp, Artificial Sequence
  chemically synthesized
tatcatacctagtggtaccgag

SEQ ID NO: 729626 - DNA, 22 bp, Artificial Sequence
  chemically synthesized
ttattatagaactcggtaccac

SEQ ID NO: 729627 - DNA, 22 bp, Artificial Sequence
  chemically synthesized
atatcatacctagtggtaccga

SEQ ID NO: 729628 - DNA, 22 bp, Artificial Sequence
  chemically synthesized
tattatagaactcggtaccact

SEQ ID NO: 729629 - DNA, 22 bp, Artificial Sequence
  chemically synthesized
attatagaactcggtaccacta

SEQ ID NO: 729630 - DNA, 22 bp, Artificial Sequence
  chemically synthesized
ttatagaactcggtaccactag

SEQ ID NO: 729631 - DNA, 22 bp, Artificial Sequence
  chemically synthesized
tagaactcggtaccactaggta

SEQ ID NO: 729632 - DNA, 22 bp, Artificial Sequence
  chemically synthesized
agtaaccatttatatcatacct

SEQ ID NO: 729633 - DNA, 22 bp, Artificial Sequence
  chemically synthesized
tcagtaaccatttatatcatac

SEQ ID NO: 729634 - DNA, 22 bp, Artificial Sequence
  chemically synthesized
ggtaccactaggtatgatataa

SEQ ID NO: 729635 - DNA, 22 bp, Artificial Sequence
  chemically synthesized
ctcagtaaccatttatatcata

SEQ ID NO: 729636 - DNA, 22 bp, Artificial Sequence
  chemically synthesized
tttctcagtaaccatttatatc

SEQ ID NO: 729637 - DNA, 22 bp, Artificial Sequence
  chemically synthesized
tgtttctcagtaaccatttata

SEQ ID NO: 729638 - DNA, 22 bp, Artificial Sequence
  chemically synthesized
ggtatgatataaatggttactg

SEQ ID NO: 729639 - DNA, 22 bp, Artificial Sequence
  chemically synthesized
gaagcacgatgcagcaaactct

SEQ ID NO: 729640 - DNA, 22 bp, Artificial Sequence
  chemically synthesized
ctgagaaacagagtttgctgca

SEQ ID NO: 729641 - DNA, 22 bp, Artificial Sequence
  chemically synthesized
actagaagcacgatgcagcaaa

SEQ ID NO: 729642 - DNA, 22 bp, Artificial Sequence
  chemically synthesized
agaaacagagtttgctgcatcg

SEQ ID NO: 729643 - DNA, 22 bp, Artificial Sequence
  chemically synthesized
tcactagaagcacgatgcagca

SEQ ID NO: 729644 - DNA, 22 bp, Artificial Sequence
  chemically synthesized
ctcactagaagcacgatgcagc

SEQ ID NO: 729645 - DNA, 22 bp, Artificial Sequence
  chemically synthesized
tttctcactagaagcacgatgc

SEQ ID NO: 729646 - DNA, 22 bp, Artificial Sequence
  chemically synthesized
tgcaactatttctcactagaag

SEQ ID NO: 729647 - DNA, 22 bp, Artificial Sequence
  chemically synthesized
gctgcatcgtgcttctagtgag

SEQ ID NO: 729648 - DNA, 22 bp, Artificial Sequence
  chemically synthesized
ctgcatcgtgcttctagtgaga

SEQ ID NO: 729649 - DNA, 22 bp, Artificial Sequence
  chemically synthesized
catcgtgcttctagtgagaaat

SEQ ID NO: 729650 - DNA, 22 bp, Artificial Sequence
  chemically synthesized
aatactgtgcaactatttctca

SEQ ID NO: 729651 - DNA, 22 bp, Artificial Sequence
  chemically synthesized
aaatactgtgcaactatttctc

SEQ ID NO: 729652 - DNA, 22 bp, Artificial Sequence
  chemically synthesized
cttaaatactgtgcaactattt

SEQ ID NO: 729653 - DNA, 22 bp, Artificial Sequence
  chemically synthesized
ctagtgagaaatagttgcacag

SEQ ID NO: 729654 - DNA, 22 bp, Artificial Sequence
  chemically synthesized
tagtgagaaatagttgcacagt

SEQ ID NO: 729655 - DNA, 22 bp, Artificial Sequence
  chemically synthesized
gtgagaaatagttgcacagtat

SEQ ID NO: 729656 - DNA, 22 bp, Artificial Sequence
  chemically synthesized
cataatgaacaactccttaaat

SEQ ID NO: 729657 - DNA, 22 bp, Artificial Sequence
  chemically synthesized
cacagtatttaaggagttgttc

SEQ ID NO: 729658 - DNA, 22 bp, Artificial Sequence
  chemically synthesized
ccattacataatgaacaactcc

SEQ ID NO: 729659 - DNA, 22 bp, Artificial Sequence
  chemically synthesized
aaggagttgttcattatgtaat

SEQ ID NO: 729660 - DNA, 22 bp, Artificial Sequence
  chemically synthesized
aggagttgttcattatgtaatg

SEQ ID NO: 729661 - DNA, 22 bp, Artificial Sequence
  chemically synthesized
agcacaaagttcccattacata

SEQ ID NO: 729662 - DNA, 22 bp, Artificial Sequence
  chemically synthesized
taagcacaaagttcccattaca

SEQ ID NO: 729663 - DNA, 22 bp, Artificial Sequence
  chemically synthesized
ttctaagcacaaagttcccatt

SEQ ID NO: 729664 - DNA, 22 bp, Artificial Sequence
  chemically synthesized
ttcattatgtaatgggaacttt

SEQ ID NO: 729665 - DNA, 22 bp, Artificial Sequence
  chemically synthesized
attatgtaatgggaactttgtg

SEQ ID NO: 729666 - DNA, 22 bp, Artificial Sequence
  chemically synthesized
tggagctgttctaagcacaaag

SEQ ID NO: 729667 - DNA, 22 bp, Artificial Sequence
  chemically synthesized
tgtaatgggaactttgtgctta

SEQ ID NO: 729668 - DNA, 22 bp, Artificial Sequence
  chemically synthesized
cctgtggagctgttctaagcac

SEQ ID NO: 729669 - DNA, 22 bp, Artificial Sequence
  chemically synthesized
tccctgtggagctgttctaagc

SEQ ID NO: 729670 - DNA, 22 bp, Artificial Sequence
  chemically synthesized
ctccctgtggagctgttctaag

SEQ ID NO: 729671 - DNA, 22 bp, Artificial Sequence
  chemically synthesized
cttctccctgtggagctgttct

SEQ ID NO: 729672 - DNA, 22 bp, Artificial Sequence
  chemically synthesized
ttgcttctccctgtggagctgt

SEQ ID NO: 729673 - DNA, 22 bp, Artificial Sequence
  chemically synthesized
tgtgcttagaacagctccacag

SEQ ID NO: 729674 - DNA, 22 bp, Artificial Sequence
  chemically synthesized
tattgcttctccctgtggagct

SEQ ID NO: 729675 - DNA, 22 bp, Artificial Sequence
  chemically synthesized
gtgcttagaacagctccacagg

SEQ ID NO: 729676 - DNA, 22 bp, Artificial Sequence
  chemically synthesized
tgcttagaacagctccacaggg

SEQ ID NO: 729677 - DNA, 22 bp, Artificial Sequence
  chemically synthesized
gctctattgcttctccctgtgg

SEQ ID NO: 729678 - DNA, 22 bp, Artificial Sequence
  chemically synthesized
agaacagctccacagggagaag

SEQ ID NO: 729679 - DNA, 22 bp, Artificial Sequence
  chemically synthesized
gaacagctccacagggagaagc

SEQ ID NO: 729680 - DNA, 22 bp, Artificial Sequence
  chemically synthesized
catctagctctattgcttctcc

SEQ ID NO: 729681 - DNA, 22 bp, Artificial Sequence
  chemically synthesized
acatctagctctattgcttctc

SEQ ID NO: 729682 - DNA, 22 bp, Artificial Sequence
  chemically synthesized
tacatctagctctattgcttct

SEQ ID NO: 729683 - DNA, 22 bp, Artificial Sequence
  chemically synthesized
ttacatctagctctattgcttc

SEQ ID NO: 729684 - DNA, 22 bp, Artificial Sequence
  chemically synthesized
cacagggagaagcaatagagct

SEQ ID NO: 729685 - DNA, 22 bp, Artificial Sequence
  chemically synthesized
tgaaatggagaacatttttaca

SEQ ID NO: 729686 - DNA, 22 bp, Artificial Sequence
  chemically synthesized
cattgtgaaatggagaacattt

SEQ ID NO: 729687 - DNA, 22 bp, Artificial Sequence
  chemically synthesized
tacattgtgaaatggagaacat

SEQ ID NO: 729688 - DNA, 22 bp, Artificial Sequence
  chemically synthesized
ctacattgtgaaatggagaaca

SEQ ID NO: 729689 - DNA, 22 bp, Artificial Sequence
  chemically synthesized
gatgtaaaaatgttctccattt

SEQ ID NO: 729690 - DNA, 22 bp, Artificial Sequence
  chemically synthesized
aacttctacattgtgaaatgga

SEQ ID NO: 729691 - DNA, 22 bp, Artificial Sequence
  chemically synthesized
caaaaattaaacttctacattg

SEQ ID NO: 729692 - DNA, 22 bp, Artificial Sequence
  chemically synthesized
tccatttcacaatgtagaagtt

SEQ ID NO: 729693 - DNA, 22 bp, Artificial Sequence
  chemically synthesized
catttcacaatgtagaagttta

SEQ ID NO: 729694 - DNA, 22 bp, Artificial Sequence
  chemically synthesized
cacaatgtagaagtttaatttt

SEQ ID NO: 729695 - DNA, 22 bp, Artificial Sequence
  chemically synthesized
acaatgtagaagtttaattttt

SEQ ID NO: 729696 - DNA, 22 bp, Artificial Sequence
  chemically synthesized
tgatagtataaggaaaagtata

SEQ ID NO: 729697 - DNA, 22 bp, Artificial Sequence
  chemically synthesized
aatttttgcagtatacttttcc

SEQ ID NO: 729698 - DNA, 22 bp, Artificial Sequence
  chemically synthesized
atttttgcagtatacttttcct

SEQ ID NO: 729699 - DNA, 22 bp, Artificial Sequence
  chemically synthesized
ttgcagtatacttttccttata

SEQ ID NO: 729700 - DNA, 22 bp, Artificial Sequence
  chemically synthesized
tgcagtatacttttccttatac

SEQ ID NO: 729701 - DNA, 22 bp, Artificial Sequence
  chemically synthesized
gcagtatacttttccttatact

SEQ ID NO: 729702 - DNA, 22 bp, Artificial Sequence
  chemically synthesized
cagtatacttttccttatacta

SEQ ID NO: 729703 - DNA, 22 bp, Artificial Sequence
  chemically synthesized
cccaacatgtaaaattatgata

SEQ ID NO: 729704 - DNA, 22 bp, Artificial Sequence
  chemically synthesized
acccaacatgtaaaattatgat

SEQ ID NO: 729705 - DNA, 22 bp, Artificial Sequence
  chemically synthesized
ttccttatactatcataatttt

SEQ ID NO: 729706 - DNA, 22 bp, Artificial Sequence
  chemically synthesized
tccttatactatcataatttta

SEQ ID NO: 729707 - DNA, 22 bp, Artificial Sequence
  chemically synthesized
ttacccaacatgtaaaattatg

SEQ ID NO: 729708 - DNA, 22 bp, Artificial Sequence
  chemically synthesized
ccttatactatcataattttac

SEQ ID NO: 729709 - DNA, 22 bp, Artificial Sequence
  chemically synthesized
cttatactatcataattttaca

SEQ ID NO: 729710 - DNA, 22 bp, Artificial Sequence
  chemically synthesized
atactatcataattttacatgt

SEQ ID NO: 729711 - DNA, 22 bp, Artificial Sequence
  chemically synthesized
tactatcataattttacatgtt

SEQ ID NO: 729712 - DNA, 22 bp, Artificial Sequence
  chemically synthesized
atggaaattcttacccaacatg

SEQ ID NO: 729713 - DNA, 22 bp, Artificial Sequence
  chemically synthesized
tcataattttacatgttgggta

SEQ ID NO: 729714 - DNA, 22 bp, Artificial Sequence
  chemically synthesized
tacatgttgggtaagaatttcc

SEQ ID NO: 729715 - DNA, 22 bp, Artificial Sequence
  chemically synthesized
acatgttgggtaagaatttcca

SEQ ID NO: 729716 - DNA, 22 bp, Artificial Sequence
  chemically synthesized
catgttgggtaagaatttccat

SEQ ID NO: 729717 - DNA, 22 bp, Artificial Sequence
  chemically synthesized
tacatagaattcatggaaattc

SEQ ID NO: 729718 - DNA, 22 bp, Artificial Sequence
  chemically synthesized
ggtaagaatttccatgaattct

SEQ ID NO: 729719 - DNA, 22 bp, Artificial Sequence
  chemically synthesized
ccatgaattctatgtacaattt

SEQ ID NO: 729720 - DNA, 22 bp, Artificial Sequence
  chemically synthesized
catgaattctatgtacaatttg

SEQ ID NO: 729721 - DNA, 22 bp, Artificial Sequence
  chemically synthesized
tatgtacaatttggcctcctgt

SEQ ID NO: 729722 - DNA, 22 bp, Artificial Sequence
  chemically synthesized
tgtacaatttggcctcctgtca

SEQ ID NO: 729723 - DNA, 22 bp, Artificial Sequence
  chemically synthesized
ggcctcctgtcatctttgtttt

SEQ ID NO: 729724 - DNA, 22 bp, Artificial Sequence
  chemically synthesized
gcctcctgtcatctttgttttg

SEQ ID NO: 729725 - DNA, 22 bp, Artificial Sequence
  chemically synthesized
ctgtcatctttgttttgccctc

SEQ ID NO: 729726 - DNA, 22 bp, Artificial Sequence
  chemically synthesized
taagagaaagggagagggcaaa

SEQ ID NO: 729727 - DNA, 22 bp, Artificial Sequence
  chemically synthesized
tcatctttgttttgccctctcc

SEQ ID NO: 729728 - DNA, 22 bp, Artificial Sequence
  chemically synthesized
caactataagagaaagggagag

SEQ ID NO: 729729 - DNA, 22 bp, Artificial Sequence
  chemically synthesized
tgttttgccctctccctttctc

SEQ ID NO: 729730 - DNA, 22 bp, Artificial Sequence
  chemically synthesized
gttttgccctctccctttctct

SEQ ID NO: 729731 - DNA, 22 bp, Artificial Sequence
  chemically synthesized
attccaactataagagaaaggg

SEQ ID NO: 729732 - DNA, 22 bp, Artificial Sequence
  chemically synthesized
ttttgccctctccctttctctt

SEQ ID NO: 729733 - DNA, 22 bp, Artificial Sequence
  chemically synthesized
cattccaactataagagaaagg

SEQ ID NO: 729734 - DNA, 22 bp, Artificial Sequence
  chemically synthesized
tgccctctccctttctcttata

SEQ ID NO: 729735 - DNA, 22 bp, Artificial Sequence
  chemically synthesized
tttcattccaactataagagaa

SEQ ID NO: 729736 - DNA, 22 bp, Artificial Sequence
  chemically synthesized
gccctctccctttctcttatag

SEQ ID NO: 729737 - DNA, 22 bp, Artificial Sequence
  chemically synthesized
ccctctccctttctcttatagt

SEQ ID NO: 729738 - DNA, 22 bp, Artificial Sequence
  chemically synthesized
tgtttcattccaactataagag

SEQ ID NO: 729739 - DNA, 22 bp, Artificial Sequence
  chemically synthesized
ctctgtttcattccaactataa

SEQ ID NO: 729740 - DNA, 22 bp, Artificial Sequence
  chemically synthesized
cctctgtttcattccaactata

SEQ ID NO: 729741 - DNA, 22 bp, Artificial Sequence
  chemically synthesized
tccctttctcttatagttggaa

SEQ ID NO: 729742 - DNA, 22 bp, Artificial Sequence
  chemically synthesized
cctttctcttatagttggaatg

SEQ ID NO: 729743 - DNA, 22 bp, Artificial Sequence
  chemically synthesized
cttcctctgtttcattccaact

SEQ ID NO: 729744 - DNA, 22 bp, Artificial Sequence
  chemically synthesized
ctccttcctctgtttcattcca

SEQ ID NO: 729745 - DNA, 22 bp, Artificial Sequence
  chemically synthesized
tctcttatagttggaatgaaac

SEQ ID NO: 729746 - DNA, 22 bp, Artificial Sequence
  chemically synthesized
ctcttatagttggaatgaaaca

SEQ ID NO: 729747 - DNA, 22 bp, Artificial Sequence
  chemically synthesized
tcttatagttggaatgaaacag

SEQ ID NO: 729748 - DNA, 22 bp, Artificial Sequence
  chemically synthesized
tctactccttcctctgtttcat

SEQ ID NO: 729749 - DNA, 22 bp, Artificial Sequence
  chemically synthesized
ttatagttggaatgaaacagag

SEQ ID NO: 729750 - DNA, 22 bp, Artificial Sequence
  chemically synthesized
atagttggaatgaaacagagga

SEQ ID NO: 729751 - DNA, 22 bp, Artificial Sequence
  chemically synthesized
tagttggaatgaaacagaggaa

SEQ ID NO: 729752 - DNA, 22 bp, Artificial Sequence
  chemically synthesized
gaatgaaacagaggaaggagta

SEQ ID NO: 729753 - DNA, 22 bp, Artificial Sequence
  chemically synthesized
aaaatgtaatgtaggtcaaaat

SEQ ID NO: 729754 - DNA, 22 bp, Artificial Sequence
  chemically synthesized
tcaaaatgtaatgtaggtcaaa

SEQ ID NO: 729755 - DNA, 22 bp, Artificial Sequence
  chemically synthesized
tttctgattttgacctacatta

SEQ ID NO: 729756 - DNA, 22 bp, Artificial Sequence
  chemically synthesized
ttctgattttgacctacattac

SEQ ID NO: 729757 - DNA, 22 bp, Artificial Sequence
  chemically synthesized
aactctcaaaatgtaatgtagg

SEQ ID NO: 729758 - DNA, 22 bp, Artificial Sequence
  chemically synthesized
tctgattttgacctacattaca

SEQ ID NO: 729759 - DNA, 22 bp, Artificial Sequence
  chemically synthesized
ctgattttgacctacattacat

SEQ ID NO: 729760 - DNA, 22 bp, Artificial Sequence
  chemically synthesized
taaactctcaaaatgtaatgta

SEQ ID NO: 729761 - DNA, 22 bp, Artificial Sequence
  chemically synthesized
tgattttgacctacattacatt

SEQ ID NO: 729762 - DNA, 22 bp, Artificial Sequence
  chemically synthesized
attttgacctacattacatttt

SEQ ID NO: 729763 - DNA, 22 bp, Artificial Sequence
  chemically synthesized
ctctaaactctcaaaatgtaat

SEQ ID NO: 729764 - DNA, 22 bp, Artificial Sequence
  chemically synthesized
tgacctacattacattttgaga

SEQ ID NO: 729765 - DNA, 22 bp, Artificial Sequence
  chemically synthesized
gacctacattacattttgagag

SEQ ID NO: 729766 - DNA, 22 bp, Artificial Sequence
  chemically synthesized
acctacattacattttgagagt

SEQ ID NO: 729767 - DNA, 22 bp, Artificial Sequence
  chemically synthesized
cattacattttgagagtttaga

SEQ ID NO: 729768 - DNA, 22 bp, Artificial Sequence
  chemically synthesized
tatggtccccattactctaaac

SEQ ID NO: 729769 - DNA, 22 bp, Artificial Sequence
  chemically synthesized
cattttgagagtttagagtaat

SEQ ID NO: 729770 - DNA, 22 bp, Artificial Sequence
  chemically synthesized
ttatatggtccccattactcta

SEQ ID NO: 729771 - DNA, 22 bp, Artificial Sequence
  chemically synthesized
tgagagtttagagtaatgggga

SEQ ID NO: 729772 - DNA, 22 bp, Artificial Sequence
  chemically synthesized
gagagtttagagtaatggggac

SEQ ID NO: 729773 - DNA, 22 bp, Artificial Sequence
  chemically synthesized
agagtttagagtaatggggacc

SEQ ID NO: 729774 - DNA, 22 bp, Artificial Sequence
  chemically synthesized
atattattatatggtccccatt

SEQ ID NO: 729775 - DNA, 22 bp, Artificial Sequence
  chemically synthesized
attaatattattatatggtccc

SEQ ID NO: 729776 - DNA, 22 bp, Artificial Sequence
  chemically synthesized
agagtaatggggaccatataat

SEQ ID NO: 729777 - DNA, 22 bp, Artificial Sequence
  chemically synthesized
gagtaatggggaccatataata

SEQ ID NO: 729778 - DNA, 22 bp, Artificial Sequence
  chemically synthesized
tcgattgattaatattattata

SEQ ID NO: 729779 - DNA, 22 bp, Artificial Sequence
  chemically synthesized
atcaatcgataattatatatat

SEQ ID NO: 729780 - DNA, 22 bp, Artificial Sequence
  chemically synthesized
ataaatatataaatatatatat

SEQ ID NO: 729781 - DNA, 22 bp, Artificial Sequence
  chemically synthesized
catctcataaatatataaatat

SEQ ID NO: 729782 - DNA, 22 bp, Artificial Sequence
  chemically synthesized
tatatatatatttatatattta

SEQ ID NO: 729783 - DNA, 22 bp, Artificial Sequence
  chemically synthesized
atatatttatgagatggaatct

SEQ ID NO: 729784 - DNA, 22 bp, Artificial Sequence
  chemically synthesized
agtgacagagtgagattccatc

SEQ ID NO: 729785 - DNA, 22 bp, Artificial Sequence
  chemically synthesized
tatatttatgagatggaatctc

SEQ ID NO: 729786 - DNA, 22 bp, Artificial Sequence
  chemically synthesized
cagcctgagtgacagagtgaga

SEQ ID NO: 729787 - DNA, 22 bp, Artificial Sequence
  chemically synthesized
atgagatggaatctcactctgt

SEQ ID NO: 729788 - DNA, 22 bp, Artificial Sequence
  chemically synthesized
tgagatggaatctcactctgtc

SEQ ID NO: 729789 - DNA, 22 bp, Artificial Sequence
  chemically synthesized
actccagcctgagtgacagagt

SEQ ID NO: 729790 - DNA, 22 bp, Artificial Sequence
  chemically synthesized
cactccagcctgagtgacagag

SEQ ID NO: 729791 - DNA, 22 bp, Artificial Sequence
  chemically synthesized
actctgtcactcaggctggagt

SEQ ID NO: 729792 - DNA, 22 bp, Artificial Sequence
  chemically synthesized
tgtcactcaggctggagtgaag

SEQ ID NO: 729793 - DNA, 22 bp, Artificial Sequence
  chemically synthesized
tcactcaggctggagtgaagtg

SEQ ID NO: 729794 - DNA, 22 bp, Artificial Sequence
  chemically synthesized
aggctggagtgaagtggtgcga

SEQ ID NO: 729795 - DNA, 22 bp, Artificial Sequence
  chemically synthesized
cagtgagccgagatcgcaccac

SEQ ID NO: 729796 - DNA, 22 bp, Artificial Sequence
  chemically synthesized
gagtgaagtggtgcgatctcgg

SEQ ID NO: 729797 - DNA, 22 bp, Artificial Sequence
  chemically synthesized
agaggtggaggttgcagtgagc

SEQ ID NO: 729798 - DNA, 22 bp, Artificial Sequence
  chemically synthesized
aacctgagaggtggaggttgca

SEQ ID NO: 729799 - DNA, 22 bp, Artificial Sequence
  chemically synthesized
gaacctgagaggtggaggttgc

SEQ ID NO: 729800 - DNA, 22 bp, Artificial Sequence
  chemically synthesized
ggctcactgcaacctccacctc

SEQ ID NO: 729801 - DNA, 22 bp, Artificial Sequence
  chemically synthesized
actgcaacctccacctctcagg

SEQ ID NO: 729802 - DNA, 22 bp, Artificial Sequence
  chemically synthesized
caacctccacctctcaggttca

SEQ ID NO: 729803 - DNA, 22 bp, Artificial Sequence
  chemically synthesized
atgtggaagaatcgcttgaacc

SEQ ID NO: 729804 - DNA, 22 bp, Artificial Sequence
  chemically synthesized
cacctctcaggttcaagcgatt

SEQ ID NO: 729805 - DNA, 22 bp, Artificial Sequence
  chemically synthesized
ggaggctgatgtggaagaatcg

SEQ ID NO: 729806 - DNA, 22 bp, Artificial Sequence
  chemically synthesized
tcaggttcaagcgattcttcca

SEQ ID NO: 729807 - DNA, 22 bp, Artificial Sequence
  chemically synthesized
gggaggctgatgtggaagaatc

SEQ ID NO: 729808 - DNA, 22 bp, Artificial Sequence
  chemically synthesized
aggttcaagcgattcttccaca

SEQ ID NO: 729809 - DNA, 22 bp, Artificial Sequence
  chemically synthesized
cttgggaggctgatgtggaaga

SEQ ID NO: 729810 - DNA, 22 bp, Artificial Sequence
  chemically synthesized
aagcgattcttccacatcagcc

SEQ ID NO: 729811 - DNA, 22 bp, Artificial Sequence
  chemically synthesized
tagtcccagctacttgggaggc

SEQ ID NO: 729812 - DNA, 22 bp, Artificial Sequence
  chemically synthesized
ttccacatcagcctcccaagta

SEQ ID NO: 729813 - DNA, 22 bp, Artificial Sequence
  chemically synthesized
ccacatcagcctcccaagtagc

SEQ ID NO: 729814 - DNA, 22 bp, Artificial Sequence
  chemically synthesized
cacatcagcctcccaagtagct

SEQ ID NO: 729815 - DNA, 22 bp, Artificial Sequence
  chemically synthesized
ccaagtagctgggactacaggc

SEQ ID NO: 729816 - DNA, 22 bp, Artificial Sequence
  chemically synthesized
gccaggtatggcggtacatgcc

SEQ ID NO: 729817 - DNA, 22 bp, Artificial Sequence
  chemically synthesized
ggactacaggcatgtaccgcca

SEQ ID NO: 729818 - DNA, 22 bp, Artificial Sequence
  chemically synthesized
caggcatgtaccgccatacctg

SEQ ID NO: 729819 - DNA, 22 bp, Artificial Sequence
  chemically synthesized
gctaatttttctgtgtgtgtgt

SEQ ID NO: 729820 - DNA, 22 bp, Artificial Sequence
  chemically synthesized
atttttctgtgtgtgtgttttt

SEQ ID NO: 729821 - DNA, 22 bp, Artificial Sequence
  chemically synthesized
ttctgtgtgtgtgttttttttt

SEQ ID NO: 729822 - DNA, 22 bp, Artificial Sequence
  chemically synthesized
tctgtgtgtgtgtttttttttt

SEQ ID NO: 729823 - DNA, 22 bp, Artificial Sequence
  chemically synthesized
ctgtgtgtgtgttttttttttt

SEQ ID NO: 729824 - DNA, 22 bp, Artificial Sequence
  chemically synthesized
aaaaaaaaaaaaaaaaaaaaaa

SEQ ID NO: 729825 - DNA, 22 bp, Artificial Sequence
  chemically synthesized
tgtgtgtgtgtttttttttttt

SEQ ID NO: 729826 - DNA, 22 bp, Artificial Sequence
  chemically synthesized
tgtgtgtgtttttttttttttt

SEQ ID NO: 729827 - DNA, 22 bp, Artificial Sequence
  chemically synthesized
ctgaaaaaaaaaaaaaaaaaaa

SEQ ID NO: 729828 - DNA, 22 bp, Artificial Sequence
  chemically synthesized
tactgaaaaaaaaaaaaaaaaa

SEQ ID NO: 729829 - DNA, 22 bp, Artificial Sequence
  chemically synthesized
tctctactgaaaaaaaaaaaaa

SEQ ID NO: 729830 - DNA, 22 bp, Artificial Sequence
  chemically synthesized
ttttttttttttttttttttca

SEQ ID NO: 729831 - DNA, 22 bp, Artificial Sequence
  chemically synthesized
tttttttttttttttttttcag

SEQ ID NO: 729832 - DNA, 22 bp, Artificial Sequence
  chemically synthesized
ttttttttttttttttttcagt

SEQ ID NO: 729833 - DNA, 22 bp, Artificial Sequence
  chemically synthesized
tttttttttttttttttcagta

SEQ ID NO: 729834 - DNA, 22 bp, Artificial Sequence
  chemically synthesized
ttttttttttttttttcagtag

SEQ ID NO: 729835 - DNA, 22 bp, Artificial Sequence
  chemically synthesized
tttttttttttttttcagtaga

SEQ ID NO: 729836 - DNA, 22 bp, Artificial Sequence
  chemically synthesized
ttttttttttttttcagtagag

SEQ ID NO: 729837 - DNA, 22 bp, Artificial Sequence
  chemically synthesized
tttttttttttttcagtagaga

SEQ ID NO: 729838 - DNA, 22 bp, Artificial Sequence
  chemically synthesized
ttttttttttttcagtagagac

SEQ ID NO: 729839 - DNA, 22 bp, Artificial Sequence
  chemically synthesized
tttttttttttcagtagagaca

SEQ ID NO: 729840 - DNA, 22 bp, Artificial Sequence
  chemically synthesized
ttttttttttcagtagagacag

SEQ ID NO: 729841 - DNA, 22 bp, Artificial Sequence
  chemically synthesized
tttttttttcagtagagacagg

SEQ ID NO: 729842 - DNA, 22 bp, Artificial Sequence
  chemically synthesized
ttttttttcagtagagacaggg

SEQ ID NO: 729843 - DNA, 22 bp, Artificial Sequence
  chemically synthesized
tttttttcagtagagacagggt

SEQ ID NO: 729844 - DNA, 22 bp, Artificial Sequence
  chemically synthesized
ttttttcagtagagacagggtg

SEQ ID NO: 729845 - DNA, 22 bp, Artificial Sequence
  chemically synthesized
tttttcagtagagacagggtgt

SEQ ID NO: 729846 - DNA, 22 bp, Artificial Sequence
  chemically synthesized
ggcaacatggtgacaccctgtc

SEQ ID NO: 729847 - DNA, 22 bp, Artificial Sequence
  chemically synthesized
ttttcagtagagacagggtgtc

SEQ ID NO: 729848 - DNA, 22 bp, Artificial Sequence
  chemically synthesized
tttcagtagagacagggtgtca

SEQ ID NO: 729849 - DNA, 22 bp, Artificial Sequence
  chemically synthesized
ttcagtagagacagggtgtcac

SEQ ID NO: 729850 - DNA, 22 bp, Artificial Sequence
  chemically synthesized
tcagtagagacagggtgtcacc

SEQ ID NO: 729851 - DNA, 22 bp, Artificial Sequence
  chemically synthesized
cagtagagacagggtgtcacca

SEQ ID NO: 729852 - DNA, 22 bp, Artificial Sequence
  chemically synthesized
agtagagacagggtgtcaccat

SEQ ID NO: 729853 - DNA, 22 bp, Artificial Sequence
  chemically synthesized
gagaccagcctgggcaacatgg

SEQ ID NO: 729854 - DNA, 22 bp, Artificial Sequence
  chemically synthesized
aggtcaggagttcgagaccagc

SEQ ID NO: 729855 - DNA, 22 bp, Artificial Sequence
  chemically synthesized
gaggtcaggagttcgagaccag

SEQ ID NO: 729856 - DNA, 22 bp, Artificial Sequence
  chemically synthesized
cccaggctggtctcgaactcct

SEQ ID NO: 729857 - DNA, 22 bp, Artificial Sequence
  chemically synthesized
gtctcgaactcctgacctcaag

SEQ ID NO: 729858 - DNA, 22 bp, Artificial Sequence
  chemically synthesized
gaactcctgacctcaagtgatc

SEQ ID NO: 729859 - DNA, 22 bp, Artificial Sequence
  chemically synthesized
ggaggccgaagcagggggatca

SEQ ID NO: 729860 - DNA, 22 bp, Artificial Sequence
  chemically synthesized
ctgacctcaagtgatccccctg

SEQ ID NO: 729861 - DNA, 22 bp, Artificial Sequence
  chemically synthesized
gggaggccgaagcagggggatc

SEQ ID NO: 729862 - DNA, 22 bp, Artificial Sequence
  chemically synthesized
tgggaggccgaagcagggggat

SEQ ID NO: 729863 - DNA, 22 bp, Artificial Sequence
  chemically synthesized
acctcaagtgatccccctgctt

SEQ ID NO: 729864 - DNA, 22 bp, Artificial Sequence
  chemically synthesized
aagtgatccccctgcttcggcc

SEQ ID NO: 729865 - DNA, 22 bp, Artificial Sequence
  chemically synthesized
taatcccaacactttgggaggc

SEQ ID NO: 729866 - DNA, 22 bp, Artificial Sequence
  chemically synthesized
cttcggcctcccaaagtgttgg

SEQ ID NO: 729867 - DNA, 22 bp, Artificial Sequence
  chemically synthesized
acgcctgtaatcccaacacttt

SEQ ID NO: 729868 - DNA, 22 bp, Artificial Sequence
  chemically synthesized
cggcctcccaaagtgttgggat

SEQ ID NO: 729869 - DNA, 22 bp, Artificial Sequence
  chemically synthesized
ggcctcccaaagtgttgggatt

SEQ ID NO: 729870 - DNA, 22 bp, Artificial Sequence
  chemically synthesized
ccaaagtgttgggattacaggc

SEQ ID NO: 729871 - DNA, 22 bp, Artificial Sequence
  chemically synthesized
ggtgcagtggctcacgcctgta

SEQ ID NO: 729872 - DNA, 22 bp, Artificial Sequence
  chemically synthesized
ggattacaggcgtgagccactg

SEQ ID NO: 729873 - DNA, 22 bp, Artificial Sequence
  chemically synthesized
tcggggttgggtgcagtggctc

SEQ ID NO: 729874 - DNA, 22 bp, Artificial Sequence
  chemically synthesized
caggcgtgagccactgcaccca

SEQ ID NO: 729875 - DNA, 22 bp, Artificial Sequence
  chemically synthesized
cacagaaaaagttatcggggtt

SEQ ID NO: 729876 - DNA, 22 bp, Artificial Sequence
  chemically synthesized
acacagaaaaagttatcggggt

SEQ ID NO: 729877 - DNA, 22 bp, Artificial Sequence
  chemically synthesized
cacccaaccccgataacttttt

SEQ ID NO: 729878 - DNA, 22 bp, Artificial Sequence
  chemically synthesized
cgcccttacacagaaaaagtta

SEQ ID NO: 729879 - DNA, 22 bp, Artificial Sequence
  chemically synthesized
aagtacctacgcccttacacag

SEQ ID NO: 729880 - DNA, 22 bp, Artificial Sequence
  chemically synthesized
aaagtacctacgcccttacaca

SEQ ID NO: 729881 - DNA, 22 bp, Artificial Sequence
  chemically synthesized
catttaaagtacctacgccctt

SEQ ID NO: 729882 - DNA, 22 bp, Artificial Sequence
  chemically synthesized
gcatttaaagtacctacgccct

SEQ ID NO: 729883 - DNA, 22 bp, Artificial Sequence
  chemically synthesized
tgcatttaaagtacctacgccc

SEQ ID NO: 729884 - DNA, 22 bp, Artificial Sequence
  chemically synthesized
tttctgtgtaagggcgtaggta

SEQ ID NO: 729885 - DNA, 22 bp, Artificial Sequence
  chemically synthesized
ttctgtgtaagggcgtaggtac

SEQ ID NO: 729886 - DNA, 22 bp, Artificial Sequence
  chemically synthesized
tctgtgtaagggcgtaggtact

SEQ ID NO: 729887 - DNA, 22 bp, Artificial Sequence
  chemically synthesized
ctgtgtaagggcgtaggtactt

SEQ ID NO: 729888 - DNA, 22 bp, Artificial Sequence
  chemically synthesized
actttgcatttaaagtacctac

SEQ ID NO: 729889 - DNA, 22 bp, Artificial Sequence
  chemically synthesized
tgtgtaagggcgtaggtacttt

SEQ ID NO: 729890 - DNA, 22 bp, Artificial Sequence
  chemically synthesized
tcactttgcatttaaagtacct

SEQ ID NO: 729891 - DNA, 22 bp, Artificial Sequence
  chemically synthesized
tgtaagggcgtaggtactttaa

SEQ ID NO: 729892 - DNA, 22 bp, Artificial Sequence
  chemically synthesized
ctcactttgcatttaaagtacc

SEQ ID NO: 729893 - DNA, 22 bp, Artificial Sequence
  chemically synthesized
catttctcactttgcatttaaa

SEQ ID NO: 729894 - DNA, 22 bp, Artificial Sequence
  chemically synthesized
gtaatactgcatttctcacttt

SEQ ID NO: 729895 - DNA, 22 bp, Artificial Sequence
  chemically synthesized
taaatgcaaagtgagaaatgca

SEQ ID NO: 729896 - DNA, 22 bp, Artificial Sequence
  chemically synthesized
ccctggtaatactgcatttctc

SEQ ID NO: 729897 - DNA, 22 bp, Artificial Sequence
  chemically synthesized
aaatgcaaagtgagaaatgcag

SEQ ID NO: 729898 - DNA, 22 bp, Artificial Sequence
  chemically synthesized
aatgcaaagtgagaaatgcagt

SEQ ID NO: 729899 - DNA, 22 bp, Artificial Sequence
  chemically synthesized
tgccctggtaatactgcatttc

SEQ ID NO: 729900 - DNA, 22 bp, Artificial Sequence
  chemically synthesized
ctgccctggtaatactgcattt

SEQ ID NO: 729901 - DNA, 22 bp, Artificial Sequence
  chemically synthesized
tctgccctggtaatactgcatt

SEQ ID NO: 729902 - DNA, 22 bp, Artificial Sequence
  chemically synthesized
ttctgccctggtaatactgcat

SEQ ID NO: 729903 - DNA, 22 bp, Artificial Sequence
  chemically synthesized
acagagcatgtttttctgccct

SEQ ID NO: 729904 - DNA, 22 bp, Artificial Sequence
  chemically synthesized
ccagggcagaaaaacatgctct

SEQ ID NO: 729905 - DNA, 22 bp, Artificial Sequence
  chemically synthesized
acataagttcacagagcatgtt

SEQ ID NO: 729906 - DNA, 22 bp, Artificial Sequence
  chemically synthesized
tgtgaacttatgtgaattcatt

SEQ ID NO: 729907 - DNA, 22 bp, Artificial Sequence
  chemically synthesized
taagtaaggaataatgaattca

SEQ ID NO: 729908 - DNA, 22 bp, Artificial Sequence
  chemically synthesized
tgaacttatgtgaattcattat

SEQ ID NO: 729909 - DNA, 22 bp, Artificial Sequence
  chemically synthesized
atgtgaattcattattccttac

SEQ ID NO: 729910 - DNA, 22 bp, Artificial Sequence
  chemically synthesized
tgtgaattcattattccttact

SEQ ID NO: 729911 - DNA, 22 bp, Artificial Sequence
  chemically synthesized
attattccttacttacaatgat

SEQ ID NO: 729912 - DNA, 22 bp, Artificial Sequence
  chemically synthesized
cagggatgtgaacaatcattgt

SEQ ID NO: 729913 - DNA, 22 bp, Artificial Sequence
  chemically synthesized
ttccttacttacaatgattgtt

SEQ ID NO: 729914 - DNA, 22 bp, Artificial Sequence
  chemically synthesized
ctacagggatgtgaacaatcat

SEQ ID NO: 729915 - DNA, 22 bp, Artificial Sequence
  chemically synthesized
actacagggatgtgaacaatca

SEQ ID NO: 729916 - DNA, 22 bp, Artificial Sequence
  chemically synthesized
cttacttacaatgattgttcac

SEQ ID NO: 729917 - DNA, 22 bp, Artificial Sequence
  chemically synthesized
tactacagggatgtgaacaatc

SEQ ID NO: 729918 - DNA, 22 bp, Artificial Sequence
  chemically synthesized
tttactacagggatgtgaacaa

SEQ ID NO: 729919 - DNA, 22 bp, Artificial Sequence
  chemically synthesized
acttacaatgattgttcacatc

SEQ ID NO: 729920 - DNA, 22 bp, Artificial Sequence
  chemically synthesized
ctttactacagggatgtgaaca

SEQ ID NO: 729921 - DNA, 22 bp, Artificial Sequence
  chemically synthesized
cttacaatgattgttcacatcc

SEQ ID NO: 729922 - DNA, 22 bp, Artificial Sequence
  chemically synthesized
acaatgattgttcacatccctg

SEQ ID NO: 729923 - DNA, 22 bp, Artificial Sequence
  chemically synthesized
caatgattgttcacatccctgt

SEQ ID NO: 729924 - DNA, 22 bp, Artificial Sequence
  chemically synthesized
ttcacatccctgtagtaaagaa

SEQ ID NO: 729925 - DNA, 22 bp, Artificial Sequence
  chemically synthesized
taagtagagaagtttctttact

SEQ ID NO: 729926 - DNA, 22 bp, Artificial Sequence
  chemically synthesized
acatccctgtagtaaagaaact

SEQ ID NO: 729927 - DNA, 22 bp, Artificial Sequence
  chemically synthesized
tgggaagttgtaagtagagaag

SEQ ID NO: 729928 - DNA, 22 bp, Artificial Sequence
  chemically synthesized
tagtaaagaaacttctctactt

SEQ ID NO: 729929 - DNA, 22 bp, Artificial Sequence
  chemically synthesized
cctatgggaagttgtaagtaga

SEQ ID NO: 729930 - DNA, 22 bp, Artificial Sequence
  chemically synthesized
ctacctatgggaagttgtaagt

SEQ ID NO: 729931 - DNA, 22 bp, Artificial Sequence
  chemically synthesized
ttgctacctatgggaagttgta

SEQ ID NO: 729932 - DNA, 22 bp, Artificial Sequence
  chemically synthesized
attgctacctatgggaagttgt

SEQ ID NO: 729933 - DNA, 22 bp, Artificial Sequence
  chemically synthesized
tattgctacctatgggaagttg

SEQ ID NO: 729934 - DNA, 22 bp, Artificial Sequence
  chemically synthesized
ctctacttacaacttcccatag

SEQ ID NO: 729935 - DNA, 22 bp, Artificial Sequence
  chemically synthesized
tctacttacaacttcccatagg

SEQ ID NO: 729936 - DNA, 22 bp, Artificial Sequence
  chemically synthesized
tacttacaacttcccataggta

SEQ ID NO: 729937 - DNA, 22 bp, Artificial Sequence
  chemically synthesized
ggacctttattgctacctatgg

SEQ ID NO: 729938 - DNA, 22 bp, Artificial Sequence
  chemically synthesized
cttacaacttcccataggtagc

SEQ ID NO: 729939 - DNA, 22 bp, Artificial Sequence
  chemically synthesized
acaacttcccataggtagcaat

SEQ ID NO: 729940 - DNA, 22 bp, Artificial Sequence
  chemically synthesized
caacttcccataggtagcaata

SEQ ID NO: 729941 - DNA, 22 bp, Artificial Sequence
  chemically synthesized
tgcctgggacctttattgctac

SEQ ID NO: 729942 - DNA, 22 bp, Artificial Sequence
  chemically synthesized
ctgtgcctgggacctttattgc

SEQ ID NO: 729943 - DNA, 22 bp, Artificial Sequence
  chemically synthesized
cccataggtagcaataaaggtc

SEQ ID NO: 729944 - DNA, 22 bp, Artificial Sequence
  chemically synthesized
tgctgtgcctgggacctttatt

SEQ ID NO: 729945 - DNA, 22 bp, Artificial Sequence
  chemically synthesized
ccataggtagcaataaaggtcc

SEQ ID NO: 729946 - DNA, 22 bp, Artificial Sequence
  chemically synthesized
ctgctgtgcctgggacctttat

SEQ ID NO: 729947 - DNA, 22 bp, Artificial Sequence
  chemically synthesized
ccatgcttctgctgtgcctggg

SEQ ID NO: 729948 - DNA, 22 bp, Artificial Sequence
  chemically synthesized
attgccatgcttctgctgtgcc

SEQ ID NO: 729949 - DNA, 22 bp, Artificial Sequence
  chemically synthesized
cattgccatgcttctgctgtgc

SEQ ID NO: 729950 - DNA, 22 bp, Artificial Sequence
  chemically synthesized
ttcattgccatgcttctgctgt

SEQ ID NO: 729951 - DNA, 22 bp, Artificial Sequence
  chemically synthesized
gtggtattcttcattgccatgc

SEQ ID NO: 729952 - DNA, 22 bp, Artificial Sequence
  chemically synthesized
ttggtggtattcttcattgcca

SEQ ID NO: 729953 - DNA, 22 bp, Artificial Sequence
  chemically synthesized
tgttggtggtattcttcattgc

SEQ ID NO: 729954 - DNA, 22 bp, Artificial Sequence
  chemically synthesized
atgtcctctgttggtggtattc

SEQ ID NO: 729955 - DNA, 22 bp, Artificial Sequence
  chemically synthesized
tgatgtcctctgttggtggtat

SEQ ID NO: 729956 - DNA, 22 bp, Artificial Sequence
  chemically synthesized
aagtaagttctgatgtcctctg

SEQ ID NO: 729957 - DNA, 22 bp, Artificial Sequence
  chemically synthesized
atggtggcctaaagtaagttct

SEQ ID NO: 729958 - DNA, 22 bp, Artificial Sequence
  chemically synthesized
agaaaacctaatggtggcctaa

SEQ ID NO: 729959 - DNA, 22 bp, Artificial Sequence
  chemically synthesized
actttaggccaccattaggttt

SEQ ID NO: 729960 - DNA, 22 bp, Artificial Sequence
  chemically synthesized
ctttaggccaccattaggtttt

SEQ ID NO: 729961 - DNA, 22 bp, Artificial Sequence
  chemically synthesized
taggccaccattaggttttctt

SEQ ID NO: 729962 - DNA, 22 bp, Artificial Sequence
  chemically synthesized
aggccaccattaggttttctta

SEQ ID NO: 729963 - DNA, 22 bp, Artificial Sequence
  chemically synthesized
ggccaccattaggttttcttag

SEQ ID NO: 729964 - DNA, 22 bp, Artificial Sequence
  chemically synthesized
ggttttcttagcctgtgttgtg

SEQ ID NO: 729965 - DNA, 22 bp, Artificial Sequence
  chemically synthesized
tcttagcctgtgttgtgttttg

SEQ ID NO: 729966 - DNA, 22 bp, Artificial Sequence
  chemically synthesized
cttagcctgtgttgtgttttgt

SEQ ID NO: 729967 - DNA, 22 bp, Artificial Sequence
  chemically synthesized
ttagcctgtgttgtgttttgtg

SEQ ID NO: 729968 - DNA, 22 bp, Artificial Sequence
  chemically synthesized
tgaaaatatgcacacaaaacac

SEQ ID NO: 729969 - DNA, 22 bp, Artificial Sequence
  chemically synthesized
agcctgtgttgtgttttgtgtg

SEQ ID NO: 729970 - DNA, 22 bp, Artificial Sequence
  chemically synthesized
gcctgtgttgtgttttgtgtgc

SEQ ID NO: 729971 - DNA, 22 bp, Artificial Sequence
  chemically synthesized
tgttgtgttttgtgtgcatatt

SEQ ID NO: 729972 - DNA, 22 bp, Artificial Sequence
  chemically synthesized
taaaacattatgaaaatatgca

SEQ ID NO: 729973 - DNA, 22 bp, Artificial Sequence
  chemically synthesized
ataaaacattatgaaaatatgc

SEQ ID NO: 729974 - DNA, 22 bp, Artificial Sequence
  chemically synthesized
tgttttgtgtgcatattttcat

SEQ ID NO: 729975 - DNA, 22 bp, Artificial Sequence
  chemically synthesized
tgtgtgcatattttcataatgt

SEQ ID NO: 729976 - DNA, 22 bp, Artificial Sequence
  chemically synthesized
gtgtgcatattttcataatgtt

SEQ ID NO: 729977 - DNA, 22 bp, Artificial Sequence
  chemically synthesized
tgtgcatattttcataatgttt

SEQ ID NO: 729978 - DNA, 22 bp, Artificial Sequence
  chemically synthesized
ataataatatttataaaacatt

SEQ ID NO: 729979 - DNA, 22 bp, Artificial Sequence
  chemically synthesized
tcataatgttttataaatatta

SEQ ID NO: 729980 - DNA, 22 bp, Artificial Sequence
  chemically synthesized
cataatgttttataaatattat

SEQ ID NO: 729981 - DNA, 22 bp, Artificial Sequence
  chemically synthesized
ataatgttttataaatattatt

SEQ ID NO: 729982 - DNA, 22 bp, Artificial Sequence
  chemically synthesized
aacatagcggtgttaataataa

SEQ ID NO: 729983 - DNA, 22 bp, Artificial Sequence
  chemically synthesized
gaacatagcggtgttaataata

SEQ ID NO: 729984 - DNA, 22 bp, Artificial Sequence
  chemically synthesized
tgaacatagcggtgttaataat

SEQ ID NO: 729985 - DNA, 22 bp, Artificial Sequence
  chemically synthesized
ttgaacatagcggtgttaataa

SEQ ID NO: 729986 - DNA, 22 bp, Artificial Sequence
  chemically synthesized
tataaatattattattaacacc

SEQ ID NO: 729987 - DNA, 22 bp, Artificial Sequence
  chemically synthesized
ataaatattattattaacaccg

SEQ ID NO: 729988 - DNA, 22 bp, Artificial Sequence
  chemically synthesized
taaatattattattaacaccgc

SEQ ID NO: 729989 - DNA, 22 bp, Artificial Sequence
  chemically synthesized
tacttttgaacatagcggtgtt

SEQ ID NO: 729990 - DNA, 22 bp, Artificial Sequence
  chemically synthesized
gtacttttgaacatagcggtgt

SEQ ID NO: 729991 - DNA, 22 bp, Artificial Sequence
  chemically synthesized
tgtacttttgaacatagcggtg

SEQ ID NO: 729992 - DNA, 22 bp, Artificial Sequence
  chemically synthesized
ttgtacttttgaacatagcggt

SEQ ID NO: 729993 - DNA, 22 bp, Artificial Sequence
  chemically synthesized
ttttgtacttttgaacatagcg

SEQ ID NO: 729994 - DNA, 22 bp, Artificial Sequence
  chemically synthesized
ttattaacaccgctatgttcaa

SEQ ID NO: 729995 - DNA, 22 bp, Artificial Sequence
  chemically synthesized
actcttttgtacttttgaacat

SEQ ID NO: 729996 - DNA, 22 bp, Artificial Sequence
  chemically synthesized
ttaacaccgctatgttcaaaag

SEQ ID NO: 729997 - DNA, 22 bp, Artificial Sequence
  chemically synthesized
gactcttttgtacttttgaaca

SEQ ID NO: 729998 - DNA, 22 bp, Artificial Sequence
  chemically synthesized
tgactcttttgtacttttgaac

SEQ ID NO: 729999 - DNA, 22 bp, Artificial Sequence
  chemically synthesized
ttgactcttttgtacttttgaa

SEQ ID NO: 730000 - DNA, 22 bp, Artificial Sequence
  chemically synthesized
acaccgctatgttcaaaagtac

SEQ ID NO: 730001 - DNA, 22 bp, Artificial Sequence
  chemically synthesized
tttgactcttttgtacttttga

SEQ ID NO: 730002 - DNA, 22 bp, Artificial Sequence
  chemically synthesized
ttttgactcttttgtacttttg

SEQ ID NO: 730003 - DNA, 22 bp, Artificial Sequence
  chemically synthesized
tgttcaaaagtacaaaagagtc

SEQ ID NO: 730004 - DNA, 22 bp, Artificial Sequence
  chemically synthesized
aaggaacacttttttgactctt

SEQ ID NO: 730005 - DNA, 22 bp, Artificial Sequence
  chemically synthesized
aaaggaacacttttttgactct

SEQ ID NO: 730006 - DNA, 22 bp, Artificial Sequence
  chemically synthesized
aaaagtacaaaagagtcaaaaa

SEQ ID NO: 730007 - DNA, 22 bp, Artificial Sequence
  chemically synthesized
ttaaaggaacacttttttgact

SEQ ID NO: 730008 - DNA, 22 bp, Artificial Sequence
  chemically synthesized
cttaaaggaacacttttttgac

SEQ ID NO: 730009 - DNA, 22 bp, Artificial Sequence
  chemically synthesized
tcttaaaggaacacttttttga

SEQ ID NO: 730010 - DNA, 22 bp, Artificial Sequence
  chemically synthesized
ttcttaaaggaacacttttttg

SEQ ID NO: 730011 - DNA, 22 bp, Artificial Sequence
  chemically synthesized
ccgtagtaatcgcatgtctttt

SEQ ID NO: 730012 - DNA, 22 bp, Artificial Sequence
  chemically synthesized
ttgccgtagtaatcgcatgtct

SEQ ID NO: 730013 - DNA, 22 bp, Artificial Sequence
  chemically synthesized
gttgccgtagtaatcgcatgtc

SEQ ID NO: 730014 - DNA, 22 bp, Artificial Sequence
  chemically synthesized
ctttaagaaaagacatgcgatt

SEQ ID NO: 730015 - DNA, 22 bp, Artificial Sequence
  chemically synthesized
tgttgccgtagtaatcgcatgt

SEQ ID NO: 730016 - DNA, 22 bp, Artificial Sequence
  chemically synthesized
ttgttgccgtagtaatcgcatg

SEQ ID NO: 730017 - DNA, 22 bp, Artificial Sequence
  chemically synthesized
taagaaaagacatgcgattact

SEQ ID NO: 730018 - DNA, 22 bp, Artificial Sequence
  chemically synthesized
ttttgttgccgtagtaatcgca

SEQ ID NO: 730019 - DNA, 22 bp, Artificial Sequence
  chemically synthesized
aagaaaagacatgcgattacta

SEQ ID NO: 730020 - DNA, 22 bp, Artificial Sequence
  chemically synthesized
agaaaagacatgcgattactac

SEQ ID NO: 730021 - DNA, 22 bp, Artificial Sequence
  chemically synthesized
tcttttgttgccgtagtaatcg

SEQ ID NO: 730022 - DNA, 22 bp, Artificial Sequence
  chemically synthesized
caataagttctcttttgttgcc

SEQ ID NO: 730023 - DNA, 22 bp, Artificial Sequence
  chemically synthesized
tacaataagttctcttttgttg

SEQ ID NO: 730024 - DNA, 22 bp, Artificial Sequence
  chemically synthesized
ctacaataagttctcttttgtt

SEQ ID NO: 730025 - DNA, 22 bp, Artificial Sequence
  chemically synthesized
ctacggcaacaaaagagaactt

SEQ ID NO: 730026 - DNA, 22 bp, Artificial Sequence
  chemically synthesized
cggcaacaaaagagaacttatt

SEQ ID NO: 730027 - DNA, 22 bp, Artificial Sequence
  chemically synthesized
attgtagaagggtgtacattgt

SEQ ID NO: 730028 - DNA, 22 bp, Artificial Sequence
  chemically synthesized
ttgtagaagggtgtacattgta

SEQ ID NO: 730029 - DNA, 22 bp, Artificial Sequence
  chemically synthesized
tagaagggtgtacattgtatat

SEQ ID NO: 730030 - DNA, 22 bp, Artificial Sequence
  chemically synthesized
tatatattggtcacttttgtat

SEQ ID NO: 730031 - DNA, 22 bp, Artificial Sequence
  chemically synthesized
agtccaaaatgacatacaaaag

SEQ ID NO: 730032 - DNA, 22 bp, Artificial Sequence
  chemically synthesized
aagtccaaaatgacatacaaaa

SEQ ID NO: 730033 - DNA, 22 bp, Artificial Sequence
  chemically synthesized
taagtccaaaatgacatacaaa

SEQ ID NO: 730034 - DNA, 22 bp, Artificial Sequence
  chemically synthesized
ttaagtccaaaatgacatacaa

SEQ ID NO: 730035 - DNA, 22 bp, Artificial Sequence
  chemically synthesized
cttttaagtccaaaatgacata

SEQ ID NO: 730036 - DNA, 22 bp, Artificial Sequence
  chemically synthesized
ccttttaagtccaaaatgacat

SEQ ID NO: 730037 - DNA, 22 bp, Artificial Sequence
  chemically synthesized
gtcacttttgtatgtcattttg

SEQ ID NO: 730038 - DNA, 22 bp, Artificial Sequence
  chemically synthesized
atttccttttaagtccaaaatg

SEQ ID NO: 730039 - DNA, 22 bp, Artificial Sequence
  chemically synthesized
ttgtatgtcattttggacttaa

SEQ ID NO: 730040 - DNA, 22 bp, Artificial Sequence
  chemically synthesized
tgtatgtcattttggacttaaa

SEQ ID NO: 730041 - DNA, 22 bp, Artificial Sequence
  chemically synthesized
gtatgtcattttggacttaaaa

SEQ ID NO: 730042 - DNA, 22 bp, Artificial Sequence
  chemically synthesized
tatgtcattttggacttaaaag

SEQ ID NO: 730043 - DNA, 22 bp, Artificial Sequence
  chemically synthesized
gaaattcatttccttttaagtc

SEQ ID NO: 730044 - DNA, 22 bp, Artificial Sequence
  chemically synthesized
ggaaattcatttccttttaagt

SEQ ID NO: 730045 - DNA, 22 bp, Artificial Sequence
  chemically synthesized
tttggaaattcatttcctttta

SEQ ID NO: 730046 - DNA, 22 bp, Artificial Sequence
  chemically synthesized
tggacttaaaaggaaatgaatt

SEQ ID NO: 730047 - DNA, 22 bp, Artificial Sequence
  chemically synthesized
ggacttaaaaggaaatgaattt

SEQ ID NO: 730048 - DNA, 22 bp, Artificial Sequence
  chemically synthesized
gacttaaaaggaaatgaatttc

SEQ ID NO: 730049 - DNA, 22 bp, Artificial Sequence
  chemically synthesized
aagggctgtttggaaattcatt

SEQ ID NO: 730050 - DNA, 22 bp, Artificial Sequence
  chemically synthesized
tcaagggctgtttggaaattca

SEQ ID NO: 730051 - DNA, 22 bp, Artificial Sequence
  chemically synthesized
aaaaggaaatgaatttccaaac

SEQ ID NO: 730052 - DNA, 22 bp, Artificial Sequence
  chemically synthesized
aaaggaaatgaatttccaaaca

SEQ ID NO: 730053 - DNA, 22 bp, Artificial Sequence
  chemically synthesized
gttctcaagggctgtttggaaa

SEQ ID NO: 730054 - DNA, 22 bp, Artificial Sequence
  chemically synthesized
caaagagaattggttctcaagg

SEQ ID NO: 730055 - DNA, 22 bp, Artificial Sequence
  chemically synthesized
tacaaagagaattggttctcaa

SEQ ID NO: 730056 - DNA, 22 bp, Artificial Sequence
  chemically synthesized
ccaaacagcccttgagaaccaa

SEQ ID NO: 730057 - DNA, 22 bp, Artificial Sequence
  chemically synthesized
caaacagcccttgagaaccaat

SEQ ID NO: 730058 - DNA, 22 bp, Artificial Sequence
  chemically synthesized
tctacaaagagaattggttctc

SEQ ID NO: 730059 - DNA, 22 bp, Artificial Sequence
  chemically synthesized
ctctacaaagagaattggttct

SEQ ID NO: 730060 - DNA, 22 bp, Artificial Sequence
  chemically synthesized
tctctacaaagagaattggttc

SEQ ID NO: 730061 - DNA, 22 bp, Artificial Sequence
  chemically synthesized
ctttctctacaaagagaattgg

SEQ ID NO: 730062 - DNA, 22 bp, Artificial Sequence
  chemically synthesized
gagaaccaattctctttgtaga

SEQ ID NO: 730063 - DNA, 22 bp, Artificial Sequence
  chemically synthesized
agaaccaattctctttgtagag

SEQ ID NO: 730064 - DNA, 22 bp, Artificial Sequence
  chemically synthesized
tagacaacatacaacctccttt

SEQ ID NO: 730065 - DNA, 22 bp, Artificial Sequence
  chemically synthesized
tctttgtagagaaaggaggttg

SEQ ID NO: 730066 - DNA, 22 bp, Artificial Sequence
  chemically synthesized
atagacaacatacaacctcctt

SEQ ID NO: 730067 - DNA, 22 bp, Artificial Sequence
  chemically synthesized
tttgtagagaaaggaggttgta

SEQ ID NO: 730068 - DNA, 22 bp, Artificial Sequence
  chemically synthesized
tgtagagaaaggaggttgtatg

SEQ ID NO: 730069 - DNA, 22 bp, Artificial Sequence
  chemically synthesized
gtagagaaaggaggttgtatgt

SEQ ID NO: 730070 - DNA, 22 bp, Artificial Sequence
  chemically synthesized
tagagaaaggaggttgtatgtt

SEQ ID NO: 730071 - DNA, 22 bp, Artificial Sequence
  chemically synthesized
taatttatagacaacatacaac

SEQ ID NO: 730072 - DNA, 22 bp, Artificial Sequence
  chemically synthesized
tgatcctataatttatagacaa

SEQ ID NO: 730073 - DNA, 22 bp, Artificial Sequence
  chemically synthesized
tatgttgtctataaattatagg

SEQ ID NO: 730074 - DNA, 22 bp, Artificial Sequence
  chemically synthesized
tctataaattataggatcatag

SEQ ID NO: 730075 - DNA, 22 bp, Artificial Sequence
  chemically synthesized
taaattataggatcatagactc

SEQ ID NO: 730076 - DNA, 22 bp, Artificial Sequence
  chemically synthesized
aaaaaacaaacaaaaagagtct

SEQ ID NO: 730077 - DNA, 22 bp, Artificial Sequence
  chemically synthesized
taggatcatagactctttttgt

SEQ ID NO: 730078 - DNA, 22 bp, Artificial Sequence
  chemically synthesized
actcaaaaaacaaacaaaaaga

SEQ ID NO: 730079 - DNA, 22 bp, Artificial Sequence
  chemically synthesized
taactcaaaaaacaaacaaaaa

SEQ ID NO: 730080 - DNA, 22 bp, Artificial Sequence
  chemically synthesized
tttttgtttgttttttgagtta

SEQ ID NO: 730081 - DNA, 22 bp, Artificial Sequence
  chemically synthesized
tttgtttgttttttgagttaga

SEQ ID NO: 730082 - DNA, 22 bp, Artificial Sequence
  chemically synthesized
ttgtttgttttttgagttagag

SEQ ID NO: 730083 - DNA, 22 bp, Artificial Sequence
  chemically synthesized
tgtttgttttttgagttagagt

SEQ ID NO: 730084 - DNA, 22 bp, Artificial Sequence
  chemically synthesized
ggtgacagtgagactctaactc

SEQ ID NO: 730085 - DNA, 22 bp, Artificial Sequence
  chemically synthesized
gtttgttttttgagttagagtc

SEQ ID NO: 730086 - DNA, 22 bp, Artificial Sequence
  chemically synthesized
tttgttttttgagttagagtct

SEQ ID NO: 730087 - DNA, 22 bp, Artificial Sequence
  chemically synthesized
gttttttgagttagagtctcac

SEQ ID NO: 730088 - DNA, 22 bp, Artificial Sequence
  chemically synthesized
ttttttgagttagagtctcact

SEQ ID NO: 730089 - DNA, 22 bp, Artificial Sequence
  chemically synthesized
cagcctgggtgacagtgagact

SEQ ID NO: 730090 - DNA, 22 bp, Artificial Sequence
  chemically synthesized
tttgagttagagtctcactgtc

SEQ ID NO: 730091 - DNA, 22 bp, Artificial Sequence
  chemically synthesized
ttgagttagagtctcactgtca

SEQ ID NO: 730092 - DNA, 22 bp, Artificial Sequence
  chemically synthesized
tgagttagagtctcactgtcac

SEQ ID NO: 730093 - DNA, 22 bp, Artificial Sequence
  chemically synthesized
gagttagagtctcactgtcacc

SEQ ID NO: 730094 - DNA, 22 bp, Artificial Sequence
  chemically synthesized
cactccagcctgggtgacagtg

SEQ ID NO: 730095 - DNA, 22 bp, Artificial Sequence
  chemically synthesized
agttagagtctcactgtcaccc

SEQ ID NO: 730096 - DNA, 22 bp, Artificial Sequence
  chemically synthesized
gagtctcactgtcacccaggct

SEQ ID NO: 730097 - DNA, 22 bp, Artificial Sequence
  chemically synthesized
actgtcacccaggctggagtgc

SEQ ID NO: 730098 - DNA, 22 bp, Artificial Sequence
  chemically synthesized
tcacccaggctggagtgcagtg

SEQ ID NO: 730099 - DNA, 22 bp, Artificial Sequence
  chemically synthesized
cagtgagccgagatcgtgccac

SEQ ID NO: 730100 - DNA, 22 bp, Artificial Sequence
  chemically synthesized
gagtgcagtggcacgatctcgg

SEQ ID NO: 730101 - DNA, 22 bp, Artificial Sequence
  chemically synthesized
aacccaggaggccaaggttaca

SEQ ID NO: 730102 - DNA, 22 bp, Artificial Sequence
  chemically synthesized
gaacccaggaggccaaggttac

SEQ ID NO: 730103 - DNA, 22 bp, Artificial Sequence
  chemically synthesized
ggctcactgtaaccttggcctc

SEQ ID NO: 730104 - DNA, 22 bp, Artificial Sequence
  chemically synthesized
actgtaaccttggcctcctggg

SEQ ID NO: 730105 - DNA, 22 bp, Artificial Sequence
  chemically synthesized
taaccttggcctcctgggttca

SEQ ID NO: 730106 - DNA, 22 bp, Artificial Sequence
  chemically synthesized
aggcaggagaatagcttgaacc

SEQ ID NO: 730107 - DNA, 22 bp, Artificial Sequence
  chemically synthesized
ggcctcctgggttcaagctatt

SEQ ID NO: 730108 - DNA, 22 bp, Artificial Sequence
  chemically synthesized
gcctcctgggttcaagctattc

SEQ ID NO: 730109 - DNA, 22 bp, Artificial Sequence
  chemically synthesized
ctgggttcaagctattctcctg

SEQ ID NO: 730110 - DNA, 22 bp, Artificial Sequence
  chemically synthesized
gggaggctgaggcaggagaata

SEQ ID NO: 730111 - DNA, 22 bp, Artificial Sequence
  chemically synthesized
ggttcaagctattctcctgcct

SEQ ID NO: 730112 - DNA, 22 bp, Artificial Sequence
  chemically synthesized
ctcgggaggctgaggcaggaga

SEQ ID NO: 730113 - DNA, 22 bp, Artificial Sequence
  chemically synthesized
aagctattctcctgcctcagcc

SEQ ID NO: 730114 - DNA, 22 bp, Artificial Sequence
  chemically synthesized
ttctcctgcctcagcctcccga

SEQ ID NO: 730115 - DNA, 22 bp, Artificial Sequence
  chemically synthesized
tagtcccagctactcgggaggc

SEQ ID NO: 730116 - DNA, 22 bp, Artificial Sequence
  chemically synthesized
tcctgcctcagcctcccgagta

SEQ ID NO: 730117 - DNA, 22 bp, Artificial Sequence
  chemically synthesized
ctgcctcagcctcccgagtagc

SEQ ID NO: 730118 - DNA, 22 bp, Artificial Sequence
  chemically synthesized
cctcagcctcccgagtagctgg

SEQ ID NO: 730119 - DNA, 22 bp, Artificial Sequence
  chemically synthesized
agcctcccgagtagctgggact

SEQ ID NO: 730120 - DNA, 22 bp, Artificial Sequence
  chemically synthesized
ccgagtagctgggactacagtt

SEQ ID NO: 730121 - DNA, 22 bp, Artificial Sequence
  chemically synthesized
ggtgtggtggcaggcaactgta

SEQ ID NO: 730122 - DNA, 22 bp, Artificial Sequence
  chemically synthesized
gctgggtgtggtggcaggcaac

SEQ ID NO: 730123 - DNA, 22 bp, Artificial Sequence
  chemically synthesized
ggactacagttgcctgccacca

SEQ ID NO: 730124 - DNA, 22 bp, Artificial Sequence
  chemically synthesized
cagttgcctgccaccacaccca

SEQ ID NO: 730125 - DNA, 22 bp, Artificial Sequence
  chemically synthesized
aaagtacaaaaattagctgggt

SEQ ID NO: 730126 - DNA, 22 bp, Artificial Sequence
  chemically synthesized
cctgccaccacacccagctaat

SEQ ID NO: 730127 - DNA, 22 bp, Artificial Sequence
  chemically synthesized
ctaaaagtacaaaaattagctg

SEQ ID NO: 730128 - DNA, 22 bp, Artificial Sequence
  chemically synthesized
ccaccacacccagctaattttt

SEQ ID NO: 730129 - DNA, 22 bp, Artificial Sequence
  chemically synthesized
tactaaaagtacaaaaattagc

SEQ ID NO: 730130 - DNA, 22 bp, Artificial Sequence
  chemically synthesized
tctctactaaaagtacaaaaat

SEQ ID NO: 730131 - DNA, 22 bp, Artificial Sequence
  chemically synthesized
atttttgtacttttagtagaga

SEQ ID NO: 730132 - DNA, 22 bp, Artificial Sequence
  chemically synthesized
ttgtacttttagtagagacagg

SEQ ID NO: 730133 - DNA, 22 bp, Artificial Sequence
  chemically synthesized
tgtacttttagtagagacaggg

SEQ ID NO: 730134 - DNA, 22 bp, Artificial Sequence
  chemically synthesized
gtacttttagtagagacagggt

SEQ ID NO: 730135 - DNA, 22 bp, Artificial Sequence
  chemically synthesized
tacttttagtagagacagggtt

SEQ ID NO: 730136 - DNA, 22 bp, Artificial Sequence
  chemically synthesized
ttagtagagacagggtttcgtc

SEQ ID NO: 730137 - DNA, 22 bp, Artificial Sequence
  chemically synthesized
tagtagagacagggtttcgtca

SEQ ID NO: 730138 - DNA, 22 bp, Artificial Sequence
  chemically synthesized
agtagagacagggtttcgtcat

SEQ ID NO: 730139 - DNA, 22 bp, Artificial Sequence
  chemically synthesized
gtagagacagggtttcgtcatg

SEQ ID NO: 730140 - DNA, 22 bp, Artificial Sequence
  chemically synthesized
aggccagtccggccaacatgac

SEQ ID NO: 730141 - DNA, 22 bp, Artificial Sequence
  chemically synthesized
gaggccagtccggccaacatga

SEQ ID NO: 730142 - DNA, 22 bp, Artificial Sequence
  chemically synthesized
cgtcatgttggccggactggcc

SEQ ID NO: 730143 - DNA, 22 bp, Artificial Sequence
  chemically synthesized
gtcatgttggccggactggcct

SEQ ID NO: 730144 - DNA, 22 bp, Artificial Sequence
  chemically synthesized
aggtcaggagtttgaggccagt

SEQ ID NO: 730145 - DNA, 22 bp, Artificial Sequence
  chemically synthesized
gaggtcaggagtttgaggccag

SEQ ID NO: 730146 - DNA, 22 bp, Artificial Sequence
  chemically synthesized
gccggactggcctcaaactcct

SEQ ID NO: 730147 - DNA, 22 bp, Artificial Sequence
  chemically synthesized
gcctcaaactcctgacctcaag

SEQ ID NO: 730148 - DNA, 22 bp, Artificial Sequence
  chemically synthesized
gaggcagggggatcacttgagg

SEQ ID NO: 730149 - DNA, 22 bp, Artificial Sequence
  chemically synthesized
aaactcctgacctcaagtgatc

SEQ ID NO: 730150 - DNA, 22 bp, Artificial Sequence
  chemically synthesized
tggaggcagggggatcacttga

SEQ ID NO: 730151 - DNA, 22 bp, Artificial Sequence
  chemically synthesized
ctgacctcaagtgatccccctg

SEQ ID NO: 730152 - DNA, 22 bp, Artificial Sequence
  chemically synthesized
acctcaagtgatccccctgcct

SEQ ID NO: 730153 - DNA, 22 bp, Artificial Sequence
  chemically synthesized
aagtgatccccctgcctccaga

SEQ ID NO: 730154 - DNA, 22 bp, Artificial Sequence
  chemically synthesized
cctccagagatgatctggctgg

SEQ ID NO: 730155 - DNA, 22 bp, Artificial Sequence
  chemically synthesized
cagagatgatctggctgggcgt

SEQ ID NO: 730156 - DNA, 22 bp, Artificial Sequence
  chemically synthesized
caggcatgagccaccacgccca

SEQ ID NO: 730157 - DNA, 22 bp, Artificial Sequence
  chemically synthesized
ggattacaggcatgagccacca

SEQ ID NO: 730158 - DNA, 22 bp, Artificial Sequence
  chemically synthesized
gctgggcgtggtggctcatgcc

SEQ ID NO: 730159 - DNA, 22 bp, Artificial Sequence
  chemically synthesized
ggattgggattacaggcatgag

SEQ ID NO: 730160 - DNA, 22 bp, Artificial Sequence
  chemically synthesized
ggcgtggtggctcatgcctgta

SEQ ID NO: 730161 - DNA, 22 bp, Artificial Sequence
  chemically synthesized
agtgctgggattgggattacag

SEQ ID NO: 730162 - DNA, 22 bp, Artificial Sequence
  chemically synthesized
cctaagtgctgggattgggatt

SEQ ID NO: 730163 - DNA, 22 bp, Artificial Sequence
  chemically synthesized
atgcctgtaatcccaatcccag

SEQ ID NO: 730164 - DNA, 22 bp, Artificial Sequence
  chemically synthesized
gacctccctaagtgctgggatt

SEQ ID NO: 730165 - DNA, 22 bp, Artificial Sequence
  chemically synthesized
taatcccaatcccagcacttag

SEQ ID NO: 730166 - DNA, 22 bp, Artificial Sequence
  chemically synthesized
gcccgcctcgacctccctaagt

SEQ ID NO: 730167 - DNA, 22 bp, Artificial Sequence
  chemically synthesized
aggtgactcgcccgcctcgacc

SEQ ID NO: 730168 - DNA, 22 bp, Artificial Sequence
  chemically synthesized
acctcaggtgactcgcccgcct

SEQ ID NO: 730169 - DNA, 22 bp, Artificial Sequence
  chemically synthesized
agggaggtcgaggcgggcgagt

SEQ ID NO: 730170 - DNA, 22 bp, Artificial Sequence
  chemically synthesized
gggaggtcgaggcgggcgagtc

SEQ ID NO: 730171 - DNA, 22 bp, Artificial Sequence
  chemically synthesized
ctgacctcaggtgactcgcccg

SEQ ID NO: 730172 - DNA, 22 bp, Artificial Sequence
  chemically synthesized
gaactcctgacctcaggtgact

SEQ ID NO: 730173 - DNA, 22 bp, Artificial Sequence
  chemically synthesized
gtctcgaactcctgacctcagg

SEQ ID NO: 730174 - DNA, 22 bp, Artificial Sequence
  chemically synthesized
gccaggctggtctcgaactcct

SEQ ID NO: 730175 - DNA, 22 bp, Artificial Sequence
  chemically synthesized
aggtcaggagttcgagaccagc

SEQ ID NO: 730176 - DNA, 22 bp, Artificial Sequence
  chemically synthesized
accgtgttggccaggctggtct

SEQ ID NO: 730177 - DNA, 22 bp, Artificial Sequence
  chemically synthesized
caccgtgttggccaggctggtc

SEQ ID NO: 730178 - DNA, 22 bp, Artificial Sequence
  chemically synthesized
gagaccagcctggccaacacgg

SEQ ID NO: 730179 - DNA, 22 bp, Artificial Sequence
  chemically synthesized
gtagagacggggtttcaccgtg

SEQ ID NO: 730180 - DNA, 22 bp, Artificial Sequence
  chemically synthesized
agtagagacggggtttcaccgt

SEQ ID NO: 730181 - DNA, 22 bp, Artificial Sequence
  chemically synthesized
tagtagagacggggtttcaccg

SEQ ID NO: 730182 - DNA, 22 bp, Artificial Sequence
  chemically synthesized
ttagtagagacggggtttcacc

SEQ ID NO: 730183 - DNA, 22 bp, Artificial Sequence
  chemically synthesized
gccaacacggtgaaaccccgtc

SEQ ID NO: 730184 - DNA, 22 bp, Artificial Sequence
  chemically synthesized
tatttttagtagagacggggtt

SEQ ID NO: 730185 - DNA, 22 bp, Artificial Sequence
  chemically synthesized
gtatttttagtagagacggggt

SEQ ID NO: 730186 - DNA, 22 bp, Artificial Sequence
  chemically synthesized
tgtatttttagtagagacgggg

SEQ ID NO: 730187 - DNA, 22 bp, Artificial Sequence
  chemically synthesized
ttgtatttttagtagagacggg

SEQ ID NO: 730188 - DNA, 22 bp, Artificial Sequence
  chemically synthesized
atttttgtatttttagtagaga

SEQ ID NO: 730189 - DNA, 22 bp, Artificial Sequence
  chemically synthesized
gctaatttttgtatttttagta

SEQ ID NO: 730190 - DNA, 22 bp, Artificial Sequence
  chemically synthesized
tactaaaaatacaaaaattagc

SEQ ID NO: 730191 - DNA, 22 bp, Artificial Sequence
  chemically synthesized
ctaaaaatacaaaaattagcca

SEQ ID NO: 730192 - DNA, 22 bp, Artificial Sequence
  chemically synthesized
aaaatacaaaaattagccaggc

SEQ ID NO: 730193 - DNA, 22 bp, Artificial Sequence
  chemically synthesized
caggcgcccgccaccatgcctg

SEQ ID NO: 730194 - DNA, 22 bp, Artificial Sequence
  chemically synthesized
ggactgcaggcgcccgccacca

SEQ ID NO: 730195 - DNA, 22 bp, Artificial Sequence
  chemically synthesized
gccaggcatggtggcgggcgcc

SEQ ID NO: 730196 - DNA, 22 bp, Artificial Sequence
  chemically synthesized
ccgagtagctgggactgcaggc

SEQ ID NO: 730197 - DNA, 22 bp, Artificial Sequence
  chemically synthesized
agcctcccgagtagctgggact

SEQ ID NO: 730198 - DNA, 22 bp, Artificial Sequence
  chemically synthesized
cctcagcctcccgagtagctgg

SEQ ID NO: 730199 - DNA, 22 bp, Artificial Sequence
  chemically synthesized
tgcctcagcctcccgagtagct

SEQ ID NO: 730200 - DNA, 22 bp, Artificial Sequence
  chemically synthesized
ctgcctcagcctcccgagtagc

SEQ ID NO: 730201 - DNA, 22 bp, Artificial Sequence
  chemically synthesized
ttctgcctcagcctcccgagta

SEQ ID NO: 730202 - DNA, 22 bp, Artificial Sequence
  chemically synthesized
cagtcccagctactcgggaggc

SEQ ID NO: 730203 - DNA, 22 bp, Artificial Sequence
  chemically synthesized
aagtgattcttctgcctcagcc

SEQ ID NO: 730204 - DNA, 22 bp, Artificial Sequence
  chemically synthesized
ctcgggaggctgaggcagaaga

SEQ ID NO: 730205 - DNA, 22 bp, Artificial Sequence
  chemically synthesized
gggaggctgaggcagaagaatc

SEQ ID NO: 730206 - DNA, 22 bp, Artificial Sequence
  chemically synthesized
ccgggttcaagtgattcttctg

SEQ ID NO: 730207 - DNA, 22 bp, Artificial Sequence
  chemically synthesized
cacctcccgggttcaagtgatt

SEQ ID NO: 730208 - DNA, 22 bp, Artificial Sequence
  chemically synthesized
aggcagaagaatcacttgaacc

SEQ ID NO: 730209 - DNA, 22 bp, Artificial Sequence
  chemically synthesized
taacctccacctcccgggttca

SEQ ID NO: 730210 - DNA, 22 bp, Artificial Sequence
  chemically synthesized
actgtaacctccacctcccggg

SEQ ID NO: 730211 - DNA, 22 bp, Artificial Sequence
  chemically synthesized
ggctcactgtaacctccacctc

SEQ ID NO: 730212 - DNA, 22 bp, Artificial Sequence
  chemically synthesized
gaacccgggaggtggaggttac

SEQ ID NO: 730213 - DNA, 22 bp, Artificial Sequence
  chemically synthesized
aacccgggaggtggaggttaca

SEQ ID NO: 730214 - DNA, 22 bp, Artificial Sequence
  chemically synthesized
gaatgtagtggtgcgatctcgg

SEQ ID NO: 730215 - DNA, 22 bp, Artificial Sequence
  chemically synthesized
cagtgagccgagatcgcaccac

SEQ ID NO: 730216 - DNA, 22 bp, Artificial Sequence
  chemically synthesized
tcacccaggctggaatgtagtg

SEQ ID NO: 730217 - DNA, 22 bp, Artificial Sequence
  chemically synthesized
tgtcacccaggctggaatgtag

SEQ ID NO: 730218 - DNA, 22 bp, Artificial Sequence
  chemically synthesized
gctctgtcacccaggctggaat

SEQ ID NO: 730219 - DNA, 22 bp, Artificial Sequence
  chemically synthesized
cattccagcctgggtgacagag

SEQ ID NO: 730220 - DNA, 22 bp, Artificial Sequence
  chemically synthesized
agacaagagtctcgctctgtca

SEQ ID NO: 730221 - DNA, 22 bp, Artificial Sequence
  chemically synthesized
gagacaagagtctcgctctgtc

SEQ ID NO: 730222 - DNA, 22 bp, Artificial Sequence
  chemically synthesized
tgagacaagagtctcgctctgt

SEQ ID NO: 730223 - DNA, 22 bp, Artificial Sequence
  chemically synthesized
cagcctgggtgacagagcgaga

SEQ ID NO: 730224 - DNA, 22 bp, Artificial Sequence
  chemically synthesized
ttgagacaagagtctcgctctg

SEQ ID NO: 730225 - DNA, 22 bp, Artificial Sequence
  chemically synthesized
tttgagacaagagtctcgctct

SEQ ID NO: 730226 - DNA, 22 bp, Artificial Sequence
  chemically synthesized
ttttgagacaagagtctcgctc

SEQ ID NO: 730227 - DNA, 22 bp, Artificial Sequence
  chemically synthesized
tttttgagacaagagtctcgct

SEQ ID NO: 730228 - DNA, 22 bp, Artificial Sequence
  chemically synthesized
ttttttgagacaagagtctcgc

SEQ ID NO: 730229 - DNA, 22 bp, Artificial Sequence
  chemically synthesized
tttttttgagacaagagtctcg

SEQ ID NO: 730230 - DNA, 22 bp, Artificial Sequence
  chemically synthesized
ttttttttgagacaagagtctc

SEQ ID NO: 730231 - DNA, 22 bp, Artificial Sequence
  chemically synthesized
ggtgacagagcgagactcttgt

SEQ ID NO: 730232 - DNA, 22 bp, Artificial Sequence
  chemically synthesized
tttttttttgagacaagagtct

SEQ ID NO: 730233 - DNA, 22 bp, Artificial Sequence
  chemically synthesized
ttttttttttgagacaagagtc

SEQ ID NO: 730234 - DNA, 22 bp, Artificial Sequence
  chemically synthesized
tttttttttttgagacaagagt

SEQ ID NO: 730235 - DNA, 22 bp, Artificial Sequence
  chemically synthesized
ttttttttttttgagacaagag

SEQ ID NO: 730236 - DNA, 22 bp, Artificial Sequence
  chemically synthesized
tttttttttttttgagacaaga

SEQ ID NO: 730237 - DNA, 22 bp, Artificial Sequence
  chemically synthesized
ttttttttttttttgagacaag

SEQ ID NO: 730238 - DNA, 22 bp, Artificial Sequence
  chemically synthesized
tttttttttttttttgagacaa

SEQ ID NO: 730239 - DNA, 22 bp, Artificial Sequence
  chemically synthesized
ttttttttttttttttgagaca

SEQ ID NO: 730240 - DNA, 22 bp, Artificial Sequence
  chemically synthesized
tttttttttttttttttgagac

SEQ ID NO: 730241 - DNA, 22 bp, Artificial Sequence
  chemically synthesized
ttttttttttttttttttgaga

SEQ ID NO: 730242 - DNA, 22 bp, Artificial Sequence
  chemically synthesized
tttttttttttttttttttgag

SEQ ID NO: 730243 - DNA, 22 bp, Artificial Sequence
  chemically synthesized
tttttttttttttttttttttg

SEQ ID NO: 730244 - DNA, 22 bp, Artificial Sequence
  chemically synthesized
tctttttttttttttttttttt

SEQ ID NO: 730245 - DNA, 22 bp, Artificial Sequence
  chemically synthesized
tctctttttttttttttttttt

SEQ ID NO: 730246 - DNA, 22 bp, Artificial Sequence
  chemically synthesized
ttgtctcaaaaaaaaaaaaaaa

SEQ ID NO: 730247 - DNA, 22 bp, Artificial Sequence
  chemically synthesized
tctctctttttttttttttttt

SEQ ID NO: 730248 - DNA, 22 bp, Artificial Sequence
  chemically synthesized
gtctcaaaaaaaaaaaaaaaaa

SEQ ID NO: 730249 - DNA, 22 bp, Artificial Sequence
  chemically synthesized
tctctctctttttttttttttt

SEQ ID NO: 730250 - DNA, 22 bp, Artificial Sequence
  chemically synthesized
tctcaaaaaaaaaaaaaaaaaa

SEQ ID NO: 730251 - DNA, 22 bp, Artificial Sequence
  chemically synthesized
tctctctctctttttttttttt

SEQ ID NO: 730252 - DNA, 22 bp, Artificial Sequence
  chemically synthesized
aaaaaaaaaaaaaaaaaaaaag

SEQ ID NO: 730253 - DNA, 22 bp, Artificial Sequence
  chemically synthesized
tcaactctctctctctcttttt

SEQ ID NO: 730254 - DNA, 22 bp, Artificial Sequence
  chemically synthesized
agatcctatcaactctctctct

SEQ ID NO: 730255 - DNA, 22 bp, Artificial Sequence
  chemically synthesized
aagatcctatcaactctctctc

SEQ ID NO: 730256 - DNA, 22 bp, Artificial Sequence
  chemically synthesized
taagatcctatcaactctctct

SEQ ID NO: 730257 - DNA, 22 bp, Artificial Sequence
  chemically synthesized
caagataaactttaagatccta

SEQ ID NO: 730258 - DNA, 22 bp, Artificial Sequence
  chemically synthesized
acaagataaactttaagatcct

SEQ ID NO: 730259 - DNA, 22 bp, Artificial Sequence
  chemically synthesized
tacaagataaactttaagatcc

SEQ ID NO: 730260 - DNA, 22 bp, Artificial Sequence
  chemically synthesized
ggaattttacaagataaacttt

SEQ ID NO: 730261 - DNA, 22 bp, Artificial Sequence
  chemically synthesized
ataggatcttaaagtttatctt

SEQ ID NO: 730262 - DNA, 22 bp, Artificial Sequence
  chemically synthesized
cctgggaattttacaagataaa

SEQ ID NO: 730263 - DNA, 22 bp, Artificial Sequence
  chemically synthesized
acctgggaattttacaagataa

SEQ ID NO: 730264 - DNA, 22 bp, Artificial Sequence
  chemically synthesized
tacctgggaattttacaagata

SEQ ID NO: 730265 - DNA, 22 bp, Artificial Sequence
  chemically synthesized
ttacctgggaattttacaagat

SEQ ID NO: 730266 - DNA, 22 bp, Artificial Sequence
  chemically synthesized
ttttacctgggaattttacaag

SEQ ID NO: 730267 - DNA, 22 bp, Artificial Sequence
  chemically synthesized
aaagtttatcttgtaaaattcc

SEQ ID NO: 730268 - DNA, 22 bp, Artificial Sequence
  chemically synthesized
ctcttttacctgggaattttac

SEQ ID NO: 730269 - DNA, 22 bp, Artificial Sequence
  chemically synthesized
aagtttatcttgtaaaattccc

SEQ ID NO: 730270 - DNA, 22 bp, Artificial Sequence
  chemically synthesized
atcttgtaaaattcccaggtaa

SEQ ID NO: 730271 - DNA, 22 bp, Artificial Sequence
  chemically synthesized
tcttgtaaaattcccaggtaaa

SEQ ID NO: 730272 - DNA, 22 bp, Artificial Sequence
  chemically synthesized
cagagaattactcttttacctg

SEQ ID NO: 730273 - DNA, 22 bp, Artificial Sequence
  chemically synthesized
acagagaattactcttttacct

SEQ ID NO: 730274 - DNA, 22 bp, Artificial Sequence
  chemically synthesized
gtaaaattcccaggtaaaagag

SEQ ID NO: 730275 - DNA, 22 bp, Artificial Sequence
  chemically synthesized
tacagagaattactcttttacc

SEQ ID NO: 730276 - DNA, 22 bp, Artificial Sequence
  chemically synthesized
taaaattcccaggtaaaagagt

SEQ ID NO: 730277 - DNA, 22 bp, Artificial Sequence
  chemically synthesized
ccaggtaaaagagtaattctct

SEQ ID NO: 730278 - DNA, 22 bp, Artificial Sequence
  chemically synthesized
cacaaagatgttttacagagaa

SEQ ID NO: 730279 - DNA, 22 bp, Artificial Sequence
  chemically synthesized
gcacaaagatgttttacagaga

SEQ ID NO: 730280 - DNA, 22 bp, Artificial Sequence
  chemically synthesized
tctgtaaaacatctttgtgcaa

SEQ ID NO: 730281 - DNA, 22 bp, Artificial Sequence
  chemically synthesized
tgtaaaacatctttgtgcaagt

SEQ ID NO: 730282 - DNA, 22 bp, Artificial Sequence
  chemically synthesized
taaaacatctttgtgcaagtac

SEQ ID NO: 730283 - DNA, 22 bp, Artificial Sequence
  chemically synthesized
tgtgcaagtactgttgattgtc

SEQ ID NO: 730284 - DNA, 22 bp, Artificial Sequence
  chemically synthesized
gtgcaagtactgttgattgtcc

SEQ ID NO: 730285 - DNA, 22 bp, Artificial Sequence
  chemically synthesized
tgcaagtactgttgattgtccc

SEQ ID NO: 730286 - DNA, 22 bp, Artificial Sequence
  chemically synthesized
ttgattgtccccatatattttc

SEQ ID NO: 730287 - DNA, 22 bp, Artificial Sequence
  chemically synthesized
attgtccccatatattttccat

SEQ ID NO: 730288 - DNA, 22 bp, Artificial Sequence
  chemically synthesized
ccacaagaaaaaatggaaaata

SEQ ID NO: 730289 - DNA, 22 bp, Artificial Sequence
  chemically synthesized
ttgccacaagaaaaaatggaaa

SEQ ID NO: 730290 - DNA, 22 bp, Artificial Sequence
  chemically synthesized
tccccatatattttccattttt

SEQ ID NO: 730291 - DNA, 22 bp, Artificial Sequence
  chemically synthesized
tattgccacaagaaaaaatgga

SEQ ID NO: 730292 - DNA, 22 bp, Artificial Sequence
  chemically synthesized
tgagttctattgccacaagaaa

SEQ ID NO: 730293 - DNA, 22 bp, Artificial Sequence
  chemically synthesized
tccattttttcttgtggcaata

SEQ ID NO: 730294 - DNA, 22 bp, Artificial Sequence
  chemically synthesized
ccattttttcttgtggcaatag

SEQ ID NO: 730295 - DNA, 22 bp, Artificial Sequence
  chemically synthesized
cattttttcttgtggcaataga

SEQ ID NO: 730296 - DNA, 22 bp, Artificial Sequence
  chemically synthesized
aaaattatgagttctattgcca

SEQ ID NO: 730297 - DNA, 22 bp, Artificial Sequence
  chemically synthesized
tttcttgtggcaatagaactca

SEQ ID NO: 730298 - DNA, 22 bp, Artificial Sequence
  chemically synthesized
ttcttgtggcaatagaactcat

SEQ ID NO: 730299 - DNA, 22 bp, Artificial Sequence
  chemically synthesized
tcttgtggcaatagaactcata

SEQ ID NO: 730300 - DNA, 22 bp, Artificial Sequence
  chemically synthesized
cttgtggcaatagaactcataa

SEQ ID NO: 730301 - DNA, 22 bp, Artificial Sequence
  chemically synthesized
ttgtggcaatagaactcataat

SEQ ID NO: 730302 - DNA, 22 bp, Artificial Sequence
  chemically synthesized
gtggcaatagaactcataattt

SEQ ID NO: 730303 - DNA, 22 bp, Artificial Sequence
  chemically synthesized
tggcaatagaactcataatttt

SEQ ID NO: 730304 - DNA, 22 bp, Artificial Sequence
  chemically synthesized
catacccaactgaaaattatga

SEQ ID NO: 730305 - DNA, 22 bp, Artificial Sequence
  chemically synthesized
aggcatctacatacccaactga

SEQ ID NO: 730306 - DNA, 22 bp, Artificial Sequence
  chemically synthesized
caggcatctacatacccaactg

SEQ ID NO: 730307 - DNA, 22 bp, Artificial Sequence
  chemically synthesized
cttcaggcatctacatacccaa

SEQ ID NO: 730308 - DNA, 22 bp, Artificial Sequence
  chemically synthesized
ataattttcagttgggtatgta

SEQ ID NO: 730309 - DNA, 22 bp, Artificial Sequence
  chemically synthesized
ccttcaggcatctacataccca

SEQ ID NO: 730310 - DNA, 22 bp, Artificial Sequence
  chemically synthesized
tccttcaggcatctacataccc

SEQ ID NO: 730311 - DNA, 22 bp, Artificial Sequence
  chemically synthesized
tttccttcaggcatctacatac

SEQ ID NO: 730312 - DNA, 22 bp, Artificial Sequence
  chemically synthesized
tcagttgggtatgtagatgcct

SEQ ID NO: 730313 - DNA, 22 bp, Artificial Sequence
  chemically synthesized
cagttgggtatgtagatgcctg

SEQ ID NO: 730314 - DNA, 22 bp, Artificial Sequence
  chemically synthesized
agttgggtatgtagatgcctga

SEQ ID NO: 730315 - DNA, 22 bp, Artificial Sequence
  chemically synthesized
ggtatgtagatgcctgaaggaa

SEQ ID NO: 730316 - DNA, 22 bp, Artificial Sequence
  chemically synthesized
agaaatatattctttccttcag

SEQ ID NO: 730317 - DNA, 22 bp, Artificial Sequence
  chemically synthesized
tgtgaggctaagaaatatattc

SEQ ID NO: 730318 - DNA, 22 bp, Artificial Sequence
  chemically synthesized
aaggaaagaatatatttcttag

SEQ ID NO: 730319 - DNA, 22 bp, Artificial Sequence
  chemically synthesized
catctatgtgaggctaagaaat

SEQ ID NO: 730320 - DNA, 22 bp, Artificial Sequence
  chemically synthesized
acatctatgtgaggctaagaaa

SEQ ID NO: 730321 - DNA, 22 bp, Artificial Sequence
  chemically synthesized
tatttacatctatgtgaggcta

SEQ ID NO: 730322 - DNA, 22 bp, Artificial Sequence
  chemically synthesized
cttagcctcacatagatgtaaa

SEQ ID NO: 730323 - DNA, 22 bp, Artificial Sequence
  chemically synthesized
ttagcctcacatagatgtaaat

SEQ ID NO: 730324 - DNA, 22 bp, Artificial Sequence
  chemically synthesized
tcccatgattatatttacatct

SEQ ID NO: 730325 - DNA, 22 bp, Artificial Sequence
  chemically synthesized
gtcccatgattatatttacatc

SEQ ID NO: 730326 - DNA, 22 bp, Artificial Sequence
  chemically synthesized
agcctcacatagatgtaaatat

SEQ ID NO: 730327 - DNA, 22 bp, Artificial Sequence
  chemically synthesized
tgtcccatgattatatttacat

SEQ ID NO: 730328 - DNA, 22 bp, Artificial Sequence
  chemically synthesized
gcctcacatagatgtaaatata

SEQ ID NO: 730329 - DNA, 22 bp, Artificial Sequence
  chemically synthesized
acatagatgtaaatataatcat

SEQ ID NO: 730330 - DNA, 22 bp, Artificial Sequence
  chemically synthesized
accagaactttgtcccatgatt

SEQ ID NO: 730331 - DNA, 22 bp, Artificial Sequence
  chemically synthesized
caccagaactttgtcccatgat

SEQ ID NO: 730332 - DNA, 22 bp, Artificial Sequence
  chemically synthesized
cttcaccagaactttgtcccat

SEQ ID NO: 730333 - DNA, 22 bp, Artificial Sequence
  chemically synthesized
atagttccttcaccagaacttt

SEQ ID NO: 730334 - DNA, 22 bp, Artificial Sequence
  chemically synthesized
tggtgaaggaactatcagggga

SEQ ID NO: 730335 - DNA, 22 bp, Artificial Sequence
  chemically synthesized
tcatgaaatgtatcccctgata

SEQ ID NO: 730336 - DNA, 22 bp, Artificial Sequence
  chemically synthesized
gtgaaggaactatcaggggata

SEQ ID NO: 730337 - DNA, 22 bp, Artificial Sequence
  chemically synthesized
agaaactgtcatgaaatgtatc

SEQ ID NO: 730338 - DNA, 22 bp, Artificial Sequence
  chemically synthesized
cagaaactgtcatgaaatgtat

SEQ ID NO: 730339 - DNA, 22 bp, Artificial Sequence
  chemically synthesized
tcagaaactgtcatgaaatgta

SEQ ID NO: 730340 - DNA, 22 bp, Artificial Sequence
  chemically synthesized
tcaggggatacatttcatgaca

SEQ ID NO: 730341 - DNA, 22 bp, Artificial Sequence
  chemically synthesized
tgagaaaatctttcagaaactg

SEQ ID NO: 730342 - DNA, 22 bp, Artificial Sequence
  chemically synthesized
catgacagtttctgaaagattt

SEQ ID NO: 730343 - DNA, 22 bp, Artificial Sequence
  chemically synthesized
atgacagtttctgaaagatttt

SEQ ID NO: 730344 - DNA, 22 bp, Artificial Sequence
  chemically synthesized
ctgaaagattttctcacaacac

SEQ ID NO: 730345 - DNA, 22 bp, Artificial Sequence
  chemically synthesized
tgaaagattttctcacaacact

SEQ ID NO: 730346 - DNA, 22 bp, Artificial Sequence
  chemically synthesized
aaagattttctcacaacactgc

SEQ ID NO: 730347 - DNA, 22 bp, Artificial Sequence
  chemically synthesized
tctcacaacactgctggcacac

SEQ ID NO: 730348 - DNA, 22 bp, Artificial Sequence
  chemically synthesized
ctcacaacactgctggcacacg

SEQ ID NO: 730349 - DNA, 22 bp, Artificial Sequence
  chemically synthesized
tcacaacactgctggcacacgc

SEQ ID NO: 730350 - DNA, 22 bp, Artificial Sequence
  chemically synthesized
acaacactgctggcacacgccc

SEQ ID NO: 730351 - DNA, 22 bp, Artificial Sequence
  chemically synthesized
ctggcacacgccctctctgtgc

SEQ ID NO: 730352 - DNA, 22 bp, Artificial Sequence
  chemically synthesized
gcacacgccctctctgtgcctc

SEQ ID NO: 730353 - DNA, 22 bp, Artificial Sequence
  chemically synthesized
tctgtgcctccttccttcttcc

SEQ ID NO: 730354 - DNA, 22 bp, Artificial Sequence
  chemically synthesized
tgtgcctccttccttcttccat

SEQ ID NO: 730355 - DNA, 22 bp, Artificial Sequence
  chemically synthesized
tgcctccttccttcttccatgt

SEQ ID NO: 730356 - DNA, 22 bp, Artificial Sequence
  chemically synthesized
cagcccccagcaacatggaaga

SEQ ID NO: 730357 - DNA, 22 bp, Artificial Sequence
  chemically synthesized
agttccagcccccagcaacatg

SEQ ID NO: 730358 - DNA, 22 bp, Artificial Sequence
  chemically synthesized
cttccttcttccatgttgctgg

SEQ ID NO: 730359 - DNA, 22 bp, Artificial Sequence
  chemically synthesized
ccttcttccatgttgctggggg

SEQ ID NO: 730360 - DNA, 22 bp, Artificial Sequence
  chemically synthesized
cttcttccatgttgctgggggc

SEQ ID NO: 730361 - DNA, 22 bp, Artificial Sequence
  chemically synthesized
cttccatgttgctgggggctgg

SEQ ID NO: 730362 - DNA, 22 bp, Artificial Sequence
  chemically synthesized
ttccatgttgctgggggctgga

SEQ ID NO: 730363 - DNA, 22 bp, Artificial Sequence
  chemically synthesized
ccatgttgctgggggctggaac

SEQ ID NO: 730364 - DNA, 22 bp, Artificial Sequence
  chemically synthesized
catgttgctgggggctggaact

SEQ ID NO: 730365 - DNA, 22 bp, Artificial Sequence
  chemically synthesized
cagccaacacatctgagttcca

SEQ ID NO: 730366 - DNA, 22 bp, Artificial Sequence
  chemically synthesized
ctgggggctggaactcagatgt

SEQ ID NO: 730367 - DNA, 22 bp, Artificial Sequence
  chemically synthesized
agctccagccaacacatctgag

SEQ ID NO: 730368 - DNA, 22 bp, Artificial Sequence
  chemically synthesized
cagctccagccaacacatctga

SEQ ID NO: 730369 - DNA, 22 bp, Artificial Sequence
  chemically synthesized
ggggctggaactcagatgtgtt

SEQ ID NO: 730370 - DNA, 22 bp, Artificial Sequence
  chemically synthesized
cttcagctccagccaacacatc

SEQ ID NO: 730371 - DNA, 22 bp, Artificial Sequence
  chemically synthesized
gaactcagatgtgttggctgga

SEQ ID NO: 730372 - DNA, 22 bp, Artificial Sequence
  chemically synthesized
agatgtgttggctggagctgaa

SEQ ID NO: 730373 - DNA, 22 bp, Artificial Sequence
  chemically synthesized
gctggagctgaagcagacatat

SEQ ID NO: 730374 - DNA, 22 bp, Artificial Sequence
  chemically synthesized
tcaccacatggtccaatatgtc

SEQ ID NO: 730375 - DNA, 22 bp, Artificial Sequence
  chemically synthesized
gagctgaagcagacatattgga

SEQ ID NO: 730376 - DNA, 22 bp, Artificial Sequence
  chemically synthesized
gttgtcaccacatggtccaata

SEQ ID NO: 730377 - DNA, 22 bp, Artificial Sequence
  chemically synthesized
tcgttgtcaccacatggtccaa

SEQ ID NO: 730378 - DNA, 22 bp, Artificial Sequence
  chemically synthesized
aagcagacatattggaccatgt

SEQ ID NO: 730379 - DNA, 22 bp, Artificial Sequence
  chemically synthesized
aattctcgttgtcaccacatgg

SEQ ID NO: 730380 - DNA, 22 bp, Artificial Sequence
  chemically synthesized
gaccatgtggtgacaacgagaa

SEQ ID NO: 730381 - DNA, 22 bp, Artificial Sequence
  chemically synthesized
ccatggtggcctcaattctcgt

SEQ ID NO: 730382 - DNA, 22 bp, Artificial Sequence
  chemically synthesized
tcctgccatggtggcctcaatt

SEQ ID NO: 730383 - DNA, 22 bp, Artificial Sequence
  chemically synthesized
gtcctgccatggtggcctcaat

SEQ ID NO: 730384 - DNA, 22 bp, Artificial Sequence
  chemically synthesized
ccttgtcctgccatggtggcct

SEQ ID NO: 730385 - DNA, 22 bp, Artificial Sequence
  chemically synthesized
accttgtcctgccatggtggcc

SEQ ID NO: 730386 - DNA, 22 bp, Artificial Sequence
  chemically synthesized
taccttgtcctgccatggtggc

SEQ ID NO: 730387 - DNA, 22 bp, Artificial Sequence
  chemically synthesized
ctttaccttgtcctgccatggt

SEQ ID NO: 730388 - DNA, 22 bp, Artificial Sequence
  chemically synthesized
aggccaccatggcaggacaagg

SEQ ID NO: 730389 - DNA, 22 bp, Artificial Sequence
  chemically synthesized
agtccgaagtcctcctttacct

SEQ ID NO: 730390 - DNA, 22 bp, Artificial Sequence
  chemically synthesized
actaagtccgaagtcctccttt

SEQ ID NO: 730391 - DNA, 22 bp, Artificial Sequence
  chemically synthesized
cactaagtccgaagtcctcctt

SEQ ID NO: 730392 - DNA, 22 bp, Artificial Sequence
  chemically synthesized
cttcactaagtccgaagtcctc

SEQ ID NO: 730393 - DNA, 22 bp, Artificial Sequence
  chemically synthesized
tgcttcactaagtccgaagtcc

SEQ ID NO: 730394 - DNA, 22 bp, Artificial Sequence
  chemically synthesized
ttctgcttcactaagtccgaag

SEQ ID NO: 730395 - DNA, 22 bp, Artificial Sequence
  chemically synthesized
cgctattctgcttcactaagtc

SEQ ID NO: 730396 - DNA, 22 bp, Artificial Sequence
  chemically synthesized
ccgctattctgcttcactaagt

SEQ ID NO: 730397 - DNA, 22 bp, Artificial Sequence
  chemically synthesized
cttccgctattctgcttcacta

SEQ ID NO: 730398 - DNA, 22 bp, Artificial Sequence
  chemically synthesized
cggacttagtgaagcagaatag

SEQ ID NO: 730399 - DNA, 22 bp, Artificial Sequence
  chemically synthesized
ggacttagtgaagcagaatagc

SEQ ID NO: 730400 - DNA, 22 bp, Artificial Sequence
  chemically synthesized
agtgaagcagaatagcggaagg

SEQ ID NO: 730401 - DNA, 22 bp, Artificial Sequence
  chemically synthesized
gtgaagcagaatagcggaagga

SEQ ID NO: 730402 - DNA, 22 bp, Artificial Sequence
  chemically synthesized
ggtagatcaggcctccttccgc

SEQ ID NO: 730403 - DNA, 22 bp, Artificial Sequence
  chemically synthesized
atgtacaagcccagaactaggt

SEQ ID NO: 730404 - DNA, 22 bp, Artificial Sequence
  chemically synthesized
tcatgtacaagcccagaactag

SEQ ID NO: 730405 - DNA, 22 bp, Artificial Sequence
  chemically synthesized
tctcatgtacaagcccagaact

SEQ ID NO: 730406 - DNA, 22 bp, Artificial Sequence
  chemically synthesized
atctacctagttctgggcttgt

SEQ ID NO: 730407 - DNA, 22 bp, Artificial Sequence
  chemically synthesized
cctagttctgggcttgtacatg

SEQ ID NO: 730408 - DNA, 22 bp, Artificial Sequence
  chemically synthesized
gttctgggcttgtacatgagag

SEQ ID NO: 730409 - DNA, 22 bp, Artificial Sequence
  chemically synthesized
tgggcttgtacatgagagagac

SEQ ID NO: 730410 - DNA, 22 bp, Artificial Sequence
  chemically synthesized
ggcttgtacatgagagagacct

SEQ ID NO: 730411 - DNA, 22 bp, Artificial Sequence
  chemically synthesized
aacaatagagaaatgtaggtct

SEQ ID NO: 730412 - DNA, 22 bp, Artificial Sequence
  chemically synthesized
gtacatgagagagacctacatt

SEQ ID NO: 730413 - DNA, 22 bp, Artificial Sequence
  chemically synthesized
aaacaatagagaaatgtaggtc

SEQ ID NO: 730414 - DNA, 22 bp, Artificial Sequence
  chemically synthesized
tacatgagagagacctacattt

SEQ ID NO: 730415 - DNA, 22 bp, Artificial Sequence
  chemically synthesized
taacaatagcttaaacaataga

SEQ ID NO: 730416 - DNA, 22 bp, Artificial Sequence
  chemically synthesized
catttctctattgtttaagcta

SEQ ID NO: 730417 - DNA, 22 bp, Artificial Sequence
  chemically synthesized
ctctattgtttaagctattgtt

SEQ ID NO: 730418 - DNA, 22 bp, Artificial Sequence
  chemically synthesized
tctattgtttaagctattgtta

SEQ ID NO: 730419 - DNA, 22 bp, Artificial Sequence
  chemically synthesized
ataggacaaactgtaacaatag

SEQ ID NO: 730420 - DNA, 22 bp, Artificial Sequence
  chemically synthesized
tattgtttaagctattgttaca

SEQ ID NO: 730421 - DNA, 22 bp, Artificial Sequence
  chemically synthesized
ttgtttaagctattgttacagt

SEQ ID NO: 730422 - DNA, 22 bp, Artificial Sequence
  chemically synthesized
ctaataggacaaactgtaacaa

SEQ ID NO: 730423 - DNA, 22 bp, Artificial Sequence
  chemically synthesized
tttaagctattgttacagtttg

SEQ ID NO: 730424 - DNA, 22 bp, Artificial Sequence
  chemically synthesized
atctgctaataggacaaactgt

SEQ ID NO: 730425 - DNA, 22 bp, Artificial Sequence
  chemically synthesized
aagctattgttacagtttgtcc

SEQ ID NO: 730426 - DNA, 22 bp, Artificial Sequence
  chemically synthesized
agctattgttacagtttgtcct

SEQ ID NO: 730427 - DNA, 22 bp, Artificial Sequence
  chemically synthesized
attcatctgctaataggacaaa

SEQ ID NO: 730428 - DNA, 22 bp, Artificial Sequence
  chemically synthesized
ttgttacagtttgtcctattag

SEQ ID NO: 730429 - DNA, 22 bp, Artificial Sequence
  chemically synthesized
atctgattcatctgctaatagg

SEQ ID NO: 730430 - DNA, 22 bp, Artificial Sequence
  chemically synthesized
ttacagtttgtcctattagcag

SEQ ID NO: 730431 - DNA, 22 bp, Artificial Sequence
  chemically synthesized
aatctgattcatctgctaatag

SEQ ID NO: 730432 - DNA, 22 bp, Artificial Sequence
  chemically synthesized
taatctgattcatctgctaata

SEQ ID NO: 730433 - DNA, 22 bp, Artificial Sequence
  chemically synthesized
ttaatctgattcatctgctaat

SEQ ID NO: 730434 - DNA, 22 bp, Artificial Sequence
  chemically synthesized
cagtttgtcctattagcagatg

SEQ ID NO: 730435 - DNA, 22 bp, Artificial Sequence
  chemically synthesized
tttaatctgattcatctgctaa

SEQ ID NO: 730436 - DNA, 22 bp, Artificial Sequence
  chemically synthesized
gtcctattagcagatgaatcag

SEQ ID NO: 730437 - DNA, 22 bp, Artificial Sequence
  chemically synthesized
tcctattagcagatgaatcaga

SEQ ID NO: 730438 - DNA, 22 bp, Artificial Sequence
  chemically synthesized
catcattttttaatctgattca

SEQ ID NO: 730439 - DNA, 22 bp, Artificial Sequence
  chemically synthesized
ccatcattttttaatctgattc

SEQ ID NO: 730440 - DNA, 22 bp, Artificial Sequence
  chemically synthesized
ttagcagatgaatcagattaaa

SEQ ID NO: 730441 - DNA, 22 bp, Artificial Sequence
  chemically synthesized
gcagatgaatcagattaaaaaa

SEQ ID NO: 730442 - DNA, 22 bp, Artificial Sequence
  chemically synthesized
acaaatttccatcattttttaa

SEQ ID NO: 730443 - DNA, 22 bp, Artificial Sequence
  chemically synthesized
cacaaatttccatcatttttta

SEQ ID NO: 730444 - DNA, 22 bp, Artificial Sequence
  chemically synthesized
cttcacaaatttccatcatttt

SEQ ID NO: 730445 - DNA, 22 bp, Artificial Sequence
  chemically synthesized
aaaaatgatggaaatttgtgaa

SEQ ID NO: 730446 - DNA, 22 bp, Artificial Sequence
  chemically synthesized
agtggcatgggctgcttcacaa

SEQ ID NO: 730447 - DNA, 22 bp, Artificial Sequence
  chemically synthesized
ttaagtggcatgggctgcttca

SEQ ID NO: 730448 - DNA, 22 bp, Artificial Sequence
  chemically synthesized
ttattaagtggcatgggctgct

SEQ ID NO: 730449 - DNA, 22 bp, Artificial Sequence
  chemically synthesized
gagttgttattaagtggcatgg

SEQ ID NO: 730450 - DNA, 22 bp, Artificial Sequence
  chemically synthesized
gtgaagcagcccatgccactta

SEQ ID NO: 730451 - DNA, 22 bp, Artificial Sequence
  chemically synthesized
tgaagcagcccatgccacttaa

SEQ ID NO: 730452 - DNA, 22 bp, Artificial Sequence
  chemically synthesized
agtaaggaaaatgtaaacgtta

SEQ ID NO: 730453 - DNA, 22 bp, Artificial Sequence
  chemically synthesized
aataacaactctaacgtttaca

SEQ ID NO: 730454 - DNA, 22 bp, Artificial Sequence
  chemically synthesized
ataacaactctaacgtttacat

SEQ ID NO: 730455 - DNA, 22 bp, Artificial Sequence
  chemically synthesized
tgagtaaggaaaatgtaaacgt

SEQ ID NO: 730456 - DNA, 22 bp, Artificial Sequence
  chemically synthesized
ctctgagtaaggaaaatgtaaa

SEQ ID NO: 730457 - DNA, 22 bp, Artificial Sequence
  chemically synthesized
actctgagtaaggaaaatgtaa

SEQ ID NO: 730458 - DNA, 22 bp, Artificial Sequence
  chemically synthesized
taacgtttacattttccttact

SEQ ID NO: 730459 - DNA, 22 bp, Artificial Sequence
  chemically synthesized
acgtttacattttccttactca

SEQ ID NO: 730460 - DNA, 22 bp, Artificial Sequence
  chemically synthesized
cagtggagcttactctgagtaa

SEQ ID NO: 730461 - DNA, 22 bp, Artificial Sequence
  chemically synthesized
acattttccttactcagagtaa

SEQ ID NO: 730462 - DNA, 22 bp, Artificial Sequence
  chemically synthesized
cattttccttactcagagtaag

SEQ ID NO: 730463 - DNA, 22 bp, Artificial Sequence
  chemically synthesized
tccttactcagagtaagctcca

SEQ ID NO: 730464 - DNA, 22 bp, Artificial Sequence
  chemically synthesized
ccttactcagagtaagctccac

SEQ ID NO: 730465 - DNA, 22 bp, Artificial Sequence
  chemically synthesized
cttactcagagtaagctccact

SEQ ID NO: 730466 - DNA, 22 bp, Artificial Sequence
  chemically synthesized
tgggcaagtgttacagtggagc

SEQ ID NO: 730467 - DNA, 22 bp, Artificial Sequence
  chemically synthesized
actcagagtaagctccactgta

SEQ ID NO: 730468 - DNA, 22 bp, Artificial Sequence
  chemically synthesized
ctcagagtaagctccactgtaa

SEQ ID NO: 730469 - DNA, 22 bp, Artificial Sequence
  chemically synthesized
agagtaagctccactgtaacac

SEQ ID NO: 730470 - DNA, 22 bp, Artificial Sequence
  chemically synthesized
tagaagagaactatgggcaagt

SEQ ID NO: 730471 - DNA, 22 bp, Artificial Sequence
  chemically synthesized
cactgtaacacttgcccatagt

SEQ ID NO: 730472 - DNA, 22 bp, Artificial Sequence
  chemically synthesized
taacacttgcccatagttctct

SEQ ID NO: 730473 - DNA, 22 bp, Artificial Sequence
  chemically synthesized
agtaagattgtagaagagaact

SEQ ID NO: 730474 - DNA, 22 bp, Artificial Sequence
  chemically synthesized
attaagtaagattgtagaagag

SEQ ID NO: 730475 - DNA, 22 bp, Artificial Sequence
  chemically synthesized
aattaagtaagattgtagaaga

SEQ ID NO: 730476 - DNA, 22 bp, Artificial Sequence
  chemically synthesized
gcccatagttctcttctacaat

SEQ ID NO: 730477 - DNA, 22 bp, Artificial Sequence
  chemically synthesized
cccatagttctcttctacaatc

SEQ ID NO: 730478 - DNA, 22 bp, Artificial Sequence
  chemically synthesized
tcttctacaatcttacttaatt

SEQ ID NO: 730479 - DNA, 22 bp, Artificial Sequence
  chemically synthesized
ttctacaatcttacttaattaa

SEQ ID NO: 730480 - DNA, 22 bp, Artificial Sequence
  chemically synthesized
ctacaatcttacttaattaagt

SEQ ID NO: 730481 - DNA, 22 bp, Artificial Sequence
  chemically synthesized
tacaatcttacttaattaagtg

SEQ ID NO: 730482 - DNA, 22 bp, Artificial Sequence
  chemically synthesized
caatcttacttaattaagtgtg

SEQ ID NO: 730483 - DNA, 22 bp, Artificial Sequence
  chemically synthesized
acttaattaagtgtgctgtgtc

SEQ ID NO: 730484 - DNA, 22 bp, Artificial Sequence
  chemically synthesized
cttaattaagtgtgctgtgtcc

SEQ ID NO: 730485 - DNA, 22 bp, Artificial Sequence
  chemically synthesized
aattaagtgtgctgtgtccttt

SEQ ID NO: 730486 - DNA, 22 bp, Artificial Sequence
  chemically synthesized
gggagggtgggtaaaggacaca

SEQ ID NO: 730487 - DNA, 22 bp, Artificial Sequence
  chemically synthesized
attaagtgtgctgtgtccttta

SEQ ID NO: 730488 - DNA, 22 bp, Artificial Sequence
  chemically synthesized
agtgtgctgtgtcctttaccca

SEQ ID NO: 730489 - DNA, 22 bp, Artificial Sequence
  chemically synthesized
atgcatctggggagggtgggta

SEQ ID NO: 730490 - DNA, 22 bp, Artificial Sequence
  chemically synthesized
catgcatctggggagggtgggt

SEQ ID NO: 730491 - DNA, 22 bp, Artificial Sequence
  chemically synthesized
ttcatgcatctggggagggtgg

SEQ ID NO: 730492 - DNA, 22 bp, Artificial Sequence
  chemically synthesized
cttcatgcatctggggagggtg

SEQ ID NO: 730493 - DNA, 22 bp, Artificial Sequence
  chemically synthesized
tgtcctttacccaccctcccca

SEQ ID NO: 730494 - DNA, 22 bp, Artificial Sequence
  chemically synthesized
tacccaccctccccagatgcat

SEQ ID NO: 730495 - DNA, 22 bp, Artificial Sequence
  chemically synthesized
acccaccctccccagatgcatg

SEQ ID NO: 730496 - DNA, 22 bp, Artificial Sequence
  chemically synthesized
cccaccctccccagatgcatga

SEQ ID NO: 730497 - DNA, 22 bp, Artificial Sequence
  chemically synthesized
cccagatgcatgaagaagctgt

SEQ ID NO: 730498 - DNA, 22 bp, Artificial Sequence
  chemically synthesized
agtaagaagataacatgaaaat

SEQ ID NO: 730499 - DNA, 22 bp, Artificial Sequence
  chemically synthesized
tcctgtattttcatgttatctt

SEQ ID NO: 730500 - DNA, 22 bp, Artificial Sequence
  chemically synthesized
gaatgttcagtaagaagataac

SEQ ID NO: 730501 - DNA, 22 bp, Artificial Sequence
  chemically synthesized
tattttcatgttatcttcttac

SEQ ID NO: 730502 - DNA, 22 bp, Artificial Sequence
  chemically synthesized
tcatgttatcttcttactgaac

SEQ ID NO: 730503 - DNA, 22 bp, Artificial Sequence
  chemically synthesized
catgttatcttcttactgaaca

SEQ ID NO: 730504 - DNA, 22 bp, Artificial Sequence
  chemically synthesized
atgttatcttcttactgaacat

SEQ ID NO: 730505 - DNA, 22 bp, Artificial Sequence
  chemically synthesized
aaagaatctagaatgttcagta

SEQ ID NO: 730506 - DNA, 22 bp, Artificial Sequence
  chemically synthesized
gaaagaatctagaatgttcagt

SEQ ID NO: 730507 - DNA, 22 bp, Artificial Sequence
  chemically synthesized
tcttcttactgaacattctaga

SEQ ID NO: 730508 - DNA, 22 bp, Artificial Sequence
  chemically synthesized
cttactgaacattctagattct

SEQ ID NO: 730509 - DNA, 22 bp, Artificial Sequence
  chemically synthesized
ttactgaacattctagattctt

SEQ ID NO: 730510 - DNA, 22 bp, Artificial Sequence
  chemically synthesized
actgaacattctagattctttc

SEQ ID NO: 730511 - DNA, 22 bp, Artificial Sequence
  chemically synthesized
ctgaacattctagattctttca

SEQ ID NO: 730512 - DNA, 22 bp, Artificial Sequence
  chemically synthesized
tatgacaaatatttgaaagaat

SEQ ID NO: 730513 - DNA, 22 bp, Artificial Sequence
  chemically synthesized
aacattctagattctttcaaat

SEQ ID NO: 730514 - DNA, 22 bp, Artificial Sequence
  chemically synthesized
tagattctttcaaatatttgtc

SEQ ID NO: 730515 - DNA, 22 bp, Artificial Sequence
  chemically synthesized
gattctttcaaatatttgtcat

SEQ ID NO: 730516 - DNA, 22 bp, Artificial Sequence
  chemically synthesized
tttcaaatatttgtcatataac

SEQ ID NO: 730517 - DNA, 22 bp, Artificial Sequence
  chemically synthesized
tcaaatatttgtcatataacca

SEQ ID NO: 730518 - DNA, 22 bp, Artificial Sequence
  chemically synthesized
caaatatttgtcatataaccat

SEQ ID NO: 730519 - DNA, 22 bp, Artificial Sequence
  chemically synthesized
aaatatttgtcatataaccatc

SEQ ID NO: 730520 - DNA, 22 bp, Artificial Sequence
  chemically synthesized
tgaaaggtatagcgatggttat

SEQ ID NO: 730521 - DNA, 22 bp, Artificial Sequence
  chemically synthesized
gtcatataaccatcgctatacc

SEQ ID NO: 730522 - DNA, 22 bp, Artificial Sequence
  chemically synthesized
tcatataaccatcgctatacct

SEQ ID NO: 730523 - DNA, 22 bp, Artificial Sequence
  chemically synthesized
acagcagggcaaccaagattgt

SEQ ID NO: 730524 - DNA, 22 bp, Artificial Sequence
  chemically synthesized
tacctttcacaatcttggttgc

SEQ ID NO: 730525 - DNA, 22 bp, Artificial Sequence
  chemically synthesized
tcacaatcttggttgccctgct

SEQ ID NO: 730526 - DNA, 22 bp, Artificial Sequence
  chemically synthesized
cacaatcttggttgccctgctg

SEQ ID NO: 730527 - DNA, 22 bp, Artificial Sequence
  chemically synthesized
acaatcttggttgccctgctgt

SEQ ID NO: 730528 - DNA, 22 bp, Artificial Sequence
  chemically synthesized
aaaaatcataatacattgacag

SEQ ID NO: 730529 - DNA, 22 bp, Artificial Sequence
  chemically synthesized
ggttgccctgctgtcaatgtat

SEQ ID NO: 730530 - DNA, 22 bp, Artificial Sequence
  chemically synthesized
gttgccctgctgtcaatgtatt

SEQ ID NO: 730531 - DNA, 22 bp, Artificial Sequence
  chemically synthesized
ccctgctgtcaatgtattatga

SEQ ID NO: 730532 - DNA, 22 bp, Artificial Sequence
  chemically synthesized
ctgtcaatgtattatgattttt

SEQ ID NO: 730533 - DNA, 22 bp, Artificial Sequence
  chemically synthesized
tcaatgtattatgatttttcag

SEQ ID NO: 730534 - DNA, 22 bp, Artificial Sequence
  chemically synthesized
tgatttttcagtgttctcatca

SEQ ID NO: 730535 - DNA, 22 bp, Artificial Sequence
  chemically synthesized
tgagcatcacgtatgatgagaa

SEQ ID NO: 730536 - DNA, 22 bp, Artificial Sequence
  chemically synthesized
atgagcatcacgtatgatgaga

SEQ ID NO: 730537 - DNA, 22 bp, Artificial Sequence
  chemically synthesized
ttcagtgttctcatcatacgtg

SEQ ID NO: 730538 - DNA, 22 bp, Artificial Sequence
  chemically synthesized
acttatgagcatcacgtatgat

SEQ ID NO: 730539 - DNA, 22 bp, Artificial Sequence
  chemically synthesized
tcagtgttctcatcatacgtga

SEQ ID NO: 730540 - DNA, 22 bp, Artificial Sequence
  chemically synthesized
cagtgttctcatcatacgtgat

SEQ ID NO: 730541 - DNA, 22 bp, Artificial Sequence
  chemically synthesized
agtgttctcatcatacgtgatg

SEQ ID NO: 730542 - DNA, 22 bp, Artificial Sequence
  chemically synthesized
tcatcatacgtgatgctcataa

SEQ ID NO: 730543 - DNA, 22 bp, Artificial Sequence
  chemically synthesized
cagtcatattgacttatgagca

SEQ ID NO: 730544 - DNA, 22 bp, Artificial Sequence
  chemically synthesized
atcatacgtgatgctcataagt

SEQ ID NO: 730545 - DNA, 22 bp, Artificial Sequence
  chemically synthesized
aaccacatctgcagtcatattg

SEQ ID NO: 730546 - DNA, 22 bp, Artificial Sequence
  chemically synthesized
gttaaaccacatctgcagtcat

SEQ ID NO: 730547 - DNA, 22 bp, Artificial Sequence
  chemically synthesized
ataagtcaatatgactgcagat

SEQ ID NO: 730548 - DNA, 22 bp, Artificial Sequence
  chemically synthesized
actagttaaaccacatctgcag

SEQ ID NO: 730549 - DNA, 22 bp, Artificial Sequence
  chemically synthesized
cactagttaaaccacatctgca

SEQ ID NO: 730550 - DNA, 22 bp, Artificial Sequence
  chemically synthesized
ttcactagttaaaccacatctg

SEQ ID NO: 730551 - DNA, 22 bp, Artificial Sequence
  chemically synthesized
atctcttcactagttaaaccac

SEQ ID NO: 730552 - DNA, 22 bp, Artificial Sequence
  chemically synthesized
cattaatctcttcactagttaa

SEQ ID NO: 730553 - DNA, 22 bp, Artificial Sequence
  chemically synthesized
cagatgtggtttaactagtgaa

SEQ ID NO: 730554 - DNA, 22 bp, Artificial Sequence
  chemically synthesized
acaaatgttccattaatctctt

SEQ ID NO: 730555 - DNA, 22 bp, Artificial Sequence
  chemically synthesized
aactagtgaagagattaatgga

SEQ ID NO: 730556 - DNA, 22 bp, Artificial Sequence
  chemically synthesized
actagtgaagagattaatggaa

SEQ ID NO: 730557 - DNA, 22 bp, Artificial Sequence
  chemically synthesized
gtgaagagattaatggaacatt

SEQ ID NO: 730558 - DNA, 22 bp, Artificial Sequence
  chemically synthesized
atgaaattcacaaatgttccat

SEQ ID NO: 730559 - DNA, 22 bp, Artificial Sequence
  chemically synthesized
cattaatgaaattcacaaatgt

SEQ ID NO: 730560 - DNA, 22 bp, Artificial Sequence
  chemically synthesized
gattgcattaatgaaattcaca

SEQ ID NO: 730561 - DNA, 22 bp, Artificial Sequence
  chemically synthesized
atggaacatttgtgaatttcat

SEQ ID NO: 730562 - DNA, 22 bp, Artificial Sequence
  chemically synthesized
gtgaatttcattaatgcaatct

SEQ ID NO: 730563 - DNA, 22 bp, Artificial Sequence
  chemically synthesized
tgaatttcattaatgcaatcta

SEQ ID NO: 730564 - DNA, 22 bp, Artificial Sequence
  chemically synthesized
tacgaggcaatacagtattaga

SEQ ID NO: 730565 - DNA, 22 bp, Artificial Sequence
  chemically synthesized
cattaatgcaatctaatactgt

SEQ ID NO: 730566 - DNA, 22 bp, Artificial Sequence
  chemically synthesized
attaatgcaatctaatactgta

SEQ ID NO: 730567 - DNA, 22 bp, Artificial Sequence
  chemically synthesized
ctgtacgaggcaatacagtatt

SEQ ID NO: 730568 - DNA, 22 bp, Artificial Sequence
  chemically synthesized
actgtacgaggcaatacagtat

SEQ ID NO: 730569 - DNA, 22 bp, Artificial Sequence
  chemically synthesized
atgcaatctaatactgtattgc

SEQ ID NO: 730570 - DNA, 22 bp, Artificial Sequence
  chemically synthesized
gtgtggcttactgtacgaggca

SEQ ID NO: 730571 - DNA, 22 bp, Artificial Sequence
  chemically synthesized
atactgtattgcctcgtacagt

SEQ ID NO: 730572 - DNA, 22 bp, Artificial Sequence
  chemically synthesized
tattgcctcgtacagtaagcca

SEQ ID NO: 730573 - DNA, 22 bp, Artificial Sequence
  chemically synthesized
cagtatgatctggtgtggctta

SEQ ID NO: 730574 - DNA, 22 bp, Artificial Sequence
  chemically synthesized
cctcgtacagtaagccacacca

SEQ ID NO: 730575 - DNA, 22 bp, Artificial Sequence
  chemically synthesized
atctccagtatgatctggtgtg

SEQ ID NO: 730576 - DNA, 22 bp, Artificial Sequence
  chemically synthesized
gtacagtaagccacaccagatc

SEQ ID NO: 730577 - DNA, 22 bp, Artificial Sequence
  chemically synthesized
tattaatctccagtatgatctg

SEQ ID NO: 730578 - DNA, 22 bp, Artificial Sequence
  chemically synthesized
aataaccacaaggactgtatta

SEQ ID NO: 730579 - DNA, 22 bp, Artificial Sequence
  chemically synthesized
aaataaccacaaggactgtatt

SEQ ID NO: 730580 - DNA, 22 bp, Artificial Sequence
  chemically synthesized
taaataaccacaaggactgtat

SEQ ID NO: 730581 - DNA, 22 bp, Artificial Sequence
  chemically synthesized
gagattaatacagtccttgtgg

SEQ ID NO: 730582 - DNA, 22 bp, Artificial Sequence
  chemically synthesized
ggattttaaataaccacaagga

SEQ ID NO: 730583 - DNA, 22 bp, Artificial Sequence
  chemically synthesized
atacagtccttgtggttattta

SEQ ID NO: 730584 - DNA, 22 bp, Artificial Sequence
  chemically synthesized
tatgaaaaacaaattgggattt

SEQ ID NO: 730585 - DNA, 22 bp, Artificial Sequence
  chemically synthesized
gtggttatttaaaatcccaatt

SEQ ID NO: 730586 - DNA, 22 bp, Artificial Sequence
  chemically synthesized
atatgaaaaacaaattgggatt

SEQ ID NO: 730587 - DNA, 22 bp, Artificial Sequence
  chemically synthesized
tggttatttaaaatcccaattt

SEQ ID NO: 730588 - DNA, 22 bp, Artificial Sequence
  chemically synthesized
tatatgaaaaacaaattgggat

SEQ ID NO: 730589 - DNA, 22 bp, Artificial Sequence
  chemically synthesized
tttaaaatcccaatttgttttt

SEQ ID NO: 730590 - DNA, 22 bp, Artificial Sequence
  chemically synthesized
tggcgctttatatgaaaaacaa

SEQ ID NO: 730591 - DNA, 22 bp, Artificial Sequence
  chemically synthesized
aaaatcccaatttgtttttcat

SEQ ID NO: 730592 - DNA, 22 bp, Artificial Sequence
  chemically synthesized
gtggcgctttatatgaaaaaca

SEQ ID NO: 730593 - DNA, 22 bp, Artificial Sequence
  chemically synthesized
aaatcccaatttgtttttcata

SEQ ID NO: 730594 - DNA, 22 bp, Artificial Sequence
  chemically synthesized
tgtggcgctttatatgaaaaac

SEQ ID NO: 730595 - DNA, 22 bp, Artificial Sequence
  chemically synthesized
actttgtggcgctttatatgaa

SEQ ID NO: 730596 - DNA, 22 bp, Artificial Sequence
  chemically synthesized
gtttttcatataaagcgccaca

SEQ ID NO: 730597 - DNA, 22 bp, Artificial Sequence
  chemically synthesized
tttttcatataaagcgccacaa

SEQ ID NO: 730598 - DNA, 22 bp, Artificial Sequence
  chemically synthesized
aggaacatctgactttgtggcg

SEQ ID NO: 730599 - DNA, 22 bp, Artificial Sequence
  chemically synthesized
ttcatataaagcgccacaaagt

SEQ ID NO: 730600 - DNA, 22 bp, Artificial Sequence
  chemically synthesized
tcatataaagcgccacaaagtc

SEQ ID NO: 730601 - DNA, 22 bp, Artificial Sequence
  chemically synthesized
catataaagcgccacaaagtca

SEQ ID NO: 730602 - DNA, 22 bp, Artificial Sequence
  chemically synthesized
atataaagcgccacaaagtcag

SEQ ID NO: 730603 - DNA, 22 bp, Artificial Sequence
  chemically synthesized
tacaaatataggctgaggaaca

SEQ ID NO: 730604 - DNA, 22 bp, Artificial Sequence
  chemically synthesized
gtacaaatataggctgaggaac

SEQ ID NO: 730605 - DNA, 22 bp, Artificial Sequence
  chemically synthesized
tgtacaaatataggctgaggaa

SEQ ID NO: 730606 - DNA, 22 bp, Artificial Sequence
  chemically synthesized
ttgtacaaatataggctgagga

SEQ ID NO: 730607 - DNA, 22 bp, Artificial Sequence
  chemically synthesized
aagtcttttgtacaaatatagg

SEQ ID NO: 730608 - DNA, 22 bp, Artificial Sequence
  chemically synthesized
aaagtcttttgtacaaatatag

SEQ ID NO: 730609 - DNA, 22 bp, Artificial Sequence
  chemically synthesized
taaagtcttttgtacaaatata

SEQ ID NO: 730610 - DNA, 22 bp, Artificial Sequence
  chemically synthesized
ttaaagtcttttgtacaaatat

SEQ ID NO: 730611 - DNA, 22 bp, Artificial Sequence
  chemically synthesized
ctcagcctatatttgtacaaaa

SEQ ID NO: 730612 - DNA, 22 bp, Artificial Sequence
  chemically synthesized
agatttttaaagtcttttgtac

SEQ ID NO: 730613 - DNA, 22 bp, Artificial Sequence
  chemically synthesized
agcctatatttgtacaaaagac

SEQ ID NO: 730614 - DNA, 22 bp, Artificial Sequence
  chemically synthesized
aagatttttaaagtcttttgta

SEQ ID NO: 730615 - DNA, 22 bp, Artificial Sequence
  chemically synthesized
taagatttttaaagtcttttgt

SEQ ID NO: 730616 - DNA, 22 bp, Artificial Sequence
  chemically synthesized
cctttaagatttttaaagtctt

SEQ ID NO: 730617 - DNA, 22 bp, Artificial Sequence
  chemically synthesized
tatttgtacaaaagactttaaa

SEQ ID NO: 730618 - DNA, 22 bp, Artificial Sequence
  chemically synthesized
gtacaaaagactttaaaaatct

SEQ ID NO: 730619 - DNA, 22 bp, Artificial Sequence
  chemically synthesized
tacaaaagactttaaaaatctt

SEQ ID NO: 730620 - DNA, 22 bp, Artificial Sequence
  chemically synthesized
taaaaatcttaaaggcaggaca

SEQ ID NO: 730621 - DNA, 22 bp, Artificial Sequence
  chemically synthesized
aaaaatcttaaaggcaggacat

SEQ ID NO: 730622 - DNA, 22 bp, Artificial Sequence
  chemically synthesized
aaaatcttaaaggcaggacatc

SEQ ID NO: 730623 - DNA, 22 bp, Artificial Sequence
  chemically synthesized
acaagaacaagcaagatgtcct

SEQ ID NO: 730624 - DNA, 22 bp, Artificial Sequence
  chemically synthesized
aacaagaacaagcaagatgtcc

SEQ ID NO: 730625 - DNA, 22 bp, Artificial Sequence
  chemically synthesized
aaaggcaggacatcttgcttgt

SEQ ID NO: 730626 - DNA, 22 bp, Artificial Sequence
  chemically synthesized
aaggcaggacatcttgcttgtt

SEQ ID NO: 730627 - DNA, 22 bp, Artificial Sequence
  chemically synthesized
aaataaaatttaacaagaacaa

SEQ ID NO: 730628 - DNA, 22 bp, Artificial Sequence
  chemically synthesized
gcttgttcttgttaaattttat

SEQ ID NO: 730629 - DNA, 22 bp, Artificial Sequence
  chemically synthesized
cttgttcttgttaaattttatt

SEQ ID NO: 730630 - DNA, 22 bp, Artificial Sequence
  chemically synthesized
gttcttgttaaattttatttta

SEQ ID NO: 730631 - DNA, 22 bp, Artificial Sequence
  chemically synthesized
ttcttgttaaattttattttaa

SEQ ID NO: 730632 - DNA, 22 bp, Artificial Sequence
  chemically synthesized
ttgttaaattttattttaattt

SEQ ID NO: 730633 - DNA, 22 bp, Artificial Sequence
  chemically synthesized
taccaaaataaaaaaattaaaa

SEQ ID NO: 730634 - DNA, 22 bp, Artificial Sequence
  chemically synthesized
gttaaattttattttaattttt

SEQ ID NO: 730635 - DNA, 22 bp, Artificial Sequence
  chemically synthesized
ttaaattttattttaatttttt

SEQ ID NO: 730636 - DNA, 22 bp, Artificial Sequence
  chemically synthesized
aattttattttaatttttttat

SEQ ID NO: 730637 - DNA, 22 bp, Artificial Sequence
  chemically synthesized
ggatactgtaccaaaataaaaa

SEQ ID NO: 730638 - DNA, 22 bp, Artificial Sequence
  chemically synthesized
tattttaatttttttattttgg

SEQ ID NO: 730639 - DNA, 22 bp, Artificial Sequence
  chemically synthesized
attttaatttttttattttggt

SEQ ID NO: 730640 - DNA, 22 bp, Artificial Sequence
  chemically synthesized
ttttaatttttttattttggta

SEQ ID NO: 730641 - DNA, 22 bp, Artificial Sequence
  chemically synthesized
taatttttttattttggtacag

SEQ ID NO: 730642 - DNA, 22 bp, Artificial Sequence
  chemically synthesized
aatttttttattttggtacagt

SEQ ID NO: 730643 - DNA, 22 bp, Artificial Sequence
  chemically synthesized
atttttttattttggtacagta

SEQ ID NO: 730644 - DNA, 22 bp, Artificial Sequence
  chemically synthesized
taacagactgggatactgtacc

SEQ ID NO: 730645 - DNA, 22 bp, Artificial Sequence
  chemically synthesized
ttttattttggtacagtatccc

SEQ ID NO: 730646 - DNA, 22 bp, Artificial Sequence
  chemically synthesized
tttattttggtacagtatccca

SEQ ID NO: 730647 - DNA, 22 bp, Artificial Sequence
  chemically synthesized
ttattttggtacagtatcccag

SEQ ID NO: 730648 - DNA, 22 bp, Artificial Sequence
  chemically synthesized
tattttggtacagtatcccagt

SEQ ID NO: 730649 - DNA, 22 bp, Artificial Sequence
  chemically synthesized
attttggtacagtatcccagtc

SEQ ID NO: 730650 - DNA, 22 bp, Artificial Sequence
  chemically synthesized
ttttggtacagtatcccagtct

SEQ ID NO: 730651 - DNA, 22 bp, Artificial Sequence
  chemically synthesized
tggtacagtatcccagtctgtt

SEQ ID NO: 730652 - DNA, 22 bp, Artificial Sequence
  chemically synthesized
ggtacagtatcccagtctgtta

SEQ ID NO: 730653 - DNA, 22 bp, Artificial Sequence
  chemically synthesized
aaaataagattataacagactg

SEQ ID NO: 730654 - DNA, 22 bp, Artificial Sequence
  chemically synthesized
gtacagtatcccagtctgttat

SEQ ID NO: 730655 - DNA, 22 bp, Artificial Sequence
  chemically synthesized
ttataatcttattttgagtctt

SEQ ID NO: 730656 - DNA, 22 bp, Artificial Sequence
  chemically synthesized
aaagatcaaaatcaagactcaa

SEQ ID NO: 730657 - DNA, 22 bp, Artificial Sequence
  chemically synthesized
taatcttattttgagtcttgat

SEQ ID NO: 730658 - DNA, 22 bp, Artificial Sequence
  chemically synthesized
attttgagtcttgattttgatc

SEQ ID NO: 730659 - DNA, 22 bp, Artificial Sequence
  chemically synthesized
ttttgagtcttgattttgatct

SEQ ID NO: 730660 - DNA, 22 bp, Artificial Sequence
  chemically synthesized
tgagtcttgattttgatctttc

SEQ ID NO: 730661 - DNA, 22 bp, Artificial Sequence
  chemically synthesized
gagtcttgattttgatctttca

SEQ ID NO: 730662 - DNA, 22 bp, Artificial Sequence
  chemically synthesized
agtcttgattttgatctttcag

SEQ ID NO: 730663 - DNA, 22 bp, Artificial Sequence
  chemically synthesized
gattttgatctttcagtgtgtt

SEQ ID NO: 730664 - DNA, 22 bp, Artificial Sequence
  chemically synthesized
attttgatctttcagtgtgttg

SEQ ID NO: 730665 - DNA, 22 bp, Artificial Sequence
  chemically synthesized
tgatctttcagtgtgttgactc

SEQ ID NO: 730666 - DNA, 22 bp, Artificial Sequence
  chemically synthesized
gatctttcagtgtgttgactcc

SEQ ID NO: 730667 - DNA, 22 bp, Artificial Sequence
  chemically synthesized
atctttcagtgtgttgactccc

SEQ ID NO: 730668 - DNA, 22 bp, Artificial Sequence
  chemically synthesized
tcagtgtgttgactcccattct

SEQ ID NO: 730669 - DNA, 22 bp, Artificial Sequence
  chemically synthesized
cagtgtgttgactcccattctc

SEQ ID NO: 730670 - DNA, 22 bp, Artificial Sequence
  chemically synthesized
agtgtgttgactcccattctca

SEQ ID NO: 730671 - DNA, 22 bp, Artificial Sequence
  chemically synthesized
aaatgacacaaaggtgagaatg

SEQ ID NO: 730672 - DNA, 22 bp, Artificial Sequence
  chemically synthesized
caaatgacacaaaggtgagaat

SEQ ID NO: 730673 - DNA, 22 bp, Artificial Sequence
  chemically synthesized
tcaaatgacacaaaggtgagaa

SEQ ID NO: 730674 - DNA, 22 bp, Artificial Sequence
  chemically synthesized
ttcaaatgacacaaaggtgaga

SEQ ID NO: 730675 - DNA, 22 bp, Artificial Sequence
  chemically synthesized
actcccattctcacctttgtgt

SEQ ID NO: 730676 - DNA, 22 bp, Artificial Sequence
  chemically synthesized
atttttcaaatgacacaaaggt

SEQ ID NO: 730677 - DNA, 22 bp, Artificial Sequence
  chemically synthesized
ttaatttttcaaatgacacaaa

SEQ ID NO: 730678 - DNA, 22 bp, Artificial Sequence
  chemically synthesized
ccattctcacctttgtgtcatt

SEQ ID NO: 730679 - DNA, 22 bp, Artificial Sequence
  chemically synthesized
attaatttttcaaatgacacaa

SEQ ID NO: 730680 - DNA, 22 bp, Artificial Sequence
  chemically synthesized
tcacctttgtgtcatttgaaaa

SEQ ID NO: 730681 - DNA, 22 bp, Artificial Sequence
  chemically synthesized
tgcacttattaatttttcaaat

SEQ ID NO: 730682 - DNA, 22 bp, Artificial Sequence
  chemically synthesized
acctttgtgtcatttgaaaaat

SEQ ID NO: 730683 - DNA, 22 bp, Artificial Sequence
  chemically synthesized
tgtgtcatttgaaaaattaata

SEQ ID NO: 730684 - DNA, 22 bp, Artificial Sequence
  chemically synthesized
gtgtcatttgaaaaattaataa

SEQ ID NO: 730685 - DNA, 22 bp, Artificial Sequence
  chemically synthesized
tgtcatttgaaaaattaataag

SEQ ID NO: 730686 - DNA, 22 bp, Artificial Sequence
  chemically synthesized
gaaaaattaataagtgcacaat

SEQ ID NO: 730687 - DNA, 22 bp, Artificial Sequence
  chemically synthesized
aaaaattaataagtgcacaatg

SEQ ID NO: 730688 - DNA, 22 bp, Artificial Sequence
  chemically synthesized
gataagcatatacattgtgcac

SEQ ID NO: 730689 - DNA, 22 bp, Artificial Sequence
  chemically synthesized
tagataagcatatacattgtgc

SEQ ID NO: 730690 - DNA, 22 bp, Artificial Sequence
  chemically synthesized
ctagataagcatatacattgtg

SEQ ID NO: 730691 - DNA, 22 bp, Artificial Sequence
  chemically synthesized
tctagataagcatatacattgt

SEQ ID NO: 730692 - DNA, 22 bp, Artificial Sequence
  chemically synthesized
ttctagataagcatatacattg

SEQ ID NO: 730693 - DNA, 22 bp, Artificial Sequence
  chemically synthesized
ataagtgcacaatgtatatgct

SEQ ID NO: 730694 - DNA, 22 bp, Artificial Sequence
  chemically synthesized
tcatttttctagataagcatat

SEQ ID NO: 730695 - DNA, 22 bp, Artificial Sequence
  chemically synthesized
gtcatttttctagataagcata

SEQ ID NO: 730696 - DNA, 22 bp, Artificial Sequence
  chemically synthesized
tgtcatttttctagataagcat

SEQ ID NO: 730697 - DNA, 22 bp, Artificial Sequence
  chemically synthesized
ttgtcatttttctagataagca

SEQ ID NO: 730698 - DNA, 22 bp, Artificial Sequence
  chemically synthesized
acccagatttttgtcatttttc

SEQ ID NO: 730699 - DNA, 22 bp, Artificial Sequence
  chemically synthesized
gacccagatttttgtcattttt

SEQ ID NO: 730700 - DNA, 22 bp, Artificial Sequence
  chemically synthesized
tgacccagatttttgtcatttt

SEQ ID NO: 730701 - DNA, 22 bp, Artificial Sequence
  chemically synthesized
atctagaaaaatgacaaaaatc

SEQ ID NO: 730702 - DNA, 22 bp, Artificial Sequence
  chemically synthesized
tactttgacccagatttttgtc

SEQ ID NO: 730703 - DNA, 22 bp, Artificial Sequence
  chemically synthesized
tctagaaaaatgacaaaaatct

SEQ ID NO: 730704 - DNA, 22 bp, Artificial Sequence
  chemically synthesized
cctgtactttgacccagatttt

SEQ ID NO: 730705 - DNA, 22 bp, Artificial Sequence
  chemically synthesized
gaaaaatgacaaaaatctgggt

SEQ ID NO: 730706 - DNA, 22 bp, Artificial Sequence
  chemically synthesized
gcctgtactttgacccagattt

SEQ ID NO: 730707 - DNA, 22 bp, Artificial Sequence
  chemically synthesized
cttgcctgtactttgacccaga

SEQ ID NO: 730708 - DNA, 22 bp, Artificial Sequence
  chemically synthesized
aaagtggtgcctccttgcctgt

SEQ ID NO: 730709 - DNA, 22 bp, Artificial Sequence
  chemically synthesized
ggtcaaagtacaggcaaggagg

SEQ ID NO: 730710 - DNA, 22 bp, Artificial Sequence
  chemically synthesized
cataaatagtgccccctaaaag

SEQ ID NO: 730711 - DNA, 22 bp, Artificial Sequence
  chemically synthesized
acaaccctccataaatagtgcc

SEQ ID NO: 730712 - DNA, 22 bp, Artificial Sequence
  chemically synthesized
cacaaccctccataaatagtgc

SEQ ID NO: 730713 - DNA, 22 bp, Artificial Sequence
  chemically synthesized
atttcacaaccctccataaata

SEQ ID NO: 730714 - DNA, 22 bp, Artificial Sequence
  chemically synthesized
ttagggggcactatttatggag

SEQ ID NO: 730715 - DNA, 22 bp, Artificial Sequence
  chemically synthesized
catttcacaaccctccataaat

SEQ ID NO: 730716 - DNA, 22 bp, Artificial Sequence
  chemically synthesized
tagggggcactatttatggagg

SEQ ID NO: 730717 - DNA, 22 bp, Artificial Sequence
  chemically synthesized
agggggcactatttatggaggg

SEQ ID NO: 730718 - DNA, 22 bp, Artificial Sequence
  chemically synthesized
gggggcactatttatggagggt

SEQ ID NO: 730719 - DNA, 22 bp, Artificial Sequence
  chemically synthesized
cttcatttcacaaccctccata

SEQ ID NO: 730720 - DNA, 22 bp, Artificial Sequence
  chemically synthesized
tacttcatttcacaaccctcca

SEQ ID NO: 730721 - DNA, 22 bp, Artificial Sequence
  chemically synthesized
agttctacttcatttcacaacc

SEQ ID NO: 730722 - DNA, 22 bp, Artificial Sequence
  chemically synthesized
tttatggagggttgtgaaatga

SEQ ID NO: 730723 - DNA, 22 bp, Artificial Sequence
  chemically synthesized
atggagggttgtgaaatgaagt

SEQ ID NO: 730724 - DNA, 22 bp, Artificial Sequence
  chemically synthesized
tggagggttgtgaaatgaagta

SEQ ID NO: 730725 - DNA, 22 bp, Artificial Sequence
  chemically synthesized
accacagagtgaattcagttct

SEQ ID NO: 730726 - DNA, 22 bp, Artificial Sequence
  chemically synthesized
tgaaatgaagtagaactgaatt

SEQ ID NO: 730727 - DNA, 22 bp, Artificial Sequence
  chemically synthesized
tggtgctaaccacagagtgaat

SEQ ID NO: 730728 - DNA, 22 bp, Artificial Sequence
  chemically synthesized
gtggtgctaaccacagagtgaa

SEQ ID NO: 730729 - DNA, 22 bp, Artificial Sequence
  chemically synthesized
tgtggtgctaaccacagagtga

SEQ ID NO: 730730 - DNA, 22 bp, Artificial Sequence
  chemically synthesized
aattcactctgtggttagcacc

SEQ ID NO: 730731 - DNA, 22 bp, Artificial Sequence
  chemically synthesized
agaagtgttttgtggtgctaac

SEQ ID NO: 730732 - DNA, 22 bp, Artificial Sequence
  chemically synthesized
gagaagtgttttgtggtgctaa

SEQ ID NO: 730733 - DNA, 22 bp, Artificial Sequence
  chemically synthesized
actctgtggttagcaccacaaa

SEQ ID NO: 730734 - DNA, 22 bp, Artificial Sequence
  chemically synthesized
tgtggttagcaccacaaaacac

SEQ ID NO: 730735 - DNA, 22 bp, Artificial Sequence
  chemically synthesized
tcaatttgagaagtgttttgtg

SEQ ID NO: 730736 - DNA, 22 bp, Artificial Sequence
  chemically synthesized
tggttagcaccacaaaacactt

SEQ ID NO: 730737 - DNA, 22 bp, Artificial Sequence
  chemically synthesized
aactgtcaatttgagaagtgtt

SEQ ID NO: 730738 - DNA, 22 bp, Artificial Sequence
  chemically synthesized
gcaccacaaaacacttctcaaa

SEQ ID NO: 730739 - DNA, 22 bp, Artificial Sequence
  chemically synthesized
tgttaaactgtcaatttgagaa

SEQ ID NO: 730740 - DNA, 22 bp, Artificial Sequence
  chemically synthesized
ctcaaattgacagtttaacaca

SEQ ID NO: 730741 - DNA, 22 bp, Artificial Sequence
  chemically synthesized
tcaaattgacagtttaacacaa

SEQ ID NO: 730742 - DNA, 22 bp, Artificial Sequence
  chemically synthesized
aaattgacagtttaacacaaca

SEQ ID NO: 730743 - DNA, 22 bp, Artificial Sequence
  chemically synthesized
acagtttaacacaacattcctc

SEQ ID NO: 730744 - DNA, 22 bp, Artificial Sequence
  chemically synthesized
aataaccatgcccaaggaggaa

SEQ ID NO: 730745 - DNA, 22 bp, Artificial Sequence
  chemically synthesized
caataaccatgcccaaggagga

SEQ ID NO: 730746 - DNA, 22 bp, Artificial Sequence
  chemically synthesized
aacacaacattcctccttgggc

SEQ ID NO: 730747 - DNA, 22 bp, Artificial Sequence
  chemically synthesized
acacaacattcctccttgggca

SEQ ID NO: 730748 - DNA, 22 bp, Artificial Sequence
  chemically synthesized
gtgatgtttcaataaccatgcc

SEQ ID NO: 730749 - DNA, 22 bp, Artificial Sequence
  chemically synthesized
ggtgatgtttcaataaccatgc

SEQ ID NO: 730750 - DNA, 22 bp, Artificial Sequence
  chemically synthesized
ctccttgggcatggttattgaa

SEQ ID NO: 730751 - DNA, 22 bp, Artificial Sequence
  chemically synthesized
cttgggcatggttattgaaaca

SEQ ID NO: 730752 - DNA, 22 bp, Artificial Sequence
  chemically synthesized
gtaaatttggtgatgtttcaat

SEQ ID NO: 730753 - DNA, 22 bp, Artificial Sequence
  chemically synthesized
ggtaaatttggtgatgtttcaa

SEQ ID NO: 730754 - DNA, 22 bp, Artificial Sequence
  chemically synthesized
gggcatggttattgaaacatca

SEQ ID NO: 730755 - DNA, 22 bp, Artificial Sequence
  chemically synthesized
ggcatggttattgaaacatcac

SEQ ID NO: 730756 - DNA, 22 bp, Artificial Sequence
  chemically synthesized
ttgaaacatcaccaaatttacc

SEQ ID NO: 730757 - DNA, 22 bp, Artificial Sequence
  chemically synthesized
aaacatcaccaaatttaccaaa

SEQ ID NO: 730758 - DNA, 22 bp, Artificial Sequence
  chemically synthesized
tacatggagagaaatataattt

SEQ ID NO: 730759 - DNA, 22 bp, Artificial Sequence
  chemically synthesized
accaaattatatttctctccat

SEQ ID NO: 730760 - DNA, 22 bp, Artificial Sequence
  chemically synthesized
catgaattatacatggagagaa

SEQ ID NO: 730761 - DNA, 22 bp, Artificial Sequence
  chemically synthesized
ccaaattatatttctctccatg

SEQ ID NO: 730762 - DNA, 22 bp, Artificial Sequence
  chemically synthesized
aactacatgaattatacatgga

SEQ ID NO: 730763 - DNA, 22 bp, Artificial Sequence
  chemically synthesized
ttaaactacatgaattatacat

SEQ ID NO: 730764 - DNA, 22 bp, Artificial Sequence
  chemically synthesized
tatttctctccatgtataattc

SEQ ID NO: 730765 - DNA, 22 bp, Artificial Sequence
  chemically synthesized
attaaactacatgaattataca

SEQ ID NO: 730766 - DNA, 22 bp, Artificial Sequence
  chemically synthesized
ctctccatgtataattcatgta

SEQ ID NO: 730767 - DNA, 22 bp, Artificial Sequence
  chemically synthesized
tctccatgtataattcatgtag

SEQ ID NO: 730768 - DNA, 22 bp, Artificial Sequence
  chemically synthesized
tccatgtataattcatgtagtt

SEQ ID NO: 730769 - DNA, 22 bp, Artificial Sequence
  chemically synthesized
acaatcttattaaactacatga

SEQ ID NO: 730770 - DNA, 22 bp, Artificial Sequence
  chemically synthesized
catgtataattcatgtagttta

SEQ ID NO: 730771 - DNA, 22 bp, Artificial Sequence
  chemically synthesized
ctcacaatcttattaaactaca

SEQ ID NO: 730772 - DNA, 22 bp, Artificial Sequence
  chemically synthesized
cgtggctgctcacaatcttatt

SEQ ID NO: 730773 - DNA, 22 bp, Artificial Sequence
  chemically synthesized
acgtggctgctcacaatcttat

SEQ ID NO: 730774 - DNA, 22 bp, Artificial Sequence
  chemically synthesized
tacgtggctgctcacaatctta

SEQ ID NO: 730775 - DNA, 22 bp, Artificial Sequence
  chemically synthesized
atgtagtttaataagattgtga

SEQ ID NO: 730776 - DNA, 22 bp, Artificial Sequence
  chemically synthesized
ttacgtggctgctcacaatctt

SEQ ID NO: 730777 - DNA, 22 bp, Artificial Sequence
  chemically synthesized
aataagattgtgagcagccacg

SEQ ID NO: 730778 - DNA, 22 bp, Artificial Sequence
  chemically synthesized
ataagattgtgagcagccacgt

SEQ ID NO: 730779 - DNA, 22 bp, Artificial Sequence
  chemically synthesized
agcagtgccttttacgtggctg

SEQ ID NO: 730780 - DNA, 22 bp, Artificial Sequence
  chemically synthesized
cagcagtgccttttacgtggct

SEQ ID NO: 730781 - DNA, 22 bp, Artificial Sequence
  chemically synthesized
aatttcagcagtgccttttacg

SEQ ID NO: 730782 - DNA, 22 bp, Artificial Sequence
  chemically synthesized
tgagcagccacgtaaaaggcac

SEQ ID NO: 730783 - DNA, 22 bp, Artificial Sequence
  chemically synthesized
cagcagtgtatctgaatttcag

SEQ ID NO: 730784 - DNA, 22 bp, Artificial Sequence
  chemically synthesized
tgctgcagcagtgtatctgaat

SEQ ID NO: 730785 - DNA, 22 bp, Artificial Sequence
  chemically synthesized
ctgaaattcagatacactgctg

SEQ ID NO: 730786 - DNA, 22 bp, Artificial Sequence
  chemically synthesized
aaattcagatacactgctgcag

SEQ ID NO: 730787 - DNA, 22 bp, Artificial Sequence
  chemically synthesized
aagtggtgttatgctgcagcag

SEQ ID NO: 730788 - DNA, 22 bp, Artificial Sequence
  chemically synthesized
aaagtggtgttatgctgcagca

SEQ ID NO: 730789 - DNA, 22 bp, Artificial Sequence
  chemically synthesized
taaagtggtgttatgctgcagc

SEQ ID NO: 730790 - DNA, 22 bp, Artificial Sequence
  chemically synthesized
ttaaagtggtgttatgctgcag

SEQ ID NO: 730791 - DNA, 22 bp, Artificial Sequence
  chemically synthesized
tttaaagtggtgttatgctgca

SEQ ID NO: 730792 - DNA, 22 bp, Artificial Sequence
  chemically synthesized
agatacactgctgcagcataac

SEQ ID NO: 730793 - DNA, 22 bp, Artificial Sequence
  chemically synthesized
ttttaaagtggtgttatgctgc

SEQ ID NO: 730794 - DNA, 22 bp, Artificial Sequence
  chemically synthesized
gcttttttaaagtggtgttatg

SEQ ID NO: 730795 - DNA, 22 bp, Artificial Sequence
  chemically synthesized
actggcttttttaaagtggtgt

SEQ ID NO: 730796 - DNA, 22 bp, Artificial Sequence
  chemically synthesized
aactggcttttttaaagtggtg

SEQ ID NO: 730797 - DNA, 22 bp, Artificial Sequence
  chemically synthesized
ctgcagcataacaccactttaa

SEQ ID NO: 730798 - DNA, 22 bp, Artificial Sequence
  chemically synthesized
cagcataacaccactttaaaaa

SEQ ID NO: 730799 - DNA, 22 bp, Artificial Sequence
  chemically synthesized
ccaacttaactggcttttttaa

SEQ ID NO: 730800 - DNA, 22 bp, Artificial Sequence
  chemically synthesized
gccaacttaactggctttttta

SEQ ID NO: 730801 - DNA, 22 bp, Artificial Sequence
  chemically synthesized
tgccaacttaactggctttttt

SEQ ID NO: 730802 - DNA, 22 bp, Artificial Sequence
  chemically synthesized
ctttgccaacttaactggcttt

SEQ ID NO: 730803 - DNA, 22 bp, Artificial Sequence
  chemically synthesized
actttgccaacttaactggctt

SEQ ID NO: 730804 - DNA, 22 bp, Artificial Sequence
  chemically synthesized
tactttgccaacttaactggct

SEQ ID NO: 730805 - DNA, 22 bp, Artificial Sequence
  chemically synthesized
ttactttgccaacttaactggc

SEQ ID NO: 730806 - DNA, 22 bp, Artificial Sequence
  chemically synthesized
tttactttgccaacttaactgg

SEQ ID NO: 730807 - DNA, 22 bp, Artificial Sequence
  chemically synthesized
ttttactttgccaacttaactg

SEQ ID NO: 730808 - DNA, 22 bp, Artificial Sequence
  chemically synthesized
tttttactttgccaacttaact

SEQ ID NO: 730809 - DNA, 22 bp, Artificial Sequence
  chemically synthesized
ttttttactttgccaacttaac

SEQ ID NO: 730810 - DNA, 22 bp, Artificial Sequence
  chemically synthesized
taaaaaagccagttaagttggc

SEQ ID NO: 730811 - DNA, 22 bp, Artificial Sequence
  chemically synthesized
tttttttactttgccaacttaa

SEQ ID NO: 730812 - DNA, 22 bp, Artificial Sequence
  chemically synthesized
aaaaaagccagttaagttggca

SEQ ID NO: 730813 - DNA, 22 bp, Artificial Sequence
  chemically synthesized
ttttttttactttgccaactta

SEQ ID NO: 730814 - DNA, 22 bp, Artificial Sequence
  chemically synthesized
aaaaagccagttaagttggcaa

SEQ ID NO: 730815 - DNA, 22 bp, Artificial Sequence
  chemically synthesized
tttttttttactttgccaactt

SEQ ID NO: 730816 - DNA, 22 bp, Artificial Sequence
  chemically synthesized
ttttttttttactttgccaact

SEQ ID NO: 730817 - DNA, 22 bp, Artificial Sequence
  chemically synthesized
tttttttttttactttgccaac

SEQ ID NO: 730818 - DNA, 22 bp, Artificial Sequence
  chemically synthesized
ttttttttttttactttgccaa

SEQ ID NO: 730819 - DNA, 22 bp, Artificial Sequence
  chemically synthesized
tttttttttttttactttgcca

SEQ ID NO: 730820 - DNA, 22 bp, Artificial Sequence
  chemically synthesized
taggctttttttttttttttac

SEQ ID NO: 730821 - DNA, 22 bp, Artificial Sequence
  chemically synthesized
agttggcaaagtaaaaaaaaaa

SEQ ID NO: 730822 - DNA, 22 bp, Artificial Sequence
  chemically synthesized
atattgtaggcttttttttttt

SEQ ID NO: 730823 - DNA, 22 bp, Artificial Sequence
  chemically synthesized
gcaaagtaaaaaaaaaaaaaaa

SEQ ID NO: 730824 - DNA, 22 bp, Artificial Sequence
  chemically synthesized
aatattgtaggctttttttttt

SEQ ID NO: 730825 - DNA, 22 bp, Artificial Sequence
  chemically synthesized
accttaatattgtaggcttttt

SEQ ID NO: 730826 - DNA, 22 bp, Artificial Sequence
  chemically synthesized
caccttaatattgtaggctttt

SEQ ID NO: 730827 - DNA, 22 bp, Artificial Sequence
  chemically synthesized
tcaccttaatattgtaggcttt

SEQ ID NO: 730828 - DNA, 22 bp, Artificial Sequence
  chemically synthesized
taaagttttcaccttaatattg

SEQ ID NO: 730829 - DNA, 22 bp, Artificial Sequence
  chemically synthesized
gagtcatgttgtaaagttttca

SEQ ID NO: 730830 - DNA, 22 bp, Artificial Sequence
  chemically synthesized
caatattaaggtgaaaacttta

SEQ ID NO: 730831 - DNA, 22 bp, Artificial Sequence
  chemically synthesized
actagagtcatgttgtaaagtt

SEQ ID NO: 730832 - DNA, 22 bp, Artificial Sequence
  chemically synthesized
aggtgaaaactttacaacatga

SEQ ID NO: 730833 - DNA, 22 bp, Artificial Sequence
  chemically synthesized
atattcactagagtcatgttgt

SEQ ID NO: 730834 - DNA, 22 bp, Artificial Sequence
  chemically synthesized
aatattcactagagtcatgttg

SEQ ID NO: 730835 - DNA, 22 bp, Artificial Sequence
  chemically synthesized
taatattcactagagtcatgtt

SEQ ID NO: 730836 - DNA, 22 bp, Artificial Sequence
  chemically synthesized
gactttaatattcactagagtc

SEQ ID NO: 730837 - DNA, 22 bp, Artificial Sequence
  chemically synthesized
agactttaatattcactagagt

SEQ ID NO: 730838 - DNA, 22 bp, Artificial Sequence
  chemically synthesized
tagactttaatattcactagag

SEQ ID NO: 730839 - DNA, 22 bp, Artificial Sequence
  chemically synthesized
tacaacatgactctagtgaata

SEQ ID NO: 730840 - DNA, 22 bp, Artificial Sequence
  chemically synthesized
acaacatgactctagtgaatat

SEQ ID NO: 730841 - DNA, 22 bp, Artificial Sequence
  chemically synthesized
ttttagactttaatattcacta

SEQ ID NO: 730842 - DNA, 22 bp, Artificial Sequence
  chemically synthesized
caacatgactctagtgaatatt

SEQ ID NO: 730843 - DNA, 22 bp, Artificial Sequence
  chemically synthesized
attttagactttaatattcact

SEQ ID NO: 730844 - DNA, 22 bp, Artificial Sequence
  chemically synthesized
tattttagactttaatattcac

SEQ ID NO: 730845 - DNA, 22 bp, Artificial Sequence
  chemically synthesized
ctttattttagactttaatatt

SEQ ID NO: 730846 - DNA, 22 bp, Artificial Sequence
  chemically synthesized
cctttattttagactttaatat

SEQ ID NO: 730847 - DNA, 22 bp, Artificial Sequence
  chemically synthesized
tcctttattttagactttaata

SEQ ID NO: 730848 - DNA, 22 bp, Artificial Sequence
  chemically synthesized
ttcctttattttagactttaat

SEQ ID NO: 730849 - DNA, 22 bp, Artificial Sequence
  chemically synthesized
ttttcctttattttagacttta

SEQ ID NO: 730850 - DNA, 22 bp, Artificial Sequence
  chemically synthesized
cttttcctttattttagacttt

SEQ ID NO: 730851 - DNA, 22 bp, Artificial Sequence
  chemically synthesized
tagtgaatattaaagtctaaaa

SEQ ID NO: 730852 - DNA, 22 bp, Artificial Sequence
  chemically synthesized
gtgaatattaaagtctaaaata

SEQ ID NO: 730853 - DNA, 22 bp, Artificial Sequence
  chemically synthesized
tttcttttcctttattttagac

SEQ ID NO: 730854 - DNA, 22 bp, Artificial Sequence
  chemically synthesized
agcaactgtttcttttccttta

SEQ ID NO: 730855 - DNA, 22 bp, Artificial Sequence
  chemically synthesized
aagtctaaaataaaggaaaaga

SEQ ID NO: 730856 - DNA, 22 bp, Artificial Sequence
  chemically synthesized
aaataaaggaaaagaaacagtt

SEQ ID NO: 730857 - DNA, 22 bp, Artificial Sequence
  chemically synthesized
gaaacattgagcaactgtttct

SEQ ID NO: 730858 - DNA, 22 bp, Artificial Sequence
  chemically synthesized
ggaaacattgagcaactgtttc

SEQ ID NO: 730859 - DNA, 22 bp, Artificial Sequence
  chemically synthesized
ggagaaaccgtatttggaaaca

SEQ ID NO: 730860 - DNA, 22 bp, Artificial Sequence
  chemically synthesized
ctcaatgtttccaaatacggtt

SEQ ID NO: 730861 - DNA, 22 bp, Artificial Sequence
  chemically synthesized
taaatctgggagaaaccgtatt

SEQ ID NO: 730862 - DNA, 22 bp, Artificial Sequence
  chemically synthesized
aatgtttccaaatacggtttct

SEQ ID NO: 730863 - DNA, 22 bp, Artificial Sequence
  chemically synthesized
ccaaatacggtttctcccagat

SEQ ID NO: 730864 - DNA, 22 bp, Artificial Sequence
  chemically synthesized
caaatacggtttctcccagatt

SEQ ID NO: 730865 - DNA, 22 bp, Artificial Sequence
  chemically synthesized
ctcccagatttatagttttctt

SEQ ID NO: 730866 - DNA, 22 bp, Artificial Sequence
  chemically synthesized
tcccagatttatagttttcttt

SEQ ID NO: 730867 - DNA, 22 bp, Artificial Sequence
  chemically synthesized
ccagatttatagttttctttat

SEQ ID NO: 730868 - DNA, 22 bp, Artificial Sequence
  chemically synthesized
atagttttctttatttctttat

SEQ ID NO: 730869 - DNA, 22 bp, Artificial Sequence
  chemically synthesized
tagttttctttatttctttatt

SEQ ID NO: 730870 - DNA, 22 bp, Artificial Sequence
  chemically synthesized
aaaaaataataataaaataaag

SEQ ID NO: 730871 - DNA, 22 bp, Artificial Sequence
  chemically synthesized
tctttatttctttattttatta

SEQ ID NO: 730872 - DNA, 22 bp, Artificial Sequence
  chemically synthesized
ctttatttctttattttattat

SEQ ID NO: 730873 - DNA, 22 bp, Artificial Sequence
  chemically synthesized
tttatttctttattttattatt

SEQ ID NO: 730874 - DNA, 22 bp, Artificial Sequence
  chemically synthesized
catctcaaaaaataataataaa

SEQ ID NO: 730875 - DNA, 22 bp, Artificial Sequence
  chemically synthesized
tatttctttattttattattat

SEQ ID NO: 730876 - DNA, 22 bp, Artificial Sequence
  chemically synthesized
atttctttattttattattatt

SEQ ID NO: 730877 - DNA, 22 bp, Artificial Sequence
  chemically synthesized
tttctttattttattattattt

SEQ ID NO: 730878 - DNA, 22 bp, Artificial Sequence
  chemically synthesized
ctttattttattattatttttt

SEQ ID NO: 730879 - DNA, 22 bp, Artificial Sequence
  chemically synthesized
tttattttattattattttttg

SEQ ID NO: 730880 - DNA, 22 bp, Artificial Sequence
  chemically synthesized
tattttattattattttttgag

SEQ ID NO: 730881 - DNA, 22 bp, Artificial Sequence
  chemically synthesized
attttattattattttttgaga

SEQ ID NO: 730882 - DNA, 22 bp, Artificial Sequence
  chemically synthesized
ttttattattattttttgagat

SEQ ID NO: 730883 - DNA, 22 bp, Artificial Sequence
  chemically synthesized
tattattattttttgagatgga

SEQ ID NO: 730884 - DNA, 22 bp, Artificial Sequence
  chemically synthesized
attattattttttgagatggag

SEQ ID NO: 730885 - DNA, 22 bp, Artificial Sequence
  chemically synthesized
ttattattttttgagatggagt

SEQ ID NO: 730886 - DNA, 22 bp, Artificial Sequence
  chemically synthesized
ggcaacagagtgaaactccatc

SEQ ID NO: 730887 - DNA, 22 bp, Artificial Sequence
  chemically synthesized
ttattttttgagatggagtttc

SEQ ID NO: 730888 - DNA, 22 bp, Artificial Sequence
  chemically synthesized
ttttttgagatggagtttcact

SEQ ID NO: 730889 - DNA, 22 bp, Artificial Sequence
  chemically synthesized
tttgagatggagtttcactctg

SEQ ID NO: 730890 - DNA, 22 bp, Artificial Sequence
  chemically synthesized
cagcctgggcaacagagtgaaa

SEQ ID NO: 730891 - DNA, 22 bp, Artificial Sequence
  chemically synthesized
ttgagatggagtttcactctgt

SEQ ID NO: 730892 - DNA, 22 bp, Artificial Sequence
  chemically synthesized
tgagatggagtttcactctgtt

SEQ ID NO: 730893 - DNA, 22 bp, Artificial Sequence
  chemically synthesized
gagatggagtttcactctgttg

SEQ ID NO: 730894 - DNA, 22 bp, Artificial Sequence
  chemically synthesized
agatggagtttcactctgttgc

SEQ ID NO: 730895 - DNA, 22 bp, Artificial Sequence
  chemically synthesized
cactccagcctgggcaacagag

SEQ ID NO: 730896 - DNA, 22 bp, Artificial Sequence
  chemically synthesized
caccactgcactccagcctggg

SEQ ID NO: 730897 - DNA, 22 bp, Artificial Sequence
  chemically synthesized
cactctgttgcccaggctggag

SEQ ID NO: 730898 - DNA, 22 bp, Artificial Sequence
  chemically synthesized
actctgttgcccaggctggagt

SEQ ID NO: 730899 - DNA, 22 bp, Artificial Sequence
  chemically synthesized
tgttgcccaggctggagtgcag

SEQ ID NO: 730900 - DNA, 22 bp, Artificial Sequence
  chemically synthesized
ttgcccaggctggagtgcagtg

SEQ ID NO: 730901 - DNA, 22 bp, Artificial Sequence
  chemically synthesized
cccaggctggagtgcagtggtg

SEQ ID NO: 730902 - DNA, 22 bp, Artificial Sequence
  chemically synthesized
cagtgagcagatattgcaccac

SEQ ID NO: 730903 - DNA, 22 bp, Artificial Sequence
  chemically synthesized
gagtgcagtggtgcaatatctg

SEQ ID NO: 730904 - DNA, 22 bp, Artificial Sequence
  chemically synthesized
aggttgcagtgagcagatattg

SEQ ID NO: 730905 - DNA, 22 bp, Artificial Sequence
  chemically synthesized
gaacccagggggctaaggttgc

SEQ ID NO: 730906 - DNA, 22 bp, Artificial Sequence
  chemically synthesized
ctggaacccagggggctaaggt

SEQ ID NO: 730907 - DNA, 22 bp, Artificial Sequence
  chemically synthesized
ctcactgcaaccttagccccct

SEQ ID NO: 730908 - DNA, 22 bp, Artificial Sequence
  chemically synthesized
actgcaaccttagccccctggg

SEQ ID NO: 730909 - DNA, 22 bp, Artificial Sequence
  chemically synthesized
caaccttagccccctgggttcc

SEQ ID NO: 730910 - DNA, 22 bp, Artificial Sequence
  chemically synthesized
aggcaggagaattgctggaacc

SEQ ID NO: 730911 - DNA, 22 bp, Artificial Sequence
  chemically synthesized
agccccctgggttccagcaatt

SEQ ID NO: 730912 - DNA, 22 bp, Artificial Sequence
  chemically synthesized
gccccctgggttccagcaattc

SEQ ID NO: 730913 - DNA, 22 bp, Artificial Sequence
  chemically synthesized
ggaggctgaggcaggagaattg

SEQ ID NO: 730914 - DNA, 22 bp, Artificial Sequence
  chemically synthesized
gggaggctgaggcaggagaatt

SEQ ID NO: 730915 - DNA, 22 bp, Artificial Sequence
  chemically synthesized
ggttccagcaattctcctgcct

SEQ ID NO: 730916 - DNA, 22 bp, Artificial Sequence
  chemically synthesized
cttgggaggctgaggcaggaga

SEQ ID NO: 730917 - DNA, 22 bp, Artificial Sequence
  chemically synthesized
cagcaattctcctgcctcagcc

SEQ ID NO: 730918 - DNA, 22 bp, Artificial Sequence
  chemically synthesized
taatcccagctacttgggaggc

SEQ ID NO: 730919 - DNA, 22 bp, Artificial Sequence
  chemically synthesized
tcctgcctcagcctcccaagta

SEQ ID NO: 730920 - DNA, 22 bp, Artificial Sequence
  chemically synthesized
ctgcctcagcctcccaagtagc

SEQ ID NO: 730921 - DNA, 22 bp, Artificial Sequence
  chemically synthesized
cctcagcctcccaagtagctgg

SEQ ID NO: 730922 - DNA, 22 bp, Artificial Sequence
  chemically synthesized
agcctcccaagtagctgggatt

SEQ ID NO: 730923 - DNA, 22 bp, Artificial Sequence
  chemically synthesized
ccaagtagctgggattacaggc

SEQ ID NO: 730924 - DNA, 22 bp, Artificial Sequence
  chemically synthesized
gccgggtgtggtggtgcatgcc

SEQ ID NO: 730925 - DNA, 22 bp, Artificial Sequence
  chemically synthesized
ggattacaggcatgcaccacca

SEQ ID NO: 730926 - DNA, 22 bp, Artificial Sequence
  chemically synthesized
caggcatgcaccaccacacccg

SEQ ID NO: 730927 - DNA, 22 bp, Artificial Sequence
  chemically synthesized
aatacaaaaaaaactagccggg

SEQ ID NO: 730928 - DNA, 22 bp, Artificial Sequence
  chemically synthesized
ctgaatacaaaaaaaactagcc

SEQ ID NO: 730929 - DNA, 22 bp, Artificial Sequence
  chemically synthesized
tactgaatacaaaaaaaactag

SEQ ID NO: 730930 - DNA, 22 bp, Artificial Sequence
  chemically synthesized
tctctactgaatacaaaaaaaa

SEQ ID NO: 730931 - DNA, 22 bp, Artificial Sequence
  chemically synthesized
gttttttttgtattcagtagag

SEQ ID NO: 730932 - DNA, 22 bp, Artificial Sequence
  chemically synthesized
tttttgtattcagtagagacag

SEQ ID NO: 730933 - DNA, 22 bp, Artificial Sequence
  chemically synthesized
ttttgtattcagtagagacagg

SEQ ID NO: 730934 - DNA, 22 bp, Artificial Sequence
  chemically synthesized
tttgtattcagtagagacaggg

SEQ ID NO: 730935 - DNA, 22 bp, Artificial Sequence
  chemically synthesized
ttgtattcagtagagacagggt

SEQ ID NO: 730936 - DNA, 22 bp, Artificial Sequence
  chemically synthesized
tgtattcagtagagacagggtt

SEQ ID NO: 730937 - DNA, 22 bp, Artificial Sequence
  chemically synthesized
gtattcagtagagacagggttt

SEQ ID NO: 730938 - DNA, 22 bp, Artificial Sequence
  chemically synthesized
accaacatgacgaaaccctgtc

SEQ ID NO: 730939 - DNA, 22 bp, Artificial Sequence
  chemically synthesized
tattcagtagagacagggtttc

SEQ ID NO: 730940 - DNA, 22 bp, Artificial Sequence
  chemically synthesized
agtagagacagggtttcgtcat

SEQ ID NO: 730941 - DNA, 22 bp, Artificial Sequence
  chemically synthesized
aagaccagcctgaccaacatga

SEQ ID NO: 730942 - DNA, 22 bp, Artificial Sequence
  chemically synthesized
cgtcatgttggtcaggctggtc

SEQ ID NO: 730943 - DNA, 22 bp, Artificial Sequence
  chemically synthesized
gtcatgttggtcaggctggtct

SEQ ID NO: 730944 - DNA, 22 bp, Artificial Sequence
  chemically synthesized
atgtcaggagttcaagaccagc

SEQ ID NO: 730945 - DNA, 22 bp, Artificial Sequence
  chemically synthesized
gatgtcaggagttcaagaccag

SEQ ID NO: 730946 - DNA, 22 bp, Artificial Sequence
  chemically synthesized
gtcaggctggtcttgaactcct

SEQ ID NO: 730947 - DNA, 22 bp, Artificial Sequence
  chemically synthesized
gtcttgaactcctgacatcaaa

SEQ ID NO: 730948 - DNA, 22 bp, Artificial Sequence
  chemically synthesized
gaactcctgacatcaaatgatc

SEQ ID NO: 730949 - DNA, 22 bp, Artificial Sequence
  chemically synthesized
aactcctgacatcaaatgatct

SEQ ID NO: 730950 - DNA, 22 bp, Artificial Sequence
  chemically synthesized
ggaggccgaggtgggtagatca

SEQ ID NO: 730951 - DNA, 22 bp, Artificial Sequence
  chemically synthesized
ctgacatcaaatgatctaccca

SEQ ID NO: 730952 - DNA, 22 bp, Artificial Sequence
  chemically synthesized
gggaggccgaggtgggtagatc

SEQ ID NO: 730953 - DNA, 22 bp, Artificial Sequence
  chemically synthesized
tgggaggccgaggtgggtagat

SEQ ID NO: 730954 - DNA, 22 bp, Artificial Sequence
  chemically synthesized
acatcaaatgatctacccacct

SEQ ID NO: 730955 - DNA, 22 bp, Artificial Sequence
  chemically synthesized
taatcccagcactttgggaggc

SEQ ID NO: 730956 - DNA, 22 bp, Artificial Sequence
  chemically synthesized
cccacctcggcctcccaaagtg

SEQ ID NO: 730957 - DNA, 22 bp, Artificial Sequence
  chemically synthesized
atgcctgtaatcccagcacttt

SEQ ID NO: 730958 - DNA, 22 bp, Artificial Sequence
  chemically synthesized
ggcctcccaaagtgctgggatt

SEQ ID NO: 730959 - DNA, 22 bp, Artificial Sequence
  chemically synthesized
ccaaagtgctgggattacaggc

SEQ ID NO: 730960 - DNA, 22 bp, Artificial Sequence
  chemically synthesized
ggggccgggtgcagtggctcat

SEQ ID NO: 730961 - DNA, 22 bp, Artificial Sequence
  chemically synthesized
ggattacaggcatgagccactg

SEQ ID NO: 730962 - DNA, 22 bp, Artificial Sequence
  chemically synthesized
caggcatgagccactgcacccg

SEQ ID NO: 730963 - DNA, 22 bp, Artificial Sequence
  chemically synthesized
taaatctgggggccgggtgcag

SEQ ID NO: 730964 - DNA, 22 bp, Artificial Sequence
  chemically synthesized
aaaactataaatctgggggccg

SEQ ID NO: 730965 - DNA, 22 bp, Artificial Sequence
  chemically synthesized
aaaaactataaatctgggggcc

SEQ ID NO: 730966 - DNA, 22 bp, Artificial Sequence
  chemically synthesized
tcttaaaaactataaatctggg

SEQ ID NO: 730967 - DNA, 22 bp, Artificial Sequence
  chemically synthesized
atcttaaaaactataaatctgg

SEQ ID NO: 730968 - DNA, 22 bp, Artificial Sequence
  chemically synthesized
tatcttaaaaactataaatctg

SEQ ID NO: 730969 - DNA, 22 bp, Artificial Sequence
  chemically synthesized
cacccggcccccagatttatag

SEQ ID NO: 730970 - DNA, 22 bp, Artificial Sequence
  chemically synthesized
ttatcttaaaaactataaatct

SEQ ID NO: 730971 - DNA, 22 bp, Artificial Sequence
  chemically synthesized
tcgcttttatcttaaaaactat

SEQ ID NO: 730972 - DNA, 22 bp, Artificial Sequence
  chemically synthesized
gtcgcttttatcttaaaaacta

SEQ ID NO: 730973 - DNA, 22 bp, Artificial Sequence
  chemically synthesized
gcttgtcgcttttatcttaaaa

SEQ ID NO: 730974 - DNA, 22 bp, Artificial Sequence
  chemically synthesized
ggcttgtcgcttttatcttaaa

SEQ ID NO: 730975 - DNA, 22 bp, Artificial Sequence
  chemically synthesized
atttggcttgtcgcttttatct

SEQ ID NO: 730976 - DNA, 22 bp, Artificial Sequence
  chemically synthesized
atagtttttaagataaaagcga

SEQ ID NO: 730977 - DNA, 22 bp, Artificial Sequence
  chemically synthesized
tagtttttaagataaaagcgac

SEQ ID NO: 730978 - DNA, 22 bp, Artificial Sequence
  chemically synthesized
aaacattaatttggcttgtcgc

SEQ ID NO: 730979 - DNA, 22 bp, Artificial Sequence
  chemically synthesized
ttaagataaaagcgacaagcca

SEQ ID NO: 730980 - DNA, 22 bp, Artificial Sequence
  chemically synthesized
aaaacattaatttggcttgtcg

SEQ ID NO: 730981 - DNA, 22 bp, Artificial Sequence
  chemically synthesized
taagataaaagcgacaagccaa

SEQ ID NO: 730982 - DNA, 22 bp, Artificial Sequence
  chemically synthesized
taaaacattaatttggcttgtc

SEQ ID NO: 730983 - DNA, 22 bp, Artificial Sequence
  chemically synthesized
aagataaaagcgacaagccaaa

SEQ ID NO: 730984 - DNA, 22 bp, Artificial Sequence
  chemically synthesized
ttaaaacattaatttggcttgt

SEQ ID NO: 730985 - DNA, 22 bp, Artificial Sequence
  chemically synthesized
agataaaagcgacaagccaaat

SEQ ID NO: 730986 - DNA, 22 bp, Artificial Sequence
  chemically synthesized
tttaaaacattaatttggcttg

SEQ ID NO: 730987 - DNA, 22 bp, Artificial Sequence
  chemically synthesized
gagctttttaaaacattaattt

SEQ ID NO: 730988 - DNA, 22 bp, Artificial Sequence
  chemically synthesized
cgagctttttaaaacattaatt

SEQ ID NO: 730989 - DNA, 22 bp, Artificial Sequence
  chemically synthesized
cccccatatgtttcgagctttt

SEQ ID NO: 730990 - DNA, 22 bp, Artificial Sequence
  chemically synthesized
ccccccatatgtttcgagcttt

SEQ ID NO: 730991 - DNA, 22 bp, Artificial Sequence
  chemically synthesized
tccccccatatgtttcgagctt

SEQ ID NO: 730992 - DNA, 22 bp, Artificial Sequence
  chemically synthesized
ttccccccatatgtttcgagct

SEQ ID NO: 730993 - DNA, 22 bp, Artificial Sequence
  chemically synthesized
atgttttaaaaagctcgaaaca

SEQ ID NO: 730994 - DNA, 22 bp, Artificial Sequence
  chemically synthesized
atttttccccccatatgtttcg

SEQ ID NO: 730995 - DNA, 22 bp, Artificial Sequence
  chemically synthesized
aatttttccccccatatgtttc

SEQ ID NO: 730996 - DNA, 22 bp, Artificial Sequence
  chemically synthesized
taaaaagctcgaaacatatggg

SEQ ID NO: 730997 - DNA, 22 bp, Artificial Sequence
  chemically synthesized
aaaaagctcgaaacatatgggg

SEQ ID NO: 730998 - DNA, 22 bp, Artificial Sequence
  chemically synthesized
tttaatttttccccccatatgt

SEQ ID NO: 730999 - DNA, 22 bp, Artificial Sequence
  chemically synthesized
aaaagctcgaaacatatggggg

SEQ ID NO: 731000 - DNA, 22 bp, Artificial Sequence
  chemically synthesized
gtttaatttttccccccatatg

SEQ ID NO: 731001 - DNA, 22 bp, Artificial Sequence
  chemically synthesized
tgtttaatttttccccccatat

SEQ ID NO: 731002 - DNA, 22 bp, Artificial Sequence
  chemically synthesized
gcactttgtttaatttttcccc

SEQ ID NO: 731003 - DNA, 22 bp, Artificial Sequence
  chemically synthesized
gaaacatatggggggaaaaatt

SEQ ID NO: 731004 - DNA, 22 bp, Artificial Sequence
  chemically synthesized
ggcactttgtttaatttttccc

SEQ ID NO: 731005 - DNA, 22 bp, Artificial Sequence
  chemically synthesized
cttggcactttgtttaattttt

SEQ ID NO: 731006 - DNA, 22 bp, Artificial Sequence
  chemically synthesized
actacttggcactttgtttaat

SEQ ID NO: 731007 - DNA, 22 bp, Artificial Sequence
  chemically synthesized
tatgttcactacttggcacttt

SEQ ID NO: 731008 - DNA, 22 bp, Artificial Sequence
  chemically synthesized
gctgtatgttcactacttggca

SEQ ID NO: 731009 - DNA, 22 bp, Artificial Sequence
  chemically synthesized
agctgtatgttcactacttggc

SEQ ID NO: 731010 - DNA, 22 bp, Artificial Sequence
  chemically synthesized
tttagctgtatgttcactactt

SEQ ID NO: 731011 - DNA, 22 bp, Artificial Sequence
  chemically synthesized
aacaaagtgccaagtagtgaac

SEQ ID NO: 731012 - DNA, 22 bp, Artificial Sequence
  chemically synthesized
ttatttagctgtatgttcacta

SEQ ID NO: 731013 - DNA, 22 bp, Artificial Sequence
  chemically synthesized
attatttagctgtatgttcact

SEQ ID NO: 731014 - DNA, 22 bp, Artificial Sequence
  chemically synthesized
tattatttagctgtatgttcac

SEQ ID NO: 731015 - DNA, 22 bp, Artificial Sequence
  chemically synthesized
ttattatttagctgtatgttca

SEQ ID NO: 731016 - DNA, 22 bp, Artificial Sequence
  chemically synthesized
tttattatttagctgtatgttc

SEQ ID NO: 731017 - DNA, 22 bp, Artificial Sequence
  chemically synthesized
ctttttattatttagctgtatg

SEQ ID NO: 731018 - DNA, 22 bp, Artificial Sequence
  chemically synthesized
aataataaaaagtagtcatact

SEQ ID NO: 731019 - DNA, 22 bp, Artificial Sequence
  chemically synthesized
aataacaaagcatcagtatgac

SEQ ID NO: 731020 - DNA, 22 bp, Artificial Sequence
  chemically synthesized
gaataacaaagcatcagtatga

SEQ ID NO: 731021 - DNA, 22 bp, Artificial Sequence
  chemically synthesized
tgaataacaaagcatcagtatg

SEQ ID NO: 731022 - DNA, 22 bp, Artificial Sequence
  chemically synthesized
ttgaataacaaagcatcagtat

SEQ ID NO: 731023 - DNA, 22 bp, Artificial Sequence
  chemically synthesized
aggaaaaatgatttttgaataa

SEQ ID NO: 731024 - DNA, 22 bp, Artificial Sequence
  chemically synthesized
gaggaaaaatgatttttgaata

SEQ ID NO: 731025 - DNA, 22 bp, Artificial Sequence
  chemically synthesized
tgaggaaaaatgatttttgaat

SEQ ID NO: 731026 - DNA, 22 bp, Artificial Sequence
  chemically synthesized
atgctttgttattcaaaaatca

SEQ ID NO: 731027 - DNA, 22 bp, Artificial Sequence
  chemically synthesized
tttgaggaaaaatgatttttga

SEQ ID NO: 731028 - DNA, 22 bp, Artificial Sequence
  chemically synthesized
ctctttgaggaaaaatgatttt

SEQ ID NO: 731029 - DNA, 22 bp, Artificial Sequence
  chemically synthesized
actctttgaggaaaaatgattt

SEQ ID NO: 731030 - DNA, 22 bp, Artificial Sequence
  chemically synthesized
tgttattcaaaaatcatttttc

SEQ ID NO: 731031 - DNA, 22 bp, Artificial Sequence
  chemically synthesized
gttattcaaaaatcatttttcc

SEQ ID NO: 731032 - DNA, 22 bp, Artificial Sequence
  chemically synthesized
ttattcaaaaatcatttttcct

SEQ ID NO: 731033 - DNA, 22 bp, Artificial Sequence
  chemically synthesized
acccttactctttgaggaaaaa

SEQ ID NO: 731034 - DNA, 22 bp, Artificial Sequence
  chemically synthesized
ttcaaaaatcatttttcctcaa

SEQ ID NO: 731035 - DNA, 22 bp, Artificial Sequence
  chemically synthesized
cacccttactctttgaggaaaa

SEQ ID NO: 731036 - DNA, 22 bp, Artificial Sequence
  chemically synthesized
tcacccttactctttgaggaaa

SEQ ID NO: 731037 - DNA, 22 bp, Artificial Sequence
  chemically synthesized
ttcacccttactctttgaggaa

SEQ ID NO: 731038 - DNA, 22 bp, Artificial Sequence
  chemically synthesized
aaaaatcatttttcctcaaaga

SEQ ID NO: 731039 - DNA, 22 bp, Artificial Sequence
  chemically synthesized
caatttttcacccttactcttt

SEQ ID NO: 731040 - DNA, 22 bp, Artificial Sequence
  chemically synthesized
acaatttttcacccttactctt

SEQ ID NO: 731041 - DNA, 22 bp, Artificial Sequence
  chemically synthesized
ttcctcaaagagtaagggtgaa

SEQ ID NO: 731042 - DNA, 22 bp, Artificial Sequence
  chemically synthesized
tcctcaaagagtaagggtgaaa

SEQ ID NO: 731043 - DNA, 22 bp, Artificial Sequence
  chemically synthesized
cctcaaagagtaagggtgaaaa

SEQ ID NO: 731044 - DNA, 22 bp, Artificial Sequence
  chemically synthesized
ctcaaagagtaagggtgaaaaa

SEQ ID NO: 731045 - DNA, 22 bp, Artificial Sequence
  chemically synthesized
aaagagtaagggtgaaaaattg

SEQ ID NO: 731046 - DNA, 22 bp, Artificial Sequence
  chemically synthesized
aacatgtagtgggatagtcctt

SEQ ID NO: 731047 - DNA, 22 bp, Artificial Sequence
  chemically synthesized
attgaacatgtagtgggatagt

SEQ ID NO: 731048 - DNA, 22 bp, Artificial Sequence
  chemically synthesized
aattgaacatgtagtgggatag

SEQ ID NO: 731049 - DNA, 22 bp, Artificial Sequence
  chemically synthesized
taaggactatcccactacatgt

SEQ ID NO: 731050 - DNA, 22 bp, Artificial Sequence
  chemically synthesized
gtcatttaattgaacatgtagt

SEQ ID NO: 731051 - DNA, 22 bp, Artificial Sequence
  chemically synthesized
agtcatttaattgaacatgtag

SEQ ID NO: 731052 - DNA, 22 bp, Artificial Sequence
  chemically synthesized
atttagtcatttaattgaacat

SEQ ID NO: 731053 - DNA, 22 bp, Artificial Sequence
  chemically synthesized
tcccactacatgttcaattaaa

SEQ ID NO: 731054 - DNA, 22 bp, Artificial Sequence
  chemically synthesized
cattaatttagtcatttaattg

SEQ ID NO: 731055 - DNA, 22 bp, Artificial Sequence
  chemically synthesized
tacattaatttagtcatttaat

SEQ ID NO: 731056 - DNA, 22 bp, Artificial Sequence
  chemically synthesized
catgttcaattaaatgactaaa

SEQ ID NO: 731057 - DNA, 22 bp, Artificial Sequence
  chemically synthesized
aatgtctctacattaatttagt

SEQ ID NO: 731058 - DNA, 22 bp, Artificial Sequence
  chemically synthesized
aattaaatgactaaattaatgt

SEQ ID NO: 731059 - DNA, 22 bp, Artificial Sequence
  chemically synthesized
attaaatgtctctacattaatt

SEQ ID NO: 731060 - DNA, 22 bp, Artificial Sequence
  chemically synthesized
aattaaatgtctctacattaat

SEQ ID NO: 731061 - DNA, 22 bp, Artificial Sequence
  chemically synthesized
taattaaatgtctctacattaa

SEQ ID NO: 731062 - DNA, 22 bp, Artificial Sequence
  chemically synthesized
aatgactaaattaatgtagaga

SEQ ID NO: 731063 - DNA, 22 bp, Artificial Sequence
  chemically synthesized
gtggaactttaattaaatgtct

SEQ ID NO: 731064 - DNA, 22 bp, Artificial Sequence
  chemically synthesized
aattaatgtagagacatttaat

SEQ ID NO: 731065 - DNA, 22 bp, Artificial Sequence
  chemically synthesized
atgtagagacatttaattaaag

SEQ ID NO: 731066 - DNA, 22 bp, Artificial Sequence
  chemically synthesized
gaaaaactagtggaactttaat

SEQ ID NO: 731067 - DNA, 22 bp, Artificial Sequence
  chemically synthesized
ggaaaaactagtggaactttaa

SEQ ID NO: 731068 - DNA, 22 bp, Artificial Sequence
  chemically synthesized
atagcatttggaaaaactagtg

SEQ ID NO: 731069 - DNA, 22 bp, Artificial Sequence
  chemically synthesized
aattaaagttccactagttttt

SEQ ID NO: 731070 - DNA, 22 bp, Artificial Sequence
  chemically synthesized
attaaagttccactagtttttc

SEQ ID NO: 731071 - DNA, 22 bp, Artificial Sequence
  chemically synthesized
aagttccactagtttttccaaa

SEQ ID NO: 731072 - DNA, 22 bp, Artificial Sequence
  chemically synthesized
cactagtttttccaaatgctat

SEQ ID NO: 731073 - DNA, 22 bp, Artificial Sequence
  chemically synthesized
gatagcggcgtaattaatagca

SEQ ID NO: 731074 - DNA, 22 bp, Artificial Sequence
  chemically synthesized
gtttttccaaatgctattaatt

SEQ ID NO: 731075 - DNA, 22 bp, Artificial Sequence
  chemically synthesized
agatagcggcgtaattaatagc

SEQ ID NO: 731076 - DNA, 22 bp, Artificial Sequence
  chemically synthesized
tagatagcggcgtaattaatag

SEQ ID NO: 731077 - DNA, 22 bp, Artificial Sequence
  chemically synthesized
ttccaaatgctattaattacgc

SEQ ID NO: 731078 - DNA, 22 bp, Artificial Sequence
  chemically synthesized
tccaaatgctattaattacgcc

SEQ ID NO: 731079 - DNA, 22 bp, Artificial Sequence
  chemically synthesized
attttagatagcggcgtaatta

SEQ ID NO: 731080 - DNA, 22 bp, Artificial Sequence
  chemically synthesized
ccaaatgctattaattacgccg

SEQ ID NO: 731081 - DNA, 22 bp, Artificial Sequence
  chemically synthesized
aattttagatagcggcgtaatt

SEQ ID NO: 731082 - DNA, 22 bp, Artificial Sequence
  chemically synthesized
caaatgctattaattacgccgc

SEQ ID NO: 731083 - DNA, 22 bp, Artificial Sequence
  chemically synthesized
ttaattacgccgctatctaaaa

SEQ ID NO: 731084 - DNA, 22 bp, Artificial Sequence
  chemically synthesized
gggagagatttaattttagata

SEQ ID NO: 731085 - DNA, 22 bp, Artificial Sequence
  chemically synthesized
ggggagagatttaattttagat

SEQ ID NO: 731086 - DNA, 22 bp, Artificial Sequence
  chemically synthesized
attacgccgctatctaaaatta

SEQ ID NO: 731087 - DNA, 22 bp, Artificial Sequence
  chemically synthesized
cgccgctatctaaaattaaatc

SEQ ID NO: 731088 - DNA, 22 bp, Artificial Sequence
  chemically synthesized
tctaaaattaaatctctcccca

SEQ ID NO: 731089 - DNA, 22 bp, Artificial Sequence
  chemically synthesized
aaattaaatctctccccaaacc

SEQ ID NO: 731090 - DNA, 22 bp, Artificial Sequence
  chemically synthesized
aatctctccccaaaccctttta

SEQ ID NO: 731091 - DNA, 22 bp, Artificial Sequence
  chemically synthesized
tccccaaacccttttacatttc

SEQ ID NO: 731092 - DNA, 22 bp, Artificial Sequence
  chemically synthesized
cccaaacccttttacatttctt

SEQ ID NO: 731093 - DNA, 22 bp, Artificial Sequence
  chemically synthesized
tatcagatgagcggaagaaatg

SEQ ID NO: 731094 - DNA, 22 bp, Artificial Sequence
  chemically synthesized
tgtctgtatcagatgagcggaa

SEQ ID NO: 731095 - DNA, 22 bp, Artificial Sequence
  chemically synthesized
ttacatttcttccgctcatctg

SEQ ID NO: 731096 - DNA, 22 bp, Artificial Sequence
  chemically synthesized
tacatttcttccgctcatctga

SEQ ID NO: 731097 - DNA, 22 bp, Artificial Sequence
  chemically synthesized
attatgtctgtatcagatgagc

SEQ ID NO: 731098 - DNA, 22 bp, Artificial Sequence
  chemically synthesized
acatttcttccgctcatctgat

SEQ ID NO: 731099 - DNA, 22 bp, Artificial Sequence
  chemically synthesized
aattatgtctgtatcagatgag

SEQ ID NO: 731100 - DNA, 22 bp, Artificial Sequence
  chemically synthesized
catttcttccgctcatctgata

SEQ ID NO: 731101 - DNA, 22 bp, Artificial Sequence
  chemically synthesized
taattatgtctgtatcagatga

SEQ ID NO: 731102 - DNA, 22 bp, Artificial Sequence
  chemically synthesized
cttccgctcatctgatacagac

SEQ ID NO: 731103 - DNA, 22 bp, Artificial Sequence
  chemically synthesized
ttccgctcatctgatacagaca

SEQ ID NO: 731104 - DNA, 22 bp, Artificial Sequence
  chemically synthesized
ccgctcatctgatacagacata

SEQ ID NO: 731105 - DNA, 22 bp, Artificial Sequence
  chemically synthesized
cagcattttaattatgtctgta

SEQ ID NO: 731106 - DNA, 22 bp, Artificial Sequence
  chemically synthesized
cgctcatctgatacagacataa

SEQ ID NO: 731107 - DNA, 22 bp, Artificial Sequence
  chemically synthesized
gcagcattttaattatgtctgt

SEQ ID NO: 731108 - DNA, 22 bp, Artificial Sequence
  chemically synthesized
atctgatacagacataattaaa

SEQ ID NO: 731109 - DNA, 22 bp, Artificial Sequence
  chemically synthesized
ggtaaacttgcagcattttaat

SEQ ID NO: 731110 - DNA, 22 bp, Artificial Sequence
  chemically synthesized
atacagacataattaaaatgct

SEQ ID NO: 731111 - DNA, 22 bp, Artificial Sequence
  chemically synthesized
aggtaaacttgcagcattttaa

SEQ ID NO: 731112 - DNA, 22 bp, Artificial Sequence
  chemically synthesized
gatgcgtttaggtaaacttgca

SEQ ID NO: 731113 - DNA, 22 bp, Artificial Sequence
  chemically synthesized
ggatgcgtttaggtaaacttgc

SEQ ID NO: 731114 - DNA, 22 bp, Artificial Sequence
  chemically synthesized
aaatgctgcaagtttacctaaa

SEQ ID NO: 731115 - DNA, 22 bp, Artificial Sequence
  chemically synthesized
taatatttggatgcgtttaggt

SEQ ID NO: 731116 - DNA, 22 bp, Artificial Sequence
  chemically synthesized
ataatatttggatgcgtttagg

SEQ ID NO: 731117 - DNA, 22 bp, Artificial Sequence
  chemically synthesized
tataatatttggatgcgtttag

SEQ ID NO: 731118 - DNA, 22 bp, Artificial Sequence
  chemically synthesized
ttataatatttggatgcgttta

SEQ ID NO: 731119 - DNA, 22 bp, Artificial Sequence
  chemically synthesized
caagtttacctaaacgcatcca

SEQ ID NO: 731120 - DNA, 22 bp, Artificial Sequence
  chemically synthesized
ttttataatatttggatgcgtt

SEQ ID NO: 731121 - DNA, 22 bp, Artificial Sequence
  chemically synthesized
cttttataatatttggatgcgt

SEQ ID NO: 731122 - DNA, 22 bp, Artificial Sequence
  chemically synthesized
tcttttataatatttggatgcg

SEQ ID NO: 731123 - DNA, 22 bp, Artificial Sequence
  chemically synthesized
acctaaacgcatccaaatatta

SEQ ID NO: 731124 - DNA, 22 bp, Artificial Sequence
  chemically synthesized
cctaaacgcatccaaatattat

SEQ ID NO: 731125 - DNA, 22 bp, Artificial Sequence
  chemically synthesized
atattttcttttataatatttg

SEQ ID NO: 731126 - DNA, 22 bp, Artificial Sequence
  chemically synthesized
catattttcttttataatattt

SEQ ID NO: 731127 - DNA, 22 bp, Artificial Sequence
  chemically synthesized
tcatattttcttttataatatt

SEQ ID NO: 731128 - DNA, 22 bp, Artificial Sequence
  chemically synthesized
ttcatattttcttttataatat

SEQ ID NO: 731129 - DNA, 22 bp, Artificial Sequence
  chemically synthesized
aacgcatccaaatattataaaa

SEQ ID NO: 731130 - DNA, 22 bp, Artificial Sequence
  chemically synthesized
cagtttttcatattttctttta

SEQ ID NO: 731131 - DNA, 22 bp, Artificial Sequence
  chemically synthesized
aaactccagtttttcatatttt

SEQ ID NO: 731132 - DNA, 22 bp, Artificial Sequence
  chemically synthesized
ctgaaactccagtttttcatat

SEQ ID NO: 731133 - DNA, 22 bp, Artificial Sequence
  chemically synthesized
taaaagaaaatatgaaaaactg

SEQ ID NO: 731134 - DNA, 22 bp, Artificial Sequence
  chemically synthesized
aggagctactgaaactccagtt

SEQ ID NO: 731135 - DNA, 22 bp, Artificial Sequence
  chemically synthesized
aaggagctactgaaactccagt

SEQ ID NO: 731136 - DNA, 22 bp, Artificial Sequence
  chemically synthesized
ttaaggagctactgaaactcca

SEQ ID NO: 731137 - DNA, 22 bp, Artificial Sequence
  chemically synthesized
cttaaggagctactgaaactcc

SEQ ID NO: 731138 - DNA, 22 bp, Artificial Sequence
  chemically synthesized
cagcttcttaaggagctactga

SEQ ID NO: 731139 - DNA, 22 bp, Artificial Sequence
  chemically synthesized
aaattccagcttcttaaggagc

SEQ ID NO: 731140 - DNA, 22 bp, Artificial Sequence
  chemically synthesized
gagtttcagtagctccttaaga

SEQ ID NO: 731141 - DNA, 22 bp, Artificial Sequence
  chemically synthesized
cagtagctccttaagaagctgg

SEQ ID NO: 731142 - DNA, 22 bp, Artificial Sequence
  chemically synthesized
agtagctccttaagaagctgga

SEQ ID NO: 731143 - DNA, 22 bp, Artificial Sequence
  chemically synthesized
tagaaatcccattaaaattcca

SEQ ID NO: 731144 - DNA, 22 bp, Artificial Sequence
  chemically synthesized
cttaagaagctggaattttaat

SEQ ID NO: 731145 - DNA, 22 bp, Artificial Sequence
  chemically synthesized
aagaagctggaattttaatggg

SEQ ID NO: 731146 - DNA, 22 bp, Artificial Sequence
  chemically synthesized
agaagctggaattttaatggga

SEQ ID NO: 731147 - DNA, 22 bp, Artificial Sequence
  chemically synthesized
cccaaggattgtagaaatccca

SEQ ID NO: 731148 - DNA, 22 bp, Artificial Sequence
  chemically synthesized
ccccaaggattgtagaaatccc

SEQ ID NO: 731149 - DNA, 22 bp, Artificial Sequence
  chemically synthesized
tccccaaggattgtagaaatcc

SEQ ID NO: 731150 - DNA, 22 bp, Artificial Sequence
  chemically synthesized
gaattttaatgggatttctaca

SEQ ID NO: 731151 - DNA, 22 bp, Artificial Sequence
  chemically synthesized
gttttccccaaggattgtagaa

SEQ ID NO: 731152 - DNA, 22 bp, Artificial Sequence
  chemically synthesized
taatgggatttctacaatcctt

SEQ ID NO: 731153 - DNA, 22 bp, Artificial Sequence
  chemically synthesized
ttggttttccccaaggattgta

SEQ ID NO: 731154 - DNA, 22 bp, Artificial Sequence
  chemically synthesized
aatgggatttctacaatccttg

SEQ ID NO: 731155 - DNA, 22 bp, Artificial Sequence
  chemically synthesized
atgggatttctacaatccttgg

SEQ ID NO: 731156 - DNA, 22 bp, Artificial Sequence
  chemically synthesized
cacatctattggttttccccaa

SEQ ID NO: 731157 - DNA, 22 bp, Artificial Sequence
  chemically synthesized
acacatctattggttttcccca

SEQ ID NO: 731158 - DNA, 22 bp, Artificial Sequence
  chemically synthesized
ctacaatccttggggaaaacca

SEQ ID NO: 731159 - DNA, 22 bp, Artificial Sequence
  chemically synthesized
tacaatccttggggaaaaccaa

SEQ ID NO: 731160 - DNA, 22 bp, Artificial Sequence
  chemically synthesized
cttacacatctattggttttcc

SEQ ID NO: 731161 - DNA, 22 bp, Artificial Sequence
  chemically synthesized
caatccttggggaaaaccaata

SEQ ID NO: 731162 - DNA, 22 bp, Artificial Sequence
  chemically synthesized
ggggaaaaccaatagatgtgta

SEQ ID NO: 731163 - DNA, 22 bp, Artificial Sequence
  chemically synthesized
gggaaaaccaatagatgtgtaa

SEQ ID NO: 731164 - DNA, 22 bp, Artificial Sequence
  chemically synthesized
tgtgtgtgtgtgcatgcctgct

SEQ ID NO: 731165 - DNA, 22 bp, Artificial Sequence
  chemically synthesized
gtgtgtgtgtgtgcatgcctgc

SEQ ID NO: 731166 - DNA, 22 bp, Artificial Sequence
  chemically synthesized
agacagtttgtgtgtgtgtgtg

SEQ ID NO: 731167 - DNA, 22 bp, Artificial Sequence
  chemically synthesized
gagacagtttgtgtgtgtgtgt

SEQ ID NO: 731168 - DNA, 22 bp, Artificial Sequence
  chemically synthesized
agaggaatcttgagacagtttg

SEQ ID NO: 731169 - DNA, 22 bp, Artificial Sequence
  chemically synthesized
cagaggaatcttgagacagttt

SEQ ID NO: 731170 - DNA, 22 bp, Artificial Sequence
  chemically synthesized
tcagaggaatcttgagacagtt

SEQ ID NO: 731171 - DNA, 22 bp, Artificial Sequence
  chemically synthesized
ttttcagaggaatcttgagaca

SEQ ID NO: 731172 - DNA, 22 bp, Artificial Sequence
  chemically synthesized
attttcagaggaatcttgagac

SEQ ID NO: 731173 - DNA, 22 bp, Artificial Sequence
  chemically synthesized
tctcaagattcctctgaaaata

SEQ ID NO: 731174 - DNA, 22 bp, Artificial Sequence
  chemically synthesized
aagattcctctgaaaataaatt

SEQ ID NO: 731175 - DNA, 22 bp, Artificial Sequence
  chemically synthesized
gatataaagagagaaatttatt

SEQ ID NO: 731176 - DNA, 22 bp, Artificial Sequence
  chemically synthesized
agatataaagagagaaatttat

SEQ ID NO: 731177 - DNA, 22 bp, Artificial Sequence
  chemically synthesized
ctctgaaaataaatttctctct

SEQ ID NO: 731178 - DNA, 22 bp, Artificial Sequence
  chemically synthesized
tgaaaataaatttctctcttta

SEQ ID NO: 731179 - DNA, 22 bp, Artificial Sequence
  chemically synthesized
aaaataaatttctctctttata

SEQ ID NO: 731180 - DNA, 22 bp, Artificial Sequence
  chemically synthesized
cagcaccttagatataaagaga

SEQ ID NO: 731181 - DNA, 22 bp, Artificial Sequence
  chemically synthesized
actgcagcaccttagatataaa

SEQ ID NO: 731182 - DNA, 22 bp, Artificial Sequence
  chemically synthesized
ctctctttatatctaaggtgct

SEQ ID NO: 731183 - DNA, 22 bp, Artificial Sequence
  chemically synthesized
tctctttatatctaaggtgctg

SEQ ID NO: 731184 - DNA, 22 bp, Artificial Sequence
  chemically synthesized
tggtattcactgcagcacctta

SEQ ID NO: 731185 - DNA, 22 bp, Artificial Sequence
  chemically synthesized
tctttatatctaaggtgctgca

SEQ ID NO: 731186 - DNA, 22 bp, Artificial Sequence
  chemically synthesized
tttatatctaaggtgctgcagt

SEQ ID NO: 731187 - DNA, 22 bp, Artificial Sequence
  chemically synthesized
tctgtggtattcactgcagcac

SEQ ID NO: 731188 - DNA, 22 bp, Artificial Sequence
  chemically synthesized
tatatctaaggtgctgcagtga

SEQ ID NO: 731189 - DNA, 22 bp, Artificial Sequence
  chemically synthesized
atatctaaggtgctgcagtgaa

SEQ ID NO: 731190 - DNA, 22 bp, Artificial Sequence
  chemically synthesized
tatctaaggtgctgcagtgaat

SEQ ID NO: 731191 - DNA, 22 bp, Artificial Sequence
  chemically synthesized
tagttgtctgtggtattcactg

SEQ ID NO: 731192 - DNA, 22 bp, Artificial Sequence
  chemically synthesized
aggtgctgcagtgaataccaca

SEQ ID NO: 731193 - DNA, 22 bp, Artificial Sequence
  chemically synthesized
aaactatagttgtctgtggtat

SEQ ID NO: 731194 - DNA, 22 bp, Artificial Sequence
  chemically synthesized
gaaactatagttgtctgtggta

SEQ ID NO: 731195 - DNA, 22 bp, Artificial Sequence
  chemically synthesized
tgaaactatagttgtctgtggt

SEQ ID NO: 731196 - DNA, 22 bp, Artificial Sequence
  chemically synthesized
cagtgaataccacagacaacta

SEQ ID NO: 731197 - DNA, 22 bp, Artificial Sequence
  chemically synthesized
gtagaaaacctttgaaactata

SEQ ID NO: 731198 - DNA, 22 bp, Artificial Sequence
  chemically synthesized
ctggtagaaaacctttgaaact

SEQ ID NO: 731199 - DNA, 22 bp, Artificial Sequence
  chemically synthesized
gctggtagaaaacctttgaaac

SEQ ID NO: 731200 - DNA, 22 bp, Artificial Sequence
  chemically synthesized
tgctggtagaaaacctttgaaa

SEQ ID NO: 731201 - DNA, 22 bp, Artificial Sequence
  chemically synthesized
ttgctggtagaaaacctttgaa

SEQ ID NO: 731202 - DNA, 22 bp, Artificial Sequence
  chemically synthesized
tcttttgctggtagaaaacctt

SEQ ID NO: 731203 - DNA, 22 bp, Artificial Sequence
  chemically synthesized
gtcttttgctggtagaaaacct

SEQ ID NO: 731204 - DNA, 22 bp, Artificial Sequence
  chemically synthesized
ttgtcttttgctggtagaaaac

SEQ ID NO: 731205 - DNA, 22 bp, Artificial Sequence
  chemically synthesized
tagtttcaaaggttttctacca

SEQ ID NO: 731206 - DNA, 22 bp, Artificial Sequence
  chemically synthesized
caaaggttttctaccagcaaaa

SEQ ID NO: 731207 - DNA, 22 bp, Artificial Sequence
  chemically synthesized
aaaggttttctaccagcaaaag

SEQ ID NO: 731208 - DNA, 22 bp, Artificial Sequence
  chemically synthesized
aaaaattcttgtcttttgctgg

SEQ ID NO: 731209 - DNA, 22 bp, Artificial Sequence
  chemically synthesized
caaaaattcttgtcttttgctg

SEQ ID NO: 731210 - DNA, 22 bp, Artificial Sequence
  chemically synthesized
tctaccagcaaaagacaagaat

SEQ ID NO: 731211 - DNA, 22 bp, Artificial Sequence
  chemically synthesized
ctaccagcaaaagacaagaatt

SEQ ID NO: 731212 - DNA, 22 bp, Artificial Sequence
  chemically synthesized
taccagcaaaagacaagaattt

SEQ ID NO: 731213 - DNA, 22 bp, Artificial Sequence
  chemically synthesized
ccagcaaaagacaagaattttt

SEQ ID NO: 731214 - DNA, 22 bp, Artificial Sequence
  chemically synthesized
cccagtgtcttcaaaaattctt

SEQ ID NO: 731215 - DNA, 22 bp, Artificial Sequence
  chemically synthesized
attacccagtgtcttcaaaaat

SEQ ID NO: 731216 - DNA, 22 bp, Artificial Sequence
  chemically synthesized
caattaattacccagtgtcttc

SEQ ID NO: 731217 - DNA, 22 bp, Artificial Sequence
  chemically synthesized
tgcctgcaattaattacccagt

SEQ ID NO: 731218 - DNA, 22 bp, Artificial Sequence
  chemically synthesized
gtgcctgcaattaattacccag

SEQ ID NO: 731219 - DNA, 22 bp, Artificial Sequence
  chemically synthesized
ttgaagacactgggtaattaat

SEQ ID NO: 731220 - DNA, 22 bp, Artificial Sequence
  chemically synthesized
tgaagacactgggtaattaatt

SEQ ID NO: 731221 - DNA, 22 bp, Artificial Sequence
  chemically synthesized
gaagacactgggtaattaattg

SEQ ID NO: 731222 - DNA, 22 bp, Artificial Sequence
  chemically synthesized
aagacactgggtaattaattgc

SEQ ID NO: 731223 - DNA, 22 bp, Artificial Sequence
  chemically synthesized
gagtacaccttgtgcctgcaat

SEQ ID NO: 731224 - DNA, 22 bp, Artificial Sequence
  chemically synthesized
ggtaattaattgcaggcacaag

SEQ ID NO: 731225 - DNA, 22 bp, Artificial Sequence
  chemically synthesized
taactagagtacaccttgtgcc

SEQ ID NO: 731226 - DNA, 22 bp, Artificial Sequence
  chemically synthesized
attgcaggcacaaggtgtactc

SEQ ID NO: 731227 - DNA, 22 bp, Artificial Sequence
  chemically synthesized
caggcacaaggtgtactctagt

SEQ ID NO: 731228 - DNA, 22 bp, Artificial Sequence
  chemically synthesized
gaaaatggtagcacagaagtgt

SEQ ID NO: 731229 - DNA, 22 bp, Artificial Sequence
  chemically synthesized
cgaaaatggtagcacagaagtg

SEQ ID NO: 731230 - DNA, 22 bp, Artificial Sequence
  chemically synthesized
tagttataacacttctgtgcta

SEQ ID NO: 731231 - DNA, 22 bp, Artificial Sequence
  chemically synthesized
tttcgaaaatggtagcacagaa

SEQ ID NO: 731232 - DNA, 22 bp, Artificial Sequence
  chemically synthesized
gttataacacttctgtgctacc

SEQ ID NO: 731233 - DNA, 22 bp, Artificial Sequence
  chemically synthesized
ttgtttcgaaaatggtagcaca

SEQ ID NO: 731234 - DNA, 22 bp, Artificial Sequence
  chemically synthesized
attgtttcgaaaatggtagcac

SEQ ID NO: 731235 - DNA, 22 bp, Artificial Sequence
  chemically synthesized
taacacttctgtgctaccattt

SEQ ID NO: 731236 - DNA, 22 bp, Artificial Sequence
  chemically synthesized
ctgtgctaccattttcgaaaca

SEQ ID NO: 731237 - DNA, 22 bp, Artificial Sequence
  chemically synthesized
aggaatgcttattgtttcgaaa

SEQ ID NO: 731238 - DNA, 22 bp, Artificial Sequence
  chemically synthesized
tgtgctaccattttcgaaacaa

SEQ ID NO: 731239 - DNA, 22 bp, Artificial Sequence
  chemically synthesized
tgctaccattttcgaaacaata

SEQ ID NO: 731240 - DNA, 22 bp, Artificial Sequence
  chemically synthesized
ttaaggaatgcttattgtttcg

SEQ ID NO: 731241 - DNA, 22 bp, Artificial Sequence
  chemically synthesized
ccattttcgaaacaataagcat

SEQ ID NO: 731242 - DNA, 22 bp, Artificial Sequence
  chemically synthesized
agccgctattaaggaatgctta

SEQ ID NO: 731243 - DNA, 22 bp, Artificial Sequence
  chemically synthesized
tgagccgctattaaggaatgct

SEQ ID NO: 731244 - DNA, 22 bp, Artificial Sequence
  chemically synthesized
tcgaaacaataagcattcctta

SEQ ID NO: 731245 - DNA, 22 bp, Artificial Sequence
  chemically synthesized
ctgagccgctattaaggaatgc

SEQ ID NO: 731246 - DNA, 22 bp, Artificial Sequence
  chemically synthesized
cgaaacaataagcattccttaa

SEQ ID NO: 731247 - DNA, 22 bp, Artificial Sequence
  chemically synthesized
tctgagccgctattaaggaatg

SEQ ID NO: 731248 - DNA, 22 bp, Artificial Sequence
  chemically synthesized
gaaacaataagcattccttaat

SEQ ID NO: 731249 - DNA, 22 bp, Artificial Sequence
  chemically synthesized
aagagtgcctttctgagccgct

SEQ ID NO: 731250 - DNA, 22 bp, Artificial Sequence
  chemically synthesized
aaagagtgcctttctgagccgc

SEQ ID NO: 731251 - DNA, 22 bp, Artificial Sequence
  chemically synthesized
ttaaagagtgcctttctgagcc

SEQ ID NO: 731252 - DNA, 22 bp, Artificial Sequence
  chemically synthesized
tcttaaagagtgcctttctgag

SEQ ID NO: 731253 - DNA, 22 bp, Artificial Sequence
  chemically synthesized
cttaatagcggctcagaaaggc

SEQ ID NO: 731254 - DNA, 22 bp, Artificial Sequence
  chemically synthesized
ctcttaaagagtgcctttctga

SEQ ID NO: 731255 - DNA, 22 bp, Artificial Sequence
  chemically synthesized
aatagcggctcagaaaggcact

SEQ ID NO: 731256 - DNA, 22 bp, Artificial Sequence
  chemically synthesized
tttctcttaaagagtgcctttc

SEQ ID NO: 731257 - DNA, 22 bp, Artificial Sequence
  chemically synthesized
atagcggctcagaaaggcactc

SEQ ID NO: 731258 - DNA, 22 bp, Artificial Sequence
  chemically synthesized
caaactgtttctcttaaagagt

SEQ ID NO: 731259 - DNA, 22 bp, Artificial Sequence
  chemically synthesized
agaaaggcactctttaagagaa

SEQ ID NO: 731260 - DNA, 22 bp, Artificial Sequence
  chemically synthesized
aattccaaactgtttctcttaa

SEQ ID NO: 731261 - DNA, 22 bp, Artificial Sequence
  chemically synthesized
tttaagagaaacagtttggaat

SEQ ID NO: 731262 - DNA, 22 bp, Artificial Sequence
  chemically synthesized
taagagaaacagtttggaattc

SEQ ID NO: 731263 - DNA, 22 bp, Artificial Sequence
  chemically synthesized
aagagaaacagtttggaattca

SEQ ID NO: 731264 - DNA, 22 bp, Artificial Sequence
  chemically synthesized
agagaaacagtttggaattcag

SEQ ID NO: 731265 - DNA, 22 bp, Artificial Sequence
  chemically synthesized
gatacaatacaaggaagcctga

SEQ ID NO: 731266 - DNA, 22 bp, Artificial Sequence
  chemically synthesized
ggatacaatacaaggaagcctg

SEQ ID NO: 731267 - DNA, 22 bp, Artificial Sequence
  chemically synthesized
ggaattcaggcttccttgtatt

SEQ ID NO: 731268 - DNA, 22 bp, Artificial Sequence
  chemically synthesized
gaattcaggcttccttgtattg

SEQ ID NO: 731269 - DNA, 22 bp, Artificial Sequence
  chemically synthesized
gaagtttggatacaatacaagg

SEQ ID NO: 731270 - DNA, 22 bp, Artificial Sequence
  chemically synthesized
ggaagtttggatacaatacaag

SEQ ID NO: 731271 - DNA, 22 bp, Artificial Sequence
  chemically synthesized
aggcttccttgtattgtatcca

SEQ ID NO: 731272 - DNA, 22 bp, Artificial Sequence
  chemically synthesized
catttggaagtttggatacaat

SEQ ID NO: 731273 - DNA, 22 bp, Artificial Sequence
  chemically synthesized
ccatttggaagtttggatacaa

SEQ ID NO: 731274 - DNA, 22 bp, Artificial Sequence
  chemically synthesized
tccatttggaagtttggataca

SEQ ID NO: 731275 - DNA, 22 bp, Artificial Sequence
  chemically synthesized
ttccatttggaagtttggatac

SEQ ID NO: 731276 - DNA, 22 bp, Artificial Sequence
  chemically synthesized
tttccatttggaagtttggata

SEQ ID NO: 731277 - DNA, 22 bp, Artificial Sequence
  chemically synthesized
ttttccatttggaagtttggat

SEQ ID NO: 731278 - DNA, 22 bp, Artificial Sequence
  chemically synthesized
ccttgtattgtatccaaacttc

SEQ ID NO: 731279 - DNA, 22 bp, Artificial Sequence
  chemically synthesized
cttgtattgtatccaaacttcc

SEQ ID NO: 731280 - DNA, 22 bp, Artificial Sequence
  chemically synthesized
gtttttttccatttggaagttt

SEQ ID NO: 731281 - DNA, 22 bp, Artificial Sequence
  chemically synthesized
gtattgtatccaaacttccaaa

SEQ ID NO: 731282 - DNA, 22 bp, Artificial Sequence
  chemically synthesized
tattgtatccaaacttccaaat

SEQ ID NO: 731283 - DNA, 22 bp, Artificial Sequence
  chemically synthesized
tatccaaacttccaaatggaaa

SEQ ID NO: 731284 - DNA, 22 bp, Artificial Sequence
  chemically synthesized
tccaggctggtttttttccatt

SEQ ID NO: 731285 - DNA, 22 bp, Artificial Sequence
  chemically synthesized
ggattgtccaggctggtttttt

SEQ ID NO: 731286 - DNA, 22 bp, Artificial Sequence
  chemically synthesized
ccaaatggaaaaaaaccagcct

SEQ ID NO: 731287 - DNA, 22 bp, Artificial Sequence
  chemically synthesized
caaatggaaaaaaaccagcctg

SEQ ID NO: 731288 - DNA, 22 bp, Artificial Sequence
  chemically synthesized
catatagaatgaagctgggatt

SEQ ID NO: 731289 - DNA, 22 bp, Artificial Sequence
  chemically synthesized
gcatatagaatgaagctgggat

SEQ ID NO: 731290 - DNA, 22 bp, Artificial Sequence
  chemically synthesized
gacaatcccagcttcattctat

SEQ ID NO: 731291 - DNA, 22 bp, Artificial Sequence
  chemically synthesized
gagaataacttgcatatagaat

SEQ ID NO: 731292 - DNA, 22 bp, Artificial Sequence
  chemically synthesized
actggagaataacttgcatata

SEQ ID NO: 731293 - DNA, 22 bp, Artificial Sequence
  chemically synthesized
ctcactggagaataacttgcat

SEQ ID NO: 731294 - DNA, 22 bp, Artificial Sequence
  chemically synthesized
actcactggagaataacttgca

SEQ ID NO: 731295 - DNA, 22 bp, Artificial Sequence
  chemically synthesized
cattctatatgcaagttattct

SEQ ID NO: 731296 - DNA, 22 bp, Artificial Sequence
  chemically synthesized
tttactcactggagaataactt

SEQ ID NO: 731297 - DNA, 22 bp, Artificial Sequence
  chemically synthesized
attctatatgcaagttattctc

SEQ ID NO: 731298 - DNA, 22 bp, Artificial Sequence
  chemically synthesized
gtttactcactggagaataact

SEQ ID NO: 731299 - DNA, 22 bp, Artificial Sequence
  chemically synthesized
tgtttactcactggagaataac

SEQ ID NO: 731300 - DNA, 22 bp, Artificial Sequence
  chemically synthesized
tatatgcaagttattctccagt

SEQ ID NO: 731301 - DNA, 22 bp, Artificial Sequence
  chemically synthesized
tatgcaagttattctccagtga

SEQ ID NO: 731302 - DNA, 22 bp, Artificial Sequence
  chemically synthesized
ggatcaacctttgtttactcac

SEQ ID NO: 731303 - DNA, 22 bp, Artificial Sequence
  chemically synthesized
ttctccagtgagtaaacaaagg

SEQ ID NO: 731304 - DNA, 22 bp, Artificial Sequence
  chemically synthesized
ggagttaggatcaacctttgtt

SEQ ID NO: 731305 - DNA, 22 bp, Artificial Sequence
  chemically synthesized
tccagtgagtaaacaaaggttg

SEQ ID NO: 731306 - DNA, 22 bp, Artificial Sequence
  chemically synthesized
gggagttaggatcaacctttgt

SEQ ID NO: 731307 - DNA, 22 bp, Artificial Sequence
  chemically synthesized
cagtgagtaaacaaaggttgat

SEQ ID NO: 731308 - DNA, 22 bp, Artificial Sequence
  chemically synthesized
ataaaataagtttgggagttag

SEQ ID NO: 731309 - DNA, 22 bp, Artificial Sequence
  chemically synthesized
atcctaactcccaaacttattt

SEQ ID NO: 731310 - DNA, 22 bp, Artificial Sequence
  chemically synthesized
tatatgattaataaaataagtt

SEQ ID NO: 731311 - DNA, 22 bp, Artificial Sequence
  chemically synthesized
gtatatgattaataaaataagt

SEQ ID NO: 731312 - DNA, 22 bp, Artificial Sequence
  chemically synthesized
actcccaaacttattttattaa

SEQ ID NO: 731313 - DNA, 22 bp, Artificial Sequence
  chemically synthesized
atcttgtatatgattaataaaa

SEQ ID NO: 731314 - DNA, 22 bp, Artificial Sequence
  chemically synthesized
catcttgtatatgattaataaa

SEQ ID NO: 731315 - DNA, 22 bp, Artificial Sequence
  chemically synthesized
tcatcttgtatatgattaataa

SEQ ID NO: 731316 - DNA, 22 bp, Artificial Sequence
  chemically synthesized
ccaaacttattttattaatcat

SEQ ID NO: 731317 - DNA, 22 bp, Artificial Sequence
  chemically synthesized
attttattaatcatatacaaga

SEQ ID NO: 731318 - DNA, 22 bp, Artificial Sequence
  chemically synthesized
ttttattaatcatatacaagat

SEQ ID NO: 731319 - DNA, 22 bp, Artificial Sequence
  chemically synthesized
atcaatgtgttttcatcttgta

SEQ ID NO: 731320 - DNA, 22 bp, Artificial Sequence
  chemically synthesized
tattaatcatatacaagatgaa

SEQ ID NO: 731321 - DNA, 22 bp, Artificial Sequence
  chemically synthesized
gatcaatgtgttttcatcttgt

SEQ ID NO: 731322 - DNA, 22 bp, Artificial Sequence
  chemically synthesized
attaatcatatacaagatgaaa

SEQ ID NO: 731323 - DNA, 22 bp, Artificial Sequence
  chemically synthesized
ttaatcatatacaagatgaaaa

SEQ ID NO: 731324 - DNA, 22 bp, Artificial Sequence
  chemically synthesized
tttgatcaatgtgttttcatct

SEQ ID NO: 731325 - DNA, 22 bp, Artificial Sequence
  chemically synthesized
gtttgatcaatgtgttttcatc

SEQ ID NO: 731326 - DNA, 22 bp, Artificial Sequence
  chemically synthesized
atcatatacaagatgaaaacac

SEQ ID NO: 731327 - DNA, 22 bp, Artificial Sequence
  chemically synthesized
gtagaccttgtttgatcaatgt

SEQ ID NO: 731328 - DNA, 22 bp, Artificial Sequence
  chemically synthesized
atgttagtagaccttgtttgat

SEQ ID NO: 731329 - DNA, 22 bp, Artificial Sequence
  chemically synthesized
atcaaacaaggtctactaacat

SEQ ID NO: 731330 - DNA, 22 bp, Artificial Sequence
  chemically synthesized
ctaacatgagacttctcttatt

SEQ ID NO: 731331 - DNA, 22 bp, Artificial Sequence
  chemically synthesized
acatgagacttctcttatttcc

SEQ ID NO: 731332 - DNA, 22 bp, Artificial Sequence
  chemically synthesized
tcagaatcaagtaagagaaagg

SEQ ID NO: 731333 - DNA, 22 bp, Artificial Sequence
  chemically synthesized
ctcttatttcctttctcttact

SEQ ID NO: 731334 - DNA, 22 bp, Artificial Sequence
  chemically synthesized
tcttatttcctttctcttactt

SEQ ID NO: 731335 - DNA, 22 bp, Artificial Sequence
  chemically synthesized
ttatttcctttctcttacttga

SEQ ID NO: 731336 - DNA, 22 bp, Artificial Sequence
  chemically synthesized
atttcctttctcttacttgatt

SEQ ID NO: 731337 - DNA, 22 bp, Artificial Sequence
  chemically synthesized
tttcctttctcttacttgattc

SEQ ID NO: 731338 - DNA, 22 bp, Artificial Sequence
  chemically synthesized
cctttctcttacttgattctga

SEQ ID NO: 731339 - DNA, 22 bp, Artificial Sequence
  chemically synthesized
aaaggacaactgtcagaatcaa

SEQ ID NO: 731340 - DNA, 22 bp, Artificial Sequence
  chemically synthesized
ctttctcttacttgattctgac

SEQ ID NO: 731341 - DNA, 22 bp, Artificial Sequence
  chemically synthesized
tctcttacttgattctgacagt

SEQ ID NO: 731342 - DNA, 22 bp, Artificial Sequence
  chemically synthesized
ctcttacttgattctgacagtt

SEQ ID NO: 731343 - DNA, 22 bp, Artificial Sequence
  chemically synthesized
tcttacttgattctgacagttg

SEQ ID NO: 731344 - DNA, 22 bp, Artificial Sequence
  chemically synthesized
ttacttgattctgacagttgtc

SEQ ID NO: 731345 - DNA, 22 bp, Artificial Sequence
  chemically synthesized
acttgattctgacagttgtcct

SEQ ID NO: 731346 - DNA, 22 bp, Artificial Sequence
  chemically synthesized
cttgattctgacagttgtcctt

SEQ ID NO: 731347 - DNA, 22 bp, Artificial Sequence
  chemically synthesized
gattctgacagttgtcctttta

SEQ ID NO: 731348 - DNA, 22 bp, Artificial Sequence
  chemically synthesized
attctgacagttgtccttttaa

SEQ ID NO: 731349 - DNA, 22 bp, Artificial Sequence
  chemically synthesized
tccgtgcagagcaattaaaagg

SEQ ID NO: 731350 - DNA, 22 bp, Artificial Sequence
  chemically synthesized
tgacagttgtccttttaattgc

SEQ ID NO: 731351 - DNA, 22 bp, Artificial Sequence
  chemically synthesized
acagttgtccttttaattgctc

SEQ ID NO: 731352 - DNA, 22 bp, Artificial Sequence
  chemically synthesized
aatactatccgtgcagagcaat

SEQ ID NO: 731353 - DNA, 22 bp, Artificial Sequence
  chemically synthesized
tccttttaattgctctgcacgg

SEQ ID NO: 731354 - DNA, 22 bp, Artificial Sequence
  chemically synthesized
gatggctgaatactatccgtgc

SEQ ID NO: 731355 - DNA, 22 bp, Artificial Sequence
  chemically synthesized
ttaattgctctgcacggatagt

SEQ ID NO: 731356 - DNA, 22 bp, Artificial Sequence
  chemically synthesized
agatggctgaatactatccgtg

SEQ ID NO: 731357 - DNA, 22 bp, Artificial Sequence
  chemically synthesized
taattgctctgcacggatagta

SEQ ID NO: 731358 - DNA, 22 bp, Artificial Sequence
  chemically synthesized
tagatggctgaatactatccgt

SEQ ID NO: 731359 - DNA, 22 bp, Artificial Sequence
  chemically synthesized
aattgctctgcacggatagtat

SEQ ID NO: 731360 - DNA, 22 bp, Artificial Sequence
  chemically synthesized
attgctctgcacggatagtatt

SEQ ID NO: 731361 - DNA, 22 bp, Artificial Sequence
  chemically synthesized
attttagatggctgaatactat

SEQ ID NO: 731362 - DNA, 22 bp, Artificial Sequence
  chemically synthesized
ctctgcacggatagtattcagc

SEQ ID NO: 731363 - DNA, 22 bp, Artificial Sequence
  chemically synthesized
ttgattttagatggctgaatac

SEQ ID NO: 731364 - DNA, 22 bp, Artificial Sequence
  chemically synthesized
gttgattttagatggctgaata

SEQ ID NO: 731365 - DNA, 22 bp, Artificial Sequence
  chemically synthesized
tgcacggatagtattcagccat

SEQ ID NO: 731366 - DNA, 22 bp, Artificial Sequence
  chemically synthesized
cacggatagtattcagccatct

SEQ ID NO: 731367 - DNA, 22 bp, Artificial Sequence
  chemically synthesized
agccatctaaaatcaacaaatt

SEQ ID NO: 731368 - DNA, 22 bp, Artificial Sequence
  chemically synthesized
gggtaaatagagaatttgttga

SEQ ID NO: 731369 - DNA, 22 bp, Artificial Sequence
  chemically synthesized
aaatcaacaaattctctattta

SEQ ID NO: 731370 - DNA, 22 bp, Artificial Sequence
  chemically synthesized
gaagacgactggggtaaataga

SEQ ID NO: 731371 - DNA, 22 bp, Artificial Sequence
  chemically synthesized
cagcaatctggaagacgactgg

SEQ ID NO: 731372 - DNA, 22 bp, Artificial Sequence
  chemically synthesized
tctatttaccccagtcgtcttc

SEQ ID NO: 731373 - DNA, 22 bp, Artificial Sequence
  chemically synthesized
tatttaccccagtcgtcttcca

SEQ ID NO: 731374 - DNA, 22 bp, Artificial Sequence
  chemically synthesized
tttaccccagtcgtcttccaga

SEQ ID NO: 731375 - DNA, 22 bp, Artificial Sequence
  chemically synthesized
accccagtcgtcttccagattg

SEQ ID NO: 731376 - DNA, 22 bp, Artificial Sequence
  chemically synthesized
ccccagtcgtcttccagattgc

SEQ ID NO: 731377 - DNA, 22 bp, Artificial Sequence
  chemically synthesized
cataatgaacctacagcaatct

SEQ ID NO: 731378 - DNA, 22 bp, Artificial Sequence
  chemically synthesized
gcataatgaacctacagcaatc

SEQ ID NO: 731379 - DNA, 22 bp, Artificial Sequence
  chemically synthesized
ccagattgctgtaggttcatta

SEQ ID NO: 731380 - DNA, 22 bp, Artificial Sequence
  chemically synthesized
cagattgctgtaggttcattat

SEQ ID NO: 731381 - DNA, 22 bp, Artificial Sequence
  chemically synthesized
aaggaacatttgcataatgaac

SEQ ID NO: 731382 - DNA, 22 bp, Artificial Sequence
  chemically synthesized
aaaggaacatttgcataatgaa

SEQ ID NO: 731383 - DNA, 22 bp, Artificial Sequence
  chemically synthesized
ttaaaggaacatttgcataatg

SEQ ID NO: 731384 - DNA, 22 bp, Artificial Sequence
  chemically synthesized
cttaaaggaacatttgcataat

SEQ ID NO: 731385 - DNA, 22 bp, Artificial Sequence
  chemically synthesized
ctgtaggttcattatgcaaatg

SEQ ID NO: 731386 - DNA, 22 bp, Artificial Sequence
  chemically synthesized
taggttcattatgcaaatgttc

SEQ ID NO: 731387 - DNA, 22 bp, Artificial Sequence
  chemically synthesized
tatttcttaaaggaacatttgc

SEQ ID NO: 731388 - DNA, 22 bp, Artificial Sequence
  chemically synthesized
tgtatttcttaaaggaacattt

SEQ ID NO: 731389 - DNA, 22 bp, Artificial Sequence
  chemically synthesized
attatgcaaatgttcctttaag

SEQ ID NO: 731390 - DNA, 22 bp, Artificial Sequence
  chemically synthesized
tgcaaatgttcctttaagaaat

SEQ ID NO: 731391 - DNA, 22 bp, Artificial Sequence
  chemically synthesized
gagtaactctgtatttcttaaa

SEQ ID NO: 731392 - DNA, 22 bp, Artificial Sequence
  chemically synthesized
ctggagtaactctgtatttctt

SEQ ID NO: 731393 - DNA, 22 bp, Artificial Sequence
  chemically synthesized
ctttaagaaatacagagttact

SEQ ID NO: 731394 - DNA, 22 bp, Artificial Sequence
  chemically synthesized
taagaaatacagagttactcca

SEQ ID NO: 731395 - DNA, 22 bp, Artificial Sequence
  chemically synthesized
aagaaatacagagttactccag

SEQ ID NO: 731396 - DNA, 22 bp, Artificial Sequence
  chemically synthesized
agaaatacagagttactccagg

SEQ ID NO: 731397 - DNA, 22 bp, Artificial Sequence
  chemically synthesized
catagtaatggcaggtagtggt

SEQ ID NO: 731398 - DNA, 22 bp, Artificial Sequence
  chemically synthesized
ctccaggaatgaccactacctg

SEQ ID NO: 731399 - DNA, 22 bp, Artificial Sequence
  chemically synthesized
caggaatgaccactacctgcca

SEQ ID NO: 731400 - DNA, 22 bp, Artificial Sequence
  chemically synthesized
gactccatagtaatggcaggta

SEQ ID NO: 731401 - DNA, 22 bp, Artificial Sequence
  chemically synthesized
tggactccatagtaatggcagg

SEQ ID NO: 731402 - DNA, 22 bp, Artificial Sequence
  chemically synthesized
cctctggactccatagtaatgg

SEQ ID NO: 731403 - DNA, 22 bp, Artificial Sequence
  chemically synthesized
accctacctctggactccatag

SEQ ID NO: 731404 - DNA, 22 bp, Artificial Sequence
  chemically synthesized
cctgccattactatggagtcca

SEQ ID NO: 731405 - DNA, 22 bp, Artificial Sequence
  chemically synthesized
ccattactatggagtccagagg

SEQ ID NO: 731406 - DNA, 22 bp, Artificial Sequence
  chemically synthesized
tacctgaccctacctctggact

SEQ ID NO: 731407 - DNA, 22 bp, Artificial Sequence
  chemically synthesized
ctatggagtccagaggtagggt

SEQ ID NO: 731408 - DNA, 22 bp, Artificial Sequence
  chemically synthesized
tggagtccagaggtagggtcag

SEQ ID NO: 731409 - DNA, 22 bp, Artificial Sequence
  chemically synthesized
aaaagaccccagcctgtacctg

SEQ ID NO: 731410 - DNA, 22 bp, Artificial Sequence
  chemically synthesized
caaaagaccccagcctgtacct

SEQ ID NO: 731411 - DNA, 22 bp, Artificial Sequence
  chemically synthesized
tcaaaagaccccagcctgtacc

SEQ ID NO: 731412 - DNA, 22 bp, Artificial Sequence
  chemically synthesized
gaaaagagacaagtcactttca

SEQ ID NO: 731413 - DNA, 22 bp, Artificial Sequence
  chemically synthesized
ggaaaagagacaagtcactttc

SEQ ID NO: 731414 - DNA, 22 bp, Artificial Sequence
  chemically synthesized
tggaaaagagacaagtcacttt

SEQ ID NO: 731415 - DNA, 22 bp, Artificial Sequence
  chemically synthesized
gggtcttttgaaagtgacttgt

SEQ ID NO: 731416 - DNA, 22 bp, Artificial Sequence
  chemically synthesized
ttgaaagtgacttgtctctttt

SEQ ID NO: 731417 - DNA, 22 bp, Artificial Sequence
  chemically synthesized
tgaaagtgacttgtctcttttc

SEQ ID NO: 731418 - DNA, 22 bp, Artificial Sequence
  chemically synthesized
gaaagtgacttgtctcttttcc

SEQ ID NO: 731419 - DNA, 22 bp, Artificial Sequence
  chemically synthesized
aaagtgacttgtctcttttcca

SEQ ID NO: 731420 - DNA, 22 bp, Artificial Sequence
  chemically synthesized
gaagcaaatgaaattttggaaa

SEQ ID NO: 731421 - DNA, 22 bp, Artificial Sequence
  chemically synthesized
attagaagcaaatgaaattttg

SEQ ID NO: 731422 - DNA, 22 bp, Artificial Sequence
  chemically synthesized
gattagaagcaaatgaaatttt

SEQ ID NO: 731423 - DNA, 22 bp, Artificial Sequence
  chemically synthesized
gtctcttttccaaaatttcatt

SEQ ID NO: 731424 - DNA, 22 bp, Artificial Sequence
  chemically synthesized
tctcttttccaaaatttcattt

SEQ ID NO: 731425 - DNA, 22 bp, Artificial Sequence
  chemically synthesized
ttgattagaagcaaatgaaatt

SEQ ID NO: 731426 - DNA, 22 bp, Artificial Sequence
  chemically synthesized
ttttccaaaatttcatttgctt

SEQ ID NO: 731427 - DNA, 22 bp, Artificial Sequence
  chemically synthesized
ttccaaaatttcatttgcttct

SEQ ID NO: 731428 - DNA, 22 bp, Artificial Sequence
  chemically synthesized
tccaaaatttcatttgcttcta

SEQ ID NO: 731429 - DNA, 22 bp, Artificial Sequence
  chemically synthesized
ccaaaatttcatttgcttctaa

SEQ ID NO: 731430 - DNA, 22 bp, Artificial Sequence
  chemically synthesized
ccagactcttgattagaagcaa

SEQ ID NO: 731431 - DNA, 22 bp, Artificial Sequence
  chemically synthesized
caaaatttcatttgcttctaat

SEQ ID NO: 731432 - DNA, 22 bp, Artificial Sequence
  chemically synthesized
accagactcttgattagaagca

SEQ ID NO: 731433 - DNA, 22 bp, Artificial Sequence
  chemically synthesized
atttaccagactcttgattaga

SEQ ID NO: 731434 - DNA, 22 bp, Artificial Sequence
  chemically synthesized
ctaatttaccagactcttgatt

SEQ ID NO: 731435 - DNA, 22 bp, Artificial Sequence
  chemically synthesized
catttgcttctaatcaagagtc

SEQ ID NO: 731436 - DNA, 22 bp, Artificial Sequence
  chemically synthesized
atttgcttctaatcaagagtct

SEQ ID NO: 731437 - DNA, 22 bp, Artificial Sequence
  chemically synthesized
ctcctaatttaccagactcttg

SEQ ID NO: 731438 - DNA, 22 bp, Artificial Sequence
  chemically synthesized
gcttctaatcaagagtctggta

SEQ ID NO: 731439 - DNA, 22 bp, Artificial Sequence
  chemically synthesized
cttctaatcaagagtctggtaa

SEQ ID NO: 731440 - DNA, 22 bp, Artificial Sequence
  chemically synthesized
ctaatcaagagtctggtaaatt

SEQ ID NO: 731441 - DNA, 22 bp, Artificial Sequence
  chemically synthesized
taatcaagagtctggtaaatta

SEQ ID NO: 731442 - DNA, 22 bp, Artificial Sequence
  chemically synthesized
atcaagagtctggtaaattagg

SEQ ID NO: 731443 - DNA, 22 bp, Artificial Sequence
  chemically synthesized
gtaaattaggaggagtcctttt

SEQ ID NO: 731444 - DNA, 22 bp, Artificial Sequence
  chemically synthesized
cgatgatgagtgagaaaaggac

SEQ ID NO: 731445 - DNA, 22 bp, Artificial Sequence
  chemically synthesized
gctacgatgatgagtgagaaaa

SEQ ID NO: 731446 - DNA, 22 bp, Artificial Sequence
  chemically synthesized
ggctacgatgatgagtgagaaa

SEQ ID NO: 731447 - DNA, 22 bp, Artificial Sequence
  chemically synthesized
ggaggagtccttttctcactca

SEQ ID NO: 731448 - DNA, 22 bp, Artificial Sequence
  chemically synthesized
tggctacgatgatgagtgagaa

SEQ ID NO: 731449 - DNA, 22 bp, Artificial Sequence
  chemically synthesized
atgagactttggctacgatgat

SEQ ID NO: 731450 - DNA, 22 bp, Artificial Sequence
  chemically synthesized
ttctcactcatcatcgtagcca

SEQ ID NO: 731451 - DNA, 22 bp, Artificial Sequence
  chemically synthesized
tctcactcatcatcgtagccaa

SEQ ID NO: 731452 - DNA, 22 bp, Artificial Sequence
  chemically synthesized
tctcatgagactttggctacga

SEQ ID NO: 731453 - DNA, 22 bp, Artificial Sequence
  chemically synthesized
ctcactcatcatcgtagccaaa

SEQ ID NO: 731454 - DNA, 22 bp, Artificial Sequence
  chemically synthesized
gtctcatgagactttggctacg

SEQ ID NO: 731455 - DNA, 22 bp, Artificial Sequence
  chemically synthesized
tcactcatcatcgtagccaaag

SEQ ID NO: 731456 - DNA, 22 bp, Artificial Sequence
  chemically synthesized
actcatcatcgtagccaaagtc

SEQ ID NO: 731457 - DNA, 22 bp, Artificial Sequence
  chemically synthesized
atcatcgtagccaaagtctcat

SEQ ID NO: 731458 - DNA, 22 bp, Artificial Sequence
  chemically synthesized
agacccagccttgtctcatgag

SEQ ID NO: 731459 - DNA, 22 bp, Artificial Sequence
  chemically synthesized
ctgagacccagccttgtctcat

SEQ ID NO: 731460 - DNA, 22 bp, Artificial Sequence
  chemically synthesized
atgagacaaggctgggtctcag

SEQ ID NO: 731461 - DNA, 22 bp, Artificial Sequence
  chemically synthesized
atgaatcacagtcctactgaga

SEQ ID NO: 731462 - DNA, 22 bp, Artificial Sequence
  chemically synthesized
catgaatcacagtcctactgag

SEQ ID NO: 731463 - DNA, 22 bp, Artificial Sequence
  chemically synthesized
tcatgaatcacagtcctactga

SEQ ID NO: 731464 - DNA, 22 bp, Artificial Sequence
  chemically synthesized
ttcatgaatcacagtcctactg

SEQ ID NO: 731465 - DNA, 22 bp, Artificial Sequence
  chemically synthesized
acttttcatgaatcacagtcct

SEQ ID NO: 731466 - DNA, 22 bp, Artificial Sequence
  chemically synthesized
ggtctcagtaggactgtgattc

SEQ ID NO: 731467 - DNA, 22 bp, Artificial Sequence
  chemically synthesized
agtaggactgtgattcatgaaa

SEQ ID NO: 731468 - DNA, 22 bp, Artificial Sequence
  chemically synthesized
tccataattgacttttcatgaa

SEQ ID NO: 731469 - DNA, 22 bp, Artificial Sequence
  chemically synthesized
atccataattgacttttcatga

SEQ ID NO: 731470 - DNA, 22 bp, Artificial Sequence
  chemically synthesized
tgattcatgaaaagtcaattat

SEQ ID NO: 731471 - DNA, 22 bp, Artificial Sequence
  chemically synthesized
gtaaacaaaatttatccataat

SEQ ID NO: 731472 - DNA, 22 bp, Artificial Sequence
  chemically synthesized
atgaaaagtcaattatggataa

SEQ ID NO: 731473 - DNA, 22 bp, Artificial Sequence
  chemically synthesized
tggataaattttgtttaccaat

SEQ ID NO: 731474 - DNA, 22 bp, Artificial Sequence
  chemically synthesized
tgtttaccaatatccttcctca

SEQ ID NO: 731475 - DNA, 22 bp, Artificial Sequence
  chemically synthesized
gtttaccaatatccttcctcat

SEQ ID NO: 731476 - DNA, 22 bp, Artificial Sequence
  chemically synthesized
tttaccaatatccttcctcatt

SEQ ID NO: 731477 - DNA, 22 bp, Artificial Sequence
  chemically synthesized
accaatatccttcctcattcct

SEQ ID NO: 731478 - DNA, 22 bp, Artificial Sequence
  chemically synthesized
ccaagcagaaccaggaatgagg

SEQ ID NO: 731479 - DNA, 22 bp, Artificial Sequence
  chemically synthesized
ccaatatccttcctcattcctg

SEQ ID NO: 731480 - DNA, 22 bp, Artificial Sequence
  chemically synthesized
gccaagcagaaccaggaatgag

SEQ ID NO: 731481 - DNA, 22 bp, Artificial Sequence
  chemically synthesized
tttgccaagcagaaccaggaat

SEQ ID NO: 731482 - DNA, 22 bp, Artificial Sequence
  chemically synthesized
cctcattcctggttctgcttgg

SEQ ID NO: 731483 - DNA, 22 bp, Artificial Sequence
  chemically synthesized
ctcattcctggttctgcttggc

SEQ ID NO: 731484 - DNA, 22 bp, Artificial Sequence
  chemically synthesized
attcctggttctgcttggcaaa

SEQ ID NO: 731485 - DNA, 22 bp, Artificial Sequence
  chemically synthesized
ctggttctgcttggcaaacagc

SEQ ID NO: 731486 - DNA, 22 bp, Artificial Sequence
  chemically synthesized
gttctgcttggcaaacagccat

SEQ ID NO: 731487 - DNA, 22 bp, Artificial Sequence
  chemically synthesized
tgcttggcaaacagccatccct

SEQ ID NO: 731488 - DNA, 22 bp, Artificial Sequence
  chemically synthesized
cttggcaaacagccatccctcc

SEQ ID NO: 731489 - DNA, 22 bp, Artificial Sequence
  chemically synthesized
ggcaaacagccatccctcctcc

SEQ ID NO: 731490 - DNA, 22 bp, Artificial Sequence
  chemically synthesized
gcaaacagccatccctcctccc

SEQ ID NO: 731491 - DNA, 22 bp, Artificial Sequence
  chemically synthesized
taataagagaatgggaggaggg

SEQ ID NO: 731492 - DNA, 22 bp, Artificial Sequence
  chemically synthesized
gtaataagagaatgggaggagg

SEQ ID NO: 731493 - DNA, 22 bp, Artificial Sequence
  chemically synthesized
caaacccttgtaataagagaat

SEQ ID NO: 731494 - DNA, 22 bp, Artificial Sequence
  chemically synthesized
gcaaacccttgtaataagagaa

SEQ ID NO: 731495 - DNA, 22 bp, Artificial Sequence
  chemically synthesized
ctcccattctcttattacaagg

SEQ ID NO: 731496 - DNA, 22 bp, Artificial Sequence
  chemically synthesized
ccattctcttattacaagggtt

SEQ ID NO: 731497 - DNA, 22 bp, Artificial Sequence
  chemically synthesized
tcttattacaagggtttgcaaa

SEQ ID NO: 731498 - DNA, 22 bp, Artificial Sequence
  chemically synthesized
ttattacaagggtttgcaaact

SEQ ID NO: 731499 - DNA, 22 bp, Artificial Sequence
  chemically synthesized
caaagtgcggtgaagtttgcaa

SEQ ID NO: 731500 - DNA, 22 bp, Artificial Sequence
  chemically synthesized
attacaagggtttgcaaacttc

SEQ ID NO: 731501 - DNA, 22 bp, Artificial Sequence
  chemically synthesized
ttacaagggtttgcaaacttca

SEQ ID NO: 731502 - DNA, 22 bp, Artificial Sequence
  chemically synthesized
caagggtttgcaaacttcaccg

SEQ ID NO: 731503 - DNA, 22 bp, Artificial Sequence
  chemically synthesized
gcaaacttcaccgcactttgta

SEQ ID NO: 731504 - DNA, 22 bp, Artificial Sequence
  chemically synthesized
caaacttcaccgcactttgtaa

SEQ ID NO: 731505 - DNA, 22 bp, Artificial Sequence
  chemically synthesized
aaaatccccaggattacaaagt

SEQ ID NO: 731506 - DNA, 22 bp, Artificial Sequence
  chemically synthesized
ttgaaaatccccaggattacaa

SEQ ID NO: 731507 - DNA, 22 bp, Artificial Sequence
  chemically synthesized
gttgaaaatccccaggattaca

SEQ ID NO: 731508 - DNA, 22 bp, Artificial Sequence
  chemically synthesized
caccgcactttgtaatcctggg

SEQ ID NO: 731509 - DNA, 22 bp, Artificial Sequence
  chemically synthesized
accgcactttgtaatcctgggg

SEQ ID NO: 731510 - DNA, 22 bp, Artificial Sequence
  chemically synthesized
tgtaatcctggggattttcaac

SEQ ID NO: 731511 - DNA, 22 bp, Artificial Sequence
  chemically synthesized
gtaatcctggggattttcaaca

SEQ ID NO: 731512 - DNA, 22 bp, Artificial Sequence
  chemically synthesized
taatcctggggattttcaacaa

SEQ ID NO: 731513 - DNA, 22 bp, Artificial Sequence
  chemically synthesized
caagcatcagcatttgttgaaa

SEQ ID NO: 731514 - DNA, 22 bp, Artificial Sequence
  chemically synthesized
gggattttcaacaaatgctgat

SEQ ID NO: 731515 - DNA, 22 bp, Artificial Sequence
  chemically synthesized
ggggtgggctccaagcatcagc

SEQ ID NO: 731516 - DNA, 22 bp, Artificial Sequence
  chemically synthesized
tgggggtgggctccaagcatca

SEQ ID NO: 731517 - DNA, 22 bp, Artificial Sequence
  chemically synthesized
tcaacaaatgctgatgcttgga

SEQ ID NO: 731518 - DNA, 22 bp, Artificial Sequence
  chemically synthesized
caacaaatgctgatgcttggag

SEQ ID NO: 731519 - DNA, 22 bp, Artificial Sequence
  chemically synthesized
aacaaatgctgatgcttggagc

SEQ ID NO: 731520 - DNA, 22 bp, Artificial Sequence
  chemically synthesized
aatctctgggggtgggctccaa

SEQ ID NO: 731521 - DNA, 22 bp, Artificial Sequence
  chemically synthesized
atgcttggagcccacccccaga

SEQ ID NO: 731522 - DNA, 22 bp, Artificial Sequence
  chemically synthesized
agaccaattcaatctctggggg

SEQ ID NO: 731523 - DNA, 22 bp, Artificial Sequence
  chemically synthesized
ggagcccacccccagagattga

SEQ ID NO: 731524 - DNA, 22 bp, Artificial Sequence
  chemically synthesized
gagcccacccccagagattgaa

SEQ ID NO: 731525 - DNA, 22 bp, Artificial Sequence
  chemically synthesized
catctcagaccaattcaatctc

SEQ ID NO: 731526 - DNA, 22 bp, Artificial Sequence
  chemically synthesized
atgcccaggctgcatctcagac

SEQ ID NO: 731527 - DNA, 22 bp, Artificial Sequence
  chemically synthesized
ctcatgcccaggctgcatctca

SEQ ID NO: 731528 - DNA, 22 bp, Artificial Sequence
  chemically synthesized
aattggtctgagatgcagcctg

SEQ ID NO: 731529 - DNA, 22 bp, Artificial Sequence
  chemically synthesized
taaagctcctcatgcccaggct

SEQ ID NO: 731530 - DNA, 22 bp, Artificial Sequence
  chemically synthesized
gtctgagatgcagcctgggcat

SEQ ID NO: 731531 - DNA, 22 bp, Artificial Sequence
  chemically synthesized
ataaagctcctcatgcccaggc

SEQ ID NO: 731532 - DNA, 22 bp, Artificial Sequence
  chemically synthesized
agatgcagcctgggcatgagga

SEQ ID NO: 731533 - DNA, 22 bp, Artificial Sequence
  chemically synthesized
ggcagcttataaagctcctcat

SEQ ID NO: 731534 - DNA, 22 bp, Artificial Sequence
  chemically synthesized
ggcatgaggagctttataagct

SEQ ID NO: 731535 - DNA, 22 bp, Artificial Sequence
  chemically synthesized
tataagctgcccaggggattct

SEQ ID NO: 731536 - DNA, 22 bp, Artificial Sequence
  chemically synthesized
ataagctgcccaggggattctg

SEQ ID NO: 731537 - DNA, 22 bp, Artificial Sequence
  chemically synthesized
taagctgcccaggggattctga

SEQ ID NO: 731538 - DNA, 22 bp, Artificial Sequence
  chemically synthesized
aagcgcagaccacatatcagaa

SEQ ID NO: 731539 - DNA, 22 bp, Artificial Sequence
  chemically synthesized
cccaggggattctgatatgtgg

SEQ ID NO: 731540 - DNA, 22 bp, Artificial Sequence
  chemically synthesized
acaggcctaaagcgcagaccac

SEQ ID NO: 731541 - DNA, 22 bp, Artificial Sequence
  chemically synthesized
gacaggcctaaagcgcagacca

SEQ ID NO: 731542 - DNA, 22 bp, Artificial Sequence
  chemically synthesized
tgatatgtggtctgcgctttag

SEQ ID NO: 731543 - DNA, 22 bp, Artificial Sequence
  chemically synthesized
atatgtggtctgcgctttaggc

SEQ ID NO: 731544 - DNA, 22 bp, Artificial Sequence
  chemically synthesized
tcccaccttgacaggcctaaag

SEQ ID NO: 731545 - DNA, 22 bp, Artificial Sequence
  chemically synthesized
ttatcccaccttgacaggccta

SEQ ID NO: 731546 - DNA, 22 bp, Artificial Sequence
  chemically synthesized
cgctttaggcctgtcaaggtgg

SEQ ID NO: 731547 - DNA, 22 bp, Artificial Sequence
  chemically synthesized
tcaagttgttatcccaccttga

SEQ ID NO: 731548 - DNA, 22 bp, Artificial Sequence
  chemically synthesized
ttatcaagttgttatcccacct

SEQ ID NO: 731549 - DNA, 22 bp, Artificial Sequence
  chemically synthesized
taggcctgtcaaggtgggataa

SEQ ID NO: 731550 - DNA, 22 bp, Artificial Sequence
  chemically synthesized
attatcaagttgttatcccacc

SEQ ID NO: 731551 - DNA, 22 bp, Artificial Sequence
  chemically synthesized
aggcctgtcaaggtgggataac

SEQ ID NO: 731552 - DNA, 22 bp, Artificial Sequence
  chemically synthesized
tattatcaagttgttatcccac

SEQ ID NO: 731553 - DNA, 22 bp, Artificial Sequence
  chemically synthesized
ggcctgtcaaggtgggataaca

SEQ ID NO: 731554 - DNA, 22 bp, Artificial Sequence
  chemically synthesized
tcaaggtgggataacaacttga

SEQ ID NO: 731555 - DNA, 22 bp, Artificial Sequence
  chemically synthesized
atcaggaaataaacctttatta

SEQ ID NO: 731556 - DNA, 22 bp, Artificial Sequence
  chemically synthesized
actgatcaggaaataaaccttt

SEQ ID NO: 731557 - DNA, 22 bp, Artificial Sequence
  chemically synthesized
aactgatcaggaaataaacctt

SEQ ID NO: 731558 - DNA, 22 bp, Artificial Sequence
  chemically synthesized
taactgatcaggaaataaacct

SEQ ID NO: 731559 - DNA, 22 bp, Artificial Sequence
  chemically synthesized
gataataaaggtttatttcctg

SEQ ID NO: 731560 - DNA, 22 bp, Artificial Sequence
  chemically synthesized
ataataaaggtttatttcctga

SEQ ID NO: 731561 - DNA, 22 bp, Artificial Sequence
  chemically synthesized
agatgtggtaacccctttaact

SEQ ID NO: 731562 - DNA, 22 bp, Artificial Sequence
  chemically synthesized
atttcctgatcagttaaagggg

SEQ ID NO: 731563 - DNA, 22 bp, Artificial Sequence
  chemically synthesized
gagatgtggtaacccctttaac

SEQ ID NO: 731564 - DNA, 22 bp, Artificial Sequence
  chemically synthesized
tttcctgatcagttaaaggggt

SEQ ID NO: 731565 - DNA, 22 bp, Artificial Sequence
  chemically synthesized
tgagatgtggtaacccctttaa

SEQ ID NO: 731566 - DNA, 22 bp, Artificial Sequence
  chemically synthesized
tttgagatgtggtaaccccttt

SEQ ID NO: 731567 - DNA, 22 bp, Artificial Sequence
  chemically synthesized
cctgatcagttaaaggggttac

SEQ ID NO: 731568 - DNA, 22 bp, Artificial Sequence
  chemically synthesized
ctttgagatgtggtaacccctt

SEQ ID NO: 731569 - DNA, 22 bp, Artificial Sequence
  chemically synthesized
ctgatcagttaaaggggttacc

SEQ ID NO: 731570 - DNA, 22 bp, Artificial Sequence
  chemically synthesized
atcagttaaaggggttaccaca

SEQ ID NO: 731571 - DNA, 22 bp, Artificial Sequence
  chemically synthesized
aaggggttaccacatctcaaag

SEQ ID NO: 731572 - DNA, 22 bp, Artificial Sequence
  chemically synthesized
agtatgcaaaatatttctttga

SEQ ID NO: 731573 - DNA, 22 bp, Artificial Sequence
  chemically synthesized
gagtatgcaaaatatttctttg

SEQ ID NO: 731574 - DNA, 22 bp, Artificial Sequence
  chemically synthesized
tgagtatgcaaaatatttcttt

SEQ ID NO: 731575 - DNA, 22 bp, Artificial Sequence
  chemically synthesized
ccacatctcaaagaaatatttt

SEQ ID NO: 731576 - DNA, 22 bp, Artificial Sequence
  chemically synthesized
caggtcctttgagtatgcaaaa

SEQ ID NO: 731577 - DNA, 22 bp, Artificial Sequence
  chemically synthesized
aaagaaatattttgcatactca

SEQ ID NO: 731578 - DNA, 22 bp, Artificial Sequence
  chemically synthesized
cattacaggtcctttgagtatg

SEQ ID NO: 731579 - DNA, 22 bp, Artificial Sequence
  chemically synthesized
aattccattacaggtcctttga

SEQ ID NO: 731580 - DNA, 22 bp, Artificial Sequence
  chemically synthesized
aaattccattacaggtcctttg

SEQ ID NO: 731581 - DNA, 22 bp, Artificial Sequence
  chemically synthesized
tgcatactcaaaggacctgtaa

SEQ ID NO: 731582 - DNA, 22 bp, Artificial Sequence
  chemically synthesized
acttaaattccattacaggtcc

SEQ ID NO: 731583 - DNA, 22 bp, Artificial Sequence
  chemically synthesized
gcatactcaaaggacctgtaat

SEQ ID NO: 731584 - DNA, 22 bp, Artificial Sequence
  chemically synthesized
aacttaaattccattacaggtc

SEQ ID NO: 731585 - DNA, 22 bp, Artificial Sequence
  chemically synthesized
catactcaaaggacctgtaatg

SEQ ID NO: 731586 - DNA, 22 bp, Artificial Sequence
  chemically synthesized
tttaacttaaattccattacag

SEQ ID NO: 731587 - DNA, 22 bp, Artificial Sequence
  chemically synthesized
aaaggacctgtaatggaattta

SEQ ID NO: 731588 - DNA, 22 bp, Artificial Sequence
  chemically synthesized
taacaccattatttaacttaaa

SEQ ID NO: 731589 - DNA, 22 bp, Artificial Sequence
  chemically synthesized
taatggaatttaagttaaataa

SEQ ID NO: 731590 - DNA, 22 bp, Artificial Sequence
  chemically synthesized
cagatattgtaacaccattatt

SEQ ID NO: 731591 - DNA, 22 bp, Artificial Sequence
  chemically synthesized
attacagatattgtaacaccat

SEQ ID NO: 731592 - DNA, 22 bp, Artificial Sequence
  chemically synthesized
aagttaaataatggtgttacaa

SEQ ID NO: 731593 - DNA, 22 bp, Artificial Sequence
  chemically synthesized
agttaaataatggtgttacaat

SEQ ID NO: 731594 - DNA, 22 bp, Artificial Sequence
  chemically synthesized
aaattaattacagatattgtaa

SEQ ID NO: 731595 - DNA, 22 bp, Artificial Sequence
  chemically synthesized
aaaattaattacagatattgta

SEQ ID NO: 731596 - DNA, 22 bp, Artificial Sequence
  chemically synthesized
aataatggtgttacaatatctg

SEQ ID NO: 731597 - DNA, 22 bp, Artificial Sequence
  chemically synthesized
agatatttaaaattaattacag

SEQ ID NO: 731598 - DNA, 22 bp, Artificial Sequence
  chemically synthesized
tgttgagatatttaaaattaat

SEQ ID NO: 731599 - DNA, 22 bp, Artificial Sequence
  chemically synthesized
caatatctgtaattaattttaa

SEQ ID NO: 731600 - DNA, 22 bp, Artificial Sequence
  chemically synthesized
tctatgttgagatatttaaaat

SEQ ID NO: 731601 - DNA, 22 bp, Artificial Sequence
  chemically synthesized
taattaattttaaatatctcaa

SEQ ID NO: 731602 - DNA, 22 bp, Artificial Sequence
  chemically synthesized
attttaaatatctcaacataga

SEQ ID NO: 731603 - DNA, 22 bp, Artificial Sequence
  chemically synthesized
taaatatctcaacatagatagt

SEQ ID NO: 731604 - DNA, 22 bp, Artificial Sequence
  chemically synthesized
aaatatctcaacatagatagtt

SEQ ID NO: 731605 - DNA, 22 bp, Artificial Sequence
  chemically synthesized
aatatctcaacatagatagttg

SEQ ID NO: 731606 - DNA, 22 bp, Artificial Sequence
  chemically synthesized
cacatataaaatatccaactat

SEQ ID NO: 731607 - DNA, 22 bp, Artificial Sequence
  chemically synthesized
actgcacatataaaatatccaa

SEQ ID NO: 731608 - DNA, 22 bp, Artificial Sequence
  chemically synthesized
aacatagatagttggatatttt

SEQ ID NO: 731609 - DNA, 22 bp, Artificial Sequence
  chemically synthesized
cactaactgcacatataaaata

SEQ ID NO: 731610 - DNA, 22 bp, Artificial Sequence
  chemically synthesized
aaggttgcactaactgcacata

SEQ ID NO: 731611 - DNA, 22 bp, Artificial Sequence
  chemically synthesized
gatattttatatgtgcagttag

SEQ ID NO: 731612 - DNA, 22 bp, Artificial Sequence
  chemically synthesized
gagttgaaggttgcactaactg

SEQ ID NO: 731613 - DNA, 22 bp, Artificial Sequence
  chemically synthesized
tagagttgaaggttgcactaac

SEQ ID NO: 731614 - DNA, 22 bp, Artificial Sequence
  chemically synthesized
tatatgtgcagttagtgcaacc

SEQ ID NO: 731615 - DNA, 22 bp, Artificial Sequence
  chemically synthesized
atatgtgcagttagtgcaacct

SEQ ID NO: 731616 - DNA, 22 bp, Artificial Sequence
  chemically synthesized
tatgtgcagttagtgcaacctt

SEQ ID NO: 731617 - DNA, 22 bp, Artificial Sequence
  chemically synthesized
aagcctctagagttgaaggttg

SEQ ID NO: 731618 - DNA, 22 bp, Artificial Sequence
  chemically synthesized
cctcaagcctctagagttgaag

SEQ ID NO: 731619 - DNA, 22 bp, Artificial Sequence
  chemically synthesized
gcctcaagcctctagagttgaa

SEQ ID NO: 731620 - DNA, 22 bp, Artificial Sequence
  chemically synthesized
gtgcaaccttcaactctagagg

SEQ ID NO: 731621 - DNA, 22 bp, Artificial Sequence
  chemically synthesized
aaataaccatttgcctcaagcc

SEQ ID NO: 731622 - DNA, 22 bp, Artificial Sequence
  chemically synthesized
caactctagaggcttgaggcaa

SEQ ID NO: 731623 - DNA, 22 bp, Artificial Sequence
  chemically synthesized
aactctagaggcttgaggcaaa

SEQ ID NO: 731624 - DNA, 22 bp, Artificial Sequence
  chemically synthesized
attaaaataaccatttgcctca

SEQ ID NO: 731625 - DNA, 22 bp, Artificial Sequence
  chemically synthesized
ctaattaaaataaccatttgcc

SEQ ID NO: 731626 - DNA, 22 bp, Artificial Sequence
  chemically synthesized
tagaggcttgaggcaaatggtt

SEQ ID NO: 731627 - DNA, 22 bp, Artificial Sequence
  chemically synthesized
gaggcttgaggcaaatggttat

SEQ ID NO: 731628 - DNA, 22 bp, Artificial Sequence
  chemically synthesized
gaggcaaatggttattttaatt

SEQ ID NO: 731629 - DNA, 22 bp, Artificial Sequence
  chemically synthesized
aggcaaatggttattttaatta

SEQ ID NO: 731630 - DNA, 22 bp, Artificial Sequence
  chemically synthesized
gaatatgaattcctaattaaaa

SEQ ID NO: 731631 - DNA, 22 bp, Artificial Sequence
  chemically synthesized
tcctagaatatgaattcctaat

SEQ ID NO: 731632 - DNA, 22 bp, Artificial Sequence
  chemically synthesized
tgctgtcctagaatatgaattc

SEQ ID NO: 731633 - DNA, 22 bp, Artificial Sequence
  chemically synthesized
ttttaattaggaattcatattc

SEQ ID NO: 731634 - DNA, 22 bp, Artificial Sequence
  chemically synthesized
taattaggaattcatattctag

SEQ ID NO: 731635 - DNA, 22 bp, Artificial Sequence
  chemically synthesized
aattaggaattcatattctagg

SEQ ID NO: 731636 - DNA, 22 bp, Artificial Sequence
  chemically synthesized
attaggaattcatattctagga

SEQ ID NO: 731637 - DNA, 22 bp, Artificial Sequence
  chemically synthesized
ggaattcatattctaggacagc

SEQ ID NO: 731638 - DNA, 22 bp, Artificial Sequence
  chemically synthesized
ataagatgaaggctgtgctgtc

SEQ ID NO: 731639 - DNA, 22 bp, Artificial Sequence
  chemically synthesized
cataagatgaaggctgtgctgt

SEQ ID NO: 731640 - DNA, 22 bp, Artificial Sequence
  chemically synthesized
tcataagatgaaggctgtgctg

SEQ ID NO: 731641 - DNA, 22 bp, Artificial Sequence
  chemically synthesized
atattctaggacagcacagcct

SEQ ID NO: 731642 - DNA, 22 bp, Artificial Sequence
  chemically synthesized
ttcataagatgaaggctgtgct

SEQ ID NO: 731643 - DNA, 22 bp, Artificial Sequence
  chemically synthesized
tttcataagatgaaggctgtgc

SEQ ID NO: 731644 - DNA, 22 bp, Artificial Sequence
  chemically synthesized
taggacagcacagccttcatct

SEQ ID NO: 731645 - DNA, 22 bp, Artificial Sequence
  chemically synthesized
gcctttttcataagatgaaggc

SEQ ID NO: 731646 - DNA, 22 bp, Artificial Sequence
  chemically synthesized
ggcctttttcataagatgaagg

SEQ ID NO: 731647 - DNA, 22 bp, Artificial Sequence
  chemically synthesized
ggacagcacagccttcatctta

SEQ ID NO: 731648 - DNA, 22 bp, Artificial Sequence
  chemically synthesized
tggcctttttcataagatgaag

SEQ ID NO: 731649 - DNA, 22 bp, Artificial Sequence
  chemically synthesized
ggttttggcctttttcataaga

SEQ ID NO: 731650 - DNA, 22 bp, Artificial Sequence
  chemically synthesized
tgggttttggcctttttcataa

SEQ ID NO: 731651 - DNA, 22 bp, Artificial Sequence
  chemically synthesized
catcttatgaaaaaggccaaaa

SEQ ID NO: 731652 - DNA, 22 bp, Artificial Sequence
  chemically synthesized
atcttatgaaaaaggccaaaac

SEQ ID NO: 731653 - DNA, 22 bp, Artificial Sequence
  chemically synthesized
atgaaaaaggccaaaacccaga

SEQ ID NO: 731654 - DNA, 22 bp, Artificial Sequence
  chemically synthesized
tgaaaaaggccaaaacccagag

SEQ ID NO: 731655 - DNA, 22 bp, Artificial Sequence
  chemically synthesized
acagagatatatagtagtagca

SEQ ID NO: 731656 - DNA, 22 bp, Artificial Sequence
  chemically synthesized
caaggttcacagagatatatag

SEQ ID NO: 731657 - DNA, 22 bp, Artificial Sequence
  chemically synthesized
ctactactatatatctctgtga

SEQ ID NO: 731658 - DNA, 22 bp, Artificial Sequence
  chemically synthesized
ctactatatatctctgtgaacc

SEQ ID NO: 731659 - DNA, 22 bp, Artificial Sequence
  chemically synthesized
caaaatcctccaaggttcacag

SEQ ID NO: 731660 - DNA, 22 bp, Artificial Sequence
  chemically synthesized
ctatatatctctgtgaaccttg

SEQ ID NO: 731661 - DNA, 22 bp, Artificial Sequence
  chemically synthesized
tatatctctgtgaaccttggag

SEQ ID NO: 731662 - DNA, 22 bp, Artificial Sequence
  chemically synthesized
catgcattacaaaatcctccaa

SEQ ID NO: 731663 - DNA, 22 bp, Artificial Sequence
  chemically synthesized
ttacatgcattacaaaatcctc

SEQ ID NO: 731664 - DNA, 22 bp, Artificial Sequence
  chemically synthesized
tgtgaaccttggaggattttgt

SEQ ID NO: 731665 - DNA, 22 bp, Artificial Sequence
  chemically synthesized
tgaaccttggaggattttgtaa

SEQ ID NO: 731666 - DNA, 22 bp, Artificial Sequence
  chemically synthesized
cgatatctattacatgcattac

SEQ ID NO: 731667 - DNA, 22 bp, Artificial Sequence
  chemically synthesized
gcgatatctattacatgcatta

SEQ ID NO: 731668 - DNA, 22 bp, Artificial Sequence
  chemically synthesized
ggaggattttgtaatgcatgta

SEQ ID NO: 731669 - DNA, 22 bp, Artificial Sequence
  chemically synthesized
gaggattttgtaatgcatgtaa

SEQ ID NO: 731670 - DNA, 22 bp, Artificial Sequence
  chemically synthesized
tgtaatgcatgtaatagatatc

SEQ ID NO: 731671 - DNA, 22 bp, Artificial Sequence
  chemically synthesized
gtaatgcatgtaatagatatcg

SEQ ID NO: 731672 - DNA, 22 bp, Artificial Sequence
  chemically synthesized
taatgcatgtaatagatatcgc

SEQ ID NO: 731673 - DNA, 22 bp, Artificial Sequence
  chemically synthesized
agcaaaaacacatttgcgatat

SEQ ID NO: 731674 - DNA, 22 bp, Artificial Sequence
  chemically synthesized
cctcagcaaaaacacatttgcg

SEQ ID NO: 731675 - DNA, 22 bp, Artificial Sequence
  chemically synthesized
ccctcagcaaaaacacatttgc

SEQ ID NO: 731676 - DNA, 22 bp, Artificial Sequence
  chemically synthesized
tttccctcagcaaaaacacatt

SEQ ID NO: 731677 - DNA, 22 bp, Artificial Sequence
  chemically synthesized
caatccactatttccctcagca

SEQ ID NO: 731678 - DNA, 22 bp, Artificial Sequence
  chemically synthesized
attgcaatccactatttccctc

SEQ ID NO: 731679 - DNA, 22 bp, Artificial Sequence
  chemically synthesized
ttgctgagggaaatagtggatt

SEQ ID NO: 731680 - DNA, 22 bp, Artificial Sequence
  chemically synthesized
tgctgagggaaatagtggattg

SEQ ID NO: 731681 - DNA, 22 bp, Artificial Sequence
  chemically synthesized
gctgagggaaatagtggattgc

SEQ ID NO: 731682 - DNA, 22 bp, Artificial Sequence
  chemically synthesized
ctgagggaaatagtggattgca

SEQ ID NO: 731683 - DNA, 22 bp, Artificial Sequence
  chemically synthesized
tagggatattcattgcaatcca

SEQ ID NO: 731684 - DNA, 22 bp, Artificial Sequence
  chemically synthesized
agggaaatagtggattgcaatg

SEQ ID NO: 731685 - DNA, 22 bp, Artificial Sequence
  chemically synthesized
atgagatcctatagggatattc

SEQ ID NO: 731686 - DNA, 22 bp, Artificial Sequence
  chemically synthesized
ctaatgagatcctatagggata

SEQ ID NO: 731687 - DNA, 22 bp, Artificial Sequence
  chemically synthesized
actaatgagatcctatagggat

SEQ ID NO: 731688 - DNA, 22 bp, Artificial Sequence
  chemically synthesized
tactaatgagatcctataggga

SEQ ID NO: 731689 - DNA, 22 bp, Artificial Sequence
  chemically synthesized
caatgaatatccctataggatc

SEQ ID NO: 731690 - DNA, 22 bp, Artificial Sequence
  chemically synthesized
aattttactaatgagatcctat

SEQ ID NO: 731691 - DNA, 22 bp, Artificial Sequence
  chemically synthesized
aaattttactaatgagatccta

SEQ ID NO: 731692 - DNA, 22 bp, Artificial Sequence
  chemically synthesized
tcttaaattttactaatgagat

SEQ ID NO: 731693 - DNA, 22 bp, Artificial Sequence
  chemically synthesized
attgtcttaaattttactaatg

SEQ ID NO: 731694 - DNA, 22 bp, Artificial Sequence
  chemically synthesized
gattgtcttaaattttactaat

SEQ ID NO: 731695 - DNA, 22 bp, Artificial Sequence
  chemically synthesized
taggatctcattagtaaaattt

SEQ ID NO: 731696 - DNA, 22 bp, Artificial Sequence
  chemically synthesized
attagtaaaatttaagacaatc

SEQ ID NO: 731697 - DNA, 22 bp, Artificial Sequence
  chemically synthesized
atccatgtatcttgattgtctt

SEQ ID NO: 731698 - DNA, 22 bp, Artificial Sequence
  chemically synthesized
gtaaaatttaagacaatcaaga

SEQ ID NO: 731699 - DNA, 22 bp, Artificial Sequence
  chemically synthesized
gttaatccatgtatcttgattg

SEQ ID NO: 731700 - DNA, 22 bp, Artificial Sequence
  chemically synthesized
agttaatccatgtatcttgatt

SEQ ID NO: 731701 - DNA, 22 bp, Artificial Sequence
  chemically synthesized
tagttaatccatgtatcttgat

SEQ ID NO: 731702 - DNA, 22 bp, Artificial Sequence
  chemically synthesized
aagacaatcaagatacatggat

SEQ ID NO: 731703 - DNA, 22 bp, Artificial Sequence
  chemically synthesized
agacaatcaagatacatggatt

SEQ ID NO: 731704 - DNA, 22 bp, Artificial Sequence
  chemically synthesized
aaatattttagttaatccatgt

SEQ ID NO: 731705 - DNA, 22 bp, Artificial Sequence
  chemically synthesized
ggggatgtcattaaaatatttt

SEQ ID NO: 731706 - DNA, 22 bp, Artificial Sequence
  chemically synthesized
actaaaatattttaatgacatc

SEQ ID NO: 731707 - DNA, 22 bp, Artificial Sequence
  chemically synthesized
tgcaatgttaggggatgtcatt

SEQ ID NO: 731708 - DNA, 22 bp, Artificial Sequence
  chemically synthesized
atgcaatgttaggggatgtcat

SEQ ID NO: 731709 - DNA, 22 bp, Artificial Sequence
  chemically synthesized
aaatattttaatgacatcccct

SEQ ID NO: 731710 - DNA, 22 bp, Artificial Sequence
  chemically synthesized
tttatgcaatgttaggggatgt

SEQ ID NO: 731711 - DNA, 22 bp, Artificial Sequence
  chemically synthesized
taatgacatcccctaacattgc

SEQ ID NO: 731712 - DNA, 22 bp, Artificial Sequence
  chemically synthesized
tatcctgtttatgcaatgttag

SEQ ID NO: 731713 - DNA, 22 bp, Artificial Sequence
  chemically synthesized
aatgacatcccctaacattgca

SEQ ID NO: 731714 - DNA, 22 bp, Artificial Sequence
  chemically synthesized
atatcctgtttatgcaatgtta

SEQ ID NO: 731715 - DNA, 22 bp, Artificial Sequence
  chemically synthesized
atgacatcccctaacattgcat

SEQ ID NO: 731716 - DNA, 22 bp, Artificial Sequence
  chemically synthesized
ttatatcctgtttatgcaatgt

SEQ ID NO: 731717 - DNA, 22 bp, Artificial Sequence
  chemically synthesized
gattcttatatcctgtttatgc

SEQ ID NO: 731718 - DNA, 22 bp, Artificial Sequence
  chemically synthesized
ctggattcttatatcctgttta

SEQ ID NO: 731719 - DNA, 22 bp, Artificial Sequence
  chemically synthesized
gctggattcttatatcctgttt

SEQ ID NO: 731720 - DNA, 22 bp, Artificial Sequence
  chemically synthesized
tgctggattcttatatcctgtt

SEQ ID NO: 731721 - DNA, 22 bp, Artificial Sequence
  chemically synthesized
acattgcataaacaggatataa

SEQ ID NO: 731722 - DNA, 22 bp, Artificial Sequence
  chemically synthesized
cataaacaggatataagaatcc

SEQ ID NO: 731723 - DNA, 22 bp, Artificial Sequence
  chemically synthesized
aaagcccaagcaacaggttttg

SEQ ID NO: 731724 - DNA, 22 bp, Artificial Sequence
  chemically synthesized
gagaccagacgtaaaattaaaa

SEQ ID NO: 731725 - DNA, 22 bp, Artificial Sequence
  chemically synthesized
ttgcttgggcttttaattttac

SEQ ID NO: 731726 - DNA, 22 bp, Artificial Sequence
  chemically synthesized
cttgggcttttaattttacgtc

SEQ ID NO: 731727 - DNA, 22 bp, Artificial Sequence
  chemically synthesized
gggcttttaattttacgtctgg

SEQ ID NO: 731728 - DNA, 22 bp, Artificial Sequence
  chemically synthesized
ggcttttaattttacgtctggt

SEQ ID NO: 731729 - DNA, 22 bp, Artificial Sequence
  chemically synthesized
ttaattttacgtctggtctcca

SEQ ID NO: 731730 - DNA, 22 bp, Artificial Sequence
  chemically synthesized
taattttacgtctggtctccaa

SEQ ID NO: 731731 - DNA, 22 bp, Artificial Sequence
  chemically synthesized
gatacaaggccattggagacca

SEQ ID NO: 731732 - DNA, 22 bp, Artificial Sequence
  chemically synthesized
aattttacgtctggtctccaat

SEQ ID NO: 731733 - DNA, 22 bp, Artificial Sequence
  chemically synthesized
attttacgtctggtctccaatg

SEQ ID NO: 731734 - DNA, 22 bp, Artificial Sequence
  chemically synthesized
tacgtctggtctccaatggcct

SEQ ID NO: 731735 - DNA, 22 bp, Artificial Sequence
  chemically synthesized
acgtctggtctccaatggcctt

SEQ ID NO: 731736 - DNA, 22 bp, Artificial Sequence
  chemically synthesized
cgtctggtctccaatggccttg

SEQ ID NO: 731737 - DNA, 22 bp, Artificial Sequence
  chemically synthesized
agccaatggttggatacaaggc

SEQ ID NO: 731738 - DNA, 22 bp, Artificial Sequence
  chemically synthesized
gtctccaatggccttgtatcca

SEQ ID NO: 731739 - DNA, 22 bp, Artificial Sequence
  chemically synthesized
ctaagccaatggttggatacaa

SEQ ID NO: 731740 - DNA, 22 bp, Artificial Sequence
  chemically synthesized
cctaagccaatggttggataca

SEQ ID NO: 731741 - DNA, 22 bp, Artificial Sequence
  chemically synthesized
ttcctaagccaatggttggata

SEQ ID NO: 731742 - DNA, 22 bp, Artificial Sequence
  chemically synthesized
caatggccttgtatccaaccat

SEQ ID NO: 731743 - DNA, 22 bp, Artificial Sequence
  chemically synthesized
gtatccaaccattggcttagga

SEQ ID NO: 731744 - DNA, 22 bp, Artificial Sequence
  chemically synthesized
tatccaaccattggcttaggaa

SEQ ID NO: 731745 - DNA, 22 bp, Artificial Sequence
  chemically synthesized
gcatcaggtcacaagaattctt

SEQ ID NO: 731746 - DNA, 22 bp, Artificial Sequence
  chemically synthesized
ggcatcaggtcacaagaattct

SEQ ID NO: 731747 - DNA, 22 bp, Artificial Sequence
  chemically synthesized
gcttaggaagaattcttgtgac

SEQ ID NO: 731748 - DNA, 22 bp, Artificial Sequence
  chemically synthesized
gatttggcatcaggtcacaaga

SEQ ID NO: 731749 - DNA, 22 bp, Artificial Sequence
  chemically synthesized
agatttggcatcaggtcacaag

SEQ ID NO: 731750 - DNA, 22 bp, Artificial Sequence
  chemically synthesized
tagatttggcatcaggtcacaa

SEQ ID NO: 731751 - DNA, 22 bp, Artificial Sequence
  chemically synthesized
aggaagaattcttgtgacctga

SEQ ID NO: 731752 - DNA, 22 bp, Artificial Sequence
  chemically synthesized
ggaagaattcttgtgacctgat

SEQ ID NO: 731753 - DNA, 22 bp, Artificial Sequence
  chemically synthesized
cctttagatttggcatcaggtc

SEQ ID NO: 731754 - DNA, 22 bp, Artificial Sequence
  chemically synthesized
acctttagatttggcatcaggt

SEQ ID NO: 731755 - DNA, 22 bp, Artificial Sequence
  chemically synthesized
ttacctttagatttggcatcag

SEQ ID NO: 731756 - DNA, 22 bp, Artificial Sequence
  chemically synthesized
tcttacctttagatttggcatc

SEQ ID NO: 731757 - DNA, 22 bp, Artificial Sequence
  chemically synthesized
ttgtgacctgatgccaaatcta

SEQ ID NO: 731758 - DNA, 22 bp, Artificial Sequence
  chemically synthesized
gtgacctgatgccaaatctaaa

SEQ ID NO: 731759 - DNA, 22 bp, Artificial Sequence
  chemically synthesized
tgacctgatgccaaatctaaag

SEQ ID NO: 731760 - DNA, 22 bp, Artificial Sequence
  chemically synthesized
atgccaaatctaaaggtaagag

SEQ ID NO: 731761 - DNA, 22 bp, Artificial Sequence
  chemically synthesized
caaatacagtattctcttacct

SEQ ID NO: 731762 - DNA, 22 bp, Artificial Sequence
  chemically synthesized
acaccattgcaaatacagtatt

SEQ ID NO: 731763 - DNA, 22 bp, Artificial Sequence
  chemically synthesized
aaggtaagagaatactgtattt

SEQ ID NO: 731764 - DNA, 22 bp, Artificial Sequence
  chemically synthesized
aattgacaccattgcaaataca

SEQ ID NO: 731765 - DNA, 22 bp, Artificial Sequence
  chemically synthesized
aaattgacaccattgcaaatac

SEQ ID NO: 731766 - DNA, 22 bp, Artificial Sequence
  chemically synthesized
ggcttaaattgacaccattgca

SEQ ID NO: 731767 - DNA, 22 bp, Artificial Sequence
  chemically synthesized
aggcttaaattgacaccattgc

SEQ ID NO: 731768 - DNA, 22 bp, Artificial Sequence
  chemically synthesized
taggcttaaattgacaccattg

SEQ ID NO: 731769 - DNA, 22 bp, Artificial Sequence
  chemically synthesized
tatttgcaatggtgtcaattta

SEQ ID NO: 731770 - DNA, 22 bp, Artificial Sequence
  chemically synthesized
gcaatggtgtcaatttaagcct

SEQ ID NO: 731771 - DNA, 22 bp, Artificial Sequence
  chemically synthesized
caatggtgtcaatttaagccta

SEQ ID NO: 731772 - DNA, 22 bp, Artificial Sequence
  chemically synthesized
tgaagtgtaggattttaggctt

SEQ ID NO: 731773 - DNA, 22 bp, Artificial Sequence
  chemically synthesized
atgaagtgtaggattttaggct

SEQ ID NO: 731774 - DNA, 22 bp, Artificial Sequence
  chemically synthesized
tatgaagtgtaggattttaggc

SEQ ID NO: 731775 - DNA, 22 bp, Artificial Sequence
  chemically synthesized
ttatgaagtgtaggattttagg

SEQ ID NO: 731776 - DNA, 22 bp, Artificial Sequence
  chemically synthesized
caatttttatgaagtgtaggat

SEQ ID NO: 731777 - DNA, 22 bp, Artificial Sequence
  chemically synthesized
tacaatttttatgaagtgtagg

SEQ ID NO: 731778 - DNA, 22 bp, Artificial Sequence
  chemically synthesized
aagcctaaaatcctacacttca

SEQ ID NO: 731779 - DNA, 22 bp, Artificial Sequence
  chemically synthesized
agcctaaaatcctacacttcat

SEQ ID NO: 731780 - DNA, 22 bp, Artificial Sequence
  chemically synthesized
ttctacaatttttatgaagtgt

SEQ ID NO: 731781 - DNA, 22 bp, Artificial Sequence
  chemically synthesized
aaatcctacacttcataaaaat

SEQ ID NO: 731782 - DNA, 22 bp, Artificial Sequence
  chemically synthesized
cagcctgttctacaatttttat

SEQ ID NO: 731783 - DNA, 22 bp, Artificial Sequence
  chemically synthesized
acagcctgttctacaattttta

SEQ ID NO: 731784 - DNA, 22 bp, Artificial Sequence
  chemically synthesized
cacttcataaaaattgtagaac

SEQ ID NO: 731785 - DNA, 22 bp, Artificial Sequence
  chemically synthesized
cataaaaattgtagaacaggct

SEQ ID NO: 731786 - DNA, 22 bp, Artificial Sequence
  chemically synthesized
ataaaaattgtagaacaggctg

SEQ ID NO: 731787 - DNA, 22 bp, Artificial Sequence
  chemically synthesized
tagaacaggctgtaagctgact

SEQ ID NO: 731788 - DNA, 22 bp, Artificial Sequence
  chemically synthesized
gaaggcaggcagaagtcagctt

SEQ ID NO: 731789 - DNA, 22 bp, Artificial Sequence
  chemically synthesized
ttagaaggcaggcagaagtcag

SEQ ID NO: 731790 - DNA, 22 bp, Artificial Sequence
  chemically synthesized
gttagaaggcaggcagaagtca

SEQ ID NO: 731791 - DNA, 22 bp, Artificial Sequence
  chemically synthesized
taagctgacttctgcctgcctt

SEQ ID NO: 731792 - DNA, 22 bp, Artificial Sequence
  chemically synthesized
accaacatttgttagaaggcag

SEQ ID NO: 731793 - DNA, 22 bp, Artificial Sequence
  chemically synthesized
acttctgcctgccttctaacaa

SEQ ID NO: 731794 - DNA, 22 bp, Artificial Sequence
  chemically synthesized
ctgcctgccttctaacaaatgt

SEQ ID NO: 731795 - DNA, 22 bp, Artificial Sequence
  chemically synthesized
tgcctgccttctaacaaatgtt

SEQ ID NO: 731796 - DNA, 22 bp, Artificial Sequence
  chemically synthesized
cctgccttctaacaaatgttgg

SEQ ID NO: 731797 - DNA, 22 bp, Artificial Sequence
  chemically synthesized
ccttctaacaaatgttggttaa

SEQ ID NO: 731798 - DNA, 22 bp, Artificial Sequence
  chemically synthesized
ctaacaaatgttggttaacgac

SEQ ID NO: 731799 - DNA, 22 bp, Artificial Sequence
  chemically synthesized
taacaaatgttggttaacgaca

SEQ ID NO: 731800 - DNA, 22 bp, Artificial Sequence
  chemically synthesized
acaaatgttggttaacgacatg

SEQ ID NO: 731801 - DNA, 22 bp, Artificial Sequence
  chemically synthesized
cacaagtgcaatcatgtcgtta

SEQ ID NO: 731802 - DNA, 22 bp, Artificial Sequence
  chemically synthesized
aagtcctccacaagtgcaatca

SEQ ID NO: 731803 - DNA, 22 bp, Artificial Sequence
  chemically synthesized
gttaacgacatgattgcacttg

SEQ ID NO: 731804 - DNA, 22 bp, Artificial Sequence
  chemically synthesized
acgacatgattgcacttgtgga

SEQ ID NO: 731805 - DNA, 22 bp, Artificial Sequence
  chemically synthesized
atgctgaagtcctccacaagtg

SEQ ID NO: 731806 - DNA, 22 bp, Artificial Sequence
  chemically synthesized
catgctgaagtcctccacaagt

SEQ ID NO: 731807 - DNA, 22 bp, Artificial Sequence
  chemically synthesized
atgcttcatgctgaagtcctcc

SEQ ID NO: 731808 - DNA, 22 bp, Artificial Sequence
  chemically synthesized
catgcttcatgctgaagtcctc

SEQ ID NO: 731809 - DNA, 22 bp, Artificial Sequence
  chemically synthesized
cacttgtggaggacttcagcat

SEQ ID NO: 731810 - DNA, 22 bp, Artificial Sequence
  chemically synthesized
gtggaggacttcagcatgaagc

SEQ ID NO: 731811 - DNA, 22 bp, Artificial Sequence
  chemically synthesized
tggaggacttcagcatgaagca

SEQ ID NO: 731812 - DNA, 22 bp, Artificial Sequence
  chemically synthesized
aagccgcagcttcatgcttcat

SEQ ID NO: 731813 - DNA, 22 bp, Artificial Sequence
  chemically synthesized
cctcaagccgcagcttcatgct

SEQ ID NO: 731814 - DNA, 22 bp, Artificial Sequence
  chemically synthesized
cagcatgaagcatgaagctgcg

SEQ ID NO: 731815 - DNA, 22 bp, Artificial Sequence
  chemically synthesized
agcatgaagcatgaagctgcgg

SEQ ID NO: 731816 - DNA, 22 bp, Artificial Sequence
  chemically synthesized
aggtggatgaggaatggctacc

SEQ ID NO: 731817 - DNA, 22 bp, Artificial Sequence
  chemically synthesized
gaggtggatgaggaatggctac

SEQ ID NO: 731818 - DNA, 22 bp, Artificial Sequence
  chemically synthesized
cggcttgaggtagccattcctc

SEQ ID NO: 731819 - DNA, 22 bp, Artificial Sequence
  chemically synthesized
gaggtagccattcctcatccac

SEQ ID NO: 731820 - DNA, 22 bp, Artificial Sequence
  chemically synthesized
aggtagccattcctcatccacc

SEQ ID NO: 731821 - DNA, 22 bp, Artificial Sequence
  chemically synthesized
ctcatccacctcaaacacatct

SEQ ID NO: 731822 - DNA, 22 bp, Artificial Sequence
  chemically synthesized
atccacctcaaacacatctgtg

SEQ ID NO: 731823 - DNA, 22 bp, Artificial Sequence
  chemically synthesized
ggaaataatggagaaccacaga

SEQ ID NO: 731824 - DNA, 22 bp, Artificial Sequence
  chemically synthesized
gggaaataatggagaaccacag

SEQ ID NO: 731825 - DNA, 22 bp, Artificial Sequence
  chemically synthesized
tgggaaataatggagaaccaca

SEQ ID NO: 731826 - DNA, 22 bp, Artificial Sequence
  chemically synthesized
ttgggaaataatggagaaccac

SEQ ID NO: 731827 - DNA, 22 bp, Artificial Sequence
  chemically synthesized
tttgggaaataatggagaacca

SEQ ID NO: 731828 - DNA, 22 bp, Artificial Sequence
  chemically synthesized
aaacacatctgtggttctccat

SEQ ID NO: 731829 - DNA, 22 bp, Artificial Sequence
  chemically synthesized
tttttgggaaataatggagaac

SEQ ID NO: 731830 - DNA, 22 bp, Artificial Sequence
  chemically synthesized
ggttctttttgggaaataatgg

SEQ ID NO: 731831 - DNA, 22 bp, Artificial Sequence
  chemically synthesized
ttaggttctttttgggaaataa

SEQ ID NO: 731832 - DNA, 22 bp, Artificial Sequence
  chemically synthesized
tggttctccattatttcccaaa

SEQ ID NO: 731833 - DNA, 22 bp, Artificial Sequence
  chemically synthesized
tccattatttcccaaaaagaac

SEQ ID NO: 731834 - DNA, 22 bp, Artificial Sequence
  chemically synthesized
cattatttcccaaaaagaacct

SEQ ID NO: 731835 - DNA, 22 bp, Artificial Sequence
  chemically synthesized
tttcccaaaaagaacctaatag

SEQ ID NO: 731836 - DNA, 22 bp, Artificial Sequence
  chemically synthesized
ggtcacgtgcaactattaggtt

SEQ ID NO: 731837 - DNA, 22 bp, Artificial Sequence
  chemically synthesized
aggtcacgtgcaactattaggt

SEQ ID NO: 731838 - DNA, 22 bp, Artificial Sequence
  chemically synthesized
cccaaaaagaacctaatagttg

SEQ ID NO: 731839 - DNA, 22 bp, Artificial Sequence
  chemically synthesized
ccaaaaagaacctaatagttgc

SEQ ID NO: 731840 - DNA, 22 bp, Artificial Sequence
  chemically synthesized
agtgaatttaggtcacgtgcaa

SEQ ID NO: 731841 - DNA, 22 bp, Artificial Sequence
  chemically synthesized
acctaagtgaatttaggtcacg

SEQ ID NO: 731842 - DNA, 22 bp, Artificial Sequence
  chemically synthesized
atagttgcacgtgacctaaatt

SEQ ID NO: 731843 - DNA, 22 bp, Artificial Sequence
  chemically synthesized
tgaactgacctaagtgaattta

SEQ ID NO: 731844 - DNA, 22 bp, Artificial Sequence
  chemically synthesized
cacgtgacctaaattcacttag

SEQ ID NO: 731845 - DNA, 22 bp, Artificial Sequence
  chemically synthesized
ctgtgaactgacctaagtgaat

SEQ ID NO: 731846 - DNA, 22 bp, Artificial Sequence
  chemically synthesized
cacctgctgtgaactgacctaa

SEQ ID NO: 731847 - DNA, 22 bp, Artificial Sequence
  chemically synthesized
aattcacttaggtcagttcaca

SEQ ID NO: 731848 - DNA, 22 bp, Artificial Sequence
  chemically synthesized
aaattccacctgctgtgaactg

SEQ ID NO: 731849 - DNA, 22 bp, Artificial Sequence
  chemically synthesized
acttaggtcagttcacagcagg

SEQ ID NO: 731850 - DNA, 22 bp, Artificial Sequence
  chemically synthesized
cctcaaattccacctgctgtga

SEQ ID NO: 731851 - DNA, 22 bp, Artificial Sequence
  chemically synthesized
aggtcagttcacagcaggtgga

SEQ ID NO: 731852 - DNA, 22 bp, Artificial Sequence
  chemically synthesized
ggtcagttcacagcaggtggaa

SEQ ID NO: 731853 - DNA, 22 bp, Artificial Sequence
  chemically synthesized
gcacactgcctcaaattccacc

SEQ ID NO: 731854 - DNA, 22 bp, Artificial Sequence
  chemically synthesized
ttggcacactgcctcaaattcc

SEQ ID NO: 731855 - DNA, 22 bp, Artificial Sequence
  chemically synthesized
attggcacactgcctcaaattc

SEQ ID NO: 731856 - DNA, 22 bp, Artificial Sequence
  chemically synthesized
tattggcacactgcctcaaatt

SEQ ID NO: 731857 - DNA, 22 bp, Artificial Sequence
  chemically synthesized
acagcaggtggaatttgaggca

SEQ ID NO: 731858 - DNA, 22 bp, Artificial Sequence
  chemically synthesized
attttattggcacactgcctca

SEQ ID NO: 731859 - DNA, 22 bp, Artificial Sequence
  chemically synthesized
ccgctcattttattggcacact

SEQ ID NO: 731860 - DNA, 22 bp, Artificial Sequence
  chemically synthesized
accgctcattttattggcacac

SEQ ID NO: 731861 - DNA, 22 bp, Artificial Sequence
  chemically synthesized
cttaccgctcattttattggca

SEQ ID NO: 731862 - DNA, 22 bp, Artificial Sequence
  chemically synthesized
acttaccgctcattttattggc

SEQ ID NO: 731863 - DNA, 22 bp, Artificial Sequence
  chemically synthesized
gaggcagtgtgccaataaaatg

SEQ ID NO: 731864 - DNA, 22 bp, Artificial Sequence
  chemically synthesized
aggcagtgtgccaataaaatga

SEQ ID NO: 731865 - DNA, 22 bp, Artificial Sequence
  chemically synthesized
ccccaaatatttacttaccgct

SEQ ID NO: 731866 - DNA, 22 bp, Artificial Sequence
  chemically synthesized
accccaaatatttacttaccgc

SEQ ID NO: 731867 - DNA, 22 bp, Artificial Sequence
  chemically synthesized
ttaccccaaatatttacttacc

SEQ ID NO: 731868 - DNA, 22 bp, Artificial Sequence
  chemically synthesized
tgcagaagaccctcttacccca

SEQ ID NO: 731869 - DNA, 22 bp, Artificial Sequence
  chemically synthesized
atcgttgtgcagaagaccctct

SEQ ID NO: 731870 - DNA, 22 bp, Artificial Sequence
  chemically synthesized
aatcgttgtgcagaagaccctc

SEQ ID NO: 731871 - DNA, 22 bp, Artificial Sequence
  chemically synthesized
tttaatcgttgtgcagaagacc

SEQ ID NO: 731872 - DNA, 22 bp, Artificial Sequence
  chemically synthesized
ggggtaagagggtcttctgcac

SEQ ID NO: 731873 - DNA, 22 bp, Artificial Sequence
  chemically synthesized
gggtaagagggtcttctgcaca

SEQ ID NO: 731874 - DNA, 22 bp, Artificial Sequence
  chemically synthesized
gaactatttaatcgttgtgcag

SEQ ID NO: 731875 - DNA, 22 bp, Artificial Sequence
  chemically synthesized
ctgcacaacgattaaatagttc

SEQ ID NO: 731876 - DNA, 22 bp, Artificial Sequence
  chemically synthesized
gaaaatcacctagaactattta

SEQ ID NO: 731877 - DNA, 22 bp, Artificial Sequence
  chemically synthesized
tgcacaacgattaaatagttct

SEQ ID NO: 731878 - DNA, 22 bp, Artificial Sequence
  chemically synthesized
cacaacgattaaatagttctag

SEQ ID NO: 731879 - DNA, 22 bp, Artificial Sequence
  chemically synthesized
aatagttctaggtgattttcta

SEQ ID NO: 731880 - DNA, 22 bp, Artificial Sequence
  chemically synthesized
taaatgaggagattagaaaatc

SEQ ID NO: 731881 - DNA, 22 bp, Artificial Sequence
  chemically synthesized
ataaatgaggagattagaaaat

SEQ ID NO: 731882 - DNA, 22 bp, Artificial Sequence
  chemically synthesized
ttataaatgaggagattagaaa

SEQ ID NO: 731883 - DNA, 22 bp, Artificial Sequence
  chemically synthesized
taggtgattttctaatctcctc

SEQ ID NO: 731884 - DNA, 22 bp, Artificial Sequence
  chemically synthesized
ggtgattttctaatctcctcat

SEQ ID NO: 731885 - DNA, 22 bp, Artificial Sequence
  chemically synthesized
ggaccactcttataaatgagga

SEQ ID NO: 731886 - DNA, 22 bp, Artificial Sequence
  chemically synthesized
ctgggaccactcttataaatga

SEQ ID NO: 731887 - DNA, 22 bp, Artificial Sequence
  chemically synthesized
gctgggaccactcttataaatg

SEQ ID NO: 731888 - DNA, 22 bp, Artificial Sequence
  chemically synthesized
tctaatctcctcatttataaga

SEQ ID NO: 731889 - DNA, 22 bp, Artificial Sequence
  chemically synthesized
ctaatctcctcatttataagag

SEQ ID NO: 731890 - DNA, 22 bp, Artificial Sequence
  chemically synthesized
ttgctgggaccactcttataaa

SEQ ID NO: 731891 - DNA, 22 bp, Artificial Sequence
  chemically synthesized
taatctcctcatttataagagt

SEQ ID NO: 731892 - DNA, 22 bp, Artificial Sequence
  chemically synthesized
atctcctcatttataagagtgg

SEQ ID NO: 731893 - DNA, 22 bp, Artificial Sequence
  chemically synthesized
ttcttgctgggaccactcttat

SEQ ID NO: 731894 - DNA, 22 bp, Artificial Sequence
  chemically synthesized
tgttcttgctgggaccactctt

SEQ ID NO: 731895 - DNA, 22 bp, Artificial Sequence
  chemically synthesized
ctcatttataagagtggtccca

SEQ ID NO: 731896 - DNA, 22 bp, Artificial Sequence
  chemically synthesized
atttataagagtggtcccagca

SEQ ID NO: 731897 - DNA, 22 bp, Artificial Sequence
  chemically synthesized
agtctctgttcttgctgggacc

SEQ ID NO: 731898 - DNA, 22 bp, Artificial Sequence
  chemically synthesized
cagtctctgttcttgctgggac

SEQ ID NO: 731899 - DNA, 22 bp, Artificial Sequence
  chemically synthesized
ataagagtggtcccagcaagaa

SEQ ID NO: 731900 - DNA, 22 bp, Artificial Sequence
  chemically synthesized
tttcagtctctgttcttgctgg

SEQ ID NO: 731901 - DNA, 22 bp, Artificial Sequence
  chemically synthesized
taagagtggtcccagcaagaac

SEQ ID NO: 731902 - DNA, 22 bp, Artificial Sequence
  chemically synthesized
atttcagtctctgttcttgctg

SEQ ID NO: 731903 - DNA, 22 bp, Artificial Sequence
  chemically synthesized
tatttcagtctctgttcttgct

SEQ ID NO: 731904 - DNA, 22 bp, Artificial Sequence
  chemically synthesized
aaacgaccactttatttcagtc

SEQ ID NO: 731905 - DNA, 22 bp, Artificial Sequence
  chemically synthesized
gaaacgaccactttatttcagt

SEQ ID NO: 731906 - DNA, 22 bp, Artificial Sequence
  chemically synthesized
tgaaacgaccactttatttcag

SEQ ID NO: 731907 - DNA, 22 bp, Artificial Sequence
  chemically synthesized
aagctttgaaacgaccacttta

SEQ ID NO: 731908 - DNA, 22 bp, Artificial Sequence
  chemically synthesized
aaagctttgaaacgaccacttt

SEQ ID NO: 731909 - DNA, 22 bp, Artificial Sequence
  chemically synthesized
aaataaagtggtcgtttcaaag

SEQ ID NO: 731910 - DNA, 22 bp, Artificial Sequence
  chemically synthesized
aaagcagagtatttaaagcttt

SEQ ID NO: 731911 - DNA, 22 bp, Artificial Sequence
  chemically synthesized
caaagctttaaatactctgctt

SEQ ID NO: 731912 - DNA, 22 bp, Artificial Sequence
  chemically synthesized
aaagctttaaatactctgcttt

SEQ ID NO: 731913 - DNA, 22 bp, Artificial Sequence
  chemically synthesized
taaatactctgctttcagctac

SEQ ID NO: 731914 - DNA, 22 bp, Artificial Sequence
  chemically synthesized
aaatactctgctttcagctact

SEQ ID NO: 731915 - DNA, 22 bp, Artificial Sequence
  chemically synthesized
aatactctgctttcagctactc

SEQ ID NO: 731916 - DNA, 22 bp, Artificial Sequence
  chemically synthesized
aataagtggacagagtagctga

SEQ ID NO: 731917 - DNA, 22 bp, Artificial Sequence
  chemically synthesized
gaataagtggacagagtagctg

SEQ ID NO: 731918 - DNA, 22 bp, Artificial Sequence
  chemically synthesized
tgaataagtggacagagtagct

SEQ ID NO: 731919 - DNA, 22 bp, Artificial Sequence
  chemically synthesized
tctttgaataagtggacagagt

SEQ ID NO: 731920 - DNA, 22 bp, Artificial Sequence
  chemically synthesized
tgctttcagctactctgtccac

SEQ ID NO: 731921 - DNA, 22 bp, Artificial Sequence
  chemically synthesized
gtctttgaataagtggacagag

SEQ ID NO: 731922 - DNA, 22 bp, Artificial Sequence
  chemically synthesized
ctttcagctactctgtccactt

SEQ ID NO: 731923 - DNA, 22 bp, Artificial Sequence
  chemically synthesized
tcagctactctgtccacttatt

SEQ ID NO: 731924 - DNA, 22 bp, Artificial Sequence
  chemically synthesized
cagctactctgtccacttattc

SEQ ID NO: 731925 - DNA, 22 bp, Artificial Sequence
  chemically synthesized
aagtttgtctttgaataagtgg

SEQ ID NO: 731926 - DNA, 22 bp, Artificial Sequence
  chemically synthesized
agctactctgtccacttattca

SEQ ID NO: 731927 - DNA, 22 bp, Artificial Sequence
  chemically synthesized
caagtttgtctttgaataagtg

SEQ ID NO: 731928 - DNA, 22 bp, Artificial Sequence
  chemically synthesized
tcaagtttgtctttgaataagt

SEQ ID NO: 731929 - DNA, 22 bp, Artificial Sequence
  chemically synthesized
ctttcaagtttgtctttgaata

SEQ ID NO: 731930 - DNA, 22 bp, Artificial Sequence
  chemically synthesized
ctctgtccacttattcaaagac

SEQ ID NO: 731931 - DNA, 22 bp, Artificial Sequence
  chemically synthesized
cctttcaagtttgtctttgaat

SEQ ID NO: 731932 - DNA, 22 bp, Artificial Sequence
  chemically synthesized
tgtccacttattcaaagacaaa

SEQ ID NO: 731933 - DNA, 22 bp, Artificial Sequence
  chemically synthesized
tttcctttcaagtttgtctttg

SEQ ID NO: 731934 - DNA, 22 bp, Artificial Sequence
  chemically synthesized
tccacttattcaaagacaaact

SEQ ID NO: 731935 - DNA, 22 bp, Artificial Sequence
  chemically synthesized
ctgtttcctttcaagtttgtct

SEQ ID NO: 731936 - DNA, 22 bp, Artificial Sequence
  chemically synthesized
attcaaagacaaacttgaaagg

SEQ ID NO: 731937 - DNA, 22 bp, Artificial Sequence
  chemically synthesized
ttcaaagacaaacttgaaagga

SEQ ID NO: 731938 - DNA, 22 bp, Artificial Sequence
  chemically synthesized
aaagacaaacttgaaaggaaac

SEQ ID NO: 731939 - DNA, 22 bp, Artificial Sequence
  chemically synthesized
taatatgggctcctgtttcctt

SEQ ID NO: 731940 - DNA, 22 bp, Artificial Sequence
  chemically synthesized
tgctataatatgggctcctgtt

SEQ ID NO: 731941 - DNA, 22 bp, Artificial Sequence
  chemically synthesized
gaaaggaaacaggagcccatat

SEQ ID NO: 731942 - DNA, 22 bp, Artificial Sequence
  chemically synthesized
aaaggaaacaggagcccatatt

SEQ ID NO: 731943 - DNA, 22 bp, Artificial Sequence
  chemically synthesized
aaagcctgtgctataatatggg

SEQ ID NO: 731944 - DNA, 22 bp, Artificial Sequence
  chemically synthesized
aaaagcctgtgctataatatgg

SEQ ID NO: 731945 - DNA, 22 bp, Artificial Sequence
  chemically synthesized
acaaatttaaaagcctgtgcta

SEQ ID NO: 731946 - DNA, 22 bp, Artificial Sequence
  chemically synthesized
atattgacaaatttaaaagcct

SEQ ID NO: 731947 - DNA, 22 bp, Artificial Sequence
  chemically synthesized
ctcatattgacaaatttaaaag

SEQ ID NO: 731948 - DNA, 22 bp, Artificial Sequence
  chemically synthesized
tagcacaggcttttaaatttgt

SEQ ID NO: 731949 - DNA, 22 bp, Artificial Sequence
  chemically synthesized
gttcctcatattgacaaattta

SEQ ID NO: 731950 - DNA, 22 bp, Artificial Sequence
  chemically synthesized
ctggttcctcatattgacaaat

SEQ ID NO: 731951 - DNA, 22 bp, Artificial Sequence
  chemically synthesized
cctggttcctcatattgacaaa

SEQ ID NO: 731952 - DNA, 22 bp, Artificial Sequence
  chemically synthesized
ttaaatttgtcaatatgaggaa

SEQ ID NO: 731953 - DNA, 22 bp, Artificial Sequence
  chemically synthesized
taaatttgtcaatatgaggaac

SEQ ID NO: 731954 - DNA, 22 bp, Artificial Sequence
  chemically synthesized
aaatttgtcaatatgaggaacc

SEQ ID NO: 731955 - DNA, 22 bp, Artificial Sequence
  chemically synthesized
aatttgtcaatatgaggaacca

SEQ ID NO: 731956 - DNA, 22 bp, Artificial Sequence
  chemically synthesized
gtcaatatgaggaaccaggaaa

SEQ ID NO: 731957 - DNA, 22 bp, Artificial Sequence
  chemically synthesized
tcaatatgaggaaccaggaaat

SEQ ID NO: 731958 - DNA, 22 bp, Artificial Sequence
  chemically synthesized
aatgaaagagccccgaagaaga

SEQ ID NO: 731959 - DNA, 22 bp, Artificial Sequence
  chemically synthesized
ttcttcttcggggctctttcat

SEQ ID NO: 731960 - DNA, 22 bp, Artificial Sequence
  chemically synthesized
gaatgcaagctaaatgaaagag

SEQ ID NO: 731961 - DNA, 22 bp, Artificial Sequence
  chemically synthesized
ttcttcggggctctttcattta

SEQ ID NO: 731962 - DNA, 22 bp, Artificial Sequence
  chemically synthesized
ctggaatgcaagctaaatgaaa

SEQ ID NO: 731963 - DNA, 22 bp, Artificial Sequence
  chemically synthesized
cttcggggctctttcatttagc

SEQ ID NO: 731964 - DNA, 22 bp, Artificial Sequence
  chemically synthesized
ttcggggctctttcatttagct

SEQ ID NO: 731965 - DNA, 22 bp, Artificial Sequence
  chemically synthesized
cggggctctttcatttagcttg

SEQ ID NO: 731966 - DNA, 22 bp, Artificial Sequence
  chemically synthesized
ggggctctttcatttagcttgc

SEQ ID NO: 731967 - DNA, 22 bp, Artificial Sequence
  chemically synthesized
tttcatttagcttgcattccag

SEQ ID NO: 731968 - DNA, 22 bp, Artificial Sequence
  chemically synthesized
tcatttagcttgcattccagga

SEQ ID NO: 731969 - DNA, 22 bp, Artificial Sequence
  chemically synthesized
catttagcttgcattccaggaa

SEQ ID NO: 731970 - DNA, 22 bp, Artificial Sequence
  chemically synthesized
atttagcttgcattccaggaat

SEQ ID NO: 731971 - DNA, 22 bp, Artificial Sequence
  chemically synthesized
gaacaaatgaacattcctggaa

SEQ ID NO: 731972 - DNA, 22 bp, Artificial Sequence
  chemically synthesized
ggaacaaatgaacattcctgga

SEQ ID NO: 731973 - DNA, 22 bp, Artificial Sequence
  chemically synthesized
agcttgcattccaggaatgttc

SEQ ID NO: 731974 - DNA, 22 bp, Artificial Sequence
  chemically synthesized
cttggaacaaatgaacattcct

SEQ ID NO: 731975 - DNA, 22 bp, Artificial Sequence
  chemically synthesized
gcttgcattccaggaatgttca

SEQ ID NO: 731976 - DNA, 22 bp, Artificial Sequence
  chemically synthesized
gcattccaggaatgttcatttg

SEQ ID NO: 731977 - DNA, 22 bp, Artificial Sequence
  chemically synthesized
cattccaggaatgttcatttgt

SEQ ID NO: 731978 - DNA, 22 bp, Artificial Sequence
  chemically synthesized
atgttgcttggaacaaatgaac

SEQ ID NO: 731979 - DNA, 22 bp, Artificial Sequence
  chemically synthesized
taatgttgcttggaacaaatga

SEQ ID NO: 731980 - DNA, 22 bp, Artificial Sequence
  chemically synthesized
ctaatgttgcttggaacaaatg

SEQ ID NO: 731981 - DNA, 22 bp, Artificial Sequence
  chemically synthesized
caggaatgttcatttgttccaa

SEQ ID NO: 731982 - DNA, 22 bp, Artificial Sequence
  chemically synthesized
atttctaatgttgcttggaaca

SEQ ID NO: 731983 - DNA, 22 bp, Artificial Sequence
  chemically synthesized
ccccattaatttctaatgttgc

SEQ ID NO: 731984 - DNA, 22 bp, Artificial Sequence
  chemically synthesized
atttgttccaagcaacattaga

SEQ ID NO: 731985 - DNA, 22 bp, Artificial Sequence
  chemically synthesized
accccattaatttctaatgttg

SEQ ID NO: 731986 - DNA, 22 bp, Artificial Sequence
  chemically synthesized
gttccaagcaacattagaaatt

SEQ ID NO: 731987 - DNA, 22 bp, Artificial Sequence
  chemically synthesized
ttccaagcaacattagaaatta

SEQ ID NO: 731988 - DNA, 22 bp, Artificial Sequence
  chemically synthesized
caagcaacattagaaattaatg

SEQ ID NO: 731989 - DNA, 22 bp, Artificial Sequence
  chemically synthesized
acccagcacttaccccattaat

SEQ ID NO: 731990 - DNA, 22 bp, Artificial Sequence
  chemically synthesized
cattcacccagcacttacccca

SEQ ID NO: 731991 - DNA, 22 bp, Artificial Sequence
  chemically synthesized
gaaattaatggggtaagtgctg

SEQ ID NO: 731992 - DNA, 22 bp, Artificial Sequence
  chemically synthesized
cctacattcacccagcacttac

SEQ ID NO: 731993 - DNA, 22 bp, Artificial Sequence
  chemically synthesized
atggggtaagtgctgggtgaat

SEQ ID NO: 731994 - DNA, 22 bp, Artificial Sequence
  chemically synthesized
taccgattacctacattcaccc

SEQ ID NO: 731995 - DNA, 22 bp, Artificial Sequence
  chemically synthesized
ataccgattacctacattcacc

SEQ ID NO: 731996 - DNA, 22 bp, Artificial Sequence
  chemically synthesized
tataccgattacctacattcac

SEQ ID NO: 731997 - DNA, 22 bp, Artificial Sequence
  chemically synthesized
ggtgaatgtaggtaatcggtat

SEQ ID NO: 731998 - DNA, 22 bp, Artificial Sequence
  chemically synthesized
aagaaagcagcctttataccga

SEQ ID NO: 731999 - DNA, 22 bp, Artificial Sequence
  chemically synthesized
actcaagaaagcagcctttata

SEQ ID NO: 732000 - DNA, 22 bp, Artificial Sequence
  chemically synthesized
aggcattaactcaagaaagcag

SEQ ID NO: 732001 - DNA, 22 bp, Artificial Sequence
  chemically synthesized
tcaggcattaactcaagaaagc

SEQ ID NO: 732002 - DNA, 22 bp, Artificial Sequence
  chemically synthesized
ctcaggcattaactcaagaaag

SEQ ID NO: 732003 - DNA, 22 bp, Artificial Sequence
  chemically synthesized
gtgatttctcaggcattaactc

SEQ ID NO: 732004 - DNA, 22 bp, Artificial Sequence
  chemically synthesized
ggtgatttctcaggcattaact

SEQ ID NO: 732005 - DNA, 22 bp, Artificial Sequence
  chemically synthesized
ctttcttgagttaatgcctgag

SEQ ID NO: 732006 - DNA, 22 bp, Artificial Sequence
  chemically synthesized
tcttgagttaatgcctgagaaa

SEQ ID NO: 732007 - DNA, 22 bp, Artificial Sequence
  chemically synthesized
taggcttggtgatttctcaggc

SEQ ID NO: 732008 - DNA, 22 bp, Artificial Sequence
  chemically synthesized
cttgagttaatgcctgagaaat

SEQ ID NO: 732009 - DNA, 22 bp, Artificial Sequence
  chemically synthesized
ttgagttaatgcctgagaaatc

SEQ ID NO: 732010 - DNA, 22 bp, Artificial Sequence
  chemically synthesized
gagttaatgcctgagaaatcac

SEQ ID NO: 732011 - DNA, 22 bp, Artificial Sequence
  chemically synthesized
agttaatgcctgagaaatcacc

SEQ ID NO: 732012 - DNA, 22 bp, Artificial Sequence
  chemically synthesized
atgcctgagaaatcaccaagcc

SEQ ID NO: 732013 - DNA, 22 bp, Artificial Sequence
  chemically synthesized
agaaatcaccaagcctataatt

SEQ ID NO: 732014 - DNA, 22 bp, Artificial Sequence
  chemically synthesized
taatttcttttttcttttcttt

SEQ ID NO: 732015 - DNA, 22 bp, Artificial Sequence
  chemically synthesized
cttttttcttttctttttttct

SEQ ID NO: 732016 - DNA, 22 bp, Artificial Sequence
  chemically synthesized
ttttttcttttctttttttctt

SEQ ID NO: 732017 - DNA, 22 bp, Artificial Sequence
  chemically synthesized
ttttcttttctttttttctttt

SEQ ID NO: 732018 - DNA, 22 bp, Artificial Sequence
  chemically synthesized
tttcttttctttttttcttttt

SEQ ID NO: 732019 - DNA, 22 bp, Artificial Sequence
  chemically synthesized
ttcttttctttttttctttttt

SEQ ID NO: 732020 - DNA, 22 bp, Artificial Sequence
  chemically synthesized
tcttttctttttttcttttttt

SEQ ID NO: 732021 - DNA, 22 bp, Artificial Sequence
  chemically synthesized
aaaaaaaaaagaaaaaaaagaa

SEQ ID NO: 732022 - DNA, 22 bp, Artificial Sequence
  chemically synthesized
cttttctttttttctttttttt

SEQ ID NO: 732023 - DNA, 22 bp, Artificial Sequence
  chemically synthesized
ttttctttttttcttttttttc

SEQ ID NO: 732024 - DNA, 22 bp, Artificial Sequence
  chemically synthesized
ttctttttttcttttttttctt

SEQ ID NO: 732025 - DNA, 22 bp, Artificial Sequence
  chemically synthesized
tctttttttcttttttttcttt

SEQ ID NO: 732026 - DNA, 22 bp, Artificial Sequence
  chemically synthesized
ctttttttcttttttttctttt

SEQ ID NO: 732027 - DNA, 22 bp, Artificial Sequence
  chemically synthesized
cgtctcaaaaaaaaaagaaaaa

SEQ ID NO: 732028 - DNA, 22 bp, Artificial Sequence
  chemically synthesized
tttttttcttttttttcttttt

SEQ ID NO: 732029 - DNA, 22 bp, Artificial Sequence
  chemically synthesized
tttttcttttttttcttttttt

SEQ ID NO: 732030 - DNA, 22 bp, Artificial Sequence
  chemically synthesized
ttttcttttttttctttttttt

SEQ ID NO: 732031 - DNA, 22 bp, Artificial Sequence
  chemically synthesized
tttcttttttttcttttttttt

SEQ ID NO: 732032 - DNA, 22 bp, Artificial Sequence
  chemically synthesized
ttcttttttttctttttttttt

SEQ ID NO: 732033 - DNA, 22 bp, Artificial Sequence
  chemically synthesized
tcttttttttcttttttttttg

SEQ ID NO: 732034 - DNA, 22 bp, Artificial Sequence
  chemically synthesized
cttttttttcttttttttttga

SEQ ID NO: 732035 - DNA, 22 bp, Artificial Sequence
  chemically synthesized
ttttttttcttttttttttgag

SEQ ID NO: 732036 - DNA, 22 bp, Artificial Sequence
  chemically synthesized
ttttttcttttttttttgagac

SEQ ID NO: 732037 - DNA, 22 bp, Artificial Sequence
  chemically synthesized
tttttcttttttttttgagacg

SEQ ID NO: 732038 - DNA, 22 bp, Artificial Sequence
  chemically synthesized
ttttcttttttttttgagacgg

SEQ ID NO: 732039 - DNA, 22 bp, Artificial Sequence
  chemically synthesized
tttcttttttttttgagacgga

SEQ ID NO: 732040 - DNA, 22 bp, Artificial Sequence
  chemically synthesized
ttcttttttttttgagacggag

SEQ ID NO: 732041 - DNA, 22 bp, Artificial Sequence
  chemically synthesized
tcttttttttttgagacggagt

SEQ ID NO: 732042 - DNA, 22 bp, Artificial Sequence
  chemically synthesized
cttttttttttgagacggagtc

SEQ ID NO: 732043 - DNA, 22 bp, Artificial Sequence
  chemically synthesized
gcgacagagcgagactccgtct

SEQ ID NO: 732044 - DNA, 22 bp, Artificial Sequence
  chemically synthesized
ttttttttttgagacggagtct

SEQ ID NO: 732045 - DNA, 22 bp, Artificial Sequence
  chemically synthesized
ttttttttgagacggagtctcg

SEQ ID NO: 732046 - DNA, 22 bp, Artificial Sequence
  chemically synthesized
tttttttgagacggagtctcgc

SEQ ID NO: 732047 - DNA, 22 bp, Artificial Sequence
  chemically synthesized
ttttttgagacggagtctcgct

SEQ ID NO: 732048 - DNA, 22 bp, Artificial Sequence
  chemically synthesized
tttttgagacggagtctcgctc

SEQ ID NO: 732049 - DNA, 22 bp, Artificial Sequence
  chemically synthesized
ttttgagacggagtctcgctct

SEQ ID NO: 732050 - DNA, 22 bp, Artificial Sequence
  chemically synthesized
cagcctggcgacagagcgagac

SEQ ID NO: 732051 - DNA, 22 bp, Artificial Sequence
  chemically synthesized
tttgagacggagtctcgctctg

SEQ ID NO: 732052 - DNA, 22 bp, Artificial Sequence
  chemically synthesized
ttgagacggagtctcgctctgt

SEQ ID NO: 732053 - DNA, 22 bp, Artificial Sequence
  chemically synthesized
tgagacggagtctcgctctgtc

SEQ ID NO: 732054 - DNA, 22 bp, Artificial Sequence
  chemically synthesized
gagacggagtctcgctctgtcg

SEQ ID NO: 732055 - DNA, 22 bp, Artificial Sequence
  chemically synthesized
agacggagtctcgctctgtcgc

SEQ ID NO: 732056 - DNA, 22 bp, Artificial Sequence
  chemically synthesized
cactccagcctggcgacagagc

SEQ ID NO: 732057 - DNA, 22 bp, Artificial Sequence
  chemically synthesized
gctctgtcgccaggctggagtg

SEQ ID NO: 732058 - DNA, 22 bp, Artificial Sequence
  chemically synthesized
tgtcgccaggctggagtgcagt

SEQ ID NO: 732059 - DNA, 22 bp, Artificial Sequence
  chemically synthesized
tcgccaggctggagtgcagtgg

SEQ ID NO: 732060 - DNA, 22 bp, Artificial Sequence
  chemically synthesized
cagtgagccgagatcgcgccac

SEQ ID NO: 732061 - DNA, 22 bp, Artificial Sequence
  chemically synthesized
gagtgcagtggcgcgatctcgg

SEQ ID NO: 732062 - DNA, 22 bp, Artificial Sequence
  chemically synthesized
ggaggaggaggttgcagtgagc

SEQ ID NO: 732063 - DNA, 22 bp, Artificial Sequence
  chemically synthesized
aacctgggaggaggaggttgca

SEQ ID NO: 732064 - DNA, 22 bp, Artificial Sequence
  chemically synthesized
gaacctgggaggaggaggttgc

SEQ ID NO: 732065 - DNA, 22 bp, Artificial Sequence
  chemically synthesized
ggctcactgcaacctcctcctc

SEQ ID NO: 732066 - DNA, 22 bp, Artificial Sequence
  chemically synthesized
actgcaacctcctcctcccagg

SEQ ID NO: 732067 - DNA, 22 bp, Artificial Sequence
  chemically synthesized
caacctcctcctcccaggttca

SEQ ID NO: 732068 - DNA, 22 bp, Artificial Sequence
  chemically synthesized
aggcaggagaatcacttgaacc

SEQ ID NO: 732069 - DNA, 22 bp, Artificial Sequence
  chemically synthesized
ctcctcccaggttcaagtgatt

SEQ ID NO: 732070 - DNA, 22 bp, Artificial Sequence
  chemically synthesized
ctcccaggttcaagtgattctc

SEQ ID NO: 732071 - DNA, 22 bp, Artificial Sequence
  chemically synthesized
ccaggttcaagtgattctcctg

SEQ ID NO: 732072 - DNA, 22 bp, Artificial Sequence
  chemically synthesized
gggaggctgaggcaggagaatc

SEQ ID NO: 732073 - DNA, 22 bp, Artificial Sequence
  chemically synthesized
ctcgggaggctgaggcaggaga

SEQ ID NO: 732074 - DNA, 22 bp, Artificial Sequence
  chemically synthesized
aagtgattctcctgcctcagcc

SEQ ID NO: 732075 - DNA, 22 bp, Artificial Sequence
  chemically synthesized
tcctgcctcagcctcccgagta

SEQ ID NO: 732076 - DNA, 22 bp, Artificial Sequence
  chemically synthesized
ctgcctcagcctcccgagtagc

SEQ ID NO: 732077 - DNA, 22 bp, Artificial Sequence
  chemically synthesized
cctcagcctcccgagtagctgg

SEQ ID NO: 732078 - DNA, 22 bp, Artificial Sequence
  chemically synthesized
agcctcccgagtagctgggact

SEQ ID NO: 732079 - DNA, 22 bp, Artificial Sequence
  chemically synthesized
ccgagtagctgggactacgggt

SEQ ID NO: 732080 - DNA, 22 bp, Artificial Sequence
  chemically synthesized
ggcgtggtggtgcacacccgta

SEQ ID NO: 732081 - DNA, 22 bp, Artificial Sequence
  chemically synthesized
gctgggcgtggtggtgcacacc

SEQ ID NO: 732082 - DNA, 22 bp, Artificial Sequence
  chemically synthesized
ggactacgggtgtgcaccacca

SEQ ID NO: 732083 - DNA, 22 bp, Artificial Sequence
  chemically synthesized
cgggtgtgcaccaccacgccca

SEQ ID NO: 732084 - DNA, 22 bp, Artificial Sequence
  chemically synthesized
aaaatacaaaaattagctgggc

SEQ ID NO: 732085 - DNA, 22 bp, Artificial Sequence
  chemically synthesized
ctaaaaatacaaaaattagctg

SEQ ID NO: 732086 - DNA, 22 bp, Artificial Sequence
  chemically synthesized
tactaaaaatacaaaaattagc

SEQ ID NO: 732087 - DNA, 22 bp, Artificial Sequence
  chemically synthesized
gtctctactaaaaatacaaaaa

SEQ ID NO: 732088 - DNA, 22 bp, Artificial Sequence
  chemically synthesized
atttttgtatttttagtagaga

SEQ ID NO: 732089 - DNA, 22 bp, Artificial Sequence
  chemically synthesized
ttgtatttttagtagagacgag

SEQ ID NO: 732090 - DNA, 22 bp, Artificial Sequence
  chemically synthesized
tgtatttttagtagagacgagt

SEQ ID NO: 732091 - DNA, 22 bp, Artificial Sequence
  chemically synthesized
gtatttttagtagagacgagtt

SEQ ID NO: 732092 - DNA, 22 bp, Artificial Sequence
  chemically synthesized
tatttttagtagagacgagttt

SEQ ID NO: 732093 - DNA, 22 bp, Artificial Sequence
  chemically synthesized
gccaacatggtgaaactcgtct

SEQ ID NO: 732094 - DNA, 22 bp, Artificial Sequence
  chemically synthesized
ttagtagagacgagtttcacca

SEQ ID NO: 732095 - DNA, 22 bp, Artificial Sequence
  chemically synthesized
tagtagagacgagtttcaccat

SEQ ID NO: 732096 - DNA, 22 bp, Artificial Sequence
  chemically synthesized
agtagagacgagtttcaccatg

SEQ ID NO: 732097 - DNA, 22 bp, Artificial Sequence
  chemically synthesized
gtagagacgagtttcaccatgt

SEQ ID NO: 732098 - DNA, 22 bp, Artificial Sequence
  chemically synthesized
gtgccatcctggccaacatggt

SEQ ID NO: 732099 - DNA, 22 bp, Artificial Sequence
  chemically synthesized
ggtgccatcctggccaacatgg

SEQ ID NO: 732100 - DNA, 22 bp, Artificial Sequence
  chemically synthesized
taggcttggtgccatcctggcc

SEQ ID NO: 732101 - DNA, 22 bp, Artificial Sequence
  chemically synthesized
caccatgttggccaggatggca

SEQ ID NO: 732102 - DNA, 22 bp, Artificial Sequence
  chemically synthesized
accatgttggccaggatggcac

SEQ ID NO: 732103 - DNA, 22 bp, Artificial Sequence
  chemically synthesized
gaaattataggcttggtgccat

SEQ ID NO: 732104 - DNA, 22 bp, Artificial Sequence
  chemically synthesized
agaaattataggcttggtgcca

SEQ ID NO: 732105 - DNA, 22 bp, Artificial Sequence
  chemically synthesized
tagaaattataggcttggtgcc

SEQ ID NO: 732106 - DNA, 22 bp, Artificial Sequence
  chemically synthesized
gccaggatggcaccaagcctat

SEQ ID NO: 732107 - DNA, 22 bp, Artificial Sequence
  chemically synthesized
aaatgaaacaggactttagaaa

SEQ ID NO: 732108 - DNA, 22 bp, Artificial Sequence
  chemically synthesized
caaatgaaacaggactttagaa

SEQ ID NO: 732109 - DNA, 22 bp, Artificial Sequence
  chemically synthesized
aaacttcaaatgaaacaggact

SEQ ID NO: 732110 - DNA, 22 bp, Artificial Sequence
  chemically synthesized
taatttctaaagtcctgtttca

SEQ ID NO: 732111 - DNA, 22 bp, Artificial Sequence
  chemically synthesized
cattcaaacttcaaatgaaaca

SEQ ID NO: 732112 - DNA, 22 bp, Artificial Sequence
  chemically synthesized
gcattcaaacttcaaatgaaac

SEQ ID NO: 732113 - DNA, 22 bp, Artificial Sequence
  chemically synthesized
tgcattcaaacttcaaatgaaa

SEQ ID NO: 732114 - DNA, 22 bp, Artificial Sequence
  chemically synthesized
ctaaagtcctgtttcatttgaa

SEQ ID NO: 732115 - DNA, 22 bp, Artificial Sequence
  chemically synthesized
ttgcattcaaacttcaaatgaa

SEQ ID NO: 732116 - DNA, 22 bp, Artificial Sequence
  chemically synthesized
taaagtcctgtttcatttgaag

SEQ ID NO: 732117 - DNA, 22 bp, Artificial Sequence
  chemically synthesized
aagtcctgtttcatttgaagtt

SEQ ID NO: 732118 - DNA, 22 bp, Artificial Sequence
  chemically synthesized
gtacttttgcattcaaacttca

SEQ ID NO: 732119 - DNA, 22 bp, Artificial Sequence
  chemically synthesized
tttcatttgaagtttgaatgca

SEQ ID NO: 732120 - DNA, 22 bp, Artificial Sequence
  chemically synthesized
catttgaagtttgaatgcaaaa

SEQ ID NO: 732121 - DNA, 22 bp, Artificial Sequence
  chemically synthesized
atttgaagtttgaatgcaaaag

SEQ ID NO: 732122 - DNA, 22 bp, Artificial Sequence
  chemically synthesized
cagtcattagtacttttgcatt

SEQ ID NO: 732123 - DNA, 22 bp, Artificial Sequence
  chemically synthesized
gaagtttgaatgcaaaagtact

SEQ ID NO: 732124 - DNA, 22 bp, Artificial Sequence
  chemically synthesized
aagtttgaatgcaaaagtacta

SEQ ID NO: 732125 - DNA, 22 bp, Artificial Sequence
  chemically synthesized
ccctgcagtcattagtactttt

SEQ ID NO: 732126 - DNA, 22 bp, Artificial Sequence
  chemically synthesized
gaatgcaaaagtactaatgact

SEQ ID NO: 732127 - DNA, 22 bp, Artificial Sequence
  chemically synthesized
aatgcaaaagtactaatgactg

SEQ ID NO: 732128 - DNA, 22 bp, Artificial Sequence
  chemically synthesized
agatatagaaaacatccctccc

SEQ ID NO: 732129 - DNA, 22 bp, Artificial Sequence
  chemically synthesized
aagatatagaaaacatccctcc

SEQ ID NO: 732130 - DNA, 22 bp, Artificial Sequence
  chemically synthesized
atgactgcaggggagggatgtt

SEQ ID NO: 732131 - DNA, 22 bp, Artificial Sequence
  chemically synthesized
ttaagatatagaaaacatccct

SEQ ID NO: 732132 - DNA, 22 bp, Artificial Sequence
  chemically synthesized
cttaagatatagaaaacatccc

SEQ ID NO: 732133 - DNA, 22 bp, Artificial Sequence
  chemically synthesized
caggggagggatgttttctata

SEQ ID NO: 732134 - DNA, 22 bp, Artificial Sequence
  chemically synthesized
cgtatttcttaagatatagaaa

SEQ ID NO: 732135 - DNA, 22 bp, Artificial Sequence
  chemically synthesized
acgtatttcttaagatatagaa

SEQ ID NO: 732136 - DNA, 22 bp, Artificial Sequence
  chemically synthesized
tttacgtatttcttaagatata

SEQ ID NO: 732137 - DNA, 22 bp, Artificial Sequence
  chemically synthesized
tctatatcttaagaaatacgta

SEQ ID NO: 732138 - DNA, 22 bp, Artificial Sequence
  chemically synthesized
ctatatcttaagaaatacgtaa

SEQ ID NO: 732139 - DNA, 22 bp, Artificial Sequence
  chemically synthesized
tatatcttaagaaatacgtaaa

SEQ ID NO: 732140 - DNA, 22 bp, Artificial Sequence
  chemically synthesized
tgccacatattatttacgtatt

SEQ ID NO: 732141 - DNA, 22 bp, Artificial Sequence
  chemically synthesized
tatcttaagaaatacgtaaata

SEQ ID NO: 732142 - DNA, 22 bp, Artificial Sequence
  chemically synthesized
aagaaatacgtaaataatatgt

SEQ ID NO: 732143 - DNA, 22 bp, Artificial Sequence
  chemically synthesized
agaaatacgtaaataatatgtg

SEQ ID NO: 732144 - DNA, 22 bp, Artificial Sequence
  chemically synthesized
tcagaagctatgccacatatta

SEQ ID NO: 732145 - DNA, 22 bp, Artificial Sequence
  chemically synthesized
cagtactatcagaagctatgcc

SEQ ID NO: 732146 - DNA, 22 bp, Artificial Sequence
  chemically synthesized
tattgcagtactatcagaagct

SEQ ID NO: 732147 - DNA, 22 bp, Artificial Sequence
  chemically synthesized
tagatagttatattgcagtact

SEQ ID NO: 732148 - DNA, 22 bp, Artificial Sequence
  chemically synthesized
gttatagatagttatattgcag

SEQ ID NO: 732149 - DNA, 22 bp, Artificial Sequence
  chemically synthesized
ctgatagtactgcaatataact

SEQ ID NO: 732150 - DNA, 22 bp, Artificial Sequence
  chemically synthesized
tgatagtactgcaatataacta

SEQ ID NO: 732151 - DNA, 22 bp, Artificial Sequence
  chemically synthesized
atagtactgcaatataactatc

SEQ ID NO: 732152 - DNA, 22 bp, Artificial Sequence
  chemically synthesized
tatatattagttatagatagtt

SEQ ID NO: 732153 - DNA, 22 bp, Artificial Sequence
  chemically synthesized
ctgtatatattagttatagata

SEQ ID NO: 732154 - DNA, 22 bp, Artificial Sequence
  chemically synthesized
gctgtatatattagttatagat

SEQ ID NO: 732155 - DNA, 22 bp, Artificial Sequence
  chemically synthesized
caatataactatctataactaa

SEQ ID NO: 732156 - DNA, 22 bp, Artificial Sequence
  chemically synthesized
tctataactaatatatacagca

SEQ ID NO: 732157 - DNA, 22 bp, Artificial Sequence
  chemically synthesized
taactaatatatacagcaaata

SEQ ID NO: 732158 - DNA, 22 bp, Artificial Sequence
  chemically synthesized
atatatacagcaaatatattat

SEQ ID NO: 732159 - DNA, 22 bp, Artificial Sequence
  chemically synthesized
caaaaaaaaaaaaaagaagtga

SEQ ID NO: 732160 - DNA, 22 bp, Artificial Sequence
  chemically synthesized
tctccaaaaaaaaaaaaaagaa

SEQ ID NO: 732161 - DNA, 22 bp, Artificial Sequence
  chemically synthesized
tcacttcttttttttttttttg

SEQ ID NO: 732162 - DNA, 22 bp, Artificial Sequence
  chemically synthesized
cttttttttttttttggagaca

SEQ ID NO: 732163 - DNA, 22 bp, Artificial Sequence
  chemically synthesized
ttttttttttttttggagacag

SEQ ID NO: 732164 - DNA, 22 bp, Artificial Sequence
  chemically synthesized
ttttttttttttggagacagtt

SEQ ID NO: 732165 - DNA, 22 bp, Artificial Sequence
  chemically synthesized
tttttttttttggagacagttt

SEQ ID NO: 732166 - DNA, 22 bp, Artificial Sequence
  chemically synthesized
ttttttttttggagacagtttc

SEQ ID NO: 732167 - DNA, 22 bp, Artificial Sequence
  chemically synthesized
gacaagaatagtgaaactgtct

SEQ ID NO: 732168 - DNA, 22 bp, Artificial Sequence
  chemically synthesized
tttttttttggagacagtttca

SEQ ID NO: 732169 - DNA, 22 bp, Artificial Sequence
  chemically synthesized
ttttttttggagacagtttcac

SEQ ID NO: 732170 - DNA, 22 bp, Artificial Sequence
  chemically synthesized
tttttttggagacagtttcact

SEQ ID NO: 732171 - DNA, 22 bp, Artificial Sequence
  chemically synthesized
ttttttggagacagtttcacta

SEQ ID NO: 732172 - DNA, 22 bp, Artificial Sequence
  chemically synthesized
tttttggagacagtttcactat

SEQ ID NO: 732173 - DNA, 22 bp, Artificial Sequence
  chemically synthesized
gcctggacaagaatagtgaaac

SEQ ID NO: 732174 - DNA, 22 bp, Artificial Sequence
  chemically synthesized
ttttggagacagtttcactatt

SEQ ID NO: 732175 - DNA, 22 bp, Artificial Sequence
  chemically synthesized
tttggagacagtttcactattc

SEQ ID NO: 732176 - DNA, 22 bp, Artificial Sequence
  chemically synthesized
tagcctggacaagaatagtgaa

SEQ ID NO: 732177 - DNA, 22 bp, Artificial Sequence
  chemically synthesized
ttggagacagtttcactattct

SEQ ID NO: 732178 - DNA, 22 bp, Artificial Sequence
  chemically synthesized
tggagacagtttcactattctt

SEQ ID NO: 732179 - DNA, 22 bp, Artificial Sequence
  chemically synthesized
ggagacagtttcactattcttg

SEQ ID NO: 732180 - DNA, 22 bp, Artificial Sequence
  chemically synthesized
gagacagtttcactattcttgt

SEQ ID NO: 732181 - DNA, 22 bp, Artificial Sequence
  chemically synthesized
cactctagcctggacaagaata

SEQ ID NO: 732182 - DNA, 22 bp, Artificial Sequence
  chemically synthesized
cactattcttgtccaggctaga

SEQ ID NO: 732183 - DNA, 22 bp, Artificial Sequence
  chemically synthesized
actattcttgtccaggctagag

SEQ ID NO: 732184 - DNA, 22 bp, Artificial Sequence
  chemically synthesized
ttcttgtccaggctagagtgca

SEQ ID NO: 732185 - DNA, 22 bp, Artificial Sequence
  chemically synthesized
ttgtccaggctagagtgcaatg

SEQ ID NO: 732186 - DNA, 22 bp, Artificial Sequence
  chemically synthesized
gtccaggctagagtgcaatggt

SEQ ID NO: 732187 - DNA, 22 bp, Artificial Sequence
  chemically synthesized
tccaggctagagtgcaatggtg

SEQ ID NO: 732188 - DNA, 22 bp, Artificial Sequence
  chemically synthesized
cagtgagccaagatcccaccat

SEQ ID NO: 732189 - DNA, 22 bp, Artificial Sequence
  chemically synthesized
gagtgcaatggtgggatcttgg

SEQ ID NO: 732190 - DNA, 22 bp, Artificial Sequence
  chemically synthesized
aggaggcagaggttgcagtgag

SEQ ID NO: 732191 - DNA, 22 bp, Artificial Sequence
  chemically synthesized
aactcaggaggcagaggttgca

SEQ ID NO: 732192 - DNA, 22 bp, Artificial Sequence
  chemically synthesized
gaactcaggaggcagaggttgc

SEQ ID NO: 732193 - DNA, 22 bp, Artificial Sequence
  chemically synthesized
ggctcactgcaacctctgcctc

SEQ ID NO: 732194 - DNA, 22 bp, Artificial Sequence
  chemically synthesized
gctcactgcaacctctgcctcc

SEQ ID NO: 732195 - DNA, 22 bp, Artificial Sequence
  chemically synthesized
actgcaacctctgcctcctgag

SEQ ID NO: 732196 - DNA, 22 bp, Artificial Sequence
  chemically synthesized
caacctctgcctcctgagttca

SEQ ID NO: 732197 - DNA, 22 bp, Artificial Sequence
  chemically synthesized
aggcaggagaatcacttgaact

SEQ ID NO: 732198 - DNA, 22 bp, Artificial Sequence
  chemically synthesized
tgcctcctgagttcaagtgatt

SEQ ID NO: 732199 - DNA, 22 bp, Artificial Sequence
  chemically synthesized
cctcctgagttcaagtgattct

SEQ ID NO: 732200 - DNA, 22 bp, Artificial Sequence
  chemically synthesized
ctgagttcaagtgattctcctg

SEQ ID NO: 732201 - DNA, 22 bp, Artificial Sequence
  chemically synthesized
aggaggctgaggcaggagaatc

SEQ ID NO: 732202 - DNA, 22 bp, Artificial Sequence
  chemically synthesized
agttcaagtgattctcctgcct

SEQ ID NO: 732203 - DNA, 22 bp, Artificial Sequence
  chemically synthesized
ctcaggaggctgaggcaggaga

SEQ ID NO: 732204 - DNA, 22 bp, Artificial Sequence
  chemically synthesized
gctactcaggaggctgaggcag

SEQ ID NO: 732205 - DNA, 22 bp, Artificial Sequence
  chemically synthesized
aagtgattctcctgcctcagcc

SEQ ID NO: 732206 - DNA, 22 bp, Artificial Sequence
  chemically synthesized
taatcctagctactcaggaggc

SEQ ID NO: 732207 - DNA, 22 bp, Artificial Sequence
  chemically synthesized
tcctgcctcagcctcctgagta

SEQ ID NO: 732208 - DNA, 22 bp, Artificial Sequence
  chemically synthesized
ctgcctcagcctcctgagtagc

SEQ ID NO: 732209 - DNA, 22 bp, Artificial Sequence
  chemically synthesized
cctcagcctcctgagtagctag

SEQ ID NO: 732210 - DNA, 22 bp, Artificial Sequence
  chemically synthesized
agcctcctgagtagctaggatt

SEQ ID NO: 732211 - DNA, 22 bp, Artificial Sequence
  chemically synthesized
ctgagtagctaggattataggt

SEQ ID NO: 732212 - DNA, 22 bp, Artificial Sequence
  chemically synthesized
agtagctaggattataggtacc

SEQ ID NO: 732213 - DNA, 22 bp, Artificial Sequence
  chemically synthesized
gccgggcatggtggtgggtacc

SEQ ID NO: 732214 - DNA, 22 bp, Artificial Sequence
  chemically synthesized
ggattataggtacccaccacca

SEQ ID NO: 732215 - DNA, 22 bp, Artificial Sequence
  chemically synthesized
taggtacccaccaccatgcccg

SEQ ID NO: 732216 - DNA, 22 bp, Artificial Sequence
  chemically synthesized
aaaatacaaaaaattagccggg

SEQ ID NO: 732217 - DNA, 22 bp, Artificial Sequence
  chemically synthesized
ctaaaaatacaaaaaattagcc

SEQ ID NO: 732218 - DNA, 22 bp, Artificial Sequence
  chemically synthesized
tactaaaaatacaaaaaattag

SEQ ID NO: 732219 - DNA, 22 bp, Artificial Sequence
  chemically synthesized
attttttgtatttttagtagag

SEQ ID NO: 732220 - DNA, 22 bp, Artificial Sequence
  chemically synthesized
tttgtatttttagtagagacgg

SEQ ID NO: 732221 - DNA, 22 bp, Artificial Sequence
  chemically synthesized
ttgtatttttagtagagacggg

SEQ ID NO: 732222 - DNA, 22 bp, Artificial Sequence
  chemically synthesized
tgtatttttagtagagacgggg

SEQ ID NO: 732223 - DNA, 22 bp, Artificial Sequence
  chemically synthesized
gtatttttagtagagacggggt

SEQ ID NO: 732224 - DNA, 22 bp, Artificial Sequence
  chemically synthesized
tatttttagtagagacggggtt

SEQ ID NO: 732225 - DNA, 22 bp, Artificial Sequence
  chemically synthesized
gccaacatggtggaaccccgtc

SEQ ID NO: 732226 - DNA, 22 bp, Artificial Sequence
  chemically synthesized
ttagtagagacggggttccacc

SEQ ID NO: 732227 - DNA, 22 bp, Artificial Sequence
  chemically synthesized
tagtagagacggggttccacca

SEQ ID NO: 732228 - DNA, 22 bp, Artificial Sequence
  chemically synthesized
agtagagacggggttccaccat

SEQ ID NO: 732229 - DNA, 22 bp, Artificial Sequence
  chemically synthesized
gtagagacggggttccaccatg

SEQ ID NO: 732230 - DNA, 22 bp, Artificial Sequence
  chemically synthesized
gagaccagcctggccaacatgg

SEQ ID NO: 732231 - DNA, 22 bp, Artificial Sequence
  chemically synthesized
caccatgttggccaggctggtc

SEQ ID NO: 732232 - DNA, 22 bp, Artificial Sequence
  chemically synthesized
aggtcaggagttcgagaccagc

SEQ ID NO: 732233 - DNA, 22 bp, Artificial Sequence
  chemically synthesized
gccaggctggtctcgaactcct

SEQ ID NO: 732234 - DNA, 22 bp, Artificial Sequence
  chemically synthesized
gtctcgaactcctgacctcagg

SEQ ID NO: 732235 - DNA, 22 bp, Artificial Sequence
  chemically synthesized
gaactcctgacctcaggtgatc

SEQ ID NO: 732236 - DNA, 22 bp, Artificial Sequence
  chemically synthesized
ggaggccacagtgggtggatca

SEQ ID NO: 732237 - DNA, 22 bp, Artificial Sequence
  chemically synthesized
ctgacctcaggtgatccaccca

SEQ ID NO: 732238 - DNA, 22 bp, Artificial Sequence
  chemically synthesized
gggaggccacagtgggtggatc

SEQ ID NO: 732239 - DNA, 22 bp, Artificial Sequence
  chemically synthesized
tgggaggccacagtgggtggat

SEQ ID NO: 732240 - DNA, 22 bp, Artificial Sequence
  chemically synthesized
acctcaggtgatccacccactg

SEQ ID NO: 732241 - DNA, 22 bp, Artificial Sequence
  chemically synthesized
aggtgatccacccactgtggcc

SEQ ID NO: 732242 - DNA, 22 bp, Artificial Sequence
  chemically synthesized
taatcccagcactttgggaggc

SEQ ID NO: 732243 - DNA, 22 bp, Artificial Sequence
  chemically synthesized
acgcctgtaatcccagcacttt

SEQ ID NO: 732244 - DNA, 22 bp, Artificial Sequence
  chemically synthesized
tggcctcccaaagtgctgggat

SEQ ID NO: 732245 - DNA, 22 bp, Artificial Sequence
  chemically synthesized
ccaaagtgctgggattacaggc

SEQ ID NO: 732246 - DNA, 22 bp, Artificial Sequence
  chemically synthesized
ggattacaggcgtgagccaccg

SEQ ID NO: 732247 - DNA, 22 bp, Artificial Sequence
  chemically synthesized
caggcgtgagccaccgtgcctg

SEQ ID NO: 732248 - DNA, 22 bp, Artificial Sequence
  chemically synthesized
cagaaacatgcagagtaataat

SEQ ID NO: 732249 - DNA, 22 bp, Artificial Sequence
  chemically synthesized
tgcagaaacatgcagagtaata

SEQ ID NO: 732250 - DNA, 22 bp, Artificial Sequence
  chemically synthesized
gccctattattactctgcatgt

SEQ ID NO: 732251 - DNA, 22 bp, Artificial Sequence
  chemically synthesized
cagatctctgcagaaacatgca

SEQ ID NO: 732252 - DNA, 22 bp, Artificial Sequence
  chemically synthesized
tacagatctctgcagaaacatg

SEQ ID NO: 732253 - DNA, 22 bp, Artificial Sequence
  chemically synthesized
ttattactctgcatgtttctgc

SEQ ID NO: 732254 - DNA, 22 bp, Artificial Sequence
  chemically synthesized
ctacagatctctgcagaaacat

SEQ ID NO: 732255 - DNA, 22 bp, Artificial Sequence
  chemically synthesized
tctacagatctctgcagaaaca

SEQ ID NO: 732256 - DNA, 22 bp, Artificial Sequence
  chemically synthesized
ttactctgcatgtttctgcaga

SEQ ID NO: 732257 - DNA, 22 bp, Artificial Sequence
  chemically synthesized
attttctacagatctctgcaga

SEQ ID NO: 732258 - DNA, 22 bp, Artificial Sequence
  chemically synthesized
ctctgcatgtttctgcagagat

SEQ ID NO: 732259 - DNA, 22 bp, Artificial Sequence
  chemically synthesized
aattttctacagatctctgcag

SEQ ID NO: 732260 - DNA, 22 bp, Artificial Sequence
  chemically synthesized
taattttctacagatctctgca

SEQ ID NO: 732261 - DNA, 22 bp, Artificial Sequence
  chemically synthesized
ttaattttctacagatctctgc

SEQ ID NO: 732262 - DNA, 22 bp, Artificial Sequence
  chemically synthesized
tgcatgtttctgcagagatctg

SEQ ID NO: 732263 - DNA, 22 bp, Artificial Sequence
  chemically synthesized
tttaattttctacagatctctg

SEQ ID NO: 732264 - DNA, 22 bp, Artificial Sequence
  chemically synthesized
ttttaattttctacagatctct

SEQ ID NO: 732265 - DNA, 22 bp, Artificial Sequence
  chemically synthesized
catgtttctgcagagatctgta

SEQ ID NO: 732266 - DNA, 22 bp, Artificial Sequence
  chemically synthesized
tttttaattttctacagatctc

SEQ ID NO: 732267 - DNA, 22 bp, Artificial Sequence
  chemically synthesized
ttttttaattttctacagatct

SEQ ID NO: 732268 - DNA, 22 bp, Artificial Sequence
  chemically synthesized
tttttttaattttctacagatc

SEQ ID NO: 732269 - DNA, 22 bp, Artificial Sequence
  chemically synthesized
ttttttttaattttctacagat

SEQ ID NO: 732270 - DNA, 22 bp, Artificial Sequence
  chemically synthesized
tttttttttaattttctacaga

SEQ ID NO: 732271 - DNA, 22 bp, Artificial Sequence
  chemically synthesized
ttttttttttaattttctacag

SEQ ID NO: 732272 - DNA, 22 bp, Artificial Sequence
  chemically synthesized
tttttttttttaattttctaca

SEQ ID NO: 732273 - DNA, 22 bp, Artificial Sequence
  chemically synthesized
ctgcagagatctgtagaaaatt

SEQ ID NO: 732274 - DNA, 22 bp, Artificial Sequence
  chemically synthesized
ttttttttttttaattttctac

SEQ ID NO: 732275 - DNA, 22 bp, Artificial Sequence
  chemically synthesized
tgcagagatctgtagaaaatta

SEQ ID NO: 732276 - DNA, 22 bp, Artificial Sequence
  chemically synthesized
tttttttttttttaattttcta

SEQ ID NO: 732277 - DNA, 22 bp, Artificial Sequence
  chemically synthesized
ttttttttttttttaattttct

SEQ ID NO: 732278 - DNA, 22 bp, Artificial Sequence
  chemically synthesized
cagagatctgtagaaaattaaa

SEQ ID NO: 732279 - DNA, 22 bp, Artificial Sequence
  chemically synthesized
ttttttttttttttttaatttt

SEQ ID NO: 732280 - DNA, 22 bp, Artificial Sequence
  chemically synthesized
tagaaaattaaaaaaaaaaaaa

SEQ ID NO: 732281 - DNA, 22 bp, Artificial Sequence
  chemically synthesized
taagccagcattcttttttttt

SEQ ID NO: 732282 - DNA, 22 bp, Artificial Sequence
  chemically synthesized
ataagccagcattctttttttt

SEQ ID NO: 732283 - DNA, 22 bp, Artificial Sequence
  chemically synthesized
aaaaaaaaaaaaaaagaatgct

SEQ ID NO: 732284 - DNA, 22 bp, Artificial Sequence
  chemically synthesized
catttataagccagcattcttt

SEQ ID NO: 732285 - DNA, 22 bp, Artificial Sequence
  chemically synthesized
ctccatttataagccagcattc

SEQ ID NO: 732286 - DNA, 22 bp, Artificial Sequence
  chemically synthesized
cagaaaatctactccatttata

SEQ ID NO: 732287 - DNA, 22 bp, Artificial Sequence
  chemically synthesized
ccagaaaatctactccatttat

SEQ ID NO: 732288 - DNA, 22 bp, Artificial Sequence
  chemically synthesized
tccagaaaatctactccattta

SEQ ID NO: 732289 - DNA, 22 bp, Artificial Sequence
  chemically synthesized
attttccagaaaatctactcca

SEQ ID NO: 732290 - DNA, 22 bp, Artificial Sequence
  chemically synthesized
gcttataaatggagtagatttt

SEQ ID NO: 732291 - DNA, 22 bp, Artificial Sequence
  chemically synthesized
ataaatggagtagattttctgg

SEQ ID NO: 732292 - DNA, 22 bp, Artificial Sequence
  chemically synthesized
taaatggagtagattttctgga

SEQ ID NO: 732293 - DNA, 22 bp, Artificial Sequence
  chemically synthesized
aaacattcattttccagaaaat

SEQ ID NO: 732294 - DNA, 22 bp, Artificial Sequence
  chemically synthesized
caacggactaaaacattcattt

SEQ ID NO: 732295 - DNA, 22 bp, Artificial Sequence
  chemically synthesized
tctggaaaatgaatgttttagt

SEQ ID NO: 732296 - DNA, 22 bp, Artificial Sequence
  chemically synthesized
ctggaaaatgaatgttttagtc

SEQ ID NO: 732297 - DNA, 22 bp, Artificial Sequence
  chemically synthesized
tggaaaatgaatgttttagtcc

SEQ ID NO: 732298 - DNA, 22 bp, Artificial Sequence
  chemically synthesized
tagcattccaacggactaaaac

SEQ ID NO: 732299 - DNA, 22 bp, Artificial Sequence
  chemically synthesized
gaaaatgaatgttttagtccgt

SEQ ID NO: 732300 - DNA, 22 bp, Artificial Sequence
  chemically synthesized
ttatagcattccaacggactaa

SEQ ID NO: 732301 - DNA, 22 bp, Artificial Sequence
  chemically synthesized
gttatagcattccaacggacta

SEQ ID NO: 732302 - DNA, 22 bp, Artificial Sequence
  chemically synthesized
tgttatagcattccaacggact

SEQ ID NO: 732303 - DNA, 22 bp, Artificial Sequence
  chemically synthesized
tgatattttgttatagcattcc

SEQ ID NO: 732304 - DNA, 22 bp, Artificial Sequence
  chemically synthesized
atgatattttgttatagcattc

SEQ ID NO: 732305 - DNA, 22 bp, Artificial Sequence
  chemically synthesized
tagtccgttggaatgctataac

SEQ ID NO: 732306 - DNA, 22 bp, Artificial Sequence
  chemically synthesized
agtccgttggaatgctataaca

SEQ ID NO: 732307 - DNA, 22 bp, Artificial Sequence
  chemically synthesized
gtccgttggaatgctataacaa

SEQ ID NO: 732308 - DNA, 22 bp, Artificial Sequence
  chemically synthesized
gaatgctataacaaaatatcat

SEQ ID NO: 732309 - DNA, 22 bp, Artificial Sequence
  chemically synthesized
taagccacccagtttatgatat

SEQ ID NO: 732310 - DNA, 22 bp, Artificial Sequence
  chemically synthesized
tctataagccacccagtttatg

SEQ ID NO: 732311 - DNA, 22 bp, Artificial Sequence
  chemically synthesized
taacaaaatatcataaactggg

SEQ ID NO: 732312 - DNA, 22 bp, Artificial Sequence
  chemically synthesized
gttgtctataagccacccagtt

SEQ ID NO: 732313 - DNA, 22 bp, Artificial Sequence
  chemically synthesized
ggttgtctataagccacccagt

SEQ ID NO: 732314 - DNA, 22 bp, Artificial Sequence
  chemically synthesized
tggttgtctataagccacccag

SEQ ID NO: 732315 - DNA, 22 bp, Artificial Sequence
  chemically synthesized
tgagaaaaaaactttggttgtc

SEQ ID NO: 732316 - DNA, 22 bp, Artificial Sequence
  chemically synthesized
ggtggcttatagacaaccaaag

SEQ ID NO: 732317 - DNA, 22 bp, Artificial Sequence
  chemically synthesized
agaattgtgagaaaaaaacttt

SEQ ID NO: 732318 - DNA, 22 bp, Artificial Sequence
  chemically synthesized
cagaattgtgagaaaaaaactt

SEQ ID NO: 732319 - DNA, 22 bp, Artificial Sequence
  chemically synthesized
atagacaaccaaagtttttttc

SEQ ID NO: 732320 - DNA, 22 bp, Artificial Sequence
  chemically synthesized
tagacaaccaaagtttttttct

SEQ ID NO: 732321 - DNA, 22 bp, Artificial Sequence
  chemically synthesized
gccttcagaattgtgagaaaaa

SEQ ID NO: 732322 - DNA, 22 bp, Artificial Sequence
  chemically synthesized
ctagccttcagaattgtgagaa

SEQ ID NO: 732323 - DNA, 22 bp, Artificial Sequence
  chemically synthesized
cctagccttcagaattgtgaga

SEQ ID NO: 732324 - DNA, 22 bp, Artificial Sequence
  chemically synthesized
ttttctcacaattctgaaggct

SEQ ID NO: 732325 - DNA, 22 bp, Artificial Sequence
  chemically synthesized
tttctcacaattctgaaggcta

SEQ ID NO: 732326 - DNA, 22 bp, Artificial Sequence
  chemically synthesized
ttctcacaattctgaaggctag

SEQ ID NO: 732327 - DNA, 22 bp, Artificial Sequence
  chemically synthesized
atatcagacttcctagccttca

SEQ ID NO: 732328 - DNA, 22 bp, Artificial Sequence
  chemically synthesized
tctcacaattctgaaggctagg

SEQ ID NO: 732329 - DNA, 22 bp, Artificial Sequence
  chemically synthesized
gatatcagacttcctagccttc

SEQ ID NO: 732330 - DNA, 22 bp, Artificial Sequence
  chemically synthesized
ctcacaattctgaaggctagga

SEQ ID NO: 732331 - DNA, 22 bp, Artificial Sequence
  chemically synthesized
tcacaattctgaaggctaggaa

SEQ ID NO: 732332 - DNA, 22 bp, Artificial Sequence
  chemically synthesized
acaattctgaaggctaggaagt

SEQ ID NO: 732333 - DNA, 22 bp, Artificial Sequence
  chemically synthesized
ccagcgccttgatatcagactt

SEQ ID NO: 732334 - DNA, 22 bp, Artificial Sequence
  chemically synthesized
tgaaggctaggaagtctgatat

SEQ ID NO: 732335 - DNA, 22 bp, Artificial Sequence
  chemically synthesized
aaggctaggaagtctgatatca

SEQ ID NO: 732336 - DNA, 22 bp, Artificial Sequence
  chemically synthesized
aatctgccagcgccttgatatc

SEQ ID NO: 732337 - DNA, 22 bp, Artificial Sequence
  chemically synthesized
ggaagtctgatatcaaggcgct

SEQ ID NO: 732338 - DNA, 22 bp, Artificial Sequence
  chemically synthesized
accaaacactgaatctgccagc

SEQ ID NO: 732339 - DNA, 22 bp, Artificial Sequence
  chemically synthesized
caccaaacactgaatctgccag

SEQ ID NO: 732340 - DNA, 22 bp, Artificial Sequence
  chemically synthesized
atatcaaggcgctggcagattc

SEQ ID NO: 732341 - DNA, 22 bp, Artificial Sequence
  chemically synthesized
gcagattcagtgtttggtgaag

SEQ ID NO: 732342 - DNA, 22 bp, Artificial Sequence
  chemically synthesized
tgaacaagaaagcaggccttca

SEQ ID NO: 732343 - DNA, 22 bp, Artificial Sequence
  chemically synthesized
agtgtttggtgaaggcctgctt

SEQ ID NO: 732344 - DNA, 22 bp, Artificial Sequence
  chemically synthesized
tctatgaacaagaaagcaggcc

SEQ ID NO: 732345 - DNA, 22 bp, Artificial Sequence
  chemically synthesized
ggtgaaggcctgctttcttgtt

SEQ ID NO: 732346 - DNA, 22 bp, Artificial Sequence
  chemically synthesized
gtgaaggcctgctttcttgttc

SEQ ID NO: 732347 - DNA, 22 bp, Artificial Sequence
  chemically synthesized
ctttcttgttcatagatagcac

SEQ ID NO: 732348 - DNA, 22 bp, Artificial Sequence
  chemically synthesized
tcttgttcatagatagcacctt

SEQ ID NO: 732349 - DNA, 22 bp, Artificial Sequence
  chemically synthesized
cttgttcatagatagcaccttc

SEQ ID NO: 732350 - DNA, 22 bp, Artificial Sequence
  chemically synthesized
ttgttcatagatagcaccttct

SEQ ID NO: 732351 - DNA, 22 bp, Artificial Sequence
  chemically synthesized
ccatgagaacacaagaaggtgc

SEQ ID NO: 732352 - DNA, 22 bp, Artificial Sequence
  chemically synthesized
gttcatagatagcaccttcttg

SEQ ID NO: 732353 - DNA, 22 bp, Artificial Sequence
  chemically synthesized
gccatgagaacacaagaaggtg

SEQ ID NO: 732354 - DNA, 22 bp, Artificial Sequence
  chemically synthesized
ttcatagatagcaccttcttgt

SEQ ID NO: 732355 - DNA, 22 bp, Artificial Sequence
  chemically synthesized
tgccatgagaacacaagaaggt

SEQ ID NO: 732356 - DNA, 22 bp, Artificial Sequence
  chemically synthesized
ttgccatgagaacacaagaagg

SEQ ID NO: 732357 - DNA, 22 bp, Artificial Sequence
  chemically synthesized
tttgccatgagaacacaagaag

SEQ ID NO: 732358 - DNA, 22 bp, Artificial Sequence
  chemically synthesized
atagatagcaccttcttgtgtt

SEQ ID NO: 732359 - DNA, 22 bp, Artificial Sequence
  chemically synthesized
ccctttttgccatgagaacaca

SEQ ID NO: 732360 - DNA, 22 bp, Artificial Sequence
  chemically synthesized
gccctttttgccatgagaacac

SEQ ID NO: 732361 - DNA, 22 bp, Artificial Sequence
  chemically synthesized
tgccctttttgccatgagaaca

SEQ ID NO: 732362 - DNA, 22 bp, Artificial Sequence
  chemically synthesized
ctttgccctttttgccatgaga

SEQ ID NO: 732363 - DNA, 22 bp, Artificial Sequence
  chemically synthesized
cttgtgttctcatggcaaaaag

SEQ ID NO: 732364 - DNA, 22 bp, Artificial Sequence
  chemically synthesized
ttgtgttctcatggcaaaaagg

SEQ ID NO: 732365 - DNA, 22 bp, Artificial Sequence
  chemically synthesized
gtgttctcatggcaaaaagggc

SEQ ID NO: 732366 - DNA, 22 bp, Artificial Sequence
  chemically synthesized
tgttctcatggcaaaaagggca

SEQ ID NO: 732367 - DNA, 22 bp, Artificial Sequence
  chemically synthesized
tcatggcaaaaagggcaaagca

SEQ ID NO: 732368 - DNA, 22 bp, Artificial Sequence
  chemically synthesized
atggcaaaaagggcaaagcagc

SEQ ID NO: 732369 - DNA, 22 bp, Artificial Sequence
  chemically synthesized
taaaagagacccagagagctgc

SEQ ID NO: 732370 - DNA, 22 bp, Artificial Sequence
  chemically synthesized
ataaaagagacccagagagctg

SEQ ID NO: 732371 - DNA, 22 bp, Artificial Sequence
  chemically synthesized
gaacccttataaaagagaccca

SEQ ID NO: 732372 - DNA, 22 bp, Artificial Sequence
  chemically synthesized
tctgggtctcttttataagggt

SEQ ID NO: 732373 - DNA, 22 bp, Artificial Sequence
  chemically synthesized
tgggtctcttttataagggttc

SEQ ID NO: 732374 - DNA, 22 bp, Artificial Sequence
  chemically synthesized
ggtctcttttataagggttcta

SEQ ID NO: 732375 - DNA, 22 bp, Artificial Sequence
  chemically synthesized
ttttataagggttctaatctca

SEQ ID NO: 732376 - DNA, 22 bp, Artificial Sequence
  chemically synthesized
ttataagggttctaatctcatt

SEQ ID NO: 732377 - DNA, 22 bp, Artificial Sequence
  chemically synthesized
tataagggttctaatctcattc

SEQ ID NO: 732378 - DNA, 22 bp, Artificial Sequence
  chemically synthesized
ataagggttctaatctcattca

SEQ ID NO: 732379 - DNA, 22 bp, Artificial Sequence
  chemically synthesized
taagggttctaatctcattcat

SEQ ID NO: 732380 - DNA, 22 bp, Artificial Sequence
  chemically synthesized
taatctcattcatgtgggctct

SEQ ID NO: 732381 - DNA, 22 bp, Artificial Sequence
  chemically synthesized
gatcatgagggcagagcccaca

SEQ ID NO: 732382 - DNA, 22 bp, Artificial Sequence
  chemically synthesized
atctcattcatgtgggctctgc

SEQ ID NO: 732383 - DNA, 22 bp, Artificial Sequence
  chemically synthesized
attcatgtgggctctgccctca

SEQ ID NO: 732384 - DNA, 22 bp, Artificial Sequence
  chemically synthesized
atgtgggctctgccctcatgat

SEQ ID NO: 732385 - DNA, 22 bp, Artificial Sequence
  chemically synthesized
ggaggtgattagatcatgaggg

SEQ ID NO: 732386 - DNA, 22 bp, Artificial Sequence
  chemically synthesized
gggaggtgattagatcatgagg

SEQ ID NO: 732387 - DNA, 22 bp, Artificial Sequence
  chemically synthesized
tgccctcatgatctaatcacct

SEQ ID NO: 732388 - DNA, 22 bp, Artificial Sequence
  chemically synthesized
ccctcatgatctaatcacctcc

SEQ ID NO: 732389 - DNA, 22 bp, Artificial Sequence
  chemically synthesized
ggaggtaggccccttgggaggt

SEQ ID NO: 732390 - DNA, 22 bp, Artificial Sequence
  chemically synthesized
atgatctaatcacctcccaagg

SEQ ID NO: 732391 - DNA, 22 bp, Artificial Sequence
  chemically synthesized
atcacctcccaaggggcctacc

SEQ ID NO: 732392 - DNA, 22 bp, Artificial Sequence
  chemically synthesized
ccaaggggcctacctcctaata

SEQ ID NO: 732393 - DNA, 22 bp, Artificial Sequence
  chemically synthesized
catatatgatggtattaggagg

SEQ ID NO: 732394 - DNA, 22 bp, Artificial Sequence
  chemically synthesized
attccatatatgatggtattag

SEQ ID NO: 732395 - DNA, 22 bp, Artificial Sequence
  chemically synthesized
cctcctaataccatcatatatg

SEQ ID NO: 732396 - DNA, 22 bp, Artificial Sequence
  chemically synthesized
ctaataccatcatatatggaat

SEQ ID NO: 732397 - DNA, 22 bp, Artificial Sequence
  chemically synthesized
ataccatcatatatggaattag

SEQ ID NO: 732398 - DNA, 22 bp, Artificial Sequence
  chemically synthesized
atatgtggaaacctaattccat

SEQ ID NO: 732399 - DNA, 22 bp, Artificial Sequence
  chemically synthesized
cccaaaattcatatgtggaaac

SEQ ID NO: 732400 - DNA, 22 bp, Artificial Sequence
  chemically synthesized
tgtctccccaaaattcatatgt

SEQ ID NO: 732401 - DNA, 22 bp, Artificial Sequence
  chemically synthesized
gtgtctccccaaaattcatatg

SEQ ID NO: 732402 - DNA, 22 bp, Artificial Sequence
  chemically synthesized
ggtttccacatatgaattttgg

SEQ ID NO: 732403 - DNA, 22 bp, Artificial Sequence
  chemically synthesized
aatatttgtgtctccccaaaat

SEQ ID NO: 732404 - DNA, 22 bp, Artificial Sequence
  chemically synthesized
gaatatttgtgtctccccaaaa

SEQ ID NO: 732405 - DNA, 22 bp, Artificial Sequence
  chemically synthesized
ccacatatgaattttggggaga

SEQ ID NO: 732406 - DNA, 22 bp, Artificial Sequence
  chemically synthesized
cacatatgaattttggggagac

SEQ ID NO: 732407 - DNA, 22 bp, Artificial Sequence
  chemically synthesized
tggcttgaatatttgtgtctcc

SEQ ID NO: 732408 - DNA, 22 bp, Artificial Sequence
  chemically synthesized
ctgtggcttgaatatttgtgtc

SEQ ID NO: 732409 - DNA, 22 bp, Artificial Sequence
  chemically synthesized
ctgctgtggcttgaatatttgt

SEQ ID NO: 732410 - DNA, 22 bp, Artificial Sequence
  chemically synthesized
actgctgtggcttgaatatttg

SEQ ID NO: 732411 - DNA, 22 bp, Artificial Sequence
  chemically synthesized
tggggagacacaaatattcaag

SEQ ID NO: 732412 - DNA, 22 bp, Artificial Sequence
  chemically synthesized
ggggagacacaaatattcaagc

SEQ ID NO: 732413 - DNA, 22 bp, Artificial Sequence
  chemically synthesized
gggagacacaaatattcaagcc

SEQ ID NO: 732414 - DNA, 22 bp, Artificial Sequence
  chemically synthesized
ccttactgctgtggcttgaata

SEQ ID NO: 732415 - DNA, 22 bp, Artificial Sequence
  chemically synthesized
tgattgccttactgctgtggct

SEQ ID NO: 732416 - DNA, 22 bp, Artificial Sequence
  chemically synthesized
gtgattgccttactgctgtggc

SEQ ID NO: 732417 - DNA, 22 bp, Artificial Sequence
  chemically synthesized
tgtgattgccttactgctgtgg

SEQ ID NO: 732418 - DNA, 22 bp, Artificial Sequence
  chemically synthesized
ttttgtgattgccttactgctg

SEQ ID NO: 732419 - DNA, 22 bp, Artificial Sequence
  chemically synthesized
ccctattttgtgattgccttac

SEQ ID NO: 732420 - DNA, 22 bp, Artificial Sequence
  chemically synthesized
aagccacagcagtaaggcaatc

SEQ ID NO: 732421 - DNA, 22 bp, Artificial Sequence
  chemically synthesized
actgccctattttgtgattgcc

SEQ ID NO: 732422 - DNA, 22 bp, Artificial Sequence
  chemically synthesized
aatctaactgccctattttgtg

SEQ ID NO: 732423 - DNA, 22 bp, Artificial Sequence
  chemically synthesized
aaatctaactgccctattttgt

SEQ ID NO: 732424 - DNA, 22 bp, Artificial Sequence
  chemically synthesized
cacttaaatctaactgccctat

SEQ ID NO: 732425 - DNA, 22 bp, Artificial Sequence
  chemically synthesized
gtatattacacttaaatctaac

SEQ ID NO: 732426 - DNA, 22 bp, Artificial Sequence
  chemically synthesized
cctagtatattacacttaaatc

SEQ ID NO: 732427 - DNA, 22 bp, Artificial Sequence
  chemically synthesized
tcattccctagtatattacact

SEQ ID NO: 732428 - DNA, 22 bp, Artificial Sequence
  chemically synthesized
attgtcattccctagtatatta

SEQ ID NO: 732429 - DNA, 22 bp, Artificial Sequence
  chemically synthesized
gatttaagtgtaatatactagg

SEQ ID NO: 732430 - DNA, 22 bp, Artificial Sequence
  chemically synthesized
tcattgtcattccctagtatat

SEQ ID NO: 732431 - DNA, 22 bp, Artificial Sequence
  chemically synthesized
tctcattgtcattccctagtat

SEQ ID NO: 732432 - DNA, 22 bp, Artificial Sequence
  chemically synthesized
aagtgtaatatactagggaatg

SEQ ID NO: 732433 - DNA, 22 bp, Artificial Sequence
  chemically synthesized
agtgtaatatactagggaatga

SEQ ID NO: 732434 - DNA, 22 bp, Artificial Sequence
  chemically synthesized
atgatacatctctctcattgtc

SEQ ID NO: 732435 - DNA, 22 bp, Artificial Sequence
  chemically synthesized
gggaatgacaatgagagagatg

SEQ ID NO: 732436 - DNA, 22 bp, Artificial Sequence
  chemically synthesized
atgataggggagaaggcaaaga

SEQ ID NO: 732437 - DNA, 22 bp, Artificial Sequence
  chemically synthesized
cctgatgataggggagaaggca

SEQ ID NO: 732438 - DNA, 22 bp, Artificial Sequence
  chemically synthesized
ccctgatgataggggagaaggc

SEQ ID NO: 732439 - DNA, 22 bp, Artificial Sequence
  chemically synthesized
ctttgccttctcccctatcatc

SEQ ID NO: 732440 - DNA, 22 bp, Artificial Sequence
  chemically synthesized
ggtaccttccctgatgataggg

SEQ ID NO: 732441 - DNA, 22 bp, Artificial Sequence
  chemically synthesized
tttgccttctcccctatcatca

SEQ ID NO: 732442 - DNA, 22 bp, Artificial Sequence
  chemically synthesized
tgccttctcccctatcatcagg

SEQ ID NO: 732443 - DNA, 22 bp, Artificial Sequence
  chemically synthesized
gccttctcccctatcatcaggg

SEQ ID NO: 732444 - DNA, 22 bp, Artificial Sequence
  chemically synthesized
ccttctcccctatcatcaggga

SEQ ID NO: 732445 - DNA, 22 bp, Artificial Sequence
  chemically synthesized
ctcccctatcatcagggaaggt

SEQ ID NO: 732446 - DNA, 22 bp, Artificial Sequence
  chemically synthesized
gagcagttaggtaccttccctg

SEQ ID NO: 732447 - DNA, 22 bp, Artificial Sequence
  chemically synthesized
tcccctatcatcagggaaggta

SEQ ID NO: 732448 - DNA, 22 bp, Artificial Sequence
  chemically synthesized
ggagcagttaggtaccttccct

SEQ ID NO: 732449 - DNA, 22 bp, Artificial Sequence
  chemically synthesized
ccctatcatcagggaaggtacc

SEQ ID NO: 732450 - DNA, 22 bp, Artificial Sequence
  chemically synthesized
tcatcagggaaggtacctaact

SEQ ID NO: 732451 - DNA, 22 bp, Artificial Sequence
  chemically synthesized
gtgcgcatggagtcatgtggcc

SEQ ID NO: 732452 - DNA, 22 bp, Artificial Sequence
  chemically synthesized
actgctccaaggccacatgact

SEQ ID NO: 732453 - DNA, 22 bp, Artificial Sequence
  chemically synthesized
ttggtgcgcatggagtcatgtg

SEQ ID NO: 732454 - DNA, 22 bp, Artificial Sequence
  chemically synthesized
ctccaaggccacatgactccat

SEQ ID NO: 732455 - DNA, 22 bp, Artificial Sequence
  chemically synthesized
ctattggtgcgcatggagtcat

SEQ ID NO: 732456 - DNA, 22 bp, Artificial Sequence
  chemically synthesized
gctattggtgcgcatggagtca

SEQ ID NO: 732457 - DNA, 22 bp, Artificial Sequence
  chemically synthesized
tgctattggtgcgcatggagtc

SEQ ID NO: 732458 - DNA, 22 bp, Artificial Sequence
  chemically synthesized
caaggccacatgactccatgcg

SEQ ID NO: 732459 - DNA, 22 bp, Artificial Sequence
  chemically synthesized
ttgctattggtgcgcatggagt

SEQ ID NO: 732460 - DNA, 22 bp, Artificial Sequence
  chemically synthesized
gatgtagtttttgctattggtg

SEQ ID NO: 732461 - DNA, 22 bp, Artificial Sequence
  chemically synthesized
catgcgcaccaatagcaaaaac

SEQ ID NO: 732462 - DNA, 22 bp, Artificial Sequence
  chemically synthesized
taaagcattggatgtagttttt

SEQ ID NO: 732463 - DNA, 22 bp, Artificial Sequence
  chemically synthesized
acctataaagcattggatgtag

SEQ ID NO: 732464 - DNA, 22 bp, Artificial Sequence
  chemically synthesized
ctaacctataaagcattggatg

SEQ ID NO: 732465 - DNA, 22 bp, Artificial Sequence
  chemically synthesized
cctaacctataaagcattggat

SEQ ID NO: 732466 - DNA, 22 bp, Artificial Sequence
  chemically synthesized
tcctaacctataaagcattgga

SEQ ID NO: 732467 - DNA, 22 bp, Artificial Sequence
  chemically synthesized
tactttcctaacctataaagca

SEQ ID NO: 732468 - DNA, 22 bp, Artificial Sequence
  chemically synthesized
catccaatgctttataggttag

SEQ ID NO: 732469 - DNA, 22 bp, Artificial Sequence
  chemically synthesized
tataggttaggaaagtacaggt

SEQ ID NO: 732470 - DNA, 22 bp, Artificial Sequence
  chemically synthesized
ataggttaggaaagtacaggtt

SEQ ID NO: 732471 - DNA, 22 bp, Artificial Sequence
  chemically synthesized
taggttaggaaagtacaggttc

SEQ ID NO: 732472 - DNA, 22 bp, Artificial Sequence
  chemically synthesized
ggaaagtacaggttcccacact

SEQ ID NO: 732473 - DNA, 22 bp, Artificial Sequence
  chemically synthesized
ccacacttatatgtgctcactt

SEQ ID NO: 732474 - DNA, 22 bp, Artificial Sequence
  chemically synthesized
atatgtgctcacttccatttct

SEQ ID NO: 732475 - DNA, 22 bp, Artificial Sequence
  chemically synthesized
tatgtgctcacttccatttctt

SEQ ID NO: 732476 - DNA, 22 bp, Artificial Sequence
  chemically synthesized
acttccatttcttgctgcccct

SEQ ID NO: 732477 - DNA, 22 bp, Artificial Sequence
  chemically synthesized
gtaaataaagagaggggcagca

SEQ ID NO: 732478 - DNA, 22 bp, Artificial Sequence
  chemically synthesized
cgtaaataaagagaggggcagc

SEQ ID NO: 732479 - DNA, 22 bp, Artificial Sequence
  chemically synthesized
tcgtaaataaagagaggggcag

SEQ ID NO: 732480 - DNA, 22 bp, Artificial Sequence
  chemically synthesized
ccatttcttgctgcccctctct

SEQ ID NO: 732481 - DNA, 22 bp, Artificial Sequence
  chemically synthesized
catttcttgctgcccctctctt

SEQ ID NO: 732482 - DNA, 22 bp, Artificial Sequence
  chemically synthesized
atcctttcgtaaataaagagag

SEQ ID NO: 732483 - DNA, 22 bp, Artificial Sequence
  chemically synthesized
cttgctgcccctctctttattt

SEQ ID NO: 732484 - DNA, 22 bp, Artificial Sequence
  chemically synthesized
tcatcctttcgtaaataaagag

SEQ ID NO: 732485 - DNA, 22 bp, Artificial Sequence
  chemically synthesized
ttgctgcccctctctttattta

SEQ ID NO: 732486 - DNA, 22 bp, Artificial Sequence
  chemically synthesized
gctgcccctctctttatttacg

SEQ ID NO: 732487 - DNA, 22 bp, Artificial Sequence
  chemically synthesized
ctgcccctctctttatttacga

SEQ ID NO: 732488 - DNA, 22 bp, Artificial Sequence
  chemically synthesized
cccctctctttatttacgaaag

SEQ ID NO: 732489 - DNA, 22 bp, Artificial Sequence
  chemically synthesized
tggatcaagttctcatcctttc

SEQ ID NO: 732490 - DNA, 22 bp, Artificial Sequence
  chemically synthesized
tctttatttacgaaaggatgag

SEQ ID NO: 732491 - DNA, 22 bp, Artificial Sequence
  chemically synthesized
gtggatcaagttctcatccttt

SEQ ID NO: 732492 - DNA, 22 bp, Artificial Sequence
  chemically synthesized
tttatttacgaaaggatgagaa

SEQ ID NO: 732493 - DNA, 22 bp, Artificial Sequence
  chemically synthesized
tatttacgaaaggatgagaact

SEQ ID NO: 732494 - DNA, 22 bp, Artificial Sequence
  chemically synthesized
atttacgaaaggatgagaactt

SEQ ID NO: 732495 - DNA, 22 bp, Artificial Sequence
  chemically synthesized
tttacgaaaggatgagaacttg

SEQ ID NO: 732496 - DNA, 22 bp, Artificial Sequence
  chemically synthesized
acgaaaggatgagaacttgatc

SEQ ID NO: 732497 - DNA, 22 bp, Artificial Sequence
  chemically synthesized
cgaaaggatgagaacttgatcc

SEQ ID NO: 732498 - DNA, 22 bp, Artificial Sequence
  chemically synthesized
aatgaaatcacttgtggatcaa

SEQ ID NO: 732499 - DNA, 22 bp, Artificial Sequence
  chemically synthesized
catctcaatgaaatcacttgtg

SEQ ID NO: 732500 - DNA, 22 bp, Artificial Sequence
  chemically synthesized
gatccacaagtgatttcattga

SEQ ID NO: 732501 - DNA, 22 bp, Artificial Sequence
  chemically synthesized
atccacaagtgatttcattgag

SEQ ID NO: 732502 - DNA, 22 bp, Artificial Sequence
  chemically synthesized
gataaaataagagttacatctc

SEQ ID NO: 732503 - DNA, 22 bp, Artificial Sequence
  chemically synthesized
ggataaaataagagttacatct

SEQ ID NO: 732504 - DNA, 22 bp, Artificial Sequence
  chemically synthesized
tggataaaataagagttacatc

SEQ ID NO: 732505 - DNA, 22 bp, Artificial Sequence
  chemically synthesized
tttggataaaataagagttaca

SEQ ID NO: 732506 - DNA, 22 bp, Artificial Sequence
  chemically synthesized
tctttggataaaataagagtta

SEQ ID NO: 732507 - DNA, 22 bp, Artificial Sequence
  chemically synthesized
ctctttggataaaataagagtt

SEQ ID NO: 732508 - DNA, 22 bp, Artificial Sequence
  chemically synthesized
cattgagatgtaactcttattt

SEQ ID NO: 732509 - DNA, 22 bp, Artificial Sequence
  chemically synthesized
attgagatgtaactcttatttt

SEQ ID NO: 732510 - DNA, 22 bp, Artificial Sequence
  chemically synthesized
agatgtaactcttattttatcc

SEQ ID NO: 732511 - DNA, 22 bp, Artificial Sequence
  chemically synthesized
caacacttctctttggataaaa

SEQ ID NO: 732512 - DNA, 22 bp, Artificial Sequence
  chemically synthesized
ttattttatccaaagagaagtg

SEQ ID NO: 732513 - DNA, 22 bp, Artificial Sequence
  chemically synthesized
attttatccaaagagaagtgtt

SEQ ID NO: 732514 - DNA, 22 bp, Artificial Sequence
  chemically synthesized
ttttatccaaagagaagtgttg

SEQ ID NO: 732515 - DNA, 22 bp, Artificial Sequence
  chemically synthesized
tatccaaagagaagtgttggaa

SEQ ID NO: 732516 - DNA, 22 bp, Artificial Sequence
  chemically synthesized
atccaaagagaagtgttggaac

SEQ ID NO: 732517 - DNA, 22 bp, Artificial Sequence
  chemically synthesized
tccaaagagaagtgttggaaca

SEQ ID NO: 732518 - DNA, 22 bp, Artificial Sequence
  chemically synthesized
ataatcaaagcatgttccaaca

SEQ ID NO: 732519 - DNA, 22 bp, Artificial Sequence
  chemically synthesized
acctgataatcaaagcatgttc

SEQ ID NO: 732520 - DNA, 22 bp, Artificial Sequence
  chemically synthesized
gaacatgctttgattatcaggt

SEQ ID NO: 732521 - DNA, 22 bp, Artificial Sequence
  chemically synthesized
tgattatcaggtgagggctctg

SEQ ID NO: 732522 - DNA, 22 bp, Artificial Sequence
  chemically synthesized
gattatcaggtgagggctctgt

SEQ ID NO: 732523 - DNA, 22 bp, Artificial Sequence
  chemically synthesized
attatcaggtgagggctctgtg

SEQ ID NO: 732524 - DNA, 22 bp, Artificial Sequence
  chemically synthesized
catgaaaatgtgcacagagccc

SEQ ID NO: 732525 - DNA, 22 bp, Artificial Sequence
  chemically synthesized
gcatgaaaatgtgcacagagcc

SEQ ID NO: 732526 - DNA, 22 bp, Artificial Sequence
  chemically synthesized
tcaggtgagggctctgtgcaca

SEQ ID NO: 732527 - DNA, 22 bp, Artificial Sequence
  chemically synthesized
agacatttgcatgaaaatgtgc

SEQ ID NO: 732528 - DNA, 22 bp, Artificial Sequence
  chemically synthesized
ccaatctaagacatttgcatga

SEQ ID NO: 732529 - DNA, 22 bp, Artificial Sequence
  chemically synthesized
tgtgcacattttcatgcaaatg

SEQ ID NO: 732530 - DNA, 22 bp, Artificial Sequence
  chemically synthesized
tgcacattttcatgcaaatgtc

SEQ ID NO: 732531 - DNA, 22 bp, Artificial Sequence
  chemically synthesized
gaggagagttaccaatctaaga

SEQ ID NO: 732532 - DNA, 22 bp, Artificial Sequence
  chemically synthesized
tcatgcaaatgtcttagattgg

SEQ ID NO: 732533 - DNA, 22 bp, Artificial Sequence
  chemically synthesized
catgcaaatgtcttagattggt

SEQ ID NO: 732534 - DNA, 22 bp, Artificial Sequence
  chemically synthesized
atgcaaatgtcttagattggta

SEQ ID NO: 732535 - DNA, 22 bp, Artificial Sequence
  chemically synthesized
attggaggagagttaccaatct

SEQ ID NO: 732536 - DNA, 22 bp, Artificial Sequence
  chemically synthesized
cattcattggaggagagttacc

SEQ ID NO: 732537 - DNA, 22 bp, Artificial Sequence
  chemically synthesized
gcattcattggaggagagttac

SEQ ID NO: 732538 - DNA, 22 bp, Artificial Sequence
  chemically synthesized
agattggtaactctcctccaat

SEQ ID NO: 732539 - DNA, 22 bp, Artificial Sequence
  chemically synthesized
gattggtaactctcctccaatg

SEQ ID NO: 732540 - DNA, 22 bp, Artificial Sequence
  chemically synthesized
gtaactctcctccaatgaatgc

SEQ ID NO: 732541 - DNA, 22 bp, Artificial Sequence
  chemically synthesized
tcctccaatgaatgcaagacct

SEQ ID NO: 732542 - DNA, 22 bp, Artificial Sequence
  chemically synthesized
ctccaatgaatgcaagaccttc

SEQ ID NO: 732543 - DNA, 22 bp, Artificial Sequence
  chemically synthesized
caatgaatgcaagaccttctgc

SEQ ID NO: 732544 - DNA, 22 bp, Artificial Sequence
  chemically synthesized
gtcatcaccgaaggcagaaggt

SEQ ID NO: 732545 - DNA, 22 bp, Artificial Sequence
  chemically synthesized
agtcatcaccgaaggcagaagg

SEQ ID NO: 732546 - DNA, 22 bp, Artificial Sequence
  chemically synthesized
ccaccttagtcatcaccgaagg

SEQ ID NO: 732547 - DNA, 22 bp, Artificial Sequence
  chemically synthesized
ttaccaccttagtcatcaccga

SEQ ID NO: 732548 - DNA, 22 bp, Artificial Sequence
  chemically synthesized
ctgccttcggtgatgactaagg

SEQ ID NO: 732549 - DNA, 22 bp, Artificial Sequence
  chemically synthesized
tgccttcggtgatgactaaggt

SEQ ID NO: 732550 - DNA, 22 bp, Artificial Sequence
  chemically synthesized
ataactgttaccaccttagtca

SEQ ID NO: 732551 - DNA, 22 bp, Artificial Sequence
  chemically synthesized
ccttcggtgatgactaaggtgg

SEQ ID NO: 732552 - DNA, 22 bp, Artificial Sequence
  chemically synthesized
cctgataactgttaccacctta

SEQ ID NO: 732553 - DNA, 22 bp, Artificial Sequence
  chemically synthesized
cggtgatgactaaggtggtaac

SEQ ID NO: 732554 - DNA, 22 bp, Artificial Sequence
  chemically synthesized
ggtgatgactaaggtggtaaca

SEQ ID NO: 732555 - DNA, 22 bp, Artificial Sequence
  chemically synthesized
aggtggtaacagttatcaggta

SEQ ID NO: 732556 - DNA, 22 bp, Artificial Sequence
  chemically synthesized
gtaaataagtcagtgccaagca

SEQ ID NO: 732557 - DNA, 22 bp, Artificial Sequence
  chemically synthesized
tcaggtagttgcttggcactga

SEQ ID NO: 732558 - DNA, 22 bp, Artificial Sequence
  chemically synthesized
cttggcactgacttatttacta

SEQ ID NO: 732559 - DNA, 22 bp, Artificial Sequence
  chemically synthesized
ggcactgacttatttactagac

SEQ ID NO: 732560 - DNA, 22 bp, Artificial Sequence
  chemically synthesized
gcactgacttatttactagaca

SEQ ID NO: 732561 - DNA, 22 bp, Artificial Sequence
  chemically synthesized
acttatttactagacattcttt

SEQ ID NO: 732562 - DNA, 22 bp, Artificial Sequence
  chemically synthesized
atttactagacattcttttttt

SEQ ID NO: 732563 - DNA, 22 bp, Artificial Sequence
  chemically synthesized
tttactagacattctttttttt

SEQ ID NO: 732564 - DNA, 22 bp, Artificial Sequence
  chemically synthesized
actagacattctttttttttgt

SEQ ID NO: 732565 - DNA, 22 bp, Artificial Sequence
  chemically synthesized
ctagacattctttttttttgtt

SEQ ID NO: 732566 - DNA, 22 bp, Artificial Sequence
  chemically synthesized
gaaaaaaacaaaaaacaaaaaa

SEQ ID NO: 732567 - DNA, 22 bp, Artificial Sequence
  chemically synthesized
gacattctttttttttgttttt

SEQ ID NO: 732568 - DNA, 22 bp, Artificial Sequence
  chemically synthesized
tggaaaaaaacaaaaaacaaaa

SEQ ID NO: 732569 - DNA, 22 bp, Artificial Sequence
  chemically synthesized
tctggaaaaaaacaaaaaacaa

SEQ ID NO: 732570 - DNA, 22 bp, Artificial Sequence
  chemically synthesized
tttttttttgttttttgttttt

SEQ ID NO: 732571 - DNA, 22 bp, Artificial Sequence
  chemically synthesized
tttttttgttttttgttttttt

SEQ ID NO: 732572 - DNA, 22 bp, Artificial Sequence
  chemically synthesized
ttttttgttttttgtttttttc

SEQ ID NO: 732573 - DNA, 22 bp, Artificial Sequence
  chemically synthesized
tttttgttttttgtttttttcc

SEQ ID NO: 732574 - DNA, 22 bp, Artificial Sequence
  chemically synthesized
ttttgttttttgtttttttcca

SEQ ID NO: 732575 - DNA, 22 bp, Artificial Sequence
  chemically synthesized
tttgttttttgtttttttccag

SEQ ID NO: 732576 - DNA, 22 bp, Artificial Sequence
  chemically synthesized
ttgttttttgtttttttccaga

SEQ ID NO: 732577 - DNA, 22 bp, Artificial Sequence
  chemically synthesized
tgttttttgtttttttccagag

SEQ ID NO: 732578 - DNA, 22 bp, Artificial Sequence
  chemically synthesized
gttttttgtttttttccagaga

SEQ ID NO: 732579 - DNA, 22 bp, Artificial Sequence
  chemically synthesized
ttttttgtttttttccagagag

SEQ ID NO: 732580 - DNA, 22 bp, Artificial Sequence
  chemically synthesized
tttgtttttttccagagagtct

SEQ ID NO: 732581 - DNA, 22 bp, Artificial Sequence
  chemically synthesized
ggccacagagtgagactctctg

SEQ ID NO: 732582 - DNA, 22 bp, Artificial Sequence
  chemically synthesized
ttgtttttttccagagagtctc

SEQ ID NO: 732583 - DNA, 22 bp, Artificial Sequence
  chemically synthesized
tgtttttttccagagagtctca

SEQ ID NO: 732584 - DNA, 22 bp, Artificial Sequence
  chemically synthesized
gtttttttccagagagtctcac

SEQ ID NO: 732585 - DNA, 22 bp, Artificial Sequence
  chemically synthesized
tttttttccagagagtctcact

SEQ ID NO: 732586 - DNA, 22 bp, Artificial Sequence
  chemically synthesized
ttttccagagagtctcactctg

SEQ ID NO: 732587 - DNA, 22 bp, Artificial Sequence
  chemically synthesized
cggcctgggccacagagtgaga

SEQ ID NO: 732588 - DNA, 22 bp, Artificial Sequence
  chemically synthesized
tttccagagagtctcactctgt

SEQ ID NO: 732589 - DNA, 22 bp, Artificial Sequence
  chemically synthesized
ttccagagagtctcactctgtg

SEQ ID NO: 732590 - DNA, 22 bp, Artificial Sequence
  chemically synthesized
tccagagagtctcactctgtgg

SEQ ID NO: 732591 - DNA, 22 bp, Artificial Sequence
  chemically synthesized
ccagagagtctcactctgtggc

SEQ ID NO: 732592 - DNA, 22 bp, Artificial Sequence
  chemically synthesized
cagagagtctcactctgtggcc

SEQ ID NO: 732593 - DNA, 22 bp, Artificial Sequence
  chemically synthesized
cactccggcctgggccacagag

SEQ ID NO: 732594 - DNA, 22 bp, Artificial Sequence
  chemically synthesized
actctgtggcccaggccggagt

SEQ ID NO: 732595 - DNA, 22 bp, Artificial Sequence
  chemically synthesized
agatcatgccactgcactccgg

SEQ ID NO: 732596 - DNA, 22 bp, Artificial Sequence
  chemically synthesized
tgtggcccaggccggagtgcag

SEQ ID NO: 732597 - DNA, 22 bp, Artificial Sequence
  chemically synthesized
tggcccaggccggagtgcagtg

SEQ ID NO: 732598 - DNA, 22 bp, Artificial Sequence
  chemically synthesized
ccgtgagctgagatcatgccac

SEQ ID NO: 732599 - DNA, 22 bp, Artificial Sequence
  chemically synthesized
aacccgggaggcggaagttgcc

SEQ ID NO: 732600 - DNA, 22 bp, Artificial Sequence
  chemically synthesized
gaacccgggaggcggaagttgc

SEQ ID NO: 732601 - DNA, 22 bp, Artificial Sequence
  chemically synthesized
cttgaacccgggaggcggaagt

SEQ ID NO: 732602 - DNA, 22 bp, Artificial Sequence
  chemically synthesized
agctcacggcaacttccgcctc

SEQ ID NO: 732603 - DNA, 22 bp, Artificial Sequence
  chemically synthesized
acggcaacttccgcctcccggg

SEQ ID NO: 732604 - DNA, 22 bp, Artificial Sequence
  chemically synthesized
aggcaggagaattgcttgaacc

SEQ ID NO: 732605 - DNA, 22 bp, Artificial Sequence
  chemically synthesized
ccgcctcccgggttcaagcaat

SEQ ID NO: 732606 - DNA, 22 bp, Artificial Sequence
  chemically synthesized
cgcctcccgggttcaagcaatt

SEQ ID NO: 732607 - DNA, 22 bp, Artificial Sequence
  chemically synthesized
ccgggttcaagcaattctcctg

SEQ ID NO: 732608 - DNA, 22 bp, Artificial Sequence
  chemically synthesized
gggaggctgaggcaggagaatt

SEQ ID NO: 732609 - DNA, 22 bp, Artificial Sequence
  chemically synthesized
ctggggaggctgaggcaggaga

SEQ ID NO: 732610 - DNA, 22 bp, Artificial Sequence
  chemically synthesized
aagcaattctcctgcctcagcc

SEQ ID NO: 732611 - DNA, 22 bp, Artificial Sequence
  chemically synthesized
tagtcccatctactggggaggc

SEQ ID NO: 732612 - DNA, 22 bp, Artificial Sequence
  chemically synthesized
tcctgcctcagcctccccagta

SEQ ID NO: 732613 - DNA, 22 bp, Artificial Sequence
  chemically synthesized
ctgcctcagcctccccagtaga

SEQ ID NO: 732614 - DNA, 22 bp, Artificial Sequence
  chemically synthesized
cctcagcctccccagtagatgg

SEQ ID NO: 732615 - DNA, 22 bp, Artificial Sequence
  chemically synthesized
agcctccccagtagatgggact

SEQ ID NO: 732616 - DNA, 22 bp, Artificial Sequence
  chemically synthesized
cccagtagatgggactacaggc

SEQ ID NO: 732617 - DNA, 22 bp, Artificial Sequence
  chemically synthesized
gccaggtgtggtggtggtgcct

SEQ ID NO: 732618 - DNA, 22 bp, Artificial Sequence
  chemically synthesized
caggcaccaccaccacacctgg

SEQ ID NO: 732619 - DNA, 22 bp, Artificial Sequence
  chemically synthesized
aaaatacaaaaattagccaggt

SEQ ID NO: 732620 - DNA, 22 bp, Artificial Sequence
  chemically synthesized
ctaaaaatacaaaaattagcca

SEQ ID NO: 732621 - DNA, 22 bp, Artificial Sequence
  chemically synthesized
tgctaaaaatacaaaaattagc

SEQ ID NO: 732622 - DNA, 22 bp, Artificial Sequence
  chemically synthesized
gctaatttttgtatttttagca

SEQ ID NO: 732623 - DNA, 22 bp, Artificial Sequence
  chemically synthesized
atttttgtatttttagcagaga

SEQ ID NO: 732624 - DNA, 22 bp, Artificial Sequence
  chemically synthesized
ttgtatttttagcagagacacg

SEQ ID NO: 732625 - DNA, 22 bp, Artificial Sequence
  chemically synthesized
tgtatttttagcagagacacgg

SEQ ID NO: 732626 - DNA, 22 bp, Artificial Sequence
  chemically synthesized
gtatttttagcagagacacggt

SEQ ID NO: 732627 - DNA, 22 bp, Artificial Sequence
  chemically synthesized
tatttttagcagagacacggtt

SEQ ID NO: 732628 - DNA, 22 bp, Artificial Sequence
  chemically synthesized
gccaccacggtgaaaccgtgtc

SEQ ID NO: 732629 - DNA, 22 bp, Artificial Sequence
  chemically synthesized
ttagcagagacacggtttcacc

SEQ ID NO: 732630 - DNA, 22 bp, Artificial Sequence
  chemically synthesized
tagcagagacacggtttcaccg

SEQ ID NO: 732631 - DNA, 22 bp, Artificial Sequence
  chemically synthesized
agcagagacacggtttcaccgt

SEQ ID NO: 732632 - DNA, 22 bp, Artificial Sequence
  chemically synthesized
gcagagacacggtttcaccgtg

SEQ ID NO: 732633 - DNA, 22 bp, Artificial Sequence
  chemically synthesized
agaccagcctggccaccacggt

SEQ ID NO: 732634 - DNA, 22 bp, Artificial Sequence
  chemically synthesized
caccgtggtggccaggctggtc

SEQ ID NO: 732635 - DNA, 22 bp, Artificial Sequence
  chemically synthesized
accgtggtggccaggctggtct

SEQ ID NO: 732636 - DNA, 22 bp, Artificial Sequence
  chemically synthesized
aggccaggagtctgagaccagc

SEQ ID NO: 732637 - DNA, 22 bp, Artificial Sequence
  chemically synthesized
gaggccaggagtctgagaccag

SEQ ID NO: 732638 - DNA, 22 bp, Artificial Sequence
  chemically synthesized
gtctcagactcctggcctcaag

SEQ ID NO: 732639 - DNA, 22 bp, Artificial Sequence
  chemically synthesized
agactcctggcctcaagtgatc

SEQ ID NO: 732640 - DNA, 22 bp, Artificial Sequence
  chemically synthesized
ggaggccaaggcaggtggatca

SEQ ID NO: 732641 - DNA, 22 bp, Artificial Sequence
  chemically synthesized
ctggcctcaagtgatccacctg

SEQ ID NO: 732642 - DNA, 22 bp, Artificial Sequence
  chemically synthesized
gggaggccaaggcaggtggatc

SEQ ID NO: 732643 - DNA, 22 bp, Artificial Sequence
  chemically synthesized
tgggaggccaaggcaggtggat

SEQ ID NO: 732644 - DNA, 22 bp, Artificial Sequence
  chemically synthesized
gcctcaagtgatccacctgcct

SEQ ID NO: 732645 - DNA, 22 bp, Artificial Sequence
  chemically synthesized
aagtgatccacctgccttggcc

SEQ ID NO: 732646 - DNA, 22 bp, Artificial Sequence
  chemically synthesized
taatcccagcactttgggaggc

SEQ ID NO: 732647 - DNA, 22 bp, Artificial Sequence
  chemically synthesized
ccttggcctcccaaagtgctgg

SEQ ID NO: 732648 - DNA, 22 bp, Artificial Sequence
  chemically synthesized
acacctgtaatcccagcacttt

SEQ ID NO: 732649 - DNA, 22 bp, Artificial Sequence
  chemically synthesized
ggcctcccaaagtgctgggatt

SEQ ID NO: 732650 - DNA, 22 bp, Artificial Sequence
  chemically synthesized
gcctcccaaagtgctgggatta

SEQ ID NO: 732651 - DNA, 22 bp, Artificial Sequence
  chemically synthesized
ccaaagtgctgggattacaggt

SEQ ID NO: 732652 - DNA, 22 bp, Artificial Sequence
  chemically synthesized
ggattacaggtgtgagccacat

SEQ ID NO: 732653 - DNA, 22 bp, Artificial Sequence
  chemically synthesized
gtaggccaggcaatgtggctca

SEQ ID NO: 732654 - DNA, 22 bp, Artificial Sequence
  chemically synthesized
caggtgtgagccacattgcctg

SEQ ID NO: 732655 - DNA, 22 bp, Artificial Sequence
  chemically synthesized
acagtatctagtaggccaggca

SEQ ID NO: 732656 - DNA, 22 bp, Artificial Sequence
  chemically synthesized
aacagtatctagtaggccaggc

SEQ ID NO: 732657 - DNA, 22 bp, Artificial Sequence
  chemically synthesized
ccttaacagtatctagtaggcc

SEQ ID NO: 732658 - DNA, 22 bp, Artificial Sequence
  chemically synthesized
cctggcctactagatactgtta

SEQ ID NO: 732659 - DNA, 22 bp, Artificial Sequence
  chemically synthesized
gcacatgcctgccttaacagta

SEQ ID NO: 732660 - DNA, 22 bp, Artificial Sequence
  chemically synthesized
agcacatgcctgccttaacagt

SEQ ID NO: 732661 - DNA, 22 bp, Artificial Sequence
  chemically synthesized
gcctactagatactgttaaggc

SEQ ID NO: 732662 - DNA, 22 bp, Artificial Sequence
  chemically synthesized
tttagcacatgcctgccttaac

SEQ ID NO: 732663 - DNA, 22 bp, Artificial Sequence
  chemically synthesized
ctagatactgttaaggcaggca

SEQ ID NO: 732664 - DNA, 22 bp, Artificial Sequence
  chemically synthesized
gatactgttaaggcaggcatgt

SEQ ID NO: 732665 - DNA, 22 bp, Artificial Sequence
  chemically synthesized
ttaaggcaggcatgtgctaaac

SEQ ID NO: 732666 - DNA, 22 bp, Artificial Sequence
  chemically synthesized
aggcaggcatgtgctaaacagg

SEQ ID NO: 732667 - DNA, 22 bp, Artificial Sequence
  chemically synthesized
cagggatagtagaggtcatgtg

SEQ ID NO: 732668 - DNA, 22 bp, Artificial Sequence
  chemically synthesized
aacaggtcacatgacctctact

SEQ ID NO: 732669 - DNA, 22 bp, Artificial Sequence
  chemically synthesized
taattccagggatagtagaggt

SEQ ID NO: 732670 - DNA, 22 bp, Artificial Sequence
  chemically synthesized
gtattataattccagggatagt

SEQ ID NO: 732671 - DNA, 22 bp, Artificial Sequence
  chemically synthesized
actagtattataattccaggga

SEQ ID NO: 732672 - DNA, 22 bp, Artificial Sequence
  chemically synthesized
taactagtattataattccagg

SEQ ID NO: 732673 - DNA, 22 bp, Artificial Sequence
  chemically synthesized
ttctaactagtattataattcc

SEQ ID NO: 732674 - DNA, 22 bp, Artificial Sequence
  chemically synthesized
tactatccctggaattataata

SEQ ID NO: 732675 - DNA, 22 bp, Artificial Sequence
  chemically synthesized
ttgttctaactagtattataat

SEQ ID NO: 732676 - DNA, 22 bp, Artificial Sequence
  chemically synthesized
ctatccctggaattataatact

SEQ ID NO: 732677 - DNA, 22 bp, Artificial Sequence
  chemically synthesized
tccctggaattataatactagt

SEQ ID NO: 732678 - DNA, 22 bp, Artificial Sequence
  chemically synthesized
aaaactattgttctaactagta

SEQ ID NO: 732679 - DNA, 22 bp, Artificial Sequence
  chemically synthesized
gaaaactattgttctaactagt

SEQ ID NO: 732680 - DNA, 22 bp, Artificial Sequence
  chemically synthesized
gaattataatactagttagaac

SEQ ID NO: 732681 - DNA, 22 bp, Artificial Sequence
  chemically synthesized
taatactagttagaacaatagt

SEQ ID NO: 732682 - DNA, 22 bp, Artificial Sequence
  chemically synthesized
gttagaacaatagttttcaaac

SEQ ID NO: 732683 - DNA, 22 bp, Artificial Sequence
  chemically synthesized
taggtcatggtcaaagtttgaa

SEQ ID NO: 732684 - DNA, 22 bp, Artificial Sequence
  chemically synthesized
gaacaatagttttcaaactttg

SEQ ID NO: 732685 - DNA, 22 bp, Artificial Sequence
  chemically synthesized
ctgtaggtcatggtcaaagttt

SEQ ID NO: 732686 - DNA, 22 bp, Artificial Sequence
  chemically synthesized
actgtaggtcatggtcaaagtt

SEQ ID NO: 732687 - DNA, 22 bp, Artificial Sequence
  chemically synthesized
ttactgtaggtcatggtcaaag

SEQ ID NO: 732688 - DNA, 22 bp, Artificial Sequence
  chemically synthesized
cttactgtaggtcatggtcaaa

SEQ ID NO: 732689 - DNA, 22 bp, Artificial Sequence
  chemically synthesized
tcaaactttgaccatgacctac

SEQ ID NO: 732690 - DNA, 22 bp, Artificial Sequence
  chemically synthesized
caaactttgaccatgacctaca

SEQ ID NO: 732691 - DNA, 22 bp, Artificial Sequence
  chemically synthesized
aaactttgaccatgacctacag

SEQ ID NO: 732692 - DNA, 22 bp, Artificial Sequence
  chemically synthesized
tgaccatgacctacagtaagaa

SEQ ID NO: 732693 - DNA, 22 bp, Artificial Sequence
  chemically synthesized
tgatgaatgtatttcttactgt

SEQ ID NO: 732694 - DNA, 22 bp, Artificial Sequence
  chemically synthesized
gaccatgacctacagtaagaaa

SEQ ID NO: 732695 - DNA, 22 bp, Artificial Sequence
  chemically synthesized
accatgacctacagtaagaaat

SEQ ID NO: 732696 - DNA, 22 bp, Artificial Sequence
  chemically synthesized
agtaactatgatgaatgtattt

SEQ ID NO: 732697 - DNA, 22 bp, Artificial Sequence
  chemically synthesized
taagtaactatgatgaatgtat

SEQ ID NO: 732698 - DNA, 22 bp, Artificial Sequence
  chemically synthesized
cagtaagaaatacattcatcat

SEQ ID NO: 732699 - DNA, 22 bp, Artificial Sequence
  chemically synthesized
atcatagttacttagaatacat

SEQ ID NO: 732700 - DNA, 22 bp, Artificial Sequence
  chemically synthesized
cttagaatacattctccacacg

SEQ ID NO: 732701 - DNA, 22 bp, Artificial Sequence
  chemically synthesized
agaatacattctccacacgtat

SEQ ID NO: 732702 - DNA, 22 bp, Artificial Sequence
  chemically synthesized
gaatacattctccacacgtata

SEQ ID NO: 732703 - DNA, 22 bp, Artificial Sequence
  chemically synthesized
tccacacgtatacattcatggg

SEQ ID NO: 732704 - DNA, 22 bp, Artificial Sequence
  chemically synthesized
cacacgtatacattcatgggtg

SEQ ID NO: 732705 - DNA, 22 bp, Artificial Sequence
  chemically synthesized
gacaaacaacacacacatacac

SEQ ID NO: 732706 - DNA, 22 bp, Artificial Sequence
  chemically synthesized
agacaaacaacacacacataca

SEQ ID NO: 732707 - DNA, 22 bp, Artificial Sequence
  chemically synthesized
tagacaaacaacacacacatac

SEQ ID NO: 732708 - DNA, 22 bp, Artificial Sequence
  chemically synthesized
atgggtgtatgtgtgtgttgtt

SEQ ID NO: 732709 - DNA, 22 bp, Artificial Sequence
  chemically synthesized
gggaagtggtattttagacaaa

SEQ ID NO: 732710 - DNA, 22 bp, Artificial Sequence
  chemically synthesized
ctggggaagtggtattttagac

SEQ ID NO: 732711 - DNA, 22 bp, Artificial Sequence
  chemically synthesized
cctggggaagtggtattttaga

SEQ ID NO: 732712 - DNA, 22 bp, Artificial Sequence
  chemically synthesized
tttgtctaaaataccacttccc

SEQ ID NO: 732713 - DNA, 22 bp, Artificial Sequence
  chemically synthesized
gaaagtttcctggggaagtggt

SEQ ID NO: 732714 - DNA, 22 bp, Artificial Sequence
  chemically synthesized
gtctaaaataccacttccccag

SEQ ID NO: 732715 - DNA, 22 bp, Artificial Sequence
  chemically synthesized
tctaaaataccacttccccagg

SEQ ID NO: 732716 - DNA, 22 bp, Artificial Sequence
  chemically synthesized
aaataccacttccccaggaaac

SEQ ID NO: 732717 - DNA, 22 bp, Artificial Sequence
  chemically synthesized
gtgtagtaggcctggaaagttt

SEQ ID NO: 732718 - DNA, 22 bp, Artificial Sequence
  chemically synthesized
ccccaggaaactttccaggcct

SEQ ID NO: 732719 - DNA, 22 bp, Artificial Sequence
  chemically synthesized
acctggtgtagtaggcctggaa

SEQ ID NO: 732720 - DNA, 22 bp, Artificial Sequence
  chemically synthesized
cccaggaaactttccaggccta

SEQ ID NO: 732721 - DNA, 22 bp, Artificial Sequence
  chemically synthesized
gacctggtgtagtaggcctgga

SEQ ID NO: 732722 - DNA, 22 bp, Artificial Sequence
  chemically synthesized
tccaggcctactacaccaggtc

SEQ ID NO: 732723 - DNA, 22 bp, Artificial Sequence
  chemically synthesized
ccaggcctactacaccaggtca

SEQ ID NO: 732724 - DNA, 22 bp, Artificial Sequence
  chemically synthesized
caggcctactacaccaggtcaa

SEQ ID NO: 732725 - DNA, 22 bp, Artificial Sequence
  chemically synthesized
ctacaccaggtcaagtccctct

SEQ ID NO: 732726 - DNA, 22 bp, Artificial Sequence
  chemically synthesized
agagagtataacagagggactt

SEQ ID NO: 732727 - DNA, 22 bp, Artificial Sequence
  chemically synthesized
caccaggtcaagtccctctgtt

SEQ ID NO: 732728 - DNA, 22 bp, Artificial Sequence
  chemically synthesized
tgttatactctctcagcactct

SEQ ID NO: 732729 - DNA, 22 bp, Artificial Sequence
  chemically synthesized
ttatactctctcagcactctgc

SEQ ID NO: 732730 - DNA, 22 bp, Artificial Sequence
  chemically synthesized
gaaaggacaaaagcagagtgct

SEQ ID NO: 732731 - DNA, 22 bp, Artificial Sequence
  chemically synthesized
agaaaggacaaaagcagagtgc

SEQ ID NO: 732732 - DNA, 22 bp, Artificial Sequence
  chemically synthesized
tactctctcagcactctgcttt

SEQ ID NO: 732733 - DNA, 22 bp, Artificial Sequence
  chemically synthesized
tctcagcactctgcttttgtcc

SEQ ID NO: 732734 - DNA, 22 bp, Artificial Sequence
  chemically synthesized
tcagcactctgcttttgtcctt

SEQ ID NO: 732735 - DNA, 22 bp, Artificial Sequence
  chemically synthesized
agcactctgcttttgtcctttc

SEQ ID NO: 732736 - DNA, 22 bp, Artificial Sequence
  chemically synthesized
taatgagtacttagaaaggaca

SEQ ID NO: 732737 - DNA, 22 bp, Artificial Sequence
  chemically synthesized
tgcttttgtcctttctaagtac

SEQ ID NO: 732738 - DNA, 22 bp, Artificial Sequence
  chemically synthesized
caattgtaatgagtacttagaa

SEQ ID NO: 732739 - DNA, 22 bp, Artificial Sequence
  chemically synthesized
cttttgtcctttctaagtactc

SEQ ID NO: 732740 - DNA, 22 bp, Artificial Sequence
  chemically synthesized
attccaattgtaatgagtactt

SEQ ID NO: 732741 - DNA, 22 bp, Artificial Sequence
  chemically synthesized
ttgtcctttctaagtactcatt

SEQ ID NO: 732742 - DNA, 22 bp, Artificial Sequence
  chemically synthesized
cattccaattgtaatgagtact

SEQ ID NO: 732743 - DNA, 22 bp, Artificial Sequence
  chemically synthesized
tgtcctttctaagtactcatta

SEQ ID NO: 732744 - DNA, 22 bp, Artificial Sequence
  chemically synthesized
gtcctttctaagtactcattac

SEQ ID NO: 732745 - DNA, 22 bp, Artificial Sequence
  chemically synthesized
tcctttctaagtactcattaca

SEQ ID NO: 732746 - DNA, 22 bp, Artificial Sequence
  chemically synthesized
tttcattccaattgtaatgagt

SEQ ID NO: 732747 - DNA, 22 bp, Artificial Sequence
  chemically synthesized
tctaagtactcattacaattgg

SEQ ID NO: 732748 - DNA, 22 bp, Artificial Sequence
  chemically synthesized
ctaagtactcattacaattgga

SEQ ID NO: 732749 - DNA, 22 bp, Artificial Sequence
  chemically synthesized
taagtactcattacaattggaa

SEQ ID NO: 732750 - DNA, 22 bp, Artificial Sequence
  chemically synthesized
tgcaattatttcattccaattg

SEQ ID NO: 732751 - DNA, 22 bp, Artificial Sequence
  chemically synthesized
agtactcattacaattggaatg

SEQ ID NO: 732752 - DNA, 22 bp, Artificial Sequence
  chemically synthesized
ttatgcaattatttcattccaa

SEQ ID NO: 732753 - DNA, 22 bp, Artificial Sequence
  chemically synthesized
gttatgcaattatttcattcca

SEQ ID NO: 732754 - DNA, 22 bp, Artificial Sequence
  chemically synthesized
tgttatgcaattatttcattcc

SEQ ID NO: 732755 - DNA, 22 bp, Artificial Sequence
  chemically synthesized
attacaattggaatgaaataat

SEQ ID NO: 732756 - DNA, 22 bp, Artificial Sequence
  chemically synthesized
caattggaatgaaataattgca

SEQ ID NO: 732757 - DNA, 22 bp, Artificial Sequence
  chemically synthesized
aacatctttgttatgcaattat

SEQ ID NO: 732758 - DNA, 22 bp, Artificial Sequence
  chemically synthesized
gaatgaaataattgcataacaa

SEQ ID NO: 732759 - DNA, 22 bp, Artificial Sequence
  chemically synthesized
gagatgggttcaacatctttgt

SEQ ID NO: 732760 - DNA, 22 bp, Artificial Sequence
  chemically synthesized
cataacaaagatgttgaaccca

SEQ ID NO: 732761 - DNA, 22 bp, Artificial Sequence
  chemically synthesized
gaatacagatctagagatgggt

SEQ ID NO: 732762 - DNA, 22 bp, Artificial Sequence
  chemically synthesized
aacccatctctagatctgtatt

SEQ ID NO: 732763 - DNA, 22 bp, Artificial Sequence
  chemically synthesized
agaaagccctagaatacagatc

SEQ ID NO: 732764 - DNA, 22 bp, Artificial Sequence
  chemically synthesized
ccctcagaaagccctagaatac

SEQ ID NO: 732765 - DNA, 22 bp, Artificial Sequence
  chemically synthesized
tagatctgtattctagggcttt

SEQ ID NO: 732766 - DNA, 22 bp, Artificial Sequence
  chemically synthesized
gatctgtattctagggctttct

SEQ ID NO: 732767 - DNA, 22 bp, Artificial Sequence
  chemically synthesized
tattctagggctttctgagggc

SEQ ID NO: 732768 - DNA, 22 bp, Artificial Sequence
  chemically synthesized
tagggctttctgagggcaggga

SEQ ID NO: 732769 - DNA, 22 bp, Artificial Sequence
  chemically synthesized
gggctttctgagggcagggacc

SEQ ID NO: 732770 - DNA, 22 bp, Artificial Sequence
  chemically synthesized
taagagaggaagaaggtccctg

SEQ ID NO: 732771 - DNA, 22 bp, Artificial Sequence
  chemically synthesized
tataagagaggaagaaggtccc

SEQ ID NO: 732772 - DNA, 22 bp, Artificial Sequence
  chemically synthesized
tctgagggcagggaccttcttc

SEQ ID NO: 732773 - DNA, 22 bp, Artificial Sequence
  chemically synthesized
ctgagggcagggaccttcttcc

SEQ ID NO: 732774 - DNA, 22 bp, Artificial Sequence
  chemically synthesized
ttctataagagaggaagaaggt

SEQ ID NO: 732775 - DNA, 22 bp, Artificial Sequence
  chemically synthesized
tgagggcagggaccttcttcct

SEQ ID NO: 732776 - DNA, 22 bp, Artificial Sequence
  chemically synthesized
agggcagggaccttcttcctct

SEQ ID NO: 732777 - DNA, 22 bp, Artificial Sequence
  chemically synthesized
ctgttctataagagaggaagaa

SEQ ID NO: 732778 - DNA, 22 bp, Artificial Sequence
  chemically synthesized
tactgctgttctataagagagg

SEQ ID NO: 732779 - DNA, 22 bp, Artificial Sequence
  chemically synthesized
ctatactgctgttctataagag

SEQ ID NO: 732780 - DNA, 22 bp, Artificial Sequence
  chemically synthesized
cctatactgctgttctataaga

SEQ ID NO: 732781 - DNA, 22 bp, Artificial Sequence
  chemically synthesized
tcctatactgctgttctataag

SEQ ID NO: 732782 - DNA, 22 bp, Artificial Sequence
  chemically synthesized
ttcctatactgctgttctataa

SEQ ID NO: 732783 - DNA, 22 bp, Artificial Sequence
  chemically synthesized
cttcctctcttatagaacagca

SEQ ID NO: 732784 - DNA, 22 bp, Artificial Sequence
  chemically synthesized
ttcctctcttatagaacagcag

SEQ ID NO: 732785 - DNA, 22 bp, Artificial Sequence
  chemically synthesized
cctctcttatagaacagcagta

SEQ ID NO: 732786 - DNA, 22 bp, Artificial Sequence
  chemically synthesized
ctctcttatagaacagcagtat

SEQ ID NO: 732787 - DNA, 22 bp, Artificial Sequence
  chemically synthesized
tcttatagaacagcagtatagg

SEQ ID NO: 732788 - DNA, 22 bp, Artificial Sequence
  chemically synthesized
aggtcagtttttcctatactgc

SEQ ID NO: 732789 - DNA, 22 bp, Artificial Sequence
  chemically synthesized
caggtcagtttttcctatactg

SEQ ID NO: 732790 - DNA, 22 bp, Artificial Sequence
  chemically synthesized
ttatagaacagcagtataggaa

SEQ ID NO: 732791 - DNA, 22 bp, Artificial Sequence
  chemically synthesized
atagaacagcagtataggaaaa

SEQ ID NO: 732792 - DNA, 22 bp, Artificial Sequence
  chemically synthesized
cttcaggtcagtttttcctata

SEQ ID NO: 732793 - DNA, 22 bp, Artificial Sequence
  chemically synthesized
tagaacagcagtataggaaaaa

SEQ ID NO: 732794 - DNA, 22 bp, Artificial Sequence
  chemically synthesized
ttgcttcaggtcagtttttcct

SEQ ID NO: 732795 - DNA, 22 bp, Artificial Sequence
  chemically synthesized
tgtgcaaaatgttattgcttca

SEQ ID NO: 732796 - DNA, 22 bp, Artificial Sequence
  chemically synthesized
atgtgcaaaatgttattgcttc

SEQ ID NO: 732797 - DNA, 22 bp, Artificial Sequence
  chemically synthesized
ttatgtgcaaaatgttattgct

SEQ ID NO: 732798 - DNA, 22 bp, Artificial Sequence
  chemically synthesized
acctgaagcaataacattttgc

SEQ ID NO: 732799 - DNA, 22 bp, Artificial Sequence
  chemically synthesized
agcagctcttatgtgcaaaatg

SEQ ID NO: 732800 - DNA, 22 bp, Artificial Sequence
  chemically synthesized
aagcaataacattttgcacata

SEQ ID NO: 732801 - DNA, 22 bp, Artificial Sequence
  chemically synthesized
attaagcagctcttatgtgcaa

SEQ ID NO: 732802 - DNA, 22 bp, Artificial Sequence
  chemically synthesized
tgcacataagagctgcttaatt

SEQ ID NO: 732803 - DNA, 22 bp, Artificial Sequence
  chemically synthesized
gcacataagagctgcttaatta

SEQ ID NO: 732804 - DNA, 22 bp, Artificial Sequence
  chemically synthesized
cacataagagctgcttaattag

SEQ ID NO: 732805 - DNA, 22 bp, Artificial Sequence
  chemically synthesized
aggtcacaagtactaattaagc

SEQ ID NO: 732806 - DNA, 22 bp, Artificial Sequence
  chemically synthesized
ctcaggtcacaagtactaatta

SEQ ID NO: 732807 - DNA, 22 bp, Artificial Sequence
  chemically synthesized
actcaggtcacaagtactaatt

SEQ ID NO: 732808 - DNA, 22 bp, Artificial Sequence
  chemically synthesized
tccatttactcaggtcacaagt

SEQ ID NO: 732809 - DNA, 22 bp, Artificial Sequence
  chemically synthesized
atccatttactcaggtcacaag

SEQ ID NO: 732810 - DNA, 22 bp, Artificial Sequence
  chemically synthesized
cttaattagtacttgtgacctg

SEQ ID NO: 732811 - DNA, 22 bp, Artificial Sequence
  chemically synthesized
tatccatttactcaggtcacaa

SEQ ID NO: 732812 - DNA, 22 bp, Artificial Sequence
  chemically synthesized
aattagtacttgtgacctgagt

SEQ ID NO: 732813 - DNA, 22 bp, Artificial Sequence
  chemically synthesized
attagtacttgtgacctgagta

SEQ ID NO: 732814 - DNA, 22 bp, Artificial Sequence
  chemically synthesized
aggtctttatccatttactcag

SEQ ID NO: 732815 - DNA, 22 bp, Artificial Sequence
  chemically synthesized
gtacttgtgacctgagtaaatg

SEQ ID NO: 732816 - DNA, 22 bp, Artificial Sequence
  chemically synthesized
ctgaggtctttatccatttact

SEQ ID NO: 732817 - DNA, 22 bp, Artificial Sequence
  chemically synthesized
gctgaggtctttatccatttac

SEQ ID NO: 732818 - DNA, 22 bp, Artificial Sequence
  chemically synthesized
gtgacctgagtaaatggataaa

SEQ ID NO: 732819 - DNA, 22 bp, Artificial Sequence
  chemically synthesized
cttgctgaggtctttatccatt

SEQ ID NO: 732820 - DNA, 22 bp, Artificial Sequence
  chemically synthesized
tgacctgagtaaatggataaag

SEQ ID NO: 732821 - DNA, 22 bp, Artificial Sequence
  chemically synthesized
agtaaatggataaagacctcag

SEQ ID NO: 732822 - DNA, 22 bp, Artificial Sequence
  chemically synthesized
caaataagaaaaggacccaggg

SEQ ID NO: 732823 - DNA, 22 bp, Artificial Sequence
  chemically synthesized
agcaaggagatccctgggtcct

SEQ ID NO: 732824 - DNA, 22 bp, Artificial Sequence
  chemically synthesized
ccaaataagaaaaggacccagg

SEQ ID NO: 732825 - DNA, 22 bp, Artificial Sequence
  chemically synthesized
aagatttccaaataagaaaagg

SEQ ID NO: 732826 - DNA, 22 bp, Artificial Sequence
  chemically synthesized
cctcaagatttccaaataagaa

SEQ ID NO: 732827 - DNA, 22 bp, Artificial Sequence
  chemically synthesized
tacctcaagatttccaaataag

SEQ ID NO: 732828 - DNA, 22 bp, Artificial Sequence
  chemically synthesized
ggtccttttcttatttggaaat

SEQ ID NO: 732829 - DNA, 22 bp, Artificial Sequence
  chemically synthesized
cagctctacctcaagatttcca

SEQ ID NO: 732830 - DNA, 22 bp, Artificial Sequence
  chemically synthesized
ctccagctctacctcaagattt

SEQ ID NO: 732831 - DNA, 22 bp, Artificial Sequence
  chemically synthesized
ttcttatttggaaatcttgagg

SEQ ID NO: 732832 - DNA, 22 bp, Artificial Sequence
  chemically synthesized
tcttatttggaaatcttgaggt

SEQ ID NO: 732833 - DNA, 22 bp, Artificial Sequence
  chemically synthesized
cttatttggaaatcttgaggta

SEQ ID NO: 732834 - DNA, 22 bp, Artificial Sequence
  chemically synthesized
ttatttggaaatcttgaggtag

SEQ ID NO: 732835 - DNA, 22 bp, Artificial Sequence
  chemically synthesized
atttggaaatcttgaggtagag

SEQ ID NO: 732836 - DNA, 22 bp, Artificial Sequence
  chemically synthesized
tttggaaatcttgaggtagagc

SEQ ID NO: 732837 - DNA, 22 bp, Artificial Sequence
  chemically synthesized
gatgacctactccagctctacc

SEQ ID NO: 732838 - DNA, 22 bp, Artificial Sequence
  chemically synthesized
ggaaatcttgaggtagagctgg

SEQ ID NO: 732839 - DNA, 22 bp, Artificial Sequence
  chemically synthesized
gaaatcttgaggtagagctgga

SEQ ID NO: 732840 - DNA, 22 bp, Artificial Sequence
  chemically synthesized
gaggtagagctggagtaggtca

SEQ ID NO: 732841 - DNA, 22 bp, Artificial Sequence
  chemically synthesized
aggtagagctggagtaggtcat

SEQ ID NO: 732842 - DNA, 22 bp, Artificial Sequence
  chemically synthesized
tgccaatgaacatgttggatga

SEQ ID NO: 732843 - DNA, 22 bp, Artificial Sequence
  chemically synthesized
gagtaggtcatccaacatgttc

SEQ ID NO: 732844 - DNA, 22 bp, Artificial Sequence
  chemically synthesized
taagctatgccaatgaacatgt

SEQ ID NO: 732845 - DNA, 22 bp, Artificial Sequence
  chemically synthesized
tgtaagctatgccaatgaacat

SEQ ID NO: 732846 - DNA, 22 bp, Artificial Sequence
  chemically synthesized
ttctgtaagctatgccaatgaa

SEQ ID NO: 732847 - DNA, 22 bp, Artificial Sequence
  chemically synthesized
ttgttctgtaagctatgccaat

SEQ ID NO: 732848 - DNA, 22 bp, Artificial Sequence
  chemically synthesized
atgctgttgttctgtaagctat

SEQ ID NO: 732849 - DNA, 22 bp, Artificial Sequence
  chemically synthesized
attggcatagcttacagaacaa

SEQ ID NO: 732850 - DNA, 22 bp, Artificial Sequence
  chemically synthesized
gcatagcttacagaacaacagc

SEQ ID NO: 732851 - DNA, 22 bp, Artificial Sequence
  chemically synthesized
gcaccatgttgatgctgttgtt

SEQ ID NO: 732852 - DNA, 22 bp, Artificial Sequence
  chemically synthesized
tcctggcaccatgttgatgctg

SEQ ID NO: 732853 - DNA, 22 bp, Artificial Sequence
  chemically synthesized
acagaacaacagcatcaacatg

SEQ ID NO: 732854 - DNA, 22 bp, Artificial Sequence
  chemically synthesized
cagaacaacagcatcaacatgg

SEQ ID NO: 732855 - DNA, 22 bp, Artificial Sequence
  chemically synthesized
tctgtcctggcaccatgttgat

SEQ ID NO: 732856 - DNA, 22 bp, Artificial Sequence
  chemically synthesized
cccagatacatcctatctgtcc

SEQ ID NO: 732857 - DNA, 22 bp, Artificial Sequence
  chemically synthesized
ctccccagatacatcctatctg

SEQ ID NO: 732858 - DNA, 22 bp, Artificial Sequence
  chemically synthesized
gctccccagatacatcctatct

SEQ ID NO: 732859 - DNA, 22 bp, Artificial Sequence
  chemically synthesized
gtatcacaccttgctccccaga

SEQ ID NO: 732860 - DNA, 22 bp, Artificial Sequence
  chemically synthesized
tcgtatcacaccttgctcccca

SEQ ID NO: 732861 - DNA, 22 bp, Artificial Sequence
  chemically synthesized
gggagcaaggtgtgatacgaga

SEQ ID NO: 732862 - DNA, 22 bp, Artificial Sequence
  chemically synthesized
ataatacatcccgctctcgtat

SEQ ID NO: 732863 - DNA, 22 bp, Artificial Sequence
  chemically synthesized
ttaataatacatcccgctctcg

SEQ ID NO: 732864 - DNA, 22 bp, Artificial Sequence
  chemically synthesized
aaaaaataatgagaaaaggtag

SEQ ID NO: 732865 - DNA, 22 bp, Artificial Sequence
  chemically synthesized
ttaatagttctaccttttctca

SEQ ID NO: 732866 - DNA, 22 bp, Artificial Sequence
  chemically synthesized
atagttctaccttttctcatta

SEQ ID NO: 732867 - DNA, 22 bp, Artificial Sequence
  chemically synthesized
aagccctgaaaaaataatgaga

SEQ ID NO: 732868 - DNA, 22 bp, Artificial Sequence
  chemically synthesized
taccttttctcattattttttc

SEQ ID NO: 732869 - DNA, 22 bp, Artificial Sequence
  chemically synthesized
ccttttctcattattttttcag

SEQ ID NO: 732870 - DNA, 22 bp, Artificial Sequence
  chemically synthesized
ttctcattattttttcagggct

SEQ ID NO: 732871 - DNA, 22 bp, Artificial Sequence
  chemically synthesized
tctcattattttttcagggctt

SEQ ID NO: 732872 - DNA, 22 bp, Artificial Sequence
  chemically synthesized
ctcattattttttcagggcttg

SEQ ID NO: 732873 - DNA, 22 bp, Artificial Sequence
  chemically synthesized
tcattattttttcagggcttga

SEQ ID NO: 732874 - DNA, 22 bp, Artificial Sequence
  chemically synthesized
attattttttcagggcttgaac

SEQ ID NO: 732875 - DNA, 22 bp, Artificial Sequence
  chemically synthesized
ttttttcagggcttgaacatgt

SEQ ID NO: 732876 - DNA, 22 bp, Artificial Sequence
  chemically synthesized
tttcagggcttgaacatgtttc

SEQ ID NO: 732877 - DNA, 22 bp, Artificial Sequence
  chemically synthesized
ttcagggcttgaacatgtttct

SEQ ID NO: 732878 - DNA, 22 bp, Artificial Sequence
  chemically synthesized
tcagggcttgaacatgtttctt

SEQ ID NO: 732879 - DNA, 22 bp, Artificial Sequence
  chemically synthesized
cagggcttgaacatgtttcttg

SEQ ID NO: 732880 - DNA, 22 bp, Artificial Sequence
  chemically synthesized
agggcttgaacatgtttcttgt

SEQ ID NO: 732881 - DNA, 22 bp, Artificial Sequence
  chemically synthesized
gaacatgtttcttgttggtatc

SEQ ID NO: 732882 - DNA, 22 bp, Artificial Sequence
  chemically synthesized
aacatgtttcttgttggtatcc

SEQ ID NO: 732883 - DNA, 22 bp, Artificial Sequence
  chemically synthesized
cttgttggtatccactcatatt

SEQ ID NO: 732884 - DNA, 22 bp, Artificial Sequence
  chemically synthesized
ttgttggtatccactcatattt

SEQ ID NO: 732885 - DNA, 22 bp, Artificial Sequence
  chemically synthesized
gttggtatccactcatatttat

SEQ ID NO: 732886 - DNA, 22 bp, Artificial Sequence
  chemically synthesized
ttggtatccactcatatttatt

SEQ ID NO: 732887 - DNA, 22 bp, Artificial Sequence
  chemically synthesized
gtatccactcatatttattgcc

SEQ ID NO: 732888 - DNA, 22 bp, Artificial Sequence
  chemically synthesized
atatttattgcctctttcttca

SEQ ID NO: 732889 - DNA, 22 bp, Artificial Sequence
  chemically synthesized
attgcctctttcttcatctcat

SEQ ID NO: 732890 - DNA, 22 bp, Artificial Sequence
  chemically synthesized
ttgcctctttcttcatctcatt

SEQ ID NO: 732891 - DNA, 22 bp, Artificial Sequence
  chemically synthesized
cctctttcttcatctcatttat

SEQ ID NO: 732892 - DNA, 22 bp, Artificial Sequence
  chemically synthesized
gtaatgacacaataaataaatg

SEQ ID NO: 732893 - DNA, 22 bp, Artificial Sequence
  chemically synthesized
tttcttcatctcatttatttat

SEQ ID NO: 732894 - DNA, 22 bp, Artificial Sequence
  chemically synthesized
tcttcatctcatttatttattg

SEQ ID NO: 732895 - DNA, 22 bp, Artificial Sequence
  chemically synthesized
cttcatctcatttatttattgt

SEQ ID NO: 732896 - DNA, 22 bp, Artificial Sequence
  chemically synthesized
ttcatctcatttatttattgtg

SEQ ID NO: 732897 - DNA, 22 bp, Artificial Sequence
  chemically synthesized
agttggtaatgacacaataaat

SEQ ID NO: 732898 - DNA, 22 bp, Artificial Sequence
  chemically synthesized
catctcatttatttattgtgtc

SEQ ID NO: 732899 - DNA, 22 bp, Artificial Sequence
  chemically synthesized
atctcatttatttattgtgtca

SEQ ID NO: 732900 - DNA, 22 bp, Artificial Sequence
  chemically synthesized
ggttaagttggtaatgacacaa

SEQ ID NO: 732901 - DNA, 22 bp, Artificial Sequence
  chemically synthesized
atttatttattgtgtcattacc

SEQ ID NO: 732902 - DNA, 22 bp, Artificial Sequence
  chemically synthesized
atttattgtgtcattaccaact

SEQ ID NO: 732903 - DNA, 22 bp, Artificial Sequence
  chemically synthesized
tttattgtgtcattaccaactt

SEQ ID NO: 732904 - DNA, 22 bp, Artificial Sequence
  chemically synthesized
attgtgtcattaccaacttaac

SEQ ID NO: 732905 - DNA, 22 bp, Artificial Sequence
  chemically synthesized
ttgtgtcattaccaacttaacc

SEQ ID NO: 732906 - DNA, 22 bp, Artificial Sequence
  chemically synthesized
tgtcattaccaacttaacccag

SEQ ID NO: 732907 - DNA, 22 bp, Artificial Sequence
  chemically synthesized
ccaacttaacccagttttattt

SEQ ID NO: 732908 - DNA, 22 bp, Artificial Sequence
  chemically synthesized
aacccagttttatttatcttct

SEQ ID NO: 732909 - DNA, 22 bp, Artificial Sequence
  chemically synthesized
acccagttttatttatcttctt

SEQ ID NO: 732910 - DNA, 22 bp, Artificial Sequence
  chemically synthesized
ccaacaggcagtcaaaaagaag

SEQ ID NO: 732911 - DNA, 22 bp, Artificial Sequence
  chemically synthesized
gccaacaggcagtcaaaaagaa

SEQ ID NO: 732912 - DNA, 22 bp, Artificial Sequence
  chemically synthesized
tgccaacaggcagtcaaaaaga

SEQ ID NO: 732913 - DNA, 22 bp, Artificial Sequence
  chemically synthesized
ttgccaacaggcagtcaaaaag

SEQ ID NO: 732914 - DNA, 22 bp, Artificial Sequence
  chemically synthesized
tttgccaacaggcagtcaaaaa

SEQ ID NO: 732915 - DNA, 22 bp, Artificial Sequence
  chemically synthesized
tatttatcttctttttgactgc

SEQ ID NO: 732916 - DNA, 22 bp, Artificial Sequence
  chemically synthesized
ttttgccaacaggcagtcaaaa

SEQ ID NO: 732917 - DNA, 22 bp, Artificial Sequence
  chemically synthesized
atttatcttctttttgactgcc

SEQ ID NO: 732918 - DNA, 22 bp, Artificial Sequence
  chemically synthesized
tttatcttctttttgactgcct

SEQ ID NO: 732919 - DNA, 22 bp, Artificial Sequence
  chemically synthesized
atcttctttttgactgcctgtt

SEQ ID NO: 732920 - DNA, 22 bp, Artificial Sequence
  chemically synthesized
tcttctttttgactgcctgttg

SEQ ID NO: 732921 - DNA, 22 bp, Artificial Sequence
  chemically synthesized
atatttttttgccaacaggcag

SEQ ID NO: 732922 - DNA, 22 bp, Artificial Sequence
  chemically synthesized
gatatttttttgccaacaggca

SEQ ID NO: 732923 - DNA, 22 bp, Artificial Sequence
  chemically synthesized
tgatatttttttgccaacaggc

SEQ ID NO: 732924 - DNA, 22 bp, Artificial Sequence
  chemically synthesized
ctttttgactgcctgttggcaa

SEQ ID NO: 732925 - DNA, 22 bp, Artificial Sequence
  chemically synthesized
tttttgactgcctgttggcaaa

SEQ ID NO: 732926 - DNA, 22 bp, Artificial Sequence
  chemically synthesized
tttgactgcctgttggcaaaaa

SEQ ID NO: 732927 - DNA, 22 bp, Artificial Sequence
  chemically synthesized
agttttgatatttttttgccaa

SEQ ID NO: 732928 - DNA, 22 bp, Artificial Sequence
  chemically synthesized
ttgactgcctgttggcaaaaaa

SEQ ID NO: 732929 - DNA, 22 bp, Artificial Sequence
  chemically synthesized
aagttttgatatttttttgcca

SEQ ID NO: 732930 - DNA, 22 bp, Artificial Sequence
  chemically synthesized
tgactgcctgttggcaaaaaaa

SEQ ID NO: 732931 - DNA, 22 bp, Artificial Sequence
  chemically synthesized
gactgcctgttggcaaaaaaat

SEQ ID NO: 732932 - DNA, 22 bp, Artificial Sequence
  chemically synthesized
ttaagttttgatatttttttgc

SEQ ID NO: 732933 - DNA, 22 bp, Artificial Sequence
  chemically synthesized
actgcctgttggcaaaaaaata

SEQ ID NO: 732934 - DNA, 22 bp, Artificial Sequence
  chemically synthesized
cttaagttttgatatttttttg

SEQ ID NO: 732935 - DNA, 22 bp, Artificial Sequence
  chemically synthesized
tcttaagttttgatattttttt

SEQ ID NO: 732936 - DNA, 22 bp, Artificial Sequence
  chemically synthesized
ttcttaagttttgatatttttt

SEQ ID NO: 732937 - DNA, 22 bp, Artificial Sequence
  chemically synthesized
cctgttggcaaaaaaatatcaa

SEQ ID NO: 732938 - DNA, 22 bp, Artificial Sequence
  chemically synthesized
ttggcaaaaaaatatcaaaact

SEQ ID NO: 732939 - DNA, 22 bp, Artificial Sequence
  chemically synthesized
gcaaaaaaatatcaaaacttaa

SEQ ID NO: 732940 - DNA, 22 bp, Artificial Sequence
  chemically synthesized
gaaaacacccatttttcttaag

SEQ ID NO: 732941 - DNA, 22 bp, Artificial Sequence
  chemically synthesized
tagaaaacacccatttttctta

SEQ ID NO: 732942 - DNA, 22 bp, Artificial Sequence
  chemically synthesized
ctagaaaacacccatttttctt

SEQ ID NO: 732943 - DNA, 22 bp, Artificial Sequence
  chemically synthesized
tctagaaaacacccatttttct

SEQ ID NO: 732944 - DNA, 22 bp, Artificial Sequence
  chemically synthesized
cccaactttctagaaaacaccc

SEQ ID NO: 732945 - DNA, 22 bp, Artificial Sequence
  chemically synthesized
acccaactttctagaaaacacc

SEQ ID NO: 732946 - DNA, 22 bp, Artificial Sequence
  chemically synthesized
tacccaactttctagaaaacac

SEQ ID NO: 732947 - DNA, 22 bp, Artificial Sequence
  chemically synthesized
aagaaaaatgggtgttttctag

SEQ ID NO: 732948 - DNA, 22 bp, Artificial Sequence
  chemically synthesized
ttacccaactttctagaaaaca

SEQ ID NO: 732949 - DNA, 22 bp, Artificial Sequence
  chemically synthesized
agaaaaatgggtgttttctaga

SEQ ID NO: 732950 - DNA, 22 bp, Artificial Sequence
  chemically synthesized
tctagaaagttgggtaaaaata

SEQ ID NO: 732951 - DNA, 22 bp, Artificial Sequence
  chemically synthesized
ctagaaagttgggtaaaaatac

SEQ ID NO: 732952 - DNA, 22 bp, Artificial Sequence
  chemically synthesized
tagaaagttgggtaaaaataca

SEQ ID NO: 732953 - DNA, 22 bp, Artificial Sequence
  chemically synthesized
gaaagttgggtaaaaatacact

SEQ ID NO: 732954 - DNA, 22 bp, Artificial Sequence
  chemically synthesized
agcaacaaaacaatagtgtatt

SEQ ID NO: 732955 - DNA, 22 bp, Artificial Sequence
  chemically synthesized
ggtaaaaatacactattgtttt

SEQ ID NO: 732956 - DNA, 22 bp, Artificial Sequence
  chemically synthesized
ttgttttgttgcttaatttctt

SEQ ID NO: 732957 - DNA, 22 bp, Artificial Sequence
  chemically synthesized
ttttgttgcttaatttctttat

SEQ ID NO: 732958 - DNA, 22 bp, Artificial Sequence
  chemically synthesized
tgttgcttaatttctttatgct

SEQ ID NO: 732959 - DNA, 22 bp, Artificial Sequence
  chemically synthesized
acagagcaaggcagcataaaga

SEQ ID NO: 732960 - DNA, 22 bp, Artificial Sequence
  chemically synthesized
gttgcttaatttctttatgctg

SEQ ID NO: 732961 - DNA, 22 bp, Artificial Sequence
  chemically synthesized
ttgcttaatttctttatgctgc

SEQ ID NO: 732962 - DNA, 22 bp, Artificial Sequence
  chemically synthesized
ttcacagagcaaggcagcataa

SEQ ID NO: 732963 - DNA, 22 bp, Artificial Sequence
  chemically synthesized
gttcacagagcaaggcagcata

SEQ ID NO: 732964 - DNA, 22 bp, Artificial Sequence
  chemically synthesized
cttaatttctttatgctgcctt

SEQ ID NO: 732965 - DNA, 22 bp, Artificial Sequence
  chemically synthesized
tgttcacagagcaaggcagcat

SEQ ID NO: 732966 - DNA, 22 bp, Artificial Sequence
  chemically synthesized
aatttctttatgctgccttgct

SEQ ID NO: 732967 - DNA, 22 bp, Artificial Sequence
  chemically synthesized
ctttgttcacagagcaaggcag

SEQ ID NO: 732968 - DNA, 22 bp, Artificial Sequence
  chemically synthesized
atttctttatgctgccttgctc

SEQ ID NO: 732969 - DNA, 22 bp, Artificial Sequence
  chemically synthesized
tactttgttcacagagcaaggc

SEQ ID NO: 732970 - DNA, 22 bp, Artificial Sequence
  chemically synthesized
ctactttgttcacagagcaagg

SEQ ID NO: 732971 - DNA, 22 bp, Artificial Sequence
  chemically synthesized
tctactttgttcacagagcaag

SEQ ID NO: 732972 - DNA, 22 bp, Artificial Sequence
  chemically synthesized
ctttatgctgccttgctctgtg

SEQ ID NO: 732973 - DNA, 22 bp, Artificial Sequence
  chemically synthesized
tttatgctgccttgctctgtga

SEQ ID NO: 732974 - DNA, 22 bp, Artificial Sequence
  chemically synthesized
ttttctactttgttcacagagc

SEQ ID NO: 732975 - DNA, 22 bp, Artificial Sequence
  chemically synthesized
tatgctgccttgctctgtgaac

SEQ ID NO: 732976 - DNA, 22 bp, Artificial Sequence
  chemically synthesized
atgctgccttgctctgtgaaca

SEQ ID NO: 732977 - DNA, 22 bp, Artificial Sequence
  chemically synthesized
tgctgccttgctctgtgaacaa

SEQ ID NO: 732978 - DNA, 22 bp, Artificial Sequence
  chemically synthesized
ccttgctctgtgaacaaagtag

SEQ ID NO: 732979 - DNA, 22 bp, Artificial Sequence
  chemically synthesized
gctctgtgaacaaagtagaaaa

SEQ ID NO: 732980 - DNA, 22 bp, Artificial Sequence
  chemically synthesized
ctctgtgaacaaagtagaaaat

SEQ ID NO: 732981 - DNA, 22 bp, Artificial Sequence
  chemically synthesized
tgtgaacaaagtagaaaataat

SEQ ID NO: 732982 - DNA, 22 bp, Artificial Sequence
  chemically synthesized
caaaataaatgtattattttct

SEQ ID NO: 732983 - DNA, 22 bp, Artificial Sequence
  chemically synthesized
ccaaaataaatgtattattttc

SEQ ID NO: 732984 - DNA, 22 bp, Artificial Sequence
  chemically synthesized
tgaacaaagtagaaaataatac

SEQ ID NO: 732985 - DNA, 22 bp, Artificial Sequence
  chemically synthesized
tccaaaataaatgtattatttt

SEQ ID NO: 732986 - DNA, 22 bp, Artificial Sequence
  chemically synthesized
ttttccaaaataaatgtattat

SEQ ID NO: 732987 - DNA, 22 bp, Artificial Sequence
  chemically synthesized
attttccaaaataaatgtatta

SEQ ID NO: 732988 - DNA, 22 bp, Artificial Sequence
  chemically synthesized
agcttattttccaaaataaatg

SEQ ID NO: 732989 - DNA, 22 bp, Artificial Sequence
  chemically synthesized
ttgagcttattttccaaaataa

SEQ ID NO: 732990 - DNA, 22 bp, Artificial Sequence
  chemically synthesized
attgagcttattttccaaaata

SEQ ID NO: 732991 - DNA, 22 bp, Artificial Sequence
  chemically synthesized
tattgagcttattttccaaaat

SEQ ID NO: 732992 - DNA, 22 bp, Artificial Sequence
  chemically synthesized
tctttattgagcttattttcca

SEQ ID NO: 732993 - DNA, 22 bp, Artificial Sequence
  chemically synthesized
ctgtctttattgagcttatttt

SEQ ID NO: 732994 - DNA, 22 bp, Artificial Sequence
  chemically synthesized
actcctgtctttattgagctta

SEQ ID NO: 732995 - DNA, 22 bp, Artificial Sequence
  chemically synthesized
attttggaaaataagctcaata

SEQ ID NO: 732996 - DNA, 22 bp, Artificial Sequence
  chemically synthesized
ttttggaaaataagctcaataa

SEQ ID NO: 732997 - DNA, 22 bp, Artificial Sequence
  chemically synthesized
ctaactcctgtctttattgagc

SEQ ID NO: 732998 - DNA, 22 bp, Artificial Sequence
  chemically synthesized
tggaaaataagctcaataaaga

SEQ ID NO: 732999 - DNA, 22 bp, Artificial Sequence
  chemically synthesized
ggaaaataagctcaataaagac

SEQ ID NO: 733000 - DNA, 22 bp, Artificial Sequence
  chemically synthesized
gaaaataagctcaataaagaca

SEQ ID NO: 733001 - DNA, 22 bp, Artificial Sequence
  chemically synthesized
gtcaagggacggttcctaactc

SEQ ID NO: 733002 - DNA, 22 bp, Artificial Sequence
  chemically synthesized
aataaagacaggagttaggaac

SEQ ID NO: 733003 - DNA, 22 bp, Artificial Sequence
  chemically synthesized
agtagttagtcaagggacggtt

SEQ ID NO: 733004 - DNA, 22 bp, Artificial Sequence
  chemically synthesized
cctcagtagttagtcaagggac

SEQ ID NO: 733005 - DNA, 22 bp, Artificial Sequence
  chemically synthesized
ccctcagtagttagtcaaggga

SEQ ID NO: 733006 - DNA, 22 bp, Artificial Sequence
  chemically synthesized
tccctcagtagttagtcaaggg

SEQ ID NO: 733007 - DNA, 22 bp, Artificial Sequence
  chemically synthesized
ggaaccgtcccttgactaacta

SEQ ID NO: 733008 - DNA, 22 bp, Artificial Sequence
  chemically synthesized
tagaaagggctttccctcagta

SEQ ID NO: 733009 - DNA, 22 bp, Artificial Sequence
  chemically synthesized
tatagaaagggctttccctcag

SEQ ID NO: 733010 - DNA, 22 bp, Artificial Sequence
  chemically synthesized
gactaactactgagggaaagcc

SEQ ID NO: 733011 - DNA, 22 bp, Artificial Sequence
  chemically synthesized
ttctatagaaagggctttccct

SEQ ID NO: 733012 - DNA, 22 bp, Artificial Sequence
  chemically synthesized
actaactactgagggaaagccc

SEQ ID NO: 733013 - DNA, 22 bp, Artificial Sequence
  chemically synthesized
tattctatagaaagggctttcc

SEQ ID NO: 733014 - DNA, 22 bp, Artificial Sequence
  chemically synthesized
actactgagggaaagccctttc

SEQ ID NO: 733015 - DNA, 22 bp, Artificial Sequence
  chemically synthesized
ctgagggaaagccctttctata

SEQ ID NO: 733016 - DNA, 22 bp, Artificial Sequence
  chemically synthesized
agggaaagccctttctatagaa

SEQ ID NO: 733017 - DNA, 22 bp, Artificial Sequence
  chemically synthesized
acaggatgtaaattctattcta

SEQ ID NO: 733018 - DNA, 22 bp, Artificial Sequence
  chemically synthesized
tctatagaatagaatttacatc

SEQ ID NO: 733019 - DNA, 22 bp, Artificial Sequence
  chemically synthesized
ctatagaatagaatttacatcc

SEQ ID NO: 733020 - DNA, 22 bp, Artificial Sequence
  chemically synthesized
tatagaatagaatttacatcct

SEQ ID NO: 733021 - DNA, 22 bp, Artificial Sequence
  chemically synthesized
tagaatagaatttacatcctgt

SEQ ID NO: 733022 - DNA, 22 bp, Artificial Sequence
  chemically synthesized
aaaacatgaccaactcacagga

SEQ ID NO: 733023 - DNA, 22 bp, Artificial Sequence
  chemically synthesized
ctaaaaacatgaccaactcaca

SEQ ID NO: 733024 - DNA, 22 bp, Artificial Sequence
  chemically synthesized
actaaaaacatgaccaactcac

SEQ ID NO: 733025 - DNA, 22 bp, Artificial Sequence
  chemically synthesized
acatcctgtgagttggtcatgt

SEQ ID NO: 733026 - DNA, 22 bp, Artificial Sequence
  chemically synthesized
catcctgtgagttggtcatgtt

SEQ ID NO: 733027 - DNA, 22 bp, Artificial Sequence
  chemically synthesized
atccatcttactaaaaacatga

SEQ ID NO: 733028 - DNA, 22 bp, Artificial Sequence
  chemically synthesized
aatccatcttactaaaaacatg

SEQ ID NO: 733029 - DNA, 22 bp, Artificial Sequence
  chemically synthesized
tgagttggtcatgtttttagta

SEQ ID NO: 733030 - DNA, 22 bp, Artificial Sequence
  chemically synthesized
gtcatgtttttagtaagatgga

SEQ ID NO: 733031 - DNA, 22 bp, Artificial Sequence
  chemically synthesized
gacatatacatgcaatttaatc

SEQ ID NO: 733032 - DNA, 22 bp, Artificial Sequence
  chemically synthesized
ttagtaagatggattaaattgc

SEQ ID NO: 733033 - DNA, 22 bp, Artificial Sequence
  chemically synthesized
tagtaagatggattaaattgca

SEQ ID NO: 733034 - DNA, 22 bp, Artificial Sequence
  chemically synthesized
tggacatatacatgcaatttaa

SEQ ID NO: 733035 - DNA, 22 bp, Artificial Sequence
  chemically synthesized
agtaagatggattaaattgcat

SEQ ID NO: 733036 - DNA, 22 bp, Artificial Sequence
  chemically synthesized
gtaagatggattaaattgcatg

SEQ ID NO: 733037 - DNA, 22 bp, Artificial Sequence
  chemically synthesized
actctggacatatacatgcaat

SEQ ID NO: 733038 - DNA, 22 bp, Artificial Sequence
  chemically synthesized
attgactctggacatatacatg

SEQ ID NO: 733039 - DNA, 22 bp, Artificial Sequence
  chemically synthesized
ccattaattgactctggacata

SEQ ID NO: 733040 - DNA, 22 bp, Artificial Sequence
  chemically synthesized
aattgcatgtatatgtccagag

SEQ ID NO: 733041 - DNA, 22 bp, Artificial Sequence
  chemically synthesized
cccattaattgactctggacat

SEQ ID NO: 733042 - DNA, 22 bp, Artificial Sequence
  chemically synthesized
catgtatatgtccagagtcaat

SEQ ID NO: 733043 - DNA, 22 bp, Artificial Sequence
  chemically synthesized
tgtttcccattaattgactctg

SEQ ID NO: 733044 - DNA, 22 bp, Artificial Sequence
  chemically synthesized
tatgtttcccattaattgactc

SEQ ID NO: 733045 - DNA, 22 bp, Artificial Sequence
  chemically synthesized
gttctatgtttcccattaattg

SEQ ID NO: 733046 - DNA, 22 bp, Artificial Sequence
  chemically synthesized
tggttctatgtttcccattaat

SEQ ID NO: 733047 - DNA, 22 bp, Artificial Sequence
  chemically synthesized
gattctggttctatgtttccca

SEQ ID NO: 733048 - DNA, 22 bp, Artificial Sequence
  chemically synthesized
ggattctggttctatgtttccc

SEQ ID NO: 733049 - DNA, 22 bp, Artificial Sequence
  chemically synthesized
acttggattctggttctatgtt

SEQ ID NO: 733050 - DNA, 22 bp, Artificial Sequence
  chemically synthesized
atgggaaacatagaaccagaat

SEQ ID NO: 733051 - DNA, 22 bp, Artificial Sequence
  chemically synthesized
agaaagaagtaatggacaaaat

SEQ ID NO: 733052 - DNA, 22 bp, Artificial Sequence
  chemically synthesized
gagaaagaagtaatggacaaaa

SEQ ID NO: 733053 - DNA, 22 bp, Artificial Sequence
  chemically synthesized
ttgagaaagaagtaatggacaa

SEQ ID NO: 733054 - DNA, 22 bp, Artificial Sequence
  chemically synthesized
ctcttgagaaagaagtaatgga

SEQ ID NO: 733055 - DNA, 22 bp, Artificial Sequence
  chemically synthesized
actcttgagaaagaagtaatgg

SEQ ID NO: 733056 - DNA, 22 bp, Artificial Sequence
  chemically synthesized
tgtccattacttctttctcaag

SEQ ID NO: 733057 - DNA, 22 bp, Artificial Sequence
  chemically synthesized
agggtgtttactcttgagaaag

SEQ ID NO: 733058 - DNA, 22 bp, Artificial Sequence
  chemically synthesized
gtccattacttctttctcaaga

SEQ ID NO: 733059 - DNA, 22 bp, Artificial Sequence
  chemically synthesized
tccattacttctttctcaagag

SEQ ID NO: 733060 - DNA, 22 bp, Artificial Sequence
  chemically synthesized
cttctttctcaagagtaaacac

SEQ ID NO: 733061 - DNA, 22 bp, Artificial Sequence
  chemically synthesized
tcatccagctgagggtgtttac

SEQ ID NO: 733062 - DNA, 22 bp, Artificial Sequence
  chemically synthesized
ctttctcaagagtaaacaccct

SEQ ID NO: 733063 - DNA, 22 bp, Artificial Sequence
  chemically synthesized
gtcatccagctgagggtgttta

SEQ ID NO: 733064 - DNA, 22 bp, Artificial Sequence
  chemically synthesized
tttctcaagagtaaacaccctc

SEQ ID NO: 733065 - DNA, 22 bp, Artificial Sequence
  chemically synthesized
tctcaagagtaaacaccctcag

SEQ ID NO: 733066 - DNA, 22 bp, Artificial Sequence
  chemically synthesized
tttgtcatccagctgagggtgt

SEQ ID NO: 733067 - DNA, 22 bp, Artificial Sequence
  chemically synthesized
ctcaagagtaaacaccctcagc

SEQ ID NO: 733068 - DNA, 22 bp, Artificial Sequence
  chemically synthesized
tcaagagtaaacaccctcagct

SEQ ID NO: 733069 - DNA, 22 bp, Artificial Sequence
  chemically synthesized
aagagtaaacaccctcagctgg

SEQ ID NO: 733070 - DNA, 22 bp, Artificial Sequence
  chemically synthesized
gcaatcattatttgtcatccag

SEQ ID NO: 733071 - DNA, 22 bp, Artificial Sequence
  chemically synthesized
cctggcaatcattatttgtcat

SEQ ID NO: 733072 - DNA, 22 bp, Artificial Sequence
  chemically synthesized
gcctggcaatcattatttgtca

SEQ ID NO: 733073 - DNA, 22 bp, Artificial Sequence
  chemically synthesized
agctggatgacaaataatgatt

SEQ ID NO: 733074 - DNA, 22 bp, Artificial Sequence
  chemically synthesized
gatgacaaataatgattgccag

SEQ ID NO: 733075 - DNA, 22 bp, Artificial Sequence
  chemically synthesized
tagaggtaataacataaacctt

SEQ ID NO: 733076 - DNA, 22 bp, Artificial Sequence
  chemically synthesized
gtagaggtaataacataaacct

SEQ ID NO: 733077 - DNA, 22 bp, Artificial Sequence
  chemically synthesized
cttgtagaggtaataacataaa

SEQ ID NO: 733078 - DNA, 22 bp, Artificial Sequence
  chemically synthesized
ccaggcaaggtttatgttatta

SEQ ID NO: 733079 - DNA, 22 bp, Artificial Sequence
  chemically synthesized
ctacttgtagaggtaataacat

SEQ ID NO: 733080 - DNA, 22 bp, Artificial Sequence
  chemically synthesized
cctacttgtagaggtaataaca

SEQ ID NO: 733081 - DNA, 22 bp, Artificial Sequence
  chemically synthesized
catcaacttcctacttgtagag

SEQ ID NO: 733082 - DNA, 22 bp, Artificial Sequence
  chemically synthesized
gcatcaacttcctacttgtaga

SEQ ID NO: 733083 - DNA, 22 bp, Artificial Sequence
  chemically synthesized
atgttattacctctacaagtag

SEQ ID NO: 733084 - DNA, 22 bp, Artificial Sequence
  chemically synthesized
tgcatcaacttcctacttgtag

SEQ ID NO: 733085 - DNA, 22 bp, Artificial Sequence
  chemically synthesized
tgttattacctctacaagtagg

SEQ ID NO: 733086 - DNA, 22 bp, Artificial Sequence
  chemically synthesized
ctttgcatcaacttcctacttg

SEQ ID NO: 733087 - DNA, 22 bp, Artificial Sequence
  chemically synthesized
gctttgcatcaacttcctactt

SEQ ID NO: 733088 - DNA, 22 bp, Artificial Sequence
  chemically synthesized
tgctttgcatcaacttcctact

SEQ ID NO: 733089 - DNA, 22 bp, Artificial Sequence
  chemically synthesized
ttacctctacaagtaggaagtt

SEQ ID NO: 733090 - DNA, 22 bp, Artificial Sequence
  chemically synthesized
cctctacaagtaggaagttgat

SEQ ID NO: 733091 - DNA, 22 bp, Artificial Sequence
  chemically synthesized
tacaagtaggaagttgatgcaa

SEQ ID NO: 733092 - DNA, 22 bp, Artificial Sequence
  chemically synthesized
caagtaggaagttgatgcaaag

SEQ ID NO: 733093 - DNA, 22 bp, Artificial Sequence
  chemically synthesized
atgcaaagcaaaactctcacct

SEQ ID NO: 733094 - DNA, 22 bp, Artificial Sequence
  chemically synthesized
aaaaaaacagatgtcaggtgag

SEQ ID NO: 733095 - DNA, 22 bp, Artificial Sequence
  chemically synthesized
taagggtgattaaaaaaaacag

SEQ ID NO: 733096 - DNA, 22 bp, Artificial Sequence
  chemically synthesized
tcacctgacatctgtttttttt

SEQ ID NO: 733097 - DNA, 22 bp, Artificial Sequence
  chemically synthesized
acctgacatctgttttttttaa

SEQ ID NO: 733098 - DNA, 22 bp, Artificial Sequence
  chemically synthesized
ctataagggtgattaaaaaaaa

SEQ ID NO: 733099 - DNA, 22 bp, Artificial Sequence
  chemically synthesized
gctataagggtgattaaaaaaa

SEQ ID NO: 733100 - DNA, 22 bp, Artificial Sequence
  chemically synthesized
acatctgttttttttaatcacc

SEQ ID NO: 733101 - DNA, 22 bp, Artificial Sequence
  chemically synthesized
acttgctataagggtgattaaa

SEQ ID NO: 733102 - DNA, 22 bp, Artificial Sequence
  chemically synthesized
aaactaacttgctataagggtg

SEQ ID NO: 733103 - DNA, 22 bp, Artificial Sequence
  chemically synthesized
ttttttttaatcacccttatag

SEQ ID NO: 733104 - DNA, 22 bp, Artificial Sequence
  chemically synthesized
aaaactaacttgctataagggt

SEQ ID NO: 733105 - DNA, 22 bp, Artificial Sequence
  chemically synthesized
taaaactaacttgctataaggg

SEQ ID NO: 733106 - DNA, 22 bp, Artificial Sequence
  chemically synthesized
tttttaatcacccttatagcaa

SEQ ID NO: 733107 - DNA, 22 bp, Artificial Sequence
  chemically synthesized
tttaaaactaacttgctataag

SEQ ID NO: 733108 - DNA, 22 bp, Artificial Sequence
  chemically synthesized
ttttaatcacccttatagcaag

SEQ ID NO: 733109 - DNA, 22 bp, Artificial Sequence
  chemically synthesized
ctttaaaactaacttgctataa

SEQ ID NO: 733110 - DNA, 22 bp, Artificial Sequence
  chemically synthesized
tttaatcacccttatagcaagt

SEQ ID NO: 733111 - DNA, 22 bp, Artificial Sequence
  chemically synthesized
ttaatcacccttatagcaagtt

SEQ ID NO: 733112 - DNA, 22 bp, Artificial Sequence
  chemically synthesized
taatcacccttatagcaagtta

SEQ ID NO: 733113 - DNA, 22 bp, Artificial Sequence
  chemically synthesized
aatcacccttatagcaagttag

SEQ ID NO: 733114 - DNA, 22 bp, Artificial Sequence
  chemically synthesized
acttctttaaaactaacttgct

SEQ ID NO: 733115 - DNA, 22 bp, Artificial Sequence
  chemically synthesized
atcacccttatagcaagttagt

SEQ ID NO: 733116 - DNA, 22 bp, Artificial Sequence
  chemically synthesized
tcacttctttaaaactaacttg

SEQ ID NO: 733117 - DNA, 22 bp, Artificial Sequence
  chemically synthesized
ctcacttctttaaaactaactt

SEQ ID NO: 733118 - DNA, 22 bp, Artificial Sequence
  chemically synthesized
tctcacttctttaaaactaact

SEQ ID NO: 733119 - DNA, 22 bp, Artificial Sequence
  chemically synthesized
atagcaagttagttttaaagaa

SEQ ID NO: 733120 - DNA, 22 bp, Artificial Sequence
  chemically synthesized
tagcaagttagttttaaagaag

SEQ ID NO: 733121 - DNA, 22 bp, Artificial Sequence
  chemically synthesized
acgcatgtctttctcacttctt

SEQ ID NO: 733122 - DNA, 22 bp, Artificial Sequence
  chemically synthesized
ttcacgcatgtctttctcactt

SEQ ID NO: 733123 - DNA, 22 bp, Artificial Sequence
  chemically synthesized
gttttaaagaagtgagaaagac

SEQ ID NO: 733124 - DNA, 22 bp, Artificial Sequence
  chemically synthesized
cctgttcacgcatgtctttctc

SEQ ID NO: 733125 - DNA, 22 bp, Artificial Sequence
  chemically synthesized
taaagaagtgagaaagacatgc

SEQ ID NO: 733126 - DNA, 22 bp, Artificial Sequence
  chemically synthesized
aaagaagtgagaaagacatgcg

SEQ ID NO: 733127 - DNA, 22 bp, Artificial Sequence
  chemically synthesized
aagaagtgagaaagacatgcgt

SEQ ID NO: 733128 - DNA, 22 bp, Artificial Sequence
  chemically synthesized
ggagcaaaattgcctgttcacg

SEQ ID NO: 733129 - DNA, 22 bp, Artificial Sequence
  chemically synthesized
atctgggagcaaaattgcctgt

SEQ ID NO: 733130 - DNA, 22 bp, Artificial Sequence
  chemically synthesized
gatctgggagcaaaattgcctg

SEQ ID NO: 733131 - DNA, 22 bp, Artificial Sequence
  chemically synthesized
taagaagaagtttgatctggga

SEQ ID NO: 733132 - DNA, 22 bp, Artificial Sequence
  chemically synthesized
gttataagaagaagtttgatct

SEQ ID NO: 733133 - DNA, 22 bp, Artificial Sequence
  chemically synthesized
tgctcccagatcaaacttcttc

SEQ ID NO: 733134 - DNA, 22 bp, Artificial Sequence
  chemically synthesized
gctcccagatcaaacttcttct

SEQ ID NO: 733135 - DNA, 22 bp, Artificial Sequence
  chemically synthesized
ctcccagatcaaacttcttctt

SEQ ID NO: 733136 - DNA, 22 bp, Artificial Sequence
  chemically synthesized
ccagatcaaacttcttcttata

SEQ ID NO: 733137 - DNA, 22 bp, Artificial Sequence
  chemically synthesized
gaacatgaagccacgtctggtt

SEQ ID NO: 733138 - DNA, 22 bp, Artificial Sequence
  chemically synthesized
ctggaacatgaagccacgtctg

SEQ ID NO: 733139 - DNA, 22 bp, Artificial Sequence
  chemically synthesized
cttcttataaccagacgtggct

SEQ ID NO: 733140 - DNA, 22 bp, Artificial Sequence
  chemically synthesized
gctggaacatgaagccacgtct

SEQ ID NO: 733141 - DNA, 22 bp, Artificial Sequence
  chemically synthesized
ttcttataaccagacgtggctt

SEQ ID NO: 733142 - DNA, 22 bp, Artificial Sequence
  chemically synthesized
tgctggaacatgaagccacgtc

SEQ ID NO: 733143 - DNA, 22 bp, Artificial Sequence
  chemically synthesized
cttataaccagacgtggcttca

SEQ ID NO: 733144 - DNA, 22 bp, Artificial Sequence
  chemically synthesized
ttataaccagacgtggcttcat

SEQ ID NO: 733145 - DNA, 22 bp, Artificial Sequence
  chemically synthesized
ctttgctggaacatgaagccac

SEQ ID NO: 733146 - DNA, 22 bp, Artificial Sequence
  chemically synthesized
gctttgctggaacatgaagcca

SEQ ID NO: 733147 - DNA, 22 bp, Artificial Sequence
  chemically synthesized
ataaccagacgtggcttcatgt

SEQ ID NO: 733148 - DNA, 22 bp, Artificial Sequence
  chemically synthesized
taaccagacgtggcttcatgtt

SEQ ID NO: 733149 - DNA, 22 bp, Artificial Sequence
  chemically synthesized
ggaatatcttgctttgctggaa

SEQ ID NO: 733150 - DNA, 22 bp, Artificial Sequence
  chemically synthesized
tggcctgggaatatcttgcttt

SEQ ID NO: 733151 - DNA, 22 bp, Artificial Sequence
  chemically synthesized
catgttccagcaaagcaagata

SEQ ID NO: 733152 - DNA, 22 bp, Artificial Sequence
  chemically synthesized
atggcctgggaatatcttgctt

SEQ ID NO: 733153 - DNA, 22 bp, Artificial Sequence
  chemically synthesized
atgttccagcaaagcaagatat

SEQ ID NO: 733154 - DNA, 22 bp, Artificial Sequence
  chemically synthesized
ccttatggcctgggaatatctt

SEQ ID NO: 733155 - DNA, 22 bp, Artificial Sequence
  chemically synthesized
cagcaaagcaagatattcccag

SEQ ID NO: 733156 - DNA, 22 bp, Artificial Sequence
  chemically synthesized
ttaccttatggcctgggaatat

SEQ ID NO: 733157 - DNA, 22 bp, Artificial Sequence
  chemically synthesized
gttaccttatggcctgggaata

SEQ ID NO: 733158 - DNA, 22 bp, Artificial Sequence
  chemically synthesized
tgttaccttatggcctgggaat

SEQ ID NO: 733159 - DNA, 22 bp, Artificial Sequence
  chemically synthesized
ccaggccataaggtaacaaagg

SEQ ID NO: 733160 - DNA, 22 bp, Artificial Sequence
  chemically synthesized
atagaagtgagaaatgtggaca

SEQ ID NO: 733161 - DNA, 22 bp, Artificial Sequence
  chemically synthesized
ggacactgtggtgtccacattt

SEQ ID NO: 733162 - DNA, 22 bp, Artificial Sequence
  chemically synthesized
attcatagaagtgagaaatgtg

SEQ ID NO: 733163 - DNA, 22 bp, Artificial Sequence
  chemically synthesized
tggtgtccacatttctcacttc

SEQ ID NO: 733164 - DNA, 22 bp, Artificial Sequence
  chemically synthesized
tgggcactcattcatagaagtg

SEQ ID NO: 733165 - DNA, 22 bp, Artificial Sequence
  chemically synthesized
ctgtgggcactcattcatagaa

SEQ ID NO: 733166 - DNA, 22 bp, Artificial Sequence
  chemically synthesized
ctcacttctatgaatgagtgcc

SEQ ID NO: 733167 - DNA, 22 bp, Artificial Sequence
  chemically synthesized
tcacttctatgaatgagtgccc

SEQ ID NO: 733168 - DNA, 22 bp, Artificial Sequence
  chemically synthesized
acttctatgaatgagtgcccac

SEQ ID NO: 733169 - DNA, 22 bp, Artificial Sequence
  chemically synthesized
tgaacacattcctgtgggcact

SEQ ID NO: 733170 - DNA, 22 bp, Artificial Sequence
  chemically synthesized
ctatgaatgagtgcccacagga

SEQ ID NO: 733171 - DNA, 22 bp, Artificial Sequence
  chemically synthesized
tatgaatgagtgcccacaggaa

SEQ ID NO: 733172 - DNA, 22 bp, Artificial Sequence
  chemically synthesized
tgaatgagtgcccacaggaatg

SEQ ID NO: 733173 - DNA, 22 bp, Artificial Sequence
  chemically synthesized
catgttatgaacacattcctgt

SEQ ID NO: 733174 - DNA, 22 bp, Artificial Sequence
  chemically synthesized
ttacatgttatgaacacattcc

SEQ ID NO: 733175 - DNA, 22 bp, Artificial Sequence
  chemically synthesized
gttacatgttatgaacacattc

SEQ ID NO: 733176 - DNA, 22 bp, Artificial Sequence
  chemically synthesized
tgttacatgttatgaacacatt

SEQ ID NO: 733177 - DNA, 22 bp, Artificial Sequence
  chemically synthesized
actttgttacatgttatgaaca

SEQ ID NO: 733178 - DNA, 22 bp, Artificial Sequence
  chemically synthesized
acaagttgactttgttacatgt

SEQ ID NO: 733179 - DNA, 22 bp, Artificial Sequence
  chemically synthesized
ataacatgtaacaaagtcaact

SEQ ID NO: 733180 - DNA, 22 bp, Artificial Sequence
  chemically synthesized
gtgagttgctgatacacatctc

SEQ ID NO: 733181 - DNA, 22 bp, Artificial Sequence
  chemically synthesized
tatgacataagagagatgtgta

SEQ ID NO: 733182 - DNA, 22 bp, Artificial Sequence
  chemically synthesized
tgagttgctgatacacatctct

SEQ ID NO: 733183 - DNA, 22 bp, Artificial Sequence
  chemically synthesized
ctgatacacatctctcttatgt

SEQ ID NO: 733184 - DNA, 22 bp, Artificial Sequence
  chemically synthesized
atacacatctctcttatgtcat

SEQ ID NO: 733185 - DNA, 22 bp, Artificial Sequence
  chemically synthesized
atggcagcagttgtatgacata

SEQ ID NO: 733186 - DNA, 22 bp, Artificial Sequence
  chemically synthesized
tcttatgtcatacaactgctgc

SEQ ID NO: 733187 - DNA, 22 bp, Artificial Sequence
  chemically synthesized
ttatgtcatacaactgctgcca

SEQ ID NO: 733188 - DNA, 22 bp, Artificial Sequence
  chemically synthesized
atgtcatacaactgctgccatt

SEQ ID NO: 733189 - DNA, 22 bp, Artificial Sequence
  chemically synthesized
ccatgaatcgctaatggcagca

SEQ ID NO: 733190 - DNA, 22 bp, Artificial Sequence
  chemically synthesized
tgtcatacaactgctgccatta

SEQ ID NO: 733191 - DNA, 22 bp, Artificial Sequence
  chemically synthesized
ctgccattagcgattcatggca

SEQ ID NO: 733192 - DNA, 22 bp, Artificial Sequence
  chemically synthesized
ccgggcaaggacactgccatga

SEQ ID NO: 733193 - DNA, 22 bp, Artificial Sequence
  chemically synthesized
ccattagcgattcatggcagtg

SEQ ID NO: 733194 - DNA, 22 bp, Artificial Sequence
  chemically synthesized
gcgattcatggcagtgtccttg

SEQ ID NO: 733195 - DNA, 22 bp, Artificial Sequence
  chemically synthesized
atggcagtgtccttgcccggca

SEQ ID NO: 733196 - DNA, 22 bp, Artificial Sequence
  chemically synthesized
gatatgcatgactgccgggcaa

SEQ ID NO: 733197 - DNA, 22 bp, Artificial Sequence
  chemically synthesized
ggatatgcatgactgccgggca

SEQ ID NO: 733198 - DNA, 22 bp, Artificial Sequence
  chemically synthesized
atttggatatgcatgactgccg

SEQ ID NO: 733199 - DNA, 22 bp, Artificial Sequence
  chemically synthesized
gcccggcagtcatgcatatcca

SEQ ID NO: 733200 - DNA, 22 bp, Artificial Sequence
  chemically synthesized
cccggcagtcatgcatatccaa

SEQ ID NO: 733201 - DNA, 22 bp, Artificial Sequence
  chemically synthesized
gggagtatgcctcatttggata

SEQ ID NO: 733202 - DNA, 22 bp, Artificial Sequence
  chemically synthesized
taatagctagggagtatgcctc

SEQ ID NO: 733203 - DNA, 22 bp, Artificial Sequence
  chemically synthesized
gtaatagctagggagtatgcct

SEQ ID NO: 733204 - DNA, 22 bp, Artificial Sequence
  chemically synthesized
ttgtaatagctagggagtatgc

SEQ ID NO: 733205 - DNA, 22 bp, Artificial Sequence
  chemically synthesized
cagccagacaggactcttgtaa

SEQ ID NO: 733206 - DNA, 22 bp, Artificial Sequence
  chemically synthesized
cctagctattacaagagtcctg

SEQ ID NO: 733207 - DNA, 22 bp, Artificial Sequence
  chemically synthesized
gctattacaagagtcctgtctg

SEQ ID NO: 733208 - DNA, 22 bp, Artificial Sequence
  chemically synthesized
ttacaagagtcctgtctggctg

SEQ ID NO: 733209 - DNA, 22 bp, Artificial Sequence
  chemically synthesized
caagagtcctgtctggctgcag

SEQ ID NO: 733210 - DNA, 22 bp, Artificial Sequence
  chemically synthesized
tctggctgcaggcattgactga

SEQ ID NO: 733211 - DNA, 22 bp, Artificial Sequence
  chemically synthesized
gctgcaggcattgactgacttc

SEQ ID NO: 733212 - DNA, 22 bp, Artificial Sequence
  chemically synthesized
agataaaaaggagaagtcagtc

SEQ ID NO: 733213 - DNA, 22 bp, Artificial Sequence
  chemically synthesized
caggcattgactgacttctcct

SEQ ID NO: 733214 - DNA, 22 bp, Artificial Sequence
  chemically synthesized
agttgagataaaaaggagaagt

SEQ ID NO: 733215 - DNA, 22 bp, Artificial Sequence
  chemically synthesized
aagttgagataaaaaggagaag

SEQ ID NO: 733216 - DNA, 22 bp, Artificial Sequence
  chemically synthesized
taagttgagataaaaaggagaa

SEQ ID NO: 733217 - DNA, 22 bp, Artificial Sequence
  chemically synthesized
attttaagttgagataaaaagg

SEQ ID NO: 733218 - DNA, 22 bp, Artificial Sequence
  chemically synthesized
actgacttctcctttttatctc

SEQ ID NO: 733219 - DNA, 22 bp, Artificial Sequence
  chemically synthesized
acttctcctttttatctcaact

SEQ ID NO: 733220 - DNA, 22 bp, Artificial Sequence
  chemically synthesized
ctcctttttatctcaacttaaa

SEQ ID NO: 733221 - DNA, 22 bp, Artificial Sequence
  chemically synthesized
tcctttttatctcaacttaaaa

SEQ ID NO: 733222 - DNA, 22 bp, Artificial Sequence
  chemically synthesized
ctttttatctcaacttaaaatc

SEQ ID NO: 733223 - DNA, 22 bp, Artificial Sequence
  chemically synthesized
tttatctcaacttaaaatcagt

SEQ ID NO: 733224 - DNA, 22 bp, Artificial Sequence
  chemically synthesized
ttatctcaacttaaaatcagtg

SEQ ID NO: 733225 - DNA, 22 bp, Artificial Sequence
  chemically synthesized
tatctcaacttaaaatcagtgc

SEQ ID NO: 733226 - DNA, 22 bp, Artificial Sequence
  chemically synthesized
gatgggagcaaggcactgattt

SEQ ID NO: 733227 - DNA, 22 bp, Artificial Sequence
  chemically synthesized
atctcaacttaaaatcagtgcc

SEQ ID NO: 733228 - DNA, 22 bp, Artificial Sequence
  chemically synthesized
tctcaacttaaaatcagtgcct

SEQ ID NO: 733229 - DNA, 22 bp, Artificial Sequence
  chemically synthesized
aacttaaaatcagtgccttgct

SEQ ID NO: 733230 - DNA, 22 bp, Artificial Sequence
  chemically synthesized
aaaatcagtgccttgctcccat

SEQ ID NO: 733231 - DNA, 22 bp, Artificial Sequence
  chemically synthesized
atgtggcactggatgggagcaa

SEQ ID NO: 733232 - DNA, 22 bp, Artificial Sequence
  chemically synthesized
aaatcagtgccttgctcccatc

SEQ ID NO: 733233 - DNA, 22 bp, Artificial Sequence
  chemically synthesized
catgtggcactggatgggagca

SEQ ID NO: 733234 - DNA, 22 bp, Artificial Sequence
  chemically synthesized
gatttcatgtggcactggatgg

SEQ ID NO: 733235 - DNA, 22 bp, Artificial Sequence
  chemically synthesized
ggatttcatgtggcactggatg

SEQ ID NO: 733236 - DNA, 22 bp, Artificial Sequence
  chemically synthesized
cttggatttcatgtggcactgg

SEQ ID NO: 733237 - DNA, 22 bp, Artificial Sequence
  chemically synthesized
gctcccatccagtgccacatga

SEQ ID NO: 733238 - DNA, 22 bp, Artificial Sequence
  chemically synthesized
attccttggatttcatgtggca

SEQ ID NO: 733239 - DNA, 22 bp, Artificial Sequence
  chemically synthesized
ctcccatccagtgccacatgaa

SEQ ID NO: 733240 - DNA, 22 bp, Artificial Sequence
  chemically synthesized
gattccttggatttcatgtggc

SEQ ID NO: 733241 - DNA, 22 bp, Artificial Sequence
  chemically synthesized
tgattccttggatttcatgtgg

SEQ ID NO: 733242 - DNA, 22 bp, Artificial Sequence
  chemically synthesized
ccatccagtgccacatgaaatc

SEQ ID NO: 733243 - DNA, 22 bp, Artificial Sequence
  chemically synthesized
cactttgattccttggatttca

SEQ ID NO: 733244 - DNA, 22 bp, Artificial Sequence
  chemically synthesized
aacatgaggagtggcagcggag

SEQ ID NO: 733245 - DNA, 22 bp, Artificial Sequence
  chemically synthesized
gaacatgaggagtggcagcgga

SEQ ID NO: 733246 - DNA, 22 bp, Artificial Sequence
  chemically synthesized
tgaacatgaggagtggcagcgg

SEQ ID NO: 733247 - DNA, 22 bp, Artificial Sequence
  chemically synthesized
cgctgccactcctcatgttcaa

SEQ ID NO: 733248 - DNA, 22 bp, Artificial Sequence
  chemically synthesized
cataatggtccatgttttgaac

SEQ ID NO: 733249 - DNA, 22 bp, Artificial Sequence
  chemically synthesized
ccactcctcatgttcaaaacat

SEQ ID NO: 733250 - DNA, 22 bp, Artificial Sequence
  chemically synthesized
atattgcataatggtccatgtt

SEQ ID NO: 733251 - DNA, 22 bp, Artificial Sequence
  chemically synthesized
ctcatgttcaaaacatggacca

SEQ ID NO: 733252 - DNA, 22 bp, Artificial Sequence
  chemically synthesized
aatattgcataatggtccatgt

SEQ ID NO: 733253 - DNA, 22 bp, Artificial Sequence
  chemically synthesized
taatattgcataatggtccatg

SEQ ID NO: 733254 - DNA, 22 bp, Artificial Sequence
  chemically synthesized
atgttcaaaacatggaccatta

SEQ ID NO: 733255 - DNA, 22 bp, Artificial Sequence
  chemically synthesized
atgctttaatattgcataatgg

SEQ ID NO: 733256 - DNA, 22 bp, Artificial Sequence
  chemically synthesized
aaaacatggaccattatgcaat

SEQ ID NO: 733257 - DNA, 22 bp, Artificial Sequence
  chemically synthesized
caggattcatgctttaatattg

SEQ ID NO: 733258 - DNA, 22 bp, Artificial Sequence
  chemically synthesized
acagagttccaggattcatgct

SEQ ID NO: 733259 - DNA, 22 bp, Artificial Sequence
  chemically synthesized
tgcaatattaaagcatgaatcc

SEQ ID NO: 733260 - DNA, 22 bp, Artificial Sequence
  chemically synthesized
acaacattaacagagttccagg

SEQ ID NO: 733261 - DNA, 22 bp, Artificial Sequence
  chemically synthesized
cacaacattaacagagttccag

SEQ ID NO: 733262 - DNA, 22 bp, Artificial Sequence
  chemically synthesized
aagcatgaatcctggaactctg

SEQ ID NO: 733263 - DNA, 22 bp, Artificial Sequence
  chemically synthesized
tttcacaacattaacagagttc

SEQ ID NO: 733264 - DNA, 22 bp, Artificial Sequence
  chemically synthesized
acctatttcacaacattaacag

SEQ ID NO: 733265 - DNA, 22 bp, Artificial Sequence
  chemically synthesized
ctcacctatttcacaacattaa

SEQ ID NO: 733266 - DNA, 22 bp, Artificial Sequence
  chemically synthesized
gaactctgttaatgttgtgaaa

SEQ ID NO: 733267 - DNA, 22 bp, Artificial Sequence
  chemically synthesized
actactcacctatttcacaaca

SEQ ID NO: 733268 - DNA, 22 bp, Artificial Sequence
  chemically synthesized
ctaactactcacctatttcaca

SEQ ID NO: 733269 - DNA, 22 bp, Artificial Sequence
  chemically synthesized
gctaactactcacctatttcac

SEQ ID NO: 733270 - DNA, 22 bp, Artificial Sequence
  chemically synthesized
tgttaatgttgtgaaataggtg

SEQ ID NO: 733271 - DNA, 22 bp, Artificial Sequence
  chemically synthesized
ttgctaactactcacctatttc

SEQ ID NO: 733272 - DNA, 22 bp, Artificial Sequence
  chemically synthesized
ttaatgttgtgaaataggtgag

SEQ ID NO: 733273 - DNA, 22 bp, Artificial Sequence
  chemically synthesized
atgttgtgaaataggtgagtag

SEQ ID NO: 733274 - DNA, 22 bp, Artificial Sequence
  chemically synthesized
tgaaataggtgagtagttagca

SEQ ID NO: 733275 - DNA, 22 bp, Artificial Sequence
  chemically synthesized
tcagaatggtaattcttgctaa

SEQ ID NO: 733276 - DNA, 22 bp, Artificial Sequence
  chemically synthesized
cactgtcagaatggtaattctt

SEQ ID NO: 733277 - DNA, 22 bp, Artificial Sequence
  chemically synthesized
cactgcactgtcagaatggtaa

SEQ ID NO: 733278 - DNA, 22 bp, Artificial Sequence
  chemically synthesized
ccactgcactgtcagaatggta

SEQ ID NO: 733279 - DNA, 22 bp, Artificial Sequence
  chemically synthesized
tccactgcactgtcagaatggt

SEQ ID NO: 733280 - DNA, 22 bp, Artificial Sequence
  chemically synthesized
ttccactgcactgtcagaatgg

SEQ ID NO: 733281 - DNA, 22 bp, Artificial Sequence
  chemically synthesized
gcaagaattaccattctgacag

SEQ ID NO: 733282 - DNA, 22 bp, Artificial Sequence
  chemically synthesized
ccattctgacagtgcagtggaa

SEQ ID NO: 733283 - DNA, 22 bp, Artificial Sequence
  chemically synthesized
caatgaatgaagtttttccact

SEQ ID NO: 733284 - DNA, 22 bp, Artificial Sequence
  chemically synthesized
acaatgaatgaagtttttccac

SEQ ID NO: 733285 - DNA, 22 bp, Artificial Sequence
  chemically synthesized
tacaatgaatgaagtttttcca

SEQ ID NO: 733286 - DNA, 22 bp, Artificial Sequence
  chemically synthesized
tgacagtgcagtggaaaaactt

SEQ ID NO: 733287 - DNA, 22 bp, Artificial Sequence
  chemically synthesized
ttacaatgaatgaagtttttcc

SEQ ID NO: 733288 - DNA, 22 bp, Artificial Sequence
  chemically synthesized
tttacaatgaatgaagtttttc

SEQ ID NO: 733289 - DNA, 22 bp, Artificial Sequence
  chemically synthesized
acagtgcagtggaaaaacttca

SEQ ID NO: 733290 - DNA, 22 bp, Artificial Sequence
  chemically synthesized
ctttttacaatgaatgaagttt

SEQ ID NO: 733291 - DNA, 22 bp, Artificial Sequence
  chemically synthesized
cctgctttttacaatgaatgaa

SEQ ID NO: 733292 - DNA, 22 bp, Artificial Sequence
  chemically synthesized
aactccctgctttttacaatga

SEQ ID NO: 733293 - DNA, 22 bp, Artificial Sequence
  chemically synthesized
cattcattgtaaaaagcaggga

SEQ ID NO: 733294 - DNA, 22 bp, Artificial Sequence
  chemically synthesized
attcattgtaaaaagcagggag

SEQ ID NO: 733295 - DNA, 22 bp, Artificial Sequence
  chemically synthesized
attgtaaaaagcagggagttga

SEQ ID NO: 733296 - DNA, 22 bp, Artificial Sequence
  chemically synthesized
taaaaagcagggagttgagttt

SEQ ID NO: 733297 - DNA, 22 bp, Artificial Sequence
  chemically synthesized
agtttctatatggggttgcctt

SEQ ID NO: 733298 - DNA, 22 bp, Artificial Sequence
  chemically synthesized
ctatatggggttgcctttcacg

SEQ ID NO: 733299 - DNA, 22 bp, Artificial Sequence
  chemically synthesized
tatatggggttgcctttcacgt

SEQ ID NO: 733300 - DNA, 22 bp, Artificial Sequence
  chemically synthesized
caaggggaggggacgtgaaagg

SEQ ID NO: 733301 - DNA, 22 bp, Artificial Sequence
  chemically synthesized
tatggggttgcctttcacgtcc

SEQ ID NO: 733302 - DNA, 22 bp, Artificial Sequence
  chemically synthesized
tgcaaggggaggggacgtgaaa

SEQ ID NO: 733303 - DNA, 22 bp, Artificial Sequence
  chemically synthesized
tctctgcaaggggaggggacgt

SEQ ID NO: 733304 - DNA, 22 bp, Artificial Sequence
  chemically synthesized
attatctctgcaaggggagggg

SEQ ID NO: 733305 - DNA, 22 bp, Artificial Sequence
  chemically synthesized
cattatctctgcaaggggaggg

SEQ ID NO: 733306 - DNA, 22 bp, Artificial Sequence
  chemically synthesized
cctttcacgtcccctccccttg

SEQ ID NO: 733307 - DNA, 22 bp, Artificial Sequence
  chemically synthesized
tcattatctctgcaaggggagg

SEQ ID NO: 733308 - DNA, 22 bp, Artificial Sequence
  chemically synthesized
ttcattatctctgcaaggggag

SEQ ID NO: 733309 - DNA, 22 bp, Artificial Sequence
  chemically synthesized
tttcattatctctgcaagggga

SEQ ID NO: 733310 - DNA, 22 bp, Artificial Sequence
  chemically synthesized
tcacgtcccctccccttgcaga

SEQ ID NO: 733311 - DNA, 22 bp, Artificial Sequence
  chemically synthesized
cacgtcccctccccttgcagag

SEQ ID NO: 733312 - DNA, 22 bp, Artificial Sequence
  chemically synthesized
acgtcccctccccttgcagaga

SEQ ID NO: 733313 - DNA, 22 bp, Artificial Sequence
  chemically synthesized
ggcattttttcattatctctgc

SEQ ID NO: 733314 - DNA, 22 bp, Artificial Sequence
  chemically synthesized
cccttgcagagataatgaaaaa

SEQ ID NO: 733315 - DNA, 22 bp, Artificial Sequence
  chemically synthesized
aaaaatagctgggcattttttc

SEQ ID NO: 733316 - DNA, 22 bp, Artificial Sequence
  chemically synthesized
gcagagataatgaaaaaatgcc

SEQ ID NO: 733317 - DNA, 22 bp, Artificial Sequence
  chemically synthesized
cagagataatgaaaaaatgccc

SEQ ID NO: 733318 - DNA, 22 bp, Artificial Sequence
  chemically synthesized
gaaaagaaagtaaacatcacat

SEQ ID NO: 733319 - DNA, 22 bp, Artificial Sequence
  chemically synthesized
ggaaaagaaagtaaacatcaca

SEQ ID NO: 733320 - DNA, 22 bp, Artificial Sequence
  chemically synthesized
ttggaaaagaaagtaaacatca

SEQ ID NO: 733321 - DNA, 22 bp, Artificial Sequence
  chemically synthesized
tttttcagatgtgatgtttact

SEQ ID NO: 733322 - DNA, 22 bp, Artificial Sequence
  chemically synthesized
ttcagatgtgatgtttactttc

SEQ ID NO: 733323 - DNA, 22 bp, Artificial Sequence
  chemically synthesized
tcagatgtgatgtttactttct

SEQ ID NO: 733324 - DNA, 22 bp, Artificial Sequence
  chemically synthesized
cagatgtgatgtttactttctt

SEQ ID NO: 733325 - DNA, 22 bp, Artificial Sequence
  chemically synthesized
agatgtgatgtttactttcttt

SEQ ID NO: 733326 - DNA, 22 bp, Artificial Sequence
  chemically synthesized
caaagaacctcttggaaaagaa

SEQ ID NO: 733327 - DNA, 22 bp, Artificial Sequence
  chemically synthesized
ctccaaagaacctcttggaaaa

SEQ ID NO: 733328 - DNA, 22 bp, Artificial Sequence
  chemically synthesized
actttcttttccaagaggttct

SEQ ID NO: 733329 - DNA, 22 bp, Artificial Sequence
  chemically synthesized
ctttcttttccaagaggttctt

SEQ ID NO: 733330 - DNA, 22 bp, Artificial Sequence
  chemically synthesized
tgtattcctccaaagaacctct

SEQ ID NO: 733331 - DNA, 22 bp, Artificial Sequence
  chemically synthesized
tgtgtattcctccaaagaacct

SEQ ID NO: 733332 - DNA, 22 bp, Artificial Sequence
  chemically synthesized
tcttttccaagaggttctttgg

SEQ ID NO: 733333 - DNA, 22 bp, Artificial Sequence
  chemically synthesized
ctgtgtattcctccaaagaacc

SEQ ID NO: 733334 - DNA, 22 bp, Artificial Sequence
  chemically synthesized
cttttccaagaggttctttgga

SEQ ID NO: 733335 - DNA, 22 bp, Artificial Sequence
  chemically synthesized
ttttccaagaggttctttggag

SEQ ID NO: 733336 - DNA, 22 bp, Artificial Sequence
  chemically synthesized
ttccaagaggttctttggagga

SEQ ID NO: 733337 - DNA, 22 bp, Artificial Sequence
  chemically synthesized
tccaagaggttctttggaggaa

SEQ ID NO: 733338 - DNA, 22 bp, Artificial Sequence
  chemically synthesized
ccaagaggttctttggaggaat

SEQ ID NO: 733339 - DNA, 22 bp, Artificial Sequence
  chemically synthesized
caagaggttctttggaggaata

SEQ ID NO: 733340 - DNA, 22 bp, Artificial Sequence
  chemically synthesized
taaaatatttctgtgtattcct

SEQ ID NO: 733341 - DNA, 22 bp, Artificial Sequence
  chemically synthesized
tataaaatatttctgtgtattc

SEQ ID NO: 733342 - DNA, 22 bp, Artificial Sequence
  chemically synthesized
tttggaggaatacacagaaata

SEQ ID NO: 733343 - DNA, 22 bp, Artificial Sequence
  chemically synthesized
tggttctataaaatatttctgt

SEQ ID NO: 733344 - DNA, 22 bp, Artificial Sequence
  chemically synthesized
tggaggaatacacagaaatatt

SEQ ID NO: 733345 - DNA, 22 bp, Artificial Sequence
  chemically synthesized
gtggttctataaaatatttctg

SEQ ID NO: 733346 - DNA, 22 bp, Artificial Sequence
  chemically synthesized
ggaggaatacacagaaatattt

SEQ ID NO: 733347 - DNA, 22 bp, Artificial Sequence
  chemically synthesized
tgtggttctataaaatatttct

SEQ ID NO: 733348 - DNA, 22 bp, Artificial Sequence
  chemically synthesized
gaggaatacacagaaatatttt

SEQ ID NO: 733349 - DNA, 22 bp, Artificial Sequence
  chemically synthesized
ttttgtggttctataaaatatt

SEQ ID NO: 733350 - DNA, 22 bp, Artificial Sequence
  chemically synthesized
ttattttgtggttctataaaat

SEQ ID NO: 733351 - DNA, 22 bp, Artificial Sequence
  chemically synthesized
tattattttgtggttctataaa

SEQ ID NO: 733352 - DNA, 22 bp, Artificial Sequence
  chemically synthesized
cctctattattttgtggttcta

SEQ ID NO: 733353 - DNA, 22 bp, Artificial Sequence
  chemically synthesized
acctctattattttgtggttct

SEQ ID NO: 733354 - DNA, 22 bp, Artificial Sequence
  chemically synthesized
tacctctattattttgtggttc

SEQ ID NO: 733355 - DNA, 22 bp, Artificial Sequence
  chemically synthesized
ttttacctctattattttgtgg

SEQ ID NO: 733356 - DNA, 22 bp, Artificial Sequence
  chemically synthesized
attttacctctattattttgtg

SEQ ID NO: 733357 - DNA, 22 bp, Artificial Sequence
  chemically synthesized
tatagaaccacaaaataataga

SEQ ID NO: 733358 - DNA, 22 bp, Artificial Sequence
  chemically synthesized
atagaaccacaaaataatagag

SEQ ID NO: 733359 - DNA, 22 bp, Artificial Sequence
  chemically synthesized
tagaaccacaaaataatagagg

SEQ ID NO: 733360 - DNA, 22 bp, Artificial Sequence
  chemically synthesized
caaagcttattttacctctatt

SEQ ID NO: 733361 - DNA, 22 bp, Artificial Sequence
  chemically synthesized
ttccaaagcttattttacctct

SEQ ID NO: 733362 - DNA, 22 bp, Artificial Sequence
  chemically synthesized
attccaaagcttattttacctc

SEQ ID NO: 733363 - DNA, 22 bp, Artificial Sequence
  chemically synthesized
tattccaaagcttattttacct

SEQ ID NO: 733364 - DNA, 22 bp, Artificial Sequence
  chemically synthesized
ttttattccaaagcttatttta

SEQ ID NO: 733365 - DNA, 22 bp, Artificial Sequence
  chemically synthesized
attttattccaaagcttatttt

SEQ ID NO: 733366 - DNA, 22 bp, Artificial Sequence
  chemically synthesized
cttattttattccaaagcttat

SEQ ID NO: 733367 - DNA, 22 bp, Artificial Sequence
  chemically synthesized
gcttattttattccaaagctta

SEQ ID NO: 733368 - DNA, 22 bp, Artificial Sequence
  chemically synthesized
tttgcttattttattccaaagc

SEQ ID NO: 733369 - DNA, 22 bp, Artificial Sequence
  chemically synthesized
atttgcttattttattccaaag

SEQ ID NO: 733370 - DNA, 22 bp, Artificial Sequence
  chemically synthesized
gtcttatttgcttattttattc

SEQ ID NO: 733371 - DNA, 22 bp, Artificial Sequence
  chemically synthesized
gaaactagtcttatttgcttat

SEQ ID NO: 733372 - DNA, 22 bp, Artificial Sequence
  chemically synthesized
tggaataaaataagcaaataag

SEQ ID NO: 733373 - DNA, 22 bp, Artificial Sequence
  chemically synthesized
ggaataaaataagcaaataaga

SEQ ID NO: 733374 - DNA, 22 bp, Artificial Sequence
  chemically synthesized
gaataaaataagcaaataagac

SEQ ID NO: 733375 - DNA, 22 bp, Artificial Sequence
  chemically synthesized
ccagaaatcgtagactagaaac

SEQ ID NO: 733376 - DNA, 22 bp, Artificial Sequence
  chemically synthesized
cccagaaatcgtagactagaaa

SEQ ID NO: 733377 - DNA, 22 bp, Artificial Sequence
  chemically synthesized
tcccagaaatcgtagactagaa

SEQ ID NO: 733378 - DNA, 22 bp, Artificial Sequence
  chemically synthesized
gcattttcccagaaatcgtaga

SEQ ID NO: 733379 - DNA, 22 bp, Artificial Sequence
  chemically synthesized
tcgcattttcccagaaatcgta

SEQ ID NO: 733380 - DNA, 22 bp, Artificial Sequence
  chemically synthesized
gtttctagtctacgatttctgg

SEQ ID NO: 733381 - DNA, 22 bp, Artificial Sequence
  chemically synthesized
ctagtctacgatttctgggaaa

SEQ ID NO: 733382 - DNA, 22 bp, Artificial Sequence
  chemically synthesized
aagttctcgcattttcccagaa

SEQ ID NO: 733383 - DNA, 22 bp, Artificial Sequence
  chemically synthesized
tagtctacgatttctgggaaaa

SEQ ID NO: 733384 - DNA, 22 bp, Artificial Sequence
  chemically synthesized
gtctacgatttctgggaaaatg

SEQ ID NO: 733385 - DNA, 22 bp, Artificial Sequence
  chemically synthesized
actaaagttctcgcattttccc

SEQ ID NO: 733386 - DNA, 22 bp, Artificial Sequence
  chemically synthesized
aactaaagttctcgcattttcc

SEQ ID NO: 733387 - DNA, 22 bp, Artificial Sequence
  chemically synthesized
cgatttctgggaaaatgcgaga

SEQ ID NO: 733388 - DNA, 22 bp, Artificial Sequence
  chemically synthesized
ctgggaaaatgcgagaacttta

SEQ ID NO: 733389 - DNA, 22 bp, Artificial Sequence
  chemically synthesized
tgggaaaatgcgagaactttag

SEQ ID NO: 733390 - DNA, 22 bp, Artificial Sequence
  chemically synthesized
ggaaaatgcgagaactttagtt

SEQ ID NO: 733391 - DNA, 22 bp, Artificial Sequence
  chemically synthesized
gaataaaataaacaagtttaac

SEQ ID NO: 733392 - DNA, 22 bp, Artificial Sequence
  chemically synthesized
acctagaataaaataaacaagt

SEQ ID NO: 733393 - DNA, 22 bp, Artificial Sequence
  chemically synthesized
tagttaaacttgtttattttat

SEQ ID NO: 733394 - DNA, 22 bp, Artificial Sequence
  chemically synthesized
agttaaacttgtttattttatt

SEQ ID NO: 733395 - DNA, 22 bp, Artificial Sequence
  chemically synthesized
gttaaacttgtttattttattc

SEQ ID NO: 733396 - DNA, 22 bp, Artificial Sequence
  chemically synthesized
ataaaattcacctagaataaaa

SEQ ID NO: 733397 - DNA, 22 bp, Artificial Sequence
  chemically synthesized
aacttgtttattttattctagg

SEQ ID NO: 733398 - DNA, 22 bp, Artificial Sequence
  chemically synthesized
agttaataaaattcacctagaa

SEQ ID NO: 733399 - DNA, 22 bp, Artificial Sequence
  chemically synthesized
aagttaataaaattcacctaga

SEQ ID NO: 733400 - DNA, 22 bp, Artificial Sequence
  chemically synthesized
gtttattttattctaggtgaat

SEQ ID NO: 733401 - DNA, 22 bp, Artificial Sequence
  chemically synthesized
taagttaataaaattcacctag

SEQ ID NO: 733402 - DNA, 22 bp, Artificial Sequence
  chemically synthesized
tttattttattctaggtgaatt

SEQ ID NO: 733403 - DNA, 22 bp, Artificial Sequence
  chemically synthesized
attttattctaggtgaatttta

SEQ ID NO: 733404 - DNA, 22 bp, Artificial Sequence
  chemically synthesized
ttttattctaggtgaattttat

SEQ ID NO: 733405 - DNA, 22 bp, Artificial Sequence
  chemically synthesized
tattctaggtgaattttattaa

SEQ ID NO: 733406 - DNA, 22 bp, Artificial Sequence
  chemically synthesized
tgatcctttaagttaataaaat

SEQ ID NO: 733407 - DNA, 22 bp, Artificial Sequence
  chemically synthesized
attctaggtgaattttattaac

SEQ ID NO: 733408 - DNA, 22 bp, Artificial Sequence
  chemically synthesized
atgatcctttaagttaataaaa

SEQ ID NO: 733409 - DNA, 22 bp, Artificial Sequence
  chemically synthesized
ttctaggtgaattttattaact

SEQ ID NO: 733410 - DNA, 22 bp, Artificial Sequence
  chemically synthesized
tatgatcctttaagttaataaa

SEQ ID NO: 733411 - DNA, 22 bp, Artificial Sequence
  chemically synthesized
taggtgaattttattaacttaa

SEQ ID NO: 733412 - DNA, 22 bp, Artificial Sequence
  chemically synthesized
ttttatgatcctttaagttaat

SEQ ID NO: 733413 - DNA, 22 bp, Artificial Sequence
  chemically synthesized
ggtgaattttattaacttaaag

SEQ ID NO: 733414 - DNA, 22 bp, Artificial Sequence
  chemically synthesized
ttattttatgatcctttaagtt

SEQ ID NO: 733415 - DNA, 22 bp, Artificial Sequence
  chemically synthesized
tattaacttaaaggatcataaa

SEQ ID NO: 733416 - DNA, 22 bp, Artificial Sequence
  chemically synthesized
attaacttaaaggatcataaaa

SEQ ID NO: 733417 - DNA, 22 bp, Artificial Sequence
  chemically synthesized
ttaacttaaaggatcataaaat

SEQ ID NO: 733418 - DNA, 22 bp, Artificial Sequence
  chemically synthesized
acttaaaggatcataaaataat

SEQ ID NO: 733419 - DNA, 22 bp, Artificial Sequence
  chemically synthesized
aaaggatcataaaataataatg

SEQ ID NO: 733420 - DNA, 22 bp, Artificial Sequence
  chemically synthesized
aaggatcataaaataataatga

SEQ ID NO: 733421 - DNA, 22 bp, Artificial Sequence
  chemically synthesized
aaagtagagatgatcattatta

SEQ ID NO: 733422 - DNA, 22 bp, Artificial Sequence
  chemically synthesized
aaaagtagagatgatcattatt

SEQ ID NO: 733423 - DNA, 22 bp, Artificial Sequence
  chemically synthesized
taaaagtagagatgatcattat

SEQ ID NO: 733424 - DNA, 22 bp, Artificial Sequence
  chemically synthesized
atagaaatgtggattttaaaag

SEQ ID NO: 733425 - DNA, 22 bp, Artificial Sequence
  chemically synthesized
tacttttaaaatccacatttct

SEQ ID NO: 733426 - DNA, 22 bp, Artificial Sequence
  chemically synthesized
cttttaaaatccacatttctat

SEQ ID NO: 733427 - DNA, 22 bp, Artificial Sequence
  chemically synthesized
ttaaaatccacatttctatcaa

SEQ ID NO: 733428 - DNA, 22 bp, Artificial Sequence
  chemically synthesized
taaaatccacatttctatcaat

SEQ ID NO: 733429 - DNA, 22 bp, Artificial Sequence
  chemically synthesized
aaaatccacatttctatcaatt

SEQ ID NO: 733430 - DNA, 22 bp, Artificial Sequence
  chemically synthesized
aaatccacatttctatcaatta

SEQ ID NO: 733431 - DNA, 22 bp, Artificial Sequence
  chemically synthesized
gaatatgcatataataattgat

SEQ ID NO: 733432 - DNA, 22 bp, Artificial Sequence
  chemically synthesized
tacacactggaatatgcatata

SEQ ID NO: 733433 - DNA, 22 bp, Artificial Sequence
  chemically synthesized
ctatcaattattatatgcatat

SEQ ID NO: 733434 - DNA, 22 bp, Artificial Sequence
  chemically synthesized
tatcaattattatatgcatatt

SEQ ID NO: 733435 - DNA, 22 bp, Artificial Sequence
  chemically synthesized
tcaattattatatgcatattcc

SEQ ID NO: 733436 - DNA, 22 bp, Artificial Sequence
  chemically synthesized
tctgtacacactggaatatgca

SEQ ID NO: 733437 - DNA, 22 bp, Artificial Sequence
  chemically synthesized
atctgtacacactggaatatgc

SEQ ID NO: 733438 - DNA, 22 bp, Artificial Sequence
  chemically synthesized
tatctgtacacactggaatatg

SEQ ID NO: 733439 - DNA, 22 bp, Artificial Sequence
  chemically synthesized
ttatctgtacacactggaatat

SEQ ID NO: 733440 - DNA, 22 bp, Artificial Sequence
  chemically synthesized
tttatctgtacacactggaata

SEQ ID NO: 733441 - DNA, 22 bp, Artificial Sequence
  chemically synthesized
ttatatgcatattccagtgtgt

SEQ ID NO: 733442 - DNA, 22 bp, Artificial Sequence
  chemically synthesized
tatgcatattccagtgtgtaca

SEQ ID NO: 733443 - DNA, 22 bp, Artificial Sequence
  chemically synthesized
aatatctttttatctgtacaca

SEQ ID NO: 733444 - DNA, 22 bp, Artificial Sequence
  chemically synthesized
gaatatctttttatctgtacac

SEQ ID NO: 733445 - DNA, 22 bp, Artificial Sequence
  chemically synthesized
tacttgaatatctttttatctg

SEQ ID NO: 733446 - DNA, 22 bp, Artificial Sequence
  chemically synthesized
cagtgtgtacagataaaaagat

SEQ ID NO: 733447 - DNA, 22 bp, Artificial Sequence
  chemically synthesized
gttgtacttgaatatcttttta

SEQ ID NO: 733448 - DNA, 22 bp, Artificial Sequence
  chemically synthesized
agttgtacttgaatatcttttt

SEQ ID NO: 733449 - DNA, 22 bp, Artificial Sequence
  chemically synthesized
ggtttagttgtacttgaatatc

SEQ ID NO: 733450 - DNA, 22 bp, Artificial Sequence
  chemically synthesized
taggtttagttgtacttgaata

SEQ ID NO: 733451 - DNA, 22 bp, Artificial Sequence
  chemically synthesized
atgaaatctctaggtttagttg

SEQ ID NO: 733452 - DNA, 22 bp, Artificial Sequence
  chemically synthesized
tgatgaaatctctaggtttagt

SEQ ID NO: 733453 - DNA, 22 bp, Artificial Sequence
  chemically synthesized
ctgatgaaatctctaggtttag

SEQ ID NO: 733454 - DNA, 22 bp, Artificial Sequence
  chemically synthesized
tctgatgaaatctctaggttta

SEQ ID NO: 733455 - DNA, 22 bp, Artificial Sequence
  chemically synthesized
aagtacaactaaacctagagat

SEQ ID NO: 733456 - DNA, 22 bp, Artificial Sequence
  chemically synthesized
ttttctgatgaaatctctaggt

SEQ ID NO: 733457 - DNA, 22 bp, Artificial Sequence
  chemically synthesized
gggattattttctgatgaaatc

SEQ ID NO: 733458 - DNA, 22 bp, Artificial Sequence
  chemically synthesized
ggggattattttctgatgaaat

SEQ ID NO: 733459 - DNA, 22 bp, Artificial Sequence
  chemically synthesized
tggggattattttctgatgaaa

SEQ ID NO: 733460 - DNA, 22 bp, Artificial Sequence
  chemically synthesized
aacctagagatttcatcagaaa

SEQ ID NO: 733461 - DNA, 22 bp, Artificial Sequence
  chemically synthesized
attttggggattattttctgat

SEQ ID NO: 733462 - DNA, 22 bp, Artificial Sequence
  chemically synthesized
gagatttcatcagaaaataatc

SEQ ID NO: 733463 - DNA, 22 bp, Artificial Sequence
  chemically synthesized
catcagaaaataatccccaaaa

SEQ ID NO: 733464 - DNA, 22 bp, Artificial Sequence
  chemically synthesized
atcagaaaataatccccaaaat

SEQ ID NO: 733465 - DNA, 22 bp, Artificial Sequence
  chemically synthesized
caatagcagctcattttgggga

SEQ ID NO: 733466 - DNA, 22 bp, Artificial Sequence
  chemically synthesized
gcaatagcagctcattttgggg

SEQ ID NO: 733467 - DNA, 22 bp, Artificial Sequence
  chemically synthesized
tgcaatagcagctcattttggg

SEQ ID NO: 733468 - DNA, 22 bp, Artificial Sequence
  chemically synthesized
cattttgcaatagcagctcatt

SEQ ID NO: 733469 - DNA, 22 bp, Artificial Sequence
  chemically synthesized
ccattttgcaatagcagctcat

SEQ ID NO: 733470 - DNA, 22 bp, Artificial Sequence
  chemically synthesized
tccattttgcaatagcagctca

SEQ ID NO: 733471 - DNA, 22 bp, Artificial Sequence
  chemically synthesized
catcatattttccattttgcaa

SEQ ID NO: 733472 - DNA, 22 bp, Artificial Sequence
  chemically synthesized
acatcatattttccattttgca

SEQ ID NO: 733473 - DNA, 22 bp, Artificial Sequence
  chemically synthesized
tttacatcatattttccatttt

SEQ ID NO: 733474 - DNA, 22 bp, Artificial Sequence
  chemically synthesized
ctattgcaaaatggaaaatatg

SEQ ID NO: 733475 - DNA, 22 bp, Artificial Sequence
  chemically synthesized
ttgcaaaatggaaaatatgatg

SEQ ID NO: 733476 - DNA, 22 bp, Artificial Sequence
  chemically synthesized
caaaatggaaaatatgatgtaa

SEQ ID NO: 733477 - DNA, 22 bp, Artificial Sequence
  chemically synthesized
aaagcccaaaatgcctgtttac

SEQ ID NO: 733478 - DNA, 22 bp, Artificial Sequence
  chemically synthesized
tctgaaagcccaaaatgcctgt

SEQ ID NO: 733479 - DNA, 22 bp, Artificial Sequence
  chemically synthesized
atctgaaagcccaaaatgcctg

SEQ ID NO: 733480 - DNA, 22 bp, Artificial Sequence
  chemically synthesized
tttatctgaaagcccaaaatgc

SEQ ID NO: 733481 - DNA, 22 bp, Artificial Sequence
  chemically synthesized
tgctgtttatctgaaagcccaa

SEQ ID NO: 733482 - DNA, 22 bp, Artificial Sequence
  chemically synthesized
atgctgtttatctgaaagccca

SEQ ID NO: 733483 - DNA, 22 bp, Artificial Sequence
  chemically synthesized
aaaaatttatgctgtttatctg

SEQ ID NO: 733484 - DNA, 22 bp, Artificial Sequence
  chemically synthesized
ttcaaaaatttatgctgtttat

SEQ ID NO: 733485 - DNA, 22 bp, Artificial Sequence
  chemically synthesized
tgggctttcagataaacagcat

SEQ ID NO: 733486 - DNA, 22 bp, Artificial Sequence
  chemically synthesized
gggctttcagataaacagcata

SEQ ID NO: 733487 - DNA, 22 bp, Artificial Sequence
  chemically synthesized
ggctttcagataaacagcataa

SEQ ID NO: 733488 - DNA, 22 bp, Artificial Sequence
  chemically synthesized
tcagataaacagcataaatttt

SEQ ID NO: 733489 - DNA, 22 bp, Artificial Sequence
  chemically synthesized
cagataaacagcataaattttt

SEQ ID NO: 733490 - DNA, 22 bp, Artificial Sequence
  chemically synthesized
agataaacagcataaatttttg

SEQ ID NO: 733491 - DNA, 22 bp, Artificial Sequence
  chemically synthesized
tggaaaacaagacgtatcctgt

SEQ ID NO: 733492 - DNA, 22 bp, Artificial Sequence
  chemically synthesized
gtggaaaacaagacgtatcctg

SEQ ID NO: 733493 - DNA, 22 bp, Artificial Sequence
  chemically synthesized
tgtggaaaacaagacgtatcct

SEQ ID NO: 733494 - DNA, 22 bp, Artificial Sequence
  chemically synthesized
tttgtggaaaacaagacgtatc

SEQ ID NO: 733495 - DNA, 22 bp, Artificial Sequence
  chemically synthesized
tctttgtggaaaacaagacgta

SEQ ID NO: 733496 - DNA, 22 bp, Artificial Sequence
  chemically synthesized
ctctttgtggaaaacaagacgt

SEQ ID NO: 733497 - DNA, 22 bp, Artificial Sequence
  chemically synthesized
ttgaacaggatacgtcttgttt

SEQ ID NO: 733498 - DNA, 22 bp, Artificial Sequence
  chemically synthesized
tctctttgtggaaaacaagacg

SEQ ID NO: 733499 - DNA, 22 bp, Artificial Sequence
  chemically synthesized
tgaacaggatacgtcttgtttt

SEQ ID NO: 733500 - DNA, 22 bp, Artificial Sequence
  chemically synthesized
ttctctttgtggaaaacaagac

SEQ ID NO: 733501 - DNA, 22 bp, Artificial Sequence
  chemically synthesized
gaacaggatacgtcttgttttc

SEQ ID NO: 733502 - DNA, 22 bp, Artificial Sequence
  chemically synthesized
aacaggatacgtcttgttttcc

SEQ ID NO: 733503 - DNA, 22 bp, Artificial Sequence
  chemically synthesized
tttttctctttgtggaaaacaa

SEQ ID NO: 733504 - DNA, 22 bp, Artificial Sequence
  chemically synthesized
gtttttctctttgtggaaaaca

SEQ ID NO: 733505 - DNA, 22 bp, Artificial Sequence
  chemically synthesized
caccttgtttttctctttgtgg

SEQ ID NO: 733506 - DNA, 22 bp, Artificial Sequence
  chemically synthesized
actacaccttgtttttctcttt

SEQ ID NO: 733507 - DNA, 22 bp, Artificial Sequence
  chemically synthesized
cactacaccttgtttttctctt

SEQ ID NO: 733508 - DNA, 22 bp, Artificial Sequence
  chemically synthesized
gttttccacaaagagaaaaaca

SEQ ID NO: 733509 - DNA, 22 bp, Artificial Sequence
  chemically synthesized
ttcactacaccttgtttttctc

SEQ ID NO: 733510 - DNA, 22 bp, Artificial Sequence
  chemically synthesized
ttttccacaaagagaaaaacaa

SEQ ID NO: 733511 - DNA, 22 bp, Artificial Sequence
  chemically synthesized
tccacaaagagaaaaacaaggt

SEQ ID NO: 733512 - DNA, 22 bp, Artificial Sequence
  chemically synthesized
ccacaaagagaaaaacaaggtg

SEQ ID NO: 733513 - DNA, 22 bp, Artificial Sequence
  chemically synthesized
cacaaagagaaaaacaaggtgt

SEQ ID NO: 733514 - DNA, 22 bp, Artificial Sequence
  chemically synthesized
aacgctcttcactacaccttgt

SEQ ID NO: 733515 - DNA, 22 bp, Artificial Sequence
  chemically synthesized
aaagcaagatcagaaatcagac

SEQ ID NO: 733516 - DNA, 22 bp, Artificial Sequence
  chemically synthesized
ttaaaagcaagatcagaaatca

SEQ ID NO: 733517 - DNA, 22 bp, Artificial Sequence
  chemically synthesized
gttaaaagcaagatcagaaatc

SEQ ID NO: 733518 - DNA, 22 bp, Artificial Sequence
  chemically synthesized
aattgtgtctgatttctgatct

SEQ ID NO: 733519 - DNA, 22 bp, Artificial Sequence
  chemically synthesized
atttgttaaaagcaagatcaga

SEQ ID NO: 733520 - DNA, 22 bp, Artificial Sequence
  chemically synthesized
tcatttgttaaaagcaagatca

SEQ ID NO: 733521 - DNA, 22 bp, Artificial Sequence
  chemically synthesized
tgtctgatttctgatcttgctt

SEQ ID NO: 733522 - DNA, 22 bp, Artificial Sequence
  chemically synthesized
atttctgatcttgcttttaaca

SEQ ID NO: 733523 - DNA, 22 bp, Artificial Sequence
  chemically synthesized
agacgttctcatttgttaaaag

SEQ ID NO: 733524 - DNA, 22 bp, Artificial Sequence
  chemically synthesized
ctgatcttgcttttaacaaatg

SEQ ID NO: 733525 - DNA, 22 bp, Artificial Sequence
  chemically synthesized
tgatcttgcttttaacaaatga

SEQ ID NO: 733526 - DNA, 22 bp, Artificial Sequence
  chemically synthesized
gctgagacgttctcatttgtta

SEQ ID NO: 733527 - DNA, 22 bp, Artificial Sequence
  chemically synthesized
agctgagacgttctcatttgtt

SEQ ID NO: 733528 - DNA, 22 bp, Artificial Sequence
  chemically synthesized
atcttgcttttaacaaatgaga

SEQ ID NO: 733529 - DNA, 22 bp, Artificial Sequence
  chemically synthesized
acttagctgagacgttctcatt

SEQ ID NO: 733530 - DNA, 22 bp, Artificial Sequence
  chemically synthesized
gcttttaacaaatgagaacgtc

SEQ ID NO: 733531 - DNA, 22 bp, Artificial Sequence
  chemically synthesized
cttttaacaaatgagaacgtct

SEQ ID NO: 733532 - DNA, 22 bp, Artificial Sequence
  chemically synthesized
gttgacttagctgagacgttct

SEQ ID NO: 733533 - DNA, 22 bp, Artificial Sequence
  chemically synthesized
ttaacaaatgagaacgtctcag

SEQ ID NO: 733534 - DNA, 22 bp, Artificial Sequence
  chemically synthesized
tggttgacttagctgagacgtt

SEQ ID NO: 733535 - DNA, 22 bp, Artificial Sequence
  chemically synthesized
taacaaatgagaacgtctcagc

SEQ ID NO: 733536 - DNA, 22 bp, Artificial Sequence
  chemically synthesized
ctggttgacttagctgagacgt

SEQ ID NO: 733537 - DNA, 22 bp, Artificial Sequence
  chemically synthesized
aacaaatgagaacgtctcagct

SEQ ID NO: 733538 - DNA, 22 bp, Artificial Sequence
  chemically synthesized
acaaatgagaacgtctcagcta

SEQ ID NO: 733539 - DNA, 22 bp, Artificial Sequence
  chemically synthesized
ggaaatagtttctggttgactt

SEQ ID NO: 733540 - DNA, 22 bp, Artificial Sequence
  chemically synthesized
tagattaggaaatagtttctgg

SEQ ID NO: 733541 - DNA, 22 bp, Artificial Sequence
  chemically synthesized
agctaagtcaaccagaaactat

SEQ ID NO: 733542 - DNA, 22 bp, Artificial Sequence
  chemically synthesized
atagattaggaaatagtttctg

SEQ ID NO: 733543 - DNA, 22 bp, Artificial Sequence
  chemically synthesized
atttatagattaggaaatagtt

SEQ ID NO: 733544 - DNA, 22 bp, Artificial Sequence
  chemically synthesized
agtcaaccagaaactatttcct

SEQ ID NO: 733545 - DNA, 22 bp, Artificial Sequence
  chemically synthesized
aatttatagattaggaaatagt

SEQ ID NO: 733546 - DNA, 22 bp, Artificial Sequence
  chemically synthesized
taatttatagattaggaaatag

SEQ ID NO: 733547 - DNA, 22 bp, Artificial Sequence
  chemically synthesized
ggccaaaccctttaatttatag

SEQ ID NO: 733548 - DNA, 22 bp, Artificial Sequence
  chemically synthesized
tttcctaatctataaattaaag

SEQ ID NO: 733549 - DNA, 22 bp, Artificial Sequence
  chemically synthesized
tctaggccaaaccctttaattt

SEQ ID NO: 733550 - DNA, 22 bp, Artificial Sequence
  chemically synthesized
cctaatctataaattaaagggt

SEQ ID NO: 733551 - DNA, 22 bp, Artificial Sequence
  chemically synthesized
ctaatctataaattaaagggtt

SEQ ID NO: 733552 - DNA, 22 bp, Artificial Sequence
  chemically synthesized
atctataaattaaagggtttgg

SEQ ID NO: 733553 - DNA, 22 bp, Artificial Sequence
  chemically synthesized
gaaattatctaggccaaaccct

SEQ ID NO: 733554 - DNA, 22 bp, Artificial Sequence
  chemically synthesized
taaattaaagggtttggcctag

SEQ ID NO: 733555 - DNA, 22 bp, Artificial Sequence
  chemically synthesized
aagggtttggcctagataattt

SEQ ID NO: 733556 - DNA, 22 bp, Artificial Sequence
  chemically synthesized
aagccagaaaagactagaaatt

SEQ ID NO: 733557 - DNA, 22 bp, Artificial Sequence
  chemically synthesized
ggcctagataatttctagtctt

SEQ ID NO: 733558 - DNA, 22 bp, Artificial Sequence
  chemically synthesized
gcctagataatttctagtcttt

SEQ ID NO: 733559 - DNA, 22 bp, Artificial Sequence
  chemically synthesized
gataatttctagtcttttctgg

SEQ ID NO: 733560 - DNA, 22 bp, Artificial Sequence
  chemically synthesized
ctagtcttttctggcttcaacc

SEQ ID NO: 733561 - DNA, 22 bp, Artificial Sequence
  chemically synthesized
tagtcttttctggcttcaaccc

SEQ ID NO: 733562 - DNA, 22 bp, Artificial Sequence
  chemically synthesized
gtcttttctggcttcaacccct

SEQ ID NO: 733563 - DNA, 22 bp, Artificial Sequence
  chemically synthesized
ttctggcttcaacccctccctg

SEQ ID NO: 733564 - DNA, 22 bp, Artificial Sequence
  chemically synthesized
tctggcttcaacccctccctgc

SEQ ID NO: 733565 - DNA, 22 bp, Artificial Sequence
  chemically synthesized
ctggcttcaacccctccctgct

SEQ ID NO: 733566 - DNA, 22 bp, Artificial Sequence
  chemically synthesized
tggcttcaacccctccctgctt

SEQ ID NO: 733567 - DNA, 22 bp, Artificial Sequence
  chemically synthesized
gcttcaacccctccctgcttac

SEQ ID NO: 733568 - DNA, 22 bp, Artificial Sequence
  chemically synthesized
caacccctccctgcttactctc

SEQ ID NO: 733569 - DNA, 22 bp, Artificial Sequence
  chemically synthesized
aacccctccctgcttactctct

SEQ ID NO: 733570 - DNA, 22 bp, Artificial Sequence
  chemically synthesized
cctgcttactctctctctctct

SEQ ID NO: 733571 - DNA, 22 bp, Artificial Sequence
  chemically synthesized
cttactctctctctctctctct

SEQ ID NO: 733572 - DNA, 22 bp, Artificial Sequence
  chemically synthesized
actctctctctctctctctctc

SEQ ID NO: 733573 - DNA, 22 bp, Artificial Sequence
  chemically synthesized
ctctctctctctctctctctct

SEQ ID NO: 733574 - DNA, 22 bp, Artificial Sequence
  chemically synthesized
tctctctctctctctctctctc

SEQ ID NO: 733575 - DNA, 22 bp, Artificial Sequence
  chemically synthesized
tctctctctctctctctctctt

SEQ ID NO: 733576 - DNA, 22 bp, Artificial Sequence
  chemically synthesized
tctctctctctctctctctttc

SEQ ID NO: 733577 - DNA, 22 bp, Artificial Sequence
  chemically synthesized
tctctctctctctctctttcta

SEQ ID NO: 733578 - DNA, 22 bp, Artificial Sequence
  chemically synthesized
tctctctctctctctttctata

SEQ ID NO: 733579 - DNA, 22 bp, Artificial Sequence
  chemically synthesized
tctctctctctctttctatata

SEQ ID NO: 733580 - DNA, 22 bp, Artificial Sequence
  chemically synthesized
tctctctctctttctatatata

SEQ ID NO: 733581 - DNA, 22 bp, Artificial Sequence
  chemically synthesized
tctctctctttctatatatata

SEQ ID NO: 733582 - DNA, 22 bp, Artificial Sequence
  chemically synthesized
tctctctttctatatatatata

SEQ ID NO: 733583 - DNA, 22 bp, Artificial Sequence
  chemically synthesized
tctctttctatatatatatata

SEQ ID NO: 733584 - DNA, 22 bp, Artificial Sequence
  chemically synthesized
tctttctatatatatatataca

SEQ ID NO: 733585 - DNA, 22 bp, Artificial Sequence
  chemically synthesized
tttctatatatatatatacaca

SEQ ID NO: 733586 - DNA, 22 bp, Artificial Sequence
  chemically synthesized
tctatatatatatatacacaca

SEQ ID NO: 733587 - DNA, 22 bp, Artificial Sequence
  chemically synthesized
ctatatatatatatacacacac

SEQ ID NO: 733588 - DNA, 22 bp, Artificial Sequence
  chemically synthesized
tatatatatatatacacacaca

SEQ ID NO: 733589 - DNA, 22 bp, Artificial Sequence
  chemically synthesized
tatatatatatacacacacaca

SEQ ID NO: 733590 - DNA, 22 bp, Artificial Sequence
  chemically synthesized
tatatatatatatgtgtgtgta

SEQ ID NO: 733591 - DNA, 22 bp, Artificial Sequence
  chemically synthesized
atatatatatatatgtgtgtgt

SEQ ID NO: 733592 - DNA, 22 bp, Artificial Sequence
  chemically synthesized
aaaaagaaaaagaaaaaaaaaa

SEQ ID NO: 733593 - DNA, 22 bp, Artificial Sequence
  chemically synthesized
tctcaaaaagaaaaagaaaaaa

SEQ ID NO: 733594 - DNA, 22 bp, Artificial Sequence
  chemically synthesized
tgtctcaaaaagaaaaagaaaa

SEQ ID NO: 733595 - DNA, 22 bp, Artificial Sequence
  chemically synthesized
ttttttttctttttctttttga

SEQ ID NO: 733596 - DNA, 22 bp, Artificial Sequence
  chemically synthesized
tttttttctttttctttttgag

SEQ ID NO: 733597 - DNA, 22 bp, Artificial Sequence
  chemically synthesized
ttttttctttttctttttgaga

SEQ ID NO: 733598 - DNA, 22 bp, Artificial Sequence
  chemically synthesized
tttttctttttctttttgagac

SEQ ID NO: 733599 - DNA, 22 bp, Artificial Sequence
  chemically synthesized
ttttctttttctttttgagaca

SEQ ID NO: 733600 - DNA, 22 bp, Artificial Sequence
  chemically synthesized
tttctttttctttttgagacag

SEQ ID NO: 733601 - DNA, 22 bp, Artificial Sequence
  chemically synthesized
ttctttttctttttgagacaga

SEQ ID NO: 733602 - DNA, 22 bp, Artificial Sequence
  chemically synthesized
tctttttctttttgagacagag

SEQ ID NO: 733603 - DNA, 22 bp, Artificial Sequence
  chemically synthesized
ctttttctttttgagacagagt

SEQ ID NO: 733604 - DNA, 22 bp, Artificial Sequence
  chemically synthesized
tttttctttttgagacagagtc

SEQ ID NO: 733605 - DNA, 22 bp, Artificial Sequence
  chemically synthesized
ggtgacagagtaagactctgtc

SEQ ID NO: 733606 - DNA, 22 bp, Artificial Sequence
  chemically synthesized
tttctttttgagacagagtctt

SEQ ID NO: 733607 - DNA, 22 bp, Artificial Sequence
  chemically synthesized
ttctttttgagacagagtctta

SEQ ID NO: 733608 - DNA, 22 bp, Artificial Sequence
  chemically synthesized
tctttttgagacagagtcttac

SEQ ID NO: 733609 - DNA, 22 bp, Artificial Sequence
  chemically synthesized
ctttttgagacagagtcttact

SEQ ID NO: 733610 - DNA, 22 bp, Artificial Sequence
  chemically synthesized
tttttgagacagagtcttactc

SEQ ID NO: 733611 - DNA, 22 bp, Artificial Sequence
  chemically synthesized
tttgagacagagtcttactctg

SEQ ID NO: 733612 - DNA, 22 bp, Artificial Sequence
  chemically synthesized
ttgagacagagtcttactctgt

SEQ ID NO: 733613 - DNA, 22 bp, Artificial Sequence
  chemically synthesized
tgagacagagtcttactctgtc

SEQ ID NO: 733614 - DNA, 22 bp, Artificial Sequence
  chemically synthesized
gagacagagtcttactctgtca

SEQ ID NO: 733615 - DNA, 22 bp, Artificial Sequence
  chemically synthesized
agacagagtcttactctgtcac

SEQ ID NO: 733616 - DNA, 22 bp, Artificial Sequence
  chemically synthesized
aacccggagcctgggtgacaga

SEQ ID NO: 733617 - DNA, 22 bp, Artificial Sequence
  chemically synthesized
gaacccggagcctgggtgacag

SEQ ID NO: 733618 - DNA, 22 bp, Artificial Sequence
  chemically synthesized
cttgaacccggagcctgggtga

SEQ ID NO: 733619 - DNA, 22 bp, Artificial Sequence
  chemically synthesized
actctgtcacccaggctccggg

SEQ ID NO: 733620 - DNA, 22 bp, Artificial Sequence
  chemically synthesized
ctctgtcacccaggctccgggt

SEQ ID NO: 733621 - DNA, 22 bp, Artificial Sequence
  chemically synthesized
tgtcacccaggctccgggttca

SEQ ID NO: 733622 - DNA, 22 bp, Artificial Sequence
  chemically synthesized
tcacccaggctccgggttcaag

SEQ ID NO: 733623 - DNA, 22 bp, Artificial Sequence
  chemically synthesized
aggtgggagaattgcttgaacc

SEQ ID NO: 733624 - DNA, 22 bp, Artificial Sequence
  chemically synthesized
gggaggctgaggtgggagaatt

SEQ ID NO: 733625 - DNA, 22 bp, Artificial Sequence
  chemically synthesized
cgggttcaagcaattctcccac

SEQ ID NO: 733626 - DNA, 22 bp, Artificial Sequence
  chemically synthesized
ctcgggaggctgaggtgggaga

SEQ ID NO: 733627 - DNA, 22 bp, Artificial Sequence
  chemically synthesized
aagcaattctcccacctcagcc

SEQ ID NO: 733628 - DNA, 22 bp, Artificial Sequence
  chemically synthesized
tcccacctcagcctcccgagta

SEQ ID NO: 733629 - DNA, 22 bp, Artificial Sequence
  chemically synthesized
ccacctcagcctcccgagtagc

SEQ ID NO: 733630 - DNA, 22 bp, Artificial Sequence
  chemically synthesized
agcctcccgagtagctgggact

SEQ ID NO: 733631 - DNA, 22 bp, Artificial Sequence
  chemically synthesized
ccgagtagctgggactatgggt

SEQ ID NO: 733632 - DNA, 22 bp, Artificial Sequence
  chemically synthesized
gccgggtgtggtggcatgcacc

SEQ ID NO: 733633 - DNA, 22 bp, Artificial Sequence
  chemically synthesized
agccgggtgtggtggcatgcac

SEQ ID NO: 733634 - DNA, 22 bp, Artificial Sequence
  chemically synthesized
ggactatgggtgcatgccacca

SEQ ID NO: 733635 - DNA, 22 bp, Artificial Sequence
  chemically synthesized
tgggtgcatgccaccacacccg

SEQ ID NO: 733636 - DNA, 22 bp, Artificial Sequence
  chemically synthesized
aaaatacaaaaaacatttagcc

SEQ ID NO: 733637 - DNA, 22 bp, Artificial Sequence
  chemically synthesized
ctaaaaatacaaaaaacattta

SEQ ID NO: 733638 - DNA, 22 bp, Artificial Sequence
  chemically synthesized
tactaaaaatacaaaaaacatt

SEQ ID NO: 733639 - DNA, 22 bp, Artificial Sequence
  chemically synthesized
aatgttttttgtatttttagta

SEQ ID NO: 733640 - DNA, 22 bp, Artificial Sequence
  chemically synthesized
tttgtatttttagtagagacgg

SEQ ID NO: 733641 - DNA, 22 bp, Artificial Sequence
  chemically synthesized
ttgtatttttagtagagacggg

SEQ ID NO: 733642 - DNA, 22 bp, Artificial Sequence
  chemically synthesized
tgtatttttagtagagacgggg

SEQ ID NO: 733643 - DNA, 22 bp, Artificial Sequence
  chemically synthesized
gtatttttagtagagacggggt

SEQ ID NO: 733644 - DNA, 22 bp, Artificial Sequence
  chemically synthesized
tatttttagtagagacggggtt

SEQ ID NO: 733645 - DNA, 22 bp, Artificial Sequence
  chemically synthesized
gccaacatggtgaaaccccgtc

SEQ ID NO: 733646 - DNA, 22 bp, Artificial Sequence
  chemically synthesized
ggccaacatggtgaaaccccgt

SEQ ID NO: 733647 - DNA, 22 bp, Artificial Sequence
  chemically synthesized
ttagtagagacggggtttcacc

SEQ ID NO: 733648 - DNA, 22 bp, Artificial Sequence
  chemically synthesized
tagtagagacggggtttcacca

SEQ ID NO: 733649 - DNA, 22 bp, Artificial Sequence
  chemically synthesized
agtagagacggggtttcaccat

SEQ ID NO: 733650 - DNA, 22 bp, Artificial Sequence
  chemically synthesized
gtagagacggggtttcaccatg

SEQ ID NO: 733651 - DNA, 22 bp, Artificial Sequence
  chemically synthesized
gagaccagcttggccaacatgg

SEQ ID NO: 733652 - DNA, 22 bp, Artificial Sequence
  chemically synthesized
caccatgttggccaagctggtc

SEQ ID NO: 733653 - DNA, 22 bp, Artificial Sequence
  chemically synthesized
accatgttggccaagctggtct

SEQ ID NO: 733654 - DNA, 22 bp, Artificial Sequence
  chemically synthesized
aggccaggagttcgagaccagc

SEQ ID NO: 733655 - DNA, 22 bp, Artificial Sequence
  chemically synthesized
gccaagctggtctcgaactcct

SEQ ID NO: 733656 - DNA, 22 bp, Artificial Sequence
  chemically synthesized
gtctcgaactcctggcctcagg

SEQ ID NO: 733657 - DNA, 22 bp, Artificial Sequence
  chemically synthesized
gaactcctggcctcaggtgatc

SEQ ID NO: 733658 - DNA, 22 bp, Artificial Sequence
  chemically synthesized
agaggccaaggcaggcagatca

SEQ ID NO: 733659 - DNA, 22 bp, Artificial Sequence
  chemically synthesized
ctggcctcaggtgatctgcctg

SEQ ID NO: 733660 - DNA, 22 bp, Artificial Sequence
  chemically synthesized
gagaggccaaggcaggcagatc

SEQ ID NO: 733661 - DNA, 22 bp, Artificial Sequence
  chemically synthesized
tgagaggccaaggcaggcagat

SEQ ID NO: 733662 - DNA, 22 bp, Artificial Sequence
  chemically synthesized
gcctcaggtgatctgcctgcct

SEQ ID NO: 733663 - DNA, 22 bp, Artificial Sequence
  chemically synthesized
aggtgatctgcctgccttggcc

SEQ ID NO: 733664 - DNA, 22 bp, Artificial Sequence
  chemically synthesized
taatcccagcactttgagaggc

SEQ ID NO: 733665 - DNA, 22 bp, Artificial Sequence
  chemically synthesized
cctgccttggcctctcaaagtg

SEQ ID NO: 733666 - DNA, 22 bp, Artificial Sequence
  chemically synthesized
ccttggcctctcaaagtgctgg

SEQ ID NO: 733667 - DNA, 22 bp, Artificial Sequence
  chemically synthesized
ggcctctcaaagtgctgggatt

SEQ ID NO: 733668 - DNA, 22 bp, Artificial Sequence
  chemically synthesized
gcctctcaaagtgctgggatta

SEQ ID NO: 733669 - DNA, 22 bp, Artificial Sequence
  chemically synthesized
tcaaagtgctgggattataggc

SEQ ID NO: 733670 - DNA, 22 bp, Artificial Sequence
  chemically synthesized
aaagtgctgggattataggcat

SEQ ID NO: 733671 - DNA, 22 bp, Artificial Sequence
  chemically synthesized
gccaggtgcggtggcccatgcc

SEQ ID NO: 733672 - DNA, 22 bp, Artificial Sequence
  chemically synthesized
ggattataggcatgggccaccg

SEQ ID NO: 733673 - DNA, 22 bp, Artificial Sequence
  chemically synthesized
caatctggccaggtgcggtggc

SEQ ID NO: 733674 - DNA, 22 bp, Artificial Sequence
  chemically synthesized
taggcatgggccaccgcacctg

SEQ ID NO: 733675 - DNA, 22 bp, Artificial Sequence
  chemically synthesized
aagatacctgcaatctggccag

SEQ ID NO: 733676 - DNA, 22 bp, Artificial Sequence
  chemically synthesized
ttaaagatacctgcaatctggc

SEQ ID NO: 733677 - DNA, 22 bp, Artificial Sequence
  chemically synthesized
caacctgttaaagatacctgca

SEQ ID NO: 733678 - DNA, 22 bp, Artificial Sequence
  chemically synthesized
gccagattgcaggtatctttaa

SEQ ID NO: 733679 - DNA, 22 bp, Artificial Sequence
  chemically synthesized
aggtaacactccaacctgttaa

SEQ ID NO: 733680 - DNA, 22 bp, Artificial Sequence
  chemically synthesized
caggtatctttaacaggttgga

SEQ ID NO: 733681 - DNA, 22 bp, Artificial Sequence
  chemically synthesized
atgaaaattcaggtaacactcc

SEQ ID NO: 733682 - DNA, 22 bp, Artificial Sequence
  chemically synthesized
taacaggttggagtgttacctg

SEQ ID NO: 733683 - DNA, 22 bp, Artificial Sequence
  chemically synthesized
aacaggttggagtgttacctga

SEQ ID NO: 733684 - DNA, 22 bp, Artificial Sequence
  chemically synthesized
acaggttggagtgttacctgaa

SEQ ID NO: 733685 - DNA, 22 bp, Artificial Sequence
  chemically synthesized
ccaagattgatgaaaattcagg

SEQ ID NO: 733686 - DNA, 22 bp, Artificial Sequence
  chemically synthesized
cccaagattgatgaaaattcag

SEQ ID NO: 733687 - DNA, 22 bp, Artificial Sequence
  chemically synthesized
gagtgttacctgaattttcatc

SEQ ID NO: 733688 - DNA, 22 bp, Artificial Sequence
  chemically synthesized
tatgtttcccaagattgatgaa

SEQ ID NO: 733689 - DNA, 22 bp, Artificial Sequence
  chemically synthesized
cctgaattttcatcaatcttgg

SEQ ID NO: 733690 - DNA, 22 bp, Artificial Sequence
  chemically synthesized
gcagctatatgtttcccaagat

SEQ ID NO: 733691 - DNA, 22 bp, Artificial Sequence
  chemically synthesized
aattttcatcaatcttgggaaa

SEQ ID NO: 733692 - DNA, 22 bp, Artificial Sequence
  chemically synthesized
ttagcagctatatgtttcccaa

SEQ ID NO: 733693 - DNA, 22 bp, Artificial Sequence
  chemically synthesized
tcatcaatcttgggaaacatat

SEQ ID NO: 733694 - DNA, 22 bp, Artificial Sequence
  chemically synthesized
catcaatcttgggaaacatata

SEQ ID NO: 733695 - DNA, 22 bp, Artificial Sequence
  chemically synthesized
atcaatcttgggaaacatatag

SEQ ID NO: 733696 - DNA, 22 bp, Artificial Sequence
  chemically synthesized
aaactgttagcagctatatgtt

SEQ ID NO: 733697 - DNA, 22 bp, Artificial Sequence
  chemically synthesized
gggaaacatatagctgctaaca

SEQ ID NO: 733698 - DNA, 22 bp, Artificial Sequence
  chemically synthesized
ggaaacatatagctgctaacag

SEQ ID NO: 733699 - DNA, 22 bp, Artificial Sequence
  chemically synthesized
aacatagagtaggaagttaaaa

SEQ ID NO: 733700 - DNA, 22 bp, Artificial Sequence
  chemically synthesized
ctaacagttttaacttcctact

SEQ ID NO: 733701 - DNA, 22 bp, Artificial Sequence
  chemically synthesized
acagttttaacttcctactcta

SEQ ID NO: 733702 - DNA, 22 bp, Artificial Sequence
  chemically synthesized
aacgagttaaacatagagtagg

SEQ ID NO: 733703 - DNA, 22 bp, Artificial Sequence
  chemically synthesized
taacttcctactctatgtttaa

SEQ ID NO: 733704 - DNA, 22 bp, Artificial Sequence
  chemically synthesized
aacttcctactctatgtttaac

SEQ ID NO: 733705 - DNA, 22 bp, Artificial Sequence
  chemically synthesized
acttcctactctatgtttaact

SEQ ID NO: 733706 - DNA, 22 bp, Artificial Sequence
  chemically synthesized
atatgttaaacgagttaaacat

SEQ ID NO: 733707 - DNA, 22 bp, Artificial Sequence
  chemically synthesized
aatatgttaaacgagttaaaca

SEQ ID NO: 733708 - DNA, 22 bp, Artificial Sequence
  chemically synthesized
taatatgttaaacgagttaaac

SEQ ID NO: 733709 - DNA, 22 bp, Artificial Sequence
  chemically synthesized
cctactctatgtttaactcgtt

SEQ ID NO: 733710 - DNA, 22 bp, Artificial Sequence
  chemically synthesized
ctactctatgtttaactcgttt

SEQ ID NO: 733711 - DNA, 22 bp, Artificial Sequence
  chemically synthesized
ctctatgtttaactcgtttaac

SEQ ID NO: 733712 - DNA, 22 bp, Artificial Sequence
  chemically synthesized
cgtgttttaatatgttaaacga

SEQ ID NO: 733713 - DNA, 22 bp, Artificial Sequence
  chemically synthesized
tatgtttaactcgtttaacata

SEQ ID NO: 733714 - DNA, 22 bp, Artificial Sequence
  chemically synthesized
tgtttaactcgtttaacatatt

SEQ ID NO: 733715 - DNA, 22 bp, Artificial Sequence
  chemically synthesized
tctgcgtgttttaatatgttaa

SEQ ID NO: 733716 - DNA, 22 bp, Artificial Sequence
  chemically synthesized
aactcgtttaacatattaaaac

SEQ ID NO: 733717 - DNA, 22 bp, Artificial Sequence
  chemically synthesized
actcgtttaacatattaaaaca

SEQ ID NO: 733718 - DNA, 22 bp, Artificial Sequence
  chemically synthesized
atattgtctgcgtgttttaata

SEQ ID NO: 733719 - DNA, 22 bp, Artificial Sequence
  chemically synthesized
aatattgtctgcgtgttttaat

SEQ ID NO: 733720 - DNA, 22 bp, Artificial Sequence
  chemically synthesized
gtttaacatattaaaacacgca

SEQ ID NO: 733721 - DNA, 22 bp, Artificial Sequence
  chemically synthesized
cagtttaatattgtctgcgtgt

SEQ ID NO: 733722 - DNA, 22 bp, Artificial Sequence
  chemically synthesized
aacatattaaaacacgcagaca

SEQ ID NO: 733723 - DNA, 22 bp, Artificial Sequence
  chemically synthesized
acatattaaaacacgcagacaa

SEQ ID NO: 733724 - DNA, 22 bp, Artificial Sequence
  chemically synthesized
ctgcagtttaatattgtctgcg

SEQ ID NO: 733725 - DNA, 22 bp, Artificial Sequence
  chemically synthesized
aaacacgcagacaatattaaac

SEQ ID NO: 733726 - DNA, 22 bp, Artificial Sequence
  chemically synthesized
catgtgttgctgcagtttaata

SEQ ID NO: 733727 - DNA, 22 bp, Artificial Sequence
  chemically synthesized
tccatgtgttgctgcagtttaa

SEQ ID NO: 733728 - DNA, 22 bp, Artificial Sequence
  chemically synthesized
ctccatgtgttgctgcagttta

SEQ ID NO: 733729 - DNA, 22 bp, Artificial Sequence
  chemically synthesized
ttctccatgtgttgctgcagtt

SEQ ID NO: 733730 - DNA, 22 bp, Artificial Sequence
  chemically synthesized
cttctccatgtgttgctgcagt

SEQ ID NO: 733731 - DNA, 22 bp, Artificial Sequence
  chemically synthesized
tcttctccatgtgttgctgcag

SEQ ID NO: 733732 - DNA, 22 bp, Artificial Sequence
  chemically synthesized
ttcttctccatgtgttgctgca

SEQ ID NO: 733733 - DNA, 22 bp, Artificial Sequence
  chemically synthesized
aactgcagcaacacatggagaa

SEQ ID NO: 733734 - DNA, 22 bp, Artificial Sequence
  chemically synthesized
cacgatgcttttcttctccatg

SEQ ID NO: 733735 - DNA, 22 bp, Artificial Sequence
  chemically synthesized
ccacgatgcttttcttctccat

SEQ ID NO: 733736 - DNA, 22 bp, Artificial Sequence
  chemically synthesized
cagcaacacatggagaagaaaa

SEQ ID NO: 733737 - DNA, 22 bp, Artificial Sequence
  chemically synthesized
ccccatttccacgatgcttttc

SEQ ID NO: 733738 - DNA, 22 bp, Artificial Sequence
  chemically synthesized
accccatttccacgatgctttt

SEQ ID NO: 733739 - DNA, 22 bp, Artificial Sequence
  chemically synthesized
gagtcccatcttaccccatttc

SEQ ID NO: 733740 - DNA, 22 bp, Artificial Sequence
  chemically synthesized
tagagtcccatcttaccccatt

SEQ ID NO: 733741 - DNA, 22 bp, Artificial Sequence
  chemically synthesized
ctagagtcccatcttaccccat

SEQ ID NO: 733742 - DNA, 22 bp, Artificial Sequence
  chemically synthesized
aacacttctagagtcccatctt

SEQ ID NO: 733743 - DNA, 22 bp, Artificial Sequence
  chemically synthesized
aaacacttctagagtcccatct

SEQ ID NO: 733744 - DNA, 22 bp, Artificial Sequence
  chemically synthesized
taaacacttctagagtcccatc

SEQ ID NO: 733745 - DNA, 22 bp, Artificial Sequence
  chemically synthesized
agcatgggaggttttaaacact

SEQ ID NO: 733746 - DNA, 22 bp, Artificial Sequence
  chemically synthesized
cagcatgggaggttttaaacac

SEQ ID NO: 733747 - DNA, 22 bp, Artificial Sequence
  chemically synthesized
aaatttcagcatgggaggtttt

SEQ ID NO: 733748 - DNA, 22 bp, Artificial Sequence
  chemically synthesized
tagaagtgtttaaaacctccca

SEQ ID NO: 733749 - DNA, 22 bp, Artificial Sequence
  chemically synthesized
aaaatttcagcatgggaggttt

SEQ ID NO: 733750 - DNA, 22 bp, Artificial Sequence
  chemically synthesized
gaagtgtttaaaacctcccatg

SEQ ID NO: 733751 - DNA, 22 bp, Artificial Sequence
  chemically synthesized
cttaaaatttcagcatgggagg

SEQ ID NO: 733752 - DNA, 22 bp, Artificial Sequence
  chemically synthesized
acttaaaatttcagcatgggag

SEQ ID NO: 733753 - DNA, 22 bp, Artificial Sequence
  chemically synthesized
aaaacctcccatgctgaaattt

SEQ ID NO: 733754 - DNA, 22 bp, Artificial Sequence
  chemically synthesized
aaacctcccatgctgaaatttt

SEQ ID NO: 733755 - DNA, 22 bp, Artificial Sequence
  chemically synthesized
cccgtcaacatttacttaaaat

SEQ ID NO: 733756 - DNA, 22 bp, Artificial Sequence
  chemically synthesized
ccatgctgaaattttaagtaaa

SEQ ID NO: 733757 - DNA, 22 bp, Artificial Sequence
  chemically synthesized
accattgcccgtcaacatttac

SEQ ID NO: 733758 - DNA, 22 bp, Artificial Sequence
  chemically synthesized
aaccattgcccgtcaacattta

SEQ ID NO: 733759 - DNA, 22 bp, Artificial Sequence
  chemically synthesized
aaattttaagtaaatgttgacg

SEQ ID NO: 733760 - DNA, 22 bp, Artificial Sequence
  chemically synthesized
caatttaaccattgcccgtcaa

SEQ ID NO: 733761 - DNA, 22 bp, Artificial Sequence
  chemically synthesized
acaatttaaccattgcccgtca

SEQ ID NO: 733762 - DNA, 22 bp, Artificial Sequence
  chemically synthesized
taagtaaatgttgacgggcaat

SEQ ID NO: 733763 - DNA, 22 bp, Artificial Sequence
  chemically synthesized
tacaatttaaccattgcccgtc

SEQ ID NO: 733764 - DNA, 22 bp, Artificial Sequence
  chemically synthesized
aagtaaatgttgacgggcaatg

SEQ ID NO: 733765 - DNA, 22 bp, Artificial Sequence
  chemically synthesized
agtaaatgttgacgggcaatgg

SEQ ID NO: 733766 - DNA, 22 bp, Artificial Sequence
  chemically synthesized
ttttacaatttaaccattgccc

SEQ ID NO: 733767 - DNA, 22 bp, Artificial Sequence
  chemically synthesized
attttacaatttaaccattgcc

SEQ ID NO: 733768 - DNA, 22 bp, Artificial Sequence
  chemically synthesized
atttattttacaatttaaccat

SEQ ID NO: 733769 - DNA, 22 bp, Artificial Sequence
  chemically synthesized
acgggcaatggttaaattgtaa

SEQ ID NO: 733770 - DNA, 22 bp, Artificial Sequence
  chemically synthesized
agtgacaacaaattcatttatt

SEQ ID NO: 733771 - DNA, 22 bp, Artificial Sequence
  chemically synthesized
cagtgacaacaaattcatttat

SEQ ID NO: 733772 - DNA, 22 bp, Artificial Sequence
  chemically synthesized
aattgtaaaataaatgaatttg

SEQ ID NO: 733773 - DNA, 22 bp, Artificial Sequence
  chemically synthesized
aatttcagtgacaacaaattca

SEQ ID NO: 733774 - DNA, 22 bp, Artificial Sequence
  chemically synthesized
taaatttcagtgacaacaaatt

SEQ ID NO: 733775 - DNA, 22 bp, Artificial Sequence
  chemically synthesized
taaaataaatgaatttgttgtc

SEQ ID NO: 733776 - DNA, 22 bp, Artificial Sequence
  chemically synthesized
gttgtcactgaaatttagaata

SEQ ID NO: 733777 - DNA, 22 bp, Artificial Sequence
  chemically synthesized
ttgtcactgaaatttagaatac

SEQ ID NO: 733778 - DNA, 22 bp, Artificial Sequence
  chemically synthesized
tcactgaaatttagaatactcc

SEQ ID NO: 733779 - DNA, 22 bp, Artificial Sequence
  chemically synthesized
aaatttagaatactcctacctc

SEQ ID NO: 733780 - DNA, 22 bp, Artificial Sequence
  chemically synthesized
agaatactcctacctcttctta

SEQ ID NO: 733781 - DNA, 22 bp, Artificial Sequence
  chemically synthesized
gaatactcctacctcttcttat

SEQ ID NO: 733782 - DNA, 22 bp, Artificial Sequence
  chemically synthesized
aaagggcaaaacataagaagag

SEQ ID NO: 733783 - DNA, 22 bp, Artificial Sequence
  chemically synthesized
aaaagggcaaaacataagaaga

SEQ ID NO: 733784 - DNA, 22 bp, Artificial Sequence
  chemically synthesized
tatcttaaaagggcaaaacata

SEQ ID NO: 733785 - DNA, 22 bp, Artificial Sequence
  chemically synthesized
ctacctcttcttatgttttgcc

SEQ ID NO: 733786 - DNA, 22 bp, Artificial Sequence
  chemically synthesized
gtatcttaaaagggcaaaacat

SEQ ID NO: 733787 - DNA, 22 bp, Artificial Sequence
  chemically synthesized
cctcttcttatgttttgccctt

SEQ ID NO: 733788 - DNA, 22 bp, Artificial Sequence
  chemically synthesized
atttgtatcttaaaagggcaaa

SEQ ID NO: 733789 - DNA, 22 bp, Artificial Sequence
  chemically synthesized
aatttgtatcttaaaagggcaa

SEQ ID NO: 733790 - DNA, 22 bp, Artificial Sequence
  chemically synthesized
taatttgtatcttaaaagggca

SEQ ID NO: 733791 - DNA, 22 bp, Artificial Sequence
  chemically synthesized
ttcttatgttttgcccttttaa

SEQ ID NO: 733792 - DNA, 22 bp, Artificial Sequence
  chemically synthesized
cttatgttttgcccttttaaga

SEQ ID NO: 733793 - DNA, 22 bp, Artificial Sequence
  chemically synthesized
ttatgttttgcccttttaagat

SEQ ID NO: 733794 - DNA, 22 bp, Artificial Sequence
  chemically synthesized
atgttttgcccttttaagatac

SEQ ID NO: 733795 - DNA, 22 bp, Artificial Sequence
  chemically synthesized
tgttttgcccttttaagataca

SEQ ID NO: 733796 - DNA, 22 bp, Artificial Sequence
  chemically synthesized
aaaattttaatttgtatcttaa

SEQ ID NO: 733797 - DNA, 22 bp, Artificial Sequence
  chemically synthesized
aaaaattttaatttgtatctta

SEQ ID NO: 733798 - DNA, 22 bp, Artificial Sequence
  chemically synthesized
taaaaattttaatttgtatctt

SEQ ID NO: 733799 - DNA, 22 bp, Artificial Sequence
  chemically synthesized
ttaaaaattttaatttgtatct

SEQ ID NO: 733800 - DNA, 22 bp, Artificial Sequence
  chemically synthesized
tttaaaaattttaatttgtatc

SEQ ID NO: 733801 - DNA, 22 bp, Artificial Sequence
  chemically synthesized
tgcccttttaagatacaaatta

SEQ ID NO: 733802 - DNA, 22 bp, Artificial Sequence
  chemically synthesized
gcccttttaagatacaaattaa

SEQ ID NO: 733803 - DNA, 22 bp, Artificial Sequence
  chemically synthesized
cccttttaagatacaaattaaa

SEQ ID NO: 733804 - DNA, 22 bp, Artificial Sequence
  chemically synthesized
ttttttaaaaattttaatttgt

SEQ ID NO: 733805 - DNA, 22 bp, Artificial Sequence
  chemically synthesized
tattttttaaaaattttaattt

SEQ ID NO: 733806 - DNA, 22 bp, Artificial Sequence
  chemically synthesized
ctattttttaaaaattttaatt

SEQ ID NO: 733807 - DNA, 22 bp, Artificial Sequence
  chemically synthesized
ttaagatacaaattaaaatttt

SEQ ID NO: 733808 - DNA, 22 bp, Artificial Sequence
  chemically synthesized
ttctattttttaaaaattttaa

SEQ ID NO: 733809 - DNA, 22 bp, Artificial Sequence
  chemically synthesized
taagatacaaattaaaattttt

SEQ ID NO: 733810 - DNA, 22 bp, Artificial Sequence
  chemically synthesized
aagatacaaattaaaattttta

SEQ ID NO: 733811 - DNA, 22 bp, Artificial Sequence
  chemically synthesized
agatacaaattaaaatttttaa

SEQ ID NO: 733812 - DNA, 22 bp, Artificial Sequence
  chemically synthesized
agctcttctattttttaaaaat

SEQ ID NO: 733813 - DNA, 22 bp, Artificial Sequence
  chemically synthesized
tgagctcttctattttttaaaa

SEQ ID NO: 733814 - DNA, 22 bp, Artificial Sequence
  chemically synthesized
ctgagctcttctattttttaaa

SEQ ID NO: 733815 - DNA, 22 bp, Artificial Sequence
  chemically synthesized
tttctgagctcttctatttttt

SEQ ID NO: 733816 - DNA, 22 bp, Artificial Sequence
  chemically synthesized
atttctgagctcttctattttt

SEQ ID NO: 733817 - DNA, 22 bp, Artificial Sequence
  chemically synthesized
tatttctgagctcttctatttt

SEQ ID NO: 733818 - DNA, 22 bp, Artificial Sequence
  chemically synthesized
aaatttttaaaaaatagaagag

SEQ ID NO: 733819 - DNA, 22 bp, Artificial Sequence
  chemically synthesized
ttaaaaaatagaagagctcaga

SEQ ID NO: 733820 - DNA, 22 bp, Artificial Sequence
  chemically synthesized
taaaaaatagaagagctcagaa

SEQ ID NO: 733821 - DNA, 22 bp, Artificial Sequence
  chemically synthesized
aaaaaatagaagagctcagaaa

SEQ ID NO: 733822 - DNA, 22 bp, Artificial Sequence
  chemically synthesized
aaaaatagaagagctcagaaat

SEQ ID NO: 733823 - DNA, 22 bp, Artificial Sequence
  chemically synthesized
tccccatcactttatttctgag

SEQ ID NO: 733824 - DNA, 22 bp, Artificial Sequence
  chemically synthesized
agaaataaagtgatggggataa

SEQ ID NO: 733825 - DNA, 22 bp, Artificial Sequence
  chemically synthesized
gtgaaaggaaaagtgtggtagt

SEQ ID NO: 733826 - DNA, 22 bp, Artificial Sequence
  chemically synthesized
tactaccacacttttcctttca

SEQ ID NO: 733827 - DNA, 22 bp, Artificial Sequence
  chemically synthesized
caaagtaactggtgaaaggaaa

SEQ ID NO: 733828 - DNA, 22 bp, Artificial Sequence
  chemically synthesized
ccaaagtaactggtgaaaggaa

SEQ ID NO: 733829 - DNA, 22 bp, Artificial Sequence
  chemically synthesized
tccaaagtaactggtgaaagga

SEQ ID NO: 733830 - DNA, 22 bp, Artificial Sequence
  chemically synthesized
ccacacttttcctttcaccagt

SEQ ID NO: 733831 - DNA, 22 bp, Artificial Sequence
  chemically synthesized
ttcctttcaccagttactttgg

SEQ ID NO: 733832 - DNA, 22 bp, Artificial Sequence
  chemically synthesized
tcctttcaccagttactttgga

SEQ ID NO: 733833 - DNA, 22 bp, Artificial Sequence
  chemically synthesized
cataggatactttccaaagtaa

SEQ ID NO: 733834 - DNA, 22 bp, Artificial Sequence
  chemically synthesized
cctttcaccagttactttggaa

SEQ ID NO: 733835 - DNA, 22 bp, Artificial Sequence
  chemically synthesized
ctttcaccagttactttggaaa

SEQ ID NO: 733836 - DNA, 22 bp, Artificial Sequence
  chemically synthesized
tcaccagttactttggaaagta

SEQ ID NO: 733837 - DNA, 22 bp, Artificial Sequence
  chemically synthesized
caccagttactttggaaagtat

SEQ ID NO: 733838 - DNA, 22 bp, Artificial Sequence
  chemically synthesized
accagttactttggaaagtatc

SEQ ID NO: 733839 - DNA, 22 bp, Artificial Sequence
  chemically synthesized
aaatcaaaactccataggatac

SEQ ID NO: 733840 - DNA, 22 bp, Artificial Sequence
  chemically synthesized
ctttggaaagtatcctatggag

SEQ ID NO: 733841 - DNA, 22 bp, Artificial Sequence
  chemically synthesized
ctaaaatcaaaactccatagga

SEQ ID NO: 733842 - DNA, 22 bp, Artificial Sequence
  chemically synthesized
tactaaaatcaaaactccatag

SEQ ID NO: 733843 - DNA, 22 bp, Artificial Sequence
  chemically synthesized
tggaaagtatcctatggagttt

SEQ ID NO: 733844 - DNA, 22 bp, Artificial Sequence
  chemically synthesized
ggaaagtatcctatggagtttt

SEQ ID NO: 733845 - DNA, 22 bp, Artificial Sequence
  chemically synthesized
gaaagtatcctatggagttttg

SEQ ID NO: 733846 - DNA, 22 bp, Artificial Sequence
  chemically synthesized
acatgaattctactaaaatcaa

SEQ ID NO: 733847 - DNA, 22 bp, Artificial Sequence
  chemically synthesized
cctcacatgaattctactaaaa

SEQ ID NO: 733848 - DNA, 22 bp, Artificial Sequence
  chemically synthesized
tggagttttgattttagtagaa

SEQ ID NO: 733849 - DNA, 22 bp, Artificial Sequence
  chemically synthesized
gcctcacatgaattctactaaa

SEQ ID NO: 733850 - DNA, 22 bp, Artificial Sequence
  chemically synthesized
tgcctcacatgaattctactaa

SEQ ID NO: 733851 - DNA, 22 bp, Artificial Sequence
  chemically synthesized
ttgcctcacatgaattctacta

SEQ ID NO: 733852 - DNA, 22 bp, Artificial Sequence
  chemically synthesized
tgattttagtagaattcatgtg

SEQ ID NO: 733853 - DNA, 22 bp, Artificial Sequence
  chemically synthesized
gattttagtagaattcatgtga

SEQ ID NO: 733854 - DNA, 22 bp, Artificial Sequence
  chemically synthesized
attttagtagaattcatgtgag

SEQ ID NO: 733855 - DNA, 22 bp, Artificial Sequence
  chemically synthesized
tagtagaattcatgtgaggcaa

SEQ ID NO: 733856 - DNA, 22 bp, Artificial Sequence
  chemically synthesized
agtagaattcatgtgaggcaaa

SEQ ID NO: 733857 - DNA, 22 bp, Artificial Sequence
  chemically synthesized
gtagaattcatgtgaggcaaaa

SEQ ID NO: 733858 - DNA, 22 bp, Artificial Sequence
  chemically synthesized
atgtgaggcaaaagatggctta

SEQ ID NO: 733859 - DNA, 22 bp, Artificial Sequence
  chemically synthesized
cacaatagaaataataagccat

SEQ ID NO: 733860 - DNA, 22 bp, Artificial Sequence
  chemically synthesized
acacaatagaaataataagcca

SEQ ID NO: 733861 - DNA, 22 bp, Artificial Sequence
  chemically synthesized
tacacaatagaaataataagcc

SEQ ID NO: 733862 - DNA, 22 bp, Artificial Sequence
  chemically synthesized
gagattttacacaatagaaata

SEQ ID NO: 733863 - DNA, 22 bp, Artificial Sequence
  chemically synthesized
ggagattttacacaatagaaat

SEQ ID NO: 733864 - DNA, 22 bp, Artificial Sequence
  chemically synthesized
attatttctattgtgtaaaatc

SEQ ID NO: 733865 - DNA, 22 bp, Artificial Sequence
  chemically synthesized
ttatttctattgtgtaaaatct

SEQ ID NO: 733866 - DNA, 22 bp, Artificial Sequence
  chemically synthesized
cccagtggtttggagattttac

SEQ ID NO: 733867 - DNA, 22 bp, Artificial Sequence
  chemically synthesized
tttctattgtgtaaaatctcca

SEQ ID NO: 733868 - DNA, 22 bp, Artificial Sequence
  chemically synthesized
ctattgtgtaaaatctccaaac

SEQ ID NO: 733869 - DNA, 22 bp, Artificial Sequence
  chemically synthesized
tattgtgtaaaatctccaaacc

SEQ ID NO: 733870 - DNA, 22 bp, Artificial Sequence
  chemically synthesized
taactgcccagtggtttggaga

SEQ ID NO: 733871 - DNA, 22 bp, Artificial Sequence
  chemically synthesized
ataactgcccagtggtttggag

SEQ ID NO: 733872 - DNA, 22 bp, Artificial Sequence
  chemically synthesized
ttgtgtaaaatctccaaaccac

SEQ ID NO: 733873 - DNA, 22 bp, Artificial Sequence
  chemically synthesized
tgtaaaatctccaaaccactgg

SEQ ID NO: 733874 - DNA, 22 bp, Artificial Sequence
  chemically synthesized
caaaccactgggcagttataag

SEQ ID NO: 733875 - DNA, 22 bp, Artificial Sequence
  chemically synthesized
aaaaaaaaaaaagtcttataac

SEQ ID NO: 733876 - DNA, 22 bp, Artificial Sequence
  chemically synthesized
aaaaaaaaaaaaagtcttataa

SEQ ID NO: 733877 - DNA, 22 bp, Artificial Sequence
  chemically synthesized
agcttaaaaaaaaaaaaagtct

SEQ ID NO: 733878 - DNA, 22 bp, Artificial Sequence
  chemically synthesized
gagcttaaaaaaaaaaaaagtc

SEQ ID NO: 733879 - DNA, 22 bp, Artificial Sequence
  chemically synthesized
ggcagttataagactttttttt

SEQ ID NO: 733880 - DNA, 22 bp, Artificial Sequence
  chemically synthesized
tgtttgagcttaaaaaaaaaaa

SEQ ID NO: 733881 - DNA, 22 bp, Artificial Sequence
  chemically synthesized
taagactttttttttttttaag

SEQ ID NO: 733882 - DNA, 22 bp, Artificial Sequence
  chemically synthesized
acctgtgtttgagcttaaaaaa

SEQ ID NO: 733883 - DNA, 22 bp, Artificial Sequence
  chemically synthesized
gacctgtgtttgagcttaaaaa

SEQ ID NO: 733884 - DNA, 22 bp, Artificial Sequence
  chemically synthesized
tttttttttttaagctcaaaca

SEQ ID NO: 733885 - DNA, 22 bp, Artificial Sequence
  chemically synthesized
ttttttttttaagctcaaacac

SEQ ID NO: 733886 - DNA, 22 bp, Artificial Sequence
  chemically synthesized
tagccttgacctgtgtttgagc

SEQ ID NO: 733887 - DNA, 22 bp, Artificial Sequence
  chemically synthesized
tttttttttaagctcaaacaca

SEQ ID NO: 733888 - DNA, 22 bp, Artificial Sequence
  chemically synthesized
ttttttttaagctcaaacacag

SEQ ID NO: 733889 - DNA, 22 bp, Artificial Sequence
  chemically synthesized
tttttttaagctcaaacacagg

SEQ ID NO: 733890 - DNA, 22 bp, Artificial Sequence
  chemically synthesized
ttttttaagctcaaacacaggt

SEQ ID NO: 733891 - DNA, 22 bp, Artificial Sequence
  chemically synthesized
tttttaagctcaaacacaggtc

SEQ ID NO: 733892 - DNA, 22 bp, Artificial Sequence
  chemically synthesized
ttttaagctcaaacacaggtca

SEQ ID NO: 733893 - DNA, 22 bp, Artificial Sequence
  chemically synthesized
tttaagctcaaacacaggtcaa

SEQ ID NO: 733894 - DNA, 22 bp, Artificial Sequence
  chemically synthesized
ccacctatagccttgacctgtg

SEQ ID NO: 733895 - DNA, 22 bp, Artificial Sequence
  chemically synthesized
ttaagctcaaacacaggtcaag

SEQ ID NO: 733896 - DNA, 22 bp, Artificial Sequence
  chemically synthesized
taagctcaaacacaggtcaagg

SEQ ID NO: 733897 - DNA, 22 bp, Artificial Sequence
  chemically synthesized
aagctcaaacacaggtcaaggc

SEQ ID NO: 733898 - DNA, 22 bp, Artificial Sequence
  chemically synthesized
agctcaaacacaggtcaaggct

SEQ ID NO: 733899 - DNA, 22 bp, Artificial Sequence
  chemically synthesized
aagaactcccacctatagcctt

SEQ ID NO: 733900 - DNA, 22 bp, Artificial Sequence
  chemically synthesized
aaacacaggtcaaggctatagg

SEQ ID NO: 733901 - DNA, 22 bp, Artificial Sequence
  chemically synthesized
ttcaagaactcccacctatagc

SEQ ID NO: 733902 - DNA, 22 bp, Artificial Sequence
  chemically synthesized
ttgttcaagaactcccacctat

SEQ ID NO: 733903 - DNA, 22 bp, Artificial Sequence
  chemically synthesized
attgttcaagaactcccaccta

SEQ ID NO: 733904 - DNA, 22 bp, Artificial Sequence
  chemically synthesized
tttattgttcaagaactcccac

SEQ ID NO: 733905 - DNA, 22 bp, Artificial Sequence
  chemically synthesized
gtttattgttcaagaactccca

SEQ ID NO: 733906 - DNA, 22 bp, Artificial Sequence
  chemically synthesized
tgtttattgttcaagaactccc

SEQ ID NO: 733907 - DNA, 22 bp, Artificial Sequence
  chemically synthesized
actttgtttattgttcaagaac

SEQ ID NO: 733908 - DNA, 22 bp, Artificial Sequence
  chemically synthesized
tcactttgtttattgttcaaga

SEQ ID NO: 733909 - DNA, 22 bp, Artificial Sequence
  chemically synthesized
taggtgggagttcttgaacaat

SEQ ID NO: 733910 - DNA, 22 bp, Artificial Sequence
  chemically synthesized
ctcactttgtttattgttcaag

SEQ ID NO: 733911 - DNA, 22 bp, Artificial Sequence
  chemically synthesized
agaccatttctcactttgttta

SEQ ID NO: 733912 - DNA, 22 bp, Artificial Sequence
  chemically synthesized
ttgaacaataaacaaagtgaga

SEQ ID NO: 733913 - DNA, 22 bp, Artificial Sequence
  chemically synthesized
gaacaataaacaaagtgagaaa

SEQ ID NO: 733914 - DNA, 22 bp, Artificial Sequence
  chemically synthesized
aacaataaacaaagtgagaaat

SEQ ID NO: 733915 - DNA, 22 bp, Artificial Sequence
  chemically synthesized
aaagcagcaataacaaaaaatt

SEQ ID NO: 733916 - DNA, 22 bp, Artificial Sequence
  chemically synthesized
tgtgtcattcaaagcagcaata

SEQ ID NO: 733917 - DNA, 22 bp, Artificial Sequence
  chemically synthesized
aattttttgttattgctgcttt

SEQ ID NO: 733918 - DNA, 22 bp, Artificial Sequence
  chemically synthesized
attttttgttattgctgctttg

SEQ ID NO: 733919 - DNA, 22 bp, Artificial Sequence
  chemically synthesized
tttgttattgctgctttgaatg

SEQ ID NO: 733920 - DNA, 22 bp, Artificial Sequence
  chemically synthesized
ttgttattgctgctttgaatga

SEQ ID NO: 733921 - DNA, 22 bp, Artificial Sequence
  chemically synthesized
tgttattgctgctttgaatgac

SEQ ID NO: 733922 - DNA, 22 bp, Artificial Sequence
  chemically synthesized
gttattgctgctttgaatgaca

SEQ ID NO: 733923 - DNA, 22 bp, Artificial Sequence
  chemically synthesized
ttattgctgctttgaatgacac

SEQ ID NO: 733924 - DNA, 22 bp, Artificial Sequence
  chemically synthesized
gtacatgtgtctgtgtgtcatt

SEQ ID NO: 733925 - DNA, 22 bp, Artificial Sequence
  chemically synthesized
ttgctgctttgaatgacacaca

SEQ ID NO: 733926 - DNA, 22 bp, Artificial Sequence
  chemically synthesized
ctgctttgaatgacacacagac

SEQ ID NO: 733927 - DNA, 22 bp, Artificial Sequence
  chemically synthesized
tgttagtacatgtgtctgtgtg

SEQ ID NO: 733928 - DNA, 22 bp, Artificial Sequence
  chemically synthesized
ctttgaatgacacacagacaca

SEQ ID NO: 733929 - DNA, 22 bp, Artificial Sequence
  chemically synthesized
cctgtgttagtacatgtgtctg

SEQ ID NO: 733930 - DNA, 22 bp, Artificial Sequence
  chemically synthesized
tgaatgacacacagacacatgt

SEQ ID NO: 733931 - DNA, 22 bp, Artificial Sequence
  chemically synthesized
gcctgtgttagtacatgtgtct

SEQ ID NO: 733932 - DNA, 22 bp, Artificial Sequence
  chemically synthesized
gaatgacacacagacacatgta

SEQ ID NO: 733933 - DNA, 22 bp, Artificial Sequence
  chemically synthesized
aatgacacacagacacatgtac

SEQ ID NO: 733934 - DNA, 22 bp, Artificial Sequence
  chemically synthesized
acacaggcaagactcttgctgc

SEQ ID NO: 733935 - DNA, 22 bp, Artificial Sequence
  chemically synthesized
caaaaatacatatatccgtgca

SEQ ID NO: 733936 - DNA, 22 bp, Artificial Sequence
  chemically synthesized
tacaaaaatacatatatccgtg

SEQ ID NO: 733937 - DNA, 22 bp, Artificial Sequence
  chemically synthesized
ctacaaaaatacatatatccgt

SEQ ID NO: 733938 - DNA, 22 bp, Artificial Sequence
  chemically synthesized
tctacaaaaatacatatatccg

SEQ ID NO: 733939 - DNA, 22 bp, Artificial Sequence
  chemically synthesized
ttctacaaaaatacatatatcc

SEQ ID NO: 733940 - DNA, 22 bp, Artificial Sequence
  chemically synthesized
ttgctgcacggatatatgtatt

SEQ ID NO: 733941 - DNA, 22 bp, Artificial Sequence
  chemically synthesized
gctgcacggatatatgtatttt

SEQ ID NO: 733942 - DNA, 22 bp, Artificial Sequence
  chemically synthesized
atcttttctacaaaaatacata

SEQ ID NO: 733943 - DNA, 22 bp, Artificial Sequence
  chemically synthesized
ctgcacggatatatgtattttt

SEQ ID NO: 733944 - DNA, 22 bp, Artificial Sequence
  chemically synthesized
gatcttttctacaaaaatacat

SEQ ID NO: 733945 - DNA, 22 bp, Artificial Sequence
  chemically synthesized
cacggatatatgtatttttgta

SEQ ID NO: 733946 - DNA, 22 bp, Artificial Sequence
  chemically synthesized
gtttgatcttttctacaaaaat

SEQ ID NO: 733947 - DNA, 22 bp, Artificial Sequence
  chemically synthesized
agtttgatcttttctacaaaaa

SEQ ID NO: 733948 - DNA, 22 bp, Artificial Sequence
  chemically synthesized
tagtttgatcttttctacaaaa

SEQ ID NO: 733949 - DNA, 22 bp, Artificial Sequence
  chemically synthesized
attttagtttgatcttttctac

SEQ ID NO: 733950 - DNA, 22 bp, Artificial Sequence
  chemically synthesized
ttgtagaaaagatcaaactaaa

SEQ ID NO: 733951 - DNA, 22 bp, Artificial Sequence
  chemically synthesized
tgtagaaaagatcaaactaaaa

SEQ ID NO: 733952 - DNA, 22 bp, Artificial Sequence
  chemically synthesized
gtagaaaagatcaaactaaaat

SEQ ID NO: 733953 - DNA, 22 bp, Artificial Sequence
  chemically synthesized
tagaaaagatcaaactaaaatg

SEQ ID NO: 733954 - DNA, 22 bp, Artificial Sequence
  chemically synthesized
aaatgaattcactgcctggcat

SEQ ID NO: 733955 - DNA, 22 bp, Artificial Sequence
  chemically synthesized
actgcctggcatcatgttttca

SEQ ID NO: 733956 - DNA, 22 bp, Artificial Sequence
  chemically synthesized
cctggcatcatgttttcatctg

SEQ ID NO: 733957 - DNA, 22 bp, Artificial Sequence
  chemically synthesized
tggaaaatggaaggcagatgaa

SEQ ID NO: 733958 - DNA, 22 bp, Artificial Sequence
  chemically synthesized
gtggaaaatggaaggcagatga

SEQ ID NO: 733959 - DNA, 22 bp, Artificial Sequence
  chemically synthesized
gcatcatgttttcatctgcctt

SEQ ID NO: 733960 - DNA, 22 bp, Artificial Sequence
  chemically synthesized
tcatctgccttccattttccac

SEQ ID NO: 733961 - DNA, 22 bp, Artificial Sequence
  chemically synthesized
catctgccttccattttccaca

SEQ ID NO: 733962 - DNA, 22 bp, Artificial Sequence
  chemically synthesized
atctgccttccattttccacaa

SEQ ID NO: 733963 - DNA, 22 bp, Artificial Sequence
  chemically synthesized
ccttccattttccacaagggtg

SEQ ID NO: 733964 - DNA, 22 bp, Artificial Sequence
  chemically synthesized
agcaagtggagtacacccttgt

SEQ ID NO: 733965 - DNA, 22 bp, Artificial Sequence
  chemically synthesized
ccattttccacaagggtgtact

SEQ ID NO: 733966 - DNA, 22 bp, Artificial Sequence
  chemically synthesized
cattttccacaagggtgtactc

SEQ ID NO: 733967 - DNA, 22 bp, Artificial Sequence
  chemically synthesized
agtctaagcaagtggagtacac

SEQ ID NO: 733968 - DNA, 22 bp, Artificial Sequence
  chemically synthesized
tccacaagggtgtactccactt

SEQ ID NO: 733969 - DNA, 22 bp, Artificial Sequence
  chemically synthesized
ccacaagggtgtactccacttg

SEQ ID NO: 733970 - DNA, 22 bp, Artificial Sequence
  chemically synthesized
cctaagtctaagcaagtggagt

SEQ ID NO: 733971 - DNA, 22 bp, Artificial Sequence
  chemically synthesized
cacaagggtgtactccacttgc

SEQ ID NO: 733972 - DNA, 22 bp, Artificial Sequence
  chemically synthesized
aattgcctaagtctaagcaagt

SEQ ID NO: 733973 - DNA, 22 bp, Artificial Sequence
  chemically synthesized
aaattgcctaagtctaagcaag

SEQ ID NO: 733974 - DNA, 22 bp, Artificial Sequence
  chemically synthesized
taaattgcctaagtctaagcaa

SEQ ID NO: 733975 - DNA, 22 bp, Artificial Sequence
  chemically synthesized
ttaaattgcctaagtctaagca

SEQ ID NO: 733976 - DNA, 22 bp, Artificial Sequence
  chemically synthesized
cacttgcttagacttaggcaat

SEQ ID NO: 733977 - DNA, 22 bp, Artificial Sequence
  chemically synthesized
gcttagacttaggcaatttaaa

SEQ ID NO: 733978 - DNA, 22 bp, Artificial Sequence
  chemically synthesized
agatcaagaatttttaaattgc

SEQ ID NO: 733979 - DNA, 22 bp, Artificial Sequence
  chemically synthesized
cttagacttaggcaatttaaaa

SEQ ID NO: 733980 - DNA, 22 bp, Artificial Sequence
  chemically synthesized
agacttaggcaatttaaaaatt

SEQ ID NO: 733981 - DNA, 22 bp, Artificial Sequence
  chemically synthesized
gacttaggcaatttaaaaattc

SEQ ID NO: 733982 - DNA, 22 bp, Artificial Sequence
  chemically synthesized
aggcaatttaaaaattcttgat

SEQ ID NO: 733983 - DNA, 22 bp, Artificial Sequence
  chemically synthesized
gaggacattaagatcaagaatt

SEQ ID NO: 733984 - DNA, 22 bp, Artificial Sequence
  chemically synthesized
ggcaatttaaaaattcttgatc

SEQ ID NO: 733985 - DNA, 22 bp, Artificial Sequence
  chemically synthesized
agaggacattaagatcaagaat

SEQ ID NO: 733986 - DNA, 22 bp, Artificial Sequence
  chemically synthesized
tagaggacattaagatcaagaa

SEQ ID NO: 733987 - DNA, 22 bp, Artificial Sequence
  chemically synthesized
aaaaattcttgatcttaatgtc

SEQ ID NO: 733988 - DNA, 22 bp, Artificial Sequence
  chemically synthesized
tacattttagaggacattaaga

SEQ ID NO: 733989 - DNA, 22 bp, Artificial Sequence
  chemically synthesized
aaaattcttgatcttaatgtcc

SEQ ID NO: 733990 - DNA, 22 bp, Artificial Sequence
  chemically synthesized
ttgatcttaatgtcctctaaaa

SEQ ID NO: 733991 - DNA, 22 bp, Artificial Sequence
  chemically synthesized
taaagtctgtacattttagagg

SEQ ID NO: 733992 - DNA, 22 bp, Artificial Sequence
  chemically synthesized
gatcttaatgtcctctaaaatg

SEQ ID NO: 733993 - DNA, 22 bp, Artificial Sequence
  chemically synthesized
atcttaatgtcctctaaaatgt

SEQ ID NO: 733994 - DNA, 22 bp, Artificial Sequence
  chemically synthesized
agctataaagtctgtacatttt

SEQ ID NO: 733995 - DNA, 22 bp, Artificial Sequence
  chemically synthesized
aatgtcctctaaaatgtacaga

SEQ ID NO: 733996 - DNA, 22 bp, Artificial Sequence
  chemically synthesized
atgtcctctaaaatgtacagac

SEQ ID NO: 733997 - DNA, 22 bp, Artificial Sequence
  chemically synthesized
aaatctaagctataaagtctgt

SEQ ID NO: 733998 - DNA, 22 bp, Artificial Sequence
  chemically synthesized
aaaatctaagctataaagtctg

SEQ ID NO: 733999 - DNA, 22 bp, Artificial Sequence
  chemically synthesized
ttaaaatctaagctataaagtc

SEQ ID NO: 734000 - DNA, 22 bp, Artificial Sequence
  chemically synthesized
taaaatgtacagactttatagc

SEQ ID NO: 734001 - DNA, 22 bp, Artificial Sequence
  chemically synthesized
aaatgtacagactttatagctt

SEQ ID NO: 734002 - DNA, 22 bp, Artificial Sequence
  chemically synthesized
tatagcttagattttaagagac

SEQ ID NO: 734003 - DNA, 22 bp, Artificial Sequence
  chemically synthesized
tcaggtaatggtgtctcttaaa

SEQ ID NO: 734004 - DNA, 22 bp, Artificial Sequence
  chemically synthesized
atagcttagattttaagagaca

SEQ ID NO: 734005 - DNA, 22 bp, Artificial Sequence
  chemically synthesized
tagcttagattttaagagacac

SEQ ID NO: 734006 - DNA, 22 bp, Artificial Sequence
  chemically synthesized
ccctgtcaggtaatggtgtctc

SEQ ID NO: 734007 - DNA, 22 bp, Artificial Sequence
  chemically synthesized
agattttaagagacaccattac

SEQ ID NO: 734008 - DNA, 22 bp, Artificial Sequence
  chemically synthesized
gattttaagagacaccattacc

SEQ ID NO: 734009 - DNA, 22 bp, Artificial Sequence
  chemically synthesized
tcattaccctgtcaggtaatgg

SEQ ID NO: 734010 - DNA, 22 bp, Artificial Sequence
  chemically synthesized
taagagacaccattacctgaca

SEQ ID NO: 734011 - DNA, 22 bp, Artificial Sequence
  chemically synthesized
aagagacaccattacctgacag

SEQ ID NO: 734012 - DNA, 22 bp, Artificial Sequence
  chemically synthesized
agagacaccattacctgacagg

SEQ ID NO: 734013 - DNA, 22 bp, Artificial Sequence
  chemically synthesized
cctgacagggtaatgacagttt

SEQ ID NO: 734014 - DNA, 22 bp, Artificial Sequence
  chemically synthesized
acagggtaatgacagttttatt

SEQ ID NO: 734015 - DNA, 22 bp, Artificial Sequence
  chemically synthesized
tatttgcactggtgactggatt

SEQ ID NO: 734016 - DNA, 22 bp, Artificial Sequence
  chemically synthesized
agtatcacagcaaatccagtca

SEQ ID NO: 734017 - DNA, 22 bp, Artificial Sequence
  chemically synthesized
atttgcactggtgactggattt

SEQ ID NO: 734018 - DNA, 22 bp, Artificial Sequence
  chemically synthesized
aagtatcacagcaaatccagtc

SEQ ID NO: 734019 - DNA, 22 bp, Artificial Sequence
  chemically synthesized
tttgcactggtgactggatttg

SEQ ID NO: 734020 - DNA, 22 bp, Artificial Sequence
  chemically synthesized
cttaagtatcacagcaaatcca

SEQ ID NO: 734021 - DNA, 22 bp, Artificial Sequence
  chemically synthesized
gcactggtgactggatttgctg

SEQ ID NO: 734022 - DNA, 22 bp, Artificial Sequence
  chemically synthesized
cactggtgactggatttgctgt

SEQ ID NO: 734023 - DNA, 22 bp, Artificial Sequence
  chemically synthesized
ttgcttaagtatcacagcaaat

SEQ ID NO: 734024 - DNA, 22 bp, Artificial Sequence
  chemically synthesized
gtgactggatttgctgtgatac

SEQ ID NO: 734025 - DNA, 22 bp, Artificial Sequence
  chemically synthesized
tattattgcttaagtatcacag

SEQ ID NO: 734026 - DNA, 22 bp, Artificial Sequence
  chemically synthesized
gtattattgcttaagtatcaca

SEQ ID NO: 734027 - DNA, 22 bp, Artificial Sequence
  chemically synthesized
tttgtattattgcttaagtatc

SEQ ID NO: 734028 - DNA, 22 bp, Artificial Sequence
  chemically synthesized
atttgtattattgcttaagtat

SEQ ID NO: 734029 - DNA, 22 bp, Artificial Sequence
  chemically synthesized
gatttgctgtgatacttaagca

SEQ ID NO: 734030 - DNA, 22 bp, Artificial Sequence
  chemically synthesized
tatttgtattattgcttaagta

SEQ ID NO: 734031 - DNA, 22 bp, Artificial Sequence
  chemically synthesized
gctgtgatacttaagcaataat

SEQ ID NO: 734032 - DNA, 22 bp, Artificial Sequence
  chemically synthesized
ctgtgatacttaagcaataata

SEQ ID NO: 734033 - DNA, 22 bp, Artificial Sequence
  chemically synthesized
tcattttatttgtattattgct

SEQ ID NO: 734034 - DNA, 22 bp, Artificial Sequence
  chemically synthesized
tgatacttaagcaataatacaa

SEQ ID NO: 734035 - DNA, 22 bp, Artificial Sequence
  chemically synthesized
aaaaaaattatcattttatttg

SEQ ID NO: 734036 - DNA, 22 bp, Artificial Sequence
  chemically synthesized
aagcaataatacaaataaaatg

SEQ ID NO: 734037 - DNA, 22 bp, Artificial Sequence
  chemically synthesized
agcaataatacaaataaaatga

SEQ ID NO: 734038 - DNA, 22 bp, Artificial Sequence
  chemically synthesized
tcaaaaaaattatcattttatt

SEQ ID NO: 734039 - DNA, 22 bp, Artificial Sequence
  chemically synthesized
acatcctctcaaaaaaattatc

SEQ ID NO: 734040 - DNA, 22 bp, Artificial Sequence
  chemically synthesized
cctgacatcctctcaaaaaaat

SEQ ID NO: 734041 - DNA, 22 bp, Artificial Sequence
  chemically synthesized
ccctgacatcctctcaaaaaaa

SEQ ID NO: 734042 - DNA, 22 bp, Artificial Sequence
  chemically synthesized
cttccctgacatcctctcaaaa

SEQ ID NO: 734043 - DNA, 22 bp, Artificial Sequence
  chemically synthesized
tccttccctgacatcctctcaa

SEQ ID NO: 734044 - DNA, 22 bp, Artificial Sequence
  chemically synthesized
ctccttccctgacatcctctca

SEQ ID NO: 734045 - DNA, 22 bp, Artificial Sequence
  chemically synthesized
tctccttccctgacatcctctc

SEQ ID NO: 734046 - DNA, 22 bp, Artificial Sequence
  chemically synthesized
tttctccttccctgacatcctc

SEQ ID NO: 734047 - DNA, 22 bp, Artificial Sequence
  chemically synthesized
ctttctccttccctgacatcct

SEQ ID NO: 734048 - DNA, 22 bp, Artificial Sequence
  chemically synthesized
tctttctccttccctgacatcc

SEQ ID NO: 734049 - DNA, 22 bp, Artificial Sequence
  chemically synthesized
ttctttctccttccctgacatc

SEQ ID NO: 734050 - DNA, 22 bp, Artificial Sequence
  chemically synthesized
ttttctttctccttccctgaca

SEQ ID NO: 734051 - DNA, 22 bp, Artificial Sequence
  chemically synthesized
ttttgagaggatgtcagggaag

SEQ ID NO: 734052 - DNA, 22 bp, Artificial Sequence
  chemically synthesized
tttgagaggatgtcagggaagg

SEQ ID NO: 734053 - DNA, 22 bp, Artificial Sequence
  chemically synthesized
ttgagaggatgtcagggaagga

SEQ ID NO: 734054 - DNA, 22 bp, Artificial Sequence
  chemically synthesized
ttcttttctttctccttccctg

SEQ ID NO: 734055 - DNA, 22 bp, Artificial Sequence
  chemically synthesized
tgagaggatgtcagggaaggag

SEQ ID NO: 734056 - DNA, 22 bp, Artificial Sequence
  chemically synthesized
gttcttttctttctccttccct

SEQ ID NO: 734057 - DNA, 22 bp, Artificial Sequence
  chemically synthesized
gagaggatgtcagggaaggaga

SEQ ID NO: 734058 - DNA, 22 bp, Artificial Sequence
  chemically synthesized
tgttcttttctttctccttccc

SEQ ID NO: 734059 - DNA, 22 bp, Artificial Sequence
  chemically synthesized
agaggatgtcagggaaggagaa

SEQ ID NO: 734060 - DNA, 22 bp, Artificial Sequence
  chemically synthesized
aatgcgatgcattttgttcttt

SEQ ID NO: 734061 - DNA, 22 bp, Artificial Sequence
  chemically synthesized
aaccaagttaaatgcgatgcat

SEQ ID NO: 734062 - DNA, 22 bp, Artificial Sequence
  chemically synthesized
aaaccaagttaaatgcgatgca

SEQ ID NO: 734063 - DNA, 22 bp, Artificial Sequence
  chemically synthesized
taaaccaagttaaatgcgatgc

SEQ ID NO: 734064 - DNA, 22 bp, Artificial Sequence
  chemically synthesized
ttaaaccaagttaaatgcgatg

SEQ ID NO: 734065 - DNA, 22 bp, Artificial Sequence
  chemically synthesized
tgtttttaaaccaagttaaatg

SEQ ID NO: 734066 - DNA, 22 bp, Artificial Sequence
  chemically synthesized
cagtgtgttgtgtttttaaacc

SEQ ID NO: 734067 - DNA, 22 bp, Artificial Sequence
  chemically synthesized
aacttggtttaaaaacacaaca

SEQ ID NO: 734068 - DNA, 22 bp, Artificial Sequence
  chemically synthesized
acttggtttaaaaacacaacac

SEQ ID NO: 734069 - DNA, 22 bp, Artificial Sequence
  chemically synthesized
ggaagctgcagtgtgttgtgtt

SEQ ID NO: 734070 - DNA, 22 bp, Artificial Sequence
  chemically synthesized
gggaagctgcagtgtgttgtgt

SEQ ID NO: 734071 - DNA, 22 bp, Artificial Sequence
  chemically synthesized
tgggaagctgcagtgtgttgtg

SEQ ID NO: 734072 - DNA, 22 bp, Artificial Sequence
  chemically synthesized
ggtttaaaaacacaacacactg

SEQ ID NO: 734073 - DNA, 22 bp, Artificial Sequence
  chemically synthesized
gtttaaaaacacaacacactgc

SEQ ID NO: 734074 - DNA, 22 bp, Artificial Sequence
  chemically synthesized
aaaaacacaacacactgcagct

SEQ ID NO: 734075 - DNA, 22 bp, Artificial Sequence
  chemically synthesized
aaaacacaacacactgcagctt

SEQ ID NO: 734076 - DNA, 22 bp, Artificial Sequence
  chemically synthesized
cagtaaaataagaagctttggg

SEQ ID NO: 734077 - DNA, 22 bp, Artificial Sequence
  chemically synthesized
ccagtaaaataagaagctttgg

SEQ ID NO: 734078 - DNA, 22 bp, Artificial Sequence
  chemically synthesized
tccagtaaaataagaagctttg

SEQ ID NO: 734079 - DNA, 22 bp, Artificial Sequence
  chemically synthesized
ttccagtaaaataagaagcttt

SEQ ID NO: 734080 - DNA, 22 bp, Artificial Sequence
  chemically synthesized
tttccagtaaaataagaagctt

SEQ ID NO: 734081 - DNA, 22 bp, Artificial Sequence
  chemically synthesized
ttttccagtaaaataagaagct

SEQ ID NO: 734082 - DNA, 22 bp, Artificial Sequence
  chemically synthesized
cagcttcccaaagcttcttatt

SEQ ID NO: 734083 - DNA, 22 bp, Artificial Sequence
  chemically synthesized
tttttccagtaaaataagaagc

SEQ ID NO: 734084 - DNA, 22 bp, Artificial Sequence
  chemically synthesized
ttttttccagtaaaataagaag

SEQ ID NO: 734085 - DNA, 22 bp, Artificial Sequence
  chemically synthesized
cccaaagcttcttattttactg

SEQ ID NO: 734086 - DNA, 22 bp, Artificial Sequence
  chemically synthesized
ccaaagcttcttattttactgg

SEQ ID NO: 734087 - DNA, 22 bp, Artificial Sequence
  chemically synthesized
agggatttttttttccagtaaa

SEQ ID NO: 734088 - DNA, 22 bp, Artificial Sequence
  chemically synthesized
ctaagggatttttttttccagt

SEQ ID NO: 734089 - DNA, 22 bp, Artificial Sequence
  chemically synthesized
cttattttactggaaaaaaaaa

SEQ ID NO: 734090 - DNA, 22 bp, Artificial Sequence
  chemically synthesized
ttattttactggaaaaaaaaat

SEQ ID NO: 734091 - DNA, 22 bp, Artificial Sequence
  chemically synthesized
attttactggaaaaaaaaatcc

SEQ ID NO: 734092 - DNA, 22 bp, Artificial Sequence
  chemically synthesized
ttttactggaaaaaaaaatccc

SEQ ID NO: 734093 - DNA, 22 bp, Artificial Sequence
  chemically synthesized
tactggaaaaaaaaatccctta

SEQ ID NO: 734094 - DNA, 22 bp, Artificial Sequence
  chemically synthesized
actggaaaaaaaaatcccttag

SEQ ID NO: 734095 - DNA, 22 bp, Artificial Sequence
  chemically synthesized
ctggaaaaaaaaatcccttagc

SEQ ID NO: 734096 - DNA, 22 bp, Artificial Sequence
  chemically synthesized
gaaaaaaaaatcccttagcaat

SEQ ID NO: 734097 - DNA, 22 bp, Artificial Sequence
  chemically synthesized
atgcgcccaaaggaagatgaat

SEQ ID NO: 734098 - DNA, 22 bp, Artificial Sequence
  chemically synthesized
agcaattcatcttcctttgggc

SEQ ID NO: 734099 - DNA, 22 bp, Artificial Sequence
  chemically synthesized
gcaattcatcttcctttgggcg

SEQ ID NO: 734100 - DNA, 22 bp, Artificial Sequence
  chemically synthesized
atcttcctttgggcgcatgaat

SEQ ID NO: 734101 - DNA, 22 bp, Artificial Sequence
  chemically synthesized
cctttgggcgcatgaatgacat

SEQ ID NO: 734102 - DNA, 22 bp, Artificial Sequence
  chemically synthesized
ctttgggcgcatgaatgacatt

SEQ ID NO: 734103 - DNA, 22 bp, Artificial Sequence
  chemically synthesized
tgggcgcatgaatgacatttta

SEQ ID NO: 734104 - DNA, 22 bp, Artificial Sequence
  chemically synthesized
gggcgcatgaatgacattttac

SEQ ID NO: 734105 - DNA, 22 bp, Artificial Sequence
  chemically synthesized
ggcgcatgaatgacattttact

SEQ ID NO: 734106 - DNA, 22 bp, Artificial Sequence
  chemically synthesized
taatcacatcacagtaaaatgt

SEQ ID NO: 734107 - DNA, 22 bp, Artificial Sequence
  chemically synthesized
ataatcacatcacagtaaaatg

SEQ ID NO: 734108 - DNA, 22 bp, Artificial Sequence
  chemically synthesized
ttataatcacatcacagtaaaa

SEQ ID NO: 734109 - DNA, 22 bp, Artificial Sequence
  chemically synthesized
cttataatcacatcacagtaaa

SEQ ID NO: 734110 - DNA, 22 bp, Artificial Sequence
  chemically synthesized
tttcttataatcacatcacagt

SEQ ID NO: 734111 - DNA, 22 bp, Artificial Sequence
  chemically synthesized
gtttcttataatcacatcacag

SEQ ID NO: 734112 - DNA, 22 bp, Artificial Sequence
  chemically synthesized
tgtttcttataatcacatcaca

SEQ ID NO: 734113 - DNA, 22 bp, Artificial Sequence
  chemically synthesized
tactgtgatgtgattataagaa

SEQ ID NO: 734114 - DNA, 22 bp, Artificial Sequence
  chemically synthesized
actgtgatgtgattataagaaa

SEQ ID NO: 734115 - DNA, 22 bp, Artificial Sequence
  chemically synthesized
cgagggattttgtttcttataa

SEQ ID NO: 734116 - DNA, 22 bp, Artificial Sequence
  chemically synthesized
ctgtgatgtgattataagaaac

SEQ ID NO: 734117 - DNA, 22 bp, Artificial Sequence
  chemically synthesized
tgatgtgattataagaaacaaa

SEQ ID NO: 734118 - DNA, 22 bp, Artificial Sequence
  chemically synthesized
aggcagcatctccgagggattt

SEQ ID NO: 734119 - DNA, 22 bp, Artificial Sequence
  chemically synthesized
aaggcagcatctccgagggatt

SEQ ID NO: 734120 - DNA, 22 bp, Artificial Sequence
  chemically synthesized
taaggcagcatctccgagggat

SEQ ID NO: 734121 - DNA, 22 bp, Artificial Sequence
  chemically synthesized
taagaaacaaaatccctcggag

SEQ ID NO: 734122 - DNA, 22 bp, Artificial Sequence
  chemically synthesized
taaagaaaaatattttaaggca

SEQ ID NO: 734123 - DNA, 22 bp, Artificial Sequence
  chemically synthesized
ggagatgctgccttaaaatatt

SEQ ID NO: 734124 - DNA, 22 bp, Artificial Sequence
  chemically synthesized
agaacattataaagaaaaatat

SEQ ID NO: 734125 - DNA, 22 bp, Artificial Sequence
  chemically synthesized
ccttaaaatatttttctttata

SEQ ID NO: 734126 - DNA, 22 bp, Artificial Sequence
  chemically synthesized
tcgagctcagaacattataaag

SEQ ID NO: 734127 - DNA, 22 bp, Artificial Sequence
  chemically synthesized
aaaatatttttctttataatgt

SEQ ID NO: 734128 - DNA, 22 bp, Artificial Sequence
  chemically synthesized
gtcgagctcagaacattataaa

SEQ ID NO: 734129 - DNA, 22 bp, Artificial Sequence
  chemically synthesized
aaatatttttctttataatgtt

SEQ ID NO: 734130 - DNA, 22 bp, Artificial Sequence
  chemically synthesized
ttctttataatgttctgagctc

SEQ ID NO: 734131 - DNA, 22 bp, Artificial Sequence
  chemically synthesized
ccaaggtttgtcgagctcagaa

SEQ ID NO: 734132 - DNA, 22 bp, Artificial Sequence
  chemically synthesized
tctttataatgttctgagctcg

SEQ ID NO: 734133 - DNA, 22 bp, Artificial Sequence
  chemically synthesized
ctttataatgttctgagctcga

SEQ ID NO: 734134 - DNA, 22 bp, Artificial Sequence
  chemically synthesized
taccaaggtttgtcgagctcag

SEQ ID NO: 734135 - DNA, 22 bp, Artificial Sequence
  chemically synthesized
tttataatgttctgagctcgac

SEQ ID NO: 734136 - DNA, 22 bp, Artificial Sequence
  chemically synthesized
ctaccaaggtttgtcgagctca

SEQ ID NO: 734137 - DNA, 22 bp, Artificial Sequence
  chemically synthesized
tctaccaaggtttgtcgagctc

SEQ ID NO: 734138 - DNA, 22 bp, Artificial Sequence
  chemically synthesized
tataatgttctgagctcgacaa

SEQ ID NO: 734139 - DNA, 22 bp, Artificial Sequence
  chemically synthesized
ataatgttctgagctcgacaaa

SEQ ID NO: 734140 - DNA, 22 bp, Artificial Sequence
  chemically synthesized
taatgttctgagctcgacaaac

SEQ ID NO: 734141 - DNA, 22 bp, Artificial Sequence
  chemically synthesized
ttttctaccaaggtttgtcgag

SEQ ID NO: 734142 - DNA, 22 bp, Artificial Sequence
  chemically synthesized
tgttttctaccaaggtttgtcg

SEQ ID NO: 734143 - DNA, 22 bp, Artificial Sequence
  chemically synthesized
tgagctcgacaaaccttggtag

SEQ ID NO: 734144 - DNA, 22 bp, Artificial Sequence
  chemically synthesized
agctcgacaaaccttggtagaa

SEQ ID NO: 734145 - DNA, 22 bp, Artificial Sequence
  chemically synthesized
agagtattctgttttctaccaa

SEQ ID NO: 734146 - DNA, 22 bp, Artificial Sequence
  chemically synthesized
gacaaaccttggtagaaaacag

SEQ ID NO: 734147 - DNA, 22 bp, Artificial Sequence
  chemically synthesized
ataattaagagtattctgtttt

SEQ ID NO: 734148 - DNA, 22 bp, Artificial Sequence
  chemically synthesized
ttcataattaagagtattctgt

SEQ ID NO: 734149 - DNA, 22 bp, Artificial Sequence
  chemically synthesized
attcataattaagagtattctg

SEQ ID NO: 734150 - DNA, 22 bp, Artificial Sequence
  chemically synthesized
ggtagaaaacagaatactctta

SEQ ID NO: 734151 - DNA, 22 bp, Artificial Sequence
  chemically synthesized
gtagaaaacagaatactcttaa

SEQ ID NO: 734152 - DNA, 22 bp, Artificial Sequence
  chemically synthesized
atttattcataattaagagtat

SEQ ID NO: 734153 - DNA, 22 bp, Artificial Sequence
  chemically synthesized
gttaatttattcataattaaga

SEQ ID NO: 734154 - DNA, 22 bp, Artificial Sequence
  chemically synthesized
agttaatttattcataattaag

SEQ ID NO: 734155 - DNA, 22 bp, Artificial Sequence
  chemically synthesized
atttagttaatttattcataat

SEQ ID NO: 734156 - DNA, 22 bp, Artificial Sequence
  chemically synthesized
ctaatttagttaatttattcat

SEQ ID NO: 734157 - DNA, 22 bp, Artificial Sequence
  chemically synthesized
ttaattatgaataaattaacta

SEQ ID NO: 734158 - DNA, 22 bp, Artificial Sequence
  chemically synthesized
atgttactaatttagttaattt

SEQ ID NO: 734159 - DNA, 22 bp, Artificial Sequence
  chemically synthesized
aattatgaataaattaactaaa

SEQ ID NO: 734160 - DNA, 22 bp, Artificial Sequence
  chemically synthesized
attatgaataaattaactaaat

SEQ ID NO: 734161 - DNA, 22 bp, Artificial Sequence
  chemically synthesized
tgaataaattaactaaattagt

SEQ ID NO: 734162 - DNA, 22 bp, Artificial Sequence
  chemically synthesized
catatccatctcatgttactaa

SEQ ID NO: 734163 - DNA, 22 bp, Artificial Sequence
  chemically synthesized
attgcatatccatctcatgtta

SEQ ID NO: 734164 - DNA, 22 bp, Artificial Sequence
  chemically synthesized
aattgcatatccatctcatgtt

SEQ ID NO: 734165 - DNA, 22 bp, Artificial Sequence
  chemically synthesized
actaaattagtaacatgagatg

SEQ ID NO: 734166 - DNA, 22 bp, Artificial Sequence
  chemically synthesized
aattagtaacatgagatggata

SEQ ID NO: 734167 - DNA, 22 bp, Artificial Sequence
  chemically synthesized
gtaacatgagatggatatgcaa

SEQ ID NO: 734168 - DNA, 22 bp, Artificial Sequence
  chemically synthesized
acaatcccttaattgcatatcc

SEQ ID NO: 734169 - DNA, 22 bp, Artificial Sequence
  chemically synthesized
aattaacaatcccttaattgca

SEQ ID NO: 734170 - DNA, 22 bp, Artificial Sequence
  chemically synthesized
caattaacaatcccttaattgc

SEQ ID NO: 734171 - DNA, 22 bp, Artificial Sequence
  chemically synthesized
cagtttcaattaacaatccctt

SEQ ID NO: 734172 - DNA, 22 bp, Artificial Sequence
  chemically synthesized
ccagtttcaattaacaatccct

SEQ ID NO: 734173 - DNA, 22 bp, Artificial Sequence
  chemically synthesized
tgtttccagtttcaattaacaa

SEQ ID NO: 734174 - DNA, 22 bp, Artificial Sequence
  chemically synthesized
agggattgttaattgaaactgg

SEQ ID NO: 734175 - DNA, 22 bp, Artificial Sequence
  chemically synthesized
tatacagctgtgtttccagttt

SEQ ID NO: 734176 - DNA, 22 bp, Artificial Sequence
  chemically synthesized
ttaattgaaactggaaacacag

SEQ ID NO: 734177 - DNA, 22 bp, Artificial Sequence
  chemically synthesized
agctgtatacagctgtgtttcc

SEQ ID NO: 734178 - DNA, 22 bp, Artificial Sequence
  chemically synthesized
taagctgtatacagctgtgttt

SEQ ID NO: 734179 - DNA, 22 bp, Artificial Sequence
  chemically synthesized
attgaaactggaaacacagctg

SEQ ID NO: 734180 - DNA, 22 bp, Artificial Sequence
  chemically synthesized
aaactggaaacacagctgtata

SEQ ID NO: 734181 - DNA, 22 bp, Artificial Sequence
  chemically synthesized
atctctaagctgtatacagctg

SEQ ID NO: 734182 - DNA, 22 bp, Artificial Sequence
  chemically synthesized
gaaacacagctgtatacagctt

SEQ ID NO: 734183 - DNA, 22 bp, Artificial Sequence
  chemically synthesized
gtatgattcatctctaagctgt

SEQ ID NO: 734184 - DNA, 22 bp, Artificial Sequence
  chemically synthesized
ctggtatgattcatctctaagc

SEQ ID NO: 734185 - DNA, 22 bp, Artificial Sequence
  chemically synthesized
tatacagcttagagatgaatca

SEQ ID NO: 734186 - DNA, 22 bp, Artificial Sequence
  chemically synthesized
cgtcattactggtatgattcat

SEQ ID NO: 734187 - DNA, 22 bp, Artificial Sequence
  chemically synthesized
agagatgaatcataccagtaat

SEQ ID NO: 734188 - DNA, 22 bp, Artificial Sequence
  chemically synthesized
gagatgaatcataccagtaatg

SEQ ID NO: 734189 - DNA, 22 bp, Artificial Sequence
  chemically synthesized
taaacatctgcgtcattactgg

SEQ ID NO: 734190 - DNA, 22 bp, Artificial Sequence
  chemically synthesized
ataaacatctgcgtcattactg

SEQ ID NO: 734191 - DNA, 22 bp, Artificial Sequence
  chemically synthesized
tataaacatctgcgtcattact

SEQ ID NO: 734192 - DNA, 22 bp, Artificial Sequence
  chemically synthesized
aagataatcacattttataaac

SEQ ID NO: 734193 - DNA, 22 bp, Artificial Sequence
  chemically synthesized
cactaaagataatcacatttta

SEQ ID NO: 734194 - DNA, 22 bp, Artificial Sequence
  chemically synthesized
tctccactaaagataatcacat

SEQ ID NO: 734195 - DNA, 22 bp, Artificial Sequence
  chemically synthesized
ataaaatgtgattatctttagt

SEQ ID NO: 734196 - DNA, 22 bp, Artificial Sequence
  chemically synthesized
taaaatgtgattatctttagtg

SEQ ID NO: 734197 - DNA, 22 bp, Artificial Sequence
  chemically synthesized
ggagatgcagcgctgtctccac

SEQ ID NO: 734198 - DNA, 22 bp, Artificial Sequence
  chemically synthesized
gggagatgcagcgctgtctcca

SEQ ID NO: 734199 - DNA, 22 bp, Artificial Sequence
  chemically synthesized
tctttagtggagacagcgctgc

SEQ ID NO: 734200 - DNA, 22 bp, Artificial Sequence
  chemically synthesized
tagtggagacagcgctgcatct

SEQ ID NO: 734201 - DNA, 22 bp, Artificial Sequence
  chemically synthesized
agtggagacagcgctgcatctc

SEQ ID NO: 734202 - DNA, 22 bp, Artificial Sequence
  chemically synthesized
gtggagacagcgctgcatctcc

SEQ ID NO: 734203 - DNA, 22 bp, Artificial Sequence
  chemically synthesized
agtgacacaatataagaatggg

SEQ ID NO: 734204 - DNA, 22 bp, Artificial Sequence
  chemically synthesized
catctcccaagcccattcttat

SEQ ID NO: 734205 - DNA, 22 bp, Artificial Sequence
  chemically synthesized
cagtgacacaatataagaatgg

SEQ ID NO: 734206 - DNA, 22 bp, Artificial Sequence
  chemically synthesized
ccaagcccattcttatattgtg

SEQ ID NO: 734207 - DNA, 22 bp, Artificial Sequence
  chemically synthesized
aaaaccatttcagtgacacaat

SEQ ID NO: 734208 - DNA, 22 bp, Artificial Sequence
  chemically synthesized
aaaaaccatttcagtgacacaa

SEQ ID NO: 734209 - DNA, 22 bp, Artificial Sequence
  chemically synthesized
ttatattgtgtcactgaaatgg

SEQ ID NO: 734210 - DNA, 22 bp, Artificial Sequence
  chemically synthesized
acgggtttaaaaaccatttcag

SEQ ID NO: 734211 - DNA, 22 bp, Artificial Sequence
  chemically synthesized
atattgtgtcactgaaatggtt

SEQ ID NO: 734212 - DNA, 22 bp, Artificial Sequence
  chemically synthesized
tattgtgtcactgaaatggttt

SEQ ID NO: 734213 - DNA, 22 bp, Artificial Sequence
  chemically synthesized
gtgttcacgggtttaaaaacca

SEQ ID NO: 734214 - DNA, 22 bp, Artificial Sequence
  chemically synthesized
tgtcactgaaatggtttttaaa

SEQ ID NO: 734215 - DNA, 22 bp, Artificial Sequence
  chemically synthesized
ctggtgttcacgggtttaaaaa

SEQ ID NO: 734216 - DNA, 22 bp, Artificial Sequence
  chemically synthesized
attcctggtgttcacgggttta

SEQ ID NO: 734217 - DNA, 22 bp, Artificial Sequence
  chemically synthesized
aaatggtttttaaacccgtgaa

SEQ ID NO: 734218 - DNA, 22 bp, Artificial Sequence
  chemically synthesized
agatcctgattcctggtgttca

SEQ ID NO: 734219 - DNA, 22 bp, Artificial Sequence
  chemically synthesized
ttaaacccgtgaacaccaggaa

SEQ ID NO: 734220 - DNA, 22 bp, Artificial Sequence
  chemically synthesized
taaacccgtgaacaccaggaat

SEQ ID NO: 734221 - DNA, 22 bp, Artificial Sequence
  chemically synthesized
aaacccgtgaacaccaggaatc

SEQ ID NO: 734222 - DNA, 22 bp, Artificial Sequence
  chemically synthesized
aacccgtgaacaccaggaatca

SEQ ID NO: 734223 - DNA, 22 bp, Artificial Sequence
  chemically synthesized
ccgtccctgagatcctgattcc

SEQ ID NO: 734224 - DNA, 22 bp, Artificial Sequence
  chemically synthesized
gccgtccctgagatcctgattc

SEQ ID NO: 734225 - DNA, 22 bp, Artificial Sequence
  chemically synthesized
atttgccgtccctgagatcctg

SEQ ID NO: 734226 - DNA, 22 bp, Artificial Sequence
  chemically synthesized
ccatatccagggagcctaattt

SEQ ID NO: 734227 - DNA, 22 bp, Artificial Sequence
  chemically synthesized
agggacggcaaattaggctccc

SEQ ID NO: 734228 - DNA, 22 bp, Artificial Sequence
  chemically synthesized
attcccatatccagggagccta

SEQ ID NO: 734229 - DNA, 22 bp, Artificial Sequence
  chemically synthesized
agacaacactaattcccatatc

SEQ ID NO: 734230 - DNA, 22 bp, Artificial Sequence
  chemically synthesized
ggctccctggatatgggaatta

SEQ ID NO: 734231 - DNA, 22 bp, Artificial Sequence
  chemically synthesized
acattcagacaacactaattcc

SEQ ID NO: 734232 - DNA, 22 bp, Artificial Sequence
  chemically synthesized
cctggatatgggaattagtgtt

SEQ ID NO: 734233 - DNA, 22 bp, Artificial Sequence
  chemically synthesized
ctgacattcagacaacactaat

SEQ ID NO: 734234 - DNA, 22 bp, Artificial Sequence
  chemically synthesized
gatatgggaattagtgttgtct

SEQ ID NO: 734235 - DNA, 22 bp, Artificial Sequence
  chemically synthesized
gagaatcaaattgctgacattc

SEQ ID NO: 734236 - DNA, 22 bp, Artificial Sequence
  chemically synthesized
gtgttgtctgaatgtcagcaat

SEQ ID NO: 734237 - DNA, 22 bp, Artificial Sequence
  chemically synthesized
aaagctggagaatcaaattgct

SEQ ID NO: 734238 - DNA, 22 bp, Artificial Sequence
  chemically synthesized
gaaagctggagaatcaaattgc

SEQ ID NO: 734239 - DNA, 22 bp, Artificial Sequence
  chemically synthesized
tctgaatgtcagcaatttgatt

SEQ ID NO: 734240 - DNA, 22 bp, Artificial Sequence
  chemically synthesized
tgaaagctggagaatcaaattg

SEQ ID NO: 734241 - DNA, 22 bp, Artificial Sequence
  chemically synthesized
tttgaaagctggagaatcaaat

SEQ ID NO: 734242 - DNA, 22 bp, Artificial Sequence
  chemically synthesized
aatgtcagcaatttgattctcc

SEQ ID NO: 734243 - DNA, 22 bp, Artificial Sequence
  chemically synthesized
cattctttgaaagctggagaat

SEQ ID NO: 734244 - DNA, 22 bp, Artificial Sequence
  chemically synthesized
catatctacattctttgaaagc

SEQ ID NO: 734245 - DNA, 22 bp, Artificial Sequence
  chemically synthesized
gattctccagctttcaaagaat

SEQ ID NO: 734246 - DNA, 22 bp, Artificial Sequence
  chemically synthesized
attctccagctttcaaagaatg

SEQ ID NO: 734247 - DNA, 22 bp, Artificial Sequence
  chemically synthesized
gctccatatctacattctttga

SEQ ID NO: 734248 - DNA, 22 bp, Artificial Sequence
  chemically synthesized
ttggctccatatctacattctt

SEQ ID NO: 734249 - DNA, 22 bp, Artificial Sequence
  chemically synthesized
tccagctttcaaagaatgtaga

SEQ ID NO: 734250 - DNA, 22 bp, Artificial Sequence
  chemically synthesized
cagctttcaaagaatgtagata

SEQ ID NO: 734251 - DNA, 22 bp, Artificial Sequence
  chemically synthesized
ttgttggctccatatctacatt

SEQ ID NO: 734252 - DNA, 22 bp, Artificial Sequence
  chemically synthesized
gttgttggctccatatctacat

SEQ ID NO: 734253 - DNA, 22 bp, Artificial Sequence
  chemically synthesized
tcaaagaatgtagatatggagc

SEQ ID NO: 734254 - DNA, 22 bp, Artificial Sequence
  chemically synthesized
caaagaatgtagatatggagcc

SEQ ID NO: 734255 - DNA, 22 bp, Artificial Sequence
  chemically synthesized
aaagaatgtagatatggagcca

SEQ ID NO: 734256 - DNA, 22 bp, Artificial Sequence
  chemically synthesized
acagatgtttgttgttggctcc

SEQ ID NO: 734257 - DNA, 22 bp, Artificial Sequence
  chemically synthesized
aagaccatgcaactaacagatg

SEQ ID NO: 734258 - DNA, 22 bp, Artificial Sequence
  chemically synthesized
gaagaccatgcaactaacagat

SEQ ID NO: 734259 - DNA, 22 bp, Artificial Sequence
  chemically synthesized
tgaagaccatgcaactaacaga

SEQ ID NO: 734260 - DNA, 22 bp, Artificial Sequence
  chemically synthesized
ttgaagaccatgcaactaacag

SEQ ID NO: 734261 - DNA, 22 bp, Artificial Sequence
  chemically synthesized
tttgaagaccatgcaactaaca

SEQ ID NO: 734262 - DNA, 22 bp, Artificial Sequence
  chemically synthesized
ttttgaagaccatgcaactaac

SEQ ID NO: 734263 - DNA, 22 bp, Artificial Sequence
  chemically synthesized
tttttttgaagaccatgcaact

SEQ ID NO: 734264 - DNA, 22 bp, Artificial Sequence
  chemically synthesized
gtttttttgaagaccatgcaac

SEQ ID NO: 734265 - DNA, 22 bp, Artificial Sequence
  chemically synthesized
tgtttttttgaagaccatgcaa

SEQ ID NO: 734266 - DNA, 22 bp, Artificial Sequence
  chemically synthesized
ttgtttttttgaagaccatgca

SEQ ID NO: 734267 - DNA, 22 bp, Artificial Sequence
  chemically synthesized
tttttgtttttttgaagaccat

SEQ ID NO: 734268 - DNA, 22 bp, Artificial Sequence
  chemically synthesized
ttagttgcatggtcttcaaaaa

SEQ ID NO: 734269 - DNA, 22 bp, Artificial Sequence
  chemically synthesized
gttgtttttgtttttttgaaga

SEQ ID NO: 734270 - DNA, 22 bp, Artificial Sequence
  chemically synthesized
ggttgtttttgtttttttgaag

SEQ ID NO: 734271 - DNA, 22 bp, Artificial Sequence
  chemically synthesized
tggttgtttttgtttttttgaa

SEQ ID NO: 734272 - DNA, 22 bp, Artificial Sequence
  chemically synthesized
gttgcatggtcttcaaaaaaac

SEQ ID NO: 734273 - DNA, 22 bp, Artificial Sequence
  chemically synthesized
ttggttgtttttgtttttttga

SEQ ID NO: 734274 - DNA, 22 bp, Artificial Sequence
  chemically synthesized
catggtcttcaaaaaaacaaaa

SEQ ID NO: 734275 - DNA, 22 bp, Artificial Sequence
  chemically synthesized
ccagcaacttttggttgttttt

SEQ ID NO: 734276 - DNA, 22 bp, Artificial Sequence
  chemically synthesized
gccagcaacttttggttgtttt

SEQ ID NO: 734277 - DNA, 22 bp, Artificial Sequence
  chemically synthesized
caaaaaaacaaaaacaaccaaa

SEQ ID NO: 734278 - DNA, 22 bp, Artificial Sequence
  chemically synthesized
aaaaaaacaaaaacaaccaaaa

SEQ ID NO: 734279 - DNA, 22 bp, Artificial Sequence
  chemically synthesized
gtttgccagcaacttttggttg

SEQ ID NO: 734280 - DNA, 22 bp, Artificial Sequence
  chemically synthesized
aagcagggactggtttgccagc

SEQ ID NO: 734281 - DNA, 22 bp, Artificial Sequence
  chemically synthesized
attgaagcagggactggtttgc

SEQ ID NO: 734282 - DNA, 22 bp, Artificial Sequence
  chemically synthesized
tgattgaagcagggactggttt

SEQ ID NO: 734283 - DNA, 22 bp, Artificial Sequence
  chemically synthesized
tctgattgaagcagggactggt

SEQ ID NO: 734284 - DNA, 22 bp, Artificial Sequence
  chemically synthesized
ctctgattgaagcagggactgg

SEQ ID NO: 734285 - DNA, 22 bp, Artificial Sequence
  chemically synthesized
ctggcaaaccagtccctgcttc

SEQ ID NO: 734286 - DNA, 22 bp, Artificial Sequence
  chemically synthesized
gcaaaccagtccctgcttcaat

SEQ ID NO: 734287 - DNA, 22 bp, Artificial Sequence
  chemically synthesized
ccgtcttctctgattgaagcag

SEQ ID NO: 734288 - DNA, 22 bp, Artificial Sequence
  chemically synthesized
accgtcttctctgattgaagca

SEQ ID NO: 734289 - DNA, 22 bp, Artificial Sequence
  chemically synthesized
taccgtcttctctgattgaagc

SEQ ID NO: 734290 - DNA, 22 bp, Artificial Sequence
  chemically synthesized
cagatactttaccgtcttctct

SEQ ID NO: 734291 - DNA, 22 bp, Artificial Sequence
  chemically synthesized
acagatactttaccgtcttctc

SEQ ID NO: 734292 - DNA, 22 bp, Artificial Sequence
  chemically synthesized
cttcaatcagagaagacggtaa

SEQ ID NO: 734293 - DNA, 22 bp, Artificial Sequence
  chemically synthesized
tttacagatactttaccgtctt

SEQ ID NO: 734294 - DNA, 22 bp, Artificial Sequence
  chemically synthesized
caatcagagaagacggtaaagt

SEQ ID NO: 734295 - DNA, 22 bp, Artificial Sequence
  chemically synthesized
aatcagagaagacggtaaagta

SEQ ID NO: 734296 - DNA, 22 bp, Artificial Sequence
  chemically synthesized
acagtcacacacagcagtgtga

SEQ ID NO: 734297 - DNA, 22 bp, Artificial Sequence
  chemically synthesized
taacagtcacacacagcagtgt

SEQ ID NO: 734298 - DNA, 22 bp, Artificial Sequence
  chemically synthesized
ctaacagtcacacacagcagtg

SEQ ID NO: 734299 - DNA, 22 bp, Artificial Sequence
  chemically synthesized
taaacagtcacactgctgtgtg

SEQ ID NO: 734300 - DNA, 22 bp, Artificial Sequence
  chemically synthesized
tatgtttctaacagtcacacac

SEQ ID NO: 734301 - DNA, 22 bp, Artificial Sequence
  chemically synthesized
tatatgtttctaacagtcacac

SEQ ID NO: 734302 - DNA, 22 bp, Artificial Sequence
  chemically synthesized
ctatatgtttctaacagtcaca

SEQ ID NO: 734303 - DNA, 22 bp, Artificial Sequence
  chemically synthesized
tctatatgtttctaacagtcac

SEQ ID NO: 734304 - DNA, 22 bp, Artificial Sequence
  chemically synthesized
ttctatatgtttctaacagtca

SEQ ID NO: 734305 - DNA, 22 bp, Artificial Sequence
  chemically synthesized
ttttctatatgtttctaacagt

SEQ ID NO: 734306 - DNA, 22 bp, Artificial Sequence
  chemically synthesized
tcttttctatatgtttctaaca

SEQ ID NO: 734307 - DNA, 22 bp, Artificial Sequence
  chemically synthesized
ctgtgtgtgactgttagaaaca

SEQ ID NO: 734308 - DNA, 22 bp, Artificial Sequence
  chemically synthesized
tgtgtgactgttagaaacatat

SEQ ID NO: 734309 - DNA, 22 bp, Artificial Sequence
  chemically synthesized
gggttctcttttctatatgttt

SEQ ID NO: 734310 - DNA, 22 bp, Artificial Sequence
  chemically synthesized
tgccctggggttctcttttcta

SEQ ID NO: 734311 - DNA, 22 bp, Artificial Sequence
  chemically synthesized
ttagaaacatatagaaaagaga

SEQ ID NO: 734312 - DNA, 22 bp, Artificial Sequence
  chemically synthesized
gaaacatatagaaaagagaacc

SEQ ID NO: 734313 - DNA, 22 bp, Artificial Sequence
  chemically synthesized
gcactgtgccctggggttctct

SEQ ID NO: 734314 - DNA, 22 bp, Artificial Sequence
  chemically synthesized
tggcactgtgccctggggttct

SEQ ID NO: 734315 - DNA, 22 bp, Artificial Sequence
  chemically synthesized
tgcataaggtctctggcactgt

SEQ ID NO: 734316 - DNA, 22 bp, Artificial Sequence
  chemically synthesized
gtgcataaggtctctggcactg

SEQ ID NO: 734317 - DNA, 22 bp, Artificial Sequence
  chemically synthesized
ccatttgtgcataaggtctctg

SEQ ID NO: 734318 - DNA, 22 bp, Artificial Sequence
  chemically synthesized
accatttgtgcataaggtctct

SEQ ID NO: 734319 - DNA, 22 bp, Artificial Sequence
  chemically synthesized
ccagcagagggggcatttacca

SEQ ID NO: 734320 - DNA, 22 bp, Artificial Sequence
  chemically synthesized
tgccagcagagggggcatttac

SEQ ID NO: 734321 - DNA, 22 bp, Artificial Sequence
  chemically synthesized
atgcacaaatggtaaatgcccc

SEQ ID NO: 734322 - DNA, 22 bp, Artificial Sequence
  chemically synthesized
tgcacaaatggtaaatgccccc

SEQ ID NO: 734323 - DNA, 22 bp, Artificial Sequence
  chemically synthesized
gagcctctgccagcagaggggg

SEQ ID NO: 734324 - DNA, 22 bp, Artificial Sequence
  chemically synthesized
agagcctctgccagcagagggg

SEQ ID NO: 734325 - DNA, 22 bp, Artificial Sequence
  chemically synthesized
tagagcctctgccagcagaggg

SEQ ID NO: 734326 - DNA, 22 bp, Artificial Sequence
  chemically synthesized
tgctggcagaggctctaaaaca

SEQ ID NO: 734327 - DNA, 22 bp, Artificial Sequence
  chemically synthesized
ctggcagaggctctaaaacatt

SEQ ID NO: 734328 - DNA, 22 bp, Artificial Sequence
  chemically synthesized
gcagaggctctaaaacattttc

SEQ ID NO: 734329 - DNA, 22 bp, Artificial Sequence
  chemically synthesized
ccgggaaaagagcagaaaatgt

SEQ ID NO: 734330 - DNA, 22 bp, Artificial Sequence
  chemically synthesized
actgccgggaaaagagcagaaa

SEQ ID NO: 734331 - DNA, 22 bp, Artificial Sequence
  chemically synthesized
taaaacattttctgctcttttc

SEQ ID NO: 734332 - DNA, 22 bp, Artificial Sequence
  chemically synthesized
ggttcactgccgggaaaagagc

SEQ ID NO: 734333 - DNA, 22 bp, Artificial Sequence
  chemically synthesized
aaacattttctgctcttttccc

SEQ ID NO: 734334 - DNA, 22 bp, Artificial Sequence
  chemically synthesized
tgggttcactgccgggaaaaga

SEQ ID NO: 734335 - DNA, 22 bp, Artificial Sequence
  chemically synthesized
ctgggttcactgccgggaaaag

SEQ ID NO: 734336 - DNA, 22 bp, Artificial Sequence
  chemically synthesized
ttctgggttcactgccgggaaa

SEQ ID NO: 734337 - DNA, 22 bp, Artificial Sequence
  chemically synthesized
cttctgggttcactgccgggaa

SEQ ID NO: 734338 - DNA, 22 bp, Artificial Sequence
  chemically synthesized
tcttctgggttcactgccggga

SEQ ID NO: 734339 - DNA, 22 bp, Artificial Sequence
  chemically synthesized
ttcttctgggttcactgccggg

SEQ ID NO: 734340 - DNA, 22 bp, Artificial Sequence
  chemically synthesized
tctgctcttttcccggcagtga

SEQ ID NO: 734341 - DNA, 22 bp, Artificial Sequence
  chemically synthesized
tttcttctgggttcactgccgg

SEQ ID NO: 734342 - DNA, 22 bp, Artificial Sequence
  chemically synthesized
ctgctcttttcccggcagtgaa

SEQ ID NO: 734343 - DNA, 22 bp, Artificial Sequence
  chemically synthesized
tgctcttttcccggcagtgaac

SEQ ID NO: 734344 - DNA, 22 bp, Artificial Sequence
  chemically synthesized
ttttttcttctgggttcactgc

SEQ ID NO: 734345 - DNA, 22 bp, Artificial Sequence
  chemically synthesized
ctcttttcccggcagtgaaccc

SEQ ID NO: 734346 - DNA, 22 bp, Artificial Sequence
  chemically synthesized
gttttttcttctgggttcactg

SEQ ID NO: 734347 - DNA, 22 bp, Artificial Sequence
  chemically synthesized
tgttttttcttctgggttcact

SEQ ID NO: 734348 - DNA, 22 bp, Artificial Sequence
  chemically synthesized
ttttcccggcagtgaacccaga

SEQ ID NO: 734349 - DNA, 22 bp, Artificial Sequence
  chemically synthesized
ttcccggcagtgaacccagaag

SEQ ID NO: 734350 - DNA, 22 bp, Artificial Sequence
  chemically synthesized
tcccggcagtgaacccagaaga

SEQ ID NO: 734351 - DNA, 22 bp, Artificial Sequence
  chemically synthesized
cccggcagtgaacccagaagaa

SEQ ID NO: 734352 - DNA, 22 bp, Artificial Sequence
  chemically synthesized
ccggcagtgaacccagaagaaa

SEQ ID NO: 734353 - DNA, 22 bp, Artificial Sequence
  chemically synthesized
tgaagattttgttttttcttct

SEQ ID NO: 734354 - DNA, 22 bp, Artificial Sequence
  chemically synthesized
gttgtgaagattttgttttttc

SEQ ID NO: 734355 - DNA, 22 bp, Artificial Sequence
  chemically synthesized
agttgtgaagattttgtttttt

SEQ ID NO: 734356 - DNA, 22 bp, Artificial Sequence
  chemically synthesized
cttagttgtgaagattttgttt

SEQ ID NO: 734357 - DNA, 22 bp, Artificial Sequence
  chemically synthesized
ccttagttgtgaagattttgtt

SEQ ID NO: 734358 - DNA, 22 bp, Artificial Sequence
  chemically synthesized
cttccttagttgtgaagatttt

SEQ ID NO: 734359 - DNA, 22 bp, Artificial Sequence
  chemically synthesized
ctgcttccttagttgtgaagat

SEQ ID NO: 734360 - DNA, 22 bp, Artificial Sequence
  chemically synthesized
ctactgcttccttagttgtgaa

SEQ ID NO: 734361 - DNA, 22 bp, Artificial Sequence
  chemically synthesized
cctactgcttccttagttgtga

SEQ ID NO: 734362 - DNA, 22 bp, Artificial Sequence
  chemically synthesized
tcctactgcttccttagttgtg

SEQ ID NO: 734363 - DNA, 22 bp, Artificial Sequence
  chemically synthesized
cacaactaaggaagcagtagga

SEQ ID NO: 734364 - DNA, 22 bp, Artificial Sequence
  chemically synthesized
acaactaaggaagcagtaggaa

SEQ ID NO: 734365 - DNA, 22 bp, Artificial Sequence
  chemically synthesized
aggaagcagtaggaaaatgccg

SEQ ID NO: 734366 - DNA, 22 bp, Artificial Sequence
  chemically synthesized
aacatacagtgagtgtaatgac

SEQ ID NO: 734367 - DNA, 22 bp, Artificial Sequence
  chemically synthesized
caacatacagtgagtgtaatga

SEQ ID NO: 734368 - DNA, 22 bp, Artificial Sequence
  chemically synthesized
gtacatttcaacatacagtgag

SEQ ID NO: 734369 - DNA, 22 bp, Artificial Sequence
  chemically synthesized
agtacatttcaacatacagtga

SEQ ID NO: 734370 - DNA, 22 bp, Artificial Sequence
  chemically synthesized
tagtacatttcaacatacagtg

SEQ ID NO: 734371 - DNA, 22 bp, Artificial Sequence
  chemically synthesized
ataattttagtacatttcaaca

SEQ ID NO: 734372 - DNA, 22 bp, Artificial Sequence
  chemically synthesized
cactcactgtatgttgaaatgt

SEQ ID NO: 734373 - DNA, 22 bp, Artificial Sequence
  chemically synthesized
actgtatgttgaaatgtactaa

SEQ ID NO: 734374 - DNA, 22 bp, Artificial Sequence
  chemically synthesized
tatgttgaaatgtactaaaatt

SEQ ID NO: 734375 - DNA, 22 bp, Artificial Sequence
  chemically synthesized
aaatgtactaaaattatcaata

SEQ ID NO: 734376 - DNA, 22 bp, Artificial Sequence
  chemically synthesized
caaagtgcaacagaatattgat

SEQ ID NO: 734377 - DNA, 22 bp, Artificial Sequence
  chemically synthesized
ccaaagtgcaacagaatattga

SEQ ID NO: 734378 - DNA, 22 bp, Artificial Sequence
  chemically synthesized
aaattatcaatattctgttgca

SEQ ID NO: 734379 - DNA, 22 bp, Artificial Sequence
  chemically synthesized
tcaatattctgttgcactttgg

SEQ ID NO: 734380 - DNA, 22 bp, Artificial Sequence
  chemically synthesized
tgttgcactttggaaacttccg

SEQ ID NO: 734381 - DNA, 22 bp, Artificial Sequence
  chemically synthesized
ttgcactttggaaacttccgtt

SEQ ID NO: 734382 - DNA, 22 bp, Artificial Sequence
  chemically synthesized
cactttggaaacttccgttttt

SEQ ID NO: 734383 - DNA, 22 bp, Artificial Sequence
  chemically synthesized
tggaaacttccgttttttgctt

SEQ ID NO: 734384 - DNA, 22 bp, Artificial Sequence
  chemically synthesized
ggaaacttccgttttttgctta

SEQ ID NO: 734385 - DNA, 22 bp, Artificial Sequence
  chemically synthesized
gaaacttccgttttttgcttat

SEQ ID NO: 734386 - DNA, 22 bp, Artificial Sequence
  chemically synthesized
ccgttttttgcttatccacacc

SEQ ID NO: 734387 - DNA, 22 bp, Artificial Sequence
  chemically synthesized
cgttttttgcttatccacacca

SEQ ID NO: 734388 - DNA, 22 bp, Artificial Sequence
  chemically synthesized
cacatgggggaaaatggtgtgg

SEQ ID NO: 734389 - DNA, 22 bp, Artificial Sequence
  chemically synthesized
tttgcttatccacaccattttc

SEQ ID NO: 734390 - DNA, 22 bp, Artificial Sequence
  chemically synthesized
ttgcttatccacaccattttcc

SEQ ID NO: 734391 - DNA, 22 bp, Artificial Sequence
  chemically synthesized
tgcttatccacaccattttccc

SEQ ID NO: 734392 - DNA, 22 bp, Artificial Sequence
  chemically synthesized
gcttatccacaccattttcccc

SEQ ID NO: 734393 - DNA, 22 bp, Artificial Sequence
  chemically synthesized
cttatccacaccattttccccc

SEQ ID NO: 734394 - DNA, 22 bp, Artificial Sequence
  chemically synthesized
atccacaccattttcccccatg

SEQ ID NO: 734395 - DNA, 22 bp, Artificial Sequence
  chemically synthesized
tccacaccattttcccccatgt

SEQ ID NO: 734396 - DNA, 22 bp, Artificial Sequence
  chemically synthesized
gggcaaatgggaattgcacatg

SEQ ID NO: 734397 - DNA, 22 bp, Artificial Sequence
  chemically synthesized
cctggggcaaatgggaattgca

SEQ ID NO: 734398 - DNA, 22 bp, Artificial Sequence
  chemically synthesized
ccctggggcaaatgggaattgc

SEQ ID NO: 734399 - DNA, 22 bp, Artificial Sequence
  chemically synthesized
tcccccatgtgcaattcccatt

SEQ ID NO: 734400 - DNA, 22 bp, Artificial Sequence
  chemically synthesized
cccccatgtgcaattcccattt

SEQ ID NO: 734401 - DNA, 22 bp, Artificial Sequence
  chemically synthesized
ccccatgtgcaattcccatttg

SEQ ID NO: 734402 - DNA, 22 bp, Artificial Sequence
  chemically synthesized
ccttccctggggcaaatgggaa

SEQ ID NO: 734403 - DNA, 22 bp, Artificial Sequence
  chemically synthesized
cccttccctggggcaaatggga

SEQ ID NO: 734404 - DNA, 22 bp, Artificial Sequence
  chemically synthesized
ccatttgccccagggaagggaa

SEQ ID NO: 734405 - DNA, 22 bp, Artificial Sequence
  chemically synthesized
gaaccatagagacatttccctt

SEQ ID NO: 734406 - DNA, 22 bp, Artificial Sequence
  chemically synthesized
gccccagggaagggaaatgtct

SEQ ID NO: 734407 - DNA, 22 bp, Artificial Sequence
  chemically synthesized
ccccagggaagggaaatgtctc

SEQ ID NO: 734408 - DNA, 22 bp, Artificial Sequence
  chemically synthesized
aaatctagaaccatagagacat

SEQ ID NO: 734409 - DNA, 22 bp, Artificial Sequence
  chemically synthesized
gattaaaatctagaaccataga

SEQ ID NO: 734410 - DNA, 22 bp, Artificial Sequence
  chemically synthesized
tatggttctagattttaatcga

SEQ ID NO: 734411 - DNA, 22 bp, Artificial Sequence
  chemically synthesized
tggttctagattttaatcgagt

SEQ ID NO: 734412 - DNA, 22 bp, Artificial Sequence
  chemically synthesized
tgcagagatcatgtaactcgat

SEQ ID NO: 734413 - DNA, 22 bp, Artificial Sequence
  chemically synthesized
tagattttaatcgagttacatg

SEQ ID NO: 734414 - DNA, 22 bp, Artificial Sequence
  chemically synthesized
gattttaatcgagttacatgat

SEQ ID NO: 734415 - DNA, 22 bp, Artificial Sequence
  chemically synthesized
taatcgagttacatgatctctg

SEQ ID NO: 734416 - DNA, 22 bp, Artificial Sequence
  chemically synthesized
aatcgagttacatgatctctgc

SEQ ID NO: 734417 - DNA, 22 bp, Artificial Sequence
  chemically synthesized
atcgagttacatgatctctgca

SEQ ID NO: 734418 - DNA, 22 bp, Artificial Sequence
  chemically synthesized
tccaatcacagtctatgcagag

SEQ ID NO: 734419 - DNA, 22 bp, Artificial Sequence
  chemically synthesized
gtccaatcacagtctatgcaga

SEQ ID NO: 734420 - DNA, 22 bp, Artificial Sequence
  chemically synthesized
catgatctctgcatagactgtg

SEQ ID NO: 734421 - DNA, 22 bp, Artificial Sequence
  chemically synthesized
aaccttgtccaatcacagtcta

SEQ ID NO: 734422 - DNA, 22 bp, Artificial Sequence
  chemically synthesized
ccctcaaccttgtccaatcaca

SEQ ID NO: 734423 - DNA, 22 bp, Artificial Sequence
  chemically synthesized
tgcatagactgtgattggacaa

SEQ ID NO: 734424 - DNA, 22 bp, Artificial Sequence
  chemically synthesized
catagactgtgattggacaagg

SEQ ID NO: 734425 - DNA, 22 bp, Artificial Sequence
  chemically synthesized
tgattggacaaggttgagggga

SEQ ID NO: 734426 - DNA, 22 bp, Artificial Sequence
  chemically synthesized
ggacacagtatccagtctcccc

SEQ ID NO: 734427 - DNA, 22 bp, Artificial Sequence
  chemically synthesized
gacaaggttgaggggagactgg

SEQ ID NO: 734428 - DNA, 22 bp, Artificial Sequence
  chemically synthesized
tggttaggacacagtatccagt

SEQ ID NO: 734429 - DNA, 22 bp, Artificial Sequence
  chemically synthesized
aggggagactggatactgtgtc

SEQ ID NO: 734430 - DNA, 22 bp, Artificial Sequence
  chemically synthesized
aactatggttaggacacagtat

SEQ ID NO: 734431 - DNA, 22 bp, Artificial Sequence
  chemically synthesized
gatactgtgtcctaaccatagt

SEQ ID NO: 734432 - DNA, 22 bp, Artificial Sequence
  chemically synthesized
cataatcattaaactatggtta

SEQ ID NO: 734433 - DNA, 22 bp, Artificial Sequence
  chemically synthesized
attccataatcattaaactatg

SEQ ID NO: 734434 - DNA, 22 bp, Artificial Sequence
  chemically synthesized
cattccataatcattaaactat

SEQ ID NO: 734435 - DNA, 22 bp, Artificial Sequence
  chemically synthesized
tgtcctaaccatagtttaatga

SEQ ID NO: 734436 - DNA, 22 bp, Artificial Sequence
  chemically synthesized
agcccttcattccataatcatt

SEQ ID NO: 734437 - DNA, 22 bp, Artificial Sequence
  chemically synthesized
accatagtttaatgattatgga

SEQ ID NO: 734438 - DNA, 22 bp, Artificial Sequence
  chemically synthesized
tgtagctgagcccttcattcca

SEQ ID NO: 734439 - DNA, 22 bp, Artificial Sequence
  chemically synthesized
aatgattatggaatgaagggct

SEQ ID NO: 734440 - DNA, 22 bp, Artificial Sequence
  chemically synthesized
atgattatggaatgaagggctc

SEQ ID NO: 734441 - DNA, 22 bp, Artificial Sequence
  chemically synthesized
gtctatgtagctgagcccttca

SEQ ID NO: 734442 - DNA, 22 bp, Artificial Sequence
  chemically synthesized
tggaatgaagggctcagctaca

SEQ ID NO: 734443 - DNA, 22 bp, Artificial Sequence
  chemically synthesized
caaagactagtctatgtagctg

SEQ ID NO: 734444 - DNA, 22 bp, Artificial Sequence
  chemically synthesized
ccaaagactagtctatgtagct

SEQ ID NO: 734445 - DNA, 22 bp, Artificial Sequence
  chemically synthesized
atttccaaagactagtctatgt

SEQ ID NO: 734446 - DNA, 22 bp, Artificial Sequence
  chemically synthesized
agctacatagactagtctttgg

SEQ ID NO: 734447 - DNA, 22 bp, Artificial Sequence
  chemically synthesized
catagactagtctttggaaatc

SEQ ID NO: 734448 - DNA, 22 bp, Artificial Sequence
  chemically synthesized
tccagaaaccaaaaacctgatt

SEQ ID NO: 734449 - DNA, 22 bp, Artificial Sequence
  chemically synthesized
gtccagaaaccaaaaacctgat

SEQ ID NO: 734450 - DNA, 22 bp, Artificial Sequence
  chemically synthesized
tgtccagaaaccaaaaacctga

SEQ ID NO: 734451 - DNA, 22 bp, Artificial Sequence
  chemically synthesized
gtctttggaaatcaggtttttg

SEQ ID NO: 734452 - DNA, 22 bp, Artificial Sequence
  chemically synthesized
tggaaatcaggtttttggtttc

SEQ ID NO: 734453 - DNA, 22 bp, Artificial Sequence
  chemically synthesized
ggaaatcaggtttttggtttct

SEQ ID NO: 734454 - DNA, 22 bp, Artificial Sequence
  chemically synthesized
gaaatcaggtttttggtttctg

SEQ ID NO: 734455 - DNA, 22 bp, Artificial Sequence
  chemically synthesized
aataatgccacaagctttgtcc

SEQ ID NO: 734456 - DNA, 22 bp, Artificial Sequence
  chemically synthesized
gaataatgccacaagctttgtc

SEQ ID NO: 734457 - DNA, 22 bp, Artificial Sequence
  chemically synthesized
ttggtttctggacaaagcttgt

SEQ ID NO: 734458 - DNA, 22 bp, Artificial Sequence
  chemically synthesized
tggtttctggacaaagcttgtg

SEQ ID NO: 734459 - DNA, 22 bp, Artificial Sequence
  chemically synthesized
ggtttctggacaaagcttgtgg

SEQ ID NO: 734460 - DNA, 22 bp, Artificial Sequence
  chemically synthesized
gtttgaataatgccacaagctt

SEQ ID NO: 734461 - DNA, 22 bp, Artificial Sequence
  chemically synthesized
gtttctggacaaagcttgtggc

SEQ ID NO: 734462 - DNA, 22 bp, Artificial Sequence
  chemically synthesized
ttggtttgaataatgccacaag

SEQ ID NO: 734463 - DNA, 22 bp, Artificial Sequence
  chemically synthesized
ctggacaaagcttgtggcatta

SEQ ID NO: 734464 - DNA, 22 bp, Artificial Sequence
  chemically synthesized
tggacaaagcttgtggcattat

SEQ ID NO: 734465 - DNA, 22 bp, Artificial Sequence
  chemically synthesized
gacaaagcttgtggcattattc

SEQ ID NO: 734466 - DNA, 22 bp, Artificial Sequence
  chemically synthesized
atagttgttggtttgaataatg

SEQ ID NO: 734467 - DNA, 22 bp, Artificial Sequence
  chemically synthesized
gtggcattattcaaaccaacaa

SEQ ID NO: 734468 - DNA, 22 bp, Artificial Sequence
  chemically synthesized
tggcattattcaaaccaacaac

SEQ ID NO: 734469 - DNA, 22 bp, Artificial Sequence
  chemically synthesized
ttcaaaccaacaactattaggc

SEQ ID NO: 734470 - DNA, 22 bp, Artificial Sequence
  chemically synthesized
taagcaccatccagcctaatag

SEQ ID NO: 734471 - DNA, 22 bp, Artificial Sequence
  chemically synthesized
gtaagcaccatccagcctaata

SEQ ID NO: 734472 - DNA, 22 bp, Artificial Sequence
  chemically synthesized
aaaccaacaactattaggctgg

SEQ ID NO: 734473 - DNA, 22 bp, Artificial Sequence
  chemically synthesized
tgtaagcaccatccagcctaat

SEQ ID NO: 734474 - DNA, 22 bp, Artificial Sequence
  chemically synthesized
catctttgtaagcaccatccag

SEQ ID NO: 734475 - DNA, 22 bp, Artificial Sequence
  chemically synthesized
ccatctttgtaagcaccatcca

SEQ ID NO: 734476 - DNA, 22 bp, Artificial Sequence
  chemically synthesized
ttaggctggatggtgcttacaa

SEQ ID NO: 734477 - DNA, 22 bp, Artificial Sequence
  chemically synthesized
ccatcttccatctttgtaagca

SEQ ID NO: 734478 - DNA, 22 bp, Artificial Sequence
  chemically synthesized
ggctggatggtgcttacaaaga

SEQ ID NO: 734479 - DNA, 22 bp, Artificial Sequence
  chemically synthesized
gatggtgcttacaaagatggaa

SEQ ID NO: 734480 - DNA, 22 bp, Artificial Sequence
  chemically synthesized
atgtctaccatcttccatcttt

SEQ ID NO: 734481 - DNA, 22 bp, Artificial Sequence
  chemically synthesized
acaaagatggaagatggtagac

SEQ ID NO: 734482 - DNA, 22 bp, Artificial Sequence
  chemically synthesized
caaagatggaagatggtagaca

SEQ ID NO: 734483 - DNA, 22 bp, Artificial Sequence
  chemically synthesized
cgtaaaaaactgatgtctacca

SEQ ID NO: 734484 - DNA, 22 bp, Artificial Sequence
  chemically synthesized
acgtaaaaaactgatgtctacc

SEQ ID NO: 734485 - DNA, 22 bp, Artificial Sequence
  chemically synthesized
tacgtaaaaaactgatgtctac

SEQ ID NO: 734486 - DNA, 22 bp, Artificial Sequence
  chemically synthesized
cactttacgtaaaaaactgatg

SEQ ID NO: 734487 - DNA, 22 bp, Artificial Sequence
  chemically synthesized
gcactttacgtaaaaaactgat

SEQ ID NO: 734488 - DNA, 22 bp, Artificial Sequence
  chemically synthesized
gtttgcactttacgtaaaaaac

SEQ ID NO: 734489 - DNA, 22 bp, Artificial Sequence
  chemically synthesized
cagtggttagtttgcactttac

SEQ ID NO: 734490 - DNA, 22 bp, Artificial Sequence
  chemically synthesized
acagtggttagtttgcacttta

SEQ ID NO: 734491 - DNA, 22 bp, Artificial Sequence
  chemically synthesized
tttacgtaaagtgcaaactaac

SEQ ID NO: 734492 - DNA, 22 bp, Artificial Sequence
  chemically synthesized
caccttacagtggttagtttgc

SEQ ID NO: 734493 - DNA, 22 bp, Artificial Sequence
  chemically synthesized
ttacgtaaagtgcaaactaacc

SEQ ID NO: 734494 - DNA, 22 bp, Artificial Sequence
  chemically synthesized
tacgtaaagtgcaaactaacca

SEQ ID NO: 734495 - DNA, 22 bp, Artificial Sequence
  chemically synthesized
acgtaaagtgcaaactaaccac

SEQ ID NO: 734496 - DNA, 22 bp, Artificial Sequence
  chemically synthesized
cgtaaagtgcaaactaaccact

SEQ ID NO: 734497 - DNA, 22 bp, Artificial Sequence
  chemically synthesized
actacaccttacagtggttagt

SEQ ID NO: 734498 - DNA, 22 bp, Artificial Sequence
  chemically synthesized
gactacaccttacagtggttag

SEQ ID NO: 734499 - DNA, 22 bp, Artificial Sequence
  chemically synthesized
tgactacaccttacagtggtta

SEQ ID NO: 734500 - DNA, 22 bp, Artificial Sequence
  chemically synthesized
ttgactacaccttacagtggtt

SEQ ID NO: 734501 - DNA, 22 bp, Artificial Sequence
  chemically synthesized
tttgactacaccttacagtggt

SEQ ID NO: 734502 - DNA, 22 bp, Artificial Sequence
  chemically synthesized
ttttgactacaccttacagtgg

SEQ ID NO: 734503 - DNA, 22 bp, Artificial Sequence
  chemically synthesized
ttttttgactacaccttacagt

SEQ ID NO: 734504 - DNA, 22 bp, Artificial Sequence
  chemically synthesized
cttttttgactacaccttacag

SEQ ID NO: 734505 - DNA, 22 bp, Artificial Sequence
  chemically synthesized
tttcttttttgactacacctta

SEQ ID NO: 734506 - DNA, 22 bp, Artificial Sequence
  chemically synthesized
accactgtaaggtgtagtcaaa

SEQ ID NO: 734507 - DNA, 22 bp, Artificial Sequence
  chemically synthesized
tgtattatttcttttttgacta

SEQ ID NO: 734508 - DNA, 22 bp, Artificial Sequence
  chemically synthesized
taaggtgtagtcaaaaaagaaa

SEQ ID NO: 734509 - DNA, 22 bp, Artificial Sequence
  chemically synthesized
aaattatgtattatttcttttt

SEQ ID NO: 734510 - DNA, 22 bp, Artificial Sequence
  chemically synthesized
gtcaatatctaaaattatgtat

SEQ ID NO: 734511 - DNA, 22 bp, Artificial Sequence
  chemically synthesized
ttggtcaatatctaaaattatg

SEQ ID NO: 734512 - DNA, 22 bp, Artificial Sequence
  chemically synthesized
tgttggtcaatatctaaaatta

SEQ ID NO: 734513 - DNA, 22 bp, Artificial Sequence
  chemically synthesized
ctgttggtcaatatctaaaatt

SEQ ID NO: 734514 - DNA, 22 bp, Artificial Sequence
  chemically synthesized
tagatattgaccaacagaagat

SEQ ID NO: 734515 - DNA, 22 bp, Artificial Sequence
  chemically synthesized
agatattgaccaacagaagata

SEQ ID NO: 734516 - DNA, 22 bp, Artificial Sequence
  chemically synthesized
aggtgacaaatatatcttctgt

SEQ ID NO: 734517 - DNA, 22 bp, Artificial Sequence
  chemically synthesized
gatattgaccaacagaagatat

SEQ ID NO: 734518 - DNA, 22 bp, Artificial Sequence
  chemically synthesized
agctaaggtgacaaatatatct

SEQ ID NO: 734519 - DNA, 22 bp, Artificial Sequence
  chemically synthesized
accaacagaagatatatttgtc

SEQ ID NO: 734520 - DNA, 22 bp, Artificial Sequence
  chemically synthesized
aaagagaagctaagctaaggtg

SEQ ID NO: 734521 - DNA, 22 bp, Artificial Sequence
  chemically synthesized
gaaagagaagctaagctaaggt

SEQ ID NO: 734522 - DNA, 22 bp, Artificial Sequence
  chemically synthesized
tgaaagagaagctaagctaagg

SEQ ID NO: 734523 - DNA, 22 bp, Artificial Sequence
  chemically synthesized
ataattttgaaagagaagctaa

SEQ ID NO: 734524 - DNA, 22 bp, Artificial Sequence
  chemically synthesized
gtcaccttagcttagcttctct

SEQ ID NO: 734525 - DNA, 22 bp, Artificial Sequence
  chemically synthesized
tcaccttagcttagcttctctt

SEQ ID NO: 734526 - DNA, 22 bp, Artificial Sequence
  chemically synthesized
agcttagcttctctttcaaaat

SEQ ID NO: 734527 - DNA, 22 bp, Artificial Sequence
  chemically synthesized
aggacattgataattttgaaag

SEQ ID NO: 734528 - DNA, 22 bp, Artificial Sequence
  chemically synthesized
gcttagcttctctttcaaaatt

SEQ ID NO: 734529 - DNA, 22 bp, Artificial Sequence
  chemically synthesized
ttaaggacattgataattttga

SEQ ID NO: 734530 - DNA, 22 bp, Artificial Sequence
  chemically synthesized
gttaaggacattgataattttg

SEQ ID NO: 734531 - DNA, 22 bp, Artificial Sequence
  chemically synthesized
agcttctctttcaaaattatca

SEQ ID NO: 734532 - DNA, 22 bp, Artificial Sequence
  chemically synthesized
tgttaaggacattgataatttt

SEQ ID NO: 734533 - DNA, 22 bp, Artificial Sequence
  chemically synthesized
gcttctctttcaaaattatcaa

SEQ ID NO: 734534 - DNA, 22 bp, Artificial Sequence
  chemically synthesized
ctctttcaaaattatcaatgtc

SEQ ID NO: 734535 - DNA, 22 bp, Artificial Sequence
  chemically synthesized
gattttgttaaggacattgata

SEQ ID NO: 734536 - DNA, 22 bp, Artificial Sequence
  chemically synthesized
tctttcaaaattatcaatgtcc

SEQ ID NO: 734537 - DNA, 22 bp, Artificial Sequence
  chemically synthesized
tttcaaaattatcaatgtcctt

SEQ ID NO: 734538 - DNA, 22 bp, Artificial Sequence
  chemically synthesized
tcaaaattatcaatgtccttaa

SEQ ID NO: 734539 - DNA, 22 bp, Artificial Sequence
  chemically synthesized
caaaattatcaatgtccttaac

SEQ ID NO: 734540 - DNA, 22 bp, Artificial Sequence
  chemically synthesized
aaaattatcaatgtccttaaca

SEQ ID NO: 734541 - DNA, 22 bp, Artificial Sequence
  chemically synthesized
cagcactagattttgttaagga

SEQ ID NO: 734542 - DNA, 22 bp, Artificial Sequence
  chemically synthesized
acagcactagattttgttaagg

SEQ ID NO: 734543 - DNA, 22 bp, Artificial Sequence
  chemically synthesized
tacagcactagattttgttaag

SEQ ID NO: 734544 - DNA, 22 bp, Artificial Sequence
  chemically synthesized
ctttacagcactagattttgtt

SEQ ID NO: 734545 - DNA, 22 bp, Artificial Sequence
  chemically synthesized
tcaatgtccttaacaaaatcta

SEQ ID NO: 734546 - DNA, 22 bp, Artificial Sequence
  chemically synthesized
cctttacagcactagattttgt

SEQ ID NO: 734547 - DNA, 22 bp, Artificial Sequence
  chemically synthesized
tcctttacagcactagattttg

SEQ ID NO: 734548 - DNA, 22 bp, Artificial Sequence
  chemically synthesized
ttttcctttacagcactagatt

SEQ ID NO: 734549 - DNA, 22 bp, Artificial Sequence
  chemically synthesized
attttcctttacagcactagat

SEQ ID NO: 734550 - DNA, 22 bp, Artificial Sequence
  chemically synthesized
tattttcctttacagcactaga

SEQ ID NO: 734551 - DNA, 22 bp, Artificial Sequence
  chemically synthesized
ttttattttcctttacagcact

SEQ ID NO: 734552 - DNA, 22 bp, Artificial Sequence
  chemically synthesized
aacaaaatctagtgctgtaaag

SEQ ID NO: 734553 - DNA, 22 bp, Artificial Sequence
  chemically synthesized
acaaaatctagtgctgtaaagg

SEQ ID NO: 734554 - DNA, 22 bp, Artificial Sequence
  chemically synthesized
ttgttttattttcctttacagc

SEQ ID NO: 734555 - DNA, 22 bp, Artificial Sequence
  chemically synthesized
tctgttgttttattttccttta

SEQ ID NO: 734556 - DNA, 22 bp, Artificial Sequence
  chemically synthesized
gtgctgtaaaggaaaataaaac

SEQ ID NO: 734557 - DNA, 22 bp, Artificial Sequence
  chemically synthesized
atgtcagactatctgttgtttt

SEQ ID NO: 734558 - DNA, 22 bp, Artificial Sequence
  chemically synthesized
taaaggaaaataaaacaacaga

SEQ ID NO: 734559 - DNA, 22 bp, Artificial Sequence
  chemically synthesized
actaatgtcagactatctgttg

SEQ ID NO: 734560 - DNA, 22 bp, Artificial Sequence
  chemically synthesized
atagaggaaagtattaactaat

SEQ ID NO: 734561 - DNA, 22 bp, Artificial Sequence
  chemically synthesized
gatagaggaaagtattaactaa

SEQ ID NO: 734562 - DNA, 22 bp, Artificial Sequence
  chemically synthesized
tgatagaggaaagtattaacta

SEQ ID NO: 734563 - DNA, 22 bp, Artificial Sequence
  chemically synthesized
ttgatagaggaaagtattaact

SEQ ID NO: 734564 - DNA, 22 bp, Artificial Sequence
  chemically synthesized
acattagttaatactttcctct

SEQ ID NO: 734565 - DNA, 22 bp, Artificial Sequence
  chemically synthesized
catccttttgatagaggaaagt

SEQ ID NO: 734566 - DNA, 22 bp, Artificial Sequence
  chemically synthesized
tgcatccttttgatagaggaaa

SEQ ID NO: 734567 - DNA, 22 bp, Artificial Sequence
  chemically synthesized
ctgcatccttttgatagaggaa

SEQ ID NO: 734568 - DNA, 22 bp, Artificial Sequence
  chemically synthesized
tctgcatccttttgatagagga

SEQ ID NO: 734569 - DNA, 22 bp, Artificial Sequence
  chemically synthesized
gttaatactttcctctatcaaa

SEQ ID NO: 734570 - DNA, 22 bp, Artificial Sequence
  chemically synthesized
agttttctgcatccttttgata

SEQ ID NO: 734571 - DNA, 22 bp, Artificial Sequence
  chemically synthesized
atactttcctctatcaaaagga

SEQ ID NO: 734572 - DNA, 22 bp, Artificial Sequence
  chemically synthesized
tcctctatcaaaaggatgcaga

SEQ ID NO: 734573 - DNA, 22 bp, Artificial Sequence
  chemically synthesized
cctctatcaaaaggatgcagaa

SEQ ID NO: 734574 - DNA, 22 bp, Artificial Sequence
  chemically synthesized
ctctatcaaaaggatgcagaaa

SEQ ID NO: 734575 - DNA, 22 bp, Artificial Sequence
  chemically synthesized
tatcaaaaggatgcagaaaact

SEQ ID NO: 734576 - DNA, 22 bp, Artificial Sequence
  chemically synthesized
tcaaaaggatgcagaaaactta

SEQ ID NO: 734577 - DNA, 22 bp, Artificial Sequence
  chemically synthesized
aaggaggatgccctaagttttc

SEQ ID NO: 734578 - DNA, 22 bp, Artificial Sequence
  chemically synthesized
aattcaaggaggatgccctaag

SEQ ID NO: 734579 - DNA, 22 bp, Artificial Sequence
  chemically synthesized
ccctgaattcaaggaggatgcc

SEQ ID NO: 734580 - DNA, 22 bp, Artificial Sequence
  chemically synthesized
agggcatcctccttgaattcag

SEQ ID NO: 734581 - DNA, 22 bp, Artificial Sequence
  chemically synthesized
gggcatcctccttgaattcagg

SEQ ID NO: 734582 - DNA, 22 bp, Artificial Sequence
  chemically synthesized
tagtaaaaggtctcccctgaat

SEQ ID NO: 734583 - DNA, 22 bp, Artificial Sequence
  chemically synthesized
cttgaattcaggggagaccttt

SEQ ID NO: 734584 - DNA, 22 bp, Artificial Sequence
  chemically synthesized
aacgttgtagtaaaaggtctcc

SEQ ID NO: 734585 - DNA, 22 bp, Artificial Sequence
  chemically synthesized
gaattcaggggagaccttttac

SEQ ID NO: 734586 - DNA, 22 bp, Artificial Sequence
  chemically synthesized
aattcaggggagaccttttact

SEQ ID NO: 734587 - DNA, 22 bp, Artificial Sequence
  chemically synthesized
gttaaacgttgtagtaaaaggt

SEQ ID NO: 734588 - DNA, 22 bp, Artificial Sequence
  chemically synthesized
cgttaaacgttgtagtaaaagg

SEQ ID NO: 734589 - DNA, 22 bp, Artificial Sequence
  chemically synthesized
aggggagaccttttactacaac

SEQ ID NO: 734590 - DNA, 22 bp, Artificial Sequence
  chemically synthesized
ttactacaacgtttaacgaagt

SEQ ID NO: 734591 - DNA, 22 bp, Artificial Sequence
  chemically synthesized
tactacaacgtttaacgaagta

SEQ ID NO: 734592 - DNA, 22 bp, Artificial Sequence
  chemically synthesized
aagtcatccaaatacttcgtta

SEQ ID NO: 734593 - DNA, 22 bp, Artificial Sequence
  chemically synthesized
actacaacgtttaacgaagtat

SEQ ID NO: 734594 - DNA, 22 bp, Artificial Sequence
  chemically synthesized
ctacaacgtttaacgaagtatt

SEQ ID NO: 734595 - DNA, 22 bp, Artificial Sequence
  chemically synthesized
caacgtttaacgaagtatttgg

SEQ ID NO: 734596 - DNA, 22 bp, Artificial Sequence
  chemically synthesized
agcctcaagtcatccaaatact

SEQ ID NO: 734597 - DNA, 22 bp, Artificial Sequence
  chemically synthesized
gagcctcaagtcatccaaatac

SEQ ID NO: 734598 - DNA, 22 bp, Artificial Sequence
  chemically synthesized
tttgagcctcaagtcatccaaa

SEQ ID NO: 734599 - DNA, 22 bp, Artificial Sequence
  chemically synthesized
atttgagcctcaagtcatccaa

SEQ ID NO: 734600 - DNA, 22 bp, Artificial Sequence
  chemically synthesized
aacgaagtatttggatgacttg

SEQ ID NO: 734601 - DNA, 22 bp, Artificial Sequence
  chemically synthesized
acgaagtatttggatgacttga

SEQ ID NO: 734602 - DNA, 22 bp, Artificial Sequence
  chemically synthesized
tttatttgagcctcaagtcatc

SEQ ID NO: 734603 - DNA, 22 bp, Artificial Sequence
  chemically synthesized
agttgtttatttgagcctcaag

SEQ ID NO: 734604 - DNA, 22 bp, Artificial Sequence
  chemically synthesized
ggatgacttgaggctcaaataa

SEQ ID NO: 734605 - DNA, 22 bp, Artificial Sequence
  chemically synthesized
gatgacttgaggctcaaataaa

SEQ ID NO: 734606 - DNA, 22 bp, Artificial Sequence
  chemically synthesized
gaggctcaaataaacaactcag

SEQ ID NO: 734607 - DNA, 22 bp, Artificial Sequence
  chemically synthesized
aggctcaaataaacaactcagt

SEQ ID NO: 734608 - DNA, 22 bp, Artificial Sequence
  chemically synthesized
aaataaacaactcagttttcca

SEQ ID NO: 734609 - DNA, 22 bp, Artificial Sequence
  chemically synthesized
agttttccactgtgttgactgt

SEQ ID NO: 734610 - DNA, 22 bp, Artificial Sequence
  chemically synthesized
caccccatatgcccacagtcaa

SEQ ID NO: 734611 - DNA, 22 bp, Artificial Sequence
  chemically synthesized
tccactgtgttgactgtgggca

SEQ ID NO: 734612 - DNA, 22 bp, Artificial Sequence
  chemically synthesized
ccactgtgttgactgtgggcat

SEQ ID NO: 734613 - DNA, 22 bp, Artificial Sequence
  chemically synthesized
cactgtgttgactgtgggcata

SEQ ID NO: 734614 - DNA, 22 bp, Artificial Sequence
  chemically synthesized
agctacaccccatatgcccaca

SEQ ID NO: 734615 - DNA, 22 bp, Artificial Sequence
  chemically synthesized
tgttgactgtgggcatatgggg

SEQ ID NO: 734616 - DNA, 22 bp, Artificial Sequence
  chemically synthesized
acaactcagctacaccccatat

SEQ ID NO: 734617 - DNA, 22 bp, Artificial Sequence
  chemically synthesized
actgtgggcatatggggtgtag

SEQ ID NO: 734618 - DNA, 22 bp, Artificial Sequence
  chemically synthesized
tgggcatatggggtgtagctga

SEQ ID NO: 734619 - DNA, 22 bp, Artificial Sequence
  chemically synthesized
acagactcacaactcagctaca

SEQ ID NO: 734620 - DNA, 22 bp, Artificial Sequence
  chemically synthesized
aacagactcacaactcagctac

SEQ ID NO: 734621 - DNA, 22 bp, Artificial Sequence
  chemically synthesized
taacagactcacaactcagcta

SEQ ID NO: 734622 - DNA, 22 bp, Artificial Sequence
  chemically synthesized
ttaacagactcacaactcagct

SEQ ID NO: 734623 - DNA, 22 bp, Artificial Sequence
  chemically synthesized
ttttaacagactcacaactcag

SEQ ID NO: 734624 - DNA, 22 bp, Artificial Sequence
  chemically synthesized
cttttaacagactcacaactca

SEQ ID NO: 734625 - DNA, 22 bp, Artificial Sequence
  chemically synthesized
tcttttaacagactcacaactc

SEQ ID NO: 734626 - DNA, 22 bp, Artificial Sequence
  chemically synthesized
aaagtgtattttcttttaacag

SEQ ID NO: 734627 - DNA, 22 bp, Artificial Sequence
  chemically synthesized
agttgtgagtctgttaaaagaa

SEQ ID NO: 734628 - DNA, 22 bp, Artificial Sequence
  chemically synthesized
ctgaaagtgtattttcttttaa

SEQ ID NO: 734629 - DNA, 22 bp, Artificial Sequence
  chemically synthesized
tgagtctgttaaaagaaaatac

SEQ ID NO: 734630 - DNA, 22 bp, Artificial Sequence
  chemically synthesized
attcctgaaagtgtattttctt

SEQ ID NO: 734631 - DNA, 22 bp, Artificial Sequence
  chemically synthesized
ttcattcctgaaagtgtatttt

SEQ ID NO: 734632 - DNA, 22 bp, Artificial Sequence
  chemically synthesized
attcattcctgaaagtgtattt

SEQ ID NO: 734633 - DNA, 22 bp, Artificial Sequence
  chemically synthesized
cttattcattcctgaaagtgta

SEQ ID NO: 734634 - DNA, 22 bp, Artificial Sequence
  chemically synthesized
ttaaaagaaaatacactttcag

SEQ ID NO: 734635 - DNA, 22 bp, Artificial Sequence
  chemically synthesized
tccttattcattcctgaaagtg

SEQ ID NO: 734636 - DNA, 22 bp, Artificial Sequence
  chemically synthesized
ctccttattcattcctgaaagt

SEQ ID NO: 734637 - DNA, 22 bp, Artificial Sequence
  chemically synthesized
aaagaaaatacactttcaggaa

SEQ ID NO: 734638 - DNA, 22 bp, Artificial Sequence
  chemically synthesized
tctccttattcattcctgaaag

SEQ ID NO: 734639 - DNA, 22 bp, Artificial Sequence
  chemically synthesized
ttctccttattcattcctgaaa

SEQ ID NO: 734640 - DNA, 22 bp, Artificial Sequence
  chemically synthesized
cgtttttctccttattcattcc

SEQ ID NO: 734641 - DNA, 22 bp, Artificial Sequence
  chemically synthesized
gcgtttttctccttattcattc

SEQ ID NO: 734642 - DNA, 22 bp, Artificial Sequence
  chemically synthesized
tgtgtttgcgtttttctcctta

SEQ ID NO: 734643 - DNA, 22 bp, Artificial Sequence
  chemically synthesized
tcaggaatgaataaggagaaaa

SEQ ID NO: 734644 - DNA, 22 bp, Artificial Sequence
  chemically synthesized
atgtgtttgcgtttttctcctt

SEQ ID NO: 734645 - DNA, 22 bp, Artificial Sequence
  chemically synthesized
caggaatgaataaggagaaaaa

SEQ ID NO: 734646 - DNA, 22 bp, Artificial Sequence
  chemically synthesized
tatgtgtttgcgtttttctcct

SEQ ID NO: 734647 - DNA, 22 bp, Artificial Sequence
  chemically synthesized
aggaatgaataaggagaaaaac

SEQ ID NO: 734648 - DNA, 22 bp, Artificial Sequence
  chemically synthesized
ttatgtgtttgcgtttttctcc

SEQ ID NO: 734649 - DNA, 22 bp, Artificial Sequence
  chemically synthesized
tttatgtgtttgcgtttttctc

SEQ ID NO: 734650 - DNA, 22 bp, Artificial Sequence
  chemically synthesized
tatatagtggtgtgtcttttta

SEQ ID NO: 734651 - DNA, 22 bp, Artificial Sequence
  chemically synthesized
taggtatccaacatagagagaa

SEQ ID NO: 734652 - DNA, 22 bp, Artificial Sequence
  chemically synthesized
ataggtatccaacatagagaga

SEQ ID NO: 734653 - DNA, 22 bp, Artificial Sequence
  chemically synthesized
tatatagttttctctctatgtt

SEQ ID NO: 734654 - DNA, 22 bp, Artificial Sequence
  chemically synthesized
tctctctatgttggatacctat

SEQ ID NO: 734655 - DNA, 22 bp, Artificial Sequence
  chemically synthesized
ctctctatgttggatacctata

SEQ ID NO: 734656 - DNA, 22 bp, Artificial Sequence
  chemically synthesized
tctctatgttggatacctataa

SEQ ID NO: 734657 - DNA, 22 bp, Artificial Sequence
  chemically synthesized
tctatgttggatacctataaat

SEQ ID NO: 734658 - DNA, 22 bp, Artificial Sequence
  chemically synthesized
aacaaatcccacatttataggt

SEQ ID NO: 734659 - DNA, 22 bp, Artificial Sequence
  chemically synthesized
tatgttggatacctataaatgt

SEQ ID NO: 734660 - DNA, 22 bp, Artificial Sequence
  chemically synthesized
tgttggatacctataaatgtgg

SEQ ID NO: 734661 - DNA, 22 bp, Artificial Sequence
  chemically synthesized
gatacctataaatgtgggattt

SEQ ID NO: 734662 - DNA, 22 bp, Artificial Sequence
  chemically synthesized
tgatcaaaattcaacaaatccc

SEQ ID NO: 734663 - DNA, 22 bp, Artificial Sequence
  chemically synthesized
gtgatcaaaattcaacaaatcc

SEQ ID NO: 734664 - DNA, 22 bp, Artificial Sequence
  chemically synthesized
tgtgatcaaaattcaacaaatc

SEQ ID NO: 734665 - DNA, 22 bp, Artificial Sequence
  chemically synthesized
taaatgtgggatttgttgaatt

SEQ ID NO: 734666 - DNA, 22 bp, Artificial Sequence
  chemically synthesized
gttgaattttgatcacaaagtc

SEQ ID NO: 734667 - DNA, 22 bp, Artificial Sequence
  chemically synthesized
ttgaattttgatcacaaagtct

SEQ ID NO: 734668 - DNA, 22 bp, Artificial Sequence
  chemically synthesized
aattttgatcacaaagtctttc

SEQ ID NO: 734669 - DNA, 22 bp, Artificial Sequence
  chemically synthesized
acacataggatagaaagacttt

SEQ ID NO: 734670 - DNA, 22 bp, Artificial Sequence
  chemically synthesized
tgatcacaaagtctttctatcc

SEQ ID NO: 734671 - DNA, 22 bp, Artificial Sequence
  chemically synthesized
gatcacaaagtctttctatcct

SEQ ID NO: 734672 - DNA, 22 bp, Artificial Sequence
  chemically synthesized
atcacaaagtctttctatccta

SEQ ID NO: 734673 - DNA, 22 bp, Artificial Sequence
  chemically synthesized
tgcagactaacacataggatag

SEQ ID NO: 734674 - DNA, 22 bp, Artificial Sequence
  chemically synthesized
gtgcagactaacacataggata

SEQ ID NO: 734675 - DNA, 22 bp, Artificial Sequence
  chemically synthesized
tacttgtgcagactaacacata

SEQ ID NO: 734676 - DNA, 22 bp, Artificial Sequence
  chemically synthesized
tctatcctatgtgttagtctgc

SEQ ID NO: 734677 - DNA, 22 bp, Artificial Sequence
  chemically synthesized
ctatcctatgtgttagtctgca

SEQ ID NO: 734678 - DNA, 22 bp, Artificial Sequence
  chemically synthesized
tatcctatgtgttagtctgcac

SEQ ID NO: 734679 - DNA, 22 bp, Artificial Sequence
  chemically synthesized
tcctatgtgttagtctgcacaa

SEQ ID NO: 734680 - DNA, 22 bp, Artificial Sequence
  chemically synthesized
taggcaaagcctgtacttgtgc

SEQ ID NO: 734681 - DNA, 22 bp, Artificial Sequence
  chemically synthesized
tgtgttagtctgcacaagtaca

SEQ ID NO: 734682 - DNA, 22 bp, Artificial Sequence
  chemically synthesized
aaattataggcaaagcctgtac

SEQ ID NO: 734683 - DNA, 22 bp, Artificial Sequence
  chemically synthesized
gtctgcacaagtacaggctttg

SEQ ID NO: 734684 - DNA, 22 bp, Artificial Sequence
  chemically synthesized
cacaagtacaggctttgcctat

SEQ ID NO: 734685 - DNA, 22 bp, Artificial Sequence
  chemically synthesized
tataacagcaaatcaatactga

SEQ ID NO: 734686 - DNA, 22 bp, Artificial Sequence
  chemically synthesized
tgcctataatttcagtattgat

SEQ ID NO: 734687 - DNA, 22 bp, Artificial Sequence
  chemically synthesized
gcctataatttcagtattgatt

SEQ ID NO: 734688 - DNA, 22 bp, Artificial Sequence
  chemically synthesized
cctataatttcagtattgattt

SEQ ID NO: 734689 - DNA, 22 bp, Artificial Sequence
  chemically synthesized
taatttcagtattgatttgctg

SEQ ID NO: 734690 - DNA, 22 bp, Artificial Sequence
  chemically synthesized
gaacctgtataacagcaaatca

SEQ ID NO: 734691 - DNA, 22 bp, Artificial Sequence
  chemically synthesized
cagtattgatttgctgttatac

SEQ ID NO: 734692 - DNA, 22 bp, Artificial Sequence
  chemically synthesized
agtattgatttgctgttataca

SEQ ID NO: 734693 - DNA, 22 bp, Artificial Sequence
  chemically synthesized
gacaagttggaacctgtataac

SEQ ID NO: 734694 - DNA, 22 bp, Artificial Sequence
  chemically synthesized
agacaagttggaacctgtataa

SEQ ID NO: 734695 - DNA, 22 bp, Artificial Sequence
  chemically synthesized
atttgctgttatacaggttcca

SEQ ID NO: 734696 - DNA, 22 bp, Artificial Sequence
  chemically synthesized
gctgttatacaggttccaactt

SEQ ID NO: 734697 - DNA, 22 bp, Artificial Sequence
  chemically synthesized
ctgttatacaggttccaacttg

SEQ ID NO: 734698 - DNA, 22 bp, Artificial Sequence
  chemically synthesized
ttatacaggttccaacttgtct

SEQ ID NO: 734699 - DNA, 22 bp, Artificial Sequence
  chemically synthesized
aggtaatgaaatttagacaagt

SEQ ID NO: 734700 - DNA, 22 bp, Artificial Sequence
  chemically synthesized
tacaggttccaacttgtctaaa

SEQ ID NO: 734701 - DNA, 22 bp, Artificial Sequence
  chemically synthesized
caggtaatgaaatttagacaag

SEQ ID NO: 734702 - DNA, 22 bp, Artificial Sequence
  chemically synthesized
tcccttcaggtaatgaaattta

SEQ ID NO: 734703 - DNA, 22 bp, Artificial Sequence
  chemically synthesized
caacttgtctaaatttcattac

SEQ ID NO: 734704 - DNA, 22 bp, Artificial Sequence
  chemically synthesized
caagctgtcccttcaggtaatg

SEQ ID NO: 734705 - DNA, 22 bp, Artificial Sequence
  chemically synthesized
gtctaaatttcattacctgaag

SEQ ID NO: 734706 - DNA, 22 bp, Artificial Sequence
  chemically synthesized
tctaaatttcattacctgaagg

SEQ ID NO: 734707 - DNA, 22 bp, Artificial Sequence
  chemically synthesized
aatttcattacctgaagggaca

SEQ ID NO: 734708 - DNA, 22 bp, Artificial Sequence
  chemically synthesized
cattacctgaagggacagcttg

SEQ ID NO: 734709 - DNA, 22 bp, Artificial Sequence
  chemically synthesized
tatatggaattgcaagctgtcc

SEQ ID NO: 734710 - DNA, 22 bp, Artificial Sequence
  chemically synthesized
attacctgaagggacagcttgc

SEQ ID NO: 734711 - DNA, 22 bp, Artificial Sequence
  chemically synthesized
cctgaagggacagcttgcaatt

SEQ ID NO: 734712 - DNA, 22 bp, Artificial Sequence
  chemically synthesized
tacctgtatatggaattgcaag

SEQ ID NO: 734713 - DNA, 22 bp, Artificial Sequence
  chemically synthesized
aagggacagcttgcaattccat

SEQ ID NO: 734714 - DNA, 22 bp, Artificial Sequence
  chemically synthesized
ttatacctgtatatggaattgc

SEQ ID NO: 734715 - DNA, 22 bp, Artificial Sequence
  chemically synthesized
attatacctgtatatggaattg

SEQ ID NO: 734716 - DNA, 22 bp, Artificial Sequence
  chemically synthesized
tattatacctgtatatggaatt

SEQ ID NO: 734717 - DNA, 22 bp, Artificial Sequence
  chemically synthesized
ttattatacctgtatatggaat

SEQ ID NO: 734718 - DNA, 22 bp, Artificial Sequence
  chemically synthesized
cttttattatacctgtatatgg

SEQ ID NO: 734719 - DNA, 22 bp, Artificial Sequence
  chemically synthesized
gcttttattatacctgtatatg

SEQ ID NO: 734720 - DNA, 22 bp, Artificial Sequence
  chemically synthesized
gcaattccatatacaggtataa

SEQ ID NO: 734721 - DNA, 22 bp, Artificial Sequence
  chemically synthesized
atcttgcttttattatacctgt

SEQ ID NO: 734722 - DNA, 22 bp, Artificial Sequence
  chemically synthesized
caattccatatacaggtataat

SEQ ID NO: 734723 - DNA, 22 bp, Artificial Sequence
  chemically synthesized
catatacaggtataataaaagc

SEQ ID NO: 734724 - DNA, 22 bp, Artificial Sequence
  chemically synthesized
acagtatgcatgtactcatctt

SEQ ID NO: 734725 - DNA, 22 bp, Artificial Sequence
  chemically synthesized
agagctcacagtatgcatgtac

SEQ ID NO: 734726 - DNA, 22 bp, Artificial Sequence
  chemically synthesized
cagagctcacagtatgcatgta

SEQ ID NO: 734727 - DNA, 22 bp, Artificial Sequence
  chemically synthesized
tcagagctcacagtatgcatgt

SEQ ID NO: 734728 - DNA, 22 bp, Artificial Sequence
  chemically synthesized
ttcagagctcacagtatgcatg

SEQ ID NO: 734729 - DNA, 22 bp, Artificial Sequence
  chemically synthesized
tagaaaaagtgccttttcagag

SEQ ID NO: 734730 - DNA, 22 bp, Artificial Sequence
  chemically synthesized
tgagctctgaaaaggcactttt

SEQ ID NO: 734731 - DNA, 22 bp, Artificial Sequence
  chemically synthesized
gcacagccattgtagaaaaagt

SEQ ID NO: 734732 - DNA, 22 bp, Artificial Sequence
  chemically synthesized
ggcacagccattgtagaaaaag

SEQ ID NO: 734733 - DNA, 22 bp, Artificial Sequence
  chemically synthesized
tgaaaaggcactttttctacaa

SEQ ID NO: 734734 - DNA, 22 bp, Artificial Sequence
  chemically synthesized
aaaaggcactttttctacaatg

SEQ ID NO: 734735 - DNA, 22 bp, Artificial Sequence
  chemically synthesized
atgaagaatttggcacagccat

SEQ ID NO: 734736 - DNA, 22 bp, Artificial Sequence
  chemically synthesized
tttctacaatggctgtgccaaa

SEQ ID NO: 734737 - DNA, 22 bp, Artificial Sequence
  chemically synthesized
ttctacaatggctgtgccaaat

SEQ ID NO: 734738 - DNA, 22 bp, Artificial Sequence
  chemically synthesized
tctacaatggctgtgccaaatt

SEQ ID NO: 734739 - DNA, 22 bp, Artificial Sequence
  chemically synthesized
ctacaatggctgtgccaaattc

SEQ ID NO: 734740 - DNA, 22 bp, Artificial Sequence
  chemically synthesized
tacaatggctgtgccaaattct

SEQ ID NO: 734741 - DNA, 22 bp, Artificial Sequence
  chemically synthesized
caatggctgtgccaaattcttc

SEQ ID NO: 734742 - DNA, 22 bp, Artificial Sequence
  chemically synthesized
caacagaataacagtctcatga

SEQ ID NO: 734743 - DNA, 22 bp, Artificial Sequence
  chemically synthesized
tgccaaattcttcatgagactg

SEQ ID NO: 734744 - DNA, 22 bp, Artificial Sequence
  chemically synthesized
gcaacagaataacagtctcatg

SEQ ID NO: 734745 - DNA, 22 bp, Artificial Sequence
  chemically synthesized
tcaccatttgcaacagaataac

SEQ ID NO: 734746 - DNA, 22 bp, Artificial Sequence
  chemically synthesized
ttcatgagactgttattctgtt

SEQ ID NO: 734747 - DNA, 22 bp, Artificial Sequence
  chemically synthesized
atcaccatttgcaacagaataa

SEQ ID NO: 734748 - DNA, 22 bp, Artificial Sequence
  chemically synthesized
catgagactgttattctgttgc

SEQ ID NO: 734749 - DNA, 22 bp, Artificial Sequence
  chemically synthesized
ttatcaccatttgcaacagaat

SEQ ID NO: 734750 - DNA, 22 bp, Artificial Sequence
  chemically synthesized
atgagactgttattctgttgca

SEQ ID NO: 734751 - DNA, 22 bp, Artificial Sequence
  chemically synthesized
cttatcaccatttgcaacagaa

SEQ ID NO: 734752 - DNA, 22 bp, Artificial Sequence
  chemically synthesized
tcttatcaccatttgcaacaga

SEQ ID NO: 734753 - DNA, 22 bp, Artificial Sequence
  chemically synthesized
gctttcttatcaccatttgcaa

SEQ ID NO: 734754 - DNA, 22 bp, Artificial Sequence
  chemically synthesized
ttattctgttgcaaatggtgat

SEQ ID NO: 734755 - DNA, 22 bp, Artificial Sequence
  chemically synthesized
ttctgttgcaaatggtgataag

SEQ ID NO: 734756 - DNA, 22 bp, Artificial Sequence
  chemically synthesized
tgttgcaaatggtgataagaaa

SEQ ID NO: 734757 - DNA, 22 bp, Artificial Sequence
  chemically synthesized
ttgcaaatggtgataagaaagc

SEQ ID NO: 734758 - DNA, 22 bp, Artificial Sequence
  chemically synthesized
caaatggtgataagaaagccaa

SEQ ID NO: 734759 - DNA, 22 bp, Artificial Sequence
  chemically synthesized
gtaaataatgtatgatattggc

SEQ ID NO: 734760 - DNA, 22 bp, Artificial Sequence
  chemically synthesized
gtacaaatgctagtaaataatg

SEQ ID NO: 734761 - DNA, 22 bp, Artificial Sequence
  chemically synthesized
aaaatattagtacaaatgctag

SEQ ID NO: 734762 - DNA, 22 bp, Artificial Sequence
  chemically synthesized
agaattgaaaatattagtacaa

SEQ ID NO: 734763 - DNA, 22 bp, Artificial Sequence
  chemically synthesized
tttactagcatttgtactaata

SEQ ID NO: 734764 - DNA, 22 bp, Artificial Sequence
  chemically synthesized
actagcatttgtactaatattt

SEQ ID NO: 734765 - DNA, 22 bp, Artificial Sequence
  chemically synthesized
ctagcatttgtactaatatttt

SEQ ID NO: 734766 - DNA, 22 bp, Artificial Sequence
  chemically synthesized
gcatttgtactaatattttcaa

SEQ ID NO: 734767 - DNA, 22 bp, Artificial Sequence
  chemically synthesized
taatgaggttcagaattgaaaa

SEQ ID NO: 734768 - DNA, 22 bp, Artificial Sequence
  chemically synthesized
gtactaatattttcaattctga

SEQ ID NO: 734769 - DNA, 22 bp, Artificial Sequence
  chemically synthesized
tactaatattttcaattctgaa

SEQ ID NO: 734770 - DNA, 22 bp, Artificial Sequence
  chemically synthesized
atattttcaattctgaacctca

SEQ ID NO: 734771 - DNA, 22 bp, Artificial Sequence
  chemically synthesized
tcaattctgaacctcattataa

SEQ ID NO: 734772 - DNA, 22 bp, Artificial Sequence
  chemically synthesized
aaacaagtgtgattataatgag

SEQ ID NO: 734773 - DNA, 22 bp, Artificial Sequence
  chemically synthesized
caattctgaacctcattataat

SEQ ID NO: 734774 - DNA, 22 bp, Artificial Sequence
  chemically synthesized
aattctgaacctcattataatc

SEQ ID NO: 734775 - DNA, 22 bp, Artificial Sequence
  chemically synthesized
tgaaacaagtgtgattataatg

SEQ ID NO: 734776 - DNA, 22 bp, Artificial Sequence
  chemically synthesized
tgaacctcattataatcacact

SEQ ID NO: 734777 - DNA, 22 bp, Artificial Sequence
  chemically synthesized
aacctcattataatcacacttg

SEQ ID NO: 734778 - DNA, 22 bp, Artificial Sequence
  chemically synthesized
attataatcacacttgtttcag

SEQ ID NO: 734779 - DNA, 22 bp, Artificial Sequence
  chemically synthesized
taatcacacttgtttcagaacc

SEQ ID NO: 734780 - DNA, 22 bp, Artificial Sequence
  chemically synthesized
ggtatgtccacaaatgggttct

SEQ ID NO: 734781 - DNA, 22 bp, Artificial Sequence
  chemically synthesized
gtttcagaacccatttgtggac

SEQ ID NO: 734782 - DNA, 22 bp, Artificial Sequence
  chemically synthesized
tttcagaacccatttgtggaca

SEQ ID NO: 734783 - DNA, 22 bp, Artificial Sequence
  chemically synthesized
cagaacccatttgtggacatac

SEQ ID NO: 734784 - DNA, 22 bp, Artificial Sequence
  chemically synthesized
agaacccatttgtggacatacc

SEQ ID NO: 734785 - DNA, 22 bp, Artificial Sequence
  chemically synthesized
ggcaaatagctgggtatgtcca

SEQ ID NO: 734786 - DNA, 22 bp, Artificial Sequence
  chemically synthesized
gttaggcaaatagctgggtatg

SEQ ID NO: 734787 - DNA, 22 bp, Artificial Sequence
  chemically synthesized
ttagttaggcaaatagctgggt

SEQ ID NO: 734788 - DNA, 22 bp, Artificial Sequence
  chemically synthesized
gtggacatacccagctatttgc

SEQ ID NO: 734789 - DNA, 22 bp, Artificial Sequence
  chemically synthesized
tggacatacccagctatttgcc

SEQ ID NO: 734790 - DNA, 22 bp, Artificial Sequence
  chemically synthesized
tttgcctaactaacagctattt

SEQ ID NO: 734791 - DNA, 22 bp, Artificial Sequence
  chemically synthesized
gcctaactaacagctatttact

SEQ ID NO: 734792 - DNA, 22 bp, Artificial Sequence
  chemically synthesized
cctaactaacagctatttactt

SEQ ID NO: 734793 - DNA, 22 bp, Artificial Sequence
  chemically synthesized
ccaaggaacaagaagtaaatag

SEQ ID NO: 734794 - DNA, 22 bp, Artificial Sequence
  chemically synthesized
accaaggaacaagaagtaaata

SEQ ID NO: 734795 - DNA, 22 bp, Artificial Sequence
  chemically synthesized
taccaaggaacaagaagtaaat

SEQ ID NO: 734796 - DNA, 22 bp, Artificial Sequence
  chemically synthesized
actaacagctatttacttcttg

SEQ ID NO: 734797 - DNA, 22 bp, Artificial Sequence
  chemically synthesized
tttaccaaggaacaagaagtaa

SEQ ID NO: 734798 - DNA, 22 bp, Artificial Sequence
  chemically synthesized
ctttaccaaggaacaagaagta

SEQ ID NO: 734799 - DNA, 22 bp, Artificial Sequence
  chemically synthesized
acagctatttacttcttgttcc

SEQ ID NO: 734800 - DNA, 22 bp, Artificial Sequence
  chemically synthesized
agcttctttaccaaggaacaag

SEQ ID NO: 734801 - DNA, 22 bp, Artificial Sequence
  chemically synthesized
tttacttcttgttccttggtaa

SEQ ID NO: 734802 - DNA, 22 bp, Artificial Sequence
  chemically synthesized
acttcttgttccttggtaaaga

SEQ ID NO: 734803 - DNA, 22 bp, Artificial Sequence
  chemically synthesized
cttcttgttccttggtaaagaa

SEQ ID NO: 734804 - DNA, 22 bp, Artificial Sequence
  chemically synthesized
aacataattgagcttctttacc

SEQ ID NO: 734805 - DNA, 22 bp, Artificial Sequence
  chemically synthesized
cttgttccttggtaaagaagct

SEQ ID NO: 734806 - DNA, 22 bp, Artificial Sequence
  chemically synthesized
ttgttccttggtaaagaagctc

SEQ ID NO: 734807 - DNA, 22 bp, Artificial Sequence
  chemically synthesized
gttccttggtaaagaagctcaa

SEQ ID NO: 734808 - DNA, 22 bp, Artificial Sequence
  chemically synthesized
ttccttggtaaagaagctcaat

SEQ ID NO: 734809 - DNA, 22 bp, Artificial Sequence
  chemically synthesized
cttggtaaagaagctcaattat

SEQ ID NO: 734810 - DNA, 22 bp, Artificial Sequence
  chemically synthesized
cccaatatctgaacataattga

SEQ ID NO: 734811 - DNA, 22 bp, Artificial Sequence
  chemically synthesized
ggtaaagaagctcaattatgtt

SEQ ID NO: 734812 - DNA, 22 bp, Artificial Sequence
  chemically synthesized
gtaaagaagctcaattatgttc

SEQ ID NO: 734813 - DNA, 22 bp, Artificial Sequence
  chemically synthesized
ttgcccaatatctgaacataat

SEQ ID NO: 734814 - DNA, 22 bp, Artificial Sequence
  chemically synthesized
gttgcccaatatctgaacataa

SEQ ID NO: 734815 - DNA, 22 bp, Artificial Sequence
  chemically synthesized
tgttgcccaatatctgaacata

SEQ ID NO: 734816 - DNA, 22 bp, Artificial Sequence
  chemically synthesized
tgtcctttgttgcccaatatct

SEQ ID NO: 734817 - DNA, 22 bp, Artificial Sequence
  chemically synthesized
aattatgttcagatattgggca

SEQ ID NO: 734818 - DNA, 22 bp, Artificial Sequence
  chemically synthesized
tgttcagatattgggcaacaaa

SEQ ID NO: 734819 - DNA, 22 bp, Artificial Sequence
  chemically synthesized
agagctgtgtcctttgttgccc

SEQ ID NO: 734820 - DNA, 22 bp, Artificial Sequence
  chemically synthesized
ctcagagctgtgtcctttgttg

SEQ ID NO: 734821 - DNA, 22 bp, Artificial Sequence
  chemically synthesized
cctcagagctgtgtcctttgtt

SEQ ID NO: 734822 - DNA, 22 bp, Artificial Sequence
  chemically synthesized
agatattgggcaacaaaggaca

SEQ ID NO: 734823 - DNA, 22 bp, Artificial Sequence
  chemically synthesized
tcctcagagctgtgtcctttgt

SEQ ID NO: 734824 - DNA, 22 bp, Artificial Sequence
  chemically synthesized
ttcctcagagctgtgtcctttg

SEQ ID NO: 734825 - DNA, 22 bp, Artificial Sequence
  chemically synthesized
tttcctcagagctgtgtccttt

SEQ ID NO: 734826 - DNA, 22 bp, Artificial Sequence
  chemically synthesized
attttttcctcagagctgtgtc

SEQ ID NO: 734827 - DNA, 22 bp, Artificial Sequence
  chemically synthesized
aattttttcctcagagctgtgt

SEQ ID NO: 734828 - DNA, 22 bp, Artificial Sequence
  chemically synthesized
ggcaacaaaggacacagctctg

SEQ ID NO: 734829 - DNA, 22 bp, Artificial Sequence
  chemically synthesized
taattttttcctcagagctgtg

SEQ ID NO: 734830 - DNA, 22 bp, Artificial Sequence
  chemically synthesized
gaccagattttaattttttcct

SEQ ID NO: 734831 - DNA, 22 bp, Artificial Sequence
  chemically synthesized
agaccagattttaattttttcc

SEQ ID NO: 734832 - DNA, 22 bp, Artificial Sequence
  chemically synthesized
gcttagaccagattttaatttt

SEQ ID NO: 734833 - DNA, 22 bp, Artificial Sequence
  chemically synthesized
tgaggaaaaaattaaaatctgg

SEQ ID NO: 734834 - DNA, 22 bp, Artificial Sequence
  chemically synthesized
tgattggcttagaccagatttt

SEQ ID NO: 734835 - DNA, 22 bp, Artificial Sequence
  chemically synthesized
aggaaaaaattaaaatctggtc

SEQ ID NO: 734836 - DNA, 22 bp, Artificial Sequence
  chemically synthesized
ctgtgattggcttagaccagat

SEQ ID NO: 734837 - DNA, 22 bp, Artificial Sequence
  chemically synthesized
actgtgattggcttagaccaga

SEQ ID NO: 734838 - DNA, 22 bp, Artificial Sequence
  chemically synthesized
aaatctggtctaagccaatcac

SEQ ID NO: 734839 - DNA, 22 bp, Artificial Sequence
  chemically synthesized
tgagaaacaagcttactgtgat

SEQ ID NO: 734840 - DNA, 22 bp, Artificial Sequence
  chemically synthesized
gtctaagccaatcacagtaagc

SEQ ID NO: 734841 - DNA, 22 bp, Artificial Sequence
  chemically synthesized
gctatgagaaacaagcttactg

SEQ ID NO: 734842 - DNA, 22 bp, Artificial Sequence
  chemically synthesized
agccaatcacagtaagcttgtt

SEQ ID NO: 734843 - DNA, 22 bp, Artificial Sequence
  chemically synthesized
agccaatcactggctatgagaa

SEQ ID NO: 734844 - DNA, 22 bp, Artificial Sequence
  chemically synthesized
aagccaatcactggctatgaga

SEQ ID NO: 734845 - DNA, 22 bp, Artificial Sequence
  chemically synthesized
taagccaatcactggctatgag

SEQ ID NO: 734846 - DNA, 22 bp, Artificial Sequence
  chemically synthesized
tttaagccaatcactggctatg

SEQ ID NO: 734847 - DNA, 22 bp, Artificial Sequence
  chemically synthesized
gtttctcatagccagtgattgg

SEQ ID NO: 734848 - DNA, 22 bp, Artificial Sequence
  chemically synthesized
aacctctttaagccaatcactg

SEQ ID NO: 734849 - DNA, 22 bp, Artificial Sequence
  chemically synthesized
tttctcatagccagtgattggc

SEQ ID NO: 734850 - DNA, 22 bp, Artificial Sequence
  chemically synthesized
ctcatagccagtgattggctta

SEQ ID NO: 734851 - DNA, 22 bp, Artificial Sequence
  chemically synthesized
actgaacctctttaagccaatc

SEQ ID NO: 734852 - DNA, 22 bp, Artificial Sequence
  chemically synthesized
tcatagccagtgattggcttaa

SEQ ID NO: 734853 - DNA, 22 bp, Artificial Sequence
  chemically synthesized
atagccagtgattggcttaaag

SEQ ID NO: 734854 - DNA, 22 bp, Artificial Sequence
  chemically synthesized
gatctcactgaacctctttaag

SEQ ID NO: 734855 - DNA, 22 bp, Artificial Sequence
  chemically synthesized
gaactggatctcactgaacctc

SEQ ID NO: 734856 - DNA, 22 bp, Artificial Sequence
  chemically synthesized
gcttaaagaggttcagtgagat

SEQ ID NO: 734857 - DNA, 22 bp, Artificial Sequence
  chemically synthesized
aaagaggttcagtgagatccag

SEQ ID NO: 734858 - DNA, 22 bp, Artificial Sequence
  chemically synthesized
aagaggttcagtgagatccagt

SEQ ID NO: 734859 - DNA, 22 bp, Artificial Sequence
  chemically synthesized
tgtgtcaactagaactggatct

SEQ ID NO: 734860 - DNA, 22 bp, Artificial Sequence
  chemically synthesized
atgtgtcaactagaactggatc

SEQ ID NO: 734861 - DNA, 22 bp, Artificial Sequence
  chemically synthesized
ttatgtgtcaactagaactgga

SEQ ID NO: 734862 - DNA, 22 bp, Artificial Sequence
  chemically synthesized
cttatgtgtcaactagaactgg

SEQ ID NO: 734863 - DNA, 22 bp, Artificial Sequence
  chemically synthesized
ttcttatgtgtcaactagaact

SEQ ID NO: 734864 - DNA, 22 bp, Artificial Sequence
  chemically synthesized
cttcttatgtgtcaactagaac

SEQ ID NO: 734865 - DNA, 22 bp, Artificial Sequence
  chemically synthesized
agtgagatccagttctagttga

SEQ ID NO: 734866 - DNA, 22 bp, Artificial Sequence
  chemically synthesized
cccaacaaatttcttcttatgt

SEQ ID NO: 734867 - DNA, 22 bp, Artificial Sequence
  chemically synthesized
tagttgacacataagaagaaat

SEQ ID NO: 734868 - DNA, 22 bp, Artificial Sequence
  chemically synthesized
gttgacacataagaagaaattt

SEQ ID NO: 734869 - DNA, 22 bp, Artificial Sequence
  chemically synthesized
acacataagaagaaatttgttg

SEQ ID NO: 734870 - DNA, 22 bp, Artificial Sequence
  chemically synthesized
ccagaagctccccaacaaattt

SEQ ID NO: 734871 - DNA, 22 bp, Artificial Sequence
  chemically synthesized
cccagaagctccccaacaaatt

SEQ ID NO: 734872 - DNA, 22 bp, Artificial Sequence
  chemically synthesized
gaaaagcaaacgtttcccagaa

SEQ ID NO: 734873 - DNA, 22 bp, Artificial Sequence
  chemically synthesized
ggaaaagcaaacgtttcccaga

SEQ ID NO: 734874 - DNA, 22 bp, Artificial Sequence
  chemically synthesized
gttggggagcttctgggaaacg

SEQ ID NO: 734875 - DNA, 22 bp, Artificial Sequence
  chemically synthesized
ttggggagcttctgggaaacgt

SEQ ID NO: 734876 - DNA, 22 bp, Artificial Sequence
  chemically synthesized
gggagcttctgggaaacgtttg

SEQ ID NO: 734877 - DNA, 22 bp, Artificial Sequence
  chemically synthesized
tgtttggaaaagcaaacgtttc

SEQ ID NO: 734878 - DNA, 22 bp, Artificial Sequence
  chemically synthesized
ctgggaaacgtttgcttttcca

SEQ ID NO: 734879 - DNA, 22 bp, Artificial Sequence
  chemically synthesized
tgtgtctgtgtttggaaaagca

SEQ ID NO: 734880 - DNA, 22 bp, Artificial Sequence
  chemically synthesized
tgggaaacgtttgcttttccaa

SEQ ID NO: 734881 - DNA, 22 bp, Artificial Sequence
  chemically synthesized
ggaaacgtttgcttttccaaac

SEQ ID NO: 734882 - DNA, 22 bp, Artificial Sequence
  chemically synthesized
atgcctgtgtgtctgtgtttgg

SEQ ID NO: 734883 - DNA, 22 bp, Artificial Sequence
  chemically synthesized
gcttttccaaacacagacacac

SEQ ID NO: 734884 - DNA, 22 bp, Artificial Sequence
  chemically synthesized
cttttccaaacacagacacaca

SEQ ID NO: 734885 - DNA, 22 bp, Artificial Sequence
  chemically synthesized
ttccaaacacagacacacaggc

SEQ ID NO: 734886 - DNA, 22 bp, Artificial Sequence
  chemically synthesized
tccaaacacagacacacaggca

SEQ ID NO: 734887 - DNA, 22 bp, Artificial Sequence
  chemically synthesized
ccaaacacagacacacaggcat

SEQ ID NO: 734888 - DNA, 22 bp, Artificial Sequence
  chemically synthesized
caaacacagacacacaggcatg

SEQ ID NO: 734889 - DNA, 22 bp, Artificial Sequence
  chemically synthesized
tgtgcgtgtgtgtgtgtgtgta

SEQ ID NO: 734890 - DNA, 22 bp, Artificial Sequence
  chemically synthesized
tattgtgtgcgtgtgtgtgtgt

SEQ ID NO: 734891 - DNA, 22 bp, Artificial Sequence
  chemically synthesized
aaggataactgtattgtgtgcg

SEQ ID NO: 734892 - DNA, 22 bp, Artificial Sequence
  chemically synthesized
tccttgaaccttattccttctt

SEQ ID NO: 734893 - DNA, 22 bp, Artificial Sequence
  chemically synthesized
gaaccttattccttcttgcctt

SEQ ID NO: 734894 - DNA, 22 bp, Artificial Sequence
  chemically synthesized
aaccttattccttcttgccttg

SEQ ID NO: 734895 - DNA, 22 bp, Artificial Sequence
  chemically synthesized
attccttcttgccttggttatt

SEQ ID NO: 734896 - DNA, 22 bp, Artificial Sequence
  chemically synthesized
ttccttcttgccttggttattg

SEQ ID NO: 734897 - DNA, 22 bp, Artificial Sequence
  chemically synthesized
cttcttgccttggttattgttg

SEQ ID NO: 734898 - DNA, 22 bp, Artificial Sequence
  chemically synthesized
cttgccttggttattgttgtct

SEQ ID NO: 734899 - DNA, 22 bp, Artificial Sequence
  chemically synthesized
ttgccttggttattgttgtctg

SEQ ID NO: 734900 - DNA, 22 bp, Artificial Sequence
  chemically synthesized
gccttggttattgttgtctgcg

SEQ ID NO: 734901 - DNA, 22 bp, Artificial Sequence
  chemically synthesized
ccttggttattgttgtctgcgg

SEQ ID NO: 734902 - DNA, 22 bp, Artificial Sequence
  chemically synthesized
cgccaagcaacatatccgcaga

SEQ ID NO: 734903 - DNA, 22 bp, Artificial Sequence
  chemically synthesized
ggttattgttgtctgcggatat

SEQ ID NO: 734904 - DNA, 22 bp, Artificial Sequence
  chemically synthesized
gttattgttgtctgcggatatg

SEQ ID NO: 734905 - DNA, 22 bp, Artificial Sequence
  chemically synthesized
ttgttgtctgcggatatgttgc

SEQ ID NO: 734906 - DNA, 22 bp, Artificial Sequence
  chemically synthesized
ccactgcgccaagcaacatatc

SEQ ID NO: 734907 - DNA, 22 bp, Artificial Sequence
  chemically synthesized
cccactgcgccaagcaacatat

SEQ ID NO: 734908 - DNA, 22 bp, Artificial Sequence
  chemically synthesized
ttgtctgcggatatgttgcttg

SEQ ID NO: 734909 - DNA, 22 bp, Artificial Sequence
  chemically synthesized
tctgcggatatgttgcttggcg

SEQ ID NO: 734910 - DNA, 22 bp, Artificial Sequence
  chemically synthesized
cggatatgttgcttggcgcagt

SEQ ID NO: 734911 - DNA, 22 bp, Artificial Sequence
  chemically synthesized
atggtcccaagatggcttccca

SEQ ID NO: 734912 - DNA, 22 bp, Artificial Sequence
  chemically synthesized
cttggcgcagtgggaagccatc

SEQ ID NO: 734913 - DNA, 22 bp, Artificial Sequence
  chemically synthesized
ctcatggtcccaagatggcttc

SEQ ID NO: 734914 - DNA, 22 bp, Artificial Sequence
  chemically synthesized
cctcatggtcccaagatggctt

SEQ ID NO: 734915 - DNA, 22 bp, Artificial Sequence
  chemically synthesized
ggcgcagtgggaagccatcttg

SEQ ID NO: 734916 - DNA, 22 bp, Artificial Sequence
  chemically synthesized
tcctcatggtcccaagatggct

SEQ ID NO: 734917 - DNA, 22 bp, Artificial Sequence
  chemically synthesized
gcgcagtgggaagccatcttgg

SEQ ID NO: 734918 - DNA, 22 bp, Artificial Sequence
  chemically synthesized
ttcctcatggtcccaagatggc

SEQ ID NO: 734919 - DNA, 22 bp, Artificial Sequence
  chemically synthesized
tttcctcatggtcccaagatgg

SEQ ID NO: 734920 - DNA, 22 bp, Artificial Sequence
  chemically synthesized
tctttttcctcatggtcccaag

SEQ ID NO: 734921 - DNA, 22 bp, Artificial Sequence
  chemically synthesized
gtctttttcctcatggtcccaa

SEQ ID NO: 734922 - DNA, 22 bp, Artificial Sequence
  chemically synthesized
ttgtctttttcctcatggtccc

SEQ ID NO: 734923 - DNA, 22 bp, Artificial Sequence
  chemically synthesized
tcttgtctttttcctcatggtc

SEQ ID NO: 734924 - DNA, 22 bp, Artificial Sequence
  chemically synthesized
ggattctcttgtctttttcctc

SEQ ID NO: 734925 - DNA, 22 bp, Artificial Sequence
  chemically synthesized
tgggattctcttgtctttttcc

SEQ ID NO: 734926 - DNA, 22 bp, Artificial Sequence
  chemically synthesized
gggaccatgaggaaaaagacaa

SEQ ID NO: 734927 - DNA, 22 bp, Artificial Sequence
  chemically synthesized
tctgggattctcttgtcttttt

SEQ ID NO: 734928 - DNA, 22 bp, Artificial Sequence
  chemically synthesized
ggaccatgaggaaaaagacaag

SEQ ID NO: 734929 - DNA, 22 bp, Artificial Sequence
  chemically synthesized
ctctgggattctcttgtctttt

SEQ ID NO: 734930 - DNA, 22 bp, Artificial Sequence
  chemically synthesized
aggtcagcttctctgggattct

SEQ ID NO: 734931 - DNA, 22 bp, Artificial Sequence
  chemically synthesized
gaggtcagcttctctgggattc

SEQ ID NO: 734932 - DNA, 22 bp, Artificial Sequence
  chemically synthesized
tatcaagacttgaggtcagctt

SEQ ID NO: 734933 - DNA, 22 bp, Artificial Sequence
  chemically synthesized
gctatatcaagacttgaggtca

SEQ ID NO: 734934 - DNA, 22 bp, Artificial Sequence
  chemically synthesized
aacagattagctatatcaagac

SEQ ID NO: 734935 - DNA, 22 bp, Artificial Sequence
  chemically synthesized
attcaacagattagctatatca

SEQ ID NO: 734936 - DNA, 22 bp, Artificial Sequence
  chemically synthesized
acctcaagtcttgatatagcta

SEQ ID NO: 734937 - DNA, 22 bp, Artificial Sequence
  chemically synthesized
gttaattcaacagattagctat

SEQ ID NO: 734938 - DNA, 22 bp, Artificial Sequence
  chemically synthesized
aagtcttgatatagctaatctg

SEQ ID NO: 734939 - DNA, 22 bp, Artificial Sequence
  chemically synthesized
gagctggttaattcaacagatt

SEQ ID NO: 734940 - DNA, 22 bp, Artificial Sequence
  chemically synthesized
gatatagctaatctgttgaatt

SEQ ID NO: 734941 - DNA, 22 bp, Artificial Sequence
  chemically synthesized
atatagctaatctgttgaatta

SEQ ID NO: 734942 - DNA, 22 bp, Artificial Sequence
  chemically synthesized
atctgttgaattaaccagctct

SEQ ID NO: 734943 - DNA, 22 bp, Artificial Sequence
  chemically synthesized
ttgaattaaccagctctaggtc

SEQ ID NO: 734944 - DNA, 22 bp, Artificial Sequence
  chemically synthesized
aattaaccagctctaggtctga

SEQ ID NO: 734945 - DNA, 22 bp, Artificial Sequence
  chemically synthesized
aagtccaaagaccatcagacct

SEQ ID NO: 734946 - DNA, 22 bp, Artificial Sequence
  chemically synthesized
accagctctaggtctgatggtc

SEQ ID NO: 734947 - DNA, 22 bp, Artificial Sequence
  chemically synthesized
taggtctgatggtctttggact

SEQ ID NO: 734948 - DNA, 22 bp, Artificial Sequence
  chemically synthesized
ggtctgatggtctttggacttc

SEQ ID NO: 734949 - DNA, 22 bp, Artificial Sequence
  chemically synthesized
atcaaaataaactgaagtccaa

SEQ ID NO: 734950 - DNA, 22 bp, Artificial Sequence
  chemically synthesized
atggtctttggacttcagttta

SEQ ID NO: 734951 - DNA, 22 bp, Artificial Sequence
  chemically synthesized
agaaccactaatcaaaataaac

SEQ ID NO: 734952 - DNA, 22 bp, Artificial Sequence
  chemically synthesized
gagaaccactaatcaaaataaa

SEQ ID NO: 734953 - DNA, 22 bp, Artificial Sequence
  chemically synthesized
tgagaaccactaatcaaaataa

SEQ ID NO: 734954 - DNA, 22 bp, Artificial Sequence
  chemically synthesized
tggacttcagtttattttgatt

SEQ ID NO: 734955 - DNA, 22 bp, Artificial Sequence
  chemically synthesized
ggacttcagtttattttgatta

SEQ ID NO: 734956 - DNA, 22 bp, Artificial Sequence
  chemically synthesized
gacttcagtttattttgattag

SEQ ID NO: 734957 - DNA, 22 bp, Artificial Sequence
  chemically synthesized
cactttgagaaccactaatcaa

SEQ ID NO: 734958 - DNA, 22 bp, Artificial Sequence
  chemically synthesized
cagtttattttgattagtggtt

SEQ ID NO: 734959 - DNA, 22 bp, Artificial Sequence
  chemically synthesized
agtttattttgattagtggttc

SEQ ID NO: 734960 - DNA, 22 bp, Artificial Sequence
  chemically synthesized
attttgattagtggttctcaaa

SEQ ID NO: 734961 - DNA, 22 bp, Artificial Sequence
  chemically synthesized
ttttgattagtggttctcaaag

SEQ ID NO: 734962 - DNA, 22 bp, Artificial Sequence
  chemically synthesized
tgattagtggttctcaaagtgc

SEQ ID NO: 734963 - DNA, 22 bp, Artificial Sequence
  chemically synthesized
tggtcaggaactgcactttgag

SEQ ID NO: 734964 - DNA, 22 bp, Artificial Sequence
  chemically synthesized
gattagtggttctcaaagtgca

SEQ ID NO: 734965 - DNA, 22 bp, Artificial Sequence
  chemically synthesized
attagtggttctcaaagtgcag

SEQ ID NO: 734966 - DNA, 22 bp, Artificial Sequence
  chemically synthesized
ctgtggtcaggaactgcacttt

SEQ ID NO: 734967 - DNA, 22 bp, Artificial Sequence
  chemically synthesized
gtggttctcaaagtgcagttcc

SEQ ID NO: 734968 - DNA, 22 bp, Artificial Sequence
  chemically synthesized
ctcctgtggtcaggaactgcac

SEQ ID NO: 734969 - DNA, 22 bp, Artificial Sequence
  chemically synthesized
ctactcctgtggtcaggaactg

SEQ ID NO: 734970 - DNA, 22 bp, Artificial Sequence
  chemically synthesized
tcaaagtgcagttcctgaccac

SEQ ID NO: 734971 - DNA, 22 bp, Artificial Sequence
  chemically synthesized
tgctgctactcctgtggtcagg

SEQ ID NO: 734972 - DNA, 22 bp, Artificial Sequence
  chemically synthesized
aaagtgcagttcctgaccacag

SEQ ID NO: 734973 - DNA, 22 bp, Artificial Sequence
  chemically synthesized
ccaagttatgctgctactcctg

SEQ ID NO: 734974 - DNA, 22 bp, Artificial Sequence
  chemically synthesized
ctgaccacaggagtagcagcat

SEQ ID NO: 734975 - DNA, 22 bp, Artificial Sequence
  chemically synthesized
accacaggagtagcagcataac

SEQ ID NO: 734976 - DNA, 22 bp, Artificial Sequence
  chemically synthesized
gtaggttgccaagttatgctgc

SEQ ID NO: 734977 - DNA, 22 bp, Artificial Sequence
  chemically synthesized
tagtaggttgccaagttatgct

SEQ ID NO: 734978 - DNA, 22 bp, Artificial Sequence
  chemically synthesized
ctagtaggttgccaagttatgc

SEQ ID NO: 734979 - DNA, 22 bp, Artificial Sequence
  chemically synthesized
catttctagtaggttgccaagt

SEQ ID NO: 734980 - DNA, 22 bp, Artificial Sequence
  chemically synthesized
tacatttctagtaggttgccaa

SEQ ID NO: 734981 - DNA, 22 bp, Artificial Sequence
  chemically synthesized
ggcaacctactagaaatgtaga

SEQ ID NO: 734982 - DNA, 22 bp, Artificial Sequence
  chemically synthesized
gcaacctactagaaatgtagaa

SEQ ID NO: 734983 - DNA, 22 bp, Artificial Sequence
  chemically synthesized
ctagaaatgtagaatctcggac

SEQ ID NO: 734984 - DNA, 22 bp, Artificial Sequence
  chemically synthesized
gaaatgtagaatctcggactcc

SEQ ID NO: 734985 - DNA, 22 bp, Artificial Sequence
  chemically synthesized
atgcagtaggtccagcgtggag

SEQ ID NO: 734986 - DNA, 22 bp, Artificial Sequence
  chemically synthesized
tgatgcagtaggtccagcgtgg

SEQ ID NO: 734987 - DNA, 22 bp, Artificial Sequence
  chemically synthesized
ctgatgcagtaggtccagcgtg

SEQ ID NO: 734988 - DNA, 22 bp, Artificial Sequence
  chemically synthesized
ggactccacgctggacctactg

SEQ ID NO: 734989 - DNA, 22 bp, Artificial Sequence
  chemically synthesized
ccagcgtttctgatgcagtagg

SEQ ID NO: 734990 - DNA, 22 bp, Artificial Sequence
  chemically synthesized
cacgctggacctactgcatcag

SEQ ID NO: 734991 - DNA, 22 bp, Artificial Sequence
  chemically synthesized
ctcccagcgtttctgatgcagt

SEQ ID NO: 734992 - DNA, 22 bp, Artificial Sequence
  chemically synthesized
gacctactgcatcagaaacgct

SEQ ID NO: 734993 - DNA, 22 bp, Artificial Sequence
  chemically synthesized
gcaggctgctcccagcgtttct

SEQ ID NO: 734994 - DNA, 22 bp, Artificial Sequence
  chemically synthesized
ctgcatcagaaacgctgggagc

SEQ ID NO: 734995 - DNA, 22 bp, Artificial Sequence
  chemically synthesized
caggctggcaggctgctcccag

SEQ ID NO: 734996 - DNA, 22 bp, Artificial Sequence
  chemically synthesized
catcagaaacgctgggagcagc

SEQ ID NO: 734997 - DNA, 22 bp, Artificial Sequence
  chemically synthesized
aactacaggctggcaggctgct

SEQ ID NO: 734998 - DNA, 22 bp, Artificial Sequence
  chemically synthesized
ttaaactacaggctggcaggct

SEQ ID NO: 734999 - DNA, 22 bp, Artificial Sequence
  chemically synthesized
gttaaactacaggctggcaggc

SEQ ID NO: 735000 - DNA, 22 bp, Artificial Sequence
  chemically synthesized
ggagcagcctgccagcctgtag

SEQ ID NO: 735001 - DNA, 22 bp, Artificial Sequence
  chemically synthesized
ggggcttgttaaactacaggct

SEQ ID NO: 735002 - DNA, 22 bp, Artificial Sequence
  chemically synthesized
ccagcctgtagtttaacaagcc

SEQ ID NO: 735003 - DNA, 22 bp, Artificial Sequence
  chemically synthesized
tagtttaacaagcccccagggg

SEQ ID NO: 735004 - DNA, 22 bp, Artificial Sequence
  chemically synthesized
gtatgcatcagaatcccctggg

SEQ ID NO: 735005 - DNA, 22 bp, Artificial Sequence
  chemically synthesized
agtatgcatcagaatcccctgg

SEQ ID NO: 735006 - DNA, 22 bp, Artificial Sequence
  chemically synthesized
tagtatgcatcagaatcccctg

SEQ ID NO: 735007 - DNA, 22 bp, Artificial Sequence
  chemically synthesized
aacaagcccccaggggattctg

SEQ ID NO: 735008 - DNA, 22 bp, Artificial Sequence
  chemically synthesized
acaagcccccaggggattctga

SEQ ID NO: 735009 - DNA, 22 bp, Artificial Sequence
  chemically synthesized
ccaaactttagtatgcatcaga

SEQ ID NO: 735010 - DNA, 22 bp, Artificial Sequence
  chemically synthesized
gcacagttcccaaactttagta

SEQ ID NO: 735011 - DNA, 22 bp, Artificial Sequence
  chemically synthesized
tgatgcatactaaagtttggga

SEQ ID NO: 735012 - DNA, 22 bp, Artificial Sequence
  chemically synthesized
atgcatactaaagtttgggaac

SEQ ID NO: 735013 - DNA, 22 bp, Artificial Sequence
  chemically synthesized
ataatctagcacagttcccaaa

SEQ ID NO: 735014 - DNA, 22 bp, Artificial Sequence
  chemically synthesized
gataatctagcacagttcccaa

SEQ ID NO: 735015 - DNA, 22 bp, Artificial Sequence
  chemically synthesized
aagtttgggaactgtgctagat

SEQ ID NO: 735016 - DNA, 22 bp, Artificial Sequence
  chemically synthesized
gggaactgtgctagattatcaa

SEQ ID NO: 735017 - DNA, 22 bp, Artificial Sequence
  chemically synthesized
ggaactgtgctagattatcaaa

SEQ ID NO: 735018 - DNA, 22 bp, Artificial Sequence
  chemically synthesized
gaaataatagagacatttgata

SEQ ID NO: 735019 - DNA, 22 bp, Artificial Sequence
  chemically synthesized
tgctagattatcaaatgtctct

SEQ ID NO: 735020 - DNA, 22 bp, Artificial Sequence
  chemically synthesized
gattatcaaatgtctctattat

SEQ ID NO: 735021 - DNA, 22 bp, Artificial Sequence
  chemically synthesized
tcaaatgtctctattatttcta

SEQ ID NO: 735022 - DNA, 22 bp, Artificial Sequence
  chemically synthesized
ataatagacacattagaaataa

SEQ ID NO: 735023 - DNA, 22 bp, Artificial Sequence
  chemically synthesized
tcgttaataatagacacattag

SEQ ID NO: 735024 - DNA, 22 bp, Artificial Sequence
  chemically synthesized
tattatttctaatgtgtctatt

SEQ ID NO: 735025 - DNA, 22 bp, Artificial Sequence
  chemically synthesized
ttatttctaatgtgtctattat

SEQ ID NO: 735026 - DNA, 22 bp, Artificial Sequence
  chemically synthesized
tttctaatgtgtctattattaa

SEQ ID NO: 735027 - DNA, 22 bp, Artificial Sequence
  chemically synthesized
ctaatgtgtctattattaacga

SEQ ID NO: 735028 - DNA, 22 bp, Artificial Sequence
  chemically synthesized
taatgtgtctattattaacgat

SEQ ID NO: 735029 - DNA, 22 bp, Artificial Sequence
  chemically synthesized
atgtgtctattattaacgatag

SEQ ID NO: 735030 - DNA, 22 bp, Artificial Sequence
  chemically synthesized
ttattaacgatagggttttcac

SEQ ID NO: 735031 - DNA, 22 bp, Artificial Sequence
  chemically synthesized
ttaacgatagggttttcacttc

SEQ ID NO: 735032 - DNA, 22 bp, Artificial Sequence
  chemically synthesized
acgatagggttttcacttcttg

SEQ ID NO: 735033 - DNA, 22 bp, Artificial Sequence
  chemically synthesized
cagtggaatcaggcaagaagtg

SEQ ID NO: 735034 - DNA, 22 bp, Artificial Sequence
  chemically synthesized
acacgaactccagtggaatcag

SEQ ID NO: 735035 - DNA, 22 bp, Artificial Sequence
  chemically synthesized
tcacttcttgcctgattccact

SEQ ID NO: 735036 - DNA, 22 bp, Artificial Sequence
  chemically synthesized
aacacgaactccagtggaatca

SEQ ID NO: 735037 - DNA, 22 bp, Artificial Sequence
  chemically synthesized
cacttcttgcctgattccactg

SEQ ID NO: 735038 - DNA, 22 bp, Artificial Sequence
  chemically synthesized
taacacgaactccagtggaatc

SEQ ID NO: 735039 - DNA, 22 bp, Artificial Sequence
  chemically synthesized
acttcttgcctgattccactgg

SEQ ID NO: 735040 - DNA, 22 bp, Artificial Sequence
  chemically synthesized
ttaacacgaactccagtggaat

SEQ ID NO: 735041 - DNA, 22 bp, Artificial Sequence
  chemically synthesized
tttaacacgaactccagtggaa

SEQ ID NO: 735042 - DNA, 22 bp, Artificial Sequence
  chemically synthesized
ttttaacacgaactccagtgga

SEQ ID NO: 735043 - DNA, 22 bp, Artificial Sequence
  chemically synthesized
tttttaacacgaactccagtgg

SEQ ID NO: 735044 - DNA, 22 bp, Artificial Sequence
  chemically synthesized
cttgcctgattccactggagtt

SEQ ID NO: 735045 - DNA, 22 bp, Artificial Sequence
  chemically synthesized
ttttttaacacgaactccagtg

SEQ ID NO: 735046 - DNA, 22 bp, Artificial Sequence
  chemically synthesized
ttgcctgattccactggagttc

SEQ ID NO: 735047 - DNA, 22 bp, Artificial Sequence
  chemically synthesized
gcctgattccactggagttcgt

SEQ ID NO: 735048 - DNA, 22 bp, Artificial Sequence
  chemically synthesized
cctgattccactggagttcgtg

SEQ ID NO: 735049 - DNA, 22 bp, Artificial Sequence
  chemically synthesized
attccactggagttcgtgttaa

SEQ ID NO: 735050 - DNA, 22 bp, Artificial Sequence
  chemically synthesized
ggaatatatttttttttaacac

SEQ ID NO: 735051 - DNA, 22 bp, Artificial Sequence
  chemically synthesized
cactggagttcgtgttaaaaaa

SEQ ID NO: 735052 - DNA, 22 bp, Artificial Sequence
  chemically synthesized
gggaatatatttttttttaaca

SEQ ID NO: 735053 - DNA, 22 bp, Artificial Sequence
  chemically synthesized
gagttcgtgttaaaaaaaaata

SEQ ID NO: 735054 - DNA, 22 bp, Artificial Sequence
  chemically synthesized
gtgttaaaaaaaaatatattcc

SEQ ID NO: 735055 - DNA, 22 bp, Artificial Sequence
  chemically synthesized
atgcaatagacttgggaatata

SEQ ID NO: 735056 - DNA, 22 bp, Artificial Sequence
  chemically synthesized
tgatgcaatagacttgggaata

SEQ ID NO: 735057 - DNA, 22 bp, Artificial Sequence
  chemically synthesized
aaaaaaaatatattcccaagtc

SEQ ID NO: 735058 - DNA, 22 bp, Artificial Sequence
  chemically synthesized
gagattctgatgcaatagactt

SEQ ID NO: 735059 - DNA, 22 bp, Artificial Sequence
  chemically synthesized
actggagattctgatgcaatag

SEQ ID NO: 735060 - DNA, 22 bp, Artificial Sequence
  chemically synthesized
cactggagattctgatgcaata

SEQ ID NO: 735061 - DNA, 22 bp, Artificial Sequence
  chemically synthesized
ccaagtctattgcatcagaatc

SEQ ID NO: 735062 - DNA, 22 bp, Artificial Sequence
  chemically synthesized
acaagccccttcactggagatt

SEQ ID NO: 735063 - DNA, 22 bp, Artificial Sequence
  chemically synthesized
ttgcatcagaatctccagtgaa

SEQ ID NO: 735064 - DNA, 22 bp, Artificial Sequence
  chemically synthesized
attcacaagccccttcactgga

SEQ ID NO: 735065 - DNA, 22 bp, Artificial Sequence
  chemically synthesized
catcagaatctccagtgaaggg

SEQ ID NO: 735066 - DNA, 22 bp, Artificial Sequence
  chemically synthesized
ttaattcacaagccccttcact

SEQ ID NO: 735067 - DNA, 22 bp, Artificial Sequence
  chemically synthesized
aattattaattcacaagcccct

SEQ ID NO: 735068 - DNA, 22 bp, Artificial Sequence
  chemically synthesized
attaaattattaattcacaagc

SEQ ID NO: 735069 - DNA, 22 bp, Artificial Sequence
  chemically synthesized
gattaaattattaattcacaag

SEQ ID NO: 735070 - DNA, 22 bp, Artificial Sequence
  chemically synthesized
cagtgaaggggcttgtgaatta

SEQ ID NO: 735071 - DNA, 22 bp, Artificial Sequence
  chemically synthesized
gtgaattaataatttaatcaag

SEQ ID NO: 735072 - DNA, 22 bp, Artificial Sequence
  chemically synthesized
tgaattaataatttaatcaagt

SEQ ID NO: 735073 - DNA, 22 bp, Artificial Sequence
  chemically synthesized
ataatttaatcaagtgcccctg

SEQ ID NO: 735074 - DNA, 22 bp, Artificial Sequence
  chemically synthesized
gtcataagaatcaccaggggca

SEQ ID NO: 735075 - DNA, 22 bp, Artificial Sequence
  chemically synthesized
tggtcataagaatcaccagggg

SEQ ID NO: 735076 - DNA, 22 bp, Artificial Sequence
  chemically synthesized
ctggtcataagaatcaccaggg

SEQ ID NO: 735077 - DNA, 22 bp, Artificial Sequence
  chemically synthesized
tctggtcataagaatcaccagg

SEQ ID NO: 735078 - DNA, 22 bp, Artificial Sequence
  chemically synthesized
aatcaagtgcccctggtgattc

SEQ ID NO: 735079 - DNA, 22 bp, Artificial Sequence
  chemically synthesized
atcaagtgcccctggtgattct

SEQ ID NO: 735080 - DNA, 22 bp, Artificial Sequence
  chemically synthesized
ccaaggttttctggtcataaga

SEQ ID NO: 735081 - DNA, 22 bp, Artificial Sequence
  chemically synthesized
cccaaggttttctggtcataag

SEQ ID NO: 735082 - DNA, 22 bp, Artificial Sequence
  chemically synthesized
tcccaaggttttctggtcataa

SEQ ID NO: 735083 - DNA, 22 bp, Artificial Sequence
  chemically synthesized
tctttcccaaggttttctggtc

SEQ ID NO: 735084 - DNA, 22 bp, Artificial Sequence
  chemically synthesized
gtgattcttatgaccagaaaac

SEQ ID NO: 735085 - DNA, 22 bp, Artificial Sequence
  chemically synthesized
gtctttcccaaggttttctggt

SEQ ID NO: 735086 - DNA, 22 bp, Artificial Sequence
  chemically synthesized
agtttgtctttcccaaggtttt

SEQ ID NO: 735087 - DNA, 22 bp, Artificial Sequence
  chemically synthesized
aagtttgtctttcccaaggttt

SEQ ID NO: 735088 - DNA, 22 bp, Artificial Sequence
  chemically synthesized
ttatgaccagaaaaccttggga

SEQ ID NO: 735089 - DNA, 22 bp, Artificial Sequence
  chemically synthesized
ttaagtttgtctttcccaaggt

SEQ ID NO: 735090 - DNA, 22 bp, Artificial Sequence
  chemically synthesized
atgaccagaaaaccttgggaaa

SEQ ID NO: 735091 - DNA, 22 bp, Artificial Sequence
  chemically synthesized
tgaccagaaaaccttgggaaag

SEQ ID NO: 735092 - DNA, 22 bp, Artificial Sequence
  chemically synthesized
aagttcttaagtttgtctttcc

SEQ ID NO: 735093 - DNA, 22 bp, Artificial Sequence
  chemically synthesized
aaagttcttaagtttgtctttc

SEQ ID NO: 735094 - DNA, 22 bp, Artificial Sequence
  chemically synthesized
taaagttcttaagtttgtcttt

SEQ ID NO: 735095 - DNA, 22 bp, Artificial Sequence
  chemically synthesized
actttaaagttcttaagtttgt

SEQ ID NO: 735096 - DNA, 22 bp, Artificial Sequence
  chemically synthesized
gggaaagacaaacttaagaact

SEQ ID NO: 735097 - DNA, 22 bp, Artificial Sequence
  chemically synthesized
ggaaagacaaacttaagaactt

SEQ ID NO: 735098 - DNA, 22 bp, Artificial Sequence
  chemically synthesized
aagaactttaaagtcaggtatc

SEQ ID NO: 735099 - DNA, 22 bp, Artificial Sequence
  chemically synthesized
agaactttaaagtcaggtatct

SEQ ID NO: 735100 - DNA, 22 bp, Artificial Sequence
  chemically synthesized
agaggccagtaacagatacctg

SEQ ID NO: 735101 - DNA, 22 bp, Artificial Sequence
  chemically synthesized
cagaggccagtaacagatacct

SEQ ID NO: 735102 - DNA, 22 bp, Artificial Sequence
  chemically synthesized
tcagaggccagtaacagatacc

SEQ ID NO: 735103 - DNA, 22 bp, Artificial Sequence
  chemically synthesized
taaagtcaggtatctgttactg

SEQ ID NO: 735104 - DNA, 22 bp, Artificial Sequence
  chemically synthesized
aaagtcaggtatctgttactgg

SEQ ID NO: 735105 - DNA, 22 bp, Artificial Sequence
  chemically synthesized
aagtcaggtatctgttactggc

SEQ ID NO: 735106 - DNA, 22 bp, Artificial Sequence
  chemically synthesized
gaatactttcagaggccagtaa

SEQ ID NO: 735107 - DNA, 22 bp, Artificial Sequence
  chemically synthesized
ttactggcctctgaaagtattc

SEQ ID NO: 735108 - DNA, 22 bp, Artificial Sequence
  chemically synthesized
ctggcctctgaaagtattctaa

SEQ ID NO: 735109 - DNA, 22 bp, Artificial Sequence
  chemically synthesized
gcctctgaaagtattctaactg

SEQ ID NO: 735110 - DNA, 22 bp, Artificial Sequence
  chemically synthesized
cagatggaatgtcagttagaat

SEQ ID NO: 735111 - DNA, 22 bp, Artificial Sequence
  chemically synthesized
tgaaagtattctaactgacatt

SEQ ID NO: 735112 - DNA, 22 bp, Artificial Sequence
  chemically synthesized
aaagtattctaactgacattcc

SEQ ID NO: 735113 - DNA, 22 bp, Artificial Sequence
  chemically synthesized
aaacaggagattgcagatggaa

SEQ ID NO: 735114 - DNA, 22 bp, Artificial Sequence
  chemically synthesized
taactgacattccatctgcaat

SEQ ID NO: 735115 - DNA, 22 bp, Artificial Sequence
  chemically synthesized
actgacattccatctgcaatct

SEQ ID NO: 735116 - DNA, 22 bp, Artificial Sequence
  chemically synthesized
acattccatctgcaatctcctg

SEQ ID NO: 735117 - DNA, 22 bp, Artificial Sequence
  chemically synthesized
cggccagttgaaacaggagatt

SEQ ID NO: 735118 - DNA, 22 bp, Artificial Sequence
  chemically synthesized
catctgcaatctcctgtttcaa

SEQ ID NO: 735119 - DNA, 22 bp, Artificial Sequence
  chemically synthesized
gagctgcggccagttgaaacag

SEQ ID NO: 735120 - DNA, 22 bp, Artificial Sequence
  chemically synthesized
caatctcctgtttcaactggcc

SEQ ID NO: 735121 - DNA, 22 bp, Artificial Sequence
  chemically synthesized
agtggtcctggagctgcggcca

SEQ ID NO: 735122 - DNA, 22 bp, Artificial Sequence
  chemically synthesized
ctgtttcaactggccgcagctc

SEQ ID NO: 735123 - DNA, 22 bp, Artificial Sequence
  chemically synthesized
cctgagtggtcctggagctgcg

SEQ ID NO: 735124 - DNA, 22 bp, Artificial Sequence
  chemically synthesized
tttcaactggccgcagctccag

SEQ ID NO: 735125 - DNA, 22 bp, Artificial Sequence
  chemically synthesized
acctgagtggtcctggagctgc

SEQ ID NO: 735126 - DNA, 22 bp, Artificial Sequence
  chemically synthesized
caactggccgcagctccaggac

SEQ ID NO: 735127 - DNA, 22 bp, Artificial Sequence
  chemically synthesized
cttacctgagtggtcctggagc

SEQ ID NO: 735128 - DNA, 22 bp, Artificial Sequence
  chemically synthesized
aactggccgcagctccaggacc

SEQ ID NO: 735129 - DNA, 22 bp, Artificial Sequence
  chemically synthesized
gccgcagctccaggaccactca

SEQ ID NO: 735130 - DNA, 22 bp, Artificial Sequence
  chemically synthesized
gtatctgcttacctgagtggtc

SEQ ID NO: 735131 - DNA, 22 bp, Artificial Sequence
  chemically synthesized
caggaccactcaggtaagcaga

SEQ ID NO: 735132 - DNA, 22 bp, Artificial Sequence
  chemically synthesized
ccaaggcaagagctagtatctg

SEQ ID NO: 735133 - DNA, 22 bp, Artificial Sequence
  chemically synthesized
gccaaggcaagagctagtatct

SEQ ID NO: 735134 - DNA, 22 bp, Artificial Sequence
  chemically synthesized
aggtaagcagatactagctctt

SEQ ID NO: 735135 - DNA, 22 bp, Artificial Sequence
  chemically synthesized
ataatatatttgccaaggcaag

SEQ ID NO: 735136 - DNA, 22 bp, Artificial Sequence
  chemically synthesized
cataatatatttgccaaggcaa

SEQ ID NO: 735137 - DNA, 22 bp, Artificial Sequence
  chemically synthesized
agacttcataatatatttgcca

SEQ ID NO: 735138 - DNA, 22 bp, Artificial Sequence
  chemically synthesized
gctcttgccttggcaaatatat

SEQ ID NO: 735139 - DNA, 22 bp, Artificial Sequence
  chemically synthesized
ttgccttggcaaatatattatg

SEQ ID NO: 735140 - DNA, 22 bp, Artificial Sequence
  chemically synthesized
caagctaagacttcataatata

SEQ ID NO: 735141 - DNA, 22 bp, Artificial Sequence
  chemically synthesized
gccttggcaaatatattatgaa

SEQ ID NO: 735142 - DNA, 22 bp, Artificial Sequence
  chemically synthesized
ccttggcaaatatattatgaag

SEQ ID NO: 735143 - DNA, 22 bp, Artificial Sequence
  chemically synthesized
tccaagctaagacttcataata

SEQ ID NO: 735144 - DNA, 22 bp, Artificial Sequence
  chemically synthesized
ggcaaatatattatgaagtctt

SEQ ID NO: 735145 - DNA, 22 bp, Artificial Sequence
  chemically synthesized
gcaaatatattatgaagtctta

SEQ ID NO: 735146 - DNA, 22 bp, Artificial Sequence
  chemically synthesized
agtcaaaggctctccaagctaa

SEQ ID NO: 735147 - DNA, 22 bp, Artificial Sequence
  chemically synthesized
aagtcaaaggctctccaagcta

SEQ ID NO: 735148 - DNA, 22 bp, Artificial Sequence
  chemically synthesized
taagtcaaaggctctccaagct

SEQ ID NO: 735149 - DNA, 22 bp, Artificial Sequence
  chemically synthesized
tgaagtcttagcttggagagcc

SEQ ID NO: 735150 - DNA, 22 bp, Artificial Sequence
  chemically synthesized
actttaagtcaaaggctctcca

SEQ ID NO: 735151 - DNA, 22 bp, Artificial Sequence
  chemically synthesized
agcttggagagcctttgactta

SEQ ID NO: 735152 - DNA, 22 bp, Artificial Sequence
  chemically synthesized
gcttggagagcctttgacttaa

SEQ ID NO: 735153 - DNA, 22 bp, Artificial Sequence
  chemically synthesized
ggagagcctttgacttaaagtg

SEQ ID NO: 735154 - DNA, 22 bp, Artificial Sequence
  chemically synthesized
gagagcctttgacttaaagtga

SEQ ID NO: 735155 - DNA, 22 bp, Artificial Sequence
  chemically synthesized
gaaatgtaaacctcactttaag

SEQ ID NO: 735156 - DNA, 22 bp, Artificial Sequence
  chemically synthesized
agaaatgtaaacctcactttaa

SEQ ID NO: 735157 - DNA, 22 bp, Artificial Sequence
  chemically synthesized
tgacttaaagtgaggtttacat

SEQ ID NO: 735158 - DNA, 22 bp, Artificial Sequence
  chemically synthesized
gacttaaagtgaggtttacatt

SEQ ID NO: 735159 - DNA, 22 bp, Artificial Sequence
  chemically synthesized
acttaaagtgaggtttacattt

SEQ ID NO: 735160 - DNA, 22 bp, Artificial Sequence
  chemically synthesized
aaagtgaggtttacatttctaa

SEQ ID NO: 735161 - DNA, 22 bp, Artificial Sequence
  chemically synthesized
aagtgaggtttacatttctaag

SEQ ID NO: 735162 - DNA, 22 bp, Artificial Sequence
  chemically synthesized
agtcaagaaaccaacatcttag

SEQ ID NO: 735163 - DNA, 22 bp, Artificial Sequence
  chemically synthesized
acatttctaagatgttggtttc

SEQ ID NO: 735164 - DNA, 22 bp, Artificial Sequence
  chemically synthesized
catttctaagatgttggtttct

SEQ ID NO: 735165 - DNA, 22 bp, Artificial Sequence
  chemically synthesized
ctaagatgttggtttcttgact

SEQ ID NO: 735166 - DNA, 22 bp, Artificial Sequence
  chemically synthesized
taagatgttggtttcttgactt

SEQ ID NO: 735167 - DNA, 22 bp, Artificial Sequence
  chemically synthesized
aaatagacagttaagtcaagaa

SEQ ID NO: 735168 - DNA, 22 bp, Artificial Sequence
  chemically synthesized
agatgttggtttcttgacttaa

SEQ ID NO: 735169 - DNA, 22 bp, Artificial Sequence
  chemically synthesized
gtttcttgacttaactgtctat

SEQ ID NO: 735170 - DNA, 22 bp, Artificial Sequence
  chemically synthesized
cttgacttaactgtctatttga

SEQ ID NO: 735171 - DNA, 22 bp, Artificial Sequence
  chemically synthesized
ttgacttaactgtctatttgaa

SEQ ID NO: 735172 - DNA, 22 bp, Artificial Sequence
  chemically synthesized
gacttaactgtctatttgaatt

SEQ ID NO: 735173 - DNA, 22 bp, Artificial Sequence
  chemically synthesized
acttaactgtctatttgaattc

SEQ ID NO: 735174 - DNA, 22 bp, Artificial Sequence
  chemically synthesized
aatggaaaagatcaggaattca

SEQ ID NO: 735175 - DNA, 22 bp, Artificial Sequence
  chemically synthesized
aactgtctatttgaattcctga

SEQ ID NO: 735176 - DNA, 22 bp, Artificial Sequence
  chemically synthesized
actgtctatttgaattcctgat

SEQ ID NO: 735177 - DNA, 22 bp, Artificial Sequence
  chemically synthesized
tgaatggaaaagatcaggaatt

SEQ ID NO: 735178 - DNA, 22 bp, Artificial Sequence
  chemically synthesized
tctatttgaattcctgatcttt

SEQ ID NO: 735179 - DNA, 22 bp, Artificial Sequence
  chemically synthesized
tttgaattcctgatcttttcca

SEQ ID NO: 735180 - DNA, 22 bp, Artificial Sequence
  chemically synthesized
gaattcctgatcttttccattc

SEQ ID NO: 735181 - DNA, 22 bp, Artificial Sequence
  chemically synthesized
aattcctgatcttttccattca

SEQ ID NO: 735182 - DNA, 22 bp, Artificial Sequence
  chemically synthesized
gggtaaacaggctctgaatgga

SEQ ID NO: 735183 - DNA, 22 bp, Artificial Sequence
  chemically synthesized
ctgatcttttccattcagagcc

SEQ ID NO: 735184 - DNA, 22 bp, Artificial Sequence
  chemically synthesized
atcttttccattcagagcctgt

SEQ ID NO: 735185 - DNA, 22 bp, Artificial Sequence
  chemically synthesized
ttccattcagagcctgtttacc

SEQ ID NO: 735186 - DNA, 22 bp, Artificial Sequence
  chemically synthesized
tccattcagagcctgtttaccc

SEQ ID NO: 735187 - DNA, 22 bp, Artificial Sequence
  chemically synthesized
ccattcagagcctgtttacccg

SEQ ID NO: 735188 - DNA, 22 bp, Artificial Sequence
  chemically synthesized
aagtggggagttcgggtaaaca

SEQ ID NO: 735189 - DNA, 22 bp, Artificial Sequence
  chemically synthesized
cattcagagcctgtttacccga

SEQ ID NO: 735190 - DNA, 22 bp, Artificial Sequence
  chemically synthesized
agagcctgtttacccgaactcc

SEQ ID NO: 735191 - DNA, 22 bp, Artificial Sequence
  chemically synthesized
tagctgaagtggggagttcggg

SEQ ID NO: 735192 - DNA, 22 bp, Artificial Sequence
  chemically synthesized
agactgtagctgaagtggggag

SEQ ID NO: 735193 - DNA, 22 bp, Artificial Sequence
  chemically synthesized
tttacccgaactccccacttca

SEQ ID NO: 735194 - DNA, 22 bp, Artificial Sequence
  chemically synthesized
acccgaactccccacttcagct

SEQ ID NO: 735195 - DNA, 22 bp, Artificial Sequence
  chemically synthesized
cccgaactccccacttcagcta

SEQ ID NO: 735196 - DNA, 22 bp, Artificial Sequence
  chemically synthesized
ggaattcagactgtagctgaag

SEQ ID NO: 735197 - DNA, 22 bp, Artificial Sequence
  chemically synthesized
cccacttcagctacagtctgaa

SEQ ID NO: 735198 - DNA, 22 bp, Artificial Sequence
  chemically synthesized
cagctacagtctgaattcctaa

SEQ ID NO: 735199 - DNA, 22 bp, Artificial Sequence
  chemically synthesized
agctacagtctgaattcctaac

SEQ ID NO: 735200 - DNA, 22 bp, Artificial Sequence
  chemically synthesized
cagtctgaattcctaacctcgt

SEQ ID NO: 735201 - DNA, 22 bp, Artificial Sequence
  chemically synthesized
atcaagaatgtacacgaggtta

SEQ ID NO: 735202 - DNA, 22 bp, Artificial Sequence
  chemically synthesized
aattcctaacctcgtgtacatt

SEQ ID NO: 735203 - DNA, 22 bp, Artificial Sequence
  chemically synthesized
ctaacctcgtgtacattcttga

SEQ ID NO: 735204 - DNA, 22 bp, Artificial Sequence
  chemically synthesized
acctcgtgtacattcttgatca

SEQ ID NO: 735205 - DNA, 22 bp, Artificial Sequence
  chemically synthesized
gtgtacattcttgatcagtgtt

SEQ ID NO: 735206 - DNA, 22 bp, Artificial Sequence
  chemically synthesized
gtgaggccaccagataacactg

SEQ ID NO: 735207 - DNA, 22 bp, Artificial Sequence
  chemically synthesized
ttgatcagtgttatctggtggc

SEQ ID NO: 735208 - DNA, 22 bp, Artificial Sequence
  chemically synthesized
gatcagtgttatctggtggcct

SEQ ID NO: 735209 - DNA, 22 bp, Artificial Sequence
  chemically synthesized
gcagggttggtgaggccaccag

SEQ ID NO: 735210 - DNA, 22 bp, Artificial Sequence
  chemically synthesized
atcagtgttatctggtggcctc

SEQ ID NO: 735211 - DNA, 22 bp, Artificial Sequence
  chemically synthesized
tggcagggttggtgaggccacc

SEQ ID NO: 735212 - DNA, 22 bp, Artificial Sequence
  chemically synthesized
aaattctggcagggttggtgag

SEQ ID NO: 735213 - DNA, 22 bp, Artificial Sequence
  chemically synthesized
tgaaattctggcagggttggtg

SEQ ID NO: 735214 - DNA, 22 bp, Artificial Sequence
  chemically synthesized
tctggtggcctcaccaaccctg

SEQ ID NO: 735215 - DNA, 22 bp, Artificial Sequence
  chemically synthesized
gtggcctcaccaaccctgccag

SEQ ID NO: 735216 - DNA, 22 bp, Artificial Sequence
  chemically synthesized
agaggggctctgaaattctggc

SEQ ID NO: 735217 - DNA, 22 bp, Artificial Sequence
  chemically synthesized
gagaggggctctgaaattctgg

SEQ ID NO: 735218 - DNA, 22 bp, Artificial Sequence
  chemically synthesized
accaaccctgccagaatttcag

SEQ ID NO: 735219 - DNA, 22 bp, Artificial Sequence
  chemically synthesized
cttgagaggggctctgaaattc

SEQ ID NO: 735220 - DNA, 22 bp, Artificial Sequence
  chemically synthesized
taattacttgagaggggctctg

SEQ ID NO: 735221 - DNA, 22 bp, Artificial Sequence
  chemically synthesized
ccagaatttcagagcccctctc

SEQ ID NO: 735222 - DNA, 22 bp, Artificial Sequence
  chemically synthesized
cccctgtaattacttgagaggg

SEQ ID NO: 735223 - DNA, 22 bp, Artificial Sequence
  chemically synthesized
cagagcccctctcaagtaatta

SEQ ID NO: 735224 - DNA, 22 bp, Artificial Sequence
  chemically synthesized
agagcccctctcaagtaattac

SEQ ID NO: 735225 - DNA, 22 bp, Artificial Sequence
  chemically synthesized
aggaatgcatgattacccctgt

SEQ ID NO: 735226 - DNA, 22 bp, Artificial Sequence
  chemically synthesized
tcaagtaattacaggggtaatc

SEQ ID NO: 735227 - DNA, 22 bp, Artificial Sequence
  chemically synthesized
aagtaattacaggggtaatcat

SEQ ID NO: 735228 - DNA, 22 bp, Artificial Sequence
  chemically synthesized
agagttaaggaatgcatgatta

SEQ ID NO: 735229 - DNA, 22 bp, Artificial Sequence
  chemically synthesized
caggggtaatcatgcattcctt

SEQ ID NO: 735230 - DNA, 22 bp, Artificial Sequence
  chemically synthesized
agaatgcagcctaagagttaag

SEQ ID NO: 735231 - DNA, 22 bp, Artificial Sequence
  chemically synthesized
ccccctaagaatgcagcctaag

SEQ ID NO: 735232 - DNA, 22 bp, Artificial Sequence
  chemically synthesized
cttaactcttaggctgcattct

SEQ ID NO: 735233 - DNA, 22 bp, Artificial Sequence
  chemically synthesized
aactcttaggctgcattcttag

SEQ ID NO: 735234 - DNA, 22 bp, Artificial Sequence
  chemically synthesized
actcttaggctgcattcttagg

SEQ ID NO: 735235 - DNA, 22 bp, Artificial Sequence
  chemically synthesized
ttaggctgcattcttagggggc

SEQ ID NO: 735236 - DNA, 22 bp, Artificial Sequence
  chemically synthesized
aggctgcattcttagggggcag

SEQ ID NO: 735237 - DNA, 22 bp, Artificial Sequence
  chemically synthesized
gtaggtaggaatctgcccccta

SEQ ID NO: 735238 - DNA, 22 bp, Artificial Sequence
  chemically synthesized
ggctgcattcttagggggcaga

SEQ ID NO: 735239 - DNA, 22 bp, Artificial Sequence
  chemically synthesized
cattcttagggggcagattcct

SEQ ID NO: 735240 - DNA, 22 bp, Artificial Sequence
  chemically synthesized
aaggttagtaggtaggaatctg

SEQ ID NO: 735241 - DNA, 22 bp, Artificial Sequence
  chemically synthesized
ttagggggcagattcctaccta

SEQ ID NO: 735242 - DNA, 22 bp, Artificial Sequence
  chemically synthesized
agggggcagattcctacctact

SEQ ID NO: 735243 - DNA, 22 bp, Artificial Sequence
  chemically synthesized
gggggcagattcctacctacta

SEQ ID NO: 735244 - DNA, 22 bp, Artificial Sequence
  chemically synthesized
atgggcatcagcaggttcaagg

SEQ ID NO: 735245 - DNA, 22 bp, Artificial Sequence
  chemically synthesized
ctacctactaaccttgaacctg

SEQ ID NO: 735246 - DNA, 22 bp, Artificial Sequence
  chemically synthesized
cctactaaccttgaacctgctg

SEQ ID NO: 735247 - DNA, 22 bp, Artificial Sequence
  chemically synthesized
ctaaccttgaacctgctgatgc

SEQ ID NO: 735248 - DNA, 22 bp, Artificial Sequence
  chemically synthesized
accttgaacctgctgatgccca

SEQ ID NO: 735249 - DNA, 22 bp, Artificial Sequence
  chemically synthesized
atgccagcctcatgggcatcag

SEQ ID NO: 735250 - DNA, 22 bp, Artificial Sequence
  chemically synthesized
catgccagcctcatgggcatca

SEQ ID NO: 735251 - DNA, 22 bp, Artificial Sequence
  chemically synthesized
tcatgccagcctcatgggcatc

SEQ ID NO: 735252 - DNA, 22 bp, Artificial Sequence
  chemically synthesized
gaacctgctgatgcccatgagg

SEQ ID NO: 735253 - DNA, 22 bp, Artificial Sequence
  chemically synthesized
ctttcatgccagcctcatgggc

SEQ ID NO: 735254 - DNA, 22 bp, Artificial Sequence
  chemically synthesized
aacctgctgatgcccatgaggc

SEQ ID NO: 735255 - DNA, 22 bp, Artificial Sequence
  chemically synthesized
ctgctttcatgccagcctcatg

SEQ ID NO: 735256 - DNA, 22 bp, Artificial Sequence
  chemically synthesized
ttcctgctttcatgccagcctc

SEQ ID NO: 735257 - DNA, 22 bp, Artificial Sequence
  chemically synthesized
ctgatgcccatgaggctggcat

SEQ ID NO: 735258 - DNA, 22 bp, Artificial Sequence
  chemically synthesized
atgcccatgaggctggcatgaa

SEQ ID NO: 735259 - DNA, 22 bp, Artificial Sequence
  chemically synthesized
attgttcctgctttcatgccag

SEQ ID NO: 735260 - DNA, 22 bp, Artificial Sequence
  chemically synthesized
acagactaattgttcctgcttt

SEQ ID NO: 735261 - DNA, 22 bp, Artificial Sequence
  chemically synthesized
aacagactaattgttcctgctt

SEQ ID NO: 735262 - DNA, 22 bp, Artificial Sequence
  chemically synthesized
taacagactaattgttcctgct

SEQ ID NO: 735263 - DNA, 22 bp, Artificial Sequence
  chemically synthesized
ttaacagactaattgttcctgc

SEQ ID NO: 735264 - DNA, 22 bp, Artificial Sequence
  chemically synthesized
gcatgaaagcaggaacaattag

SEQ ID NO: 735265 - DNA, 22 bp, Artificial Sequence
  chemically synthesized
gtttttaacagactaattgttc

SEQ ID NO: 735266 - DNA, 22 bp, Artificial Sequence
  chemically synthesized
agtttttaacagactaattgtt

SEQ ID NO: 735267 - DNA, 22 bp, Artificial Sequence
  chemically synthesized
aggaatatatgtttagttttta

SEQ ID NO: 735268 - DNA, 22 bp, Artificial Sequence
  chemically synthesized
caggaatatatgtttagttttt

SEQ ID NO: 735269 - DNA, 22 bp, Artificial Sequence
  chemically synthesized
gtctgttaaaaactaaacatat

SEQ ID NO: 735270 - DNA, 22 bp, Artificial Sequence
  chemically synthesized
agacttcaggaatatatgttta

SEQ ID NO: 735271 - DNA, 22 bp, Artificial Sequence
  chemically synthesized
cagacttcaggaatatatgttt

SEQ ID NO: 735272 - DNA, 22 bp, Artificial Sequence
  chemically synthesized
tcagacttcaggaatatatgtt

SEQ ID NO: 735273 - DNA, 22 bp, Artificial Sequence
  chemically synthesized
ttcagacttcaggaatatatgt

SEQ ID NO: 735274 - DNA, 22 bp, Artificial Sequence
  chemically synthesized
ttaaaaactaaacatatattcc

SEQ ID NO: 735275 - DNA, 22 bp, Artificial Sequence
  chemically synthesized
tttcagacttcaggaatatatg

SEQ ID NO: 735276 - DNA, 22 bp, Artificial Sequence
  chemically synthesized
ttttcagacttcaggaatatat

SEQ ID NO: 735277 - DNA, 22 bp, Artificial Sequence
  chemically synthesized
aaaactaaacatatattcctga

SEQ ID NO: 735278 - DNA, 22 bp, Artificial Sequence
  chemically synthesized
aacatatattcctgaagtctga

SEQ ID NO: 735279 - DNA, 22 bp, Artificial Sequence
  chemically synthesized
gatgagtagaaccttttttcag

SEQ ID NO: 735280 - DNA, 22 bp, Artificial Sequence
  chemically synthesized
ggatgagtagaaccttttttca

SEQ ID NO: 735281 - DNA, 22 bp, Artificial Sequence
  chemically synthesized
tttggatgagtagaaccttttt

SEQ ID NO: 735282 - DNA, 22 bp, Artificial Sequence
  chemically synthesized
ctgaagtctgaaaaaaggttct

SEQ ID NO: 735283 - DNA, 22 bp, Artificial Sequence
  chemically synthesized
tatttggatgagtagaaccttt

SEQ ID NO: 735284 - DNA, 22 bp, Artificial Sequence
  chemically synthesized
ctatttggatgagtagaacctt

SEQ ID NO: 735285 - DNA, 22 bp, Artificial Sequence
  chemically synthesized
aagtctgaaaaaaggttctact

SEQ ID NO: 735286 - DNA, 22 bp, Artificial Sequence
  chemically synthesized
tttctatttggatgagtagaac

SEQ ID NO: 735287 - DNA, 22 bp, Artificial Sequence
  chemically synthesized
aaaaaaggttctactcatccaa

SEQ ID NO: 735288 - DNA, 22 bp, Artificial Sequence
  chemically synthesized
aattatttctatttggatgagt

SEQ ID NO: 735289 - DNA, 22 bp, Artificial Sequence
  chemically synthesized
tcaattatttctatttggatga

SEQ ID NO: 735290 - DNA, 22 bp, Artificial Sequence
  chemically synthesized
gagttctcaattatttctattt

SEQ ID NO: 735291 - DNA, 22 bp, Artificial Sequence
  chemically synthesized
agagttctcaattatttctatt

SEQ ID NO: 735292 - DNA, 22 bp, Artificial Sequence
  chemically synthesized
tagagttctcaattatttctat

SEQ ID NO: 735293 - DNA, 22 bp, Artificial Sequence
  chemically synthesized
tactcatccaaatagaaataat

SEQ ID NO: 735294 - DNA, 22 bp, Artificial Sequence
  chemically synthesized
ctcatccaaatagaaataattg

SEQ ID NO: 735295 - DNA, 22 bp, Artificial Sequence
  chemically synthesized
atccaaatagaaataattgaga

SEQ ID NO: 735296 - DNA, 22 bp, Artificial Sequence
  chemically synthesized
aatattttagagttctcaatta

SEQ ID NO: 735297 - DNA, 22 bp, Artificial Sequence
  chemically synthesized
aagttaaatattttagagttct

SEQ ID NO: 735298 - DNA, 22 bp, Artificial Sequence
  chemically synthesized
aaagttaaatattttagagttc

SEQ ID NO: 735299 - DNA, 22 bp, Artificial Sequence
  chemically synthesized
cagaccatttaaagttaaatat

SEQ ID NO: 735300 - DNA, 22 bp, Artificial Sequence
  chemically synthesized
agaactctaaaatatttaactt

SEQ ID NO: 735301 - DNA, 22 bp, Artificial Sequence
  chemically synthesized
atgattccagaccatttaaagt

SEQ ID NO: 735302 - DNA, 22 bp, Artificial Sequence
  chemically synthesized
taaaatatttaactttaaatgg

SEQ ID NO: 735303 - DNA, 22 bp, Artificial Sequence
  chemically synthesized
aaatatttaactttaaatggtc

SEQ ID NO: 735304 - DNA, 22 bp, Artificial Sequence
  chemically synthesized
aactttaaatggtctggaatca

SEQ ID NO: 735305 - DNA, 22 bp, Artificial Sequence
  chemically synthesized
aaagaacattgatgattccaga

SEQ ID NO: 735306 - DNA, 22 bp, Artificial Sequence
  chemically synthesized
actttaaatggtctggaatcat

SEQ ID NO: 735307 - DNA, 22 bp, Artificial Sequence
  chemically synthesized
taaatggtctggaatcatcaat

SEQ ID NO: 735308 - DNA, 22 bp, Artificial Sequence
  chemically synthesized
aaatggtctggaatcatcaatg

SEQ ID NO: 735309 - DNA, 22 bp, Artificial Sequence
  chemically synthesized
aacctgaaagaacattgatgat

SEQ ID NO: 735310 - DNA, 22 bp, Artificial Sequence
  chemically synthesized
aatggtctggaatcatcaatgt

SEQ ID NO: 735311 - DNA, 22 bp, Artificial Sequence
  chemically synthesized
attcaacctgaaagaacattga

SEQ ID NO: 735312 - DNA, 22 bp, Artificial Sequence
  chemically synthesized
gaatcatcaatgttctttcagg

SEQ ID NO: 735313 - DNA, 22 bp, Artificial Sequence
  chemically synthesized
atgtaaaatattcattcaacct

SEQ ID NO: 735314 - DNA, 22 bp, Artificial Sequence
  chemically synthesized
aatgtaaaatattcattcaacc

SEQ ID NO: 735315 - DNA, 22 bp, Artificial Sequence
  chemically synthesized
taatgtaaaatattcattcaac

SEQ ID NO: 735316 - DNA, 22 bp, Artificial Sequence
  chemically synthesized
ttaatgtaaaatattcattcaa

SEQ ID NO: 735317 - DNA, 22 bp, Artificial Sequence
  chemically synthesized
tttcaggttgaatgaatatttt

SEQ ID NO: 735318 - DNA, 22 bp, Artificial Sequence
  chemically synthesized
tcaggttgaatgaatattttac

SEQ ID NO: 735319 - DNA, 22 bp, Artificial Sequence
  chemically synthesized
caggttgaatgaatattttaca

SEQ ID NO: 735320 - DNA, 22 bp, Artificial Sequence
  chemically synthesized
aggttgaatgaatattttacat

SEQ ID NO: 735321 - DNA, 22 bp, Artificial Sequence
  chemically synthesized
aatgaatattttacattaaaaa

SEQ ID NO: 735322 - DNA, 22 bp, Artificial Sequence
  chemically synthesized
tacattaaaaactttctgtccc

SEQ ID NO: 735323 - DNA, 22 bp, Artificial Sequence
  chemically synthesized
acattaaaaactttctgtccct

SEQ ID NO: 735324 - DNA, 22 bp, Artificial Sequence
  chemically synthesized
gccaagtaaacaagggacagaa

SEQ ID NO: 735325 - DNA, 22 bp, Artificial Sequence
  chemically synthesized
cattaaaaactttctgtccctt

SEQ ID NO: 735326 - DNA, 22 bp, Artificial Sequence
  chemically synthesized
ggccaagtaaacaagggacaga

SEQ ID NO: 735327 - DNA, 22 bp, Artificial Sequence
  chemically synthesized
tttggccaagtaaacaagggac

SEQ ID NO: 735328 - DNA, 22 bp, Artificial Sequence
  chemically synthesized
atttggccaagtaaacaaggga

SEQ ID NO: 735329 - DNA, 22 bp, Artificial Sequence
  chemically synthesized
aaaactttctgtcccttgttta

SEQ ID NO: 735330 - DNA, 22 bp, Artificial Sequence
  chemically synthesized
ccttatttggccaagtaaacaa

SEQ ID NO: 735331 - DNA, 22 bp, Artificial Sequence
  chemically synthesized
accttatttggccaagtaaaca

SEQ ID NO: 735332 - DNA, 22 bp, Artificial Sequence
  chemically synthesized
taccttatttggccaagtaaac

SEQ ID NO: 735333 - DNA, 22 bp, Artificial Sequence
  chemically synthesized
ttaccttatttggccaagtaaa

SEQ ID NO: 735334 - DNA, 22 bp, Artificial Sequence
  chemically synthesized
tctgtcccttgtttacttggcc

SEQ ID NO: 735335 - DNA, 22 bp, Artificial Sequence
  chemically synthesized
tttaccttatttggccaagtaa

SEQ ID NO: 735336 - DNA, 22 bp, Artificial Sequence
  chemically synthesized
ctgtcccttgtttacttggcca

SEQ ID NO: 735337 - DNA, 22 bp, Artificial Sequence
  chemically synthesized
tgtcccttgtttacttggccaa

SEQ ID NO: 735338 - DNA, 22 bp, Artificial Sequence
  chemically synthesized
tcccttgtttacttggccaaat

SEQ ID NO: 735339 - DNA, 22 bp, Artificial Sequence
  chemically synthesized
acctttttaccttatttggcca

SEQ ID NO: 735340 - DNA, 22 bp, Artificial Sequence
  chemically synthesized
gacctttttaccttatttggcc

SEQ ID NO: 735341 - DNA, 22 bp, Artificial Sequence
  chemically synthesized
tgacctttttaccttatttggc

SEQ ID NO: 735342 - DNA, 22 bp, Artificial Sequence
  chemically synthesized
gtttacttggccaaataaggta

SEQ ID NO: 735343 - DNA, 22 bp, Artificial Sequence
  chemically synthesized
ttttgacctttttaccttattt

SEQ ID NO: 735344 - DNA, 22 bp, Artificial Sequence
  chemically synthesized
tttacttggccaaataaggtaa

SEQ ID NO: 735345 - DNA, 22 bp, Artificial Sequence
  chemically synthesized
acttggccaaataaggtaaaaa

SEQ ID NO: 735346 - DNA, 22 bp, Artificial Sequence
  chemically synthesized
cttggccaaataaggtaaaaag

SEQ ID NO: 735347 - DNA, 22 bp, Artificial Sequence
  chemically synthesized
agattgttttgacctttttacc

SEQ ID NO: 735348 - DNA, 22 bp, Artificial Sequence
  chemically synthesized
ggccaaataaggtaaaaaggtc

SEQ ID NO: 735349 - DNA, 22 bp, Artificial Sequence
  chemically synthesized
gccaaataaggtaaaaaggtca

SEQ ID NO: 735350 - DNA, 22 bp, Artificial Sequence
  chemically synthesized
actaagattgttttgacctttt

SEQ ID NO: 735351 - DNA, 22 bp, Artificial Sequence
  chemically synthesized
cactaagattgttttgaccttt

SEQ ID NO: 735352 - DNA, 22 bp, Artificial Sequence
  chemically synthesized
ataaggaaacaatttcactaag

SEQ ID NO: 735353 - DNA, 22 bp, Artificial Sequence
  chemically synthesized
tcattcataaggaaacaatttc

SEQ ID NO: 735354 - DNA, 22 bp, Artificial Sequence
  chemically synthesized
gtcattcataaggaaacaattt

SEQ ID NO: 735355 - DNA, 22 bp, Artificial Sequence
  chemically synthesized
catttgtcattcataaggaaac

SEQ ID NO: 735356 - DNA, 22 bp, Artificial Sequence
  chemically synthesized
acatttgtcattcataaggaaa

SEQ ID NO: 735357 - DNA, 22 bp, Artificial Sequence
  chemically synthesized
tacatttgtcattcataaggaa

SEQ ID NO: 735358 - DNA, 22 bp, Artificial Sequence
  chemically synthesized
agtgaaattgtttccttatgaa

SEQ ID NO: 735359 - DNA, 22 bp, Artificial Sequence
  chemically synthesized
gtgaaattgtttccttatgaat

SEQ ID NO: 735360 - DNA, 22 bp, Artificial Sequence
  chemically synthesized
tttacatttgtcattcataagg

SEQ ID NO: 735361 - DNA, 22 bp, Artificial Sequence
  chemically synthesized
actctttacatttgtcattcat

SEQ ID NO: 735362 - DNA, 22 bp, Artificial Sequence
  chemically synthesized
gactctttacatttgtcattca

SEQ ID NO: 735363 - DNA, 22 bp, Artificial Sequence
  chemically synthesized
tgactctttacatttgtcattc

SEQ ID NO: 735364 - DNA, 22 bp, Artificial Sequence
  chemically synthesized
ttgactctttacatttgtcatt

SEQ ID NO: 735365 - DNA, 22 bp, Artificial Sequence
  chemically synthesized
tttccttatgaatgacaaatgt

SEQ ID NO: 735366 - DNA, 22 bp, Artificial Sequence
  chemically synthesized
ttttgactctttacatttgtca

SEQ ID NO: 735367 - DNA, 22 bp, Artificial Sequence
  chemically synthesized
ccttatgaatgacaaatgtaaa

SEQ ID NO: 735368 - DNA, 22 bp, Artificial Sequence
  chemically synthesized
ctcttttgactctttacatttg

SEQ ID NO: 735369 - DNA, 22 bp, Artificial Sequence
  chemically synthesized
cttatgaatgacaaatgtaaag

SEQ ID NO: 735370 - DNA, 22 bp, Artificial Sequence
  chemically synthesized
atgaatgacaaatgtaaagagt

SEQ ID NO: 735371 - DNA, 22 bp, Artificial Sequence
  chemically synthesized
attcctcttttgactctttaca

SEQ ID NO: 735372 - DNA, 22 bp, Artificial Sequence
  chemically synthesized
tgaatgacaaatgtaaagagtc

SEQ ID NO: 735373 - DNA, 22 bp, Artificial Sequence
  chemically synthesized
aattcctcttttgactctttac

SEQ ID NO: 735374 - DNA, 22 bp, Artificial Sequence
  chemically synthesized
ccttaattcctcttttgactct

SEQ ID NO: 735375 - DNA, 22 bp, Artificial Sequence
  chemically synthesized
accttaattcctcttttgactc

SEQ ID NO: 735376 - DNA, 22 bp, Artificial Sequence
  chemically synthesized
tttaccttaattcctcttttga

SEQ ID NO: 735377 - DNA, 22 bp, Artificial Sequence
  chemically synthesized
aattatttaccttaattcctct

SEQ ID NO: 735378 - DNA, 22 bp, Artificial Sequence
  chemically synthesized
ggggagatgaaatataattaaa

SEQ ID NO: 735379 - DNA, 22 bp, Artificial Sequence
  chemically synthesized
aggtaaataatttaattatatt

SEQ ID NO: 735380 - DNA, 22 bp, Artificial Sequence
  chemically synthesized
aattatatttcatctcccctaa

SEQ ID NO: 735381 - DNA, 22 bp, Artificial Sequence
  chemically synthesized
attatatttcatctcccctaat

SEQ ID NO: 735382 - DNA, 22 bp, Artificial Sequence
  chemically synthesized
tatttcatctcccctaattaca

SEQ ID NO: 735383 - DNA, 22 bp, Artificial Sequence
  chemically synthesized
agcaaatgaaaaacatgtaatt

SEQ ID NO: 735384 - DNA, 22 bp, Artificial Sequence
  chemically synthesized
catctcccctaattacatgttt

SEQ ID NO: 735385 - DNA, 22 bp, Artificial Sequence
  chemically synthesized
atctcccctaattacatgtttt

SEQ ID NO: 735386 - DNA, 22 bp, Artificial Sequence
  chemically synthesized
ccctaattacatgtttttcatt

SEQ ID NO: 735387 - DNA, 22 bp, Artificial Sequence
  chemically synthesized
attacatgtttttcatttgctt

SEQ ID NO: 735388 - DNA, 22 bp, Artificial Sequence
  chemically synthesized
catgtttttcatttgcttagat

SEQ ID NO: 735389 - DNA, 22 bp, Artificial Sequence
  chemically synthesized
ttcatttgcttagatattactt

SEQ ID NO: 735390 - DNA, 22 bp, Artificial Sequence
  chemically synthesized
tcatttgcttagatattactta

SEQ ID NO: 735391 - DNA, 22 bp, Artificial Sequence
  chemically synthesized
catttgcttagatattacttat

SEQ ID NO: 735392 - DNA, 22 bp, Artificial Sequence
  chemically synthesized
atttgcttagatattacttatt

SEQ ID NO: 735393 - DNA, 22 bp, Artificial Sequence
  chemically synthesized
gcttagatattacttatttcac

SEQ ID NO: 735394 - DNA, 22 bp, Artificial Sequence
  chemically synthesized
cttagatattacttatttcacc

SEQ ID NO: 735395 - DNA, 22 bp, Artificial Sequence
  chemically synthesized
agatattacttatttcacctct

SEQ ID NO: 735396 - DNA, 22 bp, Artificial Sequence
  chemically synthesized
gatattacttatttcacctctg

SEQ ID NO: 735397 - DNA, 22 bp, Artificial Sequence
  chemically synthesized
cttatttcacctctgctgcctt

SEQ ID NO: 735398 - DNA, 22 bp, Artificial Sequence
  chemically synthesized
atttcacctctgctgccttccc

SEQ ID NO: 735399 - DNA, 22 bp, Artificial Sequence
  chemically synthesized
tttcacctctgctgccttcccc

SEQ ID NO: 735400 - DNA, 22 bp, Artificial Sequence
  chemically synthesized
tcgggtatatggtggggaaggc

SEQ ID NO: 735401 - DNA, 22 bp, Artificial Sequence
  chemically synthesized
cacctctgctgccttccccacc

SEQ ID NO: 735402 - DNA, 22 bp, Artificial Sequence
  chemically synthesized
acctctgctgccttccccacca

SEQ ID NO: 735403 - DNA, 22 bp, Artificial Sequence
  chemically synthesized
agttatcgggtatatggtgggg

SEQ ID NO: 735404 - DNA, 22 bp, Artificial Sequence
  chemically synthesized
tgctgccttccccaccatatac

SEQ ID NO: 735405 - DNA, 22 bp, Artificial Sequence
  chemically synthesized
ctgccttccccaccatataccc

SEQ ID NO: 735406 - DNA, 22 bp, Artificial Sequence
  chemically synthesized
ccttccccaccatatacccgat

SEQ ID NO: 735407 - DNA, 22 bp, Artificial Sequence
  chemically synthesized
gaatgactgagttatcgggtat

SEQ ID NO: 735408 - DNA, 22 bp, Artificial Sequence
  chemically synthesized
ccccaccatatacccgataact

SEQ ID NO: 735409 - DNA, 22 bp, Artificial Sequence
  chemically synthesized
cccaccatatacccgataactc

SEQ ID NO: 735410 - DNA, 22 bp, Artificial Sequence
  chemically synthesized
taagtctggaatgactgagtta

SEQ ID NO: 735411 - DNA, 22 bp, Artificial Sequence
  chemically synthesized
ataagtctggaatgactgagtt

SEQ ID NO: 735412 - DNA, 22 bp, Artificial Sequence
  chemically synthesized
aggtagtttataagtctggaat

SEQ ID NO: 735413 - DNA, 22 bp, Artificial Sequence
  chemically synthesized
agtcattccagacttataaact

SEQ ID NO: 735414 - DNA, 22 bp, Artificial Sequence
  chemically synthesized
atataacctgaggtagtttata

SEQ ID NO: 735415 - DNA, 22 bp, Artificial Sequence
  chemically synthesized
cagacttataaactacctcagg

SEQ ID NO: 735416 - DNA, 22 bp, Artificial Sequence
  chemically synthesized
ggaagatctgatataacctgag

SEQ ID NO: 735417 - DNA, 22 bp, Artificial Sequence
  chemically synthesized
ataaactacctcaggttatatc

SEQ ID NO: 735418 - DNA, 22 bp, Artificial Sequence
  chemically synthesized
taaactacctcaggttatatca

SEQ ID NO: 735419 - DNA, 22 bp, Artificial Sequence
  chemically synthesized
cctcaggttatatcagatcttc

SEQ ID NO: 735420 - DNA, 22 bp, Artificial Sequence
  chemically synthesized
aggttatatcagatcttcccag

SEQ ID NO: 735421 - DNA, 22 bp, Artificial Sequence
  chemically synthesized
ggaagaaaaccaggtctgggaa

SEQ ID NO: 735422 - DNA, 22 bp, Artificial Sequence
  chemically synthesized
taggaagaaaaccaggtctggg

SEQ ID NO: 735423 - DNA, 22 bp, Artificial Sequence
  chemically synthesized
tatcagatcttcccagacctgg

SEQ ID NO: 735424 - DNA, 22 bp, Artificial Sequence
  chemically synthesized
ctaggaagaaaaccaggtctgg

SEQ ID NO: 735425 - DNA, 22 bp, Artificial Sequence
  chemically synthesized
tctaggaagaaaaccaggtctg

SEQ ID NO: 735426 - DNA, 22 bp, Artificial Sequence
  chemically synthesized
cccagacctggttttcttccta

SEQ ID NO: 735427 - DNA, 22 bp, Artificial Sequence
  chemically synthesized
ccagacctggttttcttcctag

SEQ ID NO: 735428 - DNA, 22 bp, Artificial Sequence
  chemically synthesized
gttttcttcctagaaaaccatt

SEQ ID NO: 735429 - DNA, 22 bp, Artificial Sequence
  chemically synthesized
tcttcctagaaaaccattccat

SEQ ID NO: 735430 - DNA, 22 bp, Artificial Sequence
  chemically synthesized
cttcctagaaaaccattccatt

SEQ ID NO: 735431 - DNA, 22 bp, Artificial Sequence
  chemically synthesized
ttcctagaaaaccattccattt

SEQ ID NO: 735432 - DNA, 22 bp, Artificial Sequence
  chemically synthesized
cctagaaaaccattccattttt

SEQ ID NO: 735433 - DNA, 22 bp, Artificial Sequence
  chemically synthesized
ctagaaaaccattccatttttt

SEQ ID NO: 735434 - DNA, 22 bp, Artificial Sequence
  chemically synthesized
caagaggtaaagaaaaaaatgg

SEQ ID NO: 735435 - DNA, 22 bp, Artificial Sequence
  chemically synthesized
gaaaaccattccatttttttct

SEQ ID NO: 735436 - DNA, 22 bp, Artificial Sequence
  chemically synthesized
catttttttctttacctcttgg

SEQ ID NO: 735437 - DNA, 22 bp, Artificial Sequence
  chemically synthesized
ttttctttacctcttggaaccc

SEQ ID NO: 735438 - DNA, 22 bp, Artificial Sequence
  chemically synthesized
gagcaatgagtagggttccaag

SEQ ID NO: 735439 - DNA, 22 bp, Artificial Sequence
  chemically synthesized
tttctttacctcttggaaccct

SEQ ID NO: 735440 - DNA, 22 bp, Artificial Sequence
  chemically synthesized
ttctttacctcttggaacccta

SEQ ID NO: 735441 - DNA, 22 bp, Artificial Sequence
  chemically synthesized
tctttacctcttggaaccctac

SEQ ID NO: 735442 - DNA, 22 bp, Artificial Sequence
  chemically synthesized
ctttacctcttggaaccctact

SEQ ID NO: 735443 - DNA, 22 bp, Artificial Sequence
  chemically synthesized
tttacctcttggaaccctactc

SEQ ID NO: 735444 - DNA, 22 bp, Artificial Sequence
  chemically synthesized
gactcgagcaatgagtagggtt

SEQ ID NO: 735445 - DNA, 22 bp, Artificial Sequence
  chemically synthesized
agactcgagcaatgagtagggt

SEQ ID NO: 735446 - DNA, 22 bp, Artificial Sequence
  chemically synthesized
tacctcttggaaccctactcat

SEQ ID NO: 735447 - DNA, 22 bp, Artificial Sequence
  chemically synthesized
acctcttggaaccctactcatt

SEQ ID NO: 735448 - DNA, 22 bp, Artificial Sequence
  chemically synthesized
cctcttggaaccctactcattg

SEQ ID NO: 735449 - DNA, 22 bp, Artificial Sequence
  chemically synthesized
agcttagactcgagcaatgagt

SEQ ID NO: 735450 - DNA, 22 bp, Artificial Sequence
  chemically synthesized
gagcttagactcgagcaatgag

SEQ ID NO: 735451 - DNA, 22 bp, Artificial Sequence
  chemically synthesized
ttggaaccctactcattgctcg

SEQ ID NO: 735452 - DNA, 22 bp, Artificial Sequence
  chemically synthesized
ggaaccctactcattgctcgag

SEQ ID NO: 735453 - DNA, 22 bp, Artificial Sequence
  chemically synthesized
gaaccctactcattgctcgagt

SEQ ID NO: 735454 - DNA, 22 bp, Artificial Sequence
  chemically synthesized
ctcattgctcgagtctaagctc

SEQ ID NO: 735455 - DNA, 22 bp, Artificial Sequence
  chemically synthesized
attgctcgagtctaagctcaaa

SEQ ID NO: 735456 - DNA, 22 bp, Artificial Sequence
  chemically synthesized
cacaaggggtgacatttgagct

SEQ ID NO: 735457 - DNA, 22 bp, Artificial Sequence
  chemically synthesized
gcacaaggggtgacatttgagc

SEQ ID NO: 735458 - DNA, 22 bp, Artificial Sequence
  chemically synthesized
ctcgagtctaagctcaaatgtc

SEQ ID NO: 735459 - DNA, 22 bp, Artificial Sequence
  chemically synthesized
tgcacaaggggtgacatttgag

SEQ ID NO: 735460 - DNA, 22 bp, Artificial Sequence
  chemically synthesized
gagtctaagctcaaatgtcacc

SEQ ID NO: 735461 - DNA, 22 bp, Artificial Sequence
  chemically synthesized
agctcaaatgtcaccccttgtg

SEQ ID NO: 735462 - DNA, 22 bp, Artificial Sequence
  chemically synthesized
gcaataaattttgcacaagggg

SEQ ID NO: 735463 - DNA, 22 bp, Artificial Sequence
  chemically synthesized
aaatgtcaccccttgtgcaaaa

SEQ ID NO: 735464 - DNA, 22 bp, Artificial Sequence
  chemically synthesized
atgtgcagaagagttagcaata

SEQ ID NO: 735465 - DNA, 22 bp, Artificial Sequence
  chemically synthesized
gtgcaaaatttattgctaactc

SEQ ID NO: 735466 - DNA, 22 bp, Artificial Sequence
  chemically synthesized
tgcaaaatttattgctaactct

SEQ ID NO: 735467 - DNA, 22 bp, Artificial Sequence
  chemically synthesized
attgctaactcttctgcacatt

SEQ ID NO: 735468 - DNA, 22 bp, Artificial Sequence
  chemically synthesized
ttgctaactcttctgcacatta

SEQ ID NO: 735469 - DNA, 22 bp, Artificial Sequence
  chemically synthesized
ctaactcttctgcacattaata

SEQ ID NO: 735470 - DNA, 22 bp, Artificial Sequence
  chemically synthesized
actcttctgcacattaatatca

SEQ ID NO: 735471 - DNA, 22 bp, Artificial Sequence
  chemically synthesized
ttctgcacattaatatcatttc

SEQ ID NO: 735472 - DNA, 22 bp, Artificial Sequence
  chemically synthesized
ctgcacattaatatcatttctg

SEQ ID NO: 735473 - DNA, 22 bp, Artificial Sequence
  chemically synthesized
tgcacattaatatcatttctgg

SEQ ID NO: 735474 - DNA, 22 bp, Artificial Sequence
  chemically synthesized
cacattaatatcatttctgggg

SEQ ID NO: 735475 - DNA, 22 bp, Artificial Sequence
  chemically synthesized
gagatgtgagccccccagaaat

SEQ ID NO: 735476 - DNA, 22 bp, Artificial Sequence
  chemically synthesized
cactagagatgtgagcccccca

SEQ ID NO: 735477 - DNA, 22 bp, Artificial Sequence
  chemically synthesized
atatcatttctggggggctcac

SEQ ID NO: 735478 - DNA, 22 bp, Artificial Sequence
  chemically synthesized
caagggctccactagagatgtg

SEQ ID NO: 735479 - DNA, 22 bp, Artificial Sequence
  chemically synthesized
ctggggggctcacatctctagt

SEQ ID NO: 735480 - DNA, 22 bp, Artificial Sequence
  chemically synthesized
tggggggctcacatctctagtg

SEQ ID NO: 735481 - DNA, 22 bp, Artificial Sequence
  chemically synthesized
gggggctcacatctctagtgga

SEQ ID NO: 735482 - DNA, 22 bp, Artificial Sequence
  chemically synthesized
catacagtattacaagggctcc

SEQ ID NO: 735483 - DNA, 22 bp, Artificial Sequence
  chemically synthesized
acatctctagtggagcccttgt

SEQ ID NO: 735484 - DNA, 22 bp, Artificial Sequence
  chemically synthesized
tagtggagcccttgtaatactg

SEQ ID NO: 735485 - DNA, 22 bp, Artificial Sequence
  chemically synthesized
gtggagcccttgtaatactgta

SEQ ID NO: 735486 - DNA, 22 bp, Artificial Sequence
  chemically synthesized
atacatgaactacatacagtat

SEQ ID NO: 735487 - DNA, 22 bp, Artificial Sequence
  chemically synthesized
gtaatactgtatgtagttcatg

SEQ ID NO: 735488 - DNA, 22 bp, Artificial Sequence
  chemically synthesized
taatactgtatgtagttcatgt

SEQ ID NO: 735489 - DNA, 22 bp, Artificial Sequence
  chemically synthesized
aaagatgattaatacatgaact

SEQ ID NO: 735490 - DNA, 22 bp, Artificial Sequence
  chemically synthesized
caaagatgattaatacatgaac

SEQ ID NO: 735491 - DNA, 22 bp, Artificial Sequence
  chemically synthesized
ccttcaaagatgattaatacat

SEQ ID NO: 735492 - DNA, 22 bp, Artificial Sequence
  chemically synthesized
tatgtagttcatgtattaatca

SEQ ID NO: 735493 - DNA, 22 bp, Artificial Sequence
  chemically synthesized
atgtattaatcatctttgaagg

SEQ ID NO: 735494 - DNA, 22 bp, Artificial Sequence
  chemically synthesized
atcatctttgaagggagcctgt

SEQ ID NO: 735495 - DNA, 22 bp, Artificial Sequence
  chemically synthesized
tgaagggagcctgtgtcatgta

SEQ ID NO: 735496 - DNA, 22 bp, Artificial Sequence
  chemically synthesized
gaagggagcctgtgtcatgtac

SEQ ID NO: 735497 - DNA, 22 bp, Artificial Sequence
  chemically synthesized
aagggagcctgtgtcatgtaca

SEQ ID NO: 735498 - DNA, 22 bp, Artificial Sequence
  chemically synthesized
cccaataggagggacaaagatg

SEQ ID NO: 735499 - DNA, 22 bp, Artificial Sequence
  chemically synthesized
tacccaataggagggacaaaga

SEQ ID NO: 735500 - DNA, 22 bp, Artificial Sequence
  chemically synthesized
tgtcatgtacatctttgtccct

SEQ ID NO: 735501 - DNA, 22 bp, Artificial Sequence
  chemically synthesized
gagaccctctacccaataggag

SEQ ID NO: 735502 - DNA, 22 bp, Artificial Sequence
  chemically synthesized
gtctcgagaccctctacccaat

SEQ ID NO: 735503 - DNA, 22 bp, Artificial Sequence
  chemically synthesized
tgtccctcctattgggtagagg

SEQ ID NO: 735504 - DNA, 22 bp, Artificial Sequence
  chemically synthesized
gtccctcctattgggtagaggg

SEQ ID NO: 735505 - DNA, 22 bp, Artificial Sequence
  chemically synthesized
tccctcctattgggtagagggt

SEQ ID NO: 735506 - DNA, 22 bp, Artificial Sequence
  chemically synthesized
cattagtctcgagaccctctac

SEQ ID NO: 735507 - DNA, 22 bp, Artificial Sequence
  chemically synthesized
ctattgggtagagggtctcgag

SEQ ID NO: 735508 - DNA, 22 bp, Artificial Sequence
  chemically synthesized
ttgggtagagggtctcgagact

SEQ ID NO: 735509 - DNA, 22 bp, Artificial Sequence
  chemically synthesized
tcagtgactacattagtctcga

SEQ ID NO: 735510 - DNA, 22 bp, Artificial Sequence
  chemically synthesized
ggtagagggtctcgagactaat

SEQ ID NO: 735511 - DNA, 22 bp, Artificial Sequence
  chemically synthesized
atcagtgactacattagtctcg

SEQ ID NO: 735512 - DNA, 22 bp, Artificial Sequence
  chemically synthesized
tatcagtgactacattagtctc

SEQ ID NO: 735513 - DNA, 22 bp, Artificial Sequence
  chemically synthesized
agtattttatcagtgactacat

SEQ ID NO: 735514 - DNA, 22 bp, Artificial Sequence
  chemically synthesized
gagactaatgtagtcactgata

SEQ ID NO: 735515 - DNA, 22 bp, Artificial Sequence
  chemically synthesized
agttcagtattttatcagtgac

SEQ ID NO: 735516 - DNA, 22 bp, Artificial Sequence
  chemically synthesized
atgtagtcactgataaaatact

SEQ ID NO: 735517 - DNA, 22 bp, Artificial Sequence
  chemically synthesized
catgaagttcagttcagtattt

SEQ ID NO: 735518 - DNA, 22 bp, Artificial Sequence
  chemically synthesized
gcatgaagttcagttcagtatt

SEQ ID NO: 735519 - DNA, 22 bp, Artificial Sequence
  chemically synthesized
tgcatgaagttcagttcagtat

SEQ ID NO: 735520 - DNA, 22 bp, Artificial Sequence
  chemically synthesized
ttgcatgaagttcagttcagta

SEQ ID NO: 735521 - DNA, 22 bp, Artificial Sequence
  chemically synthesized
ataaaatactgaactgaacttc

SEQ ID NO: 735522 - DNA, 22 bp, Artificial Sequence
  chemically synthesized
agaaatcacttttgcatgaagt

SEQ ID NO: 735523 - DNA, 22 bp, Artificial Sequence
  chemically synthesized
tcagaaatcacttttgcatgaa

SEQ ID NO: 735524 - DNA, 22 bp, Artificial Sequence
  chemically synthesized
ctcagaaatcacttttgcatga

SEQ ID NO: 735525 - DNA, 22 bp, Artificial Sequence
  chemically synthesized
tctcagaaatcacttttgcatg

SEQ ID NO: 735526 - DNA, 22 bp, Artificial Sequence
  chemically synthesized
ttctcagaaatcacttttgcat

SEQ ID NO: 735527 - DNA, 22 bp, Artificial Sequence
  chemically synthesized
aactgaacttcatgcaaaagtg

SEQ ID NO: 735528 - DNA, 22 bp, Artificial Sequence
  chemically synthesized
aacttcatgcaaaagtgatttc

SEQ ID NO: 735529 - DNA, 22 bp, Artificial Sequence
  chemically synthesized
atgccttttctcagaaatcact

SEQ ID NO: 735530 - DNA, 22 bp, Artificial Sequence
  chemically synthesized
catgcaaaagtgatttctgaga

SEQ ID NO: 735531 - DNA, 22 bp, Artificial Sequence
  chemically synthesized
gttaatgccttttctcagaaat

SEQ ID NO: 735532 - DNA, 22 bp, Artificial Sequence
  chemically synthesized
atgcaaaagtgatttctgagaa

SEQ ID NO: 735533 - DNA, 22 bp, Artificial Sequence
  chemically synthesized
ggttaatgccttttctcagaaa

SEQ ID NO: 735534 - DNA, 22 bp, Artificial Sequence
  chemically synthesized
tttggttaatgccttttctcag

SEQ ID NO: 735535 - DNA, 22 bp, Artificial Sequence
  chemically synthesized
aggcactatttggttaatgcct

SEQ ID NO: 735536 - DNA, 22 bp, Artificial Sequence
  chemically synthesized
ctgagaaaaggcattaaccaaa

SEQ ID NO: 735537 - DNA, 22 bp, Artificial Sequence
  chemically synthesized
tgagaaaaggcattaaccaaat

SEQ ID NO: 735538 - DNA, 22 bp, Artificial Sequence
  chemically synthesized
agaaaaggcattaaccaaatag

SEQ ID NO: 735539 - DNA, 22 bp, Artificial Sequence
  chemically synthesized
accaaatagtgccttaatttta

SEQ ID NO: 735540 - DNA, 22 bp, Artificial Sequence
  chemically synthesized
caaaacaagtaataaaattaag

SEQ ID NO: 735541 - DNA, 22 bp, Artificial Sequence
  chemically synthesized
aattttattacttgttttgcag

SEQ ID NO: 735542 - DNA, 22 bp, Artificial Sequence
  chemically synthesized
agtacataaaacctgcaaaaca

SEQ ID NO: 735543 - DNA, 22 bp, Artificial Sequence
  chemically synthesized
attttattacttgttttgcagg

SEQ ID NO: 735544 - DNA, 22 bp, Artificial Sequence
  chemically synthesized
tattacttgttttgcaggtttt

SEQ ID NO: 735545 - DNA, 22 bp, Artificial Sequence
  chemically synthesized
attacttgttttgcaggtttta

SEQ ID NO: 735546 - DNA, 22 bp, Artificial Sequence
  chemically synthesized
caattaagtacataaaacctgc

SEQ ID NO: 735547 - DNA, 22 bp, Artificial Sequence
  chemically synthesized
ttacttgttttgcaggttttat

SEQ ID NO: 735548 - DNA, 22 bp, Artificial Sequence
  chemically synthesized
gcaattaagtacataaaacctg

SEQ ID NO: 735549 - DNA, 22 bp, Artificial Sequence
  chemically synthesized
cttgttttgcaggttttatgta

SEQ ID NO: 735550 - DNA, 22 bp, Artificial Sequence
  chemically synthesized
cttgcaattaagtacataaaac

SEQ ID NO: 735551 - DNA, 22 bp, Artificial Sequence
  chemically synthesized
gttttgcaggttttatgtactt

SEQ ID NO: 735552 - DNA, 22 bp, Artificial Sequence
  chemically synthesized
ctacttgcaattaagtacataa

SEQ ID NO: 735553 - DNA, 22 bp, Artificial Sequence
  chemically synthesized
ttttgcaggttttatgtactta

SEQ ID NO: 735554 - DNA, 22 bp, Artificial Sequence
  chemically synthesized
tgcaggttttatgtacttaatt

SEQ ID NO: 735555 - DNA, 22 bp, Artificial Sequence
  chemically synthesized
gcaggttttatgtacttaattg

SEQ ID NO: 735556 - DNA, 22 bp, Artificial Sequence
  chemically synthesized
gcctcctacttgcaattaagta

SEQ ID NO: 735557 - DNA, 22 bp, Artificial Sequence
  chemically synthesized
caggttttatgtacttaattgc

SEQ ID NO: 735558 - DNA, 22 bp, Artificial Sequence
  chemically synthesized
attagcctcctacttgcaatta

SEQ ID NO: 735559 - DNA, 22 bp, Artificial Sequence
  chemically synthesized
cattagcctcctacttgcaatt

SEQ ID NO: 735560 - DNA, 22 bp, Artificial Sequence
  chemically synthesized
tcattagcctcctacttgcaat

SEQ ID NO: 735561 - DNA, 22 bp, Artificial Sequence
  chemically synthesized
ttcattagcctcctacttgcaa

SEQ ID NO: 735562 - DNA, 22 bp, Artificial Sequence
  chemically synthesized
tatgtacttaattgcaagtagg

SEQ ID NO: 735563 - DNA, 22 bp, Artificial Sequence
  chemically synthesized
atgtacttaattgcaagtagga

SEQ ID NO: 735564 - DNA, 22 bp, Artificial Sequence
  chemically synthesized
tgtacttaattgcaagtaggag

SEQ ID NO: 735565 - DNA, 22 bp, Artificial Sequence
  chemically synthesized
aacatttttcattagcctccta

SEQ ID NO: 735566 - DNA, 22 bp, Artificial Sequence
  chemically synthesized
aattgcaagtaggaggctaatg

SEQ ID NO: 735567 - DNA, 22 bp, Artificial Sequence
  chemically synthesized
attgcaagtaggaggctaatga

SEQ ID NO: 735568 - DNA, 22 bp, Artificial Sequence
  chemically synthesized
caagtaggaggctaatgaaaaa

SEQ ID NO: 735569 - DNA, 22 bp, Artificial Sequence
  chemically synthesized
caaaaactaaacatttttcatt

SEQ ID NO: 735570 - DNA, 22 bp, Artificial Sequence
  chemically synthesized
atgaaaaatgtttagtttttgc

SEQ ID NO: 735571 - DNA, 22 bp, Artificial Sequence
  chemically synthesized
accaccaccacactgcaaaaac

SEQ ID NO: 735572 - DNA, 22 bp, Artificial Sequence
  chemically synthesized
agtttttgcagtgtggtggtgg

SEQ ID NO: 735573 - DNA, 22 bp, Artificial Sequence
  chemically synthesized
ggatgcccctcaccaccaccac

SEQ ID NO: 735574 - DNA, 22 bp, Artificial Sequence
  chemically synthesized
gtttttgcagtgtggtggtggt

SEQ ID NO: 735575 - DNA, 22 bp, Artificial Sequence
  chemically synthesized
ttgcagtgtggtggtggtgagg

SEQ ID NO: 735576 - DNA, 22 bp, Artificial Sequence
  chemically synthesized
tgcagtgtggtggtggtgaggg

SEQ ID NO: 735577 - DNA, 22 bp, Artificial Sequence
  chemically synthesized
aagctgggatgcccctcaccac

SEQ ID NO: 735578 - DNA, 22 bp, Artificial Sequence
  chemically synthesized
gcagtgtggtggtggtgagggg

SEQ ID NO: 735579 - DNA, 22 bp, Artificial Sequence
  chemically synthesized
cagtgtggtggtggtgaggggc

SEQ ID NO: 735580 - DNA, 22 bp, Artificial Sequence
  chemically synthesized
ccactcaagctgggatgcccct

SEQ ID NO: 735581 - DNA, 22 bp, Artificial Sequence
  chemically synthesized
taccactcaagctgggatgccc

SEQ ID NO: 735582 - DNA, 22 bp, Artificial Sequence
  chemically synthesized
ggacctctaccactcaagctgg

SEQ ID NO: 735583 - DNA, 22 bp, Artificial Sequence
  chemically synthesized
agctgggacctctaccactcaa

SEQ ID NO: 735584 - DNA, 22 bp, Artificial Sequence
  chemically synthesized
tgttaagctgggacctctacca

SEQ ID NO: 735585 - DNA, 22 bp, Artificial Sequence
  chemically synthesized
tgtgttaagctgggacctctac

SEQ ID NO: 735586 - DNA, 22 bp, Artificial Sequence
  chemically synthesized
ctgtgttaagctgggacctcta

SEQ ID NO: 735587 - DNA, 22 bp, Artificial Sequence
  chemically synthesized
aatttctgtgttaagctgggac

SEQ ID NO: 735588 - DNA, 22 bp, Artificial Sequence
  chemically synthesized
gagtggtagaggtcccagctta

SEQ ID NO: 735589 - DNA, 22 bp, Artificial Sequence
  chemically synthesized
agtggtagaggtcccagcttaa

SEQ ID NO: 735590 - DNA, 22 bp, Artificial Sequence
  chemically synthesized
tctaaatttctgtgttaagctg

SEQ ID NO: 735591 - DNA, 22 bp, Artificial Sequence
  chemically synthesized
atctaaatttctgtgttaagct

SEQ ID NO: 735592 - DNA, 22 bp, Artificial Sequence
  chemically synthesized
ccacatttatctaaatttctgt

SEQ ID NO: 735593 - DNA, 22 bp, Artificial Sequence
  chemically synthesized
gccacatttatctaaatttctg

SEQ ID NO: 735594 - DNA, 22 bp, Artificial Sequence
  chemically synthesized
aacacagaaatttagataaatg

SEQ ID NO: 735595 - DNA, 22 bp, Artificial Sequence
  chemically synthesized
acacagaaatttagataaatgt

SEQ ID NO: 735596 - DNA, 22 bp, Artificial Sequence
  chemically synthesized
cccatcccaccaatttgccaca

SEQ ID NO: 735597 - DNA, 22 bp, Artificial Sequence
  chemically synthesized
agataaatgtggcaaattggtg

SEQ ID NO: 735598 - DNA, 22 bp, Artificial Sequence
  chemically synthesized
gataaatgtggcaaattggtgg

SEQ ID NO: 735599 - DNA, 22 bp, Artificial Sequence
  chemically synthesized
agtgcagatgagatacattgcc

SEQ ID NO: 735600 - DNA, 22 bp, Artificial Sequence
  chemically synthesized
tcagtgcagatgagatacattg

SEQ ID NO: 735601 - DNA, 22 bp, Artificial Sequence
  chemically synthesized
gtgggatgggcaatgtatctca

SEQ ID NO: 735602 - DNA, 22 bp, Artificial Sequence
  chemically synthesized
tctcagtgcagatgagatacat

SEQ ID NO: 735603 - DNA, 22 bp, Artificial Sequence
  chemically synthesized
ctctcagtgcagatgagataca

SEQ ID NO: 735604 - DNA, 22 bp, Artificial Sequence
  chemically synthesized
tctctcagtgcagatgagatac

SEQ ID NO: 735605 - DNA, 22 bp, Artificial Sequence
  chemically synthesized
ttctctcagtgcagatgagata

SEQ ID NO: 735606 - DNA, 22 bp, Artificial Sequence
  chemically synthesized
agcttttctctcagtgcagatg

SEQ ID NO: 735607 - DNA, 22 bp, Artificial Sequence
  chemically synthesized
gagcttttctctcagtgcagat

SEQ ID NO: 735608 - DNA, 22 bp, Artificial Sequence
  chemically synthesized
caccttgagcttttctctcagt

SEQ ID NO: 735609 - DNA, 22 bp, Artificial Sequence
  chemically synthesized
atctgcactgagagaaaagctc

SEQ ID NO: 735610 - DNA, 22 bp, Artificial Sequence
  chemically synthesized
cactgagagaaaagctcaaggt

SEQ ID NO: 735611 - DNA, 22 bp, Artificial Sequence
  chemically synthesized
agagaaaagctcaaggtgtaac

SEQ ID NO: 735612 - DNA, 22 bp, Artificial Sequence
  chemically synthesized
gacatgtagccccagaaatggt

SEQ ID NO: 735613 - DNA, 22 bp, Artificial Sequence
  chemically synthesized
aaggtgtaaccatttctggggc

SEQ ID NO: 735614 - DNA, 22 bp, Artificial Sequence
  chemically synthesized
gagatgactagacatgtagccc

SEQ ID NO: 735615 - DNA, 22 bp, Artificial Sequence
  chemically synthesized
agagatgactagacatgtagcc

SEQ ID NO: 735616 - DNA, 22 bp, Artificial Sequence
  chemically synthesized
ttagagatgactagacatgtag

SEQ ID NO: 735617 - DNA, 22 bp, Artificial Sequence
  chemically synthesized
ctggggctacatgtctagtcat

SEQ ID NO: 735618 - DNA, 22 bp, Artificial Sequence
  chemically synthesized
tggggctacatgtctagtcatc

SEQ ID NO: 735619 - DNA, 22 bp, Artificial Sequence
  chemically synthesized
gggctacatgtctagtcatctc

SEQ ID NO: 735620 - DNA, 22 bp, Artificial Sequence
  chemically synthesized
catgtctagtcatctctaagag

SEQ ID NO: 735621 - DNA, 22 bp, Artificial Sequence
  chemically synthesized
gggagccaccaatctcttagag

SEQ ID NO: 735622 - DNA, 22 bp, Artificial Sequence
  chemically synthesized
gtcatctctaagagattggtgg

SEQ ID NO: 735623 - DNA, 22 bp, Artificial Sequence
  chemically synthesized
caatggatgtctggggagccac

SEQ ID NO: 735624 - DNA, 22 bp, Artificial Sequence
  chemically synthesized
taagagattggtggctccccag

SEQ ID NO: 735625 - DNA, 22 bp, Artificial Sequence
  chemically synthesized
agagattggtggctccccagac

SEQ ID NO: 735626 - DNA, 22 bp, Artificial Sequence
  chemically synthesized
gtgtccctgcaatggatgtctg

SEQ ID NO: 735627 - DNA, 22 bp, Artificial Sequence
  chemically synthesized
agtgtccctgcaatggatgtct

SEQ ID NO: 735628 - DNA, 22 bp, Artificial Sequence
  chemically synthesized
gtggctccccagacatccattg

SEQ ID NO: 735629 - DNA, 22 bp, Artificial Sequence
  chemically synthesized
cttagtgtccctgcaatggatg

SEQ ID NO: 735630 - DNA, 22 bp, Artificial Sequence
  chemically synthesized
cccagacatccattgcagggac

SEQ ID NO: 735631 - DNA, 22 bp, Artificial Sequence
  chemically synthesized
agagacctccttagtgtccctg

SEQ ID NO: 735632 - DNA, 22 bp, Artificial Sequence
  chemically synthesized
ctaagagacctccttagtgtcc

SEQ ID NO: 735633 - DNA, 22 bp, Artificial Sequence
  chemically synthesized
tcctaagagacctccttagtgt

SEQ ID NO: 735634 - DNA, 22 bp, Artificial Sequence
  chemically synthesized
ctcctaagagacctccttagtg

SEQ ID NO: 735635 - DNA, 22 bp, Artificial Sequence
  chemically synthesized
cagggacactaaggaggtctct

SEQ ID NO: 735636 - DNA, 22 bp, Artificial Sequence
  chemically synthesized
cgccttctcctaagagacctcc

SEQ ID NO: 735637 - DNA, 22 bp, Artificial Sequence
  chemically synthesized
attacgccttctcctaagagac

SEQ ID NO: 735638 - DNA, 22 bp, Artificial Sequence
  chemically synthesized
cattacgccttctcctaagaga

SEQ ID NO: 735639 - DNA, 22 bp, Artificial Sequence
  chemically synthesized
tcattacgccttctcctaagag

SEQ ID NO: 735640 - DNA, 22 bp, Artificial Sequence
  chemically synthesized
tttcattacgccttctcctaag

SEQ ID NO: 735641 - DNA, 22 bp, Artificial Sequence
  chemically synthesized
aggaggtctcttaggagaaggc

SEQ ID NO: 735642 - DNA, 22 bp, Artificial Sequence
  chemically synthesized
taatatgttctttcattacgcc

SEQ ID NO: 735643 - DNA, 22 bp, Artificial Sequence
  chemically synthesized
ataatatgttctttcattacgc

SEQ ID NO: 735644 - DNA, 22 bp, Artificial Sequence
  chemically synthesized
ttaggagaaggcgtaatgaaag

SEQ ID NO: 735645 - DNA, 22 bp, Artificial Sequence
  chemically synthesized
aggagaaggcgtaatgaaagaa

SEQ ID NO: 735646 - DNA, 22 bp, Artificial Sequence
  chemically synthesized
gtttataatatgttctttcatt

SEQ ID NO: 735647 - DNA, 22 bp, Artificial Sequence
  chemically synthesized
ggagaaggcgtaatgaaagaac

SEQ ID NO: 735648 - DNA, 22 bp, Artificial Sequence
  chemically synthesized
agcaaagcacctggtttataat

SEQ ID NO: 735649 - DNA, 22 bp, Artificial Sequence
  chemically synthesized
ctgagcaaagcacctggtttat

SEQ ID NO: 735650 - DNA, 22 bp, Artificial Sequence
  chemically synthesized
tactgagcaaagcacctggttt

SEQ ID NO: 735651 - DNA, 22 bp, Artificial Sequence
  chemically synthesized
ctactgagcaaagcacctggtt

SEQ ID NO: 735652 - DNA, 22 bp, Artificial Sequence
  chemically synthesized
tctactgagcaaagcacctggt

SEQ ID NO: 735653 - DNA, 22 bp, Artificial Sequence
  chemically synthesized
ttctactgagcaaagcacctgg

SEQ ID NO: 735654 - DNA, 22 bp, Artificial Sequence
  chemically synthesized
taaaccaggtgctttgctcagt

SEQ ID NO: 735655 - DNA, 22 bp, Artificial Sequence
  chemically synthesized
accgaggcttttctactgagca

SEQ ID NO: 735656 - DNA, 22 bp, Artificial Sequence
  chemically synthesized
ttgaccgaggcttttctactga

SEQ ID NO: 735657 - DNA, 22 bp, Artificial Sequence
  chemically synthesized
gttgaccgaggcttttctactg

SEQ ID NO: 735658 - DNA, 22 bp, Artificial Sequence
  chemically synthesized
ttgttgaccgaggcttttctac

SEQ ID NO: 735659 - DNA, 22 bp, Artificial Sequence
  chemically synthesized
tcttgttgaccgaggcttttct

SEQ ID NO: 735660 - DNA, 22 bp, Artificial Sequence
  chemically synthesized
ctcttgttgaccgaggcttttc

SEQ ID NO: 735661 - DNA, 22 bp, Artificial Sequence
  chemically synthesized
tctcttgttgaccgaggctttt

SEQ ID NO: 735662 - DNA, 22 bp, Artificial Sequence
  chemically synthesized
tgctcagtagaaaagcctcggt

SEQ ID NO: 735663 - DNA, 22 bp, Artificial Sequence
  chemically synthesized
tttctcttgttgaccgaggctt

SEQ ID NO: 735664 - DNA, 22 bp, Artificial Sequence
  chemically synthesized
gctcagtagaaaagcctcggtc

SEQ ID NO: 735665 - DNA, 22 bp, Artificial Sequence
  chemically synthesized
ctcagtagaaaagcctcggtca

SEQ ID NO: 735666 - DNA, 22 bp, Artificial Sequence
  chemically synthesized
tctttctcttgttgaccgaggc

SEQ ID NO: 735667 - DNA, 22 bp, Artificial Sequence
  chemically synthesized
ctctttctcttgttgaccgagg

SEQ ID NO: 735668 - DNA, 22 bp, Artificial Sequence
  chemically synthesized
tctctttctcttgttgaccgag

SEQ ID NO: 735669 - DNA, 22 bp, Artificial Sequence
  chemically synthesized
agtagaaaagcctcggtcaaca

SEQ ID NO: 735670 - DNA, 22 bp, Artificial Sequence
  chemically synthesized
tttctctttctcttgttgaccg

SEQ ID NO: 735671 - DNA, 22 bp, Artificial Sequence
  chemically synthesized
aaaaccactctttctctttctc

SEQ ID NO: 735672 - DNA, 22 bp, Artificial Sequence
  chemically synthesized
tcaaaaccactctttctctttc

SEQ ID NO: 735673 - DNA, 22 bp, Artificial Sequence
  chemically synthesized
ggtcaacaagagaaagagaaag

SEQ ID NO: 735674 - DNA, 22 bp, Artificial Sequence
  chemically synthesized
agtagcagacaccacagtattc

SEQ ID NO: 735675 - DNA, 22 bp, Artificial Sequence
  chemically synthesized
tgagaatactgtggtgtctgct

SEQ ID NO: 735676 - DNA, 22 bp, Artificial Sequence
  chemically synthesized
gagaatactgtggtgtctgcta

SEQ ID NO: 735677 - DNA, 22 bp, Artificial Sequence
  chemically synthesized
agaatactgtggtgtctgctac

SEQ ID NO: 735678 - DNA, 22 bp, Artificial Sequence
  chemically synthesized
aaccagaagataaatctaagta

SEQ ID NO: 735679 - DNA, 22 bp, Artificial Sequence
  chemically synthesized
tggtgtctgctacttagattta

SEQ ID NO: 735680 - DNA, 22 bp, Artificial Sequence
  chemically synthesized
ctacttagatttatcttctggt

SEQ ID NO: 735681 - DNA, 22 bp, Artificial Sequence
  chemically synthesized
agatatgactgaaccagaagat

SEQ ID NO: 735682 - DNA, 22 bp, Artificial Sequence
  chemically synthesized
cttagatttatcttctggttca

SEQ ID NO: 735683 - DNA, 22 bp, Artificial Sequence
  chemically synthesized
agatttatcttctggttcagtc

SEQ ID NO: 735684 - DNA, 22 bp, Artificial Sequence
  chemically synthesized
gatttatcttctggttcagtca

SEQ ID NO: 735685 - DNA, 22 bp, Artificial Sequence
  chemically synthesized
atcttctggttcagtcatatct

SEQ ID NO: 735686 - DNA, 22 bp, Artificial Sequence
  chemically synthesized
tcttctggttcagtcatatctg

SEQ ID NO: 735687 - DNA, 22 bp, Artificial Sequence
  chemically synthesized
gatgcatgggactcagatatga

SEQ ID NO: 735688 - DNA, 22 bp, Artificial Sequence
  chemically synthesized
agatgcatgggactcagatatg

SEQ ID NO: 735689 - DNA, 22 bp, Artificial Sequence
  chemically synthesized
ctggttcagtcatatctgagtc

SEQ ID NO: 735690 - DNA, 22 bp, Artificial Sequence
  chemically synthesized
tggttcagtcatatctgagtcc

SEQ ID NO: 735691 - DNA, 22 bp, Artificial Sequence
  chemically synthesized
acttagatgcatgggactcaga

SEQ ID NO: 735692 - DNA, 22 bp, Artificial Sequence
  chemically synthesized
gttcagtcatatctgagtccca

SEQ ID NO: 735693 - DNA, 22 bp, Artificial Sequence
  chemically synthesized
tgacttagatgcatgggactca

SEQ ID NO: 735694 - DNA, 22 bp, Artificial Sequence
  chemically synthesized
agtcatatctgagtcccatgca

SEQ ID NO: 735695 - DNA, 22 bp, Artificial Sequence
  chemically synthesized
caaataattctgacttagatgc

SEQ ID NO: 735696 - DNA, 22 bp, Artificial Sequence
  chemically synthesized
gcaaataattctgacttagatg

SEQ ID NO: 735697 - DNA, 22 bp, Artificial Sequence
  chemically synthesized
agtcccatgcatctaagtcaga

SEQ ID NO: 735698 - DNA, 22 bp, Artificial Sequence
  chemically synthesized
gcacatggtcttgcaaataatt

SEQ ID NO: 735699 - DNA, 22 bp, Artificial Sequence
  chemically synthesized
atctggcacatggtcttgcaaa

SEQ ID NO: 735700 - DNA, 22 bp, Artificial Sequence
  chemically synthesized
agtcagaattatttgcaagacc

SEQ ID NO: 735701 - DNA, 22 bp, Artificial Sequence
  chemically synthesized
tttgcaagaccatgtgccagat

SEQ ID NO: 735702 - DNA, 22 bp, Artificial Sequence
  chemically synthesized
gcaagaccatgtgccagatgag

SEQ ID NO: 735703 - DNA, 22 bp, Artificial Sequence
  chemically synthesized
caagaccatgtgccagatgaga

SEQ ID NO: 735704 - DNA, 22 bp, Artificial Sequence
  chemically synthesized
cagcagaaagcatctcatctgg

SEQ ID NO: 735705 - DNA, 22 bp, Artificial Sequence
  chemically synthesized
caacctgcagcagaaagcatct

SEQ ID NO: 735706 - DNA, 22 bp, Artificial Sequence
  chemically synthesized
tacaacctgcagcagaaagcat

SEQ ID NO: 735707 - DNA, 22 bp, Artificial Sequence
  chemically synthesized
ctacaacctgcagcagaaagca

SEQ ID NO: 735708 - DNA, 22 bp, Artificial Sequence
  chemically synthesized
tctacaacctgcagcagaaagc

SEQ ID NO: 735709 - DNA, 22 bp, Artificial Sequence
  chemically synthesized
tctgctgcaggttgtagaaaac

SEQ ID NO: 735710 - DNA, 22 bp, Artificial Sequence
  chemically synthesized
ctgctgcaggttgtagaaaact

SEQ ID NO: 735711 - DNA, 22 bp, Artificial Sequence
  chemically synthesized
tgctgcaggttgtagaaaactg

SEQ ID NO: 735712 - DNA, 22 bp, Artificial Sequence
  chemically synthesized
ctgcaggttgtagaaaactgat

SEQ ID NO: 735713 - DNA, 22 bp, Artificial Sequence
  chemically synthesized
caggttgtagaaaactgatatg

SEQ ID NO: 735714 - DNA, 22 bp, Artificial Sequence
  chemically synthesized
tagaaaactgatatgggttgga

SEQ ID NO: 735715 - DNA, 22 bp, Artificial Sequence
  chemically synthesized
aagggaacaaacatccaaccca

SEQ ID NO: 735716 - DNA, 22 bp, Artificial Sequence
  chemically synthesized
gaagggaacaaacatccaaccc

SEQ ID NO: 735717 - DNA, 22 bp, Artificial Sequence
  chemically synthesized
atatgggttggatgtttgttcc

SEQ ID NO: 735718 - DNA, 22 bp, Artificial Sequence
  chemically synthesized
agcatgagatttgaagggaaca

SEQ ID NO: 735719 - DNA, 22 bp, Artificial Sequence
  chemically synthesized
cagcatgagatttgaagggaac

SEQ ID NO: 735720 - DNA, 22 bp, Artificial Sequence
  chemically synthesized
gatgtttgttcccttcaaatct

SEQ ID NO: 735721 - DNA, 22 bp, Artificial Sequence
  chemically synthesized
catttcagcatgagatttgaag

SEQ ID NO: 735722 - DNA, 22 bp, Artificial Sequence
  chemically synthesized
gttcccttcaaatctcatgctg

SEQ ID NO: 735723 - DNA, 22 bp, Artificial Sequence
  chemically synthesized
gggattacatttcagcatgaga

SEQ ID NO: 735724 - DNA, 22 bp, Artificial Sequence
  chemically synthesized
ttcccttcaaatctcatgctga

SEQ ID NO: 735725 - DNA, 22 bp, Artificial Sequence
  chemically synthesized
ccttcaaatctcatgctgaaat

SEQ ID NO: 735726 - DNA, 22 bp, Artificial Sequence
  chemically synthesized
caaatctcatgctgaaatgtaa

SEQ ID NO: 735727 - DNA, 22 bp, Artificial Sequence
  chemically synthesized
aaatctcatgctgaaatgtaat

SEQ ID NO: 735728 - DNA, 22 bp, Artificial Sequence
  chemically synthesized
atgctgaaatgtaatccccagt

SEQ ID NO: 735729 - DNA, 22 bp, Artificial Sequence
  chemically synthesized
aaatgtaatccccagtgttgga

SEQ ID NO: 735730 - DNA, 22 bp, Artificial Sequence
  chemically synthesized
ccccaccgggccccacatccaa

SEQ ID NO: 735731 - DNA, 22 bp, Artificial Sequence
  chemically synthesized
gatgtggggcccggtgggggag

SEQ ID NO: 735732 - DNA, 22 bp, Artificial Sequence
  chemically synthesized
gtgagggatccagccccatgat

SEQ ID NO: 735733 - DNA, 22 bp, Artificial Sequence
  chemically synthesized
agccattcgtgagggatccagc

SEQ ID NO: 735734 - DNA, 22 bp, Artificial Sequence
  chemically synthesized
gatcatggggctggatccctca

SEQ ID NO: 735735 - DNA, 22 bp, Artificial Sequence
  chemically synthesized
caagaatggcactgagccattc

SEQ ID NO: 735736 - DNA, 22 bp, Artificial Sequence
  chemically synthesized
gatccctcacgaatggctcagt

SEQ ID NO: 735737 - DNA, 22 bp, Artificial Sequence
  chemically synthesized
ctgcaagaatggcactgagcca

SEQ ID NO: 735738 - DNA, 22 bp, Artificial Sequence
  chemically synthesized
ttactgcaagaatggcactgag

SEQ ID NO: 735739 - DNA, 22 bp, Artificial Sequence
  chemically synthesized
attactgcaagaatggcactga

SEQ ID NO: 735740 - DNA, 22 bp, Artificial Sequence
  chemically synthesized
acgaatggctcagtgccattct

SEQ ID NO: 735741 - DNA, 22 bp, Artificial Sequence
  chemically synthesized
acttattactgcaagaatggca

SEQ ID NO: 735742 - DNA, 22 bp, Artificial Sequence
  chemically synthesized
agtgccattcttgcagtaataa

SEQ ID NO: 735743 - DNA, 22 bp, Artificial Sequence
  chemically synthesized
agtgagaactcacttattactg

SEQ ID NO: 735744 - DNA, 22 bp, Artificial Sequence
  chemically synthesized
tgagtgagaactcacttattac

SEQ ID NO: 735745 - DNA, 22 bp, Artificial Sequence
  chemically synthesized
actctgagtgagaactcactta

SEQ ID NO: 735746 - DNA, 22 bp, Artificial Sequence
  chemically synthesized
ttgcagtaataagtgagttctc

SEQ ID NO: 735747 - DNA, 22 bp, Artificial Sequence
  chemically synthesized
gcagtaataagtgagttctcac

SEQ ID NO: 735748 - DNA, 22 bp, Artificial Sequence
  chemically synthesized
cagtaataagtgagttctcact

SEQ ID NO: 735749 - DNA, 22 bp, Artificial Sequence
  chemically synthesized
tcactcagagtgagttcatgtg

SEQ ID NO: 735750 - DNA, 22 bp, Artificial Sequence
  chemically synthesized
aacagtcagatcccacatgaac

SEQ ID NO: 735751 - DNA, 22 bp, Artificial Sequence
  chemically synthesized
actcagagtgagttcatgtggg

SEQ ID NO: 735752 - DNA, 22 bp, Artificial Sequence
  chemically synthesized
aaacagtcagatcccacatgaa

SEQ ID NO: 735753 - DNA, 22 bp, Artificial Sequence
  chemically synthesized
taaacagtcagatcccacatga

SEQ ID NO: 735754 - DNA, 22 bp, Artificial Sequence
  chemically synthesized
ttaaacagtcagatcccacatg

SEQ ID NO: 735755 - DNA, 22 bp, Artificial Sequence
  chemically synthesized
agagtgagttcatgtgggatct

SEQ ID NO: 735756 - DNA, 22 bp, Artificial Sequence
  chemically synthesized
ttttaaacagtcagatcccaca

SEQ ID NO: 735757 - DNA, 22 bp, Artificial Sequence
  chemically synthesized
atgtgggatctgactgtttaaa

SEQ ID NO: 735758 - DNA, 22 bp, Artificial Sequence
  chemically synthesized
actgtttaaaagagtgtggcac

SEQ ID NO: 735759 - DNA, 22 bp, Artificial Sequence
  chemically synthesized
tttaaaagagtgtggcacctcc

SEQ ID NO: 735760 - DNA, 22 bp, Artificial Sequence
  chemically synthesized
aaaagagtgtggcacctcccac

SEQ ID NO: 735761 - DNA, 22 bp, Artificial Sequence
  chemically synthesized
aaagagtgtggcacctcccacc

SEQ ID NO: 735762 - DNA, 22 bp, Artificial Sequence
  chemically synthesized
ccaccccctcactccatctctc

SEQ ID NO: 735763 - DNA, 22 bp, Artificial Sequence
  chemically synthesized
actccatctctcaccatgtgac

SEQ ID NO: 735764 - DNA, 22 bp, Artificial Sequence
  chemically synthesized
catctctcaccatgtgacacgc

SEQ ID NO: 735765 - DNA, 22 bp, Artificial Sequence
  chemically synthesized
tcaccatgtgacacgctggttc

SEQ ID NO: 735766 - DNA, 22 bp, Artificial Sequence
  chemically synthesized
accatgtgacacgctggttctc

SEQ ID NO: 735767 - DNA, 22 bp, Artificial Sequence
  chemically synthesized
caatcatggtggaaggtgaaag

SEQ ID NO: 735768 - DNA, 22 bp, Artificial Sequence
  chemically synthesized
acaatcatggtggaaggtgaaa

SEQ ID NO: 735769 - DNA, 22 bp, Artificial Sequence
  chemically synthesized
gttctcctttcaccttccacca

SEQ ID NO: 735770 - DNA, 22 bp, Artificial Sequence
  chemically synthesized
tcctttcaccttccaccatgat

SEQ ID NO: 735771 - DNA, 22 bp, Artificial Sequence
  chemically synthesized
agcaagcttacaatcatggtgg

SEQ ID NO: 735772 - DNA, 22 bp, Artificial Sequence
  chemically synthesized
cagcaagcttacaatcatggtg

SEQ ID NO: 735773 - DNA, 22 bp, Artificial Sequence
  chemically synthesized
ctttcaccttccaccatgattg

SEQ ID NO: 735774 - DNA, 22 bp, Artificial Sequence
  chemically synthesized
tcaccttccaccatgattgtaa

SEQ ID NO: 735775 - DNA, 22 bp, Artificial Sequence
  chemically synthesized
caccttccaccatgattgtaag

SEQ ID NO: 735776 - DNA, 22 bp, Artificial Sequence
  chemically synthesized
accttccaccatgattgtaagc

SEQ ID NO: 735777 - DNA, 22 bp, Artificial Sequence
  chemically synthesized
gtgagggcttcagcaagcttac

SEQ ID NO: 735778 - DNA, 22 bp, Artificial Sequence
  chemically synthesized
ccaccatgattgtaagcttgct

SEQ ID NO: 735779 - DNA, 22 bp, Artificial Sequence
  chemically synthesized
caccatgattgtaagcttgctg

SEQ ID NO: 735780 - DNA, 22 bp, Artificial Sequence
  chemically synthesized
tggtgagggcttcagcaagctt

SEQ ID NO: 735781 - DNA, 22 bp, Artificial Sequence
  chemically synthesized
ctggtgagggcttcagcaagct

SEQ ID NO: 735782 - DNA, 22 bp, Artificial Sequence
  chemically synthesized
cttctggtgagggcttcagcaa

SEQ ID NO: 735783 - DNA, 22 bp, Artificial Sequence
  chemically synthesized
tgcttctggtgagggcttcagc

SEQ ID NO: 735784 - DNA, 22 bp, Artificial Sequence
  chemically synthesized
taagcttgctgaagccctcacc

SEQ ID NO: 735785 - DNA, 22 bp, Artificial Sequence
  chemically synthesized
gctgaagccctcaccagaagca

SEQ ID NO: 735786 - DNA, 22 bp, Artificial Sequence
  chemically synthesized
ctgaagccctcaccagaagcag

SEQ ID NO: 735787 - DNA, 22 bp, Artificial Sequence
  chemically synthesized
aagccctcaccagaagcagagg

SEQ ID NO: 735788 - DNA, 22 bp, Artificial Sequence
  chemically synthesized
accagaagcagaggctgtcacc

SEQ ID NO: 735789 - DNA, 22 bp, Artificial Sequence
  chemically synthesized
tacaggaagtgtggtgacagcc

SEQ ID NO: 735790 - DNA, 22 bp, Artificial Sequence
  chemically synthesized
caggctgtacaggaagtgtggt

SEQ ID NO: 735791 - DNA, 22 bp, Artificial Sequence
  chemically synthesized
tgcaggctgtacaggaagtgtg

SEQ ID NO: 735792 - DNA, 22 bp, Artificial Sequence
  chemically synthesized
atggttctgcaggctgtacagg

SEQ ID NO: 735793 - DNA, 22 bp, Artificial Sequence
  chemically synthesized
tcaccacacttcctgtacagcc

SEQ ID NO: 735794 - DNA, 22 bp, Artificial Sequence
  chemically synthesized
gctcatggttctgcaggctgta

SEQ ID NO: 735795 - DNA, 22 bp, Artificial Sequence
  chemically synthesized
attggctcatggttctgcaggc

SEQ ID NO: 735796 - DNA, 22 bp, Artificial Sequence
  chemically synthesized
cattggctcatggttctgcagg

SEQ ID NO: 735797 - DNA, 22 bp, Artificial Sequence
  chemically synthesized
cctgtacagcctgcagaaccat

SEQ ID NO: 735798 - DNA, 22 bp, Artificial Sequence
  chemically synthesized
ctgtacagcctgcagaaccatg

SEQ ID NO: 735799 - DNA, 22 bp, Artificial Sequence
  chemically synthesized
tacagcctgcagaaccatgagc

SEQ ID NO: 735800 - DNA, 22 bp, Artificial Sequence
  chemically synthesized
cagaaccatgagccaatgaaat

SEQ ID NO: 735801 - DNA, 22 bp, Artificial Sequence
  chemically synthesized
taaggaaaagagatttcattgg

SEQ ID NO: 735802 - DNA, 22 bp, Artificial Sequence
  chemically synthesized
ataaggaaaagagatttcattg

SEQ ID NO: 735803 - DNA, 22 bp, Artificial Sequence
  chemically synthesized
ggtaatttataaggaaaagaga

SEQ ID NO: 735804 - DNA, 22 bp, Artificial Sequence
  chemically synthesized
aggctgggtaatttataaggaa

SEQ ID NO: 735805 - DNA, 22 bp, Artificial Sequence
  chemically synthesized
ttttccttataaattacccagc

SEQ ID NO: 735806 - DNA, 22 bp, Artificial Sequence
  chemically synthesized
ttccttataaattacccagcct

SEQ ID NO: 735807 - DNA, 22 bp, Artificial Sequence
  chemically synthesized
tccttataaattacccagcctc

SEQ ID NO: 735808 - DNA, 22 bp, Artificial Sequence
  chemically synthesized
ccttataaattacccagcctca

SEQ ID NO: 735809 - DNA, 22 bp, Artificial Sequence
  chemically synthesized
taaaggaatacctgaggctggg

SEQ ID NO: 735810 - DNA, 22 bp, Artificial Sequence
  chemically synthesized
cttataaattacccagcctcag

SEQ ID NO: 735811 - DNA, 22 bp, Artificial Sequence
  chemically synthesized
ataaattacccagcctcaggta

SEQ ID NO: 735812 - DNA, 22 bp, Artificial Sequence
  chemically synthesized
taaattacccagcctcaggtat

SEQ ID NO: 735813 - DNA, 22 bp, Artificial Sequence
  chemically synthesized
catcactataaaggaatacctg

SEQ ID NO: 735814 - DNA, 22 bp, Artificial Sequence
  chemically synthesized
gcatcactataaaggaatacct

SEQ ID NO: 735815 - DNA, 22 bp, Artificial Sequence
  chemically synthesized
cccagcctcaggtattccttta

SEQ ID NO: 735816 - DNA, 22 bp, Artificial Sequence
  chemically synthesized
catttgcatcactataaaggaa

SEQ ID NO: 735817 - DNA, 22 bp, Artificial Sequence
  chemically synthesized
attccatttgcatcactataaa

SEQ ID NO: 735818 - DNA, 22 bp, Artificial Sequence
  chemically synthesized
aggtattcctttatagtgatgc

SEQ ID NO: 735819 - DNA, 22 bp, Artificial Sequence
  chemically synthesized
tgttaattccatttgcatcact

SEQ ID NO: 735820 - DNA, 22 bp, Artificial Sequence
  chemically synthesized
atgttaattccatttgcatcac

SEQ ID NO: 735821 - DNA, 22 bp, Artificial Sequence
  chemically synthesized
tatgttaattccatttgcatca

SEQ ID NO: 735822 - DNA, 22 bp, Artificial Sequence
  chemically synthesized
ttatgttaattccatttgcatc

SEQ ID NO: 735823 - DNA, 22 bp, Artificial Sequence
  chemically synthesized
ctttatagtgatgcaaatggaa

SEQ ID NO: 735824 - DNA, 22 bp, Artificial Sequence
  chemically synthesized
ggtttttatgttaattccattt

SEQ ID NO: 735825 - DNA, 22 bp, Artificial Sequence
  chemically synthesized
tatagtgatgcaaatggaatta

SEQ ID NO: 735826 - DNA, 22 bp, Artificial Sequence
  chemically synthesized
atagtgatgcaaatggaattaa

SEQ ID NO: 735827 - DNA, 22 bp, Artificial Sequence
  chemically synthesized
tagtgatgcaaatggaattaac

SEQ ID NO: 735828 - DNA, 22 bp, Artificial Sequence
  chemically synthesized
tgttgggtttttatgttaattc

SEQ ID NO: 735829 - DNA, 22 bp, Artificial Sequence
  chemically synthesized
gtgttgggtttttatgttaatt

SEQ ID NO: 735830 - DNA, 22 bp, Artificial Sequence
  chemically synthesized
tgtgttgggtttttatgttaat

SEQ ID NO: 735831 - DNA, 22 bp, Artificial Sequence
  chemically synthesized
gtcaagacattttgtgttgggt

SEQ ID NO: 735832 - DNA, 22 bp, Artificial Sequence
  chemically synthesized
acataaaaacccaacacaaaat

SEQ ID NO: 735833 - DNA, 22 bp, Artificial Sequence
  chemically synthesized
actagtcaagacattttgtgtt

SEQ ID NO: 735834 - DNA, 22 bp, Artificial Sequence
  chemically synthesized
gactagtcaagacattttgtgt

SEQ ID NO: 735835 - DNA, 22 bp, Artificial Sequence
  chemically synthesized
tgggccttgactagtcaagaca

SEQ ID NO: 735836 - DNA, 22 bp, Artificial Sequence
  chemically synthesized
tgtgggccttgactagtcaaga

SEQ ID NO: 735837 - DNA, 22 bp, Artificial Sequence
  chemically synthesized
cctctgtgggccttgactagtc

SEQ ID NO: 735838 - DNA, 22 bp, Artificial Sequence
  chemically synthesized
gcctctgtgggccttgactagt

SEQ ID NO: 735839 - DNA, 22 bp, Artificial Sequence
  chemically synthesized
tgcctctgtgggccttgactag

SEQ ID NO: 735840 - DNA, 22 bp, Artificial Sequence
  chemically synthesized
gagcagctttgcctctgtgggc

SEQ ID NO: 735841 - DNA, 22 bp, Artificial Sequence
  chemically synthesized
gactagtcaaggcccacagagg

SEQ ID NO: 735842 - DNA, 22 bp, Artificial Sequence
  chemically synthesized
actagtcaaggcccacagaggc

SEQ ID NO: 735843 - DNA, 22 bp, Artificial Sequence
  chemically synthesized
gtcaaggcccacagaggcaaag

SEQ ID NO: 735844 - DNA, 22 bp, Artificial Sequence
  chemically synthesized
cccagtcctggagcagctttgc

SEQ ID NO: 735845 - DNA, 22 bp, Artificial Sequence
  chemically synthesized
gattacccagtcctggagcagc

SEQ ID NO: 735846 - DNA, 22 bp, Artificial Sequence
  chemically synthesized
tggattacccagtcctggagca

SEQ ID NO: 735847 - DNA, 22 bp, Artificial Sequence
  chemically synthesized
ctggattacccagtcctggagc

SEQ ID NO: 735848 - DNA, 22 bp, Artificial Sequence
  chemically synthesized
tgcttctggattacccagtcct

SEQ ID NO: 735849 - DNA, 22 bp, Artificial Sequence
  chemically synthesized
ctccaggactgggtaatccaga

SEQ ID NO: 735850 - DNA, 22 bp, Artificial Sequence
  chemically synthesized
caggactgggtaatccagaagc

SEQ ID NO: 735851 - DNA, 22 bp, Artificial Sequence
  chemically synthesized
gaataatgtcattgtgcttctg

SEQ ID NO: 735852 - DNA, 22 bp, Artificial Sequence
  chemically synthesized
ggtaatccagaagcacaatgac

SEQ ID NO: 735853 - DNA, 22 bp, Artificial Sequence
  chemically synthesized
ttccaggttcctcccatccttc

SEQ ID NO: 735854 - DNA, 22 bp, Artificial Sequence
  chemically synthesized
caggttcctcccatccttccat

SEQ ID NO: 735855 - DNA, 22 bp, Artificial Sequence
  chemically synthesized
accaagaatggcagaatggaag

SEQ ID NO: 735856 - DNA, 22 bp, Artificial Sequence
  chemically synthesized
ctcccatccttccattctgcca

SEQ ID NO: 735857 - DNA, 22 bp, Artificial Sequence
  chemically synthesized
ccatccttccattctgccattc

SEQ ID NO: 735858 - DNA, 22 bp, Artificial Sequence
  chemically synthesized
ccattctgccattcttggtgaa

SEQ ID NO: 735859 - DNA, 22 bp, Artificial Sequence
  chemically synthesized
cattctgccattcttggtgaac

SEQ ID NO: 735860 - DNA, 22 bp, Artificial Sequence
  chemically synthesized
tgagtatgtggacagttcacca

SEQ ID NO: 735861 - DNA, 22 bp, Artificial Sequence
  chemically synthesized
tgccattcttggtgaactgtcc

SEQ ID NO: 735862 - DNA, 22 bp, Artificial Sequence
  chemically synthesized
ccattcttggtgaactgtccac

SEQ ID NO: 735863 - DNA, 22 bp, Artificial Sequence
  chemically synthesized
cgttgtgagtatgtggacagtt

SEQ ID NO: 735864 - DNA, 22 bp, Artificial Sequence
  chemically synthesized
ttggtgaactgtccacatactc

SEQ ID NO: 735865 - DNA, 22 bp, Artificial Sequence
  chemically synthesized
ggtgaactgtccacatactcac

SEQ ID NO: 735866 - DNA, 22 bp, Artificial Sequence
  chemically synthesized
agtagctacgttgtgagtatgt

SEQ ID NO: 735867 - DNA, 22 bp, Artificial Sequence
  chemically synthesized
gtgaactgtccacatactcaca

SEQ ID NO: 735868 - DNA, 22 bp, Artificial Sequence
  chemically synthesized
cagtagctacgttgtgagtatg

SEQ ID NO: 735869 - DNA, 22 bp, Artificial Sequence
  chemically synthesized
tccacatactcacaacgtagct

SEQ ID NO: 735870 - DNA, 22 bp, Artificial Sequence
  chemically synthesized
acaacgtagctactgaaattct

SEQ ID NO: 735871 - DNA, 22 bp, Artificial Sequence
  chemically synthesized
aatgaacgagtgaatagatcag

SEQ ID NO: 735872 - DNA, 22 bp, Artificial Sequence
  chemically synthesized
ttgaatgaacgagtgaatagat

SEQ ID NO: 735873 - DNA, 22 bp, Artificial Sequence
  chemically synthesized
ctgaaattctgatctattcact

SEQ ID NO: 735874 - DNA, 22 bp, Artificial Sequence
  chemically synthesized
gttgaatgaacgagtgaataga

SEQ ID NO: 735875 - DNA, 22 bp, Artificial Sequence
  chemically synthesized
aaattctgatctattcactcgt

SEQ ID NO: 735876 - DNA, 22 bp, Artificial Sequence
  chemically synthesized
tgatctattcactcgttcattc

SEQ ID NO: 735877 - DNA, 22 bp, Artificial Sequence
  chemically synthesized
atctattcactcgttcattcaa

SEQ ID NO: 735878 - DNA, 22 bp, Artificial Sequence
  chemically synthesized
gcgtggtaaatatttgttgaat

SEQ ID NO: 735879 - DNA, 22 bp, Artificial Sequence
  chemically synthesized
ttcactcgttcattcaacaaat

SEQ ID NO: 735880 - DNA, 22 bp, Artificial Sequence
  chemically synthesized
agcgtggtaaatatttgttgaa

SEQ ID NO: 735881 - DNA, 22 bp, Artificial Sequence
  chemically synthesized
actcgttcattcaacaaatatt

SEQ ID NO: 735882 - DNA, 22 bp, Artificial Sequence
  chemically synthesized
gttcattcaacaaatatttacc

SEQ ID NO: 735883 - DNA, 22 bp, Artificial Sequence
  chemically synthesized
attcaacaaatatttaccacgc

SEQ ID NO: 735884 - DNA, 22 bp, Artificial Sequence
  chemically synthesized
agaatagatcttagcgtggtaa

SEQ ID NO: 735885 - DNA, 22 bp, Artificial Sequence
  chemically synthesized
aacaaatatttaccacgctaag

SEQ ID NO: 735886 - DNA, 22 bp, Artificial Sequence
  chemically synthesized
cctaagaatagatcttagcgtg

SEQ ID NO: 735887 - DNA, 22 bp, Artificial Sequence
  chemically synthesized
accacgctaagatctattctta

SEQ ID NO: 735888 - DNA, 22 bp, Artificial Sequence
  chemically synthesized
ccacgctaagatctattcttag

SEQ ID NO: 735889 - DNA, 22 bp, Artificial Sequence
  chemically synthesized
atgtatccaaattacctaagaa

SEQ ID NO: 735890 - DNA, 22 bp, Artificial Sequence
  chemically synthesized
gctaatgtatccaaattaccta

SEQ ID NO: 735891 - DNA, 22 bp, Artificial Sequence
  chemically synthesized
agatctattcttaggtaatttg

SEQ ID NO: 735892 - DNA, 22 bp, Artificial Sequence
  chemically synthesized
ttagctaatgtatccaaattac

SEQ ID NO: 735893 - DNA, 22 bp, Artificial Sequence
  chemically synthesized
gttagctaatgtatccaaatta

SEQ ID NO: 735894 - DNA, 22 bp, Artificial Sequence
  chemically synthesized
tgttagctaatgtatccaaatt

SEQ ID NO: 735895 - DNA, 22 bp, Artificial Sequence
  chemically synthesized
ttcttaggtaatttggatacat

SEQ ID NO: 735896 - DNA, 22 bp, Artificial Sequence
  chemically synthesized
ttttgttagctaatgtatccaa

SEQ ID NO: 735897 - DNA, 22 bp, Artificial Sequence
  chemically synthesized
ttaggtaatttggatacattag

SEQ ID NO: 735898 - DNA, 22 bp, Artificial Sequence
  chemically synthesized
tctgttttgttagctaatgtat

SEQ ID NO: 735899 - DNA, 22 bp, Artificial Sequence
  chemically synthesized
aggtaatttggatacattagct

SEQ ID NO: 735900 - DNA, 22 bp, Artificial Sequence
  chemically synthesized
ggtaatttggatacattagcta

SEQ ID NO: 735901 - DNA, 22 bp, Artificial Sequence
  chemically synthesized
ggatacattagctaacaaaaca

SEQ ID NO: 735902 - DNA, 22 bp, Artificial Sequence
  chemically synthesized
gatacattagctaacaaaacag

SEQ ID NO: 735903 - DNA, 22 bp, Artificial Sequence
  chemically synthesized
catgaggccagggatattgtct

SEQ ID NO: 735904 - DNA, 22 bp, Artificial Sequence
  chemically synthesized
gctaacaaaacagacaatatcc

SEQ ID NO: 735905 - DNA, 22 bp, Artificial Sequence
  chemically synthesized
acaaaacagacaatatccctgg

SEQ ID NO: 735906 - DNA, 22 bp, Artificial Sequence
  chemically synthesized
tgagaaggtgagctccatgagg

SEQ ID NO: 735907 - DNA, 22 bp, Artificial Sequence
  chemically synthesized
actatgagaaggtgagctccat

SEQ ID NO: 735908 - DNA, 22 bp, Artificial Sequence
  chemically synthesized
cactatgagaaggtgagctcca

SEQ ID NO: 735909 - DNA, 22 bp, Artificial Sequence
  chemically synthesized
tcactatgagaaggtgagctcc

SEQ ID NO: 735910 - DNA, 22 bp, Artificial Sequence
  chemically synthesized
tctttcactatgagaaggtgag

SEQ ID NO: 735911 - DNA, 22 bp, Artificial Sequence
  chemically synthesized
gcctcatggagctcaccttctc

SEQ ID NO: 735912 - DNA, 22 bp, Artificial Sequence
  chemically synthesized
aattgtctttcactatgagaag

SEQ ID NO: 735913 - DNA, 22 bp, Artificial Sequence
  chemically synthesized
atggagctcaccttctcatagt

SEQ ID NO: 735914 - DNA, 22 bp, Artificial Sequence
  chemically synthesized
aaattgtctttcactatgagaa

SEQ ID NO: 735915 - DNA, 22 bp, Artificial Sequence
  chemically synthesized
taaattgtctttcactatgaga

SEQ ID NO: 735916 - DNA, 22 bp, Artificial Sequence
  chemically synthesized
ttaaattgtctttcactatgag

SEQ ID NO: 735917 - DNA, 22 bp, Artificial Sequence
  chemically synthesized
tttaaattgtctttcactatga

SEQ ID NO: 735918 - DNA, 22 bp, Artificial Sequence
  chemically synthesized
ttttaaattgtctttcactatg

SEQ ID NO: 735919 - DNA, 22 bp, Artificial Sequence
  chemically synthesized
accttctcatagtgaaagacaa

SEQ ID NO: 735920 - DNA, 22 bp, Artificial Sequence
  chemically synthesized
atatacttttttaaattgtctt

SEQ ID NO: 735921 - DNA, 22 bp, Artificial Sequence
  chemically synthesized
ctcatagtgaaagacaatttaa

SEQ ID NO: 735922 - DNA, 22 bp, Artificial Sequence
  chemically synthesized
tcatagtgaaagacaatttaaa

SEQ ID NO: 735923 - DNA, 22 bp, Artificial Sequence
  chemically synthesized
atagtgaaagacaatttaaaaa

SEQ ID NO: 735924 - DNA, 22 bp, Artificial Sequence
  chemically synthesized
ccggcctaatatacttttttaa

SEQ ID NO: 735925 - DNA, 22 bp, Artificial Sequence
  chemically synthesized
aaaaaagtatattaggccggga

SEQ ID NO: 735926 - DNA, 22 bp, Artificial Sequence
  chemically synthesized
aaaaagtatattaggccgggag

SEQ ID NO: 735927 - DNA, 22 bp, Artificial Sequence
  chemically synthesized
caggcatgagccaccactcccg

SEQ ID NO: 735928 - DNA, 22 bp, Artificial Sequence
  chemically synthesized
ggattacaggcatgagccacca

SEQ ID NO: 735929 - DNA, 22 bp, Artificial Sequence
  chemically synthesized
ggccgggagtggtggctcatgc

SEQ ID NO: 735930 - DNA, 22 bp, Artificial Sequence
  chemically synthesized
ccaagtgctgggattacaggca

SEQ ID NO: 735931 - DNA, 22 bp, Artificial Sequence
  chemically synthesized
gcctcccaagtgctgggattac

SEQ ID NO: 735932 - DNA, 22 bp, Artificial Sequence
  chemically synthesized
ggcctcccaagtgctgggatta

SEQ ID NO: 735933 - DNA, 22 bp, Artificial Sequence
  chemically synthesized
atgcctgtaatcccagcacttg

SEQ ID NO: 735934 - DNA, 22 bp, Artificial Sequence
  chemically synthesized
cccgccttggcctcccaagtgc

SEQ ID NO: 735935 - DNA, 22 bp, Artificial Sequence
  chemically synthesized
taatcccagcacttgggaggcc

SEQ ID NO: 735936 - DNA, 22 bp, Artificial Sequence
  chemically synthesized
gtgatctgcccgccttggcctc

SEQ ID NO: 735937 - DNA, 22 bp, Artificial Sequence
  chemically synthesized
acctcgtgatctgcccgccttg

SEQ ID NO: 735938 - DNA, 22 bp, Artificial Sequence
  chemically synthesized
ctgacctcgtgatctgcccgcc

SEQ ID NO: 735939 - DNA, 22 bp, Artificial Sequence
  chemically synthesized
gggaggccaaggcgggcagatc

SEQ ID NO: 735940 - DNA, 22 bp, Artificial Sequence
  chemically synthesized
ggaggccaaggcgggcagatca

SEQ ID NO: 735941 - DNA, 22 bp, Artificial Sequence
  chemically synthesized
gaactcctgacctcgtgatctg

SEQ ID NO: 735942 - DNA, 22 bp, Artificial Sequence
  chemically synthesized
gtctcgaactcctgacctcgtg

SEQ ID NO: 735943 - DNA, 22 bp, Artificial Sequence
  chemically synthesized
gccaggctggtctcgaactcct

SEQ ID NO: 735944 - DNA, 22 bp, Artificial Sequence
  chemically synthesized
accatgctggccaggctggtct

SEQ ID NO: 735945 - DNA, 22 bp, Artificial Sequence
  chemically synthesized
caccatgctggccaggctggtc

SEQ ID NO: 735946 - DNA, 22 bp, Artificial Sequence
  chemically synthesized
gagaccagcctggccagcatgg

SEQ ID NO: 735947 - DNA, 22 bp, Artificial Sequence
  chemically synthesized
gtagagacggggtttcaccatg

SEQ ID NO: 735948 - DNA, 22 bp, Artificial Sequence
  chemically synthesized
agtagagacggggtttcaccat

SEQ ID NO: 735949 - DNA, 22 bp, Artificial Sequence
  chemically synthesized
tagtagagacggggtttcacca

SEQ ID NO: 735950 - DNA, 22 bp, Artificial Sequence
  chemically synthesized
ttagtagagacggggtttcacc

SEQ ID NO: 735951 - DNA, 22 bp, Artificial Sequence
  chemically synthesized
tttttagtagagacggggtttc

SEQ ID NO: 735952 - DNA, 22 bp, Artificial Sequence
  chemically synthesized
gccagcatggtgaaaccccgtc

SEQ ID NO: 735953 - DNA, 22 bp, Artificial Sequence
  chemically synthesized
atttttagtagagacggggttt

SEQ ID NO: 735954 - DNA, 22 bp, Artificial Sequence
  chemically synthesized
tatttttagtagagacggggtt

SEQ ID NO: 735955 - DNA, 22 bp, Artificial Sequence
  chemically synthesized
ttatttttagtagagacggggt

SEQ ID NO: 735956 - DNA, 22 bp, Artificial Sequence
  chemically synthesized
tttatttttagtagagacgggg

SEQ ID NO: 735957 - DNA, 22 bp, Artificial Sequence
  chemically synthesized
ttttatttttagtagagacggg

SEQ ID NO: 735958 - DNA, 22 bp, Artificial Sequence
  chemically synthesized
tttttatttttagtagagacgg

SEQ ID NO: 735959 - DNA, 22 bp, Artificial Sequence
  chemically synthesized
ttttttatttttagtagagacg

SEQ ID NO: 735960 - DNA, 22 bp, Artificial Sequence
  chemically synthesized
gtttttttttatttttagtaga

SEQ ID NO: 735961 - DNA, 22 bp, Artificial Sequence
  chemically synthesized
tactaaaaataaaaaaaaacta

SEQ ID NO: 735962 - DNA, 22 bp, Artificial Sequence
  chemically synthesized
ctaaaaataaaaaaaaactagc

SEQ ID NO: 735963 - DNA, 22 bp, Artificial Sequence
  chemically synthesized
aaaataaaaaaaaactagctgg

SEQ ID NO: 735964 - DNA, 22 bp, Artificial Sequence
  chemically synthesized
caggcatccaccaccacgccca

SEQ ID NO: 735965 - DNA, 22 bp, Artificial Sequence
  chemically synthesized
ggactacaggcatccaccacca

SEQ ID NO: 735966 - DNA, 22 bp, Artificial Sequence
  chemically synthesized
gctgggcgtggtggtggatgcc

SEQ ID NO: 735967 - DNA, 22 bp, Artificial Sequence
  chemically synthesized
ggcgtggtggtggatgcctgta

SEQ ID NO: 735968 - DNA, 22 bp, Artificial Sequence
  chemically synthesized
ccgagtagctgggactacaggc

SEQ ID NO: 735969 - DNA, 22 bp, Artificial Sequence
  chemically synthesized
agcctcccgagtagctgggact

SEQ ID NO: 735970 - DNA, 22 bp, Artificial Sequence
  chemically synthesized
cctcagcctcccgagtagctgg

SEQ ID NO: 735971 - DNA, 22 bp, Artificial Sequence
  chemically synthesized
ctgcctcagcctcccgagtagc

SEQ ID NO: 735972 - DNA, 22 bp, Artificial Sequence
  chemically synthesized
tcctgcctcagcctcccgagta

SEQ ID NO: 735973 - DNA, 22 bp, Artificial Sequence
  chemically synthesized
tagtcccagctactcgggaggc

SEQ ID NO: 735974 - DNA, 22 bp, Artificial Sequence
  chemically synthesized
aagtaattctcctgcctcagcc

SEQ ID NO: 735975 - DNA, 22 bp, Artificial Sequence
  chemically synthesized
ctcgggaggctgaggcaggaga

SEQ ID NO: 735976 - DNA, 22 bp, Artificial Sequence
  chemically synthesized
ggttcaagtaattctcctgcct

SEQ ID NO: 735977 - DNA, 22 bp, Artificial Sequence
  chemically synthesized
gggaggctgaggcaggagaatt

SEQ ID NO: 735978 - DNA, 22 bp, Artificial Sequence
  chemically synthesized
ctgggttcaagtaattctcctg

SEQ ID NO: 735979 - DNA, 22 bp, Artificial Sequence
  chemically synthesized
cgcctgctgggttcaagtaatt

SEQ ID NO: 735980 - DNA, 22 bp, Artificial Sequence
  chemically synthesized
aggcaggagaattacttgaacc

SEQ ID NO: 735981 - DNA, 22 bp, Artificial Sequence
  chemically synthesized
caacctccgcctgctgggttca

SEQ ID NO: 735982 - DNA, 22 bp, Artificial Sequence
  chemically synthesized
actgcaacctccgcctgctggg

SEQ ID NO: 735983 - DNA, 22 bp, Artificial Sequence
  chemically synthesized
agctcactgcaacctccgcctg

SEQ ID NO: 735984 - DNA, 22 bp, Artificial Sequence
  chemically synthesized
cttgaacccagcaggcggaggt

SEQ ID NO: 735985 - DNA, 22 bp, Artificial Sequence
  chemically synthesized
gaacccagcaggcggaggttgc

SEQ ID NO: 735986 - DNA, 22 bp, Artificial Sequence
  chemically synthesized
aacccagcaggcggaggttgca

SEQ ID NO: 735987 - DNA, 22 bp, Artificial Sequence
  chemically synthesized
gagtgcagtggcatgatctcag

SEQ ID NO: 735988 - DNA, 22 bp, Artificial Sequence
  chemically synthesized
cagtgagctgagatcatgccac

SEQ ID NO: 735989 - DNA, 22 bp, Artificial Sequence
  chemically synthesized
tcgcccaggctggagtgcagtg

SEQ ID NO: 735990 - DNA, 22 bp, Artificial Sequence
  chemically synthesized
agatcatgccactgcactccag

SEQ ID NO: 735991 - DNA, 22 bp, Artificial Sequence
  chemically synthesized
aatctgtcgcccaggctggagt

SEQ ID NO: 735992 - DNA, 22 bp, Artificial Sequence
  chemically synthesized
cactccagcctgggcgacagat

SEQ ID NO: 735993 - DNA, 22 bp, Artificial Sequence
  chemically synthesized
agatggagtctcaatctgtcgc

SEQ ID NO: 735994 - DNA, 22 bp, Artificial Sequence
  chemically synthesized
gagatggagtctcaatctgtcg

SEQ ID NO: 735995 - DNA, 22 bp, Artificial Sequence
  chemically synthesized
tgagatggagtctcaatctgtc

SEQ ID NO: 735996 - DNA, 22 bp, Artificial Sequence
  chemically synthesized
ttgagatggagtctcaatctgt

SEQ ID NO: 735997 - DNA, 22 bp, Artificial Sequence
  chemically synthesized
cagcctgggcgacagattgaga

SEQ ID NO: 735998 - DNA, 22 bp, Artificial Sequence
  chemically synthesized
tttgagatggagtctcaatctg

SEQ ID NO: 735999 - DNA, 22 bp, Artificial Sequence
  chemically synthesized
ttttgagatggagtctcaatct

SEQ ID NO: 736000 - DNA, 22 bp, Artificial Sequence
  chemically synthesized
tttttgagatggagtctcaatc

SEQ ID NO: 736001 - DNA, 22 bp, Artificial Sequence
  chemically synthesized
ttttttgagatggagtctcaat

SEQ ID NO: 736002 - DNA, 22 bp, Artificial Sequence
  chemically synthesized
tttttttgagatggagtctcaa

SEQ ID NO: 736003 - DNA, 22 bp, Artificial Sequence
  chemically synthesized
ttttttttgagatggagtctca

SEQ ID NO: 736004 - DNA, 22 bp, Artificial Sequence
  chemically synthesized
tttttttttgagatggagtctc

SEQ ID NO: 736005 - DNA, 22 bp, Artificial Sequence
  chemically synthesized
ggcgacagattgagactccatc

SEQ ID NO: 736006 - DNA, 22 bp, Artificial Sequence
  chemically synthesized
ttttttttttgagatggagtct

SEQ ID NO: 736007 - DNA, 22 bp, Artificial Sequence
  chemically synthesized
tttttttttttgagatggagtc

SEQ ID NO: 736008 - DNA, 22 bp, Artificial Sequence
  chemically synthesized
ttttttttttttgagatggagt

SEQ ID NO: 736009 - DNA, 22 bp, Artificial Sequence
  chemically synthesized
tttttttttttttgagatggag

SEQ ID NO: 736010 - DNA, 22 bp, Artificial Sequence
  chemically synthesized
agactccatctcaaaaaaaaaa

SEQ ID NO: 736011 - DNA, 22 bp, Artificial Sequence
  chemically synthesized
catctcaaaaaaaaaaaaaaag

SEQ ID NO: 736012 - DNA, 22 bp, Artificial Sequence
  chemically synthesized
acatgtgtaatatacttttttt

SEQ ID NO: 736013 - DNA, 22 bp, Artificial Sequence
  chemically synthesized
aaaaaaaaaaaaaaagtatatt

SEQ ID NO: 736014 - DNA, 22 bp, Artificial Sequence
  chemically synthesized
caggattaacatgtgtaatata

SEQ ID NO: 736015 - DNA, 22 bp, Artificial Sequence
  chemically synthesized
tgcaggattaacatgtgtaata

SEQ ID NO: 736016 - DNA, 22 bp, Artificial Sequence
  chemically synthesized
attctgcaggattaacatgtgt

SEQ ID NO: 736017 - DNA, 22 bp, Artificial Sequence
  chemically synthesized
tcatacactcattctgcaggat

SEQ ID NO: 736018 - DNA, 22 bp, Artificial Sequence
  chemically synthesized
cacatgttaatcctgcagaatg

SEQ ID NO: 736019 - DNA, 22 bp, Artificial Sequence
  chemically synthesized
ctatcatacactcattctgcag

SEQ ID NO: 736020 - DNA, 22 bp, Artificial Sequence
  chemically synthesized
cctatcatacactcattctgca

SEQ ID NO: 736021 - DNA, 22 bp, Artificial Sequence
  chemically synthesized
tcctatcatacactcattctgc

SEQ ID NO: 736022 - DNA, 22 bp, Artificial Sequence
  chemically synthesized
ttcctatcatacactcattctg

SEQ ID NO: 736023 - DNA, 22 bp, Artificial Sequence
  chemically synthesized
gtttttcctatcatacactcat

SEQ ID NO: 736024 - DNA, 22 bp, Artificial Sequence
  chemically synthesized
atcctgcagaatgagtgtatga

SEQ ID NO: 736025 - DNA, 22 bp, Artificial Sequence
  chemically synthesized
tggtttttcctatcatacactc

SEQ ID NO: 736026 - DNA, 22 bp, Artificial Sequence
  chemically synthesized
ctggtttttcctatcatacact

SEQ ID NO: 736027 - DNA, 22 bp, Artificial Sequence
  chemically synthesized
tctggtttttcctatcatacac

SEQ ID NO: 736028 - DNA, 22 bp, Artificial Sequence
  chemically synthesized
ttctggtttttcctatcataca

SEQ ID NO: 736029 - DNA, 22 bp, Artificial Sequence
  chemically synthesized
tttctggtttttcctatcatac

SEQ ID NO: 736030 - DNA, 22 bp, Artificial Sequence
  chemically synthesized
cagaatgagtgtatgataggaa

SEQ ID NO: 736031 - DNA, 22 bp, Artificial Sequence
  chemically synthesized
ttttttctggtttttcctatca

SEQ ID NO: 736032 - DNA, 22 bp, Artificial Sequence
  chemically synthesized
tcctgttttttctggtttttcc

SEQ ID NO: 736033 - DNA, 22 bp, Artificial Sequence
  chemically synthesized
gggtgatatatagcaaaaggaa

SEQ ID NO: 736034 - DNA, 22 bp, Artificial Sequence
  chemically synthesized
tagggtgatatatagcaaaagg

SEQ ID NO: 736035 - DNA, 22 bp, Artificial Sequence
  chemically synthesized
gccagtaagttctagggtgata

SEQ ID NO: 736036 - DNA, 22 bp, Artificial Sequence
  chemically synthesized
cttttgctatatatcaccctag

SEQ ID NO: 736037 - DNA, 22 bp, Artificial Sequence
  chemically synthesized
agccagtaagttctagggtgat

SEQ ID NO: 736038 - DNA, 22 bp, Artificial Sequence
  chemically synthesized
tagccagtaagttctagggtga

SEQ ID NO: 736039 - DNA, 22 bp, Artificial Sequence
  chemically synthesized
ttagccagtaagttctagggtg

SEQ ID NO: 736040 - DNA, 22 bp, Artificial Sequence
  chemically synthesized
ttgctatatatcaccctagaac

SEQ ID NO: 736041 - DNA, 22 bp, Artificial Sequence
  chemically synthesized
tgctatatatcaccctagaact

SEQ ID NO: 736042 - DNA, 22 bp, Artificial Sequence
  chemically synthesized
gctatatatcaccctagaactt

SEQ ID NO: 736043 - DNA, 22 bp, Artificial Sequence
  chemically synthesized
tttttagccagtaagttctagg

SEQ ID NO: 736044 - DNA, 22 bp, Artificial Sequence
  chemically synthesized
ctatatatcaccctagaactta

SEQ ID NO: 736045 - DNA, 22 bp, Artificial Sequence
  chemically synthesized
tatatcaccctagaacttactg

SEQ ID NO: 736046 - DNA, 22 bp, Artificial Sequence
  chemically synthesized
ataaatggttatttttagccag

SEQ ID NO: 736047 - DNA, 22 bp, Artificial Sequence
  chemically synthesized
gaacttactggctaaaaataac

SEQ ID NO: 736048 - DNA, 22 bp, Artificial Sequence
  chemically synthesized
actggctaaaaataaccattta

SEQ ID NO: 736049 - DNA, 22 bp, Artificial Sequence
  chemically synthesized
ctggctaaaaataaccatttat

SEQ ID NO: 736050 - DNA, 22 bp, Artificial Sequence
  chemically synthesized
gctaaaaataaccatttatcag

SEQ ID NO: 736051 - DNA, 22 bp, Artificial Sequence
  chemically synthesized
aaaataaccatttatcagtatt

SEQ ID NO: 736052 - DNA, 22 bp, Artificial Sequence
  chemically synthesized
acagaaccatgagcaatactga

SEQ ID NO: 736053 - DNA, 22 bp, Artificial Sequence
  chemically synthesized
atcagtattgctcatggttctg

SEQ ID NO: 736054 - DNA, 22 bp, Artificial Sequence
  chemically synthesized
tcagtattgctcatggttctgt

SEQ ID NO: 736055 - DNA, 22 bp, Artificial Sequence
  chemically synthesized
agcacagtcaactcacagaacc

SEQ ID NO: 736056 - DNA, 22 bp, Artificial Sequence
  chemically synthesized
ctcatggttctgtgagttgact

SEQ ID NO: 736057 - DNA, 22 bp, Artificial Sequence
  chemically synthesized
atggttctgtgagttgactgtg

SEQ ID NO: 736058 - DNA, 22 bp, Artificial Sequence
  chemically synthesized
tgtgagttgactgtgctcaggt

SEQ ID NO: 736059 - DNA, 22 bp, Artificial Sequence
  chemically synthesized
tgagttgactgtgctcaggtgg

SEQ ID NO: 736060 - DNA, 22 bp, Artificial Sequence
  chemically synthesized
actgtgctcaggtgggtgtttc

SEQ ID NO: 736061 - DNA, 22 bp, Artificial Sequence
  chemically synthesized
tgctcaggtgggtgtttcttgc

SEQ ID NO: 736062 - DNA, 22 bp, Artificial Sequence
  chemically synthesized
aggtgggtgtttcttgcttggg

SEQ ID NO: 736063 - DNA, 22 bp, Artificial Sequence
  chemically synthesized
caaacacatgaaagaacccaag

SEQ ID NO: 736064 - DNA, 22 bp, Artificial Sequence
  chemically synthesized
actgcaaacacatgaaagaacc

SEQ ID NO: 736065 - DNA, 22 bp, Artificial Sequence
  chemically synthesized
cttgcttgggttctttcatgtg

SEQ ID NO: 736066 - DNA, 22 bp, Artificial Sequence
  chemically synthesized
tctgactgcaaacacatgaaag

SEQ ID NO: 736067 - DNA, 22 bp, Artificial Sequence
  chemically synthesized
ttgcttgggttctttcatgtgt

SEQ ID NO: 736068 - DNA, 22 bp, Artificial Sequence
  chemically synthesized
gcttgggttctttcatgtgttt

SEQ ID NO: 736069 - DNA, 22 bp, Artificial Sequence
  chemically synthesized
ctatctgactgcaaacacatga

SEQ ID NO: 736070 - DNA, 22 bp, Artificial Sequence
  chemically synthesized
cttgggttctttcatgtgtttg

SEQ ID NO: 736071 - DNA, 22 bp, Artificial Sequence
  chemically synthesized
gggttctttcatgtgtttgcag

SEQ ID NO: 736072 - DNA, 22 bp, Artificial Sequence
  chemically synthesized
gctactatctgactgcaaacac

SEQ ID NO: 736073 - DNA, 22 bp, Artificial Sequence
  chemically synthesized
ggttctttcatgtgtttgcagt

SEQ ID NO: 736074 - DNA, 22 bp, Artificial Sequence
  chemically synthesized
ggctactatctgactgcaaaca

SEQ ID NO: 736075 - DNA, 22 bp, Artificial Sequence
  chemically synthesized
tggctactatctgactgcaaac

SEQ ID NO: 736076 - DNA, 22 bp, Artificial Sequence
  chemically synthesized
tttcatgtgtttgcagtcagat

SEQ ID NO: 736077 - DNA, 22 bp, Artificial Sequence
  chemically synthesized
agctttggctactatctgactg

SEQ ID NO: 736078 - DNA, 22 bp, Artificial Sequence
  chemically synthesized
tcatgtgtttgcagtcagatag

SEQ ID NO: 736079 - DNA, 22 bp, Artificial Sequence
  chemically synthesized
catgtgtttgcagtcagatagt

SEQ ID NO: 736080 - DNA, 22 bp, Artificial Sequence
  chemically synthesized
atgtgtttgcagtcagatagta

SEQ ID NO: 736081 - DNA, 22 bp, Artificial Sequence
  chemically synthesized
agatcaattcagctttggctac

SEQ ID NO: 736082 - DNA, 22 bp, Artificial Sequence
  chemically synthesized
gcagtcagatagtagccaaagc

SEQ ID NO: 736083 - DNA, 22 bp, Artificial Sequence
  chemically synthesized
cagatcaattcagctttggcta

SEQ ID NO: 736084 - DNA, 22 bp, Artificial Sequence
  chemically synthesized
cagtcagatagtagccaaagct

SEQ ID NO: 736085 - DNA, 22 bp, Artificial Sequence
  chemically synthesized
caatggagccttcagatcaatt

SEQ ID NO: 736086 - DNA, 22 bp, Artificial Sequence
  chemically synthesized
aattgatctgaaggctccattg

SEQ ID NO: 736087 - DNA, 22 bp, Artificial Sequence
  chemically synthesized
taacagccattccaatggagcc

SEQ ID NO: 736088 - DNA, 22 bp, Artificial Sequence
  chemically synthesized
atctgaaggctccattggaatg

SEQ ID NO: 736089 - DNA, 22 bp, Artificial Sequence
  chemically synthesized
aaggctccattggaatggctgt

SEQ ID NO: 736090 - DNA, 22 bp, Artificial Sequence
  chemically synthesized
cattggaatggctgttacagtt

SEQ ID NO: 736091 - DNA, 22 bp, Artificial Sequence
  chemically synthesized
gaatggctgttacagttttttc

SEQ ID NO: 736092 - DNA, 22 bp, Artificial Sequence
  chemically synthesized
ttacagttttttcacttgtaca

SEQ ID NO: 736093 - DNA, 22 bp, Artificial Sequence
  chemically synthesized
cagttttttcacttgtacatct

SEQ ID NO: 736094 - DNA, 22 bp, Artificial Sequence
  chemically synthesized
tttcacttgtacatctggctcc

SEQ ID NO: 736095 - DNA, 22 bp, Artificial Sequence
  chemically synthesized
ttcacttgtacatctggctcct

SEQ ID NO: 736096 - DNA, 22 bp, Artificial Sequence
  chemically synthesized
tcacttgtacatctggctcctc

SEQ ID NO: 736097 - DNA, 22 bp, Artificial Sequence
  chemically synthesized
cacttgtacatctggctcctca

SEQ ID NO: 736098 - DNA, 22 bp, Artificial Sequence
  chemically synthesized
acttgtacatctggctcctcac

SEQ ID NO: 736099 - DNA, 22 bp, Artificial Sequence
  chemically synthesized
gtacatctggctcctcacttgg

SEQ ID NO: 736100 - DNA, 22 bp, Artificial Sequence
  chemically synthesized
tacatctggctcctcacttggg

SEQ ID NO: 736101 - DNA, 22 bp, Artificial Sequence
  chemically synthesized
gccgaagatccgcagccatccc

SEQ ID NO: 736102 - DNA, 22 bp, Artificial Sequence
  chemically synthesized
gctcctcacttgggatggctgc

SEQ ID NO: 736103 - DNA, 22 bp, Artificial Sequence
  chemically synthesized
ttggccgaagatccgcagccat

SEQ ID NO: 736104 - DNA, 22 bp, Artificial Sequence
  chemically synthesized
ctcacttgggatggctgcggat

SEQ ID NO: 736105 - DNA, 22 bp, Artificial Sequence
  chemically synthesized
acttgggatggctgcggatctt

SEQ ID NO: 736106 - DNA, 22 bp, Artificial Sequence
  chemically synthesized
gggatggctgcggatcttcggc

SEQ ID NO: 736107 - DNA, 22 bp, Artificial Sequence
  chemically synthesized
ggatggctgcggatcttcggcc

SEQ ID NO: 736108 - DNA, 22 bp, Artificial Sequence
  chemically synthesized
gcccccagctgttggccgaaga

SEQ ID NO: 736109 - DNA, 22 bp, Artificial Sequence
  chemically synthesized
cggatcttcggccaacagctgg

SEQ ID NO: 736110 - DNA, 22 bp, Artificial Sequence
  chemically synthesized
cggccaacagctgggggctagc

SEQ ID NO: 736111 - DNA, 22 bp, Artificial Sequence
  chemically synthesized
ggccaacagctgggggctagcc

SEQ ID NO: 736112 - DNA, 22 bp, Artificial Sequence
  chemically synthesized
catggaaagacaaatacgtggc

SEQ ID NO: 736113 - DNA, 22 bp, Artificial Sequence
  chemically synthesized
ggggctagccacgtatttgtct

SEQ ID NO: 736114 - DNA, 22 bp, Artificial Sequence
  chemically synthesized
gccacgtatttgtctttccatg

SEQ ID NO: 736115 - DNA, 22 bp, Artificial Sequence
  chemically synthesized
gccacatggggaagctgcatgg

SEQ ID NO: 736116 - DNA, 22 bp, Artificial Sequence
  chemically synthesized
agctagccacatggggaagctg

SEQ ID NO: 736117 - DNA, 22 bp, Artificial Sequence
  chemically synthesized
gtctttccatgcagcttcccca

SEQ ID NO: 736118 - DNA, 22 bp, Artificial Sequence
  chemically synthesized
tctttccatgcagcttccccat

SEQ ID NO: 736119 - DNA, 22 bp, Artificial Sequence
  chemically synthesized
tccatgcagcttccccatgtgg

SEQ ID NO: 736120 - DNA, 22 bp, Artificial Sequence
  chemically synthesized
ccatgcagcttccccatgtggc

SEQ ID NO: 736121 - DNA, 22 bp, Artificial Sequence
  chemically synthesized
catgcagcttccccatgtggct

SEQ ID NO: 736122 - DNA, 22 bp, Artificial Sequence
  chemically synthesized
ccccatgtggctagcttagatt

SEQ ID NO: 736123 - DNA, 22 bp, Artificial Sequence
  chemically synthesized
cccatgtggctagcttagattt

SEQ ID NO: 736124 - DNA, 22 bp, Artificial Sequence
  chemically synthesized
catgaagaagccacaaatctaa

SEQ ID NO: 736125 - DNA, 22 bp, Artificial Sequence
  chemically synthesized
tctacatgaagaagccacaaat

SEQ ID NO: 736126 - DNA, 22 bp, Artificial Sequence
  chemically synthesized
tgctgtctacatgaagaagcca

SEQ ID NO: 736127 - DNA, 22 bp, Artificial Sequence
  chemically synthesized
gcttagatttgtggcttcttca

SEQ ID NO: 736128 - DNA, 22 bp, Artificial Sequence
  chemically synthesized
agatttgtggcttcttcatgta

SEQ ID NO: 736129 - DNA, 22 bp, Artificial Sequence
  chemically synthesized
gatttgtggcttcttcatgtag

SEQ ID NO: 736130 - DNA, 22 bp, Artificial Sequence
  chemically synthesized
aggccactgtgctgtctacatg

SEQ ID NO: 736131 - DNA, 22 bp, Artificial Sequence
  chemically synthesized
gtggcttcttcatgtagacagc

SEQ ID NO: 736132 - DNA, 22 bp, Artificial Sequence
  chemically synthesized
taaggccactgtgctgtctaca

SEQ ID NO: 736133 - DNA, 22 bp, Artificial Sequence
  chemically synthesized
tggcttcttcatgtagacagca

SEQ ID NO: 736134 - DNA, 22 bp, Artificial Sequence
  chemically synthesized
ctctaaggccactgtgctgtct

SEQ ID NO: 736135 - DNA, 22 bp, Artificial Sequence
  chemically synthesized
cttcatgtagacagcacagtgg

SEQ ID NO: 736136 - DNA, 22 bp, Artificial Sequence
  chemically synthesized
ttcatgtagacagcacagtggc

SEQ ID NO: 736137 - DNA, 22 bp, Artificial Sequence
  chemically synthesized
agtctactctaaggccactgtg

SEQ ID NO: 736138 - DNA, 22 bp, Artificial Sequence
  chemically synthesized
catgtagacagcacagtggcct

SEQ ID NO: 736139 - DNA, 22 bp, Artificial Sequence
  chemically synthesized
atgtagacagcacagtggcctt

SEQ ID NO: 736140 - DNA, 22 bp, Artificial Sequence
  chemically synthesized
tactaagtctactctaaggcca

SEQ ID NO: 736141 - DNA, 22 bp, Artificial Sequence
  chemically synthesized
ccctgtactaagtctactctaa

SEQ ID NO: 736142 - DNA, 22 bp, Artificial Sequence
  chemically synthesized
agagtagacttagtacagggca

SEQ ID NO: 736143 - DNA, 22 bp, Artificial Sequence
  chemically synthesized
gggaaagtgatctgccctgtac

SEQ ID NO: 736144 - DNA, 22 bp, Artificial Sequence
  chemically synthesized
gagtagacttagtacagggcag

SEQ ID NO: 736145 - DNA, 22 bp, Artificial Sequence
  chemically synthesized
tggggaaagtgatctgccctgt

SEQ ID NO: 736146 - DNA, 22 bp, Artificial Sequence
  chemically synthesized
actctggggaaagtgatctgcc

SEQ ID NO: 736147 - DNA, 22 bp, Artificial Sequence
  chemically synthesized
agtacagggcagatcactttcc

SEQ ID NO: 736148 - DNA, 22 bp, Artificial Sequence
  chemically synthesized
gtacagggcagatcactttccc

SEQ ID NO: 736149 - DNA, 22 bp, Artificial Sequence
  chemically synthesized
gaatgctcactctggggaaagt

SEQ ID NO: 736150 - DNA, 22 bp, Artificial Sequence
  chemically synthesized
tggaatgctcactctggggaaa

SEQ ID NO: 736151 - DNA, 22 bp, Artificial Sequence
  chemically synthesized
ctggaatgctcactctggggaa

SEQ ID NO: 736152 - DNA, 22 bp, Artificial Sequence
  chemically synthesized
gtcttctggaatgctcactctg

SEQ ID NO: 736153 - DNA, 22 bp, Artificial Sequence
  chemically synthesized
ggtcttctggaatgctcactct

SEQ ID NO: 736154 - DNA, 22 bp, Artificial Sequence
  chemically synthesized
tcttggtcttctggaatgctca

SEQ ID NO: 736155 - DNA, 22 bp, Artificial Sequence
  chemically synthesized
tgtcttggtcttctggaatgct

SEQ ID NO: 736156 - DNA, 22 bp, Artificial Sequence
  chemically synthesized
tccccagagtgagcattccaga

SEQ ID NO: 736157 - DNA, 22 bp, Artificial Sequence
  chemically synthesized
ctgtcttggtcttctggaatgc

SEQ ID NO: 736158 - DNA, 22 bp, Artificial Sequence
  chemically synthesized
ccccagagtgagcattccagaa

SEQ ID NO: 736159 - DNA, 22 bp, Artificial Sequence
  chemically synthesized
cccagagtgagcattccagaag

SEQ ID NO: 736160 - DNA, 22 bp, Artificial Sequence
  chemically synthesized
tagcttctgtcttggtcttctg

SEQ ID NO: 736161 - DNA, 22 bp, Artificial Sequence
  chemically synthesized
gtagcttctgtcttggtcttct

SEQ ID NO: 736162 - DNA, 22 bp, Artificial Sequence
  chemically synthesized
cagaagaccaagacagaagcta

SEQ ID NO: 736163 - DNA, 22 bp, Artificial Sequence
  chemically synthesized
aataagaaggagtcttgtagct

SEQ ID NO: 736164 - DNA, 22 bp, Artificial Sequence
  chemically synthesized
aaagctaaataagaaggagtct

SEQ ID NO: 736165 - DNA, 22 bp, Artificial Sequence
  chemically synthesized
caagactccttcttatttagct

SEQ ID NO: 736166 - DNA, 22 bp, Artificial Sequence
  chemically synthesized
caagaagttcaaagctaaataa

SEQ ID NO: 736167 - DNA, 22 bp, Artificial Sequence
  chemically synthesized
tgcaagaagttcaaagctaaat

SEQ ID NO: 736168 - DNA, 22 bp, Artificial Sequence
  chemically synthesized
attctgcaagaagttcaaagct

SEQ ID NO: 736169 - DNA, 22 bp, Artificial Sequence
  chemically synthesized
cttcttatttagctttgaactt

SEQ ID NO: 736170 - DNA, 22 bp, Artificial Sequence
  chemically synthesized
cttatttagctttgaacttctt

SEQ ID NO: 736171 - DNA, 22 bp, Artificial Sequence
  chemically synthesized
ttatttagctttgaacttcttg

SEQ ID NO: 736172 - DNA, 22 bp, Artificial Sequence
  chemically synthesized
atttagctttgaacttcttgca

SEQ ID NO: 736173 - DNA, 22 bp, Artificial Sequence
  chemically synthesized
tttagctttgaacttcttgcag

SEQ ID NO: 736174 - DNA, 22 bp, Artificial Sequence
  chemically synthesized
agctttgaacttcttgcagaat

SEQ ID NO: 736175 - DNA, 22 bp, Artificial Sequence
  chemically synthesized
gctttgaacttcttgcagaatc

SEQ ID NO: 736176 - DNA, 22 bp, Artificial Sequence
  chemically synthesized
aaggaggtagaattgattctgc

SEQ ID NO: 736177 - DNA, 22 bp, Artificial Sequence
  chemically synthesized
tgaacttcttgcagaatcaatt

SEQ ID NO: 736178 - DNA, 22 bp, Artificial Sequence
  chemically synthesized
gaacttcttgcagaatcaattc

SEQ ID NO: 736179 - DNA, 22 bp, Artificial Sequence
  chemically synthesized
aacttcttgcagaatcaattct

SEQ ID NO: 736180 - DNA, 22 bp, Artificial Sequence
  chemically synthesized
cttgcagaatcaattctacctc

SEQ ID NO: 736181 - DNA, 22 bp, Artificial Sequence
  chemically synthesized
ttgcagaatcaattctacctcc

SEQ ID NO: 736182 - DNA, 22 bp, Artificial Sequence
  chemically synthesized
gcagaatcaattctacctcctt

SEQ ID NO: 736183 - DNA, 22 bp, Artificial Sequence
  chemically synthesized
tacaacaaactgaaggaggtag

SEQ ID NO: 736184 - DNA, 22 bp, Artificial Sequence
  chemically synthesized
cagaatcaattctacctccttc

SEQ ID NO: 736185 - DNA, 22 bp, Artificial Sequence
  chemically synthesized
ctgtacaacaaactgaaggagg

SEQ ID NO: 736186 - DNA, 22 bp, Artificial Sequence
  chemically synthesized
ctcctgtacaacaaactgaagg

SEQ ID NO: 736187 - DNA, 22 bp, Artificial Sequence
  chemically synthesized
ggctgctcctgtacaacaaact

SEQ ID NO: 736188 - DNA, 22 bp, Artificial Sequence
  chemically synthesized
tacctccttcagtttgttgtac

SEQ ID NO: 736189 - DNA, 22 bp, Artificial Sequence
  chemically synthesized
cctccttcagtttgttgtacag

SEQ ID NO: 736190 - DNA, 22 bp, Artificial Sequence
  chemically synthesized
cttcagtttgttgtacaggagc

SEQ ID NO: 736191 - DNA, 22 bp, Artificial Sequence
  chemically synthesized
cagtttgttgtacaggagcagc

SEQ ID NO: 736192 - DNA, 22 bp, Artificial Sequence
  chemically synthesized
agtttgttgtacaggagcagcc

SEQ ID NO: 736193 - DNA, 22 bp, Artificial Sequence
  chemically synthesized
gttgtacaggagcagcccagat

SEQ ID NO: 736194 - DNA, 22 bp, Artificial Sequence
  chemically synthesized
ttgtacaggagcagcccagatt

SEQ ID NO: 736195 - DNA, 22 bp, Artificial Sequence
  chemically synthesized
tacaggagcagcccagatttgg

SEQ ID NO: 736196 - DNA, 22 bp, Artificial Sequence
  chemically synthesized
tgtagaggaacacaccaaatct

SEQ ID NO: 736197 - DNA, 22 bp, Artificial Sequence
  chemically synthesized
gtgtagaggaacacaccaaatc

SEQ ID NO: 736198 - DNA, 22 bp, Artificial Sequence
  chemically synthesized
cttgtgtagaggaacacaccaa

SEQ ID NO: 736199 - DNA, 22 bp, Artificial Sequence
  chemically synthesized
ttccttgtgtagaggaacacac

SEQ ID NO: 736200 - DNA, 22 bp, Artificial Sequence
  chemically synthesized
caggcaattgttccttgtgtag

SEQ ID NO: 736201 - DNA, 22 bp, Artificial Sequence
  chemically synthesized
ggtgtgttcctctacacaagga

SEQ ID NO: 736202 - DNA, 22 bp, Artificial Sequence
  chemically synthesized
gtgtgttcctctacacaaggaa

SEQ ID NO: 736203 - DNA, 22 bp, Artificial Sequence
  chemically synthesized
ctctacacaaggaacaattgcc

SEQ ID NO: 736204 - DNA, 22 bp, Artificial Sequence
  chemically synthesized
tacacaaggaacaattgcctgg

SEQ ID NO: 736205 - DNA, 22 bp, Artificial Sequence
  chemically synthesized
tgaatcatgtctccaggcaatt

SEQ ID NO: 736206 - DNA, 22 bp, Artificial Sequence
  chemically synthesized
cacaaggaacaattgcctggag

SEQ ID NO: 736207 - DNA, 22 bp, Artificial Sequence
  chemically synthesized
cctgtgaatcatgtctccaggc

SEQ ID NO: 736208 - DNA, 22 bp, Artificial Sequence
  chemically synthesized
ctccctgtgaatcatgtctcca

SEQ ID NO: 736209 - DNA, 22 bp, Artificial Sequence
  chemically synthesized
cctcctccctgtgaatcatgtc

SEQ ID NO: 736210 - DNA, 22 bp, Artificial Sequence
  chemically synthesized
cctggagacatgattcacaggg

SEQ ID NO: 736211 - DNA, 22 bp, Artificial Sequence
  chemically synthesized
gagacatgattcacagggagga

SEQ ID NO: 736212 - DNA, 22 bp, Artificial Sequence
  chemically synthesized
ggaaggcactccctcctccctg

SEQ ID NO: 736213 - DNA, 22 bp, Artificial Sequence
  chemically synthesized
taggaaggcactccctcctccc

SEQ ID NO: 736214 - DNA, 22 bp, Artificial Sequence
  chemically synthesized
ctaggaaggcactccctcctcc

SEQ ID NO: 736215 - DNA, 22 bp, Artificial Sequence
  chemically synthesized
ttctaggaaggcactccctcct

SEQ ID NO: 736216 - DNA, 22 bp, Artificial Sequence
  chemically synthesized
acagggaggagggagtgccttc

SEQ ID NO: 736217 - DNA, 22 bp, Artificial Sequence
  chemically synthesized
tgatagctcttctaggaaggca

SEQ ID NO: 736218 - DNA, 22 bp, Artificial Sequence
  chemically synthesized
atgatagctcttctaggaaggc

SEQ ID NO: 736219 - DNA, 22 bp, Artificial Sequence
  chemically synthesized
tatgatagctcttctaggaagg

SEQ ID NO: 736220 - DNA, 22 bp, Artificial Sequence
  chemically synthesized
ttatgatagctcttctaggaag

SEQ ID NO: 736221 - DNA, 22 bp, Artificial Sequence
  chemically synthesized
tttatgatagctcttctaggaa

SEQ ID NO: 736222 - DNA, 22 bp, Artificial Sequence
  chemically synthesized
cctttttatgatagctcttcta

SEQ ID NO: 736223 - DNA, 22 bp, Artificial Sequence
  chemically synthesized
acctttttatgatagctcttct

SEQ ID NO: 736224 - DNA, 22 bp, Artificial Sequence
  chemically synthesized
ccacttacctttttatgatagc

SEQ ID NO: 736225 - DNA, 22 bp, Artificial Sequence
  chemically synthesized
cccacttacctttttatgatag

SEQ ID NO: 736226 - DNA, 22 bp, Artificial Sequence
  chemically synthesized
cctagaagagctatcataaaaa

SEQ ID NO: 736227 - DNA, 22 bp, Artificial Sequence
  chemically synthesized
ctagaagagctatcataaaaag

SEQ ID NO: 736228 - DNA, 22 bp, Artificial Sequence
  chemically synthesized
gaagagctatcataaaaaggta

SEQ ID NO: 736229 - DNA, 22 bp, Artificial Sequence
  chemically synthesized
aatccatttcccacttaccttt

SEQ ID NO: 736230 - DNA, 22 bp, Artificial Sequence
  chemically synthesized
tcataaaaaggtaagtgggaaa

SEQ ID NO: 736231 - DNA, 22 bp, Artificial Sequence
  chemically synthesized
ccagccatctgaatccatttcc

SEQ ID NO: 736232 - DNA, 22 bp, Artificial Sequence
  chemically synthesized
cccagccatctgaatccatttc

SEQ ID NO: 736233 - DNA, 22 bp, Artificial Sequence
  chemically synthesized
ttcccagccatctgaatccatt

SEQ ID NO: 736234 - DNA, 22 bp, Artificial Sequence
  chemically synthesized
cctcttcccagccatctgaatc

SEQ ID NO: 736235 - DNA, 22 bp, Artificial Sequence
  chemically synthesized
ccccatctccctcttcccagcc

SEQ ID NO: 736236 - DNA, 22 bp, Artificial Sequence
  chemically synthesized
agatggctgggaagagggagat

SEQ ID NO: 736237 - DNA, 22 bp, Artificial Sequence
  chemically synthesized
gacagcaactgccccatctccc

SEQ ID NO: 736238 - DNA, 22 bp, Artificial Sequence
  chemically synthesized
attagacagcaactgccccatc

SEQ ID NO: 736239 - DNA, 22 bp, Artificial Sequence
  chemically synthesized
ggaagagggagatggggcagtt

SEQ ID NO: 736240 - DNA, 22 bp, Artificial Sequence
  chemically synthesized
accacactaattagacagcaac

SEQ ID NO: 736241 - DNA, 22 bp, Artificial Sequence
  chemically synthesized
gaccacactaattagacagcaa

SEQ ID NO: 736242 - DNA, 22 bp, Artificial Sequence
  chemically synthesized
aaatttgaccacactaattaga

SEQ ID NO: 736243 - DNA, 22 bp, Artificial Sequence
  chemically synthesized
aaaatttgaccacactaattag

SEQ ID NO: 736244 - DNA, 22 bp, Artificial Sequence
  chemically synthesized
ttaaaatttgaccacactaatt

SEQ ID NO: 736245 - DNA, 22 bp, Artificial Sequence
  chemically synthesized
cttaaaatttgaccacactaat

SEQ ID NO: 736246 - DNA, 22 bp, Artificial Sequence
  chemically synthesized
ctgtctaattagtgtggtcaaa

SEQ ID NO: 736247 - DNA, 22 bp, Artificial Sequence
  chemically synthesized
tctaattagtgtggtcaaattt

SEQ ID NO: 736248 - DNA, 22 bp, Artificial Sequence
  chemically synthesized
attagtgtggtcaaattttaag

SEQ ID NO: 736249 - DNA, 22 bp, Artificial Sequence
  chemically synthesized
gtgtggtcaaattttaagaagg

SEQ ID NO: 736250 - DNA, 22 bp, Artificial Sequence
  chemically synthesized
aaaaaaaaaaaaaccttcttaa

SEQ ID NO: 736251 - DNA, 22 bp, Artificial Sequence
  chemically synthesized
aaaaaaaaaaaaaaccttctta

SEQ ID NO: 736252 - DNA, 22 bp, Artificial Sequence
  chemically synthesized
aacttaaaaaaaaaaaaaacct

SEQ ID NO: 736253 - DNA, 22 bp, Artificial Sequence
  chemically synthesized
taagaaggtttttttttttttt

SEQ ID NO: 736254 - DNA, 22 bp, Artificial Sequence
  chemically synthesized
aaatctcaacttaaaaaaaaaa

SEQ ID NO: 736255 - DNA, 22 bp, Artificial Sequence
  chemically synthesized
aagaaggtttttttttttttta

SEQ ID NO: 736256 - DNA, 22 bp, Artificial Sequence
  chemically synthesized
agaaggttttttttttttttaa

SEQ ID NO: 736257 - DNA, 22 bp, Artificial Sequence
  chemically synthesized
ttcaaatctcaacttaaaaaaa

SEQ ID NO: 736258 - DNA, 22 bp, Artificial Sequence
  chemically synthesized
attcaaatctcaacttaaaaaa

SEQ ID NO: 736259 - DNA, 22 bp, Artificial Sequence
  chemically synthesized
tttttttttttaagttgagatt

SEQ ID NO: 736260 - DNA, 22 bp, Artificial Sequence
  chemically synthesized
aagtcttattcaaatctcaact

SEQ ID NO: 736261 - DNA, 22 bp, Artificial Sequence
  chemically synthesized
ttttttttttaagttgagattt

SEQ ID NO: 736262 - DNA, 22 bp, Artificial Sequence
  chemically synthesized
caagtcttattcaaatctcaac

SEQ ID NO: 736263 - DNA, 22 bp, Artificial Sequence
  chemically synthesized
tttttttttaagttgagatttg

SEQ ID NO: 736264 - DNA, 22 bp, Artificial Sequence
  chemically synthesized
ttttttttaagttgagatttga

SEQ ID NO: 736265 - DNA, 22 bp, Artificial Sequence
  chemically synthesized
tttttttaagttgagatttgaa

SEQ ID NO: 736266 - DNA, 22 bp, Artificial Sequence
  chemically synthesized
cttcaagtcttattcaaatctc

SEQ ID NO: 736267 - DNA, 22 bp, Artificial Sequence
  chemically synthesized
ttttttaagttgagatttgaat

SEQ ID NO: 736268 - DNA, 22 bp, Artificial Sequence
  chemically synthesized
ccttcaagtcttattcaaatct

SEQ ID NO: 736269 - DNA, 22 bp, Artificial Sequence
  chemically synthesized
tttttaagttgagatttgaata

SEQ ID NO: 736270 - DNA, 22 bp, Artificial Sequence
  chemically synthesized
ttttaagttgagatttgaataa

SEQ ID NO: 736271 - DNA, 22 bp, Artificial Sequence
  chemically synthesized
tttaagttgagatttgaataag

SEQ ID NO: 736272 - DNA, 22 bp, Artificial Sequence
  chemically synthesized
ttaagttgagatttgaataaga

SEQ ID NO: 736273 - DNA, 22 bp, Artificial Sequence
  chemically synthesized
taagttgagatttgaataagac

SEQ ID NO: 736274 - DNA, 22 bp, Artificial Sequence
  chemically synthesized
aagttgagatttgaataagact

SEQ ID NO: 736275 - DNA, 22 bp, Artificial Sequence
  chemically synthesized
tcatttccttcaagtcttattc

SEQ ID NO: 736276 - DNA, 22 bp, Artificial Sequence
  chemically synthesized
agttgagatttgaataagactt

SEQ ID NO: 736277 - DNA, 22 bp, Artificial Sequence
  chemically synthesized
tgtcatttccttcaagtcttat

SEQ ID NO: 736278 - DNA, 22 bp, Artificial Sequence
  chemically synthesized
agatttgaataagacttgaagg

SEQ ID NO: 736279 - DNA, 22 bp, Artificial Sequence
  chemically synthesized
actctgtcatttccttcaagtc

SEQ ID NO: 736280 - DNA, 22 bp, Artificial Sequence
  chemically synthesized
gaataagacttgaaggaaatga

SEQ ID NO: 736281 - DNA, 22 bp, Artificial Sequence
  chemically synthesized
tgactaactctgtcatttcctt

SEQ ID NO: 736282 - DNA, 22 bp, Artificial Sequence
  chemically synthesized
aataagacttgaaggaaatgac

SEQ ID NO: 736283 - DNA, 22 bp, Artificial Sequence
  chemically synthesized
gtgactaactctgtcatttcct

SEQ ID NO: 736284 - DNA, 22 bp, Artificial Sequence
  chemically synthesized
tgtgactaactctgtcatttcc

SEQ ID NO: 736285 - DNA, 22 bp, Artificial Sequence
  chemically synthesized
gaaggaaatgacagagttagtc

SEQ ID NO: 736286 - DNA, 22 bp, Artificial Sequence
  chemically synthesized
aaggaaatgacagagttagtca

SEQ ID NO: 736287 - DNA, 22 bp, Artificial Sequence
  chemically synthesized
cagaaatctttgtgactaactc

SEQ ID NO: 736288 - DNA, 22 bp, Artificial Sequence
  chemically synthesized
tccagaaatctttgtgactaac

SEQ ID NO: 736289 - DNA, 22 bp, Artificial Sequence
  chemically synthesized
ctccagaaatctttgtgactaa

SEQ ID NO: 736290 - DNA, 22 bp, Artificial Sequence
  chemically synthesized
tctccagaaatctttgtgacta

SEQ ID NO: 736291 - DNA, 22 bp, Artificial Sequence
  chemically synthesized
tttctccagaaatctttgtgac

SEQ ID NO: 736292 - DNA, 22 bp, Artificial Sequence
  chemically synthesized
gaacattctttctccagaaatc

SEQ ID NO: 736293 - DNA, 22 bp, Artificial Sequence
  chemically synthesized
gtcacaaagatttctggagaaa

SEQ ID NO: 736294 - DNA, 22 bp, Artificial Sequence
  chemically synthesized
cctggaacattctttctccaga

SEQ ID NO: 736295 - DNA, 22 bp, Artificial Sequence
  chemically synthesized
tacctggaacattctttctcca

SEQ ID NO: 736296 - DNA, 22 bp, Artificial Sequence
  chemically synthesized
ttctacctggaacattctttct

SEQ ID NO: 736297 - DNA, 22 bp, Artificial Sequence
  chemically synthesized
attctacctggaacattctttc

SEQ ID NO: 736298 - DNA, 22 bp, Artificial Sequence
  chemically synthesized
tattctacctggaacattcttt

SEQ ID NO: 736299 - DNA, 22 bp, Artificial Sequence
  chemically synthesized
tttattctacctggaacattct

SEQ ID NO: 736300 - DNA, 22 bp, Artificial Sequence
  chemically synthesized
ctggagaaagaatgttccaggt

SEQ ID NO: 736301 - DNA, 22 bp, Artificial Sequence
  chemically synthesized
tggagaaagaatgttccaggta

SEQ ID NO: 736302 - DNA, 22 bp, Artificial Sequence
  chemically synthesized
gagaaagaatgttccaggtaga

SEQ ID NO: 736303 - DNA, 22 bp, Artificial Sequence
  chemically synthesized
tgcgtagttctttattctacct

SEQ ID NO: 736304 - DNA, 22 bp, Artificial Sequence
  chemically synthesized
cgggcactatgcgtagttcttt

SEQ ID NO: 736305 - DNA, 22 bp, Artificial Sequence
  chemically synthesized
caggtagaataaagaactacgc

SEQ ID NO: 736306 - DNA, 22 bp, Artificial Sequence
  chemically synthesized
tccgggcactatgcgtagttct

SEQ ID NO: 736307 - DNA, 22 bp, Artificial Sequence
  chemically synthesized
ctccgggcactatgcgtagttc

SEQ ID NO: 736308 - DNA, 22 bp, Artificial Sequence
  chemically synthesized
aacaggcatccttctccgggca

SEQ ID NO: 736309 - DNA, 22 bp, Artificial Sequence
  chemically synthesized
cgcatagtgcccggagaaggat

SEQ ID NO: 736310 - DNA, 22 bp, Artificial Sequence
  chemically synthesized
gagaactaaacaggcatccttc

SEQ ID NO: 736311 - DNA, 22 bp, Artificial Sequence
  chemically synthesized
gtctagagaactaaacaggcat

SEQ ID NO: 736312 - DNA, 22 bp, Artificial Sequence
  chemically synthesized
tcgtctagagaactaaacaggc

SEQ ID NO: 736313 - DNA, 22 bp, Artificial Sequence
  chemically synthesized
ctcgtctagagaactaaacagg

SEQ ID NO: 736314 - DNA, 22 bp, Artificial Sequence
  chemically synthesized
tctcgtctagagaactaaacag

SEQ ID NO: 736315 - DNA, 22 bp, Artificial Sequence
  chemically synthesized
ttctcgtctagagaactaaaca

SEQ ID NO: 736316 - DNA, 22 bp, Artificial Sequence
  chemically synthesized
agaaaggtttttctcgtctaga

SEQ ID NO: 736317 - DNA, 22 bp, Artificial Sequence
  chemically synthesized
tgagaaaggtttttctcgtcta

SEQ ID NO: 736318 - DNA, 22 bp, Artificial Sequence
  chemically synthesized
ctgagaaaggtttttctcgtct

SEQ ID NO: 736319 - DNA, 22 bp, Artificial Sequence
  chemically synthesized
tttagttctctagacgagaaaa

SEQ ID NO: 736320 - DNA, 22 bp, Artificial Sequence
  chemically synthesized
agttctctagacgagaaaaacc

SEQ ID NO: 736321 - DNA, 22 bp, Artificial Sequence
  chemically synthesized
gttctctagacgagaaaaacct

SEQ ID NO: 736322 - DNA, 22 bp, Artificial Sequence
  chemically synthesized
tctagacgagaaaaacctttct

SEQ ID NO: 736323 - DNA, 22 bp, Artificial Sequence
  chemically synthesized
agggaccttctgagaaaggttt

SEQ ID NO: 736324 - DNA, 22 bp, Artificial Sequence
  chemically synthesized
tagacgagaaaaacctttctca

SEQ ID NO: 736325 - DNA, 22 bp, Artificial Sequence
  chemically synthesized
gacgagaaaaacctttctcaga

SEQ ID NO: 736326 - DNA, 22 bp, Artificial Sequence
  chemically synthesized
agctaagggaccttctgagaaa

SEQ ID NO: 736327 - DNA, 22 bp, Artificial Sequence
  chemically synthesized
tctcagaaggtcccttagctga

SEQ ID NO: 736328 - DNA, 22 bp, Artificial Sequence
  chemically synthesized
ctcagaaggtcccttagctgaa

SEQ ID NO: 736329 - DNA, 22 bp, Artificial Sequence
  chemically synthesized
tcagaaggtcccttagctgaat

SEQ ID NO: 736330 - DNA, 22 bp, Artificial Sequence
  chemically synthesized
agaaggtcccttagctgaatgc

SEQ ID NO: 736331 - DNA, 22 bp, Artificial Sequence
  chemically synthesized
ggtaataaaatacaaagggcat

SEQ ID NO: 736332 - DNA, 22 bp, Artificial Sequence
  chemically synthesized
aggtaataaaatacaaagggca

SEQ ID NO: 736333 - DNA, 22 bp, Artificial Sequence
  chemically synthesized
taggtaataaaatacaaagggc

SEQ ID NO: 736334 - DNA, 22 bp, Artificial Sequence
  chemically synthesized
agctgaatgccctttgtatttt

SEQ ID NO: 736335 - DNA, 22 bp, Artificial Sequence
  chemically synthesized
gctgaatgccctttgtatttta

SEQ ID NO: 736336 - DNA, 22 bp, Artificial Sequence
  chemically synthesized
cgcaattttaggtaataaaata

SEQ ID NO: 736337 - DNA, 22 bp, Artificial Sequence
  chemically synthesized
aatgccctttgtattttattac

SEQ ID NO: 736338 - DNA, 22 bp, Artificial Sequence
  chemically synthesized
tgtattttattacctaaaattg

SEQ ID NO: 736339 - DNA, 22 bp, Artificial Sequence
  chemically synthesized
gtattttattacctaaaattgc

SEQ ID NO: 736340 - DNA, 22 bp, Artificial Sequence
  chemically synthesized
tattttattacctaaaattgcg

SEQ ID NO: 736341 - DNA, 22 bp, Artificial Sequence
  chemically synthesized
gacatggtcatattacgcaatt

SEQ ID NO: 736342 - DNA, 22 bp, Artificial Sequence
  chemically synthesized
tattacctaaaattgcgtaata

SEQ ID NO: 736343 - DNA, 22 bp, Artificial Sequence
  chemically synthesized
attacctaaaattgcgtaatat

SEQ ID NO: 736344 - DNA, 22 bp, Artificial Sequence
  chemically synthesized
ttacctaaaattgcgtaatatg

SEQ ID NO: 736345 - DNA, 22 bp, Artificial Sequence
  chemically synthesized
cctaaaattgcgtaatatgacc

SEQ ID NO: 736346 - DNA, 22 bp, Artificial Sequence
  chemically synthesized
ggaattggacatggtcatatta

SEQ ID NO: 736347 - DNA, 22 bp, Artificial Sequence
  chemically synthesized
cggaattggacatggtcatatt

SEQ ID NO: 736348 - DNA, 22 bp, Artificial Sequence
  chemically synthesized
ttcggaattggacatggtcata

SEQ ID NO: 736349 - DNA, 22 bp, Artificial Sequence
  chemically synthesized
aaattgcgtaatatgaccatgt

SEQ ID NO: 736350 - DNA, 22 bp, Artificial Sequence
  chemically synthesized
ccctcttcggaattggacatgg

SEQ ID NO: 736351 - DNA, 22 bp, Artificial Sequence
  chemically synthesized
cgtaatatgaccatgtccaatt

SEQ ID NO: 736352 - DNA, 22 bp, Artificial Sequence
  chemically synthesized
attgccctcttcggaattggac

SEQ ID NO: 736353 - DNA, 22 bp, Artificial Sequence
  chemically synthesized
gattgccctcttcggaattgga

SEQ ID NO: 736354 - DNA, 22 bp, Artificial Sequence
  chemically synthesized
gcagtcttgattgccctcttcg

SEQ ID NO: 736355 - DNA, 22 bp, Artificial Sequence
  chemically synthesized
tcgcagtcttgattgccctctt

SEQ ID NO: 736356 - DNA, 22 bp, Artificial Sequence
  chemically synthesized
atggtgctctcgcagtcttgat

SEQ ID NO: 736357 - DNA, 22 bp, Artificial Sequence
  chemically synthesized
cgaagagggcaatcaagactgc

SEQ ID NO: 736358 - DNA, 22 bp, Artificial Sequence
  chemically synthesized
catggtgctctcgcagtcttga

SEQ ID NO: 736359 - DNA, 22 bp, Artificial Sequence
  chemically synthesized
tttcatggtgctctcgcagtct

SEQ ID NO: 736360 - DNA, 22 bp, Artificial Sequence
  chemically synthesized
agctatttcatggtgctctcgc

SEQ ID NO: 736361 - DNA, 22 bp, Artificial Sequence
  chemically synthesized
cgagagcaccatgaaatagctc

SEQ ID NO: 736362 - DNA, 22 bp, Artificial Sequence
  chemically synthesized
aggactatcattatgtattccc

SEQ ID NO: 736363 - DNA, 22 bp, Artificial Sequence
  chemically synthesized
tcattatgtattcccttgggtt

SEQ ID NO: 736364 - DNA, 22 bp, Artificial Sequence
  chemically synthesized
tgtattcccttgggttggggct

SEQ ID NO: 736365 - DNA, 22 bp, Artificial Sequence
  chemically synthesized
ccttgggttggggcttcccttg

SEQ ID NO: 736366 - DNA, 22 bp, Artificial Sequence
  chemically synthesized
catatcatgtgcatcaagggaa

SEQ ID NO: 736367 - DNA, 22 bp, Artificial Sequence
  chemically synthesized
gggttggggcttcccttgatgc

SEQ ID NO: 736368 - DNA, 22 bp, Artificial Sequence
  chemically synthesized
tgcatatcatgtgcatcaaggg

SEQ ID NO: 736369 - DNA, 22 bp, Artificial Sequence
  chemically synthesized
ggttggggcttcccttgatgca

SEQ ID NO: 736370 - DNA, 22 bp, Artificial Sequence
  chemically synthesized
ctctgcatatcatgtgcatcaa

SEQ ID NO: 736371 - DNA, 22 bp, Artificial Sequence
  chemically synthesized
gggcttcccttgatgcacatga

SEQ ID NO: 736372 - DNA, 22 bp, Artificial Sequence
  chemically synthesized
ccctcctctgcatatcatgtgc

SEQ ID NO: 736373 - DNA, 22 bp, Artificial Sequence
  chemically synthesized
cccttgatgcacatgatatgca

SEQ ID NO: 736374 - DNA, 22 bp, Artificial Sequence
  chemically synthesized
ccttgatgcacatgatatgcag

SEQ ID NO: 736375 - DNA, 22 bp, Artificial Sequence
  chemically synthesized
aggatctaccctcctctgcata

SEQ ID NO: 736376 - DNA, 22 bp, Artificial Sequence
  chemically synthesized
gatgcacatgatatgcagagga

SEQ ID NO: 736377 - DNA, 22 bp, Artificial Sequence
  chemically synthesized
atgcacatgatatgcagaggag

SEQ ID NO: 736378 - DNA, 22 bp, Artificial Sequence
  chemically synthesized
ttgaggatctaccctcctctgc

SEQ ID NO: 736379 - DNA, 22 bp, Artificial Sequence
  chemically synthesized
gttgaggatctaccctcctctg

SEQ ID NO: 736380 - DNA, 22 bp, Artificial Sequence
  chemically synthesized
gcagccaccaggcttgttgagg

SEQ ID NO: 736381 - DNA, 22 bp, Artificial Sequence
  chemically synthesized
ctggcagccaccaggcttgttg

SEQ ID NO: 736382 - DNA, 22 bp, Artificial Sequence
  chemically synthesized
gctggcagccaccaggcttgtt

SEQ ID NO: 736383 - DNA, 22 bp, Artificial Sequence
  chemically synthesized
tgctggcagccaccaggcttgt

SEQ ID NO: 736384 - DNA, 22 bp, Artificial Sequence
  chemically synthesized
ctttgctggcagccaccaggct

SEQ ID NO: 736385 - DNA, 22 bp, Artificial Sequence
  chemically synthesized
tcctttgctggcagccaccagg

SEQ ID NO: 736386 - DNA, 22 bp, Artificial Sequence
  chemically synthesized
ctcctttgctggcagccaccag

SEQ ID NO: 736387 - DNA, 22 bp, Artificial Sequence
  chemically synthesized
aacaagcctggtggctgccagc

SEQ ID NO: 736388 - DNA, 22 bp, Artificial Sequence
  chemically synthesized
gtggctgccagcaaaggagaag

SEQ ID NO: 736389 - DNA, 22 bp, Artificial Sequence
  chemically synthesized
ccagcaaaggagaagggtgtat

SEQ ID NO: 736390 - DNA, 22 bp, Artificial Sequence
  chemically synthesized
cccaaatgtgtccatatacacc

SEQ ID NO: 736391 - DNA, 22 bp, Artificial Sequence
  chemically synthesized
ccccaaatgtgtccatatacac

SEQ ID NO: 736392 - DNA, 22 bp, Artificial Sequence
  chemically synthesized
tccccaaatgtgtccatataca

SEQ ID NO: 736393 - DNA, 22 bp, Artificial Sequence
  chemically synthesized
ttccccaaatgtgtccatatac

SEQ ID NO: 736394 - DNA, 22 bp, Artificial Sequence
  chemically synthesized
ttttccccaaatgtgtccatat

SEQ ID NO: 736395 - DNA, 22 bp, Artificial Sequence
  chemically synthesized
cttttccccaaatgtgtccata

SEQ ID NO: 736396 - DNA, 22 bp, Artificial Sequence
  chemically synthesized
tcttttccccaaatgtgtccat

SEQ ID NO: 736397 - DNA, 22 bp, Artificial Sequence
  chemically synthesized
ttttcttttccccaaatgtgtc

SEQ ID NO: 736398 - DNA, 22 bp, Artificial Sequence
  chemically synthesized
gttttcttttccccaaatgtgt

SEQ ID NO: 736399 - DNA, 22 bp, Artificial Sequence
  chemically synthesized
ttgttttcttttccccaaatgt

SEQ ID NO: 736400 - DNA, 22 bp, Artificial Sequence
  chemically synthesized
ggggaaaagaaaacaagagtat

SEQ ID NO: 736401 - DNA, 22 bp, Artificial Sequence
  chemically synthesized
gggaaaagaaaacaagagtatc

SEQ ID NO: 736402 - DNA, 22 bp, Artificial Sequence
  chemically synthesized
atccccagggtgtggggaagaa

SEQ ID NO: 736403 - DNA, 22 bp, Artificial Sequence
  chemically synthesized
aatccccagggtgtggggaaga

SEQ ID NO: 736404 - DNA, 22 bp, Artificial Sequence
  chemically synthesized
tttaatccccagggtgtgggga

SEQ ID NO: 736405 - DNA, 22 bp, Artificial Sequence
  chemically synthesized
tcttccccacaccctggggatt

SEQ ID NO: 736406 - DNA, 22 bp, Artificial Sequence
  chemically synthesized
cttccccacaccctggggatta

SEQ ID NO: 736407 - DNA, 22 bp, Artificial Sequence
  chemically synthesized
ttccccacaccctggggattaa

SEQ ID NO: 736408 - DNA, 22 bp, Artificial Sequence
  chemically synthesized
ccccacaccctggggattaaac

SEQ ID NO: 736409 - DNA, 22 bp, Artificial Sequence
  chemically synthesized
cccacaccctggggattaaaca

SEQ ID NO: 736410 - DNA, 22 bp, Artificial Sequence
  chemically synthesized
gacaggcccaaaaggagtattg

SEQ ID NO: 736411 - DNA, 22 bp, Artificial Sequence
  chemically synthesized
gggattaaacaatactcctttt

SEQ ID NO: 736412 - DNA, 22 bp, Artificial Sequence
  chemically synthesized
ttagacaggcccaaaaggagta

SEQ ID NO: 736413 - DNA, 22 bp, Artificial Sequence
  chemically synthesized
tcctgttagacaggcccaaaag

SEQ ID NO: 736414 - DNA, 22 bp, Artificial Sequence
  chemically synthesized
aacaatactccttttgggcctg

SEQ ID NO: 736415 - DNA, 22 bp, Artificial Sequence
  chemically synthesized
cttttgggcctgtctaacagga

SEQ ID NO: 736416 - DNA, 22 bp, Artificial Sequence
  chemically synthesized
ttgggcctgtctaacaggacaa

SEQ ID NO: 736417 - DNA, 22 bp, Artificial Sequence
  chemically synthesized
tgggcctgtctaacaggacaac

SEQ ID NO: 736418 - DNA, 22 bp, Artificial Sequence
  chemically synthesized
gggcctgtctaacaggacaact

SEQ ID NO: 736419 - DNA, 22 bp, Artificial Sequence
  chemically synthesized
ggcctgtctaacaggacaactc

SEQ ID NO: 736420 - DNA, 22 bp, Artificial Sequence
  chemically synthesized
ggaaaatgggatgagttgtcct

SEQ ID NO: 736421 - DNA, 22 bp, Artificial Sequence
  chemically synthesized
tctaacaggacaactcatccca

SEQ ID NO: 736422 - DNA, 22 bp, Artificial Sequence
  chemically synthesized
gggctgggaaaatgggatgagt

SEQ ID NO: 736423 - DNA, 22 bp, Artificial Sequence
  chemically synthesized
acaggacaactcatcccatttt

SEQ ID NO: 736424 - DNA, 22 bp, Artificial Sequence
  chemically synthesized
atagtcaggatctagggctggg

SEQ ID NO: 736425 - DNA, 22 bp, Artificial Sequence
  chemically synthesized
atcccattttcccagccctaga

SEQ ID NO: 736426 - DNA, 22 bp, Artificial Sequence
  chemically synthesized
ctgatagtcaggatctagggct

SEQ ID NO: 736427 - DNA, 22 bp, Artificial Sequence
  chemically synthesized
tgctgatagtcaggatctaggg

SEQ ID NO: 736428 - DNA, 22 bp, Artificial Sequence
  chemically synthesized
tctgctgatagtcaggatctag

SEQ ID NO: 736429 - DNA, 22 bp, Artificial Sequence
  chemically synthesized
tcccagccctagatcctgacta

SEQ ID NO: 736430 - DNA, 22 bp, Artificial Sequence
  chemically synthesized
cccagccctagatcctgactat

SEQ ID NO: 736431 - DNA, 22 bp, Artificial Sequence
  chemically synthesized
ccagccctagatcctgactatc

SEQ ID NO: 736432 - DNA, 22 bp, Artificial Sequence
  chemically synthesized
gatcctgactatcagcagagaa

SEQ ID NO: 736433 - DNA, 22 bp, Artificial Sequence
  chemically synthesized
caccaagcacaagaattctctg

SEQ ID NO: 736434 - DNA, 22 bp, Artificial Sequence
  chemically synthesized
acaccaagcacaagaattctct

SEQ ID NO: 736435 - DNA, 22 bp, Artificial Sequence
  chemically synthesized
ttacaccaagcacaagaattct

SEQ ID NO: 736436 - DNA, 22 bp, Artificial Sequence
  chemically synthesized
actatcagcagagaattcttgt

SEQ ID NO: 736437 - DNA, 22 bp, Artificial Sequence
  chemically synthesized
ctcttacaccaagcacaagaat

SEQ ID NO: 736438 - DNA, 22 bp, Artificial Sequence
  chemically synthesized
tcagcagagaattcttgtgctt

SEQ ID NO: 736439 - DNA, 22 bp, Artificial Sequence
  chemically synthesized
tgctcttacaccaagcacaaga

SEQ ID NO: 736440 - DNA, 22 bp, Artificial Sequence
  chemically synthesized
ctgctcttacaccaagcacaag

SEQ ID NO: 736441 - DNA, 22 bp, Artificial Sequence
  chemically synthesized
tctgctcttacaccaagcacaa

SEQ ID NO: 736442 - DNA, 22 bp, Artificial Sequence
  chemically synthesized
ttctgctcttacaccaagcaca

SEQ ID NO: 736443 - DNA, 22 bp, Artificial Sequence
  chemically synthesized
cagccttttctgctcttacacc

SEQ ID NO: 736444 - DNA, 22 bp, Artificial Sequence
  chemically synthesized
ccagccttttctgctcttacac

SEQ ID NO: 736445 - DNA, 22 bp, Artificial Sequence
  chemically synthesized
tccagccttttctgctcttaca

SEQ ID NO: 736446 - DNA, 22 bp, Artificial Sequence
  chemically synthesized
ttgtgcttggtgtaagagcaga

SEQ ID NO: 736447 - DNA, 22 bp, Artificial Sequence
  chemically synthesized
gtgcttggtgtaagagcagaaa

SEQ ID NO: 736448 - DNA, 22 bp, Artificial Sequence
  chemically synthesized
cctttccagccttttctgctct

SEQ ID NO: 736449 - DNA, 22 bp, Artificial Sequence
  chemically synthesized
tgcttggtgtaagagcagaaaa

SEQ ID NO: 736450 - DNA, 22 bp, Artificial Sequence
  chemically synthesized
ggtgtaagagcagaaaaggctg

SEQ ID NO: 736451 - DNA, 22 bp, Artificial Sequence
  chemically synthesized
tcgctgcctttccagccttttc

SEQ ID NO: 736452 - DNA, 22 bp, Artificial Sequence
  chemically synthesized
gtgtaagagcagaaaaggctgg

SEQ ID NO: 736453 - DNA, 22 bp, Artificial Sequence
  chemically synthesized
gtcattatcgctgcctttccag

SEQ ID NO: 736454 - DNA, 22 bp, Artificial Sequence
  chemically synthesized
atcctggtcattatcgctgcct

SEQ ID NO: 736455 - DNA, 22 bp, Artificial Sequence
  chemically synthesized
gatgctgatcctggtcattatc

SEQ ID NO: 736456 - DNA, 22 bp, Artificial Sequence
  chemically synthesized
gaaaggcagcgataatgaccag

SEQ ID NO: 736457 - DNA, 22 bp, Artificial Sequence
  chemically synthesized
ggtgagttagatgctgatcctg

SEQ ID NO: 736458 - DNA, 22 bp, Artificial Sequence
  chemically synthesized
ccactgggtgagttagatgctg

SEQ ID NO: 736459 - DNA, 22 bp, Artificial Sequence
  chemically synthesized
gccactgggtgagttagatgct

SEQ ID NO: 736460 - DNA, 22 bp, Artificial Sequence
  chemically synthesized
tgccactgggtgagttagatgc

SEQ ID NO: 736461 - DNA, 22 bp, Artificial Sequence
  chemically synthesized
tgggtggtggcccctttgccac

SEQ ID NO: 736462 - DNA, 22 bp, Artificial Sequence
  chemically synthesized
tgtgggtggtggcccctttgcc

SEQ ID NO: 736463 - DNA, 22 bp, Artificial Sequence
  chemically synthesized
actcacccagtggcaaaggggc

SEQ ID NO: 736464 - DNA, 22 bp, Artificial Sequence
  chemically synthesized
ctgtgggtggtggcccctttgc

SEQ ID NO: 736465 - DNA, 22 bp, Artificial Sequence
  chemically synthesized
acccagtggcaaaggggccacc

SEQ ID NO: 736466 - DNA, 22 bp, Artificial Sequence
  chemically synthesized
aaccttctgtgggtggtggccc

SEQ ID NO: 736467 - DNA, 22 bp, Artificial Sequence
  chemically synthesized
aaaccttctgtgggtggtggcc

SEQ ID NO: 736468 - DNA, 22 bp, Artificial Sequence
  chemically synthesized
taaaccttctgtgggtggtggc

SEQ ID NO: 736469 - DNA, 22 bp, Artificial Sequence
  chemically synthesized
ttaaaccttctgtgggtggtgg

SEQ ID NO: 736470 - DNA, 22 bp, Artificial Sequence
  chemically synthesized
agtgtacacttttaaaccttct

SEQ ID NO: 736471 - DNA, 22 bp, Artificial Sequence
  chemically synthesized
ttgagtgtacacttttaaacct

SEQ ID NO: 736472 - DNA, 22 bp, Artificial Sequence
  chemically synthesized
tctgttgagtgtacacttttaa

SEQ ID NO: 736473 - DNA, 22 bp, Artificial Sequence
  chemically synthesized
atctgttgagtgtacactttta

SEQ ID NO: 736474 - DNA, 22 bp, Artificial Sequence
  chemically synthesized
cttatctgttgagtgtacactt

SEQ ID NO: 736475 - DNA, 22 bp, Artificial Sequence
  chemically synthesized
ctgcttatctgttgagtgtaca

SEQ ID NO: 736476 - DNA, 22 bp, Artificial Sequence
  chemically synthesized
cctactgcttatctgttgagtg

SEQ ID NO: 736477 - DNA, 22 bp, Artificial Sequence
  chemically synthesized
aaaagtgtacactcaacagata

SEQ ID NO: 736478 - DNA, 22 bp, Artificial Sequence
  chemically synthesized
aaagtgtacactcaacagataa

SEQ ID NO: 736479 - DNA, 22 bp, Artificial Sequence
  chemically synthesized
tgaatgctacctactgcttatc

SEQ ID NO: 736480 - DNA, 22 bp, Artificial Sequence
  chemically synthesized
ccattatgaatgctacctactg

SEQ ID NO: 736481 - DNA, 22 bp, Artificial Sequence
  chemically synthesized
cccattatgaatgctacctact

SEQ ID NO: 736482 - DNA, 22 bp, Artificial Sequence
  chemically synthesized
aacagataagcagtaggtagca

SEQ ID NO: 736483 - DNA, 22 bp, Artificial Sequence
  chemically synthesized
tcccattatgaatgctacctac

SEQ ID NO: 736484 - DNA, 22 bp, Artificial Sequence
  chemically synthesized
agagtcatattttcccattatg

SEQ ID NO: 736485 - DNA, 22 bp, Artificial Sequence
  chemically synthesized
cagagtcatattttcccattat

SEQ ID NO: 736486 - DNA, 22 bp, Artificial Sequence
  chemically synthesized
tcagagtcatattttcccatta

SEQ ID NO: 736487 - DNA, 22 bp, Artificial Sequence
  chemically synthesized
tttcagagtcatattttcccat

SEQ ID NO: 736488 - DNA, 22 bp, Artificial Sequence
  chemically synthesized
ctttcagagtcatattttccca

SEQ ID NO: 736489 - DNA, 22 bp, Artificial Sequence
  chemically synthesized
tctttcagagtcatattttccc

SEQ ID NO: 736490 - DNA, 22 bp, Artificial Sequence
  chemically synthesized
ataatgggaaaatatgactctg

SEQ ID NO: 736491 - DNA, 22 bp, Artificial Sequence
  chemically synthesized
agtgccacataaaaattttctt

SEQ ID NO: 736492 - DNA, 22 bp, Artificial Sequence
  chemically synthesized
tgaaagaaaatttttatgtggc

SEQ ID NO: 736493 - DNA, 22 bp, Artificial Sequence
  chemically synthesized
aaagtatctcagtgccacataa

SEQ ID NO: 736494 - DNA, 22 bp, Artificial Sequence
  chemically synthesized
aaagaaaatttttatgtggcac

SEQ ID NO: 736495 - DNA, 22 bp, Artificial Sequence
  chemically synthesized
ttatgtggcactgagatacttt

SEQ ID NO: 736496 - DNA, 22 bp, Artificial Sequence
  chemically synthesized
atcatgcatctcaaagtatctc

SEQ ID NO: 736497 - DNA, 22 bp, Artificial Sequence
  chemically synthesized
tatgtggcactgagatactttg

SEQ ID NO: 736498 - DNA, 22 bp, Artificial Sequence
  chemically synthesized
atgtggcactgagatactttga

SEQ ID NO: 736499 - DNA, 22 bp, Artificial Sequence
  chemically synthesized
tgtggcactgagatactttgag

SEQ ID NO: 736500 - DNA, 22 bp, Artificial Sequence
  chemically synthesized
attgatcatgcatctcaaagta

SEQ ID NO: 736501 - DNA, 22 bp, Artificial Sequence
  chemically synthesized
cattgatcatgcatctcaaagt

SEQ ID NO: 736502 - DNA, 22 bp, Artificial Sequence
  chemically synthesized
ggtccttcattgatcatgcatc

SEQ ID NO: 736503 - DNA, 22 bp, Artificial Sequence
  chemically synthesized
agatactttgagatgcatgatc

SEQ ID NO: 736504 - DNA, 22 bp, Artificial Sequence
  chemically synthesized
aattaggtccttcattgatcat

SEQ ID NO: 736505 - DNA, 22 bp, Artificial Sequence
  chemically synthesized
gaattaggtccttcattgatca

SEQ ID NO: 736506 - DNA, 22 bp, Artificial Sequence
  chemically synthesized
tgaattaggtccttcattgatc

SEQ ID NO: 736507 - DNA, 22 bp, Artificial Sequence
  chemically synthesized
tgagatgcatgatcaatgaagg

SEQ ID NO: 736508 - DNA, 22 bp, Artificial Sequence
  chemically synthesized
tttgaattaggtccttcattga

SEQ ID NO: 736509 - DNA, 22 bp, Artificial Sequence
  chemically synthesized
gagatgcatgatcaatgaagga

SEQ ID NO: 736510 - DNA, 22 bp, Artificial Sequence
  chemically synthesized
agatgcatgatcaatgaaggac

SEQ ID NO: 736511 - DNA, 22 bp, Artificial Sequence
  chemically synthesized
ccctctttgaattaggtccttc

SEQ ID NO: 736512 - DNA, 22 bp, Artificial Sequence
  chemically synthesized
atgttaccctctttgaattagg

SEQ ID NO: 736513 - DNA, 22 bp, Artificial Sequence
  chemically synthesized
aatgttaccctctttgaattag

SEQ ID NO: 736514 - DNA, 22 bp, Artificial Sequence
  chemically synthesized
taatgttaccctctttgaatta

SEQ ID NO: 736515 - DNA, 22 bp, Artificial Sequence
  chemically synthesized
ggaattttaatgttaccctctt

SEQ ID NO: 736516 - DNA, 22 bp, Artificial Sequence
  chemically synthesized
gggaattttaatgttaccctct

SEQ ID NO: 736517 - DNA, 22 bp, Artificial Sequence
  chemically synthesized
tacttgggaattttaatgttac

SEQ ID NO: 736518 - DNA, 22 bp, Artificial Sequence
  chemically synthesized
attcaaagagggtaacattaaa

SEQ ID NO: 736519 - DNA, 22 bp, Artificial Sequence
  chemically synthesized
aaagagggtaacattaaaattc

SEQ ID NO: 736520 - DNA, 22 bp, Artificial Sequence
  chemically synthesized
tgctgtacttgggaattttaat

SEQ ID NO: 736521 - DNA, 22 bp, Artificial Sequence
  chemically synthesized
tggctgtgctgtacttgggaat

SEQ ID NO: 736522 - DNA, 22 bp, Artificial Sequence
  chemically synthesized
gtggctgtgctgtacttgggaa

SEQ ID NO: 736523 - DNA, 22 bp, Artificial Sequence
  chemically synthesized
tgtggctgtgctgtacttggga

SEQ ID NO: 736524 - DNA, 22 bp, Artificial Sequence
  chemically synthesized
ttgtggctgtgctgtacttggg

SEQ ID NO: 736525 - DNA, 22 bp, Artificial Sequence
  chemically synthesized
cagcttttgtggctgtgctgta

SEQ ID NO: 736526 - DNA, 22 bp, Artificial Sequence
  chemically synthesized
aaattcccaagtacagcacagc

SEQ ID NO: 736527 - DNA, 22 bp, Artificial Sequence
  chemically synthesized
ccaagtacagcacagccacaaa

SEQ ID NO: 736528 - DNA, 22 bp, Artificial Sequence
  chemically synthesized
cccatgtggctacagcttttgt

SEQ ID NO: 736529 - DNA, 22 bp, Artificial Sequence
  chemically synthesized
taggggcagtaaagttgcccat

SEQ ID NO: 736530 - DNA, 22 bp, Artificial Sequence
  chemically synthesized
tagccacatgggcaactttact

SEQ ID NO: 736531 - DNA, 22 bp, Artificial Sequence
  chemically synthesized
aactgtaggggcagtaaagttg

SEQ ID NO: 736532 - DNA, 22 bp, Artificial Sequence
  chemically synthesized
aaactgtaggggcagtaaagtt

SEQ ID NO: 736533 - DNA, 22 bp, Artificial Sequence
  chemically synthesized
ccatcagacacttaaactgtag

SEQ ID NO: 736534 - DNA, 22 bp, Artificial Sequence
  chemically synthesized
tactgcccctacagtttaagtg

SEQ ID NO: 736535 - DNA, 22 bp, Artificial Sequence
  chemically synthesized
actgcccctacagtttaagtgt

SEQ ID NO: 736536 - DNA, 22 bp, Artificial Sequence
  chemically synthesized
ctgcccctacagtttaagtgtc

SEQ ID NO: 736537 - DNA, 22 bp, Artificial Sequence
  chemically synthesized
gcattcccatcagacacttaaa

SEQ ID NO: 736538 - DNA, 22 bp, Artificial Sequence
  chemically synthesized
cccctacagtttaagtgtctga

SEQ ID NO: 736539 - DNA, 22 bp, Artificial Sequence
  chemically synthesized
ggtctggcattcccatcagaca

SEQ ID NO: 736540 - DNA, 22 bp, Artificial Sequence
  chemically synthesized
aggtctggcattcccatcagac

SEQ ID NO: 736541 - DNA, 22 bp, Artificial Sequence
  chemically synthesized
cagtttaagtgtctgatgggaa

SEQ ID NO: 736542 - DNA, 22 bp, Artificial Sequence
  chemically synthesized
ttaggtctggcattcccatcag

SEQ ID NO: 736543 - DNA, 22 bp, Artificial Sequence
  chemically synthesized
aagtgtctgatgggaatgccag

SEQ ID NO: 736544 - DNA, 22 bp, Artificial Sequence
  chemically synthesized
caattcttaggtctggcattcc

SEQ ID NO: 736545 - DNA, 22 bp, Artificial Sequence
  chemically synthesized
agtgtctgatgggaatgccaga

SEQ ID NO: 736546 - DNA, 22 bp, Artificial Sequence
  chemically synthesized
atgggaatgccagacctaagaa

SEQ ID NO: 736547 - DNA, 22 bp, Artificial Sequence
  chemically synthesized
aaacaagtcaggacccccaatt

SEQ ID NO: 736548 - DNA, 22 bp, Artificial Sequence
  chemically synthesized
caaacaagtcaggacccccaat

SEQ ID NO: 736549 - DNA, 22 bp, Artificial Sequence
  chemically synthesized
agaattggaattgggggtcctg

SEQ ID NO: 736550 - DNA, 22 bp, Artificial Sequence
  chemically synthesized
cttcaaacaagtcaggaccccc

SEQ ID NO: 736551 - DNA, 22 bp, Artificial Sequence
  chemically synthesized
gcttcaaacaagtcaggacccc

SEQ ID NO: 736552 - DNA, 22 bp, Artificial Sequence
  chemically synthesized
acttgcttcaaacaagtcagga

SEQ ID NO: 736553 - DNA, 22 bp, Artificial Sequence
  chemically synthesized
aacttgcttcaaacaagtcagg

SEQ ID NO: 736554 - DNA, 22 bp, Artificial Sequence
  chemically synthesized
gaattgggggtcctgacttgtt

SEQ ID NO: 736555 - DNA, 22 bp, Artificial Sequence
  chemically synthesized
ggggtcctgacttgtttgaagc

SEQ ID NO: 736556 - DNA, 22 bp, Artificial Sequence
  chemically synthesized
acttgtttgaagcaagttaagg

SEQ ID NO: 736557 - DNA, 22 bp, Artificial Sequence
  chemically synthesized
gtttgaagcaagttaaggtctt

SEQ ID NO: 736558 - DNA, 22 bp, Artificial Sequence
  chemically synthesized
tttgaagcaagttaaggtcttt

SEQ ID NO: 736559 - DNA, 22 bp, Artificial Sequence
  chemically synthesized
gaagcaagttaaggtctttttt

SEQ ID NO: 736560 - DNA, 22 bp, Artificial Sequence
  chemically synthesized
aagcaagttaaggtcttttttt

SEQ ID NO: 736561 - DNA, 22 bp, Artificial Sequence
  chemically synthesized
aaaaaaaaaaaaaaaaaaaaaa

SEQ ID NO: 736562 - DNA, 22 bp, Artificial Sequence
  chemically synthesized
aggtcttttttttttttttttt

SEQ ID NO: 736563 - DNA, 22 bp, Artificial Sequence
  chemically synthesized
tcaaaaaaaaaaaaaaaaaaaa

SEQ ID NO: 736564 - DNA, 22 bp, Artificial Sequence
  chemically synthesized
cctctcaaaaaaaaaaaaaaaa

SEQ ID NO: 736565 - DNA, 22 bp, Artificial Sequence
  chemically synthesized
tttttttttttttttttttttt

SEQ ID NO: 736566 - DNA, 22 bp, Artificial Sequence
  chemically synthesized
tttttttttttttttttttttt

SEQ ID NO: 736567 - DNA, 22 bp, Artificial Sequence
  chemically synthesized
tttttttttttttttttttttt

SEQ ID NO: 736568 - DNA, 22 bp, Artificial Sequence
  chemically synthesized
tttttttttttttttttttttt

SEQ ID NO: 736569 - DNA, 22 bp, Artificial Sequence
  chemically synthesized
tttttttttttttttttttttt

SEQ ID NO: 736570 - DNA, 22 bp, Artificial Sequence
  chemically synthesized
tttttttttttttttttttttg

SEQ ID NO: 736571 - DNA, 22 bp, Artificial Sequence
  chemically synthesized
ttttttttttttttttttttga

SEQ ID NO: 736572 - DNA, 22 bp, Artificial Sequence
  chemically synthesized
tttttttttttttttttttgag

SEQ ID NO: 736573 - DNA, 22 bp, Artificial Sequence
  chemically synthesized
ttttttttttttttttttgaga

SEQ ID NO: 736574 - DNA, 22 bp, Artificial Sequence
  chemically synthesized
tttttttttttttttttgagag

SEQ ID NO: 736575 - DNA, 22 bp, Artificial Sequence
  chemically synthesized
ttttttttttttttttgagagg

SEQ ID NO: 736576 - DNA, 22 bp, Artificial Sequence
  chemically synthesized
tttttttttttttttgagaggg

SEQ ID NO: 736577 - DNA, 22 bp, Artificial Sequence
  chemically synthesized
ttttttttttttttgagaggga

SEQ ID NO: 736578 - DNA, 22 bp, Artificial Sequence
  chemically synthesized
tttttttttttttgagagggag

SEQ ID NO: 736579 - DNA, 22 bp, Artificial Sequence
  chemically synthesized
ttttttttttttgagagggagt

SEQ ID NO: 736580 - DNA, 22 bp, Artificial Sequence
  chemically synthesized
tttttttttttgagagggagtc

SEQ ID NO: 736581 - DNA, 22 bp, Artificial Sequence
  chemically synthesized
gtgacagagtgagactccctct

SEQ ID NO: 736582 - DNA, 22 bp, Artificial Sequence
  chemically synthesized
ttttttttttgagagggagtct

SEQ ID NO: 736583 - DNA, 22 bp, Artificial Sequence
  chemically synthesized
tttttttttgagagggagtctc

SEQ ID NO: 736584 - DNA, 22 bp, Artificial Sequence
  chemically synthesized
ttttttttgagagggagtctca

SEQ ID NO: 736585 - DNA, 22 bp, Artificial Sequence
  chemically synthesized
tttttttgagagggagtctcac

SEQ ID NO: 736586 - DNA, 22 bp, Artificial Sequence
  chemically synthesized
ttttttgagagggagtctcact

SEQ ID NO: 736587 - DNA, 22 bp, Artificial Sequence
  chemically synthesized
tttttgagagggagtctcactc

SEQ ID NO: 736588 - DNA, 22 bp, Artificial Sequence
  chemically synthesized
ttttgagagggagtctcactct

SEQ ID NO: 736589 - DNA, 22 bp, Artificial Sequence
  chemically synthesized
cagactggtgacagagtgagac

SEQ ID NO: 736590 - DNA, 22 bp, Artificial Sequence
  chemically synthesized
tttgagagggagtctcactctg

SEQ ID NO: 736591 - DNA, 22 bp, Artificial Sequence
  chemically synthesized
ttgagagggagtctcactctgt

SEQ ID NO: 736592 - DNA, 22 bp, Artificial Sequence
  chemically synthesized
tgagagggagtctcactctgtc

SEQ ID NO: 736593 - DNA, 22 bp, Artificial Sequence
  chemically synthesized
gagagggagtctcactctgtca

SEQ ID NO: 736594 - DNA, 22 bp, Artificial Sequence
  chemically synthesized
agagggagtctcactctgtcac

SEQ ID NO: 736595 - DNA, 22 bp, Artificial Sequence
  chemically synthesized
cactccagactggtgacagagt

SEQ ID NO: 736596 - DNA, 22 bp, Artificial Sequence
  chemically synthesized
actctgtcaccagtctggagtg

SEQ ID NO: 736597 - DNA, 22 bp, Artificial Sequence
  chemically synthesized
agatcatgccactgcactccag

SEQ ID NO: 736598 - DNA, 22 bp, Artificial Sequence
  chemically synthesized
tgtcaccagtctggagtgcagt

SEQ ID NO: 736599 - DNA, 22 bp, Artificial Sequence
  chemically synthesized
tcaccagtctggagtgcagtgg

SEQ ID NO: 736600 - DNA, 22 bp, Artificial Sequence
  chemically synthesized
cagtgagctgagatcatgccac

SEQ ID NO: 736601 - DNA, 22 bp, Artificial Sequence
  chemically synthesized
gcagtgagctgagatcatgcca

SEQ ID NO: 736602 - DNA, 22 bp, Artificial Sequence
  chemically synthesized
gagtgcagtggcatgatctcag

SEQ ID NO: 736603 - DNA, 22 bp, Artificial Sequence
  chemically synthesized
ggaggcggagcttgcagtgagc

SEQ ID NO: 736604 - DNA, 22 bp, Artificial Sequence
  chemically synthesized
agctcactgcaagctccgcctc

SEQ ID NO: 736605 - DNA, 22 bp, Artificial Sequence
  chemically synthesized
actgcaagctccgcctcccagg

SEQ ID NO: 736606 - DNA, 22 bp, Artificial Sequence
  chemically synthesized
gagaatggcatgaacctgggag

SEQ ID NO: 736607 - DNA, 22 bp, Artificial Sequence
  chemically synthesized
caagctccgcctcccaggttca

SEQ ID NO: 736608 - DNA, 22 bp, Artificial Sequence
  chemically synthesized
aggctggagaatggcatgaacc

SEQ ID NO: 736609 - DNA, 22 bp, Artificial Sequence
  chemically synthesized
cgcctcccaggttcatgccatt

SEQ ID NO: 736610 - DNA, 22 bp, Artificial Sequence
  chemically synthesized
ggaggctgaggctggagaatgg

SEQ ID NO: 736611 - DNA, 22 bp, Artificial Sequence
  chemically synthesized
ccaggttcatgccattctccag

SEQ ID NO: 736612 - DNA, 22 bp, Artificial Sequence
  chemically synthesized
gggaggctgaggctggagaatg

SEQ ID NO: 736613 - DNA, 22 bp, Artificial Sequence
  chemically synthesized
cttgggaggctgaggctggaga

SEQ ID NO: 736614 - DNA, 22 bp, Artificial Sequence
  chemically synthesized
atgccattctccagcctcagcc

SEQ ID NO: 736615 - DNA, 22 bp, Artificial Sequence
  chemically synthesized
tagtcccagctacttgggaggc

SEQ ID NO: 736616 - DNA, 22 bp, Artificial Sequence
  chemically synthesized
tccagcctcagcctcccaagta

SEQ ID NO: 736617 - DNA, 22 bp, Artificial Sequence
  chemically synthesized
cagcctcagcctcccaagtagc

SEQ ID NO: 736618 - DNA, 22 bp, Artificial Sequence
  chemically synthesized
agcctcccaagtagctgggact

SEQ ID NO: 736619 - DNA, 22 bp, Artificial Sequence
  chemically synthesized
ccaagtagctgggactacaggc

SEQ ID NO: 736620 - DNA, 22 bp, Artificial Sequence
  chemically synthesized
gccgggcatggtggcaggcgcc

SEQ ID NO: 736621 - DNA, 22 bp, Artificial Sequence
  chemically synthesized
ggactacaggcgcctgccacca

SEQ ID NO: 736622 - DNA, 22 bp, Artificial Sequence
  chemically synthesized
caggcgcctgccaccatgcccg

SEQ ID NO: 736623 - DNA, 22 bp, Artificial Sequence
  chemically synthesized
aaatacaaaacattagccgggc

SEQ ID NO: 736624 - DNA, 22 bp, Artificial Sequence
  chemically synthesized
ctgaaatacaaaacattagccg

SEQ ID NO: 736625 - DNA, 22 bp, Artificial Sequence
  chemically synthesized
ccaccatgcccggctaatgttt

SEQ ID NO: 736626 - DNA, 22 bp, Artificial Sequence
  chemically synthesized
tactgaaatacaaaacattagc

SEQ ID NO: 736627 - DNA, 22 bp, Artificial Sequence
  chemically synthesized
tctctactgaaatacaaaacat

SEQ ID NO: 736628 - DNA, 22 bp, Artificial Sequence
  chemically synthesized
atgttttgtatttcagtagaga

SEQ ID NO: 736629 - DNA, 22 bp, Artificial Sequence
  chemically synthesized
tgtatttcagtagagacaggat

SEQ ID NO: 736630 - DNA, 22 bp, Artificial Sequence
  chemically synthesized
gtatttcagtagagacaggatt

SEQ ID NO: 736631 - DNA, 22 bp, Artificial Sequence
  chemically synthesized
accaaatggtgaaatcctgtct

SEQ ID NO: 736632 - DNA, 22 bp, Artificial Sequence
  chemically synthesized
tatttcagtagagacaggattt

SEQ ID NO: 736633 - DNA, 22 bp, Artificial Sequence
  chemically synthesized
cagtagagacaggatttcacca

SEQ ID NO: 736634 - DNA, 22 bp, Artificial Sequence
  chemically synthesized
agtagagacaggatttcaccat

SEQ ID NO: 736635 - DNA, 22 bp, Artificial Sequence
  chemically synthesized
caccatttggtcaggatggtct

SEQ ID NO: 736636 - DNA, 22 bp, Artificial Sequence
  chemically synthesized
accatttggtcaggatggtctt

SEQ ID NO: 736637 - DNA, 22 bp, Artificial Sequence
  chemically synthesized
cgagatcaggagatcaagacca

SEQ ID NO: 736638 - DNA, 22 bp, Artificial Sequence
  chemically synthesized
ggtcaggatggtcttgatctcc

SEQ ID NO: 736639 - DNA, 22 bp, Artificial Sequence
  chemically synthesized
gtcaggatggtcttgatctcct

SEQ ID NO: 736640 - DNA, 22 bp, Artificial Sequence
  chemically synthesized
gatctcctgatctcgtaattca

SEQ ID NO: 736641 - DNA, 22 bp, Artificial Sequence
  chemically synthesized
atctcctgatctcgtaattcac

SEQ ID NO: 736642 - DNA, 22 bp, Artificial Sequence
  chemically synthesized
ggaggccgaggcgggtgaatta

SEQ ID NO: 736643 - DNA, 22 bp, Artificial Sequence
  chemically synthesized
gggaggccgaggcgggtgaatt

SEQ ID NO: 736644 - DNA, 22 bp, Artificial Sequence
  chemically synthesized
tgggaggccgaggcgggtgaat

SEQ ID NO: 736645 - DNA, 22 bp, Artificial Sequence
  chemically synthesized
ctgatctcgtaattcacccgcc

SEQ ID NO: 736646 - DNA, 22 bp, Artificial Sequence
  chemically synthesized
atctcgtaattcacccgcctcg

SEQ ID NO: 736647 - DNA, 22 bp, Artificial Sequence
  chemically synthesized
gtaattcacccgcctcggcctc

SEQ ID NO: 736648 - DNA, 22 bp, Artificial Sequence
  chemically synthesized
taatcccaccactttgggaggc

SEQ ID NO: 736649 - DNA, 22 bp, Artificial Sequence
  chemically synthesized
acccgcctcggcctcccaaagt

SEQ ID NO: 736650 - DNA, 22 bp, Artificial Sequence
  chemically synthesized
acgcctgtaatcccaccacttt

SEQ ID NO: 736651 - DNA, 22 bp, Artificial Sequence
  chemically synthesized
ggcctcccaaagtggtgggatt

SEQ ID NO: 736652 - DNA, 22 bp, Artificial Sequence
  chemically synthesized
ccaaagtggtgggattacaggc

SEQ ID NO: 736653 - DNA, 22 bp, Artificial Sequence
  chemically synthesized
tccaggcgcggtggctcacgcc

SEQ ID NO: 736654 - DNA, 22 bp, Artificial Sequence
  chemically synthesized
gtccaggcgcggtggctcacgc

SEQ ID NO: 736655 - DNA, 22 bp, Artificial Sequence
  chemically synthesized
acttgtccaggcgcggtggctc

SEQ ID NO: 736656 - DNA, 22 bp, Artificial Sequence
  chemically synthesized
gacttgtccaggcgcggtggct

SEQ ID NO: 736657 - DNA, 22 bp, Artificial Sequence
  chemically synthesized
caggcgtgagccaccgcgcctg

SEQ ID NO: 736658 - DNA, 22 bp, Artificial Sequence
  chemically synthesized
aggaaatataaaaagaccttga

SEQ ID NO: 736659 - DNA, 22 bp, Artificial Sequence
  chemically synthesized
gacaagtcaaggtctttttata

SEQ ID NO: 736660 - DNA, 22 bp, Artificial Sequence
  chemically synthesized
taagtgacactgaggaaatata

SEQ ID NO: 736661 - DNA, 22 bp, Artificial Sequence
  chemically synthesized
ttgtaagtgacactgaggaaat

SEQ ID NO: 736662 - DNA, 22 bp, Artificial Sequence
  chemically synthesized
tttatatttcctcagtgtcact

SEQ ID NO: 736663 - DNA, 22 bp, Artificial Sequence
  chemically synthesized
ttatatttcctcagtgtcactt

SEQ ID NO: 736664 - DNA, 22 bp, Artificial Sequence
  chemically synthesized
tatatttcctcagtgtcactta

SEQ ID NO: 736665 - DNA, 22 bp, Artificial Sequence
  chemically synthesized
atatttcctcagtgtcacttac

SEQ ID NO: 736666 - DNA, 22 bp, Artificial Sequence
  chemically synthesized
tatttcctcagtgtcacttaca

SEQ ID NO: 736667 - DNA, 22 bp, Artificial Sequence
  chemically synthesized
cctcagtgtcacttacaataat

SEQ ID NO: 736668 - DNA, 22 bp, Artificial Sequence
  chemically synthesized
ctcagtgtcacttacaataatc

SEQ ID NO: 736669 - DNA, 22 bp, Artificial Sequence
  chemically synthesized
agtgtcacttacaataatccac

SEQ ID NO: 736670 - DNA, 22 bp, Artificial Sequence
  chemically synthesized
acaataatccacctacacttga

SEQ ID NO: 736671 - DNA, 22 bp, Artificial Sequence
  chemically synthesized
taacagagaaaatcaagtgtag

SEQ ID NO: 736672 - DNA, 22 bp, Artificial Sequence
  chemically synthesized
caataatccacctacacttgat

SEQ ID NO: 736673 - DNA, 22 bp, Artificial Sequence
  chemically synthesized
gtaacagagaaaatcaagtgta

SEQ ID NO: 736674 - DNA, 22 bp, Artificial Sequence
  chemically synthesized
tgtaacagagaaaatcaagtgt

SEQ ID NO: 736675 - DNA, 22 bp, Artificial Sequence
  chemically synthesized
ttgtaacagagaaaatcaagtg

SEQ ID NO: 736676 - DNA, 22 bp, Artificial Sequence
  chemically synthesized
tttgtaacagagaaaatcaagt

SEQ ID NO: 736677 - DNA, 22 bp, Artificial Sequence
  chemically synthesized
tctttttgtaacagagaaaatc

SEQ ID NO: 736678 - DNA, 22 bp, Artificial Sequence
  chemically synthesized
cacttgattttctctgttacaa

SEQ ID NO: 736679 - DNA, 22 bp, Artificial Sequence
  chemically synthesized
atatactatctttttgtaacag

SEQ ID NO: 736680 - DNA, 22 bp, Artificial Sequence
  chemically synthesized
aatatactatctttttgtaaca

SEQ ID NO: 736681 - DNA, 22 bp, Artificial Sequence
  chemically synthesized
taatatactatctttttgtaac

SEQ ID NO: 736682 - DNA, 22 bp, Artificial Sequence
  chemically synthesized
ttaatatactatctttttgtaa

SEQ ID NO: 736683 - DNA, 22 bp, Artificial Sequence
  chemically synthesized
gattttctctgttacaaaaaga

SEQ ID NO: 736684 - DNA, 22 bp, Artificial Sequence
  chemically synthesized
attttctctgttacaaaaagat

SEQ ID NO: 736685 - DNA, 22 bp, Artificial Sequence
  chemically synthesized
ccttttaatatactatcttttt

SEQ ID NO: 736686 - DNA, 22 bp, Artificial Sequence
  chemically synthesized
tctctgttacaaaaagatagta

SEQ ID NO: 736687 - DNA, 22 bp, Artificial Sequence
  chemically synthesized
ctctgttacaaaaagatagtat

SEQ ID NO: 736688 - DNA, 22 bp, Artificial Sequence
  chemically synthesized
tctgttacaaaaagatagtata

SEQ ID NO: 736689 - DNA, 22 bp, Artificial Sequence
  chemically synthesized
aactaccttttaatatactatc

SEQ ID NO: 736690 - DNA, 22 bp, Artificial Sequence
  chemically synthesized
tgttacaaaaagatagtatatt

SEQ ID NO: 736691 - DNA, 22 bp, Artificial Sequence
  chemically synthesized
ttacaaaaagatagtatattaa

SEQ ID NO: 736692 - DNA, 22 bp, Artificial Sequence
  chemically synthesized
caaaaagatagtatattaaaag

SEQ ID NO: 736693 - DNA, 22 bp, Artificial Sequence
  chemically synthesized
catccataaatatcgactgaac

SEQ ID NO: 736694 - DNA, 22 bp, Artificial Sequence
  chemically synthesized
ccatccataaatatcgactgaa

SEQ ID NO: 736695 - DNA, 22 bp, Artificial Sequence
  chemically synthesized
tttccatccataaatatcgact

SEQ ID NO: 736696 - DNA, 22 bp, Artificial Sequence
  chemically synthesized
aaaggtagttcagtcgatattt

SEQ ID NO: 736697 - DNA, 22 bp, Artificial Sequence
  chemically synthesized
tgtttccatccataaatatcga

SEQ ID NO: 736698 - DNA, 22 bp, Artificial Sequence
  chemically synthesized
acctctgtttccatccataaat

SEQ ID NO: 736699 - DNA, 22 bp, Artificial Sequence
  chemically synthesized
agtcgatatttatggatggaaa

SEQ ID NO: 736700 - DNA, 22 bp, Artificial Sequence
  chemically synthesized
aatattcacctctgtttccatc

SEQ ID NO: 736701 - DNA, 22 bp, Artificial Sequence
  chemically synthesized
taaatattcacctctgtttcca

SEQ ID NO: 736702 - DNA, 22 bp, Artificial Sequence
  chemically synthesized
ctaaatattcacctctgtttcc

SEQ ID NO: 736703 - DNA, 22 bp, Artificial Sequence
  chemically synthesized
tctaaatattcacctctgtttc

SEQ ID NO: 736704 - DNA, 22 bp, Artificial Sequence
  chemically synthesized
atggatggaaacagaggtgaat

SEQ ID NO: 736705 - DNA, 22 bp, Artificial Sequence
  chemically synthesized
gtctttctaaatattcacctct

SEQ ID NO: 736706 - DNA, 22 bp, Artificial Sequence
  chemically synthesized
tggatggaaacagaggtgaata

SEQ ID NO: 736707 - DNA, 22 bp, Artificial Sequence
  chemically synthesized
agtctttctaaatattcacctc

SEQ ID NO: 736708 - DNA, 22 bp, Artificial Sequence
  chemically synthesized
atttagtctttctaaatattca

SEQ ID NO: 736709 - DNA, 22 bp, Artificial Sequence
  chemically synthesized
gatttagtctttctaaatattc

SEQ ID NO: 736710 - DNA, 22 bp, Artificial Sequence
  chemically synthesized
agtttgatttagtctttctaaa

SEQ ID NO: 736711 - DNA, 22 bp, Artificial Sequence
  chemically synthesized
tctcagtttgatttagtctttc

SEQ ID NO: 736712 - DNA, 22 bp, Artificial Sequence
  chemically synthesized
ttatctcagtttgatttagtct

SEQ ID NO: 736713 - DNA, 22 bp, Artificial Sequence
  chemically synthesized
attatctcagtttgatttagtc

SEQ ID NO: 736714 - DNA, 22 bp, Artificial Sequence
  chemically synthesized
tattatctcagtttgatttagt

SEQ ID NO: 736715 - DNA, 22 bp, Artificial Sequence
  chemically synthesized
tttattatctcagtttgattta

SEQ ID NO: 736716 - DNA, 22 bp, Artificial Sequence
  chemically synthesized
ctttattatctcagtttgattt

SEQ ID NO: 736717 - DNA, 22 bp, Artificial Sequence
  chemically synthesized
agaaagactaaatcaaactgag

SEQ ID NO: 736718 - DNA, 22 bp, Artificial Sequence
  chemically synthesized
gaaagactaaatcaaactgaga

SEQ ID NO: 736719 - DNA, 22 bp, Artificial Sequence
  chemically synthesized
tatttctttattatctcagttt

SEQ ID NO: 736720 - DNA, 22 bp, Artificial Sequence
  chemically synthesized
atatttctttattatctcagtt

SEQ ID NO: 736721 - DNA, 22 bp, Artificial Sequence
  chemically synthesized
tagcttatatttctttattatc

SEQ ID NO: 736722 - DNA, 22 bp, Artificial Sequence
  chemically synthesized
aatcaaactgagataataaaga

SEQ ID NO: 736723 - DNA, 22 bp, Artificial Sequence
  chemically synthesized
aattatagcttatatttcttta

SEQ ID NO: 736724 - DNA, 22 bp, Artificial Sequence
  chemically synthesized
tgaattatagcttatatttctt

SEQ ID NO: 736725 - DNA, 22 bp, Artificial Sequence
  chemically synthesized
ctctgaattatagcttatattt

SEQ ID NO: 736726 - DNA, 22 bp, Artificial Sequence
  chemically synthesized
agataataaagaaatataagct

SEQ ID NO: 736727 - DNA, 22 bp, Artificial Sequence
  chemically synthesized
cattcctctgaattatagctta

SEQ ID NO: 736728 - DNA, 22 bp, Artificial Sequence
  chemically synthesized
gcattccattcctctgaattat

SEQ ID NO: 736729 - DNA, 22 bp, Artificial Sequence
  chemically synthesized
ggcattccattcctctgaatta

SEQ ID NO: 736730 - DNA, 22 bp, Artificial Sequence
  chemically synthesized
tggcattccattcctctgaatt

SEQ ID NO: 736731 - DNA, 22 bp, Artificial Sequence
  chemically synthesized
ttggcattccattcctctgaat

SEQ ID NO: 736732 - DNA, 22 bp, Artificial Sequence
  chemically synthesized
cttttggcattccattcctctg

SEQ ID NO: 736733 - DNA, 22 bp, Artificial Sequence
  chemically synthesized
acttttggcattccattcctct

SEQ ID NO: 736734 - DNA, 22 bp, Artificial Sequence
  chemically synthesized
cccttacttttggcattccatt

SEQ ID NO: 736735 - DNA, 22 bp, Artificial Sequence
  chemically synthesized
taattcagaggaatggaatgcc

SEQ ID NO: 736736 - DNA, 22 bp, Artificial Sequence
  chemically synthesized
cactccccttacttttggcatt

SEQ ID NO: 736737 - DNA, 22 bp, Artificial Sequence
  chemically synthesized
agaggaatggaatgccaaaagt

SEQ ID NO: 736738 - DNA, 22 bp, Artificial Sequence
  chemically synthesized
agattccactccccttactttt

SEQ ID NO: 736739 - DNA, 22 bp, Artificial Sequence
  chemically synthesized
cagattccactccccttacttt

SEQ ID NO: 736740 - DNA, 22 bp, Artificial Sequence
  chemically synthesized
aagttcatgactatgctctcat

SEQ ID NO: 736741 - DNA, 22 bp, Artificial Sequence
  chemically synthesized
gcaggaaaaaaatatgagagca

SEQ ID NO: 736742 - DNA, 22 bp, Artificial Sequence
  chemically synthesized
atgactatgctctcatattttt

SEQ ID NO: 736743 - DNA, 22 bp, Artificial Sequence
  chemically synthesized
ccaacagctggcaggaaaaaaa

SEQ ID NO: 736744 - DNA, 22 bp, Artificial Sequence
  chemically synthesized
tgctctcatatttttttcctgc

SEQ ID NO: 736745 - DNA, 22 bp, Artificial Sequence
  chemically synthesized
taccaacagctggcaggaaaaa

SEQ ID NO: 736746 - DNA, 22 bp, Artificial Sequence
  chemically synthesized
ctaccaacagctggcaggaaaa

SEQ ID NO: 736747 - DNA, 22 bp, Artificial Sequence
  chemically synthesized
tcatatttttttcctgccagct

SEQ ID NO: 736748 - DNA, 22 bp, Artificial Sequence
  chemically synthesized
atatttttttcctgccagctgt

SEQ ID NO: 736749 - DNA, 22 bp, Artificial Sequence
  chemically synthesized
ttttcctgccagctgttggtag

SEQ ID NO: 736750 - DNA, 22 bp, Artificial Sequence
  chemically synthesized
tttcctgccagctgttggtaga

SEQ ID NO: 736751 - DNA, 22 bp, Artificial Sequence
  chemically synthesized
ttcctgccagctgttggtagaa

SEQ ID NO: 736752 - DNA, 22 bp, Artificial Sequence
  chemically synthesized
tcctgccagctgttggtagaaa

SEQ ID NO: 736753 - DNA, 22 bp, Artificial Sequence
  chemically synthesized
cctgccagctgttggtagaaat

SEQ ID NO: 736754 - DNA, 22 bp, Artificial Sequence
  chemically synthesized
ctgccagctgttggtagaaatt

SEQ ID NO: 736755 - DNA, 22 bp, Artificial Sequence
  chemically synthesized
ccagctgttggtagaaattatt

SEQ ID NO: 736756 - DNA, 22 bp, Artificial Sequence
  chemically synthesized
ttggtagaaattattattatga

SEQ ID NO: 736757 - DNA, 22 bp, Artificial Sequence
  chemically synthesized
gtagaaattattattatgatga

SEQ ID NO: 736758 - DNA, 22 bp, Artificial Sequence
  chemically synthesized
ttattatgatgatgatgattat

SEQ ID NO: 736759 - DNA, 22 bp, Artificial Sequence
  chemically synthesized
ttatgatgatgatgattatgat

SEQ ID NO: 736760 - DNA, 22 bp, Artificial Sequence
  chemically synthesized
aaaataataataatcataatca

SEQ ID NO: 736761 - DNA, 22 bp, Artificial Sequence
  chemically synthesized
tgatgatgatgattatgattat

SEQ ID NO: 736762 - DNA, 22 bp, Artificial Sequence
  chemically synthesized
cgtctcaaaataataataatca

SEQ ID NO: 736763 - DNA, 22 bp, Artificial Sequence
  chemically synthesized
tgattattattattttgagacg

SEQ ID NO: 736764 - DNA, 22 bp, Artificial Sequence
  chemically synthesized
ttattattttgagacggagttt

SEQ ID NO: 736765 - DNA, 22 bp, Artificial Sequence
  chemically synthesized
ttattttgagacggagtttcgc

SEQ ID NO: 736766 - DNA, 22 bp, Artificial Sequence
  chemically synthesized
ttttgagacggagtttcgctct

SEQ ID NO: 736767 - DNA, 22 bp, Artificial Sequence
  chemically synthesized
cagccggggcaacaagagcgaa

SEQ ID NO: 736768 - DNA, 22 bp, Artificial Sequence
  chemically synthesized
tgagacggagtttcgctcttgt

SEQ ID NO: 736769 - DNA, 22 bp, Artificial Sequence
  chemically synthesized
gagacggagtttcgctcttgtt

SEQ ID NO: 736770 - DNA, 22 bp, Artificial Sequence
  chemically synthesized
agacggagtttcgctcttgttg

SEQ ID NO: 736771 - DNA, 22 bp, Artificial Sequence
  chemically synthesized
cactccagccggggcaacaaga

SEQ ID NO: 736772 - DNA, 22 bp, Artificial Sequence
  chemically synthesized
cgctcttgttgccccggctgga

SEQ ID NO: 736773 - DNA, 22 bp, Artificial Sequence
  chemically synthesized
gctcttgttgccccggctggag

SEQ ID NO: 736774 - DNA, 22 bp, Artificial Sequence
  chemically synthesized
ttgttgccccggctggagtgca

SEQ ID NO: 736775 - DNA, 22 bp, Artificial Sequence
  chemically synthesized
gttgccccggctggagtgcaat

SEQ ID NO: 736776 - DNA, 22 bp, Artificial Sequence
  chemically synthesized
ttgccccggctggagtgcaatg

SEQ ID NO: 736777 - DNA, 22 bp, Artificial Sequence
  chemically synthesized
ccccggctggagtgcaatggcg

SEQ ID NO: 736778 - DNA, 22 bp, Artificial Sequence
  chemically synthesized
tgagccaagatcacgccattgc

SEQ ID NO: 736779 - DNA, 22 bp, Artificial Sequence
  chemically synthesized
ctgtgagccaagatcacgccat

SEQ ID NO: 736780 - DNA, 22 bp, Artificial Sequence
  chemically synthesized
gagtgcaatggcgtgatcttgg

SEQ ID NO: 736781 - DNA, 22 bp, Artificial Sequence
  chemically synthesized
aacccaggaggcggaggttgct

SEQ ID NO: 736782 - DNA, 22 bp, Artificial Sequence
  chemically synthesized
gaacccaggaggcggaggttgc

SEQ ID NO: 736783 - DNA, 22 bp, Artificial Sequence
  chemically synthesized
ggctcacagcaacctccgcctc

SEQ ID NO: 736784 - DNA, 22 bp, Artificial Sequence
  chemically synthesized
gctcacagcaacctccgcctcc

SEQ ID NO: 736785 - DNA, 22 bp, Artificial Sequence
  chemically synthesized
acagcaacctccgcctcctggg

SEQ ID NO: 736786 - DNA, 22 bp, Artificial Sequence
  chemically synthesized
aggcaggagaatggcttgaacc

SEQ ID NO: 736787 - DNA, 22 bp, Artificial Sequence
  chemically synthesized
cgcctcctgggttcaagccatt

SEQ ID NO: 736788 - DNA, 22 bp, Artificial Sequence
  chemically synthesized
ctgggttcaagccattctcctg

SEQ ID NO: 736789 - DNA, 22 bp, Artificial Sequence
  chemically synthesized
gggaggctgaggcaggagaatg

SEQ ID NO: 736790 - DNA, 22 bp, Artificial Sequence
  chemically synthesized
ggttcaagccattctcctgcct

SEQ ID NO: 736791 - DNA, 22 bp, Artificial Sequence
  chemically synthesized
ctcgggaggctgaggcaggaga

SEQ ID NO: 736792 - DNA, 22 bp, Artificial Sequence
  chemically synthesized
aagccattctcctgcctcagcc

SEQ ID NO: 736793 - DNA, 22 bp, Artificial Sequence
  chemically synthesized
agctactcgggaggctgaggca

SEQ ID NO: 736794 - DNA, 22 bp, Artificial Sequence
  chemically synthesized
taatctcagctactcgggaggc

SEQ ID NO: 736795 - DNA, 22 bp, Artificial Sequence
  chemically synthesized
tcctgcctcagcctcccgagta

SEQ ID NO: 736796 - DNA, 22 bp, Artificial Sequence
  chemically synthesized
ctgcctcagcctcccgagtagc

SEQ ID NO: 736797 - DNA, 22 bp, Artificial Sequence
  chemically synthesized
cctcagcctcccgagtagctga

SEQ ID NO: 736798 - DNA, 22 bp, Artificial Sequence
  chemically synthesized
agcctcccgagtagctgagatt

SEQ ID NO: 736799 - DNA, 22 bp, Artificial Sequence
  chemically synthesized
ccgagtagctgagattacaggc

SEQ ID NO: 736800 - DNA, 22 bp, Artificial Sequence
  chemically synthesized
ggcgtggtggcacatgcctgta

SEQ ID NO: 736801 - DNA, 22 bp, Artificial Sequence
  chemically synthesized
gctgggcgtggtggcacatgcc

SEQ ID NO: 736802 - DNA, 22 bp, Artificial Sequence
  chemically synthesized
agattacaggcatgtgccacca

SEQ ID NO: 736803 - DNA, 22 bp, Artificial Sequence
  chemically synthesized
caggcatgtgccaccacgccca

SEQ ID NO: 736804 - DNA, 22 bp, Artificial Sequence
  chemically synthesized
aaaatacaaaattagctgggcg

SEQ ID NO: 736805 - DNA, 22 bp, Artificial Sequence
  chemically synthesized
ctaaaaatacaaaattagctgg

SEQ ID NO: 736806 - DNA, 22 bp, Artificial Sequence
  chemically synthesized
tactaaaaatacaaaattagct

SEQ ID NO: 736807 - DNA, 22 bp, Artificial Sequence
  chemically synthesized
attttgtatttttagtagagat

SEQ ID NO: 736808 - DNA, 22 bp, Artificial Sequence
  chemically synthesized
tgtatttttagtagagatgggg

SEQ ID NO: 736809 - DNA, 22 bp, Artificial Sequence
  chemically synthesized
gtatttttagtagagatggggt

SEQ ID NO: 736810 - DNA, 22 bp, Artificial Sequence
  chemically synthesized
tatttttagtagagatggggtt

SEQ ID NO: 736811 - DNA, 22 bp, Artificial Sequence
  chemically synthesized
accaacatggagaaaccccatc

SEQ ID NO: 736812 - DNA, 22 bp, Artificial Sequence
  chemically synthesized
ttagtagagatggggtttctcc

SEQ ID NO: 736813 - DNA, 22 bp, Artificial Sequence
  chemically synthesized
tagtagagatggggtttctcca

SEQ ID NO: 736814 - DNA, 22 bp, Artificial Sequence
  chemically synthesized
agtagagatggggtttctccat

SEQ ID NO: 736815 - DNA, 22 bp, Artificial Sequence
  chemically synthesized
gtagagatggggtttctccatg

SEQ ID NO: 736816 - DNA, 22 bp, Artificial Sequence
  chemically synthesized
gagaccagcctgaccaacatgg

SEQ ID NO: 736817 - DNA, 22 bp, Artificial Sequence
  chemically synthesized
ctccatgttggtcaggctggtc

SEQ ID NO: 736818 - DNA, 22 bp, Artificial Sequence
  chemically synthesized
tccatgttggtcaggctggtct

SEQ ID NO: 736819 - DNA, 22 bp, Artificial Sequence
  chemically synthesized
catgttggtcaggctggtctcg

SEQ ID NO: 736820 - DNA, 22 bp, Artificial Sequence
  chemically synthesized
aggtccggagttcgagaccagc

SEQ ID NO: 736821 - DNA, 22 bp, Artificial Sequence
  chemically synthesized
gtcaggctggtctcgaactccg

SEQ ID NO: 736822 - DNA, 22 bp, Artificial Sequence
  chemically synthesized
gtctcgaactccggacctcagg

SEQ ID NO: 736823 - DNA, 22 bp, Artificial Sequence
  chemically synthesized
gaactccggacctcaggtgatc

SEQ ID NO: 736824 - DNA, 22 bp, Artificial Sequence
  chemically synthesized
ggaggccgaggcgggtggatca

SEQ ID NO: 736825 - DNA, 22 bp, Artificial Sequence
  chemically synthesized
cggacctcaggtgatccacccg

SEQ ID NO: 736826 - DNA, 22 bp, Artificial Sequence
  chemically synthesized
gggaggccgaggcgggtggatc

SEQ ID NO: 736827 - DNA, 22 bp, Artificial Sequence
  chemically synthesized
tgggaggccgaggcgggtggat

SEQ ID NO: 736828 - DNA, 22 bp, Artificial Sequence
  chemically synthesized
aggtgatccacccgcctcggcc

SEQ ID NO: 736829 - DNA, 22 bp, Artificial Sequence
  chemically synthesized
taatcccagcactttgggaggc

SEQ ID NO: 736830 - DNA, 22 bp, Artificial Sequence
  chemically synthesized
acgcctgtaatcccagcacttt

SEQ ID NO: 736831 - DNA, 22 bp, Artificial Sequence
  chemically synthesized
ggcctcccaaagtgctgggatt

SEQ ID NO: 736832 - DNA, 22 bp, Artificial Sequence
  chemically synthesized
ccaaagtgctgggattacaggc

SEQ ID NO: 736833 - DNA, 22 bp, Artificial Sequence
  chemically synthesized
gccaggcgcagtggctcacgcc

SEQ ID NO: 736834 - DNA, 22 bp, Artificial Sequence
  chemically synthesized
tggccaggcgcagtggctcacg

SEQ ID NO: 736835 - DNA, 22 bp, Artificial Sequence
  chemically synthesized
ctggccaggcgcagtggctcac

SEQ ID NO: 736836 - DNA, 22 bp, Artificial Sequence
  chemically synthesized
ggattacaggcgtgagccactg

SEQ ID NO: 736837 - DNA, 22 bp, Artificial Sequence
  chemically synthesized
caggcgtgagccactgcgcctg

SEQ ID NO: 736838 - DNA, 22 bp, Artificial Sequence
  chemically synthesized
atataataatttctggccaggc

SEQ ID NO: 736839 - DNA, 22 bp, Artificial Sequence
  chemically synthesized
catataataatttctggccagg

SEQ ID NO: 736840 - DNA, 22 bp, Artificial Sequence
  chemically synthesized
gtttcatataataatttctggc

SEQ ID NO: 736841 - DNA, 22 bp, Artificial Sequence
  chemically synthesized
tagtttcatataataatttctg

SEQ ID NO: 736842 - DNA, 22 bp, Artificial Sequence
  chemically synthesized
ctagtttcatataataatttct

SEQ ID NO: 736843 - DNA, 22 bp, Artificial Sequence
  chemically synthesized
cgcctggccagaaattattata

SEQ ID NO: 736844 - DNA, 22 bp, Artificial Sequence
  chemically synthesized
gccagaaattattatatgaaac

SEQ ID NO: 736845 - DNA, 22 bp, Artificial Sequence
  chemically synthesized
aacaggcttctagtttcatata

SEQ ID NO: 736846 - DNA, 22 bp, Artificial Sequence
  chemically synthesized
aaattgaacaggcttctagttt

SEQ ID NO: 736847 - DNA, 22 bp, Artificial Sequence
  chemically synthesized
ttaaaattgaacaggcttctag

SEQ ID NO: 736848 - DNA, 22 bp, Artificial Sequence
  chemically synthesized
gttaaaattgaacaggcttcta

SEQ ID NO: 736849 - DNA, 22 bp, Artificial Sequence
  chemically synthesized
ttatatgaaactagaagcctgt

SEQ ID NO: 736850 - DNA, 22 bp, Artificial Sequence
  chemically synthesized
tgttaaaattgaacaggcttct

SEQ ID NO: 736851 - DNA, 22 bp, Artificial Sequence
  chemically synthesized
ttgttaaaattgaacaggcttc

SEQ ID NO: 736852 - DNA, 22 bp, Artificial Sequence
  chemically synthesized
tatgaaactagaagcctgttca

SEQ ID NO: 736853 - DNA, 22 bp, Artificial Sequence
  chemically synthesized
catccttttgttaaaattgaac

SEQ ID NO: 736854 - DNA, 22 bp, Artificial Sequence
  chemically synthesized
gaagcctgttcaattttaacaa

SEQ ID NO: 736855 - DNA, 22 bp, Artificial Sequence
  chemically synthesized
catcatatctgcatccttttgt

SEQ ID NO: 736856 - DNA, 22 bp, Artificial Sequence
  chemically synthesized
ttcaattttaacaaaaggatgc

SEQ ID NO: 736857 - DNA, 22 bp, Artificial Sequence
  chemically synthesized
aattttaacaaaaggatgcaga

SEQ ID NO: 736858 - DNA, 22 bp, Artificial Sequence
  chemically synthesized
aacagttgcatcatatctgcat

SEQ ID NO: 736859 - DNA, 22 bp, Artificial Sequence
  chemically synthesized
taacaaaaggatgcagatatga

SEQ ID NO: 736860 - DNA, 22 bp, Artificial Sequence
  chemically synthesized
aacaaaaggatgcagatatgat

SEQ ID NO: 736861 - DNA, 22 bp, Artificial Sequence
  chemically synthesized
acaaaaggatgcagatatgatg

SEQ ID NO: 736862 - DNA, 22 bp, Artificial Sequence
  chemically synthesized
tgttcaacagttgcatcatatc

SEQ ID NO: 736863 - DNA, 22 bp, Artificial Sequence
  chemically synthesized
atgttcaacagttgcatcatat

SEQ ID NO: 736864 - DNA, 22 bp, Artificial Sequence
  chemically synthesized
tcttatgttcaacagttgcatc

SEQ ID NO: 736865 - DNA, 22 bp, Artificial Sequence
  chemically synthesized
gtcttatgttcaacagttgcat

SEQ ID NO: 736866 - DNA, 22 bp, Artificial Sequence
  chemically synthesized
atttgtcttatgttcaacagtt

SEQ ID NO: 736867 - DNA, 22 bp, Artificial Sequence
  chemically synthesized
aatttgtcttatgttcaacagt

SEQ ID NO: 736868 - DNA, 22 bp, Artificial Sequence
  chemically synthesized
taatttgtcttatgttcaacag

SEQ ID NO: 736869 - DNA, 22 bp, Artificial Sequence
  chemically synthesized
ttgaacataagacaaattaaaa

SEQ ID NO: 736870 - DNA, 22 bp, Artificial Sequence
  chemically synthesized
aacataagacaaattaaaatat

SEQ ID NO: 736871 - DNA, 22 bp, Artificial Sequence
  chemically synthesized
aaatattttctttcttttcttt

SEQ ID NO: 736872 - DNA, 22 bp, Artificial Sequence
  chemically synthesized
tctttcttttcttttctttctc

SEQ ID NO: 736873 - DNA, 22 bp, Artificial Sequence
  chemically synthesized
ctttcttttcttttctttctct

SEQ ID NO: 736874 - DNA, 22 bp, Artificial Sequence
  chemically synthesized
tttcttttcttttctttctctc

SEQ ID NO: 736875 - DNA, 22 bp, Artificial Sequence
  chemically synthesized
tcttttcttttctttctctctc

SEQ ID NO: 736876 - DNA, 22 bp, Artificial Sequence
  chemically synthesized
cttttcttttctttctctctct

SEQ ID NO: 736877 - DNA, 22 bp, Artificial Sequence
  chemically synthesized
ttttcttttctttctctctctc

SEQ ID NO: 736878 - DNA, 22 bp, Artificial Sequence
  chemically synthesized
ttcttttctttctctctctctc

SEQ ID NO: 736879 - DNA, 22 bp, Artificial Sequence
  chemically synthesized
tcttttctttctctctctctct

SEQ ID NO: 736880 - DNA, 22 bp, Artificial Sequence
  chemically synthesized
aaaaagaaagaaagagagagag

SEQ ID NO: 736881 - DNA, 22 bp, Artificial Sequence
  chemically synthesized
cttttctttctctctctctctt

SEQ ID NO: 736882 - DNA, 22 bp, Artificial Sequence
  chemically synthesized
ttttctttctctctctctcttt

SEQ ID NO: 736883 - DNA, 22 bp, Artificial Sequence
  chemically synthesized
ttctttctctctctctctttct

SEQ ID NO: 736884 - DNA, 22 bp, Artificial Sequence
  chemically synthesized
tctttctctctctctctttctt

SEQ ID NO: 736885 - DNA, 22 bp, Artificial Sequence
  chemically synthesized
ctttctctctctctctttcttt

SEQ ID NO: 736886 - DNA, 22 bp, Artificial Sequence
  chemically synthesized
catctaaaaaagaaagaaagag

SEQ ID NO: 736887 - DNA, 22 bp, Artificial Sequence
  chemically synthesized
tttctctctctctctttctttc

SEQ ID NO: 736888 - DNA, 22 bp, Artificial Sequence
  chemically synthesized
tctctctctctctttctttctt

SEQ ID NO: 736889 - DNA, 22 bp, Artificial Sequence
  chemically synthesized
ctctctctctctttctttcttt

SEQ ID NO: 736890 - DNA, 22 bp, Artificial Sequence
  chemically synthesized
tctctctctctttctttctttt

SEQ ID NO: 736891 - DNA, 22 bp, Artificial Sequence
  chemically synthesized
tctctctctttctttctttttt

SEQ ID NO: 736892 - DNA, 22 bp, Artificial Sequence
  chemically synthesized
tctctctttctttcttttttag

SEQ ID NO: 736893 - DNA, 22 bp, Artificial Sequence
  chemically synthesized
tctctttctttcttttttagat

SEQ ID NO: 736894 - DNA, 22 bp, Artificial Sequence
  chemically synthesized
tctttctttcttttttagatgg

SEQ ID NO: 736895 - DNA, 22 bp, Artificial Sequence
  chemically synthesized
tttctttcttttttagatggag

SEQ ID NO: 736896 - DNA, 22 bp, Artificial Sequence
  chemically synthesized
tctttcttttttagatggagtc

SEQ ID NO: 736897 - DNA, 22 bp, Artificial Sequence
  chemically synthesized
ggtagagagggagactccatct

SEQ ID NO: 736898 - DNA, 22 bp, Artificial Sequence
  chemically synthesized
ctttcttttttagatggagtct

SEQ ID NO: 736899 - DNA, 22 bp, Artificial Sequence
  chemically synthesized
tttcttttttagatggagtctc

SEQ ID NO: 736900 - DNA, 22 bp, Artificial Sequence
  chemically synthesized
tcttttttagatggagtctccc

SEQ ID NO: 736901 - DNA, 22 bp, Artificial Sequence
  chemically synthesized
cttttttagatggagtctccct

SEQ ID NO: 736902 - DNA, 22 bp, Artificial Sequence
  chemically synthesized
ttttttagatggagtctccctc

SEQ ID NO: 736903 - DNA, 22 bp, Artificial Sequence
  chemically synthesized
cagcctgggtagagagggagac

SEQ ID NO: 736904 - DNA, 22 bp, Artificial Sequence
  chemically synthesized
ttttagatggagtctccctctc

SEQ ID NO: 736905 - DNA, 22 bp, Artificial Sequence
  chemically synthesized
tttagatggagtctccctctct

SEQ ID NO: 736906 - DNA, 22 bp, Artificial Sequence
  chemically synthesized
ttagatggagtctccctctcta

SEQ ID NO: 736907 - DNA, 22 bp, Artificial Sequence
  chemically synthesized
tagatggagtctccctctctac

SEQ ID NO: 736908 - DNA, 22 bp, Artificial Sequence
  chemically synthesized
agatggagtctccctctctacc

SEQ ID NO: 736909 - DNA, 22 bp, Artificial Sequence
  chemically synthesized
cactccagcctgggtagagagg

SEQ ID NO: 736910 - DNA, 22 bp, Artificial Sequence
  chemically synthesized
gatggagtctccctctctaccc

SEQ ID NO: 736911 - DNA, 22 bp, Artificial Sequence
  chemically synthesized
cctctctacccaggctggagtg

SEQ ID NO: 736912 - DNA, 22 bp, Artificial Sequence
  chemically synthesized
agatcatgccactgcactccag

SEQ ID NO: 736913 - DNA, 22 bp, Artificial Sequence
  chemically synthesized
tctacccaggctggagtgcagt

SEQ ID NO: 736914 - DNA, 22 bp, Artificial Sequence
  chemically synthesized
tacccaggctggagtgcagtgg

SEQ ID NO: 736915 - DNA, 22 bp, Artificial Sequence
  chemically synthesized
cccaggctggagtgcagtggca

SEQ ID NO: 736916 - DNA, 22 bp, Artificial Sequence
  chemically synthesized
cagtgagctgagatcatgccac

SEQ ID NO: 736917 - DNA, 22 bp, Artificial Sequence
  chemically synthesized
gagtgcagtggcatgatctcag

SEQ ID NO: 736918 - DNA, 22 bp, Artificial Sequence
  chemically synthesized
aacccgggaggtggaggttgca

SEQ ID NO: 736919 - DNA, 22 bp, Artificial Sequence
  chemically synthesized
gaacccgggaggtggaggttgc

SEQ ID NO: 736920 - DNA, 22 bp, Artificial Sequence
  chemically synthesized
agctcactgcaacctccacctc

SEQ ID NO: 736921 - DNA, 22 bp, Artificial Sequence
  chemically synthesized
actgcaacctccacctcccggg

SEQ ID NO: 736922 - DNA, 22 bp, Artificial Sequence
  chemically synthesized
caacctccacctcccgggttca

SEQ ID NO: 736923 - DNA, 22 bp, Artificial Sequence
  chemically synthesized
aggcaggagaatcacttgaacc

SEQ ID NO: 736924 - DNA, 22 bp, Artificial Sequence
  chemically synthesized
cacctcccgggttcaagtgatt

SEQ ID NO: 736925 - DNA, 22 bp, Artificial Sequence
  chemically synthesized
ccgggttcaagtgattctcctg

SEQ ID NO: 736926 - DNA, 22 bp, Artificial Sequence
  chemically synthesized
aggaggctgaggcaggagaatc

SEQ ID NO: 736927 - DNA, 22 bp, Artificial Sequence
  chemically synthesized
ctcaggaggctgaggcaggaga

SEQ ID NO: 736928 - DNA, 22 bp, Artificial Sequence
  chemically synthesized
aagtgattctcctgcctcagcc

SEQ ID NO: 736929 - DNA, 22 bp, Artificial Sequence
  chemically synthesized
taatcccaactactcaggaggc

SEQ ID NO: 736930 - DNA, 22 bp, Artificial Sequence
  chemically synthesized
tcctgcctcagcctcctgagta

SEQ ID NO: 736931 - DNA, 22 bp, Artificial Sequence
  chemically synthesized
ctgcctcagcctcctgagtagt

SEQ ID NO: 736932 - DNA, 22 bp, Artificial Sequence
  chemically synthesized
cctcagcctcctgagtagttgg

SEQ ID NO: 736933 - DNA, 22 bp, Artificial Sequence
  chemically synthesized
agcctcctgagtagttgggatt

SEQ ID NO: 736934 - DNA, 22 bp, Artificial Sequence
  chemically synthesized
ctgagtagttgggattacaggc

SEQ ID NO: 736935 - DNA, 22 bp, Artificial Sequence
  chemically synthesized
agtagttgggattacaggcatg

SEQ ID NO: 736936 - DNA, 22 bp, Artificial Sequence
  chemically synthesized
gccaggcatggtgacgcatgcc

SEQ ID NO: 736937 - DNA, 22 bp, Artificial Sequence
  chemically synthesized
ggattacaggcatgcgtcacca

SEQ ID NO: 736938 - DNA, 22 bp, Artificial Sequence
  chemically synthesized
caggcatgcgtcaccatgcctg

SEQ ID NO: 736939 - DNA, 22 bp, Artificial Sequence
  chemically synthesized
aatcaaaaatacaaaaattagc

SEQ ID NO: 736940 - DNA, 22 bp, Artificial Sequence
  chemically synthesized
gctaatttttgtatttttgatt

SEQ ID NO: 736941 - DNA, 22 bp, Artificial Sequence
  chemically synthesized
atttttgtatttttgattgaga

SEQ ID NO: 736942 - DNA, 22 bp, Artificial Sequence
  chemically synthesized
ttgtatttttgattgagacggg

SEQ ID NO: 736943 - DNA, 22 bp, Artificial Sequence
  chemically synthesized
tgtatttttgattgagacgggg

SEQ ID NO: 736944 - DNA, 22 bp, Artificial Sequence
  chemically synthesized
gtatttttgattgagacggggt

SEQ ID NO: 736945 - DNA, 22 bp, Artificial Sequence
  chemically synthesized
tatttttgattgagacggggtt

SEQ ID NO: 736946 - DNA, 22 bp, Artificial Sequence
  chemically synthesized
accaacatggtaaaaccccgtc

SEQ ID NO: 736947 - DNA, 22 bp, Artificial Sequence
  chemically synthesized
ttgattgagacggggttttacc

SEQ ID NO: 736948 - DNA, 22 bp, Artificial Sequence
  chemically synthesized
tgattgagacggggttttacca

SEQ ID NO: 736949 - DNA, 22 bp, Artificial Sequence
  chemically synthesized
gattgagacggggttttaccat

SEQ ID NO: 736950 - DNA, 22 bp, Artificial Sequence
  chemically synthesized
attgagacggggttttaccatg

SEQ ID NO: 736951 - DNA, 22 bp, Artificial Sequence
  chemically synthesized
agacggggttttaccatgttgg

SEQ ID NO: 736952 - DNA, 22 bp, Artificial Sequence
  chemically synthesized
gagaccagcctgaccaacatgg

SEQ ID NO: 736953 - DNA, 22 bp, Artificial Sequence
  chemically synthesized
taccatgttggtcaggctggtc

SEQ ID NO: 736954 - DNA, 22 bp, Artificial Sequence
  chemically synthesized
accatgttggtcaggctggtct

SEQ ID NO: 736955 - DNA, 22 bp, Artificial Sequence
  chemically synthesized
ccatgttggtcaggctggtctc

SEQ ID NO: 736956 - DNA, 22 bp, Artificial Sequence
  chemically synthesized
gtcaggctggtctcgaacgcct

SEQ ID NO: 736957 - DNA, 22 bp, Artificial Sequence
  chemically synthesized
gtctcgaacgcctgacctcatg

SEQ ID NO: 736958 - DNA, 22 bp, Artificial Sequence
  chemically synthesized
gaacgcctgacctcatgatctg

SEQ ID NO: 736959 - DNA, 22 bp, Artificial Sequence
  chemically synthesized
ggaggccgaggtgagcagatca

SEQ ID NO: 736960 - DNA, 22 bp, Artificial Sequence
  chemically synthesized
tgggaggccgaggtgagcagat

SEQ ID NO: 736961 - DNA, 22 bp, Artificial Sequence
  chemically synthesized
acctcatgatctgctcacctcg

SEQ ID NO: 736962 - DNA, 22 bp, Artificial Sequence
  chemically synthesized
atgatctgctcacctcggcctc

SEQ ID NO: 736963 - DNA, 22 bp, Artificial Sequence
  chemically synthesized
tggtcccagcactctgggaggc

SEQ ID NO: 736964 - DNA, 22 bp, Artificial Sequence
  chemically synthesized
ctcacctcggcctcccagagtg

SEQ ID NO: 736965 - DNA, 22 bp, Artificial Sequence
  chemically synthesized
acctcggcctcccagagtgctg

SEQ ID NO: 736966 - DNA, 22 bp, Artificial Sequence
  chemically synthesized
acacctgtggtcccagcactct

SEQ ID NO: 736967 - DNA, 22 bp, Artificial Sequence
  chemically synthesized
ggcctcccagagtgctgggacc

SEQ ID NO: 736968 - DNA, 22 bp, Artificial Sequence
  chemically synthesized
ccagagtgctgggaccacaggt

SEQ ID NO: 736969 - DNA, 22 bp, Artificial Sequence
  chemically synthesized
ggccaggtgcggtggctcacac

SEQ ID NO: 736970 - DNA, 22 bp, Artificial Sequence
  chemically synthesized
gggccaggtgcggtggctcaca

SEQ ID NO: 736971 - DNA, 22 bp, Artificial Sequence
  chemically synthesized
ggaccacaggtgtgagccaccg

SEQ ID NO: 736972 - DNA, 22 bp, Artificial Sequence
  chemically synthesized
atttgggccaggtgcggtggct

SEQ ID NO: 736973 - DNA, 22 bp, Artificial Sequence
  chemically synthesized
aatttgggccaggtgcggtggc

SEQ ID NO: 736974 - DNA, 22 bp, Artificial Sequence
  chemically synthesized
taatttgggccaggtgcggtgg

SEQ ID NO: 736975 - DNA, 22 bp, Artificial Sequence
  chemically synthesized
caatgaaaatattttaatttgg

SEQ ID NO: 736976 - DNA, 22 bp, Artificial Sequence
  chemically synthesized
gcaatgaaaatattttaatttg

SEQ ID NO: 736977 - DNA, 22 bp, Artificial Sequence
  chemically synthesized
tatttgcaatgaaaatatttta

SEQ ID NO: 736978 - DNA, 22 bp, Artificial Sequence
  chemically synthesized
gtatttgcaatgaaaatatttt

SEQ ID NO: 736979 - DNA, 22 bp, Artificial Sequence
  chemically synthesized
tgtatttgcaatgaaaatattt

SEQ ID NO: 736980 - DNA, 22 bp, Artificial Sequence
  chemically synthesized
gcccaaattaaaatattttcat

SEQ ID NO: 736981 - DNA, 22 bp, Artificial Sequence
  chemically synthesized
gtattttgtatttgcaatgaaa

SEQ ID NO: 736982 - DNA, 22 bp, Artificial Sequence
  chemically synthesized
ggtattttgtatttgcaatgaa

SEQ ID NO: 736983 - DNA, 22 bp, Artificial Sequence
  chemically synthesized
ttggtattttgtatttgcaatg

SEQ ID NO: 736984 - DNA, 22 bp, Artificial Sequence
  chemically synthesized
aaatattttcattgcaaataca

SEQ ID NO: 736985 - DNA, 22 bp, Artificial Sequence
  chemically synthesized
tcattgcaaatacaaaatacca

SEQ ID NO: 736986 - DNA, 22 bp, Artificial Sequence
  chemically synthesized
cattgcaaatacaaaataccaa

SEQ ID NO: 736987 - DNA, 22 bp, Artificial Sequence
  chemically synthesized
attgcaaatacaaaataccaag

SEQ ID NO: 736988 - DNA, 22 bp, Artificial Sequence
  chemically synthesized
tatatagaacctcttggtattt

SEQ ID NO: 736989 - DNA, 22 bp, Artificial Sequence
  chemically synthesized
caaatacaaaataccaagaggt

SEQ ID NO: 736990 - DNA, 22 bp, Artificial Sequence
  chemically synthesized
aaagattatatatagaacctct

SEQ ID NO: 736991 - DNA, 22 bp, Artificial Sequence
  chemically synthesized
caaagattatatatagaacctc

SEQ ID NO: 736992 - DNA, 22 bp, Artificial Sequence
  chemically synthesized
tcaaagattatatatagaacct

SEQ ID NO: 736993 - DNA, 22 bp, Artificial Sequence
  chemically synthesized
aatagaaagggtactttcaaag

SEQ ID NO: 736994 - DNA, 22 bp, Artificial Sequence
  chemically synthesized
aaatagaaagggtactttcaaa

SEQ ID NO: 736995 - DNA, 22 bp, Artificial Sequence
  chemically synthesized
tatatataatctttgaaagtac

SEQ ID NO: 736996 - DNA, 22 bp, Artificial Sequence
  chemically synthesized
taaatagaaagggtactttcaa

SEQ ID NO: 736997 - DNA, 22 bp, Artificial Sequence
  chemically synthesized
tatataatctttgaaagtaccc

SEQ ID NO: 736998 - DNA, 22 bp, Artificial Sequence
  chemically synthesized
atctttaaatagaaagggtact

SEQ ID NO: 736999 - DNA, 22 bp, Artificial Sequence
  chemically synthesized
tgaaagtaccctttctatttaa

SEQ ID NO: 737000 - DNA, 22 bp, Artificial Sequence
  chemically synthesized
gaaagtaccctttctatttaaa

SEQ ID NO: 737001 - DNA, 22 bp, Artificial Sequence
  chemically synthesized
aaagtaccctttctatttaaag

SEQ ID NO: 737002 - DNA, 22 bp, Artificial Sequence
  chemically synthesized
tctatttaaagatcaggatttt

SEQ ID NO: 737003 - DNA, 22 bp, Artificial Sequence
  chemically synthesized
gacatgtgaaaaaaaatcctga

SEQ ID NO: 737004 - DNA, 22 bp, Artificial Sequence
  chemically synthesized
ctatttaaagatcaggattttt

SEQ ID NO: 737005 - DNA, 22 bp, Artificial Sequence
  chemically synthesized
tatttaaagatcaggatttttt

SEQ ID NO: 737006 - DNA, 22 bp, Artificial Sequence
  chemically synthesized
tagacatgtgaaaaaaaatcct

SEQ ID NO: 737007 - DNA, 22 bp, Artificial Sequence
  chemically synthesized
ctagacatgtgaaaaaaaatcc

SEQ ID NO: 737008 - DNA, 22 bp, Artificial Sequence
  chemically synthesized
tttaaagatcaggatttttttt

SEQ ID NO: 737009 - DNA, 22 bp, Artificial Sequence
  chemically synthesized
tctagacatgtgaaaaaaaatc

SEQ ID NO: 737010 - DNA, 22 bp, Artificial Sequence
  chemically synthesized
tttctagacatgtgaaaaaaaa

SEQ ID NO: 737011 - DNA, 22 bp, Artificial Sequence
  chemically synthesized
aaagatcaggattttttttcac

SEQ ID NO: 737012 - DNA, 22 bp, Artificial Sequence
  chemically synthesized
ctttctagacatgtgaaaaaaa

SEQ ID NO: 737013 - DNA, 22 bp, Artificial Sequence
  chemically synthesized
aagatcaggattttttttcaca

SEQ ID NO: 737014 - DNA, 22 bp, Artificial Sequence
  chemically synthesized
aaccaaatttctttctagacat

SEQ ID NO: 737015 - DNA, 22 bp, Artificial Sequence
  chemically synthesized
tttttcacatgtctagaaagaa

SEQ ID NO: 737016 - DNA, 22 bp, Artificial Sequence
  chemically synthesized
ttttcacatgtctagaaagaaa

SEQ ID NO: 737017 - DNA, 22 bp, Artificial Sequence
  chemically synthesized
tttcacatgtctagaaagaaat

SEQ ID NO: 737018 - DNA, 22 bp, Artificial Sequence
  chemically synthesized
ttcacatgtctagaaagaaatt

SEQ ID NO: 737019 - DNA, 22 bp, Artificial Sequence
  chemically synthesized
tcacatgtctagaaagaaattt

SEQ ID NO: 737020 - DNA, 22 bp, Artificial Sequence
  chemically synthesized
cacatgtctagaaagaaatttg

SEQ ID NO: 737021 - DNA, 22 bp, Artificial Sequence
  chemically synthesized
acatgtctagaaagaaatttgg

SEQ ID NO: 737022 - DNA, 22 bp, Artificial Sequence
  chemically synthesized
gaaagaaatttggttcaattct

SEQ ID NO: 737023 - DNA, 22 bp, Artificial Sequence
  chemically synthesized
ccaataaatacatagtgaatag

SEQ ID NO: 737024 - DNA, 22 bp, Artificial Sequence
  chemically synthesized
ggttcaattctattcactatgt

SEQ ID NO: 737025 - DNA, 22 bp, Artificial Sequence
  chemically synthesized
gttcaattctattcactatgta

SEQ ID NO: 737026 - DNA, 22 bp, Artificial Sequence
  chemically synthesized
aattctattcactatgtattta

SEQ ID NO: 737027 - DNA, 22 bp, Artificial Sequence
  chemically synthesized
atgggttcccaataaatacata

SEQ ID NO: 737028 - DNA, 22 bp, Artificial Sequence
  chemically synthesized
tattcactatgtatttattggg

SEQ ID NO: 737029 - DNA, 22 bp, Artificial Sequence
  chemically synthesized
ttcactatgtatttattgggaa

SEQ ID NO: 737030 - DNA, 22 bp, Artificial Sequence
  chemically synthesized
cacatctaatgggttcccaata

SEQ ID NO: 737031 - DNA, 22 bp, Artificial Sequence
  chemically synthesized
actatgtatttattgggaaccc

SEQ ID NO: 737032 - DNA, 22 bp, Artificial Sequence
  chemically synthesized
tattacacatctaatgggttcc

SEQ ID NO: 737033 - DNA, 22 bp, Artificial Sequence
  chemically synthesized
tgtatttattgggaacccatta

SEQ ID NO: 737034 - DNA, 22 bp, Artificial Sequence
  chemically synthesized
attatattacacatctaatggg

SEQ ID NO: 737035 - DNA, 22 bp, Artificial Sequence
  chemically synthesized
gattatattacacatctaatgg

SEQ ID NO: 737036 - DNA, 22 bp, Artificial Sequence
  chemically synthesized
attgggaacccattagatgtgt

SEQ ID NO: 737037 - DNA, 22 bp, Artificial Sequence
  chemically synthesized
ttgggaacccattagatgtgta

SEQ ID NO: 737038 - DNA, 22 bp, Artificial Sequence
  chemically synthesized
atatttgattatattacacatc

SEQ ID NO: 737039 - DNA, 22 bp, Artificial Sequence
  chemically synthesized
ggaacccattagatgtgtaata

SEQ ID NO: 737040 - DNA, 22 bp, Artificial Sequence
  chemically synthesized
ttgatatttgattatattacac

SEQ ID NO: 737041 - DNA, 22 bp, Artificial Sequence
  chemically synthesized
taatctattgatatttgattat

SEQ ID NO: 737042 - DNA, 22 bp, Artificial Sequence
  chemically synthesized
gatgtgtaatataatcaaatat

SEQ ID NO: 737043 - DNA, 22 bp, Artificial Sequence
  chemically synthesized
tataatctattgatatttgatt

SEQ ID NO: 737044 - DNA, 22 bp, Artificial Sequence
  chemically synthesized
ctataatctattgatatttgat

SEQ ID NO: 737045 - DNA, 22 bp, Artificial Sequence
  chemically synthesized
tctataatctattgatatttga

SEQ ID NO: 737046 - DNA, 22 bp, Artificial Sequence
  chemically synthesized
ttctataatctattgatatttg

SEQ ID NO: 737047 - DNA, 22 bp, Artificial Sequence
  chemically synthesized
ttttctataatctattgatatt

SEQ ID NO: 737048 - DNA, 22 bp, Artificial Sequence
  chemically synthesized
cttttctataatctattgatat

SEQ ID NO: 737049 - DNA, 22 bp, Artificial Sequence
  chemically synthesized
ttcttttctataatctattgat

SEQ ID NO: 737050 - DNA, 22 bp, Artificial Sequence
  chemically synthesized
tcttcttttctataatctattg

SEQ ID NO: 737051 - DNA, 22 bp, Artificial Sequence
  chemically synthesized
taagaaaaaggactctcttctt

SEQ ID NO: 737052 - DNA, 22 bp, Artificial Sequence
  chemically synthesized
ggttgtaagaaaaaggactctc

SEQ ID NO: 737053 - DNA, 22 bp, Artificial Sequence
  chemically synthesized
tagaaaagaagagagtcctttt

SEQ ID NO: 737054 - DNA, 22 bp, Artificial Sequence
  chemically synthesized
ctgggttgtaagaaaaaggact

SEQ ID NO: 737055 - DNA, 22 bp, Artificial Sequence
  chemically synthesized
cgccctgctgggttgtaagaaa

SEQ ID NO: 737056 - DNA, 22 bp, Artificial Sequence
  chemically synthesized
ccgccctgctgggttgtaagaa

SEQ ID NO: 737057 - DNA, 22 bp, Artificial Sequence
  chemically synthesized
tccgccctgctgggttgtaaga

SEQ ID NO: 737058 - DNA, 22 bp, Artificial Sequence
  chemically synthesized
atcctttccgccctgctgggtt

SEQ ID NO: 737059 - DNA, 22 bp, Artificial Sequence
  chemically synthesized
aatcctttccgccctgctgggt

SEQ ID NO: 737060 - DNA, 22 bp, Artificial Sequence
  chemically synthesized
tttcttacaacccagcagggcg

SEQ ID NO: 737061 - DNA, 22 bp, Artificial Sequence
  chemically synthesized
ttcttacaacccagcagggcgg

SEQ ID NO: 737062 - DNA, 22 bp, Artificial Sequence
  chemically synthesized
tcttacaacccagcagggcgga

SEQ ID NO: 737063 - DNA, 22 bp, Artificial Sequence
  chemically synthesized
cttacaacccagcagggcggaa

SEQ ID NO: 737064 - DNA, 22 bp, Artificial Sequence
  chemically synthesized
ttacaacccagcagggcggaaa

SEQ ID NO: 737065 - DNA, 22 bp, Artificial Sequence
  chemically synthesized
acaacccagcagggcggaaagg

SEQ ID NO: 737066 - DNA, 22 bp, Artificial Sequence
  chemically synthesized
caacccagcagggcggaaagga

SEQ ID NO: 737067 - DNA, 22 bp, Artificial Sequence
  chemically synthesized
taagaagaatttaatcctttcc

SEQ ID NO: 737068 - DNA, 22 bp, Artificial Sequence
  chemically synthesized
ataagaagaatttaatcctttc

SEQ ID NO: 737069 - DNA, 22 bp, Artificial Sequence
  chemically synthesized
tataagaagaatttaatccttt

SEQ ID NO: 737070 - DNA, 22 bp, Artificial Sequence
  chemically synthesized
cctttataagaagaatttaatc

SEQ ID NO: 737071 - DNA, 22 bp, Artificial Sequence
  chemically synthesized
tccctttataagaagaatttaa

SEQ ID NO: 737072 - DNA, 22 bp, Artificial Sequence
  chemically synthesized
ttctccctttataagaagaatt

SEQ ID NO: 737073 - DNA, 22 bp, Artificial Sequence
  chemically synthesized
gttctccctttataagaagaat

SEQ ID NO: 737074 - DNA, 22 bp, Artificial Sequence
  chemically synthesized
tttgttctccctttataagaag

SEQ ID NO: 737075 - DNA, 22 bp, Artificial Sequence
  chemically synthesized
atctatttgttctccctttata

SEQ ID NO: 737076 - DNA, 22 bp, Artificial Sequence
  chemically synthesized
taatctatttgttctcccttta

SEQ ID NO: 737077 - DNA, 22 bp, Artificial Sequence
  chemically synthesized
aattcttcttataaagggagaa

SEQ ID NO: 737078 - DNA, 22 bp, Artificial Sequence
  chemically synthesized
ctaatctatttgttctcccttt

SEQ ID NO: 737079 - DNA, 22 bp, Artificial Sequence
  chemically synthesized
tctaatctatttgttctccctt

SEQ ID NO: 737080 - DNA, 22 bp, Artificial Sequence
  chemically synthesized
ttctaatctatttgttctccct

SEQ ID NO: 737081 - DNA, 22 bp, Artificial Sequence
  chemically synthesized
ttcttataaagggagaacaaat

SEQ ID NO: 737082 - DNA, 22 bp, Artificial Sequence
  chemically synthesized
cttataaagggagaacaaatag

SEQ ID NO: 737083 - DNA, 22 bp, Artificial Sequence
  chemically synthesized
ttataaagggagaacaaataga

SEQ ID NO: 737084 - DNA, 22 bp, Artificial Sequence
  chemically synthesized
ataaagggagaacaaatagatt

SEQ ID NO: 737085 - DNA, 22 bp, Artificial Sequence
  chemically synthesized
taaagggagaacaaatagatta

SEQ ID NO: 737086 - DNA, 22 bp, Artificial Sequence
  chemically synthesized
cgcagcgtcttttctaatctat

SEQ ID NO: 737087 - DNA, 22 bp, Artificial Sequence
  chemically synthesized
actacgcagcgtcttttctaat

SEQ ID NO: 737088 - DNA, 22 bp, Artificial Sequence
  chemically synthesized
gactacgcagcgtcttttctaa

SEQ ID NO: 737089 - DNA, 22 bp, Artificial Sequence
  chemically synthesized
aacttgactacgcagcgtcttt

SEQ ID NO: 737090 - DNA, 22 bp, Artificial Sequence
  chemically synthesized
tgaacttgactacgcagcgtct

SEQ ID NO: 737091 - DNA, 22 bp, Artificial Sequence
  chemically synthesized
ctgaacttgactacgcagcgtc

SEQ ID NO: 737092 - DNA, 22 bp, Artificial Sequence
  chemically synthesized
tctgaacttgactacgcagcgt

SEQ ID NO: 737093 - DNA, 22 bp, Artificial Sequence
  chemically synthesized
ttctgaacttgactacgcagcg

SEQ ID NO: 737094 - DNA, 22 bp, Artificial Sequence
  chemically synthesized
acttttctgaacttgactacgc

SEQ ID NO: 737095 - DNA, 22 bp, Artificial Sequence
  chemically synthesized
gaaaagacgctgcgtagtcaag

SEQ ID NO: 737096 - DNA, 22 bp, Artificial Sequence
  chemically synthesized
tcacttttctgaacttgactac

SEQ ID NO: 737097 - DNA, 22 bp, Artificial Sequence
  chemically synthesized
ctcacttttctgaacttgacta

SEQ ID NO: 737098 - DNA, 22 bp, Artificial Sequence
  chemically synthesized
tctcacttttctgaacttgact

SEQ ID NO: 737099 - DNA, 22 bp, Artificial Sequence
  chemically synthesized
aactttctcacttttctgaact

SEQ ID NO: 737100 - DNA, 22 bp, Artificial Sequence
  chemically synthesized
taaactttctcacttttctgaa

SEQ ID NO: 737101 - DNA, 22 bp, Artificial Sequence
  chemically synthesized
ctaaactttctcacttttctga

SEQ ID NO: 737102 - DNA, 22 bp, Artificial Sequence
  chemically synthesized
cgtagtcaagttcagaaaagtg

SEQ ID NO: 737103 - DNA, 22 bp, Artificial Sequence
  chemically synthesized
tctaaactttctcacttttctg

SEQ ID NO: 737104 - DNA, 22 bp, Artificial Sequence
  chemically synthesized
tgaaacctttctaaactttctc

SEQ ID NO: 737105 - DNA, 22 bp, Artificial Sequence
  chemically synthesized
tatgaaacctttctaaactttc

SEQ ID NO: 737106 - DNA, 22 bp, Artificial Sequence
  chemically synthesized
agaaaagtgagaaagtttagaa

SEQ ID NO: 737107 - DNA, 22 bp, Artificial Sequence
  chemically synthesized
atctctatgaaacctttctaaa

SEQ ID NO: 737108 - DNA, 22 bp, Artificial Sequence
  chemically synthesized
cagttcatctctatgaaacctt

SEQ ID NO: 737109 - DNA, 22 bp, Artificial Sequence
  chemically synthesized
gaactgcagttcatctctatga

SEQ ID NO: 737110 - DNA, 22 bp, Artificial Sequence
  chemically synthesized
agaaaggtttcatagagatgaa

SEQ ID NO: 737111 - DNA, 22 bp, Artificial Sequence
  chemically synthesized
ttagaactgcagttcatctcta

SEQ ID NO: 737112 - DNA, 22 bp, Artificial Sequence
  chemically synthesized
gaaaggtttcatagagatgaac

SEQ ID NO: 737113 - DNA, 22 bp, Artificial Sequence
  chemically synthesized
ttattagaactgcagttcatct

SEQ ID NO: 737114 - DNA, 22 bp, Artificial Sequence
  chemically synthesized
attattagaactgcagttcatc

SEQ ID NO: 737115 - DNA, 22 bp, Artificial Sequence
  chemically synthesized
tattattagaactgcagttcat

SEQ ID NO: 737116 - DNA, 22 bp, Artificial Sequence
  chemically synthesized
catagagatgaactgcagttct

SEQ ID NO: 737117 - DNA, 22 bp, Artificial Sequence
  chemically synthesized
agttttattattagaactgcag

SEQ ID NO: 737118 - DNA, 22 bp, Artificial Sequence
  chemically synthesized
atagagatgaactgcagttcta

SEQ ID NO: 737119 - DNA, 22 bp, Artificial Sequence
  chemically synthesized
taaaaatgttaagttttattat

SEQ ID NO: 737120 - DNA, 22 bp, Artificial Sequence
  chemically synthesized
cagttctaataataaaacttaa

SEQ ID NO: 737121 - DNA, 22 bp, Artificial Sequence
  chemically synthesized
taataataaaacttaacatttt

SEQ ID NO: 737122 - DNA, 22 bp, Artificial Sequence
  chemically synthesized
tcaaatgttataaaaatgttaa

SEQ ID NO: 737123 - DNA, 22 bp, Artificial Sequence
  chemically synthesized
ataataaaacttaacattttta

SEQ ID NO: 737124 - DNA, 22 bp, Artificial Sequence
  chemically synthesized
cgaaactatcaaatgttataaa

SEQ ID NO: 737125 - DNA, 22 bp, Artificial Sequence
  chemically synthesized
ccgaaactatcaaatgttataa

SEQ ID NO: 737126 - DNA, 22 bp, Artificial Sequence
  chemically synthesized
cttccgaaactatcaaatgtta

SEQ ID NO: 737127 - DNA, 22 bp, Artificial Sequence
  chemically synthesized
aacatttttataacatttgata

SEQ ID NO: 737128 - DNA, 22 bp, Artificial Sequence
  chemically synthesized
acatttttataacatttgatag

SEQ ID NO: 737129 - DNA, 22 bp, Artificial Sequence
  chemically synthesized
tgaaactgcttccgaaactatc

SEQ ID NO: 737130 - DNA, 22 bp, Artificial Sequence
  chemically synthesized
ttataacatttgatagtttcgg

SEQ ID NO: 737131 - DNA, 22 bp, Artificial Sequence
  chemically synthesized
tataacatttgatagtttcgga

SEQ ID NO: 737132 - DNA, 22 bp, Artificial Sequence
  chemically synthesized
ataacatttgatagtttcggaa

SEQ ID NO: 737133 - DNA, 22 bp, Artificial Sequence
  chemically synthesized
taacatttgatagtttcggaag

SEQ ID NO: 737134 - DNA, 22 bp, Artificial Sequence
  chemically synthesized
gatagtttcggaagcagtttca

SEQ ID NO: 737135 - DNA, 22 bp, Artificial Sequence
  chemically synthesized
atagtttcggaagcagtttcac

SEQ ID NO: 737136 - DNA, 22 bp, Artificial Sequence
  chemically synthesized
cggaagcagtttcacagacctt

SEQ ID NO: 737137 - DNA, 22 bp, Artificial Sequence
  chemically synthesized
ggaagcagtttcacagacctta

SEQ ID NO: 737138 - DNA, 22 bp, Artificial Sequence
  chemically synthesized
cacagaccttatctcattgctt

SEQ ID NO: 737139 - DNA, 22 bp, Artificial Sequence
  chemically synthesized
acagaccttatctcattgcttc

SEQ ID NO: 737140 - DNA, 22 bp, Artificial Sequence
  chemically synthesized
caaggtccatgtgaagcaatga

SEQ ID NO: 737141 - DNA, 22 bp, Artificial Sequence
  chemically synthesized
acaaggtccatgtgaagcaatg

SEQ ID NO: 737142 - DNA, 22 bp, Artificial Sequence
  chemically synthesized
tcttacaaggtccatgtgaagc

SEQ ID NO: 737143 - DNA, 22 bp, Artificial Sequence
  chemically synthesized
atctcattgcttcacatggacc

SEQ ID NO: 737144 - DNA, 22 bp, Artificial Sequence
  chemically synthesized
tctcattgcttcacatggacct

SEQ ID NO: 737145 - DNA, 22 bp, Artificial Sequence
  chemically synthesized
attgcttcacatggaccttgta

SEQ ID NO: 737146 - DNA, 22 bp, Artificial Sequence
  chemically synthesized
cttcacatggaccttgtaagac

SEQ ID NO: 737147 - DNA, 22 bp, Artificial Sequence
  chemically synthesized
tccaaatcccacctgtcttaca

SEQ ID NO: 737148 - DNA, 22 bp, Artificial Sequence
  chemically synthesized
cacatggaccttgtaagacagg

SEQ ID NO: 737149 - DNA, 22 bp, Artificial Sequence
  chemically synthesized
atccaaatcccacctgtcttac

SEQ ID NO: 737150 - DNA, 22 bp, Artificial Sequence
  chemically synthesized
acatggaccttgtaagacaggt

SEQ ID NO: 737151 - DNA, 22 bp, Artificial Sequence
  chemically synthesized
cttatccaaatcccacctgtct

SEQ ID NO: 737152 - DNA, 22 bp, Artificial Sequence
  chemically synthesized
gtaagacaggtgggatttggat

SEQ ID NO: 737153 - DNA, 22 bp, Artificial Sequence
  chemically synthesized
aaggaactacttatccaaatcc

SEQ ID NO: 737154 - DNA, 22 bp, Artificial Sequence
  chemically synthesized
taagacaggtgggatttggata

SEQ ID NO: 737155 - DNA, 22 bp, Artificial Sequence
  chemically synthesized
aaaggaactacttatccaaatc

SEQ ID NO: 737156 - DNA, 22 bp, Artificial Sequence
  chemically synthesized
taaaggaactacttatccaaat

SEQ ID NO: 737157 - DNA, 22 bp, Artificial Sequence
  chemically synthesized
ttaaaggaactacttatccaaa

SEQ ID NO: 737158 - DNA, 22 bp, Artificial Sequence
  chemically synthesized
tttaaaggaactacttatccaa

SEQ ID NO: 737159 - DNA, 22 bp, Artificial Sequence
  chemically synthesized
gaagacattttttaaaggaact

SEQ ID NO: 737160 - DNA, 22 bp, Artificial Sequence
  chemically synthesized
ggataagtagttcctttaaaaa

SEQ ID NO: 737161 - DNA, 22 bp, Artificial Sequence
  chemically synthesized
gataagtagttcctttaaaaaa

SEQ ID NO: 737162 - DNA, 22 bp, Artificial Sequence
  chemically synthesized
aatgtacaatattcgaagacat

SEQ ID NO: 737163 - DNA, 22 bp, Artificial Sequence
  chemically synthesized
ctttaaaaaatgtcttcgaata

SEQ ID NO: 737164 - DNA, 22 bp, Artificial Sequence
  chemically synthesized
taaaaaatgtcttcgaatattg

SEQ ID NO: 737165 - DNA, 22 bp, Artificial Sequence
  chemically synthesized
aaaaaatgtcttcgaatattgt

SEQ ID NO: 737166 - DNA, 22 bp, Artificial Sequence
  chemically synthesized
aaaaatgtcttcgaatattgta

SEQ ID NO: 737167 - DNA, 22 bp, Artificial Sequence
  chemically synthesized
tcagtctaaatgtacaatattc

SEQ ID NO: 737168 - DNA, 22 bp, Artificial Sequence
  chemically synthesized
gtcagtctaaatgtacaatatt

SEQ ID NO: 737169 - DNA, 22 bp, Artificial Sequence
  chemically synthesized
cgaatattgtacatttagactg

SEQ ID NO: 737170 - DNA, 22 bp, Artificial Sequence
  chemically synthesized
gaatattgtacatttagactga

SEQ ID NO: 737171 - DNA, 22 bp, Artificial Sequence
  chemically synthesized
ataaaggcatttgtcagtctaa

SEQ ID NO: 737172 - DNA, 22 bp, Artificial Sequence
  chemically synthesized
taataaaggcatttgtcagtct

SEQ ID NO: 737173 - DNA, 22 bp, Artificial Sequence
  chemically synthesized
ttctaataaaggcatttgtcag

SEQ ID NO: 737174 - DNA, 22 bp, Artificial Sequence
  chemically synthesized
attctaataaaggcatttgtca

SEQ ID NO: 737175 - DNA, 22 bp, Artificial Sequence
  chemically synthesized
tacatttagactgacaaatgcc

SEQ ID NO: 737176 - DNA, 22 bp, Artificial Sequence
  chemically synthesized
tattctaataaaggcatttgtc

SEQ ID NO: 737177 - DNA, 22 bp, Artificial Sequence
  chemically synthesized
cctttattctaataaaggcatt

SEQ ID NO: 737178 - DNA, 22 bp, Artificial Sequence
  chemically synthesized
ccctttattctaataaaggcat

SEQ ID NO: 737179 - DNA, 22 bp, Artificial Sequence
  chemically synthesized
tccctttattctaataaaggca

SEQ ID NO: 737180 - DNA, 22 bp, Artificial Sequence
  chemically synthesized
agactgacaaatgcctttatta

SEQ ID NO: 737181 - DNA, 22 bp, Artificial Sequence
  chemically synthesized
ttccctttattctaataaaggc

SEQ ID NO: 737182 - DNA, 22 bp, Artificial Sequence
  chemically synthesized
gactgacaaatgcctttattag

SEQ ID NO: 737183 - DNA, 22 bp, Artificial Sequence
  chemically synthesized
acaaatgcctttattagaataa

SEQ ID NO: 737184 - DNA, 22 bp, Artificial Sequence
  chemically synthesized
acataccttttccctttattct

SEQ ID NO: 737185 - DNA, 22 bp, Artificial Sequence
  chemically synthesized
tcacataccttttccctttatt

SEQ ID NO: 737186 - DNA, 22 bp, Artificial Sequence
  chemically synthesized
tattagaataaagggaaaaggt

SEQ ID NO: 737187 - DNA, 22 bp, Artificial Sequence
  chemically synthesized
tgtctctcacataccttttccc

SEQ ID NO: 737188 - DNA, 22 bp, Artificial Sequence
  chemically synthesized
attagaataaagggaaaaggta

SEQ ID NO: 737189 - DNA, 22 bp, Artificial Sequence
  chemically synthesized
ttagaataaagggaaaaggtat

SEQ ID NO: 737190 - DNA, 22 bp, Artificial Sequence
  chemically synthesized
tatgtctctcacataccttttc

SEQ ID NO: 737191 - DNA, 22 bp, Artificial Sequence
  chemically synthesized
tctatgtctctcacataccttt

SEQ ID NO: 737192 - DNA, 22 bp, Artificial Sequence
  chemically synthesized
gaataaagggaaaaggtatgtg

SEQ ID NO: 737193 - DNA, 22 bp, Artificial Sequence
  chemically synthesized
ctctctatgtctctcacatacc

SEQ ID NO: 737194 - DNA, 22 bp, Artificial Sequence
  chemically synthesized
gctctctatgtctctcacatac

SEQ ID NO: 737195 - DNA, 22 bp, Artificial Sequence
  chemically synthesized
gaacccaaaatttgctctctat

SEQ ID NO: 737196 - DNA, 22 bp, Artificial Sequence
  chemically synthesized
tggaactagaacccaaaatttg

SEQ ID NO: 737197 - DNA, 22 bp, Artificial Sequence
  chemically synthesized
gttgtggaactagaacccaaaa

SEQ ID NO: 737198 - DNA, 22 bp, Artificial Sequence
  chemically synthesized
gttagttgtggaactagaaccc

SEQ ID NO: 737199 - DNA, 22 bp, Artificial Sequence
  chemically synthesized
acacagctagttagttgtggaa

SEQ ID NO: 737200 - DNA, 22 bp, Artificial Sequence
  chemically synthesized
tgggttctagttccacaactaa

SEQ ID NO: 737201 - DNA, 22 bp, Artificial Sequence
  chemically synthesized
gggttctagttccacaactaac

SEQ ID NO: 737202 - DNA, 22 bp, Artificial Sequence
  chemically synthesized
ggttctagttccacaactaact

SEQ ID NO: 737203 - DNA, 22 bp, Artificial Sequence
  chemically synthesized
atagttcacacagctagttagt

SEQ ID NO: 737204 - DNA, 22 bp, Artificial Sequence
  chemically synthesized
tagttccacaactaactagctg

SEQ ID NO: 737205 - DNA, 22 bp, Artificial Sequence
  chemically synthesized
gttccacaactaactagctgtg

SEQ ID NO: 737206 - DNA, 22 bp, Artificial Sequence
  chemically synthesized
cacaactaactagctgtgtgaa

SEQ ID NO: 737207 - DNA, 22 bp, Artificial Sequence
  chemically synthesized
actagctgtgtgaactatgaac

SEQ ID NO: 737208 - DNA, 22 bp, Artificial Sequence
  chemically synthesized
gctgtgtgaactatgaactatc

SEQ ID NO: 737209 - DNA, 22 bp, Artificial Sequence
  chemically synthesized
caaagacaccacatgatagttc

SEQ ID NO: 737210 - DNA, 22 bp, Artificial Sequence
  chemically synthesized
acaaagacaccacatgatagtt

SEQ ID NO: 737211 - DNA, 22 bp, Artificial Sequence
  chemically synthesized
tgtgaactatgaactatcatgt

SEQ ID NO: 737212 - DNA, 22 bp, Artificial Sequence
  chemically synthesized
agtttacaaagacaccacatga

SEQ ID NO: 737213 - DNA, 22 bp, Artificial Sequence
  chemically synthesized
gagtttacaaagacaccacatg

SEQ ID NO: 737214 - DNA, 22 bp, Artificial Sequence
  chemically synthesized
tgaactatcatgtggtgtcttt

SEQ ID NO: 737215 - DNA, 22 bp, Artificial Sequence
  chemically synthesized
tcatgtggtgtctttgtaaact

SEQ ID NO: 737216 - DNA, 22 bp, Artificial Sequence
  chemically synthesized
tgtaaactcaagggttggattt

SEQ ID NO: 737217 - DNA, 22 bp, Artificial Sequence
  chemically synthesized
gtaaactcaagggttggatttc

SEQ ID NO: 737218 - DNA, 22 bp, Artificial Sequence
  chemically synthesized
taaactcaagggttggatttct

SEQ ID NO: 737219 - DNA, 22 bp, Artificial Sequence
  chemically synthesized
agcacagaaagtccagaaatcc

SEQ ID NO: 737220 - DNA, 22 bp, Artificial Sequence
  chemically synthesized
cagcacagaaagtccagaaatc

SEQ ID NO: 737221 - DNA, 22 bp, Artificial Sequence
  chemically synthesized
aagggttggatttctggacttt

SEQ ID NO: 737222 - DNA, 22 bp, Artificial Sequence
  chemically synthesized
cacttcagcacagaaagtccag

SEQ ID NO: 737223 - DNA, 22 bp, Artificial Sequence
  chemically synthesized
acacttcagcacagaaagtcca

SEQ ID NO: 737224 - DNA, 22 bp, Artificial Sequence
  chemically synthesized
tacacttcagcacagaaagtcc

SEQ ID NO: 737225 - DNA, 22 bp, Artificial Sequence
  chemically synthesized
gttttacacttcagcacagaaa

SEQ ID NO: 737226 - DNA, 22 bp, Artificial Sequence
  chemically synthesized
gatttctggactttctgtgctg

SEQ ID NO: 737227 - DNA, 22 bp, Artificial Sequence
  chemically synthesized
agttttacacttcagcacagaa

SEQ ID NO: 737228 - DNA, 22 bp, Artificial Sequence
  chemically synthesized
tagttttacacttcagcacaga

SEQ ID NO: 737229 - DNA, 22 bp, Artificial Sequence
  chemically synthesized
ttagttttacacttcagcacag

SEQ ID NO: 737230 - DNA, 22 bp, Artificial Sequence
  chemically synthesized
ctggactttctgtgctgaagtg

SEQ ID NO: 737231 - DNA, 22 bp, Artificial Sequence
  chemically synthesized
tggactttctgtgctgaagtgt

SEQ ID NO: 737232 - DNA, 22 bp, Artificial Sequence
  chemically synthesized
gactttctgtgctgaagtgtaa

SEQ ID NO: 737233 - DNA, 22 bp, Artificial Sequence
  chemically synthesized
atatttttagttttacacttca

SEQ ID NO: 737234 - DNA, 22 bp, Artificial Sequence
  chemically synthesized
aatatttttagttttacacttc

SEQ ID NO: 737235 - DNA, 22 bp, Artificial Sequence
  chemically synthesized
taatatttttagttttacactt

SEQ ID NO: 737236 - DNA, 22 bp, Artificial Sequence
  chemically synthesized
tctgtgctgaagtgtaaaacta

SEQ ID NO: 737237 - DNA, 22 bp, Artificial Sequence
  chemically synthesized
ctgtgctgaagtgtaaaactaa

SEQ ID NO: 737238 - DNA, 22 bp, Artificial Sequence
  chemically synthesized
tgtgctgaagtgtaaaactaaa

SEQ ID NO: 737239 - DNA, 22 bp, Artificial Sequence
  chemically synthesized
tgctgaagtgtaaaactaaaaa

SEQ ID NO: 737240 - DNA, 22 bp, Artificial Sequence
  chemically synthesized
aatattttaatatttttagttt

SEQ ID NO: 737241 - DNA, 22 bp, Artificial Sequence
  chemically synthesized
ctgaatattttaatatttttag

SEQ ID NO: 737242 - DNA, 22 bp, Artificial Sequence
  chemically synthesized
aagtgtaaaactaaaaatatta

SEQ ID NO: 737243 - DNA, 22 bp, Artificial Sequence
  chemically synthesized
aattactgaatattttaatatt

SEQ ID NO: 737244 - DNA, 22 bp, Artificial Sequence
  chemically synthesized
gaattactgaatattttaatat

SEQ ID NO: 737245 - DNA, 22 bp, Artificial Sequence
  chemically synthesized
tgaattactgaatattttaata

SEQ ID NO: 737246 - DNA, 22 bp, Artificial Sequence
  chemically synthesized
aaaatattaaaatattcagtaa

SEQ ID NO: 737247 - DNA, 22 bp, Artificial Sequence
  chemically synthesized
aaatatccactttgaattactg

SEQ ID NO: 737248 - DNA, 22 bp, Artificial Sequence
  chemically synthesized
aaaatatccactttgaattact

SEQ ID NO: 737249 - DNA, 22 bp, Artificial Sequence
  chemically synthesized
taaaatatccactttgaattac

SEQ ID NO: 737250 - DNA, 22 bp, Artificial Sequence
  chemically synthesized
ttaaaatatccactttgaatta

SEQ ID NO: 737251 - DNA, 22 bp, Artificial Sequence
  chemically synthesized
aaatattcagtaattcaaagtg

SEQ ID NO: 737252 - DNA, 22 bp, Artificial Sequence
  chemically synthesized
cttttaaaatatccactttgaa

SEQ ID NO: 737253 - DNA, 22 bp, Artificial Sequence
  chemically synthesized
attgcttttaaaatatccactt

SEQ ID NO: 737254 - DNA, 22 bp, Artificial Sequence
  chemically synthesized
cattgcttttaaaatatccact

SEQ ID NO: 737255 - DNA, 22 bp, Artificial Sequence
  chemically synthesized
agtaattcaaagtggatatttt

SEQ ID NO: 737256 - DNA, 22 bp, Artificial Sequence
  chemically synthesized
atatgtttcattgcttttaaaa

SEQ ID NO: 737257 - DNA, 22 bp, Artificial Sequence
  chemically synthesized
aaagtggatattttaaaagcaa

SEQ ID NO: 737258 - DNA, 22 bp, Artificial Sequence
  chemically synthesized
ctgatatgtttcattgctttta

SEQ ID NO: 737259 - DNA, 22 bp, Artificial Sequence
  chemically synthesized
aatctactgatatgtttcattg

SEQ ID NO: 737260 - DNA, 22 bp, Artificial Sequence
  chemically synthesized
taaaagcaatgaaacatatcag

SEQ ID NO: 737261 - DNA, 22 bp, Artificial Sequence
  chemically synthesized
aaaagcaatgaaacatatcagt

SEQ ID NO: 737262 - DNA, 22 bp, Artificial Sequence
  chemically synthesized
aaagcaatgaaacatatcagta

SEQ ID NO: 737263 - DNA, 22 bp, Artificial Sequence
  chemically synthesized
aattgttttcttatttattttt

SEQ ID NO: 737264 - DNA, 22 bp, Artificial Sequence
  chemically synthesized
ttttcttatttatttttatgat

SEQ ID NO: 737265 - DNA, 22 bp, Artificial Sequence
  chemically synthesized
tcttatttatttttatgatttg

SEQ ID NO: 737266 - DNA, 22 bp, Artificial Sequence
  chemically synthesized
cttatttatttttatgatttga

SEQ ID NO: 737267 - DNA, 22 bp, Artificial Sequence
  chemically synthesized
ttatttatttttatgatttgat

SEQ ID NO: 737268 - DNA, 22 bp, Artificial Sequence
  chemically synthesized
aaaatataaaatatcaaatcat

SEQ ID NO: 737269 - DNA, 22 bp, Artificial Sequence
  chemically synthesized
atttatttttatgatttgatat

SEQ ID NO: 737270 - DNA, 22 bp, Artificial Sequence
  chemically synthesized
tttatttttatgatttgatatt

SEQ ID NO: 737271 - DNA, 22 bp, Artificial Sequence
  chemically synthesized
atttttatgatttgatatttta

SEQ ID NO: 737272 - DNA, 22 bp, Artificial Sequence
  chemically synthesized
tttttatgatttgatattttat

SEQ ID NO: 737273 - DNA, 22 bp, Artificial Sequence
  chemically synthesized
aaatctaaaaatataaaatatc

SEQ ID NO: 737274 - DNA, 22 bp, Artificial Sequence
  chemically synthesized
ttatgatttgatattttatatt

SEQ ID NO: 737275 - DNA, 22 bp, Artificial Sequence
  chemically synthesized
tatgatttgatattttatattt

SEQ ID NO: 737276 - DNA, 22 bp, Artificial Sequence
  chemically synthesized
atgatttgatattttatatttt

SEQ ID NO: 737277 - DNA, 22 bp, Artificial Sequence
  chemically synthesized
tgatttgatattttatattttt

SEQ ID NO: 737278 - DNA, 22 bp, Artificial Sequence
  chemically synthesized
gatattttatatttttagattt

SEQ ID NO: 737279 - DNA, 22 bp, Artificial Sequence
  chemically synthesized
aaataaaaattgaaatctaaaa

SEQ ID NO: 737280 - DNA, 22 bp, Artificial Sequence
  chemically synthesized
atattttatatttttagatttc

SEQ ID NO: 737281 - DNA, 22 bp, Artificial Sequence
  chemically synthesized
agtctaaaataaaaattgaaat

SEQ ID NO: 737282 - DNA, 22 bp, Artificial Sequence
  chemically synthesized
tatatttttagatttcaatttt

SEQ ID NO: 737283 - DNA, 22 bp, Artificial Sequence
  chemically synthesized
gagtctaaaataaaaattgaaa

SEQ ID NO: 737284 - DNA, 22 bp, Artificial Sequence
  chemically synthesized
atatttttagatttcaattttt

SEQ ID NO: 737285 - DNA, 22 bp, Artificial Sequence
  chemically synthesized
tatttttagatttcaattttta

SEQ ID NO: 737286 - DNA, 22 bp, Artificial Sequence
  chemically synthesized
ttagatttcaatttttatttta

SEQ ID NO: 737287 - DNA, 22 bp, Artificial Sequence
  chemically synthesized
tagatttcaatttttattttag

SEQ ID NO: 737288 - DNA, 22 bp, Artificial Sequence
  chemically synthesized
agatttcaatttttattttaga

SEQ ID NO: 737289 - DNA, 22 bp, Artificial Sequence
  chemically synthesized
gatttcaatttttattttagac

SEQ ID NO: 737290 - DNA, 22 bp, Artificial Sequence
  chemically synthesized
cacatgtaccccttgagtctaa

SEQ ID NO: 737291 - DNA, 22 bp, Artificial Sequence
  chemically synthesized
caatttttattttagactcaag

SEQ ID NO: 737292 - DNA, 22 bp, Artificial Sequence
  chemically synthesized
aatttttattttagactcaagg

SEQ ID NO: 737293 - DNA, 22 bp, Artificial Sequence
  chemically synthesized
ttattttagactcaaggggtac

SEQ ID NO: 737294 - DNA, 22 bp, Artificial Sequence
  chemically synthesized
tattttagactcaaggggtaca

SEQ ID NO: 737295 - DNA, 22 bp, Artificial Sequence
  chemically synthesized
attttagactcaaggggtacat

SEQ ID NO: 737296 - DNA, 22 bp, Artificial Sequence
  chemically synthesized
ttttagactcaaggggtacatg

SEQ ID NO: 737297 - DNA, 22 bp, Artificial Sequence
  chemically synthesized
tagactcaaggggtacatgtgc

SEQ ID NO: 737298 - DNA, 22 bp, Artificial Sequence
  chemically synthesized
agactcaaggggtacatgtgca

SEQ ID NO: 737299 - DNA, 22 bp, Artificial Sequence
  chemically synthesized
gactcaaggggtacatgtgcag

SEQ ID NO: 737300 - DNA, 22 bp, Artificial Sequence
  chemically synthesized
aaggggtacatgtgcaggttta

SEQ ID NO: 737301 - DNA, 22 bp, Artificial Sequence
  chemically synthesized
agtgtcacacaatatacccatg

SEQ ID NO: 737302 - DNA, 22 bp, Artificial Sequence
  chemically synthesized
attacatgggtatattgtgtga

SEQ ID NO: 737303 - DNA, 22 bp, Artificial Sequence
  chemically synthesized
caaacctcagtgtcacacaata

SEQ ID NO: 737304 - DNA, 22 bp, Artificial Sequence
  chemically synthesized
ttacatgggtatattgtgtgac

SEQ ID NO: 737305 - DNA, 22 bp, Artificial Sequence
  chemically synthesized
catgggtatattgtgtgacact

SEQ ID NO: 737306 - DNA, 22 bp, Artificial Sequence
  chemically synthesized
tactccaaacctcagtgtcaca

SEQ ID NO: 737307 - DNA, 22 bp, Artificial Sequence
  chemically synthesized
aactgtactccaaacctcagtg

SEQ ID NO: 737308 - DNA, 22 bp, Artificial Sequence
  chemically synthesized
tgtgacactgaggtttggagta

SEQ ID NO: 737309 - DNA, 22 bp, Artificial Sequence
  chemically synthesized
ggtgacaggttcaactgtactc

SEQ ID NO: 737310 - DNA, 22 bp, Artificial Sequence
  chemically synthesized
cctgggtgacaggttcaactgt

SEQ ID NO: 737311 - DNA, 22 bp, Artificial Sequence
  chemically synthesized
aggtttggagtacagttgaacc

SEQ ID NO: 737312 - DNA, 22 bp, Artificial Sequence
  chemically synthesized
actacctgggtgacaggttcaa

SEQ ID NO: 737313 - DNA, 22 bp, Artificial Sequence
  chemically synthesized
ggagtacagttgaacctgtcac

SEQ ID NO: 737314 - DNA, 22 bp, Artificial Sequence
  chemically synthesized
gagtacagttgaacctgtcacc

SEQ ID NO: 737315 - DNA, 22 bp, Artificial Sequence
  chemically synthesized
tactcactacctgggtgacagg

SEQ ID NO: 737316 - DNA, 22 bp, Artificial Sequence
  chemically synthesized
aacctgtcacccaggtagtgag

SEQ ID NO: 737317 - DNA, 22 bp, Artificial Sequence
  chemically synthesized
tcgagtactatactcactacct

SEQ ID NO: 737318 - DNA, 22 bp, Artificial Sequence
  chemically synthesized
cctatcgagtactatactcact

SEQ ID NO: 737319 - DNA, 22 bp, Artificial Sequence
  chemically synthesized
tcacccaggtagtgagtatagt

SEQ ID NO: 737320 - DNA, 22 bp, Artificial Sequence
  chemically synthesized
aaaaaactacctatcgagtact

SEQ ID NO: 737321 - DNA, 22 bp, Artificial Sequence
  chemically synthesized
gataggtagttttttcagccct

SEQ ID NO: 737322 - DNA, 22 bp, Artificial Sequence
  chemically synthesized
tttcagcccttgtcccacaccc

SEQ ID NO: 737323 - DNA, 22 bp, Artificial Sequence
  chemically synthesized
ttcagcccttgtcccacaccct

SEQ ID NO: 737324 - DNA, 22 bp, Artificial Sequence
  chemically synthesized
tcagcccttgtcccacaccctc

SEQ ID NO: 737325 - DNA, 22 bp, Artificial Sequence
  chemically synthesized
cagcccttgtcccacaccctcc

SEQ ID NO: 737326 - DNA, 22 bp, Artificial Sequence
  chemically synthesized
gtgacaagggcaggagggtgtg

SEQ ID NO: 737327 - DNA, 22 bp, Artificial Sequence
  chemically synthesized
agcccttgtcccacaccctcct

SEQ ID NO: 737328 - DNA, 22 bp, Artificial Sequence
  chemically synthesized
gtcccacaccctcctgcccttg

SEQ ID NO: 737329 - DNA, 22 bp, Artificial Sequence
  chemically synthesized
tcccacaccctcctgcccttgt

SEQ ID NO: 737330 - DNA, 22 bp, Artificial Sequence
  chemically synthesized
ggaacaacaggcactagtgaca

SEQ ID NO: 737331 - DNA, 22 bp, Artificial Sequence
  chemically synthesized
ctgcccttgtcactagtgcctg

SEQ ID NO: 737332 - DNA, 22 bp, Artificial Sequence
  chemically synthesized
cccttgtcactagtgcctgttg

SEQ ID NO: 737333 - DNA, 22 bp, Artificial Sequence
  chemically synthesized
gtcactagtgcctgttgttccc

SEQ ID NO: 737334 - DNA, 22 bp, Artificial Sequence
  chemically synthesized
tcactagtgcctgttgttccca

SEQ ID NO: 737335 - DNA, 22 bp, Artificial Sequence
  chemically synthesized
gtgcctgttgttcccaacttta

SEQ ID NO: 737336 - DNA, 22 bp, Artificial Sequence
  chemically synthesized
ggtacacatggatgtaaagttg

SEQ ID NO: 737337 - DNA, 22 bp, Artificial Sequence
  chemically synthesized
gggtacacatggatgtaaagtt

SEQ ID NO: 737338 - DNA, 22 bp, Artificial Sequence
  chemically synthesized
tgggtacacatggatgtaaagt

SEQ ID NO: 737339 - DNA, 22 bp, Artificial Sequence
  chemically synthesized
ttgttcccaactttacatccat

SEQ ID NO: 737340 - DNA, 22 bp, Artificial Sequence
  chemically synthesized
acctttgggtacacatggatgt

SEQ ID NO: 737341 - DNA, 22 bp, Artificial Sequence
  chemically synthesized
ttcccaactttacatccatgtg

SEQ ID NO: 737342 - DNA, 22 bp, Artificial Sequence
  chemically synthesized
ccaactttacatccatgtgtac

SEQ ID NO: 737343 - DNA, 22 bp, Artificial Sequence
  chemically synthesized
tacatccatgtgtacccaaagg

SEQ ID NO: 737344 - DNA, 22 bp, Artificial Sequence
  chemically synthesized
acatccatgtgtacccaaaggt

SEQ ID NO: 737345 - DNA, 22 bp, Artificial Sequence
  chemically synthesized
catccatgtgtacccaaaggtt

SEQ ID NO: 737346 - DNA, 22 bp, Artificial Sequence
  chemically synthesized
taagcaggagctaacctttggg

SEQ ID NO: 737347 - DNA, 22 bp, Artificial Sequence
  chemically synthesized
ataagcaggagctaacctttgg

SEQ ID NO: 737348 - DNA, 22 bp, Artificial Sequence
  chemically synthesized
acttataagcaggagctaacct

SEQ ID NO: 737349 - DNA, 22 bp, Artificial Sequence
  chemically synthesized
gctcctgcttataagtgagcac

SEQ ID NO: 737350 - DNA, 22 bp, Artificial Sequence
  chemically synthesized
ctgcttataagtgagcacatgc

SEQ ID NO: 737351 - DNA, 22 bp, Artificial Sequence
  chemically synthesized
cttataagtgagcacatgcatt

SEQ ID NO: 737352 - DNA, 22 bp, Artificial Sequence
  chemically synthesized
ataagtgagcacatgcattatt

SEQ ID NO: 737353 - DNA, 22 bp, Artificial Sequence
  chemically synthesized
taagtgagcacatgcattattt

SEQ ID NO: 737354 - DNA, 22 bp, Artificial Sequence
  chemically synthesized
aagcagaaacagaaaaccaaat

SEQ ID NO: 737355 - DNA, 22 bp, Artificial Sequence
  chemically synthesized
agcgaattaaagcagaaacaga

SEQ ID NO: 737356 - DNA, 22 bp, Artificial Sequence
  chemically synthesized
tttggttttctgtttctgcttt

SEQ ID NO: 737357 - DNA, 22 bp, Artificial Sequence
  chemically synthesized
tcctaagcgaattaaagcagaa

SEQ ID NO: 737358 - DNA, 22 bp, Artificial Sequence
  chemically synthesized
ggttttctgtttctgctttaat

SEQ ID NO: 737359 - DNA, 22 bp, Artificial Sequence
  chemically synthesized
gttttctgtttctgctttaatt

SEQ ID NO: 737360 - DNA, 22 bp, Artificial Sequence
  chemically synthesized
tctgtttctgctttaattcgct

SEQ ID NO: 737361 - DNA, 22 bp, Artificial Sequence
  chemically synthesized
ctgtttctgctttaattcgctt

SEQ ID NO: 737362 - DNA, 22 bp, Artificial Sequence
  chemically synthesized
tgtttctgctttaattcgctta

SEQ ID NO: 737363 - DNA, 22 bp, Artificial Sequence
  chemically synthesized
gaggtcattatcctaagcgaat

SEQ ID NO: 737364 - DNA, 22 bp, Artificial Sequence
  chemically synthesized
tttctgctttaattcgcttagg

SEQ ID NO: 737365 - DNA, 22 bp, Artificial Sequence
  chemically synthesized
ctgctttaattcgcttaggata

SEQ ID NO: 737366 - DNA, 22 bp, Artificial Sequence
  chemically synthesized
tgctttaattcgcttaggataa

SEQ ID NO: 737367 - DNA, 22 bp, Artificial Sequence
  chemically synthesized
gaactggaggtcattatcctaa

SEQ ID NO: 737368 - DNA, 22 bp, Artificial Sequence
  chemically synthesized
ctttaattcgcttaggataatg

SEQ ID NO: 737369 - DNA, 22 bp, Artificial Sequence
  chemically synthesized
taattcgcttaggataatgacc

SEQ ID NO: 737370 - DNA, 22 bp, Artificial Sequence
  chemically synthesized
aattcgcttaggataatgacct

SEQ ID NO: 737371 - DNA, 22 bp, Artificial Sequence
  chemically synthesized
attcgcttaggataatgacctc

SEQ ID NO: 737372 - DNA, 22 bp, Artificial Sequence
  chemically synthesized
gcttaggataatgacctccagt

SEQ ID NO: 737373 - DNA, 22 bp, Artificial Sequence
  chemically synthesized
aggataatgacctccagttcca

SEQ ID NO: 737374 - DNA, 22 bp, Artificial Sequence
  chemically synthesized
tagcaacatggttggaactgga

SEQ ID NO: 737375 - DNA, 22 bp, Artificial Sequence
  chemically synthesized
ggataatgacctccagttccaa

SEQ ID NO: 737376 - DNA, 22 bp, Artificial Sequence
  chemically synthesized
tgtagcaacatggttggaactg

SEQ ID NO: 737377 - DNA, 22 bp, Artificial Sequence
  chemically synthesized
cagttccaaccatgttgctaca

SEQ ID NO: 737378 - DNA, 22 bp, Artificial Sequence
  chemically synthesized
caaccatgttgctacagaggac

SEQ ID NO: 737379 - DNA, 22 bp, Artificial Sequence
  chemically synthesized
tgaaaaagaaggaaatcatgtc

SEQ ID NO: 737380 - DNA, 22 bp, Artificial Sequence
  chemically synthesized
ctacagaggacatgatttcctt

SEQ ID NO: 737381 - DNA, 22 bp, Artificial Sequence
  chemically synthesized
cagaggacatgatttccttctt

SEQ ID NO: 737382 - DNA, 22 bp, Artificial Sequence
  chemically synthesized
cacagctatgaaaaagaaggaa

SEQ ID NO: 737383 - DNA, 22 bp, Artificial Sequence
  chemically synthesized
ccttctttttcatagctgtgta

SEQ ID NO: 737384 - DNA, 22 bp, Artificial Sequence
  chemically synthesized
cttctttttcatagctgtgtag

SEQ ID NO: 737385 - DNA, 22 bp, Artificial Sequence
  chemically synthesized
ctttttcatagctgtgtagtat

SEQ ID NO: 737386 - DNA, 22 bp, Artificial Sequence
  chemically synthesized
tttttcatagctgtgtagtatt

SEQ ID NO: 737387 - DNA, 22 bp, Artificial Sequence
  chemically synthesized
tttcatagctgtgtagtattcc

SEQ ID NO: 737388 - DNA, 22 bp, Artificial Sequence
  chemically synthesized
ttcatagctgtgtagtattcca

SEQ ID NO: 737389 - DNA, 22 bp, Artificial Sequence
  chemically synthesized
tcatagctgtgtagtattccat

SEQ ID NO: 737390 - DNA, 22 bp, Artificial Sequence
  chemically synthesized
catagctgtgtagtattccatg

SEQ ID NO: 737391 - DNA, 22 bp, Artificial Sequence
  chemically synthesized
atagctgtgtagtattccatgg

SEQ ID NO: 737392 - DNA, 22 bp, Artificial Sequence
  chemically synthesized
tgtagtattccatggtgcatat

SEQ ID NO: 737393 - DNA, 22 bp, Artificial Sequence
  chemically synthesized
gataaagaaaacgtggcatata

SEQ ID NO: 737394 - DNA, 22 bp, Artificial Sequence
  chemically synthesized
catggtgcatatatgccacgtt

SEQ ID NO: 737395 - DNA, 22 bp, Artificial Sequence
  chemically synthesized
ggtgcccatcaatggtggattg

SEQ ID NO: 737396 - DNA, 22 bp, Artificial Sequence
  chemically synthesized
tctttatccaatccaccattga

SEQ ID NO: 737397 - DNA, 22 bp, Artificial Sequence
  chemically synthesized
ctttatccaatccaccattgat

SEQ ID NO: 737398 - DNA, 22 bp, Artificial Sequence
  chemically synthesized
tttatccaatccaccattgatg

SEQ ID NO: 737399 - DNA, 22 bp, Artificial Sequence
  chemically synthesized
tatccaatccaccattgatggg

SEQ ID NO: 737400 - DNA, 22 bp, Artificial Sequence
  chemically synthesized
atccaatccaccattgatgggc

SEQ ID NO: 737401 - DNA, 22 bp, Artificial Sequence
  chemically synthesized
tccaatccaccattgatgggca

SEQ ID NO: 737402 - DNA, 22 bp, Artificial Sequence
  chemically synthesized
atgggcacctaggttgacttta

SEQ ID NO: 737403 - DNA, 22 bp, Artificial Sequence
  chemically synthesized
acaatagcaaagacataaagtc

SEQ ID NO: 737404 - DNA, 22 bp, Artificial Sequence
  chemically synthesized
ttcacaatagcaaagacataaa

SEQ ID NO: 737405 - DNA, 22 bp, Artificial Sequence
  chemically synthesized
ggttgactttatgtctttgcta

SEQ ID NO: 737406 - DNA, 22 bp, Artificial Sequence
  chemically synthesized
cagcactattcacaatagcaaa

SEQ ID NO: 737407 - DNA, 22 bp, Artificial Sequence
  chemically synthesized
actttatgtctttgctattgtg

SEQ ID NO: 737408 - DNA, 22 bp, Artificial Sequence
  chemically synthesized
attgcagcactattcacaatag

SEQ ID NO: 737409 - DNA, 22 bp, Artificial Sequence
  chemically synthesized
tatgtctttgctattgtgaata

SEQ ID NO: 737410 - DNA, 22 bp, Artificial Sequence
  chemically synthesized
atgtctttgctattgtgaatag

SEQ ID NO: 737411 - DNA, 22 bp, Artificial Sequence
  chemically synthesized
tgtctttgctattgtgaatagt

SEQ ID NO: 737412 - DNA, 22 bp, Artificial Sequence
  chemically synthesized
atatgttcattgcagcactatt

SEQ ID NO: 737413 - DNA, 22 bp, Artificial Sequence
  chemically synthesized
tgctattgtgaatagtgctgca

SEQ ID NO: 737414 - DNA, 22 bp, Artificial Sequence
  chemically synthesized
gctattgtgaatagtgctgcaa

SEQ ID NO: 737415 - DNA, 22 bp, Artificial Sequence
  chemically synthesized
ctattgtgaatagtgctgcaat

SEQ ID NO: 737416 - DNA, 22 bp, Artificial Sequence
  chemically synthesized
ttgtgaatagtgctgcaatgaa

SEQ ID NO: 737417 - DNA, 22 bp, Artificial Sequence
  chemically synthesized
tgaatagtgctgcaatgaacat

SEQ ID NO: 737418 - DNA, 22 bp, Artificial Sequence
  chemically synthesized
ccaaaaagacgtgcgctcatat

SEQ ID NO: 737419 - DNA, 22 bp, Artificial Sequence
  chemically synthesized
taccaaaaagacgtgcgctcat

SEQ ID NO: 737420 - DNA, 22 bp, Artificial Sequence
  chemically synthesized
ctaccaaaaagacgtgcgctca

SEQ ID NO: 737421 - DNA, 22 bp, Artificial Sequence
  chemically synthesized
caatgaacatatgagcgcacgt

SEQ ID NO: 737422 - DNA, 22 bp, Artificial Sequence
  chemically synthesized
tctaccaaaaagacgtgcgctc

SEQ ID NO: 737423 - DNA, 22 bp, Artificial Sequence
  chemically synthesized
ttctaccaaaaagacgtgcgct

SEQ ID NO: 737424 - DNA, 22 bp, Artificial Sequence
  chemically synthesized
tttggtagaaaaatttatattt

SEQ ID NO: 737425 - DNA, 22 bp, Artificial Sequence
  chemically synthesized
ttggtagaaaaatttatatttc

SEQ ID NO: 737426 - DNA, 22 bp, Artificial Sequence
  chemically synthesized
tggtagaaaaatttatatttct

SEQ ID NO: 737427 - DNA, 22 bp, Artificial Sequence
  chemically synthesized
gtatgtacccaaagaaatataa

SEQ ID NO: 737428 - DNA, 22 bp, Artificial Sequence
  chemically synthesized
ggtagaaaaatttatatttctt

SEQ ID NO: 737429 - DNA, 22 bp, Artificial Sequence
  chemically synthesized
ggtatgtacccaaagaaatata

SEQ ID NO: 737430 - DNA, 22 bp, Artificial Sequence
  chemically synthesized
gtagaaaaatttatatttcttt

SEQ ID NO: 737431 - DNA, 22 bp, Artificial Sequence
  chemically synthesized
cttggtatgtacccaaagaaat

SEQ ID NO: 737432 - DNA, 22 bp, Artificial Sequence
  chemically synthesized
cattacttggtatgtacccaaa

SEQ ID NO: 737433 - DNA, 22 bp, Artificial Sequence
  chemically synthesized
ccattacttggtatgtacccaa

SEQ ID NO: 737434 - DNA, 22 bp, Artificial Sequence
  chemically synthesized
atatttctttgggtacatacca

SEQ ID NO: 737435 - DNA, 22 bp, Artificial Sequence
  chemically synthesized
tatttctttgggtacataccaa

SEQ ID NO: 737436 - DNA, 22 bp, Artificial Sequence
  chemically synthesized
ctttgggtacataccaagtaat

SEQ ID NO: 737437 - DNA, 22 bp, Artificial Sequence
  chemically synthesized
tttgggtacataccaagtaatg

SEQ ID NO: 737438 - DNA, 22 bp, Artificial Sequence
  chemically synthesized
acccagcacttccattacttgg

SEQ ID NO: 737439 - DNA, 22 bp, Artificial Sequence
  chemically synthesized
gacccagcacttccattacttg

SEQ ID NO: 737440 - DNA, 22 bp, Artificial Sequence
  chemically synthesized
tgggtacataccaagtaatgga

SEQ ID NO: 737441 - DNA, 22 bp, Artificial Sequence
  chemically synthesized
gggtacataccaagtaatggaa

SEQ ID NO: 737442 - DNA, 22 bp, Artificial Sequence
  chemically synthesized
ggtacataccaagtaatggaag

SEQ ID NO: 737443 - DNA, 22 bp, Artificial Sequence
  chemically synthesized
ccatttgacccagcacttccat

SEQ ID NO: 737444 - DNA, 22 bp, Artificial Sequence
  chemically synthesized
ggtcaaatggtagttctttttt

SEQ ID NO: 737445 - DNA, 22 bp, Artificial Sequence
  chemically synthesized
aaaaaaaaaaaaaagaaagaaa

SEQ ID NO: 737446 - DNA, 22 bp, Artificial Sequence
  chemically synthesized
ttttttttctttctttcttttt

SEQ ID NO: 737447 - DNA, 22 bp, Artificial Sequence
  chemically synthesized
tctcaaaaaaaaaaaaaagaaa

SEQ ID NO: 737448 - DNA, 22 bp, Artificial Sequence
  chemically synthesized
ttttttctttctttcttttttt

SEQ ID NO: 737449 - DNA, 22 bp, Artificial Sequence
  chemically synthesized
tttttctttctttctttttttt

SEQ ID NO: 737450 - DNA, 22 bp, Artificial Sequence
  chemically synthesized
tgtctcaaaaaaaaaaaaaaga

SEQ ID NO: 737451 - DNA, 22 bp, Artificial Sequence
  chemically synthesized
ttttctttctttcttttttttt

SEQ ID NO: 737452 - DNA, 22 bp, Artificial Sequence
  chemically synthesized
tttctttctttctttttttttt

SEQ ID NO: 737453 - DNA, 22 bp, Artificial Sequence
  chemically synthesized
ttctttctttcttttttttttt

SEQ ID NO: 737454 - DNA, 22 bp, Artificial Sequence
  chemically synthesized
tctttctttctttttttttttt

SEQ ID NO: 737455 - DNA, 22 bp, Artificial Sequence
  chemically synthesized
ctttctttcttttttttttttt

SEQ ID NO: 737456 - DNA, 22 bp, Artificial Sequence
  chemically synthesized
tttctttctttttttttttttt

SEQ ID NO: 737457 - DNA, 22 bp, Artificial Sequence
  chemically synthesized
tctttcttttttttttttttga

SEQ ID NO: 737458 - DNA, 22 bp, Artificial Sequence
  chemically synthesized
ctttcttttttttttttttgag

SEQ ID NO: 737459 - DNA, 22 bp, Artificial Sequence
  chemically synthesized
tttcttttttttttttttgaga

SEQ ID NO: 737460 - DNA, 22 bp, Artificial Sequence
  chemically synthesized
tcttttttttttttttgagaca

SEQ ID NO: 737461 - DNA, 22 bp, Artificial Sequence
  chemically synthesized
cttttttttttttttgagacag

SEQ ID NO: 737462 - DNA, 22 bp, Artificial Sequence
  chemically synthesized
ttttttttttttttgagacaga

SEQ ID NO: 737463 - DNA, 22 bp, Artificial Sequence
  chemically synthesized
ttttttttttttgagacagagt

SEQ ID NO: 737464 - DNA, 22 bp, Artificial Sequence
  chemically synthesized
tttttttttttgagacagagtc

SEQ ID NO: 737465 - DNA, 22 bp, Artificial Sequence
  chemically synthesized
ttttttttttgagacagagtct

SEQ ID NO: 737466 - DNA, 22 bp, Artificial Sequence
  chemically synthesized
ggcaacagagcaagactctgtc

SEQ ID NO: 737467 - DNA, 22 bp, Artificial Sequence
  chemically synthesized
tttttttttgagacagagtctt

SEQ ID NO: 737468 - DNA, 22 bp, Artificial Sequence
  chemically synthesized
ttttttttgagacagagtcttg

SEQ ID NO: 737469 - DNA, 22 bp, Artificial Sequence
  chemically synthesized
tttttttgagacagagtcttgc

SEQ ID NO: 737470 - DNA, 22 bp, Artificial Sequence
  chemically synthesized
ttttttgagacagagtcttgct

SEQ ID NO: 737471 - DNA, 22 bp, Artificial Sequence
  chemically synthesized
tttttgagacagagtcttgctc

SEQ ID NO: 737472 - DNA, 22 bp, Artificial Sequence
  chemically synthesized
ttttgagacagagtcttgctct

SEQ ID NO: 737473 - DNA, 22 bp, Artificial Sequence
  chemically synthesized
tttgagacagagtcttgctctg

SEQ ID NO: 737474 - DNA, 22 bp, Artificial Sequence
  chemically synthesized
cagcctgggcaacagagcaaga

SEQ ID NO: 737475 - DNA, 22 bp, Artificial Sequence
  chemically synthesized
ttgagacagagtcttgctctgt

SEQ ID NO: 737476 - DNA, 22 bp, Artificial Sequence
  chemically synthesized
tgagacagagtcttgctctgtt

SEQ ID NO: 737477 - DNA, 22 bp, Artificial Sequence
  chemically synthesized
gagacagagtcttgctctgttg

SEQ ID NO: 737478 - DNA, 22 bp, Artificial Sequence
  chemically synthesized
agacagagtcttgctctgttgc

SEQ ID NO: 737479 - DNA, 22 bp, Artificial Sequence
  chemically synthesized
cactccagcctgggcaacagag

SEQ ID NO: 737480 - DNA, 22 bp, Artificial Sequence
  chemically synthesized
gctctgttgcccaggctggagt

SEQ ID NO: 737481 - DNA, 22 bp, Artificial Sequence
  chemically synthesized
ctctgttgcccaggctggagtg

SEQ ID NO: 737482 - DNA, 22 bp, Artificial Sequence
  chemically synthesized
tgttgcccaggctggagtgcag

SEQ ID NO: 737483 - DNA, 22 bp, Artificial Sequence
  chemically synthesized
ttgcccaggctggagtgcagtg

SEQ ID NO: 737484 - DNA, 22 bp, Artificial Sequence
  chemically synthesized
cccaggctggagtgcagtggca

SEQ ID NO: 737485 - DNA, 22 bp, Artificial Sequence
  chemically synthesized
cagtgagccgagatcatgccac

SEQ ID NO: 737486 - DNA, 22 bp, Artificial Sequence
  chemically synthesized
gagtgcagtggcatgatctcgg

SEQ ID NO: 737487 - DNA, 22 bp, Artificial Sequence
  chemically synthesized
aacataggaggcggaggttgca

SEQ ID NO: 737488 - DNA, 22 bp, Artificial Sequence
  chemically synthesized
gaacataggaggcggaggttgc

SEQ ID NO: 737489 - DNA, 22 bp, Artificial Sequence
  chemically synthesized
ggctcactgcaacctccgcctc

SEQ ID NO: 737490 - DNA, 22 bp, Artificial Sequence
  chemically synthesized
actgcaacctccgcctcctatg

SEQ ID NO: 737491 - DNA, 22 bp, Artificial Sequence
  chemically synthesized
caacctccgcctcctatgttca

SEQ ID NO: 737492 - DNA, 22 bp, Artificial Sequence
  chemically synthesized
aggcaggagaaccacttgaaca

SEQ ID NO: 737493 - DNA, 22 bp, Artificial Sequence
  chemically synthesized
cgcctcctatgttcaagtggtt

SEQ ID NO: 737494 - DNA, 22 bp, Artificial Sequence
  chemically synthesized
ctatgttcaagtggttctcctg

SEQ ID NO: 737495 - DNA, 22 bp, Artificial Sequence
  chemically synthesized
ggaaggctgaggcaggagaacc

SEQ ID NO: 737496 - DNA, 22 bp, Artificial Sequence
  chemically synthesized
tgttcaagtggttctcctgcct

SEQ ID NO: 737497 - DNA, 22 bp, Artificial Sequence
  chemically synthesized
ctcggaaggctgaggcaggaga

SEQ ID NO: 737498 - DNA, 22 bp, Artificial Sequence
  chemically synthesized
aagtggttctcctgcctcagcc

SEQ ID NO: 737499 - DNA, 22 bp, Artificial Sequence
  chemically synthesized
taatcccagttactcggaaggc

SEQ ID NO: 737500 - DNA, 22 bp, Artificial Sequence
  chemically synthesized
tcctgcctcagccttccgagta

SEQ ID NO: 737501 - DNA, 22 bp, Artificial Sequence
  chemically synthesized
ctgcctcagccttccgagtaac

SEQ ID NO: 737502 - DNA, 22 bp, Artificial Sequence
  chemically synthesized
cctcagccttccgagtaactgg

SEQ ID NO: 737503 - DNA, 22 bp, Artificial Sequence
  chemically synthesized
agccttccgagtaactgggatt

SEQ ID NO: 737504 - DNA, 22 bp, Artificial Sequence
  chemically synthesized
ccgagtaactgggattacaggt

SEQ ID NO: 737505 - DNA, 22 bp, Artificial Sequence
  chemically synthesized
cgagtaactgggattacaggtg

SEQ ID NO: 737506 - DNA, 22 bp, Artificial Sequence
  chemically synthesized
gccgggcatggtggcagacacc

SEQ ID NO: 737507 - DNA, 22 bp, Artificial Sequence
  chemically synthesized
ggattacaggtgtctgccacca

SEQ ID NO: 737508 - DNA, 22 bp, Artificial Sequence
  chemically synthesized
caggtgtctgccaccatgcccg

SEQ ID NO: 737509 - DNA, 22 bp, Artificial Sequence
  chemically synthesized
aaaatacaaaaaaattagccgg

SEQ ID NO: 737510 - DNA, 22 bp, Artificial Sequence
  chemically synthesized
ccaccatgcccggctaattttt

SEQ ID NO: 737511 - DNA, 22 bp, Artificial Sequence
  chemically synthesized
ctaaaaatacaaaaaaattagc

SEQ ID NO: 737512 - DNA, 22 bp, Artificial Sequence
  chemically synthesized
tactaaaaatacaaaaaaatta

SEQ ID NO: 737513 - DNA, 22 bp, Artificial Sequence
  chemically synthesized
tctctactaaaaatacaaaaaa

SEQ ID NO: 737514 - DNA, 22 bp, Artificial Sequence
  chemically synthesized
atttttttgtatttttagtaga

SEQ ID NO: 737515 - DNA, 22 bp, Artificial Sequence
  chemically synthesized
ttttgtatttttagtagagata

SEQ ID NO: 737516 - DNA, 22 bp, Artificial Sequence
  chemically synthesized
tttgtatttttagtagagatag

SEQ ID NO: 737517 - DNA, 22 bp, Artificial Sequence
  chemically synthesized
ttgtatttttagtagagatagg

SEQ ID NO: 737518 - DNA, 22 bp, Artificial Sequence
  chemically synthesized
tgtatttttagtagagataggg

SEQ ID NO: 737519 - DNA, 22 bp, Artificial Sequence
  chemically synthesized
gtatttttagtagagatagggt

SEQ ID NO: 737520 - DNA, 22 bp, Artificial Sequence
  chemically synthesized
tatttttagtagagatagggtt

SEQ ID NO: 737521 - DNA, 22 bp, Artificial Sequence
  chemically synthesized
gccaacatggtgaaaccctatc

SEQ ID NO: 737522 - DNA, 22 bp, Artificial Sequence
  chemically synthesized
ttagtagagatagggtttcacc

SEQ ID NO: 737523 - DNA, 22 bp, Artificial Sequence
  chemically synthesized
tagtagagatagggtttcacca

SEQ ID NO: 737524 - DNA, 22 bp, Artificial Sequence
  chemically synthesized
agtagagatagggtttcaccat

SEQ ID NO: 737525 - DNA, 22 bp, Artificial Sequence
  chemically synthesized
gtagagatagggtttcaccatg

SEQ ID NO: 737526 - DNA, 22 bp, Artificial Sequence
  chemically synthesized
gagaccagcctggccaacatgg

SEQ ID NO: 737527 - DNA, 22 bp, Artificial Sequence
  chemically synthesized
ggagttcgagaccagcctggcc

SEQ ID NO: 737528 - DNA, 22 bp, Artificial Sequence
  chemically synthesized
caccatgttggccaggctggtc

SEQ ID NO: 737529 - DNA, 22 bp, Artificial Sequence
  chemically synthesized
accatgttggccaggctggtct

SEQ ID NO: 737530 - DNA, 22 bp, Artificial Sequence
  chemically synthesized
aggttaggagttcgagaccagc

SEQ ID NO: 737531 - DNA, 22 bp, Artificial Sequence
  chemically synthesized
gccaggctggtctcgaactcct

SEQ ID NO: 737532 - DNA, 22 bp, Artificial Sequence
  chemically synthesized
gtctcgaactcctaacctcagg

SEQ ID NO: 737533 - DNA, 22 bp, Artificial Sequence
  chemically synthesized
gaactcctaacctcaggtgatc

SEQ ID NO: 737534 - DNA, 22 bp, Artificial Sequence
  chemically synthesized
ggaggtcgaggtgggtggatca

SEQ ID NO: 737535 - DNA, 22 bp, Artificial Sequence
  chemically synthesized
ctaacctcaggtgatccaccca

SEQ ID NO: 737536 - DNA, 22 bp, Artificial Sequence
  chemically synthesized
gggaggtcgaggtgggtggatc

SEQ ID NO: 737537 - DNA, 22 bp, Artificial Sequence
  chemically synthesized
tgggaggtcgaggtgggtggat

SEQ ID NO: 737538 - DNA, 22 bp, Artificial Sequence
  chemically synthesized
acctcaggtgatccacccacct

SEQ ID NO: 737539 - DNA, 22 bp, Artificial Sequence
  chemically synthesized
aggtgatccacccacctcgacc

SEQ ID NO: 737540 - DNA, 22 bp, Artificial Sequence
  chemically synthesized
tgatcccagcactttgggaggt

SEQ ID NO: 737541 - DNA, 22 bp, Artificial Sequence
  chemically synthesized
acgcctgtgatcccagcacttt

SEQ ID NO: 737542 - DNA, 22 bp, Artificial Sequence
  chemically synthesized
gacctcccaaagtgctgggatc

SEQ ID NO: 737543 - DNA, 22 bp, Artificial Sequence
  chemically synthesized
ccaaagtgctgggatcacaggc

SEQ ID NO: 737544 - DNA, 22 bp, Artificial Sequence
  chemically synthesized
ggatcacaggcgtgagccacga

SEQ ID NO: 737545 - DNA, 22 bp, Artificial Sequence
  chemically synthesized
caagaaaaaaatgaccgggtgt

SEQ ID NO: 737546 - DNA, 22 bp, Artificial Sequence
  chemically synthesized
ccaaaactccaagaaaaaaatg

SEQ ID NO: 737547 - DNA, 22 bp, Artificial Sequence
  chemically synthesized
gccaaaactccaagaaaaaaat

SEQ ID NO: 737548 - DNA, 22 bp, Artificial Sequence
  chemically synthesized
tgccaaaactccaagaaaaaaa

SEQ ID NO: 737549 - DNA, 22 bp, Artificial Sequence
  chemically synthesized
aatagttttgccaaaactccaa

SEQ ID NO: 737550 - DNA, 22 bp, Artificial Sequence
  chemically synthesized
aaatagttttgccaaaactcca

SEQ ID NO: 737551 - DNA, 22 bp, Artificial Sequence
  chemically synthesized
ttttcttggagttttggcaaaa

SEQ ID NO: 737552 - DNA, 22 bp, Artificial Sequence
  chemically synthesized
tttcttggagttttggcaaaac

SEQ ID NO: 737553 - DNA, 22 bp, Artificial Sequence
  chemically synthesized
ttcttggagttttggcaaaact

SEQ ID NO: 737554 - DNA, 22 bp, Artificial Sequence
  chemically synthesized
tcttggagttttggcaaaacta

SEQ ID NO: 737555 - DNA, 22 bp, Artificial Sequence
  chemically synthesized
cttggagttttggcaaaactat

SEQ ID NO: 737556 - DNA, 22 bp, Artificial Sequence
  chemically synthesized
accaacacttaaatagttttgc

SEQ ID NO: 737557 - DNA, 22 bp, Artificial Sequence
  chemically synthesized
ttggagttttggcaaaactatt

SEQ ID NO: 737558 - DNA, 22 bp, Artificial Sequence
  chemically synthesized
ggagttttggcaaaactattta

SEQ ID NO: 737559 - DNA, 22 bp, Artificial Sequence
  chemically synthesized
gagttttggcaaaactatttaa

SEQ ID NO: 737560 - DNA, 22 bp, Artificial Sequence
  chemically synthesized
ataaggttaaccaacacttaaa

SEQ ID NO: 737561 - DNA, 22 bp, Artificial Sequence
  chemically synthesized
tggcaaaactatttaagtgttg

SEQ ID NO: 737562 - DNA, 22 bp, Artificial Sequence
  chemically synthesized
cataaggttaaccaacacttaa

SEQ ID NO: 737563 - DNA, 22 bp, Artificial Sequence
  chemically synthesized
ggcaaaactatttaagtgttgg

SEQ ID NO: 737564 - DNA, 22 bp, Artificial Sequence
  chemically synthesized
gcaaaactatttaagtgttggt

SEQ ID NO: 737565 - DNA, 22 bp, Artificial Sequence
  chemically synthesized
tggcttcataaggttaaccaac

SEQ ID NO: 737566 - DNA, 22 bp, Artificial Sequence
  chemically synthesized
gtggcttcataaggttaaccaa

SEQ ID NO: 737567 - DNA, 22 bp, Artificial Sequence
  chemically synthesized
tttaagtgttggttaaccttat

SEQ ID NO: 737568 - DNA, 22 bp, Artificial Sequence
  chemically synthesized
aatttgtggcttcataaggtta

SEQ ID NO: 737569 - DNA, 22 bp, Artificial Sequence
  chemically synthesized
aagtgttggttaaccttatgaa

SEQ ID NO: 737570 - DNA, 22 bp, Artificial Sequence
  chemically synthesized
agtgttggttaaccttatgaag

SEQ ID NO: 737571 - DNA, 22 bp, Artificial Sequence
  chemically synthesized
catctaaatttgtggcttcata

SEQ ID NO: 737572 - DNA, 22 bp, Artificial Sequence
  chemically synthesized
acatctaaatttgtggcttcat

SEQ ID NO: 737573 - DNA, 22 bp, Artificial Sequence
  chemically synthesized
gttaaccttatgaagccacaaa

SEQ ID NO: 737574 - DNA, 22 bp, Artificial Sequence
  chemically synthesized
accttatgaagccacaaattta

SEQ ID NO: 737575 - DNA, 22 bp, Artificial Sequence
  chemically synthesized
atgaagccacaaatttagatgt

SEQ ID NO: 737576 - DNA, 22 bp, Artificial Sequence
  chemically synthesized
tgaagccacaaatttagatgta

SEQ ID NO: 737577 - DNA, 22 bp, Artificial Sequence
  chemically synthesized
aagacgtagtacttacatctaa

SEQ ID NO: 737578 - DNA, 22 bp, Artificial Sequence
  chemically synthesized
tgaagacgtagtacttacatct

SEQ ID NO: 737579 - DNA, 22 bp, Artificial Sequence
  chemically synthesized
ctgaagacgtagtacttacatc

SEQ ID NO: 737580 - DNA, 22 bp, Artificial Sequence
  chemically synthesized
taatttctgaagacgtagtact

SEQ ID NO: 737581 - DNA, 22 bp, Artificial Sequence
  chemically synthesized
agatgtaagtactacgtcttca

SEQ ID NO: 737582 - DNA, 22 bp, Artificial Sequence
  chemically synthesized
gatgtaagtactacgtcttcag

SEQ ID NO: 737583 - DNA, 22 bp, Artificial Sequence
  chemically synthesized
ggggaaaaaaactataatttct

SEQ ID NO: 737584 - DNA, 22 bp, Artificial Sequence
  chemically synthesized
cgtcttcagaaattatagtttt

SEQ ID NO: 737585 - DNA, 22 bp, Artificial Sequence
  chemically synthesized
cagaaattatagtttttttccc

SEQ ID NO: 737586 - DNA, 22 bp, Artificial Sequence
  chemically synthesized
agaaattatagtttttttcccc

SEQ ID NO: 737587 - DNA, 22 bp, Artificial Sequence
  chemically synthesized
taccagaggagaaaaattaggg

SEQ ID NO: 737588 - DNA, 22 bp, Artificial Sequence
  chemically synthesized
tagtttttttcccctaattttt

SEQ ID NO: 737589 - DNA, 22 bp, Artificial Sequence
  chemically synthesized
ttttcccctaatttttctcctc

SEQ ID NO: 737590 - DNA, 22 bp, Artificial Sequence
  chemically synthesized
tttcccctaatttttctcctct

SEQ ID NO: 737591 - DNA, 22 bp, Artificial Sequence
  chemically synthesized
ttcccctaatttttctcctctg

SEQ ID NO: 737592 - DNA, 22 bp, Artificial Sequence
  chemically synthesized
tcccctaatttttctcctctgg

SEQ ID NO: 737593 - DNA, 22 bp, Artificial Sequence
  chemically synthesized
cccctaatttttctcctctggt

SEQ ID NO: 737594 - DNA, 22 bp, Artificial Sequence
  chemically synthesized
ccctaatttttctcctctggta

SEQ ID NO: 737595 - DNA, 22 bp, Artificial Sequence
  chemically synthesized
atttttctcctctggtataact

SEQ ID NO: 737596 - DNA, 22 bp, Artificial Sequence
  chemically synthesized
taaaaataagcagaaagttata

SEQ ID NO: 737597 - DNA, 22 bp, Artificial Sequence
  chemically synthesized
ttctcctctggtataactttct

SEQ ID NO: 737598 - DNA, 22 bp, Artificial Sequence
  chemically synthesized
tctcctctggtataactttctg

SEQ ID NO: 737599 - DNA, 22 bp, Artificial Sequence
  chemically synthesized
ctcctctggtataactttctgc

SEQ ID NO: 737600 - DNA, 22 bp, Artificial Sequence
  chemically synthesized
tcctctggtataactttctgct

SEQ ID NO: 737601 - DNA, 22 bp, Artificial Sequence
  chemically synthesized
ctctggtataactttctgctta

SEQ ID NO: 737602 - DNA, 22 bp, Artificial Sequence
  chemically synthesized
aaaactataaaaataagcagaa

SEQ ID NO: 737603 - DNA, 22 bp, Artificial Sequence
  chemically synthesized
tggtataactttctgcttattt

SEQ ID NO: 737604 - DNA, 22 bp, Artificial Sequence
  chemically synthesized
ctgaaaactataaaaataagca

SEQ ID NO: 737605 - DNA, 22 bp, Artificial Sequence
  chemically synthesized
gtataactttctgcttattttt

SEQ ID NO: 737606 - DNA, 22 bp, Artificial Sequence
  chemically synthesized
aaatgttactgaaaactataaa

SEQ ID NO: 737607 - DNA, 22 bp, Artificial Sequence
  chemically synthesized
tctgcttatttttatagttttc

SEQ ID NO: 737608 - DNA, 22 bp, Artificial Sequence
  chemically synthesized
ctgcttatttttatagttttca

SEQ ID NO: 737609 - DNA, 22 bp, Artificial Sequence
  chemically synthesized
tgcttatttttatagttttcag

SEQ ID NO: 737610 - DNA, 22 bp, Artificial Sequence
  chemically synthesized
agttaaaatgttactgaaaact

SEQ ID NO: 737611 - DNA, 22 bp, Artificial Sequence
  chemically synthesized
cttatttttatagttttcagta

SEQ ID NO: 737612 - DNA, 22 bp, Artificial Sequence
  chemically synthesized
atttttatagttttcagtaaca

SEQ ID NO: 737613 - DNA, 22 bp, Artificial Sequence
  chemically synthesized
tttttatagttttcagtaacat

SEQ ID NO: 737614 - DNA, 22 bp, Artificial Sequence
  chemically synthesized
ttatagttttcagtaacatttt

SEQ ID NO: 737615 - DNA, 22 bp, Artificial Sequence
  chemically synthesized
tatagttttcagtaacatttta

SEQ ID NO: 737616 - DNA, 22 bp, Artificial Sequence
  chemically synthesized
atagttttcagtaacattttaa

SEQ ID NO: 737617 - DNA, 22 bp, Artificial Sequence
  chemically synthesized
tagttttcagtaacattttaac

SEQ ID NO: 737618 - DNA, 22 bp, Artificial Sequence
  chemically synthesized
tcagtaacattttaacttagtt

SEQ ID NO: 737619 - DNA, 22 bp, Artificial Sequence
  chemically synthesized
cagtaacattttaacttagttt

SEQ ID NO: 737620 - DNA, 22 bp, Artificial Sequence
  chemically synthesized
agtaacattttaacttagtttt

SEQ ID NO: 737621 - DNA, 22 bp, Artificial Sequence
  chemically synthesized
aatagatgaatgcataaaacta

SEQ ID NO: 737622 - DNA, 22 bp, Artificial Sequence
  chemically synthesized
gaatagatgaatgcataaaact

SEQ ID NO: 737623 - DNA, 22 bp, Artificial Sequence
  chemically synthesized
taacttagttttatgcattcat

SEQ ID NO: 737624 - DNA, 22 bp, Artificial Sequence
  chemically synthesized
aacttagttttatgcattcatc

SEQ ID NO: 737625 - DNA, 22 bp, Artificial Sequence
  chemically synthesized
acttagttttatgcattcatct

SEQ ID NO: 737626 - DNA, 22 bp, Artificial Sequence
  chemically synthesized
taaatgtcttgaatagatgaat

SEQ ID NO: 737627 - DNA, 22 bp, Artificial Sequence
  chemically synthesized
agttttatgcattcatctattc

SEQ ID NO: 737628 - DNA, 22 bp, Artificial Sequence
  chemically synthesized
tataaatgtcttgaatagatga

SEQ ID NO: 737629 - DNA, 22 bp, Artificial Sequence
  chemically synthesized
gttttatgcattcatctattca

SEQ ID NO: 737630 - DNA, 22 bp, Artificial Sequence
  chemically synthesized
tatgcattcatctattcaagac

SEQ ID NO: 737631 - DNA, 22 bp, Artificial Sequence
  chemically synthesized
atgcattcatctattcaagaca

SEQ ID NO: 737632 - DNA, 22 bp, Artificial Sequence
  chemically synthesized
tgcattcatctattcaagacat

SEQ ID NO: 737633 - DNA, 22 bp, Artificial Sequence
  chemically synthesized
atctattcaagacatttataga

SEQ ID NO: 737634 - DNA, 22 bp, Artificial Sequence
  chemically synthesized
atatagtaagcattctataaat

SEQ ID NO: 737635 - DNA, 22 bp, Artificial Sequence
  chemically synthesized
catatagtaagcattctataaa

SEQ ID NO: 737636 - DNA, 22 bp, Artificial Sequence
  chemically synthesized
tcatatagtaagcattctataa

SEQ ID NO: 737637 - DNA, 22 bp, Artificial Sequence
  chemically synthesized
ttcaagacatttatagaatgct

SEQ ID NO: 737638 - DNA, 22 bp, Artificial Sequence
  chemically synthesized
aagacatttatagaatgcttac

SEQ ID NO: 737639 - DNA, 22 bp, Artificial Sequence
  chemically synthesized
gcagtgtctttcatatagtaag

SEQ ID NO: 737640 - DNA, 22 bp, Artificial Sequence
  chemically synthesized
ggcagtgtctttcatatagtaa

SEQ ID NO: 737641 - DNA, 22 bp, Artificial Sequence
  chemically synthesized
atagaatgcttactatatgaaa

SEQ ID NO: 737642 - DNA, 22 bp, Artificial Sequence
  chemically synthesized
tagaatgcttactatatgaaag

SEQ ID NO: 737643 - DNA, 22 bp, Artificial Sequence
  chemically synthesized
acatttggcagtgtctttcata

SEQ ID NO: 737644 - DNA, 22 bp, Artificial Sequence
  chemically synthesized
ctgacatttggcagtgtctttc

SEQ ID NO: 737645 - DNA, 22 bp, Artificial Sequence
  chemically synthesized
actatatgaaagacactgccaa

SEQ ID NO: 737646 - DNA, 22 bp, Artificial Sequence
  chemically synthesized
ctatatgaaagacactgccaaa

SEQ ID NO: 737647 - DNA, 22 bp, Artificial Sequence
  chemically synthesized
tatgaaagacactgccaaatgt

SEQ ID NO: 737648 - DNA, 22 bp, Artificial Sequence
  chemically synthesized
aataccacatctactgacattt

SEQ ID NO: 737649 - DNA, 22 bp, Artificial Sequence
  chemically synthesized
ccaaatgtcagtagatgtggta

SEQ ID NO: 737650 - DNA, 22 bp, Artificial Sequence
  chemically synthesized
cataaggacagaggccctgaat

SEQ ID NO: 737651 - DNA, 22 bp, Artificial Sequence
  chemically synthesized
aatgtgagctccataaggacag

SEQ ID NO: 737652 - DNA, 22 bp, Artificial Sequence
  chemically synthesized
tctgaatgtgagctccataagg

SEQ ID NO: 737653 - DNA, 22 bp, Artificial Sequence
  chemically synthesized
agggcctctgtccttatggagc

SEQ ID NO: 737654 - DNA, 22 bp, Artificial Sequence
  chemically synthesized
ccctatctgaatgtgagctcca

SEQ ID NO: 737655 - DNA, 22 bp, Artificial Sequence
  chemically synthesized
cccctatctgaatgtgagctcc

SEQ ID NO: 737656 - DNA, 22 bp, Artificial Sequence
  chemically synthesized
tgtccttatggagctcacattc

SEQ ID NO: 737657 - DNA, 22 bp, Artificial Sequence
  chemically synthesized
tttcccctatctgaatgtgagc

SEQ ID NO: 737658 - DNA, 22 bp, Artificial Sequence
  chemically synthesized
tccttatggagctcacattcag

SEQ ID NO: 737659 - DNA, 22 bp, Artificial Sequence
  chemically synthesized
atggagctcacattcagatagg

SEQ ID NO: 737660 - DNA, 22 bp, Artificial Sequence
  chemically synthesized
tggagctcacattcagataggg

SEQ ID NO: 737661 - DNA, 22 bp, Artificial Sequence
  chemically synthesized
atgaaagtctgtttcccctatc

SEQ ID NO: 737662 - DNA, 22 bp, Artificial Sequence
  chemically synthesized
aatgaaagtctgtttcccctat

SEQ ID NO: 737663 - DNA, 22 bp, Artificial Sequence
  chemically synthesized
tttaatgaaagtctgtttcccc

SEQ ID NO: 737664 - DNA, 22 bp, Artificial Sequence
  chemically synthesized
acattcagataggggaaacaga

SEQ ID NO: 737665 - DNA, 22 bp, Artificial Sequence
  chemically synthesized
gtttaatgaaagtctgtttccc

SEQ ID NO: 737666 - DNA, 22 bp, Artificial Sequence
  chemically synthesized
agataggggaaacagactttca

SEQ ID NO: 737667 - DNA, 22 bp, Artificial Sequence
  chemically synthesized
gtggcttgtttaatgaaagtct

SEQ ID NO: 737668 - DNA, 22 bp, Artificial Sequence
  chemically synthesized
ggtggcttgtttaatgaaagtc

SEQ ID NO: 737669 - DNA, 22 bp, Artificial Sequence
  chemically synthesized
tgtgtttggtggcttgtttaat

SEQ ID NO: 737670 - DNA, 22 bp, Artificial Sequence
  chemically synthesized
tagctatgtgtttggtggcttg

SEQ ID NO: 737671 - DNA, 22 bp, Artificial Sequence
  chemically synthesized
tcattaaacaagccaccaaaca

SEQ ID NO: 737672 - DNA, 22 bp, Artificial Sequence
  chemically synthesized
cattaaacaagccaccaaacac

SEQ ID NO: 737673 - DNA, 22 bp, Artificial Sequence
  chemically synthesized
attaaacaagccaccaaacaca

SEQ ID NO: 737674 - DNA, 22 bp, Artificial Sequence
  chemically synthesized
aacaagccaccaaacacatagc

SEQ ID NO: 737675 - DNA, 22 bp, Artificial Sequence
  chemically synthesized
cgaaaatctatagctatgtgtt

SEQ ID NO: 737676 - DNA, 22 bp, Artificial Sequence
  chemically synthesized
acgaaaatctatagctatgtgt

SEQ ID NO: 737677 - DNA, 22 bp, Artificial Sequence
  chemically synthesized
acagcacttacgaaaatctata

SEQ ID NO: 737678 - DNA, 22 bp, Artificial Sequence
  chemically synthesized
cacagcacttacgaaaatctat

SEQ ID NO: 737679 - DNA, 22 bp, Artificial Sequence
  chemically synthesized
ttcacagcacttacgaaaatct

SEQ ID NO: 737680 - DNA, 22 bp, Artificial Sequence
  chemically synthesized
cttcacagcacttacgaaaatc

SEQ ID NO: 737681 - DNA, 22 bp, Artificial Sequence
  chemically synthesized
tcttcacagcacttacgaaaat

SEQ ID NO: 737682 - DNA, 22 bp, Artificial Sequence
  chemically synthesized
ctttcttcacagcacttacgaa

SEQ ID NO: 737683 - DNA, 22 bp, Artificial Sequence
  chemically synthesized
gctttcttcacagcacttacga

SEQ ID NO: 737684 - DNA, 22 bp, Artificial Sequence
  chemically synthesized
tttgctttcttcacagcactta

SEQ ID NO: 737685 - DNA, 22 bp, Artificial Sequence
  chemically synthesized
tagattttcgtaagtgctgtga

SEQ ID NO: 737686 - DNA, 22 bp, Artificial Sequence
  chemically synthesized
tcgtaagtgctgtgaagaaagc

SEQ ID NO: 737687 - DNA, 22 bp, Artificial Sequence
  chemically synthesized
cgtaagtgctgtgaagaaagca

SEQ ID NO: 737688 - DNA, 22 bp, Artificial Sequence
  chemically synthesized
gtaagtgctgtgaagaaagcaa

SEQ ID NO: 737689 - DNA, 22 bp, Artificial Sequence
  chemically synthesized
tcacagagagcatcctgtttgc

SEQ ID NO: 737690 - DNA, 22 bp, Artificial Sequence
  chemically synthesized
tgaagaaagcaaacaggatgct

SEQ ID NO: 737691 - DNA, 22 bp, Artificial Sequence
  chemically synthesized
ccatcattatcacagagagcat

SEQ ID NO: 737692 - DNA, 22 bp, Artificial Sequence
  chemically synthesized
cccatcattatcacagagagca

SEQ ID NO: 737693 - DNA, 22 bp, Artificial Sequence
  chemically synthesized
gggaagatttcccatcattatc

SEQ ID NO: 737694 - DNA, 22 bp, Artificial Sequence
  chemically synthesized
tctgtgataatgatgggaaatc

SEQ ID NO: 737695 - DNA, 22 bp, Artificial Sequence
  chemically synthesized
tgtgataatgatgggaaatctt

SEQ ID NO: 737696 - DNA, 22 bp, Artificial Sequence
  chemically synthesized
tgataatgatgggaaatcttcc

SEQ ID NO: 737697 - DNA, 22 bp, Artificial Sequence
  chemically synthesized
agtcacatctagggaagatttc

SEQ ID NO: 737698 - DNA, 22 bp, Artificial Sequence
  chemically synthesized
atgtataattaagtcacatcta

SEQ ID NO: 737699 - DNA, 22 bp, Artificial Sequence
  chemically synthesized
cagagttaatgtataattaagt

SEQ ID NO: 737700 - DNA, 22 bp, Artificial Sequence
  chemically synthesized
ccctagatgtgacttaattata

SEQ ID NO: 737701 - DNA, 22 bp, Artificial Sequence
  chemically synthesized
cctagatgtgacttaattatac

SEQ ID NO: 737702 - DNA, 22 bp, Artificial Sequence
  chemically synthesized
gatgtgacttaattatacatta

SEQ ID NO: 737703 - DNA, 22 bp, Artificial Sequence
  chemically synthesized
aagtaatggactgcagagttaa

SEQ ID NO: 737704 - DNA, 22 bp, Artificial Sequence
  chemically synthesized
gaagtaatggactgcagagtta

SEQ ID NO: 737705 - DNA, 22 bp, Artificial Sequence
  chemically synthesized
aattatacattaactctgcagt

SEQ ID NO: 737706 - DNA, 22 bp, Artificial Sequence
  chemically synthesized
attatacattaactctgcagtc

SEQ ID NO: 737707 - DNA, 22 bp, Artificial Sequence
  chemically synthesized
tacattaactctgcagtccatt

SEQ ID NO: 737708 - DNA, 22 bp, Artificial Sequence
  chemically synthesized
gggatcatttgaagtaatggac

SEQ ID NO: 737709 - DNA, 22 bp, Artificial Sequence
  chemically synthesized
actctgcagtccattacttcaa

SEQ ID NO: 737710 - DNA, 22 bp, Artificial Sequence
  chemically synthesized
tgcagtccattacttcaaatga

SEQ ID NO: 737711 - DNA, 22 bp, Artificial Sequence
  chemically synthesized
aataactagggatcatttgaag

SEQ ID NO: 737712 - DNA, 22 bp, Artificial Sequence
  chemically synthesized
cagtccattacttcaaatgatc

SEQ ID NO: 737713 - DNA, 22 bp, Artificial Sequence
  chemically synthesized
cttcaaatgatccctagttatt

SEQ ID NO: 737714 - DNA, 22 bp, Artificial Sequence
  chemically synthesized
cagtatgtaaattgaataacta

SEQ ID NO: 737715 - DNA, 22 bp, Artificial Sequence
  chemically synthesized
caaatgatccctagttattcaa

SEQ ID NO: 737716 - DNA, 22 bp, Artificial Sequence
  chemically synthesized
aaatgatccctagttattcaat

SEQ ID NO: 737717 - DNA, 22 bp, Artificial Sequence
  chemically synthesized
taaaattccagtatgtaaattg

SEQ ID NO: 737718 - DNA, 22 bp, Artificial Sequence
  chemically synthesized
gttattcaatttacatactgga

SEQ ID NO: 737719 - DNA, 22 bp, Artificial Sequence
  chemically synthesized
ttcaatttacatactggaattt

SEQ ID NO: 737720 - DNA, 22 bp, Artificial Sequence
  chemically synthesized
aacagggttgtaaaattccagt

SEQ ID NO: 737721 - DNA, 22 bp, Artificial Sequence
  chemically synthesized
aatttacatactggaattttac

SEQ ID NO: 737722 - DNA, 22 bp, Artificial Sequence
  chemically synthesized
actaaacagggttgtaaaattc

SEQ ID NO: 737723 - DNA, 22 bp, Artificial Sequence
  chemically synthesized
acatactggaattttacaaccc

SEQ ID NO: 737724 - DNA, 22 bp, Artificial Sequence
  chemically synthesized
catactggaattttacaaccct

SEQ ID NO: 737725 - DNA, 22 bp, Artificial Sequence
  chemically synthesized
ggactaactaaacagggttgta

SEQ ID NO: 737726 - DNA, 22 bp, Artificial Sequence
  chemically synthesized
gaattttacaaccctgtttagt

SEQ ID NO: 737727 - DNA, 22 bp, Artificial Sequence
  chemically synthesized
aagcctgggactaactaaacag

SEQ ID NO: 737728 - DNA, 22 bp, Artificial Sequence
  chemically synthesized
tacaaccctgtttagttagtcc

SEQ ID NO: 737729 - DNA, 22 bp, Artificial Sequence
  chemically synthesized
acaaccctgtttagttagtccc

SEQ ID NO: 737730 - DNA, 22 bp, Artificial Sequence
  chemically synthesized
caaccctgtttagttagtccca

SEQ ID NO: 737731 - DNA, 22 bp, Artificial Sequence
  chemically synthesized
aatggcctgaagcctgggacta

SEQ ID NO: 737732 - DNA, 22 bp, Artificial Sequence
  chemically synthesized
aaatggcctgaagcctgggact

SEQ ID NO: 737733 - DNA, 22 bp, Artificial Sequence
  chemically synthesized
taaatggcctgaagcctgggac

SEQ ID NO: 737734 - DNA, 22 bp, Artificial Sequence
  chemically synthesized
ttttaaatggcctgaagcctgg

SEQ ID NO: 737735 - DNA, 22 bp, Artificial Sequence
  chemically synthesized
tttagttagtcccaggcttcag

SEQ ID NO: 737736 - DNA, 22 bp, Artificial Sequence
  chemically synthesized
gttttaaatggcctgaagcctg

SEQ ID NO: 737737 - DNA, 22 bp, Artificial Sequence
  chemically synthesized
tgttttaaatggcctgaagcct

SEQ ID NO: 737738 - DNA, 22 bp, Artificial Sequence
  chemically synthesized
ttgttttaaatggcctgaagcc

SEQ ID NO: 737739 - DNA, 22 bp, Artificial Sequence
  chemically synthesized
agttagtcccaggcttcaggcc

SEQ ID NO: 737740 - DNA, 22 bp, Artificial Sequence
  chemically synthesized
gttagtcccaggcttcaggcca

SEQ ID NO: 737741 - DNA, 22 bp, Artificial Sequence
  chemically synthesized
gtcccaggcttcaggccattta

SEQ ID NO: 737742 - DNA, 22 bp, Artificial Sequence
  chemically synthesized
tatcttttgttttaaatggcct

SEQ ID NO: 737743 - DNA, 22 bp, Artificial Sequence
  chemically synthesized
atctatatcttttgttttaaat

SEQ ID NO: 737744 - DNA, 22 bp, Artificial Sequence
  chemically synthesized
ttcatctatatcttttgtttta

SEQ ID NO: 737745 - DNA, 22 bp, Artificial Sequence
  chemically synthesized
tattcatctatatcttttgttt

SEQ ID NO: 737746 - DNA, 22 bp, Artificial Sequence
  chemically synthesized
caggccatttaaaacaaaagat

SEQ ID NO: 737747 - DNA, 22 bp, Artificial Sequence
  chemically synthesized
ctattcatctatatcttttgtt

SEQ ID NO: 737748 - DNA, 22 bp, Artificial Sequence
  chemically synthesized
aggccatttaaaacaaaagata

SEQ ID NO: 737749 - DNA, 22 bp, Artificial Sequence
  chemically synthesized
ttctattcatctatatcttttg

SEQ ID NO: 737750 - DNA, 22 bp, Artificial Sequence
  chemically synthesized
aaaacaaaagatatagatgaat

SEQ ID NO: 737751 - DNA, 22 bp, Artificial Sequence
  chemically synthesized
agtgactcttctattcatctat

SEQ ID NO: 737752 - DNA, 22 bp, Artificial Sequence
  chemically synthesized
aaacaaaagatatagatgaata

SEQ ID NO: 737753 - DNA, 22 bp, Artificial Sequence
  chemically synthesized
aaggatgaagacaagctgagtg

SEQ ID NO: 737754 - DNA, 22 bp, Artificial Sequence
  chemically synthesized
accgagatctgaaggatgaaga

SEQ ID NO: 737755 - DNA, 22 bp, Artificial Sequence
  chemically synthesized
gaccgagatctgaaggatgaag

SEQ ID NO: 737756 - DNA, 22 bp, Artificial Sequence
  chemically synthesized
tgaccgagatctgaaggatgaa

SEQ ID NO: 737757 - DNA, 22 bp, Artificial Sequence
  chemically synthesized
agcttgtcttcatccttcagat

SEQ ID NO: 737758 - DNA, 22 bp, Artificial Sequence
  chemically synthesized
gtcttcatccttcagatctcgg

SEQ ID NO: 737759 - DNA, 22 bp, Artificial Sequence
  chemically synthesized
tcttcatccttcagatctcggt

SEQ ID NO: 737760 - DNA, 22 bp, Artificial Sequence
  chemically synthesized
catccttcagatctcggtcaaa

SEQ ID NO: 737761 - DNA, 22 bp, Artificial Sequence
  chemically synthesized
atccttcagatctcggtcaaag

SEQ ID NO: 737762 - DNA, 22 bp, Artificial Sequence
  chemically synthesized
ccaataaaagtgacctttgacc

SEQ ID NO: 737763 - DNA, 22 bp, Artificial Sequence
  chemically synthesized
cagatctcggtcaaaggtcact

SEQ ID NO: 737764 - DNA, 22 bp, Artificial Sequence
  chemically synthesized
agatctcggtcaaaggtcactt

SEQ ID NO: 737765 - DNA, 22 bp, Artificial Sequence
  chemically synthesized
ggtcaaaggtcacttttattgg

SEQ ID NO: 737766 - DNA, 22 bp, Artificial Sequence
  chemically synthesized
ttattgggagggtgtcctgatt

SEQ ID NO: 737767 - DNA, 22 bp, Artificial Sequence
  chemically synthesized
tattgggagggtgtcctgattg

SEQ ID NO: 737768 - DNA, 22 bp, Artificial Sequence
  chemically synthesized
attgggagggtgtcctgattgc

SEQ ID NO: 737769 - DNA, 22 bp, Artificial Sequence
  chemically synthesized
ttgggagggtgtcctgattgcc

SEQ ID NO: 737770 - DNA, 22 bp, Artificial Sequence
  chemically synthesized
ggagggtgtcctgattgccctt

SEQ ID NO: 737771 - DNA, 22 bp, Artificial Sequence
  chemically synthesized
cagtaagggtgagaggcaggaa

SEQ ID NO: 737772 - DNA, 22 bp, Artificial Sequence
  chemically synthesized
attgccctttcctgcctctcac

SEQ ID NO: 737773 - DNA, 22 bp, Artificial Sequence
  chemically synthesized
ccctttcctgcctctcaccctt

SEQ ID NO: 737774 - DNA, 22 bp, Artificial Sequence
  chemically synthesized
tcctgcctctcacccttactgc

SEQ ID NO: 737775 - DNA, 22 bp, Artificial Sequence
  chemically synthesized
cctgcctctcacccttactgca

SEQ ID NO: 737776 - DNA, 22 bp, Artificial Sequence
  chemically synthesized
ctgcctctcacccttactgcag

SEQ ID NO: 737777 - DNA, 22 bp, Artificial Sequence
  chemically synthesized
cctctcacccttactgcagcgc

SEQ ID NO: 737778 - DNA, 22 bp, Artificial Sequence
  chemically synthesized
tcacccttactgcagcgcgcgc

SEQ ID NO: 737779 - DNA, 22 bp, Artificial Sequence
  chemically synthesized
acccttactgcagcgcgcgcgc

SEQ ID NO: 737780 - DNA, 22 bp, Artificial Sequence
  chemically synthesized
actgcagcgcgcgcgcacacac

SEQ ID NO: 737781 - DNA, 22 bp, Artificial Sequence
  chemically synthesized
ctgcagcgcgcgcgcacacaca

SEQ ID NO: 737782 - DNA, 22 bp, Artificial Sequence
  chemically synthesized
cagcgcgcgcgcacacacacac

SEQ ID NO: 737783 - DNA, 22 bp, Artificial Sequence
  chemically synthesized
aatgtgtgtgtgtgtgtgtgtg

SEQ ID NO: 737784 - DNA, 22 bp, Artificial Sequence
  chemically synthesized
ccagaatatatagtaaggacct

SEQ ID NO: 737785 - DNA, 22 bp, Artificial Sequence
  chemically synthesized
aggtccttactatatattctgg

SEQ ID NO: 737786 - DNA, 22 bp, Artificial Sequence
  chemically synthesized
ggtccttactatatattctggt

SEQ ID NO: 737787 - DNA, 22 bp, Artificial Sequence
  chemically synthesized
actatatattctggtagtgtcc

SEQ ID NO: 737788 - DNA, 22 bp, Artificial Sequence
  chemically synthesized
ctatatattctggtagtgtcct

SEQ ID NO: 737789 - DNA, 22 bp, Artificial Sequence
  chemically synthesized
tatattctggtagtgtcctgta

SEQ ID NO: 737790 - DNA, 22 bp, Artificial Sequence
  chemically synthesized
tggtagtgtcctgtattttctt

SEQ ID NO: 737791 - DNA, 22 bp, Artificial Sequence
  chemically synthesized
gtagtgtcctgtattttctttc

SEQ ID NO: 737792 - DNA, 22 bp, Artificial Sequence
  chemically synthesized
caaatgtgtcaggaaagaaaat

SEQ ID NO: 737793 - DNA, 22 bp, Artificial Sequence
  chemically synthesized
tattttctttcctgacacattt

SEQ ID NO: 737794 - DNA, 22 bp, Artificial Sequence
  chemically synthesized
ataaaataattacaaatgtgtc

SEQ ID NO: 737795 - DNA, 22 bp, Artificial Sequence
  chemically synthesized
tctttcctgacacatttgtaat

SEQ ID NO: 737796 - DNA, 22 bp, Artificial Sequence
  chemically synthesized
ctttcctgacacatttgtaatt

SEQ ID NO: 737797 - DNA, 22 bp, Artificial Sequence
  chemically synthesized
tttcctgacacatttgtaatta

SEQ ID NO: 737798 - DNA, 22 bp, Artificial Sequence
  chemically synthesized
aatctcataaaataattacaaa

SEQ ID NO: 737799 - DNA, 22 bp, Artificial Sequence
  chemically synthesized
aaatctcataaaataattacaa

SEQ ID NO: 737800 - DNA, 22 bp, Artificial Sequence
  chemically synthesized
tcctgacacatttgtaattatt

SEQ ID NO: 737801 - DNA, 22 bp, Artificial Sequence
  chemically synthesized
taaatctcataaaataattaca

SEQ ID NO: 737802 - DNA, 22 bp, Artificial Sequence
  chemically synthesized
cctgacacatttgtaattattt

SEQ ID NO: 737803 - DNA, 22 bp, Artificial Sequence
  chemically synthesized
ttaaatctcataaaataattac

SEQ ID NO: 737804 - DNA, 22 bp, Artificial Sequence
  chemically synthesized
ctgacacatttgtaattatttt

SEQ ID NO: 737805 - DNA, 22 bp, Artificial Sequence
  chemically synthesized
tttaaatctcataaaataatta

SEQ ID NO: 737806 - DNA, 22 bp, Artificial Sequence
  chemically synthesized
acacatttgtaattattttatg

SEQ ID NO: 737807 - DNA, 22 bp, Artificial Sequence
  chemically synthesized
gtaattattttatgagatttaa

SEQ ID NO: 737808 - DNA, 22 bp, Artificial Sequence
  chemically synthesized
taattattttatgagatttaaa

SEQ ID NO: 737809 - DNA, 22 bp, Artificial Sequence
  chemically synthesized
ttttatgagatttaaaaaatta

SEQ ID NO: 737810 - DNA, 22 bp, Artificial Sequence
  chemically synthesized
ggatgacagacagtaatttttt

SEQ ID NO: 737811 - DNA, 22 bp, Artificial Sequence
  chemically synthesized
gggatgacagacagtaattttt

SEQ ID NO: 737812 - DNA, 22 bp, Artificial Sequence
  chemically synthesized
tatgagatttaaaaaattactg

SEQ ID NO: 737813 - DNA, 22 bp, Artificial Sequence
  chemically synthesized
atgagatttaaaaaattactgt

SEQ ID NO: 737814 - DNA, 22 bp, Artificial Sequence
  chemically synthesized
ttgggatgacagacagtaattt

SEQ ID NO: 737815 - DNA, 22 bp, Artificial Sequence
  chemically synthesized
tgagatttaaaaaattactgtc

SEQ ID NO: 737816 - DNA, 22 bp, Artificial Sequence
  chemically synthesized
cttgggatgacagacagtaatt

SEQ ID NO: 737817 - DNA, 22 bp, Artificial Sequence
  chemically synthesized
tggtttcttgggatgacagaca

SEQ ID NO: 737818 - DNA, 22 bp, Artificial Sequence
  chemically synthesized
aaaaaattactgtctgtcatcc

SEQ ID NO: 737819 - DNA, 22 bp, Artificial Sequence
  chemically synthesized
aaaaattactgtctgtcatccc

SEQ ID NO: 737820 - DNA, 22 bp, Artificial Sequence
  chemically synthesized
atggaggttatggtttcttggg

SEQ ID NO: 737821 - DNA, 22 bp, Artificial Sequence
  chemically synthesized
ctgtctgtcatcccaagaaacc

SEQ ID NO: 737822 - DNA, 22 bp, Artificial Sequence
  chemically synthesized
tctgtcatcccaagaaaccata

SEQ ID NO: 737823 - DNA, 22 bp, Artificial Sequence
  chemically synthesized
ccctcatggaggttatggtttc

SEQ ID NO: 737824 - DNA, 22 bp, Artificial Sequence
  chemically synthesized
tgccctcatggaggttatggtt

SEQ ID NO: 737825 - DNA, 22 bp, Artificial Sequence
  chemically synthesized
tcatcccaagaaaccataacct

SEQ ID NO: 737826 - DNA, 22 bp, Artificial Sequence
  chemically synthesized
tctgccctcatggaggttatgg

SEQ ID NO: 737827 - DNA, 22 bp, Artificial Sequence
  chemically synthesized
ctctgccctcatggaggttatg

SEQ ID NO: 737828 - DNA, 22 bp, Artificial Sequence
  chemically synthesized
agtcatagacagaccttctctg

SEQ ID NO: 737829 - DNA, 22 bp, Artificial Sequence
  chemically synthesized
catgagggcagagaaggtctgt

SEQ ID NO: 737830 - DNA, 22 bp, Artificial Sequence
  chemically synthesized
agatgatagggattcagtcata

SEQ ID NO: 737831 - DNA, 22 bp, Artificial Sequence
  chemically synthesized
gagatgatagggattcagtcat

SEQ ID NO: 737832 - DNA, 22 bp, Artificial Sequence
  chemically synthesized
tttgagatgatagggattcagt

SEQ ID NO: 737833 - DNA, 22 bp, Artificial Sequence
  chemically synthesized
tgtttgagatgatagggattca

SEQ ID NO: 737834 - DNA, 22 bp, Artificial Sequence
  chemically synthesized
tctatgactgaatccctatcat

SEQ ID NO: 737835 - DNA, 22 bp, Artificial Sequence
  chemically synthesized
tgactgaatccctatcatctca

SEQ ID NO: 737836 - DNA, 22 bp, Artificial Sequence
  chemically synthesized
ccaaactctgtttgagatgata

SEQ ID NO: 737837 - DNA, 22 bp, Artificial Sequence
  chemically synthesized
accaaactctgtttgagatgat

SEQ ID NO: 737838 - DNA, 22 bp, Artificial Sequence
  chemically synthesized
taccaaactctgtttgagatga

SEQ ID NO: 737839 - DNA, 22 bp, Artificial Sequence
  chemically synthesized
tttaccaaactctgtttgagat

SEQ ID NO: 737840 - DNA, 22 bp, Artificial Sequence
  chemically synthesized
aatccctatcatctcaaacaga

SEQ ID NO: 737841 - DNA, 22 bp, Artificial Sequence
  chemically synthesized
ctctttaccaaactctgtttga

SEQ ID NO: 737842 - DNA, 22 bp, Artificial Sequence
  chemically synthesized
tcatctcaaacagagtttggta

SEQ ID NO: 737843 - DNA, 22 bp, Artificial Sequence
  chemically synthesized
gtgtctactctttaccaaactc

SEQ ID NO: 737844 - DNA, 22 bp, Artificial Sequence
  chemically synthesized
tggtgtctactctttaccaaac

SEQ ID NO: 737845 - DNA, 22 bp, Artificial Sequence
  chemically synthesized
ctggtgtctactctttaccaaa

SEQ ID NO: 737846 - DNA, 22 bp, Artificial Sequence
  chemically synthesized
tctggtgtctactctttaccaa

SEQ ID NO: 737847 - DNA, 22 bp, Artificial Sequence
  chemically synthesized
ttctggtgtctactctttacca

SEQ ID NO: 737848 - DNA, 22 bp, Artificial Sequence
  chemically synthesized
tttctggtgtctactctttacc

SEQ ID NO: 737849 - DNA, 22 bp, Artificial Sequence
  chemically synthesized
aaacagagtttggtaaagagta

SEQ ID NO: 737850 - DNA, 22 bp, Artificial Sequence
  chemically synthesized
ttttctggtgtctactctttac

SEQ ID NO: 737851 - DNA, 22 bp, Artificial Sequence
  chemically synthesized
tttttttctggtgtctactctt

SEQ ID NO: 737852 - DNA, 22 bp, Artificial Sequence
  chemically synthesized
ggtaaagagtagacaccagaaa

SEQ ID NO: 737853 - DNA, 22 bp, Artificial Sequence
  chemically synthesized
aataattatttttttctggtgt

SEQ ID NO: 737854 - DNA, 22 bp, Artificial Sequence
  chemically synthesized
gtaaagagtagacaccagaaaa

SEQ ID NO: 737855 - DNA, 22 bp, Artificial Sequence
  chemically synthesized
attcaataattatttttttctg

SEQ ID NO: 737856 - DNA, 22 bp, Artificial Sequence
  chemically synthesized
aatcattcattcaataattatt

SEQ ID NO: 737857 - DNA, 22 bp, Artificial Sequence
  chemically synthesized
ttcaatcattcattcaataatt

SEQ ID NO: 737858 - DNA, 22 bp, Artificial Sequence
  chemically synthesized
gttcaatcattcattcaataat

SEQ ID NO: 737859 - DNA, 22 bp, Artificial Sequence
  chemically synthesized
tgttcaatcattcattcaataa

SEQ ID NO: 737860 - DNA, 22 bp, Artificial Sequence
  chemically synthesized
ctttgttcaatcattcattcaa

SEQ ID NO: 737861 - DNA, 22 bp, Artificial Sequence
  chemically synthesized
ttgaatgaatgattgaacaaag

SEQ ID NO: 737862 - DNA, 22 bp, Artificial Sequence
  chemically synthesized
aatgaatgattgaacaaaggag

SEQ ID NO: 737863 - DNA, 22 bp, Artificial Sequence
  chemically synthesized
aagtgaacggaaatcctccttt

SEQ ID NO: 737864 - DNA, 22 bp, Artificial Sequence
  chemically synthesized
ctgaagtgaacggaaatcctcc

SEQ ID NO: 737865 - DNA, 22 bp, Artificial Sequence
  chemically synthesized
gctgaagtgaacggaaatcctc

SEQ ID NO: 737866 - DNA, 22 bp, Artificial Sequence
  chemically synthesized
aacaaaggaggatttccgttca

SEQ ID NO: 737867 - DNA, 22 bp, Artificial Sequence
  chemically synthesized
aatcatcaaagtcttgctgaag

SEQ ID NO: 737868 - DNA, 22 bp, Artificial Sequence
  chemically synthesized
ccgttcacttcagcaagacttt

SEQ ID NO: 737869 - DNA, 22 bp, Artificial Sequence
  chemically synthesized
cgttcacttcagcaagactttg

SEQ ID NO: 737870 - DNA, 22 bp, Artificial Sequence
  chemically synthesized
acttcagcaagactttgatgat

SEQ ID NO: 737871 - DNA, 22 bp, Artificial Sequence
  chemically synthesized
cagcaagactttgatgattcaa

SEQ ID NO: 737872 - DNA, 22 bp, Artificial Sequence
  chemically synthesized
agcaagactttgatgattcaac

SEQ ID NO: 737873 - DNA, 22 bp, Artificial Sequence
  chemically synthesized
taggaccaagagggttgaatca

SEQ ID NO: 737874 - DNA, 22 bp, Artificial Sequence
  chemically synthesized
tgtaggaccaagagggttgaat

SEQ ID NO: 737875 - DNA, 22 bp, Artificial Sequence
  chemically synthesized
ctgtaggaccaagagggttgaa

SEQ ID NO: 737876 - DNA, 22 bp, Artificial Sequence
  chemically synthesized
ttctgtaggaccaagagggttg

SEQ ID NO: 737877 - DNA, 22 bp, Artificial Sequence
  chemically synthesized
tgatgattcaaccctcttggtc

SEQ ID NO: 737878 - DNA, 22 bp, Artificial Sequence
  chemically synthesized
gatgattcaaccctcttggtcc

SEQ ID NO: 737879 - DNA, 22 bp, Artificial Sequence
  chemically synthesized
atgattcaaccctcttggtcct

SEQ ID NO: 737880 - DNA, 22 bp, Artificial Sequence
  chemically synthesized
gaatcactcttctgtaggacca

SEQ ID NO: 737881 - DNA, 22 bp, Artificial Sequence
  chemically synthesized
aaccctcttggtcctacagaag

SEQ ID NO: 737882 - DNA, 22 bp, Artificial Sequence
  chemically synthesized
aaaactagaatcactcttctgt

SEQ ID NO: 737883 - DNA, 22 bp, Artificial Sequence
  chemically synthesized
ttggtcctacagaagagtgatt

SEQ ID NO: 737884 - DNA, 22 bp, Artificial Sequence
  chemically synthesized
ggtcctacagaagagtgattct

SEQ ID NO: 737885 - DNA, 22 bp, Artificial Sequence
  chemically synthesized
gtcctacagaagagtgattcta

SEQ ID NO: 737886 - DNA, 22 bp, Artificial Sequence
  chemically synthesized
acagactaaaaactagaatcac

SEQ ID NO: 737887 - DNA, 22 bp, Artificial Sequence
  chemically synthesized
cagaagagtgattctagttttt

SEQ ID NO: 737888 - DNA, 22 bp, Artificial Sequence
  chemically synthesized
aatcattcacagactaaaaact

SEQ ID NO: 737889 - DNA, 22 bp, Artificial Sequence
  chemically synthesized
agagcctgaatcattcacagac

SEQ ID NO: 737890 - DNA, 22 bp, Artificial Sequence
  chemically synthesized
tagtttttagtctgtgaatgat

SEQ ID NO: 737891 - DNA, 22 bp, Artificial Sequence
  chemically synthesized
actcagagcctgaatcattcac

SEQ ID NO: 737892 - DNA, 22 bp, Artificial Sequence
  chemically synthesized
gtttttagtctgtgaatgattc

SEQ ID NO: 737893 - DNA, 22 bp, Artificial Sequence
  chemically synthesized
aactcagagcctgaatcattca

SEQ ID NO: 737894 - DNA, 22 bp, Artificial Sequence
  chemically synthesized
tttaactcagagcctgaatcat

SEQ ID NO: 737895 - DNA, 22 bp, Artificial Sequence
  chemically synthesized
ttagtctgtgaatgattcaggc

SEQ ID NO: 737896 - DNA, 22 bp, Artificial Sequence
  chemically synthesized
tagtctgtgaatgattcaggct

SEQ ID NO: 737897 - DNA, 22 bp, Artificial Sequence
  chemically synthesized
agtctgtgaatgattcaggctc

SEQ ID NO: 737898 - DNA, 22 bp, Artificial Sequence
  chemically synthesized
gtctgtgaatgattcaggctct

SEQ ID NO: 737899 - DNA, 22 bp, Artificial Sequence
  chemically synthesized
cctgtttaactcagagcctgaa

SEQ ID NO: 737900 - DNA, 22 bp, Artificial Sequence
  chemically synthesized
tgaatgattcaggctctgagtt

SEQ ID NO: 737901 - DNA, 22 bp, Artificial Sequence
  chemically synthesized
aagaattgcctgtttaactcag

SEQ ID NO: 737902 - DNA, 22 bp, Artificial Sequence
  chemically synthesized
aggctctgagttaaacaggcaa

SEQ ID NO: 737903 - DNA, 22 bp, Artificial Sequence
  chemically synthesized
tgagttaaacaggcaattcttg

SEQ ID NO: 737904 - DNA, 22 bp, Artificial Sequence
  chemically synthesized
agaccacgatctcaagaattgc

SEQ ID NO: 737905 - DNA, 22 bp, Artificial Sequence
  chemically synthesized
cagaccacgatctcaagaattg

SEQ ID NO: 737906 - DNA, 22 bp, Artificial Sequence
  chemically synthesized
agttaaacaggcaattcttgag

SEQ ID NO: 737907 - DNA, 22 bp, Artificial Sequence
  chemically synthesized
aacaggcaattcttgagatcgt

SEQ ID NO: 737908 - DNA, 22 bp, Artificial Sequence
  chemically synthesized
tatgaatttcagaccacgatct

SEQ ID NO: 737909 - DNA, 22 bp, Artificial Sequence
  chemically synthesized
ttgagatcgtggtctgaaattc

SEQ ID NO: 737910 - DNA, 22 bp, Artificial Sequence
  chemically synthesized
gagatcgtggtctgaaattcat

SEQ ID NO: 737911 - DNA, 22 bp, Artificial Sequence
  chemically synthesized
agatcgtggtctgaaattcata

SEQ ID NO: 737912 - DNA, 22 bp, Artificial Sequence
  chemically synthesized
aagtaggagggttgtatgaatt

SEQ ID NO: 737913 - DNA, 22 bp, Artificial Sequence
  chemically synthesized
aaagtaggagggttgtatgaat

SEQ ID NO: 737914 - DNA, 22 bp, Artificial Sequence
  chemically synthesized
aggaaatttaaagtaggagggt

SEQ ID NO: 737915 - DNA, 22 bp, Artificial Sequence
  chemically synthesized
aaattcatacaaccctcctact

SEQ ID NO: 737916 - DNA, 22 bp, Artificial Sequence
  chemically synthesized
atacaaccctcctactttaaat

SEQ ID NO: 737917 - DNA, 22 bp, Artificial Sequence
  chemically synthesized
gatcatgagttgaggaaattta

SEQ ID NO: 737918 - DNA, 22 bp, Artificial Sequence
  chemically synthesized
ctactttaaatttcctcaactc

SEQ ID NO: 737919 - DNA, 22 bp, Artificial Sequence
  chemically synthesized
ctttaaatttcctcaactcatg

SEQ ID NO: 737920 - DNA, 22 bp, Artificial Sequence
  chemically synthesized
taaatttcctcaactcatgatc

SEQ ID NO: 737921 - DNA, 22 bp, Artificial Sequence
  chemically synthesized
aaatttcctcaactcatgatcc

SEQ ID NO: 737922 - DNA, 22 bp, Artificial Sequence
  chemically synthesized
aatttcctcaactcatgatcca

SEQ ID NO: 737923 - DNA, 22 bp, Artificial Sequence
  chemically synthesized
tcaggaatcacctggatcatga

SEQ ID NO: 737924 - DNA, 22 bp, Artificial Sequence
  chemically synthesized
gtcaggaatcacctggatcatg

SEQ ID NO: 737925 - DNA, 22 bp, Artificial Sequence
  chemically synthesized
cctcaactcatgatccaggtga

SEQ ID NO: 737926 - DNA, 22 bp, Artificial Sequence
  chemically synthesized
atttgtcaggaatcacctggat

SEQ ID NO: 737927 - DNA, 22 bp, Artificial Sequence
  chemically synthesized
ctcaactcatgatccaggtgat

SEQ ID NO: 737928 - DNA, 22 bp, Artificial Sequence
  chemically synthesized
ttaatttgtcaggaatcacctg

SEQ ID NO: 737929 - DNA, 22 bp, Artificial Sequence
  chemically synthesized
aactcatgatccaggtgattcc

SEQ ID NO: 737930 - DNA, 22 bp, Artificial Sequence
  chemically synthesized
attaatttgtcaggaatcacct

SEQ ID NO: 737931 - DNA, 22 bp, Artificial Sequence
  chemically synthesized
atgatccaggtgattcctgaca

SEQ ID NO: 737932 - DNA, 22 bp, Artificial Sequence
  chemically synthesized
acatttattaatttgtcaggaa

SEQ ID NO: 737933 - DNA, 22 bp, Artificial Sequence
  chemically synthesized
tcacatttattaatttgtcagg

SEQ ID NO: 737934 - DNA, 22 bp, Artificial Sequence
  chemically synthesized
ctgacaaattaataaatgtgag

SEQ ID NO: 737935 - DNA, 22 bp, Artificial Sequence
  chemically synthesized
acaaattaataaatgtgagaat

SEQ ID NO: 737936 - DNA, 22 bp, Artificial Sequence
  chemically synthesized
aacaaaaagaacagcatcattc

SEQ ID NO: 737937 - DNA, 22 bp, Artificial Sequence
  chemically synthesized
aaacaaaaagaacagcatcatt

SEQ ID NO: 737938 - DNA, 22 bp, Artificial Sequence
  chemically synthesized
ataaatgtgagaatgatgctgt

SEQ ID NO: 737939 - DNA, 22 bp, Artificial Sequence
  chemically synthesized
taaacaaaaagaacagcatcat

SEQ ID NO: 737940 - DNA, 22 bp, Artificial Sequence
  chemically synthesized
gaccctttaaacaaaaagaaca

SEQ ID NO: 737941 - DNA, 22 bp, Artificial Sequence
  chemically synthesized
tgattcgaccctttaaacaaaa

SEQ ID NO: 737942 - DNA, 22 bp, Artificial Sequence
  chemically synthesized
atgattcgaccctttaaacaaa

SEQ ID NO: 737943 - DNA, 22 bp, Artificial Sequence
  chemically synthesized
atttatgattcgaccctttaaa

SEQ ID NO: 737944 - DNA, 22 bp, Artificial Sequence
  chemically synthesized
ttctttttgtttaaagggtcga

SEQ ID NO: 737945 - DNA, 22 bp, Artificial Sequence
  chemically synthesized
ttcatttatgattcgacccttt

SEQ ID NO: 737946 - DNA, 22 bp, Artificial Sequence
  chemically synthesized
tttttgtttaaagggtcgaatc

SEQ ID NO: 737947 - DNA, 22 bp, Artificial Sequence
  chemically synthesized
ctattcatttatgattcgaccc

SEQ ID NO: 737948 - DNA, 22 bp, Artificial Sequence
  chemically synthesized
cctattcatttatgattcgacc

SEQ ID NO: 737949 - DNA, 22 bp, Artificial Sequence
  chemically synthesized
tttgtttaaagggtcgaatcat

SEQ ID NO: 737950 - DNA, 22 bp, Artificial Sequence
  chemically synthesized
ttgtttaaagggtcgaatcata

SEQ ID NO: 737951 - DNA, 22 bp, Artificial Sequence
  chemically synthesized
tgtttaaagggtcgaatcataa

SEQ ID NO: 737952 - DNA, 22 bp, Artificial Sequence
  chemically synthesized
gtttaaagggtcgaatcataaa

SEQ ID NO: 737953 - DNA, 22 bp, Artificial Sequence
  chemically synthesized
tttaaagggtcgaatcataaat

SEQ ID NO: 737954 - DNA, 22 bp, Artificial Sequence
  chemically synthesized
aaagggtcgaatcataaatgaa

SEQ ID NO: 737955 - DNA, 22 bp, Artificial Sequence
  chemically synthesized
aagggtcgaatcataaatgaat

SEQ ID NO: 737956 - DNA, 22 bp, Artificial Sequence
  chemically synthesized
acatgacaacatttcctattca

SEQ ID NO: 737957 - DNA, 22 bp, Artificial Sequence
  chemically synthesized
aattgacatgacaacatttcct

SEQ ID NO: 737958 - DNA, 22 bp, Artificial Sequence
  chemically synthesized
ataaaaagttgaattgacatga

SEQ ID NO: 737959 - DNA, 22 bp, Artificial Sequence
  chemically synthesized
tgataaaaagttgaattgacat

SEQ ID NO: 737960 - DNA, 22 bp, Artificial Sequence
  chemically synthesized
ctctgataaaaagttgaattga

SEQ ID NO: 737961 - DNA, 22 bp, Artificial Sequence
  chemically synthesized
tcatgtcaattcaactttttat

SEQ ID NO: 737962 - DNA, 22 bp, Artificial Sequence
  chemically synthesized
tgcagtaccactcctctgataa

SEQ ID NO: 737963 - DNA, 22 bp, Artificial Sequence
  chemically synthesized
actatgcagtaccactcctctg

SEQ ID NO: 737964 - DNA, 22 bp, Artificial Sequence
  chemically synthesized
aactttttatcagaggagtggt

SEQ ID NO: 737965 - DNA, 22 bp, Artificial Sequence
  chemically synthesized
ctaactatgcagtaccactcct

SEQ ID NO: 737966 - DNA, 22 bp, Artificial Sequence
  chemically synthesized
tttatcagaggagtggtactgc

SEQ ID NO: 737967 - DNA, 22 bp, Artificial Sequence
  chemically synthesized
ttatcagaggagtggtactgca

SEQ ID NO: 737968 - DNA, 22 bp, Artificial Sequence
  chemically synthesized
tatcagaggagtggtactgcat

SEQ ID NO: 737969 - DNA, 22 bp, Artificial Sequence
  chemically synthesized
atcagaggagtggtactgcata

SEQ ID NO: 737970 - DNA, 22 bp, Artificial Sequence
  chemically synthesized
tcagaggagtggtactgcatag

SEQ ID NO: 737971 - DNA, 22 bp, Artificial Sequence
  chemically synthesized
tcagaactcctaactatgcagt

SEQ ID NO: 737972 - DNA, 22 bp, Artificial Sequence
  chemically synthesized
gggaatctgtcagaactcctaa

SEQ ID NO: 737973 - DNA, 22 bp, Artificial Sequence
  chemically synthesized
cctggggaatctgtcagaactc

SEQ ID NO: 737974 - DNA, 22 bp, Artificial Sequence
  chemically synthesized
catagttaggagttctgacaga

SEQ ID NO: 737975 - DNA, 22 bp, Artificial Sequence
  chemically synthesized
ggagttctgacagattccccag

SEQ ID NO: 737976 - DNA, 22 bp, Artificial Sequence
  chemically synthesized
aacccagacagtctgcctgggg

SEQ ID NO: 737977 - DNA, 22 bp, Artificial Sequence
  chemically synthesized
gaacccagacagtctgcctggg

SEQ ID NO: 737978 - DNA, 22 bp, Artificial Sequence
  chemically synthesized
tgacagattccccaggcagact

SEQ ID NO: 737979 - DNA, 22 bp, Artificial Sequence
  chemically synthesized
acagattccccaggcagactgt

SEQ ID NO: 737980 - DNA, 22 bp, Artificial Sequence
  chemically synthesized
cccaggcagactgtctgggttc

SEQ ID NO: 737981 - DNA, 22 bp, Artificial Sequence
  chemically synthesized
tctgggttcaaatcctggctct

SEQ ID NO: 737982 - DNA, 22 bp, Artificial Sequence
  chemically synthesized
ggttcaaatcctggctctctca

SEQ ID NO: 737983 - DNA, 22 bp, Artificial Sequence
  chemically synthesized
aaatcctggctctctcacttac

SEQ ID NO: 737984 - DNA, 22 bp, Artificial Sequence
  chemically synthesized
tggtcatatatcaggtaagtga

SEQ ID NO: 737985 - DNA, 22 bp, Artificial Sequence
  chemically synthesized
cctgtggtcatatatcaggtaa

SEQ ID NO: 737986 - DNA, 22 bp, Artificial Sequence
  chemically synthesized
gcctgtggtcatatatcaggta

SEQ ID NO: 737987 - DNA, 22 bp, Artificial Sequence
  chemically synthesized
gctctctcacttacctgatata

SEQ ID NO: 737988 - DNA, 22 bp, Artificial Sequence
  chemically synthesized
tctcacttacctgatatatgac

SEQ ID NO: 737989 - DNA, 22 bp, Artificial Sequence
  chemically synthesized
tcacttacctgatatatgacca

SEQ ID NO: 737990 - DNA, 22 bp, Artificial Sequence
  chemically synthesized
agtgacttgcctgtggtcatat

SEQ ID NO: 737991 - DNA, 22 bp, Artificial Sequence
  chemically synthesized
acttacctgatatatgaccaca

SEQ ID NO: 737992 - DNA, 22 bp, Artificial Sequence
  chemically synthesized
acctgatatatgaccacaggca

SEQ ID NO: 737993 - DNA, 22 bp, Artificial Sequence
  chemically synthesized
cctgatatatgaccacaggcaa

SEQ ID NO: 737994 - DNA, 22 bp, Artificial Sequence
  chemically synthesized
atatatgaccacaggcaagtca

SEQ ID NO: 737995 - DNA, 22 bp, Artificial Sequence
  chemically synthesized
gaaaaatgaggagcccaagggt

SEQ ID NO: 737996 - DNA, 22 bp, Artificial Sequence
  chemically synthesized
caggttagaaaaatgaggagcc

SEQ ID NO: 737997 - DNA, 22 bp, Artificial Sequence
  chemically synthesized
acaggttagaaaaatgaggagc

SEQ ID NO: 737998 - DNA, 22 bp, Artificial Sequence
  chemically synthesized
tacaggttagaaaaatgaggag

SEQ ID NO: 737999 - DNA, 22 bp, Artificial Sequence
  chemically synthesized
aacccttgggctcctcattttt

SEQ ID NO: 738000 - DNA, 22 bp, Artificial Sequence
  chemically synthesized
acccttgggctcctcatttttc

SEQ ID NO: 738001 - DNA, 22 bp, Artificial Sequence
  chemically synthesized
attttacaggttagaaaaatga

SEQ ID NO: 738002 - DNA, 22 bp, Artificial Sequence
  chemically synthesized
gggctcctcatttttctaacct

SEQ ID NO: 738003 - DNA, 22 bp, Artificial Sequence
  chemically synthesized
acctcattttacaggttagaaa

SEQ ID NO: 738004 - DNA, 22 bp, Artificial Sequence
  chemically synthesized
ggctcctcatttttctaacctg

SEQ ID NO: 738005 - DNA, 22 bp, Artificial Sequence
  chemically synthesized
aacctcattttacaggttagaa

SEQ ID NO: 738006 - DNA, 22 bp, Artificial Sequence
  chemically synthesized
taacctcattttacaggttaga

SEQ ID NO: 738007 - DNA, 22 bp, Artificial Sequence
  chemically synthesized
ctcatttttctaacctgtaaaa

SEQ ID NO: 738008 - DNA, 22 bp, Artificial Sequence
  chemically synthesized
atttttctaacctgtaaaatga

SEQ ID NO: 738009 - DNA, 22 bp, Artificial Sequence
  chemically synthesized
ttctaacctgtaaaatgaggtt

SEQ ID NO: 738010 - DNA, 22 bp, Artificial Sequence
  chemically synthesized
tctaacctgtaaaatgaggtta

SEQ ID NO: 738011 - DNA, 22 bp, Artificial Sequence
  chemically synthesized
ctaacctgtaaaatgaggttaa

SEQ ID NO: 738012 - DNA, 22 bp, Artificial Sequence
  chemically synthesized
taacctgtaaaatgaggttaaa

SEQ ID NO: 738013 - DNA, 22 bp, Artificial Sequence
  chemically synthesized
acctgtaaaatgaggttaaaat

SEQ ID NO: 738014 - DNA, 22 bp, Artificial Sequence
  chemically synthesized
taaaatgaggttaaaattgtac

SEQ ID NO: 738015 - DNA, 22 bp, Artificial Sequence
  chemically synthesized
acgtaacccagtgagggaggta

SEQ ID NO: 738016 - DNA, 22 bp, Artificial Sequence
  chemically synthesized
aaattgtacctccctcactggg

SEQ ID NO: 738017 - DNA, 22 bp, Artificial Sequence
  chemically synthesized
agcctcacgtaacccagtgagg

SEQ ID NO: 738018 - DNA, 22 bp, Artificial Sequence
  chemically synthesized
aagcctcacgtaacccagtgag

SEQ ID NO: 738019 - DNA, 22 bp, Artificial Sequence
  chemically synthesized
taagcctcacgtaacccagtga

SEQ ID NO: 738020 - DNA, 22 bp, Artificial Sequence
  chemically synthesized
ttaagcctcacgtaacccagtg

SEQ ID NO: 738021 - DNA, 22 bp, Artificial Sequence
  chemically synthesized
tacctccctcactgggttacgt

SEQ ID NO: 738022 - DNA, 22 bp, Artificial Sequence
  chemically synthesized
atgcttttaagcctcacgtaac

SEQ ID NO: 738023 - DNA, 22 bp, Artificial Sequence
  chemically synthesized
cctcactgggttacgtgaggct

SEQ ID NO: 738024 - DNA, 22 bp, Artificial Sequence
  chemically synthesized
actgggttacgtgaggcttaaa

SEQ ID NO: 738025 - DNA, 22 bp, Artificial Sequence
  chemically synthesized
catgtgctaatgcttttaagcc

SEQ ID NO: 738026 - DNA, 22 bp, Artificial Sequence
  chemically synthesized
gcatgtgctaatgcttttaagc

SEQ ID NO: 738027 - DNA, 22 bp, Artificial Sequence
  chemically synthesized
ggttacgtgaggcttaaaagca

SEQ ID NO: 738028 - DNA, 22 bp, Artificial Sequence
  chemically synthesized
tgcatgtgctaatgcttttaag

SEQ ID NO: 738029 - DNA, 22 bp, Artificial Sequence
  chemically synthesized
ttgcatgtgctaatgcttttaa

SEQ ID NO: 738030 - DNA, 22 bp, Artificial Sequence
  chemically synthesized
cgtgaggcttaaaagcattagc

SEQ ID NO: 738031 - DNA, 22 bp, Artificial Sequence
  chemically synthesized
taagcacttttgcatgtgctaa

SEQ ID NO: 738032 - DNA, 22 bp, Artificial Sequence
  chemically synthesized
aaaagcattagcacatgcaaaa

SEQ ID NO: 738033 - DNA, 22 bp, Artificial Sequence
  chemically synthesized
aaagcattagcacatgcaaaag

SEQ ID NO: 738034 - DNA, 22 bp, Artificial Sequence
  chemically synthesized
acaattataagcacttttgcat

SEQ ID NO: 738035 - DNA, 22 bp, Artificial Sequence
  chemically synthesized
gcacatgcaaaagtgcttataa

SEQ ID NO: 738036 - DNA, 22 bp, Artificial Sequence
  chemically synthesized
tatgccattcacaattataagc

SEQ ID NO: 738037 - DNA, 22 bp, Artificial Sequence
  chemically synthesized
ctgtatgccattcacaattata

SEQ ID NO: 738038 - DNA, 22 bp, Artificial Sequence
  chemically synthesized
actgtatgccattcacaattat

SEQ ID NO: 738039 - DNA, 22 bp, Artificial Sequence
  chemically synthesized
gcacttactgtatgccattcac

SEQ ID NO: 738040 - DNA, 22 bp, Artificial Sequence
  chemically synthesized
cctagcacttactgtatgccat

SEQ ID NO: 738041 - DNA, 22 bp, Artificial Sequence
  chemically synthesized
acctagcacttactgtatgcca

SEQ ID NO: 738042 - DNA, 22 bp, Artificial Sequence
  chemically synthesized
ataattgtgaatggcatacagt

SEQ ID NO: 738043 - DNA, 22 bp, Artificial Sequence
  chemically synthesized
taattgtgaatggcatacagta

SEQ ID NO: 738044 - DNA, 22 bp, Artificial Sequence
  chemically synthesized
tgaatggcatacagtaagtgct

SEQ ID NO: 738045 - DNA, 22 bp, Artificial Sequence
  chemically synthesized
atagtgagaacttacctagcac

SEQ ID NO: 738046 - DNA, 22 bp, Artificial Sequence
  chemically synthesized
agattaatagtgagaacttacc

SEQ ID NO: 738047 - DNA, 22 bp, Artificial Sequence
  chemically synthesized
ctgagattaatagtgagaactt

SEQ ID NO: 738048 - DNA, 22 bp, Artificial Sequence
  chemically synthesized
actgagattaatagtgagaact

SEQ ID NO: 738049 - DNA, 22 bp, Artificial Sequence
  chemically synthesized
cgcttactgagattaatagtga

SEQ ID NO: 738050 - DNA, 22 bp, Artificial Sequence
  chemically synthesized
ggtaagttctcactattaatct

SEQ ID NO: 738051 - DNA, 22 bp, Artificial Sequence
  chemically synthesized
gtgagcattacgcttactgaga

SEQ ID NO: 738052 - DNA, 22 bp, Artificial Sequence
  chemically synthesized
agtgagcattacgcttactgag

SEQ ID NO: 738053 - DNA, 22 bp, Artificial Sequence
  chemically synthesized
tcactattaatctcagtaagcg

SEQ ID NO: 738054 - DNA, 22 bp, Artificial Sequence
  chemically synthesized
tagtgagcattacgcttactga

SEQ ID NO: 738055 - DNA, 22 bp, Artificial Sequence
  chemically synthesized
actattaatctcagtaagcgta

SEQ ID NO: 738056 - DNA, 22 bp, Artificial Sequence
  chemically synthesized
ttaatctcagtaagcgtaatgc

SEQ ID NO: 738057 - DNA, 22 bp, Artificial Sequence
  chemically synthesized
atctcagtaagcgtaatgctca

SEQ ID NO: 738058 - DNA, 22 bp, Artificial Sequence
  chemically synthesized
aaaataattttagtgagcatta

SEQ ID NO: 738059 - DNA, 22 bp, Artificial Sequence
  chemically synthesized
gaaaataattttagtgagcatt

SEQ ID NO: 738060 - DNA, 22 bp, Artificial Sequence
  chemically synthesized
agtaagcgtaatgctcactaaa

SEQ ID NO: 738061 - DNA, 22 bp, Artificial Sequence
  chemically synthesized
actaaaattattttcaaattta

SEQ ID NO: 738062 - DNA, 22 bp, Artificial Sequence
  chemically synthesized
aaattattttcaaatttatacc

SEQ ID NO: 738063 - DNA, 22 bp, Artificial Sequence
  chemically synthesized
ttttcaaatttataccatatga

SEQ ID NO: 738064 - DNA, 22 bp, Artificial Sequence
  chemically synthesized
tcaaatttataccatatgacta

SEQ ID NO: 738065 - DNA, 22 bp, Artificial Sequence
  chemically synthesized
agacaatcaatgtagtcatatg

SEQ ID NO: 738066 - DNA, 22 bp, Artificial Sequence
  chemically synthesized
caaatttataccatatgactac

SEQ ID NO: 738067 - DNA, 22 bp, Artificial Sequence
  chemically synthesized
aaatttataccatatgactaca

SEQ ID NO: 738068 - DNA, 22 bp, Artificial Sequence
  chemically synthesized
ttcagacaatcaatgtagtcat

SEQ ID NO: 738069 - DNA, 22 bp, Artificial Sequence
  chemically synthesized
attcagacaatcaatgtagtca

SEQ ID NO: 738070 - DNA, 22 bp, Artificial Sequence
  chemically synthesized
tattcagacaatcaatgtagtc

SEQ ID NO: 738071 - DNA, 22 bp, Artificial Sequence
  chemically synthesized
ataccatatgactacattgatt

SEQ ID NO: 738072 - DNA, 22 bp, Artificial Sequence
  chemically synthesized
ctttattcagacaatcaatgta

SEQ ID NO: 738073 - DNA, 22 bp, Artificial Sequence
  chemically synthesized
taccatatgactacattgattg

SEQ ID NO: 738074 - DNA, 22 bp, Artificial Sequence
  chemically synthesized
actttattcagacaatcaatgt

SEQ ID NO: 738075 - DNA, 22 bp, Artificial Sequence
  chemically synthesized
tactttattcagacaatcaatg

SEQ ID NO: 738076 - DNA, 22 bp, Artificial Sequence
  chemically synthesized
tacatagttttactttattcag

SEQ ID NO: 738077 - DNA, 22 bp, Artificial Sequence
  chemically synthesized
atacatagttttactttattca

SEQ ID NO: 738078 - DNA, 22 bp, Artificial Sequence
  chemically synthesized
cattgattgtctgaataaagta

SEQ ID NO: 738079 - DNA, 22 bp, Artificial Sequence
  chemically synthesized
tatacatagttttactttattc

SEQ ID NO: 738080 - DNA, 22 bp, Artificial Sequence
  chemically synthesized
attgtctgaataaagtaaaact

SEQ ID NO: 738081 - DNA, 22 bp, Artificial Sequence
  chemically synthesized
tctgaataaagtaaaactatgt

SEQ ID NO: 738082 - DNA, 22 bp, Artificial Sequence
  chemically synthesized
aataaagtaaaactatgtataa

SEQ ID NO: 738083 - DNA, 22 bp, Artificial Sequence
  chemically synthesized
tatcagaagtacagcctttata

SEQ ID NO: 738084 - DNA, 22 bp, Artificial Sequence
  chemically synthesized
atatcagaagtacagcctttat

SEQ ID NO: 738085 - DNA, 22 bp, Artificial Sequence
  chemically synthesized
ttatatcagaagtacagccttt

SEQ ID NO: 738086 - DNA, 22 bp, Artificial Sequence
  chemically synthesized
tgtataaaggctgtacttctga

SEQ ID NO: 738087 - DNA, 22 bp, Artificial Sequence
  chemically synthesized
gaagatgattcttatatcagaa

SEQ ID NO: 738088 - DNA, 22 bp, Artificial Sequence
  chemically synthesized
tacttctgatataagaatcatc

SEQ ID NO: 738089 - DNA, 22 bp, Artificial Sequence
  chemically synthesized
ctgatataagaatcatcttcta

SEQ ID NO: 738090 - DNA, 22 bp, Artificial Sequence
  chemically synthesized
tgatataagaatcatcttctaa

SEQ ID NO: 738091 - DNA, 22 bp, Artificial Sequence
  chemically synthesized
atataagaatcatcttctaatt

SEQ ID NO: 738092 - DNA, 22 bp, Artificial Sequence
  chemically synthesized
ctaatttattatatttccaccc

SEQ ID NO: 738093 - DNA, 22 bp, Artificial Sequence
  chemically synthesized
aaggagacgggagggtggaaat

SEQ ID NO: 738094 - DNA, 22 bp, Artificial Sequence
  chemically synthesized
taatttattatatttccaccct

SEQ ID NO: 738095 - DNA, 22 bp, Artificial Sequence
  chemically synthesized
atttattatatttccaccctcc

SEQ ID NO: 738096 - DNA, 22 bp, Artificial Sequence
  chemically synthesized
ctaaaggagacgggagggtgga

SEQ ID NO: 738097 - DNA, 22 bp, Artificial Sequence
  chemically synthesized
actaaaggagacgggagggtgg

SEQ ID NO: 738098 - DNA, 22 bp, Artificial Sequence
  chemically synthesized
attatatttccaccctcccgtc

SEQ ID NO: 738099 - DNA, 22 bp, Artificial Sequence
  chemically synthesized
ttatatttccaccctcccgtct

SEQ ID NO: 738100 - DNA, 22 bp, Artificial Sequence
  chemically synthesized
atttactaaaggagacgggagg

SEQ ID NO: 738101 - DNA, 22 bp, Artificial Sequence
  chemically synthesized
tatttccaccctcccgtctcct

SEQ ID NO: 738102 - DNA, 22 bp, Artificial Sequence
  chemically synthesized
attaatttactaaaggagacgg

SEQ ID NO: 738103 - DNA, 22 bp, Artificial Sequence
  chemically synthesized
ccaccctcccgtctcctttagt

SEQ ID NO: 738104 - DNA, 22 bp, Artificial Sequence
  chemically synthesized
caccctcccgtctcctttagta

SEQ ID NO: 738105 - DNA, 22 bp, Artificial Sequence
  chemically synthesized
atatattaattaatttactaaa

SEQ ID NO: 738106 - DNA, 22 bp, Artificial Sequence
  chemically synthesized
aatatattaattaatttactaa

SEQ ID NO: 738107 - DNA, 22 bp, Artificial Sequence
  chemically synthesized
ccgtctcctttagtaaattaat

SEQ ID NO: 738108 - DNA, 22 bp, Artificial Sequence
  chemically synthesized
ccttaatatattaattaattta

SEQ ID NO: 738109 - DNA, 22 bp, Artificial Sequence
  chemically synthesized
tcccttaatatattaattaatt

SEQ ID NO: 738110 - DNA, 22 bp, Artificial Sequence
  chemically synthesized
ctttagtaaattaattaatata

SEQ ID NO: 738111 - DNA, 22 bp, Artificial Sequence
  chemically synthesized
tcctctcccttaatatattaat

SEQ ID NO: 738112 - DNA, 22 bp, Artificial Sequence
  chemically synthesized
tagtaaattaattaatatatta

SEQ ID NO: 738113 - DNA, 22 bp, Artificial Sequence
  chemically synthesized
agtaaattaattaatatattaa

SEQ ID NO: 738114 - DNA, 22 bp, Artificial Sequence
  chemically synthesized
gtaaattaattaatatattaag

SEQ ID NO: 738115 - DNA, 22 bp, Artificial Sequence
  chemically synthesized
attaatatattaagggagagga

SEQ ID NO: 738116 - DNA, 22 bp, Artificial Sequence
  chemically synthesized
tgatataagttgtcctctccct

SEQ ID NO: 738117 - DNA, 22 bp, Artificial Sequence
  chemically synthesized
atatattaagggagaggacaac

SEQ ID NO: 738118 - DNA, 22 bp, Artificial Sequence
  chemically synthesized
agggagaggacaacttatatca

SEQ ID NO: 738119 - DNA, 22 bp, Artificial Sequence
  chemically synthesized
atataatgatcactgtgatata

SEQ ID NO: 738120 - DNA, 22 bp, Artificial Sequence
  chemically synthesized
aatataatgatcactgtgatat

SEQ ID NO: 738121 - DNA, 22 bp, Artificial Sequence
  chemically synthesized
taatgtccttaatataatgatc

SEQ ID NO: 738122 - DNA, 22 bp, Artificial Sequence
  chemically synthesized
atatcacagtgatcattatatt

SEQ ID NO: 738123 - DNA, 22 bp, Artificial Sequence
  chemically synthesized
tatcacagtgatcattatatta

SEQ ID NO: 738124 - DNA, 22 bp, Artificial Sequence
  chemically synthesized
taaatgctataatgtccttaat

SEQ ID NO: 738125 - DNA, 22 bp, Artificial Sequence
  chemically synthesized
ataaatgctataatgtccttaa

SEQ ID NO: 738126 - DNA, 22 bp, Artificial Sequence
  chemically synthesized
tataaatgctataatgtcctta

SEQ ID NO: 738127 - DNA, 22 bp, Artificial Sequence
  chemically synthesized
ttataaatgctataatgtcctt

SEQ ID NO: 738128 - DNA, 22 bp, Artificial Sequence
  chemically synthesized
tttttataaatgctataatgtc

SEQ ID NO: 738129 - DNA, 22 bp, Artificial Sequence
  chemically synthesized
atttttataaatgctataatgt

SEQ ID NO: 738130 - DNA, 22 bp, Artificial Sequence
  chemically synthesized
tatttttataaatgctataatg

SEQ ID NO: 738131 - DNA, 22 bp, Artificial Sequence
  chemically synthesized
tttatttttataaatgctataa

SEQ ID NO: 738132 - DNA, 22 bp, Artificial Sequence
  chemically synthesized
tattaaggacattatagcattt

SEQ ID NO: 738133 - DNA, 22 bp, Artificial Sequence
  chemically synthesized
ctttatttttataaatgctata

SEQ ID NO: 738134 - DNA, 22 bp, Artificial Sequence
  chemically synthesized
aggacattatagcatttataaa

SEQ ID NO: 738135 - DNA, 22 bp, Artificial Sequence
  chemically synthesized
tcataatacttctttattttta

SEQ ID NO: 738136 - DNA, 22 bp, Artificial Sequence
  chemically synthesized
atcataatacttctttattttt

SEQ ID NO: 738137 - DNA, 22 bp, Artificial Sequence
  chemically synthesized
tagcatttataaaaataaagaa

SEQ ID NO: 738138 - DNA, 22 bp, Artificial Sequence
  chemically synthesized
atacagtttatcataatacttc

SEQ ID NO: 738139 - DNA, 22 bp, Artificial Sequence
  chemically synthesized
ataaaaataaagaagtattatg

SEQ ID NO: 738140 - DNA, 22 bp, Artificial Sequence
  chemically synthesized
taaaaataaagaagtattatga

SEQ ID NO: 738141 - DNA, 22 bp, Artificial Sequence
  chemically synthesized
aaattcatacagtttatcataa

SEQ ID NO: 738142 - DNA, 22 bp, Artificial Sequence
  chemically synthesized
caaattcatacagtttatcata

SEQ ID NO: 738143 - DNA, 22 bp, Artificial Sequence
  chemically synthesized
tgataaactgtatgaatttgaa

SEQ ID NO: 738144 - DNA, 22 bp, Artificial Sequence
  chemically synthesized
tatgaatttgaaattcactttg

SEQ ID NO: 738145 - DNA, 22 bp, Artificial Sequence
  chemically synthesized
aaggtaaataccacaaagtgaa

SEQ ID NO: 738146 - DNA, 22 bp, Artificial Sequence
  chemically synthesized
aaaggtaaataccacaaagtga

SEQ ID NO: 738147 - DNA, 22 bp, Artificial Sequence
  chemically synthesized
taaaggtaaataccacaaagtg

SEQ ID NO: 738148 - DNA, 22 bp, Artificial Sequence
  chemically synthesized
ttaaaggtaaataccacaaagt

SEQ ID NO: 738149 - DNA, 22 bp, Artificial Sequence
  chemically synthesized
cttttaaaggtaaataccacaa

SEQ ID NO: 738150 - DNA, 22 bp, Artificial Sequence
  chemically synthesized
gaaattcactttgtggtattta

SEQ ID NO: 738151 - DNA, 22 bp, Artificial Sequence
  chemically synthesized
aaattcactttgtggtatttac

SEQ ID NO: 738152 - DNA, 22 bp, Artificial Sequence
  chemically synthesized
actttgtggtatttacctttaa

SEQ ID NO: 738153 - DNA, 22 bp, Artificial Sequence
  chemically synthesized
agaaatgctacttttaaaggta

SEQ ID NO: 738154 - DNA, 22 bp, Artificial Sequence
  chemically synthesized
tgtggtatttacctttaaaagt

SEQ ID NO: 738155 - DNA, 22 bp, Artificial Sequence
  chemically synthesized
gtggtatttacctttaaaagta

SEQ ID NO: 738156 - DNA, 22 bp, Artificial Sequence
  chemically synthesized
tggtatttacctttaaaagtag

SEQ ID NO: 738157 - DNA, 22 bp, Artificial Sequence
  chemically synthesized
acctttaaaagtagcatttctg

SEQ ID NO: 738158 - DNA, 22 bp, Artificial Sequence
  chemically synthesized
gcgtatgaaattcagaaatgct

SEQ ID NO: 738159 - DNA, 22 bp, Artificial Sequence
  chemically synthesized
cctttaaaagtagcatttctga

SEQ ID NO: 738160 - DNA, 22 bp, Artificial Sequence
  chemically synthesized
taaaagtagcatttctgaattt

SEQ ID NO: 738161 - DNA, 22 bp, Artificial Sequence
  chemically synthesized
aaaagtagcatttctgaatttc

SEQ ID NO: 738162 - DNA, 22 bp, Artificial Sequence
  chemically synthesized
aaagtagcatttctgaatttca

SEQ ID NO: 738163 - DNA, 22 bp, Artificial Sequence
  chemically synthesized
ctgaatttcatacgctagtttc

SEQ ID NO: 738164 - DNA, 22 bp, Artificial Sequence
  chemically synthesized
tgaatttcatacgctagtttcc

SEQ ID NO: 738165 - DNA, 22 bp, Artificial Sequence
  chemically synthesized
cataaaggggaatggaaactag

SEQ ID NO: 738166 - DNA, 22 bp, Artificial Sequence
  chemically synthesized
aatttcatacgctagtttccat

SEQ ID NO: 738167 - DNA, 22 bp, Artificial Sequence
  chemically synthesized
catacgctagtttccattcccc

SEQ ID NO: 738168 - DNA, 22 bp, Artificial Sequence
  chemically synthesized
atacgctagtttccattcccct

SEQ ID NO: 738169 - DNA, 22 bp, Artificial Sequence
  chemically synthesized
aagccaactccataaaggggaa

SEQ ID NO: 738170 - DNA, 22 bp, Artificial Sequence
  chemically synthesized
gtttccattcccctttatggag

SEQ ID NO: 738171 - DNA, 22 bp, Artificial Sequence
  chemically synthesized
cgtgttaaagccaactccataa

SEQ ID NO: 738172 - DNA, 22 bp, Artificial Sequence
  chemically synthesized
ccattcccctttatggagttgg

SEQ ID NO: 738173 - DNA, 22 bp, Artificial Sequence
  chemically synthesized
cattcccctttatggagttggc

SEQ ID NO: 738174 - DNA, 22 bp, Artificial Sequence
  chemically synthesized
ccctttatggagttggctttaa

SEQ ID NO: 738175 - DNA, 22 bp, Artificial Sequence
  chemically synthesized
tatggagttggctttaacacgc

SEQ ID NO: 738176 - DNA, 22 bp, Artificial Sequence
  chemically synthesized
atggagttggctttaacacgca

SEQ ID NO: 738177 - DNA, 22 bp, Artificial Sequence
  chemically synthesized
tggagttggctttaacacgcag

SEQ ID NO: 738178 - DNA, 22 bp, Artificial Sequence
  chemically synthesized
aggccacatgagaagctgcgtg

SEQ ID NO: 738179 - DNA, 22 bp, Artificial Sequence
  chemically synthesized
caggccacatgagaagctgcgt

SEQ ID NO: 738180 - DNA, 22 bp, Artificial Sequence
  chemically synthesized
tcaggccacatgagaagctgcg

SEQ ID NO: 738181 - DNA, 22 bp, Artificial Sequence
  chemically synthesized
gctttaacacgcagcttctcat

SEQ ID NO: 738182 - DNA, 22 bp, Artificial Sequence
  chemically synthesized
taacacgcagcttctcatgtgg

SEQ ID NO: 738183 - DNA, 22 bp, Artificial Sequence
  chemically synthesized
aacacgcagcttctcatgtggc

SEQ ID NO: 738184 - DNA, 22 bp, Artificial Sequence
  chemically synthesized
acacgcagcttctcatgtggcc

SEQ ID NO: 738185 - DNA, 22 bp, Artificial Sequence
  chemically synthesized
ctcatgtggcctgaaaggggat

SEQ ID NO: 738186 - DNA, 22 bp, Artificial Sequence
  chemically synthesized
tcatgtggcctgaaaggggatt

SEQ ID NO: 738187 - DNA, 22 bp, Artificial Sequence
  chemically synthesized
gaaagtagaaagaatccccttt

SEQ ID NO: 738188 - DNA, 22 bp, Artificial Sequence
  chemically synthesized
atgtggcctgaaaggggattct

SEQ ID NO: 738189 - DNA, 22 bp, Artificial Sequence
  chemically synthesized
tagaaagtagaaagaatcccct

SEQ ID NO: 738190 - DNA, 22 bp, Artificial Sequence
  chemically synthesized
ctctagaaagtagaaagaatcc

SEQ ID NO: 738191 - DNA, 22 bp, Artificial Sequence
  chemically synthesized
aaaggggattctttctactttc

SEQ ID NO: 738192 - DNA, 22 bp, Artificial Sequence
  chemically synthesized
acagcacattcctctagaaagt

SEQ ID NO: 738193 - DNA, 22 bp, Artificial Sequence
  chemically synthesized
cacagcacattcctctagaaag

SEQ ID NO: 738194 - DNA, 22 bp, Artificial Sequence
  chemically synthesized
cttcacagcacattcctctaga

SEQ ID NO: 738195 - DNA, 22 bp, Artificial Sequence
  chemically synthesized
tttctactttctagaggaatgt

SEQ ID NO: 738196 - DNA, 22 bp, Artificial Sequence
  chemically synthesized
ctccttcacagcacattcctct

SEQ ID NO: 738197 - DNA, 22 bp, Artificial Sequence
  chemically synthesized
tctactttctagaggaatgtgc

SEQ ID NO: 738198 - DNA, 22 bp, Artificial Sequence
  chemically synthesized
ctactttctagaggaatgtgct

SEQ ID NO: 738199 - DNA, 22 bp, Artificial Sequence
  chemically synthesized
tactttctagaggaatgtgctg

SEQ ID NO: 738200 - DNA, 22 bp, Artificial Sequence
  chemically synthesized
ctttctagaggaatgtgctgtg

SEQ ID NO: 738201 - DNA, 22 bp, Artificial Sequence
  chemically synthesized
ccgactcctccttcacagcaca

SEQ ID NO: 738202 - DNA, 22 bp, Artificial Sequence
  chemically synthesized
tctagaggaatgtgctgtgaag

SEQ ID NO: 738203 - DNA, 22 bp, Artificial Sequence
  chemically synthesized
ctagaggaatgtgctgtgaagg

SEQ ID NO: 738204 - DNA, 22 bp, Artificial Sequence
  chemically synthesized
tagaggaatgtgctgtgaagga

SEQ ID NO: 738205 - DNA, 22 bp, Artificial Sequence
  chemically synthesized
gaggaatgtgctgtgaaggagg

SEQ ID NO: 738206 - DNA, 22 bp, Artificial Sequence
  chemically synthesized
tgaaggaggagtcgggaatctt

SEQ ID NO: 738207 - DNA, 22 bp, Artificial Sequence
  chemically synthesized
acatggccgccagtaagattcc

SEQ ID NO: 738208 - DNA, 22 bp, Artificial Sequence
  chemically synthesized
tcacatggccgccagtaagatt

SEQ ID NO: 738209 - DNA, 22 bp, Artificial Sequence
  chemically synthesized
ttctcacatggccgccagtaag

SEQ ID NO: 738210 - DNA, 22 bp, Artificial Sequence
  chemically synthesized
ctgttctcacatggccgccagt

SEQ ID NO: 738211 - DNA, 22 bp, Artificial Sequence
  chemically synthesized
aaagagctgctgttctcacatg

SEQ ID NO: 738212 - DNA, 22 bp, Artificial Sequence
  chemically synthesized
actggcggccatgtgagaacag

SEQ ID NO: 738213 - DNA, 22 bp, Artificial Sequence
  chemically synthesized
ctggcggccatgtgagaacagc

SEQ ID NO: 738214 - DNA, 22 bp, Artificial Sequence
  chemically synthesized
gcggccatgtgagaacagcagc

SEQ ID NO: 738215 - DNA, 22 bp, Artificial Sequence
  chemically synthesized
catcatacccagcattcaaaga

SEQ ID NO: 738216 - DNA, 22 bp, Artificial Sequence
  chemically synthesized
ccatgctacatcatacccagca

SEQ ID NO: 738217 - DNA, 22 bp, Artificial Sequence
  chemically synthesized
tttgaatgctgggtatgatgta

SEQ ID NO: 738218 - DNA, 22 bp, Artificial Sequence
  chemically synthesized
acagttcccatgctacatcata

SEQ ID NO: 738219 - DNA, 22 bp, Artificial Sequence
  chemically synthesized
tgaatgctgggtatgatgtagc

SEQ ID NO: 738220 - DNA, 22 bp, Artificial Sequence
  chemically synthesized
gaatgctgggtatgatgtagca

SEQ ID NO: 738221 - DNA, 22 bp, Artificial Sequence
  chemically synthesized
aatgctgggtatgatgtagcat

SEQ ID NO: 738222 - DNA, 22 bp, Artificial Sequence
  chemically synthesized
ctcacagttcccatgctacatc

SEQ ID NO: 738223 - DNA, 22 bp, Artificial Sequence
  chemically synthesized
ggtatgatgtagcatgggaact

SEQ ID NO: 738224 - DNA, 22 bp, Artificial Sequence
  chemically synthesized
cgccagtagctgctcacagttc

SEQ ID NO: 738225 - DNA, 22 bp, Artificial Sequence
  chemically synthesized
catgtgaaacactccgccagta

SEQ ID NO: 738226 - DNA, 22 bp, Artificial Sequence
  chemically synthesized
tgagcagctactggcggagtgt

SEQ ID NO: 738227 - DNA, 22 bp, Artificial Sequence
  chemically synthesized
cgctgcatgtgaaacactccgc

SEQ ID NO: 738228 - DNA, 22 bp, Artificial Sequence
  chemically synthesized
ccccgctgcgctgcatgtgaaa

SEQ ID NO: 738229 - DNA, 22 bp, Artificial Sequence
  chemically synthesized
ctggcggagtgtttcacatgca

SEQ ID NO: 738230 - DNA, 22 bp, Artificial Sequence
  chemically synthesized
gcggagtgtttcacatgcagcg

SEQ ID NO: 738231 - DNA, 22 bp, Artificial Sequence
  chemically synthesized
ccactgccccgctgcgctgcat

SEQ ID NO: 738232 - DNA, 22 bp, Artificial Sequence
  chemically synthesized
cccactgccccgctgcgctgca

SEQ ID NO: 738233 - DNA, 22 bp, Artificial Sequence
  chemically synthesized
tcccactgccccgctgcgctgc

SEQ ID NO: 738234 - DNA, 22 bp, Artificial Sequence
  chemically synthesized
cctttcccactgccccgctgcg

SEQ ID NO: 738235 - DNA, 22 bp, Artificial Sequence
  chemically synthesized
cacatgcagcgcagcggggcag

SEQ ID NO: 738236 - DNA, 22 bp, Artificial Sequence
  chemically synthesized
acatgcagcgcagcggggcagt

SEQ ID NO: 738237 - DNA, 22 bp, Artificial Sequence
  chemically synthesized
attgcctttcccactgccccgc

SEQ ID NO: 738238 - DNA, 22 bp, Artificial Sequence
  chemically synthesized
cattgcctttcccactgccccg

SEQ ID NO: 738239 - DNA, 22 bp, Artificial Sequence
  chemically synthesized
ttcattgcctttcccactgccc

SEQ ID NO: 738240 - DNA, 22 bp, Artificial Sequence
  chemically synthesized
cttcattgcctttcccactgcc

SEQ ID NO: 738241 - DNA, 22 bp, Artificial Sequence
  chemically synthesized
tcttcattgcctttcccactgc

SEQ ID NO: 738242 - DNA, 22 bp, Artificial Sequence
  chemically synthesized
ttttcttcattgcctttcccac

SEQ ID NO: 738243 - DNA, 22 bp, Artificial Sequence
  chemically synthesized
gttgttttcttcattgcctttc

SEQ ID NO: 738244 - DNA, 22 bp, Artificial Sequence
  chemically synthesized
cactggttgttttcttcattgc

SEQ ID NO: 738245 - DNA, 22 bp, Artificial Sequence
  chemically synthesized
gcactggttgttttcttcattg

SEQ ID NO: 738246 - DNA, 22 bp, Artificial Sequence
  chemically synthesized
tttgcactggttgttttcttca

SEQ ID NO: 738247 - DNA, 22 bp, Artificial Sequence
  chemically synthesized
gtttgcactggttgttttcttc

SEQ ID NO: 738248 - DNA, 22 bp, Artificial Sequence
  chemically synthesized
catttgtttgcactggttgttt

SEQ ID NO: 738249 - DNA, 22 bp, Artificial Sequence
  chemically synthesized
tgcatttgtttgcactggttgt

SEQ ID NO: 738250 - DNA, 22 bp, Artificial Sequence
  chemically synthesized
ctgcatttgtttgcactggttg

SEQ ID NO: 738251 - DNA, 22 bp, Artificial Sequence
  chemically synthesized
ttctgcatttgtttgcactggt

SEQ ID NO: 738252 - DNA, 22 bp, Artificial Sequence
  chemically synthesized
cttctgcatttgtttgcactgg

SEQ ID NO: 738253 - DNA, 22 bp, Artificial Sequence
  chemically synthesized
tcttctgcatttgtttgcactg

SEQ ID NO: 738254 - DNA, 22 bp, Artificial Sequence
  chemically synthesized
accccgccccaccctttcttct

SEQ ID NO: 738255 - DNA, 22 bp, Artificial Sequence
  chemically synthesized
gaccccgccccaccctttcttc

SEQ ID NO: 738256 - DNA, 22 bp, Artificial Sequence
  chemically synthesized
gagtttgaccccgccccaccct

SEQ ID NO: 738257 - DNA, 22 bp, Artificial Sequence
  chemically synthesized
cctggagtttgaccccgcccca

SEQ ID NO: 738258 - DNA, 22 bp, Artificial Sequence
  chemically synthesized
ccctggagtttgaccccgcccc

SEQ ID NO: 738259 - DNA, 22 bp, Artificial Sequence
  chemically synthesized
cttccctggagtttgaccccgc

SEQ ID NO: 738260 - DNA, 22 bp, Artificial Sequence
  chemically synthesized
tccttccctggagtttgacccc

SEQ ID NO: 738261 - DNA, 22 bp, Artificial Sequence
  chemically synthesized
tctccttccctggagtttgacc

SEQ ID NO: 738262 - DNA, 22 bp, Artificial Sequence
  chemically synthesized
acctctctccttccctggagtt

SEQ ID NO: 738263 - DNA, 22 bp, Artificial Sequence
  chemically synthesized
ggctgacctctctccttccctg

SEQ ID NO: 738264 - DNA, 22 bp, Artificial Sequence
  chemically synthesized
tgggctgacctctctccttccc

SEQ ID NO: 738265 - DNA, 22 bp, Artificial Sequence
  chemically synthesized
tctgggctgacctctctccttc

SEQ ID NO: 738266 - DNA, 22 bp, Artificial Sequence
  chemically synthesized
tctctctgggctgacctctctc

SEQ ID NO: 738267 - DNA, 22 bp, Artificial Sequence
  chemically synthesized
gtctctctgggctgacctctct

SEQ ID NO: 738268 - DNA, 22 bp, Artificial Sequence
  chemically synthesized
ttgtctctctgggctgacctct

SEQ ID NO: 738269 - DNA, 22 bp, Artificial Sequence
  chemically synthesized
cagggaaggagagaggtcagcc

SEQ ID NO: 738270 - DNA, 22 bp, Artificial Sequence
  chemically synthesized
taagtgttcttgtctctctggg

SEQ ID NO: 738271 - DNA, 22 bp, Artificial Sequence
  chemically synthesized
gtaagtgttcttgtctctctgg

SEQ ID NO: 738272 - DNA, 22 bp, Artificial Sequence
  chemically synthesized
ttgtaagtgttcttgtctctct

SEQ ID NO: 738273 - DNA, 22 bp, Artificial Sequence
  chemically synthesized
ttcttgtaagtgttcttgtctc

SEQ ID NO: 738274 - DNA, 22 bp, Artificial Sequence
  chemically synthesized
gttcttgtaagtgttcttgtct

SEQ ID NO: 738275 - DNA, 22 bp, Artificial Sequence
  chemically synthesized
tgttcttgtaagtgttcttgtc

SEQ ID NO: 738276 - DNA, 22 bp, Artificial Sequence
  chemically synthesized
tttgttcttgtaagtgttcttg

SEQ ID NO: 738277 - DNA, 22 bp, Artificial Sequence
  chemically synthesized
ttctttgttcttgtaagtgttc

SEQ ID NO: 738278 - DNA, 22 bp, Artificial Sequence
  chemically synthesized
attctttgttcttgtaagtgtt

SEQ ID NO: 738279 - DNA, 22 bp, Artificial Sequence
  chemically synthesized
tattctttgttcttgtaagtgt

SEQ ID NO: 738280 - DNA, 22 bp, Artificial Sequence
  chemically synthesized
ctttattctttgttcttgtaag

SEQ ID NO: 738281 - DNA, 22 bp, Artificial Sequence
  chemically synthesized
actgctttattctttgttcttg

SEQ ID NO: 738282 - DNA, 22 bp, Artificial Sequence
  chemically synthesized
tcactgctttattctttgttct

SEQ ID NO: 738283 - DNA, 22 bp, Artificial Sequence
  chemically synthesized
ctcactgctttattctttgttc

SEQ ID NO: 738284 - DNA, 22 bp, Artificial Sequence
  chemically synthesized
caatttctcactgctttattct

SEQ ID NO: 738285 - DNA, 22 bp, Artificial Sequence
  chemically synthesized
acaagaacaaagaataaagcag

SEQ ID NO: 738286 - DNA, 22 bp, Artificial Sequence
  chemically synthesized
caagaacaaagaataaagcagt

SEQ ID NO: 738287 - DNA, 22 bp, Artificial Sequence
  chemically synthesized
tctccaatttctcactgcttta

SEQ ID NO: 738288 - DNA, 22 bp, Artificial Sequence
  chemically synthesized
gtctccaatttctcactgcttt

SEQ ID NO: 738289 - DNA, 22 bp, Artificial Sequence
  chemically synthesized
cccttgtctccaatttctcact

SEQ ID NO: 738290 - DNA, 22 bp, Artificial Sequence
  chemically synthesized
gcccttgtctccaatttctcac

SEQ ID NO: 738291 - DNA, 22 bp, Artificial Sequence
  chemically synthesized
acatttgcccttgtctccaatt

SEQ ID NO: 738292 - DNA, 22 bp, Artificial Sequence
  chemically synthesized
caactgacatttgcccttgtct

SEQ ID NO: 738293 - DNA, 22 bp, Artificial Sequence
  chemically synthesized
tgcaactgacatttgcccttgt

SEQ ID NO: 738294 - DNA, 22 bp, Artificial Sequence
  chemically synthesized
ttctgcaactgacatttgccct

SEQ ID NO: 738295 - DNA, 22 bp, Artificial Sequence
  chemically synthesized
attctgcaactgacatttgccc

SEQ ID NO: 738296 - DNA, 22 bp, Artificial Sequence
  chemically synthesized
ccttattctgcaactgacattt

SEQ ID NO: 738297 - DNA, 22 bp, Artificial Sequence
  chemically synthesized
gagacaagggcaaatgtcagtt

SEQ ID NO: 738298 - DNA, 22 bp, Artificial Sequence
  chemically synthesized
cccttattctgcaactgacatt

SEQ ID NO: 738299 - DNA, 22 bp, Artificial Sequence
  chemically synthesized
tcccttattctgcaactgacat

SEQ ID NO: 738300 - DNA, 22 bp, Artificial Sequence
  chemically synthesized
ttcccttattctgcaactgaca

SEQ ID NO: 738301 - DNA, 22 bp, Artificial Sequence
  chemically synthesized
tccttttcccttattctgcaac

SEQ ID NO: 738302 - DNA, 22 bp, Artificial Sequence
  chemically synthesized
gtccttttcccttattctgcaa

SEQ ID NO: 738303 - DNA, 22 bp, Artificial Sequence
  chemically synthesized
ttgtccttttcccttattctgc

SEQ ID NO: 738304 - DNA, 22 bp, Artificial Sequence
  chemically synthesized
cttgtccttttcccttattctg

SEQ ID NO: 738305 - DNA, 22 bp, Artificial Sequence
  chemically synthesized
tcttgtccttttcccttattct

SEQ ID NO: 738306 - DNA, 22 bp, Artificial Sequence
  chemically synthesized
cagaataagggaaaaggacaag

SEQ ID NO: 738307 - DNA, 22 bp, Artificial Sequence
  chemically synthesized
ccatgatggtcatgttttcttg

SEQ ID NO: 738308 - DNA, 22 bp, Artificial Sequence
  chemically synthesized
aaattgccatgatggtcatgtt

SEQ ID NO: 738309 - DNA, 22 bp, Artificial Sequence
  chemically synthesized
aaaattgccatgatggtcatgt

SEQ ID NO: 738310 - DNA, 22 bp, Artificial Sequence
  chemically synthesized
caggcatttaaaattgccatga

SEQ ID NO: 738311 - DNA, 22 bp, Artificial Sequence
  chemically synthesized
gaaacatgtatataattccagg

SEQ ID NO: 738312 - DNA, 22 bp, Artificial Sequence
  chemically synthesized
ctagaaacatgtatataattcc

SEQ ID NO: 738313 - DNA, 22 bp, Artificial Sequence
  chemically synthesized
actagaaacatgtatataattc

SEQ ID NO: 738314 - DNA, 22 bp, Artificial Sequence
  chemically synthesized
taaatgcctggaattatataca

SEQ ID NO: 738315 - DNA, 22 bp, Artificial Sequence
  chemically synthesized
aaatgcctggaattatatacat

SEQ ID NO: 738316 - DNA, 22 bp, Artificial Sequence
  chemically synthesized
cttactagaaacatgtatataa

SEQ ID NO: 738317 - DNA, 22 bp, Artificial Sequence
  chemically synthesized
aatgcctggaattatatacatg

SEQ ID NO: 738318 - DNA, 22 bp, Artificial Sequence
  chemically synthesized
gttccttactagaaacatgtat

SEQ ID NO: 738319 - DNA, 22 bp, Artificial Sequence
  chemically synthesized
tagttccttactagaaacatgt

SEQ ID NO: 738320 - DNA, 22 bp, Artificial Sequence
  chemically synthesized
gaattatatacatgtttctagt

SEQ ID NO: 738321 - DNA, 22 bp, Artificial Sequence
  chemically synthesized
agacctctagttccttactaga

SEQ ID NO: 738322 - DNA, 22 bp, Artificial Sequence
  chemically synthesized
tatacatgtttctagtaaggaa

SEQ ID NO: 738323 - DNA, 22 bp, Artificial Sequence
  chemically synthesized
ctgagacctctagttccttact

SEQ ID NO: 738324 - DNA, 22 bp, Artificial Sequence
  chemically synthesized
cctgagacctctagttccttac

SEQ ID NO: 738325 - DNA, 22 bp, Artificial Sequence
  chemically synthesized
gtttcctgagacctctagttcc

SEQ ID NO: 738326 - DNA, 22 bp, Artificial Sequence
  chemically synthesized
agtttcctgagacctctagttc

SEQ ID NO: 738327 - DNA, 22 bp, Artificial Sequence
  chemically synthesized
tagtttcctgagacctctagtt

SEQ ID NO: 738328 - DNA, 22 bp, Artificial Sequence
  chemically synthesized
ctagtaaggaactagaggtctc

SEQ ID NO: 738329 - DNA, 22 bp, Artificial Sequence
  chemically synthesized
ttttagtttcctgagacctcta

SEQ ID NO: 738330 - DNA, 22 bp, Artificial Sequence
  chemically synthesized
tagtaaggaactagaggtctca

SEQ ID NO: 738331 - DNA, 22 bp, Artificial Sequence
  chemically synthesized
attttagtttcctgagacctct

SEQ ID NO: 738332 - DNA, 22 bp, Artificial Sequence
  chemically synthesized
gtaaggaactagaggtctcagg

SEQ ID NO: 738333 - DNA, 22 bp, Artificial Sequence
  chemically synthesized
gaggtctcaggaaactaaaata

SEQ ID NO: 738334 - DNA, 22 bp, Artificial Sequence
  chemically synthesized
tgcatgcatgtatttattttag

SEQ ID NO: 738335 - DNA, 22 bp, Artificial Sequence
  chemically synthesized
atgcatgcatgtatttatttta

SEQ ID NO: 738336 - DNA, 22 bp, Artificial Sequence
  chemically synthesized
aggaaactaaaataaatacatg

SEQ ID NO: 738337 - DNA, 22 bp, Artificial Sequence
  chemically synthesized
aaataaatacatgcatgcataa

SEQ ID NO: 738338 - DNA, 22 bp, Artificial Sequence
  chemically synthesized
aatagcaaaatgtatttatgca

SEQ ID NO: 738339 - DNA, 22 bp, Artificial Sequence
  chemically synthesized
aaatagcaaaatgtatttatgc

SEQ ID NO: 738340 - DNA, 22 bp, Artificial Sequence
  chemically synthesized
gtaaatgtgtttaaatagcaaa

SEQ ID NO: 738341 - DNA, 22 bp, Artificial Sequence
  chemically synthesized
ctagtaaatgtgtttaaatagc

SEQ ID NO: 738342 - DNA, 22 bp, Artificial Sequence
  chemically synthesized
tgctatttaaacacatttacta

SEQ ID NO: 738343 - DNA, 22 bp, Artificial Sequence
  chemically synthesized
gctatttaaacacatttactag

SEQ ID NO: 738344 - DNA, 22 bp, Artificial Sequence
  chemically synthesized
ctatttaaacacatttactagg

SEQ ID NO: 738345 - DNA, 22 bp, Artificial Sequence
  chemically synthesized
tttaaacacatttactaggaac

SEQ ID NO: 738346 - DNA, 22 bp, Artificial Sequence
  chemically synthesized
aaaatggaatgtgttcctagta

SEQ ID NO: 738347 - DNA, 22 bp, Artificial Sequence
  chemically synthesized
aaaaatggaatgtgttcctagt

SEQ ID NO: 738348 - DNA, 22 bp, Artificial Sequence
  chemically synthesized
taaaaatggaatgtgttcctag

SEQ ID NO: 738349 - DNA, 22 bp, Artificial Sequence
  chemically synthesized
aaacacatttactaggaacaca

SEQ ID NO: 738350 - DNA, 22 bp, Artificial Sequence
  chemically synthesized
ttaaaaatggaatgtgttccta

SEQ ID NO: 738351 - DNA, 22 bp, Artificial Sequence
  chemically synthesized
aacacatttactaggaacacat

SEQ ID NO: 738352 - DNA, 22 bp, Artificial Sequence
  chemically synthesized
tttttaaaaatggaatgtgttc

SEQ ID NO: 738353 - DNA, 22 bp, Artificial Sequence
  chemically synthesized
ttgtttttaaaaatggaatgtg

SEQ ID NO: 738354 - DNA, 22 bp, Artificial Sequence
  chemically synthesized
ttattgtttttaaaaatggaat

SEQ ID NO: 738355 - DNA, 22 bp, Artificial Sequence
  chemically synthesized
actaggaacacattccattttt

SEQ ID NO: 738356 - DNA, 22 bp, Artificial Sequence
  chemically synthesized
attattgtttttaaaaatggaa

SEQ ID NO: 738357 - DNA, 22 bp, Artificial Sequence
  chemically synthesized
ctaggaacacattccattttta

SEQ ID NO: 738358 - DNA, 22 bp, Artificial Sequence
  chemically synthesized
ggaacacattccatttttaaaa

SEQ ID NO: 738359 - DNA, 22 bp, Artificial Sequence
  chemically synthesized
catttttaaaaacaataataaa

SEQ ID NO: 738360 - DNA, 22 bp, Artificial Sequence
  chemically synthesized
ttaaaaacaataataaacacac

SEQ ID NO: 738361 - DNA, 22 bp, Artificial Sequence
  chemically synthesized
taaaaacaataataaacacact

SEQ ID NO: 738362 - DNA, 22 bp, Artificial Sequence
  chemically synthesized
aaaaacaataataaacacactt

SEQ ID NO: 738363 - DNA, 22 bp, Artificial Sequence
  chemically synthesized
aaaacaataataaacacactta

SEQ ID NO: 738364 - DNA, 22 bp, Artificial Sequence
  chemically synthesized
tggtaatccatgtaagtgtgtt

SEQ ID NO: 738365 - DNA, 22 bp, Artificial Sequence
  chemically synthesized
ttatggtaatccatgtaagtgt

SEQ ID NO: 738366 - DNA, 22 bp, Artificial Sequence
  chemically synthesized
gctattatggtaatccatgtaa

SEQ ID NO: 738367 - DNA, 22 bp, Artificial Sequence
  chemically synthesized
aggctagctattatggtaatcc

SEQ ID NO: 738368 - DNA, 22 bp, Artificial Sequence
  chemically synthesized
taaggctagctattatggtaat

SEQ ID NO: 738369 - DNA, 22 bp, Artificial Sequence
  chemically synthesized
gttctaaggctagctattatgg

SEQ ID NO: 738370 - DNA, 22 bp, Artificial Sequence
  chemically synthesized
acatggattaccataatagcta

SEQ ID NO: 738371 - DNA, 22 bp, Artificial Sequence
  chemically synthesized
catggattaccataatagctag

SEQ ID NO: 738372 - DNA, 22 bp, Artificial Sequence
  chemically synthesized
ctagttctaaggctagctatta

SEQ ID NO: 738373 - DNA, 22 bp, Artificial Sequence
  chemically synthesized
gctagttctaaggctagctatt

SEQ ID NO: 738374 - DNA, 22 bp, Artificial Sequence
  chemically synthesized
tgctagttctaaggctagctat

SEQ ID NO: 738375 - DNA, 22 bp, Artificial Sequence
  chemically synthesized
ttgctagttctaaggctagcta

SEQ ID NO: 738376 - DNA, 22 bp, Artificial Sequence
  chemically synthesized
tttttgctagttctaaggctag

SEQ ID NO: 738377 - DNA, 22 bp, Artificial Sequence
  chemically synthesized
ccataatagctagccttagaac

SEQ ID NO: 738378 - DNA, 22 bp, Artificial Sequence
  chemically synthesized
atcgggaactatttttgctagt

SEQ ID NO: 738379 - DNA, 22 bp, Artificial Sequence
  chemically synthesized
aatcgggaactatttttgctag

SEQ ID NO: 738380 - DNA, 22 bp, Artificial Sequence
  chemically synthesized
taatcgggaactatttttgcta

SEQ ID NO: 738381 - DNA, 22 bp, Artificial Sequence
  chemically synthesized
gccttagaactagcaaaaatag

SEQ ID NO: 738382 - DNA, 22 bp, Artificial Sequence
  chemically synthesized
ttttaatcgggaactatttttg

SEQ ID NO: 738383 - DNA, 22 bp, Artificial Sequence
  chemically synthesized
gttttaatcgggaactattttt

SEQ ID NO: 738384 - DNA, 22 bp, Artificial Sequence
  chemically synthesized
agaactagcaaaaatagttccc

SEQ ID NO: 738385 - DNA, 22 bp, Artificial Sequence
  chemically synthesized
gaactagcaaaaatagttcccg

SEQ ID NO: 738386 - DNA, 22 bp, Artificial Sequence
  chemically synthesized
atttgttttaatcgggaactat

SEQ ID NO: 738387 - DNA, 22 bp, Artificial Sequence
  chemically synthesized
taatttgttttaatcgggaact

SEQ ID NO: 738388 - DNA, 22 bp, Artificial Sequence
  chemically synthesized
ctaatttgttttaatcgggaac

SEQ ID NO: 738389 - DNA, 22 bp, Artificial Sequence
  chemically synthesized
gcaaaaatagttcccgattaaa

SEQ ID NO: 738390 - DNA, 22 bp, Artificial Sequence
  chemically synthesized
atttctaatttgttttaatcgg

SEQ ID NO: 738391 - DNA, 22 bp, Artificial Sequence
  chemically synthesized
tatactaatttctaatttgttt

SEQ ID NO: 738392 - DNA, 22 bp, Artificial Sequence
  chemically synthesized
atatactaatttctaatttgtt

SEQ ID NO: 738393 - DNA, 22 bp, Artificial Sequence
  chemically synthesized
tatatactaatttctaatttgt

SEQ ID NO: 738394 - DNA, 22 bp, Artificial Sequence
  chemically synthesized
ccgattaaaacaaattagaaat

SEQ ID NO: 738395 - DNA, 22 bp, Artificial Sequence
  chemically synthesized
atctttatatactaatttctaa

SEQ ID NO: 738396 - DNA, 22 bp, Artificial Sequence
  chemically synthesized
gatctttatatactaatttcta

SEQ ID NO: 738397 - DNA, 22 bp, Artificial Sequence
  chemically synthesized
cttgatctttatatactaattt

SEQ ID NO: 738398 - DNA, 22 bp, Artificial Sequence
  chemically synthesized
aaacaaattagaaattagtata

SEQ ID NO: 738399 - DNA, 22 bp, Artificial Sequence
  chemically synthesized
attgcttgatctttatatacta

SEQ ID NO: 738400 - DNA, 22 bp, Artificial Sequence
  chemically synthesized
gattgcttgatctttatatact

SEQ ID NO: 738401 - DNA, 22 bp, Artificial Sequence
  chemically synthesized
cttgattgcttgatctttatat

SEQ ID NO: 738402 - DNA, 22 bp, Artificial Sequence
  chemically synthesized
gaaattagtatataaagatcaa

SEQ ID NO: 738403 - DNA, 22 bp, Artificial Sequence
  chemically synthesized
ggctacttgattgcttgatctt

SEQ ID NO: 738404 - DNA, 22 bp, Artificial Sequence
  chemically synthesized
attaggctacttgattgcttga

SEQ ID NO: 738405 - DNA, 22 bp, Artificial Sequence
  chemically synthesized
gtatataaagatcaagcaatca

SEQ ID NO: 738406 - DNA, 22 bp, Artificial Sequence
  chemically synthesized
taaagtattaattaggctactt

SEQ ID NO: 738407 - DNA, 22 bp, Artificial Sequence
  chemically synthesized
taaagtgaacccaaatcattat

SEQ ID NO: 738408 - DNA, 22 bp, Artificial Sequence
  chemically synthesized
attaatactttataatgatttg

SEQ ID NO: 738409 - DNA, 22 bp, Artificial Sequence
  chemically synthesized
ataaagtgaacccaaatcatta

SEQ ID NO: 738410 - DNA, 22 bp, Artificial Sequence
  chemically synthesized
tataaagtgaacccaaatcatt

SEQ ID NO: 738411 - DNA, 22 bp, Artificial Sequence
  chemically synthesized
atactttataatgatttgggtt

SEQ ID NO: 738412 - DNA, 22 bp, Artificial Sequence
  chemically synthesized
agatattttataaagtgaaccc

SEQ ID NO: 738413 - DNA, 22 bp, Artificial Sequence
  chemically synthesized
tataatgatttgggttcacttt

SEQ ID NO: 738414 - DNA, 22 bp, Artificial Sequence
  chemically synthesized
cagatattttataaagtgaacc

SEQ ID NO: 738415 - DNA, 22 bp, Artificial Sequence
  chemically synthesized
ataatgatttgggttcacttta

SEQ ID NO: 738416 - DNA, 22 bp, Artificial Sequence
  chemically synthesized
tcagatattttataaagtgaac

SEQ ID NO: 738417 - DNA, 22 bp, Artificial Sequence
  chemically synthesized
taatgatttgggttcactttat

SEQ ID NO: 738418 - DNA, 22 bp, Artificial Sequence
  chemically synthesized
ttttcagatattttataaagtg

SEQ ID NO: 738419 - DNA, 22 bp, Artificial Sequence
  chemically synthesized
ttattttcagatattttataaa

SEQ ID NO: 738420 - DNA, 22 bp, Artificial Sequence
  chemically synthesized
gggttcactttataaaatatct

SEQ ID NO: 738421 - DNA, 22 bp, Artificial Sequence
  chemically synthesized
ggttcactttataaaatatctg

SEQ ID NO: 738422 - DNA, 22 bp, Artificial Sequence
  chemically synthesized
actttataaaatatctgaaaat

SEQ ID NO: 738423 - DNA, 22 bp, Artificial Sequence
  chemically synthesized
tataaaatatctgaaaataata

SEQ ID NO: 738424 - DNA, 22 bp, Artificial Sequence
  chemically synthesized
ataaaatatctgaaaataataa

SEQ ID NO: 738425 - DNA, 22 bp, Artificial Sequence
  chemically synthesized
taaaatatctgaaaataataat

SEQ ID NO: 738426 - DNA, 22 bp, Artificial Sequence
  chemically synthesized
agagaatgaaaagcatattatt

SEQ ID NO: 738427 - DNA, 22 bp, Artificial Sequence
  chemically synthesized
aagagaatgaaaagcatattat

SEQ ID NO: 738428 - DNA, 22 bp, Artificial Sequence
  chemically synthesized
aaaataataatatgcttttcat

SEQ ID NO: 738429 - DNA, 22 bp, Artificial Sequence
  chemically synthesized
tgaatttaagagaatgaaaagc

SEQ ID NO: 738430 - DNA, 22 bp, Artificial Sequence
  chemically synthesized
atgaatttaagagaatgaaaag

SEQ ID NO: 738431 - DNA, 22 bp, Artificial Sequence
  chemically synthesized
ttcattctcttaaattcataaa

SEQ ID NO: 738432 - DNA, 22 bp, Artificial Sequence
  chemically synthesized
tcattctcttaaattcataaat

SEQ ID NO: 738433 - DNA, 22 bp, Artificial Sequence
  chemically synthesized
cattctcttaaattcataaata

SEQ ID NO: 738434 - DNA, 22 bp, Artificial Sequence
  chemically synthesized
attctcttaaattcataaatat

SEQ ID NO: 738435 - DNA, 22 bp, Artificial Sequence
  chemically synthesized
tcttaaattcataaatatttct

SEQ ID NO: 738436 - DNA, 22 bp, Artificial Sequence
  chemically synthesized
ttaaattcataaatatttcttt

SEQ ID NO: 738437 - DNA, 22 bp, Artificial Sequence
  chemically synthesized
aaattcataaatatttctttgg

SEQ ID NO: 738438 - DNA, 22 bp, Artificial Sequence
  chemically synthesized
aattcataaatatttctttggc

SEQ ID NO: 738439 - DNA, 22 bp, Artificial Sequence
  chemically synthesized
ataaatatttctttggctcctg

SEQ ID NO: 738440 - DNA, 22 bp, Artificial Sequence
  chemically synthesized
ctttggctcctgatggcttcat

SEQ ID NO: 738441 - DNA, 22 bp, Artificial Sequence
  chemically synthesized
tttggctcctgatggcttcatt

SEQ ID NO: 738442 - DNA, 22 bp, Artificial Sequence
  chemically synthesized
tggctcctgatggcttcattcc

SEQ ID NO: 738443 - DNA, 22 bp, Artificial Sequence
  chemically synthesized
ggctcctgatggcttcattccc

SEQ ID NO: 738444 - DNA, 22 bp, Artificial Sequence
  chemically synthesized
gctcctgatggcttcattccca

SEQ ID NO: 738445 - DNA, 22 bp, Artificial Sequence
  chemically synthesized
tatgaagtataaaatgggaatg

SEQ ID NO: 738446 - DNA, 22 bp, Artificial Sequence
  chemically synthesized
ctgatggcttcattcccatttt

SEQ ID NO: 738447 - DNA, 22 bp, Artificial Sequence
  chemically synthesized
atggcttcattcccattttata

SEQ ID NO: 738448 - DNA, 22 bp, Artificial Sequence
  chemically synthesized
cattcccattttatacttcata

SEQ ID NO: 738449 - DNA, 22 bp, Artificial Sequence
  chemically synthesized
attcccattttatacttcatat

SEQ ID NO: 738450 - DNA, 22 bp, Artificial Sequence
  chemically synthesized
ccattttatacttcatataatt

SEQ ID NO: 738451 - DNA, 22 bp, Artificial Sequence
  chemically synthesized
tatacttcatataattttttca

SEQ ID NO: 738452 - DNA, 22 bp, Artificial Sequence
  chemically synthesized
atacttcatataattttttcat

SEQ ID NO: 738453 - DNA, 22 bp, Artificial Sequence
  chemically synthesized
tacttcatataattttttcatc

SEQ ID NO: 738454 - DNA, 22 bp, Artificial Sequence
  chemically synthesized
catataattttttcatcacatt

SEQ ID NO: 738455 - DNA, 22 bp, Artificial Sequence
  chemically synthesized
atataattttttcatcacattc

SEQ ID NO: 738456 - DNA, 22 bp, Artificial Sequence
  chemically synthesized
tttcatcacattctgtacatcg

SEQ ID NO: 738457 - DNA, 22 bp, Artificial Sequence
  chemically synthesized
ttcatcacattctgtacatcgt

SEQ ID NO: 738458 - DNA, 22 bp, Artificial Sequence
  chemically synthesized
tcatcacattctgtacatcgtt

SEQ ID NO: 738459 - DNA, 22 bp, Artificial Sequence
  chemically synthesized
catcacattctgtacatcgttc

SEQ ID NO: 738460 - DNA, 22 bp, Artificial Sequence
  chemically synthesized
atcacattctgtacatcgttca

SEQ ID NO: 738461 - DNA, 22 bp, Artificial Sequence
  chemically synthesized
cagggggataaatgaacgatgt

SEQ ID NO: 738462 - DNA, 22 bp, Artificial Sequence
  chemically synthesized
tgtacatcgttcatttatcccc

SEQ ID NO: 738463 - DNA, 22 bp, Artificial Sequence
  chemically synthesized
tacatcgttcatttatccccct

SEQ ID NO: 738464 - DNA, 22 bp, Artificial Sequence
  chemically synthesized
atttatccccctgtagtttcac

SEQ ID NO: 738465 - DNA, 22 bp, Artificial Sequence
  chemically synthesized
aaggcatcaggatgtgtgaaac

SEQ ID NO: 738466 - DNA, 22 bp, Artificial Sequence
  chemically synthesized
atccccctgtagtttcacacat

SEQ ID NO: 738467 - DNA, 22 bp, Artificial Sequence
  chemically synthesized
gaaggcatcaggatgtgtgaaa

SEQ ID NO: 738468 - DNA, 22 bp, Artificial Sequence
  chemically synthesized
tccccctgtagtttcacacatc

SEQ ID NO: 738469 - DNA, 22 bp, Artificial Sequence
  chemically synthesized
tgaaggcatcaggatgtgtgaa

SEQ ID NO: 738470 - DNA, 22 bp, Artificial Sequence
  chemically synthesized
ttgaaggcatcaggatgtgtga

SEQ ID NO: 738471 - DNA, 22 bp, Artificial Sequence
  chemically synthesized
tttgaaggcatcaggatgtgtg

SEQ ID NO: 738472 - DNA, 22 bp, Artificial Sequence
  chemically synthesized
ttttgaaggcatcaggatgtgt

SEQ ID NO: 738473 - DNA, 22 bp, Artificial Sequence
  chemically synthesized
tttttgaaggcatcaggatgtg

SEQ ID NO: 738474 - DNA, 22 bp, Artificial Sequence
  chemically synthesized
ttttttgaaggcatcaggatgt

SEQ ID NO: 738475 - DNA, 22 bp, Artificial Sequence
  chemically synthesized
tttttttgaaggcatcaggatg

SEQ ID NO: 738476 - DNA, 22 bp, Artificial Sequence
  chemically synthesized
ttttttttgaaggcatcaggat

SEQ ID NO: 738477 - DNA, 22 bp, Artificial Sequence
  chemically synthesized
tagtttcacacatcctgatgcc

SEQ ID NO: 738478 - DNA, 22 bp, Artificial Sequence
  chemically synthesized
tttttttttgaaggcatcagga

SEQ ID NO: 738479 - DNA, 22 bp, Artificial Sequence
  chemically synthesized
ttttttttttttgaaggcatca

SEQ ID NO: 738480 - DNA, 22 bp, Artificial Sequence
  chemically synthesized
tattttttttttttgaaggcat

SEQ ID NO: 738481 - DNA, 22 bp, Artificial Sequence
  chemically synthesized
cacacatcctgatgccttcaaa

SEQ ID NO: 738482 - DNA, 22 bp, Artificial Sequence
  chemically synthesized
acacatcctgatgccttcaaaa

SEQ ID NO: 738483 - DNA, 22 bp, Artificial Sequence
  chemically synthesized
tctattttttttttttgaaggc

SEQ ID NO: 738484 - DNA, 22 bp, Artificial Sequence
  chemically synthesized
atgccttcaaaaaaaaaaaata

SEQ ID NO: 738485 - DNA, 22 bp, Artificial Sequence
  chemically synthesized
aagggaattctctatttttttt

SEQ ID NO: 738486 - DNA, 22 bp, Artificial Sequence
  chemically synthesized
caagggaattctctattttttt

SEQ ID NO: 738487 - DNA, 22 bp, Artificial Sequence
  chemically synthesized
tcaagggaattctctatttttt

SEQ ID NO: 738488 - DNA, 22 bp, Artificial Sequence
  chemically synthesized
gttttcaagggaattctctatt

SEQ ID NO: 738489 - DNA, 22 bp, Artificial Sequence
  chemically synthesized
caaaaaaaaaaaatagagaatt

SEQ ID NO: 738490 - DNA, 22 bp, Artificial Sequence
  chemically synthesized
aaaaaaaaaaaatagagaattc

SEQ ID NO: 738491 - DNA, 22 bp, Artificial Sequence
  chemically synthesized
ggagaagaatggtctggttttc

SEQ ID NO: 738492 - DNA, 22 bp, Artificial Sequence
  chemically synthesized
accctaggagaagaatggtctg

SEQ ID NO: 738493 - DNA, 22 bp, Artificial Sequence
  chemically synthesized
ccttgaaaaccagaccattctt

SEQ ID NO: 738494 - DNA, 22 bp, Artificial Sequence
  chemically synthesized
tcaccctaggagaagaatggtc

SEQ ID NO: 738495 - DNA, 22 bp, Artificial Sequence
  chemically synthesized
ctcaccctaggagaagaatggt

SEQ ID NO: 738496 - DNA, 22 bp, Artificial Sequence
  chemically synthesized
tctcaccctaggagaagaatgg

SEQ ID NO: 738497 - DNA, 22 bp, Artificial Sequence
  chemically synthesized
gaaaaccagaccattcttctcc

SEQ ID NO: 738498 - DNA, 22 bp, Artificial Sequence
  chemically synthesized
aaaaccagaccattcttctcct

SEQ ID NO: 738499 - DNA, 22 bp, Artificial Sequence
  chemically synthesized
tctttctcaccctaggagaaga

SEQ ID NO: 738500 - DNA, 22 bp, Artificial Sequence
  chemically synthesized
cagagtctgtctttctcaccct

SEQ ID NO: 738501 - DNA, 22 bp, Artificial Sequence
  chemically synthesized
ttctcctagggtgagaaagaca

SEQ ID NO: 738502 - DNA, 22 bp, Artificial Sequence
  chemically synthesized
ctcctagggtgagaaagacaga

SEQ ID NO: 738503 - DNA, 22 bp, Artificial Sequence
  chemically synthesized
tcctagggtgagaaagacagac

SEQ ID NO: 738504 - DNA, 22 bp, Artificial Sequence
  chemically synthesized
ctagggtgagaaagacagactc

SEQ ID NO: 738505 - DNA, 22 bp, Artificial Sequence
  chemically synthesized
gggtgagaaagacagactctgg

SEQ ID NO: 738506 - DNA, 22 bp, Artificial Sequence
  chemically synthesized
atatggcccaaatattccagag

SEQ ID NO: 738507 - DNA, 22 bp, Artificial Sequence
  chemically synthesized
aaactaatatggcccaaatatt

SEQ ID NO: 738508 - DNA, 22 bp, Artificial Sequence
  chemically synthesized
gaaactaatatggcccaaatat

SEQ ID NO: 738509 - DNA, 22 bp, Artificial Sequence
  chemically synthesized
tggaatatttgggccatattag

SEQ ID NO: 738510 - DNA, 22 bp, Artificial Sequence
  chemically synthesized
gaatatttgggccatattagtt

SEQ ID NO: 738511 - DNA, 22 bp, Artificial Sequence
  chemically synthesized
aggtagccttgaaactaatatg

SEQ ID NO: 738512 - DNA, 22 bp, Artificial Sequence
  chemically synthesized
ctcaggtagccttgaaactaat

SEQ ID NO: 738513 - DNA, 22 bp, Artificial Sequence
  chemically synthesized
gggccatattagtttcaaggct

SEQ ID NO: 738514 - DNA, 22 bp, Artificial Sequence
  chemically synthesized
ggccatattagtttcaaggcta

SEQ ID NO: 738515 - DNA, 22 bp, Artificial Sequence
  chemically synthesized
tcgaaattgctcaggtagcctt

SEQ ID NO: 738516 - DNA, 22 bp, Artificial Sequence
  chemically synthesized
ttatcgaaattgctcaggtagc

SEQ ID NO: 738517 - DNA, 22 bp, Artificial Sequence
  chemically synthesized
gtttcaaggctacctgagcaat

SEQ ID NO: 738518 - DNA, 22 bp, Artificial Sequence
  chemically synthesized
caaggctacctgagcaatttcg

SEQ ID NO: 738519 - DNA, 22 bp, Artificial Sequence
  chemically synthesized
aaggctacctgagcaatttcga

SEQ ID NO: 738520 - DNA, 22 bp, Artificial Sequence
  chemically synthesized
gtcaagaggactgttatcgaaa

SEQ ID NO: 738521 - DNA, 22 bp, Artificial Sequence
  chemically synthesized
agtcaagaggactgttatcgaa

SEQ ID NO: 738522 - DNA, 22 bp, Artificial Sequence
  chemically synthesized
tagtcaagaggactgttatcga

SEQ ID NO: 738523 - DNA, 22 bp, Artificial Sequence
  chemically synthesized
cctgagcaatttcgataacagt

SEQ ID NO: 738524 - DNA, 22 bp, Artificial Sequence
  chemically synthesized
agcaatttcgataacagtcctc

SEQ ID NO: 738525 - DNA, 22 bp, Artificial Sequence
  chemically synthesized
tactttagtcaagaggactgtt

SEQ ID NO: 738526 - DNA, 22 bp, Artificial Sequence
  chemically synthesized
attgtactttagtcaagaggac

SEQ ID NO: 738527 - DNA, 22 bp, Artificial Sequence
  chemically synthesized
cgataacagtcctcttgactaa

SEQ ID NO: 738528 - DNA, 22 bp, Artificial Sequence
  chemically synthesized
gataacagtcctcttgactaaa

SEQ ID NO: 738529 - DNA, 22 bp, Artificial Sequence
  chemically synthesized
tacaactaattgtactttagtc

SEQ ID NO: 738530 - DNA, 22 bp, Artificial Sequence
  chemically synthesized
gtacaactaattgtactttagt

SEQ ID NO: 738531 - DNA, 22 bp, Artificial Sequence
  chemically synthesized
aatgtttgtacaactaattgta

SEQ ID NO: 738532 - DNA, 22 bp, Artificial Sequence
  chemically synthesized
caatgtttgtacaactaattgt

SEQ ID NO: 738533 - DNA, 22 bp, Artificial Sequence
  chemically synthesized
ttgactaaagtacaattagttg

SEQ ID NO: 738534 - DNA, 22 bp, Artificial Sequence
  chemically synthesized
tcaatgtttgtacaactaattg

SEQ ID NO: 738535 - DNA, 22 bp, Artificial Sequence
  chemically synthesized
gactaaagtacaattagttgta

SEQ ID NO: 738536 - DNA, 22 bp, Artificial Sequence
  chemically synthesized
actaaagtacaattagttgtac

SEQ ID NO: 738537 - DNA, 22 bp, Artificial Sequence
  chemically synthesized
gttttcaatgtttgtacaacta

SEQ ID NO: 738538 - DNA, 22 bp, Artificial Sequence
  chemically synthesized
ggttttcaatgtttgtacaact

SEQ ID NO: 738539 - DNA, 22 bp, Artificial Sequence
  chemically synthesized
aagtacaattagttgtacaaac

SEQ ID NO: 738540 - DNA, 22 bp, Artificial Sequence
  chemically synthesized
agaacatttggttttcaatgtt

SEQ ID NO: 738541 - DNA, 22 bp, Artificial Sequence
  chemically synthesized
aagaacatttggttttcaatgt

SEQ ID NO: 738542 - DNA, 22 bp, Artificial Sequence
  chemically synthesized
gttgtacaaacattgaaaacca

SEQ ID NO: 738543 - DNA, 22 bp, Artificial Sequence
  chemically synthesized
tacaaacattgaaaaccaaatg

SEQ ID NO: 738544 - DNA, 22 bp, Artificial Sequence
  chemically synthesized
tcaagcttaagaacatttggtt

SEQ ID NO: 738545 - DNA, 22 bp, Artificial Sequence
  chemically synthesized
aaaaccaaatgttcttaagctt

SEQ ID NO: 738546 - DNA, 22 bp, Artificial Sequence
  chemically synthesized
aggtcaaagcgtactgtcaagc

SEQ ID NO: 738547 - DNA, 22 bp, Artificial Sequence
  chemically synthesized
ttaagcttgacagtacgctttg

SEQ ID NO: 738548 - DNA, 22 bp, Artificial Sequence
  chemically synthesized
aagcttgacagtacgctttgac

SEQ ID NO: 738549 - DNA, 22 bp, Artificial Sequence
  chemically synthesized
gagcatactgaggtcaaagcgt

SEQ ID NO: 738550 - DNA, 22 bp, Artificial Sequence
  chemically synthesized
agcttgacagtacgctttgacc

SEQ ID NO: 738551 - DNA, 22 bp, Artificial Sequence
  chemically synthesized
agagcatactgaggtcaaagcg

SEQ ID NO: 738552 - DNA, 22 bp, Artificial Sequence
  chemically synthesized
gacagtacgctttgacctcagt

SEQ ID NO: 738553 - DNA, 22 bp, Artificial Sequence
  chemically synthesized
acagtacgctttgacctcagta

SEQ ID NO: 738554 - DNA, 22 bp, Artificial Sequence
  chemically synthesized
gtgaccacccttagagcatact

SEQ ID NO: 738555 - DNA, 22 bp, Artificial Sequence
  chemically synthesized
tgacctcagtatgctctaaggg

SEQ ID NO: 738556 - DNA, 22 bp, Artificial Sequence
  chemically synthesized
gacctcagtatgctctaagggt

SEQ ID NO: 738557 - DNA, 22 bp, Artificial Sequence
  chemically synthesized
acctcagtatgctctaagggtg

SEQ ID NO: 738558 - DNA, 22 bp, Artificial Sequence
  chemically synthesized
agtatgctctaagggtggtcac

SEQ ID NO: 738559 - DNA, 22 bp, Artificial Sequence
  chemically synthesized
aatgcccaggttagtgaccacc

SEQ ID NO: 738560 - DNA, 22 bp, Artificial Sequence
  chemically synthesized
aaatgcccaggttagtgaccac

SEQ ID NO: 738561 - DNA, 22 bp, Artificial Sequence
  chemically synthesized
taagggtggtcactaacctggg

SEQ ID NO: 738562 - DNA, 22 bp, Artificial Sequence
  chemically synthesized
agggtggtcactaacctgggca

SEQ ID NO: 738563 - DNA, 22 bp, Artificial Sequence
  chemically synthesized
aagaaggagagtataaatttaa

SEQ ID NO: 738564 - DNA, 22 bp, Artificial Sequence
  chemically synthesized
acctgggcatttaaatttatac

SEQ ID NO: 738565 - DNA, 22 bp, Artificial Sequence
  chemically synthesized
ggcatttaaatttatactctcc

SEQ ID NO: 738566 - DNA, 22 bp, Artificial Sequence
  chemically synthesized
aagaattgaagaaggagagtat

SEQ ID NO: 738567 - DNA, 22 bp, Artificial Sequence
  chemically synthesized
aaagaattgaagaaggagagta

SEQ ID NO: 738568 - DNA, 22 bp, Artificial Sequence
  chemically synthesized
taaagaattgaagaaggagagt

SEQ ID NO: 738569 - DNA, 22 bp, Artificial Sequence
  chemically synthesized
aaatttatactctccttcttca

SEQ ID NO: 738570 - DNA, 22 bp, Artificial Sequence
  chemically synthesized
aatttatactctccttcttcaa

SEQ ID NO: 738571 - DNA, 22 bp, Artificial Sequence
  chemically synthesized
atactctccttcttcaattctt

SEQ ID NO: 738572 - DNA, 22 bp, Artificial Sequence
  chemically synthesized
tactctccttcttcaattcttt

SEQ ID NO: 738573 - DNA, 22 bp, Artificial Sequence
  chemically synthesized
tccttcttcaattctttaaagg

SEQ ID NO: 738574 - DNA, 22 bp, Artificial Sequence
  chemically synthesized
cttcttcaattctttaaagggt

SEQ ID NO: 738575 - DNA, 22 bp, Artificial Sequence
  chemically synthesized
cttcaattctttaaagggtttt

SEQ ID NO: 738576 - DNA, 22 bp, Artificial Sequence
  chemically synthesized
ttcaattctttaaagggttttg

SEQ ID NO: 738577 - DNA, 22 bp, Artificial Sequence
  chemically synthesized
caattctttaaagggttttgtt

SEQ ID NO: 738578 - DNA, 22 bp, Artificial Sequence
  chemically synthesized
aattctttaaagggttttgttt

SEQ ID NO: 738579 - DNA, 22 bp, Artificial Sequence
  chemically synthesized
ggaaaaaaaggatgtaaacaaa

SEQ ID NO: 738580 - DNA, 22 bp, Artificial Sequence
  chemically synthesized
tttaaagggttttgtttacatc

SEQ ID NO: 738581 - DNA, 22 bp, Artificial Sequence
  chemically synthesized
ttaggaaaaaaaggatgtaaac

SEQ ID NO: 738582 - DNA, 22 bp, Artificial Sequence
  chemically synthesized
taaagggttttgtttacatcct

SEQ ID NO: 738583 - DNA, 22 bp, Artificial Sequence
  chemically synthesized
aaagggttttgtttacatcctt

SEQ ID NO: 738584 - DNA, 22 bp, Artificial Sequence
  chemically synthesized
tgttaggaaaaaaaggatgtaa

SEQ ID NO: 738585 - DNA, 22 bp, Artificial Sequence
  chemically synthesized
aagggttttgtttacatccttt

SEQ ID NO: 738586 - DNA, 22 bp, Artificial Sequence
  chemically synthesized
aactctgttaggaaaaaaagga

SEQ ID NO: 738587 - DNA, 22 bp, Artificial Sequence
  chemically synthesized
tgtttacatcctttttttccta

SEQ ID NO: 738588 - DNA, 22 bp, Artificial Sequence
  chemically synthesized
gtttacatcctttttttcctaa

SEQ ID NO: 738589 - DNA, 22 bp, Artificial Sequence
  chemically synthesized
acctcaactctgttaggaaaaa

SEQ ID NO: 738590 - DNA, 22 bp, Artificial Sequence
  chemically synthesized
tttacatcctttttttcctaac

SEQ ID NO: 738591 - DNA, 22 bp, Artificial Sequence
  chemically synthesized
aacctcaactctgttaggaaaa

SEQ ID NO: 738592 - DNA, 22 bp, Artificial Sequence
  chemically synthesized
acatcctttttttcctaacaga

SEQ ID NO: 738593 - DNA, 22 bp, Artificial Sequence
  chemically synthesized
catcctttttttcctaacagag

SEQ ID NO: 738594 - DNA, 22 bp, Artificial Sequence
  chemically synthesized
tgcttaacctcaactctgttag

SEQ ID NO: 738595 - DNA, 22 bp, Artificial Sequence
  chemically synthesized
atgcttaacctcaactctgtta

SEQ ID NO: 738596 - DNA, 22 bp, Artificial Sequence
  chemically synthesized
tttttcctaacagagttgaggt

SEQ ID NO: 738597 - DNA, 22 bp, Artificial Sequence
  chemically synthesized
ttttcctaacagagttgaggtt

SEQ ID NO: 738598 - DNA, 22 bp, Artificial Sequence
  chemically synthesized
tttcctaacagagttgaggtta

SEQ ID NO: 738599 - DNA, 22 bp, Artificial Sequence
  chemically synthesized
ttcctaacagagttgaggttaa

SEQ ID NO: 738600 - DNA, 22 bp, Artificial Sequence
  chemically synthesized
tcctaacagagttgaggttaag

SEQ ID NO: 738601 - DNA, 22 bp, Artificial Sequence
  chemically synthesized
cctaacagagttgaggttaagc

SEQ ID NO: 738602 - DNA, 22 bp, Artificial Sequence
  chemically synthesized
ctaacagagttgaggttaagca

SEQ ID NO: 738603 - DNA, 22 bp, Artificial Sequence
  chemically synthesized
acagagttgaggttaagcataa

SEQ ID NO: 738604 - DNA, 22 bp, Artificial Sequence
  chemically synthesized
agtaaggagagaataatcattt

SEQ ID NO: 738605 - DNA, 22 bp, Artificial Sequence
  chemically synthesized
aggttaagcataaatgattatt

SEQ ID NO: 738606 - DNA, 22 bp, Artificial Sequence
  chemically synthesized
cagtaaggagagaataatcatt

SEQ ID NO: 738607 - DNA, 22 bp, Artificial Sequence
  chemically synthesized
tcagtaaggagagaataatcat

SEQ ID NO: 738608 - DNA, 22 bp, Artificial Sequence
  chemically synthesized
ttcagtaaggagagaataatca

SEQ ID NO: 738609 - DNA, 22 bp, Artificial Sequence
  chemically synthesized
agcataaatgattattctctcc

SEQ ID NO: 738610 - DNA, 22 bp, Artificial Sequence
  chemically synthesized
caggaaaacatcttttcagtaa

SEQ ID NO: 738611 - DNA, 22 bp, Artificial Sequence
  chemically synthesized
ttctctccttactgaaaagatg

SEQ ID NO: 738612 - DNA, 22 bp, Artificial Sequence
  chemically synthesized
agttccaggaaaacatcttttc

SEQ ID NO: 738613 - DNA, 22 bp, Artificial Sequence
  chemically synthesized
tctccttactgaaaagatgttt

SEQ ID NO: 738614 - DNA, 22 bp, Artificial Sequence
  chemically synthesized
tccttactgaaaagatgttttc

SEQ ID NO: 738615 - DNA, 22 bp, Artificial Sequence
  chemically synthesized
cttactgaaaagatgttttcct

SEQ ID NO: 738616 - DNA, 22 bp, Artificial Sequence
  chemically synthesized
actgaaaagatgttttcctgga

SEQ ID NO: 738617 - DNA, 22 bp, Artificial Sequence
  chemically synthesized
ctgaaaagatgttttcctggaa

SEQ ID NO: 738618 - DNA, 22 bp, Artificial Sequence
  chemically synthesized
aaaagatgttttcctggaactt

SEQ ID NO: 738619 - DNA, 22 bp, Artificial Sequence
  chemically synthesized
tcctggaacttaattgtccttt

SEQ ID NO: 738620 - DNA, 22 bp, Artificial Sequence
  chemically synthesized
cctggaacttaattgtcctttt

SEQ ID NO: 738621 - DNA, 22 bp, Artificial Sequence
  chemically synthesized
ctggaacttaattgtccttttt

SEQ ID NO: 738622 - DNA, 22 bp, Artificial Sequence
  chemically synthesized
gaacttaattgtccttttttca

SEQ ID NO: 738623 - DNA, 22 bp, Artificial Sequence
  chemically synthesized
ggaatagaatgacccgtgaaaa

SEQ ID NO: 738624 - DNA, 22 bp, Artificial Sequence
  chemically synthesized
aattgtccttttttcacgggtc

SEQ ID NO: 738625 - DNA, 22 bp, Artificial Sequence
  chemically synthesized
attgtccttttttcacgggtca

SEQ ID NO: 738626 - DNA, 22 bp, Artificial Sequence
  chemically synthesized
atattaggaatagaatgacccg

SEQ ID NO: 738627 - DNA, 22 bp, Artificial Sequence
  chemically synthesized
tccttttttcacgggtcattct

SEQ ID NO: 738628 - DNA, 22 bp, Artificial Sequence
  chemically synthesized
ttgatattaggaatagaatgac

SEQ ID NO: 738629 - DNA, 22 bp, Artificial Sequence
  chemically synthesized
gttgatattaggaatagaatga

SEQ ID NO: 738630 - DNA, 22 bp, Artificial Sequence
  chemically synthesized
ttttcacgggtcattctattcc

SEQ ID NO: 738631 - DNA, 22 bp, Artificial Sequence
  chemically synthesized
tttcacgggtcattctattcct

SEQ ID NO: 738632 - DNA, 22 bp, Artificial Sequence
  chemically synthesized
ttcacgggtcattctattccta

SEQ ID NO: 738633 - DNA, 22 bp, Artificial Sequence
  chemically synthesized
tcacgggtcattctattcctaa

SEQ ID NO: 738634 - DNA, 22 bp, Artificial Sequence
  chemically synthesized
cacgggtcattctattcctaat

SEQ ID NO: 738635 - DNA, 22 bp, Artificial Sequence
  chemically synthesized
acgggtcattctattcctaata

SEQ ID NO: 738636 - DNA, 22 bp, Artificial Sequence
  chemically synthesized
ggtcacagaaggatttgttgat

SEQ ID NO: 738637 - DNA, 22 bp, Artificial Sequence
  chemically synthesized
tattcctaatatcaacaaatcc

SEQ ID NO: 738638 - DNA, 22 bp, Artificial Sequence
  chemically synthesized
ttcctaatatcaacaaatcctt

SEQ ID NO: 738639 - DNA, 22 bp, Artificial Sequence
  chemically synthesized
ctaatatcaacaaatccttctg

SEQ ID NO: 738640 - DNA, 22 bp, Artificial Sequence
  chemically synthesized
aaaaggttaggtcacagaagga

SEQ ID NO: 738641 - DNA, 22 bp, Artificial Sequence
  chemically synthesized
atatcaacaaatccttctgtga

SEQ ID NO: 738642 - DNA, 22 bp, Artificial Sequence
  chemically synthesized
gaaaaggttaggtcacagaagg

SEQ ID NO: 738643 - DNA, 22 bp, Artificial Sequence
  chemically synthesized
tgaaaaggttaggtcacagaag

SEQ ID NO: 738644 - DNA, 22 bp, Artificial Sequence
  chemically synthesized
ttgaaaaggttaggtcacagaa

SEQ ID NO: 738645 - DNA, 22 bp, Artificial Sequence
  chemically synthesized
tttttgaaaaggttaggtcaca

SEQ ID NO: 738646 - DNA, 22 bp, Artificial Sequence
  chemically synthesized
gtttttgaaaaggttaggtcac

SEQ ID NO: 738647 - DNA, 22 bp, Artificial Sequence
  chemically synthesized
ctgtgacctaaccttttcaaaa

SEQ ID NO: 738648 - DNA, 22 bp, Artificial Sequence
  chemically synthesized
tgtgacctaaccttttcaaaaa

SEQ ID NO: 738649 - DNA, 22 bp, Artificial Sequence
  chemically synthesized
tgacctaaccttttcaaaaaca

SEQ ID NO: 738650 - DNA, 22 bp, Artificial Sequence
  chemically synthesized
accttttcaaaaacaaacacat

SEQ ID NO: 738651 - DNA, 22 bp, Artificial Sequence
  chemically synthesized
ttcaaaaacaaacacatacttc

SEQ ID NO: 738652 - DNA, 22 bp, Artificial Sequence
  chemically synthesized
tcaaaaacaaacacatacttct

SEQ ID NO: 738653 - DNA, 22 bp, Artificial Sequence
  chemically synthesized
caaaaacaaacacatacttctt

SEQ ID NO: 738654 - DNA, 22 bp, Artificial Sequence
  chemically synthesized
aaaaacaaacacatacttcttt

SEQ ID NO: 738655 - DNA, 22 bp, Artificial Sequence
  chemically synthesized
aaagtaaaggaaataaaaaaaa

SEQ ID NO: 738656 - DNA, 22 bp, Artificial Sequence
  chemically synthesized
ctttcttttttttatttccttt

SEQ ID NO: 738657 - DNA, 22 bp, Artificial Sequence
  chemically synthesized
tttcttttttttatttccttta

SEQ ID NO: 738658 - DNA, 22 bp, Artificial Sequence
  chemically synthesized
taaaagctaaaagtaaaggaaa

SEQ ID NO: 738659 - DNA, 22 bp, Artificial Sequence
  chemically synthesized
tcttttttttatttcctttact

SEQ ID NO: 738660 - DNA, 22 bp, Artificial Sequence
  chemically synthesized
gtaaaagctaaaagtaaaggaa

SEQ ID NO: 738661 - DNA, 22 bp, Artificial Sequence
  chemically synthesized
cttttttttatttcctttactt

SEQ ID NO: 738662 - DNA, 22 bp, Artificial Sequence
  chemically synthesized
tgtaaaagctaaaagtaaagga

SEQ ID NO: 738663 - DNA, 22 bp, Artificial Sequence
  chemically synthesized
ttttttttatttcctttacttt

SEQ ID NO: 738664 - DNA, 22 bp, Artificial Sequence
  chemically synthesized
ttttttatttcctttactttta

SEQ ID NO: 738665 - DNA, 22 bp, Artificial Sequence
  chemically synthesized
tttttatttcctttacttttag

SEQ ID NO: 738666 - DNA, 22 bp, Artificial Sequence
  chemically synthesized
ttttatttcctttacttttagc

SEQ ID NO: 738667 - DNA, 22 bp, Artificial Sequence
  chemically synthesized
tttatttcctttacttttagct

SEQ ID NO: 738668 - DNA, 22 bp, Artificial Sequence
  chemically synthesized
ttatttcctttacttttagctt

SEQ ID NO: 738669 - DNA, 22 bp, Artificial Sequence
  chemically synthesized
tatttcctttacttttagcttt

SEQ ID NO: 738670 - DNA, 22 bp, Artificial Sequence
  chemically synthesized
atttcctttacttttagctttt

SEQ ID NO: 738671 - DNA, 22 bp, Artificial Sequence
  chemically synthesized
tttcctttacttttagctttta

SEQ ID NO: 738672 - DNA, 22 bp, Artificial Sequence
  chemically synthesized
gccagagttttgtaaaagctaa

SEQ ID NO: 738673 - DNA, 22 bp, Artificial Sequence
  chemically synthesized
cctttacttttagcttttacaa

SEQ ID NO: 738674 - DNA, 22 bp, Artificial Sequence
  chemically synthesized
ctttacttttagcttttacaaa

SEQ ID NO: 738675 - DNA, 22 bp, Artificial Sequence
  chemically synthesized
tacttttagcttttacaaaact

SEQ ID NO: 738676 - DNA, 22 bp, Artificial Sequence
  chemically synthesized
acttttagcttttacaaaactc

SEQ ID NO: 738677 - DNA, 22 bp, Artificial Sequence
  chemically synthesized
cttttagcttttacaaaactct

SEQ ID NO: 738678 - DNA, 22 bp, Artificial Sequence
  chemically synthesized
ttagcttttacaaaactctggc

SEQ ID NO: 738679 - DNA, 22 bp, Artificial Sequence
  chemically synthesized
atgtgcccactggccagagttt

SEQ ID NO: 738680 - DNA, 22 bp, Artificial Sequence
  chemically synthesized
tagcttttacaaaactctggcc

SEQ ID NO: 738681 - DNA, 22 bp, Artificial Sequence
  chemically synthesized
agcttttacaaaactctggcca

SEQ ID NO: 738682 - DNA, 22 bp, Artificial Sequence
  chemically synthesized
gcttttacaaaactctggccag

SEQ ID NO: 738683 - DNA, 22 bp, Artificial Sequence
  chemically synthesized
gtctgatgtgcccactggccag

SEQ ID NO: 738684 - DNA, 22 bp, Artificial Sequence
  chemically synthesized
ttacaaaactctggccagtggg

SEQ ID NO: 738685 - DNA, 22 bp, Artificial Sequence
  chemically synthesized
tacaaaactctggccagtgggc

SEQ ID NO: 738686 - DNA, 22 bp, Artificial Sequence
  chemically synthesized
acaaaactctggccagtgggca

SEQ ID NO: 738687 - DNA, 22 bp, Artificial Sequence
  chemically synthesized
caaaactctggccagtgggcac

SEQ ID NO: 738688 - DNA, 22 bp, Artificial Sequence
  chemically synthesized
taatatctagtctgatgtgccc

SEQ ID NO: 738689 - DNA, 22 bp, Artificial Sequence
  chemically synthesized
tggccagtgggcacatcagact

SEQ ID NO: 738690 - DNA, 22 bp, Artificial Sequence
  chemically synthesized
aactataatatctagtctgatg

SEQ ID NO: 738691 - DNA, 22 bp, Artificial Sequence
  chemically synthesized
gccagtgggcacatcagactag

SEQ ID NO: 738692 - DNA, 22 bp, Artificial Sequence
  chemically synthesized
caactataatatctagtctgat

SEQ ID NO: 738693 - DNA, 22 bp, Artificial Sequence
  chemically synthesized
tgtaaatatttcaactataata

SEQ ID NO: 738694 - DNA, 22 bp, Artificial Sequence
  chemically synthesized
atgtaaatatttcaactataat

SEQ ID NO: 738695 - DNA, 22 bp, Artificial Sequence
  chemically synthesized
ttatgtaaatatttcaactata

SEQ ID NO: 738696 - DNA, 22 bp, Artificial Sequence
  chemically synthesized
ctcttatgtaaatatttcaact

SEQ ID NO: 738697 - DNA, 22 bp, Artificial Sequence
  chemically synthesized
gatattatagttgaaatattta

SEQ ID NO: 738698 - DNA, 22 bp, Artificial Sequence
  chemically synthesized
taggttgctcttatgtaaatat

SEQ ID NO: 738699 - DNA, 22 bp, Artificial Sequence
  chemically synthesized
tagttgaaatatttacataaga

SEQ ID NO: 738700 - DNA, 22 bp, Artificial Sequence
  chemically synthesized
aactataggttgctcttatgta

SEQ ID NO: 738701 - DNA, 22 bp, Artificial Sequence
  chemically synthesized
taaactataggttgctcttatg

SEQ ID NO: 738702 - DNA, 22 bp, Artificial Sequence
  chemically synthesized
aaatatttacataagagcaacc

SEQ ID NO: 738703 - DNA, 22 bp, Artificial Sequence
  chemically synthesized
acatattctaaactataggttg

SEQ ID NO: 738704 - DNA, 22 bp, Artificial Sequence
  chemically synthesized
taacatattctaaactataggt

SEQ ID NO: 738705 - DNA, 22 bp, Artificial Sequence
  chemically synthesized
acataagagcaacctatagttt

SEQ ID NO: 738706 - DNA, 22 bp, Artificial Sequence
  chemically synthesized
cataagagcaacctatagttta

SEQ ID NO: 738707 - DNA, 22 bp, Artificial Sequence
  chemically synthesized
ctctaacatattctaaactata

SEQ ID NO: 738708 - DNA, 22 bp, Artificial Sequence
  chemically synthesized
tagtttagaatatgttagagca

SEQ ID NO: 738709 - DNA, 22 bp, Artificial Sequence
  chemically synthesized
agaatatgttagagcagttttt

SEQ ID NO: 738710 - DNA, 22 bp, Artificial Sequence
  chemically synthesized
gaatatgttagagcagtttttc

SEQ ID NO: 738711 - DNA, 22 bp, Artificial Sequence
  chemically synthesized
cagtaagatgtaggaaaaactg

SEQ ID NO: 738712 - DNA, 22 bp, Artificial Sequence
  chemically synthesized
gagcagtttttcctacatctta

SEQ ID NO: 738713 - DNA, 22 bp, Artificial Sequence
  chemically synthesized
ccaaaatactgcagtaagatgt

SEQ ID NO: 738714 - DNA, 22 bp, Artificial Sequence
  chemically synthesized
tcccaaaatactgcagtaagat

SEQ ID NO: 738715 - DNA, 22 bp, Artificial Sequence
  chemically synthesized
ttcctacatcttactgcagtat

SEQ ID NO: 738716 - DNA, 22 bp, Artificial Sequence
  chemically synthesized
tcctacatcttactgcagtatt

SEQ ID NO: 738717 - DNA, 22 bp, Artificial Sequence
  chemically synthesized
cctacatcttactgcagtattt

SEQ ID NO: 738718 - DNA, 22 bp, Artificial Sequence
  chemically synthesized
ctacatcttactgcagtatttt

SEQ ID NO: 738719 - DNA, 22 bp, Artificial Sequence
  chemically synthesized
catcttactgcagtattttggg

SEQ ID NO: 738720 - DNA, 22 bp, Artificial Sequence
  chemically synthesized
gaaagcacctctcccaaaatac

SEQ ID NO: 738721 - DNA, 22 bp, Artificial Sequence
  chemically synthesized
actgcagtattttgggagaggt

SEQ ID NO: 738722 - DNA, 22 bp, Artificial Sequence
  chemically synthesized
ctgcagtattttgggagaggtg

SEQ ID NO: 738723 - DNA, 22 bp, Artificial Sequence
  chemically synthesized
cagtattttgggagaggtgctt

SEQ ID NO: 738724 - DNA, 22 bp, Artificial Sequence
  chemically synthesized
aaacaaattagaaagcacctct

SEQ ID NO: 738725 - DNA, 22 bp, Artificial Sequence
  chemically synthesized
tgggagaggtgctttctaattt

SEQ ID NO: 738726 - DNA, 22 bp, Artificial Sequence
  chemically synthesized
gggagaggtgctttctaatttg

SEQ ID NO: 738727 - DNA, 22 bp, Artificial Sequence
  chemically synthesized
ggagaggtgctttctaatttgt

SEQ ID NO: 738728 - DNA, 22 bp, Artificial Sequence
  chemically synthesized
agaaatacacagggttaaaaca

SEQ ID NO: 738729 - DNA, 22 bp, Artificial Sequence
  chemically synthesized
ttgagaaatacacagggttaaa

SEQ ID NO: 738730 - DNA, 22 bp, Artificial Sequence
  chemically synthesized
tctaatttgttttaaccctgtg

SEQ ID NO: 738731 - DNA, 22 bp, Artificial Sequence
  chemically synthesized
ctaatttgttttaaccctgtgt

SEQ ID NO: 738732 - DNA, 22 bp, Artificial Sequence
  chemically synthesized
taatttgttttaaccctgtgta

SEQ ID NO: 738733 - DNA, 22 bp, Artificial Sequence
  chemically synthesized
atttgttttaaccctgtgtatt

SEQ ID NO: 738734 - DNA, 22 bp, Artificial Sequence
  chemically synthesized
gaatgttattgagaaatacaca

SEQ ID NO: 738735 - DNA, 22 bp, Artificial Sequence
  chemically synthesized
ggaatgttattgagaaatacac

SEQ ID NO: 738736 - DNA, 22 bp, Artificial Sequence
  chemically synthesized
gttttaaccctgtgtatttctc

SEQ ID NO: 738737 - DNA, 22 bp, Artificial Sequence
  chemically synthesized
tggaatgttattgagaaataca

SEQ ID NO: 738738 - DNA, 22 bp, Artificial Sequence
  chemically synthesized
ttttaaccctgtgtatttctca

SEQ ID NO: 738739 - DNA, 22 bp, Artificial Sequence
  chemically synthesized
ttggaatgttattgagaaatac

SEQ ID NO: 738740 - DNA, 22 bp, Artificial Sequence
  chemically synthesized
taaccctgtgtatttctcaata

SEQ ID NO: 738741 - DNA, 22 bp, Artificial Sequence
  chemically synthesized
aaccctgtgtatttctcaataa

SEQ ID NO: 738742 - DNA, 22 bp, Artificial Sequence
  chemically synthesized
accctgtgtatttctcaataac

SEQ ID NO: 738743 - DNA, 22 bp, Artificial Sequence
  chemically synthesized
cagtttttggaatgttattgag

SEQ ID NO: 738744 - DNA, 22 bp, Artificial Sequence
  chemically synthesized
tccagtttttggaatgttattg

SEQ ID NO: 738745 - DNA, 22 bp, Artificial Sequence
  chemically synthesized
tgtatttctcaataacattcca

SEQ ID NO: 738746 - DNA, 22 bp, Artificial Sequence
  chemically synthesized
ctcaataacattccaaaaactg

SEQ ID NO: 738747 - DNA, 22 bp, Artificial Sequence
  chemically synthesized
tcaataacattccaaaaactgg

SEQ ID NO: 738748 - DNA, 22 bp, Artificial Sequence
  chemically synthesized
tgtggcaattctccagtttttg

SEQ ID NO: 738749 - DNA, 22 bp, Artificial Sequence
  chemically synthesized
aataacattccaaaaactggag

SEQ ID NO: 738750 - DNA, 22 bp, Artificial Sequence
  chemically synthesized
ttatgtggcaattctccagttt

SEQ ID NO: 738751 - DNA, 22 bp, Artificial Sequence
  chemically synthesized
attatgtggcaattctccagtt

SEQ ID NO: 738752 - DNA, 22 bp, Artificial Sequence
  chemically synthesized
tattatgtggcaattctccagt

SEQ ID NO: 738753 - DNA, 22 bp, Artificial Sequence
  chemically synthesized
ttattatgtggcaattctccag

SEQ ID NO: 738754 - DNA, 22 bp, Artificial Sequence
  chemically synthesized
caaaaactggagaattgccaca

SEQ ID NO: 738755 - DNA, 22 bp, Artificial Sequence
  chemically synthesized
agtagtacttttattatgtggc

SEQ ID NO: 738756 - DNA, 22 bp, Artificial Sequence
  chemically synthesized
gagaattgccacataataaaag

SEQ ID NO: 738757 - DNA, 22 bp, Artificial Sequence
  chemically synthesized
gcagatactaagtagtactttt

SEQ ID NO: 738758 - DNA, 22 bp, Artificial Sequence
  chemically synthesized
ccacataataaaagtactactt

SEQ ID NO: 738759 - DNA, 22 bp, Artificial Sequence
  chemically synthesized
aattagcagatactaagtagta

SEQ ID NO: 738760 - DNA, 22 bp, Artificial Sequence
  chemically synthesized
tcaattagcagatactaagtag

SEQ ID NO: 738761 - DNA, 22 bp, Artificial Sequence
  chemically synthesized
ctcaattagcagatactaagta

SEQ ID NO: 738762 - DNA, 22 bp, Artificial Sequence
  chemically synthesized
tctcaattagcagatactaagt

SEQ ID NO: 738763 - DNA, 22 bp, Artificial Sequence
  chemically synthesized
ttctcaattagcagatactaag

SEQ ID NO: 738764 - DNA, 22 bp, Artificial Sequence
  chemically synthesized
atagccttttctcaattagcag

SEQ ID NO: 738765 - DNA, 22 bp, Artificial Sequence
  chemically synthesized
cttagtatctgctaattgagaa

SEQ ID NO: 738766 - DNA, 22 bp, Artificial Sequence
  chemically synthesized
agtatctgctaattgagaaaag

SEQ ID NO: 738767 - DNA, 22 bp, Artificial Sequence
  chemically synthesized
tcagctaatagccttttctcaa

SEQ ID NO: 738768 - DNA, 22 bp, Artificial Sequence
  chemically synthesized
gtatctgctaattgagaaaagg

SEQ ID NO: 738769 - DNA, 22 bp, Artificial Sequence
  chemically synthesized
atcagctaatagccttttctca

SEQ ID NO: 738770 - DNA, 22 bp, Artificial Sequence
  chemically synthesized
tatcagctaatagccttttctc

SEQ ID NO: 738771 - DNA, 22 bp, Artificial Sequence
  chemically synthesized
ttatcagctaatagccttttct

SEQ ID NO: 738772 - DNA, 22 bp, Artificial Sequence
  chemically synthesized
ctaattgagaaaaggctattag

SEQ ID NO: 738773 - DNA, 22 bp, Artificial Sequence
  chemically synthesized
attgagaaaaggctattagctg

SEQ ID NO: 738774 - DNA, 22 bp, Artificial Sequence
  chemically synthesized
agaaaaggctattagctgataa

SEQ ID NO: 738775 - DNA, 22 bp, Artificial Sequence
  chemically synthesized
caaagcatacaagtttttatca

SEQ ID NO: 738776 - DNA, 22 bp, Artificial Sequence
  chemically synthesized
tgttacaaagcatacaagtttt

SEQ ID NO: 738777 - DNA, 22 bp, Artificial Sequence
  chemically synthesized
ttagctgataaaaacttgtatg

SEQ ID NO: 738778 - DNA, 22 bp, Artificial Sequence
  chemically synthesized
gctgataaaaacttgtatgctt

SEQ ID NO: 738779 - DNA, 22 bp, Artificial Sequence
  chemically synthesized
ataaaaacttgtatgctttgta

SEQ ID NO: 738780 - DNA, 22 bp, Artificial Sequence
  chemically synthesized
taagtaaagcagttgtgttaca

SEQ ID NO: 738781 - DNA, 22 bp, Artificial Sequence
  chemically synthesized
gtaagtaaagcagttgtgttac

SEQ ID NO: 738782 - DNA, 22 bp, Artificial Sequence
  chemically synthesized
tgtaagtaaagcagttgtgtta

SEQ ID NO: 738783 - DNA, 22 bp, Artificial Sequence
  chemically synthesized
ttgtaagtaaagcagttgtgtt

SEQ ID NO: 738784 - DNA, 22 bp, Artificial Sequence
  chemically synthesized
gtatgctttgtaacacaactgc

SEQ ID NO: 738785 - DNA, 22 bp, Artificial Sequence
  chemically synthesized
tatgctttgtaacacaactgct

SEQ ID NO: 738786 - DNA, 22 bp, Artificial Sequence
  chemically synthesized
gtttttgtaagtaaagcagttg

SEQ ID NO: 738787 - DNA, 22 bp, Artificial Sequence
  chemically synthesized
tgtaacacaactgctttactta

SEQ ID NO: 738788 - DNA, 22 bp, Artificial Sequence
  chemically synthesized
gtaacacaactgctttacttac

SEQ ID NO: 738789 - DNA, 22 bp, Artificial Sequence
  chemically synthesized
taacacaactgctttacttaca

SEQ ID NO: 738790 - DNA, 22 bp, Artificial Sequence
  chemically synthesized
cccatataccactggtttttgt

SEQ ID NO: 738791 - DNA, 22 bp, Artificial Sequence
  chemically synthesized
ctttacttacaaaaaccagtgg

SEQ ID NO: 738792 - DNA, 22 bp, Artificial Sequence
  chemically synthesized
tgttgcccatataccactggtt

SEQ ID NO: 738793 - DNA, 22 bp, Artificial Sequence
  chemically synthesized
tacttacaaaaaccagtggtat

SEQ ID NO: 738794 - DNA, 22 bp, Artificial Sequence
  chemically synthesized
acttacaaaaaccagtggtata

SEQ ID NO: 738795 - DNA, 22 bp, Artificial Sequence
  chemically synthesized
cttacaaaaaccagtggtatat

SEQ ID NO: 738796 - DNA, 22 bp, Artificial Sequence
  chemically synthesized
acaaaaaccagtggtatatggg

SEQ ID NO: 738797 - DNA, 22 bp, Artificial Sequence
  chemically synthesized
caaaaaccagtggtatatgggc

SEQ ID NO: 738798 - DNA, 22 bp, Artificial Sequence
  chemically synthesized
aatacaaaattatgttgcccat

SEQ ID NO: 738799 - DNA, 22 bp, Artificial Sequence
  chemically synthesized
gaatacaaaattatgttgccca

SEQ ID NO: 738800 - DNA, 22 bp, Artificial Sequence
  chemically synthesized
tagcttgaatacaaaattatgt

SEQ ID NO: 738801 - DNA, 22 bp, Artificial Sequence
  chemically synthesized
tctgtagcttgaatacaaaatt

SEQ ID NO: 738802 - DNA, 22 bp, Artificial Sequence
  chemically synthesized
catcaagcattgtctgtagctt

SEQ ID NO: 738803 - DNA, 22 bp, Artificial Sequence
  chemically synthesized
gcatcaagcattgtctgtagct

SEQ ID NO: 738804 - DNA, 22 bp, Artificial Sequence
  chemically synthesized
tgcatcaagcattgtctgtagc

SEQ ID NO: 738805 - DNA, 22 bp, Artificial Sequence
  chemically synthesized
ttgcatcaagcattgtctgtag

SEQ ID NO: 738806 - DNA, 22 bp, Artificial Sequence
  chemically synthesized
tgtattcaagctacagacaatg

SEQ ID NO: 738807 - DNA, 22 bp, Artificial Sequence
  chemically synthesized
gtattcaagctacagacaatgc

SEQ ID NO: 738808 - DNA, 22 bp, Artificial Sequence
  chemically synthesized
tattcaagctacagacaatgct

SEQ ID NO: 738809 - DNA, 22 bp, Artificial Sequence
  chemically synthesized
aagctacagacaatgcttgatg

SEQ ID NO: 738810 - DNA, 22 bp, Artificial Sequence
  chemically synthesized
cagacaatgcttgatgcaaaaa

SEQ ID NO: 738811 - DNA, 22 bp, Artificial Sequence
  chemically synthesized
cagagaggtgcaaaaatatatt

SEQ ID NO: 738812 - DNA, 22 bp, Artificial Sequence
  chemically synthesized
acagagaggtgcaaaaatatat

SEQ ID NO: 738813 - DNA, 22 bp, Artificial Sequence
  chemically synthesized
tacagagaggtgcaaaaatata

SEQ ID NO: 738814 - DNA, 22 bp, Artificial Sequence
  chemically synthesized
gatgcaaaaatatatttttgca

SEQ ID NO: 738815 - DNA, 22 bp, Artificial Sequence
  chemically synthesized
atgcaaaaatatatttttgcac

SEQ ID NO: 738816 - DNA, 22 bp, Artificial Sequence
  chemically synthesized
cagatgatagagttttacagag

SEQ ID NO: 738817 - DNA, 22 bp, Artificial Sequence
  chemically synthesized
ttgcacctctctgtaaaactct

SEQ ID NO: 738818 - DNA, 22 bp, Artificial Sequence
  chemically synthesized
tgcacctctctgtaaaactcta

SEQ ID NO: 738819 - DNA, 22 bp, Artificial Sequence
  chemically synthesized
gcacctctctgtaaaactctat

SEQ ID NO: 738820 - DNA, 22 bp, Artificial Sequence
  chemically synthesized
cacctctctgtaaaactctatc

SEQ ID NO: 738821 - DNA, 22 bp, Artificial Sequence
  chemically synthesized
ccaaactacagatgatagagtt

SEQ ID NO: 738822 - DNA, 22 bp, Artificial Sequence
  chemically synthesized
attcccaaactacagatgatag

SEQ ID NO: 738823 - DNA, 22 bp, Artificial Sequence
  chemically synthesized
tctgtaaaactctatcatctgt

SEQ ID NO: 738824 - DNA, 22 bp, Artificial Sequence
  chemically synthesized
tgtaaaactctatcatctgtag

SEQ ID NO: 738825 - DNA, 22 bp, Artificial Sequence
  chemically synthesized
taaaactctatcatctgtagtt

SEQ ID NO: 738826 - DNA, 22 bp, Artificial Sequence
  chemically synthesized
tatcatctgtagtttgggaatg

SEQ ID NO: 738827 - DNA, 22 bp, Artificial Sequence
  chemically synthesized
tcatctgtagtttgggaatgaa

SEQ ID NO: 738828 - DNA, 22 bp, Artificial Sequence
  chemically synthesized
taaccacatatagaaattcatt

SEQ ID NO: 738829 - DNA, 22 bp, Artificial Sequence
  chemically synthesized
gtaaccacatatagaaattcat

SEQ ID NO: 738830 - DNA, 22 bp, Artificial Sequence
  chemically synthesized
tagtttgggaatgaatttctat

SEQ ID NO: 738831 - DNA, 22 bp, Artificial Sequence
  chemically synthesized
tttgtaaccacatatagaaatt

SEQ ID NO: 738832 - DNA, 22 bp, Artificial Sequence
  chemically synthesized
tctatttgtaaccacatataga

SEQ ID NO: 738833 - DNA, 22 bp, Artificial Sequence
  chemically synthesized
gggaatgaatttctatatgtgg

SEQ ID NO: 738834 - DNA, 22 bp, Artificial Sequence
  chemically synthesized
ggaatgaatttctatatgtggt

SEQ ID NO: 738835 - DNA, 22 bp, Artificial Sequence
  chemically synthesized
ctatatgtggttacaaatagac

SEQ ID NO: 738836 - DNA, 22 bp, Artificial Sequence
  chemically synthesized
ccaggagatgctgtctatttgt

SEQ ID NO: 738837 - DNA, 22 bp, Artificial Sequence
  chemically synthesized
tatatgtggttacaaatagaca

SEQ ID NO: 738838 - DNA, 22 bp, Artificial Sequence
  chemically synthesized
tatgtggttacaaatagacagc

SEQ ID NO: 738839 - DNA, 22 bp, Artificial Sequence
  chemically synthesized
tcatgctcccaggagatgctgt

SEQ ID NO: 738840 - DNA, 22 bp, Artificial Sequence
  chemically synthesized
tatcatgctcccaggagatgct

SEQ ID NO: 738841 - DNA, 22 bp, Artificial Sequence
  chemically synthesized
ctatcatgctcccaggagatgc

SEQ ID NO: 738842 - DNA, 22 bp, Artificial Sequence
  chemically synthesized
caaatagacagcatctcctggg

SEQ ID NO: 738843 - DNA, 22 bp, Artificial Sequence
  chemically synthesized
catttctatcatgctcccagga

SEQ ID NO: 738844 - DNA, 22 bp, Artificial Sequence
  chemically synthesized
tgcatttctatcatgctcccag

SEQ ID NO: 738845 - DNA, 22 bp, Artificial Sequence
  chemically synthesized
caattctgcatttctatcatgc

SEQ ID NO: 738846 - DNA, 22 bp, Artificial Sequence
  chemically synthesized
ctgggagcatgatagaaatgca

SEQ ID NO: 738847 - DNA, 22 bp, Artificial Sequence
  chemically synthesized
ggagcatgatagaaatgcagaa

SEQ ID NO: 738848 - DNA, 22 bp, Artificial Sequence
  chemically synthesized
gtatcgggtgaggcctgcaatt

SEQ ID NO: 738849 - DNA, 22 bp, Artificial Sequence
  chemically synthesized
agtatcgggtgaggcctgcaat

SEQ ID NO: 738850 - DNA, 22 bp, Artificial Sequence
  chemically synthesized
caggcctcacccgatactaaat

SEQ ID NO: 738851 - DNA, 22 bp, Artificial Sequence
  chemically synthesized
aaccaatccgcccccagaaatt

SEQ ID NO: 738852 - DNA, 22 bp, Artificial Sequence
  chemically synthesized
acccgatactaaatttctgggg

SEQ ID NO: 738853 - DNA, 22 bp, Artificial Sequence
  chemically synthesized
ttaaaccaatccgcccccagaa

SEQ ID NO: 738854 - DNA, 22 bp, Artificial Sequence
  chemically synthesized
gttaaaccaatccgcccccaga

SEQ ID NO: 738855 - DNA, 22 bp, Artificial Sequence
  chemically synthesized
aatttctgggggcggattggtt

SEQ ID NO: 738856 - DNA, 22 bp, Artificial Sequence
  chemically synthesized
caaagcttgttaaaccaatccg

SEQ ID NO: 738857 - DNA, 22 bp, Artificial Sequence
  chemically synthesized
ctgggggcggattggtttaaca

SEQ ID NO: 738858 - DNA, 22 bp, Artificial Sequence
  chemically synthesized
tgggggcggattggtttaacaa

SEQ ID NO: 738859 - DNA, 22 bp, Artificial Sequence
  chemically synthesized
ggggcggattggtttaacaagc

SEQ ID NO: 738860 - DNA, 22 bp, Artificial Sequence
  chemically synthesized
gtttaacaagctttgcaggtga

SEQ ID NO: 738861 - DNA, 22 bp, Artificial Sequence
  chemically synthesized
gcatggataagaatcacctgca

SEQ ID NO: 738862 - DNA, 22 bp, Artificial Sequence
  chemically synthesized
aacaagctttgcaggtgattct

SEQ ID NO: 738863 - DNA, 22 bp, Artificial Sequence
  chemically synthesized
acaagctttgcaggtgattctt

SEQ ID NO: 738864 - DNA, 22 bp, Artificial Sequence
  chemically synthesized
aaaatctagcatggataagaat

SEQ ID NO: 738865 - DNA, 22 bp, Artificial Sequence
  chemically synthesized
caaaatctagcatggataagaa

SEQ ID NO: 738866 - DNA, 22 bp, Artificial Sequence
  chemically synthesized
tcaaaatctagcatggataaga

SEQ ID NO: 738867 - DNA, 22 bp, Artificial Sequence
  chemically synthesized
tgcaggtgattcttatccatgc

SEQ ID NO: 738868 - DNA, 22 bp, Artificial Sequence
  chemically synthesized
gcaggtgattcttatccatgct

SEQ ID NO: 738869 - DNA, 22 bp, Artificial Sequence
  chemically synthesized
caggtgattcttatccatgcta

SEQ ID NO: 738870 - DNA, 22 bp, Artificial Sequence
  chemically synthesized
aaagttttcaaaatctagcatg

SEQ ID NO: 738871 - DNA, 22 bp, Artificial Sequence
  chemically synthesized
gcctaaaagttttcaaaatcta

SEQ ID NO: 738872 - DNA, 22 bp, Artificial Sequence
  chemically synthesized
ttatccatgctagattttgaaa

SEQ ID NO: 738873 - DNA, 22 bp, Artificial Sequence
  chemically synthesized
atccatgctagattttgaaaac

SEQ ID NO: 738874 - DNA, 22 bp, Artificial Sequence
  chemically synthesized
tccatgctagattttgaaaact

SEQ ID NO: 738875 - DNA, 22 bp, Artificial Sequence
  chemically synthesized
gatagcattggcctaaaagttt

SEQ ID NO: 738876 - DNA, 22 bp, Artificial Sequence
  chemically synthesized
ttggatagcattggcctaaaag

SEQ ID NO: 738877 - DNA, 22 bp, Artificial Sequence
  chemically synthesized
gattttgaaaacttttaggcca

SEQ ID NO: 738878 - DNA, 22 bp, Artificial Sequence
  chemically synthesized
tgttggatagcattggcctaaa

SEQ ID NO: 738879 - DNA, 22 bp, Artificial Sequence
  chemically synthesized
ctgttggatagcattggcctaa

SEQ ID NO: 738880 - DNA, 22 bp, Artificial Sequence
  chemically synthesized
tgaaaacttttaggccaatgct

SEQ ID NO: 738881 - DNA, 22 bp, Artificial Sequence
  chemically synthesized
gaaaacttttaggccaatgcta

SEQ ID NO: 738882 - DNA, 22 bp, Artificial Sequence
  chemically synthesized
aaaacttttaggccaatgctat

SEQ ID NO: 738883 - DNA, 22 bp, Artificial Sequence
  chemically synthesized
tatttctgttggatagcattgg

SEQ ID NO: 738884 - DNA, 22 bp, Artificial Sequence
  chemically synthesized
attatatttctgttggatagca

SEQ ID NO: 738885 - DNA, 22 bp, Artificial Sequence
  chemically synthesized
ttaggccaatgctatccaacag

SEQ ID NO: 738886 - DNA, 22 bp, Artificial Sequence
  chemically synthesized
taggccaatgctatccaacaga

SEQ ID NO: 738887 - DNA, 22 bp, Artificial Sequence
  chemically synthesized
aggccaatgctatccaacagaa

SEQ ID NO: 738888 - DNA, 22 bp, Artificial Sequence
  chemically synthesized
ggccaatgctatccaacagaaa

SEQ ID NO: 738889 - DNA, 22 bp, Artificial Sequence
  chemically synthesized
tacatgtagcactcattatatt

SEQ ID NO: 738890 - DNA, 22 bp, Artificial Sequence
  chemically synthesized
tccaacagaaatataatgagtg

SEQ ID NO: 738891 - DNA, 22 bp, Artificial Sequence
  chemically synthesized
aaattgtacatgtagcactcat

SEQ ID NO: 738892 - DNA, 22 bp, Artificial Sequence
  chemically synthesized
aaaattgtacatgtagcactca

SEQ ID NO: 738893 - DNA, 22 bp, Artificial Sequence
  chemically synthesized
gaacatttaaaattgtacatgt

SEQ ID NO: 738894 - DNA, 22 bp, Artificial Sequence
  chemically synthesized
ctagaacatttaaaattgtaca

SEQ ID NO: 738895 - DNA, 22 bp, Artificial Sequence
  chemically synthesized
catgtacaattttaaatgttct

SEQ ID NO: 738896 - DNA, 22 bp, Artificial Sequence
  chemically synthesized
catgtgcctactagaacattta

SEQ ID NO: 738897 - DNA, 22 bp, Artificial Sequence
  chemically synthesized
acatgtgcctactagaacattt

SEQ ID NO: 738898 - DNA, 22 bp, Artificial Sequence
  chemically synthesized
tacatgtgcctactagaacatt

SEQ ID NO: 738899 - DNA, 22 bp, Artificial Sequence
  chemically synthesized
ttacatgtgcctactagaacat

SEQ ID NO: 738900 - DNA, 22 bp, Artificial Sequence
  chemically synthesized
caaaatttttacatgtgcctac

SEQ ID NO: 738901 - DNA, 22 bp, Artificial Sequence
  chemically synthesized
taaatgttctagtaggcacatg

SEQ ID NO: 738902 - DNA, 22 bp, Artificial Sequence
  chemically synthesized
aaatgttctagtaggcacatgt

SEQ ID NO: 738903 - DNA, 22 bp, Artificial Sequence
  chemically synthesized
tgcaaaatttttacatgtgcct

SEQ ID NO: 738904 - DNA, 22 bp, Artificial Sequence
  chemically synthesized
aatgttctagtaggcacatgta

SEQ ID NO: 738905 - DNA, 22 bp, Artificial Sequence
  chemically synthesized
ctgcaaaatttttacatgtgcc

SEQ ID NO: 738906 - DNA, 22 bp, Artificial Sequence
  chemically synthesized
tagtaggcacatgtaaaaattt

SEQ ID NO: 738907 - DNA, 22 bp, Artificial Sequence
  chemically synthesized
gtaggcacatgtaaaaattttg

SEQ ID NO: 738908 - DNA, 22 bp, Artificial Sequence
  chemically synthesized
caacaatgggcagtgtttctgc

SEQ ID NO: 738909 - DNA, 22 bp, Artificial Sequence
  chemically synthesized
ggctacaacaatgggcagtgtt

SEQ ID NO: 738910 - DNA, 22 bp, Artificial Sequence
  chemically synthesized
cggctacaacaatgggcagtgt

SEQ ID NO: 738911 - DNA, 22 bp, Artificial Sequence
  chemically synthesized
cttcggctacaacaatgggcag

SEQ ID NO: 738912 - DNA, 22 bp, Artificial Sequence
  chemically synthesized
tgcagaaacactgcccattgtt

SEQ ID NO: 738913 - DNA, 22 bp, Artificial Sequence
  chemically synthesized
gcagaaacactgcccattgttg

SEQ ID NO: 738914 - DNA, 22 bp, Artificial Sequence
  chemically synthesized
ttgcttcggctacaacaatggg

SEQ ID NO: 738915 - DNA, 22 bp, Artificial Sequence
  chemically synthesized
cagaaacactgcccattgttgt

SEQ ID NO: 738916 - DNA, 22 bp, Artificial Sequence
  chemically synthesized
cccattgttgtagccgaagcaa

SEQ ID NO: 738917 - DNA, 22 bp, Artificial Sequence
  chemically synthesized
ttgtagccgaagcaacaggctc

SEQ ID NO: 738918 - DNA, 22 bp, Artificial Sequence
  chemically synthesized
aaaatgaatgaagtgagcctgt

SEQ ID NO: 738919 - DNA, 22 bp, Artificial Sequence
  chemically synthesized
tagccgaagcaacaggctcact

SEQ ID NO: 738920 - DNA, 22 bp, Artificial Sequence
  chemically synthesized
gaaaatgaatgaagtgagcctg

SEQ ID NO: 738921 - DNA, 22 bp, Artificial Sequence
  chemically synthesized
ttgaaaatgaatgaagtgagcc

SEQ ID NO: 738922 - DNA, 22 bp, Artificial Sequence
  chemically synthesized
cttgaaaatgaatgaagtgagc

SEQ ID NO: 738923 - DNA, 22 bp, Artificial Sequence
  chemically synthesized
tcttgaaaatgaatgaagtgag

SEQ ID NO: 738924 - DNA, 22 bp, Artificial Sequence
  chemically synthesized
ttcttgaaaatgaatgaagtga

SEQ ID NO: 738925 - DNA, 22 bp, Artificial Sequence
  chemically synthesized
tttttcttgaaaatgaatgaag

SEQ ID NO: 738926 - DNA, 22 bp, Artificial Sequence
  chemically synthesized
gttatttttcttgaaaatgaat

SEQ ID NO: 738927 - DNA, 22 bp, Artificial Sequence
  chemically synthesized
ggttatttttcttgaaaatgaa

SEQ ID NO: 738928 - DNA, 22 bp, Artificial Sequence
  chemically synthesized
acttcattcattttcaagaaaa

SEQ ID NO: 738929 - DNA, 22 bp, Artificial Sequence
  chemically synthesized
aaacttggttatttttcttgaa

SEQ ID NO: 738930 - DNA, 22 bp, Artificial Sequence
  chemically synthesized
ttcaaacttggttatttttctt

SEQ ID NO: 738931 - DNA, 22 bp, Artificial Sequence
  chemically synthesized
cattcattttcaagaaaaataa

SEQ ID NO: 738932 - DNA, 22 bp, Artificial Sequence
  chemically synthesized
attcattttcaagaaaaataac

SEQ ID NO: 738933 - DNA, 22 bp, Artificial Sequence
  chemically synthesized
attttcaagaaaaataaccaag

SEQ ID NO: 738934 - DNA, 22 bp, Artificial Sequence
  chemically synthesized
tgattattcaaacttggttatt

SEQ ID NO: 738935 - DNA, 22 bp, Artificial Sequence
  chemically synthesized
ttatgattattcaaacttggtt

SEQ ID NO: 738936 - DNA, 22 bp, Artificial Sequence
  chemically synthesized
tcaagaaaaataaccaagtttg

SEQ ID NO: 738937 - DNA, 22 bp, Artificial Sequence
  chemically synthesized
attatgattattcaaacttggt

SEQ ID NO: 738938 - DNA, 22 bp, Artificial Sequence
  chemically synthesized
caagaaaaataaccaagtttga

SEQ ID NO: 738939 - DNA, 22 bp, Artificial Sequence
  chemically synthesized
aagaaaaataaccaagtttgaa

SEQ ID NO: 738940 - DNA, 22 bp, Artificial Sequence
  chemically synthesized
atttattatgattattcaaact

SEQ ID NO: 738941 - DNA, 22 bp, Artificial Sequence
  chemically synthesized
actcatttattatgattattca

SEQ ID NO: 738942 - DNA, 22 bp, Artificial Sequence
  chemically synthesized
cactcatttattatgattattc

SEQ ID NO: 738943 - DNA, 22 bp, Artificial Sequence
  chemically synthesized
gaataatcataataaatgagtg

SEQ ID NO: 738944 - DNA, 22 bp, Artificial Sequence
  chemically synthesized
aataatcataataaatgagtga

SEQ ID NO: 738945 - DNA, 22 bp, Artificial Sequence
  chemically synthesized
ggtaaaatgtcataatgaattt

SEQ ID NO: 738946 - DNA, 22 bp, Artificial Sequence
  chemically synthesized
gggtaaaatgtcataatgaatt

SEQ ID NO: 738947 - DNA, 22 bp, Artificial Sequence
  chemically synthesized
cttgggtaaaatgtcataatga

SEQ ID NO: 738948 - DNA, 22 bp, Artificial Sequence
  chemically synthesized
gcttgggtaaaatgtcataatg

SEQ ID NO: 738949 - DNA, 22 bp, Artificial Sequence
  chemically synthesized
tgtatttgcttgggtaaaatgt

SEQ ID NO: 738950 - DNA, 22 bp, Artificial Sequence
  chemically synthesized
atgtatttgcttgggtaaaatg

SEQ ID NO: 738951 - DNA, 22 bp, Artificial Sequence
  chemically synthesized
tatgtatttgcttgggtaaaat

SEQ ID NO: 738952 - DNA, 22 bp, Artificial Sequence
  chemically synthesized
ttatgtatttgcttgggtaaaa

SEQ ID NO: 738953 - DNA, 22 bp, Artificial Sequence
  chemically synthesized
attatgacattttacccaagca

SEQ ID NO: 738954 - DNA, 22 bp, Artificial Sequence
  chemically synthesized
tgacattttacccaagcaaata

SEQ ID NO: 738955 - DNA, 22 bp, Artificial Sequence
  chemically synthesized
aaatgatagtatttttatgtat

SEQ ID NO: 738956 - DNA, 22 bp, Artificial Sequence
  chemically synthesized
tacccaagcaaatacataaaaa

SEQ ID NO: 738957 - DNA, 22 bp, Artificial Sequence
  chemically synthesized
acccaagcaaatacataaaaat

SEQ ID NO: 738958 - DNA, 22 bp, Artificial Sequence
  chemically synthesized
cccaagcaaatacataaaaata

SEQ ID NO: 738959 - DNA, 22 bp, Artificial Sequence
  chemically synthesized
catgttgaaatgatagtatttt

SEQ ID NO: 738960 - DNA, 22 bp, Artificial Sequence
  chemically synthesized
attacatgttgaaatgatagta

SEQ ID NO: 738961 - DNA, 22 bp, Artificial Sequence
  chemically synthesized
tattgattacatgttgaaatga

SEQ ID NO: 738962 - DNA, 22 bp, Artificial Sequence
  chemically synthesized
atattgattacatgttgaaatg

SEQ ID NO: 738963 - DNA, 22 bp, Artificial Sequence
  chemically synthesized
tatattgattacatgttgaaat

SEQ ID NO: 738964 - DNA, 22 bp, Artificial Sequence
  chemically synthesized
ttatattgattacatgttgaaa

SEQ ID NO: 738965 - DNA, 22 bp, Artificial Sequence
  chemically synthesized
tttttatattgattacatgttg

SEQ ID NO: 738966 - DNA, 22 bp, Artificial Sequence
  chemically synthesized
attatttttatattgattacat

SEQ ID NO: 738967 - DNA, 22 bp, Artificial Sequence
  chemically synthesized
tcatttcaacatgtaatcaata

SEQ ID NO: 738968 - DNA, 22 bp, Artificial Sequence
  chemically synthesized
caacatgtaatcaatataaaaa

SEQ ID NO: 738969 - DNA, 22 bp, Artificial Sequence
  chemically synthesized
aacatgtaatcaatataaaaat

SEQ ID NO: 738970 - DNA, 22 bp, Artificial Sequence
  chemically synthesized
gtaccaaaaaaagaatgtaaaa

SEQ ID NO: 738971 - DNA, 22 bp, Artificial Sequence
  chemically synthesized
agtaccaaaaaaagaatgtaaa

SEQ ID NO: 738972 - DNA, 22 bp, Artificial Sequence
  chemically synthesized
tacattctttttttggtactaa

SEQ ID NO: 738973 - DNA, 22 bp, Artificial Sequence
  chemically synthesized
acattctttttttggtactaag

SEQ ID NO: 738974 - DNA, 22 bp, Artificial Sequence
  chemically synthesized
cattctttttttggtactaagt

SEQ ID NO: 738975 - DNA, 22 bp, Artificial Sequence
  chemically synthesized
tttttttggtactaagtctttg

SEQ ID NO: 738976 - DNA, 22 bp, Artificial Sequence
  chemically synthesized
tttttggtactaagtctttgca

SEQ ID NO: 738977 - DNA, 22 bp, Artificial Sequence
  chemically synthesized
ttttggtactaagtctttgcat

SEQ ID NO: 738978 - DNA, 22 bp, Artificial Sequence
  chemically synthesized
tttggtactaagtctttgcatc

SEQ ID NO: 738979 - DNA, 22 bp, Artificial Sequence
  chemically synthesized
ttggtactaagtctttgcatcc

SEQ ID NO: 738980 - DNA, 22 bp, Artificial Sequence
  chemically synthesized
tggtactaagtctttgcatcct

SEQ ID NO: 738981 - DNA, 22 bp, Artificial Sequence
  chemically synthesized
ggtactaagtctttgcatcctg

SEQ ID NO: 738982 - DNA, 22 bp, Artificial Sequence
  chemically synthesized
gtactaagtctttgcatcctga

SEQ ID NO: 738983 - DNA, 22 bp, Artificial Sequence
  chemically synthesized
tatatatatatatatatcagga

SEQ ID NO: 738984 - DNA, 22 bp, Artificial Sequence
  chemically synthesized
agtctttgcatcctgatatata

SEQ ID NO: 738985 - DNA, 22 bp, Artificial Sequence
  chemically synthesized
tgcatcctgatatatatatata

SEQ ID NO: 738986 - DNA, 22 bp, Artificial Sequence
  chemically synthesized
gcatcctgatatatatatatat

SEQ ID NO: 738987 - DNA, 22 bp, Artificial Sequence
  chemically synthesized
catcctgatatatatatatata

SEQ ID NO: 738988 - DNA, 22 bp, Artificial Sequence
  chemically synthesized
atatatatatatatatataaca

SEQ ID NO: 738989 - DNA, 22 bp, Artificial Sequence
  chemically synthesized
tatatatgatatatatgtaata

SEQ ID NO: 738990 - DNA, 22 bp, Artificial Sequence
  chemically synthesized
catatatatcatatatataaca

SEQ ID NO: 738991 - DNA, 22 bp, Artificial Sequence
  chemically synthesized
tatatatgatatagatgtaata

SEQ ID NO: 738992 - DNA, 22 bp, Artificial Sequence
  chemically synthesized
catctatatcatatatataaca

SEQ ID NO: 738993 - DNA, 22 bp, Artificial Sequence
  chemically synthesized
tatcatatatataacatataca

SEQ ID NO: 738994 - DNA, 22 bp, Artificial Sequence
  chemically synthesized
catgtgtatatattacgcttac

SEQ ID NO: 738995 - DNA, 22 bp, Artificial Sequence
  chemically synthesized
cgcttactacacatctcacttt

SEQ ID NO: 738996 - DNA, 22 bp, Artificial Sequence
  chemically synthesized
aatgtagccagtcgaaagtgag

SEQ ID NO: 738997 - DNA, 22 bp, Artificial Sequence
  chemically synthesized
caatgtagccagtcgaaagtga

SEQ ID NO: 738998 - DNA, 22 bp, Artificial Sequence
  chemically synthesized
actacacatctcactttcgact

SEQ ID NO: 738999 - DNA, 22 bp, Artificial Sequence
  chemically synthesized
ctacacatctcactttcgactg

SEQ ID NO: 739000 - DNA, 22 bp, Artificial Sequence
  chemically synthesized
cacatctcactttcgactggct

SEQ ID NO: 739001 - DNA, 22 bp, Artificial Sequence
  chemically synthesized
agcccttcaatgtagccagtcg

SEQ ID NO: 739002 - DNA, 22 bp, Artificial Sequence
  chemically synthesized
actttcgactggctacattgaa

SEQ ID NO: 739003 - DNA, 22 bp, Artificial Sequence
  chemically synthesized
tcgactggctacattgaagggc

SEQ ID NO: 739004 - DNA, 22 bp, Artificial Sequence
  chemically synthesized
cgactggctacattgaagggct

SEQ ID NO: 739005 - DNA, 22 bp, Artificial Sequence
  chemically synthesized
gactggctacattgaagggctc

SEQ ID NO: 739006 - DNA, 22 bp, Artificial Sequence
  chemically synthesized
catatggccattgagcccttca

SEQ ID NO: 739007 - DNA, 22 bp, Artificial Sequence
  chemically synthesized
gctacattgaagggctcaatgg

SEQ ID NO: 739008 - DNA, 22 bp, Artificial Sequence
  chemically synthesized
cattgaagggctcaatggccat

SEQ ID NO: 739009 - DNA, 22 bp, Artificial Sequence
  chemically synthesized
aagggctcaatggccatatgta

SEQ ID NO: 739010 - DNA, 22 bp, Artificial Sequence
  chemically synthesized
tccaatatgatagctacatatg

SEQ ID NO: 739011 - DNA, 22 bp, Artificial Sequence
  chemically synthesized
tgctgtccaatatgatagctac

SEQ ID NO: 739012 - DNA, 22 bp, Artificial Sequence
  chemically synthesized
aatggccatatgtagctatcat

SEQ ID NO: 739013 - DNA, 22 bp, Artificial Sequence
  chemically synthesized
gaactgtgctgtccaatatgat

SEQ ID NO: 739014 - DNA, 22 bp, Artificial Sequence
  chemically synthesized
tcatattggacagcacagttct

SEQ ID NO: 739015 - DNA, 22 bp, Artificial Sequence
  chemically synthesized
aaatcacatggtctagaactgt

SEQ ID NO: 739016 - DNA, 22 bp, Artificial Sequence
  chemically synthesized
caaatcacatggtctagaactg

SEQ ID NO: 739017 - DNA, 22 bp, Artificial Sequence
  chemically synthesized
gacagcacagttctagaccatg

SEQ ID NO: 739018 - DNA, 22 bp, Artificial Sequence
  chemically synthesized
tatttcaaatcacatggtctag

SEQ ID NO: 739019 - DNA, 22 bp, Artificial Sequence
  chemically synthesized
ctgtatttcaaatcacatggtc

SEQ ID NO: 739020 - DNA, 22 bp, Artificial Sequence
  chemically synthesized
actgtatttcaaatcacatggt

SEQ ID NO: 739021 - DNA, 22 bp, Artificial Sequence
  chemically synthesized
tatttactgtatttcaaatcac

SEQ ID NO: 739022 - DNA, 22 bp, Artificial Sequence
  chemically synthesized
atatttactgtatttcaaatca

SEQ ID NO: 739023 - DNA, 22 bp, Artificial Sequence
  chemically synthesized
tagaccatgtgatttgaaatac

SEQ ID NO: 739024 - DNA, 22 bp, Artificial Sequence
  chemically synthesized
gaccatgtgatttgaaatacag

SEQ ID NO: 739025 - DNA, 22 bp, Artificial Sequence
  chemically synthesized
tatggatttatatttactgtat

SEQ ID NO: 739026 - DNA, 22 bp, Artificial Sequence
  chemically synthesized
ctatatggatttatatttactg

SEQ ID NO: 739027 - DNA, 22 bp, Artificial Sequence
  chemically synthesized
ctgctatatggatttatattta

SEQ ID NO: 739028 - DNA, 22 bp, Artificial Sequence
  chemically synthesized
gctgctatatggatttatattt

SEQ ID NO: 739029 - DNA, 22 bp, Artificial Sequence
  chemically synthesized
gaaatacagtaaatataaatcc

SEQ ID NO: 739030 - DNA, 22 bp, Artificial Sequence
  chemically synthesized
aaatacagtaaatataaatcca

SEQ ID NO: 739031 - DNA, 22 bp, Artificial Sequence
  chemically synthesized
atagatccccagaaacacaatt

SEQ ID NO: 739032 - DNA, 22 bp, Artificial Sequence
  chemically synthesized
ttaatagatccccagaaacaca

SEQ ID NO: 739033 - DNA, 22 bp, Artificial Sequence
  chemically synthesized
tgtttctggggatctattaaca

SEQ ID NO: 739034 - DNA, 22 bp, Artificial Sequence
  chemically synthesized
ctggggatctattaacagtttc

SEQ ID NO: 739035 - DNA, 22 bp, Artificial Sequence
  chemically synthesized
tggggatctattaacagtttcc

SEQ ID NO: 739036 - DNA, 22 bp, Artificial Sequence
  chemically synthesized
gggatctattaacagtttccct

SEQ ID NO: 739037 - DNA, 22 bp, Artificial Sequence
  chemically synthesized
ttaacagtttcccttcatcctc

SEQ ID NO: 739038 - DNA, 22 bp, Artificial Sequence
  chemically synthesized
acagtttcccttcatcctccac

SEQ ID NO: 739039 - DNA, 22 bp, Artificial Sequence
  chemically synthesized
cccttcatcctccacgtttccc

SEQ ID NO: 739040 - DNA, 22 bp, Artificial Sequence
  chemically synthesized
ccttcatcctccacgtttccct

SEQ ID NO: 739041 - DNA, 22 bp, Artificial Sequence
  chemically synthesized
catcctccacgtttccctttat

SEQ ID NO: 739042 - DNA, 22 bp, Artificial Sequence
  chemically synthesized
atcctccacgtttccctttatc

SEQ ID NO: 739043 - DNA, 22 bp, Artificial Sequence
  chemically synthesized
tgaggcagaaagaggaagataa

SEQ ID NO: 739044 - DNA, 22 bp, Artificial Sequence
  chemically synthesized
cacgtttccctttatcttcctc

SEQ ID NO: 739045 - DNA, 22 bp, Artificial Sequence
  chemically synthesized
tatgaggcagaaagaggaagat

SEQ ID NO: 739046 - DNA, 22 bp, Artificial Sequence
  chemically synthesized
ctatgaggcagaaagaggaaga

SEQ ID NO: 739047 - DNA, 22 bp, Artificial Sequence
  chemically synthesized
tctatgaggcagaaagaggaag

SEQ ID NO: 739048 - DNA, 22 bp, Artificial Sequence
  chemically synthesized
ttctatgaggcagaaagaggaa

SEQ ID NO: 739049 - DNA, 22 bp, Artificial Sequence
  chemically synthesized
ccctttatcttcctctttctgc

SEQ ID NO: 739050 - DNA, 22 bp, Artificial Sequence
  chemically synthesized
cctttatcttcctctttctgcc

SEQ ID NO: 739051 - DNA, 22 bp, Artificial Sequence
  chemically synthesized
acttttctatgaggcagaaaga

SEQ ID NO: 739052 - DNA, 22 bp, Artificial Sequence
  chemically synthesized
aacttttctatgaggcagaaag

SEQ ID NO: 739053 - DNA, 22 bp, Artificial Sequence
  chemically synthesized
tatcttcctctttctgcctcat

SEQ ID NO: 739054 - DNA, 22 bp, Artificial Sequence
  chemically synthesized
atcttcctctttctgcctcata

SEQ ID NO: 739055 - DNA, 22 bp, Artificial Sequence
  chemically synthesized
tcttcctctttctgcctcatag

SEQ ID NO: 739056 - DNA, 22 bp, Artificial Sequence
  chemically synthesized
cctctttctgcctcatagaaaa

SEQ ID NO: 739057 - DNA, 22 bp, Artificial Sequence
  chemically synthesized
ctctttctgcctcatagaaaag

SEQ ID NO: 739058 - DNA, 22 bp, Artificial Sequence
  chemically synthesized
tttctgcctcatagaaaagtta

SEQ ID NO: 739059 - DNA, 22 bp, Artificial Sequence
  chemically synthesized
tctgcctcatagaaaagttaag

SEQ ID NO: 739060 - DNA, 22 bp, Artificial Sequence
  chemically synthesized
ctgcctcatagaaaagttaagt

SEQ ID NO: 739061 - DNA, 22 bp, Artificial Sequence
  chemically synthesized
tgcctcatagaaaagttaagtg

SEQ ID NO: 739062 - DNA, 22 bp, Artificial Sequence
  chemically synthesized
cctcatagaaaagttaagtgct

SEQ ID NO: 739063 - DNA, 22 bp, Artificial Sequence
  chemically synthesized
atagaaaagttaagtgcttggt

SEQ ID NO: 739064 - DNA, 22 bp, Artificial Sequence
  chemically synthesized
caggatcatggagaaccaagca

SEQ ID NO: 739065 - DNA, 22 bp, Artificial Sequence
  chemically synthesized
aagtgctgcaggatcatggaga

SEQ ID NO: 739066 - DNA, 22 bp, Artificial Sequence
  chemically synthesized
agtgcttggttctccatgatcc

SEQ ID NO: 739067 - DNA, 22 bp, Artificial Sequence
  chemically synthesized
ggttctccatgatcctgcagca

SEQ ID NO: 739068 - DNA, 22 bp, Artificial Sequence
  chemically synthesized
gttctccatgatcctgcagcac

SEQ ID NO: 739069 - DNA, 22 bp, Artificial Sequence
  chemically synthesized
gaggagtgttcaagtgctgcag

SEQ ID NO: 739070 - DNA, 22 bp, Artificial Sequence
  chemically synthesized
tccatgatcctgcagcacttga

SEQ ID NO: 739071 - DNA, 22 bp, Artificial Sequence
  chemically synthesized
catgatcctgcagcacttgaac

SEQ ID NO: 739072 - DNA, 22 bp, Artificial Sequence
  chemically synthesized
tgttggaggagtgttcaagtgc

SEQ ID NO: 739073 - DNA, 22 bp, Artificial Sequence
  chemically synthesized
tgtgttggaggagtgttcaagt

SEQ ID NO: 739074 - DNA, 22 bp, Artificial Sequence
  chemically synthesized
cagcacttgaacactcctccaa

SEQ ID NO: 739075 - DNA, 22 bp, Artificial Sequence
  chemically synthesized
gaacactcctccaacacagagt

SEQ ID NO: 739076 - DNA, 22 bp, Artificial Sequence
  chemically synthesized
aacactcctccaacacagagtt

SEQ ID NO: 739077 - DNA, 22 bp, Artificial Sequence
  chemically synthesized
ctccaacacagagtttttggga

SEQ ID NO: 739078 - DNA, 22 bp, Artificial Sequence
  chemically synthesized
agtataatgccatcccaaaaac

SEQ ID NO: 739079 - DNA, 22 bp, Artificial Sequence
  chemically synthesized
caacacagagtttttgggatgg

SEQ ID NO: 739080 - DNA, 22 bp, Artificial Sequence
  chemically synthesized
gggaaattaagtataatgccat

SEQ ID NO: 739081 - DNA, 22 bp, Artificial Sequence
  chemically synthesized
tggggaaattaagtataatgcc

SEQ ID NO: 739082 - DNA, 22 bp, Artificial Sequence
  chemically synthesized
ttgggatggcattatacttaat

SEQ ID NO: 739083 - DNA, 22 bp, Artificial Sequence
  chemically synthesized
gactctggggaaattaagtata

SEQ ID NO: 739084 - DNA, 22 bp, Artificial Sequence
  chemically synthesized
tgggatggcattatacttaatt

SEQ ID NO: 739085 - DNA, 22 bp, Artificial Sequence
  chemically synthesized
agactctggggaaattaagtat

SEQ ID NO: 739086 - DNA, 22 bp, Artificial Sequence
  chemically synthesized
gggatggcattatacttaattt

SEQ ID NO: 739087 - DNA, 22 bp, Artificial Sequence
  chemically synthesized
ggatggcattatacttaatttc

SEQ ID NO: 739088 - DNA, 22 bp, Artificial Sequence
  chemically synthesized
tgaagggtttagactctgggga

SEQ ID NO: 739089 - DNA, 22 bp, Artificial Sequence
  chemically synthesized
tacttaatttccccagagtcta

SEQ ID NO: 739090 - DNA, 22 bp, Artificial Sequence
  chemically synthesized
aatttccccagagtctaaaccc

SEQ ID NO: 739091 - DNA, 22 bp, Artificial Sequence
  chemically synthesized
atttccccagagtctaaaccct

SEQ ID NO: 739092 - DNA, 22 bp, Artificial Sequence
  chemically synthesized
taagacactgtgaagggtttag

SEQ ID NO: 739093 - DNA, 22 bp, Artificial Sequence
  chemically synthesized
tgtaagacactgtgaagggttt

SEQ ID NO: 739094 - DNA, 22 bp, Artificial Sequence
  chemically synthesized
ccccagagtctaaacccttcac

SEQ ID NO: 739095 - DNA, 22 bp, Artificial Sequence
  chemically synthesized
ctgtaagacactgtgaagggtt

SEQ ID NO: 739096 - DNA, 22 bp, Artificial Sequence
  chemically synthesized
cccagagtctaaacccttcaca

SEQ ID NO: 739097 - DNA, 22 bp, Artificial Sequence
  chemically synthesized
aacccttcacagtgtcttacag

SEQ ID NO: 739098 - DNA, 22 bp, Artificial Sequence
  chemically synthesized
cacagtgtcttacagaagtcat

SEQ ID NO: 739099 - DNA, 22 bp, Artificial Sequence
  chemically synthesized
acagtgtcttacagaagtcata

SEQ ID NO: 739100 - DNA, 22 bp, Artificial Sequence
  chemically synthesized
aaaaaatatatatatgacttct

SEQ ID NO: 739101 - DNA, 22 bp, Artificial Sequence
  chemically synthesized
aaagttaaaaaaatatatatat

SEQ ID NO: 739102 - DNA, 22 bp, Artificial Sequence
  chemically synthesized
aaaagttaaaaaaatatatata

SEQ ID NO: 739103 - DNA, 22 bp, Artificial Sequence
  chemically synthesized
acagaagtcatatatatatttt

SEQ ID NO: 739104 - DNA, 22 bp, Artificial Sequence
  chemically synthesized
cagaagtcatatatatattttt

SEQ ID NO: 739105 - DNA, 22 bp, Artificial Sequence
  chemically synthesized
tcaggtacagacaaatttaaaa

SEQ ID NO: 739106 - DNA, 22 bp, Artificial Sequence
  chemically synthesized
gtcaggtacagacaaatttaaa

SEQ ID NO: 739107 - DNA, 22 bp, Artificial Sequence
  chemically synthesized
ttttaacttttaaatttgtctg

SEQ ID NO: 739108 - DNA, 22 bp, Artificial Sequence
  chemically synthesized
tttaacttttaaatttgtctgt

SEQ ID NO: 739109 - DNA, 22 bp, Artificial Sequence
  chemically synthesized
ttaacttttaaatttgtctgta

SEQ ID NO: 739110 - DNA, 22 bp, Artificial Sequence
  chemically synthesized
taacttttaaatttgtctgtac

SEQ ID NO: 739111 - DNA, 22 bp, Artificial Sequence
  chemically synthesized
agtacttgtcaggtacagacaa

SEQ ID NO: 739112 - DNA, 22 bp, Artificial Sequence
  chemically synthesized
aacttttaaatttgtctgtacc

SEQ ID NO: 739113 - DNA, 22 bp, Artificial Sequence
  chemically synthesized
acttttaaatttgtctgtacct

SEQ ID NO: 739114 - DNA, 22 bp, Artificial Sequence
  chemically synthesized
tgttaagtacttgtcaggtaca

SEQ ID NO: 739115 - DNA, 22 bp, Artificial Sequence
  chemically synthesized
ttaaatttgtctgtacctgaca

SEQ ID NO: 739116 - DNA, 22 bp, Artificial Sequence
  chemically synthesized
taaatttgtctgtacctgacaa

SEQ ID NO: 739117 - DNA, 22 bp, Artificial Sequence
  chemically synthesized
tatgttaagtacttgtcaggta

SEQ ID NO: 739118 - DNA, 22 bp, Artificial Sequence
  chemically synthesized
aaatttgtctgtacctgacaag

SEQ ID NO: 739119 - DNA, 22 bp, Artificial Sequence
  chemically synthesized
aatttgtctgtacctgacaagt

SEQ ID NO: 739120 - DNA, 22 bp, Artificial Sequence
  chemically synthesized
ttctatgttaagtacttgtcag

SEQ ID NO: 739121 - DNA, 22 bp, Artificial Sequence
  chemically synthesized
gtctgtacctgacaagtactta

SEQ ID NO: 739122 - DNA, 22 bp, Artificial Sequence
  chemically synthesized
tctgtacctgacaagtacttaa

SEQ ID NO: 739123 - DNA, 22 bp, Artificial Sequence
  chemically synthesized
tacctgacaagtacttaacata

SEQ ID NO: 739124 - DNA, 22 bp, Artificial Sequence
  chemically synthesized
ataacccctgttctatgttaag

SEQ ID NO: 739125 - DNA, 22 bp, Artificial Sequence
  chemically synthesized
gataacccctgttctatgttaa

SEQ ID NO: 739126 - DNA, 22 bp, Artificial Sequence
  chemically synthesized
tgataacccctgttctatgtta

SEQ ID NO: 739127 - DNA, 22 bp, Artificial Sequence
  chemically synthesized
acaagtacttaacatagaacag

SEQ ID NO: 739128 - DNA, 22 bp, Artificial Sequence
  chemically synthesized
aacatagaacaggggttatcaa

SEQ ID NO: 739129 - DNA, 22 bp, Artificial Sequence
  chemically synthesized
acatagaacaggggttatcaaa

SEQ ID NO: 739130 - DNA, 22 bp, Artificial Sequence
  chemically synthesized
aatcatggaccacactttgata

SEQ ID NO: 739131 - DNA, 22 bp, Artificial Sequence
  chemically synthesized
ctgaatcatggaccacactttg

SEQ ID NO: 739132 - DNA, 22 bp, Artificial Sequence
  chemically synthesized
atgctgctgaatcatggaccac

SEQ ID NO: 739133 - DNA, 22 bp, Artificial Sequence
  chemically synthesized
tcaaagtgtggtccatgattca

SEQ ID NO: 739134 - DNA, 22 bp, Artificial Sequence
  chemically synthesized
aagtgaggctaatgctgctgaa

SEQ ID NO: 739135 - DNA, 22 bp, Artificial Sequence
  chemically synthesized
caagtgaggctaatgctgctga

SEQ ID NO: 739136 - DNA, 22 bp, Artificial Sequence
  chemically synthesized
tcaagtgaggctaatgctgctg

SEQ ID NO: 739137 - DNA, 22 bp, Artificial Sequence
  chemically synthesized
acaaactttcaagtgaggctaa

SEQ ID NO: 739138 - DNA, 22 bp, Artificial Sequence
  chemically synthesized
taacaaactttcaagtgaggct

SEQ ID NO: 739139 - DNA, 22 bp, Artificial Sequence
  chemically synthesized
agcagcattagcctcacttgaa

SEQ ID NO: 739140 - DNA, 22 bp, Artificial Sequence
  chemically synthesized
catctctaacaaactttcaagt

SEQ ID NO: 739141 - DNA, 22 bp, Artificial Sequence
  chemically synthesized
gcctcacttgaaagtttgttag

SEQ ID NO: 739142 - DNA, 22 bp, Artificial Sequence
  chemically synthesized
agaatctgcatctctaacaaac

SEQ ID NO: 739143 - DNA, 22 bp, Artificial Sequence
  chemically synthesized
gagaatctgcatctctaacaaa

SEQ ID NO: 739144 - DNA, 22 bp, Artificial Sequence
  chemically synthesized
acttgaaagtttgttagagatg

SEQ ID NO: 739145 - DNA, 22 bp, Artificial Sequence
  chemically synthesized
gaaagtttgttagagatgcaga

SEQ ID NO: 739146 - DNA, 22 bp, Artificial Sequence
  chemically synthesized
aaagtttgttagagatgcagat

SEQ ID NO: 739147 - DNA, 22 bp, Artificial Sequence
  chemically synthesized
gtgtggagcttgagaatctgca

SEQ ID NO: 739148 - DNA, 22 bp, Artificial Sequence
  chemically synthesized
gttagagatgcagattctcaag

SEQ ID NO: 739149 - DNA, 22 bp, Artificial Sequence
  chemically synthesized
ttagagatgcagattctcaagc

SEQ ID NO: 739150 - DNA, 22 bp, Artificial Sequence
  chemically synthesized
gagatgcagattctcaagctcc

SEQ ID NO: 739151 - DNA, 22 bp, Artificial Sequence
  chemically synthesized
agtgggtctggtgtggagcttg

SEQ ID NO: 739152 - DNA, 22 bp, Artificial Sequence
  chemically synthesized
aaatgattcagtgggtctggtg

SEQ ID NO: 739153 - DNA, 22 bp, Artificial Sequence
  chemically synthesized
caaatgattcagtgggtctggt

SEQ ID NO: 739154 - DNA, 22 bp, Artificial Sequence
  chemically synthesized
tcaagctccacaccagacccac

SEQ ID NO: 739155 - DNA, 22 bp, Artificial Sequence
  chemically synthesized
aagctccacaccagacccactg

SEQ ID NO: 739156 - DNA, 22 bp, Artificial Sequence
  chemically synthesized
cacaccagacccactgaatcat

SEQ ID NO: 739157 - DNA, 22 bp, Artificial Sequence
  chemically synthesized
cacataccaagtttcaaatgat

SEQ ID NO: 739158 - DNA, 22 bp, Artificial Sequence
  chemically synthesized
ggctccacataccaagtttcaa

SEQ ID NO: 739159 - DNA, 22 bp, Artificial Sequence
  chemically synthesized
aatcatttgaaacttggtatgt

SEQ ID NO: 739160 - DNA, 22 bp, Artificial Sequence
  chemically synthesized
gaaacttggtatgtggagccca

SEQ ID NO: 739161 - DNA, 22 bp, Artificial Sequence
  chemically synthesized
aaacttggtatgtggagcccag

SEQ ID NO: 739162 - DNA, 22 bp, Artificial Sequence
  chemically synthesized
aaacacagataactgggctcca

SEQ ID NO: 739163 - DNA, 22 bp, Artificial Sequence
  chemically synthesized
ttaaaacacagataactgggct

SEQ ID NO: 739164 - DNA, 22 bp, Artificial Sequence
  chemically synthesized
attaaaacacagataactgggc

SEQ ID NO: 739165 - DNA, 22 bp, Artificial Sequence
  chemically synthesized
ggtatgtggagcccagttatct

SEQ ID NO: 739166 - DNA, 22 bp, Artificial Sequence
  chemically synthesized
gtatgtggagcccagttatctg

SEQ ID NO: 739167 - DNA, 22 bp, Artificial Sequence
  chemically synthesized
gaaggcttattaaaacacagat

SEQ ID NO: 739168 - DNA, 22 bp, Artificial Sequence
  chemically synthesized
acctggaaggcttattaaaaca

SEQ ID NO: 739169 - DNA, 22 bp, Artificial Sequence
  chemically synthesized
tctgtgttttaataagccttcc

SEQ ID NO: 739170 - DNA, 22 bp, Artificial Sequence
  chemically synthesized
tgttttaataagccttccaggt

SEQ ID NO: 739171 - DNA, 22 bp, Artificial Sequence
  chemically synthesized
acaagcatcaaattcacctgga

SEQ ID NO: 739172 - DNA, 22 bp, Artificial Sequence
  chemically synthesized
aacaagcatcaaattcacctgg

SEQ ID NO: 739173 - DNA, 22 bp, Artificial Sequence
  chemically synthesized
taataagccttccaggtgaatt

SEQ ID NO: 739174 - DNA, 22 bp, Artificial Sequence
  chemically synthesized
taacaagcatcaaattcacctg

SEQ ID NO: 739175 - DNA, 22 bp, Artificial Sequence
  chemically synthesized
aataagccttccaggtgaattt

SEQ ID NO: 739176 - DNA, 22 bp, Artificial Sequence
  chemically synthesized
ataagccttccaggtgaatttg

SEQ ID NO: 739177 - DNA, 22 bp, Artificial Sequence
  chemically synthesized
aaattttaacaagcatcaaatt

SEQ ID NO: 739178 - DNA, 22 bp, Artificial Sequence
  chemically synthesized
tcaaattttaacaagcatcaaa

SEQ ID NO: 739179 - DNA, 22 bp, Artificial Sequence
  chemically synthesized
ccaggtgaatttgatgcttgtt

SEQ ID NO: 739180 - DNA, 22 bp, Artificial Sequence
  chemically synthesized
caggtgaatttgatgcttgtta

SEQ ID NO: 739181 - DNA, 22 bp, Artificial Sequence
  chemically synthesized
gtggttctcaaattttaacaag

SEQ ID NO: 739182 - DNA, 22 bp, Artificial Sequence
  chemically synthesized
cattagtggttctcaaatttta

SEQ ID NO: 739183 - DNA, 22 bp, Artificial Sequence
  chemically synthesized
gatgcttgttaaaatttgagaa

SEQ ID NO: 739184 - DNA, 22 bp, Artificial Sequence
  chemically synthesized
ctacattagtggttctcaaatt

SEQ ID NO: 739185 - DNA, 22 bp, Artificial Sequence
  chemically synthesized
atgcttgttaaaatttgagaac

SEQ ID NO: 739186 - DNA, 22 bp, Artificial Sequence
  chemically synthesized
cctacattagtggttctcaaat

SEQ ID NO: 739187 - DNA, 22 bp, Artificial Sequence
  chemically synthesized
tcctacattagtggttctcaaa

SEQ ID NO: 739188 - DNA, 22 bp, Artificial Sequence
  chemically synthesized
gttaaaatttgagaaccactaa

SEQ ID NO: 739189 - DNA, 22 bp, Artificial Sequence
  chemically synthesized
ttaaaatttgagaaccactaat

SEQ ID NO: 739190 - DNA, 22 bp, Artificial Sequence
  chemically synthesized
aaatttgagaaccactaatgta

SEQ ID NO: 739191 - DNA, 22 bp, Artificial Sequence
  chemically synthesized
gagaaccactaatgtaggaaaa

SEQ ID NO: 739192 - DNA, 22 bp, Artificial Sequence
  chemically synthesized
caaataaatatgttttcctaca

SEQ ID NO: 739193 - DNA, 22 bp, Artificial Sequence
  chemically synthesized
agaaccactaatgtaggaaaac

SEQ ID NO: 739194 - DNA, 22 bp, Artificial Sequence
  chemically synthesized
tccaaataaatatgttttccta

SEQ ID NO: 739195 - DNA, 22 bp, Artificial Sequence
  chemically synthesized
atgtaggaaaacatatttattt

SEQ ID NO: 739196 - DNA, 22 bp, Artificial Sequence
  chemically synthesized
atttggagaatggcctcatatt

SEQ ID NO: 739197 - DNA, 22 bp, Artificial Sequence
  chemically synthesized
tttggagaatggcctcatattt

SEQ ID NO: 739198 - DNA, 22 bp, Artificial Sequence
  chemically synthesized
aggagaaaatgataaatatgag

SEQ ID NO: 739199 - DNA, 22 bp, Artificial Sequence
  chemically synthesized
ggagaatggcctcatatttatc

SEQ ID NO: 739200 - DNA, 22 bp, Artificial Sequence
  chemically synthesized
gagaatggcctcatatttatca

SEQ ID NO: 739201 - DNA, 22 bp, Artificial Sequence
  chemically synthesized
ccacagaactcaggagaaaatg

SEQ ID NO: 739202 - DNA, 22 bp, Artificial Sequence
  chemically synthesized
taccacagaactcaggagaaaa

SEQ ID NO: 739203 - DNA, 22 bp, Artificial Sequence
  chemically synthesized
atatttatcattttctcctgag

SEQ ID NO: 739204 - DNA, 22 bp, Artificial Sequence
  chemically synthesized
tggttctaccacagaactcagg

SEQ ID NO: 739205 - DNA, 22 bp, Artificial Sequence
  chemically synthesized
gtggttctaccacagaactcag

SEQ ID NO: 739206 - DNA, 22 bp, Artificial Sequence
  chemically synthesized
atcattttctcctgagttctgt

SEQ ID NO: 739207 - DNA, 22 bp, Artificial Sequence
  chemically synthesized
tcattttctcctgagttctgtg

SEQ ID NO: 739208 - DNA, 22 bp, Artificial Sequence
  chemically synthesized
agcttgtggttctaccacagaa

SEQ ID NO: 739209 - DNA, 22 bp, Artificial Sequence
  chemically synthesized
tctcctgagttctgtggtagaa

SEQ ID NO: 739210 - DNA, 22 bp, Artificial Sequence
  chemically synthesized
ctcctgagttctgtggtagaac

SEQ ID NO: 739211 - DNA, 22 bp, Artificial Sequence
  chemically synthesized
tcctgagttctgtggtagaacc

SEQ ID NO: 739212 - DNA, 22 bp, Artificial Sequence
  chemically synthesized
ctgagttctgtggtagaaccac

SEQ ID NO: 739213 - DNA, 22 bp, Artificial Sequence
  chemically synthesized
aaatgattcagcttgtggttct

SEQ ID NO: 739214 - DNA, 22 bp, Artificial Sequence
  chemically synthesized
agttctgtggtagaaccacaag

SEQ ID NO: 739215 - DNA, 22 bp, Artificial Sequence
  chemically synthesized
tgtggtagaaccacaagctgaa

SEQ ID NO: 739216 - DNA, 22 bp, Artificial Sequence
  chemically synthesized
tggtagaaccacaagctgaatc

SEQ ID NO: 739217 - DNA, 22 bp, Artificial Sequence
  chemically synthesized
agaagactaaaatgattcagct

SEQ ID NO: 739218 - DNA, 22 bp, Artificial Sequence
  chemically synthesized
aagaagactaaaatgattcagc

SEQ ID NO: 739219 - DNA, 22 bp, Artificial Sequence
  chemically synthesized
taagaagactaaaatgattcag

SEQ ID NO: 739220 - DNA, 22 bp, Artificial Sequence
  chemically synthesized
tttaagaagactaaaatgattc

SEQ ID NO: 739221 - DNA, 22 bp, Artificial Sequence
  chemically synthesized
ctttaagaagactaaaatgatt

SEQ ID NO: 739222 - DNA, 22 bp, Artificial Sequence
  chemically synthesized
tctttaagaagactaaaatgat

SEQ ID NO: 739223 - DNA, 22 bp, Artificial Sequence
  chemically synthesized
tttctttaagaagactaaaatg

SEQ ID NO: 739224 - DNA, 22 bp, Artificial Sequence
  chemically synthesized
ctttctttaagaagactaaaat

SEQ ID NO: 739225 - DNA, 22 bp, Artificial Sequence
  chemically synthesized
tctttctttaagaagactaaaa

SEQ ID NO: 739226 - DNA, 22 bp, Artificial Sequence
  chemically synthesized
ttctttctttaagaagactaaa

SEQ ID NO: 739227 - DNA, 22 bp, Artificial Sequence
  chemically synthesized
tttctttctttaagaagactaa

SEQ ID NO: 739228 - DNA, 22 bp, Artificial Sequence
  chemically synthesized
actttttctttctttaagaaga

SEQ ID NO: 739229 - DNA, 22 bp, Artificial Sequence
  chemically synthesized
aatcattttagtcttcttaaag

SEQ ID NO: 739230 - DNA, 22 bp, Artificial Sequence
  chemically synthesized
gactttttctttctttaagaag

SEQ ID NO: 739231 - DNA, 22 bp, Artificial Sequence
  chemically synthesized
ttgactttttctttctttaaga

SEQ ID NO: 739232 - DNA, 22 bp, Artificial Sequence
  chemically synthesized
cttgactttttctttctttaag

SEQ ID NO: 739233 - DNA, 22 bp, Artificial Sequence
  chemically synthesized
tagtcttcttaaagaaagaaaa

SEQ ID NO: 739234 - DNA, 22 bp, Artificial Sequence
  chemically synthesized
agtcttcttaaagaaagaaaaa

SEQ ID NO: 739235 - DNA, 22 bp, Artificial Sequence
  chemically synthesized
gtcttcttaaagaaagaaaaag

SEQ ID NO: 739236 - DNA, 22 bp, Artificial Sequence
  chemically synthesized
gcatgtccttcttgactttttc

SEQ ID NO: 739237 - DNA, 22 bp, Artificial Sequence
  chemically synthesized
cttaaagaaagaaaaagtcaag

SEQ ID NO: 739238 - DNA, 22 bp, Artificial Sequence
  chemically synthesized
tagcatgtccttcttgactttt

SEQ ID NO: 739239 - DNA, 22 bp, Artificial Sequence
  chemically synthesized
ttaaagaaagaaaaagtcaaga

SEQ ID NO: 739240 - DNA, 22 bp, Artificial Sequence
  chemically synthesized
ctagcatgtccttcttgacttt

SEQ ID NO: 739241 - DNA, 22 bp, Artificial Sequence
  chemically synthesized
tctagcatgtccttcttgactt

SEQ ID NO: 739242 - DNA, 22 bp, Artificial Sequence
  chemically synthesized
aaagaaagaaaaagtcaagaag

SEQ ID NO: 739243 - DNA, 22 bp, Artificial Sequence
  chemically synthesized
aagaaagaaaaagtcaagaagg

SEQ ID NO: 739244 - DNA, 22 bp, Artificial Sequence
  chemically synthesized
ccgatgtctttctagcatgtcc

SEQ ID NO: 739245 - DNA, 22 bp, Artificial Sequence
  chemically synthesized
gggataaggagaagacatctac

SEQ ID NO: 739246 - DNA, 22 bp, Artificial Sequence
  chemically synthesized
gaaagacatcggtagatgtctt

SEQ ID NO: 739247 - DNA, 22 bp, Artificial Sequence
  chemically synthesized
actggggataaggagaagacat

SEQ ID NO: 739248 - DNA, 22 bp, Artificial Sequence
  chemically synthesized
tcactaactggggataaggaga

SEQ ID NO: 739249 - DNA, 22 bp, Artificial Sequence
  chemically synthesized
ctccttatccccagttagtgat

SEQ ID NO: 739250 - DNA, 22 bp, Artificial Sequence
  chemically synthesized
tccttatccccagttagtgata

SEQ ID NO: 739251 - DNA, 22 bp, Artificial Sequence
  chemically synthesized
cttatccccagttagtgatagg

SEQ ID NO: 739252 - DNA, 22 bp, Artificial Sequence
  chemically synthesized
caaataatgtcggcctatcact

SEQ ID NO: 739253 - DNA, 22 bp, Artificial Sequence
  chemically synthesized
acaaataatgtcggcctatcac

SEQ ID NO: 739254 - DNA, 22 bp, Artificial Sequence
  chemically synthesized
atccccagttagtgataggccg

SEQ ID NO: 739255 - DNA, 22 bp, Artificial Sequence
  chemically synthesized
tccccagttagtgataggccga

SEQ ID NO: 739256 - DNA, 22 bp, Artificial Sequence
  chemically synthesized
ttacaaataatgtcggcctatc

SEQ ID NO: 739257 - DNA, 22 bp, Artificial Sequence
  chemically synthesized
ctcttacaaataatgtcggcct

SEQ ID NO: 739258 - DNA, 22 bp, Artificial Sequence
  chemically synthesized
gtgataggccgacattatttgt

SEQ ID NO: 739259 - DNA, 22 bp, Artificial Sequence
  chemically synthesized
gccatctgctcttacaaataat

SEQ ID NO: 739260 - DNA, 22 bp, Artificial Sequence
  chemically synthesized
gacagagagcctagccatctgc

SEQ ID NO: 739261 - DNA, 22 bp, Artificial Sequence
  chemically synthesized
tggacagagagcctagccatct

SEQ ID NO: 739262 - DNA, 22 bp, Artificial Sequence
  chemically synthesized
tttgtaagagcagatggctagg

SEQ ID NO: 739263 - DNA, 22 bp, Artificial Sequence
  chemically synthesized
ctggacagagagcctagccatc

SEQ ID NO: 739264 - DNA, 22 bp, Artificial Sequence
  chemically synthesized
gtaagagcagatggctaggctc

SEQ ID NO: 739265 - DNA, 22 bp, Artificial Sequence
  chemically synthesized
taagagcagatggctaggctct

SEQ ID NO: 739266 - DNA, 22 bp, Artificial Sequence
  chemically synthesized
tggggtcacttctggacagaga

SEQ ID NO: 739267 - DNA, 22 bp, Artificial Sequence
  chemically synthesized
cattatggggtcacttctggac

SEQ ID NO: 739268 - DNA, 22 bp, Artificial Sequence
  chemically synthesized
gcattatggggtcacttctgga

SEQ ID NO: 739269 - DNA, 22 bp, Artificial Sequence
  chemically synthesized
tgcattatggggtcacttctgg

SEQ ID NO: 739270 - DNA, 22 bp, Artificial Sequence
  chemically synthesized
ggctctctgtccagaagtgacc

SEQ ID NO: 739271 - DNA, 22 bp, Artificial Sequence
  chemically synthesized
tctgtccagaagtgaccccata

SEQ ID NO: 739272 - DNA, 22 bp, Artificial Sequence
  chemically synthesized
atcattttgcattatggggtca

SEQ ID NO: 739273 - DNA, 22 bp, Artificial Sequence
  chemically synthesized
tgtccagaagtgaccccataat

SEQ ID NO: 739274 - DNA, 22 bp, Artificial Sequence
  chemically synthesized
tccagaagtgaccccataatgc

SEQ ID NO: 739275 - DNA, 22 bp, Artificial Sequence
  chemically synthesized
tactaatcattttgcattatgg

SEQ ID NO: 739276 - DNA, 22 bp, Artificial Sequence
  chemically synthesized
atgatcctgtactaatcatttt

SEQ ID NO: 739277 - DNA, 22 bp, Artificial Sequence
  chemically synthesized
aatgatcctgtactaatcattt

SEQ ID NO: 739278 - DNA, 22 bp, Artificial Sequence
  chemically synthesized
taatgatcctgtactaatcatt

SEQ ID NO: 739279 - DNA, 22 bp, Artificial Sequence
  chemically synthesized
ttaatgatcctgtactaatcat

SEQ ID NO: 739280 - DNA, 22 bp, Artificial Sequence
  chemically synthesized
tttaatgatcctgtactaatca

SEQ ID NO: 739281 - DNA, 22 bp, Artificial Sequence
  chemically synthesized
ttttttaatgatcctgtactaa

SEQ ID NO: 739282 - DNA, 22 bp, Artificial Sequence
  chemically synthesized
gttttttaatgatcctgtacta

SEQ ID NO: 739283 - DNA, 22 bp, Artificial Sequence
  chemically synthesized
tgttttttaatgatcctgtact

SEQ ID NO: 739284 - DNA, 22 bp, Artificial Sequence
  chemically synthesized
ttgttttttaatgatcctgtac

SEQ ID NO: 739285 - DNA, 22 bp, Artificial Sequence
  chemically synthesized
tttgttttttaatgatcctgta

SEQ ID NO: 739286 - DNA, 22 bp, Artificial Sequence
  chemically synthesized
ttttgttttttaatgatcctgt

SEQ ID NO: 739287 - DNA, 22 bp, Artificial Sequence
  chemically synthesized
ttttttgttttttaatgatcct

SEQ ID NO: 739288 - DNA, 22 bp, Artificial Sequence
  chemically synthesized
cttttttgttttttaatgatcc

SEQ ID NO: 739289 - DNA, 22 bp, Artificial Sequence
  chemically synthesized
tcttttttgttttttaatgatc

SEQ ID NO: 739290 - DNA, 22 bp, Artificial Sequence
  chemically synthesized
gtacaggatcattaaaaaacaa

SEQ ID NO: 739291 - DNA, 22 bp, Artificial Sequence
  chemically synthesized
atatctttcttttttgtttttt

SEQ ID NO: 739292 - DNA, 22 bp, Artificial Sequence
  chemically synthesized
ctcatatctttcttttttgttt

SEQ ID NO: 739293 - DNA, 22 bp, Artificial Sequence
  chemically synthesized
cctcatatctttcttttttgtt

SEQ ID NO: 739294 - DNA, 22 bp, Artificial Sequence
  chemically synthesized
tcctcatatctttcttttttgt

SEQ ID NO: 739295 - DNA, 22 bp, Artificial Sequence
  chemically synthesized
aacattttcctcatatctttct

SEQ ID NO: 739296 - DNA, 22 bp, Artificial Sequence
  chemically synthesized
aaaaacaaaaaagaaagatatg

SEQ ID NO: 739297 - DNA, 22 bp, Artificial Sequence
  chemically synthesized
gaacattttcctcatatctttc

SEQ ID NO: 739298 - DNA, 22 bp, Artificial Sequence
  chemically synthesized
tgaacattttcctcatatcttt

SEQ ID NO: 739299 - DNA, 22 bp, Artificial Sequence
  chemically synthesized
acagattttgaacattttcctc

SEQ ID NO: 739300 - DNA, 22 bp, Artificial Sequence
  chemically synthesized
aatgtgttgacagattttgaac

SEQ ID NO: 739301 - DNA, 22 bp, Artificial Sequence
  chemically synthesized
aaatgtgttgacagattttgaa

SEQ ID NO: 739302 - DNA, 22 bp, Artificial Sequence
  chemically synthesized
taaatgtgttgacagattttga

SEQ ID NO: 739303 - DNA, 22 bp, Artificial Sequence
  chemically synthesized
atcctttaaatgtgttgacaga

SEQ ID NO: 739304 - DNA, 22 bp, Artificial Sequence
  chemically synthesized
gatcctttaaatgtgttgacag

SEQ ID NO: 739305 - DNA, 22 bp, Artificial Sequence
  chemically synthesized
aaaatctgtcaacacatttaaa

SEQ ID NO: 739306 - DNA, 22 bp, Artificial Sequence
  chemically synthesized
agcacaggatttgatcctttaa

SEQ ID NO: 739307 - DNA, 22 bp, Artificial Sequence
  chemically synthesized
tcaacacatttaaaggatcaaa

SEQ ID NO: 739308 - DNA, 22 bp, Artificial Sequence
  chemically synthesized
ccatcattgagcacaggatttg

SEQ ID NO: 739309 - DNA, 22 bp, Artificial Sequence
  chemically synthesized
accatcattgagcacaggattt

SEQ ID NO: 739310 - DNA, 22 bp, Artificial Sequence
  chemically synthesized
ttaccatcattgagcacaggat

SEQ ID NO: 739311 - DNA, 22 bp, Artificial Sequence
  chemically synthesized
aaaggatcaaatcctgtgctca

SEQ ID NO: 739312 - DNA, 22 bp, Artificial Sequence
  chemically synthesized
aaggatcaaatcctgtgctcaa

SEQ ID NO: 739313 - DNA, 22 bp, Artificial Sequence
  chemically synthesized
ttcttaccatcattgagcacag

SEQ ID NO: 739314 - DNA, 22 bp, Artificial Sequence
  chemically synthesized
gttcttaccatcattgagcaca

SEQ ID NO: 739315 - DNA, 22 bp, Artificial Sequence
  chemically synthesized
tgtatgtttgttcttaccatca

SEQ ID NO: 739316 - DNA, 22 bp, Artificial Sequence
  chemically synthesized
tgctcaatgatggtaagaacaa

SEQ ID NO: 739317 - DNA, 22 bp, Artificial Sequence
  chemically synthesized
tatctatgtatgtttgttctta

SEQ ID NO: 739318 - DNA, 22 bp, Artificial Sequence
  chemically synthesized
aatgatggtaagaacaaacata

SEQ ID NO: 739319 - DNA, 22 bp, Artificial Sequence
  chemically synthesized
tctgtatctatgtatgtttgtt

SEQ ID NO: 739320 - DNA, 22 bp, Artificial Sequence
  chemically synthesized
atctgtatctatgtatgtttgt

SEQ ID NO: 739321 - DNA, 22 bp, Artificial Sequence
  chemically synthesized
tatctgtatctatgtatgtttg

SEQ ID NO: 739322 - DNA, 22 bp, Artificial Sequence
  chemically synthesized
ttatctgtatctatgtatgttt

SEQ ID NO: 739323 - DNA, 22 bp, Artificial Sequence
  chemically synthesized
agcaggtcttttatctgtatct

SEQ ID NO: 739324 - DNA, 22 bp, Artificial Sequence
  chemically synthesized
taagcaggtcttttatctgtat

SEQ ID NO: 739325 - DNA, 22 bp, Artificial Sequence
  chemically synthesized
ctaagcaggtcttttatctgta

SEQ ID NO: 739326 - DNA, 22 bp, Artificial Sequence
  chemically synthesized
tctaagcaggtcttttatctgt

SEQ ID NO: 739327 - DNA, 22 bp, Artificial Sequence
  chemically synthesized
gtgagataggattttctaagca

SEQ ID NO: 739328 - DNA, 22 bp, Artificial Sequence
  chemically synthesized
ggtgagataggattttctaagc

SEQ ID NO: 739329 - DNA, 22 bp, Artificial Sequence
  chemically synthesized
tggtgagataggattttctaag

SEQ ID NO: 739330 - DNA, 22 bp, Artificial Sequence
  chemically synthesized
ctttggtgagataggattttct

SEQ ID NO: 739331 - DNA, 22 bp, Artificial Sequence
  chemically synthesized
actttggtgagataggattttc

SEQ ID NO: 739332 - DNA, 22 bp, Artificial Sequence
  chemically synthesized
tactttggtgagataggatttt

SEQ ID NO: 739333 - DNA, 22 bp, Artificial Sequence
  chemically synthesized
tttactttggtgagataggatt

SEQ ID NO: 739334 - DNA, 22 bp, Artificial Sequence
  chemically synthesized
cttagaaaatcctatctcacca

SEQ ID NO: 739335 - DNA, 22 bp, Artificial Sequence
  chemically synthesized
tattctttactttggtgagata

SEQ ID NO: 739336 - DNA, 22 bp, Artificial Sequence
  chemically synthesized
atattctttactttggtgagat

SEQ ID NO: 739337 - DNA, 22 bp, Artificial Sequence
  chemically synthesized
agaaaatcctatctcaccaaag

SEQ ID NO: 739338 - DNA, 22 bp, Artificial Sequence
  chemically synthesized
gaaaatcctatctcaccaaagt

SEQ ID NO: 739339 - DNA, 22 bp, Artificial Sequence
  chemically synthesized
tctcaccaaagtaaagaatata

SEQ ID NO: 739340 - DNA, 22 bp, Artificial Sequence
  chemically synthesized
tatcagaaccatttatattctt

SEQ ID NO: 739341 - DNA, 22 bp, Artificial Sequence
  chemically synthesized
atatcagaaccatttatattct

SEQ ID NO: 739342 - DNA, 22 bp, Artificial Sequence
  chemically synthesized
accaaagtaaagaatataaatg

SEQ ID NO: 739343 - DNA, 22 bp, Artificial Sequence
  chemically synthesized
ttatatcagaaccatttatatt

SEQ ID NO: 739344 - DNA, 22 bp, Artificial Sequence
  chemically synthesized
caacaagcaattcttatatcag

SEQ ID NO: 739345 - DNA, 22 bp, Artificial Sequence
  chemically synthesized
ccaacaagcaattcttatatca

SEQ ID NO: 739346 - DNA, 22 bp, Artificial Sequence
  chemically synthesized
tccaacaagcaattcttatatc

SEQ ID NO: 739347 - DNA, 22 bp, Artificial Sequence
  chemically synthesized
ttccaacaagcaattcttatat

SEQ ID NO: 739348 - DNA, 22 bp, Artificial Sequence
  chemically synthesized
tttccaacaagcaattcttata

SEQ ID NO: 739349 - DNA, 22 bp, Artificial Sequence
  chemically synthesized
ttttccaacaagcaattcttat

SEQ ID NO: 739350 - DNA, 22 bp, Artificial Sequence
  chemically synthesized
tgatataagaattgcttgttgg

SEQ ID NO: 739351 - DNA, 22 bp, Artificial Sequence
  chemically synthesized
accagtttttttccaacaagca

SEQ ID NO: 739352 - DNA, 22 bp, Artificial Sequence
  chemically synthesized
atataagaattgcttgttggaa

SEQ ID NO: 739353 - DNA, 22 bp, Artificial Sequence
  chemically synthesized
aaaaaactaaccagtttttttc

SEQ ID NO: 739354 - DNA, 22 bp, Artificial Sequence
  chemically synthesized
aaaaaaactaaccagttttttt

SEQ ID NO: 739355 - DNA, 22 bp, Artificial Sequence
  chemically synthesized
taaaaaaactaaccagtttttt

SEQ ID NO: 739356 - DNA, 22 bp, Artificial Sequence
  chemically synthesized
cttgttggaaaaaaactggtta

SEQ ID NO: 739357 - DNA, 22 bp, Artificial Sequence
  chemically synthesized
attttaaaaaaactaaccagtt

SEQ ID NO: 739358 - DNA, 22 bp, Artificial Sequence
  chemically synthesized
cattttaaaaaaactaaccagt

SEQ ID NO: 739359 - DNA, 22 bp, Artificial Sequence
  chemically synthesized
gttggaaaaaaactggttagtt

SEQ ID NO: 739360 - DNA, 22 bp, Artificial Sequence
  chemically synthesized
ttggaaaaaaactggttagttt

SEQ ID NO: 739361 - DNA, 22 bp, Artificial Sequence
  chemically synthesized
gaaaaaaactggttagtttttt

SEQ ID NO: 739362 - DNA, 22 bp, Artificial Sequence
  chemically synthesized
tgtggcttcattttaaaaaaac

SEQ ID NO: 739363 - DNA, 22 bp, Artificial Sequence
  chemically synthesized
gtgtggcttcattttaaaaaaa

SEQ ID NO: 739364 - DNA, 22 bp, Artificial Sequence
  chemically synthesized
gttagtttttttaaaatgaagc

SEQ ID NO: 739365 - DNA, 22 bp, Artificial Sequence
  chemically synthesized
gtttttttaaaatgaagccaca

SEQ ID NO: 739366 - DNA, 22 bp, Artificial Sequence
  chemically synthesized
ttttaaaatgaagccacacaaa

SEQ ID NO: 739367 - DNA, 22 bp, Artificial Sequence
  chemically synthesized
tttaaaatgaagccacacaaat

SEQ ID NO: 739368 - DNA, 22 bp, Artificial Sequence
  chemically synthesized
aacaataggagtatttgtgtgg

SEQ ID NO: 739369 - DNA, 22 bp, Artificial Sequence
  chemically synthesized
ttaaaatgaagccacacaaata

SEQ ID NO: 739370 - DNA, 22 bp, Artificial Sequence
  chemically synthesized
taaaatgaagccacacaaatac

SEQ ID NO: 739371 - DNA, 22 bp, Artificial Sequence
  chemically synthesized
aaaatgaagccacacaaatact

SEQ ID NO: 739372 - DNA, 22 bp, Artificial Sequence
  chemically synthesized
aaatgaagccacacaaatactc

SEQ ID NO: 739373 - DNA, 22 bp, Artificial Sequence
  chemically synthesized
gctaaacaataggagtatttgt

SEQ ID NO: 739374 - DNA, 22 bp, Artificial Sequence
  chemically synthesized
ctattgtttagctaactatgat

SEQ ID NO: 739375 - DNA, 22 bp, Artificial Sequence
  chemically synthesized
ttgtttagctaactatgatccc

SEQ ID NO: 739376 - DNA, 22 bp, Artificial Sequence
  chemically synthesized
tgagaggatgtgatgggatcat

SEQ ID NO: 739377 - DNA, 22 bp, Artificial Sequence
  chemically synthesized
tttagctaactatgatcccatc

SEQ ID NO: 739378 - DNA, 22 bp, Artificial Sequence
  chemically synthesized
gtgagaggatgtgatgggatca

SEQ ID NO: 739379 - DNA, 22 bp, Artificial Sequence
  chemically synthesized
tgtgagaggatgtgatgggatc

SEQ ID NO: 739380 - DNA, 22 bp, Artificial Sequence
  chemically synthesized
agctaactatgatcccatcaca

SEQ ID NO: 739381 - DNA, 22 bp, Artificial Sequence
  chemically synthesized
gctaactatgatcccatcacat

SEQ ID NO: 739382 - DNA, 22 bp, Artificial Sequence
  chemically synthesized
actatgatcccatcacatcctc

SEQ ID NO: 739383 - DNA, 22 bp, Artificial Sequence
  chemically synthesized
tgatcccatcacatcctctcac

SEQ ID NO: 739384 - DNA, 22 bp, Artificial Sequence
  chemically synthesized
tatagtcatagtagtaagcttt

SEQ ID NO: 739385 - DNA, 22 bp, Artificial Sequence
  chemically synthesized
gtctatatagtcatagtagtaa

SEQ ID NO: 739386 - DNA, 22 bp, Artificial Sequence
  chemically synthesized
ggtctatatagtcatagtagta

SEQ ID NO: 739387 - DNA, 22 bp, Artificial Sequence
  chemically synthesized
tcacaaagcttactactatgac

SEQ ID NO: 739388 - DNA, 22 bp, Artificial Sequence
  chemically synthesized
acaaagcttactactatgacta

SEQ ID NO: 739389 - DNA, 22 bp, Artificial Sequence
  chemically synthesized
gaaacttggtctatatagtcat

SEQ ID NO: 739390 - DNA, 22 bp, Artificial Sequence
  chemically synthesized
ctggaaacttggtctatatagt

SEQ ID NO: 739391 - DNA, 22 bp, Artificial Sequence
  chemically synthesized
actggaaacttggtctatatag

SEQ ID NO: 739392 - DNA, 22 bp, Artificial Sequence
  chemically synthesized
actactatgactatatagacca

SEQ ID NO: 739393 - DNA, 22 bp, Artificial Sequence
  chemically synthesized
ttactggaaacttggtctatat

SEQ ID NO: 739394 - DNA, 22 bp, Artificial Sequence
  chemically synthesized
ctactatgactatatagaccaa

SEQ ID NO: 739395 - DNA, 22 bp, Artificial Sequence
  chemically synthesized
cttactggaaacttggtctata

SEQ ID NO: 739396 - DNA, 22 bp, Artificial Sequence
  chemically synthesized
ctatgactatatagaccaagtt

SEQ ID NO: 739397 - DNA, 22 bp, Artificial Sequence
  chemically synthesized
tgactatatagaccaagtttcc

SEQ ID NO: 739398 - DNA, 22 bp, Artificial Sequence
  chemically synthesized
aataatttcttactggaaactt

SEQ ID NO: 739399 - DNA, 22 bp, Artificial Sequence
  chemically synthesized
ttcaataatttcttactggaaa

SEQ ID NO: 739400 - DNA, 22 bp, Artificial Sequence
  chemically synthesized
tatagaccaagtttccagtaag

SEQ ID NO: 739401 - DNA, 22 bp, Artificial Sequence
  chemically synthesized
caaattattcaataatttctta

SEQ ID NO: 739402 - DNA, 22 bp, Artificial Sequence
  chemically synthesized
acaaattattcaataatttctt

SEQ ID NO: 739403 - DNA, 22 bp, Artificial Sequence
  chemically synthesized
gtttacaaattattcaataatt

SEQ ID NO: 739404 - DNA, 22 bp, Artificial Sequence
  chemically synthesized
tggtttacaaattattcaataa

SEQ ID NO: 739405 - DNA, 22 bp, Artificial Sequence
  chemically synthesized
ccagtaagaaattattgaataa

SEQ ID NO: 739406 - DNA, 22 bp, Artificial Sequence
  chemically synthesized
cagtaagaaattattgaataat

SEQ ID NO: 739407 - DNA, 22 bp, Artificial Sequence
  chemically synthesized
tctctggtttacaaattattca

SEQ ID NO: 739408 - DNA, 22 bp, Artificial Sequence
  chemically synthesized
ttatctctggtttacaaattat

SEQ ID NO: 739409 - DNA, 22 bp, Artificial Sequence
  chemically synthesized
ttgaataatttgtaaaccagag

SEQ ID NO: 739410 - DNA, 22 bp, Artificial Sequence
  chemically synthesized
aataatttgtaaaccagagata

SEQ ID NO: 739411 - DNA, 22 bp, Artificial Sequence
  chemically synthesized
caaaagcagtacccattattat

SEQ ID NO: 739412 - DNA, 22 bp, Artificial Sequence
  chemically synthesized
gtaaaccagagataataatggg

SEQ ID NO: 739413 - DNA, 22 bp, Artificial Sequence
  chemically synthesized
taaaccagagataataatgggt

SEQ ID NO: 739414 - DNA, 22 bp, Artificial Sequence
  chemically synthesized
atactacaaaagcagtacccat

SEQ ID NO: 739415 - DNA, 22 bp, Artificial Sequence
  chemically synthesized
tcataacactgatactacaaaa

SEQ ID NO: 739416 - DNA, 22 bp, Artificial Sequence
  chemically synthesized
catactatcataacactgatac

SEQ ID NO: 739417 - DNA, 22 bp, Artificial Sequence
  chemically synthesized
acatactatcataacactgata

SEQ ID NO: 739418 - DNA, 22 bp, Artificial Sequence
  chemically synthesized
cttttgtagtatcagtgttatg

SEQ ID NO: 739419 - DNA, 22 bp, Artificial Sequence
  chemically synthesized
ttgtagtatcagtgttatgata

SEQ ID NO: 739420 - DNA, 22 bp, Artificial Sequence
  chemically synthesized
tgtagtatcagtgttatgatag

SEQ ID NO: 739421 - DNA, 22 bp, Artificial Sequence
  chemically synthesized
gtagtatcagtgttatgatagt

SEQ ID NO: 739422 - DNA, 22 bp, Artificial Sequence
  chemically synthesized
tagtatcagtgttatgatagta

SEQ ID NO: 739423 - DNA, 22 bp, Artificial Sequence
  chemically synthesized
aaaaccagaaatatacatactt

SEQ ID NO: 739424 - DNA, 22 bp, Artificial Sequence
  chemically synthesized
tgatagtatgtaagtatgtata

SEQ ID NO: 739425 - DNA, 22 bp, Artificial Sequence
  chemically synthesized
agtgttaaaaaccagaaatata

SEQ ID NO: 739426 - DNA, 22 bp, Artificial Sequence
  chemically synthesized
tcagtgttaaaaaccagaaata

SEQ ID NO: 739427 - DNA, 22 bp, Artificial Sequence
  chemically synthesized
ctcagtgttaaaaaccagaaat

SEQ ID NO: 739428 - DNA, 22 bp, Artificial Sequence
  chemically synthesized
tctcagtgttaaaaaccagaaa

SEQ ID NO: 739429 - DNA, 22 bp, Artificial Sequence
  chemically synthesized
atcctttctcagtgttaaaaac

SEQ ID NO: 739430 - DNA, 22 bp, Artificial Sequence
  chemically synthesized
tcatcctttctcagtgttaaaa

SEQ ID NO: 739431 - DNA, 22 bp, Artificial Sequence
  chemically synthesized
ctggtttttaacactgagaaag

SEQ ID NO: 739432 - DNA, 22 bp, Artificial Sequence
  chemically synthesized
tggtttttaacactgagaaagg

SEQ ID NO: 739433 - DNA, 22 bp, Artificial Sequence
  chemically synthesized
gtttttaacactgagaaaggat

SEQ ID NO: 739434 - DNA, 22 bp, Artificial Sequence
  chemically synthesized
ttaacactgagaaaggatgaga

SEQ ID NO: 739435 - DNA, 22 bp, Artificial Sequence
  chemically synthesized
taacactgagaaaggatgagag

SEQ ID NO: 739436 - DNA, 22 bp, Artificial Sequence
  chemically synthesized
aacactgagaaaggatgagagg

SEQ ID NO: 739437 - DNA, 22 bp, Artificial Sequence
  chemically synthesized
acactgagaaaggatgagaggg

SEQ ID NO: 739438 - DNA, 22 bp, Artificial Sequence
  chemically synthesized
catgatggcccacccctctcat

SEQ ID NO: 739439 - DNA, 22 bp, Artificial Sequence
  chemically synthesized
ccatgatggcccacccctctca

SEQ ID NO: 739440 - DNA, 22 bp, Artificial Sequence
  chemically synthesized
cttccatgatggcccacccctc

SEQ ID NO: 739441 - DNA, 22 bp, Artificial Sequence
  chemically synthesized
agaaaggatgagaggggtgggc

SEQ ID NO: 739442 - DNA, 22 bp, Artificial Sequence
  chemically synthesized
ttacttccatgatggcccaccc

SEQ ID NO: 739443 - DNA, 22 bp, Artificial Sequence
  chemically synthesized
attacttccatgatggcccacc

SEQ ID NO: 739444 - DNA, 22 bp, Artificial Sequence
  chemically synthesized
tattacttccatgatggcccac

SEQ ID NO: 739445 - DNA, 22 bp, Artificial Sequence
  chemically synthesized
ttattacttccatgatggccca

SEQ ID NO: 739446 - DNA, 22 bp, Artificial Sequence
  chemically synthesized
ttttattacttccatgatggcc

SEQ ID NO: 739447 - DNA, 22 bp, Artificial Sequence
  chemically synthesized
tcttttattacttccatgatgg

SEQ ID NO: 739448 - DNA, 22 bp, Artificial Sequence
  chemically synthesized
aagatgggttctcttttattac

SEQ ID NO: 739449 - DNA, 22 bp, Artificial Sequence
  chemically synthesized
aaagatgggttctcttttatta

SEQ ID NO: 739450 - DNA, 22 bp, Artificial Sequence
  chemically synthesized
taaagatgggttctcttttatt

SEQ ID NO: 739451 - DNA, 22 bp, Artificial Sequence
  chemically synthesized
agtaaagctttaaagatgggtt

SEQ ID NO: 739452 - DNA, 22 bp, Artificial Sequence
  chemically synthesized
tattaagtaaagctttaaagat

SEQ ID NO: 739453 - DNA, 22 bp, Artificial Sequence
  chemically synthesized
tgctatattaagtaaagcttta

SEQ ID NO: 739454 - DNA, 22 bp, Artificial Sequence
  chemically synthesized
atgctatattaagtaaagcttt

SEQ ID NO: 739455 - DNA, 22 bp, Artificial Sequence
  chemically synthesized
cttatgctatattaagtaaagc

SEQ ID NO: 739456 - DNA, 22 bp, Artificial Sequence
  chemically synthesized
ctgcttatgctatattaagtaa

SEQ ID NO: 739457 - DNA, 22 bp, Artificial Sequence
  chemically synthesized
actgcttatgctatattaagta

SEQ ID NO: 739458 - DNA, 22 bp, Artificial Sequence
  chemically synthesized
tactgcttatgctatattaagt

SEQ ID NO: 739459 - DNA, 22 bp, Artificial Sequence
  chemically synthesized
taaagctttacttaatatagca

SEQ ID NO: 739460 - DNA, 22 bp, Artificial Sequence
  chemically synthesized
aaagctttacttaatatagcat

SEQ ID NO: 739461 - DNA, 22 bp, Artificial Sequence
  chemically synthesized
cctttactgcttatgctatatt

SEQ ID NO: 739462 - DNA, 22 bp, Artificial Sequence
  chemically synthesized
aagctttacttaatatagcata

SEQ ID NO: 739463 - DNA, 22 bp, Artificial Sequence
  chemically synthesized
tacttaatatagcataagcagt

SEQ ID NO: 739464 - DNA, 22 bp, Artificial Sequence
  chemically synthesized
acttaatatagcataagcagta

SEQ ID NO: 739465 - DNA, 22 bp, Artificial Sequence
  chemically synthesized
cttaatatagcataagcagtaa

SEQ ID NO: 739466 - DNA, 22 bp, Artificial Sequence
  chemically synthesized
aacaaaactccctttactgctt

SEQ ID NO: 739467 - DNA, 22 bp, Artificial Sequence
  chemically synthesized
aatatagcataagcagtaaagg

SEQ ID NO: 739468 - DNA, 22 bp, Artificial Sequence
  chemically synthesized
atatagcataagcagtaaaggg

SEQ ID NO: 739469 - DNA, 22 bp, Artificial Sequence
  chemically synthesized
gtccaaggacatactaaacaaa

SEQ ID NO: 739470 - DNA, 22 bp, Artificial Sequence
  chemically synthesized
ggtccaaggacatactaaacaa

SEQ ID NO: 739471 - DNA, 22 bp, Artificial Sequence
  chemically synthesized
tttggtccaaggacatactaaa

SEQ ID NO: 739472 - DNA, 22 bp, Artificial Sequence
  chemically synthesized
tgtttagtatgtccttggacca

SEQ ID NO: 739473 - DNA, 22 bp, Artificial Sequence
  chemically synthesized
gtttagtatgtccttggaccaa

SEQ ID NO: 739474 - DNA, 22 bp, Artificial Sequence
  chemically synthesized
taatgatcctgtttggtccaag

SEQ ID NO: 739475 - DNA, 22 bp, Artificial Sequence
  chemically synthesized
tttagtatgtccttggaccaaa

SEQ ID NO: 739476 - DNA, 22 bp, Artificial Sequence
  chemically synthesized
agtatgtccttggaccaaacag

SEQ ID NO: 739477 - DNA, 22 bp, Artificial Sequence
  chemically synthesized
gtatgtccttggaccaaacagg

SEQ ID NO: 739478 - DNA, 22 bp, Artificial Sequence
  chemically synthesized
gaagacattgtaatgatcctgt

SEQ ID NO: 739479 - DNA, 22 bp, Artificial Sequence
  chemically synthesized
ggaccaaacaggatcattacaa

SEQ ID NO: 739480 - DNA, 22 bp, Artificial Sequence
  chemically synthesized
gaccaaacaggatcattacaat

SEQ ID NO: 739481 - DNA, 22 bp, Artificial Sequence
  chemically synthesized
tgtacctagaagacattgtaat

SEQ ID NO: 739482 - DNA, 22 bp, Artificial Sequence
  chemically synthesized
ctgtgtacctagaagacattgt

SEQ ID NO: 739483 - DNA, 22 bp, Artificial Sequence
  chemically synthesized
agcatctactgtgtacctagaa

SEQ ID NO: 739484 - DNA, 22 bp, Artificial Sequence
  chemically synthesized
attgagcatctactgtgtacct

SEQ ID NO: 739485 - DNA, 22 bp, Artificial Sequence
  chemically synthesized
caatgtcttctaggtacacagt

SEQ ID NO: 739486 - DNA, 22 bp, Artificial Sequence
  chemically synthesized
ctaggtacacagtagatgctca

SEQ ID NO: 739487 - DNA, 22 bp, Artificial Sequence
  chemically synthesized
taggtacacagtagatgctcaa

SEQ ID NO: 739488 - DNA, 22 bp, Artificial Sequence
  chemically synthesized
agtcagcactgattgagcatct

SEQ ID NO: 739489 - DNA, 22 bp, Artificial Sequence
  chemically synthesized
ggtacacagtagatgctcaatc

SEQ ID NO: 739490 - DNA, 22 bp, Artificial Sequence
  chemically synthesized
attcagtcagcactgattgagc

SEQ ID NO: 739491 - DNA, 22 bp, Artificial Sequence
  chemically synthesized
cattcagtcagcactgattgag

SEQ ID NO: 739492 - DNA, 22 bp, Artificial Sequence
  chemically synthesized
tcattcagtcagcactgattga

SEQ ID NO: 739493 - DNA, 22 bp, Artificial Sequence
  chemically synthesized
tttcattcagtcagcactgatt

SEQ ID NO: 739494 - DNA, 22 bp, Artificial Sequence
  chemically synthesized
ttctttcattcagtcagcactg

SEQ ID NO: 739495 - DNA, 22 bp, Artificial Sequence
  chemically synthesized
gttctttcattcagtcagcact

SEQ ID NO: 739496 - DNA, 22 bp, Artificial Sequence
  chemically synthesized
tgttctttcattcagtcagcac

SEQ ID NO: 739497 - DNA, 22 bp, Artificial Sequence
  chemically synthesized
aatcagtgctgactgaatgaaa

SEQ ID NO: 739498 - DNA, 22 bp, Artificial Sequence
  chemically synthesized
atccctttgttctttcattcag

SEQ ID NO: 739499 - DNA, 22 bp, Artificial Sequence
  chemically synthesized
catccctttgttctttcattca

SEQ ID NO: 739500 - DNA, 22 bp, Artificial Sequence
  chemically synthesized
tcatccctttgttctttcattc

SEQ ID NO: 739501 - DNA, 22 bp, Artificial Sequence
  chemically synthesized
tttcatccctttgttctttcat

SEQ ID NO: 739502 - DNA, 22 bp, Artificial Sequence
  chemically synthesized
ctttcatccctttgttctttca

SEQ ID NO: 739503 - DNA, 22 bp, Artificial Sequence
  chemically synthesized
cttctttcatccctttgttctt

SEQ ID NO: 739504 - DNA, 22 bp, Artificial Sequence
  chemically synthesized
actgaatgaaagaacaaaggga

SEQ ID NO: 739505 - DNA, 22 bp, Artificial Sequence
  chemically synthesized
attccttctttcatccctttgt

SEQ ID NO: 739506 - DNA, 22 bp, Artificial Sequence
  chemically synthesized
cattccttctttcatccctttg

SEQ ID NO: 739507 - DNA, 22 bp, Artificial Sequence
  chemically synthesized
aatgaaagaacaaagggatgaa

SEQ ID NO: 739508 - DNA, 22 bp, Artificial Sequence
  chemically synthesized
caaacttcattccttctttcat

SEQ ID NO: 739509 - DNA, 22 bp, Artificial Sequence
  chemically synthesized
gcaaacttcattccttctttca

SEQ ID NO: 739510 - DNA, 22 bp, Artificial Sequence
  chemically synthesized
tgcaaacttcattccttctttc

SEQ ID NO: 739511 - DNA, 22 bp, Artificial Sequence
  chemically synthesized
ttgcaaacttcattccttcttt

SEQ ID NO: 739512 - DNA, 22 bp, Artificial Sequence
  chemically synthesized
atcttttgcaaacttcattcct

SEQ ID NO: 739513 - DNA, 22 bp, Artificial Sequence
  chemically synthesized
gagcctcatcttttgcaaactt

SEQ ID NO: 739514 - DNA, 22 bp, Artificial Sequence
  chemically synthesized
tcgcagggatctagagcctcat

SEQ ID NO: 739515 - DNA, 22 bp, Artificial Sequence
  chemically synthesized
ctgtcgcagggatctagagcct

SEQ ID NO: 739516 - DNA, 22 bp, Artificial Sequence
  chemically synthesized
gctgtcgcagggatctagagcc

SEQ ID NO: 739517 - DNA, 22 bp, Artificial Sequence
  chemically synthesized
gcaaaagatgaggctctagatc

SEQ ID NO: 739518 - DNA, 22 bp, Artificial Sequence
  chemically synthesized
caaaagatgaggctctagatcc

SEQ ID NO: 739519 - DNA, 22 bp, Artificial Sequence
  chemically synthesized
tggtaacttgctgtcgcaggga

SEQ ID NO: 739520 - DNA, 22 bp, Artificial Sequence
  chemically synthesized
tgtggtaacttgctgtcgcagg

SEQ ID NO: 739521 - DNA, 22 bp, Artificial Sequence
  chemically synthesized
tagatccctgcgacagcaagtt

SEQ ID NO: 739522 - DNA, 22 bp, Artificial Sequence
  chemically synthesized
gatccctgcgacagcaagttac

SEQ ID NO: 739523 - DNA, 22 bp, Artificial Sequence
  chemically synthesized
tatacctctgtggtaacttgct

SEQ ID NO: 739524 - DNA, 22 bp, Artificial Sequence
  chemically synthesized
catctgtatacctctgtggtaa

SEQ ID NO: 739525 - DNA, 22 bp, Artificial Sequence
  chemically synthesized
cgacagcaagttaccacagagg

SEQ ID NO: 739526 - DNA, 22 bp, Artificial Sequence
  chemically synthesized
cactccatctgtatacctctgt

SEQ ID NO: 739527 - DNA, 22 bp, Artificial Sequence
  chemically synthesized
ccacagaggtatacagatggag

SEQ ID NO: 739528 - DNA, 22 bp, Artificial Sequence
  chemically synthesized
caaagtcatgtagacatcatta

SEQ ID NO: 739529 - DNA, 22 bp, Artificial Sequence
  chemically synthesized
ccaaagtcatgtagacatcatt

SEQ ID NO: 739530 - DNA, 22 bp, Artificial Sequence
  chemically synthesized
ttccaaagtcatgtagacatca

SEQ ID NO: 739531 - DNA, 22 bp, Artificial Sequence
  chemically synthesized
cttccaaagtcatgtagacatc

SEQ ID NO: 739532 - DNA, 22 bp, Artificial Sequence
  chemically synthesized
agcttcttccaaagtcatgtag

SEQ ID NO: 739533 - DNA, 22 bp, Artificial Sequence
  chemically synthesized
ctaagcttcttccaaagtcatg

SEQ ID NO: 739534 - DNA, 22 bp, Artificial Sequence
  chemically synthesized
cctaagcttcttccaaagtcat

SEQ ID NO: 739535 - DNA, 22 bp, Artificial Sequence
  chemically synthesized
aaggtttcctaagcttcttcca

SEQ ID NO: 739536 - DNA, 22 bp, Artificial Sequence
  chemically synthesized
aaaggtttcctaagcttcttcc

SEQ ID NO: 739537 - DNA, 22 bp, Artificial Sequence
  chemically synthesized
taaaggtttcctaagcttcttc

SEQ ID NO: 739538 - DNA, 22 bp, Artificial Sequence
  chemically synthesized
ttaaaggtttcctaagcttctt

SEQ ID NO: 739539 - DNA, 22 bp, Artificial Sequence
  chemically synthesized
catgactttggaagaagcttag

SEQ ID NO: 739540 - DNA, 22 bp, Artificial Sequence
  chemically synthesized
tttaaaggtttcctaagcttct

SEQ ID NO: 739541 - DNA, 22 bp, Artificial Sequence
  chemically synthesized
tggaagaagcttaggaaacctt

SEQ ID NO: 739542 - DNA, 22 bp, Artificial Sequence
  chemically synthesized
ggaagaagcttaggaaaccttt

SEQ ID NO: 739543 - DNA, 22 bp, Artificial Sequence
  chemically synthesized
tgtatgttttttaaaggtttcc

SEQ ID NO: 739544 - DNA, 22 bp, Artificial Sequence
  chemically synthesized
gaagaagcttaggaaaccttta

SEQ ID NO: 739545 - DNA, 22 bp, Artificial Sequence
  chemically synthesized
aggaaacctttaaaaaacatac

SEQ ID NO: 739546 - DNA, 22 bp, Artificial Sequence
  chemically synthesized
ggaaacctttaaaaaacataca

SEQ ID NO: 739547 - DNA, 22 bp, Artificial Sequence
  chemically synthesized
taaaaaacatacataatttatg

SEQ ID NO: 739548 - DNA, 22 bp, Artificial Sequence
  chemically synthesized
aaaaaacatacataatttatga

SEQ ID NO: 739549 - DNA, 22 bp, Artificial Sequence
  chemically synthesized
aaaaacatacataatttatgat

SEQ ID NO: 739550 - DNA, 22 bp, Artificial Sequence
  chemically synthesized
catatgtcaaagaacagtatca

SEQ ID NO: 739551 - DNA, 22 bp, Artificial Sequence
  chemically synthesized
acatatgtcaaagaacagtatc

SEQ ID NO: 739552 - DNA, 22 bp, Artificial Sequence
  chemically synthesized
tacatatgtcaaagaacagtat

SEQ ID NO: 739553 - DNA, 22 bp, Artificial Sequence
  chemically synthesized
tttacatatgtcaaagaacagt

SEQ ID NO: 739554 - DNA, 22 bp, Artificial Sequence
  chemically synthesized
gattctttacatatgtcaaaga

SEQ ID NO: 739555 - DNA, 22 bp, Artificial Sequence
  chemically synthesized
atgatactgttctttgacatat

SEQ ID NO: 739556 - DNA, 22 bp, Artificial Sequence
  chemically synthesized
tgatactgttctttgacatatg

SEQ ID NO: 739557 - DNA, 22 bp, Artificial Sequence
  chemically synthesized
ttagattctttacatatgtcaa

SEQ ID NO: 739558 - DNA, 22 bp, Artificial Sequence
  chemically synthesized
cagctattagattctttacata

SEQ ID NO: 739559 - DNA, 22 bp, Artificial Sequence
  chemically synthesized
ccagctattagattctttacat

SEQ ID NO: 739560 - DNA, 22 bp, Artificial Sequence
  chemically synthesized
ttctttgacatatgtaaagaat

SEQ ID NO: 739561 - DNA, 22 bp, Artificial Sequence
  chemically synthesized
tttgacatatgtaaagaatcta

SEQ ID NO: 739562 - DNA, 22 bp, Artificial Sequence
  chemically synthesized
tgacatatgtaaagaatctaat

SEQ ID NO: 739563 - DNA, 22 bp, Artificial Sequence
  chemically synthesized
gacatatgtaaagaatctaata

SEQ ID NO: 739564 - DNA, 22 bp, Artificial Sequence
  chemically synthesized
acatatgtaaagaatctaatag

SEQ ID NO: 739565 - DNA, 22 bp, Artificial Sequence
  chemically synthesized
aataatatgaaggcatttccag

SEQ ID NO: 739566 - DNA, 22 bp, Artificial Sequence
  chemically synthesized
aaatctgaataatatgaaggca

SEQ ID NO: 739567 - DNA, 22 bp, Artificial Sequence
  chemically synthesized
atagctggaaatgccttcatat

SEQ ID NO: 739568 - DNA, 22 bp, Artificial Sequence
  chemically synthesized
aaaatctgaataatatgaaggc

SEQ ID NO: 739569 - DNA, 22 bp, Artificial Sequence
  chemically synthesized
taaaatctgaataatatgaagg

SEQ ID NO: 739570 - DNA, 22 bp, Artificial Sequence
  chemically synthesized
gaaatgccttcatattattcag

SEQ ID NO: 739571 - DNA, 22 bp, Artificial Sequence
  chemically synthesized
catattattcagattttaaagg

SEQ ID NO: 739572 - DNA, 22 bp, Artificial Sequence
  chemically synthesized
atattattcagattttaaaggt

SEQ ID NO: 739573 - DNA, 22 bp, Artificial Sequence
  chemically synthesized
atggaatgcaaacacctttaaa

SEQ ID NO: 739574 - DNA, 22 bp, Artificial Sequence
  chemically synthesized
ttcagattttaaaggtgtttgc

SEQ ID NO: 739575 - DNA, 22 bp, Artificial Sequence
  chemically synthesized
agattttaaaggtgtttgcatt

SEQ ID NO: 739576 - DNA, 22 bp, Artificial Sequence
  chemically synthesized
taggaactcatggaatgcaaac

SEQ ID NO: 739577 - DNA, 22 bp, Artificial Sequence
  chemically synthesized
actgtaggaactcatggaatgc

SEQ ID NO: 739578 - DNA, 22 bp, Artificial Sequence
  chemically synthesized
taaaggtgtttgcattccatga

SEQ ID NO: 739579 - DNA, 22 bp, Artificial Sequence
  chemically synthesized
aaaggtgtttgcattccatgag

SEQ ID NO: 739580 - DNA, 22 bp, Artificial Sequence
  chemically synthesized
aaggtgtttgcattccatgagt

SEQ ID NO: 739581 - DNA, 22 bp, Artificial Sequence
  chemically synthesized
ttgactgtaggaactcatggaa

SEQ ID NO: 739582 - DNA, 22 bp, Artificial Sequence
  chemically synthesized
attgactgtaggaactcatgga

SEQ ID NO: 739583 - DNA, 22 bp, Artificial Sequence
  chemically synthesized
tattgactgtaggaactcatgg

SEQ ID NO: 739584 - DNA, 22 bp, Artificial Sequence
  chemically synthesized
ttttattgactgtaggaactca

SEQ ID NO: 739585 - DNA, 22 bp, Artificial Sequence
  chemically synthesized
gttttattgactgtaggaactc

SEQ ID NO: 739586 - DNA, 22 bp, Artificial Sequence
  chemically synthesized
gcattccatgagttcctacagt

SEQ ID NO: 739587 - DNA, 22 bp, Artificial Sequence
  chemically synthesized
cattccatgagttcctacagtc

SEQ ID NO: 739588 - DNA, 22 bp, Artificial Sequence
  chemically synthesized
catgagttcctacagtcaataa

SEQ ID NO: 739589 - DNA, 22 bp, Artificial Sequence
  chemically synthesized
acataaggagtatttgttttat

SEQ ID NO: 739590 - DNA, 22 bp, Artificial Sequence
  chemically synthesized
aacataaggagtatttgtttta

SEQ ID NO: 739591 - DNA, 22 bp, Artificial Sequence
  chemically synthesized
taacataaggagtatttgtttt

SEQ ID NO: 739592 - DNA, 22 bp, Artificial Sequence
  chemically synthesized
ctacagtcaataaaacaaatac

SEQ ID NO: 739593 - DNA, 22 bp, Artificial Sequence
  chemically synthesized
cagtcaataaaacaaatactcc

SEQ ID NO: 739594 - DNA, 22 bp, Artificial Sequence
  chemically synthesized
caaaaacactttaacataagga

SEQ ID NO: 739595 - DNA, 22 bp, Artificial Sequence
  chemically synthesized
cttatgttaaagtgtttttgca

SEQ ID NO: 739596 - DNA, 22 bp, Artificial Sequence
  chemically synthesized
atgttaaagtgtttttgcagct

SEQ ID NO: 739597 - DNA, 22 bp, Artificial Sequence
  chemically synthesized
tgttaaagtgtttttgcagctt

SEQ ID NO: 739598 - DNA, 22 bp, Artificial Sequence
  chemically synthesized
aagtgtttttgcagcttttgtg

SEQ ID NO: 739599 - DNA, 22 bp, Artificial Sequence
  chemically synthesized
ttgcagcttttgtgctatttgt

SEQ ID NO: 739600 - DNA, 22 bp, Artificial Sequence
  chemically synthesized
atgagtaaacccacaaatagca

SEQ ID NO: 739601 - DNA, 22 bp, Artificial Sequence
  chemically synthesized
tgcagcttttgtgctatttgtg

SEQ ID NO: 739602 - DNA, 22 bp, Artificial Sequence
  chemically synthesized
gcagcttttgtgctatttgtgg

SEQ ID NO: 739603 - DNA, 22 bp, Artificial Sequence
  chemically synthesized
cagcttttgtgctatttgtggg

SEQ ID NO: 739604 - DNA, 22 bp, Artificial Sequence
  chemically synthesized
ctcatgagtaaacccacaaata

SEQ ID NO: 739605 - DNA, 22 bp, Artificial Sequence
  chemically synthesized
actcatgagtaaacccacaaat

SEQ ID NO: 739606 - DNA, 22 bp, Artificial Sequence
  chemically synthesized
tactcatgagtaaacccacaaa

SEQ ID NO: 739607 - DNA, 22 bp, Artificial Sequence
  chemically synthesized
tttactcatgagtaaacccaca

SEQ ID NO: 739608 - DNA, 22 bp, Artificial Sequence
  chemically synthesized
ctttactcatgagtaaacccac

SEQ ID NO: 739609 - DNA, 22 bp, Artificial Sequence
  chemically synthesized
ttgtgctatttgtgggtttact

SEQ ID NO: 739610 - DNA, 22 bp, Artificial Sequence
  chemically synthesized
tctttactcatgagtaaaccca

SEQ ID NO: 739611 - DNA, 22 bp, Artificial Sequence
  chemically synthesized
tgtgctatttgtgggtttactc

SEQ ID NO: 739612 - DNA, 22 bp, Artificial Sequence
  chemically synthesized
ttctttactcatgagtaaaccc

SEQ ID NO: 739613 - DNA, 22 bp, Artificial Sequence
  chemically synthesized
gtgctatttgtgggtttactca

SEQ ID NO: 739614 - DNA, 22 bp, Artificial Sequence
  chemically synthesized
tgctatttgtgggtttactcat

SEQ ID NO: 739615 - DNA, 22 bp, Artificial Sequence
  chemically synthesized
tttgtgggtttactcatgagta

SEQ ID NO: 739616 - DNA, 22 bp, Artificial Sequence
  chemically synthesized
taccatttttctttactcatga

SEQ ID NO: 739617 - DNA, 22 bp, Artificial Sequence
  chemically synthesized
gtgggtttactcatgagtaaag

SEQ ID NO: 739618 - DNA, 22 bp, Artificial Sequence
  chemically synthesized
tgggtttactcatgagtaaaga

SEQ ID NO: 739619 - DNA, 22 bp, Artificial Sequence
  chemically synthesized
actcatgagtaaagaaaaatgg

SEQ ID NO: 739620 - DNA, 22 bp, Artificial Sequence
  chemically synthesized
ctcatgagtaaagaaaaatggt

SEQ ID NO: 739621 - DNA, 22 bp, Artificial Sequence
  chemically synthesized
atgagtaaagaaaaatggtata

SEQ ID NO: 739622 - DNA, 22 bp, Artificial Sequence
  chemically synthesized
accaagcgcaagtagtatataa

SEQ ID NO: 739623 - DNA, 22 bp, Artificial Sequence
  chemically synthesized
ttcaccaagcgcaagtagtata

SEQ ID NO: 739624 - DNA, 22 bp, Artificial Sequence
  chemically synthesized
attcaccaagcgcaagtagtat

SEQ ID NO: 739625 - DNA, 22 bp, Artificial Sequence
  chemically synthesized
tattcaccaagcgcaagtagta

SEQ ID NO: 739626 - DNA, 22 bp, Artificial Sequence
  chemically synthesized
tttattcaccaagcgcaagtag

SEQ ID NO: 739627 - DNA, 22 bp, Artificial Sequence
  chemically synthesized
ctttatatactacttgcgcttg

SEQ ID NO: 739628 - DNA, 22 bp, Artificial Sequence
  chemically synthesized
tatatactacttgcgcttggtg

SEQ ID NO: 739629 - DNA, 22 bp, Artificial Sequence
  chemically synthesized
atatactacttgcgcttggtga

SEQ ID NO: 739630 - DNA, 22 bp, Artificial Sequence
  chemically synthesized
tatactacttgcgcttggtgaa

SEQ ID NO: 739631 - DNA, 22 bp, Artificial Sequence
  chemically synthesized
cttgcgcttggtgaataaagag

SEQ ID NO: 739632 - DNA, 22 bp, Artificial Sequence
  chemically synthesized
gcgcttggtgaataaagagatt

SEQ ID NO: 739633 - DNA, 22 bp, Artificial Sequence
  chemically synthesized
agtaatgcagtcaatctcttta

SEQ ID NO: 739634 - DNA, 22 bp, Artificial Sequence
  chemically synthesized
cgcttggtgaataaagagattg

SEQ ID NO: 739635 - DNA, 22 bp, Artificial Sequence
  chemically synthesized
ggtgaataaagagattgactgc

SEQ ID NO: 739636 - DNA, 22 bp, Artificial Sequence
  chemically synthesized
gtgaataaagagattgactgca

SEQ ID NO: 739637 - DNA, 22 bp, Artificial Sequence
  chemically synthesized
aaatagtacacacactgagtaa

SEQ ID NO: 739638 - DNA, 22 bp, Artificial Sequence
  chemically synthesized
gaaatagtacacacactgagta

SEQ ID NO: 739639 - DNA, 22 bp, Artificial Sequence
  chemically synthesized
tgaaatagtacacacactgagt

SEQ ID NO: 739640 - DNA, 22 bp, Artificial Sequence
  chemically synthesized
actgcattactcagtgtgtgta

SEQ ID NO: 739641 - DNA, 22 bp, Artificial Sequence
  chemically synthesized
attttgaaatagtacacacact

SEQ ID NO: 739642 - DNA, 22 bp, Artificial Sequence
  chemically synthesized
taattttgaaatagtacacaca

SEQ ID NO: 739643 - DNA, 22 bp, Artificial Sequence
  chemically synthesized
ctaattttgaaatagtacacac

SEQ ID NO: 739644 - DNA, 22 bp, Artificial Sequence
  chemically synthesized
cattactcagtgtgtgtactat

SEQ ID NO: 739645 - DNA, 22 bp, Artificial Sequence
  chemically synthesized
tctaattttgaaatagtacaca

SEQ ID NO: 739646 - DNA, 22 bp, Artificial Sequence
  chemically synthesized
ctcagtgtgtgtactatttcaa

SEQ ID NO: 739647 - DNA, 22 bp, Artificial Sequence
  chemically synthesized
agtgtgtgtactatttcaaaat

SEQ ID NO: 739648 - DNA, 22 bp, Artificial Sequence
  chemically synthesized
aaatgatgataaacctttctaa

SEQ ID NO: 739649 - DNA, 22 bp, Artificial Sequence
  chemically synthesized
tttcaaaattagaaaggtttat

SEQ ID NO: 739650 - DNA, 22 bp, Artificial Sequence
  chemically synthesized
caaaattagaaaggtttatcat

SEQ ID NO: 739651 - DNA, 22 bp, Artificial Sequence
  chemically synthesized
aaaattagaaaggtttatcatc

SEQ ID NO: 739652 - DNA, 22 bp, Artificial Sequence
  chemically synthesized
gaaaggtttatcatcattttaa

SEQ ID NO: 739653 - DNA, 22 bp, Artificial Sequence
  chemically synthesized
aaccaggtgagaaaaaagttaa

SEQ ID NO: 739654 - DNA, 22 bp, Artificial Sequence
  chemically synthesized
atcatcattttaacttttttct

SEQ ID NO: 739655 - DNA, 22 bp, Artificial Sequence
  chemically synthesized
tcatcattttaacttttttctc

SEQ ID NO: 739656 - DNA, 22 bp, Artificial Sequence
  chemically synthesized
taacttttttctcacctggttt

SEQ ID NO: 739657 - DNA, 22 bp, Artificial Sequence
  chemically synthesized
aacttttttctcacctggttta

SEQ ID NO: 739658 - DNA, 22 bp, Artificial Sequence
  chemically synthesized
acttttttctcacctggtttag

SEQ ID NO: 739659 - DNA, 22 bp, Artificial Sequence
  chemically synthesized
ttttctcacctggtttagatat

SEQ ID NO: 739660 - DNA, 22 bp, Artificial Sequence
  chemically synthesized
tttctcacctggtttagatatt

SEQ ID NO: 739661 - DNA, 22 bp, Artificial Sequence
  chemically synthesized
ttctcacctggtttagatattc

SEQ ID NO: 739662 - DNA, 22 bp, Artificial Sequence
  chemically synthesized
tctcacctggtttagatattcg

SEQ ID NO: 739663 - DNA, 22 bp, Artificial Sequence
  chemically synthesized
accaagtagaaacgaatatcta

SEQ ID NO: 739664 - DNA, 22 bp, Artificial Sequence
  chemically synthesized
ctcacctggtttagatattcgt

SEQ ID NO: 739665 - DNA, 22 bp, Artificial Sequence
  chemically synthesized
gaccaagtagaaacgaatatct

SEQ ID NO: 739666 - DNA, 22 bp, Artificial Sequence
  chemically synthesized
tcacctggtttagatattcgtt

SEQ ID NO: 739667 - DNA, 22 bp, Artificial Sequence
  chemically synthesized
acctggtttagatattcgtttc

SEQ ID NO: 739668 - DNA, 22 bp, Artificial Sequence
  chemically synthesized
atatttgaccaagtagaaacga

SEQ ID NO: 739669 - DNA, 22 bp, Artificial Sequence
  chemically synthesized
gtttagatattcgtttctactt

SEQ ID NO: 739670 - DNA, 22 bp, Artificial Sequence
  chemically synthesized
agatattcgtttctacttggtc

SEQ ID NO: 739671 - DNA, 22 bp, Artificial Sequence
  chemically synthesized
atgctaatatttgaccaagtag

SEQ ID NO: 739672 - DNA, 22 bp, Artificial Sequence
  chemically synthesized
gatattcgtttctacttggtca

SEQ ID NO: 739673 - DNA, 22 bp, Artificial Sequence
  chemically synthesized
gtttctacttggtcaaatatta

SEQ ID NO: 739674 - DNA, 22 bp, Artificial Sequence
  chemically synthesized
aagccaaactaatgctaatatt

SEQ ID NO: 739675 - DNA, 22 bp, Artificial Sequence
  chemically synthesized
ctacttggtcaaatattagcat

SEQ ID NO: 739676 - DNA, 22 bp, Artificial Sequence
  chemically synthesized
aaagccaaactaatgctaatat

SEQ ID NO: 739677 - DNA, 22 bp, Artificial Sequence
  chemically synthesized
tacttggtcaaatattagcatt

SEQ ID NO: 739678 - DNA, 22 bp, Artificial Sequence
  chemically synthesized
ttaaagccaaactaatgctaat

SEQ ID NO: 739679 - DNA, 22 bp, Artificial Sequence
  chemically synthesized
cttggtcaaatattagcattag

SEQ ID NO: 739680 - DNA, 22 bp, Artificial Sequence
  chemically synthesized
ggtcaaatattagcattagttt

SEQ ID NO: 739681 - DNA, 22 bp, Artificial Sequence
  chemically synthesized
gtcaaatattagcattagtttg

SEQ ID NO: 739682 - DNA, 22 bp, Artificial Sequence
  chemically synthesized
agtgaatcagctcttaaagcca

SEQ ID NO: 739683 - DNA, 22 bp, Artificial Sequence
  chemically synthesized
cagtgaatcagctcttaaagcc

SEQ ID NO: 739684 - DNA, 22 bp, Artificial Sequence
  chemically synthesized
gcattagtttggctttaagagc

SEQ ID NO: 739685 - DNA, 22 bp, Artificial Sequence
  chemically synthesized
gtttggctttaagagctgattc

SEQ ID NO: 739686 - DNA, 22 bp, Artificial Sequence
  chemically synthesized
ggctttaagagctgattcactg

SEQ ID NO: 739687 - DNA, 22 bp, Artificial Sequence
  chemically synthesized
gctttaagagctgattcactga

SEQ ID NO: 739688 - DNA, 22 bp, Artificial Sequence
  chemically synthesized
taagagctgattcactgaaatc

SEQ ID NO: 739689 - DNA, 22 bp, Artificial Sequence
  chemically synthesized
aagagctgattcactgaaatca

SEQ ID NO: 739690 - DNA, 22 bp, Artificial Sequence
  chemically synthesized
agagctgattcactgaaatcac

SEQ ID NO: 739691 - DNA, 22 bp, Artificial Sequence
  chemically synthesized
aaatcagccaaaagtgatttca

SEQ ID NO: 739692 - DNA, 22 bp, Artificial Sequence
  chemically synthesized
tactaaaatcagccaaaagtga

SEQ ID NO: 739693 - DNA, 22 bp, Artificial Sequence
  chemically synthesized
attcactgaaatcacttttggc

SEQ ID NO: 739694 - DNA, 22 bp, Artificial Sequence
  chemically synthesized
actgaaatcacttttggctgat

SEQ ID NO: 739695 - DNA, 22 bp, Artificial Sequence
  chemically synthesized
agcaattgtactaaaatcagcc

SEQ ID NO: 739696 - DNA, 22 bp, Artificial Sequence
  chemically synthesized
aaatcacttttggctgatttta

SEQ ID NO: 739697 - DNA, 22 bp, Artificial Sequence
  chemically synthesized
gaactcagcaattgtactaaaa

SEQ ID NO: 739698 - DNA, 22 bp, Artificial Sequence
  chemically synthesized
agaactcagcaattgtactaaa

SEQ ID NO: 739699 - DNA, 22 bp, Artificial Sequence
  chemically synthesized
tagaactcagcaattgtactaa

SEQ ID NO: 739700 - DNA, 22 bp, Artificial Sequence
  chemically synthesized
ttggctgattttagtacaattg

SEQ ID NO: 739701 - DNA, 22 bp, Artificial Sequence
  chemically synthesized
tggctgattttagtacaattgc

SEQ ID NO: 739702 - DNA, 22 bp, Artificial Sequence
  chemically synthesized
ggctgattttagtacaattgct

SEQ ID NO: 739703 - DNA, 22 bp, Artificial Sequence
  chemically synthesized
cctttagaactcagcaattgta

SEQ ID NO: 739704 - DNA, 22 bp, Artificial Sequence
  chemically synthesized
gctgattttagtacaattgctg

SEQ ID NO: 739705 - DNA, 22 bp, Artificial Sequence
  chemically synthesized
attgcctttagaactcagcaat

SEQ ID NO: 739706 - DNA, 22 bp, Artificial Sequence
  chemically synthesized
attttagtacaattgctgagtt

SEQ ID NO: 739707 - DNA, 22 bp, Artificial Sequence
  chemically synthesized
ctcattgcctttagaactcagc

SEQ ID NO: 739708 - DNA, 22 bp, Artificial Sequence
  chemically synthesized
tagtacaattgctgagttctaa

SEQ ID NO: 739709 - DNA, 22 bp, Artificial Sequence
  chemically synthesized
agtacaattgctgagttctaaa

SEQ ID NO: 739710 - DNA, 22 bp, Artificial Sequence
  chemically synthesized
gtacaattgctgagttctaaag

SEQ ID NO: 739711 - DNA, 22 bp, Artificial Sequence
  chemically synthesized
tattcctcattgcctttagaac

SEQ ID NO: 739712 - DNA, 22 bp, Artificial Sequence
  chemically synthesized
ctgagttctaaaggcaatgagg

SEQ ID NO: 739713 - DNA, 22 bp, Artificial Sequence
  chemically synthesized
aagcattatattcctcattgcc

SEQ ID NO: 739714 - DNA, 22 bp, Artificial Sequence
  chemically synthesized
aaagcattatattcctcattgc

SEQ ID NO: 739715 - DNA, 22 bp, Artificial Sequence
  chemically synthesized
taaagcattatattcctcattg

SEQ ID NO: 739716 - DNA, 22 bp, Artificial Sequence
  chemically synthesized
agttctaaaggcaatgaggaat

SEQ ID NO: 739717 - DNA, 22 bp, Artificial Sequence
  chemically synthesized
taaaggcaatgaggaatataat

SEQ ID NO: 739718 - DNA, 22 bp, Artificial Sequence
  chemically synthesized
aaggcaatgaggaatataatgc

SEQ ID NO: 739719 - DNA, 22 bp, Artificial Sequence
  chemically synthesized
aaatataaaattttaaagcatt

SEQ ID NO: 739720 - DNA, 22 bp, Artificial Sequence
  chemically synthesized
caaatataaaattttaaagcat

SEQ ID NO: 739721 - DNA, 22 bp, Artificial Sequence
  chemically synthesized
tttcaaatataaaattttaaag

SEQ ID NO: 739722 - DNA, 22 bp, Artificial Sequence
  chemically synthesized
gtttcaaatataaaattttaaa

SEQ ID NO: 739723 - DNA, 22 bp, Artificial Sequence
  chemically synthesized
gaaatcacacttgtttcaaata

SEQ ID NO: 739724 - DNA, 22 bp, Artificial Sequence
  chemically synthesized
agaaatcacacttgtttcaaat

SEQ ID NO: 739725 - DNA, 22 bp, Artificial Sequence
  chemically synthesized
taaaattttatatttgaaacaa

SEQ ID NO: 739726 - DNA, 22 bp, Artificial Sequence
  chemically synthesized
aaaattttatatttgaaacaag

SEQ ID NO: 739727 - DNA, 22 bp, Artificial Sequence
  chemically synthesized
aaattttatatttgaaacaagt

SEQ ID NO: 739728 - DNA, 22 bp, Artificial Sequence
  chemically synthesized
tatatttgaaacaagtgtgatt

SEQ ID NO: 739729 - DNA, 22 bp, Artificial Sequence
  chemically synthesized
atatttgaaacaagtgtgattt

SEQ ID NO: 739730 - DNA, 22 bp, Artificial Sequence
  chemically synthesized
tatttgaaacaagtgtgatttc

SEQ ID NO: 739731 - DNA, 22 bp, Artificial Sequence
  chemically synthesized
agtgtaccccttagaaatcaca

SEQ ID NO: 739732 - DNA, 22 bp, Artificial Sequence
  chemically synthesized
gaaacaagtgtgatttctaagg

SEQ ID NO: 739733 - DNA, 22 bp, Artificial Sequence
  chemically synthesized
aaacaagtgtgatttctaaggg

SEQ ID NO: 739734 - DNA, 22 bp, Artificial Sequence
  chemically synthesized
atgaacccagttcagtgtaccc

SEQ ID NO: 739735 - DNA, 22 bp, Artificial Sequence
  chemically synthesized
ctaaggggtacactgaactggg

SEQ ID NO: 739736 - DNA, 22 bp, Artificial Sequence
  chemically synthesized
taaggggtacactgaactgggt

SEQ ID NO: 739737 - DNA, 22 bp, Artificial Sequence
  chemically synthesized
aggggtacactgaactgggttc

SEQ ID NO: 739738 - DNA, 22 bp, Artificial Sequence
  chemically synthesized
taaaccaatggattaatgaacc

SEQ ID NO: 739739 - DNA, 22 bp, Artificial Sequence
  chemically synthesized
ataaaccaatggattaatgaac

SEQ ID NO: 739740 - DNA, 22 bp, Artificial Sequence
  chemically synthesized
tataaaccaatggattaatgaa

SEQ ID NO: 739741 - DNA, 22 bp, Artificial Sequence
  chemically synthesized
ttataaaccaatggattaatga

SEQ ID NO: 739742 - DNA, 22 bp, Artificial Sequence
  chemically synthesized
cttttataaaccaatggattaa

SEQ ID NO: 739743 - DNA, 22 bp, Artificial Sequence
  chemically synthesized
aactgggttcattaatccattg

SEQ ID NO: 739744 - DNA, 22 bp, Artificial Sequence
  chemically synthesized
ccttttataaaccaatggatta

SEQ ID NO: 739745 - DNA, 22 bp, Artificial Sequence
  chemically synthesized
ggttcattaatccattggttta

SEQ ID NO: 739746 - DNA, 22 bp, Artificial Sequence
  chemically synthesized
aatcttccttttataaaccaat

SEQ ID NO: 739747 - DNA, 22 bp, Artificial Sequence
  chemically synthesized
aaatcttccttttataaaccaa

SEQ ID NO: 739748 - DNA, 22 bp, Artificial Sequence
  chemically synthesized
taaatcttccttttataaacca

SEQ ID NO: 739749 - DNA, 22 bp, Artificial Sequence
  chemically synthesized
ttaaatcttccttttataaacc

SEQ ID NO: 739750 - DNA, 22 bp, Artificial Sequence
  chemically synthesized
attaatccattggtttataaaa

SEQ ID NO: 739751 - DNA, 22 bp, Artificial Sequence
  chemically synthesized
acttttaaatcttccttttata

SEQ ID NO: 739752 - DNA, 22 bp, Artificial Sequence
  chemically synthesized
atccattggtttataaaaggaa

SEQ ID NO: 739753 - DNA, 22 bp, Artificial Sequence
  chemically synthesized
gtttataaaaggaagatttaaa

SEQ ID NO: 739754 - DNA, 22 bp, Artificial Sequence
  chemically synthesized
ggtatattaacttttaaatctt

SEQ ID NO: 739755 - DNA, 22 bp, Artificial Sequence
  chemically synthesized
aggtatattaacttttaaatct

SEQ ID NO: 739756 - DNA, 22 bp, Artificial Sequence
  chemically synthesized
ttaggtatattaacttttaaat

SEQ ID NO: 739757 - DNA, 22 bp, Artificial Sequence
  chemically synthesized
ataaaaggaagatttaaaagtt

SEQ ID NO: 739758 - DNA, 22 bp, Artificial Sequence
  chemically synthesized
taaaaggaagatttaaaagtta

SEQ ID NO: 739759 - DNA, 22 bp, Artificial Sequence
  chemically synthesized
aaatgattcttaggtatattaa

SEQ ID NO: 739760 - DNA, 22 bp, Artificial Sequence
  chemically synthesized
gaaatgattcttaggtatatta

SEQ ID NO: 739761 - DNA, 22 bp, Artificial Sequence
  chemically synthesized
tgaaatgattcttaggtatatt

SEQ ID NO: 739762 - DNA, 22 bp, Artificial Sequence
  chemically synthesized
ttgaaatgattcttaggtatat

SEQ ID NO: 739763 - DNA, 22 bp, Artificial Sequence
  chemically synthesized
tttgaaatgattcttaggtata

SEQ ID NO: 739764 - DNA, 22 bp, Artificial Sequence
  chemically synthesized
ttttgaaatgattcttaggtat

SEQ ID NO: 739765 - DNA, 22 bp, Artificial Sequence
  chemically synthesized
aaaagttaatatacctaagaat

SEQ ID NO: 739766 - DNA, 22 bp, Artificial Sequence
  chemically synthesized
ttttttgaaatgattcttaggt

SEQ ID NO: 739767 - DNA, 22 bp, Artificial Sequence
  chemically synthesized
aaagttaatatacctaagaatc

SEQ ID NO: 739768 - DNA, 22 bp, Artificial Sequence
  chemically synthesized
cttttttgaaatgattcttagg

SEQ ID NO: 739769 - DNA, 22 bp, Artificial Sequence
  chemically synthesized
atatacctaagaatcatttcaa

SEQ ID NO: 739770 - DNA, 22 bp, Artificial Sequence
  chemically synthesized
catgtatcttcttttttgaaat

SEQ ID NO: 739771 - DNA, 22 bp, Artificial Sequence
  chemically synthesized
acatgtatcttcttttttgaaa

SEQ ID NO: 739772 - DNA, 22 bp, Artificial Sequence
  chemically synthesized
tacatgtatcttcttttttgaa

SEQ ID NO: 739773 - DNA, 22 bp, Artificial Sequence
  chemically synthesized
ttacatgtatcttcttttttga

SEQ ID NO: 739774 - DNA, 22 bp, Artificial Sequence
  chemically synthesized
tttacatgtatcttcttttttg

SEQ ID NO: 739775 - DNA, 22 bp, Artificial Sequence
  chemically synthesized
ttttacatgtatcttctttttt

SEQ ID NO: 739776 - DNA, 22 bp, Artificial Sequence
  chemically synthesized
agaatcatttcaaaaaagaaga

SEQ ID NO: 739777 - DNA, 22 bp, Artificial Sequence
  chemically synthesized
acttttttacatgtatcttctt

SEQ ID NO: 739778 - DNA, 22 bp, Artificial Sequence
  chemically synthesized
cacttttttacatgtatcttct

SEQ ID NO: 739779 - DNA, 22 bp, Artificial Sequence
  chemically synthesized
caaaaaagaagatacatgtaaa

SEQ ID NO: 739780 - DNA, 22 bp, Artificial Sequence
  chemically synthesized
aaaaaagaagatacatgtaaaa

SEQ ID NO: 739781 - DNA, 22 bp, Artificial Sequence
  chemically synthesized
gacaatacaggtgtaaaatact

SEQ ID NO: 739782 - DNA, 22 bp, Artificial Sequence
  chemically synthesized
ggacaatacaggtgtaaaatac

SEQ ID NO: 739783 - DNA, 22 bp, Artificial Sequence
  chemically synthesized
tggacaatacaggtgtaaaata

SEQ ID NO: 739784 - DNA, 22 bp, Artificial Sequence
  chemically synthesized
ttttggacaatacaggtgtaaa

SEQ ID NO: 739785 - DNA, 22 bp, Artificial Sequence
  chemically synthesized
aaactattttggacaatacagg

SEQ ID NO: 739786 - DNA, 22 bp, Artificial Sequence
  chemically synthesized
aaaactattttggacaatacag

SEQ ID NO: 739787 - DNA, 22 bp, Artificial Sequence
  chemically synthesized
taaaactattttggacaataca

SEQ ID NO: 739788 - DNA, 22 bp, Artificial Sequence
  chemically synthesized
tacacctgtattgtccaaaata

SEQ ID NO: 739789 - DNA, 22 bp, Artificial Sequence
  chemically synthesized
acacctgtattgtccaaaatag

SEQ ID NO: 739790 - DNA, 22 bp, Artificial Sequence
  chemically synthesized
cacctgtattgtccaaaatagt

SEQ ID NO: 739791 - DNA, 22 bp, Artificial Sequence
  chemically synthesized
tattgtccaaaatagttttaaa

SEQ ID NO: 739792 - DNA, 22 bp, Artificial Sequence
  chemically synthesized
tccaaaatagttttaaagtatt

SEQ ID NO: 739793 - DNA, 22 bp, Artificial Sequence
  chemically synthesized
caaaaaaaaaaaaaaaaagcaa

SEQ ID NO: 739794 - DNA, 22 bp, Artificial Sequence
  chemically synthesized
ccaaaaaaaaaaaaaaaaagca

SEQ ID NO: 739795 - DNA, 22 bp, Artificial Sequence
  chemically synthesized
taaagtattgcttttttttttt

SEQ ID NO: 739796 - DNA, 22 bp, Artificial Sequence
  chemically synthesized
aaagtattgctttttttttttt

SEQ ID NO: 739797 - DNA, 22 bp, Artificial Sequence
  chemically synthesized
aagtattgcttttttttttttt

SEQ ID NO: 739798 - DNA, 22 bp, Artificial Sequence
  chemically synthesized
ctttttttttttttttttggaa

SEQ ID NO: 739799 - DNA, 22 bp, Artificial Sequence
  chemically synthesized
tttttttttttttttggaaatg

SEQ ID NO: 739800 - DNA, 22 bp, Artificial Sequence
  chemically synthesized
ttttttttttttttggaaatgg

SEQ ID NO: 739801 - DNA, 22 bp, Artificial Sequence
  chemically synthesized
tttttttttttttggaaatggt

SEQ ID NO: 739802 - DNA, 22 bp, Artificial Sequence
  chemically synthesized
ttttttttttttggaaatggtg

SEQ ID NO: 739803 - DNA, 22 bp, Artificial Sequence
  chemically synthesized
tttttttttttggaaatggtgt

SEQ ID NO: 739804 - DNA, 22 bp, Artificial Sequence
  chemically synthesized
ttttttttttggaaatggtgtc

SEQ ID NO: 739805 - DNA, 22 bp, Artificial Sequence
  chemically synthesized
tttttttttggaaatggtgtct

SEQ ID NO: 739806 - DNA, 22 bp, Artificial Sequence
  chemically synthesized
ggcaacagagcaagacaccatt

SEQ ID NO: 739807 - DNA, 22 bp, Artificial Sequence
  chemically synthesized
ttttttttggaaatggtgtctt

SEQ ID NO: 739808 - DNA, 22 bp, Artificial Sequence
  chemically synthesized
tttttttggaaatggtgtcttg

SEQ ID NO: 739809 - DNA, 22 bp, Artificial Sequence
  chemically synthesized
ttttttggaaatggtgtcttgc

SEQ ID NO: 739810 - DNA, 22 bp, Artificial Sequence
  chemically synthesized
tttttggaaatggtgtcttgct

SEQ ID NO: 739811 - DNA, 22 bp, Artificial Sequence
  chemically synthesized
ttttggaaatggtgtcttgctc

SEQ ID NO: 739812 - DNA, 22 bp, Artificial Sequence
  chemically synthesized
tttggaaatggtgtcttgctct

SEQ ID NO: 739813 - DNA, 22 bp, Artificial Sequence
  chemically synthesized
ttggaaatggtgtcttgctctg

SEQ ID NO: 739814 - DNA, 22 bp, Artificial Sequence
  chemically synthesized
cagcctgggcaacagagcaaga

SEQ ID NO: 739815 - DNA, 22 bp, Artificial Sequence
  chemically synthesized
tggaaatggtgtcttgctctgt

SEQ ID NO: 739816 - DNA, 22 bp, Artificial Sequence
  chemically synthesized
ggaaatggtgtcttgctctgtt

SEQ ID NO: 739817 - DNA, 22 bp, Artificial Sequence
  chemically synthesized
gaaatggtgtcttgctctgttg

SEQ ID NO: 739818 - DNA, 22 bp, Artificial Sequence
  chemically synthesized
cactccagcctgggcaacagag

SEQ ID NO: 739819 - DNA, 22 bp, Artificial Sequence
  chemically synthesized
gctctgttgcccaggctggagt

SEQ ID NO: 739820 - DNA, 22 bp, Artificial Sequence
  chemically synthesized
ctctgttgcccaggctggagtg

SEQ ID NO: 739821 - DNA, 22 bp, Artificial Sequence
  chemically synthesized
agatcatgccactgcactccag

SEQ ID NO: 739822 - DNA, 22 bp, Artificial Sequence
  chemically synthesized
tgttgcccaggctggagtgcag

SEQ ID NO: 739823 - DNA, 22 bp, Artificial Sequence
  chemically synthesized
ttgcccaggctggagtgcagtg

SEQ ID NO: 739824 - DNA, 22 bp, Artificial Sequence
  chemically synthesized
cccaggctggagtgcagtggca

SEQ ID NO: 739825 - DNA, 22 bp, Artificial Sequence
  chemically synthesized
cagtaagctgagatcatgccac

SEQ ID NO: 739826 - DNA, 22 bp, Artificial Sequence
  chemically synthesized
gagtgcagtggcatgatctcag

SEQ ID NO: 739827 - DNA, 22 bp, Artificial Sequence
  chemically synthesized
aacccgggaggcggatgttgca

SEQ ID NO: 739828 - DNA, 22 bp, Artificial Sequence
  chemically synthesized
gaacccgggaggcggatgttgc

SEQ ID NO: 739829 - DNA, 22 bp, Artificial Sequence
  chemically synthesized
agcttactgcaacatccgcctc

SEQ ID NO: 739830 - DNA, 22 bp, Artificial Sequence
  chemically synthesized
actgcaacatccgcctcccggg

SEQ ID NO: 739831 - DNA, 22 bp, Artificial Sequence
  chemically synthesized
ctgcaacatccgcctcccgggt

SEQ ID NO: 739832 - DNA, 22 bp, Artificial Sequence
  chemically synthesized
caacatccgcctcccgggttca

SEQ ID NO: 739833 - DNA, 22 bp, Artificial Sequence
  chemically synthesized
aggcaggagaatcgcttgaacc

SEQ ID NO: 739834 - DNA, 22 bp, Artificial Sequence
  chemically synthesized
ggaagctgaggcaggagaatcg

SEQ ID NO: 739835 - DNA, 22 bp, Artificial Sequence
  chemically synthesized
ccgggttcaagcgattctcctg

SEQ ID NO: 739836 - DNA, 22 bp, Artificial Sequence
  chemically synthesized
gggaagctgaggcaggagaatc

SEQ ID NO: 739837 - DNA, 22 bp, Artificial Sequence
  chemically synthesized
cttgggaagctgaggcaggaga

SEQ ID NO: 739838 - DNA, 22 bp, Artificial Sequence
  chemically synthesized
aagcgattctcctgcctcagct

SEQ ID NO: 739839 - DNA, 22 bp, Artificial Sequence
  chemically synthesized
tagatcagctacttgggaagct

SEQ ID NO: 739840 - DNA, 22 bp, Artificial Sequence
  chemically synthesized
gtagatcagctacttgggaagc

SEQ ID NO: 739841 - DNA, 22 bp, Artificial Sequence
  chemically synthesized
tcctgcctcagcttcccaagta

SEQ ID NO: 739842 - DNA, 22 bp, Artificial Sequence
  chemically synthesized
ctgcctcagcttcccaagtagc

SEQ ID NO: 739843 - DNA, 22 bp, Artificial Sequence
  chemically synthesized
cctcagcttcccaagtagctga

SEQ ID NO: 739844 - DNA, 22 bp, Artificial Sequence
  chemically synthesized
agcttcccaagtagctgatcta

SEQ ID NO: 739845 - DNA, 22 bp, Artificial Sequence
  chemically synthesized
cccaagtagctgatctacaagc

SEQ ID NO: 739846 - DNA, 22 bp, Artificial Sequence
  chemically synthesized
ccaagtagctgatctacaagcg

SEQ ID NO: 739847 - DNA, 22 bp, Artificial Sequence
  chemically synthesized
ggtgtggtggcgcacgcttgta

SEQ ID NO: 739848 - DNA, 22 bp, Artificial Sequence
  chemically synthesized
gctgggtgtggtggcgcacgct

SEQ ID NO: 739849 - DNA, 22 bp, Artificial Sequence
  chemically synthesized
atctacaagcgtgcgccaccac

SEQ ID NO: 739850 - DNA, 22 bp, Artificial Sequence
  chemically synthesized
caagcgtgcgccaccacaccca

SEQ ID NO: 739851 - DNA, 22 bp, Artificial Sequence
  chemically synthesized
aaaatacaaaaattagctgggt

SEQ ID NO: 739852 - DNA, 22 bp, Artificial Sequence
  chemically synthesized
ctaaaaatacaaaaattagctg

SEQ ID NO: 739853 - DNA, 22 bp, Artificial Sequence
  chemically synthesized
atttttgtatttttagtagtga

SEQ ID NO: 739854 - DNA, 22 bp, Artificial Sequence
  chemically synthesized
ttgtatttttagtagtgatggg

SEQ ID NO: 739855 - DNA, 22 bp, Artificial Sequence
  chemically synthesized
tgtatttttagtagtgatgggg

SEQ ID NO: 739856 - DNA, 22 bp, Artificial Sequence
  chemically synthesized
gtatttttagtagtgatggggt

SEQ ID NO: 739857 - DNA, 22 bp, Artificial Sequence
  chemically synthesized
tatttttagtagtgatggggtt

SEQ ID NO: 739858 - DNA, 22 bp, Artificial Sequence
  chemically synthesized
gccaacacatagtgaaacccca

SEQ ID NO: 739859 - DNA, 22 bp, Artificial Sequence
  chemically synthesized
ttagtagtgatggggtttcact

SEQ ID NO: 739860 - DNA, 22 bp, Artificial Sequence
  chemically synthesized
tagtagtgatggggtttcacta

SEQ ID NO: 739861 - DNA, 22 bp, Artificial Sequence
  chemically synthesized
agtagtgatggggtttcactat

SEQ ID NO: 739862 - DNA, 22 bp, Artificial Sequence
  chemically synthesized
gtagtgatggggtttcactatg

SEQ ID NO: 739863 - DNA, 22 bp, Artificial Sequence
  chemically synthesized
aagaccggcctggccaacacat

SEQ ID NO: 739864 - DNA, 22 bp, Artificial Sequence
  chemically synthesized
cactatgtgttggccaggccgg

SEQ ID NO: 739865 - DNA, 22 bp, Artificial Sequence
  chemically synthesized
actatgtgttggccaggccggt

SEQ ID NO: 739866 - DNA, 22 bp, Artificial Sequence
  chemically synthesized
tgtgttggccaggccggtcttg

SEQ ID NO: 739867 - DNA, 22 bp, Artificial Sequence
  chemically synthesized
agatcaggagttcaagaccggc

SEQ ID NO: 739868 - DNA, 22 bp, Artificial Sequence
  chemically synthesized
gagatcaggagttcaagaccgg

SEQ ID NO: 739869 - DNA, 22 bp, Artificial Sequence
  chemically synthesized
gccaggccggtcttgaactcct

SEQ ID NO: 739870 - DNA, 22 bp, Artificial Sequence
  chemically synthesized
gaactcctgatctcaagtgatc

SEQ ID NO: 739871 - DNA, 22 bp, Artificial Sequence
  chemically synthesized
aactcctgatctcaagtgatcc

SEQ ID NO: 739872 - DNA, 22 bp, Artificial Sequence
  chemically synthesized
ggagggtgaggcgggtggatca

SEQ ID NO: 739873 - DNA, 22 bp, Artificial Sequence
  chemically synthesized
ctgatctcaagtgatccacccg

SEQ ID NO: 739874 - DNA, 22 bp, Artificial Sequence
  chemically synthesized
gggagggtgaggcgggtggatc

SEQ ID NO: 739875 - DNA, 22 bp, Artificial Sequence
  chemically synthesized
tgggagggtgaggcgggtggat

SEQ ID NO: 739876 - DNA, 22 bp, Artificial Sequence
  chemically synthesized
atctcaagtgatccacccgcct

SEQ ID NO: 739877 - DNA, 22 bp, Artificial Sequence
  chemically synthesized
aagtgatccacccgcctcaccc

SEQ ID NO: 739878 - DNA, 22 bp, Artificial Sequence
  chemically synthesized
taatcccagtactttgggaggg

SEQ ID NO: 739879 - DNA, 22 bp, Artificial Sequence
  chemically synthesized
acgcctgtaatcccagtacttt

SEQ ID NO: 739880 - DNA, 22 bp, Artificial Sequence
  chemically synthesized
accctcccaaagtactgggatt

SEQ ID NO: 739881 - DNA, 22 bp, Artificial Sequence
  chemically synthesized
ccaaagtactgggattacaggc

SEQ ID NO: 739882 - DNA, 22 bp, Artificial Sequence
  chemically synthesized
ggtgtggtggctcacgcctgta

SEQ ID NO: 739883 - DNA, 22 bp, Artificial Sequence
  chemically synthesized
ggattacaggcgtgagccacca

SEQ ID NO: 739884 - DNA, 22 bp, Artificial Sequence
  chemically synthesized
caggcgtgagccaccacaccca

SEQ ID NO: 739885 - DNA, 22 bp, Artificial Sequence
  chemically synthesized
acaaagcaataatggctgggtg

SEQ ID NO: 739886 - DNA, 22 bp, Artificial Sequence
  chemically synthesized
aacaaagcaataatggctgggt

SEQ ID NO: 739887 - DNA, 22 bp, Artificial Sequence
  chemically synthesized
gacttaacaaagcaataatggc

SEQ ID NO: 739888 - DNA, 22 bp, Artificial Sequence
  chemically synthesized
ggacttaacaaagcaataatgg

SEQ ID NO: 739889 - DNA, 22 bp, Artificial Sequence
  chemically synthesized
cgtttggacttaacaaagcaat

SEQ ID NO: 739890 - DNA, 22 bp, Artificial Sequence
  chemically synthesized
ttacgtttggacttaacaaagc

SEQ ID NO: 739891 - DNA, 22 bp, Artificial Sequence
  chemically synthesized
aaaatcctattacgtttggact

SEQ ID NO: 739892 - DNA, 22 bp, Artificial Sequence
  chemically synthesized
ttgctttgttaagtccaaacgt

SEQ ID NO: 739893 - DNA, 22 bp, Artificial Sequence
  chemically synthesized
tcaaaatcctattacgtttgga

SEQ ID NO: 739894 - DNA, 22 bp, Artificial Sequence
  chemically synthesized
ctcaaaatcctattacgtttgg

SEQ ID NO: 739895 - DNA, 22 bp, Artificial Sequence
  chemically synthesized
ctttgttaagtccaaacgtaat

SEQ ID NO: 739896 - DNA, 22 bp, Artificial Sequence
  chemically synthesized
ttctcaaaatcctattacgttt

SEQ ID NO: 739897 - DNA, 22 bp, Artificial Sequence
  chemically synthesized
tgttaagtccaaacgtaatagg

SEQ ID NO: 739898 - DNA, 22 bp, Artificial Sequence
  chemically synthesized
gttaagtccaaacgtaatagga

SEQ ID NO: 739899 - DNA, 22 bp, Artificial Sequence
  chemically synthesized
ctcttctcaaaatcctattacg

SEQ ID NO: 739900 - DNA, 22 bp, Artificial Sequence
  chemically synthesized
ttaagtccaaacgtaataggat

SEQ ID NO: 739901 - DNA, 22 bp, Artificial Sequence
  chemically synthesized
agtccaaacgtaataggatttt

SEQ ID NO: 739902 - DNA, 22 bp, Artificial Sequence
  chemically synthesized
tctcctcttctcaaaatcctat

SEQ ID NO: 739903 - DNA, 22 bp, Artificial Sequence
  chemically synthesized
gtctcctcttctcaaaatccta

SEQ ID NO: 739904 - DNA, 22 bp, Artificial Sequence
  chemically synthesized
tgtctcctcttctcaaaatcct

SEQ ID NO: 739905 - DNA, 22 bp, Artificial Sequence
  chemically synthesized
ttgtctcctcttctcaaaatcc

SEQ ID NO: 739906 - DNA, 22 bp, Artificial Sequence
  chemically synthesized
tttgtctcctcttctcaaaatc

SEQ ID NO: 739907 - DNA, 22 bp, Artificial Sequence
  chemically synthesized
tttttgtctcctcttctcaaaa

SEQ ID NO: 739908 - DNA, 22 bp, Artificial Sequence
  chemically synthesized
ccatgctctttttgtctcctct

SEQ ID NO: 739909 - DNA, 22 bp, Artificial Sequence
  chemically synthesized
ttcccatgctctttttgtctcc

SEQ ID NO: 739910 - DNA, 22 bp, Artificial Sequence
  chemically synthesized
ctattcccatgctctttttgtc

SEQ ID NO: 739911 - DNA, 22 bp, Artificial Sequence
  chemically synthesized
tgagaagaggagacaaaaagag

SEQ ID NO: 739912 - DNA, 22 bp, Artificial Sequence
  chemically synthesized
gagaagaggagacaaaaagagc

SEQ ID NO: 739913 - DNA, 22 bp, Artificial Sequence
  chemically synthesized
agaagaggagacaaaaagagca

SEQ ID NO: 739914 - DNA, 22 bp, Artificial Sequence
  chemically synthesized
gaactgctattcccatgctctt

SEQ ID NO: 739915 - DNA, 22 bp, Artificial Sequence
  chemically synthesized
cgaactgctattcccatgctct

SEQ ID NO: 739916 - DNA, 22 bp, Artificial Sequence
  chemically synthesized
tcgaactgctattcccatgctc

SEQ ID NO: 739917 - DNA, 22 bp, Artificial Sequence
  chemically synthesized
ttcgaactgctattcccatgct

SEQ ID NO: 739918 - DNA, 22 bp, Artificial Sequence
  chemically synthesized
agtcaggtttttcgaactgcta

SEQ ID NO: 739919 - DNA, 22 bp, Artificial Sequence
  chemically synthesized
tatcagtcaagatctgagtcag

SEQ ID NO: 739920 - DNA, 22 bp, Artificial Sequence
  chemically synthesized
gtatcagtcaagatctgagtca

SEQ ID NO: 739921 - DNA, 22 bp, Artificial Sequence
  chemically synthesized
gaaaaacctgactcagatcttg

SEQ ID NO: 739922 - DNA, 22 bp, Artificial Sequence
  chemically synthesized
actcagatcttgactgatacaa

SEQ ID NO: 739923 - DNA, 22 bp, Artificial Sequence
  chemically synthesized
agatcttgactgatacaagtta

SEQ ID NO: 739924 - DNA, 22 bp, Artificial Sequence
  chemically synthesized
gactgatacaagttatgtgact

SEQ ID NO: 739925 - DNA, 22 bp, Artificial Sequence
  chemically synthesized
actgatacaagttatgtgactg

SEQ ID NO: 739926 - DNA, 22 bp, Artificial Sequence
  chemically synthesized
atacaagttatgtgactgtgac

SEQ ID NO: 739927 - DNA, 22 bp, Artificial Sequence
  chemically synthesized
gaaacatgaagtaccacagtca

SEQ ID NO: 739928 - DNA, 22 bp, Artificial Sequence
  chemically synthesized
agaaacatgaagtaccacagtc

SEQ ID NO: 739929 - DNA, 22 bp, Artificial Sequence
  chemically synthesized
tgtgactgtgactgtggtactt

SEQ ID NO: 739930 - DNA, 22 bp, Artificial Sequence
  chemically synthesized
tgactgtggtacttcatgtttc

SEQ ID NO: 739931 - DNA, 22 bp, Artificial Sequence
  chemically synthesized
tggtacttcatgtttctaagcc

SEQ ID NO: 739932 - DNA, 22 bp, Artificial Sequence
  chemically synthesized
cgtgtaaggaaaccgaggctta

SEQ ID NO: 739933 - DNA, 22 bp, Artificial Sequence
  chemically synthesized
acgtgtaaggaaaccgaggctt

SEQ ID NO: 739934 - DNA, 22 bp, Artificial Sequence
  chemically synthesized
tacgtgtaaggaaaccgaggct

SEQ ID NO: 739935 - DNA, 22 bp, Artificial Sequence
  chemically synthesized
ttacgtgtaaggaaaccgaggc

SEQ ID NO: 739936 - DNA, 22 bp, Artificial Sequence
  chemically synthesized
catgtttctaagcctcggtttc

SEQ ID NO: 739937 - DNA, 22 bp, Artificial Sequence
  chemically synthesized
atgtttctaagcctcggtttcc

SEQ ID NO: 739938 - DNA, 22 bp, Artificial Sequence
  chemically synthesized
ccttttacgtgtaaggaaaccg

SEQ ID NO: 739939 - DNA, 22 bp, Artificial Sequence
  chemically synthesized
ttcccttttacgtgtaaggaaa

SEQ ID NO: 739940 - DNA, 22 bp, Artificial Sequence
  chemically synthesized
ctaagcctcggtttccttacac

SEQ ID NO: 739941 - DNA, 22 bp, Artificial Sequence
  chemically synthesized
taagcctcggtttccttacacg

SEQ ID NO: 739942 - DNA, 22 bp, Artificial Sequence
  chemically synthesized
agcctcggtttccttacacgta

SEQ ID NO: 739943 - DNA, 22 bp, Artificial Sequence
  chemically synthesized
tcattattcccttttacgtgta

SEQ ID NO: 739944 - DNA, 22 bp, Artificial Sequence
  chemically synthesized
ttatcattattcccttttacgt

SEQ ID NO: 739945 - DNA, 22 bp, Artificial Sequence
  chemically synthesized
ggtttccttacacgtaaaaggg

SEQ ID NO: 739946 - DNA, 22 bp, Artificial Sequence
  chemically synthesized
cctattatcattattccctttt

SEQ ID NO: 739947 - DNA, 22 bp, Artificial Sequence
  chemically synthesized
ccttacacgtaaaagggaataa

SEQ ID NO: 739948 - DNA, 22 bp, Artificial Sequence
  chemically synthesized
cttacacgtaaaagggaataat

SEQ ID NO: 739949 - DNA, 22 bp, Artificial Sequence
  chemically synthesized
acacgtaaaagggaataatgat

SEQ ID NO: 739950 - DNA, 22 bp, Artificial Sequence
  chemically synthesized
tgattacctattatcattattc

SEQ ID NO: 739951 - DNA, 22 bp, Artificial Sequence
  chemically synthesized
cacgtaaaagggaataatgata

SEQ ID NO: 739952 - DNA, 22 bp, Artificial Sequence
  chemically synthesized
tgattatgattacctattatca

SEQ ID NO: 739953 - DNA, 22 bp, Artificial Sequence
  chemically synthesized
tattatgattatgattacctat

SEQ ID NO: 739954 - DNA, 22 bp, Artificial Sequence
  chemically synthesized
gtattatgattatgattaccta

SEQ ID NO: 739955 - DNA, 22 bp, Artificial Sequence
  chemically synthesized
tgtattatgattatgattacct

SEQ ID NO: 739956 - DNA, 22 bp, Artificial Sequence
  chemically synthesized
tgattttgtattatgattatga

SEQ ID NO: 739957 - DNA, 22 bp, Artificial Sequence
  chemically synthesized
gtgattttgtattatgattatg

SEQ ID NO: 739958 - DNA, 22 bp, Artificial Sequence
  chemically synthesized
agaatcacaaccttgtgatttt

SEQ ID NO: 739959 - DNA, 22 bp, Artificial Sequence
  chemically synthesized
atctaagaatcacaaccttgtg

SEQ ID NO: 739960 - DNA, 22 bp, Artificial Sequence
  chemically synthesized
tcatctaagaatcacaaccttg

SEQ ID NO: 739961 - DNA, 22 bp, Artificial Sequence
  chemically synthesized
tctcatctaagaatcacaacct

SEQ ID NO: 739962 - DNA, 22 bp, Artificial Sequence
  chemically synthesized
atgtgcattctctcatctaaga

SEQ ID NO: 739963 - DNA, 22 bp, Artificial Sequence
  chemically synthesized
tgattcttagatgagagaatgc

SEQ ID NO: 739964 - DNA, 22 bp, Artificial Sequence
  chemically synthesized
gaaaaagtcctcatgtgcattc

SEQ ID NO: 739965 - DNA, 22 bp, Artificial Sequence
  chemically synthesized
ttagatgagagaatgcacatga

SEQ ID NO: 739966 - DNA, 22 bp, Artificial Sequence
  chemically synthesized
agatgagagaatgcacatgagg

SEQ ID NO: 739967 - DNA, 22 bp, Artificial Sequence
  chemically synthesized
gatgagagaatgcacatgagga

SEQ ID NO: 739968 - DNA, 22 bp, Artificial Sequence
  chemically synthesized
cagttagaaaaagtcctcatgt

SEQ ID NO: 739969 - DNA, 22 bp, Artificial Sequence
  chemically synthesized
gcagttagaaaaagtcctcatg

SEQ ID NO: 739970 - DNA, 22 bp, Artificial Sequence
  chemically synthesized
cttgcagttagaaaaagtcctc

SEQ ID NO: 739971 - DNA, 22 bp, Artificial Sequence
  chemically synthesized
tttctaactgcaaggagtgatg

SEQ ID NO: 739972 - DNA, 22 bp, Artificial Sequence
  chemically synthesized
ttctaactgcaaggagtgatgg

SEQ ID NO: 739973 - DNA, 22 bp, Artificial Sequence
  chemically synthesized
tggtgtaggaaaccatcactcc

SEQ ID NO: 739974 - DNA, 22 bp, Artificial Sequence
  chemically synthesized
tctaactgcaaggagtgatggt

SEQ ID NO: 739975 - DNA, 22 bp, Artificial Sequence
  chemically synthesized
gtggtgtaggaaaccatcactc

SEQ ID NO: 739976 - DNA, 22 bp, Artificial Sequence
  chemically synthesized
ctaactgcaaggagtgatggtt

SEQ ID NO: 739977 - DNA, 22 bp, Artificial Sequence
  chemically synthesized
tgtggtgtaggaaaccatcact

SEQ ID NO: 739978 - DNA, 22 bp, Artificial Sequence
  chemically synthesized
taactgcaaggagtgatggttt

SEQ ID NO: 739979 - DNA, 22 bp, Artificial Sequence
  chemically synthesized
ttgtggtgtaggaaaccatcac

SEQ ID NO: 739980 - DNA, 22 bp, Artificial Sequence
  chemically synthesized
tttgtggtgtaggaaaccatca

SEQ ID NO: 739981 - DNA, 22 bp, Artificial Sequence
  chemically synthesized
actgcaaggagtgatggtttcc

SEQ ID NO: 739982 - DNA, 22 bp, Artificial Sequence
  chemically synthesized
actttttgtggtgtaggaaacc

SEQ ID NO: 739983 - DNA, 22 bp, Artificial Sequence
  chemically synthesized
caaggagtgatggtttcctaca

SEQ ID NO: 739984 - DNA, 22 bp, Artificial Sequence
  chemically synthesized
gactttttgtggtgtaggaaac

SEQ ID NO: 739985 - DNA, 22 bp, Artificial Sequence
  chemically synthesized
accatttgactttttgtggtgt

SEQ ID NO: 739986 - DNA, 22 bp, Artificial Sequence
  chemically synthesized
gaccatttgactttttgtggtg

SEQ ID NO: 739987 - DNA, 22 bp, Artificial Sequence
  chemically synthesized
tttgaccatttgactttttgtg

SEQ ID NO: 739988 - DNA, 22 bp, Artificial Sequence
  chemically synthesized
ctatttgaccatttgacttttt

SEQ ID NO: 739989 - DNA, 22 bp, Artificial Sequence
  chemically synthesized
cctacaccacaaaaagtcaaat

SEQ ID NO: 739990 - DNA, 22 bp, Artificial Sequence
  chemically synthesized
ctacaccacaaaaagtcaaatg

SEQ ID NO: 739991 - DNA, 22 bp, Artificial Sequence
  chemically synthesized
caccacaaaaagtcaaatggtc

SEQ ID NO: 739992 - DNA, 22 bp, Artificial Sequence
  chemically synthesized
gtatgcatgttactatttgacc

SEQ ID NO: 739993 - DNA, 22 bp, Artificial Sequence
  chemically synthesized
aaagtagacacattggtatgca

SEQ ID NO: 739994 - DNA, 22 bp, Artificial Sequence
  chemically synthesized
ctcaaagtagacacattggtat

SEQ ID NO: 739995 - DNA, 22 bp, Artificial Sequence
  chemically synthesized
cctcaaagtagacacattggta

SEQ ID NO: 739996 - DNA, 22 bp, Artificial Sequence
  chemically synthesized
ttcctcaaagtagacacattgg

SEQ ID NO: 739997 - DNA, 22 bp, Artificial Sequence
  chemically synthesized
cttcctcaaagtagacacattg

SEQ ID NO: 739998 - DNA, 22 bp, Artificial Sequence
  chemically synthesized
tcttcctcaaagtagacacatt

SEQ ID NO: 739999 - DNA, 22 bp, Artificial Sequence
  chemically synthesized
ttttcttcctcaaagtagacac

SEQ ID NO: 740000 - DNA, 22 bp, Artificial Sequence
  chemically synthesized
tgggaatgaagtcctattttct

SEQ ID NO: 740001 - DNA, 22 bp, Artificial Sequence
  chemically synthesized
tgtgggaatgaagtcctatttt

SEQ ID NO: 740002 - DNA, 22 bp, Artificial Sequence
  chemically synthesized
ctttgaggaagaaaataggact

SEQ ID NO: 740003 - DNA, 22 bp, Artificial Sequence
  chemically synthesized
ctgtgggaatgaagtcctattt

SEQ ID NO: 740004 - DNA, 22 bp, Artificial Sequence
  chemically synthesized
tctgtgggaatgaagtcctatt

SEQ ID NO: 740005 - DNA, 22 bp, Artificial Sequence
  chemically synthesized
tgaggaagaaaataggacttca

SEQ ID NO: 740006 - DNA, 22 bp, Artificial Sequence
  chemically synthesized
gaggaagaaaataggacttcat

SEQ ID NO: 740007 - DNA, 22 bp, Artificial Sequence
  chemically synthesized
aggaagaaaataggacttcatt

SEQ ID NO: 740008 - DNA, 22 bp, Artificial Sequence
  chemically synthesized
aaattttctgtgggaatgaagt

SEQ ID NO: 740009 - DNA, 22 bp, Artificial Sequence
  chemically synthesized
gaaattttctgtgggaatgaag

SEQ ID NO: 740010 - DNA, 22 bp, Artificial Sequence
  chemically synthesized
tttgaaattttctgtgggaatg

SEQ ID NO: 740011 - DNA, 22 bp, Artificial Sequence
  chemically synthesized
cctgtttgaaattttctgtggg

SEQ ID NO: 740012 - DNA, 22 bp, Artificial Sequence
  chemically synthesized
gcctgtttgaaattttctgtgg

SEQ ID NO: 740013 - DNA, 22 bp, Artificial Sequence
  chemically synthesized
gtttgcctgtttgaaattttct

SEQ ID NO: 740014 - DNA, 22 bp, Artificial Sequence
  chemically synthesized
cattcccacagaaaatttcaaa

SEQ ID NO: 740015 - DNA, 22 bp, Artificial Sequence
  chemically synthesized
attcccacagaaaatttcaaac

SEQ ID NO: 740016 - DNA, 22 bp, Artificial Sequence
  chemically synthesized
ccacagaaaatttcaaacaggc

SEQ ID NO: 740017 - DNA, 22 bp, Artificial Sequence
  chemically synthesized
caaacaggcaaaccaatgtctc

SEQ ID NO: 740018 - DNA, 22 bp, Artificial Sequence
  chemically synthesized
atagaaatgtaagagacattgg

SEQ ID NO: 740019 - DNA, 22 bp, Artificial Sequence
  chemically synthesized
aaacaggcaaaccaatgtctct

SEQ ID NO: 740020 - DNA, 22 bp, Artificial Sequence
  chemically synthesized
taatagaaatgtaagagacatt

SEQ ID NO: 740021 - DNA, 22 bp, Artificial Sequence
  chemically synthesized
ctaatagaaatgtaagagacat

SEQ ID NO: 740022 - DNA, 22 bp, Artificial Sequence
  chemically synthesized
aatcttctaatagaaatgtaag

SEQ ID NO: 740023 - DNA, 22 bp, Artificial Sequence
  chemically synthesized
gaatcttctaatagaaatgtaa

SEQ ID NO: 740024 - DNA, 22 bp, Artificial Sequence
  chemically synthesized
tgaatcttctaatagaaatgta

SEQ ID NO: 740025 - DNA, 22 bp, Artificial Sequence
  chemically synthesized
actttgaatcttctaatagaaa

SEQ ID NO: 740026 - DNA, 22 bp, Artificial Sequence
  chemically synthesized
ttacatttctattagaagattc

SEQ ID NO: 740027 - DNA, 22 bp, Artificial Sequence
  chemically synthesized
caaactgactttgaatcttcta

SEQ ID NO: 740028 - DNA, 22 bp, Artificial Sequence
  chemically synthesized
acatttctattagaagattcaa

SEQ ID NO: 740029 - DNA, 22 bp, Artificial Sequence
  chemically synthesized
catttctattagaagattcaaa

SEQ ID NO: 740030 - DNA, 22 bp, Artificial Sequence
  chemically synthesized
ctattagaagattcaaagtcag

SEQ ID NO: 740031 - DNA, 22 bp, Artificial Sequence
  chemically synthesized
tattagaagattcaaagtcagt

SEQ ID NO: 740032 - DNA, 22 bp, Artificial Sequence
  chemically synthesized
ttagaagattcaaagtcagttt

SEQ ID NO: 740033 - DNA, 22 bp, Artificial Sequence
  chemically synthesized
gaagattcaaagtcagtttgga

SEQ ID NO: 740034 - DNA, 22 bp, Artificial Sequence
  chemically synthesized
aaagtcagtttggaattctcta

SEQ ID NO: 740035 - DNA, 22 bp, Artificial Sequence
  chemically synthesized
tgtatagaatcataatgtatag

SEQ ID NO: 740036 - DNA, 22 bp, Artificial Sequence
  chemically synthesized
ggaattctctatacattatgat

SEQ ID NO: 740037 - DNA, 22 bp, Artificial Sequence
  chemically synthesized
cctatgtatagaatcataatgt

SEQ ID NO: 740038 - DNA, 22 bp, Artificial Sequence
  chemically synthesized
gaattctctatacattatgatt

SEQ ID NO: 740039 - DNA, 22 bp, Artificial Sequence
  chemically synthesized
acctatgtatagaatcataatg

SEQ ID NO: 740040 - DNA, 22 bp, Artificial Sequence
  chemically synthesized
tctatacattatgattctatac

SEQ ID NO: 740041 - DNA, 22 bp, Artificial Sequence
  chemically synthesized
tatacattatgattctatacat

SEQ ID NO: 740042 - DNA, 22 bp, Artificial Sequence
  chemically synthesized
tacattatgattctatacatag

SEQ ID NO: 740043 - DNA, 22 bp, Artificial Sequence
  chemically synthesized
tgattctatacataggtaaatt

SEQ ID NO: 740044 - DNA, 22 bp, Artificial Sequence
  chemically synthesized
tatacataggtaaattgtgact

SEQ ID NO: 740045 - DNA, 22 bp, Artificial Sequence
  chemically synthesized
tacataggtaaattgtgactgg

SEQ ID NO: 740046 - DNA, 22 bp, Artificial Sequence
  chemically synthesized
tgactgggtttgactgtattgt

SEQ ID NO: 740047 - DNA, 22 bp, Artificial Sequence
  chemically synthesized
agggatgtgagcaccaacaata

SEQ ID NO: 740048 - DNA, 22 bp, Artificial Sequence
  chemically synthesized
ggtttgactgtattgttggtgc

SEQ ID NO: 740049 - DNA, 22 bp, Artificial Sequence
  chemically synthesized
gactgtattgttggtgctcaca

SEQ ID NO: 740050 - DNA, 22 bp, Artificial Sequence
  chemically synthesized
actgtattgttggtgctcacat

SEQ ID NO: 740051 - DNA, 22 bp, Artificial Sequence
  chemically synthesized
tattgttggtgctcacatccct

SEQ ID NO: 740052 - DNA, 22 bp, Artificial Sequence
  chemically synthesized
ttggtgctcacatcccttaact

SEQ ID NO: 740053 - DNA, 22 bp, Artificial Sequence
  chemically synthesized
gtgctcacatcccttaactggt

SEQ ID NO: 740054 - DNA, 22 bp, Artificial Sequence
  chemically synthesized
acatcccttaactggtttcacc

SEQ ID NO: 740055 - DNA, 22 bp, Artificial Sequence
  chemically synthesized
taatatcagtcaaaatggtgaa

SEQ ID NO: 740056 - DNA, 22 bp, Artificial Sequence
  chemically synthesized
tctgtaatatcagtcaaaatgg

SEQ ID NO: 740057 - DNA, 22 bp, Artificial Sequence
  chemically synthesized
aactggtttcaccattttgact

SEQ ID NO: 740058 - DNA, 22 bp, Artificial Sequence
  chemically synthesized
actggtttcaccattttgactg

SEQ ID NO: 740059 - DNA, 22 bp, Artificial Sequence
  chemically synthesized
gctgtctgtaatatcagtcaaa

SEQ ID NO: 740060 - DNA, 22 bp, Artificial Sequence
  chemically synthesized
agctgtctgtaatatcagtcaa

SEQ ID NO: 740061 - DNA, 22 bp, Artificial Sequence
  chemically synthesized
gtttcaccattttgactgatat

SEQ ID NO: 740062 - DNA, 22 bp, Artificial Sequence
  chemically synthesized
tagctgtctgtaatatcagtca

SEQ ID NO: 740063 - DNA, 22 bp, Artificial Sequence
  chemically synthesized
ttagctgtctgtaatatcagtc

SEQ ID NO: 740064 - DNA, 22 bp, Artificial Sequence
  chemically synthesized
tttagctgtctgtaatatcagt

SEQ ID NO: 740065 - DNA, 22 bp, Artificial Sequence
  chemically synthesized
caccattttgactgatattaca

SEQ ID NO: 740066 - DNA, 22 bp, Artificial Sequence
  chemically synthesized
accattttgactgatattacag

SEQ ID NO: 740067 - DNA, 22 bp, Artificial Sequence
  chemically synthesized
gttttttagctgtctgtaatat

SEQ ID NO: 740068 - DNA, 22 bp, Artificial Sequence
  chemically synthesized
tgactgatattacagacagcta

SEQ ID NO: 740069 - DNA, 22 bp, Artificial Sequence
  chemically synthesized
gactgatattacagacagctaa

SEQ ID NO: 740070 - DNA, 22 bp, Artificial Sequence
  chemically synthesized
actgatattacagacagctaaa

SEQ ID NO: 740071 - DNA, 22 bp, Artificial Sequence
  chemically synthesized
atattacagacagctaaaaaac

SEQ ID NO: 740072 - DNA, 22 bp, Artificial Sequence
  chemically synthesized
aaggaaagccatgctagttttt

SEQ ID NO: 740073 - DNA, 22 bp, Artificial Sequence
  chemically synthesized
caaggaaagccatgctagtttt

SEQ ID NO: 740074 - DNA, 22 bp, Artificial Sequence
  chemically synthesized
cagacagctaaaaaactagcat

SEQ ID NO: 740075 - DNA, 22 bp, Artificial Sequence
  chemically synthesized
tcaaggaaagccatgctagttt

SEQ ID NO: 740076 - DNA, 22 bp, Artificial Sequence
  chemically synthesized
attttcaaggaaagccatgcta

SEQ ID NO: 740077 - DNA, 22 bp, Artificial Sequence
  chemically synthesized
aattttcaaggaaagccatgct

SEQ ID NO: 740078 - DNA, 22 bp, Artificial Sequence
  chemically synthesized
atttaattttcaaggaaagcca

SEQ ID NO: 740079 - DNA, 22 bp, Artificial Sequence
  chemically synthesized
aaaaactagcatggctttcctt

SEQ ID NO: 740080 - DNA, 22 bp, Artificial Sequence
  chemically synthesized
tccattcatttaattttcaagg

SEQ ID NO: 740081 - DNA, 22 bp, Artificial Sequence
  chemically synthesized
gcatggctttccttgaaaatta

SEQ ID NO: 740082 - DNA, 22 bp, Artificial Sequence
  chemically synthesized
cattatccattcatttaatttt

SEQ ID NO: 740083 - DNA, 22 bp, Artificial Sequence
  chemically synthesized
gcattatccattcatttaattt

SEQ ID NO: 740084 - DNA, 22 bp, Artificial Sequence
  chemically synthesized
tgcattatccattcatttaatt

SEQ ID NO: 740085 - DNA, 22 bp, Artificial Sequence
  chemically synthesized
tttgcattatccattcatttaa

SEQ ID NO: 740086 - DNA, 22 bp, Artificial Sequence
  chemically synthesized
tccttgaaaattaaatgaatgg

SEQ ID NO: 740087 - DNA, 22 bp, Artificial Sequence
  chemically synthesized
ccttgaaaattaaatgaatgga

SEQ ID NO: 740088 - DNA, 22 bp, Artificial Sequence
  chemically synthesized
cttgaaaattaaatgaatggat

SEQ ID NO: 740089 - DNA, 22 bp, Artificial Sequence
  chemically synthesized
ggttctttgcattatccattca

SEQ ID NO: 740090 - DNA, 22 bp, Artificial Sequence
  chemically synthesized
gaaaattaaatgaatggataat

SEQ ID NO: 740091 - DNA, 22 bp, Artificial Sequence
  chemically synthesized
aaaattaaatgaatggataatg

SEQ ID NO: 740092 - DNA, 22 bp, Artificial Sequence
  chemically synthesized
aatgaatggataatgcaaagaa

SEQ ID NO: 740093 - DNA, 22 bp, Artificial Sequence
  chemically synthesized
atatcagaatatcctgggttct

SEQ ID NO: 740094 - DNA, 22 bp, Artificial Sequence
  chemically synthesized
gatatcagaatatcctgggttc

SEQ ID NO: 740095 - DNA, 22 bp, Artificial Sequence
  chemically synthesized
cttgatatcagaatatcctggg

SEQ ID NO: 740096 - DNA, 22 bp, Artificial Sequence
  chemically synthesized
tcaggccgtgtctacttgatat

SEQ ID NO: 740097 - DNA, 22 bp, Artificial Sequence
  chemically synthesized
catactatcaggccgtgtctac

SEQ ID NO: 740098 - DNA, 22 bp, Artificial Sequence
  chemically synthesized
tgatatcaagtagacacggcct

SEQ ID NO: 740099 - DNA, 22 bp, Artificial Sequence
  chemically synthesized
atatcaagtagacacggcctga

SEQ ID NO: 740100 - DNA, 22 bp, Artificial Sequence
  chemically synthesized
gagttacatactatcaggccgt

SEQ ID NO: 740101 - DNA, 22 bp, Artificial Sequence
  chemically synthesized
atagtatgtaactctaatcttt

SEQ ID NO: 740102 - DNA, 22 bp, Artificial Sequence
  chemically synthesized
ggcaaaatagtataatagaaag

SEQ ID NO: 740103 - DNA, 22 bp, Artificial Sequence
  chemically synthesized
gggcaaaatagtataatagaaa

SEQ ID NO: 740104 - DNA, 22 bp, Artificial Sequence
  chemically synthesized
aatttgggcaaaatagtataat

SEQ ID NO: 740105 - DNA, 22 bp, Artificial Sequence
  chemically synthesized
aaatttgggcaaaatagtataa

SEQ ID NO: 740106 - DNA, 22 bp, Artificial Sequence
  chemically synthesized
taatctttctattatactattt

SEQ ID NO: 740107 - DNA, 22 bp, Artificial Sequence
  chemically synthesized
atctttctattatactattttg

SEQ ID NO: 740108 - DNA, 22 bp, Artificial Sequence
  chemically synthesized
tctattatactattttgcccaa

SEQ ID NO: 740109 - DNA, 22 bp, Artificial Sequence
  chemically synthesized
ctattatactattttgcccaaa

SEQ ID NO: 740110 - DNA, 22 bp, Artificial Sequence
  chemically synthesized
tattatactattttgcccaaat

SEQ ID NO: 740111 - DNA, 22 bp, Artificial Sequence
  chemically synthesized
ttatactattttgcccaaattt

SEQ ID NO: 740112 - DNA, 22 bp, Artificial Sequence
  chemically synthesized
tactattttgcccaaatttaag

SEQ ID NO: 740113 - DNA, 22 bp, Artificial Sequence
  chemically synthesized
agaaaagaagaagagtcttaaa

SEQ ID NO: 740114 - DNA, 22 bp, Artificial Sequence
  chemically synthesized
ttttgcccaaatttaagactct

SEQ ID NO: 740115 - DNA, 22 bp, Artificial Sequence
  chemically synthesized
tgcccaaatttaagactcttct

SEQ ID NO: 740116 - DNA, 22 bp, Artificial Sequence
  chemically synthesized
gcccaaatttaagactcttctt

SEQ ID NO: 740117 - DNA, 22 bp, Artificial Sequence
  chemically synthesized
cccaaatttaagactcttcttc

SEQ ID NO: 740118 - DNA, 22 bp, Artificial Sequence
  chemically synthesized
aagactcttcttcttttctcag

SEQ ID NO: 740119 - DNA, 22 bp, Artificial Sequence
  chemically synthesized
agactcttcttcttttctcagg

SEQ ID NO: 740120 - DNA, 22 bp, Artificial Sequence
  chemically synthesized
ttcttcttttctcaggtttaca

SEQ ID NO: 740121 - DNA, 22 bp, Artificial Sequence
  chemically synthesized
cttcttttctcaggtttacatc

SEQ ID NO: 740122 - DNA, 22 bp, Artificial Sequence
  chemically synthesized
ttcttttctcaggtttacatct

SEQ ID NO: 740123 - DNA, 22 bp, Artificial Sequence
  chemically synthesized
cttttctcaggtttacatctgc

SEQ ID NO: 740124 - DNA, 22 bp, Artificial Sequence
  chemically synthesized
ttttctcaggtttacatctgcc

SEQ ID NO: 740125 - DNA, 22 bp, Artificial Sequence
  chemically synthesized
gagtagtagaaaggcagatgta

SEQ ID NO: 740126 - DNA, 22 bp, Artificial Sequence
  chemically synthesized
ttctcaggtttacatctgcctt

SEQ ID NO: 740127 - DNA, 22 bp, Artificial Sequence
  chemically synthesized
tctcaggtttacatctgccttt

SEQ ID NO: 740128 - DNA, 22 bp, Artificial Sequence
  chemically synthesized
ctcaggtttacatctgcctttc

SEQ ID NO: 740129 - DNA, 22 bp, Artificial Sequence
  chemically synthesized
tcaggtttacatctgcctttct

SEQ ID NO: 740130 - DNA, 22 bp, Artificial Sequence
  chemically synthesized
aggtttacatctgcctttctac

SEQ ID NO: 740131 - DNA, 22 bp, Artificial Sequence
  chemically synthesized
acatctgcctttctactactcc

SEQ ID NO: 740132 - DNA, 22 bp, Artificial Sequence
  chemically synthesized
catctgcctttctactactcca

SEQ ID NO: 740133 - DNA, 22 bp, Artificial Sequence
  chemically synthesized
cctttctactactccagttctc

SEQ ID NO: 740134 - DNA, 22 bp, Artificial Sequence
  chemically synthesized
tctactactccagttctctatt

SEQ ID NO: 740135 - DNA, 22 bp, Artificial Sequence
  chemically synthesized
ctactactccagttctctattt

SEQ ID NO: 740136 - DNA, 22 bp, Artificial Sequence
  chemically synthesized
tactactccagttctctatttt

SEQ ID NO: 740137 - DNA, 22 bp, Artificial Sequence
  chemically synthesized
ctactccagttctctattttta

SEQ ID NO: 740138 - DNA, 22 bp, Artificial Sequence
  chemically synthesized
ctccagttctctatttttattt

SEQ ID NO: 740139 - DNA, 22 bp, Artificial Sequence
  chemically synthesized
cagttctctatttttattttat

SEQ ID NO: 740140 - DNA, 22 bp, Artificial Sequence
  chemically synthesized
aaaaataaaataaaataaaata

SEQ ID NO: 740141 - DNA, 22 bp, Artificial Sequence
  chemically synthesized
tctatttttattttattttatt

SEQ ID NO: 740142 - DNA, 22 bp, Artificial Sequence
  chemically synthesized
tatttttattttattttatttt

SEQ ID NO: 740143 - DNA, 22 bp, Artificial Sequence
  chemically synthesized
ggtctcaaaaataaaataaaat

SEQ ID NO: 740144 - DNA, 22 bp, Artificial Sequence
  chemically synthesized
tttttattttattttattttat

SEQ ID NO: 740145 - DNA, 22 bp, Artificial Sequence
  chemically synthesized
ttattttattttattttatttt

SEQ ID NO: 740146 - DNA, 22 bp, Artificial Sequence
  chemically synthesized
tattttattttattttattttt

SEQ ID NO: 740147 - DNA, 22 bp, Artificial Sequence
  chemically synthesized
attttattttattttatttttg

SEQ ID NO: 740148 - DNA, 22 bp, Artificial Sequence
  chemically synthesized
ttttattttattttatttttga

SEQ ID NO: 740149 - DNA, 22 bp, Artificial Sequence
  chemically synthesized
tattttattttatttttgagac

SEQ ID NO: 740150 - DNA, 22 bp, Artificial Sequence
  chemically synthesized
attttattttatttttgagacc

SEQ ID NO: 740151 - DNA, 22 bp, Artificial Sequence
  chemically synthesized
ttttattttatttttgagaccg

SEQ ID NO: 740152 - DNA, 22 bp, Artificial Sequence
  chemically synthesized
tattttatttttgagaccgagt

SEQ ID NO: 740153 - DNA, 22 bp, Artificial Sequence
  chemically synthesized
attttatttttgagaccgagtc

SEQ ID NO: 740154 - DNA, 22 bp, Artificial Sequence
  chemically synthesized
ttttatttttgagaccgagtct

SEQ ID NO: 740155 - DNA, 22 bp, Artificial Sequence
  chemically synthesized
ggcgacagagccagactcggtc

SEQ ID NO: 740156 - DNA, 22 bp, Artificial Sequence
  chemically synthesized
tatttttgagaccgagtctggc

SEQ ID NO: 740157 - DNA, 22 bp, Artificial Sequence
  chemically synthesized
atttttgagaccgagtctggct

SEQ ID NO: 740158 - DNA, 22 bp, Artificial Sequence
  chemically synthesized
tttttgagaccgagtctggctc

SEQ ID NO: 740159 - DNA, 22 bp, Artificial Sequence
  chemically synthesized
cagcctgggcgacagagccaga

SEQ ID NO: 740160 - DNA, 22 bp, Artificial Sequence
  chemically synthesized
ttgagaccgagtctggctctgt

SEQ ID NO: 740161 - DNA, 22 bp, Artificial Sequence
  chemically synthesized
tgagaccgagtctggctctgtc

SEQ ID NO: 740162 - DNA, 22 bp, Artificial Sequence
  chemically synthesized
gagaccgagtctggctctgtcg

SEQ ID NO: 740163 - DNA, 22 bp, Artificial Sequence
  chemically synthesized
agaccgagtctggctctgtcgc

SEQ ID NO: 740164 - DNA, 22 bp, Artificial Sequence
  chemically synthesized
cactccagcctgggcgacagag

SEQ ID NO: 740165 - DNA, 22 bp, Artificial Sequence
  chemically synthesized
gctctgtcgcccaggctggagt

SEQ ID NO: 740166 - DNA, 22 bp, Artificial Sequence
  chemically synthesized
agatcgtgccactgcactccag

SEQ ID NO: 740167 - DNA, 22 bp, Artificial Sequence
  chemically synthesized
tgtcgcccaggctggagtgcag

SEQ ID NO: 740168 - DNA, 22 bp, Artificial Sequence
  chemically synthesized
tcgcccaggctggagtgcagtg

SEQ ID NO: 740169 - DNA, 22 bp, Artificial Sequence
  chemically synthesized
cagtgagctgagatcgtgccac

SEQ ID NO: 740170 - DNA, 22 bp, Artificial Sequence
  chemically synthesized
gagtgcagtggcacgatctcag

SEQ ID NO: 740171 - DNA, 22 bp, Artificial Sequence
  chemically synthesized
aaaccaggaggcagaggttgca

SEQ ID NO: 740172 - DNA, 22 bp, Artificial Sequence
  chemically synthesized
gaaaccaggaggcagaggttgc

SEQ ID NO: 740173 - DNA, 22 bp, Artificial Sequence
  chemically synthesized
cttgaaaccaggaggcagaggt

SEQ ID NO: 740174 - DNA, 22 bp, Artificial Sequence
  chemically synthesized
agctcactgcaacctctgcctc

SEQ ID NO: 740175 - DNA, 22 bp, Artificial Sequence
  chemically synthesized
actgcaacctctgcctcctggt

SEQ ID NO: 740176 - DNA, 22 bp, Artificial Sequence
  chemically synthesized
caacctctgcctcctggtttca

SEQ ID NO: 740177 - DNA, 22 bp, Artificial Sequence
  chemically synthesized
aggcaggagaattgcttgaaac

SEQ ID NO: 740178 - DNA, 22 bp, Artificial Sequence
  chemically synthesized
tgcctcctggtttcaagcaatt

SEQ ID NO: 740179 - DNA, 22 bp, Artificial Sequence
  chemically synthesized
cctcctggtttcaagcaattct

SEQ ID NO: 740180 - DNA, 22 bp, Artificial Sequence
  chemically synthesized
gaggctgaggcaggagaattgc

SEQ ID NO: 740181 - DNA, 22 bp, Artificial Sequence
  chemically synthesized
ctggtttcaagcaattctcctg

SEQ ID NO: 740182 - DNA, 22 bp, Artificial Sequence
  chemically synthesized
tggaggctgaggcaggagaatt

SEQ ID NO: 740183 - DNA, 22 bp, Artificial Sequence
  chemically synthesized
gtttcaagcaattctcctgcct

SEQ ID NO: 740184 - DNA, 22 bp, Artificial Sequence
  chemically synthesized
ctctggaggctgaggcaggaga

SEQ ID NO: 740185 - DNA, 22 bp, Artificial Sequence
  chemically synthesized
caagcaattctcctgcctcagc

SEQ ID NO: 740186 - DNA, 22 bp, Artificial Sequence
  chemically synthesized
gctactctggaggctgaggcag

SEQ ID NO: 740187 - DNA, 22 bp, Artificial Sequence
  chemically synthesized
aagcaattctcctgcctcagcc

SEQ ID NO: 740188 - DNA, 22 bp, Artificial Sequence
  chemically synthesized
taatcctagctactctggaggc

SEQ ID NO: 740189 - DNA, 22 bp, Artificial Sequence
  chemically synthesized
tcctgcctcagcctccagagta

SEQ ID NO: 740190 - DNA, 22 bp, Artificial Sequence
  chemically synthesized
ctgcctcagcctccagagtagc

SEQ ID NO: 740191 - DNA, 22 bp, Artificial Sequence
  chemically synthesized
cctcagcctccagagtagctag

SEQ ID NO: 740192 - DNA, 22 bp, Artificial Sequence
  chemically synthesized
agcctccagagtagctaggatt

SEQ ID NO: 740193 - DNA, 22 bp, Artificial Sequence
  chemically synthesized
cagagtagctaggattacaggc

SEQ ID NO: 740194 - DNA, 22 bp, Artificial Sequence
  chemically synthesized
ggtgtggtggtgcgtgcctgta

SEQ ID NO: 740195 - DNA, 22 bp, Artificial Sequence
  chemically synthesized
cctgggtgtggtggtgcgtgcc

SEQ ID NO: 740196 - DNA, 22 bp, Artificial Sequence
  chemically synthesized
acctgggtgtggtggtgcgtgc

SEQ ID NO: 740197 - DNA, 22 bp, Artificial Sequence
  chemically synthesized
ggattacaggcacgcaccacca

SEQ ID NO: 740198 - DNA, 22 bp, Artificial Sequence
  chemically synthesized
caggcacgcaccaccacaccca

SEQ ID NO: 740199 - DNA, 22 bp, Artificial Sequence
  chemically synthesized
aaaatacaaaacttacctgggt

SEQ ID NO: 740200 - DNA, 22 bp, Artificial Sequence
  chemically synthesized
ctaaaaatacaaaacttacctg

SEQ ID NO: 740201 - DNA, 22 bp, Artificial Sequence
  chemically synthesized
tactaaaaatacaaaacttacc

SEQ ID NO: 740202 - DNA, 22 bp, Artificial Sequence
  chemically synthesized
atctctactaaaaatacaaaac

SEQ ID NO: 740203 - DNA, 22 bp, Artificial Sequence
  chemically synthesized
tgtatttttagtagagatgagg

SEQ ID NO: 740204 - DNA, 22 bp, Artificial Sequence
  chemically synthesized
gtatttttagtagagatgaggt

SEQ ID NO: 740205 - DNA, 22 bp, Artificial Sequence
  chemically synthesized
tatttttagtagagatgaggtt

SEQ ID NO: 740206 - DNA, 22 bp, Artificial Sequence
  chemically synthesized
accagcatggtgaaacctcatc

SEQ ID NO: 740207 - DNA, 22 bp, Artificial Sequence
  chemically synthesized
ttagtagagatgaggtttcacc

SEQ ID NO: 740208 - DNA, 22 bp, Artificial Sequence
  chemically synthesized
tagtagagatgaggtttcacca

SEQ ID NO: 740209 - DNA, 22 bp, Artificial Sequence
  chemically synthesized
agtagagatgaggtttcaccat

SEQ ID NO: 740210 - DNA, 22 bp, Artificial Sequence
  chemically synthesized
gtagagatgaggtttcaccatg

SEQ ID NO: 740211 - DNA, 22 bp, Artificial Sequence
  chemically synthesized
acaccagcctgaccagcatggt

SEQ ID NO: 740212 - DNA, 22 bp, Artificial Sequence
  chemically synthesized
gacaccagcctgaccagcatgg

SEQ ID NO: 740213 - DNA, 22 bp, Artificial Sequence
  chemically synthesized
caccatgctggtcaggctggtg

SEQ ID NO: 740214 - DNA, 22 bp, Artificial Sequence
  chemically synthesized
accatgctggtcaggctggtgt

SEQ ID NO: 740215 - DNA, 22 bp, Artificial Sequence
  chemically synthesized
aggtcaggagtttgacaccagc

SEQ ID NO: 740216 - DNA, 22 bp, Artificial Sequence
  chemically synthesized
gaggtcaggagtttgacaccag

SEQ ID NO: 740217 - DNA, 22 bp, Artificial Sequence
  chemically synthesized
gtcaggctggtgtcaaactcct

SEQ ID NO: 740218 - DNA, 22 bp, Artificial Sequence
  chemically synthesized
gtgtcaaactcctgacctcaag

SEQ ID NO: 740219 - DNA, 22 bp, Artificial Sequence
  chemically synthesized
ggaggccgaggcaggcggatca

SEQ ID NO: 740220 - DNA, 22 bp, Artificial Sequence
  chemically synthesized
ctgacctcaagtgatccgcctg

SEQ ID NO: 740221 - DNA, 22 bp, Artificial Sequence
  chemically synthesized
gggaggccgaggcaggcggatc

SEQ ID NO: 740222 - DNA, 22 bp, Artificial Sequence
  chemically synthesized
tgggaggccgaggcaggcggat

SEQ ID NO: 740223 - DNA, 22 bp, Artificial Sequence
  chemically synthesized
acctcaagtgatccgcctgcct

SEQ ID NO: 740224 - DNA, 22 bp, Artificial Sequence
  chemically synthesized
aagtgatccgcctgcctcggcc

SEQ ID NO: 740225 - DNA, 22 bp, Artificial Sequence
  chemically synthesized
taatcccagcactttgggaggc

SEQ ID NO: 740226 - DNA, 22 bp, Artificial Sequence
  chemically synthesized
cctcggcctcccaaagtgctgg

SEQ ID NO: 740227 - DNA, 22 bp, Artificial Sequence
  chemically synthesized
acgcctgtaatcccagcacttt

SEQ ID NO: 740228 - DNA, 22 bp, Artificial Sequence
  chemically synthesized
ggcctcccaaagtgctgggatt

SEQ ID NO: 740229 - DNA, 22 bp, Artificial Sequence
  chemically synthesized
ccaaagtgctgggattacaggc

SEQ ID NO: 740230 - DNA, 22 bp, Artificial Sequence
  chemically synthesized
ggcatggtggctcacgcctgta

SEQ ID NO: 740231 - DNA, 22 bp, Artificial Sequence
  chemically synthesized
tgggcatggtggctcacgcctg

SEQ ID NO: 740232 - DNA, 22 bp, Artificial Sequence
  chemically synthesized
tctgggcatggtggctcacgcc

SEQ ID NO: 740233 - DNA, 22 bp, Artificial Sequence
  chemically synthesized
ggattacaggcgtgagccacca

SEQ ID NO: 740234 - DNA, 22 bp, Artificial Sequence
  chemically synthesized
caggcgtgagccaccatgccca

SEQ ID NO: 740235 - DNA, 22 bp, Artificial Sequence
  chemically synthesized
agacaaagaacaatcaaaaagt

SEQ ID NO: 740236 - DNA, 22 bp, Artificial Sequence
  chemically synthesized
tccactaagacaaagaacaatc

SEQ ID NO: 740237 - DNA, 22 bp, Artificial Sequence
  chemically synthesized
tttactttttgattgttctttg

SEQ ID NO: 740238 - DNA, 22 bp, Artificial Sequence
  chemically synthesized
tgtccactaagacaaagaacaa

SEQ ID NO: 740239 - DNA, 22 bp, Artificial Sequence
  chemically synthesized
tactttttgattgttctttgtc

SEQ ID NO: 740240 - DNA, 22 bp, Artificial Sequence
  chemically synthesized
actttttgattgttctttgtct

SEQ ID NO: 740241 - DNA, 22 bp, Artificial Sequence
  chemically synthesized
ctttttgattgttctttgtctt

SEQ ID NO: 740242 - DNA, 22 bp, Artificial Sequence
  chemically synthesized
cctctgtccactaagacaaaga

SEQ ID NO: 740243 - DNA, 22 bp, Artificial Sequence
  chemically synthesized
gcctctgtccactaagacaaag

SEQ ID NO: 740244 - DNA, 22 bp, Artificial Sequence
  chemically synthesized
tgcctctgtccactaagacaaa

SEQ ID NO: 740245 - DNA, 22 bp, Artificial Sequence
  chemically synthesized
tttgattgttctttgtcttagt

SEQ ID NO: 740246 - DNA, 22 bp, Artificial Sequence
  chemically synthesized
ttgattgttctttgtcttagtg

SEQ ID NO: 740247 - DNA, 22 bp, Artificial Sequence
  chemically synthesized
tgattgttctttgtcttagtgg

SEQ ID NO: 740248 - DNA, 22 bp, Artificial Sequence
  chemically synthesized
gattgttctttgtcttagtgga

SEQ ID NO: 740249 - DNA, 22 bp, Artificial Sequence
  chemically synthesized
attgttctttgtcttagtggac

SEQ ID NO: 740250 - DNA, 22 bp, Artificial Sequence
  chemically synthesized
atctttgcctctgtccactaag

SEQ ID NO: 740251 - DNA, 22 bp, Artificial Sequence
  chemically synthesized
ttctttgtcttagtggacagag

SEQ ID NO: 740252 - DNA, 22 bp, Artificial Sequence
  chemically synthesized
tttgtcttagtggacagaggca

SEQ ID NO: 740253 - DNA, 22 bp, Artificial Sequence
  chemically synthesized
tgtcttagtggacagaggcaaa

SEQ ID NO: 740254 - DNA, 22 bp, Artificial Sequence
  chemically synthesized
gtcttagtggacagaggcaaag

SEQ ID NO: 740255 - DNA, 22 bp, Artificial Sequence
  chemically synthesized
tcttagtggacagaggcaaaga

SEQ ID NO: 740256 - DNA, 22 bp, Artificial Sequence
  chemically synthesized
agtggacagaggcaaagatgaa

SEQ ID NO: 740257 - DNA, 22 bp, Artificial Sequence
  chemically synthesized
gtggacagaggcaaagatgaac

SEQ ID NO: 740258 - DNA, 22 bp, Artificial Sequence
  chemically synthesized
aatcgtgataaaaaccaagtac

SEQ ID NO: 740259 - DNA, 22 bp, Artificial Sequence
  chemically synthesized
aaatcgtgataaaaaccaagta

SEQ ID NO: 740260 - DNA, 22 bp, Artificial Sequence
  chemically synthesized
taaatcgtgataaaaaccaagt

SEQ ID NO: 740261 - DNA, 22 bp, Artificial Sequence
  chemically synthesized
gtacttggtttttatcacgatt

SEQ ID NO: 740262 - DNA, 22 bp, Artificial Sequence
  chemically synthesized
tgtcaatctttaaatcgtgata

SEQ ID NO: 740263 - DNA, 22 bp, Artificial Sequence
  chemically synthesized
tacttggtttttatcacgattt

SEQ ID NO: 740264 - DNA, 22 bp, Artificial Sequence
  chemically synthesized
ggtttttatcacgatttaaaga

SEQ ID NO: 740265 - DNA, 22 bp, Artificial Sequence
  chemically synthesized
gtttttatcacgatttaaagat

SEQ ID NO: 740266 - DNA, 22 bp, Artificial Sequence
  chemically synthesized
ttatcacgatttaaagattgac

SEQ ID NO: 740267 - DNA, 22 bp, Artificial Sequence
  chemically synthesized
tatcacgatttaaagattgaca

SEQ ID NO: 740268 - DNA, 22 bp, Artificial Sequence
  chemically synthesized
gtcacaatgctatgtcaatctt

SEQ ID NO: 740269 - DNA, 22 bp, Artificial Sequence
  chemically synthesized
atcacgatttaaagattgacat

SEQ ID NO: 740270 - DNA, 22 bp, Artificial Sequence
  chemically synthesized
agtcacaatgctatgtcaatct

SEQ ID NO: 740271 - DNA, 22 bp, Artificial Sequence
  chemically synthesized
tcacgatttaaagattgacata

SEQ ID NO: 740272 - DNA, 22 bp, Artificial Sequence
  chemically synthesized
aaagattgacatagcattgtga

SEQ ID NO: 740273 - DNA, 22 bp, Artificial Sequence
  chemically synthesized
aagattgacatagcattgtgac

SEQ ID NO: 740274 - DNA, 22 bp, Artificial Sequence
  chemically synthesized
tgaaaataaagaatttagtcac

SEQ ID NO: 740275 - DNA, 22 bp, Artificial Sequence
  chemically synthesized
acatagcattgtgactaaattc

SEQ ID NO: 740276 - DNA, 22 bp, Artificial Sequence
  chemically synthesized
tatgaaaataaagaatttagtc

SEQ ID NO: 740277 - DNA, 22 bp, Artificial Sequence
  chemically synthesized
ctatgaaaataaagaatttagt

SEQ ID NO: 740278 - DNA, 22 bp, Artificial Sequence
  chemically synthesized
tgactaaattctttattttcat

SEQ ID NO: 740279 - DNA, 22 bp, Artificial Sequence
  chemically synthesized
aattctttattttcatagaaat

SEQ ID NO: 740280 - DNA, 22 bp, Artificial Sequence
  chemically synthesized
tttattttcatagaaatatgtc

SEQ ID NO: 740281 - DNA, 22 bp, Artificial Sequence
  chemically synthesized
tattttcatagaaatatgtctt

SEQ ID NO: 740282 - DNA, 22 bp, Artificial Sequence
  chemically synthesized
attttcatagaaatatgtcttt

SEQ ID NO: 740283 - DNA, 22 bp, Artificial Sequence
  chemically synthesized
ttttcatagaaatatgtctttt

SEQ ID NO: 740284 - DNA, 22 bp, Artificial Sequence
  chemically synthesized
tcatagaaatatgtcttttttg

SEQ ID NO: 740285 - DNA, 22 bp, Artificial Sequence
  chemically synthesized
aatagtaaatgtcaaaaaagac

SEQ ID NO: 740286 - DNA, 22 bp, Artificial Sequence
  chemically synthesized
catagaaatatgtcttttttga

SEQ ID NO: 740287 - DNA, 22 bp, Artificial Sequence
  chemically synthesized
aaatagtaaatgtcaaaaaaga

SEQ ID NO: 740288 - DNA, 22 bp, Artificial Sequence
  chemically synthesized
atagaaatatgtcttttttgac

SEQ ID NO: 740289 - DNA, 22 bp, Artificial Sequence
  chemically synthesized
taaatagtaaatgtcaaaaaag

SEQ ID NO: 740290 - DNA, 22 bp, Artificial Sequence
  chemically synthesized
ttaaatagtaaatgtcaaaaaa

SEQ ID NO: 740291 - DNA, 22 bp, Artificial Sequence
  chemically synthesized
tttaaatagtaaatgtcaaaaa

SEQ ID NO: 740292 - DNA, 22 bp, Artificial Sequence
  chemically synthesized
ttttaaatagtaaatgtcaaaa

SEQ ID NO: 740293 - DNA, 22 bp, Artificial Sequence
  chemically synthesized
ttttgacatttactatttaaaa

SEQ ID NO: 740294 - DNA, 22 bp, Artificial Sequence
  chemically synthesized
tttgacatttactatttaaaaa

SEQ ID NO: 740295 - DNA, 22 bp, Artificial Sequence
  chemically synthesized
tgacatcatatttttttaaata

SEQ ID NO: 740296 - DNA, 22 bp, Artificial Sequence
  chemically synthesized
ttgacatttactatttaaaaaa

SEQ ID NO: 740297 - DNA, 22 bp, Artificial Sequence
  chemically synthesized
tgacatttactatttaaaaaaa

SEQ ID NO: 740298 - DNA, 22 bp, Artificial Sequence
  chemically synthesized
gacatttactatttaaaaaaat

SEQ ID NO: 740299 - DNA, 22 bp, Artificial Sequence
  chemically synthesized
acatttactatttaaaaaaata

SEQ ID NO: 740300 - DNA, 22 bp, Artificial Sequence
  chemically synthesized
actatttaaaaaaatatgatgt

SEQ ID NO: 740301 - DNA, 22 bp, Artificial Sequence
  chemically synthesized
ctatttaaaaaaatatgatgtc

SEQ ID NO: 740302 - DNA, 22 bp, Artificial Sequence
  chemically synthesized
tttaaaaaaatatgatgtcata

SEQ ID NO: 740303 - DNA, 22 bp, Artificial Sequence
  chemically synthesized
agcccaccaccattatgacatc

SEQ ID NO: 740304 - DNA, 22 bp, Artificial Sequence
  chemically synthesized
gagcccaccaccattatgacat

SEQ ID NO: 740305 - DNA, 22 bp, Artificial Sequence
  chemically synthesized
aaaaaaatatgatgtcataatg

SEQ ID NO: 740306 - DNA, 22 bp, Artificial Sequence
  chemically synthesized
aaaaaatatgatgtcataatgg

SEQ ID NO: 740307 - DNA, 22 bp, Artificial Sequence
  chemically synthesized
tggcgggaagcttgagcccacc

SEQ ID NO: 740308 - DNA, 22 bp, Artificial Sequence
  chemically synthesized
tatggcgggaagcttgagccca

SEQ ID NO: 740309 - DNA, 22 bp, Artificial Sequence
  chemically synthesized
tccaagttctatggcgggaagc

SEQ ID NO: 740310 - DNA, 22 bp, Artificial Sequence
  chemically synthesized
acgcattatccaagttctatgg

SEQ ID NO: 740311 - DNA, 22 bp, Artificial Sequence
  chemically synthesized
aagcttcccgccatagaacttg

SEQ ID NO: 740312 - DNA, 22 bp, Artificial Sequence
  chemically synthesized
cccgccatagaacttggataat

SEQ ID NO: 740313 - DNA, 22 bp, Artificial Sequence
  chemically synthesized
ccgccatagaacttggataatg

SEQ ID NO: 740314 - DNA, 22 bp, Artificial Sequence
  chemically synthesized
gaacaatgtatgtgaggctaac

SEQ ID NO: 740315 - DNA, 22 bp, Artificial Sequence
  chemically synthesized
agaacaatgtatgtgaggctaa

SEQ ID NO: 740316 - DNA, 22 bp, Artificial Sequence
  chemically synthesized
ggataatgcgttagcctcacat

SEQ ID NO: 740317 - DNA, 22 bp, Artificial Sequence
  chemically synthesized
gataatgcgttagcctcacata

SEQ ID NO: 740318 - DNA, 22 bp, Artificial Sequence
  chemically synthesized
tatttagaacaatgtatgtgag

SEQ ID NO: 740319 - DNA, 22 bp, Artificial Sequence
  chemically synthesized
atatttagaacaatgtatgtga

SEQ ID NO: 740320 - DNA, 22 bp, Artificial Sequence
  chemically synthesized
tatatttagaacaatgtatgtg

SEQ ID NO: 740321 - DNA, 22 bp, Artificial Sequence
  chemically synthesized
gcctcacatacattgttctaaa

SEQ ID NO: 740322 - DNA, 22 bp, Artificial Sequence
  chemically synthesized
agaatattttatatttagaaca

SEQ ID NO: 740323 - DNA, 22 bp, Artificial Sequence
  chemically synthesized
ttgagaatattttatatttaga

SEQ ID NO: 740324 - DNA, 22 bp, Artificial Sequence
  chemically synthesized
acatacattgttctaaatataa

SEQ ID NO: 740325 - DNA, 22 bp, Artificial Sequence
  chemically synthesized
atacatcctgttgagaatattt

SEQ ID NO: 740326 - DNA, 22 bp, Artificial Sequence
  chemically synthesized
ttctaaatataaaatattctca

SEQ ID NO: 740327 - DNA, 22 bp, Artificial Sequence
  chemically synthesized
taaatataaaatattctcaaca

SEQ ID NO: 740328 - DNA, 22 bp, Artificial Sequence
  chemically synthesized
aatataaaatattctcaacagg

SEQ ID NO: 740329 - DNA, 22 bp, Artificial Sequence
  chemically synthesized
gaaaagcaattcatacatcctg

SEQ ID NO: 740330 - DNA, 22 bp, Artificial Sequence
  chemically synthesized
ctggaaaagcaattcatacatc

SEQ ID NO: 740331 - DNA, 22 bp, Artificial Sequence
  chemically synthesized
tcaacaggatgtatgaattgct

SEQ ID NO: 740332 - DNA, 22 bp, Artificial Sequence
  chemically synthesized
ccattactggaaaagcaattca

SEQ ID NO: 740333 - DNA, 22 bp, Artificial Sequence
  chemically synthesized
aacaggatgtatgaattgcttt

SEQ ID NO: 740334 - DNA, 22 bp, Artificial Sequence
  chemically synthesized
cccattactggaaaagcaattc

SEQ ID NO: 740335 - DNA, 22 bp, Artificial Sequence
  chemically synthesized
tcccattactggaaaagcaatt

SEQ ID NO: 740336 - DNA, 22 bp, Artificial Sequence
  chemically synthesized
ttcccattactggaaaagcaat

SEQ ID NO: 740337 - DNA, 22 bp, Artificial Sequence
  chemically synthesized
tttcccattactggaaaagcaa

SEQ ID NO: 740338 - DNA, 22 bp, Artificial Sequence
  chemically synthesized
ttttcccattactggaaaagca

SEQ ID NO: 740339 - DNA, 22 bp, Artificial Sequence
  chemically synthesized
cttttccagtaatgggaaaaaa

SEQ ID NO: 740340 - DNA, 22 bp, Artificial Sequence
  chemically synthesized
acatcaagcaatttttttccca

SEQ ID NO: 740341 - DNA, 22 bp, Artificial Sequence
  chemically synthesized
ttccagtaatgggaaaaaaatt

SEQ ID NO: 740342 - DNA, 22 bp, Artificial Sequence
  chemically synthesized
tccagtaatgggaaaaaaattg

SEQ ID NO: 740343 - DNA, 22 bp, Artificial Sequence
  chemically synthesized
ccagtaatgggaaaaaaattgc

SEQ ID NO: 740344 - DNA, 22 bp, Artificial Sequence
  chemically synthesized
cagtaatgggaaaaaaattgct

SEQ ID NO: 740345 - DNA, 22 bp, Artificial Sequence
  chemically synthesized
cttgatgtgaacctcatttctt

SEQ ID NO: 740346 - DNA, 22 bp, Artificial Sequence
  chemically synthesized
gatgtgaacctcatttcttgct

SEQ ID NO: 740347 - DNA, 22 bp, Artificial Sequence
  chemically synthesized
atgtgaacctcatttcttgctt

SEQ ID NO: 740348 - DNA, 22 bp, Artificial Sequence
  chemically synthesized
agaaagagaagaaagcaagaaa

SEQ ID NO: 740349 - DNA, 22 bp, Artificial Sequence
  chemically synthesized
ttcagaaagagaagaaagcaag

SEQ ID NO: 740350 - DNA, 22 bp, Artificial Sequence
  chemically synthesized
gttcagaaagagaagaaagcaa

SEQ ID NO: 740351 - DNA, 22 bp, Artificial Sequence
  chemically synthesized
atttcttgctttcttctctttc

SEQ ID NO: 740352 - DNA, 22 bp, Artificial Sequence
  chemically synthesized
cttgctttcttctctttctgaa

SEQ ID NO: 740353 - DNA, 22 bp, Artificial Sequence
  chemically synthesized
ttgctttcttctctttctgaac

SEQ ID NO: 740354 - DNA, 22 bp, Artificial Sequence
  chemically synthesized
gctttcttctctttctgaacaa

SEQ ID NO: 740355 - DNA, 22 bp, Artificial Sequence
  chemically synthesized
ctttcttctctttctgaacaag

SEQ ID NO: 740356 - DNA, 22 bp, Artificial Sequence
  chemically synthesized
taaatgtgaggccttgttcaga

SEQ ID NO: 740357 - DNA, 22 bp, Artificial Sequence
  chemically synthesized
tcttctctttctgaacaaggcc

SEQ ID NO: 740358 - DNA, 22 bp, Artificial Sequence
  chemically synthesized
cttctctttctgaacaaggcct

SEQ ID NO: 740359 - DNA, 22 bp, Artificial Sequence
  chemically synthesized
ttctctttctgaacaaggcctc

SEQ ID NO: 740360 - DNA, 22 bp, Artificial Sequence
  chemically synthesized
cattataaatgtgaggccttgt

SEQ ID NO: 740361 - DNA, 22 bp, Artificial Sequence
  chemically synthesized
ctctttctgaacaaggcctcac

SEQ ID NO: 740362 - DNA, 22 bp, Artificial Sequence
  chemically synthesized
tctttctgaacaaggcctcaca

SEQ ID NO: 740363 - DNA, 22 bp, Artificial Sequence
  chemically synthesized
ctacattataaatgtgaggcct

SEQ ID NO: 740364 - DNA, 22 bp, Artificial Sequence
  chemically synthesized
tttctgaacaaggcctcacatt

SEQ ID NO: 740365 - DNA, 22 bp, Artificial Sequence
  chemically synthesized
tgctacattataaatgtgaggc

SEQ ID NO: 740366 - DNA, 22 bp, Artificial Sequence
  chemically synthesized
tctgaacaaggcctcacattta

SEQ ID NO: 740367 - DNA, 22 bp, Artificial Sequence
  chemically synthesized
ctgaacaaggcctcacatttat

SEQ ID NO: 740368 - DNA, 22 bp, Artificial Sequence
  chemically synthesized
tgaacaaggcctcacatttata

SEQ ID NO: 740369 - DNA, 22 bp, Artificial Sequence
  chemically synthesized
aacaaggcctcacatttataat

SEQ ID NO: 740370 - DNA, 22 bp, Artificial Sequence
  chemically synthesized
atagtaattctgctacattata

SEQ ID NO: 740371 - DNA, 22 bp, Artificial Sequence
  chemically synthesized
gatagtaattctgctacattat

SEQ ID NO: 740372 - DNA, 22 bp, Artificial Sequence
  chemically synthesized
tgatagtaattctgctacatta

SEQ ID NO: 740373 - DNA, 22 bp, Artificial Sequence
  chemically synthesized
tttgatagtaattctgctacat

SEQ ID NO: 740374 - DNA, 22 bp, Artificial Sequence
  chemically synthesized
ctttgatagtaattctgctaca

SEQ ID NO: 740375 - DNA, 22 bp, Artificial Sequence
  chemically synthesized
tctttgatagtaattctgctac

SEQ ID NO: 740376 - DNA, 22 bp, Artificial Sequence
  chemically synthesized
acatttataatgtagcagaatt

SEQ ID NO: 740377 - DNA, 22 bp, Artificial Sequence
  chemically synthesized
ttctttgatagtaattctgcta

SEQ ID NO: 740378 - DNA, 22 bp, Artificial Sequence
  chemically synthesized
ttttctttgatagtaattctgc

SEQ ID NO: 740379 - DNA, 22 bp, Artificial Sequence
  chemically synthesized
ataatgtagcagaattactatc

SEQ ID NO: 740380 - DNA, 22 bp, Artificial Sequence
  chemically synthesized
taatgtagcagaattactatca

SEQ ID NO: 740381 - DNA, 22 bp, Artificial Sequence
  chemically synthesized
cattcttttctttgatagtaat

SEQ ID NO: 740382 - DNA, 22 bp, Artificial Sequence
  chemically synthesized
gttccattcttttctttgatag

SEQ ID NO: 740383 - DNA, 22 bp, Artificial Sequence
  chemically synthesized
ctatcaaagaaaagaatggaac

SEQ ID NO: 740384 - DNA, 22 bp, Artificial Sequence
  chemically synthesized
tcaaagaaaagaatggaactaa

SEQ ID NO: 740385 - DNA, 22 bp, Artificial Sequence
  chemically synthesized
catataaccgagtcaagttagt

SEQ ID NO: 740386 - DNA, 22 bp, Artificial Sequence
  chemically synthesized
gcatataaccgagtcaagttag

SEQ ID NO: 740387 - DNA, 22 bp, Artificial Sequence
  chemically synthesized
gtttgcatataaccgagtcaag

SEQ ID NO: 740388 - DNA, 22 bp, Artificial Sequence
  chemically synthesized
ggtttgcatataaccgagtcaa

SEQ ID NO: 740389 - DNA, 22 bp, Artificial Sequence
  chemically synthesized
tggtttgcatataaccgagtca

SEQ ID NO: 740390 - DNA, 22 bp, Artificial Sequence
  chemically synthesized
acttgactcggttatatgcaaa

SEQ ID NO: 740391 - DNA, 22 bp, Artificial Sequence
  chemically synthesized
gactcggttatatgcaaaccaa

SEQ ID NO: 740392 - DNA, 22 bp, Artificial Sequence
  chemically synthesized
actcggttatatgcaaaccaaa

SEQ ID NO: 740393 - DNA, 22 bp, Artificial Sequence
  chemically synthesized
ataaatccaaggttttggtttg

SEQ ID NO: 740394 - DNA, 22 bp, Artificial Sequence
  chemically synthesized
ggttatatgcaaaccaaaacct

SEQ ID NO: 740395 - DNA, 22 bp, Artificial Sequence
  chemically synthesized
tatgcaaaccaaaaccttggat

SEQ ID NO: 740396 - DNA, 22 bp, Artificial Sequence
  chemically synthesized
gcagaaagctgataaatccaag

SEQ ID NO: 740397 - DNA, 22 bp, Artificial Sequence
  chemically synthesized
agcagaaagctgataaatccaa

SEQ ID NO: 740398 - DNA, 22 bp, Artificial Sequence
  chemically synthesized
tagcagaaagctgataaatcca

SEQ ID NO: 740399 - DNA, 22 bp, Artificial Sequence
  chemically synthesized
ttagcagaaagctgataaatcc

SEQ ID NO: 740400 - DNA, 22 bp, Artificial Sequence
  chemically synthesized
aaaagtgtttttagcagaaagc

SEQ ID NO: 740401 - DNA, 22 bp, Artificial Sequence
  chemically synthesized
aaaaagtgtttttagcagaaag

SEQ ID NO: 740402 - DNA, 22 bp, Artificial Sequence
  chemically synthesized
ggatttatcagctttctgctaa

SEQ ID NO: 740403 - DNA, 22 bp, Artificial Sequence
  chemically synthesized
gatttatcagctttctgctaaa

SEQ ID NO: 740404 - DNA, 22 bp, Artificial Sequence
  chemically synthesized
atcagctttctgctaaaaacac

SEQ ID NO: 740405 - DNA, 22 bp, Artificial Sequence
  chemically synthesized
tcagctttctgctaaaaacact

SEQ ID NO: 740406 - DNA, 22 bp, Artificial Sequence
  chemically synthesized
aagatatgcttaaaaagtgttt

SEQ ID NO: 740407 - DNA, 22 bp, Artificial Sequence
  chemically synthesized
aaagatatgcttaaaaagtgtt

SEQ ID NO: 740408 - DNA, 22 bp, Artificial Sequence
  chemically synthesized
tctgctaaaaacactttttaag

SEQ ID NO: 740409 - DNA, 22 bp, Artificial Sequence
  chemically synthesized
ctgctaaaaacactttttaagc

SEQ ID NO: 740410 - DNA, 22 bp, Artificial Sequence
  chemically synthesized
tgctaaaaacactttttaagca

SEQ ID NO: 740411 - DNA, 22 bp, Artificial Sequence
  chemically synthesized
ctaaaaacactttttaagcata

SEQ ID NO: 740412 - DNA, 22 bp, Artificial Sequence
  chemically synthesized
aaaacactttttaagcatatct

SEQ ID NO: 740413 - DNA, 22 bp, Artificial Sequence
  chemically synthesized
aacatgaccttaaagatatgct

SEQ ID NO: 740414 - DNA, 22 bp, Artificial Sequence
  chemically synthesized
gaacatgaccttaaagatatgc

SEQ ID NO: 740415 - DNA, 22 bp, Artificial Sequence
  chemically synthesized
tgaacatgaccttaaagatatg

SEQ ID NO: 740416 - DNA, 22 bp, Artificial Sequence
  chemically synthesized
ttgaacatgaccttaaagatat

SEQ ID NO: 740417 - DNA, 22 bp, Artificial Sequence
  chemically synthesized
tttttgaacatgaccttaaaga

SEQ ID NO: 740418 - DNA, 22 bp, Artificial Sequence
  chemically synthesized
tttaagcatatctttaaggtca

SEQ ID NO: 740419 - DNA, 22 bp, Artificial Sequence
  chemically synthesized
tatttttgaacatgaccttaaa

SEQ ID NO: 740420 - DNA, 22 bp, Artificial Sequence
  chemically synthesized
ttaagcatatctttaaggtcat

SEQ ID NO: 740421 - DNA, 22 bp, Artificial Sequence
  chemically synthesized
ctatttttgaacatgaccttaa

SEQ ID NO: 740422 - DNA, 22 bp, Artificial Sequence
  chemically synthesized
taagcatatctttaaggtcatg

SEQ ID NO: 740423 - DNA, 22 bp, Artificial Sequence
  chemically synthesized
aagcatatctttaaggtcatgt

SEQ ID NO: 740424 - DNA, 22 bp, Artificial Sequence
  chemically synthesized
agcatatctttaaggtcatgtt

SEQ ID NO: 740425 - DNA, 22 bp, Artificial Sequence
  chemically synthesized
atgtttctatttttgaacatga

SEQ ID NO: 740426 - DNA, 22 bp, Artificial Sequence
  chemically synthesized
catgtttctatttttgaacatg

SEQ ID NO: 740427 - DNA, 22 bp, Artificial Sequence
  chemically synthesized
taaggtcatgttcaaaaataga

SEQ ID NO: 740428 - DNA, 22 bp, Artificial Sequence
  chemically synthesized
aaggtcatgttcaaaaatagaa

SEQ ID NO: 740429 - DNA, 22 bp, Artificial Sequence
  chemically synthesized
aggtcatgttcaaaaatagaaa

SEQ ID NO: 740430 - DNA, 22 bp, Artificial Sequence
  chemically synthesized
tagcaaatttcatgtttctatt

SEQ ID NO: 740431 - DNA, 22 bp, Artificial Sequence
  chemically synthesized
tattgtagcaaatttcatgttt

SEQ ID NO: 740432 - DNA, 22 bp, Artificial Sequence
  chemically synthesized
tatattgtagcaaatttcatgt

SEQ ID NO: 740433 - DNA, 22 bp, Artificial Sequence
  chemically synthesized
aaaaatagaaacatgaaatttg

SEQ ID NO: 740434 - DNA, 22 bp, Artificial Sequence
  chemically synthesized
ctctatattgtagcaaatttca

SEQ ID NO: 740435 - DNA, 22 bp, Artificial Sequence
  chemically synthesized
tggtgtctgctctatattgtag

SEQ ID NO: 740436 - DNA, 22 bp, Artificial Sequence
  chemically synthesized
gtggtgtctgctctatattgta

SEQ ID NO: 740437 - DNA, 22 bp, Artificial Sequence
  chemically synthesized
agtttgtggtgtctgctctata

SEQ ID NO: 740438 - DNA, 22 bp, Artificial Sequence
  chemically synthesized
gctacaatatagagcagacacc

SEQ ID NO: 740439 - DNA, 22 bp, Artificial Sequence
  chemically synthesized
ctacaatatagagcagacacca

SEQ ID NO: 740440 - DNA, 22 bp, Artificial Sequence
  chemically synthesized
aacagttcagtttgtggtgtct

SEQ ID NO: 740441 - DNA, 22 bp, Artificial Sequence
  chemically synthesized
caatatagagcagacaccacaa

SEQ ID NO: 740442 - DNA, 22 bp, Artificial Sequence
  chemically synthesized
ttaaacagttcagtttgtggtg

SEQ ID NO: 740443 - DNA, 22 bp, Artificial Sequence
  chemically synthesized
ctattaaacagttcagtttgtg

SEQ ID NO: 740444 - DNA, 22 bp, Artificial Sequence
  chemically synthesized
tcctattaaacagttcagtttg

SEQ ID NO: 740445 - DNA, 22 bp, Artificial Sequence
  chemically synthesized
ctcctattaaacagttcagttt

SEQ ID NO: 740446 - DNA, 22 bp, Artificial Sequence
  chemically synthesized
aactgtttaataggagaaggct

SEQ ID NO: 740447 - DNA, 22 bp, Artificial Sequence
  chemically synthesized
aacccacatatacacagccttc

SEQ ID NO: 740448 - DNA, 22 bp, Artificial Sequence
  chemically synthesized
tttaataggagaaggctgtgta

SEQ ID NO: 740449 - DNA, 22 bp, Artificial Sequence
  chemically synthesized
cctaaacccacatatacacagc

SEQ ID NO: 740450 - DNA, 22 bp, Artificial Sequence
  chemically synthesized
aataggagaaggctgtgtatat

SEQ ID NO: 740451 - DNA, 22 bp, Artificial Sequence
  chemically synthesized
ccctaaacccacatatacacag

SEQ ID NO: 740452 - DNA, 22 bp, Artificial Sequence
  chemically synthesized
ataggagaaggctgtgtatatg

SEQ ID NO: 740453 - DNA, 22 bp, Artificial Sequence
  chemically synthesized
ttccctaaacccacatatacac

SEQ ID NO: 740454 - DNA, 22 bp, Artificial Sequence
  chemically synthesized
cttccctaaacccacatataca

SEQ ID NO: 740455 - DNA, 22 bp, Artificial Sequence
  chemically synthesized
ttcttccctaaacccacatata

SEQ ID NO: 740456 - DNA, 22 bp, Artificial Sequence
  chemically synthesized
atctcttcttccctaaacccac

SEQ ID NO: 740457 - DNA, 22 bp, Artificial Sequence
  chemically synthesized
aatctcttcttccctaaaccca

SEQ ID NO: 740458 - DNA, 22 bp, Artificial Sequence
  chemically synthesized
taatctcttcttccctaaaccc

SEQ ID NO: 740459 - DNA, 22 bp, Artificial Sequence
  chemically synthesized
ttaatctcttcttccctaaacc

SEQ ID NO: 740460 - DNA, 22 bp, Artificial Sequence
  chemically synthesized
tgtatatgtgggtttagggaag

SEQ ID NO: 740461 - DNA, 22 bp, Artificial Sequence
  chemically synthesized
acttttaatctcttcttcccta

SEQ ID NO: 740462 - DNA, 22 bp, Artificial Sequence
  chemically synthesized
taacttttaatctcttcttccc

SEQ ID NO: 740463 - DNA, 22 bp, Artificial Sequence
  chemically synthesized
tataactctaacttttaatctc

SEQ ID NO: 740464 - DNA, 22 bp, Artificial Sequence
  chemically synthesized
gtataactctaacttttaatct

SEQ ID NO: 740465 - DNA, 22 bp, Artificial Sequence
  chemically synthesized
agggaagaagagattaaaagtt

SEQ ID NO: 740466 - DNA, 22 bp, Artificial Sequence
  chemically synthesized
gggaagaagagattaaaagtta

SEQ ID NO: 740467 - DNA, 22 bp, Artificial Sequence
  chemically synthesized
cttgtataactctaacttttaa

SEQ ID NO: 740468 - DNA, 22 bp, Artificial Sequence
  chemically synthesized
tccttgtataactctaactttt

SEQ ID NO: 740469 - DNA, 22 bp, Artificial Sequence
  chemically synthesized
ctccttgtataactctaacttt

SEQ ID NO: 740470 - DNA, 22 bp, Artificial Sequence
  chemically synthesized
tatttctccttgtataactcta

SEQ ID NO: 740471 - DNA, 22 bp, Artificial Sequence
  chemically synthesized
aaattatatttctccttgtata

SEQ ID NO: 740472 - DNA, 22 bp, Artificial Sequence
  chemically synthesized
aaagttagagttatacaaggag

SEQ ID NO: 740473 - DNA, 22 bp, Artificial Sequence
  chemically synthesized
ttgaaattatatttctccttgt

SEQ ID NO: 740474 - DNA, 22 bp, Artificial Sequence
  chemically synthesized
gttgaaattatatttctccttg

SEQ ID NO: 740475 - DNA, 22 bp, Artificial Sequence
  chemically synthesized
gagttatacaaggagaaatata

SEQ ID NO: 740476 - DNA, 22 bp, Artificial Sequence
  chemically synthesized
tacaaggagaaatataatttca

SEQ ID NO: 740477 - DNA, 22 bp, Artificial Sequence
  chemically synthesized
ataatacaaatgtggtttgttg

SEQ ID NO: 740478 - DNA, 22 bp, Artificial Sequence
  chemically synthesized
ttcataatacaaatgtggtttg

SEQ ID NO: 740479 - DNA, 22 bp, Artificial Sequence
  chemically synthesized
attcataatacaaatgtggttt

SEQ ID NO: 740480 - DNA, 22 bp, Artificial Sequence
  chemically synthesized
tattcataatacaaatgtggtt

SEQ ID NO: 740481 - DNA, 22 bp, Artificial Sequence
  chemically synthesized
tttattcataatacaaatgtgg

SEQ ID NO: 740482 - DNA, 22 bp, Artificial Sequence
  chemically synthesized
ctttattcataatacaaatgtg

SEQ ID NO: 740483 - DNA, 22 bp, Artificial Sequence
  chemically synthesized
tctttattcataatacaaatgt

SEQ ID NO: 740484 - DNA, 22 bp, Artificial Sequence
  chemically synthesized
caacaaaccacatttgtattat

SEQ ID NO: 740485 - DNA, 22 bp, Artificial Sequence
  chemically synthesized
ctttctttattcataatacaaa

SEQ ID NO: 740486 - DNA, 22 bp, Artificial Sequence
  chemically synthesized
aacaaaccacatttgtattatg

SEQ ID NO: 740487 - DNA, 22 bp, Artificial Sequence
  chemically synthesized
gtattatgaataaagaaaggaa

SEQ ID NO: 740488 - DNA, 22 bp, Artificial Sequence
  chemically synthesized
aaaccaatgaagttcctttctt

SEQ ID NO: 740489 - DNA, 22 bp, Artificial Sequence
  chemically synthesized
tattatgaataaagaaaggaac

SEQ ID NO: 740490 - DNA, 22 bp, Artificial Sequence
  chemically synthesized
aaaaccaatgaagttcctttct

SEQ ID NO: 740491 - DNA, 22 bp, Artificial Sequence
  chemically synthesized
gtttaaaaccaatgaagttcct

SEQ ID NO: 740492 - DNA, 22 bp, Artificial Sequence
  chemically synthesized
tgaataaagaaaggaacttcat

SEQ ID NO: 740493 - DNA, 22 bp, Artificial Sequence
  chemically synthesized
agtttaaaaccaatgaagttcc

SEQ ID NO: 740494 - DNA, 22 bp, Artificial Sequence
  chemically synthesized
acagaatttagtttaaaaccaa

SEQ ID NO: 740495 - DNA, 22 bp, Artificial Sequence
  chemically synthesized
gacagaatttagtttaaaacca

SEQ ID NO: 740496 - DNA, 22 bp, Artificial Sequence
  chemically synthesized
cattggttttaaactaaattct

SEQ ID NO: 740497 - DNA, 22 bp, Artificial Sequence
  chemically synthesized
attggttttaaactaaattctg

SEQ ID NO: 740498 - DNA, 22 bp, Artificial Sequence
  chemically synthesized
gttttaaactaaattctgtcaa

SEQ ID NO: 740499 - DNA, 22 bp, Artificial Sequence
  chemically synthesized
ggggagatacacatttgacaga

SEQ ID NO: 740500 - DNA, 22 bp, Artificial Sequence
  chemically synthesized
taaactaaattctgtcaaatgt

SEQ ID NO: 740501 - DNA, 22 bp, Artificial Sequence
  chemically synthesized
aaactaaattctgtcaaatgtg

SEQ ID NO: 740502 - DNA, 22 bp, Artificial Sequence
  chemically synthesized
aactaaattctgtcaaatgtgt

SEQ ID NO: 740503 - DNA, 22 bp, Artificial Sequence
  chemically synthesized
gatatctgggggagatacacat

SEQ ID NO: 740504 - DNA, 22 bp, Artificial Sequence
  chemically synthesized
aattctgtcaaatgtgtatctc

SEQ ID NO: 740505 - DNA, 22 bp, Artificial Sequence
  chemically synthesized
tagatatctgggggagatacac

SEQ ID NO: 740506 - DNA, 22 bp, Artificial Sequence
  chemically synthesized
tgtcaaatgtgtatctccccca

SEQ ID NO: 740507 - DNA, 22 bp, Artificial Sequence
  chemically synthesized
tctctagatatctgggggagat

SEQ ID NO: 740508 - DNA, 22 bp, Artificial Sequence
  chemically synthesized
tcaaatgtgtatctcccccaga

SEQ ID NO: 740509 - DNA, 22 bp, Artificial Sequence
  chemically synthesized
tgtctctagatatctgggggag

SEQ ID NO: 740510 - DNA, 22 bp, Artificial Sequence
  chemically synthesized
tgattctgtctctagatatctg

SEQ ID NO: 740511 - DNA, 22 bp, Artificial Sequence
  chemically synthesized
atgattctgtctctagatatct

SEQ ID NO: 740512 - DNA, 22 bp, Artificial Sequence
  chemically synthesized
aatcttatgattctgtctctag

SEQ ID NO: 740513 - DNA, 22 bp, Artificial Sequence
  chemically synthesized
ccccagatatctagagacagaa

SEQ ID NO: 740514 - DNA, 22 bp, Artificial Sequence
  chemically synthesized
gagacagaatcataagattgaa

SEQ ID NO: 740515 - DNA, 22 bp, Artificial Sequence
  chemically synthesized
aggtcacatacagttcaatctt

SEQ ID NO: 740516 - DNA, 22 bp, Artificial Sequence
  chemically synthesized
tctaaggtcacatacagttcaa

SEQ ID NO: 740517 - DNA, 22 bp, Artificial Sequence
  chemically synthesized
gtctaaggtcacatacagttca

SEQ ID NO: 740518 - DNA, 22 bp, Artificial Sequence
  chemically synthesized
tgtctaaggtcacatacagttc

SEQ ID NO: 740519 - DNA, 22 bp, Artificial Sequence
  chemically synthesized
ttttgtctaaggtcacatacag

SEQ ID NO: 740520 - DNA, 22 bp, Artificial Sequence
  chemically synthesized
aactgtatgtgaccttagacaa

SEQ ID NO: 740521 - DNA, 22 bp, Artificial Sequence
  chemically synthesized
tatgtgaccttagacaaaatag

SEQ ID NO: 740522 - DNA, 22 bp, Artificial Sequence
  chemically synthesized
aaatgcagaaatctattttgtc

SEQ ID NO: 740523 - DNA, 22 bp, Artificial Sequence
  chemically synthesized
aaaatgcagaaatctattttgt

SEQ ID NO: 740524 - DNA, 22 bp, Artificial Sequence
  chemically synthesized
taaaatgcagaaatctattttg

SEQ ID NO: 740525 - DNA, 22 bp, Artificial Sequence
  chemically synthesized
ttaaaatgcagaaatctatttt

SEQ ID NO: 740526 - DNA, 22 bp, Artificial Sequence
  chemically synthesized
atttttaaaatgcagaaatcta

SEQ ID NO: 740527 - DNA, 22 bp, Artificial Sequence
  chemically synthesized
ctcatttttaaaatgcagaaat

SEQ ID NO: 740528 - DNA, 22 bp, Artificial Sequence
  chemically synthesized
agacaaaatagatttctgcatt

SEQ ID NO: 740529 - DNA, 22 bp, Artificial Sequence
  chemically synthesized
gacaaaatagatttctgcattt

SEQ ID NO: 740530 - DNA, 22 bp, Artificial Sequence
  chemically synthesized
tcctcatttttaaaatgcagaa

SEQ ID NO: 740531 - DNA, 22 bp, Artificial Sequence
  chemically synthesized
attctcctcatttttaaaatgc

SEQ ID NO: 740532 - DNA, 22 bp, Artificial Sequence
  chemically synthesized
aattctcctcatttttaaaatg

SEQ ID NO: 740533 - DNA, 22 bp, Artificial Sequence
  chemically synthesized
taattctcctcatttttaaaat

SEQ ID NO: 740534 - DNA, 22 bp, Artificial Sequence
  chemically synthesized
agctttaattctcctcattttt

SEQ ID NO: 740535 - DNA, 22 bp, Artificial Sequence
  chemically synthesized
tcagctttaattctcctcattt

SEQ ID NO: 740536 - DNA, 22 bp, Artificial Sequence
  chemically synthesized
ctgcattttaaaaatgaggaga

SEQ ID NO: 740537 - DNA, 22 bp, Artificial Sequence
  chemically synthesized
tgcattttaaaaatgaggagaa

SEQ ID NO: 740538 - DNA, 22 bp, Artificial Sequence
  chemically synthesized
tctcagctttaattctcctcat

SEQ ID NO: 740539 - DNA, 22 bp, Artificial Sequence
  chemically synthesized
cattttaaaaatgaggagaatt

SEQ ID NO: 740540 - DNA, 22 bp, Artificial Sequence
  chemically synthesized
acctctctcagctttaattctc

SEQ ID NO: 740541 - DNA, 22 bp, Artificial Sequence
  chemically synthesized
aacctctctcagctttaattct

SEQ ID NO: 740542 - DNA, 22 bp, Artificial Sequence
  chemically synthesized
taaaaatgaggagaattaaagc

SEQ ID NO: 740543 - DNA, 22 bp, Artificial Sequence
  chemically synthesized
aaaaatgaggagaattaaagct

SEQ ID NO: 740544 - DNA, 22 bp, Artificial Sequence
  chemically synthesized
aaaatgaggagaattaaagctg

SEQ ID NO: 740545 - DNA, 22 bp, Artificial Sequence
  chemically synthesized
tgagaaagccatttaacctctc

SEQ ID NO: 740546 - DNA, 22 bp, Artificial Sequence
  chemically synthesized
ttgtgagaaagccatttaacct

SEQ ID NO: 740547 - DNA, 22 bp, Artificial Sequence
  chemically synthesized
aagctgagagaggttaaatggc

SEQ ID NO: 740548 - DNA, 22 bp, Artificial Sequence
  chemically synthesized
agagaggttaaatggctttctc

SEQ ID NO: 740549 - DNA, 22 bp, Artificial Sequence
  chemically synthesized
accgtgttattgtgagaaagcc

SEQ ID NO: 740550 - DNA, 22 bp, Artificial Sequence
  chemically synthesized
gaccgtgttattgtgagaaagc

SEQ ID NO: 740551 - DNA, 22 bp, Artificial Sequence
  chemically synthesized
tttgaccgtgttattgtgagaa

SEQ ID NO: 740552 - DNA, 22 bp, Artificial Sequence
  chemically synthesized
aatggctttctcacaataacac

SEQ ID NO: 740553 - DNA, 22 bp, Artificial Sequence
  chemically synthesized
agccattatttgaccgtgttat

SEQ ID NO: 740554 - DNA, 22 bp, Artificial Sequence
  chemically synthesized
tctcacaataacacggtcaaat

SEQ ID NO: 740555 - DNA, 22 bp, Artificial Sequence
  chemically synthesized
agctcagccattatttgaccgt

SEQ ID NO: 740556 - DNA, 22 bp, Artificial Sequence
  chemically synthesized
ctcacaataacacggtcaaata

SEQ ID NO: 740557 - DNA, 22 bp, Artificial Sequence
  chemically synthesized
aagctcagccattatttgaccg

SEQ ID NO: 740558 - DNA, 22 bp, Artificial Sequence
  chemically synthesized
tcacaataacacggtcaaataa

SEQ ID NO: 740559 - DNA, 22 bp, Artificial Sequence
  chemically synthesized
acaataacacggtcaaataatg

SEQ ID NO: 740560 - DNA, 22 bp, Artificial Sequence
  chemically synthesized
aaacttaagctcagccattatt

SEQ ID NO: 740561 - DNA, 22 bp, Artificial Sequence
  chemically synthesized
caaacttaagctcagccattat

SEQ ID NO: 740562 - DNA, 22 bp, Artificial Sequence
  chemically synthesized
acttcaaacttaagctcagcca

SEQ ID NO: 740563 - DNA, 22 bp, Artificial Sequence
  chemically synthesized
ggaggtctaacttcaaacttaa

SEQ ID NO: 740564 - DNA, 22 bp, Artificial Sequence
  chemically synthesized
ttaggaggtctaacttcaaact

SEQ ID NO: 740565 - DNA, 22 bp, Artificial Sequence
  chemically synthesized
actattaggaggtctaacttca

SEQ ID NO: 740566 - DNA, 22 bp, Artificial Sequence
  chemically synthesized
agcttaagtttgaagttagacc

SEQ ID NO: 740567 - DNA, 22 bp, Artificial Sequence
  chemically synthesized
gattgactattaggaggtctaa

SEQ ID NO: 740568 - DNA, 22 bp, Artificial Sequence
  chemically synthesized
aagtttgaagttagacctccta

SEQ ID NO: 740569 - DNA, 22 bp, Artificial Sequence
  chemically synthesized
agtttgaagttagacctcctaa

SEQ ID NO: 740570 - DNA, 22 bp, Artificial Sequence
  chemically synthesized
gaagttagacctcctaatagtc

SEQ ID NO: 740571 - DNA, 22 bp, Artificial Sequence
  chemically synthesized
aagttagacctcctaatagtca

SEQ ID NO: 740572 - DNA, 22 bp, Artificial Sequence
  chemically synthesized
gacctcctaatagtcaatccaa

SEQ ID NO: 740573 - DNA, 22 bp, Artificial Sequence
  chemically synthesized
ctaatagtcaatccaatgctct

SEQ ID NO: 740574 - DNA, 22 bp, Artificial Sequence
  chemically synthesized
atagtcaatccaatgctctttt

SEQ ID NO: 740575 - DNA, 22 bp, Artificial Sequence
  chemically synthesized
ttttcgctatatcatactatct

SEQ ID NO: 740576 - DNA, 22 bp, Artificial Sequence
  chemically synthesized
ttcgctatatcatactatctcc

SEQ ID NO: 740577 - DNA, 22 bp, Artificial Sequence
  chemically synthesized
tcgctatatcatactatctcct

SEQ ID NO: 740578 - DNA, 22 bp, Artificial Sequence
  chemically synthesized
cgctatatcatactatctcctt

SEQ ID NO: 740579 - DNA, 22 bp, Artificial Sequence
  chemically synthesized
gctatatcatactatctcctta

SEQ ID NO: 740580 - DNA, 22 bp, Artificial Sequence
  chemically synthesized
tatcatactatctccttacatg

SEQ ID NO: 740581 - DNA, 22 bp, Artificial Sequence
  chemically synthesized
taagtacaggaaaacacatgta

SEQ ID NO: 740582 - DNA, 22 bp, Artificial Sequence
  chemically synthesized
gttataagtacaggaaaacaca

SEQ ID NO: 740583 - DNA, 22 bp, Artificial Sequence
  chemically synthesized
ggttataagtacaggaaaacac

SEQ ID NO: 740584 - DNA, 22 bp, Artificial Sequence
  chemically synthesized
tctccttacatgtgttttcctg

SEQ ID NO: 740585 - DNA, 22 bp, Artificial Sequence
  chemically synthesized
cttacatgtgttttcctgtact

SEQ ID NO: 740586 - DNA, 22 bp, Artificial Sequence
  chemically synthesized
acatgtgttttcctgtacttat

SEQ ID NO: 740587 - DNA, 22 bp, Artificial Sequence
  chemically synthesized
catgtgttttcctgtacttata

SEQ ID NO: 740588 - DNA, 22 bp, Artificial Sequence
  chemically synthesized
caatgagtaaaaacttggttat

SEQ ID NO: 740589 - DNA, 22 bp, Artificial Sequence
  chemically synthesized
acaatgagtaaaaacttggtta

SEQ ID NO: 740590 - DNA, 22 bp, Artificial Sequence
  chemically synthesized
tcctgtacttataaccaagttt

SEQ ID NO: 740591 - DNA, 22 bp, Artificial Sequence
  chemically synthesized
tacaatgagtaaaaacttggtt

SEQ ID NO: 740592 - DNA, 22 bp, Artificial Sequence
  chemically synthesized
cctgtacttataaccaagtttt

SEQ ID NO: 740593 - DNA, 22 bp, Artificial Sequence
  chemically synthesized
ctgtacttataaccaagttttt

SEQ ID NO: 740594 - DNA, 22 bp, Artificial Sequence
  chemically synthesized
tttacaatgagtaaaaacttgg

SEQ ID NO: 740595 - DNA, 22 bp, Artificial Sequence
  chemically synthesized
tacttataaccaagtttttact

SEQ ID NO: 740596 - DNA, 22 bp, Artificial Sequence
  chemically synthesized
ataaccaagtttttactcattg

SEQ ID NO: 740597 - DNA, 22 bp, Artificial Sequence
  chemically synthesized
taaccaagtttttactcattgt

SEQ ID NO: 740598 - DNA, 22 bp, Artificial Sequence
  chemically synthesized
tgtagccattctttacaatgag

SEQ ID NO: 740599 - DNA, 22 bp, Artificial Sequence
  chemically synthesized
ctatgtagccattctttacaat

SEQ ID NO: 740600 - DNA, 22 bp, Artificial Sequence
  chemically synthesized
actatgtagccattctttacaa

SEQ ID NO: 740601 - DNA, 22 bp, Artificial Sequence
  chemically synthesized
ttactcattgtaaagaatggct

SEQ ID NO: 740602 - DNA, 22 bp, Artificial Sequence
  chemically synthesized
tactcattgtaaagaatggcta

SEQ ID NO: 740603 - DNA, 22 bp, Artificial Sequence
  chemically synthesized
actcattgtaaagaatggctac

SEQ ID NO: 740604 - DNA, 22 bp, Artificial Sequence
  chemically synthesized
ctcattgtaaagaatggctaca

SEQ ID NO: 740605 - DNA, 22 bp, Artificial Sequence
  chemically synthesized
attgtaaagaatggctacatag

SEQ ID NO: 740606 - DNA, 22 bp, Artificial Sequence
  chemically synthesized
taaagaatggctacatagtaag

SEQ ID NO: 740607 - DNA, 22 bp, Artificial Sequence
  chemically synthesized
aggtatcaaaaacagtaaatag

SEQ ID NO: 740608 - DNA, 22 bp, Artificial Sequence
  chemically synthesized
aaggtatcaaaaacagtaaata

SEQ ID NO: 740609 - DNA, 22 bp, Artificial Sequence
  chemically synthesized
catagtaagctatttactgttt

SEQ ID NO: 740610 - DNA, 22 bp, Artificial Sequence
  chemically synthesized
catttaaggtatcaaaaacagt

SEQ ID NO: 740611 - DNA, 22 bp, Artificial Sequence
  chemically synthesized
gcatttaaggtatcaaaaacag

SEQ ID NO: 740612 - DNA, 22 bp, Artificial Sequence
  chemically synthesized
tttgcatttaaggtatcaaaaa

SEQ ID NO: 740613 - DNA, 22 bp, Artificial Sequence
  chemically synthesized
atttgcatttaaggtatcaaaa

SEQ ID NO: 740614 - DNA, 22 bp, Artificial Sequence
  chemically synthesized
tttatttgcatttaaggtatca

SEQ ID NO: 740615 - DNA, 22 bp, Artificial Sequence
  chemically synthesized
tttactgtttttgataccttaa

SEQ ID NO: 740616 - DNA, 22 bp, Artificial Sequence
  chemically synthesized
actgtttttgataccttaaatg

SEQ ID NO: 740617 - DNA, 22 bp, Artificial Sequence
  chemically synthesized
ctgtttttgataccttaaatgc

SEQ ID NO: 740618 - DNA, 22 bp, Artificial Sequence
  chemically synthesized
cactatttatttgcatttaagg

SEQ ID NO: 740619 - DNA, 22 bp, Artificial Sequence
  chemically synthesized
tttttgataccttaaatgcaaa

SEQ ID NO: 740620 - DNA, 22 bp, Artificial Sequence
  chemically synthesized
gttgcactatttatttgcattt

SEQ ID NO: 740621 - DNA, 22 bp, Artificial Sequence
  chemically synthesized
ttgataccttaaatgcaaataa

SEQ ID NO: 740622 - DNA, 22 bp, Artificial Sequence
  chemically synthesized
tagttgcactatttatttgcat

SEQ ID NO: 740623 - DNA, 22 bp, Artificial Sequence
  chemically synthesized
tgataccttaaatgcaaataaa

SEQ ID NO: 740624 - DNA, 22 bp, Artificial Sequence
  chemically synthesized
gataccttaaatgcaaataaat

SEQ ID NO: 740625 - DNA, 22 bp, Artificial Sequence
  chemically synthesized
ataccttaaatgcaaataaata

SEQ ID NO: 740626 - DNA, 22 bp, Artificial Sequence
  chemically synthesized
aaatgcaaataaatagtgcaac

SEQ ID NO: 740627 - DNA, 22 bp, Artificial Sequence
  chemically synthesized
aatgcaaataaatagtgcaact

SEQ ID NO: 740628 - DNA, 22 bp, Artificial Sequence
  chemically synthesized
agtgatccattctagttgcact

SEQ ID NO: 740629 - DNA, 22 bp, Artificial Sequence
  chemically synthesized
atcaatgctaagtgatccattc

SEQ ID NO: 740630 - DNA, 22 bp, Artificial Sequence
  chemically synthesized
aatcaatgctaagtgatccatt

SEQ ID NO: 740631 - DNA, 22 bp, Artificial Sequence
  chemically synthesized
taatcaatgctaagtgatccat

SEQ ID NO: 740632 - DNA, 22 bp, Artificial Sequence
  chemically synthesized
ttaatcaatgctaagtgatcca

SEQ ID NO: 740633 - DNA, 22 bp, Artificial Sequence
  chemically synthesized
tttaatcaatgctaagtgatcc

SEQ ID NO: 740634 - DNA, 22 bp, Artificial Sequence
  chemically synthesized
ttttaatcaatgctaagtgatc

SEQ ID NO: 740635 - DNA, 22 bp, Artificial Sequence
  chemically synthesized
tttttaatcaatgctaagtgat

SEQ ID NO: 740636 - DNA, 22 bp, Artificial Sequence
  chemically synthesized
ttttttaatcaatgctaagtga

SEQ ID NO: 740637 - DNA, 22 bp, Artificial Sequence
  chemically synthesized
tttttttaatcaatgctaagtg

SEQ ID NO: 740638 - DNA, 22 bp, Artificial Sequence
  chemically synthesized
ttttttttaatcaatgctaagt

SEQ ID NO: 740639 - DNA, 22 bp, Artificial Sequence
  chemically synthesized
tttttttttaatcaatgctaag

SEQ ID NO: 740640 - DNA, 22 bp, Artificial Sequence
  chemically synthesized
ttttttttttaatcaatgctaa

SEQ ID NO: 740641 - DNA, 22 bp, Artificial Sequence
  chemically synthesized
gaatggatcacttagcattgat

SEQ ID NO: 740642 - DNA, 22 bp, Artificial Sequence
  chemically synthesized
gtaagaaaagtttttttttttt

SEQ ID NO: 740643 - DNA, 22 bp, Artificial Sequence
  chemically synthesized
agcattgattaaaaaaaaaaaa

SEQ ID NO: 740644 - DNA, 22 bp, Artificial Sequence
  chemically synthesized
gcattgattaaaaaaaaaaaaa

SEQ ID NO: 740645 - DNA, 22 bp, Artificial Sequence
  chemically synthesized
tgactagtaagaaaagtttttt

SEQ ID NO: 740646 - DNA, 22 bp, Artificial Sequence
  chemically synthesized
attaaaaaaaaaaaaacttttc

SEQ ID NO: 740647 - DNA, 22 bp, Artificial Sequence
  chemically synthesized
aaaaaaaaaaaacttttcttac

SEQ ID NO: 740648 - DNA, 22 bp, Artificial Sequence
  chemically synthesized
caaatgaggtcaaaggattatg

SEQ ID NO: 740649 - DNA, 22 bp, Artificial Sequence
  chemically synthesized
ttcttactagtcataatccttt

SEQ ID NO: 740650 - DNA, 22 bp, Artificial Sequence
  chemically synthesized
ccaaatgaggtcaaaggattat

SEQ ID NO: 740651 - DNA, 22 bp, Artificial Sequence
  chemically synthesized
tcttactagtcataatcctttg

SEQ ID NO: 740652 - DNA, 22 bp, Artificial Sequence
  chemically synthesized
cttactagtcataatcctttga

SEQ ID NO: 740653 - DNA, 22 bp, Artificial Sequence
  chemically synthesized
ttactagtcataatcctttgac

SEQ ID NO: 740654 - DNA, 22 bp, Artificial Sequence
  chemically synthesized
actagtcataatcctttgacct

SEQ ID NO: 740655 - DNA, 22 bp, Artificial Sequence
  chemically synthesized
ctagtcataatcctttgacctc

SEQ ID NO: 740656 - DNA, 22 bp, Artificial Sequence
  chemically synthesized
gtcataatcctttgacctcatt

SEQ ID NO: 740657 - DNA, 22 bp, Artificial Sequence
  chemically synthesized
tgacagtggcaggtagatttcc

SEQ ID NO: 740658 - DNA, 22 bp, Artificial Sequence
  chemically synthesized
tgacctcatttggaaatctacc

SEQ ID NO: 740659 - DNA, 22 bp, Artificial Sequence
  chemically synthesized
gtgacagtggcaggtagatttc

SEQ ID NO: 740660 - DNA, 22 bp, Artificial Sequence
  chemically synthesized
gacctcatttggaaatctacct

SEQ ID NO: 740661 - DNA, 22 bp, Artificial Sequence
  chemically synthesized
acctcatttggaaatctacctg

SEQ ID NO: 740662 - DNA, 22 bp, Artificial Sequence
  chemically synthesized
atttggaaatctacctgccact

SEQ ID NO: 740663 - DNA, 22 bp, Artificial Sequence
  chemically synthesized
ggaaatctacctgccactgtca

SEQ ID NO: 740664 - DNA, 22 bp, Artificial Sequence
  chemically synthesized
gaaatctacctgccactgtcac

SEQ ID NO: 740665 - DNA, 22 bp, Artificial Sequence
  chemically synthesized
agaacgtggtaaaagatttgtg

SEQ ID NO: 740666 - DNA, 22 bp, Artificial Sequence
  chemically synthesized
cctgccactgtcacaaatcttt

SEQ ID NO: 740667 - DNA, 22 bp, Artificial Sequence
  chemically synthesized
cagaacgtggtaaaagatttgt

SEQ ID NO: 740668 - DNA, 22 bp, Artificial Sequence
  chemically synthesized
tcagaacgtggtaaaagatttg

SEQ ID NO: 740669 - DNA, 22 bp, Artificial Sequence
  chemically synthesized
ccactgtcacaaatcttttacc

SEQ ID NO: 740670 - DNA, 22 bp, Artificial Sequence
  chemically synthesized
ctttcagaacgtggtaaaagat

SEQ ID NO: 740671 - DNA, 22 bp, Artificial Sequence
  chemically synthesized
gctttcagaacgtggtaaaaga

SEQ ID NO: 740672 - DNA, 22 bp, Artificial Sequence
  chemically synthesized
tcacaaatcttttaccacgttc

SEQ ID NO: 740673 - DNA, 22 bp, Artificial Sequence
  chemically synthesized
ttaccacgttctgaaagcaaac

SEQ ID NO: 740674 - DNA, 22 bp, Artificial Sequence
  chemically synthesized
taccacgttctgaaagcaaacg

SEQ ID NO: 740675 - DNA, 22 bp, Artificial Sequence
  chemically synthesized
accacgttctgaaagcaaacgt

SEQ ID NO: 740676 - DNA, 22 bp, Artificial Sequence
  chemically synthesized
ccacgttctgaaagcaaacgtg

SEQ ID NO: 740677 - DNA, 22 bp, Artificial Sequence
  chemically synthesized
gagagcagaatgccacgtttgc

SEQ ID NO: 740678 - DNA, 22 bp, Artificial Sequence
  chemically synthesized
agagagcagaatgccacgtttg

SEQ ID NO: 740679 - DNA, 22 bp, Artificial Sequence
  chemically synthesized
tagagagcagaatgccacgttt

SEQ ID NO: 740680 - DNA, 22 bp, Artificial Sequence
  chemically synthesized
ttagagagcagaatgccacgtt

SEQ ID NO: 740681 - DNA, 22 bp, Artificial Sequence
  chemically synthesized
ttttagagagcagaatgccacg

SEQ ID NO: 740682 - DNA, 22 bp, Artificial Sequence
  chemically synthesized
cttttagagagcagaatgccac

SEQ ID NO: 740683 - DNA, 22 bp, Artificial Sequence
  chemically synthesized
tgaaagcaaacgtggcattctg

SEQ ID NO: 740684 - DNA, 22 bp, Artificial Sequence
  chemically synthesized
aaagcaaacgtggcattctgct

SEQ ID NO: 740685 - DNA, 22 bp, Artificial Sequence
  chemically synthesized
taatttcttttagagagcagaa

SEQ ID NO: 740686 - DNA, 22 bp, Artificial Sequence
  chemically synthesized
ataatttcttttagagagcaga

SEQ ID NO: 740687 - DNA, 22 bp, Artificial Sequence
  chemically synthesized
tataatttcttttagagagcag

SEQ ID NO: 740688 - DNA, 22 bp, Artificial Sequence
  chemically synthesized
gaagtatattttataatttctt

SEQ ID NO: 740689 - DNA, 22 bp, Artificial Sequence
  chemically synthesized
tgctctctaaaagaaattataa

SEQ ID NO: 740690 - DNA, 22 bp, Artificial Sequence
  chemically synthesized
tagaagtatattttataatttc

SEQ ID NO: 740691 - DNA, 22 bp, Artificial Sequence
  chemically synthesized
ctctctaaaagaaattataaaa

SEQ ID NO: 740692 - DNA, 22 bp, Artificial Sequence
  chemically synthesized
tctaaaagaaattataaaatat

SEQ ID NO: 740693 - DNA, 22 bp, Artificial Sequence
  chemically synthesized
taaaagaaattataaaatatac

SEQ ID NO: 740694 - DNA, 22 bp, Artificial Sequence
  chemically synthesized
aaagaaattataaaatatactt

SEQ ID NO: 740695 - DNA, 22 bp, Artificial Sequence
  chemically synthesized
gtcccatataagtgttctagaa

SEQ ID NO: 740696 - DNA, 22 bp, Artificial Sequence
  chemically synthesized
taaaatatacttctagaacact

SEQ ID NO: 740697 - DNA, 22 bp, Artificial Sequence
  chemically synthesized
ctagaacacttatatgggacta

SEQ ID NO: 740698 - DNA, 22 bp, Artificial Sequence
  chemically synthesized
tagaacacttatatgggactaa

SEQ ID NO: 740699 - DNA, 22 bp, Artificial Sequence
  chemically synthesized
gaacacttatatgggactaatg

SEQ ID NO: 740700 - DNA, 22 bp, Artificial Sequence
  chemically synthesized
atatgggactaatgtggccatt

SEQ ID NO: 740701 - DNA, 22 bp, Artificial Sequence
  chemically synthesized
tatgggactaatgtggccattg

SEQ ID NO: 740702 - DNA, 22 bp, Artificial Sequence
  chemically synthesized
atgtggccattggttttctttg

SEQ ID NO: 740703 - DNA, 22 bp, Artificial Sequence
  chemically synthesized
gttttctttggacatttattac

SEQ ID NO: 740704 - DNA, 22 bp, Artificial Sequence
  chemically synthesized
tctttggacatttattactttc

SEQ ID NO: 740705 - DNA, 22 bp, Artificial Sequence
  chemically synthesized
agtataaataaggaaagtaata

SEQ ID NO: 740706 - DNA, 22 bp, Artificial Sequence
  chemically synthesized
ctttggacatttattactttcc

SEQ ID NO: 740707 - DNA, 22 bp, Artificial Sequence
  chemically synthesized
aagtataaataaggaaagtaat

SEQ ID NO: 740708 - DNA, 22 bp, Artificial Sequence
  chemically synthesized
tttggacatttattactttcct

SEQ ID NO: 740709 - DNA, 22 bp, Artificial Sequence
  chemically synthesized
tggacatttattactttcctta

SEQ ID NO: 740710 - DNA, 22 bp, Artificial Sequence
  chemically synthesized
ggacatttattactttccttat

SEQ ID NO: 740711 - DNA, 22 bp, Artificial Sequence
  chemically synthesized
gacatttattactttccttatt

SEQ ID NO: 740712 - DNA, 22 bp, Artificial Sequence
  chemically synthesized
atcttaagtataaataaggaaa

SEQ ID NO: 740713 - DNA, 22 bp, Artificial Sequence
  chemically synthesized
catcttaagtataaataaggaa

SEQ ID NO: 740714 - DNA, 22 bp, Artificial Sequence
  chemically synthesized
tcatcttaagtataaataagga

SEQ ID NO: 740715 - DNA, 22 bp, Artificial Sequence
  chemically synthesized
ttcatcttaagtataaataagg

SEQ ID NO: 740716 - DNA, 22 bp, Artificial Sequence
  chemically synthesized
attactttccttatttatactt

SEQ ID NO: 740717 - DNA, 22 bp, Artificial Sequence
  chemically synthesized
ttactttccttatttatactta

SEQ ID NO: 740718 - DNA, 22 bp, Artificial Sequence
  chemically synthesized
ctttccttatttatacttaaga

SEQ ID NO: 740719 - DNA, 22 bp, Artificial Sequence
  chemically synthesized
gtatgtttttcatcttaagtat

SEQ ID NO: 740720 - DNA, 22 bp, Artificial Sequence
  chemically synthesized
agtatgtttttcatcttaagta

SEQ ID NO: 740721 - DNA, 22 bp, Artificial Sequence
  chemically synthesized
tccttatttatacttaagatga

SEQ ID NO: 740722 - DNA, 22 bp, Artificial Sequence
  chemically synthesized
ccttatttatacttaagatgaa

SEQ ID NO: 740723 - DNA, 22 bp, Artificial Sequence
  chemically synthesized
cttatttatacttaagatgaaa

SEQ ID NO: 740724 - DNA, 22 bp, Artificial Sequence
  chemically synthesized
atttatacttaagatgaaaaac

SEQ ID NO: 740725 - DNA, 22 bp, Artificial Sequence
  chemically synthesized
catccttagtatgtttttcatc

SEQ ID NO: 740726 - DNA, 22 bp, Artificial Sequence
  chemically synthesized
tttatacttaagatgaaaaaca

SEQ ID NO: 740727 - DNA, 22 bp, Artificial Sequence
  chemically synthesized
ttccatccttagtatgtttttc

SEQ ID NO: 740728 - DNA, 22 bp, Artificial Sequence
  chemically synthesized
atacttaagatgaaaaacatac

SEQ ID NO: 740729 - DNA, 22 bp, Artificial Sequence
  chemically synthesized
tacttaagatgaaaaacatact

SEQ ID NO: 740730 - DNA, 22 bp, Artificial Sequence
  chemically synthesized
tctgttccatccttagtatgtt

SEQ ID NO: 740731 - DNA, 22 bp, Artificial Sequence
  chemically synthesized
atctgttccatccttagtatgt

SEQ ID NO: 740732 - DNA, 22 bp, Artificial Sequence
  chemically synthesized
tatctgttccatccttagtatg

SEQ ID NO: 740733 - DNA, 22 bp, Artificial Sequence
  chemically synthesized
aagatgaaaaacatactaagga

SEQ ID NO: 740734 - DNA, 22 bp, Artificial Sequence
  chemically synthesized
agatgaaaaacatactaaggat

SEQ ID NO: 740735 - DNA, 22 bp, Artificial Sequence
  chemically synthesized
aaattttatctgttccatcctt

SEQ ID NO: 740736 - DNA, 22 bp, Artificial Sequence
  chemically synthesized
ttaaaattttatctgttccatc

SEQ ID NO: 740737 - DNA, 22 bp, Artificial Sequence
  chemically synthesized
agtactattaaaattttatctg

SEQ ID NO: 740738 - DNA, 22 bp, Artificial Sequence
  chemically synthesized
aggatggaacagataaaatttt

SEQ ID NO: 740739 - DNA, 22 bp, Artificial Sequence
  chemically synthesized
catagtagttgagtactattaa

SEQ ID NO: 740740 - DNA, 22 bp, Artificial Sequence
  chemically synthesized
ctccatagtagttgagtactat

SEQ ID NO: 740741 - DNA, 22 bp, Artificial Sequence
  chemically synthesized
gctccatagtagttgagtacta

SEQ ID NO: 740742 - DNA, 22 bp, Artificial Sequence
  chemically synthesized
tttgctccatagtagttgagta

SEQ ID NO: 740743 - DNA, 22 bp, Artificial Sequence
  chemically synthesized
tgtttgctccatagtagttgag

SEQ ID NO: 740744 - DNA, 22 bp, Artificial Sequence
  chemically synthesized
tctgtttgctccatagtagttg

SEQ ID NO: 740745 - DNA, 22 bp, Artificial Sequence
  chemically synthesized
ctctgtttgctccatagtagtt

SEQ ID NO: 740746 - DNA, 22 bp, Artificial Sequence
  chemically synthesized
taatagtactcaactactatgg

SEQ ID NO: 740747 - DNA, 22 bp, Artificial Sequence
  chemically synthesized
tctctgtttgctccatagtagt

SEQ ID NO: 740748 - DNA, 22 bp, Artificial Sequence
  chemically synthesized
aatagtactcaactactatgga

SEQ ID NO: 740749 - DNA, 22 bp, Artificial Sequence
  chemically synthesized
atagtactcaactactatggag

SEQ ID NO: 740750 - DNA, 22 bp, Artificial Sequence
  chemically synthesized
tatgcctttctctgtttgctcc

SEQ ID NO: 740751 - DNA, 22 bp, Artificial Sequence
  chemically synthesized
aactactatggagcaaacagag

SEQ ID NO: 740752 - DNA, 22 bp, Artificial Sequence
  chemically synthesized
ctatggagcaaacagagaaagg

SEQ ID NO: 740753 - DNA, 22 bp, Artificial Sequence
  chemically synthesized
agtgattatatgcctttctctg

SEQ ID NO: 740754 - DNA, 22 bp, Artificial Sequence
  chemically synthesized
tggagcaaacagagaaaggcat

SEQ ID NO: 740755 - DNA, 22 bp, Artificial Sequence
  chemically synthesized
aagcaaggcgatatagctaagt

SEQ ID NO: 740756 - DNA, 22 bp, Artificial Sequence
  chemically synthesized
agctatatcgccttgctttagt

SEQ ID NO: 740757 - DNA, 22 bp, Artificial Sequence
  chemically synthesized
taagtggcatcgactaaagcaa

SEQ ID NO: 740758 - DNA, 22 bp, Artificial Sequence
  chemically synthesized
gctatatcgccttgctttagtc

SEQ ID NO: 740759 - DNA, 22 bp, Artificial Sequence
  chemically synthesized
ttataagtggcatcgactaaag

SEQ ID NO: 740760 - DNA, 22 bp, Artificial Sequence
  chemically synthesized
tatcgccttgctttagtcgatg

SEQ ID NO: 740761 - DNA, 22 bp, Artificial Sequence
  chemically synthesized
gattgttataagtggcatcgac

SEQ ID NO: 740762 - DNA, 22 bp, Artificial Sequence
  chemically synthesized
tagattgttataagtggcatcg

SEQ ID NO: 740763 - DNA, 22 bp, Artificial Sequence
  chemically synthesized
gctttagtcgatgccacttata

SEQ ID NO: 740764 - DNA, 22 bp, Artificial Sequence
  chemically synthesized
ctttagtcgatgccacttataa

SEQ ID NO: 740765 - DNA, 22 bp, Artificial Sequence
  chemically synthesized
tattctagattgttataagtgg

SEQ ID NO: 740766 - DNA, 22 bp, Artificial Sequence
  chemically synthesized
gtattctagattgttataagtg

SEQ ID NO: 740767 - DNA, 22 bp, Artificial Sequence
  chemically synthesized
tagtcgatgccacttataacaa

SEQ ID NO: 740768 - DNA, 22 bp, Artificial Sequence
  chemically synthesized
agtcgatgccacttataacaat

SEQ ID NO: 740769 - DNA, 22 bp, Artificial Sequence
  chemically synthesized
gtcgatgccacttataacaatc

SEQ ID NO: 740770 - DNA, 22 bp, Artificial Sequence
  chemically synthesized
aaagatttgtattctagattgt

SEQ ID NO: 740771 - DNA, 22 bp, Artificial Sequence
  chemically synthesized
ataacaatctagaatacaaatc

SEQ ID NO: 740772 - DNA, 22 bp, Artificial Sequence
  chemically synthesized
taacaatctagaatacaaatct

SEQ ID NO: 740773 - DNA, 22 bp, Artificial Sequence
  chemically synthesized
tgatggatagtcctgaaagatt

SEQ ID NO: 740774 - DNA, 22 bp, Artificial Sequence
  chemically synthesized
ttgtgatggatagtcctgaaag

SEQ ID NO: 740775 - DNA, 22 bp, Artificial Sequence
  chemically synthesized
gttgtgatggatagtcctgaaa

SEQ ID NO: 740776 - DNA, 22 bp, Artificial Sequence
  chemically synthesized
gaatacaaatctttcaggacta

SEQ ID NO: 740777 - DNA, 22 bp, Artificial Sequence
  chemically synthesized
ttgttgtgatggatagtcctga

SEQ ID NO: 740778 - DNA, 22 bp, Artificial Sequence
  chemically synthesized
attcttgttgtgatggatagtc

SEQ ID NO: 740779 - DNA, 22 bp, Artificial Sequence
  chemically synthesized
aattcttgttgtgatggatagt

SEQ ID NO: 740780 - DNA, 22 bp, Artificial Sequence
  chemically synthesized
tcaggactatccatcacaacaa

SEQ ID NO: 740781 - DNA, 22 bp, Artificial Sequence
  chemically synthesized
caggactatccatcacaacaag

SEQ ID NO: 740782 - DNA, 22 bp, Artificial Sequence
  chemically synthesized
aggactatccatcacaacaaga

SEQ ID NO: 740783 - DNA, 22 bp, Artificial Sequence
  chemically synthesized
acataatttaattcttgttgtg

SEQ ID NO: 740784 - DNA, 22 bp, Artificial Sequence
  chemically synthesized
tccatcacaacaagaattaaat

SEQ ID NO: 740785 - DNA, 22 bp, Artificial Sequence
  chemically synthesized
agatctcacataatttaattct

SEQ ID NO: 740786 - DNA, 22 bp, Artificial Sequence
  chemically synthesized
gagatctcacataatttaattc

SEQ ID NO: 740787 - DNA, 22 bp, Artificial Sequence
  chemically synthesized
ttgagatctcacataatttaat

SEQ ID NO: 740788 - DNA, 22 bp, Artificial Sequence
  chemically synthesized
caaatcccagacctcttgagat

SEQ ID NO: 740789 - DNA, 22 bp, Artificial Sequence
  chemically synthesized
aattatgtgagatctcaagagg

SEQ ID NO: 740790 - DNA, 22 bp, Artificial Sequence
  chemically synthesized
tgtgagatctcaagaggtctgg

SEQ ID NO: 740791 - DNA, 22 bp, Artificial Sequence
  chemically synthesized
ataaagataagttgcaaatccc

SEQ ID NO: 740792 - DNA, 22 bp, Artificial Sequence
  chemically synthesized
aataaagataagttgcaaatcc

SEQ ID NO: 740793 - DNA, 22 bp, Artificial Sequence
  chemically synthesized
taataaagataagttgcaaatc

SEQ ID NO: 740794 - DNA, 22 bp, Artificial Sequence
  chemically synthesized
aagaggtctgggatttgcaact

SEQ ID NO: 740795 - DNA, 22 bp, Artificial Sequence
  chemically synthesized
gatctttaataaagataagttg

SEQ ID NO: 740796 - DNA, 22 bp, Artificial Sequence
  chemically synthesized
ctagatctttaataaagataag

SEQ ID NO: 740797 - DNA, 22 bp, Artificial Sequence
  chemically synthesized
ggatttgcaacttatctttatt

SEQ ID NO: 740798 - DNA, 22 bp, Artificial Sequence
  chemically synthesized
gcaacttatctttattaaagat

SEQ ID NO: 740799 - DNA, 22 bp, Artificial Sequence
  chemically synthesized
aagaattgctagatctttaata

SEQ ID NO: 740800 - DNA, 22 bp, Artificial Sequence
  chemically synthesized
caacttatctttattaaagatc

SEQ ID NO: 740801 - DNA, 22 bp, Artificial Sequence
  chemically synthesized
ttaaagaattgctagatcttta

SEQ ID NO: 740802 - DNA, 22 bp, Artificial Sequence
  chemically synthesized
atctttattaaagatctagcaa

SEQ ID NO: 740803 - DNA, 22 bp, Artificial Sequence
  chemically synthesized
tctttattaaagatctagcaat

SEQ ID NO: 740804 - DNA, 22 bp, Artificial Sequence
  chemically synthesized
tattaaagatctagcaattctt

SEQ ID NO: 740805 - DNA, 22 bp, Artificial Sequence
  chemically synthesized
agaggcctgttaaagaattgct

SEQ ID NO: 740806 - DNA, 22 bp, Artificial Sequence
  chemically synthesized
attaaagatctagcaattcttt

SEQ ID NO: 740807 - DNA, 22 bp, Artificial Sequence
  chemically synthesized
ttaaagatctagcaattcttta

SEQ ID NO: 740808 - DNA, 22 bp, Artificial Sequence
  chemically synthesized
aagatctagcaattctttaaca

SEQ ID NO: 740809 - DNA, 22 bp, Artificial Sequence
  chemically synthesized
ggggtgtgattgagaggcctgt

SEQ ID NO: 740810 - DNA, 22 bp, Artificial Sequence
  chemically synthesized
gcaattctttaacaggcctctc

SEQ ID NO: 740811 - DNA, 22 bp, Artificial Sequence
  chemically synthesized
aggggtgtgattgagaggcctg

SEQ ID NO: 740812 - DNA, 22 bp, Artificial Sequence
  chemically synthesized
tttaacaggcctctcaatcaca

SEQ ID NO: 740813 - DNA, 22 bp, Artificial Sequence
  chemically synthesized
taacaggcctctcaatcacacc

SEQ ID NO: 740814 - DNA, 22 bp, Artificial Sequence
  chemically synthesized
aacaggcctctcaatcacaccc

SEQ ID NO: 740815 - DNA, 22 bp, Artificial Sequence
  chemically synthesized
acaggcctctcaatcacacccc

SEQ ID NO: 740816 - DNA, 22 bp, Artificial Sequence
  chemically synthesized
tcagtccatttaggggtgtgat

SEQ ID NO: 740817 - DNA, 22 bp, Artificial Sequence
  chemically synthesized
ttgtcagtccatttaggggtgt

SEQ ID NO: 740818 - DNA, 22 bp, Artificial Sequence
  chemically synthesized
ctattgtcagtccatttagggg

SEQ ID NO: 740819 - DNA, 22 bp, Artificial Sequence
  chemically synthesized
cctattgtcagtccatttaggg

SEQ ID NO: 740820 - DNA, 22 bp, Artificial Sequence
  chemically synthesized
tcctattgtcagtccatttagg

SEQ ID NO: 740821 - DNA, 22 bp, Artificial Sequence
  chemically synthesized
tcaatcacacccctaaatggac

SEQ ID NO: 740822 - DNA, 22 bp, Artificial Sequence
  chemically synthesized
aatcacacccctaaatggactg

SEQ ID NO: 740823 - DNA, 22 bp, Artificial Sequence
  chemically synthesized
aatggactgacaataggaaagt

SEQ ID NO: 740824 - DNA, 22 bp, Artificial Sequence
  chemically synthesized
acaataggaaagtgatttggtt

SEQ ID NO: 740825 - DNA, 22 bp, Artificial Sequence
  chemically synthesized
ataagaaaaatataataaacca

SEQ ID NO: 740826 - DNA, 22 bp, Artificial Sequence
  chemically synthesized
aataagaaaaatataataaacc

SEQ ID NO: 740827 - DNA, 22 bp, Artificial Sequence
  chemically synthesized
taataagaaaaatataataaac

SEQ ID NO: 740828 - DNA, 22 bp, Artificial Sequence
  chemically synthesized
ttaataagaaaaatataataaa

SEQ ID NO: 740829 - DNA, 22 bp, Artificial Sequence
  chemically synthesized
tttaataagaaaaatataataa

SEQ ID NO: 740830 - DNA, 22 bp, Artificial Sequence
  chemically synthesized
actttttaataagaaaaatata

SEQ ID NO: 740831 - DNA, 22 bp, Artificial Sequence
  chemically synthesized
aactttttaataagaaaaatat

SEQ ID NO: 740832 - DNA, 22 bp, Artificial Sequence
  chemically synthesized
taactttttaataagaaaaata

SEQ ID NO: 740833 - DNA, 22 bp, Artificial Sequence
  chemically synthesized
ggtttattatatttttcttatt

SEQ ID NO: 740834 - DNA, 22 bp, Artificial Sequence
  chemically synthesized
gtttattatatttttcttatta

SEQ ID NO: 740835 - DNA, 22 bp, Artificial Sequence
  chemically synthesized
gttttaactttttaataagaaa

SEQ ID NO: 740836 - DNA, 22 bp, Artificial Sequence
  chemically synthesized
ggttttaactttttaataagaa

SEQ ID NO: 740837 - DNA, 22 bp, Artificial Sequence
  chemically synthesized
attatatttttcttattaaaaa

SEQ ID NO: 740838 - DNA, 22 bp, Artificial Sequence
  chemically synthesized
tttggttttaactttttaataa

SEQ ID NO: 740839 - DNA, 22 bp, Artificial Sequence
  chemically synthesized
ttatatttttcttattaaaaag

SEQ ID NO: 740840 - DNA, 22 bp, Artificial Sequence
  chemically synthesized
tatttttcttattaaaaagtta

SEQ ID NO: 740841 - DNA, 22 bp, Artificial Sequence
  chemically synthesized
aaactatttggttttaactttt

SEQ ID NO: 740842 - DNA, 22 bp, Artificial Sequence
  chemically synthesized
aaaactatttggttttaacttt

SEQ ID NO: 740843 - DNA, 22 bp, Artificial Sequence
  chemically synthesized
ttcttattaaaaagttaaaacc

SEQ ID NO: 740844 - DNA, 22 bp, Artificial Sequence
  chemically synthesized
tcttattaaaaagttaaaacca

SEQ ID NO: 740845 - DNA, 22 bp, Artificial Sequence
  chemically synthesized
cttattaaaaagttaaaaccaa

SEQ ID NO: 740846 - DNA, 22 bp, Artificial Sequence
  chemically synthesized
ttattaaaaagttaaaaccaaa

SEQ ID NO: 740847 - DNA, 22 bp, Artificial Sequence
  chemically synthesized
ggtttaaaactatttggtttta

SEQ ID NO: 740848 - DNA, 22 bp, Artificial Sequence
  chemically synthesized
attaaaaagttaaaaccaaata

SEQ ID NO: 740849 - DNA, 22 bp, Artificial Sequence
  chemically synthesized
ttaaaaagttaaaaccaaatag

SEQ ID NO: 740850 - DNA, 22 bp, Artificial Sequence
  chemically synthesized
aaaagttaaaaccaaatagttt

SEQ ID NO: 740851 - DNA, 22 bp, Artificial Sequence
  chemically synthesized
aggaaactgggtttaaaactat

SEQ ID NO: 740852 - DNA, 22 bp, Artificial Sequence
  chemically synthesized
tgaggaaactgggtttaaaact

SEQ ID NO: 740853 - DNA, 22 bp, Artificial Sequence
  chemically synthesized
aaaccaaatagttttaaaccca

SEQ ID NO: 740854 - DNA, 22 bp, Artificial Sequence
  chemically synthesized
taaacccagtttcctcagaggc

SEQ ID NO: 740855 - DNA, 22 bp, Artificial Sequence
  chemically synthesized
aaacccagtttcctcagaggca

SEQ ID NO: 740856 - DNA, 22 bp, Artificial Sequence
  chemically synthesized
aacccagtttcctcagaggcat

SEQ ID NO: 740857 - DNA, 22 bp, Artificial Sequence
  chemically synthesized
caacaggatgcagaaggtatgc

SEQ ID NO: 740858 - DNA, 22 bp, Artificial Sequence
  chemically synthesized
ccaacaggatgcagaaggtatg

SEQ ID NO: 740859 - DNA, 22 bp, Artificial Sequence
  chemically synthesized
tccaacaggatgcagaaggtat

SEQ ID NO: 740860 - DNA, 22 bp, Artificial Sequence
  chemically synthesized
cctcagaggcataccttctgca

SEQ ID NO: 740861 - DNA, 22 bp, Artificial Sequence
  chemically synthesized
ctcagaggcataccttctgcat

SEQ ID NO: 740862 - DNA, 22 bp, Artificial Sequence
  chemically synthesized
ctttccaacaggatgcagaagg

SEQ ID NO: 740863 - DNA, 22 bp, Artificial Sequence
  chemically synthesized
tcctttccaacaggatgcagaa

SEQ ID NO: 740864 - DNA, 22 bp, Artificial Sequence
  chemically synthesized
agaggcataccttctgcatcct

SEQ ID NO: 740865 - DNA, 22 bp, Artificial Sequence
  chemically synthesized
ctcctttccaacaggatgcaga

SEQ ID NO: 740866 - DNA, 22 bp, Artificial Sequence
  chemically synthesized
tctcctttccaacaggatgcag

SEQ ID NO: 740867 - DNA, 22 bp, Artificial Sequence
  chemically synthesized
caattttctcctttccaacagg

SEQ ID NO: 740868 - DNA, 22 bp, Artificial Sequence
  chemically synthesized
ccaattttctcctttccaacag

SEQ ID NO: 740869 - DNA, 22 bp, Artificial Sequence
  chemically synthesized
tccaattttctcctttccaaca

SEQ ID NO: 740870 - DNA, 22 bp, Artificial Sequence
  chemically synthesized
ctttccaattttctcctttcca

SEQ ID NO: 740871 - DNA, 22 bp, Artificial Sequence
  chemically synthesized
ctgcatcctgttggaaaggaga

SEQ ID NO: 740872 - DNA, 22 bp, Artificial Sequence
  chemically synthesized
tgcatcctgttggaaaggagaa

SEQ ID NO: 740873 - DNA, 22 bp, Artificial Sequence
  chemically synthesized
tcctttccaattttctcctttc

SEQ ID NO: 740874 - DNA, 22 bp, Artificial Sequence
  chemically synthesized
catcctgttggaaaggagaaaa

SEQ ID NO: 740875 - DNA, 22 bp, Artificial Sequence
  chemically synthesized
tctcctttccaattttctcctt

SEQ ID NO: 740876 - DNA, 22 bp, Artificial Sequence
  chemically synthesized
ctctcctttccaattttctcct

SEQ ID NO: 740877 - DNA, 22 bp, Artificial Sequence
  chemically synthesized
tctctcctttccaattttctcc

SEQ ID NO: 740878 - DNA, 22 bp, Artificial Sequence
  chemically synthesized
ttggaaaggagaaaattggaaa

SEQ ID NO: 740879 - DNA, 22 bp, Artificial Sequence
  chemically synthesized
gaaaggagaaaattggaaagga

SEQ ID NO: 740880 - DNA, 22 bp, Artificial Sequence
  chemically synthesized
gagaatcattttctctcctttc

SEQ ID NO: 740881 - DNA, 22 bp, Artificial Sequence
  chemically synthesized
gaaaggagagaaaatgattctc

SEQ ID NO: 740882 - DNA, 22 bp, Artificial Sequence
  chemically synthesized
accgtagaattagagaatcatt

SEQ ID NO: 740883 - DNA, 22 bp, Artificial Sequence
  chemically synthesized
aaccgtagaattagagaatcat

SEQ ID NO: 740884 - DNA, 22 bp, Artificial Sequence
  chemically synthesized
gtttaaccgtagaattagagaa

SEQ ID NO: 740885 - DNA, 22 bp, Artificial Sequence
  chemically synthesized
aaattagtttaaccgtagaatt

SEQ ID NO: 740886 - DNA, 22 bp, Artificial Sequence
  chemically synthesized
tctaattctacggttaaactaa

SEQ ID NO: 740887 - DNA, 22 bp, Artificial Sequence
  chemically synthesized
taattctacggttaaactaatt

SEQ ID NO: 740888 - DNA, 22 bp, Artificial Sequence
  chemically synthesized
attctacggttaaactaatttt

SEQ ID NO: 740889 - DNA, 22 bp, Artificial Sequence
  chemically synthesized
taccccaaaaccctaaaattag

SEQ ID NO: 740890 - DNA, 22 bp, Artificial Sequence
  chemically synthesized
tacggttaaactaattttaggg

SEQ ID NO: 740891 - DNA, 22 bp, Artificial Sequence
  chemically synthesized
cggttaaactaattttagggtt

SEQ ID NO: 740892 - DNA, 22 bp, Artificial Sequence
  chemically synthesized
aactaattttagggttttgggg

SEQ ID NO: 740893 - DNA, 22 bp, Artificial Sequence
  chemically synthesized
attttagggttttggggtataa

SEQ ID NO: 740894 - DNA, 22 bp, Artificial Sequence
  chemically synthesized
tagggttttggggtataacatg

SEQ ID NO: 740895 - DNA, 22 bp, Artificial Sequence
  chemically synthesized
agggttttggggtataacatgg

SEQ ID NO: 740896 - DNA, 22 bp, Artificial Sequence
  chemically synthesized
gggttttggggtataacatggt

SEQ ID NO: 740897 - DNA, 22 bp, Artificial Sequence
  chemically synthesized
agtgtgaaggacaccatgttat

SEQ ID NO: 740898 - DNA, 22 bp, Artificial Sequence
  chemically synthesized
tcagtgtgaaggacaccatgtt

SEQ ID NO: 740899 - DNA, 22 bp, Artificial Sequence
  chemically synthesized
ctcagtgtgaaggacaccatgt

SEQ ID NO: 740900 - DNA, 22 bp, Artificial Sequence
  chemically synthesized
tggggtataacatggtgtcctt

SEQ ID NO: 740901 - DNA, 22 bp, Artificial Sequence
  chemically synthesized
ggggtataacatggtgtccttc

SEQ ID NO: 740902 - DNA, 22 bp, Artificial Sequence
  chemically synthesized
ccttctcagtgtgaaggacacc

SEQ ID NO: 740903 - DNA, 22 bp, Artificial Sequence
  chemically synthesized
gggtataacatggtgtccttca

SEQ ID NO: 740904 - DNA, 22 bp, Artificial Sequence
  chemically synthesized
cacactgagaaggtagacgcac

SEQ ID NO: 740905 - DNA, 22 bp, Artificial Sequence
  chemically synthesized
acactgagaaggtagacgcacc

SEQ ID NO: 740906 - DNA, 22 bp, Artificial Sequence
  chemically synthesized
tagtggtggaagaggtgcgtct

SEQ ID NO: 740907 - DNA, 22 bp, Artificial Sequence
  chemically synthesized
agaaggtagacgcacctcttcc

SEQ ID NO: 740908 - DNA, 22 bp, Artificial Sequence
  chemically synthesized
atgcagagtaatggttgtagtg

SEQ ID NO: 740909 - DNA, 22 bp, Artificial Sequence
  chemically synthesized
attcatgcagagtaatggttgt

SEQ ID NO: 740910 - DNA, 22 bp, Artificial Sequence
  chemically synthesized
ttccaccactacaaccattact

SEQ ID NO: 740911 - DNA, 22 bp, Artificial Sequence
  chemically synthesized
ccaccactacaaccattactct

SEQ ID NO: 740912 - DNA, 22 bp, Artificial Sequence
  chemically synthesized
caccactacaaccattactctg

SEQ ID NO: 740913 - DNA, 22 bp, Artificial Sequence
  chemically synthesized
caaccattactctgcatgaatt

SEQ ID NO: 740914 - DNA, 22 bp, Artificial Sequence
  chemically synthesized
taacatcgaatgagttaattca

SEQ ID NO: 740915 - DNA, 22 bp, Artificial Sequence
  chemically synthesized
ctgtaacatcgaatgagttaat

SEQ ID NO: 740916 - DNA, 22 bp, Artificial Sequence
  chemically synthesized
ctctgcatgaattaactcattc

SEQ ID NO: 740917 - DNA, 22 bp, Artificial Sequence
  chemically synthesized
tgcatgaattaactcattcgat

SEQ ID NO: 740918 - DNA, 22 bp, Artificial Sequence
  chemically synthesized
catgaattaactcattcgatgt

SEQ ID NO: 740919 - DNA, 22 bp, Artificial Sequence
  chemically synthesized
acatggttactgtaacatcgaa

SEQ ID NO: 740920 - DNA, 22 bp, Artificial Sequence
  chemically synthesized
taacatggttactgtaacatcg

SEQ ID NO: 740921 - DNA, 22 bp, Artificial Sequence
  chemically synthesized
actcattcgatgttacagtaac

SEQ ID NO: 740922 - DNA, 22 bp, Artificial Sequence
  chemically synthesized
atctctaacatggttactgtaa

SEQ ID NO: 740923 - DNA, 22 bp, Artificial Sequence
  chemically synthesized
ctcatctctaacatggttactg

SEQ ID NO: 740924 - DNA, 22 bp, Artificial Sequence
  chemically synthesized
attcgatgttacagtaaccatg

SEQ ID NO: 740925 - DNA, 22 bp, Artificial Sequence
  chemically synthesized
actcatctctaacatggttact

SEQ ID NO: 740926 - DNA, 22 bp, Artificial Sequence
  chemically synthesized
gatgttacagtaaccatgttag

SEQ ID NO: 740927 - DNA, 22 bp, Artificial Sequence
  chemically synthesized
tccatttactcatctctaacat

SEQ ID NO: 740928 - DNA, 22 bp, Artificial Sequence
  chemically synthesized
cagtaaccatgttagagatgag

SEQ ID NO: 740929 - DNA, 22 bp, Artificial Sequence
  chemically synthesized
tggttgtccatttactcatctc

SEQ ID NO: 740930 - DNA, 22 bp, Artificial Sequence
  chemically synthesized
tgtggttgtccatttactcatc

SEQ ID NO: 740931 - DNA, 22 bp, Artificial Sequence
  chemically synthesized
atctctgtggttgtccatttac

SEQ ID NO: 740932 - DNA, 22 bp, Artificial Sequence
  chemically synthesized
aatctctgtggttgtccattta

SEQ ID NO: 740933 - DNA, 22 bp, Artificial Sequence
  chemically synthesized
gagatgagtaaatggacaacca

SEQ ID NO: 740934 - DNA, 22 bp, Artificial Sequence
  chemically synthesized
aggccacttaatctctgtggtt

SEQ ID NO: 740935 - DNA, 22 bp, Artificial Sequence
  chemically synthesized
gaggccacttaatctctgtggt

SEQ ID NO: 740936 - DNA, 22 bp, Artificial Sequence
  chemically synthesized
agtgaccttgaggccacttaat

SEQ ID NO: 740937 - DNA, 22 bp, Artificial Sequence
  chemically synthesized
gctgagtgaccttgaggccact

SEQ ID NO: 740938 - DNA, 22 bp, Artificial Sequence
  chemically synthesized
agtggcctcaaggtcactcagc

SEQ ID NO: 740939 - DNA, 22 bp, Artificial Sequence
  chemically synthesized
gaatccaacatattagctgagt

SEQ ID NO: 740940 - DNA, 22 bp, Artificial Sequence
  chemically synthesized
ggaatccaacatattagctgag

SEQ ID NO: 740941 - DNA, 22 bp, Artificial Sequence
  chemically synthesized
tggaatccaacatattagctga

SEQ ID NO: 740942 - DNA, 22 bp, Artificial Sequence
  chemically synthesized
aaggtcactcagctaatatgtt

SEQ ID NO: 740943 - DNA, 22 bp, Artificial Sequence
  chemically synthesized
agctaatatgttggattccaaa

SEQ ID NO: 740944 - DNA, 22 bp, Artificial Sequence
  chemically synthesized
cagtacacaggttttggaatcc

SEQ ID NO: 740945 - DNA, 22 bp, Artificial Sequence
  chemically synthesized
ttacagtacacaggttttggaa

SEQ ID NO: 740946 - DNA, 22 bp, Artificial Sequence
  chemically synthesized
atatgttggattccaaaacctg

SEQ ID NO: 740947 - DNA, 22 bp, Artificial Sequence
  chemically synthesized
ttattacagtacacaggttttg

SEQ ID NO: 740948 - DNA, 22 bp, Artificial Sequence
  chemically synthesized
ttattattacagtacacaggtt

SEQ ID NO: 740949 - DNA, 22 bp, Artificial Sequence
  chemically synthesized
ttattattattacagtacacag

SEQ ID NO: 740950 - DNA, 22 bp, Artificial Sequence
  chemically synthesized
gattccaaaacctgtgtactgt

SEQ ID NO: 740951 - DNA, 22 bp, Artificial Sequence
  chemically synthesized
ttattattattattacagtaca

SEQ ID NO: 740952 - DNA, 22 bp, Artificial Sequence
  chemically synthesized
caaaacctgtgtactgtaataa

SEQ ID NO: 740953 - DNA, 22 bp, Artificial Sequence
  chemically synthesized
ttattattattattattacagt

SEQ ID NO: 740954 - DNA, 22 bp, Artificial Sequence
  chemically synthesized
atgttgttattattattattat

SEQ ID NO: 740955 - DNA, 22 bp, Artificial Sequence
  chemically synthesized
gatgttgttattattattatta

SEQ ID NO: 740956 - DNA, 22 bp, Artificial Sequence
  chemically synthesized
tgtactgtaataataataataa

SEQ ID NO: 740957 - DNA, 22 bp, Artificial Sequence
  chemically synthesized
ttgatgttgttattattattat

SEQ ID NO: 740958 - DNA, 22 bp, Artificial Sequence
  chemically synthesized
gctcttgatgttgttattatta

SEQ ID NO: 740959 - DNA, 22 bp, Artificial Sequence
  chemically synthesized
tagctcttgatgttgttattat

SEQ ID NO: 740960 - DNA, 22 bp, Artificial Sequence
  chemically synthesized
taataataataataataacaac

SEQ ID NO: 740961 - DNA, 22 bp, Artificial Sequence
  chemically synthesized
caaattctagctcttgatgttg

SEQ ID NO: 740962 - DNA, 22 bp, Artificial Sequence
  chemically synthesized
tacaaattctagctcttgatgt

SEQ ID NO: 740963 - DNA, 22 bp, Artificial Sequence
  chemically synthesized
gaatttgtagagtgtttatcat

SEQ ID NO: 740964 - DNA, 22 bp, Artificial Sequence
  chemically synthesized
gggagcgaacatgccaaatgat

SEQ ID NO: 740965 - DNA, 22 bp, Artificial Sequence
  chemically synthesized
gtagagtgtttatcatttggca

SEQ ID NO: 740966 - DNA, 22 bp, Artificial Sequence
  chemically synthesized
tagagtgtttatcatttggcat

SEQ ID NO: 740967 - DNA, 22 bp, Artificial Sequence
  chemically synthesized
atcatttggcatgttcgctccc

SEQ ID NO: 740968 - DNA, 22 bp, Artificial Sequence
  chemically synthesized
tcatttggcatgttcgctcccg

SEQ ID NO: 740969 - DNA, 22 bp, Artificial Sequence
  chemically synthesized
ggcatgttcgctcccgagcact

SEQ ID NO: 740970 - DNA, 22 bp, Artificial Sequence
  chemically synthesized
gcatgttcgctcccgagcactt

SEQ ID NO: 740971 - DNA, 22 bp, Artificial Sequence
  chemically synthesized
gctcccgagcactttccattta

SEQ ID NO: 740972 - DNA, 22 bp, Artificial Sequence
  chemically synthesized
ccgagcactttccatttatttt

SEQ ID NO: 740973 - DNA, 22 bp, Artificial Sequence
  chemically synthesized
ggatgaataagtcaaaataaat

SEQ ID NO: 740974 - DNA, 22 bp, Artificial Sequence
  chemically synthesized
ttaggatgaataagtcaaaata

SEQ ID NO: 740975 - DNA, 22 bp, Artificial Sequence
  chemically synthesized
ttattaggatgaataagtcaaa

SEQ ID NO: 740976 - DNA, 22 bp, Artificial Sequence
  chemically synthesized
attattaggatgaataagtcaa

SEQ ID NO: 740977 - DNA, 22 bp, Artificial Sequence
  chemically synthesized
tccatttattttgacttattca

SEQ ID NO: 740978 - DNA, 22 bp, Artificial Sequence
  chemically synthesized
ccatttattttgacttattcat

SEQ ID NO: 740979 - DNA, 22 bp, Artificial Sequence
  chemically synthesized
catttattttgacttattcatc

SEQ ID NO: 740980 - DNA, 22 bp, Artificial Sequence
  chemically synthesized
attttgacttattcatcctaat

SEQ ID NO: 740981 - DNA, 22 bp, Artificial Sequence
  chemically synthesized
ttttgacttattcatcctaata

SEQ ID NO: 740982 - DNA, 22 bp, Artificial Sequence
  chemically synthesized
caatatcagtttattattagga

SEQ ID NO: 740983 - DNA, 22 bp, Artificial Sequence
  chemically synthesized
tgacttattcatcctaataata

SEQ ID NO: 740984 - DNA, 22 bp, Artificial Sequence
  chemically synthesized
gacttattcatcctaataataa

SEQ ID NO: 740985 - DNA, 22 bp, Artificial Sequence
  chemically synthesized
tgcaatatcagtttattattag

SEQ ID NO: 740986 - DNA, 22 bp, Artificial Sequence
  chemically synthesized
acttattcatcctaataataaa

SEQ ID NO: 740987 - DNA, 22 bp, Artificial Sequence
  chemically synthesized
tctgcaatatcagtttattatt

SEQ ID NO: 740988 - DNA, 22 bp, Artificial Sequence
  chemically synthesized
attcatcctaataataaactga

SEQ ID NO: 740989 - DNA, 22 bp, Artificial Sequence
  chemically synthesized
ttcatcctaataataaactgat

SEQ ID NO: 740990 - DNA, 22 bp, Artificial Sequence
  chemically synthesized
atcctaataataaactgatatt

SEQ ID NO: 740991 - DNA, 22 bp, Artificial Sequence
  chemically synthesized
ataataaactgatattgcagag

SEQ ID NO: 740992 - DNA, 22 bp, Artificial Sequence
  chemically synthesized
atattgcagagaattttattat

SEQ ID NO: 740993 - DNA, 22 bp, Artificial Sequence
  chemically synthesized
cagagaattttattatcgcatt

SEQ ID NO: 740994 - DNA, 22 bp, Artificial Sequence
  chemically synthesized
atcaaaaaaaaaaaaatgcgat

SEQ ID NO: 740995 - DNA, 22 bp, Artificial Sequence
  chemically synthesized
catcaaaaaaaaaaaaatgcga

SEQ ID NO: 740996 - DNA, 22 bp, Artificial Sequence
  chemically synthesized
tcatcaaaaaaaaaaaaatgcg

SEQ ID NO: 740997 - DNA, 22 bp, Artificial Sequence
  chemically synthesized
tattatcgcatttttttttttt

SEQ ID NO: 740998 - DNA, 22 bp, Artificial Sequence
  chemically synthesized
agtctttcatcaaaaaaaaaaa

SEQ ID NO: 740999 - DNA, 22 bp, Artificial Sequence
  chemically synthesized
attatcgcattttttttttttt

SEQ ID NO: 741000 - DNA, 22 bp, Artificial Sequence
  chemically synthesized
ttatcgcatttttttttttttg

SEQ ID NO: 741001 - DNA, 22 bp, Artificial Sequence
  chemically synthesized
tcgcatttttttttttttgatg

SEQ ID NO: 741002 - DNA, 22 bp, Artificial Sequence
  chemically synthesized
agcctcagtctttcatcaaaaa

SEQ ID NO: 741003 - DNA, 22 bp, Artificial Sequence
  chemically synthesized
tgagcctcagtctttcatcaaa

SEQ ID NO: 741004 - DNA, 22 bp, Artificial Sequence
  chemically synthesized
ctgagcctcagtctttcatcaa

SEQ ID NO: 741005 - DNA, 22 bp, Artificial Sequence
  chemically synthesized
tctgagcctcagtctttcatca

SEQ ID NO: 741006 - DNA, 22 bp, Artificial Sequence
  chemically synthesized
ttttttttttgatgaaagactg

SEQ ID NO: 741007 - DNA, 22 bp, Artificial Sequence
  chemically synthesized
tttttttttgatgaaagactga

SEQ ID NO: 741008 - DNA, 22 bp, Artificial Sequence
  chemically synthesized
ttttttttgatgaaagactgag

SEQ ID NO: 741009 - DNA, 22 bp, Artificial Sequence
  chemically synthesized
acctttctgagcctcagtcttt

SEQ ID NO: 741010 - DNA, 22 bp, Artificial Sequence
  chemically synthesized
tttttttgatgaaagactgagg

SEQ ID NO: 741011 - DNA, 22 bp, Artificial Sequence
  chemically synthesized
aacctttctgagcctcagtctt

SEQ ID NO: 741012 - DNA, 22 bp, Artificial Sequence
  chemically synthesized
ttttttgatgaaagactgaggc

SEQ ID NO: 741013 - DNA, 22 bp, Artificial Sequence
  chemically synthesized
tttttgatgaaagactgaggct

SEQ ID NO: 741014 - DNA, 22 bp, Artificial Sequence
  chemically synthesized
ttttgatgaaagactgaggctc

SEQ ID NO: 741015 - DNA, 22 bp, Artificial Sequence
  chemically synthesized
cttaacctttctgagcctcagt

SEQ ID NO: 741016 - DNA, 22 bp, Artificial Sequence
  chemically synthesized
tttgatgaaagactgaggctca

SEQ ID NO: 741017 - DNA, 22 bp, Artificial Sequence
  chemically synthesized
ttgatgaaagactgaggctcag

SEQ ID NO: 741018 - DNA, 22 bp, Artificial Sequence
  chemically synthesized
tgatgaaagactgaggctcaga

SEQ ID NO: 741019 - DNA, 22 bp, Artificial Sequence
  chemically synthesized
gatgaaagactgaggctcagaa

SEQ ID NO: 741020 - DNA, 22 bp, Artificial Sequence
  chemically synthesized
atgaaagactgaggctcagaaa

SEQ ID NO: 741021 - DNA, 22 bp, Artificial Sequence
  chemically synthesized
gagcaaattacttaacctttct

SEQ ID NO: 741022 - DNA, 22 bp, Artificial Sequence
  chemically synthesized
aggctcagaaaggttaagtaat

SEQ ID NO: 741023 - DNA, 22 bp, Artificial Sequence
  chemically synthesized
agaaaggttaagtaatttgctc

SEQ ID NO: 741024 - DNA, 22 bp, Artificial Sequence
  chemically synthesized
gccatgggacctggagcaaatt

SEQ ID NO: 741025 - DNA, 22 bp, Artificial Sequence
  chemically synthesized
ctagccatgggacctggagcaa

SEQ ID NO: 741026 - DNA, 22 bp, Artificial Sequence
  chemically synthesized
actagccatgggacctggagca

SEQ ID NO: 741027 - DNA, 22 bp, Artificial Sequence
  chemically synthesized
agtaatttgctccaggtcccat

SEQ ID NO: 741028 - DNA, 22 bp, Artificial Sequence
  chemically synthesized
aaggtcacacttactagccatg

SEQ ID NO: 741029 - DNA, 22 bp, Artificial Sequence
  chemically synthesized
gctccaggtcccatggctagta

SEQ ID NO: 741030 - DNA, 22 bp, Artificial Sequence
  chemically synthesized
ctccaggtcccatggctagtaa

SEQ ID NO: 741031 - DNA, 22 bp, Artificial Sequence
  chemically synthesized
ctcaaggtcacacttactagcc

SEQ ID NO: 741032 - DNA, 22 bp, Artificial Sequence
  chemically synthesized
caggtcccatggctagtaagtg

SEQ ID NO: 741033 - DNA, 22 bp, Artificial Sequence
  chemically synthesized
gtaagtgtgaccttgagcagca

SEQ ID NO: 741034 - DNA, 22 bp, Artificial Sequence
  chemically synthesized
gagcagcacacttacattgcct

SEQ ID NO: 741035 - DNA, 22 bp, Artificial Sequence
  chemically synthesized
cgtaataaatacaggcaatgta

SEQ ID NO: 741036 - DNA, 22 bp, Artificial Sequence
  chemically synthesized
agcagcacacttacattgcctg

SEQ ID NO: 741037 - DNA, 22 bp, Artificial Sequence
  chemically synthesized
gcgtaataaatacaggcaatgt

SEQ ID NO: 741038 - DNA, 22 bp, Artificial Sequence
  chemically synthesized
gtaggtttgcgtaataaataca

SEQ ID NO: 741039 - DNA, 22 bp, Artificial Sequence
  chemically synthesized
cgtaggtttgcgtaataaatac

SEQ ID NO: 741040 - DNA, 22 bp, Artificial Sequence
  chemically synthesized
tcgtaggtttgcgtaataaata

SEQ ID NO: 741041 - DNA, 22 bp, Artificial Sequence
  chemically synthesized
ttcgtaggtttgcgtaataaat

SEQ ID NO: 741042 - DNA, 22 bp, Artificial Sequence
  chemically synthesized
acattgcctgtatttattacgc

SEQ ID NO: 741043 - DNA, 22 bp, Artificial Sequence
  chemically synthesized
cattgcctgtatttattacgca

SEQ ID NO: 741044 - DNA, 22 bp, Artificial Sequence
  chemically synthesized
cctgtatttattacgcaaacct

SEQ ID NO: 741045 - DNA, 22 bp, Artificial Sequence
  chemically synthesized
tatttattacgcaaacctacga

SEQ ID NO: 741046 - DNA, 22 bp, Artificial Sequence
  chemically synthesized
catgtggaagtttttcgtaggt

SEQ ID NO: 741047 - DNA, 22 bp, Artificial Sequence
  chemically synthesized
acatgtggaagtttttcgtagg

SEQ ID NO: 741048 - DNA, 22 bp, Artificial Sequence
  chemically synthesized
attacgcaaacctacgaaaaac

SEQ ID NO: 741049 - DNA, 22 bp, Artificial Sequence
  chemically synthesized
ttacgcaaacctacgaaaaact

SEQ ID NO: 741050 - DNA, 22 bp, Artificial Sequence
  chemically synthesized
cgcaaacctacgaaaaacttcc

SEQ ID NO: 741051 - DNA, 22 bp, Artificial Sequence
  chemically synthesized
tcacaaacttacatgtggaagt

SEQ ID NO: 741052 - DNA, 22 bp, Artificial Sequence
  chemically synthesized
cgaaaaacttccacatgtaagt

SEQ ID NO: 741053 - DNA, 22 bp, Artificial Sequence
  chemically synthesized
ccacatgtaagtttgtgatagg

SEQ ID NO: 741054 - DNA, 22 bp, Artificial Sequence
  chemically synthesized
aagaaagagcatcctatcacaa

SEQ ID NO: 741055 - DNA, 22 bp, Artificial Sequence
  chemically synthesized
cacatgtaagtttgtgatagga

SEQ ID NO: 741056 - DNA, 22 bp, Artificial Sequence
  chemically synthesized
aaagaaagagcatcctatcaca

SEQ ID NO: 741057 - DNA, 22 bp, Artificial Sequence
  chemically synthesized
gtgataggatgctctttcttta

SEQ ID NO: 741058 - DNA, 22 bp, Artificial Sequence
  chemically synthesized
tgataggatgctctttctttaa

SEQ ID NO: 741059 - DNA, 22 bp, Artificial Sequence
  chemically synthesized
tttctttaaatgacttttggac

SEQ ID NO: 741060 - DNA, 22 bp, Artificial Sequence
  chemically synthesized
tctttaaatgacttttggacac

SEQ ID NO: 741061 - DNA, 22 bp, Artificial Sequence
  chemically synthesized
ctttaaatgacttttggacaca

SEQ ID NO: 741062 - DNA, 22 bp, Artificial Sequence
  chemically synthesized
tttaaatgacttttggacacat

SEQ ID NO: 741063 - DNA, 22 bp, Artificial Sequence
  chemically synthesized
taaatgacttttggacacatct

SEQ ID NO: 741064 - DNA, 22 bp, Artificial Sequence
  chemically synthesized
aaatgacttttggacacatctt

SEQ ID NO: 741065 - DNA, 22 bp, Artificial Sequence
  chemically synthesized
aatgacttttggacacatctta

SEQ ID NO: 741066 - DNA, 22 bp, Artificial Sequence
  chemically synthesized
aacaagagtcaatagtaagatg

SEQ ID NO: 741067 - DNA, 22 bp, Artificial Sequence
  chemically synthesized
aaacaagagtcaatagtaagat

SEQ ID NO: 741068 - DNA, 22 bp, Artificial Sequence
  chemically synthesized
ttggacacatcttactattgac

SEQ ID NO: 741069 - DNA, 22 bp, Artificial Sequence
  chemically synthesized
atttaaacaagagtcaatagta

SEQ ID NO: 741070 - DNA, 22 bp, Artificial Sequence
  chemically synthesized
tggacacatcttactattgact

SEQ ID NO: 741071 - DNA, 22 bp, Artificial Sequence
  chemically synthesized
ggacacatcttactattgactc

SEQ ID NO: 741072 - DNA, 22 bp, Artificial Sequence
  chemically synthesized
gacacatcttactattgactct

SEQ ID NO: 741073 - DNA, 22 bp, Artificial Sequence
  chemically synthesized
gaatcctaatttaaacaagagt

SEQ ID NO: 741074 - DNA, 22 bp, Artificial Sequence
  chemically synthesized
agaatcctaatttaaacaagag

SEQ ID NO: 741075 - DNA, 22 bp, Artificial Sequence
  chemically synthesized
tagaatcctaatttaaacaaga

SEQ ID NO: 741076 - DNA, 22 bp, Artificial Sequence
  chemically synthesized
actattgactcttgtttaaatt

SEQ ID NO: 741077 - DNA, 22 bp, Artificial Sequence
  chemically synthesized
ctattgactcttgtttaaatta

SEQ ID NO: 741078 - DNA, 22 bp, Artificial Sequence
  chemically synthesized
cctttagaatcctaatttaaac

SEQ ID NO: 741079 - DNA, 22 bp, Artificial Sequence
  chemically synthesized
ccctttagaatcctaatttaaa

SEQ ID NO: 741080 - DNA, 22 bp, Artificial Sequence
  chemically synthesized
tccctttagaatcctaatttaa

SEQ ID NO: 741081 - DNA, 22 bp, Artificial Sequence
  chemically synthesized
ttgactcttgtttaaattagga

SEQ ID NO: 741082 - DNA, 22 bp, Artificial Sequence
  chemically synthesized
actcttgtttaaattaggattc

SEQ ID NO: 741083 - DNA, 22 bp, Artificial Sequence
  chemically synthesized
ttgtttaaattaggattctaaa

SEQ ID NO: 741084 - DNA, 22 bp, Artificial Sequence
  chemically synthesized
gtttaaattaggattctaaagg

SEQ ID NO: 741085 - DNA, 22 bp, Artificial Sequence
  chemically synthesized
tttaaattaggattctaaaggg

SEQ ID NO: 741086 - DNA, 22 bp, Artificial Sequence
  chemically synthesized
aaaaacatctttccctttagaa

SEQ ID NO: 741087 - DNA, 22 bp, Artificial Sequence
  chemically synthesized
tcaaaaacatctttccctttag

SEQ ID NO: 741088 - DNA, 22 bp, Artificial Sequence
  chemically synthesized
aaattaggattctaaagggaaa

SEQ ID NO: 741089 - DNA, 22 bp, Artificial Sequence
  chemically synthesized
aattaggattctaaagggaaag

SEQ ID NO: 741090 - DNA, 22 bp, Artificial Sequence
  chemically synthesized
gattctcaaaaacatctttccc

SEQ ID NO: 741091 - DNA, 22 bp, Artificial Sequence
  chemically synthesized
ggattctcaaaaacatctttcc

SEQ ID NO: 741092 - DNA, 22 bp, Artificial Sequence
  chemically synthesized
ggattctaaagggaaagatgtt

SEQ ID NO: 741093 - DNA, 22 bp, Artificial Sequence
  chemically synthesized
cttggattctcaaaaacatctt

SEQ ID NO: 741094 - DNA, 22 bp, Artificial Sequence
  chemically synthesized
ctgcttggattctcaaaaacat

SEQ ID NO: 741095 - DNA, 22 bp, Artificial Sequence
  chemically synthesized
taaagggaaagatgtttttgag

SEQ ID NO: 741096 - DNA, 22 bp, Artificial Sequence
  chemically synthesized
actgcttggattctcaaaaaca

SEQ ID NO: 741097 - DNA, 22 bp, Artificial Sequence
  chemically synthesized
aagggaaagatgtttttgagaa

SEQ ID NO: 741098 - DNA, 22 bp, Artificial Sequence
  chemically synthesized
ttactgcttggattctcaaaaa

SEQ ID NO: 741099 - DNA, 22 bp, Artificial Sequence
  chemically synthesized
tactcttactgcttggattctc

SEQ ID NO: 741100 - DNA, 22 bp, Artificial Sequence
  chemically synthesized
gtactcttactgcttggattct

SEQ ID NO: 741101 - DNA, 22 bp, Artificial Sequence
  chemically synthesized
tgtactcttactgcttggattc

SEQ ID NO: 741102 - DNA, 22 bp, Artificial Sequence
  chemically synthesized
ctttgtactcttactgcttgga

SEQ ID NO: 741103 - DNA, 22 bp, Artificial Sequence
  chemically synthesized
ttgagaatccaagcagtaagag

SEQ ID NO: 741104 - DNA, 22 bp, Artificial Sequence
  chemically synthesized
tgagaatccaagcagtaagagt

SEQ ID NO: 741105 - DNA, 22 bp, Artificial Sequence
  chemically synthesized
gagaatccaagcagtaagagta

SEQ ID NO: 741106 - DNA, 22 bp, Artificial Sequence
  chemically synthesized
agaatccaagcagtaagagtac

SEQ ID NO: 741107 - DNA, 22 bp, Artificial Sequence
  chemically synthesized
ccaccatgcagttcctttgtac

SEQ ID NO: 741108 - DNA, 22 bp, Artificial Sequence
  chemically synthesized
aatcatgatggaagatgtgaat

SEQ ID NO: 741109 - DNA, 22 bp, Artificial Sequence
  chemically synthesized
catggtggcaattcacatcttc

SEQ ID NO: 741110 - DNA, 22 bp, Artificial Sequence
  chemically synthesized
acatcttccatcatgattcagc

SEQ ID NO: 741111 - DNA, 22 bp, Artificial Sequence
  chemically synthesized
cgataaacagaaaataatgctg

SEQ ID NO: 741112 - DNA, 22 bp, Artificial Sequence
  chemically synthesized
ccatcatgattcagcattattt

SEQ ID NO: 741113 - DNA, 22 bp, Artificial Sequence
  chemically synthesized
acgataaacagaaaataatgct

SEQ ID NO: 741114 - DNA, 22 bp, Artificial Sequence
  chemically synthesized
catcatgattcagcattatttt

SEQ ID NO: 741115 - DNA, 22 bp, Artificial Sequence
  chemically synthesized
ttacgataaacagaaaataatg

SEQ ID NO: 741116 - DNA, 22 bp, Artificial Sequence
  chemically synthesized
agcattattttctgtttatcgt

SEQ ID NO: 741117 - DNA, 22 bp, Artificial Sequence
  chemically synthesized
tgtagcagtattcttacgataa

SEQ ID NO: 741118 - DNA, 22 bp, Artificial Sequence
  chemically synthesized
tgtgtagcagtattcttacgat

SEQ ID NO: 741119 - DNA, 22 bp, Artificial Sequence
  chemically synthesized
ttttctgtttatcgtaagaata

SEQ ID NO: 741120 - DNA, 22 bp, Artificial Sequence
  chemically synthesized
tctgtttatcgtaagaatactg

SEQ ID NO: 741121 - DNA, 22 bp, Artificial Sequence
  chemically synthesized
ctgtttatcgtaagaatactgc

SEQ ID NO: 741122 - DNA, 22 bp, Artificial Sequence
  chemically synthesized
tgtttatcgtaagaatactgct

SEQ ID NO: 741123 - DNA, 22 bp, Artificial Sequence
  chemically synthesized
tttatcgtaagaatactgctac

SEQ ID NO: 741124 - DNA, 22 bp, Artificial Sequence
  chemically synthesized
atcgtaagaatactgctacaca

SEQ ID NO: 741125 - DNA, 22 bp, Artificial Sequence
  chemically synthesized
tcgtaagaatactgctacacag

SEQ ID NO: 741126 - DNA, 22 bp, Artificial Sequence
  chemically synthesized
gagggaacatccaaactctgtg

SEQ ID NO: 741127 - DNA, 22 bp, Artificial Sequence
  chemically synthesized
ctacacagagtttggatgttcc

SEQ ID NO: 741128 - DNA, 22 bp, Artificial Sequence
  chemically synthesized
cacagagtttggatgttccctc

SEQ ID NO: 741129 - DNA, 22 bp, Artificial Sequence
  chemically synthesized
aacacgcgagttagagggaaca

SEQ ID NO: 741130 - DNA, 22 bp, Artificial Sequence
  chemically synthesized
caacacgcgagttagagggaac

SEQ ID NO: 741131 - DNA, 22 bp, Artificial Sequence
  chemically synthesized
ggatgttccctctaactcgcgt

SEQ ID NO: 741132 - DNA, 22 bp, Artificial Sequence
  chemically synthesized
gatgttccctctaactcgcgtg

SEQ ID NO: 741133 - DNA, 22 bp, Artificial Sequence
  chemically synthesized
cctctaactcgcgtgttgaaat

SEQ ID NO: 741134 - DNA, 22 bp, Artificial Sequence
  chemically synthesized
taactcgcgtgttgaaatctga

SEQ ID NO: 741135 - DNA, 22 bp, Artificial Sequence
  chemically synthesized
actcgcgtgttgaaatctgatc

SEQ ID NO: 741136 - DNA, 22 bp, Artificial Sequence
  chemically synthesized
accaccaacacgggggatcaga

SEQ ID NO: 741137 - DNA, 22 bp, Artificial Sequence
  chemically synthesized
gcgtgttgaaatctgatccccc

SEQ ID NO: 741138 - DNA, 22 bp, Artificial Sequence
  chemically synthesized
ggcctcaccaccaacacggggg

SEQ ID NO: 741139 - DNA, 22 bp, Artificial Sequence
  chemically synthesized
aaatctgatcccccgtgttggt

SEQ ID NO: 741140 - DNA, 22 bp, Artificial Sequence
  chemically synthesized
cactaggcctcaccaccaacac

SEQ ID NO: 741141 - DNA, 22 bp, Artificial Sequence
  chemically synthesized
ccactaggcctcaccaccaaca

SEQ ID NO: 741142 - DNA, 22 bp, Artificial Sequence
  chemically synthesized
atcccccgtgttggtggtgagg

SEQ ID NO: 741143 - DNA, 22 bp, Artificial Sequence
  chemically synthesized
caacccagacaccttccactag

SEQ ID NO: 741144 - DNA, 22 bp, Artificial Sequence
  chemically synthesized
gtggtgaggcctagtggaaggt

SEQ ID NO: 741145 - DNA, 22 bp, Artificial Sequence
  chemically synthesized
ctacaacccagacaccttccac

SEQ ID NO: 741146 - DNA, 22 bp, Artificial Sequence
  chemically synthesized
actcctacaacccagacacctt

SEQ ID NO: 741147 - DNA, 22 bp, Artificial Sequence
  chemically synthesized
gtggaaggtgtctgggttgtag

SEQ ID NO: 741148 - DNA, 22 bp, Artificial Sequence
  chemically synthesized
atgagggattcactcctacaac

SEQ ID NO: 741149 - DNA, 22 bp, Artificial Sequence
  chemically synthesized
ggttgtaggagtgaatccctca

SEQ ID NO: 741150 - DNA, 22 bp, Artificial Sequence
  chemically synthesized
taggagtgaatccctcatgaat

SEQ ID NO: 741151 - DNA, 22 bp, Artificial Sequence
  chemically synthesized
ccgtgagaatggcaccaaacca

SEQ ID NO: 741152 - DNA, 22 bp, Artificial Sequence
  chemically synthesized
actaccgtgagaatggcaccaa

SEQ ID NO: 741153 - DNA, 22 bp, Artificial Sequence
  chemically synthesized
atgaatggtttggtgccattct

SEQ ID NO: 741154 - DNA, 22 bp, Artificial Sequence
  chemically synthesized
gctcactaccgtgagaatggca

SEQ ID NO: 741155 - DNA, 22 bp, Artificial Sequence
  chemically synthesized
ggtgccattctcacggtagtga

SEQ ID NO: 741156 - DNA, 22 bp, Artificial Sequence
  chemically synthesized
gtgccattctcacggtagtgag

SEQ ID NO: 741157 - DNA, 22 bp, Artificial Sequence
  chemically synthesized
gagcaaaacctcgctcactacc

SEQ ID NO: 741158 - DNA, 22 bp, Artificial Sequence
  chemically synthesized
ctagagcaaaacctcgctcact

SEQ ID NO: 741159 - DNA, 22 bp, Artificial Sequence
  chemically synthesized
tcacggtagtgagcgaggtttt

SEQ ID NO: 741160 - DNA, 22 bp, Artificial Sequence
  chemically synthesized
acggtagtgagcgaggttttgc

SEQ ID NO: 741161 - DNA, 22 bp, Artificial Sequence
  chemically synthesized
atgaaaactgctagagcaaaac

SEQ ID NO: 741162 - DNA, 22 bp, Artificial Sequence
  chemically synthesized
tcatgaaaactgctagagcaaa

SEQ ID NO: 741163 - DNA, 22 bp, Artificial Sequence
  chemically synthesized
tgctctagcagttttcatgaga

SEQ ID NO: 741164 - DNA, 22 bp, Artificial Sequence
  chemically synthesized
gctctagcagttttcatgagaa

SEQ ID NO: 741165 - DNA, 22 bp, Artificial Sequence
  chemically synthesized
ctctagcagttttcatgagaac

SEQ ID NO: 741166 - DNA, 22 bp, Artificial Sequence
  chemically synthesized
tagcagttttcatgagaactgg

SEQ ID NO: 741167 - DNA, 22 bp, Artificial Sequence
  chemically synthesized
gcagttttcatgagaactggca

SEQ ID NO: 741168 - DNA, 22 bp, Artificial Sequence
  chemically synthesized
tcatgagaactggcacctcccc

SEQ ID NO: 741169 - DNA, 22 bp, Artificial Sequence
  chemically synthesized
catgagaactggcacctcccct

SEQ ID NO: 741170 - DNA, 22 bp, Artificial Sequence
  chemically synthesized
atgagaactggcacctcccctc

SEQ ID NO: 741171 - DNA, 22 bp, Artificial Sequence
  chemically synthesized
gcacctcccctccctctttttc

SEQ ID NO: 741172 - DNA, 22 bp, Artificial Sequence
  chemically synthesized
ccctccctctttttctcctcct

SEQ ID NO: 741173 - DNA, 22 bp, Artificial Sequence
  chemically synthesized
cctctttttctcctcctctctt

SEQ ID NO: 741174 - DNA, 22 bp, Artificial Sequence
  chemically synthesized
tttttctcctcctctcttgccg

SEQ ID NO: 741175 - DNA, 22 bp, Artificial Sequence
  chemically synthesized
tttctcctcctctcttgccgtg

SEQ ID NO: 741176 - DNA, 22 bp, Artificial Sequence
  chemically synthesized
ttctcctcctctcttgccgtgt

SEQ ID NO: 741177 - DNA, 22 bp, Artificial Sequence
  chemically synthesized
tctcctcctctcttgccgtgtg

SEQ ID NO: 741178 - DNA, 22 bp, Artificial Sequence
  chemically synthesized
gtgtacaaagatcacacggcaa

SEQ ID NO: 741179 - DNA, 22 bp, Artificial Sequence
  chemically synthesized
ctcctcctctcttgccgtgtga

SEQ ID NO: 741180 - DNA, 22 bp, Artificial Sequence
  chemically synthesized
tcctcctctcttgccgtgtgat

SEQ ID NO: 741181 - DNA, 22 bp, Artificial Sequence
  chemically synthesized
ctcctctcttgccgtgtgatct

SEQ ID NO: 741182 - DNA, 22 bp, Artificial Sequence
  chemically synthesized
ctctcttgccgtgtgatctttg

SEQ ID NO: 741183 - DNA, 22 bp, Artificial Sequence
  chemically synthesized
tcttgccgtgtgatctttgtac

SEQ ID NO: 741184 - DNA, 22 bp, Artificial Sequence
  chemically synthesized
ttgccgtgtgatctttgtacac

SEQ ID NO: 741185 - DNA, 22 bp, Artificial Sequence
  chemically synthesized
gccgtgtgatctttgtacacca

SEQ ID NO: 741186 - DNA, 22 bp, Artificial Sequence
  chemically synthesized
ccgtgtgatctttgtacaccag

SEQ ID NO: 741187 - DNA, 22 bp, Artificial Sequence
  chemically synthesized
atggcagaaggcaaaggggagc

SEQ ID NO: 741188 - DNA, 22 bp, Artificial Sequence
  chemically synthesized
tgtacaccagctcccctttgcc

SEQ ID NO: 741189 - DNA, 22 bp, Artificial Sequence
  chemically synthesized
gtacaccagctcccctttgcct

SEQ ID NO: 741190 - DNA, 22 bp, Artificial Sequence
  chemically synthesized
tacaccagctcccctttgcctt

SEQ ID NO: 741191 - DNA, 22 bp, Artificial Sequence
  chemically synthesized
cactcatggcagaaggcaaagg

SEQ ID NO: 741192 - DNA, 22 bp, Artificial Sequence
  chemically synthesized
ccactcatggcagaaggcaaag

SEQ ID NO: 741193 - DNA, 22 bp, Artificial Sequence
  chemically synthesized
cttccactcatggcagaaggca

SEQ ID NO: 741194 - DNA, 22 bp, Artificial Sequence
  chemically synthesized
ccctttgccttctgccatgagt

SEQ ID NO: 741195 - DNA, 22 bp, Artificial Sequence
  chemically synthesized
tgccttctgccatgagtggaag

SEQ ID NO: 741196 - DNA, 22 bp, Artificial Sequence
  chemically synthesized
gccttctgccatgagtggaagc

SEQ ID NO: 741197 - DNA, 22 bp, Artificial Sequence
  chemically synthesized
ccttctgccatgagtggaagca

SEQ ID NO: 741198 - DNA, 22 bp, Artificial Sequence
  chemically synthesized
gcgagggcgtcaggctgcttcc

SEQ ID NO: 741199 - DNA, 22 bp, Artificial Sequence
  chemically synthesized
ctgccatgagtggaagcagcct

SEQ ID NO: 741200 - DNA, 22 bp, Artificial Sequence
  chemically synthesized
tgccatgagtggaagcagcctg

SEQ ID NO: 741201 - DNA, 22 bp, Artificial Sequence
  chemically synthesized
tggcgagggcgtcaggctgctt

SEQ ID NO: 741202 - DNA, 22 bp, Artificial Sequence
  chemically synthesized
ctggcgagggcgtcaggctgct

SEQ ID NO: 741203 - DNA, 22 bp, Artificial Sequence
  chemically synthesized
ccatgagtggaagcagcctgac

SEQ ID NO: 741204 - DNA, 22 bp, Artificial Sequence
  chemically synthesized
cttctggcgagggcgtcaggct

SEQ ID NO: 741205 - DNA, 22 bp, Artificial Sequence
  chemically synthesized
tacaagaagcatctgcttctgg

SEQ ID NO: 741206 - DNA, 22 bp, Artificial Sequence
  chemically synthesized
acgccctcgccagaagcagatg

SEQ ID NO: 741207 - DNA, 22 bp, Artificial Sequence
  chemically synthesized
caggctgtacaagaagcatctg

SEQ ID NO: 741208 - DNA, 22 bp, Artificial Sequence
  chemically synthesized
tgcaggctgtacaagaagcatc

SEQ ID NO: 741209 - DNA, 22 bp, Artificial Sequence
  chemically synthesized
gccagaagcagatgcttcttgt

SEQ ID NO: 741210 - DNA, 22 bp, Artificial Sequence
  chemically synthesized
agttctgcaggctgtacaagaa

SEQ ID NO: 741211 - DNA, 22 bp, Artificial Sequence
  chemically synthesized
gctcagttctgcaggctgtaca

SEQ ID NO: 741212 - DNA, 22 bp, Artificial Sequence
  chemically synthesized
ggctcagttctgcaggctgtac

SEQ ID NO: 741213 - DNA, 22 bp, Artificial Sequence
  chemically synthesized
tttggctcagttctgcaggctg

SEQ ID NO: 741214 - DNA, 22 bp, Artificial Sequence
  chemically synthesized
atttggctcagttctgcaggct

SEQ ID NO: 741215 - DNA, 22 bp, Artificial Sequence
  chemically synthesized
cttgtacagcctgcagaactga

SEQ ID NO: 741216 - DNA, 22 bp, Artificial Sequence
  chemically synthesized
ttgtacagcctgcagaactgag

SEQ ID NO: 741217 - DNA, 22 bp, Artificial Sequence
  chemically synthesized
gtacagcctgcagaactgagcc

SEQ ID NO: 741218 - DNA, 22 bp, Artificial Sequence
  chemically synthesized
tacagcctgcagaactgagcca

SEQ ID NO: 741219 - DNA, 22 bp, Artificial Sequence
  chemically synthesized
ataaagaacaggtgtttatttg

SEQ ID NO: 741220 - DNA, 22 bp, Artificial Sequence
  chemically synthesized
cagaactgagccaaataaacac

SEQ ID NO: 741221 - DNA, 22 bp, Artificial Sequence
  chemically synthesized
ggtaattcataaagaacaggtg

SEQ ID NO: 741222 - DNA, 22 bp, Artificial Sequence
  chemically synthesized
agccaaataaacacctgttctt

SEQ ID NO: 741223 - DNA, 22 bp, Artificial Sequence
  chemically synthesized
gggctgggtaattcataaagaa

SEQ ID NO: 741224 - DNA, 22 bp, Artificial Sequence
  chemically synthesized
ggggctgggtaattcataaaga

SEQ ID NO: 741225 - DNA, 22 bp, Artificial Sequence
  chemically synthesized
ttctttatgaattacccagccc

SEQ ID NO: 741226 - DNA, 22 bp, Artificial Sequence
  chemically synthesized
taaaagaatacttggggctggg

SEQ ID NO: 741227 - DNA, 22 bp, Artificial Sequence
  chemically synthesized
tttatgaattacccagccccaa

SEQ ID NO: 741228 - DNA, 22 bp, Artificial Sequence
  chemically synthesized
tatgaattacccagccccaagt

SEQ ID NO: 741229 - DNA, 22 bp, Artificial Sequence
  chemically synthesized
ctataaaagaatacttggggct

SEQ ID NO: 741230 - DNA, 22 bp, Artificial Sequence
  chemically synthesized
atgaattacccagccccaagta

SEQ ID NO: 741231 - DNA, 22 bp, Artificial Sequence
  chemically synthesized
tgaattacccagccccaagtat

SEQ ID NO: 741232 - DNA, 22 bp, Artificial Sequence
  chemically synthesized
gtgttgctataaaagaatactt

SEQ ID NO: 741233 - DNA, 22 bp, Artificial Sequence
  chemically synthesized
agtgttgctataaaagaatact

SEQ ID NO: 741234 - DNA, 22 bp, Artificial Sequence
  chemically synthesized
cccagccccaagtattctttta

SEQ ID NO: 741235 - DNA, 22 bp, Artificial Sequence
  chemically synthesized
tttagtgttgctataaaagaat

SEQ ID NO: 741236 - DNA, 22 bp, Artificial Sequence
  chemically synthesized
gtctgtttagtgttgctataaa

SEQ ID NO: 741237 - DNA, 22 bp, Artificial Sequence
  chemically synthesized
agtctgtttagtgttgctataa

SEQ ID NO: 741238 - DNA, 22 bp, Artificial Sequence
  chemically synthesized
ttttatagcaacactaaacaga

SEQ ID NO: 741239 - DNA, 22 bp, Artificial Sequence
  chemically synthesized
gtatatgtcttagtctgtttag

SEQ ID NO: 741240 - DNA, 22 bp, Artificial Sequence
  chemically synthesized
ttatagcaacactaaacagact

SEQ ID NO: 741241 - DNA, 22 bp, Artificial Sequence
  chemically synthesized
agtatatgtcttagtctgttta

SEQ ID NO: 741242 - DNA, 22 bp, Artificial Sequence
  chemically synthesized
tatagcaacactaaacagacta

SEQ ID NO: 741243 - DNA, 22 bp, Artificial Sequence
  chemically synthesized
atagcaacactaaacagactaa

SEQ ID NO: 741244 - DNA, 22 bp, Artificial Sequence
  chemically synthesized
tagcaacactaaacagactaag

SEQ ID NO: 741245 - DNA, 22 bp, Artificial Sequence
  chemically synthesized
agacttagtatatgtcttagtc

SEQ ID NO: 741246 - DNA, 22 bp, Artificial Sequence
  chemically synthesized
aacagactaagacatatactaa

SEQ ID NO: 741247 - DNA, 22 bp, Artificial Sequence
  chemically synthesized
gaagcaactaagacttagtata

SEQ ID NO: 741248 - DNA, 22 bp, Artificial Sequence
  chemically synthesized
ggaagcaactaagacttagtat

SEQ ID NO: 741249 - DNA, 22 bp, Artificial Sequence
  chemically synthesized
tggaagcaactaagacttagta

SEQ ID NO: 741250 - DNA, 22 bp, Artificial Sequence
  chemically synthesized
attttggaagcaactaagactt

SEQ ID NO: 741251 - DNA, 22 bp, Artificial Sequence
  chemically synthesized
agacatatactaagtcttagtt

SEQ ID NO: 741252 - DNA, 22 bp, Artificial Sequence
  chemically synthesized
atattaattttggaagcaacta

SEQ ID NO: 741253 - DNA, 22 bp, Artificial Sequence
  chemically synthesized
ttaatattaattttggaagcaa

SEQ ID NO: 741254 - DNA, 22 bp, Artificial Sequence
  chemically synthesized
agtcttagttgcttccaaaatt

SEQ ID NO: 741255 - DNA, 22 bp, Artificial Sequence
  chemically synthesized
aaattattaatattaattttgg

SEQ ID NO: 741256 - DNA, 22 bp, Artificial Sequence
  chemically synthesized
caaattattaatattaattttg

SEQ ID NO: 741257 - DNA, 22 bp, Artificial Sequence
  chemically synthesized
tcaaattattaatattaatttt

SEQ ID NO: 741258 - DNA, 22 bp, Artificial Sequence
  chemically synthesized
agttgcttccaaaattaatatt

SEQ ID NO: 741259 - DNA, 22 bp, Artificial Sequence
  chemically synthesized
gttgcttccaaaattaatatta

SEQ ID NO: 741260 - DNA, 22 bp, Artificial Sequence
  chemically synthesized
cttccaaaattaatattaataa

SEQ ID NO: 741261 - DNA, 22 bp, Artificial Sequence
  chemically synthesized
aacattttcaaattattaatat

SEQ ID NO: 741262 - DNA, 22 bp, Artificial Sequence
  chemically synthesized
ccaaaattaatattaataattt

SEQ ID NO: 741263 - DNA, 22 bp, Artificial Sequence
  chemically synthesized
caaaattaatattaataatttg

SEQ ID NO: 741264 - DNA, 22 bp, Artificial Sequence
  chemically synthesized
ccatctaaacattttcaaatta

SEQ ID NO: 741265 - DNA, 22 bp, Artificial Sequence
  chemically synthesized
atattaataatttgaaaatgtt

SEQ ID NO: 741266 - DNA, 22 bp, Artificial Sequence
  chemically synthesized
taattcccatctaaacattttc

SEQ ID NO: 741267 - DNA, 22 bp, Artificial Sequence
  chemically synthesized
ataattcccatctaaacatttt

SEQ ID NO: 741268 - DNA, 22 bp, Artificial Sequence
  chemically synthesized
ataatttgaaaatgtttagatg

SEQ ID NO: 741269 - DNA, 22 bp, Artificial Sequence
  chemically synthesized
gtttataattcccatctaaaca

SEQ ID NO: 741270 - DNA, 22 bp, Artificial Sequence
  chemically synthesized
tattagtttataattcccatct

SEQ ID NO: 741271 - DNA, 22 bp, Artificial Sequence
  chemically synthesized
atattagtttataattcccatc

SEQ ID NO: 741272 - DNA, 22 bp, Artificial Sequence
  chemically synthesized
gaaaatgtttagatgggaatta

SEQ ID NO: 741273 - DNA, 22 bp, Artificial Sequence
  chemically synthesized
tatattagtttataattcccat

SEQ ID NO: 741274 - DNA, 22 bp, Artificial Sequence
  chemically synthesized
aaaatgtttagatgggaattat

SEQ ID NO: 741275 - DNA, 22 bp, Artificial Sequence
  chemically synthesized
agatgggaattataaactaata

SEQ ID NO: 741276 - DNA, 22 bp, Artificial Sequence
  chemically synthesized
gatgggaattataaactaatat

SEQ ID NO: 741277 - DNA, 22 bp, Artificial Sequence
  chemically synthesized
tgaggataggatattttatatt

SEQ ID NO: 741278 - DNA, 22 bp, Artificial Sequence
  chemically synthesized
gtgaggataggatattttatat

SEQ ID NO: 741279 - DNA, 22 bp, Artificial Sequence
  chemically synthesized
taaactaatataaaatatccta

SEQ ID NO: 741280 - DNA, 22 bp, Artificial Sequence
  chemically synthesized
atataaaatatcctatcctcac

SEQ ID NO: 741281 - DNA, 22 bp, Artificial Sequence
  chemically synthesized
atggtaatatttgtgaggatag

SEQ ID NO: 741282 - DNA, 22 bp, Artificial Sequence
  chemically synthesized
atgtaatgttcatggtaatatt

SEQ ID NO: 741283 - DNA, 22 bp, Artificial Sequence
  chemically synthesized
catgtaatgttcatggtaatat

SEQ ID NO: 741284 - DNA, 22 bp, Artificial Sequence
  chemically synthesized
tcatgtaatgttcatggtaata

SEQ ID NO: 741285 - DNA, 22 bp, Artificial Sequence
  chemically synthesized
ttcatgtaatgttcatggtaat

SEQ ID NO: 741286 - DNA, 22 bp, Artificial Sequence
  chemically synthesized
tcctcacaaatattaccatgaa

SEQ ID NO: 741287 - DNA, 22 bp, Artificial Sequence
  chemically synthesized
tttcatgtaatgttcatggtaa

SEQ ID NO: 741288 - DNA, 22 bp, Artificial Sequence
  chemically synthesized
ttttcatgtaatgttcatggta

SEQ ID NO: 741289 - DNA, 22 bp, Artificial Sequence
  chemically synthesized
acaaatattaccatgaacatta

SEQ ID NO: 741290 - DNA, 22 bp, Artificial Sequence
  chemically synthesized
ccatgaacattacatgaaaaaa

SEQ ID NO: 741291 - DNA, 22 bp, Artificial Sequence
  chemically synthesized
taaagaacaatgaaagtacttt

SEQ ID NO: 741292 - DNA, 22 bp, Artificial Sequence
  chemically synthesized
gtaaagaacaatgaaagtactt

SEQ ID NO: 741293 - DNA, 22 bp, Artificial Sequence
  chemically synthesized
catgaaaaaagtactttcattg

SEQ ID NO: 741294 - DNA, 22 bp, Artificial Sequence
  chemically synthesized
tcattgttctttacaaatttta

SEQ ID NO: 741295 - DNA, 22 bp, Artificial Sequence
  chemically synthesized
cattgttctttacaaattttat

SEQ ID NO: 741296 - DNA, 22 bp, Artificial Sequence
  chemically synthesized
attgttctttacaaattttatc

SEQ ID NO: 741297 - DNA, 22 bp, Artificial Sequence
  chemically synthesized
ttctttacaaattttatctgta

SEQ ID NO: 741298 - DNA, 22 bp, Artificial Sequence
  chemically synthesized
cagtaaaataatatacagataa

SEQ ID NO: 741299 - DNA, 22 bp, Artificial Sequence
  chemically synthesized
tttacaaattttatctgtatat

SEQ ID NO: 741300 - DNA, 22 bp, Artificial Sequence
  chemically synthesized
ttacagtaaaataatatacaga

SEQ ID NO: 741301 - DNA, 22 bp, Artificial Sequence
  chemically synthesized
tacaaattttatctgtatatta

SEQ ID NO: 741302 - DNA, 22 bp, Artificial Sequence
  chemically synthesized
gttacagtaaaataatatacag

SEQ ID NO: 741303 - DNA, 22 bp, Artificial Sequence
  chemically synthesized
acaaattttatctgtatattat

SEQ ID NO: 741304 - DNA, 22 bp, Artificial Sequence
  chemically synthesized
tgttacagtaaaataatataca

SEQ ID NO: 741305 - DNA, 22 bp, Artificial Sequence
  chemically synthesized
caaattttatctgtatattatt

SEQ ID NO: 741306 - DNA, 22 bp, Artificial Sequence
  chemically synthesized
tcctttgttacagtaaaataat

SEQ ID NO: 741307 - DNA, 22 bp, Artificial Sequence
  chemically synthesized
tatctgtatattattttactgt

SEQ ID NO: 741308 - DNA, 22 bp, Artificial Sequence
  chemically synthesized
ttgtcctttgttacagtaaaat

SEQ ID NO: 741309 - DNA, 22 bp, Artificial Sequence
  chemically synthesized
atctgtatattattttactgta

SEQ ID NO: 741310 - DNA, 22 bp, Artificial Sequence
  chemically synthesized
tctgtatattattttactgtaa

SEQ ID NO: 741311 - DNA, 22 bp, Artificial Sequence
  chemically synthesized
tatattattttactgtaacaaa

SEQ ID NO: 741312 - DNA, 22 bp, Artificial Sequence
  chemically synthesized
taaacattgttgtcctttgtta

SEQ ID NO: 741313 - DNA, 22 bp, Artificial Sequence
  chemically synthesized
ttttactgtaacaaaggacaac

SEQ ID NO: 741314 - DNA, 22 bp, Artificial Sequence
  chemically synthesized
tactgtaacaaaggacaacaat

SEQ ID NO: 741315 - DNA, 22 bp, Artificial Sequence
  chemically synthesized
actgtaacaaaggacaacaatg

SEQ ID NO: 741316 - DNA, 22 bp, Artificial Sequence
  chemically synthesized
ctgtaacaaaggacaacaatgt

SEQ ID NO: 741317 - DNA, 22 bp, Artificial Sequence
  chemically synthesized
taacaaaggacaacaatgttta

SEQ ID NO: 741318 - DNA, 22 bp, Artificial Sequence
  chemically synthesized
caggtaagcacattgtaaacat

SEQ ID NO: 741319 - DNA, 22 bp, Artificial Sequence
  chemically synthesized
tgcaggtaagcacattgtaaac

SEQ ID NO: 741320 - DNA, 22 bp, Artificial Sequence
  chemically synthesized
ctgcaggtaagcacattgtaaa

SEQ ID NO: 741321 - DNA, 22 bp, Artificial Sequence
  chemically synthesized
acaatgtgcttacctgcagaag

SEQ ID NO: 741322 - DNA, 22 bp, Artificial Sequence
  chemically synthesized
caatgtgcttacctgcagaagc

SEQ ID NO: 741323 - DNA, 22 bp, Artificial Sequence
  chemically synthesized
aacaccagatggaagcttctgc

SEQ ID NO: 741324 - DNA, 22 bp, Artificial Sequence
  chemically synthesized
acctgcagaagcttccatctgg

SEQ ID NO: 741325 - DNA, 22 bp, Artificial Sequence
  chemically synthesized
cctgcagaagcttccatctggt

SEQ ID NO: 741326 - DNA, 22 bp, Artificial Sequence
  chemically synthesized
gaagacctgaacaccagatgga

SEQ ID NO: 741327 - DNA, 22 bp, Artificial Sequence
  chemically synthesized
tggaagacctgaacaccagatg

SEQ ID NO: 741328 - DNA, 22 bp, Artificial Sequence
  chemically synthesized
cagaagcttccatctggtgttc

SEQ ID NO: 741329 - DNA, 22 bp, Artificial Sequence
  chemically synthesized
agcactctggaagacctgaaca

SEQ ID NO: 741330 - DNA, 22 bp, Artificial Sequence
  chemically synthesized
ccatctggtgttcaggtcttcc

SEQ ID NO: 741331 - DNA, 22 bp, Artificial Sequence
  chemically synthesized
catctggtgttcaggtcttcca

SEQ ID NO: 741332 - DNA, 22 bp, Artificial Sequence
  chemically synthesized
gtgttcaggtcttccagagtgc

SEQ ID NO: 741333 - DNA, 22 bp, Artificial Sequence
  chemically synthesized
accgtataacctcagcactctg

SEQ ID NO: 741334 - DNA, 22 bp, Artificial Sequence
  chemically synthesized
tcaccgtataacctcagcactc

SEQ ID NO: 741335 - DNA, 22 bp, Artificial Sequence
  chemically synthesized
aggtcttccagagtgctgaggt

SEQ ID NO: 741336 - DNA, 22 bp, Artificial Sequence
  chemically synthesized
agctctcaccgtataacctcag

SEQ ID NO: 741337 - DNA, 22 bp, Artificial Sequence
  chemically synthesized
ccagagtgctgaggttatacgg

SEQ ID NO: 741338 - DNA, 22 bp, Artificial Sequence
  chemically synthesized
cagagtgctgaggttatacggt

SEQ ID NO: 741339 - DNA, 22 bp, Artificial Sequence
  chemically synthesized
ggcattcagctctcaccgtata

SEQ ID NO: 741340 - DNA, 22 bp, Artificial Sequence
  chemically synthesized
gggcattcagctctcaccgtat

SEQ ID NO: 741341 - DNA, 22 bp, Artificial Sequence
  chemically synthesized
tgggcattcagctctcaccgta

SEQ ID NO: 741342 - DNA, 22 bp, Artificial Sequence
  chemically synthesized
aggttatacggtgagagctgaa

SEQ ID NO: 741343 - DNA, 22 bp, Artificial Sequence
  chemically synthesized
ccactttgggcattcagctctc

SEQ ID NO: 741344 - DNA, 22 bp, Artificial Sequence
  chemically synthesized
accactttgggcattcagctct

SEQ ID NO: 741345 - DNA, 22 bp, Artificial Sequence
  chemically synthesized
tacggtgagagctgaatgccca

SEQ ID NO: 741346 - DNA, 22 bp, Artificial Sequence
  chemically synthesized
gccagcttaccactttgggcat

SEQ ID NO: 741347 - DNA, 22 bp, Artificial Sequence
  chemically synthesized
ctcgccagcttaccactttggg

SEQ ID NO: 741348 - DNA, 22 bp, Artificial Sequence
  chemically synthesized
gctcgccagcttaccactttgg

SEQ ID NO: 741349 - DNA, 22 bp, Artificial Sequence
  chemically synthesized
aatgcccaaagtggtaagctgg

SEQ ID NO: 741350 - DNA, 22 bp, Artificial Sequence
  chemically synthesized
gcgagcaaggtcattgacgtgg

SEQ ID NO: 741351 - DNA, 22 bp, Artificial Sequence
  chemically synthesized
aaagagaacgtgagccacgtca

SEQ ID NO: 741352 - DNA, 22 bp, Artificial Sequence
  chemically synthesized
tgaaagagaacgtgagccacgt

SEQ ID NO: 741353 - DNA, 22 bp, Artificial Sequence
  chemically synthesized
cgcctctgaaagagaacgtgag

SEQ ID NO: 741354 - DNA, 22 bp, Artificial Sequence
  chemically synthesized
acgtggctcacgttctctttca

SEQ ID NO: 741355 - DNA, 22 bp, Artificial Sequence
  chemically synthesized
gaggagaaattgcgcctctgaa

SEQ ID NO: 741356 - DNA, 22 bp, Artificial Sequence
  chemically synthesized
cgaggagaaattgcgcctctga

SEQ ID NO: 741357 - DNA, 22 bp, Artificial Sequence
  chemically synthesized
acgttctctttcagaggcgcaa

SEQ ID NO: 741358 - DNA, 22 bp, Artificial Sequence
  chemically synthesized
tctttcagaggcgcaatttctc

SEQ ID NO: 741359 - DNA, 22 bp, Artificial Sequence
  chemically synthesized
tttcagaggcgcaatttctcct

SEQ ID NO: 741360 - DNA, 22 bp, Artificial Sequence
  chemically synthesized
tcagaggcgcaatttctcctcg

SEQ ID NO: 741361 - DNA, 22 bp, Artificial Sequence
  chemically synthesized
cagaggcgcaatttctcctcga

SEQ ID NO: 741362 - DNA, 22 bp, Artificial Sequence
  chemically synthesized
cacacaggcacttcgaggagaa

SEQ ID NO: 741363 - DNA, 22 bp, Artificial Sequence
  chemically synthesized
agaggcgcaatttctcctcgaa

SEQ ID NO: 741364 - DNA, 22 bp, Artificial Sequence
  chemically synthesized
ttgcacacaggcacttcgagga

SEQ ID NO: 741365 - DNA, 22 bp, Artificial Sequence
  chemically synthesized
actattgcacacaggcacttcg

SEQ ID NO: 741366 - DNA, 22 bp, Artificial Sequence
  chemically synthesized
gactattgcacacaggcacttc

SEQ ID NO: 741367 - DNA, 22 bp, Artificial Sequence
  chemically synthesized
tgactattgcacacaggcactt

SEQ ID NO: 741368 - DNA, 22 bp, Artificial Sequence
  chemically synthesized
ttgactattgcacacaggcact

SEQ ID NO: 741369 - DNA, 22 bp, Artificial Sequence
  chemically synthesized
cttttgactattgcacacaggc

SEQ ID NO: 741370 - DNA, 22 bp, Artificial Sequence
  chemically synthesized
ctcctcgaagtgcctgtgtgca

SEQ ID NO: 741371 - DNA, 22 bp, Artificial Sequence
  chemically synthesized
gcttttgactattgcacacagg

SEQ ID NO: 741372 - DNA, 22 bp, Artificial Sequence
  chemically synthesized
tcctcgaagtgcctgtgtgcaa

SEQ ID NO: 741373 - DNA, 22 bp, Artificial Sequence
  chemically synthesized
ctcgaagtgcctgtgtgcaata

SEQ ID NO: 741374 - DNA, 22 bp, Artificial Sequence
  chemically synthesized
gaagtgcctgtgtgcaatagtc

SEQ ID NO: 741375 - DNA, 22 bp, Artificial Sequence
  chemically synthesized
caatttgcttttgactattgca

SEQ ID NO: 741376 - DNA, 22 bp, Artificial Sequence
  chemically synthesized
ccaatttgcttttgactattgc

SEQ ID NO: 741377 - DNA, 22 bp, Artificial Sequence
  chemically synthesized
atcttccaatttgcttttgact

SEQ ID NO: 741378 - DNA, 22 bp, Artificial Sequence
  chemically synthesized
tcatcttccaatttgcttttga

SEQ ID NO: 741379 - DNA, 22 bp, Artificial Sequence
  chemically synthesized
tgtgcaatagtcaaaagcaaat

SEQ ID NO: 741380 - DNA, 22 bp, Artificial Sequence
  chemically synthesized
aatattctcatcttccaatttg

SEQ ID NO: 741381 - DNA, 22 bp, Artificial Sequence
  chemically synthesized
aaatattctcatcttccaattt

SEQ ID NO: 741382 - DNA, 22 bp, Artificial Sequence
  chemically synthesized
taaatattctcatcttccaatt

SEQ ID NO: 741383 - DNA, 22 bp, Artificial Sequence
  chemically synthesized
ttttaaatattctcatcttcca

SEQ ID NO: 741384 - DNA, 22 bp, Artificial Sequence
  chemically synthesized
gttttaaatattctcatcttcc

SEQ ID NO: 741385 - DNA, 22 bp, Artificial Sequence
  chemically synthesized
ttgttttaaatattctcatctt

SEQ ID NO: 741386 - DNA, 22 bp, Artificial Sequence
  chemically synthesized
cttgttttaaatattctcatct

SEQ ID NO: 741387 - DNA, 22 bp, Artificial Sequence
  chemically synthesized
ttcttgttttaaatattctcat

SEQ ID NO: 741388 - DNA, 22 bp, Artificial Sequence
  chemically synthesized
gaagatgagaatatttaaaaca

SEQ ID NO: 741389 - DNA, 22 bp, Artificial Sequence
  chemically synthesized
aaaacaagaagaactgatacct

SEQ ID NO: 741390 - DNA, 22 bp, Artificial Sequence
  chemically synthesized
aaacaagaagaactgatacctg

SEQ ID NO: 741391 - DNA, 22 bp, Artificial Sequence
  chemically synthesized
aagagaataagcccaggtatca

SEQ ID NO: 741392 - DNA, 22 bp, Artificial Sequence
  chemically synthesized
caccctaaagagaataagccca

SEQ ID NO: 741393 - DNA, 22 bp, Artificial Sequence
  chemically synthesized
gcactgcaccctaaagagaata

SEQ ID NO: 741394 - DNA, 22 bp, Artificial Sequence
  chemically synthesized
atacctgggcttattctcttta

SEQ ID NO: 741395 - DNA, 22 bp, Artificial Sequence
  chemically synthesized
ctggcactgcaccctaaagaga

SEQ ID NO: 741396 - DNA, 22 bp, Artificial Sequence
  chemically synthesized
ggcttattctctttagggtgca

SEQ ID NO: 741397 - DNA, 22 bp, Artificial Sequence
  chemically synthesized
attctctttagggtgcagtgcc

SEQ ID NO: 741398 - DNA, 22 bp, Artificial Sequence
  chemically synthesized
ttctctttagggtgcagtgcca

SEQ ID NO: 741399 - DNA, 22 bp, Artificial Sequence
  chemically synthesized
tctttagggtgcagtgccagta

SEQ ID NO: 741400 - DNA, 22 bp, Artificial Sequence
  chemically synthesized
tttagggtgcagtgccagtaat

SEQ ID NO: 741401 - DNA, 22 bp, Artificial Sequence
  chemically synthesized
tagggtgcagtgccagtaatgt

SEQ ID NO: 741402 - DNA, 22 bp, Artificial Sequence
  chemically synthesized
agggtgcagtgccagtaatgtt

SEQ ID NO: 741403 - DNA, 22 bp, Artificial Sequence
  chemically synthesized
gggtgcagtgccagtaatgttt

SEQ ID NO: 741404 - DNA, 22 bp, Artificial Sequence
  chemically synthesized
aaaccgtagcatagagcaaaca

SEQ ID NO: 741405 - DNA, 22 bp, Artificial Sequence
  chemically synthesized
gctctatgctacggtttgaatg

SEQ ID NO: 741406 - DNA, 22 bp, Artificial Sequence
  chemically synthesized
ctctatgctacggtttgaatgt

SEQ ID NO: 741407 - DNA, 22 bp, Artificial Sequence
  chemically synthesized
aggggggacacaaacattcaaa

SEQ ID NO: 741408 - DNA, 22 bp, Artificial Sequence
  chemically synthesized
gaggggggacacaaacattcaa

SEQ ID NO: 741409 - DNA, 22 bp, Artificial Sequence
  chemically synthesized
tatgctacggtttgaatgtttg

SEQ ID NO: 741410 - DNA, 22 bp, Artificial Sequence
  chemically synthesized
tgctacggtttgaatgtttgtg

SEQ ID NO: 741411 - DNA, 22 bp, Artificial Sequence
  chemically synthesized
cggtttgaatgtttgtgtcccc

SEQ ID NO: 741412 - DNA, 22 bp, Artificial Sequence
  chemically synthesized
aacataggaatttgagggggga

SEQ ID NO: 741413 - DNA, 22 bp, Artificial Sequence
  chemically synthesized
gaatgtttgtgtcccccctcaa

SEQ ID NO: 741414 - DNA, 22 bp, Artificial Sequence
  chemically synthesized
caacataggaatttgagggggg

SEQ ID NO: 741415 - DNA, 22 bp, Artificial Sequence
  chemically synthesized
aatgtttgtgtcccccctcaaa

SEQ ID NO: 741416 - DNA, 22 bp, Artificial Sequence
  chemically synthesized
ggatttcaacataggaatttga

SEQ ID NO: 741417 - DNA, 22 bp, Artificial Sequence
  chemically synthesized
aggatttcaacataggaatttg

SEQ ID NO: 741418 - DNA, 22 bp, Artificial Sequence
  chemically synthesized
gtgtcccccctcaaattcctat

SEQ ID NO: 741419 - DNA, 22 bp, Artificial Sequence
  chemically synthesized
taggatttcaacataggaattt

SEQ ID NO: 741420 - DNA, 22 bp, Artificial Sequence
  chemically synthesized
tgtcccccctcaaattcctatg

SEQ ID NO: 741421 - DNA, 22 bp, Artificial Sequence
  chemically synthesized
ttaggatttcaacataggaatt

SEQ ID NO: 741422 - DNA, 22 bp, Artificial Sequence
  chemically synthesized
tttaggatttcaacataggaat

SEQ ID NO: 741423 - DNA, 22 bp, Artificial Sequence
  chemically synthesized
ttttttaggatttcaacatagg

SEQ ID NO: 741424 - DNA, 22 bp, Artificial Sequence
  chemically synthesized
attttttaggatttcaacatag

SEQ ID NO: 741425 - DNA, 22 bp, Artificial Sequence
  chemically synthesized
tattttttaggatttcaacata

SEQ ID NO: 741426 - DNA, 22 bp, Artificial Sequence
  chemically synthesized
ttattttttaggatttcaacat

SEQ ID NO: 741427 - DNA, 22 bp, Artificial Sequence
  chemically synthesized
tttattttttaggatttcaaca

SEQ ID NO: 741428 - DNA, 22 bp, Artificial Sequence
  chemically synthesized
aaattcctatgttgaaatccta

SEQ ID NO: 741429 - DNA, 22 bp, Artificial Sequence
  chemically synthesized
ctttttattttttaggatttca

SEQ ID NO: 741430 - DNA, 22 bp, Artificial Sequence
  chemically synthesized
cctttttattttttaggatttc

SEQ ID NO: 741431 - DNA, 22 bp, Artificial Sequence
  chemically synthesized
gtttcctttttattttttagga

SEQ ID NO: 741432 - DNA, 22 bp, Artificial Sequence
  chemically synthesized
ctatgttgaaatcctaaaaaat

SEQ ID NO: 741433 - DNA, 22 bp, Artificial Sequence
  chemically synthesized
cgtttcctttttattttttagg

SEQ ID NO: 741434 - DNA, 22 bp, Artificial Sequence
  chemically synthesized
tgttgaaatcctaaaaaataaa

SEQ ID NO: 741435 - DNA, 22 bp, Artificial Sequence
  chemically synthesized
atttcgtttcctttttattttt

SEQ ID NO: 741436 - DNA, 22 bp, Artificial Sequence
  chemically synthesized
gatttcgtttcctttttatttt

SEQ ID NO: 741437 - DNA, 22 bp, Artificial Sequence
  chemically synthesized
tgatttcgtttcctttttattt

SEQ ID NO: 741438 - DNA, 22 bp, Artificial Sequence
  chemically synthesized
aaatcctaaaaaataaaaagga

SEQ ID NO: 741439 - DNA, 22 bp, Artificial Sequence
  chemically synthesized
ggtgttttgatttcgtttcctt

SEQ ID NO: 741440 - DNA, 22 bp, Artificial Sequence
  chemically synthesized
aggtgttttgatttcgtttcct

SEQ ID NO: 741441 - DNA, 22 bp, Artificial Sequence
  chemically synthesized
aaaaataaaaaggaaacgaaat

SEQ ID NO: 741442 - DNA, 22 bp, Artificial Sequence
  chemically synthesized
ccttaggtgttttgatttcgtt

SEQ ID NO: 741443 - DNA, 22 bp, Artificial Sequence
  chemically synthesized
ataccattgccttaggtgtttt

SEQ ID NO: 741444 - DNA, 22 bp, Artificial Sequence
  chemically synthesized
ctaataccattgccttaggtgt

SEQ ID NO: 741445 - DNA, 22 bp, Artificial Sequence
  chemically synthesized
aaggccccatctcctaatacca

SEQ ID NO: 741446 - DNA, 22 bp, Artificial Sequence
  chemically synthesized
cctaaaggccccatctcctaat

SEQ ID NO: 741447 - DNA, 22 bp, Artificial Sequence
  chemically synthesized
aggcaatggtattaggagatgg

SEQ ID NO: 741448 - DNA, 22 bp, Artificial Sequence
  chemically synthesized
ggagatggggcctttagggagg

SEQ ID NO: 741449 - DNA, 22 bp, Artificial Sequence
  chemically synthesized
atcccaaaaatcacctccctaa

SEQ ID NO: 741450 - DNA, 22 bp, Artificial Sequence
  chemically synthesized
taagggcgctaatcccaaaaat

SEQ ID NO: 741451 - DNA, 22 bp, Artificial Sequence
  chemically synthesized
ataagggcgctaatcccaaaaa

SEQ ID NO: 741452 - DNA, 22 bp, Artificial Sequence
  chemically synthesized
tagggaggtgatttttgggatt

SEQ ID NO: 741453 - DNA, 22 bp, Artificial Sequence
  chemically synthesized
tataagggcgctaatcccaaaa

SEQ ID NO: 741454 - DNA, 22 bp, Artificial Sequence
  chemically synthesized
agggaggtgatttttgggatta

SEQ ID NO: 741455 - DNA, 22 bp, Artificial Sequence
  chemically synthesized
ttataagggcgctaatcccaaa

SEQ ID NO: 741456 - DNA, 22 bp, Artificial Sequence
  chemically synthesized
gggaggtgatttttgggattag

SEQ ID NO: 741457 - DNA, 22 bp, Artificial Sequence
  chemically synthesized
ttttataagggcgctaatccca

SEQ ID NO: 741458 - DNA, 22 bp, Artificial Sequence
  chemically synthesized
aggtctcttttataagggcgct

SEQ ID NO: 741459 - DNA, 22 bp, Artificial Sequence
  chemically synthesized
tgaggtctcttttataagggcg

SEQ ID NO: 741460 - DNA, 22 bp, Artificial Sequence
  chemically synthesized
ttgggattagcgcccttataaa

SEQ ID NO: 741461 - DNA, 22 bp, Artificial Sequence
  chemically synthesized
tctgaggtctcttttataaggg

SEQ ID NO: 741462 - DNA, 22 bp, Artificial Sequence
  chemically synthesized
tgggattagcgcccttataaaa

SEQ ID NO: 741463 - DNA, 22 bp, Artificial Sequence
  chemically synthesized
gggattagcgcccttataaaag

SEQ ID NO: 741464 - DNA, 22 bp, Artificial Sequence
  chemically synthesized
ggattagcgcccttataaaaga

SEQ ID NO: 741465 - DNA, 22 bp, Artificial Sequence
  chemically synthesized
gctctctgaggtctcttttata

SEQ ID NO: 741466 - DNA, 22 bp, Artificial Sequence
  chemically synthesized
gctagctctctgaggtctcttt

SEQ ID NO: 741467 - DNA, 22 bp, Artificial Sequence
  chemically synthesized
gcgcccttataaaagagacctc

SEQ ID NO: 741468 - DNA, 22 bp, Artificial Sequence
  chemically synthesized
ataaaagagacctcagagagct

SEQ ID NO: 741469 - DNA, 22 bp, Artificial Sequence
  chemically synthesized
taaaagagacctcagagagcta

SEQ ID NO: 741470 - DNA, 22 bp, Artificial Sequence
  chemically synthesized
aaaggagctagctagctctctg

SEQ ID NO: 741471 - DNA, 22 bp, Artificial Sequence
  chemically synthesized
acatgctgaaaggagctagcta

SEQ ID NO: 741472 - DNA, 22 bp, Artificial Sequence
  chemically synthesized
agagagctagctagctcctttc

SEQ ID NO: 741473 - DNA, 22 bp, Artificial Sequence
  chemically synthesized
caccctcacatgctgaaaggag

SEQ ID NO: 741474 - DNA, 22 bp, Artificial Sequence
  chemically synthesized
actgcaccctcacatgctgaaa

SEQ ID NO: 741475 - DNA, 22 bp, Artificial Sequence
  chemically synthesized
tcactgcaccctcacatgctga

SEQ ID NO: 741476 - DNA, 22 bp, Artificial Sequence
  chemically synthesized
gctagctcctttcagcatgtga

SEQ ID NO: 741477 - DNA, 22 bp, Artificial Sequence
  chemically synthesized
ctcactgcaccctcacatgctg

SEQ ID NO: 741478 - DNA, 22 bp, Artificial Sequence
  chemically synthesized
gctcctttcagcatgtgagggt

SEQ ID NO: 741479 - DNA, 22 bp, Artificial Sequence
  chemically synthesized
ctttcagcatgtgagggtgcag

SEQ ID NO: 741480 - DNA, 22 bp, Artificial Sequence
  chemically synthesized
tcagcatgtgagggtgcagtga

SEQ ID NO: 741481 - DNA, 22 bp, Artificial Sequence
  chemically synthesized
cagcatgtgagggtgcagtgag

SEQ ID NO: 741482 - DNA, 22 bp, Artificial Sequence
  chemically synthesized
agcatgtgagggtgcagtgaga

SEQ ID NO: 741483 - DNA, 22 bp, Artificial Sequence
  chemically synthesized
atacaaagcaccttctcactgc

SEQ ID NO: 741484 - DNA, 22 bp, Artificial Sequence
  chemically synthesized
ctcatacaaagcaccttctcac

SEQ ID NO: 741485 - DNA, 22 bp, Artificial Sequence
  chemically synthesized
gggaaggcccattcctcataca

SEQ ID NO: 741486 - DNA, 22 bp, Artificial Sequence
  chemically synthesized
gtgtctggggaaggcccattcc

SEQ ID NO: 741487 - DNA, 22 bp, Artificial Sequence
  chemically synthesized
ggtgtctggggaaggcccattc

SEQ ID NO: 741488 - DNA, 22 bp, Artificial Sequence
  chemically synthesized
tgtatgaggaatgggccttccc

SEQ ID NO: 741489 - DNA, 22 bp, Artificial Sequence
  chemically synthesized
gtatgaggaatgggccttcccc

SEQ ID NO: 741490 - DNA, 22 bp, Artificial Sequence
  chemically synthesized
tatgaggaatgggccttcccca

SEQ ID NO: 741491 - DNA, 22 bp, Artificial Sequence
  chemically synthesized
ccccagacaccaaatctgctgg

SEQ ID NO: 741492 - DNA, 22 bp, Artificial Sequence
  chemically synthesized
cccagacaccaaatctgctggt

SEQ ID NO: 741493 - DNA, 22 bp, Artificial Sequence
  chemically synthesized
agaagtccaagatcaaaatacc

SEQ ID NO: 741494 - DNA, 22 bp, Artificial Sequence
  chemically synthesized
gaggttgagaagtccaagatca

SEQ ID NO: 741495 - DNA, 22 bp, Artificial Sequence
  chemically synthesized
tggaggttgagaagtccaagat

SEQ ID NO: 741496 - DNA, 22 bp, Artificial Sequence
  chemically synthesized
ctggtattttgatcttggactt

SEQ ID NO: 741497 - DNA, 22 bp, Artificial Sequence
  chemically synthesized
ttctggaggttgagaagtccaa

SEQ ID NO: 741498 - DNA, 22 bp, Artificial Sequence
  chemically synthesized
gtattttgatcttggacttctc

SEQ ID NO: 741499 - DNA, 22 bp, Artificial Sequence
  chemically synthesized
actgttctggaggttgagaagt

SEQ ID NO: 741500 - DNA, 22 bp, Artificial Sequence
  chemically synthesized
tcactgttctggaggttgagaa

SEQ ID NO: 741501 - DNA, 22 bp, Artificial Sequence
  chemically synthesized
tgatcttggacttctcaacctc

SEQ ID NO: 741502 - DNA, 22 bp, Artificial Sequence
  chemically synthesized
ctcactgttctggaggttgaga

SEQ ID NO: 741503 - DNA, 22 bp, Artificial Sequence
  chemically synthesized
gatcttggacttctcaacctcc

SEQ ID NO: 741504 - DNA, 22 bp, Artificial Sequence
  chemically synthesized
atcttggacttctcaacctcca

SEQ ID NO: 741505 - DNA, 22 bp, Artificial Sequence
  chemically synthesized
tttctcactgttctggaggttg

SEQ ID NO: 741506 - DNA, 22 bp, Artificial Sequence
  chemically synthesized
atttctcactgttctggaggtt

SEQ ID NO: 741507 - DNA, 22 bp, Artificial Sequence
  chemically synthesized
ggacttctcaacctccagaaca

SEQ ID NO: 741508 - DNA, 22 bp, Artificial Sequence
  chemically synthesized
gacttctcaacctccagaacag

SEQ ID NO: 741509 - DNA, 22 bp, Artificial Sequence
  chemically synthesized
ctcaacctccagaacagtgaga

SEQ ID NO: 741510 - DNA, 22 bp, Artificial Sequence
  chemically synthesized
tcaacctccagaacagtgagaa

SEQ ID NO: 741511 - DNA, 22 bp, Artificial Sequence
  chemically synthesized
aacctccagaacagtgagaaat

SEQ ID NO: 741512 - DNA, 22 bp, Artificial Sequence
  chemically synthesized
tgaaacaacaaaaacttatttc

SEQ ID NO: 741513 - DNA, 22 bp, Artificial Sequence
  chemically synthesized
cagaacagtgagaaataagttt

SEQ ID NO: 741514 - DNA, 22 bp, Artificial Sequence
  chemically synthesized
gtgaaacaacaaaaacttattt

SEQ ID NO: 741515 - DNA, 22 bp, Artificial Sequence
  chemically synthesized
gatagcttgtgaaacaacaaaa

SEQ ID NO: 741516 - DNA, 22 bp, Artificial Sequence
  chemically synthesized
ttgttgtttcacaagctatcca

SEQ ID NO: 741517 - DNA, 22 bp, Artificial Sequence
  chemically synthesized
tgttgtttcacaagctatccaa

SEQ ID NO: 741518 - DNA, 22 bp, Artificial Sequence
  chemically synthesized
gttgtttcacaagctatccaat

SEQ ID NO: 741519 - DNA, 22 bp, Artificial Sequence
  chemically synthesized
ttgtttcacaagctatccaatt

SEQ ID NO: 741520 - DNA, 22 bp, Artificial Sequence
  chemically synthesized
tttcacaagctatccaatttat

SEQ ID NO: 741521 - DNA, 22 bp, Artificial Sequence
  chemically synthesized
taatagaaatgccataaattgg

SEQ ID NO: 741522 - DNA, 22 bp, Artificial Sequence
  chemically synthesized
cacaagctatccaatttatggc

SEQ ID NO: 741523 - DNA, 22 bp, Artificial Sequence
  chemically synthesized
acaagctatccaatttatggca

SEQ ID NO: 741524 - DNA, 22 bp, Artificial Sequence
  chemically synthesized
ctataatagaaatgccataaat

SEQ ID NO: 741525 - DNA, 22 bp, Artificial Sequence
  chemically synthesized
cagctgctataatagaaatgcc

SEQ ID NO: 741526 - DNA, 22 bp, Artificial Sequence
  chemically synthesized
tccaatttatggcatttctatt

SEQ ID NO: 741527 - DNA, 22 bp, Artificial Sequence
  chemically synthesized
ttccagctgctataatagaaat

SEQ ID NO: 741528 - DNA, 22 bp, Artificial Sequence
  chemically synthesized
gtctgttccagctgctataata

SEQ ID NO: 741529 - DNA, 22 bp, Artificial Sequence
  chemically synthesized
agtctgttccagctgctataat

SEQ ID NO: 741530 - DNA, 22 bp, Artificial Sequence
  chemically synthesized
atggcatttctattatagcagc

SEQ ID NO: 741531 - DNA, 22 bp, Artificial Sequence
  chemically synthesized
tggcatttctattatagcagct

SEQ ID NO: 741532 - DNA, 22 bp, Artificial Sequence
  chemically synthesized
tcttagtctgttccagctgcta

SEQ ID NO: 741533 - DNA, 22 bp, Artificial Sequence
  chemically synthesized
ctattatagcagctggaacaga

SEQ ID NO: 741534 - DNA, 22 bp, Artificial Sequence
  chemically synthesized
tattatagcagctggaacagac

SEQ ID NO: 741535 - DNA, 22 bp, Artificial Sequence
  chemically synthesized
ttatagcagctggaacagacta

SEQ ID NO: 741536 - DNA, 22 bp, Artificial Sequence
  chemically synthesized
tagcagctggaacagactaaga

SEQ ID NO: 741537 - DNA, 22 bp, Artificial Sequence
  chemically synthesized
ccacaagagactgtcttagtct

SEQ ID NO: 741538 - DNA, 22 bp, Artificial Sequence
  chemically synthesized
gaacagactaagacagtctctt

SEQ ID NO: 741539 - DNA, 22 bp, Artificial Sequence
  chemically synthesized
taatactaccacaagagactgt

SEQ ID NO: 741540 - DNA, 22 bp, Artificial Sequence
  chemically synthesized
ttataatactaccacaagagac

SEQ ID NO: 741541 - DNA, 22 bp, Artificial Sequence
  chemically synthesized
agacagtctcttgtggtagtat

SEQ ID NO: 741542 - DNA, 22 bp, Artificial Sequence
  chemically synthesized
acaaatatccattgttataata

SEQ ID NO: 741543 - DNA, 22 bp, Artificial Sequence
  chemically synthesized
ttgtggtagtattataacaatg

SEQ ID NO: 741544 - DNA, 22 bp, Artificial Sequence
  chemically synthesized
gtggtagtattataacaatgga

SEQ ID NO: 741545 - DNA, 22 bp, Artificial Sequence
  chemically synthesized
tggtagtattataacaatggat

SEQ ID NO: 741546 - DNA, 22 bp, Artificial Sequence
  chemically synthesized
ccccattaacaaatatccattg

SEQ ID NO: 741547 - DNA, 22 bp, Artificial Sequence
  chemically synthesized
ttcccccattaacaaatatcca

SEQ ID NO: 741548 - DNA, 22 bp, Artificial Sequence
  chemically synthesized
taacaatggatatttgttaatg

SEQ ID NO: 741549 - DNA, 22 bp, Artificial Sequence
  chemically synthesized
tcattattcccccattaacaaa

SEQ ID NO: 741550 - DNA, 22 bp, Artificial Sequence
  chemically synthesized
gttaatgggggaataatgataa

SEQ ID NO: 741551 - DNA, 22 bp, Artificial Sequence
  chemically synthesized
aacaaatagtagttatcattat

SEQ ID NO: 741552 - DNA, 22 bp, Artificial Sequence
  chemically synthesized
ttaatgggggaataatgataac

SEQ ID NO: 741553 - DNA, 22 bp, Artificial Sequence
  chemically synthesized
atgggggaataatgataactac

SEQ ID NO: 741554 - DNA, 22 bp, Artificial Sequence
  chemically synthesized
ggaagtgctcaacaaatagtag

SEQ ID NO: 741555 - DNA, 22 bp, Artificial Sequence
  chemically synthesized
ggcacctaggaagtgctcaaca

SEQ ID NO: 741556 - DNA, 22 bp, Artificial Sequence
  chemically synthesized
ctatttgttgagcacttcctag

SEQ ID NO: 741557 - DNA, 22 bp, Artificial Sequence
  chemically synthesized
tttgttgagcacttcctaggtg

SEQ ID NO: 741558 - DNA, 22 bp, Artificial Sequence
  chemically synthesized
atcatggcattaggcacctagg

SEQ ID NO: 741559 - DNA, 22 bp, Artificial Sequence
  chemically synthesized
gttgagcacttcctaggtgcct

SEQ ID NO: 741560 - DNA, 22 bp, Artificial Sequence
  chemically synthesized
ttgagcacttcctaggtgccta

SEQ ID NO: 741561 - DNA, 22 bp, Artificial Sequence
  chemically synthesized
agcacttcctaggtgcctaatg

SEQ ID NO: 741562 - DNA, 22 bp, Artificial Sequence
  chemically synthesized
cctaggtgcctaatgccatgat

SEQ ID NO: 741563 - DNA, 22 bp, Artificial Sequence
  chemically synthesized
ctaggtgcctaatgccatgatg

SEQ ID NO: 741564 - DNA, 22 bp, Artificial Sequence
  chemically synthesized
ggtgcctaatgccatgatgagc

SEQ ID NO: 741565 - DNA, 22 bp, Artificial Sequence
  chemically synthesized
tgtatgaatagagctcatcatg

SEQ ID NO: 741566 - DNA, 22 bp, Artificial Sequence
  chemically synthesized
atgtatgaatagagctcatcat

SEQ ID NO: 741567 - DNA, 22 bp, Artificial Sequence
  chemically synthesized
atgccatgatgagctctattca

SEQ ID NO: 741568 - DNA, 22 bp, Artificial Sequence
  chemically synthesized
ggtagaaataaaatcagtttat

SEQ ID NO: 741569 - DNA, 22 bp, Artificial Sequence
  chemically synthesized
tattcatacataaactgatttt

SEQ ID NO: 741570 - DNA, 22 bp, Artificial Sequence
  chemically synthesized
ttgggtagaaataaaatcagtt

SEQ ID NO: 741571 - DNA, 22 bp, Artificial Sequence
  chemically synthesized
ttcatacataaactgattttat

SEQ ID NO: 741572 - DNA, 22 bp, Artificial Sequence
  chemically synthesized
atacataaactgattttatttc

SEQ ID NO: 741573 - DNA, 22 bp, Artificial Sequence
  chemically synthesized
ataggattgttgggtagaaata

SEQ ID NO: 741574 - DNA, 22 bp, Artificial Sequence
  chemically synthesized
gcctcataggattgttgggtag

SEQ ID NO: 741575 - DNA, 22 bp, Artificial Sequence
  chemically synthesized
attttatttctacccaacaatc

SEQ ID NO: 741576 - DNA, 22 bp, Artificial Sequence
  chemically synthesized
ctggcctcataggattgttggg

SEQ ID NO: 741577 - DNA, 22 bp, Artificial Sequence
  chemically synthesized
tatttctacccaacaatcctat

SEQ ID NO: 741578 - DNA, 22 bp, Artificial Sequence
  chemically synthesized
atttctacccaacaatcctatg

SEQ ID NO: 741579 - DNA, 22 bp, Artificial Sequence
  chemically synthesized
tttctacccaacaatcctatga

SEQ ID NO: 741580 - DNA, 22 bp, Artificial Sequence
  chemically synthesized
caactactggcctcataggatt

SEQ ID NO: 741581 - DNA, 22 bp, Artificial Sequence
  chemically synthesized
tccaactactggcctcatagga

SEQ ID NO: 741582 - DNA, 22 bp, Artificial Sequence
  chemically synthesized
ctacccaacaatcctatgaggc

SEQ ID NO: 741583 - DNA, 22 bp, Artificial Sequence
  chemically synthesized
tacccaacaatcctatgaggcc

SEQ ID NO: 741584 - DNA, 22 bp, Artificial Sequence
  chemically synthesized
cccaacaatcctatgaggccag

SEQ ID NO: 741585 - DNA, 22 bp, Artificial Sequence
  chemically synthesized
gaattctccaactactggcctc

SEQ ID NO: 741586 - DNA, 22 bp, Artificial Sequence
  chemically synthesized
tgaggccagtagttggagaatt

SEQ ID NO: 741587 - DNA, 22 bp, Artificial Sequence
  chemically synthesized
atgtataaaattagaattctcc

SEQ ID NO: 741588 - DNA, 22 bp, Artificial Sequence
  chemically synthesized
tcatgtataaaattagaattct

SEQ ID NO: 741589 - DNA, 22 bp, Artificial Sequence
  chemically synthesized
ctcatgtataaaattagaattc

SEQ ID NO: 741590 - DNA, 22 bp, Artificial Sequence
  chemically synthesized
tctcatgtataaaattagaatt

SEQ ID NO: 741591 - DNA, 22 bp, Artificial Sequence
  chemically synthesized
ttttctcatgtataaaattaga

SEQ ID NO: 741592 - DNA, 22 bp, Artificial Sequence
  chemically synthesized
gttttctcatgtataaaattag

SEQ ID NO: 741593 - DNA, 22 bp, Artificial Sequence
  chemically synthesized
gagaattctaattttatacatg

SEQ ID NO: 741594 - DNA, 22 bp, Artificial Sequence
  chemically synthesized
caagtttgttttctcatgtata

SEQ ID NO: 741595 - DNA, 22 bp, Artificial Sequence
  chemically synthesized
tgcaagtttgttttctcatgta

SEQ ID NO: 741596 - DNA, 22 bp, Artificial Sequence
  chemically synthesized
taattttatacatgagaaaaca

SEQ ID NO: 741597 - DNA, 22 bp, Artificial Sequence
  chemically synthesized
attttatacatgagaaaacaaa

SEQ ID NO: 741598 - DNA, 22 bp, Artificial Sequence
  chemically synthesized
tatacatgagaaaacaaacttg

SEQ ID NO: 741599 - DNA, 22 bp, Artificial Sequence
  chemically synthesized
atacatgagaaaacaaacttgc

SEQ ID NO: 741600 - DNA, 22 bp, Artificial Sequence
  chemically synthesized
tacatgagaaaacaaacttgca

SEQ ID NO: 741601 - DNA, 22 bp, Artificial Sequence
  chemically synthesized
aaaacaaacctctgcaagtttg

SEQ ID NO: 741602 - DNA, 22 bp, Artificial Sequence
  chemically synthesized
gaaaacaaacctctgcaagttt

SEQ ID NO: 741603 - DNA, 22 bp, Artificial Sequence
  chemically synthesized
tgaaaacaaacctctgcaagtt

SEQ ID NO: 741604 - DNA, 22 bp, Artificial Sequence
  chemically synthesized
ttttgaaaacaaacctctgcaa

SEQ ID NO: 741605 - DNA, 22 bp, Artificial Sequence
  chemically synthesized
gttttgaaaacaaacctctgca

SEQ ID NO: 741606 - DNA, 22 bp, Artificial Sequence
  chemically synthesized
tttgttttgaaaacaaacctct

SEQ ID NO: 741607 - DNA, 22 bp, Artificial Sequence
  chemically synthesized
gtttgttttgaaaacaaacctc

SEQ ID NO: 741608 - DNA, 22 bp, Artificial Sequence
  chemically synthesized
gcagaggtttgttttcaaaaca

SEQ ID NO: 741609 - DNA, 22 bp, Artificial Sequence
  chemically synthesized
gcaaggtttgtttgttttgaaa

SEQ ID NO: 741610 - DNA, 22 bp, Artificial Sequence
  chemically synthesized
cagaggtttgttttcaaaacaa

SEQ ID NO: 741611 - DNA, 22 bp, Artificial Sequence
  chemically synthesized
ggcaaggtttgtttgttttgaa

SEQ ID NO: 741612 - DNA, 22 bp, Artificial Sequence
  chemically synthesized
gttttcaaaacaaacaaacctt

SEQ ID NO: 741613 - DNA, 22 bp, Artificial Sequence
  chemically synthesized
ttttcaaaacaaacaaaccttg

SEQ ID NO: 741614 - DNA, 22 bp, Artificial Sequence
  chemically synthesized
tcaaaacaaacaaaccttgcca

SEQ ID NO: 741615 - DNA, 22 bp, Artificial Sequence
  chemically synthesized
cccatgagagcttggcaaggtt

SEQ ID NO: 741616 - DNA, 22 bp, Artificial Sequence
  chemically synthesized
caaaacaaacaaaccttgccaa

SEQ ID NO: 741617 - DNA, 22 bp, Artificial Sequence
  chemically synthesized
acccatgagagcttggcaaggt

SEQ ID NO: 741618 - DNA, 22 bp, Artificial Sequence
  chemically synthesized
aaaacaaacaaaccttgccaag

SEQ ID NO: 741619 - DNA, 22 bp, Artificial Sequence
  chemically synthesized
tacccatgagagcttggcaagg

SEQ ID NO: 741620 - DNA, 22 bp, Artificial Sequence
  chemically synthesized
ttacccatgagagcttggcaag

SEQ ID NO: 741621 - DNA, 22 bp, Artificial Sequence
  chemically synthesized
aatttttacccatgagagcttg

SEQ ID NO: 741622 - DNA, 22 bp, Artificial Sequence
  chemically synthesized
ctcaatttttacccatgagagc

SEQ ID NO: 741623 - DNA, 22 bp, Artificial Sequence
  chemically synthesized
gccaagctctcatgggtaaaaa

SEQ ID NO: 741624 - DNA, 22 bp, Artificial Sequence
  chemically synthesized
ccaagctctcatgggtaaaaat

SEQ ID NO: 741625 - DNA, 22 bp, Artificial Sequence
  chemically synthesized
tcatgggtaaaaattgaggaac

SEQ ID NO: 741626 - DNA, 22 bp, Artificial Sequence
  chemically synthesized
atgggtaaaaattgaggaacct

SEQ ID NO: 741627 - DNA, 22 bp, Artificial Sequence
  chemically synthesized
catataggtatcccaggttcct

SEQ ID NO: 741628 - DNA, 22 bp, Artificial Sequence
  chemically synthesized
aggaacctgggatacctatatg

SEQ ID NO: 741629 - DNA, 22 bp, Artificial Sequence
  chemically synthesized
gaggcaggcaaacctgcatata

SEQ ID NO: 741630 - DNA, 22 bp, Artificial Sequence
  chemically synthesized
tagaggcaggcaaacctgcata

SEQ ID NO: 741631 - DNA, 22 bp, Artificial Sequence
  chemically synthesized
ggatacctatatgcaggtttgc

SEQ ID NO: 741632 - DNA, 22 bp, Artificial Sequence
  chemically synthesized
tatgcaggtttgcctgcctcta

SEQ ID NO: 741633 - DNA, 22 bp, Artificial Sequence
  chemically synthesized
agaatatatattctagaggcag

SEQ ID NO: 741634 - DNA, 22 bp, Artificial Sequence
  chemically synthesized
gcctgcctctagaatatatatt

SEQ ID NO: 741635 - DNA, 22 bp, Artificial Sequence
  chemically synthesized
cctgcctctagaatatatattc

SEQ ID NO: 741636 - DNA, 22 bp, Artificial Sequence
  chemically synthesized
cctctagaatatatattcttaa

SEQ ID NO: 741637 - DNA, 22 bp, Artificial Sequence
  chemically synthesized
tagaatatatattcttaactat

SEQ ID NO: 741638 - DNA, 22 bp, Artificial Sequence
  chemically synthesized
gaatatatattcttaactatta

SEQ ID NO: 741639 - DNA, 22 bp, Artificial Sequence
  chemically synthesized
ggggaagcatataacataatag

SEQ ID NO: 741640 - DNA, 22 bp, Artificial Sequence
  chemically synthesized
aggggaagcatataacataata

SEQ ID NO: 741641 - DNA, 22 bp, Artificial Sequence
  chemically synthesized
ttaggggaagcatataacataa

SEQ ID NO: 741642 - DNA, 22 bp, Artificial Sequence
  chemically synthesized
cttaggggaagcatataacata

SEQ ID NO: 741643 - DNA, 22 bp, Artificial Sequence
  chemically synthesized
ttaactattatgttatatgctt

SEQ ID NO: 741644 - DNA, 22 bp, Artificial Sequence
  chemically synthesized
aactattatgttatatgcttcc

SEQ ID NO: 741645 - DNA, 22 bp, Artificial Sequence
  chemically synthesized
actattatgttatatgcttccc

SEQ ID NO: 741646 - DNA, 22 bp, Artificial Sequence
  chemically synthesized
ttatgttatatgcttcccctaa

SEQ ID NO: 741647 - DNA, 22 bp, Artificial Sequence
  chemically synthesized
tgttatatgcttcccctaagaa

SEQ ID NO: 741648 - DNA, 22 bp, Artificial Sequence
  chemically synthesized
ccaatccagaatttcttagggg

SEQ ID NO: 741649 - DNA, 22 bp, Artificial Sequence
  chemically synthesized
gccaatccagaatttcttaggg

SEQ ID NO: 741650 - DNA, 22 bp, Artificial Sequence
  chemically synthesized
tgccaatccagaatttcttagg

SEQ ID NO: 741651 - DNA, 22 bp, Artificial Sequence
  chemically synthesized
tatgcttcccctaagaaattct

SEQ ID NO: 741652 - DNA, 22 bp, Artificial Sequence
  chemically synthesized
ctttgccaatccagaatttctt

SEQ ID NO: 741653 - DNA, 22 bp, Artificial Sequence
  chemically synthesized
ttactttgccaatccagaattt

SEQ ID NO: 741654 - DNA, 22 bp, Artificial Sequence
  chemically synthesized
gttactttgccaatccagaatt

SEQ ID NO: 741655 - DNA, 22 bp, Artificial Sequence
  chemically synthesized
ttgttactttgccaatccagaa

SEQ ID NO: 741656 - DNA, 22 bp, Artificial Sequence
  chemically synthesized
cccctaagaaattctggattgg

SEQ ID NO: 741657 - DNA, 22 bp, Artificial Sequence
  chemically synthesized
cttgttactttgccaatccaga

SEQ ID NO: 741658 - DNA, 22 bp, Artificial Sequence
  chemically synthesized
ccctaagaaattctggattggc

SEQ ID NO: 741659 - DNA, 22 bp, Artificial Sequence
  chemically synthesized
tcttgttactttgccaatccag

SEQ ID NO: 741660 - DNA, 22 bp, Artificial Sequence
  chemically synthesized
ttcttgttactttgccaatcca

SEQ ID NO: 741661 - DNA, 22 bp, Artificial Sequence
  chemically synthesized
agaaattctggattggcaaagt

SEQ ID NO: 741662 - DNA, 22 bp, Artificial Sequence
  chemically synthesized
tggattggcaaagtaacaagaa

SEQ ID NO: 741663 - DNA, 22 bp, Artificial Sequence
  chemically synthesized
gattggcaaagtaacaagaaaa

SEQ ID NO: 741664 - DNA, 22 bp, Artificial Sequence
  chemically synthesized
gcaaagtaacaagaaaaatata

SEQ ID NO: 741665 - DNA, 22 bp, Artificial Sequence
  chemically synthesized
gaatccagcagcaatatatttt

SEQ ID NO: 741666 - DNA, 22 bp, Artificial Sequence
  chemically synthesized
agaatccagcagcaatatattt

SEQ ID NO: 741667 - DNA, 22 bp, Artificial Sequence
  chemically synthesized
tgacatgagtagaatttagaat

SEQ ID NO: 741668 - DNA, 22 bp, Artificial Sequence
  chemically synthesized
gttgtgacatgagtagaattta

SEQ ID NO: 741669 - DNA, 22 bp, Artificial Sequence
  chemically synthesized
ctgctggattctaaattctact

SEQ ID NO: 741670 - DNA, 22 bp, Artificial Sequence
  chemically synthesized
tggttgtgacatgagtagaatt

SEQ ID NO: 741671 - DNA, 22 bp, Artificial Sequence
  chemically synthesized
ctggttgtgacatgagtagaat

SEQ ID NO: 741672 - DNA, 22 bp, Artificial Sequence
  chemically synthesized
ctggattctaaattctactcat

SEQ ID NO: 741673 - DNA, 22 bp, Artificial Sequence
  chemically synthesized
gattctaaattctactcatgtc

SEQ ID NO: 741674 - DNA, 22 bp, Artificial Sequence
  chemically synthesized
taaattctactcatgtcacaac

SEQ ID NO: 741675 - DNA, 22 bp, Artificial Sequence
  chemically synthesized
aattctactcatgtcacaacca

SEQ ID NO: 741676 - DNA, 22 bp, Artificial Sequence
  chemically synthesized
tactcatgtcacaaccagaaat

SEQ ID NO: 741677 - DNA, 22 bp, Artificial Sequence
  chemically synthesized
ctcatgtcacaaccagaaatgg

SEQ ID NO: 741678 - DNA, 22 bp, Artificial Sequence
  chemically synthesized
taaaaaataaggatccatttct

SEQ ID NO: 741679 - DNA, 22 bp, Artificial Sequence
  chemically synthesized
atgtcacaaccagaaatggatc

SEQ ID NO: 741680 - DNA, 22 bp, Artificial Sequence
  chemically synthesized
ttgtaaaaaataaggatccatt

SEQ ID NO: 741681 - DNA, 22 bp, Artificial Sequence
  chemically synthesized
tattgtaaaaaataaggatcca

SEQ ID NO: 741682 - DNA, 22 bp, Artificial Sequence
  chemically synthesized
ctattgtaaaaaataaggatcc

SEQ ID NO: 741683 - DNA, 22 bp, Artificial Sequence
  chemically synthesized
tctattgtaaaaaataaggatc

SEQ ID NO: 741684 - DNA, 22 bp, Artificial Sequence
  chemically synthesized
aatatatctttctattgtaaaa

SEQ ID NO: 741685 - DNA, 22 bp, Artificial Sequence
  chemically synthesized
tgactgaatatatctttctatt

SEQ ID NO: 741686 - DNA, 22 bp, Artificial Sequence
  chemically synthesized
atgactgaatatatctttctat

SEQ ID NO: 741687 - DNA, 22 bp, Artificial Sequence
  chemically synthesized
tatgactgaatatatctttcta

SEQ ID NO: 741688 - DNA, 22 bp, Artificial Sequence
  chemically synthesized
attttttacaatagaaagatat

SEQ ID NO: 741689 - DNA, 22 bp, Artificial Sequence
  chemically synthesized
ttttttacaatagaaagatata

SEQ ID NO: 741690 - DNA, 22 bp, Artificial Sequence
  chemically synthesized
tttacaatagaaagatatattc

SEQ ID NO: 741691 - DNA, 22 bp, Artificial Sequence
  chemically synthesized
ttacaatagaaagatatattca

SEQ ID NO: 741692 - DNA, 22 bp, Artificial Sequence
  chemically synthesized
tacaatagaaagatatattcag

SEQ ID NO: 741693 - DNA, 22 bp, Artificial Sequence
  chemically synthesized
acaatagaaagatatattcagt

SEQ ID NO: 741694 - DNA, 22 bp, Artificial Sequence
  chemically synthesized
caatagaaagatatattcagtc

SEQ ID NO: 741695 - DNA, 22 bp, Artificial Sequence
  chemically synthesized
gtgcaaagtatgcatgcaatat

SEQ ID NO: 741696 - DNA, 22 bp, Artificial Sequence
  chemically synthesized
agtcataaaatattgcatgcat

SEQ ID NO: 741697 - DNA, 22 bp, Artificial Sequence
  chemically synthesized
tgatgtggttggtgcaaagtat

SEQ ID NO: 741698 - DNA, 22 bp, Artificial Sequence
  chemically synthesized
ttatgatgtggttggtgcaaag

SEQ ID NO: 741699 - DNA, 22 bp, Artificial Sequence
  chemically synthesized
catgcatactttgcaccaacca

SEQ ID NO: 741700 - DNA, 22 bp, Artificial Sequence
  chemically synthesized
aatgaaactgttatgatgtggt

SEQ ID NO: 741701 - DNA, 22 bp, Artificial Sequence
  chemically synthesized
cctaaatgaaactgttatgatg

SEQ ID NO: 741702 - DNA, 22 bp, Artificial Sequence
  chemically synthesized
tgcaccaaccacatcataacag

SEQ ID NO: 741703 - DNA, 22 bp, Artificial Sequence
  chemically synthesized
gcaccaaccacatcataacagt

SEQ ID NO: 741704 - DNA, 22 bp, Artificial Sequence
  chemically synthesized
caccaaccacatcataacagtt

SEQ ID NO: 741705 - DNA, 22 bp, Artificial Sequence
  chemically synthesized
ctccctaaatgaaactgttatg

SEQ ID NO: 741706 - DNA, 22 bp, Artificial Sequence
  chemically synthesized
acaaaataccctactccctaaa

SEQ ID NO: 741707 - DNA, 22 bp, Artificial Sequence
  chemically synthesized
gacaaaataccctactccctaa

SEQ ID NO: 741708 - DNA, 22 bp, Artificial Sequence
  chemically synthesized
aggacttgacaaaataccctac

SEQ ID NO: 741709 - DNA, 22 bp, Artificial Sequence
  chemically synthesized
catttagggagtagggtatttt

SEQ ID NO: 741710 - DNA, 22 bp, Artificial Sequence
  chemically synthesized
tgaggacttgacaaaataccct

SEQ ID NO: 741711 - DNA, 22 bp, Artificial Sequence
  chemically synthesized
atttagggagtagggtattttg

SEQ ID NO: 741712 - DNA, 22 bp, Artificial Sequence
  chemically synthesized
agggagtagggtattttgtcaa

SEQ ID NO: 741713 - DNA, 22 bp, Artificial Sequence
  chemically synthesized
gggagtagggtattttgtcaag

SEQ ID NO: 741714 - DNA, 22 bp, Artificial Sequence
  chemically synthesized
tgtcaagtcctcagaatgactt

SEQ ID NO: 741715 - DNA, 22 bp, Artificial Sequence
  chemically synthesized
gtcaagtcctcagaatgacttc

SEQ ID NO: 741716 - DNA, 22 bp, Artificial Sequence
  chemically synthesized
tcaagtcctcagaatgacttcc

SEQ ID NO: 741717 - DNA, 22 bp, Artificial Sequence
  chemically synthesized
aaataccaggagatcaggaagt

SEQ ID NO: 741718 - DNA, 22 bp, Artificial Sequence
  chemically synthesized
agaatgacttcctgatctcctg

SEQ ID NO: 741719 - DNA, 22 bp, Artificial Sequence
  chemically synthesized
caagggctaaaataccaggaga

SEQ ID NO: 741720 - DNA, 22 bp, Artificial Sequence
  chemically synthesized
ctacaagggctaaaataccagg

SEQ ID NO: 741721 - DNA, 22 bp, Artificial Sequence
  chemically synthesized
cctgatctcctggtattttagc

SEQ ID NO: 741722 - DNA, 22 bp, Artificial Sequence
  chemically synthesized
ctgatctcctggtattttagcc

SEQ ID NO: 741723 - DNA, 22 bp, Artificial Sequence
  chemically synthesized
atctcctggtattttagccctt

SEQ ID NO: 741724 - DNA, 22 bp, Artificial Sequence
  chemically synthesized
aagtcattgctacaagggctaa

SEQ ID NO: 741725 - DNA, 22 bp, Artificial Sequence
  chemically synthesized
tgaagtcattgctacaagggct

SEQ ID NO: 741726 - DNA, 22 bp, Artificial Sequence
  chemically synthesized
ctgaagtcattgctacaagggc

SEQ ID NO: 741727 - DNA, 22 bp, Artificial Sequence
  chemically synthesized
ctggtattttagcccttgtagc

SEQ ID NO: 741728 - DNA, 22 bp, Artificial Sequence
  chemically synthesized
gtattttagcccttgtagcaat

SEQ ID NO: 741729 - DNA, 22 bp, Artificial Sequence
  chemically synthesized
tagcccttgtagcaatgacttc

SEQ ID NO: 741730 - DNA, 22 bp, Artificial Sequence
  chemically synthesized
agcccttgtagcaatgacttca

SEQ ID NO: 741731 - DNA, 22 bp, Artificial Sequence
  chemically synthesized
gcccttgtagcaatgacttcag

SEQ ID NO: 741732 - DNA, 22 bp, Artificial Sequence
  chemically synthesized
gtagcaatgacttcagaaggct

SEQ ID NO: 741733 - DNA, 22 bp, Artificial Sequence
  chemically synthesized
tagcaatgacttcagaaggctc

SEQ ID NO: 741734 - DNA, 22 bp, Artificial Sequence
  chemically synthesized
agaagccccacgggagccttct

SEQ ID NO: 741735 - DNA, 22 bp, Artificial Sequence
  chemically synthesized
cagaaggctcccgtggggcttc

SEQ ID NO: 741736 - DNA, 22 bp, Artificial Sequence
  chemically synthesized
aaagacagctgagaagccccac

SEQ ID NO: 741737 - DNA, 22 bp, Artificial Sequence
  chemically synthesized
agaaggctcccgtggggcttct

SEQ ID NO: 741738 - DNA, 22 bp, Artificial Sequence
  chemically synthesized
caaagacagctgagaagcccca

SEQ ID NO: 741739 - DNA, 22 bp, Artificial Sequence
  chemically synthesized
gtgcttcaaagacagctgagaa

SEQ ID NO: 741740 - DNA, 22 bp, Artificial Sequence
  chemically synthesized
tagtgcttcaaagacagctgag

SEQ ID NO: 741741 - DNA, 22 bp, Artificial Sequence
  chemically synthesized
ccgtggggcttctcagctgtct

SEQ ID NO: 741742 - DNA, 22 bp, Artificial Sequence
  chemically synthesized
ctctagtgcttcaaagacagct

SEQ ID NO: 741743 - DNA, 22 bp, Artificial Sequence
  chemically synthesized
ctgctctagtgcttcaaagaca

SEQ ID NO: 741744 - DNA, 22 bp, Artificial Sequence
  chemically synthesized
ctcagctgtctttgaagcacta

SEQ ID NO: 741745 - DNA, 22 bp, Artificial Sequence
  chemically synthesized
tcagctgtctttgaagcactag

SEQ ID NO: 741746 - DNA, 22 bp, Artificial Sequence
  chemically synthesized
agctgtctttgaagcactagag

SEQ ID NO: 741747 - DNA, 22 bp, Artificial Sequence
  chemically synthesized
catcagagactcctgctctagt

SEQ ID NO: 741748 - DNA, 22 bp, Artificial Sequence
  chemically synthesized
tctttgaagcactagagcagga

SEQ ID NO: 741749 - DNA, 22 bp, Artificial Sequence
  chemically synthesized
tgaagcactagagcaggagtct

SEQ ID NO: 741750 - DNA, 22 bp, Artificial Sequence
  chemically synthesized
gaagcactagagcaggagtctc

SEQ ID NO: 741751 - DNA, 22 bp, Artificial Sequence
  chemically synthesized
aagcactagagcaggagtctct

SEQ ID NO: 741752 - DNA, 22 bp, Artificial Sequence
  chemically synthesized
tgatgtattgcatcagagactc

SEQ ID NO: 741753 - DNA, 22 bp, Artificial Sequence
  chemically synthesized
ctatgatgtattgcatcagaga

SEQ ID NO: 741754 - DNA, 22 bp, Artificial Sequence
  chemically synthesized
gagcaggagtctctgatgcaat

SEQ ID NO: 741755 - DNA, 22 bp, Artificial Sequence
  chemically synthesized
aacggattgctatgatgtattg

SEQ ID NO: 741756 - DNA, 22 bp, Artificial Sequence
  chemically synthesized
ctcaacggattgctatgatgta

SEQ ID NO: 741757 - DNA, 22 bp, Artificial Sequence
  chemically synthesized
tgctcaacggattgctatgatg

SEQ ID NO: 741758 - DNA, 22 bp, Artificial Sequence
  chemically synthesized
ctgctcaacggattgctatgat

SEQ ID NO: 741759 - DNA, 22 bp, Artificial Sequence
  chemically synthesized
tgatgcaatacatcatagcaat

SEQ ID NO: 741760 - DNA, 22 bp, Artificial Sequence
  chemically synthesized
ttctgctcaacggattgctatg

SEQ ID NO: 741761 - DNA, 22 bp, Artificial Sequence
  chemically synthesized
atgcaatacatcatagcaatcc

SEQ ID NO: 741762 - DNA, 22 bp, Artificial Sequence
  chemically synthesized
catagggttcttctgctcaacg

SEQ ID NO: 741763 - DNA, 22 bp, Artificial Sequence
  chemically synthesized
cccatatctgcatagggttctt

SEQ ID NO: 741764 - DNA, 22 bp, Artificial Sequence
  chemically synthesized
agcagaagaaccctatgcagat

SEQ ID NO: 741765 - DNA, 22 bp, Artificial Sequence
  chemically synthesized
tgcagatatggggaggatatta

SEQ ID NO: 741766 - DNA, 22 bp, Artificial Sequence
  chemically synthesized
gatagggtagatatgaggcgtg

SEQ ID NO: 741767 - DNA, 22 bp, Artificial Sequence
  chemically synthesized
ccacgcctcatatctaccctat

SEQ ID NO: 741768 - DNA, 22 bp, Artificial Sequence
  chemically synthesized
atatctaccctatcgagatggc

SEQ ID NO: 741769 - DNA, 22 bp, Artificial Sequence
  chemically synthesized
aagatccataaatgccatctcg

SEQ ID NO: 741770 - DNA, 22 bp, Artificial Sequence
  chemically synthesized
ccctatcgagatggcatttatg

SEQ ID NO: 741771 - DNA, 22 bp, Artificial Sequence
  chemically synthesized
tcgagatggcatttatggatct

SEQ ID NO: 741772 - DNA, 22 bp, Artificial Sequence
  chemically synthesized
gacatcatgcatcatgttaaag

SEQ ID NO: 741773 - DNA, 22 bp, Artificial Sequence
  chemically synthesized
ggacatcatgcatcatgttaaa

SEQ ID NO: 741774 - DNA, 22 bp, Artificial Sequence
  chemically synthesized
atggatctttaacatgatgcat

SEQ ID NO: 741775 - DNA, 22 bp, Artificial Sequence
  chemically synthesized
tggatctttaacatgatgcatg

SEQ ID NO: 741776 - DNA, 22 bp, Artificial Sequence
  chemically synthesized
gaacatttggacatcatgcatc

SEQ ID NO: 741777 - DNA, 22 bp, Artificial Sequence
  chemically synthesized
ttggaacatttggacatcatgc

SEQ ID NO: 741778 - DNA, 22 bp, Artificial Sequence
  chemically synthesized
attggaacatttggacatcatg

SEQ ID NO: 741779 - DNA, 22 bp, Artificial Sequence
  chemically synthesized
taacatgatgcatgatgtccaa

SEQ ID NO: 741780 - DNA, 22 bp, Artificial Sequence
  chemically synthesized
aacatgatgcatgatgtccaaa

SEQ ID NO: 741781 - DNA, 22 bp, Artificial Sequence
  chemically synthesized
cttattggaacatttggacatc

SEQ ID NO: 741782 - DNA, 22 bp, Artificial Sequence
  chemically synthesized
acatgatgcatgatgtccaaat

SEQ ID NO: 741783 - DNA, 22 bp, Artificial Sequence
  chemically synthesized
gaaattgcttattggaacattt

SEQ ID NO: 741784 - DNA, 22 bp, Artificial Sequence
  chemically synthesized
agaaattgcttattggaacatt

SEQ ID NO: 741785 - DNA, 22 bp, Artificial Sequence
  chemically synthesized
tcccttagaaattgcttattgg

SEQ ID NO: 741786 - DNA, 22 bp, Artificial Sequence
  chemically synthesized
gtcccttagaaattgcttattg

SEQ ID NO: 741787 - DNA, 22 bp, Artificial Sequence
  chemically synthesized
caataagcaatttctaagggac

SEQ ID NO: 741788 - DNA, 22 bp, Artificial Sequence
  chemically synthesized
agtgagggaatttgtcccttag

SEQ ID NO: 741789 - DNA, 22 bp, Artificial Sequence
  chemically synthesized
ctaagtgagggaatttgtccct

SEQ ID NO: 741790 - DNA, 22 bp, Artificial Sequence
  chemically synthesized
tcctaagtgagggaatttgtcc

SEQ ID NO: 741791 - DNA, 22 bp, Artificial Sequence
  chemically synthesized
ttctcctaagtgagggaatttg

SEQ ID NO: 741792 - DNA, 22 bp, Artificial Sequence
  chemically synthesized
ctaagggacaaattccctcact

SEQ ID NO: 741793 - DNA, 22 bp, Artificial Sequence
  chemically synthesized
taagggacaaattccctcactt

SEQ ID NO: 741794 - DNA, 22 bp, Artificial Sequence
  chemically synthesized
agggacaaattccctcacttag

SEQ ID NO: 741795 - DNA, 22 bp, Artificial Sequence
  chemically synthesized
cacaaactgttctcctaagtga

SEQ ID NO: 741796 - DNA, 22 bp, Artificial Sequence
  chemically synthesized
cattacacaaactgttctccta

SEQ ID NO: 741797 - DNA, 22 bp, Artificial Sequence
  chemically synthesized
cctcacttaggagaacagtttg

SEQ ID NO: 741798 - DNA, 22 bp, Artificial Sequence
  chemically synthesized
acttaggagaacagtttgtgta

SEQ ID NO: 741799 - DNA, 22 bp, Artificial Sequence
  chemically synthesized
aggagaacagtttgtgtaatgt

SEQ ID NO: 741800 - DNA, 22 bp, Artificial Sequence
  chemically synthesized
tacacagacattacattacaca

SEQ ID NO: 741801 - DNA, 22 bp, Artificial Sequence
  chemically synthesized
ggagaacagtttgtgtaatgta

SEQ ID NO: 741802 - DNA, 22 bp, Artificial Sequence
  chemically synthesized
gtacacagacattacattacac

SEQ ID NO: 741803 - DNA, 22 bp, Artificial Sequence
  chemically synthesized
tccttgtacacagacattacat

SEQ ID NO: 741804 - DNA, 22 bp, Artificial Sequence
  chemically synthesized
gtgtaatgtaatgtctgtgtac

SEQ ID NO: 741805 - DNA, 22 bp, Artificial Sequence
  chemically synthesized
tgtaatgtaatgtctgtgtaca

SEQ ID NO: 741806 - DNA, 22 bp, Artificial Sequence
  chemically synthesized
tgtacaaggacagcaccacttg

SEQ ID NO: 741807 - DNA, 22 bp, Artificial Sequence
  chemically synthesized
gactatacgtgttgttttgact

SEQ ID NO: 741808 - DNA, 22 bp, Artificial Sequence
  chemically synthesized
actatacgtgttgttttgactt

SEQ ID NO: 741809 - DNA, 22 bp, Artificial Sequence
  chemically synthesized
cccagatcaagcaagtcaaaac

SEQ ID NO: 741810 - DNA, 22 bp, Artificial Sequence
  chemically synthesized
tacgtgttgttttgacttgctt

SEQ ID NO: 741811 - DNA, 22 bp, Artificial Sequence
  chemically synthesized
ttttgacttgcttgatctgggc

SEQ ID NO: 741812 - DNA, 22 bp, Artificial Sequence
  chemically synthesized
tgacttgcttgatctgggcagg

SEQ ID NO: 741813 - DNA, 22 bp, Artificial Sequence
  chemically synthesized
gacttgcttgatctgggcaggt

SEQ ID NO: 741814 - DNA, 22 bp, Artificial Sequence
  chemically synthesized
acttgcttgatctgggcaggtg

SEQ ID NO: 741815 - DNA, 22 bp, Artificial Sequence
  chemically synthesized
gcttgatctgggcaggtgttat

SEQ ID NO: 741816 - DNA, 22 bp, Artificial Sequence
  chemically synthesized
cttgatctgggcaggtgttatt

SEQ ID NO: 741817 - DNA, 22 bp, Artificial Sequence
  chemically synthesized
gatctgggcaggtgttatttct

SEQ ID NO: 741818 - DNA, 22 bp, Artificial Sequence
  chemically synthesized
atctgggcaggtgttatttctc

SEQ ID NO: 741819 - DNA, 22 bp, Artificial Sequence
  chemically synthesized
ggcaggtgttatttctctgtct

SEQ ID NO: 741820 - DNA, 22 bp, Artificial Sequence
  chemically synthesized
tcaacatagtgaaccagacaga

SEQ ID NO: 741821 - DNA, 22 bp, Artificial Sequence
  chemically synthesized
atcaacatagtgaaccagacag

SEQ ID NO: 741822 - DNA, 22 bp, Artificial Sequence
  chemically synthesized
tatcaacatagtgaaccagaca

SEQ ID NO: 741823 - DNA, 22 bp, Artificial Sequence
  chemically synthesized
tttctctgtctggttcactatg

SEQ ID NO: 741824 - DNA, 22 bp, Artificial Sequence
  chemically synthesized
ctctgtctggttcactatgttg

SEQ ID NO: 741825 - DNA, 22 bp, Artificial Sequence
  chemically synthesized
tctgtctggttcactatgttga

SEQ ID NO: 741826 - DNA, 22 bp, Artificial Sequence
  chemically synthesized
tgtctggttcactatgttgata

SEQ ID NO: 741827 - DNA, 22 bp, Artificial Sequence
  chemically synthesized
tctggttcactatgttgataaa

SEQ ID NO: 741828 - DNA, 22 bp, Artificial Sequence
  chemically synthesized
gttcactatgttgataaaacca

SEQ ID NO: 741829 - DNA, 22 bp, Artificial Sequence
  chemically synthesized
actatgttgataaaaccattgg

SEQ ID NO: 741830 - DNA, 22 bp, Artificial Sequence
  chemically synthesized
tgttgataaaaccattggttac

SEQ ID NO: 741831 - DNA, 22 bp, Artificial Sequence
  chemically synthesized
taaatgaggtcagtgtaaccaa

SEQ ID NO: 741832 - DNA, 22 bp, Artificial Sequence
  chemically synthesized
ataaatgaggtcagtgtaacca

SEQ ID NO: 741833 - DNA, 22 bp, Artificial Sequence
  chemically synthesized
ataaaaccattggttacactga

SEQ ID NO: 741834 - DNA, 22 bp, Artificial Sequence
  chemically synthesized
gttacactgacctcatttataa

SEQ ID NO: 741835 - DNA, 22 bp, Artificial Sequence
  chemically synthesized
cactgacctcatttataagcct

SEQ ID NO: 741836 - DNA, 22 bp, Artificial Sequence
  chemically synthesized
acctcatttataagccttgcat

SEQ ID NO: 741837 - DNA, 22 bp, Artificial Sequence
  chemically synthesized
gagtgggaggaaatgcaaggct

SEQ ID NO: 741838 - DNA, 22 bp, Artificial Sequence
  chemically synthesized
ggagtgggaggaaatgcaaggc

SEQ ID NO: 741839 - DNA, 22 bp, Artificial Sequence
  chemically synthesized
tttggagtgggaggaaatgcaa

SEQ ID NO: 741840 - DNA, 22 bp, Artificial Sequence
  chemically synthesized
atttataagccttgcatttcct

SEQ ID NO: 741841 - DNA, 22 bp, Artificial Sequence
  chemically synthesized
atttggagtgggaggaaatgca

SEQ ID NO: 741842 - DNA, 22 bp, Artificial Sequence
  chemically synthesized
tatttggagtgggaggaaatgc

SEQ ID NO: 741843 - DNA, 22 bp, Artificial Sequence
  chemically synthesized
ttatttggagtgggaggaaatg

SEQ ID NO: 741844 - DNA, 22 bp, Artificial Sequence
  chemically synthesized
ataagccttgcatttcctccca

SEQ ID NO: 741845 - DNA, 22 bp, Artificial Sequence
  chemically synthesized
taagccttgcatttcctcccac

SEQ ID NO: 741846 - DNA, 22 bp, Artificial Sequence
  chemically synthesized
cttttatttggagtgggaggaa

SEQ ID NO: 741847 - DNA, 22 bp, Artificial Sequence
  chemically synthesized
gctccttttatttggagtggga

SEQ ID NO: 741848 - DNA, 22 bp, Artificial Sequence
  chemically synthesized
gcatttcctcccactccaaata

SEQ ID NO: 741849 - DNA, 22 bp, Artificial Sequence
  chemically synthesized
catttcctcccactccaaataa

SEQ ID NO: 741850 - DNA, 22 bp, Artificial Sequence
  chemically synthesized
atactggctccttttatttgga

SEQ ID NO: 741851 - DNA, 22 bp, Artificial Sequence
  chemically synthesized
cctcccactccaaataaaagga

SEQ ID NO: 741852 - DNA, 22 bp, Artificial Sequence
  chemically synthesized
ctcccactccaaataaaaggag

SEQ ID NO: 741853 - DNA, 22 bp, Artificial Sequence
  chemically synthesized
aatgttcatactggctcctttt

SEQ ID NO: 741854 - DNA, 22 bp, Artificial Sequence
  chemically synthesized
ccactccaaataaaaggagcca

SEQ ID NO: 741855 - DNA, 22 bp, Artificial Sequence
  chemically synthesized
gaatgttcatactggctccttt

SEQ ID NO: 741856 - DNA, 22 bp, Artificial Sequence
  chemically synthesized
tgaatgttcatactggctcctt

SEQ ID NO: 741857 - DNA, 22 bp, Artificial Sequence
  chemically synthesized
ttttgaatgttcatactggctc

SEQ ID NO: 741858 - DNA, 22 bp, Artificial Sequence
  chemically synthesized
attttgaatgttcatactggct

SEQ ID NO: 741859 - DNA, 22 bp, Artificial Sequence
  chemically synthesized
caaataaaaggagccagtatga

SEQ ID NO: 741860 - DNA, 22 bp, Artificial Sequence
  chemically synthesized
ttattttgaatgttcatactgg

SEQ ID NO: 741861 - DNA, 22 bp, Artificial Sequence
  chemically synthesized
agaggataatgtcgttcttatt

SEQ ID NO: 741862 - DNA, 22 bp, Artificial Sequence
  chemically synthesized
gagaggataatgtcgttcttat

SEQ ID NO: 741863 - DNA, 22 bp, Artificial Sequence
  chemically synthesized
atttgagaggataatgtcgttc

SEQ ID NO: 741864 - DNA, 22 bp, Artificial Sequence
  chemically synthesized
aaaataagaacgacattatcct

SEQ ID NO: 741865 - DNA, 22 bp, Artificial Sequence
  chemically synthesized
aggttgatttgagaggataatg

SEQ ID NO: 741866 - DNA, 22 bp, Artificial Sequence
  chemically synthesized
atgaagtattcaggttgatttg

SEQ ID NO: 741867 - DNA, 22 bp, Artificial Sequence
  chemically synthesized
ctgatgaagtattcaggttgat

SEQ ID NO: 741868 - DNA, 22 bp, Artificial Sequence
  chemically synthesized
actgatgaagtattcaggttga

SEQ ID NO: 741869 - DNA, 22 bp, Artificial Sequence
  chemically synthesized
tcctctcaaatcaacctgaata

SEQ ID NO: 741870 - DNA, 22 bp, Artificial Sequence
  chemically synthesized
tcaaatcaacctgaatacttca

SEQ ID NO: 741871 - DNA, 22 bp, Artificial Sequence
  chemically synthesized
aaatcaacctgaatacttcatc

SEQ ID NO: 741872 - DNA, 22 bp, Artificial Sequence
  chemically synthesized
tacagcaccacggtttactgat

SEQ ID NO: 741873 - DNA, 22 bp, Artificial Sequence
  chemically synthesized
tatacagcaccacggtttactg

SEQ ID NO: 741874 - DNA, 22 bp, Artificial Sequence
  chemically synthesized
aatacttcatcagtaaaccgtg

SEQ ID NO: 741875 - DNA, 22 bp, Artificial Sequence
  chemically synthesized
tgctctatacagcaccacggtt

SEQ ID NO: 741876 - DNA, 22 bp, Artificial Sequence
  chemically synthesized
catcagtaaaccgtggtgctgt

SEQ ID NO: 741877 - DNA, 22 bp, Artificial Sequence
  chemically synthesized
atcagtaaaccgtggtgctgta

SEQ ID NO: 741878 - DNA, 22 bp, Artificial Sequence
  chemically synthesized
cacaacagtgttatgctctata

SEQ ID NO: 741879 - DNA, 22 bp, Artificial Sequence
  chemically synthesized
agaactacacaacagtgttatg

SEQ ID NO: 741880 - DNA, 22 bp, Artificial Sequence
  chemically synthesized
tctaagaactacacaacagtgt

SEQ ID NO: 741881 - DNA, 22 bp, Artificial Sequence
  chemically synthesized
tatagagcataacactgttgtg

SEQ ID NO: 741882 - DNA, 22 bp, Artificial Sequence
  chemically synthesized
tattatctaagaactacacaac

SEQ ID NO: 741883 - DNA, 22 bp, Artificial Sequence
  chemically synthesized
gtattatctaagaactacacaa

SEQ ID NO: 741884 - DNA, 22 bp, Artificial Sequence
  chemically synthesized
tgtattatctaagaactacaca

SEQ ID NO: 741885 - DNA, 22 bp, Artificial Sequence
  chemically synthesized
ttgtgtagttcttagataatac

SEQ ID NO: 741886 - DNA, 22 bp, Artificial Sequence
  chemically synthesized
tcacaatgttttgtattatcta

SEQ ID NO: 741887 - DNA, 22 bp, Artificial Sequence
  chemically synthesized
tgtagttcttagataatacaaa

SEQ ID NO: 741888 - DNA, 22 bp, Artificial Sequence
  chemically synthesized
ttagataatacaaaacattgtg

SEQ ID NO: 741889 - DNA, 22 bp, Artificial Sequence
  chemically synthesized
agataatacaaaacattgtgat

SEQ ID NO: 741890 - DNA, 22 bp, Artificial Sequence
  chemically synthesized
aacagagtgattatcacaatgt

SEQ ID NO: 741891 - DNA, 22 bp, Artificial Sequence
  chemically synthesized
gataatacaaaacattgtgata

SEQ ID NO: 741892 - DNA, 22 bp, Artificial Sequence
  chemically synthesized
agttcaacagagtgattatcac

SEQ ID NO: 741893 - DNA, 22 bp, Artificial Sequence
  chemically synthesized
aagttcaacagagtgattatca

SEQ ID NO: 741894 - DNA, 22 bp, Artificial Sequence
  chemically synthesized
taagttcaacagagtgattatc

SEQ ID NO: 741895 - DNA, 22 bp, Artificial Sequence
  chemically synthesized
aaactttaagttcaacagagtg

SEQ ID NO: 741896 - DNA, 22 bp, Artificial Sequence
  chemically synthesized
aaaactttaagttcaacagagt

SEQ ID NO: 741897 - DNA, 22 bp, Artificial Sequence
  chemically synthesized
taaaactttaagttcaacagag

SEQ ID NO: 741898 - DNA, 22 bp, Artificial Sequence
  chemically synthesized
ttaaaactttaagttcaacaga

SEQ ID NO: 741899 - DNA, 22 bp, Artificial Sequence
  chemically synthesized
tttaaaactttaagttcaacag

SEQ ID NO: 741900 - DNA, 22 bp, Artificial Sequence
  chemically synthesized
tgataatcactctgttgaactt

SEQ ID NO: 741901 - DNA, 22 bp, Artificial Sequence
  chemically synthesized
atgaccactttttaaaacttta

SEQ ID NO: 741902 - DNA, 22 bp, Artificial Sequence
  chemically synthesized
aatgaccactttttaaaacttt

SEQ ID NO: 741903 - DNA, 22 bp, Artificial Sequence
  chemically synthesized
taatgaccactttttaaaactt

SEQ ID NO: 741904 - DNA, 22 bp, Artificial Sequence
  chemically synthesized
tgttgaacttaaagttttaaaa

SEQ ID NO: 741905 - DNA, 22 bp, Artificial Sequence
  chemically synthesized
ttaatgaccactttttaaaact

SEQ ID NO: 741906 - DNA, 22 bp, Artificial Sequence
  chemically synthesized
ttgaacttaaagttttaaaaag

SEQ ID NO: 741907 - DNA, 22 bp, Artificial Sequence
  chemically synthesized
aacttaaagttttaaaaagtgg

SEQ ID NO: 741908 - DNA, 22 bp, Artificial Sequence
  chemically synthesized
aaagttttaaaaagtggtcatt

SEQ ID NO: 741909 - DNA, 22 bp, Artificial Sequence
  chemically synthesized
aagttttaaaaagtggtcatta

SEQ ID NO: 741910 - DNA, 22 bp, Artificial Sequence
  chemically synthesized
acgtaatgtttttaatgaccac

SEQ ID NO: 741911 - DNA, 22 bp, Artificial Sequence
  chemically synthesized
aacgtaatgtttttaatgacca

SEQ ID NO: 741912 - DNA, 22 bp, Artificial Sequence
  chemically synthesized
cttaacgtaatgtttttaatga

SEQ ID NO: 741913 - DNA, 22 bp, Artificial Sequence
  chemically synthesized
taaaaagtggtcattaaaaaca

SEQ ID NO: 741914 - DNA, 22 bp, Artificial Sequence
  chemically synthesized
aaaaagtggtcattaaaaacat

SEQ ID NO: 741915 - DNA, 22 bp, Artificial Sequence
  chemically synthesized
aaaagtggtcattaaaaacatt

SEQ ID NO: 741916 - DNA, 22 bp, Artificial Sequence
  chemically synthesized
attgcttaacgtaatgttttta

SEQ ID NO: 741917 - DNA, 22 bp, Artificial Sequence
  chemically synthesized
aaaacattacgttaagcaatca

SEQ ID NO: 741918 - DNA, 22 bp, Artificial Sequence
  chemically synthesized
tcgtccaaaagaaaccccctga

SEQ ID NO: 741919 - DNA, 22 bp, Artificial Sequence
  chemically synthesized
cgttaagcaatcagggggtttc

SEQ ID NO: 741920 - DNA, 22 bp, Artificial Sequence
  chemically synthesized
gttatcgtccaaaagaaacccc

SEQ ID NO: 741921 - DNA, 22 bp, Artificial Sequence
  chemically synthesized
cgttatcgtccaaaagaaaccc

SEQ ID NO: 741922 - DNA, 22 bp, Artificial Sequence
  chemically synthesized
tcgttatcgtccaaaagaaacc

SEQ ID NO: 741923 - DNA, 22 bp, Artificial Sequence
  chemically synthesized
agcaatcagggggtttcttttg

SEQ ID NO: 741924 - DNA, 22 bp, Artificial Sequence
  chemically synthesized
ataccagaacattttcgttatc

SEQ ID NO: 741925 - DNA, 22 bp, Artificial Sequence
  chemically synthesized
aataccagaacattttcgttat

SEQ ID NO: 741926 - DNA, 22 bp, Artificial Sequence
  chemically synthesized
cttttggacgataacgaaaatg

SEQ ID NO: 741927 - DNA, 22 bp, Artificial Sequence
  chemically synthesized
ttttggacgataacgaaaatgt

SEQ ID NO: 741928 - DNA, 22 bp, Artificial Sequence
  chemically synthesized
tttaataccagaacattttcgt

SEQ ID NO: 741929 - DNA, 22 bp, Artificial Sequence
  chemically synthesized
ttggacgataacgaaaatgttc

SEQ ID NO: 741930 - DNA, 22 bp, Artificial Sequence
  chemically synthesized
tggacgataacgaaaatgttct

SEQ ID NO: 741931 - DNA, 22 bp, Artificial Sequence
  chemically synthesized
ggacgataacgaaaatgttctg

SEQ ID NO: 741932 - DNA, 22 bp, Artificial Sequence
  chemically synthesized
gacgataacgaaaatgttctgg

SEQ ID NO: 741933 - DNA, 22 bp, Artificial Sequence
  chemically synthesized
tgccaccatcaccattgtttaa

SEQ ID NO: 741934 - DNA, 22 bp, Artificial Sequence
  chemically synthesized
tggtattaaacaatggtgatgg

SEQ ID NO: 741935 - DNA, 22 bp, Artificial Sequence
  chemically synthesized
gtattaaacaatggtgatggtg

SEQ ID NO: 741936 - DNA, 22 bp, Artificial Sequence
  chemically synthesized
acaagattgtgccaccatcacc

SEQ ID NO: 741937 - DNA, 22 bp, Artificial Sequence
  chemically synthesized
aacaatggtgatggtggcacaa

SEQ ID NO: 741938 - DNA, 22 bp, Artificial Sequence
  chemically synthesized
gtatattcacaagattgtgcca

SEQ ID NO: 741939 - DNA, 22 bp, Artificial Sequence
  chemically synthesized
agtatattcacaagattgtgcc

SEQ ID NO: 741940 - DNA, 22 bp, Artificial Sequence
  chemically synthesized
agtggtgtttagtatattcaca

SEQ ID NO: 741941 - DNA, 22 bp, Artificial Sequence
  chemically synthesized
gtgaatatactaaacaccactg

SEQ ID NO: 741942 - DNA, 22 bp, Artificial Sequence
  chemically synthesized
tgaatatactaaacaccactga

SEQ ID NO: 741943 - DNA, 22 bp, Artificial Sequence
  chemically synthesized
aaagtgtacaattcagtggtgt

SEQ ID NO: 741944 - DNA, 22 bp, Artificial Sequence
  chemically synthesized
caaagtgtacaattcagtggtg

SEQ ID NO: 741945 - DNA, 22 bp, Artificial Sequence
  chemically synthesized
tcaaagtgtacaattcagtggt

SEQ ID NO: 741946 - DNA, 22 bp, Artificial Sequence
  chemically synthesized
tttcaaagtgtacaattcagtg

SEQ ID NO: 741947 - DNA, 22 bp, Artificial Sequence
  chemically synthesized
actctttcaaagtgtacaattc

SEQ ID NO: 741948 - DNA, 22 bp, Artificial Sequence
  chemically synthesized
aacaccactgaattgtacactt

SEQ ID NO: 741949 - DNA, 22 bp, Artificial Sequence
  chemically synthesized
aaattcactctttcaaagtgta

SEQ ID NO: 741950 - DNA, 22 bp, Artificial Sequence
  chemically synthesized
aaaattcactctttcaaagtgt

SEQ ID NO: 741951 - DNA, 22 bp, Artificial Sequence
  chemically synthesized
taaaattcactctttcaaagtg

SEQ ID NO: 741952 - DNA, 22 bp, Artificial Sequence
  chemically synthesized
aattgtacactttgaaagagtg

SEQ ID NO: 741953 - DNA, 22 bp, Artificial Sequence
  chemically synthesized
acatactttaaaattcactctt

SEQ ID NO: 741954 - DNA, 22 bp, Artificial Sequence
  chemically synthesized
tacactttgaaagagtgaattt

SEQ ID NO: 741955 - DNA, 22 bp, Artificial Sequence
  chemically synthesized
tgaaagagtgaattttaaagta

SEQ ID NO: 741956 - DNA, 22 bp, Artificial Sequence
  chemically synthesized
gaaagagtgaattttaaagtat

SEQ ID NO: 741957 - DNA, 22 bp, Artificial Sequence
  chemically synthesized
aaagagtgaattttaaagtatg

SEQ ID NO: 741958 - DNA, 22 bp, Artificial Sequence
  chemically synthesized
atatataattcacatactttaa

SEQ ID NO: 741959 - DNA, 22 bp, Artificial Sequence
  chemically synthesized
ttaatatataattcacatactt

SEQ ID NO: 741960 - DNA, 22 bp, Artificial Sequence
  chemically synthesized
attaatatataattcacatact

SEQ ID NO: 741961 - DNA, 22 bp, Artificial Sequence
  chemically synthesized
tattaatatataattcacatac

SEQ ID NO: 741962 - DNA, 22 bp, Artificial Sequence
  chemically synthesized
ttattaatatataattcacata

SEQ ID NO: 741963 - DNA, 22 bp, Artificial Sequence
  chemically synthesized
tttttattaatatataattcac

SEQ ID NO: 741964 - DNA, 22 bp, Artificial Sequence
  chemically synthesized
gtttttattaatatataattca

SEQ ID NO: 741965 - DNA, 22 bp, Artificial Sequence
  chemically synthesized
taaagtatgtgaattatatatt

SEQ ID NO: 741966 - DNA, 22 bp, Artificial Sequence
  chemically synthesized
tttgtttttattaatatataat

SEQ ID NO: 741967 - DNA, 22 bp, Artificial Sequence
  chemically synthesized
aaagtatgtgaattatatatta

SEQ ID NO: 741968 - DNA, 22 bp, Artificial Sequence
  chemically synthesized
gtttgtttttattaatatataa

SEQ ID NO: 741969 - DNA, 22 bp, Artificial Sequence
  chemically synthesized
aagtatgtgaattatatattaa

SEQ ID NO: 741970 - DNA, 22 bp, Artificial Sequence
  chemically synthesized
tgtttgtttttattaatatata

SEQ ID NO: 741971 - DNA, 22 bp, Artificial Sequence
  chemically synthesized
ttgtttgtttttattaatatat

SEQ ID NO: 741972 - DNA, 22 bp, Artificial Sequence
  chemically synthesized
ttttgtttgtttttattaatat

SEQ ID NO: 741973 - DNA, 22 bp, Artificial Sequence
  chemically synthesized
tcttttgtttgtttttattaat

SEQ ID NO: 741974 - DNA, 22 bp, Artificial Sequence
  chemically synthesized
tatattaataaaaacaaacaaa

SEQ ID NO: 741975 - DNA, 22 bp, Artificial Sequence
  chemically synthesized
ataaaaacaaacaaaagagagc

SEQ ID NO: 741976 - DNA, 22 bp, Artificial Sequence
  chemically synthesized
catgtgtatggtcagaaggggc

SEQ ID NO: 741977 - DNA, 22 bp, Artificial Sequence
  chemically synthesized
gcatgtgtatggtcagaagggg

SEQ ID NO: 741978 - DNA, 22 bp, Artificial Sequence
  chemically synthesized
tgcatgtgtatggtcagaaggg

SEQ ID NO: 741979 - DNA, 22 bp, Artificial Sequence
  chemically synthesized
ttgcatgtgtatggtcagaagg

SEQ ID NO: 741980 - DNA, 22 bp, Artificial Sequence
  chemically synthesized
tttgcatgtgtatggtcagaag

SEQ ID NO: 741981 - DNA, 22 bp, Artificial Sequence
  chemically synthesized
ttttgcatgtgtatggtcagaa

SEQ ID NO: 741982 - DNA, 22 bp, Artificial Sequence
  chemically synthesized
tttttgcatgtgtatggtcaga

SEQ ID NO: 741983 - DNA, 22 bp, Artificial Sequence
  chemically synthesized
ttttttgcatgtgtatggtcag

SEQ ID NO: 741984 - DNA, 22 bp, Artificial Sequence
  chemically synthesized
tttttttgcatgtgtatggtca

SEQ ID NO: 741985 - DNA, 22 bp, Artificial Sequence
  chemically synthesized
ctgaccatacacatgcaaaaaa

SEQ ID NO: 741986 - DNA, 22 bp, Artificial Sequence
  chemically synthesized
tgaccatacacatgcaaaaaaa

SEQ ID NO: 741987 - DNA, 22 bp, Artificial Sequence
  chemically synthesized
accatacacatgcaaaaaaaaa

SEQ ID NO: 741988 - DNA, 22 bp, Artificial Sequence
  chemically synthesized
aatacagatgaatacatcacat

SEQ ID NO: 741989 - DNA, 22 bp, Artificial Sequence
  chemically synthesized
acacgaagttgaatacagatga

SEQ ID NO: 741990 - DNA, 22 bp, Artificial Sequence
  chemically synthesized
cactaacacgaagttgaataca

SEQ ID NO: 741991 - DNA, 22 bp, Artificial Sequence
  chemically synthesized
atctgtattcaacttcgtgtta

SEQ ID NO: 741992 - DNA, 22 bp, Artificial Sequence
  chemically synthesized
cagtgacattccactaacacga

SEQ ID NO: 741993 - DNA, 22 bp, Artificial Sequence
  chemically synthesized
tattcaacttcgtgttagtgga

SEQ ID NO: 741994 - DNA, 22 bp, Artificial Sequence
  chemically synthesized
attccagtgacattccactaac

SEQ ID NO: 741995 - DNA, 22 bp, Artificial Sequence
  chemically synthesized
aacttcgtgttagtggaatgtc

SEQ ID NO: 741996 - DNA, 22 bp, Artificial Sequence
  chemically synthesized
acactgattccagtgacattcc

SEQ ID NO: 741997 - DNA, 22 bp, Artificial Sequence
  chemically synthesized
cacactgattccagtgacattc

SEQ ID NO: 741998 - DNA, 22 bp, Artificial Sequence
  chemically synthesized
cgtgttagtggaatgtcactgg

SEQ ID NO: 741999 - DNA, 22 bp, Artificial Sequence
  chemically synthesized
gtgttagtggaatgtcactgga

SEQ ID NO: 742000 - DNA, 22 bp, Artificial Sequence
  chemically synthesized
aatttcacactgattccagtga

SEQ ID NO: 742001 - DNA, 22 bp, Artificial Sequence
  chemically synthesized
tgaatttcacactgattccagt

SEQ ID NO: 742002 - DNA, 22 bp, Artificial Sequence
  chemically synthesized
ctgaatttcacactgattccag

SEQ ID NO: 742003 - DNA, 22 bp, Artificial Sequence
  chemically synthesized
gtggaatgtcactggaatcagt

SEQ ID NO: 742004 - DNA, 22 bp, Artificial Sequence
  chemically synthesized
tctgaatttcacactgattcca

SEQ ID NO: 742005 - DNA, 22 bp, Artificial Sequence
  chemically synthesized
taaaactttctgaatttcacac

SEQ ID NO: 742006 - DNA, 22 bp, Artificial Sequence
  chemically synthesized
gaatcagtgtgaaattcagaaa

SEQ ID NO: 742007 - DNA, 22 bp, Artificial Sequence
  chemically synthesized
tccacccctataaaactttctg

SEQ ID NO: 742008 - DNA, 22 bp, Artificial Sequence
  chemically synthesized
ctatccacccctataaaacttt

SEQ ID NO: 742009 - DNA, 22 bp, Artificial Sequence
  chemically synthesized
actatccacccctataaaactt

SEQ ID NO: 742010 - DNA, 22 bp, Artificial Sequence
  chemically synthesized
agaaagttttataggggtggat

SEQ ID NO: 742011 - DNA, 22 bp, Artificial Sequence
  chemically synthesized
tataggggtggatagtaaatat

SEQ ID NO: 742012 - DNA, 22 bp, Artificial Sequence
  chemically synthesized
ataggggtggatagtaaatatt

SEQ ID NO: 742013 - DNA, 22 bp, Artificial Sequence
  chemically synthesized
taggggtggatagtaaatattg

SEQ ID NO: 742014 - DNA, 22 bp, Artificial Sequence
  chemically synthesized
ataaggaaatggaacaatattt

SEQ ID NO: 742015 - DNA, 22 bp, Artificial Sequence
  chemically synthesized
ttcataaggaaatggaacaata

SEQ ID NO: 742016 - DNA, 22 bp, Artificial Sequence
  chemically synthesized
attcataaggaaatggaacaat

SEQ ID NO: 742017 - DNA, 22 bp, Artificial Sequence
  chemically synthesized
atccatgtatttattcataagg

SEQ ID NO: 742018 - DNA, 22 bp, Artificial Sequence
  chemically synthesized
aatccatgtatttattcataag

SEQ ID NO: 742019 - DNA, 22 bp, Artificial Sequence
  chemically synthesized
taatccatgtatttattcataa

SEQ ID NO: 742020 - DNA, 22 bp, Artificial Sequence
  chemically synthesized
ttaatccatgtatttattcata

SEQ ID NO: 742021 - DNA, 22 bp, Artificial Sequence
  chemically synthesized
ttccatttccttatgaataaat

SEQ ID NO: 742022 - DNA, 22 bp, Artificial Sequence
  chemically synthesized
catttccttatgaataaataca

SEQ ID NO: 742023 - DNA, 22 bp, Artificial Sequence
  chemically synthesized
atacttttaatccatgtattta

SEQ ID NO: 742024 - DNA, 22 bp, Artificial Sequence
  chemically synthesized
tgatacttttaatccatgtatt

SEQ ID NO: 742025 - DNA, 22 bp, Artificial Sequence
  chemically synthesized
ccttatgaataaatacatggat

SEQ ID NO: 742026 - DNA, 22 bp, Artificial Sequence
  chemically synthesized
cttatgaataaatacatggatt

SEQ ID NO: 742027 - DNA, 22 bp, Artificial Sequence
  chemically synthesized
ttctgatacttttaatccatgt

SEQ ID NO: 742028 - DNA, 22 bp, Artificial Sequence
  chemically synthesized
attctgatacttttaatccatg

SEQ ID NO: 742029 - DNA, 22 bp, Artificial Sequence
  chemically synthesized
atgaataaatacatggattaaa

SEQ ID NO: 742030 - DNA, 22 bp, Artificial Sequence
  chemically synthesized
tgaataaatacatggattaaaa

SEQ ID NO: 742031 - DNA, 22 bp, Artificial Sequence
  chemically synthesized
catgggcccttattctgatact

SEQ ID NO: 742032 - DNA, 22 bp, Artificial Sequence
  chemically synthesized
tccatgggcccttattctgata

SEQ ID NO: 742033 - DNA, 22 bp, Artificial Sequence
  chemically synthesized
ctccatgggcccttattctgat

SEQ ID NO: 742034 - DNA, 22 bp, Artificial Sequence
  chemically synthesized
tctccatgggcccttattctga

SEQ ID NO: 742035 - DNA, 22 bp, Artificial Sequence
  chemically synthesized
aaagtatcagaataagggccca

SEQ ID NO: 742036 - DNA, 22 bp, Artificial Sequence
  chemically synthesized
aaccacctttctccatgggccc

SEQ ID NO: 742037 - DNA, 22 bp, Artificial Sequence
  chemically synthesized
aaaccacctttctccatgggcc

SEQ ID NO: 742038 - DNA, 22 bp, Artificial Sequence
  chemically synthesized
atatatatggatttaaaccacc

SEQ ID NO: 742039 - DNA, 22 bp, Artificial Sequence
  chemically synthesized
gagataagtattcatatatatg

SEQ ID NO: 742040 - DNA, 22 bp, Artificial Sequence
  chemically synthesized
agagataagtattcatatatat

SEQ ID NO: 742041 - DNA, 22 bp, Artificial Sequence
  chemically synthesized
tagagataagtattcatatata

SEQ ID NO: 742042 - DNA, 22 bp, Artificial Sequence
  chemically synthesized
ttagagataagtattcatatat

SEQ ID NO: 742043 - DNA, 22 bp, Artificial Sequence
  chemically synthesized
cttttagagataagtattcata

SEQ ID NO: 742044 - DNA, 22 bp, Artificial Sequence
  chemically synthesized
aaatccatatatatgaatactt

SEQ ID NO: 742045 - DNA, 22 bp, Artificial Sequence
  chemically synthesized
ccttttagagataagtattcat

SEQ ID NO: 742046 - DNA, 22 bp, Artificial Sequence
  chemically synthesized
aatccatatatatgaatactta

SEQ ID NO: 742047 - DNA, 22 bp, Artificial Sequence
  chemically synthesized
atatggatcatttccttttaga

SEQ ID NO: 742048 - DNA, 22 bp, Artificial Sequence
  chemically synthesized
atctctaaaaggaaatgatcca

SEQ ID NO: 742049 - DNA, 22 bp, Artificial Sequence
  chemically synthesized
tctctaaaaggaaatgatccat

SEQ ID NO: 742050 - DNA, 22 bp, Artificial Sequence
  chemically synthesized
taaaaggaaatgatccatatta

SEQ ID NO: 742051 - DNA, 22 bp, Artificial Sequence
  chemically synthesized
tgcaaaacaaaattaatatgga

SEQ ID NO: 742052 - DNA, 22 bp, Artificial Sequence
  chemically synthesized
aaaggaaatgatccatattaat

SEQ ID NO: 742053 - DNA, 22 bp, Artificial Sequence
  chemically synthesized
ttatgcaaaacaaaattaatat

SEQ ID NO: 742054 - DNA, 22 bp, Artificial Sequence
  chemically synthesized
tattatgcaaaacaaaattaat

SEQ ID NO: 742055 - DNA, 22 bp, Artificial Sequence
  chemically synthesized
ctattatgcaaaacaaaattaa

SEQ ID NO: 742056 - DNA, 22 bp, Artificial Sequence
  chemically synthesized
tctattatgcaaaacaaaatta

SEQ ID NO: 742057 - DNA, 22 bp, Artificial Sequence
  chemically synthesized
acctttctattatgcaaaacaa

SEQ ID NO: 742058 - DNA, 22 bp, Artificial Sequence
  chemically synthesized
taacctttctattatgcaaaac

SEQ ID NO: 742059 - DNA, 22 bp, Artificial Sequence
  chemically synthesized
ctaacctttctattatgcaaaa

SEQ ID NO: 742060 - DNA, 22 bp, Artificial Sequence
  chemically synthesized
tctaacctttctattatgcaaa

SEQ ID NO: 742061 - DNA, 22 bp, Artificial Sequence
  chemically synthesized
ttttctaacctttctattatgc

SEQ ID NO: 742062 - DNA, 22 bp, Artificial Sequence
  chemically synthesized
attttgttttgcataatagaaa

SEQ ID NO: 742063 - DNA, 22 bp, Artificial Sequence
  chemically synthesized
tgttttgcataatagaaaggtt

SEQ ID NO: 742064 - DNA, 22 bp, Artificial Sequence
  chemically synthesized
gttttgcataatagaaaggtta

SEQ ID NO: 742065 - DNA, 22 bp, Artificial Sequence
  chemically synthesized
ttttgcataatagaaaggttag

SEQ ID NO: 742066 - DNA, 22 bp, Artificial Sequence
  chemically synthesized
agaaatctgttttctaaccttt

SEQ ID NO: 742067 - DNA, 22 bp, Artificial Sequence
  chemically synthesized
aagaaatctgttttctaacctt

SEQ ID NO: 742068 - DNA, 22 bp, Artificial Sequence
  chemically synthesized
tgcataatagaaaggttagaaa

SEQ ID NO: 742069 - DNA, 22 bp, Artificial Sequence
  chemically synthesized
gcataatagaaaggttagaaaa

SEQ ID NO: 742070 - DNA, 22 bp, Artificial Sequence
  chemically synthesized
cataatagaaaggttagaaaac

SEQ ID NO: 742071 - DNA, 22 bp, Artificial Sequence
  chemically synthesized
acatttaagaaatctgttttct

SEQ ID NO: 742072 - DNA, 22 bp, Artificial Sequence
  chemically synthesized
ccccattgacatttaagaaatc

SEQ ID NO: 742073 - DNA, 22 bp, Artificial Sequence
  chemically synthesized
cccccattgacatttaagaaat

SEQ ID NO: 742074 - DNA, 22 bp, Artificial Sequence
  chemically synthesized
gaaaacagatttcttaaatgtc

SEQ ID NO: 742075 - DNA, 22 bp, Artificial Sequence
  chemically synthesized
tccaagtttcccccattgacat

SEQ ID NO: 742076 - DNA, 22 bp, Artificial Sequence
  chemically synthesized
gtccaagtttcccccattgaca

SEQ ID NO: 742077 - DNA, 22 bp, Artificial Sequence
  chemically synthesized
tccttgtccaagtttcccccat

SEQ ID NO: 742078 - DNA, 22 bp, Artificial Sequence
  chemically synthesized
cttaaatgtcaatgggggaaac

SEQ ID NO: 742079 - DNA, 22 bp, Artificial Sequence
  chemically synthesized
ttaaatgtcaatgggggaaact

SEQ ID NO: 742080 - DNA, 22 bp, Artificial Sequence
  chemically synthesized
aaatgtcaatgggggaaacttg

SEQ ID NO: 742081 - DNA, 22 bp, Artificial Sequence
  chemically synthesized
aatgtcaatgggggaaacttgg

SEQ ID NO: 742082 - DNA, 22 bp, Artificial Sequence
  chemically synthesized
taaccgttgtccttgtccaagt

SEQ ID NO: 742083 - DNA, 22 bp, Artificial Sequence
  chemically synthesized
gtaaccgttgtccttgtccaag

SEQ ID NO: 742084 - DNA, 22 bp, Artificial Sequence
  chemically synthesized
tgtaaccgttgtccttgtccaa

SEQ ID NO: 742085 - DNA, 22 bp, Artificial Sequence
  chemically synthesized
attttgtaaccgttgtccttgt

SEQ ID NO: 742086 - DNA, 22 bp, Artificial Sequence
  chemically synthesized
cattttgtaaccgttgtccttg

SEQ ID NO: 742087 - DNA, 22 bp, Artificial Sequence
  chemically synthesized
ggacaaggacaacggttacaaa

SEQ ID NO: 742088 - DNA, 22 bp, Artificial Sequence
  chemically synthesized
gacaaggacaacggttacaaaa

SEQ ID NO: 742089 - DNA, 22 bp, Artificial Sequence
  chemically synthesized
tccagaagagaatgatttcatt

SEQ ID NO: 742090 - DNA, 22 bp, Artificial Sequence
  chemically synthesized
ttatccagaagagaatgatttc

SEQ ID NO: 742091 - DNA, 22 bp, Artificial Sequence
  chemically synthesized
caaaatgaaatcattctcttct

SEQ ID NO: 742092 - DNA, 22 bp, Artificial Sequence
  chemically synthesized
gaaatgcacgttattatccaga

SEQ ID NO: 742093 - DNA, 22 bp, Artificial Sequence
  chemically synthesized
ctagaaatgcacgttattatcc

SEQ ID NO: 742094 - DNA, 22 bp, Artificial Sequence
  chemically synthesized
tcttctggataataacgtgcat

SEQ ID NO: 742095 - DNA, 22 bp, Artificial Sequence
  chemically synthesized
tggctactagaaatgcacgtta

SEQ ID NO: 742096 - DNA, 22 bp, Artificial Sequence
  chemically synthesized
gtggctactagaaatgcacgtt

SEQ ID NO: 742097 - DNA, 22 bp, Artificial Sequence
  chemically synthesized
ttctggataataacgtgcattt

SEQ ID NO: 742098 - DNA, 22 bp, Artificial Sequence
  chemically synthesized
ctggataataacgtgcatttct

SEQ ID NO: 742099 - DNA, 22 bp, Artificial Sequence
  chemically synthesized
tttgtggctactagaaatgcac

SEQ ID NO: 742100 - DNA, 22 bp, Artificial Sequence
  chemically synthesized
tggataataacgtgcatttcta

SEQ ID NO: 742101 - DNA, 22 bp, Artificial Sequence
  chemically synthesized
atttgtggctactagaaatgca

SEQ ID NO: 742102 - DNA, 22 bp, Artificial Sequence
  chemically synthesized
gataataacgtgcatttctagt

SEQ ID NO: 742103 - DNA, 22 bp, Artificial Sequence
  chemically synthesized
acatgatatttatttgtggcta

SEQ ID NO: 742104 - DNA, 22 bp, Artificial Sequence
  chemically synthesized
ccctcacatgatatttatttgt

SEQ ID NO: 742105 - DNA, 22 bp, Artificial Sequence
  chemically synthesized
cccctcacatgatatttatttg

SEQ ID NO: 742106 - DNA, 22 bp, Artificial Sequence
  chemically synthesized
ctagtagccacaaataaatatc

SEQ ID NO: 742107 - DNA, 22 bp, Artificial Sequence
  chemically synthesized
tagtagccacaaataaatatca

SEQ ID NO: 742108 - DNA, 22 bp, Artificial Sequence
  chemically synthesized
gtagccacaaataaatatcatg

SEQ ID NO: 742109 - DNA, 22 bp, Artificial Sequence
  chemically synthesized
cagtttcccctcacatgatatt

SEQ ID NO: 742110 - DNA, 22 bp, Artificial Sequence
  chemically synthesized
acagtttcccctcacatgatat

SEQ ID NO: 742111 - DNA, 22 bp, Artificial Sequence
  chemically synthesized
tttacagtttcccctcacatga

SEQ ID NO: 742112 - DNA, 22 bp, Artificial Sequence
  chemically synthesized
ctgtttacagtttcccctcaca

SEQ ID NO: 742113 - DNA, 22 bp, Artificial Sequence
  chemically synthesized
cagaggttcctgtttacagttt

SEQ ID NO: 742114 - DNA, 22 bp, Artificial Sequence
  chemically synthesized
tgcagaggttcctgtttacagt

SEQ ID NO: 742115 - DNA, 22 bp, Artificial Sequence
  chemically synthesized
tctgcagaggttcctgtttaca

SEQ ID NO: 742116 - DNA, 22 bp, Artificial Sequence
  chemically synthesized
ccctctctgcagaggttcctgt

SEQ ID NO: 742117 - DNA, 22 bp, Artificial Sequence
  chemically synthesized
gccctctctgcagaggttcctg

SEQ ID NO: 742118 - DNA, 22 bp, Artificial Sequence
  chemically synthesized
gcttgccctctctgcagaggtt

SEQ ID NO: 742119 - DNA, 22 bp, Artificial Sequence
  chemically synthesized
ctggcttgccctctctgcagag

SEQ ID NO: 742120 - DNA, 22 bp, Artificial Sequence
  chemically synthesized
taaacaggaacctctgcagaga

SEQ ID NO: 742121 - DNA, 22 bp, Artificial Sequence
  chemically synthesized
cctgctggcttgccctctctgc

SEQ ID NO: 742122 - DNA, 22 bp, Artificial Sequence
  chemically synthesized
aaagatgctgcctgctggcttg

SEQ ID NO: 742123 - DNA, 22 bp, Artificial Sequence
  chemically synthesized
tgcagagagggcaagccagcag

SEQ ID NO: 742124 - DNA, 22 bp, Artificial Sequence
  chemically synthesized
cagagagggcaagccagcaggc

SEQ ID NO: 742125 - DNA, 22 bp, Artificial Sequence
  chemically synthesized
tatcactgaaagatgctgcctg

SEQ ID NO: 742126 - DNA, 22 bp, Artificial Sequence
  chemically synthesized
acctgtatcactgaaagatgct

SEQ ID NO: 742127 - DNA, 22 bp, Artificial Sequence
  chemically synthesized
gcacaaaggactcacctgtatc

SEQ ID NO: 742128 - DNA, 22 bp, Artificial Sequence
  chemically synthesized
tcagtgatacaggtgagtcctt

SEQ ID NO: 742129 - DNA, 22 bp, Artificial Sequence
  chemically synthesized
cagtgatacaggtgagtccttt

SEQ ID NO: 742130 - DNA, 22 bp, Artificial Sequence
  chemically synthesized
agtgatacaggtgagtcctttg

SEQ ID NO: 742131 - DNA, 22 bp, Artificial Sequence
  chemically synthesized
taaagagagatgattagcacaa

SEQ ID NO: 742132 - DNA, 22 bp, Artificial Sequence
  chemically synthesized
gtaaagagagatgattagcaca

SEQ ID NO: 742133 - DNA, 22 bp, Artificial Sequence
  chemically synthesized
cttgtaaagagagatgattagc

SEQ ID NO: 742134 - DNA, 22 bp, Artificial Sequence
  chemically synthesized
gcttgtaaagagagatgattag

SEQ ID NO: 742135 - DNA, 22 bp, Artificial Sequence
  chemically synthesized
tgtgctaatcatctctctttac

SEQ ID NO: 742136 - DNA, 22 bp, Artificial Sequence
  chemically synthesized
agagtcttgcttgtaaagagag

SEQ ID NO: 742137 - DNA, 22 bp, Artificial Sequence
  chemically synthesized
gtgctaatcatctctctttaca

SEQ ID NO: 742138 - DNA, 22 bp, Artificial Sequence
  chemically synthesized
gagagtcttgcttgtaaagaga

SEQ ID NO: 742139 - DNA, 22 bp, Artificial Sequence
  chemically synthesized
tgctaatcatctctctttacaa

SEQ ID NO: 742140 - DNA, 22 bp, Artificial Sequence
  chemically synthesized
atcatctctctttacaagcaag

SEQ ID NO: 742141 - DNA, 22 bp, Artificial Sequence
  chemically synthesized
atggcttgagagtcttgcttgt

SEQ ID NO: 742142 - DNA, 22 bp, Artificial Sequence
  chemically synthesized
aatggcttgagagtcttgcttg

SEQ ID NO: 742143 - DNA, 22 bp, Artificial Sequence
  chemically synthesized
tctttacaagcaagactctcaa

SEQ ID NO: 742144 - DNA, 22 bp, Artificial Sequence
  chemically synthesized
tttacaagcaagactctcaagc

SEQ ID NO: 742145 - DNA, 22 bp, Artificial Sequence
  chemically synthesized
tacaagcaagactctcaagcca

SEQ ID NO: 742146 - DNA, 22 bp, Artificial Sequence
  chemically synthesized
acaagcaagactctcaagccat

SEQ ID NO: 742147 - DNA, 22 bp, Artificial Sequence
  chemically synthesized
caagcaagactctcaagccatt

SEQ ID NO: 742148 - DNA, 22 bp, Artificial Sequence
  chemically synthesized
acgaggtaggataatcaactta

SEQ ID NO: 742149 - DNA, 22 bp, Artificial Sequence
  chemically synthesized
aacgaggtaggataatcaactt

SEQ ID NO: 742150 - DNA, 22 bp, Artificial Sequence
  chemically synthesized
tcaagccattaagttgattatc

SEQ ID NO: 742151 - DNA, 22 bp, Artificial Sequence
  chemically synthesized
aagccattaagttgattatcct

SEQ ID NO: 742152 - DNA, 22 bp, Artificial Sequence
  chemically synthesized
tggcttaacgaggtaggataat

SEQ ID NO: 742153 - DNA, 22 bp, Artificial Sequence
  chemically synthesized
gctatggcttaacgaggtagga

SEQ ID NO: 742154 - DNA, 22 bp, Artificial Sequence
  chemically synthesized
agttgattatcctacctcgtta

SEQ ID NO: 742155 - DNA, 22 bp, Artificial Sequence
  chemically synthesized
aaatctagctatggcttaacga

SEQ ID NO: 742156 - DNA, 22 bp, Artificial Sequence
  chemically synthesized
attatcctacctcgttaagcca

SEQ ID NO: 742157 - DNA, 22 bp, Artificial Sequence
  chemically synthesized
tcctacctcgttaagccatagc

SEQ ID NO: 742158 - DNA, 22 bp, Artificial Sequence
  chemically synthesized
cctcgttaagccatagctagat

SEQ ID NO: 742159 - DNA, 22 bp, Artificial Sequence
  chemically synthesized
aagggaactgaaatctagctat

SEQ ID NO: 742160 - DNA, 22 bp, Artificial Sequence
  chemically synthesized
gttaagccatagctagatttca

SEQ ID NO: 742161 - DNA, 22 bp, Artificial Sequence
  chemically synthesized
agccatagctagatttcagttc

SEQ ID NO: 742162 - DNA, 22 bp, Artificial Sequence
  chemically synthesized
tgtcacctaaagggaactgaaa

SEQ ID NO: 742163 - DNA, 22 bp, Artificial Sequence
  chemically synthesized
gatttcagttccctttaggtga

SEQ ID NO: 742164 - DNA, 22 bp, Artificial Sequence
  chemically synthesized
aaaatgtacattgtgtcaccta

SEQ ID NO: 742165 - DNA, 22 bp, Artificial Sequence
  chemically synthesized
gaaaatgtacattgtgtcacct

SEQ ID NO: 742166 - DNA, 22 bp, Artificial Sequence
  chemically synthesized
cagttccctttaggtgacacaa

SEQ ID NO: 742167 - DNA, 22 bp, Artificial Sequence
  chemically synthesized
agttccctttaggtgacacaat

SEQ ID NO: 742168 - DNA, 22 bp, Artificial Sequence
  chemically synthesized
cctttaggtgacacaatgtaca

SEQ ID NO: 742169 - DNA, 22 bp, Artificial Sequence
  chemically synthesized
taggtgacacaatgtacatttt

SEQ ID NO: 742170 - DNA, 22 bp, Artificial Sequence
  chemically synthesized
aggtgacacaatgtacattttc

SEQ ID NO: 742171 - DNA, 22 bp, Artificial Sequence
  chemically synthesized
ggtgacacaatgtacattttca

SEQ ID NO: 742172 - DNA, 22 bp, Artificial Sequence
  chemically synthesized
ataagagacatttgaaaatgta

SEQ ID NO: 742173 - DNA, 22 bp, Artificial Sequence
  chemically synthesized
taataagagacatttgaaaatg

SEQ ID NO: 742174 - DNA, 22 bp, Artificial Sequence
  chemically synthesized
tcaaatgtctcttattagaata

SEQ ID NO: 742175 - DNA, 22 bp, Artificial Sequence
  chemically synthesized
caaatgtctcttattagaatat

SEQ ID NO: 742176 - DNA, 22 bp, Artificial Sequence
  chemically synthesized
aaatgtctcttattagaatatt

SEQ ID NO: 742177 - DNA, 22 bp, Artificial Sequence
  chemically synthesized
ggagagaaaatgaaaatcaaaa

SEQ ID NO: 742178 - DNA, 22 bp, Artificial Sequence
  chemically synthesized
ttattagaatattttgattttc

SEQ ID NO: 742179 - DNA, 22 bp, Artificial Sequence
  chemically synthesized
gggagagaaaatgaaaatcaaa

SEQ ID NO: 742180 - DNA, 22 bp, Artificial Sequence
  chemically synthesized
attagaatattttgattttcat

SEQ ID NO: 742181 - DNA, 22 bp, Artificial Sequence
  chemically synthesized
ttagaatattttgattttcatt

SEQ ID NO: 742182 - DNA, 22 bp, Artificial Sequence
  chemically synthesized
gaatattttgattttcattttc

SEQ ID NO: 742183 - DNA, 22 bp, Artificial Sequence
  chemically synthesized
aggaatttgggagagaaaatga

SEQ ID NO: 742184 - DNA, 22 bp, Artificial Sequence
  chemically synthesized
tgattttcattttctctcccaa

SEQ ID NO: 742185 - DNA, 22 bp, Artificial Sequence
  chemically synthesized
gattttcattttctctcccaaa

SEQ ID NO: 742186 - DNA, 22 bp, Artificial Sequence
  chemically synthesized
attttcattttctctcccaaat

SEQ ID NO: 742187 - DNA, 22 bp, Artificial Sequence
  chemically synthesized
tcattttctctcccaaattcct

SEQ ID NO: 742188 - DNA, 22 bp, Artificial Sequence
  chemically synthesized
atatgtgtgctcaggaatttgg

SEQ ID NO: 742189 - DNA, 22 bp, Artificial Sequence
  chemically synthesized
cattttctctcccaaattcctg

SEQ ID NO: 742190 - DNA, 22 bp, Artificial Sequence
  chemically synthesized
attttctctcccaaattcctga

SEQ ID NO: 742191 - DNA, 22 bp, Artificial Sequence
  chemically synthesized
tctctcccaaattcctgagcac

SEQ ID NO: 742192 - DNA, 22 bp, Artificial Sequence
  chemically synthesized
ctctcccaaattcctgagcaca

SEQ ID NO: 742193 - DNA, 22 bp, Artificial Sequence
  chemically synthesized
tctcccaaattcctgagcacac

SEQ ID NO: 742194 - DNA, 22 bp, Artificial Sequence
  chemically synthesized
tcccaaattcctgagcacacat

SEQ ID NO: 742195 - DNA, 22 bp, Artificial Sequence
  chemically synthesized
aagcaggattaatatgtgtgct

SEQ ID NO: 742196 - DNA, 22 bp, Artificial Sequence
  chemically synthesized
ccaaattcctgagcacacatat

SEQ ID NO: 742197 - DNA, 22 bp, Artificial Sequence
  chemically synthesized
ctgagcacacatattaatcctg

SEQ ID NO: 742198 - DNA, 22 bp, Artificial Sequence
  chemically synthesized
caaaacattgaagcaggattaa

SEQ ID NO: 742199 - DNA, 22 bp, Artificial Sequence
  chemically synthesized
agcacacatattaatcctgctt

SEQ ID NO: 742200 - DNA, 22 bp, Artificial Sequence
  chemically synthesized
atcctccaaaacattgaagcag

SEQ ID NO: 742201 - DNA, 22 bp, Artificial Sequence
  chemically synthesized
catcctccaaaacattgaagca

SEQ ID NO: 742202 - DNA, 22 bp, Artificial Sequence
  chemically synthesized
atcctgcttcaatgttttggag

SEQ ID NO: 742203 - DNA, 22 bp, Artificial Sequence
  chemically synthesized
aatccccttcatcctccaaaac

SEQ ID NO: 742204 - DNA, 22 bp, Artificial Sequence
  chemically synthesized
gaatccccttcatcctccaaaa

SEQ ID NO: 742205 - DNA, 22 bp, Artificial Sequence
  chemically synthesized
tgaatccccttcatcctccaaa

SEQ ID NO: 742206 - DNA, 22 bp, Artificial Sequence
  chemically synthesized
ttgaatccccttcatcctccaa

SEQ ID NO: 742207 - DNA, 22 bp, Artificial Sequence
  chemically synthesized
cttcaatgttttggaggatgaa

SEQ ID NO: 742208 - DNA, 22 bp, Artificial Sequence
  chemically synthesized
tttttgaatccccttcatcctc

SEQ ID NO: 742209 - DNA, 22 bp, Artificial Sequence
  chemically synthesized
atttttgaatccccttcatcct

SEQ ID NO: 742210 - DNA, 22 bp, Artificial Sequence
  chemically synthesized
caatgttttggaggatgaaggg

SEQ ID NO: 742211 - DNA, 22 bp, Artificial Sequence
  chemically synthesized
aatgttttggaggatgaagggg

SEQ ID NO: 742212 - DNA, 22 bp, Artificial Sequence
  chemically synthesized
tggaggatgaaggggattcaaa

SEQ ID NO: 742213 - DNA, 22 bp, Artificial Sequence
  chemically synthesized
ggaggatgaaggggattcaaaa

SEQ ID NO: 742214 - DNA, 22 bp, Artificial Sequence
  chemically synthesized
gaggatgaaggggattcaaaaa

SEQ ID NO: 742215 - DNA, 22 bp, Artificial Sequence
  chemically synthesized
tgagtaccaaaacttatttttg

SEQ ID NO: 742216 - DNA, 22 bp, Artificial Sequence
  chemically synthesized
attatgagtaccaaaacttatt

SEQ ID NO: 742217 - DNA, 22 bp, Artificial Sequence
  chemically synthesized
caattaattatgagtaccaaaa

SEQ ID NO: 742218 - DNA, 22 bp, Artificial Sequence
  chemically synthesized
aaaaataagttttggtactcat

SEQ ID NO: 742219 - DNA, 22 bp, Artificial Sequence
  chemically synthesized
tggtactcataattaattgcaa

SEQ ID NO: 742220 - DNA, 22 bp, Artificial Sequence
  chemically synthesized
ggtactcataattaattgcaat

SEQ ID NO: 742221 - DNA, 22 bp, Artificial Sequence
  chemically synthesized
gtactcataattaattgcaatg

SEQ ID NO: 742222 - DNA, 22 bp, Artificial Sequence
  chemically synthesized
ataattaattgcaatgctctcc

SEQ ID NO: 742223 - DNA, 22 bp, Artificial Sequence
  chemically synthesized
attgcaatgctctcccttttcc

SEQ ID NO: 742224 - DNA, 22 bp, Artificial Sequence
  chemically synthesized
caatgctctcccttttcctctt

SEQ ID NO: 742225 - DNA, 22 bp, Artificial Sequence
  chemically synthesized
aaaagaaaaaaaaagaggaaaa

SEQ ID NO: 742226 - DNA, 22 bp, Artificial Sequence
  chemically synthesized
aaaaagaaaaaaaaagaggaaa

SEQ ID NO: 742227 - DNA, 22 bp, Artificial Sequence
  chemically synthesized
taaaaagaaaaaaaaagaggaa

SEQ ID NO: 742228 - DNA, 22 bp, Artificial Sequence
  chemically synthesized
tcccttttcctctttttttttc

SEQ ID NO: 742229 - DNA, 22 bp, Artificial Sequence
  chemically synthesized
ccttttcctctttttttttctt

SEQ ID NO: 742230 - DNA, 22 bp, Artificial Sequence
  chemically synthesized
ttcctctttttttttcttttta

SEQ ID NO: 742231 - DNA, 22 bp, Artificial Sequence
  chemically synthesized
tcctctttttttttctttttaa

SEQ ID NO: 742232 - DNA, 22 bp, Artificial Sequence
  chemically synthesized
cctctttttttttctttttaaa

SEQ ID NO: 742233 - DNA, 22 bp, Artificial Sequence
  chemically synthesized
ctctttttttttctttttaaaa

SEQ ID NO: 742234 - DNA, 22 bp, Artificial Sequence
  chemically synthesized
tttttttttctttttaaaattt

SEQ ID NO: 742235 - DNA, 22 bp, Artificial Sequence
  chemically synthesized
aagaagaaaagtaaattttaaa

SEQ ID NO: 742236 - DNA, 22 bp, Artificial Sequence
  chemically synthesized
aaagaagaaaagtaaattttaa

SEQ ID NO: 742237 - DNA, 22 bp, Artificial Sequence
  chemically synthesized
tttttttctttttaaaatttac

SEQ ID NO: 742238 - DNA, 22 bp, Artificial Sequence
  chemically synthesized
ttttttctttttaaaatttact

SEQ ID NO: 742239 - DNA, 22 bp, Artificial Sequence
  chemically synthesized
tttttctttttaaaatttactt

SEQ ID NO: 742240 - DNA, 22 bp, Artificial Sequence
  chemically synthesized
ttttctttttaaaatttacttt

SEQ ID NO: 742241 - DNA, 22 bp, Artificial Sequence
  chemically synthesized
tttctttttaaaatttactttt

SEQ ID NO: 742242 - DNA, 22 bp, Artificial Sequence
  chemically synthesized
ttctttttaaaatttacttttc

SEQ ID NO: 742243 - DNA, 22 bp, Artificial Sequence
  chemically synthesized
tctttttaaaatttacttttct

SEQ ID NO: 742244 - DNA, 22 bp, Artificial Sequence
  chemically synthesized
ctttttaaaatttacttttctt

SEQ ID NO: 742245 - DNA, 22 bp, Artificial Sequence
  chemically synthesized
tttttaaaatttacttttcttc

SEQ ID NO: 742246 - DNA, 22 bp, Artificial Sequence
  chemically synthesized
tttaaaatttacttttcttctt

SEQ ID NO: 742247 - DNA, 22 bp, Artificial Sequence
  chemically synthesized
tggtaaagtttaaagaagaaaa

SEQ ID NO: 742248 - DNA, 22 bp, Artificial Sequence
  chemically synthesized
ttaaaatttacttttcttcttt

SEQ ID NO: 742249 - DNA, 22 bp, Artificial Sequence
  chemically synthesized
atggtaaagtttaaagaagaaa

SEQ ID NO: 742250 - DNA, 22 bp, Artificial Sequence
  chemically synthesized
taaaatttacttttcttcttta

SEQ ID NO: 742251 - DNA, 22 bp, Artificial Sequence
  chemically synthesized
aaaatttacttttcttctttaa

SEQ ID NO: 742252 - DNA, 22 bp, Artificial Sequence
  chemically synthesized
aaatttacttttcttctttaaa

SEQ ID NO: 742253 - DNA, 22 bp, Artificial Sequence
  chemically synthesized
acttttcttctttaaactttac

SEQ ID NO: 742254 - DNA, 22 bp, Artificial Sequence
  chemically synthesized
cttttcttctttaaactttacc

SEQ ID NO: 742255 - DNA, 22 bp, Artificial Sequence
  chemically synthesized
ttcttctttaaactttaccata

SEQ ID NO: 742256 - DNA, 22 bp, Artificial Sequence
  chemically synthesized
tcttctttaaactttaccataa

SEQ ID NO: 742257 - DNA, 22 bp, Artificial Sequence
  chemically synthesized
cttctttaaactttaccataag

SEQ ID NO: 742258 - DNA, 22 bp, Artificial Sequence
  chemically synthesized
ttctttaaactttaccataaga

SEQ ID NO: 742259 - DNA, 22 bp, Artificial Sequence
  chemically synthesized
ctttaaactttaccataagatc

SEQ ID NO: 742260 - DNA, 22 bp, Artificial Sequence
  chemically synthesized
tttaaactttaccataagatct

SEQ ID NO: 742261 - DNA, 22 bp, Artificial Sequence
  chemically synthesized
taaactttaccataagatcttg

SEQ ID NO: 742262 - DNA, 22 bp, Artificial Sequence
  chemically synthesized
aaactttaccataagatcttgg

SEQ ID NO: 742263 - DNA, 22 bp, Artificial Sequence
  chemically synthesized
aactttaccataagatcttggg

SEQ ID NO: 742264 - DNA, 22 bp, Artificial Sequence
  chemically synthesized
taccataagatcttgggatttt

SEQ ID NO: 742265 - DNA, 22 bp, Artificial Sequence
  chemically synthesized
accataagatcttgggattttt

SEQ ID NO: 742266 - DNA, 22 bp, Artificial Sequence
  chemically synthesized
ccataagatcttgggatttttt

SEQ ID NO: 742267 - DNA, 22 bp, Artificial Sequence
  chemically synthesized
gggatttttttttttttttttt

SEQ ID NO: 742268 - DNA, 22 bp, Artificial Sequence
  chemically synthesized
ggattttttttttttttttttt

SEQ ID NO: 742269 - DNA, 22 bp, Artificial Sequence
  chemically synthesized
aaagaagcaaaaaaaaaaaaaa

SEQ ID NO: 742270 - DNA, 22 bp, Artificial Sequence
  chemically synthesized
gaaagaagcaaaaaaaaaaaaa

SEQ ID NO: 742271 - DNA, 22 bp, Artificial Sequence
  chemically synthesized
tttttttttttttttttttttt

SEQ ID NO: 742272 - DNA, 22 bp, Artificial Sequence
  chemically synthesized
tttttttttttttttttttttt

SEQ ID NO: 742273 - DNA, 22 bp, Artificial Sequence
  chemically synthesized
cttgaaagaagcaaaaaaaaaa

SEQ ID NO: 742274 - DNA, 22 bp, Artificial Sequence
  chemically synthesized
tttttttttttttttttttttg

SEQ ID NO: 742275 - DNA, 22 bp, Artificial Sequence
  chemically synthesized
ttttttttttttttttttttgc

SEQ ID NO: 742276 - DNA, 22 bp, Artificial Sequence
  chemically synthesized
tttttttttttttttttttgct

SEQ ID NO: 742277 - DNA, 22 bp, Artificial Sequence
  chemically synthesized
ttttttttttttttttttgctt

SEQ ID NO: 742278 - DNA, 22 bp, Artificial Sequence
  chemically synthesized
tttttttttttttttttgcttc

SEQ ID NO: 742279 - DNA, 22 bp, Artificial Sequence
  chemically synthesized
ttttttttttttttttgcttct

SEQ ID NO: 742280 - DNA, 22 bp, Artificial Sequence
  chemically synthesized
tcattgcttgaaagaagcaaaa

SEQ ID NO: 742281 - DNA, 22 bp, Artificial Sequence
  chemically synthesized
tttttttttttttttgcttctt

SEQ ID NO: 742282 - DNA, 22 bp, Artificial Sequence
  chemically synthesized
ttttttttttttttgcttcttt

SEQ ID NO: 742283 - DNA, 22 bp, Artificial Sequence
  chemically synthesized
tttttttttttttgcttctttc

SEQ ID NO: 742284 - DNA, 22 bp, Artificial Sequence
  chemically synthesized
ttttttttttttgcttctttca

SEQ ID NO: 742285 - DNA, 22 bp, Artificial Sequence
  chemically synthesized
tttttttttttgcttctttcaa

SEQ ID NO: 742286 - DNA, 22 bp, Artificial Sequence
  chemically synthesized
cactatcattgcttgaaagaag

SEQ ID NO: 742287 - DNA, 22 bp, Artificial Sequence
  chemically synthesized
ttttttttttgcttctttcaag

SEQ ID NO: 742288 - DNA, 22 bp, Artificial Sequence
  chemically synthesized
ccactatcattgcttgaaagaa

SEQ ID NO: 742289 - DNA, 22 bp, Artificial Sequence
  chemically synthesized
tttttttttgcttctttcaagc

SEQ ID NO: 742290 - DNA, 22 bp, Artificial Sequence
  chemically synthesized
ttttttttgcttctttcaagca

SEQ ID NO: 742291 - DNA, 22 bp, Artificial Sequence
  chemically synthesized
tttttttgcttctttcaagcaa

SEQ ID NO: 742292 - DNA, 22 bp, Artificial Sequence
  chemically synthesized
ttttttgcttctttcaagcaat

SEQ ID NO: 742293 - DNA, 22 bp, Artificial Sequence
  chemically synthesized
tttttgcttctttcaagcaatg

SEQ ID NO: 742294 - DNA, 22 bp, Artificial Sequence
  chemically synthesized
ttttgcttctttcaagcaatga

SEQ ID NO: 742295 - DNA, 22 bp, Artificial Sequence
  chemically synthesized
tttgcttctttcaagcaatgat

SEQ ID NO: 742296 - DNA, 22 bp, Artificial Sequence
  chemically synthesized
ttgcttctttcaagcaatgata

SEQ ID NO: 742297 - DNA, 22 bp, Artificial Sequence
  chemically synthesized
tgcttctttcaagcaatgatag

SEQ ID NO: 742298 - DNA, 22 bp, Artificial Sequence
  chemically synthesized
agagaacttccactatcattgc

SEQ ID NO: 742299 - DNA, 22 bp, Artificial Sequence
  chemically synthesized
gcttctttcaagcaatgatagt

SEQ ID NO: 742300 - DNA, 22 bp, Artificial Sequence
  chemically synthesized
cttctttcaagcaatgatagtg

SEQ ID NO: 742301 - DNA, 22 bp, Artificial Sequence
  chemically synthesized
gttcagagaacttccactatca

SEQ ID NO: 742302 - DNA, 22 bp, Artificial Sequence
  chemically synthesized
ctttcaagcaatgatagtggaa

SEQ ID NO: 742303 - DNA, 22 bp, Artificial Sequence
  chemically synthesized
tttcaagcaatgatagtggaag

SEQ ID NO: 742304 - DNA, 22 bp, Artificial Sequence
  chemically synthesized
tcaagcaatgatagtggaagtt

SEQ ID NO: 742305 - DNA, 22 bp, Artificial Sequence
  chemically synthesized
caagcaatgatagtggaagttc

SEQ ID NO: 742306 - DNA, 22 bp, Artificial Sequence
  chemically synthesized
aagcaatgatagtggaagttct

SEQ ID NO: 742307 - DNA, 22 bp, Artificial Sequence
  chemically synthesized
agtggagattagttcagagaac

SEQ ID NO: 742308 - DNA, 22 bp, Artificial Sequence
  chemically synthesized
aagtggagattagttcagagaa

SEQ ID NO: 742309 - DNA, 22 bp, Artificial Sequence
  chemically synthesized
gtgagtcttaagtggagattag

SEQ ID NO: 742310 - DNA, 22 bp, Artificial Sequence
  chemically synthesized
ggtgagtcttaagtggagatta

SEQ ID NO: 742311 - DNA, 22 bp, Artificial Sequence
  chemically synthesized
atttggtgagtcttaagtggag

SEQ ID NO: 742312 - DNA, 22 bp, Artificial Sequence
  chemically synthesized
tctgaactaatctccacttaag

SEQ ID NO: 742313 - DNA, 22 bp, Artificial Sequence
  chemically synthesized
tgaactaatctccacttaagac

SEQ ID NO: 742314 - DNA, 22 bp, Artificial Sequence
  chemically synthesized
gctaatttggtgagtcttaagt

SEQ ID NO: 742315 - DNA, 22 bp, Artificial Sequence
  chemically synthesized
aactaatctccacttaagactc

SEQ ID NO: 742316 - DNA, 22 bp, Artificial Sequence
  chemically synthesized
ggctaatttggtgagtcttaag

SEQ ID NO: 742317 - DNA, 22 bp, Artificial Sequence
  chemically synthesized
tggctaatttggtgagtcttaa

SEQ ID NO: 742318 - DNA, 22 bp, Artificial Sequence
  chemically synthesized
atctccacttaagactcaccaa

SEQ ID NO: 742319 - DNA, 22 bp, Artificial Sequence
  chemically synthesized
cacttaagactcaccaaattag

SEQ ID NO: 742320 - DNA, 22 bp, Artificial Sequence
  chemically synthesized
aagactcaccaaattagccaaa

SEQ ID NO: 742321 - DNA, 22 bp, Artificial Sequence
  chemically synthesized
agactcaccaaattagccaaag

SEQ ID NO: 742322 - DNA, 22 bp, Artificial Sequence
  chemically synthesized
acaaagagaatgaagactttgg

SEQ ID NO: 742323 - DNA, 22 bp, Artificial Sequence
  chemically synthesized
cacaaagagaatgaagactttg

SEQ ID NO: 742324 - DNA, 22 bp, Artificial Sequence
  chemically synthesized
accaaattagccaaagtcttca

SEQ ID NO: 742325 - DNA, 22 bp, Artificial Sequence
  chemically synthesized
tttcacaaagagaatgaagact

SEQ ID NO: 742326 - DNA, 22 bp, Artificial Sequence
  chemically synthesized
ctgtttcacaaagagaatgaag

SEQ ID NO: 742327 - DNA, 22 bp, Artificial Sequence
  chemically synthesized
gccaaagtcttcattctctttg

SEQ ID NO: 742328 - DNA, 22 bp, Artificial Sequence
  chemically synthesized
ccatcactgctgtttcacaaag

SEQ ID NO: 742329 - DNA, 22 bp, Artificial Sequence
  chemically synthesized
cattctctttgtgaaacagcag

SEQ ID NO: 742330 - DNA, 22 bp, Artificial Sequence
  chemically synthesized
attctctttgtgaaacagcagt

SEQ ID NO: 742331 - DNA, 22 bp, Artificial Sequence
  chemically synthesized
tgagaggttcccatcactgctg

SEQ ID NO: 742332 - DNA, 22 bp, Artificial Sequence
  chemically synthesized
tctttgtgaaacagcagtgatg

SEQ ID NO: 742333 - DNA, 22 bp, Artificial Sequence
  chemically synthesized
tttgtgaaacagcagtgatggg

SEQ ID NO: 742334 - DNA, 22 bp, Artificial Sequence
  chemically synthesized
tgtgaaacagcagtgatgggaa

SEQ ID NO: 742335 - DNA, 22 bp, Artificial Sequence
  chemically synthesized
gtgaaacagcagtgatgggaac

SEQ ID NO: 742336 - DNA, 22 bp, Artificial Sequence
  chemically synthesized
aggctgtgagaggttcccatca

SEQ ID NO: 742337 - DNA, 22 bp, Artificial Sequence
  chemically synthesized
tgaaacagcagtgatgggaacc

SEQ ID NO: 742338 - DNA, 22 bp, Artificial Sequence
  chemically synthesized
ttgaggctgtgagaggttccca

SEQ ID NO: 742339 - DNA, 22 bp, Artificial Sequence
  chemically synthesized
attgaggctgtgagaggttccc

SEQ ID NO: 742340 - DNA, 22 bp, Artificial Sequence
  chemically synthesized
tattgaggctgtgagaggttcc

SEQ ID NO: 742341 - DNA, 22 bp, Artificial Sequence
  chemically synthesized
gaacattttattgaggctgtga

SEQ ID NO: 742342 - DNA, 22 bp, Artificial Sequence
  chemically synthesized
acaggcacctcgaacattttat

SEQ ID NO: 742343 - DNA, 22 bp, Artificial Sequence
  chemically synthesized
tcacagcctcaataaaatgttc

SEQ ID NO: 742344 - DNA, 22 bp, Artificial Sequence
  chemically synthesized
acagcctcaataaaatgttcga

SEQ ID NO: 742345 - DNA, 22 bp, Artificial Sequence
  chemically synthesized
aataaaatgttcgaggtgcctg

SEQ ID NO: 742346 - DNA, 22 bp, Artificial Sequence
  chemically synthesized
gaggtgcctgtcagtatgtgtg

SEQ ID NO: 742347 - DNA, 22 bp, Artificial Sequence
  chemically synthesized
atgggagcagaaggtccacaca

SEQ ID NO: 742348 - DNA, 22 bp, Artificial Sequence
  chemically synthesized
tcagtatgtgtggaccttctgc

SEQ ID NO: 742349 - DNA, 22 bp, Artificial Sequence
  chemically synthesized
taacaagtcaactgatgggagc

SEQ ID NO: 742350 - DNA, 22 bp, Artificial Sequence
  chemically synthesized
acggttgtaacaagtcaactga

SEQ ID NO: 742351 - DNA, 22 bp, Artificial Sequence
  chemically synthesized
ctgctcccatcagttgacttgt

SEQ ID NO: 742352 - DNA, 22 bp, Artificial Sequence
  chemically synthesized
tgctcccatcagttgacttgtt

SEQ ID NO: 742353 - DNA, 22 bp, Artificial Sequence
  chemically synthesized
ctcccatcagttgacttgttac

SEQ ID NO: 742354 - DNA, 22 bp, Artificial Sequence
  chemically synthesized
ccatcagttgacttgttacaac

SEQ ID NO: 742355 - DNA, 22 bp, Artificial Sequence
  chemically synthesized
agaacatacacacaactgacgg

SEQ ID NO: 742356 - DNA, 22 bp, Artificial Sequence
  chemically synthesized
acttgttacaaccgtcagttgt

SEQ ID NO: 742357 - DNA, 22 bp, Artificial Sequence
  chemically synthesized
gagaacatacacacaactgacg

SEQ ID NO: 742358 - DNA, 22 bp, Artificial Sequence
  chemically synthesized
gttacaaccgtcagttgtgtgt

SEQ ID NO: 742359 - DNA, 22 bp, Artificial Sequence
  chemically synthesized
ttacaaccgtcagttgtgtgta

SEQ ID NO: 742360 - DNA, 22 bp, Artificial Sequence
  chemically synthesized
caaccgtcagttgtgtgtatgt

SEQ ID NO: 742361 - DNA, 22 bp, Artificial Sequence
  chemically synthesized
gcaaagataggtttgagaacat

SEQ ID NO: 742362 - DNA, 22 bp, Artificial Sequence
  chemically synthesized
ctggcaaagataggtttgagaa

SEQ ID NO: 742363 - DNA, 22 bp, Artificial Sequence
  chemically synthesized
tgtgtatgttctcaaacctatc

SEQ ID NO: 742364 - DNA, 22 bp, Artificial Sequence
  chemically synthesized
tcaaacctatctttgccagtaa

SEQ ID NO: 742365 - DNA, 22 bp, Artificial Sequence
  chemically synthesized
aaacctatctttgccagtaact

SEQ ID NO: 742366 - DNA, 22 bp, Artificial Sequence
  chemically synthesized
cataatcacaacagttactggc

SEQ ID NO: 742367 - DNA, 22 bp, Artificial Sequence
  chemically synthesized
aattacataatcacaacagtta

SEQ ID NO: 742368 - DNA, 22 bp, Artificial Sequence
  chemically synthesized
tctttgccagtaactgttgtga

SEQ ID NO: 742369 - DNA, 22 bp, Artificial Sequence
  chemically synthesized
ttaaattacataatcacaacag

SEQ ID NO: 742370 - DNA, 22 bp, Artificial Sequence
  chemically synthesized
attaaattacataatcacaaca

SEQ ID NO: 742371 - DNA, 22 bp, Artificial Sequence
  chemically synthesized
tattaaattacataatcacaac

SEQ ID NO: 742372 - DNA, 22 bp, Artificial Sequence
  chemically synthesized
tgccagtaactgttgtgattat

SEQ ID NO: 742373 - DNA, 22 bp, Artificial Sequence
  chemically synthesized
gccagtaactgttgtgattatg

SEQ ID NO: 742374 - DNA, 22 bp, Artificial Sequence
  chemically synthesized
tttattaaattacataatcaca

SEQ ID NO: 742375 - DNA, 22 bp, Artificial Sequence
  chemically synthesized
ccagtaactgttgtgattatgt

SEQ ID NO: 742376 - DNA, 22 bp, Artificial Sequence
  chemically synthesized
ctttattaaattacataatcac

SEQ ID NO: 742377 - DNA, 22 bp, Artificial Sequence
  chemically synthesized
tctttattaaattacataatca

SEQ ID NO: 742378 - DNA, 22 bp, Artificial Sequence
  chemically synthesized
ttgtgattatgtaatttaataa

SEQ ID NO: 742379 - DNA, 22 bp, Artificial Sequence
  chemically synthesized
ggaaatctttctttattaaatt

SEQ ID NO: 742380 - DNA, 22 bp, Artificial Sequence
  chemically synthesized
aggaaatctttctttattaaat

SEQ ID NO: 742381 - DNA, 22 bp, Artificial Sequence
  chemically synthesized
tgattatgtaatttaataaaga

SEQ ID NO: 742382 - DNA, 22 bp, Artificial Sequence
  chemically synthesized
tgatttaggaaatctttcttta

SEQ ID NO: 742383 - DNA, 22 bp, Artificial Sequence
  chemically synthesized
atgatttaggaaatctttcttt

SEQ ID NO: 742384 - DNA, 22 bp, Artificial Sequence
  chemically synthesized
tgtaatttaataaagaaagatt

SEQ ID NO: 742385 - DNA, 22 bp, Artificial Sequence
  chemically synthesized
tatgatttaggaaatctttctt

SEQ ID NO: 742386 - DNA, 22 bp, Artificial Sequence
  chemically synthesized
ttatgatttaggaaatctttct

SEQ ID NO: 742387 - DNA, 22 bp, Artificial Sequence
  chemically synthesized
atatttttatgatttaggaaat

SEQ ID NO: 742388 - DNA, 22 bp, Artificial Sequence
  chemically synthesized
aataaagaaagatttcctaaat

SEQ ID NO: 742389 - DNA, 22 bp, Artificial Sequence
  chemically synthesized
ataaagaaagatttcctaaatc

SEQ ID NO: 742390 - DNA, 22 bp, Artificial Sequence
  chemically synthesized
aactaatatttttatgatttag

SEQ ID NO: 742391 - DNA, 22 bp, Artificial Sequence
  chemically synthesized
aaactaatatttttatgattta

SEQ ID NO: 742392 - DNA, 22 bp, Artificial Sequence
  chemically synthesized
taaactaatatttttatgattt

SEQ ID NO: 742393 - DNA, 22 bp, Artificial Sequence
  chemically synthesized
ttaaactaatatttttatgatt

SEQ ID NO: 742394 - DNA, 22 bp, Artificial Sequence
  chemically synthesized
tttaaactaatatttttatgat

SEQ ID NO: 742395 - DNA, 22 bp, Artificial Sequence
  chemically synthesized
tttttaaactaatatttttatg

SEQ ID NO: 742396 - DNA, 22 bp, Artificial Sequence
  chemically synthesized
ctttttaaactaatatttttat

SEQ ID NO: 742397 - DNA, 22 bp, Artificial Sequence
  chemically synthesized
tctttttaaactaatattttta

SEQ ID NO: 742398 - DNA, 22 bp, Artificial Sequence
  chemically synthesized
ttctttttaaactaatattttt

SEQ ID NO: 742399 - DNA, 22 bp, Artificial Sequence
  chemically synthesized
cctaaatcataaaaatattagt

SEQ ID NO: 742400 - DNA, 22 bp, Artificial Sequence
  chemically synthesized
ttttctttttaaactaatattt

SEQ ID NO: 742401 - DNA, 22 bp, Artificial Sequence
  chemically synthesized
ctaaatcataaaaatattagtt

SEQ ID NO: 742402 - DNA, 22 bp, Artificial Sequence
  chemically synthesized
cttttctttttaaactaatatt

SEQ ID NO: 742403 - DNA, 22 bp, Artificial Sequence
  chemically synthesized
tcttttctttttaaactaatat

SEQ ID NO: 742404 - DNA, 22 bp, Artificial Sequence
  chemically synthesized
ttcttttctttttaaactaata

SEQ ID NO: 742405 - DNA, 22 bp, Artificial Sequence
  chemically synthesized
aatcataaaaatattagtttaa

SEQ ID NO: 742406 - DNA, 22 bp, Artificial Sequence
  chemically synthesized
tttcttttctttttaaactaat

SEQ ID NO: 742407 - DNA, 22 bp, Artificial Sequence
  chemically synthesized
ttttcttttctttttaaactaa

SEQ ID NO: 742408 - DNA, 22 bp, Artificial Sequence
  chemically synthesized
gtttaaaaagaaaagaaaaaag

SEQ ID NO: 742409 - DNA, 22 bp, Artificial Sequence
  chemically synthesized
tagaaataataacttttttctt

SEQ ID NO: 742410 - DNA, 22 bp, Artificial Sequence
  chemically synthesized
atagaaataataacttttttct

SEQ ID NO: 742411 - DNA, 22 bp, Artificial Sequence
  chemically synthesized
tatagaaataataacttttttc

SEQ ID NO: 742412 - DNA, 22 bp, Artificial Sequence
  chemically synthesized
ttatagaaataataactttttt

SEQ ID NO: 742413 - DNA, 22 bp, Artificial Sequence
  chemically synthesized
aaaaagaaaagaaaaaagttat

SEQ ID NO: 742414 - DNA, 22 bp, Artificial Sequence
  chemically synthesized
aaaagaaaagaaaaaagttatt

SEQ ID NO: 742415 - DNA, 22 bp, Artificial Sequence
  chemically synthesized
gtttttatagaaataataactt

SEQ ID NO: 742416 - DNA, 22 bp, Artificial Sequence
  chemically synthesized
gcctggtttttatagaaataat

SEQ ID NO: 742417 - DNA, 22 bp, Artificial Sequence
  chemically synthesized
ggcctggtttttatagaaataa

SEQ ID NO: 742418 - DNA, 22 bp, Artificial Sequence
  chemically synthesized
cagagtatttggcctggttttt

SEQ ID NO: 742419 - DNA, 22 bp, Artificial Sequence
  chemically synthesized
ttatttctataaaaaccaggcc

SEQ ID NO: 742420 - DNA, 22 bp, Artificial Sequence
  chemically synthesized
tccagagtatttggcctggttt

SEQ ID NO: 742421 - DNA, 22 bp, Artificial Sequence
  chemically synthesized
tttctataaaaaccaggccaaa

SEQ ID NO: 742422 - DNA, 22 bp, Artificial Sequence
  chemically synthesized
ctataaaaaccaggccaaatac

SEQ ID NO: 742423 - DNA, 22 bp, Artificial Sequence
  chemically synthesized
tataaaaaccaggccaaatact

SEQ ID NO: 742424 - DNA, 22 bp, Artificial Sequence
  chemically synthesized
taaaaaccaggccaaatactct

SEQ ID NO: 742425 - DNA, 22 bp, Artificial Sequence
  chemically synthesized
aagcaactctccagagtatttg

SEQ ID NO: 742426 - DNA, 22 bp, Artificial Sequence
  chemically synthesized
gaagcaactctccagagtattt

SEQ ID NO: 742427 - DNA, 22 bp, Artificial Sequence
  chemically synthesized
tgaagcaactctccagagtatt

SEQ ID NO: 742428 - DNA, 22 bp, Artificial Sequence
  chemically synthesized
ttgaagcaactctccagagtat

SEQ ID NO: 742429 - DNA, 22 bp, Artificial Sequence
  chemically synthesized
tttgaagcaactctccagagta

SEQ ID NO: 742430 - DNA, 22 bp, Artificial Sequence
  chemically synthesized
tttttgaagcaactctccagag

SEQ ID NO: 742431 - DNA, 22 bp, Artificial Sequence
  chemically synthesized
ctttttgaagcaactctccaga

SEQ ID NO: 742432 - DNA, 22 bp, Artificial Sequence
  chemically synthesized
tctttttgaagcaactctccag

SEQ ID NO: 742433 - DNA, 22 bp, Artificial Sequence
  chemically synthesized
ttctttttgaagcaactctcca

SEQ ID NO: 742434 - DNA, 22 bp, Artificial Sequence
  chemically synthesized
tttctttttgaagcaactctcc

SEQ ID NO: 742435 - DNA, 22 bp, Artificial Sequence
  chemically synthesized
tttttctttttgaagcaactct

SEQ ID NO: 742436 - DNA, 22 bp, Artificial Sequence
  chemically synthesized
ctttttctttttgaagcaactc

SEQ ID NO: 742437 - DNA, 22 bp, Artificial Sequence
  chemically synthesized
tctttttctttttgaagcaact

SEQ ID NO: 742438 - DNA, 22 bp, Artificial Sequence
  chemically synthesized
ttttctttttctttttgaagca

SEQ ID NO: 742439 - DNA, 22 bp, Artificial Sequence
  chemically synthesized
attttctttttctttttgaagc

SEQ ID NO: 742440 - DNA, 22 bp, Artificial Sequence
  chemically synthesized
tggagagttgcttcaaaaagaa

SEQ ID NO: 742441 - DNA, 22 bp, Artificial Sequence
  chemically synthesized
gagagttgcttcaaaaagaaaa

SEQ ID NO: 742442 - DNA, 22 bp, Artificial Sequence
  chemically synthesized
aacaatatttattttctttttc

SEQ ID NO: 742443 - DNA, 22 bp, Artificial Sequence
  chemically synthesized
caacaatatttattttcttttt

SEQ ID NO: 742444 - DNA, 22 bp, Artificial Sequence
  chemically synthesized
cttcaaaaagaaaaagaaaata

SEQ ID NO: 742445 - DNA, 22 bp, Artificial Sequence
  chemically synthesized
cttcaacaatatttattttctt

SEQ ID NO: 742446 - DNA, 22 bp, Artificial Sequence
  chemically synthesized
caaaaagaaaaagaaaataaat

SEQ ID NO: 742447 - DNA, 22 bp, Artificial Sequence
  chemically synthesized
aaaaagaaaaagaaaataaata

SEQ ID NO: 742448 - DNA, 22 bp, Artificial Sequence
  chemically synthesized
acaactacttcaacaatattta

SEQ ID NO: 742449 - DNA, 22 bp, Artificial Sequence
  chemically synthesized
ttcacaactacttcaacaatat

SEQ ID NO: 742450 - DNA, 22 bp, Artificial Sequence
  chemically synthesized
gttcacaactacttcaacaata

SEQ ID NO: 742451 - DNA, 22 bp, Artificial Sequence
  chemically synthesized
tcttgttcacaactacttcaac

SEQ ID NO: 742452 - DNA, 22 bp, Artificial Sequence
  chemically synthesized
gcagttgtcttgttcacaacta

SEQ ID NO: 742453 - DNA, 22 bp, Artificial Sequence
  chemically synthesized
agcagttgtcttgttcacaact

SEQ ID NO: 742454 - DNA, 22 bp, Artificial Sequence
  chemically synthesized
tagcagttgtcttgttcacaac

SEQ ID NO: 742455 - DNA, 22 bp, Artificial Sequence
  chemically synthesized
ttgaagtagttgtgaacaagac

SEQ ID NO: 742456 - DNA, 22 bp, Artificial Sequence
  chemically synthesized
atctttagcagttgtcttgttc

SEQ ID NO: 742457 - DNA, 22 bp, Artificial Sequence
  chemically synthesized
catctttagcagttgtcttgtt

SEQ ID NO: 742458 - DNA, 22 bp, Artificial Sequence
  chemically synthesized
aagtagttgtgaacaagacaac

SEQ ID NO: 742459 - DNA, 22 bp, Artificial Sequence
  chemically synthesized
ttcatctttagcagttgtcttg

SEQ ID NO: 742460 - DNA, 22 bp, Artificial Sequence
  chemically synthesized
cttcatctttagcagttgtctt

SEQ ID NO: 742461 - DNA, 22 bp, Artificial Sequence
  chemically synthesized
tcttcatctttagcagttgtct

SEQ ID NO: 742462 - DNA, 22 bp, Artificial Sequence
  chemically synthesized
ttttcttcatctttagcagttg

SEQ ID NO: 742463 - DNA, 22 bp, Artificial Sequence
  chemically synthesized
tgaacaagacaactgctaaaga

SEQ ID NO: 742464 - DNA, 22 bp, Artificial Sequence
  chemically synthesized
ggttgttttcttcatctttagc

SEQ ID NO: 742465 - DNA, 22 bp, Artificial Sequence
  chemically synthesized
gtctgggttgttttcttcatct

SEQ ID NO: 742466 - DNA, 22 bp, Artificial Sequence
  chemically synthesized
ctaaagatgaagaaaacaaccc

SEQ ID NO: 742467 - DNA, 22 bp, Artificial Sequence
  chemically synthesized
aagatgaagaaaacaacccaga

SEQ ID NO: 742468 - DNA, 22 bp, Artificial Sequence
  chemically synthesized
agccaccccacctggtctgggt

SEQ ID NO: 742469 - DNA, 22 bp, Artificial Sequence
  chemically synthesized
gagccaccccacctggtctggg

SEQ ID NO: 742470 - DNA, 22 bp, Artificial Sequence
  chemically synthesized
cagtcttgagccaccccacctg

SEQ ID NO: 742471 - DNA, 22 bp, Artificial Sequence
  chemically synthesized
ggattacagtcttgagccaccc

SEQ ID NO: 742472 - DNA, 22 bp, Artificial Sequence
  chemically synthesized
ccaaagtgctgggattacagtc

SEQ ID NO: 742473 - DNA, 22 bp, Artificial Sequence
  chemically synthesized
agcctcccaaagtgctgggatt

SEQ ID NO: 742474 - DNA, 22 bp, Artificial Sequence
  chemically synthesized
aagactgtaatcccagcacttt

SEQ ID NO: 742475 - DNA, 22 bp, Artificial Sequence
  chemically synthesized
taatcccagcactttgggaggc

SEQ ID NO: 742476 - DNA, 22 bp, Artificial Sequence
  chemically synthesized
tgggaggctgaggtgggtggat

SEQ ID NO: 742477 - DNA, 22 bp, Artificial Sequence
  chemically synthesized
gggaggctgaggtgggtggatg

SEQ ID NO: 742478 - DNA, 22 bp, Artificial Sequence
  chemically synthesized
aagtgatccacccatccaccca

SEQ ID NO: 742479 - DNA, 22 bp, Artificial Sequence
  chemically synthesized
ggaggctgaggtgggtggatgg

SEQ ID NO: 742480 - DNA, 22 bp, Artificial Sequence
  chemically synthesized
acctcaagtgatccacccatcc

SEQ ID NO: 742481 - DNA, 22 bp, Artificial Sequence
  chemically synthesized
ctgacctcaagtgatccaccca

SEQ ID NO: 742482 - DNA, 22 bp, Artificial Sequence
  chemically synthesized
aggtgggtggatgggtggatca

SEQ ID NO: 742483 - DNA, 22 bp, Artificial Sequence
  chemically synthesized
gaactgctgacctcaagtgatc

SEQ ID NO: 742484 - DNA, 22 bp, Artificial Sequence
  chemically synthesized
gtctcgaactgctgacctcaag

SEQ ID NO: 742485 - DNA, 22 bp, Artificial Sequence
  chemically synthesized
gccagtctggtctcgaactgct

SEQ ID NO: 742486 - DNA, 22 bp, Artificial Sequence
  chemically synthesized
gaggtcagcagttcgagaccag

SEQ ID NO: 742487 - DNA, 22 bp, Artificial Sequence
  chemically synthesized
aggtcagcagttcgagaccaga

SEQ ID NO: 742488 - DNA, 22 bp, Artificial Sequence
  chemically synthesized
accatgttggccagtctggtct

SEQ ID NO: 742489 - DNA, 22 bp, Artificial Sequence
  chemically synthesized
caccatgttggccagtctggtc

SEQ ID NO: 742490 - DNA, 22 bp, Artificial Sequence
  chemically synthesized
gagaccagactggccaacatgg

SEQ ID NO: 742491 - DNA, 22 bp, Artificial Sequence
  chemically synthesized
gtagagacagggtttcaccatg

SEQ ID NO: 742492 - DNA, 22 bp, Artificial Sequence
  chemically synthesized
agtagagacagggtttcaccat

SEQ ID NO: 742493 - DNA, 22 bp, Artificial Sequence
  chemically synthesized
tagtagagacagggtttcacca

SEQ ID NO: 742494 - DNA, 22 bp, Artificial Sequence
  chemically synthesized
gccaacatggtgaaaccctgtc

SEQ ID NO: 742495 - DNA, 22 bp, Artificial Sequence
  chemically synthesized
tatctttagtagagacagggtt

SEQ ID NO: 742496 - DNA, 22 bp, Artificial Sequence
  chemically synthesized
gtatctttagtagagacagggt

SEQ ID NO: 742497 - DNA, 22 bp, Artificial Sequence
  chemically synthesized
tgtatctttagtagagacaggg

SEQ ID NO: 742498 - DNA, 22 bp, Artificial Sequence
  chemically synthesized
ttgtatctttagtagagacagg

SEQ ID NO: 742499 - DNA, 22 bp, Artificial Sequence
  chemically synthesized
tctctactaaagatacaaaaat

SEQ ID NO: 742500 - DNA, 22 bp, Artificial Sequence
  chemically synthesized
tactaaagatacaaaaattatt

SEQ ID NO: 742501 - DNA, 22 bp, Artificial Sequence
  chemically synthesized
ctaaagatacaaaaattattcg

SEQ ID NO: 742502 - DNA, 22 bp, Artificial Sequence
  chemically synthesized
aagatacaaaaattattcgggc

SEQ ID NO: 742503 - DNA, 22 bp, Artificial Sequence
  chemically synthesized
caggcatgtgccaccacgcccg

SEQ ID NO: 742504 - DNA, 22 bp, Artificial Sequence
  chemically synthesized
gtactacaggcatgtgccacca

SEQ ID NO: 742505 - DNA, 22 bp, Artificial Sequence
  chemically synthesized
ttcgggcgtggtggcacatgcc

SEQ ID NO: 742506 - DNA, 22 bp, Artificial Sequence
  chemically synthesized
gggcgtggtggcacatgcctgt

SEQ ID NO: 742507 - DNA, 22 bp, Artificial Sequence
  chemically synthesized
agtagctggtactacaggcatg

SEQ ID NO: 742508 - DNA, 22 bp, Artificial Sequence
  chemically synthesized
agccccctgagtagctggtact

SEQ ID NO: 742509 - DNA, 22 bp, Artificial Sequence
  chemically synthesized
atgcctcagccccctgagtagc

SEQ ID NO: 742510 - DNA, 22 bp, Artificial Sequence
  chemically synthesized
tcatgcctcagccccctgagta

SEQ ID NO: 742511 - DNA, 22 bp, Artificial Sequence
  chemically synthesized
ctcatgcctcagccccctgagt

SEQ ID NO: 742512 - DNA, 22 bp, Artificial Sequence
  chemically synthesized
tagtaccagctactcagggggc

SEQ ID NO: 742513 - DNA, 22 bp, Artificial Sequence
  chemically synthesized
aagcgcttctcatgcctcagcc

SEQ ID NO: 742514 - DNA, 22 bp, Artificial Sequence
  chemically synthesized
ctcagggggctgaggcatgaga

SEQ ID NO: 742515 - DNA, 22 bp, Artificial Sequence
  chemically synthesized
agggggctgaggcatgagaagc

SEQ ID NO: 742516 - DNA, 22 bp, Artificial Sequence
  chemically synthesized
ccaggttcaagcgcttctcatg

SEQ ID NO: 742517 - DNA, 22 bp, Artificial Sequence
  chemically synthesized
cacctcccaggttcaagcgctt

SEQ ID NO: 742518 - DNA, 22 bp, Artificial Sequence
  chemically synthesized
aggcatgagaagcgcttgaacc

SEQ ID NO: 742519 - DNA, 22 bp, Artificial Sequence
  chemically synthesized
caacctccacctcccaggttca

SEQ ID NO: 742520 - DNA, 22 bp, Artificial Sequence
  chemically synthesized
actgcaacctccacctcccagg

SEQ ID NO: 742521 - DNA, 22 bp, Artificial Sequence
  chemically synthesized
gctcactgcaacctccacctcc

SEQ ID NO: 742522 - DNA, 22 bp, Artificial Sequence
  chemically synthesized
ggctcactgcaacctccacctc

SEQ ID NO: 742523 - DNA, 22 bp, Artificial Sequence
  chemically synthesized
gaacctgggaggtggaggttgc

SEQ ID NO: 742524 - DNA, 22 bp, Artificial Sequence
  chemically synthesized
aacctgggaggtggaggttgca

SEQ ID NO: 742525 - DNA, 22 bp, Artificial Sequence
  chemically synthesized
ggaggtggaggttgcagtgagc

SEQ ID NO: 742526 - DNA, 22 bp, Artificial Sequence
  chemically synthesized
gagtgagtgcagtggtgccatc

SEQ ID NO: 742527 - DNA, 22 bp, Artificial Sequence
  chemically synthesized
cagtgagccaagatggcaccac

SEQ ID NO: 742528 - DNA, 22 bp, Artificial Sequence
  chemically synthesized
ggtcacccaggctggagtgagt

SEQ ID NO: 742529 - DNA, 22 bp, Artificial Sequence
  chemically synthesized
ctgggtcacccaggctggagtg

SEQ ID NO: 742530 - DNA, 22 bp, Artificial Sequence
  chemically synthesized
gctgggtcacccaggctggagt

SEQ ID NO: 742531 - DNA, 22 bp, Artificial Sequence
  chemically synthesized
cactcactccagcctgggtgac

SEQ ID NO: 742532 - DNA, 22 bp, Artificial Sequence
  chemically synthesized
actccagcctgggtgacccagc

SEQ ID NO: 742533 - DNA, 22 bp, Artificial Sequence
  chemically synthesized
gagacagagtcttgctgggtca

SEQ ID NO: 742534 - DNA, 22 bp, Artificial Sequence
  chemically synthesized
ggagacagagtcttgctgggtc

SEQ ID NO: 742535 - DNA, 22 bp, Artificial Sequence
  chemically synthesized
tggagacagagtcttgctgggt

SEQ ID NO: 742536 - DNA, 22 bp, Artificial Sequence
  chemically synthesized
cagcctgggtgacccagcaaga

SEQ ID NO: 742537 - DNA, 22 bp, Artificial Sequence
  chemically synthesized
ttggagacagagtcttgctggg

SEQ ID NO: 742538 - DNA, 22 bp, Artificial Sequence
  chemically synthesized
tttggagacagagtcttgctgg

SEQ ID NO: 742539 - DNA, 22 bp, Artificial Sequence
  chemically synthesized
ttttggagacagagtcttgctg

SEQ ID NO: 742540 - DNA, 22 bp, Artificial Sequence
  chemically synthesized
tttttggagacagagtcttgct

SEQ ID NO: 742541 - DNA, 22 bp, Artificial Sequence
  chemically synthesized
ttttttggagacagagtcttgc

SEQ ID NO: 742542 - DNA, 22 bp, Artificial Sequence
  chemically synthesized
tttttttggagacagagtcttg

SEQ ID NO: 742543 - DNA, 22 bp, Artificial Sequence
  chemically synthesized
ttttttttggagacagagtctt

SEQ ID NO: 742544 - DNA, 22 bp, Artificial Sequence
  chemically synthesized
ggtgacccagcaagactctgtc

SEQ ID NO: 742545 - DNA, 22 bp, Artificial Sequence
  chemically synthesized
tttttttttggagacagagtct

SEQ ID NO: 742546 - DNA, 22 bp, Artificial Sequence
  chemically synthesized
ttttttttttggagacagagtc

SEQ ID NO: 742547 - DNA, 22 bp, Artificial Sequence
  chemically synthesized
tttttttttttggagacagagt

SEQ ID NO: 742548 - DNA, 22 bp, Artificial Sequence
  chemically synthesized
ttttttttttttggagacagag

SEQ ID NO: 742549 - DNA, 22 bp, Artificial Sequence
  chemically synthesized
tttttttttttttggagacaga

SEQ ID NO: 742550 - DNA, 22 bp, Artificial Sequence
  chemically synthesized
ttttttttttttttggagacag

SEQ ID NO: 742551 - DNA, 22 bp, Artificial Sequence
  chemically synthesized
tttttttttttttttggagaca

SEQ ID NO: 742552 - DNA, 22 bp, Artificial Sequence
  chemically synthesized
ttttttttttttttttggagac

SEQ ID NO: 742553 - DNA, 22 bp, Artificial Sequence
  chemically synthesized
tttttttttttttttttggaga

SEQ ID NO: 742554 - DNA, 22 bp, Artificial Sequence
  chemically synthesized
ttttttttttttttttttggag

SEQ ID NO: 742555 - DNA, 22 bp, Artificial Sequence
  chemically synthesized
tttttttttttttttttttgga

SEQ ID NO: 742556 - DNA, 22 bp, Artificial Sequence
  chemically synthesized
ttttttttttttttttttttgg

SEQ ID NO: 742557 - DNA, 22 bp, Artificial Sequence
  chemically synthesized
tttttttttttttttttttttt

SEQ ID NO: 742558 - DNA, 22 bp, Artificial Sequence
  chemically synthesized
cttttttttttttttttttttt

SEQ ID NO: 742559 - DNA, 22 bp, Artificial Sequence
  chemically synthesized
tctttttttttttttttttttt

SEQ ID NO: 742560 - DNA, 22 bp, Artificial Sequence
  chemically synthesized
ttcttttttttttttttttttt

SEQ ID NO: 742561 - DNA, 22 bp, Artificial Sequence
  chemically synthesized
tttctttttttttttttttttt

SEQ ID NO: 742562 - DNA, 22 bp, Artificial Sequence
  chemically synthesized
tgtctccaaaaaaaaaaaaaaa

SEQ ID NO: 742563 - DNA, 22 bp, Artificial Sequence
  chemically synthesized
tctccaaaaaaaaaaaaaaaaa

SEQ ID NO: 742564 - DNA, 22 bp, Artificial Sequence
  chemically synthesized
gcattttttctttttttttttt

SEQ ID NO: 742565 - DNA, 22 bp, Artificial Sequence
  chemically synthesized
caaaaaaaaaaaaaaaaaaaaa

SEQ ID NO: 742566 - DNA, 22 bp, Artificial Sequence
  chemically synthesized
ggcattttttcttttttttttt

SEQ ID NO: 742567 - DNA, 22 bp, Artificial Sequence
  chemically synthesized
aatatttggcattttttctttt

SEQ ID NO: 742568 - DNA, 22 bp, Artificial Sequence
  chemically synthesized
aactgaatatttggcatttttt

SEQ ID NO: 742569 - DNA, 22 bp, Artificial Sequence
  chemically synthesized
agattaaactgaatatttggca

SEQ ID NO: 742570 - DNA, 22 bp, Artificial Sequence
  chemically synthesized
ggaattcagattaaactgaata

SEQ ID NO: 742571 - DNA, 22 bp, Artificial Sequence
  chemically synthesized
aggaattcagattaaactgaat

SEQ ID NO: 742572 - DNA, 22 bp, Artificial Sequence
  chemically synthesized
acagaaatttaggaattcagat

SEQ ID NO: 742573 - DNA, 22 bp, Artificial Sequence
  chemically synthesized
aacagaaatttaggaattcaga

SEQ ID NO: 742574 - DNA, 22 bp, Artificial Sequence
  chemically synthesized
taacagaaatttaggaattcag

SEQ ID NO: 742575 - DNA, 22 bp, Artificial Sequence
  chemically synthesized
agtttaatctgaattcctaaat

SEQ ID NO: 742576 - DNA, 22 bp, Artificial Sequence
  chemically synthesized
aatctgaattcctaaatttctg

SEQ ID NO: 742577 - DNA, 22 bp, Artificial Sequence
  chemically synthesized
atctgaattcctaaatttctgt

SEQ ID NO: 742578 - DNA, 22 bp, Artificial Sequence
  chemically synthesized
tcaaatattttaacagaaattt

SEQ ID NO: 742579 - DNA, 22 bp, Artificial Sequence
  chemically synthesized
aattcctaaatttctgttaaaa

SEQ ID NO: 742580 - DNA, 22 bp, Artificial Sequence
  chemically synthesized
cattgtcaaatattttaacaga

SEQ ID NO: 742581 - DNA, 22 bp, Artificial Sequence
  chemically synthesized
ccattgtcaaatattttaacag

SEQ ID NO: 742582 - DNA, 22 bp, Artificial Sequence
  chemically synthesized
ctaaatttctgttaaaatattt

SEQ ID NO: 742583 - DNA, 22 bp, Artificial Sequence
  chemically synthesized
aatttctgttaaaatatttgac

SEQ ID NO: 742584 - DNA, 22 bp, Artificial Sequence
  chemically synthesized
ctgttaaaatatttgacaatgg

SEQ ID NO: 742585 - DNA, 22 bp, Artificial Sequence
  chemically synthesized
tgttaaaatatttgacaatgga

SEQ ID NO: 742586 - DNA, 22 bp, Artificial Sequence
  chemically synthesized
ttaaaatatttgacaatggaag

SEQ ID NO: 742587 - DNA, 22 bp, Artificial Sequence
  chemically synthesized
acaccagtcaaagcttccattg

SEQ ID NO: 742588 - DNA, 22 bp, Artificial Sequence
  chemically synthesized
aaatatttgacaatggaagctt

SEQ ID NO: 742589 - DNA, 22 bp, Artificial Sequence
  chemically synthesized
acctcacaccagtcaaagcttc

SEQ ID NO: 742590 - DNA, 22 bp, Artificial Sequence
  chemically synthesized
gacaatggaagctttgactggt

SEQ ID NO: 742591 - DNA, 22 bp, Artificial Sequence
  chemically synthesized
acaatggaagctttgactggtg

SEQ ID NO: 742592 - DNA, 22 bp, Artificial Sequence
  chemically synthesized
tcaactgacctcacaccagtca

SEQ ID NO: 742593 - DNA, 22 bp, Artificial Sequence
  chemically synthesized
atcaactgacctcacaccagtc

SEQ ID NO: 742594 - DNA, 22 bp, Artificial Sequence
  chemically synthesized
tttatcaactgacctcacacca

SEQ ID NO: 742595 - DNA, 22 bp, Artificial Sequence
  chemically synthesized
tctgtttatcaactgacctcac

SEQ ID NO: 742596 - DNA, 22 bp, Artificial Sequence
  chemically synthesized
tgactggtgtgaggtcagttga

SEQ ID NO: 742597 - DNA, 22 bp, Artificial Sequence
  chemically synthesized
gactggtgtgaggtcagttgat

SEQ ID NO: 742598 - DNA, 22 bp, Artificial Sequence
  chemically synthesized
actggtgtgaggtcagttgata

SEQ ID NO: 742599 - DNA, 22 bp, Artificial Sequence
  chemically synthesized
gtgtgaggtcagttgataaaca

SEQ ID NO: 742600 - DNA, 22 bp, Artificial Sequence
  chemically synthesized
cccccagttatctgtttatcaa

SEQ ID NO: 742601 - DNA, 22 bp, Artificial Sequence
  chemically synthesized
gcccccagttatctgtttatca

SEQ ID NO: 742602 - DNA, 22 bp, Artificial Sequence
  chemically synthesized
tgcccccagttatctgtttatc

SEQ ID NO: 742603 - DNA, 22 bp, Artificial Sequence
  chemically synthesized
ataaacagataactgggggcaa

SEQ ID NO: 742604 - DNA, 22 bp, Artificial Sequence
  chemically synthesized
cccaaagtgaacctttgccccc

SEQ ID NO: 742605 - DNA, 22 bp, Artificial Sequence
  chemically synthesized
ccccaaagtgaacctttgcccc

SEQ ID NO: 742606 - DNA, 22 bp, Artificial Sequence
  chemically synthesized
gagacttccccaaagtgaacct

SEQ ID NO: 742607 - DNA, 22 bp, Artificial Sequence
  chemically synthesized
ggggcaaaggttcactttgggg

SEQ ID NO: 742608 - DNA, 22 bp, Artificial Sequence
  chemically synthesized
aaccccatctagagacttcccc

SEQ ID NO: 742609 - DNA, 22 bp, Artificial Sequence
  chemically synthesized
ctcaaccccatctagagacttc

SEQ ID NO: 742610 - DNA, 22 bp, Artificial Sequence
  chemically synthesized
actttggggaagtctctagatg

SEQ ID NO: 742611 - DNA, 22 bp, Artificial Sequence
  chemically synthesized
gtctgctcaaccccatctagag

SEQ ID NO: 742612 - DNA, 22 bp, Artificial Sequence
  chemically synthesized
agtctgctcaaccccatctaga

SEQ ID NO: 742613 - DNA, 22 bp, Artificial Sequence
  chemically synthesized
tagtctgctcaaccccatctag

SEQ ID NO: 742614 - DNA, 22 bp, Artificial Sequence
  chemically synthesized
tggggaagtctctagatggggt

SEQ ID NO: 742615 - DNA, 22 bp, Artificial Sequence
  chemically synthesized
ggggaagtctctagatggggtt

SEQ ID NO: 742616 - DNA, 22 bp, Artificial Sequence
  chemically synthesized
gggaagtctctagatggggttg

SEQ ID NO: 742617 - DNA, 22 bp, Artificial Sequence
  chemically synthesized
aagtcctttagtctgctcaacc

SEQ ID NO: 742618 - DNA, 22 bp, Artificial Sequence
  chemically synthesized
actgaagtcctttagtctgctc

SEQ ID NO: 742619 - DNA, 22 bp, Artificial Sequence
  chemically synthesized
tagatggggttgagcagactaa

SEQ ID NO: 742620 - DNA, 22 bp, Artificial Sequence
  chemically synthesized
gatggggttgagcagactaaag

SEQ ID NO: 742621 - DNA, 22 bp, Artificial Sequence
  chemically synthesized
gctgactgaagtcctttagtct

SEQ ID NO: 742622 - DNA, 22 bp, Artificial Sequence
  chemically synthesized
tagctgactgaagtcctttagt

SEQ ID NO: 742623 - DNA, 22 bp, Artificial Sequence
  chemically synthesized
ctagctgactgaagtcctttag

SEQ ID NO: 742624 - DNA, 22 bp, Artificial Sequence
  chemically synthesized
agcagactaaaggacttcagtc

SEQ ID NO: 742625 - DNA, 22 bp, Artificial Sequence
  chemically synthesized
atgatgatttctagctgactga

SEQ ID NO: 742626 - DNA, 22 bp, Artificial Sequence
  chemically synthesized
aaggacttcagtcagctagaaa

SEQ ID NO: 742627 - DNA, 22 bp, Artificial Sequence
  chemically synthesized
agtgccctcatgatgatttcta

SEQ ID NO: 742628 - DNA, 22 bp, Artificial Sequence
  chemically synthesized
cagtcagctagaaatcatcatg

SEQ ID NO: 742629 - DNA, 22 bp, Artificial Sequence
  chemically synthesized
agtcagctagaaatcatcatga

SEQ ID NO: 742630 - DNA, 22 bp, Artificial Sequence
  chemically synthesized
atgcgttgagtgccctcatgat

SEQ ID NO: 742631 - DNA, 22 bp, Artificial Sequence
  chemically synthesized
catgcgttgagtgccctcatga

SEQ ID NO: 742632 - DNA, 22 bp, Artificial Sequence
  chemically synthesized
gaaatcatcatgagggcactca

SEQ ID NO: 742633 - DNA, 22 bp, Artificial Sequence
  chemically synthesized
caccttcatgcgttgagtgccc

SEQ ID NO: 742634 - DNA, 22 bp, Artificial Sequence
  chemically synthesized
ccaccttcatgcgttgagtgcc

SEQ ID NO: 742635 - DNA, 22 bp, Artificial Sequence
  chemically synthesized
ttccaccttcatgcgttgagtg

SEQ ID NO: 742636 - DNA, 22 bp, Artificial Sequence
  chemically synthesized
cttccaccttcatgcgttgagt

SEQ ID NO: 742637 - DNA, 22 bp, Artificial Sequence
  chemically synthesized
tcttccaccttcatgcgttgag

SEQ ID NO: 742638 - DNA, 22 bp, Artificial Sequence
  chemically synthesized
ctttcttccaccttcatgcgtt

SEQ ID NO: 742639 - DNA, 22 bp, Artificial Sequence
  chemically synthesized
tctcctttcttccaccttcatg

SEQ ID NO: 742640 - DNA, 22 bp, Artificial Sequence
  chemically synthesized
ttatctcctttcttccaccttc

SEQ ID NO: 742641 - DNA, 22 bp, Artificial Sequence
  chemically synthesized
aacgcatgaaggtggaagaaag

SEQ ID NO: 742642 - DNA, 22 bp, Artificial Sequence
  chemically synthesized
ccatctgttatctcctttcttc

SEQ ID NO: 742643 - DNA, 22 bp, Artificial Sequence
  chemically synthesized
ctaccatctgttatctcctttc

SEQ ID NO: 742644 - DNA, 22 bp, Artificial Sequence
  chemically synthesized
cctaccatctgttatctccttt

SEQ ID NO: 742645 - DNA, 22 bp, Artificial Sequence
  chemically synthesized
tcctaccatctgttatctcctt

SEQ ID NO: 742646 - DNA, 22 bp, Artificial Sequence
  chemically synthesized
tctttcctaccatctgttatct

SEQ ID NO: 742647 - DNA, 22 bp, Artificial Sequence
  chemically synthesized
atctttcctaccatctgttatc

SEQ ID NO: 742648 - DNA, 22 bp, Artificial Sequence
  chemically synthesized
tatctttcctaccatctgttat

SEQ ID NO: 742649 - DNA, 22 bp, Artificial Sequence
  chemically synthesized
ttatctttcctaccatctgtta

SEQ ID NO: 742650 - DNA, 22 bp, Artificial Sequence
  chemically synthesized
tttatctttcctaccatctgtt

SEQ ID NO: 742651 - DNA, 22 bp, Artificial Sequence
  chemically synthesized
ctttttatctttcctaccatct

SEQ ID NO: 742652 - DNA, 22 bp, Artificial Sequence
  chemically synthesized
cctttttatctttcctaccatc

SEQ ID NO: 742653 - DNA, 22 bp, Artificial Sequence
  chemically synthesized
tcctttttatctttcctaccat

SEQ ID NO: 742654 - DNA, 22 bp, Artificial Sequence
  chemically synthesized
ttcctttttatctttcctacca

SEQ ID NO: 742655 - DNA, 22 bp, Artificial Sequence
  chemically synthesized
cttttcctttttatctttccta

SEQ ID NO: 742656 - DNA, 22 bp, Artificial Sequence
  chemically synthesized
cctccttttcctttttatcttt

SEQ ID NO: 742657 - DNA, 22 bp, Artificial Sequence
  chemically synthesized
ctgcctccttttcctttttatc

SEQ ID NO: 742658 - DNA, 22 bp, Artificial Sequence
  chemically synthesized
tcctgcctccttttccttttta

SEQ ID NO: 742659 - DNA, 22 bp, Artificial Sequence
  chemically synthesized
acatgagcattctcctgcctcc

SEQ ID NO: 742660 - DNA, 22 bp, Artificial Sequence
  chemically synthesized
aatcaaatgccaaagtgaagac

SEQ ID NO: 742661 - DNA, 22 bp, Artificial Sequence
  chemically synthesized
atgtcagtcttcactttggcat

SEQ ID NO: 742662 - DNA, 22 bp, Artificial Sequence
  chemically synthesized
ccaaaacctaaatcaaatgcca

SEQ ID NO: 742663 - DNA, 22 bp, Artificial Sequence
  chemically synthesized
ctaccaaaacctaaatcaaatg

SEQ ID NO: 742664 - DNA, 22 bp, Artificial Sequence
  chemically synthesized
cactttggcatttgatttaggt

SEQ ID NO: 742665 - DNA, 22 bp, Artificial Sequence
  chemically synthesized
actttggcatttgatttaggtt

SEQ ID NO: 742666 - DNA, 22 bp, Artificial Sequence
  chemically synthesized
tggcatttgatttaggttttgg

SEQ ID NO: 742667 - DNA, 22 bp, Artificial Sequence
  chemically synthesized
ggcatttgatttaggttttggt

SEQ ID NO: 742668 - DNA, 22 bp, Artificial Sequence
  chemically synthesized
gcatttgatttaggttttggta

SEQ ID NO: 742669 - DNA, 22 bp, Artificial Sequence
  chemically synthesized
ggtggtaaaagctgctaccaaa

SEQ ID NO: 742670 - DNA, 22 bp, Artificial Sequence
  chemically synthesized
gggtggtaaaagctgctaccaa

SEQ ID NO: 742671 - DNA, 22 bp, Artificial Sequence
  chemically synthesized
gatttaggttttggtagcagct

SEQ ID NO: 742672 - DNA, 22 bp, Artificial Sequence
  chemically synthesized
atttaggttttggtagcagctt

SEQ ID NO: 742673 - DNA, 22 bp, Artificial Sequence
  chemically synthesized
aggttttggtagcagcttttac

SEQ ID NO: 742674 - DNA, 22 bp, Artificial Sequence
  chemically synthesized
ggttttggtagcagcttttacc

SEQ ID NO: 742675 - DNA, 22 bp, Artificial Sequence
  chemically synthesized
tggtagcagcttttaccaccca

SEQ ID NO: 742676 - DNA, 22 bp, Artificial Sequence
  chemically synthesized
ggtagcagcttttaccacccaa

SEQ ID NO: 742677 - DNA, 22 bp, Artificial Sequence
  chemically synthesized
gtagcagcttttaccacccaag

SEQ ID NO: 742678 - DNA, 22 bp, Artificial Sequence
  chemically synthesized
ttaccacccaaggatggctcac

SEQ ID NO: 742679 - DNA, 22 bp, Artificial Sequence
  chemically synthesized
taccacccaaggatggctcacc

SEQ ID NO: 742680 - DNA, 22 bp, Artificial Sequence
  chemically synthesized
agagcccacagtggtgagccat

SEQ ID NO: 742681 - DNA, 22 bp, Artificial Sequence
  chemically synthesized
accacccaaggatggctcacca

SEQ ID NO: 742682 - DNA, 22 bp, Artificial Sequence
  chemically synthesized
ccacccaaggatggctcaccac

SEQ ID NO: 742683 - DNA, 22 bp, Artificial Sequence
  chemically synthesized
ggcactgagagcccacagtggt

SEQ ID NO: 742684 - DNA, 22 bp, Artificial Sequence
  chemically synthesized
ctgggcactgagagcccacagt

SEQ ID NO: 742685 - DNA, 22 bp, Artificial Sequence
  chemically synthesized
accactgtgggctctcagtgcc

SEQ ID NO: 742686 - DNA, 22 bp, Artificial Sequence
  chemically synthesized
tgtatgctgctgggcactgaga

SEQ ID NO: 742687 - DNA, 22 bp, Artificial Sequence
  chemically synthesized
ttatgtatgctgctgggcactg

SEQ ID NO: 742688 - DNA, 22 bp, Artificial Sequence
  chemically synthesized
gttatgtatgctgctgggcact

SEQ ID NO: 742689 - DNA, 22 bp, Artificial Sequence
  chemically synthesized
ttgttatgtatgctgctgggca

SEQ ID NO: 742690 - DNA, 22 bp, Artificial Sequence
  chemically synthesized
tgggctctcagtgcccagcagc

SEQ ID NO: 742691 - DNA, 22 bp, Artificial Sequence
  chemically synthesized
cttgttatgtatgctgctgggc

SEQ ID NO: 742692 - DNA, 22 bp, Artificial Sequence
  chemically synthesized
tcagtgcccagcagcatacata

SEQ ID NO: 742693 - DNA, 22 bp, Artificial Sequence
  chemically synthesized
agtgcccagcagcatacataac

SEQ ID NO: 742694 - DNA, 22 bp, Artificial Sequence
  chemically synthesized
ggcggccatacttcttgttatg

SEQ ID NO: 742695 - DNA, 22 bp, Artificial Sequence
  chemically synthesized
aggcggccatacttcttgttat

SEQ ID NO: 742696 - DNA, 22 bp, Artificial Sequence
  chemically synthesized
tgtttaggcggccatacttctt

SEQ ID NO: 742697 - DNA, 22 bp, Artificial Sequence
  chemically synthesized
tgtgtttaggcggccatacttc

SEQ ID NO: 742698 - DNA, 22 bp, Artificial Sequence
  chemically synthesized
tgactctgtgtttaggcggcca

SEQ ID NO: 742699 - DNA, 22 bp, Artificial Sequence
  chemically synthesized
gtgactctgtgtttaggcggcc

SEQ ID NO: 742700 - DNA, 22 bp, Artificial Sequence
  chemically synthesized
cagggtgaaggtcttgtgactc

SEQ ID NO: 742701 - DNA, 22 bp, Artificial Sequence
  chemically synthesized
acagggtgaaggtcttgtgact

SEQ ID NO: 742702 - DNA, 22 bp, Artificial Sequence
  chemically synthesized
tacagggtgaaggtcttgtgac

SEQ ID NO: 742703 - DNA, 22 bp, Artificial Sequence
  chemically synthesized
aacacagagtcacaagaccttc

SEQ ID NO: 742704 - DNA, 22 bp, Artificial Sequence
  chemically synthesized
accctttacagggtgaaggtct

SEQ ID NO: 742705 - DNA, 22 bp, Artificial Sequence
  chemically synthesized
tgttcaccctttacagggtgaa

SEQ ID NO: 742706 - DNA, 22 bp, Artificial Sequence
  chemically synthesized
caccctgtaaagggtgaacaca

SEQ ID NO: 742707 - DNA, 22 bp, Artificial Sequence
  chemically synthesized
accctgtaaagggtgaacacag

SEQ ID NO: 742708 - DNA, 22 bp, Artificial Sequence
  chemically synthesized
aatagcaaagtacctgtgttca

SEQ ID NO: 742709 - DNA, 22 bp, Artificial Sequence
  chemically synthesized
aaatagcaaagtacctgtgttc

SEQ ID NO: 742710 - DNA, 22 bp, Artificial Sequence
  chemically synthesized
tttaaatagcaaagtacctgtg

SEQ ID NO: 742711 - DNA, 22 bp, Artificial Sequence
  chemically synthesized
taaagggtgaacacaggtactt

SEQ ID NO: 742712 - DNA, 22 bp, Artificial Sequence
  chemically synthesized
tgctatttaaatagatgtgaca

SEQ ID NO: 742713 - DNA, 22 bp, Artificial Sequence
  chemically synthesized
gctatttaaatagatgtgacat

SEQ ID NO: 742714 - DNA, 22 bp, Artificial Sequence
  chemically synthesized
ctatttaaatagatgtgacatt

SEQ ID NO: 742715 - DNA, 22 bp, Artificial Sequence
  chemically synthesized
tttaaatagatgtgacattggt

SEQ ID NO: 742716 - DNA, 22 bp, Artificial Sequence
  chemically synthesized
tgaaatatagccaaaccaatgt

SEQ ID NO: 742717 - DNA, 22 bp, Artificial Sequence
  chemically synthesized
aaatagatgtgacattggtttg

SEQ ID NO: 742718 - DNA, 22 bp, Artificial Sequence
  chemically synthesized
aatagatgtgacattggtttgg

SEQ ID NO: 742719 - DNA, 22 bp, Artificial Sequence
  chemically synthesized
atctgtgaaatatagccaaacc

SEQ ID NO: 742720 - DNA, 22 bp, Artificial Sequence
  chemically synthesized
taatctgtgaaatatagccaaa

SEQ ID NO: 742721 - DNA, 22 bp, Artificial Sequence
  chemically synthesized
aaagctctaatctgtgaaatat

SEQ ID NO: 742722 - DNA, 22 bp, Artificial Sequence
  chemically synthesized
gtttggctatatttcacagatt

SEQ ID NO: 742723 - DNA, 22 bp, Artificial Sequence
  chemically synthesized
ggctatatttcacagattagag

SEQ ID NO: 742724 - DNA, 22 bp, Artificial Sequence
  chemically synthesized
gctatatttcacagattagagc

SEQ ID NO: 742725 - DNA, 22 bp, Artificial Sequence
  chemically synthesized
tatttcacagattagagctttt

SEQ ID NO: 742726 - DNA, 22 bp, Artificial Sequence
  chemically synthesized
tgtgtgtcatattaaaagctct

SEQ ID NO: 742727 - DNA, 22 bp, Artificial Sequence
  chemically synthesized
atgtgtgtcatattaaaagctc

SEQ ID NO: 742728 - DNA, 22 bp, Artificial Sequence
  chemically synthesized
cacagattagagcttttaatat

SEQ ID NO: 742729 - DNA, 22 bp, Artificial Sequence
  chemically synthesized
acagattagagcttttaatatg

SEQ ID NO: 742730 - DNA, 22 bp, Artificial Sequence
  chemically synthesized
aacacaaatttatgtgtgtcat

SEQ ID NO: 742731 - DNA, 22 bp, Artificial Sequence
  chemically synthesized
gagcttttaatatgacacacat

SEQ ID NO: 742732 - DNA, 22 bp, Artificial Sequence
  chemically synthesized
aaacacaaatttatgtgtgtca

SEQ ID NO: 742733 - DNA, 22 bp, Artificial Sequence
  chemically synthesized
ttaatatgacacacataaattt

SEQ ID NO: 742734 - DNA, 22 bp, Artificial Sequence
  chemically synthesized
taatatgacacacataaatttg

SEQ ID NO: 742735 - DNA, 22 bp, Artificial Sequence
  chemically synthesized
ataatttaaacacaaatttatg

SEQ ID NO: 742736 - DNA, 22 bp, Artificial Sequence
  chemically synthesized
aatatgacacacataaatttgt

SEQ ID NO: 742737 - DNA, 22 bp, Artificial Sequence
  chemically synthesized
aataatttaaacacaaatttat

SEQ ID NO: 742738 - DNA, 22 bp, Artificial Sequence
  chemically synthesized
atatgacacacataaatttgtg

SEQ ID NO: 742739 - DNA, 22 bp, Artificial Sequence
  chemically synthesized
ggtgtagtgtttaataatttaa

SEQ ID NO: 742740 - DNA, 22 bp, Artificial Sequence
  chemically synthesized
aggtgtagtgtttaataattta

SEQ ID NO: 742741 - DNA, 22 bp, Artificial Sequence
  chemically synthesized
taggtgtagtgtttaataattt

SEQ ID NO: 742742 - DNA, 22 bp, Artificial Sequence
  chemically synthesized
gtgtttaaattattaaacacta

SEQ ID NO: 742743 - DNA, 22 bp, Artificial Sequence
  chemically synthesized
acattttaggtgtagtgtttaa

SEQ ID NO: 742744 - DNA, 22 bp, Artificial Sequence
  chemically synthesized
tgtttaaattattaaacactac

SEQ ID NO: 742745 - DNA, 22 bp, Artificial Sequence
  chemically synthesized
gacattttaggtgtagtgttta

SEQ ID NO: 742746 - DNA, 22 bp, Artificial Sequence
  chemically synthesized
tgacattttaggtgtagtgttt

SEQ ID NO: 742747 - DNA, 22 bp, Artificial Sequence
  chemically synthesized
ttgacattttaggtgtagtgtt

SEQ ID NO: 742748 - DNA, 22 bp, Artificial Sequence
  chemically synthesized
tttgacattttaggtgtagtgt

SEQ ID NO: 742749 - DNA, 22 bp, Artificial Sequence
  chemically synthesized
aaattattaaacactacaccta

SEQ ID NO: 742750 - DNA, 22 bp, Artificial Sequence
  chemically synthesized
aattattaaacactacacctaa

SEQ ID NO: 742751 - DNA, 22 bp, Artificial Sequence
  chemically synthesized
tgctttttgacattttaggtgt

SEQ ID NO: 742752 - DNA, 22 bp, Artificial Sequence
  chemically synthesized
ttaaacactacacctaaaatgt

SEQ ID NO: 742753 - DNA, 22 bp, Artificial Sequence
  chemically synthesized
actgtgctttttgacattttag

SEQ ID NO: 742754 - DNA, 22 bp, Artificial Sequence
  chemically synthesized
aacactacacctaaaatgtcaa

SEQ ID NO: 742755 - DNA, 22 bp, Artificial Sequence
  chemically synthesized
agcgttaactgtgctttttgac

SEQ ID NO: 742756 - DNA, 22 bp, Artificial Sequence
  chemically synthesized
cacctaaaatgtcaaaaagcac

SEQ ID NO: 742757 - DNA, 22 bp, Artificial Sequence
  chemically synthesized
ctcagcgttaactgtgcttttt

SEQ ID NO: 742758 - DNA, 22 bp, Artificial Sequence
  chemically synthesized
aaatgtcaaaaagcacagttaa

SEQ ID NO: 742759 - DNA, 22 bp, Artificial Sequence
  chemically synthesized
gtattgctcagcgttaactgtg

SEQ ID NO: 742760 - DNA, 22 bp, Artificial Sequence
  chemically synthesized
aatagcacctcgtattgctcag

SEQ ID NO: 742761 - DNA, 22 bp, Artificial Sequence
  chemically synthesized
aaatagcacctcgtattgctca

SEQ ID NO: 742762 - DNA, 22 bp, Artificial Sequence
  chemically synthesized
acgctgagcaatacgaggtgct

SEQ ID NO: 742763 - DNA, 22 bp, Artificial Sequence
  chemically synthesized
atatcacttaaatagcacctcg

SEQ ID NO: 742764 - DNA, 22 bp, Artificial Sequence
  chemically synthesized
agcaatacgaggtgctatttaa

SEQ ID NO: 742765 - DNA, 22 bp, Artificial Sequence
  chemically synthesized
atgcaatcctgatatcacttaa

SEQ ID NO: 742766 - DNA, 22 bp, Artificial Sequence
  chemically synthesized
tttaagtgatatcaggattgca

SEQ ID NO: 742767 - DNA, 22 bp, Artificial Sequence
  chemically synthesized
gaaaaaaaacctaatgcaatcc

SEQ ID NO: 742768 - DNA, 22 bp, Artificial Sequence
  chemically synthesized
aagtgatatcaggattgcatta

SEQ ID NO: 742769 - DNA, 22 bp, Artificial Sequence
  chemically synthesized
agtgatatcaggattgcattag

SEQ ID NO: 742770 - DNA, 22 bp, Artificial Sequence
  chemically synthesized
caaactagaaaaaaaacctaat

SEQ ID NO: 742771 - DNA, 22 bp, Artificial Sequence
  chemically synthesized
ccaaactagaaaaaaaacctaa

SEQ ID NO: 742772 - DNA, 22 bp, Artificial Sequence
  chemically synthesized
cttccaaactagaaaaaaaacc

SEQ ID NO: 742773 - DNA, 22 bp, Artificial Sequence
  chemically synthesized
ctgcttccaaactagaaaaaaa

SEQ ID NO: 742774 - DNA, 22 bp, Artificial Sequence
  chemically synthesized
actgcttccaaactagaaaaaa

SEQ ID NO: 742775 - DNA, 22 bp, Artificial Sequence
  chemically synthesized
cattaggttttttttctagttt

SEQ ID NO: 742776 - DNA, 22 bp, Artificial Sequence
  chemically synthesized
acttactgcttccaaactagaa

SEQ ID NO: 742777 - DNA, 22 bp, Artificial Sequence
  chemically synthesized
tcacttactgcttccaaactag

SEQ ID NO: 742778 - DNA, 22 bp, Artificial Sequence
  chemically synthesized
ctcacttactgcttccaaacta

SEQ ID NO: 742779 - DNA, 22 bp, Artificial Sequence
  chemically synthesized
ggttttttttctagtttggaag

SEQ ID NO: 742780 - DNA, 22 bp, Artificial Sequence
  chemically synthesized
tctcacttactgcttccaaact

SEQ ID NO: 742781 - DNA, 22 bp, Artificial Sequence
  chemically synthesized
tttttctagtttggaagcagta

SEQ ID NO: 742782 - DNA, 22 bp, Artificial Sequence
  chemically synthesized
ttttctagtttggaagcagtaa

SEQ ID NO: 742783 - DNA, 22 bp, Artificial Sequence
  chemically synthesized
tttctagtttggaagcagtaag

SEQ ID NO: 742784 - DNA, 22 bp, Artificial Sequence
  chemically synthesized
aatgttttctcacttactgctt

SEQ ID NO: 742785 - DNA, 22 bp, Artificial Sequence
  chemically synthesized
ttctagtttggaagcagtaagt

SEQ ID NO: 742786 - DNA, 22 bp, Artificial Sequence
  chemically synthesized
caatgttttctcacttactgct

SEQ ID NO: 742787 - DNA, 22 bp, Artificial Sequence
  chemically synthesized
tctagtttggaagcagtaagtg

SEQ ID NO: 742788 - DNA, 22 bp, Artificial Sequence
  chemically synthesized
ctagtttggaagcagtaagtga

SEQ ID NO: 742789 - DNA, 22 bp, Artificial Sequence
  chemically synthesized
ttcaatgttttctcacttactg

SEQ ID NO: 742790 - DNA, 22 bp, Artificial Sequence
  chemically synthesized
tagtttggaagcagtaagtgag

SEQ ID NO: 742791 - DNA, 22 bp, Artificial Sequence
  chemically synthesized
cttcaatgttttctcacttact

SEQ ID NO: 742792 - DNA, 22 bp, Artificial Sequence
  chemically synthesized
tcttcaatgttttctcacttac

SEQ ID NO: 742793 - DNA, 22 bp, Artificial Sequence
  chemically synthesized
gtttggaagcagtaagtgagaa

SEQ ID NO: 742794 - DNA, 22 bp, Artificial Sequence
  chemically synthesized
ggaagcagtaagtgagaaaaca

SEQ ID NO: 742795 - DNA, 22 bp, Artificial Sequence
  chemically synthesized
gaagcagtaagtgagaaaacat

SEQ ID NO: 742796 - DNA, 22 bp, Artificial Sequence
  chemically synthesized
aaagaaaacccacaatataatg

SEQ ID NO: 742797 - DNA, 22 bp, Artificial Sequence
  chemically synthesized
aagaaagccattatattgtggg

SEQ ID NO: 742798 - DNA, 22 bp, Artificial Sequence
  chemically synthesized
agtgattcaaagaaaacccaca

SEQ ID NO: 742799 - DNA, 22 bp, Artificial Sequence
  chemically synthesized
aagtgattcaaagaaaacccac

SEQ ID NO: 742800 - DNA, 22 bp, Artificial Sequence
  chemically synthesized
tattgtgggttttctttgaatc

SEQ ID NO: 742801 - DNA, 22 bp, Artificial Sequence
  chemically synthesized
cagatgtttaagtgattcaaag

SEQ ID NO: 742802 - DNA, 22 bp, Artificial Sequence
  chemically synthesized
tgggttttctttgaatcactta

SEQ ID NO: 742803 - DNA, 22 bp, Artificial Sequence
  chemically synthesized
tctttgaatcacttaaacatct

SEQ ID NO: 742804 - DNA, 22 bp, Artificial Sequence
  chemically synthesized
ctttgaatcacttaaacatctg

SEQ ID NO: 742805 - DNA, 22 bp, Artificial Sequence
  chemically synthesized
tttgaatcacttaaacatctgg

SEQ ID NO: 742806 - DNA, 22 bp, Artificial Sequence
  chemically synthesized
tgaatcacttaaacatctggaa

SEQ ID NO: 742807 - DNA, 22 bp, Artificial Sequence
  chemically synthesized
atggagaacatattccagatgt

SEQ ID NO: 742808 - DNA, 22 bp, Artificial Sequence
  chemically synthesized
gaatcacttaaacatctggaat

SEQ ID NO: 742809 - DNA, 22 bp, Artificial Sequence
  chemically synthesized
catggagaacatattccagatg

SEQ ID NO: 742810 - DNA, 22 bp, Artificial Sequence
  chemically synthesized
aatcacttaaacatctggaata

SEQ ID NO: 742811 - DNA, 22 bp, Artificial Sequence
  chemically synthesized
tcatggagaacatattccagat

SEQ ID NO: 742812 - DNA, 22 bp, Artificial Sequence
  chemically synthesized
tttcatggagaacatattccag

SEQ ID NO: 742813 - DNA, 22 bp, Artificial Sequence
  chemically synthesized
ctctttcatggagaacatattc

SEQ ID NO: 742814 - DNA, 22 bp, Artificial Sequence
  chemically synthesized
gctctttcatggagaacatatt

SEQ ID NO: 742815 - DNA, 22 bp, Artificial Sequence
  chemically synthesized
aaacatctggaatatgttctcc

SEQ ID NO: 742816 - DNA, 22 bp, Artificial Sequence
  chemically synthesized
aacatctggaatatgttctcca

SEQ ID NO: 742817 - DNA, 22 bp, Artificial Sequence
  chemically synthesized
gtttgctctttcatggagaaca

SEQ ID NO: 742818 - DNA, 22 bp, Artificial Sequence
  chemically synthesized
ggtttgctctttcatggagaac

SEQ ID NO: 742819 - DNA, 22 bp, Artificial Sequence
  chemically synthesized
gacttggtttgctctttcatgg

SEQ ID NO: 742820 - DNA, 22 bp, Artificial Sequence
  chemically synthesized
gaatatgttctccatgaaagag

SEQ ID NO: 742821 - DNA, 22 bp, Artificial Sequence
  chemically synthesized
tccatgaaagagcaaaccaagt

SEQ ID NO: 742822 - DNA, 22 bp, Artificial Sequence
  chemically synthesized
catgaaagagcaaaccaagtct

SEQ ID NO: 742823 - DNA, 22 bp, Artificial Sequence
  chemically synthesized
gtcataataaaattagacttgg

SEQ ID NO: 742824 - DNA, 22 bp, Artificial Sequence
  chemically synthesized
tgagaaactagtcataataaaa

SEQ ID NO: 742825 - DNA, 22 bp, Artificial Sequence
  chemically synthesized
cctgtgagaaactagtcataat

SEQ ID NO: 742826 - DNA, 22 bp, Artificial Sequence
  chemically synthesized
tgcctgtgagaaactagtcata

SEQ ID NO: 742827 - DNA, 22 bp, Artificial Sequence
  chemically synthesized
attttattatgactagtttctc

SEQ ID NO: 742828 - DNA, 22 bp, Artificial Sequence
  chemically synthesized
aaaattctgcctgtgagaaact

SEQ ID NO: 742829 - DNA, 22 bp, Artificial Sequence
  chemically synthesized
tattatgactagtttctcacag

SEQ ID NO: 742830 - DNA, 22 bp, Artificial Sequence
  chemically synthesized
attatgactagtttctcacagg

SEQ ID NO: 742831 - DNA, 22 bp, Artificial Sequence
  chemically synthesized
ttatgactagtttctcacaggc

SEQ ID NO: 742832 - DNA, 22 bp, Artificial Sequence
  chemically synthesized
tgactagtttctcacaggcaga

SEQ ID NO: 742833 - DNA, 22 bp, Artificial Sequence
  chemically synthesized
atgaactgaaaattctgcctgt

SEQ ID NO: 742834 - DNA, 22 bp, Artificial Sequence
  chemically synthesized
aatgaactgaaaattctgcctg

SEQ ID NO: 742835 - DNA, 22 bp, Artificial Sequence
  chemically synthesized
gtttctcacaggcagaattttc

SEQ ID NO: 742836 - DNA, 22 bp, Artificial Sequence
  chemically synthesized
ctcacaggcagaattttcagtt

SEQ ID NO: 742837 - DNA, 22 bp, Artificial Sequence
  chemically synthesized
tcacaggcagaattttcagttc

SEQ ID NO: 742838 - DNA, 22 bp, Artificial Sequence
  chemically synthesized
acaggcagaattttcagttcat

SEQ ID NO: 742839 - DNA, 22 bp, Artificial Sequence
  chemically synthesized
taatcagacaacatttaatgaa

SEQ ID NO: 742840 - DNA, 22 bp, Artificial Sequence
  chemically synthesized
tatctataatcagacaacattt

SEQ ID NO: 742841 - DNA, 22 bp, Artificial Sequence
  chemically synthesized
gtatctataatcagacaacatt

SEQ ID NO: 742842 - DNA, 22 bp, Artificial Sequence
  chemically synthesized
tcagttcattaaatgttgtctg

SEQ ID NO: 742843 - DNA, 22 bp, Artificial Sequence
  chemically synthesized
tgtatctataatcagacaacat

SEQ ID NO: 742844 - DNA, 22 bp, Artificial Sequence
  chemically synthesized
cagttcattaaatgttgtctga

SEQ ID NO: 742845 - DNA, 22 bp, Artificial Sequence
  chemically synthesized
ttgtatctataatcagacaaca

SEQ ID NO: 742846 - DNA, 22 bp, Artificial Sequence
  chemically synthesized
agttcattaaatgttgtctgat

SEQ ID NO: 742847 - DNA, 22 bp, Artificial Sequence
  chemically synthesized
attaaatgttgtctgattatag

SEQ ID NO: 742848 - DNA, 22 bp, Artificial Sequence
  chemically synthesized
aatgttgtctgattatagatac

SEQ ID NO: 742849 - DNA, 22 bp, Artificial Sequence
  chemically synthesized
aatcagtacttttgtatctata

SEQ ID NO: 742850 - DNA, 22 bp, Artificial Sequence
  chemically synthesized
taaatcagtacttttgtatcta

SEQ ID NO: 742851 - DNA, 22 bp, Artificial Sequence
  chemically synthesized
tctgattatagatacaaaagta

SEQ ID NO: 742852 - DNA, 22 bp, Artificial Sequence
  chemically synthesized
tcattctaaatcagtacttttg

SEQ ID NO: 742853 - DNA, 22 bp, Artificial Sequence
  chemically synthesized
attatagatacaaaagtactga

SEQ ID NO: 742854 - DNA, 22 bp, Artificial Sequence
  chemically synthesized
cctatcattctaaatcagtact

SEQ ID NO: 742855 - DNA, 22 bp, Artificial Sequence
  chemically synthesized
acctatcattctaaatcagtac

SEQ ID NO: 742856 - DNA, 22 bp, Artificial Sequence
  chemically synthesized
tagatacaaaagtactgattta

SEQ ID NO: 742857 - DNA, 22 bp, Artificial Sequence
  chemically synthesized
tatcagacttacctatcattct

SEQ ID NO: 742858 - DNA, 22 bp, Artificial Sequence
  chemically synthesized
ttatatcagacttacctatcat

SEQ ID NO: 742859 - DNA, 22 bp, Artificial Sequence
  chemically synthesized
attatatcagacttacctatca

SEQ ID NO: 742860 - DNA, 22 bp, Artificial Sequence
  chemically synthesized
atttagaatgataggtaagtct

SEQ ID NO: 742861 - DNA, 22 bp, Artificial Sequence
  chemically synthesized
agaatgataggtaagtctgata

SEQ ID NO: 742862 - DNA, 22 bp, Artificial Sequence
  chemically synthesized
gaatgataggtaagtctgatat

SEQ ID NO: 742863 - DNA, 22 bp, Artificial Sequence
  chemically synthesized
tatgaagaaaaacttattatat

SEQ ID NO: 742864 - DNA, 22 bp, Artificial Sequence
  chemically synthesized
atatgaagaaaaacttattata

SEQ ID NO: 742865 - DNA, 22 bp, Artificial Sequence
  chemically synthesized
tatatgaagaaaaacttattat

SEQ ID NO: 742866 - DNA, 22 bp, Artificial Sequence
  chemically synthesized
attttatatgaagaaaaactta

SEQ ID NO: 742867 - DNA, 22 bp, Artificial Sequence
  chemically synthesized
aattttatatgaagaaaaactt

SEQ ID NO: 742868 - DNA, 22 bp, Artificial Sequence
  chemically synthesized
atataataagtttttcttcata

SEQ ID NO: 742869 - DNA, 22 bp, Artificial Sequence
  chemically synthesized
ttcttcatataaaattaaattg

SEQ ID NO: 742870 - DNA, 22 bp, Artificial Sequence
  chemically synthesized
tcttcatataaaattaaattgc

SEQ ID NO: 742871 - DNA, 22 bp, Artificial Sequence
  chemically synthesized
cttcatataaaattaaattgcc

SEQ ID NO: 742872 - DNA, 22 bp, Artificial Sequence
  chemically synthesized
ttcatataaaattaaattgcct

SEQ ID NO: 742873 - DNA, 22 bp, Artificial Sequence
  chemically synthesized
catataaaattaaattgcctgt

SEQ ID NO: 742874 - DNA, 22 bp, Artificial Sequence
  chemically synthesized
atataaaattaaattgcctgtc

SEQ ID NO: 742875 - DNA, 22 bp, Artificial Sequence
  chemically synthesized
cataaagataagcaaagatatg

SEQ ID NO: 742876 - DNA, 22 bp, Artificial Sequence
  chemically synthesized
aattgcctgtcatatctttgct

SEQ ID NO: 742877 - DNA, 22 bp, Artificial Sequence
  chemically synthesized
gctacataaagataagcaaaga

SEQ ID NO: 742878 - DNA, 22 bp, Artificial Sequence
  chemically synthesized
agctacataaagataagcaaag

SEQ ID NO: 742879 - DNA, 22 bp, Artificial Sequence
  chemically synthesized
cctgtcatatctttgcttatct

SEQ ID NO: 742880 - DNA, 22 bp, Artificial Sequence
  chemically synthesized
tcatatctttgcttatctttat

SEQ ID NO: 742881 - DNA, 22 bp, Artificial Sequence
  chemically synthesized
aacaaatccttagctacataaa

SEQ ID NO: 742882 - DNA, 22 bp, Artificial Sequence
  chemically synthesized
gaacaaatccttagctacataa

SEQ ID NO: 742883 - DNA, 22 bp, Artificial Sequence
  chemically synthesized
tgcttatctttatgtagctaag

SEQ ID NO: 742884 - DNA, 22 bp, Artificial Sequence
  chemically synthesized
gcttatctttatgtagctaagg

SEQ ID NO: 742885 - DNA, 22 bp, Artificial Sequence
  chemically synthesized
cttatctttatgtagctaagga

SEQ ID NO: 742886 - DNA, 22 bp, Artificial Sequence
  chemically synthesized
atctttatgtagctaaggattt

SEQ ID NO: 742887 - DNA, 22 bp, Artificial Sequence
  chemically synthesized
tctttatgtagctaaggatttg

SEQ ID NO: 742888 - DNA, 22 bp, Artificial Sequence
  chemically synthesized
aatgtgtatttgaacaaatcct

SEQ ID NO: 742889 - DNA, 22 bp, Artificial Sequence
  chemically synthesized
aaatgtgtatttgaacaaatcc

SEQ ID NO: 742890 - DNA, 22 bp, Artificial Sequence
  chemically synthesized
tatgtagctaaggatttgttca

SEQ ID NO: 742891 - DNA, 22 bp, Artificial Sequence
  chemically synthesized
taaatgtgtatttgaacaaatc

SEQ ID NO: 742892 - DNA, 22 bp, Artificial Sequence
  chemically synthesized
atgtagctaaggatttgttcaa

SEQ ID NO: 742893 - DNA, 22 bp, Artificial Sequence
  chemically synthesized
tgtagctaaggatttgttcaaa

SEQ ID NO: 742894 - DNA, 22 bp, Artificial Sequence
  chemically synthesized
taattttaaatgtgtatttgaa

SEQ ID NO: 742895 - DNA, 22 bp, Artificial Sequence
  chemically synthesized
aggatttgttcaaatacacatt

SEQ ID NO: 742896 - DNA, 22 bp, Artificial Sequence
  chemically synthesized
gttcaaatacacatttaaaatt

SEQ ID NO: 742897 - DNA, 22 bp, Artificial Sequence
  chemically synthesized
ttcaaatacacatttaaaatta

SEQ ID NO: 742898 - DNA, 22 bp, Artificial Sequence
  chemically synthesized
aaatacacatttaaaattatag

SEQ ID NO: 742899 - DNA, 22 bp, Artificial Sequence
  chemically synthesized
gaaaagtagtagatgactataa

SEQ ID NO: 742900 - DNA, 22 bp, Artificial Sequence
  chemically synthesized
agaaaagtagtagatgactata

SEQ ID NO: 742901 - DNA, 22 bp, Artificial Sequence
  chemically synthesized
ttagaaaagtagtagatgacta

SEQ ID NO: 742902 - DNA, 22 bp, Artificial Sequence
  chemically synthesized
cttagaaaagtagtagatgact

SEQ ID NO: 742903 - DNA, 22 bp, Artificial Sequence
  chemically synthesized
tcttagaaaagtagtagatgac

SEQ ID NO: 742904 - DNA, 22 bp, Artificial Sequence
  chemically synthesized
aaaattatagtcatctactact

SEQ ID NO: 742905 - DNA, 22 bp, Artificial Sequence
  chemically synthesized
ttttcttagaaaagtagtagat

SEQ ID NO: 742906 - DNA, 22 bp, Artificial Sequence
  chemically synthesized
aaattatagtcatctactactt

SEQ ID NO: 742907 - DNA, 22 bp, Artificial Sequence
  chemically synthesized
attttcttagaaaagtagtaga

SEQ ID NO: 742908 - DNA, 22 bp, Artificial Sequence
  chemically synthesized
tattttcttagaaaagtagtag

SEQ ID NO: 742909 - DNA, 22 bp, Artificial Sequence
  chemically synthesized
ctttattttcttagaaaagtag

SEQ ID NO: 742910 - DNA, 22 bp, Artificial Sequence
  chemically synthesized
tagtcatctactacttttctaa

SEQ ID NO: 742911 - DNA, 22 bp, Artificial Sequence
  chemically synthesized
atagacaattcctttattttct

SEQ ID NO: 742912 - DNA, 22 bp, Artificial Sequence
  chemically synthesized
ctacttttctaagaaaataaag

SEQ ID NO: 742913 - DNA, 22 bp, Artificial Sequence
  chemically synthesized
ttaatagacaattcctttattt

SEQ ID NO: 742914 - DNA, 22 bp, Artificial Sequence
  chemically synthesized
cttttctaagaaaataaaggaa

SEQ ID NO: 742915 - DNA, 22 bp, Artificial Sequence
  chemically synthesized
gttaatagacaattcctttatt

SEQ ID NO: 742916 - DNA, 22 bp, Artificial Sequence
  chemically synthesized
ttctaagaaaataaaggaattg

SEQ ID NO: 742917 - DNA, 22 bp, Artificial Sequence
  chemically synthesized
tctaagaaaataaaggaattgt

SEQ ID NO: 742918 - DNA, 22 bp, Artificial Sequence
  chemically synthesized
ccttgttaatagacaattcctt

SEQ ID NO: 742919 - DNA, 22 bp, Artificial Sequence
  chemically synthesized
ctaagaaaataaaggaattgtc

SEQ ID NO: 742920 - DNA, 22 bp, Artificial Sequence
  chemically synthesized
taagaaaataaaggaattgtct

SEQ ID NO: 742921 - DNA, 22 bp, Artificial Sequence
  chemically synthesized
agaaaataaaggaattgtctat

SEQ ID NO: 742922 - DNA, 22 bp, Artificial Sequence
  chemically synthesized
aaaaataagattcccttgttaa

SEQ ID NO: 742923 - DNA, 22 bp, Artificial Sequence
  chemically synthesized
cctcaaaaataagattcccttg

SEQ ID NO: 742924 - DNA, 22 bp, Artificial Sequence
  chemically synthesized
ctccctcaaaaataagattccc

SEQ ID NO: 742925 - DNA, 22 bp, Artificial Sequence
  chemically synthesized
tctattaacaagggaatcttat

SEQ ID NO: 742926 - DNA, 22 bp, Artificial Sequence
  chemically synthesized
ttaacaagggaatcttattttt

SEQ ID NO: 742927 - DNA, 22 bp, Artificial Sequence
  chemically synthesized
acaagggaatcttatttttgag

SEQ ID NO: 742928 - DNA, 22 bp, Artificial Sequence
  chemically synthesized
tcaagtcaaaattcctccctca

SEQ ID NO: 742929 - DNA, 22 bp, Artificial Sequence
  chemically synthesized
actgtcaagtcaaaattcctcc

SEQ ID NO: 742930 - DNA, 22 bp, Artificial Sequence
  chemically synthesized
aactgtcaagtcaaaattcctc

SEQ ID NO: 742931 - DNA, 22 bp, Artificial Sequence
  chemically synthesized
atttttgagggaggaattttga

SEQ ID NO: 742932 - DNA, 22 bp, Artificial Sequence
  chemically synthesized
ttaactgtcaagtcaaaattcc

SEQ ID NO: 742933 - DNA, 22 bp, Artificial Sequence
  chemically synthesized
tttttgagggaggaattttgac

SEQ ID NO: 742934 - DNA, 22 bp, Artificial Sequence
  chemically synthesized
tcttaactgtcaagtcaaaatt

SEQ ID NO: 742935 - DNA, 22 bp, Artificial Sequence
  chemically synthesized
ttgagggaggaattttgacttg

SEQ ID NO: 742936 - DNA, 22 bp, Artificial Sequence
  chemically synthesized
tgagggaggaattttgacttga

SEQ ID NO: 742937 - DNA, 22 bp, Artificial Sequence
  chemically synthesized
gagggaggaattttgacttgac

SEQ ID NO: 742938 - DNA, 22 bp, Artificial Sequence
  chemically synthesized
agggaggaattttgacttgaca

SEQ ID NO: 742939 - DNA, 22 bp, Artificial Sequence
  chemically synthesized
cagtaggaatgttctcttaact

SEQ ID NO: 742940 - DNA, 22 bp, Artificial Sequence
  chemically synthesized
gcagtaggaatgttctcttaac

SEQ ID NO: 742941 - DNA, 22 bp, Artificial Sequence
  chemically synthesized
tgcagtaggaatgttctcttaa

SEQ ID NO: 742942 - DNA, 22 bp, Artificial Sequence
  chemically synthesized
tgacttgacagttaagagaaca

SEQ ID NO: 742943 - DNA, 22 bp, Artificial Sequence
  chemically synthesized
gacttgacagttaagagaacat

SEQ ID NO: 742944 - DNA, 22 bp, Artificial Sequence
  chemically synthesized
acttgacagttaagagaacatt

SEQ ID NO: 742945 - DNA, 22 bp, Artificial Sequence
  chemically synthesized
tgctttgcagtaggaatgttct

SEQ ID NO: 742946 - DNA, 22 bp, Artificial Sequence
  chemically synthesized
gacagttaagagaacattccta

SEQ ID NO: 742947 - DNA, 22 bp, Artificial Sequence
  chemically synthesized
tgtgctttgcagtaggaatgtt

SEQ ID NO: 742948 - DNA, 22 bp, Artificial Sequence
  chemically synthesized
acagttaagagaacattcctac

SEQ ID NO: 742949 - DNA, 22 bp, Artificial Sequence
  chemically synthesized
ctgtgctttgcagtaggaatgt

SEQ ID NO: 742950 - DNA, 22 bp, Artificial Sequence
  chemically synthesized
accttctgtgctttgcagtagg

SEQ ID NO: 742951 - DNA, 22 bp, Artificial Sequence
  chemically synthesized
agagaacattcctactgcaaag

SEQ ID NO: 742952 - DNA, 22 bp, Artificial Sequence
  chemically synthesized
caactgaccttctgtgctttgc

SEQ ID NO: 742953 - DNA, 22 bp, Artificial Sequence
  chemically synthesized
ccaactgaccttctgtgctttg

SEQ ID NO: 742954 - DNA, 22 bp, Artificial Sequence
  chemically synthesized
tccaactgaccttctgtgcttt

SEQ ID NO: 742955 - DNA, 22 bp, Artificial Sequence
  chemically synthesized
ctactgcaaagcacagaaggtc

SEQ ID NO: 742956 - DNA, 22 bp, Artificial Sequence
  chemically synthesized
gtctttccaactgaccttctgt

SEQ ID NO: 742957 - DNA, 22 bp, Artificial Sequence
  chemically synthesized
tagtctttccaactgaccttct

SEQ ID NO: 742958 - DNA, 22 bp, Artificial Sequence
  chemically synthesized
ctgcaaagcacagaaggtcagt

SEQ ID NO: 742959 - DNA, 22 bp, Artificial Sequence
  chemically synthesized
ctagtctttccaactgaccttc

SEQ ID NO: 742960 - DNA, 22 bp, Artificial Sequence
  chemically synthesized
tctagtctttccaactgacctt

SEQ ID NO: 742961 - DNA, 22 bp, Artificial Sequence
  chemically synthesized
caaagcacagaaggtcagttgg

SEQ ID NO: 742962 - DNA, 22 bp, Artificial Sequence
  chemically synthesized
tttctagtctttccaactgacc

SEQ ID NO: 742963 - DNA, 22 bp, Artificial Sequence
  chemically synthesized
ctctttctagtctttccaactg

SEQ ID NO: 742964 - DNA, 22 bp, Artificial Sequence
  chemically synthesized
actctttctagtctttccaact

SEQ ID NO: 742965 - DNA, 22 bp, Artificial Sequence
  chemically synthesized
aatttactctttctagtctttc

SEQ ID NO: 742966 - DNA, 22 bp, Artificial Sequence
  chemically synthesized
cctcaatttactctttctagtc

SEQ ID NO: 742967 - DNA, 22 bp, Artificial Sequence
  chemically synthesized
gaaagactagaaagagtaaatt

SEQ ID NO: 742968 - DNA, 22 bp, Artificial Sequence
  chemically synthesized
caagcagaattccctcaattta

SEQ ID NO: 742969 - DNA, 22 bp, Artificial Sequence
  chemically synthesized
gaaagagtaaattgagggaatt

SEQ ID NO: 742970 - DNA, 22 bp, Artificial Sequence
  chemically synthesized
agggaattctgcttggaggggt

SEQ ID NO: 742971 - DNA, 22 bp, Artificial Sequence
  chemically synthesized
acagaggaaataaaacccctcc

SEQ ID NO: 742972 - DNA, 22 bp, Artificial Sequence
  chemically synthesized
cacagaggaaataaaacccctc

SEQ ID NO: 742973 - DNA, 22 bp, Artificial Sequence
  chemically synthesized
cttcacagaggaaataaaaccc

SEQ ID NO: 742974 - DNA, 22 bp, Artificial Sequence
  chemically synthesized
tgcttggaggggttttatttcc

SEQ ID NO: 742975 - DNA, 22 bp, Artificial Sequence
  chemically synthesized
ctacttcacagaggaaataaaa

SEQ ID NO: 742976 - DNA, 22 bp, Artificial Sequence
  chemically synthesized
cttggaggggttttatttcctc

SEQ ID NO: 742977 - DNA, 22 bp, Artificial Sequence
  chemically synthesized
attcctacttcacagaggaaat

SEQ ID NO: 742978 - DNA, 22 bp, Artificial Sequence
  chemically synthesized
ggaggggttttatttcctctgt

SEQ ID NO: 742979 - DNA, 22 bp, Artificial Sequence
  chemically synthesized
gaggggttttatttcctctgtg

SEQ ID NO: 742980 - DNA, 22 bp, Artificial Sequence
  chemically synthesized
ttgattcctacttcacagagga

SEQ ID NO: 742981 - DNA, 22 bp, Artificial Sequence
  chemically synthesized
tatttcctctgtgaagtaggaa

SEQ ID NO: 742982 - DNA, 22 bp, Artificial Sequence
  chemically synthesized
atttcctctgtgaagtaggaat

SEQ ID NO: 742983 - DNA, 22 bp, Artificial Sequence
  chemically synthesized
tttcctctgtgaagtaggaatc

SEQ ID NO: 742984 - DNA, 22 bp, Artificial Sequence
  chemically synthesized
tgccaggtctgttgattcctac

SEQ ID NO: 742985 - DNA, 22 bp, Artificial Sequence
  chemically synthesized
cctctgtgaagtaggaatcaac

SEQ ID NO: 742986 - DNA, 22 bp, Artificial Sequence
  chemically synthesized
ctctgtgaagtaggaatcaaca

SEQ ID NO: 742987 - DNA, 22 bp, Artificial Sequence
  chemically synthesized
tgtgaagtaggaatcaacagac

SEQ ID NO: 742988 - DNA, 22 bp, Artificial Sequence
  chemically synthesized
cagactatgccaggtctgttga

SEQ ID NO: 742989 - DNA, 22 bp, Artificial Sequence
  chemically synthesized
tgaagtaggaatcaacagacct

SEQ ID NO: 742990 - DNA, 22 bp, Artificial Sequence
  chemically synthesized
tgccaggcactgcagactatgc

SEQ ID NO: 742991 - DNA, 22 bp, Artificial Sequence
  chemically synthesized
cacgctatgccaggcactgcag

SEQ ID NO: 742992 - DNA, 22 bp, Artificial Sequence
  chemically synthesized
gcatagtctgcagtgcctggca

SEQ ID NO: 742993 - DNA, 22 bp, Artificial Sequence
  chemically synthesized
cacaccaggcactgcacgctat

SEQ ID NO: 742994 - DNA, 22 bp, Artificial Sequence
  chemically synthesized
cagtgcctggcatagcgtgcag

SEQ ID NO: 742995 - DNA, 22 bp, Artificial Sequence
  chemically synthesized
attgcacaccaggcactgcacg

SEQ ID NO: 742996 - DNA, 22 bp, Artificial Sequence
  chemically synthesized
ttcattgcacaccaggcactgc

SEQ ID NO: 742997 - DNA, 22 bp, Artificial Sequence
  chemically synthesized
gcatagcgtgcagtgcctggtg

SEQ ID NO: 742998 - DNA, 22 bp, Artificial Sequence
  chemically synthesized
agtgactattcattgcacacca

SEQ ID NO: 742999 - DNA, 22 bp, Artificial Sequence
  chemically synthesized
attcagtgactattcattgcac

SEQ ID NO: 743000 - DNA, 22 bp, Artificial Sequence
  chemically synthesized
cattcagtgactattcattgca

SEQ ID NO: 743001 - DNA, 22 bp, Artificial Sequence
  chemically synthesized
tcattcagtgactattcattgc

SEQ ID NO: 743002 - DNA, 22 bp, Artificial Sequence
  chemically synthesized
atgttttcattcagtgactatt

SEQ ID NO: 743003 - DNA, 22 bp, Artificial Sequence
  chemically synthesized
gtgtgcaatgaatagtcactga

SEQ ID NO: 743004 - DNA, 22 bp, Artificial Sequence
  chemically synthesized
attcatgttttcattcagtgac

SEQ ID NO: 743005 - DNA, 22 bp, Artificial Sequence
  chemically synthesized
aattcatgttttcattcagtga

SEQ ID NO: 743006 - DNA, 22 bp, Artificial Sequence
  chemically synthesized
cccttaattcatgttttcattc

SEQ ID NO: 743007 - DNA, 22 bp, Artificial Sequence
  chemically synthesized
acccttaattcatgttttcatt

SEQ ID NO: 743008 - DNA, 22 bp, Artificial Sequence
  chemically synthesized
ccacttacccttaattcatgtt

SEQ ID NO: 743009 - DNA, 22 bp, Artificial Sequence
  chemically synthesized
aatgaaaacatgaattaagggt

SEQ ID NO: 743010 - DNA, 22 bp, Artificial Sequence
  chemically synthesized
aaatgttcccacttacccttaa

SEQ ID NO: 743011 - DNA, 22 bp, Artificial Sequence
  chemically synthesized
attcaaatgttcccacttaccc

SEQ ID NO: 743012 - DNA, 22 bp, Artificial Sequence
  chemically synthesized
cgattaattcaaatgttcccac

SEQ ID NO: 743013 - DNA, 22 bp, Artificial Sequence
  chemically synthesized
ttacgattaattcaaatgttcc

SEQ ID NO: 743014 - DNA, 22 bp, Artificial Sequence
  chemically synthesized
agggtaagtgggaacatttgaa

SEQ ID NO: 743015 - DNA, 22 bp, Artificial Sequence
  chemically synthesized
tattacgattaattcaaatgtt

SEQ ID NO: 743016 - DNA, 22 bp, Artificial Sequence
  chemically synthesized
acagtctctattacgattaatt

SEQ ID NO: 743017 - DNA, 22 bp, Artificial Sequence
  chemically synthesized
tcacagtctctattacgattaa

SEQ ID NO: 743018 - DNA, 22 bp, Artificial Sequence
  chemically synthesized
cctctcacagtctctattacga

SEQ ID NO: 743019 - DNA, 22 bp, Artificial Sequence
  chemically synthesized
gaattaatcgtaatagagactg

SEQ ID NO: 743020 - DNA, 22 bp, Artificial Sequence
  chemically synthesized
aattaatcgtaatagagactgt

SEQ ID NO: 743021 - DNA, 22 bp, Artificial Sequence
  chemically synthesized
ggtcaactccctctcacagtct

SEQ ID NO: 743022 - DNA, 22 bp, Artificial Sequence
  chemically synthesized
aggtcaactccctctcacagtc

SEQ ID NO: 743023 - DNA, 22 bp, Artificial Sequence
  chemically synthesized
atcgtaatagagactgtgagag

SEQ ID NO: 743024 - DNA, 22 bp, Artificial Sequence
  chemically synthesized
ttaggtcaactccctctcacag

SEQ ID NO: 743025 - DNA, 22 bp, Artificial Sequence
  chemically synthesized
catctcttaggtcaactccctc

SEQ ID NO: 743026 - DNA, 22 bp, Artificial Sequence
  chemically synthesized
attacatctcttaggtcaactc

SEQ ID NO: 743027 - DNA, 22 bp, Artificial Sequence
  chemically synthesized
tgagagggagttgacctaagag

SEQ ID NO: 743028 - DNA, 22 bp, Artificial Sequence
  chemically synthesized
ccaacctcattacatctcttag

SEQ ID NO: 743029 - DNA, 22 bp, Artificial Sequence
  chemically synthesized
gccaacctcattacatctctta

SEQ ID NO: 743030 - DNA, 22 bp, Artificial Sequence
  chemically synthesized
tttgccaacctcattacatctc

SEQ ID NO: 743031 - DNA, 22 bp, Artificial Sequence
  chemically synthesized
acctaagagatgtaatgaggtt

SEQ ID NO: 743032 - DNA, 22 bp, Artificial Sequence
  chemically synthesized
aacactgtttgccaacctcatt

SEQ ID NO: 743033 - DNA, 22 bp, Artificial Sequence
  chemically synthesized
agagatgtaatgaggttggcaa

SEQ ID NO: 743034 - DNA, 22 bp, Artificial Sequence
  chemically synthesized
aagtgggccctcaacactgttt

SEQ ID NO: 743035 - DNA, 22 bp, Artificial Sequence
  chemically synthesized
atcctcaagtgggccctcaaca

SEQ ID NO: 743036 - DNA, 22 bp, Artificial Sequence
  chemically synthesized
gcaaacagtgttgagggcccac

SEQ ID NO: 743037 - DNA, 22 bp, Artificial Sequence
  chemically synthesized
aacctcatcctcaagtgggccc

SEQ ID NO: 743038 - DNA, 22 bp, Artificial Sequence
  chemically synthesized
aaaaatgttgaacctcatcctc

SEQ ID NO: 743039 - DNA, 22 bp, Artificial Sequence
  chemically synthesized
agggcccacttgaggatgaggt

SEQ ID NO: 743040 - DNA, 22 bp, Artificial Sequence
  chemically synthesized
ctaaaaaatgttgaacctcatc

SEQ ID NO: 743041 - DNA, 22 bp, Artificial Sequence
  chemically synthesized
tgctaaaaaatgttgaacctca

SEQ ID NO: 743042 - DNA, 22 bp, Artificial Sequence
  chemically synthesized
gttctgctaaaaaatgttgaac

SEQ ID NO: 743043 - DNA, 22 bp, Artificial Sequence
  chemically synthesized
gaggatgaggttcaacattttt

SEQ ID NO: 743044 - DNA, 22 bp, Artificial Sequence
  chemically synthesized
aggatgaggttcaacatttttt

SEQ ID NO: 743045 - DNA, 22 bp, Artificial Sequence
  chemically synthesized
aacattttttagcagaaccaat

SEQ ID NO: 743046 - DNA, 22 bp, Artificial Sequence
  chemically synthesized
tttagcagaaccaatctgcctg

SEQ ID NO: 743047 - DNA, 22 bp, Artificial Sequence
  chemically synthesized
ttagcagaaccaatctgcctga

SEQ ID NO: 743048 - DNA, 22 bp, Artificial Sequence
  chemically synthesized
tagcagaaccaatctgcctgac

SEQ ID NO: 743049 - DNA, 22 bp, Artificial Sequence
  chemically synthesized
agcagaaccaatctgcctgact

SEQ ID NO: 743050 - DNA, 22 bp, Artificial Sequence
  chemically synthesized
gcagaaccaatctgcctgactt

SEQ ID NO: 743051 - DNA, 22 bp, Artificial Sequence
  chemically synthesized
gagaaaatgagaaagtcaggca

SEQ ID NO: 743052 - DNA, 22 bp, Artificial Sequence
  chemically synthesized
ttggagaaaatgagaaagtcag

SEQ ID NO: 743053 - DNA, 22 bp, Artificial Sequence
  chemically synthesized
cctgactttctcattttctcca

SEQ ID NO: 743054 - DNA, 22 bp, Artificial Sequence
  chemically synthesized
catgcaacactgttggagaaaa

SEQ ID NO: 743055 - DNA, 22 bp, Artificial Sequence
  chemically synthesized
acatgcaacactgttggagaaa

SEQ ID NO: 743056 - DNA, 22 bp, Artificial Sequence
  chemically synthesized
actttctcattttctccaacag

SEQ ID NO: 743057 - DNA, 22 bp, Artificial Sequence
  chemically synthesized
tctcattttctccaacagtgtt

SEQ ID NO: 743058 - DNA, 22 bp, Artificial Sequence
  chemically synthesized
ctcattttctccaacagtgttg

SEQ ID NO: 743059 - DNA, 22 bp, Artificial Sequence
  chemically synthesized
tcattttctccaacagtgttgc

SEQ ID NO: 743060 - DNA, 22 bp, Artificial Sequence
  chemically synthesized
cccatgcttacatgcaacactg

SEQ ID NO: 743061 - DNA, 22 bp, Artificial Sequence
  chemically synthesized
attttctccaacagtgttgcat

SEQ ID NO: 743062 - DNA, 22 bp, Artificial Sequence
  chemically synthesized
ccccatgcttacatgcaacact

SEQ ID NO: 743063 - DNA, 22 bp, Artificial Sequence
  chemically synthesized
tccccatgcttacatgcaacac

SEQ ID NO: 743064 - DNA, 22 bp, Artificial Sequence
  chemically synthesized
tctccaacagtgttgcatgtaa

SEQ ID NO: 743065 - DNA, 22 bp, Artificial Sequence
  chemically synthesized
ttttccccatgcttacatgcaa

SEQ ID NO: 743066 - DNA, 22 bp, Artificial Sequence
  chemically synthesized
ctccaacagtgttgcatgtaag

SEQ ID NO: 743067 - DNA, 22 bp, Artificial Sequence
  chemically synthesized
tccaacagtgttgcatgtaagc

SEQ ID NO: 743068 - DNA, 22 bp, Artificial Sequence
  chemically synthesized
caacagtgttgcatgtaagcat

SEQ ID NO: 743069 - DNA, 22 bp, Artificial Sequence
  chemically synthesized
gatcaactgttttccccatgct

SEQ ID NO: 743070 - DNA, 22 bp, Artificial Sequence
  chemically synthesized
catgtaagcatggggaaaacag

SEQ ID NO: 743071 - DNA, 22 bp, Artificial Sequence
  chemically synthesized
acgaaaccccaaacctggatca

SEQ ID NO: 743072 - DNA, 22 bp, Artificial Sequence
  chemically synthesized
atccaggtttggggtttcgtca

SEQ ID NO: 743073 - DNA, 22 bp, Artificial Sequence
  chemically synthesized
aatgtgtgagccacagtcatct

SEQ ID NO: 743074 - DNA, 22 bp, Artificial Sequence
  chemically synthesized
ggggtttcgtcagatgactgtg

SEQ ID NO: 743075 - DNA, 22 bp, Artificial Sequence
  chemically synthesized
gggtttcgtcagatgactgtgg

SEQ ID NO: 743076 - DNA, 22 bp, Artificial Sequence
  chemically synthesized
tccctaaatgtgtgagccacag

SEQ ID NO: 743077 - DNA, 22 bp, Artificial Sequence
  chemically synthesized
atccctaaatgtgtgagccaca

SEQ ID NO: 743078 - DNA, 22 bp, Artificial Sequence
  chemically synthesized
cgtcagatgactgtggctcaca

SEQ ID NO: 743079 - DNA, 22 bp, Artificial Sequence
  chemically synthesized
gtcagatgactgtggctcacac

SEQ ID NO: 743080 - DNA, 22 bp, Artificial Sequence
  chemically synthesized
ccttatccctaaatgtgtgagc

SEQ ID NO: 743081 - DNA, 22 bp, Artificial Sequence
  chemically synthesized
tggctcacacatttagggataa

SEQ ID NO: 743082 - DNA, 22 bp, Artificial Sequence
  chemically synthesized
atatcgaaactcccttatccct

SEQ ID NO: 743083 - DNA, 22 bp, Artificial Sequence
  chemically synthesized
acacatttagggataagggagt

SEQ ID NO: 743084 - DNA, 22 bp, Artificial Sequence
  chemically synthesized
gctaatatcgaaactcccttat

SEQ ID NO: 743085 - DNA, 22 bp, Artificial Sequence
  chemically synthesized
catcctggctaatatcgaaact

SEQ ID NO: 743086 - DNA, 22 bp, Artificial Sequence
  chemically synthesized
agggataagggagtttcgatat

SEQ ID NO: 743087 - DNA, 22 bp, Artificial Sequence
  chemically synthesized
gggataagggagtttcgatatt

SEQ ID NO: 743088 - DNA, 22 bp, Artificial Sequence
  chemically synthesized
aattacatcctggctaatatcg

SEQ ID NO: 743089 - DNA, 22 bp, Artificial Sequence
  chemically synthesized
caattacatcctggctaatatc

SEQ ID NO: 743090 - DNA, 22 bp, Artificial Sequence
  chemically synthesized
tcaattacatcctggctaatat

SEQ ID NO: 743091 - DNA, 22 bp, Artificial Sequence
  chemically synthesized
ttcaattacatcctggctaata

SEQ ID NO: 743092 - DNA, 22 bp, Artificial Sequence
  chemically synthesized
tttcaattacatcctggctaat

SEQ ID NO: 743093 - DNA, 22 bp, Artificial Sequence
  chemically synthesized
cgatattagccaggatgtaatt

SEQ ID NO: 743094 - DNA, 22 bp, Artificial Sequence
  chemically synthesized
gatattagccaggatgtaattg

SEQ ID NO: 743095 - DNA, 22 bp, Artificial Sequence
  chemically synthesized
cacagtatattttttcaattac

SEQ ID NO: 743096 - DNA, 22 bp, Artificial Sequence
  chemically synthesized
gccaggatgtaattgaaaaaat

SEQ ID NO: 743097 - DNA, 22 bp, Artificial Sequence
  chemically synthesized
gattccacagtatattttttca

SEQ ID NO: 743098 - DNA, 22 bp, Artificial Sequence
  chemically synthesized
agattccacagtatattttttc

SEQ ID NO: 743099 - DNA, 22 bp, Artificial Sequence
  chemically synthesized
atccagtttagattccacagta

SEQ ID NO: 743100 - DNA, 22 bp, Artificial Sequence
  chemically synthesized
ctaatccagtttagattccaca

SEQ ID NO: 743101 - DNA, 22 bp, Artificial Sequence
  chemically synthesized
aaaaaatatactgtggaatcta

SEQ ID NO: 743102 - DNA, 22 bp, Artificial Sequence
  chemically synthesized
ctcctaatccagtttagattcc

SEQ ID NO: 743103 - DNA, 22 bp, Artificial Sequence
  chemically synthesized
cctcctaatccagtttagattc

SEQ ID NO: 743104 - DNA, 22 bp, Artificial Sequence
  chemically synthesized
tcctcctaatccagtttagatt

SEQ ID NO: 743105 - DNA, 22 bp, Artificial Sequence
  chemically synthesized
ctttcctcctaatccagtttag

SEQ ID NO: 743106 - DNA, 22 bp, Artificial Sequence
  chemically synthesized
gctttcctcctaatccagttta

SEQ ID NO: 743107 - DNA, 22 bp, Artificial Sequence
  chemically synthesized
tgctttcctcctaatccagttt

SEQ ID NO: 743108 - DNA, 22 bp, Artificial Sequence
  chemically synthesized
ctttgctttcctcctaatccag

SEQ ID NO: 743109 - DNA, 22 bp, Artificial Sequence
  chemically synthesized
tggaatctaaactggattagga

SEQ ID NO: 743110 - DNA, 22 bp, Artificial Sequence
  chemically synthesized
gctttgctttcctcctaatcca

SEQ ID NO: 743111 - DNA, 22 bp, Artificial Sequence
  chemically synthesized
tgctttgctttcctcctaatcc

SEQ ID NO: 743112 - DNA, 22 bp, Artificial Sequence
  chemically synthesized
attttgctttgctttcctccta

SEQ ID NO: 743113 - DNA, 22 bp, Artificial Sequence
  chemically synthesized
cattttgctttgctttcctcct

SEQ ID NO: 743114 - DNA, 22 bp, Artificial Sequence
  chemically synthesized
aactggattaggaggaaagcaa

SEQ ID NO: 743115 - DNA, 22 bp, Artificial Sequence
  chemically synthesized
caagcttcattttgctttgctt

SEQ ID NO: 743116 - DNA, 22 bp, Artificial Sequence
  chemically synthesized
gattaggaggaaagcaaagcaa

SEQ ID NO: 743117 - DNA, 22 bp, Artificial Sequence
  chemically synthesized
ggaggaaagcaaagcaaaatga

SEQ ID NO: 743118 - DNA, 22 bp, Artificial Sequence
  chemically synthesized
catctacaagcttcattttgct

SEQ ID NO: 743119 - DNA, 22 bp, Artificial Sequence
  chemically synthesized
tccatctacaagcttcattttg

SEQ ID NO: 743120 - DNA, 22 bp, Artificial Sequence
  chemically synthesized
tctccatctacaagcttcattt

SEQ ID NO: 743121 - DNA, 22 bp, Artificial Sequence
  chemically synthesized
ctctccatctacaagcttcatt

SEQ ID NO: 743122 - DNA, 22 bp, Artificial Sequence
  chemically synthesized
tctctccatctacaagcttcat

SEQ ID NO: 743123 - DNA, 22 bp, Artificial Sequence
  chemically synthesized
ctttctctccatctacaagctt

SEQ ID NO: 743124 - DNA, 22 bp, Artificial Sequence
  chemically synthesized
tactttctctccatctacaagc

SEQ ID NO: 743125 - DNA, 22 bp, Artificial Sequence
  chemically synthesized
acccctctactttctctccatc

SEQ ID NO: 743126 - DNA, 22 bp, Artificial Sequence
  chemically synthesized
caactgacccctctactttctc

SEQ ID NO: 743127 - DNA, 22 bp, Artificial Sequence
  chemically synthesized
tacaactgacccctctactttc

SEQ ID NO: 743128 - DNA, 22 bp, Artificial Sequence
  chemically synthesized
gtagatggagagaaagtagagg

SEQ ID NO: 743129 - DNA, 22 bp, Artificial Sequence
  chemically synthesized
ctacaactgacccctctacttt

SEQ ID NO: 743130 - DNA, 22 bp, Artificial Sequence
  chemically synthesized
tagatggagagaaagtagaggg

SEQ ID NO: 743131 - DNA, 22 bp, Artificial Sequence
  chemically synthesized
gacttctacaactgacccctct

SEQ ID NO: 743132 - DNA, 22 bp, Artificial Sequence
  chemically synthesized
tcctggacttctacaactgacc

SEQ ID NO: 743133 - DNA, 22 bp, Artificial Sequence
  chemically synthesized
tggattatcctggacttctaca

SEQ ID NO: 743134 - DNA, 22 bp, Artificial Sequence
  chemically synthesized
atggattatcctggacttctac

SEQ ID NO: 743135 - DNA, 22 bp, Artificial Sequence
  chemically synthesized
tatggattatcctggacttcta

SEQ ID NO: 743136 - DNA, 22 bp, Artificial Sequence
  chemically synthesized
ttatggattatcctggacttct

SEQ ID NO: 743137 - DNA, 22 bp, Artificial Sequence
  chemically synthesized
tggccttttatggattatcctg

SEQ ID NO: 743138 - DNA, 22 bp, Artificial Sequence
  chemically synthesized
ctgtggccttttatggattatc

SEQ ID NO: 743139 - DNA, 22 bp, Artificial Sequence
  chemically synthesized
tagaagtccaggataatccata

SEQ ID NO: 743140 - DNA, 22 bp, Artificial Sequence
  chemically synthesized
ctgctgtggccttttatggatt

SEQ ID NO: 743141 - DNA, 22 bp, Artificial Sequence
  chemically synthesized
ctcctgctgtggccttttatgg

SEQ ID NO: 743142 - DNA, 22 bp, Artificial Sequence
  chemically synthesized
tgcagctactcctgctgtggcc

SEQ ID NO: 743143 - DNA, 22 bp, Artificial Sequence
  chemically synthesized
gtgcagctactcctgctgtggc

SEQ ID NO: 743144 - DNA, 22 bp, Artificial Sequence
  chemically synthesized
tttgtgcagctactcctgctgt

SEQ ID NO: 743145 - DNA, 22 bp, Artificial Sequence
  chemically synthesized
gtttgtgcagctactcctgctg

SEQ ID NO: 743146 - DNA, 22 bp, Artificial Sequence
  chemically synthesized
tcgcttgtttgtgcagctactc

SEQ ID NO: 743147 - DNA, 22 bp, Artificial Sequence
  chemically synthesized
tgtcgcttgtttgtgcagctac

SEQ ID NO: 743148 - DNA, 22 bp, Artificial Sequence
  chemically synthesized
tctgtcgcttgtttgtgcagct

SEQ ID NO: 743149 - DNA, 22 bp, Artificial Sequence
  chemically synthesized
ccctctctgtcgcttgtttgtg

SEQ ID NO: 743150 - DNA, 22 bp, Artificial Sequence
  chemically synthesized
cacaaacaagcgacagagaggg

SEQ ID NO: 743151 - DNA, 22 bp, Artificial Sequence
  chemically synthesized
agcatcccagagtctcccctct

SEQ ID NO: 743152 - DNA, 22 bp, Artificial Sequence
  chemically synthesized
atctgagcatcccagagtctcc

SEQ ID NO: 743153 - DNA, 22 bp, Artificial Sequence
  chemically synthesized
tgggatgctcagattagctcta

SEQ ID NO: 743154 - DNA, 22 bp, Artificial Sequence
  chemically synthesized
ggatgctcagattagctctact

SEQ ID NO: 743155 - DNA, 22 bp, Artificial Sequence
  chemically synthesized
ataagtggcaaatccagtagag

SEQ ID NO: 743156 - DNA, 22 bp, Artificial Sequence
  chemically synthesized
agattagctctactggatttgc

SEQ ID NO: 743157 - DNA, 22 bp, Artificial Sequence
  chemically synthesized
gctctactggatttgccactta

SEQ ID NO: 743158 - DNA, 22 bp, Artificial Sequence
  chemically synthesized
taaataaactcataagtggcaa

SEQ ID NO: 743159 - DNA, 22 bp, Artificial Sequence
  chemically synthesized
ataaataaactcataagtggca

SEQ ID NO: 743160 - DNA, 22 bp, Artificial Sequence
  chemically synthesized
tactggatttgccacttatgag

SEQ ID NO: 743161 - DNA, 22 bp, Artificial Sequence
  chemically synthesized
ctggatttgccacttatgagtt

SEQ ID NO: 743162 - DNA, 22 bp, Artificial Sequence
  chemically synthesized
gatttgccacttatgagtttat

SEQ ID NO: 743163 - DNA, 22 bp, Artificial Sequence
  chemically synthesized
gccacttatgagtttatttata

SEQ ID NO: 743164 - DNA, 22 bp, Artificial Sequence
  chemically synthesized
ccacttatgagtttatttataa

SEQ ID NO: 743165 - DNA, 22 bp, Artificial Sequence
  chemically synthesized
atgagtttatttataaatggtg

SEQ ID NO: 743166 - DNA, 22 bp, Artificial Sequence
  chemically synthesized
tgagtttatttataaatggtgt

SEQ ID NO: 743167 - DNA, 22 bp, Artificial Sequence
  chemically synthesized
atttataaatggtgtgatatat

SEQ ID NO: 743168 - DNA, 22 bp, Artificial Sequence
  chemically synthesized
tttataaatggtgtgatatata

SEQ ID NO: 743169 - DNA, 22 bp, Artificial Sequence
  chemically synthesized
ataaatggtgtgatatatatat

SEQ ID NO: 743170 - DNA, 22 bp, Artificial Sequence
  chemically synthesized
taaatggtgtgatatatatata

SEQ ID NO: 743171 - DNA, 22 bp, Artificial Sequence
  chemically synthesized
tatatatatatatatatatata

SEQ ID NO: 743172 - DNA, 22 bp, Artificial Sequence
  chemically synthesized
tctatatatatatatatatata

SEQ ID NO: 743173 - DNA, 22 bp, Artificial Sequence
  chemically synthesized
tctatctatatatatatatata

SEQ ID NO: 743174 - DNA, 22 bp, Artificial Sequence
  chemically synthesized
tctatctatctatatatatata

SEQ ID NO: 743175 - DNA, 22 bp, Artificial Sequence
  chemically synthesized
tctatctatctatctatatata

SEQ ID NO: 743176 - DNA, 22 bp, Artificial Sequence
  chemically synthesized
tatctatctatctatctatata

SEQ ID NO: 743177 - DNA, 22 bp, Artificial Sequence
  chemically synthesized
ctatctatctatctatctatat

SEQ ID NO: 743178 - DNA, 22 bp, Artificial Sequence
  chemically synthesized
tatatatatagccagatttcta

SEQ ID NO: 743179 - DNA, 22 bp, Artificial Sequence
  chemically synthesized
atatatatatagccagatttct

SEQ ID NO: 743180 - DNA, 22 bp, Artificial Sequence
  chemically synthesized
tatatatttatatatatatagc

SEQ ID NO: 743181 - DNA, 22 bp, Artificial Sequence
  chemically synthesized
agtagcactatatatatttata

SEQ ID NO: 743182 - DNA, 22 bp, Artificial Sequence
  chemically synthesized
gctatatatatataaatatata

SEQ ID NO: 743183 - DNA, 22 bp, Artificial Sequence
  chemically synthesized
tatatatataaatatatatagt

SEQ ID NO: 743184 - DNA, 22 bp, Artificial Sequence
  chemically synthesized
aaacactgagtagcactatata

SEQ ID NO: 743185 - DNA, 22 bp, Artificial Sequence
  chemically synthesized
caaacactgagtagcactatat

SEQ ID NO: 743186 - DNA, 22 bp, Artificial Sequence
  chemically synthesized
tcaaacactgagtagcactata

SEQ ID NO: 743187 - DNA, 22 bp, Artificial Sequence
  chemically synthesized
ttcaaacactgagtagcactat

SEQ ID NO: 743188 - DNA, 22 bp, Artificial Sequence
  chemically synthesized
agaagggaagtttttcaaacac

SEQ ID NO: 743189 - DNA, 22 bp, Artificial Sequence
  chemically synthesized
ctcagtgtttgaaaaacttccc

SEQ ID NO: 743190 - DNA, 22 bp, Artificial Sequence
  chemically synthesized
atatccctaagaagggaagttt

SEQ ID NO: 743191 - DNA, 22 bp, Artificial Sequence
  chemically synthesized
aatatccctaagaagggaagtt

SEQ ID NO: 743192 - DNA, 22 bp, Artificial Sequence
  chemically synthesized
agtgtttgaaaaacttcccttc

SEQ ID NO: 743193 - DNA, 22 bp, Artificial Sequence
  chemically synthesized
gaaaaacttcccttcttaggga

SEQ ID NO: 743194 - DNA, 22 bp, Artificial Sequence
  chemically synthesized
aaaaacttcccttcttagggat

SEQ ID NO: 743195 - DNA, 22 bp, Artificial Sequence
  chemically synthesized
ggaggaatatttaatatcccta

SEQ ID NO: 743196 - DNA, 22 bp, Artificial Sequence
  chemically synthesized
aggaggaatatttaatatccct

SEQ ID NO: 743197 - DNA, 22 bp, Artificial Sequence
  chemically synthesized
taggaggaatatttaatatccc

SEQ ID NO: 743198 - DNA, 22 bp, Artificial Sequence
  chemically synthesized
cccttcttagggatattaaata

SEQ ID NO: 743199 - DNA, 22 bp, Artificial Sequence
  chemically synthesized
ccttcttagggatattaaatat

SEQ ID NO: 743200 - DNA, 22 bp, Artificial Sequence
  chemically synthesized
agattttaggaggaatatttaa

SEQ ID NO: 743201 - DNA, 22 bp, Artificial Sequence
  chemically synthesized
cttagggatattaaatattcct

SEQ ID NO: 743202 - DNA, 22 bp, Artificial Sequence
  chemically synthesized
ttagggatattaaatattcctc

SEQ ID NO: 743203 - DNA, 22 bp, Artificial Sequence
  chemically synthesized
agggatattaaatattcctcct

SEQ ID NO: 743204 - DNA, 22 bp, Artificial Sequence
  chemically synthesized
gggatattaaatattcctccta

SEQ ID NO: 743205 - DNA, 22 bp, Artificial Sequence
  chemically synthesized
gcaggttaagattttaggagga

SEQ ID NO: 743206 - DNA, 22 bp, Artificial Sequence
  chemically synthesized
aatattcctcctaaaatcttaa

SEQ ID NO: 743207 - DNA, 22 bp, Artificial Sequence
  chemically synthesized
tgagttagcaggttaagatttt

SEQ ID NO: 743208 - DNA, 22 bp, Artificial Sequence
  chemically synthesized
ctcctaaaatcttaacctgcta

SEQ ID NO: 743209 - DNA, 22 bp, Artificial Sequence
  chemically synthesized
ctaaaatcttaacctgctaact

SEQ ID NO: 743210 - DNA, 22 bp, Artificial Sequence
  chemically synthesized
aaatcttaacctgctaactcat

SEQ ID NO: 743211 - DNA, 22 bp, Artificial Sequence
  chemically synthesized
aacctgctaactcatagacgtc

SEQ ID NO: 743212 - DNA, 22 bp, Artificial Sequence
  chemically synthesized
acctgctaactcatagacgtcc

SEQ ID NO: 743213 - DNA, 22 bp, Artificial Sequence
  chemically synthesized
gtaagtgagataggacgtctat

SEQ ID NO: 743214 - DNA, 22 bp, Artificial Sequence
  chemically synthesized
ctagtaagtgagataggacgtc

SEQ ID NO: 743215 - DNA, 22 bp, Artificial Sequence
  chemically synthesized
ctaactcatagacgtcctatct

SEQ ID NO: 743216 - DNA, 22 bp, Artificial Sequence
  chemically synthesized
actcatagacgtcctatctcac

SEQ ID NO: 743217 - DNA, 22 bp, Artificial Sequence
  chemically synthesized
aattcctagtaagtgagatagg

SEQ ID NO: 743218 - DNA, 22 bp, Artificial Sequence
  chemically synthesized
gaattcctagtaagtgagatag

SEQ ID NO: 743219 - DNA, 22 bp, Artificial Sequence
  chemically synthesized
tgaattcctagtaagtgagata

SEQ ID NO: 743220 - DNA, 22 bp, Artificial Sequence
  chemically synthesized
atagacgtcctatctcacttac

SEQ ID NO: 743221 - DNA, 22 bp, Artificial Sequence
  chemically synthesized
gtaattttgaattcctagtaag

SEQ ID NO: 743222 - DNA, 22 bp, Artificial Sequence
  chemically synthesized
tctcacttactaggaattcaaa

SEQ ID NO: 743223 - DNA, 22 bp, Artificial Sequence
  chemically synthesized
gaacctagtaattttgaattcc

SEQ ID NO: 743224 - DNA, 22 bp, Artificial Sequence
  chemically synthesized
ggaacctagtaattttgaattc

SEQ ID NO: 743225 - DNA, 22 bp, Artificial Sequence
  chemically synthesized
tggaacctagtaattttgaatt

SEQ ID NO: 743226 - DNA, 22 bp, Artificial Sequence
  chemically synthesized
ttggaacctagtaattttgaat

SEQ ID NO: 743227 - DNA, 22 bp, Artificial Sequence
  chemically synthesized
acttactaggaattcaaaatta

SEQ ID NO: 743228 - DNA, 22 bp, Artificial Sequence
  chemically synthesized
atttttggaacctagtaatttt

SEQ ID NO: 743229 - DNA, 22 bp, Artificial Sequence
  chemically synthesized
actaggaattcaaaattactag

SEQ ID NO: 743230 - DNA, 22 bp, Artificial Sequence
  chemically synthesized
catttttggaacctagtaattt

SEQ ID NO: 743231 - DNA, 22 bp, Artificial Sequence
  chemically synthesized
ctaggaattcaaaattactagg

SEQ ID NO: 743232 - DNA, 22 bp, Artificial Sequence
  chemically synthesized
ggaattcaaaattactaggttc

SEQ ID NO: 743233 - DNA, 22 bp, Artificial Sequence
  chemically synthesized
aaaattactaggttccaaaaat

SEQ ID NO: 743234 - DNA, 22 bp, Artificial Sequence
  chemically synthesized
ctaggttccaaaaatgaagtgt

SEQ ID NO: 743235 - DNA, 22 bp, Artificial Sequence
  chemically synthesized
ggttccaaaaatgaagtgttat

SEQ ID NO: 743236 - DNA, 22 bp, Artificial Sequence
  chemically synthesized
caaaaatgaagtgttattcttg

SEQ ID NO: 743237 - DNA, 22 bp, Artificial Sequence
  chemically synthesized
cacgtgtatgtagcccaagaat

SEQ ID NO: 743238 - DNA, 22 bp, Artificial Sequence
  chemically synthesized
tgcacgtgtatgtagcccaaga

SEQ ID NO: 743239 - DNA, 22 bp, Artificial Sequence
  chemically synthesized
tctgcacgtgtatgtagcccaa

SEQ ID NO: 743240 - DNA, 22 bp, Artificial Sequence
  chemically synthesized
ctctgcacgtgtatgtagccca

SEQ ID NO: 743241 - DNA, 22 bp, Artificial Sequence
  chemically synthesized
ttcttgggctacatacacgtgc

SEQ ID NO: 743242 - DNA, 22 bp, Artificial Sequence
  chemically synthesized
ttgggctacatacacgtgcaga

SEQ ID NO: 743243 - DNA, 22 bp, Artificial Sequence
  chemically synthesized
taacataaatttctctgcacgt

SEQ ID NO: 743244 - DNA, 22 bp, Artificial Sequence
  chemically synthesized
gggctacatacacgtgcagaga

SEQ ID NO: 743245 - DNA, 22 bp, Artificial Sequence
  chemically synthesized
gtaacataaatttctctgcacg

SEQ ID NO: 743246 - DNA, 22 bp, Artificial Sequence
  chemically synthesized
ggctacatacacgtgcagagaa

SEQ ID NO: 743247 - DNA, 22 bp, Artificial Sequence
  chemically synthesized
catacacgtgcagagaaattta

SEQ ID NO: 743248 - DNA, 22 bp, Artificial Sequence
  chemically synthesized
agtaatatttgtaacataaatt

SEQ ID NO: 743249 - DNA, 22 bp, Artificial Sequence
  chemically synthesized
aagtaatatttgtaacataaat

SEQ ID NO: 743250 - DNA, 22 bp, Artificial Sequence
  chemically synthesized
cttaagtaatatttgtaacata

SEQ ID NO: 743251 - DNA, 22 bp, Artificial Sequence
  chemically synthesized
gtccctacttaagtaatatttg

SEQ ID NO: 743252 - DNA, 22 bp, Artificial Sequence
  chemically synthesized
atgttacaaatattacttaagt

SEQ ID NO: 743253 - DNA, 22 bp, Artificial Sequence
  chemically synthesized
tgttacaaatattacttaagta

SEQ ID NO: 743254 - DNA, 22 bp, Artificial Sequence
  chemically synthesized
caaatattacttaagtagggac

SEQ ID NO: 743255 - DNA, 22 bp, Artificial Sequence
  chemically synthesized
cttaagtagggactaatggcat

SEQ ID NO: 743256 - DNA, 22 bp, Artificial Sequence
  chemically synthesized
atggtagacagcaatgccatta

SEQ ID NO: 743257 - DNA, 22 bp, Artificial Sequence
  chemically synthesized
aagtagggactaatggcattgc

SEQ ID NO: 743258 - DNA, 22 bp, Artificial Sequence
  chemically synthesized
agtagggactaatggcattgct

SEQ ID NO: 743259 - DNA, 22 bp, Artificial Sequence
  chemically synthesized
acaaggattcatggtagacagc

SEQ ID NO: 743260 - DNA, 22 bp, Artificial Sequence
  chemically synthesized
gacaaggattcatggtagacag

SEQ ID NO: 743261 - DNA, 22 bp, Artificial Sequence
  chemically synthesized
atggcattgctgtctaccatga

SEQ ID NO: 743262 - DNA, 22 bp, Artificial Sequence
  chemically synthesized
tttgacaaggattcatggtaga

SEQ ID NO: 743263 - DNA, 22 bp, Artificial Sequence
  chemically synthesized
gtttgacaaggattcatggtag

SEQ ID NO: 743264 - DNA, 22 bp, Artificial Sequence
  chemically synthesized
ctgtctaccatgaatccttgtc

SEQ ID NO: 743265 - DNA, 22 bp, Artificial Sequence
  chemically synthesized
acaaacatttgtttgacaagga

SEQ ID NO: 743266 - DNA, 22 bp, Artificial Sequence
  chemically synthesized
tctaccatgaatccttgtcaaa

SEQ ID NO: 743267 - DNA, 22 bp, Artificial Sequence
  chemically synthesized
gttaacaaacatttgtttgaca

SEQ ID NO: 743268 - DNA, 22 bp, Artificial Sequence
  chemically synthesized
ccatgaatccttgtcaaacaaa

SEQ ID NO: 743269 - DNA, 22 bp, Artificial Sequence
  chemically synthesized
ggttaacaaacatttgtttgac

SEQ ID NO: 743270 - DNA, 22 bp, Artificial Sequence
  chemically synthesized
caagagtcttggttaacaaaca

SEQ ID NO: 743271 - DNA, 22 bp, Artificial Sequence
  chemically synthesized
ccaagagtcttggttaacaaac

SEQ ID NO: 743272 - DNA, 22 bp, Artificial Sequence
  chemically synthesized
gtcaaacaaatgtttgttaacc

SEQ ID NO: 743273 - DNA, 22 bp, Artificial Sequence
  chemically synthesized
tccaagagtcttggttaacaaa

SEQ ID NO: 743274 - DNA, 22 bp, Artificial Sequence
  chemically synthesized
tcaaacaaatgtttgttaacca

SEQ ID NO: 743275 - DNA, 22 bp, Artificial Sequence
  chemically synthesized
ttttccaagagtcttggttaac

SEQ ID NO: 743276 - DNA, 22 bp, Artificial Sequence
  chemically synthesized
ggctgttttccaagagtcttgg

SEQ ID NO: 743277 - DNA, 22 bp, Artificial Sequence
  chemically synthesized
aggctgttttccaagagtcttg

SEQ ID NO: 743278 - DNA, 22 bp, Artificial Sequence
  chemically synthesized
taggctgttttccaagagtctt

SEQ ID NO: 743279 - DNA, 22 bp, Artificial Sequence
  chemically synthesized
ttaggctgttttccaagagtct

SEQ ID NO: 743280 - DNA, 22 bp, Artificial Sequence
  chemically synthesized
tttaggctgttttccaagagtc

SEQ ID NO: 743281 - DNA, 22 bp, Artificial Sequence
  chemically synthesized
tttttaggctgttttccaagag

SEQ ID NO: 743282 - DNA, 22 bp, Artificial Sequence
  chemically synthesized
gttaaccaagactcttggaaaa

SEQ ID NO: 743283 - DNA, 22 bp, Artificial Sequence
  chemically synthesized
ttaaccaagactcttggaaaac

SEQ ID NO: 743284 - DNA, 22 bp, Artificial Sequence
  chemically synthesized
ctctttttaggctgttttccaa

SEQ ID NO: 743285 - DNA, 22 bp, Artificial Sequence
  chemically synthesized
accaagactcttggaaaacagc

SEQ ID NO: 743286 - DNA, 22 bp, Artificial Sequence
  chemically synthesized
gcacctcctctttttaggctgt

SEQ ID NO: 743287 - DNA, 22 bp, Artificial Sequence
  chemically synthesized
ctagcacctcctctttttaggc

SEQ ID NO: 743288 - DNA, 22 bp, Artificial Sequence
  chemically synthesized
cctagcacctcctctttttagg

SEQ ID NO: 743289 - DNA, 22 bp, Artificial Sequence
  chemically synthesized
ttggaaaacagcctaaaaagag

SEQ ID NO: 743290 - DNA, 22 bp, Artificial Sequence
  chemically synthesized
tcctagcacctcctctttttag

SEQ ID NO: 743291 - DNA, 22 bp, Artificial Sequence
  chemically synthesized
ggaaaacagcctaaaaagagga

SEQ ID NO: 743292 - DNA, 22 bp, Artificial Sequence
  chemically synthesized
tttcctagcacctcctcttttt

SEQ ID NO: 743293 - DNA, 22 bp, Artificial Sequence
  chemically synthesized
gaaaacagcctaaaaagaggag

SEQ ID NO: 743294 - DNA, 22 bp, Artificial Sequence
  chemically synthesized
ctttcctagcacctcctctttt

SEQ ID NO: 743295 - DNA, 22 bp, Artificial Sequence
  chemically synthesized
tctttcctagcacctcctcttt

SEQ ID NO: 743296 - DNA, 22 bp, Artificial Sequence
  chemically synthesized
ttctttcctagcacctcctctt

SEQ ID NO: 743297 - DNA, 22 bp, Artificial Sequence
  chemically synthesized
ggacttttctttcctagcacct

SEQ ID NO: 743298 - DNA, 22 bp, Artificial Sequence
  chemically synthesized
aaaagaggaggtgctaggaaag

SEQ ID NO: 743299 - DNA, 22 bp, Artificial Sequence
  chemically synthesized
agcatgaagaatgctgggactt

SEQ ID NO: 743300 - DNA, 22 bp, Artificial Sequence
  chemically synthesized
ggaaagaaaagtcccagcattc

SEQ ID NO: 743301 - DNA, 22 bp, Artificial Sequence
  chemically synthesized
gctcagcatgaagaatgctggg

SEQ ID NO: 743302 - DNA, 22 bp, Artificial Sequence
  chemically synthesized
atgactagctcagcatgaagaa

SEQ ID NO: 743303 - DNA, 22 bp, Artificial Sequence
  chemically synthesized
tcatgactagctcagcatgaag

SEQ ID NO: 743304 - DNA, 22 bp, Artificial Sequence
  chemically synthesized
ctcatgactagctcagcatgaa

SEQ ID NO: 743305 - DNA, 22 bp, Artificial Sequence
  chemically synthesized
ccttctcatgactagctcagca

SEQ ID NO: 743306 - DNA, 22 bp, Artificial Sequence
  chemically synthesized
gccttctcatgactagctcagc

SEQ ID NO: 743307 - DNA, 22 bp, Artificial Sequence
  chemically synthesized
atccttgccttctcatgactag

SEQ ID NO: 743308 - DNA, 22 bp, Artificial Sequence
  chemically synthesized
ttcatgctgagctagtcatgag

SEQ ID NO: 743309 - DNA, 22 bp, Artificial Sequence
  chemically synthesized
catgctgagctagtcatgagaa

SEQ ID NO: 743310 - DNA, 22 bp, Artificial Sequence
  chemically synthesized
ctcatccttgccttctcatgac

SEQ ID NO: 743311 - DNA, 22 bp, Artificial Sequence
  chemically synthesized
atgctgagctagtcatgagaag

SEQ ID NO: 743312 - DNA, 22 bp, Artificial Sequence
  chemically synthesized
attgctcatccttgccttctca

SEQ ID NO: 743313 - DNA, 22 bp, Artificial Sequence
  chemically synthesized
taattgctcatccttgccttct

SEQ ID NO: 743314 - DNA, 22 bp, Artificial Sequence
  chemically synthesized
agctagtcatgagaaggcaagg

SEQ ID NO: 743315 - DNA, 22 bp, Artificial Sequence
  chemically synthesized
ctaattgctcatccttgccttc

SEQ ID NO: 743316 - DNA, 22 bp, Artificial Sequence
  chemically synthesized
gtcatgagaaggcaaggatgag

SEQ ID NO: 743317 - DNA, 22 bp, Artificial Sequence
  chemically synthesized
taggacatgatttctaattgct

SEQ ID NO: 743318 - DNA, 22 bp, Artificial Sequence
  chemically synthesized
ataggacatgatttctaattgc

SEQ ID NO: 743319 - DNA, 22 bp, Artificial Sequence
  chemically synthesized
aacaccagtatttataggacat

SEQ ID NO: 743320 - DNA, 22 bp, Artificial Sequence
  chemically synthesized
gaaatcatgtcctataaatact

SEQ ID NO: 743321 - DNA, 22 bp, Artificial Sequence
  chemically synthesized
taaatactggtgtttagtactt

SEQ ID NO: 743322 - DNA, 22 bp, Artificial Sequence
  chemically synthesized
gtgtttagtacttattccgggg

SEQ ID NO: 743323 - DNA, 22 bp, Artificial Sequence
  chemically synthesized
aaccacgaggaagagccccgga

SEQ ID NO: 743324 - DNA, 22 bp, Artificial Sequence
  chemically synthesized
agtacttattccggggctcttc

SEQ ID NO: 743325 - DNA, 22 bp, Artificial Sequence
  chemically synthesized
gtacttattccggggctcttcc

SEQ ID NO: 743326 - DNA, 22 bp, Artificial Sequence
  chemically synthesized
cctgaaccacgaggaagagccc

SEQ ID NO: 743327 - DNA, 22 bp, Artificial Sequence
  chemically synthesized
ccctgaaccacgaggaagagcc

SEQ ID NO: 743328 - DNA, 22 bp, Artificial Sequence
  chemically synthesized
attccggggctcttcctcgtgg

SEQ ID NO: 743329 - DNA, 22 bp, Artificial Sequence
  chemically synthesized
ttccggggctcttcctcgtggt

SEQ ID NO: 743330 - DNA, 22 bp, Artificial Sequence
  chemically synthesized
cggggctcttcctcgtggttca

SEQ ID NO: 743331 - DNA, 22 bp, Artificial Sequence
  chemically synthesized
tgagggcttccctgaaccacga

SEQ ID NO: 743332 - DNA, 22 bp, Artificial Sequence
  chemically synthesized
tgtgagggcttccctgaaccac

SEQ ID NO: 743333 - DNA, 22 bp, Artificial Sequence
  chemically synthesized
cattctgtgagggcttccctga

SEQ ID NO: 743334 - DNA, 22 bp, Artificial Sequence
  chemically synthesized
ttcctcgtggttcagggaagcc

SEQ ID NO: 743335 - DNA, 22 bp, Artificial Sequence
  chemically synthesized
cctcgtggttcagggaagccct

SEQ ID NO: 743336 - DNA, 22 bp, Artificial Sequence
  chemically synthesized
ctcgtggttcagggaagccctc

SEQ ID NO: 743337 - DNA, 22 bp, Artificial Sequence
  chemically synthesized
gtggttcagggaagccctcaca

SEQ ID NO: 743338 - DNA, 22 bp, Artificial Sequence
  chemically synthesized
ccgggtaattgcattctgtgag

SEQ ID NO: 743339 - DNA, 22 bp, Artificial Sequence
  chemically synthesized
agggaagccctcacagaatgca

SEQ ID NO: 743340 - DNA, 22 bp, Artificial Sequence
  chemically synthesized
ccaattcccgggtaattgcatt

SEQ ID NO: 743341 - DNA, 22 bp, Artificial Sequence
  chemically synthesized
ctgccaattcccgggtaattgc

SEQ ID NO: 743342 - DNA, 22 bp, Artificial Sequence
  chemically synthesized
acagaatgcaattacccgggaa

SEQ ID NO: 743343 - DNA, 22 bp, Artificial Sequence
  chemically synthesized
tacctgctgccaattcccgggt

SEQ ID NO: 743344 - DNA, 22 bp, Artificial Sequence
  chemically synthesized
ggctgtacctgctgccaattcc

SEQ ID NO: 743345 - DNA, 22 bp, Artificial Sequence
  chemically synthesized
cccgggaattggcagcaggtac

SEQ ID NO: 743346 - DNA, 22 bp, Artificial Sequence
  chemically synthesized
caaaacatagctgggctgtacc

SEQ ID NO: 743347 - DNA, 22 bp, Artificial Sequence
  chemically synthesized
gcagcaggtacagcccagctat

SEQ ID NO: 743348 - DNA, 22 bp, Artificial Sequence
  chemically synthesized
agaaatgcaggagctgcaaaac

SEQ ID NO: 743349 - DNA, 22 bp, Artificial Sequence
  chemically synthesized
ctgagaaatgcaggagctgcaa

SEQ ID NO: 743350 - DNA, 22 bp, Artificial Sequence
  chemically synthesized
tgttttgcagctcctgcatttc

SEQ ID NO: 743351 - DNA, 22 bp, Artificial Sequence
  chemically synthesized
tgcagctcctgcatttctcagc

SEQ ID NO: 743352 - DNA, 22 bp, Artificial Sequence
  chemically synthesized
gcagctcctgcatttctcagca

SEQ ID NO: 743353 - DNA, 22 bp, Artificial Sequence
  chemically synthesized
cagctcctgcatttctcagcag

SEQ ID NO: 743354 - DNA, 22 bp, Artificial Sequence
  chemically synthesized
ctgcatttctcagcagatatat

SEQ ID NO: 743355 - DNA, 22 bp, Artificial Sequence
  chemically synthesized
gccccatgaggatgatatatct

SEQ ID NO: 743356 - DNA, 22 bp, Artificial Sequence
  chemically synthesized
catttctcagcagatatatcat

SEQ ID NO: 743357 - DNA, 22 bp, Artificial Sequence
  chemically synthesized
ggccccatgaggatgatatatc

SEQ ID NO: 743358 - DNA, 22 bp, Artificial Sequence
  chemically synthesized
ttggccccatgaggatgatata

SEQ ID NO: 743359 - DNA, 22 bp, Artificial Sequence
  chemically synthesized
tcttggccccatgaggatgata

SEQ ID NO: 743360 - DNA, 22 bp, Artificial Sequence
  chemically synthesized
ctcagcagatatatcatcctca

SEQ ID NO: 743361 - DNA, 22 bp, Artificial Sequence
  chemically synthesized
tcagcagatatatcatcctcat

SEQ ID NO: 743362 - DNA, 22 bp, Artificial Sequence
  chemically synthesized
agcagatatatcatcctcatgg

SEQ ID NO: 743363 - DNA, 22 bp, Artificial Sequence
  chemically synthesized
actctcttggccccatgaggat

SEQ ID NO: 743364 - DNA, 22 bp, Artificial Sequence
  chemically synthesized
gactctcttggccccatgagga

SEQ ID NO: 743365 - DNA, 22 bp, Artificial Sequence
  chemically synthesized
atggggccaagagagtcaagga

SEQ ID NO: 743366 - DNA, 22 bp, Artificial Sequence
  chemically synthesized
gaaaaagcaagatacagtcctt

SEQ ID NO: 743367 - DNA, 22 bp, Artificial Sequence
  chemically synthesized
tggaaaaagcaagatacagtcc

SEQ ID NO: 743368 - DNA, 22 bp, Artificial Sequence
  chemically synthesized
atcctctggaaaaagcaagata

SEQ ID NO: 743369 - DNA, 22 bp, Artificial Sequence
  chemically synthesized
tgatcctctggaaaaagcaaga

SEQ ID NO: 743370 - DNA, 22 bp, Artificial Sequence
  chemically synthesized
tatcttgctttttccagaggat

SEQ ID NO: 743371 - DNA, 22 bp, Artificial Sequence
  chemically synthesized
cagtaggcctctgatcctctgg

SEQ ID NO: 743372 - DNA, 22 bp, Artificial Sequence
  chemically synthesized
gctttttccagaggatcagagg

SEQ ID NO: 743373 - DNA, 22 bp, Artificial Sequence
  chemically synthesized
ctttttccagaggatcagaggc

SEQ ID NO: 743374 - DNA, 22 bp, Artificial Sequence
  chemically synthesized
agagattccagtaggcctctga

SEQ ID NO: 743375 - DNA, 22 bp, Artificial Sequence
  chemically synthesized
tttccagaggatcagaggccta

SEQ ID NO: 743376 - DNA, 22 bp, Artificial Sequence
  chemically synthesized
gagagattccagtaggcctctg

SEQ ID NO: 743377 - DNA, 22 bp, Artificial Sequence
  chemically synthesized
ttccagaggatcagaggcctac

SEQ ID NO: 743378 - DNA, 22 bp, Artificial Sequence
  chemically synthesized
tccagaggatcagaggcctact

SEQ ID NO: 743379 - DNA, 22 bp, Artificial Sequence
  chemically synthesized
ccagaggatcagaggcctactg

SEQ ID NO: 743380 - DNA, 22 bp, Artificial Sequence
  chemically synthesized
cagaggatcagaggcctactgg

SEQ ID NO: 743381 - DNA, 22 bp, Artificial Sequence
  chemically synthesized
cgcccaggtatttgagagattc

SEQ ID NO: 743382 - DNA, 22 bp, Artificial Sequence
  chemically synthesized
attccgcccaggtatttgagag

SEQ ID NO: 743383 - DNA, 22 bp, Artificial Sequence
  chemically synthesized
ctggaatctctcaaatacctgg

SEQ ID NO: 743384 - DNA, 22 bp, Artificial Sequence
  chemically synthesized
gaatctctcaaatacctgggcg

SEQ ID NO: 743385 - DNA, 22 bp, Artificial Sequence
  chemically synthesized
agtagctcattccgcccaggta

SEQ ID NO: 743386 - DNA, 22 bp, Artificial Sequence
  chemically synthesized
gagtagctcattccgcccaggt

SEQ ID NO: 743387 - DNA, 22 bp, Artificial Sequence
  chemically synthesized
tcaaatacctgggcggaatgag

SEQ ID NO: 743388 - DNA, 22 bp, Artificial Sequence
  chemically synthesized
aaatacctgggcggaatgagct

SEQ ID NO: 743389 - DNA, 22 bp, Artificial Sequence
  chemically synthesized
aacagcatttgagtagctcatt

SEQ ID NO: 743390 - DNA, 22 bp, Artificial Sequence
  chemically synthesized
caacagcatttgagtagctcat

SEQ ID NO: 743391 - DNA, 22 bp, Artificial Sequence
  chemically synthesized
tttcaacagcatttgagtagct

SEQ ID NO: 743392 - DNA, 22 bp, Artificial Sequence
  chemically synthesized
ggcggaatgagctactcaaatg

SEQ ID NO: 743393 - DNA, 22 bp, Artificial Sequence
  chemically synthesized
attgtttcaacagcatttgagt

SEQ ID NO: 743394 - DNA, 22 bp, Artificial Sequence
  chemically synthesized
aattgtttcaacagcatttgag

SEQ ID NO: 743395 - DNA, 22 bp, Artificial Sequence
  chemically synthesized
taattgtttcaacagcatttga

SEQ ID NO: 743396 - DNA, 22 bp, Artificial Sequence
  chemically synthesized
ttaattgtttcaacagcatttg

SEQ ID NO: 743397 - DNA, 22 bp, Artificial Sequence
  chemically synthesized
tttaattgtttcaacagcattt

SEQ ID NO: 743398 - DNA, 22 bp, Artificial Sequence
  chemically synthesized
tttttaattgtttcaacagcat

SEQ ID NO: 743399 - DNA, 22 bp, Artificial Sequence
  chemically synthesized
ctttttaattgtttcaacagca

SEQ ID NO: 743400 - DNA, 22 bp, Artificial Sequence
  chemically synthesized
tgtttctttttaattgtttcaa

SEQ ID NO: 743401 - DNA, 22 bp, Artificial Sequence
  chemically synthesized
ctcaaatgctgttgaaacaatt

SEQ ID NO: 743402 - DNA, 22 bp, Artificial Sequence
  chemically synthesized
gtgtttctttttaattgtttca

SEQ ID NO: 743403 - DNA, 22 bp, Artificial Sequence
  chemically synthesized
aaatgctgttgaaacaattaaa

SEQ ID NO: 743404 - DNA, 22 bp, Artificial Sequence
  chemically synthesized
aacttgtgtttctttttaattg

SEQ ID NO: 743405 - DNA, 22 bp, Artificial Sequence
  chemically synthesized
ttgaaacaattaaaaagaaaca

SEQ ID NO: 743406 - DNA, 22 bp, Artificial Sequence
  chemically synthesized
cagctcaacttgtgtttctttt

SEQ ID NO: 743407 - DNA, 22 bp, Artificial Sequence
  chemically synthesized
acagctcaacttgtgtttcttt

SEQ ID NO: 743408 - DNA, 22 bp, Artificial Sequence
  chemically synthesized
aaacaattaaaaagaaacacaa

SEQ ID NO: 743409 - DNA, 22 bp, Artificial Sequence
  chemically synthesized
cttacagctcaacttgtgtttc

SEQ ID NO: 743410 - DNA, 22 bp, Artificial Sequence
  chemically synthesized
gcttacagctcaacttgtgttt

SEQ ID NO: 743411 - DNA, 22 bp, Artificial Sequence
  chemically synthesized
aaaagaaacacaagttgagctg

SEQ ID NO: 743412 - DNA, 22 bp, Artificial Sequence
  chemically synthesized
atgaagggcttgcttacagctc

SEQ ID NO: 743413 - DNA, 22 bp, Artificial Sequence
  chemically synthesized
catgaagggcttgcttacagct

SEQ ID NO: 743414 - DNA, 22 bp, Artificial Sequence
  chemically synthesized
atacatttcatgaagggcttgc

SEQ ID NO: 743415 - DNA, 22 bp, Artificial Sequence
  chemically synthesized
agctgtaagcaagcccttcatg

SEQ ID NO: 743416 - DNA, 22 bp, Artificial Sequence
  chemically synthesized
agcctgatacatttcatgaagg

SEQ ID NO: 743417 - DNA, 22 bp, Artificial Sequence
  chemically synthesized
tgagcctgatacatttcatgaa

SEQ ID NO: 743418 - DNA, 22 bp, Artificial Sequence
  chemically synthesized
taagcaagcccttcatgaaatg

SEQ ID NO: 743419 - DNA, 22 bp, Artificial Sequence
  chemically synthesized
catgaaatgtatcaggctcaga

SEQ ID NO: 743420 - DNA, 22 bp, Artificial Sequence
  chemically synthesized
atgaaatgtatcaggctcagag

SEQ ID NO: 743421 - DNA, 22 bp, Artificial Sequence
  chemically synthesized
cagataatgatggaagtctctg

SEQ ID NO: 743422 - DNA, 22 bp, Artificial Sequence
  chemically synthesized
agagacttccatcattatctgt

SEQ ID NO: 743423 - DNA, 22 bp, Artificial Sequence
  chemically synthesized
ccatcattatctgtaatttttg

SEQ ID NO: 743424 - DNA, 22 bp, Artificial Sequence
  chemically synthesized
catcattatctgtaatttttga

SEQ ID NO: 743425 - DNA, 22 bp, Artificial Sequence
  chemically synthesized
tctgtaatttttgacttttcat

SEQ ID NO: 743426 - DNA, 22 bp, Artificial Sequence
  chemically synthesized
taatttttgacttttcattctg

SEQ ID NO: 743427 - DNA, 22 bp, Artificial Sequence
  chemically synthesized
ttgacttttcattctggttggt

SEQ ID NO: 743428 - DNA, 22 bp, Artificial Sequence
  chemically synthesized
tgacttttcattctggttggtt

SEQ ID NO: 743429 - DNA, 22 bp, Artificial Sequence
  chemically synthesized
gacttttcattctggttggttc

SEQ ID NO: 743430 - DNA, 22 bp, Artificial Sequence
  chemically synthesized
acttttcattctggttggttcc

SEQ ID NO: 743431 - DNA, 22 bp, Artificial Sequence
  chemically synthesized
ttcattctggttggttccctga

SEQ ID NO: 743432 - DNA, 22 bp, Artificial Sequence
  chemically synthesized
tcattctggttggttccctgac

SEQ ID NO: 743433 - DNA, 22 bp, Artificial Sequence
  chemically synthesized
ggcatcagagcagtcagggaac

SEQ ID NO: 743434 - DNA, 22 bp, Artificial Sequence
  chemically synthesized
cattctggttggttccctgact

SEQ ID NO: 743435 - DNA, 22 bp, Artificial Sequence
  chemically synthesized
attctggttggttccctgactg

SEQ ID NO: 743436 - DNA, 22 bp, Artificial Sequence
  chemically synthesized
tgggcatcagagcagtcaggga

SEQ ID NO: 743437 - DNA, 22 bp, Artificial Sequence
  chemically synthesized
tggttggttccctgactgctct

SEQ ID NO: 743438 - DNA, 22 bp, Artificial Sequence
  chemically synthesized
cattctgggcatcagagcagtc

SEQ ID NO: 743439 - DNA, 22 bp, Artificial Sequence
  chemically synthesized
gttggttccctgactgctctga

SEQ ID NO: 743440 - DNA, 22 bp, Artificial Sequence
  chemically synthesized
gttccctgactgctctgatgcc

SEQ ID NO: 743441 - DNA, 22 bp, Artificial Sequence
  chemically synthesized
tacctacattctgggcatcaga

SEQ ID NO: 743442 - DNA, 22 bp, Artificial Sequence
  chemically synthesized
cctgactgctctgatgcccaga

SEQ ID NO: 743443 - DNA, 22 bp, Artificial Sequence
  chemically synthesized
actgctctgatgcccagaatgt

SEQ ID NO: 743444 - DNA, 22 bp, Artificial Sequence
  chemically synthesized
ctctgatgcccagaatgtaggt

SEQ ID NO: 743445 - DNA, 22 bp, Artificial Sequence
  chemically synthesized
aaagaaaagctgtacctacatt

SEQ ID NO: 743446 - DNA, 22 bp, Artificial Sequence
  chemically synthesized
tgatgcccagaatgtaggtaca

SEQ ID NO: 743447 - DNA, 22 bp, Artificial Sequence
  chemically synthesized
atgcccagaatgtaggtacagc

SEQ ID NO: 743448 - DNA, 22 bp, Artificial Sequence
  chemically synthesized
aaggcagtaggtatctgaaaga

SEQ ID NO: 743449 - DNA, 22 bp, Artificial Sequence
  chemically synthesized
gctgaaggcagtaggtatctga

SEQ ID NO: 743450 - DNA, 22 bp, Artificial Sequence
  chemically synthesized
aacctggctgaaggcagtaggt

SEQ ID NO: 743451 - DNA, 22 bp, Artificial Sequence
  chemically synthesized
ttctttcagatacctactgcct

SEQ ID NO: 743452 - DNA, 22 bp, Artificial Sequence
  chemically synthesized
aaacctggctgaaggcagtagg

SEQ ID NO: 743453 - DNA, 22 bp, Artificial Sequence
  chemically synthesized
tctttcagatacctactgcctt

SEQ ID NO: 743454 - DNA, 22 bp, Artificial Sequence
  chemically synthesized
ctttcagatacctactgccttc

SEQ ID NO: 743455 - DNA, 22 bp, Artificial Sequence
  chemically synthesized
ttaaacctggctgaaggcagta

SEQ ID NO: 743456 - DNA, 22 bp, Artificial Sequence
  chemically synthesized
tttcagatacctactgccttca

SEQ ID NO: 743457 - DNA, 22 bp, Artificial Sequence
  chemically synthesized
tcttaaacctggctgaaggcag

SEQ ID NO: 743458 - DNA, 22 bp, Artificial Sequence
  chemically synthesized
tcagatacctactgccttcagc

SEQ ID NO: 743459 - DNA, 22 bp, Artificial Sequence
  chemically synthesized
ctcttaaacctggctgaaggca

SEQ ID NO: 743460 - DNA, 22 bp, Artificial Sequence
  chemically synthesized
cagatacctactgccttcagcc

SEQ ID NO: 743461 - DNA, 22 bp, Artificial Sequence
  chemically synthesized
agatacctactgccttcagcca

SEQ ID NO: 743462 - DNA, 22 bp, Artificial Sequence
  chemically synthesized
cttctcttaaacctggctgaag

SEQ ID NO: 743463 - DNA, 22 bp, Artificial Sequence
  chemically synthesized
tgcttctcttaaacctggctga

SEQ ID NO: 743464 - DNA, 22 bp, Artificial Sequence
  chemically synthesized
ctgccttcagccaggtttaaga

SEQ ID NO: 743465 - DNA, 22 bp, Artificial Sequence
  chemically synthesized
agactctgcttctcttaaacct

SEQ ID NO: 743466 - DNA, 22 bp, Artificial Sequence
  chemically synthesized
ccttcagccaggtttaagagaa

SEQ ID NO: 743467 - DNA, 22 bp, Artificial Sequence
  chemically synthesized
cagccaggtttaagagaagcag

SEQ ID NO: 743468 - DNA, 22 bp, Artificial Sequence
  chemically synthesized
agccaggtttaagagaagcaga

SEQ ID NO: 743469 - DNA, 22 bp, Artificial Sequence
  chemically synthesized
agagcactcagactctgcttct

SEQ ID NO: 743470 - DNA, 22 bp, Artificial Sequence
  chemically synthesized
aagagcactcagactctgcttc

SEQ ID NO: 743471 - DNA, 22 bp, Artificial Sequence
  chemically synthesized
ttaagagcactcagactctgct

SEQ ID NO: 743472 - DNA, 22 bp, Artificial Sequence
  chemically synthesized
cttaagagcactcagactctgc

SEQ ID NO: 743473 - DNA, 22 bp, Artificial Sequence
  chemically synthesized
tcttaagagcactcagactctg

SEQ ID NO: 743474 - DNA, 22 bp, Artificial Sequence
  chemically synthesized
ttcttaagagcactcagactct

SEQ ID NO: 743475 - DNA, 22 bp, Artificial Sequence
  chemically synthesized
tttcttaagagcactcagactc

SEQ ID NO: 743476 - DNA, 22 bp, Artificial Sequence
  chemically synthesized
aagagaagcagagtctgagtgc

SEQ ID NO: 743477 - DNA, 22 bp, Artificial Sequence
  chemically synthesized
agagaagcagagtctgagtgct

SEQ ID NO: 743478 - DNA, 22 bp, Artificial Sequence
  chemically synthesized
cctttttcttaagagcactcag

SEQ ID NO: 743479 - DNA, 22 bp, Artificial Sequence
  chemically synthesized
actccctttttcttaagagcac

SEQ ID NO: 743480 - DNA, 22 bp, Artificial Sequence
  chemically synthesized
tcactccctttttcttaagagc

SEQ ID NO: 743481 - DNA, 22 bp, Artificial Sequence
  chemically synthesized
tctcactccctttttcttaaga

SEQ ID NO: 743482 - DNA, 22 bp, Artificial Sequence
  chemically synthesized
ctctcactccctttttcttaag

SEQ ID NO: 743483 - DNA, 22 bp, Artificial Sequence
  chemically synthesized
cttctctcactccctttttctt

SEQ ID NO: 743484 - DNA, 22 bp, Artificial Sequence
  chemically synthesized
agtgctcttaagaaaaagggag

SEQ ID NO: 743485 - DNA, 22 bp, Artificial Sequence
  chemically synthesized
ctgcttctctcactcccttttt

SEQ ID NO: 743486 - DNA, 22 bp, Artificial Sequence
  chemically synthesized
cctgcttctctcactccctttt

SEQ ID NO: 743487 - DNA, 22 bp, Artificial Sequence
  chemically synthesized
tcttcctgcttctctcactccc

SEQ ID NO: 743488 - DNA, 22 bp, Artificial Sequence
  chemically synthesized
ttaagaaaaagggagtgagaga

SEQ ID NO: 743489 - DNA, 22 bp, Artificial Sequence
  chemically synthesized
aagaaaaagggagtgagagaag

SEQ ID NO: 743490 - DNA, 22 bp, Artificial Sequence
  chemically synthesized
agaaaaagggagtgagagaagc

SEQ ID NO: 743491 - DNA, 22 bp, Artificial Sequence
  chemically synthesized
ccctgtcttcctgcttctctca

SEQ ID NO: 743492 - DNA, 22 bp, Artificial Sequence
  chemically synthesized
gccctgtcttcctgcttctctc

SEQ ID NO: 743493 - DNA, 22 bp, Artificial Sequence
  chemically synthesized
ttgccctgtcttcctgcttctc

SEQ ID NO: 743494 - DNA, 22 bp, Artificial Sequence
  chemically synthesized
cttgccctgtcttcctgcttct

SEQ ID NO: 743495 - DNA, 22 bp, Artificial Sequence
  chemically synthesized
tcttgccctgtcttcctgcttc

SEQ ID NO: 743496 - DNA, 22 bp, Artificial Sequence
  chemically synthesized
actttcttgccctgtcttcctg

SEQ ID NO: 743497 - DNA, 22 bp, Artificial Sequence
  chemically synthesized
aactttcttgccctgtcttcct

SEQ ID NO: 743498 - DNA, 22 bp, Artificial Sequence
  chemically synthesized
cagcccataccacatcccaact

SEQ ID NO: 743499 - DNA, 22 bp, Artificial Sequence
  chemically synthesized
gtctccagcccataccacatcc

SEQ ID NO: 743500 - DNA, 22 bp, Artificial Sequence
  chemically synthesized
atgctggtctccagcccatacc

SEQ ID NO: 743501 - DNA, 22 bp, Artificial Sequence
  chemically synthesized
agttgggatgtggtatgggctg

SEQ ID NO: 743502 - DNA, 22 bp, Artificial Sequence
  chemically synthesized
ggatgtggtatgggctggagac

SEQ ID NO: 743503 - DNA, 22 bp, Artificial Sequence
  chemically synthesized
ccatggggccagattgatgctg

SEQ ID NO: 743504 - DNA, 22 bp, Artificial Sequence
  chemically synthesized
gagaccagcatcaatctggccc

SEQ ID NO: 743505 - DNA, 22 bp, Artificial Sequence
  chemically synthesized
ggaattcccatggggccagatt

SEQ ID NO: 743506 - DNA, 22 bp, Artificial Sequence
  chemically synthesized
tgatctgggaattcccatgggg

SEQ ID NO: 743507 - DNA, 22 bp, Artificial Sequence
  chemically synthesized
gtgatctgggaattcccatggg

SEQ ID NO: 743508 - DNA, 22 bp, Artificial Sequence
  chemically synthesized
tacaatttgtgatctgggaatt

SEQ ID NO: 743509 - DNA, 22 bp, Artificial Sequence
  chemically synthesized
gccccatgggaattcccagatc

SEQ ID NO: 743510 - DNA, 22 bp, Artificial Sequence
  chemically synthesized
ttgtacaatttgtgatctggga

SEQ ID NO: 743511 - DNA, 22 bp, Artificial Sequence
  chemically synthesized
ctgttgtacaatttgtgatctg

SEQ ID NO: 743512 - DNA, 22 bp, Artificial Sequence
  chemically synthesized
ccagatcacaaattgtacaaca

SEQ ID NO: 743513 - DNA, 22 bp, Artificial Sequence
  chemically synthesized
atcatggcacctgctgttgtac

SEQ ID NO: 743514 - DNA, 22 bp, Artificial Sequence
  chemically synthesized
cctcatcatggcacctgctgtt

SEQ ID NO: 743515 - DNA, 22 bp, Artificial Sequence
  chemically synthesized
gcctcatcatggcacctgctgt

SEQ ID NO: 743516 - DNA, 22 bp, Artificial Sequence
  chemically synthesized
tgcctcatcatggcacctgctg

SEQ ID NO: 743517 - DNA, 22 bp, Artificial Sequence
  chemically synthesized
tacaacagcaggtgccatgatg

SEQ ID NO: 743518 - DNA, 22 bp, Artificial Sequence
  chemically synthesized
aaaccaccaggggtacaaaggg

SEQ ID NO: 743519 - DNA, 22 bp, Artificial Sequence
  chemically synthesized
aaaaccaccaggggtacaaagg

SEQ ID NO: 743520 - DNA, 22 bp, Artificial Sequence
  chemically synthesized
ttaaaaccaccaggggtacaaa

SEQ ID NO: 743521 - DNA, 22 bp, Artificial Sequence
  chemically synthesized
tcttaaaaccaccaggggtaca

SEQ ID NO: 743522 - DNA, 22 bp, Artificial Sequence
  chemically synthesized
tctcttaaaaccaccaggggta

SEQ ID NO: 743523 - DNA, 22 bp, Artificial Sequence
  chemically synthesized
ctctcttaaaaccaccaggggt

SEQ ID NO: 743524 - DNA, 22 bp, Artificial Sequence
  chemically synthesized
tccctttgtacccctggtggtt

SEQ ID NO: 743525 - DNA, 22 bp, Artificial Sequence
  chemically synthesized
ccctttgtacccctggtggttt

SEQ ID NO: 743526 - DNA, 22 bp, Artificial Sequence
  chemically synthesized
cctttgtacccctggtggtttt

SEQ ID NO: 743527 - DNA, 22 bp, Artificial Sequence
  chemically synthesized
tgtacccctggtggttttaaga

SEQ ID NO: 743528 - DNA, 22 bp, Artificial Sequence
  chemically synthesized
gtacccctggtggttttaagag

SEQ ID NO: 743529 - DNA, 22 bp, Artificial Sequence
  chemically synthesized
tacccctggtggttttaagaga

SEQ ID NO: 743530 - DNA, 22 bp, Artificial Sequence
  chemically synthesized
gtggttttaagagagaaggtgt

SEQ ID NO: 743531 - DNA, 22 bp, Artificial Sequence
  chemically synthesized
gcatgtcccaccacaccttctc

SEQ ID NO: 743532 - DNA, 22 bp, Artificial Sequence
  chemically synthesized
actggcatgtcccaccacacct

SEQ ID NO: 743533 - DNA, 22 bp, Artificial Sequence
  chemically synthesized
gactggcatgtcccaccacacc

SEQ ID NO: 743534 - DNA, 22 bp, Artificial Sequence
  chemically synthesized
taagagagaaggtgtggtggga

SEQ ID NO: 743535 - DNA, 22 bp, Artificial Sequence
  chemically synthesized
aagagagaaggtgtggtgggac

SEQ ID NO: 743536 - DNA, 22 bp, Artificial Sequence
  chemically synthesized
agagagaaggtgtggtgggaca

SEQ ID NO: 743537 - DNA, 22 bp, Artificial Sequence
  chemically synthesized
agccaaaaggaagccaccttga

SEQ ID NO: 743538 - DNA, 22 bp, Artificial Sequence
  chemically synthesized
cctcagccaaaaggaagccacc

SEQ ID NO: 743539 - DNA, 22 bp, Artificial Sequence
  chemically synthesized
cagagaacctccctcagccaaa

SEQ ID NO: 743540 - DNA, 22 bp, Artificial Sequence
  chemically synthesized
ccagagaacctccctcagccaa

SEQ ID NO: 743541 - DNA, 22 bp, Artificial Sequence
  chemically synthesized
tccagagaacctccctcagcca

SEQ ID NO: 743542 - DNA, 22 bp, Artificial Sequence
  chemically synthesized
ccttttggctgagggaggttct

SEQ ID NO: 743543 - DNA, 22 bp, Artificial Sequence
  chemically synthesized
acccctttccagagaacctccc

SEQ ID NO: 743544 - DNA, 22 bp, Artificial Sequence
  chemically synthesized
cttttggctgagggaggttctc

SEQ ID NO: 743545 - DNA, 22 bp, Artificial Sequence
  chemically synthesized
cacccctttccagagaacctcc

SEQ ID NO: 743546 - DNA, 22 bp, Artificial Sequence
  chemically synthesized
ttggctgagggaggttctctgg

SEQ ID NO: 743547 - DNA, 22 bp, Artificial Sequence
  chemically synthesized
tggctgagggaggttctctgga

SEQ ID NO: 743548 - DNA, 22 bp, Artificial Sequence
  chemically synthesized
ggctgagggaggttctctggaa

SEQ ID NO: 743549 - DNA, 22 bp, Artificial Sequence
  chemically synthesized
gctgagggaggttctctggaaa

SEQ ID NO: 743550 - DNA, 22 bp, Artificial Sequence
  chemically synthesized
atggtttcacccctttccagag

SEQ ID NO: 743551 - DNA, 22 bp, Artificial Sequence
  chemically synthesized
agggaggttctctggaaagggg

SEQ ID NO: 743552 - DNA, 22 bp, Artificial Sequence
  chemically synthesized
aagcctcatggtttcacccctt

SEQ ID NO: 743553 - DNA, 22 bp, Artificial Sequence
  chemically synthesized
ctaaagcctcatggtttcaccc

SEQ ID NO: 743554 - DNA, 22 bp, Artificial Sequence
  chemically synthesized
tctggaaaggggtgaaaccatg

SEQ ID NO: 743555 - DNA, 22 bp, Artificial Sequence
  chemically synthesized
gctgctaaagcctcatggtttc

SEQ ID NO: 743556 - DNA, 22 bp, Artificial Sequence
  chemically synthesized
tggaaaggggtgaaaccatgag

SEQ ID NO: 743557 - DNA, 22 bp, Artificial Sequence
  chemically synthesized
gaaaggggtgaaaccatgaggc

SEQ ID NO: 743558 - DNA, 22 bp, Artificial Sequence
  chemically synthesized
agtattagctgctaaagcctca

SEQ ID NO: 743559 - DNA, 22 bp, Artificial Sequence
  chemically synthesized
tgagtattagctgctaaagcct

SEQ ID NO: 743560 - DNA, 22 bp, Artificial Sequence
  chemically synthesized
agtgactctgagtattagctgc

SEQ ID NO: 743561 - DNA, 22 bp, Artificial Sequence
  chemically synthesized
ctcagtgactctgagtattagc

SEQ ID NO: 743562 - DNA, 22 bp, Artificial Sequence
  chemically synthesized
tagcagctaatactcagagtca

SEQ ID NO: 743563 - DNA, 22 bp, Artificial Sequence
  chemically synthesized
agcagctaatactcagagtcac

SEQ ID NO: 743564 - DNA, 22 bp, Artificial Sequence
  chemically synthesized
gcagctaatactcagagtcact

SEQ ID NO: 743565 - DNA, 22 bp, Artificial Sequence
  chemically synthesized
gtgcacccattcctcagtgact

SEQ ID NO: 743566 - DNA, 22 bp, Artificial Sequence
  chemically synthesized
atactcagagtcactgaggaat

SEQ ID NO: 743567 - DNA, 22 bp, Artificial Sequence
  chemically synthesized
ggttggtgcacccattcctcag

SEQ ID NO: 743568 - DNA, 22 bp, Artificial Sequence
  chemically synthesized
actgggttggtgcacccattcc

SEQ ID NO: 743569 - DNA, 22 bp, Artificial Sequence
  chemically synthesized
agagtcactgaggaatgggtgc

SEQ ID NO: 743570 - DNA, 22 bp, Artificial Sequence
  chemically synthesized
gttcactgggttggtgcaccca

SEQ ID NO: 743571 - DNA, 22 bp, Artificial Sequence
  chemically synthesized
aggaatgggtgcaccaacccag

SEQ ID NO: 743572 - DNA, 22 bp, Artificial Sequence
  chemically synthesized
gtgccccagtcagattcgttca

SEQ ID NO: 743573 - DNA, 22 bp, Artificial Sequence
  chemically synthesized
ttggtgccccagtcagattcgt

SEQ ID NO: 743574 - DNA, 22 bp, Artificial Sequence
  chemically synthesized
agtaatggatgctgttggtgcc

SEQ ID NO: 743575 - DNA, 22 bp, Artificial Sequence
  chemically synthesized
atctaagtaatggatgctgttg

SEQ ID NO: 743576 - DNA, 22 bp, Artificial Sequence
  chemically synthesized
actggggcaccaacagcatcca

SEQ ID NO: 743577 - DNA, 22 bp, Artificial Sequence
  chemically synthesized
gggcaccaacagcatccattac

SEQ ID NO: 743578 - DNA, 22 bp, Artificial Sequence
  chemically synthesized
ggaaagcagatgaagttaatct

SEQ ID NO: 743579 - DNA, 22 bp, Artificial Sequence
  chemically synthesized
ttgggaaagcagatgaagttaa

SEQ ID NO: 743580 - DNA, 22 bp, Artificial Sequence
  chemically synthesized
cttagattaacttcatctgctt

SEQ ID NO: 743581 - DNA, 22 bp, Artificial Sequence
  chemically synthesized
agattaacttcatctgctttcc

SEQ ID NO: 743582 - DNA, 22 bp, Artificial Sequence
  chemically synthesized
gattaacttcatctgctttccc

SEQ ID NO: 743583 - DNA, 22 bp, Artificial Sequence
  chemically synthesized
aagggtaaaggctattgggaaa

SEQ ID NO: 743584 - DNA, 22 bp, Artificial Sequence
  chemically synthesized
acttcatctgctttcccaatag

SEQ ID NO: 743585 - DNA, 22 bp, Artificial Sequence
  chemically synthesized
catctgctttcccaatagcctt

SEQ ID NO: 743586 - DNA, 22 bp, Artificial Sequence
  chemically synthesized
atctgctttcccaatagccttt

SEQ ID NO: 743587 - DNA, 22 bp, Artificial Sequence
  chemically synthesized
aagttcaagggtaaaggctatt

SEQ ID NO: 743588 - DNA, 22 bp, Artificial Sequence
  chemically synthesized
ctttcccaatagcctttaccct

SEQ ID NO: 743589 - DNA, 22 bp, Artificial Sequence
  chemically synthesized
acaactgaagttcaagggtaaa

SEQ ID NO: 743590 - DNA, 22 bp, Artificial Sequence
  chemically synthesized
tcccaatagcctttacccttga

SEQ ID NO: 743591 - DNA, 22 bp, Artificial Sequence
  chemically synthesized
gacaactgaagttcaagggtaa

SEQ ID NO: 743592 - DNA, 22 bp, Artificial Sequence
  chemically synthesized
cccaatagcctttacccttgaa

SEQ ID NO: 743593 - DNA, 22 bp, Artificial Sequence
  chemically synthesized
ccaatagcctttacccttgaac

SEQ ID NO: 743594 - DNA, 22 bp, Artificial Sequence
  chemically synthesized
tacccttgaacttcagttgtca

SEQ ID NO: 743595 - DNA, 22 bp, Artificial Sequence
  chemically synthesized
acccttgaacttcagttgtcaa

SEQ ID NO: 743596 - DNA, 22 bp, Artificial Sequence
  chemically synthesized
cccttgaacttcagttgtcaag

SEQ ID NO: 743597 - DNA, 22 bp, Artificial Sequence
  chemically synthesized
gaacttcagttgtcaagcactt

SEQ ID NO: 743598 - DNA, 22 bp, Artificial Sequence
  chemically synthesized
aacttcagttgtcaagcactta

SEQ ID NO: 743599 - DNA, 22 bp, Artificial Sequence
  chemically synthesized
cagttgtcaagcacttatattt

SEQ ID NO: 743600 - DNA, 22 bp, Artificial Sequence
  chemically synthesized
agttgtcaagcacttatatttt

SEQ ID NO: 743601 - DNA, 22 bp, Artificial Sequence
  chemically synthesized
aaaaaaaaaaaaaaacaaaata

SEQ ID NO: 743602 - DNA, 22 bp, Artificial Sequence
  chemically synthesized
tcaagcacttatattttgtttt

SEQ ID NO: 743603 - DNA, 22 bp, Artificial Sequence
  chemically synthesized
ctgaaaaaaaaaaaaaaacaaa

SEQ ID NO: 743604 - DNA, 22 bp, Artificial Sequence
  chemically synthesized
atattttgtttttttttttttt

SEQ ID NO: 743605 - DNA, 22 bp, Artificial Sequence
  chemically synthesized
tattttgttttttttttttttt

SEQ ID NO: 743606 - DNA, 22 bp, Artificial Sequence
  chemically synthesized
tgtttttttttttttttcagga

SEQ ID NO: 743607 - DNA, 22 bp, Artificial Sequence
  chemically synthesized
gtttttttttttttttcaggag

SEQ ID NO: 743608 - DNA, 22 bp, Artificial Sequence
  chemically synthesized
tttttttttttttttcaggaga

SEQ ID NO: 743609 - DNA, 22 bp, Artificial Sequence
  chemically synthesized
ttttttttttttcaggagactt

SEQ ID NO: 743610 - DNA, 22 bp, Artificial Sequence
  chemically synthesized
tttttttttttcaggagacttt

SEQ ID NO: 743611 - DNA, 22 bp, Artificial Sequence
  chemically synthesized
ttttttttttcaggagactttt

SEQ ID NO: 743612 - DNA, 22 bp, Artificial Sequence
  chemically synthesized
tttttttttcaggagacttttc

SEQ ID NO: 743613 - DNA, 22 bp, Artificial Sequence
  chemically synthesized
ttttttttcaggagacttttct

SEQ ID NO: 743614 - DNA, 22 bp, Artificial Sequence
  chemically synthesized
tttttttcaggagacttttctt

SEQ ID NO: 743615 - DNA, 22 bp, Artificial Sequence
  chemically synthesized
ttttttcaggagacttttcttt

SEQ ID NO: 743616 - DNA, 22 bp, Artificial Sequence
  chemically synthesized
tttttcaggagacttttctttt

SEQ ID NO: 743617 - DNA, 22 bp, Artificial Sequence
  chemically synthesized
ttttcaggagacttttcttttc

SEQ ID NO: 743618 - DNA, 22 bp, Artificial Sequence
  chemically synthesized
tttcaggagacttttcttttct

SEQ ID NO: 743619 - DNA, 22 bp, Artificial Sequence
  chemically synthesized
ttcaggagacttttcttttctt

SEQ ID NO: 743620 - DNA, 22 bp, Artificial Sequence
  chemically synthesized
tcaggagacttttcttttcttt

SEQ ID NO: 743621 - DNA, 22 bp, Artificial Sequence
  chemically synthesized
caggagacttttcttttctttt

SEQ ID NO: 743622 - DNA, 22 bp, Artificial Sequence
  chemically synthesized
aggagacttttcttttcttttc

SEQ ID NO: 743623 - DNA, 22 bp, Artificial Sequence
  chemically synthesized
ttcttttcttttcttccttcct

SEQ ID NO: 743624 - DNA, 22 bp, Artificial Sequence
  chemically synthesized
tcttttcttttcttccttcctt

SEQ ID NO: 743625 - DNA, 22 bp, Artificial Sequence
  chemically synthesized
cttttcttttcttccttccttc

SEQ ID NO: 743626 - DNA, 22 bp, Artificial Sequence
  chemically synthesized
ttttcttttcttccttccttcc

SEQ ID NO: 743627 - DNA, 22 bp, Artificial Sequence
  chemically synthesized
ttcttttcttccttccttcctt

SEQ ID NO: 743628 - DNA, 22 bp, Artificial Sequence
  chemically synthesized
tcttttcttccttccttccttc

SEQ ID NO: 743629 - DNA, 22 bp, Artificial Sequence
  chemically synthesized
cttttcttccttccttccttct

SEQ ID NO: 743630 - DNA, 22 bp, Artificial Sequence
  chemically synthesized
ttttcttccttccttccttctt

SEQ ID NO: 743631 - DNA, 22 bp, Artificial Sequence
  chemically synthesized
ttcttccttccttccttctttt

SEQ ID NO: 743632 - DNA, 22 bp, Artificial Sequence
  chemically synthesized
tcttccttccttccttcttttc

SEQ ID NO: 743633 - DNA, 22 bp, Artificial Sequence
  chemically synthesized
cttccttccttccttcttttct

SEQ ID NO: 743634 - DNA, 22 bp, Artificial Sequence
  chemically synthesized
ttccttccttccttcttttctt

SEQ ID NO: 743635 - DNA, 22 bp, Artificial Sequence
  chemically synthesized
ccttccttccttcttttctttc

SEQ ID NO: 743636 - DNA, 22 bp, Artificial Sequence
  chemically synthesized
cttccttccttcttttctttct

SEQ ID NO: 743637 - DNA, 22 bp, Artificial Sequence
  chemically synthesized
tataaaaaaaggaaagaaagaa

SEQ ID NO: 743638 - DNA, 22 bp, Artificial Sequence
  chemically synthesized
ccttccttcttttctttctttc

SEQ ID NO: 743639 - DNA, 22 bp, Artificial Sequence
  chemically synthesized
cttccttcttttctttctttcc

SEQ ID NO: 743640 - DNA, 22 bp, Artificial Sequence
  chemically synthesized
ctgtataaaaaaaggaaagaaa

SEQ ID NO: 743641 - DNA, 22 bp, Artificial Sequence
  chemically synthesized
ccttcttttctttctttccttt

SEQ ID NO: 743642 - DNA, 22 bp, Artificial Sequence
  chemically synthesized
cttcttttctttctttcctttt

SEQ ID NO: 743643 - DNA, 22 bp, Artificial Sequence
  chemically synthesized
cttttctttctttccttttttt

SEQ ID NO: 743644 - DNA, 22 bp, Artificial Sequence
  chemically synthesized
ttttctttctttccttttttta

SEQ ID NO: 743645 - DNA, 22 bp, Artificial Sequence
  chemically synthesized
ttctttctttcctttttttata

SEQ ID NO: 743646 - DNA, 22 bp, Artificial Sequence
  chemically synthesized
tctttctttcctttttttatac

SEQ ID NO: 743647 - DNA, 22 bp, Artificial Sequence
  chemically synthesized
ctttctttcctttttttataca

SEQ ID NO: 743648 - DNA, 22 bp, Artificial Sequence
  chemically synthesized
tttctttcctttttttatacag

SEQ ID NO: 743649 - DNA, 22 bp, Artificial Sequence
  chemically synthesized
tctttcctttttttatacagga

SEQ ID NO: 743650 - DNA, 22 bp, Artificial Sequence
  chemically synthesized
ctttcctttttttatacaggag

SEQ ID NO: 743651 - DNA, 22 bp, Artificial Sequence
  chemically synthesized
tttcctttttttatacaggaga

SEQ ID NO: 743652 - DNA, 22 bp, Artificial Sequence
  chemically synthesized
tcctttttttatacaggagact

SEQ ID NO: 743653 - DNA, 22 bp, Artificial Sequence
  chemically synthesized
cctttttttatacaggagactt

SEQ ID NO: 743654 - DNA, 22 bp, Artificial Sequence
  chemically synthesized
ctttttttatacaggagacttc

SEQ ID NO: 743655 - DNA, 22 bp, Artificial Sequence
  chemically synthesized
tttttatacaggagacttcttt

SEQ ID NO: 743656 - DNA, 22 bp, Artificial Sequence
  chemically synthesized
ttttatacaggagacttctttc

SEQ ID NO: 743657 - DNA, 22 bp, Artificial Sequence
  chemically synthesized
tttatacaggagacttctttct

SEQ ID NO: 743658 - DNA, 22 bp, Artificial Sequence
  chemically synthesized
ttatacaggagacttctttctt

SEQ ID NO: 743659 - DNA, 22 bp, Artificial Sequence
  chemically synthesized
tatacaggagacttctttcttt

SEQ ID NO: 743660 - DNA, 22 bp, Artificial Sequence
  chemically synthesized
atacaggagacttctttctttc

SEQ ID NO: 743661 - DNA, 22 bp, Artificial Sequence
  chemically synthesized
tacaggagacttctttctttct

SEQ ID NO: 743662 - DNA, 22 bp, Artificial Sequence
  chemically synthesized
aaaaaaagaaaggaagaaagaa

SEQ ID NO: 743663 - DNA, 22 bp, Artificial Sequence
  chemically synthesized
gaaaaaaagaaaggaagaaaga

SEQ ID NO: 743664 - DNA, 22 bp, Artificial Sequence
  chemically synthesized
ctttctttctttctttcttcct

SEQ ID NO: 743665 - DNA, 22 bp, Artificial Sequence
  chemically synthesized
tttctttctttctttcttcctt

SEQ ID NO: 743666 - DNA, 22 bp, Artificial Sequence
  chemically synthesized
ttgaaaaaaagaaaggaagaaa

SEQ ID NO: 743667 - DNA, 22 bp, Artificial Sequence
  chemically synthesized
tctttctttctttcttcctttc

SEQ ID NO: 743668 - DNA, 22 bp, Artificial Sequence
  chemically synthesized
ctttctttctttcttcctttct

SEQ ID NO: 743669 - DNA, 22 bp, Artificial Sequence
  chemically synthesized
tttctttctttcttcctttctt

SEQ ID NO: 743670 - DNA, 22 bp, Artificial Sequence
  chemically synthesized
tctttctttcttcctttctttt

SEQ ID NO: 743671 - DNA, 22 bp, Artificial Sequence
  chemically synthesized
ctttctttcttcctttcttttt

SEQ ID NO: 743672 - DNA, 22 bp, Artificial Sequence
  chemically synthesized
tttctttcttcctttctttttt

SEQ ID NO: 743673 - DNA, 22 bp, Artificial Sequence
  chemically synthesized
tctttcttcctttctttttttc

SEQ ID NO: 743674 - DNA, 22 bp, Artificial Sequence
  chemically synthesized
ctttcttcctttctttttttca

SEQ ID NO: 743675 - DNA, 22 bp, Artificial Sequence
  chemically synthesized
tttcttcctttctttttttcaa

SEQ ID NO: 743676 - DNA, 22 bp, Artificial Sequence
  chemically synthesized
tcttcctttctttttttcaaga

SEQ ID NO: 743677 - DNA, 22 bp, Artificial Sequence
  chemically synthesized
cttcctttctttttttcaagag

SEQ ID NO: 743678 - DNA, 22 bp, Artificial Sequence
  chemically synthesized
ttcctttctttttttcaagaga

SEQ ID NO: 743679 - DNA, 22 bp, Artificial Sequence
  chemically synthesized
cctttctttttttcaagagact

SEQ ID NO: 743680 - DNA, 22 bp, Artificial Sequence
  chemically synthesized
ctttctttttttcaagagactt

SEQ ID NO: 743681 - DNA, 22 bp, Artificial Sequence
  chemically synthesized
tctttttttcaagagacttctt

SEQ ID NO: 743682 - DNA, 22 bp, Artificial Sequence
  chemically synthesized
ctttttttcaagagacttcttt

SEQ ID NO: 743683 - DNA, 22 bp, Artificial Sequence
  chemically synthesized
tttttttcaagagacttctttc

SEQ ID NO: 743684 - DNA, 22 bp, Artificial Sequence
  chemically synthesized
tttttcaagagacttctttctc

SEQ ID NO: 743685 - DNA, 22 bp, Artificial Sequence
  chemically synthesized
ttttcaagagacttctttctct

SEQ ID NO: 743686 - DNA, 22 bp, Artificial Sequence
  chemically synthesized
tttcaagagacttctttctctt

SEQ ID NO: 743687 - DNA, 22 bp, Artificial Sequence
  chemically synthesized
ttcaagagacttctttctcttt

SEQ ID NO: 743688 - DNA, 22 bp, Artificial Sequence
  chemically synthesized
tcaagagacttctttctctttt

SEQ ID NO: 743689 - DNA, 22 bp, Artificial Sequence
  chemically synthesized
caagagacttctttctcttttt

SEQ ID NO: 743690 - DNA, 22 bp, Artificial Sequence
  chemically synthesized
aagagacttctttctctttttt

SEQ ID NO: 743691 - DNA, 22 bp, Artificial Sequence
  chemically synthesized
ctttctcttttttctttccttc

SEQ ID NO: 743692 - DNA, 22 bp, Artificial Sequence
  chemically synthesized
tttctcttttttctttccttcc

SEQ ID NO: 743693 - DNA, 22 bp, Artificial Sequence
  chemically synthesized
tctcttttttctttccttcctt

SEQ ID NO: 743694 - DNA, 22 bp, Artificial Sequence
  chemically synthesized
ctcttttttctttccttccttc

SEQ ID NO: 743695 - DNA, 22 bp, Artificial Sequence
  chemically synthesized
tcttttttctttccttccttcc

SEQ ID NO: 743696 - DNA, 22 bp, Artificial Sequence
  chemically synthesized
ttttttctttccttccttcctt

SEQ ID NO: 743697 - DNA, 22 bp, Artificial Sequence
  chemically synthesized
ttttctttccttccttccttcc

SEQ ID NO: 743698 - DNA, 22 bp, Artificial Sequence
  chemically synthesized
tttctttccttccttccttcct

SEQ ID NO: 743699 - DNA, 22 bp, Artificial Sequence
  chemically synthesized
ttctttccttccttccttcctt

SEQ ID NO: 743700 - DNA, 22 bp, Artificial Sequence
  chemically synthesized
tctttccttccttccttccttc

SEQ ID NO: 743701 - DNA, 22 bp, Artificial Sequence
  chemically synthesized
ctttccttccttccttccttcc

SEQ ID NO: 743702 - DNA, 22 bp, Artificial Sequence
  chemically synthesized
tttccttccttccttccttcct

SEQ ID NO: 743703 - DNA, 22 bp, Artificial Sequence
  chemically synthesized
tccttccttccttccttccttt

SEQ ID NO: 743704 - DNA, 22 bp, Artificial Sequence
  chemically synthesized
ccttccttccttccttcctttc

SEQ ID NO: 743705 - DNA, 22 bp, Artificial Sequence
  chemically synthesized
cttccttccttccttcctttcc

SEQ ID NO: 743706 - DNA, 22 bp, Artificial Sequence
  chemically synthesized
ccttccttccttcctttccttc

SEQ ID NO: 743707 - DNA, 22 bp, Artificial Sequence
  chemically synthesized
cttccttccttcctttccttcc

SEQ ID NO: 743708 - DNA, 22 bp, Artificial Sequence
  chemically synthesized
ccttccttcctttccttccttt

SEQ ID NO: 743709 - DNA, 22 bp, Artificial Sequence
  chemically synthesized
cttccttcctttccttcctttc

SEQ ID NO: 743710 - DNA, 22 bp, Artificial Sequence
  chemically synthesized
ccttcctttccttcctttcttt

SEQ ID NO: 743711 - DNA, 22 bp, Artificial Sequence
  chemically synthesized
cttcctttccttcctttctttc

SEQ ID NO: 743712 - DNA, 22 bp, Artificial Sequence
  chemically synthesized
cctttccttcctttctttcctt

SEQ ID NO: 743713 - DNA, 22 bp, Artificial Sequence
  chemically synthesized
ctttccttcctttctttccttt

SEQ ID NO: 743714 - DNA, 22 bp, Artificial Sequence
  chemically synthesized
tccttcctttctttcctttttt

SEQ ID NO: 743715 - DNA, 22 bp, Artificial Sequence
  chemically synthesized
gaaaaaaaaaaaaaaaaaggaa

SEQ ID NO: 743716 - DNA, 22 bp, Artificial Sequence
  chemically synthesized
ccttcctttctttccttttttt

SEQ ID NO: 743717 - DNA, 22 bp, Artificial Sequence
  chemically synthesized
ggaaaaaaaaaaaaaaaaagga

SEQ ID NO: 743718 - DNA, 22 bp, Artificial Sequence
  chemically synthesized
cttcctttctttcctttttttt

SEQ ID NO: 743719 - DNA, 22 bp, Artificial Sequence
  chemically synthesized
cctttctttccttttttttttt

SEQ ID NO: 743720 - DNA, 22 bp, Artificial Sequence
  chemically synthesized
ctttctttcctttttttttttt

SEQ ID NO: 743721 - DNA, 22 bp, Artificial Sequence
  chemically synthesized
caccttggaaaaaaaaaaaaaa

SEQ ID NO: 743722 - DNA, 22 bp, Artificial Sequence
  chemically synthesized
tctttccttttttttttttttt

SEQ ID NO: 743723 - DNA, 22 bp, Artificial Sequence
  chemically synthesized
ctttcctttttttttttttttt

SEQ ID NO: 743724 - DNA, 22 bp, Artificial Sequence
  chemically synthesized
tttccttttttttttttttttt

SEQ ID NO: 743725 - DNA, 22 bp, Artificial Sequence
  chemically synthesized
tcctttttttttttttttttcc

SEQ ID NO: 743726 - DNA, 22 bp, Artificial Sequence
  chemically synthesized
cctttttttttttttttttcca

SEQ ID NO: 743727 - DNA, 22 bp, Artificial Sequence
  chemically synthesized
ctttttttttttttttttccaa

SEQ ID NO: 743728 - DNA, 22 bp, Artificial Sequence
  chemically synthesized
tttttttttttttttccaaggt

SEQ ID NO: 743729 - DNA, 22 bp, Artificial Sequence
  chemically synthesized
ttttttttttttttccaaggtg

SEQ ID NO: 743730 - DNA, 22 bp, Artificial Sequence
  chemically synthesized
tttttttttttttccaaggtgg

SEQ ID NO: 743731 - DNA, 22 bp, Artificial Sequence
  chemically synthesized
ttttttttttttccaaggtgga

SEQ ID NO: 743732 - DNA, 22 bp, Artificial Sequence
  chemically synthesized
tttttttttttccaaggtggag

SEQ ID NO: 743733 - DNA, 22 bp, Artificial Sequence
  chemically synthesized
ttttttttttccaaggtggagt

SEQ ID NO: 743734 - DNA, 22 bp, Artificial Sequence
  chemically synthesized
tttttttttccaaggtggagtt

SEQ ID NO: 743735 - DNA, 22 bp, Artificial Sequence
  chemically synthesized
ttttttttccaaggtggagttt

SEQ ID NO: 743736 - DNA, 22 bp, Artificial Sequence
  chemically synthesized
tttttttccaaggtggagtttc

SEQ ID NO: 743737 - DNA, 22 bp, Artificial Sequence
  chemically synthesized
ggcagcaagagtgaaactccac

SEQ ID NO: 743738 - DNA, 22 bp, Artificial Sequence
  chemically synthesized
ttttttccaaggtggagtttca

SEQ ID NO: 743739 - DNA, 22 bp, Artificial Sequence
  chemically synthesized
tttttccaaggtggagtttcac

SEQ ID NO: 743740 - DNA, 22 bp, Artificial Sequence
  chemically synthesized
ttttccaaggtggagtttcact

SEQ ID NO: 743741 - DNA, 22 bp, Artificial Sequence
  chemically synthesized
tttccaaggtggagtttcactc

SEQ ID NO: 743742 - DNA, 22 bp, Artificial Sequence
  chemically synthesized
ttccaaggtggagtttcactct

SEQ ID NO: 743743 - DNA, 22 bp, Artificial Sequence
  chemically synthesized
tccaaggtggagtttcactctt

SEQ ID NO: 743744 - DNA, 22 bp, Artificial Sequence
  chemically synthesized
ccaaggtggagtttcactcttg

SEQ ID NO: 743745 - DNA, 22 bp, Artificial Sequence
  chemically synthesized
cagcctgggcagcaagagtgaa

SEQ ID NO: 743746 - DNA, 22 bp, Artificial Sequence
  chemically synthesized
caaggtggagtttcactcttgc

SEQ ID NO: 743747 - DNA, 22 bp, Artificial Sequence
  chemically synthesized
tactccagcctgggcagcaaga

SEQ ID NO: 743748 - DNA, 22 bp, Artificial Sequence
  chemically synthesized
cactcttgctgcccaggctgga

SEQ ID NO: 743749 - DNA, 22 bp, Artificial Sequence
  chemically synthesized
actcttgctgcccaggctggag

SEQ ID NO: 743750 - DNA, 22 bp, Artificial Sequence
  chemically synthesized
ttgctgcccaggctggagtaca

SEQ ID NO: 743751 - DNA, 22 bp, Artificial Sequence
  chemically synthesized
gctgcccaggctggagtacaat

SEQ ID NO: 743752 - DNA, 22 bp, Artificial Sequence
  chemically synthesized
ctgcccaggctggagtacaatg

SEQ ID NO: 743753 - DNA, 22 bp, Artificial Sequence
  chemically synthesized
cccaggctggagtacaatggca

SEQ ID NO: 743754 - DNA, 22 bp, Artificial Sequence
  chemically synthesized
cagtgagccgagatcgtgccat

SEQ ID NO: 743755 - DNA, 22 bp, Artificial Sequence
  chemically synthesized
gagtacaatggcacgatctcgg

SEQ ID NO: 743756 - DNA, 22 bp, Artificial Sequence
  chemically synthesized
aacccaggaggtagaagttgca

SEQ ID NO: 743757 - DNA, 22 bp, Artificial Sequence
  chemically synthesized
gaacccaggaggtagaagttgc

SEQ ID NO: 743758 - DNA, 22 bp, Artificial Sequence
  chemically synthesized
ggctcactgcaacttctacctc

SEQ ID NO: 743759 - DNA, 22 bp, Artificial Sequence
  chemically synthesized
actgcaacttctacctcctggg

SEQ ID NO: 743760 - DNA, 22 bp, Artificial Sequence
  chemically synthesized
caacttctacctcctgggttca

SEQ ID NO: 743761 - DNA, 22 bp, Artificial Sequence
  chemically synthesized
aggcaggagaatcacttgaacc

SEQ ID NO: 743762 - DNA, 22 bp, Artificial Sequence
  chemically synthesized
ctacctcctgggttcaagtgat

SEQ ID NO: 743763 - DNA, 22 bp, Artificial Sequence
  chemically synthesized
tacctcctgggttcaagtgatt

SEQ ID NO: 743764 - DNA, 22 bp, Artificial Sequence
  chemically synthesized
cctcctgggttcaagtgattct

SEQ ID NO: 743765 - DNA, 22 bp, Artificial Sequence
  chemically synthesized
ctgggttcaagtgattctcctg

SEQ ID NO: 743766 - DNA, 22 bp, Artificial Sequence
  chemically synthesized
aggaggctgaggcaggagaatc

SEQ ID NO: 743767 - DNA, 22 bp, Artificial Sequence
  chemically synthesized
ggttcaagtgattctcctgcct

SEQ ID NO: 743768 - DNA, 22 bp, Artificial Sequence
  chemically synthesized
ctcaggaggctgaggcaggaga

SEQ ID NO: 743769 - DNA, 22 bp, Artificial Sequence
  chemically synthesized
aagtgattctcctgcctcagcc

SEQ ID NO: 743770 - DNA, 22 bp, Artificial Sequence
  chemically synthesized
taatcccagctactcaggaggc

SEQ ID NO: 743771 - DNA, 22 bp, Artificial Sequence
  chemically synthesized
tcctgcctcagcctcctgagta

SEQ ID NO: 743772 - DNA, 22 bp, Artificial Sequence
  chemically synthesized
ctgcctcagcctcctgagtagc

SEQ ID NO: 743773 - DNA, 22 bp, Artificial Sequence
  chemically synthesized
cctcagcctcctgagtagctgg

SEQ ID NO: 743774 - DNA, 22 bp, Artificial Sequence
  chemically synthesized
agcctcctgagtagctgggatt

SEQ ID NO: 743775 - DNA, 22 bp, Artificial Sequence
  chemically synthesized
ctgagtagctgggattacaggt

SEQ ID NO: 743776 - DNA, 22 bp, Artificial Sequence
  chemically synthesized
agtagctgggattacaggtgcc

SEQ ID NO: 743777 - DNA, 22 bp, Artificial Sequence
  chemically synthesized
gccaggcgtggtggcgggcacc

SEQ ID NO: 743778 - DNA, 22 bp, Artificial Sequence
  chemically synthesized
ggattacaggtgcccgccacca

SEQ ID NO: 743779 - DNA, 22 bp, Artificial Sequence
  chemically synthesized
caggtgcccgccaccacgcctg

SEQ ID NO: 743780 - DNA, 22 bp, Artificial Sequence
  chemically synthesized
aaaatacaaaattagccaggcg

SEQ ID NO: 743781 - DNA, 22 bp, Artificial Sequence
  chemically synthesized
taaaaatacaaaattagccagg

SEQ ID NO: 743782 - DNA, 22 bp, Artificial Sequence
  chemically synthesized
ctaaaaatacaaaattagccag

SEQ ID NO: 743783 - DNA, 22 bp, Artificial Sequence
  chemically synthesized
ttctaaaaatacaaaattagcc

SEQ ID NO: 743784 - DNA, 22 bp, Artificial Sequence
  chemically synthesized
gctaattttgtatttttagaag

SEQ ID NO: 743785 - DNA, 22 bp, Artificial Sequence
  chemically synthesized
attttgtatttttagaagagat

SEQ ID NO: 743786 - DNA, 22 bp, Artificial Sequence
  chemically synthesized
tgtatttttagaagagatgggg

SEQ ID NO: 743787 - DNA, 22 bp, Artificial Sequence
  chemically synthesized
gtatttttagaagagatggggt

SEQ ID NO: 743788 - DNA, 22 bp, Artificial Sequence
  chemically synthesized
tatttttagaagagatggggtt

SEQ ID NO: 743789 - DNA, 22 bp, Artificial Sequence
  chemically synthesized
gccaacatggtgaaaccccatc

SEQ ID NO: 743790 - DNA, 22 bp, Artificial Sequence
  chemically synthesized
ttagaagagatggggtttcacc

SEQ ID NO: 743791 - DNA, 22 bp, Artificial Sequence
  chemically synthesized
tagaagagatggggtttcacca

SEQ ID NO: 743792 - DNA, 22 bp, Artificial Sequence
  chemically synthesized
agaagagatggggtttcaccat

SEQ ID NO: 743793 - DNA, 22 bp, Artificial Sequence
  chemically synthesized
gaagagatggggtttcaccatg

SEQ ID NO: 743794 - DNA, 22 bp, Artificial Sequence
  chemically synthesized
aagaccagcctggccaacatgg

SEQ ID NO: 743795 - DNA, 22 bp, Artificial Sequence
  chemically synthesized
caccatgttggccaggctggtc

SEQ ID NO: 743796 - DNA, 22 bp, Artificial Sequence
  chemically synthesized
accatgttggccaggctggtct

SEQ ID NO: 743797 - DNA, 22 bp, Artificial Sequence
  chemically synthesized
aggtcaagagttcaagaccagc

SEQ ID NO: 743798 - DNA, 22 bp, Artificial Sequence
  chemically synthesized
gccaggctggtcttgaactctt

SEQ ID NO: 743799 - DNA, 22 bp, Artificial Sequence
  chemically synthesized
gtcttgaactcttgacctcagg

SEQ ID NO: 743800 - DNA, 22 bp, Artificial Sequence
  chemically synthesized
cgtgggtggatcacctgaggtc

SEQ ID NO: 743801 - DNA, 22 bp, Artificial Sequence
  chemically synthesized
gaactcttgacctcaggtgatc

SEQ ID NO: 743802 - DNA, 22 bp, Artificial Sequence
  chemically synthesized
aactcttgacctcaggtgatcc

SEQ ID NO: 743803 - DNA, 22 bp, Artificial Sequence
  chemically synthesized
ggaggcctacgtgggtggatca

SEQ ID NO: 743804 - DNA, 22 bp, Artificial Sequence
  chemically synthesized
ttgacctcaggtgatccaccca

SEQ ID NO: 743805 - DNA, 22 bp, Artificial Sequence
  chemically synthesized
gggaggcctacgtgggtggatc

SEQ ID NO: 743806 - DNA, 22 bp, Artificial Sequence
  chemically synthesized
tgggaggcctacgtgggtggat

SEQ ID NO: 743807 - DNA, 22 bp, Artificial Sequence
  chemically synthesized
gacctcaggtgatccacccacg

SEQ ID NO: 743808 - DNA, 22 bp, Artificial Sequence
  chemically synthesized
acctcaggtgatccacccacgt

SEQ ID NO: 743809 - DNA, 22 bp, Artificial Sequence
  chemically synthesized
aggtgatccacccacgtaggcc

SEQ ID NO: 743810 - DNA, 22 bp, Artificial Sequence
  chemically synthesized
taatcccagcactttgggaggc

SEQ ID NO: 743811 - DNA, 22 bp, Artificial Sequence
  chemically synthesized
aggcctgtaatcccagcacttt

SEQ ID NO: 743812 - DNA, 22 bp, Artificial Sequence
  chemically synthesized
ccaaagtgctgggattacaggc

SEQ ID NO: 743813 - DNA, 22 bp, Artificial Sequence
  chemically synthesized
caggcccggcacggtggctcag

SEQ ID NO: 743814 - DNA, 22 bp, Artificial Sequence
  chemically synthesized
ggattacaggcctgagccaccg

SEQ ID NO: 743815 - DNA, 22 bp, Artificial Sequence
  chemically synthesized
ctgcaggcccggcacggtggct

SEQ ID NO: 743816 - DNA, 22 bp, Artificial Sequence
  chemically synthesized
caggcctgagccaccgtgccgg

SEQ ID NO: 743817 - DNA, 22 bp, Artificial Sequence
  chemically synthesized
agaagtctcctgcaggcccggc

SEQ ID NO: 743818 - DNA, 22 bp, Artificial Sequence
  chemically synthesized
aagaagtctcctgcaggcccgg

SEQ ID NO: 743819 - DNA, 22 bp, Artificial Sequence
  chemically synthesized
agccaccgtgccgggcctgcag

SEQ ID NO: 743820 - DNA, 22 bp, Artificial Sequence
  chemically synthesized
acttaagaagtctcctgcaggc

SEQ ID NO: 743821 - DNA, 22 bp, Artificial Sequence
  chemically synthesized
gtaatgaaaattcacttaagaa

SEQ ID NO: 743822 - DNA, 22 bp, Artificial Sequence
  chemically synthesized
caggagacttcttaagtgaatt

SEQ ID NO: 743823 - DNA, 22 bp, Artificial Sequence
  chemically synthesized
cttaagtgaattttcattacta

SEQ ID NO: 743824 - DNA, 22 bp, Artificial Sequence
  chemically synthesized
ttaagtgaattttcattactaa

SEQ ID NO: 743825 - DNA, 22 bp, Artificial Sequence
  chemically synthesized
aagtgaattttcattactaaca

SEQ ID NO: 743826 - DNA, 22 bp, Artificial Sequence
  chemically synthesized
agtgaattttcattactaacac

SEQ ID NO: 743827 - DNA, 22 bp, Artificial Sequence
  chemically synthesized
tgaaatagccccatagtgttag

SEQ ID NO: 743828 - DNA, 22 bp, Artificial Sequence
  chemically synthesized
tcattactaacactatggggct

SEQ ID NO: 743829 - DNA, 22 bp, Artificial Sequence
  chemically synthesized
cattactaacactatggggcta

SEQ ID NO: 743830 - DNA, 22 bp, Artificial Sequence
  chemically synthesized
attactaacactatggggctat

SEQ ID NO: 743831 - DNA, 22 bp, Artificial Sequence
  chemically synthesized
gagagctatgaaatagccccat

SEQ ID NO: 743832 - DNA, 22 bp, Artificial Sequence
  chemically synthesized
ttggagagctatgaaatagccc

SEQ ID NO: 743833 - DNA, 22 bp, Artificial Sequence
  chemically synthesized
ctaacactatggggctatttca

SEQ ID NO: 743834 - DNA, 22 bp, Artificial Sequence
  chemically synthesized
gttggagagctatgaaatagcc

SEQ ID NO: 743835 - DNA, 22 bp, Artificial Sequence
  chemically synthesized
tgttggagagctatgaaatagc

SEQ ID NO: 743836 - DNA, 22 bp, Artificial Sequence
  chemically synthesized
acactatggggctatttcatag

SEQ ID NO: 743837 - DNA, 22 bp, Artificial Sequence
  chemically synthesized
tggggctatttcatagctctcc

SEQ ID NO: 743838 - DNA, 22 bp, Artificial Sequence
  chemically synthesized
tttcatagctctccaacaaaac

SEQ ID NO: 743839 - DNA, 22 bp, Artificial Sequence
  chemically synthesized
catagctctccaacaaaactgg

SEQ ID NO: 743840 - DNA, 22 bp, Artificial Sequence
  chemically synthesized
atagctctccaacaaaactggg

SEQ ID NO: 743841 - DNA, 22 bp, Artificial Sequence
  chemically synthesized
gagaaagggtgacaatcccagt

SEQ ID NO: 743842 - DNA, 22 bp, Artificial Sequence
  chemically synthesized
cgagaaagggtgacaatcccag

SEQ ID NO: 743843 - DNA, 22 bp, Artificial Sequence
  chemically synthesized
tcgagaaagggtgacaatccca

SEQ ID NO: 743844 - DNA, 22 bp, Artificial Sequence
  chemically synthesized
tccaacaaaactgggattgtca

SEQ ID NO: 743845 - DNA, 22 bp, Artificial Sequence
  chemically synthesized
caacaaaactgggattgtcacc

SEQ ID NO: 743846 - DNA, 22 bp, Artificial Sequence
  chemically synthesized
aactttcgagaaagggtgacaa

SEQ ID NO: 743847 - DNA, 22 bp, Artificial Sequence
  chemically synthesized
ggattgtcaccctttctcgaaa

SEQ ID NO: 743848 - DNA, 22 bp, Artificial Sequence
  chemically synthesized
tcaccctttctcgaaagttgag

SEQ ID NO: 743849 - DNA, 22 bp, Artificial Sequence
  chemically synthesized
gcagaaatgagggactcaactt

SEQ ID NO: 743850 - DNA, 22 bp, Artificial Sequence
  chemically synthesized
ggcagaaatgagggactcaact

SEQ ID NO: 743851 - DNA, 22 bp, Artificial Sequence
  chemically synthesized
tctcgaaagttgagtccctcat

SEQ ID NO: 743852 - DNA, 22 bp, Artificial Sequence
  chemically synthesized
ctcgaaagttgagtccctcatt

SEQ ID NO: 743853 - DNA, 22 bp, Artificial Sequence
  chemically synthesized
tcgaaagttgagtccctcattt

SEQ ID NO: 743854 - DNA, 22 bp, Artificial Sequence
  chemically synthesized
agaatttggcagaaatgaggga

SEQ ID NO: 743855 - DNA, 22 bp, Artificial Sequence
  chemically synthesized
gaaagttgagtccctcatttct

SEQ ID NO: 743856 - DNA, 22 bp, Artificial Sequence
  chemically synthesized
agtccctcatttctgccaaatt

SEQ ID NO: 743857 - DNA, 22 bp, Artificial Sequence
  chemically synthesized
cacacagtccctcagaatttgg

SEQ ID NO: 743858 - DNA, 22 bp, Artificial Sequence
  chemically synthesized
gctccacacagtccctcagaat

SEQ ID NO: 743859 - DNA, 22 bp, Artificial Sequence
  chemically synthesized
atttctgccaaattctgaggga

SEQ ID NO: 743860 - DNA, 22 bp, Artificial Sequence
  chemically synthesized
agctccacacagtccctcagaa

SEQ ID NO: 743861 - DNA, 22 bp, Artificial Sequence
  chemically synthesized
ctgccaaattctgagggactgt

SEQ ID NO: 743862 - DNA, 22 bp, Artificial Sequence
  chemically synthesized
tcttagctccacacagtccctc

SEQ ID NO: 743863 - DNA, 22 bp, Artificial Sequence
  chemically synthesized
tgccaaattctgagggactgtg

SEQ ID NO: 743864 - DNA, 22 bp, Artificial Sequence
  chemically synthesized
gtcttagctccacacagtccct

SEQ ID NO: 743865 - DNA, 22 bp, Artificial Sequence
  chemically synthesized
tgtcttagctccacacagtccc

SEQ ID NO: 743866 - DNA, 22 bp, Artificial Sequence
  chemically synthesized
ccaaattctgagggactgtgtg

SEQ ID NO: 743867 - DNA, 22 bp, Artificial Sequence
  chemically synthesized
tgagggactgtgtggagctaag

SEQ ID NO: 743868 - DNA, 22 bp, Artificial Sequence
  chemically synthesized
agggactgtgtggagctaagac

SEQ ID NO: 743869 - DNA, 22 bp, Artificial Sequence
  chemically synthesized
caaagtatcccctttgtcttag

SEQ ID NO: 743870 - DNA, 22 bp, Artificial Sequence
  chemically synthesized
tgtggagctaagacaaagggga

SEQ ID NO: 743871 - DNA, 22 bp, Artificial Sequence
  chemically synthesized
agtctgcaaagtatcccctttg

SEQ ID NO: 743872 - DNA, 22 bp, Artificial Sequence
  chemically synthesized
gctcagtctgcaaagtatcccc

SEQ ID NO: 743873 - DNA, 22 bp, Artificial Sequence
  chemically synthesized
agacaaaggggatactttgcag

SEQ ID NO: 743874 - DNA, 22 bp, Artificial Sequence
  chemically synthesized
tattcgctcagtctgcaaagta

SEQ ID NO: 743875 - DNA, 22 bp, Artificial Sequence
  chemically synthesized
aaggcagagggttgtattcgct

SEQ ID NO: 743876 - DNA, 22 bp, Artificial Sequence
  chemically synthesized
tgcagactgagcgaatacaacc

SEQ ID NO: 743877 - DNA, 22 bp, Artificial Sequence
  chemically synthesized
gcagactgagcgaatacaaccc

SEQ ID NO: 743878 - DNA, 22 bp, Artificial Sequence
  chemically synthesized
cagactgagcgaatacaaccct

SEQ ID NO: 743879 - DNA, 22 bp, Artificial Sequence
  chemically synthesized
agcgaatacaaccctctgcctt

SEQ ID NO: 743880 - DNA, 22 bp, Artificial Sequence
  chemically synthesized
ccagaagcataagtgatactaa

SEQ ID NO: 743881 - DNA, 22 bp, Artificial Sequence
  chemically synthesized
taccagaagcataagtgatact

SEQ ID NO: 743882 - DNA, 22 bp, Artificial Sequence
  chemically synthesized
tgcctttagtatcacttatgct

SEQ ID NO: 743883 - DNA, 22 bp, Artificial Sequence
  chemically synthesized
cctttagtatcacttatgcttc

SEQ ID NO: 743884 - DNA, 22 bp, Artificial Sequence
  chemically synthesized
tagtatcacttatgcttctggt

SEQ ID NO: 743885 - DNA, 22 bp, Artificial Sequence
  chemically synthesized
agtatcacttatgcttctggta

SEQ ID NO: 743886 - DNA, 22 bp, Artificial Sequence
  chemically synthesized
gtatcacttatgcttctggtag

SEQ ID NO: 743887 - DNA, 22 bp, Artificial Sequence
  chemically synthesized
tcgagaatgtctctaccagaag

SEQ ID NO: 743888 - DNA, 22 bp, Artificial Sequence
  chemically synthesized
ttgtcgagaatgtctctaccag

SEQ ID NO: 743889 - DNA, 22 bp, Artificial Sequence
  chemically synthesized
attgtcgagaatgtctctacca

SEQ ID NO: 743890 - DNA, 22 bp, Artificial Sequence
  chemically synthesized
atgcttctggtagagacattct

SEQ ID NO: 743891 - DNA, 22 bp, Artificial Sequence
  chemically synthesized
tgcttctggtagagacattctc

SEQ ID NO: 743892 - DNA, 22 bp, Artificial Sequence
  chemically synthesized
ctggtagagacattctcgacaa

SEQ ID NO: 743893 - DNA, 22 bp, Artificial Sequence
  chemically synthesized
tggtagagacattctcgacaat

SEQ ID NO: 743894 - DNA, 22 bp, Artificial Sequence
  chemically synthesized
aatggcataatttattgtcgag

SEQ ID NO: 743895 - DNA, 22 bp, Artificial Sequence
  chemically synthesized
gtagagacattctcgacaataa

SEQ ID NO: 743896 - DNA, 22 bp, Artificial Sequence
  chemically synthesized
caatggcataatttattgtcga

SEQ ID NO: 743897 - DNA, 22 bp, Artificial Sequence
  chemically synthesized
aagtacgtttcaatggcataat

SEQ ID NO: 743898 - DNA, 22 bp, Artificial Sequence
  chemically synthesized
aaagtacgtttcaatggcataa

SEQ ID NO: 743899 - DNA, 22 bp, Artificial Sequence
  chemically synthesized
tcgacaataaattatgccattg

SEQ ID NO: 743900 - DNA, 22 bp, Artificial Sequence
  chemically synthesized
taaagtacgtttcaatggcata

SEQ ID NO: 743901 - DNA, 22 bp, Artificial Sequence
  chemically synthesized
ttaaagtacgtttcaatggcat

SEQ ID NO: 743902 - DNA, 22 bp, Artificial Sequence
  chemically synthesized
gacaataaattatgccattgaa

SEQ ID NO: 743903 - DNA, 22 bp, Artificial Sequence
  chemically synthesized
tttaaagtacgtttcaatggca

SEQ ID NO: 743904 - DNA, 22 bp, Artificial Sequence
  chemically synthesized
ttttaaagtacgtttcaatggc

SEQ ID NO: 743905 - DNA, 22 bp, Artificial Sequence
  chemically synthesized
tttttaaagtacgtttcaatgg

SEQ ID NO: 743906 - DNA, 22 bp, Artificial Sequence
  chemically synthesized
ttttttaaagtacgtttcaatg

SEQ ID NO: 743907 - DNA, 22 bp, Artificial Sequence
  chemically synthesized
tttttttaaagtacgtttcaat

SEQ ID NO: 743908 - DNA, 22 bp, Artificial Sequence
  chemically synthesized
ttttttttaaagtacgtttcaa

SEQ ID NO: 743909 - DNA, 22 bp, Artificial Sequence
  chemically synthesized
tttttttttaaagtacgtttca

SEQ ID NO: 743910 - DNA, 22 bp, Artificial Sequence
  chemically synthesized
ttttttttttaaagtacgtttc

SEQ ID NO: 743911 - DNA, 22 bp, Artificial Sequence
  chemically synthesized
tgccattgaaacgtactttaaa

SEQ ID NO: 743912 - DNA, 22 bp, Artificial Sequence
  chemically synthesized
aaacgtactttaaaaaaaaaaa

SEQ ID NO: 743913 - DNA, 22 bp, Artificial Sequence
  chemically synthesized
taaaaaaaaaaaagggatgtga

SEQ ID NO: 743914 - DNA, 22 bp, Artificial Sequence
  chemically synthesized
aaaaaaaaaaaagggatgtgat

SEQ ID NO: 743915 - DNA, 22 bp, Artificial Sequence
  chemically synthesized
gaaaaaaatgcaatcacatccc

SEQ ID NO: 743916 - DNA, 22 bp, Artificial Sequence
  chemically synthesized
aaaaaaaaaaagggatgtgatt

SEQ ID NO: 743917 - DNA, 22 bp, Artificial Sequence
  chemically synthesized
ctggaaaaaaatgcaatcacat

SEQ ID NO: 743918 - DNA, 22 bp, Artificial Sequence
  chemically synthesized
ttgctggaaaaaaatgcaatca

SEQ ID NO: 743919 - DNA, 22 bp, Artificial Sequence
  chemically synthesized
tcacaataaaaactgttgctgg

SEQ ID NO: 743920 - DNA, 22 bp, Artificial Sequence
  chemically synthesized
catttttttccagcaacagttt

SEQ ID NO: 743921 - DNA, 22 bp, Artificial Sequence
  chemically synthesized
aggctatcacaataaaaactgt

SEQ ID NO: 743922 - DNA, 22 bp, Artificial Sequence
  chemically synthesized
caggctatcacaataaaaactg

SEQ ID NO: 743923 - DNA, 22 bp, Artificial Sequence
  chemically synthesized
ttttccagcaacagtttttatt

SEQ ID NO: 743924 - DNA, 22 bp, Artificial Sequence
  chemically synthesized
tttccagcaacagtttttattg

SEQ ID NO: 743925 - DNA, 22 bp, Artificial Sequence
  chemically synthesized
ttccagcaacagtttttattgt

SEQ ID NO: 743926 - DNA, 22 bp, Artificial Sequence
  chemically synthesized
tccagcaacagtttttattgtg

SEQ ID NO: 743927 - DNA, 22 bp, Artificial Sequence
  chemically synthesized
ccttcaggctatcacaataaaa

SEQ ID NO: 743928 - DNA, 22 bp, Artificial Sequence
  chemically synthesized
ccagcaacagtttttattgtga

SEQ ID NO: 743929 - DNA, 22 bp, Artificial Sequence
  chemically synthesized
gccttcaggctatcacaataaa

SEQ ID NO: 743930 - DNA, 22 bp, Artificial Sequence
  chemically synthesized
cagcaacagtttttattgtgat

SEQ ID NO: 743931 - DNA, 22 bp, Artificial Sequence
  chemically synthesized
tgccttcaggctatcacaataa

SEQ ID NO: 743932 - DNA, 22 bp, Artificial Sequence
  chemically synthesized
cataatattttgccttcaggct

SEQ ID NO: 743933 - DNA, 22 bp, Artificial Sequence
  chemically synthesized
ttattgtgatagcctgaaggca

SEQ ID NO: 743934 - DNA, 22 bp, Artificial Sequence
  chemically synthesized
tattgtgatagcctgaaggcaa

SEQ ID NO: 743935 - DNA, 22 bp, Artificial Sequence
  chemically synthesized
attgtgatagcctgaaggcaaa

SEQ ID NO: 743936 - DNA, 22 bp, Artificial Sequence
  chemically synthesized
ttgtgatagcctgaaggcaaaa

SEQ ID NO: 743937 - DNA, 22 bp, Artificial Sequence
  chemically synthesized
tgatagcctgaaggcaaaatat

SEQ ID NO: 743938 - DNA, 22 bp, Artificial Sequence
  chemically synthesized
aaggcaaaatattatgcagttt

SEQ ID NO: 743939 - DNA, 22 bp, Artificial Sequence
  chemically synthesized
aacggaaggagacaacgaaaag

SEQ ID NO: 743940 - DNA, 22 bp, Artificial Sequence
  chemically synthesized
tgcagtttcttttcgttgtctc

SEQ ID NO: 743941 - DNA, 22 bp, Artificial Sequence
  chemically synthesized
aaaactgaacggaaggagacaa

SEQ ID NO: 743942 - DNA, 22 bp, Artificial Sequence
  chemically synthesized
cttttcgttgtctccttccgtt

SEQ ID NO: 743943 - DNA, 22 bp, Artificial Sequence
  chemically synthesized
ccctgaaaactgaacggaagga

SEQ ID NO: 743944 - DNA, 22 bp, Artificial Sequence
  chemically synthesized
ttttcgttgtctccttccgttc

SEQ ID NO: 743945 - DNA, 22 bp, Artificial Sequence
  chemically synthesized
ttcgttgtctccttccgttcag

SEQ ID NO: 743946 - DNA, 22 bp, Artificial Sequence
  chemically synthesized
tcgttgtctccttccgttcagt

SEQ ID NO: 743947 - DNA, 22 bp, Artificial Sequence
  chemically synthesized
cgttgtctccttccgttcagtt

SEQ ID NO: 743948 - DNA, 22 bp, Artificial Sequence
  chemically synthesized
gttgtctccttccgttcagttt

SEQ ID NO: 743949 - DNA, 22 bp, Artificial Sequence
  chemically synthesized
caagaattgccctgaaaactga

SEQ ID NO: 743950 - DNA, 22 bp, Artificial Sequence
  chemically synthesized
tctccttccgttcagttttcag

SEQ ID NO: 743951 - DNA, 22 bp, Artificial Sequence
  chemically synthesized
acaagaattgccctgaaaactg

SEQ ID NO: 743952 - DNA, 22 bp, Artificial Sequence
  chemically synthesized
cttccgttcagttttcagggca

SEQ ID NO: 743953 - DNA, 22 bp, Artificial Sequence
  chemically synthesized
ccgttcagttttcagggcaatt

SEQ ID NO: 743954 - DNA, 22 bp, Artificial Sequence
  chemically synthesized
cgttcagttttcagggcaattc

SEQ ID NO: 743955 - DNA, 22 bp, Artificial Sequence
  chemically synthesized
agttttcagggcaattcttgta

SEQ ID NO: 743956 - DNA, 22 bp, Artificial Sequence
  chemically synthesized
tcagggcaattcttgtaaactt

SEQ ID NO: 743957 - DNA, 22 bp, Artificial Sequence
  chemically synthesized
cagggcaattcttgtaaacttt

SEQ ID NO: 743958 - DNA, 22 bp, Artificial Sequence
  chemically synthesized
agggcaattcttgtaaactttc

SEQ ID NO: 743959 - DNA, 22 bp, Artificial Sequence
  chemically synthesized
ttgtaaactttcatatttgggc

SEQ ID NO: 743960 - DNA, 22 bp, Artificial Sequence
  chemically synthesized
gtaaactttcatatttgggcat

SEQ ID NO: 743961 - DNA, 22 bp, Artificial Sequence
  chemically synthesized
taaactttcatatttgggcatg

SEQ ID NO: 743962 - DNA, 22 bp, Artificial Sequence
  chemically synthesized
gtcaaaagtgatcatgcccaaa

SEQ ID NO: 743963 - DNA, 22 bp, Artificial Sequence
  chemically synthesized
ctcgtcaaaagtgatcatgccc

SEQ ID NO: 743964 - DNA, 22 bp, Artificial Sequence
  chemically synthesized
actcgtcaaaagtgatcatgcc

SEQ ID NO: 743965 - DNA, 22 bp, Artificial Sequence
  chemically synthesized
tcatatttgggcatgatcactt

SEQ ID NO: 743966 - DNA, 22 bp, Artificial Sequence
  chemically synthesized
catatttgggcatgatcacttt

SEQ ID NO: 743967 - DNA, 22 bp, Artificial Sequence
  chemically synthesized
atatttgggcatgatcactttt

SEQ ID NO: 743968 - DNA, 22 bp, Artificial Sequence
  chemically synthesized
agtttactcgtcaaaagtgatc

SEQ ID NO: 743969 - DNA, 22 bp, Artificial Sequence
  chemically synthesized
ttcagtttactcgtcaaaagtg

SEQ ID NO: 743970 - DNA, 22 bp, Artificial Sequence
  chemically synthesized
gggcatgatcacttttgacgag

SEQ ID NO: 743971 - DNA, 22 bp, Artificial Sequence
  chemically synthesized
ttattcagtttactcgtcaaaa

SEQ ID NO: 743972 - DNA, 22 bp, Artificial Sequence
  chemically synthesized
ggcatgatcacttttgacgagt

SEQ ID NO: 743973 - DNA, 22 bp, Artificial Sequence
  chemically synthesized
tattgttattcagtttactcgt

SEQ ID NO: 743974 - DNA, 22 bp, Artificial Sequence
  chemically synthesized
atattgttattcagtttactcg

SEQ ID NO: 743975 - DNA, 22 bp, Artificial Sequence
  chemically synthesized
tttatattgttattcagtttac

SEQ ID NO: 743976 - DNA, 22 bp, Artificial Sequence
  chemically synthesized
attatttatattgttattcagt

SEQ ID NO: 743977 - DNA, 22 bp, Artificial Sequence
  chemically synthesized
ttgacgagtaaactgaataaca

SEQ ID NO: 743978 - DNA, 22 bp, Artificial Sequence
  chemically synthesized
cattatttatattgttattcag

SEQ ID NO: 743979 - DNA, 22 bp, Artificial Sequence
  chemically synthesized
tgacgagtaaactgaataacaa

SEQ ID NO: 743980 - DNA, 22 bp, Artificial Sequence
  chemically synthesized
gacgagtaaactgaataacaat

SEQ ID NO: 743981 - DNA, 22 bp, Artificial Sequence
  chemically synthesized
acgagtaaactgaataacaata

SEQ ID NO: 743982 - DNA, 22 bp, Artificial Sequence
  chemically synthesized
tttcattatttatattgttatt

SEQ ID NO: 743983 - DNA, 22 bp, Artificial Sequence
  chemically synthesized
agtctgtttcattatttatatt

SEQ ID NO: 743984 - DNA, 22 bp, Artificial Sequence
  chemically synthesized
tgagtctgtttcattatttata

SEQ ID NO: 743985 - DNA, 22 bp, Artificial Sequence
  chemically synthesized
aataacaatataaataatgaaa

SEQ ID NO: 743986 - DNA, 22 bp, Artificial Sequence
  chemically synthesized
gttctgagtctgtttcattatt

SEQ ID NO: 743987 - DNA, 22 bp, Artificial Sequence
  chemically synthesized
ggccattagttctgagtctgtt

SEQ ID NO: 743988 - DNA, 22 bp, Artificial Sequence
  chemically synthesized
aatctaggccattagttctgag

SEQ ID NO: 743989 - DNA, 22 bp, Artificial Sequence
  chemically synthesized
tgctaaatctaggccattagtt

SEQ ID NO: 743990 - DNA, 22 bp, Artificial Sequence
  chemically synthesized
attatgctaaatctaggccatt

SEQ ID NO: 743991 - DNA, 22 bp, Artificial Sequence
  chemically synthesized
tgattatgctaaatctaggcca

SEQ ID NO: 743992 - DNA, 22 bp, Artificial Sequence
  chemically synthesized
ctgattatgctaaatctaggcc

SEQ ID NO: 743993 - DNA, 22 bp, Artificial Sequence
  chemically synthesized
agaactaatggcctagatttag

SEQ ID NO: 743994 - DNA, 22 bp, Artificial Sequence
  chemically synthesized
agtgtttctgattatgctaaat

SEQ ID NO: 743995 - DNA, 22 bp, Artificial Sequence
  chemically synthesized
aagtgtttctgattatgctaaa

SEQ ID NO: 743996 - DNA, 22 bp, Artificial Sequence
  chemically synthesized
atggcctagatttagcataatc

SEQ ID NO: 743997 - DNA, 22 bp, Artificial Sequence
  chemically synthesized
ttaagtgtttctgattatgcta

SEQ ID NO: 743998 - DNA, 22 bp, Artificial Sequence
  chemically synthesized
cttaagtgtttctgattatgct

SEQ ID NO: 743999 - DNA, 22 bp, Artificial Sequence
  chemically synthesized
tcttaagtgtttctgattatgc

SEQ ID NO: 744000 - DNA, 22 bp, Artificial Sequence
  chemically synthesized
acctttcttaagtgtttctgat

SEQ ID NO: 744001 - DNA, 22 bp, Artificial Sequence
  chemically synthesized
gatttagcataatcagaaacac

SEQ ID NO: 744002 - DNA, 22 bp, Artificial Sequence
  chemically synthesized
aacctttcttaagtgtttctga

SEQ ID NO: 744003 - DNA, 22 bp, Artificial Sequence
  chemically synthesized
taacctttcttaagtgtttctg

SEQ ID NO: 744004 - DNA, 22 bp, Artificial Sequence
  chemically synthesized
agcataatcagaaacacttaag

SEQ ID NO: 744005 - DNA, 22 bp, Artificial Sequence
  chemically synthesized
actttaacctttcttaagtgtt

SEQ ID NO: 744006 - DNA, 22 bp, Artificial Sequence
  chemically synthesized
gcataatcagaaacacttaaga

SEQ ID NO: 744007 - DNA, 22 bp, Artificial Sequence
  chemically synthesized
gactttaacctttcttaagtgt

SEQ ID NO: 744008 - DNA, 22 bp, Artificial Sequence
  chemically synthesized
tgactttaacctttcttaagtg

SEQ ID NO: 744009 - DNA, 22 bp, Artificial Sequence
  chemically synthesized
ttgactttaacctttcttaagt

SEQ ID NO: 744010 - DNA, 22 bp, Artificial Sequence
  chemically synthesized
tttgactttaacctttcttaag

SEQ ID NO: 744011 - DNA, 22 bp, Artificial Sequence
  chemically synthesized
ttttgactttaacctttcttaa

SEQ ID NO: 744012 - DNA, 22 bp, Artificial Sequence
  chemically synthesized
tttttgactttaacctttctta

SEQ ID NO: 744013 - DNA, 22 bp, Artificial Sequence
  chemically synthesized
ttttttgactttaacctttctt

SEQ ID NO: 744014 - DNA, 22 bp, Artificial Sequence
  chemically synthesized
ccaagatcttttttttgacttt

SEQ ID NO: 744015 - DNA, 22 bp, Artificial Sequence
  chemically synthesized
cccaagatcttttttttgactt

SEQ ID NO: 744016 - DNA, 22 bp, Artificial Sequence
  chemically synthesized
aagaaaggttaaagtcaaaaaa

SEQ ID NO: 744017 - DNA, 22 bp, Artificial Sequence
  chemically synthesized
tcccaagatcttttttttgact

SEQ ID NO: 744018 - DNA, 22 bp, Artificial Sequence
  chemically synthesized
agaaaggttaaagtcaaaaaaa

SEQ ID NO: 744019 - DNA, 22 bp, Artificial Sequence
  chemically synthesized
ttttcccaagatcttttttttg

SEQ ID NO: 744020 - DNA, 22 bp, Artificial Sequence
  chemically synthesized
atattgttttcccaagatcttt

SEQ ID NO: 744021 - DNA, 22 bp, Artificial Sequence
  chemically synthesized
aatattgttttcccaagatctt

SEQ ID NO: 744022 - DNA, 22 bp, Artificial Sequence
  chemically synthesized
aagtcaaaaaaaagatcttggg

SEQ ID NO: 744023 - DNA, 22 bp, Artificial Sequence
  chemically synthesized
caaacttaatattgttttccca

SEQ ID NO: 744024 - DNA, 22 bp, Artificial Sequence
  chemically synthesized
atgcctacaaacttaatattgt

SEQ ID NO: 744025 - DNA, 22 bp, Artificial Sequence
  chemically synthesized
catgcctacaaacttaatattg

SEQ ID NO: 744026 - DNA, 22 bp, Artificial Sequence
  chemically synthesized
ttcatgcctacaaacttaatat

SEQ ID NO: 744027 - DNA, 22 bp, Artificial Sequence
  chemically synthesized
cttcatgcctacaaacttaata

SEQ ID NO: 744028 - DNA, 22 bp, Artificial Sequence
  chemically synthesized
gggaaaacaatattaagtttgt

SEQ ID NO: 744029 - DNA, 22 bp, Artificial Sequence
  chemically synthesized
ggaaaacaatattaagtttgta

SEQ ID NO: 744030 - DNA, 22 bp, Artificial Sequence
  chemically synthesized
aatttcttcatgcctacaaact

SEQ ID NO: 744031 - DNA, 22 bp, Artificial Sequence
  chemically synthesized
agtttgtaggcatgaagaaatt

SEQ ID NO: 744032 - DNA, 22 bp, Artificial Sequence
  chemically synthesized
ggaaataaaagccctaaatttc

SEQ ID NO: 744033 - DNA, 22 bp, Artificial Sequence
  chemically synthesized
gtaggcatgaagaaatttaggg

SEQ ID NO: 744034 - DNA, 22 bp, Artificial Sequence
  chemically synthesized
gggaaataaaagccctaaattt

SEQ ID NO: 744035 - DNA, 22 bp, Artificial Sequence
  chemically synthesized
taggcatgaagaaatttagggc

SEQ ID NO: 744036 - DNA, 22 bp, Artificial Sequence
  chemically synthesized
ataatcgcttgggaaataaaag

SEQ ID NO: 744037 - DNA, 22 bp, Artificial Sequence
  chemically synthesized
ctgataatcgcttgggaaataa

SEQ ID NO: 744038 - DNA, 22 bp, Artificial Sequence
  chemically synthesized
agggcttttatttcccaagcga

SEQ ID NO: 744039 - DNA, 22 bp, Artificial Sequence
  chemically synthesized
gggcttttatttcccaagcgat

SEQ ID NO: 744040 - DNA, 22 bp, Artificial Sequence
  chemically synthesized
aaatataattactgataatcgc

SEQ ID NO: 744041 - DNA, 22 bp, Artificial Sequence
  chemically synthesized
ttatttcccaagcgattatcag

SEQ ID NO: 744042 - DNA, 22 bp, Artificial Sequence
  chemically synthesized
tatttcccaagcgattatcagt

SEQ ID NO: 744043 - DNA, 22 bp, Artificial Sequence
  chemically synthesized
atttcccaagcgattatcagta

SEQ ID NO: 744044 - DNA, 22 bp, Artificial Sequence
  chemically synthesized
tttcccaagcgattatcagtaa

SEQ ID NO: 744045 - DNA, 22 bp, Artificial Sequence
  chemically synthesized
cccaagcgattatcagtaatta

SEQ ID NO: 744046 - DNA, 22 bp, Artificial Sequence
  chemically synthesized
ccaagcgattatcagtaattat

SEQ ID NO: 744047 - DNA, 22 bp, Artificial Sequence
  chemically synthesized
agaagaaaccatagttaaaata

SEQ ID NO: 744048 - DNA, 22 bp, Artificial Sequence
  chemically synthesized
tcagtaattatattttaactat

SEQ ID NO: 744049 - DNA, 22 bp, Artificial Sequence
  chemically synthesized
agtctgagaagaaaccatagtt

SEQ ID NO: 744050 - DNA, 22 bp, Artificial Sequence
  chemically synthesized
tattttaactatggtttcttct

SEQ ID NO: 744051 - DNA, 22 bp, Artificial Sequence
  chemically synthesized
taactatggtttcttctcagac

SEQ ID NO: 744052 - DNA, 22 bp, Artificial Sequence
  chemically synthesized
gaagcgtgttgagtctgagaag

SEQ ID NO: 744053 - DNA, 22 bp, Artificial Sequence
  chemically synthesized
aactatggtttcttctcagact

SEQ ID NO: 744054 - DNA, 22 bp, Artificial Sequence
  chemically synthesized
ggaagcgtgttgagtctgagaa

SEQ ID NO: 744055 - DNA, 22 bp, Artificial Sequence
  chemically synthesized
actatggtttcttctcagactc

SEQ ID NO: 744056 - DNA, 22 bp, Artificial Sequence
  chemically synthesized
tggtttcttctcagactcaaca

SEQ ID NO: 744057 - DNA, 22 bp, Artificial Sequence
  chemically synthesized
cttctcagactcaacacgcttc

SEQ ID NO: 744058 - DNA, 22 bp, Artificial Sequence
  chemically synthesized
ttctcagactcaacacgcttcc

SEQ ID NO: 744059 - DNA, 22 bp, Artificial Sequence
  chemically synthesized
atgtcacaaatttggaagcgtg

SEQ ID NO: 744060 - DNA, 22 bp, Artificial Sequence
  chemically synthesized
ctcagactcaacacgcttccaa

SEQ ID NO: 744061 - DNA, 22 bp, Artificial Sequence
  chemically synthesized
aatgtcacaaatttggaagcgt

SEQ ID NO: 744062 - DNA, 22 bp, Artificial Sequence
  chemically synthesized
tcagactcaacacgcttccaaa

SEQ ID NO: 744063 - DNA, 22 bp, Artificial Sequence
  chemically synthesized
taatgtcacaaatttggaagcg

SEQ ID NO: 744064 - DNA, 22 bp, Artificial Sequence
  chemically synthesized
ttaatgtcacaaatttggaagc

SEQ ID NO: 744065 - DNA, 22 bp, Artificial Sequence
  chemically synthesized
agactcaacacgcttccaaatt

SEQ ID NO: 744066 - DNA, 22 bp, Artificial Sequence
  chemically synthesized
tttaatgtcacaaatttggaag

SEQ ID NO: 744067 - DNA, 22 bp, Artificial Sequence
  chemically synthesized
ttttaatgtcacaaatttggaa

SEQ ID NO: 744068 - DNA, 22 bp, Artificial Sequence
  chemically synthesized
tttttttaatgtcacaaatttg

SEQ ID NO: 744069 - DNA, 22 bp, Artificial Sequence
  chemically synthesized
aacacgcttccaaatttgtgac

SEQ ID NO: 744070 - DNA, 22 bp, Artificial Sequence
  chemically synthesized
ctatttttttaatgtcacaaat

SEQ ID NO: 744071 - DNA, 22 bp, Artificial Sequence
  chemically synthesized
attgctatttttttaatgtcac

SEQ ID NO: 744072 - DNA, 22 bp, Artificial Sequence
  chemically synthesized
ccaaatttgtgacattaaaaaa

SEQ ID NO: 744073 - DNA, 22 bp, Artificial Sequence
  chemically synthesized
caaatttgtgacattaaaaaaa

SEQ ID NO: 744074 - DNA, 22 bp, Artificial Sequence
  chemically synthesized
gtgacattaaaaaaatagcaat

SEQ ID NO: 744075 - DNA, 22 bp, Artificial Sequence
  chemically synthesized
tgacattaaaaaaatagcaatt

SEQ ID NO: 744076 - DNA, 22 bp, Artificial Sequence
  chemically synthesized
tggaaaacacagagcagttaat

SEQ ID NO: 744077 - DNA, 22 bp, Artificial Sequence
  chemically synthesized
aaaaaatagcaattaactgctc

SEQ ID NO: 744078 - DNA, 22 bp, Artificial Sequence
  chemically synthesized
atggaaaacacagagcagttaa

SEQ ID NO: 744079 - DNA, 22 bp, Artificial Sequence
  chemically synthesized
tatggaaaacacagagcagtta

SEQ ID NO: 744080 - DNA, 22 bp, Artificial Sequence
  chemically synthesized
tttatggaaaacacagagcagt

SEQ ID NO: 744081 - DNA, 22 bp, Artificial Sequence
  chemically synthesized
actgctctgtgttttccataaa

SEQ ID NO: 744082 - DNA, 22 bp, Artificial Sequence
  chemically synthesized
ctctgtgttttccataaagaat

SEQ ID NO: 744083 - DNA, 22 bp, Artificial Sequence
  chemically synthesized
taaaaagatgtggattctttat

SEQ ID NO: 744084 - DNA, 22 bp, Artificial Sequence
  chemically synthesized
ataaaaagatgtggattcttta

SEQ ID NO: 744085 - DNA, 22 bp, Artificial Sequence
  chemically synthesized
tgtgttttccataaagaatcca

SEQ ID NO: 744086 - DNA, 22 bp, Artificial Sequence
  chemically synthesized
tataaaaagatgtggattcttt

SEQ ID NO: 744087 - DNA, 22 bp, Artificial Sequence
  chemically synthesized
ttataaaaagatgtggattctt

SEQ ID NO: 744088 - DNA, 22 bp, Artificial Sequence
  chemically synthesized
tgttttccataaagaatccaca

SEQ ID NO: 744089 - DNA, 22 bp, Artificial Sequence
  chemically synthesized
tttataaaaagatgtggattct

SEQ ID NO: 744090 - DNA, 22 bp, Artificial Sequence
  chemically synthesized
ttttttataaaaagatgtggat

SEQ ID NO: 744091 - DNA, 22 bp, Artificial Sequence
  chemically synthesized
tccataaagaatccacatcttt

SEQ ID NO: 744092 - DNA, 22 bp, Artificial Sequence
  chemically synthesized
ccataaagaatccacatctttt

SEQ ID NO: 744093 - DNA, 22 bp, Artificial Sequence
  chemically synthesized
cataaagaatccacatcttttt

SEQ ID NO: 744094 - DNA, 22 bp, Artificial Sequence
  chemically synthesized
agattgttttttataaaaagat

SEQ ID NO: 744095 - DNA, 22 bp, Artificial Sequence
  chemically synthesized
gttgagattgttttttataaaa

SEQ ID NO: 744096 - DNA, 22 bp, Artificial Sequence
  chemically synthesized
tttataaaaaacaatctcaacc

SEQ ID NO: 744097 - DNA, 22 bp, Artificial Sequence
  chemically synthesized
ttataaaaaacaatctcaacca

SEQ ID NO: 744098 - DNA, 22 bp, Artificial Sequence
  chemically synthesized
tataaaaaacaatctcaaccag

SEQ ID NO: 744099 - DNA, 22 bp, Artificial Sequence
  chemically synthesized
ataaaaaacaatctcaaccagg

SEQ ID NO: 744100 - DNA, 22 bp, Artificial Sequence
  chemically synthesized
taaaaaacaatctcaaccaggt

SEQ ID NO: 744101 - DNA, 22 bp, Artificial Sequence
  chemically synthesized
caggcgtgagccaccgcacctg

SEQ ID NO: 744102 - DNA, 22 bp, Artificial Sequence
  chemically synthesized
ggattacaggcgtgagccaccg

SEQ ID NO: 744103 - DNA, 22 bp, Artificial Sequence
  chemically synthesized
aaccaggtgcggtggctcacgc

SEQ ID NO: 744104 - DNA, 22 bp, Artificial Sequence
  chemically synthesized
ccaaagtgctaggattacaggc

SEQ ID NO: 744105 - DNA, 22 bp, Artificial Sequence
  chemically synthesized
agcctcccaaagtgctaggatt

SEQ ID NO: 744106 - DNA, 22 bp, Artificial Sequence
  chemically synthesized
acgcctgtaatcctagcacttt

SEQ ID NO: 744107 - DNA, 22 bp, Artificial Sequence
  chemically synthesized
taatcctagcactttgggaggc

SEQ ID NO: 744108 - DNA, 22 bp, Artificial Sequence
  chemically synthesized
aggtgatccacccacctcagcc

SEQ ID NO: 744109 - DNA, 22 bp, Artificial Sequence
  chemically synthesized
gcactttgggaggctgaggtgg

SEQ ID NO: 744110 - DNA, 22 bp, Artificial Sequence
  chemically synthesized
acctcaggtgatccacccacct

SEQ ID NO: 744111 - DNA, 22 bp, Artificial Sequence
  chemically synthesized
tgggaggctgaggtgggtggat

SEQ ID NO: 744112 - DNA, 22 bp, Artificial Sequence
  chemically synthesized
gggaggctgaggtgggtggatc

SEQ ID NO: 744113 - DNA, 22 bp, Artificial Sequence
  chemically synthesized
ctgacctcaggtgatccaccca

SEQ ID NO: 744114 - DNA, 22 bp, Artificial Sequence
  chemically synthesized
ggaggctgaggtgggtggatca

SEQ ID NO: 744115 - DNA, 22 bp, Artificial Sequence
  chemically synthesized
taactcctgacctcaggtgatc

SEQ ID NO: 744116 - DNA, 22 bp, Artificial Sequence
  chemically synthesized
aggtgggtggatcacctgaggt

SEQ ID NO: 744117 - DNA, 22 bp, Artificial Sequence
  chemically synthesized
gtctgtaactcctgacctcagg

SEQ ID NO: 744118 - DNA, 22 bp, Artificial Sequence
  chemically synthesized
gccaggctcgtctgtaactcct

SEQ ID NO: 744119 - DNA, 22 bp, Artificial Sequence
  chemically synthesized
tgttggccaggctcgtctgtaa

SEQ ID NO: 744120 - DNA, 22 bp, Artificial Sequence
  chemically synthesized
aggtcaggagttacagacgagc

SEQ ID NO: 744121 - DNA, 22 bp, Artificial Sequence
  chemically synthesized
actgtgttggccaggctcgtct

SEQ ID NO: 744122 - DNA, 22 bp, Artificial Sequence
  chemically synthesized
cactgtgttggccaggctcgtc

SEQ ID NO: 744123 - DNA, 22 bp, Artificial Sequence
  chemically synthesized
cagacgagcctggccaacacag

SEQ ID NO: 744124 - DNA, 22 bp, Artificial Sequence
  chemically synthesized
gtagagacagggtttcactgtg

SEQ ID NO: 744125 - DNA, 22 bp, Artificial Sequence
  chemically synthesized
agtagagacagggtttcactgt

SEQ ID NO: 744126 - DNA, 22 bp, Artificial Sequence
  chemically synthesized
tagtagagacagggtttcactg

SEQ ID NO: 744127 - DNA, 22 bp, Artificial Sequence
  chemically synthesized
ttagtagagacagggtttcact

SEQ ID NO: 744128 - DNA, 22 bp, Artificial Sequence
  chemically synthesized
tttttagtagagacagggtttc

SEQ ID NO: 744129 - DNA, 22 bp, Artificial Sequence
  chemically synthesized
gccaacacagtgaaaccctgtc

SEQ ID NO: 744130 - DNA, 22 bp, Artificial Sequence
  chemically synthesized
tgtttttagtagagacagggtt

SEQ ID NO: 744131 - DNA, 22 bp, Artificial Sequence
  chemically synthesized
ctgtttttagtagagacagggt

SEQ ID NO: 744132 - DNA, 22 bp, Artificial Sequence
  chemically synthesized
tctgtttttagtagagacaggg

SEQ ID NO: 744133 - DNA, 22 bp, Artificial Sequence
  chemically synthesized
ttctgtttttagtagagacagg

SEQ ID NO: 744134 - DNA, 22 bp, Artificial Sequence
  chemically synthesized
atttttctgtttttagtagaga

SEQ ID NO: 744135 - DNA, 22 bp, Artificial Sequence
  chemically synthesized
tctctactaaaaacagaaaaat

SEQ ID NO: 744136 - DNA, 22 bp, Artificial Sequence
  chemically synthesized
tactaaaaacagaaaaattagc

SEQ ID NO: 744137 - DNA, 22 bp, Artificial Sequence
  chemically synthesized
ctaaaaacagaaaaattagccg

SEQ ID NO: 744138 - DNA, 22 bp, Artificial Sequence
  chemically synthesized
aaaacagaaaaattagccgggc

SEQ ID NO: 744139 - DNA, 22 bp, Artificial Sequence
  chemically synthesized
caggtgtgcaccaccatgcccg

SEQ ID NO: 744140 - DNA, 22 bp, Artificial Sequence
  chemically synthesized
ggattacaggtgtgcaccacca

SEQ ID NO: 744141 - DNA, 22 bp, Artificial Sequence
  chemically synthesized
gccgggcatggtggtgcacacc

SEQ ID NO: 744142 - DNA, 22 bp, Artificial Sequence
  chemically synthesized
cagagtggctgggattacaggt

SEQ ID NO: 744143 - DNA, 22 bp, Artificial Sequence
  chemically synthesized
agcctccagagtggctgggatt

SEQ ID NO: 744144 - DNA, 22 bp, Artificial Sequence
  chemically synthesized
cctcagcctccagagtggctgg

SEQ ID NO: 744145 - DNA, 22 bp, Artificial Sequence
  chemically synthesized
ctgcctcagcctccagagtggc

SEQ ID NO: 744146 - DNA, 22 bp, Artificial Sequence
  chemically synthesized
tcctgcctcagcctccagagtg

SEQ ID NO: 744147 - DNA, 22 bp, Artificial Sequence
  chemically synthesized
taatcccagccactctggaggc

SEQ ID NO: 744148 - DNA, 22 bp, Artificial Sequence
  chemically synthesized
aagcaattctcctgcctcagcc

SEQ ID NO: 744149 - DNA, 22 bp, Artificial Sequence
  chemically synthesized
tggaggctgaggcaggagaatt

SEQ ID NO: 744150 - DNA, 22 bp, Artificial Sequence
  chemically synthesized
ccgggttcaagcaattctcctg

SEQ ID NO: 744151 - DNA, 22 bp, Artificial Sequence
  chemically synthesized
gaggctgaggcaggagaattgc

SEQ ID NO: 744152 - DNA, 22 bp, Artificial Sequence
  chemically synthesized
cacctcccgggttcaagcaatt

SEQ ID NO: 744153 - DNA, 22 bp, Artificial Sequence
  chemically synthesized
aggcaggagaattgcttgaacc

SEQ ID NO: 744154 - DNA, 22 bp, Artificial Sequence
  chemically synthesized
caacctccacctcccgggttca

SEQ ID NO: 744155 - DNA, 22 bp, Artificial Sequence
  chemically synthesized
actgcaacctccacctcccggg

SEQ ID NO: 744156 - DNA, 22 bp, Artificial Sequence
  chemically synthesized
agctcactgcaacctccacctc

SEQ ID NO: 744157 - DNA, 22 bp, Artificial Sequence
  chemically synthesized
cttgaacccgggaggtggaggt

SEQ ID NO: 744158 - DNA, 22 bp, Artificial Sequence
  chemically synthesized
gaacccgggaggtggaggttgc

SEQ ID NO: 744159 - DNA, 22 bp, Artificial Sequence
  chemically synthesized
aacccgggaggtggaggttgca

SEQ ID NO: 744160 - DNA, 22 bp, Artificial Sequence
  chemically synthesized
caatctcagctcactgcaacct

SEQ ID NO: 744161 - DNA, 22 bp, Artificial Sequence
  chemically synthesized
gagtgcaatgttgcaatctcag

SEQ ID NO: 744162 - DNA, 22 bp, Artificial Sequence
  chemically synthesized
cagtgagctgagattgcaacat

SEQ ID NO: 744163 - DNA, 22 bp, Artificial Sequence
  chemically synthesized
cccaggctggagtgcaatgttg

SEQ ID NO: 744164 - DNA, 22 bp, Artificial Sequence
  chemically synthesized
ttgcccaggctggagtgcaatg

SEQ ID NO: 744165 - DNA, 22 bp, Artificial Sequence
  chemically synthesized
gttgcccaggctggagtgcaat

SEQ ID NO: 744166 - DNA, 22 bp, Artificial Sequence
  chemically synthesized
agattgcaacattgcactccag

SEQ ID NO: 744167 - DNA, 22 bp, Artificial Sequence
  chemically synthesized
ttgttgcccaggctggagtgca

SEQ ID NO: 744168 - DNA, 22 bp, Artificial Sequence
  chemically synthesized
ctcttgttgcccaggctggagt

SEQ ID NO: 744169 - DNA, 22 bp, Artificial Sequence
  chemically synthesized
gctcttgttgcccaggctggag

SEQ ID NO: 744170 - DNA, 22 bp, Artificial Sequence
  chemically synthesized
tgctcttgttgcccaggctgga

SEQ ID NO: 744171 - DNA, 22 bp, Artificial Sequence
  chemically synthesized
caacattgcactccagcctggg

SEQ ID NO: 744172 - DNA, 22 bp, Artificial Sequence
  chemically synthesized
cactccagcctgggcaacaaga

SEQ ID NO: 744173 - DNA, 22 bp, Artificial Sequence
  chemically synthesized
agacagagttttgctcttgttg

SEQ ID NO: 744174 - DNA, 22 bp, Artificial Sequence
  chemically synthesized
gagacagagttttgctcttgtt

SEQ ID NO: 744175 - DNA, 22 bp, Artificial Sequence
  chemically synthesized
tgagacagagttttgctcttgt

SEQ ID NO: 744176 - DNA, 22 bp, Artificial Sequence
  chemically synthesized
cagcctgggcaacaagagcaaa

SEQ ID NO: 744177 - DNA, 22 bp, Artificial Sequence
  chemically synthesized
ttgagacagagttttgctcttg

SEQ ID NO: 744178 - DNA, 22 bp, Artificial Sequence
  chemically synthesized
tttttgagacagagttttgctc

SEQ ID NO: 744179 - DNA, 22 bp, Artificial Sequence
  chemically synthesized
gtttttgagacagagttttgct

SEQ ID NO: 744180 - DNA, 22 bp, Artificial Sequence
  chemically synthesized
ttgtttttgagacagagttttg

SEQ ID NO: 744181 - DNA, 22 bp, Artificial Sequence
  chemically synthesized
ggcaacaagagcaaaactctgt

SEQ ID NO: 744182 - DNA, 22 bp, Artificial Sequence
  chemically synthesized
ttcttgtttttgagacagagtt

SEQ ID NO: 744183 - DNA, 22 bp, Artificial Sequence
  chemically synthesized
gttcttgtttttgagacagagt

SEQ ID NO: 744184 - DNA, 22 bp, Artificial Sequence
  chemically synthesized
tgttcttgtttttgagacagag

SEQ ID NO: 744185 - DNA, 22 bp, Artificial Sequence
  chemically synthesized
ttgttcttgtttttgagacaga

SEQ ID NO: 744186 - DNA, 22 bp, Artificial Sequence
  chemically synthesized
tttgttcttgtttttgagacag

SEQ ID NO: 744187 - DNA, 22 bp, Artificial Sequence
  chemically synthesized
gagttttttgttcttgtttttg

SEQ ID NO: 744188 - DNA, 22 bp, Artificial Sequence
  chemically synthesized
tgtctcaaaaacaagaacaaaa

SEQ ID NO: 744189 - DNA, 22 bp, Artificial Sequence
  chemically synthesized
tctcaaaaacaagaacaaaaaa

SEQ ID NO: 744190 - DNA, 22 bp, Artificial Sequence
  chemically synthesized
aaaaacaagaacaaaaaactct

SEQ ID NO: 744191 - DNA, 22 bp, Artificial Sequence
  chemically synthesized
taaagagaaactagagtttttt

SEQ ID NO: 744192 - DNA, 22 bp, Artificial Sequence
  chemically synthesized
gatattgtaaagagaaactaga

SEQ ID NO: 744193 - DNA, 22 bp, Artificial Sequence
  chemically synthesized
cgatattgtaaagagaaactag

SEQ ID NO: 744194 - DNA, 22 bp, Artificial Sequence
  chemically synthesized
tcgatattgtaaagagaaacta

SEQ ID NO: 744195 - DNA, 22 bp, Artificial Sequence
  chemically synthesized
ttcgatattgtaaagagaaact

SEQ ID NO: 744196 - DNA, 22 bp, Artificial Sequence
  chemically synthesized
tttcgatattgtaaagagaaac

SEQ ID NO: 744197 - DNA, 22 bp, Artificial Sequence
  chemically synthesized
tttttcgatattgtaaagagaa

SEQ ID NO: 744198 - DNA, 22 bp, Artificial Sequence
  chemically synthesized
tagtttctctttacaatatcga

SEQ ID NO: 744199 - DNA, 22 bp, Artificial Sequence
  chemically synthesized
gtttctctttacaatatcgaaa

SEQ ID NO: 744200 - DNA, 22 bp, Artificial Sequence
  chemically synthesized
ggtatatattctttttcgatat

SEQ ID NO: 744201 - DNA, 22 bp, Artificial Sequence
  chemically synthesized
gggtatatattctttttcgata

SEQ ID NO: 744202 - DNA, 22 bp, Artificial Sequence
  chemically synthesized
ctctttacaatatcgaaaaaga

SEQ ID NO: 744203 - DNA, 22 bp, Artificial Sequence
  chemically synthesized
tctttacaatatcgaaaaagaa

SEQ ID NO: 744204 - DNA, 22 bp, Artificial Sequence
  chemically synthesized
tttacaatatcgaaaaagaata

SEQ ID NO: 744205 - DNA, 22 bp, Artificial Sequence
  chemically synthesized
tgtttgggtatatattcttttt

SEQ ID NO: 744206 - DNA, 22 bp, Artificial Sequence
  chemically synthesized
atgtttgggtatatattctttt

SEQ ID NO: 744207 - DNA, 22 bp, Artificial Sequence
  chemically synthesized
tacaatatcgaaaaagaatata

SEQ ID NO: 744208 - DNA, 22 bp, Artificial Sequence
  chemically synthesized
tatgtttgggtatatattcttt

SEQ ID NO: 744209 - DNA, 22 bp, Artificial Sequence
  chemically synthesized
acaatatcgaaaaagaatatat

SEQ ID NO: 744210 - DNA, 22 bp, Artificial Sequence
  chemically synthesized
ttatgtttgggtatatattctt

SEQ ID NO: 744211 - DNA, 22 bp, Artificial Sequence
  chemically synthesized
caatatcgaaaaagaatatata

SEQ ID NO: 744212 - DNA, 22 bp, Artificial Sequence
  chemically synthesized
tccttttatgtttgggtatata

SEQ ID NO: 744213 - DNA, 22 bp, Artificial Sequence
  chemically synthesized
aaaagaaaaagttatcctttta

SEQ ID NO: 744214 - DNA, 22 bp, Artificial Sequence
  chemically synthesized
tgatcagtgcaaagagaaaatg

SEQ ID NO: 744215 - DNA, 22 bp, Artificial Sequence
  chemically synthesized
tttctttttaacattttctctt

SEQ ID NO: 744216 - DNA, 22 bp, Artificial Sequence
  chemically synthesized
ttctttttaacattttctcttt

SEQ ID NO: 744217 - DNA, 22 bp, Artificial Sequence
  chemically synthesized
tctttttaacattttctctttg

SEQ ID NO: 744218 - DNA, 22 bp, Artificial Sequence
  chemically synthesized
ctttttaacattttctctttgc

SEQ ID NO: 744219 - DNA, 22 bp, Artificial Sequence
  chemically synthesized
tttttaacattttctctttgca

SEQ ID NO: 744220 - DNA, 22 bp, Artificial Sequence
  chemically synthesized
tttaacattttctctttgcact

SEQ ID NO: 744221 - DNA, 22 bp, Artificial Sequence
  chemically synthesized
ttaacattttctctttgcactg

SEQ ID NO: 744222 - DNA, 22 bp, Artificial Sequence
  chemically synthesized
taacattttctctttgcactga

SEQ ID NO: 744223 - DNA, 22 bp, Artificial Sequence
  chemically synthesized
aacattttctctttgcactgat

SEQ ID NO: 744224 - DNA, 22 bp, Artificial Sequence
  chemically synthesized
acattttctctttgcactgatc

SEQ ID NO: 744225 - DNA, 22 bp, Artificial Sequence
  chemically synthesized
aaagatgaagaattatgatcag

SEQ ID NO: 744226 - DNA, 22 bp, Artificial Sequence
  chemically synthesized
tctctttgcactgatcataatt

SEQ ID NO: 744227 - DNA, 22 bp, Artificial Sequence
  chemically synthesized
ctctttgcactgatcataattc

SEQ ID NO: 744228 - DNA, 22 bp, Artificial Sequence
  chemically synthesized
tctttgcactgatcataattct

SEQ ID NO: 744229 - DNA, 22 bp, Artificial Sequence
  chemically synthesized
tttgcactgatcataattcttc

SEQ ID NO: 744230 - DNA, 22 bp, Artificial Sequence
  chemically synthesized
tgcactgatcataattcttcat

SEQ ID NO: 744231 - DNA, 22 bp, Artificial Sequence
  chemically synthesized
gcactgatcataattcttcatc

SEQ ID NO: 744232 - DNA, 22 bp, Artificial Sequence
  chemically synthesized
cactgatcataattcttcatct

SEQ ID NO: 744233 - DNA, 22 bp, Artificial Sequence
  chemically synthesized
atcataattcttcatcttttag

SEQ ID NO: 744234 - DNA, 22 bp, Artificial Sequence
  chemically synthesized
atagaaagccatgtcctaaaag

SEQ ID NO: 744235 - DNA, 22 bp, Artificial Sequence
  chemically synthesized
catagaaagccatgtcctaaaa

SEQ ID NO: 744236 - DNA, 22 bp, Artificial Sequence
  chemically synthesized
ttcatcttttaggacatggctt

SEQ ID NO: 744237 - DNA, 22 bp, Artificial Sequence
  chemically synthesized
caagcttcatagaaagccatgt

SEQ ID NO: 744238 - DNA, 22 bp, Artificial Sequence
  chemically synthesized
catcttttaggacatggctttc

SEQ ID NO: 744239 - DNA, 22 bp, Artificial Sequence
  chemically synthesized
atcttttaggacatggctttct

SEQ ID NO: 744240 - DNA, 22 bp, Artificial Sequence
  chemically synthesized
gagttacaagcttcatagaaag

SEQ ID NO: 744241 - DNA, 22 bp, Artificial Sequence
  chemically synthesized
ttaggacatggctttctatgaa

SEQ ID NO: 744242 - DNA, 22 bp, Artificial Sequence
  chemically synthesized
taggacatggctttctatgaag

SEQ ID NO: 744243 - DNA, 22 bp, Artificial Sequence
  chemically synthesized
aggacatggctttctatgaagc

SEQ ID NO: 744244 - DNA, 22 bp, Artificial Sequence
  chemically synthesized
ggacatggctttctatgaagct

SEQ ID NO: 744245 - DNA, 22 bp, Artificial Sequence
  chemically synthesized
taagaacattggagttacaagc

SEQ ID NO: 744246 - DNA, 22 bp, Artificial Sequence
  chemically synthesized
ttataagaacattggagttaca

SEQ ID NO: 744247 - DNA, 22 bp, Artificial Sequence
  chemically synthesized
tctatgaagcttgtaactccaa

SEQ ID NO: 744248 - DNA, 22 bp, Artificial Sequence
  chemically synthesized
attataagaacattggagttac

SEQ ID NO: 744249 - DNA, 22 bp, Artificial Sequence
  chemically synthesized
ctatgaagcttgtaactccaat

SEQ ID NO: 744250 - DNA, 22 bp, Artificial Sequence
  chemically synthesized
tattataagaacattggagtta

SEQ ID NO: 744251 - DNA, 22 bp, Artificial Sequence
  chemically synthesized
tatgaagcttgtaactccaatg

SEQ ID NO: 744252 - DNA, 22 bp, Artificial Sequence
  chemically synthesized
ttattataagaacattggagtt

SEQ ID NO: 744253 - DNA, 22 bp, Artificial Sequence
  chemically synthesized
tgaagcttgtaactccaatgtt

SEQ ID NO: 744254 - DNA, 22 bp, Artificial Sequence
  chemically synthesized
ggcttttattataagaacattg

SEQ ID NO: 744255 - DNA, 22 bp, Artificial Sequence
  chemically synthesized
gtaactccaatgttcttataat

SEQ ID NO: 744256 - DNA, 22 bp, Artificial Sequence
  chemically synthesized
taactccaatgttcttataata

SEQ ID NO: 744257 - DNA, 22 bp, Artificial Sequence
  chemically synthesized
caatgttcttataataaaagcc

SEQ ID NO: 744258 - DNA, 22 bp, Artificial Sequence
  chemically synthesized
ttataataaaagccgaattata

SEQ ID NO: 744259 - DNA, 22 bp, Artificial Sequence
  chemically synthesized
atatggccaagatataattcgg

SEQ ID NO: 744260 - DNA, 22 bp, Artificial Sequence
  chemically synthesized
ataataaaagccgaattatatc

SEQ ID NO: 744261 - DNA, 22 bp, Artificial Sequence
  chemically synthesized
taataaaagccgaattatatct

SEQ ID NO: 744262 - DNA, 22 bp, Artificial Sequence
  chemically synthesized
ttaatatggccaagatataatt

SEQ ID NO: 744263 - DNA, 22 bp, Artificial Sequence
  chemically synthesized
tatcttggccatattaacagtg

SEQ ID NO: 744264 - DNA, 22 bp, Artificial Sequence
  chemically synthesized
ggccatattaacagtgtctatc

SEQ ID NO: 744265 - DNA, 22 bp, Artificial Sequence
  chemically synthesized
gccatattaacagtgtctatct

SEQ ID NO: 744266 - DNA, 22 bp, Artificial Sequence
  chemically synthesized
acagtgtctatcttctttcttt

SEQ ID NO: 744267 - DNA, 22 bp, Artificial Sequence
  chemically synthesized
tcttctttcttttctgggtgct

SEQ ID NO: 744268 - DNA, 22 bp, Artificial Sequence
  chemically synthesized
ctttcttttctgggtgctcaca

SEQ ID NO: 744269 - DNA, 22 bp, Artificial Sequence
  chemically synthesized
tttcttttctgggtgctcacat

SEQ ID NO: 744270 - DNA, 22 bp, Artificial Sequence
  chemically synthesized
tacatgaaggaaatgtgagcac

SEQ ID NO: 744271 - DNA, 22 bp, Artificial Sequence
  chemically synthesized
atacatgaaggaaatgtgagca

SEQ ID NO: 744272 - DNA, 22 bp, Artificial Sequence
  chemically synthesized
tcttttctgggtgctcacattt

SEQ ID NO: 744273 - DNA, 22 bp, Artificial Sequence
  chemically synthesized
tatacatgaaggaaatgtgagc

SEQ ID NO: 744274 - DNA, 22 bp, Artificial Sequence
  chemically synthesized
cttttctgggtgctcacatttc

SEQ ID NO: 744275 - DNA, 22 bp, Artificial Sequence
  chemically synthesized
ttttctgggtgctcacatttcc

SEQ ID NO: 744276 - DNA, 22 bp, Artificial Sequence
  chemically synthesized
ttctgggtgctcacatttcctt

SEQ ID NO: 744277 - DNA, 22 bp, Artificial Sequence
  chemically synthesized
tctgggtgctcacatttccttc

SEQ ID NO: 744278 - DNA, 22 bp, Artificial Sequence
  chemically synthesized
ctgggtgctcacatttccttca

SEQ ID NO: 744279 - DNA, 22 bp, Artificial Sequence
  chemically synthesized
tgggtgctcacatttccttcat

SEQ ID NO: 744280 - DNA, 22 bp, Artificial Sequence
  chemically synthesized
caaattttatacatgaaggaaa

SEQ ID NO: 744281 - DNA, 22 bp, Artificial Sequence
  chemically synthesized
ccaaattttatacatgaaggaa

SEQ ID NO: 744282 - DNA, 22 bp, Artificial Sequence
  chemically synthesized
ggtgctcacatttccttcatgt

SEQ ID NO: 744283 - DNA, 22 bp, Artificial Sequence
  chemically synthesized
atttccaaattttatacatgaa

SEQ ID NO: 744284 - DNA, 22 bp, Artificial Sequence
  chemically synthesized
ctcatttccaaattttatacat

SEQ ID NO: 744285 - DNA, 22 bp, Artificial Sequence
  chemically synthesized
acatttccttcatgtataaaat

SEQ ID NO: 744286 - DNA, 22 bp, Artificial Sequence
  chemically synthesized
ttcctcatttccaaattttata

SEQ ID NO: 744287 - DNA, 22 bp, Artificial Sequence
  chemically synthesized
ccttcatgtataaaatttggaa

SEQ ID NO: 744288 - DNA, 22 bp, Artificial Sequence
  chemically synthesized
cctgttcctcatttccaaattt

SEQ ID NO: 744289 - DNA, 22 bp, Artificial Sequence
  chemically synthesized
cttcatgtataaaatttggaaa

SEQ ID NO: 744290 - DNA, 22 bp, Artificial Sequence
  chemically synthesized
ccctgttcctcatttccaaatt

SEQ ID NO: 744291 - DNA, 22 bp, Artificial Sequence
  chemically synthesized
catgtataaaatttggaaatga

SEQ ID NO: 744292 - DNA, 22 bp, Artificial Sequence
  chemically synthesized
atgtataaaatttggaaatgag

SEQ ID NO: 744293 - DNA, 22 bp, Artificial Sequence
  chemically synthesized
tggtcaatacttccctgttcct

SEQ ID NO: 744294 - DNA, 22 bp, Artificial Sequence
  chemically synthesized
gtggtcaatacttccctgttcc

SEQ ID NO: 744295 - DNA, 22 bp, Artificial Sequence
  chemically synthesized
tgtggtcaatacttccctgttc

SEQ ID NO: 744296 - DNA, 22 bp, Artificial Sequence
  chemically synthesized
ggaaatgaggaacagggaagta

SEQ ID NO: 744297 - DNA, 22 bp, Artificial Sequence
  chemically synthesized
ctttgtggtcaatacttccctg

SEQ ID NO: 744298 - DNA, 22 bp, Artificial Sequence
  chemically synthesized
gaaatgaggaacagggaagtat

SEQ ID NO: 744299 - DNA, 22 bp, Artificial Sequence
  chemically synthesized
cctttgtggtcaatacttccct

SEQ ID NO: 744300 - DNA, 22 bp, Artificial Sequence
  chemically synthesized
tcctttgtggtcaatacttccc

SEQ ID NO: 744301 - DNA, 22 bp, Artificial Sequence
  chemically synthesized
ttcctttgtggtcaatacttcc

SEQ ID NO: 744302 - DNA, 22 bp, Artificial Sequence
  chemically synthesized
aaaataaaaacttttcctttgt

SEQ ID NO: 744303 - DNA, 22 bp, Artificial Sequence
  chemically synthesized
aaaaataaaaacttttcctttg

SEQ ID NO: 744304 - DNA, 22 bp, Artificial Sequence
  chemically synthesized
ttaaaaataaaaacttttcctt

SEQ ID NO: 744305 - DNA, 22 bp, Artificial Sequence
  chemically synthesized
ttcttaaaaataaaaacttttc

SEQ ID NO: 744306 - DNA, 22 bp, Artificial Sequence
  chemically synthesized
gttcttaaaaataaaaactttt

SEQ ID NO: 744307 - DNA, 22 bp, Artificial Sequence
  chemically synthesized
accacaaaggaaaagtttttat

SEQ ID NO: 744308 - DNA, 22 bp, Artificial Sequence
  chemically synthesized
aacttgttcttaaaaataaaaa

SEQ ID NO: 744309 - DNA, 22 bp, Artificial Sequence
  chemically synthesized
tgttcaacttgttcttaaaaat

SEQ ID NO: 744310 - DNA, 22 bp, Artificial Sequence
  chemically synthesized
ctatgttcaacttgttcttaaa

SEQ ID NO: 744311 - DNA, 22 bp, Artificial Sequence
  chemically synthesized
ctgctatgttcaacttgttctt

SEQ ID NO: 744312 - DNA, 22 bp, Artificial Sequence
  chemically synthesized
ctcctgctatgttcaacttgtt

SEQ ID NO: 744313 - DNA, 22 bp, Artificial Sequence
  chemically synthesized
ttatttttaagaacaagttgaa

SEQ ID NO: 744314 - DNA, 22 bp, Artificial Sequence
  chemically synthesized
tatttttaagaacaagttgaac

SEQ ID NO: 744315 - DNA, 22 bp, Artificial Sequence
  chemically synthesized
atttttaagaacaagttgaaca

SEQ ID NO: 744316 - DNA, 22 bp, Artificial Sequence
  chemically synthesized
tttttaagaacaagttgaacat

SEQ ID NO: 744317 - DNA, 22 bp, Artificial Sequence
  chemically synthesized
ttaagaacaagttgaacatagc

SEQ ID NO: 744318 - DNA, 22 bp, Artificial Sequence
  chemically synthesized
taagaacaagttgaacatagca

SEQ ID NO: 744319 - DNA, 22 bp, Artificial Sequence
  chemically synthesized
aagaacaagttgaacatagcag

SEQ ID NO: 744320 - DNA, 22 bp, Artificial Sequence
  chemically synthesized
agaacaagttgaacatagcagg

SEQ ID NO: 744321 - DNA, 22 bp, Artificial Sequence
  chemically synthesized
caaaatatcaattgctcctgct

SEQ ID NO: 744322 - DNA, 22 bp, Artificial Sequence
  chemically synthesized
gcaaaatatcaattgctcctgc

SEQ ID NO: 744323 - DNA, 22 bp, Artificial Sequence
  chemically synthesized
aacatagcaggagcaattgata

SEQ ID NO: 744324 - DNA, 22 bp, Artificial Sequence
  chemically synthesized
ccgggtgtatggtttgcaaaat

SEQ ID NO: 744325 - DNA, 22 bp, Artificial Sequence
  chemically synthesized
accgggtgtatggtttgcaaaa

SEQ ID NO: 744326 - DNA, 22 bp, Artificial Sequence
  chemically synthesized
accccttaccgggtgtatggtt

SEQ ID NO: 744327 - DNA, 22 bp, Artificial Sequence
  chemically synthesized
atattttgcaaaccatacaccc

SEQ ID NO: 744328 - DNA, 22 bp, Artificial Sequence
  chemically synthesized
aatactgaccccttaccgggtg

SEQ ID NO: 744329 - DNA, 22 bp, Artificial Sequence
  chemically synthesized
tgcaaaccatacacccggtaag

SEQ ID NO: 744330 - DNA, 22 bp, Artificial Sequence
  chemically synthesized
gaatactgaccccttaccgggt

SEQ ID NO: 744331 - DNA, 22 bp, Artificial Sequence
  chemically synthesized
gcaaaccatacacccggtaagg

SEQ ID NO: 744332 - DNA, 22 bp, Artificial Sequence
  chemically synthesized
tgaatactgaccccttaccggg

SEQ ID NO: 744333 - DNA, 22 bp, Artificial Sequence
  chemically synthesized
caaaccatacacccggtaaggg

SEQ ID NO: 744334 - DNA, 22 bp, Artificial Sequence
  chemically synthesized
tgtattttgaatactgacccct

SEQ ID NO: 744335 - DNA, 22 bp, Artificial Sequence
  chemically synthesized
gtgtattttgaatactgacccc

SEQ ID NO: 744336 - DNA, 22 bp, Artificial Sequence
  chemically synthesized
cttgtgtattttgaatactgac

SEQ ID NO: 744337 - DNA, 22 bp, Artificial Sequence
  chemically synthesized
taggagttccttgtgtattttg

SEQ ID NO: 744338 - DNA, 22 bp, Artificial Sequence
  chemically synthesized
agttgtaggagttccttgtgta

SEQ ID NO: 744339 - DNA, 22 bp, Artificial Sequence
  chemically synthesized
ttgagttgtaggagttccttgt

SEQ ID NO: 744340 - DNA, 22 bp, Artificial Sequence
  chemically synthesized
ctattgagttgtaggagttcct

SEQ ID NO: 744341 - DNA, 22 bp, Artificial Sequence
  chemically synthesized
gctattgagttgtaggagttcc

SEQ ID NO: 744342 - DNA, 22 bp, Artificial Sequence
  chemically synthesized
aaaatacacaaggaactcctac

SEQ ID NO: 744343 - DNA, 22 bp, Artificial Sequence
  chemically synthesized
ttgctattgagttgtaggagtt

SEQ ID NO: 744344 - DNA, 22 bp, Artificial Sequence
  chemically synthesized
cttgctattgagttgtaggagt

SEQ ID NO: 744345 - DNA, 22 bp, Artificial Sequence
  chemically synthesized
tcttgctattgagttgtaggag

SEQ ID NO: 744346 - DNA, 22 bp, Artificial Sequence
  chemically synthesized
ttttcttgctattgagttgtag

SEQ ID NO: 744347 - DNA, 22 bp, Artificial Sequence
  chemically synthesized
gttttcttgctattgagttgta

SEQ ID NO: 744348 - DNA, 22 bp, Artificial Sequence
  chemically synthesized
ctacaactcaatagcaagaaaa

SEQ ID NO: 744349 - DNA, 22 bp, Artificial Sequence
  chemically synthesized
gtcaggtgatttgttttcttgc

SEQ ID NO: 744350 - DNA, 22 bp, Artificial Sequence
  chemically synthesized
agtcaggtgatttgttttcttg

SEQ ID NO: 744351 - DNA, 22 bp, Artificial Sequence
  chemically synthesized
caactcaatagcaagaaaacaa

SEQ ID NO: 744352 - DNA, 22 bp, Artificial Sequence
  chemically synthesized
tagtcaggtgatttgttttctt

SEQ ID NO: 744353 - DNA, 22 bp, Artificial Sequence
  chemically synthesized
ttagtcaggtgatttgttttct

SEQ ID NO: 744354 - DNA, 22 bp, Artificial Sequence
  chemically synthesized
tttagtcaggtgatttgttttc

SEQ ID NO: 744355 - DNA, 22 bp, Artificial Sequence
  chemically synthesized
aatagcaagaaaacaaatcacc

SEQ ID NO: 744356 - DNA, 22 bp, Artificial Sequence
  chemically synthesized
attttttagtcaggtgatttgt

SEQ ID NO: 744357 - DNA, 22 bp, Artificial Sequence
  chemically synthesized
ctcattttttagtcaggtgatt

SEQ ID NO: 744358 - DNA, 22 bp, Artificial Sequence
  chemically synthesized
gctcattttttagtcaggtgat

SEQ ID NO: 744359 - DNA, 22 bp, Artificial Sequence
  chemically synthesized
cttgctcattttttagtcaggt

SEQ ID NO: 744360 - DNA, 22 bp, Artificial Sequence
  chemically synthesized
aggttacttgctcattttttag

SEQ ID NO: 744361 - DNA, 22 bp, Artificial Sequence
  chemically synthesized
ttcaggttacttgctcattttt

SEQ ID NO: 744362 - DNA, 22 bp, Artificial Sequence
  chemically synthesized
actaaaaaatgagcaagtaacc

SEQ ID NO: 744363 - DNA, 22 bp, Artificial Sequence
  chemically synthesized
aaaaatgagcaagtaacctgaa

SEQ ID NO: 744364 - DNA, 22 bp, Artificial Sequence
  chemically synthesized
gagaaatgtctattcaggttac

SEQ ID NO: 744365 - DNA, 22 bp, Artificial Sequence
  chemically synthesized
ggagaaatgtctattcaggtta

SEQ ID NO: 744366 - DNA, 22 bp, Artificial Sequence
  chemically synthesized
tggagaaatgtctattcaggtt

SEQ ID NO: 744367 - DNA, 22 bp, Artificial Sequence
  chemically synthesized
tttggagaaatgtctattcagg

SEQ ID NO: 744368 - DNA, 22 bp, Artificial Sequence
  chemically synthesized
ctttggagaaatgtctattcag

SEQ ID NO: 744369 - DNA, 22 bp, Artificial Sequence
  chemically synthesized
tatcttctttggagaaatgtct

SEQ ID NO: 744370 - DNA, 22 bp, Artificial Sequence
  chemically synthesized
tatatcttctttggagaaatgt

SEQ ID NO: 744371 - DNA, 22 bp, Artificial Sequence
  chemically synthesized
ctatatcttctttggagaaatg

SEQ ID NO: 744372 - DNA, 22 bp, Artificial Sequence
  chemically synthesized
atttctatatcttctttggaga

SEQ ID NO: 744373 - DNA, 22 bp, Artificial Sequence
  chemically synthesized
aatagacatttctccaaagaag

SEQ ID NO: 744374 - DNA, 22 bp, Artificial Sequence
  chemically synthesized
aatactcatttctatatcttct

SEQ ID NO: 744375 - DNA, 22 bp, Artificial Sequence
  chemically synthesized
ctccaaagaagatatagaaatg

SEQ ID NO: 744376 - DNA, 22 bp, Artificial Sequence
  chemically synthesized
tccaaagaagatatagaaatga

SEQ ID NO: 744377 - DNA, 22 bp, Artificial Sequence
  chemically synthesized
taaatctgaatactcatttcta

SEQ ID NO: 744378 - DNA, 22 bp, Artificial Sequence
  chemically synthesized
caaagaagatatagaaatgagt

SEQ ID NO: 744379 - DNA, 22 bp, Artificial Sequence
  chemically synthesized
tctataaatctgaatactcatt

SEQ ID NO: 744380 - DNA, 22 bp, Artificial Sequence
  chemically synthesized
ctgtctataaatctgaatactc

SEQ ID NO: 744381 - DNA, 22 bp, Artificial Sequence
  chemically synthesized
cctgtctataaatctgaatact

SEQ ID NO: 744382 - DNA, 22 bp, Artificial Sequence
  chemically synthesized
tttcctgtctataaatctgaat

SEQ ID NO: 744383 - DNA, 22 bp, Artificial Sequence
  chemically synthesized
tatttcctgtctataaatctga

SEQ ID NO: 744384 - DNA, 22 bp, Artificial Sequence
  chemically synthesized
gaaaccaccattctatttcctg

SEQ ID NO: 744385 - DNA, 22 bp, Artificial Sequence
  chemically synthesized
agatttatagacaggaaataga

SEQ ID NO: 744386 - DNA, 22 bp, Artificial Sequence
  chemically synthesized
atagacaggaaatagaatggtg

SEQ ID NO: 744387 - DNA, 22 bp, Artificial Sequence
  chemically synthesized
tagacaggaaatagaatggtgg

SEQ ID NO: 744388 - DNA, 22 bp, Artificial Sequence
  chemically synthesized
cccccagcccctggaaaccacc

SEQ ID NO: 744389 - DNA, 22 bp, Artificial Sequence
  chemically synthesized
ctgcccccagcccctggaaacc

SEQ ID NO: 744390 - DNA, 22 bp, Artificial Sequence
  chemically synthesized
cctgcccccagcccctggaaac

SEQ ID NO: 744391 - DNA, 22 bp, Artificial Sequence
  chemically synthesized
cttcctgcccccagcccctgga

SEQ ID NO: 744392 - DNA, 22 bp, Artificial Sequence
  chemically synthesized
cccattgcttcctgcccccagc

SEQ ID NO: 744393 - DNA, 22 bp, Artificial Sequence
  chemically synthesized
ccaggggctgggggcaggaagc

SEQ ID NO: 744394 - DNA, 22 bp, Artificial Sequence
  chemically synthesized
caggggctgggggcaggaagca

SEQ ID NO: 744395 - DNA, 22 bp, Artificial Sequence
  chemically synthesized
ggggcaggaagcaatggggaat

SEQ ID NO: 744396 - DNA, 22 bp, Artificial Sequence
  chemically synthesized
aaaaggaacaaaaaagaaaaaa

SEQ ID NO: 744397 - DNA, 22 bp, Artificial Sequence
  chemically synthesized
ctgtggttttttcttttttgtt

SEQ ID NO: 744398 - DNA, 22 bp, Artificial Sequence
  chemically synthesized
catctcaaaaggaacaaaaaag

SEQ ID NO: 744399 - DNA, 22 bp, Artificial Sequence
  chemically synthesized
tggttttttcttttttgttcct

SEQ ID NO: 744400 - DNA, 22 bp, Artificial Sequence
  chemically synthesized
tttcttttttgttccttttgag

SEQ ID NO: 744401 - DNA, 22 bp, Artificial Sequence
  chemically synthesized
ttcttttttgttccttttgaga

SEQ ID NO: 744402 - DNA, 22 bp, Artificial Sequence
  chemically synthesized
tcttttttgttccttttgagat

SEQ ID NO: 744403 - DNA, 22 bp, Artificial Sequence
  chemically synthesized
cttttttgttccttttgagatg

SEQ ID NO: 744404 - DNA, 22 bp, Artificial Sequence
  chemically synthesized
ttttttgttccttttgagatgg

SEQ ID NO: 744405 - DNA, 22 bp, Artificial Sequence
  chemically synthesized
ttttgttccttttgagatggag

SEQ ID NO: 744406 - DNA, 22 bp, Artificial Sequence
  chemically synthesized
tttgttccttttgagatggagt

SEQ ID NO: 744407 - DNA, 22 bp, Artificial Sequence
  chemically synthesized
ttgttccttttgagatggagtc

SEQ ID NO: 744408 - DNA, 22 bp, Artificial Sequence
  chemically synthesized
tgttccttttgagatggagtct

SEQ ID NO: 744409 - DNA, 22 bp, Artificial Sequence
  chemically synthesized
ggcaacagagcgagactccatc

SEQ ID NO: 744410 - DNA, 22 bp, Artificial Sequence
  chemically synthesized
gttccttttgagatggagtctc

SEQ ID NO: 744411 - DNA, 22 bp, Artificial Sequence
  chemically synthesized
ttccttttgagatggagtctcg

SEQ ID NO: 744412 - DNA, 22 bp, Artificial Sequence
  chemically synthesized
cttttgagatggagtctcgctc

SEQ ID NO: 744413 - DNA, 22 bp, Artificial Sequence
  chemically synthesized
cagcctgggcaacagagcgaga

SEQ ID NO: 744414 - DNA, 22 bp, Artificial Sequence
  chemically synthesized
ttgagatggagtctcgctctgt

SEQ ID NO: 744415 - DNA, 22 bp, Artificial Sequence
  chemically synthesized
tgagatggagtctcgctctgtt

SEQ ID NO: 744416 - DNA, 22 bp, Artificial Sequence
  chemically synthesized
gagatggagtctcgctctgttg

SEQ ID NO: 744417 - DNA, 22 bp, Artificial Sequence
  chemically synthesized
agatggagtctcgctctgttgc

SEQ ID NO: 744418 - DNA, 22 bp, Artificial Sequence
  chemically synthesized
cactccagcctgggcaacagag

SEQ ID NO: 744419 - DNA, 22 bp, Artificial Sequence
  chemically synthesized
gctctgttgcccaggctggagt

SEQ ID NO: 744420 - DNA, 22 bp, Artificial Sequence
  chemically synthesized
tgttgcccaggctggagtgcag

SEQ ID NO: 744421 - DNA, 22 bp, Artificial Sequence
  chemically synthesized
ttgcccaggctggagtgcagtg

SEQ ID NO: 744422 - DNA, 22 bp, Artificial Sequence
  chemically synthesized
cccaggctggagtgcagtggtg

SEQ ID NO: 744423 - DNA, 22 bp, Artificial Sequence
  chemically synthesized
agatcgagatcacaccactgca

SEQ ID NO: 744424 - DNA, 22 bp, Artificial Sequence
  chemically synthesized
gagtgcagtggtgtgatctcga

SEQ ID NO: 744425 - DNA, 22 bp, Artificial Sequence
  chemically synthesized
cagtgagctgagatcgagatca

SEQ ID NO: 744426 - DNA, 22 bp, Artificial Sequence
  chemically synthesized
ggaggcggaggttgcagtgagc

SEQ ID NO: 744427 - DNA, 22 bp, Artificial Sequence
  chemically synthesized
gatctcagctcactgcaacctc

SEQ ID NO: 744428 - DNA, 22 bp, Artificial Sequence
  chemically synthesized
aacctgggaggcggaggttgca

SEQ ID NO: 744429 - DNA, 22 bp, Artificial Sequence
  chemically synthesized
gaacctgggaggcggaggttgc

SEQ ID NO: 744430 - DNA, 22 bp, Artificial Sequence
  chemically synthesized
cttgaacctgggaggcggaggt

SEQ ID NO: 744431 - DNA, 22 bp, Artificial Sequence
  chemically synthesized
agctcactgcaacctccgcctc

SEQ ID NO: 744432 - DNA, 22 bp, Artificial Sequence
  chemically synthesized
actgcaacctccgcctcccagg

SEQ ID NO: 744433 - DNA, 22 bp, Artificial Sequence
  chemically synthesized
caacctccgcctcccaggttca

SEQ ID NO: 744434 - DNA, 22 bp, Artificial Sequence
  chemically synthesized
aggcagcagaattgcttgaacc

SEQ ID NO: 744435 - DNA, 22 bp, Artificial Sequence
  chemically synthesized
cgcctcccaggttcaagcaatt

SEQ ID NO: 744436 - DNA, 22 bp, Artificial Sequence
  chemically synthesized
ggaggctgaggcagcagaattg

SEQ ID NO: 744437 - DNA, 22 bp, Artificial Sequence
  chemically synthesized
ccaggttcaagcaattctgctg

SEQ ID NO: 744438 - DNA, 22 bp, Artificial Sequence
  chemically synthesized
gggaggctgaggcagcagaatt

SEQ ID NO: 744439 - DNA, 22 bp, Artificial Sequence
  chemically synthesized
cttgggaggctgaggcagcaga

SEQ ID NO: 744440 - DNA, 22 bp, Artificial Sequence
  chemically synthesized
aagcaattctgctgcctcagcc

SEQ ID NO: 744441 - DNA, 22 bp, Artificial Sequence
  chemically synthesized
taatcccagctacttgggaggc

SEQ ID NO: 744442 - DNA, 22 bp, Artificial Sequence
  chemically synthesized
tgctgcctcagcctcccaagta

SEQ ID NO: 744443 - DNA, 22 bp, Artificial Sequence
  chemically synthesized
ctgcctcagcctcccaagtagc

SEQ ID NO: 744444 - DNA, 22 bp, Artificial Sequence
  chemically synthesized
cctcagcctcccaagtagctgg

SEQ ID NO: 744445 - DNA, 22 bp, Artificial Sequence
  chemically synthesized
agcctcccaagtagctgggatt

SEQ ID NO: 744446 - DNA, 22 bp, Artificial Sequence
  chemically synthesized
ccaagtagctgggattacaggt

SEQ ID NO: 744447 - DNA, 22 bp, Artificial Sequence
  chemically synthesized
ggcgtggtggtgcacacctgta

SEQ ID NO: 744448 - DNA, 22 bp, Artificial Sequence
  chemically synthesized
gctgggcgtggtggtgcacacc

SEQ ID NO: 744449 - DNA, 22 bp, Artificial Sequence
  chemically synthesized
ggattacaggtgtgcaccacca

SEQ ID NO: 744450 - DNA, 22 bp, Artificial Sequence
  chemically synthesized
caggtgtgcaccaccacgccca

SEQ ID NO: 744451 - DNA, 22 bp, Artificial Sequence
  chemically synthesized
aaaatacaaaaattagctgggc

SEQ ID NO: 744452 - DNA, 22 bp, Artificial Sequence
  chemically synthesized
ctaaaaatacaaaaattagctg

SEQ ID NO: 744453 - DNA, 22 bp, Artificial Sequence
  chemically synthesized
tactaaaaatacaaaaattagc

SEQ ID NO: 744454 - DNA, 22 bp, Artificial Sequence
  chemically synthesized
atttttgtatttttagtagaga

SEQ ID NO: 744455 - DNA, 22 bp, Artificial Sequence
  chemically synthesized
ttgtatttttagtagagatggg

SEQ ID NO: 744456 - DNA, 22 bp, Artificial Sequence
  chemically synthesized
tgtatttttagtagagatgggg

SEQ ID NO: 744457 - DNA, 22 bp, Artificial Sequence
  chemically synthesized
gtatttttagtagagatggggt

SEQ ID NO: 744458 - DNA, 22 bp, Artificial Sequence
  chemically synthesized
tatttttagtagagatggggtt

SEQ ID NO: 744459 - DNA, 22 bp, Artificial Sequence
  chemically synthesized
gccaacatggtaaaaccccatc

SEQ ID NO: 744460 - DNA, 22 bp, Artificial Sequence
  chemically synthesized
ttagtagagatggggttttacc

SEQ ID NO: 744461 - DNA, 22 bp, Artificial Sequence
  chemically synthesized
tagtagagatggggttttacca

SEQ ID NO: 744462 - DNA, 22 bp, Artificial Sequence
  chemically synthesized
agtagagatggggttttaccat

SEQ ID NO: 744463 - DNA, 22 bp, Artificial Sequence
  chemically synthesized
gtagagatggggttttaccatg

SEQ ID NO: 744464 - DNA, 22 bp, Artificial Sequence
  chemically synthesized
gagaccagcctggccaacatgg

SEQ ID NO: 744465 - DNA, 22 bp, Artificial Sequence
  chemically synthesized
taccatgttggccaggctggtc

SEQ ID NO: 744466 - DNA, 22 bp, Artificial Sequence
  chemically synthesized
accatgttggccaggctggtct

SEQ ID NO: 744467 - DNA, 22 bp, Artificial Sequence
  chemically synthesized
ccatgttggccaggctggtctc

SEQ ID NO: 744468 - DNA, 22 bp, Artificial Sequence
  chemically synthesized
aggccaggagttcgagaccagc

SEQ ID NO: 744469 - DNA, 22 bp, Artificial Sequence
  chemically synthesized
gccaggctggtctcgaactcct

SEQ ID NO: 744470 - DNA, 22 bp, Artificial Sequence
  chemically synthesized
gtctcgaactcctggcctcagg

SEQ ID NO: 744471 - DNA, 22 bp, Artificial Sequence
  chemically synthesized
gaactcctggcctcaggtgatc

SEQ ID NO: 744472 - DNA, 22 bp, Artificial Sequence
  chemically synthesized
ggaggccaaggcaggcggatca

SEQ ID NO: 744473 - DNA, 22 bp, Artificial Sequence
  chemically synthesized
ctggcctcaggtgatccgcctg

SEQ ID NO: 744474 - DNA, 22 bp, Artificial Sequence
  chemically synthesized
gggaggccaaggcaggcggatc

SEQ ID NO: 744475 - DNA, 22 bp, Artificial Sequence
  chemically synthesized
tgggaggccaaggcaggcggat

SEQ ID NO: 744476 - DNA, 22 bp, Artificial Sequence
  chemically synthesized
gcctcaggtgatccgcctgcct

SEQ ID NO: 744477 - DNA, 22 bp, Artificial Sequence
  chemically synthesized
aggtgatccgcctgccttggcc

SEQ ID NO: 744478 - DNA, 22 bp, Artificial Sequence
  chemically synthesized
aacactttgggaggccaaggca

SEQ ID NO: 744479 - DNA, 22 bp, Artificial Sequence
  chemically synthesized
taatctcaacactttgggaggc

SEQ ID NO: 744480 - DNA, 22 bp, Artificial Sequence
  chemically synthesized
ccttggcctcccaaagtgttga

SEQ ID NO: 744481 - DNA, 22 bp, Artificial Sequence
  chemically synthesized
acacctgtaatctcaacacttt

SEQ ID NO: 744482 - DNA, 22 bp, Artificial Sequence
  chemically synthesized
ggcctcccaaagtgttgagatt

SEQ ID NO: 744483 - DNA, 22 bp, Artificial Sequence
  chemically synthesized
gcctcccaaagtgttgagatta

SEQ ID NO: 744484 - DNA, 22 bp, Artificial Sequence
  chemically synthesized
ccaaagtgttgagattacaggt

SEQ ID NO: 744485 - DNA, 22 bp, Artificial Sequence
  chemically synthesized
agattacaggtgtgagccacca

SEQ ID NO: 744486 - DNA, 22 bp, Artificial Sequence
  chemically synthesized
caggtgtgagccaccatgcctg

SEQ ID NO: 744487 - DNA, 22 bp, Artificial Sequence
  chemically synthesized
aacgataatccccaccaggcat

SEQ ID NO: 744488 - DNA, 22 bp, Artificial Sequence
  chemically synthesized
ttcaacgataatccccaccagg

SEQ ID NO: 744489 - DNA, 22 bp, Artificial Sequence
  chemically synthesized
tgtctattcaacgataatcccc

SEQ ID NO: 744490 - DNA, 22 bp, Artificial Sequence
  chemically synthesized
tatgtctattcaacgataatcc

SEQ ID NO: 744491 - DNA, 22 bp, Artificial Sequence
  chemically synthesized
aaactctatgtctattcaacga

SEQ ID NO: 744492 - DNA, 22 bp, Artificial Sequence
  chemically synthesized
gtggggattatcgttgaataga

SEQ ID NO: 744493 - DNA, 22 bp, Artificial Sequence
  chemically synthesized
caaaactgaaactctatgtcta

SEQ ID NO: 744494 - DNA, 22 bp, Artificial Sequence
  chemically synthesized
gcaaaactgaaactctatgtct

SEQ ID NO: 744495 - DNA, 22 bp, Artificial Sequence
  chemically synthesized
tcgttgaatagacatagagttt

SEQ ID NO: 744496 - DNA, 22 bp, Artificial Sequence
  chemically synthesized
atcttgcaaaactgaaactcta

SEQ ID NO: 744497 - DNA, 22 bp, Artificial Sequence
  chemically synthesized
tcatcttgcaaaactgaaactc

SEQ ID NO: 744498 - DNA, 22 bp, Artificial Sequence
  chemically synthesized
ctcatcttgcaaaactgaaact

SEQ ID NO: 744499 - DNA, 22 bp, Artificial Sequence
  chemically synthesized
aatagacatagagtttcagttt

SEQ ID NO: 744500 - DNA, 22 bp, Artificial Sequence
  chemically synthesized
ttctcatcttgcaaaactgaaa

SEQ ID NO: 744501 - DNA, 22 bp, Artificial Sequence
  chemically synthesized
cagaactcttctcatcttgcaa

SEQ ID NO: 744502 - DNA, 22 bp, Artificial Sequence
  chemically synthesized
cagttttgcaagatgagaagag

SEQ ID NO: 744503 - DNA, 22 bp, Artificial Sequence
  chemically synthesized
agttttgcaagatgagaagagt

SEQ ID NO: 744504 - DNA, 22 bp, Artificial Sequence
  chemically synthesized
tgcaagatgagaagagttctgg

SEQ ID NO: 744505 - DNA, 22 bp, Artificial Sequence
  chemically synthesized
gcaagatgagaagagttctgga

SEQ ID NO: 744506 - DNA, 22 bp, Artificial Sequence
  chemically synthesized
caagatgagaagagttctggag

SEQ ID NO: 744507 - DNA, 22 bp, Artificial Sequence
  chemically synthesized
ccatcaccaccatccatctcca

SEQ ID NO: 744508 - DNA, 22 bp, Artificial Sequence
  chemically synthesized
ctgccatcaccaccatccatct

SEQ ID NO: 744509 - DNA, 22 bp, Artificial Sequence
  chemically synthesized
tgctgccatcaccaccatccat

SEQ ID NO: 744510 - DNA, 22 bp, Artificial Sequence
  chemically synthesized
ttctgctgccatcaccaccatc

SEQ ID NO: 744511 - DNA, 22 bp, Artificial Sequence
  chemically synthesized
tggagatggatggtggtgatgg

SEQ ID NO: 744512 - DNA, 22 bp, Artificial Sequence
  chemically synthesized
cgttgttctgctgccatcacca

SEQ ID NO: 744513 - DNA, 22 bp, Artificial Sequence
  chemically synthesized
gagatggatggtggtgatggca

SEQ ID NO: 744514 - DNA, 22 bp, Artificial Sequence
  chemically synthesized
acgttgttctgctgccatcacc

SEQ ID NO: 744515 - DNA, 22 bp, Artificial Sequence
  chemically synthesized
catacatttacgttgttctgct

SEQ ID NO: 744516 - DNA, 22 bp, Artificial Sequence
  chemically synthesized
catggcattacatacatttacg

SEQ ID NO: 744517 - DNA, 22 bp, Artificial Sequence
  chemically synthesized
ccatggcattacatacatttac

SEQ ID NO: 744518 - DNA, 22 bp, Artificial Sequence
  chemically synthesized
aatgtatacttccatggcatta

SEQ ID NO: 744519 - DNA, 22 bp, Artificial Sequence
  chemically synthesized
aaatgtatacttccatggcatt

SEQ ID NO: 744520 - DNA, 22 bp, Artificial Sequence
  chemically synthesized
tttaaatgtatacttccatggc

SEQ ID NO: 744521 - DNA, 22 bp, Artificial Sequence
  chemically synthesized
tatttaaatgtatacttccatg

SEQ ID NO: 744522 - DNA, 22 bp, Artificial Sequence
  chemically synthesized
gctctatttaaatgtatacttc

SEQ ID NO: 744523 - DNA, 22 bp, Artificial Sequence
  chemically synthesized
ggctctatttaaatgtatactt

SEQ ID NO: 744524 - DNA, 22 bp, Artificial Sequence
  chemically synthesized
tcttggctctatttaaatgtat

SEQ ID NO: 744525 - DNA, 22 bp, Artificial Sequence
  chemically synthesized
ctatcttggctctatttaaatg

SEQ ID NO: 744526 - DNA, 22 bp, Artificial Sequence
  chemically synthesized
actatcttggctctatttaaat

SEQ ID NO: 744527 - DNA, 22 bp, Artificial Sequence
  chemically synthesized
catgaagtttactatcttggct

SEQ ID NO: 744528 - DNA, 22 bp, Artificial Sequence
  chemically synthesized
aaatagagccaagatagtaaac

SEQ ID NO: 744529 - DNA, 22 bp, Artificial Sequence
  chemically synthesized
aatagagccaagatagtaaact

SEQ ID NO: 744530 - DNA, 22 bp, Artificial Sequence
  chemically synthesized
aatagtggtaaaatacaaatta

SEQ ID NO: 744531 - DNA, 22 bp, Artificial Sequence
  chemically synthesized
aaatagtggtaaaatacaaatt

SEQ ID NO: 744532 - DNA, 22 bp, Artificial Sequence
  chemically synthesized
taaatagtggtaaaatacaaat

SEQ ID NO: 744533 - DNA, 22 bp, Artificial Sequence
  chemically synthesized
ttaaatagtggtaaaatacaaa

SEQ ID NO: 744534 - DNA, 22 bp, Artificial Sequence
  chemically synthesized
tttaaatagtggtaaaatacaa

SEQ ID NO: 744535 - DNA, 22 bp, Artificial Sequence
  chemically synthesized
catgtaatttgtattttaccac

SEQ ID NO: 744536 - DNA, 22 bp, Artificial Sequence
  chemically synthesized
attttttaaatagtggtaaaat

SEQ ID NO: 744537 - DNA, 22 bp, Artificial Sequence
  chemically synthesized
atgtaatttgtattttaccact

SEQ ID NO: 744538 - DNA, 22 bp, Artificial Sequence
  chemically synthesized
gattttttaaatagtggtaaaa

SEQ ID NO: 744539 - DNA, 22 bp, Artificial Sequence
  chemically synthesized
tgattttttaaatagtggtaaa

SEQ ID NO: 744540 - DNA, 22 bp, Artificial Sequence
  chemically synthesized
ttgattttttaaatagtggtaa

SEQ ID NO: 744541 - DNA, 22 bp, Artificial Sequence
  chemically synthesized
tttttgattttttaaatagtgg

SEQ ID NO: 744542 - DNA, 22 bp, Artificial Sequence
  chemically synthesized
atttttgattttttaaatagtg

SEQ ID NO: 744543 - DNA, 22 bp, Artificial Sequence
  chemically synthesized
gtattttaccactatttaaaaa

SEQ ID NO: 744544 - DNA, 22 bp, Artificial Sequence
  chemically synthesized
tattttaccactatttaaaaaa

SEQ ID NO: 744545 - DNA, 22 bp, Artificial Sequence
  chemically synthesized
tacttatttttgattttttaaa

SEQ ID NO: 744546 - DNA, 22 bp, Artificial Sequence
  chemically synthesized
taccactatttaaaaaatcaaa

SEQ ID NO: 744547 - DNA, 22 bp, Artificial Sequence
  chemically synthesized
accactatttaaaaaatcaaaa

SEQ ID NO: 744548 - DNA, 22 bp, Artificial Sequence
  chemically synthesized
ccactatttaaaaaatcaaaaa

SEQ ID NO: 744549 - DNA, 22 bp, Artificial Sequence
  chemically synthesized
caaattgtacttatttttgatt

SEQ ID NO: 744550 - DNA, 22 bp, Artificial Sequence
  chemically synthesized
acaaattgtacttatttttgat

SEQ ID NO: 744551 - DNA, 22 bp, Artificial Sequence
  chemically synthesized
tacaaattgtacttatttttga

SEQ ID NO: 744552 - DNA, 22 bp, Artificial Sequence
  chemically synthesized
ttacaaattgtacttatttttg

SEQ ID NO: 744553 - DNA, 22 bp, Artificial Sequence
  chemically synthesized
tttaaaaaatcaaaaataagta

SEQ ID NO: 744554 - DNA, 22 bp, Artificial Sequence
  chemically synthesized
ttttacaaattgtacttatttt

SEQ ID NO: 744555 - DNA, 22 bp, Artificial Sequence
  chemically synthesized
cttttacaaattgtacttattt

SEQ ID NO: 744556 - DNA, 22 bp, Artificial Sequence
  chemically synthesized
aaaaaatcaaaaataagtacaa

SEQ ID NO: 744557 - DNA, 22 bp, Artificial Sequence
  chemically synthesized
ttcttttacaaattgtacttat

SEQ ID NO: 744558 - DNA, 22 bp, Artificial Sequence
  chemically synthesized
aaaaatcaaaaataagtacaat

SEQ ID NO: 744559 - DNA, 22 bp, Artificial Sequence
  chemically synthesized
cttcttttacaaattgtactta

SEQ ID NO: 744560 - DNA, 22 bp, Artificial Sequence
  chemically synthesized
aagtttcttcttttacaaattg

SEQ ID NO: 744561 - DNA, 22 bp, Artificial Sequence
  chemically synthesized
ttcaagtttcttcttttacaaa

SEQ ID NO: 744562 - DNA, 22 bp, Artificial Sequence
  chemically synthesized
gttcaagtttcttcttttacaa

SEQ ID NO: 744563 - DNA, 22 bp, Artificial Sequence
  chemically synthesized
ataaaatttgttcaagtttctt

SEQ ID NO: 744564 - DNA, 22 bp, Artificial Sequence
  chemically synthesized
gtaaaagaagaaacttgaacaa

SEQ ID NO: 744565 - DNA, 22 bp, Artificial Sequence
  chemically synthesized
taaaagaagaaacttgaacaaa

SEQ ID NO: 744566 - DNA, 22 bp, Artificial Sequence
  chemically synthesized
ccaaggaaattaataaaatttg

SEQ ID NO: 744567 - DNA, 22 bp, Artificial Sequence
  chemically synthesized
cccaaggaaattaataaaattt

SEQ ID NO: 744568 - DNA, 22 bp, Artificial Sequence
  chemically synthesized
tcccaaggaaattaataaaatt

SEQ ID NO: 744569 - DNA, 22 bp, Artificial Sequence
  chemically synthesized
gaacaaattttattaatttcct

SEQ ID NO: 744570 - DNA, 22 bp, Artificial Sequence
  chemically synthesized
aacaaattttattaatttcctt

SEQ ID NO: 744571 - DNA, 22 bp, Artificial Sequence
  chemically synthesized
tagaaacattttcccaaggaaa

SEQ ID NO: 744572 - DNA, 22 bp, Artificial Sequence
  chemically synthesized
tattaatttccttgggaaaatg

SEQ ID NO: 744573 - DNA, 22 bp, Artificial Sequence
  chemically synthesized
ggattatagaaacattttccca

SEQ ID NO: 744574 - DNA, 22 bp, Artificial Sequence
  chemically synthesized
attaatttccttgggaaaatgt

SEQ ID NO: 744575 - DNA, 22 bp, Artificial Sequence
  chemically synthesized
ttaatttccttgggaaaatgtt

SEQ ID NO: 744576 - DNA, 22 bp, Artificial Sequence
  chemically synthesized
atttccttgggaaaatgtttct

SEQ ID NO: 744577 - DNA, 22 bp, Artificial Sequence
  chemically synthesized
cagttaggattatagaaacatt

SEQ ID NO: 744578 - DNA, 22 bp, Artificial Sequence
  chemically synthesized
ccttgggaaaatgtttctataa

SEQ ID NO: 744579 - DNA, 22 bp, Artificial Sequence
  chemically synthesized
cttgggaaaatgtttctataat

SEQ ID NO: 744580 - DNA, 22 bp, Artificial Sequence
  chemically synthesized
gggaaaatgtttctataatcct

SEQ ID NO: 744581 - DNA, 22 bp, Artificial Sequence
  chemically synthesized
gcagttgcagttaggattatag

SEQ ID NO: 744582 - DNA, 22 bp, Artificial Sequence
  chemically synthesized
ggaaaatgtttctataatccta

SEQ ID NO: 744583 - DNA, 22 bp, Artificial Sequence
  chemically synthesized
ctataatcctaactgcaactgc

SEQ ID NO: 744584 - DNA, 22 bp, Artificial Sequence
  chemically synthesized
tataatcctaactgcaactgcc

SEQ ID NO: 744585 - DNA, 22 bp, Artificial Sequence
  chemically synthesized
taatcctaactgcaactgccag

SEQ ID NO: 744586 - DNA, 22 bp, Artificial Sequence
  chemically synthesized
taaaggggagataactggcagt

SEQ ID NO: 744587 - DNA, 22 bp, Artificial Sequence
  chemically synthesized
tctataaaggggagataactgg

SEQ ID NO: 744588 - DNA, 22 bp, Artificial Sequence
  chemically synthesized
gtctataaaggggagataactg

SEQ ID NO: 744589 - DNA, 22 bp, Artificial Sequence
  chemically synthesized
actgcaactgccagttatctcc

SEQ ID NO: 744590 - DNA, 22 bp, Artificial Sequence
  chemically synthesized
tgtctataaaggggagataact

SEQ ID NO: 744591 - DNA, 22 bp, Artificial Sequence
  chemically synthesized
ttgtctataaaggggagataac

SEQ ID NO: 744592 - DNA, 22 bp, Artificial Sequence
  chemically synthesized
tttgtctataaaggggagataa

SEQ ID NO: 744593 - DNA, 22 bp, Artificial Sequence
  chemically synthesized
caactgccagttatctcccctt

SEQ ID NO: 744594 - DNA, 22 bp, Artificial Sequence
  chemically synthesized
ttttttgtctataaaggggaga

SEQ ID NO: 744595 - DNA, 22 bp, Artificial Sequence
  chemically synthesized
gttttttgtctataaaggggag

SEQ ID NO: 744596 - DNA, 22 bp, Artificial Sequence
  chemically synthesized
cttgttttttgtctataaaggg

SEQ ID NO: 744597 - DNA, 22 bp, Artificial Sequence
  chemically synthesized
ccagttatctcccctttataga

SEQ ID NO: 744598 - DNA, 22 bp, Artificial Sequence
  chemically synthesized
gcttgttttttgtctataaagg

SEQ ID NO: 744599 - DNA, 22 bp, Artificial Sequence
  chemically synthesized
tgcttgttttttgtctataaag

SEQ ID NO: 744600 - DNA, 22 bp, Artificial Sequence
  chemically synthesized
ttgcttgttttttgtctataaa

SEQ ID NO: 744601 - DNA, 22 bp, Artificial Sequence
  chemically synthesized
tttgcttgttttttgtctataa

SEQ ID NO: 744602 - DNA, 22 bp, Artificial Sequence
  chemically synthesized
ttttgcttgttttttgtctata

SEQ ID NO: 744603 - DNA, 22 bp, Artificial Sequence
  chemically synthesized
tttttgcttgttttttgtctat

SEQ ID NO: 744604 - DNA, 22 bp, Artificial Sequence
  chemically synthesized
ttttttgcttgttttttgtcta

SEQ ID NO: 744605 - DNA, 22 bp, Artificial Sequence
  chemically synthesized
tctcccctttatagacaaaaaa

SEQ ID NO: 744606 - DNA, 22 bp, Artificial Sequence
  chemically synthesized
tttttttgcttgttttttgtct

SEQ ID NO: 744607 - DNA, 22 bp, Artificial Sequence
  chemically synthesized
ttttttttgcttgttttttgtc

SEQ ID NO: 744608 - DNA, 22 bp, Artificial Sequence
  chemically synthesized
tttttttttgcttgttttttgt

SEQ ID NO: 744609 - DNA, 22 bp, Artificial Sequence
  chemically synthesized
ttttttttttgcttgttttttg

SEQ ID NO: 744610 - DNA, 22 bp, Artificial Sequence
  chemically synthesized
ccctttatagacaaaaaacaag

SEQ ID NO: 744611 - DNA, 22 bp, Artificial Sequence
  chemically synthesized
tttttttttttgcttgtttttt

SEQ ID NO: 744612 - DNA, 22 bp, Artificial Sequence
  chemically synthesized
ttttttttttttgcttgttttt

SEQ ID NO: 744613 - DNA, 22 bp, Artificial Sequence
  chemically synthesized
tttttttttttttgcttgtttt

SEQ ID NO: 744614 - DNA, 22 bp, Artificial Sequence
  chemically synthesized
ttttttttttttttgcttgttt

SEQ ID NO: 744615 - DNA, 22 bp, Artificial Sequence
  chemically synthesized
tttttttttttttttgcttgtt

SEQ ID NO: 744616 - DNA, 22 bp, Artificial Sequence
  chemically synthesized
tatagacaaaaaacaagcaaaa

SEQ ID NO: 744617 - DNA, 22 bp, Artificial Sequence
  chemically synthesized
ttttttttttttttttgcttgt

SEQ ID NO: 744618 - DNA, 22 bp, Artificial Sequence
  chemically synthesized
atagacaaaaaacaagcaaaaa

SEQ ID NO: 744619 - DNA, 22 bp, Artificial Sequence
  chemically synthesized
tttttttttttttttttgcttg

SEQ ID NO: 744620 - DNA, 22 bp, Artificial Sequence
  chemically synthesized
tagacaaaaaacaagcaaaaaa

SEQ ID NO: 744621 - DNA, 22 bp, Artificial Sequence
  chemically synthesized
ttttttttttttttttttgctt

SEQ ID NO: 744622 - DNA, 22 bp, Artificial Sequence
  chemically synthesized
tttttttttttttttttttgct

SEQ ID NO: 744623 - DNA, 22 bp, Artificial Sequence
  chemically synthesized
ttttttttttttttttttttgc

SEQ ID NO: 744624 - DNA, 22 bp, Artificial Sequence
  chemically synthesized
tttttttttttttttttttttg

SEQ ID NO: 744625 - DNA, 22 bp, Artificial Sequence
  chemically synthesized
tttttttttttttttttttttt

SEQ ID NO: 744626 - DNA, 22 bp, Artificial Sequence
  chemically synthesized
tggttttttttttttttttttt

SEQ ID NO: 744627 - DNA, 22 bp, Artificial Sequence
  chemically synthesized
gtggtttttttttttttttttt

SEQ ID NO: 744628 - DNA, 22 bp, Artificial Sequence
  chemically synthesized
tgtggttttttttttttttttt

SEQ ID NO: 744629 - DNA, 22 bp, Artificial Sequence
  chemically synthesized
aagtattttgtggttttttttt

SEQ ID NO: 744630 - DNA, 22 bp, Artificial Sequence
  chemically synthesized
gaagtattttgtggtttttttt

SEQ ID NO: 744631 - DNA, 22 bp, Artificial Sequence
  chemically synthesized
gaaagcttgaagtattttgtgg

SEQ ID NO: 744632 - DNA, 22 bp, Artificial Sequence
  chemically synthesized
tgtcattggaaagcttgaagta

SEQ ID NO: 744633 - DNA, 22 bp, Artificial Sequence
  chemically synthesized
attgtgtcattggaaagcttga

SEQ ID NO: 744634 - DNA, 22 bp, Artificial Sequence
  chemically synthesized
aattgtgtcattggaaagcttg

SEQ ID NO: 744635 - DNA, 22 bp, Artificial Sequence
  chemically synthesized
taattgtgtcattggaaagctt

SEQ ID NO: 744636 - DNA, 22 bp, Artificial Sequence
  chemically synthesized
ttttaattgtgtcattggaaag

SEQ ID NO: 744637 - DNA, 22 bp, Artificial Sequence
  chemically synthesized
gttttaattgtgtcattggaaa

SEQ ID NO: 744638 - DNA, 22 bp, Artificial Sequence
  chemically synthesized
tttgttttaattgtgtcattgg

SEQ ID NO: 744639 - DNA, 22 bp, Artificial Sequence
  chemically synthesized
atttgttttaattgtgtcattg

SEQ ID NO: 744640 - DNA, 22 bp, Artificial Sequence
  chemically synthesized
tatttgttttaattgtgtcatt

SEQ ID NO: 744641 - DNA, 22 bp, Artificial Sequence
  chemically synthesized
ttatttgttttaattgtgtcat

SEQ ID NO: 744642 - DNA, 22 bp, Artificial Sequence
  chemically synthesized
caagctttccaatgacacaatt

SEQ ID NO: 744643 - DNA, 22 bp, Artificial Sequence
  chemically synthesized
tttatttgttttaattgtgtca

SEQ ID NO: 744644 - DNA, 22 bp, Artificial Sequence
  chemically synthesized
aagctttccaatgacacaatta

SEQ ID NO: 744645 - DNA, 22 bp, Artificial Sequence
  chemically synthesized
tctttttatttgttttaattgt

SEQ ID NO: 744646 - DNA, 22 bp, Artificial Sequence
  chemically synthesized
tccaatgacacaattaaaacaa

SEQ ID NO: 744647 - DNA, 22 bp, Artificial Sequence
  chemically synthesized
ccaatgacacaattaaaacaaa

SEQ ID NO: 744648 - DNA, 22 bp, Artificial Sequence
  chemically synthesized
caatgacacaattaaaacaaat

SEQ ID NO: 744649 - DNA, 22 bp, Artificial Sequence
  chemically synthesized
atgaactatctttttatttgtt

SEQ ID NO: 744650 - DNA, 22 bp, Artificial Sequence
  chemically synthesized
tgaaacactcatgaactatctt

SEQ ID NO: 744651 - DNA, 22 bp, Artificial Sequence
  chemically synthesized
aaacaaataaaaagatagttca

SEQ ID NO: 744652 - DNA, 22 bp, Artificial Sequence
  chemically synthesized
tgtgaaacactcatgaactatc

SEQ ID NO: 744653 - DNA, 22 bp, Artificial Sequence
  chemically synthesized
gcctctgtgaaacactcatgaa

SEQ ID NO: 744654 - DNA, 22 bp, Artificial Sequence
  chemically synthesized
agcctctgtgaaacactcatga

SEQ ID NO: 744655 - DNA, 22 bp, Artificial Sequence
  chemically synthesized
tatttagcctctgtgaaacact

SEQ ID NO: 744656 - DNA, 22 bp, Artificial Sequence
  chemically synthesized
gtatttagcctctgtgaaacac

SEQ ID NO: 744657 - DNA, 22 bp, Artificial Sequence
  chemically synthesized
tgtatttagcctctgtgaaaca

SEQ ID NO: 744658 - DNA, 22 bp, Artificial Sequence
  chemically synthesized
atgagtgtttcacagaggctaa

SEQ ID NO: 744659 - DNA, 22 bp, Artificial Sequence
  chemically synthesized
tgtatattttgtatttagcctc

SEQ ID NO: 744660 - DNA, 22 bp, Artificial Sequence
  chemically synthesized
attgtgtatattttgtatttag

SEQ ID NO: 744661 - DNA, 22 bp, Artificial Sequence
  chemically synthesized
cacagaggctaaatacaaaata

SEQ ID NO: 744662 - DNA, 22 bp, Artificial Sequence
  chemically synthesized
acagaggctaaatacaaaatat

SEQ ID NO: 744663 - DNA, 22 bp, Artificial Sequence
  chemically synthesized
tgttaattgtgtatattttgta

SEQ ID NO: 744664 - DNA, 22 bp, Artificial Sequence
  chemically synthesized
gtgttaattgtgtatattttgt

SEQ ID NO: 744665 - DNA, 22 bp, Artificial Sequence
  chemically synthesized
tgtgttaattgtgtatattttg

SEQ ID NO: 744666 - DNA, 22 bp, Artificial Sequence
  chemically synthesized
ttgtgttaattgtgtatatttt

SEQ ID NO: 744667 - DNA, 22 bp, Artificial Sequence
  chemically synthesized
tttgtgttaattgtgtatattt

SEQ ID NO: 744668 - DNA, 22 bp, Artificial Sequence
  chemically synthesized
aatacaaaatatacacaattaa

SEQ ID NO: 744669 - DNA, 22 bp, Artificial Sequence
  chemically synthesized
aaagcctttttgtgttaattgt

SEQ ID NO: 744670 - DNA, 22 bp, Artificial Sequence
  chemically synthesized
attaaaagcctttttgtgttaa

SEQ ID NO: 744671 - DNA, 22 bp, Artificial Sequence
  chemically synthesized
tgctcattaaaagcctttttgt

SEQ ID NO: 744672 - DNA, 22 bp, Artificial Sequence
  chemically synthesized
gtgctcattaaaagcctttttg

SEQ ID NO: 744673 - DNA, 22 bp, Artificial Sequence
  chemically synthesized
tttgtgctcattaaaagccttt

SEQ ID NO: 744674 - DNA, 22 bp, Artificial Sequence
  chemically synthesized
atttgtgctcattaaaagcctt

SEQ ID NO: 744675 - DNA, 22 bp, Artificial Sequence
  chemically synthesized
acacaaaaaggcttttaatgag

SEQ ID NO: 744676 - DNA, 22 bp, Artificial Sequence
  chemically synthesized
aatgacttatttgtgctcatta

SEQ ID NO: 744677 - DNA, 22 bp, Artificial Sequence
  chemically synthesized
aaatgacttatttgtgctcatt

SEQ ID NO: 744678 - DNA, 22 bp, Artificial Sequence
  chemically synthesized
cttaaatgacttatttgtgctc

SEQ ID NO: 744679 - DNA, 22 bp, Artificial Sequence
  chemically synthesized
ttaatgagcacaaataagtcat

SEQ ID NO: 744680 - DNA, 22 bp, Artificial Sequence
  chemically synthesized
taatgagcacaaataagtcatt

SEQ ID NO: 744681 - DNA, 22 bp, Artificial Sequence
  chemically synthesized
aatgagcacaaataagtcattt

SEQ ID NO: 744682 - DNA, 22 bp, Artificial Sequence
  chemically synthesized
atgagcacaaataagtcattta

SEQ ID NO: 744683 - DNA, 22 bp, Artificial Sequence
  chemically synthesized
aagcatgacctgcttaaatgac

SEQ ID NO: 744684 - DNA, 22 bp, Artificial Sequence
  chemically synthesized
gcaacctaaagcatgacctgct

SEQ ID NO: 744685 - DNA, 22 bp, Artificial Sequence
  chemically synthesized
agcaacctaaagcatgacctgc

SEQ ID NO: 744686 - DNA, 22 bp, Artificial Sequence
  chemically synthesized
cttagcaacctaaagcatgacc

SEQ ID NO: 744687 - DNA, 22 bp, Artificial Sequence
  chemically synthesized
ccttagcaacctaaagcatgac

SEQ ID NO: 744688 - DNA, 22 bp, Artificial Sequence
  chemically synthesized
tttccttagcaacctaaagcat

SEQ ID NO: 744689 - DNA, 22 bp, Artificial Sequence
  chemically synthesized
tgtttccttagcaacctaaagc

SEQ ID NO: 744690 - DNA, 22 bp, Artificial Sequence
  chemically synthesized
aagcaggtcatgctttaggttg

SEQ ID NO: 744691 - DNA, 22 bp, Artificial Sequence
  chemically synthesized
ctgtttccttagcaacctaaag

SEQ ID NO: 744692 - DNA, 22 bp, Artificial Sequence
  chemically synthesized
agcaggtcatgctttaggttgc

SEQ ID NO: 744693 - DNA, 22 bp, Artificial Sequence
  chemically synthesized
tctgtttccttagcaacctaaa

SEQ ID NO: 744694 - DNA, 22 bp, Artificial Sequence
  chemically synthesized
ttctgtttccttagcaacctaa

SEQ ID NO: 744695 - DNA, 22 bp, Artificial Sequence
  chemically synthesized
tttctgtttccttagcaaccta

SEQ ID NO: 744696 - DNA, 22 bp, Artificial Sequence
  chemically synthesized
gtattttttctgtttccttagc

SEQ ID NO: 744697 - DNA, 22 bp, Artificial Sequence
  chemically synthesized
taggttgctaaggaaacagaaa

SEQ ID NO: 744698 - DNA, 22 bp, Artificial Sequence
  chemically synthesized
aggttgctaaggaaacagaaaa

SEQ ID NO: 744699 - DNA, 22 bp, Artificial Sequence
  chemically synthesized
ggttgctaaggaaacagaaaaa

SEQ ID NO: 744700 - DNA, 22 bp, Artificial Sequence
  chemically synthesized
ctaaggaaacagaaaaaatacc

SEQ ID NO: 744701 - DNA, 22 bp, Artificial Sequence
  chemically synthesized
agacagaaaatattggtatttt

SEQ ID NO: 744702 - DNA, 22 bp, Artificial Sequence
  chemically synthesized
aggaaacagaaaaaataccaat

SEQ ID NO: 744703 - DNA, 22 bp, Artificial Sequence
  chemically synthesized
cagacagaaaatattggtattt

SEQ ID NO: 744704 - DNA, 22 bp, Artificial Sequence
  chemically synthesized
tcagacagaaaatattggtatt

SEQ ID NO: 744705 - DNA, 22 bp, Artificial Sequence
  chemically synthesized
ttcagacagaaaatattggtat

SEQ ID NO: 744706 - DNA, 22 bp, Artificial Sequence
  chemically synthesized
aaatttttcagacagaaaatat

SEQ ID NO: 744707 - DNA, 22 bp, Artificial Sequence
  chemically synthesized
tcacatataattaaaatttttc

SEQ ID NO: 744708 - DNA, 22 bp, Artificial Sequence
  chemically synthesized
gtcacatataattaaaattttt

SEQ ID NO: 744709 - DNA, 22 bp, Artificial Sequence
  chemically synthesized
tgtcacatataattaaaatttt

SEQ ID NO: 744710 - DNA, 22 bp, Artificial Sequence
  chemically synthesized
tctgtctgaaaaattttaatta

SEQ ID NO: 744711 - DNA, 22 bp, Artificial Sequence
  chemically synthesized
ctgtctgaaaaattttaattat

SEQ ID NO: 744712 - DNA, 22 bp, Artificial Sequence
  chemically synthesized
attttgtcacatataattaaaa

SEQ ID NO: 744713 - DNA, 22 bp, Artificial Sequence
  chemically synthesized
tgtctgaaaaattttaattata

SEQ ID NO: 744714 - DNA, 22 bp, Artificial Sequence
  chemically synthesized
cattttgtcacatataattaaa

SEQ ID NO: 744715 - DNA, 22 bp, Artificial Sequence
  chemically synthesized
tctgaaaaattttaattatatg

SEQ ID NO: 744716 - DNA, 22 bp, Artificial Sequence
  chemically synthesized
cttcattttgtcacatataatt

SEQ ID NO: 744717 - DNA, 22 bp, Artificial Sequence
  chemically synthesized
gcttcattttgtcacatataat

SEQ ID NO: 744718 - DNA, 22 bp, Artificial Sequence
  chemically synthesized
tgcttcattttgtcacatataa

SEQ ID NO: 744719 - DNA, 22 bp, Artificial Sequence
  chemically synthesized
aaaaattttaattatatgtgac

SEQ ID NO: 744720 - DNA, 22 bp, Artificial Sequence
  chemically synthesized
ccattttgcttcattttgtcac

SEQ ID NO: 744721 - DNA, 22 bp, Artificial Sequence
  chemically synthesized
taattatatgtgacaaaatgaa

SEQ ID NO: 744722 - DNA, 22 bp, Artificial Sequence
  chemically synthesized
aattatatgtgacaaaatgaag

SEQ ID NO: 744723 - DNA, 22 bp, Artificial Sequence
  chemically synthesized
actgccattttgcttcattttg

SEQ ID NO: 744724 - DNA, 22 bp, Artificial Sequence
  chemically synthesized
attatatgtgacaaaatgaagc

SEQ ID NO: 744725 - DNA, 22 bp, Artificial Sequence
  chemically synthesized
attaactgccattttgcttcat

SEQ ID NO: 744726 - DNA, 22 bp, Artificial Sequence
  chemically synthesized
tatgtgacaaaatgaagcaaaa

SEQ ID NO: 744727 - DNA, 22 bp, Artificial Sequence
  chemically synthesized
cattaactgccattttgcttca

SEQ ID NO: 744728 - DNA, 22 bp, Artificial Sequence
  chemically synthesized
ataggtttcattaactgccatt

SEQ ID NO: 744729 - DNA, 22 bp, Artificial Sequence
  chemically synthesized
aggaagttaataggtttcatta

SEQ ID NO: 744730 - DNA, 22 bp, Artificial Sequence
  chemically synthesized
aaggaagttaataggtttcatt

SEQ ID NO: 744731 - DNA, 22 bp, Artificial Sequence
  chemically synthesized
taaggaagttaataggtttcat

SEQ ID NO: 744732 - DNA, 22 bp, Artificial Sequence
  chemically synthesized
ttaaggaagttaataggtttca

SEQ ID NO: 744733 - DNA, 22 bp, Artificial Sequence
  chemically synthesized
cttttaaggaagttaataggtt

SEQ ID NO: 744734 - DNA, 22 bp, Artificial Sequence
  chemically synthesized
acttttaaggaagttaataggt

SEQ ID NO: 744735 - DNA, 22 bp, Artificial Sequence
  chemically synthesized
cttacttttaaggaagttaata

SEQ ID NO: 744736 - DNA, 22 bp, Artificial Sequence
  chemically synthesized
ttacttacttttaaggaagtta

SEQ ID NO: 744737 - DNA, 22 bp, Artificial Sequence
  chemically synthesized
atgaaacctattaacttcctta

SEQ ID NO: 744738 - DNA, 22 bp, Artificial Sequence
  chemically synthesized
tggattattacttacttttaag

SEQ ID NO: 744739 - DNA, 22 bp, Artificial Sequence
  chemically synthesized
atggattattacttacttttaa

SEQ ID NO: 744740 - DNA, 22 bp, Artificial Sequence
  chemically synthesized
ttaacttccttaaaagtaagta

SEQ ID NO: 744741 - DNA, 22 bp, Artificial Sequence
  chemically synthesized
acttccttaaaagtaagtaata

SEQ ID NO: 744742 - DNA, 22 bp, Artificial Sequence
  chemically synthesized
atggtttatggattattactta

SEQ ID NO: 744743 - DNA, 22 bp, Artificial Sequence
  chemically synthesized
aatggtttatggattattactt

SEQ ID NO: 744744 - DNA, 22 bp, Artificial Sequence
  chemically synthesized
taatggtttatggattattact

SEQ ID NO: 744745 - DNA, 22 bp, Artificial Sequence
  chemically synthesized
ccttaaaagtaagtaataatcc

SEQ ID NO: 744746 - DNA, 22 bp, Artificial Sequence
  chemically synthesized
cttaaaagtaagtaataatcca

SEQ ID NO: 744747 - DNA, 22 bp, Artificial Sequence
  chemically synthesized
aaaagtaagtaataatccataa

SEQ ID NO: 744748 - DNA, 22 bp, Artificial Sequence
  chemically synthesized
aaagtaagtaataatccataaa

SEQ ID NO: 744749 - DNA, 22 bp, Artificial Sequence
  chemically synthesized
atattttaatggtttatggatt

SEQ ID NO: 744750 - DNA, 22 bp, Artificial Sequence
  chemically synthesized
atggttgatattttaatggttt

SEQ ID NO: 744751 - DNA, 22 bp, Artificial Sequence
  chemically synthesized
aagataaacatcctcatggttg

SEQ ID NO: 744752 - DNA, 22 bp, Artificial Sequence
  chemically synthesized
gaagataaacatcctcatggtt

SEQ ID NO: 744753 - DNA, 22 bp, Artificial Sequence
  chemically synthesized
aaatatcaaccatgaggatgtt

SEQ ID NO: 744754 - DNA, 22 bp, Artificial Sequence
  chemically synthesized
aatttgaagataaacatcctca

SEQ ID NO: 744755 - DNA, 22 bp, Artificial Sequence
  chemically synthesized
tgaatttgaagataaacatcct

SEQ ID NO: 744756 - DNA, 22 bp, Artificial Sequence
  chemically synthesized
ctgaatttgaagataaacatcc

SEQ ID NO: 744757 - DNA, 22 bp, Artificial Sequence
  chemically synthesized
aagtaacttctgaatttgaaga

SEQ ID NO: 744758 - DNA, 22 bp, Artificial Sequence
  chemically synthesized
tctgaagtaacttctgaatttg

SEQ ID NO: 744759 - DNA, 22 bp, Artificial Sequence
  chemically synthesized
atctgtctgaagtaacttctga

SEQ ID NO: 744760 - DNA, 22 bp, Artificial Sequence
  chemically synthesized
catctgtctgaagtaacttctg

SEQ ID NO: 744761 - DNA, 22 bp, Artificial Sequence
  chemically synthesized
atcttcaaattcagaagttact

SEQ ID NO: 744762 - DNA, 22 bp, Artificial Sequence
  chemically synthesized
tcttcaaattcagaagttactt

SEQ ID NO: 744763 - DNA, 22 bp, Artificial Sequence
  chemically synthesized
caaattcagaagttacttcaga

SEQ ID NO: 744764 - DNA, 22 bp, Artificial Sequence
  chemically synthesized
aaattcagaagttacttcagac

SEQ ID NO: 744765 - DNA, 22 bp, Artificial Sequence
  chemically synthesized
agaagttacttcagacagatga

SEQ ID NO: 744766 - DNA, 22 bp, Artificial Sequence
  chemically synthesized
aaaaaaaaagtaaaacttcatc

SEQ ID NO: 744767 - DNA, 22 bp, Artificial Sequence
  chemically synthesized
cttcagacagatgaagttttac

SEQ ID NO: 744768 - DNA, 22 bp, Artificial Sequence
  chemically synthesized
tctcaaaaaaaaagtaaaactt

SEQ ID NO: 744769 - DNA, 22 bp, Artificial Sequence
  chemically synthesized
cagacagatgaagttttacttt

SEQ ID NO: 744770 - DNA, 22 bp, Artificial Sequence
  chemically synthesized
tatctcaaaaaaaaagtaaaac

SEQ ID NO: 744771 - DNA, 22 bp, Artificial Sequence
  chemically synthesized
agacagatgaagttttactttt

SEQ ID NO: 744772 - DNA, 22 bp, Artificial Sequence
  chemically synthesized
tactttttttttgagatagagt

SEQ ID NO: 744773 - DNA, 22 bp, Artificial Sequence
  chemically synthesized
actttttttttgagatagagtt

SEQ ID NO: 744774 - DNA, 22 bp, Artificial Sequence
  chemically synthesized
ctttttttttgagatagagttt

SEQ ID NO: 744775 - DNA, 22 bp, Artificial Sequence
  chemically synthesized
tttttttgagatagagttttgc

SEQ ID NO: 744776 - DNA, 22 bp, Artificial Sequence
  chemically synthesized
ttttttgagatagagttttgct

SEQ ID NO: 744777 - DNA, 22 bp, Artificial Sequence
  chemically synthesized
tttttgagatagagttttgctc

SEQ ID NO: 744778 - DNA, 22 bp, Artificial Sequence
  chemically synthesized
ttttgagatagagttttgctct

SEQ ID NO: 744779 - DNA, 22 bp, Artificial Sequence
  chemically synthesized
tttgagatagagttttgctctt

SEQ ID NO: 744780 - DNA, 22 bp, Artificial Sequence
  chemically synthesized
ttgagatagagttttgctcttg

SEQ ID NO: 744781 - DNA, 22 bp, Artificial Sequence
  chemically synthesized
cagccggggcgacaagagcaaa

SEQ ID NO: 744782 - DNA, 22 bp, Artificial Sequence
  chemically synthesized
tgagatagagttttgctcttgt

SEQ ID NO: 744783 - DNA, 22 bp, Artificial Sequence
  chemically synthesized
gagatagagttttgctcttgtc

SEQ ID NO: 744784 - DNA, 22 bp, Artificial Sequence
  chemically synthesized
agatagagttttgctcttgtcg

SEQ ID NO: 744785 - DNA, 22 bp, Artificial Sequence
  chemically synthesized
cactccagccggggcgacaaga

SEQ ID NO: 744786 - DNA, 22 bp, Artificial Sequence
  chemically synthesized
tgctcttgtcgccccggctgga

SEQ ID NO: 744787 - DNA, 22 bp, Artificial Sequence
  chemically synthesized
gctcttgtcgccccggctggag

SEQ ID NO: 744788 - DNA, 22 bp, Artificial Sequence
  chemically synthesized
ctcttgtcgccccggctggagt

SEQ ID NO: 744789 - DNA, 22 bp, Artificial Sequence
  chemically synthesized
ttgtcgccccggctggagtgca

SEQ ID NO: 744790 - DNA, 22 bp, Artificial Sequence
  chemically synthesized
gtcgccccggctggagtgcaat

SEQ ID NO: 744791 - DNA, 22 bp, Artificial Sequence
  chemically synthesized
tcgccccggctggagtgcaatg

SEQ ID NO: 744792 - DNA, 22 bp, Artificial Sequence
  chemically synthesized
cagtgagcccagatcgcaccat

SEQ ID NO: 744793 - DNA, 22 bp, Artificial Sequence
  chemically synthesized
gagtgcaatggtgcgatctggg

SEQ ID NO: 744794 - DNA, 22 bp, Artificial Sequence
  chemically synthesized
aacccacgaggcggaggttgca

SEQ ID NO: 744795 - DNA, 22 bp, Artificial Sequence
  chemically synthesized
gaacccacgaggcggaggttgc

SEQ ID NO: 744796 - DNA, 22 bp, Artificial Sequence
  chemically synthesized
ggctcactgcaacctccgcctc

SEQ ID NO: 744797 - DNA, 22 bp, Artificial Sequence
  chemically synthesized
actgcaacctccgcctcgtggg

SEQ ID NO: 744798 - DNA, 22 bp, Artificial Sequence
  chemically synthesized
caacctccgcctcgtgggttca

SEQ ID NO: 744799 - DNA, 22 bp, Artificial Sequence
  chemically synthesized
aagcaggagaatcgcttgaacc

SEQ ID NO: 744800 - DNA, 22 bp, Artificial Sequence
  chemically synthesized
cgcctcgtgggttcaagcgatt

SEQ ID NO: 744801 - DNA, 22 bp, Artificial Sequence
  chemically synthesized
ggaggttgaagcaggagaatcg

SEQ ID NO: 744802 - DNA, 22 bp, Artificial Sequence
  chemically synthesized
gtgggttcaagcgattctcctg

SEQ ID NO: 744803 - DNA, 22 bp, Artificial Sequence
  chemically synthesized
gggaggttgaagcaggagaatc

SEQ ID NO: 744804 - DNA, 22 bp, Artificial Sequence
  chemically synthesized
cttgggaggttgaagcaggaga

SEQ ID NO: 744805 - DNA, 22 bp, Artificial Sequence
  chemically synthesized
aagcgattctcctgcttcaacc

SEQ ID NO: 744806 - DNA, 22 bp, Artificial Sequence
  chemically synthesized
taatcccagctacttgggaggt

SEQ ID NO: 744807 - DNA, 22 bp, Artificial Sequence
  chemically synthesized
tcctgcttcaacctcccaagta

SEQ ID NO: 744808 - DNA, 22 bp, Artificial Sequence
  chemically synthesized
ctgcttcaacctcccaagtagc

SEQ ID NO: 744809 - DNA, 22 bp, Artificial Sequence
  chemically synthesized
cttcaacctcccaagtagctgg

SEQ ID NO: 744810 - DNA, 22 bp, Artificial Sequence
  chemically synthesized
caacctcccaagtagctgggat

SEQ ID NO: 744811 - DNA, 22 bp, Artificial Sequence
  chemically synthesized
aacctcccaagtagctgggatt

SEQ ID NO: 744812 - DNA, 22 bp, Artificial Sequence
  chemically synthesized
ccaagtagctgggattacaggc

SEQ ID NO: 744813 - DNA, 22 bp, Artificial Sequence
  chemically synthesized
gccaggcatggtggtggtgtgc

SEQ ID NO: 744814 - DNA, 22 bp, Artificial Sequence
  chemically synthesized
ggattacaggcgcacaccacca

SEQ ID NO: 744815 - DNA, 22 bp, Artificial Sequence
  chemically synthesized
caggcgcacaccaccaccatgc

SEQ ID NO: 744816 - DNA, 22 bp, Artificial Sequence
  chemically synthesized
gtaaaaatagaaaaattagcca

SEQ ID NO: 744817 - DNA, 22 bp, Artificial Sequence
  chemically synthesized
tagtaaaaatagaaaaattagc

SEQ ID NO: 744818 - DNA, 22 bp, Artificial Sequence
  chemically synthesized
gctaatttttctatttttacta

SEQ ID NO: 744819 - DNA, 22 bp, Artificial Sequence
  chemically synthesized
atttttctatttttactagaga

SEQ ID NO: 744820 - DNA, 22 bp, Artificial Sequence
  chemically synthesized
ttctatttttactagagactgg

SEQ ID NO: 744821 - DNA, 22 bp, Artificial Sequence
  chemically synthesized
tctatttttactagagactggg

SEQ ID NO: 744822 - DNA, 22 bp, Artificial Sequence
  chemically synthesized
ctatttttactagagactgggt

SEQ ID NO: 744823 - DNA, 22 bp, Artificial Sequence
  chemically synthesized
tatttttactagagactgggtt

SEQ ID NO: 744824 - DNA, 22 bp, Artificial Sequence
  chemically synthesized
gccaacaaggtgaaacccagtc

SEQ ID NO: 744825 - DNA, 22 bp, Artificial Sequence
  chemically synthesized
tttttactagagactgggtttc

SEQ ID NO: 744826 - DNA, 22 bp, Artificial Sequence
  chemically synthesized
ttactagagactgggtttcacc

SEQ ID NO: 744827 - DNA, 22 bp, Artificial Sequence
  chemically synthesized
tactagagactgggtttcacct

SEQ ID NO: 744828 - DNA, 22 bp, Artificial Sequence
  chemically synthesized
actagagactgggtttcacctt

SEQ ID NO: 744829 - DNA, 22 bp, Artificial Sequence
  chemically synthesized
ctagagactgggtttcaccttg

SEQ ID NO: 744830 - DNA, 22 bp, Artificial Sequence
  chemically synthesized
gagactgggtttcaccttgttg

SEQ ID NO: 744831 - DNA, 22 bp, Artificial Sequence
  chemically synthesized
aagaccagcctggccaacaagg

SEQ ID NO: 744832 - DNA, 22 bp, Artificial Sequence
  chemically synthesized
ggtttcaccttgttggccaggc

SEQ ID NO: 744833 - DNA, 22 bp, Artificial Sequence
  chemically synthesized
caccttgttggccaggctggtc

SEQ ID NO: 744834 - DNA, 22 bp, Artificial Sequence
  chemically synthesized
accttgttggccaggctggtct

SEQ ID NO: 744835 - DNA, 22 bp, Artificial Sequence
  chemically synthesized
atgtcaggagttcaagaccagc

SEQ ID NO: 744836 - DNA, 22 bp, Artificial Sequence
  chemically synthesized
gttggccaggctggtcttgaac

SEQ ID NO: 744837 - DNA, 22 bp, Artificial Sequence
  chemically synthesized
ttggccaggctggtcttgaact

SEQ ID NO: 744838 - DNA, 22 bp, Artificial Sequence
  chemically synthesized
gccaggctggtcttgaactcct

SEQ ID NO: 744839 - DNA, 22 bp, Artificial Sequence
  chemically synthesized
gtcttgaactcctgacatcaga

SEQ ID NO: 744840 - DNA, 22 bp, Artificial Sequence
  chemically synthesized
gaactcctgacatcagatgatc

SEQ ID NO: 744841 - DNA, 22 bp, Artificial Sequence
  chemically synthesized
aactcctgacatcagatgatcc

SEQ ID NO: 744842 - DNA, 22 bp, Artificial Sequence
  chemically synthesized
ggaggccgaggcgggtggatca

SEQ ID NO: 744843 - DNA, 22 bp, Artificial Sequence
  chemically synthesized
ctgacatcagatgatccacccg

SEQ ID NO: 744844 - DNA, 22 bp, Artificial Sequence
  chemically synthesized
gggaggccgaggcgggtggatc

SEQ ID NO: 744845 - DNA, 22 bp, Artificial Sequence
  chemically synthesized
tgggaggccgaggcgggtggat

SEQ ID NO: 744846 - DNA, 22 bp, Artificial Sequence
  chemically synthesized
acatcagatgatccacccgcct

SEQ ID NO: 744847 - DNA, 22 bp, Artificial Sequence
  chemically synthesized
taatcccagcactttgggaggc

SEQ ID NO: 744848 - DNA, 22 bp, Artificial Sequence
  chemically synthesized
acgcctgtaatcccagcacttt

SEQ ID NO: 744849 - DNA, 22 bp, Artificial Sequence
  chemically synthesized
ggcctcccaaagtgctgggatt

SEQ ID NO: 744850 - DNA, 22 bp, Artificial Sequence
  chemically synthesized
ccaaagtgctgggattacaggc

SEQ ID NO: 744851 - DNA, 22 bp, Artificial Sequence
  chemically synthesized
aggcgcagtggctcacgcctgt

SEQ ID NO: 744852 - DNA, 22 bp, Artificial Sequence
  chemically synthesized
caggcgcagtggctcacgcctg

SEQ ID NO: 744853 - DNA, 22 bp, Artificial Sequence
  chemically synthesized
ggattacaggcgtgagccactg

SEQ ID NO: 744854 - DNA, 22 bp, Artificial Sequence
  chemically synthesized
caggcgtgagccactgcgcctg

SEQ ID NO: 744855 - DNA, 22 bp, Artificial Sequence
  chemically synthesized
aatgtaaaacttcaggcgcagt

SEQ ID NO: 744856 - DNA, 22 bp, Artificial Sequence
  chemically synthesized
ttaaatgtaaaacttcaggcgc

SEQ ID NO: 744857 - DNA, 22 bp, Artificial Sequence
  chemically synthesized
gttaaatgtaaaacttcaggcg

SEQ ID NO: 744858 - DNA, 22 bp, Artificial Sequence
  chemically synthesized
cgcctgaagttttacatttaac

SEQ ID NO: 744859 - DNA, 22 bp, Artificial Sequence
  chemically synthesized
caagcccaaaaacttgttaaat

SEQ ID NO: 744860 - DNA, 22 bp, Artificial Sequence
  chemically synthesized
aagttttacatttaacaagttt

SEQ ID NO: 744861 - DNA, 22 bp, Artificial Sequence
  chemically synthesized
tacatttaacaagtttttgggc

SEQ ID NO: 744862 - DNA, 22 bp, Artificial Sequence
  chemically synthesized
acatttaacaagtttttgggct

SEQ ID NO: 744863 - DNA, 22 bp, Artificial Sequence
  chemically synthesized
catttaacaagtttttgggctt

SEQ ID NO: 744864 - DNA, 22 bp, Artificial Sequence
  chemically synthesized
aacaagtttttgggcttgcaat

SEQ ID NO: 744865 - DNA, 22 bp, Artificial Sequence
  chemically synthesized
acaagtttttgggcttgcaatc

SEQ ID NO: 744866 - DNA, 22 bp, Artificial Sequence
  chemically synthesized
agaccaagaaatgattgcaagc

SEQ ID NO: 744867 - DNA, 22 bp, Artificial Sequence
  chemically synthesized
ttgggcttgcaatcatttcttg

SEQ ID NO: 744868 - DNA, 22 bp, Artificial Sequence
  chemically synthesized
tgggcttgcaatcatttcttgg

SEQ ID NO: 744869 - DNA, 22 bp, Artificial Sequence
  chemically synthesized
gggcttgcaatcatttcttggt

SEQ ID NO: 744870 - DNA, 22 bp, Artificial Sequence
  chemically synthesized
ggcttgcaatcatttcttggtc

SEQ ID NO: 744871 - DNA, 22 bp, Artificial Sequence
  chemically synthesized
acacatgtggctcagaccaaga

SEQ ID NO: 744872 - DNA, 22 bp, Artificial Sequence
  chemically synthesized
gcaatcatttcttggtctgagc

SEQ ID NO: 744873 - DNA, 22 bp, Artificial Sequence
  chemically synthesized
caatcatttcttggtctgagcc

SEQ ID NO: 744874 - DNA, 22 bp, Artificial Sequence
  chemically synthesized
cttggtctgagccacatgtgtt

SEQ ID NO: 744875 - DNA, 22 bp, Artificial Sequence
  chemically synthesized
ttggtctgagccacatgtgtta

SEQ ID NO: 744876 - DNA, 22 bp, Artificial Sequence
  chemically synthesized
ggtctgagccacatgtgttaac

SEQ ID NO: 744877 - DNA, 22 bp, Artificial Sequence
  chemically synthesized
gtctgagccacatgtgttaacc

SEQ ID NO: 744878 - DNA, 22 bp, Artificial Sequence
  chemically synthesized
agggacaatggtggttaacaca

SEQ ID NO: 744879 - DNA, 22 bp, Artificial Sequence
  chemically synthesized
agccacatgtgttaaccaccat

SEQ ID NO: 744880 - DNA, 22 bp, Artificial Sequence
  chemically synthesized
accaccattgtccctgaatggg

SEQ ID NO: 744881 - DNA, 22 bp, Artificial Sequence
  chemically synthesized
ggggagggagagggcccattca

SEQ ID NO: 744882 - DNA, 22 bp, Artificial Sequence
  chemically synthesized
aggggagggagagggcccattc

SEQ ID NO: 744883 - DNA, 22 bp, Artificial Sequence
  chemically synthesized
tttaggggagggagagggccca

SEQ ID NO: 744884 - DNA, 22 bp, Artificial Sequence
  chemically synthesized
tccctgaatgggccctctccct

SEQ ID NO: 744885 - DNA, 22 bp, Artificial Sequence
  chemically synthesized
agctatttaggggagggagagg

SEQ ID NO: 744886 - DNA, 22 bp, Artificial Sequence
  chemically synthesized
gagctatttaggggagggagag

SEQ ID NO: 744887 - DNA, 22 bp, Artificial Sequence
  chemically synthesized
tgagctatttaggggagggaga

SEQ ID NO: 744888 - DNA, 22 bp, Artificial Sequence
  chemically synthesized
aatgggccctctccctccccta

SEQ ID NO: 744889 - DNA, 22 bp, Artificial Sequence
  chemically synthesized
atgttttgagctatttagggga

SEQ ID NO: 744890 - DNA, 22 bp, Artificial Sequence
  chemically synthesized
gactgatgttttgagctattta

SEQ ID NO: 744891 - DNA, 22 bp, Artificial Sequence
  chemically synthesized
agactgatgttttgagctattt

SEQ ID NO: 744892 - DNA, 22 bp, Artificial Sequence
  chemically synthesized
tccctcccctaaatagctcaaa

SEQ ID NO: 744893 - DNA, 22 bp, Artificial Sequence
  chemically synthesized
cctcccctaaatagctcaaaac

SEQ ID NO: 744894 - DNA, 22 bp, Artificial Sequence
  chemically synthesized
ccttagactgatgttttgagct

SEQ ID NO: 744895 - DNA, 22 bp, Artificial Sequence
  chemically synthesized
ccctaaatagctcaaaacatca

SEQ ID NO: 744896 - DNA, 22 bp, Artificial Sequence
  chemically synthesized
aatagctcaaaacatcagtcta

SEQ ID NO: 744897 - DNA, 22 bp, Artificial Sequence
  chemically synthesized
tgtgagaatcactgccttagac

SEQ ID NO: 744898 - DNA, 22 bp, Artificial Sequence
  chemically synthesized
aaaacatcagtctaaggcagtg

SEQ ID NO: 744899 - DNA, 22 bp, Artificial Sequence
  chemically synthesized
ttgtgtgagaatcactgcctta

SEQ ID NO: 744900 - DNA, 22 bp, Artificial Sequence
  chemically synthesized
aggcagtgattctcacacaata

SEQ ID NO: 744901 - DNA, 22 bp, Artificial Sequence
  chemically synthesized
cacatgacaatgagatgcacac

SEQ ID NO: 744902 - DNA, 22 bp, Artificial Sequence
  chemically synthesized
ccacatgacaatgagatgcaca

SEQ ID NO: 744903 - DNA, 22 bp, Artificial Sequence
  chemically synthesized
tcacacaatagtgtgcatctca

SEQ ID NO: 744904 - DNA, 22 bp, Artificial Sequence
  chemically synthesized
acacaatagtgtgcatctcatt

SEQ ID NO: 744905 - DNA, 22 bp, Artificial Sequence
  chemically synthesized
acaagccttccacatgacaatg

SEQ ID NO: 744906 - DNA, 22 bp, Artificial Sequence
  chemically synthesized
tgttaacaagccttccacatga

SEQ ID NO: 744907 - DNA, 22 bp, Artificial Sequence
  chemically synthesized
tgtgttaacaagccttccacat

SEQ ID NO: 744908 - DNA, 22 bp, Artificial Sequence
  chemically synthesized
attgtcatgtggaaggcttgtt

SEQ ID NO: 744909 - DNA, 22 bp, Artificial Sequence
  chemically synthesized
agcagtctctgtgttaacaagc

SEQ ID NO: 744910 - DNA, 22 bp, Artificial Sequence
  chemically synthesized
tcatgtggaaggcttgttaaca

SEQ ID NO: 744911 - DNA, 22 bp, Artificial Sequence
  chemically synthesized
agtgggactcagcagtctctgt

SEQ ID NO: 744912 - DNA, 22 bp, Artificial Sequence
  chemically synthesized
gttaacacagagactgctgagt

SEQ ID NO: 744913 - DNA, 22 bp, Artificial Sequence
  chemically synthesized
ttaacacagagactgctgagtc

SEQ ID NO: 744914 - DNA, 22 bp, Artificial Sequence
  chemically synthesized
acacagagactgctgagtccca

SEQ ID NO: 744915 - DNA, 22 bp, Artificial Sequence
  chemically synthesized
aatcaaaagcactaagtgggac

SEQ ID NO: 744916 - DNA, 22 bp, Artificial Sequence
  chemically synthesized
ctgagtcccacttagtgctttt

SEQ ID NO: 744917 - DNA, 22 bp, Artificial Sequence
  chemically synthesized
cacccactgaatcaaaagcact

SEQ ID NO: 744918 - DNA, 22 bp, Artificial Sequence
  chemically synthesized
acacccactgaatcaaaagcac

SEQ ID NO: 744919 - DNA, 22 bp, Artificial Sequence
  chemically synthesized
agtcccacttagtgcttttgat

SEQ ID NO: 744920 - DNA, 22 bp, Artificial Sequence
  chemically synthesized
agtgcttttgattcagtgggtg

SEQ ID NO: 744921 - DNA, 22 bp, Artificial Sequence
  chemically synthesized
aggcccaccttacacccactga

SEQ ID NO: 744922 - DNA, 22 bp, Artificial Sequence
  chemically synthesized
gtgcttttgattcagtgggtgt

SEQ ID NO: 744923 - DNA, 22 bp, Artificial Sequence
  chemically synthesized
tcaggcccaccttacacccact

SEQ ID NO: 744924 - DNA, 22 bp, Artificial Sequence
  chemically synthesized
ttgattcagtgggtgtaaggtg

SEQ ID NO: 744925 - DNA, 22 bp, Artificial Sequence
  chemically synthesized
tgattcagtgggtgtaaggtgg

SEQ ID NO: 744926 - DNA, 22 bp, Artificial Sequence
  chemically synthesized
gattcagtgggtgtaaggtggg

SEQ ID NO: 744927 - DNA, 22 bp, Artificial Sequence
  chemically synthesized
attcagtgggtgtaaggtgggc

SEQ ID NO: 744928 - DNA, 22 bp, Artificial Sequence
  chemically synthesized
agtgggtgtaaggtgggcctga

SEQ ID NO: 744929 - DNA, 22 bp, Artificial Sequence
  chemically synthesized
gaaatgccaaattctcaggccc

SEQ ID NO: 744930 - DNA, 22 bp, Artificial Sequence
  chemically synthesized
ttagaaatgccaaattctcagg

SEQ ID NO: 744931 - DNA, 22 bp, Artificial Sequence
  chemically synthesized
attagaaatgccaaattctcag

SEQ ID NO: 744932 - DNA, 22 bp, Artificial Sequence
  chemically synthesized
ttattagaaatgccaaattctc

SEQ ID NO: 744933 - DNA, 22 bp, Artificial Sequence
  chemically synthesized
cttattagaaatgccaaattct

SEQ ID NO: 744934 - DNA, 22 bp, Artificial Sequence
  chemically synthesized
acttcttattagaaatgccaaa

SEQ ID NO: 744935 - DNA, 22 bp, Artificial Sequence
  chemically synthesized
taacttcttattagaaatgcca

SEQ ID NO: 744936 - DNA, 22 bp, Artificial Sequence
  chemically synthesized
ctaacttcttattagaaatgcc

SEQ ID NO: 744937 - DNA, 22 bp, Artificial Sequence
  chemically synthesized
tctaacttcttattagaaatgc

SEQ ID NO: 744938 - DNA, 22 bp, Artificial Sequence
  chemically synthesized
agaatttggcatttctaataag

SEQ ID NO: 744939 - DNA, 22 bp, Artificial Sequence
  chemically synthesized
aacattttctaacttcttatta

SEQ ID NO: 744940 - DNA, 22 bp, Artificial Sequence
  chemically synthesized
ggcatttctaataagaagttag

SEQ ID NO: 744941 - DNA, 22 bp, Artificial Sequence
  chemically synthesized
gcatttctaataagaagttaga

SEQ ID NO: 744942 - DNA, 22 bp, Artificial Sequence
  chemically synthesized
ggaactcaacattttctaactt

SEQ ID NO: 744943 - DNA, 22 bp, Artificial Sequence
  chemically synthesized
taggaactcaacattttctaac

SEQ ID NO: 744944 - DNA, 22 bp, Artificial Sequence
  chemically synthesized
ctaataagaagttagaaaatgt

SEQ ID NO: 744945 - DNA, 22 bp, Artificial Sequence
  chemically synthesized
taataagaagttagaaaatgtt

SEQ ID NO: 744946 - DNA, 22 bp, Artificial Sequence
  chemically synthesized
ataagaagttagaaaatgttga

SEQ ID NO: 744947 - DNA, 22 bp, Artificial Sequence
  chemically synthesized
atgagttctaggaactcaacat

SEQ ID NO: 744948 - DNA, 22 bp, Artificial Sequence
  chemically synthesized
gatgagttctaggaactcaaca

SEQ ID NO: 744949 - DNA, 22 bp, Artificial Sequence
  chemically synthesized
gaaaatgttgagttcctagaac

SEQ ID NO: 744950 - DNA, 22 bp, Artificial Sequence
  chemically synthesized
agttcctagaactcatcaagct

SEQ ID NO: 744951 - DNA, 22 bp, Artificial Sequence
  chemically synthesized
ctagaactcatcaagcttttta

SEQ ID NO: 744952 - DNA, 22 bp, Artificial Sequence
  chemically synthesized
gaactcatcaagctttttattt

SEQ ID NO: 744953 - DNA, 22 bp, Artificial Sequence
  chemically synthesized
atcaagctttttatttctttat

SEQ ID NO: 744954 - DNA, 22 bp, Artificial Sequence
  chemically synthesized
aaaaataaaataaaaataaata

SEQ ID NO: 744955 - DNA, 22 bp, Artificial Sequence
  chemically synthesized
tttatttctttatttattttta

SEQ ID NO: 744956 - DNA, 22 bp, Artificial Sequence
  chemically synthesized
ttatttctttatttatttttat

SEQ ID NO: 744957 - DNA, 22 bp, Artificial Sequence
  chemically synthesized
tatttctttatttatttttatt

SEQ ID NO: 744958 - DNA, 22 bp, Artificial Sequence
  chemically synthesized
tctgaaaaataaaataaaaata

SEQ ID NO: 744959 - DNA, 22 bp, Artificial Sequence
  chemically synthesized
atttctttatttatttttattt

SEQ ID NO: 744960 - DNA, 22 bp, Artificial Sequence
  chemically synthesized
tttctttatttatttttatttt

SEQ ID NO: 744961 - DNA, 22 bp, Artificial Sequence
  chemically synthesized
ctttatttatttttattttatt

SEQ ID NO: 744962 - DNA, 22 bp, Artificial Sequence
  chemically synthesized
tttatttatttttattttattt

SEQ ID NO: 744963 - DNA, 22 bp, Artificial Sequence
  chemically synthesized
tatttatttttattttattttt

SEQ ID NO: 744964 - DNA, 22 bp, Artificial Sequence
  chemically synthesized
atttatttttattttatttttc

SEQ ID NO: 744965 - DNA, 22 bp, Artificial Sequence
  chemically synthesized
tttatttttattttatttttca

SEQ ID NO: 744966 - DNA, 22 bp, Artificial Sequence
  chemically synthesized
atttttattttatttttcagac

SEQ ID NO: 744967 - DNA, 22 bp, Artificial Sequence
  chemically synthesized
tttttattttatttttcagaca

SEQ ID NO: 744968 - DNA, 22 bp, Artificial Sequence
  chemically synthesized
ttattttatttttcagacaggg

SEQ ID NO: 744969 - DNA, 22 bp, Artificial Sequence
  chemically synthesized
tattttatttttcagacagggc

SEQ ID NO: 744970 - DNA, 22 bp, Artificial Sequence
  chemically synthesized
attttatttttcagacagggcc

SEQ ID NO: 744971 - DNA, 22 bp, Artificial Sequence
  chemically synthesized
ttttatttttcagacagggcct

SEQ ID NO: 744972 - DNA, 22 bp, Artificial Sequence
  chemically synthesized
ggcgacagaaagaggccctgtc

SEQ ID NO: 744973 - DNA, 22 bp, Artificial Sequence
  chemically synthesized
tatttttcagacagggcctctt

SEQ ID NO: 744974 - DNA, 22 bp, Artificial Sequence
  chemically synthesized
atttttcagacagggcctcttt

SEQ ID NO: 744975 - DNA, 22 bp, Artificial Sequence
  chemically synthesized
tttttcagacagggcctctttc

SEQ ID NO: 744976 - DNA, 22 bp, Artificial Sequence
  chemically synthesized
cagcctgggcgacagaaagagg

SEQ ID NO: 744977 - DNA, 22 bp, Artificial Sequence
  chemically synthesized
ttcagacagggcctctttctgt

SEQ ID NO: 744978 - DNA, 22 bp, Artificial Sequence
  chemically synthesized
tcagacagggcctctttctgtc

SEQ ID NO: 744979 - DNA, 22 bp, Artificial Sequence
  chemically synthesized
cagacagggcctctttctgtcg

SEQ ID NO: 744980 - DNA, 22 bp, Artificial Sequence
  chemically synthesized
agacagggcctctttctgtcgc

SEQ ID NO: 744981 - DNA, 22 bp, Artificial Sequence
  chemically synthesized
cactccagcctgggcgacagaa

SEQ ID NO: 744982 - DNA, 22 bp, Artificial Sequence
  chemically synthesized
ctgcactccagcctgggcgaca

SEQ ID NO: 744983 - DNA, 22 bp, Artificial Sequence
  chemically synthesized
tttctgtcgcccaggctggagt

SEQ ID NO: 744984 - DNA, 22 bp, Artificial Sequence
  chemically synthesized
tctgtcgcccaggctggagtgc

SEQ ID NO: 744985 - DNA, 22 bp, Artificial Sequence
  chemically synthesized
ctgtcgcccaggctggagtgca

SEQ ID NO: 744986 - DNA, 22 bp, Artificial Sequence
  chemically synthesized
tgatcgcactgctgcactccag

SEQ ID NO: 744987 - DNA, 22 bp, Artificial Sequence
  chemically synthesized
tgtcgcccaggctggagtgcag

SEQ ID NO: 744988 - DNA, 22 bp, Artificial Sequence
  chemically synthesized
tcgcccaggctggagtgcagca

SEQ ID NO: 744989 - DNA, 22 bp, Artificial Sequence
  chemically synthesized
cagtgagctatgatcgcactgc

SEQ ID NO: 744990 - DNA, 22 bp, Artificial Sequence
  chemically synthesized
gagtgcagcagtgcgatcatag

SEQ ID NO: 744991 - DNA, 22 bp, Artificial Sequence
  chemically synthesized
aggctgcagtgagctatgatcg

SEQ ID NO: 744992 - DNA, 22 bp, Artificial Sequence
  chemically synthesized
gaggctgcagtgagctatgatc

SEQ ID NO: 744993 - DNA, 22 bp, Artificial Sequence
  chemically synthesized
agcccaggagtttgaggctgca

SEQ ID NO: 744994 - DNA, 22 bp, Artificial Sequence
  chemically synthesized
gagcccaggagtttgaggctgc

SEQ ID NO: 744995 - DNA, 22 bp, Artificial Sequence
  chemically synthesized
actgcagcctcaaactcctggg

SEQ ID NO: 744996 - DNA, 22 bp, Artificial Sequence
  chemically synthesized
cagcctcaaactcctgggctca

SEQ ID NO: 744997 - DNA, 22 bp, Artificial Sequence
  chemically synthesized
aagcaggaggatcgcttgagcc

SEQ ID NO: 744998 - DNA, 22 bp, Artificial Sequence
  chemically synthesized
aaactcctgggctcaagcgatc

SEQ ID NO: 744999 - DNA, 22 bp, Artificial Sequence
  chemically synthesized
ggaggctgaagcaggaggatcg

SEQ ID NO: 745000 - DNA, 22 bp, Artificial Sequence
  chemically synthesized
ctgggctcaagcgatcctcctg

SEQ ID NO: 745001 - DNA, 22 bp, Artificial Sequence
  chemically synthesized
gggaggctgaagcaggaggatc

SEQ ID NO: 745002 - DNA, 22 bp, Artificial Sequence
  chemically synthesized
ggctcaagcgatcctcctgctt

SEQ ID NO: 745003 - DNA, 22 bp, Artificial Sequence
  chemically synthesized
acttgggaggctgaagcaggag

SEQ ID NO: 745004 - DNA, 22 bp, Artificial Sequence
  chemically synthesized
aagcgatcctcctgcttcagcc

SEQ ID NO: 745005 - DNA, 22 bp, Artificial Sequence
  chemically synthesized
gctaacttgggaggctgaagca

SEQ ID NO: 745006 - DNA, 22 bp, Artificial Sequence
  chemically synthesized
tagtcctggctaacttgggagg

SEQ ID NO: 745007 - DNA, 22 bp, Artificial Sequence
  chemically synthesized
gtagtcctggctaacttgggag

SEQ ID NO: 745008 - DNA, 22 bp, Artificial Sequence
  chemically synthesized
ctgcttcagcctcccaagttag

SEQ ID NO: 745009 - DNA, 22 bp, Artificial Sequence
  chemically synthesized
cttcagcctcccaagttagcca

SEQ ID NO: 745010 - DNA, 22 bp, Artificial Sequence
  chemically synthesized
cagcctcccaagttagccagga

SEQ ID NO: 745011 - DNA, 22 bp, Artificial Sequence
  chemically synthesized
agcctcccaagttagccaggac

SEQ ID NO: 745012 - DNA, 22 bp, Artificial Sequence
  chemically synthesized
ccaagttagccaggactacaag

SEQ ID NO: 745013 - DNA, 22 bp, Artificial Sequence
  chemically synthesized
gccaggactacaagcacacacc

SEQ ID NO: 745014 - DNA, 22 bp, Artificial Sequence
  chemically synthesized
caagcacacaccactggcattg

SEQ ID NO: 745015 - DNA, 22 bp, Artificial Sequence
  chemically synthesized
aaaatatatatatatcaatgcc

SEQ ID NO: 745016 - DNA, 22 bp, Artificial Sequence
  chemically synthesized
aaaaatatatatatatcaatgc

SEQ ID NO: 745017 - DNA, 22 bp, Artificial Sequence
  chemically synthesized
acttaaaaatatatatatatca

SEQ ID NO: 745018 - DNA, 22 bp, Artificial Sequence
  chemically synthesized
gcattgatatatatatattttt

SEQ ID NO: 745019 - DNA, 22 bp, Artificial Sequence
  chemically synthesized
atatatatatatttttaagtta

SEQ ID NO: 745020 - DNA, 22 bp, Artificial Sequence
  chemically synthesized
ttaagttagttttttctttttc

SEQ ID NO: 745021 - DNA, 22 bp, Artificial Sequence
  chemically synthesized
taagttagttttttctttttct

SEQ ID NO: 745022 - DNA, 22 bp, Artificial Sequence
  chemically synthesized
aagttagttttttctttttctt

SEQ ID NO: 745023 - DNA, 22 bp, Artificial Sequence
  chemically synthesized
agttagttttttctttttcttt

SEQ ID NO: 745024 - DNA, 22 bp, Artificial Sequence
  chemically synthesized
gttttttctttttctttttttt

SEQ ID NO: 745025 - DNA, 22 bp, Artificial Sequence
  chemically synthesized
gcaaaaaaaaaaaaaaaaaaga

SEQ ID NO: 745026 - DNA, 22 bp, Artificial Sequence
  chemically synthesized
tttctttttctttttttttttt

SEQ ID NO: 745027 - DNA, 22 bp, Artificial Sequence
  chemically synthesized
ttctttttcttttttttttttt

SEQ ID NO: 745028 - DNA, 22 bp, Artificial Sequence
  chemically synthesized
tctttttctttttttttttttt

SEQ ID NO: 745029 - DNA, 22 bp, Artificial Sequence
  chemically synthesized
ctttttcttttttttttttttt

SEQ ID NO: 745030 - DNA, 22 bp, Artificial Sequence
  chemically synthesized
tttttctttttttttttttttt

SEQ ID NO: 745031 - DNA, 22 bp, Artificial Sequence
  chemically synthesized
tttctttttttttttttttttt

SEQ ID NO: 745032 - DNA, 22 bp, Artificial Sequence
  chemically synthesized
ttcttttttttttttttttttg

SEQ ID NO: 745033 - DNA, 22 bp, Artificial Sequence
  chemically synthesized
tcttttttttttttttttttgc

SEQ ID NO: 745034 - DNA, 22 bp, Artificial Sequence
  chemically synthesized
cttttttttttttttttttgcg

SEQ ID NO: 745035 - DNA, 22 bp, Artificial Sequence
  chemically synthesized
ttttttttttttttttttgcga

SEQ ID NO: 745036 - DNA, 22 bp, Artificial Sequence
  chemically synthesized
ttttttttttttttttgcgaga

SEQ ID NO: 745037 - DNA, 22 bp, Artificial Sequence
  chemically synthesized
tttttttttttttttgcgagat

SEQ ID NO: 745038 - DNA, 22 bp, Artificial Sequence
  chemically synthesized
ttttttttttttttgcgagatg

SEQ ID NO: 745039 - DNA, 22 bp, Artificial Sequence
  chemically synthesized
tttttttttttttgcgagatgg

SEQ ID NO: 745040 - DNA, 22 bp, Artificial Sequence
  chemically synthesized
ttttttttttttgcgagatggg

SEQ ID NO: 745041 - DNA, 22 bp, Artificial Sequence
  chemically synthesized
tttttttttttgcgagatggga

SEQ ID NO: 745042 - DNA, 22 bp, Artificial Sequence
  chemically synthesized
ttttttttttgcgagatgggat

SEQ ID NO: 745043 - DNA, 22 bp, Artificial Sequence
  chemically synthesized
tttttttttgcgagatgggatc

SEQ ID NO: 745044 - DNA, 22 bp, Artificial Sequence
  chemically synthesized
ttttttttgcgagatgggatct

SEQ ID NO: 745045 - DNA, 22 bp, Artificial Sequence
  chemically synthesized
gaaaacatagagagatcccatc

SEQ ID NO: 745046 - DNA, 22 bp, Artificial Sequence
  chemically synthesized
tttttttgcgagatgggatctc

SEQ ID NO: 745047 - DNA, 22 bp, Artificial Sequence
  chemically synthesized
ttttttgcgagatgggatctct

SEQ ID NO: 745048 - DNA, 22 bp, Artificial Sequence
  chemically synthesized
tttttgcgagatgggatctctc

SEQ ID NO: 745049 - DNA, 22 bp, Artificial Sequence
  chemically synthesized
ttttgcgagatgggatctctct

SEQ ID NO: 745050 - DNA, 22 bp, Artificial Sequence
  chemically synthesized
tttgcgagatgggatctctcta

SEQ ID NO: 745051 - DNA, 22 bp, Artificial Sequence
  chemically synthesized
ttgcgagatgggatctctctat

SEQ ID NO: 745052 - DNA, 22 bp, Artificial Sequence
  chemically synthesized
tgcgagatgggatctctctatg

SEQ ID NO: 745053 - DNA, 22 bp, Artificial Sequence
  chemically synthesized
gcgagatgggatctctctatgt

SEQ ID NO: 745054 - DNA, 22 bp, Artificial Sequence
  chemically synthesized
cgagatgggatctctctatgtt

SEQ ID NO: 745055 - DNA, 22 bp, Artificial Sequence
  chemically synthesized
agaccagcctggaaaacataga

SEQ ID NO: 745056 - DNA, 22 bp, Artificial Sequence
  chemically synthesized
gagaccagcctggaaaacatag

SEQ ID NO: 745057 - DNA, 22 bp, Artificial Sequence
  chemically synthesized
tctatgttttccaggctggtct

SEQ ID NO: 745058 - DNA, 22 bp, Artificial Sequence
  chemically synthesized
tatgttttccaggctggtctca

SEQ ID NO: 745059 - DNA, 22 bp, Artificial Sequence
  chemically synthesized
agcccaggagtttgagaccagc

SEQ ID NO: 745060 - DNA, 22 bp, Artificial Sequence
  chemically synthesized
gagcccaggagtttgagaccag

SEQ ID NO: 745061 - DNA, 22 bp, Artificial Sequence
  chemically synthesized
tgttttccaggctggtctcaaa

SEQ ID NO: 745062 - DNA, 22 bp, Artificial Sequence
  chemically synthesized
tccaggctggtctcaaactcct

SEQ ID NO: 745063 - DNA, 22 bp, Artificial Sequence
  chemically synthesized
ccaggctggtctcaaactcctg

SEQ ID NO: 745064 - DNA, 22 bp, Artificial Sequence
  chemically synthesized
caggctggtctcaaactcctgg

SEQ ID NO: 745065 - DNA, 22 bp, Artificial Sequence
  chemically synthesized
gtctcaaactcctgggctcaag

SEQ ID NO: 745066 - DNA, 22 bp, Artificial Sequence
  chemically synthesized
aaactcctgggctcaagtgatc

SEQ ID NO: 745067 - DNA, 22 bp, Artificial Sequence
  chemically synthesized
ggaggccgaagtgggaggatca

SEQ ID NO: 745068 - DNA, 22 bp, Artificial Sequence
  chemically synthesized
ctgggctcaagtgatcctccca

SEQ ID NO: 745069 - DNA, 22 bp, Artificial Sequence
  chemically synthesized
gggaggccgaagtgggaggatc

SEQ ID NO: 745070 - DNA, 22 bp, Artificial Sequence
  chemically synthesized
tgggaggccgaagtgggaggat

SEQ ID NO: 745071 - DNA, 22 bp, Artificial Sequence
  chemically synthesized
ggctcaagtgatcctcccactt

SEQ ID NO: 745072 - DNA, 22 bp, Artificial Sequence
  chemically synthesized
aagtgatcctcccacttcggcc

SEQ ID NO: 745073 - DNA, 22 bp, Artificial Sequence
  chemically synthesized
taatcccaacactttgggaggc

SEQ ID NO: 745074 - DNA, 22 bp, Artificial Sequence
  chemically synthesized
gtaatcccaacactttgggagg

SEQ ID NO: 745075 - DNA, 22 bp, Artificial Sequence
  chemically synthesized
ccacttcggcctcccaaagtgt

SEQ ID NO: 745076 - DNA, 22 bp, Artificial Sequence
  chemically synthesized
atgcttgtaatcccaacacttt

SEQ ID NO: 745077 - DNA, 22 bp, Artificial Sequence
  chemically synthesized
cggcctcccaaagtgttgggat

SEQ ID NO: 745078 - DNA, 22 bp, Artificial Sequence
  chemically synthesized
ggcctcccaaagtgttgggatt

SEQ ID NO: 745079 - DNA, 22 bp, Artificial Sequence
  chemically synthesized
ccaaagtgttgggattacaagc

SEQ ID NO: 745080 - DNA, 22 bp, Artificial Sequence
  chemically synthesized
ggccaggcacggtggctcatgc

SEQ ID NO: 745081 - DNA, 22 bp, Artificial Sequence
  chemically synthesized
gggccaggcacggtggctcatg

SEQ ID NO: 745082 - DNA, 22 bp, Artificial Sequence
  chemically synthesized
ggattacaagcatgagccaccg

SEQ ID NO: 745083 - DNA, 22 bp, Artificial Sequence
  chemically synthesized
caagcatgagccaccgtgcctg

SEQ ID NO: 745084 - DNA, 22 bp, Artificial Sequence
  chemically synthesized
agtcaagagtaagcttgggcca

SEQ ID NO: 745085 - DNA, 22 bp, Artificial Sequence
  chemically synthesized
taagtcaagagtaagcttgggc

SEQ ID NO: 745086 - DNA, 22 bp, Artificial Sequence
  chemically synthesized
aaggttctaagtcaagagtaag

SEQ ID NO: 745087 - DNA, 22 bp, Artificial Sequence
  chemically synthesized
gcccaagcttactcttgactta

SEQ ID NO: 745088 - DNA, 22 bp, Artificial Sequence
  chemically synthesized
actcttgacttagaaccttcag

SEQ ID NO: 745089 - DNA, 22 bp, Artificial Sequence
  chemically synthesized
ctcttgacttagaaccttcaga

SEQ ID NO: 745090 - DNA, 22 bp, Artificial Sequence
  chemically synthesized
ttgacttagaaccttcagatac

SEQ ID NO: 745091 - DNA, 22 bp, Artificial Sequence
  chemically synthesized
gacttagaaccttcagatacac

SEQ ID NO: 745092 - DNA, 22 bp, Artificial Sequence
  chemically synthesized
acttagaaccttcagatacact

SEQ ID NO: 745093 - DNA, 22 bp, Artificial Sequence
  chemically synthesized
caagcagagggaacagtgtatc

SEQ ID NO: 745094 - DNA, 22 bp, Artificial Sequence
  chemically synthesized
agaaccttcagatacactgttc

SEQ ID NO: 745095 - DNA, 22 bp, Artificial Sequence
  chemically synthesized
gaaccttcagatacactgttcc

SEQ ID NO: 745096 - DNA, 22 bp, Artificial Sequence
  chemically synthesized
cagatacactgttccctctgct

SEQ ID NO: 745097 - DNA, 22 bp, Artificial Sequence
  chemically synthesized
agatacactgttccctctgctt

SEQ ID NO: 745098 - DNA, 22 bp, Artificial Sequence
  chemically synthesized
ttccctctgcttggagttttat

SEQ ID NO: 745099 - DNA, 22 bp, Artificial Sequence
  chemically synthesized
cctctgcttggagttttatata

SEQ ID NO: 745100 - DNA, 22 bp, Artificial Sequence
  chemically synthesized
ggcataaagtggatatataaaa

SEQ ID NO: 745101 - DNA, 22 bp, Artificial Sequence
  chemically synthesized
tgcttggagttttatatatcca

SEQ ID NO: 745102 - DNA, 22 bp, Artificial Sequence
  chemically synthesized
cttggagttttatatatccact

SEQ ID NO: 745103 - DNA, 22 bp, Artificial Sequence
  chemically synthesized
ggagttttatatatccacttta

SEQ ID NO: 745104 - DNA, 22 bp, Artificial Sequence
  chemically synthesized
gagttttatatatccactttat

SEQ ID NO: 745105 - DNA, 22 bp, Artificial Sequence
  chemically synthesized
tatatatccactttatgcctag

SEQ ID NO: 745106 - DNA, 22 bp, Artificial Sequence
  chemically synthesized
atatatccactttatgcctagc

SEQ ID NO: 745107 - DNA, 22 bp, Artificial Sequence
  chemically synthesized
tatatccactttatgcctagct

SEQ ID NO: 745108 - DNA, 22 bp, Artificial Sequence
  chemically synthesized
tatgcctagctggctcttattc

SEQ ID NO: 745109 - DNA, 22 bp, Artificial Sequence
  chemically synthesized
atgcctagctggctcttattca

SEQ ID NO: 745110 - DNA, 22 bp, Artificial Sequence
  chemically synthesized
tgcctagctggctcttattcat

SEQ ID NO: 745111 - DNA, 22 bp, Artificial Sequence
  chemically synthesized
agatcagaagtatatgaataag

SEQ ID NO: 745112 - DNA, 22 bp, Artificial Sequence
  chemically synthesized
actgagatcagaagtatatgaa

SEQ ID NO: 745113 - DNA, 22 bp, Artificial Sequence
  chemically synthesized
gctggctcttattcatatactt

SEQ ID NO: 745114 - DNA, 22 bp, Artificial Sequence
  chemically synthesized
gctcttattcatatacttctga

SEQ ID NO: 745115 - DNA, 22 bp, Artificial Sequence
  chemically synthesized
ttattcatatacttctgatctc

SEQ ID NO: 745116 - DNA, 22 bp, Artificial Sequence
  chemically synthesized
attcatatacttctgatctcag

SEQ ID NO: 745117 - DNA, 22 bp, Artificial Sequence
  chemically synthesized
ttcatatacttctgatctcagt

SEQ ID NO: 745118 - DNA, 22 bp, Artificial Sequence
  chemically synthesized
aaagtcacatctaactgagatc

SEQ ID NO: 745119 - DNA, 22 bp, Artificial Sequence
  chemically synthesized
aaaagtcacatctaactgagat

SEQ ID NO: 745120 - DNA, 22 bp, Artificial Sequence
  chemically synthesized
atatacttctgatctcagttag

SEQ ID NO: 745121 - DNA, 22 bp, Artificial Sequence
  chemically synthesized
taaaagtcacatctaactgaga

SEQ ID NO: 745122 - DNA, 22 bp, Artificial Sequence
  chemically synthesized
tctttaaaagtcacatctaact

SEQ ID NO: 745123 - DNA, 22 bp, Artificial Sequence
  chemically synthesized
ctgatctcagttagatgtgact

SEQ ID NO: 745124 - DNA, 22 bp, Artificial Sequence
  chemically synthesized
tgatctcagttagatgtgactt

SEQ ID NO: 745125 - DNA, 22 bp, Artificial Sequence
  chemically synthesized
atctcagttagatgtgactttt

SEQ ID NO: 745126 - DNA, 22 bp, Artificial Sequence
  chemically synthesized
ggaataggctatctttaaaagt

SEQ ID NO: 745127 - DNA, 22 bp, Artificial Sequence
  chemically synthesized
agttagatgtgacttttaaaga

SEQ ID NO: 745128 - DNA, 22 bp, Artificial Sequence
  chemically synthesized
gatgtgacttttaaagatagcc

SEQ ID NO: 745129 - DNA, 22 bp, Artificial Sequence
  chemically synthesized
ttaaagatagcctattcccagt

SEQ ID NO: 745130 - DNA, 22 bp, Artificial Sequence
  chemically synthesized
taaagatagcctattcccagtt

SEQ ID NO: 745131 - DNA, 22 bp, Artificial Sequence
  chemically synthesized
cgtagggcaaccaactgggaat

SEQ ID NO: 745132 - DNA, 22 bp, Artificial Sequence
  chemically synthesized
aaagatagcctattcccagttg

SEQ ID NO: 745133 - DNA, 22 bp, Artificial Sequence
  chemically synthesized
acgtagggcaaccaactgggaa

SEQ ID NO: 745134 - DNA, 22 bp, Artificial Sequence
  chemically synthesized
aagatagcctattcccagttgg

SEQ ID NO: 745135 - DNA, 22 bp, Artificial Sequence
  chemically synthesized
tacgtagggcaaccaactggga

SEQ ID NO: 745136 - DNA, 22 bp, Artificial Sequence
  chemically synthesized
ttcccagttggttgccctacgt

SEQ ID NO: 745137 - DNA, 22 bp, Artificial Sequence
  chemically synthesized
ccagttggttgccctacgtaaa

SEQ ID NO: 745138 - DNA, 22 bp, Artificial Sequence
  chemically synthesized
gttgccctacgtaaagtgtctc

SEQ ID NO: 745139 - DNA, 22 bp, Artificial Sequence
  chemically synthesized
ccctacgtaaagtgtctccttt

SEQ ID NO: 745140 - DNA, 22 bp, Artificial Sequence
  chemically synthesized
agagtcaaggaaaaaggagaca

SEQ ID NO: 745141 - DNA, 22 bp, Artificial Sequence
  chemically synthesized
cgtaaagtgtctcctttttcct

SEQ ID NO: 745142 - DNA, 22 bp, Artificial Sequence
  chemically synthesized
ctttttccttgactctcaacac

SEQ ID NO: 745143 - DNA, 22 bp, Artificial Sequence
  chemically synthesized
agaaggaaaatagggtgttgag

SEQ ID NO: 745144 - DNA, 22 bp, Artificial Sequence
  chemically synthesized
tttccttgactctcaacaccct

SEQ ID NO: 745145 - DNA, 22 bp, Artificial Sequence
  chemically synthesized
ttccttgactctcaacacccta

SEQ ID NO: 745146 - DNA, 22 bp, Artificial Sequence
  chemically synthesized
tccttgactctcaacaccctat

SEQ ID NO: 745147 - DNA, 22 bp, Artificial Sequence
  chemically synthesized
ccttgactctcaacaccctatt

SEQ ID NO: 745148 - DNA, 22 bp, Artificial Sequence
  chemically synthesized
cttgactctcaacaccctattt

SEQ ID NO: 745149 - DNA, 22 bp, Artificial Sequence
  chemically synthesized
gactctcaacaccctattttcc

SEQ ID NO: 745150 - DNA, 22 bp, Artificial Sequence
  chemically synthesized
actctcaacaccctattttcct

SEQ ID NO: 745151 - DNA, 22 bp, Artificial Sequence
  chemically synthesized
tgatcagggttcagaaggaaaa

SEQ ID NO: 745152 - DNA, 22 bp, Artificial Sequence
  chemically synthesized
tcaacaccctattttccttctg

SEQ ID NO: 745153 - DNA, 22 bp, Artificial Sequence
  chemically synthesized
aacaccctattttccttctgaa

SEQ ID NO: 745154 - DNA, 22 bp, Artificial Sequence
  chemically synthesized
caaattgtgatcagggttcaga

SEQ ID NO: 745155 - DNA, 22 bp, Artificial Sequence
  chemically synthesized
gcaaattgtgatcagggttcag

SEQ ID NO: 745156 - DNA, 22 bp, Artificial Sequence
  chemically synthesized
ttttccttctgaaccctgatca

SEQ ID NO: 745157 - DNA, 22 bp, Artificial Sequence
  chemically synthesized
tccttctgaaccctgatcacaa

SEQ ID NO: 745158 - DNA, 22 bp, Artificial Sequence
  chemically synthesized
ccttctgaaccctgatcacaat

SEQ ID NO: 745159 - DNA, 22 bp, Artificial Sequence
  chemically synthesized
cttctgaaccctgatcacaatt

SEQ ID NO: 745160 - DNA, 22 bp, Artificial Sequence
  chemically synthesized
ctgaaccctgatcacaatttgc

SEQ ID NO: 745161 - DNA, 22 bp, Artificial Sequence
  chemically synthesized
tgaaccctgatcacaatttgca

SEQ ID NO: 745162 - DNA, 22 bp, Artificial Sequence
  chemically synthesized
aaccctgatcacaatttgcaag

SEQ ID NO: 745163 - DNA, 22 bp, Artificial Sequence
  chemically synthesized
atcacaatttgcaagtacatat

SEQ ID NO: 745164 - DNA, 22 bp, Artificial Sequence
  chemically synthesized
gcaagtacatatatatttgcct

SEQ ID NO: 745165 - DNA, 22 bp, Artificial Sequence
  chemically synthesized
caagtacatatatatttgccta

SEQ ID NO: 745166 - DNA, 22 bp, Artificial Sequence
  chemically synthesized
ggaaggaacagacaatgaataa

SEQ ID NO: 745167 - DNA, 22 bp, Artificial Sequence
  chemically synthesized
gggaaggaacagacaatgaata

SEQ ID NO: 745168 - DNA, 22 bp, Artificial Sequence
  chemically synthesized
gcctattcatttattcattgtc

SEQ ID NO: 745169 - DNA, 22 bp, Artificial Sequence
  chemically synthesized
cctattcatttattcattgtct

SEQ ID NO: 745170 - DNA, 22 bp, Artificial Sequence
  chemically synthesized
gtcttgggaaggaacagacaat

SEQ ID NO: 745171 - DNA, 22 bp, Artificial Sequence
  chemically synthesized
ttcatttattcattgtctgttc

SEQ ID NO: 745172 - DNA, 22 bp, Artificial Sequence
  chemically synthesized
tggtcttgggaaggaacagaca

SEQ ID NO: 745173 - DNA, 22 bp, Artificial Sequence
  chemically synthesized
ctggtcttgggaaggaacagac

SEQ ID NO: 745174 - DNA, 22 bp, Artificial Sequence
  chemically synthesized
atttattcattgtctgttcctt

SEQ ID NO: 745175 - DNA, 22 bp, Artificial Sequence
  chemically synthesized
tctggtcttgggaaggaacaga

SEQ ID NO: 745176 - DNA, 22 bp, Artificial Sequence
  chemically synthesized
attcattgtctgttccttccca

SEQ ID NO: 745177 - DNA, 22 bp, Artificial Sequence
  chemically synthesized
ttcattgtctgttccttcccaa

SEQ ID NO: 745178 - DNA, 22 bp, Artificial Sequence
  chemically synthesized
attgtctgttccttcccaagac

SEQ ID NO: 745179 - DNA, 22 bp, Artificial Sequence
  chemically synthesized
ataaattttctggtcttgggaa

SEQ ID NO: 745180 - DNA, 22 bp, Artificial Sequence
  chemically synthesized
aataaattttctggtcttggga

SEQ ID NO: 745181 - DNA, 22 bp, Artificial Sequence
  chemically synthesized
tctgttccttcccaagaccaga

SEQ ID NO: 745182 - DNA, 22 bp, Artificial Sequence
  chemically synthesized
ccttaataaattttctggtctt

SEQ ID NO: 745183 - DNA, 22 bp, Artificial Sequence
  chemically synthesized
ttccttcccaagaccagaaaat

SEQ ID NO: 745184 - DNA, 22 bp, Artificial Sequence
  chemically synthesized
cttcccaagaccagaaaattta

SEQ ID NO: 745185 - DNA, 22 bp, Artificial Sequence
  chemically synthesized
cccaagaccagaaaatttatta

SEQ ID NO: 745186 - DNA, 22 bp, Artificial Sequence
  chemically synthesized
ccaagaccagaaaatttattaa

SEQ ID NO: 745187 - DNA, 22 bp, Artificial Sequence
  chemically synthesized
gtgaaaaacaataatgtaggat

SEQ ID NO: 745188 - DNA, 22 bp, Artificial Sequence
  chemically synthesized
attaaggcaatcctacattatt

SEQ ID NO: 745189 - DNA, 22 bp, Artificial Sequence
  chemically synthesized
ttaaggcaatcctacattattg

SEQ ID NO: 745190 - DNA, 22 bp, Artificial Sequence
  chemically synthesized
aggcaatcctacattattgttt

SEQ ID NO: 745191 - DNA, 22 bp, Artificial Sequence
  chemically synthesized
gcatatactggtgaaaaacaat

SEQ ID NO: 745192 - DNA, 22 bp, Artificial Sequence
  chemically synthesized
ggcatatactggtgaaaaacaa

SEQ ID NO: 745193 - DNA, 22 bp, Artificial Sequence
  chemically synthesized
tggcttggcatatactggtgaa

SEQ ID NO: 745194 - DNA, 22 bp, Artificial Sequence
  chemically synthesized
cattattgtttttcaccagtat

SEQ ID NO: 745195 - DNA, 22 bp, Artificial Sequence
  chemically synthesized
ttgtttttcaccagtatatgcc

SEQ ID NO: 745196 - DNA, 22 bp, Artificial Sequence
  chemically synthesized
tttttcaccagtatatgccaag

SEQ ID NO: 745197 - DNA, 22 bp, Artificial Sequence
  chemically synthesized
tcatgtactatggcttggcata

SEQ ID NO: 745198 - DNA, 22 bp, Artificial Sequence
  chemically synthesized
ttcaccagtatatgccaagcca

SEQ ID NO: 745199 - DNA, 22 bp, Artificial Sequence
  chemically synthesized
tcaccagtatatgccaagccat

SEQ ID NO: 745200 - DNA, 22 bp, Artificial Sequence
  chemically synthesized
caccagtatatgccaagccata

SEQ ID NO: 745201 - DNA, 22 bp, Artificial Sequence
  chemically synthesized
accagtatatgccaagccatag

SEQ ID NO: 745202 - DNA, 22 bp, Artificial Sequence
  chemically synthesized
agggattatcatgtactatggc

SEQ ID NO: 745203 - DNA, 22 bp, Artificial Sequence
  chemically synthesized
ataaaaatgtattgagggatta

SEQ ID NO: 745204 - DNA, 22 bp, Artificial Sequence
  chemically synthesized
aataaaaatgtattgagggatt

SEQ ID NO: 745205 - DNA, 22 bp, Artificial Sequence
  chemically synthesized
taataaaaatgtattgagggat

SEQ ID NO: 745206 - DNA, 22 bp, Artificial Sequence
  chemically synthesized
tttaataaaaatgtattgaggg

SEQ ID NO: 745207 - DNA, 22 bp, Artificial Sequence
  chemically synthesized
ttctttaataaaaatgtattga

SEQ ID NO: 745208 - DNA, 22 bp, Artificial Sequence
  chemically synthesized
gttctttaataaaaatgtattg

SEQ ID NO: 745209 - DNA, 22 bp, Artificial Sequence
  chemically synthesized
cttgttctttaataaaaatgta

SEQ ID NO: 745210 - DNA, 22 bp, Artificial Sequence
  chemically synthesized
actgcttgttctttaataaaaa

SEQ ID NO: 745211 - DNA, 22 bp, Artificial Sequence
  chemically synthesized
gactgcttgttctttaataaaa

SEQ ID NO: 745212 - DNA, 22 bp, Artificial Sequence
  chemically synthesized
ttgactgcttgttctttaataa

SEQ ID NO: 745213 - DNA, 22 bp, Artificial Sequence
  chemically synthesized
tcttgactgcttgttctttaat

SEQ ID NO: 745214 - DNA, 22 bp, Artificial Sequence
  chemically synthesized
aatacatttttattaaagaaca

SEQ ID NO: 745215 - DNA, 22 bp, Artificial Sequence
  chemically synthesized
attctcttgactgcttgttctt

SEQ ID NO: 745216 - DNA, 22 bp, Artificial Sequence
  chemically synthesized
ttattaaagaacaagcagtcaa

SEQ ID NO: 745217 - DNA, 22 bp, Artificial Sequence
  chemically synthesized
tattaaagaacaagcagtcaag

SEQ ID NO: 745218 - DNA, 22 bp, Artificial Sequence
  chemically synthesized
attaaagaacaagcagtcaaga

SEQ ID NO: 745219 - DNA, 22 bp, Artificial Sequence
  chemically synthesized
ttaaagaacaagcagtcaagag

SEQ ID NO: 745220 - DNA, 22 bp, Artificial Sequence
  chemically synthesized
aagaacaagcagtcaagagaat

SEQ ID NO: 745221 - DNA, 22 bp, Artificial Sequence
  chemically synthesized
gtacagaagtgcctaattctct

SEQ ID NO: 745222 - DNA, 22 bp, Artificial Sequence
  chemically synthesized
gtaattagtacagaagtgccta

SEQ ID NO: 745223 - DNA, 22 bp, Artificial Sequence
  chemically synthesized
aagtattagtaattagtacaga

SEQ ID NO: 745224 - DNA, 22 bp, Artificial Sequence
  chemically synthesized
gtctgaagtattagtaattagt

SEQ ID NO: 745225 - DNA, 22 bp, Artificial Sequence
  chemically synthesized
ggcacttctgtactaattacta

SEQ ID NO: 745226 - DNA, 22 bp, Artificial Sequence
  chemically synthesized
ttggtctgaagtattagtaatt

SEQ ID NO: 745227 - DNA, 22 bp, Artificial Sequence
  chemically synthesized
ctgtactaattactaatacttc

SEQ ID NO: 745228 - DNA, 22 bp, Artificial Sequence
  chemically synthesized
tgtactaattactaatacttca

SEQ ID NO: 745229 - DNA, 22 bp, Artificial Sequence
  chemically synthesized
tactaattactaatacttcaga

SEQ ID NO: 745230 - DNA, 22 bp, Artificial Sequence
  chemically synthesized
acaatagctattggtctgaagt

SEQ ID NO: 745231 - DNA, 22 bp, Artificial Sequence
  chemically synthesized
attactaatacttcagaccaat

SEQ ID NO: 745232 - DNA, 22 bp, Artificial Sequence
  chemically synthesized
ctaatacttcagaccaatagct

SEQ ID NO: 745233 - DNA, 22 bp, Artificial Sequence
  chemically synthesized
atacttcagaccaatagctatt

SEQ ID NO: 745234 - DNA, 22 bp, Artificial Sequence
  chemically synthesized
cgaagcagtctgacaatagcta

SEQ ID NO: 745235 - DNA, 22 bp, Artificial Sequence
  chemically synthesized
acgaagcagtctgacaatagct

SEQ ID NO: 745236 - DNA, 22 bp, Artificial Sequence
  chemically synthesized
cagaccaatagctattgtcaga

SEQ ID NO: 745237 - DNA, 22 bp, Artificial Sequence
  chemically synthesized
tttacgaagcagtctgacaata

SEQ ID NO: 745238 - DNA, 22 bp, Artificial Sequence
  chemically synthesized
agaccaatagctattgtcagac

SEQ ID NO: 745239 - DNA, 22 bp, Artificial Sequence
  chemically synthesized
tgagaaactgtttacgaagcag

SEQ ID NO: 745240 - DNA, 22 bp, Artificial Sequence
  chemically synthesized
tgtgagaaactgtttacgaagc

SEQ ID NO: 745241 - DNA, 22 bp, Artificial Sequence
  chemically synthesized
ctgtgagaaactgtttacgaag

SEQ ID NO: 745242 - DNA, 22 bp, Artificial Sequence
  chemically synthesized
ttgtcagactgcttcgtaaaca

SEQ ID NO: 745243 - DNA, 22 bp, Artificial Sequence
  chemically synthesized
tcagactgcttcgtaaacagtt

SEQ ID NO: 745244 - DNA, 22 bp, Artificial Sequence
  chemically synthesized
tgtcaggtttctgtgagaaact

SEQ ID NO: 745245 - DNA, 22 bp, Artificial Sequence
  chemically synthesized
cttcgtaaacagtttctcacag

SEQ ID NO: 745246 - DNA, 22 bp, Artificial Sequence
  chemically synthesized
tatgtcaggtttctgtgagaaa

SEQ ID NO: 745247 - DNA, 22 bp, Artificial Sequence
  chemically synthesized
cgtaaacagtttctcacagaaa

SEQ ID NO: 745248 - DNA, 22 bp, Artificial Sequence
  chemically synthesized
gtaaacagtttctcacagaaac

SEQ ID NO: 745249 - DNA, 22 bp, Artificial Sequence
  chemically synthesized
ggaactctatgtcaggtttctg

SEQ ID NO: 745250 - DNA, 22 bp, Artificial Sequence
  chemically synthesized
aggaactctatgtcaggtttct

SEQ ID NO: 745251 - DNA, 22 bp, Artificial Sequence
  chemically synthesized
tttaggaactctatgtcaggtt

SEQ ID NO: 745252 - DNA, 22 bp, Artificial Sequence
  chemically synthesized
atttaggaactctatgtcaggt

SEQ ID NO: 745253 - DNA, 22 bp, Artificial Sequence
  chemically synthesized
ttatttaggaactctatgtcag

SEQ ID NO: 745254 - DNA, 22 bp, Artificial Sequence
  chemically synthesized
ctcacagaaacctgacatagag

SEQ ID NO: 745255 - DNA, 22 bp, Artificial Sequence
  chemically synthesized
tcacagaaacctgacatagagt

SEQ ID NO: 745256 - DNA, 22 bp, Artificial Sequence
  chemically synthesized
tcttatttaggaactctatgtc

SEQ ID NO: 745257 - DNA, 22 bp, Artificial Sequence
  chemically synthesized
ctcttatttaggaactctatgt

SEQ ID NO: 745258 - DNA, 22 bp, Artificial Sequence
  chemically synthesized
acagaaacctgacatagagttc

SEQ ID NO: 745259 - DNA, 22 bp, Artificial Sequence
  chemically synthesized
tctcttatttaggaactctatg

SEQ ID NO: 745260 - DNA, 22 bp, Artificial Sequence
  chemically synthesized
acatagagttcctaaataagag

SEQ ID NO: 745261 - DNA, 22 bp, Artificial Sequence
  chemically synthesized
ctaaataagagaaagctaccca

SEQ ID NO: 745262 - DNA, 22 bp, Artificial Sequence
  chemically synthesized
aataagagaaagctacccattt

SEQ ID NO: 745263 - DNA, 22 bp, Artificial Sequence
  chemically synthesized
agatatgggataaggaaaatgg

SEQ ID NO: 745264 - DNA, 22 bp, Artificial Sequence
  chemically synthesized
cccattttccttatcccatatc

SEQ ID NO: 745265 - DNA, 22 bp, Artificial Sequence
  chemically synthesized
tccttatcccatatctgaatta

SEQ ID NO: 745266 - DNA, 22 bp, Artificial Sequence
  chemically synthesized
ccttatcccatatctgaattat

SEQ ID NO: 745267 - DNA, 22 bp, Artificial Sequence
  chemically synthesized
cttatcccatatctgaattatt

SEQ ID NO: 745268 - DNA, 22 bp, Artificial Sequence
  chemically synthesized
atcccatatctgaattatttat

SEQ ID NO: 745269 - DNA, 22 bp, Artificial Sequence
  chemically synthesized
tcccatatctgaattatttata

SEQ ID NO: 745270 - DNA, 22 bp, Artificial Sequence
  chemically synthesized
caatataaatcaagtgatagat

SEQ ID NO: 745271 - DNA, 22 bp, Artificial Sequence
  chemically synthesized
aattatttatatctatcacttg

SEQ ID NO: 745272 - DNA, 22 bp, Artificial Sequence
  chemically synthesized
tttatatctatcacttgattta

SEQ ID NO: 745273 - DNA, 22 bp, Artificial Sequence
  chemically synthesized
atatctatcacttgatttatat

SEQ ID NO: 745274 - DNA, 22 bp, Artificial Sequence
  chemically synthesized
gcaaatgctccaatataaatca

SEQ ID NO: 745275 - DNA, 22 bp, Artificial Sequence
  chemically synthesized
tatctatcacttgatttatatt

SEQ ID NO: 745276 - DNA, 22 bp, Artificial Sequence
  chemically synthesized
tcacttgatttatattggagca

SEQ ID NO: 745277 - DNA, 22 bp, Artificial Sequence
  chemically synthesized
agaaattagcaaatgctccaat

SEQ ID NO: 745278 - DNA, 22 bp, Artificial Sequence
  chemically synthesized
cagaaattagcaaatgctccaa

SEQ ID NO: 745279 - DNA, 22 bp, Artificial Sequence
  chemically synthesized
gatttatattggagcatttgct

SEQ ID NO: 745280 - DNA, 22 bp, Artificial Sequence
  chemically synthesized
atttatattggagcatttgcta

SEQ ID NO: 745281 - DNA, 22 bp, Artificial Sequence
  chemically synthesized
atattggagcatttgctaattt

SEQ ID NO: 745282 - DNA, 22 bp, Artificial Sequence
  chemically synthesized
tattggagcatttgctaatttc

SEQ ID NO: 745283 - DNA, 22 bp, Artificial Sequence
  chemically synthesized
gagcatttgctaatttctgaag

SEQ ID NO: 745284 - DNA, 22 bp, Artificial Sequence
  chemically synthesized
cccaaagaatgagagatgcttc

SEQ ID NO: 745285 - DNA, 22 bp, Artificial Sequence
  chemically synthesized
gcccaaagaatgagagatgctt

SEQ ID NO: 745286 - DNA, 22 bp, Artificial Sequence
  chemically synthesized
gctaatttctgaagcatctctc

SEQ ID NO: 745287 - DNA, 22 bp, Artificial Sequence
  chemically synthesized
ctaatttctgaagcatctctca

SEQ ID NO: 745288 - DNA, 22 bp, Artificial Sequence
  chemically synthesized
ttgcccaaagaatgagagatgc

SEQ ID NO: 745289 - DNA, 22 bp, Artificial Sequence
  chemically synthesized
atttctgaagcatctctcattc

SEQ ID NO: 745290 - DNA, 22 bp, Artificial Sequence
  chemically synthesized
tattcttgcccaaagaatgaga

SEQ ID NO: 745291 - DNA, 22 bp, Artificial Sequence
  chemically synthesized
ctgaagcatctctcattctttg

SEQ ID NO: 745292 - DNA, 22 bp, Artificial Sequence
  chemically synthesized
tgaagcatctctcattctttgg

SEQ ID NO: 745293 - DNA, 22 bp, Artificial Sequence
  chemically synthesized
aagcatctctcattctttgggc

SEQ ID NO: 745294 - DNA, 22 bp, Artificial Sequence
  chemically synthesized
aaatgttatattcttgcccaaa

SEQ ID NO: 745295 - DNA, 22 bp, Artificial Sequence
  chemically synthesized
tcattctttgggcaagaatata

SEQ ID NO: 745296 - DNA, 22 bp, Artificial Sequence
  chemically synthesized
attctttgggcaagaatataac

SEQ ID NO: 745297 - DNA, 22 bp, Artificial Sequence
  chemically synthesized
tttgggcaagaatataacattt

SEQ ID NO: 745298 - DNA, 22 bp, Artificial Sequence
  chemically synthesized
tgggcaagaatataacatttca

SEQ ID NO: 745299 - DNA, 22 bp, Artificial Sequence
  chemically synthesized
gggcaagaatataacatttcag

SEQ ID NO: 745300 - DNA, 22 bp, Artificial Sequence
  chemically synthesized
ggcaagaatataacatttcagt

SEQ ID NO: 745301 - DNA, 22 bp, Artificial Sequence
  chemically synthesized
gtagagaccaaaaactgaaatg

SEQ ID NO: 745302 - DNA, 22 bp, Artificial Sequence
  chemically synthesized
aaaatccctggtagagaccaaa

SEQ ID NO: 745303 - DNA, 22 bp, Artificial Sequence
  chemically synthesized
aaaaatccctggtagagaccaa

SEQ ID NO: 745304 - DNA, 22 bp, Artificial Sequence
  chemically synthesized
taaaaatccctggtagagacca

SEQ ID NO: 745305 - DNA, 22 bp, Artificial Sequence
  chemically synthesized
ttttaaaaatccctggtagaga

SEQ ID NO: 745306 - DNA, 22 bp, Artificial Sequence
  chemically synthesized
attttaaaaatccctggtagag

SEQ ID NO: 745307 - DNA, 22 bp, Artificial Sequence
  chemically synthesized
cagtttttggtctctaccaggg

SEQ ID NO: 745308 - DNA, 22 bp, Artificial Sequence
  chemically synthesized
tattttaaaaatccctggtaga

SEQ ID NO: 745309 - DNA, 22 bp, Artificial Sequence
  chemically synthesized
agtttttggtctctaccaggga

SEQ ID NO: 745310 - DNA, 22 bp, Artificial Sequence
  chemically synthesized
ttattttaaaaatccctggtag

SEQ ID NO: 745311 - DNA, 22 bp, Artificial Sequence
  chemically synthesized
ttggtctctaccagggattttt

SEQ ID NO: 745312 - DNA, 22 bp, Artificial Sequence
  chemically synthesized
catttttattttaaaaatccct

SEQ ID NO: 745313 - DNA, 22 bp, Artificial Sequence
  chemically synthesized
tggtctctaccagggattttta

SEQ ID NO: 745314 - DNA, 22 bp, Artificial Sequence
  chemically synthesized
ggtctctaccagggatttttaa

SEQ ID NO: 745315 - DNA, 22 bp, Artificial Sequence
  chemically synthesized
gtctctaccagggatttttaaa

SEQ ID NO: 745316 - DNA, 22 bp, Artificial Sequence
  chemically synthesized
actccatttttattttaaaaat

SEQ ID NO: 745317 - DNA, 22 bp, Artificial Sequence
  chemically synthesized
taccagggatttttaaaataaa

SEQ ID NO: 745318 - DNA, 22 bp, Artificial Sequence
  chemically synthesized
ccagggatttttaaaataaaaa

SEQ ID NO: 745319 - DNA, 22 bp, Artificial Sequence
  chemically synthesized
ccactcactccatttttatttt

SEQ ID NO: 745320 - DNA, 22 bp, Artificial Sequence
  chemically synthesized
cccactcactccatttttattt

SEQ ID NO: 745321 - DNA, 22 bp, Artificial Sequence
  chemically synthesized
tcccactcactccatttttatt

SEQ ID NO: 745322 - DNA, 22 bp, Artificial Sequence
  chemically synthesized
ttcccactcactccatttttat

SEQ ID NO: 745323 - DNA, 22 bp, Artificial Sequence
  chemically synthesized
tttcccactcactccattttta

SEQ ID NO: 745324 - DNA, 22 bp, Artificial Sequence
  chemically synthesized
ttttcccactcactccattttt

SEQ ID NO: 745325 - DNA, 22 bp, Artificial Sequence
  chemically synthesized
tttttcccactcactccatttt

SEQ ID NO: 745326 - DNA, 22 bp, Artificial Sequence
  chemically synthesized
tttttttcccactcactccatt

SEQ ID NO: 745327 - DNA, 22 bp, Artificial Sequence
  chemically synthesized
ttaaaataaaaatggagtgagt

SEQ ID NO: 745328 - DNA, 22 bp, Artificial Sequence
  chemically synthesized
taaaataaaaatggagtgagtg

SEQ ID NO: 745329 - DNA, 22 bp, Artificial Sequence
  chemically synthesized
ctctttttttcccactcactcc

SEQ ID NO: 745330 - DNA, 22 bp, Artificial Sequence
  chemically synthesized
aaaataaaaatggagtgagtgg

SEQ ID NO: 745331 - DNA, 22 bp, Artificial Sequence
  chemically synthesized
cctctttttttcccactcactc

SEQ ID NO: 745332 - DNA, 22 bp, Artificial Sequence
  chemically synthesized
aaataaaaatggagtgagtggg

SEQ ID NO: 745333 - DNA, 22 bp, Artificial Sequence
  chemically synthesized
cttcctctttttttcccactca

SEQ ID NO: 745334 - DNA, 22 bp, Artificial Sequence
  chemically synthesized
aataggctacttcctctttttt

SEQ ID NO: 745335 - DNA, 22 bp, Artificial Sequence
  chemically synthesized
gaataggctacttcctcttttt

SEQ ID NO: 745336 - DNA, 22 bp, Artificial Sequence
  chemically synthesized
cttgaataggctacttcctctt

SEQ ID NO: 745337 - DNA, 22 bp, Artificial Sequence
  chemically synthesized
ccttgaataggctacttcctct

SEQ ID NO: 745338 - DNA, 22 bp, Artificial Sequence
  chemically synthesized
tccttgaataggctacttcctc

SEQ ID NO: 745339 - DNA, 22 bp, Artificial Sequence
  chemically synthesized
ttcaaggaaaatatattctgct

SEQ ID NO: 745340 - DNA, 22 bp, Artificial Sequence
  chemically synthesized
tgccaccaccaccaagcagaat

SEQ ID NO: 745341 - DNA, 22 bp, Artificial Sequence
  chemically synthesized
aaggaaaatatattctgcttgg

SEQ ID NO: 745342 - DNA, 22 bp, Artificial Sequence
  chemically synthesized
gtgccaccaccaccaagcagaa

SEQ ID NO: 745343 - DNA, 22 bp, Artificial Sequence
  chemically synthesized
acttgtgccaccaccaccaagc

SEQ ID NO: 745344 - DNA, 22 bp, Artificial Sequence
  chemically synthesized
tgcttggtggtggtggcacaag

SEQ ID NO: 745345 - DNA, 22 bp, Artificial Sequence
  chemically synthesized
cttggtggtggtggcacaagtt

SEQ ID NO: 745346 - DNA, 22 bp, Artificial Sequence
  chemically synthesized
caaaagatgcactaacttgtgc

SEQ ID NO: 745347 - DNA, 22 bp, Artificial Sequence
  chemically synthesized
ggtggtggtggcacaagttagt

SEQ ID NO: 745348 - DNA, 22 bp, Artificial Sequence
  chemically synthesized
gtggtggtggcacaagttagtg

SEQ ID NO: 745349 - DNA, 22 bp, Artificial Sequence
  chemically synthesized
aaatgccctccaaaagatgcac

SEQ ID NO: 745350 - DNA, 22 bp, Artificial Sequence
  chemically synthesized
ttaaaatgccctccaaaagatg

SEQ ID NO: 745351 - DNA, 22 bp, Artificial Sequence
  chemically synthesized
agtgttgttaaaatgccctcca

SEQ ID NO: 745352 - DNA, 22 bp, Artificial Sequence
  chemically synthesized
gtgcatcttttggagggcattt

SEQ ID NO: 745353 - DNA, 22 bp, Artificial Sequence
  chemically synthesized
ttcagtgttgttaaaatgccct

SEQ ID NO: 745354 - DNA, 22 bp, Artificial Sequence
  chemically synthesized
attcagtgttgttaaaatgccc

SEQ ID NO: 745355 - DNA, 22 bp, Artificial Sequence
  chemically synthesized
tattcagtgttgttaaaatgcc

SEQ ID NO: 745356 - DNA, 22 bp, Artificial Sequence
  chemically synthesized
ttattcagtgttgttaaaatgc

SEQ ID NO: 745357 - DNA, 22 bp, Artificial Sequence
  chemically synthesized
ttggagggcattttaacaacac

SEQ ID NO: 745358 - DNA, 22 bp, Artificial Sequence
  chemically synthesized
tggagggcattttaacaacact

SEQ ID NO: 745359 - DNA, 22 bp, Artificial Sequence
  chemically synthesized
atgcttttattcagtgttgtta

SEQ ID NO: 745360 - DNA, 22 bp, Artificial Sequence
  chemically synthesized
ggagggcattttaacaacactg

SEQ ID NO: 745361 - DNA, 22 bp, Artificial Sequence
  chemically synthesized
aatgcttttattcagtgttgtt

SEQ ID NO: 745362 - DNA, 22 bp, Artificial Sequence
  chemically synthesized
gagggcattttaacaacactga

SEQ ID NO: 745363 - DNA, 22 bp, Artificial Sequence
  chemically synthesized
taatgcttttattcagtgttgt

SEQ ID NO: 745364 - DNA, 22 bp, Artificial Sequence
  chemically synthesized
ttaatgcttttattcagtgttg

SEQ ID NO: 745365 - DNA, 22 bp, Artificial Sequence
  chemically synthesized
taacaacactgaataaaagcat

SEQ ID NO: 745366 - DNA, 22 bp, Artificial Sequence
  chemically synthesized
aacaacactgaataaaagcatt

SEQ ID NO: 745367 - DNA, 22 bp, Artificial Sequence
  chemically synthesized
acaacactgaataaaagcatta

SEQ ID NO: 745368 - DNA, 22 bp, Artificial Sequence
  chemically synthesized
atatgtaaatatttttaatgct

SEQ ID NO: 745369 - DNA, 22 bp, Artificial Sequence
  chemically synthesized
catatgtaaatatttttaatgc

SEQ ID NO: 745370 - DNA, 22 bp, Artificial Sequence
  chemically synthesized
tcatatgtaaatatttttaatg

SEQ ID NO: 745371 - DNA, 22 bp, Artificial Sequence
  chemically synthesized
ttcatatgtaaatatttttaat

SEQ ID NO: 745372 - DNA, 22 bp, Artificial Sequence
  chemically synthesized
aataaaagcattaaaaatattt

SEQ ID NO: 745373 - DNA, 22 bp, Artificial Sequence
  chemically synthesized
gtcttttcatatgtaaatattt

SEQ ID NO: 745374 - DNA, 22 bp, Artificial Sequence
  chemically synthesized
tagtcttttcatatgtaaatat

SEQ ID NO: 745375 - DNA, 22 bp, Artificial Sequence
  chemically synthesized
ctagtcttttcatatgtaaata

SEQ ID NO: 745376 - DNA, 22 bp, Artificial Sequence
  chemically synthesized
tagtcttctagtcttttcatat

SEQ ID NO: 745377 - DNA, 22 bp, Artificial Sequence
  chemically synthesized
aaaatatttacatatgaaaaga

SEQ ID NO: 745378 - DNA, 22 bp, Artificial Sequence
  chemically synthesized
gtagtcttctagtcttttcata

SEQ ID NO: 745379 - DNA, 22 bp, Artificial Sequence
  chemically synthesized
gtttgtagtcttctagtctttt

SEQ ID NO: 745380 - DNA, 22 bp, Artificial Sequence
  chemically synthesized
acatatgaaaagactagaagac

SEQ ID NO: 745381 - DNA, 22 bp, Artificial Sequence
  chemically synthesized
agttggtttgtagtcttctagt

SEQ ID NO: 745382 - DNA, 22 bp, Artificial Sequence
  chemically synthesized
catatgaaaagactagaagact

SEQ ID NO: 745383 - DNA, 22 bp, Artificial Sequence
  chemically synthesized
cagttggtttgtagtcttctag

SEQ ID NO: 745384 - DNA, 22 bp, Artificial Sequence
  chemically synthesized
gatttcagttggtttgtagtct

SEQ ID NO: 745385 - DNA, 22 bp, Artificial Sequence
  chemically synthesized
gaagactacaaaccaactgaaa

SEQ ID NO: 745386 - DNA, 22 bp, Artificial Sequence
  chemically synthesized
caaaccaactgaaatccagcct

SEQ ID NO: 745387 - DNA, 22 bp, Artificial Sequence
  chemically synthesized
gtagtagagcccaggctggatt

SEQ ID NO: 745388 - DNA, 22 bp, Artificial Sequence
  chemically synthesized
ggtagtagagcccaggctggat

SEQ ID NO: 745389 - DNA, 22 bp, Artificial Sequence
  chemically synthesized
accaatttggtagtagagccca

SEQ ID NO: 745390 - DNA, 22 bp, Artificial Sequence
  chemically synthesized
aaatccagcctgggctctacta

SEQ ID NO: 745391 - DNA, 22 bp, Artificial Sequence
  chemically synthesized
tgccaagcctaaccaatttggt

SEQ ID NO: 745392 - DNA, 22 bp, Artificial Sequence
  chemically synthesized
ggctctactaccaaattggtta

SEQ ID NO: 745393 - DNA, 22 bp, Artificial Sequence
  chemically synthesized
tactaccaaattggttaggctt

SEQ ID NO: 745394 - DNA, 22 bp, Artificial Sequence
  chemically synthesized
ctaccaaattggttaggcttgg

SEQ ID NO: 745395 - DNA, 22 bp, Artificial Sequence
  chemically synthesized
ccaaattggttaggcttggcat

SEQ ID NO: 745396 - DNA, 22 bp, Artificial Sequence
  chemically synthesized
aagagatccccggtcctatgcc

SEQ ID NO: 745397 - DNA, 22 bp, Artificial Sequence
  chemically synthesized
gaagagatccccggtcctatgc

SEQ ID NO: 745398 - DNA, 22 bp, Artificial Sequence
  chemically synthesized
tgaagagatccccggtcctatg

SEQ ID NO: 745399 - DNA, 22 bp, Artificial Sequence
  chemically synthesized
gttaggcttggcataggaccgg

SEQ ID NO: 745400 - DNA, 22 bp, Artificial Sequence
  chemically synthesized
ttgaagagatccccggtcctat

SEQ ID NO: 745401 - DNA, 22 bp, Artificial Sequence
  chemically synthesized
ggcttggcataggaccggggat

SEQ ID NO: 745402 - DNA, 22 bp, Artificial Sequence
  chemically synthesized
tgtttttgaagagatccccggt

SEQ ID NO: 745403 - DNA, 22 bp, Artificial Sequence
  chemically synthesized
ggcataggaccggggatctctt

SEQ ID NO: 745404 - DNA, 22 bp, Artificial Sequence
  chemically synthesized
gcataggaccggggatctcttc

SEQ ID NO: 745405 - DNA, 22 bp, Artificial Sequence
  chemically synthesized
ggcaaagaagaaaaaggcactg

SEQ ID NO: 745406 - DNA, 22 bp, Artificial Sequence
  chemically synthesized
gggcaaagaagaaaaaggcact

SEQ ID NO: 745407 - DNA, 22 bp, Artificial Sequence
  chemically synthesized
ttcaaaaacacagtgccttttt

SEQ ID NO: 745408 - DNA, 22 bp, Artificial Sequence
  chemically synthesized
tgggcaaagaagaaaaaggcac

SEQ ID NO: 745409 - DNA, 22 bp, Artificial Sequence
  chemically synthesized
caaaaacacagtgcctttttct

SEQ ID NO: 745410 - DNA, 22 bp, Artificial Sequence
  chemically synthesized
tttgggcaaagaagaaaaaggc

SEQ ID NO: 745411 - DNA, 22 bp, Artificial Sequence
  chemically synthesized
aaaaacacagtgcctttttctt

SEQ ID NO: 745412 - DNA, 22 bp, Artificial Sequence
  chemically synthesized
caagggcctctttgggcaaaga

SEQ ID NO: 745413 - DNA, 22 bp, Artificial Sequence
  chemically synthesized
tttcttctttgcccaaagaggc

SEQ ID NO: 745414 - DNA, 22 bp, Artificial Sequence
  chemically synthesized
ttcttctttgcccaaagaggcc

SEQ ID NO: 745415 - DNA, 22 bp, Artificial Sequence
  chemically synthesized
tcttctttgcccaaagaggccc

SEQ ID NO: 745416 - DNA, 22 bp, Artificial Sequence
  chemically synthesized
cttctttgcccaaagaggccct

SEQ ID NO: 745417 - DNA, 22 bp, Artificial Sequence
  chemically synthesized
ttctttgcccaaagaggccctt

SEQ ID NO: 745418 - DNA, 22 bp, Artificial Sequence
  chemically synthesized
ctttgcccaaagaggcccttgc

SEQ ID NO: 745419 - DNA, 22 bp, Artificial Sequence
  chemically synthesized
tttgcccaaagaggcccttgca

SEQ ID NO: 745420 - DNA, 22 bp, Artificial Sequence
  chemically synthesized
taatcccaatccctgcaagggc

SEQ ID NO: 745421 - DNA, 22 bp, Artificial Sequence
  chemically synthesized
tgcccaaagaggcccttgcagg

SEQ ID NO: 745422 - DNA, 22 bp, Artificial Sequence
  chemically synthesized
gcccaaagaggcccttgcaggg

SEQ ID NO: 745423 - DNA, 22 bp, Artificial Sequence
  chemically synthesized
cccaaagaggcccttgcaggga

SEQ ID NO: 745424 - DNA, 22 bp, Artificial Sequence
  chemically synthesized
agccccagcatctataatccca

SEQ ID NO: 745425 - DNA, 22 bp, Artificial Sequence
  chemically synthesized
gcagggattgggattatagatg

SEQ ID NO: 745426 - DNA, 22 bp, Artificial Sequence
  chemically synthesized
cagggattgggattatagatgc

SEQ ID NO: 745427 - DNA, 22 bp, Artificial Sequence
  chemically synthesized
taatctcagccccagcatctat

SEQ ID NO: 745428 - DNA, 22 bp, Artificial Sequence
  chemically synthesized
ggattatagatgctggggctga

SEQ ID NO: 745429 - DNA, 22 bp, Artificial Sequence
  chemically synthesized
tagatgctggggctgagattac

SEQ ID NO: 745430 - DNA, 22 bp, Artificial Sequence
  chemically synthesized
gggctgagattacagatgatcc

SEQ ID NO: 745431 - DNA, 22 bp, Artificial Sequence
  chemically synthesized
agattacagatgatccctctct

SEQ ID NO: 745432 - DNA, 22 bp, Artificial Sequence
  chemically synthesized
cagatgatccctctctctctct

SEQ ID NO: 745433 - DNA, 22 bp, Artificial Sequence
  chemically synthesized
gggaggcagggagagagagaga

SEQ ID NO: 745434 - DNA, 22 bp, Artificial Sequence
  chemically synthesized
tctctctctctctctctctccc

SEQ ID NO: 745435 - DNA, 22 bp, Artificial Sequence
  chemically synthesized
tctctctctctctctctccctg

SEQ ID NO: 745436 - DNA, 22 bp, Artificial Sequence
  chemically synthesized
tctctctctctctctccctgcc

SEQ ID NO: 745437 - DNA, 22 bp, Artificial Sequence
  chemically synthesized
tctctctctctctccctgcctc

SEQ ID NO: 745438 - DNA, 22 bp, Artificial Sequence
  chemically synthesized
tctctctctctccctgcctccc

SEQ ID NO: 745439 - DNA, 22 bp, Artificial Sequence
  chemically synthesized
tctctctctccctgcctcccta

SEQ ID NO: 745440 - DNA, 22 bp, Artificial Sequence
  chemically synthesized
tctctctccctgcctccctaat

SEQ ID NO: 745441 - DNA, 22 bp, Artificial Sequence
  chemically synthesized
tctctccctgcctccctaattt

SEQ ID NO: 745442 - DNA, 22 bp, Artificial Sequence
  chemically synthesized
tctccctgcctccctaattttt

SEQ ID NO: 745443 - DNA, 22 bp, Artificial Sequence
  chemically synthesized
gtggaaaagcccaaaaattagg

SEQ ID NO: 745444 - DNA, 22 bp, Artificial Sequence
  chemically synthesized
agtggaaaagcccaaaaattag

SEQ ID NO: 745445 - DNA, 22 bp, Artificial Sequence
  chemically synthesized
tccctgcctccctaatttttgg

SEQ ID NO: 745446 - DNA, 22 bp, Artificial Sequence
  chemically synthesized
tagtggaaaagcccaaaaatta

SEQ ID NO: 745447 - DNA, 22 bp, Artificial Sequence
  chemically synthesized
cctgcctccctaatttttgggc

SEQ ID NO: 745448 - DNA, 22 bp, Artificial Sequence
  chemically synthesized
tttagtggaaaagcccaaaaat

SEQ ID NO: 745449 - DNA, 22 bp, Artificial Sequence
  chemically synthesized
ctttagtggaaaagcccaaaaa

SEQ ID NO: 745450 - DNA, 22 bp, Artificial Sequence
  chemically synthesized
tctttagtggaaaagcccaaaa

SEQ ID NO: 745451 - DNA, 22 bp, Artificial Sequence
  chemically synthesized
ttctttagtggaaaagcccaaa

SEQ ID NO: 745452 - DNA, 22 bp, Artificial Sequence
  chemically synthesized
cctccctaatttttgggctttt

SEQ ID NO: 745453 - DNA, 22 bp, Artificial Sequence
  chemically synthesized
cctaatttttgggcttttccac

SEQ ID NO: 745454 - DNA, 22 bp, Artificial Sequence
  chemically synthesized
agtaacttttctttagtggaaa

SEQ ID NO: 745455 - DNA, 22 bp, Artificial Sequence
  chemically synthesized
atttttgggcttttccactaaa

SEQ ID NO: 745456 - DNA, 22 bp, Artificial Sequence
  chemically synthesized
aagtaacttttctttagtggaa

SEQ ID NO: 745457 - DNA, 22 bp, Artificial Sequence
  chemically synthesized
tttaagtaacttttctttagtg

SEQ ID NO: 745458 - DNA, 22 bp, Artificial Sequence
  chemically synthesized
ttgggcttttccactaaagaaa

SEQ ID NO: 745459 - DNA, 22 bp, Artificial Sequence
  chemically synthesized
tgggcttttccactaaagaaaa

SEQ ID NO: 745460 - DNA, 22 bp, Artificial Sequence
  chemically synthesized
gggcttttccactaaagaaaag

SEQ ID NO: 745461 - DNA, 22 bp, Artificial Sequence
  chemically synthesized
ggcttttccactaaagaaaagt

SEQ ID NO: 745462 - DNA, 22 bp, Artificial Sequence
  chemically synthesized
ttccactaaagaaaagttactt

SEQ ID NO: 745463 - DNA, 22 bp, Artificial Sequence
  chemically synthesized
atatcattatttaagtaacttt

SEQ ID NO: 745464 - DNA, 22 bp, Artificial Sequence
  chemically synthesized
tccactaaagaaaagttactta

SEQ ID NO: 745465 - DNA, 22 bp, Artificial Sequence
  chemically synthesized
ccactaaagaaaagttacttaa

SEQ ID NO: 745466 - DNA, 22 bp, Artificial Sequence
  chemically synthesized
cactaaagaaaagttacttaaa

SEQ ID NO: 745467 - DNA, 22 bp, Artificial Sequence
  chemically synthesized
gttcatatcattatttaagtaa

SEQ ID NO: 745468 - DNA, 22 bp, Artificial Sequence
  chemically synthesized
agttcatatcattatttaagta

SEQ ID NO: 745469 - DNA, 22 bp, Artificial Sequence
  chemically synthesized
ttagttcatatcattatttaag

SEQ ID NO: 745470 - DNA, 22 bp, Artificial Sequence
  chemically synthesized
aagaaaagttacttaaataatg

SEQ ID NO: 745471 - DNA, 22 bp, Artificial Sequence
  chemically synthesized
cttagttcatatcattatttaa

SEQ ID NO: 745472 - DNA, 22 bp, Artificial Sequence
  chemically synthesized
atgacttcttagttcatatcat

SEQ ID NO: 745473 - DNA, 22 bp, Artificial Sequence
  chemically synthesized
gatgacttcttagttcatatca

SEQ ID NO: 745474 - DNA, 22 bp, Artificial Sequence
  chemically synthesized
cttaaataatgatatgaactaa

SEQ ID NO: 745475 - DNA, 22 bp, Artificial Sequence
  chemically synthesized
aaataatgatatgaactaagaa

SEQ ID NO: 745476 - DNA, 22 bp, Artificial Sequence
  chemically synthesized
atatttgatgacttcttagttc

SEQ ID NO: 745477 - DNA, 22 bp, Artificial Sequence
  chemically synthesized
aataatgatatgaactaagaag

SEQ ID NO: 745478 - DNA, 22 bp, Artificial Sequence
  chemically synthesized
cagtctaatatttgatgacttc

SEQ ID NO: 745479 - DNA, 22 bp, Artificial Sequence
  chemically synthesized
gttacagtctaatatttgatga

SEQ ID NO: 745480 - DNA, 22 bp, Artificial Sequence
  chemically synthesized
cgttacagtctaatatttgatg

SEQ ID NO: 745481 - DNA, 22 bp, Artificial Sequence
  chemically synthesized
agaagtcatcaaatattagact

SEQ ID NO: 745482 - DNA, 22 bp, Artificial Sequence
  chemically synthesized
taaatgaacttcgttacagtct

SEQ ID NO: 745483 - DNA, 22 bp, Artificial Sequence
  chemically synthesized
gtaaatgaacttcgttacagtc

SEQ ID NO: 745484 - DNA, 22 bp, Artificial Sequence
  chemically synthesized
gactgtaacgaagttcatttac

SEQ ID NO: 745485 - DNA, 22 bp, Artificial Sequence
  chemically synthesized
taacgaagttcatttacaaata

SEQ ID NO: 745486 - DNA, 22 bp, Artificial Sequence
  chemically synthesized
cacaagtggaaaatatttgtaa

SEQ ID NO: 745487 - DNA, 22 bp, Artificial Sequence
  chemically synthesized
tacacaagtggaaaatatttgt

SEQ ID NO: 745488 - DNA, 22 bp, Artificial Sequence
  chemically synthesized
ctacacaagtggaaaatatttg

SEQ ID NO: 745489 - DNA, 22 bp, Artificial Sequence
  chemically synthesized
tctacacaagtggaaaatattt

SEQ ID NO: 745490 - DNA, 22 bp, Artificial Sequence
  chemically synthesized
ttctacacaagtggaaaatatt

SEQ ID NO: 745491 - DNA, 22 bp, Artificial Sequence
  chemically synthesized
atttacaaatattttccacttg

SEQ ID NO: 745492 - DNA, 22 bp, Artificial Sequence
  chemically synthesized
tcccttttctacacaagtggaa

SEQ ID NO: 745493 - DNA, 22 bp, Artificial Sequence
  chemically synthesized
acaaatattttccacttgtgta

SEQ ID NO: 745494 - DNA, 22 bp, Artificial Sequence
  chemically synthesized
ctatcccttttctacacaagtg

SEQ ID NO: 745495 - DNA, 22 bp, Artificial Sequence
  chemically synthesized
caaatattttccacttgtgtag

SEQ ID NO: 745496 - DNA, 22 bp, Artificial Sequence
  chemically synthesized
tccacttgtgtagaaaagggat

SEQ ID NO: 745497 - DNA, 22 bp, Artificial Sequence
  chemically synthesized
ccacttgtgtagaaaagggata

SEQ ID NO: 745498 - DNA, 22 bp, Artificial Sequence
  chemically synthesized
cacttgtgtagaaaagggatag

SEQ ID NO: 745499 - DNA, 22 bp, Artificial Sequence
  chemically synthesized
aagtatgcatgttactatccct

SEQ ID NO: 745500 - DNA, 22 bp, Artificial Sequence
  chemically synthesized
gtgtagaaaagggatagtaaca

SEQ ID NO: 745501 - DNA, 22 bp, Artificial Sequence
  chemically synthesized
tgtagaaaagggatagtaacat

SEQ ID NO: 745502 - DNA, 22 bp, Artificial Sequence
  chemically synthesized
taacagccctaaagtatgcatg

SEQ ID NO: 745503 - DNA, 22 bp, Artificial Sequence
  chemically synthesized
gtaacagccctaaagtatgcat

SEQ ID NO: 745504 - DNA, 22 bp, Artificial Sequence
  chemically synthesized
tgtaacagccctaaagtatgca

SEQ ID NO: 745505 - DNA, 22 bp, Artificial Sequence
  chemically synthesized
atccatctttgtaacagcccta

SEQ ID NO: 745506 - DNA, 22 bp, Artificial Sequence
  chemically synthesized
tcatccatctttgtaacagccc

SEQ ID NO: 745507 - DNA, 22 bp, Artificial Sequence
  chemically synthesized
ctcatccatctttgtaacagcc

SEQ ID NO: 745508 - DNA, 22 bp, Artificial Sequence
  chemically synthesized
aacttctcatccatctttgtaa

SEQ ID NO: 745509 - DNA, 22 bp, Artificial Sequence
  chemically synthesized
tagggctgttacaaagatggat

SEQ ID NO: 745510 - DNA, 22 bp, Artificial Sequence
  chemically synthesized
agggctgttacaaagatggatg

SEQ ID NO: 745511 - DNA, 22 bp, Artificial Sequence
  chemically synthesized
gggctgttacaaagatggatga

SEQ ID NO: 745512 - DNA, 22 bp, Artificial Sequence
  chemically synthesized
ttacaaagatggatgagaagtt

SEQ ID NO: 745513 - DNA, 22 bp, Artificial Sequence
  chemically synthesized
caaagatggatgagaagtttag

SEQ ID NO: 745514 - DNA, 22 bp, Artificial Sequence
  chemically synthesized
aaagaaggagaaatatgcctaa

SEQ ID NO: 745515 - DNA, 22 bp, Artificial Sequence
  chemically synthesized
tatgtgaactaaaagaaggaga

SEQ ID NO: 745516 - DNA, 22 bp, Artificial Sequence
  chemically synthesized
aggcatatttctccttctttta

SEQ ID NO: 745517 - DNA, 22 bp, Artificial Sequence
  chemically synthesized
ggcatatttctccttcttttag

SEQ ID NO: 745518 - DNA, 22 bp, Artificial Sequence
  chemically synthesized
tgtgactatatgtgaactaaaa

SEQ ID NO: 745519 - DNA, 22 bp, Artificial Sequence
  chemically synthesized
gtgtgactatatgtgaactaaa

SEQ ID NO: 745520 - DNA, 22 bp, Artificial Sequence
  chemically synthesized
ctccttcttttagttcacatat

SEQ ID NO: 745521 - DNA, 22 bp, Artificial Sequence
  chemically synthesized
tccttcttttagttcacatata

SEQ ID NO: 745522 - DNA, 22 bp, Artificial Sequence
  chemically synthesized
cttcttttagttcacatatagt

SEQ ID NO: 745523 - DNA, 22 bp, Artificial Sequence
  chemically synthesized
cttttagttcacatatagtcac

SEQ ID NO: 745524 - DNA, 22 bp, Artificial Sequence
  chemically synthesized
ttttagttcacatatagtcaca

SEQ ID NO: 745525 - DNA, 22 bp, Artificial Sequence
  chemically synthesized
aataggaacttgtgtgactata

SEQ ID NO: 745526 - DNA, 22 bp, Artificial Sequence
  chemically synthesized
ttagttcacatatagtcacaca

SEQ ID NO: 745527 - DNA, 22 bp, Artificial Sequence
  chemically synthesized
tagttcacatatagtcacacaa

SEQ ID NO: 745528 - DNA, 22 bp, Artificial Sequence
  chemically synthesized
agttcacatatagtcacacaag

SEQ ID NO: 745529 - DNA, 22 bp, Artificial Sequence
  chemically synthesized
gttcacatatagtcacacaagt

SEQ ID NO: 745530 - DNA, 22 bp, Artificial Sequence
  chemically synthesized
gcctgaataggaacttgtgtga

SEQ ID NO: 745531 - DNA, 22 bp, Artificial Sequence
  chemically synthesized
acatatagtcacacaagttcct

SEQ ID NO: 745532 - DNA, 22 bp, Artificial Sequence
  chemically synthesized
gactagcctgaataggaacttg

SEQ ID NO: 745533 - DNA, 22 bp, Artificial Sequence
  chemically synthesized
cctggactagcctgaataggaa

SEQ ID NO: 745534 - DNA, 22 bp, Artificial Sequence
  chemically synthesized
cagagtctccctggactagcct

SEQ ID NO: 745535 - DNA, 22 bp, Artificial Sequence
  chemically synthesized
gcagagtctccctggactagcc

SEQ ID NO: 745536 - DNA, 22 bp, Artificial Sequence
  chemically synthesized
tgcagagtctccctggactagc

SEQ ID NO: 745537 - DNA, 22 bp, Artificial Sequence
  chemically synthesized
ctttgcagagtctccctggact

SEQ ID NO: 745538 - DNA, 22 bp, Artificial Sequence
  chemically synthesized
ctattcaggctagtccagggag

SEQ ID NO: 745539 - DNA, 22 bp, Artificial Sequence
  chemically synthesized
ctgctttgcagagtctccctgg

SEQ ID NO: 745540 - DNA, 22 bp, Artificial Sequence
  chemically synthesized
ttcaggctagtccagggagact

SEQ ID NO: 745541 - DNA, 22 bp, Artificial Sequence
  chemically synthesized
aggctagtccagggagactctg

SEQ ID NO: 745542 - DNA, 22 bp, Artificial Sequence
  chemically synthesized
cctactgctttgcagagtctcc

SEQ ID NO: 745543 - DNA, 22 bp, Artificial Sequence
  chemically synthesized
ttacctactgctttgcagagtc

SEQ ID NO: 745544 - DNA, 22 bp, Artificial Sequence
  chemically synthesized
attacctactgctttgcagagt

SEQ ID NO: 745545 - DNA, 22 bp, Artificial Sequence
  chemically synthesized
gtccagggagactctgcaaagc

SEQ ID NO: 745546 - DNA, 22 bp, Artificial Sequence
  chemically synthesized
atggatgaacttattacctact

SEQ ID NO: 745547 - DNA, 22 bp, Artificial Sequence
  chemically synthesized
tcatggatgaacttattaccta

SEQ ID NO: 745548 - DNA, 22 bp, Artificial Sequence
  chemically synthesized
tgcaaagcagtaggtaataagt

SEQ ID NO: 745549 - DNA, 22 bp, Artificial Sequence
  chemically synthesized
tctcatggatgaacttattacc

SEQ ID NO: 745550 - DNA, 22 bp, Artificial Sequence
  chemically synthesized
caaagcagtaggtaataagttc

SEQ ID NO: 745551 - DNA, 22 bp, Artificial Sequence
  chemically synthesized
tgactctctcatggatgaactt

SEQ ID NO: 745552 - DNA, 22 bp, Artificial Sequence
  chemically synthesized
gtctgtgactctctcatggatg

SEQ ID NO: 745553 - DNA, 22 bp, Artificial Sequence
  chemically synthesized
agtctgtgactctctcatggat

SEQ ID NO: 745554 - DNA, 22 bp, Artificial Sequence
  chemically synthesized
atccatgagagagtcacagact

SEQ ID NO: 745555 - DNA, 22 bp, Artificial Sequence
  chemically synthesized
cccggcaaaggatcttagtctg

SEQ ID NO: 745556 - DNA, 22 bp, Artificial Sequence
  chemically synthesized
caaaaaggtagctacccggcaa

SEQ ID NO: 745557 - DNA, 22 bp, Artificial Sequence
  chemically synthesized
agatcctttgccgggtagctac

SEQ ID NO: 745558 - DNA, 22 bp, Artificial Sequence
  chemically synthesized
tgccgggtagctacctttttgg

SEQ ID NO: 745559 - DNA, 22 bp, Artificial Sequence
  chemically synthesized
gccgggtagctacctttttgga

SEQ ID NO: 745560 - DNA, 22 bp, Artificial Sequence
  chemically synthesized
ccgggtagctacctttttggag

SEQ ID NO: 745561 - DNA, 22 bp, Artificial Sequence
  chemically synthesized
gggcgatgtgagaaatcagctc

SEQ ID NO: 745562 - DNA, 22 bp, Artificial Sequence
  chemically synthesized
cctttttggagctgatttctca

SEQ ID NO: 745563 - DNA, 22 bp, Artificial Sequence
  chemically synthesized
cccctggggcgatgtgagaaat

SEQ ID NO: 745564 - DNA, 22 bp, Artificial Sequence
  chemically synthesized
tttggagctgatttctcacatc

SEQ ID NO: 745565 - DNA, 22 bp, Artificial Sequence
  chemically synthesized
ttggagctgatttctcacatcg

SEQ ID NO: 745566 - DNA, 22 bp, Artificial Sequence
  chemically synthesized
tggagctgatttctcacatcgc

SEQ ID NO: 745567 - DNA, 22 bp, Artificial Sequence
  chemically synthesized
ggagctgatttctcacatcgcc

SEQ ID NO: 745568 - DNA, 22 bp, Artificial Sequence
  chemically synthesized
gagctgatttctcacatcgccc

SEQ ID NO: 745569 - DNA, 22 bp, Artificial Sequence
  chemically synthesized
atttctcacatcgccccagggg

SEQ ID NO: 745570 - DNA, 22 bp, Artificial Sequence
  chemically synthesized
catgatagaggttgcccctggg

SEQ ID NO: 745571 - DNA, 22 bp, Artificial Sequence
  chemically synthesized
ctcacatcgccccaggggcaac

SEQ ID NO: 745572 - DNA, 22 bp, Artificial Sequence
  chemically synthesized
tcacatcgccccaggggcaacc

SEQ ID NO: 745573 - DNA, 22 bp, Artificial Sequence
  chemically synthesized
acatcgccccaggggcaacctc

SEQ ID NO: 745574 - DNA, 22 bp, Artificial Sequence
  chemically synthesized
taaggctacatgatagaggttg

SEQ ID NO: 745575 - DNA, 22 bp, Artificial Sequence
  chemically synthesized
ataaggctacatgatagaggtt

SEQ ID NO: 745576 - DNA, 22 bp, Artificial Sequence
  chemically synthesized
gaggagacgtttataaggctac

SEQ ID NO: 745577 - DNA, 22 bp, Artificial Sequence
  chemically synthesized
gttcgaggagacgtttataagg

SEQ ID NO: 745578 - DNA, 22 bp, Artificial Sequence
  chemically synthesized
tatcatgtagccttataaacgt

SEQ ID NO: 745579 - DNA, 22 bp, Artificial Sequence
  chemically synthesized
tcatgtagccttataaacgtct

SEQ ID NO: 745580 - DNA, 22 bp, Artificial Sequence
  chemically synthesized
caatgtctagttcgaggagacg

SEQ ID NO: 745581 - DNA, 22 bp, Artificial Sequence
  chemically synthesized
ccaatgtctagttcgaggagac

SEQ ID NO: 745582 - DNA, 22 bp, Artificial Sequence
  chemically synthesized
tccaatgtctagttcgaggaga

SEQ ID NO: 745583 - DNA, 22 bp, Artificial Sequence
  chemically synthesized
ctttccaatgtctagttcgagg

SEQ ID NO: 745584 - DNA, 22 bp, Artificial Sequence
  chemically synthesized
ataaacgtctcctcgaactaga

SEQ ID NO: 745585 - DNA, 22 bp, Artificial Sequence
  chemically synthesized
taaacgtctcctcgaactagac

SEQ ID NO: 745586 - DNA, 22 bp, Artificial Sequence
  chemically synthesized
atgtacctactttccaatgtct

SEQ ID NO: 745587 - DNA, 22 bp, Artificial Sequence
  chemically synthesized
catgtacctactttccaatgtc

SEQ ID NO: 745588 - DNA, 22 bp, Artificial Sequence
  chemically synthesized
ctcgaactagacattggaaagt

SEQ ID NO: 745589 - DNA, 22 bp, Artificial Sequence
  chemically synthesized
gaactagacattggaaagtagg

SEQ ID NO: 745590 - DNA, 22 bp, Artificial Sequence
  chemically synthesized
tcagtttcatgtacctactttc

SEQ ID NO: 745591 - DNA, 22 bp, Artificial Sequence
  chemically synthesized
atcagtttcatgtacctacttt

SEQ ID NO: 745592 - DNA, 22 bp, Artificial Sequence
  chemically synthesized
tatcagtttcatgtacctactt

SEQ ID NO: 745593 - DNA, 22 bp, Artificial Sequence
  chemically synthesized
tttatcagtttcatgtacctac

SEQ ID NO: 745594 - DNA, 22 bp, Artificial Sequence
  chemically synthesized
gacattggaaagtaggtacatg

SEQ ID NO: 745595 - DNA, 22 bp, Artificial Sequence
  chemically synthesized
ctctttatcagtttcatgtacc

SEQ ID NO: 745596 - DNA, 22 bp, Artificial Sequence
  chemically synthesized
cctctttatcagtttcatgtac

SEQ ID NO: 745597 - DNA, 22 bp, Artificial Sequence
  chemically synthesized
gaaagtaggtacatgaaactga

SEQ ID NO: 745598 - DNA, 22 bp, Artificial Sequence
  chemically synthesized
tgcttcctctttatcagtttca

SEQ ID NO: 745599 - DNA, 22 bp, Artificial Sequence
  chemically synthesized
cccacactatgcttcctcttta

SEQ ID NO: 745600 - DNA, 22 bp, Artificial Sequence
  chemically synthesized
ccccacactatgcttcctcttt

SEQ ID NO: 745601 - DNA, 22 bp, Artificial Sequence
  chemically synthesized
ttccccacactatgcttcctct

SEQ ID NO: 745602 - DNA, 22 bp, Artificial Sequence
  chemically synthesized
cttccccacactatgcttcctc

SEQ ID NO: 745603 - DNA, 22 bp, Artificial Sequence
  chemically synthesized
tcttccccacactatgcttcct

SEQ ID NO: 745604 - DNA, 22 bp, Artificial Sequence
  chemically synthesized
ataaagaggaagcatagtgtgg

SEQ ID NO: 745605 - DNA, 22 bp, Artificial Sequence
  chemically synthesized
aacacatatctttcttccccac

SEQ ID NO: 745606 - DNA, 22 bp, Artificial Sequence
  chemically synthesized
tgaacacatatctttcttcccc

SEQ ID NO: 745607 - DNA, 22 bp, Artificial Sequence
  chemically synthesized
aagttctgaacacatatctttc

SEQ ID NO: 745608 - DNA, 22 bp, Artificial Sequence
  chemically synthesized
ttcaagttctgaacacatatct

SEQ ID NO: 745609 - DNA, 22 bp, Artificial Sequence
  chemically synthesized
gttcaagttctgaacacatatc

SEQ ID NO: 745610 - DNA, 22 bp, Artificial Sequence
  chemically synthesized
tgttcaagttctgaacacatat

SEQ ID NO: 745611 - DNA, 22 bp, Artificial Sequence
  chemically synthesized
ccctttgttcaagttctgaaca

SEQ ID NO: 745612 - DNA, 22 bp, Artificial Sequence
  chemically synthesized
accctttgttcaagttctgaac

SEQ ID NO: 745613 - DNA, 22 bp, Artificial Sequence
  chemically synthesized
ttaccctttgttcaagttctga

SEQ ID NO: 745614 - DNA, 22 bp, Artificial Sequence
  chemically synthesized
cctcttaccctttgttcaagtt

SEQ ID NO: 745615 - DNA, 22 bp, Artificial Sequence
  chemically synthesized
ctacctcttaccctttgttcaa

SEQ ID NO: 745616 - DNA, 22 bp, Artificial Sequence
  chemically synthesized
cctacctcttaccctttgttca

SEQ ID NO: 745617 - DNA, 22 bp, Artificial Sequence
  chemically synthesized
tcctacctcttaccctttgttc

SEQ ID NO: 745618 - DNA, 22 bp, Artificial Sequence
  chemically synthesized
agaacttgaacaaagggtaaga

SEQ ID NO: 745619 - DNA, 22 bp, Artificial Sequence
  chemically synthesized
aactttcctacctcttaccctt

SEQ ID NO: 745620 - DNA, 22 bp, Artificial Sequence
  chemically synthesized
gaacaaagggtaagaggtagga

SEQ ID NO: 745621 - DNA, 22 bp, Artificial Sequence
  chemically synthesized
aacaaagggtaagaggtaggaa

SEQ ID NO: 745622 - DNA, 22 bp, Artificial Sequence
  chemically synthesized
agacacacattaaactttccta

SEQ ID NO: 745623 - DNA, 22 bp, Artificial Sequence
  chemically synthesized
ctcagacacacattaaactttc

SEQ ID NO: 745624 - DNA, 22 bp, Artificial Sequence
  chemically synthesized
cctcagacacacattaaacttt

SEQ ID NO: 745625 - DNA, 22 bp, Artificial Sequence
  chemically synthesized
tcctcagacacacattaaactt

SEQ ID NO: 745626 - DNA, 22 bp, Artificial Sequence
  chemically synthesized
ttcctcagacacacattaaact

SEQ ID NO: 745627 - DNA, 22 bp, Artificial Sequence
  chemically synthesized
cttttcctcagacacacattaa

SEQ ID NO: 745628 - DNA, 22 bp, Artificial Sequence
  chemically synthesized
gcttttcctcagacacacatta

SEQ ID NO: 745629 - DNA, 22 bp, Artificial Sequence
  chemically synthesized
tttgcttttcctcagacacaca

SEQ ID NO: 745630 - DNA, 22 bp, Artificial Sequence
  chemically synthesized
aaggctatttgcttttcctcag

SEQ ID NO: 745631 - DNA, 22 bp, Artificial Sequence
  chemically synthesized
aatgtgtgtctgaggaaaagca

SEQ ID NO: 745632 - DNA, 22 bp, Artificial Sequence
  chemically synthesized
ttaaaggctatttgcttttcct

SEQ ID NO: 745633 - DNA, 22 bp, Artificial Sequence
  chemically synthesized
atgtgtgtctgaggaaaagcaa

SEQ ID NO: 745634 - DNA, 22 bp, Artificial Sequence
  chemically synthesized
agttattaaaggctatttgctt

SEQ ID NO: 745635 - DNA, 22 bp, Artificial Sequence
  chemically synthesized
aagttattaaaggctatttgct

SEQ ID NO: 745636 - DNA, 22 bp, Artificial Sequence
  chemically synthesized
taagttattaaaggctatttgc

SEQ ID NO: 745637 - DNA, 22 bp, Artificial Sequence
  chemically synthesized
aggaaaagcaaatagcctttaa

SEQ ID NO: 745638 - DNA, 22 bp, Artificial Sequence
  chemically synthesized
atattttaagttattaaaggct

SEQ ID NO: 745639 - DNA, 22 bp, Artificial Sequence
  chemically synthesized
catattttaagttattaaaggc

SEQ ID NO: 745640 - DNA, 22 bp, Artificial Sequence
  chemically synthesized
tacttcatattttaagttatta

SEQ ID NO: 745641 - DNA, 22 bp, Artificial Sequence
  chemically synthesized
ccctgtacttcatattttaagt

SEQ ID NO: 745642 - DNA, 22 bp, Artificial Sequence
  chemically synthesized
cagctgccctgtacttcatatt

SEQ ID NO: 745643 - DNA, 22 bp, Artificial Sequence
  chemically synthesized
taataacttaaaatatgaagta

SEQ ID NO: 745644 - DNA, 22 bp, Artificial Sequence
  chemically synthesized
acagctgccctgtacttcatat

SEQ ID NO: 745645 - DNA, 22 bp, Artificial Sequence
  chemically synthesized
aataacttaaaatatgaagtac

SEQ ID NO: 745646 - DNA, 22 bp, Artificial Sequence
  chemically synthesized
tacagctgccctgtacttcata

SEQ ID NO: 745647 - DNA, 22 bp, Artificial Sequence
  chemically synthesized
ataacttaaaatatgaagtaca

SEQ ID NO: 745648 - DNA, 22 bp, Artificial Sequence
  chemically synthesized
ttacagctgccctgtacttcat

SEQ ID NO: 745649 - DNA, 22 bp, Artificial Sequence
  chemically synthesized
atcttttacagctgccctgtac

SEQ ID NO: 745650 - DNA, 22 bp, Artificial Sequence
  chemically synthesized
aaaatatgaagtacagggcagc

SEQ ID NO: 745651 - DNA, 22 bp, Artificial Sequence
  chemically synthesized
aaatatgaagtacagggcagct

SEQ ID NO: 745652 - DNA, 22 bp, Artificial Sequence
  chemically synthesized
atcccagaaaacacccatgatt

SEQ ID NO: 745653 - DNA, 22 bp, Artificial Sequence
  chemically synthesized
gatcccagaaaacacccatgat

SEQ ID NO: 745654 - DNA, 22 bp, Artificial Sequence
  chemically synthesized
taaaagatgaatcatgggtgtt

SEQ ID NO: 745655 - DNA, 22 bp, Artificial Sequence
  chemically synthesized
aagacccaccacaatcttgatc

SEQ ID NO: 745656 - DNA, 22 bp, Artificial Sequence
  chemically synthesized
attcaagacccaccacaatctt

SEQ ID NO: 745657 - DNA, 22 bp, Artificial Sequence
  chemically synthesized
tctgggatcaagattgtggtgg

SEQ ID NO: 745658 - DNA, 22 bp, Artificial Sequence
  chemically synthesized
ctgggatcaagattgtggtggg

SEQ ID NO: 745659 - DNA, 22 bp, Artificial Sequence
  chemically synthesized
tgggatcaagattgtggtgggt

SEQ ID NO: 745660 - DNA, 22 bp, Artificial Sequence
  chemically synthesized
ggatcaagattgtggtgggtct

SEQ ID NO: 745661 - DNA, 22 bp, Artificial Sequence
  chemically synthesized
taaaggccacctcattcaagac

SEQ ID NO: 745662 - DNA, 22 bp, Artificial Sequence
  chemically synthesized
cattgtaaaggccacctcattc

SEQ ID NO: 745663 - DNA, 22 bp, Artificial Sequence
  chemically synthesized
tggtgggtcttgaatgaggtgg

SEQ ID NO: 745664 - DNA, 22 bp, Artificial Sequence
  chemically synthesized
tacattgtaaaggccacctcat

SEQ ID NO: 745665 - DNA, 22 bp, Artificial Sequence
  chemically synthesized
attctacattgtaaaggccacc

SEQ ID NO: 745666 - DNA, 22 bp, Artificial Sequence
  chemically synthesized
cattctacattgtaaaggccac

SEQ ID NO: 745667 - DNA, 22 bp, Artificial Sequence
  chemically synthesized
gaatgaggtggcctttacaatg

SEQ ID NO: 745668 - DNA, 22 bp, Artificial Sequence
  chemically synthesized
aatgaggtggcctttacaatgt

SEQ ID NO: 745669 - DNA, 22 bp, Artificial Sequence
  chemically synthesized
tggacatcttcattctacattg

SEQ ID NO: 745670 - DNA, 22 bp, Artificial Sequence
  chemically synthesized
gtggacatcttcattctacatt

SEQ ID NO: 745671 - DNA, 22 bp, Artificial Sequence
  chemically synthesized
tgtggacatcttcattctacat

SEQ ID NO: 745672 - DNA, 22 bp, Artificial Sequence
  chemically synthesized
ccgttttgtggacatcttcatt

SEQ ID NO: 745673 - DNA, 22 bp, Artificial Sequence
  chemically synthesized
tacaatgtagaatgaagatgtc

SEQ ID NO: 745674 - DNA, 22 bp, Artificial Sequence
  chemically synthesized
acaatgtagaatgaagatgtcc

SEQ ID NO: 745675 - DNA, 22 bp, Artificial Sequence
  chemically synthesized
caatgtagaatgaagatgtcca

SEQ ID NO: 745676 - DNA, 22 bp, Artificial Sequence
  chemically synthesized
ccgagaaaatgccattcccgtt

SEQ ID NO: 745677 - DNA, 22 bp, Artificial Sequence
  chemically synthesized
agagttgccgagaaaatgccat

SEQ ID NO: 745678 - DNA, 22 bp, Artificial Sequence
  chemically synthesized
aatctaagagttgccgagaaaa

SEQ ID NO: 745679 - DNA, 22 bp, Artificial Sequence
  chemically synthesized
tctcggcaactcttagatttaa

SEQ ID NO: 745680 - DNA, 22 bp, Artificial Sequence
  chemically synthesized
ctcggcaactcttagatttaat

SEQ ID NO: 745681 - DNA, 22 bp, Artificial Sequence
  chemically synthesized
aagtgagtagtaattaaatcta

SEQ ID NO: 745682 - DNA, 22 bp, Artificial Sequence
  chemically synthesized
tcggcaactcttagatttaatt

SEQ ID NO: 745683 - DNA, 22 bp, Artificial Sequence
  chemically synthesized
caagtgagtagtaattaaatct

SEQ ID NO: 745684 - DNA, 22 bp, Artificial Sequence
  chemically synthesized
tcaagtgagtagtaattaaatc

SEQ ID NO: 745685 - DNA, 22 bp, Artificial Sequence
  chemically synthesized
ggcaactcttagatttaattac

SEQ ID NO: 745686 - DNA, 22 bp, Artificial Sequence
  chemically synthesized
ttagatttaattactactcact

SEQ ID NO: 745687 - DNA, 22 bp, Artificial Sequence
  chemically synthesized
agatttaattactactcacttg

SEQ ID NO: 745688 - DNA, 22 bp, Artificial Sequence
  chemically synthesized
gatttaattactactcacttga

SEQ ID NO: 745689 - DNA, 22 bp, Artificial Sequence
  chemically synthesized
aattactactcacttgaaaaca

SEQ ID NO: 745690 - DNA, 22 bp, Artificial Sequence
  chemically synthesized
attactactcacttgaaaacac

SEQ ID NO: 745691 - DNA, 22 bp, Artificial Sequence
  chemically synthesized
gtggatataaagtaagtgtttt

SEQ ID NO: 745692 - DNA, 22 bp, Artificial Sequence
  chemically synthesized
ctactcacttgaaaacacttac

SEQ ID NO: 745693 - DNA, 22 bp, Artificial Sequence
  chemically synthesized
ctcacttgaaaacacttacttt

SEQ ID NO: 745694 - DNA, 22 bp, Artificial Sequence
  chemically synthesized
acttgaaaacacttactttata

SEQ ID NO: 745695 - DNA, 22 bp, Artificial Sequence
  chemically synthesized
gaaaacacttactttatatcca

SEQ ID NO: 745696 - DNA, 22 bp, Artificial Sequence
  chemically synthesized
aaaacacttactttatatccac

SEQ ID NO: 745697 - DNA, 22 bp, Artificial Sequence
  chemically synthesized
actttatatccactagatactg

SEQ ID NO: 745698 - DNA, 22 bp, Artificial Sequence
  chemically synthesized
ctttatatccactagatactgt

SEQ ID NO: 745699 - DNA, 22 bp, Artificial Sequence
  chemically synthesized
tatatccactagatactgtgcc

SEQ ID NO: 745700 - DNA, 22 bp, Artificial Sequence
  chemically synthesized
atatccactagatactgtgccc

SEQ ID NO: 745701 - DNA, 22 bp, Artificial Sequence
  chemically synthesized
tatccactagatactgtgccca

SEQ ID NO: 745702 - DNA, 22 bp, Artificial Sequence
  chemically synthesized
gatactgtgcccacatatatgt

SEQ ID NO: 745703 - DNA, 22 bp, Artificial Sequence
  chemically synthesized
tgcccacatatatgtgtgtgtg

SEQ ID NO: 745704 - DNA, 22 bp, Artificial Sequence
  chemically synthesized
cagtggatgataggtatataat

SEQ ID NO: 745705 - DNA, 22 bp, Artificial Sequence
  chemically synthesized
ccagtggatgataggtatataa

SEQ ID NO: 745706 - DNA, 22 bp, Artificial Sequence
  chemically synthesized
tccagtggatgataggtatata

SEQ ID NO: 745707 - DNA, 22 bp, Artificial Sequence
  chemically synthesized
ttccagtggatgataggtatat

SEQ ID NO: 745708 - DNA, 22 bp, Artificial Sequence
  chemically synthesized
catttttccagtggatgatagg

SEQ ID NO: 745709 - DNA, 22 bp, Artificial Sequence
  chemically synthesized
ccatttttccagtggatgatag

SEQ ID NO: 745710 - DNA, 22 bp, Artificial Sequence
  chemically synthesized
agacttccatttttccagtgga

SEQ ID NO: 745711 - DNA, 22 bp, Artificial Sequence
  chemically synthesized
tatacctatcatccactggaaa

SEQ ID NO: 745712 - DNA, 22 bp, Artificial Sequence
  chemically synthesized
tcatccactggaaaaatggaag

SEQ ID NO: 745713 - DNA, 22 bp, Artificial Sequence
  chemically synthesized
tgagtgtgttgagacttccatt

SEQ ID NO: 745714 - DNA, 22 bp, Artificial Sequence
  chemically synthesized
atgattgtgagtgtgttgagac

SEQ ID NO: 745715 - DNA, 22 bp, Artificial Sequence
  chemically synthesized
gaaaaatggaagtctcaacaca

SEQ ID NO: 745716 - DNA, 22 bp, Artificial Sequence
  chemically synthesized
ctaatgattgtgagtgtgttga

SEQ ID NO: 745717 - DNA, 22 bp, Artificial Sequence
  chemically synthesized
tgctaatgattgtgagtgtgtt

SEQ ID NO: 745718 - DNA, 22 bp, Artificial Sequence
  chemically synthesized
tgtacctctgctaatgattgtg

SEQ ID NO: 745719 - DNA, 22 bp, Artificial Sequence
  chemically synthesized
aacacactcacaatcattagca

SEQ ID NO: 745720 - DNA, 22 bp, Artificial Sequence
  chemically synthesized
aattgtgtacctctgctaatga

SEQ ID NO: 745721 - DNA, 22 bp, Artificial Sequence
  chemically synthesized
acaatcattagcagaggtacac

SEQ ID NO: 745722 - DNA, 22 bp, Artificial Sequence
  chemically synthesized
atgacccattaaattgtgtacc

SEQ ID NO: 745723 - DNA, 22 bp, Artificial Sequence
  chemically synthesized
aatgacccattaaattgtgtac

SEQ ID NO: 745724 - DNA, 22 bp, Artificial Sequence
  chemically synthesized
taatgacccattaaattgtgta

SEQ ID NO: 745725 - DNA, 22 bp, Artificial Sequence
  chemically synthesized
ttaatgacccattaaattgtgt

SEQ ID NO: 745726 - DNA, 22 bp, Artificial Sequence
  chemically synthesized
tttaatgacccattaaattgtg

SEQ ID NO: 745727 - DNA, 22 bp, Artificial Sequence
  chemically synthesized
ttttaatgacccattaaattgt

SEQ ID NO: 745728 - DNA, 22 bp, Artificial Sequence
  chemically synthesized
tttttaatgacccattaaattg

SEQ ID NO: 745729 - DNA, 22 bp, Artificial Sequence
  chemically synthesized
gcagaggtacacaatttaatgg

SEQ ID NO: 745730 - DNA, 22 bp, Artificial Sequence
  chemically synthesized
cattttttttaatgacccatta

SEQ ID NO: 745731 - DNA, 22 bp, Artificial Sequence
  chemically synthesized
aatgggtcattaaaaaaaatgc

SEQ ID NO: 745732 - DNA, 22 bp, Artificial Sequence
  chemically synthesized
ataatatggattgcattttttt

SEQ ID NO: 745733 - DNA, 22 bp, Artificial Sequence
  chemically synthesized
atgggtcattaaaaaaaatgca

SEQ ID NO: 745734 - DNA, 22 bp, Artificial Sequence
  chemically synthesized
tcataatatggattgcattttt

SEQ ID NO: 745735 - DNA, 22 bp, Artificial Sequence
  chemically synthesized
ctcataatatggattgcatttt

SEQ ID NO: 745736 - DNA, 22 bp, Artificial Sequence
  chemically synthesized
aacttctcataatatggattgc

SEQ ID NO: 745737 - DNA, 22 bp, Artificial Sequence
  chemically synthesized
aaaaaaatgcaatccatattat

SEQ ID NO: 745738 - DNA, 22 bp, Artificial Sequence
  chemically synthesized
tgactcaacttctcataatatg

SEQ ID NO: 745739 - DNA, 22 bp, Artificial Sequence
  chemically synthesized
caaacccctatgactcaacttc

SEQ ID NO: 745740 - DNA, 22 bp, Artificial Sequence
  chemically synthesized
ccaaacccctatgactcaactt

SEQ ID NO: 745741 - DNA, 22 bp, Artificial Sequence
  chemically synthesized
caccttccaaacccctatgact

SEQ ID NO: 745742 - DNA, 22 bp, Artificial Sequence
  chemically synthesized
tgagaagttgagtcataggggt

SEQ ID NO: 745743 - DNA, 22 bp, Artificial Sequence
  chemically synthesized
tgcaccttccaaacccctatga

SEQ ID NO: 745744 - DNA, 22 bp, Artificial Sequence
  chemically synthesized
tctgcaccttccaaacccctat

SEQ ID NO: 745745 - DNA, 22 bp, Artificial Sequence
  chemically synthesized
ctctgcaccttccaaaccccta

SEQ ID NO: 745746 - DNA, 22 bp, Artificial Sequence
  chemically synthesized
tctctgcaccttccaaacccct

SEQ ID NO: 745747 - DNA, 22 bp, Artificial Sequence
  chemically synthesized
agtcataggggtttggaaggtg

SEQ ID NO: 745748 - DNA, 22 bp, Artificial Sequence
  chemically synthesized
catcagcatctttctctgcacc

SEQ ID NO: 745749 - DNA, 22 bp, Artificial Sequence
  chemically synthesized
ccctccatcagcatctttctct

SEQ ID NO: 745750 - DNA, 22 bp, Artificial Sequence
  chemically synthesized
cccctccatcagcatctttctc

SEQ ID NO: 745751 - DNA, 22 bp, Artificial Sequence
  chemically synthesized
ggaaggtgcagagaaagatgct

SEQ ID NO: 745752 - DNA, 22 bp, Artificial Sequence
  chemically synthesized
ttcccctccatcagcatctttc

SEQ ID NO: 745753 - DNA, 22 bp, Artificial Sequence
  chemically synthesized
gaaggtgcagagaaagatgctg

SEQ ID NO: 745754 - DNA, 22 bp, Artificial Sequence
  chemically synthesized
tcttcccctccatcagcatctt

SEQ ID NO: 745755 - DNA, 22 bp, Artificial Sequence
  chemically synthesized
aggaggtctctcttcccctcca

SEQ ID NO: 745756 - DNA, 22 bp, Artificial Sequence
  chemically synthesized
ctcaggaggtctctcttcccct

SEQ ID NO: 745757 - DNA, 22 bp, Artificial Sequence
  chemically synthesized
tctactcaggaggtctctcttc

SEQ ID NO: 745758 - DNA, 22 bp, Artificial Sequence
  chemically synthesized
atctactcaggaggtctctctt

SEQ ID NO: 745759 - DNA, 22 bp, Artificial Sequence
  chemically synthesized
atggaggggaagagagacctcc

SEQ ID NO: 745760 - DNA, 22 bp, Artificial Sequence
  chemically synthesized
agtcaccttatctactcaggag

SEQ ID NO: 745761 - DNA, 22 bp, Artificial Sequence
  chemically synthesized
cagtcaccttatctactcagga

SEQ ID NO: 745762 - DNA, 22 bp, Artificial Sequence
  chemically synthesized
tgaatgatttcagtcaccttat

SEQ ID NO: 745763 - DNA, 22 bp, Artificial Sequence
  chemically synthesized
tgtgaatgatttcagtcacctt

SEQ ID NO: 745764 - DNA, 22 bp, Artificial Sequence
  chemically synthesized
ctgagtagataaggtgactgaa

SEQ ID NO: 745765 - DNA, 22 bp, Artificial Sequence
  chemically synthesized
agtagataaggtgactgaaatc

SEQ ID NO: 745766 - DNA, 22 bp, Artificial Sequence
  chemically synthesized
ccctctgtgaatgatttcagtc

SEQ ID NO: 745767 - DNA, 22 bp, Artificial Sequence
  chemically synthesized
gtgttcccctctgtgaatgatt

SEQ ID NO: 745768 - DNA, 22 bp, Artificial Sequence
  chemically synthesized
tagtgttcccctctgtgaatga

SEQ ID NO: 745769 - DNA, 22 bp, Artificial Sequence
  chemically synthesized
ctagtgttcccctctgtgaatg

SEQ ID NO: 745770 - DNA, 22 bp, Artificial Sequence
  chemically synthesized
ttctagtgttcccctctgtgaa

SEQ ID NO: 745771 - DNA, 22 bp, Artificial Sequence
  chemically synthesized
aaatcattcacagaggggaaca

SEQ ID NO: 745772 - DNA, 22 bp, Artificial Sequence
  chemically synthesized
acagaggggaacactagaagag

SEQ ID NO: 745773 - DNA, 22 bp, Artificial Sequence
  chemically synthesized
atgtccagaggaacatgcctct

SEQ ID NO: 745774 - DNA, 22 bp, Artificial Sequence
  chemically synthesized
catgtccagaggaacatgcctc

SEQ ID NO: 745775 - DNA, 22 bp, Artificial Sequence
  chemically synthesized
tttcatgtccagaggaacatgc

SEQ ID NO: 745776 - DNA, 22 bp, Artificial Sequence
  chemically synthesized
gaagaggcatgttcctctggac

SEQ ID NO: 745777 - DNA, 22 bp, Artificial Sequence
  chemically synthesized
caggtgactatttcatgtccag

SEQ ID NO: 745778 - DNA, 22 bp, Artificial Sequence
  chemically synthesized
ccaggtgactatttcatgtcca

SEQ ID NO: 745779 - DNA, 22 bp, Artificial Sequence
  chemically synthesized
tccaggtgactatttcatgtcc

SEQ ID NO: 745780 - DNA, 22 bp, Artificial Sequence
  chemically synthesized
agattttccaggtgactatttc

SEQ ID NO: 745781 - DNA, 22 bp, Artificial Sequence
  chemically synthesized
gagattttccaggtgactattt

SEQ ID NO: 745782 - DNA, 22 bp, Artificial Sequence
  chemically synthesized
ctctggacatgaaatagtcacc

SEQ ID NO: 745783 - DNA, 22 bp, Artificial Sequence
  chemically synthesized
cttgagattttccaggtgacta

SEQ ID NO: 745784 - DNA, 22 bp, Artificial Sequence
  chemically synthesized
tggacatgaaatagtcacctgg

SEQ ID NO: 745785 - DNA, 22 bp, Artificial Sequence
  chemically synthesized
gacatgaaatagtcacctggaa

SEQ ID NO: 745786 - DNA, 22 bp, Artificial Sequence
  chemically synthesized
atctacttgagattttccaggt

SEQ ID NO: 745787 - DNA, 22 bp, Artificial Sequence
  chemically synthesized
tactgatctacttgagattttc

SEQ ID NO: 745788 - DNA, 22 bp, Artificial Sequence
  chemically synthesized
gaaaatctcaagtagatcagta

SEQ ID NO: 745789 - DNA, 22 bp, Artificial Sequence
  chemically synthesized
cacaatgaccacaagttatact

SEQ ID NO: 745790 - DNA, 22 bp, Artificial Sequence
  chemically synthesized
ccacaatgaccacaagttatac

SEQ ID NO: 745791 - DNA, 22 bp, Artificial Sequence
  chemically synthesized
tccacaatgaccacaagttata

SEQ ID NO: 745792 - DNA, 22 bp, Artificial Sequence
  chemically synthesized
aagtagatcagtataacttgtg

SEQ ID NO: 745793 - DNA, 22 bp, Artificial Sequence
  chemically synthesized
ctttccacaatgaccacaagtt

SEQ ID NO: 745794 - DNA, 22 bp, Artificial Sequence
  chemically synthesized
tcctttccacaatgaccacaag

SEQ ID NO: 745795 - DNA, 22 bp, Artificial Sequence
  chemically synthesized
ctcctttccacaatgaccacaa

SEQ ID NO: 745796 - DNA, 22 bp, Artificial Sequence
  chemically synthesized
ttctcctttccacaatgaccac

SEQ ID NO: 745797 - DNA, 22 bp, Artificial Sequence
  chemically synthesized
tgtctcttctcctttccacaat

SEQ ID NO: 745798 - DNA, 22 bp, Artificial Sequence
  chemically synthesized
tgtgtctcttctcctttccaca

SEQ ID NO: 745799 - DNA, 22 bp, Artificial Sequence
  chemically synthesized
gtggtcattgtggaaaggagaa

SEQ ID NO: 745800 - DNA, 22 bp, Artificial Sequence
  chemically synthesized
tggtcattgtggaaaggagaag

SEQ ID NO: 745801 - DNA, 22 bp, Artificial Sequence
  chemically synthesized
catacaaacactctgtgtctct

SEQ ID NO: 745802 - DNA, 22 bp, Artificial Sequence
  chemically synthesized
tggaaaggagaagagacacaga

SEQ ID NO: 745803 - DNA, 22 bp, Artificial Sequence
  chemically synthesized
tgcatacaaacactctgtgtct

SEQ ID NO: 745804 - DNA, 22 bp, Artificial Sequence
  chemically synthesized
tctctgcatacaaacactctgt

SEQ ID NO: 745805 - DNA, 22 bp, Artificial Sequence
  chemically synthesized
gtctctgcatacaaacactctg

SEQ ID NO: 745806 - DNA, 22 bp, Artificial Sequence
  chemically synthesized
ttgtctctgcatacaaacactc

SEQ ID NO: 745807 - DNA, 22 bp, Artificial Sequence
  chemically synthesized
cttgtctctgcatacaaacact

SEQ ID NO: 745808 - DNA, 22 bp, Artificial Sequence
  chemically synthesized
cttcttgtctctgcatacaaac

SEQ ID NO: 745809 - DNA, 22 bp, Artificial Sequence
  chemically synthesized
ttacttcttgtctctgcataca

SEQ ID NO: 745810 - DNA, 22 bp, Artificial Sequence
  chemically synthesized
gccattgttacttcttgtctct

SEQ ID NO: 745811 - DNA, 22 bp, Artificial Sequence
  chemically synthesized
tggccattgttacttcttgtct

SEQ ID NO: 745812 - DNA, 22 bp, Artificial Sequence
  chemically synthesized
ctggccattgttacttcttgtc

SEQ ID NO: 745813 - DNA, 22 bp, Artificial Sequence
  chemically synthesized
gtatgcagagacaagaagtaac

SEQ ID NO: 745814 - DNA, 22 bp, Artificial Sequence
  chemically synthesized
tttctggccattgttacttctt

SEQ ID NO: 745815 - DNA, 22 bp, Artificial Sequence
  chemically synthesized
tatgcagagacaagaagtaaca

SEQ ID NO: 745816 - DNA, 22 bp, Artificial Sequence
  chemically synthesized
atttctggccattgttacttct

SEQ ID NO: 745817 - DNA, 22 bp, Artificial Sequence
  chemically synthesized
ccaccagcttatttctggccat

SEQ ID NO: 745818 - DNA, 22 bp, Artificial Sequence
  chemically synthesized
gccaccagcttatttctggcca

SEQ ID NO: 745819 - DNA, 22 bp, Artificial Sequence
  chemically synthesized
catttgccaccagcttatttct

SEQ ID NO: 745820 - DNA, 22 bp, Artificial Sequence
  chemically synthesized
ctccatttgccaccagcttatt

SEQ ID NO: 745821 - DNA, 22 bp, Artificial Sequence
  chemically synthesized
gctccatttgccaccagcttat

SEQ ID NO: 745822 - DNA, 22 bp, Artificial Sequence
  chemically synthesized
caaataatttgctccatttgcc

SEQ ID NO: 745823 - DNA, 22 bp, Artificial Sequence
  chemically synthesized
gcaaataatttgctccatttgc

SEQ ID NO: 745824 - DNA, 22 bp, Artificial Sequence
  chemically synthesized
tgcaaataatttgctccatttg

SEQ ID NO: 745825 - DNA, 22 bp, Artificial Sequence
  chemically synthesized
ttttgcaaataatttgctccat

SEQ ID NO: 745826 - DNA, 22 bp, Artificial Sequence
  chemically synthesized
gtggcaaatggagcaaattatt

SEQ ID NO: 745827 - DNA, 22 bp, Artificial Sequence
  chemically synthesized
aaaattattttgcaaataattt

SEQ ID NO: 745828 - DNA, 22 bp, Artificial Sequence
  chemically synthesized
aaaaattattttgcaaataatt

SEQ ID NO: 745829 - DNA, 22 bp, Artificial Sequence
  chemically synthesized
gatagcgtgacccttaaaaatt

SEQ ID NO: 745830 - DNA, 22 bp, Artificial Sequence
  chemically synthesized
agatagcgtgacccttaaaaat

SEQ ID NO: 745831 - DNA, 22 bp, Artificial Sequence
  chemically synthesized
tttgcaaaataatttttaaggg

SEQ ID NO: 745832 - DNA, 22 bp, Artificial Sequence
  chemically synthesized
tagatagcgtgacccttaaaaa

SEQ ID NO: 745833 - DNA, 22 bp, Artificial Sequence
  chemically synthesized
ttagatagcgtgacccttaaaa

SEQ ID NO: 745834 - DNA, 22 bp, Artificial Sequence
  chemically synthesized
gcaaaataatttttaagggtca

SEQ ID NO: 745835 - DNA, 22 bp, Artificial Sequence
  chemically synthesized
caaaataatttttaagggtcac

SEQ ID NO: 745836 - DNA, 22 bp, Artificial Sequence
  chemically synthesized
tcttttagatagcgtgaccctt

SEQ ID NO: 745837 - DNA, 22 bp, Artificial Sequence
  chemically synthesized
ttaagggtcacgctatctaaaa

SEQ ID NO: 745838 - DNA, 22 bp, Artificial Sequence
  chemically synthesized
taagggtcacgctatctaaaag

SEQ ID NO: 745839 - DNA, 22 bp, Artificial Sequence
  chemically synthesized
aagggtcacgctatctaaaaga

SEQ ID NO: 745840 - DNA, 22 bp, Artificial Sequence
  chemically synthesized
agggtcacgctatctaaaagat

SEQ ID NO: 745841 - DNA, 22 bp, Artificial Sequence
  chemically synthesized
tctaaaagatagcattttgccc

SEQ ID NO: 745842 - DNA, 22 bp, Artificial Sequence
  chemically synthesized
tgcaaaagcatagggcaaaatg

SEQ ID NO: 745843 - DNA, 22 bp, Artificial Sequence
  chemically synthesized
gtgcaaaagcatagggcaaaat

SEQ ID NO: 745844 - DNA, 22 bp, Artificial Sequence
  chemically synthesized
aaagatagcattttgccctatg

SEQ ID NO: 745845 - DNA, 22 bp, Artificial Sequence
  chemically synthesized
tgccctatgcttttgcacaaat

SEQ ID NO: 745846 - DNA, 22 bp, Artificial Sequence
  chemically synthesized
gccctatgcttttgcacaaatt

SEQ ID NO: 745847 - DNA, 22 bp, Artificial Sequence
  chemically synthesized
ccctatgcttttgcacaaattt

SEQ ID NO: 745848 - DNA, 22 bp, Artificial Sequence
  chemically synthesized
gaataaatgaataaacaaattt

SEQ ID NO: 745849 - DNA, 22 bp, Artificial Sequence
  chemically synthesized
tgcttttgcacaaatttgttta

SEQ ID NO: 745850 - DNA, 22 bp, Artificial Sequence
  chemically synthesized
ggaataaatgaataaacaaatt

SEQ ID NO: 745851 - DNA, 22 bp, Artificial Sequence
  chemically synthesized
tggaataaatgaataaacaaat

SEQ ID NO: 745852 - DNA, 22 bp, Artificial Sequence
  chemically synthesized
ttggaataaatgaataaacaaa

SEQ ID NO: 745853 - DNA, 22 bp, Artificial Sequence
  chemically synthesized
ttgcacaaatttgtttattcat

SEQ ID NO: 745854 - DNA, 22 bp, Artificial Sequence
  chemically synthesized
tgcacaaatttgtttattcatt

SEQ ID NO: 745855 - DNA, 22 bp, Artificial Sequence
  chemically synthesized
gcacaaatttgtttattcattt

SEQ ID NO: 745856 - DNA, 22 bp, Artificial Sequence
  chemically synthesized
cacaaatttgtttattcattta

SEQ ID NO: 745857 - DNA, 22 bp, Artificial Sequence
  chemically synthesized
gtttattcatttattccaaaaa

SEQ ID NO: 745858 - DNA, 22 bp, Artificial Sequence
  chemically synthesized
tttattcatttattccaaaaac

SEQ ID NO: 745859 - DNA, 22 bp, Artificial Sequence
  chemically synthesized
attcatttattccaaaaactat

SEQ ID NO: 745860 - DNA, 22 bp, Artificial Sequence
  chemically synthesized
ttcatttattccaaaaactatt

SEQ ID NO: 745861 - DNA, 22 bp, Artificial Sequence
  chemically synthesized
atttattccaaaaactattatt

SEQ ID NO: 745862 - DNA, 22 bp, Artificial Sequence
  chemically synthesized
attccaaaaactattattgggt

SEQ ID NO: 745863 - DNA, 22 bp, Artificial Sequence
  chemically synthesized
ttccaaaaactattattgggta

SEQ ID NO: 745864 - DNA, 22 bp, Artificial Sequence
  chemically synthesized
gcatataataggtacccaataa

SEQ ID NO: 745865 - DNA, 22 bp, Artificial Sequence
  chemically synthesized
caaaaactattattgggtacct

SEQ ID NO: 745866 - DNA, 22 bp, Artificial Sequence
  chemically synthesized
cctggcatataataggtaccca

SEQ ID NO: 745867 - DNA, 22 bp, Artificial Sequence
  chemically synthesized
ttattgggtacctattatatgc

SEQ ID NO: 745868 - DNA, 22 bp, Artificial Sequence
  chemically synthesized
gaacattccctggcatataata

SEQ ID NO: 745869 - DNA, 22 bp, Artificial Sequence
  chemically synthesized
ttgggtacctattatatgccag

SEQ ID NO: 745870 - DNA, 22 bp, Artificial Sequence
  chemically synthesized
ggtacctattatatgccaggga

SEQ ID NO: 745871 - DNA, 22 bp, Artificial Sequence
  chemically synthesized
cagtgcctagaacattccctgg

SEQ ID NO: 745872 - DNA, 22 bp, Artificial Sequence
  chemically synthesized
ccagtgcctagaacattccctg

SEQ ID NO: 745873 - DNA, 22 bp, Artificial Sequence
  chemically synthesized
ttatatgccagggaatgttcta

SEQ ID NO: 745874 - DNA, 22 bp, Artificial Sequence
  chemically synthesized
tatttccagtgcctagaacatt

SEQ ID NO: 745875 - DNA, 22 bp, Artificial Sequence
  chemically synthesized
tatgccagggaatgttctaggc

SEQ ID NO: 745876 - DNA, 22 bp, Artificial Sequence
  chemically synthesized
cgctgtatttccagtgcctaga

SEQ ID NO: 745877 - DNA, 22 bp, Artificial Sequence
  chemically synthesized
acgctgtatttccagtgcctag

SEQ ID NO: 745878 - DNA, 22 bp, Artificial Sequence
  chemically synthesized
tcttacgctgtatttccagtgc

SEQ ID NO: 745879 - DNA, 22 bp, Artificial Sequence
  chemically synthesized
gtctatcttacgctgtatttcc

SEQ ID NO: 745880 - DNA, 22 bp, Artificial Sequence
  chemically synthesized
ggtctatcttacgctgtatttc

SEQ ID NO: 745881 - DNA, 22 bp, Artificial Sequence
  chemically synthesized
taggcactggaaatacagcgta

SEQ ID NO: 745882 - DNA, 22 bp, Artificial Sequence
  chemically synthesized
ggcactggaaatacagcgtaag

SEQ ID NO: 745883 - DNA, 22 bp, Artificial Sequence
  chemically synthesized
cagagacttggtctatcttacg

SEQ ID NO: 745884 - DNA, 22 bp, Artificial Sequence
  chemically synthesized
gaaatacagcgtaagatagacc

SEQ ID NO: 745885 - DNA, 22 bp, Artificial Sequence
  chemically synthesized
catgattacagagacttggtct

SEQ ID NO: 745886 - DNA, 22 bp, Artificial Sequence
  chemically synthesized
agctgcatgattacagagactt

SEQ ID NO: 745887 - DNA, 22 bp, Artificial Sequence
  chemically synthesized
aagctgcatgattacagagact

SEQ ID NO: 745888 - DNA, 22 bp, Artificial Sequence
  chemically synthesized
gccttaagctgcatgattacag

SEQ ID NO: 745889 - DNA, 22 bp, Artificial Sequence
  chemically synthesized
tgtaatcatgcagcttaaggct

SEQ ID NO: 745890 - DNA, 22 bp, Artificial Sequence
  chemically synthesized
taatcatgcagcttaaggctaa

SEQ ID NO: 745891 - DNA, 22 bp, Artificial Sequence
  chemically synthesized
aatgaaatgatatccattagcc

SEQ ID NO: 745892 - DNA, 22 bp, Artificial Sequence
  chemically synthesized
aaatgaaatgatatccattagc

SEQ ID NO: 745893 - DNA, 22 bp, Artificial Sequence
  chemically synthesized
aaggctaatggatatcatttca

SEQ ID NO: 745894 - DNA, 22 bp, Artificial Sequence
  chemically synthesized
aggctaatggatatcatttcat

SEQ ID NO: 745895 - DNA, 22 bp, Artificial Sequence
  chemically synthesized
atagtcatcatttaaatgaaat

SEQ ID NO: 745896 - DNA, 22 bp, Artificial Sequence
  chemically synthesized
atggatatcatttcatttaaat

SEQ ID NO: 745897 - DNA, 22 bp, Artificial Sequence
  chemically synthesized
ttaatagtcatcatttaaatga

SEQ ID NO: 745898 - DNA, 22 bp, Artificial Sequence
  chemically synthesized
gttattaatagtcatcatttaa

SEQ ID NO: 745899 - DNA, 22 bp, Artificial Sequence
  chemically synthesized
taagcctagttattaatagtca

SEQ ID NO: 745900 - DNA, 22 bp, Artificial Sequence
  chemically synthesized
catttaaatgatgactattaat

SEQ ID NO: 745901 - DNA, 22 bp, Artificial Sequence
  chemically synthesized
ataagcctagttattaatagtc

SEQ ID NO: 745902 - DNA, 22 bp, Artificial Sequence
  chemically synthesized
atttaaatgatgactattaata

SEQ ID NO: 745903 - DNA, 22 bp, Artificial Sequence
  chemically synthesized
tataagcctagttattaatagt

SEQ ID NO: 745904 - DNA, 22 bp, Artificial Sequence
  chemically synthesized
tttataagcctagttattaata

SEQ ID NO: 745905 - DNA, 22 bp, Artificial Sequence
  chemically synthesized
ctttataagcctagttattaat

SEQ ID NO: 745906 - DNA, 22 bp, Artificial Sequence
  chemically synthesized
aaatgatgactattaataacta

SEQ ID NO: 745907 - DNA, 22 bp, Artificial Sequence
  chemically synthesized
aatgatgactattaataactag

SEQ ID NO: 745908 - DNA, 22 bp, Artificial Sequence
  chemically synthesized
cttctttataagcctagttatt

SEQ ID NO: 745909 - DNA, 22 bp, Artificial Sequence
  chemically synthesized
gcttctttataagcctagttat

SEQ ID NO: 745910 - DNA, 22 bp, Artificial Sequence
  chemically synthesized
gaatttgcttctttataagcct

SEQ ID NO: 745911 - DNA, 22 bp, Artificial Sequence
  chemically synthesized
ggaatttgcttctttataagcc

SEQ ID NO: 745912 - DNA, 22 bp, Artificial Sequence
  chemically synthesized
ttaataactaggcttataaaga

SEQ ID NO: 745913 - DNA, 22 bp, Artificial Sequence
  chemically synthesized
gcttggaatttgcttctttata

SEQ ID NO: 745914 - DNA, 22 bp, Artificial Sequence
  chemically synthesized
ataactaggcttataaagaagc

SEQ ID NO: 745915 - DNA, 22 bp, Artificial Sequence
  chemically synthesized
ggcttggaatttgcttctttat

SEQ ID NO: 745916 - DNA, 22 bp, Artificial Sequence
  chemically synthesized
tggcttggaatttgcttcttta

SEQ ID NO: 745917 - DNA, 22 bp, Artificial Sequence
  chemically synthesized
ggcttataaagaagcaaattcc

SEQ ID NO: 745918 - DNA, 22 bp, Artificial Sequence
  chemically synthesized
ataaagaagcaaattccaagcc

SEQ ID NO: 745919 - DNA, 22 bp, Artificial Sequence
  chemically synthesized
taaagaagcaaattccaagcca

SEQ ID NO: 745920 - DNA, 22 bp, Artificial Sequence
  chemically synthesized
tagccatgatatattttggctt

SEQ ID NO: 745921 - DNA, 22 bp, Artificial Sequence
  chemically synthesized
atagccatgatatattttggct

SEQ ID NO: 745922 - DNA, 22 bp, Artificial Sequence
  chemically synthesized
tatagccatgatatattttggc

SEQ ID NO: 745923 - DNA, 22 bp, Artificial Sequence
  chemically synthesized
tattttatagccatgatatatt

SEQ ID NO: 745924 - DNA, 22 bp, Artificial Sequence
  chemically synthesized
caagccaaaatatatcatggct

SEQ ID NO: 745925 - DNA, 22 bp, Artificial Sequence
  chemically synthesized
gtcaaaaattgtattttatagc

SEQ ID NO: 745926 - DNA, 22 bp, Artificial Sequence
  chemically synthesized
ggtcaaaaattgtattttatag

SEQ ID NO: 745927 - DNA, 22 bp, Artificial Sequence
  chemically synthesized
ttggtcaaaaattgtattttat

SEQ ID NO: 745928 - DNA, 22 bp, Artificial Sequence
  chemically synthesized
cttggtcaaaaattgtatttta

SEQ ID NO: 745929 - DNA, 22 bp, Artificial Sequence
  chemically synthesized
tcttggtcaaaaattgtatttt

SEQ ID NO: 745930 - DNA, 22 bp, Artificial Sequence
  chemically synthesized
cattttcttggtcaaaaattgt

SEQ ID NO: 745931 - DNA, 22 bp, Artificial Sequence
  chemically synthesized
tcctgcattttcttggtcaaaa

SEQ ID NO: 745932 - DNA, 22 bp, Artificial Sequence
  chemically synthesized
taaaatacaatttttgaccaag

SEQ ID NO: 745933 - DNA, 22 bp, Artificial Sequence
  chemically synthesized
gtcctgcattttcttggtcaaa

SEQ ID NO: 745934 - DNA, 22 bp, Artificial Sequence
  chemically synthesized
tgtcctgcattttcttggtcaa

SEQ ID NO: 745935 - DNA, 22 bp, Artificial Sequence
  chemically synthesized
tactttgtcctgcattttcttg

SEQ ID NO: 745936 - DNA, 22 bp, Artificial Sequence
  chemically synthesized
ttgaccaagaaaatgcaggaca

SEQ ID NO: 745937 - DNA, 22 bp, Artificial Sequence
  chemically synthesized
tgaccaagaaaatgcaggacaa

SEQ ID NO: 745938 - DNA, 22 bp, Artificial Sequence
  chemically synthesized
caatattatactttgtcctgca

SEQ ID NO: 745939 - DNA, 22 bp, Artificial Sequence
  chemically synthesized
gaccaagaaaatgcaggacaaa

SEQ ID NO: 745940 - DNA, 22 bp, Artificial Sequence
  chemically synthesized
accaagaaaatgcaggacaaag

SEQ ID NO: 745941 - DNA, 22 bp, Artificial Sequence
  chemically synthesized
tctgcaatattatactttgtcc

SEQ ID NO: 745942 - DNA, 22 bp, Artificial Sequence
  chemically synthesized
ctatctgcaatattatactttg

SEQ ID NO: 745943 - DNA, 22 bp, Artificial Sequence
  chemically synthesized
agactgctatctgcaatattat

SEQ ID NO: 745944 - DNA, 22 bp, Artificial Sequence
  chemically synthesized
gagactgctatctgcaatatta

SEQ ID NO: 745945 - DNA, 22 bp, Artificial Sequence
  chemically synthesized
tgagactgctatctgcaatatt

SEQ ID NO: 745946 - DNA, 22 bp, Artificial Sequence
  chemically synthesized
tttgagactgctatctgcaata

SEQ ID NO: 745947 - DNA, 22 bp, Artificial Sequence
  chemically synthesized
cagatagcagtctcaaagagat

SEQ ID NO: 745948 - DNA, 22 bp, Artificial Sequence
  chemically synthesized
ataagtgaaaacagaatctctt

SEQ ID NO: 745949 - DNA, 22 bp, Artificial Sequence
  chemically synthesized
aataagtgaaaacagaatctct

SEQ ID NO: 745950 - DNA, 22 bp, Artificial Sequence
  chemically synthesized
taataagtgaaaacagaatctc

SEQ ID NO: 745951 - DNA, 22 bp, Artificial Sequence
  chemically synthesized
ctttaataagtgaaaacagaat

SEQ ID NO: 745952 - DNA, 22 bp, Artificial Sequence
  chemically synthesized
gctttaataagtgaaaacagaa

SEQ ID NO: 745953 - DNA, 22 bp, Artificial Sequence
  chemically synthesized
atttgctttaataagtgaaaac

SEQ ID NO: 745954 - DNA, 22 bp, Artificial Sequence
  chemically synthesized
aaagagattctgttttcactta

SEQ ID NO: 745955 - DNA, 22 bp, Artificial Sequence
  chemically synthesized
aatttgctttaataagtgaaaa

SEQ ID NO: 745956 - DNA, 22 bp, Artificial Sequence
  chemically synthesized
tgttttcacttattaaagcaaa

SEQ ID NO: 745957 - DNA, 22 bp, Artificial Sequence
  chemically synthesized
ttttcacttattaaagcaaatt

SEQ ID NO: 745958 - DNA, 22 bp, Artificial Sequence
  chemically synthesized
tcacttattaaagcaaattaag

SEQ ID NO: 745959 - DNA, 22 bp, Artificial Sequence
  chemically synthesized
cacttattaaagcaaattaagc

SEQ ID NO: 745960 - DNA, 22 bp, Artificial Sequence
  chemically synthesized
acttattaaagcaaattaagct

SEQ ID NO: 745961 - DNA, 22 bp, Artificial Sequence
  chemically synthesized
agacatgcagaggtagcttaat

SEQ ID NO: 745962 - DNA, 22 bp, Artificial Sequence
  chemically synthesized
attaaagcaaattaagctacct

SEQ ID NO: 745963 - DNA, 22 bp, Artificial Sequence
  chemically synthesized
ttaaagcaaattaagctacctc

SEQ ID NO: 745964 - DNA, 22 bp, Artificial Sequence
  chemically synthesized
ttcagacatgcagaggtagctt

SEQ ID NO: 745965 - DNA, 22 bp, Artificial Sequence
  chemically synthesized
aagcaaattaagctacctctgc

SEQ ID NO: 745966 - DNA, 22 bp, Artificial Sequence
  chemically synthesized
atcattattcagacatgcagag

SEQ ID NO: 745967 - DNA, 22 bp, Artificial Sequence
  chemically synthesized
ttaatcattattcagacatgca

SEQ ID NO: 745968 - DNA, 22 bp, Artificial Sequence
  chemically synthesized
tattaatcattattcagacatg

SEQ ID NO: 745969 - DNA, 22 bp, Artificial Sequence
  chemically synthesized
agctacctctgcatgtctgaat

SEQ ID NO: 745970 - DNA, 22 bp, Artificial Sequence
  chemically synthesized
ctctattaatcattattcagac

SEQ ID NO: 745971 - DNA, 22 bp, Artificial Sequence
  chemically synthesized
cctctgcatgtctgaataatga

SEQ ID NO: 745972 - DNA, 22 bp, Artificial Sequence
  chemically synthesized
gattcctctattaatcattatt

SEQ ID NO: 745973 - DNA, 22 bp, Artificial Sequence
  chemically synthesized
tgcatgtctgaataatgattaa

SEQ ID NO: 745974 - DNA, 22 bp, Artificial Sequence
  chemically synthesized
tagattcctctattaatcatta

SEQ ID NO: 745975 - DNA, 22 bp, Artificial Sequence
  chemically synthesized
catgtctgaataatgattaata

SEQ ID NO: 745976 - DNA, 22 bp, Artificial Sequence
  chemically synthesized
acaattctagattcctctatta

SEQ ID NO: 745977 - DNA, 22 bp, Artificial Sequence
  chemically synthesized
aataatgattaatagaggaatc

SEQ ID NO: 745978 - DNA, 22 bp, Artificial Sequence
  chemically synthesized
cacgggtaactcacaattctag

SEQ ID NO: 745979 - DNA, 22 bp, Artificial Sequence
  chemically synthesized
atagaggaatctagaattgtga

SEQ ID NO: 745980 - DNA, 22 bp, Artificial Sequence
  chemically synthesized
gaattgtgagttacccgtgcaa

SEQ ID NO: 745981 - DNA, 22 bp, Artificial Sequence
  chemically synthesized
tgagttacccgtgcaatatgct

SEQ ID NO: 745982 - DNA, 22 bp, Artificial Sequence
  chemically synthesized
cccgtgcaatatgctgtacctg

SEQ ID NO: 745983 - DNA, 22 bp, Artificial Sequence
  chemically synthesized
catataaagcaaaccaggtaca

SEQ ID NO: 745984 - DNA, 22 bp, Artificial Sequence
  chemically synthesized
aataaatgtgctccatataaag

SEQ ID NO: 745985 - DNA, 22 bp, Artificial Sequence
  chemically synthesized
tacctggtttgctttatatgga

SEQ ID NO: 745986 - DNA, 22 bp, Artificial Sequence
  chemically synthesized
gtttgctttatatggagcacat

SEQ ID NO: 745987 - DNA, 22 bp, Artificial Sequence
  chemically synthesized
gctttatatggagcacatttat

SEQ ID NO: 745988 - DNA, 22 bp, Artificial Sequence
  chemically synthesized
ctttatatggagcacatttatt

SEQ ID NO: 745989 - DNA, 22 bp, Artificial Sequence
  chemically synthesized
gaaccaaaactaaataaatgtg

SEQ ID NO: 745990 - DNA, 22 bp, Artificial Sequence
  chemically synthesized
tatatggagcacatttatttag

SEQ ID NO: 745991 - DNA, 22 bp, Artificial Sequence
  chemically synthesized
atatggagcacatttatttagt

SEQ ID NO: 745992 - DNA, 22 bp, Artificial Sequence
  chemically synthesized
tatggagcacatttatttagtt

SEQ ID NO: 745993 - DNA, 22 bp, Artificial Sequence
  chemically synthesized
cccctagaaccaaaactaaata

SEQ ID NO: 745994 - DNA, 22 bp, Artificial Sequence
  chemically synthesized
ccccctagaaccaaaactaaat

SEQ ID NO: 745995 - DNA, 22 bp, Artificial Sequence
  chemically synthesized
atttagttttggttctaggggg

SEQ ID NO: 745996 - DNA, 22 bp, Artificial Sequence
  chemically synthesized
tttagttttggttctaggggga

SEQ ID NO: 745997 - DNA, 22 bp, Artificial Sequence
  chemically synthesized
agtagtgagtgccttcccccta

SEQ ID NO: 745998 - DNA, 22 bp, Artificial Sequence
  chemically synthesized
agttttggttctagggggaagg

SEQ ID NO: 745999 - DNA, 22 bp, Artificial Sequence
  chemically synthesized
cagtagtgagtgccttccccct

SEQ ID NO: 746000 - DNA, 22 bp, Artificial Sequence
  chemically synthesized
gttttggttctagggggaaggc

SEQ ID NO: 746001 - DNA, 22 bp, Artificial Sequence
  chemically synthesized
tttcagtagtgagtgccttccc

SEQ ID NO: 746002 - DNA, 22 bp, Artificial Sequence
  chemically synthesized
gtttcagtagtgagtgccttcc

SEQ ID NO: 746003 - DNA, 22 bp, Artificial Sequence
  chemically synthesized
tggttctagggggaaggcactc

SEQ ID NO: 746004 - DNA, 22 bp, Artificial Sequence
  chemically synthesized
tgtttcagtagtgagtgccttc

SEQ ID NO: 746005 - DNA, 22 bp, Artificial Sequence
  chemically synthesized
ggttctagggggaaggcactca

SEQ ID NO: 746006 - DNA, 22 bp, Artificial Sequence
  chemically synthesized
gttctagggggaaggcactcac

SEQ ID NO: 746007 - DNA, 22 bp, Artificial Sequence
  chemically synthesized
tagggggaaggcactcactact

SEQ ID NO: 746008 - DNA, 22 bp, Artificial Sequence
  chemically synthesized
gggggaaggcactcactactga

SEQ ID NO: 746009 - DNA, 22 bp, Artificial Sequence
  chemically synthesized
actactgaaacaaaatggattt

SEQ ID NO: 746010 - DNA, 22 bp, Artificial Sequence
  chemically synthesized
ctgaaacaaaatggatttttac

SEQ ID NO: 746011 - DNA, 22 bp, Artificial Sequence
  chemically synthesized
aaacaaaatggatttttactga

SEQ ID NO: 746012 - DNA, 22 bp, Artificial Sequence
  chemically synthesized
aatgaaaaatcaaatcagtaaa

SEQ ID NO: 746013 - DNA, 22 bp, Artificial Sequence
  chemically synthesized
ataatatattgaatgaaaaatc

SEQ ID NO: 746014 - DNA, 22 bp, Artificial Sequence
  chemically synthesized
ttactgatttgatttttcattc

SEQ ID NO: 746015 - DNA, 22 bp, Artificial Sequence
  chemically synthesized
tactgatttgatttttcattca

SEQ ID NO: 746016 - DNA, 22 bp, Artificial Sequence
  chemically synthesized
actgatttgatttttcattcaa

SEQ ID NO: 746017 - DNA, 22 bp, Artificial Sequence
  chemically synthesized
ctgatttgatttttcattcaat

SEQ ID NO: 746018 - DNA, 22 bp, Artificial Sequence
  chemically synthesized
agttaataatatattgaatgaa

SEQ ID NO: 746019 - DNA, 22 bp, Artificial Sequence
  chemically synthesized
taagttaataatatattgaatg

SEQ ID NO: 746020 - DNA, 22 bp, Artificial Sequence
  chemically synthesized
atttgatttttcattcaatata

SEQ ID NO: 746021 - DNA, 22 bp, Artificial Sequence
  chemically synthesized
ctaagttaataatatattgaat

SEQ ID NO: 746022 - DNA, 22 bp, Artificial Sequence
  chemically synthesized
gatttttcattcaatatattat

SEQ ID NO: 746023 - DNA, 22 bp, Artificial Sequence
  chemically synthesized
atttttcattcaatatattatt

SEQ ID NO: 746024 - DNA, 22 bp, Artificial Sequence
  chemically synthesized
gtatttctaagttaataatata

SEQ ID NO: 746025 - DNA, 22 bp, Artificial Sequence
  chemically synthesized
agtatttctaagttaataatat

SEQ ID NO: 746026 - DNA, 22 bp, Artificial Sequence
  chemically synthesized
ttcattcaatatattattaact

SEQ ID NO: 746027 - DNA, 22 bp, Artificial Sequence
  chemically synthesized
tcattcaatatattattaactt

SEQ ID NO: 746028 - DNA, 22 bp, Artificial Sequence
  chemically synthesized
cattcaatatattattaactta

SEQ ID NO: 746029 - DNA, 22 bp, Artificial Sequence
  chemically synthesized
ccttagtatttctaagttaata

SEQ ID NO: 746030 - DNA, 22 bp, Artificial Sequence
  chemically synthesized
attcaatatattattaacttag

SEQ ID NO: 746031 - DNA, 22 bp, Artificial Sequence
  chemically synthesized
tgccttagtatttctaagttaa

SEQ ID NO: 746032 - DNA, 22 bp, Artificial Sequence
  chemically synthesized
ctgccttagtatttctaagtta

SEQ ID NO: 746033 - DNA, 22 bp, Artificial Sequence
  chemically synthesized
aatatattattaacttagaaat

SEQ ID NO: 746034 - DNA, 22 bp, Artificial Sequence
  chemically synthesized
atttctgccttagtatttctaa

SEQ ID NO: 746035 - DNA, 22 bp, Artificial Sequence
  chemically synthesized
gttcatttctgccttagtattt

SEQ ID NO: 746036 - DNA, 22 bp, Artificial Sequence
  chemically synthesized
ggttcatttctgccttagtatt

SEQ ID NO: 746037 - DNA, 22 bp, Artificial Sequence
  chemically synthesized
tggttcatttctgccttagtat

SEQ ID NO: 746038 - DNA, 22 bp, Artificial Sequence
  chemically synthesized
ttaacttagaaatactaaggca

SEQ ID NO: 746039 - DNA, 22 bp, Artificial Sequence
  chemically synthesized
acttagaaatactaaggcagaa

SEQ ID NO: 746040 - DNA, 22 bp, Artificial Sequence
  chemically synthesized
atctttggttcatttctgcctt

SEQ ID NO: 746041 - DNA, 22 bp, Artificial Sequence
  chemically synthesized
agaaatactaaggcagaaatga

SEQ ID NO: 746042 - DNA, 22 bp, Artificial Sequence
  chemically synthesized
gaaatactaaggcagaaatgaa

SEQ ID NO: 746043 - DNA, 22 bp, Artificial Sequence
  chemically synthesized
tattaatctttggttcatttct

SEQ ID NO: 746044 - DNA, 22 bp, Artificial Sequence
  chemically synthesized
gtattaatctttggttcatttc

SEQ ID NO: 746045 - DNA, 22 bp, Artificial Sequence
  chemically synthesized
aggcagaaatgaaccaaagatt

SEQ ID NO: 746046 - DNA, 22 bp, Artificial Sequence
  chemically synthesized
aaaatttgtattaatctttggt

SEQ ID NO: 746047 - DNA, 22 bp, Artificial Sequence
  chemically synthesized
aaaaatttgtattaatctttgg

SEQ ID NO: 746048 - DNA, 22 bp, Artificial Sequence
  chemically synthesized
ttaaaaatttgtattaatcttt

SEQ ID NO: 746049 - DNA, 22 bp, Artificial Sequence
  chemically synthesized
ctcttaaaaatttgtattaatc

SEQ ID NO: 746050 - DNA, 22 bp, Artificial Sequence
  chemically synthesized
tcactgctcttaaaaatttgta

SEQ ID NO: 746051 - DNA, 22 bp, Artificial Sequence
  chemically synthesized
atcactgctcttaaaaatttgt

SEQ ID NO: 746052 - DNA, 22 bp, Artificial Sequence
  chemically synthesized
tatcactgctcttaaaaatttg

SEQ ID NO: 746053 - DNA, 22 bp, Artificial Sequence
  chemically synthesized
ttatcactgctcttaaaaattt

SEQ ID NO: 746054 - DNA, 22 bp, Artificial Sequence
  chemically synthesized
tttttatcactgctcttaaaaa

SEQ ID NO: 746055 - DNA, 22 bp, Artificial Sequence
  chemically synthesized
atacaaatttttaagagcagtg

SEQ ID NO: 746056 - DNA, 22 bp, Artificial Sequence
  chemically synthesized
tgtattatttttatcactgctc

SEQ ID NO: 746057 - DNA, 22 bp, Artificial Sequence
  chemically synthesized
tgtgtattatttttatcactgc

SEQ ID NO: 746058 - DNA, 22 bp, Artificial Sequence
  chemically synthesized
ctgtgtattatttttatcactg

SEQ ID NO: 746059 - DNA, 22 bp, Artificial Sequence
  chemically synthesized
ttctgtgtattatttttatcac

SEQ ID NO: 746060 - DNA, 22 bp, Artificial Sequence
  chemically synthesized
ttaagagcagtgataaaaataa

SEQ ID NO: 746061 - DNA, 22 bp, Artificial Sequence
  chemically synthesized
taagagcagtgataaaaataat

SEQ ID NO: 746062 - DNA, 22 bp, Artificial Sequence
  chemically synthesized
aagagcagtgataaaaataata

SEQ ID NO: 746063 - DNA, 22 bp, Artificial Sequence
  chemically synthesized
agagcagtgataaaaataatac

SEQ ID NO: 746064 - DNA, 22 bp, Artificial Sequence
  chemically synthesized
gccctcttctgtgtattatttt

SEQ ID NO: 746065 - DNA, 22 bp, Artificial Sequence
  chemically synthesized
agccctcttctgtgtattattt

SEQ ID NO: 746066 - DNA, 22 bp, Artificial Sequence
  chemically synthesized
tagccctcttctgtgtattatt

SEQ ID NO: 746067 - DNA, 22 bp, Artificial Sequence
  chemically synthesized
ttagccctcttctgtgtattat

SEQ ID NO: 746068 - DNA, 22 bp, Artificial Sequence
  chemically synthesized
tttagccctcttctgtgtatta

SEQ ID NO: 746069 - DNA, 22 bp, Artificial Sequence
  chemically synthesized
caatcctttttagccctcttct

SEQ ID NO: 746070 - DNA, 22 bp, Artificial Sequence
  chemically synthesized
gcaatcctttttagccctcttc

SEQ ID NO: 746071 - DNA, 22 bp, Artificial Sequence
  chemically synthesized
tgcaatcctttttagccctctt

SEQ ID NO: 746072 - DNA, 22 bp, Artificial Sequence
  chemically synthesized
ttgcaatcctttttagccctct

SEQ ID NO: 746073 - DNA, 22 bp, Artificial Sequence
  chemically synthesized
aaggacgtttttgcaatccttt

SEQ ID NO: 746074 - DNA, 22 bp, Artificial Sequence
  chemically synthesized
gatattaaaggacgtttttgca

SEQ ID NO: 746075 - DNA, 22 bp, Artificial Sequence
  chemically synthesized
aaaaggattgcaaaaacgtcct

SEQ ID NO: 746076 - DNA, 22 bp, Artificial Sequence
  chemically synthesized
aaagtaaaattggatattaaag

SEQ ID NO: 746077 - DNA, 22 bp, Artificial Sequence
  chemically synthesized
caaaaacgtcctttaatatcca

SEQ ID NO: 746078 - DNA, 22 bp, Artificial Sequence
  chemically synthesized
caataatctgaaagtaaaattg

SEQ ID NO: 746079 - DNA, 22 bp, Artificial Sequence
  chemically synthesized
taatatccaattttactttcag

SEQ ID NO: 746080 - DNA, 22 bp, Artificial Sequence
  chemically synthesized
aatatccaattttactttcaga

SEQ ID NO: 746081 - DNA, 22 bp, Artificial Sequence
  chemically synthesized
atatccaattttactttcagat

SEQ ID NO: 746082 - DNA, 22 bp, Artificial Sequence
  chemically synthesized
ggaactacaataatctgaaagt

SEQ ID NO: 746083 - DNA, 22 bp, Artificial Sequence
  chemically synthesized
aggaactacaataatctgaaag

SEQ ID NO: 746084 - DNA, 22 bp, Artificial Sequence
  chemically synthesized
catttaggaactacaataatct

SEQ ID NO: 746085 - DNA, 22 bp, Artificial Sequence
  chemically synthesized
attacatttaggaactacaata

SEQ ID NO: 746086 - DNA, 22 bp, Artificial Sequence
  chemically synthesized
tactttcagattattgtagttc

SEQ ID NO: 746087 - DNA, 22 bp, Artificial Sequence
  chemically synthesized
actttcagattattgtagttcc

SEQ ID NO: 746088 - DNA, 22 bp, Artificial Sequence
  chemically synthesized
ctttcagattattgtagttcct

SEQ ID NO: 746089 - DNA, 22 bp, Artificial Sequence
  chemically synthesized
tcagattattgtagttcctaaa

SEQ ID NO: 746090 - DNA, 22 bp, Artificial Sequence
  chemically synthesized
cagattattgtagttcctaaat

SEQ ID NO: 746091 - DNA, 22 bp, Artificial Sequence
  chemically synthesized
agattattgtagttcctaaatg

SEQ ID NO: 746092 - DNA, 22 bp, Artificial Sequence
  chemically synthesized
aaaacattaattacatttagga

SEQ ID NO: 746093 - DNA, 22 bp, Artificial Sequence
  chemically synthesized
ttgtagttcctaaatgtaatta

SEQ ID NO: 746094 - DNA, 22 bp, Artificial Sequence
  chemically synthesized
tagttcctaaatgtaattaatg

SEQ ID NO: 746095 - DNA, 22 bp, Artificial Sequence
  chemically synthesized
gaaaggctaaaaacattaatta

SEQ ID NO: 746096 - DNA, 22 bp, Artificial Sequence
  chemically synthesized
agaaaggctaaaaacattaatt

SEQ ID NO: 746097 - DNA, 22 bp, Artificial Sequence
  chemically synthesized
tagaaaggctaaaaacattaat

SEQ ID NO: 746098 - DNA, 22 bp, Artificial Sequence
  chemically synthesized
ctaaatgtaattaatgttttta

SEQ ID NO: 746099 - DNA, 22 bp, Artificial Sequence
  chemically synthesized
aatgtaattaatgtttttagcc

SEQ ID NO: 746100 - DNA, 22 bp, Artificial Sequence
  chemically synthesized
atgtttttagcctttctaaaat

SEQ ID NO: 746101 - DNA, 22 bp, Artificial Sequence
  chemically synthesized
caagaaataagaccattttaga

SEQ ID NO: 746102 - DNA, 22 bp, Artificial Sequence
  chemically synthesized
gcaagaaataagaccattttag

SEQ ID NO: 746103 - DNA, 22 bp, Artificial Sequence
  chemically synthesized
ttagcctttctaaaatggtctt

SEQ ID NO: 746104 - DNA, 22 bp, Artificial Sequence
  chemically synthesized
tttgcaagaaataagaccattt

SEQ ID NO: 746105 - DNA, 22 bp, Artificial Sequence
  chemically synthesized
tagcctttctaaaatggtctta

SEQ ID NO: 746106 - DNA, 22 bp, Artificial Sequence
  chemically synthesized
gtttgcaagaaataagaccatt

SEQ ID NO: 746107 - DNA, 22 bp, Artificial Sequence
  chemically synthesized
agcctttctaaaatggtcttat

SEQ ID NO: 746108 - DNA, 22 bp, Artificial Sequence
  chemically synthesized
tgtttgcaagaaataagaccat

SEQ ID NO: 746109 - DNA, 22 bp, Artificial Sequence
  chemically synthesized
gcctttctaaaatggtcttatt

SEQ ID NO: 746110 - DNA, 22 bp, Artificial Sequence
  chemically synthesized
ttttgtttgcaagaaataagac

SEQ ID NO: 746111 - DNA, 22 bp, Artificial Sequence
  chemically synthesized
attttgtttgcaagaaataaga

SEQ ID NO: 746112 - DNA, 22 bp, Artificial Sequence
  chemically synthesized
tattttgtttgcaagaaataag

SEQ ID NO: 746113 - DNA, 22 bp, Artificial Sequence
  chemically synthesized
tctaaaatggtcttatttcttg

SEQ ID NO: 746114 - DNA, 22 bp, Artificial Sequence
  chemically synthesized
ttattttgtttgcaagaaataa

SEQ ID NO: 746115 - DNA, 22 bp, Artificial Sequence
  chemically synthesized
ctaaaatggtcttatttcttgc

SEQ ID NO: 746116 - DNA, 22 bp, Artificial Sequence
  chemically synthesized
tttattttgtttgcaagaaata

SEQ ID NO: 746117 - DNA, 22 bp, Artificial Sequence
  chemically synthesized
taaaatggtcttatttcttgca

SEQ ID NO: 746118 - DNA, 22 bp, Artificial Sequence
  chemically synthesized
ttttattttgtttgcaagaaat

SEQ ID NO: 746119 - DNA, 22 bp, Artificial Sequence
  chemically synthesized
aaatggtcttatttcttgcaaa

SEQ ID NO: 746120 - DNA, 22 bp, Artificial Sequence
  chemically synthesized
cttttttattttgtttgcaaga

SEQ ID NO: 746121 - DNA, 22 bp, Artificial Sequence
  chemically synthesized
atttcttgcaaacaaaataaaa

SEQ ID NO: 746122 - DNA, 22 bp, Artificial Sequence
  chemically synthesized
aacatcctgcttttttattttg

SEQ ID NO: 746123 - DNA, 22 bp, Artificial Sequence
  chemically synthesized
tttcttgcaaacaaaataaaaa

SEQ ID NO: 746124 - DNA, 22 bp, Artificial Sequence
  chemically synthesized
cttgcaaacaaaataaaaaagc

SEQ ID NO: 746125 - DNA, 22 bp, Artificial Sequence
  chemically synthesized
ttgcaaacaaaataaaaaagca

SEQ ID NO: 746126 - DNA, 22 bp, Artificial Sequence
  chemically synthesized
gcaaacaaaataaaaaagcagg

SEQ ID NO: 746127 - DNA, 22 bp, Artificial Sequence
  chemically synthesized
caaacaaaataaaaaagcagga

SEQ ID NO: 746128 - DNA, 22 bp, Artificial Sequence
  chemically synthesized
agtagttgaacatcctgctttt

SEQ ID NO: 746129 - DNA, 22 bp, Artificial Sequence
  chemically synthesized
aagtagttgaacatcctgcttt

SEQ ID NO: 746130 - DNA, 22 bp, Artificial Sequence
  chemically synthesized
taagtagttgaacatcctgctt

SEQ ID NO: 746131 - DNA, 22 bp, Artificial Sequence
  chemically synthesized
actttaagtagttgaacatcct

SEQ ID NO: 746132 - DNA, 22 bp, Artificial Sequence
  chemically synthesized
gactttaagtagttgaacatcc

SEQ ID NO: 746133 - DNA, 22 bp, Artificial Sequence
  chemically synthesized
gtttgactttaagtagttgaac

SEQ ID NO: 746134 - DNA, 22 bp, Artificial Sequence
  chemically synthesized
cgtttgactttaagtagttgaa

SEQ ID NO: 746135 - DNA, 22 bp, Artificial Sequence
  chemically synthesized
tcgtttgactttaagtagttga

SEQ ID NO: 746136 - DNA, 22 bp, Artificial Sequence
  chemically synthesized
ctttcgtttgactttaagtagt

SEQ ID NO: 746137 - DNA, 22 bp, Artificial Sequence
  chemically synthesized
ttcctttcgtttgactttaagt

SEQ ID NO: 746138 - DNA, 22 bp, Artificial Sequence
  chemically synthesized
tgttcctttcgtttgactttaa

SEQ ID NO: 746139 - DNA, 22 bp, Artificial Sequence
  chemically synthesized
ctgttcctttcgtttgacttta

SEQ ID NO: 746140 - DNA, 22 bp, Artificial Sequence
  chemically synthesized
tctgttcctttcgtttgacttt

SEQ ID NO: 746141 - DNA, 22 bp, Artificial Sequence
  chemically synthesized
aactacttaaagtcaaacgaaa

SEQ ID NO: 746142 - DNA, 22 bp, Artificial Sequence
  chemically synthesized
gttttctgttcctttcgtttga

SEQ ID NO: 746143 - DNA, 22 bp, Artificial Sequence
  chemically synthesized
cttaaagtcaaacgaaaggaac

SEQ ID NO: 746144 - DNA, 22 bp, Artificial Sequence
  chemically synthesized
aaagtcaaacgaaaggaacaga

SEQ ID NO: 746145 - DNA, 22 bp, Artificial Sequence
  chemically synthesized
aagtcaaacgaaaggaacagaa

SEQ ID NO: 746146 - DNA, 22 bp, Artificial Sequence
  chemically synthesized
atgaagaaaattcgttttctgt

SEQ ID NO: 746147 - DNA, 22 bp, Artificial Sequence
  chemically synthesized
aatgaagaaaattcgttttctg

SEQ ID NO: 746148 - DNA, 22 bp, Artificial Sequence
  chemically synthesized
taatgaagaaaattcgttttct

SEQ ID NO: 746149 - DNA, 22 bp, Artificial Sequence
  chemically synthesized
catagattttaatgaagaaaat

SEQ ID NO: 746150 - DNA, 22 bp, Artificial Sequence
  chemically synthesized
tgatgttgcatagattttaatg

SEQ ID NO: 746151 - DNA, 22 bp, Artificial Sequence
  chemically synthesized
tcttcattaaaatctatgcaac

SEQ ID NO: 746152 - DNA, 22 bp, Artificial Sequence
  chemically synthesized
cttcattaaaatctatgcaaca

SEQ ID NO: 746153 - DNA, 22 bp, Artificial Sequence
  chemically synthesized
ttcattaaaatctatgcaacat

SEQ ID NO: 746154 - DNA, 22 bp, Artificial Sequence
  chemically synthesized
cattaaaatctatgcaacatca

SEQ ID NO: 746155 - DNA, 22 bp, Artificial Sequence
  chemically synthesized
attaaaatctatgcaacatcat

SEQ ID NO: 746156 - DNA, 22 bp, Artificial Sequence
  chemically synthesized
aaatctatgcaacatcataatg

SEQ ID NO: 746157 - DNA, 22 bp, Artificial Sequence
  chemically synthesized
tgcaacatcataatggttcatc

SEQ ID NO: 746158 - DNA, 22 bp, Artificial Sequence
  chemically synthesized
agaatatgatgaaaagaagatg

SEQ ID NO: 746159 - DNA, 22 bp, Artificial Sequence
  chemically synthesized
agcctcagaatatgatgaaaag

SEQ ID NO: 746160 - DNA, 22 bp, Artificial Sequence
  chemically synthesized
cagcctcagaatatgatgaaaa

SEQ ID NO: 746161 - DNA, 22 bp, Artificial Sequence
  chemically synthesized
tcagcctcagaatatgatgaaa

SEQ ID NO: 746162 - DNA, 22 bp, Artificial Sequence
  chemically synthesized
ttcagcctcagaatatgatgaa

SEQ ID NO: 746163 - DNA, 22 bp, Artificial Sequence
  chemically synthesized
ttttcagcctcagaatatgatg

SEQ ID NO: 746164 - DNA, 22 bp, Artificial Sequence
  chemically synthesized
cttttcagcctcagaatatgat

SEQ ID NO: 746165 - DNA, 22 bp, Artificial Sequence
  chemically synthesized
atcttcttttcatcatattctg

SEQ ID NO: 746166 - DNA, 22 bp, Artificial Sequence
  chemically synthesized
tcttttcagcctcagaatatga

SEQ ID NO: 746167 - DNA, 22 bp, Artificial Sequence
  chemically synthesized
cttttcatcatattctgaggct

SEQ ID NO: 746168 - DNA, 22 bp, Artificial Sequence
  chemically synthesized
ttttcatcatattctgaggctg

SEQ ID NO: 746169 - DNA, 22 bp, Artificial Sequence
  chemically synthesized
ttcatcatattctgaggctgaa

SEQ ID NO: 746170 - DNA, 22 bp, Artificial Sequence
  chemically synthesized
tcatcatattctgaggctgaaa

SEQ ID NO: 746171 - DNA, 22 bp, Artificial Sequence
  chemically synthesized
catcatattctgaggctgaaaa

SEQ ID NO: 746172 - DNA, 22 bp, Artificial Sequence
  chemically synthesized
atcatattctgaggctgaaaag

SEQ ID NO: 746173 - DNA, 22 bp, Artificial Sequence
  chemically synthesized
tgaggctgaaaagaaagtctta

SEQ ID NO: 746174 - DNA, 22 bp, Artificial Sequence
  chemically synthesized
agaaatgaatacataagacttt

SEQ ID NO: 746175 - DNA, 22 bp, Artificial Sequence
  chemically synthesized
aggctgaaaagaaagtcttatg

SEQ ID NO: 746176 - DNA, 22 bp, Artificial Sequence
  chemically synthesized
ctcagaaatgaatacataagac

SEQ ID NO: 746177 - DNA, 22 bp, Artificial Sequence
  chemically synthesized
aaaagaaagtcttatgtattca

SEQ ID NO: 746178 - DNA, 22 bp, Artificial Sequence
  chemically synthesized
atgtattcatttctgagcaatg

SEQ ID NO: 746179 - DNA, 22 bp, Artificial Sequence
  chemically synthesized
tgtattcatttctgagcaatgt

SEQ ID NO: 746180 - DNA, 22 bp, Artificial Sequence
  chemically synthesized
atttctgagcaatgtgggccct

SEQ ID NO: 746181 - DNA, 22 bp, Artificial Sequence
  chemically synthesized
ataatgtgtccagagggcccac

SEQ ID NO: 746182 - DNA, 22 bp, Artificial Sequence
  chemically synthesized
ctgagcaatgtgggccctctgg

SEQ ID NO: 746183 - DNA, 22 bp, Artificial Sequence
  chemically synthesized
tgagcaatgtgggccctctgga

SEQ ID NO: 746184 - DNA, 22 bp, Artificial Sequence
  chemically synthesized
agcaatgtgggccctctggaca

SEQ ID NO: 746185 - DNA, 22 bp, Artificial Sequence
  chemically synthesized
tggacacattattagttgttat

SEQ ID NO: 746186 - DNA, 22 bp, Artificial Sequence
  chemically synthesized
acagaagtaaaaataacaacta

SEQ ID NO: 746187 - DNA, 22 bp, Artificial Sequence
  chemically synthesized
gacacattattagttgttattt

SEQ ID NO: 746188 - DNA, 22 bp, Artificial Sequence
  chemically synthesized
atgtattcacagaagtaaaaat

SEQ ID NO: 746189 - DNA, 22 bp, Artificial Sequence
  chemically synthesized
ttagttgttatttttacttctg

SEQ ID NO: 746190 - DNA, 22 bp, Artificial Sequence
  chemically synthesized
gttgttatttttacttctgtga

SEQ ID NO: 746191 - DNA, 22 bp, Artificial Sequence
  chemically synthesized
acaacctcatgtattcacagaa

SEQ ID NO: 746192 - DNA, 22 bp, Artificial Sequence
  chemically synthesized
cacaacctcatgtattcacaga

SEQ ID NO: 746193 - DNA, 22 bp, Artificial Sequence
  chemically synthesized
ttatttttacttctgtgaatac

SEQ ID NO: 746194 - DNA, 22 bp, Artificial Sequence
  chemically synthesized
tcacaacctcatgtattcacag

SEQ ID NO: 746195 - DNA, 22 bp, Artificial Sequence
  chemically synthesized
ttcacaacctcatgtattcaca

SEQ ID NO: 746196 - DNA, 22 bp, Artificial Sequence
  chemically synthesized
tttttacttctgtgaatacatg

SEQ ID NO: 746197 - DNA, 22 bp, Artificial Sequence
  chemically synthesized
ttacttctgtgaatacatgagg

SEQ ID NO: 746198 - DNA, 22 bp, Artificial Sequence
  chemically synthesized
gacttttcacaacctcatgtat

SEQ ID NO: 746199 - DNA, 22 bp, Artificial Sequence
  chemically synthesized
tacttctgtgaatacatgaggt

SEQ ID NO: 746200 - DNA, 22 bp, Artificial Sequence
  chemically synthesized
acttctgtgaatacatgaggtt

SEQ ID NO: 746201 - DNA, 22 bp, Artificial Sequence
  chemically synthesized
cttctgtgaatacatgaggttg

SEQ ID NO: 746202 - DNA, 22 bp, Artificial Sequence
  chemically synthesized
ctgtgaatacatgaggttgtga

SEQ ID NO: 746203 - DNA, 22 bp, Artificial Sequence
  chemically synthesized
tgtgaatacatgaggttgtgaa

SEQ ID NO: 746204 - DNA, 22 bp, Artificial Sequence
  chemically synthesized
tgaatacatgaggttgtgaaaa

SEQ ID NO: 746205 - DNA, 22 bp, Artificial Sequence
  chemically synthesized
aagaagctagacttttcacaac

SEQ ID NO: 746206 - DNA, 22 bp, Artificial Sequence
  chemically synthesized
actcaagaagctagacttttca

SEQ ID NO: 746207 - DNA, 22 bp, Artificial Sequence
  chemically synthesized
gactcaagaagctagacttttc

SEQ ID NO: 746208 - DNA, 22 bp, Artificial Sequence
  chemically synthesized
ttgactcaagaagctagacttt

SEQ ID NO: 746209 - DNA, 22 bp, Artificial Sequence
  chemically synthesized
tgaaaagtctagcttcttgagt

SEQ ID NO: 746210 - DNA, 22 bp, Artificial Sequence
  chemically synthesized
aataaactcttgactcaagaag

SEQ ID NO: 746211 - DNA, 22 bp, Artificial Sequence
  chemically synthesized
gcttcttgagtcaagagtttat

SEQ ID NO: 746212 - DNA, 22 bp, Artificial Sequence
  chemically synthesized
cttgagtcaagagtttattcag

SEQ ID NO: 746213 - DNA, 22 bp, Artificial Sequence
  chemically synthesized
ttgagtcaagagtttattcagt

SEQ ID NO: 746214 - DNA, 22 bp, Artificial Sequence
  chemically synthesized
gagtcaagagtttattcagttt

SEQ ID NO: 746215 - DNA, 22 bp, Artificial Sequence
  chemically synthesized
agtcaagagtttattcagtttg

SEQ ID NO: 746216 - DNA, 22 bp, Artificial Sequence
  chemically synthesized
tggtgagaaaaatgacaaactg

SEQ ID NO: 746217 - DNA, 22 bp, Artificial Sequence
  chemically synthesized
atggtgagaaaaatgacaaact

SEQ ID NO: 746218 - DNA, 22 bp, Artificial Sequence
  chemically synthesized
tatggtgagaaaaatgacaaac

SEQ ID NO: 746219 - DNA, 22 bp, Artificial Sequence
  chemically synthesized
attcagtttgtcatttttctca

SEQ ID NO: 746220 - DNA, 22 bp, Artificial Sequence
  chemically synthesized
ttcagtttgtcatttttctcac

SEQ ID NO: 746221 - DNA, 22 bp, Artificial Sequence
  chemically synthesized
agtttgtcatttttctcaccat

SEQ ID NO: 746222 - DNA, 22 bp, Artificial Sequence
  chemically synthesized
aaaatatcaattttatggtgag

SEQ ID NO: 746223 - DNA, 22 bp, Artificial Sequence
  chemically synthesized
gaaaatatcaattttatggtga

SEQ ID NO: 746224 - DNA, 22 bp, Artificial Sequence
  chemically synthesized
gtcatttttctcaccataaaat

SEQ ID NO: 746225 - DNA, 22 bp, Artificial Sequence
  chemically synthesized
tcatttttctcaccataaaatt

SEQ ID NO: 746226 - DNA, 22 bp, Artificial Sequence
  chemically synthesized
ttctcaccataaaattgatatt

SEQ ID NO: 746227 - DNA, 22 bp, Artificial Sequence
  chemically synthesized
tctcaccataaaattgatattt

SEQ ID NO: 746228 - DNA, 22 bp, Artificial Sequence
  chemically synthesized
ctcaccataaaattgatatttt

SEQ ID NO: 746229 - DNA, 22 bp, Artificial Sequence
  chemically synthesized
tcaccataaaattgatattttc

SEQ ID NO: 746230 - DNA, 22 bp, Artificial Sequence
  chemically synthesized
accataaaattgatattttcaa

SEQ ID NO: 746231 - DNA, 22 bp, Artificial Sequence
  chemically synthesized
atattttcaagatattattctg

SEQ ID NO: 746232 - DNA, 22 bp, Artificial Sequence
  chemically synthesized
tcaagatattattctgattttt

SEQ ID NO: 746233 - DNA, 22 bp, Artificial Sequence
  chemically synthesized
agatgtgatcataaaaatcaga

SEQ ID NO: 746234 - DNA, 22 bp, Artificial Sequence
  chemically synthesized
caagatattattctgattttta

SEQ ID NO: 746235 - DNA, 22 bp, Artificial Sequence
  chemically synthesized
aagatgtgatcataaaaatcag

SEQ ID NO: 746236 - DNA, 22 bp, Artificial Sequence
  chemically synthesized
aagatattattctgatttttat

SEQ ID NO: 746237 - DNA, 22 bp, Artificial Sequence
  chemically synthesized
ccttaagatgtgatcataaaaa

SEQ ID NO: 746238 - DNA, 22 bp, Artificial Sequence
  chemically synthesized
ttctgatttttatgatcacatc

SEQ ID NO: 746239 - DNA, 22 bp, Artificial Sequence
  chemically synthesized
gatattaccttaagatgtgatc

SEQ ID NO: 746240 - DNA, 22 bp, Artificial Sequence
  chemically synthesized
agatattaccttaagatgtgat

SEQ ID NO: 746241 - DNA, 22 bp, Artificial Sequence
  chemically synthesized
tgatttttatgatcacatctta

SEQ ID NO: 746242 - DNA, 22 bp, Artificial Sequence
  chemically synthesized
atttttatgatcacatcttaag

SEQ ID NO: 746243 - DNA, 22 bp, Artificial Sequence
  chemically synthesized
ttatgatcacatcttaaggtaa

SEQ ID NO: 746244 - DNA, 22 bp, Artificial Sequence
  chemically synthesized
tatgatcacatcttaaggtaat

SEQ ID NO: 746245 - DNA, 22 bp, Artificial Sequence
  chemically synthesized
atgatcacatcttaaggtaata

SEQ ID NO: 746246 - DNA, 22 bp, Artificial Sequence
  chemically synthesized
tgatcacatcttaaggtaatat

SEQ ID NO: 746247 - DNA, 22 bp, Artificial Sequence
  chemically synthesized
caggatatgaatttagatatta

SEQ ID NO: 746248 - DNA, 22 bp, Artificial Sequence
  chemically synthesized
ttacaggatatgaatttagata

SEQ ID NO: 746249 - DNA, 22 bp, Artificial Sequence
  chemically synthesized
aaggtaatatctaaattcatat

SEQ ID NO: 746250 - DNA, 22 bp, Artificial Sequence
  chemically synthesized
aggtaatatctaaattcatatc

SEQ ID NO: 746251 - DNA, 22 bp, Artificial Sequence
  chemically synthesized
tcataacagactattacaggat

SEQ ID NO: 746252 - DNA, 22 bp, Artificial Sequence
  chemically synthesized
aattcatatcctgtaatagtct

SEQ ID NO: 746253 - DNA, 22 bp, Artificial Sequence
  chemically synthesized
atatcctgtaatagtctgttat

SEQ ID NO: 746254 - DNA, 22 bp, Artificial Sequence
  chemically synthesized
tcatgatagcagttgtcataac

SEQ ID NO: 746255 - DNA, 22 bp, Artificial Sequence
  chemically synthesized
taatagtctgttatgacaactg

SEQ ID NO: 746256 - DNA, 22 bp, Artificial Sequence
  chemically synthesized
gacattatcatgatagcagttg

SEQ ID NO: 746257 - DNA, 22 bp, Artificial Sequence
  chemically synthesized
actggacattatcatgatagca

SEQ ID NO: 746258 - DNA, 22 bp, Artificial Sequence
  chemically synthesized
aactggacattatcatgatagc

SEQ ID NO: 746259 - DNA, 22 bp, Artificial Sequence
  chemically synthesized
ttatgacaactgctatcatgat

SEQ ID NO: 746260 - DNA, 22 bp, Artificial Sequence
  chemically synthesized
tgacaactgctatcatgataat

SEQ ID NO: 746261 - DNA, 22 bp, Artificial Sequence
  chemically synthesized
catgtacttaactggacattat

SEQ ID NO: 746262 - DNA, 22 bp, Artificial Sequence
  chemically synthesized
gcatgtacttaactggacatta

SEQ ID NO: 746263 - DNA, 22 bp, Artificial Sequence
  chemically synthesized
ctatcatgataatgtccagtta

SEQ ID NO: 746264 - DNA, 22 bp, Artificial Sequence
  chemically synthesized
tcatgataatgtccagttaagt

SEQ ID NO: 746265 - DNA, 22 bp, Artificial Sequence
  chemically synthesized
atcatttgcatgtacttaactg

SEQ ID NO: 746266 - DNA, 22 bp, Artificial Sequence
  chemically synthesized
ttcatcatttgcatgtacttaa

SEQ ID NO: 746267 - DNA, 22 bp, Artificial Sequence
  chemically synthesized
attcatcatttgcatgtactta

SEQ ID NO: 746268 - DNA, 22 bp, Artificial Sequence
  chemically synthesized
agtacatgcaaatgatgaataa

SEQ ID NO: 746269 - DNA, 22 bp, Artificial Sequence
  chemically synthesized
tgtaagtagtaatttattcatc

SEQ ID NO: 746270 - DNA, 22 bp, Artificial Sequence
  chemically synthesized
gtgtaagtagtaatttattcat

SEQ ID NO: 746271 - DNA, 22 bp, Artificial Sequence
  chemically synthesized
atttgtgtaagtagtaatttat

SEQ ID NO: 746272 - DNA, 22 bp, Artificial Sequence
  chemically synthesized
gactcatttgtgtaagtagtaa

SEQ ID NO: 746273 - DNA, 22 bp, Artificial Sequence
  chemically synthesized
agactcatttgtgtaagtagta

SEQ ID NO: 746274 - DNA, 22 bp, Artificial Sequence
  chemically synthesized
acacttagactcatttgtgtaa

SEQ ID NO: 746275 - DNA, 22 bp, Artificial Sequence
  chemically synthesized
gacacttagactcatttgtgta

SEQ ID NO: 746276 - DNA, 22 bp, Artificial Sequence
  chemically synthesized
ctacttacacaaatgagtctaa

SEQ ID NO: 746277 - DNA, 22 bp, Artificial Sequence
  chemically synthesized
gacagcttgacacttagactca

SEQ ID NO: 746278 - DNA, 22 bp, Artificial Sequence
  chemically synthesized
agacagcttgacacttagactc

SEQ ID NO: 746279 - DNA, 22 bp, Artificial Sequence
  chemically synthesized
cttacacaaatgagtctaagtg

SEQ ID NO: 746280 - DNA, 22 bp, Artificial Sequence
  chemically synthesized
tttagacagcttgacacttaga

SEQ ID NO: 746281 - DNA, 22 bp, Artificial Sequence
  chemically synthesized
acacaaatgagtctaagtgtca

SEQ ID NO: 746282 - DNA, 22 bp, Artificial Sequence
  chemically synthesized
cacaaatgagtctaagtgtcaa

SEQ ID NO: 746283 - DNA, 22 bp, Artificial Sequence
  chemically synthesized
agaacgttgtttagacagcttg

SEQ ID NO: 746284 - DNA, 22 bp, Artificial Sequence
  chemically synthesized
agtgtcaagctgtctaaacaac

SEQ ID NO: 746285 - DNA, 22 bp, Artificial Sequence
  chemically synthesized
gaaatcacatctgagaacgttg

SEQ ID NO: 746286 - DNA, 22 bp, Artificial Sequence
  chemically synthesized
ggaaatcacatctgagaacgtt

SEQ ID NO: 746287 - DNA, 22 bp, Artificial Sequence
  chemically synthesized
tggaaatcacatctgagaacgt

SEQ ID NO: 746288 - DNA, 22 bp, Artificial Sequence
  chemically synthesized
ttggaaatcacatctgagaacg

SEQ ID NO: 746289 - DNA, 22 bp, Artificial Sequence
  chemically synthesized
tttggaaatcacatctgagaac

SEQ ID NO: 746290 - DNA, 22 bp, Artificial Sequence
  chemically synthesized
ttttggaaatcacatctgagaa

SEQ ID NO: 746291 - DNA, 22 bp, Artificial Sequence
  chemically synthesized
tctaaacaacgttctcagatgt

SEQ ID NO: 746292 - DNA, 22 bp, Artificial Sequence
  chemically synthesized
tttttggaaatcacatctgaga

SEQ ID NO: 746293 - DNA, 22 bp, Artificial Sequence
  chemically synthesized
ttttttggaaatcacatctgag

SEQ ID NO: 746294 - DNA, 22 bp, Artificial Sequence
  chemically synthesized
tttttttggaaatcacatctga

SEQ ID NO: 746295 - DNA, 22 bp, Artificial Sequence
  chemically synthesized
ttttttttggaaatcacatctg

SEQ ID NO: 746296 - DNA, 22 bp, Artificial Sequence
  chemically synthesized
aacaacgttctcagatgtgatt

SEQ ID NO: 746297 - DNA, 22 bp, Artificial Sequence
  chemically synthesized
tttttttttggaaatcacatct

SEQ ID NO: 746298 - DNA, 22 bp, Artificial Sequence
  chemically synthesized
ttttttttttggaaatcacatc

SEQ ID NO: 746299 - DNA, 22 bp, Artificial Sequence
  chemically synthesized
tttttttttttggaaatcacat

SEQ ID NO: 746300 - DNA, 22 bp, Artificial Sequence
  chemically synthesized
ttttttttttttggaaatcaca

SEQ ID NO: 746301 - DNA, 22 bp, Artificial Sequence
  chemically synthesized
tttttttttttttggaaatcac

SEQ ID NO: 746302 - DNA, 22 bp, Artificial Sequence
  chemically synthesized
ttttttttttttttggaaatca

SEQ ID NO: 746303 - DNA, 22 bp, Artificial Sequence
  chemically synthesized
tttttttttttttttggaaatc

SEQ ID NO: 746304 - DNA, 22 bp, Artificial Sequence
  chemically synthesized
ttttttttttttttttggaaat

SEQ ID NO: 746305 - DNA, 22 bp, Artificial Sequence
  chemically synthesized
tttttttttttttttttggaaa

SEQ ID NO: 746306 - DNA, 22 bp, Artificial Sequence
  chemically synthesized
ttttttttttttttttttggaa

SEQ ID NO: 746307 - DNA, 22 bp, Artificial Sequence
  chemically synthesized
tcagatgtgatttccaaaaaaa

SEQ ID NO: 746308 - DNA, 22 bp, Artificial Sequence
  chemically synthesized
agatgtgatttccaaaaaaaaa

SEQ ID NO: 746309 - DNA, 22 bp, Artificial Sequence
  chemically synthesized
ccaaaaaaaaaaaaaaaaaaaa

SEQ ID NO: 746310 - DNA, 22 bp, Artificial Sequence
  chemically synthesized
caaaaaaaaaaaaaaaaaaaaa

SEQ ID NO: 746311 - DNA, 22 bp, Artificial Sequence
  chemically synthesized
gccaatgagtgatttttttttt

SEQ ID NO: 746312 - DNA, 22 bp, Artificial Sequence
  chemically synthesized
ggccaatgagtgattttttttt

SEQ ID NO: 746313 - DNA, 22 bp, Artificial Sequence
  chemically synthesized
aagggtagatttggccaatgag

SEQ ID NO: 746314 - DNA, 22 bp, Artificial Sequence
  chemically synthesized
taaagggtagatttggccaatg

SEQ ID NO: 746315 - DNA, 22 bp, Artificial Sequence
  chemically synthesized
ctaaagggtagatttggccaat

SEQ ID NO: 746316 - DNA, 22 bp, Artificial Sequence
  chemically synthesized
tctaaagggtagatttggccaa

SEQ ID NO: 746317 - DNA, 22 bp, Artificial Sequence
  chemically synthesized
ttctaaagggtagatttggcca

SEQ ID NO: 746318 - DNA, 22 bp, Artificial Sequence
  chemically synthesized
tttctaaagggtagatttggcc

SEQ ID NO: 746319 - DNA, 22 bp, Artificial Sequence
  chemically synthesized
attggccaaatctaccctttag

SEQ ID NO: 746320 - DNA, 22 bp, Artificial Sequence
  chemically synthesized
gccaaatctaccctttagaaaa

SEQ ID NO: 746321 - DNA, 22 bp, Artificial Sequence
  chemically synthesized
aatatcaatcactttttctaaa

SEQ ID NO: 746322 - DNA, 22 bp, Artificial Sequence
  chemically synthesized
gttgaatatcaatcactttttc

SEQ ID NO: 746323 - DNA, 22 bp, Artificial Sequence
  chemically synthesized
ttagttgaatatcaatcacttt

SEQ ID NO: 746324 - DNA, 22 bp, Artificial Sequence
  chemically synthesized
ccctttagaaaaagtgattgat

SEQ ID NO: 746325 - DNA, 22 bp, Artificial Sequence
  chemically synthesized
tagaaaaagtgattgatattca

SEQ ID NO: 746326 - DNA, 22 bp, Artificial Sequence
  chemically synthesized
agaaaaagtgattgatattcaa

SEQ ID NO: 746327 - DNA, 22 bp, Artificial Sequence
  chemically synthesized
gaaaaagtgattgatattcaac

SEQ ID NO: 746328 - DNA, 22 bp, Artificial Sequence
  chemically synthesized
aatatatctgttagttgaatat

SEQ ID NO: 746329 - DNA, 22 bp, Artificial Sequence
  chemically synthesized
ttaaatatatctgttagttgaa

SEQ ID NO: 746330 - DNA, 22 bp, Artificial Sequence
  chemically synthesized
ctattaaatatatctgttagtt

SEQ ID NO: 746331 - DNA, 22 bp, Artificial Sequence
  chemically synthesized
ttactattaaatatatctgtta

SEQ ID NO: 746332 - DNA, 22 bp, Artificial Sequence
  chemically synthesized
atattcaactaacagatatatt

SEQ ID NO: 746333 - DNA, 22 bp, Artificial Sequence
  chemically synthesized
aactaacagatatatttaatag

SEQ ID NO: 746334 - DNA, 22 bp, Artificial Sequence
  chemically synthesized
acagatatatttaatagtaata

SEQ ID NO: 746335 - DNA, 22 bp, Artificial Sequence
  chemically synthesized
aaaaagaaaaaagtctattact

SEQ ID NO: 746336 - DNA, 22 bp, Artificial Sequence
  chemically synthesized
gaaaaagaaaaaagtctattac

SEQ ID NO: 746337 - DNA, 22 bp, Artificial Sequence
  chemically synthesized
tgaaaaagaaaaaagtctatta

SEQ ID NO: 746338 - DNA, 22 bp, Artificial Sequence
  chemically synthesized
ttttgaaaaagaaaaaagtcta

SEQ ID NO: 746339 - DNA, 22 bp, Artificial Sequence
  chemically synthesized
ctattttgaaaaagaaaaaagt

SEQ ID NO: 746340 - DNA, 22 bp, Artificial Sequence
  chemically synthesized
aatagtaatagacttttttctt

SEQ ID NO: 746341 - DNA, 22 bp, Artificial Sequence
  chemically synthesized
atagtaatagacttttttcttt

SEQ ID NO: 746342 - DNA, 22 bp, Artificial Sequence
  chemically synthesized
aatcatactcctattttgaaaa

SEQ ID NO: 746343 - DNA, 22 bp, Artificial Sequence
  chemically synthesized
ttttctttttcaaaataggagt

SEQ ID NO: 746344 - DNA, 22 bp, Artificial Sequence
  chemically synthesized
tttctttttcaaaataggagta

SEQ ID NO: 746345 - DNA, 22 bp, Artificial Sequence
  chemically synthesized
ttctttttcaaaataggagtat

SEQ ID NO: 746346 - DNA, 22 bp, Artificial Sequence
  chemically synthesized
tctttttcaaaataggagtatg

SEQ ID NO: 746347 - DNA, 22 bp, Artificial Sequence
  chemically synthesized
agggcactaaatcatactccta

SEQ ID NO: 746348 - DNA, 22 bp, Artificial Sequence
  chemically synthesized
ctttttcaaaataggagtatga

SEQ ID NO: 746349 - DNA, 22 bp, Artificial Sequence
  chemically synthesized
gagggcactaaatcatactcct

SEQ ID NO: 746350 - DNA, 22 bp, Artificial Sequence
  chemically synthesized
tttttcaaaataggagtatgat

SEQ ID NO: 746351 - DNA, 22 bp, Artificial Sequence
  chemically synthesized
tgagggcactaaatcatactcc

SEQ ID NO: 746352 - DNA, 22 bp, Artificial Sequence
  chemically synthesized
ttgagggcactaaatcatactc

SEQ ID NO: 746353 - DNA, 22 bp, Artificial Sequence
  chemically synthesized
tttcaaaataggagtatgattt

SEQ ID NO: 746354 - DNA, 22 bp, Artificial Sequence
  chemically synthesized
ttcaaaataggagtatgattta

SEQ ID NO: 746355 - DNA, 22 bp, Artificial Sequence
  chemically synthesized
tcaaaataggagtatgatttag

SEQ ID NO: 746356 - DNA, 22 bp, Artificial Sequence
  chemically synthesized
caaaataggagtatgatttagt

SEQ ID NO: 746357 - DNA, 22 bp, Artificial Sequence
  chemically synthesized
aaaataggagtatgatttagtg

SEQ ID NO: 746358 - DNA, 22 bp, Artificial Sequence
  chemically synthesized
agtgccctcaaaaatctgtggg

SEQ ID NO: 746359 - DNA, 22 bp, Artificial Sequence
  chemically synthesized
gtgccctcaaaaatctgtgggg

SEQ ID NO: 746360 - DNA, 22 bp, Artificial Sequence
  chemically synthesized
aaaaatctgtgggggtgatgct

SEQ ID NO: 746361 - DNA, 22 bp, Artificial Sequence
  chemically synthesized
gataatcaatgcagcatcaccc

SEQ ID NO: 746362 - DNA, 22 bp, Artificial Sequence
  chemically synthesized
agataatcaatgcagcatcacc

SEQ ID NO: 746363 - DNA, 22 bp, Artificial Sequence
  chemically synthesized
tagataatcaatgcagcatcac

SEQ ID NO: 746364 - DNA, 22 bp, Artificial Sequence
  chemically synthesized
ctttagataatcaatgcagcat

SEQ ID NO: 746365 - DNA, 22 bp, Artificial Sequence
  chemically synthesized
tcctttagataatcaatgcagc

SEQ ID NO: 746366 - DNA, 22 bp, Artificial Sequence
  chemically synthesized
tgggggtgatgctgcattgatt

SEQ ID NO: 746367 - DNA, 22 bp, Artificial Sequence
  chemically synthesized
tattctcctttagataatcaat

SEQ ID NO: 746368 - DNA, 22 bp, Artificial Sequence
  chemically synthesized
aaattgtattctcctttagata

SEQ ID NO: 746369 - DNA, 22 bp, Artificial Sequence
  chemically synthesized
ctgaaattgtattctcctttag

SEQ ID NO: 746370 - DNA, 22 bp, Artificial Sequence
  chemically synthesized
cattgattatctaaaggagaat

SEQ ID NO: 746371 - DNA, 22 bp, Artificial Sequence
  chemically synthesized
ctactgaaattgtattctcctt

SEQ ID NO: 746372 - DNA, 22 bp, Artificial Sequence
  chemically synthesized
cctactgaaattgtattctcct

SEQ ID NO: 746373 - DNA, 22 bp, Artificial Sequence
  chemically synthesized
tcctactgaaattgtattctcc

SEQ ID NO: 746374 - DNA, 22 bp, Artificial Sequence
  chemically synthesized
ttcctactgaaattgtattctc

SEQ ID NO: 746375 - DNA, 22 bp, Artificial Sequence
  chemically synthesized
attatctaaaggagaatacaat

SEQ ID NO: 746376 - DNA, 22 bp, Artificial Sequence
  chemically synthesized
tttcctactgaaattgtattct

SEQ ID NO: 746377 - DNA, 22 bp, Artificial Sequence
  chemically synthesized
tttttcctactgaaattgtatt

SEQ ID NO: 746378 - DNA, 22 bp, Artificial Sequence
  chemically synthesized
tctaaaggagaatacaatttca

SEQ ID NO: 746379 - DNA, 22 bp, Artificial Sequence
  chemically synthesized
aactctttttcctactgaaatt

SEQ ID NO: 746380 - DNA, 22 bp, Artificial Sequence
  chemically synthesized
aaggagaatacaatttcagtag

SEQ ID NO: 746381 - DNA, 22 bp, Artificial Sequence
  chemically synthesized
gaactctttttcctactgaaat

SEQ ID NO: 746382 - DNA, 22 bp, Artificial Sequence
  chemically synthesized
tgaactctttttcctactgaaa

SEQ ID NO: 746383 - DNA, 22 bp, Artificial Sequence
  chemically synthesized
aaaagagttttgaactcttttt

SEQ ID NO: 746384 - DNA, 22 bp, Artificial Sequence
  chemically synthesized
aaaaagagttttgaactctttt

SEQ ID NO: 746385 - DNA, 22 bp, Artificial Sequence
  chemically synthesized
taaaaagagttttgaactcttt

SEQ ID NO: 746386 - DNA, 22 bp, Artificial Sequence
  chemically synthesized
cagtaggaaaaagagttcaaaa

SEQ ID NO: 746387 - DNA, 22 bp, Artificial Sequence
  chemically synthesized
ttttaaaaagagttttgaactc

SEQ ID NO: 746388 - DNA, 22 bp, Artificial Sequence
  chemically synthesized
agtaggaaaaagagttcaaaac

SEQ ID NO: 746389 - DNA, 22 bp, Artificial Sequence
  chemically synthesized
gtgaaaagattattttaaaaag

SEQ ID NO: 746390 - DNA, 22 bp, Artificial Sequence
  chemically synthesized
ttagtgaaaagattattttaaa

SEQ ID NO: 746391 - DNA, 22 bp, Artificial Sequence
  chemically synthesized
aaaactctttttaaaataatct

SEQ ID NO: 746392 - DNA, 22 bp, Artificial Sequence
  chemically synthesized
aattattagtgaaaagattatt

SEQ ID NO: 746393 - DNA, 22 bp, Artificial Sequence
  chemically synthesized
ctgaattattagtgaaaagatt

SEQ ID NO: 746394 - DNA, 22 bp, Artificial Sequence
  chemically synthesized
tttttaaaataatcttttcact

SEQ ID NO: 746395 - DNA, 22 bp, Artificial Sequence
  chemically synthesized
tttaaaataatcttttcactaa

SEQ ID NO: 746396 - DNA, 22 bp, Artificial Sequence
  chemically synthesized
ttaaaataatcttttcactaat

SEQ ID NO: 746397 - DNA, 22 bp, Artificial Sequence
  chemically synthesized
taaaataatcttttcactaata

SEQ ID NO: 746398 - DNA, 22 bp, Artificial Sequence
  chemically synthesized
aaattactgaattattagtgaa

SEQ ID NO: 746399 - DNA, 22 bp, Artificial Sequence
  chemically synthesized
aaaataatcttttcactaataa

SEQ ID NO: 746400 - DNA, 22 bp, Artificial Sequence
  chemically synthesized
aaataatcttttcactaataat

SEQ ID NO: 746401 - DNA, 22 bp, Artificial Sequence
  chemically synthesized
aatctaaaattactgaattatt

SEQ ID NO: 746402 - DNA, 22 bp, Artificial Sequence
  chemically synthesized
gaatctaaaattactgaattat

SEQ ID NO: 746403 - DNA, 22 bp, Artificial Sequence
  chemically synthesized
tgaatctaaaattactgaatta

SEQ ID NO: 746404 - DNA, 22 bp, Artificial Sequence
  chemically synthesized
ttcactaataattcagtaattt

SEQ ID NO: 746405 - DNA, 22 bp, Artificial Sequence
  chemically synthesized
tcactaataattcagtaatttt

SEQ ID NO: 746406 - DNA, 22 bp, Artificial Sequence
  chemically synthesized
cactaataattcagtaatttta

SEQ ID NO: 746407 - DNA, 22 bp, Artificial Sequence
  chemically synthesized
actaataattcagtaattttag

SEQ ID NO: 746408 - DNA, 22 bp, Artificial Sequence
  chemically synthesized
acccactttgaatctaaaatta

SEQ ID NO: 746409 - DNA, 22 bp, Artificial Sequence
  chemically synthesized
ataattcagtaattttagattc

SEQ ID NO: 746410 - DNA, 22 bp, Artificial Sequence
  chemically synthesized
agtaattttagattcaaagtgg

SEQ ID NO: 746411 - DNA, 22 bp, Artificial Sequence
  chemically synthesized
gtgaaatctgacccactttgaa

SEQ ID NO: 746412 - DNA, 22 bp, Artificial Sequence
  chemically synthesized
ggtgaaatctgacccactttga

SEQ ID NO: 746413 - DNA, 22 bp, Artificial Sequence
  chemically synthesized
tagattcaaagtgggtcagatt

SEQ ID NO: 746414 - DNA, 22 bp, Artificial Sequence
  chemically synthesized
agattcaaagtgggtcagattt

SEQ ID NO: 746415 - DNA, 22 bp, Artificial Sequence
  chemically synthesized
gattcaaagtgggtcagatttc

SEQ ID NO: 746416 - DNA, 22 bp, Artificial Sequence
  chemically synthesized
aaagtgggtcagatttcaccaa

SEQ ID NO: 746417 - DNA, 22 bp, Artificial Sequence
  chemically synthesized
tatgcaagaggggtcttggtga

SEQ ID NO: 746418 - DNA, 22 bp, Artificial Sequence
  chemically synthesized
ttgtatgcaagaggggtcttgg

SEQ ID NO: 746419 - DNA, 22 bp, Artificial Sequence
  chemically synthesized
attgttgtatgcaagaggggtc

SEQ ID NO: 746420 - DNA, 22 bp, Artificial Sequence
  chemically synthesized
caccaagacccctcttgcatac

SEQ ID NO: 746421 - DNA, 22 bp, Artificial Sequence
  chemically synthesized
gggttgattgttgtatgcaaga

SEQ ID NO: 746422 - DNA, 22 bp, Artificial Sequence
  chemically synthesized
accaagacccctcttgcataca

SEQ ID NO: 746423 - DNA, 22 bp, Artificial Sequence
  chemically synthesized
ggggttgattgttgtatgcaag

SEQ ID NO: 746424 - DNA, 22 bp, Artificial Sequence
  chemically synthesized
gggtttggggttgattgttgta

SEQ ID NO: 746425 - DNA, 22 bp, Artificial Sequence
  chemically synthesized
cctagggtttggggttgattgt

SEQ ID NO: 746426 - DNA, 22 bp, Artificial Sequence
  chemically synthesized
ttgcatacaacaatcaacccca

SEQ ID NO: 746427 - DNA, 22 bp, Artificial Sequence
  chemically synthesized
gcatacaacaatcaaccccaaa

SEQ ID NO: 746428 - DNA, 22 bp, Artificial Sequence
  chemically synthesized
catacaacaatcaaccccaaac

SEQ ID NO: 746429 - DNA, 22 bp, Artificial Sequence
  chemically synthesized
taaaactgcctagggtttgggg

SEQ ID NO: 746430 - DNA, 22 bp, Artificial Sequence
  chemically synthesized
ctataaaactgcctagggtttg

SEQ ID NO: 746431 - DNA, 22 bp, Artificial Sequence
  chemically synthesized
tcctataaaactgcctagggtt

SEQ ID NO: 746432 - DNA, 22 bp, Artificial Sequence
  chemically synthesized
ctcctataaaactgcctagggt

SEQ ID NO: 746433 - DNA, 22 bp, Artificial Sequence
  chemically synthesized
caaagtcgtttctcctataaaa

SEQ ID NO: 746434 - DNA, 22 bp, Artificial Sequence
  chemically synthesized
gcaaagtcgtttctcctataaa

SEQ ID NO: 746435 - DNA, 22 bp, Artificial Sequence
  chemically synthesized
ggcagttttataggagaaacga

SEQ ID NO: 746436 - DNA, 22 bp, Artificial Sequence
  chemically synthesized
aaggaagacatttgcaaagtcg

SEQ ID NO: 746437 - DNA, 22 bp, Artificial Sequence
  chemically synthesized
tataggagaaacgactttgcaa

SEQ ID NO: 746438 - DNA, 22 bp, Artificial Sequence
  chemically synthesized
ataggagaaacgactttgcaaa

SEQ ID NO: 746439 - DNA, 22 bp, Artificial Sequence
  chemically synthesized
taggagaaacgactttgcaaat

SEQ ID NO: 746440 - DNA, 22 bp, Artificial Sequence
  chemically synthesized
tataaaggttgaaggaagacat

SEQ ID NO: 746441 - DNA, 22 bp, Artificial Sequence
  chemically synthesized
gtataaaggttgaaggaagaca

SEQ ID NO: 746442 - DNA, 22 bp, Artificial Sequence
  chemically synthesized
tgtataaaggttgaaggaagac

SEQ ID NO: 746443 - DNA, 22 bp, Artificial Sequence
  chemically synthesized
ttgtataaaggttgaaggaaga

SEQ ID NO: 746444 - DNA, 22 bp, Artificial Sequence
  chemically synthesized
tttgtataaaggttgaaggaag

SEQ ID NO: 746445 - DNA, 22 bp, Artificial Sequence
  chemically synthesized
ttttgtataaaggttgaaggaa

SEQ ID NO: 746446 - DNA, 22 bp, Artificial Sequence
  chemically synthesized
tttttgtataaaggttgaagga

SEQ ID NO: 746447 - DNA, 22 bp, Artificial Sequence
  chemically synthesized
tgcaaatgtcttccttcaacct

SEQ ID NO: 746448 - DNA, 22 bp, Artificial Sequence
  chemically synthesized
ttttttgtataaaggttgaagg

SEQ ID NO: 746449 - DNA, 22 bp, Artificial Sequence
  chemically synthesized
gcaaatgtcttccttcaacctt

SEQ ID NO: 746450 - DNA, 22 bp, Artificial Sequence
  chemically synthesized
tttttttgtataaaggttgaag

SEQ ID NO: 746451 - DNA, 22 bp, Artificial Sequence
  chemically synthesized
caaatgtcttccttcaaccttt

SEQ ID NO: 746452 - DNA, 22 bp, Artificial Sequence
  chemically synthesized
aattttttttttgtataaaggt

SEQ ID NO: 746453 - DNA, 22 bp, Artificial Sequence
  chemically synthesized
ccttcaacctttatacaaaaaa

SEQ ID NO: 746454 - DNA, 22 bp, Artificial Sequence
  chemically synthesized
cttcaacctttatacaaaaaaa

SEQ ID NO: 746455 - DNA, 22 bp, Artificial Sequence
  chemically synthesized
caacctttatacaaaaaaaaaa

SEQ ID NO: 746456 - DNA, 22 bp, Artificial Sequence
  chemically synthesized
gaaccatctcaatttttttttt

SEQ ID NO: 746457 - DNA, 22 bp, Artificial Sequence
  chemically synthesized
aacctttatacaaaaaaaaaat

SEQ ID NO: 746458 - DNA, 22 bp, Artificial Sequence
  chemically synthesized
ggaaccatctcaattttttttt

SEQ ID NO: 746459 - DNA, 22 bp, Artificial Sequence
  chemically synthesized
tggaaccatctcaatttttttt

SEQ ID NO: 746460 - DNA, 22 bp, Artificial Sequence
  chemically synthesized
cctttggaaccatctcaatttt

SEQ ID NO: 746461 - DNA, 22 bp, Artificial Sequence
  chemically synthesized
tatacaaaaaaaaaattgagat

SEQ ID NO: 746462 - DNA, 22 bp, Artificial Sequence
  chemically synthesized
atacaaaaaaaaaattgagatg

SEQ ID NO: 746463 - DNA, 22 bp, Artificial Sequence
  chemically synthesized
tacaaaaaaaaaattgagatgg

SEQ ID NO: 746464 - DNA, 22 bp, Artificial Sequence
  chemically synthesized
tgaataaaatattacctttgga

SEQ ID NO: 746465 - DNA, 22 bp, Artificial Sequence
  chemically synthesized
agatggttccaaaggtaatatt

SEQ ID NO: 746466 - DNA, 22 bp, Artificial Sequence
  chemically synthesized
tgctgtgaataaaatattacct

SEQ ID NO: 746467 - DNA, 22 bp, Artificial Sequence
  chemically synthesized
atgctgtgaataaaatattacc

SEQ ID NO: 746468 - DNA, 22 bp, Artificial Sequence
  chemically synthesized
gcttatgctgtgaataaaatat

SEQ ID NO: 746469 - DNA, 22 bp, Artificial Sequence
  chemically synthesized
caaaggtaatattttattcaca

SEQ ID NO: 746470 - DNA, 22 bp, Artificial Sequence
  chemically synthesized
cgttggcttatgctgtgaataa

SEQ ID NO: 746471 - DNA, 22 bp, Artificial Sequence
  chemically synthesized
ctccgttggcttatgctgtgaa

SEQ ID NO: 746472 - DNA, 22 bp, Artificial Sequence
  chemically synthesized
tattcacagcataagccaacgg

SEQ ID NO: 746473 - DNA, 22 bp, Artificial Sequence
  chemically synthesized
attcacagcataagccaacgga

SEQ ID NO: 746474 - DNA, 22 bp, Artificial Sequence
  chemically synthesized
ttcacagcataagccaacggag

SEQ ID NO: 746475 - DNA, 22 bp, Artificial Sequence
  chemically synthesized
acagcataagccaacggagtaa

SEQ ID NO: 746476 - DNA, 22 bp, Artificial Sequence
  chemically synthesized
aacaaatgagcataaattactc

SEQ ID NO: 746477 - DNA, 22 bp, Artificial Sequence
  chemically synthesized
aaagaaatacaggctaaacaaa

SEQ ID NO: 746478 - DNA, 22 bp, Artificial Sequence
  chemically synthesized
atgctcatttgtttagcctgta

SEQ ID NO: 746479 - DNA, 22 bp, Artificial Sequence
  chemically synthesized
tgctcatttgtttagcctgtat

SEQ ID NO: 746480 - DNA, 22 bp, Artificial Sequence
  chemically synthesized
atttgtttagcctgtatttctt

SEQ ID NO: 746481 - DNA, 22 bp, Artificial Sequence
  chemically synthesized
gtttagcctgtatttcttttaa

SEQ ID NO: 746482 - DNA, 22 bp, Artificial Sequence
  chemically synthesized
tttagcctgtatttcttttaac

SEQ ID NO: 746483 - DNA, 22 bp, Artificial Sequence
  chemically synthesized
agcctgtatttcttttaacctt

SEQ ID NO: 746484 - DNA, 22 bp, Artificial Sequence
  chemically synthesized
gcctgtatttcttttaacctta

SEQ ID NO: 746485 - DNA, 22 bp, Artificial Sequence
  chemically synthesized
tgcatccaataaagcataaggt

SEQ ID NO: 746486 - DNA, 22 bp, Artificial Sequence
  chemically synthesized
tatttcttttaaccttatgctt

SEQ ID NO: 746487 - DNA, 22 bp, Artificial Sequence
  chemically synthesized
gtgcatccaataaagcataagg

SEQ ID NO: 746488 - DNA, 22 bp, Artificial Sequence
  chemically synthesized
tgtgcatccaataaagcataag

SEQ ID NO: 746489 - DNA, 22 bp, Artificial Sequence
  chemically synthesized
ttgtgcatccaataaagcataa

SEQ ID NO: 746490 - DNA, 22 bp, Artificial Sequence
  chemically synthesized
cttttaaccttatgctttattg

SEQ ID NO: 746491 - DNA, 22 bp, Artificial Sequence
  chemically synthesized
ttttaaccttatgctttattgg

SEQ ID NO: 746492 - DNA, 22 bp, Artificial Sequence
  chemically synthesized
ttaaccttatgctttattggat

SEQ ID NO: 746493 - DNA, 22 bp, Artificial Sequence
  chemically synthesized
taaccttatgctttattggatg

SEQ ID NO: 746494 - DNA, 22 bp, Artificial Sequence
  chemically synthesized
aaccttatgctttattggatgc

SEQ ID NO: 746495 - DNA, 22 bp, Artificial Sequence
  chemically synthesized
accttatgctttattggatgca

SEQ ID NO: 746496 - DNA, 22 bp, Artificial Sequence
  chemically synthesized
atgctttattggatgcacaaaa

SEQ ID NO: 746497 - DNA, 22 bp, Artificial Sequence
  chemically synthesized
tgctttattggatgcacaaaag

SEQ ID NO: 746498 - DNA, 22 bp, Artificial Sequence
  chemically synthesized
tccaatatcagggtgacttttg

SEQ ID NO: 746499 - DNA, 22 bp, Artificial Sequence
  chemically synthesized
tattggatgcacaaaagtcacc

SEQ ID NO: 746500 - DNA, 22 bp, Artificial Sequence
  chemically synthesized
attggatgcacaaaagtcaccc

SEQ ID NO: 746501 - DNA, 22 bp, Artificial Sequence
  chemically synthesized
ttggatgcacaaaagtcaccct

SEQ ID NO: 746502 - DNA, 22 bp, Artificial Sequence
  chemically synthesized
gatgcacaaaagtcaccctgat

SEQ ID NO: 746503 - DNA, 22 bp, Artificial Sequence
  chemically synthesized
cacaaaggttatccaatatcag

SEQ ID NO: 746504 - DNA, 22 bp, Artificial Sequence
  chemically synthesized
gaatctccacaaaggttatcca

SEQ ID NO: 746505 - DNA, 22 bp, Artificial Sequence
  chemically synthesized
atattggataacctttgtggag

SEQ ID NO: 746506 - DNA, 22 bp, Artificial Sequence
  chemically synthesized
gataacctttgtggagattcta

SEQ ID NO: 746507 - DNA, 22 bp, Artificial Sequence
  chemically synthesized
acaaacccaatatactagaatc

SEQ ID NO: 746508 - DNA, 22 bp, Artificial Sequence
  chemically synthesized
cacaaacccaatatactagaat

SEQ ID NO: 746509 - DNA, 22 bp, Artificial Sequence
  chemically synthesized
tcacaaacccaatatactagaa

SEQ ID NO: 746510 - DNA, 22 bp, Artificial Sequence
  chemically synthesized
tgtggagattctagtatattgg

SEQ ID NO: 746511 - DNA, 22 bp, Artificial Sequence
  chemically synthesized
gtggagattctagtatattggg

SEQ ID NO: 746512 - DNA, 22 bp, Artificial Sequence
  chemically synthesized
gactttcacaaacccaatatac

SEQ ID NO: 746513 - DNA, 22 bp, Artificial Sequence
  chemically synthesized
tggagattctagtatattgggt

SEQ ID NO: 746514 - DNA, 22 bp, Artificial Sequence
  chemically synthesized
agactttcacaaacccaatata

SEQ ID NO: 746515 - DNA, 22 bp, Artificial Sequence
  chemically synthesized
tagactttcacaaacccaatat

SEQ ID NO: 746516 - DNA, 22 bp, Artificial Sequence
  chemically synthesized
ttttagactttcacaaacccaa

SEQ ID NO: 746517 - DNA, 22 bp, Artificial Sequence
  chemically synthesized
tagtatattgggtttgtgaaag

SEQ ID NO: 746518 - DNA, 22 bp, Artificial Sequence
  chemically synthesized
gtatattgggtttgtgaaagtc

SEQ ID NO: 746519 - DNA, 22 bp, Artificial Sequence
  chemically synthesized
ggtttgtgaaagtctaaaacaa

SEQ ID NO: 746520 - DNA, 22 bp, Artificial Sequence
  chemically synthesized
gtgaaagtctaaaacaatggac

SEQ ID NO: 746521 - DNA, 22 bp, Artificial Sequence
  chemically synthesized
tgaaagtctaaaacaatggacc

SEQ ID NO: 746522 - DNA, 22 bp, Artificial Sequence
  chemically synthesized
aagcaagggagagaatggtcca

SEQ ID NO: 746523 - DNA, 22 bp, Artificial Sequence
  chemically synthesized
aaacaatggaccattctctccc

SEQ ID NO: 746524 - DNA, 22 bp, Artificial Sequence
  chemically synthesized
gcagggatggggctaaagcaag

SEQ ID NO: 746525 - DNA, 22 bp, Artificial Sequence
  chemically synthesized
tagcagggatggggctaaagca

SEQ ID NO: 746526 - DNA, 22 bp, Artificial Sequence
  chemically synthesized
ctagcagggatggggctaaagc

SEQ ID NO: 746527 - DNA, 22 bp, Artificial Sequence
  chemically synthesized
tctcccttgctttagccccatc

SEQ ID NO: 746528 - DNA, 22 bp, Artificial Sequence
  chemically synthesized
tcccttgctttagccccatccc

SEQ ID NO: 746529 - DNA, 22 bp, Artificial Sequence
  chemically synthesized
ccttgctttagccccatccctg

SEQ ID NO: 746530 - DNA, 22 bp, Artificial Sequence
  chemically synthesized
acatgtttctagcagggatggg

SEQ ID NO: 746531 - DNA, 22 bp, Artificial Sequence
  chemically synthesized
cacatgtttctagcagggatgg

SEQ ID NO: 746532 - DNA, 22 bp, Artificial Sequence
  chemically synthesized
gctttagccccatccctgctag

SEQ ID NO: 746533 - DNA, 22 bp, Artificial Sequence
  chemically synthesized
ctttagccccatccctgctaga

SEQ ID NO: 746534 - DNA, 22 bp, Artificial Sequence
  chemically synthesized
gtcttcacatgtttctagcagg

SEQ ID NO: 746535 - DNA, 22 bp, Artificial Sequence
  chemically synthesized
ggtcttcacatgtttctagcag

SEQ ID NO: 746536 - DNA, 22 bp, Artificial Sequence
  chemically synthesized
tagccccatccctgctagaaac

SEQ ID NO: 746537 - DNA, 22 bp, Artificial Sequence
  chemically synthesized
tggtcttcacatgtttctagca

SEQ ID NO: 746538 - DNA, 22 bp, Artificial Sequence
  chemically synthesized
agccccatccctgctagaaaca

SEQ ID NO: 746539 - DNA, 22 bp, Artificial Sequence
  chemically synthesized
ttggtcttcacatgtttctagc

SEQ ID NO: 746540 - DNA, 22 bp, Artificial Sequence
  chemically synthesized
gccccatccctgctagaaacat

SEQ ID NO: 746541 - DNA, 22 bp, Artificial Sequence
  chemically synthesized
gtttttggtcttcacatgtttc

SEQ ID NO: 746542 - DNA, 22 bp, Artificial Sequence
  chemically synthesized
ccagttggtttttggtcttcac

SEQ ID NO: 746543 - DNA, 22 bp, Artificial Sequence
  chemically synthesized
gccagttggtttttggtcttca

SEQ ID NO: 746544 - DNA, 22 bp, Artificial Sequence
  chemically synthesized
ctagaaacatgtgaagaccaaa

SEQ ID NO: 746545 - DNA, 22 bp, Artificial Sequence
  chemically synthesized
cttgccagttggtttttggtct

SEQ ID NO: 746546 - DNA, 22 bp, Artificial Sequence
  chemically synthesized
gaaacatgtgaagaccaaaaac

SEQ ID NO: 746547 - DNA, 22 bp, Artificial Sequence
  chemically synthesized
tgcttgccagttggtttttggt

SEQ ID NO: 746548 - DNA, 22 bp, Artificial Sequence
  chemically synthesized
ctgcttgccagttggtttttgg

SEQ ID NO: 746549 - DNA, 22 bp, Artificial Sequence
  chemically synthesized
accttctgcttgccagttggtt

SEQ ID NO: 746550 - DNA, 22 bp, Artificial Sequence
  chemically synthesized
caccttctgcttgccagttggt

SEQ ID NO: 746551 - DNA, 22 bp, Artificial Sequence
  chemically synthesized
cttcaccttctgcttgccagtt

SEQ ID NO: 746552 - DNA, 22 bp, Artificial Sequence
  chemically synthesized
cctgcttcaccttctgcttgcc

SEQ ID NO: 746553 - DNA, 22 bp, Artificial Sequence
  chemically synthesized
acctgcttcaccttctgcttgc

SEQ ID NO: 746554 - DNA, 22 bp, Artificial Sequence
  chemically synthesized
tacctgcttcaccttctgcttg

SEQ ID NO: 746555 - DNA, 22 bp, Artificial Sequence
  chemically synthesized
gcaagcagaaggtgaagcaggt

SEQ ID NO: 746556 - DNA, 22 bp, Artificial Sequence
  chemically synthesized
tatgcaacggcattttacctgc

SEQ ID NO: 746557 - DNA, 22 bp, Artificial Sequence
  chemically synthesized
cccccaagcaagcagactgtat

SEQ ID NO: 746558 - DNA, 22 bp, Artificial Sequence
  chemically synthesized
tctgcccccaagcaagcagact

SEQ ID NO: 746559 - DNA, 22 bp, Artificial Sequence
  chemically synthesized
atctgcccccaagcaagcagac

SEQ ID NO: 746560 - DNA, 22 bp, Artificial Sequence
  chemically synthesized
ttatctgcccccaagcaagcag

SEQ ID NO: 746561 - DNA, 22 bp, Artificial Sequence
  chemically synthesized
cttatctgcccccaagcaagca

SEQ ID NO: 746562 - DNA, 22 bp, Artificial Sequence
  chemically synthesized
catacagtctgcttgcttgggg

SEQ ID NO: 746563 - DNA, 22 bp, Artificial Sequence
  chemically synthesized
agtttcttatctgcccccaagc

SEQ ID NO: 746564 - DNA, 22 bp, Artificial Sequence
  chemically synthesized
aagtttcttatctgcccccaag

SEQ ID NO: 746565 - DNA, 22 bp, Artificial Sequence
  chemically synthesized
tgatttaagtttcttatctgcc

SEQ ID NO: 746566 - DNA, 22 bp, Artificial Sequence
  chemically synthesized
cttgcttgggggcagataagaa

SEQ ID NO: 746567 - DNA, 22 bp, Artificial Sequence
  chemically synthesized
gcttgggggcagataagaaact

SEQ ID NO: 746568 - DNA, 22 bp, Artificial Sequence
  chemically synthesized
acctgtgatttaagtttcttat

SEQ ID NO: 746569 - DNA, 22 bp, Artificial Sequence
  chemically synthesized
cttgggggcagataagaaactt

SEQ ID NO: 746570 - DNA, 22 bp, Artificial Sequence
  chemically synthesized
gggggcagataagaaacttaaa

SEQ ID NO: 746571 - DNA, 22 bp, Artificial Sequence
  chemically synthesized
actgacctgtgatttaagtttc

SEQ ID NO: 746572 - DNA, 22 bp, Artificial Sequence
  chemically synthesized
ggggcagataagaaacttaaat

SEQ ID NO: 746573 - DNA, 22 bp, Artificial Sequence
  chemically synthesized
aactgacctgtgatttaagttt

SEQ ID NO: 746574 - DNA, 22 bp, Artificial Sequence
  chemically synthesized
aataatacccatttaactgacc

SEQ ID NO: 746575 - DNA, 22 bp, Artificial Sequence
  chemically synthesized
ttaaataatacccatttaactg

SEQ ID NO: 746576 - DNA, 22 bp, Artificial Sequence
  chemically synthesized
aaatcacaggtcagttaaatgg

SEQ ID NO: 746577 - DNA, 22 bp, Artificial Sequence
  chemically synthesized
attaaataatacccatttaact

SEQ ID NO: 746578 - DNA, 22 bp, Artificial Sequence
  chemically synthesized
aatcacaggtcagttaaatggg

SEQ ID NO: 746579 - DNA, 22 bp, Artificial Sequence
  chemically synthesized
ggtcttattaaataatacccat

SEQ ID NO: 746580 - DNA, 22 bp, Artificial Sequence
  chemically synthesized
ttaggtcttattaaataatacc

SEQ ID NO: 746581 - DNA, 22 bp, Artificial Sequence
  chemically synthesized
aagcctattaggtcttattaaa

SEQ ID NO: 746582 - DNA, 22 bp, Artificial Sequence
  chemically synthesized
aatgggtattatttaataagac

SEQ ID NO: 746583 - DNA, 22 bp, Artificial Sequence
  chemically synthesized
tgaacctaaagcctattaggtc

SEQ ID NO: 746584 - DNA, 22 bp, Artificial Sequence
  chemically synthesized
ttgtgaacctaaagcctattag

SEQ ID NO: 746585 - DNA, 22 bp, Artificial Sequence
  chemically synthesized
tttaataagacctaataggctt

SEQ ID NO: 746586 - DNA, 22 bp, Artificial Sequence
  chemically synthesized
aataagacctaataggctttag

SEQ ID NO: 746587 - DNA, 22 bp, Artificial Sequence
  chemically synthesized
ataagacctaataggctttagg

SEQ ID NO: 746588 - DNA, 22 bp, Artificial Sequence
  chemically synthesized
tccattgttgtgaacctaaagc

SEQ ID NO: 746589 - DNA, 22 bp, Artificial Sequence
  chemically synthesized
agatctatccattgttgtgaac

SEQ ID NO: 746590 - DNA, 22 bp, Artificial Sequence
  chemically synthesized
ataggctttaggttcacaacaa

SEQ ID NO: 746591 - DNA, 22 bp, Artificial Sequence
  chemically synthesized
gagatctatccattgttgtgaa

SEQ ID NO: 746592 - DNA, 22 bp, Artificial Sequence
  chemically synthesized
tgagatctatccattgttgtga

SEQ ID NO: 746593 - DNA, 22 bp, Artificial Sequence
  chemically synthesized
taggttcacaacaatggataga

SEQ ID NO: 746594 - DNA, 22 bp, Artificial Sequence
  chemically synthesized
aggttcacaacaatggatagat

SEQ ID NO: 746595 - DNA, 22 bp, Artificial Sequence
  chemically synthesized
ggttcacaacaatggatagatc

SEQ ID NO: 746596 - DNA, 22 bp, Artificial Sequence
  chemically synthesized
taacccattttgagatctatcc

SEQ ID NO: 746597 - DNA, 22 bp, Artificial Sequence
  chemically synthesized
acaacaatggatagatctcaaa

SEQ ID NO: 746598 - DNA, 22 bp, Artificial Sequence
  chemically synthesized
aaacattgtaacccattttgag

SEQ ID NO: 746599 - DNA, 22 bp, Artificial Sequence
  chemically synthesized
aaaacattgtaacccattttga

SEQ ID NO: 746600 - DNA, 22 bp, Artificial Sequence
  chemically synthesized
ttaaaacattgtaacccatttt

SEQ ID NO: 746601 - DNA, 22 bp, Artificial Sequence
  chemically synthesized
ctcttaaaacattgtaacccat

SEQ ID NO: 746602 - DNA, 22 bp, Artificial Sequence
  chemically synthesized
ctactcttaaaacattgtaacc

SEQ ID NO: 746603 - DNA, 22 bp, Artificial Sequence
  chemically synthesized
cctactcttaaaacattgtaac

SEQ ID NO: 746604 - DNA, 22 bp, Artificial Sequence
  chemically synthesized
tcctactcttaaaacattgtaa

SEQ ID NO: 746605 - DNA, 22 bp, Artificial Sequence
  chemically synthesized
ttcctactcttaaaacattgta

SEQ ID NO: 746606 - DNA, 22 bp, Artificial Sequence
  chemically synthesized
tttcctactcttaaaacattgt

SEQ ID NO: 746607 - DNA, 22 bp, Artificial Sequence
  chemically synthesized
ttttcctactcttaaaacattg

SEQ ID NO: 746608 - DNA, 22 bp, Artificial Sequence
  chemically synthesized
aaaatgggttacaatgttttaa

SEQ ID NO: 746609 - DNA, 22 bp, Artificial Sequence
  chemically synthesized
cttttttcctactcttaaaaca

SEQ ID NO: 746610 - DNA, 22 bp, Artificial Sequence
  chemically synthesized
acttttttcctactcttaaaac

SEQ ID NO: 746611 - DNA, 22 bp, Artificial Sequence
  chemically synthesized
atttacttttttcctactctta

SEQ ID NO: 746612 - DNA, 22 bp, Artificial Sequence
  chemically synthesized
catttacttttttcctactctt

SEQ ID NO: 746613 - DNA, 22 bp, Artificial Sequence
  chemically synthesized
tcatttacttttttcctactct

SEQ ID NO: 746614 - DNA, 22 bp, Artificial Sequence
  chemically synthesized
caatgttttaagagtaggaaaa

SEQ ID NO: 746615 - DNA, 22 bp, Artificial Sequence
  chemically synthesized
ctttcatttacttttttcctac

SEQ ID NO: 746616 - DNA, 22 bp, Artificial Sequence
  chemically synthesized
cctttcatttacttttttccta

SEQ ID NO: 746617 - DNA, 22 bp, Artificial Sequence
  chemically synthesized
agtttcctttcatttacttttt

SEQ ID NO: 746618 - DNA, 22 bp, Artificial Sequence
  chemically synthesized
taagagtaggaaaaaagtaaat

SEQ ID NO: 746619 - DNA, 22 bp, Artificial Sequence
  chemically synthesized
aagagtaggaaaaaagtaaatg

SEQ ID NO: 746620 - DNA, 22 bp, Artificial Sequence
  chemically synthesized
agagtaggaaaaaagtaaatga

SEQ ID NO: 746621 - DNA, 22 bp, Artificial Sequence
  chemically synthesized
ctgagtttcctttcatttactt

SEQ ID NO: 746622 - DNA, 22 bp, Artificial Sequence
  chemically synthesized
ctgctgagtttcctttcattta

SEQ ID NO: 746623 - DNA, 22 bp, Artificial Sequence
  chemically synthesized
gaaccaatgataaactactgct

SEQ ID NO: 746624 - DNA, 22 bp, Artificial Sequence
  chemically synthesized
agaaccaatgataaactactgc

SEQ ID NO: 746625 - DNA, 22 bp, Artificial Sequence
  chemically synthesized
tagaaccaatgataaactactg

SEQ ID NO: 746626 - DNA, 22 bp, Artificial Sequence
  chemically synthesized
ttagaaccaatgataaactact

SEQ ID NO: 746627 - DNA, 22 bp, Artificial Sequence
  chemically synthesized
tttagaaccaatgataaactac

SEQ ID NO: 746628 - DNA, 22 bp, Artificial Sequence
  chemically synthesized
ttttagaaccaatgataaacta

SEQ ID NO: 746629 - DNA, 22 bp, Artificial Sequence
  chemically synthesized
tttttagaaccaatgataaact

SEQ ID NO: 746630 - DNA, 22 bp, Artificial Sequence
  chemically synthesized
agcagtagtttatcattggttc

SEQ ID NO: 746631 - DNA, 22 bp, Artificial Sequence
  chemically synthesized
atgtgttttttttagaaccaat

SEQ ID NO: 746632 - DNA, 22 bp, Artificial Sequence
  chemically synthesized
atcattggttctaaaaaaaaca

SEQ ID NO: 746633 - DNA, 22 bp, Artificial Sequence
  chemically synthesized
tcattggttctaaaaaaaacac

SEQ ID NO: 746634 - DNA, 22 bp, Artificial Sequence
  chemically synthesized
gcaatacattgatgtgtttttt

SEQ ID NO: 746635 - DNA, 22 bp, Artificial Sequence
  chemically synthesized
ggcaatacattgatgtgttttt

SEQ ID NO: 746636 - DNA, 22 bp, Artificial Sequence
  chemically synthesized
tggcaatacattgatgtgtttt

SEQ ID NO: 746637 - DNA, 22 bp, Artificial Sequence
  chemically synthesized
gttctaaaaaaaacacatcaat

SEQ ID NO: 746638 - DNA, 22 bp, Artificial Sequence
  chemically synthesized
taaaaaaaacacatcaatgtat

SEQ ID NO: 746639 - DNA, 22 bp, Artificial Sequence
  chemically synthesized
aaaaaaacacatcaatgtattg

SEQ ID NO: 746640 - DNA, 22 bp, Artificial Sequence
  chemically synthesized
agtagaaacaaaagtgaatgag

SEQ ID NO: 746641 - DNA, 22 bp, Artificial Sequence
  chemically synthesized
ccaaagactctcattcactttt

SEQ ID NO: 746642 - DNA, 22 bp, Artificial Sequence
  chemically synthesized
tcattcacttttgtttctactt

SEQ ID NO: 746643 - DNA, 22 bp, Artificial Sequence
  chemically synthesized
attcacttttgtttctacttaa

SEQ ID NO: 746644 - DNA, 22 bp, Artificial Sequence
  chemically synthesized
acttttgtttctacttaattcc

SEQ ID NO: 746645 - DNA, 22 bp, Artificial Sequence
  chemically synthesized
ttgtttctacttaattcctgta

SEQ ID NO: 746646 - DNA, 22 bp, Artificial Sequence
  chemically synthesized
tgtttctacttaattcctgtac

SEQ ID NO: 746647 - DNA, 22 bp, Artificial Sequence
  chemically synthesized
gtttctacttaattcctgtact

SEQ ID NO: 746648 - DNA, 22 bp, Artificial Sequence
  chemically synthesized
tttctacttaattcctgtactt

SEQ ID NO: 746649 - DNA, 22 bp, Artificial Sequence
  chemically synthesized
gcaatatatgccgaagtacagg

SEQ ID NO: 746650 - DNA, 22 bp, Artificial Sequence
  chemically synthesized
ctacttaattcctgtacttcgg

SEQ ID NO: 746651 - DNA, 22 bp, Artificial Sequence
  chemically synthesized
tacttaattcctgtacttcggc

SEQ ID NO: 746652 - DNA, 22 bp, Artificial Sequence
  chemically synthesized
ttggcaatatatgccgaagtac

SEQ ID NO: 746653 - DNA, 22 bp, Artificial Sequence
  chemically synthesized
attggcaatatatgccgaagta

SEQ ID NO: 746654 - DNA, 22 bp, Artificial Sequence
  chemically synthesized
cttaattcctgtacttcggcat

SEQ ID NO: 746655 - DNA, 22 bp, Artificial Sequence
  chemically synthesized
aattcctgtacttcggcatata

SEQ ID NO: 746656 - DNA, 22 bp, Artificial Sequence
  chemically synthesized
attcctgtacttcggcatatat

SEQ ID NO: 746657 - DNA, 22 bp, Artificial Sequence
  chemically synthesized
ctgtacttcggcatatattgcc

SEQ ID NO: 746658 - DNA, 22 bp, Artificial Sequence
  chemically synthesized
tacttcggcatatattgccaat

SEQ ID NO: 746659 - DNA, 22 bp, Artificial Sequence
  chemically synthesized
cggcatatattgccaataaatt

SEQ ID NO: 746660 - DNA, 22 bp, Artificial Sequence
  chemically synthesized
ggcatatattgccaataaattg

SEQ ID NO: 746661 - DNA, 22 bp, Artificial Sequence
  chemically synthesized
gtgaacagagtgaagtcaattt

SEQ ID NO: 746662 - DNA, 22 bp, Artificial Sequence
  chemically synthesized
ccaataaattgacttcactctg

SEQ ID NO: 746663 - DNA, 22 bp, Artificial Sequence
  chemically synthesized
acttcactctgttcactaactt

SEQ ID NO: 746664 - DNA, 22 bp, Artificial Sequence
  chemically synthesized
acacggcataagcaagttagtg

SEQ ID NO: 746665 - DNA, 22 bp, Artificial Sequence
  chemically synthesized
aacacggcataagcaagttagt

SEQ ID NO: 746666 - DNA, 22 bp, Artificial Sequence
  chemically synthesized
cactctgttcactaacttgctt

SEQ ID NO: 746667 - DNA, 22 bp, Artificial Sequence
  chemically synthesized
actctgttcactaacttgctta

SEQ ID NO: 746668 - DNA, 22 bp, Artificial Sequence
  chemically synthesized
tgttcactaacttgcttatgcc

SEQ ID NO: 746669 - DNA, 22 bp, Artificial Sequence
  chemically synthesized
ttcactaacttgcttatgccgt

SEQ ID NO: 746670 - DNA, 22 bp, Artificial Sequence
  chemically synthesized
actaacttgcttatgccgtgtt

SEQ ID NO: 746671 - DNA, 22 bp, Artificial Sequence
  chemically synthesized
tcatcatgatcttaacacggca

SEQ ID NO: 746672 - DNA, 22 bp, Artificial Sequence
  chemically synthesized
tatcatcatgatcttaacacgg

SEQ ID NO: 746673 - DNA, 22 bp, Artificial Sequence
  chemically synthesized
acttgcttatgccgtgttaaga

SEQ ID NO: 746674 - DNA, 22 bp, Artificial Sequence
  chemically synthesized
gcttatgccgtgttaagatcat

SEQ ID NO: 746675 - DNA, 22 bp, Artificial Sequence
  chemically synthesized
cttatgccgtgttaagatcatg

SEQ ID NO: 746676 - DNA, 22 bp, Artificial Sequence
  chemically synthesized
acattctatcatcatgatctta

SEQ ID NO: 746677 - DNA, 22 bp, Artificial Sequence
  chemically synthesized
atgccgtgttaagatcatgatg

SEQ ID NO: 746678 - DNA, 22 bp, Artificial Sequence
  chemically synthesized
tgccgtgttaagatcatgatga

SEQ ID NO: 746679 - DNA, 22 bp, Artificial Sequence
  chemically synthesized
tcaaatattcacattctatcat

SEQ ID NO: 746680 - DNA, 22 bp, Artificial Sequence
  chemically synthesized
agatcatgatgatagaatgtga

SEQ ID NO: 746681 - DNA, 22 bp, Artificial Sequence
  chemically synthesized
cctatcaaatattcacattcta

SEQ ID NO: 746682 - DNA, 22 bp, Artificial Sequence
  chemically synthesized
ccctatcaaatattcacattct

SEQ ID NO: 746683 - DNA, 22 bp, Artificial Sequence
  chemically synthesized
tccctatcaaatattcacattc

SEQ ID NO: 746684 - DNA, 22 bp, Artificial Sequence
  chemically synthesized
ttccctatcaaatattcacatt

SEQ ID NO: 746685 - DNA, 22 bp, Artificial Sequence
  chemically synthesized
gaacttttccctatcaaatatt

SEQ ID NO: 746686 - DNA, 22 bp, Artificial Sequence
  chemically synthesized
agaacttttccctatcaaatat

SEQ ID NO: 746687 - DNA, 22 bp, Artificial Sequence
  chemically synthesized
atttagaacttttccctatcaa

SEQ ID NO: 746688 - DNA, 22 bp, Artificial Sequence
  chemically synthesized
aaatgactcatttagaactttt

SEQ ID NO: 746689 - DNA, 22 bp, Artificial Sequence
  chemically synthesized
gatagggaaaagttctaaatga

SEQ ID NO: 746690 - DNA, 22 bp, Artificial Sequence
  chemically synthesized
atagggaaaagttctaaatgag

SEQ ID NO: 746691 - DNA, 22 bp, Artificial Sequence
  chemically synthesized
tagactcaaatgactcatttag

SEQ ID NO: 746692 - DNA, 22 bp, Artificial Sequence
  chemically synthesized
tgcatcattatagactcaaatg

SEQ ID NO: 746693 - DNA, 22 bp, Artificial Sequence
  chemically synthesized
taaatgagtcatttgagtctat

SEQ ID NO: 746694 - DNA, 22 bp, Artificial Sequence
  chemically synthesized
aatgagtcatttgagtctataa

SEQ ID NO: 746695 - DNA, 22 bp, Artificial Sequence
  chemically synthesized
cgggattatgcatcattataga

SEQ ID NO: 746696 - DNA, 22 bp, Artificial Sequence
  chemically synthesized
ccgggattatgcatcattatag

SEQ ID NO: 746697 - DNA, 22 bp, Artificial Sequence
  chemically synthesized
tccgggattatgcatcattata

SEQ ID NO: 746698 - DNA, 22 bp, Artificial Sequence
  chemically synthesized
gttttccgggattatgcatcat

SEQ ID NO: 746699 - DNA, 22 bp, Artificial Sequence
  chemically synthesized
ggttttccgggattatgcatca

SEQ ID NO: 746700 - DNA, 22 bp, Artificial Sequence
  chemically synthesized
gagtctataatgatgcataatc

SEQ ID NO: 746701 - DNA, 22 bp, Artificial Sequence
  chemically synthesized
agtctataatgatgcataatcc

SEQ ID NO: 746702 - DNA, 22 bp, Artificial Sequence
  chemically synthesized
gaagtttggttttccgggatta

SEQ ID NO: 746703 - DNA, 22 bp, Artificial Sequence
  chemically synthesized
agaagtttggttttccgggatt

SEQ ID NO: 746704 - DNA, 22 bp, Artificial Sequence
  chemically synthesized
taatgatgcataatcccggaaa

SEQ ID NO: 746705 - DNA, 22 bp, Artificial Sequence
  chemically synthesized
tagaagtttggttttccgggat

SEQ ID NO: 746706 - DNA, 22 bp, Artificial Sequence
  chemically synthesized
ttagaagtttggttttccggga

SEQ ID NO: 746707 - DNA, 22 bp, Artificial Sequence
  chemically synthesized
tttttagaagtttggttttccg

SEQ ID NO: 746708 - DNA, 22 bp, Artificial Sequence
  chemically synthesized
atttttagaagtttggttttcc

SEQ ID NO: 746709 - DNA, 22 bp, Artificial Sequence
  chemically synthesized
gaaacacacttatttttagaag

SEQ ID NO: 746710 - DNA, 22 bp, Artificial Sequence
  chemically synthesized
cgaaacacacttatttttagaa

SEQ ID NO: 746711 - DNA, 22 bp, Artificial Sequence
  chemically synthesized
tttcgaaacacacttattttta

SEQ ID NO: 746712 - DNA, 22 bp, Artificial Sequence
  chemically synthesized
ccagtcctgtttcgaaacacac

SEQ ID NO: 746713 - DNA, 22 bp, Artificial Sequence
  chemically synthesized
ctaaaaataagtgtgtttcgaa

SEQ ID NO: 746714 - DNA, 22 bp, Artificial Sequence
  chemically synthesized
taaaaataagtgtgtttcgaaa

SEQ ID NO: 746715 - DNA, 22 bp, Artificial Sequence
  chemically synthesized
aaaataagtgtgtttcgaaaca

SEQ ID NO: 746716 - DNA, 22 bp, Artificial Sequence
  chemically synthesized
agaacctgccagtcctgtttcg

SEQ ID NO: 746717 - DNA, 22 bp, Artificial Sequence
  chemically synthesized
ataaagttaagaacctgccagt

SEQ ID NO: 746718 - DNA, 22 bp, Artificial Sequence
  chemically synthesized
cataaagttaagaacctgccag

SEQ ID NO: 746719 - DNA, 22 bp, Artificial Sequence
  chemically synthesized
cgaaacaggactggcaggttct

SEQ ID NO: 746720 - DNA, 22 bp, Artificial Sequence
  chemically synthesized
ttcataaagttaagaacctgcc

SEQ ID NO: 746721 - DNA, 22 bp, Artificial Sequence
  chemically synthesized
gaaacaggactggcaggttctt

SEQ ID NO: 746722 - DNA, 22 bp, Artificial Sequence
  chemically synthesized
cttcataaagttaagaacctgc

SEQ ID NO: 746723 - DNA, 22 bp, Artificial Sequence
  chemically synthesized
tcttcataaagttaagaacctg

SEQ ID NO: 746724 - DNA, 22 bp, Artificial Sequence
  chemically synthesized
ttcttcataaagttaagaacct

SEQ ID NO: 746725 - DNA, 22 bp, Artificial Sequence
  chemically synthesized
tttcttcataaagttaagaacc

SEQ ID NO: 746726 - DNA, 22 bp, Artificial Sequence
  chemically synthesized
ttttcttcataaagttaagaac

SEQ ID NO: 746727 - DNA, 22 bp, Artificial Sequence
  chemically synthesized
tttttcttcataaagttaagaa

SEQ ID NO: 746728 - DNA, 22 bp, Artificial Sequence
  chemically synthesized
gcaggttcttaactttatgaag

SEQ ID NO: 746729 - DNA, 22 bp, Artificial Sequence
  chemically synthesized
tggtaattttttttcttcataa

SEQ ID NO: 746730 - DNA, 22 bp, Artificial Sequence
  chemically synthesized
atggtaattttttttcttcata

SEQ ID NO: 746731 - DNA, 22 bp, Artificial Sequence
  chemically synthesized
tatggtaattttttttcttcat

SEQ ID NO: 746732 - DNA, 22 bp, Artificial Sequence
  chemically synthesized
ttatggtaattttttttcttca

SEQ ID NO: 746733 - DNA, 22 bp, Artificial Sequence
  chemically synthesized
ttaactttatgaagaaaaaaaa

SEQ ID NO: 746734 - DNA, 22 bp, Artificial Sequence
  chemically synthesized
atttttatggtaattttttttc

SEQ ID NO: 746735 - DNA, 22 bp, Artificial Sequence
  chemically synthesized
aactttatgaagaaaaaaaatt

SEQ ID NO: 746736 - DNA, 22 bp, Artificial Sequence
  chemically synthesized
actttatgaagaaaaaaaatta

SEQ ID NO: 746737 - DNA, 22 bp, Artificial Sequence
  chemically synthesized
tatgaagaaaaaaaattaccat

SEQ ID NO: 746738 - DNA, 22 bp, Artificial Sequence
  chemically synthesized
atgaagaaaaaaaattaccata

SEQ ID NO: 746739 - DNA, 22 bp, Artificial Sequence
  chemically synthesized
tgaagaaaaaaaattaccataa

SEQ ID NO: 746740 - DNA, 22 bp, Artificial Sequence
  chemically synthesized
aggaattgatttttatggtaat

SEQ ID NO: 746741 - DNA, 22 bp, Artificial Sequence
  chemically synthesized
aaggaattgatttttatggtaa

SEQ ID NO: 746742 - DNA, 22 bp, Artificial Sequence
  chemically synthesized
taaggaattgatttttatggta

SEQ ID NO: 746743 - DNA, 22 bp, Artificial Sequence
  chemically synthesized
ttaaggaattgatttttatggt

SEQ ID NO: 746744 - DNA, 22 bp, Artificial Sequence
  chemically synthesized
ttttaaggaattgatttttatg

SEQ ID NO: 746745 - DNA, 22 bp, Artificial Sequence
  chemically synthesized
cttttaaggaattgatttttat

SEQ ID NO: 746746 - DNA, 22 bp, Artificial Sequence
  chemically synthesized
tcttttaaggaattgattttta

SEQ ID NO: 746747 - DNA, 22 bp, Artificial Sequence
  chemically synthesized
ttttcttttaaggaattgattt

SEQ ID NO: 746748 - DNA, 22 bp, Artificial Sequence
  chemically synthesized
tattttcttttaaggaattgat

SEQ ID NO: 746749 - DNA, 22 bp, Artificial Sequence
  chemically synthesized
ctattttcttttaaggaattga

SEQ ID NO: 746750 - DNA, 22 bp, Artificial Sequence
  chemically synthesized
ccataaaaatcaattccttaaa

SEQ ID NO: 746751 - DNA, 22 bp, Artificial Sequence
  chemically synthesized
agacagatttctattttctttt

SEQ ID NO: 746752 - DNA, 22 bp, Artificial Sequence
  chemically synthesized
acactaagacagatttctattt

SEQ ID NO: 746753 - DNA, 22 bp, Artificial Sequence
  chemically synthesized
cttaaaagaaaatagaaatctg

SEQ ID NO: 746754 - DNA, 22 bp, Artificial Sequence
  chemically synthesized
aaaagaaaatagaaatctgtct

SEQ ID NO: 746755 - DNA, 22 bp, Artificial Sequence
  chemically synthesized
aaagaaaatagaaatctgtctt

SEQ ID NO: 746756 - DNA, 22 bp, Artificial Sequence
  chemically synthesized
gaggatctaacactaagacaga

SEQ ID NO: 746757 - DNA, 22 bp, Artificial Sequence
  chemically synthesized
accagaatgaggctggaggatc

SEQ ID NO: 746758 - DNA, 22 bp, Artificial Sequence
  chemically synthesized
tcttagtgttagatcctccagc

SEQ ID NO: 746759 - DNA, 22 bp, Artificial Sequence
  chemically synthesized
aaccagaatgaggctggaggat

SEQ ID NO: 746760 - DNA, 22 bp, Artificial Sequence
  chemically synthesized
ttaaccagaatgaggctggagg

SEQ ID NO: 746761 - DNA, 22 bp, Artificial Sequence
  chemically synthesized
agtgttagatcctccagcctca

SEQ ID NO: 746762 - DNA, 22 bp, Artificial Sequence
  chemically synthesized
tcttaaccagaatgaggctgga

SEQ ID NO: 746763 - DNA, 22 bp, Artificial Sequence
  chemically synthesized
gtgttagatcctccagcctcat

SEQ ID NO: 746764 - DNA, 22 bp, Artificial Sequence
  chemically synthesized
gatcctccagcctcattctggt

SEQ ID NO: 746765 - DNA, 22 bp, Artificial Sequence
  chemically synthesized
aaacgccaaattctcttaacca

SEQ ID NO: 746766 - DNA, 22 bp, Artificial Sequence
  chemically synthesized
cagcctcattctggttaagaga

SEQ ID NO: 746767 - DNA, 22 bp, Artificial Sequence
  chemically synthesized
agccctgaaacgccaaattctc

SEQ ID NO: 746768 - DNA, 22 bp, Artificial Sequence
  chemically synthesized
attctggttaagagaatttggc

SEQ ID NO: 746769 - DNA, 22 bp, Artificial Sequence
  chemically synthesized
tggttaagagaatttggcgttt

SEQ ID NO: 746770 - DNA, 22 bp, Artificial Sequence
  chemically synthesized
gttaagagaatttggcgtttca

SEQ ID NO: 746771 - DNA, 22 bp, Artificial Sequence
  chemically synthesized
agagaatttggcgtttcagggc

SEQ ID NO: 746772 - DNA, 22 bp, Artificial Sequence
  chemically synthesized
cacagtgtgctcagccctgaaa

SEQ ID NO: 746773 - DNA, 22 bp, Artificial Sequence
  chemically synthesized
ccacagtgtgctcagccctgaa

SEQ ID NO: 746774 - DNA, 22 bp, Artificial Sequence
  chemically synthesized
agtttccacagtgtgctcagcc

SEQ ID NO: 746775 - DNA, 22 bp, Artificial Sequence
  chemically synthesized
ggcgtttcagggctgagcacac

SEQ ID NO: 746776 - DNA, 22 bp, Artificial Sequence
  chemically synthesized
gcgtttcagggctgagcacact

SEQ ID NO: 746777 - DNA, 22 bp, Artificial Sequence
  chemically synthesized
ttaagtttccacagtgtgctca

SEQ ID NO: 746778 - DNA, 22 bp, Artificial Sequence
  chemically synthesized
attaagtttccacagtgtgctc

SEQ ID NO: 746779 - DNA, 22 bp, Artificial Sequence
  chemically synthesized
cagggctgagcacactgtggaa

SEQ ID NO: 746780 - DNA, 22 bp, Artificial Sequence
  chemically synthesized
agggctgagcacactgtggaaa

SEQ ID NO: 746781 - DNA, 22 bp, Artificial Sequence
  chemically synthesized
aatatttattaagtttccacag

SEQ ID NO: 746782 - DNA, 22 bp, Artificial Sequence
  chemically synthesized
agcacactgtggaaacttaata

SEQ ID NO: 746783 - DNA, 22 bp, Artificial Sequence
  chemically synthesized
taaacctcaatatttattaagt

SEQ ID NO: 746784 - DNA, 22 bp, Artificial Sequence
  chemically synthesized
gtaaacctcaatatttattaag

SEQ ID NO: 746785 - DNA, 22 bp, Artificial Sequence
  chemically synthesized
tttgtaaacctcaatatttatt

SEQ ID NO: 746786 - DNA, 22 bp, Artificial Sequence
  chemically synthesized
gtttgtaaacctcaatatttat

SEQ ID NO: 746787 - DNA, 22 bp, Artificial Sequence
  chemically synthesized
tgtttgtaaacctcaatattta

SEQ ID NO: 746788 - DNA, 22 bp, Artificial Sequence
  chemically synthesized
tggaaacttaataaatattgag

SEQ ID NO: 746789 - DNA, 22 bp, Artificial Sequence
  chemically synthesized
ttgtttgtaaacctcaatattt

SEQ ID NO: 746790 - DNA, 22 bp, Artificial Sequence
  chemically synthesized
tttgtttgtaaacctcaatatt

SEQ ID NO: 746791 - DNA, 22 bp, Artificial Sequence
  chemically synthesized
tgctttttgtttgtaaacctca

SEQ ID NO: 746792 - DNA, 22 bp, Artificial Sequence
  chemically synthesized
aataaatattgaggtttacaaa

SEQ ID NO: 746793 - DNA, 22 bp, Artificial Sequence
  chemically synthesized
ttatgctttttgtttgtaaacc

SEQ ID NO: 746794 - DNA, 22 bp, Artificial Sequence
  chemically synthesized
ataaatattgaggtttacaaac

SEQ ID NO: 746795 - DNA, 22 bp, Artificial Sequence
  chemically synthesized
aggtttacaaacaaaaagcata

SEQ ID NO: 746796 - DNA, 22 bp, Artificial Sequence
  chemically synthesized
gtccacatatcattgttatgct

SEQ ID NO: 746797 - DNA, 22 bp, Artificial Sequence
  chemically synthesized
acaaacaaaaagcataacaatg

SEQ ID NO: 746798 - DNA, 22 bp, Artificial Sequence
  chemically synthesized
caaacaaaaagcataacaatga

SEQ ID NO: 746799 - DNA, 22 bp, Artificial Sequence
  chemically synthesized
aaaattggtccacatatcattg

SEQ ID NO: 746800 - DNA, 22 bp, Artificial Sequence
  chemically synthesized
ttgaaaattggtccacatatca

SEQ ID NO: 746801 - DNA, 22 bp, Artificial Sequence
  chemically synthesized
agtgttgttgaaaattggtcca

SEQ ID NO: 746802 - DNA, 22 bp, Artificial Sequence
  chemically synthesized
cagtgttgttgaaaattggtcc

SEQ ID NO: 746803 - DNA, 22 bp, Artificial Sequence
  chemically synthesized
tcagtgttgttgaaaattggtc

SEQ ID NO: 746804 - DNA, 22 bp, Artificial Sequence
  chemically synthesized
attttcagtgttgttgaaaatt

SEQ ID NO: 746805 - DNA, 22 bp, Artificial Sequence
  chemically synthesized
tcaacaacactgaaaatcaatg

SEQ ID NO: 746806 - DNA, 22 bp, Artificial Sequence
  chemically synthesized
caacaacactgaaaatcaatgt

SEQ ID NO: 746807 - DNA, 22 bp, Artificial Sequence
  chemically synthesized
aacaacactgaaaatcaatgtg

SEQ ID NO: 746808 - DNA, 22 bp, Artificial Sequence
  chemically synthesized
ggcagagtaagggcacattgat

SEQ ID NO: 746809 - DNA, 22 bp, Artificial Sequence
  chemically synthesized
aattaggcagagtaagggcaca

SEQ ID NO: 746810 - DNA, 22 bp, Artificial Sequence
  chemically synthesized
aaaatcaatgtgcccttactct

SEQ ID NO: 746811 - DNA, 22 bp, Artificial Sequence
  chemically synthesized
actgaattaggcagagtaaggg

SEQ ID NO: 746812 - DNA, 22 bp, Artificial Sequence
  chemically synthesized
agttaactgaattaggcagagt

SEQ ID NO: 746813 - DNA, 22 bp, Artificial Sequence
  chemically synthesized
aataattgagttaactgaatta

SEQ ID NO: 746814 - DNA, 22 bp, Artificial Sequence
  chemically synthesized
actctgcctaattcagttaact

SEQ ID NO: 746815 - DNA, 22 bp, Artificial Sequence
  chemically synthesized
ctctgcctaattcagttaactc

SEQ ID NO: 746816 - DNA, 22 bp, Artificial Sequence
  chemically synthesized
tgcctaattcagttaactcaat

SEQ ID NO: 746817 - DNA, 22 bp, Artificial Sequence
  chemically synthesized
cctaattcagttaactcaatta

SEQ ID NO: 746818 - DNA, 22 bp, Artificial Sequence
  chemically synthesized
attcagttaactcaattattta

SEQ ID NO: 746819 - DNA, 22 bp, Artificial Sequence
  chemically synthesized
aaatcaagtgtacattaaataa

SEQ ID NO: 746820 - DNA, 22 bp, Artificial Sequence
  chemically synthesized
agttaactcaattatttaatgt

SEQ ID NO: 746821 - DNA, 22 bp, Artificial Sequence
  chemically synthesized
actcaattatttaatgtacact

SEQ ID NO: 746822 - DNA, 22 bp, Artificial Sequence
  chemically synthesized
aattatttaatgtacacttgat

SEQ ID NO: 746823 - DNA, 22 bp, Artificial Sequence
  chemically synthesized
tttaatgtacacttgatttgag

SEQ ID NO: 746824 - DNA, 22 bp, Artificial Sequence
  chemically synthesized
tggtcaaacccactcaaatcaa

SEQ ID NO: 746825 - DNA, 22 bp, Artificial Sequence
  chemically synthesized
aatgtacacttgatttgagtgg

SEQ ID NO: 746826 - DNA, 22 bp, Artificial Sequence
  chemically synthesized
atgtacacttgatttgagtggg

SEQ ID NO: 746827 - DNA, 22 bp, Artificial Sequence
  chemically synthesized
gatttgagtgggtttgaccata

SEQ ID NO: 746828 - DNA, 22 bp, Artificial Sequence
  chemically synthesized
atttgagtgggtttgaccatag

SEQ ID NO: 746829 - DNA, 22 bp, Artificial Sequence
  chemically synthesized
gagtgggtttgaccatagctat

SEQ ID NO: 746830 - DNA, 22 bp, Artificial Sequence
  chemically synthesized
agtgggtttgaccatagctatt

SEQ ID NO: 746831 - DNA, 22 bp, Artificial Sequence
  chemically synthesized
aatggaaaatggaaatagctat

SEQ ID NO: 746832 - DNA, 22 bp, Artificial Sequence
  chemically synthesized
atgttcaatggaaaatggaaat

SEQ ID NO: 746833 - DNA, 22 bp, Artificial Sequence
  chemically synthesized
gaccatagctatttccattttc

SEQ ID NO: 746834 - DNA, 22 bp, Artificial Sequence
  chemically synthesized
accatagctatttccattttcc

SEQ ID NO: 746835 - DNA, 22 bp, Artificial Sequence
  chemically synthesized
attaatgttcaatggaaaatgg

SEQ ID NO: 746836 - DNA, 22 bp, Artificial Sequence
  chemically synthesized
gattaatgttcaatggaaaatg

SEQ ID NO: 746837 - DNA, 22 bp, Artificial Sequence
  chemically synthesized
tttccattttccattgaacatt

SEQ ID NO: 746838 - DNA, 22 bp, Artificial Sequence
  chemically synthesized
gaagcaatttgattaatgttca

SEQ ID NO: 746839 - DNA, 22 bp, Artificial Sequence
  chemically synthesized
ccattttccattgaacattaat

SEQ ID NO: 746840 - DNA, 22 bp, Artificial Sequence
  chemically synthesized
cattttccattgaacattaatc

SEQ ID NO: 746841 - DNA, 22 bp, Artificial Sequence
  chemically synthesized
cattagaagcaatttgattaat

SEQ ID NO: 746842 - DNA, 22 bp, Artificial Sequence
  chemically synthesized
acattagaagcaatttgattaa

SEQ ID NO: 746843 - DNA, 22 bp, Artificial Sequence
  chemically synthesized
tccattgaacattaatcaaatt

SEQ ID NO: 746844 - DNA, 22 bp, Artificial Sequence
  chemically synthesized
tacattagaagcaatttgatta

SEQ ID NO: 746845 - DNA, 22 bp, Artificial Sequence
  chemically synthesized
ccattgaacattaatcaaattg

SEQ ID NO: 746846 - DNA, 22 bp, Artificial Sequence
  chemically synthesized
cattgaacattaatcaaattgc

SEQ ID NO: 746847 - DNA, 22 bp, Artificial Sequence
  chemically synthesized
aacattaatcaaattgcttcta

SEQ ID NO: 746848 - DNA, 22 bp, Artificial Sequence
  chemically synthesized
atcaaattgcttctaatgtaaa

SEQ ID NO: 746849 - DNA, 22 bp, Artificial Sequence
  chemically synthesized
cttctaatgtaaaatttcattt

SEQ ID NO: 746850 - DNA, 22 bp, Artificial Sequence
  chemically synthesized
ctaatgtaaaatttcatttttt

SEQ ID NO: 746851 - DNA, 22 bp, Artificial Sequence
  chemically synthesized
taatgtaaaatttcattttttc

SEQ ID NO: 746852 - DNA, 22 bp, Artificial Sequence
  chemically synthesized
atgtaaaatttcattttttctc

SEQ ID NO: 746853 - DNA, 22 bp, Artificial Sequence
  chemically synthesized
ggagaggagaaggatgagaaaa

SEQ ID NO: 746854 - DNA, 22 bp, Artificial Sequence
  chemically synthesized
gaatctgggagaggagaaggat

SEQ ID NO: 746855 - DNA, 22 bp, Artificial Sequence
  chemically synthesized
cattttttctcatccttctcct

SEQ ID NO: 746856 - DNA, 22 bp, Artificial Sequence
  chemically synthesized
attttttctcatccttctcctc

SEQ ID NO: 746857 - DNA, 22 bp, Artificial Sequence
  chemically synthesized
tcctagaatctgggagaggaga

SEQ ID NO: 746858 - DNA, 22 bp, Artificial Sequence
  chemically synthesized
tttctcatccttctcctctccc

SEQ ID NO: 746859 - DNA, 22 bp, Artificial Sequence
  chemically synthesized
atcctagaatctgggagaggag

SEQ ID NO: 746860 - DNA, 22 bp, Artificial Sequence
  chemically synthesized
ttctcatccttctcctctccca

SEQ ID NO: 746861 - DNA, 22 bp, Artificial Sequence
  chemically synthesized
tctcatccttctcctctcccag

SEQ ID NO: 746862 - DNA, 22 bp, Artificial Sequence
  chemically synthesized
ctcatccttctcctctcccaga

SEQ ID NO: 746863 - DNA, 22 bp, Artificial Sequence
  chemically synthesized
tcatccttctcctctcccagat

SEQ ID NO: 746864 - DNA, 22 bp, Artificial Sequence
  chemically synthesized
ccttatcctagaatctgggaga

SEQ ID NO: 746865 - DNA, 22 bp, Artificial Sequence
  chemically synthesized
cccttatcctagaatctgggag

SEQ ID NO: 746866 - DNA, 22 bp, Artificial Sequence
  chemically synthesized
atccttctcctctcccagattc

SEQ ID NO: 746867 - DNA, 22 bp, Artificial Sequence
  chemically synthesized
tcccttatcctagaatctggga

SEQ ID NO: 746868 - DNA, 22 bp, Artificial Sequence
  chemically synthesized
ttcccttatcctagaatctggg

SEQ ID NO: 746869 - DNA, 22 bp, Artificial Sequence
  chemically synthesized
ctcctctcccagattctaggat

SEQ ID NO: 746870 - DNA, 22 bp, Artificial Sequence
  chemically synthesized
aacttttcccttatcctagaat

SEQ ID NO: 746871 - DNA, 22 bp, Artificial Sequence
  chemically synthesized
tcctctcccagattctaggata

SEQ ID NO: 746872 - DNA, 22 bp, Artificial Sequence
  chemically synthesized
aaacttttcccttatcctagaa

SEQ ID NO: 746873 - DNA, 22 bp, Artificial Sequence
  chemically synthesized
ctctcccagattctaggataag

SEQ ID NO: 746874 - DNA, 22 bp, Artificial Sequence
  chemically synthesized
tcccagattctaggataaggga

SEQ ID NO: 746875 - DNA, 22 bp, Artificial Sequence
  chemically synthesized
ccagattctaggataagggaaa

SEQ ID NO: 746876 - DNA, 22 bp, Artificial Sequence
  chemically synthesized
taggataagggaaaagtttaag

SEQ ID NO: 746877 - DNA, 22 bp, Artificial Sequence
  chemically synthesized
ggataagggaaaagtttaagtt

SEQ ID NO: 746878 - DNA, 22 bp, Artificial Sequence
  chemically synthesized
aacaagagacatgaaacttaaa

SEQ ID NO: 746879 - DNA, 22 bp, Artificial Sequence
  chemically synthesized
aaacaagagacatgaaacttaa

SEQ ID NO: 746880 - DNA, 22 bp, Artificial Sequence
  chemically synthesized
taaacaagagacatgaaactta

SEQ ID NO: 746881 - DNA, 22 bp, Artificial Sequence
  chemically synthesized
actttaaacaagagacatgaaa

SEQ ID NO: 746882 - DNA, 22 bp, Artificial Sequence
  chemically synthesized
aactttaaacaagagacatgaa

SEQ ID NO: 746883 - DNA, 22 bp, Artificial Sequence
  chemically synthesized
taactttaaacaagagacatga

SEQ ID NO: 746884 - DNA, 22 bp, Artificial Sequence
  chemically synthesized
ttaactttaaacaagagacatg

SEQ ID NO: 746885 - DNA, 22 bp, Artificial Sequence
  chemically synthesized
cttttaactttaaacaagagac

SEQ ID NO: 746886 - DNA, 22 bp, Artificial Sequence
  chemically synthesized
gcttttaactttaaacaagaga

SEQ ID NO: 746887 - DNA, 22 bp, Artificial Sequence
  chemically synthesized
aagtttcatgtctcttgtttaa

SEQ ID NO: 746888 - DNA, 22 bp, Artificial Sequence
  chemically synthesized
agtttcatgtctcttgtttaaa

SEQ ID NO: 746889 - DNA, 22 bp, Artificial Sequence
  chemically synthesized
aaatttgcttttaactttaaac

SEQ ID NO: 746890 - DNA, 22 bp, Artificial Sequence
  chemically synthesized
aaaatttgcttttaactttaaa

SEQ ID NO: 746891 - DNA, 22 bp, Artificial Sequence
  chemically synthesized
catgtctcttgtttaaagttaa

SEQ ID NO: 746892 - DNA, 22 bp, Artificial Sequence
  chemically synthesized
atgtctcttgtttaaagttaaa

SEQ ID NO: 746893 - DNA, 22 bp, Artificial Sequence
  chemically synthesized
ttgtttaaagttaaaagcaaat

SEQ ID NO: 746894 - DNA, 22 bp, Artificial Sequence
  chemically synthesized
gtttaaagttaaaagcaaattt

SEQ ID NO: 746895 - DNA, 22 bp, Artificial Sequence
  chemically synthesized
tttaaagttaaaagcaaatttt

SEQ ID NO: 746896 - DNA, 22 bp, Artificial Sequence
  chemically synthesized
aaagttaaaagcaaattttaag

SEQ ID NO: 746897 - DNA, 22 bp, Artificial Sequence
  chemically synthesized
aagttaaaagcaaattttaaga

SEQ ID NO: 746898 - DNA, 22 bp, Artificial Sequence
  chemically synthesized
atggaaacagatgtcttaaaat

SEQ ID NO: 746899 - DNA, 22 bp, Artificial Sequence
  chemically synthesized
aaagcaaattttaagacatctg

SEQ ID NO: 746900 - DNA, 22 bp, Artificial Sequence
  chemically synthesized
tgggataaactaatggaaacag

SEQ ID NO: 746901 - DNA, 22 bp, Artificial Sequence
  chemically synthesized
taagacatctgtttccattagt

SEQ ID NO: 746902 - DNA, 22 bp, Artificial Sequence
  chemically synthesized
aagacatctgtttccattagtt

SEQ ID NO: 746903 - DNA, 22 bp, Artificial Sequence
  chemically synthesized
agacatctgtttccattagttt

SEQ ID NO: 746904 - DNA, 22 bp, Artificial Sequence
  chemically synthesized
tttccattagtttatcccataa

SEQ ID NO: 746905 - DNA, 22 bp, Artificial Sequence
  chemically synthesized
ccattagtttatcccataattc

SEQ ID NO: 746906 - DNA, 22 bp, Artificial Sequence
  chemically synthesized
cattagtttatcccataattct

SEQ ID NO: 746907 - DNA, 22 bp, Artificial Sequence
  chemically synthesized
gtttatcccataattctctttt

SEQ ID NO: 746908 - DNA, 22 bp, Artificial Sequence
  chemically synthesized
atcccataattctcttttcata

SEQ ID NO: 746909 - DNA, 22 bp, Artificial Sequence
  chemically synthesized
tcccataattctcttttcatat

SEQ ID NO: 746910 - DNA, 22 bp, Artificial Sequence
  chemically synthesized
tggtatagggtgagtggtatat

SEQ ID NO: 746911 - DNA, 22 bp, Artificial Sequence
  chemically synthesized
tcttttcatataccactcaccc

SEQ ID NO: 746912 - DNA, 22 bp, Artificial Sequence
  chemically synthesized
ttttcatataccactcacccta

SEQ ID NO: 746913 - DNA, 22 bp, Artificial Sequence
  chemically synthesized
atggttgtggtatagggtgagt

SEQ ID NO: 746914 - DNA, 22 bp, Artificial Sequence
  chemically synthesized
ttcatataccactcaccctata

SEQ ID NO: 746915 - DNA, 22 bp, Artificial Sequence
  chemically synthesized
tcatataccactcaccctatac

SEQ ID NO: 746916 - DNA, 22 bp, Artificial Sequence
  chemically synthesized
catataccactcaccctatacc

SEQ ID NO: 746917 - DNA, 22 bp, Artificial Sequence
  chemically synthesized
atataccactcaccctatacca

SEQ ID NO: 746918 - DNA, 22 bp, Artificial Sequence
  chemically synthesized
tgaaaaagttcatggttgtggt

SEQ ID NO: 746919 - DNA, 22 bp, Artificial Sequence
  chemically synthesized
accctataccacaaccatgaac

SEQ ID NO: 746920 - DNA, 22 bp, Artificial Sequence
  chemically synthesized
aatatctgtgaaaaagttcatg

SEQ ID NO: 746921 - DNA, 22 bp, Artificial Sequence
  chemically synthesized
taccacaaccatgaactttttc

SEQ ID NO: 746922 - DNA, 22 bp, Artificial Sequence
  chemically synthesized
tttcacagatatttaatacatt

SEQ ID NO: 746923 - DNA, 22 bp, Artificial Sequence
  chemically synthesized
ttcacagatatttaatacattg

SEQ ID NO: 746924 - DNA, 22 bp, Artificial Sequence
  chemically synthesized
tcacagatatttaatacattgt

SEQ ID NO: 746925 - DNA, 22 bp, Artificial Sequence
  chemically synthesized
cacagatatttaatacattgtt

SEQ ID NO: 746926 - DNA, 22 bp, Artificial Sequence
  chemically synthesized
acagatatttaatacattgttt

SEQ ID NO: 746927 - DNA, 22 bp, Artificial Sequence
  chemically synthesized
ccaaaatggtgcaaaaaacaat

SEQ ID NO: 746928 - DNA, 22 bp, Artificial Sequence
  chemically synthesized
cccaaaatggtgcaaaaaacaa

SEQ ID NO: 746929 - DNA, 22 bp, Artificial Sequence
  chemically synthesized
tcccaaaatggtgcaaaaaaca

SEQ ID NO: 746930 - DNA, 22 bp, Artificial Sequence
  chemically synthesized
ttcccaaaatggtgcaaaaaac

SEQ ID NO: 746931 - DNA, 22 bp, Artificial Sequence
  chemically synthesized
aatacattgttttttgcaccat

SEQ ID NO: 746932 - DNA, 22 bp, Artificial Sequence
  chemically synthesized
atacattgttttttgcaccatt

SEQ ID NO: 746933 - DNA, 22 bp, Artificial Sequence
  chemically synthesized
ttttttgcaccattttgggaaa

SEQ ID NO: 746934 - DNA, 22 bp, Artificial Sequence
  chemically synthesized
aggaaggaggatttttcccaaa

SEQ ID NO: 746935 - DNA, 22 bp, Artificial Sequence
  chemically synthesized
tttgcaccattttgggaaaaat

SEQ ID NO: 746936 - DNA, 22 bp, Artificial Sequence
  chemically synthesized
ttgcaccattttgggaaaaatc

SEQ ID NO: 746937 - DNA, 22 bp, Artificial Sequence
  chemically synthesized
tgcaccattttgggaaaaatcc

SEQ ID NO: 746938 - DNA, 22 bp, Artificial Sequence
  chemically synthesized
gcaccattttgggaaaaatcct

SEQ ID NO: 746939 - DNA, 22 bp, Artificial Sequence
  chemically synthesized
caccattttgggaaaaatcctc

SEQ ID NO: 746940 - DNA, 22 bp, Artificial Sequence
  chemically synthesized
aagtggttgaggaaggaggatt

SEQ ID NO: 746941 - DNA, 22 bp, Artificial Sequence
  chemically synthesized
gctgaagtggttgaggaaggag

SEQ ID NO: 746942 - DNA, 22 bp, Artificial Sequence
  chemically synthesized
tgggaaaaatcctccttcctca

SEQ ID NO: 746943 - DNA, 22 bp, Artificial Sequence
  chemically synthesized
agctgaagtggttgaggaagga

SEQ ID NO: 746944 - DNA, 22 bp, Artificial Sequence
  chemically synthesized
gggaaaaatcctccttcctcaa

SEQ ID NO: 746945 - DNA, 22 bp, Artificial Sequence
  chemically synthesized
ggaaaaatcctccttcctcaac

SEQ ID NO: 746946 - DNA, 22 bp, Artificial Sequence
  chemically synthesized
cttcctcaaccacttcagctaa

SEQ ID NO: 746947 - DNA, 22 bp, Artificial Sequence
  chemically synthesized
cctcaaccacttcagctaagac

SEQ ID NO: 746948 - DNA, 22 bp, Artificial Sequence
  chemically synthesized
ctcaaccacttcagctaagact

SEQ ID NO: 746949 - DNA, 22 bp, Artificial Sequence
  chemically synthesized
aaccacttcagctaagactctt

SEQ ID NO: 746950 - DNA, 22 bp, Artificial Sequence
  chemically synthesized
ggagaaagtagaaaagagtctt

SEQ ID NO: 746951 - DNA, 22 bp, Artificial Sequence
  chemically synthesized
cagctaagactcttttctactt

SEQ ID NO: 746952 - DNA, 22 bp, Artificial Sequence
  chemically synthesized
agctaagactcttttctacttt

SEQ ID NO: 746953 - DNA, 22 bp, Artificial Sequence
  chemically synthesized
agactcttttctactttctccc

SEQ ID NO: 746954 - DNA, 22 bp, Artificial Sequence
  chemically synthesized
ttttctactttctcccagttga

SEQ ID NO: 746955 - DNA, 22 bp, Artificial Sequence
  chemically synthesized
ttctactttctcccagttgatc

SEQ ID NO: 746956 - DNA, 22 bp, Artificial Sequence
  chemically synthesized
tctactttctcccagttgatcc

SEQ ID NO: 746957 - DNA, 22 bp, Artificial Sequence
  chemically synthesized
ctactttctcccagttgatccc

SEQ ID NO: 746958 - DNA, 22 bp, Artificial Sequence
  chemically synthesized
tactttctcccagttgatccca

SEQ ID NO: 746959 - DNA, 22 bp, Artificial Sequence
  chemically synthesized
ctttctcccagttgatcccaca

SEQ ID NO: 746960 - DNA, 22 bp, Artificial Sequence
  chemically synthesized
tctcccagttgatcccacatca

SEQ ID NO: 746961 - DNA, 22 bp, Artificial Sequence
  chemically synthesized
ctcccagttgatcccacatcat

SEQ ID NO: 746962 - DNA, 22 bp, Artificial Sequence
  chemically synthesized
tcccagttgatcccacatcatc

SEQ ID NO: 746963 - DNA, 22 bp, Artificial Sequence
  chemically synthesized
ccagttgatcccacatcatctc

SEQ ID NO: 746964 - DNA, 22 bp, Artificial Sequence
  chemically synthesized
atcccacatcatctctatttca

SEQ ID NO: 746965 - DNA, 22 bp, Artificial Sequence
  chemically synthesized
tatttcatctctatttcacctc

SEQ ID NO: 746966 - DNA, 22 bp, Artificial Sequence
  chemically synthesized
tttcatctctatttcacctcat

SEQ ID NO: 746967 - DNA, 22 bp, Artificial Sequence
  chemically synthesized
catctctatttcacctcatctc

SEQ ID NO: 746968 - DNA, 22 bp, Artificial Sequence
  chemically synthesized
tgtatagaaatagagatgaggt

SEQ ID NO: 746969 - DNA, 22 bp, Artificial Sequence
  chemically synthesized
atctctatttcacctcatctct

SEQ ID NO: 746970 - DNA, 22 bp, Artificial Sequence
  chemically synthesized
gtgtatagaaatagagatgagg

SEQ ID NO: 746971 - DNA, 22 bp, Artificial Sequence
  chemically synthesized
tgtgtatagaaatagagatgag

SEQ ID NO: 746972 - DNA, 22 bp, Artificial Sequence
  chemically synthesized
ttgtgtatagaaatagagatga

SEQ ID NO: 746973 - DNA, 22 bp, Artificial Sequence
  chemically synthesized
tatttcacctcatctctatttc

SEQ ID NO: 746974 - DNA, 22 bp, Artificial Sequence
  chemically synthesized
tttcacctcatctctatttcta

SEQ ID NO: 746975 - DNA, 22 bp, Artificial Sequence
  chemically synthesized
cacctcatctctatttctatac

SEQ ID NO: 746976 - DNA, 22 bp, Artificial Sequence
  chemically synthesized
acctcatctctatttctataca

SEQ ID NO: 746977 - DNA, 22 bp, Artificial Sequence
  chemically synthesized
atctctatttctatacacaaaa

SEQ ID NO: 746978 - DNA, 22 bp, Artificial Sequence
  chemically synthesized
agggggagggtatatttttgtg

SEQ ID NO: 746979 - DNA, 22 bp, Artificial Sequence
  chemically synthesized
tatttctatacacaaaaatata

SEQ ID NO: 746980 - DNA, 22 bp, Artificial Sequence
  chemically synthesized
tttctatacacaaaaatatacc

SEQ ID NO: 746981 - DNA, 22 bp, Artificial Sequence
  chemically synthesized
tgttcagggggagggtatattt

SEQ ID NO: 746982 - DNA, 22 bp, Artificial Sequence
  chemically synthesized
ctatacacaaaaatataccctc

SEQ ID NO: 746983 - DNA, 22 bp, Artificial Sequence
  chemically synthesized
tgtgttcagggggagggtatat

SEQ ID NO: 746984 - DNA, 22 bp, Artificial Sequence
  chemically synthesized
tatacacaaaaatataccctcc

SEQ ID NO: 746985 - DNA, 22 bp, Artificial Sequence
  chemically synthesized
tacacaaaaatataccctcccc

SEQ ID NO: 746986 - DNA, 22 bp, Artificial Sequence
  chemically synthesized
aggctctgtgttcagggggagg

SEQ ID NO: 746987 - DNA, 22 bp, Artificial Sequence
  chemically synthesized
gaggctctgtgttcagggggag

SEQ ID NO: 746988 - DNA, 22 bp, Artificial Sequence
  chemically synthesized
tccaccccttgaggctctgtgt

SEQ ID NO: 746989 - DNA, 22 bp, Artificial Sequence
  chemically synthesized
gtccaccccttgaggctctgtg

SEQ ID NO: 746990 - DNA, 22 bp, Artificial Sequence
  chemically synthesized
tgtccaccccttgaggctctgt

SEQ ID NO: 746991 - DNA, 22 bp, Artificial Sequence
  chemically synthesized
cccctgaacacagagcctcaag

SEQ ID NO: 746992 - DNA, 22 bp, Artificial Sequence
  chemically synthesized
ctttgtccaccccttgaggctc

SEQ ID NO: 746993 - DNA, 22 bp, Artificial Sequence
  chemically synthesized
actttgtccaccccttgaggct

SEQ ID NO: 746994 - DNA, 22 bp, Artificial Sequence
  chemically synthesized
aacacagagcctcaaggggtgg

SEQ ID NO: 746995 - DNA, 22 bp, Artificial Sequence
  chemically synthesized
taacttactttgtccacccctt

SEQ ID NO: 746996 - DNA, 22 bp, Artificial Sequence
  chemically synthesized
ataacttactttgtccacccct

SEQ ID NO: 746997 - DNA, 22 bp, Artificial Sequence
  chemically synthesized
tataacttactttgtccacccc

SEQ ID NO: 746998 - DNA, 22 bp, Artificial Sequence
  chemically synthesized
cattttataacttactttgtcc

SEQ ID NO: 746999 - DNA, 22 bp, Artificial Sequence
  chemically synthesized
aaggggtggacaaagtaagtta

SEQ ID NO: 747000 - DNA, 22 bp, Artificial Sequence
  chemically synthesized
caggagtgcctacattttataa

SEQ ID NO: 747001 - DNA, 22 bp, Artificial Sequence
  chemically synthesized
tccaggagtgcctacattttat

SEQ ID NO: 747002 - DNA, 22 bp, Artificial Sequence
  chemically synthesized
ctccaggagtgcctacatttta

SEQ ID NO: 747003 - DNA, 22 bp, Artificial Sequence
  chemically synthesized
acagcttctccaggagtgccta

SEQ ID NO: 747004 - DNA, 22 bp, Artificial Sequence
  chemically synthesized
taaaatgtaggcactcctggag

SEQ ID NO: 747005 - DNA, 22 bp, Artificial Sequence
  chemically synthesized
gatatgaatagctaacagcttc

SEQ ID NO: 747006 - DNA, 22 bp, Artificial Sequence
  chemically synthesized
ctagatatgaatagctaacagc

SEQ ID NO: 747007 - DNA, 22 bp, Artificial Sequence
  chemically synthesized
gctagatatgaatagctaacag

SEQ ID NO: 747008 - DNA, 22 bp, Artificial Sequence
  chemically synthesized
ctggagaagctgttagctattc

SEQ ID NO: 747009 - DNA, 22 bp, Artificial Sequence
  chemically synthesized
cttgctagatatgaatagctaa

SEQ ID NO: 747010 - DNA, 22 bp, Artificial Sequence
  chemically synthesized
gagaagctgttagctattcata

SEQ ID NO: 747011 - DNA, 22 bp, Artificial Sequence
  chemically synthesized
agtaaaatctacttgctagata

SEQ ID NO: 747012 - DNA, 22 bp, Artificial Sequence
  chemically synthesized
ttagctattcatatctagcaag

SEQ ID NO: 747013 - DNA, 22 bp, Artificial Sequence
  chemically synthesized
aagtaaaatctacttgctagat

SEQ ID NO: 747014 - DNA, 22 bp, Artificial Sequence
  chemically synthesized
taagtaaaatctacttgctaga

SEQ ID NO: 747015 - DNA, 22 bp, Artificial Sequence
  chemically synthesized
ttaagtaaaatctacttgctag

SEQ ID NO: 747016 - DNA, 22 bp, Artificial Sequence
  chemically synthesized
gctattcatatctagcaagtag

SEQ ID NO: 747017 - DNA, 22 bp, Artificial Sequence
  chemically synthesized
tttaagtaaaatctacttgcta

SEQ ID NO: 747018 - DNA, 22 bp, Artificial Sequence
  chemically synthesized
ttcatatctagcaagtagattt

SEQ ID NO: 747019 - DNA, 22 bp, Artificial Sequence
  chemically synthesized
atatctagcaagtagattttac

SEQ ID NO: 747020 - DNA, 22 bp, Artificial Sequence
  chemically synthesized
gcaagtagattttacttaaaaa

SEQ ID NO: 747021 - DNA, 22 bp, Artificial Sequence
  chemically synthesized
ggatcagtcaacactttttaag

SEQ ID NO: 747022 - DNA, 22 bp, Artificial Sequence
  chemically synthesized
tacttaaaaagtgttgactgat

SEQ ID NO: 747023 - DNA, 22 bp, Artificial Sequence
  chemically synthesized
aaaatagttgggatcagtcaac

SEQ ID NO: 747024 - DNA, 22 bp, Artificial Sequence
  chemically synthesized
acttaaaaagtgttgactgatc

SEQ ID NO: 747025 - DNA, 22 bp, Artificial Sequence
  chemically synthesized
cttaaaaagtgttgactgatcc

SEQ ID NO: 747026 - DNA, 22 bp, Artificial Sequence
  chemically synthesized
aaaaagtgttgactgatcccaa

SEQ ID NO: 747027 - DNA, 22 bp, Artificial Sequence
  chemically synthesized
aaaagtgttgactgatcccaac

SEQ ID NO: 747028 - DNA, 22 bp, Artificial Sequence
  chemically synthesized
ggatattaaaaatagttgggat

SEQ ID NO: 747029 - DNA, 22 bp, Artificial Sequence
  chemically synthesized
aatctaggatattaaaaatagt

SEQ ID NO: 747030 - DNA, 22 bp, Artificial Sequence
  chemically synthesized
actgatcccaactatttttaat

SEQ ID NO: 747031 - DNA, 22 bp, Artificial Sequence
  chemically synthesized
tgaatctaggatattaaaaata

SEQ ID NO: 747032 - DNA, 22 bp, Artificial Sequence
  chemically synthesized
ctgaatctaggatattaaaaat

SEQ ID NO: 747033 - DNA, 22 bp, Artificial Sequence
  chemically synthesized
atcccaactatttttaatatcc

SEQ ID NO: 747034 - DNA, 22 bp, Artificial Sequence
  chemically synthesized
tagagtttctgaatctaggata

SEQ ID NO: 747035 - DNA, 22 bp, Artificial Sequence
  chemically synthesized
atagagtttctgaatctaggat

SEQ ID NO: 747036 - DNA, 22 bp, Artificial Sequence
  chemically synthesized
tatagagtttctgaatctagga

SEQ ID NO: 747037 - DNA, 22 bp, Artificial Sequence
  chemically synthesized
tttttaatatcctagattcaga

SEQ ID NO: 747038 - DNA, 22 bp, Artificial Sequence
  chemically synthesized
ttaatatcctagattcagaaac

SEQ ID NO: 747039 - DNA, 22 bp, Artificial Sequence
  chemically synthesized
taatatcctagattcagaaact

SEQ ID NO: 747040 - DNA, 22 bp, Artificial Sequence
  chemically synthesized
aatatcctagattcagaaactc

SEQ ID NO: 747041 - DNA, 22 bp, Artificial Sequence
  chemically synthesized
atatcctagattcagaaactct

SEQ ID NO: 747042 - DNA, 22 bp, Artificial Sequence
  chemically synthesized
gattcagaaactctataaagta

SEQ ID NO: 747043 - DNA, 22 bp, Artificial Sequence
  chemically synthesized
atgataaaatagtactttatag

SEQ ID NO: 747044 - DNA, 22 bp, Artificial Sequence
  chemically synthesized
agaaactctataaagtactatt

SEQ ID NO: 747045 - DNA, 22 bp, Artificial Sequence
  chemically synthesized
ccaaacatactgatgataaaat

SEQ ID NO: 747046 - DNA, 22 bp, Artificial Sequence
  chemically synthesized
tataaagtactattttatcatc

SEQ ID NO: 747047 - DNA, 22 bp, Artificial Sequence
  chemically synthesized
taccaaacatactgatgataaa

SEQ ID NO: 747048 - DNA, 22 bp, Artificial Sequence
  chemically synthesized
taaagtactattttatcatcag

SEQ ID NO: 747049 - DNA, 22 bp, Artificial Sequence
  chemically synthesized
ctaccaaacatactgatgataa

SEQ ID NO: 747050 - DNA, 22 bp, Artificial Sequence
  chemically synthesized
tctaccaaacatactgatgata

SEQ ID NO: 747051 - DNA, 22 bp, Artificial Sequence
  chemically synthesized
ttctaccaaacatactgatgat

SEQ ID NO: 747052 - DNA, 22 bp, Artificial Sequence
  chemically synthesized
cacttttctaccaaacatactg

SEQ ID NO: 747053 - DNA, 22 bp, Artificial Sequence
  chemically synthesized
acacttttctaccaaacatact

SEQ ID NO: 747054 - DNA, 22 bp, Artificial Sequence
  chemically synthesized
ttttatcatcagtatgtttggt

SEQ ID NO: 747055 - DNA, 22 bp, Artificial Sequence
  chemically synthesized
cttacacttttctaccaaacat

SEQ ID NO: 747056 - DNA, 22 bp, Artificial Sequence
  chemically synthesized
tatcatcagtatgtttggtaga

SEQ ID NO: 747057 - DNA, 22 bp, Artificial Sequence
  chemically synthesized
tccttacacttttctaccaaac

SEQ ID NO: 747058 - DNA, 22 bp, Artificial Sequence
  chemically synthesized
atcatcagtatgtttggtagaa

SEQ ID NO: 747059 - DNA, 22 bp, Artificial Sequence
  chemically synthesized
tcatcagtatgtttggtagaaa

SEQ ID NO: 747060 - DNA, 22 bp, Artificial Sequence
  chemically synthesized
aaaattctccttacacttttct

SEQ ID NO: 747061 - DNA, 22 bp, Artificial Sequence
  chemically synthesized
aaaaattctccttacacttttc

SEQ ID NO: 747062 - DNA, 22 bp, Artificial Sequence
  chemically synthesized
catttaaaaattctccttacac

SEQ ID NO: 747063 - DNA, 22 bp, Artificial Sequence
  chemically synthesized
ggtagaaaagtgtaaggagaat

SEQ ID NO: 747064 - DNA, 22 bp, Artificial Sequence
  chemically synthesized
gtagaaaagtgtaaggagaatt

SEQ ID NO: 747065 - DNA, 22 bp, Artificial Sequence
  chemically synthesized
ccaataaaaacaattacattta

SEQ ID NO: 747066 - DNA, 22 bp, Artificial Sequence
  chemically synthesized
accaataaaaacaattacattt

SEQ ID NO: 747067 - DNA, 22 bp, Artificial Sequence
  chemically synthesized
catttaccaataaaaacaatta

SEQ ID NO: 747068 - DNA, 22 bp, Artificial Sequence
  chemically synthesized
gcatttaccaataaaaacaatt

SEQ ID NO: 747069 - DNA, 22 bp, Artificial Sequence
  chemically synthesized
tgcatttaccaataaaaacaat

SEQ ID NO: 747070 - DNA, 22 bp, Artificial Sequence
  chemically synthesized
ttgcatttaccaataaaaacaa

SEQ ID NO: 747071 - DNA, 22 bp, Artificial Sequence
  chemically synthesized
tttgcatttaccaataaaaaca

SEQ ID NO: 747072 - DNA, 22 bp, Artificial Sequence
  chemically synthesized
ttaaatgtaattgtttttattg

SEQ ID NO: 747073 - DNA, 22 bp, Artificial Sequence
  chemically synthesized
taaatgtaattgtttttattgg

SEQ ID NO: 747074 - DNA, 22 bp, Artificial Sequence
  chemically synthesized
aaatgtaattgtttttattggt

SEQ ID NO: 747075 - DNA, 22 bp, Artificial Sequence
  chemically synthesized
aatgtaattgtttttattggta

SEQ ID NO: 747076 - DNA, 22 bp, Artificial Sequence
  chemically synthesized
tgtaaatattttttgcatttac

SEQ ID NO: 747077 - DNA, 22 bp, Artificial Sequence
  chemically synthesized
gtgtaaatattttttgcattta

SEQ ID NO: 747078 - DNA, 22 bp, Artificial Sequence
  chemically synthesized
tgtgtaaatattttttgcattt

SEQ ID NO: 747079 - DNA, 22 bp, Artificial Sequence
  chemically synthesized
tttttattggtaaatgcaaaaa

SEQ ID NO: 747080 - DNA, 22 bp, Artificial Sequence
  chemically synthesized
ttattggtaaatgcaaaaaata

SEQ ID NO: 747081 - DNA, 22 bp, Artificial Sequence
  chemically synthesized
actttgtgtaaatattttttgc

SEQ ID NO: 747082 - DNA, 22 bp, Artificial Sequence
  chemically synthesized
tattggtaaatgcaaaaaatat

SEQ ID NO: 747083 - DNA, 22 bp, Artificial Sequence
  chemically synthesized
cactttgtgtaaatattttttg

SEQ ID NO: 747084 - DNA, 22 bp, Artificial Sequence
  chemically synthesized
attggtaaatgcaaaaaatatt

SEQ ID NO: 747085 - DNA, 22 bp, Artificial Sequence
  chemically synthesized
tcactttgtgtaaatatttttt

SEQ ID NO: 747086 - DNA, 22 bp, Artificial Sequence
  chemically synthesized
ttggtaaatgcaaaaaatattt

SEQ ID NO: 747087 - DNA, 22 bp, Artificial Sequence
  chemically synthesized
ttcactttgtgtaaatattttt

SEQ ID NO: 747088 - DNA, 22 bp, Artificial Sequence
  chemically synthesized
gtaaatgcaaaaaatatttaca

SEQ ID NO: 747089 - DNA, 22 bp, Artificial Sequence
  chemically synthesized
gtcacataacttttcactttgt

SEQ ID NO: 747090 - DNA, 22 bp, Artificial Sequence
  chemically synthesized
agtcacataacttttcactttg

SEQ ID NO: 747091 - DNA, 22 bp, Artificial Sequence
  chemically synthesized
acacaaagtgaaaagttatgtg

SEQ ID NO: 747092 - DNA, 22 bp, Artificial Sequence
  chemically synthesized
cacaaagtgaaaagttatgtga

SEQ ID NO: 747093 - DNA, 22 bp, Artificial Sequence
  chemically synthesized
tatatatatttagtcacataac

SEQ ID NO: 747094 - DNA, 22 bp, Artificial Sequence
  chemically synthesized
aaactatatatatatttagtca

SEQ ID NO: 747095 - DNA, 22 bp, Artificial Sequence
  chemically synthesized
tctcaaactatatatatattta

SEQ ID NO: 747096 - DNA, 22 bp, Artificial Sequence
  chemically synthesized
gtctcaaactatatatatattt

SEQ ID NO: 747097 - DNA, 22 bp, Artificial Sequence
  chemically synthesized
tgtgactaaatatatatatagt

SEQ ID NO: 747098 - DNA, 22 bp, Artificial Sequence
  chemically synthesized
aatatatatatagtttgagaca

SEQ ID NO: 747099 - DNA, 22 bp, Artificial Sequence
  chemically synthesized
agtgacaaagcaagaccttgtc

SEQ ID NO: 747100 - DNA, 22 bp, Artificial Sequence
  chemically synthesized
caggctgagtgacaaagcaaga

SEQ ID NO: 747101 - DNA, 22 bp, Artificial Sequence
  chemically synthesized
gagacaaggtcttgctttgtca

SEQ ID NO: 747102 - DNA, 22 bp, Artificial Sequence
  chemically synthesized
agacaaggtcttgctttgtcac

SEQ ID NO: 747103 - DNA, 22 bp, Artificial Sequence
  chemically synthesized
tactccaggctgagtgacaaag

SEQ ID NO: 747104 - DNA, 22 bp, Artificial Sequence
  chemically synthesized
cactgtactccaggctgagtga

SEQ ID NO: 747105 - DNA, 22 bp, Artificial Sequence
  chemically synthesized
actccactgtactccaggctga

SEQ ID NO: 747106 - DNA, 22 bp, Artificial Sequence
  chemically synthesized
gctttgtcactcagcctggagt

SEQ ID NO: 747107 - DNA, 22 bp, Artificial Sequence
  chemically synthesized
ctttgtcactcagcctggagta

SEQ ID NO: 747108 - DNA, 22 bp, Artificial Sequence
  chemically synthesized
ttcactccactgtactccaggc

SEQ ID NO: 747109 - DNA, 22 bp, Artificial Sequence
  chemically synthesized
tgtcactcagcctggagtacag

SEQ ID NO: 747110 - DNA, 22 bp, Artificial Sequence
  chemically synthesized
gtcactcagcctggagtacagt

SEQ ID NO: 747111 - DNA, 22 bp, Artificial Sequence
  chemically synthesized
tcactcagcctggagtacagtg

SEQ ID NO: 747112 - DNA, 22 bp, Artificial Sequence
  chemically synthesized
agcctggagtacagtggagtga

SEQ ID NO: 747113 - DNA, 22 bp, Artificial Sequence
  chemically synthesized
cagtgtgccctgttcactccac

SEQ ID NO: 747114 - DNA, 22 bp, Artificial Sequence
  chemically synthesized
gagtacagtggagtgaacaggg

SEQ ID NO: 747115 - DNA, 22 bp, Artificial Sequence
  chemically synthesized
aggctgcagtgtgccctgttca

SEQ ID NO: 747116 - DNA, 22 bp, Artificial Sequence
  chemically synthesized
agcacaggaggttgaggctgca

SEQ ID NO: 747117 - DNA, 22 bp, Artificial Sequence
  chemically synthesized
gagcacaggaggttgaggctgc

SEQ ID NO: 747118 - DNA, 22 bp, Artificial Sequence
  chemically synthesized
tttgagcacaggaggttgaggc

SEQ ID NO: 747119 - DNA, 22 bp, Artificial Sequence
  chemically synthesized
cagcctcaacctcctgtgctca

SEQ ID NO: 747120 - DNA, 22 bp, Artificial Sequence
  chemically synthesized
gggcaggaggactgtttgagca

SEQ ID NO: 747121 - DNA, 22 bp, Artificial Sequence
  chemically synthesized
aacctcctgtgctcaaacagtc

SEQ ID NO: 747122 - DNA, 22 bp, Artificial Sequence
  chemically synthesized
ctgtgctcaaacagtcctcctg

SEQ ID NO: 747123 - DNA, 22 bp, Artificial Sequence
  chemically synthesized
tgctcaaacagtcctcctgccc

SEQ ID NO: 747124 - DNA, 22 bp, Artificial Sequence
  chemically synthesized
cccgaaaggctggggcaggagg

SEQ ID NO: 747125 - DNA, 22 bp, Artificial Sequence
  chemically synthesized
aaacagtcctcctgccccagcc

SEQ ID NO: 747126 - DNA, 22 bp, Artificial Sequence
  chemically synthesized
tagtcccagctacccgaaaggc

SEQ ID NO: 747127 - DNA, 22 bp, Artificial Sequence
  chemically synthesized
ctgccccagcctttcgggtagc

SEQ ID NO: 747128 - DNA, 22 bp, Artificial Sequence
  chemically synthesized
ccccagcctttcgggtagctgg

SEQ ID NO: 747129 - DNA, 22 bp, Artificial Sequence
  chemically synthesized
tcgggtagctgggactacagac

SEQ ID NO: 747130 - DNA, 22 bp, Artificial Sequence
  chemically synthesized
cgggtagctgggactacagaca

SEQ ID NO: 747131 - DNA, 22 bp, Artificial Sequence
  chemically synthesized
gggtagctgggactacagacac

SEQ ID NO: 747132 - DNA, 22 bp, Artificial Sequence
  chemically synthesized
accaggtgtggtggcatgtgtc

SEQ ID NO: 747133 - DNA, 22 bp, Artificial Sequence
  chemically synthesized
ggactacagacacatgccacca

SEQ ID NO: 747134 - DNA, 22 bp, Artificial Sequence
  chemically synthesized
cagacacatgccaccacacctg

SEQ ID NO: 747135 - DNA, 22 bp, Artificial Sequence
  chemically synthesized
gacaaaaaatacaaaaattaac

SEQ ID NO: 747136 - DNA, 22 bp, Artificial Sequence
  chemically synthesized
ggacaaaaaatacaaaaattaa

SEQ ID NO: 747137 - DNA, 22 bp, Artificial Sequence
  chemically synthesized
gtttggacaaaaaatacaaaaa

SEQ ID NO: 747138 - DNA, 22 bp, Artificial Sequence
  chemically synthesized
gttaatttttgtattttttgtc

SEQ ID NO: 747139 - DNA, 22 bp, Artificial Sequence
  chemically synthesized
atttttgtattttttgtccaaa

SEQ ID NO: 747140 - DNA, 22 bp, Artificial Sequence
  chemically synthesized
ttgtattttttgtccaaacgag

SEQ ID NO: 747141 - DNA, 22 bp, Artificial Sequence
  chemically synthesized
tgtattttttgtccaaacgagg

SEQ ID NO: 747142 - DNA, 22 bp, Artificial Sequence
  chemically synthesized
gtattttttgtccaaacgaggt

SEQ ID NO: 747143 - DNA, 22 bp, Artificial Sequence
  chemically synthesized
tattttttgtccaaacgaggtt

SEQ ID NO: 747144 - DNA, 22 bp, Artificial Sequence
  chemically synthesized
gacaacatagtgaaacctcgtt

SEQ ID NO: 747145 - DNA, 22 bp, Artificial Sequence
  chemically synthesized
tttgtccaaacgaggtttcact

SEQ ID NO: 747146 - DNA, 22 bp, Artificial Sequence
  chemically synthesized
ttgtccaaacgaggtttcacta

SEQ ID NO: 747147 - DNA, 22 bp, Artificial Sequence
  chemically synthesized
tgtccaaacgaggtttcactat

SEQ ID NO: 747148 - DNA, 22 bp, Artificial Sequence
  chemically synthesized
gtccaaacgaggtttcactatg

SEQ ID NO: 747149 - DNA, 22 bp, Artificial Sequence
  chemically synthesized
tccaaacgaggtttcactatgt

SEQ ID NO: 747150 - DNA, 22 bp, Artificial Sequence
  chemically synthesized
agaccagcctggacaacatagt

SEQ ID NO: 747151 - DNA, 22 bp, Artificial Sequence
  chemically synthesized
aagaccagcctggacaacatag

SEQ ID NO: 747152 - DNA, 22 bp, Artificial Sequence
  chemically synthesized
aggagtttaagaccagcctgga

SEQ ID NO: 747153 - DNA, 22 bp, Artificial Sequence
  chemically synthesized
cactatgttgtccaggctggtc

SEQ ID NO: 747154 - DNA, 22 bp, Artificial Sequence
  chemically synthesized
actatgttgtccaggctggtct

SEQ ID NO: 747155 - DNA, 22 bp, Artificial Sequence
  chemically synthesized
tgttgtccaggctggtcttaaa

SEQ ID NO: 747156 - DNA, 22 bp, Artificial Sequence
  chemically synthesized
catgagctcaggagtttaagac

SEQ ID NO: 747157 - DNA, 22 bp, Artificial Sequence
  chemically synthesized
tccaggctggtcttaaactcct

SEQ ID NO: 747158 - DNA, 22 bp, Artificial Sequence
  chemically synthesized
gtcttaaactcctgagctcatg

SEQ ID NO: 747159 - DNA, 22 bp, Artificial Sequence
  chemically synthesized
aaactcctgagctcatgcaacc

SEQ ID NO: 747160 - DNA, 22 bp, Artificial Sequence
  chemically synthesized
aactcctgagctcatgcaaccc

SEQ ID NO: 747161 - DNA, 22 bp, Artificial Sequence
  chemically synthesized
ggaggccgaggtgggtgggttg

SEQ ID NO: 747162 - DNA, 22 bp, Artificial Sequence
  chemically synthesized
ctgagctcatgcaacccaccca

SEQ ID NO: 747163 - DNA, 22 bp, Artificial Sequence
  chemically synthesized
gggaggccgaggtgggtgggtt

SEQ ID NO: 747164 - DNA, 22 bp, Artificial Sequence
  chemically synthesized
tgggaggccgaggtgggtgggt

SEQ ID NO: 747165 - DNA, 22 bp, Artificial Sequence
  chemically synthesized
agctcatgcaacccacccacct

SEQ ID NO: 747166 - DNA, 22 bp, Artificial Sequence
  chemically synthesized
atgcaacccacccacctcggcc

SEQ ID NO: 747167 - DNA, 22 bp, Artificial Sequence
  chemically synthesized
taatcccagcactttgggaggc

SEQ ID NO: 747168 - DNA, 22 bp, Artificial Sequence
  chemically synthesized
acgcctgtaatcccagcacttt

SEQ ID NO: 747169 - DNA, 22 bp, Artificial Sequence
  chemically synthesized
ggcctcccaaagtgctgggatt

SEQ ID NO: 747170 - DNA, 22 bp, Artificial Sequence
  chemically synthesized
ccaaagtgctgggattacaggc

SEQ ID NO: 747171 - DNA, 22 bp, Artificial Sequence
  chemically synthesized
ggattacaggcgtgagccacca

SEQ ID NO: 747172 - DNA, 22 bp, Artificial Sequence
  chemically synthesized
gtcatggccggccgtggtggct

SEQ ID NO: 747173 - DNA, 22 bp, Artificial Sequence
  chemically synthesized
agtcatggccggccgtggtggc

SEQ ID NO: 747174 - DNA, 22 bp, Artificial Sequence
  chemically synthesized
caggcgtgagccaccacggccg

SEQ ID NO: 747175 - DNA, 22 bp, Artificial Sequence
  chemically synthesized
aaaatatttagtcatggccggc

SEQ ID NO: 747176 - DNA, 22 bp, Artificial Sequence
  chemically synthesized
acgttaaaaatatttagtcatg

SEQ ID NO: 747177 - DNA, 22 bp, Artificial Sequence
  chemically synthesized
aacgttaaaaatatttagtcat

SEQ ID NO: 747178 - DNA, 22 bp, Artificial Sequence
  chemically synthesized
taacgttaaaaatatttagtca

SEQ ID NO: 747179 - DNA, 22 bp, Artificial Sequence
  chemically synthesized
ttaacgttaaaaatatttagtc

SEQ ID NO: 747180 - DNA, 22 bp, Artificial Sequence
  chemically synthesized
atttttaacgttaaaaatattt

SEQ ID NO: 747181 - DNA, 22 bp, Artificial Sequence
  chemically synthesized
ccagtattaatttttaacgtta

SEQ ID NO: 747182 - DNA, 22 bp, Artificial Sequence
  chemically synthesized
cccagtattaatttttaacgtt

SEQ ID NO: 747183 - DNA, 22 bp, Artificial Sequence
  chemically synthesized
aatatttttaacgttaaaaatt

SEQ ID NO: 747184 - DNA, 22 bp, Artificial Sequence
  chemically synthesized
ccttcccagtattaatttttaa

SEQ ID NO: 747185 - DNA, 22 bp, Artificial Sequence
  chemically synthesized
gccttcccagtattaattttta

SEQ ID NO: 747186 - DNA, 22 bp, Artificial Sequence
  chemically synthesized
ttaacgttaaaaattaatactg

SEQ ID NO: 747187 - DNA, 22 bp, Artificial Sequence
  chemically synthesized
taacgttaaaaattaatactgg

SEQ ID NO: 747188 - DNA, 22 bp, Artificial Sequence
  chemically synthesized
aacgttaaaaattaatactggg

SEQ ID NO: 747189 - DNA, 22 bp, Artificial Sequence
  chemically synthesized
acgttaaaaattaatactggga

SEQ ID NO: 747190 - DNA, 22 bp, Artificial Sequence
  chemically synthesized
aaaattaatactgggaaggcaa

SEQ ID NO: 747191 - DNA, 22 bp, Artificial Sequence
  chemically synthesized
atactgggaaggcaagttatgc

SEQ ID NO: 747192 - DNA, 22 bp, Artificial Sequence
  chemically synthesized
agatgaccaacagcataacttg

SEQ ID NO: 747193 - DNA, 22 bp, Artificial Sequence
  chemically synthesized
cagatgaccaacagcataactt

SEQ ID NO: 747194 - DNA, 22 bp, Artificial Sequence
  chemically synthesized
cttcagatgaccaacagcataa

SEQ ID NO: 747195 - DNA, 22 bp, Artificial Sequence
  chemically synthesized
ggaaggcaagttatgctgttgg

SEQ ID NO: 747196 - DNA, 22 bp, Artificial Sequence
  chemically synthesized
gggttgcttcagatgaccaaca

SEQ ID NO: 747197 - DNA, 22 bp, Artificial Sequence
  chemically synthesized
ggggttgcttcagatgaccaac

SEQ ID NO: 747198 - DNA, 22 bp, Artificial Sequence
  chemically synthesized
tggggttgcttcagatgaccaa

SEQ ID NO: 747199 - DNA, 22 bp, Artificial Sequence
  chemically synthesized
tgctgttggtcatctgaagcaa

SEQ ID NO: 747200 - DNA, 22 bp, Artificial Sequence
  chemically synthesized
gtacaattttggggttgcttca

SEQ ID NO: 747201 - DNA, 22 bp, Artificial Sequence
  chemically synthesized
ttggtcatctgaagcaacccca

SEQ ID NO: 747202 - DNA, 22 bp, Artificial Sequence
  chemically synthesized
gtcatctgaagcaaccccaaaa

SEQ ID NO: 747203 - DNA, 22 bp, Artificial Sequence
  chemically synthesized
atgacactggtacaattttggg

SEQ ID NO: 747204 - DNA, 22 bp, Artificial Sequence
  chemically synthesized
aatgacactggtacaattttgg

SEQ ID NO: 747205 - DNA, 22 bp, Artificial Sequence
  chemically synthesized
taatgacactggtacaattttg

SEQ ID NO: 747206 - DNA, 22 bp, Artificial Sequence
  chemically synthesized
aagcaaccccaaaattgtacca

SEQ ID NO: 747207 - DNA, 22 bp, Artificial Sequence
  chemically synthesized
gtattttaatgacactggtaca

SEQ ID NO: 747208 - DNA, 22 bp, Artificial Sequence
  chemically synthesized
ttggtattttaatgacactggt

SEQ ID NO: 747209 - DNA, 22 bp, Artificial Sequence
  chemically synthesized
ctgttggtattttaatgacact

SEQ ID NO: 747210 - DNA, 22 bp, Artificial Sequence
  chemically synthesized
cctgttggtattttaatgacac

SEQ ID NO: 747211 - DNA, 22 bp, Artificial Sequence
  chemically synthesized
tcctgttggtattttaatgaca

SEQ ID NO: 747212 - DNA, 22 bp, Artificial Sequence
  chemically synthesized
ttcctgttggtattttaatgac

SEQ ID NO: 747213 - DNA, 22 bp, Artificial Sequence
  chemically synthesized
tttcctgttggtattttaatga

SEQ ID NO: 747214 - DNA, 22 bp, Artificial Sequence
  chemically synthesized
taccagtgtcattaaaatacca

SEQ ID NO: 747215 - DNA, 22 bp, Artificial Sequence
  chemically synthesized
attttttcctgttggtatttta

SEQ ID NO: 747216 - DNA, 22 bp, Artificial Sequence
  chemically synthesized
cattttttcctgttggtatttt

SEQ ID NO: 747217 - DNA, 22 bp, Artificial Sequence
  chemically synthesized
tttcattttttcctgttggtat

SEQ ID NO: 747218 - DNA, 22 bp, Artificial Sequence
  chemically synthesized
atttcattttttcctgttggta

SEQ ID NO: 747219 - DNA, 22 bp, Artificial Sequence
  chemically synthesized
aaataccaacaggaaaaaatga

SEQ ID NO: 747220 - DNA, 22 bp, Artificial Sequence
  chemically synthesized
acggtggtttatttcatttttt

SEQ ID NO: 747221 - DNA, 22 bp, Artificial Sequence
  chemically synthesized
gacggtggtttatttcattttt

SEQ ID NO: 747222 - DNA, 22 bp, Artificial Sequence
  chemically synthesized
tgacggtggtttatttcatttt

SEQ ID NO: 747223 - DNA, 22 bp, Artificial Sequence
  chemically synthesized
tggaagactttgacggtggttt

SEQ ID NO: 747224 - DNA, 22 bp, Artificial Sequence
  chemically synthesized
gtggaagactttgacggtggtt

SEQ ID NO: 747225 - DNA, 22 bp, Artificial Sequence
  chemically synthesized
acttgtggaagactttgacggt

SEQ ID NO: 747226 - DNA, 22 bp, Artificial Sequence
  chemically synthesized
aatctcacttgtggaagacttt

SEQ ID NO: 747227 - DNA, 22 bp, Artificial Sequence
  chemically synthesized
taaatctcacttgtggaagact

SEQ ID NO: 747228 - DNA, 22 bp, Artificial Sequence
  chemically synthesized
ctaaatctcacttgtggaagac

SEQ ID NO: 747229 - DNA, 22 bp, Artificial Sequence
  chemically synthesized
tctaaatctcacttgtggaaga

SEQ ID NO: 747230 - DNA, 22 bp, Artificial Sequence
  chemically synthesized
ttctaaatctcacttgtggaag

SEQ ID NO: 747231 - DNA, 22 bp, Artificial Sequence
  chemically synthesized
ttttctaaatctcacttgtgga

SEQ ID NO: 747232 - DNA, 22 bp, Artificial Sequence
  chemically synthesized
cttttctaaatctcacttgtgg

SEQ ID NO: 747233 - DNA, 22 bp, Artificial Sequence
  chemically synthesized
ccacaagtgagatttagaaaag

SEQ ID NO: 747234 - DNA, 22 bp, Artificial Sequence
  chemically synthesized
cacaagtgagatttagaaaaga

SEQ ID NO: 747235 - DNA, 22 bp, Artificial Sequence
  chemically synthesized
aaatgaataaatggcttctttt

SEQ ID NO: 747236 - DNA, 22 bp, Artificial Sequence
  chemically synthesized
gaaatgaataaatggcttcttt

SEQ ID NO: 747237 - DNA, 22 bp, Artificial Sequence
  chemically synthesized
ggaaccttgaaatgaataaatg

SEQ ID NO: 747238 - DNA, 22 bp, Artificial Sequence
  chemically synthesized
agaaaagaagccatttattcat

SEQ ID NO: 747239 - DNA, 22 bp, Artificial Sequence
  chemically synthesized
aggaaccttgaaatgaataaat

SEQ ID NO: 747240 - DNA, 22 bp, Artificial Sequence
  chemically synthesized
gaaaagaagccatttattcatt

SEQ ID NO: 747241 - DNA, 22 bp, Artificial Sequence
  chemically synthesized
gcttaggaaccttgaaatgaat

SEQ ID NO: 747242 - DNA, 22 bp, Artificial Sequence
  chemically synthesized
cgcttaggaaccttgaaatgaa

SEQ ID NO: 747243 - DNA, 22 bp, Artificial Sequence
  chemically synthesized
tttcgcttaggaaccttgaaat

SEQ ID NO: 747244 - DNA, 22 bp, Artificial Sequence
  chemically synthesized
attcatttcaaggttcctaagc

SEQ ID NO: 747245 - DNA, 22 bp, Artificial Sequence
  chemically synthesized
ttcatttcaaggttcctaagcg

SEQ ID NO: 747246 - DNA, 22 bp, Artificial Sequence
  chemically synthesized
atttcaaggttcctaagcgaaa

SEQ ID NO: 747247 - DNA, 22 bp, Artificial Sequence
  chemically synthesized
caaggttcctaagcgaaacaat

SEQ ID NO: 747248 - DNA, 22 bp, Artificial Sequence
  chemically synthesized
aaggttcctaagcgaaacaatg

SEQ ID NO: 747249 - DNA, 22 bp, Artificial Sequence
  chemically synthesized
ctaagcgaaacaatgctcccta

SEQ ID NO: 747250 - DNA, 22 bp, Artificial Sequence
  chemically synthesized
agcgaaacaatgctccctatga

SEQ ID NO: 747251 - DNA, 22 bp, Artificial Sequence
  chemically synthesized
gatatgggagcatcatagggag

SEQ ID NO: 747252 - DNA, 22 bp, Artificial Sequence
  chemically synthesized
agatatgggagcatcataggga

SEQ ID NO: 747253 - DNA, 22 bp, Artificial Sequence
  chemically synthesized
atagtttagatatgggagcatc

SEQ ID NO: 747254 - DNA, 22 bp, Artificial Sequence
  chemically synthesized
attaatagtttagatatgggag

SEQ ID NO: 747255 - DNA, 22 bp, Artificial Sequence
  chemically synthesized
cctatgatgctcccatatctaa

SEQ ID NO: 747256 - DNA, 22 bp, Artificial Sequence
  chemically synthesized
gattgattaatagtttagatat

SEQ ID NO: 747257 - DNA, 22 bp, Artificial Sequence
  chemically synthesized
tgatgctcccatatctaaacta

SEQ ID NO: 747258 - DNA, 22 bp, Artificial Sequence
  chemically synthesized
ttggattgattaatagtttaga

SEQ ID NO: 747259 - DNA, 22 bp, Artificial Sequence
  chemically synthesized
gttggattgattaatagtttag

SEQ ID NO: 747260 - DNA, 22 bp, Artificial Sequence
  chemically synthesized
ttgttggattgattaatagttt

SEQ ID NO: 747261 - DNA, 22 bp, Artificial Sequence
  chemically synthesized
ccatatctaaactattaatcaa

SEQ ID NO: 747262 - DNA, 22 bp, Artificial Sequence
  chemically synthesized
aactattaatcaatccaacaag

SEQ ID NO: 747263 - DNA, 22 bp, Artificial Sequence
  chemically synthesized
ttaatcaatccaacaagaggct

SEQ ID NO: 747264 - DNA, 22 bp, Artificial Sequence
  chemically synthesized
atcaatccaacaagaggctgtg

SEQ ID NO: 747265 - DNA, 22 bp, Artificial Sequence
  chemically synthesized
aaaatgaatgcaggcacacagc

SEQ ID NO: 747266 - DNA, 22 bp, Artificial Sequence
  chemically synthesized
aaaaatgaatgcaggcacacag

SEQ ID NO: 747267 - DNA, 22 bp, Artificial Sequence
  chemically synthesized
gtttaaaaatgaatgcaggcac

SEQ ID NO: 747268 - DNA, 22 bp, Artificial Sequence
  chemically synthesized
agtttaaaaatgaatgcaggca

SEQ ID NO: 747269 - DNA, 22 bp, Artificial Sequence
  chemically synthesized
tgtgcctgcattcatttttaaa

SEQ ID NO: 747270 - DNA, 22 bp, Artificial Sequence
  chemically synthesized
cattcatttttaaactaaatct

SEQ ID NO: 747271 - DNA, 22 bp, Artificial Sequence
  chemically synthesized
tcaatatccagaagatttagtt

SEQ ID NO: 747272 - DNA, 22 bp, Artificial Sequence
  chemically synthesized
atcaatatccagaagatttagt

SEQ ID NO: 747273 - DNA, 22 bp, Artificial Sequence
  chemically synthesized
atttttaaactaaatcttctgg

SEQ ID NO: 747274 - DNA, 22 bp, Artificial Sequence
  chemically synthesized
tatttatcaatatccagaagat

SEQ ID NO: 747275 - DNA, 22 bp, Artificial Sequence
  chemically synthesized
atatttatcaatatccagaaga

SEQ ID NO: 747276 - DNA, 22 bp, Artificial Sequence
  chemically synthesized
tatatttatcaatatccagaag

SEQ ID NO: 747277 - DNA, 22 bp, Artificial Sequence
  chemically synthesized
ttaaactaaatcttctggatat

SEQ ID NO: 747278 - DNA, 22 bp, Artificial Sequence
  chemically synthesized
ttatatttatcaatatccagaa

SEQ ID NO: 747279 - DNA, 22 bp, Artificial Sequence
  chemically synthesized
taaactaaatcttctggatatt

SEQ ID NO: 747280 - DNA, 22 bp, Artificial Sequence
  chemically synthesized
aaactaaatcttctggatattg

SEQ ID NO: 747281 - DNA, 22 bp, Artificial Sequence
  chemically synthesized
ttttatatttatcaatatccag

SEQ ID NO: 747282 - DNA, 22 bp, Artificial Sequence
  chemically synthesized
aactaaatcttctggatattga

SEQ ID NO: 747283 - DNA, 22 bp, Artificial Sequence
  chemically synthesized
cttttatatttatcaatatcca

SEQ ID NO: 747284 - DNA, 22 bp, Artificial Sequence
  chemically synthesized
tttcttttatatttatcaatat

SEQ ID NO: 747285 - DNA, 22 bp, Artificial Sequence
  chemically synthesized
aatcttctggatattgataaat

SEQ ID NO: 747286 - DNA, 22 bp, Artificial Sequence
  chemically synthesized
ttatttcttttatatttatcaa

SEQ ID NO: 747287 - DNA, 22 bp, Artificial Sequence
  chemically synthesized
attatttcttttatatttatca

SEQ ID NO: 747288 - DNA, 22 bp, Artificial Sequence
  chemically synthesized
ctggatattgataaatataaaa

SEQ ID NO: 747289 - DNA, 22 bp, Artificial Sequence
  chemically synthesized
tggatattgataaatataaaag

SEQ ID NO: 747290 - DNA, 22 bp, Artificial Sequence
  chemically synthesized
gatattgataaatataaaagaa

SEQ ID NO: 747291 - DNA, 22 bp, Artificial Sequence
  chemically synthesized
ataaatataaaagaaataataa

SEQ ID NO: 747292 - DNA, 22 bp, Artificial Sequence
  chemically synthesized
caagtaataaatatatcattta

SEQ ID NO: 747293 - DNA, 22 bp, Artificial Sequence
  chemically synthesized
aattacaagtaataaatatatc

SEQ ID NO: 747294 - DNA, 22 bp, Artificial Sequence
  chemically synthesized
caattacaagtaataaatatat

SEQ ID NO: 747295 - DNA, 22 bp, Artificial Sequence
  chemically synthesized
ttcaattacaagtaataaatat

SEQ ID NO: 747296 - DNA, 22 bp, Artificial Sequence
  chemically synthesized
cttcaattacaagtaataaata

SEQ ID NO: 747297 - DNA, 22 bp, Artificial Sequence
  chemically synthesized
gcgtttcttcaattacaagtaa

SEQ ID NO: 747298 - DNA, 22 bp, Artificial Sequence
  chemically synthesized
tgtagtgttagcgtttcttcaa

SEQ ID NO: 747299 - DNA, 22 bp, Artificial Sequence
  chemically synthesized
attacttgtaattgaagaaacg

SEQ ID NO: 747300 - DNA, 22 bp, Artificial Sequence
  chemically synthesized
gtgtagtgttagcgtttcttca

SEQ ID NO: 747301 - DNA, 22 bp, Artificial Sequence
  chemically synthesized
ttacttgtaattgaagaaacgc

SEQ ID NO: 747302 - DNA, 22 bp, Artificial Sequence
  chemically synthesized
tgtgtagtgttagcgtttcttc

SEQ ID NO: 747303 - DNA, 22 bp, Artificial Sequence
  chemically synthesized
cttgtaattgaagaaacgctaa

SEQ ID NO: 747304 - DNA, 22 bp, Artificial Sequence
  chemically synthesized
gtaattgaagaaacgctaacac

SEQ ID NO: 747305 - DNA, 22 bp, Artificial Sequence
  chemically synthesized
taattgaagaaacgctaacact

SEQ ID NO: 747306 - DNA, 22 bp, Artificial Sequence
  chemically synthesized
aagacatattttgtgtagtgtt

SEQ ID NO: 747307 - DNA, 22 bp, Artificial Sequence
  chemically synthesized
aagaaacgctaacactacacaa

SEQ ID NO: 747308 - DNA, 22 bp, Artificial Sequence
  chemically synthesized
tgtatgtacctgaagacatatt

SEQ ID NO: 747309 - DNA, 22 bp, Artificial Sequence
  chemically synthesized
acactacacaaaatatgtcttc

SEQ ID NO: 747310 - DNA, 22 bp, Artificial Sequence
  chemically synthesized
ctgtgtatgtacctgaagacat

SEQ ID NO: 747311 - DNA, 22 bp, Artificial Sequence
  chemically synthesized
cacaaaatatgtcttcaggtac

SEQ ID NO: 747312 - DNA, 22 bp, Artificial Sequence
  chemically synthesized
catagtaaagctactgtgtatg

SEQ ID NO: 747313 - DNA, 22 bp, Artificial Sequence
  chemically synthesized
caggtacatacacagtagcttt

SEQ ID NO: 747314 - DNA, 22 bp, Artificial Sequence
  chemically synthesized
aggtacatacacagtagcttta

SEQ ID NO: 747315 - DNA, 22 bp, Artificial Sequence
  chemically synthesized
agaaccaatattccatagtaaa

SEQ ID NO: 747316 - DNA, 22 bp, Artificial Sequence
  chemically synthesized
tgagaaccaatattccatagta

SEQ ID NO: 747317 - DNA, 22 bp, Artificial Sequence
  chemically synthesized
tactatggaatattggttctca

SEQ ID NO: 747318 - DNA, 22 bp, Artificial Sequence
  chemically synthesized
agagatacattctgagaaccaa

SEQ ID NO: 747319 - DNA, 22 bp, Artificial Sequence
  chemically synthesized
actatggaatattggttctcag

SEQ ID NO: 747320 - DNA, 22 bp, Artificial Sequence
  chemically synthesized
ctatggaatattggttctcaga

SEQ ID NO: 747321 - DNA, 22 bp, Artificial Sequence
  chemically synthesized
gttcagagatacattctgagaa

SEQ ID NO: 747322 - DNA, 22 bp, Artificial Sequence
  chemically synthesized
tggaatattggttctcagaatg

SEQ ID NO: 747323 - DNA, 22 bp, Artificial Sequence
  chemically synthesized
ctggttcagagatacattctga

SEQ ID NO: 747324 - DNA, 22 bp, Artificial Sequence
  chemically synthesized
gttctcagaatgtatctctgaa

SEQ ID NO: 747325 - DNA, 22 bp, Artificial Sequence
  chemically synthesized
atgatgctgctggttcagagat

SEQ ID NO: 747326 - DNA, 22 bp, Artificial Sequence
  chemically synthesized
tcagaatgtatctctgaaccag

SEQ ID NO: 747327 - DNA, 22 bp, Artificial Sequence
  chemically synthesized
agaatgtatctctgaaccagca

SEQ ID NO: 747328 - DNA, 22 bp, Artificial Sequence
  chemically synthesized
ccaggtgttcatgatgctgctg

SEQ ID NO: 747329 - DNA, 22 bp, Artificial Sequence
  chemically synthesized
ttcccaggtgttcatgatgctg

SEQ ID NO: 747330 - DNA, 22 bp, Artificial Sequence
  chemically synthesized
gttcccaggtgttcatgatgct

SEQ ID NO: 747331 - DNA, 22 bp, Artificial Sequence
  chemically synthesized
tgaaccagcagcatcatgaaca

SEQ ID NO: 747332 - DNA, 22 bp, Artificial Sequence
  chemically synthesized
aaccagcagcatcatgaacacc

SEQ ID NO: 747333 - DNA, 22 bp, Artificial Sequence
  chemically synthesized
agaagtcccaacttgttcccag

SEQ ID NO: 747334 - DNA, 22 bp, Artificial Sequence
  chemically synthesized
gggcaaggctaagaagtcccaa

SEQ ID NO: 747335 - DNA, 22 bp, Artificial Sequence
  chemically synthesized
ggaacaagttgggacttcttag

SEQ ID NO: 747336 - DNA, 22 bp, Artificial Sequence
  chemically synthesized
aaaatgtctggggcaaggctaa

SEQ ID NO: 747337 - DNA, 22 bp, Artificial Sequence
  chemically synthesized
attcaaaatgtctggggcaagg

SEQ ID NO: 747338 - DNA, 22 bp, Artificial Sequence
  chemically synthesized
ggacttcttagccttgccccag

SEQ ID NO: 747339 - DNA, 22 bp, Artificial Sequence
  chemically synthesized
ctgattcaaaatgtctggggca

SEQ ID NO: 747340 - DNA, 22 bp, Artificial Sequence
  chemically synthesized
cttagccttgccccagacattt

SEQ ID NO: 747341 - DNA, 22 bp, Artificial Sequence
  chemically synthesized
ttagccttgccccagacatttt

SEQ ID NO: 747342 - DNA, 22 bp, Artificial Sequence
  chemically synthesized
agccttgccccagacattttga

SEQ ID NO: 747343 - DNA, 22 bp, Artificial Sequence
  chemically synthesized
gccttgccccagacattttgaa

SEQ ID NO: 747344 - DNA, 22 bp, Artificial Sequence
  chemically synthesized
cccagagttcctgattcaaaat

SEQ ID NO: 747345 - DNA, 22 bp, Artificial Sequence
  chemically synthesized
ccccagagttcctgattcaaaa

SEQ ID NO: 747346 - DNA, 22 bp, Artificial Sequence
  chemically synthesized
gccccagacattttgaatcagg

SEQ ID NO: 747347 - DNA, 22 bp, Artificial Sequence
  chemically synthesized
ccccagacattttgaatcagga

SEQ ID NO: 747348 - DNA, 22 bp, Artificial Sequence
  chemically synthesized
gtgaaccccttccccagagttc

SEQ ID NO: 747349 - DNA, 22 bp, Artificial Sequence
  chemically synthesized
tgaatcaggaactctggggaag

SEQ ID NO: 747350 - DNA, 22 bp, Artificial Sequence
  chemically synthesized
gaatcaggaactctggggaagg

SEQ ID NO: 747351 - DNA, 22 bp, Artificial Sequence
  chemically synthesized
aatcaggaactctggggaaggg

SEQ ID NO: 747352 - DNA, 22 bp, Artificial Sequence
  chemically synthesized
aggttggtgaaccccttcccca

SEQ ID NO: 747353 - DNA, 22 bp, Artificial Sequence
  chemically synthesized
tagaaactcaggttggtgaacc

SEQ ID NO: 747354 - DNA, 22 bp, Artificial Sequence
  chemically synthesized
gtagaaactcaggttggtgaac

SEQ ID NO: 747355 - DNA, 22 bp, Artificial Sequence
  chemically synthesized
tggggaaggggttcaccaacct

SEQ ID NO: 747356 - DNA, 22 bp, Artificial Sequence
  chemically synthesized
gggaaggggttcaccaacctga

SEQ ID NO: 747357 - DNA, 22 bp, Artificial Sequence
  chemically synthesized
gagggcttgtagaaactcaggt

SEQ ID NO: 747358 - DNA, 22 bp, Artificial Sequence
  chemically synthesized
accaacctgagtttctacaagc

SEQ ID NO: 747359 - DNA, 22 bp, Artificial Sequence
  chemically synthesized
agtttctacaagccctccaggt

SEQ ID NO: 747360 - DNA, 22 bp, Artificial Sequence
  chemically synthesized
agcatacatcagaatcacctgg

SEQ ID NO: 747361 - DNA, 22 bp, Artificial Sequence
  chemically synthesized
ctacaagccctccaggtgattc

SEQ ID NO: 747362 - DNA, 22 bp, Artificial Sequence
  chemically synthesized
tacaagccctccaggtgattct

SEQ ID NO: 747363 - DNA, 22 bp, Artificial Sequence
  chemically synthesized
caagccctccaggtgattctga

SEQ ID NO: 747364 - DNA, 22 bp, Artificial Sequence
  chemically synthesized
acctcagcatacatcagaatca

SEQ ID NO: 747365 - DNA, 22 bp, Artificial Sequence
  chemically synthesized
tcacctcagcatacatcagaat

SEQ ID NO: 747366 - DNA, 22 bp, Artificial Sequence
  chemically synthesized
caggtgattctgatgtatgctg

SEQ ID NO: 747367 - DNA, 22 bp, Artificial Sequence
  chemically synthesized
agtggcaatggttctcacctca

SEQ ID NO: 747368 - DNA, 22 bp, Artificial Sequence
  chemically synthesized
cagtggcaatggttctcacctc

SEQ ID NO: 747369 - DNA, 22 bp, Artificial Sequence
  chemically synthesized
tgatgtatgctgaggtgagaac

SEQ ID NO: 747370 - DNA, 22 bp, Artificial Sequence
  chemically synthesized
tcagtggcaatggttctcacct

SEQ ID NO: 747371 - DNA, 22 bp, Artificial Sequence
  chemically synthesized
atgtatgctgaggtgagaacca

SEQ ID NO: 747372 - DNA, 22 bp, Artificial Sequence
  chemically synthesized
aggtgagaaccattgccactga

SEQ ID NO: 747373 - DNA, 22 bp, Artificial Sequence
  chemically synthesized
agaatgtcaagaattttcagtg

SEQ ID NO: 747374 - DNA, 22 bp, Artificial Sequence
  chemically synthesized
ccactgaaaattcttgacattc

SEQ ID NO: 747375 - DNA, 22 bp, Artificial Sequence
  chemically synthesized
aaaattcttgacattctcaatg

SEQ ID NO: 747376 - DNA, 22 bp, Artificial Sequence
  chemically synthesized
agacatgtccagacatcattga

SEQ ID NO: 747377 - DNA, 22 bp, Artificial Sequence
  chemically synthesized
ttgacattctcaatgatgtctg

SEQ ID NO: 747378 - DNA, 22 bp, Artificial Sequence
  chemically synthesized
gacattctcaatgatgtctgga

SEQ ID NO: 747379 - DNA, 22 bp, Artificial Sequence
  chemically synthesized
acattctcaatgatgtctggac

SEQ ID NO: 747380 - DNA, 22 bp, Artificial Sequence
  chemically synthesized
ggcattcagacatgtccagaca

SEQ ID NO: 747381 - DNA, 22 bp, Artificial Sequence
  chemically synthesized
tcaatgatgtctggacatgtct

SEQ ID NO: 747382 - DNA, 22 bp, Artificial Sequence
  chemically synthesized
aatgatgtctggacatgtctga

SEQ ID NO: 747383 - DNA, 22 bp, Artificial Sequence
  chemically synthesized
taaatgtctaggcattcagaca

SEQ ID NO: 747384 - DNA, 22 bp, Artificial Sequence
  chemically synthesized
gacatgtctgaatgcctagaca

SEQ ID NO: 747385 - DNA, 22 bp, Artificial Sequence
  chemically synthesized
tggaatctgtaaatgtctaggc

SEQ ID NO: 747386 - DNA, 22 bp, Artificial Sequence
  chemically synthesized
tagttatggaatctgtaaatgt

SEQ ID NO: 747387 - DNA, 22 bp, Artificial Sequence
  chemically synthesized
atagttatggaatctgtaaatg

SEQ ID NO: 747388 - DNA, 22 bp, Artificial Sequence
  chemically synthesized
tatagttatggaatctgtaaat

SEQ ID NO: 747389 - DNA, 22 bp, Artificial Sequence
  chemically synthesized
aatgcctagacatttacagatt

SEQ ID NO: 747390 - DNA, 22 bp, Artificial Sequence
  chemically synthesized
gctttatagttatggaatctgt

SEQ ID NO: 747391 - DNA, 22 bp, Artificial Sequence
  chemically synthesized
ggctttatagttatggaatctg

SEQ ID NO: 747392 - DNA, 22 bp, Artificial Sequence
  chemically synthesized
gacatttacagattccataact

SEQ ID NO: 747393 - DNA, 22 bp, Artificial Sequence
  chemically synthesized
acagattccataactataaagc

SEQ ID NO: 747394 - DNA, 22 bp, Artificial Sequence
  chemically synthesized
cagattccataactataaagcc

SEQ ID NO: 747395 - DNA, 22 bp, Artificial Sequence
  chemically synthesized
ataagtgagtttggctttatag

SEQ ID NO: 747396 - DNA, 22 bp, Artificial Sequence
  chemically synthesized
cataactataaagccaaactca

SEQ ID NO: 747397 - DNA, 22 bp, Artificial Sequence
  chemically synthesized
taaagccaaactcacttatgag

SEQ ID NO: 747398 - DNA, 22 bp, Artificial Sequence
  chemically synthesized
gtaagaaaatggcctcataagt

SEQ ID NO: 747399 - DNA, 22 bp, Artificial Sequence
  chemically synthesized
ttagtaagaaaatggcctcata

SEQ ID NO: 747400 - DNA, 22 bp, Artificial Sequence
  chemically synthesized
acttatgaggccattttcttac

SEQ ID NO: 747401 - DNA, 22 bp, Artificial Sequence
  chemically synthesized
atgaggccattttcttactaat

SEQ ID NO: 747402 - DNA, 22 bp, Artificial Sequence
  chemically synthesized
tgaggccattttcttactaata

SEQ ID NO: 747403 - DNA, 22 bp, Artificial Sequence
  chemically synthesized
agaaagtgatcactattagtaa

SEQ ID NO: 747404 - DNA, 22 bp, Artificial Sequence
  chemically synthesized
tcttactaatagtgatcacttt

SEQ ID NO: 747405 - DNA, 22 bp, Artificial Sequence
  chemically synthesized
cttactaatagtgatcactttc

SEQ ID NO: 747406 - DNA, 22 bp, Artificial Sequence
  chemically synthesized
ttactaatagtgatcactttct

SEQ ID NO: 747407 - DNA, 22 bp, Artificial Sequence
  chemically synthesized
actaatagtgatcactttctta

SEQ ID NO: 747408 - DNA, 22 bp, Artificial Sequence
  chemically synthesized
ctaatagtgatcactttcttag

SEQ ID NO: 747409 - DNA, 22 bp, Artificial Sequence
  chemically synthesized
atgaatgaaaaagtctaagaaa

SEQ ID NO: 747410 - DNA, 22 bp, Artificial Sequence
  chemically synthesized
atagtgatcactttcttagact

SEQ ID NO: 747411 - DNA, 22 bp, Artificial Sequence
  chemically synthesized
tcttagactttttcattcatta

SEQ ID NO: 747412 - DNA, 22 bp, Artificial Sequence
  chemically synthesized
cttagactttttcattcattaa

SEQ ID NO: 747413 - DNA, 22 bp, Artificial Sequence
  chemically synthesized
ttagactttttcattcattaac

SEQ ID NO: 747414 - DNA, 22 bp, Artificial Sequence
  chemically synthesized
agactttttcattcattaactc

SEQ ID NO: 747415 - DNA, 22 bp, Artificial Sequence
  chemically synthesized
gactttttcattcattaactct

SEQ ID NO: 747416 - DNA, 22 bp, Artificial Sequence
  chemically synthesized
gtgatggaagagaagagttaat

SEQ ID NO: 747417 - DNA, 22 bp, Artificial Sequence
  chemically synthesized
tttcattcattaactcttctct

SEQ ID NO: 747418 - DNA, 22 bp, Artificial Sequence
  chemically synthesized
ttcattcattaactcttctctt

SEQ ID NO: 747419 - DNA, 22 bp, Artificial Sequence
  chemically synthesized
tcattcattaactcttctcttc

SEQ ID NO: 747420 - DNA, 22 bp, Artificial Sequence
  chemically synthesized
cattcattaactcttctcttcc

SEQ ID NO: 747421 - DNA, 22 bp, Artificial Sequence
  chemically synthesized
attcattaactcttctcttcca

SEQ ID NO: 747422 - DNA, 22 bp, Artificial Sequence
  chemically synthesized
atcagaattagtgatggaagag

SEQ ID NO: 747423 - DNA, 22 bp, Artificial Sequence
  chemically synthesized
attaactcttctcttccatcac

SEQ ID NO: 747424 - DNA, 22 bp, Artificial Sequence
  chemically synthesized
ttcatcagaattagtgatggaa

SEQ ID NO: 747425 - DNA, 22 bp, Artificial Sequence
  chemically synthesized
actcttctcttccatcactaat

SEQ ID NO: 747426 - DNA, 22 bp, Artificial Sequence
  chemically synthesized
ttctcttccatcactaattctg

SEQ ID NO: 747427 - DNA, 22 bp, Artificial Sequence
  chemically synthesized
atagctgttcatcagaattagt

SEQ ID NO: 747428 - DNA, 22 bp, Artificial Sequence
  chemically synthesized
gatagctgttcatcagaattag

SEQ ID NO: 747429 - DNA, 22 bp, Artificial Sequence
  chemically synthesized
ctcttccatcactaattctgat

SEQ ID NO: 747430 - DNA, 22 bp, Artificial Sequence
  chemically synthesized
tcttccatcactaattctgatg

SEQ ID NO: 747431 - DNA, 22 bp, Artificial Sequence
  chemically synthesized
ttccatcactaattctgatgaa

SEQ ID NO: 747432 - DNA, 22 bp, Artificial Sequence
  chemically synthesized
ccatcactaattctgatgaaca

SEQ ID NO: 747433 - DNA, 22 bp, Artificial Sequence
  chemically synthesized
catcactaattctgatgaacag

SEQ ID NO: 747434 - DNA, 22 bp, Artificial Sequence
  chemically synthesized
ccatgaatagcttgatagctgt

SEQ ID NO: 747435 - DNA, 22 bp, Artificial Sequence
  chemically synthesized
attctgatgaacagctatcaag

SEQ ID NO: 747436 - DNA, 22 bp, Artificial Sequence
  chemically synthesized
tgatgaacagctatcaagctat

SEQ ID NO: 747437 - DNA, 22 bp, Artificial Sequence
  chemically synthesized
caccctaccatgaatagcttga

SEQ ID NO: 747438 - DNA, 22 bp, Artificial Sequence
  chemically synthesized
atgaacagctatcaagctattc

SEQ ID NO: 747439 - DNA, 22 bp, Artificial Sequence
  chemically synthesized
ccctccaccctaccatgaatag

SEQ ID NO: 747440 - DNA, 22 bp, Artificial Sequence
  chemically synthesized
tcaagctattcatggtagggtg

SEQ ID NO: 747441 - DNA, 22 bp, Artificial Sequence
  chemically synthesized
ttcatggtagggtggagggtag

SEQ ID NO: 747442 - DNA, 22 bp, Artificial Sequence
  chemically synthesized
tggaaaatccacctaccctcca

SEQ ID NO: 747443 - DNA, 22 bp, Artificial Sequence
  chemically synthesized
atggaaaatccacctaccctcc

SEQ ID NO: 747444 - DNA, 22 bp, Artificial Sequence
  chemically synthesized
tatggaaaatccacctaccctc

SEQ ID NO: 747445 - DNA, 22 bp, Artificial Sequence
  chemically synthesized
atggtagggtggagggtaggtg

SEQ ID NO: 747446 - DNA, 22 bp, Artificial Sequence
  chemically synthesized
tttatggaaaatccacctaccc

SEQ ID NO: 747447 - DNA, 22 bp, Artificial Sequence
  chemically synthesized
ctttatggaaaatccacctacc

SEQ ID NO: 747448 - DNA, 22 bp, Artificial Sequence
  chemically synthesized
tttctttatggaaaatccacct

SEQ ID NO: 747449 - DNA, 22 bp, Artificial Sequence
  chemically synthesized
gtttctttatggaaaatccacc

SEQ ID NO: 747450 - DNA, 22 bp, Artificial Sequence
  chemically synthesized
tgtttctttatggaaaatccac

SEQ ID NO: 747451 - DNA, 22 bp, Artificial Sequence
  chemically synthesized
taaataatgagaattttgtttc

SEQ ID NO: 747452 - DNA, 22 bp, Artificial Sequence
  chemically synthesized
ataaataatgagaattttgttt

SEQ ID NO: 747453 - DNA, 22 bp, Artificial Sequence
  chemically synthesized
tataaataatgagaattttgtt

SEQ ID NO: 747454 - DNA, 22 bp, Artificial Sequence
  chemically synthesized
tccataaagaaacaaaattctc

SEQ ID NO: 747455 - DNA, 22 bp, Artificial Sequence
  chemically synthesized
tttataaataatgagaattttg

SEQ ID NO: 747456 - DNA, 22 bp, Artificial Sequence
  chemically synthesized
ccataaagaaacaaaattctca

SEQ ID NO: 747457 - DNA, 22 bp, Artificial Sequence
  chemically synthesized
cataaagaaacaaaattctcat

SEQ ID NO: 747458 - DNA, 22 bp, Artificial Sequence
  chemically synthesized
catgtacagtaattctttataa

SEQ ID NO: 747459 - DNA, 22 bp, Artificial Sequence
  chemically synthesized
gcatgtacagtaattctttata

SEQ ID NO: 747460 - DNA, 22 bp, Artificial Sequence
  chemically synthesized
tgcatgtacagtaattctttat

SEQ ID NO: 747461 - DNA, 22 bp, Artificial Sequence
  chemically synthesized
ttgcatgtacagtaattcttta

SEQ ID NO: 747462 - DNA, 22 bp, Artificial Sequence
  chemically synthesized
tcattatttataaagaattact

SEQ ID NO: 747463 - DNA, 22 bp, Artificial Sequence
  chemically synthesized
tttttgcatgtacagtaattct

SEQ ID NO: 747464 - DNA, 22 bp, Artificial Sequence
  chemically synthesized
attatttataaagaattactgt

SEQ ID NO: 747465 - DNA, 22 bp, Artificial Sequence
  chemically synthesized
gtttttgcatgtacagtaattc

SEQ ID NO: 747466 - DNA, 22 bp, Artificial Sequence
  chemically synthesized
tgtttttgcatgtacagtaatt

SEQ ID NO: 747467 - DNA, 22 bp, Artificial Sequence
  chemically synthesized
tttataaagaattactgtacat

SEQ ID NO: 747468 - DNA, 22 bp, Artificial Sequence
  chemically synthesized
ttttgtttttgcatgtacagta

SEQ ID NO: 747469 - DNA, 22 bp, Artificial Sequence
  chemically synthesized
ataaagaattactgtacatgca

SEQ ID NO: 747470 - DNA, 22 bp, Artificial Sequence
  chemically synthesized
taaagaattactgtacatgcaa

SEQ ID NO: 747471 - DNA, 22 bp, Artificial Sequence
  chemically synthesized
atgctgttttgtttttgcatgt

SEQ ID NO: 747472 - DNA, 22 bp, Artificial Sequence
  chemically synthesized
aatgctgttttgtttttgcatg

SEQ ID NO: 747473 - DNA, 22 bp, Artificial Sequence
  chemically synthesized
taatgctgttttgtttttgcat

SEQ ID NO: 747474 - DNA, 22 bp, Artificial Sequence
  chemically synthesized
ttaatgctgttttgtttttgca

SEQ ID NO: 747475 - DNA, 22 bp, Artificial Sequence
  chemically synthesized
tttaatgctgttttgtttttgc

SEQ ID NO: 747476 - DNA, 22 bp, Artificial Sequence
  chemically synthesized
ttttaatgctgttttgtttttg

SEQ ID NO: 747477 - DNA, 22 bp, Artificial Sequence
  chemically synthesized
tttttaatgctgttttgttttt

SEQ ID NO: 747478 - DNA, 22 bp, Artificial Sequence
  chemically synthesized
ctgtacatgcaaaaacaaaaca

SEQ ID NO: 747479 - DNA, 22 bp, Artificial Sequence
  chemically synthesized
gctttttttaatgctgttttgt

SEQ ID NO: 747480 - DNA, 22 bp, Artificial Sequence
  chemically synthesized
tacatgcaaaaacaaaacagca

SEQ ID NO: 747481 - DNA, 22 bp, Artificial Sequence
  chemically synthesized
ggctttttttaatgctgttttg

SEQ ID NO: 747482 - DNA, 22 bp, Artificial Sequence
  chemically synthesized
aacttggctttttttaatgctg

SEQ ID NO: 747483 - DNA, 22 bp, Artificial Sequence
  chemically synthesized
atattcaacttggcttttttta

SEQ ID NO: 747484 - DNA, 22 bp, Artificial Sequence
  chemically synthesized
catattcaacttggcttttttt

SEQ ID NO: 747485 - DNA, 22 bp, Artificial Sequence
  chemically synthesized
ttcatattcaacttggcttttt

SEQ ID NO: 747486 - DNA, 22 bp, Artificial Sequence
  chemically synthesized
actcttcatattcaacttggct

SEQ ID NO: 747487 - DNA, 22 bp, Artificial Sequence
  chemically synthesized
aaaaaagccaagttgaatatga

SEQ ID NO: 747488 - DNA, 22 bp, Artificial Sequence
  chemically synthesized
gtaatccactcactcttcatat

SEQ ID NO: 747489 - DNA, 22 bp, Artificial Sequence
  chemically synthesized
aatatgaagagtgagtggatta

SEQ ID NO: 747490 - DNA, 22 bp, Artificial Sequence
  chemically synthesized
ataagtaaacctagtaatccac

SEQ ID NO: 747491 - DNA, 22 bp, Artificial Sequence
  chemically synthesized
caactaataagtaaacctagta

SEQ ID NO: 747492 - DNA, 22 bp, Artificial Sequence
  chemically synthesized
ctaggtttacttattagttgca

SEQ ID NO: 747493 - DNA, 22 bp, Artificial Sequence
  chemically synthesized
ggtaaagtgtcccctgcaacta

SEQ ID NO: 747494 - DNA, 22 bp, Artificial Sequence
  chemically synthesized
ggtttacttattagttgcaggg

SEQ ID NO: 747495 - DNA, 22 bp, Artificial Sequence
  chemically synthesized
acttattagttgcaggggacac

SEQ ID NO: 747496 - DNA, 22 bp, Artificial Sequence
  chemically synthesized
cttattagttgcaggggacact

SEQ ID NO: 747497 - DNA, 22 bp, Artificial Sequence
  chemically synthesized
attagttgcaggggacacttta

SEQ ID NO: 747498 - DNA, 22 bp, Artificial Sequence
  chemically synthesized
ttagttgcaggggacactttac

SEQ ID NO: 747499 - DNA, 22 bp, Artificial Sequence
  chemically synthesized
gttgcaggggacactttaccta

SEQ ID NO: 747500 - DNA, 22 bp, Artificial Sequence
  chemically synthesized
caggggacactttacctaacct

SEQ ID NO: 747501 - DNA, 22 bp, Artificial Sequence
  chemically synthesized
aaggatggatgcccaggttagg

SEQ ID NO: 747502 - DNA, 22 bp, Artificial Sequence
  chemically synthesized
tacctaacctgggcatccatcc

SEQ ID NO: 747503 - DNA, 22 bp, Artificial Sequence
  chemically synthesized
acctaacctgggcatccatcct

SEQ ID NO: 747504 - DNA, 22 bp, Artificial Sequence
  chemically synthesized
cctaacctgggcatccatcctt

SEQ ID NO: 747505 - DNA, 22 bp, Artificial Sequence
  chemically synthesized
acctgggcatccatccttcagc

SEQ ID NO: 747506 - DNA, 22 bp, Artificial Sequence
  chemically synthesized
ggcatccatccttcagctgctg

SEQ ID NO: 747507 - DNA, 22 bp, Artificial Sequence
  chemically synthesized
atagtcaaccatcacagcagct

SEQ ID NO: 747508 - DNA, 22 bp, Artificial Sequence
  chemically synthesized
taagacattaatagtcaaccat

SEQ ID NO: 747509 - DNA, 22 bp, Artificial Sequence
  chemically synthesized
cagctgctgtgatggttgacta

SEQ ID NO: 747510 - DNA, 22 bp, Artificial Sequence
  chemically synthesized
agctgctgtgatggttgactat

SEQ ID NO: 747511 - DNA, 22 bp, Artificial Sequence
  chemically synthesized
ctgtgatggttgactattaatg

SEQ ID NO: 747512 - DNA, 22 bp, Artificial Sequence
  chemically synthesized
tgatggttgactattaatgtct

SEQ ID NO: 747513 - DNA, 22 bp, Artificial Sequence
  chemically synthesized
actattaatgtcttatagctac

SEQ ID NO: 747514 - DNA, 22 bp, Artificial Sequence
  chemically synthesized
ttaatgtcttatagctacctgc

SEQ ID NO: 747515 - DNA, 22 bp, Artificial Sequence
  chemically synthesized
atgtcttatagctacctgcctt

SEQ ID NO: 747516 - DNA, 22 bp, Artificial Sequence
  chemically synthesized
atagctacctgccttctccaca

SEQ ID NO: 747517 - DNA, 22 bp, Artificial Sequence
  chemically synthesized
tagctacctgccttctccacat

SEQ ID NO: 747518 - DNA, 22 bp, Artificial Sequence
  chemically synthesized
ccataagcagaggtcacatgtg

SEQ ID NO: 747519 - DNA, 22 bp, Artificial Sequence
  chemically synthesized
cctgccttctccacatgtgacc

SEQ ID NO: 747520 - DNA, 22 bp, Artificial Sequence
  chemically synthesized
ccttctccacatgtgacctctg

SEQ ID NO: 747521 - DNA, 22 bp, Artificial Sequence
  chemically synthesized
gggggctcccataagcagaggt

SEQ ID NO: 747522 - DNA, 22 bp, Artificial Sequence
  chemically synthesized
ctccacatgtgacctctgctta

SEQ ID NO: 747523 - DNA, 22 bp, Artificial Sequence
  chemically synthesized
tccacatgtgacctctgcttat

SEQ ID NO: 747524 - DNA, 22 bp, Artificial Sequence
  chemically synthesized
cacatgtgacctctgcttatgg

SEQ ID NO: 747525 - DNA, 22 bp, Artificial Sequence
  chemically synthesized
ggctagggggctcccataagca

SEQ ID NO: 747526 - DNA, 22 bp, Artificial Sequence
  chemically synthesized
ctgggctagggggctcccataa

SEQ ID NO: 747527 - DNA, 22 bp, Artificial Sequence
  chemically synthesized
cctgggctagggggctcccata

SEQ ID NO: 747528 - DNA, 22 bp, Artificial Sequence
  chemically synthesized
cttcctgggctagggggctccc

SEQ ID NO: 747529 - DNA, 22 bp, Artificial Sequence
  chemically synthesized
tgcttatgggagccccctagcc

SEQ ID NO: 747530 - DNA, 22 bp, Artificial Sequence
  chemically synthesized
cttatgggagccccctagccca

SEQ ID NO: 747531 - DNA, 22 bp, Artificial Sequence
  chemically synthesized
atgggagccccctagcccagga

SEQ ID NO: 747532 - DNA, 22 bp, Artificial Sequence
  chemically synthesized
tgggagccccctagcccaggaa

SEQ ID NO: 747533 - DNA, 22 bp, Artificial Sequence
  chemically synthesized
ggatatgggttacttcctgggc

SEQ ID NO: 747534 - DNA, 22 bp, Artificial Sequence
  chemically synthesized
ctgggatatgggttacttcctg

SEQ ID NO: 747535 - DNA, 22 bp, Artificial Sequence
  chemically synthesized
gcccaggaagtaacccatatcc

SEQ ID NO: 747536 - DNA, 22 bp, Artificial Sequence
  chemically synthesized
tggtccactcctgggatatggg

SEQ ID NO: 747537 - DNA, 22 bp, Artificial Sequence
  chemically synthesized
gctgtggtccactcctgggata

SEQ ID NO: 747538 - DNA, 22 bp, Artificial Sequence
  chemically synthesized
cagcacaccactggctgtggtc

SEQ ID NO: 747539 - DNA, 22 bp, Artificial Sequence
  chemically synthesized
ctgcagcacaccactggctgtg

SEQ ID NO: 747540 - DNA, 22 bp, Artificial Sequence
  chemically synthesized
tgctgcagcacaccactggctg

SEQ ID NO: 747541 - DNA, 22 bp, Artificial Sequence
  chemically synthesized
ggctctgctgcagcacaccact

SEQ ID NO: 747542 - DNA, 22 bp, Artificial Sequence
  chemically synthesized
gggctctgctgcagcacaccac

SEQ ID NO: 747543 - DNA, 22 bp, Artificial Sequence
  chemically synthesized
ttgggctctgctgcagcacacc

SEQ ID NO: 747544 - DNA, 22 bp, Artificial Sequence
  chemically synthesized
gctcttgggctctgctgcagca

SEQ ID NO: 747545 - DNA, 22 bp, Artificial Sequence
  chemically synthesized
cagcagagcccaagagccaatt

SEQ ID NO: 747546 - DNA, 22 bp, Artificial Sequence
  chemically synthesized
ggaggagatgcacacaattggc

SEQ ID NO: 747547 - DNA, 22 bp, Artificial Sequence
  chemically synthesized
agtatggaattgggaggagatg

SEQ ID NO: 747548 - DNA, 22 bp, Artificial Sequence
  chemically synthesized
tgtgcatctcctcccaattcca

SEQ ID NO: 747549 - DNA, 22 bp, Artificial Sequence
  chemically synthesized
ccgacataatgccactgagtat

SEQ ID NO: 747550 - DNA, 22 bp, Artificial Sequence
  chemically synthesized
ctcccaattccatactcagtgg

SEQ ID NO: 747551 - DNA, 22 bp, Artificial Sequence
  chemically synthesized
ccaattccatactcagtggcat

SEQ ID NO: 747552 - DNA, 22 bp, Artificial Sequence
  chemically synthesized
cagctaccgacataatgccact

SEQ ID NO: 747553 - DNA, 22 bp, Artificial Sequence
  chemically synthesized
catactcagtggcattatgtcg

SEQ ID NO: 747554 - DNA, 22 bp, Artificial Sequence
  chemically synthesized
atctccagctaccgacataatg

SEQ ID NO: 747555 - DNA, 22 bp, Artificial Sequence
  chemically synthesized
ccactgatctccagctaccgac

SEQ ID NO: 747556 - DNA, 22 bp, Artificial Sequence
  chemically synthesized
agtggcattatgtcggtagctg

SEQ ID NO: 747557 - DNA, 22 bp, Artificial Sequence
  chemically synthesized
taccactgatctccagctaccg

SEQ ID NO: 747558 - DNA, 22 bp, Artificial Sequence
  chemically synthesized
cctctaccactgatctccagct

SEQ ID NO: 747559 - DNA, 22 bp, Artificial Sequence
  chemically synthesized
tgtcggtagctggagatcagtg

SEQ ID NO: 747560 - DNA, 22 bp, Artificial Sequence
  chemically synthesized
gtggtgtaaatactccctctac

SEQ ID NO: 747561 - DNA, 22 bp, Artificial Sequence
  chemically synthesized
cgtggtgtaaatactccctcta

SEQ ID NO: 747562 - DNA, 22 bp, Artificial Sequence
  chemically synthesized
gagatcagtggtagagggagta

SEQ ID NO: 747563 - DNA, 22 bp, Artificial Sequence
  chemically synthesized
tcgtggtgtaaatactccctct

SEQ ID NO: 747564 - DNA, 22 bp, Artificial Sequence
  chemically synthesized
gtgtgtatcaaaaccagttttc

SEQ ID NO: 747565 - DNA, 22 bp, Artificial Sequence
  chemically synthesized
acaccacgaaaactggttttga

SEQ ID NO: 747566 - DNA, 22 bp, Artificial Sequence
  chemically synthesized
caccacgaaaactggttttgat

SEQ ID NO: 747567 - DNA, 22 bp, Artificial Sequence
  chemically synthesized
aggtgggatgaatcctggtgtg

SEQ ID NO: 747568 - DNA, 22 bp, Artificial Sequence
  chemically synthesized
tgaggtgggatgaatcctggtg

SEQ ID NO: 747569 - DNA, 22 bp, Artificial Sequence
  chemically synthesized
gttttgatacacaccaggattc

SEQ ID NO: 747570 - DNA, 22 bp, Artificial Sequence
  chemically synthesized
gctctgaggtgggatgaatcct

SEQ ID NO: 747571 - DNA, 22 bp, Artificial Sequence
  chemically synthesized
tgatacacaccaggattcatcc

SEQ ID NO: 747572 - DNA, 22 bp, Artificial Sequence
  chemically synthesized
gatacacaccaggattcatccc

SEQ ID NO: 747573 - DNA, 22 bp, Artificial Sequence
  chemically synthesized
atacacaccaggattcatccca

SEQ ID NO: 747574 - DNA, 22 bp, Artificial Sequence
  chemically synthesized
tcgactagctctgaggtgggat

SEQ ID NO: 747575 - DNA, 22 bp, Artificial Sequence
  chemically synthesized
gtcgactagctctgaggtggga

SEQ ID NO: 747576 - DNA, 22 bp, Artificial Sequence
  chemically synthesized
gcaaatatttgtcgactagctc

SEQ ID NO: 747577 - DNA, 22 bp, Artificial Sequence
  chemically synthesized
atcccacctcagagctagtcga

SEQ ID NO: 747578 - DNA, 22 bp, Artificial Sequence
  chemically synthesized
aagtgctggcaaatatttgtcg

SEQ ID NO: 747579 - DNA, 22 bp, Artificial Sequence
  chemically synthesized
agagctagtcgacaaatatttg

SEQ ID NO: 747580 - DNA, 22 bp, Artificial Sequence
  chemically synthesized
tgtcactgaagtgctggcaaat

SEQ ID NO: 747581 - DNA, 22 bp, Artificial Sequence
  chemically synthesized
gtcgacaaatatttgccagcac

SEQ ID NO: 747582 - DNA, 22 bp, Artificial Sequence
  chemically synthesized
tctgtgtcactgaagtgctggc

SEQ ID NO: 747583 - DNA, 22 bp, Artificial Sequence
  chemically synthesized
gccagcacttcagtgacacaga

SEQ ID NO: 747584 - DNA, 22 bp, Artificial Sequence
  chemically synthesized
taccagtcattgtctgtgtcac

SEQ ID NO: 747585 - DNA, 22 bp, Artificial Sequence
  chemically synthesized
ccagcacttcagtgacacagac

SEQ ID NO: 747586 - DNA, 22 bp, Artificial Sequence
  chemically synthesized
ataccagtcattgtctgtgtca

SEQ ID NO: 747587 - DNA, 22 bp, Artificial Sequence
  chemically synthesized
tataccagtcattgtctgtgtc

SEQ ID NO: 747588 - DNA, 22 bp, Artificial Sequence
  chemically synthesized
tgcctttataccagtcattgtc

SEQ ID NO: 747589 - DNA, 22 bp, Artificial Sequence
  chemically synthesized
cagtgacacagacaatgactgg

SEQ ID NO: 747590 - DNA, 22 bp, Artificial Sequence
  chemically synthesized
agtgacacagacaatgactggt

SEQ ID NO: 747591 - DNA, 22 bp, Artificial Sequence
  chemically synthesized
gtataaaggcacaactccggct

SEQ ID NO: 747592 - DNA, 22 bp, Artificial Sequence
  chemically synthesized
caggcgtaagccacaacaccga

SEQ ID NO: 747593 - DNA, 22 bp, Artificial Sequence
  chemically synthesized
ggattacaggcgtaagccacaa

SEQ ID NO: 747594 - DNA, 22 bp, Artificial Sequence
  chemically synthesized
cggctcggtgttgtggcttacg

SEQ ID NO: 747595 - DNA, 22 bp, Artificial Sequence
  chemically synthesized
ggtgttgtggcttacgcctgta

SEQ ID NO: 747596 - DNA, 22 bp, Artificial Sequence
  chemically synthesized
ccaaagtgctgggattacaggc

SEQ ID NO: 747597 - DNA, 22 bp, Artificial Sequence
  chemically synthesized
tggcttacgcctgtaatcccag

SEQ ID NO: 747598 - DNA, 22 bp, Artificial Sequence
  chemically synthesized
agcctcccaaagtgctgggatt

SEQ ID NO: 747599 - DNA, 22 bp, Artificial Sequence
  chemically synthesized
acgcctgtaatcccagcacttt

SEQ ID NO: 747600 - DNA, 22 bp, Artificial Sequence
  chemically synthesized
cgcctgtaatcccagcactttg

SEQ ID NO: 747601 - DNA, 22 bp, Artificial Sequence
  chemically synthesized
cccacctcagcctcccaaagtg

SEQ ID NO: 747602 - DNA, 22 bp, Artificial Sequence
  chemically synthesized
taatcccagcactttgggaggc

SEQ ID NO: 747603 - DNA, 22 bp, Artificial Sequence
  chemically synthesized
aggtgatctgcccacctcagcc

SEQ ID NO: 747604 - DNA, 22 bp, Artificial Sequence
  chemically synthesized
acctcaggtgatctgcccacct

SEQ ID NO: 747605 - DNA, 22 bp, Artificial Sequence
  chemically synthesized
tgggaggctgaggtgggcagat

SEQ ID NO: 747606 - DNA, 22 bp, Artificial Sequence
  chemically synthesized
gggaggctgaggtgggcagatc

SEQ ID NO: 747607 - DNA, 22 bp, Artificial Sequence
  chemically synthesized
ctgacctcaggtgatctgccca

SEQ ID NO: 747608 - DNA, 22 bp, Artificial Sequence
  chemically synthesized
ggaggctgaggtgggcagatca

SEQ ID NO: 747609 - DNA, 22 bp, Artificial Sequence
  chemically synthesized
aactcctgacctcaggtgatct

SEQ ID NO: 747610 - DNA, 22 bp, Artificial Sequence
  chemically synthesized
gaactcctgacctcaggtgatc

SEQ ID NO: 747611 - DNA, 22 bp, Artificial Sequence
  chemically synthesized
aggtgggcagatcacctgaggt

SEQ ID NO: 747612 - DNA, 22 bp, Artificial Sequence
  chemically synthesized
gtcttgaactcctgacctcagg

SEQ ID NO: 747613 - DNA, 22 bp, Artificial Sequence
  chemically synthesized
gtcaggctggtcttgaactcct

SEQ ID NO: 747614 - DNA, 22 bp, Artificial Sequence
  chemically synthesized
aggtcaggagttcaagaccagc

SEQ ID NO: 747615 - DNA, 22 bp, Artificial Sequence
  chemically synthesized
accatgttagtcaggctggtct

SEQ ID NO: 747616 - DNA, 22 bp, Artificial Sequence
  chemically synthesized
caccatgttagtcaggctggtc

SEQ ID NO: 747617 - DNA, 22 bp, Artificial Sequence
  chemically synthesized
aagaccagcctgactaacatgg

SEQ ID NO: 747618 - DNA, 22 bp, Artificial Sequence
  chemically synthesized
gtagagatggggtttcaccatg

SEQ ID NO: 747619 - DNA, 22 bp, Artificial Sequence
  chemically synthesized
agtagagatggggtttcaccat

SEQ ID NO: 747620 - DNA, 22 bp, Artificial Sequence
  chemically synthesized
tagtagagatggggtttcacca

SEQ ID NO: 747621 - DNA, 22 bp, Artificial Sequence
  chemically synthesized
ttagtagagatggggtttcacc

SEQ ID NO: 747622 - DNA, 22 bp, Artificial Sequence
  chemically synthesized
actaacatggtgaaaccccatc

SEQ ID NO: 747623 - DNA, 22 bp, Artificial Sequence
  chemically synthesized
tgtttttagtagagatggggtt

SEQ ID NO: 747624 - DNA, 22 bp, Artificial Sequence
  chemically synthesized
gtgtttttagtagagatggggt

SEQ ID NO: 747625 - DNA, 22 bp, Artificial Sequence
  chemically synthesized
tgtgtttttagtagagatgggg

SEQ ID NO: 747626 - DNA, 22 bp, Artificial Sequence
  chemically synthesized
acatggtgaaaccccatctcta

SEQ ID NO: 747627 - DNA, 22 bp, Artificial Sequence
  chemically synthesized
ttgtgtttttagtagagatggg

SEQ ID NO: 747628 - DNA, 22 bp, Artificial Sequence
  chemically synthesized
atttttgtgtttttagtagaga

SEQ ID NO: 747629 - DNA, 22 bp, Artificial Sequence
  chemically synthesized
gctaatttttgtgtttttagta

SEQ ID NO: 747630 - DNA, 22 bp, Artificial Sequence
  chemically synthesized
tactaaaaacacaaaaattagc

SEQ ID NO: 747631 - DNA, 22 bp, Artificial Sequence
  chemically synthesized
ctaaaaacacaaaaattagcca

SEQ ID NO: 747632 - DNA, 22 bp, Artificial Sequence
  chemically synthesized
aaaacacaaaaattagccaggc

SEQ ID NO: 747633 - DNA, 22 bp, Artificial Sequence
  chemically synthesized
caggcatgcaccgccacgcctg

SEQ ID NO: 747634 - DNA, 22 bp, Artificial Sequence
  chemically synthesized
ggattacaggcatgcaccgcca

SEQ ID NO: 747635 - DNA, 22 bp, Artificial Sequence
  chemically synthesized
gccaggcgtggcggtgcatgcc

SEQ ID NO: 747636 - DNA, 22 bp, Artificial Sequence
  chemically synthesized
agtagctgggattacaggcatg

SEQ ID NO: 747637 - DNA, 22 bp, Artificial Sequence
  chemically synthesized
ctgagtagctgggattacaggc

SEQ ID NO: 747638 - DNA, 22 bp, Artificial Sequence
  chemically synthesized
agcctcctgagtagctgggatt

SEQ ID NO: 747639 - DNA, 22 bp, Artificial Sequence
  chemically synthesized
cctcagcctcctgagtagctgg

SEQ ID NO: 747640 - DNA, 22 bp, Artificial Sequence
  chemically synthesized
ctgcctcagcctcctgagtagc

SEQ ID NO: 747641 - DNA, 22 bp, Artificial Sequence
  chemically synthesized
tcctgcctcagcctcctgagta

SEQ ID NO: 747642 - DNA, 22 bp, Artificial Sequence
  chemically synthesized
taatcccagctactcaggaggc

SEQ ID NO: 747643 - DNA, 22 bp, Artificial Sequence
  chemically synthesized
aagtgattctcctgcctcagcc

SEQ ID NO: 747644 - DNA, 22 bp, Artificial Sequence
  chemically synthesized
ctcaggaggctgaggcaggaga

SEQ ID NO: 747645 - DNA, 22 bp, Artificial Sequence
  chemically synthesized
aggaggctgaggcaggagaatc

SEQ ID NO: 747646 - DNA, 22 bp, Artificial Sequence
  chemically synthesized
ccaggttcaagtgattctcctg

SEQ ID NO: 747647 - DNA, 22 bp, Artificial Sequence
  chemically synthesized
cgcctcccaggttcaagtgatt

SEQ ID NO: 747648 - DNA, 22 bp, Artificial Sequence
  chemically synthesized
aggcaggagaatcacttgaacc

SEQ ID NO: 747649 - DNA, 22 bp, Artificial Sequence
  chemically synthesized
caacctccgcctcccaggttca

SEQ ID NO: 747650 - DNA, 22 bp, Artificial Sequence
  chemically synthesized
actgcaacctccgcctcccagg

SEQ ID NO: 747651 - DNA, 22 bp, Artificial Sequence
  chemically synthesized
agctcactgcaacctccgcctc

SEQ ID NO: 747652 - DNA, 22 bp, Artificial Sequence
  chemically synthesized
gaacctgggaggcggaggttgc

SEQ ID NO: 747653 - DNA, 22 bp, Artificial Sequence
  chemically synthesized
aacctgggaggcggaggttgca

SEQ ID NO: 747654 - DNA, 22 bp, Artificial Sequence
  chemically synthesized
ggaggcggaggttgcagtgagc

SEQ ID NO: 747655 - DNA, 22 bp, Artificial Sequence
  chemically synthesized
gagtgcaatctcagctcactgc

SEQ ID NO: 747656 - DNA, 22 bp, Artificial Sequence
  chemically synthesized
cccaggctggagtgcaatctca

SEQ ID NO: 747657 - DNA, 22 bp, Artificial Sequence
  chemically synthesized
ttgcccaggctggagtgcaatc

SEQ ID NO: 747658 - DNA, 22 bp, Artificial Sequence
  chemically synthesized
cagtgagctgagattgcactcc

SEQ ID NO: 747659 - DNA, 22 bp, Artificial Sequence
  chemically synthesized
gttgcccaggctggagtgcaat

SEQ ID NO: 747660 - DNA, 22 bp, Artificial Sequence
  chemically synthesized
ttgttgcccaggctggagtgca

SEQ ID NO: 747661 - DNA, 22 bp, Artificial Sequence
  chemically synthesized
gctcttgttgcccaggctggag

SEQ ID NO: 747662 - DNA, 22 bp, Artificial Sequence
  chemically synthesized
cgctcttgttgcccaggctgga

SEQ ID NO: 747663 - DNA, 22 bp, Artificial Sequence
  chemically synthesized
agattgcactccagcctgggca

SEQ ID NO: 747664 - DNA, 22 bp, Artificial Sequence
  chemically synthesized
cactccagcctgggcaacaaga

SEQ ID NO: 747665 - DNA, 22 bp, Artificial Sequence
  chemically synthesized
agatggagtttcgctcttgttg

SEQ ID NO: 747666 - DNA, 22 bp, Artificial Sequence
  chemically synthesized
gagatggagtttcgctcttgtt

SEQ ID NO: 747667 - DNA, 22 bp, Artificial Sequence
  chemically synthesized
tgagatggagtttcgctcttgt

SEQ ID NO: 747668 - DNA, 22 bp, Artificial Sequence
  chemically synthesized
cagcctgggcaacaagagcgaa

SEQ ID NO: 747669 - DNA, 22 bp, Artificial Sequence
  chemically synthesized
ttgagatggagtttcgctcttg

SEQ ID NO: 747670 - DNA, 22 bp, Artificial Sequence
  chemically synthesized
tttgagatggagtttcgctctt

SEQ ID NO: 747671 - DNA, 22 bp, Artificial Sequence
  chemically synthesized
ttttgagatggagtttcgctct

SEQ ID NO: 747672 - DNA, 22 bp, Artificial Sequence
  chemically synthesized
tttttttgagatggagtttcgc

SEQ ID NO: 747673 - DNA, 22 bp, Artificial Sequence
  chemically synthesized
atttttttgagatggagtttcg

SEQ ID NO: 747674 - DNA, 22 bp, Artificial Sequence
  chemically synthesized
ggcaacaagagcgaaactccat

SEQ ID NO: 747675 - DNA, 22 bp, Artificial Sequence
  chemically synthesized
tatttttttgagatggagtttc

SEQ ID NO: 747676 - DNA, 22 bp, Artificial Sequence
  chemically synthesized
ttttatttttttgagatggagt

SEQ ID NO: 747677 - DNA, 22 bp, Artificial Sequence
  chemically synthesized
attttatttttttgagatggag

SEQ ID NO: 747678 - DNA, 22 bp, Artificial Sequence
  chemically synthesized
tattttatttttttgagatgga

SEQ ID NO: 747679 - DNA, 22 bp, Artificial Sequence
  chemically synthesized
ttttattttatttttttgagat

SEQ ID NO: 747680 - DNA, 22 bp, Artificial Sequence
  chemically synthesized
attttattttatttttttgaga

SEQ ID NO: 747681 - DNA, 22 bp, Artificial Sequence
  chemically synthesized
tattttattttatttttttgag

SEQ ID NO: 747682 - DNA, 22 bp, Artificial Sequence
  chemically synthesized
tttattttattttatttttttg

SEQ ID NO: 747683 - DNA, 22 bp, Artificial Sequence
  chemically synthesized
tactctttattttattttattt

SEQ ID NO: 747684 - DNA, 22 bp, Artificial Sequence
  chemically synthesized
catctcaaaaaaataaaataaa

SEQ ID NO: 747685 - DNA, 22 bp, Artificial Sequence
  chemically synthesized
aaaaaaataaaataaaataaag

SEQ ID NO: 747686 - DNA, 22 bp, Artificial Sequence
  chemically synthesized
tggagttgtactctttatttta

SEQ ID NO: 747687 - DNA, 22 bp, Artificial Sequence
  chemically synthesized
gctgtggagttgtactctttat

SEQ ID NO: 747688 - DNA, 22 bp, Artificial Sequence
  chemically synthesized
gagcagaaacctcgctgtggag

SEQ ID NO: 747689 - DNA, 22 bp, Artificial Sequence
  chemically synthesized
cacagcgaggtttctgctcgag

SEQ ID NO: 747690 - DNA, 22 bp, Artificial Sequence
  chemically synthesized
atccagagagagagcaagccct

SEQ ID NO: 747691 - DNA, 22 bp, Artificial Sequence
  chemically synthesized
ctgctcgagggcttgctctctc

SEQ ID NO: 747692 - DNA, 22 bp, Artificial Sequence
  chemically synthesized
tgctcgagggcttgctctctct

SEQ ID NO: 747693 - DNA, 22 bp, Artificial Sequence
  chemically synthesized
tgtctgatccagagagagagca

SEQ ID NO: 747694 - DNA, 22 bp, Artificial Sequence
  chemically synthesized
ctcgagggcttgctctctctct

SEQ ID NO: 747695 - DNA, 22 bp, Artificial Sequence
  chemically synthesized
gagggcttgctctctctctgga

SEQ ID NO: 747696 - DNA, 22 bp, Artificial Sequence
  chemically synthesized
acattgtgtctgatccagagag

SEQ ID NO: 747697 - DNA, 22 bp, Artificial Sequence
  chemically synthesized
gctctctctctggatcagacac

SEQ ID NO: 747698 - DNA, 22 bp, Artificial Sequence
  chemically synthesized
ctctctctctggatcagacaca

SEQ ID NO: 747699 - DNA, 22 bp, Artificial Sequence
  chemically synthesized
tctctctggatcagacacaatg

SEQ ID NO: 747700 - DNA, 22 bp, Artificial Sequence
  chemically synthesized
aggtgaaacctcacattgtgtc

SEQ ID NO: 747701 - DNA, 22 bp, Artificial Sequence
  chemically synthesized
tctctggatcagacacaatgtg

SEQ ID NO: 747702 - DNA, 22 bp, Artificial Sequence
  chemically synthesized
caggtgaaacctcacattgtgt

SEQ ID NO: 747703 - DNA, 22 bp, Artificial Sequence
  chemically synthesized
tctggatcagacacaatgtgag

SEQ ID NO: 747704 - DNA, 22 bp, Artificial Sequence
  chemically synthesized
tggatcagacacaatgtgaggt

SEQ ID NO: 747705 - DNA, 22 bp, Artificial Sequence
  chemically synthesized
gatcagacacaatgtgaggttt

SEQ ID NO: 747706 - DNA, 22 bp, Artificial Sequence
  chemically synthesized
cacctgaaatggcatacttgct

SEQ ID NO: 747707 - DNA, 22 bp, Artificial Sequence
  chemically synthesized
acctgaaatggcatacttgctg

SEQ ID NO: 747708 - DNA, 22 bp, Artificial Sequence
  chemically synthesized
aaatggcatacttgctgggctc

SEQ ID NO: 747709 - DNA, 22 bp, Artificial Sequence
  chemically synthesized
gggaaacaatacaggagaagaa

SEQ ID NO: 747710 - DNA, 22 bp, Artificial Sequence
  chemically synthesized
gctgggctctttcttctcctgt

SEQ ID NO: 747711 - DNA, 22 bp, Artificial Sequence
  chemically synthesized
ctgggctctttcttctcctgta

SEQ ID NO: 747712 - DNA, 22 bp, Artificial Sequence
  chemically synthesized
ggctctttcttctcctgtattg

SEQ ID NO: 747713 - DNA, 22 bp, Artificial Sequence
  chemically synthesized
gagttagggaaacaatacagga

SEQ ID NO: 747714 - DNA, 22 bp, Artificial Sequence
  chemically synthesized
tttcttctcctgtattgtttcc

SEQ ID NO: 747715 - DNA, 22 bp, Artificial Sequence
  chemically synthesized
tattggagttagggaaacaata

SEQ ID NO: 747716 - DNA, 22 bp, Artificial Sequence
  chemically synthesized
tcttctcctgtattgtttccct

SEQ ID NO: 747717 - DNA, 22 bp, Artificial Sequence
  chemically synthesized
cttctcctgtattgtttcccta

SEQ ID NO: 747718 - DNA, 22 bp, Artificial Sequence
  chemically synthesized
ttctcctgtattgtttccctaa

SEQ ID NO: 747719 - DNA, 22 bp, Artificial Sequence
  chemically synthesized
ctcctgtattgtttccctaact

SEQ ID NO: 747720 - DNA, 22 bp, Artificial Sequence
  chemically synthesized
tcctgtattgtttccctaactc

SEQ ID NO: 747721 - DNA, 22 bp, Artificial Sequence
  chemically synthesized
ctgtattgtttccctaactcca

SEQ ID NO: 747722 - DNA, 22 bp, Artificial Sequence
  chemically synthesized
tattgtttccctaactccaata

SEQ ID NO: 747723 - DNA, 22 bp, Artificial Sequence
  chemically synthesized
aggagaagcctgtattggagtt

SEQ ID NO: 747724 - DNA, 22 bp, Artificial Sequence
  chemically synthesized
tcaggagaagcctgtattggag

SEQ ID NO: 747725 - DNA, 22 bp, Artificial Sequence
  chemically synthesized
tttccctaactccaatacaggc

SEQ ID NO: 747726 - DNA, 22 bp, Artificial Sequence
  chemically synthesized
ctctcaggagaagcctgtattg

SEQ ID NO: 747727 - DNA, 22 bp, Artificial Sequence
  chemically synthesized
ccctaactccaatacaggcttc

SEQ ID NO: 747728 - DNA, 22 bp, Artificial Sequence
  chemically synthesized
cctaactccaatacaggcttct

SEQ ID NO: 747729 - DNA, 22 bp, Artificial Sequence
  chemically synthesized
actccaatacaggcttctcctg

SEQ ID NO: 747730 - DNA, 22 bp, Artificial Sequence
  chemically synthesized
tagagggtctgctctcaggaga

SEQ ID NO: 747731 - DNA, 22 bp, Artificial Sequence
  chemically synthesized
caatacaggcttctcctgagag

SEQ ID NO: 747732 - DNA, 22 bp, Artificial Sequence
  chemically synthesized
atagagggtctgctctcaggag

SEQ ID NO: 747733 - DNA, 22 bp, Artificial Sequence
  chemically synthesized
tgatttatagagggtctgctct

SEQ ID NO: 747734 - DNA, 22 bp, Artificial Sequence
  chemically synthesized
ctcctgagagcagaccctctat

SEQ ID NO: 747735 - DNA, 22 bp, Artificial Sequence
  chemically synthesized
tcctgagagcagaccctctata

SEQ ID NO: 747736 - DNA, 22 bp, Artificial Sequence
  chemically synthesized
ggtgcctgtgatttatagaggg

SEQ ID NO: 747737 - DNA, 22 bp, Artificial Sequence
  chemically synthesized
ctgagagcagaccctctataaa

SEQ ID NO: 747738 - DNA, 22 bp, Artificial Sequence
  chemically synthesized
agagcagaccctctataaatca

SEQ ID NO: 747739 - DNA, 22 bp, Artificial Sequence
  chemically synthesized
agaacaggggtctaggtgcctg

SEQ ID NO: 747740 - DNA, 22 bp, Artificial Sequence
  chemically synthesized
tataaatcacaggcacctagac

SEQ ID NO: 747741 - DNA, 22 bp, Artificial Sequence
  chemically synthesized
taaatcacaggcacctagaccc

SEQ ID NO: 747742 - DNA, 22 bp, Artificial Sequence
  chemically synthesized
catgaacgcagaccctgagaac

SEQ ID NO: 747743 - DNA, 22 bp, Artificial Sequence
  chemically synthesized
gacccctgttctcagggtctgc

SEQ ID NO: 747744 - DNA, 22 bp, Artificial Sequence
  chemically synthesized
agtcaggttccatgaacgcaga

SEQ ID NO: 747745 - DNA, 22 bp, Artificial Sequence
  chemically synthesized
aagtcaggttccatgaacgcag

SEQ ID NO: 747746 - DNA, 22 bp, Artificial Sequence
  chemically synthesized
taagtcaggttccatgaacgca

SEQ ID NO: 747747 - DNA, 22 bp, Artificial Sequence
  chemically synthesized
ttctcagggtctgcgttcatgg

SEQ ID NO: 747748 - DNA, 22 bp, Artificial Sequence
  chemically synthesized
tcagggtctgcgttcatggaac

SEQ ID NO: 747749 - DNA, 22 bp, Artificial Sequence
  chemically synthesized
agggtctgcgttcatggaacct

SEQ ID NO: 747750 - DNA, 22 bp, Artificial Sequence
  chemically synthesized
aatggcattttaagtcaggttc

SEQ ID NO: 747751 - DNA, 22 bp, Artificial Sequence
  chemically synthesized
cgttcatggaacctgacttaaa

SEQ ID NO: 747752 - DNA, 22 bp, Artificial Sequence
  chemically synthesized
atgagttaaatggcattttaag

SEQ ID NO: 747753 - DNA, 22 bp, Artificial Sequence
  chemically synthesized
atggaacctgacttaaaatgcc

SEQ ID NO: 747754 - DNA, 22 bp, Artificial Sequence
  chemically synthesized
actaatgagttaaatggcattt

SEQ ID NO: 747755 - DNA, 22 bp, Artificial Sequence
  chemically synthesized
aactaatgagttaaatggcatt

SEQ ID NO: 747756 - DNA, 22 bp, Artificial Sequence
  chemically synthesized
acttaaaatgccatttaactca

SEQ ID NO: 747757 - DNA, 22 bp, Artificial Sequence
  chemically synthesized
aaaatgccatttaactcattag

SEQ ID NO: 747758 - DNA, 22 bp, Artificial Sequence
  chemically synthesized
aaatgccatttaactcattagt

SEQ ID NO: 747759 - DNA, 22 bp, Artificial Sequence
  chemically synthesized
tgcatagtcacttaactaatga

SEQ ID NO: 747760 - DNA, 22 bp, Artificial Sequence
  chemically synthesized
gtgcatagtcacttaactaatg

SEQ ID NO: 747761 - DNA, 22 bp, Artificial Sequence
  chemically synthesized
tgtgcatagtcacttaactaat

SEQ ID NO: 747762 - DNA, 22 bp, Artificial Sequence
  chemically synthesized
ttgtgcatagtcacttaactaa

SEQ ID NO: 747763 - DNA, 22 bp, Artificial Sequence
  chemically synthesized
aactcattagttaagtgactat

SEQ ID NO: 747764 - DNA, 22 bp, Artificial Sequence
  chemically synthesized
aagcttttgtgcatagtcactt

SEQ ID NO: 747765 - DNA, 22 bp, Artificial Sequence
  chemically synthesized
actcattagttaagtgactatg

SEQ ID NO: 747766 - DNA, 22 bp, Artificial Sequence
  chemically synthesized
caagcttttgtgcatagtcact

SEQ ID NO: 747767 - DNA, 22 bp, Artificial Sequence
  chemically synthesized
tttcaagcttttgtgcatagtc

SEQ ID NO: 747768 - DNA, 22 bp, Artificial Sequence
  chemically synthesized
attagttaagtgactatgcaca

SEQ ID NO: 747769 - DNA, 22 bp, Artificial Sequence
  chemically synthesized
gttaagtgactatgcacaaaag

SEQ ID NO: 747770 - DNA, 22 bp, Artificial Sequence
  chemically synthesized
agtgactatgcacaaaagcttg

SEQ ID NO: 747771 - DNA, 22 bp, Artificial Sequence
  chemically synthesized
aacatgtattatttcaagcttt

SEQ ID NO: 747772 - DNA, 22 bp, Artificial Sequence
  chemically synthesized
gaacatgtattatttcaagctt

SEQ ID NO: 747773 - DNA, 22 bp, Artificial Sequence
  chemically synthesized
tgaacatgtattatttcaagct

SEQ ID NO: 747774 - DNA, 22 bp, Artificial Sequence
  chemically synthesized
tgcacaaaagcttgaaataata

SEQ ID NO: 747775 - DNA, 22 bp, Artificial Sequence
  chemically synthesized
attttgaacatgtattatttca

SEQ ID NO: 747776 - DNA, 22 bp, Artificial Sequence
  chemically synthesized
aattttgaacatgtattatttc

SEQ ID NO: 747777 - DNA, 22 bp, Artificial Sequence
  chemically synthesized
ttaattttgaacatgtattatt

SEQ ID NO: 747778 - DNA, 22 bp, Artificial Sequence
  chemically synthesized
gcagctcttaattttgaacatg

SEQ ID NO: 747779 - DNA, 22 bp, Artificial Sequence
  chemically synthesized
gaaataatacatgttcaaaatt

SEQ ID NO: 747780 - DNA, 22 bp, Artificial Sequence
  chemically synthesized
aaataatacatgttcaaaatta

SEQ ID NO: 747781 - DNA, 22 bp, Artificial Sequence
  chemically synthesized
catgactagcagctcttaattt

SEQ ID NO: 747782 - DNA, 22 bp, Artificial Sequence
  chemically synthesized
aaaattaagagctgctagtcat

SEQ ID NO: 747783 - DNA, 22 bp, Artificial Sequence
  chemically synthesized
tgatccaaagttccatgactag

SEQ ID NO: 747784 - DNA, 22 bp, Artificial Sequence
  chemically synthesized
ttgtgatccaaagttccatgac

SEQ ID NO: 747785 - DNA, 22 bp, Artificial Sequence
  chemically synthesized
agagctgctagtcatggaactt

SEQ ID NO: 747786 - DNA, 22 bp, Artificial Sequence
  chemically synthesized
attattgtgatccaaagttcca

SEQ ID NO: 747787 - DNA, 22 bp, Artificial Sequence
  chemically synthesized
ctagtcatggaactttggatca

SEQ ID NO: 747788 - DNA, 22 bp, Artificial Sequence
  chemically synthesized
atctgattattgtgatccaaag

SEQ ID NO: 747789 - DNA, 22 bp, Artificial Sequence
  chemically synthesized
gtcatggaactttggatcacaa

SEQ ID NO: 747790 - DNA, 22 bp, Artificial Sequence
  chemically synthesized
caggttcatctgattattgtga

SEQ ID NO: 747791 - DNA, 22 bp, Artificial Sequence
  chemically synthesized
gcaggttcatctgattattgtg

SEQ ID NO: 747792 - DNA, 22 bp, Artificial Sequence
  chemically synthesized
tgcaggttcatctgattattgt

SEQ ID NO: 747793 - DNA, 22 bp, Artificial Sequence
  chemically synthesized
ttgcaggttcatctgattattg

SEQ ID NO: 747794 - DNA, 22 bp, Artificial Sequence
  chemically synthesized
tcttttgcaggttcatctgatt

SEQ ID NO: 747795 - DNA, 22 bp, Artificial Sequence
  chemically synthesized
tggatcacaataatcagatgaa

SEQ ID NO: 747796 - DNA, 22 bp, Artificial Sequence
  chemically synthesized
atcttttgcaggttcatctgat

SEQ ID NO: 747797 - DNA, 22 bp, Artificial Sequence
  chemically synthesized
ggatcacaataatcagatgaac

SEQ ID NO: 747798 - DNA, 22 bp, Artificial Sequence
  chemically synthesized
gatcacaataatcagatgaacc

SEQ ID NO: 747799 - DNA, 22 bp, Artificial Sequence
  chemically synthesized
aaatttatcttttgcaggttca

SEQ ID NO: 747800 - DNA, 22 bp, Artificial Sequence
  chemically synthesized
caaatttatcttttgcaggttc

SEQ ID NO: 747801 - DNA, 22 bp, Artificial Sequence
  chemically synthesized
tttcaaatttatcttttgcagg

SEQ ID NO: 747802 - DNA, 22 bp, Artificial Sequence
  chemically synthesized
ctatttcaaatttatcttttgc

SEQ ID NO: 747803 - DNA, 22 bp, Artificial Sequence
  chemically synthesized
gctatttcaaatttatcttttg

SEQ ID NO: 747804 - DNA, 22 bp, Artificial Sequence
  chemically synthesized
caaaagataaatttgaaatagc

SEQ ID NO: 747805 - DNA, 22 bp, Artificial Sequence
  chemically synthesized
gaaatagcaagggtctgctctt

SEQ ID NO: 747806 - DNA, 22 bp, Artificial Sequence
  chemically synthesized
aaatagcaagggtctgctcttt

SEQ ID NO: 747807 - DNA, 22 bp, Artificial Sequence
  chemically synthesized
tgtacacagacaaaaagagcag

SEQ ID NO: 747808 - DNA, 22 bp, Artificial Sequence
  chemically synthesized
atgtacacagacaaaaagagca

SEQ ID NO: 747809 - DNA, 22 bp, Artificial Sequence
  chemically synthesized
tatgtacacagacaaaaagagc

SEQ ID NO: 747810 - DNA, 22 bp, Artificial Sequence
  chemically synthesized
ttatgtacacagacaaaaagag

SEQ ID NO: 747811 - DNA, 22 bp, Artificial Sequence
  chemically synthesized
tcttttatgtacacagacaaaa

SEQ ID NO: 747812 - DNA, 22 bp, Artificial Sequence
  chemically synthesized
tgtcttttatgtacacagacaa

SEQ ID NO: 747813 - DNA, 22 bp, Artificial Sequence
  chemically synthesized
ctgtcttttatgtacacagaca

SEQ ID NO: 747814 - DNA, 22 bp, Artificial Sequence
  chemically synthesized
ctctttttgtctgtgtacataa

SEQ ID NO: 747815 - DNA, 22 bp, Artificial Sequence
  chemically synthesized
tttttgtctgtgtacataaaag

SEQ ID NO: 747816 - DNA, 22 bp, Artificial Sequence
  chemically synthesized
catcaacttctgtcttttatgt

SEQ ID NO: 747817 - DNA, 22 bp, Artificial Sequence
  chemically synthesized
tttgtctgtgtacataaaagac

SEQ ID NO: 747818 - DNA, 22 bp, Artificial Sequence
  chemically synthesized
ccatcaacttctgtcttttatg

SEQ ID NO: 747819 - DNA, 22 bp, Artificial Sequence
  chemically synthesized
ttgtctgtgtacataaaagaca

SEQ ID NO: 747820 - DNA, 22 bp, Artificial Sequence
  chemically synthesized
tccatcaacttctgtcttttat

SEQ ID NO: 747821 - DNA, 22 bp, Artificial Sequence
  chemically synthesized
tgtctgtgtacataaaagacag

SEQ ID NO: 747822 - DNA, 22 bp, Artificial Sequence
  chemically synthesized
ttccatcaacttctgtctttta

SEQ ID NO: 747823 - DNA, 22 bp, Artificial Sequence
  chemically synthesized
gtctgtgtacataaaagacaga

SEQ ID NO: 747824 - DNA, 22 bp, Artificial Sequence
  chemically synthesized
tttccatcaacttctgtctttt

SEQ ID NO: 747825 - DNA, 22 bp, Artificial Sequence
  chemically synthesized
tctgtgtacataaaagacagaa

SEQ ID NO: 747826 - DNA, 22 bp, Artificial Sequence
  chemically synthesized
tctttttccatcaacttctgtc

SEQ ID NO: 747827 - DNA, 22 bp, Artificial Sequence
  chemically synthesized
tgtacataaaagacagaagttg

SEQ ID NO: 747828 - DNA, 22 bp, Artificial Sequence
  chemically synthesized
atctttttccatcaacttctgt

SEQ ID NO: 747829 - DNA, 22 bp, Artificial Sequence
  chemically synthesized
tatctttttccatcaacttctg

SEQ ID NO: 747830 - DNA, 22 bp, Artificial Sequence
  chemically synthesized
caggctttatctttttccatca

SEQ ID NO: 747831 - DNA, 22 bp, Artificial Sequence
  chemically synthesized
gcaggctttatctttttccatc

SEQ ID NO: 747832 - DNA, 22 bp, Artificial Sequence
  chemically synthesized
tgcaggctttatctttttccat

SEQ ID NO: 747833 - DNA, 22 bp, Artificial Sequence
  chemically synthesized
ttgcaggctttatctttttcca

SEQ ID NO: 747834 - DNA, 22 bp, Artificial Sequence
  chemically synthesized
cccagtttttgcaggctttatc

SEQ ID NO: 747835 - DNA, 22 bp, Artificial Sequence
  chemically synthesized
atggaaaaagataaagcctgca

SEQ ID NO: 747836 - DNA, 22 bp, Artificial Sequence
  chemically synthesized
agaatcacagtataaaggattg

SEQ ID NO: 747837 - DNA, 22 bp, Artificial Sequence
  chemically synthesized
caaaaactgggcaatcctttat

SEQ ID NO: 747838 - DNA, 22 bp, Artificial Sequence
  chemically synthesized
ggcaatcctttatactgtgatt

SEQ ID NO: 747839 - DNA, 22 bp, Artificial Sequence
  chemically synthesized
tatactgtgattctcaacttac

SEQ ID NO: 747840 - DNA, 22 bp, Artificial Sequence
  chemically synthesized
atactgtgattctcaacttacg

SEQ ID NO: 747841 - DNA, 22 bp, Artificial Sequence
  chemically synthesized
tggacatgaaagcgtaagttga

SEQ ID NO: 747842 - DNA, 22 bp, Artificial Sequence
  chemically synthesized
tactgtgattctcaacttacgc

SEQ ID NO: 747843 - DNA, 22 bp, Artificial Sequence
  chemically synthesized
acctatggacatgaaagcgtaa

SEQ ID NO: 747844 - DNA, 22 bp, Artificial Sequence
  chemically synthesized
tgattctcaacttacgctttca

SEQ ID NO: 747845 - DNA, 22 bp, Artificial Sequence
  chemically synthesized
tcaacttacgctttcatgtcca

SEQ ID NO: 747846 - DNA, 22 bp, Artificial Sequence
  chemically synthesized
aacttacgctttcatgtccata

SEQ ID NO: 747847 - DNA, 22 bp, Artificial Sequence
  chemically synthesized
agcacattcacctatggacatg

SEQ ID NO: 747848 - DNA, 22 bp, Artificial Sequence
  chemically synthesized
cagcacattcacctatggacat

SEQ ID NO: 747849 - DNA, 22 bp, Artificial Sequence
  chemically synthesized
tcagcacattcacctatggaca

SEQ ID NO: 747850 - DNA, 22 bp, Artificial Sequence
  chemically synthesized
acgctttcatgtccataggtga

SEQ ID NO: 747851 - DNA, 22 bp, Artificial Sequence
  chemically synthesized
cgctttcatgtccataggtgaa

SEQ ID NO: 747852 - DNA, 22 bp, Artificial Sequence
  chemically synthesized
tcatgtccataggtgaatgtgc

SEQ ID NO: 747853 - DNA, 22 bp, Artificial Sequence
  chemically synthesized
catgtccataggtgaatgtgct

SEQ ID NO: 747854 - DNA, 22 bp, Artificial Sequence
  chemically synthesized
atgtccataggtgaatgtgctg

SEQ ID NO: 747855 - DNA, 22 bp, Artificial Sequence
  chemically synthesized
aagtaaggaatctttcagcaca

SEQ ID NO: 747856 - DNA, 22 bp, Artificial Sequence
  chemically synthesized
tgaagtaaggaatctttcagca

SEQ ID NO: 747857 - DNA, 22 bp, Artificial Sequence
  chemically synthesized
aaattctgaagtaaggaatctt

SEQ ID NO: 747858 - DNA, 22 bp, Artificial Sequence
  chemically synthesized
caaattctgaagtaaggaatct

SEQ ID NO: 747859 - DNA, 22 bp, Artificial Sequence
  chemically synthesized
ttcaaattctgaagtaaggaat

SEQ ID NO: 747860 - DNA, 22 bp, Artificial Sequence
  chemically synthesized
cttcaaattctgaagtaaggaa

SEQ ID NO: 747861 - DNA, 22 bp, Artificial Sequence
  chemically synthesized
tcttcaaattctgaagtaagga

SEQ ID NO: 747862 - DNA, 22 bp, Artificial Sequence
  chemically synthesized
ttcttcaaattctgaagtaagg

SEQ ID NO: 747863 - DNA, 22 bp, Artificial Sequence
  chemically synthesized
tttcttcaaattctgaagtaag

SEQ ID NO: 747864 - DNA, 22 bp, Artificial Sequence
  chemically synthesized
aaagattccttacttcagaatt

SEQ ID NO: 747865 - DNA, 22 bp, Artificial Sequence
  chemically synthesized
cttacttcagaatttgaagaaa

SEQ ID NO: 747866 - DNA, 22 bp, Artificial Sequence
  chemically synthesized
atatgaagatgctttttcttca

SEQ ID NO: 747867 - DNA, 22 bp, Artificial Sequence
  chemically synthesized
acttcagaatttgaagaaaaag

SEQ ID NO: 747868 - DNA, 22 bp, Artificial Sequence
  chemically synthesized
aatatgaagatgctttttcttc

SEQ ID NO: 747869 - DNA, 22 bp, Artificial Sequence
  chemically synthesized
cttcagaatttgaagaaaaagc

SEQ ID NO: 747870 - DNA, 22 bp, Artificial Sequence
  chemically synthesized
taatatgaagatgctttttctt

SEQ ID NO: 747871 - DNA, 22 bp, Artificial Sequence
  chemically synthesized
cagaatttgaagaaaaagcatc

SEQ ID NO: 747872 - DNA, 22 bp, Artificial Sequence
  chemically synthesized
agaatttgaagaaaaagcatct

SEQ ID NO: 747873 - DNA, 22 bp, Artificial Sequence
  chemically synthesized
atcatgttttaatatgaagatg

SEQ ID NO: 747874 - DNA, 22 bp, Artificial Sequence
  chemically synthesized
gaagaaaaagcatcttcatatt

SEQ ID NO: 747875 - DNA, 22 bp, Artificial Sequence
  chemically synthesized
aagaaaaagcatcttcatatta

SEQ ID NO: 747876 - DNA, 22 bp, Artificial Sequence
  chemically synthesized
cataatggattcatcatgtttt

SEQ ID NO: 747877 - DNA, 22 bp, Artificial Sequence
  chemically synthesized
ccataatggattcatcatgttt

SEQ ID NO: 747878 - DNA, 22 bp, Artificial Sequence
  chemically synthesized
tccataatggattcatcatgtt

SEQ ID NO: 747879 - DNA, 22 bp, Artificial Sequence
  chemically synthesized
catattaaaacatgatgaatcc

SEQ ID NO: 747880 - DNA, 22 bp, Artificial Sequence
  chemically synthesized
atattaaaacatgatgaatcca

SEQ ID NO: 747881 - DNA, 22 bp, Artificial Sequence
  chemically synthesized
tggtattttccataatggattc

SEQ ID NO: 747882 - DNA, 22 bp, Artificial Sequence
  chemically synthesized
atggtattttccataatggatt

SEQ ID NO: 747883 - DNA, 22 bp, Artificial Sequence
  chemically synthesized
tatggtattttccataatggat

SEQ ID NO: 747884 - DNA, 22 bp, Artificial Sequence
  chemically synthesized
aaacatgatgaatccattatgg

SEQ ID NO: 747885 - DNA, 22 bp, Artificial Sequence
  chemically synthesized
acatcaattttatggtattttc

SEQ ID NO: 747886 - DNA, 22 bp, Artificial Sequence
  chemically synthesized
aatctcacatcaattttatggt

SEQ ID NO: 747887 - DNA, 22 bp, Artificial Sequence
  chemically synthesized
aaatctcacatcaattttatgg

SEQ ID NO: 747888 - DNA, 22 bp, Artificial Sequence
  chemically synthesized
taaatctcacatcaattttatg

SEQ ID NO: 747889 - DNA, 22 bp, Artificial Sequence
  chemically synthesized
ttaaatctcacatcaattttat

SEQ ID NO: 747890 - DNA, 22 bp, Artificial Sequence
  chemically synthesized
tggaaaataccataaaattgat

SEQ ID NO: 747891 - DNA, 22 bp, Artificial Sequence
  chemically synthesized
tttaaatctcacatcaatttta

SEQ ID NO: 747892 - DNA, 22 bp, Artificial Sequence
  chemically synthesized
ttttttaaatctcacatcaatt

SEQ ID NO: 747893 - DNA, 22 bp, Artificial Sequence
  chemically synthesized
attttttaaatctcacatcaat

SEQ ID NO: 747894 - DNA, 22 bp, Artificial Sequence
  chemically synthesized
tattttttaaatctcacatcaa

SEQ ID NO: 747895 - DNA, 22 bp, Artificial Sequence
  chemically synthesized
ttttattttttaaatctcacat

SEQ ID NO: 747896 - DNA, 22 bp, Artificial Sequence
  chemically synthesized
gttttattttttaaatctcaca

SEQ ID NO: 747897 - DNA, 22 bp, Artificial Sequence
  chemically synthesized
ttgttttattttttaaatctca

SEQ ID NO: 747898 - DNA, 22 bp, Artificial Sequence
  chemically synthesized
atgttcttgttttattttttaa

SEQ ID NO: 747899 - DNA, 22 bp, Artificial Sequence
  chemically synthesized
gatgttcttgttttatttttta

SEQ ID NO: 747900 - DNA, 22 bp, Artificial Sequence
  chemically synthesized
tgatgttcttgttttatttttt

SEQ ID NO: 747901 - DNA, 22 bp, Artificial Sequence
  chemically synthesized
atgtgagatttaaaaaataaaa

SEQ ID NO: 747902 - DNA, 22 bp, Artificial Sequence
  chemically synthesized
tttgatgttcttgttttatttt

SEQ ID NO: 747903 - DNA, 22 bp, Artificial Sequence
  chemically synthesized
ctttgatgttcttgttttattt

SEQ ID NO: 747904 - DNA, 22 bp, Artificial Sequence
  chemically synthesized
aaaaaataaaacaagaacatca

SEQ ID NO: 747905 - DNA, 22 bp, Artificial Sequence
  chemically synthesized
aaaaataaaacaagaacatcaa

SEQ ID NO: 747906 - DNA, 22 bp, Artificial Sequence
  chemically synthesized
catgagcatgaaatttctttga

SEQ ID NO: 747907 - DNA, 22 bp, Artificial Sequence
  chemically synthesized
ccatgagcatgaaatttctttg

SEQ ID NO: 747908 - DNA, 22 bp, Artificial Sequence
  chemically synthesized
tccatgagcatgaaatttcttt

SEQ ID NO: 747909 - DNA, 22 bp, Artificial Sequence
  chemically synthesized
ttccatgagcatgaaatttctt

SEQ ID NO: 747910 - DNA, 22 bp, Artificial Sequence
  chemically synthesized
tttccatgagcatgaaatttct

SEQ ID NO: 747911 - DNA, 22 bp, Artificial Sequence
  chemically synthesized
ctttttccatgagcatgaaatt

SEQ ID NO: 747912 - DNA, 22 bp, Artificial Sequence
  chemically synthesized
tctcctttttccatgagcatga

SEQ ID NO: 747913 - DNA, 22 bp, Artificial Sequence
  chemically synthesized
cctatctcctttttccatgagc

SEQ ID NO: 747914 - DNA, 22 bp, Artificial Sequence
  chemically synthesized
acctatctcctttttccatgag

SEQ ID NO: 747915 - DNA, 22 bp, Artificial Sequence
  chemically synthesized
cacttacctatctcctttttcc

SEQ ID NO: 747916 - DNA, 22 bp, Artificial Sequence
  chemically synthesized
ccacttacctatctcctttttc

SEQ ID NO: 747917 - DNA, 22 bp, Artificial Sequence
  chemically synthesized
catgctcatggaaaaaggagat

SEQ ID NO: 747918 - DNA, 22 bp, Artificial Sequence
  chemically synthesized
atgctcatggaaaaaggagata

SEQ ID NO: 747919 - DNA, 22 bp, Artificial Sequence
  chemically synthesized
ccgcttccacttacctatctcc

SEQ ID NO: 747920 - DNA, 22 bp, Artificial Sequence
  chemically synthesized
atggaaaaaggagataggtaag

SEQ ID NO: 747921 - DNA, 22 bp, Artificial Sequence
  chemically synthesized
acatctcccgcttccacttacc

SEQ ID NO: 747922 - DNA, 22 bp, Artificial Sequence
  chemically synthesized
acagcatagaagacatagcctg

SEQ ID NO: 747923 - DNA, 22 bp, Artificial Sequence
  chemically synthesized
aacagcatagaagacatagcct

SEQ ID NO: 747924 - DNA, 22 bp, Artificial Sequence
  chemically synthesized
tcttaacagcatagaagacata

SEQ ID NO: 747925 - DNA, 22 bp, Artificial Sequence
  chemically synthesized
agttatcttaacagcatagaag

SEQ ID NO: 747926 - DNA, 22 bp, Artificial Sequence
  chemically synthesized
cagttatcttaacagcatagaa

SEQ ID NO: 747927 - DNA, 22 bp, Artificial Sequence
  chemically synthesized
cttcagttatcttaacagcata

SEQ ID NO: 747928 - DNA, 22 bp, Artificial Sequence
  chemically synthesized
acttcagttatcttaacagcat

SEQ ID NO: 747929 - DNA, 22 bp, Artificial Sequence
  chemically synthesized
tttacttcagttatcttaacag

SEQ ID NO: 747930 - DNA, 22 bp, Artificial Sequence
  chemically synthesized
tgtcttctatgctgttaagata

SEQ ID NO: 747931 - DNA, 22 bp, Artificial Sequence
  chemically synthesized
atttacttcagttatcttaaca

SEQ ID NO: 747932 - DNA, 22 bp, Artificial Sequence
  chemically synthesized
aacttatttacttcagttatct

SEQ ID NO: 747933 - DNA, 22 bp, Artificial Sequence
  chemically synthesized
ctatgctgttaagataactgaa

SEQ ID NO: 747934 - DNA, 22 bp, Artificial Sequence
  chemically synthesized
aaacttatttacttcagttatc

SEQ ID NO: 747935 - DNA, 22 bp, Artificial Sequence
  chemically synthesized
tatgctgttaagataactgaag

SEQ ID NO: 747936 - DNA, 22 bp, Artificial Sequence
  chemically synthesized
ttaaacttatttacttcagtta

SEQ ID NO: 747937 - DNA, 22 bp, Artificial Sequence
  chemically synthesized
tgctgttaagataactgaagta

SEQ ID NO: 747938 - DNA, 22 bp, Artificial Sequence
  chemically synthesized
ttaagataactgaagtaaataa

SEQ ID NO: 747939 - DNA, 22 bp, Artificial Sequence
  chemically synthesized
agataactgaagtaaataagtt

SEQ ID NO: 747940 - DNA, 22 bp, Artificial Sequence
  chemically synthesized
cgagagcagtgattcttaaact

SEQ ID NO: 747941 - DNA, 22 bp, Artificial Sequence
  chemically synthesized
ccgagagcagtgattcttaaac

SEQ ID NO: 747942 - DNA, 22 bp, Artificial Sequence
  chemically synthesized
aagtaaataagtttaagaatca

SEQ ID NO: 747943 - DNA, 22 bp, Artificial Sequence
  chemically synthesized
aaagcatcttccgagagcagtg

SEQ ID NO: 747944 - DNA, 22 bp, Artificial Sequence
  chemically synthesized
aaaagcatcttccgagagcagt

SEQ ID NO: 747945 - DNA, 22 bp, Artificial Sequence
  chemically synthesized
tttaaaagcatcttccgagagc

SEQ ID NO: 747946 - DNA, 22 bp, Artificial Sequence
  chemically synthesized
aagaatcactgctctcggaaga

SEQ ID NO: 747947 - DNA, 22 bp, Artificial Sequence
  chemically synthesized
tatttaaaagcatcttccgaga

SEQ ID NO: 747948 - DNA, 22 bp, Artificial Sequence
  chemically synthesized
agaatcactgctctcggaagat

SEQ ID NO: 747949 - DNA, 22 bp, Artificial Sequence
  chemically synthesized
ctatttaaaagcatcttccgag

SEQ ID NO: 747950 - DNA, 22 bp, Artificial Sequence
  chemically synthesized
tctatttaaaagcatcttccga

SEQ ID NO: 747951 - DNA, 22 bp, Artificial Sequence
  chemically synthesized
ttctatttaaaagcatcttccg

SEQ ID NO: 747952 - DNA, 22 bp, Artificial Sequence
  chemically synthesized
caggtttttctatttaaaagca

SEQ ID NO: 747953 - DNA, 22 bp, Artificial Sequence
  chemically synthesized
ctctcggaagatgcttttaaat

SEQ ID NO: 747954 - DNA, 22 bp, Artificial Sequence
  chemically synthesized
ctgcaggtttttctatttaaaa

SEQ ID NO: 747955 - DNA, 22 bp, Artificial Sequence
  chemically synthesized
tcggaagatgcttttaaataga

SEQ ID NO: 747956 - DNA, 22 bp, Artificial Sequence
  chemically synthesized
actgcaggtttttctatttaaa

SEQ ID NO: 747957 - DNA, 22 bp, Artificial Sequence
  chemically synthesized
ggaagatgcttttaaatagaaa

SEQ ID NO: 747958 - DNA, 22 bp, Artificial Sequence
  chemically synthesized
cacttactgcaggtttttctat

SEQ ID NO: 747959 - DNA, 22 bp, Artificial Sequence
  chemically synthesized
acacttactgcaggtttttcta

SEQ ID NO: 747960 - DNA, 22 bp, Artificial Sequence
  chemically synthesized
tagtttacacttactgcaggtt

SEQ ID NO: 747961 - DNA, 22 bp, Artificial Sequence
  chemically synthesized
ttaaatagaaaaacctgcagta

SEQ ID NO: 747962 - DNA, 22 bp, Artificial Sequence
  chemically synthesized
taaatagaaaaacctgcagtaa

SEQ ID NO: 747963 - DNA, 22 bp, Artificial Sequence
  chemically synthesized
aaatagaaaaacctgcagtaag

SEQ ID NO: 747964 - DNA, 22 bp, Artificial Sequence
  chemically synthesized
aatagaaaaacctgcagtaagt

SEQ ID NO: 747965 - DNA, 22 bp, Artificial Sequence
  chemically synthesized
gttatagtttacacttactgca

SEQ ID NO: 747966 - DNA, 22 bp, Artificial Sequence
  chemically synthesized
agttatagtttacacttactgc

SEQ ID NO: 747967 - DNA, 22 bp, Artificial Sequence
  chemically synthesized
tagttatagtttacacttactg

SEQ ID NO: 747968 - DNA, 22 bp, Artificial Sequence
  chemically synthesized
ttagttatagtttacacttact

SEQ ID NO: 747969 - DNA, 22 bp, Artificial Sequence
  chemically synthesized
cagtaagtgtaaactataacta

SEQ ID NO: 747970 - DNA, 22 bp, Artificial Sequence
  chemically synthesized
aaataatatttttagttatagt

SEQ ID NO: 747971 - DNA, 22 bp, Artificial Sequence
  chemically synthesized
atgttaaaataatatttttagt

SEQ ID NO: 747972 - DNA, 22 bp, Artificial Sequence
  chemically synthesized
catgttaaaataatatttttag

SEQ ID NO: 747973 - DNA, 22 bp, Artificial Sequence
  chemically synthesized
tcatgttaaaataatattttta

SEQ ID NO: 747974 - DNA, 22 bp, Artificial Sequence
  chemically synthesized
ttcatgttaaaataatattttt

SEQ ID NO: 747975 - DNA, 22 bp, Artificial Sequence
  chemically synthesized
tttcatgttaaaataatatttt

SEQ ID NO: 747976 - DNA, 22 bp, Artificial Sequence
  chemically synthesized
taactaaaaatattattttaac

SEQ ID NO: 747977 - DNA, 22 bp, Artificial Sequence
  chemically synthesized
aaaatattattttaacatgaaa

SEQ ID NO: 747978 - DNA, 22 bp, Artificial Sequence
  chemically synthesized
ataataagattttttcatgtta

SEQ ID NO: 747979 - DNA, 22 bp, Artificial Sequence
  chemically synthesized
cataataagattttttcatgtt

SEQ ID NO: 747980 - DNA, 22 bp, Artificial Sequence
  chemically synthesized
tcataataagattttttcatgt

SEQ ID NO: 747981 - DNA, 22 bp, Artificial Sequence
  chemically synthesized
ttcataataagattttttcatg

SEQ ID NO: 747982 - DNA, 22 bp, Artificial Sequence
  chemically synthesized
tttcataataagattttttcat

SEQ ID NO: 747983 - DNA, 22 bp, Artificial Sequence
  chemically synthesized
ttttaacatgaaaaaatcttat

SEQ ID NO: 747984 - DNA, 22 bp, Artificial Sequence
  chemically synthesized
taacatgaaaaaatcttattat

SEQ ID NO: 747985 - DNA, 22 bp, Artificial Sequence
  chemically synthesized
aacatgaaaaaatcttattatg

SEQ ID NO: 747986 - DNA, 22 bp, Artificial Sequence
  chemically synthesized
acatgaaaaaatcttattatga

SEQ ID NO: 747987 - DNA, 22 bp, Artificial Sequence
  chemically synthesized
agaaagaactttttcataataa

SEQ ID NO: 747988 - DNA, 22 bp, Artificial Sequence
  chemically synthesized
atggggcctaagaaagaacttt

SEQ ID NO: 747989 - DNA, 22 bp, Artificial Sequence
  chemically synthesized
aatggggcctaagaaagaactt

SEQ ID NO: 747990 - DNA, 22 bp, Artificial Sequence
  chemically synthesized
taatggggcctaagaaagaact

SEQ ID NO: 747991 - DNA, 22 bp, Artificial Sequence
  chemically synthesized
attatgaaaaagttctttctta

SEQ ID NO: 747992 - DNA, 22 bp, Artificial Sequence
  chemically synthesized
ttatgaaaaagttctttcttag

SEQ ID NO: 747993 - DNA, 22 bp, Artificial Sequence
  chemically synthesized
attttaatggggcctaagaaag

SEQ ID NO: 747994 - DNA, 22 bp, Artificial Sequence
  chemically synthesized
tgaaaaagttctttcttaggcc

SEQ ID NO: 747995 - DNA, 22 bp, Artificial Sequence
  chemically synthesized
tcattttaatggggcctaagaa

SEQ ID NO: 747996 - DNA, 22 bp, Artificial Sequence
  chemically synthesized
tctcattttaatggggcctaag

SEQ ID NO: 747997 - DNA, 22 bp, Artificial Sequence
  chemically synthesized
atgtctctctcattttaatggg

SEQ ID NO: 747998 - DNA, 22 bp, Artificial Sequence
  chemically synthesized
tttcttaggccccattaaaatg

SEQ ID NO: 747999 - DNA, 22 bp, Artificial Sequence
  chemically synthesized
tcttaggccccattaaaatgag

SEQ ID NO: 748000 - DNA, 22 bp, Artificial Sequence
  chemically synthesized
cttaggccccattaaaatgaga

SEQ ID NO: 748001 - DNA, 22 bp, Artificial Sequence
  chemically synthesized
ttaggccccattaaaatgagag

SEQ ID NO: 748002 - DNA, 22 bp, Artificial Sequence
  chemically synthesized
aggccccattaaaatgagagag

SEQ ID NO: 748003 - DNA, 22 bp, Artificial Sequence
  chemically synthesized
tgatactaatgtctctctcatt

SEQ ID NO: 748004 - DNA, 22 bp, Artificial Sequence
  chemically synthesized
ggccccattaaaatgagagaga

SEQ ID NO: 748005 - DNA, 22 bp, Artificial Sequence
  chemically synthesized
tgtctgtgatactaatgtctct

SEQ ID NO: 748006 - DNA, 22 bp, Artificial Sequence
  chemically synthesized
aaatgagagagacattagtatc

SEQ ID NO: 748007 - DNA, 22 bp, Artificial Sequence
  chemically synthesized
tgggaacagttgtgtctgtgat

SEQ ID NO: 748008 - DNA, 22 bp, Artificial Sequence
  chemically synthesized
ggtattatgggaacagttgtgt

SEQ ID NO: 748009 - DNA, 22 bp, Artificial Sequence
  chemically synthesized
tgggtattatgggaacagttgt

SEQ ID NO: 748010 - DNA, 22 bp, Artificial Sequence
  chemically synthesized
gtatcacagacacaactgttcc

SEQ ID NO: 748011 - DNA, 22 bp, Artificial Sequence
  chemically synthesized
ctgggtattatgggaacagttg

SEQ ID NO: 748012 - DNA, 22 bp, Artificial Sequence
  chemically synthesized
tctgggtattatgggaacagtt

SEQ ID NO: 748013 - DNA, 22 bp, Artificial Sequence
  chemically synthesized
gtaaatcagttttctgggtatt

SEQ ID NO: 748014 - DNA, 22 bp, Artificial Sequence
  chemically synthesized
ggtaaatcagttttctgggtat

SEQ ID NO: 748015 - DNA, 22 bp, Artificial Sequence
  chemically synthesized
ttggtaaatcagttttctgggt

SEQ ID NO: 748016 - DNA, 22 bp, Artificial Sequence
  chemically synthesized
cttggtaaatcagttttctggg

SEQ ID NO: 748017 - DNA, 22 bp, Artificial Sequence
  chemically synthesized
ttcccataatacccagaaaact

SEQ ID NO: 748018 - DNA, 22 bp, Artificial Sequence
  chemically synthesized
tcttggtaaatcagttttctgg

SEQ ID NO: 748019 - DNA, 22 bp, Artificial Sequence
  chemically synthesized
ttcttggtaaatcagttttctg

SEQ ID NO: 748020 - DNA, 22 bp, Artificial Sequence
  chemically synthesized
ccataatacccagaaaactgat

SEQ ID NO: 748021 - DNA, 22 bp, Artificial Sequence
  chemically synthesized
aataatttttcttggtaaatca

SEQ ID NO: 748022 - DNA, 22 bp, Artificial Sequence
  chemically synthesized
agtaatggcattgaataatttt

SEQ ID NO: 748023 - DNA, 22 bp, Artificial Sequence
  chemically synthesized
atttaccaagaaaaattattca

SEQ ID NO: 748024 - DNA, 22 bp, Artificial Sequence
  chemically synthesized
accaagaaaaattattcaatgc

SEQ ID NO: 748025 - DNA, 22 bp, Artificial Sequence
  chemically synthesized
agttaagtaatggcattgaata

SEQ ID NO: 748026 - DNA, 22 bp, Artificial Sequence
  chemically synthesized
ccaagaaaaattattcaatgcc

SEQ ID NO: 748027 - DNA, 22 bp, Artificial Sequence
  chemically synthesized
actaagttaagtaatggcattg

SEQ ID NO: 748028 - DNA, 22 bp, Artificial Sequence
  chemically synthesized
aaattaactaagttaagtaatg

SEQ ID NO: 748029 - DNA, 22 bp, Artificial Sequence
  chemically synthesized
ttcaatgccattacttaactta

SEQ ID NO: 748030 - DNA, 22 bp, Artificial Sequence
  chemically synthesized
aatgccattacttaacttagtt

SEQ ID NO: 748031 - DNA, 22 bp, Artificial Sequence
  chemically synthesized
cacaacctgaaattaactaagt

SEQ ID NO: 748032 - DNA, 22 bp, Artificial Sequence
  chemically synthesized
acacaacctgaaattaactaag

SEQ ID NO: 748033 - DNA, 22 bp, Artificial Sequence
  chemically synthesized
tgccttacacaacctgaaatta

SEQ ID NO: 748034 - DNA, 22 bp, Artificial Sequence
  chemically synthesized
cttaacttagttaatttcaggt

SEQ ID NO: 748035 - DNA, 22 bp, Artificial Sequence
  chemically synthesized
aacttagttaatttcaggttgt

SEQ ID NO: 748036 - DNA, 22 bp, Artificial Sequence
  chemically synthesized
acttagttaatttcaggttgtg

SEQ ID NO: 748037 - DNA, 22 bp, Artificial Sequence
  chemically synthesized
agttaatttcaggttgtgtaag

SEQ ID NO: 748038 - DNA, 22 bp, Artificial Sequence
  chemically synthesized
gttaatttcaggttgtgtaagg

SEQ ID NO: 748039 - DNA, 22 bp, Artificial Sequence
  chemically synthesized
acaccagtattatgccttacac

SEQ ID NO: 748040 - DNA, 22 bp, Artificial Sequence
  chemically synthesized
atttcaggttgtgtaaggcata

SEQ ID NO: 748041 - DNA, 22 bp, Artificial Sequence
  chemically synthesized
caggttgtgtaaggcataatac

SEQ ID NO: 748042 - DNA, 22 bp, Artificial Sequence
  chemically synthesized
gcattgacaccagtattatgcc

SEQ ID NO: 748043 - DNA, 22 bp, Artificial Sequence
  chemically synthesized
aggttgtgtaaggcataatact

SEQ ID NO: 748044 - DNA, 22 bp, Artificial Sequence
  chemically synthesized
tgtaaggcataatactggtgtc

SEQ ID NO: 748045 - DNA, 22 bp, Artificial Sequence
  chemically synthesized
acagttagcattgacaccagta

SEQ ID NO: 748046 - DNA, 22 bp, Artificial Sequence
  chemically synthesized
aacagttagcattgacaccagt

SEQ ID NO: 748047 - DNA, 22 bp, Artificial Sequence
  chemically synthesized
aaaatttaacagttagcattga

SEQ ID NO: 748048 - DNA, 22 bp, Artificial Sequence
  chemically synthesized
caaaatttaacagttagcattg

SEQ ID NO: 748049 - DNA, 22 bp, Artificial Sequence
  chemically synthesized
tcaaaatttaacagttagcatt

SEQ ID NO: 748050 - DNA, 22 bp, Artificial Sequence
  chemically synthesized
caattttcaaaatttaacagtt

SEQ ID NO: 748051 - DNA, 22 bp, Artificial Sequence
  chemically synthesized
gtgtcaatgctaactgttaaat

SEQ ID NO: 748052 - DNA, 22 bp, Artificial Sequence
  chemically synthesized
acaattacaattttcaaaattt

SEQ ID NO: 748053 - DNA, 22 bp, Artificial Sequence
  chemically synthesized
gacaattacaattttcaaaatt

SEQ ID NO: 748054 - DNA, 22 bp, Artificial Sequence
  chemically synthesized
actgttaaattttgaaaattgt

SEQ ID NO: 748055 - DNA, 22 bp, Artificial Sequence
  chemically synthesized
tcatgcttgacaattacaattt

SEQ ID NO: 748056 - DNA, 22 bp, Artificial Sequence
  chemically synthesized
ttaaattttgaaaattgtaatt

SEQ ID NO: 748057 - DNA, 22 bp, Artificial Sequence
  chemically synthesized
ctgtcatgcttgacaattacaa

SEQ ID NO: 748058 - DNA, 22 bp, Artificial Sequence
  chemically synthesized
aattttgaaaattgtaattgtc

SEQ ID NO: 748059 - DNA, 22 bp, Artificial Sequence
  chemically synthesized
cctgtcatgcttgacaattaca

SEQ ID NO: 748060 - DNA, 22 bp, Artificial Sequence
  chemically synthesized
ttcctgtcatgcttgacaatta

SEQ ID NO: 748061 - DNA, 22 bp, Artificial Sequence
  chemically synthesized
cttcctgtcatgcttgacaatt

SEQ ID NO: 748062 - DNA, 22 bp, Artificial Sequence
  chemically synthesized
tgaaaattgtaattgtcaagca

SEQ ID NO: 748063 - DNA, 22 bp, Artificial Sequence
  chemically synthesized
gaaaattgtaattgtcaagcat

SEQ ID NO: 748064 - DNA, 22 bp, Artificial Sequence
  chemically synthesized
aaaattgtaattgtcaagcatg

SEQ ID NO: 748065 - DNA, 22 bp, Artificial Sequence
  chemically synthesized
gcttcttcctgtcatgcttgac

SEQ ID NO: 748066 - DNA, 22 bp, Artificial Sequence
  chemically synthesized
taattgtcaagcatgacaggaa

SEQ ID NO: 748067 - DNA, 22 bp, Artificial Sequence
  chemically synthesized
tcaagcatgacaggaagaagcg

SEQ ID NO: 748068 - DNA, 22 bp, Artificial Sequence
  chemically synthesized
agatcaaataacccaaggagtt

SEQ ID NO: 748069 - DNA, 22 bp, Artificial Sequence
  chemically synthesized
aagatcaaataacccaaggagt

SEQ ID NO: 748070 - DNA, 22 bp, Artificial Sequence
  chemically synthesized
taagatcaaataacccaaggag

SEQ ID NO: 748071 - DNA, 22 bp, Artificial Sequence
  chemically synthesized
cttgggttatttgatcttaaag

SEQ ID NO: 748072 - DNA, 22 bp, Artificial Sequence
  chemically synthesized
gggttatttgatcttaaagcat

SEQ ID NO: 748073 - DNA, 22 bp, Artificial Sequence
  chemically synthesized
ggttatttgatcttaaagcatt

SEQ ID NO: 748074 - DNA, 22 bp, Artificial Sequence
  chemically synthesized
agtaaaacaggaaatgctttaa

SEQ ID NO: 748075 - DNA, 22 bp, Artificial Sequence
  chemically synthesized
tttgatcttaaagcatttcctg

SEQ ID NO: 748076 - DNA, 22 bp, Artificial Sequence
  chemically synthesized
ccgttcagtaaaacaggaaatg

SEQ ID NO: 748077 - DNA, 22 bp, Artificial Sequence
  chemically synthesized
gatcttaaagcatttcctgttt

SEQ ID NO: 748078 - DNA, 22 bp, Artificial Sequence
  chemically synthesized
atcttaaagcatttcctgtttt

SEQ ID NO: 748079 - DNA, 22 bp, Artificial Sequence
  chemically synthesized
ctaccgttcagtaaaacaggaa

SEQ ID NO: 748080 - DNA, 22 bp, Artificial Sequence
  chemically synthesized
tcctaccgttcagtaaaacagg

SEQ ID NO: 748081 - DNA, 22 bp, Artificial Sequence
  chemically synthesized
aaagcatttcctgttttactga

SEQ ID NO: 748082 - DNA, 22 bp, Artificial Sequence
  chemically synthesized
ctctcctaccgttcagtaaaac

SEQ ID NO: 748083 - DNA, 22 bp, Artificial Sequence
  chemically synthesized
aagcatttcctgttttactgaa

SEQ ID NO: 748084 - DNA, 22 bp, Artificial Sequence
  chemically synthesized
ttactctcctaccgttcagtaa

SEQ ID NO: 748085 - DNA, 22 bp, Artificial Sequence
  chemically synthesized
tgttactctcctaccgttcagt

SEQ ID NO: 748086 - DNA, 22 bp, Artificial Sequence
  chemically synthesized
cctgttttactgaacggtagga

SEQ ID NO: 748087 - DNA, 22 bp, Artificial Sequence
  chemically synthesized
ctgttttactgaacggtaggag

SEQ ID NO: 748088 - DNA, 22 bp, Artificial Sequence
  chemically synthesized
acaattctgttactctcctacc

SEQ ID NO: 748089 - DNA, 22 bp, Artificial Sequence
  chemically synthesized
ttttactgaacggtaggagagt

SEQ ID NO: 748090 - DNA, 22 bp, Artificial Sequence
  chemically synthesized
tactgaacggtaggagagtaac

SEQ ID NO: 748091 - DNA, 22 bp, Artificial Sequence
  chemically synthesized
actgaacggtaggagagtaaca

SEQ ID NO: 748092 - DNA, 22 bp, Artificial Sequence
  chemically synthesized
ctgaacggtaggagagtaacag

SEQ ID NO: 748093 - DNA, 22 bp, Artificial Sequence
  chemically synthesized
aacggtaggagagtaacagaat

SEQ ID NO: 748094 - DNA, 22 bp, Artificial Sequence
  chemically synthesized
tgacaagaataaagttcacaat

SEQ ID NO: 748095 - DNA, 22 bp, Artificial Sequence
  chemically synthesized
ccaaagttgtgacaagaataaa

SEQ ID NO: 748096 - DNA, 22 bp, Artificial Sequence
  chemically synthesized
tgaactttattcttgtcacaac

SEQ ID NO: 748097 - DNA, 22 bp, Artificial Sequence
  chemically synthesized
acatctaccaaagttgtgacaa

SEQ ID NO: 748098 - DNA, 22 bp, Artificial Sequence
  chemically synthesized
gacatctaccaaagttgtgaca

SEQ ID NO: 748099 - DNA, 22 bp, Artificial Sequence
  chemically synthesized
tgacatctaccaaagttgtgac

SEQ ID NO: 748100 - DNA, 22 bp, Artificial Sequence
  chemically synthesized
ttgacatctaccaaagttgtga

SEQ ID NO: 748101 - DNA, 22 bp, Artificial Sequence
  chemically synthesized
tttgacatctaccaaagttgtg

SEQ ID NO: 748102 - DNA, 22 bp, Artificial Sequence
  chemically synthesized
tattcttgtcacaactttggta

SEQ ID NO: 748103 - DNA, 22 bp, Artificial Sequence
  chemically synthesized
ttttttgacatctaccaaagtt

SEQ ID NO: 748104 - DNA, 22 bp, Artificial Sequence
  chemically synthesized
attcttgtcacaactttggtag

SEQ ID NO: 748105 - DNA, 22 bp, Artificial Sequence
  chemically synthesized
ttcttgtcacaactttggtaga

SEQ ID NO: 748106 - DNA, 22 bp, Artificial Sequence
  chemically synthesized
attattttttgacatctaccaa

SEQ ID NO: 748107 - DNA, 22 bp, Artificial Sequence
  chemically synthesized
ttgtcacaactttggtagatgt

SEQ ID NO: 748108 - DNA, 22 bp, Artificial Sequence
  chemically synthesized
aattattttttgacatctacca

SEQ ID NO: 748109 - DNA, 22 bp, Artificial Sequence
  chemically synthesized
taattattttttgacatctacc

SEQ ID NO: 748110 - DNA, 22 bp, Artificial Sequence
  chemically synthesized
gtcacaactttggtagatgtca

SEQ ID NO: 748111 - DNA, 22 bp, Artificial Sequence
  chemically synthesized
ttaattattttttgacatctac

SEQ ID NO: 748112 - DNA, 22 bp, Artificial Sequence
  chemically synthesized
tcacaactttggtagatgtcaa

SEQ ID NO: 748113 - DNA, 22 bp, Artificial Sequence
  chemically synthesized
tggtagatgtcaaaaaataatt

SEQ ID NO: 748114 - DNA, 22 bp, Artificial Sequence
  chemically synthesized
ggtagatgtcaaaaaataatta

SEQ ID NO: 748115 - DNA, 22 bp, Artificial Sequence
  chemically synthesized
gtagatgtcaaaaaataattaa

SEQ ID NO: 748116 - DNA, 22 bp, Artificial Sequence
  chemically synthesized
agaaaatggaatcacacagcca

SEQ ID NO: 748117 - DNA, 22 bp, Artificial Sequence
  chemically synthesized
aaaatatatattggctgtgtga

SEQ ID NO: 748118 - DNA, 22 bp, Artificial Sequence
  chemically synthesized
ctaagaaaatggaatcacacag

SEQ ID NO: 748119 - DNA, 22 bp, Artificial Sequence
  chemically synthesized
cctaagaaaatggaatcacaca

SEQ ID NO: 748120 - DNA, 22 bp, Artificial Sequence
  chemically synthesized
catatttcctaagaaaatggaa

SEQ ID NO: 748121 - DNA, 22 bp, Artificial Sequence
  chemically synthesized
gctgtgtgattccattttctta

SEQ ID NO: 748122 - DNA, 22 bp, Artificial Sequence
  chemically synthesized
aaattccatatttcctaagaaa

SEQ ID NO: 748123 - DNA, 22 bp, Artificial Sequence
  chemically synthesized
tgtgattccattttcttaggaa

SEQ ID NO: 748124 - DNA, 22 bp, Artificial Sequence
  chemically synthesized
actgaaattccatatttcctaa

SEQ ID NO: 748125 - DNA, 22 bp, Artificial Sequence
  chemically synthesized
aactgaaattccatatttccta

SEQ ID NO: 748126 - DNA, 22 bp, Artificial Sequence
  chemically synthesized
tttaactgaaattccatatttc

SEQ ID NO: 748127 - DNA, 22 bp, Artificial Sequence
  chemically synthesized
cattttcttaggaaatatggaa

SEQ ID NO: 748128 - DNA, 22 bp, Artificial Sequence
  chemically synthesized
atttaactgaaattccatattt

SEQ ID NO: 748129 - DNA, 22 bp, Artificial Sequence
  chemically synthesized
tttatttaactgaaattccata

SEQ ID NO: 748130 - DNA, 22 bp, Artificial Sequence
  chemically synthesized
tcttaggaaatatggaatttca

SEQ ID NO: 748131 - DNA, 22 bp, Artificial Sequence
  chemically synthesized
cttaggaaatatggaatttcag

SEQ ID NO: 748132 - DNA, 22 bp, Artificial Sequence
  chemically synthesized
ttaggaaatatggaatttcagt

SEQ ID NO: 748133 - DNA, 22 bp, Artificial Sequence
  chemically synthesized
aggaaatatggaatttcagtta

SEQ ID NO: 748134 - DNA, 22 bp, Artificial Sequence
  chemically synthesized
ggaaatatggaatttcagttaa

SEQ ID NO: 748135 - DNA, 22 bp, Artificial Sequence
  chemically synthesized
aaatgtgagttatttatttaac

SEQ ID NO: 748136 - DNA, 22 bp, Artificial Sequence
  chemically synthesized
cagttaaataaataactcacat

SEQ ID NO: 748137 - DNA, 22 bp, Artificial Sequence
  chemically synthesized
agttaaataaataactcacatt

SEQ ID NO: 748138 - DNA, 22 bp, Artificial Sequence
  chemically synthesized
gaaacagtgctaaaatgtgagt

SEQ ID NO: 748139 - DNA, 22 bp, Artificial Sequence
  chemically synthesized
aataaataactcacattttagc

SEQ ID NO: 748140 - DNA, 22 bp, Artificial Sequence
  chemically synthesized
actagaaacagtgctaaaatgt

SEQ ID NO: 748141 - DNA, 22 bp, Artificial Sequence
  chemically synthesized
acattttagcactgtttctagt

SEQ ID NO: 748142 - DNA, 22 bp, Artificial Sequence
  chemically synthesized
tagcactgtttctagttaatgt

SEQ ID NO: 748143 - DNA, 22 bp, Artificial Sequence
  chemically synthesized
agcactgtttctagttaatgtg

SEQ ID NO: 748144 - DNA, 22 bp, Artificial Sequence
  chemically synthesized
gcactgtttctagttaatgtgg

SEQ ID NO: 748145 - DNA, 22 bp, Artificial Sequence
  chemically synthesized
tttctagttaatgtggtacatg

SEQ ID NO: 748146 - DNA, 22 bp, Artificial Sequence
  chemically synthesized
tgtatacatgtgcatgtaccac

SEQ ID NO: 748147 - DNA, 22 bp, Artificial Sequence
  chemically synthesized
gtgtatacatgtgcatgtacca

SEQ ID NO: 748148 - DNA, 22 bp, Artificial Sequence
  chemically synthesized
ctagttaatgtggtacatgcac

SEQ ID NO: 748149 - DNA, 22 bp, Artificial Sequence
  chemically synthesized
tagttaatgtggtacatgcaca

SEQ ID NO: 748150 - DNA, 22 bp, Artificial Sequence
  chemically synthesized
gcttgtgtatacatgtgcatgt

SEQ ID NO: 748151 - DNA, 22 bp, Artificial Sequence
  chemically synthesized
gttaatgtggtacatgcacatg

SEQ ID NO: 748152 - DNA, 22 bp, Artificial Sequence
  chemically synthesized
atgtggtacatgcacatgtata

SEQ ID NO: 748153 - DNA, 22 bp, Artificial Sequence
  chemically synthesized
tattagcttgtgtatacatgtg

SEQ ID NO: 748154 - DNA, 22 bp, Artificial Sequence
  chemically synthesized
gtattagcttgtgtatacatgt

SEQ ID NO: 748155 - DNA, 22 bp, Artificial Sequence
  chemically synthesized
agggagcaagaatttgtattag

SEQ ID NO: 748156 - DNA, 22 bp, Artificial Sequence
  chemically synthesized
gcaccaagctgagggagcaaga

SEQ ID NO: 748157 - DNA, 22 bp, Artificial Sequence
  chemically synthesized
agcaccaagctgagggagcaag

SEQ ID NO: 748158 - DNA, 22 bp, Artificial Sequence
  chemically synthesized
atacaaattcttgctccctcag

SEQ ID NO: 748159 - DNA, 22 bp, Artificial Sequence
  chemically synthesized
tttagcaccaagctgagggagc

SEQ ID NO: 748160 - DNA, 22 bp, Artificial Sequence
  chemically synthesized
ttatttagcaccaagctgaggg

SEQ ID NO: 748161 - DNA, 22 bp, Artificial Sequence
  chemically synthesized
ttgctccctcagcttggtgcta

SEQ ID NO: 748162 - DNA, 22 bp, Artificial Sequence
  chemically synthesized
gctccctcagcttggtgctaaa

SEQ ID NO: 748163 - DNA, 22 bp, Artificial Sequence
  chemically synthesized
ggaatattattatttagcacca

SEQ ID NO: 748164 - DNA, 22 bp, Artificial Sequence
  chemically synthesized
ctccctcagcttggtgctaaat

SEQ ID NO: 748165 - DNA, 22 bp, Artificial Sequence
  chemically synthesized
ctgggaatattattatttagca

SEQ ID NO: 748166 - DNA, 22 bp, Artificial Sequence
  chemically synthesized
cctcagcttggtgctaaataat

SEQ ID NO: 748167 - DNA, 22 bp, Artificial Sequence
  chemically synthesized
cctgggaatattattatttagc

SEQ ID NO: 748168 - DNA, 22 bp, Artificial Sequence
  chemically synthesized
tcctgggaatattattatttag

SEQ ID NO: 748169 - DNA, 22 bp, Artificial Sequence
  chemically synthesized
agcttggtgctaaataataata

SEQ ID NO: 748170 - DNA, 22 bp, Artificial Sequence
  chemically synthesized
gttttcctgggaatattattat

SEQ ID NO: 748171 - DNA, 22 bp, Artificial Sequence
  chemically synthesized
agttttcctgggaatattatta

SEQ ID NO: 748172 - DNA, 22 bp, Artificial Sequence
  chemically synthesized
ggtgctaaataataatattccc

SEQ ID NO: 748173 - DNA, 22 bp, Artificial Sequence
  chemically synthesized
gtgctaaataataatattccca

SEQ ID NO: 748174 - DNA, 22 bp, Artificial Sequence
  chemically synthesized
aataataatattcccaggaaaa

SEQ ID NO: 748175 - DNA, 22 bp, Artificial Sequence
  chemically synthesized
tatagatggcatcttagttttc

SEQ ID NO: 748176 - DNA, 22 bp, Artificial Sequence
  chemically synthesized
agagttgtatagatggcatctt

SEQ ID NO: 748177 - DNA, 22 bp, Artificial Sequence
  chemically synthesized
ccaggaaaactaagatgccatc

SEQ ID NO: 748178 - DNA, 22 bp, Artificial Sequence
  chemically synthesized
tattgagagttgtatagatggc

SEQ ID NO: 748179 - DNA, 22 bp, Artificial Sequence
  chemically synthesized
agatgccatctatacaactctc

SEQ ID NO: 748180 - DNA, 22 bp, Artificial Sequence
  chemically synthesized
aaaaacaaaaattatattgaga

SEQ ID NO: 748181 - DNA, 22 bp, Artificial Sequence
  chemically synthesized
caaaaacaaaaattatattgag

SEQ ID NO: 748182 - DNA, 22 bp, Artificial Sequence
  chemically synthesized
tttcaaaaacaaaaattatatt

SEQ ID NO: 748183 - DNA, 22 bp, Artificial Sequence
  chemically synthesized
atttcaaaaacaaaaattatat

SEQ ID NO: 748184 - DNA, 22 bp, Artificial Sequence
  chemically synthesized
tacaactctcaatataattttt

SEQ ID NO: 748185 - DNA, 22 bp, Artificial Sequence
  chemically synthesized
atttatttcaaaaacaaaaatt

SEQ ID NO: 748186 - DNA, 22 bp, Artificial Sequence
  chemically synthesized
aatttatttcaaaaacaaaaat

SEQ ID NO: 748187 - DNA, 22 bp, Artificial Sequence
  chemically synthesized
tcaatataatttttgtttttga

SEQ ID NO: 748188 - DNA, 22 bp, Artificial Sequence
  chemically synthesized
aatataatttttgtttttgaaa

SEQ ID NO: 748189 - DNA, 22 bp, Artificial Sequence
  chemically synthesized
ttgtttttgaaataaattaaat

SEQ ID NO: 748190 - DNA, 22 bp, Artificial Sequence
  chemically synthesized
tagagtgtgaacatttaattta

SEQ ID NO: 748191 - DNA, 22 bp, Artificial Sequence
  chemically synthesized
tgtttttgaaataaattaaatg

SEQ ID NO: 748192 - DNA, 22 bp, Artificial Sequence
  chemically synthesized
gtttttgaaataaattaaatgt

SEQ ID NO: 748193 - DNA, 22 bp, Artificial Sequence
  chemically synthesized
tttttgaaataaattaaatgtt

SEQ ID NO: 748194 - DNA, 22 bp, Artificial Sequence
  chemically synthesized
attatagagtgtgaacatttaa

SEQ ID NO: 748195 - DNA, 22 bp, Artificial Sequence
  chemically synthesized
ttgaaataaattaaatgttcac

SEQ ID NO: 748196 - DNA, 22 bp, Artificial Sequence
  chemically synthesized
tgaaataaattaaatgttcaca

SEQ ID NO: 748197 - DNA, 22 bp, Artificial Sequence
  chemically synthesized
gaaataaattaaatgttcacac

SEQ ID NO: 748198 - DNA, 22 bp, Artificial Sequence
  chemically synthesized
aaataaattaaatgttcacact

SEQ ID NO: 748199 - DNA, 22 bp, Artificial Sequence
  chemically synthesized
atctcattatagagtgtgaaca

SEQ ID NO: 748200 - DNA, 22 bp, Artificial Sequence
  chemically synthesized
aatgttcacactctataatgag

SEQ ID NO: 748201 - DNA, 22 bp, Artificial Sequence
  chemically synthesized
tacccagagaagtctgatctca

SEQ ID NO: 748202 - DNA, 22 bp, Artificial Sequence
  chemically synthesized
acactctataatgagatcagac

SEQ ID NO: 748203 - DNA, 22 bp, Artificial Sequence
  chemically synthesized
tataatgagatcagacttctct

SEQ ID NO: 748204 - DNA, 22 bp, Artificial Sequence
  chemically synthesized
aaacctatacccagagaagtct

SEQ ID NO: 748205 - DNA, 22 bp, Artificial Sequence
  chemically synthesized
taatgagatcagacttctctgg

SEQ ID NO: 748206 - DNA, 22 bp, Artificial Sequence
  chemically synthesized
atgatatgattgaaacctatac

SEQ ID NO: 748207 - DNA, 22 bp, Artificial Sequence
  chemically synthesized
attcatgatatgattgaaacct

SEQ ID NO: 748208 - DNA, 22 bp, Artificial Sequence
  chemically synthesized
ctctgggtataggtttcaatca

SEQ ID NO: 748209 - DNA, 22 bp, Artificial Sequence
  chemically synthesized
tctgggtataggtttcaatcat

SEQ ID NO: 748210 - DNA, 22 bp, Artificial Sequence
  chemically synthesized
attaattcatgatatgattgaa

SEQ ID NO: 748211 - DNA, 22 bp, Artificial Sequence
  chemically synthesized
tgggtataggtttcaatcatat

SEQ ID NO: 748212 - DNA, 22 bp, Artificial Sequence
  chemically synthesized
ggtataggtttcaatcatatca

SEQ ID NO: 748213 - DNA, 22 bp, Artificial Sequence
  chemically synthesized
attcattaattcatgatatgat

SEQ ID NO: 748214 - DNA, 22 bp, Artificial Sequence
  chemically synthesized
caatcatatcatgaattaatga

SEQ ID NO: 748215 - DNA, 22 bp, Artificial Sequence
  chemically synthesized
aatcatatcatgaattaatgaa

SEQ ID NO: 748216 - DNA, 22 bp, Artificial Sequence
  chemically synthesized
gaggatatacaaatgcactcat

SEQ ID NO: 748217 - DNA, 22 bp, Artificial Sequence
  chemically synthesized
agtattagaggatatacaaatg

SEQ ID NO: 748218 - DNA, 22 bp, Artificial Sequence
  chemically synthesized
atgaatgagtgcatttgtatat

SEQ ID NO: 748219 - DNA, 22 bp, Artificial Sequence
  chemically synthesized
tcagtattagaggatatacaaa

SEQ ID NO: 748220 - DNA, 22 bp, Artificial Sequence
  chemically synthesized
agtaatatactctcagtattag

SEQ ID NO: 748221 - DNA, 22 bp, Artificial Sequence
  chemically synthesized
aagtaatatactctcagtatta

SEQ ID NO: 748222 - DNA, 22 bp, Artificial Sequence
  chemically synthesized
gtatatcctctaatactgagag

SEQ ID NO: 748223 - DNA, 22 bp, Artificial Sequence
  chemically synthesized
tatatcctctaatactgagagt

SEQ ID NO: 748224 - DNA, 22 bp, Artificial Sequence
  chemically synthesized
aaaaaacttaagtaatatactc

SEQ ID NO: 748225 - DNA, 22 bp, Artificial Sequence
  chemically synthesized
taatactgagagtatattactt

SEQ ID NO: 748226 - DNA, 22 bp, Artificial Sequence
  chemically synthesized
ttcaaaaaacttaagtaatata

SEQ ID NO: 748227 - DNA, 22 bp, Artificial Sequence
  chemically synthesized
atactgagagtatattacttaa

SEQ ID NO: 748228 - DNA, 22 bp, Artificial Sequence
  chemically synthesized
agagtatattacttaagttttt

SEQ ID NO: 748229 - DNA, 22 bp, Artificial Sequence
  chemically synthesized
gggtaataaaagattattcaaa

SEQ ID NO: 748230 - DNA, 22 bp, Artificial Sequence
  chemically synthesized
cttaagttttttgaataatctt

SEQ ID NO: 748231 - DNA, 22 bp, Artificial Sequence
  chemically synthesized
aagttttttgaataatctttta

SEQ ID NO: 748232 - DNA, 22 bp, Artificial Sequence
  chemically synthesized
agttttttgaataatcttttat

SEQ ID NO: 748233 - DNA, 22 bp, Artificial Sequence
  chemically synthesized
aagagtctcgggtaataaaaga

SEQ ID NO: 748234 - DNA, 22 bp, Artificial Sequence
  chemically synthesized
tttgaataatcttttattaccc

SEQ ID NO: 748235 - DNA, 22 bp, Artificial Sequence
  chemically synthesized
ctcaagagtctcgggtaataaa

SEQ ID NO: 748236 - DNA, 22 bp, Artificial Sequence
  chemically synthesized
ttgaataatcttttattacccg

SEQ ID NO: 748237 - DNA, 22 bp, Artificial Sequence
  chemically synthesized
tgaataatcttttattacccga

SEQ ID NO: 748238 - DNA, 22 bp, Artificial Sequence
  chemically synthesized
gaataatcttttattacccgag

SEQ ID NO: 748239 - DNA, 22 bp, Artificial Sequence
  chemically synthesized
ttcctcaagagtctcgggtaat

SEQ ID NO: 748240 - DNA, 22 bp, Artificial Sequence
  chemically synthesized
aataatcttttattacccgaga

SEQ ID NO: 748241 - DNA, 22 bp, Artificial Sequence
  chemically synthesized
gaaatactattcctcaagagtc

SEQ ID NO: 748242 - DNA, 22 bp, Artificial Sequence
  chemically synthesized
ttattacccgagactcttgagg

SEQ ID NO: 748243 - DNA, 22 bp, Artificial Sequence
  chemically synthesized
tattacccgagactcttgagga

SEQ ID NO: 748244 - DNA, 22 bp, Artificial Sequence
  chemically synthesized
attacccgagactcttgaggaa

SEQ ID NO: 748245 - DNA, 22 bp, Artificial Sequence
  chemically synthesized
ttacccgagactcttgaggaat

SEQ ID NO: 748246 - DNA, 22 bp, Artificial Sequence
  chemically synthesized
cccgagactcttgaggaatagt

SEQ ID NO: 748247 - DNA, 22 bp, Artificial Sequence
  chemically synthesized
tggtgggtaataactagaaata

SEQ ID NO: 748248 - DNA, 22 bp, Artificial Sequence
  chemically synthesized
ttgaggaatagtatttctagtt

SEQ ID NO: 748249 - DNA, 22 bp, Artificial Sequence
  chemically synthesized
gtggtgggtaataactagaaat

SEQ ID NO: 748250 - DNA, 22 bp, Artificial Sequence
  chemically synthesized
gaggaatagtatttctagttat

SEQ ID NO: 748251 - DNA, 22 bp, Artificial Sequence
  chemically synthesized
aggaatagtatttctagttatt

SEQ ID NO: 748252 - DNA, 22 bp, Artificial Sequence
  chemically synthesized
tttgtggtgggtaataactaga

SEQ ID NO: 748253 - DNA, 22 bp, Artificial Sequence
  chemically synthesized
gtttgtggtgggtaataactag

SEQ ID NO: 748254 - DNA, 22 bp, Artificial Sequence
  chemically synthesized
tgtttgtggtgggtaataacta

SEQ ID NO: 748255 - DNA, 22 bp, Artificial Sequence
  chemically synthesized
aaagctttgtttgtggtgggta

SEQ ID NO: 748256 - DNA, 22 bp, Artificial Sequence
  chemically synthesized
tgaaagctttgtttgtggtggg

SEQ ID NO: 748257 - DNA, 22 bp, Artificial Sequence
  chemically synthesized
ctgaaagctttgtttgtggtgg

SEQ ID NO: 748258 - DNA, 22 bp, Artificial Sequence
  chemically synthesized
ctagttattacccaccacaaac

SEQ ID NO: 748259 - DNA, 22 bp, Artificial Sequence
  chemically synthesized
tctgaaagctttgtttgtggtg

SEQ ID NO: 748260 - DNA, 22 bp, Artificial Sequence
  chemically synthesized
tagttattacccaccacaaaca

SEQ ID NO: 748261 - DNA, 22 bp, Artificial Sequence
  chemically synthesized
gttattacccaccacaaacaaa

SEQ ID NO: 748262 - DNA, 22 bp, Artificial Sequence
  chemically synthesized
ggattttctgaaagctttgttt

SEQ ID NO: 748263 - DNA, 22 bp, Artificial Sequence
  chemically synthesized
ttacccaccacaaacaaagctt

SEQ ID NO: 748264 - DNA, 22 bp, Artificial Sequence
  chemically synthesized
ctaggattttctgaaagctttg

SEQ ID NO: 748265 - DNA, 22 bp, Artificial Sequence
  chemically synthesized
cccaccacaaacaaagctttca

SEQ ID NO: 748266 - DNA, 22 bp, Artificial Sequence
  chemically synthesized
gctaggattttctgaaagcttt

SEQ ID NO: 748267 - DNA, 22 bp, Artificial Sequence
  chemically synthesized
tttgctaggattttctgaaagc

SEQ ID NO: 748268 - DNA, 22 bp, Artificial Sequence
  chemically synthesized
tcagaaaatcctagcaaacagg

SEQ ID NO: 748269 - DNA, 22 bp, Artificial Sequence
  chemically synthesized
taatatgccaatcctgtttgct

SEQ ID NO: 748270 - DNA, 22 bp, Artificial Sequence
  chemically synthesized
cagaaaatcctagcaaacagga

SEQ ID NO: 748271 - DNA, 22 bp, Artificial Sequence
  chemically synthesized
agaaaatcctagcaaacaggat

SEQ ID NO: 748272 - DNA, 22 bp, Artificial Sequence
  chemically synthesized
atcctataatatgccaatcctg

SEQ ID NO: 748273 - DNA, 22 bp, Artificial Sequence
  chemically synthesized
gcaaacaggattggcatattat

SEQ ID NO: 748274 - DNA, 22 bp, Artificial Sequence
  chemically synthesized
gcatattataggatcagatgtt

SEQ ID NO: 748275 - DNA, 22 bp, Artificial Sequence
  chemically synthesized
aaaacaaccatatcaacatctg

SEQ ID NO: 748276 - DNA, 22 bp, Artificial Sequence
  chemically synthesized
gaaaacaaccatatcaacatct

SEQ ID NO: 748277 - DNA, 22 bp, Artificial Sequence
  chemically synthesized
tttgaaaacaaccatatcaaca

SEQ ID NO: 748278 - DNA, 22 bp, Artificial Sequence
  chemically synthesized
taggatcagatgttgatatggt

SEQ ID NO: 748279 - DNA, 22 bp, Artificial Sequence
  chemically synthesized
ctatttgaaaacaaccatatca

SEQ ID NO: 748280 - DNA, 22 bp, Artificial Sequence
  chemically synthesized
ctactatttgaaaacaaccata

SEQ ID NO: 748281 - DNA, 22 bp, Artificial Sequence
  chemically synthesized
cctactatttgaaaacaaccat

SEQ ID NO: 748282 - DNA, 22 bp, Artificial Sequence
  chemically synthesized
atatggttgttttcaaatagta

SEQ ID NO: 748283 - DNA, 22 bp, Artificial Sequence
  chemically synthesized
caaataataccatccttcctac

SEQ ID NO: 748284 - DNA, 22 bp, Artificial Sequence
  chemically synthesized
ttttcaaatagtaggaaggatg

SEQ ID NO: 748285 - DNA, 22 bp, Artificial Sequence
  chemically synthesized
tccaaataataccatccttcct

SEQ ID NO: 748286 - DNA, 22 bp, Artificial Sequence
  chemically synthesized
ctccaaataataccatccttcc

SEQ ID NO: 748287 - DNA, 22 bp, Artificial Sequence
  chemically synthesized
tcaaatagtaggaaggatggta

SEQ ID NO: 748288 - DNA, 22 bp, Artificial Sequence
  chemically synthesized
caaatagtaggaaggatggtat

SEQ ID NO: 748289 - DNA, 22 bp, Artificial Sequence
  chemically synthesized
aaatagtaggaaggatggtatt

SEQ ID NO: 748290 - DNA, 22 bp, Artificial Sequence
  chemically synthesized
atcagataataaaaatttctcc

SEQ ID NO: 748291 - DNA, 22 bp, Artificial Sequence
  chemically synthesized
aatcagataataaaaatttctc

SEQ ID NO: 748292 - DNA, 22 bp, Artificial Sequence
  chemically synthesized
tttggagaaatttttattatct

SEQ ID NO: 748293 - DNA, 22 bp, Artificial Sequence
  chemically synthesized
ggagaaatttttattatctgat

SEQ ID NO: 748294 - DNA, 22 bp, Artificial Sequence
  chemically synthesized
aagaagtgtttaatcagataat

SEQ ID NO: 748295 - DNA, 22 bp, Artificial Sequence
  chemically synthesized
gagaaatttttattatctgatt

SEQ ID NO: 748296 - DNA, 22 bp, Artificial Sequence
  chemically synthesized
ctcaagaagtgtttaatcagat

SEQ ID NO: 748297 - DNA, 22 bp, Artificial Sequence
  chemically synthesized
tactcaagaagtgtttaatcag

SEQ ID NO: 748298 - DNA, 22 bp, Artificial Sequence
  chemically synthesized
attctactcaagaagtgtttaa

SEQ ID NO: 748299 - DNA, 22 bp, Artificial Sequence
  chemically synthesized
ttattatctgattaaacacttc

SEQ ID NO: 748300 - DNA, 22 bp, Artificial Sequence
  chemically synthesized
tattatctgattaaacacttct

SEQ ID NO: 748301 - DNA, 22 bp, Artificial Sequence
  chemically synthesized
attatctgattaaacacttctt

SEQ ID NO: 748302 - DNA, 22 bp, Artificial Sequence
  chemically synthesized
ttatctgattaaacacttcttg

SEQ ID NO: 748303 - DNA, 22 bp, Artificial Sequence
  chemically synthesized
atctgattctactcaagaagtg

SEQ ID NO: 748304 - DNA, 22 bp, Artificial Sequence
  chemically synthesized
tctgattaaacacttcttgagt

SEQ ID NO: 748305 - DNA, 22 bp, Artificial Sequence
  chemically synthesized
attaaacacttcttgagtagaa

SEQ ID NO: 748306 - DNA, 22 bp, Artificial Sequence
  chemically synthesized
atgagttcatctgattctactc

SEQ ID NO: 748307 - DNA, 22 bp, Artificial Sequence
  chemically synthesized
aacacttcttgagtagaatcag

SEQ ID NO: 748308 - DNA, 22 bp, Artificial Sequence
  chemically synthesized
agctaatgagttcatctgattc

SEQ ID NO: 748309 - DNA, 22 bp, Artificial Sequence
  chemically synthesized
cttgagtagaatcagatgaact

SEQ ID NO: 748310 - DNA, 22 bp, Artificial Sequence
  chemically synthesized
ttgagtagaatcagatgaactc

SEQ ID NO: 748311 - DNA, 22 bp, Artificial Sequence
  chemically synthesized
gagtagaatcagatgaactcat

SEQ ID NO: 748312 - DNA, 22 bp, Artificial Sequence
  chemically synthesized
agtagaatcagatgaactcatt

SEQ ID NO: 748313 - DNA, 22 bp, Artificial Sequence
  chemically synthesized
ggagaacacgggtaatcaaaat

SEQ ID NO: 748314 - DNA, 22 bp, Artificial Sequence
  chemically synthesized
attagctgaacattttgattac

SEQ ID NO: 748315 - DNA, 22 bp, Artificial Sequence
  chemically synthesized
aggagaacacgggtaatcaaaa

SEQ ID NO: 748316 - DNA, 22 bp, Artificial Sequence
  chemically synthesized
gctgaacattttgattacccgt

SEQ ID NO: 748317 - DNA, 22 bp, Artificial Sequence
  chemically synthesized
aacattttgattacccgtgttc

SEQ ID NO: 748318 - DNA, 22 bp, Artificial Sequence
  chemically synthesized
gtcatgggatatttaggagaac

SEQ ID NO: 748319 - DNA, 22 bp, Artificial Sequence
  chemically synthesized
tgattacccgtgttctcctaaa

SEQ ID NO: 748320 - DNA, 22 bp, Artificial Sequence
  chemically synthesized
gattacccgtgttctcctaaat

SEQ ID NO: 748321 - DNA, 22 bp, Artificial Sequence
  chemically synthesized
tggtcatgggatatttaggaga

SEQ ID NO: 748322 - DNA, 22 bp, Artificial Sequence
  chemically synthesized
attacccgtgttctcctaaata

SEQ ID NO: 748323 - DNA, 22 bp, Artificial Sequence
  chemically synthesized
ctggtcatgggatatttaggag

SEQ ID NO: 748324 - DNA, 22 bp, Artificial Sequence
  chemically synthesized
ttctggtcatgggatatttagg

SEQ ID NO: 748325 - DNA, 22 bp, Artificial Sequence
  chemically synthesized
cccgtgttctcctaaatatccc

SEQ ID NO: 748326 - DNA, 22 bp, Artificial Sequence
  chemically synthesized
ctcttctggtcatgggatattt

SEQ ID NO: 748327 - DNA, 22 bp, Artificial Sequence
  chemically synthesized
tcctaaatatcccatgaccaga

SEQ ID NO: 748328 - DNA, 22 bp, Artificial Sequence
  chemically synthesized
tacagctactcttctggtcatg

SEQ ID NO: 748329 - DNA, 22 bp, Artificial Sequence
  chemically synthesized
ctaaatatcccatgaccagaag

SEQ ID NO: 748330 - DNA, 22 bp, Artificial Sequence
  chemically synthesized
aatatcccatgaccagaagagt

SEQ ID NO: 748331 - DNA, 22 bp, Artificial Sequence
  chemically synthesized
aatcagagttgtacagctactc

SEQ ID NO: 748332 - DNA, 22 bp, Artificial Sequence
  chemically synthesized
gattaaatcagagttgtacagc

SEQ ID NO: 748333 - DNA, 22 bp, Artificial Sequence
  chemically synthesized
ttggattaaatcagagttgtac

SEQ ID NO: 748334 - DNA, 22 bp, Artificial Sequence
  chemically synthesized
ttattggattaaatcagagttg

SEQ ID NO: 748335 - DNA, 22 bp, Artificial Sequence
  chemically synthesized
ttgttattggattaaatcagag

SEQ ID NO: 748336 - DNA, 22 bp, Artificial Sequence
  chemically synthesized
ttattgttattggattaaatca

SEQ ID NO: 748337 - DNA, 22 bp, Artificial Sequence
  chemically synthesized
tacaactctgatttaatccaat

SEQ ID NO: 748338 - DNA, 22 bp, Artificial Sequence
  chemically synthesized
gttattattgttattggattaa

SEQ ID NO: 748339 - DNA, 22 bp, Artificial Sequence
  chemically synthesized
gaattggttattattgttattg

SEQ ID NO: 748340 - DNA, 22 bp, Artificial Sequence
  chemically synthesized
tgatttaatccaataacaataa

SEQ ID NO: 748341 - DNA, 22 bp, Artificial Sequence
  chemically synthesized
atttaatccaataacaataata

SEQ ID NO: 748342 - DNA, 22 bp, Artificial Sequence
  chemically synthesized
aatccaataacaataataacca

SEQ ID NO: 748343 - DNA, 22 bp, Artificial Sequence
  chemically synthesized
atccaataacaataataaccaa

SEQ ID NO: 748344 - DNA, 22 bp, Artificial Sequence
  chemically synthesized
tgataaaagaaggagctagaat

SEQ ID NO: 748345 - DNA, 22 bp, Artificial Sequence
  chemically synthesized
atggactgtgataaaagaagga

SEQ ID NO: 748346 - DNA, 22 bp, Artificial Sequence
  chemically synthesized
gatggactgtgataaaagaagg

SEQ ID NO: 748347 - DNA, 22 bp, Artificial Sequence
  chemically synthesized
tgatggactgtgataaaagaag

SEQ ID NO: 748348 - DNA, 22 bp, Artificial Sequence
  chemically synthesized
ttttgatggactgtgataaaag

SEQ ID NO: 748349 - DNA, 22 bp, Artificial Sequence
  chemically synthesized
tagctccttcttttatcacagt

SEQ ID NO: 748350 - DNA, 22 bp, Artificial Sequence
  chemically synthesized
gctccttcttttatcacagtcc

SEQ ID NO: 748351 - DNA, 22 bp, Artificial Sequence
  chemically synthesized
tgttattttgatggactgtgat

SEQ ID NO: 748352 - DNA, 22 bp, Artificial Sequence
  chemically synthesized
gtgttattttgatggactgtga

SEQ ID NO: 748353 - DNA, 22 bp, Artificial Sequence
  chemically synthesized
tgtgttattttgatggactgtg

SEQ ID NO: 748354 - DNA, 22 bp, Artificial Sequence
  chemically synthesized
cttcttttatcacagtccatca

SEQ ID NO: 748355 - DNA, 22 bp, Artificial Sequence
  chemically synthesized
tttgtgttattttgatggactg

SEQ ID NO: 748356 - DNA, 22 bp, Artificial Sequence
  chemically synthesized
ctttgtgttattttgatggact

SEQ ID NO: 748357 - DNA, 22 bp, Artificial Sequence
  chemically synthesized
cttttatcacagtccatcaaaa

SEQ ID NO: 748358 - DNA, 22 bp, Artificial Sequence
  chemically synthesized
ttttatcacagtccatcaaaat

SEQ ID NO: 748359 - DNA, 22 bp, Artificial Sequence
  chemically synthesized
ttatcacagtccatcaaaataa

SEQ ID NO: 748360 - DNA, 22 bp, Artificial Sequence
  chemically synthesized
gacttctttgtgttattttgat

SEQ ID NO: 748361 - DNA, 22 bp, Artificial Sequence
  chemically synthesized
tatcacagtccatcaaaataac

SEQ ID NO: 748362 - DNA, 22 bp, Artificial Sequence
  chemically synthesized
ggacttctttgtgttattttga

SEQ ID NO: 748363 - DNA, 22 bp, Artificial Sequence
  chemically synthesized
atcacagtccatcaaaataaca

SEQ ID NO: 748364 - DNA, 22 bp, Artificial Sequence
  chemically synthesized
tcacagtccatcaaaataacac

SEQ ID NO: 748365 - DNA, 22 bp, Artificial Sequence
  chemically synthesized
atttggacttctttgtgttatt

SEQ ID NO: 748366 - DNA, 22 bp, Artificial Sequence
  chemically synthesized
aatttggacttctttgtgttat

SEQ ID NO: 748367 - DNA, 22 bp, Artificial Sequence
  chemically synthesized
taatttggacttctttgtgtta

SEQ ID NO: 748368 - DNA, 22 bp, Artificial Sequence
  chemically synthesized
ttttaatttggacttctttgtg

SEQ ID NO: 748369 - DNA, 22 bp, Artificial Sequence
  chemically synthesized
attttaatttggacttctttgt

SEQ ID NO: 748370 - DNA, 22 bp, Artificial Sequence
  chemically synthesized
aacttattttaatttggacttc

SEQ ID NO: 748371 - DNA, 22 bp, Artificial Sequence
  chemically synthesized
tcattgaacttattttaatttg

SEQ ID NO: 748372 - DNA, 22 bp, Artificial Sequence
  chemically synthesized
gtcattgaacttattttaattt

SEQ ID NO: 748373 - DNA, 22 bp, Artificial Sequence
  chemically synthesized
tgtcattgaacttattttaatt

SEQ ID NO: 748374 - DNA, 22 bp, Artificial Sequence
  chemically synthesized
ttgtcattgaacttattttaat

SEQ ID NO: 748375 - DNA, 22 bp, Artificial Sequence
  chemically synthesized
tttgtcattgaacttattttaa

SEQ ID NO: 748376 - DNA, 22 bp, Artificial Sequence
  chemically synthesized
tttttgtcattgaacttatttt

SEQ ID NO: 748377 - DNA, 22 bp, Artificial Sequence
  chemically synthesized
aaataagttcaatgacaaaaag

SEQ ID NO: 748378 - DNA, 22 bp, Artificial Sequence
  chemically synthesized
gaaaaggaacatgttctttttg

SEQ ID NO: 748379 - DNA, 22 bp, Artificial Sequence
  chemically synthesized
aatgacaaaaagaacatgttcc

SEQ ID NO: 748380 - DNA, 22 bp, Artificial Sequence
  chemically synthesized
gaacagttggaaaaggaacatg

SEQ ID NO: 748381 - DNA, 22 bp, Artificial Sequence
  chemically synthesized
agaacagttggaaaaggaacat

SEQ ID NO: 748382 - DNA, 22 bp, Artificial Sequence
  chemically synthesized
tagaacagttggaaaaggaaca

SEQ ID NO: 748383 - DNA, 22 bp, Artificial Sequence
  chemically synthesized
cttttccaactgttctaaagcc

SEQ ID NO: 748384 - DNA, 22 bp, Artificial Sequence
  chemically synthesized
aagacaggaaaaggctttagaa

SEQ ID NO: 748385 - DNA, 22 bp, Artificial Sequence
  chemically synthesized
aaagacaggaaaaggctttaga

SEQ ID NO: 748386 - DNA, 22 bp, Artificial Sequence
  chemically synthesized
ttccaactgttctaaagccttt

SEQ ID NO: 748387 - DNA, 22 bp, Artificial Sequence
  chemically synthesized
tccaactgttctaaagcctttt

SEQ ID NO: 748388 - DNA, 22 bp, Artificial Sequence
  chemically synthesized
cttaaagacaggaaaaggcttt

SEQ ID NO: 748389 - DNA, 22 bp, Artificial Sequence
  chemically synthesized
ccaactgttctaaagccttttc

SEQ ID NO: 748390 - DNA, 22 bp, Artificial Sequence
  chemically synthesized
gcttaaagacaggaaaaggctt

SEQ ID NO: 748391 - DNA, 22 bp, Artificial Sequence
  chemically synthesized
caactgttctaaagccttttcc

SEQ ID NO: 748392 - DNA, 22 bp, Artificial Sequence
  chemically synthesized
tgcttaaagacaggaaaaggct

SEQ ID NO: 748393 - DNA, 22 bp, Artificial Sequence
  chemically synthesized
ttctaaagccttttcctgtctt

SEQ ID NO: 748394 - DNA, 22 bp, Artificial Sequence
  chemically synthesized
taaagccttttcctgtctttaa

SEQ ID NO: 748395 - DNA, 22 bp, Artificial Sequence
  chemically synthesized
aatgaactttgcttaaagacag

SEQ ID NO: 748396 - DNA, 22 bp, Artificial Sequence
  chemically synthesized
aagccttttcctgtctttaagc

SEQ ID NO: 748397 - DNA, 22 bp, Artificial Sequence
  chemically synthesized
ttcctgtctttaagcaaagttc

SEQ ID NO: 748398 - DNA, 22 bp, Artificial Sequence
  chemically synthesized
tcctgtctttaagcaaagttca

SEQ ID NO: 748399 - DNA, 22 bp, Artificial Sequence
  chemically synthesized
cctgtctttaagcaaagttcat

SEQ ID NO: 748400 - DNA, 22 bp, Artificial Sequence
  chemically synthesized
ctgtctttaagcaaagttcatt

SEQ ID NO: 748401 - DNA, 22 bp, Artificial Sequence
  chemically synthesized
tctttaagcaaagttcattcag

SEQ ID NO: 748402 - DNA, 22 bp, Artificial Sequence
  chemically synthesized
taagcaaagttcattcagtcat

SEQ ID NO: 748403 - DNA, 22 bp, Artificial Sequence
  chemically synthesized
atagatgagataatgactgaat

SEQ ID NO: 748404 - DNA, 22 bp, Artificial Sequence
  chemically synthesized
aagcaaagttcattcagtcatt

SEQ ID NO: 748405 - DNA, 22 bp, Artificial Sequence
  chemically synthesized
catagatgagataatgactgaa

SEQ ID NO: 748406 - DNA, 22 bp, Artificial Sequence
  chemically synthesized
agcaaagttcattcagtcatta

SEQ ID NO: 748407 - DNA, 22 bp, Artificial Sequence
  chemically synthesized
tcatagatgagataatgactga

SEQ ID NO: 748408 - DNA, 22 bp, Artificial Sequence
  chemically synthesized
ctttcatagatgagataatgac

SEQ ID NO: 748409 - DNA, 22 bp, Artificial Sequence
  chemically synthesized
actttcatagatgagataatga

SEQ ID NO: 748410 - DNA, 22 bp, Artificial Sequence
  chemically synthesized
tactttcatagatgagataatg

SEQ ID NO: 748411 - DNA, 22 bp, Artificial Sequence
  chemically synthesized
ttactttcatagatgagataat

SEQ ID NO: 748412 - DNA, 22 bp, Artificial Sequence
  chemically synthesized
cttttactttcatagatgagat

SEQ ID NO: 748413 - DNA, 22 bp, Artificial Sequence
  chemically synthesized
attcagtcattatctcatctat

SEQ ID NO: 748414 - DNA, 22 bp, Artificial Sequence
  chemically synthesized
tgcttttactttcatagatgag

SEQ ID NO: 748415 - DNA, 22 bp, Artificial Sequence
  chemically synthesized
ctgcttttactttcatagatga

SEQ ID NO: 748416 - DNA, 22 bp, Artificial Sequence
  chemically synthesized
agtcattatctcatctatgaaa

SEQ ID NO: 748417 - DNA, 22 bp, Artificial Sequence
  chemically synthesized
tctcatctatgaaagtaaaagc

SEQ ID NO: 748418 - DNA, 22 bp, Artificial Sequence
  chemically synthesized
atctatgaaagtaaaagcagaa

SEQ ID NO: 748419 - DNA, 22 bp, Artificial Sequence
  chemically synthesized
ataagggaaacatccttctgct

SEQ ID NO: 748420 - DNA, 22 bp, Artificial Sequence
  chemically synthesized
aataagggaaacatccttctgc

SEQ ID NO: 748421 - DNA, 22 bp, Artificial Sequence
  chemically synthesized
tgaaagtaaaagcagaaggatg

SEQ ID NO: 748422 - DNA, 22 bp, Artificial Sequence
  chemically synthesized
tttaataagggaaacatccttc

SEQ ID NO: 748423 - DNA, 22 bp, Artificial Sequence
  chemically synthesized
atttaataagggaaacatcctt

SEQ ID NO: 748424 - DNA, 22 bp, Artificial Sequence
  chemically synthesized
cccttattaaataaatggcttt

SEQ ID NO: 748425 - DNA, 22 bp, Artificial Sequence
  chemically synthesized
ccttattaaataaatggcttta

SEQ ID NO: 748426 - DNA, 22 bp, Artificial Sequence
  chemically synthesized
cacatcgaaagcataaagccat

SEQ ID NO: 748427 - DNA, 22 bp, Artificial Sequence
  chemically synthesized
ccacatcgaaagcataaagcca

SEQ ID NO: 748428 - DNA, 22 bp, Artificial Sequence
  chemically synthesized
attaaataaatggctttatgct

SEQ ID NO: 748429 - DNA, 22 bp, Artificial Sequence
  chemically synthesized
ttaaataaatggctttatgctt

SEQ ID NO: 748430 - DNA, 22 bp, Artificial Sequence
  chemically synthesized
aataaatggctttatgctttcg

SEQ ID NO: 748431 - DNA, 22 bp, Artificial Sequence
  chemically synthesized
tgaaatgccttccacatcgaaa

SEQ ID NO: 748432 - DNA, 22 bp, Artificial Sequence
  chemically synthesized
ttatgaaatgccttccacatcg

SEQ ID NO: 748433 - DNA, 22 bp, Artificial Sequence
  chemically synthesized
tatgctttcgatgtggaaggca

SEQ ID NO: 748434 - DNA, 22 bp, Artificial Sequence
  chemically synthesized
actgttatgaaatgccttccac

SEQ ID NO: 748435 - DNA, 22 bp, Artificial Sequence
  chemically synthesized
atgctttcgatgtggaaggcat

SEQ ID NO: 748436 - DNA, 22 bp, Artificial Sequence
  chemically synthesized
gactgttatgaaatgccttcca

SEQ ID NO: 748437 - DNA, 22 bp, Artificial Sequence
  chemically synthesized
tgctttcgatgtggaaggcatt

SEQ ID NO: 748438 - DNA, 22 bp, Artificial Sequence
  chemically synthesized
tgactgttatgaaatgccttcc

SEQ ID NO: 748439 - DNA, 22 bp, Artificial Sequence
  chemically synthesized
ttgactgttatgaaatgccttc

SEQ ID NO: 748440 - DNA, 22 bp, Artificial Sequence
  chemically synthesized
tttgactgttatgaaatgcctt

SEQ ID NO: 748441 - DNA, 22 bp, Artificial Sequence
  chemically synthesized
ttttgactgttatgaaatgcct

SEQ ID NO: 748442 - DNA, 22 bp, Artificial Sequence
  chemically synthesized
tcgatgtggaaggcatttcata

SEQ ID NO: 748443 - DNA, 22 bp, Artificial Sequence
  chemically synthesized
cgatgtggaaggcatttcataa

SEQ ID NO: 748444 - DNA, 22 bp, Artificial Sequence
  chemically synthesized
cttttttgactgttatgaaatg

SEQ ID NO: 748445 - DNA, 22 bp, Artificial Sequence
  chemically synthesized
gatgtggaaggcatttcataac

SEQ ID NO: 748446 - DNA, 22 bp, Artificial Sequence
  chemically synthesized
ccttttttgactgttatgaaat

SEQ ID NO: 748447 - DNA, 22 bp, Artificial Sequence
  chemically synthesized
aaaacgcttccttttttgactg

SEQ ID NO: 748448 - DNA, 22 bp, Artificial Sequence
  chemically synthesized
cataacagtcaaaaaaggaagc

SEQ ID NO: 748449 - DNA, 22 bp, Artificial Sequence
  chemically synthesized
ataacagtcaaaaaaggaagcg

SEQ ID NO: 748450 - DNA, 22 bp, Artificial Sequence
  chemically synthesized
atggcattcaaaacgcttcctt

SEQ ID NO: 748451 - DNA, 22 bp, Artificial Sequence
  chemically synthesized
tgaatgccatcaactcatttcc

SEQ ID NO: 748452 - DNA, 22 bp, Artificial Sequence
  chemically synthesized
gaatgccatcaactcatttcct

SEQ ID NO: 748453 - DNA, 22 bp, Artificial Sequence
  chemically synthesized
aatgccatcaactcatttcctc

SEQ ID NO: 748454 - DNA, 22 bp, Artificial Sequence
  chemically synthesized
aaacagtgggtgggaggaaatg

SEQ ID NO: 748455 - DNA, 22 bp, Artificial Sequence
  chemically synthesized
aaaacagtgggtgggaggaaat

SEQ ID NO: 748456 - DNA, 22 bp, Artificial Sequence
  chemically synthesized
atttcctcccacccactgtttt

SEQ ID NO: 748457 - DNA, 22 bp, Artificial Sequence
  chemically synthesized
cctcccacccactgttttaaat

SEQ ID NO: 748458 - DNA, 22 bp, Artificial Sequence
  chemically synthesized
ctcccacccactgttttaaatc

SEQ ID NO: 748459 - DNA, 22 bp, Artificial Sequence
  chemically synthesized
gaaccaaacaaacgatttaaaa

SEQ ID NO: 748460 - DNA, 22 bp, Artificial Sequence
  chemically synthesized
ccacccactgttttaaatcgtt

SEQ ID NO: 748461 - DNA, 22 bp, Artificial Sequence
  chemically synthesized
ttttaaatcgtttgtttggttc

SEQ ID NO: 748462 - DNA, 22 bp, Artificial Sequence
  chemically synthesized
taaatcgtttgtttggttccaa

SEQ ID NO: 748463 - DNA, 22 bp, Artificial Sequence
  chemically synthesized
aaatcgtttgtttggttccaat

SEQ ID NO: 748464 - DNA, 22 bp, Artificial Sequence
  chemically synthesized
aatcgtttgtttggttccaatg

SEQ ID NO: 748465 - DNA, 22 bp, Artificial Sequence
  chemically synthesized
tgtaagtgtagtatacattgga

SEQ ID NO: 748466 - DNA, 22 bp, Artificial Sequence
  chemically synthesized
atgtaagtgtagtatacattgg

SEQ ID NO: 748467 - DNA, 22 bp, Artificial Sequence
  chemically synthesized
gtttggttccaatgtatactac

SEQ ID NO: 748468 - DNA, 22 bp, Artificial Sequence
  chemically synthesized
tttggttccaatgtatactaca

SEQ ID NO: 748469 - DNA, 22 bp, Artificial Sequence
  chemically synthesized
ggttccaatgtatactacactt

SEQ ID NO: 748470 - DNA, 22 bp, Artificial Sequence
  chemically synthesized
gttccaatgtatactacactta

SEQ ID NO: 748471 - DNA, 22 bp, Artificial Sequence
  chemically synthesized
ataaacaacttatgtaagtgta

SEQ ID NO: 748472 - DNA, 22 bp, Artificial Sequence
  chemically synthesized
cataaacaacttatgtaagtgt

SEQ ID NO: 748473 - DNA, 22 bp, Artificial Sequence
  chemically synthesized
caatgtatactacacttacata

SEQ ID NO: 748474 - DNA, 22 bp, Artificial Sequence
  chemically synthesized
ttcataaacaacttatgtaagt

SEQ ID NO: 748475 - DNA, 22 bp, Artificial Sequence
  chemically synthesized
gctcttcataaacaacttatgt

SEQ ID NO: 748476 - DNA, 22 bp, Artificial Sequence
  chemically synthesized
ggctcttcataaacaacttatg

SEQ ID NO: 748477 - DNA, 22 bp, Artificial Sequence
  chemically synthesized
atttggctcttcataaacaact

SEQ ID NO: 748478 - DNA, 22 bp, Artificial Sequence
  chemically synthesized
cacttacataagttgtttatga

SEQ ID NO: 748479 - DNA, 22 bp, Artificial Sequence
  chemically synthesized
ttaatttggctcttcataaaca

SEQ ID NO: 748480 - DNA, 22 bp, Artificial Sequence
  chemically synthesized
acataagttgtttatgaagagc

SEQ ID NO: 748481 - DNA, 22 bp, Artificial Sequence
  chemically synthesized
cataagttgtttatgaagagcc

SEQ ID NO: 748482 - DNA, 22 bp, Artificial Sequence
  chemically synthesized
caaagactattaatttggctct

SEQ ID NO: 748483 - DNA, 22 bp, Artificial Sequence
  chemically synthesized
tttatgaagagccaaattaata

SEQ ID NO: 748484 - DNA, 22 bp, Artificial Sequence
  chemically synthesized
atgaagagccaaattaatagtc

SEQ ID NO: 748485 - DNA, 22 bp, Artificial Sequence
  chemically synthesized
tgaagagccaaattaatagtct

SEQ ID NO: 748486 - DNA, 22 bp, Artificial Sequence
  chemically synthesized
caacaaaaacaattgcaaagac

SEQ ID NO: 748487 - DNA, 22 bp, Artificial Sequence
  chemically synthesized
caaattccaacaaaaacaattg

SEQ ID NO: 748488 - DNA, 22 bp, Artificial Sequence
  chemically synthesized
atagtctttgcaattgtttttg

SEQ ID NO: 748489 - DNA, 22 bp, Artificial Sequence
  chemically synthesized
tccaaattccaacaaaaacaat

SEQ ID NO: 748490 - DNA, 22 bp, Artificial Sequence
  chemically synthesized
tcagctctccaaattccaacaa

SEQ ID NO: 748491 - DNA, 22 bp, Artificial Sequence
  chemically synthesized
tgcaattgtttttgttggaatt

SEQ ID NO: 748492 - DNA, 22 bp, Artificial Sequence
  chemically synthesized
gtcagctctccaaattccaaca

SEQ ID NO: 748493 - DNA, 22 bp, Artificial Sequence
  chemically synthesized
gcaattgtttttgttggaattt

SEQ ID NO: 748494 - DNA, 22 bp, Artificial Sequence
  chemically synthesized
caattgtttttgttggaatttg

SEQ ID NO: 748495 - DNA, 22 bp, Artificial Sequence
  chemically synthesized
acttgtcagctctccaaattcc

SEQ ID NO: 748496 - DNA, 22 bp, Artificial Sequence
  chemically synthesized
tttttgttggaatttggagagc

SEQ ID NO: 748497 - DNA, 22 bp, Artificial Sequence
  chemically synthesized
attcacttgtcagctctccaaa

SEQ ID NO: 748498 - DNA, 22 bp, Artificial Sequence
  chemically synthesized
ttgttggaatttggagagctga

SEQ ID NO: 748499 - DNA, 22 bp, Artificial Sequence
  chemically synthesized
ctaattcacttgtcagctctcc

SEQ ID NO: 748500 - DNA, 22 bp, Artificial Sequence
  chemically synthesized
tgttggaatttggagagctgac

SEQ ID NO: 748501 - DNA, 22 bp, Artificial Sequence
  chemically synthesized
gttggaatttggagagctgaca

SEQ ID NO: 748502 - DNA, 22 bp, Artificial Sequence
  chemically synthesized
tactaattcacttgtcagctct

SEQ ID NO: 748503 - DNA, 22 bp, Artificial Sequence
  chemically synthesized
ttggaatttggagagctgacaa

SEQ ID NO: 748504 - DNA, 22 bp, Artificial Sequence
  chemically synthesized
ctactaattcacttgtcagctc

SEQ ID NO: 748505 - DNA, 22 bp, Artificial Sequence
  chemically synthesized
tctactaattcacttgtcagct

SEQ ID NO: 748506 - DNA, 22 bp, Artificial Sequence
  chemically synthesized
gaatttggagagctgacaagtg

SEQ ID NO: 748507 - DNA, 22 bp, Artificial Sequence
  chemically synthesized
ccattttctactaattcacttg

SEQ ID NO: 748508 - DNA, 22 bp, Artificial Sequence
  chemically synthesized
ggagagctgacaagtgaattag

SEQ ID NO: 748509 - DNA, 22 bp, Artificial Sequence
  chemically synthesized
gagagctgacaagtgaattagt

SEQ ID NO: 748510 - DNA, 22 bp, Artificial Sequence
  chemically synthesized
acaagtgaattagtagaaaatg

SEQ ID NO: 748511 - DNA, 22 bp, Artificial Sequence
  chemically synthesized
atgtagaattgccattttctac

SEQ ID NO: 748512 - DNA, 22 bp, Artificial Sequence
  chemically synthesized
attcatgtagaattgccatttt

SEQ ID NO: 748513 - DNA, 22 bp, Artificial Sequence
  chemically synthesized
aaagctaattcatgtagaattg

SEQ ID NO: 748514 - DNA, 22 bp, Artificial Sequence
  chemically synthesized
gtagaaaatggcaattctacat

SEQ ID NO: 748515 - DNA, 22 bp, Artificial Sequence
  chemically synthesized
aaaagctaattcatgtagaatt

SEQ ID NO: 748516 - DNA, 22 bp, Artificial Sequence
  chemically synthesized
gggagacttaaaagctaattca

SEQ ID NO: 748517 - DNA, 22 bp, Artificial Sequence
  chemically synthesized
agggagacttaaaagctaattc

SEQ ID NO: 748518 - DNA, 22 bp, Artificial Sequence
  chemically synthesized
ttagggagacttaaaagctaat

SEQ ID NO: 748519 - DNA, 22 bp, Artificial Sequence
  chemically synthesized
tacatgaattagcttttaagtc

SEQ ID NO: 748520 - DNA, 22 bp, Artificial Sequence
  chemically synthesized
catgaattagcttttaagtctc

SEQ ID NO: 748521 - DNA, 22 bp, Artificial Sequence
  chemically synthesized
catcagcctcttagggagactt

SEQ ID NO: 748522 - DNA, 22 bp, Artificial Sequence
  chemically synthesized
tgcatcagcctcttagggagac

SEQ ID NO: 748523 - DNA, 22 bp, Artificial Sequence
  chemically synthesized
gcttttaagtctccctaagagg

SEQ ID NO: 748524 - DNA, 22 bp, Artificial Sequence
  chemically synthesized
agttctgcatcagcctcttagg

SEQ ID NO: 748525 - DNA, 22 bp, Artificial Sequence
  chemically synthesized
ttaagtctccctaagaggctga

SEQ ID NO: 748526 - DNA, 22 bp, Artificial Sequence
  chemically synthesized
ttaagttctgcatcagcctctt

SEQ ID NO: 748527 - DNA, 22 bp, Artificial Sequence
  chemically synthesized
taagtctccctaagaggctgat

SEQ ID NO: 748528 - DNA, 22 bp, Artificial Sequence
  chemically synthesized
attaagttctgcatcagcctct

SEQ ID NO: 748529 - DNA, 22 bp, Artificial Sequence
  chemically synthesized
aagtctccctaagaggctgatg

SEQ ID NO: 748530 - DNA, 22 bp, Artificial Sequence
  chemically synthesized
agtctccctaagaggctgatgc

SEQ ID NO: 748531 - DNA, 22 bp, Artificial Sequence
  chemically synthesized
ttattaagttctgcatcagcct

SEQ ID NO: 748532 - DNA, 22 bp, Artificial Sequence
  chemically synthesized
cctaagaggctgatgcagaact

SEQ ID NO: 748533 - DNA, 22 bp, Artificial Sequence
  chemically synthesized
ataagtctcttattaagttctg

SEQ ID NO: 748534 - DNA, 22 bp, Artificial Sequence
  chemically synthesized
agaggctgatgcagaacttaat

SEQ ID NO: 748535 - DNA, 22 bp, Artificial Sequence
  chemically synthesized
ctaataagtctcttattaagtt

SEQ ID NO: 748536 - DNA, 22 bp, Artificial Sequence
  chemically synthesized
tcctaataagtctcttattaag

SEQ ID NO: 748537 - DNA, 22 bp, Artificial Sequence
  chemically synthesized
ctcctaataagtctcttattaa

SEQ ID NO: 748538 - DNA, 22 bp, Artificial Sequence
  chemically synthesized
atgcagaacttaataagagact

SEQ ID NO: 748539 - DNA, 22 bp, Artificial Sequence
  chemically synthesized
cttctcctaataagtctcttat

SEQ ID NO: 748540 - DNA, 22 bp, Artificial Sequence
  chemically synthesized
tcctacttctcctaataagtct

SEQ ID NO: 748541 - DNA, 22 bp, Artificial Sequence
  chemically synthesized
agttgtcctacttctcctaata

SEQ ID NO: 748542 - DNA, 22 bp, Artificial Sequence
  chemically synthesized
aataagagacttattaggagaa

SEQ ID NO: 748543 - DNA, 22 bp, Artificial Sequence
  chemically synthesized
ataagagacttattaggagaag

SEQ ID NO: 748544 - DNA, 22 bp, Artificial Sequence
  chemically synthesized
aattaagttgtcctacttctcc

SEQ ID NO: 748545 - DNA, 22 bp, Artificial Sequence
  chemically synthesized
attaggagaagtaggacaactt

SEQ ID NO: 748546 - DNA, 22 bp, Artificial Sequence
  chemically synthesized
ttaggagaagtaggacaactta

SEQ ID NO: 748547 - DNA, 22 bp, Artificial Sequence
  chemically synthesized
taatcaatctgaattaagttgt

SEQ ID NO: 748548 - DNA, 22 bp, Artificial Sequence
  chemically synthesized
ggagaagtaggacaacttaatt

SEQ ID NO: 748549 - DNA, 22 bp, Artificial Sequence
  chemically synthesized
accgaagtctataatcaatctg

SEQ ID NO: 748550 - DNA, 22 bp, Artificial Sequence
  chemically synthesized
caccgaagtctataatcaatct

SEQ ID NO: 748551 - DNA, 22 bp, Artificial Sequence
  chemically synthesized
tcttcaccgaagtctataatca

SEQ ID NO: 748552 - DNA, 22 bp, Artificial Sequence
  chemically synthesized
aattcagattgattatagactt

SEQ ID NO: 748553 - DNA, 22 bp, Artificial Sequence
  chemically synthesized
attcagattgattatagacttc

SEQ ID NO: 748554 - DNA, 22 bp, Artificial Sequence
  chemically synthesized
agattgattatagacttcggtg

SEQ ID NO: 748555 - DNA, 22 bp, Artificial Sequence
  chemically synthesized
aaccccagctgtcttcaccgaa

SEQ ID NO: 748556 - DNA, 22 bp, Artificial Sequence
  chemically synthesized
gaaccccagctgtcttcaccga

SEQ ID NO: 748557 - DNA, 22 bp, Artificial Sequence
  chemically synthesized
attatagacttcggtgaagaca

SEQ ID NO: 748558 - DNA, 22 bp, Artificial Sequence
  chemically synthesized
atttgaaccccagctgtcttca

SEQ ID NO: 748559 - DNA, 22 bp, Artificial Sequence
  chemically synthesized
catttgaaccccagctgtcttc

SEQ ID NO: 748560 - DNA, 22 bp, Artificial Sequence
  chemically synthesized
tagacttcggtgaagacagctg

SEQ ID NO: 748561 - DNA, 22 bp, Artificial Sequence
  chemically synthesized
agtttcatttgaaccccagctg

SEQ ID NO: 748562 - DNA, 22 bp, Artificial Sequence
  chemically synthesized
cagtttcatttgaaccccagct

SEQ ID NO: 748563 - DNA, 22 bp, Artificial Sequence
  chemically synthesized
tcagtttcatttgaaccccagc

SEQ ID NO: 748564 - DNA, 22 bp, Artificial Sequence
  chemically synthesized
cggtgaagacagctggggttca

SEQ ID NO: 748565 - DNA, 22 bp, Artificial Sequence
  chemically synthesized
ttcagtttcatttgaaccccag

SEQ ID NO: 748566 - DNA, 22 bp, Artificial Sequence
  chemically synthesized
ggtgaagacagctggggttcaa

SEQ ID NO: 748567 - DNA, 22 bp, Artificial Sequence
  chemically synthesized
tttcagtttcatttgaacccca

SEQ ID NO: 748568 - DNA, 22 bp, Artificial Sequence
  chemically synthesized
tttttcagtttcatttgaaccc

SEQ ID NO: 748569 - DNA, 22 bp, Artificial Sequence
  chemically synthesized
gggttcaaatgaaactgaaaaa

SEQ ID NO: 748570 - DNA, 22 bp, Artificial Sequence
  chemically synthesized
aagtgcatataagttctttttc

SEQ ID NO: 748571 - DNA, 22 bp, Artificial Sequence
  chemically synthesized
gaagtgcatataagttcttttt

SEQ ID NO: 748572 - DNA, 22 bp, Artificial Sequence
  chemically synthesized
aaatgaaactgaaaaagaactt

SEQ ID NO: 748573 - DNA, 22 bp, Artificial Sequence
  chemically synthesized
tgaagtgcatataagttctttt

SEQ ID NO: 748574 - DNA, 22 bp, Artificial Sequence
  chemically synthesized
gcatactttgaagtgcatataa

SEQ ID NO: 748575 - DNA, 22 bp, Artificial Sequence
  chemically synthesized
agcatactttgaagtgcatata

SEQ ID NO: 748576 - DNA, 22 bp, Artificial Sequence
  chemically synthesized
aaaaagaacttatatgcacttc

SEQ ID NO: 748577 - DNA, 22 bp, Artificial Sequence
  chemically synthesized
cttagcatactttgaagtgcat

SEQ ID NO: 748578 - DNA, 22 bp, Artificial Sequence
  chemically synthesized
agacatctgcttagcatacttt

SEQ ID NO: 748579 - DNA, 22 bp, Artificial Sequence
  chemically synthesized
atatgcacttcaaagtatgcta

SEQ ID NO: 748580 - DNA, 22 bp, Artificial Sequence
  chemically synthesized
cagacatctgcttagcatactt

SEQ ID NO: 748581 - DNA, 22 bp, Artificial Sequence
  chemically synthesized
tatgcacttcaaagtatgctaa

SEQ ID NO: 748582 - DNA, 22 bp, Artificial Sequence
  chemically synthesized
tttcagacatctgcttagcata

SEQ ID NO: 748583 - DNA, 22 bp, Artificial Sequence
  chemically synthesized
caaagtatgctaagcagatgtc

SEQ ID NO: 748584 - DNA, 22 bp, Artificial Sequence
  chemically synthesized
aaagtatgctaagcagatgtct

SEQ ID NO: 748585 - DNA, 22 bp, Artificial Sequence
  chemically synthesized
agcagatgtctgaaacaattac

SEQ ID NO: 748586 - DNA, 22 bp, Artificial Sequence
  chemically synthesized
aaaaggcagagcggagtaattg

SEQ ID NO: 748587 - DNA, 22 bp, Artificial Sequence
  chemically synthesized
tgaaaaggcagagcggagtaat

SEQ ID NO: 748588 - DNA, 22 bp, Artificial Sequence
  chemically synthesized
ctgaaaaggcagagcggagtaa

SEQ ID NO: 748589 - DNA, 22 bp, Artificial Sequence
  chemically synthesized
aaacaattactccgctctgcct

SEQ ID NO: 748590 - DNA, 22 bp, Artificial Sequence
  chemically synthesized
aaacttctgaaaaggcagagcg

SEQ ID NO: 748591 - DNA, 22 bp, Artificial Sequence
  chemically synthesized
gaaacttctgaaaaggcagagc

SEQ ID NO: 748592 - DNA, 22 bp, Artificial Sequence
  chemically synthesized
tgaaacttctgaaaaggcagag

SEQ ID NO: 748593 - DNA, 22 bp, Artificial Sequence
  chemically synthesized
ctccgctctgccttttcagaag

SEQ ID NO: 748594 - DNA, 22 bp, Artificial Sequence
  chemically synthesized
cgctctgccttttcagaagttt

SEQ ID NO: 748595 - DNA, 22 bp, Artificial Sequence
  chemically synthesized
ccatcccgcctttgaaacttct

SEQ ID NO: 748596 - DNA, 22 bp, Artificial Sequence
  chemically synthesized
tgccttttcagaagtttcaaag

SEQ ID NO: 748597 - DNA, 22 bp, Artificial Sequence
  chemically synthesized
ttcccatcccgcctttgaaact

SEQ ID NO: 748598 - DNA, 22 bp, Artificial Sequence
  chemically synthesized
ccttttcagaagtttcaaaggc

SEQ ID NO: 748599 - DNA, 22 bp, Artificial Sequence
  chemically synthesized
ttcagaagtttcaaaggcggga

SEQ ID NO: 748600 - DNA, 22 bp, Artificial Sequence
  chemically synthesized
tcagaagtttcaaaggcgggat

SEQ ID NO: 748601 - DNA, 22 bp, Artificial Sequence
  chemically synthesized
cagaagtttcaaaggcgggatg

SEQ ID NO: 748602 - DNA, 22 bp, Artificial Sequence
  chemically synthesized
ccatgctattcccatcccgcct

SEQ ID NO: 748603 - DNA, 22 bp, Artificial Sequence
  chemically synthesized
agaagtttcaaaggcgggatgg

SEQ ID NO: 748604 - DNA, 22 bp, Artificial Sequence
  chemically synthesized
accatgctattcccatcccgcc

SEQ ID NO: 748605 - DNA, 22 bp, Artificial Sequence
  chemically synthesized
gtttaccatgctattcccatcc

SEQ ID NO: 748606 - DNA, 22 bp, Artificial Sequence
  chemically synthesized
cgtttaccatgctattcccatc

SEQ ID NO: 748607 - DNA, 22 bp, Artificial Sequence
  chemically synthesized
caaaggcgggatgggaatagca

SEQ ID NO: 748608 - DNA, 22 bp, Artificial Sequence
  chemically synthesized
aaaggcgggatgggaatagcat

SEQ ID NO: 748609 - DNA, 22 bp, Artificial Sequence
  chemically synthesized
ggcaaacagaaccttcgtttac

SEQ ID NO: 748610 - DNA, 22 bp, Artificial Sequence
  chemically synthesized
aggcaaacagaaccttcgttta

SEQ ID NO: 748611 - DNA, 22 bp, Artificial Sequence
  chemically synthesized
gacttaggcaaacagaaccttc

SEQ ID NO: 748612 - DNA, 22 bp, Artificial Sequence
  chemically synthesized
cctcgacttaggcaaacagaac

SEQ ID NO: 748613 - DNA, 22 bp, Artificial Sequence
  chemically synthesized
aaagcccctacctcgacttagg

SEQ ID NO: 748614 - DNA, 22 bp, Artificial Sequence
  chemically synthesized
aaaagcccctacctcgacttag

SEQ ID NO: 748615 - DNA, 22 bp, Artificial Sequence
  chemically synthesized
taaaagcccctacctcgactta

SEQ ID NO: 748616 - DNA, 22 bp, Artificial Sequence
  chemically synthesized
tgtttgcctaagtcgaggtagg

SEQ ID NO: 748617 - DNA, 22 bp, Artificial Sequence
  chemically synthesized
tttgcctaagtcgaggtagggg

SEQ ID NO: 748618 - DNA, 22 bp, Artificial Sequence
  chemically synthesized
gcctaagtcgaggtaggggctt

SEQ ID NO: 748619 - DNA, 22 bp, Artificial Sequence
  chemically synthesized
tgtgtgttttaaaagcccctac

SEQ ID NO: 748620 - DNA, 22 bp, Artificial Sequence
  chemically synthesized
cctaagtcgaggtaggggcttt

SEQ ID NO: 748621 - DNA, 22 bp, Artificial Sequence
  chemically synthesized
agtcgaggtaggggcttttaaa

SEQ ID NO: 748622 - DNA, 22 bp, Artificial Sequence
  chemically synthesized
gatagcgctgtgtgtgttttaa

SEQ ID NO: 748623 - DNA, 22 bp, Artificial Sequence
  chemically synthesized
agatagcgctgtgtgtgtttta

SEQ ID NO: 748624 - DNA, 22 bp, Artificial Sequence
  chemically synthesized
tagatagcgctgtgtgtgtttt

SEQ ID NO: 748625 - DNA, 22 bp, Artificial Sequence
  chemically synthesized
attttagatagcgctgtgtgtg

SEQ ID NO: 748626 - DNA, 22 bp, Artificial Sequence
  chemically synthesized
ttaaaacacacacagcgctatc

SEQ ID NO: 748627 - DNA, 22 bp, Artificial Sequence
  chemically synthesized
taaaacacacacagcgctatct

SEQ ID NO: 748628 - DNA, 22 bp, Artificial Sequence
  chemically synthesized
aaaacacacacagcgctatcta

SEQ ID NO: 748629 - DNA, 22 bp, Artificial Sequence
  chemically synthesized
aaacacacacagcgctatctaa

SEQ ID NO: 748630 - DNA, 22 bp, Artificial Sequence
  chemically synthesized
cccaaagcatctgattttagat

SEQ ID NO: 748631 - DNA, 22 bp, Artificial Sequence
  chemically synthesized
ccccaaagcatctgattttaga

SEQ ID NO: 748632 - DNA, 22 bp, Artificial Sequence
  chemically synthesized
tccccaaagcatctgattttag

SEQ ID NO: 748633 - DNA, 22 bp, Artificial Sequence
  chemically synthesized
tttccccaaagcatctgatttt

SEQ ID NO: 748634 - DNA, 22 bp, Artificial Sequence
  chemically synthesized
ctttccccaaagcatctgattt

SEQ ID NO: 748635 - DNA, 22 bp, Artificial Sequence
  chemically synthesized
tctttccccaaagcatctgatt

SEQ ID NO: 748636 - DNA, 22 bp, Artificial Sequence
  chemically synthesized
tctaaaatcagatgctttgggg

SEQ ID NO: 748637 - DNA, 22 bp, Artificial Sequence
  chemically synthesized
aaatcagatgctttggggaaag

SEQ ID NO: 748638 - DNA, 22 bp, Artificial Sequence
  chemically synthesized
ggacagcaatgtcaaatcactt

SEQ ID NO: 748639 - DNA, 22 bp, Artificial Sequence
  chemically synthesized
aggacagcaatgtcaaatcact

SEQ ID NO: 748640 - DNA, 22 bp, Artificial Sequence
  chemically synthesized
tggggaaagaaagtgatttgac

SEQ ID NO: 748641 - DNA, 22 bp, Artificial Sequence
  chemically synthesized
ggggaaagaaagtgatttgaca

SEQ ID NO: 748642 - DNA, 22 bp, Artificial Sequence
  chemically synthesized
gggaaagaaagtgatttgacat

SEQ ID NO: 748643 - DNA, 22 bp, Artificial Sequence
  chemically synthesized
cttaggacagcaatgtcaaatc

SEQ ID NO: 748644 - DNA, 22 bp, Artificial Sequence
  chemically synthesized
aaagcaaattacttaggacagc

SEQ ID NO: 748645 - DNA, 22 bp, Artificial Sequence
  chemically synthesized
gacattgctgtcctaagtaatt

SEQ ID NO: 748646 - DNA, 22 bp, Artificial Sequence
  chemically synthesized
acattgctgtcctaagtaattt

SEQ ID NO: 748647 - DNA, 22 bp, Artificial Sequence
  chemically synthesized
taaagctaaaagcaaattactt

SEQ ID NO: 748648 - DNA, 22 bp, Artificial Sequence
  chemically synthesized
ataaagctaaaagcaaattact

SEQ ID NO: 748649 - DNA, 22 bp, Artificial Sequence
  chemically synthesized
tttataaagctaaaagcaaatt

SEQ ID NO: 748650 - DNA, 22 bp, Artificial Sequence
  chemically synthesized
ctgtcctaagtaatttgctttt

SEQ ID NO: 748651 - DNA, 22 bp, Artificial Sequence
  chemically synthesized
gtttataaagctaaaagcaaat

SEQ ID NO: 748652 - DNA, 22 bp, Artificial Sequence
  chemically synthesized
tgtttataaagctaaaagcaaa

SEQ ID NO: 748653 - DNA, 22 bp, Artificial Sequence
  chemically synthesized
tcctaagtaatttgcttttagc

SEQ ID NO: 748654 - DNA, 22 bp, Artificial Sequence
  chemically synthesized
ctttgtttataaagctaaaagc

SEQ ID NO: 748655 - DNA, 22 bp, Artificial Sequence
  chemically synthesized
ctgctttgtttataaagctaaa

SEQ ID NO: 748656 - DNA, 22 bp, Artificial Sequence
  chemically synthesized
agtaatttgcttttagctttat

SEQ ID NO: 748657 - DNA, 22 bp, Artificial Sequence
  chemically synthesized
atctcctgctttgtttataaag

SEQ ID NO: 748658 - DNA, 22 bp, Artificial Sequence
  chemically synthesized
tcatctcctgctttgtttataa

SEQ ID NO: 748659 - DNA, 22 bp, Artificial Sequence
  chemically synthesized
gcttttagctttataaacaaag

SEQ ID NO: 748660 - DNA, 22 bp, Artificial Sequence
  chemically synthesized
cttttagctttataaacaaagc

SEQ ID NO: 748661 - DNA, 22 bp, Artificial Sequence
  chemically synthesized
cctctcatctcctgctttgttt

SEQ ID NO: 748662 - DNA, 22 bp, Artificial Sequence
  chemically synthesized
ttagctttataaacaaagcagg

SEQ ID NO: 748663 - DNA, 22 bp, Artificial Sequence
  chemically synthesized
tagctttataaacaaagcagga

SEQ ID NO: 748664 - DNA, 22 bp, Artificial Sequence
  chemically synthesized
agctttataaacaaagcaggag

SEQ ID NO: 748665 - DNA, 22 bp, Artificial Sequence
  chemically synthesized
gctttataaacaaagcaggaga

SEQ ID NO: 748666 - DNA, 22 bp, Artificial Sequence
  chemically synthesized
tataaacaaagcaggagatgag

SEQ ID NO: 748667 - DNA, 22 bp, Artificial Sequence
  chemically synthesized
ataaacaaagcaggagatgaga

SEQ ID NO: 748668 - DNA, 22 bp, Artificial Sequence
  chemically synthesized
ccatgtattccctctcatctcc

SEQ ID NO: 748669 - DNA, 22 bp, Artificial Sequence
  chemically synthesized
taaacaaagcaggagatgagag

SEQ ID NO: 748670 - DNA, 22 bp, Artificial Sequence
  chemically synthesized
gttaccatgtattccctctcat

SEQ ID NO: 748671 - DNA, 22 bp, Artificial Sequence
  chemically synthesized
agttaccatgtattccctctca

SEQ ID NO: 748672 - DNA, 22 bp, Artificial Sequence
  chemically synthesized
cttagttaccatgtattccctc

SEQ ID NO: 748673 - DNA, 22 bp, Artificial Sequence
  chemically synthesized
ttacttagttaccatgtattcc

SEQ ID NO: 748674 - DNA, 22 bp, Artificial Sequence
  chemically synthesized
attacttagttaccatgtattc

SEQ ID NO: 748675 - DNA, 22 bp, Artificial Sequence
  chemically synthesized
ccaggagagcttattacttagt

SEQ ID NO: 748676 - DNA, 22 bp, Artificial Sequence
  chemically synthesized
gtgttgccaggagagcttatta

SEQ ID NO: 748677 - DNA, 22 bp, Artificial Sequence
  chemically synthesized
taagttagtgttgccaggagag

SEQ ID NO: 748678 - DNA, 22 bp, Artificial Sequence
  chemically synthesized
agtaataagctctcctggcaac

SEQ ID NO: 748679 - DNA, 22 bp, Artificial Sequence
  chemically synthesized
attgtaagttagtgttgccagg

SEQ ID NO: 748680 - DNA, 22 bp, Artificial Sequence
  chemically synthesized
tcctggcaacactaacttacaa

SEQ ID NO: 748681 - DNA, 22 bp, Artificial Sequence
  chemically synthesized
aatgtgaaattaattgtaagtt

SEQ ID NO: 748682 - DNA, 22 bp, Artificial Sequence
  chemically synthesized
ctggcaacactaacttacaatt

SEQ ID NO: 748683 - DNA, 22 bp, Artificial Sequence
  chemically synthesized
ttcaatgtgaaattaattgtaa

SEQ ID NO: 748684 - DNA, 22 bp, Artificial Sequence
  chemically synthesized
gcaacactaacttacaattaat

SEQ ID NO: 748685 - DNA, 22 bp, Artificial Sequence
  chemically synthesized
attcaatgtgaaattaattgta

SEQ ID NO: 748686 - DNA, 22 bp, Artificial Sequence
  chemically synthesized
tttattcaatgtgaaattaatt

SEQ ID NO: 748687 - DNA, 22 bp, Artificial Sequence
  chemically synthesized
acttacaattaatttcacattg

SEQ ID NO: 748688 - DNA, 22 bp, Artificial Sequence
  chemically synthesized
accaaattatttattcaatgtg

SEQ ID NO: 748689 - DNA, 22 bp, Artificial Sequence
  chemically synthesized
acaattaatttcacattgaata

SEQ ID NO: 748690 - DNA, 22 bp, Artificial Sequence
  chemically synthesized
caattaatttcacattgaataa

SEQ ID NO: 748691 - DNA, 22 bp, Artificial Sequence
  chemically synthesized
atttcacattgaataaataatt

SEQ ID NO: 748692 - DNA, 22 bp, Artificial Sequence
  chemically synthesized
cacattgaataaataatttggt

SEQ ID NO: 748693 - DNA, 22 bp, Artificial Sequence
  chemically synthesized
acattgaataaataatttggtc

SEQ ID NO: 748694 - DNA, 22 bp, Artificial Sequence
  chemically synthesized
aataaataatttggtcaggatt

SEQ ID NO: 748695 - DNA, 22 bp, Artificial Sequence
  chemically synthesized
aagtataataataataaaaaaa

SEQ ID NO: 748696 - DNA, 22 bp, Artificial Sequence
  chemically synthesized
ggtcaggattttttttttatta

SEQ ID NO: 748697 - DNA, 22 bp, Artificial Sequence
  chemically synthesized
aaagtataataataataaaaaa

SEQ ID NO: 748698 - DNA, 22 bp, Artificial Sequence
  chemically synthesized
gtcaggattttttttttattat

SEQ ID NO: 748699 - DNA, 22 bp, Artificial Sequence
  chemically synthesized
tttttttattattattatactt

SEQ ID NO: 748700 - DNA, 22 bp, Artificial Sequence
  chemically synthesized
ttttttattattattatacttt

SEQ ID NO: 748701 - DNA, 22 bp, Artificial Sequence
  chemically synthesized
tttttattattattatacttta

SEQ ID NO: 748702 - DNA, 22 bp, Artificial Sequence
  chemically synthesized
ttttattattattatactttaa

SEQ ID NO: 748703 - DNA, 22 bp, Artificial Sequence
  chemically synthesized
tttattattattatactttaag

SEQ ID NO: 748704 - DNA, 22 bp, Artificial Sequence
  chemically synthesized
ttattattattatactttaagt

SEQ ID NO: 748705 - DNA, 22 bp, Artificial Sequence
  chemically synthesized
tattattattatactttaagtt

SEQ ID NO: 748706 - DNA, 22 bp, Artificial Sequence
  chemically synthesized
attattattatactttaagttc

SEQ ID NO: 748707 - DNA, 22 bp, Artificial Sequence
  chemically synthesized
ttattattatactttaagttct

SEQ ID NO: 748708 - DNA, 22 bp, Artificial Sequence
  chemically synthesized
cacatgtatcccagaacttaaa

SEQ ID NO: 748709 - DNA, 22 bp, Artificial Sequence
  chemically synthesized
tgcacatgtatcccagaactta

SEQ ID NO: 748710 - DNA, 22 bp, Artificial Sequence
  chemically synthesized
ttattatactttaagttctggg

SEQ ID NO: 748711 - DNA, 22 bp, Artificial Sequence
  chemically synthesized
ttatactttaagttctgggata

SEQ ID NO: 748712 - DNA, 22 bp, Artificial Sequence
  chemically synthesized
tactttaagttctgggatacat

SEQ ID NO: 748713 - DNA, 22 bp, Artificial Sequence
  chemically synthesized
cacgttctgcacatgtatccca

SEQ ID NO: 748714 - DNA, 22 bp, Artificial Sequence
  chemically synthesized
taagttctgggatacatgtgca

SEQ ID NO: 748715 - DNA, 22 bp, Artificial Sequence
  chemically synthesized
aagttctgggatacatgtgcag

SEQ ID NO: 748716 - DNA, 22 bp, Artificial Sequence
  chemically synthesized
agttctgggatacatgtgcaga

SEQ ID NO: 748717 - DNA, 22 bp, Artificial Sequence
  chemically synthesized
tgggatacatgtgcagaacgtg

SEQ ID NO: 748718 - DNA, 22 bp, Artificial Sequence
  chemically synthesized
tgtaacaaacctgcacgttctg

SEQ ID NO: 748719 - DNA, 22 bp, Artificial Sequence
  chemically synthesized
ggatacatgtgcagaacgtgca

SEQ ID NO: 748720 - DNA, 22 bp, Artificial Sequence
  chemically synthesized
gttacataggtatacacatgcc

SEQ ID NO: 748721 - DNA, 22 bp, Artificial Sequence
  chemically synthesized
ttacataggtatacacatgcca

SEQ ID NO: 748722 - DNA, 22 bp, Artificial Sequence
  chemically synthesized
cataggtatacacatgccatgg

SEQ ID NO: 748723 - DNA, 22 bp, Artificial Sequence
  chemically synthesized
atgggtgcagcaaaccaccatg

SEQ ID NO: 748724 - DNA, 22 bp, Artificial Sequence
  chemically synthesized
atgtagatgacaggttgatggg

SEQ ID NO: 748725 - DNA, 22 bp, Artificial Sequence
  chemically synthesized
gctgcacccatcaacctgtcat

SEQ ID NO: 748726 - DNA, 22 bp, Artificial Sequence
  chemically synthesized
ctgcacccatcaacctgtcatc

SEQ ID NO: 748727 - DNA, 22 bp, Artificial Sequence
  chemically synthesized
cacccatcaacctgtcatctac

SEQ ID NO: 748728 - DNA, 22 bp, Artificial Sequence
  chemically synthesized
tcatctacattaggtatttctc

SEQ ID NO: 748729 - DNA, 22 bp, Artificial Sequence
  chemically synthesized
ggggagggatagcagtaagaga

SEQ ID NO: 748730 - DNA, 22 bp, Artificial Sequence
  chemically synthesized
cattaggtatttctcttactgc

SEQ ID NO: 748731 - DNA, 22 bp, Artificial Sequence
  chemically synthesized
ggtatttctcttactgctatcc

SEQ ID NO: 748732 - DNA, 22 bp, Artificial Sequence
  chemically synthesized
ctcttactgctatccctcccct

SEQ ID NO: 748733 - DNA, 22 bp, Artificial Sequence
  chemically synthesized
tcttactgctatccctccccta

SEQ ID NO: 748734 - DNA, 22 bp, Artificial Sequence
  chemically synthesized
ttactgctatccctcccctaac

SEQ ID NO: 748735 - DNA, 22 bp, Artificial Sequence
  chemically synthesized
actgctatccctcccctaacct

SEQ ID NO: 748736 - DNA, 22 bp, Artificial Sequence
  chemically synthesized
tcgaggggtgggaggttagggg

SEQ ID NO: 748737 - DNA, 22 bp, Artificial Sequence
  chemically synthesized
ctgctatccctcccctaacctc

SEQ ID NO: 748738 - DNA, 22 bp, Artificial Sequence
  chemically synthesized
ctatccctcccctaacctccca

SEQ ID NO: 748739 - DNA, 22 bp, Artificial Sequence
  chemically synthesized
tccctcccctaacctcccaccc

SEQ ID NO: 748740 - DNA, 22 bp, Artificial Sequence
  chemically synthesized
ccctaacctcccacccctcgac

SEQ ID NO: 748741 - DNA, 22 bp, Artificial Sequence
  chemically synthesized
acctcccacccctcgacaggcc

SEQ ID NO: 748742 - DNA, 22 bp, Artificial Sequence
  chemically synthesized
ccacccctcgacaggccccggt

SEQ ID NO: 748743 - DNA, 22 bp, Artificial Sequence
  chemically synthesized
gacaggccccggtgtgtgatgt

SEQ ID NO: 748744 - DNA, 22 bp, Artificial Sequence
  chemically synthesized
aacaacgagagcccatggacac

SEQ ID NO: 748745 - DNA, 22 bp, Artificial Sequence
  chemically synthesized
ccgtccctgtgtccatgggctc

SEQ ID NO: 748746 - DNA, 22 bp, Artificial Sequence
  chemically synthesized
tgtccatgggctctcgttgttc

SEQ ID NO: 748747 - DNA, 22 bp, Artificial Sequence
  chemically synthesized
gtaagtgggagttgaacaacga

SEQ ID NO: 748748 - DNA, 22 bp, Artificial Sequence
  chemically synthesized
actcgtaagtgggagttgaaca

SEQ ID NO: 748749 - DNA, 22 bp, Artificial Sequence
  chemically synthesized
tcactcgtaagtgggagttgaa

SEQ ID NO: 748750 - DNA, 22 bp, Artificial Sequence
  chemically synthesized
tcgttgttcaactcccacttac

SEQ ID NO: 748751 - DNA, 22 bp, Artificial Sequence
  chemically synthesized
gttgttcaactcccacttacga

SEQ ID NO: 748752 - DNA, 22 bp, Artificial Sequence
  chemically synthesized
ttcaactcccacttacgagtga

SEQ ID NO: 748753 - DNA, 22 bp, Artificial Sequence
  chemically synthesized
aactcccacttacgagtgagaa

SEQ ID NO: 748754 - DNA, 22 bp, Artificial Sequence
  chemically synthesized
ccacttacgagtgagaacatgc

SEQ ID NO: 748755 - DNA, 22 bp, Artificial Sequence
  chemically synthesized
acgagtgagaacatgcggtgcc

SEQ ID NO: 748756 - DNA, 22 bp, Artificial Sequence
  chemically synthesized
cgagtgagaacatgcggtgcct

SEQ ID NO: 748757 - DNA, 22 bp, Artificial Sequence
  chemically synthesized
acacaggaacagaaaaccaggc

SEQ ID NO: 748758 - DNA, 22 bp, Artificial Sequence
  chemically synthesized
agcaaactaacacaggaacaga

SEQ ID NO: 748759 - DNA, 22 bp, Artificial Sequence
  chemically synthesized
gttttctgttcctgtgttagtt

SEQ ID NO: 748760 - DNA, 22 bp, Artificial Sequence
  chemically synthesized
tctgttcctgtgttagtttgct

SEQ ID NO: 748761 - DNA, 22 bp, Artificial Sequence
  chemically synthesized
ctgttcctgtgttagtttgctg

SEQ ID NO: 748762 - DNA, 22 bp, Artificial Sequence
  chemically synthesized
tgttcctgtgttagtttgctga

SEQ ID NO: 748763 - DNA, 22 bp, Artificial Sequence
  chemically synthesized
gaagccatcaatctcagcaaac

SEQ ID NO: 748764 - DNA, 22 bp, Artificial Sequence
  chemically synthesized
ttcctgtgttagtttgctgaga

SEQ ID NO: 748765 - DNA, 22 bp, Artificial Sequence
  chemically synthesized
ctgtgttagtttgctgagattg

SEQ ID NO: 748766 - DNA, 22 bp, Artificial Sequence
  chemically synthesized
tgttagtttgctgagattgatg

SEQ ID NO: 748767 - DNA, 22 bp, Artificial Sequence
  chemically synthesized
gtttgctgagattgatggcttc

SEQ ID NO: 748768 - DNA, 22 bp, Artificial Sequence
  chemically synthesized
gctgagattgatggcttccagc

SEQ ID NO: 748769 - DNA, 22 bp, Artificial Sequence
  chemically synthesized
ctgagattgatggcttccagct

SEQ ID NO: 748770 - DNA, 22 bp, Artificial Sequence
  chemically synthesized
agattgatggcttccagcttca

SEQ ID NO: 748771 - DNA, 22 bp, Artificial Sequence
  chemically synthesized
gcagggacatggatgaagctgg

SEQ ID NO: 748772 - DNA, 22 bp, Artificial Sequence
  chemically synthesized
ggcagggacatggatgaagctg

SEQ ID NO: 748773 - DNA, 22 bp, Artificial Sequence
  chemically synthesized
atggcttccagcttcatccatg

SEQ ID NO: 748774 - DNA, 22 bp, Artificial Sequence
  chemically synthesized
atgtccttggcagggacatgga

SEQ ID NO: 748775 - DNA, 22 bp, Artificial Sequence
  chemically synthesized
ccagcttcatccatgtccctgc

SEQ ID NO: 748776 - DNA, 22 bp, Artificial Sequence
  chemically synthesized
cagcttcatccatgtccctgcc

SEQ ID NO: 748777 - DNA, 22 bp, Artificial Sequence
  chemically synthesized
catccatgtccctgccaaggac

SEQ ID NO: 748778 - DNA, 22 bp, Artificial Sequence
  chemically synthesized
atccatgtccctgccaaggaca

SEQ ID NO: 748779 - DNA, 22 bp, Artificial Sequence
  chemically synthesized
ccaaggacatgaactcatcctt

SEQ ID NO: 748780 - DNA, 22 bp, Artificial Sequence
  chemically synthesized
tgcagccataagaaaggatgag

SEQ ID NO: 748781 - DNA, 22 bp, Artificial Sequence
  chemically synthesized
atcctttcttatggctgcatag

SEQ ID NO: 748782 - DNA, 22 bp, Artificial Sequence
  chemically synthesized
tcttatggctgcatagtattcc

SEQ ID NO: 748783 - DNA, 22 bp, Artificial Sequence
  chemically synthesized
cttatggctgcatagtattcca

SEQ ID NO: 748784 - DNA, 22 bp, Artificial Sequence
  chemically synthesized
ttatggctgcatagtattccat

SEQ ID NO: 748785 - DNA, 22 bp, Artificial Sequence
  chemically synthesized
atggctgcatagtattccatgg

SEQ ID NO: 748786 - DNA, 22 bp, Artificial Sequence
  chemically synthesized
tggctgcatagtattccatggt

SEQ ID NO: 748787 - DNA, 22 bp, Artificial Sequence
  chemically synthesized
catagtattccatggtgtatct

SEQ ID NO: 748788 - DNA, 22 bp, Artificial Sequence
  chemically synthesized
gataaagaaaacgtggcacaga

SEQ ID NO: 748789 - DNA, 22 bp, Artificial Sequence
  chemically synthesized
catggtgtatctgtgccacgtt

SEQ ID NO: 748790 - DNA, 22 bp, Artificial Sequence
  chemically synthesized
atcaatgatagactggataaag

SEQ ID NO: 748791 - DNA, 22 bp, Artificial Sequence
  chemically synthesized
tgccacgttttctttatccagt

SEQ ID NO: 748792 - DNA, 22 bp, Artificial Sequence
  chemically synthesized
tctttatccagtctatcattga

SEQ ID NO: 748793 - DNA, 22 bp, Artificial Sequence
  chemically synthesized
ctttatccagtctatcattgat

SEQ ID NO: 748794 - DNA, 22 bp, Artificial Sequence
  chemically synthesized
tttatccagtctatcattgatg

SEQ ID NO: 748795 - DNA, 22 bp, Artificial Sequence
  chemically synthesized
tatccagtctatcattgatgag

SEQ ID NO: 748796 - DNA, 22 bp, Artificial Sequence
  chemically synthesized
atccagtctatcattgatgagc

SEQ ID NO: 748797 - DNA, 22 bp, Artificial Sequence
  chemically synthesized
tccagtctatcattgatgagca

SEQ ID NO: 748798 - DNA, 22 bp, Artificial Sequence
  chemically synthesized
gaaccaacccaaatgctcatca

SEQ ID NO: 748799 - DNA, 22 bp, Artificial Sequence
  chemically synthesized
ggaaccaacccaaatgctcatc

SEQ ID NO: 748800 - DNA, 22 bp, Artificial Sequence
  chemically synthesized
tcattgatgagcatttgggttg

SEQ ID NO: 748801 - DNA, 22 bp, Artificial Sequence
  chemically synthesized
atgagcatttgggttggttcca

SEQ ID NO: 748802 - DNA, 22 bp, Artificial Sequence
  chemically synthesized
acaatagcaaagacttggaacc

SEQ ID NO: 748803 - DNA, 22 bp, Artificial Sequence
  chemically synthesized
ttcacaatagcaaagacttgga

SEQ ID NO: 748804 - DNA, 22 bp, Artificial Sequence
  chemically synthesized
gggttggttccaagtctttgct

SEQ ID NO: 748805 - DNA, 22 bp, Artificial Sequence
  chemically synthesized
ggttggttccaagtctttgcta

SEQ ID NO: 748806 - DNA, 22 bp, Artificial Sequence
  chemically synthesized
cagcactgttcacaatagcaaa

SEQ ID NO: 748807 - DNA, 22 bp, Artificial Sequence
  chemically synthesized
gttccaagtctttgctattgtg

SEQ ID NO: 748808 - DNA, 22 bp, Artificial Sequence
  chemically synthesized
ttgcagcactgttcacaatagc

SEQ ID NO: 748809 - DNA, 22 bp, Artificial Sequence
  chemically synthesized
gttgcagcactgttcacaatag

SEQ ID NO: 748810 - DNA, 22 bp, Artificial Sequence
  chemically synthesized
caagtctttgctattgtgaaca

SEQ ID NO: 748811 - DNA, 22 bp, Artificial Sequence
  chemically synthesized
tgctattgtgaacagtgctgca

SEQ ID NO: 748812 - DNA, 22 bp, Artificial Sequence
  chemically synthesized
gctattgtgaacagtgctgcaa

SEQ ID NO: 748813 - DNA, 22 bp, Artificial Sequence
  chemically synthesized
ctattgtgaacagtgctgcaac

SEQ ID NO: 748814 - DNA, 22 bp, Artificial Sequence
  chemically synthesized
ttgtgaacagtgctgcaacaaa

SEQ ID NO: 748815 - DNA, 22 bp, Artificial Sequence
  chemically synthesized
tgaacagtgctgcaacaaacat

SEQ ID NO: 748816 - DNA, 22 bp, Artificial Sequence
  chemically synthesized
taaagacacatgcacatgtatg

SEQ ID NO: 748817 - DNA, 22 bp, Artificial Sequence
  chemically synthesized
ctataaagacacatgcacatgt

SEQ ID NO: 748818 - DNA, 22 bp, Artificial Sequence
  chemically synthesized
caacaaacatacatgtgcatgt

SEQ ID NO: 748819 - DNA, 22 bp, Artificial Sequence
  chemically synthesized
tactataaagacacatgcacat

SEQ ID NO: 748820 - DNA, 22 bp, Artificial Sequence
  chemically synthesized
taaatcattctactataaagac

SEQ ID NO: 748821 - DNA, 22 bp, Artificial Sequence
  chemically synthesized
tatacccaaaggattataaatc

SEQ ID NO: 748822 - DNA, 22 bp, Artificial Sequence
  chemically synthesized
tatagtagaatgatttataatc

SEQ ID NO: 748823 - DNA, 22 bp, Artificial Sequence
  chemically synthesized
atagtagaatgatttataatcc

SEQ ID NO: 748824 - DNA, 22 bp, Artificial Sequence
  chemically synthesized
tagtagaatgatttataatcct

SEQ ID NO: 748825 - DNA, 22 bp, Artificial Sequence
  chemically synthesized
gttatatacccaaaggattata

SEQ ID NO: 748826 - DNA, 22 bp, Artificial Sequence
  chemically synthesized
ctggttatatacccaaaggatt

SEQ ID NO: 748827 - DNA, 22 bp, Artificial Sequence
  chemically synthesized
ataatcctttgggtatataacc

SEQ ID NO: 748828 - DNA, 22 bp, Artificial Sequence
  chemically synthesized
taatcctttgggtatataacca

SEQ ID NO: 748829 - DNA, 22 bp, Artificial Sequence
  chemically synthesized
atccagcaatcccattactggt

SEQ ID NO: 748830 - DNA, 22 bp, Artificial Sequence
  chemically synthesized
gatccagcaatcccattactgg

SEQ ID NO: 748831 - DNA, 22 bp, Artificial Sequence
  chemically synthesized
tgggtatataaccagtaatggg

SEQ ID NO: 748832 - DNA, 22 bp, Artificial Sequence
  chemically synthesized
gggtatataaccagtaatggga

SEQ ID NO: 748833 - DNA, 22 bp, Artificial Sequence
  chemically synthesized
ggtatataaccagtaatgggat

SEQ ID NO: 748834 - DNA, 22 bp, Artificial Sequence
  chemically synthesized
gaaccagaagtaccatttgatc

SEQ ID NO: 748835 - DNA, 22 bp, Artificial Sequence
  chemically synthesized
ctggatcaaatggtacttctgg

SEQ ID NO: 748836 - DNA, 22 bp, Artificial Sequence
  chemically synthesized
aaggatctagaaccagaagtac

SEQ ID NO: 748837 - DNA, 22 bp, Artificial Sequence
  chemically synthesized
gatcaaatggtacttctggttc

SEQ ID NO: 748838 - DNA, 22 bp, Artificial Sequence
  chemically synthesized
ctcaaggatctagaaccagaag

SEQ ID NO: 748839 - DNA, 22 bp, Artificial Sequence
  chemically synthesized
ctggttctagatccttgaggaa

SEQ ID NO: 748840 - DNA, 22 bp, Artificial Sequence
  chemically synthesized
tggttctagatccttgaggaat

SEQ ID NO: 748841 - DNA, 22 bp, Artificial Sequence
  chemically synthesized
gttctagatccttgaggaattg

SEQ ID NO: 748842 - DNA, 22 bp, Artificial Sequence
  chemically synthesized
tggaagacagtgtggcaattcc

SEQ ID NO: 748843 - DNA, 22 bp, Artificial Sequence
  chemically synthesized
tagatccttgaggaattgccac

SEQ ID NO: 748844 - DNA, 22 bp, Artificial Sequence
  chemically synthesized
gatccttgaggaattgccacac

SEQ ID NO: 748845 - DNA, 22 bp, Artificial Sequence
  chemically synthesized
aaccattgtggaagacagtgtg

SEQ ID NO: 748846 - DNA, 22 bp, Artificial Sequence
  chemically synthesized
gaggaattgccacactgtcttc

SEQ ID NO: 748847 - DNA, 22 bp, Artificial Sequence
  chemically synthesized
aggaattgccacactgtcttcc

SEQ ID NO: 748848 - DNA, 22 bp, Artificial Sequence
  chemically synthesized
gttcaaccattgtggaagacag

SEQ ID NO: 748849 - DNA, 22 bp, Artificial Sequence
  chemically synthesized
ccacactgtcttccacaatggt

SEQ ID NO: 748850 - DNA, 22 bp, Artificial Sequence
  chemically synthesized
tcttccacaatggttgaactaa

SEQ ID NO: 748851 - DNA, 22 bp, Artificial Sequence
  chemically synthesized
gtgggagtgtaaattagttcaa

SEQ ID NO: 748852 - DNA, 22 bp, Artificial Sequence
  chemically synthesized
ccacaatggttgaactaattta

SEQ ID NO: 748853 - DNA, 22 bp, Artificial Sequence
  chemically synthesized
ttggtgggagtgtaaattagtt

SEQ ID NO: 748854 - DNA, 22 bp, Artificial Sequence
  chemically synthesized
cacaatggttgaactaatttac

SEQ ID NO: 748855 - DNA, 22 bp, Artificial Sequence
  chemically synthesized
cactgttggtgggagtgtaaat

SEQ ID NO: 748856 - DNA, 22 bp, Artificial Sequence
  chemically synthesized
acactgttggtgggagtgtaaa

SEQ ID NO: 748857 - DNA, 22 bp, Artificial Sequence
  chemically synthesized
tacactgttggtgggagtgtaa

SEQ ID NO: 748858 - DNA, 22 bp, Artificial Sequence
  chemically synthesized
ttacactgttggtgggagtgta

SEQ ID NO: 748859 - DNA, 22 bp, Artificial Sequence
  chemically synthesized
aactaatttacactcccaccaa

SEQ ID NO: 748860 - DNA, 22 bp, Artificial Sequence
  chemically synthesized
atttacactcccaccaacagtg

SEQ ID NO: 748861 - DNA, 22 bp, Artificial Sequence
  chemically synthesized
acactcccaccaacagtgtaaa

SEQ ID NO: 748862 - DNA, 22 bp, Artificial Sequence
  chemically synthesized
cactcccaccaacagtgtaaaa

SEQ ID NO: 748863 - DNA, 22 bp, Artificial Sequence
  chemically synthesized
ccaccaacagtgtaaaagcaca

SEQ ID NO: 748864 - DNA, 22 bp, Artificial Sequence
  chemically synthesized
gggaagatgtggagaaataggt

SEQ ID NO: 748865 - DNA, 22 bp, Artificial Sequence
  chemically synthesized
tttctccacatcttccccagca

SEQ ID NO: 748866 - DNA, 22 bp, Artificial Sequence
  chemically synthesized
ctccacatcttccccagcacct

SEQ ID NO: 748867 - DNA, 22 bp, Artificial Sequence
  chemically synthesized
tccacatcttccccagcacctg

SEQ ID NO: 748868 - DNA, 22 bp, Artificial Sequence
  chemically synthesized
cacatcttccccagcacctgat

SEQ ID NO: 748869 - DNA, 22 bp, Artificial Sequence
  chemically synthesized
aaaagtcaggaaacatcaggtg

SEQ ID NO: 748870 - DNA, 22 bp, Artificial Sequence
  chemically synthesized
ccccagcacctgatgtttcctg

SEQ ID NO: 748871 - DNA, 22 bp, Artificial Sequence
  chemically synthesized
cccagcacctgatgtttcctga

SEQ ID NO: 748872 - DNA, 22 bp, Artificial Sequence
  chemically synthesized
caatggcgatcattaaaaagtc

SEQ ID NO: 748873 - DNA, 22 bp, Artificial Sequence
  chemically synthesized
atgtttcctgactttttaatga

SEQ ID NO: 748874 - DNA, 22 bp, Artificial Sequence
  chemically synthesized
cctgactttttaatgatcgcca

SEQ ID NO: 748875 - DNA, 22 bp, Artificial Sequence
  chemically synthesized
ctgactttttaatgatcgccat

SEQ ID NO: 748876 - DNA, 22 bp, Artificial Sequence
  chemically synthesized
actttttaatgatcgccattgt

SEQ ID NO: 748877 - DNA, 22 bp, Artificial Sequence
  chemically synthesized
tttaatgatcgccattgtaact

SEQ ID NO: 748878 - DNA, 22 bp, Artificial Sequence
  chemically synthesized
ttaatgatcgccattgtaactg

SEQ ID NO: 748879 - DNA, 22 bp, Artificial Sequence
  chemically synthesized
taatgatcgccattgtaactgg

SEQ ID NO: 748880 - DNA, 22 bp, Artificial Sequence
  chemically synthesized
aatgatcgccattgtaactggt

SEQ ID NO: 748881 - DNA, 22 bp, Artificial Sequence
  chemically synthesized
atgatcgccattgtaactggtg

SEQ ID NO: 748882 - DNA, 22 bp, Artificial Sequence
  chemically synthesized
gagaaatgcaaatcaaaacaca

SEQ ID NO: 748883 - DNA, 22 bp, Artificial Sequence
  chemically synthesized
taactggtgtgttttgatttgc

SEQ ID NO: 748884 - DNA, 22 bp, Artificial Sequence
  chemically synthesized
gtgattagagaaatgcaaatca

SEQ ID NO: 748885 - DNA, 22 bp, Artificial Sequence
  chemically synthesized
gtgtgttttgatttgcatttct

SEQ ID NO: 748886 - DNA, 22 bp, Artificial Sequence
  chemically synthesized
atcatcactggtgattagagaa

SEQ ID NO: 748887 - DNA, 22 bp, Artificial Sequence
  chemically synthesized
tgatttgcatttctctaatcac

SEQ ID NO: 748888 - DNA, 22 bp, Artificial Sequence
  chemically synthesized
gatttgcatttctctaatcacc

SEQ ID NO: 748889 - DNA, 22 bp, Artificial Sequence
  chemically synthesized
atttgcatttctctaatcacca

SEQ ID NO: 748890 - DNA, 22 bp, Artificial Sequence
  chemically synthesized
gcatttctctaatcaccagtga

SEQ ID NO: 748891 - DNA, 22 bp, Artificial Sequence
  chemically synthesized
catttctctaatcaccagtgat

SEQ ID NO: 748892 - DNA, 22 bp, Artificial Sequence
  chemically synthesized
ctctaatcaccagtgatgatga

SEQ ID NO: 748893 - DNA, 22 bp, Artificial Sequence
  chemically synthesized
tctaatcaccagtgatgatgag

SEQ ID NO: 748894 - DNA, 22 bp, Artificial Sequence
  chemically synthesized
taatcaccagtgatgatgagct

SEQ ID NO: 748895 - DNA, 22 bp, Artificial Sequence
  chemically synthesized
atcaccagtgatgatgagcttt

SEQ ID NO: 748896 - DNA, 22 bp, Artificial Sequence
  chemically synthesized
tgcggccaacaaacatgaaaaa

SEQ ID NO: 748897 - DNA, 22 bp, Artificial Sequence
  chemically synthesized
atgcggccaacaaacatgaaaa

SEQ ID NO: 748898 - DNA, 22 bp, Artificial Sequence
  chemically synthesized
tttttcatgtttgttggccgca

SEQ ID NO: 748899 - DNA, 22 bp, Artificial Sequence
  chemically synthesized
ttttcatgtttgttggccgcat

SEQ ID NO: 748900 - DNA, 22 bp, Artificial Sequence
  chemically synthesized
tttcatgtttgttggccgcata

SEQ ID NO: 748901 - DNA, 22 bp, Artificial Sequence
  chemically synthesized
ttcatgtttgttggccgcataa

SEQ ID NO: 748902 - DNA, 22 bp, Artificial Sequence
  chemically synthesized
aaagtaagacatttatgcggcc

SEQ ID NO: 748903 - DNA, 22 bp, Artificial Sequence
  chemically synthesized
tcatgtttgttggccgcataaa

SEQ ID NO: 748904 - DNA, 22 bp, Artificial Sequence
  chemically synthesized
catgtttgttggccgcataaat

SEQ ID NO: 748905 - DNA, 22 bp, Artificial Sequence
  chemically synthesized
tcaaagtaagacatttatgcgg

SEQ ID NO: 748906 - DNA, 22 bp, Artificial Sequence
  chemically synthesized
atgtttgttggccgcataaatg

SEQ ID NO: 748907 - DNA, 22 bp, Artificial Sequence
  chemically synthesized
ctcaaagtaagacatttatgcg

SEQ ID NO: 748908 - DNA, 22 bp, Artificial Sequence
  chemically synthesized
gttggccgcataaatgtcttac

SEQ ID NO: 748909 - DNA, 22 bp, Artificial Sequence
  chemically synthesized
ttggccgcataaatgtcttact

SEQ ID NO: 748910 - DNA, 22 bp, Artificial Sequence
  chemically synthesized
gccgcataaatgtcttactttg

SEQ ID NO: 748911 - DNA, 22 bp, Artificial Sequence
  chemically synthesized
ggcaaaggatatgaacagacac

SEQ ID NO: 748912 - DNA, 22 bp, Artificial Sequence
  chemically synthesized
actttgagaagtgtctgttcat

SEQ ID NO: 748913 - DNA, 22 bp, Artificial Sequence
  chemically synthesized
ctttgagaagtgtctgttcata

SEQ ID NO: 748914 - DNA, 22 bp, Artificial Sequence
  chemically synthesized
tgagaagtgtctgttcatatcc

SEQ ID NO: 748915 - DNA, 22 bp, Artificial Sequence
  chemically synthesized
gagaagtgtctgttcatatcct

SEQ ID NO: 748916 - DNA, 22 bp, Artificial Sequence
  chemically synthesized
agaagtgtctgttcatatcctt

SEQ ID NO: 748917 - DNA, 22 bp, Artificial Sequence
  chemically synthesized
atcaaaaattgggcaaaggata

SEQ ID NO: 748918 - DNA, 22 bp, Artificial Sequence
  chemically synthesized
ttcatatcctttgcccaatttt

SEQ ID NO: 748919 - DNA, 22 bp, Artificial Sequence
  chemically synthesized
atatcctttgcccaatttttga

SEQ ID NO: 748920 - DNA, 22 bp, Artificial Sequence
  chemically synthesized
caagaaaaaacctaatcaaaaa

SEQ ID NO: 748921 - DNA, 22 bp, Artificial Sequence
  chemically synthesized
acaagaaaaaacctaatcaaaa

SEQ ID NO: 748922 - DNA, 22 bp, Artificial Sequence
  chemically synthesized
tgcccaatttttgattaggttt

SEQ ID NO: 748923 - DNA, 22 bp, Artificial Sequence
  chemically synthesized
gcccaatttttgattaggtttt

SEQ ID NO: 748924 - DNA, 22 bp, Artificial Sequence
  chemically synthesized
cccaatttttgattaggttttt

SEQ ID NO: 748925 - DNA, 22 bp, Artificial Sequence
  chemically synthesized
aacaaatttacaagaaaaaacc

SEQ ID NO: 748926 - DNA, 22 bp, Artificial Sequence
  chemically synthesized
aaacaaatttacaagaaaaaac

SEQ ID NO: 748927 - DNA, 22 bp, Artificial Sequence
  chemically synthesized
ttgattaggttttttcttgtaa

SEQ ID NO: 748928 - DNA, 22 bp, Artificial Sequence
  chemically synthesized
tgattaggttttttcttgtaaa

SEQ ID NO: 748929 - DNA, 22 bp, Artificial Sequence
  chemically synthesized
gattaggttttttcttgtaaat

SEQ ID NO: 748930 - DNA, 22 bp, Artificial Sequence
  chemically synthesized
attaggttttttcttgtaaatt

SEQ ID NO: 748931 - DNA, 22 bp, Artificial Sequence
  chemically synthesized
caaggaacttaaacaaatttac

SEQ ID NO: 748932 - DNA, 22 bp, Artificial Sequence
  chemically synthesized
ggttttttcttgtaaatttgtt

SEQ ID NO: 748933 - DNA, 22 bp, Artificial Sequence
  chemically synthesized
tttcttgtaaatttgtttaagt

SEQ ID NO: 748934 - DNA, 22 bp, Artificial Sequence
  chemically synthesized
ttcttgtaaatttgtttaagtt

SEQ ID NO: 748935 - DNA, 22 bp, Artificial Sequence
  chemically synthesized
tcttgtaaatttgtttaagttc

SEQ ID NO: 748936 - DNA, 22 bp, Artificial Sequence
  chemically synthesized
cttgtaaatttgtttaagttcc

SEQ ID NO: 748937 - DNA, 22 bp, Artificial Sequence
  chemically synthesized
ttgtaaatttgtttaagttcct

SEQ ID NO: 748938 - DNA, 22 bp, Artificial Sequence
  chemically synthesized
gtaaatttgtttaagttccttg

SEQ ID NO: 748939 - DNA, 22 bp, Artificial Sequence
  chemically synthesized
taaatttgtttaagttccttgt

SEQ ID NO: 748940 - DNA, 22 bp, Artificial Sequence
  chemically synthesized
atatccagaatctacaaggaac

SEQ ID NO: 748941 - DNA, 22 bp, Artificial Sequence
  chemically synthesized
gtttaagttccttgtagattct

SEQ ID NO: 748942 - DNA, 22 bp, Artificial Sequence
  chemically synthesized
tttaagttccttgtagattctg

SEQ ID NO: 748943 - DNA, 22 bp, Artificial Sequence
  chemically synthesized
aagttccttgtagattctggat

SEQ ID NO: 748944 - DNA, 22 bp, Artificial Sequence
  chemically synthesized
agttccttgtagattctggata

SEQ ID NO: 748945 - DNA, 22 bp, Artificial Sequence
  chemically synthesized
acaaagggctgatatccagaat

SEQ ID NO: 748946 - DNA, 22 bp, Artificial Sequence
  chemically synthesized
cttgtagattctggatatcagc

SEQ ID NO: 748947 - DNA, 22 bp, Artificial Sequence
  chemically synthesized
atctgacaaagggctgatatcc

SEQ ID NO: 748948 - DNA, 22 bp, Artificial Sequence
  chemically synthesized
gtagattctggatatcagccct

SEQ ID NO: 748949 - DNA, 22 bp, Artificial Sequence
  chemically synthesized
ttcatctgacaaagggctgata

SEQ ID NO: 748950 - DNA, 22 bp, Artificial Sequence
  chemically synthesized
tagattctggatatcagccctt

SEQ ID NO: 748951 - DNA, 22 bp, Artificial Sequence
  chemically synthesized
ccatctattcatctgacaaagg

SEQ ID NO: 748952 - DNA, 22 bp, Artificial Sequence
  chemically synthesized
tggatatcagccctttgtcaga

SEQ ID NO: 748953 - DNA, 22 bp, Artificial Sequence
  chemically synthesized
gccatctattcatctgacaaag

SEQ ID NO: 748954 - DNA, 22 bp, Artificial Sequence
  chemically synthesized
gatatcagccctttgtcagatg

SEQ ID NO: 748955 - DNA, 22 bp, Artificial Sequence
  chemically synthesized
tgtcagatgaatagatggcaaa

SEQ ID NO: 748956 - DNA, 22 bp, Artificial Sequence
  chemically synthesized
gtcagatgaatagatggcaaac

SEQ ID NO: 748957 - DNA, 22 bp, Artificial Sequence
  chemically synthesized
tcagatgaatagatggcaaaca

SEQ ID NO: 748958 - DNA, 22 bp, Artificial Sequence
  chemically synthesized
cagaatgggagaaaatgtttgc

SEQ ID NO: 748959 - DNA, 22 bp, Artificial Sequence
  chemically synthesized
tctcccattctgtaggttgctt

SEQ ID NO: 748960 - DNA, 22 bp, Artificial Sequence
  chemically synthesized
ctcccattctgtaggttgcttg

SEQ ID NO: 748961 - DNA, 22 bp, Artificial Sequence
  chemically synthesized
tcccattctgtaggttgcttgt

SEQ ID NO: 748962 - DNA, 22 bp, Artificial Sequence
  chemically synthesized
tcatcagagtgaacaagcaacc

SEQ ID NO: 748963 - DNA, 22 bp, Artificial Sequence
  chemically synthesized
ccattctgtaggttgcttgttc

SEQ ID NO: 748964 - DNA, 22 bp, Artificial Sequence
  chemically synthesized
tgtaggttgcttgttcactctg

SEQ ID NO: 748965 - DNA, 22 bp, Artificial Sequence
  chemically synthesized
taggttgcttgttcactctgat

SEQ ID NO: 748966 - DNA, 22 bp, Artificial Sequence
  chemically synthesized
cttgttcactctgatgatagtt

SEQ ID NO: 748967 - DNA, 22 bp, Artificial Sequence
  chemically synthesized
cacagcaaaagaaactatcatc

SEQ ID NO: 748968 - DNA, 22 bp, Artificial Sequence
  chemically synthesized
tgcacagcaaaagaaactatca

SEQ ID NO: 748969 - DNA, 22 bp, Artificial Sequence
  chemically synthesized
gttcactctgatgatagtttct

SEQ ID NO: 748970 - DNA, 22 bp, Artificial Sequence
  chemically synthesized
ctgcacagcaaaagaaactatc

SEQ ID NO: 748971 - DNA, 22 bp, Artificial Sequence
  chemically synthesized
ttcactctgatgatagtttctt

SEQ ID NO: 748972 - DNA, 22 bp, Artificial Sequence
  chemically synthesized
actctgatgatagtttcttttg

SEQ ID NO: 748973 - DNA, 22 bp, Artificial Sequence
  chemically synthesized
tgatgatagtttcttttgctgt

SEQ ID NO: 748974 - DNA, 22 bp, Artificial Sequence
  chemically synthesized
aagagcttctgcacagcaaaag

SEQ ID NO: 748975 - DNA, 22 bp, Artificial Sequence
  chemically synthesized
atgatagtttcttttgctgtgc

SEQ ID NO: 748976 - DNA, 22 bp, Artificial Sequence
  chemically synthesized
aactaaagagcttctgcacagc

SEQ ID NO: 748977 - DNA, 22 bp, Artificial Sequence
  chemically synthesized
attaaactaaagagcttctgca

SEQ ID NO: 748978 - DNA, 22 bp, Artificial Sequence
  chemically synthesized
cttttgctgtgcagaagctctt

SEQ ID NO: 748979 - DNA, 22 bp, Artificial Sequence
  chemically synthesized
ttttgctgtgcagaagctcttt

SEQ ID NO: 748980 - DNA, 22 bp, Artificial Sequence
  chemically synthesized
ttgctgtgcagaagctctttag

SEQ ID NO: 748981 - DNA, 22 bp, Artificial Sequence
  chemically synthesized
tgctgtgcagaagctctttagt

SEQ ID NO: 748982 - DNA, 22 bp, Artificial Sequence
  chemically synthesized
gctgtgcagaagctctttagtt

SEQ ID NO: 748983 - DNA, 22 bp, Artificial Sequence
  chemically synthesized
ctgtgcagaagctctttagttt

SEQ ID NO: 748984 - DNA, 22 bp, Artificial Sequence
  chemically synthesized
tgcagaagctctttagtttaat

SEQ ID NO: 748985 - DNA, 22 bp, Artificial Sequence
  chemically synthesized
acaaatggaatctaattaaact

SEQ ID NO: 748986 - DNA, 22 bp, Artificial Sequence
  chemically synthesized
tttagtttaattagattccatt

SEQ ID NO: 748987 - DNA, 22 bp, Artificial Sequence
  chemically synthesized
tagtttaattagattccatttg

SEQ ID NO: 748988 - DNA, 22 bp, Artificial Sequence
  chemically synthesized
agtttaattagattccatttgt

SEQ ID NO: 748989 - DNA, 22 bp, Artificial Sequence
  chemically synthesized
gtttaattagattccatttgtc

SEQ ID NO: 748990 - DNA, 22 bp, Artificial Sequence
  chemically synthesized
aattagattccatttgtcaatt

SEQ ID NO: 748991 - DNA, 22 bp, Artificial Sequence
  chemically synthesized
attagattccatttgtcaattt

SEQ ID NO: 748992 - DNA, 22 bp, Artificial Sequence
  chemically synthesized
gattccatttgtcaattttggc

SEQ ID NO: 748993 - DNA, 22 bp, Artificial Sequence
  chemically synthesized
catttgtcaattttggcttttg

SEQ ID NO: 748994 - DNA, 22 bp, Artificial Sequence
  chemically synthesized
gtcaattttggcttttgttgcc

SEQ ID NO: 748995 - DNA, 22 bp, Artificial Sequence
  chemically synthesized
tcaattttggcttttgttgcca

SEQ ID NO: 748996 - DNA, 22 bp, Artificial Sequence
  chemically synthesized
aaacaccaaaagcaatggcaac

SEQ ID NO: 748997 - DNA, 22 bp, Artificial Sequence
  chemically synthesized
tggcttttgttgccattgcttt

SEQ ID NO: 748998 - DNA, 22 bp, Artificial Sequence
  chemically synthesized
ggcttttgttgccattgctttt

SEQ ID NO: 748999 - DNA, 22 bp, Artificial Sequence
  chemically synthesized
gcttttgttgccattgcttttg

SEQ ID NO: 749000 - DNA, 22 bp, Artificial Sequence
  chemically synthesized
acgactaaaacaccaaaagcaa

SEQ ID NO: 749001 - DNA, 22 bp, Artificial Sequence
  chemically synthesized
cacgactaaaacaccaaaagca

SEQ ID NO: 749002 - DNA, 22 bp, Artificial Sequence
  chemically synthesized
ttgttgccattgcttttggtgt

SEQ ID NO: 749003 - DNA, 22 bp, Artificial Sequence
  chemically synthesized
tgttgccattgcttttggtgtt

SEQ ID NO: 749004 - DNA, 22 bp, Artificial Sequence
  chemically synthesized
gttgccattgcttttggtgttt

SEQ ID NO: 749005 - DNA, 22 bp, Artificial Sequence
  chemically synthesized
ttgccattgcttttggtgtttt

SEQ ID NO: 749006 - DNA, 22 bp, Artificial Sequence
  chemically synthesized
ccattgcttttggtgttttagt

SEQ ID NO: 749007 - DNA, 22 bp, Artificial Sequence
  chemically synthesized
cttttggtgttttagtcgtgaa

SEQ ID NO: 749008 - DNA, 22 bp, Artificial Sequence
  chemically synthesized
ttggtgttttagtcgtgaagtc

SEQ ID NO: 749009 - DNA, 22 bp, Artificial Sequence
  chemically synthesized
tggtgttttagtcgtgaagtct

SEQ ID NO: 749010 - DNA, 22 bp, Artificial Sequence
  chemically synthesized
ggtgttttagtcgtgaagtctt

SEQ ID NO: 749011 - DNA, 22 bp, Artificial Sequence
  chemically synthesized
gtgttttagtcgtgaagtcttt

SEQ ID NO: 749012 - DNA, 22 bp, Artificial Sequence
  chemically synthesized
aggatataggcatgggcaaaga

SEQ ID NO: 749013 - DNA, 22 bp, Artificial Sequence
  chemically synthesized
tagtcgtgaagtctttgcccat

SEQ ID NO: 749014 - DNA, 22 bp, Artificial Sequence
  chemically synthesized
agtcgtgaagtctttgcccatg

SEQ ID NO: 749015 - DNA, 22 bp, Artificial Sequence
  chemically synthesized
gtcgtgaagtctttgcccatgc

SEQ ID NO: 749016 - DNA, 22 bp, Artificial Sequence
  chemically synthesized
ggcaataccattcaggatatag

SEQ ID NO: 749017 - DNA, 22 bp, Artificial Sequence
  chemically synthesized
tgcccatgcctatatcctgaat

SEQ ID NO: 749018 - DNA, 22 bp, Artificial Sequence
  chemically synthesized
gcccatgcctatatcctgaatg

SEQ ID NO: 749019 - DNA, 22 bp, Artificial Sequence
  chemically synthesized
cccatgcctatatcctgaatgg

SEQ ID NO: 749020 - DNA, 22 bp, Artificial Sequence
  chemically synthesized
gaagaaaacctaggcaatacca

SEQ ID NO: 749021 - DNA, 22 bp, Artificial Sequence
  chemically synthesized
tatcctgaatggtattgcctag

SEQ ID NO: 749022 - DNA, 22 bp, Artificial Sequence
  chemically synthesized
aatggtattgcctaggttttct

SEQ ID NO: 749023 - DNA, 22 bp, Artificial Sequence
  chemically synthesized
aaaccataaaaaccctagaaga

SEQ ID NO: 749024 - DNA, 22 bp, Artificial Sequence
  chemically synthesized
cctaggttttcttctagggttt

SEQ ID NO: 749025 - DNA, 22 bp, Artificial Sequence
  chemically synthesized
ggttttcttctagggtttttat

SEQ ID NO: 749026 - DNA, 22 bp, Artificial Sequence
  chemically synthesized
tcttctagggtttttatggttt

SEQ ID NO: 749027 - DNA, 22 bp, Artificial Sequence
  chemically synthesized
cttctagggtttttatggtttt

SEQ ID NO: 749028 - DNA, 22 bp, Artificial Sequence
  chemically synthesized
aacataaaacctaaaaccataa

SEQ ID NO: 749029 - DNA, 22 bp, Artificial Sequence
  chemically synthesized
ttctagggtttttatggtttta

SEQ ID NO: 749030 - DNA, 22 bp, Artificial Sequence
  chemically synthesized
aaacataaaacctaaaaccata

SEQ ID NO: 749031 - DNA, 22 bp, Artificial Sequence
  chemically synthesized
ctagggtttttatggttttagg

SEQ ID NO: 749032 - DNA, 22 bp, Artificial Sequence
  chemically synthesized
tagggtttttatggttttaggt

SEQ ID NO: 749033 - DNA, 22 bp, Artificial Sequence
  chemically synthesized
gggtttttatggttttaggttt

SEQ ID NO: 749034 - DNA, 22 bp, Artificial Sequence
  chemically synthesized
aagacttaaacataaaacctaa

SEQ ID NO: 749035 - DNA, 22 bp, Artificial Sequence
  chemically synthesized
ttatggttttaggttttatgtt

SEQ ID NO: 749036 - DNA, 22 bp, Artificial Sequence
  chemically synthesized
actcaagacttaaacataaaac

SEQ ID NO: 749037 - DNA, 22 bp, Artificial Sequence
  chemically synthesized
tatggttttaggttttatgttt

SEQ ID NO: 749038 - DNA, 22 bp, Artificial Sequence
  chemically synthesized
atggttttaggttttatgttta

SEQ ID NO: 749039 - DNA, 22 bp, Artificial Sequence
  chemically synthesized
tggttttaggttttatgtttaa

SEQ ID NO: 749040 - DNA, 22 bp, Artificial Sequence
  chemically synthesized
taggttttatgtttaagtcttg

SEQ ID NO: 749041 - DNA, 22 bp, Artificial Sequence
  chemically synthesized
aggttttatgtttaagtcttga

SEQ ID NO: 749042 - DNA, 22 bp, Artificial Sequence
  chemically synthesized
ggttttatgtttaagtcttgag

SEQ ID NO: 749043 - DNA, 22 bp, Artificial Sequence
  chemically synthesized
tacaaaaattaactcaagactt

SEQ ID NO: 749044 - DNA, 22 bp, Artificial Sequence
  chemically synthesized
atacaaaaattaactcaagact

SEQ ID NO: 749045 - DNA, 22 bp, Artificial Sequence
  chemically synthesized
tatgtttaagtcttgagttaat

SEQ ID NO: 749046 - DNA, 22 bp, Artificial Sequence
  chemically synthesized
atgtttaagtcttgagttaatt

SEQ ID NO: 749047 - DNA, 22 bp, Artificial Sequence
  chemically synthesized
tgtttaagtcttgagttaattt

SEQ ID NO: 749048 - DNA, 22 bp, Artificial Sequence
  chemically synthesized
caccttatacaaaaattaactc

SEQ ID NO: 749049 - DNA, 22 bp, Artificial Sequence
  chemically synthesized
acaccttatacaaaaattaact

SEQ ID NO: 749050 - DNA, 22 bp, Artificial Sequence
  chemically synthesized
cttacaccttatacaaaaatta

SEQ ID NO: 749051 - DNA, 22 bp, Artificial Sequence
  chemically synthesized
aagtcttgagttaatttttgta

SEQ ID NO: 749052 - DNA, 22 bp, Artificial Sequence
  chemically synthesized
ccttacaccttatacaaaaatt

SEQ ID NO: 749053 - DNA, 22 bp, Artificial Sequence
  chemically synthesized
agtcttgagttaatttttgtat

SEQ ID NO: 749054 - DNA, 22 bp, Artificial Sequence
  chemically synthesized
gagttaatttttgtataaggtg

SEQ ID NO: 749055 - DNA, 22 bp, Artificial Sequence
  chemically synthesized
agttaatttttgtataaggtgt

SEQ ID NO: 749056 - DNA, 22 bp, Artificial Sequence
  chemically synthesized
gaccccttccttacaccttata

SEQ ID NO: 749057 - DNA, 22 bp, Artificial Sequence
  chemically synthesized
atttttgtataaggtgtaagga

SEQ ID NO: 749058 - DNA, 22 bp, Artificial Sequence
  chemically synthesized
aaactggaccccttccttacac

SEQ ID NO: 749059 - DNA, 22 bp, Artificial Sequence
  chemically synthesized
ttgtataaggtgtaaggaaggg

SEQ ID NO: 749060 - DNA, 22 bp, Artificial Sequence
  chemically synthesized
tgtataaggtgtaaggaagggg

SEQ ID NO: 749061 - DNA, 22 bp, Artificial Sequence
  chemically synthesized
gtataaggtgtaaggaaggggt

SEQ ID NO: 749062 - DNA, 22 bp, Artificial Sequence
  chemically synthesized
tataaggtgtaaggaaggggtc

SEQ ID NO: 749063 - DNA, 22 bp, Artificial Sequence
  chemically synthesized
cagaaaactgaaactggacccc

SEQ ID NO: 749064 - DNA, 22 bp, Artificial Sequence
  chemically synthesized
gccatctacagaaaactgaaac

SEQ ID NO: 749065 - DNA, 22 bp, Artificial Sequence
  chemically synthesized
ggtaaaccggctagccatctac

SEQ ID NO: 749066 - DNA, 22 bp, Artificial Sequence
  chemically synthesized
cagttttctgtagatggctagc

SEQ ID NO: 749067 - DNA, 22 bp, Artificial Sequence
  chemically synthesized
agttttctgtagatggctagcc

SEQ ID NO: 749068 - DNA, 22 bp, Artificial Sequence
  chemically synthesized
tctgtagatggctagccggttt

SEQ ID NO: 749069 - DNA, 22 bp, Artificial Sequence
  chemically synthesized
ctgtagatggctagccggttta

SEQ ID NO: 749070 - DNA, 22 bp, Artificial Sequence
  chemically synthesized
tgtagatggctagccggtttac

SEQ ID NO: 749071 - DNA, 22 bp, Artificial Sequence
  chemically synthesized
tagatggctagccggtttaccc

SEQ ID NO: 749072 - DNA, 22 bp, Artificial Sequence
  chemically synthesized
agtaaatggtgctgggtaaacc

SEQ ID NO: 749073 - DNA, 22 bp, Artificial Sequence
  chemically synthesized
ttcagtaaatggtgctgggtaa

SEQ ID NO: 749074 - DNA, 22 bp, Artificial Sequence
  chemically synthesized
cctattcagtaaatggtgctgg

SEQ ID NO: 749075 - DNA, 22 bp, Artificial Sequence
  chemically synthesized
gccggtttacccagcaccattt

SEQ ID NO: 749076 - DNA, 22 bp, Artificial Sequence
  chemically synthesized
acccagcaccatttactgaata

SEQ ID NO: 749077 - DNA, 22 bp, Artificial Sequence
  chemically synthesized
cccagcaccatttactgaatag

SEQ ID NO: 749078 - DNA, 22 bp, Artificial Sequence
  chemically synthesized
actgaatagggaatcctttctc

SEQ ID NO: 749079 - DNA, 22 bp, Artificial Sequence
  chemically synthesized
ctgaatagggaatcctttctcc

SEQ ID NO: 749080 - DNA, 22 bp, Artificial Sequence
  chemically synthesized
aatagggaatcctttctccatt

SEQ ID NO: 749081 - DNA, 22 bp, Artificial Sequence
  chemically synthesized
acaaaaacaagcaatggagaaa

SEQ ID NO: 749082 - DNA, 22 bp, Artificial Sequence
  chemically synthesized
acaaacctgacaaaaacaagca

SEQ ID NO: 749083 - DNA, 22 bp, Artificial Sequence
  chemically synthesized
gacaaacctgacaaaaacaagc

SEQ ID NO: 749084 - DNA, 22 bp, Artificial Sequence
  chemically synthesized
tgacaaacctgacaaaaacaag

SEQ ID NO: 749085 - DNA, 22 bp, Artificial Sequence
  chemically synthesized
tctccattgcttgtttttgtca

SEQ ID NO: 749086 - DNA, 22 bp, Artificial Sequence
  chemically synthesized
ctccattgcttgtttttgtcag

SEQ ID NO: 749087 - DNA, 22 bp, Artificial Sequence
  chemically synthesized
tccattgcttgtttttgtcagg

SEQ ID NO: 749088 - DNA, 22 bp, Artificial Sequence
  chemically synthesized
atctttgacaaacctgacaaaa

SEQ ID NO: 749089 - DNA, 22 bp, Artificial Sequence
  chemically synthesized
cattgcttgtttttgtcaggtt

SEQ ID NO: 749090 - DNA, 22 bp, Artificial Sequence
  chemically synthesized
cttgtttttgtcaggtttgtca

SEQ ID NO: 749091 - DNA, 22 bp, Artificial Sequence
  chemically synthesized
gtttttgtcaggtttgtcaaag

SEQ ID NO: 749092 - DNA, 22 bp, Artificial Sequence
  chemically synthesized
caaccatctgatctttgacaaa

SEQ ID NO: 749093 - DNA, 22 bp, Artificial Sequence
  chemically synthesized
tttttgtcaggtttgtcaaaga

SEQ ID NO: 749094 - DNA, 22 bp, Artificial Sequence
  chemically synthesized
ttgtcaggtttgtcaaagatca

SEQ ID NO: 749095 - DNA, 22 bp, Artificial Sequence
  chemically synthesized
tgtcaggtttgtcaaagatcag

SEQ ID NO: 749096 - DNA, 22 bp, Artificial Sequence
  chemically synthesized
gtcaggtttgtcaaagatcaga

SEQ ID NO: 749097 - DNA, 22 bp, Artificial Sequence
  chemically synthesized
tcaggtttgtcaaagatcagat

SEQ ID NO: 749098 - DNA, 22 bp, Artificial Sequence
  chemically synthesized
gtcaaagatcagatggttgtag

SEQ ID NO: 749099 - DNA, 22 bp, Artificial Sequence
  chemically synthesized
tcaaagatcagatggttgtaga

SEQ ID NO: 749100 - DNA, 22 bp, Artificial Sequence
  chemically synthesized
agaaataatgccacacatctac

SEQ ID NO: 749101 - DNA, 22 bp, Artificial Sequence
  chemically synthesized
tagatgtgtggcattatttctg

SEQ ID NO: 749102 - DNA, 22 bp, Artificial Sequence
  chemically synthesized
tttctgaggcctctgttccatt

SEQ ID NO: 749103 - DNA, 22 bp, Artificial Sequence
  chemically synthesized
ctgaggcctctgttccattggt

SEQ ID NO: 749104 - DNA, 22 bp, Artificial Sequence
  chemically synthesized
tgaggcctctgttccattggtc

SEQ ID NO: 749105 - DNA, 22 bp, Artificial Sequence
  chemically synthesized
aggcctctgttccattggtcta

SEQ ID NO: 749106 - DNA, 22 bp, Artificial Sequence
  chemically synthesized
gtaccaaaacagatatatagac

SEQ ID NO: 749107 - DNA, 22 bp, Artificial Sequence
  chemically synthesized
tgttccattggtctatatatct

SEQ ID NO: 749108 - DNA, 22 bp, Artificial Sequence
  chemically synthesized
ttccattggtctatatatctgt

SEQ ID NO: 749109 - DNA, 22 bp, Artificial Sequence
  chemically synthesized
cattggtctatatatctgtttt

SEQ ID NO: 749110 - DNA, 22 bp, Artificial Sequence
  chemically synthesized
gtctatatatctgttttggtac

SEQ ID NO: 749111 - DNA, 22 bp, Artificial Sequence
  chemically synthesized
tatatctgttttggtaccaata

SEQ ID NO: 749112 - DNA, 22 bp, Artificial Sequence
  chemically synthesized
agtaaccaaaacagtatggtat

SEQ ID NO: 749113 - DNA, 22 bp, Artificial Sequence
  chemically synthesized
ttttggtaccaataccatactg

SEQ ID NO: 749114 - DNA, 22 bp, Artificial Sequence
  chemically synthesized
cagtaaccaaaacagtatggta

SEQ ID NO: 749115 - DNA, 22 bp, Artificial Sequence
  chemically synthesized
tggtaccaataccatactgttt

SEQ ID NO: 749116 - DNA, 22 bp, Artificial Sequence
  chemically synthesized
ggtaccaataccatactgtttt

SEQ ID NO: 749117 - DNA, 22 bp, Artificial Sequence
  chemically synthesized
gtaccaataccatactgttttg

SEQ ID NO: 749118 - DNA, 22 bp, Artificial Sequence
  chemically synthesized
caaggcttcagtaaccaaaaca

SEQ ID NO: 749119 - DNA, 22 bp, Artificial Sequence
  chemically synthesized
tactacaaggcttcagtaacca

SEQ ID NO: 749120 - DNA, 22 bp, Artificial Sequence
  chemically synthesized
aaactatactacaaggcttcag

SEQ ID NO: 749121 - DNA, 22 bp, Artificial Sequence
  chemically synthesized
caaactatactacaaggcttca

SEQ ID NO: 749122 - DNA, 22 bp, Artificial Sequence
  chemically synthesized
ttttggttactgaagccttgta

SEQ ID NO: 749123 - DNA, 22 bp, Artificial Sequence
  chemically synthesized
acttcaaactatactacaaggc

SEQ ID NO: 749124 - DNA, 22 bp, Artificial Sequence
  chemically synthesized
tggttactgaagccttgtagta

SEQ ID NO: 749125 - DNA, 22 bp, Artificial Sequence
  chemically synthesized
ggttactgaagccttgtagtat

SEQ ID NO: 749126 - DNA, 22 bp, Artificial Sequence
  chemically synthesized
gttactgaagccttgtagtata

SEQ ID NO: 749127 - DNA, 22 bp, Artificial Sequence
  chemically synthesized
cctgacttcaaactatactaca

SEQ ID NO: 749128 - DNA, 22 bp, Artificial Sequence
  chemically synthesized
ctgaagccttgtagtatagttt

SEQ ID NO: 749129 - DNA, 22 bp, Artificial Sequence
  chemically synthesized
aagccttgtagtatagtttgaa

SEQ ID NO: 749130 - DNA, 22 bp, Artificial Sequence
  chemically synthesized
gtagtatagtttgaagtcaggt

SEQ ID NO: 749131 - DNA, 22 bp, Artificial Sequence
  chemically synthesized
tagtatagtttgaagtcaggta

SEQ ID NO: 749132 - DNA, 22 bp, Artificial Sequence
  chemically synthesized
gaggcatcatgctacctgactt

SEQ ID NO: 749133 - DNA, 22 bp, Artificial Sequence
  chemically synthesized
gaagtcaggtagcatgatgcct

SEQ ID NO: 749134 - DNA, 22 bp, Artificial Sequence
  chemically synthesized
aagtcaggtagcatgatgcctc

SEQ ID NO: 749135 - DNA, 22 bp, Artificial Sequence
  chemically synthesized
agcaaaaagaacaaagctggag

SEQ ID NO: 749136 - DNA, 22 bp, Artificial Sequence
  chemically synthesized
cagctttgttctttttgcttag

SEQ ID NO: 749137 - DNA, 22 bp, Artificial Sequence
  chemically synthesized
tgttctttttgcttaggattga

SEQ ID NO: 749138 - DNA, 22 bp, Artificial Sequence
  chemically synthesized
gttctttttgcttaggattgac

SEQ ID NO: 749139 - DNA, 22 bp, Artificial Sequence
  chemically synthesized
ttctttttgcttaggattgact

SEQ ID NO: 749140 - DNA, 22 bp, Artificial Sequence
  chemically synthesized
tttttgcttaggattgacttgg

SEQ ID NO: 749141 - DNA, 22 bp, Artificial Sequence
  chemically synthesized
tttgcttaggattgacttggct

SEQ ID NO: 749142 - DNA, 22 bp, Artificial Sequence
  chemically synthesized
ttgcttaggattgacttggcta

SEQ ID NO: 749143 - DNA, 22 bp, Artificial Sequence
  chemically synthesized
tgcttaggattgacttggctat

SEQ ID NO: 749144 - DNA, 22 bp, Artificial Sequence
  chemically synthesized
gcttaggattgacttggctatg

SEQ ID NO: 749145 - DNA, 22 bp, Artificial Sequence
  chemically synthesized
cttaggattgacttggctatgt

SEQ ID NO: 749146 - DNA, 22 bp, Artificial Sequence
  chemically synthesized
aggattgacttggctatgtggg

SEQ ID NO: 749147 - DNA, 22 bp, Artificial Sequence
  chemically synthesized
ggattgacttggctatgtgggc

SEQ ID NO: 749148 - DNA, 22 bp, Artificial Sequence
  chemically synthesized
acttggctatgtgggctctttt

SEQ ID NO: 749149 - DNA, 22 bp, Artificial Sequence
  chemically synthesized
atatggaaccaaaaaagagccc

SEQ ID NO: 749150 - DNA, 22 bp, Artificial Sequence
  chemically synthesized
catatggaaccaaaaaagagcc

SEQ ID NO: 749151 - DNA, 22 bp, Artificial Sequence
  chemically synthesized
ggctatgtgggctcttttttgg

SEQ ID NO: 749152 - DNA, 22 bp, Artificial Sequence
  chemically synthesized
gctatgtgggctcttttttggt

SEQ ID NO: 749153 - DNA, 22 bp, Artificial Sequence
  chemically synthesized
aatttcatatggaaccaaaaaa

SEQ ID NO: 749154 - DNA, 22 bp, Artificial Sequence
  chemically synthesized
aaatttcatatggaaccaaaaa

SEQ ID NO: 749155 - DNA, 22 bp, Artificial Sequence
  chemically synthesized
taaatttcatatggaaccaaaa

SEQ ID NO: 749156 - DNA, 22 bp, Artificial Sequence
  chemically synthesized
tgtgggctcttttttggttcca

SEQ ID NO: 749157 - DNA, 22 bp, Artificial Sequence
  chemically synthesized
ctttaaatttcatatggaacca

SEQ ID NO: 749158 - DNA, 22 bp, Artificial Sequence
  chemically synthesized
ttttttggttccatatgaaatt

SEQ ID NO: 749159 - DNA, 22 bp, Artificial Sequence
  chemically synthesized
ttttggttccatatgaaattta

SEQ ID NO: 749160 - DNA, 22 bp, Artificial Sequence
  chemically synthesized
gaaaaactactttaaatttcat

SEQ ID NO: 749161 - DNA, 22 bp, Artificial Sequence
  chemically synthesized
tttggttccatatgaaatttaa

SEQ ID NO: 749162 - DNA, 22 bp, Artificial Sequence
  chemically synthesized
ttggttccatatgaaatttaaa

SEQ ID NO: 749163 - DNA, 22 bp, Artificial Sequence
  chemically synthesized
tggttccatatgaaatttaaag

SEQ ID NO: 749164 - DNA, 22 bp, Artificial Sequence
  chemically synthesized
ggttccatatgaaatttaaagt

SEQ ID NO: 749165 - DNA, 22 bp, Artificial Sequence
  chemically synthesized
gttccatatgaaatttaaagta

SEQ ID NO: 749166 - DNA, 22 bp, Artificial Sequence
  chemically synthesized
catatgaaatttaaagtagttt

SEQ ID NO: 749167 - DNA, 22 bp, Artificial Sequence
  chemically synthesized
acataattagaaaaactacttt

SEQ ID NO: 749168 - DNA, 22 bp, Artificial Sequence
  chemically synthesized
cacataattagaaaaactactt

SEQ ID NO: 749169 - DNA, 22 bp, Artificial Sequence
  chemically synthesized
ttcacataattagaaaaactac

SEQ ID NO: 749170 - DNA, 22 bp, Artificial Sequence
  chemically synthesized
cttcacataattagaaaaacta

SEQ ID NO: 749171 - DNA, 22 bp, Artificial Sequence
  chemically synthesized
tcttcacataattagaaaaact

SEQ ID NO: 749172 - DNA, 22 bp, Artificial Sequence
  chemically synthesized
actttcttcacataattagaaa

SEQ ID NO: 749173 - DNA, 22 bp, Artificial Sequence
  chemically synthesized
aaagtagtttttctaattatgt

SEQ ID NO: 749174 - DNA, 22 bp, Artificial Sequence
  chemically synthesized
aagtagtttttctaattatgtg

SEQ ID NO: 749175 - DNA, 22 bp, Artificial Sequence
  chemically synthesized
ccattgactttcttcacataat

SEQ ID NO: 749176 - DNA, 22 bp, Artificial Sequence
  chemically synthesized
ttctaattatgtgaagaaagtc

SEQ ID NO: 749177 - DNA, 22 bp, Artificial Sequence
  chemically synthesized
tctaattatgtgaagaaagtca

SEQ ID NO: 749178 - DNA, 22 bp, Artificial Sequence
  chemically synthesized
ctaattatgtgaagaaagtcaa

SEQ ID NO: 749179 - DNA, 22 bp, Artificial Sequence
  chemically synthesized
taattatgtgaagaaagtcaat

SEQ ID NO: 749180 - DNA, 22 bp, Artificial Sequence
  chemically synthesized
catcaagctaccattgactttc

SEQ ID NO: 749181 - DNA, 22 bp, Artificial Sequence
  chemically synthesized
attatgtgaagaaagtcaatgg

SEQ ID NO: 749182 - DNA, 22 bp, Artificial Sequence
  chemically synthesized
tgtgaagaaagtcaatggtagc

SEQ ID NO: 749183 - DNA, 22 bp, Artificial Sequence
  chemically synthesized
aatgcagtctccatcaagctac

SEQ ID NO: 749184 - DNA, 22 bp, Artificial Sequence
  chemically synthesized
tagattcaatgcagtctccatc

SEQ ID NO: 749185 - DNA, 22 bp, Artificial Sequence
  chemically synthesized
atagattcaatgcagtctccat

SEQ ID NO: 749186 - DNA, 22 bp, Artificial Sequence
  chemically synthesized
gatggagactgcattgaatcta

SEQ ID NO: 749187 - DNA, 22 bp, Artificial Sequence
  chemically synthesized
atggagactgcattgaatctat

SEQ ID NO: 749188 - DNA, 22 bp, Artificial Sequence
  chemically synthesized
tccaaagtaatttatagattca

SEQ ID NO: 749189 - DNA, 22 bp, Artificial Sequence
  chemically synthesized
cattgaatctataaattacttt

SEQ ID NO: 749190 - DNA, 22 bp, Artificial Sequence
  chemically synthesized
aatctataaattactttggaca

SEQ ID NO: 749191 - DNA, 22 bp, Artificial Sequence
  chemically synthesized
taaattactttggacagtatgg

SEQ ID NO: 749192 - DNA, 22 bp, Artificial Sequence
  chemically synthesized
ctttggacagtatggccatttt

SEQ ID NO: 749193 - DNA, 22 bp, Artificial Sequence
  chemically synthesized
tggacagtatggccattttcac

SEQ ID NO: 749194 - DNA, 22 bp, Artificial Sequence
  chemically synthesized
ggacagtatggccattttcacg

SEQ ID NO: 749195 - DNA, 22 bp, Artificial Sequence
  chemically synthesized
gacagtatggccattttcacga

SEQ ID NO: 749196 - DNA, 22 bp, Artificial Sequence
  chemically synthesized
atggataggaagaatcaatatc

SEQ ID NO: 749197 - DNA, 22 bp, Artificial Sequence
  chemically synthesized
catgctcatggataggaagaat

SEQ ID NO: 749198 - DNA, 22 bp, Artificial Sequence
  chemically synthesized
tcacgatattgattcttcctat

SEQ ID NO: 749199 - DNA, 22 bp, Artificial Sequence
  chemically synthesized
cacgatattgattcttcctatc

SEQ ID NO: 749200 - DNA, 22 bp, Artificial Sequence
  chemically synthesized
acgatattgattcttcctatcc

SEQ ID NO: 749201 - DNA, 22 bp, Artificial Sequence
  chemically synthesized
attcttcctatccatgagcatg

SEQ ID NO: 749202 - DNA, 22 bp, Artificial Sequence
  chemically synthesized
ttcctatccatgagcatggaat

SEQ ID NO: 749203 - DNA, 22 bp, Artificial Sequence
  chemically synthesized
cctatccatgagcatggaatgt

SEQ ID NO: 749204 - DNA, 22 bp, Artificial Sequence
  chemically synthesized
ctatccatgagcatggaatgtt

SEQ ID NO: 749205 - DNA, 22 bp, Artificial Sequence
  chemically synthesized
tccatgagcatggaatgttctt

SEQ ID NO: 749206 - DNA, 22 bp, Artificial Sequence
  chemically synthesized
ttccatttgtttgtggtgtcct

SEQ ID NO: 749207 - DNA, 22 bp, Artificial Sequence
  chemically synthesized
aaggaaatgagagaggacacca

SEQ ID NO: 749208 - DNA, 22 bp, Artificial Sequence
  chemically synthesized
ccatttgtttgtggtgtcctct

SEQ ID NO: 749209 - DNA, 22 bp, Artificial Sequence
  chemically synthesized
catttgtttgtggtgtcctctc

SEQ ID NO: 749210 - DNA, 22 bp, Artificial Sequence
  chemically synthesized
ctcaaggaaatgagagaggaca

SEQ ID NO: 749211 - DNA, 22 bp, Artificial Sequence
  chemically synthesized
gtttgtggtgtcctctctcatt

SEQ ID NO: 749212 - DNA, 22 bp, Artificial Sequence
  chemically synthesized
tttgtggtgtcctctctcattt

SEQ ID NO: 749213 - DNA, 22 bp, Artificial Sequence
  chemically synthesized
gtggtgtcctctctcatttcct

SEQ ID NO: 749214 - DNA, 22 bp, Artificial Sequence
  chemically synthesized
tggtgtcctctctcatttcctt

SEQ ID NO: 749215 - DNA, 22 bp, Artificial Sequence
  chemically synthesized
caaaccactgctcaaggaaatg

SEQ ID NO: 749216 - DNA, 22 bp, Artificial Sequence
  chemically synthesized
tctcatttccttgagcagtggt

SEQ ID NO: 749217 - DNA, 22 bp, Artificial Sequence
  chemically synthesized
tcatttccttgagcagtggttt

SEQ ID NO: 749218 - DNA, 22 bp, Artificial Sequence
  chemically synthesized
aaggagaactacaaaccactgc

SEQ ID NO: 749219 - DNA, 22 bp, Artificial Sequence
  chemically synthesized
caaggagaactacaaaccactg

SEQ ID NO: 749220 - DNA, 22 bp, Artificial Sequence
  chemically synthesized
atttccttgagcagtggtttgt

SEQ ID NO: 749221 - DNA, 22 bp, Artificial Sequence
  chemically synthesized
ttcaaggagaactacaaaccac

SEQ ID NO: 749222 - DNA, 22 bp, Artificial Sequence
  chemically synthesized
ccttgagcagtggtttgtagtt

SEQ ID NO: 749223 - DNA, 22 bp, Artificial Sequence
  chemically synthesized
cttgagcagtggtttgtagttc

SEQ ID NO: 749224 - DNA, 22 bp, Artificial Sequence
  chemically synthesized
gagcagtggtttgtagttctcc

SEQ ID NO: 749225 - DNA, 22 bp, Artificial Sequence
  chemically synthesized
agcagtggtttgtagttctcct

SEQ ID NO: 749226 - DNA, 22 bp, Artificial Sequence
  chemically synthesized
gtagttctccttgaagaggtct

SEQ ID NO: 749227 - DNA, 22 bp, Artificial Sequence
  chemically synthesized
tagttctccttgaagaggtctt

SEQ ID NO: 749228 - DNA, 22 bp, Artificial Sequence
  chemically synthesized
gaagggatgtgaaagacctctt

SEQ ID NO: 749229 - DNA, 22 bp, Artificial Sequence
  chemically synthesized
agaagggatgtgaaagacctct

SEQ ID NO: 749230 - DNA, 22 bp, Artificial Sequence
  chemically synthesized
tccttgaagaggtctttcacat

SEQ ID NO: 749231 - DNA, 22 bp, Artificial Sequence
  chemically synthesized
cttgaagaggtctttcacatcc

SEQ ID NO: 749232 - DNA, 22 bp, Artificial Sequence
  chemically synthesized
gaagaggtctttcacatccctt

SEQ ID NO: 749233 - DNA, 22 bp, Artificial Sequence
  chemically synthesized
aagaggtctttcacatcccttc

SEQ ID NO: 749234 - DNA, 22 bp, Artificial Sequence
  chemically synthesized
ggaatacaacttagaagggatg

SEQ ID NO: 749235 - DNA, 22 bp, Artificial Sequence
  chemically synthesized
tcacatcccttctaagttgtat

SEQ ID NO: 749236 - DNA, 22 bp, Artificial Sequence
  chemically synthesized
cacatcccttctaagttgtatt

SEQ ID NO: 749237 - DNA, 22 bp, Artificial Sequence
  chemically synthesized
acatcccttctaagttgtattc

SEQ ID NO: 749238 - DNA, 22 bp, Artificial Sequence
  chemically synthesized
aaagagaataaaatacctagga

SEQ ID NO: 749239 - DNA, 22 bp, Artificial Sequence
  chemically synthesized
ctaagttgtattcctaggtatt

SEQ ID NO: 749240 - DNA, 22 bp, Artificial Sequence
  chemically synthesized
caaagagaataaaatacctagg

SEQ ID NO: 749241 - DNA, 22 bp, Artificial Sequence
  chemically synthesized
taagttgtattcctaggtattt

SEQ ID NO: 749242 - DNA, 22 bp, Artificial Sequence
  chemically synthesized
agttgtattcctaggtatttta

SEQ ID NO: 749243 - DNA, 22 bp, Artificial Sequence
  chemically synthesized
cttcaaagagaataaaatacct

SEQ ID NO: 749244 - DNA, 22 bp, Artificial Sequence
  chemically synthesized
tattcctaggtattttattctc

SEQ ID NO: 749245 - DNA, 22 bp, Artificial Sequence
  chemically synthesized
acaattgcttcaaagagaataa

SEQ ID NO: 749246 - DNA, 22 bp, Artificial Sequence
  chemically synthesized
ctaggtattttattctctttga

SEQ ID NO: 749247 - DNA, 22 bp, Artificial Sequence
  chemically synthesized
ggtattttattctctttgaagc

SEQ ID NO: 749248 - DNA, 22 bp, Artificial Sequence
  chemically synthesized
ccattcacaattgcttcaaaga

SEQ ID NO: 749249 - DNA, 22 bp, Artificial Sequence
  chemically synthesized
tattctctttgaagcaattgtg

SEQ ID NO: 749250 - DNA, 22 bp, Artificial Sequence
  chemically synthesized
attctctttgaagcaattgtga

SEQ ID NO: 749251 - DNA, 22 bp, Artificial Sequence
  chemically synthesized
ttctctttgaagcaattgtgaa

SEQ ID NO: 749252 - DNA, 22 bp, Artificial Sequence
  chemically synthesized
tctttgaagcaattgtgaatgg

SEQ ID NO: 749253 - DNA, 22 bp, Artificial Sequence
  chemically synthesized
tttgaagcaattgtgaatggga

SEQ ID NO: 749254 - DNA, 22 bp, Artificial Sequence
  chemically synthesized
tgaagcaattgtgaatgggaat

SEQ ID NO: 749255 - DNA, 22 bp, Artificial Sequence
  chemically synthesized
gaagcaattgtgaatgggaatt

SEQ ID NO: 749256 - DNA, 22 bp, Artificial Sequence
  chemically synthesized
aagcaattgtgaatgggaattc

SEQ ID NO: 749257 - DNA, 22 bp, Artificial Sequence
  chemically synthesized
tgaatgggaattcactcatgat

SEQ ID NO: 749258 - DNA, 22 bp, Artificial Sequence
  chemically synthesized
actcatgatttggcactctctt

SEQ ID NO: 749259 - DNA, 22 bp, Artificial Sequence
  chemically synthesized
atgatttggcactctctttgtc

SEQ ID NO: 749260 - DNA, 22 bp, Artificial Sequence
  chemically synthesized
tacgccaataatagacaaagag

SEQ ID NO: 749261 - DNA, 22 bp, Artificial Sequence
  chemically synthesized
ctatacgccaataatagacaaa

SEQ ID NO: 749262 - DNA, 22 bp, Artificial Sequence
  chemically synthesized
ggcactctctttgtctattatt

SEQ ID NO: 749263 - DNA, 22 bp, Artificial Sequence
  chemically synthesized
gcactctctttgtctattattg

SEQ ID NO: 749264 - DNA, 22 bp, Artificial Sequence
  chemically synthesized
tctttgtctattattggcgtat

SEQ ID NO: 749265 - DNA, 22 bp, Artificial Sequence
  chemically synthesized
tttgtctattattggcgtatag

SEQ ID NO: 749266 - DNA, 22 bp, Artificial Sequence
  chemically synthesized
tgtctattattggcgtatagga

SEQ ID NO: 749267 - DNA, 22 bp, Artificial Sequence
  chemically synthesized
gtctattattggcgtataggaa

SEQ ID NO: 749268 - DNA, 22 bp, Artificial Sequence
  chemically synthesized
tctattattggcgtataggaat

SEQ ID NO: 749269 - DNA, 22 bp, Artificial Sequence
  chemically synthesized
ttattggcgtataggaatgctt

SEQ ID NO: 749270 - DNA, 22 bp, Artificial Sequence
  chemically synthesized
ttggcgtataggaatgcttact

SEQ ID NO: 749271 - DNA, 22 bp, Artificial Sequence
  chemically synthesized
gcgtataggaatgcttactatt

SEQ ID NO: 749272 - DNA, 22 bp, Artificial Sequence
  chemically synthesized
aggatacaaaatcaatgtggaa

SEQ ID NO: 749273 - DNA, 22 bp, Artificial Sequence
  chemically synthesized
actatttttccacattgatttt

SEQ ID NO: 749274 - DNA, 22 bp, Artificial Sequence
  chemically synthesized
ctatttttccacattgattttg

SEQ ID NO: 749275 - DNA, 22 bp, Artificial Sequence
  chemically synthesized
tttttccacattgattttgtat

SEQ ID NO: 749276 - DNA, 22 bp, Artificial Sequence
  chemically synthesized
agcaaagtctcaggatacaaaa

SEQ ID NO: 749277 - DNA, 22 bp, Artificial Sequence
  chemically synthesized
ttccacattgattttgtatcct

SEQ ID NO: 749278 - DNA, 22 bp, Artificial Sequence
  chemically synthesized
cagcaaagtctcaggatacaaa

SEQ ID NO: 749279 - DNA, 22 bp, Artificial Sequence
  chemically synthesized
tccacattgattttgtatcctg

SEQ ID NO: 749280 - DNA, 22 bp, Artificial Sequence
  chemically synthesized
ccacattgattttgtatcctga

SEQ ID NO: 749281 - DNA, 22 bp, Artificial Sequence
  chemically synthesized
cacattgattttgtatcctgag

SEQ ID NO: 749282 - DNA, 22 bp, Artificial Sequence
  chemically synthesized
attttgtatcctgagactttgc

SEQ ID NO: 749283 - DNA, 22 bp, Artificial Sequence
  chemically synthesized
ataagcaacttcagcaaagtct

SEQ ID NO: 749284 - DNA, 22 bp, Artificial Sequence
  chemically synthesized
tgtatcctgagactttgctgaa

SEQ ID NO: 749285 - DNA, 22 bp, Artificial Sequence
  chemically synthesized
gtatcctgagactttgctgaag

SEQ ID NO: 749286 - DNA, 22 bp, Artificial Sequence
  chemically synthesized
tatcctgagactttgctgaagt

SEQ ID NO: 749287 - DNA, 22 bp, Artificial Sequence
  chemically synthesized
agctgataagcaacttcagcaa

SEQ ID NO: 749288 - DNA, 22 bp, Artificial Sequence
  chemically synthesized
aagctgataagcaacttcagca

SEQ ID NO: 749289 - DNA, 22 bp, Artificial Sequence
  chemically synthesized
ttaagctgataagcaacttcag

SEQ ID NO: 749290 - DNA, 22 bp, Artificial Sequence
  chemically synthesized
cttaagctgataagcaacttca

SEQ ID NO: 749291 - DNA, 22 bp, Artificial Sequence
  chemically synthesized
agactttgctgaagttgcttat

SEQ ID NO: 749292 - DNA, 22 bp, Artificial Sequence
  chemically synthesized
tgctgaagttgcttatcagctt

SEQ ID NO: 749293 - DNA, 22 bp, Artificial Sequence
  chemically synthesized
gctgaagttgcttatcagctta

SEQ ID NO: 749294 - DNA, 22 bp, Artificial Sequence
  chemically synthesized
ctgaagttgcttatcagcttaa

SEQ ID NO: 749295 - DNA, 22 bp, Artificial Sequence
  chemically synthesized
aacccaaaatcttcttaagctg

SEQ ID NO: 749296 - DNA, 22 bp, Artificial Sequence
  chemically synthesized
aagttgcttatcagcttaagaa

SEQ ID NO: 749297 - DNA, 22 bp, Artificial Sequence
  chemically synthesized
cttatcagcttaagaagatttt

SEQ ID NO: 749298 - DNA, 22 bp, Artificial Sequence
  chemically synthesized
atcagcttaagaagattttggg

SEQ ID NO: 749299 - DNA, 22 bp, Artificial Sequence
  chemically synthesized
tcagcttaagaagattttgggt

SEQ ID NO: 749300 - DNA, 22 bp, Artificial Sequence
  chemically synthesized
gaaaaccccatcgtctcaaccc

SEQ ID NO: 749301 - DNA, 22 bp, Artificial Sequence
  chemically synthesized
aagaagattttgggttgagacg

SEQ ID NO: 749302 - DNA, 22 bp, Artificial Sequence
  chemically synthesized
agaaaaccccatcgtctcaacc

SEQ ID NO: 749303 - DNA, 22 bp, Artificial Sequence
  chemically synthesized
agaagattttgggttgagacga

SEQ ID NO: 749304 - DNA, 22 bp, Artificial Sequence
  chemically synthesized
tatatttagaaaaccccatcgt

SEQ ID NO: 749305 - DNA, 22 bp, Artificial Sequence
  chemically synthesized
tgggttgagacgatggggtttt

SEQ ID NO: 749306 - DNA, 22 bp, Artificial Sequence
  chemically synthesized
gggttgagacgatggggttttc

SEQ ID NO: 749307 - DNA, 22 bp, Artificial Sequence
  chemically synthesized
ggttgagacgatggggttttct

SEQ ID NO: 749308 - DNA, 22 bp, Artificial Sequence
  chemically synthesized
acatgattgtatatttagaaaa

SEQ ID NO: 749309 - DNA, 22 bp, Artificial Sequence
  chemically synthesized
agacgatggggttttctaaata

SEQ ID NO: 749310 - DNA, 22 bp, Artificial Sequence
  chemically synthesized
cagctgacatgattgtatattt

SEQ ID NO: 749311 - DNA, 22 bp, Artificial Sequence
  chemically synthesized
gcagctgacatgattgtatatt

SEQ ID NO: 749312 - DNA, 22 bp, Artificial Sequence
  chemically synthesized
tttgcagctgacatgattgtat

SEQ ID NO: 749313 - DNA, 22 bp, Artificial Sequence
  chemically synthesized
tgtttgcagctgacatgattgt

SEQ ID NO: 749314 - DNA, 22 bp, Artificial Sequence
  chemically synthesized
tctaaatatacaatcatgtcag

SEQ ID NO: 749315 - DNA, 22 bp, Artificial Sequence
  chemically synthesized
ctaaatatacaatcatgtcagc

SEQ ID NO: 749316 - DNA, 22 bp, Artificial Sequence
  chemically synthesized
tctctgtttgcagctgacatga

SEQ ID NO: 749317 - DNA, 22 bp, Artificial Sequence
  chemically synthesized
taaatatacaatcatgtcagct

SEQ ID NO: 749318 - DNA, 22 bp, Artificial Sequence
  chemically synthesized
aatatacaatcatgtcagctgc

SEQ ID NO: 749319 - DNA, 22 bp, Artificial Sequence
  chemically synthesized
caaacagagacaatctgacttc

SEQ ID NO: 749320 - DNA, 22 bp, Artificial Sequence
  chemically synthesized
aaataggaagagaggaagtcag

SEQ ID NO: 749321 - DNA, 22 bp, Artificial Sequence
  chemically synthesized
acttcctctcttcctatttgaa

SEQ ID NO: 749322 - DNA, 22 bp, Artificial Sequence
  chemically synthesized
cctctcttcctatttgaatacc

SEQ ID NO: 749323 - DNA, 22 bp, Artificial Sequence
  chemically synthesized
ctctcttcctatttgaataccc

SEQ ID NO: 749324 - DNA, 22 bp, Artificial Sequence
  chemically synthesized
tcttcctatttgaatacccttt

SEQ ID NO: 749325 - DNA, 22 bp, Artificial Sequence
  chemically synthesized
ttcctatttgaataccctttat

SEQ ID NO: 749326 - DNA, 22 bp, Artificial Sequence
  chemically synthesized
cctatttgaataccctttattt

SEQ ID NO: 749327 - DNA, 22 bp, Artificial Sequence
  chemically synthesized
ctatttgaataccctttatttc

SEQ ID NO: 749328 - DNA, 22 bp, Artificial Sequence
  chemically synthesized
tttgaataccctttatttcttt

SEQ ID NO: 749329 - DNA, 22 bp, Artificial Sequence
  chemically synthesized
gaataccctttatttctttccc

SEQ ID NO: 749330 - DNA, 22 bp, Artificial Sequence
  chemically synthesized
aataccctttatttctttccct

SEQ ID NO: 749331 - DNA, 22 bp, Artificial Sequence
  chemically synthesized
gccaggacaatcaggcaaggga

SEQ ID NO: 749332 - DNA, 22 bp, Artificial Sequence
  chemically synthesized
ggccaggacaatcaggcaaggg

SEQ ID NO: 749333 - DNA, 22 bp, Artificial Sequence
  chemically synthesized
tggccaggacaatcaggcaagg

SEQ ID NO: 749334 - DNA, 22 bp, Artificial Sequence
  chemically synthesized
tatttctttcccttgcctgatt

SEQ ID NO: 749335 - DNA, 22 bp, Artificial Sequence
  chemically synthesized
atttctttcccttgcctgattg

SEQ ID NO: 749336 - DNA, 22 bp, Artificial Sequence
  chemically synthesized
tttctttcccttgcctgattgt

SEQ ID NO: 749337 - DNA, 22 bp, Artificial Sequence
  chemically synthesized
ctttcccttgcctgattgtcct

SEQ ID NO: 749338 - DNA, 22 bp, Artificial Sequence
  chemically synthesized
gaagttttggccaggacaatca

SEQ ID NO: 749339 - DNA, 22 bp, Artificial Sequence
  chemically synthesized
tttcccttgcctgattgtcctg

SEQ ID NO: 749340 - DNA, 22 bp, Artificial Sequence
  chemically synthesized
tcccttgcctgattgtcctggc

SEQ ID NO: 749341 - DNA, 22 bp, Artificial Sequence
  chemically synthesized
cccttgcctgattgtcctggcc

SEQ ID NO: 749342 - DNA, 22 bp, Artificial Sequence
  chemically synthesized
ccttgcctgattgtcctggcca

SEQ ID NO: 749343 - DNA, 22 bp, Artificial Sequence
  chemically synthesized
gcctgattgtcctggccaaaac

SEQ ID NO: 749344 - DNA, 22 bp, Artificial Sequence
  chemically synthesized
cctgattgtcctggccaaaact

SEQ ID NO: 749345 - DNA, 22 bp, Artificial Sequence
  chemically synthesized
aacataatattggaagttttgg

SEQ ID NO: 749346 - DNA, 22 bp, Artificial Sequence
  chemically synthesized
attgtcctggccaaaacttcca

SEQ ID NO: 749347 - DNA, 22 bp, Artificial Sequence
  chemically synthesized
tcctggccaaaacttccaatat

SEQ ID NO: 749348 - DNA, 22 bp, Artificial Sequence
  chemically synthesized
gtattcaacataatattggaag

SEQ ID NO: 749349 - DNA, 22 bp, Artificial Sequence
  chemically synthesized
gccaaaacttccaatattatgt

SEQ ID NO: 749350 - DNA, 22 bp, Artificial Sequence
  chemically synthesized
ccaccactcgtattcaacataa

SEQ ID NO: 749351 - DNA, 22 bp, Artificial Sequence
  chemically synthesized
tcccaccactcgtattcaacat

SEQ ID NO: 749352 - DNA, 22 bp, Artificial Sequence
  chemically synthesized
ccaatattatgttgaatacgag

SEQ ID NO: 749353 - DNA, 22 bp, Artificial Sequence
  chemically synthesized
caatattatgttgaatacgagt

SEQ ID NO: 749354 - DNA, 22 bp, Artificial Sequence
  chemically synthesized
tgttgaatacgagtggtgggag

SEQ ID NO: 749355 - DNA, 22 bp, Artificial Sequence
  chemically synthesized
aatacgagtggtgggagagggc

SEQ ID NO: 749356 - DNA, 22 bp, Artificial Sequence
  chemically synthesized
aaaaccggcacaagacaaggat

SEQ ID NO: 749357 - DNA, 22 bp, Artificial Sequence
  chemically synthesized
aaaaaccggcacaagacaagga

SEQ ID NO: 749358 - DNA, 22 bp, Artificial Sequence
  chemically synthesized
taaaaaccggcacaagacaagg

SEQ ID NO: 749359 - DNA, 22 bp, Artificial Sequence
  chemically synthesized
cctttaaaaaccggcacaagac

SEQ ID NO: 749360 - DNA, 22 bp, Artificial Sequence
  chemically synthesized
gaagcactccctttaaaaaccg

SEQ ID NO: 749361 - DNA, 22 bp, Artificial Sequence
  chemically synthesized
gtcttgtgccggtttttaaagg

SEQ ID NO: 749362 - DNA, 22 bp, Artificial Sequence
  chemically synthesized
tcttgtgccggtttttaaaggg

SEQ ID NO: 749363 - DNA, 22 bp, Artificial Sequence
  chemically synthesized
gtgccggtttttaaagggagtg

SEQ ID NO: 749364 - DNA, 22 bp, Artificial Sequence
  chemically synthesized
tgccggtttttaaagggagtgc

SEQ ID NO: 749365 - DNA, 22 bp, Artificial Sequence
  chemically synthesized
aatgggcaaaagctggaagcac

SEQ ID NO: 749366 - DNA, 22 bp, Artificial Sequence
  chemically synthesized
ttaaagggagtgcttccagctt

SEQ ID NO: 749367 - DNA, 22 bp, Artificial Sequence
  chemically synthesized
taaagggagtgcttccagcttt

SEQ ID NO: 749368 - DNA, 22 bp, Artificial Sequence
  chemically synthesized
aaagggagtgcttccagctttt

SEQ ID NO: 749369 - DNA, 22 bp, Artificial Sequence
  chemically synthesized
aagggagtgcttccagcttttg

SEQ ID NO: 749370 - DNA, 22 bp, Artificial Sequence
  chemically synthesized
tcatactgaatgggcaaaagct

SEQ ID NO: 749371 - DNA, 22 bp, Artificial Sequence
  chemically synthesized
ccagcttttgcccattcagtat

SEQ ID NO: 749372 - DNA, 22 bp, Artificial Sequence
  chemically synthesized
cagcttttgcccattcagtatg

SEQ ID NO: 749373 - DNA, 22 bp, Artificial Sequence
  chemically synthesized
ttgcccattcagtatgataatg

SEQ ID NO: 749374 - DNA, 22 bp, Artificial Sequence
  chemically synthesized
tgcccattcagtatgataatgg

SEQ ID NO: 749375 - DNA, 22 bp, Artificial Sequence
  chemically synthesized
gcccattcagtatgataatggc

SEQ ID NO: 749376 - DNA, 22 bp, Artificial Sequence
  chemically synthesized
cccattcagtatgataatggct

SEQ ID NO: 749377 - DNA, 22 bp, Artificial Sequence
  chemically synthesized
tgacaaacccacagccattatc

SEQ ID NO: 749378 - DNA, 22 bp, Artificial Sequence
  chemically synthesized
atgacaaacccacagccattat

SEQ ID NO: 749379 - DNA, 22 bp, Artificial Sequence
  chemically synthesized
cttatgacaaacccacagccat

SEQ ID NO: 749380 - DNA, 22 bp, Artificial Sequence
  chemically synthesized
agtatgataatggctgtgggtt

SEQ ID NO: 749381 - DNA, 22 bp, Artificial Sequence
  chemically synthesized
aaaataataagagctacttatg

SEQ ID NO: 749382 - DNA, 22 bp, Artificial Sequence
  chemically synthesized
tgggtttgtcataagtagctct

SEQ ID NO: 749383 - DNA, 22 bp, Artificial Sequence
  chemically synthesized
gtcataagtagctcttattatt

SEQ ID NO: 749384 - DNA, 22 bp, Artificial Sequence
  chemically synthesized
tcataagtagctcttattattt

SEQ ID NO: 749385 - DNA, 22 bp, Artificial Sequence
  chemically synthesized
atggaacgtatctcaaaataat

SEQ ID NO: 749386 - DNA, 22 bp, Artificial Sequence
  chemically synthesized
ggtactgatggaacgtatctca

SEQ ID NO: 749387 - DNA, 22 bp, Artificial Sequence
  chemically synthesized
ttattattttgagatacgttcc

SEQ ID NO: 749388 - DNA, 22 bp, Artificial Sequence
  chemically synthesized
attattttgagatacgttccat

SEQ ID NO: 749389 - DNA, 22 bp, Artificial Sequence
  chemically synthesized
ttattttgagatacgttccatc

SEQ ID NO: 749390 - DNA, 22 bp, Artificial Sequence
  chemically synthesized
ttttgagatacgttccatcagt

SEQ ID NO: 749391 - DNA, 22 bp, Artificial Sequence
  chemically synthesized
aataaattaggtactgatggaa

SEQ ID NO: 749392 - DNA, 22 bp, Artificial Sequence
  chemically synthesized
tcaataaattaggtactgatgg

SEQ ID NO: 749393 - DNA, 22 bp, Artificial Sequence
  chemically synthesized
tgagatacgttccatcagtacc

SEQ ID NO: 749394 - DNA, 22 bp, Artificial Sequence
  chemically synthesized
gagatacgttccatcagtacct

SEQ ID NO: 749395 - DNA, 22 bp, Artificial Sequence
  chemically synthesized
agatacgttccatcagtaccta

SEQ ID NO: 749396 - DNA, 22 bp, Artificial Sequence
  chemically synthesized
aaaactctcaataaattaggta

SEQ ID NO: 749397 - DNA, 22 bp, Artificial Sequence
  chemically synthesized
catcagtacctaatttattgag

SEQ ID NO: 749398 - DNA, 22 bp, Artificial Sequence
  chemically synthesized
atgctaaaaactctcaataaat

SEQ ID NO: 749399 - DNA, 22 bp, Artificial Sequence
  chemically synthesized
catgctaaaaactctcaataaa

SEQ ID NO: 749400 - DNA, 22 bp, Artificial Sequence
  chemically synthesized
aacaccccttcatgctaaaaac

SEQ ID NO: 749401 - DNA, 22 bp, Artificial Sequence
  chemically synthesized
atttattgagagtttttagcat

SEQ ID NO: 749402 - DNA, 22 bp, Artificial Sequence
  chemically synthesized
attgagagtttttagcatgaag

SEQ ID NO: 749403 - DNA, 22 bp, Artificial Sequence
  chemically synthesized
ttgagagtttttagcatgaagg

SEQ ID NO: 749404 - DNA, 22 bp, Artificial Sequence
  chemically synthesized
agagtttttagcatgaaggggt

SEQ ID NO: 749405 - DNA, 22 bp, Artificial Sequence
  chemically synthesized
aataaaattcaacaccccttca

SEQ ID NO: 749406 - DNA, 22 bp, Artificial Sequence
  chemically synthesized
caataaaattcaacaccccttc

SEQ ID NO: 749407 - DNA, 22 bp, Artificial Sequence
  chemically synthesized
ttagcatgaaggggtgttgaat

SEQ ID NO: 749408 - DNA, 22 bp, Artificial Sequence
  chemically synthesized
tagcatgaaggggtgttgaatt

SEQ ID NO: 749409 - DNA, 22 bp, Artificial Sequence
  chemically synthesized
agcatgaaggggtgttgaattt

SEQ ID NO: 749410 - DNA, 22 bp, Artificial Sequence
  chemically synthesized
gcatgaaggggtgttgaatttt

SEQ ID NO: 749411 - DNA, 22 bp, Artificial Sequence
  chemically synthesized
aatagaagcggaaaaggccttc

SEQ ID NO: 749412 - DNA, 22 bp, Artificial Sequence
  chemically synthesized
aattttattgaaggccttttcc

SEQ ID NO: 749413 - DNA, 22 bp, Artificial Sequence
  chemically synthesized
tctcaatagaagcggaaaaggc

SEQ ID NO: 749414 - DNA, 22 bp, Artificial Sequence
  chemically synthesized
tattgaaggccttttccgcttc

SEQ ID NO: 749415 - DNA, 22 bp, Artificial Sequence
  chemically synthesized
attgaaggccttttccgcttct

SEQ ID NO: 749416 - DNA, 22 bp, Artificial Sequence
  chemically synthesized
ttgaaggccttttccgcttcta

SEQ ID NO: 749417 - DNA, 22 bp, Artificial Sequence
  chemically synthesized
aaggccttttccgcttctattg

SEQ ID NO: 749418 - DNA, 22 bp, Artificial Sequence
  chemically synthesized
ttccgcttctattgagataatc

SEQ ID NO: 749419 - DNA, 22 bp, Artificial Sequence
  chemically synthesized
tccgcttctattgagataatca

SEQ ID NO: 749420 - DNA, 22 bp, Artificial Sequence
  chemically synthesized
ccgcttctattgagataatcat

SEQ ID NO: 749421 - DNA, 22 bp, Artificial Sequence
  chemically synthesized
cgcttctattgagataatcatg

SEQ ID NO: 749422 - DNA, 22 bp, Artificial Sequence
  chemically synthesized
ctattgagataatcatgtggtt

SEQ ID NO: 749423 - DNA, 22 bp, Artificial Sequence
  chemically synthesized
tattgagataatcatgtggttt

SEQ ID NO: 749424 - DNA, 22 bp, Artificial Sequence
  chemically synthesized
ttgagataatcatgtggttttt

SEQ ID NO: 749425 - DNA, 22 bp, Artificial Sequence
  chemically synthesized
agataatcatgtggtttttgtc

SEQ ID NO: 749426 - DNA, 22 bp, Artificial Sequence
  chemically synthesized
aacagaaccaatgacaaaaacc

SEQ ID NO: 749427 - DNA, 22 bp, Artificial Sequence
  chemically synthesized
aaacagaaccaatgacaaaaac

SEQ ID NO: 749428 - DNA, 22 bp, Artificial Sequence
  chemically synthesized
ttgtcattggttctgtttaagt

SEQ ID NO: 749429 - DNA, 22 bp, Artificial Sequence
  chemically synthesized
tgtcattggttctgtttaagtg

SEQ ID NO: 749430 - DNA, 22 bp, Artificial Sequence
  chemically synthesized
gtcattggttctgtttaagtga

SEQ ID NO: 749431 - DNA, 22 bp, Artificial Sequence
  chemically synthesized
tcattggttctgtttaagtgat

SEQ ID NO: 749432 - DNA, 22 bp, Artificial Sequence
  chemically synthesized
gttctgtttaagtgatggatta

SEQ ID NO: 749433 - DNA, 22 bp, Artificial Sequence
  chemically synthesized
tgtttaagtgatggattatgtt

SEQ ID NO: 749434 - DNA, 22 bp, Artificial Sequence
  chemically synthesized
tttaagtgatggattatgttta

SEQ ID NO: 749435 - DNA, 22 bp, Artificial Sequence
  chemically synthesized
aagtgatggattatgtttattg

SEQ ID NO: 749436 - DNA, 22 bp, Artificial Sequence
  chemically synthesized
agtgatggattatgtttattga

SEQ ID NO: 749437 - DNA, 22 bp, Artificial Sequence
  chemically synthesized
aacatacagaaatcaataaaca

SEQ ID NO: 749438 - DNA, 22 bp, Artificial Sequence
  chemically synthesized
gttcaacatacagaaatcaata

SEQ ID NO: 749439 - DNA, 22 bp, Artificial Sequence
  chemically synthesized
tgtttattgatttctgtatgtt

SEQ ID NO: 749440 - DNA, 22 bp, Artificial Sequence
  chemically synthesized
attgatttctgtatgttgaacc

SEQ ID NO: 749441 - DNA, 22 bp, Artificial Sequence
  chemically synthesized
ggatgccaggctggttcaacat

SEQ ID NO: 749442 - DNA, 22 bp, Artificial Sequence
  chemically synthesized
ttgatttctgtatgttgaacca

SEQ ID NO: 749443 - DNA, 22 bp, Artificial Sequence
  chemically synthesized
atttctgtatgttgaaccagcc

SEQ ID NO: 749444 - DNA, 22 bp, Artificial Sequence
  chemically synthesized
atccctgggatgccaggctggt

SEQ ID NO: 749445 - DNA, 22 bp, Artificial Sequence
  chemically synthesized
ctgtatgttgaaccagcctggc

SEQ ID NO: 749446 - DNA, 22 bp, Artificial Sequence
  chemically synthesized
catccctgggatgccaggctgg

SEQ ID NO: 749447 - DNA, 22 bp, Artificial Sequence
  chemically synthesized
tgtatgttgaaccagcctggca

SEQ ID NO: 749448 - DNA, 22 bp, Artificial Sequence
  chemically synthesized
tatgttgaaccagcctggcatc

SEQ ID NO: 749449 - DNA, 22 bp, Artificial Sequence
  chemically synthesized
gcttcatccctgggatgccagg

SEQ ID NO: 749450 - DNA, 22 bp, Artificial Sequence
  chemically synthesized
aaccagcctggcatcccaggga

SEQ ID NO: 749451 - DNA, 22 bp, Artificial Sequence
  chemically synthesized
gcatcccagggatgaagccaac

SEQ ID NO: 749452 - DNA, 22 bp, Artificial Sequence
  chemically synthesized
tccagcatgatcaagttggctt

SEQ ID NO: 749453 - DNA, 22 bp, Artificial Sequence
  chemically synthesized
atccagcatgatcaagttggct

SEQ ID NO: 749454 - DNA, 22 bp, Artificial Sequence
  chemically synthesized
gatcatgctggataagcttttt

SEQ ID NO: 749455 - DNA, 22 bp, Artificial Sequence
  chemically synthesized
atcatgctggataagctttttc

SEQ ID NO: 749456 - DNA, 22 bp, Artificial Sequence
  chemically synthesized
gataagctttttcatgtgctgc

SEQ ID NO: 749457 - DNA, 22 bp, Artificial Sequence
  chemically synthesized
gcaaaccgaatccagcagcaca

SEQ ID NO: 749458 - DNA, 22 bp, Artificial Sequence
  chemically synthesized
tttcatgtgctgctggattcgg

SEQ ID NO: 749459 - DNA, 22 bp, Artificial Sequence
  chemically synthesized
ttcatgtgctgctggattcggt

SEQ ID NO: 749460 - DNA, 22 bp, Artificial Sequence
  chemically synthesized
tcatgtgctgctggattcggtt

SEQ ID NO: 749461 - DNA, 22 bp, Artificial Sequence
  chemically synthesized
catgtgctgctggattcggttt

SEQ ID NO: 749462 - DNA, 22 bp, Artificial Sequence
  chemically synthesized
atgtgctgctggattcggtttg

SEQ ID NO: 749463 - DNA, 22 bp, Artificial Sequence
  chemically synthesized
aataaaatactggcaaaccgaa

SEQ ID NO: 749464 - DNA, 22 bp, Artificial Sequence
  chemically synthesized
ctggattcggtttgccagtatt

SEQ ID NO: 749465 - DNA, 22 bp, Artificial Sequence
  chemically synthesized
gattcggtttgccagtatttta

SEQ ID NO: 749466 - DNA, 22 bp, Artificial Sequence
  chemically synthesized
ggtttgccagtattttattgag

SEQ ID NO: 749467 - DNA, 22 bp, Artificial Sequence
  chemically synthesized
gccagtattttattgaggattt

SEQ ID NO: 749468 - DNA, 22 bp, Artificial Sequence
  chemically synthesized
ccagtattttattgaggatttt

SEQ ID NO: 749469 - DNA, 22 bp, Artificial Sequence
  chemically synthesized
atgaacatcaatgcgaaaatcc

SEQ ID NO: 749470 - DNA, 22 bp, Artificial Sequence
  chemically synthesized
tattgaggattttcgcattgat

SEQ ID NO: 749471 - DNA, 22 bp, Artificial Sequence
  chemically synthesized
attgaggattttcgcattgatg

SEQ ID NO: 749472 - DNA, 22 bp, Artificial Sequence
  chemically synthesized
ttgaggattttcgcattgatgt

SEQ ID NO: 749473 - DNA, 22 bp, Artificial Sequence
  chemically synthesized
aggattttcgcattgatgttca

SEQ ID NO: 749474 - DNA, 22 bp, Artificial Sequence
  chemically synthesized
aggccaatatccctgatgaaca

SEQ ID NO: 749475 - DNA, 22 bp, Artificial Sequence
  chemically synthesized
caggccaatatccctgatgaac

SEQ ID NO: 749476 - DNA, 22 bp, Artificial Sequence
  chemically synthesized
tcgcattgatgttcatcaggga

SEQ ID NO: 749477 - DNA, 22 bp, Artificial Sequence
  chemically synthesized
cgcattgatgttcatcagggat

SEQ ID NO: 749478 - DNA, 22 bp, Artificial Sequence
  chemically synthesized
gcattgatgttcatcagggata

SEQ ID NO: 749479 - DNA, 22 bp, Artificial Sequence
  chemically synthesized
atgttcatcagggatattggcc

SEQ ID NO: 749480 - DNA, 22 bp, Artificial Sequence
  chemically synthesized
atcagggatattggcctgaaat

SEQ ID NO: 749481 - DNA, 22 bp, Artificial Sequence
  chemically synthesized
gcagagacacaacagacaaaga

SEQ ID NO: 749482 - DNA, 22 bp, Artificial Sequence
  chemically synthesized
gcctgaaattttctttgtctgt

SEQ ID NO: 749483 - DNA, 22 bp, Artificial Sequence
  chemically synthesized
aaattttctttgtctgttgtgt

SEQ ID NO: 749484 - DNA, 22 bp, Artificial Sequence
  chemically synthesized
tctttgtctgttgtgtctctgc

SEQ ID NO: 749485 - DNA, 22 bp, Artificial Sequence
  chemically synthesized
ctttgtctgttgtgtctctgcc

SEQ ID NO: 749486 - DNA, 22 bp, Artificial Sequence
  chemically synthesized
ataccaaaacctggcagagaca

SEQ ID NO: 749487 - DNA, 22 bp, Artificial Sequence
  chemically synthesized
tttgtctgttgtgtctctgcca

SEQ ID NO: 749488 - DNA, 22 bp, Artificial Sequence
  chemically synthesized
tgtctgttgtgtctctgccagg

SEQ ID NO: 749489 - DNA, 22 bp, Artificial Sequence
  chemically synthesized
gtctgttgtgtctctgccaggt

SEQ ID NO: 749490 - DNA, 22 bp, Artificial Sequence
  chemically synthesized
tctgttgtgtctctgccaggtt

SEQ ID NO: 749491 - DNA, 22 bp, Artificial Sequence
  chemically synthesized
ttgtgtctctgccaggttttgg

SEQ ID NO: 749492 - DNA, 22 bp, Artificial Sequence
  chemically synthesized
tgtctctgccaggttttggtat

SEQ ID NO: 749493 - DNA, 22 bp, Artificial Sequence
  chemically synthesized
tgccaggttttggtatcaggat

SEQ ID NO: 749494 - DNA, 22 bp, Artificial Sequence
  chemically synthesized
tgaggccagcatcatcctgata

SEQ ID NO: 749495 - DNA, 22 bp, Artificial Sequence
  chemically synthesized
ccaggttttggtatcaggatga

SEQ ID NO: 749496 - DNA, 22 bp, Artificial Sequence
  chemically synthesized
atgaggccagcatcatcctgat

SEQ ID NO: 749497 - DNA, 22 bp, Artificial Sequence
  chemically synthesized
tatgaggccagcatcatcctga

SEQ ID NO: 749498 - DNA, 22 bp, Artificial Sequence
  chemically synthesized
ttatgaggccagcatcatcctg

SEQ ID NO: 749499 - DNA, 22 bp, Artificial Sequence
  chemically synthesized
tttatgaggccagcatcatcct

SEQ ID NO: 749500 - DNA, 22 bp, Artificial Sequence
  chemically synthesized
tttttatgaggccagcatcatc

SEQ ID NO: 749501 - DNA, 22 bp, Artificial Sequence
  chemically synthesized
tggtatcaggatgatgctggcc

SEQ ID NO: 749502 - DNA, 22 bp, Artificial Sequence
  chemically synthesized
ggtatcaggatgatgctggcct

SEQ ID NO: 749503 - DNA, 22 bp, Artificial Sequence
  chemically synthesized
actctttttatgaggccagcat

SEQ ID NO: 749504 - DNA, 22 bp, Artificial Sequence
  chemically synthesized
gtatcaggatgatgctggcctc

SEQ ID NO: 749505 - DNA, 22 bp, Artificial Sequence
  chemically synthesized
cctaactctttttatgaggcca

SEQ ID NO: 749506 - DNA, 22 bp, Artificial Sequence
  chemically synthesized
ctccctaactctttttatgagg

SEQ ID NO: 749507 - DNA, 22 bp, Artificial Sequence
  chemically synthesized
gcctcataaaaagagttaggga

SEQ ID NO: 749508 - DNA, 22 bp, Artificial Sequence
  chemically synthesized
ataaaaagagttagggaggagt

SEQ ID NO: 749509 - DNA, 22 bp, Artificial Sequence
  chemically synthesized
aacaataggaaaagagggactc

SEQ ID NO: 749510 - DNA, 22 bp, Artificial Sequence
  chemically synthesized
taaacaataggaaaagagggac

SEQ ID NO: 749511 - DNA, 22 bp, Artificial Sequence
  chemically synthesized
ttctaaacaataggaaaagagg

SEQ ID NO: 749512 - DNA, 22 bp, Artificial Sequence
  chemically synthesized
gggaggagtccctcttttccta

SEQ ID NO: 749513 - DNA, 22 bp, Artificial Sequence
  chemically synthesized
aaactattctaaacaataggaa

SEQ ID NO: 749514 - DNA, 22 bp, Artificial Sequence
  chemically synthesized
tgaaactattctaaacaatagg

SEQ ID NO: 749515 - DNA, 22 bp, Artificial Sequence
  chemically synthesized
ctgaaactattctaaacaatag

SEQ ID NO: 749516 - DNA, 22 bp, Artificial Sequence
  chemically synthesized
cttctgaaactattctaaacaa

SEQ ID NO: 749517 - DNA, 22 bp, Artificial Sequence
  chemically synthesized
ttttcctattgtttagaatagt

SEQ ID NO: 749518 - DNA, 22 bp, Artificial Sequence
  chemically synthesized
ttcctattgtttagaatagttt

SEQ ID NO: 749519 - DNA, 22 bp, Artificial Sequence
  chemically synthesized
tcctattgtttagaatagtttc

SEQ ID NO: 749520 - DNA, 22 bp, Artificial Sequence
  chemically synthesized
cctattgtttagaatagtttca

SEQ ID NO: 749521 - DNA, 22 bp, Artificial Sequence
  chemically synthesized
ctattgtttagaatagtttcag

SEQ ID NO: 749522 - DNA, 22 bp, Artificial Sequence
  chemically synthesized
gtaccattccttctgaaactat

SEQ ID NO: 749523 - DNA, 22 bp, Artificial Sequence
  chemically synthesized
ttgtttagaatagtttcagaag

SEQ ID NO: 749524 - DNA, 22 bp, Artificial Sequence
  chemically synthesized
tttagaatagtttcagaaggaa

SEQ ID NO: 749525 - DNA, 22 bp, Artificial Sequence
  chemically synthesized
agaatagtttcagaaggaatgg

SEQ ID NO: 749526 - DNA, 22 bp, Artificial Sequence
  chemically synthesized
gaatagtttcagaaggaatggt

SEQ ID NO: 749527 - DNA, 22 bp, Artificial Sequence
  chemically synthesized
cagaaggaatggtaccagctcc

SEQ ID NO: 749528 - DNA, 22 bp, Artificial Sequence
  chemically synthesized
agaaggaatggtaccagctcct

SEQ ID NO: 749529 - DNA, 22 bp, Artificial Sequence
  chemically synthesized
ccagaggtacaaagaggagctg

SEQ ID NO: 749530 - DNA, 22 bp, Artificial Sequence
  chemically synthesized
taccagaggtacaaagaggagc

SEQ ID NO: 749531 - DNA, 22 bp, Artificial Sequence
  chemically synthesized
aattctaccagaggtacaaaga

SEQ ID NO: 749532 - DNA, 22 bp, Artificial Sequence
  chemically synthesized
acagctgaattctaccagaggt

SEQ ID NO: 749533 - DNA, 22 bp, Artificial Sequence
  chemically synthesized
ctctttgtacctctggtagaat

SEQ ID NO: 749534 - DNA, 22 bp, Artificial Sequence
  chemically synthesized
tttgtacctctggtagaattca

SEQ ID NO: 749535 - DNA, 22 bp, Artificial Sequence
  chemically synthesized
tgtacctctggtagaattcagc

SEQ ID NO: 749536 - DNA, 22 bp, Artificial Sequence
  chemically synthesized
gtacctctggtagaattcagct

SEQ ID NO: 749537 - DNA, 22 bp, Artificial Sequence
  chemically synthesized
tacctctggtagaattcagctg

SEQ ID NO: 749538 - DNA, 22 bp, Artificial Sequence
  chemically synthesized
tggtagaattcagctgtgaatc

SEQ ID NO: 749539 - DNA, 22 bp, Artificial Sequence
  chemically synthesized
gtagaattcagctgtgaatcca

SEQ ID NO: 749540 - DNA, 22 bp, Artificial Sequence
  chemically synthesized
agctgtgaatccatctgttcct

SEQ ID NO: 749541 - DNA, 22 bp, Artificial Sequence
  chemically synthesized
tgaatccatctgttcctgggct

SEQ ID NO: 749542 - DNA, 22 bp, Artificial Sequence
  chemically synthesized
ccaaccaaaaaaagcccaggaa

SEQ ID NO: 749543 - DNA, 22 bp, Artificial Sequence
  chemically synthesized
atagcctaccaaccaaaaaaag

SEQ ID NO: 749544 - DNA, 22 bp, Artificial Sequence
  chemically synthesized
ttcctgggctttttttggttgg

SEQ ID NO: 749545 - DNA, 22 bp, Artificial Sequence
  chemically synthesized
ctgggctttttttggttggtag

SEQ ID NO: 749546 - DNA, 22 bp, Artificial Sequence
  chemically synthesized
ggctttttttggttggtaggct

SEQ ID NO: 749547 - DNA, 22 bp, Artificial Sequence
  chemically synthesized
aggcagtaattaatagcctacc

SEQ ID NO: 749548 - DNA, 22 bp, Artificial Sequence
  chemically synthesized
tttttggttggtaggctattaa

SEQ ID NO: 749549 - DNA, 22 bp, Artificial Sequence
  chemically synthesized
ttttggttggtaggctattaat

SEQ ID NO: 749550 - DNA, 22 bp, Artificial Sequence
  chemically synthesized
tttggttggtaggctattaatt

SEQ ID NO: 749551 - DNA, 22 bp, Artificial Sequence
  chemically synthesized
ttggttggtaggctattaatta

SEQ ID NO: 749552 - DNA, 22 bp, Artificial Sequence
  chemically synthesized
aaattgaggcagtaattaatag

SEQ ID NO: 749553 - DNA, 22 bp, Artificial Sequence
  chemically synthesized
tggttggtaggctattaattac

SEQ ID NO: 749554 - DNA, 22 bp, Artificial Sequence
  chemically synthesized
ggttggtaggctattaattact

SEQ ID NO: 749555 - DNA, 22 bp, Artificial Sequence
  chemically synthesized
tgaaattgaggcagtaattaat

SEQ ID NO: 749556 - DNA, 22 bp, Artificial Sequence
  chemically synthesized
gttggtaggctattaattactg

SEQ ID NO: 749557 - DNA, 22 bp, Artificial Sequence
  chemically synthesized
gtaggctattaattactgcctc

SEQ ID NO: 749558 - DNA, 22 bp, Artificial Sequence
  chemically synthesized
ttaattactgcctcaatttcag

SEQ ID NO: 749559 - DNA, 22 bp, Artificial Sequence
  chemically synthesized
attactgcctcaatttcagaac

SEQ ID NO: 749560 - DNA, 22 bp, Artificial Sequence
  chemically synthesized
ctgcctcaatttcagaactcgt

SEQ ID NO: 749561 - DNA, 22 bp, Artificial Sequence
  chemically synthesized
aatagaccaataacgagttctg

SEQ ID NO: 749562 - DNA, 22 bp, Artificial Sequence
  chemically synthesized
cctcaatttcagaactcgttat

SEQ ID NO: 749563 - DNA, 22 bp, Artificial Sequence
  chemically synthesized
aatttcagaactcgttattggt

SEQ ID NO: 749564 - DNA, 22 bp, Artificial Sequence
  chemically synthesized
cagaactcgttattggtctatt

SEQ ID NO: 749565 - DNA, 22 bp, Artificial Sequence
  chemically synthesized
agaactcgttattggtctattc

SEQ ID NO: 749566 - DNA, 22 bp, Artificial Sequence
  chemically synthesized
gttattggtctattcagggatt

SEQ ID NO: 749567 - DNA, 22 bp, Artificial Sequence
  chemically synthesized
ttggtctattcagggattcgat

SEQ ID NO: 749568 - DNA, 22 bp, Artificial Sequence
  chemically synthesized
aaccaggaagaaatcgaatccc

SEQ ID NO: 749569 - DNA, 22 bp, Artificial Sequence
  chemically synthesized
gtctattcagggattcgatttc

SEQ ID NO: 749570 - DNA, 22 bp, Artificial Sequence
  chemically synthesized
ttcagggattcgatttcttcct

SEQ ID NO: 749571 - DNA, 22 bp, Artificial Sequence
  chemically synthesized
ccaagactaaaccaggaagaaa

SEQ ID NO: 749572 - DNA, 22 bp, Artificial Sequence
  chemically synthesized
agggattcgatttcttcctggt

SEQ ID NO: 749573 - DNA, 22 bp, Artificial Sequence
  chemically synthesized
gatttcttcctggtttagtctt

SEQ ID NO: 749574 - DNA, 22 bp, Artificial Sequence
  chemically synthesized
cttcctggtttagtcttgggag

SEQ ID NO: 749575 - DNA, 22 bp, Artificial Sequence
  chemically synthesized
gacacatacaccctcccaagac

SEQ ID NO: 749576 - DNA, 22 bp, Artificial Sequence
  chemically synthesized
ttcctggtttagtcttgggagg

SEQ ID NO: 749577 - DNA, 22 bp, Artificial Sequence
  chemically synthesized
tggacacatacaccctcccaag

SEQ ID NO: 749578 - DNA, 22 bp, Artificial Sequence
  chemically synthesized
cctggtttagtcttgggagggt

SEQ ID NO: 749579 - DNA, 22 bp, Artificial Sequence
  chemically synthesized
ctggacacatacaccctcccaa

SEQ ID NO: 749580 - DNA, 22 bp, Artificial Sequence
  chemically synthesized
ctggtttagtcttgggagggtg

SEQ ID NO: 749581 - DNA, 22 bp, Artificial Sequence
  chemically synthesized
gtttagtcttgggagggtgtat

SEQ ID NO: 749582 - DNA, 22 bp, Artificial Sequence
  chemically synthesized
atttctggacacatacaccctc

SEQ ID NO: 749583 - DNA, 22 bp, Artificial Sequence
  chemically synthesized
agtcttgggagggtgtatgtgt

SEQ ID NO: 749584 - DNA, 22 bp, Artificial Sequence
  chemically synthesized
attaatttctggacacatacac

SEQ ID NO: 749585 - DNA, 22 bp, Artificial Sequence
  chemically synthesized
gtcttgggagggtgtatgtgtc

SEQ ID NO: 749586 - DNA, 22 bp, Artificial Sequence
  chemically synthesized
gggagggtgtatgtgtccagaa

SEQ ID NO: 749587 - DNA, 22 bp, Artificial Sequence
  chemically synthesized
ggagggtgtatgtgtccagaaa

SEQ ID NO: 749588 - DNA, 22 bp, Artificial Sequence
  chemically synthesized
gaagaaattgattaatttctgg

SEQ ID NO: 749589 - DNA, 22 bp, Artificial Sequence
  chemically synthesized
gaaaatctagaagaaattgatt

SEQ ID NO: 749590 - DNA, 22 bp, Artificial Sequence
  chemically synthesized
atcaatttcttctagattttct

SEQ ID NO: 749591 - DNA, 22 bp, Artificial Sequence
  chemically synthesized
cgcaaataaactagaaaatcta

SEQ ID NO: 749592 - DNA, 22 bp, Artificial Sequence
  chemically synthesized
tacgcaaataaactagaaaatc

SEQ ID NO: 749593 - DNA, 22 bp, Artificial Sequence
  chemically synthesized
cttctagattttctagtttatt

SEQ ID NO: 749594 - DNA, 22 bp, Artificial Sequence
  chemically synthesized
ttctagattttctagtttattt

SEQ ID NO: 749595 - DNA, 22 bp, Artificial Sequence
  chemically synthesized
ctagattttctagtttatttgc

SEQ ID NO: 749596 - DNA, 22 bp, Artificial Sequence
  chemically synthesized
tagattttctagtttatttgcg

SEQ ID NO: 749597 - DNA, 22 bp, Artificial Sequence
  chemically synthesized
taaacacctctacgcaaataaa

SEQ ID NO: 749598 - DNA, 22 bp, Artificial Sequence
  chemically synthesized
gattttctagtttatttgcgta

SEQ ID NO: 749599 - DNA, 22 bp, Artificial Sequence
  chemically synthesized
tctagtttatttgcgtagaggt

SEQ ID NO: 749600 - DNA, 22 bp, Artificial Sequence
  chemically synthesized
ctagtttatttgcgtagaggtg

SEQ ID NO: 749601 - DNA, 22 bp, Artificial Sequence
  chemically synthesized
tagtttatttgcgtagaggtgt

SEQ ID NO: 749602 - DNA, 22 bp, Artificial Sequence
  chemically synthesized
gtttatttgcgtagaggtgttt

SEQ ID NO: 749603 - DNA, 22 bp, Artificial Sequence
  chemically synthesized
atttgcgtagaggtgtttatag

SEQ ID NO: 749604 - DNA, 22 bp, Artificial Sequence
  chemically synthesized
tttgcgtagaggtgtttatagt

SEQ ID NO: 749605 - DNA, 22 bp, Artificial Sequence
  chemically synthesized
ccatcagagaatactataaaca

SEQ ID NO: 749606 - DNA, 22 bp, Artificial Sequence
  chemically synthesized
gcgtagaggtgtttatagtatt

SEQ ID NO: 749607 - DNA, 22 bp, Artificial Sequence
  chemically synthesized
cgtagaggtgtttatagtattc

SEQ ID NO: 749608 - DNA, 22 bp, Artificial Sequence
  chemically synthesized
atagtattctctgatggtagtt

SEQ ID NO: 749609 - DNA, 22 bp, Artificial Sequence
  chemically synthesized
tagtattctctgatggtagttt

SEQ ID NO: 749610 - DNA, 22 bp, Artificial Sequence
  chemically synthesized
atcccacagaaatacaaactac

SEQ ID NO: 749611 - DNA, 22 bp, Artificial Sequence
  chemically synthesized
tcatcccacagaaatacaaact

SEQ ID NO: 749612 - DNA, 22 bp, Artificial Sequence
  chemically synthesized
tctgatggtagtttgtatttct

SEQ ID NO: 749613 - DNA, 22 bp, Artificial Sequence
  chemically synthesized
gctctcatcccacagaaataca

SEQ ID NO: 749614 - DNA, 22 bp, Artificial Sequence
  chemically synthesized
tgatggtagtttgtatttctgt

SEQ ID NO: 749615 - DNA, 22 bp, Artificial Sequence
  chemically synthesized
atggtagtttgtatttctgtgg

SEQ ID NO: 749616 - DNA, 22 bp, Artificial Sequence
  chemically synthesized
gtatttctgtgggatgagagct

SEQ ID NO: 749617 - DNA, 22 bp, Artificial Sequence
  chemically synthesized
tatttctgtgggatgagagcta

SEQ ID NO: 749618 - DNA, 22 bp, Artificial Sequence
  chemically synthesized
ctgtgggatgagagctaatatc

SEQ ID NO: 749619 - DNA, 22 bp, Artificial Sequence
  chemically synthesized
tgtgggatgagagctaatatcc

SEQ ID NO: 749620 - DNA, 22 bp, Artificial Sequence
  chemically synthesized
tgggatgagagctaatatcccc

SEQ ID NO: 749621 - DNA, 22 bp, Artificial Sequence
  chemically synthesized
atatcccctttatcattttttc

SEQ ID NO: 749622 - DNA, 22 bp, Artificial Sequence
  chemically synthesized
tatcattttttcttgtgtctgt

SEQ ID NO: 749623 - DNA, 22 bp, Artificial Sequence
  chemically synthesized
atcattttttcttgtgtctgtc

SEQ ID NO: 749624 - DNA, 22 bp, Artificial Sequence
  chemically synthesized
tcattttttcttgtgtctgtct

SEQ ID NO: 749625 - DNA, 22 bp, Artificial Sequence
  chemically synthesized
tttcttgtgtctgtctgattct

SEQ ID NO: 749626 - DNA, 22 bp, Artificial Sequence
  chemically synthesized
ttcttgtgtctgtctgattctt

SEQ ID NO: 749627 - DNA, 22 bp, Artificial Sequence
  chemically synthesized
tcttgtgtctgtctgattcttc

SEQ ID NO: 749628 - DNA, 22 bp, Artificial Sequence
  chemically synthesized
cttgtgtctgtctgattcttct

SEQ ID NO: 749629 - DNA, 22 bp, Artificial Sequence
  chemically synthesized
ttgtgtctgtctgattcttctc

SEQ ID NO: 749630 - DNA, 22 bp, Artificial Sequence
  chemically synthesized
gtgtctgtctgattcttctctc

SEQ ID NO: 749631 - DNA, 22 bp, Artificial Sequence
  chemically synthesized
tgtctgtctgattcttctctct

SEQ ID NO: 749632 - DNA, 22 bp, Artificial Sequence
  chemically synthesized
ataaagaagaaaagagagaaga

SEQ ID NO: 749633 - DNA, 22 bp, Artificial Sequence
  chemically synthesized
tctgattcttctctcttttctt

SEQ ID NO: 749634 - DNA, 22 bp, Artificial Sequence
  chemically synthesized
gccagactaataaagaagaaaa

SEQ ID NO: 749635 - DNA, 22 bp, Artificial Sequence
  chemically synthesized
attcttctctcttttcttcttt

SEQ ID NO: 749636 - DNA, 22 bp, Artificial Sequence
  chemically synthesized
ctagccagactaataaagaaga

SEQ ID NO: 749637 - DNA, 22 bp, Artificial Sequence
  chemically synthesized
ttctctcttttcttctttatta

SEQ ID NO: 749638 - DNA, 22 bp, Artificial Sequence
  chemically synthesized
ctctcttttcttctttattagt

SEQ ID NO: 749639 - DNA, 22 bp, Artificial Sequence
  chemically synthesized
tctcttttcttctttattagtc

SEQ ID NO: 749640 - DNA, 22 bp, Artificial Sequence
  chemically synthesized
tcttttcttctttattagtctg

SEQ ID NO: 749641 - DNA, 22 bp, Artificial Sequence
  chemically synthesized
ttttcttctttattagtctggc

SEQ ID NO: 749642 - DNA, 22 bp, Artificial Sequence
  chemically synthesized
ttcttctttattagtctggcta

SEQ ID NO: 749643 - DNA, 22 bp, Artificial Sequence
  chemically synthesized
tcttctttattagtctggctag

SEQ ID NO: 749644 - DNA, 22 bp, Artificial Sequence
  chemically synthesized
cttctttattagtctggctagc

SEQ ID NO: 749645 - DNA, 22 bp, Artificial Sequence
  chemically synthesized
ttctttattagtctggctagca

SEQ ID NO: 749646 - DNA, 22 bp, Artificial Sequence
  chemically synthesized
ctttattagtctggctagcagt

SEQ ID NO: 749647 - DNA, 22 bp, Artificial Sequence
  chemically synthesized
tttattagtctggctagcagtc

SEQ ID NO: 749648 - DNA, 22 bp, Artificial Sequence
  chemically synthesized
acaaaatagatagactgctagc

SEQ ID NO: 749649 - DNA, 22 bp, Artificial Sequence
  chemically synthesized
tattagtctggctagcagtcta

SEQ ID NO: 749650 - DNA, 22 bp, Artificial Sequence
  chemically synthesized
attagtctggctagcagtctat

SEQ ID NO: 749651 - DNA, 22 bp, Artificial Sequence
  chemically synthesized
ttagtctggctagcagtctatc

SEQ ID NO: 749652 - DNA, 22 bp, Artificial Sequence
  chemically synthesized
gtctggctagcagtctatctat

SEQ ID NO: 749653 - DNA, 22 bp, Artificial Sequence
  chemically synthesized
aaaagattaacaaaatagatag

SEQ ID NO: 749654 - DNA, 22 bp, Artificial Sequence
  chemically synthesized
gaaaagattaacaaaatagata

SEQ ID NO: 749655 - DNA, 22 bp, Artificial Sequence
  chemically synthesized
tgaaaagattaacaaaatagat

SEQ ID NO: 749656 - DNA, 22 bp, Artificial Sequence
  chemically synthesized
gctagcagtctatctattttgt

SEQ ID NO: 749657 - DNA, 22 bp, Artificial Sequence
  chemically synthesized
ttgaaaagattaacaaaataga

SEQ ID NO: 749658 - DNA, 22 bp, Artificial Sequence
  chemically synthesized
tttgaaaagattaacaaaatag

SEQ ID NO: 749659 - DNA, 22 bp, Artificial Sequence
  chemically synthesized
gcagtctatctattttgttaat

SEQ ID NO: 749660 - DNA, 22 bp, Artificial Sequence
  chemically synthesized
gttttttgaaaagattaacaaa

SEQ ID NO: 749661 - DNA, 22 bp, Artificial Sequence
  chemically synthesized
tctattttgttaatcttttcaa

SEQ ID NO: 749662 - DNA, 22 bp, Artificial Sequence
  chemically synthesized
ttttgttaatcttttcaaaaaa

SEQ ID NO: 749663 - DNA, 22 bp, Artificial Sequence
  chemically synthesized
tgttaatcttttcaaaaaacca

SEQ ID NO: 749664 - DNA, 22 bp, Artificial Sequence
  chemically synthesized
gttaatcttttcaaaaaaccag

SEQ ID NO: 749665 - DNA, 22 bp, Artificial Sequence
  chemically synthesized
ttaatcttttcaaaaaaccagc

SEQ ID NO: 749666 - DNA, 22 bp, Artificial Sequence
  chemically synthesized
atcttttcaaaaaaccagcccc

SEQ ID NO: 749667 - DNA, 22 bp, Artificial Sequence
  chemically synthesized
ttcaaaaaaccagcccctggct

SEQ ID NO: 749668 - DNA, 22 bp, Artificial Sequence
  chemically synthesized
tcaaaaaaccagcccctggctt

SEQ ID NO: 749669 - DNA, 22 bp, Artificial Sequence
  chemically synthesized
aaaaaatcaatgaagccagggg

SEQ ID NO: 749670 - DNA, 22 bp, Artificial Sequence
  chemically synthesized
caaaaaaccagcccctggcttc

SEQ ID NO: 749671 - DNA, 22 bp, Artificial Sequence
  chemically synthesized
caaaaaatcaatgaagccaggg

SEQ ID NO: 749672 - DNA, 22 bp, Artificial Sequence
  chemically synthesized
aaaaaaccagcccctggcttca

SEQ ID NO: 749673 - DNA, 22 bp, Artificial Sequence
  chemically synthesized
gcttcattgattttttgaagga

SEQ ID NO: 749674 - DNA, 22 bp, Artificial Sequence
  chemically synthesized
cattgattttttgaaggatttc

SEQ ID NO: 749675 - DNA, 22 bp, Artificial Sequence
  chemically synthesized
attgattttttgaaggatttct

SEQ ID NO: 749676 - DNA, 22 bp, Artificial Sequence
  chemically synthesized
attttttgaaggatttctcatg

SEQ ID NO: 749677 - DNA, 22 bp, Artificial Sequence
  chemically synthesized
aaggagatagagacatgagaaa

SEQ ID NO: 749678 - DNA, 22 bp, Artificial Sequence
  chemically synthesized
tttgaaggatttctcatgtctc

SEQ ID NO: 749679 - DNA, 22 bp, Artificial Sequence
  chemically synthesized
ttgaaggatttctcatgtctct

SEQ ID NO: 749680 - DNA, 22 bp, Artificial Sequence
  chemically synthesized
tgaaggatttctcatgtctcta

SEQ ID NO: 749681 - DNA, 22 bp, Artificial Sequence
  chemically synthesized
gaaggatttctcatgtctctat

SEQ ID NO: 749682 - DNA, 22 bp, Artificial Sequence
  chemically synthesized
aaggatttctcatgtctctatc

SEQ ID NO: 749683 - DNA, 22 bp, Artificial Sequence
  chemically synthesized
ctcatgtctctatctccttcag

SEQ ID NO: 749684 - DNA, 22 bp, Artificial Sequence
  chemically synthesized
tcatgtctctatctccttcagt

SEQ ID NO: 749685 - DNA, 22 bp, Artificial Sequence
  chemically synthesized
cgatcagagcagaactgaagga

SEQ ID NO: 749686 - DNA, 22 bp, Artificial Sequence
  chemically synthesized
atgtctctatctccttcagttc

SEQ ID NO: 749687 - DNA, 22 bp, Artificial Sequence
  chemically synthesized
tatctccttcagttctgctctg

SEQ ID NO: 749688 - DNA, 22 bp, Artificial Sequence
  chemically synthesized
tctccttcagttctgctctgat

SEQ ID NO: 749689 - DNA, 22 bp, Artificial Sequence
  chemically synthesized
cttcagttctgctctgatcgta

SEQ ID NO: 749690 - DNA, 22 bp, Artificial Sequence
  chemically synthesized
cagttctgctctgatcgtagtt

SEQ ID NO: 749691 - DNA, 22 bp, Artificial Sequence
  chemically synthesized
agttctgctctgatcgtagtta

SEQ ID NO: 749692 - DNA, 22 bp, Artificial Sequence
  chemically synthesized
gcagaagagaagaaataactac

SEQ ID NO: 749693 - DNA, 22 bp, Artificial Sequence
  chemically synthesized
tgctctgatcgtagttatttct

SEQ ID NO: 749694 - DNA, 22 bp, Artificial Sequence
  chemically synthesized
ctctgatcgtagttatttcttc

SEQ ID NO: 749695 - DNA, 22 bp, Artificial Sequence
  chemically synthesized
tgatcgtagttatttcttctct

SEQ ID NO: 749696 - DNA, 22 bp, Artificial Sequence
  chemically synthesized
caaagctagcagaagagaagaa

SEQ ID NO: 749697 - DNA, 22 bp, Artificial Sequence
  chemically synthesized
atcgtagttatttcttctcttc

SEQ ID NO: 749698 - DNA, 22 bp, Artificial Sequence
  chemically synthesized
tttcttctcttctgctagcttt

SEQ ID NO: 749699 - DNA, 22 bp, Artificial Sequence
  chemically synthesized
cttctcttctgctagctttgga

SEQ ID NO: 749700 - DNA, 22 bp, Artificial Sequence
  chemically synthesized
ttctcttctgctagctttggaa

SEQ ID NO: 749701 - DNA, 22 bp, Artificial Sequence
  chemically synthesized
ctcttctgctagctttggaatt

SEQ ID NO: 749702 - DNA, 22 bp, Artificial Sequence
  chemically synthesized
tcttctgctagctttggaattt

SEQ ID NO: 749703 - DNA, 22 bp, Artificial Sequence
  chemically synthesized
ttctgctagctttggaatttgt

SEQ ID NO: 749704 - DNA, 22 bp, Artificial Sequence
  chemically synthesized
ctgctagctttggaatttgttt

SEQ ID NO: 749705 - DNA, 22 bp, Artificial Sequence
  chemically synthesized
tgctagctttggaatttgtttg

SEQ ID NO: 749706 - DNA, 22 bp, Artificial Sequence
  chemically synthesized
ctagctttggaatttgtttgct

SEQ ID NO: 749707 - DNA, 22 bp, Artificial Sequence
  chemically synthesized
gctttggaatttgtttgctctt

SEQ ID NO: 749708 - DNA, 22 bp, Artificial Sequence
  chemically synthesized
tggaatttgtttgctcttgctt

SEQ ID NO: 749709 - DNA, 22 bp, Artificial Sequence
  chemically synthesized
aaagaagtagagaagcaagagc

SEQ ID NO: 749710 - DNA, 22 bp, Artificial Sequence
  chemically synthesized
ggaatttgtttgctcttgcttc

SEQ ID NO: 749711 - DNA, 22 bp, Artificial Sequence
  chemically synthesized
gaatttgtttgctcttgcttct

SEQ ID NO: 749712 - DNA, 22 bp, Artificial Sequence
  chemically synthesized
gtttgctcttgcttctctactt

SEQ ID NO: 749713 - DNA, 22 bp, Artificial Sequence
  chemically synthesized
tttgctcttgcttctctacttc

SEQ ID NO: 749714 - DNA, 22 bp, Artificial Sequence
  chemically synthesized
gctcttgcttctctacttcttt

SEQ ID NO: 749715 - DNA, 22 bp, Artificial Sequence
  chemically synthesized
acatcacaattaaaagaagtag

SEQ ID NO: 749716 - DNA, 22 bp, Artificial Sequence
  chemically synthesized
ctcttgcttctctacttctttt

SEQ ID NO: 749717 - DNA, 22 bp, Artificial Sequence
  chemically synthesized
aacatcacaattaaaagaagta

SEQ ID NO: 749718 - DNA, 22 bp, Artificial Sequence
  chemically synthesized
ttgcttctctacttcttttaat

SEQ ID NO: 749719 - DNA, 22 bp, Artificial Sequence
  chemically synthesized
gcttctctacttcttttaattg

SEQ ID NO: 749720 - DNA, 22 bp, Artificial Sequence
  chemically synthesized
cttctctacttcttttaattgt

SEQ ID NO: 749721 - DNA, 22 bp, Artificial Sequence
  chemically synthesized
acaccttaacatcacaattaaa

SEQ ID NO: 749722 - DNA, 22 bp, Artificial Sequence
  chemically synthesized
ctctacttcttttaattgtgat

SEQ ID NO: 749723 - DNA, 22 bp, Artificial Sequence
  chemically synthesized
tctacttcttttaattgtgatg

SEQ ID NO: 749724 - DNA, 22 bp, Artificial Sequence
  chemically synthesized
tacttcttttaattgtgatgtt

SEQ ID NO: 749725 - DNA, 22 bp, Artificial Sequence
  chemically synthesized
aaattgacaccttaacatcaca

SEQ ID NO: 749726 - DNA, 22 bp, Artificial Sequence
  chemically synthesized
cttcttttaattgtgatgttaa

SEQ ID NO: 749727 - DNA, 22 bp, Artificial Sequence
  chemically synthesized
cttttaattgtgatgttaaggt

SEQ ID NO: 749728 - DNA, 22 bp, Artificial Sequence
  chemically synthesized
ttttaattgtgatgttaaggtg

SEQ ID NO: 749729 - DNA, 22 bp, Artificial Sequence
  chemically synthesized
ttaattgtgatgttaaggtgtc

SEQ ID NO: 749730 - DNA, 22 bp, Artificial Sequence
  chemically synthesized
taattgtgatgttaaggtgtca

SEQ ID NO: 749731 - DNA, 22 bp, Artificial Sequence
  chemically synthesized
aattgtgatgttaaggtgtcaa

SEQ ID NO: 749732 - DNA, 22 bp, Artificial Sequence
  chemically synthesized
attgtgatgttaaggtgtcaat

SEQ ID NO: 749733 - DNA, 22 bp, Artificial Sequence
  chemically synthesized
tgatgttaaggtgtcaatttta

SEQ ID NO: 749734 - DNA, 22 bp, Artificial Sequence
  chemically synthesized
aggtgtcaattttagatatttc

SEQ ID NO: 749735 - DNA, 22 bp, Artificial Sequence
  chemically synthesized
aaatccccacaggagaaagcag

SEQ ID NO: 749736 - DNA, 22 bp, Artificial Sequence
  chemically synthesized
tagatatttcctgctttctcct

SEQ ID NO: 749737 - DNA, 22 bp, Artificial Sequence
  chemically synthesized
agatatttcctgctttctcctg

SEQ ID NO: 749738 - DNA, 22 bp, Artificial Sequence
  chemically synthesized
gatatttcctgctttctcctgt

SEQ ID NO: 749739 - DNA, 22 bp, Artificial Sequence
  chemically synthesized
cagcattaaaatccccacagga

SEQ ID NO: 749740 - DNA, 22 bp, Artificial Sequence
  chemically synthesized
acagcattaaaatccccacagg

SEQ ID NO: 749741 - DNA, 22 bp, Artificial Sequence
  chemically synthesized
cctgctttctcctgtggggatt

SEQ ID NO: 749742 - DNA, 22 bp, Artificial Sequence
  chemically synthesized
ctgctttctcctgtggggattt

SEQ ID NO: 749743 - DNA, 22 bp, Artificial Sequence
  chemically synthesized
ctttctcctgtggggattttaa

SEQ ID NO: 749744 - DNA, 22 bp, Artificial Sequence
  chemically synthesized
tctcctgtggggattttaatgc

SEQ ID NO: 749745 - DNA, 22 bp, Artificial Sequence
  chemically synthesized
ctcctgtggggattttaatgct

SEQ ID NO: 749746 - DNA, 22 bp, Artificial Sequence
  chemically synthesized
tcctgtggggattttaatgctg

SEQ ID NO: 749747 - DNA, 22 bp, Artificial Sequence
  chemically synthesized
gagggaaatttacagcattaaa

SEQ ID NO: 749748 - DNA, 22 bp, Artificial Sequence
  chemically synthesized
agagggaaatttacagcattaa

SEQ ID NO: 749749 - DNA, 22 bp, Artificial Sequence
  chemically synthesized
ctgtggggattttaatgctgta

SEQ ID NO: 749750 - DNA, 22 bp, Artificial Sequence
  chemically synthesized
tggggattttaatgctgtaaat

SEQ ID NO: 749751 - DNA, 22 bp, Artificial Sequence
  chemically synthesized
aagcagtatttagagggaaatt

SEQ ID NO: 749752 - DNA, 22 bp, Artificial Sequence
  chemically synthesized
taatgctgtaaatttccctcta

SEQ ID NO: 749753 - DNA, 22 bp, Artificial Sequence
  chemically synthesized
aatgctgtaaatttccctctaa

SEQ ID NO: 749754 - DNA, 22 bp, Artificial Sequence
  chemically synthesized
atgctgtaaatttccctctaaa

SEQ ID NO: 749755 - DNA, 22 bp, Artificial Sequence
  chemically synthesized
taaatttccctctaaatactgc

SEQ ID NO: 749756 - DNA, 22 bp, Artificial Sequence
  chemically synthesized
ggacacagctaaagcagtattt

SEQ ID NO: 749757 - DNA, 22 bp, Artificial Sequence
  chemically synthesized
tgggacacagctaaagcagtat

SEQ ID NO: 749758 - DNA, 22 bp, Artificial Sequence
  chemically synthesized
ccctctaaatactgctttagct

SEQ ID NO: 749759 - DNA, 22 bp, Artificial Sequence
  chemically synthesized
cctctaaatactgctttagctg

SEQ ID NO: 749760 - DNA, 22 bp, Artificial Sequence
  chemically synthesized
taaatactgctttagctgtgtc

SEQ ID NO: 749761 - DNA, 22 bp, Artificial Sequence
  chemically synthesized
aatactgctttagctgtgtccc

SEQ ID NO: 749762 - DNA, 22 bp, Artificial Sequence
  chemically synthesized
ctttagctgtgtcccagagatt

SEQ ID NO: 749763 - DNA, 22 bp, Artificial Sequence
  chemically synthesized
tagctgtgtcccagagattctg

SEQ ID NO: 749764 - DNA, 22 bp, Artificial Sequence
  chemically synthesized
agctgtgtcccagagattctgg

SEQ ID NO: 749765 - DNA, 22 bp, Artificial Sequence
  chemically synthesized
gctgtgtcccagagattctggt

SEQ ID NO: 749766 - DNA, 22 bp, Artificial Sequence
  chemically synthesized
tgtcccagagattctggtccgt

SEQ ID NO: 749767 - DNA, 22 bp, Artificial Sequence
  chemically synthesized
aaaccaatgagaataaatacac

SEQ ID NO: 749768 - DNA, 22 bp, Artificial Sequence
  chemically synthesized
caaaccaatgagaataaataca

SEQ ID NO: 749769 - DNA, 22 bp, Artificial Sequence
  chemically synthesized
tcaaaccaatgagaataaatac

SEQ ID NO: 749770 - DNA, 22 bp, Artificial Sequence
  chemically synthesized
tggtccgttgtgtatttattct

SEQ ID NO: 749771 - DNA, 22 bp, Artificial Sequence
  chemically synthesized
tttcaaaccaatgagaataaat

SEQ ID NO: 749772 - DNA, 22 bp, Artificial Sequence
  chemically synthesized
gtccgttgtgtatttattctca

SEQ ID NO: 749773 - DNA, 22 bp, Artificial Sequence
  chemically synthesized
tgtatttattctcattggtttg

SEQ ID NO: 749774 - DNA, 22 bp, Artificial Sequence
  chemically synthesized
attctcattggtttgaaagaac

SEQ ID NO: 749775 - DNA, 22 bp, Artificial Sequence
  chemically synthesized
ttctcattggtttgaaagaact

SEQ ID NO: 749776 - DNA, 22 bp, Artificial Sequence
  chemically synthesized
tcattggtttgaaagaacttat

SEQ ID NO: 749777 - DNA, 22 bp, Artificial Sequence
  chemically synthesized
aggcagaaatgaataagttctt

SEQ ID NO: 749778 - DNA, 22 bp, Artificial Sequence
  chemically synthesized
attggtttgaaagaacttattc

SEQ ID NO: 749779 - DNA, 22 bp, Artificial Sequence
  chemically synthesized
gtttgaaagaacttattcattt

SEQ ID NO: 749780 - DNA, 22 bp, Artificial Sequence
  chemically synthesized
gaaagaacttattcatttctgc

SEQ ID NO: 749781 - DNA, 22 bp, Artificial Sequence
  chemically synthesized
aaagaacttattcatttctgcc

SEQ ID NO: 749782 - DNA, 22 bp, Artificial Sequence
  chemically synthesized
gataaataaggaaattaaggca

SEQ ID NO: 749783 - DNA, 22 bp, Artificial Sequence
  chemically synthesized
attcatttctgccttaatttcc

SEQ ID NO: 749784 - DNA, 22 bp, Artificial Sequence
  chemically synthesized
ctggataaataaggaaattaag

SEQ ID NO: 749785 - DNA, 22 bp, Artificial Sequence
  chemically synthesized
ttcatttctgccttaatttcct

SEQ ID NO: 749786 - DNA, 22 bp, Artificial Sequence
  chemically synthesized
atttctgccttaatttccttat

SEQ ID NO: 749787 - DNA, 22 bp, Artificial Sequence
  chemically synthesized
ctgccttaatttccttatttat

SEQ ID NO: 749788 - DNA, 22 bp, Artificial Sequence
  chemically synthesized
aatgactgctggataaataagg

SEQ ID NO: 749789 - DNA, 22 bp, Artificial Sequence
  chemically synthesized
tgccttaatttccttatttatc

SEQ ID NO: 749790 - DNA, 22 bp, Artificial Sequence
  chemically synthesized
ccttaatttccttatttatcca

SEQ ID NO: 749791 - DNA, 22 bp, Artificial Sequence
  chemically synthesized
ctgaatgactgctggataaata

SEQ ID NO: 749792 - DNA, 22 bp, Artificial Sequence
  chemically synthesized
ctcctgaatgactgctggataa

SEQ ID NO: 749793 - DNA, 22 bp, Artificial Sequence
  chemically synthesized
aatttccttatttatccagcag

SEQ ID NO: 749794 - DNA, 22 bp, Artificial Sequence
  chemically synthesized
atttccttatttatccagcagt

SEQ ID NO: 749795 - DNA, 22 bp, Artificial Sequence
  chemically synthesized
ccttatttatccagcagtcatt

SEQ ID NO: 749796 - DNA, 22 bp, Artificial Sequence
  chemically synthesized
cttatttatccagcagtcattc

SEQ ID NO: 749797 - DNA, 22 bp, Artificial Sequence
  chemically synthesized
agcaacctgctcctgaatgact

SEQ ID NO: 749798 - DNA, 22 bp, Artificial Sequence
  chemically synthesized
atttatccagcagtcattcagg

SEQ ID NO: 749799 - DNA, 22 bp, Artificial Sequence
  chemically synthesized
tttatccagcagtcattcagga

SEQ ID NO: 749800 - DNA, 22 bp, Artificial Sequence
  chemically synthesized
atccagcagtcattcaggagca

SEQ ID NO: 749801 - DNA, 22 bp, Artificial Sequence
  chemically synthesized
tccagcagtcattcaggagcag

SEQ ID NO: 749802 - DNA, 22 bp, Artificial Sequence
  chemically synthesized
catggaaactgagcaacctgct

SEQ ID NO: 749803 - DNA, 22 bp, Artificial Sequence
  chemically synthesized
aggagcaggttgctcagtttcc

SEQ ID NO: 749804 - DNA, 22 bp, Artificial Sequence
  chemically synthesized
aaaaccacacaactacatggaa

SEQ ID NO: 749805 - DNA, 22 bp, Artificial Sequence
  chemically synthesized
actcaaaaccacacaactacat

SEQ ID NO: 749806 - DNA, 22 bp, Artificial Sequence
  chemically synthesized
ctcagtttccatgtagttgtgt

SEQ ID NO: 749807 - DNA, 22 bp, Artificial Sequence
  chemically synthesized
agtttccatgtagttgtgtggt

SEQ ID NO: 749808 - DNA, 22 bp, Artificial Sequence
  chemically synthesized
agaaactcactcaaaaccacac

SEQ ID NO: 749809 - DNA, 22 bp, Artificial Sequence
  chemically synthesized
ccatgtagttgtgtggttttga

SEQ ID NO: 749810 - DNA, 22 bp, Artificial Sequence
  chemically synthesized
catgtagttgtgtggttttgag

SEQ ID NO: 749811 - DNA, 22 bp, Artificial Sequence
  chemically synthesized
aggattaagaaactcactcaaa

SEQ ID NO: 749812 - DNA, 22 bp, Artificial Sequence
  chemically synthesized
tgtggttttgagtgagtttctt

SEQ ID NO: 749813 - DNA, 22 bp, Artificial Sequence
  chemically synthesized
gaactcaggattaagaaactca

SEQ ID NO: 749814 - DNA, 22 bp, Artificial Sequence
  chemically synthesized
tgagtgagtttcttaatcctga

SEQ ID NO: 749815 - DNA, 22 bp, Artificial Sequence
  chemically synthesized
gagtgagtttcttaatcctgag

SEQ ID NO: 749816 - DNA, 22 bp, Artificial Sequence
  chemically synthesized
agtgagtttcttaatcctgagt

SEQ ID NO: 749817 - DNA, 22 bp, Artificial Sequence
  chemically synthesized
cttaatcctgagttctaatttg

SEQ ID NO: 749818 - DNA, 22 bp, Artificial Sequence
  chemically synthesized
ttaatcctgagttctaatttga

SEQ ID NO: 749819 - DNA, 22 bp, Artificial Sequence
  chemically synthesized
aatcctgagttctaatttgatt

SEQ ID NO: 749820 - DNA, 22 bp, Artificial Sequence
  chemically synthesized
agaccacagtacaatcaaatta

SEQ ID NO: 749821 - DNA, 22 bp, Artificial Sequence
  chemically synthesized
atcctgagttctaatttgattg

SEQ ID NO: 749822 - DNA, 22 bp, Artificial Sequence
  chemically synthesized
tcagaccacagtacaatcaaat

SEQ ID NO: 749823 - DNA, 22 bp, Artificial Sequence
  chemically synthesized
agttctaatttgattgtactgt

SEQ ID NO: 749824 - DNA, 22 bp, Artificial Sequence
  chemically synthesized
taatttgattgtactgtggtct

SEQ ID NO: 749825 - DNA, 22 bp, Artificial Sequence
  chemically synthesized
atttgattgtactgtggtctga

SEQ ID NO: 749826 - DNA, 22 bp, Artificial Sequence
  chemically synthesized
gattgtactgtggtctgagaga

SEQ ID NO: 749827 - DNA, 22 bp, Artificial Sequence
  chemically synthesized
attgtactgtggtctgagagac

SEQ ID NO: 749828 - DNA, 22 bp, Artificial Sequence
  chemically synthesized
tactgtggtctgagagactctt

SEQ ID NO: 749829 - DNA, 22 bp, Artificial Sequence
  chemically synthesized
tggtctgagagactcttatgat

SEQ ID NO: 749830 - DNA, 22 bp, Artificial Sequence
  chemically synthesized
agagactcttatgatttctgtt

SEQ ID NO: 749831 - DNA, 22 bp, Artificial Sequence
  chemically synthesized
agcaaatgcaaaaaaacagaaa

SEQ ID NO: 749832 - DNA, 22 bp, Artificial Sequence
  chemically synthesized
ctcagcaaatgcaaaaaaacag

SEQ ID NO: 749833 - DNA, 22 bp, Artificial Sequence
  chemically synthesized
ttatgatttctgtttttttgca

SEQ ID NO: 749834 - DNA, 22 bp, Artificial Sequence
  chemically synthesized
atgatttctgtttttttgcatt

SEQ ID NO: 749835 - DNA, 22 bp, Artificial Sequence
  chemically synthesized
tgatttctgtttttttgcattt

SEQ ID NO: 749836 - DNA, 22 bp, Artificial Sequence
  chemically synthesized
ctgtttttttgcatttgctgag

SEQ ID NO: 749837 - DNA, 22 bp, Artificial Sequence
  chemically synthesized
tgtttttttgcatttgctgagg

SEQ ID NO: 749838 - DNA, 22 bp, Artificial Sequence
  chemically synthesized
gaagtaaaacactcctcagcaa

SEQ ID NO: 749839 - DNA, 22 bp, Artificial Sequence
  chemically synthesized
tttttttgcatttgctgaggag

SEQ ID NO: 749840 - DNA, 22 bp, Artificial Sequence
  chemically synthesized
ttttgcatttgctgaggagtgt

SEQ ID NO: 749841 - DNA, 22 bp, Artificial Sequence
  chemically synthesized
tttgcatttgctgaggagtgtt

SEQ ID NO: 749842 - DNA, 22 bp, Artificial Sequence
  chemically synthesized
ttgcatttgctgaggagtgttt

SEQ ID NO: 749843 - DNA, 22 bp, Artificial Sequence
  chemically synthesized
tgcatttgctgaggagtgtttt

SEQ ID NO: 749844 - DNA, 22 bp, Artificial Sequence
  chemically synthesized
gcatttgctgaggagtgtttta

SEQ ID NO: 749845 - DNA, 22 bp, Artificial Sequence
  chemically synthesized
catttgctgaggagtgttttac

SEQ ID NO: 749846 - DNA, 22 bp, Artificial Sequence
  chemically synthesized
accacataattggaagtaaaac

SEQ ID NO: 749847 - DNA, 22 bp, Artificial Sequence
  chemically synthesized
gctgaggagtgttttacttcca

SEQ ID NO: 749848 - DNA, 22 bp, Artificial Sequence
  chemically synthesized
ctgaggagtgttttacttccaa

SEQ ID NO: 749849 - DNA, 22 bp, Artificial Sequence
  chemically synthesized
aggagtgttttacttccaatta

SEQ ID NO: 749850 - DNA, 22 bp, Artificial Sequence
  chemically synthesized
taaaattgaccacataattgga

SEQ ID NO: 749851 - DNA, 22 bp, Artificial Sequence
  chemically synthesized
ttataaaattgaccacataatt

SEQ ID NO: 749852 - DNA, 22 bp, Artificial Sequence
  chemically synthesized
attataaaattgaccacataat

SEQ ID NO: 749853 - DNA, 22 bp, Artificial Sequence
  chemically synthesized
tacttccaattatgtggtcaat

SEQ ID NO: 749854 - DNA, 22 bp, Artificial Sequence
  chemically synthesized
acttccaattatgtggtcaatt

SEQ ID NO: 749855 - DNA, 22 bp, Artificial Sequence
  chemically synthesized
cttccaattatgtggtcaattt

SEQ ID NO: 749856 - DNA, 22 bp, Artificial Sequence
  chemically synthesized
ccaattatgtggtcaattttat

SEQ ID NO: 749857 - DNA, 22 bp, Artificial Sequence
  chemically synthesized
caattatgtggtcaattttata

SEQ ID NO: 749858 - DNA, 22 bp, Artificial Sequence
  chemically synthesized
tgtggtcaattttataataagt

SEQ ID NO: 749859 - DNA, 22 bp, Artificial Sequence
  chemically synthesized
agcaccacatcacacttattat

SEQ ID NO: 749860 - DNA, 22 bp, Artificial Sequence
  chemically synthesized
tcagcaccacatcacacttatt

SEQ ID NO: 749861 - DNA, 22 bp, Artificial Sequence
  chemically synthesized
ttctcagcaccacatcacactt

SEQ ID NO: 749862 - DNA, 22 bp, Artificial Sequence
  chemically synthesized
tataataagtgtgatgtggtgc

SEQ ID NO: 749863 - DNA, 22 bp, Artificial Sequence
  chemically synthesized
ataataagtgtgatgtggtgct

SEQ ID NO: 749864 - DNA, 22 bp, Artificial Sequence
  chemically synthesized
taataagtgtgatgtggtgctg

SEQ ID NO: 749865 - DNA, 22 bp, Artificial Sequence
  chemically synthesized
cccaccccaaatcaacagaata

SEQ ID NO: 749866 - DNA, 22 bp, Artificial Sequence
  chemically synthesized
agaataatgtatattctgttga

SEQ ID NO: 749867 - DNA, 22 bp, Artificial Sequence
  chemically synthesized
cagaactccccaccccaaatca

SEQ ID NO: 749868 - DNA, 22 bp, Artificial Sequence
  chemically synthesized
tgttgatttggggtggggagtt

SEQ ID NO: 749869 - DNA, 22 bp, Artificial Sequence
  chemically synthesized
ttgatttggggtggggagttct

SEQ ID NO: 749870 - DNA, 22 bp, Artificial Sequence
  chemically synthesized
atagacatctacagaactcccc

SEQ ID NO: 749871 - DNA, 22 bp, Artificial Sequence
  chemically synthesized
aatagacatctacagaactccc

SEQ ID NO: 749872 - DNA, 22 bp, Artificial Sequence
  chemically synthesized
atttggggtggggagttctgta

SEQ ID NO: 749873 - DNA, 22 bp, Artificial Sequence
  chemically synthesized
ggggtggggagttctgtagatg

SEQ ID NO: 749874 - DNA, 22 bp, Artificial Sequence
  chemically synthesized
gggtggggagttctgtagatgt

SEQ ID NO: 749875 - DNA, 22 bp, Artificial Sequence
  chemically synthesized
gaccaagtggacttaatagaca

SEQ ID NO: 749876 - DNA, 22 bp, Artificial Sequence
  chemically synthesized
tggaccaagtggacttaataga

SEQ ID NO: 749877 - DNA, 22 bp, Artificial Sequence
  chemically synthesized
tgtagatgtctattaagtccac

SEQ ID NO: 749878 - DNA, 22 bp, Artificial Sequence
  chemically synthesized
agctctggaccaagtggactta

SEQ ID NO: 749879 - DNA, 22 bp, Artificial Sequence
  chemically synthesized
tagatgtctattaagtccactt

SEQ ID NO: 749880 - DNA, 22 bp, Artificial Sequence
  chemically synthesized
aactcagctctggaccaagtgg

SEQ ID NO: 749881 - DNA, 22 bp, Artificial Sequence
  chemically synthesized
aaactcagctctggaccaagtg

SEQ ID NO: 749882 - DNA, 22 bp, Artificial Sequence
  chemically synthesized
ttaagtccacttggtccagagc

SEQ ID NO: 749883 - DNA, 22 bp, Artificial Sequence
  chemically synthesized
aggacttaaactcagctctgga

SEQ ID NO: 749884 - DNA, 22 bp, Artificial Sequence
  chemically synthesized
agtccacttggtccagagctga

SEQ ID NO: 749885 - DNA, 22 bp, Artificial Sequence
  chemically synthesized
ggtccagagctgagtttaagtc

SEQ ID NO: 749886 - DNA, 22 bp, Artificial Sequence
  chemically synthesized
gtccagagctgagtttaagtcc

SEQ ID NO: 749887 - DNA, 22 bp, Artificial Sequence
  chemically synthesized
acaaggatattcaggacttaaa

SEQ ID NO: 749888 - DNA, 22 bp, Artificial Sequence
  chemically synthesized
agtttaagtcctgaatatcctt

SEQ ID NO: 749889 - DNA, 22 bp, Artificial Sequence
  chemically synthesized
aagtcctgaatatccttgttaa

SEQ ID NO: 749890 - DNA, 22 bp, Artificial Sequence
  chemically synthesized
agtcctgaatatccttgttaat

SEQ ID NO: 749891 - DNA, 22 bp, Artificial Sequence
  chemically synthesized
aatatccttgttaattttctgt

SEQ ID NO: 749892 - DNA, 22 bp, Artificial Sequence
  chemically synthesized
gacggatcaacgaaacagaaaa

SEQ ID NO: 749893 - DNA, 22 bp, Artificial Sequence
  chemically synthesized
gttaattttctgtttcgttgat

SEQ ID NO: 749894 - DNA, 22 bp, Artificial Sequence
  chemically synthesized
ttaattttctgtttcgttgatc

SEQ ID NO: 749895 - DNA, 22 bp, Artificial Sequence
  chemically synthesized
tcaatattagacggatcaacga

SEQ ID NO: 749896 - DNA, 22 bp, Artificial Sequence
  chemically synthesized
attttctgtttcgttgatccgt

SEQ ID NO: 749897 - DNA, 22 bp, Artificial Sequence
  chemically synthesized
tctgtttcgttgatccgtctaa

SEQ ID NO: 749898 - DNA, 22 bp, Artificial Sequence
  chemically synthesized
ctgtttcgttgatccgtctaat

SEQ ID NO: 749899 - DNA, 22 bp, Artificial Sequence
  chemically synthesized
tgtttcgttgatccgtctaata

SEQ ID NO: 749900 - DNA, 22 bp, Artificial Sequence
  chemically synthesized
tttcgttgatccgtctaatatt

SEQ ID NO: 749901 - DNA, 22 bp, Artificial Sequence
  chemically synthesized
acaccccactgtcaatattaga

SEQ ID NO: 749902 - DNA, 22 bp, Artificial Sequence
  chemically synthesized
aacaccccactgtcaatattag

SEQ ID NO: 749903 - DNA, 22 bp, Artificial Sequence
  chemically synthesized
cgttgatccgtctaatattgac

SEQ ID NO: 749904 - DNA, 22 bp, Artificial Sequence
  chemically synthesized
taacaccccactgtcaatatta

SEQ ID NO: 749905 - DNA, 22 bp, Artificial Sequence
  chemically synthesized
gttgatccgtctaatattgaca

SEQ ID NO: 749906 - DNA, 22 bp, Artificial Sequence
  chemically synthesized
atccgtctaatattgacagtgg

SEQ ID NO: 749907 - DNA, 22 bp, Artificial Sequence
  chemically synthesized
atattgacagtggggtgttaaa

SEQ ID NO: 749908 - DNA, 22 bp, Artificial Sequence
  chemically synthesized
acagtggggtgttaaaatctcc

SEQ ID NO: 749909 - DNA, 22 bp, Artificial Sequence
  chemically synthesized
aaatctcccactattattgtat

SEQ ID NO: 749910 - DNA, 22 bp, Artificial Sequence
  chemically synthesized
ccactattattgtatgggcatc

SEQ ID NO: 749911 - DNA, 22 bp, Artificial Sequence
  chemically synthesized
caaagagacatagatgcccata

SEQ ID NO: 749912 - DNA, 22 bp, Artificial Sequence
  chemically synthesized
ttattgtatgggcatctatgtc

SEQ ID NO: 749913 - DNA, 22 bp, Artificial Sequence
  chemically synthesized
gagacctacaaagagacataga

SEQ ID NO: 749914 - DNA, 22 bp, Artificial Sequence
  chemically synthesized
ttgtatgggcatctatgtctct

SEQ ID NO: 749915 - DNA, 22 bp, Artificial Sequence
  chemically synthesized
agagacctacaaagagacatag

SEQ ID NO: 749916 - DNA, 22 bp, Artificial Sequence
  chemically synthesized
ttagagacctacaaagagacat

SEQ ID NO: 749917 - DNA, 22 bp, Artificial Sequence
  chemically synthesized
tatgggcatctatgtctctttg

SEQ ID NO: 749918 - DNA, 22 bp, Artificial Sequence
  chemically synthesized
tgtctctttgtaggtctctaag

SEQ ID NO: 749919 - DNA, 22 bp, Artificial Sequence
  chemically synthesized
ataaagtaagttcttagagacc

SEQ ID NO: 749920 - DNA, 22 bp, Artificial Sequence
  chemically synthesized
tttgtaggtctctaagaactta

SEQ ID NO: 749921 - DNA, 22 bp, Artificial Sequence
  chemically synthesized
tgtaggtctctaagaacttact

SEQ ID NO: 749922 - DNA, 22 bp, Artificial Sequence
  chemically synthesized
gtaggtctctaagaacttactt

SEQ ID NO: 749923 - DNA, 22 bp, Artificial Sequence
  chemically synthesized
taggtctctaagaacttacttt

SEQ ID NO: 749924 - DNA, 22 bp, Artificial Sequence
  chemically synthesized
taagaacttactttatgaatcc

SEQ ID NO: 749925 - DNA, 22 bp, Artificial Sequence
  chemically synthesized
agaacttactttatgaatccgg

SEQ ID NO: 749926 - DNA, 22 bp, Artificial Sequence
  chemically synthesized
actttatgaatccgggtgctcc

SEQ ID NO: 749927 - DNA, 22 bp, Artificial Sequence
  chemically synthesized
ctttatgaatccgggtgctcct

SEQ ID NO: 749928 - DNA, 22 bp, Artificial Sequence
  chemically synthesized
tatgaatccgggtgctcctata

SEQ ID NO: 749929 - DNA, 22 bp, Artificial Sequence
  chemically synthesized
atgaatccgggtgctcctatat

SEQ ID NO: 749930 - DNA, 22 bp, Artificial Sequence
  chemically synthesized
tgaatccgggtgctcctatatt

SEQ ID NO: 749931 - DNA, 22 bp, Artificial Sequence
  chemically synthesized
aatatatatgcacccaatatag

SEQ ID NO: 749932 - DNA, 22 bp, Artificial Sequence
  chemically synthesized
tcctaaatatatatgcacccaa

SEQ ID NO: 749933 - DNA, 22 bp, Artificial Sequence
  chemically synthesized
actatcctaaatatatatgcac

SEQ ID NO: 749934 - DNA, 22 bp, Artificial Sequence
  chemically synthesized
ctatattgggtgcatatatatt

SEQ ID NO: 749935 - DNA, 22 bp, Artificial Sequence
  chemically synthesized
tattgggtgcatatatatttag

SEQ ID NO: 749936 - DNA, 22 bp, Artificial Sequence
  chemically synthesized
ggtgcatatatatttaggatag

SEQ ID NO: 749937 - DNA, 22 bp, Artificial Sequence
  chemically synthesized
aggatagttagctcttcttgtt

SEQ ID NO: 749938 - DNA, 22 bp, Artificial Sequence
  chemically synthesized
ggatagttagctcttcttgttg

SEQ ID NO: 749939 - DNA, 22 bp, Artificial Sequence
  chemically synthesized
gctcttcttgttgcattgatca

SEQ ID NO: 749940 - DNA, 22 bp, Artificial Sequence
  chemically synthesized
cataatggtaaagtgatcaatg

SEQ ID NO: 749941 - DNA, 22 bp, Artificial Sequence
  chemically synthesized
ttcttgttgcattgatcacttt

SEQ ID NO: 749942 - DNA, 22 bp, Artificial Sequence
  chemically synthesized
cttgttgcattgatcactttac

SEQ ID NO: 749943 - DNA, 22 bp, Artificial Sequence
  chemically synthesized
ttgttgcattgatcactttacc

SEQ ID NO: 749944 - DNA, 22 bp, Artificial Sequence
  chemically synthesized
gttgcattgatcactttaccat

SEQ ID NO: 749945 - DNA, 22 bp, Artificial Sequence
  chemically synthesized
ttgcattgatcactttaccatt

SEQ ID NO: 749946 - DNA, 22 bp, Artificial Sequence
  chemically synthesized
cattgatcactttaccattatg

SEQ ID NO: 749947 - DNA, 22 bp, Artificial Sequence
  chemically synthesized
atcactttaccattatgtaata

SEQ ID NO: 749948 - DNA, 22 bp, Artificial Sequence
  chemically synthesized
taccattatgtaataccatttt

SEQ ID NO: 749949 - DNA, 22 bp, Artificial Sequence
  chemically synthesized
accattatgtaataccattttt

SEQ ID NO: 749950 - DNA, 22 bp, Artificial Sequence
  chemically synthesized
ccattatgtaataccatttttt

SEQ ID NO: 749951 - DNA, 22 bp, Artificial Sequence
  chemically synthesized
tgtaataccattttttttgtcc

SEQ ID NO: 749952 - DNA, 22 bp, Artificial Sequence
  chemically synthesized
aaccaataaagatcaaaaagga

SEQ ID NO: 749953 - DNA, 22 bp, Artificial Sequence
  chemically synthesized
aaaccaataaagatcaaaaagg

SEQ ID NO: 749954 - DNA, 22 bp, Artificial Sequence
  chemically synthesized
taaaccaataaagatcaaaaag

SEQ ID NO: 749955 - DNA, 22 bp, Artificial Sequence
  chemically synthesized
tttttgtcctttttgatcttta

SEQ ID NO: 749956 - DNA, 22 bp, Artificial Sequence
  chemically synthesized
ttttgtcctttttgatctttat

SEQ ID NO: 749957 - DNA, 22 bp, Artificial Sequence
  chemically synthesized
tttgtcctttttgatctttatt

SEQ ID NO: 749958 - DNA, 22 bp, Artificial Sequence
  chemically synthesized
ttgtcctttttgatctttattg

SEQ ID NO: 749959 - DNA, 22 bp, Artificial Sequence
  chemically synthesized
tgtcctttttgatctttattgg

SEQ ID NO: 749960 - DNA, 22 bp, Artificial Sequence
  chemically synthesized
gtcctttttgatctttattggt

SEQ ID NO: 749961 - DNA, 22 bp, Artificial Sequence
  chemically synthesized
tcctttttgatctttattggtt

SEQ ID NO: 749962 - DNA, 22 bp, Artificial Sequence
  chemically synthesized
tttgatctttattggtttaaag

SEQ ID NO: 749963 - DNA, 22 bp, Artificial Sequence
  chemically synthesized
agacaaaacagactttaaacca

SEQ ID NO: 749964 - DNA, 22 bp, Artificial Sequence
  chemically synthesized
ttgatctttattggtttaaagt

SEQ ID NO: 749965 - DNA, 22 bp, Artificial Sequence
  chemically synthesized
tgatctttattggtttaaagtc

SEQ ID NO: 749966 - DNA, 22 bp, Artificial Sequence
  chemically synthesized
gatctttattggtttaaagtct

SEQ ID NO: 749967 - DNA, 22 bp, Artificial Sequence
  chemically synthesized
atctttattggtttaaagtctg

SEQ ID NO: 749968 - DNA, 22 bp, Artificial Sequence
  chemically synthesized
gtctcagacaaaacagacttta

SEQ ID NO: 749969 - DNA, 22 bp, Artificial Sequence
  chemically synthesized
tattggtttaaagtctgttttg

SEQ ID NO: 749970 - DNA, 22 bp, Artificial Sequence
  chemically synthesized
attggtttaaagtctgttttgt

SEQ ID NO: 749971 - DNA, 22 bp, Artificial Sequence
  chemically synthesized
ttggtttaaagtctgttttgtc

SEQ ID NO: 749972 - DNA, 22 bp, Artificial Sequence
  chemically synthesized
caatcctagtctcagacaaaac

SEQ ID NO: 749973 - DNA, 22 bp, Artificial Sequence
  chemically synthesized
gtttaaagtctgttttgtctga

SEQ ID NO: 749974 - DNA, 22 bp, Artificial Sequence
  chemically synthesized
aaagtctgttttgtctgagact

SEQ ID NO: 749975 - DNA, 22 bp, Artificial Sequence
  chemically synthesized
aagtctgttttgtctgagacta

SEQ ID NO: 749976 - DNA, 22 bp, Artificial Sequence
  chemically synthesized
ttttgtctgagactaggattgc

SEQ ID NO: 749977 - DNA, 22 bp, Artificial Sequence
  chemically synthesized
tgtctgagactaggattgcaac

SEQ ID NO: 749978 - DNA, 22 bp, Artificial Sequence
  chemically synthesized
gtctgagactaggattgcaacc

SEQ ID NO: 749979 - DNA, 22 bp, Artificial Sequence
  chemically synthesized
tctgagactaggattgcaaccc

SEQ ID NO: 749980 - DNA, 22 bp, Artificial Sequence
  chemically synthesized
agactaggattgcaacccctgc

SEQ ID NO: 749981 - DNA, 22 bp, Artificial Sequence
  chemically synthesized
ggattgcaacccctgctttttt

SEQ ID NO: 749982 - DNA, 22 bp, Artificial Sequence
  chemically synthesized
caacccctgctttttttttctt

SEQ ID NO: 749983 - DNA, 22 bp, Artificial Sequence
  chemically synthesized
ccaagcagcaaatggaaagaaa

SEQ ID NO: 749984 - DNA, 22 bp, Artificial Sequence
  chemically synthesized
accaagcagcaaatggaaagaa

SEQ ID NO: 749985 - DNA, 22 bp, Artificial Sequence
  chemically synthesized
ctttttttttctttccatttgc

SEQ ID NO: 749986 - DNA, 22 bp, Artificial Sequence
  chemically synthesized
tttttttctttccatttgctgc

SEQ ID NO: 749987 - DNA, 22 bp, Artificial Sequence
  chemically synthesized
ttttttctttccatttgctgct

SEQ ID NO: 749988 - DNA, 22 bp, Artificial Sequence
  chemically synthesized
tttttctttccatttgctgctt

SEQ ID NO: 749989 - DNA, 22 bp, Artificial Sequence
  chemically synthesized
ttttctttccatttgctgcttg

SEQ ID NO: 749990 - DNA, 22 bp, Artificial Sequence
  chemically synthesized
tttctttccatttgctgcttgg

SEQ ID NO: 749991 - DNA, 22 bp, Artificial Sequence
  chemically synthesized
ttctttccatttgctgcttggt

SEQ ID NO: 749992 - DNA, 22 bp, Artificial Sequence
  chemically synthesized
tctttccatttgctgcttggta

SEQ ID NO: 749993 - DNA, 22 bp, Artificial Sequence
  chemically synthesized
ctttccatttgctgcttggtaa

SEQ ID NO: 749994 - DNA, 22 bp, Artificial Sequence
  chemically synthesized
tttccatttgctgcttggtaaa

SEQ ID NO: 749995 - DNA, 22 bp, Artificial Sequence
  chemically synthesized
tccatttgctgcttggtaaata

SEQ ID NO: 749996 - DNA, 22 bp, Artificial Sequence
  chemically synthesized
ccatttgctgcttggtaaatat

SEQ ID NO: 749997 - DNA, 22 bp, Artificial Sequence
  chemically synthesized
catttgctgcttggtaaatatt

SEQ ID NO: 749998 - DNA, 22 bp, Artificial Sequence
  chemically synthesized
gctgcttggtaaatattcatcg

SEQ ID NO: 749999 - DNA, 22 bp, Artificial Sequence
  chemically synthesized
ctgcttggtaaatattcatcga

SEQ ID NO: 750000 - DNA, 22 bp, Artificial Sequence
  chemically synthesized
aaaataaagggatcgatgaata

SEQ ID NO: 750001 - DNA, 22 bp, Artificial Sequence
  chemically synthesized
cttggtaaatattcatcgatcc

SEQ ID NO: 750002 - DNA, 22 bp, Artificial Sequence
  chemically synthesized
ggtaaatattcatcgatccctt

SEQ ID NO: 750003 - DNA, 22 bp, Artificial Sequence
  chemically synthesized
gtaaatattcatcgatcccttt

SEQ ID NO: 750004 - DNA, 22 bp, Artificial Sequence
  chemically synthesized
atcgatccctttattttgagcc

SEQ ID NO: 750005 - DNA, 22 bp, Artificial Sequence
  chemically synthesized
atgtgcagagacacacataggc

SEQ ID NO: 750006 - DNA, 22 bp, Artificial Sequence
  chemically synthesized
tattttgagcctatgtgtgtct

SEQ ID NO: 750007 - DNA, 22 bp, Artificial Sequence
  chemically synthesized
attttgagcctatgtgtgtctc

SEQ ID NO: 750008 - DNA, 22 bp, Artificial Sequence
  chemically synthesized
ttttgagcctatgtgtgtctct

SEQ ID NO: 750009 - DNA, 22 bp, Artificial Sequence
  chemically synthesized
tgagcctatgtgtgtctctgca

SEQ ID NO: 750010 - DNA, 22 bp, Artificial Sequence
  chemically synthesized
gagcctatgtgtgtctctgcac

SEQ ID NO: 750011 - DNA, 22 bp, Artificial Sequence
  chemically synthesized
agcctatgtgtgtctctgcaca

SEQ ID NO: 750012 - DNA, 22 bp, Artificial Sequence
  chemically synthesized
agaagacccacctcatgtgcag

SEQ ID NO: 750013 - DNA, 22 bp, Artificial Sequence
  chemically synthesized
tgtgtgtctctgcacatgaggt

SEQ ID NO: 750014 - DNA, 22 bp, Artificial Sequence
  chemically synthesized
tattcagaagacccacctcatg

SEQ ID NO: 750015 - DNA, 22 bp, Artificial Sequence
  chemically synthesized
tgcacatgaggtgggtcttctg

SEQ ID NO: 750016 - DNA, 22 bp, Artificial Sequence
  chemically synthesized
cacatgaggtgggtcttctgaa

SEQ ID NO: 750017 - DNA, 22 bp, Artificial Sequence
  chemically synthesized
aagacccatcagtgtgctgtat

SEQ ID NO: 750018 - DNA, 22 bp, Artificial Sequence
  chemically synthesized
ctgaatacagcacactgatggg

SEQ ID NO: 750019 - DNA, 22 bp, Artificial Sequence
  chemically synthesized
tgaatacagcacactgatgggt

SEQ ID NO: 750020 - DNA, 22 bp, Artificial Sequence
  chemically synthesized
aatacagcacactgatgggtct

SEQ ID NO: 750021 - DNA, 22 bp, Artificial Sequence
  chemically synthesized
gataaagactcaagacccatca

SEQ ID NO: 750022 - DNA, 22 bp, Artificial Sequence
  chemically synthesized
gcaaattggataaagactcaag

SEQ ID NO: 750023 - DNA, 22 bp, Artificial Sequence
  chemically synthesized
atgggtcttgagtctttatcca

SEQ ID NO: 750024 - DNA, 22 bp, Artificial Sequence
  chemically synthesized
aaagacacagactggcaaattg

SEQ ID NO: 750025 - DNA, 22 bp, Artificial Sequence
  chemically synthesized
gagtctttatccaatttgccag

SEQ ID NO: 750026 - DNA, 22 bp, Artificial Sequence
  chemically synthesized
agtctttatccaatttgccagt

SEQ ID NO: 750027 - DNA, 22 bp, Artificial Sequence
  chemically synthesized
tatccaatttgccagtctgtgt

SEQ ID NO: 750028 - DNA, 22 bp, Artificial Sequence
  chemically synthesized
atccaatttgccagtctgtgtc

SEQ ID NO: 750029 - DNA, 22 bp, Artificial Sequence
  chemically synthesized
tccaatttgccagtctgtgtct

SEQ ID NO: 750030 - DNA, 22 bp, Artificial Sequence
  chemically synthesized
aatgccccaattaaaagacaca

SEQ ID NO: 750031 - DNA, 22 bp, Artificial Sequence
  chemically synthesized
gccagtctgtgtcttttaattg

SEQ ID NO: 750032 - DNA, 22 bp, Artificial Sequence
  chemically synthesized
ccagtctgtgtcttttaattgg

SEQ ID NO: 750033 - DNA, 22 bp, Artificial Sequence
  chemically synthesized
tgtcttttaattggggcattta

SEQ ID NO: 750034 - DNA, 22 bp, Artificial Sequence
  chemically synthesized
aatgtaaacaggctaaatgccc

SEQ ID NO: 750035 - DNA, 22 bp, Artificial Sequence
  chemically synthesized
aaatgtaaacaggctaaatgcc

SEQ ID NO: 750036 - DNA, 22 bp, Artificial Sequence
  chemically synthesized
ttaattggggcatttagcctgt

SEQ ID NO: 750037 - DNA, 22 bp, Artificial Sequence
  chemically synthesized
taattggggcatttagcctgtt

SEQ ID NO: 750038 - DNA, 22 bp, Artificial Sequence
  chemically synthesized
accttaaatgtaaacaggctaa

SEQ ID NO: 750039 - DNA, 22 bp, Artificial Sequence
  chemically synthesized
aattggggcatttagcctgttt

SEQ ID NO: 750040 - DNA, 22 bp, Artificial Sequence
  chemically synthesized
attggggcatttagcctgttta

SEQ ID NO: 750041 - DNA, 22 bp, Artificial Sequence
  chemically synthesized
gggcatttagcctgtttacatt

SEQ ID NO: 750042 - DNA, 22 bp, Artificial Sequence
  chemically synthesized
agcctgtttacatttaaggtta

SEQ ID NO: 750043 - DNA, 22 bp, Artificial Sequence
  chemically synthesized
gcctgtttacatttaaggttaa

SEQ ID NO: 750044 - DNA, 22 bp, Artificial Sequence
  chemically synthesized
acacataacaatattaacctta

SEQ ID NO: 750045 - DNA, 22 bp, Artificial Sequence
  chemically synthesized
tttacatttaaggttaatattg

SEQ ID NO: 750046 - DNA, 22 bp, Artificial Sequence
  chemically synthesized
acatttaaggttaatattgtta

SEQ ID NO: 750047 - DNA, 22 bp, Artificial Sequence
  chemically synthesized
catttaaggttaatattgttat

SEQ ID NO: 750048 - DNA, 22 bp, Artificial Sequence
  chemically synthesized
aaggttaatattgttatgtgtg

SEQ ID NO: 750049 - DNA, 22 bp, Artificial Sequence
  chemically synthesized
aggttaatattgttatgtgtga

SEQ ID NO: 750050 - DNA, 22 bp, Artificial Sequence
  chemically synthesized
atattgttatgtgtgaatttga

SEQ ID NO: 750051 - DNA, 22 bp, Artificial Sequence
  chemically synthesized
gcatcataatgacaggatcaaa

SEQ ID NO: 750052 - DNA, 22 bp, Artificial Sequence
  chemically synthesized
ttatgtgtgaatttgatcctgt

SEQ ID NO: 750053 - DNA, 22 bp, Artificial Sequence
  chemically synthesized
tgtgtgaatttgatcctgtcat

SEQ ID NO: 750054 - DNA, 22 bp, Artificial Sequence
  chemically synthesized
gatcctgtcattatgatgctag

SEQ ID NO: 750055 - DNA, 22 bp, Artificial Sequence
  chemically synthesized
atcctgtcattatgatgctagc

SEQ ID NO: 750056 - DNA, 22 bp, Artificial Sequence
  chemically synthesized
acgggcaaagtaaccagctagc

SEQ ID NO: 750057 - DNA, 22 bp, Artificial Sequence
  chemically synthesized
tcattatgatgctagctggtta

SEQ ID NO: 750058 - DNA, 22 bp, Artificial Sequence
  chemically synthesized
tgatgctagctggttactttgc

SEQ ID NO: 750059 - DNA, 22 bp, Artificial Sequence
  chemically synthesized
catcaactaacgggcaaagtaa

SEQ ID NO: 750060 - DNA, 22 bp, Artificial Sequence
  chemically synthesized
gctggttactttgcccgttagt

SEQ ID NO: 750061 - DNA, 22 bp, Artificial Sequence
  chemically synthesized
gttactttgcccgttagttgat

SEQ ID NO: 750062 - DNA, 22 bp, Artificial Sequence
  chemically synthesized
tgaagaaactgcatcaactaac

SEQ ID NO: 750063 - DNA, 22 bp, Artificial Sequence
  chemically synthesized
ctttgcccgttagttgatgcag

SEQ ID NO: 750064 - DNA, 22 bp, Artificial Sequence
  chemically synthesized
tgcccgttagttgatgcagttt

SEQ ID NO: 750065 - DNA, 22 bp, Artificial Sequence
  chemically synthesized
gcccgttagttgatgcagtttc

SEQ ID NO: 750066 - DNA, 22 bp, Artificial Sequence
  chemically synthesized
cccgttagttgatgcagtttct

SEQ ID NO: 750067 - DNA, 22 bp, Artificial Sequence
  chemically synthesized
gttgatgcagtttcttcatagt

SEQ ID NO: 750068 - DNA, 22 bp, Artificial Sequence
  chemically synthesized
taaagaccatcacactatgaag

SEQ ID NO: 750069 - DNA, 22 bp, Artificial Sequence
  chemically synthesized
atgcagtttcttcatagtgtga

SEQ ID NO: 750070 - DNA, 22 bp, Artificial Sequence
  chemically synthesized
cttcatagtgtgatggtcttta

SEQ ID NO: 750071 - DNA, 22 bp, Artificial Sequence
  chemically synthesized
ttcatagtgtgatggtctttac

SEQ ID NO: 750072 - DNA, 22 bp, Artificial Sequence
  chemically synthesized
catagtgtgatggtctttacaa

SEQ ID NO: 750073 - DNA, 22 bp, Artificial Sequence
  chemically synthesized
atagtgtgatggtctttacaat

SEQ ID NO: 750074 - DNA, 22 bp, Artificial Sequence
  chemically synthesized
gtaccagccatggtaaaaacat

SEQ ID NO: 750075 - DNA, 22 bp, Artificial Sequence
  chemically synthesized
tacaatttgttatgtttttacc

SEQ ID NO: 750076 - DNA, 22 bp, Artificial Sequence
  chemically synthesized
acaatttgttatgtttttacca

SEQ ID NO: 750077 - DNA, 22 bp, Artificial Sequence
  chemically synthesized
caatttgttatgtttttaccat

SEQ ID NO: 750078 - DNA, 22 bp, Artificial Sequence
  chemically synthesized
gttatgtttttaccatggctgg

SEQ ID NO: 750079 - DNA, 22 bp, Artificial Sequence
  chemically synthesized
ttatgtttttaccatggctggt

SEQ ID NO: 750080 - DNA, 22 bp, Artificial Sequence
  chemically synthesized
tgtttttaccatggctggtacc

SEQ ID NO: 750081 - DNA, 22 bp, Artificial Sequence
  chemically synthesized
ttaccatggctggtaccagttt

SEQ ID NO: 750082 - DNA, 22 bp, Artificial Sequence
  chemically synthesized
taccatggctggtaccagtttt

SEQ ID NO: 750083 - DNA, 22 bp, Artificial Sequence
  chemically synthesized
accatggctggtaccagttttt

SEQ ID NO: 750084 - DNA, 22 bp, Artificial Sequence
  chemically synthesized
aatatggaaaggaaaaactggt

SEQ ID NO: 750085 - DNA, 22 bp, Artificial Sequence
  chemically synthesized
ccatggctggtaccagtttttc

SEQ ID NO: 750086 - DNA, 22 bp, Artificial Sequence
  chemically synthesized
gtaccagtttttcctttccata

SEQ ID NO: 750087 - DNA, 22 bp, Artificial Sequence
  chemically synthesized
atgaaggaagcactaaatatgg

SEQ ID NO: 750088 - DNA, 22 bp, Artificial Sequence
  chemically synthesized
taatgaaggaagcactaaatat

SEQ ID NO: 750089 - DNA, 22 bp, Artificial Sequence
  chemically synthesized
ctaatgaaggaagcactaaata

SEQ ID NO: 750090 - DNA, 22 bp, Artificial Sequence
  chemically synthesized
ttcctttccatatttagtgctt

SEQ ID NO: 750091 - DNA, 22 bp, Artificial Sequence
  chemically synthesized
tcctttccatatttagtgcttc

SEQ ID NO: 750092 - DNA, 22 bp, Artificial Sequence
  chemically synthesized
cctttccatatttagtgcttcc

SEQ ID NO: 750093 - DNA, 22 bp, Artificial Sequence
  chemically synthesized
ctttccatatttagtgcttcct

SEQ ID NO: 750094 - DNA, 22 bp, Artificial Sequence
  chemically synthesized
tccatatttagtgcttccttca

SEQ ID NO: 750095 - DNA, 22 bp, Artificial Sequence
  chemically synthesized
ccatatttagtgcttccttcat

SEQ ID NO: 750096 - DNA, 22 bp, Artificial Sequence
  chemically synthesized
caagagcttctaatgaaggaag

SEQ ID NO: 750097 - DNA, 22 bp, Artificial Sequence
  chemically synthesized
catatttagtgcttccttcatt

SEQ ID NO: 750098 - DNA, 22 bp, Artificial Sequence
  chemically synthesized
acaagagcttctaatgaaggaa

SEQ ID NO: 750099 - DNA, 22 bp, Artificial Sequence
  chemically synthesized
ccttacaagagcttctaatgaa

SEQ ID NO: 750100 - DNA, 22 bp, Artificial Sequence
  chemically synthesized
agtgcttccttcattagaagct

SEQ ID NO: 750101 - DNA, 22 bp, Artificial Sequence
  chemically synthesized
gtgcttccttcattagaagctc

SEQ ID NO: 750102 - DNA, 22 bp, Artificial Sequence
  chemically synthesized
ccttcattagaagctcttgtaa

SEQ ID NO: 750103 - DNA, 22 bp, Artificial Sequence
  chemically synthesized
cttcattagaagctcttgtaag

SEQ ID NO: 750104 - DNA, 22 bp, Artificial Sequence
  chemically synthesized
cattagaagctcttgtaaggca

SEQ ID NO: 750105 - DNA, 22 bp, Artificial Sequence
  chemically synthesized
attagaagctcttgtaaggcag

SEQ ID NO: 750106 - DNA, 22 bp, Artificial Sequence
  chemically synthesized
tcaccaccaggcctgccttaca

SEQ ID NO: 750107 - DNA, 22 bp, Artificial Sequence
  chemically synthesized
gtcaccaccaggcctgccttac

SEQ ID NO: 750108 - DNA, 22 bp, Artificial Sequence
  chemically synthesized
tgtcaccaccaggcctgcctta

SEQ ID NO: 750109 - DNA, 22 bp, Artificial Sequence
  chemically synthesized
gaagctcttgtaaggcaggcct

SEQ ID NO: 750110 - DNA, 22 bp, Artificial Sequence
  chemically synthesized
agagattttgtcaccaccaggc

SEQ ID NO: 750111 - DNA, 22 bp, Artificial Sequence
  chemically synthesized
ttgtaaggcaggcctggtggtg

SEQ ID NO: 750112 - DNA, 22 bp, Artificial Sequence
  chemically synthesized
gtaaggcaggcctggtggtgac

SEQ ID NO: 750113 - DNA, 22 bp, Artificial Sequence
  chemically synthesized
taaggcaggcctggtggtgaca

SEQ ID NO: 750114 - DNA, 22 bp, Artificial Sequence
  chemically synthesized
gtggtgacaaaatctctcagca

SEQ ID NO: 750115 - DNA, 22 bp, Artificial Sequence
  chemically synthesized
cagacaagcaaatgctgagaga

SEQ ID NO: 750116 - DNA, 22 bp, Artificial Sequence
  chemically synthesized
acagacaagcaaatgctgagag

SEQ ID NO: 750117 - DNA, 22 bp, Artificial Sequence
  chemically synthesized
tacagacaagcaaatgctgaga

SEQ ID NO: 750118 - DNA, 22 bp, Artificial Sequence
  chemically synthesized
tcagcatttgcttgtctgtaaa

SEQ ID NO: 750119 - DNA, 22 bp, Artificial Sequence
  chemically synthesized
agcatttgcttgtctgtaaagg

SEQ ID NO: 750120 - DNA, 22 bp, Artificial Sequence
  chemically synthesized
gcttgtctgtaaaggattttat

SEQ ID NO: 750121 - DNA, 22 bp, Artificial Sequence
  chemically synthesized
cttgtctgtaaaggattttatt

SEQ ID NO: 750122 - DNA, 22 bp, Artificial Sequence
  chemically synthesized
ataagcaaagtagaaataaaat

SEQ ID NO: 750123 - DNA, 22 bp, Artificial Sequence
  chemically synthesized
gtctgtaaaggattttatttct

SEQ ID NO: 750124 - DNA, 22 bp, Artificial Sequence
  chemically synthesized
cataagcaaagtagaaataaaa

SEQ ID NO: 750125 - DNA, 22 bp, Artificial Sequence
  chemically synthesized
tctgtaaaggattttatttcta

SEQ ID NO: 750126 - DNA, 22 bp, Artificial Sequence
  chemically synthesized
taaaggattttatttctacttt

SEQ ID NO: 750127 - DNA, 22 bp, Artificial Sequence
  chemically synthesized
agcttcataagcaaagtagaaa

SEQ ID NO: 750128 - DNA, 22 bp, Artificial Sequence
  chemically synthesized
tatttctactttgcttatgaag

SEQ ID NO: 750129 - DNA, 22 bp, Artificial Sequence
  chemically synthesized
atttctactttgcttatgaagc

SEQ ID NO: 750130 - DNA, 22 bp, Artificial Sequence
  chemically synthesized
tttctactttgcttatgaagct

SEQ ID NO: 750131 - DNA, 22 bp, Artificial Sequence
  chemically synthesized
ctactttgcttatgaagcttag

SEQ ID NO: 750132 - DNA, 22 bp, Artificial Sequence
  chemically synthesized
tactttgcttatgaagcttagt

SEQ ID NO: 750133 - DNA, 22 bp, Artificial Sequence
  chemically synthesized
atatccagccaaactaagcttc

SEQ ID NO: 750134 - DNA, 22 bp, Artificial Sequence
  chemically synthesized
catatccagccaaactaagctt

SEQ ID NO: 750135 - DNA, 22 bp, Artificial Sequence
  chemically synthesized
ctttgcttatgaagcttagttt

SEQ ID NO: 750136 - DNA, 22 bp, Artificial Sequence
  chemically synthesized
tgcttatgaagcttagtttggc

SEQ ID NO: 750137 - DNA, 22 bp, Artificial Sequence
  chemically synthesized
gcttatgaagcttagtttggct

SEQ ID NO: 750138 - DNA, 22 bp, Artificial Sequence
  chemically synthesized
cttatgaagcttagtttggctg

SEQ ID NO: 750139 - DNA, 22 bp, Artificial Sequence
  chemically synthesized
atgaagcttagtttggctggat

SEQ ID NO: 750140 - DNA, 22 bp, Artificial Sequence
  chemically synthesized
tgaagcttagtttggctggata

SEQ ID NO: 750141 - DNA, 22 bp, Artificial Sequence
  chemically synthesized
aacccagaatttcatatccagc

SEQ ID NO: 750142 - DNA, 22 bp, Artificial Sequence
  chemically synthesized
caacccagaatttcatatccag

SEQ ID NO: 750143 - DNA, 22 bp, Artificial Sequence
  chemically synthesized
tcaacccagaatttcatatcca

SEQ ID NO: 750144 - DNA, 22 bp, Artificial Sequence
  chemically synthesized
agtttggctggatatgaaattc

SEQ ID NO: 750145 - DNA, 22 bp, Artificial Sequence
  chemically synthesized
gtttggctggatatgaaattct

SEQ ID NO: 750146 - DNA, 22 bp, Artificial Sequence
  chemically synthesized
ggctggatatgaaattctgggt

SEQ ID NO: 750147 - DNA, 22 bp, Artificial Sequence
  chemically synthesized
gctggatatgaaattctgggtt

SEQ ID NO: 750148 - DNA, 22 bp, Artificial Sequence
  chemically synthesized
aagaaaagaattttcaacccag

SEQ ID NO: 750149 - DNA, 22 bp, Artificial Sequence
  chemically synthesized
gatatgaaattctgggttgaaa

SEQ ID NO: 750150 - DNA, 22 bp, Artificial Sequence
  chemically synthesized
aaagaaaagaattttcaaccca

SEQ ID NO: 750151 - DNA, 22 bp, Artificial Sequence
  chemically synthesized
ttaaagaaaagaattttcaacc

SEQ ID NO: 750152 - DNA, 22 bp, Artificial Sequence
  chemically synthesized
aacattcttaaagaaaagaatt

SEQ ID NO: 750153 - DNA, 22 bp, Artificial Sequence
  chemically synthesized
tgggttgaaaattcttttcttt

SEQ ID NO: 750154 - DNA, 22 bp, Artificial Sequence
  chemically synthesized
ggttgaaaattcttttctttaa

SEQ ID NO: 750155 - DNA, 22 bp, Artificial Sequence
  chemically synthesized
aaaattcttttctttaagaatg

SEQ ID NO: 750156 - DNA, 22 bp, Artificial Sequence
  chemically synthesized
ttttctttaagaatgttgaata

SEQ ID NO: 750157 - DNA, 22 bp, Artificial Sequence
  chemically synthesized
ttctttaagaatgttgaatatt

SEQ ID NO: 750158 - DNA, 22 bp, Artificial Sequence
  chemically synthesized
tctttaagaatgttgaatattg

SEQ ID NO: 750159 - DNA, 22 bp, Artificial Sequence
  chemically synthesized
ctttaagaatgttgaatattgg

SEQ ID NO: 750160 - DNA, 22 bp, Artificial Sequence
  chemically synthesized
tttaagaatgttgaatattggc

SEQ ID NO: 750161 - DNA, 22 bp, Artificial Sequence
  chemically synthesized
taagaatgttgaatattggccc

SEQ ID NO: 750162 - DNA, 22 bp, Artificial Sequence
  chemically synthesized
aagaatgttgaatattggcccc

SEQ ID NO: 750163 - DNA, 22 bp, Artificial Sequence
  chemically synthesized
agaatgttgaatattggccccc

SEQ ID NO: 750164 - DNA, 22 bp, Artificial Sequence
  chemically synthesized
caagccagaagagagtgggggc

SEQ ID NO: 750165 - DNA, 22 bp, Artificial Sequence
  chemically synthesized
aatattggcccccactctcttc

SEQ ID NO: 750166 - DNA, 22 bp, Artificial Sequence
  chemically synthesized
gcccccactctcttctggcttg

SEQ ID NO: 750167 - DNA, 22 bp, Artificial Sequence
  chemically synthesized
gcagaaaccctacaagccagaa

SEQ ID NO: 750168 - DNA, 22 bp, Artificial Sequence
  chemically synthesized
ggcagaaaccctacaagccaga

SEQ ID NO: 750169 - DNA, 22 bp, Artificial Sequence
  chemically synthesized
tcttctggcttgtagggtttct

SEQ ID NO: 750170 - DNA, 22 bp, Artificial Sequence
  chemically synthesized
ttctggcttgtagggtttctgc

SEQ ID NO: 750171 - DNA, 22 bp, Artificial Sequence
  chemically synthesized
ctggcttgtagggtttctgcca

SEQ ID NO: 750172 - DNA, 22 bp, Artificial Sequence
  chemically synthesized
tggcttgtagggtttctgccaa

SEQ ID NO: 750173 - DNA, 22 bp, Artificial Sequence
  chemically synthesized
acagcggatcatttggcagaaa

SEQ ID NO: 750174 - DNA, 22 bp, Artificial Sequence
  chemically synthesized
gcttgtagggtttctgccaaat

SEQ ID NO: 750175 - DNA, 22 bp, Artificial Sequence
  chemically synthesized
gtagggtttctgccaaatgatc

SEQ ID NO: 750176 - DNA, 22 bp, Artificial Sequence
  chemically synthesized
tagggtttctgccaaatgatcc

SEQ ID NO: 750177 - DNA, 22 bp, Artificial Sequence
  chemically synthesized
ctgccaaatgatccgctgttag

SEQ ID NO: 750178 - DNA, 22 bp, Artificial Sequence
  chemically synthesized
tgccaaatgatccgctgttagt

SEQ ID NO: 750179 - DNA, 22 bp, Artificial Sequence
  chemically synthesized
ccaaatgatccgctgttagtct

SEQ ID NO: 750180 - DNA, 22 bp, Artificial Sequence
  chemically synthesized
ccccaaaggaaagcccatcaga

SEQ ID NO: 750181 - DNA, 22 bp, Artificial Sequence
  chemically synthesized
ttagtctgatgggctttccttt

SEQ ID NO: 750182 - DNA, 22 bp, Artificial Sequence
  chemically synthesized
gtctgatgggctttcctttggg

SEQ ID NO: 750183 - DNA, 22 bp, Artificial Sequence
  chemically synthesized
atgggctttcctttggggtagc

SEQ ID NO: 750184 - DNA, 22 bp, Artificial Sequence
  chemically synthesized
tcctttggggtagcctgacctt

SEQ ID NO: 750185 - DNA, 22 bp, Artificial Sequence
  chemically synthesized
cctttggggtagcctgaccttt

SEQ ID NO: 750186 - DNA, 22 bp, Artificial Sequence
  chemically synthesized
ctttggggtagcctgacctttc

SEQ ID NO: 750187 - DNA, 22 bp, Artificial Sequence
  chemically synthesized
agggcagccagagagaaaggtc

SEQ ID NO: 750188 - DNA, 22 bp, Artificial Sequence
  chemically synthesized
tggggtagcctgacctttctct

SEQ ID NO: 750189 - DNA, 22 bp, Artificial Sequence
  chemically synthesized
ggggtagcctgacctttctctc

SEQ ID NO: 750190 - DNA, 22 bp, Artificial Sequence
  chemically synthesized
gggtagcctgacctttctctct

SEQ ID NO: 750191 - DNA, 22 bp, Artificial Sequence
  chemically synthesized
acctttctctctggctgccctt

SEQ ID NO: 750192 - DNA, 22 bp, Artificial Sequence
  chemically synthesized
tctctctggctgcccttaacat

SEQ ID NO: 750193 - DNA, 22 bp, Artificial Sequence
  chemically synthesized
ctctctggctgcccttaacatt

SEQ ID NO: 750194 - DNA, 22 bp, Artificial Sequence
  chemically synthesized
tctctggctgcccttaacattt

SEQ ID NO: 750195 - DNA, 22 bp, Artificial Sequence
  chemically synthesized
aaatgaaggaaaaaatgttaag

SEQ ID NO: 750196 - DNA, 22 bp, Artificial Sequence
  chemically synthesized
tctggctgcccttaacattttt

SEQ ID NO: 750197 - DNA, 22 bp, Artificial Sequence
  chemically synthesized
tggctgcccttaacattttttc

SEQ ID NO: 750198 - DNA, 22 bp, Artificial Sequence
  chemically synthesized
gctgcccttaacattttttcct

SEQ ID NO: 750199 - DNA, 22 bp, Artificial Sequence
  chemically synthesized
cccttaacattttttccttcat

SEQ ID NO: 750200 - DNA, 22 bp, Artificial Sequence
  chemically synthesized
accaaggttgaaatgaaggaaa

SEQ ID NO: 750201 - DNA, 22 bp, Artificial Sequence
  chemically synthesized
aacattttttccttcatttcaa

SEQ ID NO: 750202 - DNA, 22 bp, Artificial Sequence
  chemically synthesized
acattttttccttcatttcaac

SEQ ID NO: 750203 - DNA, 22 bp, Artificial Sequence
  chemically synthesized
tttccttcatttcaaccttggt

SEQ ID NO: 750204 - DNA, 22 bp, Artificial Sequence
  chemically synthesized
ttccttcatttcaaccttggtg

SEQ ID NO: 750205 - DNA, 22 bp, Artificial Sequence
  chemically synthesized
tccttcatttcaaccttggtga

SEQ ID NO: 750206 - DNA, 22 bp, Artificial Sequence
  chemically synthesized
ccttcatttcaaccttggtgaa

SEQ ID NO: 750207 - DNA, 22 bp, Artificial Sequence
  chemically synthesized
cttcatttcaaccttggtgaat

SEQ ID NO: 750208 - DNA, 22 bp, Artificial Sequence
  chemically synthesized
catttcaaccttggtgaatccg

SEQ ID NO: 750209 - DNA, 22 bp, Artificial Sequence
  chemically synthesized
atttcaaccttggtgaatccga

SEQ ID NO: 750210 - DNA, 22 bp, Artificial Sequence
  chemically synthesized
caaccttggtgaatccgattat

SEQ ID NO: 750211 - DNA, 22 bp, Artificial Sequence
  chemically synthesized
aaccttggtgaatccgattatt

SEQ ID NO: 750212 - DNA, 22 bp, Artificial Sequence
  chemically synthesized
ggtgaatccgattattatgtgt

SEQ ID NO: 750213 - DNA, 22 bp, Artificial Sequence
  chemically synthesized
gtgaatccgattattatgtgtc

SEQ ID NO: 750214 - DNA, 22 bp, Artificial Sequence
  chemically synthesized
agaagagcaacccaagacacat

SEQ ID NO: 750215 - DNA, 22 bp, Artificial Sequence
  chemically synthesized
gagaagagcaacccaagacaca

SEQ ID NO: 750216 - DNA, 22 bp, Artificial Sequence
  chemically synthesized
cttgagaagagcaacccaagac

SEQ ID NO: 750217 - DNA, 22 bp, Artificial Sequence
  chemically synthesized
ttatgtgtcttgggttgctctt

SEQ ID NO: 750218 - DNA, 22 bp, Artificial Sequence
  chemically synthesized
tgtgtcttgggttgctcttctc

SEQ ID NO: 750219 - DNA, 22 bp, Artificial Sequence
  chemically synthesized
gggttgctcttctcaaggagta

SEQ ID NO: 750220 - DNA, 22 bp, Artificial Sequence
  chemically synthesized
ggttgctcttctcaaggagtat

SEQ ID NO: 750221 - DNA, 22 bp, Artificial Sequence
  chemically synthesized
ctcttctcaaggagtatctttg

SEQ ID NO: 750222 - DNA, 22 bp, Artificial Sequence
  chemically synthesized
ttctcaaggagtatctttgtgg

SEQ ID NO: 750223 - DNA, 22 bp, Artificial Sequence
  chemically synthesized
ctcaaggagtatctttgtggtg

SEQ ID NO: 750224 - DNA, 22 bp, Artificial Sequence
  chemically synthesized
tcaaggagtatctttgtggtgt

SEQ ID NO: 750225 - DNA, 22 bp, Artificial Sequence
  chemically synthesized
aaggagtatctttgtggtgttc

SEQ ID NO: 750226 - DNA, 22 bp, Artificial Sequence
  chemically synthesized
aggaaatatggagaacaccaca

SEQ ID NO: 750227 - DNA, 22 bp, Artificial Sequence
  chemically synthesized
aaattcaggaaatatggagaac

SEQ ID NO: 750228 - DNA, 22 bp, Artificial Sequence
  chemically synthesized
tgtggtgttctccatatttcct

SEQ ID NO: 750229 - DNA, 22 bp, Artificial Sequence
  chemically synthesized
gtggtgttctccatatttcctg

SEQ ID NO: 750230 - DNA, 22 bp, Artificial Sequence
  chemically synthesized
tggtgttctccatatttcctga

SEQ ID NO: 750231 - DNA, 22 bp, Artificial Sequence
  chemically synthesized
tccatatttcctgaatttgaat

SEQ ID NO: 750232 - DNA, 22 bp, Artificial Sequence
  chemically synthesized
catatttcctgaatttgaatgt

SEQ ID NO: 750233 - DNA, 22 bp, Artificial Sequence
  chemically synthesized
gcaagacaggccaacattcaaa

SEQ ID NO: 750234 - DNA, 22 bp, Artificial Sequence
  chemically synthesized
cctgaatttgaatgttggcctg

SEQ ID NO: 750235 - DNA, 22 bp, Artificial Sequence
  chemically synthesized
ctgaatttgaatgttggcctgt

SEQ ID NO: 750236 - DNA, 22 bp, Artificial Sequence
  chemically synthesized
cccaacctagcaagacaggcca

SEQ ID NO: 750237 - DNA, 22 bp, Artificial Sequence
  chemically synthesized
aatttgaatgttggcctgtctt

SEQ ID NO: 750238 - DNA, 22 bp, Artificial Sequence
  chemically synthesized
ccccaacctagcaagacaggcc

SEQ ID NO: 750239 - DNA, 22 bp, Artificial Sequence
  chemically synthesized
gaatgttggcctgtcttgctag

SEQ ID NO: 750240 - DNA, 22 bp, Artificial Sequence
  chemically synthesized
aatgttggcctgtcttgctagg

SEQ ID NO: 750241 - DNA, 22 bp, Artificial Sequence
  chemically synthesized
gcctgtcttgctaggttgggga

SEQ ID NO: 750242 - DNA, 22 bp, Artificial Sequence
  chemically synthesized
tccaggagaacttccccaacct

SEQ ID NO: 750243 - DNA, 22 bp, Artificial Sequence
  chemically synthesized
ttatccaggagaacttccccaa

SEQ ID NO: 750244 - DNA, 22 bp, Artificial Sequence
  chemically synthesized
tcttgctaggttggggaagttc

SEQ ID NO: 750245 - DNA, 22 bp, Artificial Sequence
  chemically synthesized
gctaggttggggaagttctcct

SEQ ID NO: 750246 - DNA, 22 bp, Artificial Sequence
  chemically synthesized
aggttattatccaggagaactt

SEQ ID NO: 750247 - DNA, 22 bp, Artificial Sequence
  chemically synthesized
ctaggttggggaagttctcctg

SEQ ID NO: 750248 - DNA, 22 bp, Artificial Sequence
  chemically synthesized
caggttattatccaggagaact

SEQ ID NO: 750249 - DNA, 22 bp, Artificial Sequence
  chemically synthesized
ttcaggttattatccaggagaa

SEQ ID NO: 750250 - DNA, 22 bp, Artificial Sequence
  chemically synthesized
ggttggggaagttctcctggat

SEQ ID NO: 750251 - DNA, 22 bp, Artificial Sequence
  chemically synthesized
gggaagttctcctggataataa

SEQ ID NO: 750252 - DNA, 22 bp, Artificial Sequence
  chemically synthesized
gaaaacactcttcaggttatta

SEQ ID NO: 750253 - DNA, 22 bp, Artificial Sequence
  chemically synthesized
tcctggataataacctgaagag

SEQ ID NO: 750254 - DNA, 22 bp, Artificial Sequence
  chemically synthesized
ctggataataacctgaagagtg

SEQ ID NO: 750255 - DNA, 22 bp, Artificial Sequence
  chemically synthesized
gataataacctgaagagtgttt

SEQ ID NO: 750256 - DNA, 22 bp, Artificial Sequence
  chemically synthesized
aagagtgttttccaacttggtt

SEQ ID NO: 750257 - DNA, 22 bp, Artificial Sequence
  chemically synthesized
aaagtgatggggagaatggaac

SEQ ID NO: 750258 - DNA, 22 bp, Artificial Sequence
  chemically synthesized
tccaacttggttccattctccc

SEQ ID NO: 750259 - DNA, 22 bp, Artificial Sequence
  chemically synthesized
ccaacttggttccattctcccc

SEQ ID NO: 750260 - DNA, 22 bp, Artificial Sequence
  chemically synthesized
caacttggttccattctcccca

SEQ ID NO: 750261 - DNA, 22 bp, Artificial Sequence
  chemically synthesized
gtgtacctgaaagtgatgggga

SEQ ID NO: 750262 - DNA, 22 bp, Artificial Sequence
  chemically synthesized
ggttccattctccccatcactt

SEQ ID NO: 750263 - DNA, 22 bp, Artificial Sequence
  chemically synthesized
gttccattctccccatcacttt

SEQ ID NO: 750264 - DNA, 22 bp, Artificial Sequence
  chemically synthesized
attggtgtacctgaaagtgatg

SEQ ID NO: 750265 - DNA, 22 bp, Artificial Sequence
  chemically synthesized
gattggtgtacctgaaagtgat

SEQ ID NO: 750266 - DNA, 22 bp, Artificial Sequence
  chemically synthesized
cattctccccatcactttcagg

SEQ ID NO: 750267 - DNA, 22 bp, Artificial Sequence
  chemically synthesized
catttgattggtgtacctgaaa

SEQ ID NO: 750268 - DNA, 22 bp, Artificial Sequence
  chemically synthesized
tccccatcactttcaggtacac

SEQ ID NO: 750269 - DNA, 22 bp, Artificial Sequence
  chemically synthesized
cccatcactttcaggtacacca

SEQ ID NO: 750270 - DNA, 22 bp, Artificial Sequence
  chemically synthesized
tcaggtacaccaatcaaatgta

SEQ ID NO: 750271 - DNA, 22 bp, Artificial Sequence
  chemically synthesized
caggtacaccaatcaaatgtag

SEQ ID NO: 750272 - DNA, 22 bp, Artificial Sequence
  chemically synthesized
aggtacaccaatcaaatgtagg

SEQ ID NO: 750273 - DNA, 22 bp, Artificial Sequence
  chemically synthesized
aagaaatatgggacgatgtgaa

SEQ ID NO: 750274 - DNA, 22 bp, Artificial Sequence
  chemically synthesized
caagaaatatgggacgatgtga

SEQ ID NO: 750275 - DNA, 22 bp, Artificial Sequence
  chemically synthesized
ggtcttttcacatcgtcccata

SEQ ID NO: 750276 - DNA, 22 bp, Artificial Sequence
  chemically synthesized
gtcttttcacatcgtcccatat

SEQ ID NO: 750277 - DNA, 22 bp, Artificial Sequence
  chemically synthesized
ttcacatcgtcccatatttctt

SEQ ID NO: 750278 - DNA, 22 bp, Artificial Sequence
  chemically synthesized
tcacatcgtcccatatttcttg

SEQ ID NO: 750279 - DNA, 22 bp, Artificial Sequence
  chemically synthesized
cacatcgtcccatatttcttga

SEQ ID NO: 750280 - DNA, 22 bp, Artificial Sequence
  chemically synthesized
acatcgtcccatatttcttgaa

SEQ ID NO: 750281 - DNA, 22 bp, Artificial Sequence
  chemically synthesized
cttgaaggctttgtttgttcct

SEQ ID NO: 750282 - DNA, 22 bp, Artificial Sequence
  chemically synthesized
ttgaaggctttgtttgttcctt

SEQ ID NO: 750283 - DNA, 22 bp, Artificial Sequence
  chemically synthesized
aaaaaagaatgaaaaggaacaa

SEQ ID NO: 750284 - DNA, 22 bp, Artificial Sequence
  chemically synthesized
gaaggctttgtttgttcctttt

SEQ ID NO: 750285 - DNA, 22 bp, Artificial Sequence
  chemically synthesized
aaggctttgtttgttccttttc

SEQ ID NO: 750286 - DNA, 22 bp, Artificial Sequence
  chemically synthesized
ctgaaaaaagaatgaaaaggaa

SEQ ID NO: 750287 - DNA, 22 bp, Artificial Sequence
  chemically synthesized
tgtttgttccttttcattcttt

SEQ ID NO: 750288 - DNA, 22 bp, Artificial Sequence
  chemically synthesized
gtttgttccttttcattctttt

SEQ ID NO: 750289 - DNA, 22 bp, Artificial Sequence
  chemically synthesized
tttgttccttttcattcttttt

SEQ ID NO: 750290 - DNA, 22 bp, Artificial Sequence
  chemically synthesized
gttccttttcattcttttttca

SEQ ID NO: 750291 - DNA, 22 bp, Artificial Sequence
  chemically synthesized
ttccttttcattcttttttcag

SEQ ID NO: 750292 - DNA, 22 bp, Artificial Sequence
  chemically synthesized
cttttcattcttttttcagtaa

SEQ ID NO: 750293 - DNA, 22 bp, Artificial Sequence
  chemically synthesized
ttcattcttttttcagtaatct

SEQ ID NO: 750294 - DNA, 22 bp, Artificial Sequence
  chemically synthesized
tcattcttttttcagtaatctt

SEQ ID NO: 750295 - DNA, 22 bp, Artificial Sequence
  chemically synthesized
cattcttttttcagtaatcttc

SEQ ID NO: 750296 - DNA, 22 bp, Artificial Sequence
  chemically synthesized
attcttttttcagtaatcttct

SEQ ID NO: 750297 - DNA, 22 bp, Artificial Sequence
  chemically synthesized
ttttttcagtaatcttctcttc

SEQ ID NO: 750298 - DNA, 22 bp, Artificial Sequence
  chemically synthesized
ttttcagtaatcttctcttcat

SEQ ID NO: 750299 - DNA, 22 bp, Artificial Sequence
  chemically synthesized
atgaaataaagcatgaagagaa

SEQ ID NO: 750300 - DNA, 22 bp, Artificial Sequence
  chemically synthesized
tttcagtaatcttctcttcatg

SEQ ID NO: 750301 - DNA, 22 bp, Artificial Sequence
  chemically synthesized
aatgaaataaagcatgaagaga

SEQ ID NO: 750302 - DNA, 22 bp, Artificial Sequence
  chemically synthesized
ttcagtaatcttctcttcatgc

SEQ ID NO: 750303 - DNA, 22 bp, Artificial Sequence
  chemically synthesized
tcagtaatcttctcttcatgct

SEQ ID NO: 750304 - DNA, 22 bp, Artificial Sequence
  chemically synthesized
cagtaatcttctcttcatgctt

SEQ ID NO: 750305 - DNA, 22 bp, Artificial Sequence
  chemically synthesized
agtaatcttctcttcatgcttt

SEQ ID NO: 750306 - DNA, 22 bp, Artificial Sequence
  chemically synthesized
aagatcaacttaatgaaataaa

SEQ ID NO: 750307 - DNA, 22 bp, Artificial Sequence
  chemically synthesized
ctcttcatgctttatttcatta

SEQ ID NO: 750308 - DNA, 22 bp, Artificial Sequence
  chemically synthesized
tcttcatgctttatttcattaa

SEQ ID NO: 750309 - DNA, 22 bp, Artificial Sequence
  chemically synthesized
ttcatgctttatttcattaagt

SEQ ID NO: 750310 - DNA, 22 bp, Artificial Sequence
  chemically synthesized
catgctttatttcattaagttg

SEQ ID NO: 750311 - DNA, 22 bp, Artificial Sequence
  chemically synthesized
atgctttatttcattaagttga

SEQ ID NO: 750312 - DNA, 22 bp, Artificial Sequence
  chemically synthesized
tatttcattaagttgatcttca

SEQ ID NO: 750313 - DNA, 22 bp, Artificial Sequence
  chemically synthesized
atttcattaagttgatcttcag

SEQ ID NO: 750314 - DNA, 22 bp, Artificial Sequence
  chemically synthesized
tttcattaagttgatcttcagt

SEQ ID NO: 750315 - DNA, 22 bp, Artificial Sequence
  chemically synthesized
cattaagttgatcttcagtctc

SEQ ID NO: 750316 - DNA, 22 bp, Artificial Sequence
  chemically synthesized
attaagttgatcttcagtctct

SEQ ID NO: 750317 - DNA, 22 bp, Artificial Sequence
  chemically synthesized
agttgatcttcagtctctgata

SEQ ID NO: 750318 - DNA, 22 bp, Artificial Sequence
  chemically synthesized
atcttcagtctctgatatcctt

SEQ ID NO: 750319 - DNA, 22 bp, Artificial Sequence
  chemically synthesized
cagtctctgatatcctttcttt

SEQ ID NO: 750320 - DNA, 22 bp, Artificial Sequence
  chemically synthesized
agtctctgatatcctttctttt

SEQ ID NO: 750321 - DNA, 22 bp, Artificial Sequence
  chemically synthesized
tgatatcctttcttttgcttgg

SEQ ID NO: 750322 - DNA, 22 bp, Artificial Sequence
  chemically synthesized
atatcctttcttttgcttggtc

SEQ ID NO: 750323 - DNA, 22 bp, Artificial Sequence
  chemically synthesized
tcttttgcttggtcgatttggc

SEQ ID NO: 750324 - DNA, 22 bp, Artificial Sequence
  chemically synthesized
cttttgcttggtcgatttggct

SEQ ID NO: 750325 - DNA, 22 bp, Artificial Sequence
  chemically synthesized
ttttgcttggtcgatttggcta

SEQ ID NO: 750326 - DNA, 22 bp, Artificial Sequence
  chemically synthesized
ttgcttggtcgatttggctatt

SEQ ID NO: 750327 - DNA, 22 bp, Artificial Sequence
  chemically synthesized
tgcttggtcgatttggctattg

SEQ ID NO: 750328 - DNA, 22 bp, Artificial Sequence
  chemically synthesized
gcttggtcgatttggctattga

SEQ ID NO: 750329 - DNA, 22 bp, Artificial Sequence
  chemically synthesized
cttggtcgatttggctattgat

SEQ ID NO: 750330 - DNA, 22 bp, Artificial Sequence
  chemically synthesized
ggtcgatttggctattgatact

SEQ ID NO: 750331 - DNA, 22 bp, Artificial Sequence
  chemically synthesized
gtcgatttggctattgatactt

SEQ ID NO: 750332 - DNA, 22 bp, Artificial Sequence
  chemically synthesized
tgaagcatacacaagtatcaat

SEQ ID NO: 750333 - DNA, 22 bp, Artificial Sequence
  chemically synthesized
gtgaagcatacacaagtatcaa

SEQ ID NO: 750334 - DNA, 22 bp, Artificial Sequence
  chemically synthesized
tgtgaagcatacacaagtatca

SEQ ID NO: 750335 - DNA, 22 bp, Artificial Sequence
  chemically synthesized
ggctattgatacttgtgtatgc

SEQ ID NO: 750336 - DNA, 22 bp, Artificial Sequence
  chemically synthesized
gctattgatacttgtgtatgct

SEQ ID NO: 750337 - DNA, 22 bp, Artificial Sequence
  chemically synthesized
ttgatacttgtgtatgcttcac

SEQ ID NO: 750338 - DNA, 22 bp, Artificial Sequence
  chemically synthesized
atacttgtgtatgcttcacaaa

SEQ ID NO: 750339 - DNA, 22 bp, Artificial Sequence
  chemically synthesized
gtgtatgcttcacaaagttctc

SEQ ID NO: 750340 - DNA, 22 bp, Artificial Sequence
  chemically synthesized
tgtatgcttcacaaagttctcg

SEQ ID NO: 750341 - DNA, 22 bp, Artificial Sequence
  chemically synthesized
agaaacacagcacgagaacttt

SEQ ID NO: 750342 - DNA, 22 bp, Artificial Sequence
  chemically synthesized
cacaaagttctcgtgctgtgtt

SEQ ID NO: 750343 - DNA, 22 bp, Artificial Sequence
  chemically synthesized
aaggagctgagaaacacagcac

SEQ ID NO: 750344 - DNA, 22 bp, Artificial Sequence
  chemically synthesized
acaaagttctcgtgctgtgttt

SEQ ID NO: 750345 - DNA, 22 bp, Artificial Sequence
  chemically synthesized
tcgtgctgtgtttctcagctcc

SEQ ID NO: 750346 - DNA, 22 bp, Artificial Sequence
  chemically synthesized
gtgctgtgtttctcagctcctt

SEQ ID NO: 750347 - DNA, 22 bp, Artificial Sequence
  chemically synthesized
tgtttctcagctccttcaggtc

SEQ ID NO: 750348 - DNA, 22 bp, Artificial Sequence
  chemically synthesized
gagaggaacataaatgacctga

SEQ ID NO: 750349 - DNA, 22 bp, Artificial Sequence
  chemically synthesized
agagaggaacataaatgacctg

SEQ ID NO: 750350 - DNA, 22 bp, Artificial Sequence
  chemically synthesized
ctcagctccttcaggtcattta

SEQ ID NO: 750351 - DNA, 22 bp, Artificial Sequence
  chemically synthesized
tcagctccttcaggtcatttat

SEQ ID NO: 750352 - DNA, 22 bp, Artificial Sequence
  chemically synthesized
agctccttcaggtcatttatgt

SEQ ID NO: 750353 - DNA, 22 bp, Artificial Sequence
  chemically synthesized
cttcaggtcatttatgttcctc

SEQ ID NO: 750354 - DNA, 22 bp, Artificial Sequence
  chemically synthesized
caggtcatttatgttcctctct

SEQ ID NO: 750355 - DNA, 22 bp, Artificial Sequence
  chemically synthesized
aggtcatttatgttcctctcta

SEQ ID NO: 750356 - DNA, 22 bp, Artificial Sequence
  chemically synthesized
gaataaccagtttagagaggaa

SEQ ID NO: 750357 - DNA, 22 bp, Artificial Sequence
  chemically synthesized
actagaataaccagtttagaga

SEQ ID NO: 750358 - DNA, 22 bp, Artificial Sequence
  chemically synthesized
ctaactagaataaccagtttag

SEQ ID NO: 750359 - DNA, 22 bp, Artificial Sequence
  chemically synthesized
atgttcctctctaaactggtta

SEQ ID NO: 750360 - DNA, 22 bp, Artificial Sequence
  chemically synthesized
tgttcctctctaaactggttat

SEQ ID NO: 750361 - DNA, 22 bp, Artificial Sequence
  chemically synthesized
ctctctaaactggttattctag

SEQ ID NO: 750362 - DNA, 22 bp, Artificial Sequence
  chemically synthesized
gaggaattgctaactagaataa

SEQ ID NO: 750363 - DNA, 22 bp, Artificial Sequence
  chemically synthesized
tctaaactggttattctagtta

SEQ ID NO: 750364 - DNA, 22 bp, Artificial Sequence
  chemically synthesized
taaactggttattctagttagc

SEQ ID NO: 750365 - DNA, 22 bp, Artificial Sequence
  chemically synthesized
aactggttattctagttagcaa

SEQ ID NO: 750366 - DNA, 22 bp, Artificial Sequence
  chemically synthesized
gttattctagttagcaattcct

SEQ ID NO: 750367 - DNA, 22 bp, Artificial Sequence
  chemically synthesized
aaaaaaaggttagaggaattgc

SEQ ID NO: 750368 - DNA, 22 bp, Artificial Sequence
  chemically synthesized
aaaaaaaaggttagaggaattg

SEQ ID NO: 750369 - DNA, 22 bp, Artificial Sequence
  chemically synthesized
ttctagttagcaattcctctaa

SEQ ID NO: 750370 - DNA, 22 bp, Artificial Sequence
  chemically synthesized
tagttagcaattcctctaacct

SEQ ID NO: 750371 - DNA, 22 bp, Artificial Sequence
  chemically synthesized
gttagcaattcctctaaccttt

SEQ ID NO: 750372 - DNA, 22 bp, Artificial Sequence
  chemically synthesized
agaaccttaaaaaaaaggttag

SEQ ID NO: 750373 - DNA, 22 bp, Artificial Sequence
  chemically synthesized
gcaattcctctaaccttttttt

SEQ ID NO: 750374 - DNA, 22 bp, Artificial Sequence
  chemically synthesized
ctctaaccttttttttaaggtt

SEQ ID NO: 750375 - DNA, 22 bp, Artificial Sequence
  chemically synthesized
taaccttttttttaaggttctt

SEQ ID NO: 750376 - DNA, 22 bp, Artificial Sequence
  chemically synthesized
accttttttttaaggttcttag

SEQ ID NO: 750377 - DNA, 22 bp, Artificial Sequence
  chemically synthesized
acccaatgcaaggaagctaaga

SEQ ID NO: 750378 - DNA, 22 bp, Artificial Sequence
  chemically synthesized
ttttttaaggttcttagcttcc

SEQ ID NO: 750379 - DNA, 22 bp, Artificial Sequence
  chemically synthesized
tttttaaggttcttagcttcct

SEQ ID NO: 750380 - DNA, 22 bp, Artificial Sequence
  chemically synthesized
taacccaatgcaaggaagctaa

SEQ ID NO: 750381 - DNA, 22 bp, Artificial Sequence
  chemically synthesized
ttttaaggttcttagcttcctt

SEQ ID NO: 750382 - DNA, 22 bp, Artificial Sequence
  chemically synthesized
tttaaggttcttagcttccttg

SEQ ID NO: 750383 - DNA, 22 bp, Artificial Sequence
  chemically synthesized
ttaaggttcttagcttccttgc

SEQ ID NO: 750384 - DNA, 22 bp, Artificial Sequence
  chemically synthesized
taaggttcttagcttccttgca

SEQ ID NO: 750385 - DNA, 22 bp, Artificial Sequence
  chemically synthesized
aaggttcttagcttccttgcat

SEQ ID NO: 750386 - DNA, 22 bp, Artificial Sequence
  chemically synthesized
aggttcttagcttccttgcatt

SEQ ID NO: 750387 - DNA, 22 bp, Artificial Sequence
  chemically synthesized
ttagcttccttgcattgggtta

SEQ ID NO: 750388 - DNA, 22 bp, Artificial Sequence
  chemically synthesized
aaggagcgtgttctaacccaat

SEQ ID NO: 750389 - DNA, 22 bp, Artificial Sequence
  chemically synthesized
agcttccttgcattgggttaga

SEQ ID NO: 750390 - DNA, 22 bp, Artificial Sequence
  chemically synthesized
gcttccttgcattgggttagaa

SEQ ID NO: 750391 - DNA, 22 bp, Artificial Sequence
  chemically synthesized
ccttgcattgggttagaacacg

SEQ ID NO: 750392 - DNA, 22 bp, Artificial Sequence
  chemically synthesized
cttgcattgggttagaacacgc

SEQ ID NO: 750393 - DNA, 22 bp, Artificial Sequence
  chemically synthesized
cgagctaaaggagcgtgttcta

SEQ ID NO: 750394 - DNA, 22 bp, Artificial Sequence
  chemically synthesized
acgagctaaaggagcgtgttct

SEQ ID NO: 750395 - DNA, 22 bp, Artificial Sequence
  chemically synthesized
gcattgggttagaacacgctcc

SEQ ID NO: 750396 - DNA, 22 bp, Artificial Sequence
  chemically synthesized
ttacgagctaaaggagcgtgtt

SEQ ID NO: 750397 - DNA, 22 bp, Artificial Sequence
  chemically synthesized
cattgggttagaacacgctcct

SEQ ID NO: 750398 - DNA, 22 bp, Artificial Sequence
  chemically synthesized
ggttagaacacgctcctttagc

SEQ ID NO: 750399 - DNA, 22 bp, Artificial Sequence
  chemically synthesized
gaacacgctcctttagctcgta

SEQ ID NO: 750400 - DNA, 22 bp, Artificial Sequence
  chemically synthesized
ctttagctcgtaagagtttgtt

SEQ ID NO: 750401 - DNA, 22 bp, Artificial Sequence
  chemically synthesized
agaaggtgggtaataacaaact

SEQ ID NO: 750402 - DNA, 22 bp, Artificial Sequence
  chemically synthesized
tagctcgtaagagtttgttatt

SEQ ID NO: 750403 - DNA, 22 bp, Artificial Sequence
  chemically synthesized
cagaaggtgggtaataacaaac

SEQ ID NO: 750404 - DNA, 22 bp, Artificial Sequence
  chemically synthesized
agctcgtaagagtttgttatta

SEQ ID NO: 750405 - DNA, 22 bp, Artificial Sequence
  chemically synthesized
gctcgtaagagtttgttattac

SEQ ID NO: 750406 - DNA, 22 bp, Artificial Sequence
  chemically synthesized
gtaagagtttgttattacccac

SEQ ID NO: 750407 - DNA, 22 bp, Artificial Sequence
  chemically synthesized
acggaagtaggcttcagaaggt

SEQ ID NO: 750408 - DNA, 22 bp, Artificial Sequence
  chemically synthesized
gttattacccaccttctgaagc

SEQ ID NO: 750409 - DNA, 22 bp, Artificial Sequence
  chemically synthesized
ttattacccaccttctgaagcc

SEQ ID NO: 750410 - DNA, 22 bp, Artificial Sequence
  chemically synthesized
ttacccaccttctgaagcctac

SEQ ID NO: 750411 - DNA, 22 bp, Artificial Sequence
  chemically synthesized
acgaattgacggaagtaggctt

SEQ ID NO: 750412 - DNA, 22 bp, Artificial Sequence
  chemically synthesized
cccaccttctgaagcctacttc

SEQ ID NO: 750413 - DNA, 22 bp, Artificial Sequence
  chemically synthesized
gacgaattgacggaagtaggct

SEQ ID NO: 750414 - DNA, 22 bp, Artificial Sequence
  chemically synthesized
ctgaagcctacttccgtcaatt

SEQ ID NO: 750415 - DNA, 22 bp, Artificial Sequence
  chemically synthesized
tgaagcctacttccgtcaattc

SEQ ID NO: 750416 - DNA, 22 bp, Artificial Sequence
  chemically synthesized
aagcctacttccgtcaattcgt

SEQ ID NO: 750417 - DNA, 22 bp, Artificial Sequence
  chemically synthesized
gatggagaatgagtttgacgaa

SEQ ID NO: 750418 - DNA, 22 bp, Artificial Sequence
  chemically synthesized
cttccgtcaattcgtcaaactc

SEQ ID NO: 750419 - DNA, 22 bp, Artificial Sequence
  chemically synthesized
ccgtcaattcgtcaaactcatt

SEQ ID NO: 750420 - DNA, 22 bp, Artificial Sequence
  chemically synthesized
cgtcaattcgtcaaactcattc

SEQ ID NO: 750421 - DNA, 22 bp, Artificial Sequence
  chemically synthesized
gtcaaactcattctccatccag

SEQ ID NO: 750422 - DNA, 22 bp, Artificial Sequence
  chemically synthesized
cagcaagggaacaaaactggat

SEQ ID NO: 750423 - DNA, 22 bp, Artificial Sequence
  chemically synthesized
tccagcaagggaacaaaactgg

SEQ ID NO: 750424 - DNA, 22 bp, Artificial Sequence
  chemically synthesized
attctccatccagttttgttcc

SEQ ID NO: 750425 - DNA, 22 bp, Artificial Sequence
  chemically synthesized
ctctccagcaagggaacaaaac

SEQ ID NO: 750426 - DNA, 22 bp, Artificial Sequence
  chemically synthesized
tccatccagttttgttcccttg

SEQ ID NO: 750427 - DNA, 22 bp, Artificial Sequence
  chemically synthesized
catccagttttgttcccttgct

SEQ ID NO: 750428 - DNA, 22 bp, Artificial Sequence
  chemically synthesized
tgttcccttgctggagaggagt

SEQ ID NO: 750429 - DNA, 22 bp, Artificial Sequence
  chemically synthesized
caaatgatcacaactcctctcc

SEQ ID NO: 750430 - DNA, 22 bp, Artificial Sequence
  chemically synthesized
gttcccttgctggagaggagtt

SEQ ID NO: 750431 - DNA, 22 bp, Artificial Sequence
  chemically synthesized
ttcccttgctggagaggagttg

SEQ ID NO: 750432 - DNA, 22 bp, Artificial Sequence
  chemically synthesized
ctccaaatgatcacaactcctc

SEQ ID NO: 750433 - DNA, 22 bp, Artificial Sequence
  chemically synthesized
ccttgctggagaggagttgtga

SEQ ID NO: 750434 - DNA, 22 bp, Artificial Sequence
  chemically synthesized
tcctccaaatgatcacaactcc

SEQ ID NO: 750435 - DNA, 22 bp, Artificial Sequence
  chemically synthesized
ctcctccaaatgatcacaactc

SEQ ID NO: 750436 - DNA, 22 bp, Artificial Sequence
  chemically synthesized
ttctcctccaaatgatcacaac

SEQ ID NO: 750437 - DNA, 22 bp, Artificial Sequence
  chemically synthesized
gctggagaggagttgtgatcat

SEQ ID NO: 750438 - DNA, 22 bp, Artificial Sequence
  chemically synthesized
ctggagaggagttgtgatcatt

SEQ ID NO: 750439 - DNA, 22 bp, Artificial Sequence
  chemically synthesized
gagaggagttgtgatcatttgg

SEQ ID NO: 750440 - DNA, 22 bp, Artificial Sequence
  chemically synthesized
tgatcatttggaggagaagagg

SEQ ID NO: 750441 - DNA, 22 bp, Artificial Sequence
  chemically synthesized
caaaaaccggaacgcctcttct

SEQ ID NO: 750442 - DNA, 22 bp, Artificial Sequence
  chemically synthesized
ggaggagaagaggcgttccggt

SEQ ID NO: 750443 - DNA, 22 bp, Artificial Sequence
  chemically synthesized
aaaattccaaaaaccggaacgc

SEQ ID NO: 750444 - DNA, 22 bp, Artificial Sequence
  chemically synthesized
gaggagaagaggcgttccggtt

SEQ ID NO: 750445 - DNA, 22 bp, Artificial Sequence
  chemically synthesized
cggtttttggaattttcaggct

SEQ ID NO: 750446 - DNA, 22 bp, Artificial Sequence
  chemically synthesized
ttggaattttcaggctttttgt

SEQ ID NO: 750447 - DNA, 22 bp, Artificial Sequence
  chemically synthesized
tggaattttcaggctttttgtg

SEQ ID NO: 750448 - DNA, 22 bp, Artificial Sequence
  chemically synthesized
ggaattttcaggctttttgtgc

SEQ ID NO: 750449 - DNA, 22 bp, Artificial Sequence
  chemically synthesized
gaattttcaggctttttgtgct

SEQ ID NO: 750450 - DNA, 22 bp, Artificial Sequence
  chemically synthesized
tcaggctttttgtgctggtttt

SEQ ID NO: 750451 - DNA, 22 bp, Artificial Sequence
  chemically synthesized
caggctttttgtgctggttttt

SEQ ID NO: 750452 - DNA, 22 bp, Artificial Sequence
  chemically synthesized
aggctttttgtgctggtttttc

SEQ ID NO: 750453 - DNA, 22 bp, Artificial Sequence
  chemically synthesized
tttgtgctggtttttcctcatc

SEQ ID NO: 750454 - DNA, 22 bp, Artificial Sequence
  chemically synthesized
ttgtgctggtttttcctcatct

SEQ ID NO: 750455 - DNA, 22 bp, Artificial Sequence
  chemically synthesized
tgtgctggtttttcctcatctt

SEQ ID NO: 750456 - DNA, 22 bp, Artificial Sequence
  chemically synthesized
gtgctggtttttcctcatcttc

SEQ ID NO: 750457 - DNA, 22 bp, Artificial Sequence
  chemically synthesized
tgctggtttttcctcatcttcg

SEQ ID NO: 750458 - DNA, 22 bp, Artificial Sequence
  chemically synthesized
gtttttcctcatcttcgtggat

SEQ ID NO: 750459 - DNA, 22 bp, Artificial Sequence
  chemically synthesized
ttcctcatcttcgtggatttat

SEQ ID NO: 750460 - DNA, 22 bp, Artificial Sequence
  chemically synthesized
tcctcatcttcgtggatttatc

SEQ ID NO: 750461 - DNA, 22 bp, Artificial Sequence
  chemically synthesized
cctcatcttcgtggatttatct

SEQ ID NO: 750462 - DNA, 22 bp, Artificial Sequence
  chemically synthesized
ctcatcttcgtggatttatcta

SEQ ID NO: 750463 - DNA, 22 bp, Artificial Sequence
  chemically synthesized
atcttcgtggatttatctacct

SEQ ID NO: 750464 - DNA, 22 bp, Artificial Sequence
  chemically synthesized
cgtggatttatctacctttggt

SEQ ID NO: 750465 - DNA, 22 bp, Artificial Sequence
  chemically synthesized
gtggatttatctacctttggtc

SEQ ID NO: 750466 - DNA, 22 bp, Artificial Sequence
  chemically synthesized
aaggtcaccaacatcaaagacc

SEQ ID NO: 750467 - DNA, 22 bp, Artificial Sequence
  chemically synthesized
atctacctttggtctttgatgt

SEQ ID NO: 750468 - DNA, 22 bp, Artificial Sequence
  chemically synthesized
tctacctttggtctttgatgtt

SEQ ID NO: 750469 - DNA, 22 bp, Artificial Sequence
  chemically synthesized
cctttggtctttgatgttggtg

SEQ ID NO: 750470 - DNA, 22 bp, Artificial Sequence
  chemically synthesized
tggtctttgatgttggtgacct

SEQ ID NO: 750471 - DNA, 22 bp, Artificial Sequence
  chemically synthesized
ggtctttgatgttggtgacctt

SEQ ID NO: 750472 - DNA, 22 bp, Artificial Sequence
  chemically synthesized
gtctttgatgttggtgaccttc

SEQ ID NO: 750473 - DNA, 22 bp, Artificial Sequence
  chemically synthesized
tgatgttggtgaccttcagatg

SEQ ID NO: 750474 - DNA, 22 bp, Artificial Sequence
  chemically synthesized
gatgttggtgaccttcagatgg

SEQ ID NO: 750475 - DNA, 22 bp, Artificial Sequence
  chemically synthesized
atgttggtgaccttcagatggg

SEQ ID NO: 750476 - DNA, 22 bp, Artificial Sequence
  chemically synthesized
gtgaccttcagatggggttttt

SEQ ID NO: 750477 - DNA, 22 bp, Artificial Sequence
  chemically synthesized
cagatggggtttttgtgtggac

SEQ ID NO: 750478 - DNA, 22 bp, Artificial Sequence
  chemically synthesized
agatggggtttttgtgtggacg

SEQ ID NO: 750479 - DNA, 22 bp, Artificial Sequence
  chemically synthesized
gcatcaacatcaacaaaaagga

SEQ ID NO: 750480 - DNA, 22 bp, Artificial Sequence
  chemically synthesized
ttgtgtggacgtcctttttgtt

SEQ ID NO: 750481 - DNA, 22 bp, Artificial Sequence
  chemically synthesized
tgtgtggacgtcctttttgttg

SEQ ID NO: 750482 - DNA, 22 bp, Artificial Sequence
  chemically synthesized
gtgtggacgtcctttttgttga

SEQ ID NO: 750483 - DNA, 22 bp, Artificial Sequence
  chemically synthesized
ctagcatcaacatcaacaaaaa

SEQ ID NO: 750484 - DNA, 22 bp, Artificial Sequence
  chemically synthesized
tgtggacgtcctttttgttgat

SEQ ID NO: 750485 - DNA, 22 bp, Artificial Sequence
  chemically synthesized
actgctagcatcaacatcaaca

SEQ ID NO: 750486 - DNA, 22 bp, Artificial Sequence
  chemically synthesized
ctgactgctagcatcaacatca

SEQ ID NO: 750487 - DNA, 22 bp, Artificial Sequence
  chemically synthesized
tttgttgatgttgatgctagca

SEQ ID NO: 750488 - DNA, 22 bp, Artificial Sequence
  chemically synthesized
ttgttgatgttgatgctagcag

SEQ ID NO: 750489 - DNA, 22 bp, Artificial Sequence
  chemically synthesized
tgttgatgttgatgctagcagt

SEQ ID NO: 750490 - DNA, 22 bp, Artificial Sequence
  chemically synthesized
gttgatgttgatgctagcagtc

SEQ ID NO: 750491 - DNA, 22 bp, Artificial Sequence
  chemically synthesized
ttgatgttgatgctagcagtca

SEQ ID NO: 750492 - DNA, 22 bp, Artificial Sequence
  chemically synthesized
cagcagagggttcctgactgct

SEQ ID NO: 750493 - DNA, 22 bp, Artificial Sequence
  chemically synthesized
atgttgatgctagcagtcagga

SEQ ID NO: 750494 - DNA, 22 bp, Artificial Sequence
  chemically synthesized
atgctagcagtcaggaaccctc

SEQ ID NO: 750495 - DNA, 22 bp, Artificial Sequence
  chemically synthesized
cagcagacctgcagcagagggt

SEQ ID NO: 750496 - DNA, 22 bp, Artificial Sequence
  chemically synthesized
gcagtcaggaaccctctgctgc

SEQ ID NO: 750497 - DNA, 22 bp, Artificial Sequence
  chemically synthesized
cagcaaattccagcagacctgc

SEQ ID NO: 750498 - DNA, 22 bp, Artificial Sequence
  chemically synthesized
tgctgcaggtctgctggaattt

SEQ ID NO: 750499 - DNA, 22 bp, Artificial Sequence
  chemically synthesized
ctgcaggtctgctggaatttgc

SEQ ID NO: 750500 - DNA, 22 bp, Artificial Sequence
  chemically synthesized
gagtggacctccagcaaattcc

SEQ ID NO: 750501 - DNA, 22 bp, Artificial Sequence
  chemically synthesized
caggtctgctggaatttgctgg

SEQ ID NO: 750502 - DNA, 22 bp, Artificial Sequence
  chemically synthesized
ctggaatttgctggaggtccac

SEQ ID NO: 750503 - DNA, 22 bp, Artificial Sequence
  chemically synthesized
gaatttgctggaggtccactcc

SEQ ID NO: 750504 - DNA, 22 bp, Artificial Sequence
  chemically synthesized
aggcaaacagggtctggagtgg

SEQ ID NO: 750505 - DNA, 22 bp, Artificial Sequence
  chemically synthesized
gctggaggtccactccagaccc

SEQ ID NO: 750506 - DNA, 22 bp, Artificial Sequence
  chemically synthesized
ctggaggtccactccagaccct

SEQ ID NO: 750507 - DNA, 22 bp, Artificial Sequence
  chemically synthesized
gaggtccactccagaccctgtt

SEQ ID NO: 750508 - DNA, 22 bp, Artificial Sequence
  chemically synthesized
gtgatactcaggcaaacagggt

SEQ ID NO: 750509 - DNA, 22 bp, Artificial Sequence
  chemically synthesized
ctggtgatactcaggcaaacag

SEQ ID NO: 750510 - DNA, 22 bp, Artificial Sequence
  chemically synthesized
tgctggtgatactcaggcaaac

SEQ ID NO: 750511 - DNA, 22 bp, Artificial Sequence
  chemically synthesized
ctgctggtgatactcaggcaaa

SEQ ID NO: 750512 - DNA, 22 bp, Artificial Sequence
  chemically synthesized
cagaccctgtttgcctgagtat

SEQ ID NO: 750513 - DNA, 22 bp, Artificial Sequence
  chemically synthesized
cagcttctgctggtgatactca

SEQ ID NO: 750514 - DNA, 22 bp, Artificial Sequence
  chemically synthesized
tgcagcttctgctggtgatact

SEQ ID NO: 750515 - DNA, 22 bp, Artificial Sequence
  chemically synthesized
ttctgcagcttctgctggtgat

SEQ ID NO: 750516 - DNA, 22 bp, Artificial Sequence
  chemically synthesized
tttgcctgagtatcaccagcag

SEQ ID NO: 750517 - DNA, 22 bp, Artificial Sequence
  chemically synthesized
ctgttctgcagcttctgctggt

SEQ ID NO: 750518 - DNA, 22 bp, Artificial Sequence
  chemically synthesized
gcctgagtatcaccagcagaag

SEQ ID NO: 750519 - DNA, 22 bp, Artificial Sequence
  chemically synthesized
gctgttctgcagcttctgctgg

SEQ ID NO: 750520 - DNA, 22 bp, Artificial Sequence
  chemically synthesized
cctgagtatcaccagcagaagc

SEQ ID NO: 750521 - DNA, 22 bp, Artificial Sequence
  chemically synthesized
tgctgttctgcagcttctgctg

SEQ ID NO: 750522 - DNA, 22 bp, Artificial Sequence
  chemically synthesized
agtatcaccagcagaagctgca

SEQ ID NO: 750523 - DNA, 22 bp, Artificial Sequence
  chemically synthesized
cagaacagcaaagattgctgtc

SEQ ID NO: 750524 - DNA, 22 bp, Artificial Sequence
  chemically synthesized
cagaggaaggaacagacagcaa

SEQ ID NO: 750525 - DNA, 22 bp, Artificial Sequence
  chemically synthesized
ccagaggaaggaacagacagca

SEQ ID NO: 750526 - DNA, 22 bp, Artificial Sequence
  chemically synthesized
ggatgaagcttccagaggaagg

SEQ ID NO: 750527 - DNA, 22 bp, Artificial Sequence
  chemically synthesized
tgggatgaagcttccagaggaa

SEQ ID NO: 750528 - DNA, 22 bp, Artificial Sequence
  chemically synthesized
ctgtctgttccttcctctggaa

SEQ ID NO: 750529 - DNA, 22 bp, Artificial Sequence
  chemically synthesized
tctgttccttcctctggaagct

SEQ ID NO: 750530 - DNA, 22 bp, Artificial Sequence
  chemically synthesized
ttccttcctctggaagcttcat

SEQ ID NO: 750531 - DNA, 22 bp, Artificial Sequence
  chemically synthesized
cttcctctggaagcttcatccc

SEQ ID NO: 750532 - DNA, 22 bp, Artificial Sequence
  chemically synthesized
gcaggtgcccctctgggatgaa

SEQ ID NO: 750533 - DNA, 22 bp, Artificial Sequence
  chemically synthesized
cctctggaagcttcatcccaga

SEQ ID NO: 750534 - DNA, 22 bp, Artificial Sequence
  chemically synthesized
ctctggaagcttcatcccagag

SEQ ID NO: 750535 - DNA, 22 bp, Artificial Sequence
  chemically synthesized
tggaagcttcatcccagagggg

SEQ ID NO: 750536 - DNA, 22 bp, Artificial Sequence
  chemically synthesized
gaagcttcatcccagaggggca

SEQ ID NO: 750537 - DNA, 22 bp, Artificial Sequence
  chemically synthesized
gcatctggcaggtgcccctctg

SEQ ID NO: 750538 - DNA, 22 bp, Artificial Sequence
  chemically synthesized
gctggcatctggcaggtgcccc

SEQ ID NO: 750539 - DNA, 22 bp, Artificial Sequence
  chemically synthesized
tggctggcatctggcaggtgcc

SEQ ID NO: 750540 - DNA, 22 bp, Artificial Sequence
  chemically synthesized
catcccagaggggcacctgcca

SEQ ID NO: 750541 - DNA, 22 bp, Artificial Sequence
  chemically synthesized
atcccagaggggcacctgccag

SEQ ID NO: 750542 - DNA, 22 bp, Artificial Sequence
  chemically synthesized
atacaggagagctctggctggc

SEQ ID NO: 750543 - DNA, 22 bp, Artificial Sequence
  chemically synthesized
ccagatgccagccagagctctc

SEQ ID NO: 750544 - DNA, 22 bp, Artificial Sequence
  chemically synthesized
acagacaccctcatacaggaga

SEQ ID NO: 750545 - DNA, 22 bp, Artificial Sequence
  chemically synthesized
ccagcaggggttgacagacacc

SEQ ID NO: 750546 - DNA, 22 bp, Artificial Sequence
  chemically synthesized
tcctgtatgagggtgtctgtca

SEQ ID NO: 750547 - DNA, 22 bp, Artificial Sequence
  chemically synthesized
ctgtatgagggtgtctgtcaac

SEQ ID NO: 750548 - DNA, 22 bp, Artificial Sequence
  chemically synthesized
tatgagggtgtctgtcaacccc

SEQ ID NO: 750549 - DNA, 22 bp, Artificial Sequence
  chemically synthesized
ggagacacctcccagcaggggt

SEQ ID NO: 750550 - DNA, 22 bp, Artificial Sequence
  chemically synthesized
actgggagacacctcccagcag

SEQ ID NO: 750551 - DNA, 22 bp, Artificial Sequence
  chemically synthesized
ctgactgggagacacctcccag

SEQ ID NO: 750552 - DNA, 22 bp, Artificial Sequence
  chemically synthesized
tcaacccctgctgggaggtgtc

SEQ ID NO: 750553 - DNA, 22 bp, Artificial Sequence
  chemically synthesized
ctgggaggtgtctcccagtcag

SEQ ID NO: 750554 - DNA, 22 bp, Artificial Sequence
  chemically synthesized
acccccgtgcctcctgactggg

SEQ ID NO: 750555 - DNA, 22 bp, Artificial Sequence
  chemically synthesized
ggaggtgtctcccagtcaggag

SEQ ID NO: 750556 - DNA, 22 bp, Artificial Sequence
  chemically synthesized
ccagtcaggaggcacgggggtc

SEQ ID NO: 750557 - DNA, 22 bp, Artificial Sequence
  chemically synthesized
aagtggggtcctgacccccgtg

SEQ ID NO: 750558 - DNA, 22 bp, Artificial Sequence
  chemically synthesized
tcaagtggggtcctgacccccg

SEQ ID NO: 750559 - DNA, 22 bp, Artificial Sequence
  chemically synthesized
ctcaagtggggtcctgaccccc

SEQ ID NO: 750560 - DNA, 22 bp, Artificial Sequence
  chemically synthesized
ccttctcaagtggggtcctgac

SEQ ID NO: 750561 - DNA, 22 bp, Artificial Sequence
  chemically synthesized
agggacagactgccttctcaag

SEQ ID NO: 750562 - DNA, 22 bp, Artificial Sequence
  chemically synthesized
ctaagggacagactgccttctc

SEQ ID NO: 750563 - DNA, 22 bp, Artificial Sequence
  chemically synthesized
tgctaagggacagactgccttc

SEQ ID NO: 750564 - DNA, 22 bp, Artificial Sequence
  chemically synthesized
gagctctgctaagggacagact

SEQ ID NO: 750565 - DNA, 22 bp, Artificial Sequence
  chemically synthesized
gagaaggcagtctgtcccttag

SEQ ID NO: 750566 - DNA, 22 bp, Artificial Sequence
  chemically synthesized
agaaggcagtctgtcccttagc

SEQ ID NO: 750567 - DNA, 22 bp, Artificial Sequence
  chemically synthesized
ccagcacagcactcgagctctg

SEQ ID NO: 750568 - DNA, 22 bp, Artificial Sequence
  chemically synthesized
tcccttagcagagctcgagtgc

SEQ ID NO: 750569 - DNA, 22 bp, Artificial Sequence
  chemically synthesized
agcagagctcgagtgctgtgct

SEQ ID NO: 750570 - DNA, 22 bp, Artificial Sequence
  chemically synthesized
gcagagctcgagtgctgtgctg

SEQ ID NO: 750571 - DNA, 22 bp, Artificial Sequence
  chemically synthesized
aagagagcagcagatctcccag

SEQ ID NO: 750572 - DNA, 22 bp, Artificial Sequence
  chemically synthesized
gagtgctgtgctgggagatctg

SEQ ID NO: 750573 - DNA, 22 bp, Artificial Sequence
  chemically synthesized
tgaagagagcagcagatctccc

SEQ ID NO: 750574 - DNA, 22 bp, Artificial Sequence
  chemically synthesized
gctctgaagagagcagcagatc

SEQ ID NO: 750575 - DNA, 22 bp, Artificial Sequence
  chemically synthesized
ctggctctgaagagagcagcag

SEQ ID NO: 750576 - DNA, 22 bp, Artificial Sequence
  chemically synthesized
tgctgggagatctgctgctctc

SEQ ID NO: 750577 - DNA, 22 bp, Artificial Sequence
  chemically synthesized
cctgctggctctgaagagagca

SEQ ID NO: 750578 - DNA, 22 bp, Artificial Sequence
  chemically synthesized
ggagatctgctgctctcttcag

SEQ ID NO: 750579 - DNA, 22 bp, Artificial Sequence
  chemically synthesized
ctgcctgctggctctgaagaga

SEQ ID NO: 750580 - DNA, 22 bp, Artificial Sequence
  chemically synthesized
aacgttcctgcctgctggctct

SEQ ID NO: 750581 - DNA, 22 bp, Artificial Sequence
  chemically synthesized
ctgctctcttcagagccagcag

SEQ ID NO: 750582 - DNA, 22 bp, Artificial Sequence
  chemically synthesized
aaacgttcctgcctgctggctc

SEQ ID NO: 750583 - DNA, 22 bp, Artificial Sequence
  chemically synthesized
ctctcttcagagccagcaggca

SEQ ID NO: 750584 - DNA, 22 bp, Artificial Sequence
  chemically synthesized
tcttcagagccagcaggcagga

SEQ ID NO: 750585 - DNA, 22 bp, Artificial Sequence
  chemically synthesized
ttcagagccagcaggcaggaac

SEQ ID NO: 750586 - DNA, 22 bp, Artificial Sequence
  chemically synthesized
cagagccagcaggcaggaacgt

SEQ ID NO: 750587 - DNA, 22 bp, Artificial Sequence
  chemically synthesized
agagccagcaggcaggaacgtt

SEQ ID NO: 750588 - DNA, 22 bp, Artificial Sequence
  chemically synthesized
tgggtgcagcatcagcagactt

SEQ ID NO: 750589 - DNA, 22 bp, Artificial Sequence
  chemically synthesized
aagtctgctgatgctgcaccca

SEQ ID NO: 750590 - DNA, 22 bp, Artificial Sequence
  chemically synthesized
agtctgctgatgctgcacccac

SEQ ID NO: 750591 - DNA, 22 bp, Artificial Sequence
  chemically synthesized
ctgatgctgcacccacagctgc

SEQ ID NO: 750592 - DNA, 22 bp, Artificial Sequence
  chemically synthesized
atgctgcacccacagctgcccc

SEQ ID NO: 750593 - DNA, 22 bp, Artificial Sequence
  chemically synthesized
cacccacagctgccccttcccc

SEQ ID NO: 750594 - DNA, 22 bp, Artificial Sequence
  chemically synthesized
ggacagagcaccacggggaagg

SEQ ID NO: 750595 - DNA, 22 bp, Artificial Sequence
  chemically synthesized
cctgggacagagcaccacgggg

SEQ ID NO: 750596 - DNA, 22 bp, Artificial Sequence
  chemically synthesized
ccccttccccgtggtgctctgt

SEQ ID NO: 750597 - DNA, 22 bp, Artificial Sequence
  chemically synthesized
ccatctccctgggacagagcac

SEQ ID NO: 750598 - DNA, 22 bp, Artificial Sequence
  chemically synthesized
ccccgtggtgctctgtcccagg

SEQ ID NO: 750599 - DNA, 22 bp, Artificial Sequence
  chemically synthesized
cccgtggtgctctgtcccaggg

SEQ ID NO: 750600 - DNA, 22 bp, Artificial Sequence
  chemically synthesized
tagataaaactcccatctccct

SEQ ID NO: 750601 - DNA, 22 bp, Artificial Sequence
  chemically synthesized
atagataaaactcccatctccc

SEQ ID NO: 750602 - DNA, 22 bp, Artificial Sequence
  chemically synthesized
tgtcccagggagatgggagttt

SEQ ID NO: 750603 - DNA, 22 bp, Artificial Sequence
  chemically synthesized
tcccagggagatgggagtttta

SEQ ID NO: 750604 - DNA, 22 bp, Artificial Sequence
  chemically synthesized
tatctataagcccctgactggg

SEQ ID NO: 750605 - DNA, 22 bp, Artificial Sequence
  chemically synthesized
atctataagcccctgactgggg

SEQ ID NO: 750606 - DNA, 22 bp, Artificial Sequence
  chemically synthesized
tctataagcccctgactggggc

SEQ ID NO: 750607 - DNA, 22 bp, Artificial Sequence
  chemically synthesized
aaagaaaggcagcagccccagt

SEQ ID NO: 750608 - DNA, 22 bp, Artificial Sequence
  chemically synthesized
taagcccctgactggggctgct

SEQ ID NO: 750609 - DNA, 22 bp, Artificial Sequence
  chemically synthesized
tgaaagaaaggcagcagcccca

SEQ ID NO: 750610 - DNA, 22 bp, Artificial Sequence
  chemically synthesized
actggggctgctgcctttcttt

SEQ ID NO: 750611 - DNA, 22 bp, Artificial Sequence
  chemically synthesized
ggcagggcatctctgaaagaaa

SEQ ID NO: 750612 - DNA, 22 bp, Artificial Sequence
  chemically synthesized
gggctgctgcctttctttcaga

SEQ ID NO: 750613 - DNA, 22 bp, Artificial Sequence
  chemically synthesized
tgggcagggcatctctgaaaga

SEQ ID NO: 750614 - DNA, 22 bp, Artificial Sequence
  chemically synthesized
tctgggcagggcatctctgaaa

SEQ ID NO: 750615 - DNA, 22 bp, Artificial Sequence
  chemically synthesized
tctctgggcagggcatctctga

SEQ ID NO: 750616 - DNA, 22 bp, Artificial Sequence
  chemically synthesized
ctgcctttctttcagagatgcc

SEQ ID NO: 750617 - DNA, 22 bp, Artificial Sequence
  chemically synthesized
ctctctgggcagggcatctctg

SEQ ID NO: 750618 - DNA, 22 bp, Artificial Sequence
  chemically synthesized
cctttctttcagagatgccctg

SEQ ID NO: 750619 - DNA, 22 bp, Artificial Sequence
  chemically synthesized
cttctctctgggcagggcatct

SEQ ID NO: 750620 - DNA, 22 bp, Artificial Sequence
  chemically synthesized
tctttcagagatgccctgccca

SEQ ID NO: 750621 - DNA, 22 bp, Artificial Sequence
  chemically synthesized
ctttcagagatgccctgcccag

SEQ ID NO: 750622 - DNA, 22 bp, Artificial Sequence
  chemically synthesized
gattccttctctctgggcaggg

SEQ ID NO: 750623 - DNA, 22 bp, Artificial Sequence
  chemically synthesized
tttcagagatgccctgcccaga

SEQ ID NO: 750624 - DNA, 22 bp, Artificial Sequence
  chemically synthesized
tagattccttctctctgggcag

SEQ ID NO: 750625 - DNA, 22 bp, Artificial Sequence
  chemically synthesized
tcagagatgccctgcccagaga

SEQ ID NO: 750626 - DNA, 22 bp, Artificial Sequence
  chemically synthesized
cagagatgccctgcccagagag

SEQ ID NO: 750627 - DNA, 22 bp, Artificial Sequence
  chemically synthesized
tctagattccttctctctgggc

SEQ ID NO: 750628 - DNA, 22 bp, Artificial Sequence
  chemically synthesized
agagatgccctgcccagagaga

SEQ ID NO: 750629 - DNA, 22 bp, Artificial Sequence
  chemically synthesized
cctctctagattccttctctct

SEQ ID NO: 750630 - DNA, 22 bp, Artificial Sequence
  chemically synthesized
cccagagagaaggaatctagag

SEQ ID NO: 750631 - DNA, 22 bp, Artificial Sequence
  chemically synthesized
tagccagattgcctctctagat

SEQ ID NO: 750632 - DNA, 22 bp, Artificial Sequence
  chemically synthesized
ggcaaagccactgtagccagat

SEQ ID NO: 750633 - DNA, 22 bp, Artificial Sequence
  chemically synthesized
gagaggcaatctggctacagtg

SEQ ID NO: 750634 - DNA, 22 bp, Artificial Sequence
  chemically synthesized
accgcagctcggcaaagccact

SEQ ID NO: 750635 - DNA, 22 bp, Artificial Sequence
  chemically synthesized
gctacagtggctttgccgagct

SEQ ID NO: 750636 - DNA, 22 bp, Artificial Sequence
  chemically synthesized
ggcggagctcaccgcagctcgg

SEQ ID NO: 750637 - DNA, 22 bp, Artificial Sequence
  chemically synthesized
cagtggctttgccgagctgcgg

SEQ ID NO: 750638 - DNA, 22 bp, Artificial Sequence
  chemically synthesized
actgggcggagctcaccgcagc

SEQ ID NO: 750639 - DNA, 22 bp, Artificial Sequence
  chemically synthesized
taactgggcggagctcaccgca

SEQ ID NO: 750640 - DNA, 22 bp, Artificial Sequence
  chemically synthesized
tgccgagctgcggtgagctccg

SEQ ID NO: 750641 - DNA, 22 bp, Artificial Sequence
  chemically synthesized
gccgagctgcggtgagctccgc

SEQ ID NO: 750642 - DNA, 22 bp, Artificial Sequence
  chemically synthesized
ccgagctgcggtgagctccgcc

SEQ ID NO: 750643 - DNA, 22 bp, Artificial Sequence
  chemically synthesized
cggtgagctccgcccagttaga

SEQ ID NO: 750644 - DNA, 22 bp, Artificial Sequence
  chemically synthesized
cgcccagttagaacttcttgac

SEQ ID NO: 750645 - DNA, 22 bp, Artificial Sequence
  chemically synthesized
acagtgtaaacaaagccgtcaa

SEQ ID NO: 750646 - DNA, 22 bp, Artificial Sequence
  chemically synthesized
gaacttcttgacggctttgttt

SEQ ID NO: 750647 - DNA, 22 bp, Artificial Sequence
  chemically synthesized
ccctcacagtgtaaacaaagcc

SEQ ID NO: 750648 - DNA, 22 bp, Artificial Sequence
  chemically synthesized
cccctcacagtgtaaacaaagc

SEQ ID NO: 750649 - DNA, 22 bp, Artificial Sequence
  chemically synthesized
tcccctcacagtgtaaacaaag

SEQ ID NO: 750650 - DNA, 22 bp, Artificial Sequence
  chemically synthesized
cttgacggctttgtttacactg

SEQ ID NO: 750651 - DNA, 22 bp, Artificial Sequence
  chemically synthesized
ttgacggctttgtttacactgt

SEQ ID NO: 750652 - DNA, 22 bp, Artificial Sequence
  chemically synthesized
gacggctttgtttacactgtga

SEQ ID NO: 750653 - DNA, 22 bp, Artificial Sequence
  chemically synthesized
acggctttgtttacactgtgag

SEQ ID NO: 750654 - DNA, 22 bp, Artificial Sequence
  chemically synthesized
agtaggcagttttcccctcaca

SEQ ID NO: 750655 - DNA, 22 bp, Artificial Sequence
  chemically synthesized
gagtaggcagttttcccctcac

SEQ ID NO: 750656 - DNA, 22 bp, Artificial Sequence
  chemically synthesized
tgtttacactgtgaggggaaaa

SEQ ID NO: 750657 - DNA, 22 bp, Artificial Sequence
  chemically synthesized
gtttacactgtgaggggaaaac

SEQ ID NO: 750658 - DNA, 22 bp, Artificial Sequence
  chemically synthesized
tttacactgtgaggggaaaact

SEQ ID NO: 750659 - DNA, 22 bp, Artificial Sequence
  chemically synthesized
aagcttgagtaggcagttttcc

SEQ ID NO: 750660 - DNA, 22 bp, Artificial Sequence
  chemically synthesized
acactgtgaggggaaaactgcc

SEQ ID NO: 750661 - DNA, 22 bp, Artificial Sequence
  chemically synthesized
cactgtgaggggaaaactgcct

SEQ ID NO: 750662 - DNA, 22 bp, Artificial Sequence
  chemically synthesized
ctgaagcttgagtaggcagttt

SEQ ID NO: 750663 - DNA, 22 bp, Artificial Sequence
  chemically synthesized
tgaggggaaaactgcctactca

SEQ ID NO: 750664 - DNA, 22 bp, Artificial Sequence
  chemically synthesized
ccattactgaagcttgagtagg

SEQ ID NO: 750665 - DNA, 22 bp, Artificial Sequence
  chemically synthesized
cctactcaagcttcagtaatgg

SEQ ID NO: 750666 - DNA, 22 bp, Artificial Sequence
  chemically synthesized
ctcaagcttcagtaatggcagg

SEQ ID NO: 750667 - DNA, 22 bp, Artificial Sequence
  chemically synthesized
aagcttcagtaatggcaggtgc

SEQ ID NO: 750668 - DNA, 22 bp, Artificial Sequence
  chemically synthesized
gtgtggggaggggcacctgcca

SEQ ID NO: 750669 - DNA, 22 bp, Artificial Sequence
  chemically synthesized
agtgtggggaggggcacctgcc

SEQ ID NO: 750670 - DNA, 22 bp, Artificial Sequence
  chemically synthesized
cagtaatggcaggtgcccctcc

SEQ ID NO: 750671 - DNA, 22 bp, Artificial Sequence
  chemically synthesized
agtaatggcaggtgcccctccc

SEQ ID NO: 750672 - DNA, 22 bp, Artificial Sequence
  chemically synthesized
aagcttagtgtggggaggggca

SEQ ID NO: 750673 - DNA, 22 bp, Artificial Sequence
  chemically synthesized
ggatactcaagcttagtgtggg

SEQ ID NO: 750674 - DNA, 22 bp, Artificial Sequence
  chemically synthesized
aagtggacctgggatactcaag

SEQ ID NO: 750675 - DNA, 22 bp, Artificial Sequence
  chemically synthesized
cccacactaagcttgagtatcc

SEQ ID NO: 750676 - DNA, 22 bp, Artificial Sequence
  chemically synthesized
agcttgagtatcccaggtccac

SEQ ID NO: 750677 - DNA, 22 bp, Artificial Sequence
  chemically synthesized
gagtatcccaggtccacttcag

SEQ ID NO: 750678 - DNA, 22 bp, Artificial Sequence
  chemically synthesized
agtatcccaggtccacttcaga

SEQ ID NO: 750679 - DNA, 22 bp, Artificial Sequence
  chemically synthesized
ccagcacagcagtctgaagtgg

SEQ ID NO: 750680 - DNA, 22 bp, Artificial Sequence
  chemically synthesized
gctgccagcacagcagtctgaa

SEQ ID NO: 750681 - DNA, 22 bp, Artificial Sequence
  chemically synthesized
tcgctgccagcacagcagtctg

SEQ ID NO: 750682 - DNA, 22 bp, Artificial Sequence
  chemically synthesized
aaattctcgctgccagcacagc

SEQ ID NO: 750683 - DNA, 22 bp, Artificial Sequence
  chemically synthesized
gaaattctcgctgccagcacag

SEQ ID NO: 750684 - DNA, 22 bp, Artificial Sequence
  chemically synthesized
gcttgaaattctcgctgccagc

SEQ ID NO: 750685 - DNA, 22 bp, Artificial Sequence
  chemically synthesized
cagactgctgtgctggcagcga

SEQ ID NO: 750686 - DNA, 22 bp, Artificial Sequence
  chemically synthesized
agactgctgtgctggcagcgag

SEQ ID NO: 750687 - DNA, 22 bp, Artificial Sequence
  chemically synthesized
ctgtgctggcagcgagaatttc

SEQ ID NO: 750688 - DNA, 22 bp, Artificial Sequence
  chemically synthesized
agatccactggcttgaaattct

SEQ ID NO: 750689 - DNA, 22 bp, Artificial Sequence
  chemically synthesized
tgctggcagcgagaatttcaag

SEQ ID NO: 750690 - DNA, 22 bp, Artificial Sequence
  chemically synthesized
gcagcgagaatttcaagccagt

SEQ ID NO: 750691 - DNA, 22 bp, Artificial Sequence
  chemically synthesized
caagccagtggatcttagctgg

SEQ ID NO: 750692 - DNA, 22 bp, Artificial Sequence
  chemically synthesized
aagccagtggatcttagctggc

SEQ ID NO: 750693 - DNA, 22 bp, Artificial Sequence
  chemically synthesized
agctggctgggctccgttgggg

SEQ ID NO: 750694 - DNA, 22 bp, Artificial Sequence
  chemically synthesized
agtggatcccacccccaacgga

SEQ ID NO: 750695 - DNA, 22 bp, Artificial Sequence
  chemically synthesized
gctggctgggctccgttggggg

SEQ ID NO: 750696 - DNA, 22 bp, Artificial Sequence
  chemically synthesized
gctcagtggatcccacccccaa

SEQ ID NO: 750697 - DNA, 22 bp, Artificial Sequence
  chemically synthesized
gctgggctccgttgggggtggg

SEQ ID NO: 750698 - DNA, 22 bp, Artificial Sequence
  chemically synthesized
ggctccgttgggggtgggatcc

SEQ ID NO: 750699 - DNA, 22 bp, Artificial Sequence
  chemically synthesized
cgttgggggtgggatccactga

SEQ ID NO: 750700 - DNA, 22 bp, Artificial Sequence
  chemically synthesized
ggggtgggatccactgagctag

SEQ ID NO: 750701 - DNA, 22 bp, Artificial Sequence
  chemically synthesized
aagtcagggagccaagtggtct

SEQ ID NO: 750702 - DNA, 22 bp, Artificial Sequence
  chemically synthesized
agctagaccacttggctccctg

SEQ ID NO: 750703 - DNA, 22 bp, Artificial Sequence
  chemically synthesized
gaaaggggactgaagtcaggga

SEQ ID NO: 750704 - DNA, 22 bp, Artificial Sequence
  chemically synthesized
gaccacttggctccctgacttc

SEQ ID NO: 750705 - DNA, 22 bp, Artificial Sequence
  chemically synthesized
ccctggaaaggggactgaagtc

SEQ ID NO: 750706 - DNA, 22 bp, Artificial Sequence
  chemically synthesized
ggctccctgacttcagtcccct

SEQ ID NO: 750707 - DNA, 22 bp, Artificial Sequence
  chemically synthesized
actcccctggaaaggggactga

SEQ ID NO: 750708 - DNA, 22 bp, Artificial Sequence
  chemically synthesized
gctccctgacttcagtcccctt

SEQ ID NO: 750709 - DNA, 22 bp, Artificial Sequence
  chemically synthesized
cctgacttcagtcccctttcca

SEQ ID NO: 750710 - DNA, 22 bp, Artificial Sequence
  chemically synthesized
acttcagtcccctttccagggg

SEQ ID NO: 750711 - DNA, 22 bp, Artificial Sequence
  chemically synthesized
cagtcccctttccaggggagtg

SEQ ID NO: 750712 - DNA, 22 bp, Artificial Sequence
  chemically synthesized
agtcccctttccaggggagtga

SEQ ID NO: 750713 - DNA, 22 bp, Artificial Sequence
  chemically synthesized
tccaggggagtgaatggttcta

SEQ ID NO: 750714 - DNA, 22 bp, Artificial Sequence
  chemically synthesized
ccaggggagtgaatggttctat

SEQ ID NO: 750715 - DNA, 22 bp, Artificial Sequence
  chemically synthesized
caggggagtgaatggttctatc

SEQ ID NO: 750716 - DNA, 22 bp, Artificial Sequence
  chemically synthesized
gaacaccagcgagatagaacca

SEQ ID NO: 750717 - DNA, 22 bp, Artificial Sequence
  chemically synthesized
tatctcgctggtgttccaggtg

SEQ ID NO: 750718 - DNA, 22 bp, Artificial Sequence
  chemically synthesized
atatcccagcgtcacctggaac

SEQ ID NO: 750719 - DNA, 22 bp, Artificial Sequence
  chemically synthesized
catatcccagcgtcacctggaa

SEQ ID NO: 750720 - DNA, 22 bp, Artificial Sequence
  chemically synthesized
tctcgctggtgttccaggtgac

SEQ ID NO: 750721 - DNA, 22 bp, Artificial Sequence
  chemically synthesized
tcatatcccagcgtcacctgga

SEQ ID NO: 750722 - DNA, 22 bp, Artificial Sequence
  chemically synthesized
ttcatatcccagcgtcacctgg

SEQ ID NO: 750723 - DNA, 22 bp, Artificial Sequence
  chemically synthesized
tttcatatcccagcgtcacctg

SEQ ID NO: 750724 - DNA, 22 bp, Artificial Sequence
  chemically synthesized
ttttcatatcccagcgtcacct

SEQ ID NO: 750725 - DNA, 22 bp, Artificial Sequence
  chemically synthesized
gctggtgttccaggtgacgctg

SEQ ID NO: 750726 - DNA, 22 bp, Artificial Sequence
  chemically synthesized
gtgttccaggtgacgctgggat

SEQ ID NO: 750727 - DNA, 22 bp, Artificial Sequence
  chemically synthesized
caggcgtttttttcatatccca

SEQ ID NO: 750728 - DNA, 22 bp, Artificial Sequence
  chemically synthesized
caggtgacgctgggatatgaaa

SEQ ID NO: 750729 - DNA, 22 bp, Artificial Sequence
  chemically synthesized
gctgcaggcgtttttttcatat

SEQ ID NO: 750730 - DNA, 22 bp, Artificial Sequence
  chemically synthesized
ggatatgaaaaaaacgcctgca

SEQ ID NO: 750731 - DNA, 22 bp, Artificial Sequence
  chemically synthesized
ggcagacaccgagctagctgca

SEQ ID NO: 750732 - DNA, 22 bp, Artificial Sequence
  chemically synthesized
gggcagacaccgagctagctgc

SEQ ID NO: 750733 - DNA, 22 bp, Artificial Sequence
  chemically synthesized
tttgggcagacaccgagctagc

SEQ ID NO: 750734 - DNA, 22 bp, Artificial Sequence
  chemically synthesized
ggcagctgtttgggcagacacc

SEQ ID NO: 750735 - DNA, 22 bp, Artificial Sequence
  chemically synthesized
cagctagctcggtgtctgccca

SEQ ID NO: 750736 - DNA, 22 bp, Artificial Sequence
  chemically synthesized
gctcggtgtctgcccaaacagc

SEQ ID NO: 750737 - DNA, 22 bp, Artificial Sequence
  chemically synthesized
ggtgtctgcccaaacagctgcc

SEQ ID NO: 750738 - DNA, 22 bp, Artificial Sequence
  chemically synthesized
aagcacaaaattgggcagctgt

SEQ ID NO: 750739 - DNA, 22 bp, Artificial Sequence
  chemically synthesized
caagcacaaaattgggcagctg

SEQ ID NO: 750740 - DNA, 22 bp, Artificial Sequence
  chemically synthesized
ggtttcaagcacaaaattgggc

SEQ ID NO: 750741 - DNA, 22 bp, Artificial Sequence
  chemically synthesized
cccaaacagctgcccaattttg

SEQ ID NO: 750742 - DNA, 22 bp, Artificial Sequence
  chemically synthesized
cccaattttgtgcttgaaaccc

SEQ ID NO: 750743 - DNA, 22 bp, Artificial Sequence
  chemically synthesized
cgccaccagggccctgggtttc

SEQ ID NO: 750744 - DNA, 22 bp, Artificial Sequence
  chemically synthesized
tgtgcttgaaacccagggccct

SEQ ID NO: 750745 - DNA, 22 bp, Artificial Sequence
  chemically synthesized
gtgcttgaaacccagggccctg

SEQ ID NO: 750746 - DNA, 22 bp, Artificial Sequence
  chemically synthesized
tgcttgaaacccagggccctgg

SEQ ID NO: 750747 - DNA, 22 bp, Artificial Sequence
  chemically synthesized
gggtgcctacgccaccagggcc

SEQ ID NO: 750748 - DNA, 22 bp, Artificial Sequence
  chemically synthesized
gaaacccagggccctggtggcg

SEQ ID NO: 750749 - DNA, 22 bp, Artificial Sequence
  chemically synthesized
aaacccagggccctggtggcgt

SEQ ID NO: 750750 - DNA, 22 bp, Artificial Sequence
  chemically synthesized
cctcgggtgcctacgccaccag

SEQ ID NO: 750751 - DNA, 22 bp, Artificial Sequence
  chemically synthesized
gtggcgtaggcacccgagggaa

SEQ ID NO: 750752 - DNA, 22 bp, Artificial Sequence
  chemically synthesized
cgcaacatgcagaccaggagat

SEQ ID NO: 750753 - DNA, 22 bp, Artificial Sequence
  chemically synthesized
ccacagcctccgcaacatgcag

SEQ ID NO: 750754 - DNA, 22 bp, Artificial Sequence
  chemically synthesized
cccacagcctccgcaacatgca

SEQ ID NO: 750755 - DNA, 22 bp, Artificial Sequence
  chemically synthesized
tcccacagcctccgcaacatgc

SEQ ID NO: 750756 - DNA, 22 bp, Artificial Sequence
  chemically synthesized
ttcccacagcctccgcaacatg

SEQ ID NO: 750757 - DNA, 22 bp, Artificial Sequence
  chemically synthesized
ctggtctgcatgttgcggaggc

SEQ ID NO: 750758 - DNA, 22 bp, Artificial Sequence
  chemically synthesized
tgcttttcccacagcctccgca

SEQ ID NO: 750759 - DNA, 22 bp, Artificial Sequence
  chemically synthesized
gtctgcatgttgcggaggctgt

SEQ ID NO: 750760 - DNA, 22 bp, Artificial Sequence
  chemically synthesized
catgttgcggaggctgtgggaa

SEQ ID NO: 750761 - DNA, 22 bp, Artificial Sequence
  chemically synthesized
cggaggctgtgggaaaagcata

SEQ ID NO: 750762 - DNA, 22 bp, Artificial Sequence
  chemically synthesized
cagcccagacactatgcttttc

SEQ ID NO: 750763 - DNA, 22 bp, Artificial Sequence
  chemically synthesized
tgggaaaagcatagtgtctggg

SEQ ID NO: 750764 - DNA, 22 bp, Artificial Sequence
  chemically synthesized
aggaacggagcattccagccca

SEQ ID NO: 750765 - DNA, 22 bp, Artificial Sequence
  chemically synthesized
tgccctgaggaacggagcattc

SEQ ID NO: 750766 - DNA, 22 bp, Artificial Sequence
  chemically synthesized
ggctggaatgctccgttcctca

SEQ ID NO: 750767 - DNA, 22 bp, Artificial Sequence
  chemically synthesized
gaatgctccgttcctcagggca

SEQ ID NO: 750768 - DNA, 22 bp, Artificial Sequence
  chemically synthesized
cgttcctcagggcacagtccct

SEQ ID NO: 750769 - DNA, 22 bp, Artificial Sequence
  chemically synthesized
gccaacagaagccgtgagggac

SEQ ID NO: 750770 - DNA, 22 bp, Artificial Sequence
  chemically synthesized
ctcagggcacagtccctcacgg

SEQ ID NO: 750771 - DNA, 22 bp, Artificial Sequence
  chemically synthesized
agggcacagtccctcacggctt

SEQ ID NO: 750772 - DNA, 22 bp, Artificial Sequence
  chemically synthesized
ccctagccaacagaagccgtga

SEQ ID NO: 750773 - DNA, 22 bp, Artificial Sequence
  chemically synthesized
cctcccctagccaacagaagcc

SEQ ID NO: 750774 - DNA, 22 bp, Artificial Sequence
  chemically synthesized
acggcttctgttggctagggga

SEQ ID NO: 750775 - DNA, 22 bp, Artificial Sequence
  chemically synthesized
ctgttggctaggggagggaatt

SEQ ID NO: 750776 - DNA, 22 bp, Artificial Sequence
  chemically synthesized
tgttggctaggggagggaattc

SEQ ID NO: 750777 - DNA, 22 bp, Artificial Sequence
  chemically synthesized
ttggctaggggagggaattccc

SEQ ID NO: 750778 - DNA, 22 bp, Artificial Sequence
  chemically synthesized
gctaggggagggaattccctga

SEQ ID NO: 750779 - DNA, 22 bp, Artificial Sequence
  chemically synthesized
ggggagggaattccctgacccc

SEQ ID NO: 750780 - DNA, 22 bp, Artificial Sequence
  chemically synthesized
accccggaagcacaaggggtca

SEQ ID NO: 750781 - DNA, 22 bp, Artificial Sequence
  chemically synthesized
cctgaccccttgtgcttccggg

SEQ ID NO: 750782 - DNA, 22 bp, Artificial Sequence
  chemically synthesized
accccttgtgcttccggggtga

SEQ ID NO: 750783 - DNA, 22 bp, Artificial Sequence
  chemically synthesized
gtgcttccggggtgaggcgaca

SEQ ID NO: 750784 - DNA, 22 bp, Artificial Sequence
  chemically synthesized
tgcttccggggtgaggcgacat

SEQ ID NO: 750785 - DNA, 22 bp, Artificial Sequence
  chemically synthesized
ccggggtgaggcgacatcccac

SEQ ID NO: 750786 - DNA, 22 bp, Artificial Sequence
  chemically synthesized
cggggtgaggcgacatcccacc

SEQ ID NO: 750787 - DNA, 22 bp, Artificial Sequence
  chemically synthesized
gacagtgggtgcagcccacaga

SEQ ID NO: 750788 - DNA, 22 bp, Artificial Sequence
  chemically synthesized
ctgcgccctctgtgggctgcac

SEQ ID NO: 750789 - DNA, 22 bp, Artificial Sequence
  chemically synthesized
gttagacagtgggtgcagccca

SEQ ID NO: 750790 - DNA, 22 bp, Artificial Sequence
  chemically synthesized
tgcgccctctgtgggctgcacc

SEQ ID NO: 750791 - DNA, 22 bp, Artificial Sequence
  chemically synthesized
cgccctctgtgggctgcaccca

SEQ ID NO: 750792 - DNA, 22 bp, Artificial Sequence
  chemically synthesized
ggactggttagacagtgggtgc

SEQ ID NO: 750793 - DNA, 22 bp, Artificial Sequence
  chemically synthesized
tgtgggctgcacccactgtcta

SEQ ID NO: 750794 - DNA, 22 bp, Artificial Sequence
  chemically synthesized
actgggactggttagacagtgg

SEQ ID NO: 750795 - DNA, 22 bp, Artificial Sequence
  chemically synthesized
tgggctgcacccactgtctaac

SEQ ID NO: 750796 - DNA, 22 bp, Artificial Sequence
  chemically synthesized
atctcactgggactggttagac

SEQ ID NO: 750797 - DNA, 22 bp, Artificial Sequence
  chemically synthesized
cacccactgtctaaccagtccc

SEQ ID NO: 750798 - DNA, 22 bp, Artificial Sequence
  chemically synthesized
tctaaccagtcccagtgagatg

SEQ ID NO: 750799 - DNA, 22 bp, Artificial Sequence
  chemically synthesized
cagtacccggctcatctcactg

SEQ ID NO: 750800 - DNA, 22 bp, Artificial Sequence
  chemically synthesized
accagtcccagtgagatgagcc

SEQ ID NO: 750801 - DNA, 22 bp, Artificial Sequence
  chemically synthesized
caactgcagtacccggctcatc

SEQ ID NO: 750802 - DNA, 22 bp, Artificial Sequence
  chemically synthesized
ccaactgcagtacccggctcat

SEQ ID NO: 750803 - DNA, 22 bp, Artificial Sequence
  chemically synthesized
catttccaactgcagtacccgg

SEQ ID NO: 750804 - DNA, 22 bp, Artificial Sequence
  chemically synthesized
tgcatttccaactgcagtaccc

SEQ ID NO: 750805 - DNA, 22 bp, Artificial Sequence
  chemically synthesized
ctgcatttccaactgcagtacc

SEQ ID NO: 750806 - DNA, 22 bp, Artificial Sequence
  chemically synthesized
cagttggaaatgcagaaatcac

SEQ ID NO: 750807 - DNA, 22 bp, Artificial Sequence
  chemically synthesized
gaaatgcagaaatcacccacct

SEQ ID NO: 750808 - DNA, 22 bp, Artificial Sequence
  chemically synthesized
gtgagatcaacacagaaggtgg

SEQ ID NO: 750809 - DNA, 22 bp, Artificial Sequence
  chemically synthesized
aggtgcgcagcccctagtgaga

SEQ ID NO: 750810 - DNA, 22 bp, Artificial Sequence
  chemically synthesized
ctgtgttgatctcactaggggc

SEQ ID NO: 750811 - DNA, 22 bp, Artificial Sequence
  chemically synthesized
tgtgttgatctcactaggggct

SEQ ID NO: 750812 - DNA, 22 bp, Artificial Sequence
  chemically synthesized
tgttgatctcactaggggctgc

SEQ ID NO: 750813 - DNA, 22 bp, Artificial Sequence
  chemically synthesized
atctcactaggggctgcgcacc

SEQ ID NO: 750814 - DNA, 22 bp, Artificial Sequence
  chemically synthesized
aataggaacagctcaggtgcgc

SEQ ID NO: 750815 - DNA, 22 bp, Artificial Sequence
  chemically synthesized
actaggggctgcgcacctgagc

SEQ ID NO: 750816 - DNA, 22 bp, Artificial Sequence
  chemically synthesized
ggggctgcgcacctgagctgtt

SEQ ID NO: 750817 - DNA, 22 bp, Artificial Sequence
  chemically synthesized
gcaagatggctgaataggaaca

SEQ ID NO: 750818 - DNA, 22 bp, Artificial Sequence
  chemically synthesized
cgcacctgagctgttcctattc

SEQ ID NO: 750819 - DNA, 22 bp, Artificial Sequence
  chemically synthesized
agctgttcctattcagccatct

SEQ ID NO: 750820 - DNA, 22 bp, Artificial Sequence
  chemically synthesized
ttcctattcagccatcttgcca

SEQ ID NO: 750821 - DNA, 22 bp, Artificial Sequence
  chemically synthesized
accaaagaagtggctggcaaga

SEQ ID NO: 750822 - DNA, 22 bp, Artificial Sequence
  chemically synthesized
ctattcagccatcttgccagcc

SEQ ID NO: 750823 - DNA, 22 bp, Artificial Sequence
  chemically synthesized
ttcagccatcttgccagccact

SEQ ID NO: 750824 - DNA, 22 bp, Artificial Sequence
  chemically synthesized
agccatcttgccagccacttct

SEQ ID NO: 750825 - DNA, 22 bp, Artificial Sequence
  chemically synthesized
aaatcctgaccaaagaagtggc

SEQ ID NO: 750826 - DNA, 22 bp, Artificial Sequence
  chemically synthesized
aaaatcctgaccaaagaagtgg

SEQ ID NO: 750827 - DNA, 22 bp, Artificial Sequence
  chemically synthesized
taaaatcctgaccaaagaagtg

SEQ ID NO: 750828 - DNA, 22 bp, Artificial Sequence
  chemically synthesized
atctttaaaatcctgaccaaag

SEQ ID NO: 750829 - DNA, 22 bp, Artificial Sequence
  chemically synthesized
gccagccacttctttggtcagg

SEQ ID NO: 750830 - DNA, 22 bp, Artificial Sequence
  chemically synthesized
ccagccacttctttggtcagga

SEQ ID NO: 750831 - DNA, 22 bp, Artificial Sequence
  chemically synthesized
ttcatctttaaaatcctgacca

SEQ ID NO: 750832 - DNA, 22 bp, Artificial Sequence
  chemically synthesized
ctttggtcaggattttaaagat

SEQ ID NO: 750833 - DNA, 22 bp, Artificial Sequence
  chemically synthesized
tttggtcaggattttaaagatg

SEQ ID NO: 750834 - DNA, 22 bp, Artificial Sequence
  chemically synthesized
tggtcaggattttaaagatgaa

SEQ ID NO: 750835 - DNA, 22 bp, Artificial Sequence
  chemically synthesized
aagcaggaattattcatcttta

SEQ ID NO: 750836 - DNA, 22 bp, Artificial Sequence
  chemically synthesized
ggtcaggattttaaagatgaat

SEQ ID NO: 750837 - DNA, 22 bp, Artificial Sequence
  chemically synthesized
gtcaggattttaaagatgaata

SEQ ID NO: 750838 - DNA, 22 bp, Artificial Sequence
  chemically synthesized
gaaactaaagcaggaattattc

SEQ ID NO: 750839 - DNA, 22 bp, Artificial Sequence
  chemically synthesized
agaaactaaagcaggaattatt

SEQ ID NO: 750840 - DNA, 22 bp, Artificial Sequence
  chemically synthesized
taaagatgaataattcctgctt

SEQ ID NO: 750841 - DNA, 22 bp, Artificial Sequence
  chemically synthesized
aaagatgaataattcctgcttt

SEQ ID NO: 750842 - DNA, 22 bp, Artificial Sequence
  chemically synthesized
aagatgaataattcctgcttta

SEQ ID NO: 750843 - DNA, 22 bp, Artificial Sequence
  chemically synthesized
atacagcttagaaactaaagca

SEQ ID NO: 750844 - DNA, 22 bp, Artificial Sequence
  chemically synthesized
aatacagcttagaaactaaagc

SEQ ID NO: 750845 - DNA, 22 bp, Artificial Sequence
  chemically synthesized
gggtttaatacagcttagaaac

SEQ ID NO: 750846 - DNA, 22 bp, Artificial Sequence
  chemically synthesized
ctgctttagtttctaagctgta

SEQ ID NO: 750847 - DNA, 22 bp, Artificial Sequence
  chemically synthesized
ctttagtttctaagctgtatta

SEQ ID NO: 750848 - DNA, 22 bp, Artificial Sequence
  chemically synthesized
tagtttctaagctgtattaaac

SEQ ID NO: 750849 - DNA, 22 bp, Artificial Sequence
  chemically synthesized
agtttctaagctgtattaaacc

SEQ ID NO: 750850 - DNA, 22 bp, Artificial Sequence
  chemically synthesized
gtttctaagctgtattaaaccc

SEQ ID NO: 750851 - DNA, 22 bp, Artificial Sequence
  chemically synthesized
aatagaatatctagggtttaat

SEQ ID NO: 750852 - DNA, 22 bp, Artificial Sequence
  chemically synthesized
caatagaatatctagggtttaa

SEQ ID NO: 750853 - DNA, 22 bp, Artificial Sequence
  chemically synthesized
tcaatagaatatctagggttta

SEQ ID NO: 750854 - DNA, 22 bp, Artificial Sequence
  chemically synthesized
ctaagctgtattaaaccctaga

SEQ ID NO: 750855 - DNA, 22 bp, Artificial Sequence
  chemically synthesized
ttcaatagaatatctagggttt

SEQ ID NO: 750856 - DNA, 22 bp, Artificial Sequence
  chemically synthesized
taagctgtattaaaccctagat

SEQ ID NO: 750857 - DNA, 22 bp, Artificial Sequence
  chemically synthesized
agctgtattaaaccctagatat

SEQ ID NO: 750858 - DNA, 22 bp, Artificial Sequence
  chemically synthesized
tattaaaccctagatattctat

SEQ ID NO: 750859 - DNA, 22 bp, Artificial Sequence
  chemically synthesized
agtagcttttcaatagaatatc

SEQ ID NO: 750860 - DNA, 22 bp, Artificial Sequence
  chemically synthesized
cagtagcttttcaatagaatat

SEQ ID NO: 750861 - DNA, 22 bp, Artificial Sequence
  chemically synthesized
tcagtagcttttcaatagaata

SEQ ID NO: 750862 - DNA, 22 bp, Artificial Sequence
  chemically synthesized
aaccctagatattctattgaaa

SEQ ID NO: 750863 - DNA, 22 bp, Artificial Sequence
  chemically synthesized
ctttcagtagcttttcaataga

SEQ ID NO: 750864 - DNA, 22 bp, Artificial Sequence
  chemically synthesized
actttcagtagcttttcaatag

SEQ ID NO: 750865 - DNA, 22 bp, Artificial Sequence
  chemically synthesized
atttactttcagtagcttttca

SEQ ID NO: 750866 - DNA, 22 bp, Artificial Sequence
  chemically synthesized
gatattctattgaaaagctact

SEQ ID NO: 750867 - DNA, 22 bp, Artificial Sequence
  chemically synthesized
tattgaaaagctactgaaagta

SEQ ID NO: 750868 - DNA, 22 bp, Artificial Sequence
  chemically synthesized
atatatattgatttactttcag

SEQ ID NO: 750869 - DNA, 22 bp, Artificial Sequence
  chemically synthesized
ttgaaaagctactgaaagtaaa

SEQ ID NO: 750870 - DNA, 22 bp, Artificial Sequence
  chemically synthesized
aaaagctactgaaagtaaatca

SEQ ID NO: 750871 - DNA, 22 bp, Artificial Sequence
  chemically synthesized
tgtgaattcatatatattgatt

SEQ ID NO: 750872 - DNA, 22 bp, Artificial Sequence
  chemically synthesized
ctgaaagtaaatcaatatatat

SEQ ID NO: 750873 - DNA, 22 bp, Artificial Sequence
  chemically synthesized
aaagtaaatcaatatatatgaa

SEQ ID NO: 750874 - DNA, 22 bp, Artificial Sequence
  chemically synthesized
tggattatgtgaattcatatat

SEQ ID NO: 750875 - DNA, 22 bp, Artificial Sequence
  chemically synthesized
taagattatggattatgtgaat

SEQ ID NO: 750876 - DNA, 22 bp, Artificial Sequence
  chemically synthesized
ttgtaagattatggattatgtg

SEQ ID NO: 750877 - DNA, 22 bp, Artificial Sequence
  chemically synthesized
tgctattgtaagattatggatt

SEQ ID NO: 750878 - DNA, 22 bp, Artificial Sequence
  chemically synthesized
atgctattgtaagattatggat

SEQ ID NO: 750879 - DNA, 22 bp, Artificial Sequence
  chemically synthesized
tatgctattgtaagattatgga

SEQ ID NO: 750880 - DNA, 22 bp, Artificial Sequence
  chemically synthesized
acataatccataatcttacaat

SEQ ID NO: 750881 - DNA, 22 bp, Artificial Sequence
  chemically synthesized
aggattttatgctattgtaaga

SEQ ID NO: 750882 - DNA, 22 bp, Artificial Sequence
  chemically synthesized
tattaaggattttatgctattg

SEQ ID NO: 750883 - DNA, 22 bp, Artificial Sequence
  chemically synthesized
acaatagcataaaatccttaat

SEQ ID NO: 750884 - DNA, 22 bp, Artificial Sequence
  chemically synthesized
aaccagtactgtattaaggatt

SEQ ID NO: 750885 - DNA, 22 bp, Artificial Sequence
  chemically synthesized
caatagcataaaatccttaata

SEQ ID NO: 750886 - DNA, 22 bp, Artificial Sequence
  chemically synthesized
taaaccagtactgtattaagga

SEQ ID NO: 750887 - DNA, 22 bp, Artificial Sequence
  chemically synthesized
ctaaaccagtactgtattaagg

SEQ ID NO: 750888 - DNA, 22 bp, Artificial Sequence
  chemically synthesized
ggtttctaaaccagtactgtat

SEQ ID NO: 750889 - DNA, 22 bp, Artificial Sequence
  chemically synthesized
ctgggtttctaaaccagtactg

SEQ ID NO: 750890 - DNA, 22 bp, Artificial Sequence
  chemically synthesized
aatacagtactggtttagaaac

SEQ ID NO: 750891 - DNA, 22 bp, Artificial Sequence
  chemically synthesized
atacagtactggtttagaaacc

SEQ ID NO: 750892 - DNA, 22 bp, Artificial Sequence
  chemically synthesized
gtgataagagatgttactgggt

SEQ ID NO: 750893 - DNA, 22 bp, Artificial Sequence
  chemically synthesized
gtttagaaacccagtaacatct

SEQ ID NO: 750894 - DNA, 22 bp, Artificial Sequence
  chemically synthesized
tgtactggtgataagagatgtt

SEQ ID NO: 750895 - DNA, 22 bp, Artificial Sequence
  chemically synthesized
agaaacccagtaacatctctta

SEQ ID NO: 750896 - DNA, 22 bp, Artificial Sequence
  chemically synthesized
atgtactggtgataagagatgt

SEQ ID NO: 750897 - DNA, 22 bp, Artificial Sequence
  chemically synthesized
gaaacccagtaacatctcttat

SEQ ID NO: 750898 - DNA, 22 bp, Artificial Sequence
  chemically synthesized
atagaatgtttatgtactggtg

SEQ ID NO: 750899 - DNA, 22 bp, Artificial Sequence
  chemically synthesized
aatagaatgtttatgtactggt

SEQ ID NO: 750900 - DNA, 22 bp, Artificial Sequence
  chemically synthesized
taatagaatgtttatgtactgg

SEQ ID NO: 750901 - DNA, 22 bp, Artificial Sequence
  chemically synthesized
ttaatagaatgtttatgtactg

SEQ ID NO: 750902 - DNA, 22 bp, Artificial Sequence
  chemically synthesized
ttatcaccagtacataaacatt

SEQ ID NO: 750903 - DNA, 22 bp, Artificial Sequence
  chemically synthesized
atcaccagtacataaacattct

SEQ ID NO: 750904 - DNA, 22 bp, Artificial Sequence
  chemically synthesized
tcaccagtacataaacattcta

SEQ ID NO: 750905 - DNA, 22 bp, Artificial Sequence
  chemically synthesized
taagtacggtatatttttaata

SEQ ID NO: 750906 - DNA, 22 bp, Artificial Sequence
  chemically synthesized
ataagtacggtatatttttaat

SEQ ID NO: 750907 - DNA, 22 bp, Artificial Sequence
  chemically synthesized
tataagtacggtatatttttaa

SEQ ID NO: 750908 - DNA, 22 bp, Artificial Sequence
  chemically synthesized
catactttataagtacggtata

SEQ ID NO: 750909 - DNA, 22 bp, Artificial Sequence
  chemically synthesized
tattaaaaatataccgtactta

SEQ ID NO: 750910 - DNA, 22 bp, Artificial Sequence
  chemically synthesized
ttaaaaatataccgtacttata

SEQ ID NO: 750911 - DNA, 22 bp, Artificial Sequence
  chemically synthesized
aaaatataccgtacttataaag

SEQ ID NO: 750912 - DNA, 22 bp, Artificial Sequence
  chemically synthesized
tagcgagtgtcactccatactt

SEQ ID NO: 750913 - DNA, 22 bp, Artificial Sequence
  chemically synthesized
ataaagtatggagtgacactcg

SEQ ID NO: 750914 - DNA, 22 bp, Artificial Sequence
  chemically synthesized
taaagtatggagtgacactcgc

SEQ ID NO: 750915 - DNA, 22 bp, Artificial Sequence
  chemically synthesized
tcaaaggccatattatagcgag

SEQ ID NO: 750916 - DNA, 22 bp, Artificial Sequence
  chemically synthesized
aaaatatgtctatcaaaggcca

SEQ ID NO: 750917 - DNA, 22 bp, Artificial Sequence
  chemically synthesized
gctataatatggcctttgatag

SEQ ID NO: 750918 - DNA, 22 bp, Artificial Sequence
  chemically synthesized
taatatggcctttgatagacat

SEQ ID NO: 750919 - DNA, 22 bp, Artificial Sequence
  chemically synthesized
atatctgaaaatatgtctatca

SEQ ID NO: 750920 - DNA, 22 bp, Artificial Sequence
  chemically synthesized
aatatctgaaaatatgtctatc

SEQ ID NO: 750921 - DNA, 22 bp, Artificial Sequence
  chemically synthesized
taatatctgaaaatatgtctat

SEQ ID NO: 750922 - DNA, 22 bp, Artificial Sequence
  chemically synthesized
gcctttaatatctgaaaatatg

SEQ ID NO: 750923 - DNA, 22 bp, Artificial Sequence
  chemically synthesized
ggcctttaatatctgaaaatat

SEQ ID NO: 750924 - DNA, 22 bp, Artificial Sequence
  chemically synthesized
tgatagacatattttcagatat

SEQ ID NO: 750925 - DNA, 22 bp, Artificial Sequence
  chemically synthesized
gatagacatattttcagatatt

SEQ ID NO: 750926 - DNA, 22 bp, Artificial Sequence
  chemically synthesized
atagacatattttcagatatta

SEQ ID NO: 750927 - DNA, 22 bp, Artificial Sequence
  chemically synthesized
aaagcatatgatttggccttta

SEQ ID NO: 750928 - DNA, 22 bp, Artificial Sequence
  chemically synthesized
aaaagcatatgatttggccttt

SEQ ID NO: 750929 - DNA, 22 bp, Artificial Sequence
  chemically synthesized
tcagatattaaaggccaaatca

SEQ ID NO: 750930 - DNA, 22 bp, Artificial Sequence
  chemically synthesized
cagatattaaaggccaaatcat

SEQ ID NO: 750931 - DNA, 22 bp, Artificial Sequence
  chemically synthesized
agatattaaaggccaaatcata

SEQ ID NO: 750932 - DNA, 22 bp, Artificial Sequence
  chemically synthesized
caatgtttaaaagcatatgatt

SEQ ID NO: 750933 - DNA, 22 bp, Artificial Sequence
  chemically synthesized
aaggccaaatcatatgctttta

SEQ ID NO: 750934 - DNA, 22 bp, Artificial Sequence
  chemically synthesized
caaagcatgcaattgcaatgtt

SEQ ID NO: 750935 - DNA, 22 bp, Artificial Sequence
  chemically synthesized
acaaagcatgcaattgcaatgt

SEQ ID NO: 750936 - DNA, 22 bp, Artificial Sequence
  chemically synthesized
gtttacaaagcatgcaattgca

SEQ ID NO: 750937 - DNA, 22 bp, Artificial Sequence
  chemically synthesized
ttaaacattgcaattgcatgct

SEQ ID NO: 750938 - DNA, 22 bp, Artificial Sequence
  chemically synthesized
tctagtttacaaagcatgcaat

SEQ ID NO: 750939 - DNA, 22 bp, Artificial Sequence
  chemically synthesized
taaacattgcaattgcatgctt

SEQ ID NO: 750940 - DNA, 22 bp, Artificial Sequence
  chemically synthesized
atctagtttacaaagcatgcaa

SEQ ID NO: 750941 - DNA, 22 bp, Artificial Sequence
  chemically synthesized
aaacattgcaattgcatgcttt

SEQ ID NO: 750942 - DNA, 22 bp, Artificial Sequence
  chemically synthesized
tatctagtttacaaagcatgca

SEQ ID NO: 750943 - DNA, 22 bp, Artificial Sequence
  chemically synthesized
aacattgcaattgcatgctttg

SEQ ID NO: 750944 - DNA, 22 bp, Artificial Sequence
  chemically synthesized
caattgcatgctttgtaaacta

SEQ ID NO: 750945 - DNA, 22 bp, Artificial Sequence
  chemically synthesized
catgctttgtaaactagataaa

SEQ ID NO: 750946 - DNA, 22 bp, Artificial Sequence
  chemically synthesized
gagtaaccagggttttatctag

SEQ ID NO: 750947 - DNA, 22 bp, Artificial Sequence
  chemically synthesized
ggagtaaccagggttttatcta

SEQ ID NO: 750948 - DNA, 22 bp, Artificial Sequence
  chemically synthesized
tttggagtaaccagggttttat

SEQ ID NO: 750949 - DNA, 22 bp, Artificial Sequence
  chemically synthesized
tgtaaactagataaaaccctgg

SEQ ID NO: 750950 - DNA, 22 bp, Artificial Sequence
  chemically synthesized
gtaaactagataaaaccctggt

SEQ ID NO: 750951 - DNA, 22 bp, Artificial Sequence
  chemically synthesized
ttatttggagtaaccagggttt

SEQ ID NO: 750952 - DNA, 22 bp, Artificial Sequence
  chemically synthesized
taaactagataaaaccctggtt

SEQ ID NO: 750953 - DNA, 22 bp, Artificial Sequence
  chemically synthesized
ctgttatttggagtaaccaggg

SEQ ID NO: 750954 - DNA, 22 bp, Artificial Sequence
  chemically synthesized
attcctgttatttggagtaacc

SEQ ID NO: 750955 - DNA, 22 bp, Artificial Sequence
  chemically synthesized
gataaaaccctggttactccaa

SEQ ID NO: 750956 - DNA, 22 bp, Artificial Sequence
  chemically synthesized
aatatgaagctaattcctgtta

SEQ ID NO: 750957 - DNA, 22 bp, Artificial Sequence
  chemically synthesized
gttactccaaataacaggaatt

SEQ ID NO: 750958 - DNA, 22 bp, Artificial Sequence
  chemically synthesized
ctccaaataacaggaattagct

SEQ ID NO: 750959 - DNA, 22 bp, Artificial Sequence
  chemically synthesized
ggttaaatatgaagctaattcc

SEQ ID NO: 750960 - DNA, 22 bp, Artificial Sequence
  chemically synthesized
caaataacaggaattagcttca

SEQ ID NO: 750961 - DNA, 22 bp, Artificial Sequence
  chemically synthesized
ataaatctgggttaaatatgaa

SEQ ID NO: 750962 - DNA, 22 bp, Artificial Sequence
  chemically synthesized
cataaatctgggttaaatatga

SEQ ID NO: 750963 - DNA, 22 bp, Artificial Sequence
  chemically synthesized
atccttcataaatctgggttaa

SEQ ID NO: 750964 - DNA, 22 bp, Artificial Sequence
  chemically synthesized
aatccttcataaatctgggtta

SEQ ID NO: 750965 - DNA, 22 bp, Artificial Sequence
  chemically synthesized
gcttcatatttaacccagattt

SEQ ID NO: 750966 - DNA, 22 bp, Artificial Sequence
  chemically synthesized
catatttaacccagatttatga

SEQ ID NO: 750967 - DNA, 22 bp, Artificial Sequence
  chemically synthesized
atatttaacccagatttatgaa

SEQ ID NO: 750968 - DNA, 22 bp, Artificial Sequence
  chemically synthesized
aacccagatttatgaaggatta

SEQ ID NO: 750969 - DNA, 22 bp, Artificial Sequence
  chemically synthesized
acccagatttatgaaggattaa

SEQ ID NO: 750970 - DNA, 22 bp, Artificial Sequence
  chemically synthesized
atgaaggattaaatattttttc

SEQ ID NO: 750971 - DNA, 22 bp, Artificial Sequence
  chemically synthesized
tgaaggattaaatattttttct

SEQ ID NO: 750972 - DNA, 22 bp, Artificial Sequence
  chemically synthesized
atggagaagaaaaaacaaagaa

SEQ ID NO: 750973 - DNA, 22 bp, Artificial Sequence
  chemically synthesized
gatggagaagaaaaaacaaaga

SEQ ID NO: 750974 - DNA, 22 bp, Artificial Sequence
  chemically synthesized
tgatggagaagaaaaaacaaag

SEQ ID NO: 750975 - DNA, 22 bp, Artificial Sequence
  chemically synthesized
aatattttttctttgttttttc

SEQ ID NO: 750976 - DNA, 22 bp, Artificial Sequence
  chemically synthesized
tttctttgttttttcttctcca

SEQ ID NO: 750977 - DNA, 22 bp, Artificial Sequence
  chemically synthesized
ttctttgttttttcttctccat

SEQ ID NO: 750978 - DNA, 22 bp, Artificial Sequence
  chemically synthesized
agtaagcctttgatggagaaga

SEQ ID NO: 750979 - DNA, 22 bp, Artificial Sequence
  chemically synthesized
tctttgttttttcttctccatc

SEQ ID NO: 750980 - DNA, 22 bp, Artificial Sequence
  chemically synthesized
ctttgttttttcttctccatca

SEQ ID NO: 750981 - DNA, 22 bp, Artificial Sequence
  chemically synthesized
tttgttttttcttctccatcaa

SEQ ID NO: 750982 - DNA, 22 bp, Artificial Sequence
  chemically synthesized
tgttttttcttctccatcaaag

SEQ ID NO: 750983 - DNA, 22 bp, Artificial Sequence
  chemically synthesized
gttttttcttctccatcaaagg

SEQ ID NO: 750984 - DNA, 22 bp, Artificial Sequence
  chemically synthesized
ttttttcttctccatcaaaggc

SEQ ID NO: 750985 - DNA, 22 bp, Artificial Sequence
  chemically synthesized
tgtgtattaagtaagcctttga

SEQ ID NO: 750986 - DNA, 22 bp, Artificial Sequence
  chemically synthesized
tttcttctccatcaaaggctta

SEQ ID NO: 750987 - DNA, 22 bp, Artificial Sequence
  chemically synthesized
ttcttctccatcaaaggcttac

SEQ ID NO: 750988 - DNA, 22 bp, Artificial Sequence
  chemically synthesized
tcttctccatcaaaggcttact

SEQ ID NO: 750989 - DNA, 22 bp, Artificial Sequence
  chemically synthesized
cttctccatcaaaggcttactt

SEQ ID NO: 750990 - DNA, 22 bp, Artificial Sequence
  chemically synthesized
ttctccatcaaaggcttactta

SEQ ID NO: 750991 - DNA, 22 bp, Artificial Sequence
  chemically synthesized
ctccatcaaaggcttacttaat

SEQ ID NO: 750992 - DNA, 22 bp, Artificial Sequence
  chemically synthesized
tccatcaaaggcttacttaata

SEQ ID NO: 750993 - DNA, 22 bp, Artificial Sequence
  chemically synthesized
catcaaaggcttacttaataca

SEQ ID NO: 750994 - DNA, 22 bp, Artificial Sequence
  chemically synthesized
taaaaatgctatgtgtattaag

SEQ ID NO: 750995 - DNA, 22 bp, Artificial Sequence
  chemically synthesized
ttgtaaaaatgctatgtgtatt

SEQ ID NO: 750996 - DNA, 22 bp, Artificial Sequence
  chemically synthesized
ttgttgtaaaaatgctatgtgt

SEQ ID NO: 750997 - DNA, 22 bp, Artificial Sequence
  chemically synthesized
ttgttgttgtaaaaatgctatg

SEQ ID NO: 750998 - DNA, 22 bp, Artificial Sequence
  chemically synthesized
acttaatacacatagcattttt

SEQ ID NO: 750999 - DNA, 22 bp, Artificial Sequence
  chemically synthesized
cttaatacacatagcattttta

SEQ ID NO: 751000 - DNA, 22 bp, Artificial Sequence
  chemically synthesized
attgttgttgttgtaaaaatgc

SEQ ID NO: 751001 - DNA, 22 bp, Artificial Sequence
  chemically synthesized
cattgttgttgttgtaaaaatg

SEQ ID NO: 751002 - DNA, 22 bp, Artificial Sequence
  chemically synthesized
aatacacatagcatttttacaa

SEQ ID NO: 751003 - DNA, 22 bp, Artificial Sequence
  chemically synthesized
tcattgttgttgttgtaaaaat

SEQ ID NO: 751004 - DNA, 22 bp, Artificial Sequence
  chemically synthesized
atacacatagcatttttacaac

SEQ ID NO: 751005 - DNA, 22 bp, Artificial Sequence
  chemically synthesized
ccgtgtggaggctttcattgtt

SEQ ID NO: 751006 - DNA, 22 bp, Artificial Sequence
  chemically synthesized
ttacaacaacaacaatgaaagc

SEQ ID NO: 751007 - DNA, 22 bp, Artificial Sequence
  chemically synthesized
tacaacaacaacaatgaaagcc

SEQ ID NO: 751008 - DNA, 22 bp, Artificial Sequence
  chemically synthesized
acaacaacaacaatgaaagcct

SEQ ID NO: 751009 - DNA, 22 bp, Artificial Sequence
  chemically synthesized
caacaacaacaatgaaagcctc

SEQ ID NO: 751010 - DNA, 22 bp, Artificial Sequence
  chemically synthesized
caaatgaattgccgtgtggagg

SEQ ID NO: 751011 - DNA, 22 bp, Artificial Sequence
  chemically synthesized
aagaactacaaatgaattgccg

SEQ ID NO: 751012 - DNA, 22 bp, Artificial Sequence
  chemically synthesized
ttaaagaactacaaatgaattg

SEQ ID NO: 751013 - DNA, 22 bp, Artificial Sequence
  chemically synthesized
cacacggcaattcatttgtagt

SEQ ID NO: 751014 - DNA, 22 bp, Artificial Sequence
  chemically synthesized
tgcattgttaaagaactacaaa

SEQ ID NO: 751015 - DNA, 22 bp, Artificial Sequence
  chemically synthesized
gtgcattgttaaagaactacaa

SEQ ID NO: 751016 - DNA, 22 bp, Artificial Sequence
  chemically synthesized
tgtgcattgttaaagaactaca

SEQ ID NO: 751017 - DNA, 22 bp, Artificial Sequence
  chemically synthesized
atgttttgtgcattgttaaaga

SEQ ID NO: 751018 - DNA, 22 bp, Artificial Sequence
  chemically synthesized
atttgtagttctttaacaatgc

SEQ ID NO: 751019 - DNA, 22 bp, Artificial Sequence
  chemically synthesized
ttaatgttttgtgcattgttaa

SEQ ID NO: 751020 - DNA, 22 bp, Artificial Sequence
  chemically synthesized
attaatgttttgtgcattgtta

SEQ ID NO: 751021 - DNA, 22 bp, Artificial Sequence
  chemically synthesized
gtagttctttaacaatgcacaa

SEQ ID NO: 751022 - DNA, 22 bp, Artificial Sequence
  chemically synthesized
tagttctttaacaatgcacaaa

SEQ ID NO: 751023 - DNA, 22 bp, Artificial Sequence
  chemically synthesized
tttaacaatgcacaaaacatta

SEQ ID NO: 751024 - DNA, 22 bp, Artificial Sequence
  chemically synthesized
taacaatgcacaaaacattaat

SEQ ID NO: 751025 - DNA, 22 bp, Artificial Sequence
  chemically synthesized
aacaatgcacaaaacattaata

SEQ ID NO: 751026 - DNA, 22 bp, Artificial Sequence
  chemically synthesized
acaatgcacaaaacattaataa

SEQ ID NO: 751027 - DNA, 22 bp, Artificial Sequence
  chemically synthesized
tagtaggaagaggaaaatttat

SEQ ID NO: 751028 - DNA, 22 bp, Artificial Sequence
  chemically synthesized
cctatagtaggaagaggaaaat

SEQ ID NO: 751029 - DNA, 22 bp, Artificial Sequence
  chemically synthesized
ataaattttcctcttcctacta

SEQ ID NO: 751030 - DNA, 22 bp, Artificial Sequence
  chemically synthesized
tcctcttcctactataggcagt

SEQ ID NO: 751031 - DNA, 22 bp, Artificial Sequence
  chemically synthesized
cctcttcctactataggcagta

SEQ ID NO: 751032 - DNA, 22 bp, Artificial Sequence
  chemically synthesized
ctcttcctactataggcagtat

SEQ ID NO: 751033 - DNA, 22 bp, Artificial Sequence
  chemically synthesized
ataatgaataaggtatactgcc

SEQ ID NO: 751034 - DNA, 22 bp, Artificial Sequence
  chemically synthesized
ttcctactataggcagtatacc

SEQ ID NO: 751035 - DNA, 22 bp, Artificial Sequence
  chemically synthesized
cataatgaataaggtatactgc

SEQ ID NO: 751036 - DNA, 22 bp, Artificial Sequence
  chemically synthesized
cctactataggcagtatacctt

SEQ ID NO: 751037 - DNA, 22 bp, Artificial Sequence
  chemically synthesized
ctactataggcagtatacctta

SEQ ID NO: 751038 - DNA, 22 bp, Artificial Sequence
  chemically synthesized
ctataggcagtataccttattc

SEQ ID NO: 751039 - DNA, 22 bp, Artificial Sequence
  chemically synthesized
taggcagtataccttattcatt

SEQ ID NO: 751040 - DNA, 22 bp, Artificial Sequence
  chemically synthesized
tgatatcttcataatgaataag

SEQ ID NO: 751041 - DNA, 22 bp, Artificial Sequence
  chemically synthesized
gtgatatcttcataatgaataa

SEQ ID NO: 751042 - DNA, 22 bp, Artificial Sequence
  chemically synthesized
aataaacttgtgatatcttcat

SEQ ID NO: 751043 - DNA, 22 bp, Artificial Sequence
  chemically synthesized
tgaataaacttgtgatatcttc

SEQ ID NO: 751044 - DNA, 22 bp, Artificial Sequence
  chemically synthesized
attcattatgaagatatcacaa

SEQ ID NO: 751045 - DNA, 22 bp, Artificial Sequence
  chemically synthesized
ttcattatgaagatatcacaag

SEQ ID NO: 751046 - DNA, 22 bp, Artificial Sequence
  chemically synthesized
attatgaagatatcacaagttt

SEQ ID NO: 751047 - DNA, 22 bp, Artificial Sequence
  chemically synthesized
ccaactctgaataaacttgtga

SEQ ID NO: 751048 - DNA, 22 bp, Artificial Sequence
  chemically synthesized
tcccaactctgaataaacttgt

SEQ ID NO: 751049 - DNA, 22 bp, Artificial Sequence
  chemically synthesized
tgaagatatcacaagtttattc

SEQ ID NO: 751050 - DNA, 22 bp, Artificial Sequence
  chemically synthesized
aaaacatgtaagctctcccaac

SEQ ID NO: 751051 - DNA, 22 bp, Artificial Sequence
  chemically synthesized
attcagagttgggagagcttac

SEQ ID NO: 751052 - DNA, 22 bp, Artificial Sequence
  chemically synthesized
ttcagagttgggagagcttaca

SEQ ID NO: 751053 - DNA, 22 bp, Artificial Sequence
  chemically synthesized
agagttgggagagcttacatgt

SEQ ID NO: 751054 - DNA, 22 bp, Artificial Sequence
  chemically synthesized
aaaatcattcaaaacatgtaag

SEQ ID NO: 751055 - DNA, 22 bp, Artificial Sequence
  chemically synthesized
ggagagcttacatgttttgaat

SEQ ID NO: 751056 - DNA, 22 bp, Artificial Sequence
  chemically synthesized
acatgttttgaatgatttttag

SEQ ID NO: 751057 - DNA, 22 bp, Artificial Sequence
  chemically synthesized
catgttttgaatgatttttagg

SEQ ID NO: 751058 - DNA, 22 bp, Artificial Sequence
  chemically synthesized
tgaatgatttttaggatcgccc

SEQ ID NO: 751059 - DNA, 22 bp, Artificial Sequence
  chemically synthesized
gaatgatttttaggatcgccct

SEQ ID NO: 751060 - DNA, 22 bp, Artificial Sequence
  chemically synthesized
aatgatttttaggatcgccctg

SEQ ID NO: 751061 - DNA, 22 bp, Artificial Sequence
  chemically synthesized
ttaggatcgccctgttcatgtt

SEQ ID NO: 751062 - DNA, 22 bp, Artificial Sequence
  chemically synthesized
taggatcgccctgttcatgttg

SEQ ID NO: 751063 - DNA, 22 bp, Artificial Sequence
  chemically synthesized
aggatcgccctgttcatgttgg

SEQ ID NO: 751064 - DNA, 22 bp, Artificial Sequence
  chemically synthesized
ggatcgccctgttcatgttggt

SEQ ID NO: 751065 - DNA, 22 bp, Artificial Sequence
  chemically synthesized
ggggatgaatgagcagatagaa

SEQ ID NO: 751066 - DNA, 22 bp, Artificial Sequence
  chemically synthesized
ttcatgttggttctatctgctc

SEQ ID NO: 751067 - DNA, 22 bp, Artificial Sequence
  chemically synthesized
atgttggttctatctgctcatt

SEQ ID NO: 751068 - DNA, 22 bp, Artificial Sequence
  chemically synthesized
tagaattaggggatgaatgagc

SEQ ID NO: 751069 - DNA, 22 bp, Artificial Sequence
  chemically synthesized
atagaattaggggatgaatgag

SEQ ID NO: 751070 - DNA, 22 bp, Artificial Sequence
  chemically synthesized
gttctatctgctcattcatccc

SEQ ID NO: 751071 - DNA, 22 bp, Artificial Sequence
  chemically synthesized
ttatagaattaggggatgaatg

SEQ ID NO: 751072 - DNA, 22 bp, Artificial Sequence
  chemically synthesized
cttatagaattaggggatgaat

SEQ ID NO: 751073 - DNA, 22 bp, Artificial Sequence
  chemically synthesized
tcttatagaattaggggatgaa

SEQ ID NO: 751074 - DNA, 22 bp, Artificial Sequence
  chemically synthesized
ttcttatagaattaggggatga

SEQ ID NO: 751075 - DNA, 22 bp, Artificial Sequence
  chemically synthesized
tatctgctcattcatcccctaa

SEQ ID NO: 751076 - DNA, 22 bp, Artificial Sequence
  chemically synthesized
tctgctcattcatcccctaatt

SEQ ID NO: 751077 - DNA, 22 bp, Artificial Sequence
  chemically synthesized
tcttttcttatagaattagggg

SEQ ID NO: 751078 - DNA, 22 bp, Artificial Sequence
  chemically synthesized
atcttttcttatagaattaggg

SEQ ID NO: 751079 - DNA, 22 bp, Artificial Sequence
  chemically synthesized
ctcattcatcccctaattctat

SEQ ID NO: 751080 - DNA, 22 bp, Artificial Sequence
  chemically synthesized
attcatcccctaattctataag

SEQ ID NO: 751081 - DNA, 22 bp, Artificial Sequence
  chemically synthesized
atcccctaattctataagaaaa

SEQ ID NO: 751082 - DNA, 22 bp, Artificial Sequence
  chemically synthesized
tgtaaggaaaacttatcttttc

SEQ ID NO: 751083 - DNA, 22 bp, Artificial Sequence
  chemically synthesized
attctataagaaaagataagtt

SEQ ID NO: 751084 - DNA, 22 bp, Artificial Sequence
  chemically synthesized
tataagaaaagataagttttcc

SEQ ID NO: 751085 - DNA, 22 bp, Artificial Sequence
  chemically synthesized
taagaaaagataagttttcctt

SEQ ID NO: 751086 - DNA, 22 bp, Artificial Sequence
  chemically synthesized
tatatgagttatgtaaggaaaa

SEQ ID NO: 751087 - DNA, 22 bp, Artificial Sequence
  chemically synthesized
atatatgagttatgtaaggaaa

SEQ ID NO: 751088 - DNA, 22 bp, Artificial Sequence
  chemically synthesized
ttatatatgagttatgtaagga

SEQ ID NO: 751089 - DNA, 22 bp, Artificial Sequence
  chemically synthesized
cttatatatgagttatgtaagg

SEQ ID NO: 751090 - DNA, 22 bp, Artificial Sequence
  chemically synthesized
atttcttatatatgagttatgt

SEQ ID NO: 751091 - DNA, 22 bp, Artificial Sequence
  chemically synthesized
gatttcttatatatgagttatg

SEQ ID NO: 751092 - DNA, 22 bp, Artificial Sequence
  chemically synthesized
cttgatttcttatatatgagtt

SEQ ID NO: 751093 - DNA, 22 bp, Artificial Sequence
  chemically synthesized
acttgatttcttatatatgagt

SEQ ID NO: 751094 - DNA, 22 bp, Artificial Sequence
  chemically synthesized
tccttacataactcatatataa

SEQ ID NO: 751095 - DNA, 22 bp, Artificial Sequence
  chemically synthesized
ccttacataactcatatataag

SEQ ID NO: 751096 - DNA, 22 bp, Artificial Sequence
  chemically synthesized
cttacataactcatatataaga

SEQ ID NO: 751097 - DNA, 22 bp, Artificial Sequence
  chemically synthesized
acataactcatatataagaaat

SEQ ID NO: 751098 - DNA, 22 bp, Artificial Sequence
  chemically synthesized
cataactcatatataagaaatc

SEQ ID NO: 751099 - DNA, 22 bp, Artificial Sequence
  chemically synthesized
atatataagaaatcaagtaagg

SEQ ID NO: 751100 - DNA, 22 bp, Artificial Sequence
  chemically synthesized
tatgagtcaagtcaaccttact

SEQ ID NO: 751101 - DNA, 22 bp, Artificial Sequence
  chemically synthesized
atatgagtcaagtcaaccttac

SEQ ID NO: 751102 - DNA, 22 bp, Artificial Sequence
  chemically synthesized
ccatttatatgagtcaagtcaa

SEQ ID NO: 751103 - DNA, 22 bp, Artificial Sequence
  chemically synthesized
cccatttatatgagtcaagtca

SEQ ID NO: 751104 - DNA, 22 bp, Artificial Sequence
  chemically synthesized
tgcttcccatttatatgagtca

SEQ ID NO: 751105 - DNA, 22 bp, Artificial Sequence
  chemically synthesized
ttatgcttcccatttatatgag

SEQ ID NO: 751106 - DNA, 22 bp, Artificial Sequence
  chemically synthesized
gttatgcttcccatttatatga

SEQ ID NO: 751107 - DNA, 22 bp, Artificial Sequence
  chemically synthesized
tgttatgcttcccatttatatg

SEQ ID NO: 751108 - DNA, 22 bp, Artificial Sequence
  chemically synthesized
acttgactcatataaatgggaa

SEQ ID NO: 751109 - DNA, 22 bp, Artificial Sequence
  chemically synthesized
attttgttatgcttcccattta

SEQ ID NO: 751110 - DNA, 22 bp, Artificial Sequence
  chemically synthesized
gactcatataaatgggaagcat

SEQ ID NO: 751111 - DNA, 22 bp, Artificial Sequence
  chemically synthesized
actcatataaatgggaagcata

SEQ ID NO: 751112 - DNA, 22 bp, Artificial Sequence
  chemically synthesized
tattaattttgttatgcttccc

SEQ ID NO: 751113 - DNA, 22 bp, Artificial Sequence
  chemically synthesized
ttgtattaattttgttatgctt

SEQ ID NO: 751114 - DNA, 22 bp, Artificial Sequence
  chemically synthesized
atataaatgggaagcataacaa

SEQ ID NO: 751115 - DNA, 22 bp, Artificial Sequence
  chemically synthesized
attgtattaattttgttatgct

SEQ ID NO: 751116 - DNA, 22 bp, Artificial Sequence
  chemically synthesized
ttattgtattaattttgttatg

SEQ ID NO: 751117 - DNA, 22 bp, Artificial Sequence
  chemically synthesized
cttattgtattaattttgttat

SEQ ID NO: 751118 - DNA, 22 bp, Artificial Sequence
  chemically synthesized
ttcttattgtattaattttgtt

SEQ ID NO: 751119 - DNA, 22 bp, Artificial Sequence
  chemically synthesized
cttcttattgtattaattttgt

SEQ ID NO: 751120 - DNA, 22 bp, Artificial Sequence
  chemically synthesized
tcttcttattgtattaattttg

SEQ ID NO: 751121 - DNA, 22 bp, Artificial Sequence
  chemically synthesized
aagttttcttcttattgtatta

SEQ ID NO: 751122 - DNA, 22 bp, Artificial Sequence
  chemically synthesized
taaagttttcttcttattgtat

SEQ ID NO: 751123 - DNA, 22 bp, Artificial Sequence
  chemically synthesized
gttctaaagttttcttcttatt

SEQ ID NO: 751124 - DNA, 22 bp, Artificial Sequence
  chemically synthesized
ggttctaaagttttcttcttat

SEQ ID NO: 751125 - DNA, 22 bp, Artificial Sequence
  chemically synthesized
accttggttctaaagttttctt

SEQ ID NO: 751126 - DNA, 22 bp, Artificial Sequence
  chemically synthesized
aaccttggttctaaagttttct

SEQ ID NO: 751127 - DNA, 22 bp, Artificial Sequence
  chemically synthesized
atacaataagaagaaaacttta

SEQ ID NO: 751128 - DNA, 22 bp, Artificial Sequence
  chemically synthesized
ttaaccttggttctaaagtttt

SEQ ID NO: 751129 - DNA, 22 bp, Artificial Sequence
  chemically synthesized
cttaaccttggttctaaagttt

SEQ ID NO: 751130 - DNA, 22 bp, Artificial Sequence
  chemically synthesized
ttcttaaccttggttctaaagt

SEQ ID NO: 751131 - DNA, 22 bp, Artificial Sequence
  chemically synthesized
tcttcttaaccttggttctaaa

SEQ ID NO: 751132 - DNA, 22 bp, Artificial Sequence
  chemically synthesized
ctcttcttaaccttggttctaa

SEQ ID NO: 751133 - DNA, 22 bp, Artificial Sequence
  chemically synthesized
tctcttcttaaccttggttcta

SEQ ID NO: 751134 - DNA, 22 bp, Artificial Sequence
  chemically synthesized
ttctcttcttaaccttggttct

SEQ ID NO: 751135 - DNA, 22 bp, Artificial Sequence
  chemically synthesized
cttttctcttcttaaccttggt

SEQ ID NO: 751136 - DNA, 22 bp, Artificial Sequence
  chemically synthesized
ttgcttttctcttcttaacctt

SEQ ID NO: 751137 - DNA, 22 bp, Artificial Sequence
  chemically synthesized
attgcttttctcttcttaacct

SEQ ID NO: 751138 - DNA, 22 bp, Artificial Sequence
  chemically synthesized
tagaaccaaggttaagaagaga

SEQ ID NO: 751139 - DNA, 22 bp, Artificial Sequence
  chemically synthesized
ccttattgcttttctcttctta

SEQ ID NO: 751140 - DNA, 22 bp, Artificial Sequence
  chemically synthesized
agaaccaaggttaagaagagaa

SEQ ID NO: 751141 - DNA, 22 bp, Artificial Sequence
  chemically synthesized
cccttattgcttttctcttctt

SEQ ID NO: 751142 - DNA, 22 bp, Artificial Sequence
  chemically synthesized
gaaccaaggttaagaagagaaa

SEQ ID NO: 751143 - DNA, 22 bp, Artificial Sequence
  chemically synthesized
tcttcccttattgcttttctct

SEQ ID NO: 751144 - DNA, 22 bp, Artificial Sequence
  chemically synthesized
agaagagaaaagcaataaggga

SEQ ID NO: 751145 - DNA, 22 bp, Artificial Sequence
  chemically synthesized
atgcaactatcttcccttattg

SEQ ID NO: 751146 - DNA, 22 bp, Artificial Sequence
  chemically synthesized
caaccatgttcatgcaactatc

SEQ ID NO: 751147 - DNA, 22 bp, Artificial Sequence
  chemically synthesized
gcaaccatgttcatgcaactat

SEQ ID NO: 751148 - DNA, 22 bp, Artificial Sequence
  chemically synthesized
gcaagcaagatacttgcaacca

SEQ ID NO: 751149 - DNA, 22 bp, Artificial Sequence
  chemically synthesized
ggcaagcaagatacttgcaacc

SEQ ID NO: 751150 - DNA, 22 bp, Artificial Sequence
  chemically synthesized
tggcaagcaagatacttgcaac

SEQ ID NO: 751151 - DNA, 22 bp, Artificial Sequence
  chemically synthesized
catgaacatggttgcaagtatc

SEQ ID NO: 751152 - DNA, 22 bp, Artificial Sequence
  chemically synthesized
actttggcaagcaagatacttg

SEQ ID NO: 751153 - DNA, 22 bp, Artificial Sequence
  chemically synthesized
cactttggcaagcaagatactt

SEQ ID NO: 751154 - DNA, 22 bp, Artificial Sequence
  chemically synthesized
atcttcactttggcaagcaaga

SEQ ID NO: 751155 - DNA, 22 bp, Artificial Sequence
  chemically synthesized
catcttcactttggcaagcaag

SEQ ID NO: 751156 - DNA, 22 bp, Artificial Sequence
  chemically synthesized
caagtatcttgcttgccaaagt

SEQ ID NO: 751157 - DNA, 22 bp, Artificial Sequence
  chemically synthesized
gaatttcatcttcactttggca

SEQ ID NO: 751158 - DNA, 22 bp, Artificial Sequence
  chemically synthesized
gcttgccaaagtgaagatgaaa

SEQ ID NO: 751159 - DNA, 22 bp, Artificial Sequence
  chemically synthesized
cttgccaaagtgaagatgaaat

SEQ ID NO: 751160 - DNA, 22 bp, Artificial Sequence
  chemically synthesized
gccaaagtgaagatgaaattct

SEQ ID NO: 751161 - DNA, 22 bp, Artificial Sequence
  chemically synthesized
ccaaagtgaagatgaaattcta

SEQ ID NO: 751162 - DNA, 22 bp, Artificial Sequence
  chemically synthesized
aatagataatgtgaaatgtgat

SEQ ID NO: 751163 - DNA, 22 bp, Artificial Sequence
  chemically synthesized
taatacattatatcacatttca

SEQ ID NO: 751164 - DNA, 22 bp, Artificial Sequence
  chemically synthesized
tgaatagataatgtgaaatgtg

SEQ ID NO: 751165 - DNA, 22 bp, Artificial Sequence
  chemically synthesized
atacattatatcacatttcaca

SEQ ID NO: 751166 - DNA, 22 bp, Artificial Sequence
  chemically synthesized
ctctgaatagataatgtgaaat

SEQ ID NO: 751167 - DNA, 22 bp, Artificial Sequence
  chemically synthesized
cctctgaatagataatgtgaaa

SEQ ID NO: 751168 - DNA, 22 bp, Artificial Sequence
  chemically synthesized
tatcacatttcacattatctat

SEQ ID NO: 751169 - DNA, 22 bp, Artificial Sequence
  chemically synthesized
cacattatctattcagaggaaa

SEQ ID NO: 751170 - DNA, 22 bp, Artificial Sequence
  chemically synthesized
acattatctattcagaggaaat

SEQ ID NO: 751171 - DNA, 22 bp, Artificial Sequence
  chemically synthesized
aggaagccaagcatatttcctc

SEQ ID NO: 751172 - DNA, 22 bp, Artificial Sequence
  chemically synthesized
tctattcagaggaaatatgctt

SEQ ID NO: 751173 - DNA, 22 bp, Artificial Sequence
  chemically synthesized
acattgaggaagccaagcatat

SEQ ID NO: 751174 - DNA, 22 bp, Artificial Sequence
  chemically synthesized
gacattgaggaagccaagcata

SEQ ID NO: 751175 - DNA, 22 bp, Artificial Sequence
  chemically synthesized
ttcagaggaaatatgcttggct

SEQ ID NO: 751176 - DNA, 22 bp, Artificial Sequence
  chemically synthesized
agaggaaatatgcttggcttcc

SEQ ID NO: 751177 - DNA, 22 bp, Artificial Sequence
  chemically synthesized
gaatttgacattgaggaagcca

SEQ ID NO: 751178 - DNA, 22 bp, Artificial Sequence
  chemically synthesized
tgttagaatttgacattgagga

SEQ ID NO: 751179 - DNA, 22 bp, Artificial Sequence
  chemically synthesized
ggcttcctcaatgtcaaattct

SEQ ID NO: 751180 - DNA, 22 bp, Artificial Sequence
  chemically synthesized
gcttcctcaatgtcaaattcta

SEQ ID NO: 751181 - DNA, 22 bp, Artificial Sequence
  chemically synthesized
cctcaatgtcaaattctaacat

SEQ ID NO: 751182 - DNA, 22 bp, Artificial Sequence
  chemically synthesized
ctcaatgtcaaattctaacata

SEQ ID NO: 751183 - DNA, 22 bp, Artificial Sequence
  chemically synthesized
tcaaagaaacgctatgttagaa

SEQ ID NO: 751184 - DNA, 22 bp, Artificial Sequence
  chemically synthesized
gtcaaagaaacgctatgttaga

SEQ ID NO: 751185 - DNA, 22 bp, Artificial Sequence
  chemically synthesized
aatgtcaaattctaacatagcg

SEQ ID NO: 751186 - DNA, 22 bp, Artificial Sequence
  chemically synthesized
agaaatttgtcaaagaaacgct

SEQ ID NO: 751187 - DNA, 22 bp, Artificial Sequence
  chemically synthesized
gagaaatttgtcaaagaaacgc

SEQ ID NO: 751188 - DNA, 22 bp, Artificial Sequence
  chemically synthesized
tgagaaatttgtcaaagaaacg

SEQ ID NO: 751189 - DNA, 22 bp, Artificial Sequence
  chemically synthesized
ttgagaaatttgtcaaagaaac

SEQ ID NO: 751190 - DNA, 22 bp, Artificial Sequence
  chemically synthesized
tttgagaaatttgtcaaagaaa

SEQ ID NO: 751191 - DNA, 22 bp, Artificial Sequence
  chemically synthesized
ttttgagaaatttgtcaaagaa

SEQ ID NO: 751192 - DNA, 22 bp, Artificial Sequence
  chemically synthesized
taacatagcgtttctttgacaa

SEQ ID NO: 751193 - DNA, 22 bp, Artificial Sequence
  chemically synthesized
acatagcgtttctttgacaaat

SEQ ID NO: 751194 - DNA, 22 bp, Artificial Sequence
  chemically synthesized
ggtttttttgagaaatttgtca

SEQ ID NO: 751195 - DNA, 22 bp, Artificial Sequence
  chemically synthesized
gggtttttttgagaaatttgtc

SEQ ID NO: 751196 - DNA, 22 bp, Artificial Sequence
  chemically synthesized
tgggtttttttgagaaatttgt

SEQ ID NO: 751197 - DNA, 22 bp, Artificial Sequence
  chemically synthesized
tggctttgggtttttttgagaa

SEQ ID NO: 751198 - DNA, 22 bp, Artificial Sequence
  chemically synthesized
ctttgacaaatttctcaaaaaa

SEQ ID NO: 751199 - DNA, 22 bp, Artificial Sequence
  chemically synthesized
tttgacaaatttctcaaaaaaa

SEQ ID NO: 751200 - DNA, 22 bp, Artificial Sequence
  chemically synthesized
tgacaaatttctcaaaaaaacc

SEQ ID NO: 751201 - DNA, 22 bp, Artificial Sequence
  chemically synthesized
gacaaatttctcaaaaaaaccc

SEQ ID NO: 751202 - DNA, 22 bp, Artificial Sequence
  chemically synthesized
acaaatttctcaaaaaaaccca

SEQ ID NO: 751203 - DNA, 22 bp, Artificial Sequence
  chemically synthesized
agtccctgtggctttgggtttt

SEQ ID NO: 751204 - DNA, 22 bp, Artificial Sequence
  chemically synthesized
ctcaaaaaaacccaaagccaca

SEQ ID NO: 751205 - DNA, 22 bp, Artificial Sequence
  chemically synthesized
tcaaaaaaacccaaagccacag

SEQ ID NO: 751206 - DNA, 22 bp, Artificial Sequence
  chemically synthesized
ccatcctcagtccctgtggctt

SEQ ID NO: 751207 - DNA, 22 bp, Artificial Sequence
  chemically synthesized
aaaaaaacccaaagccacaggg

SEQ ID NO: 751208 - DNA, 22 bp, Artificial Sequence
  chemically synthesized
accatcctcagtccctgtggct

SEQ ID NO: 751209 - DNA, 22 bp, Artificial Sequence
  chemically synthesized
ggcttaccatcctcagtccctg

SEQ ID NO: 751210 - DNA, 22 bp, Artificial Sequence
  chemically synthesized
aggcttaccatcctcagtccct

SEQ ID NO: 751211 - DNA, 22 bp, Artificial Sequence
  chemically synthesized
taggcttaccatcctcagtccc

SEQ ID NO: 751212 - DNA, 22 bp, Artificial Sequence
  chemically synthesized
ttaggcttaccatcctcagtcc

SEQ ID NO: 751213 - DNA, 22 bp, Artificial Sequence
  chemically synthesized
tttaggcttaccatcctcagtc

SEQ ID NO: 751214 - DNA, 22 bp, Artificial Sequence
  chemically synthesized
gcaaatccacctttttaggctt

SEQ ID NO: 751215 - DNA, 22 bp, Artificial Sequence
  chemically synthesized
aggatggtaagcctaaaaaggt

SEQ ID NO: 751216 - DNA, 22 bp, Artificial Sequence
  chemically synthesized
agaagaaaactggcaaatccac

SEQ ID NO: 751217 - DNA, 22 bp, Artificial Sequence
  chemically synthesized
aagaagaaaactggcaaatcca

SEQ ID NO: 751218 - DNA, 22 bp, Artificial Sequence
  chemically synthesized
taagaagaaaactggcaaatcc

SEQ ID NO: 751219 - DNA, 22 bp, Artificial Sequence
  chemically synthesized
aaaaggtggatttgccagtttt

SEQ ID NO: 751220 - DNA, 22 bp, Artificial Sequence
  chemically synthesized
aagttttaagaagaaaactggc

SEQ ID NO: 751221 - DNA, 22 bp, Artificial Sequence
  chemically synthesized
acatctaaagttttaagaagaa

SEQ ID NO: 751222 - DNA, 22 bp, Artificial Sequence
  chemically synthesized
gccagttttcttcttaaaactt

SEQ ID NO: 751223 - DNA, 22 bp, Artificial Sequence
  chemically synthesized
ccagttttcttcttaaaacttt

SEQ ID NO: 751224 - DNA, 22 bp, Artificial Sequence
  chemically synthesized
agcattcacatctaaagtttta

SEQ ID NO: 751225 - DNA, 22 bp, Artificial Sequence
  chemically synthesized
cagcattcacatctaaagtttt

SEQ ID NO: 751226 - DNA, 22 bp, Artificial Sequence
  chemically synthesized
tcttcagcattcacatctaaag

SEQ ID NO: 751227 - DNA, 22 bp, Artificial Sequence
  chemically synthesized
tcttcttaaaactttagatgtg

SEQ ID NO: 751228 - DNA, 22 bp, Artificial Sequence
  chemically synthesized
atcttcagcattcacatctaaa

SEQ ID NO: 751229 - DNA, 22 bp, Artificial Sequence
  chemically synthesized
cttcttaaaactttagatgtga

SEQ ID NO: 751230 - DNA, 22 bp, Artificial Sequence
  chemically synthesized
ttcttaaaactttagatgtgaa

SEQ ID NO: 751231 - DNA, 22 bp, Artificial Sequence
  chemically synthesized
tttatcttcagcattcacatct

SEQ ID NO: 751232 - DNA, 22 bp, Artificial Sequence
  chemically synthesized
cttaaaactttagatgtgaatg

SEQ ID NO: 751233 - DNA, 22 bp, Artificial Sequence
  chemically synthesized
atttatcttcagcattcacatc

SEQ ID NO: 751234 - DNA, 22 bp, Artificial Sequence
  chemically synthesized
ttaaaactttagatgtgaatgc

SEQ ID NO: 751235 - DNA, 22 bp, Artificial Sequence
  chemically synthesized
aaaactttagatgtgaatgctg

SEQ ID NO: 751236 - DNA, 22 bp, Artificial Sequence
  chemically synthesized
aaactttagatgtgaatgctga

SEQ ID NO: 751237 - DNA, 22 bp, Artificial Sequence
  chemically synthesized
tagatgtgaatgctgaagataa

SEQ ID NO: 751238 - DNA, 22 bp, Artificial Sequence
  chemically synthesized
agatgtgaatgctgaagataaa

SEQ ID NO: 751239 - DNA, 22 bp, Artificial Sequence
  chemically synthesized
gatgtgaatgctgaagataaat

SEQ ID NO: 751240 - DNA, 22 bp, Artificial Sequence
  chemically synthesized
tgatgaagtgacgatgccatcc

SEQ ID NO: 751241 - DNA, 22 bp, Artificial Sequence
  chemically synthesized
aagataaataaggatggcatcg

SEQ ID NO: 751242 - DNA, 22 bp, Artificial Sequence
  chemically synthesized
gaaattatgatgaagtgacgat

SEQ ID NO: 751243 - DNA, 22 bp, Artificial Sequence
  chemically synthesized
atgatgtgtgtagtaggctaga

SEQ ID NO: 751244 - DNA, 22 bp, Artificial Sequence
  chemically synthesized
aatgatgtgtgtagtaggctag

SEQ ID NO: 751245 - DNA, 22 bp, Artificial Sequence
  chemically synthesized
catcataatttctagcctacta

SEQ ID NO: 751246 - DNA, 22 bp, Artificial Sequence
  chemically synthesized
atcataatttctagcctactac

SEQ ID NO: 751247 - DNA, 22 bp, Artificial Sequence
  chemically synthesized
atttaatgatgtgtgtagtagg

SEQ ID NO: 751248 - DNA, 22 bp, Artificial Sequence
  chemically synthesized
agattgatttaatgatgtgtgt

SEQ ID NO: 751249 - DNA, 22 bp, Artificial Sequence
  chemically synthesized
ctagcctactacacacatcatt

SEQ ID NO: 751250 - DNA, 22 bp, Artificial Sequence
  chemically synthesized
tagcctactacacacatcatta

SEQ ID NO: 751251 - DNA, 22 bp, Artificial Sequence
  chemically synthesized
gcctactacacacatcattaaa

SEQ ID NO: 751252 - DNA, 22 bp, Artificial Sequence
  chemically synthesized
aaattgagattgatttaatgat

SEQ ID NO: 751253 - DNA, 22 bp, Artificial Sequence
  chemically synthesized
ctacacacatcattaaatcaat

SEQ ID NO: 751254 - DNA, 22 bp, Artificial Sequence
  chemically synthesized
gcattcaaattgagattgattt

SEQ ID NO: 751255 - DNA, 22 bp, Artificial Sequence
  chemically synthesized
cacacatcattaaatcaatctc

SEQ ID NO: 751256 - DNA, 22 bp, Artificial Sequence
  chemically synthesized
ggcattcaaattgagattgatt

SEQ ID NO: 751257 - DNA, 22 bp, Artificial Sequence
  chemically synthesized
tggcattcaaattgagattgat

SEQ ID NO: 751258 - DNA, 22 bp, Artificial Sequence
  chemically synthesized
ttggcattcaaattgagattga

SEQ ID NO: 751259 - DNA, 22 bp, Artificial Sequence
  chemically synthesized
tttggcattcaaattgagattg

SEQ ID NO: 751260 - DNA, 22 bp, Artificial Sequence
  chemically synthesized
ttttggcattcaaattgagatt

SEQ ID NO: 751261 - DNA, 22 bp, Artificial Sequence
  chemically synthesized
aaccttttttggcattcaaatt

SEQ ID NO: 751262 - DNA, 22 bp, Artificial Sequence
  chemically synthesized
aatcaatctcaatttgaatgcc

SEQ ID NO: 751263 - DNA, 22 bp, Artificial Sequence
  chemically synthesized
attaaaccttttttggcattca

SEQ ID NO: 751264 - DNA, 22 bp, Artificial Sequence
  chemically synthesized
gattaaaccttttttggcattc

SEQ ID NO: 751265 - DNA, 22 bp, Artificial Sequence
  chemically synthesized
tgattaaaccttttttggcatt

SEQ ID NO: 751266 - DNA, 22 bp, Artificial Sequence
  chemically synthesized
aatttgaatgccaaaaaaggtt

SEQ ID NO: 751267 - DNA, 22 bp, Artificial Sequence
  chemically synthesized
gaatgccaaaaaaggtttaatc

SEQ ID NO: 751268 - DNA, 22 bp, Artificial Sequence
  chemically synthesized
aatgccaaaaaaggtttaatca

SEQ ID NO: 751269 - DNA, 22 bp, Artificial Sequence
  chemically synthesized
caatgaaatgttttgattaaac

SEQ ID NO: 751270 - DNA, 22 bp, Artificial Sequence
  chemically synthesized
ctacaatgaaatgttttgatta

SEQ ID NO: 751271 - DNA, 22 bp, Artificial Sequence
  chemically synthesized
aagttcctacaatgaaatgttt

SEQ ID NO: 751272 - DNA, 22 bp, Artificial Sequence
  chemically synthesized
aaagttcctacaatgaaatgtt

SEQ ID NO: 751273 - DNA, 22 bp, Artificial Sequence
  chemically synthesized
taaagttcctacaatgaaatgt

SEQ ID NO: 751274 - DNA, 22 bp, Artificial Sequence
  chemically synthesized
tttaaagttcctacaatgaaat

SEQ ID NO: 751275 - DNA, 22 bp, Artificial Sequence
  chemically synthesized
ctttaaagttcctacaatgaaa

SEQ ID NO: 751276 - DNA, 22 bp, Artificial Sequence
  chemically synthesized
tctttaaagttcctacaatgaa

SEQ ID NO: 751277 - DNA, 22 bp, Artificial Sequence
  chemically synthesized
aatcaaaacatttcattgtagg

SEQ ID NO: 751278 - DNA, 22 bp, Artificial Sequence
  chemically synthesized
ttctttaaagttcctacaatga

SEQ ID NO: 751279 - DNA, 22 bp, Artificial Sequence
  chemically synthesized
atcaaaacatttcattgtagga

SEQ ID NO: 751280 - DNA, 22 bp, Artificial Sequence
  chemically synthesized
tttctttaaagttcctacaatg

SEQ ID NO: 751281 - DNA, 22 bp, Artificial Sequence
  chemically synthesized
tgagttttttctttaaagttcc

SEQ ID NO: 751282 - DNA, 22 bp, Artificial Sequence
  chemically synthesized
tatgagttttttctttaaagtt

SEQ ID NO: 751283 - DNA, 22 bp, Artificial Sequence
  chemically synthesized
cattgtaggaactttaaagaaa

SEQ ID NO: 751284 - DNA, 22 bp, Artificial Sequence
  chemically synthesized
attgtaggaactttaaagaaaa

SEQ ID NO: 751285 - DNA, 22 bp, Artificial Sequence
  chemically synthesized
taggaactttaaagaaaaaact

SEQ ID NO: 751286 - DNA, 22 bp, Artificial Sequence
  chemically synthesized
taaagaaaaaactcatagaatc

SEQ ID NO: 751287 - DNA, 22 bp, Artificial Sequence
  chemically synthesized
aaagaaaaaactcatagaatcc

SEQ ID NO: 751288 - DNA, 22 bp, Artificial Sequence
  chemically synthesized
aagaaaaaactcatagaatccc

SEQ ID NO: 751289 - DNA, 22 bp, Artificial Sequence
  chemically synthesized
tgaaaagtcagggcagggattc

SEQ ID NO: 751290 - DNA, 22 bp, Artificial Sequence
  chemically synthesized
ctgtgaaaagtcagggcaggga

SEQ ID NO: 751291 - DNA, 22 bp, Artificial Sequence
  chemically synthesized
actgtgaaaagtcagggcaggg

SEQ ID NO: 751292 - DNA, 22 bp, Artificial Sequence
  chemically synthesized
ttactgtgaaaagtcagggcag

SEQ ID NO: 751293 - DNA, 22 bp, Artificial Sequence
  chemically synthesized
cttactgtgaaaagtcagggca

SEQ ID NO: 751294 - DNA, 22 bp, Artificial Sequence
  chemically synthesized
atagaatccctgccctgacttt

SEQ ID NO: 751295 - DNA, 22 bp, Artificial Sequence
  chemically synthesized
catttcttactgtgaaaagtca

SEQ ID NO: 751296 - DNA, 22 bp, Artificial Sequence
  chemically synthesized
gcatttcttactgtgaaaagtc

SEQ ID NO: 751297 - DNA, 22 bp, Artificial Sequence
  chemically synthesized
acttgcatttcttactgtgaaa

SEQ ID NO: 751298 - DNA, 22 bp, Artificial Sequence
  chemically synthesized
aacttgcatttcttactgtgaa

SEQ ID NO: 751299 - DNA, 22 bp, Artificial Sequence
  chemically synthesized
taacttgcatttcttactgtga

SEQ ID NO: 751300 - DNA, 22 bp, Artificial Sequence
  chemically synthesized
ttaacttgcatttcttactgtg

SEQ ID NO: 751301 - DNA, 22 bp, Artificial Sequence
  chemically synthesized
ccctgacttttcacagtaagaa

SEQ ID NO: 751302 - DNA, 22 bp, Artificial Sequence
  chemically synthesized
acttttcacagtaagaaatgca

SEQ ID NO: 751303 - DNA, 22 bp, Artificial Sequence
  chemically synthesized
tcaaacttttaacttgcatttc

SEQ ID NO: 751304 - DNA, 22 bp, Artificial Sequence
  chemically synthesized
gtcaaacttttaacttgcattt

SEQ ID NO: 751305 - DNA, 22 bp, Artificial Sequence
  chemically synthesized
ttcacagtaagaaatgcaagtt

SEQ ID NO: 751306 - DNA, 22 bp, Artificial Sequence
  chemically synthesized
tgtcaaacttttaacttgcatt

SEQ ID NO: 751307 - DNA, 22 bp, Artificial Sequence
  chemically synthesized
tcacagtaagaaatgcaagtta

SEQ ID NO: 751308 - DNA, 22 bp, Artificial Sequence
  chemically synthesized
ttgtcaaacttttaacttgcat

SEQ ID NO: 751309 - DNA, 22 bp, Artificial Sequence
  chemically synthesized
cacagtaagaaatgcaagttaa

SEQ ID NO: 751310 - DNA, 22 bp, Artificial Sequence
  chemically synthesized
acagtaagaaatgcaagttaaa

SEQ ID NO: 751311 - DNA, 22 bp, Artificial Sequence
  chemically synthesized
tgcatatcgcatttttgtcaaa

SEQ ID NO: 751312 - DNA, 22 bp, Artificial Sequence
  chemically synthesized
aaagtttgacaaaaatgcgata

SEQ ID NO: 751313 - DNA, 22 bp, Artificial Sequence
  chemically synthesized
tgtagttatgcatatcgcattt

SEQ ID NO: 751314 - DNA, 22 bp, Artificial Sequence
  chemically synthesized
gacaaaaatgcgatatgcataa

SEQ ID NO: 751315 - DNA, 22 bp, Artificial Sequence
  chemically synthesized
acaaaaatgcgatatgcataac

SEQ ID NO: 751316 - DNA, 22 bp, Artificial Sequence
  chemically synthesized
tcgcatctatgtagttatgcat

SEQ ID NO: 751317 - DNA, 22 bp, Artificial Sequence
  chemically synthesized
gaatatgcaaatctgtcgcatc

SEQ ID NO: 751318 - DNA, 22 bp, Artificial Sequence
  chemically synthesized
ggaatatgcaaatctgtcgcat

SEQ ID NO: 751319 - DNA, 22 bp, Artificial Sequence
  chemically synthesized
catagatgcgacagatttgcat

SEQ ID NO: 751320 - DNA, 22 bp, Artificial Sequence
  chemically synthesized
ccatcttggaatatgcaaatct

SEQ ID NO: 751321 - DNA, 22 bp, Artificial Sequence
  chemically synthesized
ccaggctgccatcttggaatat

SEQ ID NO: 751322 - DNA, 22 bp, Artificial Sequence
  chemically synthesized
tcccaggctgccatcttggaat

SEQ ID NO: 751323 - DNA, 22 bp, Artificial Sequence
  chemically synthesized
gcatattccaagatggcagcct

SEQ ID NO: 751324 - DNA, 22 bp, Artificial Sequence
  chemically synthesized
catattccaagatggcagcctg

SEQ ID NO: 751325 - DNA, 22 bp, Artificial Sequence
  chemically synthesized
taaataactctcccaggctgcc

SEQ ID NO: 751326 - DNA, 22 bp, Artificial Sequence
  chemically synthesized
caagatggcagcctgggagagt

SEQ ID NO: 751327 - DNA, 22 bp, Artificial Sequence
  chemically synthesized
atacactgtaaataactctccc

SEQ ID NO: 751328 - DNA, 22 bp, Artificial Sequence
  chemically synthesized
catacactgtaaataactctcc

SEQ ID NO: 751329 - DNA, 22 bp, Artificial Sequence
  chemically synthesized
tcatacactgtaaataactctc

SEQ ID NO: 751330 - DNA, 22 bp, Artificial Sequence
  chemically synthesized
ttcatacactgtaaataactct

SEQ ID NO: 751331 - DNA, 22 bp, Artificial Sequence
  chemically synthesized
ggagagttatttacagtgtatg

SEQ ID NO: 751332 - DNA, 22 bp, Artificial Sequence
  chemically synthesized
aacacagtttttcatacactgt

SEQ ID NO: 751333 - DNA, 22 bp, Artificial Sequence
  chemically synthesized
tgaacacagtttttcatacact

SEQ ID NO: 751334 - DNA, 22 bp, Artificial Sequence
  chemically synthesized
actctgaacacagtttttcata

SEQ ID NO: 751335 - DNA, 22 bp, Artificial Sequence
  chemically synthesized
tttacagtgtatgaaaaactgt

SEQ ID NO: 751336 - DNA, 22 bp, Artificial Sequence
  chemically synthesized
ttgactctgaacacagtttttc

SEQ ID NO: 751337 - DNA, 22 bp, Artificial Sequence
  chemically synthesized
acagtgtatgaaaaactgtgtt

SEQ ID NO: 751338 - DNA, 22 bp, Artificial Sequence
  chemically synthesized
cagtgtatgaaaaactgtgttc

SEQ ID NO: 751339 - DNA, 22 bp, Artificial Sequence
  chemically synthesized
cctgttgactctgaacacagtt

SEQ ID NO: 751340 - DNA, 22 bp, Artificial Sequence
  chemically synthesized
acctgttgactctgaacacagt

SEQ ID NO: 751341 - DNA, 22 bp, Artificial Sequence
  chemically synthesized
gtttacctgttgactctgaaca

SEQ ID NO: 751342 - DNA, 22 bp, Artificial Sequence
  chemically synthesized
agtttacctgttgactctgaac

SEQ ID NO: 751343 - DNA, 22 bp, Artificial Sequence
  chemically synthesized
ttagtttacctgttgactctga

SEQ ID NO: 751344 - DNA, 22 bp, Artificial Sequence
  chemically synthesized
ttcttagtttacctgttgactc

SEQ ID NO: 751345 - DNA, 22 bp, Artificial Sequence
  chemically synthesized
actgttcttagtttacctgttg

SEQ ID NO: 751346 - DNA, 22 bp, Artificial Sequence
  chemically synthesized
cactgttcttagtttacctgtt

SEQ ID NO: 751347 - DNA, 22 bp, Artificial Sequence
  chemically synthesized
tgttcagagtcaacaggtaaac

SEQ ID NO: 751348 - DNA, 22 bp, Artificial Sequence
  chemically synthesized
agagtcaacaggtaaactaaga

SEQ ID NO: 751349 - DNA, 22 bp, Artificial Sequence
  chemically synthesized
agccaggaatatttcactgttc

SEQ ID NO: 751350 - DNA, 22 bp, Artificial Sequence
  chemically synthesized
gagccaggaatatttcactgtt

SEQ ID NO: 751351 - DNA, 22 bp, Artificial Sequence
  chemically synthesized
ttgagccaggaatatttcactg

SEQ ID NO: 751352 - DNA, 22 bp, Artificial Sequence
  chemically synthesized
cttgagccaggaatatttcact

SEQ ID NO: 751353 - DNA, 22 bp, Artificial Sequence
  chemically synthesized
agaacagtgaaatattcctggc

SEQ ID NO: 751354 - DNA, 22 bp, Artificial Sequence
  chemically synthesized
taccaaaagtggtatgtccttc

SEQ ID NO: 751355 - DNA, 22 bp, Artificial Sequence
  chemically synthesized
tgtaccaaaagtggtatgtcct

SEQ ID NO: 751356 - DNA, 22 bp, Artificial Sequence
  chemically synthesized
ctggctcaagaaggacatacca

SEQ ID NO: 751357 - DNA, 22 bp, Artificial Sequence
  chemically synthesized
tctgtaccaaaagtggtatgtc

SEQ ID NO: 751358 - DNA, 22 bp, Artificial Sequence
  chemically synthesized
ctctgtaccaaaagtggtatgt

SEQ ID NO: 751359 - DNA, 22 bp, Artificial Sequence
  chemically synthesized
gctcaagaaggacataccactt

SEQ ID NO: 751360 - DNA, 22 bp, Artificial Sequence
  chemically synthesized
aagaaggacataccacttttgg

SEQ ID NO: 751361 - DNA, 22 bp, Artificial Sequence
  chemically synthesized
taaaccatagtttctctgtacc

SEQ ID NO: 751362 - DNA, 22 bp, Artificial Sequence
  chemically synthesized
ttggtacagagaaactatggtt

SEQ ID NO: 751363 - DNA, 22 bp, Artificial Sequence
  chemically synthesized
tggtacagagaaactatggttt

SEQ ID NO: 751364 - DNA, 22 bp, Artificial Sequence
  chemically synthesized
cgcccagactataaaccatagt

SEQ ID NO: 751365 - DNA, 22 bp, Artificial Sequence
  chemically synthesized
ggtacagagaaactatggttta

SEQ ID NO: 751366 - DNA, 22 bp, Artificial Sequence
  chemically synthesized
gtacagagaaactatggtttat

SEQ ID NO: 751367 - DNA, 22 bp, Artificial Sequence
  chemically synthesized
tggtttatagtctgggcgcagt

SEQ ID NO: 751368 - DNA, 22 bp, Artificial Sequence
  chemically synthesized
caggcgtgagccactgcgccca

SEQ ID NO: 751369 - DNA, 22 bp, Artificial Sequence
  chemically synthesized
atagtctgggcgcagtggctca

SEQ ID NO: 751370 - DNA, 22 bp, Artificial Sequence
  chemically synthesized
ggattacaggcgtgagccactg

SEQ ID NO: 751371 - DNA, 22 bp, Artificial Sequence
  chemically synthesized
tagtctgggcgcagtggctcac

SEQ ID NO: 751372 - DNA, 22 bp, Artificial Sequence
  chemically synthesized
ggcgcagtggctcacgcctgta

SEQ ID NO: 751373 - DNA, 22 bp, Artificial Sequence
  chemically synthesized
ccaaagtgctgggattacaggc

SEQ ID NO: 751374 - DNA, 22 bp, Artificial Sequence
  chemically synthesized
gcctcccaaagtgctgggatta

SEQ ID NO: 751375 - DNA, 22 bp, Artificial Sequence
  chemically synthesized
ggcctcccaaagtgctgggatt

SEQ ID NO: 751376 - DNA, 22 bp, Artificial Sequence
  chemically synthesized
acgcctgtaatcccagcacttt

SEQ ID NO: 751377 - DNA, 22 bp, Artificial Sequence
  chemically synthesized
accttggcctcccaaagtgctg

SEQ ID NO: 751378 - DNA, 22 bp, Artificial Sequence
  chemically synthesized
taatcccagcactttgggaggc

SEQ ID NO: 751379 - DNA, 22 bp, Artificial Sequence
  chemically synthesized
aggtgatccgttcaccttggcc

SEQ ID NO: 751380 - DNA, 22 bp, Artificial Sequence
  chemically synthesized
acctcaggtgatccgttcacct

SEQ ID NO: 751381 - DNA, 22 bp, Artificial Sequence
  chemically synthesized
tgggaggccaaggtgaacggat

SEQ ID NO: 751382 - DNA, 22 bp, Artificial Sequence
  chemically synthesized
tgacctcaggtgatccgttcac

SEQ ID NO: 751383 - DNA, 22 bp, Artificial Sequence
  chemically synthesized
gggaggccaaggtgaacggatc

SEQ ID NO: 751384 - DNA, 22 bp, Artificial Sequence
  chemically synthesized
ctgacctcaggtgatccgttca

SEQ ID NO: 751385 - DNA, 22 bp, Artificial Sequence
  chemically synthesized
ggaggccaaggtgaacggatca

SEQ ID NO: 751386 - DNA, 22 bp, Artificial Sequence
  chemically synthesized
gaacttctgacctcaggtgatc

SEQ ID NO: 751387 - DNA, 22 bp, Artificial Sequence
  chemically synthesized
gtctcgaacttctgacctcagg

SEQ ID NO: 751388 - DNA, 22 bp, Artificial Sequence
  chemically synthesized
gccaggctggtctcgaacttct

SEQ ID NO: 751389 - DNA, 22 bp, Artificial Sequence
  chemically synthesized
aggtcagaagttcgagaccagc

SEQ ID NO: 751390 - DNA, 22 bp, Artificial Sequence
  chemically synthesized
accacgttggccaggctggtct

SEQ ID NO: 751391 - DNA, 22 bp, Artificial Sequence
  chemically synthesized
caccacgttggccaggctggtc

SEQ ID NO: 751392 - DNA, 22 bp, Artificial Sequence
  chemically synthesized
gagaccagcctggccaacgtgg

SEQ ID NO: 751393 - DNA, 22 bp, Artificial Sequence
  chemically synthesized
gtagagatggggtttcaccacg

SEQ ID NO: 751394 - DNA, 22 bp, Artificial Sequence
  chemically synthesized
agtagagatggggtttcaccac

SEQ ID NO: 751395 - DNA, 22 bp, Artificial Sequence
  chemically synthesized
tagtagagatggggtttcacca

SEQ ID NO: 751396 - DNA, 22 bp, Artificial Sequence
  chemically synthesized
ttagtagagatggggtttcacc

SEQ ID NO: 751397 - DNA, 22 bp, Artificial Sequence
  chemically synthesized
tttagtagagatggggtttcac

SEQ ID NO: 751398 - DNA, 22 bp, Artificial Sequence
  chemically synthesized
gccaacgtggtgaaaccccatc

SEQ ID NO: 751399 - DNA, 22 bp, Artificial Sequence
  chemically synthesized
gattttttagtagagatggggt

SEQ ID NO: 751400 - DNA, 22 bp, Artificial Sequence
  chemically synthesized
ggattttttagtagagatgggg

SEQ ID NO: 751401 - DNA, 22 bp, Artificial Sequence
  chemically synthesized
tggattttttagtagagatggg

SEQ ID NO: 751402 - DNA, 22 bp, Artificial Sequence
  chemically synthesized
ttggattttttagtagagatgg

SEQ ID NO: 751403 - DNA, 22 bp, Artificial Sequence
  chemically synthesized
tttggattttttagtagagatg

SEQ ID NO: 751404 - DNA, 22 bp, Artificial Sequence
  chemically synthesized
ttttggattttttagtagagat

SEQ ID NO: 751405 - DNA, 22 bp, Artificial Sequence
  chemically synthesized
tttttggattttttagtagaga

SEQ ID NO: 751406 - DNA, 22 bp, Artificial Sequence
  chemically synthesized
ttttttggattttttagtagag

SEQ ID NO: 751407 - DNA, 22 bp, Artificial Sequence
  chemically synthesized
tttttttggattttttagtaga

SEQ ID NO: 751408 - DNA, 22 bp, Artificial Sequence
  chemically synthesized
ttttttttggattttttagtag

SEQ ID NO: 751409 - DNA, 22 bp, Artificial Sequence
  chemically synthesized
tttttttttggattttttagta

SEQ ID NO: 751410 - DNA, 22 bp, Artificial Sequence
  chemically synthesized
ttttttttttggattttttagt

SEQ ID NO: 751411 - DNA, 22 bp, Artificial Sequence
  chemically synthesized
tttttttttttggattttttag

SEQ ID NO: 751412 - DNA, 22 bp, Artificial Sequence
  chemically synthesized
ttttttttttttggatttttta

SEQ ID NO: 751413 - DNA, 22 bp, Artificial Sequence
  chemically synthesized
tttttttttttttggatttttt

SEQ ID NO: 751414 - DNA, 22 bp, Artificial Sequence
  chemically synthesized
attttttttttttttttggatt

SEQ ID NO: 751415 - DNA, 22 bp, Artificial Sequence
  chemically synthesized
tactaaaaaatccaaaaaaaaa

SEQ ID NO: 751416 - DNA, 22 bp, Artificial Sequence
  chemically synthesized
gctaattttttttttttttttg

SEQ ID NO: 751417 - DNA, 22 bp, Artificial Sequence
  chemically synthesized
ctaaaaaatccaaaaaaaaaaa

SEQ ID NO: 751418 - DNA, 22 bp, Artificial Sequence
  chemically synthesized
aaaaatccaaaaaaaaaaaaaa

SEQ ID NO: 751419 - DNA, 22 bp, Artificial Sequence
  chemically synthesized
cagacatgtgccaccacgcctg

SEQ ID NO: 751420 - DNA, 22 bp, Artificial Sequence
  chemically synthesized
ggattacagacatgtgccacca

SEQ ID NO: 751421 - DNA, 22 bp, Artificial Sequence
  chemically synthesized
gccaggcgtggtggcacatgtc

SEQ ID NO: 751422 - DNA, 22 bp, Artificial Sequence
  chemically synthesized
agtagctgggattacagacatg

SEQ ID NO: 751423 - DNA, 22 bp, Artificial Sequence
  chemically synthesized
ctgagtagctgggattacagac

SEQ ID NO: 751424 - DNA, 22 bp, Artificial Sequence
  chemically synthesized
agcctcctgagtagctgggatt

SEQ ID NO: 751425 - DNA, 22 bp, Artificial Sequence
  chemically synthesized
cctcagcctcctgagtagctgg

SEQ ID NO: 751426 - DNA, 22 bp, Artificial Sequence
  chemically synthesized
tgcctcagcctcctgagtagct

SEQ ID NO: 751427 - DNA, 22 bp, Artificial Sequence
  chemically synthesized
tctgcctcagcctcctgagtag

SEQ ID NO: 751428 - DNA, 22 bp, Artificial Sequence
  chemically synthesized
taatcccagctactcaggaggc

SEQ ID NO: 751429 - DNA, 22 bp, Artificial Sequence
  chemically synthesized
aagcaattctctgcctcagcct

SEQ ID NO: 751430 - DNA, 22 bp, Artificial Sequence
  chemically synthesized
ggttcaagcaattctctgcctc

SEQ ID NO: 751431 - DNA, 22 bp, Artificial Sequence
  chemically synthesized
ctcaggaggctgaggcagagaa

SEQ ID NO: 751432 - DNA, 22 bp, Artificial Sequence
  chemically synthesized
ctgggttcaagcaattctctgc

SEQ ID NO: 751433 - DNA, 22 bp, Artificial Sequence
  chemically synthesized
aggaggctgaggcagagaattg

SEQ ID NO: 751434 - DNA, 22 bp, Artificial Sequence
  chemically synthesized
cgcctcctgggttcaagcaatt

SEQ ID NO: 751435 - DNA, 22 bp, Artificial Sequence
  chemically synthesized
aggcagagaattgcttgaaccc

SEQ ID NO: 751436 - DNA, 22 bp, Artificial Sequence
  chemically synthesized
caacctccgcctcctgggttca

SEQ ID NO: 751437 - DNA, 22 bp, Artificial Sequence
  chemically synthesized
actgcaacctccgcctcctggg

SEQ ID NO: 751438 - DNA, 22 bp, Artificial Sequence
  chemically synthesized
ggctcactgcaacctccgcctc

SEQ ID NO: 751439 - DNA, 22 bp, Artificial Sequence
  chemically synthesized
cttgaacccaggaggcggaggt

SEQ ID NO: 751440 - DNA, 22 bp, Artificial Sequence
  chemically synthesized
gaacccaggaggcggaggttgc

SEQ ID NO: 751441 - DNA, 22 bp, Artificial Sequence
  chemically synthesized
tctcggctcactgcaacctccg

SEQ ID NO: 751442 - DNA, 22 bp, Artificial Sequence
  chemically synthesized
aacccaggaggcggaggttgca

SEQ ID NO: 751443 - DNA, 22 bp, Artificial Sequence
  chemically synthesized
gagtgcagtggtgctgtctcgg

SEQ ID NO: 751444 - DNA, 22 bp, Artificial Sequence
  chemically synthesized
cagtgagccgagacagcaccac

SEQ ID NO: 751445 - DNA, 22 bp, Artificial Sequence
  chemically synthesized
tcacccaggctggagtgcagtg

SEQ ID NO: 751446 - DNA, 22 bp, Artificial Sequence
  chemically synthesized
tgtcacccaggctggagtgcag

SEQ ID NO: 751447 - DNA, 22 bp, Artificial Sequence
  chemically synthesized
actctgtcacccaggctggagt

SEQ ID NO: 751448 - DNA, 22 bp, Artificial Sequence
  chemically synthesized
agacagtctcactctgtcaccc

SEQ ID NO: 751449 - DNA, 22 bp, Artificial Sequence
  chemically synthesized
cactccagcctgggtgacagag

SEQ ID NO: 751450 - DNA, 22 bp, Artificial Sequence
  chemically synthesized
gagacagtctcactctgtcacc

SEQ ID NO: 751451 - DNA, 22 bp, Artificial Sequence
  chemically synthesized
tgagacagtctcactctgtcac

SEQ ID NO: 751452 - DNA, 22 bp, Artificial Sequence
  chemically synthesized
ttgagacagtctcactctgtca

SEQ ID NO: 751453 - DNA, 22 bp, Artificial Sequence
  chemically synthesized
tttgagacagtctcactctgtc

SEQ ID NO: 751454 - DNA, 22 bp, Artificial Sequence
  chemically synthesized
ttttgagacagtctcactctgt

SEQ ID NO: 751455 - DNA, 22 bp, Artificial Sequence
  chemically synthesized
cagcctgggtgacagagtgaga

SEQ ID NO: 751456 - DNA, 22 bp, Artificial Sequence
  chemically synthesized
tttttgagacagtctcactctg

SEQ ID NO: 751457 - DNA, 22 bp, Artificial Sequence
  chemically synthesized
ttttttgagacagtctcactct

SEQ ID NO: 751458 - DNA, 22 bp, Artificial Sequence
  chemically synthesized
tttttttgagacagtctcactc

SEQ ID NO: 751459 - DNA, 22 bp, Artificial Sequence
  chemically synthesized
ttttttttgagacagtctcact

SEQ ID NO: 751460 - DNA, 22 bp, Artificial Sequence
  chemically synthesized
tttttttttgagacagtctcac

SEQ ID NO: 751461 - DNA, 22 bp, Artificial Sequence
  chemically synthesized
ttttttttttgagacagtctca

SEQ ID NO: 751462 - DNA, 22 bp, Artificial Sequence
  chemically synthesized
ggtgacagagtgagactgtctc

SEQ ID NO: 751463 - DNA, 22 bp, Artificial Sequence
  chemically synthesized
atttttttttttttgagacagt

SEQ ID NO: 751464 - DNA, 22 bp, Artificial Sequence
  chemically synthesized
aatttttttttttttgagacag

SEQ ID NO: 751465 - DNA, 22 bp, Artificial Sequence
  chemically synthesized
taatttttttttttttgagaca

SEQ ID NO: 751466 - DNA, 22 bp, Artificial Sequence
  chemically synthesized
ttaatttttttttttttgagac

SEQ ID NO: 751467 - DNA, 22 bp, Artificial Sequence
  chemically synthesized
tttaatttttttttttttgaga

SEQ ID NO: 751468 - DNA, 22 bp, Artificial Sequence
  chemically synthesized
ttttaatttttttttttttgag

SEQ ID NO: 751469 - DNA, 22 bp, Artificial Sequence
  chemically synthesized
tttttaatttttttttttttga

SEQ ID NO: 751470 - DNA, 22 bp, Artificial Sequence
  chemically synthesized
tttttttaattttttttttttt

SEQ ID NO: 751471 - DNA, 22 bp, Artificial Sequence
  chemically synthesized
tctttttttaattttttttttt

SEQ ID NO: 751472 - DNA, 22 bp, Artificial Sequence
  chemically synthesized
ctctttttttaatttttttttt

SEQ ID NO: 751473 - DNA, 22 bp, Artificial Sequence
  chemically synthesized
tctcaaaaaaaaaaaaattaaa

SEQ ID NO: 751474 - DNA, 22 bp, Artificial Sequence
  chemically synthesized
aaaaaaaaaaaaattaaaaaaa

SEQ ID NO: 751475 - DNA, 22 bp, Artificial Sequence
  chemically synthesized
ataaaccatggtttctcttttt

SEQ ID NO: 751476 - DNA, 22 bp, Artificial Sequence
  chemically synthesized
aataaaccatggtttctctttt

SEQ ID NO: 751477 - DNA, 22 bp, Artificial Sequence
  chemically synthesized
taataaaccatggtttctcttt

SEQ ID NO: 751478 - DNA, 22 bp, Artificial Sequence
  chemically synthesized
ttttaataaaccatggtttctc

SEQ ID NO: 751479 - DNA, 22 bp, Artificial Sequence
  chemically synthesized
gttttaataaaccatggtttct

SEQ ID NO: 751480 - DNA, 22 bp, Artificial Sequence
  chemically synthesized
tgttttaataaaccatggtttc

SEQ ID NO: 751481 - DNA, 22 bp, Artificial Sequence
  chemically synthesized
ttgttttaataaaccatggttt

SEQ ID NO: 751482 - DNA, 22 bp, Artificial Sequence
  chemically synthesized
aaaaaagagaaaccatggttta

SEQ ID NO: 751483 - DNA, 22 bp, Artificial Sequence
  chemically synthesized
tttttgttttaataaaccatgg

SEQ ID NO: 751484 - DNA, 22 bp, Artificial Sequence
  chemically synthesized
gtttttgttttaataaaccatg

SEQ ID NO: 751485 - DNA, 22 bp, Artificial Sequence
  chemically synthesized
tgtttttgttttaataaaccat

SEQ ID NO: 751486 - DNA, 22 bp, Artificial Sequence
  chemically synthesized
atgttttgtttttgttttaata

SEQ ID NO: 751487 - DNA, 22 bp, Artificial Sequence
  chemically synthesized
aatgttttgtttttgttttaat

SEQ ID NO: 751488 - DNA, 22 bp, Artificial Sequence
  chemically synthesized
taatgttttgtttttgttttaa

SEQ ID NO: 751489 - DNA, 22 bp, Artificial Sequence
  chemically synthesized
ttaatgttttgtttttgtttta

SEQ ID NO: 751490 - DNA, 22 bp, Artificial Sequence
  chemically synthesized
tttaatgttttgtttttgtttt

SEQ ID NO: 751491 - DNA, 22 bp, Artificial Sequence
  chemically synthesized
ttttttaatgttttgtttttgt

SEQ ID NO: 751492 - DNA, 22 bp, Artificial Sequence
  chemically synthesized
ctgttttttaatgttttgtttt

SEQ ID NO: 751493 - DNA, 22 bp, Artificial Sequence
  chemically synthesized
attaaaacaaaaacaaaacatt

SEQ ID NO: 751494 - DNA, 22 bp, Artificial Sequence
  chemically synthesized
ttaaaacaaaaacaaaacatta

SEQ ID NO: 751495 - DNA, 22 bp, Artificial Sequence
  chemically synthesized
aaacaaaaacaaaacattaaaa

SEQ ID NO: 751496 - DNA, 22 bp, Artificial Sequence
  chemically synthesized
ccggccagattgctgtttttta

SEQ ID NO: 751497 - DNA, 22 bp, Artificial Sequence
  chemically synthesized
aaaaacagcaatctggccggga

SEQ ID NO: 751498 - DNA, 22 bp, Artificial Sequence
  chemically synthesized
caggcgtgagccaccgctcccg

SEQ ID NO: 751499 - DNA, 22 bp, Artificial Sequence
  chemically synthesized
ggattacaggcgtgagccaccg

SEQ ID NO: 751500 - DNA, 22 bp, Artificial Sequence
  chemically synthesized
gccgggagcggtggctcacgcc

SEQ ID NO: 751501 - DNA, 22 bp, Artificial Sequence
  chemically synthesized
ccaaagtgctgggattacaggc

SEQ ID NO: 751502 - DNA, 22 bp, Artificial Sequence
  chemically synthesized
gcctcccaaagtgctgggatta

SEQ ID NO: 751503 - DNA, 22 bp, Artificial Sequence
  chemically synthesized
ggcctcccaaagtgctgggatt

SEQ ID NO: 751504 - DNA, 22 bp, Artificial Sequence
  chemically synthesized
acgcctgtaatcccagcacttt

SEQ ID NO: 751505 - DNA, 22 bp, Artificial Sequence
  chemically synthesized
taatcccagcactttgggaggc

SEQ ID NO: 751506 - DNA, 22 bp, Artificial Sequence
  chemically synthesized
gtgatccgcccaccttggcctc

SEQ ID NO: 751507 - DNA, 22 bp, Artificial Sequence
  chemically synthesized
atctcgtgatccgcccaccttg

SEQ ID NO: 751508 - DNA, 22 bp, Artificial Sequence
  chemically synthesized
gatctcgtgatccgcccacctt

SEQ ID NO: 751509 - DNA, 22 bp, Artificial Sequence
  chemically synthesized
ttgatctcgtgatccgcccacc

SEQ ID NO: 751510 - DNA, 22 bp, Artificial Sequence
  chemically synthesized
tgggaggccaaggtgggcggat

SEQ ID NO: 751511 - DNA, 22 bp, Artificial Sequence
  chemically synthesized
gggaggccaaggtgggcggatc

SEQ ID NO: 751512 - DNA, 22 bp, Artificial Sequence
  chemically synthesized
ggaggccaaggtgggcggatca

SEQ ID NO: 751513 - DNA, 22 bp, Artificial Sequence
  chemically synthesized
atctcttgatctcgtgatccgc

SEQ ID NO: 751514 - DNA, 22 bp, Artificial Sequence
  chemically synthesized
gatctcttgatctcgtgatccg

SEQ ID NO: 751515 - DNA, 22 bp, Artificial Sequence
  chemically synthesized
gccaggatggtcttgatctctt

SEQ ID NO: 751516 - DNA, 22 bp, Artificial Sequence
  chemically synthesized
accatgttggccaggatggtct

SEQ ID NO: 751517 - DNA, 22 bp, Artificial Sequence
  chemically synthesized
caccatgttggccaggatggtc

SEQ ID NO: 751518 - DNA, 22 bp, Artificial Sequence
  chemically synthesized
gtagagacggggtttcaccatg

SEQ ID NO: 751519 - DNA, 22 bp, Artificial Sequence
  chemically synthesized
agtagagacggggtttcaccat

SEQ ID NO: 751520 - DNA, 22 bp, Artificial Sequence
  chemically synthesized
tagtagagacggggtttcacca

SEQ ID NO: 751521 - DNA, 22 bp, Artificial Sequence
  chemically synthesized
gccaacatggtgaaaccccgtc

SEQ ID NO: 751522 - DNA, 22 bp, Artificial Sequence
  chemically synthesized
taattttagtagagacggggtt

SEQ ID NO: 751523 - DNA, 22 bp, Artificial Sequence
  chemically synthesized
gtaattttagtagagacggggt

SEQ ID NO: 751524 - DNA, 22 bp, Artificial Sequence
  chemically synthesized
tgtaattttagtagagacgggg

SEQ ID NO: 751525 - DNA, 22 bp, Artificial Sequence
  chemically synthesized
ttgtaattttagtagagacggg

SEQ ID NO: 751526 - DNA, 22 bp, Artificial Sequence
  chemically synthesized
atttttgtaattttagtagaga

SEQ ID NO: 751527 - DNA, 22 bp, Artificial Sequence
  chemically synthesized
tactaaaattacaaaaatcagc

SEQ ID NO: 751528 - DNA, 22 bp, Artificial Sequence
  chemically synthesized
ctaaaattacaaaaatcagctg

SEQ ID NO: 751529 - DNA, 22 bp, Artificial Sequence
  chemically synthesized
aaattacaaaaatcagctgggc

SEQ ID NO: 751530 - DNA, 22 bp, Artificial Sequence
  chemically synthesized
caggcgcgcaccaccacgccca

SEQ ID NO: 751531 - DNA, 22 bp, Artificial Sequence
  chemically synthesized
caaaaatcagctgggcgtggtg

SEQ ID NO: 751532 - DNA, 22 bp, Artificial Sequence
  chemically synthesized
ggactacaggcgcgcaccacca

SEQ ID NO: 751533 - DNA, 22 bp, Artificial Sequence
  chemically synthesized
ggcgtggtggtgcgcgcctgta

SEQ ID NO: 751534 - DNA, 22 bp, Artificial Sequence
  chemically synthesized
agtagctgggactacaggcgcg

SEQ ID NO: 751535 - DNA, 22 bp, Artificial Sequence
  chemically synthesized
ctgagtagctgggactacaggc

SEQ ID NO: 751536 - DNA, 22 bp, Artificial Sequence
  chemically synthesized
agcctcctgagtagctgggact

SEQ ID NO: 751537 - DNA, 22 bp, Artificial Sequence
  chemically synthesized
cctcagcctcctgagtagctgg

SEQ ID NO: 751538 - DNA, 22 bp, Artificial Sequence
  chemically synthesized
ctgcctcagcctcctgagtagc

SEQ ID NO: 751539 - DNA, 22 bp, Artificial Sequence
  chemically synthesized
tcctgcctcagcctcctgagta

SEQ ID NO: 751540 - DNA, 22 bp, Artificial Sequence
  chemically synthesized
tagtcccagctactcaggaggc

SEQ ID NO: 751541 - DNA, 22 bp, Artificial Sequence
  chemically synthesized
aagcaattctcctgcctcagcc

SEQ ID NO: 751542 - DNA, 22 bp, Artificial Sequence
  chemically synthesized
ctcaggaggctgaggcaggaga

SEQ ID NO: 751543 - DNA, 22 bp, Artificial Sequence
  chemically synthesized
ggttcaagcaattctcctgcct

SEQ ID NO: 751544 - DNA, 22 bp, Artificial Sequence
  chemically synthesized
aggaggctgaggcaggagaatt

SEQ ID NO: 751545 - DNA, 22 bp, Artificial Sequence
  chemically synthesized
ctgggttcaagcaattctcctg

SEQ ID NO: 751546 - DNA, 22 bp, Artificial Sequence
  chemically synthesized
aacctcctgggttcaagcaatt

SEQ ID NO: 751547 - DNA, 22 bp, Artificial Sequence
  chemically synthesized
aggcaggagaattgcttgaacc

SEQ ID NO: 751548 - DNA, 22 bp, Artificial Sequence
  chemically synthesized
gctgaacctcctgggttcaagc

SEQ ID NO: 751549 - DNA, 22 bp, Artificial Sequence
  chemically synthesized
ggctcgctgaacctcctgggtt

SEQ ID NO: 751550 - DNA, 22 bp, Artificial Sequence
  chemically synthesized
cttgaacccaggaggttcagcg

SEQ ID NO: 751551 - DNA, 22 bp, Artificial Sequence
  chemically synthesized
gaacccaggaggttcagcgagc

SEQ ID NO: 751552 - DNA, 22 bp, Artificial Sequence
  chemically synthesized
aacccaggaggttcagcgagcc

SEQ ID NO: 751553 - DNA, 22 bp, Artificial Sequence
  chemically synthesized
gagtgcagtggtgagatctcgg

SEQ ID NO: 751554 - DNA, 22 bp, Artificial Sequence
  chemically synthesized
agcgagccgagatctcaccact

SEQ ID NO: 751555 - DNA, 22 bp, Artificial Sequence
  chemically synthesized
tcaccaggctggagtgcagtgg

SEQ ID NO: 751556 - DNA, 22 bp, Artificial Sequence
  chemically synthesized
tgtcaccaggctggagtgcagt

SEQ ID NO: 751557 - DNA, 22 bp, Artificial Sequence
  chemically synthesized
actctgtcaccaggctggagtg

SEQ ID NO: 751558 - DNA, 22 bp, Artificial Sequence
  chemically synthesized
accactgcactccagcctggtg

SEQ ID NO: 751559 - DNA, 22 bp, Artificial Sequence
  chemically synthesized
cactccagcctggtgacagagt

SEQ ID NO: 751560 - DNA, 22 bp, Artificial Sequence
  chemically synthesized
agacagagtctcactctgtcac

SEQ ID NO: 751561 - DNA, 22 bp, Artificial Sequence
  chemically synthesized
gagacagagtctcactctgtca

SEQ ID NO: 751562 - DNA, 22 bp, Artificial Sequence
  chemically synthesized
tgagacagagtctcactctgtc

SEQ ID NO: 751563 - DNA, 22 bp, Artificial Sequence
  chemically synthesized
ttgagacagagtctcactctgt

SEQ ID NO: 751564 - DNA, 22 bp, Artificial Sequence
  chemically synthesized
tttgagacagagtctcactctg

SEQ ID NO: 751565 - DNA, 22 bp, Artificial Sequence
  chemically synthesized
cagcctggtgacagagtgagac

SEQ ID NO: 751566 - DNA, 22 bp, Artificial Sequence
  chemically synthesized
ttttgagacagagtctcactct

SEQ ID NO: 751567 - DNA, 22 bp, Artificial Sequence
  chemically synthesized
tttttgagacagagtctcactc

SEQ ID NO: 751568 - DNA, 22 bp, Artificial Sequence
  chemically synthesized
ttttttgagacagagtctcact

SEQ ID NO: 751569 - DNA, 22 bp, Artificial Sequence
  chemically synthesized
tttttttgagacagagtctcac

SEQ ID NO: 751570 - DNA, 22 bp, Artificial Sequence
  chemically synthesized
ttttttttgagacagagtctca

SEQ ID NO: 751571 - DNA, 22 bp, Artificial Sequence
  chemically synthesized
tttttttttgagacagagtctc

SEQ ID NO: 751572 - DNA, 22 bp, Artificial Sequence
  chemically synthesized
ttttttttttgagacagagtct

SEQ ID NO: 751573 - DNA, 22 bp, Artificial Sequence
  chemically synthesized
gtgacagagtgagactctgtct

SEQ ID NO: 751574 - DNA, 22 bp, Artificial Sequence
  chemically synthesized
tttttttttttgagacagagtc

SEQ ID NO: 751575 - DNA, 22 bp, Artificial Sequence
  chemically synthesized
ttttttttttttgagacagagt

SEQ ID NO: 751576 - DNA, 22 bp, Artificial Sequence
  chemically synthesized
tttttttttttttgagacagag

SEQ ID NO: 751577 - DNA, 22 bp, Artificial Sequence
  chemically synthesized
ttttttttttttttgagacaga

SEQ ID NO: 751578 - DNA, 22 bp, Artificial Sequence
  chemically synthesized
tttttttttttttttgagacag

SEQ ID NO: 751579 - DNA, 22 bp, Artificial Sequence
  chemically synthesized
tttttttttttttttttgagac

SEQ ID NO: 751580 - DNA, 22 bp, Artificial Sequence
  chemically synthesized
ctttttttttttttttttgaga

SEQ ID NO: 751581 - DNA, 22 bp, Artificial Sequence
  chemically synthesized
tctttttttttttttttttgag

SEQ ID NO: 751582 - DNA, 22 bp, Artificial Sequence
  chemically synthesized
ttttcttttttttttttttttt

SEQ ID NO: 751583 - DNA, 22 bp, Artificial Sequence
  chemically synthesized
ttgttttctttttttttttttt

SEQ ID NO: 751584 - DNA, 22 bp, Artificial Sequence
  chemically synthesized
tgtctcaaaaaaaaaaaaaaaa

SEQ ID NO: 751585 - DNA, 22 bp, Artificial Sequence
  chemically synthesized
tctcaaaaaaaaaaaaaaaaag

SEQ ID NO: 751586 - DNA, 22 bp, Artificial Sequence
  chemically synthesized
tggattgttgttttcttttttt

SEQ ID NO: 751587 - DNA, 22 bp, Artificial Sequence
  chemically synthesized
gtggattgttgttttctttttt

SEQ ID NO: 751588 - DNA, 22 bp, Artificial Sequence
  chemically synthesized
aaaaaaaaaaaaaaaaagaaaa

SEQ ID NO: 751589 - DNA, 22 bp, Artificial Sequence
  chemically synthesized
aggacaatcccaaggtgaaaag

SEQ ID NO: 751590 - DNA, 22 bp, Artificial Sequence
  chemically synthesized
caggacaatcccaaggtgaaaa

SEQ ID NO: 751591 - DNA, 22 bp, Artificial Sequence
  chemically synthesized
ttcaggacaatcccaaggtgaa

SEQ ID NO: 751592 - DNA, 22 bp, Artificial Sequence
  chemically synthesized
ttcttcaggacaatcccaaggt

SEQ ID NO: 751593 - DNA, 22 bp, Artificial Sequence
  chemically synthesized
gttcttcaggacaatcccaagg

SEQ ID NO: 751594 - DNA, 22 bp, Artificial Sequence
  chemically synthesized
tgttcttcaggacaatcccaag

SEQ ID NO: 751595 - DNA, 22 bp, Artificial Sequence
  chemically synthesized
ttgttcttcaggacaatcccaa

SEQ ID NO: 751596 - DNA, 22 bp, Artificial Sequence
  chemically synthesized
ttcaccttgggattgtcctgaa

SEQ ID NO: 751597 - DNA, 22 bp, Artificial Sequence
  chemically synthesized
tcaccttgggattgtcctgaag

SEQ ID NO: 751598 - DNA, 22 bp, Artificial Sequence
  chemically synthesized
caccttgggattgtcctgaaga

SEQ ID NO: 751599 - DNA, 22 bp, Artificial Sequence
  chemically synthesized
accttgggattgtcctgaagaa

SEQ ID NO: 751600 - DNA, 22 bp, Artificial Sequence
  chemically synthesized
gatacaagatttttgttcttca

SEQ ID NO: 751601 - DNA, 22 bp, Artificial Sequence
  chemically synthesized
gggattgtcctgaagaacaaaa

SEQ ID NO: 751602 - DNA, 22 bp, Artificial Sequence
  chemically synthesized
ggattgtcctgaagaacaaaaa

SEQ ID NO: 751603 - DNA, 22 bp, Artificial Sequence
  chemically synthesized
tagtctggatacaagatttttg

SEQ ID NO: 751604 - DNA, 22 bp, Artificial Sequence
  chemically synthesized
tcctgaagaacaaaaatcttgt

SEQ ID NO: 751605 - DNA, 22 bp, Artificial Sequence
  chemically synthesized
aacctgtagtctggatacaaga

SEQ ID NO: 751606 - DNA, 22 bp, Artificial Sequence
  chemically synthesized
aagaacaaaaatcttgtatcca

SEQ ID NO: 751607 - DNA, 22 bp, Artificial Sequence
  chemically synthesized
aaacctgtagtctggatacaag

SEQ ID NO: 751608 - DNA, 22 bp, Artificial Sequence
  chemically synthesized
taaacctgtagtctggatacaa

SEQ ID NO: 751609 - DNA, 22 bp, Artificial Sequence
  chemically synthesized
ttaaacctgtagtctggataca

SEQ ID NO: 751610 - DNA, 22 bp, Artificial Sequence
  chemically synthesized
gtatccagactacaggtttaaa

SEQ ID NO: 751611 - DNA, 22 bp, Artificial Sequence
  chemically synthesized
tatccagactacaggtttaaaa

SEQ ID NO: 751612 - DNA, 22 bp, Artificial Sequence
  chemically synthesized
ataaagtagaataacttttaaa

SEQ ID NO: 751613 - DNA, 22 bp, Artificial Sequence
  chemically synthesized
aataaagtagaataacttttaa

SEQ ID NO: 751614 - DNA, 22 bp, Artificial Sequence
  chemically synthesized
taataaagtagaataactttta

SEQ ID NO: 751615 - DNA, 22 bp, Artificial Sequence
  chemically synthesized
caggtttaaaagttattctact

SEQ ID NO: 751616 - DNA, 22 bp, Artificial Sequence
  chemically synthesized
aaaagttattctactttattaa

SEQ ID NO: 751617 - DNA, 22 bp, Artificial Sequence
  chemically synthesized
aaagttattctactttattaaa

SEQ ID NO: 751618 - DNA, 22 bp, Artificial Sequence
  chemically synthesized
ttctactttattaaagccttta

SEQ ID NO: 751619 - DNA, 22 bp, Artificial Sequence
  chemically synthesized
taagtggaatatataaaggctt

SEQ ID NO: 751620 - DNA, 22 bp, Artificial Sequence
  chemically synthesized
tactttattaaagcctttatat

SEQ ID NO: 751621 - DNA, 22 bp, Artificial Sequence
  chemically synthesized
ctttattaaagcctttatatat

SEQ ID NO: 751622 - DNA, 22 bp, Artificial Sequence
  chemically synthesized
tattaaagcctttatatattcc

SEQ ID NO: 751623 - DNA, 22 bp, Artificial Sequence
  chemically synthesized
attaaagcctttatatattcca

SEQ ID NO: 751624 - DNA, 22 bp, Artificial Sequence
  chemically synthesized
ttaaagcctttatatattccac

SEQ ID NO: 751625 - DNA, 22 bp, Artificial Sequence
  chemically synthesized
aagcctttatatattccactta

SEQ ID NO: 751626 - DNA, 22 bp, Artificial Sequence
  chemically synthesized
cacatagatctgtaagtggaat

SEQ ID NO: 751627 - DNA, 22 bp, Artificial Sequence
  chemically synthesized
tatatattccacttacagatct

SEQ ID NO: 751628 - DNA, 22 bp, Artificial Sequence
  chemically synthesized
ggtgttccacatagatctgtaa

SEQ ID NO: 751629 - DNA, 22 bp, Artificial Sequence
  chemically synthesized
atatattccacttacagatcta

SEQ ID NO: 751630 - DNA, 22 bp, Artificial Sequence
  chemically synthesized
tatattccacttacagatctat

SEQ ID NO: 751631 - DNA, 22 bp, Artificial Sequence
  chemically synthesized
ctaggtgttccacatagatctg

SEQ ID NO: 751632 - DNA, 22 bp, Artificial Sequence
  chemically synthesized
aattactaggtgttccacatag

SEQ ID NO: 751633 - DNA, 22 bp, Artificial Sequence
  chemically synthesized
cacttacagatctatgtggaac

SEQ ID NO: 751634 - DNA, 22 bp, Artificial Sequence
  chemically synthesized
gaattactaggtgttccacata

SEQ ID NO: 751635 - DNA, 22 bp, Artificial Sequence
  chemically synthesized
tgaattactaggtgttccacat

SEQ ID NO: 751636 - DNA, 22 bp, Artificial Sequence
  chemically synthesized
ttgaattactaggtgttccaca

SEQ ID NO: 751637 - DNA, 22 bp, Artificial Sequence
  chemically synthesized
tttgaattactaggtgttccac

SEQ ID NO: 751638 - DNA, 22 bp, Artificial Sequence
  chemically synthesized
acagatctatgtggaacaccta

SEQ ID NO: 751639 - DNA, 22 bp, Artificial Sequence
  chemically synthesized
cagatctatgtggaacacctag

SEQ ID NO: 751640 - DNA, 22 bp, Artificial Sequence
  chemically synthesized
tgtggaacacctagtaattcaa

SEQ ID NO: 751641 - DNA, 22 bp, Artificial Sequence
  chemically synthesized
taatggggaataggaataactt

SEQ ID NO: 751642 - DNA, 22 bp, Artificial Sequence
  chemically synthesized
gtaatggggaataggaataact

SEQ ID NO: 751643 - DNA, 22 bp, Artificial Sequence
  chemically synthesized
gtaattcaaaaagttattccta

SEQ ID NO: 751644 - DNA, 22 bp, Artificial Sequence
  chemically synthesized
cttgtaatggggaataggaata

SEQ ID NO: 751645 - DNA, 22 bp, Artificial Sequence
  chemically synthesized
ccttgtaatggggaataggaat

SEQ ID NO: 751646 - DNA, 22 bp, Artificial Sequence
  chemically synthesized
aaaaagttattcctattcccca

SEQ ID NO: 751647 - DNA, 22 bp, Artificial Sequence
  chemically synthesized
ccttccttgtaatggggaatag

SEQ ID NO: 751648 - DNA, 22 bp, Artificial Sequence
  chemically synthesized
taccttccttgtaatggggaat

SEQ ID NO: 751649 - DNA, 22 bp, Artificial Sequence
  chemically synthesized
ttcctattccccattacaagga

SEQ ID NO: 751650 - DNA, 22 bp, Artificial Sequence
  chemically synthesized
ctattccccattacaaggaagg

SEQ ID NO: 751651 - DNA, 22 bp, Artificial Sequence
  chemically synthesized
gacaaatattctaccttccttg

SEQ ID NO: 751652 - DNA, 22 bp, Artificial Sequence
  chemically synthesized
ttccccattacaaggaaggtag

SEQ ID NO: 751653 - DNA, 22 bp, Artificial Sequence
  chemically synthesized
actagacaaatattctaccttc

SEQ ID NO: 751654 - DNA, 22 bp, Artificial Sequence
  chemically synthesized
cccattacaaggaaggtagaat

SEQ ID NO: 751655 - DNA, 22 bp, Artificial Sequence
  chemically synthesized
gactagacaaatattctacctt

SEQ ID NO: 751656 - DNA, 22 bp, Artificial Sequence
  chemically synthesized
tttgactagacaaatattctac

SEQ ID NO: 751657 - DNA, 22 bp, Artificial Sequence
  chemically synthesized
atttgactagacaaatattcta

SEQ ID NO: 751658 - DNA, 22 bp, Artificial Sequence
  chemically synthesized
caaggaaggtagaatatttgtc

SEQ ID NO: 751659 - DNA, 22 bp, Artificial Sequence
  chemically synthesized
aaaatagcaccagtgcttattt

SEQ ID NO: 751660 - DNA, 22 bp, Artificial Sequence
  chemically synthesized
ctgaaaatagcaccagtgctta

SEQ ID NO: 751661 - DNA, 22 bp, Artificial Sequence
  chemically synthesized
gtctagtcaaataagcactggt

SEQ ID NO: 751662 - DNA, 22 bp, Artificial Sequence
  chemically synthesized
actgaaaatagcaccagtgctt

SEQ ID NO: 751663 - DNA, 22 bp, Artificial Sequence
  chemically synthesized
tctagtcaaataagcactggtg

SEQ ID NO: 751664 - DNA, 22 bp, Artificial Sequence
  chemically synthesized
tactgaaaatagcaccagtgct

SEQ ID NO: 751665 - DNA, 22 bp, Artificial Sequence
  chemically synthesized
gtcaaataagcactggtgctat

SEQ ID NO: 751666 - DNA, 22 bp, Artificial Sequence
  chemically synthesized
actttactgaaaatagcaccag

SEQ ID NO: 751667 - DNA, 22 bp, Artificial Sequence
  chemically synthesized
cactttactgaaaatagcacca

SEQ ID NO: 751668 - DNA, 22 bp, Artificial Sequence
  chemically synthesized
tcactttactgaaaatagcacc

SEQ ID NO: 751669 - DNA, 22 bp, Artificial Sequence
  chemically synthesized
ttcactttactgaaaatagcac

SEQ ID NO: 751670 - DNA, 22 bp, Artificial Sequence
  chemically synthesized
gtgctattttcagtaaagtgaa

SEQ ID NO: 751671 - DNA, 22 bp, Artificial Sequence
  chemically synthesized
ttttcagtaaagtgaaaagtca

SEQ ID NO: 751672 - DNA, 22 bp, Artificial Sequence
  chemically synthesized
agggcaagatcatgacttttca

SEQ ID NO: 751673 - DNA, 22 bp, Artificial Sequence
  chemically synthesized
aagggcaagatcatgacttttc

SEQ ID NO: 751674 - DNA, 22 bp, Artificial Sequence
  chemically synthesized
taagggcaagatcatgactttt

SEQ ID NO: 751675 - DNA, 22 bp, Artificial Sequence
  chemically synthesized
tcagtaaagtgaaaagtcatga

SEQ ID NO: 751676 - DNA, 22 bp, Artificial Sequence
  chemically synthesized
cagtaaagtgaaaagtcatgat

SEQ ID NO: 751677 - DNA, 22 bp, Artificial Sequence
  chemically synthesized
agtaaagtgaaaagtcatgatc

SEQ ID NO: 751678 - DNA, 22 bp, Artificial Sequence
  chemically synthesized
tcaaatattttaagggcaagat

SEQ ID NO: 751679 - DNA, 22 bp, Artificial Sequence
  chemically synthesized
atcaaatattttaagggcaaga

SEQ ID NO: 751680 - DNA, 22 bp, Artificial Sequence
  chemically synthesized
cttatcaaatattttaagggca

SEQ ID NO: 751681 - DNA, 22 bp, Artificial Sequence
  chemically synthesized
tactgcttatcaaatattttaa

SEQ ID NO: 751682 - DNA, 22 bp, Artificial Sequence
  chemically synthesized
atactgcttatcaaatatttta

SEQ ID NO: 751683 - DNA, 22 bp, Artificial Sequence
  chemically synthesized
gcccttaaaatatttgataagc

SEQ ID NO: 751684 - DNA, 22 bp, Artificial Sequence
  chemically synthesized
atgatttatactgcttatcaaa

SEQ ID NO: 751685 - DNA, 22 bp, Artificial Sequence
  chemically synthesized
cccttaaaatatttgataagca

SEQ ID NO: 751686 - DNA, 22 bp, Artificial Sequence
  chemically synthesized
aaaatatttgataagcagtata

SEQ ID NO: 751687 - DNA, 22 bp, Artificial Sequence
  chemically synthesized
aaattcatgatttatactgctt

SEQ ID NO: 751688 - DNA, 22 bp, Artificial Sequence
  chemically synthesized
aaatatttgataagcagtataa

SEQ ID NO: 751689 - DNA, 22 bp, Artificial Sequence
  chemically synthesized
aaaattcatgatttatactgct

SEQ ID NO: 751690 - DNA, 22 bp, Artificial Sequence
  chemically synthesized
taaaattcatgatttatactgc

SEQ ID NO: 751691 - DNA, 22 bp, Artificial Sequence
  chemically synthesized
ttaaaattcatgatttatactg

SEQ ID NO: 751692 - DNA, 22 bp, Artificial Sequence
  chemically synthesized
cttttaaaattcatgatttata

SEQ ID NO: 751693 - DNA, 22 bp, Artificial Sequence
  chemically synthesized
acttttaaaattcatgatttat

SEQ ID NO: 751694 - DNA, 22 bp, Artificial Sequence
  chemically synthesized
tacttttaaaattcatgattta

SEQ ID NO: 751695 - DNA, 22 bp, Artificial Sequence
  chemically synthesized
gataagcagtataaatcatgaa

SEQ ID NO: 751696 - DNA, 22 bp, Artificial Sequence
  chemically synthesized
ataagcagtataaatcatgaat

SEQ ID NO: 751697 - DNA, 22 bp, Artificial Sequence
  chemically synthesized
tttacttttaaaattcatgatt

SEQ ID NO: 751698 - DNA, 22 bp, Artificial Sequence
  chemically synthesized
ctttacttttaaaattcatgat

SEQ ID NO: 751699 - DNA, 22 bp, Artificial Sequence
  chemically synthesized
aatgcttctttacttttaaaat

SEQ ID NO: 751700 - DNA, 22 bp, Artificial Sequence
  chemically synthesized
aaatgcttctttacttttaaaa

SEQ ID NO: 751701 - DNA, 22 bp, Artificial Sequence
  chemically synthesized
taaatgcttctttacttttaaa

SEQ ID NO: 751702 - DNA, 22 bp, Artificial Sequence
  chemically synthesized
agttttaaatgcttctttactt

SEQ ID NO: 751703 - DNA, 22 bp, Artificial Sequence
  chemically synthesized
aagttttaaatgcttctttact

SEQ ID NO: 751704 - DNA, 22 bp, Artificial Sequence
  chemically synthesized
taaaagtaaagaagcatttaaa

SEQ ID NO: 751705 - DNA, 22 bp, Artificial Sequence
  chemically synthesized
aaaagtaaagaagcatttaaaa

SEQ ID NO: 751706 - DNA, 22 bp, Artificial Sequence
  chemically synthesized
aaagtaaagaagcatttaaaac

SEQ ID NO: 751707 - DNA, 22 bp, Artificial Sequence
  chemically synthesized
aaaacttaaatttgattctact

SEQ ID NO: 751708 - DNA, 22 bp, Artificial Sequence
  chemically synthesized
aaacttaaatttgattctactg

SEQ ID NO: 751709 - DNA, 22 bp, Artificial Sequence
  chemically synthesized
cataggaaaaaacagtagaatc

SEQ ID NO: 751710 - DNA, 22 bp, Artificial Sequence
  chemically synthesized
ccataggaaaaaacagtagaat

SEQ ID NO: 751711 - DNA, 22 bp, Artificial Sequence
  chemically synthesized
aaatttgattctactgtttttt

SEQ ID NO: 751712 - DNA, 22 bp, Artificial Sequence
  chemically synthesized
aatttgattctactgttttttc

SEQ ID NO: 751713 - DNA, 22 bp, Artificial Sequence
  chemically synthesized
gattctactgttttttcctatg

SEQ ID NO: 751714 - DNA, 22 bp, Artificial Sequence
  chemically synthesized
attctactgttttttcctatgg

SEQ ID NO: 751715 - DNA, 22 bp, Artificial Sequence
  chemically synthesized
caaacatagcttccataggaaa

SEQ ID NO: 751716 - DNA, 22 bp, Artificial Sequence
  chemically synthesized
ccaaacatagcttccataggaa

SEQ ID NO: 751717 - DNA, 22 bp, Artificial Sequence
  chemically synthesized
tactgttttttcctatggaagc

SEQ ID NO: 751718 - DNA, 22 bp, Artificial Sequence
  chemically synthesized
ctgttttttcctatggaagcta

SEQ ID NO: 751719 - DNA, 22 bp, Artificial Sequence
  chemically synthesized
agccttccaaacatagcttcca

SEQ ID NO: 751720 - DNA, 22 bp, Artificial Sequence
  chemically synthesized
ttttttcctatggaagctatgt

SEQ ID NO: 751721 - DNA, 22 bp, Artificial Sequence
  chemically synthesized
tttcctatggaagctatgtttg

SEQ ID NO: 751722 - DNA, 22 bp, Artificial Sequence
  chemically synthesized
ttcctatggaagctatgtttgg

SEQ ID NO: 751723 - DNA, 22 bp, Artificial Sequence
  chemically synthesized
tcctatggaagctatgtttgga

SEQ ID NO: 751724 - DNA, 22 bp, Artificial Sequence
  chemically synthesized
cctatggaagctatgtttggaa

SEQ ID NO: 751725 - DNA, 22 bp, Artificial Sequence
  chemically synthesized
ctatggaagctatgtttggaag

SEQ ID NO: 751726 - DNA, 22 bp, Artificial Sequence
  chemically synthesized
agagaatctcagccttccaaac

SEQ ID NO: 751727 - DNA, 22 bp, Artificial Sequence
  chemically synthesized
tggaagctatgtttggaaggct

SEQ ID NO: 751728 - DNA, 22 bp, Artificial Sequence
  chemically synthesized
actaagagaatctcagccttcc

SEQ ID NO: 751729 - DNA, 22 bp, Artificial Sequence
  chemically synthesized
ctcactaagagaatctcagcct

SEQ ID NO: 751730 - DNA, 22 bp, Artificial Sequence
  chemically synthesized
tgtttggaaggctgagattctc

SEQ ID NO: 751731 - DNA, 22 bp, Artificial Sequence
  chemically synthesized
tattgctcactaagagaatctc

SEQ ID NO: 751732 - DNA, 22 bp, Artificial Sequence
  chemically synthesized
ggaaggctgagattctcttagt

SEQ ID NO: 751733 - DNA, 22 bp, Artificial Sequence
  chemically synthesized
actatattgctcactaagagaa

SEQ ID NO: 751734 - DNA, 22 bp, Artificial Sequence
  chemically synthesized
gaaggctgagattctcttagtg

SEQ ID NO: 751735 - DNA, 22 bp, Artificial Sequence
  chemically synthesized
atattgactatattgctcacta

SEQ ID NO: 751736 - DNA, 22 bp, Artificial Sequence
  chemically synthesized
agattctcttagtgagcaatat

SEQ ID NO: 751737 - DNA, 22 bp, Artificial Sequence
  chemically synthesized
tcttagtgagcaatatagtcaa

SEQ ID NO: 751738 - DNA, 22 bp, Artificial Sequence
  chemically synthesized
ttagtgagcaatatagtcaata

SEQ ID NO: 751739 - DNA, 22 bp, Artificial Sequence
  chemically synthesized
agtgagcaatatagtcaatatt

SEQ ID NO: 751740 - DNA, 22 bp, Artificial Sequence
  chemically synthesized
gtgagcaatatagtcaatatta

SEQ ID NO: 751741 - DNA, 22 bp, Artificial Sequence
  chemically synthesized
ataaatggaaacacaatattaa

SEQ ID NO: 751742 - DNA, 22 bp, Artificial Sequence
  chemically synthesized
atattgtgtttccatttattaa

SEQ ID NO: 751743 - DNA, 22 bp, Artificial Sequence
  chemically synthesized
tgtttccatttattaatttacc

SEQ ID NO: 751744 - DNA, 22 bp, Artificial Sequence
  chemically synthesized
cgggtggtgaacatggtaaatt

SEQ ID NO: 751745 - DNA, 22 bp, Artificial Sequence
  chemically synthesized
ccatttattaatttaccatgtt

SEQ ID NO: 751746 - DNA, 22 bp, Artificial Sequence
  chemically synthesized
catttattaatttaccatgttc

SEQ ID NO: 751747 - DNA, 22 bp, Artificial Sequence
  chemically synthesized
atcatctgcgggtggtgaacat

SEQ ID NO: 751748 - DNA, 22 bp, Artificial Sequence
  chemically synthesized
attaatttaccatgttcaccac

SEQ ID NO: 751749 - DNA, 22 bp, Artificial Sequence
  chemically synthesized
ttaatttaccatgttcaccacc

SEQ ID NO: 751750 - DNA, 22 bp, Artificial Sequence
  chemically synthesized
gctgatcatctgcgggtggtga

SEQ ID NO: 751751 - DNA, 22 bp, Artificial Sequence
  chemically synthesized
atttaccatgttcaccacccgc

SEQ ID NO: 751752 - DNA, 22 bp, Artificial Sequence
  chemically synthesized
ctagctgatcatctgcgggtgg

SEQ ID NO: 751753 - DNA, 22 bp, Artificial Sequence
  chemically synthesized
accatgttcaccacccgcagat

SEQ ID NO: 751754 - DNA, 22 bp, Artificial Sequence
  chemically synthesized
ccatgttcaccacccgcagatg

SEQ ID NO: 751755 - DNA, 22 bp, Artificial Sequence
  chemically synthesized
ttgctagctgatcatctgcggg

SEQ ID NO: 751756 - DNA, 22 bp, Artificial Sequence
  chemically synthesized
accacccgcagatgatcagcta

SEQ ID NO: 751757 - DNA, 22 bp, Artificial Sequence
  chemically synthesized
tggaaatggcattattgctagc

SEQ ID NO: 751758 - DNA, 22 bp, Artificial Sequence
  chemically synthesized
atggaaatggcattattgctag

SEQ ID NO: 751759 - DNA, 22 bp, Artificial Sequence
  chemically synthesized
tatggaaatggcattattgcta

SEQ ID NO: 751760 - DNA, 22 bp, Artificial Sequence
  chemically synthesized
gcctttatggaaatggcattat

SEQ ID NO: 751761 - DNA, 22 bp, Artificial Sequence
  chemically synthesized
agtccctggcctttatggaaat

SEQ ID NO: 751762 - DNA, 22 bp, Artificial Sequence
  chemically synthesized
gcaataatgccatttccataaa

SEQ ID NO: 751763 - DNA, 22 bp, Artificial Sequence
  chemically synthesized
ccataaaggccagggacttagt

SEQ ID NO: 751764 - DNA, 22 bp, Artificial Sequence
  chemically synthesized
cataaaggccagggacttagtc

SEQ ID NO: 751765 - DNA, 22 bp, Artificial Sequence
  chemically synthesized
aagaatgggtgaaacaacaatg

SEQ ID NO: 751766 - DNA, 22 bp, Artificial Sequence
  chemically synthesized
aaagaatgggtgaaacaacaat

SEQ ID NO: 751767 - DNA, 22 bp, Artificial Sequence
  chemically synthesized
gatttaaagaatgggtgaaaca

SEQ ID NO: 751768 - DNA, 22 bp, Artificial Sequence
  chemically synthesized
ggatttaaagaatgggtgaaac

SEQ ID NO: 751769 - DNA, 22 bp, Artificial Sequence
  chemically synthesized
tggatttaaagaatgggtgaaa

SEQ ID NO: 751770 - DNA, 22 bp, Artificial Sequence
  chemically synthesized
agtcattgttgtttcacccatt

SEQ ID NO: 751771 - DNA, 22 bp, Artificial Sequence
  chemically synthesized
ttggatttaaagaatgggtgaa

SEQ ID NO: 751772 - DNA, 22 bp, Artificial Sequence
  chemically synthesized
gtcattgttgtttcacccattc

SEQ ID NO: 751773 - DNA, 22 bp, Artificial Sequence
  chemically synthesized
ttgtttcacccattctttaaat

SEQ ID NO: 751774 - DNA, 22 bp, Artificial Sequence
  chemically synthesized
tttcacccattctttaaatcca

SEQ ID NO: 751775 - DNA, 22 bp, Artificial Sequence
  chemically synthesized
gcaaatgtggcttttggattta

SEQ ID NO: 751776 - DNA, 22 bp, Artificial Sequence
  chemically synthesized
cacccattctttaaatccaaaa

SEQ ID NO: 751777 - DNA, 22 bp, Artificial Sequence
  chemically synthesized
acccattctttaaatccaaaag

SEQ ID NO: 751778 - DNA, 22 bp, Artificial Sequence
  chemically synthesized
tattagcaaatgtggcttttgg

SEQ ID NO: 751779 - DNA, 22 bp, Artificial Sequence
  chemically synthesized
tttaaatccaaaagccacattt

SEQ ID NO: 751780 - DNA, 22 bp, Artificial Sequence
  chemically synthesized
taattgtattagcaaatgtggc

SEQ ID NO: 751781 - DNA, 22 bp, Artificial Sequence
  chemically synthesized
taaatccaaaagccacatttgc

SEQ ID NO: 751782 - DNA, 22 bp, Artificial Sequence
  chemically synthesized
aaatccaaaagccacatttgct

SEQ ID NO: 751783 - DNA, 22 bp, Artificial Sequence
  chemically synthesized
tgtaattgtattagcaaatgtg

SEQ ID NO: 751784 - DNA, 22 bp, Artificial Sequence
  chemically synthesized
aatccaaaagccacatttgcta

SEQ ID NO: 751785 - DNA, 22 bp, Artificial Sequence
  chemically synthesized
gcattctgtaattgtattagca

SEQ ID NO: 751786 - DNA, 22 bp, Artificial Sequence
  chemically synthesized
agcattctgtaattgtattagc

SEQ ID NO: 751787 - DNA, 22 bp, Artificial Sequence
  chemically synthesized
tgagatttagcattctgtaatt

SEQ ID NO: 751788 - DNA, 22 bp, Artificial Sequence
  chemically synthesized
tgtgagatttagcattctgtaa

SEQ ID NO: 751789 - DNA, 22 bp, Artificial Sequence
  chemically synthesized
ctgtgagatttagcattctgta

SEQ ID NO: 751790 - DNA, 22 bp, Artificial Sequence
  chemically synthesized
gctaatacaattacagaatgct

SEQ ID NO: 751791 - DNA, 22 bp, Artificial Sequence
  chemically synthesized
ctaatacaattacagaatgcta

SEQ ID NO: 751792 - DNA, 22 bp, Artificial Sequence
  chemically synthesized
atacaattacagaatgctaaat

SEQ ID NO: 751793 - DNA, 22 bp, Artificial Sequence
  chemically synthesized
cagaatgctaaatctcacagaa

SEQ ID NO: 751794 - DNA, 22 bp, Artificial Sequence
  chemically synthesized
agtaatatgtgtttctgtgaga

SEQ ID NO: 751795 - DNA, 22 bp, Artificial Sequence
  chemically synthesized
aagaaactaagtaatatgtgtt

SEQ ID NO: 751796 - DNA, 22 bp, Artificial Sequence
  chemically synthesized
aatctcacagaaacacatatta

SEQ ID NO: 751797 - DNA, 22 bp, Artificial Sequence
  chemically synthesized
ttcaagaaactaagtaatatgt

SEQ ID NO: 751798 - DNA, 22 bp, Artificial Sequence
  chemically synthesized
ttattcaagaaactaagtaata

SEQ ID NO: 751799 - DNA, 22 bp, Artificial Sequence
  chemically synthesized
acagaaacacatattacttagt

SEQ ID NO: 751800 - DNA, 22 bp, Artificial Sequence
  chemically synthesized
gttattcaagaaactaagtaat

SEQ ID NO: 751801 - DNA, 22 bp, Artificial Sequence
  chemically synthesized
aataacttgttattcaagaaac

SEQ ID NO: 751802 - DNA, 22 bp, Artificial Sequence
  chemically synthesized
tgtgttaaataacttgttattc

SEQ ID NO: 751803 - DNA, 22 bp, Artificial Sequence
  chemically synthesized
cttagtttcttgaataacaagt

SEQ ID NO: 751804 - DNA, 22 bp, Artificial Sequence
  chemically synthesized
atgtgttaaataacttgttatt

SEQ ID NO: 751805 - DNA, 22 bp, Artificial Sequence
  chemically synthesized
agtttcttgaataacaagttat

SEQ ID NO: 751806 - DNA, 22 bp, Artificial Sequence
  chemically synthesized
gtttcttgaataacaagttatt

SEQ ID NO: 751807 - DNA, 22 bp, Artificial Sequence
  chemically synthesized
atcttatgtgttaaataacttg

SEQ ID NO: 751808 - DNA, 22 bp, Artificial Sequence
  chemically synthesized
tgatcttatgtgttaaataact

SEQ ID NO: 751809 - DNA, 22 bp, Artificial Sequence
  chemically synthesized
cttgaataacaagttatttaac

SEQ ID NO: 751810 - DNA, 22 bp, Artificial Sequence
  chemically synthesized
ttgaataacaagttatttaaca

SEQ ID NO: 751811 - DNA, 22 bp, Artificial Sequence
  chemically synthesized
gaataacaagttatttaacaca

SEQ ID NO: 751812 - DNA, 22 bp, Artificial Sequence
  chemically synthesized
aataacaagttatttaacacat

SEQ ID NO: 751813 - DNA, 22 bp, Artificial Sequence
  chemically synthesized
cattctgatcttatgtgttaaa

SEQ ID NO: 751814 - DNA, 22 bp, Artificial Sequence
  chemically synthesized
tttaacacataagatcagaatg

SEQ ID NO: 751815 - DNA, 22 bp, Artificial Sequence
  chemically synthesized
aacacataagatcagaatggag

SEQ ID NO: 751816 - DNA, 22 bp, Artificial Sequence
  chemically synthesized
acacataagatcagaatggagg

SEQ ID NO: 751817 - DNA, 22 bp, Artificial Sequence
  chemically synthesized
tcatagtaccccccctccattc

SEQ ID NO: 751818 - DNA, 22 bp, Artificial Sequence
  chemically synthesized
tatcatagtaccccccctccat

SEQ ID NO: 751819 - DNA, 22 bp, Artificial Sequence
  chemically synthesized
gacactctatcatagtaccccc

SEQ ID NO: 751820 - DNA, 22 bp, Artificial Sequence
  chemically synthesized
cccctagacactctatcatagt

SEQ ID NO: 751821 - DNA, 22 bp, Artificial Sequence
  chemically synthesized
acccctagacactctatcatag

SEQ ID NO: 751822 - DNA, 22 bp, Artificial Sequence
  chemically synthesized
cttacccctagacactctatca

SEQ ID NO: 751823 - DNA, 22 bp, Artificial Sequence
  chemically synthesized
ccttacccctagacactctatc

SEQ ID NO: 751824 - DNA, 22 bp, Artificial Sequence
  chemically synthesized
tccttacccctagacactctat

SEQ ID NO: 751825 - DNA, 22 bp, Artificial Sequence
  chemically synthesized
attttccttacccctagacact

SEQ ID NO: 751826 - DNA, 22 bp, Artificial Sequence
  chemically synthesized
tgatagagtgtctaggggtaag

SEQ ID NO: 751827 - DNA, 22 bp, Artificial Sequence
  chemically synthesized
tatatccatatcagttcatttt

SEQ ID NO: 751828 - DNA, 22 bp, Artificial Sequence
  chemically synthesized
atatatccatatcagttcattt

SEQ ID NO: 751829 - DNA, 22 bp, Artificial Sequence
  chemically synthesized
tatatatccatatcagttcatt

SEQ ID NO: 751830 - DNA, 22 bp, Artificial Sequence
  chemically synthesized
ggggtaaggaaaatgaactgat

SEQ ID NO: 751831 - DNA, 22 bp, Artificial Sequence
  chemically synthesized
gaagaacattttatatatccat

SEQ ID NO: 751832 - DNA, 22 bp, Artificial Sequence
  chemically synthesized
gctagaagaacattttatatat

SEQ ID NO: 751833 - DNA, 22 bp, Artificial Sequence
  chemically synthesized
atatggatatataaaatgttct

SEQ ID NO: 751834 - DNA, 22 bp, Artificial Sequence
  chemically synthesized
ggcagctagctagaagaacatt

SEQ ID NO: 751835 - DNA, 22 bp, Artificial Sequence
  chemically synthesized
ataactaggcagctagctagaa

SEQ ID NO: 751836 - DNA, 22 bp, Artificial Sequence
  chemically synthesized
cagcactgataactaggcagct

SEQ ID NO: 751837 - DNA, 22 bp, Artificial Sequence
  chemically synthesized
ttctagctagctgcctagttat

SEQ ID NO: 751838 - DNA, 22 bp, Artificial Sequence
  chemically synthesized
ctagctagctgcctagttatca

SEQ ID NO: 751839 - DNA, 22 bp, Artificial Sequence
  chemically synthesized
tagctagctgcctagttatcag

SEQ ID NO: 751840 - DNA, 22 bp, Artificial Sequence
  chemically synthesized
gctagctgcctagttatcagtg

SEQ ID NO: 751841 - DNA, 22 bp, Artificial Sequence
  chemically synthesized
gctgcctagttatcagtgctgt

SEQ ID NO: 751842 - DNA, 22 bp, Artificial Sequence
  chemically synthesized
ccaaagtggattacagcactga

SEQ ID NO: 751843 - DNA, 22 bp, Artificial Sequence
  chemically synthesized
cctagttatcagtgctgtaatc

SEQ ID NO: 751844 - DNA, 22 bp, Artificial Sequence
  chemically synthesized
gcctcccaaagtggattacagc

SEQ ID NO: 751845 - DNA, 22 bp, Artificial Sequence
  chemically synthesized
ggcctcccaaagtggattacag

SEQ ID NO: 751846 - DNA, 22 bp, Artificial Sequence
  chemically synthesized
gttatcagtgctgtaatccact

SEQ ID NO: 751847 - DNA, 22 bp, Artificial Sequence
  chemically synthesized
accttggcctcccaaagtggat

SEQ ID NO: 751848 - DNA, 22 bp, Artificial Sequence
  chemically synthesized
tcagtgctgtaatccactttgg

SEQ ID NO: 751849 - DNA, 22 bp, Artificial Sequence
  chemically synthesized
taatccactttgggaggccaag

SEQ ID NO: 751850 - DNA, 22 bp, Artificial Sequence
  chemically synthesized
aggtgatccactcaccttggcc

SEQ ID NO: 751851 - DNA, 22 bp, Artificial Sequence
  chemically synthesized
acctcaggtgatccactcacct

SEQ ID NO: 751852 - DNA, 22 bp, Artificial Sequence
  chemically synthesized
tgggaggccaaggtgagtggat

SEQ ID NO: 751853 - DNA, 22 bp, Artificial Sequence
  chemically synthesized
tgacctcaggtgatccactcac

SEQ ID NO: 751854 - DNA, 22 bp, Artificial Sequence
  chemically synthesized
gggaggccaaggtgagtggatc

SEQ ID NO: 751855 - DNA, 22 bp, Artificial Sequence
  chemically synthesized
ctgacctcaggtgatccactca

SEQ ID NO: 751856 - DNA, 22 bp, Artificial Sequence
  chemically synthesized
ggaggccaaggtgagtggatca

SEQ ID NO: 751857 - DNA, 22 bp, Artificial Sequence
  chemically synthesized
gaacttctgacctcaggtgatc

SEQ ID NO: 751858 - DNA, 22 bp, Artificial Sequence
  chemically synthesized
gtctcgaacttctgacctcagg

SEQ ID NO: 751859 - DNA, 22 bp, Artificial Sequence
  chemically synthesized
gccaggctagtctcgaacttct

SEQ ID NO: 751860 - DNA, 22 bp, Artificial Sequence
  chemically synthesized
aggtcagaagttcgagactagc

SEQ ID NO: 751861 - DNA, 22 bp, Artificial Sequence
  chemically synthesized
accatgttggccaggctagtct

SEQ ID NO: 751862 - DNA, 22 bp, Artificial Sequence
  chemically synthesized
caccatgttggccaggctagtc

SEQ ID NO: 751863 - DNA, 22 bp, Artificial Sequence
  chemically synthesized
gagactagcctggccaacatgg

SEQ ID NO: 751864 - DNA, 22 bp, Artificial Sequence
  chemically synthesized
gtagagatggggtttcaccatg

SEQ ID NO: 751865 - DNA, 22 bp, Artificial Sequence
  chemically synthesized
agtagagatggggtttcaccat

SEQ ID NO: 751866 - DNA, 22 bp, Artificial Sequence
  chemically synthesized
gcctggccaacatggtgaaacc

SEQ ID NO: 751867 - DNA, 22 bp, Artificial Sequence
  chemically synthesized
tagtagagatggggtttcacca

SEQ ID NO: 751868 - DNA, 22 bp, Artificial Sequence
  chemically synthesized
ttagtagagatggggtttcacc

SEQ ID NO: 751869 - DNA, 22 bp, Artificial Sequence
  chemically synthesized
tttagtagagatggggtttcac

SEQ ID NO: 751870 - DNA, 22 bp, Artificial Sequence
  chemically synthesized
gccaacatggtgaaaccccatc

SEQ ID NO: 751871 - DNA, 22 bp, Artificial Sequence
  chemically synthesized
tattttttagtagagatggggt

SEQ ID NO: 751872 - DNA, 22 bp, Artificial Sequence
  chemically synthesized
gtattttttagtagagatgggg

SEQ ID NO: 751873 - DNA, 22 bp, Artificial Sequence
  chemically synthesized
tgtattttttagtagagatggg

SEQ ID NO: 751874 - DNA, 22 bp, Artificial Sequence
  chemically synthesized
ttgtattttttagtagagatgg

SEQ ID NO: 751875 - DNA, 22 bp, Artificial Sequence
  chemically synthesized
tttgtattttttagtagagatg

SEQ ID NO: 751876 - DNA, 22 bp, Artificial Sequence
  chemically synthesized
ttttgtattttttagtagagat

SEQ ID NO: 751877 - DNA, 22 bp, Artificial Sequence
  chemically synthesized
tttttgtattttttagtagaga

SEQ ID NO: 751878 - DNA, 22 bp, Artificial Sequence
  chemically synthesized
ttttttgtattttttagtagag

SEQ ID NO: 751879 - DNA, 22 bp, Artificial Sequence
  chemically synthesized
tttttttgtattttttagtaga

SEQ ID NO: 751880 - DNA, 22 bp, Artificial Sequence
  chemically synthesized
ttttttttgtattttttagtag

SEQ ID NO: 751881 - DNA, 22 bp, Artificial Sequence
  chemically synthesized
tttttttttgtattttttagta

SEQ ID NO: 751882 - DNA, 22 bp, Artificial Sequence
  chemically synthesized
ttttttttttgtattttttagt

SEQ ID NO: 751883 - DNA, 22 bp, Artificial Sequence
  chemically synthesized
tttttttttttttgtatttttt

SEQ ID NO: 751884 - DNA, 22 bp, Artificial Sequence
  chemically synthesized
tactaaaaaatacaaaaaaaaa

SEQ ID NO: 751885 - DNA, 22 bp, Artificial Sequence
  chemically synthesized
ctaaaaaatacaaaaaaaaaaa

SEQ ID NO: 751886 - DNA, 22 bp, Artificial Sequence
  chemically synthesized
aaaaatacaaaaaaaaaaaaat

SEQ ID NO: 751887 - DNA, 22 bp, Artificial Sequence
  chemically synthesized
caggcgcccaccaccatgccca

SEQ ID NO: 751888 - DNA, 22 bp, Artificial Sequence
  chemically synthesized
ggactacaggcgcccaccacca

SEQ ID NO: 751889 - DNA, 22 bp, Artificial Sequence
  chemically synthesized
ggcatggtggtgggcgcctgta

SEQ ID NO: 751890 - DNA, 22 bp, Artificial Sequence
  chemically synthesized
ccaaatagctgggactacaggc

SEQ ID NO: 751891 - DNA, 22 bp, Artificial Sequence
  chemically synthesized
agcctcccaaatagctgggact

SEQ ID NO: 751892 - DNA, 22 bp, Artificial Sequence
  chemically synthesized
cgcctcagcctcccaaatagct

SEQ ID NO: 751893 - DNA, 22 bp, Artificial Sequence
  chemically synthesized
tccgcctcagcctcccaaatag

SEQ ID NO: 751894 - DNA, 22 bp, Artificial Sequence
  chemically synthesized
tagtcccagctatttgggaggc

SEQ ID NO: 751895 - DNA, 22 bp, Artificial Sequence
  chemically synthesized
aagcagttctccgcctcagcct

SEQ ID NO: 751896 - DNA, 22 bp, Artificial Sequence
  chemically synthesized
ggctcaagcagttctccgcctc

SEQ ID NO: 751897 - DNA, 22 bp, Artificial Sequence
  chemically synthesized
tttgggaggctgaggcggagaa

SEQ ID NO: 751898 - DNA, 22 bp, Artificial Sequence
  chemically synthesized
ctgggctcaagcagttctccgc

SEQ ID NO: 751899 - DNA, 22 bp, Artificial Sequence
  chemically synthesized
gggaggctgaggcggagaactg

SEQ ID NO: 751900 - DNA, 22 bp, Artificial Sequence
  chemically synthesized
ggaggctgaggcggagaactgc

SEQ ID NO: 751901 - DNA, 22 bp, Artificial Sequence
  chemically synthesized
cacctcctgggctcaagcagtt

SEQ ID NO: 751902 - DNA, 22 bp, Artificial Sequence
  chemically synthesized
aggcggagaactgcttgagccc

SEQ ID NO: 751903 - DNA, 22 bp, Artificial Sequence
  chemically synthesized
caacctccacctcctgggctca

SEQ ID NO: 751904 - DNA, 22 bp, Artificial Sequence
  chemically synthesized
actgcaacctccacctcctggg

SEQ ID NO: 751905 - DNA, 22 bp, Artificial Sequence
  chemically synthesized
ggctcactgcaacctccacctc

SEQ ID NO: 751906 - DNA, 22 bp, Artificial Sequence
  chemically synthesized
cttgagcccaggaggtggaggt

SEQ ID NO: 751907 - DNA, 22 bp, Artificial Sequence
  chemically synthesized
gagcccaggaggtggaggttgc

SEQ ID NO: 751908 - DNA, 22 bp, Artificial Sequence
  chemically synthesized
tctcggctcactgcaacctcca

SEQ ID NO: 751909 - DNA, 22 bp, Artificial Sequence
  chemically synthesized
agcccaggaggtggaggttgca

SEQ ID NO: 751910 - DNA, 22 bp, Artificial Sequence
  chemically synthesized
gagtgcagtggtgctatctcgg

SEQ ID NO: 751911 - DNA, 22 bp, Artificial Sequence
  chemically synthesized
cagtgagccgagatagcaccac

SEQ ID NO: 751912 - DNA, 22 bp, Artificial Sequence
  chemically synthesized
tcacccaggctggagtgcagtg

SEQ ID NO: 751913 - DNA, 22 bp, Artificial Sequence
  chemically synthesized
tgtcacccaggctggagtgcag

SEQ ID NO: 751914 - DNA, 22 bp, Artificial Sequence
  chemically synthesized
gctctgtcacccaggctggagt

SEQ ID NO: 751915 - DNA, 22 bp, Artificial Sequence
  chemically synthesized
cgacagtctcgctctgtcaccc

SEQ ID NO: 751916 - DNA, 22 bp, Artificial Sequence
  chemically synthesized
cactccagcctgggtgacagag

SEQ ID NO: 751917 - DNA, 22 bp, Artificial Sequence
  chemically synthesized
gcgacagtctcgctctgtcacc

SEQ ID NO: 751918 - DNA, 22 bp, Artificial Sequence
  chemically synthesized
tgcgacagtctcgctctgtcac

SEQ ID NO: 751919 - DNA, 22 bp, Artificial Sequence
  chemically synthesized
ttgcgacagtctcgctctgtca

SEQ ID NO: 751920 - DNA, 22 bp, Artificial Sequence
  chemically synthesized
tttgcgacagtctcgctctgtc

SEQ ID NO: 751921 - DNA, 22 bp, Artificial Sequence
  chemically synthesized
ttttgcgacagtctcgctctgt

SEQ ID NO: 751922 - DNA, 22 bp, Artificial Sequence
  chemically synthesized
cagcctgggtgacagagcgaga

SEQ ID NO: 751923 - DNA, 22 bp, Artificial Sequence
  chemically synthesized
tttttgcgacagtctcgctctg

SEQ ID NO: 751924 - DNA, 22 bp, Artificial Sequence
  chemically synthesized
ttttttgcgacagtctcgctct

SEQ ID NO: 751925 - DNA, 22 bp, Artificial Sequence
  chemically synthesized
tttttttgcgacagtctcgctc

SEQ ID NO: 751926 - DNA, 22 bp, Artificial Sequence
  chemically synthesized
ttttttttttgcgacagtctcg

SEQ ID NO: 751927 - DNA, 22 bp, Artificial Sequence
  chemically synthesized
attttttttttgcgacagtctc

SEQ ID NO: 751928 - DNA, 22 bp, Artificial Sequence
  chemically synthesized
ggtgacagagcgagactgtcgc

SEQ ID NO: 751929 - DNA, 22 bp, Artificial Sequence
  chemically synthesized
tattttttttttgcgacagtct

SEQ ID NO: 751930 - DNA, 22 bp, Artificial Sequence
  chemically synthesized
ttttattttttttttgcgacag

SEQ ID NO: 751931 - DNA, 22 bp, Artificial Sequence
  chemically synthesized
attttattttttttttgcgaca

SEQ ID NO: 751932 - DNA, 22 bp, Artificial Sequence
  chemically synthesized
tattttattttttttttgcgac

SEQ ID NO: 751933 - DNA, 22 bp, Artificial Sequence
  chemically synthesized
ttttattttattttttttttgc

SEQ ID NO: 751934 - DNA, 22 bp, Artificial Sequence
  chemically synthesized
attttattttattttttttttg

SEQ ID NO: 751935 - DNA, 22 bp, Artificial Sequence
  chemically synthesized
tattttattttatttttttttt

SEQ ID NO: 751936 - DNA, 22 bp, Artificial Sequence
  chemically synthesized
ttttattttattttattttttt

SEQ ID NO: 751937 - DNA, 22 bp, Artificial Sequence
  chemically synthesized
attttattttattttatttttt

SEQ ID NO: 751938 - DNA, 22 bp, Artificial Sequence
  chemically synthesized
tattttattttattttattttt

SEQ ID NO: 751939 - DNA, 22 bp, Artificial Sequence
  chemically synthesized
tcgcaaaaaaaaaataaaataa

SEQ ID NO: 751940 - DNA, 22 bp, Artificial Sequence
  chemically synthesized
ttttattttattttattttatt

SEQ ID NO: 751941 - DNA, 22 bp, Artificial Sequence
  chemically synthesized
attttattttattttattttat

SEQ ID NO: 751942 - DNA, 22 bp, Artificial Sequence
  chemically synthesized
tattttattttattttatttta

SEQ ID NO: 751943 - DNA, 22 bp, Artificial Sequence
  chemically synthesized
ttttattttattttattttatt

SEQ ID NO: 751944 - DNA, 22 bp, Artificial Sequence
  chemically synthesized
attttattttattttattttat

SEQ ID NO: 751945 - DNA, 22 bp, Artificial Sequence
  chemically synthesized
tattttattttattttatttta

SEQ ID NO: 751946 - DNA, 22 bp, Artificial Sequence
  chemically synthesized
ttttattttattttattttatt

SEQ ID NO: 751947 - DNA, 22 bp, Artificial Sequence
  chemically synthesized
attttattttattttattttat

SEQ ID NO: 751948 - DNA, 22 bp, Artificial Sequence
  chemically synthesized
tattttattttattttatttta

SEQ ID NO: 751949 - DNA, 22 bp, Artificial Sequence
  chemically synthesized
ttttattttattttattttatt

SEQ ID NO: 751950 - DNA, 22 bp, Artificial Sequence
  chemically synthesized
attttattttattttattttat

SEQ ID NO: 751951 - DNA, 22 bp, Artificial Sequence
  chemically synthesized
tattttattttattttatttta

SEQ ID NO: 751952 - DNA, 22 bp, Artificial Sequence
  chemically synthesized
ttattttattttattttatttt

SEQ ID NO: 751953 - DNA, 22 bp, Artificial Sequence
  chemically synthesized
tttattttattttattttattt

SEQ ID NO: 751954 - DNA, 22 bp, Artificial Sequence
  chemically synthesized
ttttattttattttattttatt

SEQ ID NO: 751955 - DNA, 22 bp, Artificial Sequence
  chemically synthesized
tttttattttattttattttat

SEQ ID NO: 751956 - DNA, 22 bp, Artificial Sequence
  chemically synthesized
tttttttattttattttatttt

SEQ ID NO: 751957 - DNA, 22 bp, Artificial Sequence
  chemically synthesized
tctttttttattttattttatt

SEQ ID NO: 751958 - DNA, 22 bp, Artificial Sequence
  chemically synthesized
ctctttttttattttattttat

SEQ ID NO: 751959 - DNA, 22 bp, Artificial Sequence
  chemically synthesized
ataaaccatggtttctcttttt

SEQ ID NO: 751960 - DNA, 22 bp, Artificial Sequence
  chemically synthesized
taataaaccatggtttctcttt

SEQ ID NO: 751961 - DNA, 22 bp, Artificial Sequence
  chemically synthesized
ctaataaaccatggtttctctt

SEQ ID NO: 751962 - DNA, 22 bp, Artificial Sequence
  chemically synthesized
tctaataaaccatggtttctct

SEQ ID NO: 751963 - DNA, 22 bp, Artificial Sequence
  chemically synthesized
ttctaataaaccatggtttctc

SEQ ID NO: 751964 - DNA, 22 bp, Artificial Sequence
  chemically synthesized
tagggaacttttctaataaacc

SEQ ID NO: 751965 - DNA, 22 bp, Artificial Sequence
  chemically synthesized
atgctgtagggaacttttctaa

SEQ ID NO: 751966 - DNA, 22 bp, Artificial Sequence
  chemically synthesized
agaggattcatgctgtagggaa

SEQ ID NO: 751967 - DNA, 22 bp, Artificial Sequence
  chemically synthesized
attagaaaagttccctacagca

SEQ ID NO: 751968 - DNA, 22 bp, Artificial Sequence
  chemically synthesized
ttagaaaagttccctacagcat

SEQ ID NO: 751969 - DNA, 22 bp, Artificial Sequence
  chemically synthesized
gaaaagttccctacagcatgaa

SEQ ID NO: 751970 - DNA, 22 bp, Artificial Sequence
  chemically synthesized
agccctcagaggattcatgctg

SEQ ID NO: 751971 - DNA, 22 bp, Artificial Sequence
  chemically synthesized
aagccctcagaggattcatgct

SEQ ID NO: 751972 - DNA, 22 bp, Artificial Sequence
  chemically synthesized
cctacagcatgaatcctctgag

SEQ ID NO: 751973 - DNA, 22 bp, Artificial Sequence
  chemically synthesized
agcaatttaagccctcagagga

SEQ ID NO: 751974 - DNA, 22 bp, Artificial Sequence
  chemically synthesized
cagcatgaatcctctgagggct

SEQ ID NO: 751975 - DNA, 22 bp, Artificial Sequence
  chemically synthesized
cactcagcaatttaagccctca

SEQ ID NO: 751976 - DNA, 22 bp, Artificial Sequence
  chemically synthesized
ccactcagcaatttaagccctc

SEQ ID NO: 751977 - DNA, 22 bp, Artificial Sequence
  chemically synthesized
tccactcagcaatttaagccct

SEQ ID NO: 751978 - DNA, 22 bp, Artificial Sequence
  chemically synthesized
ttccactcagcaatttaagccc

SEQ ID NO: 751979 - DNA, 22 bp, Artificial Sequence
  chemically synthesized
ccatttttccactcagcaattt

SEQ ID NO: 751980 - DNA, 22 bp, Artificial Sequence
  chemically synthesized
cccatttttccactcagcaatt

SEQ ID NO: 751981 - DNA, 22 bp, Artificial Sequence
  chemically synthesized
tgagggcttaaattgctgagtg

SEQ ID NO: 751982 - DNA, 22 bp, Artificial Sequence
  chemically synthesized
ttcccatttttccactcagcaa

SEQ ID NO: 751983 - DNA, 22 bp, Artificial Sequence
  chemically synthesized
agggcttaaattgctgagtgga

SEQ ID NO: 751984 - DNA, 22 bp, Artificial Sequence
  chemically synthesized
aaattgctgagtggaaaaatgg

SEQ ID NO: 751985 - DNA, 22 bp, Artificial Sequence
  chemically synthesized
aaaccactcttcccatttttcc

SEQ ID NO: 751986 - DNA, 22 bp, Artificial Sequence
  chemically synthesized
aattgctgagtggaaaaatggg

SEQ ID NO: 751987 - DNA, 22 bp, Artificial Sequence
  chemically synthesized
gaaaccactcttcccatttttc

SEQ ID NO: 751988 - DNA, 22 bp, Artificial Sequence
  chemically synthesized
ctgagtggaaaaatgggaagag

SEQ ID NO: 751989 - DNA, 22 bp, Artificial Sequence
  chemically synthesized
agtggaaaaatgggaagagtgg

SEQ ID NO: 751990 - DNA, 22 bp, Artificial Sequence
  chemically synthesized
agaaaaaaagtagaagtgtact

SEQ ID NO: 751991 - DNA, 22 bp, Artificial Sequence
  chemically synthesized
cagaaaaaaagtagaagtgtac

SEQ ID NO: 751992 - DNA, 22 bp, Artificial Sequence
  chemically synthesized
tttcagaaaaaaagtagaagtg

SEQ ID NO: 751993 - DNA, 22 bp, Artificial Sequence
  chemically synthesized
atttcagaaaaaaagtagaagt

SEQ ID NO: 751994 - DNA, 22 bp, Artificial Sequence
  chemically synthesized
caagtacacttctacttttttt

SEQ ID NO: 751995 - DNA, 22 bp, Artificial Sequence
  chemically synthesized
aagtacacttctactttttttc

SEQ ID NO: 751996 - DNA, 22 bp, Artificial Sequence
  chemically synthesized
aaatttatttcagaaaaaaagt

SEQ ID NO: 751997 - DNA, 22 bp, Artificial Sequence
  chemically synthesized
actaaaatttatttcagaaaaa

SEQ ID NO: 751998 - DNA, 22 bp, Artificial Sequence
  chemically synthesized
ttaactaaaatttatttcagaa

SEQ ID NO: 751999 - DNA, 22 bp, Artificial Sequence
  chemically synthesized
attaactaaaatttatttcaga

SEQ ID NO: 752000 - DNA, 22 bp, Artificial Sequence
  chemically synthesized
tattaactaaaatttatttcag

SEQ ID NO: 752001 - DNA, 22 bp, Artificial Sequence
  chemically synthesized
ctactttttttctgaaataaat

SEQ ID NO: 752002 - DNA, 22 bp, Artificial Sequence
  chemically synthesized
tactttttttctgaaataaatt

SEQ ID NO: 752003 - DNA, 22 bp, Artificial Sequence
  chemically synthesized
ctttttttctgaaataaatttt

SEQ ID NO: 752004 - DNA, 22 bp, Artificial Sequence
  chemically synthesized
tttttctgaaataaattttagt

SEQ ID NO: 752005 - DNA, 22 bp, Artificial Sequence
  chemically synthesized
ttttctgaaataaattttagtt

SEQ ID NO: 752006 - DNA, 22 bp, Artificial Sequence
  chemically synthesized
tttctgaaataaattttagtta

SEQ ID NO: 752007 - DNA, 22 bp, Artificial Sequence
  chemically synthesized
ttctgaaataaattttagttaa

SEQ ID NO: 752008 - DNA, 22 bp, Artificial Sequence
  chemically synthesized
tctgaaataaattttagttaat

SEQ ID NO: 752009 - DNA, 22 bp, Artificial Sequence
  chemically synthesized
ctgaaataaattttagttaata

SEQ ID NO: 752010 - DNA, 22 bp, Artificial Sequence
  chemically synthesized
tgaaataaattttagttaataa

SEQ ID NO: 752011 - DNA, 22 bp, Artificial Sequence
  chemically synthesized
caaagaatgagttttattaact

SEQ ID NO: 752012 - DNA, 22 bp, Artificial Sequence
  chemically synthesized
aaataaattttagttaataaaa

SEQ ID NO: 752013 - DNA, 22 bp, Artificial Sequence
  chemically synthesized
acaaagaatgagttttattaac

SEQ ID NO: 752014 - DNA, 22 bp, Artificial Sequence
  chemically synthesized
tagttaataaaactcattcttt

SEQ ID NO: 752015 - DNA, 22 bp, Artificial Sequence
  chemically synthesized
agttaataaaactcattctttg

SEQ ID NO: 752016 - DNA, 22 bp, Artificial Sequence
  chemically synthesized
gttaataaaactcattctttgt

SEQ ID NO: 752017 - DNA, 22 bp, Artificial Sequence
  chemically synthesized
ggggtagtagtttacaaagaat

SEQ ID NO: 752018 - DNA, 22 bp, Artificial Sequence
  chemically synthesized
gggggtagtagtttacaaagaa

SEQ ID NO: 752019 - DNA, 22 bp, Artificial Sequence
  chemically synthesized
tgggggtagtagtttacaaaga

SEQ ID NO: 752020 - DNA, 22 bp, Artificial Sequence
  chemically synthesized
ataaaactcattctttgtaaac

SEQ ID NO: 752021 - DNA, 22 bp, Artificial Sequence
  chemically synthesized
aagctttgggggtagtagttta

SEQ ID NO: 752022 - DNA, 22 bp, Artificial Sequence
  chemically synthesized
tgaagctttgggggtagtagtt

SEQ ID NO: 752023 - DNA, 22 bp, Artificial Sequence
  chemically synthesized
attctttgtaaactactacccc

SEQ ID NO: 752024 - DNA, 22 bp, Artificial Sequence
  chemically synthesized
tttgtaaactactacccccaaa

SEQ ID NO: 752025 - DNA, 22 bp, Artificial Sequence
  chemically synthesized
aaactctgaagctttgggggta

SEQ ID NO: 752026 - DNA, 22 bp, Artificial Sequence
  chemically synthesized
gaaactctgaagctttgggggt

SEQ ID NO: 752027 - DNA, 22 bp, Artificial Sequence
  chemically synthesized
tgtaaactactacccccaaagc

SEQ ID NO: 752028 - DNA, 22 bp, Artificial Sequence
  chemically synthesized
gtaaactactacccccaaagct

SEQ ID NO: 752029 - DNA, 22 bp, Artificial Sequence
  chemically synthesized
taaactactacccccaaagctt

SEQ ID NO: 752030 - DNA, 22 bp, Artificial Sequence
  chemically synthesized
ggtttgaaactctgaagctttg

SEQ ID NO: 752031 - DNA, 22 bp, Artificial Sequence
  chemically synthesized
ctacccccaaagcttcagagtt

SEQ ID NO: 752032 - DNA, 22 bp, Artificial Sequence
  chemically synthesized
acactgggtttgaaactctgaa

SEQ ID NO: 752033 - DNA, 22 bp, Artificial Sequence
  chemically synthesized
cccccaaagcttcagagtttca

SEQ ID NO: 752034 - DNA, 22 bp, Artificial Sequence
  chemically synthesized
ttgacactgggtttgaaactct

SEQ ID NO: 752035 - DNA, 22 bp, Artificial Sequence
  chemically synthesized
attgacactgggtttgaaactc

SEQ ID NO: 752036 - DNA, 22 bp, Artificial Sequence
  chemically synthesized
catcttattgacactgggtttg

SEQ ID NO: 752037 - DNA, 22 bp, Artificial Sequence
  chemically synthesized
cagagtttcaaacccagtgtca

SEQ ID NO: 752038 - DNA, 22 bp, Artificial Sequence
  chemically synthesized
agagtttcaaacccagtgtcaa

SEQ ID NO: 752039 - DNA, 22 bp, Artificial Sequence
  chemically synthesized
cactgcatcttattgacactgg

SEQ ID NO: 752040 - DNA, 22 bp, Artificial Sequence
  chemically synthesized
tccactgcatcttattgacact

SEQ ID NO: 752041 - DNA, 22 bp, Artificial Sequence
  chemically synthesized
ctccactgcatcttattgacac

SEQ ID NO: 752042 - DNA, 22 bp, Artificial Sequence
  chemically synthesized
tctccactgcatcttattgaca

SEQ ID NO: 752043 - DNA, 22 bp, Artificial Sequence
  chemically synthesized
ttctccactgcatcttattgac

SEQ ID NO: 752044 - DNA, 22 bp, Artificial Sequence
  chemically synthesized
caaacccagtgtcaataagatg

SEQ ID NO: 752045 - DNA, 22 bp, Artificial Sequence
  chemically synthesized
aaacccagtgtcaataagatgc

SEQ ID NO: 752046 - DNA, 22 bp, Artificial Sequence
  chemically synthesized
cagtggaaataaatcatttttc

SEQ ID NO: 752047 - DNA, 22 bp, Artificial Sequence
  chemically synthesized
gcagtggaaataaatcattttt

SEQ ID NO: 752048 - DNA, 22 bp, Artificial Sequence
  chemically synthesized
tgcagtggaaataaatcatttt

SEQ ID NO: 752049 - DNA, 22 bp, Artificial Sequence
  chemically synthesized
attttgcagtggaaataaatca

SEQ ID NO: 752050 - DNA, 22 bp, Artificial Sequence
  chemically synthesized
aattttgcagtggaaataaatc

SEQ ID NO: 752051 - DNA, 22 bp, Artificial Sequence
  chemically synthesized
taattttgcagtggaaataaat

SEQ ID NO: 752052 - DNA, 22 bp, Artificial Sequence
  chemically synthesized
tttaattttgcagtggaaataa

SEQ ID NO: 752053 - DNA, 22 bp, Artificial Sequence
  chemically synthesized
ctttaattttgcagtggaaata

SEQ ID NO: 752054 - DNA, 22 bp, Artificial Sequence
  chemically synthesized
ttctttaattttgcagtggaaa

SEQ ID NO: 752055 - DNA, 22 bp, Artificial Sequence
  chemically synthesized
ggtagctcttctttaattttgc

SEQ ID NO: 752056 - DNA, 22 bp, Artificial Sequence
  chemically synthesized
cggtagctcttctttaattttg

SEQ ID NO: 752057 - DNA, 22 bp, Artificial Sequence
  chemically synthesized
atttccactgcaaaattaaaga

SEQ ID NO: 752058 - DNA, 22 bp, Artificial Sequence
  chemically synthesized
tttccactgcaaaattaaagaa

SEQ ID NO: 752059 - DNA, 22 bp, Artificial Sequence
  chemically synthesized
ccttcggtagctcttctttaat

SEQ ID NO: 752060 - DNA, 22 bp, Artificial Sequence
  chemically synthesized
ccactgcaaaattaaagaagag

SEQ ID NO: 752061 - DNA, 22 bp, Artificial Sequence
  chemically synthesized
cactgcaaaattaaagaagagc

SEQ ID NO: 752062 - DNA, 22 bp, Artificial Sequence
  chemically synthesized
tctcccttcggtagctcttctt

SEQ ID NO: 752063 - DNA, 22 bp, Artificial Sequence
  chemically synthesized
atctcccttcggtagctcttct

SEQ ID NO: 752064 - DNA, 22 bp, Artificial Sequence
  chemically synthesized
caaaattaaagaagagctaccg

SEQ ID NO: 752065 - DNA, 22 bp, Artificial Sequence
  chemically synthesized
atatatatttatctcccttcgg

SEQ ID NO: 752066 - DNA, 22 bp, Artificial Sequence
  chemically synthesized
aagaagagctaccgaagggaga

SEQ ID NO: 752067 - DNA, 22 bp, Artificial Sequence
  chemically synthesized
catgaattcatatatatttatc

SEQ ID NO: 752068 - DNA, 22 bp, Artificial Sequence
  chemically synthesized
ccgaagggagataaatatatat

SEQ ID NO: 752069 - DNA, 22 bp, Artificial Sequence
  chemically synthesized
tgaattacatgaattcatatat

SEQ ID NO: 752070 - DNA, 22 bp, Artificial Sequence
  chemically synthesized
aaactatgaattacatgaattc

SEQ ID NO: 752071 - DNA, 22 bp, Artificial Sequence
  chemically synthesized
caaactatgaattacatgaatt

SEQ ID NO: 752072 - DNA, 22 bp, Artificial Sequence
  chemically synthesized
tgcgtgtttcaaactatgaatt

SEQ ID NO: 752073 - DNA, 22 bp, Artificial Sequence
  chemically synthesized
atgcgtgtttcaaactatgaat

SEQ ID NO: 752074 - DNA, 22 bp, Artificial Sequence
  chemically synthesized
tatgcgtgtttcaaactatgaa

SEQ ID NO: 752075 - DNA, 22 bp, Artificial Sequence
  chemically synthesized
tattttatgcgtgtttcaaact

SEQ ID NO: 752076 - DNA, 22 bp, Artificial Sequence
  chemically synthesized
atgtaattcatagtttgaaaca

SEQ ID NO: 752077 - DNA, 22 bp, Artificial Sequence
  chemically synthesized
tgttgtattttatgcgtgtttc

SEQ ID NO: 752078 - DNA, 22 bp, Artificial Sequence
  chemically synthesized
atagtttgaaacacgcataaaa

SEQ ID NO: 752079 - DNA, 22 bp, Artificial Sequence
  chemically synthesized
aatctgtgttgtattttatgcg

SEQ ID NO: 752080 - DNA, 22 bp, Artificial Sequence
  chemically synthesized
gaatctgtgttgtattttatgc

SEQ ID NO: 752081 - DNA, 22 bp, Artificial Sequence
  chemically synthesized
tgaatctgtgttgtattttatg

SEQ ID NO: 752082 - DNA, 22 bp, Artificial Sequence
  chemically synthesized
ttgaatctgtgttgtattttat

SEQ ID NO: 752083 - DNA, 22 bp, Artificial Sequence
  chemically synthesized
gaaacacgcataaaatacaaca

SEQ ID NO: 752084 - DNA, 22 bp, Artificial Sequence
  chemically synthesized
aaacacgcataaaatacaacac

SEQ ID NO: 752085 - DNA, 22 bp, Artificial Sequence
  chemically synthesized
ggcttttgaatctgtgttgtat

SEQ ID NO: 752086 - DNA, 22 bp, Artificial Sequence
  chemically synthesized
gtaatagtagatgtgattgggc

SEQ ID NO: 752087 - DNA, 22 bp, Artificial Sequence
  chemically synthesized
tgtactggtaatagtagatgtg

SEQ ID NO: 752088 - DNA, 22 bp, Artificial Sequence
  chemically synthesized
aaaagcccaatcacatctacta

SEQ ID NO: 752089 - DNA, 22 bp, Artificial Sequence
  chemically synthesized
atgtactggtaatagtagatgt

SEQ ID NO: 752090 - DNA, 22 bp, Artificial Sequence
  chemically synthesized
tatgtactggtaatagtagatg

SEQ ID NO: 752091 - DNA, 22 bp, Artificial Sequence
  chemically synthesized
ttatgtactggtaatagtagat

SEQ ID NO: 752092 - DNA, 22 bp, Artificial Sequence
  chemically synthesized
aatttttatgtactggtaatag

SEQ ID NO: 752093 - DNA, 22 bp, Artificial Sequence
  chemically synthesized
tctgaatttttatgtactggta

SEQ ID NO: 752094 - DNA, 22 bp, Artificial Sequence
  chemically synthesized
atctgaatttttatgtactggt

SEQ ID NO: 752095 - DNA, 22 bp, Artificial Sequence
  chemically synthesized
ctattaccagtacataaaaatt

SEQ ID NO: 752096 - DNA, 22 bp, Artificial Sequence
  chemically synthesized
tggtacttatctgaatttttat

SEQ ID NO: 752097 - DNA, 22 bp, Artificial Sequence
  chemically synthesized
ttaccagtacataaaaattcag

SEQ ID NO: 752098 - DNA, 22 bp, Artificial Sequence
  chemically synthesized
ccagtacataaaaattcagata

SEQ ID NO: 752099 - DNA, 22 bp, Artificial Sequence
  chemically synthesized
agttatggtacttatctgaatt

SEQ ID NO: 752100 - DNA, 22 bp, Artificial Sequence
  chemically synthesized
aagttatggtacttatctgaat

SEQ ID NO: 752101 - DNA, 22 bp, Artificial Sequence
  chemically synthesized
agataagtaccataacttaagt

SEQ ID NO: 752102 - DNA, 22 bp, Artificial Sequence
  chemically synthesized
agacatatatacacttaagtta

SEQ ID NO: 752103 - DNA, 22 bp, Artificial Sequence
  chemically synthesized
tcagacatatatacacttaagt

SEQ ID NO: 752104 - DNA, 22 bp, Artificial Sequence
  chemically synthesized
ctcagacatatatacacttaag

SEQ ID NO: 752105 - DNA, 22 bp, Artificial Sequence
  chemically synthesized
tctcagacatatatacacttaa

SEQ ID NO: 752106 - DNA, 22 bp, Artificial Sequence
  chemically synthesized
tctttctcagacatatatacac

SEQ ID NO: 752107 - DNA, 22 bp, Artificial Sequence
  chemically synthesized
aagtgtatatatgtctgagaaa

SEQ ID NO: 752108 - DNA, 22 bp, Artificial Sequence
  chemically synthesized
agtgtatatatgtctgagaaag

SEQ ID NO: 752109 - DNA, 22 bp, Artificial Sequence
  chemically synthesized
taacccagcacatctatctttc

SEQ ID NO: 752110 - DNA, 22 bp, Artificial Sequence
  chemically synthesized
ataacccagcacatctatcttt

SEQ ID NO: 752111 - DNA, 22 bp, Artificial Sequence
  chemically synthesized
tatttataacccagcacatcta

SEQ ID NO: 752112 - DNA, 22 bp, Artificial Sequence
  chemically synthesized
agaaagatagatgtgctgggtt

SEQ ID NO: 752113 - DNA, 22 bp, Artificial Sequence
  chemically synthesized
gaaaaattatatttataaccca

SEQ ID NO: 752114 - DNA, 22 bp, Artificial Sequence
  chemically synthesized
cgaaaaattatatttataaccc

SEQ ID NO: 752115 - DNA, 22 bp, Artificial Sequence
  chemically synthesized
tcgaaaaattatatttataacc

SEQ ID NO: 752116 - DNA, 22 bp, Artificial Sequence
  chemically synthesized
aacatacctttcgaaaaattat

SEQ ID NO: 752117 - DNA, 22 bp, Artificial Sequence
  chemically synthesized
ggttataaatataatttttcga

SEQ ID NO: 752118 - DNA, 22 bp, Artificial Sequence
  chemically synthesized
taaatataatttttcgaaaggt

SEQ ID NO: 752119 - DNA, 22 bp, Artificial Sequence
  chemically synthesized
ttcgaaaggtatgtttaatgtt

SEQ ID NO: 752120 - DNA, 22 bp, Artificial Sequence
  chemically synthesized
tcgaaaggtatgtttaatgttt

SEQ ID NO: 752121 - DNA, 22 bp, Artificial Sequence
  chemically synthesized
cgaaaggtatgtttaatgttta

SEQ ID NO: 752122 - DNA, 22 bp, Artificial Sequence
  chemically synthesized
gaaaggtatgtttaatgtttat

SEQ ID NO: 752123 - DNA, 22 bp, Artificial Sequence
  chemically synthesized
atcccaatgatagcaaaacata

SEQ ID NO: 752124 - DNA, 22 bp, Artificial Sequence
  chemically synthesized
tgatcccaatgatagcaaaaca

SEQ ID NO: 752125 - DNA, 22 bp, Artificial Sequence
  chemically synthesized
aatgtttatatgttttgctatc

SEQ ID NO: 752126 - DNA, 22 bp, Artificial Sequence
  chemically synthesized
atgtttatatgttttgctatca

SEQ ID NO: 752127 - DNA, 22 bp, Artificial Sequence
  chemically synthesized
attctgatcccaatgatagcaa

SEQ ID NO: 752128 - DNA, 22 bp, Artificial Sequence
  chemically synthesized
tcattctgatcccaatgatagc

SEQ ID NO: 752129 - DNA, 22 bp, Artificial Sequence
  chemically synthesized
atatgttttgctatcattggga

SEQ ID NO: 752130 - DNA, 22 bp, Artificial Sequence
  chemically synthesized
tatgttttgctatcattgggat

SEQ ID NO: 752131 - DNA, 22 bp, Artificial Sequence
  chemically synthesized
gtaaaactctcattctgatccc

SEQ ID NO: 752132 - DNA, 22 bp, Artificial Sequence
  chemically synthesized
tgctatcattgggatcagaatg

SEQ ID NO: 752133 - DNA, 22 bp, Artificial Sequence
  chemically synthesized
gctatcattgggatcagaatga

SEQ ID NO: 752134 - DNA, 22 bp, Artificial Sequence
  chemically synthesized
ctatcattgggatcagaatgag

SEQ ID NO: 752135 - DNA, 22 bp, Artificial Sequence
  chemically synthesized
attggtaaaactctcattctga

SEQ ID NO: 752136 - DNA, 22 bp, Artificial Sequence
  chemically synthesized
tcattgggatcagaatgagagt

SEQ ID NO: 752137 - DNA, 22 bp, Artificial Sequence
  chemically synthesized
ggatcagaatgagagttttacc

SEQ ID NO: 752138 - DNA, 22 bp, Artificial Sequence
  chemically synthesized
cataccctgattggtaaaactc

SEQ ID NO: 752139 - DNA, 22 bp, Artificial Sequence
  chemically synthesized
ccataccctgattggtaaaact

SEQ ID NO: 752140 - DNA, 22 bp, Artificial Sequence
  chemically synthesized
tccataccctgattggtaaaac

SEQ ID NO: 752141 - DNA, 22 bp, Artificial Sequence
  chemically synthesized
attttccataccctgattggta

SEQ ID NO: 752142 - DNA, 22 bp, Artificial Sequence
  chemically synthesized
cattttccataccctgattggt

SEQ ID NO: 752143 - DNA, 22 bp, Artificial Sequence
  chemically synthesized
agacaaacttcattttccatac

SEQ ID NO: 752144 - DNA, 22 bp, Artificial Sequence
  chemically synthesized
taccaatcagggtatggaaaat

SEQ ID NO: 752145 - DNA, 22 bp, Artificial Sequence
  chemically synthesized
aagacaaacttcattttccata

SEQ ID NO: 752146 - DNA, 22 bp, Artificial Sequence
  chemically synthesized
accaatcagggtatggaaaatg

SEQ ID NO: 752147 - DNA, 22 bp, Artificial Sequence
  chemically synthesized
ccaatcagggtatggaaaatga

SEQ ID NO: 752148 - DNA, 22 bp, Artificial Sequence
  chemically synthesized
gtcttaagacaaacttcatttt

SEQ ID NO: 752149 - DNA, 22 bp, Artificial Sequence
  chemically synthesized
ggtcttaagacaaacttcattt

SEQ ID NO: 752150 - DNA, 22 bp, Artificial Sequence
  chemically synthesized
ttggtcttaagacaaacttcat

SEQ ID NO: 752151 - DNA, 22 bp, Artificial Sequence
  chemically synthesized
ttcttggtcttaagacaaactt

SEQ ID NO: 752152 - DNA, 22 bp, Artificial Sequence
  chemically synthesized
tctgttcttggtcttaagacaa

SEQ ID NO: 752153 - DNA, 22 bp, Artificial Sequence
  chemically synthesized
atctgttcttggtcttaagaca

SEQ ID NO: 752154 - DNA, 22 bp, Artificial Sequence
  chemically synthesized
tcttatctgttcttggtcttaa

SEQ ID NO: 752155 - DNA, 22 bp, Artificial Sequence
  chemically synthesized
cctgtcttatctgttcttggtc

SEQ ID NO: 752156 - DNA, 22 bp, Artificial Sequence
  chemically synthesized
ccctgtcttatctgttcttggt

SEQ ID NO: 752157 - DNA, 22 bp, Artificial Sequence
  chemically synthesized
gtcttaagaccaagaacagata

SEQ ID NO: 752158 - DNA, 22 bp, Artificial Sequence
  chemically synthesized
gtttccctgtcttatctgttct

SEQ ID NO: 752159 - DNA, 22 bp, Artificial Sequence
  chemically synthesized
tcttaagaccaagaacagataa

SEQ ID NO: 752160 - DNA, 22 bp, Artificial Sequence
  chemically synthesized
agtttccctgtcttatctgttc

SEQ ID NO: 752161 - DNA, 22 bp, Artificial Sequence
  chemically synthesized
tagtttccctgtcttatctgtt

SEQ ID NO: 752162 - DNA, 22 bp, Artificial Sequence
  chemically synthesized
ttagtttccctgtcttatctgt

SEQ ID NO: 752163 - DNA, 22 bp, Artificial Sequence
  chemically synthesized
aagaccaagaacagataagaca

SEQ ID NO: 752164 - DNA, 22 bp, Artificial Sequence
  chemically synthesized
agaccaagaacagataagacag

SEQ ID NO: 752165 - DNA, 22 bp, Artificial Sequence
  chemically synthesized
cttttagtttccctgtcttatc

SEQ ID NO: 752166 - DNA, 22 bp, Artificial Sequence
  chemically synthesized
cggtattccttttagtttccct

SEQ ID NO: 752167 - DNA, 22 bp, Artificial Sequence
  chemically synthesized
gcggtattccttttagtttccc

SEQ ID NO: 752168 - DNA, 22 bp, Artificial Sequence
  chemically synthesized
tttgcggtattccttttagttt

SEQ ID NO: 752169 - DNA, 22 bp, Artificial Sequence
  chemically synthesized
acccaaccctatttgcggtatt

SEQ ID NO: 752170 - DNA, 22 bp, Artificial Sequence
  chemically synthesized
cacccaaccctatttgcggtat

SEQ ID NO: 752171 - DNA, 22 bp, Artificial Sequence
  chemically synthesized
gccttcacccaaccctatttgc

SEQ ID NO: 752172 - DNA, 22 bp, Artificial Sequence
  chemically synthesized
aaaggaataccgcaaatagggt

SEQ ID NO: 752173 - DNA, 22 bp, Artificial Sequence
  chemically synthesized
aagtatcagctggccttcaccc

SEQ ID NO: 752174 - DNA, 22 bp, Artificial Sequence
  chemically synthesized
ggtgaaggccagctgatacttg

SEQ ID NO: 752175 - DNA, 22 bp, Artificial Sequence
  chemically synthesized
aaagcataacagttcaagtatc

SEQ ID NO: 752176 - DNA, 22 bp, Artificial Sequence
  chemically synthesized
aaaataactaaaagcataacag

SEQ ID NO: 752177 - DNA, 22 bp, Artificial Sequence
  chemically synthesized
atacttgaactgttatgctttt

SEQ ID NO: 752178 - DNA, 22 bp, Artificial Sequence
  chemically synthesized
ataattaaaaataactaaaagc

SEQ ID NO: 752179 - DNA, 22 bp, Artificial Sequence
  chemically synthesized
aataattaaaaataactaaaag

SEQ ID NO: 752180 - DNA, 22 bp, Artificial Sequence
  chemically synthesized
gaactgttatgcttttagttat

SEQ ID NO: 752181 - DNA, 22 bp, Artificial Sequence
  chemically synthesized
aactgttatgcttttagttatt

SEQ ID NO: 752182 - DNA, 22 bp, Artificial Sequence
  chemically synthesized
ttatgcttttagttatttttaa

SEQ ID NO: 752183 - DNA, 22 bp, Artificial Sequence
  chemically synthesized
tgcttttagttatttttaatta

SEQ ID NO: 752184 - DNA, 22 bp, Artificial Sequence
  chemically synthesized
ttagttatttttaattattaaa

SEQ ID NO: 752185 - DNA, 22 bp, Artificial Sequence
  chemically synthesized
tagttatttttaattattaaat

SEQ ID NO: 752186 - DNA, 22 bp, Artificial Sequence
  chemically synthesized
agttatttttaattattaaatt

SEQ ID NO: 752187 - DNA, 22 bp, Artificial Sequence
  chemically synthesized
gttatttttaattattaaatta

SEQ ID NO: 752188 - DNA, 22 bp, Artificial Sequence
  chemically synthesized
tttttaattattaaattatgct

SEQ ID NO: 752189 - DNA, 22 bp, Artificial Sequence
  chemically synthesized
ttaattattaaattatgctgta

SEQ ID NO: 752190 - DNA, 22 bp, Artificial Sequence
  chemically synthesized
taattattaaattatgctgtac

SEQ ID NO: 752191 - DNA, 22 bp, Artificial Sequence
  chemically synthesized
aattattaaattatgctgtaca

SEQ ID NO: 752192 - DNA, 22 bp, Artificial Sequence
  chemically synthesized
attattaaattatgctgtacac

SEQ ID NO: 752193 - DNA, 22 bp, Artificial Sequence
  chemically synthesized
ttaaattatgctgtacacattc

SEQ ID NO: 752194 - DNA, 22 bp, Artificial Sequence
  chemically synthesized
aattatgctgtacacattctct

SEQ ID NO: 752195 - DNA, 22 bp, Artificial Sequence
  chemically synthesized
agtatggatggagaagagaatg

SEQ ID NO: 752196 - DNA, 22 bp, Artificial Sequence
  chemically synthesized
tgctgtacacattctcttctcc

SEQ ID NO: 752197 - DNA, 22 bp, Artificial Sequence
  chemically synthesized
tacacattctcttctccatcca

SEQ ID NO: 752198 - DNA, 22 bp, Artificial Sequence
  chemically synthesized
taagatactgagtatggatgga

SEQ ID NO: 752199 - DNA, 22 bp, Artificial Sequence
  chemically synthesized
gtaagatactgagtatggatgg

SEQ ID NO: 752200 - DNA, 22 bp, Artificial Sequence
  chemically synthesized
tcttctccatccatactcagta

SEQ ID NO: 752201 - DNA, 22 bp, Artificial Sequence
  chemically synthesized
ttctccatccatactcagtatc

SEQ ID NO: 752202 - DNA, 22 bp, Artificial Sequence
  chemically synthesized
ctccatccatactcagtatctt

SEQ ID NO: 752203 - DNA, 22 bp, Artificial Sequence
  chemically synthesized
tccatccatactcagtatctta

SEQ ID NO: 752204 - DNA, 22 bp, Artificial Sequence
  chemically synthesized
catccatactcagtatcttaca

SEQ ID NO: 752205 - DNA, 22 bp, Artificial Sequence
  chemically synthesized
tcacacaggtgcatttgtaaga

SEQ ID NO: 752206 - DNA, 22 bp, Artificial Sequence
  chemically synthesized
gtcacacaggtgcatttgtaag

SEQ ID NO: 752207 - DNA, 22 bp, Artificial Sequence
  chemically synthesized
agtatcttacaaatgcacctgt

SEQ ID NO: 752208 - DNA, 22 bp, Artificial Sequence
  chemically synthesized
gccatacttgtcacacaggtgc

SEQ ID NO: 752209 - DNA, 22 bp, Artificial Sequence
  chemically synthesized
agccatacttgtcacacaggtg

SEQ ID NO: 752210 - DNA, 22 bp, Artificial Sequence
  chemically synthesized
tagccatacttgtcacacaggt

SEQ ID NO: 752211 - DNA, 22 bp, Artificial Sequence
  chemically synthesized
ttagccatacttgtcacacagg

SEQ ID NO: 752212 - DNA, 22 bp, Artificial Sequence
  chemically synthesized
acaaatgcacctgtgtgacaag

SEQ ID NO: 752213 - DNA, 22 bp, Artificial Sequence
  chemically synthesized
caaatgcacctgtgtgacaagt

SEQ ID NO: 752214 - DNA, 22 bp, Artificial Sequence
  chemically synthesized
atttttagccatacttgtcaca

SEQ ID NO: 752215 - DNA, 22 bp, Artificial Sequence
  chemically synthesized
tgtgacaagtatggctaaaaat

SEQ ID NO: 752216 - DNA, 22 bp, Artificial Sequence
  chemically synthesized
tagagcagacataagggattca

SEQ ID NO: 752217 - DNA, 22 bp, Artificial Sequence
  chemically synthesized
aaaatgaatcccttatgtctgc

SEQ ID NO: 752218 - DNA, 22 bp, Artificial Sequence
  chemically synthesized
aatagataggctgtagagcaga

SEQ ID NO: 752219 - DNA, 22 bp, Artificial Sequence
  chemically synthesized
ctcaatagataggctgtagagc

SEQ ID NO: 752220 - DNA, 22 bp, Artificial Sequence
  chemically synthesized
aattgctcaatagataggctgt

SEQ ID NO: 752221 - DNA, 22 bp, Artificial Sequence
  chemically synthesized
atgtctgctctacagcctatct

SEQ ID NO: 752222 - DNA, 22 bp, Artificial Sequence
  chemically synthesized
tgtctgctctacagcctatcta

SEQ ID NO: 752223 - DNA, 22 bp, Artificial Sequence
  chemically synthesized
ctctacagcctatctattgagc

SEQ ID NO: 752224 - DNA, 22 bp, Artificial Sequence
  chemically synthesized
tacagcctatctattgagcaat

SEQ ID NO: 752225 - DNA, 22 bp, Artificial Sequence
  chemically synthesized
atatgtcaattaaattgctcaa

SEQ ID NO: 752226 - DNA, 22 bp, Artificial Sequence
  chemically synthesized
cagcctatctattgagcaattt

SEQ ID NO: 752227 - DNA, 22 bp, Artificial Sequence
  chemically synthesized
gttaatatgtcaattaaattgc

SEQ ID NO: 752228 - DNA, 22 bp, Artificial Sequence
  chemically synthesized
tctattgagcaatttaattgac

SEQ ID NO: 752229 - DNA, 22 bp, Artificial Sequence
  chemically synthesized
aattagttaatatgtcaattaa

SEQ ID NO: 752230 - DNA, 22 bp, Artificial Sequence
  chemically synthesized
ttgagcaatttaattgacatat

SEQ ID NO: 752231 - DNA, 22 bp, Artificial Sequence
  chemically synthesized
agcaatttaattgacatattaa

SEQ ID NO: 752232 - DNA, 22 bp, Artificial Sequence
  chemically synthesized
aattgacatattaactaattta

SEQ ID NO: 752233 - DNA, 22 bp, Artificial Sequence
  chemically synthesized
attgacatattaactaatttag

SEQ ID NO: 752234 - DNA, 22 bp, Artificial Sequence
  chemically synthesized
acatattaactaatttagttcc

SEQ ID NO: 752235 - DNA, 22 bp, Artificial Sequence
  chemically synthesized
ggaaaatgtcccagtggaacta

SEQ ID NO: 752236 - DNA, 22 bp, Artificial Sequence
  chemically synthesized
actaatttagttccactgggac

SEQ ID NO: 752237 - DNA, 22 bp, Artificial Sequence
  chemically synthesized
atttagttccactgggacattt

SEQ ID NO: 752238 - DNA, 22 bp, Artificial Sequence
  chemically synthesized
agttccactgggacattttcct

SEQ ID NO: 752239 - DNA, 22 bp, Artificial Sequence
  chemically synthesized
gttccactgggacattttccta

SEQ ID NO: 752240 - DNA, 22 bp, Artificial Sequence
  chemically synthesized
cactgggacattttcctaactt

SEQ ID NO: 752241 - DNA, 22 bp, Artificial Sequence
  chemically synthesized
caaaaatgagaaataagttagg

SEQ ID NO: 752242 - DNA, 22 bp, Artificial Sequence
  chemically synthesized
tccaaaaatgagaaataagtta

SEQ ID NO: 752243 - DNA, 22 bp, Artificial Sequence
  chemically synthesized
ggacattttcctaacttatttc

SEQ ID NO: 752244 - DNA, 22 bp, Artificial Sequence
  chemically synthesized
ctccaaaaatgagaaataagtt

SEQ ID NO: 752245 - DNA, 22 bp, Artificial Sequence
  chemically synthesized
tcctaacttatttctcattttt

SEQ ID NO: 752246 - DNA, 22 bp, Artificial Sequence
  chemically synthesized
acagacttctccaaaaatgaga

SEQ ID NO: 752247 - DNA, 22 bp, Artificial Sequence
  chemically synthesized
cctaacttatttctcatttttg

SEQ ID NO: 752248 - DNA, 22 bp, Artificial Sequence
  chemically synthesized
gacagacttctccaaaaatgag

SEQ ID NO: 752249 - DNA, 22 bp, Artificial Sequence
  chemically synthesized
ctaacttatttctcatttttgg

SEQ ID NO: 752250 - DNA, 22 bp, Artificial Sequence
  chemically synthesized
tgacagacttctccaaaaatga

SEQ ID NO: 752251 - DNA, 22 bp, Artificial Sequence
  chemically synthesized
ttgacagacttctccaaaaatg

SEQ ID NO: 752252 - DNA, 22 bp, Artificial Sequence
  chemically synthesized
tttgacagacttctccaaaaat

SEQ ID NO: 752253 - DNA, 22 bp, Artificial Sequence
  chemically synthesized
acttatttctcatttttggaga

SEQ ID NO: 752254 - DNA, 22 bp, Artificial Sequence
  chemically synthesized
attttttgacagacttctccaa

SEQ ID NO: 752255 - DNA, 22 bp, Artificial Sequence
  chemically synthesized
atttctcatttttggagaagtc

SEQ ID NO: 752256 - DNA, 22 bp, Artificial Sequence
  chemically synthesized
tttctcatttttggagaagtct

SEQ ID NO: 752257 - DNA, 22 bp, Artificial Sequence
  chemically synthesized
ctcatttttggagaagtctgtc

SEQ ID NO: 752258 - DNA, 22 bp, Artificial Sequence
  chemically synthesized
tcatttttggagaagtctgtca

SEQ ID NO: 752259 - DNA, 22 bp, Artificial Sequence
  chemically synthesized
atttttggagaagtctgtcaaa

SEQ ID NO: 752260 - DNA, 22 bp, Artificial Sequence
  chemically synthesized
ttggagaagtctgtcaaaaaat

SEQ ID NO: 752261 - DNA, 22 bp, Artificial Sequence
  chemically synthesized
tggagaagtctgtcaaaaaatt

SEQ ID NO: 752262 - DNA, 22 bp, Artificial Sequence
  chemically synthesized
ggagaagtctgtcaaaaaatta

SEQ ID NO: 752263 - DNA, 22 bp, Artificial Sequence
  chemically synthesized
gagaagtctgtcaaaaaattag

SEQ ID NO: 752264 - DNA, 22 bp, Artificial Sequence
  chemically synthesized
aaaaatatagggactaattttt

SEQ ID NO: 752265 - DNA, 22 bp, Artificial Sequence
  chemically synthesized
ttcaaaaatatagggactaatt

SEQ ID NO: 752266 - DNA, 22 bp, Artificial Sequence
  chemically synthesized
attcaaaaatatagggactaat

SEQ ID NO: 752267 - DNA, 22 bp, Artificial Sequence
  chemically synthesized
tattcaaaaatatagggactaa

SEQ ID NO: 752268 - DNA, 22 bp, Artificial Sequence
  chemically synthesized
tcaaaaaattagtccctatatt

SEQ ID NO: 752269 - DNA, 22 bp, Artificial Sequence
  chemically synthesized
attttattcaaaaatataggga

SEQ ID NO: 752270 - DNA, 22 bp, Artificial Sequence
  chemically synthesized
aatatgttgattttattcaaaa

SEQ ID NO: 752271 - DNA, 22 bp, Artificial Sequence
  chemically synthesized
gtccctatatttttgaataaaa

SEQ ID NO: 752272 - DNA, 22 bp, Artificial Sequence
  chemically synthesized
tatttttgaataaaatcaacat

SEQ ID NO: 752273 - DNA, 22 bp, Artificial Sequence
  chemically synthesized
aaagcattaaatatgttgattt

SEQ ID NO: 752274 - DNA, 22 bp, Artificial Sequence
  chemically synthesized
aaaagcattaaatatgttgatt

SEQ ID NO: 752275 - DNA, 22 bp, Artificial Sequence
  chemically synthesized
taaaagcattaaatatgttgat

SEQ ID NO: 752276 - DNA, 22 bp, Artificial Sequence
  chemically synthesized
ttgaataaaatcaacatattta

SEQ ID NO: 752277 - DNA, 22 bp, Artificial Sequence
  chemically synthesized
tgaataaaatcaacatatttaa

SEQ ID NO: 752278 - DNA, 22 bp, Artificial Sequence
  chemically synthesized
gaataaaatcaacatatttaat

SEQ ID NO: 752279 - DNA, 22 bp, Artificial Sequence
  chemically synthesized
aataaaatcaacatatttaatg

SEQ ID NO: 752280 - DNA, 22 bp, Artificial Sequence
  chemically synthesized
gtattttaaaagcattaaatat

SEQ ID NO: 752281 - DNA, 22 bp, Artificial Sequence
  chemically synthesized
cctagtattttaaaagcattaa

SEQ ID NO: 752282 - DNA, 22 bp, Artificial Sequence
  chemically synthesized
aaatgtattacctagtatttta

SEQ ID NO: 752283 - DNA, 22 bp, Artificial Sequence
  chemically synthesized
gaaatgtattacctagtatttt

SEQ ID NO: 752284 - DNA, 22 bp, Artificial Sequence
  chemically synthesized
tgaaatgtattacctagtattt

SEQ ID NO: 752285 - DNA, 22 bp, Artificial Sequence
  chemically synthesized
aatgcttttaaaatactaggta

SEQ ID NO: 752286 - DNA, 22 bp, Artificial Sequence
  chemically synthesized
atgcttttaaaatactaggtaa

SEQ ID NO: 752287 - DNA, 22 bp, Artificial Sequence
  chemically synthesized
agggttttgaaatgtattacct

SEQ ID NO: 752288 - DNA, 22 bp, Artificial Sequence
  chemically synthesized
ttaaaatactaggtaatacatt

SEQ ID NO: 752289 - DNA, 22 bp, Artificial Sequence
  chemically synthesized
taaaatactaggtaatacattt

SEQ ID NO: 752290 - DNA, 22 bp, Artificial Sequence
  chemically synthesized
aaaatactaggtaatacatttc

SEQ ID NO: 752291 - DNA, 22 bp, Artificial Sequence
  chemically synthesized
aaatactaggtaatacatttca

SEQ ID NO: 752292 - DNA, 22 bp, Artificial Sequence
  chemically synthesized
gaaaactaagggttttgaaatg

SEQ ID NO: 752293 - DNA, 22 bp, Artificial Sequence
  chemically synthesized
ggtaatacatttcaaaaccctt

SEQ ID NO: 752294 - DNA, 22 bp, Artificial Sequence
  chemically synthesized
tgtactggaaaactaagggttt

SEQ ID NO: 752295 - DNA, 22 bp, Artificial Sequence
  chemically synthesized
ctgtgtactggaaaactaaggg

SEQ ID NO: 752296 - DNA, 22 bp, Artificial Sequence
  chemically synthesized
gctgtgtactggaaaactaagg

SEQ ID NO: 752297 - DNA, 22 bp, Artificial Sequence
  chemically synthesized
accttgctgtgtactggaaaac

SEQ ID NO: 752298 - DNA, 22 bp, Artificial Sequence
  chemically synthesized
caaaacccttagttttccagta

SEQ ID NO: 752299 - DNA, 22 bp, Artificial Sequence
  chemically synthesized
aaaacccttagttttccagtac

SEQ ID NO: 752300 - DNA, 22 bp, Artificial Sequence
  chemically synthesized
agttttccagtacacagcaagg

SEQ ID NO: 752301 - DNA, 22 bp, Artificial Sequence
  chemically synthesized
gttttccagtacacagcaaggt

SEQ ID NO: 752302 - DNA, 22 bp, Artificial Sequence
  chemically synthesized
aagtaagggttaaccttgctgt

SEQ ID NO: 752303 - DNA, 22 bp, Artificial Sequence
  chemically synthesized
aaagtaagggttaaccttgctg

SEQ ID NO: 752304 - DNA, 22 bp, Artificial Sequence
  chemically synthesized
tccagtacacagcaaggttaac

SEQ ID NO: 752305 - DNA, 22 bp, Artificial Sequence
  chemically synthesized
ccagtacacagcaaggttaacc

SEQ ID NO: 752306 - DNA, 22 bp, Artificial Sequence
  chemically synthesized
cagtacacagcaaggttaaccc

SEQ ID NO: 752307 - DNA, 22 bp, Artificial Sequence
  chemically synthesized
acatttaaagtaagggttaacc

SEQ ID NO: 752308 - DNA, 22 bp, Artificial Sequence
  chemically synthesized
tgaccccatgtctaacatttaa

SEQ ID NO: 752309 - DNA, 22 bp, Artificial Sequence
  chemically synthesized
atgaccccatgtctaacattta

SEQ ID NO: 752310 - DNA, 22 bp, Artificial Sequence
  chemically synthesized
tatgaccccatgtctaacattt

SEQ ID NO: 752311 - DNA, 22 bp, Artificial Sequence
  chemically synthesized
acccttactttaaatgttagac

SEQ ID NO: 752312 - DNA, 22 bp, Artificial Sequence
  chemically synthesized
actttaaatgttagacatgggg

SEQ ID NO: 752313 - DNA, 22 bp, Artificial Sequence
  chemically synthesized
ctttaaatgttagacatggggt

SEQ ID NO: 752314 - DNA, 22 bp, Artificial Sequence
  chemically synthesized
taaatgttagacatggggtcat

SEQ ID NO: 752315 - DNA, 22 bp, Artificial Sequence
  chemically synthesized
ccccaatgttttatgaccccat

SEQ ID NO: 752316 - DNA, 22 bp, Artificial Sequence
  chemically synthesized
aaatgttagacatggggtcata

SEQ ID NO: 752317 - DNA, 22 bp, Artificial Sequence
  chemically synthesized
aatgttagacatggggtcataa

SEQ ID NO: 752318 - DNA, 22 bp, Artificial Sequence
  chemically synthesized
taccccaatgttttatgacccc

SEQ ID NO: 752319 - DNA, 22 bp, Artificial Sequence
  chemically synthesized
ctaccccaatgttttatgaccc

SEQ ID NO: 752320 - DNA, 22 bp, Artificial Sequence
  chemically synthesized
gacatggggtcataaaacattg

SEQ ID NO: 752321 - DNA, 22 bp, Artificial Sequence
  chemically synthesized
taaaatcccttctaccccaatg

SEQ ID NO: 752322 - DNA, 22 bp, Artificial Sequence
  chemically synthesized
gtaaaatcccttctaccccaat

SEQ ID NO: 752323 - DNA, 22 bp, Artificial Sequence
  chemically synthesized
atacttgtaaaatcccttctac

SEQ ID NO: 752324 - DNA, 22 bp, Artificial Sequence
  chemically synthesized
taatacttgtaaaatcccttct

SEQ ID NO: 752325 - DNA, 22 bp, Artificial Sequence
  chemically synthesized
actctaatacttgtaaaatccc

SEQ ID NO: 752326 - DNA, 22 bp, Artificial Sequence
  chemically synthesized
gactctaatacttgtaaaatcc

SEQ ID NO: 752327 - DNA, 22 bp, Artificial Sequence
  chemically synthesized
gggtagaagggattttacaagt

SEQ ID NO: 752328 - DNA, 22 bp, Artificial Sequence
  chemically synthesized
aaaatttgactctaatacttgt

SEQ ID NO: 752329 - DNA, 22 bp, Artificial Sequence
  chemically synthesized
tacaagtattagagtcaaattt

SEQ ID NO: 752330 - DNA, 22 bp, Artificial Sequence
  chemically synthesized
acaagtattagagtcaaatttt

SEQ ID NO: 752331 - DNA, 22 bp, Artificial Sequence
  chemically synthesized
caagtattagagtcaaattttt

SEQ ID NO: 752332 - DNA, 22 bp, Artificial Sequence
  chemically synthesized
aaaagaaaagattaaaaatttg

SEQ ID NO: 752333 - DNA, 22 bp, Artificial Sequence
  chemically synthesized
aaaaagaaaagattaaaaattt

SEQ ID NO: 752334 - DNA, 22 bp, Artificial Sequence
  chemically synthesized
taaaaagaaaagattaaaaatt

SEQ ID NO: 752335 - DNA, 22 bp, Artificial Sequence
  chemically synthesized
ttaaaaagaaaagattaaaaat

SEQ ID NO: 752336 - DNA, 22 bp, Artificial Sequence
  chemically synthesized
gagtcaaatttttaatcttttc

SEQ ID NO: 752337 - DNA, 22 bp, Artificial Sequence
  chemically synthesized
ttaatcttttctttttaaaaat

SEQ ID NO: 752338 - DNA, 22 bp, Artificial Sequence
  chemically synthesized
taatcttttctttttaaaaatt

SEQ ID NO: 752339 - DNA, 22 bp, Artificial Sequence
  chemically synthesized
aatcttttctttttaaaaattt

SEQ ID NO: 752340 - DNA, 22 bp, Artificial Sequence
  chemically synthesized
aaatagtaggtaaaatttttaa

SEQ ID NO: 752341 - DNA, 22 bp, Artificial Sequence
  chemically synthesized
atcttttctttttaaaaatttt

SEQ ID NO: 752342 - DNA, 22 bp, Artificial Sequence
  chemically synthesized
attaaaatagtaggtaaaattt

SEQ ID NO: 752343 - DNA, 22 bp, Artificial Sequence
  chemically synthesized
cattaaaatagtaggtaaaatt

SEQ ID NO: 752344 - DNA, 22 bp, Artificial Sequence
  chemically synthesized
ttctttttaaaaattttaccta

SEQ ID NO: 752345 - DNA, 22 bp, Artificial Sequence
  chemically synthesized
tctttttaaaaattttacctac

SEQ ID NO: 752346 - DNA, 22 bp, Artificial Sequence
  chemically synthesized
ttcattaaaatagtaggtaaaa

SEQ ID NO: 752347 - DNA, 22 bp, Artificial Sequence
  chemically synthesized
ctttttaaaaattttacctact

SEQ ID NO: 752348 - DNA, 22 bp, Artificial Sequence
  chemically synthesized
tttttaaaaattttacctacta

SEQ ID NO: 752349 - DNA, 22 bp, Artificial Sequence
  chemically synthesized
tttaaaaattttacctactatt

SEQ ID NO: 752350 - DNA, 22 bp, Artificial Sequence
  chemically synthesized
ttaaaaattttacctactattt

SEQ ID NO: 752351 - DNA, 22 bp, Artificial Sequence
  chemically synthesized
taaaaattttacctactatttt

SEQ ID NO: 752352 - DNA, 22 bp, Artificial Sequence
  chemically synthesized
aaaaattttacctactatttta

SEQ ID NO: 752353 - DNA, 22 bp, Artificial Sequence
  chemically synthesized
aaaattttacctactattttaa

SEQ ID NO: 752354 - DNA, 22 bp, Artificial Sequence
  chemically synthesized
catagctcttcattaaaatagt

SEQ ID NO: 752355 - DNA, 22 bp, Artificial Sequence
  chemically synthesized
aattgcatagctcttcattaaa

SEQ ID NO: 752356 - DNA, 22 bp, Artificial Sequence
  chemically synthesized
tacctactattttaatgaagag

SEQ ID NO: 752357 - DNA, 22 bp, Artificial Sequence
  chemically synthesized
acctactattttaatgaagagc

SEQ ID NO: 752358 - DNA, 22 bp, Artificial Sequence
  chemically synthesized
cctactattttaatgaagagct

SEQ ID NO: 752359 - DNA, 22 bp, Artificial Sequence
  chemically synthesized
atgttgaattgcatagctcttc

SEQ ID NO: 752360 - DNA, 22 bp, Artificial Sequence
  chemically synthesized
ctattttaatgaagagctatgc

SEQ ID NO: 752361 - DNA, 22 bp, Artificial Sequence
  chemically synthesized
ttttaatgaagagctatgcaat

SEQ ID NO: 752362 - DNA, 22 bp, Artificial Sequence
  chemically synthesized
tggtctaatgttgaattgcata

SEQ ID NO: 752363 - DNA, 22 bp, Artificial Sequence
  chemically synthesized
taatgaagagctatgcaattca

SEQ ID NO: 752364 - DNA, 22 bp, Artificial Sequence
  chemically synthesized
aatgaagagctatgcaattcaa

SEQ ID NO: 752365 - DNA, 22 bp, Artificial Sequence
  chemically synthesized
atgaagagctatgcaattcaac

SEQ ID NO: 752366 - DNA, 22 bp, Artificial Sequence
  chemically synthesized
atgaagcctatggtctaatgtt

SEQ ID NO: 752367 - DNA, 22 bp, Artificial Sequence
  chemically synthesized
catgaagcctatggtctaatgt

SEQ ID NO: 752368 - DNA, 22 bp, Artificial Sequence
  chemically synthesized
tgcaattcaacattagaccata

SEQ ID NO: 752369 - DNA, 22 bp, Artificial Sequence
  chemically synthesized
ccttcatgaagcctatggtcta

SEQ ID NO: 752370 - DNA, 22 bp, Artificial Sequence
  chemically synthesized
aacattagaccataggcttcat

SEQ ID NO: 752371 - DNA, 22 bp, Artificial Sequence
  chemically synthesized
atcattgccttcatgaagccta

SEQ ID NO: 752372 - DNA, 22 bp, Artificial Sequence
  chemically synthesized
gatcattgccttcatgaagcct

SEQ ID NO: 752373 - DNA, 22 bp, Artificial Sequence
  chemically synthesized
gaccataggcttcatgaaggca

SEQ ID NO: 752374 - DNA, 22 bp, Artificial Sequence
  chemically synthesized
taaaagaaacagacttgatcat

SEQ ID NO: 752375 - DNA, 22 bp, Artificial Sequence
  chemically synthesized
catgaaggcaatgatcaagtct

SEQ ID NO: 752376 - DNA, 22 bp, Artificial Sequence
  chemically synthesized
atgaaggcaatgatcaagtctg

SEQ ID NO: 752377 - DNA, 22 bp, Artificial Sequence
  chemically synthesized
gacaggtagttataaaagaaac

SEQ ID NO: 752378 - DNA, 22 bp, Artificial Sequence
  chemically synthesized
tataatgtgctggacaggtagt

SEQ ID NO: 752379 - DNA, 22 bp, Artificial Sequence
  chemically synthesized
tttcttttataactacctgtcc

SEQ ID NO: 752380 - DNA, 22 bp, Artificial Sequence
  chemically synthesized
cttttataactacctgtccagc

SEQ ID NO: 752381 - DNA, 22 bp, Artificial Sequence
  chemically synthesized
ttttataactacctgtccagca

SEQ ID NO: 752382 - DNA, 22 bp, Artificial Sequence
  chemically synthesized
ttataactacctgtccagcaca

SEQ ID NO: 752383 - DNA, 22 bp, Artificial Sequence
  chemically synthesized
tataactacctgtccagcacat

SEQ ID NO: 752384 - DNA, 22 bp, Artificial Sequence
  chemically synthesized
ataactacctgtccagcacatt

SEQ ID NO: 752385 - DNA, 22 bp, Artificial Sequence
  chemically synthesized
taactacctgtccagcacatta

SEQ ID NO: 752386 - DNA, 22 bp, Artificial Sequence
  chemically synthesized
tgagtcattatataatgtgctg

SEQ ID NO: 752387 - DNA, 22 bp, Artificial Sequence
  chemically synthesized
atgagtcattatataatgtgct

SEQ ID NO: 752388 - DNA, 22 bp, Artificial Sequence
  chemically synthesized
tttatgagtcattatataatgt

SEQ ID NO: 752389 - DNA, 22 bp, Artificial Sequence
  chemically synthesized
cctgtccagcacattatataat

SEQ ID NO: 752390 - DNA, 22 bp, Artificial Sequence
  chemically synthesized
tccagcacattatataatgact

SEQ ID NO: 752391 - DNA, 22 bp, Artificial Sequence
  chemically synthesized
aacaactgtttatgagtcatta

SEQ ID NO: 752392 - DNA, 22 bp, Artificial Sequence
  chemically synthesized
actcaacaactgtttatgagtc

SEQ ID NO: 752393 - DNA, 22 bp, Artificial Sequence
  chemically synthesized
ttcactcaacaactgtttatga

SEQ ID NO: 752394 - DNA, 22 bp, Artificial Sequence
  chemically synthesized
attcactcaacaactgtttatg

SEQ ID NO: 752395 - DNA, 22 bp, Artificial Sequence
  chemically synthesized
tataatgactcataaacagttg

SEQ ID NO: 752396 - DNA, 22 bp, Artificial Sequence
  chemically synthesized
atttattcactcaacaactgtt

SEQ ID NO: 752397 - DNA, 22 bp, Artificial Sequence
  chemically synthesized
catttattcactcaacaactgt

SEQ ID NO: 752398 - DNA, 22 bp, Artificial Sequence
  chemically synthesized
ataaacagttgttgagtgaata

SEQ ID NO: 752399 - DNA, 22 bp, Artificial Sequence
  chemically synthesized
ggtaccttcatttattcactca

SEQ ID NO: 752400 - DNA, 22 bp, Artificial Sequence
  chemically synthesized
attaggtaccttcatttattca

SEQ ID NO: 752401 - DNA, 22 bp, Artificial Sequence
  chemically synthesized
ttgagtgaataaatgaaggtac

SEQ ID NO: 752402 - DNA, 22 bp, Artificial Sequence
  chemically synthesized
agtgaataaatgaaggtaccta

SEQ ID NO: 752403 - DNA, 22 bp, Artificial Sequence
  chemically synthesized
gcccagggccagcaacatatga

SEQ ID NO: 752404 - DNA, 22 bp, Artificial Sequence
  chemically synthesized
atgagattcctcatatgttgct

SEQ ID NO: 752405 - DNA, 22 bp, Artificial Sequence
  chemically synthesized
ctagcccagggccagcaacata

SEQ ID NO: 752406 - DNA, 22 bp, Artificial Sequence
  chemically synthesized
ggctgctagcccagggccagca

SEQ ID NO: 752407 - DNA, 22 bp, Artificial Sequence
  chemically synthesized
gggctgctagcccagggccagc

SEQ ID NO: 752408 - DNA, 22 bp, Artificial Sequence
  chemically synthesized
tgggctgctagcccagggccag

SEQ ID NO: 752409 - DNA, 22 bp, Artificial Sequence
  chemically synthesized
ctcatatgttgctggccctggg

SEQ ID NO: 752410 - DNA, 22 bp, Artificial Sequence
  chemically synthesized
atatgttgctggccctgggcta

SEQ ID NO: 752411 - DNA, 22 bp, Artificial Sequence
  chemically synthesized
tacatctttgggctgctagccc

SEQ ID NO: 752412 - DNA, 22 bp, Artificial Sequence
  chemically synthesized
ctggccctgggctagcagccca

SEQ ID NO: 752413 - DNA, 22 bp, Artificial Sequence
  chemically synthesized
gccctgggctagcagcccaaag

SEQ ID NO: 752414 - DNA, 22 bp, Artificial Sequence
  chemically synthesized
ggctagcagcccaaagatgtac

SEQ ID NO: 752415 - DNA, 22 bp, Artificial Sequence
  chemically synthesized
gcagcccaaagatgtacagcat

SEQ ID NO: 752416 - DNA, 22 bp, Artificial Sequence
  chemically synthesized
agagcaaggatcatgctgtaca

SEQ ID NO: 752417 - DNA, 22 bp, Artificial Sequence
  chemically synthesized
ctaagagcaaggatcatgctgt

SEQ ID NO: 752418 - DNA, 22 bp, Artificial Sequence
  chemically synthesized
ccagagaaagtgaagttgctaa

SEQ ID NO: 752419 - DNA, 22 bp, Artificial Sequence
  chemically synthesized
tcccagagaaagtgaagttgct

SEQ ID NO: 752420 - DNA, 22 bp, Artificial Sequence
  chemically synthesized
ctcccagagaaagtgaagttgc

SEQ ID NO: 752421 - DNA, 22 bp, Artificial Sequence
  chemically synthesized
tctcccagagaaagtgaagttg

SEQ ID NO: 752422 - DNA, 22 bp, Artificial Sequence
  chemically synthesized
ttctcccagagaaagtgaagtt

SEQ ID NO: 752423 - DNA, 22 bp, Artificial Sequence
  chemically synthesized
tttctcccagagaaagtgaagt

SEQ ID NO: 752424 - DNA, 22 bp, Artificial Sequence
  chemically synthesized
ttttctcccagagaaagtgaag

SEQ ID NO: 752425 - DNA, 22 bp, Artificial Sequence
  chemically synthesized
gctcttagcaacttcactttct

SEQ ID NO: 752426 - DNA, 22 bp, Artificial Sequence
  chemically synthesized
tttttctcccagagaaagtgaa

SEQ ID NO: 752427 - DNA, 22 bp, Artificial Sequence
  chemically synthesized
ctcttagcaacttcactttctc

SEQ ID NO: 752428 - DNA, 22 bp, Artificial Sequence
  chemically synthesized
ttttttctcccagagaaagtga

SEQ ID NO: 752429 - DNA, 22 bp, Artificial Sequence
  chemically synthesized
ttagcaacttcactttctctgg

SEQ ID NO: 752430 - DNA, 22 bp, Artificial Sequence
  chemically synthesized
agcaacttcactttctctggga

SEQ ID NO: 752431 - DNA, 22 bp, Artificial Sequence
  chemically synthesized
gcaacttcactttctctgggag

SEQ ID NO: 752432 - DNA, 22 bp, Artificial Sequence
  chemically synthesized
tgcatttttttttctcccagag

SEQ ID NO: 752433 - DNA, 22 bp, Artificial Sequence
  chemically synthesized
atgcatttttttttctcccaga

SEQ ID NO: 752434 - DNA, 22 bp, Artificial Sequence
  chemically synthesized
cttatgcatttttttttctccc

SEQ ID NO: 752435 - DNA, 22 bp, Artificial Sequence
  chemically synthesized
gcttatgcatttttttttctcc

SEQ ID NO: 752436 - DNA, 22 bp, Artificial Sequence
  chemically synthesized
cactttctctgggagaaaaaaa

SEQ ID NO: 752437 - DNA, 22 bp, Artificial Sequence
  chemically synthesized
actttctctgggagaaaaaaaa

SEQ ID NO: 752438 - DNA, 22 bp, Artificial Sequence
  chemically synthesized
tctctgggagaaaaaaaaatgc

SEQ ID NO: 752439 - DNA, 22 bp, Artificial Sequence
  chemically synthesized
ctctgggagaaaaaaaaatgca

SEQ ID NO: 752440 - DNA, 22 bp, Artificial Sequence
  chemically synthesized
tctgggagaaaaaaaaatgcat

SEQ ID NO: 752441 - DNA, 22 bp, Artificial Sequence
  chemically synthesized
tagcaacttgcttatgcatttt

SEQ ID NO: 752442 - DNA, 22 bp, Artificial Sequence
  chemically synthesized
tgggagaaaaaaaaatgcataa

SEQ ID NO: 752443 - DNA, 22 bp, Artificial Sequence
  chemically synthesized
ggagaaaaaaaaatgcataagc

SEQ ID NO: 752444 - DNA, 22 bp, Artificial Sequence
  chemically synthesized
acatatattgtagcaacttgct

SEQ ID NO: 752445 - DNA, 22 bp, Artificial Sequence
  chemically synthesized
cacatatattgtagcaacttgc

SEQ ID NO: 752446 - DNA, 22 bp, Artificial Sequence
  chemically synthesized
aatttcacatatattgtagcaa

SEQ ID NO: 752447 - DNA, 22 bp, Artificial Sequence
  chemically synthesized
aaatttcacatatattgtagca

SEQ ID NO: 752448 - DNA, 22 bp, Artificial Sequence
  chemically synthesized
tcacacttaaatttcacatata

SEQ ID NO: 752449 - DNA, 22 bp, Artificial Sequence
  chemically synthesized
aattgtcacacttaaatttcac

SEQ ID NO: 752450 - DNA, 22 bp, Artificial Sequence
  chemically synthesized
ctacaatatatgtgaaatttaa

SEQ ID NO: 752451 - DNA, 22 bp, Artificial Sequence
  chemically synthesized
caatatatgtgaaatttaagtg

SEQ ID NO: 752452 - DNA, 22 bp, Artificial Sequence
  chemically synthesized
atagatcaccaagcatgctaaa

SEQ ID NO: 752453 - DNA, 22 bp, Artificial Sequence
  chemically synthesized
aagtgtgacaatttagcatgct

SEQ ID NO: 752454 - DNA, 22 bp, Artificial Sequence
  chemically synthesized
agtgtgacaatttagcatgctt

SEQ ID NO: 752455 - DNA, 22 bp, Artificial Sequence
  chemically synthesized
tcatagatcaccaagcatgcta

SEQ ID NO: 752456 - DNA, 22 bp, Artificial Sequence
  chemically synthesized
gtactctcatagatcaccaagc

SEQ ID NO: 752457 - DNA, 22 bp, Artificial Sequence
  chemically synthesized
cagttggtactctcatagatca

SEQ ID NO: 752458 - DNA, 22 bp, Artificial Sequence
  chemically synthesized
agcatgcttggtgatctatgag

SEQ ID NO: 752459 - DNA, 22 bp, Artificial Sequence
  chemically synthesized
acagttggtactctcatagatc

SEQ ID NO: 752460 - DNA, 22 bp, Artificial Sequence
  chemically synthesized
gcatgcttggtgatctatgaga

SEQ ID NO: 752461 - DNA, 22 bp, Artificial Sequence
  chemically synthesized
cttacagttggtactctcatag

SEQ ID NO: 752462 - DNA, 22 bp, Artificial Sequence
  chemically synthesized
ggtgatctatgagagtaccaac

SEQ ID NO: 752463 - DNA, 22 bp, Artificial Sequence
  chemically synthesized
gtgatctatgagagtaccaact

SEQ ID NO: 752464 - DNA, 22 bp, Artificial Sequence
  chemically synthesized
tgagagtaccaactgtaagcag

SEQ ID NO: 752465 - DNA, 22 bp, Artificial Sequence
  chemically synthesized
ccaccaagcagaagaaactgct

SEQ ID NO: 752466 - DNA, 22 bp, Artificial Sequence
  chemically synthesized
taagcagtttcttctgcttggt

SEQ ID NO: 752467 - DNA, 22 bp, Artificial Sequence
  chemically synthesized
caacccccaactcccaccaagc

SEQ ID NO: 752468 - DNA, 22 bp, Artificial Sequence
  chemically synthesized
cttctgcttggtgggagttggg

SEQ ID NO: 752469 - DNA, 22 bp, Artificial Sequence
  chemically synthesized
ttctgcttggtgggagttgggg

SEQ ID NO: 752470 - DNA, 22 bp, Artificial Sequence
  chemically synthesized
agtgtctacaacccccaactcc

SEQ ID NO: 752471 - DNA, 22 bp, Artificial Sequence
  chemically synthesized
ctgcttggtgggagttgggggt

SEQ ID NO: 752472 - DNA, 22 bp, Artificial Sequence
  chemically synthesized
tgcttggtgggagttgggggtt

SEQ ID NO: 752473 - DNA, 22 bp, Artificial Sequence
  chemically synthesized
ctgagtgtctacaacccccaac

SEQ ID NO: 752474 - DNA, 22 bp, Artificial Sequence
  chemically synthesized
cctgagtgtctacaacccccaa

SEQ ID NO: 752475 - DNA, 22 bp, Artificial Sequence
  chemically synthesized
cttggtgggagttgggggttgt

SEQ ID NO: 752476 - DNA, 22 bp, Artificial Sequence
  chemically synthesized
tcctgagtgtctacaaccccca

SEQ ID NO: 752477 - DNA, 22 bp, Artificial Sequence
  chemically synthesized
ggtgggagttgggggttgtaga

SEQ ID NO: 752478 - DNA, 22 bp, Artificial Sequence
  chemically synthesized
gtgggagttgggggttgtagac

SEQ ID NO: 752479 - DNA, 22 bp, Artificial Sequence
  chemically synthesized
tctttcctgagtgtctacaacc

SEQ ID NO: 752480 - DNA, 22 bp, Artificial Sequence
  chemically synthesized
ttgtctttcctgagtgtctaca

SEQ ID NO: 752481 - DNA, 22 bp, Artificial Sequence
  chemically synthesized
gttgtctttcctgagtgtctac

SEQ ID NO: 752482 - DNA, 22 bp, Artificial Sequence
  chemically synthesized
tgttgtctttcctgagtgtcta

SEQ ID NO: 752483 - DNA, 22 bp, Artificial Sequence
  chemically synthesized
tctttgttgtctttcctgagtg

SEQ ID NO: 752484 - DNA, 22 bp, Artificial Sequence
  chemically synthesized
ggggttgtagacactcaggaaa

SEQ ID NO: 752485 - DNA, 22 bp, Artificial Sequence
  chemically synthesized
cctatctttgttgtctttcctg

SEQ ID NO: 752486 - DNA, 22 bp, Artificial Sequence
  chemically synthesized
tagacactcaggaaagacaaca

SEQ ID NO: 752487 - DNA, 22 bp, Artificial Sequence
  chemically synthesized
aggaaagacaacaaagataggt

SEQ ID NO: 752488 - DNA, 22 bp, Artificial Sequence
  chemically synthesized
aaggaccagccaaaatgttacc

SEQ ID NO: 752489 - DNA, 22 bp, Artificial Sequence
  chemically synthesized
agccctcaaggaccagccaaaa

SEQ ID NO: 752490 - DNA, 22 bp, Artificial Sequence
  chemically synthesized
cagccctcaaggaccagccaaa

SEQ ID NO: 752491 - DNA, 22 bp, Artificial Sequence
  chemically synthesized
cttcagccctcaaggaccagcc

SEQ ID NO: 752492 - DNA, 22 bp, Artificial Sequence
  chemically synthesized
tccttcagccctcaaggaccag

SEQ ID NO: 752493 - DNA, 22 bp, Artificial Sequence
  chemically synthesized
gcgaattctccttcagccctca

SEQ ID NO: 752494 - DNA, 22 bp, Artificial Sequence
  chemically synthesized
tggctggtccttgagggctgaa

SEQ ID NO: 752495 - DNA, 22 bp, Artificial Sequence
  chemically synthesized
ggcgaattctccttcagccctc

SEQ ID NO: 752496 - DNA, 22 bp, Artificial Sequence
  chemically synthesized
ggctggtccttgagggctgaag

SEQ ID NO: 752497 - DNA, 22 bp, Artificial Sequence
  chemically synthesized
gctggtccttgagggctgaagg

SEQ ID NO: 752498 - DNA, 22 bp, Artificial Sequence
  chemically synthesized
cttggcgaattctccttcagcc

SEQ ID NO: 752499 - DNA, 22 bp, Artificial Sequence
  chemically synthesized
gtccttgagggctgaaggagaa

SEQ ID NO: 752500 - DNA, 22 bp, Artificial Sequence
  chemically synthesized
tctacttggcgaattctccttc

SEQ ID NO: 752501 - DNA, 22 bp, Artificial Sequence
  chemically synthesized
gagggctgaaggagaattcgcc

SEQ ID NO: 752502 - DNA, 22 bp, Artificial Sequence
  chemically synthesized
cgttgtctacttggcgaattct

SEQ ID NO: 752503 - DNA, 22 bp, Artificial Sequence
  chemically synthesized
agggctgaaggagaattcgcca

SEQ ID NO: 752504 - DNA, 22 bp, Artificial Sequence
  chemically synthesized
aaggagaattcgccaagtagac

SEQ ID NO: 752505 - DNA, 22 bp, Artificial Sequence
  chemically synthesized
gatccccctacgttgtctactt

SEQ ID NO: 752506 - DNA, 22 bp, Artificial Sequence
  chemically synthesized
tctggatccccctacgttgtct

SEQ ID NO: 752507 - DNA, 22 bp, Artificial Sequence
  chemically synthesized
tgtctggatccccctacgttgt

SEQ ID NO: 752508 - DNA, 22 bp, Artificial Sequence
  chemically synthesized
tctgtctggatccccctacgtt

SEQ ID NO: 752509 - DNA, 22 bp, Artificial Sequence
  chemically synthesized
gccaagtagacaacgtaggggg

SEQ ID NO: 752510 - DNA, 22 bp, Artificial Sequence
  chemically synthesized
tctctgtctggatccccctacg

SEQ ID NO: 752511 - DNA, 22 bp, Artificial Sequence
  chemically synthesized
ttctctctgtctggatccccct

SEQ ID NO: 752512 - DNA, 22 bp, Artificial Sequence
  chemically synthesized
caaatgctgttctctctgtctg

SEQ ID NO: 752513 - DNA, 22 bp, Artificial Sequence
  chemically synthesized
gcaaatgctgttctctctgtct

SEQ ID NO: 752514 - DNA, 22 bp, Artificial Sequence
  chemically synthesized
tgcaaatgctgttctctctgtc

SEQ ID NO: 752515 - DNA, 22 bp, Artificial Sequence
  chemically synthesized
cctttgcaaatgctgttctctc

SEQ ID NO: 752516 - DNA, 22 bp, Artificial Sequence
  chemically synthesized
gcaaaggcagatatatctatat

SEQ ID NO: 752517 - DNA, 22 bp, Artificial Sequence
  chemically synthesized
caaaggcagatatatctatatc

SEQ ID NO: 752518 - DNA, 22 bp, Artificial Sequence
  chemically synthesized
tatctatatctatgtgtatata

SEQ ID NO: 752519 - DNA, 22 bp, Artificial Sequence
  chemically synthesized
tatctatgtgtatatatatgtg

SEQ ID NO: 752520 - DNA, 22 bp, Artificial Sequence
  chemically synthesized
tgtgtatatatatgtgtatatc

SEQ ID NO: 752521 - DNA, 22 bp, Artificial Sequence
  chemically synthesized
gatatatacatagtatatatac

SEQ ID NO: 752522 - DNA, 22 bp, Artificial Sequence
  chemically synthesized
tgtatatatgtatatatactat

SEQ ID NO: 752523 - DNA, 22 bp, Artificial Sequence
  chemically synthesized
tgtatatatctaactatgtatg

SEQ ID NO: 752524 - DNA, 22 bp, Artificial Sequence
  chemically synthesized
actatgtatgtgtgtgtgtgta

SEQ ID NO: 752525 - DNA, 22 bp, Artificial Sequence
  chemically synthesized
tgtatgtgtgtgtgtgtatata

SEQ ID NO: 752526 - DNA, 22 bp, Artificial Sequence
  chemically synthesized
taaagtatgtgtgtgtgtgtgt

SEQ ID NO: 752527 - DNA, 22 bp, Artificial Sequence
  chemically synthesized
aatgtgtgtgtctgtaaagtat

SEQ ID NO: 752528 - DNA, 22 bp, Artificial Sequence
  chemically synthesized
tacagacacacacattcaatac

SEQ ID NO: 752529 - DNA, 22 bp, Artificial Sequence
  chemically synthesized
acagacacacacattcaataca

SEQ ID NO: 752530 - DNA, 22 bp, Artificial Sequence
  chemically synthesized
cagacacacacattcaatacac

SEQ ID NO: 752531 - DNA, 22 bp, Artificial Sequence
  chemically synthesized
ggaaaaaggggtgatatgggca

SEQ ID NO: 752532 - DNA, 22 bp, Artificial Sequence
  chemically synthesized
gggaaaaaggggtgatatgggc

SEQ ID NO: 752533 - DNA, 22 bp, Artificial Sequence
  chemically synthesized
aatacactctgcccatatcacc

SEQ ID NO: 752534 - DNA, 22 bp, Artificial Sequence
  chemically synthesized
tgcccatatcacccctttttcc

SEQ ID NO: 752535 - DNA, 22 bp, Artificial Sequence
  chemically synthesized
cccatatcacccctttttccca

SEQ ID NO: 752536 - DNA, 22 bp, Artificial Sequence
  chemically synthesized
tttcccaaatatgccatcacat

SEQ ID NO: 752537 - DNA, 22 bp, Artificial Sequence
  chemically synthesized
ttcccaaatatgccatcacata

SEQ ID NO: 752538 - DNA, 22 bp, Artificial Sequence
  chemically synthesized
tcccaaatatgccatcacatat

SEQ ID NO: 752539 - DNA, 22 bp, Artificial Sequence
  chemically synthesized
cccaaatatgccatcacatata

SEQ ID NO: 752540 - DNA, 22 bp, Artificial Sequence
  chemically synthesized
ccaaatatgccatcacatatat

SEQ ID NO: 752541 - DNA, 22 bp, Artificial Sequence
  chemically synthesized
cccatatgatatatatatatat

SEQ ID NO: 752542 - DNA, 22 bp, Artificial Sequence
  chemically synthesized
tgcccatatgatatatatatat

SEQ ID NO: 752543 - DNA, 22 bp, Artificial Sequence
  chemically synthesized
atacactctgcccatatgatat

SEQ ID NO: 752544 - DNA, 22 bp, Artificial Sequence
  chemically synthesized
aatacactctgcccatatgata

SEQ ID NO: 752545 - DNA, 22 bp, Artificial Sequence
  chemically synthesized
cagaccatttaatacactctgc

SEQ ID NO: 752546 - DNA, 22 bp, Artificial Sequence
  chemically synthesized
tccagaccatttaatacactct

SEQ ID NO: 752547 - DNA, 22 bp, Artificial Sequence
  chemically synthesized
ttctccagaccatttaatacac

SEQ ID NO: 752548 - DNA, 22 bp, Artificial Sequence
  chemically synthesized
ctattctccagaccatttaata

SEQ ID NO: 752549 - DNA, 22 bp, Artificial Sequence
  chemically synthesized
agccatagctcctattctccag

SEQ ID NO: 752550 - DNA, 22 bp, Artificial Sequence
  chemically synthesized
tcagccatagctcctattctcc

SEQ ID NO: 752551 - DNA, 22 bp, Artificial Sequence
  chemically synthesized
ctcagccatagctcctattctc

SEQ ID NO: 752552 - DNA, 22 bp, Artificial Sequence
  chemically synthesized
aatggtctggagaataggagct

SEQ ID NO: 752553 - DNA, 22 bp, Artificial Sequence
  chemically synthesized
ccttctcagccatagctcctat

SEQ ID NO: 752554 - DNA, 22 bp, Artificial Sequence
  chemically synthesized
accttctcagccatagctccta

SEQ ID NO: 752555 - DNA, 22 bp, Artificial Sequence
  chemically synthesized
acttaccttctcagccatagct

SEQ ID NO: 752556 - DNA, 22 bp, Artificial Sequence
  chemically synthesized
gacttaccttctcagccatagc

SEQ ID NO: 752557 - DNA, 22 bp, Artificial Sequence
  chemically synthesized
gagaataggagctatggctgag

SEQ ID NO: 752558 - DNA, 22 bp, Artificial Sequence
  chemically synthesized
gccttgacttaccttctcagcc

SEQ ID NO: 752559 - DNA, 22 bp, Artificial Sequence
  chemically synthesized
ctagccttgacttaccttctca

SEQ ID NO: 752560 - DNA, 22 bp, Artificial Sequence
  chemically synthesized
cctagccttgacttaccttctc

SEQ ID NO: 752561 - DNA, 22 bp, Artificial Sequence
  chemically synthesized
ttcctagccttgacttaccttc

SEQ ID NO: 752562 - DNA, 22 bp, Artificial Sequence
  chemically synthesized
cttcctagccttgacttacctt

SEQ ID NO: 752563 - DNA, 22 bp, Artificial Sequence
  chemically synthesized
tcttcctagccttgacttacct

SEQ ID NO: 752564 - DNA, 22 bp, Artificial Sequence
  chemically synthesized
ttcttcctagccttgacttacc

SEQ ID NO: 752565 - DNA, 22 bp, Artificial Sequence
  chemically synthesized
tggctgagaaggtaagtcaagg

SEQ ID NO: 752566 - DNA, 22 bp, Artificial Sequence
  chemically synthesized
agaaggtaagtcaaggctagga

SEQ ID NO: 752567 - DNA, 22 bp, Artificial Sequence
  chemically synthesized
cgtggcccttttcttcctagcc

SEQ ID NO: 752568 - DNA, 22 bp, Artificial Sequence
  chemically synthesized
ggaagaaaagggccacgtaatc

SEQ ID NO: 752569 - DNA, 22 bp, Artificial Sequence
  chemically synthesized
gagaatgaaatccaatgaataa

SEQ ID NO: 752570 - DNA, 22 bp, Artificial Sequence
  chemically synthesized
cctagagaatgaaatccaatga

SEQ ID NO: 752571 - DNA, 22 bp, Artificial Sequence
  chemically synthesized
gcctagagaatgaaatccaatg

SEQ ID NO: 752572 - DNA, 22 bp, Artificial Sequence
  chemically synthesized
cttattcattggatttcattct

SEQ ID NO: 752573 - DNA, 22 bp, Artificial Sequence
  chemically synthesized
attcattggatttcattctcta

SEQ ID NO: 752574 - DNA, 22 bp, Artificial Sequence
  chemically synthesized
ttcattggatttcattctctag

SEQ ID NO: 752575 - DNA, 22 bp, Artificial Sequence
  chemically synthesized
attggatttcattctctaggca

SEQ ID NO: 752576 - DNA, 22 bp, Artificial Sequence
  chemically synthesized
cgggagaatacttgcctagaga

SEQ ID NO: 752577 - DNA, 22 bp, Artificial Sequence
  chemically synthesized
gcgggagaatacttgcctagag

SEQ ID NO: 752578 - DNA, 22 bp, Artificial Sequence
  chemically synthesized
gatttcattctctaggcaagta

SEQ ID NO: 752579 - DNA, 22 bp, Artificial Sequence
  chemically synthesized
cttgcgggagaatacttgccta

SEQ ID NO: 752580 - DNA, 22 bp, Artificial Sequence
  chemically synthesized
cattctctaggcaagtattctc

SEQ ID NO: 752581 - DNA, 22 bp, Artificial Sequence
  chemically synthesized
attctctaggcaagtattctcc

SEQ ID NO: 752582 - DNA, 22 bp, Artificial Sequence
  chemically synthesized
tctaggcaagtattctcccgca

SEQ ID NO: 752583 - DNA, 22 bp, Artificial Sequence
  chemically synthesized
taggcaagtattctcccgcaag

SEQ ID NO: 752584 - DNA, 22 bp, Artificial Sequence
  chemically synthesized
caatccaaactccttgcgggag

SEQ ID NO: 752585 - DNA, 22 bp, Artificial Sequence
  chemically synthesized
ggcaagtattctcccgcaagga

SEQ ID NO: 752586 - DNA, 22 bp, Artificial Sequence
  chemically synthesized
caattccaatccaaactccttg

SEQ ID NO: 752587 - DNA, 22 bp, Artificial Sequence
  chemically synthesized
ccaattccaatccaaactcctt

SEQ ID NO: 752588 - DNA, 22 bp, Artificial Sequence
  chemically synthesized
ttccaattccaatccaaactcc

SEQ ID NO: 752589 - DNA, 22 bp, Artificial Sequence
  chemically synthesized
cttccaattccaatccaaactc

SEQ ID NO: 752590 - DNA, 22 bp, Artificial Sequence
  chemically synthesized
tcccgcaaggagtttggattgg

SEQ ID NO: 752591 - DNA, 22 bp, Artificial Sequence
  chemically synthesized
ccgcaaggagtttggattggaa

SEQ ID NO: 752592 - DNA, 22 bp, Artificial Sequence
  chemically synthesized
cccagcttcttccaattccaat

SEQ ID NO: 752593 - DNA, 22 bp, Artificial Sequence
  chemically synthesized
cattacccagcttcttccaatt

SEQ ID NO: 752594 - DNA, 22 bp, Artificial Sequence
  chemically synthesized
ctgcattacccagcttcttcca

SEQ ID NO: 752595 - DNA, 22 bp, Artificial Sequence
  chemically synthesized
ggattggaattggaagaagctg

SEQ ID NO: 752596 - DNA, 22 bp, Artificial Sequence
  chemically synthesized
gattggaattggaagaagctgg

SEQ ID NO: 752597 - DNA, 22 bp, Artificial Sequence
  chemically synthesized
atgttcctgcattacccagctt

SEQ ID NO: 752598 - DNA, 22 bp, Artificial Sequence
  chemically synthesized
gaattggaagaagctgggtaat

SEQ ID NO: 752599 - DNA, 22 bp, Artificial Sequence
  chemically synthesized
ctgatgttcctgcattacccag

SEQ ID NO: 752600 - DNA, 22 bp, Artificial Sequence
  chemically synthesized
gctgatgttcctgcattaccca

SEQ ID NO: 752601 - DNA, 22 bp, Artificial Sequence
  chemically synthesized
tgctgatgttcctgcattaccc

SEQ ID NO: 752602 - DNA, 22 bp, Artificial Sequence
  chemically synthesized
tttgctgatgttcctgcattac

SEQ ID NO: 752603 - DNA, 22 bp, Artificial Sequence
  chemically synthesized
gaagaagctgggtaatgcagga

SEQ ID NO: 752604 - DNA, 22 bp, Artificial Sequence
  chemically synthesized
ctttgctgatgttcctgcatta

SEQ ID NO: 752605 - DNA, 22 bp, Artificial Sequence
  chemically synthesized
ggtaatgcaggaacatcagcaa

SEQ ID NO: 752606 - DNA, 22 bp, Artificial Sequence
  chemically synthesized
atggatggatgaatggtttctt

SEQ ID NO: 752607 - DNA, 22 bp, Artificial Sequence
  chemically synthesized
gtgaattaatggatggatgaat

SEQ ID NO: 752608 - DNA, 22 bp, Artificial Sequence
  chemically synthesized
ggtgaattaatggatggatgaa

SEQ ID NO: 752609 - DNA, 22 bp, Artificial Sequence
  chemically synthesized
aacatttggtgaattaatggat

SEQ ID NO: 752610 - DNA, 22 bp, Artificial Sequence
  chemically synthesized
aaacatttggtgaattaatgga

SEQ ID NO: 752611 - DNA, 22 bp, Artificial Sequence
  chemically synthesized
taaacatttggtgaattaatgg

SEQ ID NO: 752612 - DNA, 22 bp, Artificial Sequence
  chemically synthesized
cattttaaacatttggtgaatt

SEQ ID NO: 752613 - DNA, 22 bp, Artificial Sequence
  chemically synthesized
atccatccattaattcaccaaa

SEQ ID NO: 752614 - DNA, 22 bp, Artificial Sequence
  chemically synthesized
agatactgcattttaaacattt

SEQ ID NO: 752615 - DNA, 22 bp, Artificial Sequence
  chemically synthesized
attcaccaaatgtttaaaatgc

SEQ ID NO: 752616 - DNA, 22 bp, Artificial Sequence
  chemically synthesized
accaaatgtttaaaatgcagta

SEQ ID NO: 752617 - DNA, 22 bp, Artificial Sequence
  chemically synthesized
gcatatctcagatactgcattt

SEQ ID NO: 752618 - DNA, 22 bp, Artificial Sequence
  chemically synthesized
tgtgcctggcatatctcagata

SEQ ID NO: 752619 - DNA, 22 bp, Artificial Sequence
  chemically synthesized
tgtgtgcctggcatatctcaga

SEQ ID NO: 752620 - DNA, 22 bp, Artificial Sequence
  chemically synthesized
aaaatgcagtatctgagatatg

SEQ ID NO: 752621 - DNA, 22 bp, Artificial Sequence
  chemically synthesized
aaatgcagtatctgagatatgc

SEQ ID NO: 752622 - DNA, 22 bp, Artificial Sequence
  chemically synthesized
acccctctgtgtgcctggcata

SEQ ID NO: 752623 - DNA, 22 bp, Artificial Sequence
  chemically synthesized
agatatgccaggcacacagagg

SEQ ID NO: 752624 - DNA, 22 bp, Artificial Sequence
  chemically synthesized
aatcccattcacccctctgtgt

SEQ ID NO: 752625 - DNA, 22 bp, Artificial Sequence
  chemically synthesized
aaatcccattcacccctctgtg

SEQ ID NO: 752626 - DNA, 22 bp, Artificial Sequence
  chemically synthesized
taaatcccattcacccctctgt

SEQ ID NO: 752627 - DNA, 22 bp, Artificial Sequence
  chemically synthesized
gatgataacagtatacatcttt

SEQ ID NO: 752628 - DNA, 22 bp, Artificial Sequence
  chemically synthesized
agatgataacagtatacatctt

SEQ ID NO: 752629 - DNA, 22 bp, Artificial Sequence
  chemically synthesized
cttagatgataacagtatacat

SEQ ID NO: 752630 - DNA, 22 bp, Artificial Sequence
  chemically synthesized
acttagatgataacagtataca

SEQ ID NO: 752631 - DNA, 22 bp, Artificial Sequence
  chemically synthesized
tacttagatgataacagtatac

SEQ ID NO: 752632 - DNA, 22 bp, Artificial Sequence
  chemically synthesized
ttacttagatgataacagtata

SEQ ID NO: 752633 - DNA, 22 bp, Artificial Sequence
  chemically synthesized
aaagatgtatactgttatcatc

SEQ ID NO: 752634 - DNA, 22 bp, Artificial Sequence
  chemically synthesized
aagatgtatactgttatcatct

SEQ ID NO: 752635 - DNA, 22 bp, Artificial Sequence
  chemically synthesized
atccccagcatcttttacttag

SEQ ID NO: 752636 - DNA, 22 bp, Artificial Sequence
  chemically synthesized
aatccccagcatcttttactta

SEQ ID NO: 752637 - DNA, 22 bp, Artificial Sequence
  chemically synthesized
taatccccagcatcttttactt

SEQ ID NO: 752638 - DNA, 22 bp, Artificial Sequence
  chemically synthesized
ttaatccccagcatcttttact

SEQ ID NO: 752639 - DNA, 22 bp, Artificial Sequence
  chemically synthesized
tttaatccccagcatcttttac

SEQ ID NO: 752640 - DNA, 22 bp, Artificial Sequence
  chemically synthesized
ttatcatctaagtaaaagatgc

SEQ ID NO: 752641 - DNA, 22 bp, Artificial Sequence
  chemically synthesized
tcatctaagtaaaagatgctgg

SEQ ID NO: 752642 - DNA, 22 bp, Artificial Sequence
  chemically synthesized
agtaaaagatgctggggattaa

SEQ ID NO: 752643 - DNA, 22 bp, Artificial Sequence
  chemically synthesized
accaatgtcctttttaatcccc

SEQ ID NO: 752644 - DNA, 22 bp, Artificial Sequence
  chemically synthesized
aaccaatgtcctttttaatccc

SEQ ID NO: 752645 - DNA, 22 bp, Artificial Sequence
  chemically synthesized
taaccaatgtcctttttaatcc

SEQ ID NO: 752646 - DNA, 22 bp, Artificial Sequence
  chemically synthesized
ttaaccaatgtcctttttaatc

SEQ ID NO: 752647 - DNA, 22 bp, Artificial Sequence
  chemically synthesized
ttttaaccaatgtcctttttaa

SEQ ID NO: 752648 - DNA, 22 bp, Artificial Sequence
  chemically synthesized
ctcttttaaccaatgtcctttt

SEQ ID NO: 752649 - DNA, 22 bp, Artificial Sequence
  chemically synthesized
tcctcttttaaccaatgtcctt

SEQ ID NO: 752650 - DNA, 22 bp, Artificial Sequence
  chemically synthesized
tctcctcttttaaccaatgtcc

SEQ ID NO: 752651 - DNA, 22 bp, Artificial Sequence
  chemically synthesized
gggattaaaaaggacattggtt

SEQ ID NO: 752652 - DNA, 22 bp, Artificial Sequence
  chemically synthesized
ctctcctcttttaaccaatgtc

SEQ ID NO: 752653 - DNA, 22 bp, Artificial Sequence
  chemically synthesized
tctctcctcttttaaccaatgt

SEQ ID NO: 752654 - DNA, 22 bp, Artificial Sequence
  chemically synthesized
tgttttctctcctcttttaacc

SEQ ID NO: 752655 - DNA, 22 bp, Artificial Sequence
  chemically synthesized
aaaaggacattggttaaaagag

SEQ ID NO: 752656 - DNA, 22 bp, Artificial Sequence
  chemically synthesized
gtgttttctctcctcttttaac

SEQ ID NO: 752657 - DNA, 22 bp, Artificial Sequence
  chemically synthesized
tgtgttttctctcctcttttaa

SEQ ID NO: 752658 - DNA, 22 bp, Artificial Sequence
  chemically synthesized
ttgtgttttctctcctctttta

SEQ ID NO: 752659 - DNA, 22 bp, Artificial Sequence
  chemically synthesized
ttttgtgttttctctcctcttt

SEQ ID NO: 752660 - DNA, 22 bp, Artificial Sequence
  chemically synthesized
gttaaaagaggagagaaaacac

SEQ ID NO: 752661 - DNA, 22 bp, Artificial Sequence
  chemically synthesized
agaatagctcttttgtgttttc

SEQ ID NO: 752662 - DNA, 22 bp, Artificial Sequence
  chemically synthesized
aaagaggagagaaaacacaaaa

SEQ ID NO: 752663 - DNA, 22 bp, Artificial Sequence
  chemically synthesized
cctcagaatagctcttttgtgt

SEQ ID NO: 752664 - DNA, 22 bp, Artificial Sequence
  chemically synthesized
atgttacctcagaatagctctt

SEQ ID NO: 752665 - DNA, 22 bp, Artificial Sequence
  chemically synthesized
atggcacatgatggctcatgtt

SEQ ID NO: 752666 - DNA, 22 bp, Artificial Sequence
  chemically synthesized
ttctgaggtaacatgagccatc

SEQ ID NO: 752667 - DNA, 22 bp, Artificial Sequence
  chemically synthesized
actgatggcacatgatggctca

SEQ ID NO: 752668 - DNA, 22 bp, Artificial Sequence
  chemically synthesized
cactgatggcacatgatggctc

SEQ ID NO: 752669 - DNA, 22 bp, Artificial Sequence
  chemically synthesized
tgaggtaacatgagccatcatg

SEQ ID NO: 752670 - DNA, 22 bp, Artificial Sequence
  chemically synthesized
tcactgatggcacatgatggct

SEQ ID NO: 752671 - DNA, 22 bp, Artificial Sequence
  chemically synthesized
aggtaacatgagccatcatgtg

SEQ ID NO: 752672 - DNA, 22 bp, Artificial Sequence
  chemically synthesized
cattttcactgatggcacatga

SEQ ID NO: 752673 - DNA, 22 bp, Artificial Sequence
  chemically synthesized
tgcattttcactgatggcacat

SEQ ID NO: 752674 - DNA, 22 bp, Artificial Sequence
  chemically synthesized
ctgcattttcactgatggcaca

SEQ ID NO: 752675 - DNA, 22 bp, Artificial Sequence
  chemically synthesized
aacccttctgcattttcactga

SEQ ID NO: 752676 - DNA, 22 bp, Artificial Sequence
  chemically synthesized
aaacccttctgcattttcactg

SEQ ID NO: 752677 - DNA, 22 bp, Artificial Sequence
  chemically synthesized
atccttaaacccttctgcattt

SEQ ID NO: 752678 - DNA, 22 bp, Artificial Sequence
  chemically synthesized
ggttcatccttaaacccttctg

SEQ ID NO: 752679 - DNA, 22 bp, Artificial Sequence
  chemically synthesized
aggttcatccttaaacccttct

SEQ ID NO: 752680 - DNA, 22 bp, Artificial Sequence
  chemically synthesized
taggttcatccttaaacccttc

SEQ ID NO: 752681 - DNA, 22 bp, Artificial Sequence
  chemically synthesized
gaaactttaggttcatccttaa

SEQ ID NO: 752682 - DNA, 22 bp, Artificial Sequence
  chemically synthesized
caggctagaaactttaggttca

SEQ ID NO: 752683 - DNA, 22 bp, Artificial Sequence
  chemically synthesized
ccaggctagaaactttaggttc

SEQ ID NO: 752684 - DNA, 22 bp, Artificial Sequence
  chemically synthesized
tccaggctagaaactttaggtt

SEQ ID NO: 752685 - DNA, 22 bp, Artificial Sequence
  chemically synthesized
aaggatgaacctaaagtttcta

SEQ ID NO: 752686 - DNA, 22 bp, Artificial Sequence
  chemically synthesized
aggatgaacctaaagtttctag

SEQ ID NO: 752687 - DNA, 22 bp, Artificial Sequence
  chemically synthesized
aagtttctagcctggaaaattt

SEQ ID NO: 752688 - DNA, 22 bp, Artificial Sequence
  chemically synthesized
atgaatcatcatccaacaaatt

SEQ ID NO: 752689 - DNA, 22 bp, Artificial Sequence
  chemically synthesized
ctagcctggaaaatttgttgga

SEQ ID NO: 752690 - DNA, 22 bp, Artificial Sequence
  chemically synthesized
tagcctggaaaatttgttggat

SEQ ID NO: 752691 - DNA, 22 bp, Artificial Sequence
  chemically synthesized
gcctggaaaatttgttggatga

SEQ ID NO: 752692 - DNA, 22 bp, Artificial Sequence
  chemically synthesized
agttaatgaatcatcatccaac

SEQ ID NO: 752693 - DNA, 22 bp, Artificial Sequence
  chemically synthesized
cagttaatgaatcatcatccaa

SEQ ID NO: 752694 - DNA, 22 bp, Artificial Sequence
  chemically synthesized
gaaaatttgttggatgatgatt

SEQ ID NO: 752695 - DNA, 22 bp, Artificial Sequence
  chemically synthesized
tttcagttaatgaatcatcatc

SEQ ID NO: 752696 - DNA, 22 bp, Artificial Sequence
  chemically synthesized
ctatttcagttaatgaatcatc

SEQ ID NO: 752697 - DNA, 22 bp, Artificial Sequence
  chemically synthesized
cctatttcagttaatgaatcat

SEQ ID NO: 752698 - DNA, 22 bp, Artificial Sequence
  chemically synthesized
tttcctatttcagttaatgaat

SEQ ID NO: 752699 - DNA, 22 bp, Artificial Sequence
  chemically synthesized
gttggatgatgattcattaact

SEQ ID NO: 752700 - DNA, 22 bp, Artificial Sequence
  chemically synthesized
ttggatgatgattcattaactg

SEQ ID NO: 752701 - DNA, 22 bp, Artificial Sequence
  chemically synthesized
ctgtttcctatttcagttaatg

SEQ ID NO: 752702 - DNA, 22 bp, Artificial Sequence
  chemically synthesized
cctgtttcctatttcagttaat

SEQ ID NO: 752703 - DNA, 22 bp, Artificial Sequence
  chemically synthesized
gatgatgattcattaactgaaa

SEQ ID NO: 752704 - DNA, 22 bp, Artificial Sequence
  chemically synthesized
tcctgtttcctatttcagttaa

SEQ ID NO: 752705 - DNA, 22 bp, Artificial Sequence
  chemically synthesized
ttcctgtttcctatttcagtta

SEQ ID NO: 752706 - DNA, 22 bp, Artificial Sequence
  chemically synthesized
tttcctgtttcctatttcagtt

SEQ ID NO: 752707 - DNA, 22 bp, Artificial Sequence
  chemically synthesized
ttttcctgtttcctatttcagt

SEQ ID NO: 752708 - DNA, 22 bp, Artificial Sequence
  chemically synthesized
tttttcctgtttcctatttcag

SEQ ID NO: 752709 - DNA, 22 bp, Artificial Sequence
  chemically synthesized
ttttttcctgtttcctatttca

SEQ ID NO: 752710 - DNA, 22 bp, Artificial Sequence
  chemically synthesized
accttttttttcctgtttccta

SEQ ID NO: 752711 - DNA, 22 bp, Artificial Sequence
  chemically synthesized
attaactgaaataggaaacagg

SEQ ID NO: 752712 - DNA, 22 bp, Artificial Sequence
  chemically synthesized
tctgaccttttttttcctgttt

SEQ ID NO: 752713 - DNA, 22 bp, Artificial Sequence
  chemically synthesized
actgaaataggaaacaggaaaa

SEQ ID NO: 752714 - DNA, 22 bp, Artificial Sequence
  chemically synthesized
atctgaccttttttttcctgtt

SEQ ID NO: 752715 - DNA, 22 bp, Artificial Sequence
  chemically synthesized
ttatctgaccttttttttcctg

SEQ ID NO: 752716 - DNA, 22 bp, Artificial Sequence
  chemically synthesized
aaataggaaacaggaaaaaaaa

SEQ ID NO: 752717 - DNA, 22 bp, Artificial Sequence
  chemically synthesized
tcccctcttatctgaccttttt

SEQ ID NO: 752718 - DNA, 22 bp, Artificial Sequence
  chemically synthesized
tgtcccctcttatctgaccttt

SEQ ID NO: 752719 - DNA, 22 bp, Artificial Sequence
  chemically synthesized
ctgtcccctcttatctgacctt

SEQ ID NO: 752720 - DNA, 22 bp, Artificial Sequence
  chemically synthesized
cttctgtcccctcttatctgac

SEQ ID NO: 752721 - DNA, 22 bp, Artificial Sequence
  chemically synthesized
cctacttctgtcccctcttatc

SEQ ID NO: 752722 - DNA, 22 bp, Artificial Sequence
  chemically synthesized
ccctacttctgtcccctcttat

SEQ ID NO: 752723 - DNA, 22 bp, Artificial Sequence
  chemically synthesized
catttccctacttctgtcccct

SEQ ID NO: 752724 - DNA, 22 bp, Artificial Sequence
  chemically synthesized
ccatttccctacttctgtcccc

SEQ ID NO: 752725 - DNA, 22 bp, Artificial Sequence
  chemically synthesized
tccatttccctacttctgtccc

SEQ ID NO: 752726 - DNA, 22 bp, Artificial Sequence
  chemically synthesized
ttttccatttccctacttctgt

SEQ ID NO: 752727 - DNA, 22 bp, Artificial Sequence
  chemically synthesized
ctgttttccatttccctacttc

SEQ ID NO: 752728 - DNA, 22 bp, Artificial Sequence
  chemically synthesized
tcctgttttccatttccctact

SEQ ID NO: 752729 - DNA, 22 bp, Artificial Sequence
  chemically synthesized
ttctcctgttttccatttccct

SEQ ID NO: 752730 - DNA, 22 bp, Artificial Sequence
  chemically synthesized
gttctcctgttttccatttccc

SEQ ID NO: 752731 - DNA, 22 bp, Artificial Sequence
  chemically synthesized
atttgttctcctgttttccatt

SEQ ID NO: 752732 - DNA, 22 bp, Artificial Sequence
  chemically synthesized
aaaccaagttcatttgttctcc

SEQ ID NO: 752733 - DNA, 22 bp, Artificial Sequence
  chemically synthesized
tgaaaccaagttcatttgttct

SEQ ID NO: 752734 - DNA, 22 bp, Artificial Sequence
  chemically synthesized
ttctgaaaccaagttcatttgt

SEQ ID NO: 752735 - DNA, 22 bp, Artificial Sequence
  chemically synthesized
cgatcacaaatgcaactattct

SEQ ID NO: 752736 - DNA, 22 bp, Artificial Sequence
  chemically synthesized
ggtttcagaatagttgcatttg

SEQ ID NO: 752737 - DNA, 22 bp, Artificial Sequence
  chemically synthesized
gtttcagaatagttgcatttgt

SEQ ID NO: 752738 - DNA, 22 bp, Artificial Sequence
  chemically synthesized
cagaatagttgcatttgtgatc

SEQ ID NO: 752739 - DNA, 22 bp, Artificial Sequence
  chemically synthesized
agaatagttgcatttgtgatcg

SEQ ID NO: 752740 - DNA, 22 bp, Artificial Sequence
  chemically synthesized
aatccatgtggcattacgatca

SEQ ID NO: 752741 - DNA, 22 bp, Artificial Sequence
  chemically synthesized
tgaatccatgtggcattacgat

SEQ ID NO: 752742 - DNA, 22 bp, Artificial Sequence
  chemically synthesized
catttgtgatcgtaatgccaca

SEQ ID NO: 752743 - DNA, 22 bp, Artificial Sequence
  chemically synthesized
atctctgaatccatgtggcatt

SEQ ID NO: 752744 - DNA, 22 bp, Artificial Sequence
  chemically synthesized
tgatctctgaatccatgtggca

SEQ ID NO: 752745 - DNA, 22 bp, Artificial Sequence
  chemically synthesized
ctgatctctgaatccatgtggc

SEQ ID NO: 752746 - DNA, 22 bp, Artificial Sequence
  chemically synthesized
gtgatcgtaatgccacatggat

SEQ ID NO: 752747 - DNA, 22 bp, Artificial Sequence
  chemically synthesized
tgatcgtaatgccacatggatt

SEQ ID NO: 752748 - DNA, 22 bp, Artificial Sequence
  chemically synthesized
ttctgatctctgaatccatgtg

SEQ ID NO: 752749 - DNA, 22 bp, Artificial Sequence
  chemically synthesized
tcttctgatctctgaatccatg

SEQ ID NO: 752750 - DNA, 22 bp, Artificial Sequence
  chemically synthesized
gtccgcatctctcttctgatct

SEQ ID NO: 752751 - DNA, 22 bp, Artificial Sequence
  chemically synthesized
tagtccgcatctctcttctgat

SEQ ID NO: 752752 - DNA, 22 bp, Artificial Sequence
  chemically synthesized
catctctagtccgcatctctct

SEQ ID NO: 752753 - DNA, 22 bp, Artificial Sequence
  chemically synthesized
agagatcagaagagagatgcgg

SEQ ID NO: 752754 - DNA, 22 bp, Artificial Sequence
  chemically synthesized
gatggtgatgtatctacatctc

SEQ ID NO: 752755 - DNA, 22 bp, Artificial Sequence
  chemically synthesized
agatggcctggatggtgatgta

SEQ ID NO: 752756 - DNA, 22 bp, Artificial Sequence
  chemically synthesized
gagatggcctggatggtgatgt

SEQ ID NO: 752757 - DNA, 22 bp, Artificial Sequence
  chemically synthesized
gagatgtagatacatcaccatc

SEQ ID NO: 752758 - DNA, 22 bp, Artificial Sequence
  chemically synthesized
tttgagatggcctggatggtga

SEQ ID NO: 752759 - DNA, 22 bp, Artificial Sequence
  chemically synthesized
cctgtttgagatggcctggatg

SEQ ID NO: 752760 - DNA, 22 bp, Artificial Sequence
  chemically synthesized
aaccctccctgtttgagatggc

SEQ ID NO: 752761 - DNA, 22 bp, Artificial Sequence
  chemically synthesized
aaaccctccctgtttgagatgg

SEQ ID NO: 752762 - DNA, 22 bp, Artificial Sequence
  chemically synthesized
tttaaaccctccctgtttgaga

SEQ ID NO: 752763 - DNA, 22 bp, Artificial Sequence
  chemically synthesized
attgtttaaaccctccctgttt

SEQ ID NO: 752764 - DNA, 22 bp, Artificial Sequence
  chemically synthesized
gattgtttaaaccctccctgtt

SEQ ID NO: 752765 - DNA, 22 bp, Artificial Sequence
  chemically synthesized
tgattgtttaaaccctccctgt

SEQ ID NO: 752766 - DNA, 22 bp, Artificial Sequence
  chemically synthesized
ttgattgtttaaaccctccctg

SEQ ID NO: 752767 - DNA, 22 bp, Artificial Sequence
  chemically synthesized
ttttgattgtttaaaccctccc

SEQ ID NO: 752768 - DNA, 22 bp, Artificial Sequence
  chemically synthesized
tcttttgattgtttaaaccctc

SEQ ID NO: 752769 - DNA, 22 bp, Artificial Sequence
  chemically synthesized
attctcttttgattgtttaaac

SEQ ID NO: 752770 - DNA, 22 bp, Artificial Sequence
  chemically synthesized
aaacagggagggtttaaacaat

SEQ ID NO: 752771 - DNA, 22 bp, Artificial Sequence
  chemically synthesized
gcctaattctcttttgattgtt

SEQ ID NO: 752772 - DNA, 22 bp, Artificial Sequence
  chemically synthesized
agcctaattctcttttgattgt

SEQ ID NO: 752773 - DNA, 22 bp, Artificial Sequence
  chemically synthesized
accttagcctaattctcttttg

SEQ ID NO: 752774 - DNA, 22 bp, Artificial Sequence
  chemically synthesized
taaccttagcctaattctcttt

SEQ ID NO: 752775 - DNA, 22 bp, Artificial Sequence
  chemically synthesized
ctaaccttagcctaattctctt

SEQ ID NO: 752776 - DNA, 22 bp, Artificial Sequence
  chemically synthesized
aaacaatcaaaagagaattagg

SEQ ID NO: 752777 - DNA, 22 bp, Artificial Sequence
  chemically synthesized
aacaatcaaaagagaattaggc

SEQ ID NO: 752778 - DNA, 22 bp, Artificial Sequence
  chemically synthesized
tgcccaagtttctaaccttagc

SEQ ID NO: 752779 - DNA, 22 bp, Artificial Sequence
  chemically synthesized
ttgtgcccaagtttctaacctt

SEQ ID NO: 752780 - DNA, 22 bp, Artificial Sequence
  chemically synthesized
ggctaaggttagaaacttgggc

SEQ ID NO: 752781 - DNA, 22 bp, Artificial Sequence
  chemically synthesized
aaatactgttgtgcccaagttt

SEQ ID NO: 752782 - DNA, 22 bp, Artificial Sequence
  chemically synthesized
aggttagaaacttgggcacaac

SEQ ID NO: 752783 - DNA, 22 bp, Artificial Sequence
  chemically synthesized
gccacccctcaaatactgttgt

SEQ ID NO: 752784 - DNA, 22 bp, Artificial Sequence
  chemically synthesized
gaaacttgggcacaacagtatt

SEQ ID NO: 752785 - DNA, 22 bp, Artificial Sequence
  chemically synthesized
ctagccacccctcaaatactgt

SEQ ID NO: 752786 - DNA, 22 bp, Artificial Sequence
  chemically synthesized
tcctagccacccctcaaatact

SEQ ID NO: 752787 - DNA, 22 bp, Artificial Sequence
  chemically synthesized
ctcctagccacccctcaaatac

SEQ ID NO: 752788 - DNA, 22 bp, Artificial Sequence
  chemically synthesized
gggcacaacagtatttgagggg

SEQ ID NO: 752789 - DNA, 22 bp, Artificial Sequence
  chemically synthesized
ttctcctagccacccctcaaat

SEQ ID NO: 752790 - DNA, 22 bp, Artificial Sequence
  chemically synthesized
ggcacaacagtatttgaggggt

SEQ ID NO: 752791 - DNA, 22 bp, Artificial Sequence
  chemically synthesized
gattcttctcctagccacccct

SEQ ID NO: 752792 - DNA, 22 bp, Artificial Sequence
  chemically synthesized
tagattcttctcctagccaccc

SEQ ID NO: 752793 - DNA, 22 bp, Artificial Sequence
  chemically synthesized
ctagattcttctcctagccacc

SEQ ID NO: 752794 - DNA, 22 bp, Artificial Sequence
  chemically synthesized
tctagattcttctcctagccac

SEQ ID NO: 752795 - DNA, 22 bp, Artificial Sequence
  chemically synthesized
ttctagattcttctcctagcca

SEQ ID NO: 752796 - DNA, 22 bp, Artificial Sequence
  chemically synthesized
tatttttctagattcttctcct

SEQ ID NO: 752797 - DNA, 22 bp, Artificial Sequence
  chemically synthesized
gaggggtggctaggagaagaat

SEQ ID NO: 752798 - DNA, 22 bp, Artificial Sequence
  chemically synthesized
aggggtggctaggagaagaatc

SEQ ID NO: 752799 - DNA, 22 bp, Artificial Sequence
  chemically synthesized
ctatatttttctagattcttct

SEQ ID NO: 752800 - DNA, 22 bp, Artificial Sequence
  chemically synthesized
cctatatttttctagattcttc

SEQ ID NO: 752801 - DNA, 22 bp, Artificial Sequence
  chemically synthesized
ttcctatatttttctagattct

SEQ ID NO: 752802 - DNA, 22 bp, Artificial Sequence
  chemically synthesized
cttcctatatttttctagattc

SEQ ID NO: 752803 - DNA, 22 bp, Artificial Sequence
  chemically synthesized
ttcttcctatatttttctagat

SEQ ID NO: 752804 - DNA, 22 bp, Artificial Sequence
  chemically synthesized
ggagaagaatctagaaaaatat

SEQ ID NO: 752805 - DNA, 22 bp, Artificial Sequence
  chemically synthesized
catccatgttcttcttcctata

SEQ ID NO: 752806 - DNA, 22 bp, Artificial Sequence
  chemically synthesized
ttccatccatgttcttcttcct

SEQ ID NO: 752807 - DNA, 22 bp, Artificial Sequence
  chemically synthesized
gaaaaatataggaagaagaaca

SEQ ID NO: 752808 - DNA, 22 bp, Artificial Sequence
  chemically synthesized
atggaactgttccatccatgtt

SEQ ID NO: 752809 - DNA, 22 bp, Artificial Sequence
  chemically synthesized
catggaactgttccatccatgt

SEQ ID NO: 752810 - DNA, 22 bp, Artificial Sequence
  chemically synthesized
tcatggaactgttccatccatg

SEQ ID NO: 752811 - DNA, 22 bp, Artificial Sequence
  chemically synthesized
gctttcatggaactgttccatc

SEQ ID NO: 752812 - DNA, 22 bp, Artificial Sequence
  chemically synthesized
ggctttcatggaactgttccat

SEQ ID NO: 752813 - DNA, 22 bp, Artificial Sequence
  chemically synthesized
cttggctttcatggaactgttc

SEQ ID NO: 752814 - DNA, 22 bp, Artificial Sequence
  chemically synthesized
ccttggctttcatggaactgtt

SEQ ID NO: 752815 - DNA, 22 bp, Artificial Sequence
  chemically synthesized
ttccttggctttcatggaactg

SEQ ID NO: 752816 - DNA, 22 bp, Artificial Sequence
  chemically synthesized
tcctcttccttggctttcatgg

SEQ ID NO: 752817 - DNA, 22 bp, Artificial Sequence
  chemically synthesized
gaagttgtcctcttccttggct

SEQ ID NO: 752818 - DNA, 22 bp, Artificial Sequence
  chemically synthesized
tagaagttgtcctcttccttgg

SEQ ID NO: 752819 - DNA, 22 bp, Artificial Sequence
  chemically synthesized
catgaaagccaaggaagaggac

SEQ ID NO: 752820 - DNA, 22 bp, Artificial Sequence
  chemically synthesized
attctagaagttgtcctcttcc

SEQ ID NO: 752821 - DNA, 22 bp, Artificial Sequence
  chemically synthesized
agcatcctcattctagaagttg

SEQ ID NO: 752822 - DNA, 22 bp, Artificial Sequence
  chemically synthesized
ccagcatctcagcatcctcatt

SEQ ID NO: 752823 - DNA, 22 bp, Artificial Sequence
  chemically synthesized
gccagcatctcagcatcctcat

SEQ ID NO: 752824 - DNA, 22 bp, Artificial Sequence
  chemically synthesized
ctagaatgaggatgctgagatg

SEQ ID NO: 752825 - DNA, 22 bp, Artificial Sequence
  chemically synthesized
tagaatgaggatgctgagatgc

SEQ ID NO: 752826 - DNA, 22 bp, Artificial Sequence
  chemically synthesized
agcatgtttgccagcatctcag

SEQ ID NO: 752827 - DNA, 22 bp, Artificial Sequence
  chemically synthesized
gaatgaggatgctgagatgctg

SEQ ID NO: 752828 - DNA, 22 bp, Artificial Sequence
  chemically synthesized
atgcactcagcatgtttgccag

SEQ ID NO: 752829 - DNA, 22 bp, Artificial Sequence
  chemically synthesized
cctcatgcactcagcatgtttg

SEQ ID NO: 752830 - DNA, 22 bp, Artificial Sequence
  chemically synthesized
agatgctggcaaacatgctgag

SEQ ID NO: 752831 - DNA, 22 bp, Artificial Sequence
  chemically synthesized
aattccctcatgcactcagcat

SEQ ID NO: 752832 - DNA, 22 bp, Artificial Sequence
  chemically synthesized
gcaaacatgctgagtgcatgag

SEQ ID NO: 752833 - DNA, 22 bp, Artificial Sequence
  chemically synthesized
aaaagaagttaaattccctcat

SEQ ID NO: 752834 - DNA, 22 bp, Artificial Sequence
  chemically synthesized
aaattcaaaagaagttaaattc

SEQ ID NO: 752835 - DNA, 22 bp, Artificial Sequence
  chemically synthesized
agtgcatgagggaatttaactt

SEQ ID NO: 752836 - DNA, 22 bp, Artificial Sequence
  chemically synthesized
gattaaaattcaaaagaagtta

SEQ ID NO: 752837 - DNA, 22 bp, Artificial Sequence
  chemically synthesized
ctagattaaaattcaaaagaag

SEQ ID NO: 752838 - DNA, 22 bp, Artificial Sequence
  chemically synthesized
aacttcttttgaattttaatct

SEQ ID NO: 752839 - DNA, 22 bp, Artificial Sequence
  chemically synthesized
acttcttttgaattttaatcta

SEQ ID NO: 752840 - DNA, 22 bp, Artificial Sequence
  chemically synthesized
cttttgaattttaatctaggag

SEQ ID NO: 752841 - DNA, 22 bp, Artificial Sequence
  chemically synthesized
ttttgaattttaatctaggagg

SEQ ID NO: 752842 - DNA, 22 bp, Artificial Sequence
  chemically synthesized
ttgaattttaatctaggaggat

SEQ ID NO: 752843 - DNA, 22 bp, Artificial Sequence
  chemically synthesized
tgaattttaatctaggaggatt

SEQ ID NO: 752844 - DNA, 22 bp, Artificial Sequence
  chemically synthesized
gaattttaatctaggaggattt

SEQ ID NO: 752845 - DNA, 22 bp, Artificial Sequence
  chemically synthesized
tcaaaatcacaaaaatcctcct

SEQ ID NO: 752846 - DNA, 22 bp, Artificial Sequence
  chemically synthesized
aattttaatctaggaggatttt

SEQ ID NO: 752847 - DNA, 22 bp, Artificial Sequence
  chemically synthesized
ttgtcaaaatcacaaaaatcct

SEQ ID NO: 752848 - DNA, 22 bp, Artificial Sequence
  chemically synthesized
taatctaggaggatttttgtga

SEQ ID NO: 752849 - DNA, 22 bp, Artificial Sequence
  chemically synthesized
aatctaggaggatttttgtgat

SEQ ID NO: 752850 - DNA, 22 bp, Artificial Sequence
  chemically synthesized
atctaggaggatttttgtgatt

SEQ ID NO: 752851 - DNA, 22 bp, Artificial Sequence
  chemically synthesized
atctattgtcaaaatcacaaaa

SEQ ID NO: 752852 - DNA, 22 bp, Artificial Sequence
  chemically synthesized
ctcatctattgtcaaaatcaca

SEQ ID NO: 752853 - DNA, 22 bp, Artificial Sequence
  chemically synthesized
ggaggatttttgtgattttgac

SEQ ID NO: 752854 - DNA, 22 bp, Artificial Sequence
  chemically synthesized
ttgtgattttgacaatagatga

SEQ ID NO: 752855 - DNA, 22 bp, Artificial Sequence
  chemically synthesized
tgtgattttgacaatagatgag

SEQ ID NO: 752856 - DNA, 22 bp, Artificial Sequence
  chemically synthesized
gtgattttgacaatagatgagt

SEQ ID NO: 752857 - DNA, 22 bp, Artificial Sequence
  chemically synthesized
aaatcagcaactactcatctat

SEQ ID NO: 752858 - DNA, 22 bp, Artificial Sequence
  chemically synthesized
tgattttgacaatagatgagta

SEQ ID NO: 752859 - DNA, 22 bp, Artificial Sequence
  chemically synthesized
gaaatcagcaactactcatcta

SEQ ID NO: 752860 - DNA, 22 bp, Artificial Sequence
  chemically synthesized
tgaaatcagcaactactcatct

SEQ ID NO: 752861 - DNA, 22 bp, Artificial Sequence
  chemically synthesized
tgacaatagatgagtagttgct

SEQ ID NO: 752862 - DNA, 22 bp, Artificial Sequence
  chemically synthesized
gacaatagatgagtagttgctg

SEQ ID NO: 752863 - DNA, 22 bp, Artificial Sequence
  chemically synthesized
acaatagatgagtagttgctga

SEQ ID NO: 752864 - DNA, 22 bp, Artificial Sequence
  chemically synthesized
ggagtatcattttgaaatcagc

SEQ ID NO: 752865 - DNA, 22 bp, Artificial Sequence
  chemically synthesized
aggagtatcattttgaaatcag

SEQ ID NO: 752866 - DNA, 22 bp, Artificial Sequence
  chemically synthesized
ctgatttcaaaatgatactcct

SEQ ID NO: 752867 - DNA, 22 bp, Artificial Sequence
  chemically synthesized
atttcaaaatgatactcctaaa

SEQ ID NO: 752868 - DNA, 22 bp, Artificial Sequence
  chemically synthesized
caaaatgatactcctaaatatg

SEQ ID NO: 752869 - DNA, 22 bp, Artificial Sequence
  chemically synthesized
tagaaaaaaatacatatttagg

SEQ ID NO: 752870 - DNA, 22 bp, Artificial Sequence
  chemically synthesized
aaaatgatactcctaaatatgt

SEQ ID NO: 752871 - DNA, 22 bp, Artificial Sequence
  chemically synthesized
tgtagaaaaaaatacatattta

SEQ ID NO: 752872 - DNA, 22 bp, Artificial Sequence
  chemically synthesized
ctaaatatgtatttttttctac

SEQ ID NO: 752873 - DNA, 22 bp, Artificial Sequence
  chemically synthesized
aatatgtatttttttctacaga

SEQ ID NO: 752874 - DNA, 22 bp, Artificial Sequence
  chemically synthesized
ttttctacagaatatatttgcc

SEQ ID NO: 752875 - DNA, 22 bp, Artificial Sequence
  chemically synthesized
tggcacaaagatggcaaatata

SEQ ID NO: 752876 - DNA, 22 bp, Artificial Sequence
  chemically synthesized
tttctacagaatatatttgcca

SEQ ID NO: 752877 - DNA, 22 bp, Artificial Sequence
  chemically synthesized
gtggcacaaagatggcaaatat

SEQ ID NO: 752878 - DNA, 22 bp, Artificial Sequence
  chemically synthesized
ttctacagaatatatttgccat

SEQ ID NO: 752879 - DNA, 22 bp, Artificial Sequence
  chemically synthesized
tctacagaatatatttgccatc

SEQ ID NO: 752880 - DNA, 22 bp, Artificial Sequence
  chemically synthesized
ctacagaatatatttgccatct

SEQ ID NO: 752881 - DNA, 22 bp, Artificial Sequence
  chemically synthesized
tacagaatatatttgccatctt

SEQ ID NO: 752882 - DNA, 22 bp, Artificial Sequence
  chemically synthesized
ccttgtggcacaaagatggcaa

SEQ ID NO: 752883 - DNA, 22 bp, Artificial Sequence
  chemically synthesized
cagaatatatttgccatctttg

SEQ ID NO: 752884 - DNA, 22 bp, Artificial Sequence
  chemically synthesized
aattcccttgtggcacaaagat

SEQ ID NO: 752885 - DNA, 22 bp, Artificial Sequence
  chemically synthesized
gccatctttgtgccacaaggga

SEQ ID NO: 752886 - DNA, 22 bp, Artificial Sequence
  chemically synthesized
ccatctttgtgccacaagggaa

SEQ ID NO: 752887 - DNA, 22 bp, Artificial Sequence
  chemically synthesized
taagaccaaagttaaattccct

SEQ ID NO: 752888 - DNA, 22 bp, Artificial Sequence
  chemically synthesized
tgtgccacaagggaatttaact

SEQ ID NO: 752889 - DNA, 22 bp, Artificial Sequence
  chemically synthesized
gtgccacaagggaatttaactt

SEQ ID NO: 752890 - DNA, 22 bp, Artificial Sequence
  chemically synthesized
tctataagaccaaagttaaatt

SEQ ID NO: 752891 - DNA, 22 bp, Artificial Sequence
  chemically synthesized
tgccacaagggaatttaacttt

SEQ ID NO: 752892 - DNA, 22 bp, Artificial Sequence
  chemically synthesized
gaagaccactgtctataagacc

SEQ ID NO: 752893 - DNA, 22 bp, Artificial Sequence
  chemically synthesized
ggaagaccactgtctataagac

SEQ ID NO: 752894 - DNA, 22 bp, Artificial Sequence
  chemically synthesized
aactttggtcttatagacagtg

SEQ ID NO: 752895 - DNA, 22 bp, Artificial Sequence
  chemically synthesized
actttggtcttatagacagtgg

SEQ ID NO: 752896 - DNA, 22 bp, Artificial Sequence
  chemically synthesized
tatatttggaagaccactgtct

SEQ ID NO: 752897 - DNA, 22 bp, Artificial Sequence
  chemically synthesized
tggtcttatagacagtggtctt

SEQ ID NO: 752898 - DNA, 22 bp, Artificial Sequence
  chemically synthesized
ggtcttatagacagtggtcttc

SEQ ID NO: 752899 - DNA, 22 bp, Artificial Sequence
  chemically synthesized
gtcttatagacagtggtcttcc

SEQ ID NO: 752900 - DNA, 22 bp, Artificial Sequence
  chemically synthesized
atagacagtggtcttccaaata

SEQ ID NO: 752901 - DNA, 22 bp, Artificial Sequence
  chemically synthesized
tagacagtggtcttccaaatat

SEQ ID NO: 752902 - DNA, 22 bp, Artificial Sequence
  chemically synthesized
cagaaatgagggaaaatcatta

SEQ ID NO: 752903 - DNA, 22 bp, Artificial Sequence
  chemically synthesized
ccaaatatataatgattttccc

SEQ ID NO: 752904 - DNA, 22 bp, Artificial Sequence
  chemically synthesized
caaatatataatgattttccct

SEQ ID NO: 752905 - DNA, 22 bp, Artificial Sequence
  chemically synthesized
gcccactgcagaaatgagggaa

SEQ ID NO: 752906 - DNA, 22 bp, Artificial Sequence
  chemically synthesized
attggcccactgcagaaatgag

SEQ ID NO: 752907 - DNA, 22 bp, Artificial Sequence
  chemically synthesized
cattggcccactgcagaaatga

SEQ ID NO: 752908 - DNA, 22 bp, Artificial Sequence
  chemically synthesized
aagtttcattggcccactgcag

SEQ ID NO: 752909 - DNA, 22 bp, Artificial Sequence
  chemically synthesized
caagtttcattggcccactgca

SEQ ID NO: 752910 - DNA, 22 bp, Artificial Sequence
  chemically synthesized
tccctcatttctgcagtgggcc

SEQ ID NO: 752911 - DNA, 22 bp, Artificial Sequence
  chemically synthesized
ccctcatttctgcagtgggcca

SEQ ID NO: 752912 - DNA, 22 bp, Artificial Sequence
  chemically synthesized
cctcatttctgcagtgggccaa

SEQ ID NO: 752913 - DNA, 22 bp, Artificial Sequence
  chemically synthesized
atttctgcagtgggccaatgaa

SEQ ID NO: 752914 - DNA, 22 bp, Artificial Sequence
  chemically synthesized
ctgcagtgggccaatgaaactt

SEQ ID NO: 752915 - DNA, 22 bp, Artificial Sequence
  chemically synthesized
taatacagtttcaagtttcatt

SEQ ID NO: 752916 - DNA, 22 bp, Artificial Sequence
  chemically synthesized
tgcagtgggccaatgaaacttg

SEQ ID NO: 752917 - DNA, 22 bp, Artificial Sequence
  chemically synthesized
gtaatacagtttcaagtttcat

SEQ ID NO: 752918 - DNA, 22 bp, Artificial Sequence
  chemically synthesized
cagtgggccaatgaaacttgaa

SEQ ID NO: 752919 - DNA, 22 bp, Artificial Sequence
  chemically synthesized
gaaggcaacatttgtaatacag

SEQ ID NO: 752920 - DNA, 22 bp, Artificial Sequence
  chemically synthesized
ggaaggcaacatttgtaataca

SEQ ID NO: 752921 - DNA, 22 bp, Artificial Sequence
  chemically synthesized
ccttggaaggcaacatttgtaa

SEQ ID NO: 752922 - DNA, 22 bp, Artificial Sequence
  chemically synthesized
cccttggaaggcaacatttgta

SEQ ID NO: 752923 - DNA, 22 bp, Artificial Sequence
  chemically synthesized
gaaactgtattacaaatgttgc

SEQ ID NO: 752924 - DNA, 22 bp, Artificial Sequence
  chemically synthesized
aaactgtattacaaatgttgcc

SEQ ID NO: 752925 - DNA, 22 bp, Artificial Sequence
  chemically synthesized
cccttcccttggaaggcaacat

SEQ ID NO: 752926 - DNA, 22 bp, Artificial Sequence
  chemically synthesized
tattacaaatgttgccttccaa

SEQ ID NO: 752927 - DNA, 22 bp, Artificial Sequence
  chemically synthesized
atgtgttgcccttcccttggaa

SEQ ID NO: 752928 - DNA, 22 bp, Artificial Sequence
  chemically synthesized
caaatgttgccttccaagggaa

SEQ ID NO: 752929 - DNA, 22 bp, Artificial Sequence
  chemically synthesized
ttaatgtgttgcccttcccttg

SEQ ID NO: 752930 - DNA, 22 bp, Artificial Sequence
  chemically synthesized
ccttccaagggaagggcaacac

SEQ ID NO: 752931 - DNA, 22 bp, Artificial Sequence
  chemically synthesized
ccaagggaagggcaacacatta

SEQ ID NO: 752932 - DNA, 22 bp, Artificial Sequence
  chemically synthesized
caagggaagggcaacacattaa

SEQ ID NO: 752933 - DNA, 22 bp, Artificial Sequence
  chemically synthesized
gtgaaataaggctgttaatgtg

SEQ ID NO: 752934 - DNA, 22 bp, Artificial Sequence
  chemically synthesized
ggtgaaataaggctgttaatgt

SEQ ID NO: 752935 - DNA, 22 bp, Artificial Sequence
  chemically synthesized
tggtttggtgaaataaggctgt

SEQ ID NO: 752936 - DNA, 22 bp, Artificial Sequence
  chemically synthesized
ggtaagttatggtttggtgaaa

SEQ ID NO: 752937 - DNA, 22 bp, Artificial Sequence
  chemically synthesized
gggtaagttatggtttggtgaa

SEQ ID NO: 752938 - DNA, 22 bp, Artificial Sequence
  chemically synthesized
acagccttatttcaccaaacca

SEQ ID NO: 752939 - DNA, 22 bp, Artificial Sequence
  chemically synthesized
catgacttgggtaagttatggt

SEQ ID NO: 752940 - DNA, 22 bp, Artificial Sequence
  chemically synthesized
atttcaccaaaccataacttac

SEQ ID NO: 752941 - DNA, 22 bp, Artificial Sequence
  chemically synthesized
tttcaccaaaccataacttacc

SEQ ID NO: 752942 - DNA, 22 bp, Artificial Sequence
  chemically synthesized
caccaaaccataacttacccaa

SEQ ID NO: 752943 - DNA, 22 bp, Artificial Sequence
  chemically synthesized
accaaaccataacttacccaag

SEQ ID NO: 752944 - DNA, 22 bp, Artificial Sequence
  chemically synthesized
accaaattacatgacttgggta

SEQ ID NO: 752945 - DNA, 22 bp, Artificial Sequence
  chemically synthesized
ctaaccaaattacatgacttgg

SEQ ID NO: 752946 - DNA, 22 bp, Artificial Sequence
  chemically synthesized
gctaaccaaattacatgacttg

SEQ ID NO: 752947 - DNA, 22 bp, Artificial Sequence
  chemically synthesized
tgctaaccaaattacatgactt

SEQ ID NO: 752948 - DNA, 22 bp, Artificial Sequence
  chemically synthesized
ttgctaaccaaattacatgact

SEQ ID NO: 752949 - DNA, 22 bp, Artificial Sequence
  chemically synthesized
gcccttttgctaaccaaattac

SEQ ID NO: 752950 - DNA, 22 bp, Artificial Sequence
  chemically synthesized
acccaagtcatgtaatttggtt

SEQ ID NO: 752951 - DNA, 22 bp, Artificial Sequence
  chemically synthesized
cccaagtcatgtaatttggtta

SEQ ID NO: 752952 - DNA, 22 bp, Artificial Sequence
  chemically synthesized
ggtgttggcccttttgctaacc

SEQ ID NO: 752953 - DNA, 22 bp, Artificial Sequence
  chemically synthesized
ggttagcaaaagggccaacacc

SEQ ID NO: 752954 - DNA, 22 bp, Artificial Sequence
  chemically synthesized
gttagcaaaagggccaacacct

SEQ ID NO: 752955 - DNA, 22 bp, Artificial Sequence
  chemically synthesized
gcaaaagggccaacacctagac

SEQ ID NO: 752956 - DNA, 22 bp, Artificial Sequence
  chemically synthesized
atcaaaagccaggagtctaggt

SEQ ID NO: 752957 - DNA, 22 bp, Artificial Sequence
  chemically synthesized
aatcaaaagccaggagtctagg

SEQ ID NO: 752958 - DNA, 22 bp, Artificial Sequence
  chemically synthesized
gactcctggcttttgattaagt

SEQ ID NO: 752959 - DNA, 22 bp, Artificial Sequence
  chemically synthesized
ctggcttttgattaagtgtttt

SEQ ID NO: 752960 - DNA, 22 bp, Artificial Sequence
  chemically synthesized
gcttttgattaagtgttttatt

SEQ ID NO: 752961 - DNA, 22 bp, Artificial Sequence
  chemically synthesized
ttgattaagtgttttatttttc

SEQ ID NO: 752962 - DNA, 22 bp, Artificial Sequence
  chemically synthesized
tgattaagtgttttatttttct

SEQ ID NO: 752963 - DNA, 22 bp, Artificial Sequence
  chemically synthesized
gtatcagaatacagaaaaataa

SEQ ID NO: 752964 - DNA, 22 bp, Artificial Sequence
  chemically synthesized
gattaagtgttttatttttctg

SEQ ID NO: 752965 - DNA, 22 bp, Artificial Sequence
  chemically synthesized
agtatcagaatacagaaaaata

SEQ ID NO: 752966 - DNA, 22 bp, Artificial Sequence
  chemically synthesized
attaagtgttttatttttctgt

SEQ ID NO: 752967 - DNA, 22 bp, Artificial Sequence
  chemically synthesized
cttagtatcagaatacagaaaa

SEQ ID NO: 752968 - DNA, 22 bp, Artificial Sequence
  chemically synthesized
agtgttttatttttctgtattc

SEQ ID NO: 752969 - DNA, 22 bp, Artificial Sequence
  chemically synthesized
tgttacttagtatcagaataca

SEQ ID NO: 752970 - DNA, 22 bp, Artificial Sequence
  chemically synthesized
gtgttacttagtatcagaatac

SEQ ID NO: 752971 - DNA, 22 bp, Artificial Sequence
  chemically synthesized
tatttttctgtattctgatact

SEQ ID NO: 752972 - DNA, 22 bp, Artificial Sequence
  chemically synthesized
cttgtgttacttagtatcagaa

SEQ ID NO: 752973 - DNA, 22 bp, Artificial Sequence
  chemically synthesized
atttttctgtattctgatacta

SEQ ID NO: 752974 - DNA, 22 bp, Artificial Sequence
  chemically synthesized
tttttctgtattctgatactaa

SEQ ID NO: 752975 - DNA, 22 bp, Artificial Sequence
  chemically synthesized
ttctgtattctgatactaagta

SEQ ID NO: 752976 - DNA, 22 bp, Artificial Sequence
  chemically synthesized
tctgtattctgatactaagtaa

SEQ ID NO: 752977 - DNA, 22 bp, Artificial Sequence
  chemically synthesized
ctgtattctgatactaagtaac

SEQ ID NO: 752978 - DNA, 22 bp, Artificial Sequence
  chemically synthesized
tgtattctgatactaagtaaca

SEQ ID NO: 752979 - DNA, 22 bp, Artificial Sequence
  chemically synthesized
gtgtattgcttgtgttacttag

SEQ ID NO: 752980 - DNA, 22 bp, Artificial Sequence
  chemically synthesized
tattctgatactaagtaacaca

SEQ ID NO: 752981 - DNA, 22 bp, Artificial Sequence
  chemically synthesized
tgatactaagtaacacaagcaa

SEQ ID NO: 752982 - DNA, 22 bp, Artificial Sequence
  chemically synthesized
atactaagtaacacaagcaata

SEQ ID NO: 752983 - DNA, 22 bp, Artificial Sequence
  chemically synthesized
agtaacacaagcaatacaccaa

SEQ ID NO: 752984 - DNA, 22 bp, Artificial Sequence
  chemically synthesized
atgtgtgtgtgtgtgtgtgtgt

SEQ ID NO: 752985 - DNA, 22 bp, Artificial Sequence
  chemically synthesized
aagtctgatgtgtgtgtgtgtg

SEQ ID NO: 752986 - DNA, 22 bp, Artificial Sequence
  chemically synthesized
tactaaagtctgatgtgtgtgt

SEQ ID NO: 752987 - DNA, 22 bp, Artificial Sequence
  chemically synthesized
agtgattgtactaaagtctgat

SEQ ID NO: 752988 - DNA, 22 bp, Artificial Sequence
  chemically synthesized
atattaagtgattgtactaaag

SEQ ID NO: 752989 - DNA, 22 bp, Artificial Sequence
  chemically synthesized
gatattaagtgattgtactaaa

SEQ ID NO: 752990 - DNA, 22 bp, Artificial Sequence
  chemically synthesized
tgatattaagtgattgtactaa

SEQ ID NO: 752991 - DNA, 22 bp, Artificial Sequence
  chemically synthesized
actttgatattaagtgattgta

SEQ ID NO: 752992 - DNA, 22 bp, Artificial Sequence
  chemically synthesized
gactttgatattaagtgattgt

SEQ ID NO: 752993 - DNA, 22 bp, Artificial Sequence
  chemically synthesized
tgactttgatattaagtgattg

SEQ ID NO: 752994 - DNA, 22 bp, Artificial Sequence
  chemically synthesized
tagtacaatcacttaatatcaa

SEQ ID NO: 752995 - DNA, 22 bp, Artificial Sequence
  chemically synthesized
agtacaatcacttaatatcaaa

SEQ ID NO: 752996 - DNA, 22 bp, Artificial Sequence
  chemically synthesized
gtacaatcacttaatatcaaag

SEQ ID NO: 752997 - DNA, 22 bp, Artificial Sequence
  chemically synthesized
cagggcaagaaatcactttgac

SEQ ID NO: 752998 - DNA, 22 bp, Artificial Sequence
  chemically synthesized
aatatcaaagtcaaagtgattt

SEQ ID NO: 752999 - DNA, 22 bp, Artificial Sequence
  chemically synthesized
atatcaaagtcaaagtgatttc

SEQ ID NO: 753000 - DNA, 22 bp, Artificial Sequence
  chemically synthesized
aaacagttacagggcaagaaat

SEQ ID NO: 753001 - DNA, 22 bp, Artificial Sequence
  chemically synthesized
cttgccctgtaactgttttaat

SEQ ID NO: 753002 - DNA, 22 bp, Artificial Sequence
  chemically synthesized
ttgccctgtaactgttttaata

SEQ ID NO: 753003 - DNA, 22 bp, Artificial Sequence
  chemically synthesized
tatgaaatgaaatattaaaaca

SEQ ID NO: 753004 - DNA, 22 bp, Artificial Sequence
  chemically synthesized
gccctgtaactgttttaatatt

SEQ ID NO: 753005 - DNA, 22 bp, Artificial Sequence
  chemically synthesized
ccctgtaactgttttaatattt

SEQ ID NO: 753006 - DNA, 22 bp, Artificial Sequence
  chemically synthesized
agttatatgaaatgaaatatta

SEQ ID NO: 753007 - DNA, 22 bp, Artificial Sequence
  chemically synthesized
cagttatatgaaatgaaatatt

SEQ ID NO: 753008 - DNA, 22 bp, Artificial Sequence
  chemically synthesized
taactgttttaatatttcattt

SEQ ID NO: 753009 - DNA, 22 bp, Artificial Sequence
  chemically synthesized
tcttcagttatatgaaatgaaa

SEQ ID NO: 753010 - DNA, 22 bp, Artificial Sequence
  chemically synthesized
ttttaatatttcatttcatata

SEQ ID NO: 753011 - DNA, 22 bp, Artificial Sequence
  chemically synthesized
tctgtcttcagttatatgaaat

SEQ ID NO: 753012 - DNA, 22 bp, Artificial Sequence
  chemically synthesized
gtctgtcttcagttatatgaaa

SEQ ID NO: 753013 - DNA, 22 bp, Artificial Sequence
  chemically synthesized
taatatttcatttcatataact

SEQ ID NO: 753014 - DNA, 22 bp, Artificial Sequence
  chemically synthesized
aatatttcatttcatataactg

SEQ ID NO: 753015 - DNA, 22 bp, Artificial Sequence
  chemically synthesized
tttgtctgtcttcagttatatg

SEQ ID NO: 753016 - DNA, 22 bp, Artificial Sequence
  chemically synthesized
atatttcatttcatataactga

SEQ ID NO: 753017 - DNA, 22 bp, Artificial Sequence
  chemically synthesized
attatttgtctgtcttcagtta

SEQ ID NO: 753018 - DNA, 22 bp, Artificial Sequence
  chemically synthesized
catttcatataactgaagacag

SEQ ID NO: 753019 - DNA, 22 bp, Artificial Sequence
  chemically synthesized
atttcatataactgaagacaga

SEQ ID NO: 753020 - DNA, 22 bp, Artificial Sequence
  chemically synthesized
catataactgaagacagacaaa

SEQ ID NO: 753021 - DNA, 22 bp, Artificial Sequence
  chemically synthesized
atataactgaagacagacaaat

SEQ ID NO: 753022 - DNA, 22 bp, Artificial Sequence
  chemically synthesized
aagacagacaaataattagatc

SEQ ID NO: 753023 - DNA, 22 bp, Artificial Sequence
  chemically synthesized
caagagaagacagtgatctaat

SEQ ID NO: 753024 - DNA, 22 bp, Artificial Sequence
  chemically synthesized
tccaagagaagacagtgatcta

SEQ ID NO: 753025 - DNA, 22 bp, Artificial Sequence
  chemically synthesized
ctccaagagaagacagtgatct

SEQ ID NO: 753026 - DNA, 22 bp, Artificial Sequence
  chemically synthesized
tctccaagagaagacagtgatc

SEQ ID NO: 753027 - DNA, 22 bp, Artificial Sequence
  chemically synthesized
acatggtattttctccaagaga

SEQ ID NO: 753028 - DNA, 22 bp, Artificial Sequence
  chemically synthesized
gatcactgtcttctcttggaga

SEQ ID NO: 753029 - DNA, 22 bp, Artificial Sequence
  chemically synthesized
attcacatggtattttctccaa

SEQ ID NO: 753030 - DNA, 22 bp, Artificial Sequence
  chemically synthesized
cattcacatggtattttctcca

SEQ ID NO: 753031 - DNA, 22 bp, Artificial Sequence
  chemically synthesized
tcttctcttggagaaaatacca

SEQ ID NO: 753032 - DNA, 22 bp, Artificial Sequence
  chemically synthesized
agtcttcattcacatggtattt

SEQ ID NO: 753033 - DNA, 22 bp, Artificial Sequence
  chemically synthesized
ctcttggagaaaataccatgtg

SEQ ID NO: 753034 - DNA, 22 bp, Artificial Sequence
  chemically synthesized
tcttggagaaaataccatgtga

SEQ ID NO: 753035 - DNA, 22 bp, Artificial Sequence
  chemically synthesized
ttggagaaaataccatgtgaat

SEQ ID NO: 753036 - DNA, 22 bp, Artificial Sequence
  chemically synthesized
ggagaaaataccatgtgaatga

SEQ ID NO: 753037 - DNA, 22 bp, Artificial Sequence
  chemically synthesized
gagaaaataccatgtgaatgaa

SEQ ID NO: 753038 - DNA, 22 bp, Artificial Sequence
  chemically synthesized
acaaattcagtcttcattcaca

SEQ ID NO: 753039 - DNA, 22 bp, Artificial Sequence
  chemically synthesized
cacaaattcagtcttcattcac

SEQ ID NO: 753040 - DNA, 22 bp, Artificial Sequence
  chemically synthesized
tcacaaattcagtcttcattca

SEQ ID NO: 753041 - DNA, 22 bp, Artificial Sequence
  chemically synthesized
gagaaatcagtccgtctttcac

SEQ ID NO: 753042 - DNA, 22 bp, Artificial Sequence
  chemically synthesized
aagctagagaaatcagtccgtc

SEQ ID NO: 753043 - DNA, 22 bp, Artificial Sequence
  chemically synthesized
aatttgtgaaagacggactgat

SEQ ID NO: 753044 - DNA, 22 bp, Artificial Sequence
  chemically synthesized
gtgaaagacggactgatttctc

SEQ ID NO: 753045 - DNA, 22 bp, Artificial Sequence
  chemically synthesized
tgaaagacggactgatttctct

SEQ ID NO: 753046 - DNA, 22 bp, Artificial Sequence
  chemically synthesized
ccacaaagttaaagctagagaa

SEQ ID NO: 753047 - DNA, 22 bp, Artificial Sequence
  chemically synthesized
cccacaaagttaaagctagaga

SEQ ID NO: 753048 - DNA, 22 bp, Artificial Sequence
  chemically synthesized
tcttcccacaaagttaaagcta

SEQ ID NO: 753049 - DNA, 22 bp, Artificial Sequence
  chemically synthesized
atttctctagctttaactttgt

SEQ ID NO: 753050 - DNA, 22 bp, Artificial Sequence
  chemically synthesized
ctctagctttaactttgtggga

SEQ ID NO: 753051 - DNA, 22 bp, Artificial Sequence
  chemically synthesized
tctagctttaactttgtgggaa

SEQ ID NO: 753052 - DNA, 22 bp, Artificial Sequence
  chemically synthesized
tagctttaactttgtgggaaga

SEQ ID NO: 753053 - DNA, 22 bp, Artificial Sequence
  chemically synthesized
agtgcagtgttatcttcccaca

SEQ ID NO: 753054 - DNA, 22 bp, Artificial Sequence
  chemically synthesized
gagtgcagtgttatcttcccac

SEQ ID NO: 753055 - DNA, 22 bp, Artificial Sequence
  chemically synthesized
gctttaactttgtgggaagata

SEQ ID NO: 753056 - DNA, 22 bp, Artificial Sequence
  chemically synthesized
taactttgtgggaagataacac

SEQ ID NO: 753057 - DNA, 22 bp, Artificial Sequence
  chemically synthesized
aacttgagtgcagtgttatctt

SEQ ID NO: 753058 - DNA, 22 bp, Artificial Sequence
  chemically synthesized
aactttgtgggaagataacact

SEQ ID NO: 753059 - DNA, 22 bp, Artificial Sequence
  chemically synthesized
actttgtgggaagataacactg

SEQ ID NO: 753060 - DNA, 22 bp, Artificial Sequence
  chemically synthesized
atctgaacttgagtgcagtgtt

SEQ ID NO: 753061 - DNA, 22 bp, Artificial Sequence
  chemically synthesized
tgtgggaagataacactgcact

SEQ ID NO: 753062 - DNA, 22 bp, Artificial Sequence
  chemically synthesized
gtgggaagataacactgcactc

SEQ ID NO: 753063 - DNA, 22 bp, Artificial Sequence
  chemically synthesized
taatctgaacttgagtgcagtg

SEQ ID NO: 753064 - DNA, 22 bp, Artificial Sequence
  chemically synthesized
tgggaagataacactgcactca

SEQ ID NO: 753065 - DNA, 22 bp, Artificial Sequence
  chemically synthesized
ctaatctgaacttgagtgcagt

SEQ ID NO: 753066 - DNA, 22 bp, Artificial Sequence
  chemically synthesized
aaaagagcttctaatctgaact

SEQ ID NO: 753067 - DNA, 22 bp, Artificial Sequence
  chemically synthesized
cactcaagttcagattagaagc

SEQ ID NO: 753068 - DNA, 22 bp, Artificial Sequence
  chemically synthesized
agagactcaaaagagcttctaa

SEQ ID NO: 753069 - DNA, 22 bp, Artificial Sequence
  chemically synthesized
gagagactcaaaagagcttcta

SEQ ID NO: 753070 - DNA, 22 bp, Artificial Sequence
  chemically synthesized
tgagagactcaaaagagcttct

SEQ ID NO: 753071 - DNA, 22 bp, Artificial Sequence
  chemically synthesized
aagttcagattagaagctcttt

SEQ ID NO: 753072 - DNA, 22 bp, Artificial Sequence
  chemically synthesized
agattagaagctcttttgagtc

SEQ ID NO: 753073 - DNA, 22 bp, Artificial Sequence
  chemically synthesized
agggccctttgagagactcaaa

SEQ ID NO: 753074 - DNA, 22 bp, Artificial Sequence
  chemically synthesized
cagggccctttgagagactcaa

SEQ ID NO: 753075 - DNA, 22 bp, Artificial Sequence
  chemically synthesized
gaagctcttttgagtctctcaa

SEQ ID NO: 753076 - DNA, 22 bp, Artificial Sequence
  chemically synthesized
cttcagggccctttgagagact

SEQ ID NO: 753077 - DNA, 22 bp, Artificial Sequence
  chemically synthesized
gcttcagggccctttgagagac

SEQ ID NO: 753078 - DNA, 22 bp, Artificial Sequence
  chemically synthesized
tgcttcagggccctttgagaga

SEQ ID NO: 753079 - DNA, 22 bp, Artificial Sequence
  chemically synthesized
tttgcttcagggccctttgaga

SEQ ID NO: 753080 - DNA, 22 bp, Artificial Sequence
  chemically synthesized
ctttgcttcagggccctttgag

SEQ ID NO: 753081 - DNA, 22 bp, Artificial Sequence
  chemically synthesized
ttttgagtctctcaaagggccc

SEQ ID NO: 753082 - DNA, 22 bp, Artificial Sequence
  chemically synthesized
cttctttgcttcagggcccttt

SEQ ID NO: 753083 - DNA, 22 bp, Artificial Sequence
  chemically synthesized
ttgagtctctcaaagggccctg

SEQ ID NO: 753084 - DNA, 22 bp, Artificial Sequence
  chemically synthesized
tgagtctctcaaagggccctga

SEQ ID NO: 753085 - DNA, 22 bp, Artificial Sequence
  chemically synthesized
gagtctctcaaagggccctgaa

SEQ ID NO: 753086 - DNA, 22 bp, Artificial Sequence
  chemically synthesized
agtctctcaaagggccctgaag

SEQ ID NO: 753087 - DNA, 22 bp, Artificial Sequence
  chemically synthesized
tcaaagggccctgaagcaaaga

SEQ ID NO: 753088 - DNA, 22 bp, Artificial Sequence
  chemically synthesized
aaagggccctgaagcaaagaag

SEQ ID NO: 753089 - DNA, 22 bp, Artificial Sequence
  chemically synthesized
gagaaagtcaaggtaccgtcta

SEQ ID NO: 753090 - DNA, 22 bp, Artificial Sequence
  chemically synthesized
aagcaaagaagtagacggtacc

SEQ ID NO: 753091 - DNA, 22 bp, Artificial Sequence
  chemically synthesized
caagatcacctcgagaaagtca

SEQ ID NO: 753092 - DNA, 22 bp, Artificial Sequence
  chemically synthesized
tccaagatcacctcgagaaagt

SEQ ID NO: 753093 - DNA, 22 bp, Artificial Sequence
  chemically synthesized
tctccaagatcacctcgagaaa

SEQ ID NO: 753094 - DNA, 22 bp, Artificial Sequence
  chemically synthesized
actctctccaagatcacctcga

SEQ ID NO: 753095 - DNA, 22 bp, Artificial Sequence
  chemically synthesized
attgactctctccaagatcacc

SEQ ID NO: 753096 - DNA, 22 bp, Artificial Sequence
  chemically synthesized
gactttctcgaggtgatcttgg

SEQ ID NO: 753097 - DNA, 22 bp, Artificial Sequence
  chemically synthesized
actttctcgaggtgatcttgga

SEQ ID NO: 753098 - DNA, 22 bp, Artificial Sequence
  chemically synthesized
ctcattgactctctccaagatc

SEQ ID NO: 753099 - DNA, 22 bp, Artificial Sequence
  chemically synthesized
tctcgaggtgatcttggagaga

SEQ ID NO: 753100 - DNA, 22 bp, Artificial Sequence
  chemically synthesized
ctcgaggtgatcttggagagag

SEQ ID NO: 753101 - DNA, 22 bp, Artificial Sequence
  chemically synthesized
tcgaggtgatcttggagagagt

SEQ ID NO: 753102 - DNA, 22 bp, Artificial Sequence
  chemically synthesized
gaggtgatcttggagagagtca

SEQ ID NO: 753103 - DNA, 22 bp, Artificial Sequence
  chemically synthesized
ggagagagtcaatgaggagatc

SEQ ID NO: 753104 - DNA, 22 bp, Artificial Sequence
  chemically synthesized
gagagagtcaatgaggagatcg

SEQ ID NO: 753105 - DNA, 22 bp, Artificial Sequence
  chemically synthesized
gcagcccgtgggcgatctcctc

SEQ ID NO: 753106 - DNA, 22 bp, Artificial Sequence
  chemically synthesized
aggtgatcaagggatcctggca

SEQ ID NO: 753107 - DNA, 22 bp, Artificial Sequence
  chemically synthesized
cgccaagctgaggtgatcaagg

SEQ ID NO: 753108 - DNA, 22 bp, Artificial Sequence
  chemically synthesized
ccaggatcccttgatcacctca

SEQ ID NO: 753109 - DNA, 22 bp, Artificial Sequence
  chemically synthesized
aagctgcgccaagctgaggtga

SEQ ID NO: 753110 - DNA, 22 bp, Artificial Sequence
  chemically synthesized
gacctcaagctgcgccaagctg

SEQ ID NO: 753111 - DNA, 22 bp, Artificial Sequence
  chemically synthesized
gatcacctcagcttggcgcagc

SEQ ID NO: 753112 - DNA, 22 bp, Artificial Sequence
  chemically synthesized
atcacctcagcttggcgcagct

SEQ ID NO: 753113 - DNA, 22 bp, Artificial Sequence
  chemically synthesized
agcttggcgcagcttgaggtcc

SEQ ID NO: 753114 - DNA, 22 bp, Artificial Sequence
  chemically synthesized
ggcgcagcttgaggtccagctc

SEQ ID NO: 753115 - DNA, 22 bp, Artificial Sequence
  chemically synthesized
gcgcagcttgaggtccagctca

SEQ ID NO: 753116 - DNA, 22 bp, Artificial Sequence
  chemically synthesized
aagaggccacggatgagctgga

SEQ ID NO: 753117 - DNA, 22 bp, Artificial Sequence
  chemically synthesized
caagaggccacggatgagctgg

SEQ ID NO: 753118 - DNA, 22 bp, Artificial Sequence
  chemically synthesized
gaggtccagctcatccgtggcc

SEQ ID NO: 753119 - DNA, 22 bp, Artificial Sequence
  chemically synthesized
aggtccagctcatccgtggcct

SEQ ID NO: 753120 - DNA, 22 bp, Artificial Sequence
  chemically synthesized
caggaacttcaagaggccacgg

SEQ ID NO: 753121 - DNA, 22 bp, Artificial Sequence
  chemically synthesized
aaagactccaggaacttcaaga

SEQ ID NO: 753122 - DNA, 22 bp, Artificial Sequence
  chemically synthesized
gaaagactccaggaacttcaag

SEQ ID NO: 753123 - DNA, 22 bp, Artificial Sequence
  chemically synthesized
atccgtggcctcttgaagttcc

SEQ ID NO: 753124 - DNA, 22 bp, Artificial Sequence
  chemically synthesized
ttgaagttcctggagtctttca

SEQ ID NO: 753125 - DNA, 22 bp, Artificial Sequence
  chemically synthesized
gaagttcctggagtctttcaag

SEQ ID NO: 753126 - DNA, 22 bp, Artificial Sequence
  chemically synthesized
aagttcctggagtctttcaagg

SEQ ID NO: 753127 - DNA, 22 bp, Artificial Sequence
  chemically synthesized
ctggagtctttcaagggtctca

SEQ ID NO: 753128 - DNA, 22 bp, Artificial Sequence
  chemically synthesized
gagtctttcaagggtctcatct

SEQ ID NO: 753129 - DNA, 22 bp, Artificial Sequence
  chemically synthesized
gcagagaaaaatagatgagacc

SEQ ID NO: 753130 - DNA, 22 bp, Artificial Sequence
  chemically synthesized
actggcagagaaaaatagatga

SEQ ID NO: 753131 - DNA, 22 bp, Artificial Sequence
  chemically synthesized
tcaagggtctcatctatttttc

SEQ ID NO: 753132 - DNA, 22 bp, Artificial Sequence
  chemically synthesized
caagggtctcatctatttttct

SEQ ID NO: 753133 - DNA, 22 bp, Artificial Sequence
  chemically synthesized
aagggtctcatctatttttctc

SEQ ID NO: 753134 - DNA, 22 bp, Artificial Sequence
  chemically synthesized
cgctgactggcagagaaaaata

SEQ ID NO: 753135 - DNA, 22 bp, Artificial Sequence
  chemically synthesized
cactccgctgactggcagagaa

SEQ ID NO: 753136 - DNA, 22 bp, Artificial Sequence
  chemically synthesized
atctatttttctctgccagtca

SEQ ID NO: 753137 - DNA, 22 bp, Artificial Sequence
  chemically synthesized
aacctgcactccgctgactggc

SEQ ID NO: 753138 - DNA, 22 bp, Artificial Sequence
  chemically synthesized
tttttctctgccagtcagcgga

SEQ ID NO: 753139 - DNA, 22 bp, Artificial Sequence
  chemically synthesized
ttctctgccagtcagcggagtg

SEQ ID NO: 753140 - DNA, 22 bp, Artificial Sequence
  chemically synthesized
tctctgccagtcagcggagtgc

SEQ ID NO: 753141 - DNA, 22 bp, Artificial Sequence
  chemically synthesized
ctctgccagtcagcggagtgca

SEQ ID NO: 753142 - DNA, 22 bp, Artificial Sequence
  chemically synthesized
tctgccagtcagcggagtgcag

SEQ ID NO: 753143 - DNA, 22 bp, Artificial Sequence
  chemically synthesized
tgccagtcagcggagtgcaggt

SEQ ID NO: 753144 - DNA, 22 bp, Artificial Sequence
  chemically synthesized
ccagtcagcggagtgcaggttc

SEQ ID NO: 753145 - DNA, 22 bp, Artificial Sequence
  chemically synthesized
agtgggaaaaattgaacctgca

SEQ ID NO: 753146 - DNA, 22 bp, Artificial Sequence
  chemically synthesized
aggaggtcaatactgagtggga

SEQ ID NO: 753147 - DNA, 22 bp, Artificial Sequence
  chemically synthesized
aatttttcccactcagtattga

SEQ ID NO: 753148 - DNA, 22 bp, Artificial Sequence
  chemically synthesized
ttcccactcagtattgacctcc

SEQ ID NO: 753149 - DNA, 22 bp, Artificial Sequence
  chemically synthesized
tcccactcagtattgacctcct

SEQ ID NO: 753150 - DNA, 22 bp, Artificial Sequence
  chemically synthesized
cccactcagtattgacctcctc

SEQ ID NO: 753151 - DNA, 22 bp, Artificial Sequence
  chemically synthesized
cgaaagcaggctgaggaggtca

SEQ ID NO: 753152 - DNA, 22 bp, Artificial Sequence
  chemically synthesized
ccactcagtattgacctcctca

SEQ ID NO: 753153 - DNA, 22 bp, Artificial Sequence
  chemically synthesized
tacgaaagcaggctgaggaggt

SEQ ID NO: 753154 - DNA, 22 bp, Artificial Sequence
  chemically synthesized
ctacgaaagcaggctgaggagg

SEQ ID NO: 753155 - DNA, 22 bp, Artificial Sequence
  chemically synthesized
agtattgacctcctcagcctgc

SEQ ID NO: 753156 - DNA, 22 bp, Artificial Sequence
  chemically synthesized
ggcttctacgaaagcaggctga

SEQ ID NO: 753157 - DNA, 22 bp, Artificial Sequence
  chemically synthesized
acctcctcagcctgctttcgta

SEQ ID NO: 753158 - DNA, 22 bp, Artificial Sequence
  chemically synthesized
ctcagcctgctttcgtagaagc

SEQ ID NO: 753159 - DNA, 22 bp, Artificial Sequence
  chemically synthesized
agcctgctttcgtagaagccga

SEQ ID NO: 753160 - DNA, 22 bp, Artificial Sequence
  chemically synthesized
ctttcgtagaagccgagtgaca

SEQ ID NO: 753161 - DNA, 22 bp, Artificial Sequence
  chemically synthesized
tcgtagaagccgagtgacattc

SEQ ID NO: 753162 - DNA, 22 bp, Artificial Sequence
  chemically synthesized
cgtagaagccgagtgacattct

SEQ ID NO: 753163 - DNA, 22 bp, Artificial Sequence
  chemically synthesized
aggagagagcccagaatgtcac

SEQ ID NO: 753164 - DNA, 22 bp, Artificial Sequence
  chemically synthesized
gtagaagccgagtgacattctg

SEQ ID NO: 753165 - DNA, 22 bp, Artificial Sequence
  chemically synthesized
ctgaggagagagcccagaatgt

SEQ ID NO: 753166 - DNA, 22 bp, Artificial Sequence
  chemically synthesized
cctcctgaggagagagcccaga

SEQ ID NO: 753167 - DNA, 22 bp, Artificial Sequence
  chemically synthesized
gagctgcctcctgaggagagag

SEQ ID NO: 753168 - DNA, 22 bp, Artificial Sequence
  chemically synthesized
agagctgcctcctgaggagaga

SEQ ID NO: 753169 - DNA, 22 bp, Artificial Sequence
  chemically synthesized
tgggctctctcctcaggaggca

SEQ ID NO: 753170 - DNA, 22 bp, Artificial Sequence
  chemically synthesized
ccaatttagagctgcctcctga

SEQ ID NO: 753171 - DNA, 22 bp, Artificial Sequence
  chemically synthesized
ggctctctcctcaggaggcagc

SEQ ID NO: 753172 - DNA, 22 bp, Artificial Sequence
  chemically synthesized
tctcctcaggaggcagctctaa

SEQ ID NO: 753173 - DNA, 22 bp, Artificial Sequence
  chemically synthesized
tcatattgccaatttagagctg

SEQ ID NO: 753174 - DNA, 22 bp, Artificial Sequence
  chemically synthesized
tcctcaggaggcagctctaaat

SEQ ID NO: 753175 - DNA, 22 bp, Artificial Sequence
  chemically synthesized
gtcatattgccaatttagagct

SEQ ID NO: 753176 - DNA, 22 bp, Artificial Sequence
  chemically synthesized
ctcaggaggcagctctaaattg

SEQ ID NO: 753177 - DNA, 22 bp, Artificial Sequence
  chemically synthesized
aggaggcagctctaaattggca

SEQ ID NO: 753178 - DNA, 22 bp, Artificial Sequence
  chemically synthesized
aaaccttgtcatattgccaatt

SEQ ID NO: 753179 - DNA, 22 bp, Artificial Sequence
  chemically synthesized
taaattggcaatatgacaaggt

SEQ ID NO: 753180 - DNA, 22 bp, Artificial Sequence
  chemically synthesized
aattggcaatatgacaaggttt

SEQ ID NO: 753181 - DNA, 22 bp, Artificial Sequence
  chemically synthesized
gcaatatgacaaggttttaggc

SEQ ID NO: 753182 - DNA, 22 bp, Artificial Sequence
  chemically synthesized
aaaaaaaagaatgtggcctaaa

SEQ ID NO: 753183 - DNA, 22 bp, Artificial Sequence
  chemically synthesized
aaaaaaaaagaatgtggcctaa

SEQ ID NO: 753184 - DNA, 22 bp, Artificial Sequence
  chemically synthesized
acaatgtttaaaaaaaaagaat

SEQ ID NO: 753185 - DNA, 22 bp, Artificial Sequence
  chemically synthesized
gacaatgtttaaaaaaaaagaa

SEQ ID NO: 753186 - DNA, 22 bp, Artificial Sequence
  chemically synthesized
tgacaatgtttaaaaaaaaaga

SEQ ID NO: 753187 - DNA, 22 bp, Artificial Sequence
  chemically synthesized
ttgacaatgtttaaaaaaaaag

SEQ ID NO: 753188 - DNA, 22 bp, Artificial Sequence
  chemically synthesized
taggccacattcttttttttta

SEQ ID NO: 753189 - DNA, 22 bp, Artificial Sequence
  chemically synthesized
tttgacaatgtttaaaaaaaaa

SEQ ID NO: 753190 - DNA, 22 bp, Artificial Sequence
  chemically synthesized
aggccacattctttttttttaa

SEQ ID NO: 753191 - DNA, 22 bp, Artificial Sequence
  chemically synthesized
ggccacattctttttttttaaa

SEQ ID NO: 753192 - DNA, 22 bp, Artificial Sequence
  chemically synthesized
tttttttttaaacattgtcaaa

SEQ ID NO: 753193 - DNA, 22 bp, Artificial Sequence
  chemically synthesized
cagtatgacctttttgacaatg

SEQ ID NO: 753194 - DNA, 22 bp, Artificial Sequence
  chemically synthesized
ccagtatgacctttttgacaat

SEQ ID NO: 753195 - DNA, 22 bp, Artificial Sequence
  chemically synthesized
tttttttaaacattgtcaaaaa

SEQ ID NO: 753196 - DNA, 22 bp, Artificial Sequence
  chemically synthesized
ttttttaaacattgtcaaaaag

SEQ ID NO: 753197 - DNA, 22 bp, Artificial Sequence
  chemically synthesized
ttccagtatgacctttttgaca

SEQ ID NO: 753198 - DNA, 22 bp, Artificial Sequence
  chemically synthesized
tttttaaacattgtcaaaaagg

SEQ ID NO: 753199 - DNA, 22 bp, Artificial Sequence
  chemically synthesized
cttccagtatgacctttttgac

SEQ ID NO: 753200 - DNA, 22 bp, Artificial Sequence
  chemically synthesized
ttttaaacattgtcaaaaaggt

SEQ ID NO: 753201 - DNA, 22 bp, Artificial Sequence
  chemically synthesized
tcttccagtatgacctttttga

SEQ ID NO: 753202 - DNA, 22 bp, Artificial Sequence
  chemically synthesized
tttaaacattgtcaaaaaggtc

SEQ ID NO: 753203 - DNA, 22 bp, Artificial Sequence
  chemically synthesized
ttaaacattgtcaaaaaggtca

SEQ ID NO: 753204 - DNA, 22 bp, Artificial Sequence
  chemically synthesized
tttcttccagtatgaccttttt

SEQ ID NO: 753205 - DNA, 22 bp, Artificial Sequence
  chemically synthesized
taaacattgtcaaaaaggtcat

SEQ ID NO: 753206 - DNA, 22 bp, Artificial Sequence
  chemically synthesized
ctttcttccagtatgacctttt

SEQ ID NO: 753207 - DNA, 22 bp, Artificial Sequence
  chemically synthesized
aaacattgtcaaaaaggtcata

SEQ ID NO: 753208 - DNA, 22 bp, Artificial Sequence
  chemically synthesized
tctttcttccagtatgaccttt

SEQ ID NO: 753209 - DNA, 22 bp, Artificial Sequence
  chemically synthesized
aacattgtcaaaaaggtcatac

SEQ ID NO: 753210 - DNA, 22 bp, Artificial Sequence
  chemically synthesized
tttctttcttccagtatgacct

SEQ ID NO: 753211 - DNA, 22 bp, Artificial Sequence
  chemically synthesized
tactctttctttcttccagtat

SEQ ID NO: 753212 - DNA, 22 bp, Artificial Sequence
  chemically synthesized
tcaaaaaggtcatactggaaga

SEQ ID NO: 753213 - DNA, 22 bp, Artificial Sequence
  chemically synthesized
aactgtactctttctttcttcc

SEQ ID NO: 753214 - DNA, 22 bp, Artificial Sequence
  chemically synthesized
ttcaactgtactctttctttct

SEQ ID NO: 753215 - DNA, 22 bp, Artificial Sequence
  chemically synthesized
gttcaactgtactctttctttc

SEQ ID NO: 753216 - DNA, 22 bp, Artificial Sequence
  chemically synthesized
ttgttcaactgtactctttctt

SEQ ID NO: 753217 - DNA, 22 bp, Artificial Sequence
  chemically synthesized
ccctcttgttcaactgtactct

SEQ ID NO: 753218 - DNA, 22 bp, Artificial Sequence
  chemically synthesized
gaagaaagaaagagtacagttg

SEQ ID NO: 753219 - DNA, 22 bp, Artificial Sequence
  chemically synthesized
atcagtaggttaccctcttgtt

SEQ ID NO: 753220 - DNA, 22 bp, Artificial Sequence
  chemically synthesized
aacaagagggtaacctactgat

SEQ ID NO: 753221 - DNA, 22 bp, Artificial Sequence
  chemically synthesized
tgccaaagtataaaaaagccgt

SEQ ID NO: 753222 - DNA, 22 bp, Artificial Sequence
  chemically synthesized
atgccaaagtataaaaaagccg

SEQ ID NO: 753223 - DNA, 22 bp, Artificial Sequence
  chemically synthesized
ctgattaacggcttttttatac

SEQ ID NO: 753224 - DNA, 22 bp, Artificial Sequence
  chemically synthesized
attaacggcttttttatacttt

SEQ ID NO: 753225 - DNA, 22 bp, Artificial Sequence
  chemically synthesized
acggcttttttatactttggca

SEQ ID NO: 753226 - DNA, 22 bp, Artificial Sequence
  chemically synthesized
tatcaaaatttatgccaaagta

SEQ ID NO: 753227 - DNA, 22 bp, Artificial Sequence
  chemically synthesized
ggctgtatcaaaatttatgcca

SEQ ID NO: 753228 - DNA, 22 bp, Artificial Sequence
  chemically synthesized
ttttatactttggcataaattt

SEQ ID NO: 753229 - DNA, 22 bp, Artificial Sequence
  chemically synthesized
tgggctgtatcaaaatttatgc

SEQ ID NO: 753230 - DNA, 22 bp, Artificial Sequence
  chemically synthesized
tttatactttggcataaatttt

SEQ ID NO: 753231 - DNA, 22 bp, Artificial Sequence
  chemically synthesized
ttatactttggcataaattttg

SEQ ID NO: 753232 - DNA, 22 bp, Artificial Sequence
  chemically synthesized
tatactttggcataaattttga

SEQ ID NO: 753233 - DNA, 22 bp, Artificial Sequence
  chemically synthesized
atactttggcataaattttgat

SEQ ID NO: 753234 - DNA, 22 bp, Artificial Sequence
  chemically synthesized
tactttggcataaattttgata

SEQ ID NO: 753235 - DNA, 22 bp, Artificial Sequence
  chemically synthesized
gatgttctgggctgtatcaaaa

SEQ ID NO: 753236 - DNA, 22 bp, Artificial Sequence
  chemically synthesized
agatgttctgggctgtatcaaa

SEQ ID NO: 753237 - DNA, 22 bp, Artificial Sequence
  chemically synthesized
tagatgttctgggctgtatcaa

SEQ ID NO: 753238 - DNA, 22 bp, Artificial Sequence
  chemically synthesized
tggcataaattttgatacagcc

SEQ ID NO: 753239 - DNA, 22 bp, Artificial Sequence
  chemically synthesized
ggcataaattttgatacagccc

SEQ ID NO: 753240 - DNA, 22 bp, Artificial Sequence
  chemically synthesized
gcataaattttgatacagccca

SEQ ID NO: 753241 - DNA, 22 bp, Artificial Sequence
  chemically synthesized
tgatacagcccagaacatctaa

SEQ ID NO: 753242 - DNA, 22 bp, Artificial Sequence
  chemically synthesized
gatacagcccagaacatctaaa

SEQ ID NO: 753243 - DNA, 22 bp, Artificial Sequence
  chemically synthesized
aggaagatatactttagatgtt

SEQ ID NO: 753244 - DNA, 22 bp, Artificial Sequence
  chemically synthesized
atacagcccagaacatctaaag

SEQ ID NO: 753245 - DNA, 22 bp, Artificial Sequence
  chemically synthesized
atataaggtagaaactcaggaa

SEQ ID NO: 753246 - DNA, 22 bp, Artificial Sequence
  chemically synthesized
aagtatatcttcctgagtttct

SEQ ID NO: 753247 - DNA, 22 bp, Artificial Sequence
  chemically synthesized
tcggattgatataaggtagaaa

SEQ ID NO: 753248 - DNA, 22 bp, Artificial Sequence
  chemically synthesized
aattgtcggattgatataaggt

SEQ ID NO: 753249 - DNA, 22 bp, Artificial Sequence
  chemically synthesized
cctgagtttctaccttatatca

SEQ ID NO: 753250 - DNA, 22 bp, Artificial Sequence
  chemically synthesized
aaattgtcggattgatataagg

SEQ ID NO: 753251 - DNA, 22 bp, Artificial Sequence
  chemically synthesized
ctgagtttctaccttatatcaa

SEQ ID NO: 753252 - DNA, 22 bp, Artificial Sequence
  chemically synthesized
agtttctaccttatatcaatcc

SEQ ID NO: 753253 - DNA, 22 bp, Artificial Sequence
  chemically synthesized
ctaccttatatcaatccgacaa

SEQ ID NO: 753254 - DNA, 22 bp, Artificial Sequence
  chemically synthesized
taccttatatcaatccgacaat

SEQ ID NO: 753255 - DNA, 22 bp, Artificial Sequence
  chemically synthesized
agtgaatcttaaattgtcggat

SEQ ID NO: 753256 - DNA, 22 bp, Artificial Sequence
  chemically synthesized
aagtgaatcttaaattgtcgga

SEQ ID NO: 753257 - DNA, 22 bp, Artificial Sequence
  chemically synthesized
ccttatatcaatccgacaattt

SEQ ID NO: 753258 - DNA, 22 bp, Artificial Sequence
  chemically synthesized
atatcaatccgacaatttaaga

SEQ ID NO: 753259 - DNA, 22 bp, Artificial Sequence
  chemically synthesized
tatcaatccgacaatttaagat

SEQ ID NO: 753260 - DNA, 22 bp, Artificial Sequence
  chemically synthesized
aatagcttaagtgaatcttaaa

SEQ ID NO: 753261 - DNA, 22 bp, Artificial Sequence
  chemically synthesized
ctcaatagcttaagtgaatctt

SEQ ID NO: 753262 - DNA, 22 bp, Artificial Sequence
  chemically synthesized
tcctcaatagcttaagtgaatc

SEQ ID NO: 753263 - DNA, 22 bp, Artificial Sequence
  chemically synthesized
ctcctcaatagcttaagtgaat

SEQ ID NO: 753264 - DNA, 22 bp, Artificial Sequence
  chemically synthesized
tctcctcaatagcttaagtgaa

SEQ ID NO: 753265 - DNA, 22 bp, Artificial Sequence
  chemically synthesized
ttctcctcaatagcttaagtga

SEQ ID NO: 753266 - DNA, 22 bp, Artificial Sequence
  chemically synthesized
acgtttttctcctcaatagctt

SEQ ID NO: 753267 - DNA, 22 bp, Artificial Sequence
  chemically synthesized
aagattcacttaagctattgag

SEQ ID NO: 753268 - DNA, 22 bp, Artificial Sequence
  chemically synthesized
agattcacttaagctattgagg

SEQ ID NO: 753269 - DNA, 22 bp, Artificial Sequence
  chemically synthesized
acttaagctattgaggagaaaa

SEQ ID NO: 753270 - DNA, 22 bp, Artificial Sequence
  chemically synthesized
aagctattgaggagaaaaacgt

SEQ ID NO: 753271 - DNA, 22 bp, Artificial Sequence
  chemically synthesized
agctattgaggagaaaaacgtt

SEQ ID NO: 753272 - DNA, 22 bp, Artificial Sequence
  chemically synthesized
tggtatgcatcctaacgttttt

SEQ ID NO: 753273 - DNA, 22 bp, Artificial Sequence
  chemically synthesized
gtggtatgcatcctaacgtttt

SEQ ID NO: 753274 - DNA, 22 bp, Artificial Sequence
  chemically synthesized
ttgaggagaaaaacgttaggat

SEQ ID NO: 753275 - DNA, 22 bp, Artificial Sequence
  chemically synthesized
aggagaaaaacgttaggatgca

SEQ ID NO: 753276 - DNA, 22 bp, Artificial Sequence
  chemically synthesized
gagcttgtggtatgcatcctaa

SEQ ID NO: 753277 - DNA, 22 bp, Artificial Sequence
  chemically synthesized
aagtaaattagagcttgtggta

SEQ ID NO: 753278 - DNA, 22 bp, Artificial Sequence
  chemically synthesized
cctgaagtaaattagagcttgt

SEQ ID NO: 753279 - DNA, 22 bp, Artificial Sequence
  chemically synthesized
ggatgcataccacaagctctaa

SEQ ID NO: 753280 - DNA, 22 bp, Artificial Sequence
  chemically synthesized
agagcctgcctgaagtaaatta

SEQ ID NO: 753281 - DNA, 22 bp, Artificial Sequence
  chemically synthesized
aagagcctgcctgaagtaaatt

SEQ ID NO: 753282 - DNA, 22 bp, Artificial Sequence
  chemically synthesized
catttaagagcctgcctgaagt

SEQ ID NO: 753283 - DNA, 22 bp, Artificial Sequence
  chemically synthesized
ccatttaagagcctgcctgaag

SEQ ID NO: 753284 - DNA, 22 bp, Artificial Sequence
  chemically synthesized
tccatttaagagcctgcctgaa

SEQ ID NO: 753285 - DNA, 22 bp, Artificial Sequence
  chemically synthesized
taatttacttcaggcaggctct

SEQ ID NO: 753286 - DNA, 22 bp, Artificial Sequence
  chemically synthesized
attttccatttaagagcctgcc

SEQ ID NO: 753287 - DNA, 22 bp, Artificial Sequence
  chemically synthesized
atttacttcaggcaggctctta

SEQ ID NO: 753288 - DNA, 22 bp, Artificial Sequence
  chemically synthesized
acttcaggcaggctcttaaatg

SEQ ID NO: 753289 - DNA, 22 bp, Artificial Sequence
  chemically synthesized
cttcaggcaggctcttaaatgg

SEQ ID NO: 753290 - DNA, 22 bp, Artificial Sequence
  chemically synthesized
caagttaattttccatttaaga

SEQ ID NO: 753291 - DNA, 22 bp, Artificial Sequence
  chemically synthesized
caggcaggctcttaaatggaaa

SEQ ID NO: 753292 - DNA, 22 bp, Artificial Sequence
  chemically synthesized
aggcaggctcttaaatggaaaa

SEQ ID NO: 753293 - DNA, 22 bp, Artificial Sequence
  chemically synthesized
caaagactacaagttaattttc

SEQ ID NO: 753294 - DNA, 22 bp, Artificial Sequence
  chemically synthesized
ttgcaaagactacaagttaatt

SEQ ID NO: 753295 - DNA, 22 bp, Artificial Sequence
  chemically synthesized
ttaaatggaaaattaacttgta

SEQ ID NO: 753296 - DNA, 22 bp, Artificial Sequence
  chemically synthesized
ttgttgcaaagactacaagtta

SEQ ID NO: 753297 - DNA, 22 bp, Artificial Sequence
  chemically synthesized
aaatggaaaattaacttgtagt

SEQ ID NO: 753298 - DNA, 22 bp, Artificial Sequence
  chemically synthesized
aatggaaaattaacttgtagtc

SEQ ID NO: 753299 - DNA, 22 bp, Artificial Sequence
  chemically synthesized
tattgttgcaaagactacaagt

SEQ ID NO: 753300 - DNA, 22 bp, Artificial Sequence
  chemically synthesized
acttgtagtctttgcaacaata

SEQ ID NO: 753301 - DNA, 22 bp, Artificial Sequence
  chemically synthesized
tgaggaggaattctattgttgc

SEQ ID NO: 753302 - DNA, 22 bp, Artificial Sequence
  chemically synthesized
gtagtctttgcaacaatagaat

SEQ ID NO: 753303 - DNA, 22 bp, Artificial Sequence
  chemically synthesized
tagtctttgcaacaatagaatt

SEQ ID NO: 753304 - DNA, 22 bp, Artificial Sequence
  chemically synthesized
tctgtgaggaggaattctattg

SEQ ID NO: 753305 - DNA, 22 bp, Artificial Sequence
  chemically synthesized
tgcaacaatagaattcctcctc

SEQ ID NO: 753306 - DNA, 22 bp, Artificial Sequence
  chemically synthesized
gcaacaatagaattcctcctca

SEQ ID NO: 753307 - DNA, 22 bp, Artificial Sequence
  chemically synthesized
caacaatagaattcctcctcac

SEQ ID NO: 753308 - DNA, 22 bp, Artificial Sequence
  chemically synthesized
ctcctcacagataactcccttt

SEQ ID NO: 753309 - DNA, 22 bp, Artificial Sequence
  chemically synthesized
gaaaataataaacaaagggagt

SEQ ID NO: 753310 - DNA, 22 bp, Artificial Sequence
  chemically synthesized
agaaaataataaacaaagggag

SEQ ID NO: 753311 - DNA, 22 bp, Artificial Sequence
  chemically synthesized
ctcacagataactccctttgtt

SEQ ID NO: 753312 - DNA, 22 bp, Artificial Sequence
  chemically synthesized
acagataactccctttgtttat

SEQ ID NO: 753313 - DNA, 22 bp, Artificial Sequence
  chemically synthesized
gaacatttagaaaataataaac

SEQ ID NO: 753314 - DNA, 22 bp, Artificial Sequence
  chemically synthesized
ttggaacatttagaaaataata

SEQ ID NO: 753315 - DNA, 22 bp, Artificial Sequence
  chemically synthesized
cctttgtttattattttctaaa

SEQ ID NO: 753316 - DNA, 22 bp, Artificial Sequence
  chemically synthesized
tgtttattattttctaaatgtt

SEQ ID NO: 753317 - DNA, 22 bp, Artificial Sequence
  chemically synthesized
gtttattattttctaaatgttc

SEQ ID NO: 753318 - DNA, 22 bp, Artificial Sequence
  chemically synthesized
tttattattttctaaatgttcc

SEQ ID NO: 753319 - DNA, 22 bp, Artificial Sequence
  chemically synthesized
gcaatcagttattggaacattt

SEQ ID NO: 753320 - DNA, 22 bp, Artificial Sequence
  chemically synthesized
attattttctaaatgttccaat

SEQ ID NO: 753321 - DNA, 22 bp, Artificial Sequence
  chemically synthesized
ttattttctaaatgttccaata

SEQ ID NO: 753322 - DNA, 22 bp, Artificial Sequence
  chemically synthesized
ttttctaaatgttccaataact

SEQ ID NO: 753323 - DNA, 22 bp, Artificial Sequence
  chemically synthesized
tctaaatgttccaataactgat

SEQ ID NO: 753324 - DNA, 22 bp, Artificial Sequence
  chemically synthesized
ctaaatgttccaataactgatt

SEQ ID NO: 753325 - DNA, 22 bp, Artificial Sequence
  chemically synthesized
taaatgttccaataactgattg

SEQ ID NO: 753326 - DNA, 22 bp, Artificial Sequence
  chemically synthesized
aatgttccaataactgattgct

SEQ ID NO: 753327 - DNA, 22 bp, Artificial Sequence
  chemically synthesized
caataactgattgctaatctct

SEQ ID NO: 753328 - DNA, 22 bp, Artificial Sequence
  chemically synthesized
ataaataaacatcaaaagagat

SEQ ID NO: 753329 - DNA, 22 bp, Artificial Sequence
  chemically synthesized
attgctaatctcttttgatgtt

SEQ ID NO: 753330 - DNA, 22 bp, Artificial Sequence
  chemically synthesized
tgcattcataaataaacatcaa

SEQ ID NO: 753331 - DNA, 22 bp, Artificial Sequence
  chemically synthesized
gtgcattcataaataaacatca

SEQ ID NO: 753332 - DNA, 22 bp, Artificial Sequence
  chemically synthesized
ctaatctcttttgatgtttatt

SEQ ID NO: 753333 - DNA, 22 bp, Artificial Sequence
  chemically synthesized
atctcttttgatgtttatttat

SEQ ID NO: 753334 - DNA, 22 bp, Artificial Sequence
  chemically synthesized
ttttgatgtttatttatgaatg

SEQ ID NO: 753335 - DNA, 22 bp, Artificial Sequence
  chemically synthesized
ttgatgtttatttatgaatgca

SEQ ID NO: 753336 - DNA, 22 bp, Artificial Sequence
  chemically synthesized
tgatgtttatttatgaatgcac

SEQ ID NO: 753337 - DNA, 22 bp, Artificial Sequence
  chemically synthesized
gatgtttatttatgaatgcaca

SEQ ID NO: 753338 - DNA, 22 bp, Artificial Sequence
  chemically synthesized
atgtttatttatgaatgcacaa

SEQ ID NO: 753339 - DNA, 22 bp, Artificial Sequence
  chemically synthesized
ccatgcataaatcagtttgtgc

SEQ ID NO: 753340 - DNA, 22 bp, Artificial Sequence
  chemically synthesized
atttatgaatgcacaaactgat

SEQ ID NO: 753341 - DNA, 22 bp, Artificial Sequence
  chemically synthesized
tttatgaatgcacaaactgatt

SEQ ID NO: 753342 - DNA, 22 bp, Artificial Sequence
  chemically synthesized
atgaatgcacaaactgatttat

SEQ ID NO: 753343 - DNA, 22 bp, Artificial Sequence
  chemically synthesized
tgaatgcacaaactgatttatg

SEQ ID NO: 753344 - DNA, 22 bp, Artificial Sequence
  chemically synthesized
ataaactaccatgcataaatca

SEQ ID NO: 753345 - DNA, 22 bp, Artificial Sequence
  chemically synthesized
atttatgcatggtagtttatga

SEQ ID NO: 753346 - DNA, 22 bp, Artificial Sequence
  chemically synthesized
atgcatggtagtttatgagtcc

SEQ ID NO: 753347 - DNA, 22 bp, Artificial Sequence
  chemically synthesized
aaaaaaaaataaggactcataa

SEQ ID NO: 753348 - DNA, 22 bp, Artificial Sequence
  chemically synthesized
tgcatggtagtttatgagtcct

SEQ ID NO: 753349 - DNA, 22 bp, Artificial Sequence
  chemically synthesized
aacatagatgctgaaaaaaaaa

SEQ ID NO: 753350 - DNA, 22 bp, Artificial Sequence
  chemically synthesized
atgagtccttatttttttttca

SEQ ID NO: 753351 - DNA, 22 bp, Artificial Sequence
  chemically synthesized
tgagtccttatttttttttcag

SEQ ID NO: 753352 - DNA, 22 bp, Artificial Sequence
  chemically synthesized
aaattaaacatagatgctgaaa

SEQ ID NO: 753353 - DNA, 22 bp, Artificial Sequence
  chemically synthesized
atttttttttcagcatctatgt

SEQ ID NO: 753354 - DNA, 22 bp, Artificial Sequence
  chemically synthesized
tttttttttcagcatctatgtt

SEQ ID NO: 753355 - DNA, 22 bp, Artificial Sequence
  chemically synthesized
ttttttcagcatctatgtttaa

SEQ ID NO: 753356 - DNA, 22 bp, Artificial Sequence
  chemically synthesized
tttttcagcatctatgtttaat

SEQ ID NO: 753357 - DNA, 22 bp, Artificial Sequence
  chemically synthesized
ttttcagcatctatgtttaatt

SEQ ID NO: 753358 - DNA, 22 bp, Artificial Sequence
  chemically synthesized
tttcagcatctatgtttaattt

SEQ ID NO: 753359 - DNA, 22 bp, Artificial Sequence
  chemically synthesized
ttcagcatctatgtttaatttg

SEQ ID NO: 753360 - DNA, 22 bp, Artificial Sequence
  chemically synthesized
tcagcatctatgtttaatttga

SEQ ID NO: 753361 - DNA, 22 bp, Artificial Sequence
  chemically synthesized
aatagaatcaattcaaattaaa

SEQ ID NO: 753362 - DNA, 22 bp, Artificial Sequence
  chemically synthesized
cagcatctatgtttaatttgaa

SEQ ID NO: 753363 - DNA, 22 bp, Artificial Sequence
  chemically synthesized
agcatctatgtttaatttgaat

SEQ ID NO: 753364 - DNA, 22 bp, Artificial Sequence
  chemically synthesized
gttaaatagaatcaattcaaat

SEQ ID NO: 753365 - DNA, 22 bp, Artificial Sequence
  chemically synthesized
ggttaaatagaatcaattcaaa

SEQ ID NO: 753366 - DNA, 22 bp, Artificial Sequence
  chemically synthesized
ttggttaaatagaatcaattca

SEQ ID NO: 753367 - DNA, 22 bp, Artificial Sequence
  chemically synthesized
cttggttaaatagaatcaattc

SEQ ID NO: 753368 - DNA, 22 bp, Artificial Sequence
  chemically synthesized
tcttggttaaatagaatcaatt

SEQ ID NO: 753369 - DNA, 22 bp, Artificial Sequence
  chemically synthesized
tgtttaatttgaattgattcta

SEQ ID NO: 753370 - DNA, 22 bp, Artificial Sequence
  chemically synthesized
aatttgaattgattctatttaa

SEQ ID NO: 753371 - DNA, 22 bp, Artificial Sequence
  chemically synthesized
atattttcttggttaaatagaa

SEQ ID NO: 753372 - DNA, 22 bp, Artificial Sequence
  chemically synthesized
atttgaattgattctatttaac

SEQ ID NO: 753373 - DNA, 22 bp, Artificial Sequence
  chemically synthesized
tcatattttcttggttaaatag

SEQ ID NO: 753374 - DNA, 22 bp, Artificial Sequence
  chemically synthesized
gaattgattctatttaaccaag

SEQ ID NO: 753375 - DNA, 22 bp, Artificial Sequence
  chemically synthesized
aattgattctatttaaccaaga

SEQ ID NO: 753376 - DNA, 22 bp, Artificial Sequence
  chemically synthesized
gatagctctcatattttcttgg

SEQ ID NO: 753377 - DNA, 22 bp, Artificial Sequence
  chemically synthesized
attctatttaaccaagaaaata

SEQ ID NO: 753378 - DNA, 22 bp, Artificial Sequence
  chemically synthesized
tatttaaccaagaaaatatgag

SEQ ID NO: 753379 - DNA, 22 bp, Artificial Sequence
  chemically synthesized
tttaaccaagaaaatatgagag

SEQ ID NO: 753380 - DNA, 22 bp, Artificial Sequence
  chemically synthesized
aaccaagaaaatatgagagcta

SEQ ID NO: 753381 - DNA, 22 bp, Artificial Sequence
  chemically synthesized
ccagggtctggatagctctcat

SEQ ID NO: 753382 - DNA, 22 bp, Artificial Sequence
  chemically synthesized
accaagaaaatatgagagctat

SEQ ID NO: 753383 - DNA, 22 bp, Artificial Sequence
  chemically synthesized
ctgccagggtctggatagctct

SEQ ID NO: 753384 - DNA, 22 bp, Artificial Sequence
  chemically synthesized
gctgccagggtctggatagctc

SEQ ID NO: 753385 - DNA, 22 bp, Artificial Sequence
  chemically synthesized
ttgctgccagggtctggatagc

SEQ ID NO: 753386 - DNA, 22 bp, Artificial Sequence
  chemically synthesized
tccagaccctggcagcaagaat

SEQ ID NO: 753387 - DNA, 22 bp, Artificial Sequence
  chemically synthesized
gcagcaagaatggatgggctgc

SEQ ID NO: 753388 - DNA, 22 bp, Artificial Sequence
  chemically synthesized
atagaaggatcagtggtgacgg

SEQ ID NO: 753389 - DNA, 22 bp, Artificial Sequence
  chemically synthesized
ctccgtcaccactgatccttct

SEQ ID NO: 753390 - DNA, 22 bp, Artificial Sequence
  chemically synthesized
cgtcaccactgatccttctatc

SEQ ID NO: 753391 - DNA, 22 bp, Artificial Sequence
  chemically synthesized
taataacatattgatagaagga

SEQ ID NO: 753392 - DNA, 22 bp, Artificial Sequence
  chemically synthesized
atccttctatcaatatgttatt

SEQ ID NO: 753393 - DNA, 22 bp, Artificial Sequence
  chemically synthesized
aatgtggaactataataacata

SEQ ID NO: 753394 - DNA, 22 bp, Artificial Sequence
  chemically synthesized
ctatcaatatgttattatagtt

SEQ ID NO: 753395 - DNA, 22 bp, Artificial Sequence
  chemically synthesized
tatcaatatgttattatagttc

SEQ ID NO: 753396 - DNA, 22 bp, Artificial Sequence
  chemically synthesized
tcaatatgttattatagttcca

SEQ ID NO: 753397 - DNA, 22 bp, Artificial Sequence
  chemically synthesized
ttatagttccacattcaattac

SEQ ID NO: 753398 - DNA, 22 bp, Artificial Sequence
  chemically synthesized
ccaggagcccagaggtaattga

SEQ ID NO: 753399 - DNA, 22 bp, Artificial Sequence
  chemically synthesized
tagttccacattcaattacctc

SEQ ID NO: 753400 - DNA, 22 bp, Artificial Sequence
  chemically synthesized
taccaggagcccagaggtaatt

SEQ ID NO: 753401 - DNA, 22 bp, Artificial Sequence
  chemically synthesized
cacattcaattacctctgggct

SEQ ID NO: 753402 - DNA, 22 bp, Artificial Sequence
  chemically synthesized
gagaaactctaccaggagccca

SEQ ID NO: 753403 - DNA, 22 bp, Artificial Sequence
  chemically synthesized
aattacctctgggctcctggta

SEQ ID NO: 753404 - DNA, 22 bp, Artificial Sequence
  chemically synthesized
cctctgggctcctggtagagtt

SEQ ID NO: 753405 - DNA, 22 bp, Artificial Sequence
  chemically synthesized
gaaggactagagaaactctacc

SEQ ID NO: 753406 - DNA, 22 bp, Artificial Sequence
  chemically synthesized
ggaaggactagagaaactctac

SEQ ID NO: 753407 - DNA, 22 bp, Artificial Sequence
  chemically synthesized
tggaaggactagagaaactcta

SEQ ID NO: 753408 - DNA, 22 bp, Artificial Sequence
  chemically synthesized
tgggctcctggtagagtttctc

SEQ ID NO: 753409 - DNA, 22 bp, Artificial Sequence
  chemically synthesized
ggctcctggtagagtttctcta

SEQ ID NO: 753410 - DNA, 22 bp, Artificial Sequence
  chemically synthesized
ctggtagagtttctctagtcct

SEQ ID NO: 753411 - DNA, 22 bp, Artificial Sequence
  chemically synthesized
gtagagtttctctagtccttcc

SEQ ID NO: 753412 - DNA, 22 bp, Artificial Sequence
  chemically synthesized
acagagcagcctttggaaggac

SEQ ID NO: 753413 - DNA, 22 bp, Artificial Sequence
  chemically synthesized
tgacagagcagcctttggaagg

SEQ ID NO: 753414 - DNA, 22 bp, Artificial Sequence
  chemically synthesized
ctgacagagcagcctttggaag

SEQ ID NO: 753415 - DNA, 22 bp, Artificial Sequence
  chemically synthesized
ctctagtccttccaaaggctgc

SEQ ID NO: 753416 - DNA, 22 bp, Artificial Sequence
  chemically synthesized
tctagtccttccaaaggctgct

SEQ ID NO: 753417 - DNA, 22 bp, Artificial Sequence
  chemically synthesized
tagtccttccaaaggctgctct

SEQ ID NO: 753418 - DNA, 22 bp, Artificial Sequence
  chemically synthesized
gtccttccaaaggctgctctgt

SEQ ID NO: 753419 - DNA, 22 bp, Artificial Sequence
  chemically synthesized
tacgaatatttctgacagagca

SEQ ID NO: 753420 - DNA, 22 bp, Artificial Sequence
  chemically synthesized
ccaaaggctgctctgtcagaaa

SEQ ID NO: 753421 - DNA, 22 bp, Artificial Sequence
  chemically synthesized
caaaggctgctctgtcagaaat

SEQ ID NO: 753422 - DNA, 22 bp, Artificial Sequence
  chemically synthesized
agactgtacgaatatttctgac

SEQ ID NO: 753423 - DNA, 22 bp, Artificial Sequence
  chemically synthesized
gagactgtacgaatatttctga

SEQ ID NO: 753424 - DNA, 22 bp, Artificial Sequence
  chemically synthesized
ttgagactgtacgaatatttct

SEQ ID NO: 753425 - DNA, 22 bp, Artificial Sequence
  chemically synthesized
ctctgtcagaaatattcgtaca

SEQ ID NO: 753426 - DNA, 22 bp, Artificial Sequence
  chemically synthesized
tgtcagaaatattcgtacagtc

SEQ ID NO: 753427 - DNA, 22 bp, Artificial Sequence
  chemically synthesized
tcagaaatattcgtacagtctc

SEQ ID NO: 753428 - DNA, 22 bp, Artificial Sequence
  chemically synthesized
taatcatgagtactcttgagac

SEQ ID NO: 753429 - DNA, 22 bp, Artificial Sequence
  chemically synthesized
gtacagtctcaagagtactcat

SEQ ID NO: 753430 - DNA, 22 bp, Artificial Sequence
  chemically synthesized
aagaacctgtaatcatgagtac

SEQ ID NO: 753431 - DNA, 22 bp, Artificial Sequence
  chemically synthesized
aaaactaaagaacctgtaatca

SEQ ID NO: 753432 - DNA, 22 bp, Artificial Sequence
  chemically synthesized
aagagtactcatgattacaggt

SEQ ID NO: 753433 - DNA, 22 bp, Artificial Sequence
  chemically synthesized
atgattacaggttctttagttt

SEQ ID NO: 753434 - DNA, 22 bp, Artificial Sequence
  chemically synthesized
aagagggaattgaaaactaaag

SEQ ID NO: 753435 - DNA, 22 bp, Artificial Sequence
  chemically synthesized
caagagggaattgaaaactaaa

SEQ ID NO: 753436 - DNA, 22 bp, Artificial Sequence
  chemically synthesized
caggttctttagttttcaattc

SEQ ID NO: 753437 - DNA, 22 bp, Artificial Sequence
  chemically synthesized
acaggccttcaagagggaattg

SEQ ID NO: 753438 - DNA, 22 bp, Artificial Sequence
  chemically synthesized
cacaggccttcaagagggaatt

SEQ ID NO: 753439 - DNA, 22 bp, Artificial Sequence
  chemically synthesized
tttagttttcaattccctcttg

SEQ ID NO: 753440 - DNA, 22 bp, Artificial Sequence
  chemically synthesized
tagttttcaattccctcttgaa

SEQ ID NO: 753441 - DNA, 22 bp, Artificial Sequence
  chemically synthesized
atttcacaggccttcaagaggg

SEQ ID NO: 753442 - DNA, 22 bp, Artificial Sequence
  chemically synthesized
agttttcaattccctcttgaag

SEQ ID NO: 753443 - DNA, 22 bp, Artificial Sequence
  chemically synthesized
gttttcaattccctcttgaagg

SEQ ID NO: 753444 - DNA, 22 bp, Artificial Sequence
  chemically synthesized
atctcatttcacaggccttcaa

SEQ ID NO: 753445 - DNA, 22 bp, Artificial Sequence
  chemically synthesized
tcaattccctcttgaaggcctg

SEQ ID NO: 753446 - DNA, 22 bp, Artificial Sequence
  chemically synthesized
catctcatttcacaggccttca

SEQ ID NO: 753447 - DNA, 22 bp, Artificial Sequence
  chemically synthesized
caattccctcttgaaggcctgt

SEQ ID NO: 753448 - DNA, 22 bp, Artificial Sequence
  chemically synthesized
tcatctcatttcacaggccttc

SEQ ID NO: 753449 - DNA, 22 bp, Artificial Sequence
  chemically synthesized
aattccctcttgaaggcctgtg

SEQ ID NO: 753450 - DNA, 22 bp, Artificial Sequence
  chemically synthesized
ttcatctcatttcacaggcctt

SEQ ID NO: 753451 - DNA, 22 bp, Artificial Sequence
  chemically synthesized
ttttcatctcatttcacaggcc

SEQ ID NO: 753452 - DNA, 22 bp, Artificial Sequence
  chemically synthesized
cttttcatctcatttcacaggc

SEQ ID NO: 753453 - DNA, 22 bp, Artificial Sequence
  chemically synthesized
cctcttgaaggcctgtgaaatg

SEQ ID NO: 753454 - DNA, 22 bp, Artificial Sequence
  chemically synthesized
ttgaaggcctgtgaaatgagat

SEQ ID NO: 753455 - DNA, 22 bp, Artificial Sequence
  chemically synthesized
gaaggcctgtgaaatgagatga

SEQ ID NO: 753456 - DNA, 22 bp, Artificial Sequence
  chemically synthesized
aaggcctgtgaaatgagatgaa

SEQ ID NO: 753457 - DNA, 22 bp, Artificial Sequence
  chemically synthesized
tgaaatgagatgaaaagaagtg

SEQ ID NO: 753458 - DNA, 22 bp, Artificial Sequence
  chemically synthesized
agaagaatgccacaagccaaat

SEQ ID NO: 753459 - DNA, 22 bp, Artificial Sequence
  chemically synthesized
gagaagaatgccacaagccaaa

SEQ ID NO: 753460 - DNA, 22 bp, Artificial Sequence
  chemically synthesized
tgagaagaatgccacaagccaa

SEQ ID NO: 753461 - DNA, 22 bp, Artificial Sequence
  chemically synthesized
attttgagaagaatgccacaag

SEQ ID NO: 753462 - DNA, 22 bp, Artificial Sequence
  chemically synthesized
atttggcttgtggcattcttct

SEQ ID NO: 753463 - DNA, 22 bp, Artificial Sequence
  chemically synthesized
tttggcttgtggcattcttctc

SEQ ID NO: 753464 - DNA, 22 bp, Artificial Sequence
  chemically synthesized
ggcttgtggcattcttctcaaa

SEQ ID NO: 753465 - DNA, 22 bp, Artificial Sequence
  chemically synthesized
gcttgtggcattcttctcaaaa

SEQ ID NO: 753466 - DNA, 22 bp, Artificial Sequence
  chemically synthesized
agcacccaggattaattttgag

SEQ ID NO: 753467 - DNA, 22 bp, Artificial Sequence
  chemically synthesized
gtggcattcttctcaaaattaa

SEQ ID NO: 753468 - DNA, 22 bp, Artificial Sequence
  chemically synthesized
tggcattcttctcaaaattaat

SEQ ID NO: 753469 - DNA, 22 bp, Artificial Sequence
  chemically synthesized
tgagcacccaggattaattttg

SEQ ID NO: 753470 - DNA, 22 bp, Artificial Sequence
  chemically synthesized
ttctcaaaattaatcctgggtg

SEQ ID NO: 753471 - DNA, 22 bp, Artificial Sequence
  chemically synthesized
ctcaaaattaatcctgggtgct

SEQ ID NO: 753472 - DNA, 22 bp, Artificial Sequence
  chemically synthesized
tcaaaattaatcctgggtgctc

SEQ ID NO: 753473 - DNA, 22 bp, Artificial Sequence
  chemically synthesized
ataaacaagttctgagcaccca

SEQ ID NO: 753474 - DNA, 22 bp, Artificial Sequence
  chemically synthesized
aaaattaatcctgggtgctcag

SEQ ID NO: 753475 - DNA, 22 bp, Artificial Sequence
  chemically synthesized
cataaacaagttctgagcaccc

SEQ ID NO: 753476 - DNA, 22 bp, Artificial Sequence
  chemically synthesized
atcctgggtgctcagaacttgt

SEQ ID NO: 753477 - DNA, 22 bp, Artificial Sequence
  chemically synthesized
ggagtttcataaacaagttctg

SEQ ID NO: 753478 - DNA, 22 bp, Artificial Sequence
  chemically synthesized
acctgggagtttcataaacaag

SEQ ID NO: 753479 - DNA, 22 bp, Artificial Sequence
  chemically synthesized
ggtgctcagaacttgtttatga

SEQ ID NO: 753480 - DNA, 22 bp, Artificial Sequence
  chemically synthesized
agaacttgtttatgaaactccc

SEQ ID NO: 753481 - DNA, 22 bp, Artificial Sequence
  chemically synthesized
gtttatgaaactcccaggtcaa

SEQ ID NO: 753482 - DNA, 22 bp, Artificial Sequence
  chemically synthesized
tttatgaaactcccaggtcaat

SEQ ID NO: 753483 - DNA, 22 bp, Artificial Sequence
  chemically synthesized
atgaaactcccaggtcaatttc

SEQ ID NO: 753484 - DNA, 22 bp, Artificial Sequence
  chemically synthesized
tgaaactcccaggtcaatttct

SEQ ID NO: 753485 - DNA, 22 bp, Artificial Sequence
  chemically synthesized
ccaggtcaatttctatctcttt

SEQ ID NO: 753486 - DNA, 22 bp, Artificial Sequence
  chemically synthesized
taaccatcagtgtataaataaa

SEQ ID NO: 753487 - DNA, 22 bp, Artificial Sequence
  chemically synthesized
ataaccatcagtgtataaataa

SEQ ID NO: 753488 - DNA, 22 bp, Artificial Sequence
  chemically synthesized
tataaccatcagtgtataaata

SEQ ID NO: 753489 - DNA, 22 bp, Artificial Sequence
  chemically synthesized
ctatctcttttatttatacact

SEQ ID NO: 753490 - DNA, 22 bp, Artificial Sequence
  chemically synthesized
tatctcttttatttatacactg

SEQ ID NO: 753491 - DNA, 22 bp, Artificial Sequence
  chemically synthesized
tctcttttatttatacactgat

SEQ ID NO: 753492 - DNA, 22 bp, Artificial Sequence
  chemically synthesized
ttttatttatacactgatggtt

SEQ ID NO: 753493 - DNA, 22 bp, Artificial Sequence
  chemically synthesized
ttatttatacactgatggttat

SEQ ID NO: 753494 - DNA, 22 bp, Artificial Sequence
  chemically synthesized
tatttatacactgatggttata

SEQ ID NO: 753495 - DNA, 22 bp, Artificial Sequence
  chemically synthesized
atttatacactgatggttataa

SEQ ID NO: 753496 - DNA, 22 bp, Artificial Sequence
  chemically synthesized
aaaaaaatcattttataaccat

SEQ ID NO: 753497 - DNA, 22 bp, Artificial Sequence
  chemically synthesized
tttatacactgatggttataaa

SEQ ID NO: 753498 - DNA, 22 bp, Artificial Sequence
  chemically synthesized
aaaaaaaatcattttataacca

SEQ ID NO: 753499 - DNA, 22 bp, Artificial Sequence
  chemically synthesized
taaaaaaaatcattttataacc

SEQ ID NO: 753500 - DNA, 22 bp, Artificial Sequence
  chemically synthesized
atacactgatggttataaaatg

SEQ ID NO: 753501 - DNA, 22 bp, Artificial Sequence
  chemically synthesized
tacactgatggttataaaatga

SEQ ID NO: 753502 - DNA, 22 bp, Artificial Sequence
  chemically synthesized
atggttataaaatgattttttt

SEQ ID NO: 753503 - DNA, 22 bp, Artificial Sequence
  chemically synthesized
taaaatgattttttttaaaggc

SEQ ID NO: 753504 - DNA, 22 bp, Artificial Sequence
  chemically synthesized
acagatagacccatatagcctt

SEQ ID NO: 753505 - DNA, 22 bp, Artificial Sequence
  chemically synthesized
attaacagatagacccatatag

SEQ ID NO: 753506 - DNA, 22 bp, Artificial Sequence
  chemically synthesized
tttttaaaggctatatgggtct

SEQ ID NO: 753507 - DNA, 22 bp, Artificial Sequence
  chemically synthesized
ttttaaaggctatatgggtcta

SEQ ID NO: 753508 - DNA, 22 bp, Artificial Sequence
  chemically synthesized
ctcattaacagatagacccata

SEQ ID NO: 753509 - DNA, 22 bp, Artificial Sequence
  chemically synthesized
tttaaaggctatatgggtctat

SEQ ID NO: 753510 - DNA, 22 bp, Artificial Sequence
  chemically synthesized
cctcattaacagatagacccat

SEQ ID NO: 753511 - DNA, 22 bp, Artificial Sequence
  chemically synthesized
ttaaaggctatatgggtctatc

SEQ ID NO: 753512 - DNA, 22 bp, Artificial Sequence
  chemically synthesized
tcctcattaacagatagaccca

SEQ ID NO: 753513 - DNA, 22 bp, Artificial Sequence
  chemically synthesized
taaaggctatatgggtctatct

SEQ ID NO: 753514 - DNA, 22 bp, Artificial Sequence
  chemically synthesized
aaaggctatatgggtctatctg

SEQ ID NO: 753515 - DNA, 22 bp, Artificial Sequence
  chemically synthesized
aaggctatatgggtctatctgt

SEQ ID NO: 753516 - DNA, 22 bp, Artificial Sequence
  chemically synthesized
tatgggtctatctgttaatgag

SEQ ID NO: 753517 - DNA, 22 bp, Artificial Sequence
  chemically synthesized
caaacacagcgctttcctcatt

SEQ ID NO: 753518 - DNA, 22 bp, Artificial Sequence
  chemically synthesized
acaaacacagcgctttcctcat

SEQ ID NO: 753519 - DNA, 22 bp, Artificial Sequence
  chemically synthesized
tacaaacacagcgctttcctca

SEQ ID NO: 753520 - DNA, 22 bp, Artificial Sequence
  chemically synthesized
tctgttaatgaggaaagcgctg

SEQ ID NO: 753521 - DNA, 22 bp, Artificial Sequence
  chemically synthesized
ttaatgaggaaagcgctgtgtt

SEQ ID NO: 753522 - DNA, 22 bp, Artificial Sequence
  chemically synthesized
atgaggaaagcgctgtgtttgt

SEQ ID NO: 753523 - DNA, 22 bp, Artificial Sequence
  chemically synthesized
cccagaatagctttacaaacac

SEQ ID NO: 753524 - DNA, 22 bp, Artificial Sequence
  chemically synthesized
cccccatctccccagaatagct

SEQ ID NO: 753525 - DNA, 22 bp, Artificial Sequence
  chemically synthesized
tgtttgtaaagctattctgggg

SEQ ID NO: 753526 - DNA, 22 bp, Artificial Sequence
  chemically synthesized
gtaaagctattctggggagatg

SEQ ID NO: 753527 - DNA, 22 bp, Artificial Sequence
  chemically synthesized
taaagctattctggggagatgg

SEQ ID NO: 753528 - DNA, 22 bp, Artificial Sequence
  chemically synthesized
tccagaatgctccccccatctc

SEQ ID NO: 753529 - DNA, 22 bp, Artificial Sequence
  chemically synthesized
actatccagaatgctcccccca

SEQ ID NO: 753530 - DNA, 22 bp, Artificial Sequence
  chemically synthesized
ttctggggagatggggggagca

SEQ ID NO: 753531 - DNA, 22 bp, Artificial Sequence
  chemically synthesized
tggggagatggggggagcattc

SEQ ID NO: 753532 - DNA, 22 bp, Artificial Sequence
  chemically synthesized
gggagatggggggagcattctg

SEQ ID NO: 753533 - DNA, 22 bp, Artificial Sequence
  chemically synthesized
aatgagagggcattaactatcc

SEQ ID NO: 753534 - DNA, 22 bp, Artificial Sequence
  chemically synthesized
tctcaatgagagggcattaact

SEQ ID NO: 753535 - DNA, 22 bp, Artificial Sequence
  chemically synthesized
atctcaatgagagggcattaac

SEQ ID NO: 753536 - DNA, 22 bp, Artificial Sequence
  chemically synthesized
ttatctcaatgagagggcatta

SEQ ID NO: 753537 - DNA, 22 bp, Artificial Sequence
  chemically synthesized
tggatagttaatgccctctcat

SEQ ID NO: 753538 - DNA, 22 bp, Artificial Sequence
  chemically synthesized
gatagttaatgccctctcattg

SEQ ID NO: 753539 - DNA, 22 bp, Artificial Sequence
  chemically synthesized
atgccctctcattgagataaga

SEQ ID NO: 753540 - DNA, 22 bp, Artificial Sequence
  chemically synthesized
cataaacaaagcactcttatct

SEQ ID NO: 753541 - DNA, 22 bp, Artificial Sequence
  chemically synthesized
tcattgagataagagtgctttg

SEQ ID NO: 753542 - DNA, 22 bp, Artificial Sequence
  chemically synthesized
attgagataagagtgctttgtt

SEQ ID NO: 753543 - DNA, 22 bp, Artificial Sequence
  chemically synthesized
tcaggttacataaacaaagcac

SEQ ID NO: 753544 - DNA, 22 bp, Artificial Sequence
  chemically synthesized
agataagagtgctttgtttatg

SEQ ID NO: 753545 - DNA, 22 bp, Artificial Sequence
  chemically synthesized
aagtatggctgtcaggttacat

SEQ ID NO: 753546 - DNA, 22 bp, Artificial Sequence
  chemically synthesized
gaagtatggctgtcaggttaca

SEQ ID NO: 753547 - DNA, 22 bp, Artificial Sequence
  chemically synthesized
tgtttatgtaacctgacagcca

SEQ ID NO: 753548 - DNA, 22 bp, Artificial Sequence
  chemically synthesized
gtttatgtaacctgacagccat

SEQ ID NO: 753549 - DNA, 22 bp, Artificial Sequence
  chemically synthesized
tagatttgaagtatggctgtca

SEQ ID NO: 753550 - DNA, 22 bp, Artificial Sequence
  chemically synthesized
tttatgtaacctgacagccata

SEQ ID NO: 753551 - DNA, 22 bp, Artificial Sequence
  chemically synthesized
atgtaacctgacagccatactt

SEQ ID NO: 753552 - DNA, 22 bp, Artificial Sequence
  chemically synthesized
gctgtagatttgaagtatggct

SEQ ID NO: 753553 - DNA, 22 bp, Artificial Sequence
  chemically synthesized
tgtaacctgacagccatacttc

SEQ ID NO: 753554 - DNA, 22 bp, Artificial Sequence
  chemically synthesized
agctgtagatttgaagtatggc

SEQ ID NO: 753555 - DNA, 22 bp, Artificial Sequence
  chemically synthesized
tagctgtagatttgaagtatgg

SEQ ID NO: 753556 - DNA, 22 bp, Artificial Sequence
  chemically synthesized
aaactttagctgtagatttgaa

SEQ ID NO: 753557 - DNA, 22 bp, Artificial Sequence
  chemically synthesized
gaaactttagctgtagatttga

SEQ ID NO: 753558 - DNA, 22 bp, Artificial Sequence
  chemically synthesized
acagccatacttcaaatctaca

SEQ ID NO: 753559 - DNA, 22 bp, Artificial Sequence
  chemically synthesized
caaatctacagctaaagtttca

SEQ ID NO: 753560 - DNA, 22 bp, Artificial Sequence
  chemically synthesized
caatatataccttgaaacttta

SEQ ID NO: 753561 - DNA, 22 bp, Artificial Sequence
  chemically synthesized
aaatctacagctaaagtttcaa

SEQ ID NO: 753562 - DNA, 22 bp, Artificial Sequence
  chemically synthesized
gcaatatataccttgaaacttt

SEQ ID NO: 753563 - DNA, 22 bp, Artificial Sequence
  chemically synthesized
tgcaatatataccttgaaactt

SEQ ID NO: 753564 - DNA, 22 bp, Artificial Sequence
  chemically synthesized
cagctaaagtttcaaggtatat

SEQ ID NO: 753565 - DNA, 22 bp, Artificial Sequence
  chemically synthesized
gagttttgcaatatataccttg

SEQ ID NO: 753566 - DNA, 22 bp, Artificial Sequence
  chemically synthesized
aagtttcaaggtatatattgca

SEQ ID NO: 753567 - DNA, 22 bp, Artificial Sequence
  chemically synthesized
gccatgctagagttttgcaata

SEQ ID NO: 753568 - DNA, 22 bp, Artificial Sequence
  chemically synthesized
caaggtatatattgcaaaactc

SEQ ID NO: 753569 - DNA, 22 bp, Artificial Sequence
  chemically synthesized
aaggtatatattgcaaaactct

SEQ ID NO: 753570 - DNA, 22 bp, Artificial Sequence
  chemically synthesized
attagccatgctagagttttgc

SEQ ID NO: 753571 - DNA, 22 bp, Artificial Sequence
  chemically synthesized
agtcctcattagccatgctaga

SEQ ID NO: 753572 - DNA, 22 bp, Artificial Sequence
  chemically synthesized
aagtcctcattagccatgctag

SEQ ID NO: 753573 - DNA, 22 bp, Artificial Sequence
  chemically synthesized
caaaactctagcatggctaatg

SEQ ID NO: 753574 - DNA, 22 bp, Artificial Sequence
  chemically synthesized
gggtatgtttaagtcctcatta

SEQ ID NO: 753575 - DNA, 22 bp, Artificial Sequence
  chemically synthesized
ggggtatgtttaagtcctcatt

SEQ ID NO: 753576 - DNA, 22 bp, Artificial Sequence
  chemically synthesized
tagcatggctaatgaggactta

SEQ ID NO: 753577 - DNA, 22 bp, Artificial Sequence
  chemically synthesized
tttggggtatgtttaagtcctc

SEQ ID NO: 753578 - DNA, 22 bp, Artificial Sequence
  chemically synthesized
gcatggctaatgaggacttaaa

SEQ ID NO: 753579 - DNA, 22 bp, Artificial Sequence
  chemically synthesized
atgaggacttaaacatacccca

SEQ ID NO: 753580 - DNA, 22 bp, Artificial Sequence
  chemically synthesized
gatatccactatttggggtatg

SEQ ID NO: 753581 - DNA, 22 bp, Artificial Sequence
  chemically synthesized
tggatatccactatttggggta

SEQ ID NO: 753582 - DNA, 22 bp, Artificial Sequence
  chemically synthesized
tgttctggatatccactatttg

SEQ ID NO: 753583 - DNA, 22 bp, Artificial Sequence
  chemically synthesized
aaacataccccaaatagtggat

SEQ ID NO: 753584 - DNA, 22 bp, Artificial Sequence
  chemically synthesized
aacataccccaaatagtggata

SEQ ID NO: 753585 - DNA, 22 bp, Artificial Sequence
  chemically synthesized
ccattatgttctggatatccac

SEQ ID NO: 753586 - DNA, 22 bp, Artificial Sequence
  chemically synthesized
cccattatgttctggatatcca

SEQ ID NO: 753587 - DNA, 22 bp, Artificial Sequence
  chemically synthesized
aggcttcccattatgttctgga

SEQ ID NO: 753588 - DNA, 22 bp, Artificial Sequence
  chemically synthesized
aaggcttcccattatgttctgg

SEQ ID NO: 753589 - DNA, 22 bp, Artificial Sequence
  chemically synthesized
caaatggcccttaaggcttccc

SEQ ID NO: 753590 - DNA, 22 bp, Artificial Sequence
  chemically synthesized
aggtcctgcaaatggcccttaa

SEQ ID NO: 753591 - DNA, 22 bp, Artificial Sequence
  chemically synthesized
atatagcctaaggtcctgcaaa

SEQ ID NO: 753592 - DNA, 22 bp, Artificial Sequence
  chemically synthesized
aatatagcctaaggtcctgcaa

SEQ ID NO: 753593 - DNA, 22 bp, Artificial Sequence
  chemically synthesized
taatatagcctaaggtcctgca

SEQ ID NO: 753594 - DNA, 22 bp, Artificial Sequence
  chemically synthesized
aagggccatttgcaggacctta

SEQ ID NO: 753595 - DNA, 22 bp, Artificial Sequence
  chemically synthesized
agggccatttgcaggaccttag

SEQ ID NO: 753596 - DNA, 22 bp, Artificial Sequence
  chemically synthesized
tatactttaatatagcctaagg

SEQ ID NO: 753597 - DNA, 22 bp, Artificial Sequence
  chemically synthesized
attgtatactttaatatagcct

SEQ ID NO: 753598 - DNA, 22 bp, Artificial Sequence
  chemically synthesized
gcaggaccttaggctatattaa

SEQ ID NO: 753599 - DNA, 22 bp, Artificial Sequence
  chemically synthesized
caggaccttaggctatattaaa

SEQ ID NO: 753600 - DNA, 22 bp, Artificial Sequence
  chemically synthesized
gattcattgtatactttaatat

SEQ ID NO: 753601 - DNA, 22 bp, Artificial Sequence
  chemically synthesized
aggctatattaaagtatacaat

SEQ ID NO: 753602 - DNA, 22 bp, Artificial Sequence
  chemically synthesized
tcagttggattcattgtatact

SEQ ID NO: 753603 - DNA, 22 bp, Artificial Sequence
  chemically synthesized
ggctatattaaagtatacaatg

SEQ ID NO: 753604 - DNA, 22 bp, Artificial Sequence
  chemically synthesized
tattaaagtatacaatgaatcc

SEQ ID NO: 753605 - DNA, 22 bp, Artificial Sequence
  chemically synthesized
gtgattgtcagttggattcatt

SEQ ID NO: 753606 - DNA, 22 bp, Artificial Sequence
  chemically synthesized
aagtatacaatgaatccaactg

SEQ ID NO: 753607 - DNA, 22 bp, Artificial Sequence
  chemically synthesized
actggtgattgtcagttggatt

SEQ ID NO: 753608 - DNA, 22 bp, Artificial Sequence
  chemically synthesized
acagaattaactggtgattgtc

SEQ ID NO: 753609 - DNA, 22 bp, Artificial Sequence
  chemically synthesized
gacagaattaactggtgattgt

SEQ ID NO: 753610 - DNA, 22 bp, Artificial Sequence
  chemically synthesized
tgacagaattaactggtgattg

SEQ ID NO: 753611 - DNA, 22 bp, Artificial Sequence
  chemically synthesized
tcagacattttgacagaattaa

SEQ ID NO: 753612 - DNA, 22 bp, Artificial Sequence
  chemically synthesized
acaatcaccagttaattctgtc

SEQ ID NO: 753613 - DNA, 22 bp, Artificial Sequence
  chemically synthesized
gtcagacattttgacagaatta

SEQ ID NO: 753614 - DNA, 22 bp, Artificial Sequence
  chemically synthesized
taccttgtcagacattttgaca

SEQ ID NO: 753615 - DNA, 22 bp, Artificial Sequence
  chemically synthesized
ataccttgtcagacattttgac

SEQ ID NO: 753616 - DNA, 22 bp, Artificial Sequence
  chemically synthesized
tataccttgtcagacattttga

SEQ ID NO: 753617 - DNA, 22 bp, Artificial Sequence
  chemically synthesized
ttttataccttgtcagacattt

SEQ ID NO: 753618 - DNA, 22 bp, Artificial Sequence
  chemically synthesized
attctgtcaaaatgtctgacaa

SEQ ID NO: 753619 - DNA, 22 bp, Artificial Sequence
  chemically synthesized
cctattttataccttgtcagac

SEQ ID NO: 753620 - DNA, 22 bp, Artificial Sequence
  chemically synthesized
acctattttataccttgtcaga

SEQ ID NO: 753621 - DNA, 22 bp, Artificial Sequence
  chemically synthesized
tgtcaaaatgtctgacaaggta

SEQ ID NO: 753622 - DNA, 22 bp, Artificial Sequence
  chemically synthesized
tcaaaatgtctgacaaggtata

SEQ ID NO: 753623 - DNA, 22 bp, Artificial Sequence
  chemically synthesized
gcttacctattttataccttgt

SEQ ID NO: 753624 - DNA, 22 bp, Artificial Sequence
  chemically synthesized
agcttacctattttataccttg

SEQ ID NO: 753625 - DNA, 22 bp, Artificial Sequence
  chemically synthesized
ttagcttacctattttatacct

SEQ ID NO: 753626 - DNA, 22 bp, Artificial Sequence
  chemically synthesized
tcttagcttacctattttatac

SEQ ID NO: 753627 - DNA, 22 bp, Artificial Sequence
  chemically synthesized
ctcttagcttacctattttata

SEQ ID NO: 753628 - DNA, 22 bp, Artificial Sequence
  chemically synthesized
tctcttagcttacctattttat

SEQ ID NO: 753629 - DNA, 22 bp, Artificial Sequence
  chemically synthesized
ttctcttagcttacctatttta

SEQ ID NO: 753630 - DNA, 22 bp, Artificial Sequence
  chemically synthesized
acaaggtataaaataggtaagc

SEQ ID NO: 753631 - DNA, 22 bp, Artificial Sequence
  chemically synthesized
agacttttctcttagcttacct

SEQ ID NO: 753632 - DNA, 22 bp, Artificial Sequence
  chemically synthesized
aaaagtattgagacttttctct

SEQ ID NO: 753633 - DNA, 22 bp, Artificial Sequence
  chemically synthesized
caaaagtattgagacttttctc

SEQ ID NO: 753634 - DNA, 22 bp, Artificial Sequence
  chemically synthesized
tcaaaagtattgagacttttct

SEQ ID NO: 753635 - DNA, 22 bp, Artificial Sequence
  chemically synthesized
ttcaaaagtattgagacttttc

SEQ ID NO: 753636 - DNA, 22 bp, Artificial Sequence
  chemically synthesized
tttttcaaaagtattgagactt

SEQ ID NO: 753637 - DNA, 22 bp, Artificial Sequence
  chemically synthesized
agagaaaagtctcaatactttt

SEQ ID NO: 753638 - DNA, 22 bp, Artificial Sequence
  chemically synthesized
aatacttttgaaaaatagtcat

SEQ ID NO: 753639 - DNA, 22 bp, Artificial Sequence
  chemically synthesized
ttgaaaaatagtcattacatca

SEQ ID NO: 753640 - DNA, 22 bp, Artificial Sequence
  chemically synthesized
tgaaaaatagtcattacatcat

SEQ ID NO: 753641 - DNA, 22 bp, Artificial Sequence
  chemically synthesized
gaaaaatagtcattacatcatc

SEQ ID NO: 753642 - DNA, 22 bp, Artificial Sequence
  chemically synthesized
aaaaatagtcattacatcatcc

SEQ ID NO: 753643 - DNA, 22 bp, Artificial Sequence
  chemically synthesized
aaagaggtcacaatggatgatg

SEQ ID NO: 753644 - DNA, 22 bp, Artificial Sequence
  chemically synthesized
tcaaagaggtcacaatggatga

SEQ ID NO: 753645 - DNA, 22 bp, Artificial Sequence
  chemically synthesized
ttctcaaagaggtcacaatgga

SEQ ID NO: 753646 - DNA, 22 bp, Artificial Sequence
  chemically synthesized
ctattctcaaagaggtcacaat

SEQ ID NO: 753647 - DNA, 22 bp, Artificial Sequence
  chemically synthesized
tactattctcaaagaggtcaca

SEQ ID NO: 753648 - DNA, 22 bp, Artificial Sequence
  chemically synthesized
ctactattctcaaagaggtcac

SEQ ID NO: 753649 - DNA, 22 bp, Artificial Sequence
  chemically synthesized
catcatccattgtgacctcttt

SEQ ID NO: 753650 - DNA, 22 bp, Artificial Sequence
  chemically synthesized
aaaacatttctactattctcaa

SEQ ID NO: 753651 - DNA, 22 bp, Artificial Sequence
  chemically synthesized
tgacctctttgagaatagtaga

SEQ ID NO: 753652 - DNA, 22 bp, Artificial Sequence
  chemically synthesized
tttgagaatagtagaaatgttt

SEQ ID NO: 753653 - DNA, 22 bp, Artificial Sequence
  chemically synthesized
tgagaatagtagaaatgttttg

SEQ ID NO: 753654 - DNA, 22 bp, Artificial Sequence
  chemically synthesized
gagaatagtagaaatgttttga

SEQ ID NO: 753655 - DNA, 22 bp, Artificial Sequence
  chemically synthesized
agaatagtagaaatgttttgag

SEQ ID NO: 753656 - DNA, 22 bp, Artificial Sequence
  chemically synthesized
catccataatagctcaaaacat

SEQ ID NO: 753657 - DNA, 22 bp, Artificial Sequence
  chemically synthesized
ctacatccataatagctcaaaa

SEQ ID NO: 753658 - DNA, 22 bp, Artificial Sequence
  chemically synthesized
gtgtccgcaattcctacatcca

SEQ ID NO: 753659 - DNA, 22 bp, Artificial Sequence
  chemically synthesized
tgagctattatggatgtaggaa

SEQ ID NO: 753660 - DNA, 22 bp, Artificial Sequence
  chemically synthesized
gagctattatggatgtaggaat

SEQ ID NO: 753661 - DNA, 22 bp, Artificial Sequence
  chemically synthesized
agctattatggatgtaggaatt

SEQ ID NO: 753662 - DNA, 22 bp, Artificial Sequence
  chemically synthesized
ttatggatgtaggaattgcgga

SEQ ID NO: 753663 - DNA, 22 bp, Artificial Sequence
  chemically synthesized
tagaaactagtgtccgcaattc

SEQ ID NO: 753664 - DNA, 22 bp, Artificial Sequence
  chemically synthesized
atagaaactagtgtccgcaatt

SEQ ID NO: 753665 - DNA, 22 bp, Artificial Sequence
  chemically synthesized
tggatgtaggaattgcggacac

SEQ ID NO: 753666 - DNA, 22 bp, Artificial Sequence
  chemically synthesized
atttatagaaactagtgtccgc

SEQ ID NO: 753667 - DNA, 22 bp, Artificial Sequence
  chemically synthesized
ttcatttatagaaactagtgtc

SEQ ID NO: 753668 - DNA, 22 bp, Artificial Sequence
  chemically synthesized
gatctgttcatttatagaaact

SEQ ID NO: 753669 - DNA, 22 bp, Artificial Sequence
  chemically synthesized
tagatctgttcatttatagaaa

SEQ ID NO: 753670 - DNA, 22 bp, Artificial Sequence
  chemically synthesized
cggacactagtttctataaatg

SEQ ID NO: 753671 - DNA, 22 bp, Artificial Sequence
  chemically synthesized
attctagatctgttcatttata

SEQ ID NO: 753672 - DNA, 22 bp, Artificial Sequence
  chemically synthesized
gtttctataaatgaacagatct

SEQ ID NO: 753673 - DNA, 22 bp, Artificial Sequence
  chemically synthesized
aagattaattctagatctgttc

SEQ ID NO: 753674 - DNA, 22 bp, Artificial Sequence
  chemically synthesized
ctataaatgaacagatctagaa

SEQ ID NO: 753675 - DNA, 22 bp, Artificial Sequence
  chemically synthesized
tataaatgaacagatctagaat

SEQ ID NO: 753676 - DNA, 22 bp, Artificial Sequence
  chemically synthesized
taaatgaacagatctagaatta

SEQ ID NO: 753677 - DNA, 22 bp, Artificial Sequence
  chemically synthesized
cagattaaagattaattctaga

SEQ ID NO: 753678 - DNA, 22 bp, Artificial Sequence
  chemically synthesized
gataaaggaagattacagatta

SEQ ID NO: 753679 - DNA, 22 bp, Artificial Sequence
  chemically synthesized
gaattaatctttaatctgtaat

SEQ ID NO: 753680 - DNA, 22 bp, Artificial Sequence
  chemically synthesized
atctttaatctgtaatcttcct

SEQ ID NO: 753681 - DNA, 22 bp, Artificial Sequence
  chemically synthesized
atcccctggataaaggaagatt

SEQ ID NO: 753682 - DNA, 22 bp, Artificial Sequence
  chemically synthesized
gatcccctggataaaggaagat

SEQ ID NO: 753683 - DNA, 22 bp, Artificial Sequence
  chemically synthesized
ttgatcccctggataaaggaag

SEQ ID NO: 753684 - DNA, 22 bp, Artificial Sequence
  chemically synthesized
taatctgtaatcttcctttatc

SEQ ID NO: 753685 - DNA, 22 bp, Artificial Sequence
  chemically synthesized
aatctgtaatcttcctttatcc

SEQ ID NO: 753686 - DNA, 22 bp, Artificial Sequence
  chemically synthesized
tcttgatcccctggataaagga

SEQ ID NO: 753687 - DNA, 22 bp, Artificial Sequence
  chemically synthesized
atctgtaatcttcctttatcca

SEQ ID NO: 753688 - DNA, 22 bp, Artificial Sequence
  chemically synthesized
ctcttgatcccctggataaagg

SEQ ID NO: 753689 - DNA, 22 bp, Artificial Sequence
  chemically synthesized
tctcttgatcccctggataaag

SEQ ID NO: 753690 - DNA, 22 bp, Artificial Sequence
  chemically synthesized
ttctcttgatcccctggataaa

SEQ ID NO: 753691 - DNA, 22 bp, Artificial Sequence
  chemically synthesized
taatcttcctttatccagggga

SEQ ID NO: 753692 - DNA, 22 bp, Artificial Sequence
  chemically synthesized
tttttctcttgatcccctggat

SEQ ID NO: 753693 - DNA, 22 bp, Artificial Sequence
  chemically synthesized
gtttttctcttgatcccctgga

SEQ ID NO: 753694 - DNA, 22 bp, Artificial Sequence
  chemically synthesized
tgtttttctcttgatcccctgg

SEQ ID NO: 753695 - DNA, 22 bp, Artificial Sequence
  chemically synthesized
attttgtttttctcttgatccc

SEQ ID NO: 753696 - DNA, 22 bp, Artificial Sequence
  chemically synthesized
cctttatccaggggatcaagag

SEQ ID NO: 753697 - DNA, 22 bp, Artificial Sequence
  chemically synthesized
ctttatccaggggatcaagaga

SEQ ID NO: 753698 - DNA, 22 bp, Artificial Sequence
  chemically synthesized
ttcattttgtttttctcttgat

SEQ ID NO: 753699 - DNA, 22 bp, Artificial Sequence
  chemically synthesized
tatccaggggatcaagagaaaa

SEQ ID NO: 753700 - DNA, 22 bp, Artificial Sequence
  chemically synthesized
atccaggggatcaagagaaaaa

SEQ ID NO: 753701 - DNA, 22 bp, Artificial Sequence
  chemically synthesized
tccaggggatcaagagaaaaac

SEQ ID NO: 753702 - DNA, 22 bp, Artificial Sequence
  chemically synthesized
aaggcagaaactattcattttg

SEQ ID NO: 753703 - DNA, 22 bp, Artificial Sequence
  chemically synthesized
gaaggcagaaactattcatttt

SEQ ID NO: 753704 - DNA, 22 bp, Artificial Sequence
  chemically synthesized
tgaaggcagaaactattcattt

SEQ ID NO: 753705 - DNA, 22 bp, Artificial Sequence
  chemically synthesized
ttgaaggcagaaactattcatt

SEQ ID NO: 753706 - DNA, 22 bp, Artificial Sequence
  chemically synthesized
tttgaaggcagaaactattcat

SEQ ID NO: 753707 - DNA, 22 bp, Artificial Sequence
  chemically synthesized
gaaactttttgaaggcagaaac

SEQ ID NO: 753708 - DNA, 22 bp, Artificial Sequence
  chemically synthesized
gatctagaaactttttgaaggc

SEQ ID NO: 753709 - DNA, 22 bp, Artificial Sequence
  chemically synthesized
ggatctagaaactttttgaagg

SEQ ID NO: 753710 - DNA, 22 bp, Artificial Sequence
  chemically synthesized
tggatctagaaactttttgaag

SEQ ID NO: 753711 - DNA, 22 bp, Artificial Sequence
  chemically synthesized
tttggatctagaaactttttga

SEQ ID NO: 753712 - DNA, 22 bp, Artificial Sequence
  chemically synthesized
ctttggatctagaaactttttg

SEQ ID NO: 753713 - DNA, 22 bp, Artificial Sequence
  chemically synthesized
ccttctttggatctagaaactt

SEQ ID NO: 753714 - DNA, 22 bp, Artificial Sequence
  chemically synthesized
ctgccttcaaaaagtttctaga

SEQ ID NO: 753715 - DNA, 22 bp, Artificial Sequence
  chemically synthesized
tgccttcaaaaagtttctagat

SEQ ID NO: 753716 - DNA, 22 bp, Artificial Sequence
  chemically synthesized
tcccttctttggatctagaaac

SEQ ID NO: 753717 - DNA, 22 bp, Artificial Sequence
  chemically synthesized
ctcccttctttggatctagaaa

SEQ ID NO: 753718 - DNA, 22 bp, Artificial Sequence
  chemically synthesized
ccttcaaaaagtttctagatcc

SEQ ID NO: 753719 - DNA, 22 bp, Artificial Sequence
  chemically synthesized
tctcccttctttggatctagaa

SEQ ID NO: 753720 - DNA, 22 bp, Artificial Sequence
  chemically synthesized
caaaaagtttctagatccaaag

SEQ ID NO: 753721 - DNA, 22 bp, Artificial Sequence
  chemically synthesized
attttctcccttctttggatct

SEQ ID NO: 753722 - DNA, 22 bp, Artificial Sequence
  chemically synthesized
aaaaagtttctagatccaaaga

SEQ ID NO: 753723 - DNA, 22 bp, Artificial Sequence
  chemically synthesized
gtgttaattttctcccttcttt

SEQ ID NO: 753724 - DNA, 22 bp, Artificial Sequence
  chemically synthesized
tagtgttaattttctcccttct

SEQ ID NO: 753725 - DNA, 22 bp, Artificial Sequence
  chemically synthesized
ctagtgttaattttctcccttc

SEQ ID NO: 753726 - DNA, 22 bp, Artificial Sequence
  chemically synthesized
ctagatccaaagaagggagaaa

SEQ ID NO: 753727 - DNA, 22 bp, Artificial Sequence
  chemically synthesized
tagatccaaagaagggagaaaa

SEQ ID NO: 753728 - DNA, 22 bp, Artificial Sequence
  chemically synthesized
cttctagtgttaattttctccc

SEQ ID NO: 753729 - DNA, 22 bp, Artificial Sequence
  chemically synthesized
gatccaaagaagggagaaaatt

SEQ ID NO: 753730 - DNA, 22 bp, Artificial Sequence
  chemically synthesized
tgcttctagtgttaattttctc

SEQ ID NO: 753731 - DNA, 22 bp, Artificial Sequence
  chemically synthesized
actctgcttctagtgttaattt

SEQ ID NO: 753732 - DNA, 22 bp, Artificial Sequence
  chemically synthesized
cactctgcttctagtgttaatt

SEQ ID NO: 753733 - DNA, 22 bp, Artificial Sequence
  chemically synthesized
tcactctgcttctagtgttaat

SEQ ID NO: 753734 - DNA, 22 bp, Artificial Sequence
  chemically synthesized
ttttcactctgcttctagtgtt

SEQ ID NO: 753735 - DNA, 22 bp, Artificial Sequence
  chemically synthesized
ctgttttcactctgcttctagt

SEQ ID NO: 753736 - DNA, 22 bp, Artificial Sequence
  chemically synthesized
actgttttcactctgcttctag

SEQ ID NO: 753737 - DNA, 22 bp, Artificial Sequence
  chemically synthesized
acactagaagcagagtgaaaac

SEQ ID NO: 753738 - DNA, 22 bp, Artificial Sequence
  chemically synthesized
tgtgtgaacttactgttttcac

SEQ ID NO: 753739 - DNA, 22 bp, Artificial Sequence
  chemically synthesized
gaagcagagtgaaaacagtaag

SEQ ID NO: 753740 - DNA, 22 bp, Artificial Sequence
  chemically synthesized
gattatgtgtgaacttactgtt

SEQ ID NO: 753741 - DNA, 22 bp, Artificial Sequence
  chemically synthesized
gcactcgattatgtgtgaactt

SEQ ID NO: 753742 - DNA, 22 bp, Artificial Sequence
  chemically synthesized
agcactcgattatgtgtgaact

SEQ ID NO: 753743 - DNA, 22 bp, Artificial Sequence
  chemically synthesized
tagcactcgattatgtgtgaac

SEQ ID NO: 753744 - DNA, 22 bp, Artificial Sequence
  chemically synthesized
ttagcactcgattatgtgtgaa

SEQ ID NO: 753745 - DNA, 22 bp, Artificial Sequence
  chemically synthesized
acgatccttttagcactcgatt

SEQ ID NO: 753746 - DNA, 22 bp, Artificial Sequence
  chemically synthesized
acacataatcgagtgctaaaag

SEQ ID NO: 753747 - DNA, 22 bp, Artificial Sequence
  chemically synthesized
acggtatacctcacgatccttt

SEQ ID NO: 753748 - DNA, 22 bp, Artificial Sequence
  chemically synthesized
ggctcacggtatacctcacgat

SEQ ID NO: 753749 - DNA, 22 bp, Artificial Sequence
  chemically synthesized
taggctcacggtatacctcacg

SEQ ID NO: 753750 - DNA, 22 bp, Artificial Sequence
  chemically synthesized
ttctaggctcacggtatacctc

SEQ ID NO: 753751 - DNA, 22 bp, Artificial Sequence
  chemically synthesized
aaaggatcgtgaggtataccgt

SEQ ID NO: 753752 - DNA, 22 bp, Artificial Sequence
  chemically synthesized
ggttattctaggctcacggtat

SEQ ID NO: 753753 - DNA, 22 bp, Artificial Sequence
  chemically synthesized
aatggtgtcagagtatccgtta

SEQ ID NO: 753754 - DNA, 22 bp, Artificial Sequence
  chemically synthesized
caatggtgtcagagtatccgtt

SEQ ID NO: 753755 - DNA, 22 bp, Artificial Sequence
  chemically synthesized
ttcaatggtgtcagagtatccg

SEQ ID NO: 753756 - DNA, 22 bp, Artificial Sequence
  chemically synthesized
gaataacctaacggatactctg

SEQ ID NO: 753757 - DNA, 22 bp, Artificial Sequence
  chemically synthesized
tcttcaatggtgtcagagtatc

SEQ ID NO: 753758 - DNA, 22 bp, Artificial Sequence
  chemically synthesized
acggatactctgacaccattga

SEQ ID NO: 753759 - DNA, 22 bp, Artificial Sequence
  chemically synthesized
ggtcaataactctcttcaatgg

SEQ ID NO: 753760 - DNA, 22 bp, Artificial Sequence
  chemically synthesized
tgacaccattgaagagagttat

SEQ ID NO: 753761 - DNA, 22 bp, Artificial Sequence
  chemically synthesized
acaccattgaagagagttattg

SEQ ID NO: 753762 - DNA, 22 bp, Artificial Sequence
  chemically synthesized
agatcaaagaatctgggtcaat

SEQ ID NO: 753763 - DNA, 22 bp, Artificial Sequence
  chemically synthesized
tgagatcaaagaatctgggtca

SEQ ID NO: 753764 - DNA, 22 bp, Artificial Sequence
  chemically synthesized
aagagagttattgacccagatt

SEQ ID NO: 753765 - DNA, 22 bp, Artificial Sequence
  chemically synthesized
ctgagatcaaagaatctgggtc

SEQ ID NO: 753766 - DNA, 22 bp, Artificial Sequence
  chemically synthesized
acttctgagatcaaagaatctg

SEQ ID NO: 753767 - DNA, 22 bp, Artificial Sequence
  chemically synthesized
ttgacccagattctttgatctc

SEQ ID NO: 753768 - DNA, 22 bp, Artificial Sequence
  chemically synthesized
ataccctcacttctgagatcaa

SEQ ID NO: 753769 - DNA, 22 bp, Artificial Sequence
  chemically synthesized
acccagattctttgatctcaga

SEQ ID NO: 753770 - DNA, 22 bp, Artificial Sequence
  chemically synthesized
ttaataccctcacttctgagat

SEQ ID NO: 753771 - DNA, 22 bp, Artificial Sequence
  chemically synthesized
attaataccctcacttctgaga

SEQ ID NO: 753772 - DNA, 22 bp, Artificial Sequence
  chemically synthesized
tattaataccctcacttctgag

SEQ ID NO: 753773 - DNA, 22 bp, Artificial Sequence
  chemically synthesized
ttattaataccctcacttctga

SEQ ID NO: 753774 - DNA, 22 bp, Artificial Sequence
  chemically synthesized
tttgatctcagaagtgagggta

SEQ ID NO: 753775 - DNA, 22 bp, Artificial Sequence
  chemically synthesized
atacttttattaataccctcac

SEQ ID NO: 753776 - DNA, 22 bp, Artificial Sequence
  chemically synthesized
tgatctcagaagtgagggtatt

SEQ ID NO: 753777 - DNA, 22 bp, Artificial Sequence
  chemically synthesized
aatacttttattaataccctca

SEQ ID NO: 753778 - DNA, 22 bp, Artificial Sequence
  chemically synthesized
gatctcagaagtgagggtatta

SEQ ID NO: 753779 - DNA, 22 bp, Artificial Sequence
  chemically synthesized
atctcagaagtgagggtattaa

SEQ ID NO: 753780 - DNA, 22 bp, Artificial Sequence
  chemically synthesized
agaagtgagggtattaataaaa

SEQ ID NO: 753781 - DNA, 22 bp, Artificial Sequence
  chemically synthesized
tgtagcatgcacttaatacttt

SEQ ID NO: 753782 - DNA, 22 bp, Artificial Sequence
  chemically synthesized
atgtagcatgcacttaatactt

SEQ ID NO: 753783 - DNA, 22 bp, Artificial Sequence
  chemically synthesized
gcatttatgtagcatgcactta

SEQ ID NO: 753784 - DNA, 22 bp, Artificial Sequence
  chemically synthesized
ataaaagtattaagtgcatgct

SEQ ID NO: 753785 - DNA, 22 bp, Artificial Sequence
  chemically synthesized
tattagcatttatgtagcatgc

SEQ ID NO: 753786 - DNA, 22 bp, Artificial Sequence
  chemically synthesized
aacagttatattagcatttatg

SEQ ID NO: 753787 - DNA, 22 bp, Artificial Sequence
  chemically synthesized
agtgcatgctacataaatgcta

SEQ ID NO: 753788 - DNA, 22 bp, Artificial Sequence
  chemically synthesized
ttaaacagttatattagcattt

SEQ ID NO: 753789 - DNA, 22 bp, Artificial Sequence
  chemically synthesized
ttgttaaacagttatattagca

SEQ ID NO: 753790 - DNA, 22 bp, Artificial Sequence
  chemically synthesized
ttattgttaaacagttatatta

SEQ ID NO: 753791 - DNA, 22 bp, Artificial Sequence
  chemically synthesized
cataaatgctaatataactgtt

SEQ ID NO: 753792 - DNA, 22 bp, Artificial Sequence
  chemically synthesized
ctgttattgttaaacagttata

SEQ ID NO: 753793 - DNA, 22 bp, Artificial Sequence
  chemically synthesized
atataactgtttaacaataaca

SEQ ID NO: 753794 - DNA, 22 bp, Artificial Sequence
  chemically synthesized
gatcagggcaaatattactgtt

SEQ ID NO: 753795 - DNA, 22 bp, Artificial Sequence
  chemically synthesized
tttaacaataacagtaatattt

SEQ ID NO: 753796 - DNA, 22 bp, Artificial Sequence
  chemically synthesized
aacaataacagtaatatttgcc

SEQ ID NO: 753797 - DNA, 22 bp, Artificial Sequence
  chemically synthesized
acaataacagtaatatttgccc

SEQ ID NO: 753798 - DNA, 22 bp, Artificial Sequence
  chemically synthesized
agccctagatcagggcaaatat

SEQ ID NO: 753799 - DNA, 22 bp, Artificial Sequence
  chemically synthesized
caaaaattaagccctagatcag

SEQ ID NO: 753800 - DNA, 22 bp, Artificial Sequence
  chemically synthesized
gccctgatctagggcttaattt

SEQ ID NO: 753801 - DNA, 22 bp, Artificial Sequence
  chemically synthesized
ccctgatctagggcttaatttt

SEQ ID NO: 753802 - DNA, 22 bp, Artificial Sequence
  chemically synthesized
aaaaaagttacaaaaattaagc

SEQ ID NO: 753803 - DNA, 22 bp, Artificial Sequence
  chemically synthesized
atctagggcttaatttttgtaa

SEQ ID NO: 753804 - DNA, 22 bp, Artificial Sequence
  chemically synthesized
gggcttaatttttgtaactttt

SEQ ID NO: 753805 - DNA, 22 bp, Artificial Sequence
  chemically synthesized
aaagacagagttgaaaaaagtt

SEQ ID NO: 753806 - DNA, 22 bp, Artificial Sequence
  chemically synthesized
aatttttgtaacttttttcaac

SEQ ID NO: 753807 - DNA, 22 bp, Artificial Sequence
  chemically synthesized
ctaaaagacagagttgaaaaaa

SEQ ID NO: 753808 - DNA, 22 bp, Artificial Sequence
  chemically synthesized
atttttgtaacttttttcaact

SEQ ID NO: 753809 - DNA, 22 bp, Artificial Sequence
  chemically synthesized
ttgtaacttttttcaactctgt

SEQ ID NO: 753810 - DNA, 22 bp, Artificial Sequence
  chemically synthesized
tgtaacttttttcaactctgtc

SEQ ID NO: 753811 - DNA, 22 bp, Artificial Sequence
  chemically synthesized
gtaacttttttcaactctgtct

SEQ ID NO: 753812 - DNA, 22 bp, Artificial Sequence
  chemically synthesized
taacttttttcaactctgtctt

SEQ ID NO: 753813 - DNA, 22 bp, Artificial Sequence
  chemically synthesized
ttttcaactctgtcttttagca

SEQ ID NO: 753814 - DNA, 22 bp, Artificial Sequence
  chemically synthesized
agcaggcaacattgctaaaaga

SEQ ID NO: 753815 - DNA, 22 bp, Artificial Sequence
  chemically synthesized
tttcaactctgtcttttagcaa

SEQ ID NO: 753816 - DNA, 22 bp, Artificial Sequence
  chemically synthesized
ttcaactctgtcttttagcaat

SEQ ID NO: 753817 - DNA, 22 bp, Artificial Sequence
  chemically synthesized
tcaactctgtcttttagcaatg

SEQ ID NO: 753818 - DNA, 22 bp, Artificial Sequence
  chemically synthesized
caactctgtcttttagcaatgt

SEQ ID NO: 753819 - DNA, 22 bp, Artificial Sequence
  chemically synthesized
aactctgtcttttagcaatgtt

SEQ ID NO: 753820 - DNA, 22 bp, Artificial Sequence
  chemically synthesized
aattcagcaggcaacattgcta

SEQ ID NO: 753821 - DNA, 22 bp, Artificial Sequence
  chemically synthesized
aaattcagcaggcaacattgct

SEQ ID NO: 753822 - DNA, 22 bp, Artificial Sequence
  chemically synthesized
tgtcttttagcaatgttgcctg

SEQ ID NO: 753823 - DNA, 22 bp, Artificial Sequence
  chemically synthesized
tcttttagcaatgttgcctgct

SEQ ID NO: 753824 - DNA, 22 bp, Artificial Sequence
  chemically synthesized
ttagcaatgttgcctgctgaat

SEQ ID NO: 753825 - DNA, 22 bp, Artificial Sequence
  chemically synthesized
tagcaatgttgcctgctgaatt

SEQ ID NO: 753826 - DNA, 22 bp, Artificial Sequence
  chemically synthesized
agcaatgttgcctgctgaattt

SEQ ID NO: 753827 - DNA, 22 bp, Artificial Sequence
  chemically synthesized
gcaatgttgcctgctgaattta

SEQ ID NO: 753828 - DNA, 22 bp, Artificial Sequence
  chemically synthesized
cccagtgaaagaacagggctta

SEQ ID NO: 753829 - DNA, 22 bp, Artificial Sequence
  chemically synthesized
cctgctgaatttaagccctgtt

SEQ ID NO: 753830 - DNA, 22 bp, Artificial Sequence
  chemically synthesized
ccccagtgaaagaacagggctt

SEQ ID NO: 753831 - DNA, 22 bp, Artificial Sequence
  chemically synthesized
tccccagtgaaagaacagggct

SEQ ID NO: 753832 - DNA, 22 bp, Artificial Sequence
  chemically synthesized
ttccccagtgaaagaacagggc

SEQ ID NO: 753833 - DNA, 22 bp, Artificial Sequence
  chemically synthesized
ctgaatttaagccctgttcttt

SEQ ID NO: 753834 - DNA, 22 bp, Artificial Sequence
  chemically synthesized
tttttccccagtgaaagaacag

SEQ ID NO: 753835 - DNA, 22 bp, Artificial Sequence
  chemically synthesized
gtttttccccagtgaaagaaca

SEQ ID NO: 753836 - DNA, 22 bp, Artificial Sequence
  chemically synthesized
aatttaagccctgttctttcac

SEQ ID NO: 753837 - DNA, 22 bp, Artificial Sequence
  chemically synthesized
atttgtttttccccagtgaaag

SEQ ID NO: 753838 - DNA, 22 bp, Artificial Sequence
  chemically synthesized
aagccctgttctttcactgggg

SEQ ID NO: 753839 - DNA, 22 bp, Artificial Sequence
  chemically synthesized
agccctgttctttcactgggga

SEQ ID NO: 753840 - DNA, 22 bp, Artificial Sequence
  chemically synthesized
ctaatttgtttttccccagtga

SEQ ID NO: 753841 - DNA, 22 bp, Artificial Sequence
  chemically synthesized
ttctttcactggggaaaaacaa

SEQ ID NO: 753842 - DNA, 22 bp, Artificial Sequence
  chemically synthesized
tttcactggggaaaaacaaatt

SEQ ID NO: 753843 - DNA, 22 bp, Artificial Sequence
  chemically synthesized
tcactggggaaaaacaaattag

SEQ ID NO: 753844 - DNA, 22 bp, Artificial Sequence
  chemically synthesized
cactggggaaaaacaaattagc

SEQ ID NO: 753845 - DNA, 22 bp, Artificial Sequence
  chemically synthesized
actggggaaaaacaaattagca

SEQ ID NO: 753846 - DNA, 22 bp, Artificial Sequence
  chemically synthesized
aaggaagaatactgctaatttg

SEQ ID NO: 753847 - DNA, 22 bp, Artificial Sequence
  chemically synthesized
gggaaaaacaaattagcagtat

SEQ ID NO: 753848 - DNA, 22 bp, Artificial Sequence
  chemically synthesized
aaattcaaggaagaatactgct

SEQ ID NO: 753849 - DNA, 22 bp, Artificial Sequence
  chemically synthesized
gcagtattcttccttgaatttc

SEQ ID NO: 753850 - DNA, 22 bp, Artificial Sequence
  chemically synthesized
taacataatggcatatctgaaa

SEQ ID NO: 753851 - DNA, 22 bp, Artificial Sequence
  chemically synthesized
tgtaacataatggcatatctga

SEQ ID NO: 753852 - DNA, 22 bp, Artificial Sequence
  chemically synthesized
ttccttgaatttcagatatgcc

SEQ ID NO: 753853 - DNA, 22 bp, Artificial Sequence
  chemically synthesized
ctgtaacataatggcatatctg

SEQ ID NO: 753854 - DNA, 22 bp, Artificial Sequence
  chemically synthesized
ccttgaatttcagatatgccat

SEQ ID NO: 753855 - DNA, 22 bp, Artificial Sequence
  chemically synthesized
cttgaatttcagatatgccatt

SEQ ID NO: 753856 - DNA, 22 bp, Artificial Sequence
  chemically synthesized
gaatttcagatatgccattatg

SEQ ID NO: 753857 - DNA, 22 bp, Artificial Sequence
  chemically synthesized
aatttcagatatgccattatgt

SEQ ID NO: 753858 - DNA, 22 bp, Artificial Sequence
  chemically synthesized
gaacacttctgtaacataatgg

SEQ ID NO: 753859 - DNA, 22 bp, Artificial Sequence
  chemically synthesized
tggaacacttctgtaacataat

SEQ ID NO: 753860 - DNA, 22 bp, Artificial Sequence
  chemically synthesized
cagatatgccattatgttacag

SEQ ID NO: 753861 - DNA, 22 bp, Artificial Sequence
  chemically synthesized
agatatgccattatgttacaga

SEQ ID NO: 753862 - DNA, 22 bp, Artificial Sequence
  chemically synthesized
tgttacagaagtgttccagagc

SEQ ID NO: 753863 - DNA, 22 bp, Artificial Sequence
  chemically synthesized
cagaagtgttccagagctgtat

SEQ ID NO: 753864 - DNA, 22 bp, Artificial Sequence
  chemically synthesized
ataaatgtgtcatacaatacag

SEQ ID NO: 753865 - DNA, 22 bp, Artificial Sequence
  chemically synthesized
ttaataaatgtgtcatacaata

SEQ ID NO: 753866 - DNA, 22 bp, Artificial Sequence
  chemically synthesized
attaataaatgtgtcatacaat

SEQ ID NO: 753867 - DNA, 22 bp, Artificial Sequence
  chemically synthesized
tattaataaatgtgtcatacaa

SEQ ID NO: 753868 - DNA, 22 bp, Artificial Sequence
  chemically synthesized
cagagctgtattgtatgacaca
